United States Patent 11,369,692 (MATERIALS AND METHODS FOR TREATMENT OF DUCHENNE MUSCULAR DYSTROPHY) - sequence listing, part 10

SEQ ID NO: 307147 - DNA, 20 bp, Artificial Sequence
  chemically synthesized
ttcaaatatggctctcagct

SEQ ID NO: 307148 - DNA, 20 bp, Artificial Sequence
  chemically synthesized
tgaaattcaaatatggctct

SEQ ID NO: 307149 - DNA, 20 bp, Artificial Sequence
  chemically synthesized
tatacattgaaattcaaata

SEQ ID NO: 307150 - DNA, 20 bp, Artificial Sequence
  chemically synthesized
aatttcaatgtatattcctc

SEQ ID NO: 307151 - DNA, 20 bp, Artificial Sequence
  chemically synthesized
aatgtatattcctccagtta

SEQ ID NO: 307152 - DNA, 20 bp, Artificial Sequence
  chemically synthesized
aaaaatgacactataactgg

SEQ ID NO: 307153 - DNA, 20 bp, Artificial Sequence
  chemically synthesized
aaaaaatgacactataactg

SEQ ID NO: 307154 - DNA, 20 bp, Artificial Sequence
  chemically synthesized
aaaaaaaatgacactataac

SEQ ID NO: 307155 - DNA, 20 bp, Artificial Sequence
  chemically synthesized
gtcattttttttctttacta

SEQ ID NO: 307156 - DNA, 20 bp, Artificial Sequence
  chemically synthesized
ttgtgcctctttccatagta

SEQ ID NO: 307157 - DNA, 20 bp, Artificial Sequence
  chemically synthesized
ttttttttctttactatgga

SEQ ID NO: 307158 - DNA, 20 bp, Artificial Sequence
  chemically synthesized
ttttttctttactatggaaa

SEQ ID NO: 307159 - DNA, 20 bp, Artificial Sequence
  chemically synthesized
tttttctttactatggaaag

SEQ ID NO: 307160 - DNA, 20 bp, Artificial Sequence
  chemically synthesized
gtatattgtgcctctttcca

SEQ ID NO: 307161 - DNA, 20 bp, Artificial Sequence
  chemically synthesized
aaagaggcacaatatacaca

SEQ ID NO: 307162 - DNA, 20 bp, Artificial Sequence
  chemically synthesized
ttagattttttttttatttt

SEQ ID NO: 307163 - DNA, 20 bp, Artificial Sequence
  chemically synthesized
taaaaataaaaaaaaaatct

SEQ ID NO: 307164 - DNA, 20 bp, Artificial Sequence
  chemically synthesized
aagtcaaagaggattgtact

SEQ ID NO: 307165 - DNA, 20 bp, Artificial Sequence
  chemically synthesized
tctgagtaagtaagtcaaag

SEQ ID NO: 307166 - DNA, 20 bp, Artificial Sequence
  chemically synthesized
ttctgagtaagtaagtcaaa

SEQ ID NO: 307167 - DNA, 20 bp, Artificial Sequence
  chemically synthesized
cattctgagtaagtaagtca

SEQ ID NO: 307168 - DNA, 20 bp, Artificial Sequence
  chemically synthesized
tcctctttgacttacttact

SEQ ID NO: 307169 - DNA, 20 bp, Artificial Sequence
  chemically synthesized
ttctaacattctgagtaagt

SEQ ID NO: 307170 - DNA, 20 bp, Artificial Sequence
  chemically synthesized
tagtttctaacattctgagt

SEQ ID NO: 307171 - DNA, 20 bp, Artificial Sequence
  chemically synthesized
gacttacttactcagaatgt

SEQ ID NO: 307172 - DNA, 20 bp, Artificial Sequence
  chemically synthesized
aaaatagtttctaacattct

SEQ ID NO: 307173 - DNA, 20 bp, Artificial Sequence
  chemically synthesized
atgttagaaactattttaaa

SEQ ID NO: 307174 - DNA, 20 bp, Artificial Sequence
  chemically synthesized
acacatatggctatttaaaa

SEQ ID NO: 307175 - DNA, 20 bp, Artificial Sequence
  chemically synthesized
ttttaaatagccatatgtgt

SEQ ID NO: 307176 - DNA, 20 bp, Artificial Sequence
  chemically synthesized
accattcagccttacacata

SEQ ID NO: 307177 - DNA, 20 bp, Artificial Sequence
  chemically synthesized
tttaaatagccatatgtgta

SEQ ID NO: 307178 - DNA, 20 bp, Artificial Sequence
  chemically synthesized
gccatatgtgtaaggctgaa

SEQ ID NO: 307179 - DNA, 20 bp, Artificial Sequence
  chemically synthesized
taaataatgggtagaccatt

SEQ ID NO: 307180 - DNA, 20 bp, Artificial Sequence
  chemically synthesized
tattttgtttaaataatggg

SEQ ID NO: 307181 - DNA, 20 bp, Artificial Sequence
  chemically synthesized
acatattttgtttaaataat

SEQ ID NO: 307182 - DNA, 20 bp, Artificial Sequence
  chemically synthesized
tacatattttgtttaaataa

SEQ ID NO: 307183 - DNA, 20 bp, Artificial Sequence
  chemically synthesized
aaacaaaatatgtaatgatt

SEQ ID NO: 307184 - DNA, 20 bp, Artificial Sequence
  chemically synthesized
gtaatgatttggaaacatgt

SEQ ID NO: 307185 - DNA, 20 bp, Artificial Sequence
  chemically synthesized
atgatttggaaacatgtcag

SEQ ID NO: 307186 - DNA, 20 bp, Artificial Sequence
  chemically synthesized
gatttggaaacatgtcagaa

SEQ ID NO: 307187 - DNA, 20 bp, Artificial Sequence
  chemically synthesized
atttggaaacatgtcagaag

SEQ ID NO: 307188 - DNA, 20 bp, Artificial Sequence
  chemically synthesized
ttggaaacatgtcagaagag

SEQ ID NO: 307189 - DNA, 20 bp, Artificial Sequence
  chemically synthesized
acatgtcagaagaggagtgt

SEQ ID NO: 307190 - DNA, 20 bp, Artificial Sequence
  chemically synthesized
gagtgtgagaattatgttta

SEQ ID NO: 307191 - DNA, 20 bp, Artificial Sequence
  chemically synthesized
tgtgagaattatgtttaaag

SEQ ID NO: 307192 - DNA, 20 bp, Artificial Sequence
  chemically synthesized
tgagaattatgtttaaagaa

SEQ ID NO: 307193 - DNA, 20 bp, Artificial Sequence
  chemically synthesized
gagaattatgtttaaagaag

SEQ ID NO: 307194 - DNA, 20 bp, Artificial Sequence
  chemically synthesized
ggattgcaataaaaacctat

SEQ ID NO: 307195 - DNA, 20 bp, Artificial Sequence
  chemically synthesized
ggtaccatgaggttactcat

SEQ ID NO: 307196 - DNA, 20 bp, Artificial Sequence
  chemically synthesized
aggtaccatgaggttactca

SEQ ID NO: 307197 - DNA, 20 bp, Artificial Sequence
  chemically synthesized
aaaacctatgagtaacctca

SEQ ID NO: 307198 - DNA, 20 bp, Artificial Sequence
  chemically synthesized
tcatttgtttaggtaccatg

SEQ ID NO: 307199 - DNA, 20 bp, Artificial Sequence
  chemically synthesized
ttcatttgtttaggtaccat

SEQ ID NO: 307200 - DNA, 20 bp, Artificial Sequence
  chemically synthesized
aggcttattttcatttgttt

SEQ ID NO: 307201 - DNA, 20 bp, Artificial Sequence
  chemically synthesized
gaggcttattttcatttgtt

SEQ ID NO: 307202 - DNA, 20 bp, Artificial Sequence
  chemically synthesized
gtacctaaacaaatgaaaat

SEQ ID NO: 307203 - DNA, 20 bp, Artificial Sequence
  chemically synthesized
tggcttaataataaaacagg

SEQ ID NO: 307204 - DNA, 20 bp, Artificial Sequence
  chemically synthesized
gtggcttaataataaaacag

SEQ ID NO: 307205 - DNA, 20 bp, Artificial Sequence
  chemically synthesized
atgtggcttaataataaaac

SEQ ID NO: 307206 - DNA, 20 bp, Artificial Sequence
  chemically synthesized
catgtggcttaataataaaa

SEQ ID NO: 307207 - DNA, 20 bp, Artificial Sequence
  chemically synthesized
aagcctcctgttttattatt

SEQ ID NO: 307208 - DNA, 20 bp, Artificial Sequence
  chemically synthesized
ttttattattaagccacatg

SEQ ID NO: 307209 - DNA, 20 bp, Artificial Sequence
  chemically synthesized
ttaccaaatgtttcttcatg

SEQ ID NO: 307210 - DNA, 20 bp, Artificial Sequence
  chemically synthesized
aagccacatgaagaaacatt

SEQ ID NO: 307211 - DNA, 20 bp, Artificial Sequence
  chemically synthesized
cacatgaagaaacatttggt

SEQ ID NO: 307212 - DNA, 20 bp, Artificial Sequence
  chemically synthesized
ggtaagcattacaaaaatga

SEQ ID NO: 307213 - DNA, 20 bp, Artificial Sequence
  chemically synthesized
cattacaaaaatgaaagtga

SEQ ID NO: 307214 - DNA, 20 bp, Artificial Sequence
  chemically synthesized
acctctaattttatttttaa

SEQ ID NO: 307215 - DNA, 20 bp, Artificial Sequence
  chemically synthesized
gtcaccattaaaaataaaat

SEQ ID NO: 307216 - DNA, 20 bp, Artificial Sequence
  chemically synthesized
caccattaaaaataaaatta

SEQ ID NO: 307217 - DNA, 20 bp, Artificial Sequence
  chemically synthesized
accattaaaaataaaattag

SEQ ID NO: 307218 - DNA, 20 bp, Artificial Sequence
  chemically synthesized
attaaaaataaaattagagg

SEQ ID NO: 307219 - DNA, 20 bp, Artificial Sequence
  chemically synthesized
aaaaataaaattagaggtgg

SEQ ID NO: 307220 - DNA, 20 bp, Artificial Sequence
  chemically synthesized
agtgctgagattataggcgt

SEQ ID NO: 307221 - DNA, 20 bp, Artificial Sequence
  chemically synthesized
gtggctcacgcctataatct

SEQ ID NO: 307222 - DNA, 20 bp, Artificial Sequence
  chemically synthesized
tcccaaagtgctgagattat

SEQ ID NO: 307223 - DNA, 20 bp, Artificial Sequence
  chemically synthesized
ctcccaaagtgctgagatta

SEQ ID NO: 307224 - DNA, 20 bp, Artificial Sequence
  chemically synthesized
cgcctataatctcagcactt

SEQ ID NO: 307225 - DNA, 20 bp, Artificial Sequence
  chemically synthesized
cctcagcctcccaaagtgct

SEQ ID NO: 307226 - DNA, 20 bp, Artificial Sequence
  chemically synthesized
gcctataatctcagcacttt

SEQ ID NO: 307227 - DNA, 20 bp, Artificial Sequence
  chemically synthesized
ctataatctcagcactttgg

SEQ ID NO: 307228 - DNA, 20 bp, Artificial Sequence
  chemically synthesized
tataatctcagcactttggg

SEQ ID NO: 307229 - DNA, 20 bp, Artificial Sequence
  chemically synthesized
ccgcccgcctcagcctccca

SEQ ID NO: 307230 - DNA, 20 bp, Artificial Sequence
  chemically synthesized
tctcagcactttgggaggct

SEQ ID NO: 307231 - DNA, 20 bp, Artificial Sequence
  chemically synthesized
ctcagcactttgggaggctg

SEQ ID NO: 307232 - DNA, 20 bp, Artificial Sequence
  chemically synthesized
agcactttgggaggctgagg

SEQ ID NO: 307233 - DNA, 20 bp, Artificial Sequence
  chemically synthesized
gcactttgggaggctgaggc

SEQ ID NO: 307234 - DNA, 20 bp, Artificial Sequence
  chemically synthesized
ctttgggaggctgaggcggg

SEQ ID NO: 307235 - DNA, 20 bp, Artificial Sequence
  chemically synthesized
acctcgtgatccgcccgcct

SEQ ID NO: 307236 - DNA, 20 bp, Artificial Sequence
  chemically synthesized
ggctgaggcgggcggatcac

SEQ ID NO: 307237 - DNA, 20 bp, Artificial Sequence
  chemically synthesized
gctgaggcgggcggatcacg

SEQ ID NO: 307238 - DNA, 20 bp, Artificial Sequence
  chemically synthesized
aggcgggcggatcacgaggt

SEQ ID NO: 307239 - DNA, 20 bp, Artificial Sequence
  chemically synthesized
ggcgggcggatcacgaggtc

SEQ ID NO: 307240 - DNA, 20 bp, Artificial Sequence
  chemically synthesized
cgggcggatcacgaggtcag

SEQ ID NO: 307241 - DNA, 20 bp, Artificial Sequence
  chemically synthesized
gatcacgaggtcaggagttc

SEQ ID NO: 307242 - DNA, 20 bp, Artificial Sequence
  chemically synthesized
cgaggtcaggagttccagat

SEQ ID NO: 307243 - DNA, 20 bp, Artificial Sequence
  chemically synthesized
ctatgttggccaggctgatc

SEQ ID NO: 307244 - DNA, 20 bp, Artificial Sequence
  chemically synthesized
tcaggagttccagatcagcc

SEQ ID NO: 307245 - DNA, 20 bp, Artificial Sequence
  chemically synthesized
gaggtttcactatgttggcc

SEQ ID NO: 307246 - DNA, 20 bp, Artificial Sequence
  chemically synthesized
ccagatcagcctggccaaca

SEQ ID NO: 307247 - DNA, 20 bp, Artificial Sequence
  chemically synthesized
cgaggtttcactatgttggc

SEQ ID NO: 307248 - DNA, 20 bp, Artificial Sequence
  chemically synthesized
cagacgaggtttcactatgt

SEQ ID NO: 307249 - DNA, 20 bp, Artificial Sequence
  chemically synthesized
ttgtatttttagtacagacg

SEQ ID NO: 307250 - DNA, 20 bp, Artificial Sequence
  chemically synthesized
attgtatttttagtacagac

SEQ ID NO: 307251 - DNA, 20 bp, Artificial Sequence
  chemically synthesized
taattattgtatttttagta

SEQ ID NO: 307252 - DNA, 20 bp, Artificial Sequence
  chemically synthesized
ccagctaattattgtatttt

SEQ ID NO: 307253 - DNA, 20 bp, Artificial Sequence
  chemically synthesized
tgtactaaaaatacaataat

SEQ ID NO: 307254 - DNA, 20 bp, Artificial Sequence
  chemically synthesized
ctaaaaatacaataattagc

SEQ ID NO: 307255 - DNA, 20 bp, Artificial Sequence
  chemically synthesized
taaaaatacaataattagct

SEQ ID NO: 307256 - DNA, 20 bp, Artificial Sequence
  chemically synthesized
caataattagctgggaatgt

SEQ ID NO: 307257 - DNA, 20 bp, Artificial Sequence
  chemically synthesized
caggcatgcaccaacattcc

SEQ ID NO: 307258 - DNA, 20 bp, Artificial Sequence
  chemically synthesized
ggaatgttggtgcatgcctg

SEQ ID NO: 307259 - DNA, 20 bp, Artificial Sequence
  chemically synthesized
ttggtgcatgcctgtggtcc

SEQ ID NO: 307260 - DNA, 20 bp, Artificial Sequence
  chemically synthesized
tcctgagtcgctgggaccac

SEQ ID NO: 307261 - DNA, 20 bp, Artificial Sequence
  chemically synthesized
ttcctgagtcgctgggacca

SEQ ID NO: 307262 - DNA, 20 bp, Artificial Sequence
  chemically synthesized
tgcctgtggtcccagcgact

SEQ ID NO: 307263 - DNA, 20 bp, Artificial Sequence
  chemically synthesized
cctcagcttcctgagtcgct

SEQ ID NO: 307264 - DNA, 20 bp, Artificial Sequence
  chemically synthesized
gcctgtggtcccagcgactc

SEQ ID NO: 307265 - DNA, 20 bp, Artificial Sequence
  chemically synthesized
gcctcagcttcctgagtcgc

SEQ ID NO: 307266 - DNA, 20 bp, Artificial Sequence
  chemically synthesized
tgtggtcccagcgactcagg

SEQ ID NO: 307267 - DNA, 20 bp, Artificial Sequence
  chemically synthesized
attccttgcctcagcttcct

SEQ ID NO: 307268 - DNA, 20 bp, Artificial Sequence
  chemically synthesized
tcccagcgactcaggaagct

SEQ ID NO: 307269 - DNA, 20 bp, Artificial Sequence
  chemically synthesized
cccagcgactcaggaagctg

SEQ ID NO: 307270 - DNA, 20 bp, Artificial Sequence
  chemically synthesized
gcgactcaggaagctgaggc

SEQ ID NO: 307271 - DNA, 20 bp, Artificial Sequence
  chemically synthesized
cgactcaggaagctgaggca

SEQ ID NO: 307272 - DNA, 20 bp, Artificial Sequence
  chemically synthesized
gttccagcgattccttgcct

SEQ ID NO: 307273 - DNA, 20 bp, Artificial Sequence
  chemically synthesized
aagctgaggcaaggaatcgc

SEQ ID NO: 307274 - DNA, 20 bp, Artificial Sequence
  chemically synthesized
aggcaaggaatcgctggaac

SEQ ID NO: 307275 - DNA, 20 bp, Artificial Sequence
  chemically synthesized
ggcaaggaatcgctggaacc

SEQ ID NO: 307276 - DNA, 20 bp, Artificial Sequence
  chemically synthesized
gcaaggaatcgctggaacca

SEQ ID NO: 307277 - DNA, 20 bp, Artificial Sequence
  chemically synthesized
aacctctgcctccctggttc

SEQ ID NO: 307278 - DNA, 20 bp, Artificial Sequence
  chemically synthesized
aaggaatcgctggaaccagg

SEQ ID NO: 307279 - DNA, 20 bp, Artificial Sequence
  chemically synthesized
aggaatcgctggaaccaggg

SEQ ID NO: 307280 - DNA, 20 bp, Artificial Sequence
  chemically synthesized
aatcgctggaaccagggagg

SEQ ID NO: 307281 - DNA, 20 bp, Artificial Sequence
  chemically synthesized
cagggcaacctctgcctccc

SEQ ID NO: 307282 - DNA, 20 bp, Artificial Sequence
  chemically synthesized
tcgctggaaccagggaggca

SEQ ID NO: 307283 - DNA, 20 bp, Artificial Sequence
  chemically synthesized
cgctggaaccagggaggcag

SEQ ID NO: 307284 - DNA, 20 bp, Artificial Sequence
  chemically synthesized
agggaggcagaggttgccct

SEQ ID NO: 307285 - DNA, 20 bp, Artificial Sequence
  chemically synthesized
ggcagaggttgccctgagcc

SEQ ID NO: 307286 - DNA, 20 bp, Artificial Sequence
  chemically synthesized
agtggtgtgatctcggctca

SEQ ID NO: 307287 - DNA, 20 bp, Artificial Sequence
  chemically synthesized
cagtggtgtgatctcggctc

SEQ ID NO: 307288 - DNA, 20 bp, Artificial Sequence
  chemically synthesized
gcagtggtgtgatctcggct

SEQ ID NO: 307289 - DNA, 20 bp, Artificial Sequence
  chemically synthesized
ggagtgcagtggtgtgatct

SEQ ID NO: 307290 - DNA, 20 bp, Artificial Sequence
  chemically synthesized
ttgcccaggctggagtgcag

SEQ ID NO: 307291 - DNA, 20 bp, Artificial Sequence
  chemically synthesized
gagatcacaccactgcactc

SEQ ID NO: 307292 - DNA, 20 bp, Artificial Sequence
  chemically synthesized
ctgttgcccaggctggagtg

SEQ ID NO: 307293 - DNA, 20 bp, Artificial Sequence
  chemically synthesized
cacaccactgcactccagcc

SEQ ID NO: 307294 - DNA, 20 bp, Artificial Sequence
  chemically synthesized
acaccactgcactccagcct

SEQ ID NO: 307295 - DNA, 20 bp, Artificial Sequence
  chemically synthesized
ttgctctgttgcccaggctg

SEQ ID NO: 307296 - DNA, 20 bp, Artificial Sequence
  chemically synthesized
tcttgctctgttgcccaggc

SEQ ID NO: 307297 - DNA, 20 bp, Artificial Sequence
  chemically synthesized
ctgcactccagcctgggcaa

SEQ ID NO: 307298 - DNA, 20 bp, Artificial Sequence
  chemically synthesized
ggagtcttgctctgttgccc

SEQ ID NO: 307299 - DNA, 20 bp, Artificial Sequence
  chemically synthesized
gcactccagcctgggcaaca

SEQ ID NO: 307300 - DNA, 20 bp, Artificial Sequence
  chemically synthesized
tggagtcttgctctgttgcc

SEQ ID NO: 307301 - DNA, 20 bp, Artificial Sequence
  chemically synthesized
tccagcctgggcaacagagc

SEQ ID NO: 307302 - DNA, 20 bp, Artificial Sequence
  chemically synthesized
acagagcaagactccatctc

SEQ ID NO: 307303 - DNA, 20 bp, Artificial Sequence
  chemically synthesized
tttttttttttcttgagatg

SEQ ID NO: 307304 - DNA, 20 bp, Artificial Sequence
  chemically synthesized
tttttttttttttcttgaga

SEQ ID NO: 307305 - DNA, 20 bp, Artificial Sequence
  chemically synthesized
tggatttttttttttttctt

SEQ ID NO: 307306 - DNA, 20 bp, Artificial Sequence
  chemically synthesized
gaaaaaaaaaaaaatccaat

SEQ ID NO: 307307 - DNA, 20 bp, Artificial Sequence
  chemically synthesized
aaaaaaaaaaaaatccaatt

SEQ ID NO: 307308 - DNA, 20 bp, Artificial Sequence
  chemically synthesized
gagtgcacttttttcctaat

SEQ ID NO: 307309 - DNA, 20 bp, Artificial Sequence
  chemically synthesized
aaaaaatccaattaggaaaa

SEQ ID NO: 307310 - DNA, 20 bp, Artificial Sequence
  chemically synthesized
attaggaaaaaagtgcactc

SEQ ID NO: 307311 - DNA, 20 bp, Artificial Sequence
  chemically synthesized
ttaggaaaaaagtgcactca

SEQ ID NO: 307312 - DNA, 20 bp, Artificial Sequence
  chemically synthesized
aaaaaagtgcactcaaggta

SEQ ID NO: 307313 - DNA, 20 bp, Artificial Sequence
  chemically synthesized
cattgattttactttacctt

SEQ ID NO: 307314 - DNA, 20 bp, Artificial Sequence
  chemically synthesized
ggttcagtgtttttgtcata

SEQ ID NO: 307315 - DNA, 20 bp, Artificial Sequence
  chemically synthesized
tatgacaaaaacactgaacc

SEQ ID NO: 307316 - DNA, 20 bp, Artificial Sequence
  chemically synthesized
actaggtataagtctgggtt

SEQ ID NO: 307317 - DNA, 20 bp, Artificial Sequence
  chemically synthesized
aatttactaggtataagtct

SEQ ID NO: 307318 - DNA, 20 bp, Artificial Sequence
  chemically synthesized
aaatttactaggtataagtc

SEQ ID NO: 307319 - DNA, 20 bp, Artificial Sequence
  chemically synthesized
actgaacccagacttatacc

SEQ ID NO: 307320 - DNA, 20 bp, Artificial Sequence
  chemically synthesized
atctaaaatttactaggtat

SEQ ID NO: 307321 - DNA, 20 bp, Artificial Sequence
  chemically synthesized
actcatatctaaaatttact

SEQ ID NO: 307322 - DNA, 20 bp, Artificial Sequence
  chemically synthesized
tactcatatctaaaatttac

SEQ ID NO: 307323 - DNA, 20 bp, Artificial Sequence
  chemically synthesized
gacttatacctagtaaattt

SEQ ID NO: 307324 - DNA, 20 bp, Artificial Sequence
  chemically synthesized
acctagtaaattttagatat

SEQ ID NO: 307325 - DNA, 20 bp, Artificial Sequence
  chemically synthesized
atgagtatcaaaaatgatga

SEQ ID NO: 307326 - DNA, 20 bp, Artificial Sequence
  chemically synthesized
agtatcaaaaatgatgatgg

SEQ ID NO: 307327 - DNA, 20 bp, Artificial Sequence
  chemically synthesized
caaaaatgatgatggcagat

SEQ ID NO: 307328 - DNA, 20 bp, Artificial Sequence
  chemically synthesized
atgatggcagattagttgtt

SEQ ID NO: 307329 - DNA, 20 bp, Artificial Sequence
  chemically synthesized
gcagattagttgtttggtct

SEQ ID NO: 307330 - DNA, 20 bp, Artificial Sequence
  chemically synthesized
cagaaaaagagagagaaact

SEQ ID NO: 307331 - DNA, 20 bp, Artificial Sequence
  chemically synthesized
ctgaaagacagaaaaagaga

SEQ ID NO: 307332 - DNA, 20 bp, Artificial Sequence
  chemically synthesized
tactgaaagacagaaaaaga

SEQ ID NO: 307333 - DNA, 20 bp, Artificial Sequence
  chemically synthesized
actactgaaagacagaaaaa

SEQ ID NO: 307334 - DNA, 20 bp, Artificial Sequence
  chemically synthesized
tgactactgaaagacagaaa

SEQ ID NO: 307335 - DNA, 20 bp, Artificial Sequence
  chemically synthesized
ctctctctttttctgtcttt

SEQ ID NO: 307336 - DNA, 20 bp, Artificial Sequence
  chemically synthesized
gggagatgactactgaaaga

SEQ ID NO: 307337 - DNA, 20 bp, Artificial Sequence
  chemically synthesized
tctctttttctgtctttcag

SEQ ID NO: 307338 - DNA, 20 bp, Artificial Sequence
  chemically synthesized
aactgggagatgactactga

SEQ ID NO: 307339 - DNA, 20 bp, Artificial Sequence
  chemically synthesized
gtctttcagtagtcatctcc

SEQ ID NO: 307340 - DNA, 20 bp, Artificial Sequence
  chemically synthesized
cagtagtcatctcccagttc

SEQ ID NO: 307341 - DNA, 20 bp, Artificial Sequence
  chemically synthesized
tgggggagttctggaactgg

SEQ ID NO: 307342 - DNA, 20 bp, Artificial Sequence
  chemically synthesized
cctgggggagttctggaact

SEQ ID NO: 307343 - DNA, 20 bp, Artificial Sequence
  chemically synthesized
tcctgggggagttctggaac

SEQ ID NO: 307344 - DNA, 20 bp, Artificial Sequence
  chemically synthesized
taataatcctgggggagttc

SEQ ID NO: 307345 - DNA, 20 bp, Artificial Sequence
  chemically synthesized
tcccagttccagaactcccc

SEQ ID NO: 307346 - DNA, 20 bp, Artificial Sequence
  chemically synthesized
cccagttccagaactccccc

SEQ ID NO: 307347 - DNA, 20 bp, Artificial Sequence
  chemically synthesized
ctcagttaataatcctgggg

SEQ ID NO: 307348 - DNA, 20 bp, Artificial Sequence
  chemically synthesized
ccctcagttaataatcctgg

SEQ ID NO: 307349 - DNA, 20 bp, Artificial Sequence
  chemically synthesized
tccctcagttaataatcctg

SEQ ID NO: 307350 - DNA, 20 bp, Artificial Sequence
  chemically synthesized
ctccctcagttaataatcct

SEQ ID NO: 307351 - DNA, 20 bp, Artificial Sequence
  chemically synthesized
cctccctcagttaataatcc

SEQ ID NO: 307352 - DNA, 20 bp, Artificial Sequence
  chemically synthesized
ctcccccaggattattaact

SEQ ID NO: 307353 - DNA, 20 bp, Artificial Sequence
  chemically synthesized
tcccccaggattattaactg

SEQ ID NO: 307354 - DNA, 20 bp, Artificial Sequence
  chemically synthesized
cccccaggattattaactga

SEQ ID NO: 307355 - DNA, 20 bp, Artificial Sequence
  chemically synthesized
cccaggattattaactgagg

SEQ ID NO: 307356 - DNA, 20 bp, Artificial Sequence
  chemically synthesized
ccaggattattaactgaggg

SEQ ID NO: 307357 - DNA, 20 bp, Artificial Sequence
  chemically synthesized
ttttctttcttttcctccct

SEQ ID NO: 307358 - DNA, 20 bp, Artificial Sequence
  chemically synthesized
attattaactgagggaggaa

SEQ ID NO: 307359 - DNA, 20 bp, Artificial Sequence
  chemically synthesized
ttaactgagggaggaaaaga

SEQ ID NO: 307360 - DNA, 20 bp, Artificial Sequence
  chemically synthesized
aaaagaaagaaaatccatga

SEQ ID NO: 307361 - DNA, 20 bp, Artificial Sequence
  chemically synthesized
aaagaaagaaaatccatgat

SEQ ID NO: 307362 - DNA, 20 bp, Artificial Sequence
  chemically synthesized
aagaaagaaaatccatgatg

SEQ ID NO: 307363 - DNA, 20 bp, Artificial Sequence
  chemically synthesized
taatgtatctggccccatca

SEQ ID NO: 307364 - DNA, 20 bp, Artificial Sequence
  chemically synthesized
aagaaaatccatgatggggc

SEQ ID NO: 307365 - DNA, 20 bp, Artificial Sequence
  chemically synthesized
catgatggggccagatacat

SEQ ID NO: 307366 - DNA, 20 bp, Artificial Sequence
  chemically synthesized
attctatgatctaatgtatc

SEQ ID NO: 307367 - DNA, 20 bp, Artificial Sequence
  chemically synthesized
gggccagatacattagatca

SEQ ID NO: 307368 - DNA, 20 bp, Artificial Sequence
  chemically synthesized
cattagatcatagaattcat

SEQ ID NO: 307369 - DNA, 20 bp, Artificial Sequence
  chemically synthesized
atcaatggatagacaggaca

SEQ ID NO: 307370 - DNA, 20 bp, Artificial Sequence
  chemically synthesized
catcaatggatagacaggac

SEQ ID NO: 307371 - DNA, 20 bp, Artificial Sequence
  chemically synthesized
atcagcatcaatggatagac

SEQ ID NO: 307372 - DNA, 20 bp, Artificial Sequence
  chemically synthesized
aatcagcatcaatggataga

SEQ ID NO: 307373 - DNA, 20 bp, Artificial Sequence
  chemically synthesized
aaagaatcagcatcaatgga

SEQ ID NO: 307374 - DNA, 20 bp, Artificial Sequence
  chemically synthesized
cttaaaagaatcagcatcaa

SEQ ID NO: 307375 - DNA, 20 bp, Artificial Sequence
  chemically synthesized
agacctaagcttaaaagaat

SEQ ID NO: 307376 - DNA, 20 bp, Artificial Sequence
  chemically synthesized
ccattgatgctgattctttt

SEQ ID NO: 307377 - DNA, 20 bp, Artificial Sequence
  chemically synthesized
gatgctgattcttttaagct

SEQ ID NO: 307378 - DNA, 20 bp, Artificial Sequence
  chemically synthesized
catgtaagacctaagcttaa

SEQ ID NO: 307379 - DNA, 20 bp, Artificial Sequence
  chemically synthesized
atgctgattcttttaagctt

SEQ ID NO: 307380 - DNA, 20 bp, Artificial Sequence
  chemically synthesized
aatatgcacatgtaagacct

SEQ ID NO: 307381 - DNA, 20 bp, Artificial Sequence
  chemically synthesized
gttatttaatatgcacatgt

SEQ ID NO: 307382 - DNA, 20 bp, Artificial Sequence
  chemically synthesized
caataattagtaacaaatca

SEQ ID NO: 307383 - DNA, 20 bp, Artificial Sequence
  chemically synthesized
tacatattttatgcaataat

SEQ ID NO: 307384 - DNA, 20 bp, Artificial Sequence
  chemically synthesized
tatggttaattattgatatg

SEQ ID NO: 307385 - DNA, 20 bp, Artificial Sequence
  chemically synthesized
tacatatcaataattaacca

SEQ ID NO: 307386 - DNA, 20 bp, Artificial Sequence
  chemically synthesized
acatatcaataattaaccat

SEQ ID NO: 307387 - DNA, 20 bp, Artificial Sequence
  chemically synthesized
ctctggcactcatagaccta

SEQ ID NO: 307388 - DNA, 20 bp, Artificial Sequence
  chemically synthesized
ataattaaccataggtctat

SEQ ID NO: 307389 - DNA, 20 bp, Artificial Sequence
  chemically synthesized
aaccataggtctatgagtgc

SEQ ID NO: 307390 - DNA, 20 bp, Artificial Sequence
  chemically synthesized
ctatgggtctctggcactca

SEQ ID NO: 307391 - DNA, 20 bp, Artificial Sequence
  chemically synthesized
ccataggtctatgagtgcca

SEQ ID NO: 307392 - DNA, 20 bp, Artificial Sequence
  chemically synthesized
tctagagctctatgggtctc

SEQ ID NO: 307393 - DNA, 20 bp, Artificial Sequence
  chemically synthesized
ctatgagtgccagagaccca

SEQ ID NO: 307394 - DNA, 20 bp, Artificial Sequence
  chemically synthesized
atgagtgccagagacccata

SEQ ID NO: 307395 - DNA, 20 bp, Artificial Sequence
  chemically synthesized
tgaattttctagagctctat

SEQ ID NO: 307396 - DNA, 20 bp, Artificial Sequence
  chemically synthesized
ctgaattttctagagctcta

SEQ ID NO: 307397 - DNA, 20 bp, Artificial Sequence
  chemically synthesized
gccagagacccatagagctc

SEQ ID NO: 307398 - DNA, 20 bp, Artificial Sequence
  chemically synthesized
tttgccacctgaattttcta

SEQ ID NO: 307399 - DNA, 20 bp, Artificial Sequence
  chemically synthesized
ccatagagctctagaaaatt

SEQ ID NO: 307400 - DNA, 20 bp, Artificial Sequence
  chemically synthesized
cttttgccacctgaattttc

SEQ ID NO: 307401 - DNA, 20 bp, Artificial Sequence
  chemically synthesized
catagagctctagaaaattc

SEQ ID NO: 307402 - DNA, 20 bp, Artificial Sequence
  chemically synthesized
agagctctagaaaattcagg

SEQ ID NO: 307403 - DNA, 20 bp, Artificial Sequence
  chemically synthesized
ctagaaaattcaggtggcaa

SEQ ID NO: 307404 - DNA, 20 bp, Artificial Sequence
  chemically synthesized
tagaaaattcaggtggcaaa

SEQ ID NO: 307405 - DNA, 20 bp, Artificial Sequence
  chemically synthesized
aaaattcaggtggcaaaagg

SEQ ID NO: 307406 - DNA, 20 bp, Artificial Sequence
  chemically synthesized
caggtggcaaaaggaagatc

SEQ ID NO: 307407 - DNA, 20 bp, Artificial Sequence
  chemically synthesized
ggtggcaaaaggaagatcta

SEQ ID NO: 307408 - DNA, 20 bp, Artificial Sequence
  chemically synthesized
tttgccttgtacacattctc

SEQ ID NO: 307409 - DNA, 20 bp, Artificial Sequence
  chemically synthesized
aagatctagagaatgtgtac

SEQ ID NO: 307410 - DNA, 20 bp, Artificial Sequence
  chemically synthesized
agatctagagaatgtgtaca

SEQ ID NO: 307411 - DNA, 20 bp, Artificial Sequence
  chemically synthesized
tagagaatgtgtacaaggca

SEQ ID NO: 307412 - DNA, 20 bp, Artificial Sequence
  chemically synthesized
agagaatgtgtacaaggcaa

SEQ ID NO: 307413 - DNA, 20 bp, Artificial Sequence
  chemically synthesized
aatgtgtacaaggcaaaggc

SEQ ID NO: 307414 - DNA, 20 bp, Artificial Sequence
  chemically synthesized
tgtacaaggcaaaggccagc

SEQ ID NO: 307415 - DNA, 20 bp, Artificial Sequence
  chemically synthesized
gtacaaggcaaaggccagct

SEQ ID NO: 307416 - DNA, 20 bp, Artificial Sequence
  chemically synthesized
aaggcaaaggccagctggga

SEQ ID NO: 307417 - DNA, 20 bp, Artificial Sequence
  chemically synthesized
tattcttttactatcccagc

SEQ ID NO: 307418 - DNA, 20 bp, Artificial Sequence
  chemically synthesized
tgtttattcttttactatcc

SEQ ID NO: 307419 - DNA, 20 bp, Artificial Sequence
  chemically synthesized
aaggccagctgggatagtaa

SEQ ID NO: 307420 - DNA, 20 bp, Artificial Sequence
  chemically synthesized
tgggatagtaaaagaataaa

SEQ ID NO: 307421 - DNA, 20 bp, Artificial Sequence
  chemically synthesized
tcctggcttctataaaaata

SEQ ID NO: 307422 - DNA, 20 bp, Artificial Sequence
  chemically synthesized
ataaacagactttattttta

SEQ ID NO: 307423 - DNA, 20 bp, Artificial Sequence
  chemically synthesized
aacagactttatttttatag

SEQ ID NO: 307424 - DNA, 20 bp, Artificial Sequence
  chemically synthesized
gactttatttttatagaagc

SEQ ID NO: 307425 - DNA, 20 bp, Artificial Sequence
  chemically synthesized
actttatttttatagaagcc

SEQ ID NO: 307426 - DNA, 20 bp, Artificial Sequence
  chemically synthesized
ttttatagaagccaggaatg

SEQ ID NO: 307427 - DNA, 20 bp, Artificial Sequence
  chemically synthesized
tggaggtaggtctacattcc

SEQ ID NO: 307428 - DNA, 20 bp, Artificial Sequence
  chemically synthesized
aggaatgtagacctacctcc

SEQ ID NO: 307429 - DNA, 20 bp, Artificial Sequence
  chemically synthesized
ggaatgtagacctacctcca

SEQ ID NO: 307430 - DNA, 20 bp, Artificial Sequence
  chemically synthesized
ttcctccctaccttggaggt

SEQ ID NO: 307431 - DNA, 20 bp, Artificial Sequence
  chemically synthesized
cttcctccctaccttggagg

SEQ ID NO: 307432 - DNA, 20 bp, Artificial Sequence
  chemically synthesized
atgtagacctacctccaagg

SEQ ID NO: 307433 - DNA, 20 bp, Artificial Sequence
  chemically synthesized
tgtagacctacctccaaggt

SEQ ID NO: 307434 - DNA, 20 bp, Artificial Sequence
  chemically synthesized
taccttcctccctaccttgg

SEQ ID NO: 307435 - DNA, 20 bp, Artificial Sequence
  chemically synthesized
gtagacctacctccaaggta

SEQ ID NO: 307436 - DNA, 20 bp, Artificial Sequence
  chemically synthesized
gtaccttcctccctaccttg

SEQ ID NO: 307437 - DNA, 20 bp, Artificial Sequence
  chemically synthesized
agacctacctccaaggtagg

SEQ ID NO: 307438 - DNA, 20 bp, Artificial Sequence
  chemically synthesized
ctgtaccttcctccctacct

SEQ ID NO: 307439 - DNA, 20 bp, Artificial Sequence
  chemically synthesized
gacctacctccaaggtaggg

SEQ ID NO: 307440 - DNA, 20 bp, Artificial Sequence
  chemically synthesized
ctacctccaaggtagggagg

SEQ ID NO: 307441 - DNA, 20 bp, Artificial Sequence
  chemically synthesized
tacctccaaggtagggagga

SEQ ID NO: 307442 - DNA, 20 bp, Artificial Sequence
  chemically synthesized
ccaaggtagggaggaaggta

SEQ ID NO: 307443 - DNA, 20 bp, Artificial Sequence
  chemically synthesized
ggaaggtacagtcaataaat

SEQ ID NO: 307444 - DNA, 20 bp, Artificial Sequence
  chemically synthesized
gtacagtcaataaatcagac

SEQ ID NO: 307445 - DNA, 20 bp, Artificial Sequence
  chemically synthesized
tacagtcaataaatcagact

SEQ ID NO: 307446 - DNA, 20 bp, Artificial Sequence
  chemically synthesized
gtcaataaatcagactgggt

SEQ ID NO: 307447 - DNA, 20 bp, Artificial Sequence
  chemically synthesized
aataaatcagactgggtcag

SEQ ID NO: 307448 - DNA, 20 bp, Artificial Sequence
  chemically synthesized
ctccatatccactactgacc

SEQ ID NO: 307449 - DNA, 20 bp, Artificial Sequence
  chemically synthesized
aaatcagactgggtcagtag

SEQ ID NO: 307450 - DNA, 20 bp, Artificial Sequence
  chemically synthesized
gactgggtcagtagtggata

SEQ ID NO: 307451 - DNA, 20 bp, Artificial Sequence
  chemically synthesized
ctgggtcagtagtggatatg

SEQ ID NO: 307452 - DNA, 20 bp, Artificial Sequence
  chemically synthesized
ggtcagtagtggatatggag

SEQ ID NO: 307453 - DNA, 20 bp, Artificial Sequence
  chemically synthesized
tcagtagtggatatggagaa

SEQ ID NO: 307454 - DNA, 20 bp, Artificial Sequence
  chemically synthesized
tagtggatatggagaagaga

SEQ ID NO: 307455 - DNA, 20 bp, Artificial Sequence
  chemically synthesized
gatatggagaagagacagat

SEQ ID NO: 307456 - DNA, 20 bp, Artificial Sequence
  chemically synthesized
aagagacagataagctgttc

SEQ ID NO: 307457 - DNA, 20 bp, Artificial Sequence
  chemically synthesized
tcacttcaaatcatcttgaa

SEQ ID NO: 307458 - DNA, 20 bp, Artificial Sequence
  chemically synthesized
aagctgttcaagatgatttg

SEQ ID NO: 307459 - DNA, 20 bp, Artificial Sequence
  chemically synthesized
tcaagatgatttgaagtgaa

SEQ ID NO: 307460 - DNA, 20 bp, Artificial Sequence
  chemically synthesized
aagataatgtatccttacaa

SEQ ID NO: 307461 - DNA, 20 bp, Artificial Sequence
  chemically synthesized
agataatgtatccttacaaa

SEQ ID NO: 307462 - DNA, 20 bp, Artificial Sequence
  chemically synthesized
ggtttcctgggccttttgta

SEQ ID NO: 307463 - DNA, 20 bp, Artificial Sequence
  chemically synthesized
aggtttcctgggccttttgt

SEQ ID NO: 307464 - DNA, 20 bp, Artificial Sequence
  chemically synthesized
atgtatccttacaaaaggcc

SEQ ID NO: 307465 - DNA, 20 bp, Artificial Sequence
  chemically synthesized
tgtatccttacaaaaggccc

SEQ ID NO: 307466 - DNA, 20 bp, Artificial Sequence
  chemically synthesized
gagtgaggtgaaggtttcct

SEQ ID NO: 307467 - DNA, 20 bp, Artificial Sequence
  chemically synthesized
agagtgaggtgaaggtttcc

SEQ ID NO: 307468 - DNA, 20 bp, Artificial Sequence
  chemically synthesized
tcctgatgagagtgaggtga

SEQ ID NO: 307469 - DNA, 20 bp, Artificial Sequence
  chemically synthesized
ttcctgatgagagtgaggtg

SEQ ID NO: 307470 - DNA, 20 bp, Artificial Sequence
  chemically synthesized
gcgtattcctgatgagagtg

SEQ ID NO: 307471 - DNA, 20 bp, Artificial Sequence
  chemically synthesized
tgcgtattcctgatgagagt

SEQ ID NO: 307472 - DNA, 20 bp, Artificial Sequence
  chemically synthesized
aaccttcacctcactctcat

SEQ ID NO: 307473 - DNA, 20 bp, Artificial Sequence
  chemically synthesized
accttcacctcactctcatc

SEQ ID NO: 307474 - DNA, 20 bp, Artificial Sequence
  chemically synthesized
cttatgcgtattcctgatga

SEQ ID NO: 307475 - DNA, 20 bp, Artificial Sequence
  chemically synthesized
ctcttatgcgtattcctgat

SEQ ID NO: 307476 - DNA, 20 bp, Artificial Sequence
  chemically synthesized
ctctcatcaggaatacgcat

SEQ ID NO: 307477 - DNA, 20 bp, Artificial Sequence
  chemically synthesized
ctcatcaggaatacgcataa

SEQ ID NO: 307478 - DNA, 20 bp, Artificial Sequence
  chemically synthesized
acgcataagagaataatgcc

SEQ ID NO: 307479 - DNA, 20 bp, Artificial Sequence
  chemically synthesized
caatataggagaaattgtct

SEQ ID NO: 307480 - DNA, 20 bp, Artificial Sequence
  chemically synthesized
caagacaatttctcctatat

SEQ ID NO: 307481 - DNA, 20 bp, Artificial Sequence
  chemically synthesized
actcaattttgccaatatag

SEQ ID NO: 307482 - DNA, 20 bp, Artificial Sequence
  chemically synthesized
aaactcaattttgccaatat

SEQ ID NO: 307483 - DNA, 20 bp, Artificial Sequence
  chemically synthesized
aaaactcaattttgccaata

SEQ ID NO: 307484 - DNA, 20 bp, Artificial Sequence
  chemically synthesized
tctcctatattggcaaaatt

SEQ ID NO: 307485 - DNA, 20 bp, Artificial Sequence
  chemically synthesized
gtaactacacataatatagg

SEQ ID NO: 307486 - DNA, 20 bp, Artificial Sequence
  chemically synthesized
taagtaactacacataatat

SEQ ID NO: 307487 - DNA, 20 bp, Artificial Sequence
  chemically synthesized
ataagtaactacacataata

SEQ ID NO: 307488 - DNA, 20 bp, Artificial Sequence
  chemically synthesized
ttttccacctatattatgtg

SEQ ID NO: 307489 - DNA, 20 bp, Artificial Sequence
  chemically synthesized
agcacatcttacatgtagat

SEQ ID NO: 307490 - DNA, 20 bp, Artificial Sequence
  chemically synthesized
gtagttacttatctacatgt

SEQ ID NO: 307491 - DNA, 20 bp, Artificial Sequence
  chemically synthesized
attggagcacatcttacatg

SEQ ID NO: 307492 - DNA, 20 bp, Artificial Sequence
  chemically synthesized
ctggtgattagaatgaattg

SEQ ID NO: 307493 - DNA, 20 bp, Artificial Sequence
  chemically synthesized
aactggtgattagaatgaat

SEQ ID NO: 307494 - DNA, 20 bp, Artificial Sequence
  chemically synthesized
ctccaattcattctaatcac

SEQ ID NO: 307495 - DNA, 20 bp, Artificial Sequence
  chemically synthesized
cccaaagtacaactggtgat

SEQ ID NO: 307496 - DNA, 20 bp, Artificial Sequence
  chemically synthesized
tcaacctcccaaagtacaac

SEQ ID NO: 307497 - DNA, 20 bp, Artificial Sequence
  chemically synthesized
tctaatcaccagttgtactt

SEQ ID NO: 307498 - DNA, 20 bp, Artificial Sequence
  chemically synthesized
ctaatcaccagttgtacttt

SEQ ID NO: 307499 - DNA, 20 bp, Artificial Sequence
  chemically synthesized
aatcaccagttgtactttgg

SEQ ID NO: 307500 - DNA, 20 bp, Artificial Sequence
  chemically synthesized
atcaccagttgtactttggg

SEQ ID NO: 307501 - DNA, 20 bp, Artificial Sequence
  chemically synthesized
tgtaatagatcaacctccca

SEQ ID NO: 307502 - DNA, 20 bp, Artificial Sequence
  chemically synthesized
tttgggaggttgatctatta

SEQ ID NO: 307503 - DNA, 20 bp, Artificial Sequence
  chemically synthesized
tgggaggttgatctattaca

SEQ ID NO: 307504 - DNA, 20 bp, Artificial Sequence
  chemically synthesized
gggaggttgatctattacag

SEQ ID NO: 307505 - DNA, 20 bp, Artificial Sequence
  chemically synthesized
caagatgagaacctctgtaa

SEQ ID NO: 307506 - DNA, 20 bp, Artificial Sequence
  chemically synthesized
tacagaggttctcatcttga

SEQ ID NO: 307507 - DNA, 20 bp, Artificial Sequence
  chemically synthesized
ttctgatgttctttcaagat

SEQ ID NO: 307508 - DNA, 20 bp, Artificial Sequence
  chemically synthesized
ggtaattctgatgttctttc

SEQ ID NO: 307509 - DNA, 20 bp, Artificial Sequence
  chemically synthesized
ttctcatcttgaaagaacat

SEQ ID NO: 307510 - DNA, 20 bp, Artificial Sequence
  chemically synthesized
agaacatcagaattacctga

SEQ ID NO: 307511 - DNA, 20 bp, Artificial Sequence
  chemically synthesized
gaacatcagaattacctgaa

SEQ ID NO: 307512 - DNA, 20 bp, Artificial Sequence
  chemically synthesized
tgcattctaacaagcctttc

SEQ ID NO: 307513 - DNA, 20 bp, Artificial Sequence
  chemically synthesized
ctgcattctaacaagccttt

SEQ ID NO: 307514 - DNA, 20 bp, Artificial Sequence
  chemically synthesized
gaattacctgaaaggcttgt

SEQ ID NO: 307515 - DNA, 20 bp, Artificial Sequence
  chemically synthesized
ctagtcatctgcattctaac

SEQ ID NO: 307516 - DNA, 20 bp, Artificial Sequence
  chemically synthesized
ctgaaaggcttgttagaatg

SEQ ID NO: 307517 - DNA, 20 bp, Artificial Sequence
  chemically synthesized
cttgttagaatgcagatgac

SEQ ID NO: 307518 - DNA, 20 bp, Artificial Sequence
  chemically synthesized
ttgttagaatgcagatgact

SEQ ID NO: 307519 - DNA, 20 bp, Artificial Sequence
  chemically synthesized
gaaactctggaagtggagcc

SEQ ID NO: 307520 - DNA, 20 bp, Artificial Sequence
  chemically synthesized
agatgactaggctccacttc

SEQ ID NO: 307521 - DNA, 20 bp, Artificial Sequence
  chemically synthesized
atttagaaactctggaagtg

SEQ ID NO: 307522 - DNA, 20 bp, Artificial Sequence
  chemically synthesized
atgactaggctccacttcca

SEQ ID NO: 307523 - DNA, 20 bp, Artificial Sequence
  chemically synthesized
tgatttagaaactctggaag

SEQ ID NO: 307524 - DNA, 20 bp, Artificial Sequence
  chemically synthesized
tactgatttagaaactctgg

SEQ ID NO: 307525 - DNA, 20 bp, Artificial Sequence
  chemically synthesized
acctactgatttagaaactc

SEQ ID NO: 307526 - DNA, 20 bp, Artificial Sequence
  chemically synthesized
cacttccagagtttctaaat

SEQ ID NO: 307527 - DNA, 20 bp, Artificial Sequence
  chemically synthesized
ttccagagtttctaaatcag

SEQ ID NO: 307528 - DNA, 20 bp, Artificial Sequence
  chemically synthesized
tccagagtttctaaatcagt

SEQ ID NO: 307529 - DNA, 20 bp, Artificial Sequence
  chemically synthesized
catcttcagacctactgatt

SEQ ID NO: 307530 - DNA, 20 bp, Artificial Sequence
  chemically synthesized
tttctaaatcagtaggtctg

SEQ ID NO: 307531 - DNA, 20 bp, Artificial Sequence
  chemically synthesized
taaatcagtaggtctgaaga

SEQ ID NO: 307532 - DNA, 20 bp, Artificial Sequence
  chemically synthesized
gcacattgttaggccatctt

SEQ ID NO: 307533 - DNA, 20 bp, Artificial Sequence
  chemically synthesized
tgttaggaatgcacattgtt

SEQ ID NO: 307534 - DNA, 20 bp, Artificial Sequence
  chemically synthesized
ttgttaggaatgcacattgt

SEQ ID NO: 307535 - DNA, 20 bp, Artificial Sequence
  chemically synthesized
cagtatcaaggaaatttgtt

SEQ ID NO: 307536 - DNA, 20 bp, Artificial Sequence
  chemically synthesized
tcagtatcaaggaaatttgt

SEQ ID NO: 307537 - DNA, 20 bp, Artificial Sequence
  chemically synthesized
gaccggcagcatcagtatca

SEQ ID NO: 307538 - DNA, 20 bp, Artificial Sequence
  chemically synthesized
cgaccggcagcatcagtatc

SEQ ID NO: 307539 - DNA, 20 bp, Artificial Sequence
  chemically synthesized
ttccttgatactgatgctgc

SEQ ID NO: 307540 - DNA, 20 bp, Artificial Sequence
  chemically synthesized
gttcccccgaccggcagcat

SEQ ID NO: 307541 - DNA, 20 bp, Artificial Sequence
  chemically synthesized
ttgatactgatgctgccggt

SEQ ID NO: 307542 - DNA, 20 bp, Artificial Sequence
  chemically synthesized
tgatactgatgctgccggtc

SEQ ID NO: 307543 - DNA, 20 bp, Artificial Sequence
  chemically synthesized
gatactgatgctgccggtcg

SEQ ID NO: 307544 - DNA, 20 bp, Artificial Sequence
  chemically synthesized
aaatgtgttcccccgaccgg

SEQ ID NO: 307545 - DNA, 20 bp, Artificial Sequence
  chemically synthesized
atactgatgctgccggtcgg

SEQ ID NO: 307546 - DNA, 20 bp, Artificial Sequence
  chemically synthesized
tcaaaatgtgttcccccgac

SEQ ID NO: 307547 - DNA, 20 bp, Artificial Sequence
  chemically synthesized
cggtcgggggaacacatttt

SEQ ID NO: 307548 - DNA, 20 bp, Artificial Sequence
  chemically synthesized
tcgggggaacacattttgag

SEQ ID NO: 307549 - DNA, 20 bp, Artificial Sequence
  chemically synthesized
ctcaaataattaattcagac

SEQ ID NO: 307550 - DNA, 20 bp, Artificial Sequence
  chemically synthesized
cctcaaataattaattcaga

SEQ ID NO: 307551 - DNA, 20 bp, Artificial Sequence
  chemically synthesized
tggccctcaaataattaatt

SEQ ID NO: 307552 - DNA, 20 bp, Artificial Sequence
  chemically synthesized
cctgtctgaattaattattt

SEQ ID NO: 307553 - DNA, 20 bp, Artificial Sequence
  chemically synthesized
ctgtctgaattaattatttg

SEQ ID NO: 307554 - DNA, 20 bp, Artificial Sequence
  chemically synthesized
tgtctgaattaattatttga

SEQ ID NO: 307555 - DNA, 20 bp, Artificial Sequence
  chemically synthesized
taattatttgagggccatcc

SEQ ID NO: 307556 - DNA, 20 bp, Artificial Sequence
  chemically synthesized
aattatttgagggccatccc

SEQ ID NO: 307557 - DNA, 20 bp, Artificial Sequence
  chemically synthesized
ttatttgagggccatcccag

SEQ ID NO: 307558 - DNA, 20 bp, Artificial Sequence
  chemically synthesized
ctttacctcaactcctggga

SEQ ID NO: 307559 - DNA, 20 bp, Artificial Sequence
  chemically synthesized
tgagggccatcccaggagtt

SEQ ID NO: 307560 - DNA, 20 bp, Artificial Sequence
  chemically synthesized
ctacctttacctcaactcct

SEQ ID NO: 307561 - DNA, 20 bp, Artificial Sequence
  chemically synthesized
gagggccatcccaggagttg

SEQ ID NO: 307562 - DNA, 20 bp, Artificial Sequence
  chemically synthesized
gctacctttacctcaactcc

SEQ ID NO: 307563 - DNA, 20 bp, Artificial Sequence
  chemically synthesized
ccatcccaggagttgaggta

SEQ ID NO: 307564 - DNA, 20 bp, Artificial Sequence
  chemically synthesized
catcccaggagttgaggtaa

SEQ ID NO: 307565 - DNA, 20 bp, Artificial Sequence
  chemically synthesized
cccaggagttgaggtaaagg

SEQ ID NO: 307566 - DNA, 20 bp, Artificial Sequence
  chemically synthesized
ggagttgaggtaaaggtagc

SEQ ID NO: 307567 - DNA, 20 bp, Artificial Sequence
  chemically synthesized
ggtaaaggtagcaagtcaaa

SEQ ID NO: 307568 - DNA, 20 bp, Artificial Sequence
  chemically synthesized
gtaaaggtagcaagtcaaac

SEQ ID NO: 307569 - DNA, 20 bp, Artificial Sequence
  chemically synthesized
aagtcaaacaggaacttgct

SEQ ID NO: 307570 - DNA, 20 bp, Artificial Sequence
  chemically synthesized
agtgctcatggtaactgagc

SEQ ID NO: 307571 - DNA, 20 bp, Artificial Sequence
  chemically synthesized
atgaagtgctcatggtaact

SEQ ID NO: 307572 - DNA, 20 bp, Artificial Sequence
  chemically synthesized
ggaacttgctcagttaccat

SEQ ID NO: 307573 - DNA, 20 bp, Artificial Sequence
  chemically synthesized
ggacatggatgaagtgctca

SEQ ID NO: 307574 - DNA, 20 bp, Artificial Sequence
  chemically synthesized
gggatcaaaggacatggatg

SEQ ID NO: 307575 - DNA, 20 bp, Artificial Sequence
  chemically synthesized
ggctgtgggatcaaaggaca

SEQ ID NO: 307576 - DNA, 20 bp, Artificial Sequence
  chemically synthesized
tcaaatggctgtgggatcaa

SEQ ID NO: 307577 - DNA, 20 bp, Artificial Sequence
  chemically synthesized
ctcaaatggctgtgggatca

SEQ ID NO: 307578 - DNA, 20 bp, Artificial Sequence
  chemically synthesized
atccatgtcctttgatccca

SEQ ID NO: 307579 - DNA, 20 bp, Artificial Sequence
  chemically synthesized
agatattctcaaatggctgt

SEQ ID NO: 307580 - DNA, 20 bp, Artificial Sequence
  chemically synthesized
aagatattctcaaatggctg

SEQ ID NO: 307581 - DNA, 20 bp, Artificial Sequence
  chemically synthesized
ctttgatcccacagccattt

SEQ ID NO: 307582 - DNA, 20 bp, Artificial Sequence
  chemically synthesized
gaattgaagatattctcaaa

SEQ ID NO: 307583 - DNA, 20 bp, Artificial Sequence
  chemically synthesized
acagaagtacttaggaattg

SEQ ID NO: 307584 - DNA, 20 bp, Artificial Sequence
  chemically synthesized
tgagaatatcttcaattcct

SEQ ID NO: 307585 - DNA, 20 bp, Artificial Sequence
  chemically synthesized
taagggctacagaagtactt

SEQ ID NO: 307586 - DNA, 20 bp, Artificial Sequence
  chemically synthesized
ataagggctacagaagtact

SEQ ID NO: 307587 - DNA, 20 bp, Artificial Sequence
  chemically synthesized
tcaattcctaagtacttctg

SEQ ID NO: 307588 - DNA, 20 bp, Artificial Sequence
  chemically synthesized
atggtatataagggctacag

SEQ ID NO: 307589 - DNA, 20 bp, Artificial Sequence
  chemically synthesized
attatggtatataagggcta

SEQ ID NO: 307590 - DNA, 20 bp, Artificial Sequence
  chemically synthesized
caagagattatggtatataa

SEQ ID NO: 307591 - DNA, 20 bp, Artificial Sequence
  chemically synthesized
ccaagagattatggtatata

SEQ ID NO: 307592 - DNA, 20 bp, Artificial Sequence
  chemically synthesized
tccaagagattatggtatat

SEQ ID NO: 307593 - DNA, 20 bp, Artificial Sequence
  chemically synthesized
cagggtgatccaagagatta

SEQ ID NO: 307594 - DNA, 20 bp, Artificial Sequence
  chemically synthesized
ccttatataccataatctct

SEQ ID NO: 307595 - DNA, 20 bp, Artificial Sequence
  chemically synthesized
ggggaagcagggtgatccaa

SEQ ID NO: 307596 - DNA, 20 bp, Artificial Sequence
  chemically synthesized
ctggggaagcagggtgatcc

SEQ ID NO: 307597 - DNA, 20 bp, Artificial Sequence
  chemically synthesized
aggacagctctggggaagca

SEQ ID NO: 307598 - DNA, 20 bp, Artificial Sequence
  chemically synthesized
cttggatcaccctgcttccc

SEQ ID NO: 307599 - DNA, 20 bp, Artificial Sequence
  chemically synthesized
aaggacagctctggggaagc

SEQ ID NO: 307600 - DNA, 20 bp, Artificial Sequence
  chemically synthesized
gaaggacagctctggggaag

SEQ ID NO: 307601 - DNA, 20 bp, Artificial Sequence
  chemically synthesized
tggatcaccctgcttcccca

SEQ ID NO: 307602 - DNA, 20 bp, Artificial Sequence
  chemically synthesized
ggggaaggacagctctgggg

SEQ ID NO: 307603 - DNA, 20 bp, Artificial Sequence
  chemically synthesized
gctggggaaggacagctctg

SEQ ID NO: 307604 - DNA, 20 bp, Artificial Sequence
  chemically synthesized
tgctggggaaggacagctct

SEQ ID NO: 307605 - DNA, 20 bp, Artificial Sequence
  chemically synthesized
ttgctggggaaggacagctc

SEQ ID NO: 307606 - DNA, 20 bp, Artificial Sequence
  chemically synthesized
tggcgtttgctggggaagga

SEQ ID NO: 307607 - DNA, 20 bp, Artificial Sequence
  chemically synthesized
tccccagagctgtccttccc

SEQ ID NO: 307608 - DNA, 20 bp, Artificial Sequence
  chemically synthesized
ctgttggcgtttgctgggga

SEQ ID NO: 307609 - DNA, 20 bp, Artificial Sequence
  chemically synthesized
actgttggcgtttgctgggg

SEQ ID NO: 307610 - DNA, 20 bp, Artificial Sequence
  chemically synthesized
gggactgttggcgtttgctg

SEQ ID NO: 307611 - DNA, 20 bp, Artificial Sequence
  chemically synthesized
ggggactgttggcgtttgct

SEQ ID NO: 307612 - DNA, 20 bp, Artificial Sequence
  chemically synthesized
tggggactgttggcgtttgc

SEQ ID NO: 307613 - DNA, 20 bp, Artificial Sequence
  chemically synthesized
ccttccccagcaaacgccaa

SEQ ID NO: 307614 - DNA, 20 bp, Artificial Sequence
  chemically synthesized
atttctgctgtggggactgt

SEQ ID NO: 307615 - DNA, 20 bp, Artificial Sequence
  chemically synthesized
gcaaacgccaacagtcccca

SEQ ID NO: 307616 - DNA, 20 bp, Artificial Sequence
  chemically synthesized
aacgccaacagtccccacag

SEQ ID NO: 307617 - DNA, 20 bp, Artificial Sequence
  chemically synthesized
gtaaatgtatttctgctgtg

SEQ ID NO: 307618 - DNA, 20 bp, Artificial Sequence
  chemically synthesized
agtaaatgtatttctgctgt

SEQ ID NO: 307619 - DNA, 20 bp, Artificial Sequence
  chemically synthesized
gagtaaatgtatttctgctg

SEQ ID NO: 307620 - DNA, 20 bp, Artificial Sequence
  chemically synthesized
acagcagaaatacatttact

SEQ ID NO: 307621 - DNA, 20 bp, Artificial Sequence
  chemically synthesized
cagcagaaatacatttactc

SEQ ID NO: 307622 - DNA, 20 bp, Artificial Sequence
  chemically synthesized
gaaatacatttactcaggaa

SEQ ID NO: 307623 - DNA, 20 bp, Artificial Sequence
  chemically synthesized
aaatacatttactcaggaac

SEQ ID NO: 307624 - DNA, 20 bp, Artificial Sequence
  chemically synthesized
tcaagaagaaacctgttcct

SEQ ID NO: 307625 - DNA, 20 bp, Artificial Sequence
  chemically synthesized
gaacaggtttcttcttgact

SEQ ID NO: 307626 - DNA, 20 bp, Artificial Sequence
  chemically synthesized
gtgggaagatccaagtcaag

SEQ ID NO: 307627 - DNA, 20 bp, Artificial Sequence
  chemically synthesized
atcgtgggaagatccaagtc

SEQ ID NO: 307628 - DNA, 20 bp, Artificial Sequence
  chemically synthesized
aaattatcgtgggaagatcc

SEQ ID NO: 307629 - DNA, 20 bp, Artificial Sequence
  chemically synthesized
atcacgtaaattatcgtggg

SEQ ID NO: 307630 - DNA, 20 bp, Artificial Sequence
  chemically synthesized
agaatcacgtaaattatcgt

SEQ ID NO: 307631 - DNA, 20 bp, Artificial Sequence
  chemically synthesized
tagaatcacgtaaattatcg

SEQ ID NO: 307632 - DNA, 20 bp, Artificial Sequence
  chemically synthesized
gataatttacgtgattctac

SEQ ID NO: 307633 - DNA, 20 bp, Artificial Sequence
  chemically synthesized
gaggtgaattataagacttg

SEQ ID NO: 307634 - DNA, 20 bp, Artificial Sequence
  chemically synthesized
gcttttatgaggtgaattat

SEQ ID NO: 307635 - DNA, 20 bp, Artificial Sequence
  chemically synthesized
tcttataattcacctcataa

SEQ ID NO: 307636 - DNA, 20 bp, Artificial Sequence
  chemically synthesized
aagaaacagtagcttttatg

SEQ ID NO: 307637 - DNA, 20 bp, Artificial Sequence
  chemically synthesized
gaagaaacagtagcttttat

SEQ ID NO: 307638 - DNA, 20 bp, Artificial Sequence
  chemically synthesized
tgaagggaaagaagaaacag

SEQ ID NO: 307639 - DNA, 20 bp, Artificial Sequence
  chemically synthesized
aaatgaagggaaagaagaaa

SEQ ID NO: 307640 - DNA, 20 bp, Artificial Sequence
  chemically synthesized
ggataaaaatgaagggaaag

SEQ ID NO: 307641 - DNA, 20 bp, Artificial Sequence
  chemically synthesized
cagggataaaaatgaaggga

SEQ ID NO: 307642 - DNA, 20 bp, Artificial Sequence
  chemically synthesized
gcatcagggataaaaatgaa

SEQ ID NO: 307643 - DNA, 20 bp, Artificial Sequence
  chemically synthesized
ggcatcagggataaaaatga

SEQ ID NO: 307644 - DNA, 20 bp, Artificial Sequence
  chemically synthesized
tggcatcagggataaaaatg

SEQ ID NO: 307645 - DNA, 20 bp, Artificial Sequence
  chemically synthesized
tttaaactgatttggcatca

SEQ ID NO: 307646 - DNA, 20 bp, Artificial Sequence
  chemically synthesized
ttttaaactgatttggcatc

SEQ ID NO: 307647 - DNA, 20 bp, Artificial Sequence
  chemically synthesized
gttttaaactgatttggcat

SEQ ID NO: 307648 - DNA, 20 bp, Artificial Sequence
  chemically synthesized
ttttatccctgatgccaaat

SEQ ID NO: 307649 - DNA, 20 bp, Artificial Sequence
  chemically synthesized
atttaagttttaaactgatt

SEQ ID NO: 307650 - DNA, 20 bp, Artificial Sequence
  chemically synthesized
aatcagtttaaaacttaaat

SEQ ID NO: 307651 - DNA, 20 bp, Artificial Sequence
  chemically synthesized
tttataatcaaaactgattt

SEQ ID NO: 307652 - DNA, 20 bp, Artificial Sequence
  chemically synthesized
gttttgattataaaaaataa

SEQ ID NO: 307653 - DNA, 20 bp, Artificial Sequence
  chemically synthesized
aataatagatctacatgatt

SEQ ID NO: 307654 - DNA, 20 bp, Artificial Sequence
  chemically synthesized
ggattcatatccaaatcatg

SEQ ID NO: 307655 - DNA, 20 bp, Artificial Sequence
  chemically synthesized
tgatttggatatgaatccca

SEQ ID NO: 307656 - DNA, 20 bp, Artificial Sequence
  chemically synthesized
ggatatgaatcccaaagatc

SEQ ID NO: 307657 - DNA, 20 bp, Artificial Sequence
  chemically synthesized
ttaatttgctctagatcttt

SEQ ID NO: 307658 - DNA, 20 bp, Artificial Sequence
  chemically synthesized
tttaatttgctctagatctt

SEQ ID NO: 307659 - DNA, 20 bp, Artificial Sequence
  chemically synthesized
atatgaatcccaaagatcta

SEQ ID NO: 307660 - DNA, 20 bp, Artificial Sequence
  chemically synthesized
ttatgacatttaatttgctc

SEQ ID NO: 307661 - DNA, 20 bp, Artificial Sequence
  chemically synthesized
tgccattgaggtgggaggtg

SEQ ID NO: 307662 - DNA, 20 bp, Artificial Sequence
  chemically synthesized
ttgccattgaggtgggaggt

SEQ ID NO: 307663 - DNA, 20 bp, Artificial Sequence
  chemically synthesized
cttgccattgaggtgggagg

SEQ ID NO: 307664 - DNA, 20 bp, Artificial Sequence
  chemically synthesized
ctgcttgccattgaggtggg

SEQ ID NO: 307665 - DNA, 20 bp, Artificial Sequence
  chemically synthesized
cctgcttgccattgaggtgg

SEQ ID NO: 307666 - DNA, 20 bp, Artificial Sequence
  chemically synthesized
atccccacctcccacctcaa

SEQ ID NO: 307667 - DNA, 20 bp, Artificial Sequence
  chemically synthesized
gtcctgcttgccattgaggt

SEQ ID NO: 307668 - DNA, 20 bp, Artificial Sequence
  chemically synthesized
tgtcctgcttgccattgagg

SEQ ID NO: 307669 - DNA, 20 bp, Artificial Sequence
  chemically synthesized
ccacctcccacctcaatggc

SEQ ID NO: 307670 - DNA, 20 bp, Artificial Sequence
  chemically synthesized
ttgtgtcctgcttgccattg

SEQ ID NO: 307671 - DNA, 20 bp, Artificial Sequence
  chemically synthesized
attgtgtcctgcttgccatt

SEQ ID NO: 307672 - DNA, 20 bp, Artificial Sequence
  chemically synthesized
cctcccacctcaatggcaag

SEQ ID NO: 307673 - DNA, 20 bp, Artificial Sequence
  chemically synthesized
ctcccacctcaatggcaagc

SEQ ID NO: 307674 - DNA, 20 bp, Artificial Sequence
  chemically synthesized
gcaagcaggacacaatccca

SEQ ID NO: 307675 - DNA, 20 bp, Artificial Sequence
  chemically synthesized
caagcaggacacaatcccat

SEQ ID NO: 307676 - DNA, 20 bp, Artificial Sequence
  chemically synthesized
tagtatcactgataacccat

SEQ ID NO: 307677 - DNA, 20 bp, Artificial Sequence
  chemically synthesized
atagtatcactgataaccca

SEQ ID NO: 307678 - DNA, 20 bp, Artificial Sequence
  chemically synthesized
gacacaatcccatgggttat

SEQ ID NO: 307679 - DNA, 20 bp, Artificial Sequence
  chemically synthesized
aagtgtaatttgtttcaaaa

SEQ ID NO: 307680 - DNA, 20 bp, Artificial Sequence
  chemically synthesized
aacaaattacacttattgta

SEQ ID NO: 307681 - DNA, 20 bp, Artificial Sequence
  chemically synthesized
aactctcttctctttacaat

SEQ ID NO: 307682 - DNA, 20 bp, Artificial Sequence
  chemically synthesized
caaattacacttattgtaaa

SEQ ID NO: 307683 - DNA, 20 bp, Artificial Sequence
  chemically synthesized
attacacttattgtaaagag

SEQ ID NO: 307684 - DNA, 20 bp, Artificial Sequence
  chemically synthesized
tacacttattgtaaagagaa

SEQ ID NO: 307685 - DNA, 20 bp, Artificial Sequence
  chemically synthesized
cacttattgtaaagagaaga

SEQ ID NO: 307686 - DNA, 20 bp, Artificial Sequence
  chemically synthesized
attgtaaagagaagagagtt

SEQ ID NO: 307687 - DNA, 20 bp, Artificial Sequence
  chemically synthesized
aaagagaagagagtttagca

SEQ ID NO: 307688 - DNA, 20 bp, Artificial Sequence
  chemically synthesized
tagcacagtgtatctatacc

SEQ ID NO: 307689 - DNA, 20 bp, Artificial Sequence
  chemically synthesized
tttcactacatgtctaggta

SEQ ID NO: 307690 - DNA, 20 bp, Artificial Sequence
  chemically synthesized
tgtatctatacctagacatg

SEQ ID NO: 307691 - DNA, 20 bp, Artificial Sequence
  chemically synthesized
ccagttttcactacatgtct

SEQ ID NO: 307692 - DNA, 20 bp, Artificial Sequence
  chemically synthesized
accagttttcactacatgtc

SEQ ID NO: 307693 - DNA, 20 bp, Artificial Sequence
  chemically synthesized
cctagacatgtagtgaaaac

SEQ ID NO: 307694 - DNA, 20 bp, Artificial Sequence
  chemically synthesized
catgtagtgaaaactggtga

SEQ ID NO: 307695 - DNA, 20 bp, Artificial Sequence
  chemically synthesized
aaacaggtaccatctgtcac

SEQ ID NO: 307696 - DNA, 20 bp, Artificial Sequence
  chemically synthesized
tagtgaaaactggtgacaga

SEQ ID NO: 307697 - DNA, 20 bp, Artificial Sequence
  chemically synthesized
gtgacagatggtacctgttt

SEQ ID NO: 307698 - DNA, 20 bp, Artificial Sequence
  chemically synthesized
tgacagatggtacctgtttt

SEQ ID NO: 307699 - DNA, 20 bp, Artificial Sequence
  chemically synthesized
cacaatctgagacccaaaac

SEQ ID NO: 307700 - DNA, 20 bp, Artificial Sequence
  chemically synthesized
tcacaatctgagacccaaaa

SEQ ID NO: 307701 - DNA, 20 bp, Artificial Sequence
  chemically synthesized
atggtacctgttttgggtct

SEQ ID NO: 307702 - DNA, 20 bp, Artificial Sequence
  chemically synthesized
attaaaatatgtcacaatct

SEQ ID NO: 307703 - DNA, 20 bp, Artificial Sequence
  chemically synthesized
tgctgactcaggcagtgaat

SEQ ID NO: 307704 - DNA, 20 bp, Artificial Sequence
  chemically synthesized
taaattcttattcactgcct

SEQ ID NO: 307705 - DNA, 20 bp, Artificial Sequence
  chemically synthesized
ttcttattcactgcctgagt

SEQ ID NO: 307706 - DNA, 20 bp, Artificial Sequence
  chemically synthesized
aattcctttgctgactcagg

SEQ ID NO: 307707 - DNA, 20 bp, Artificial Sequence
  chemically synthesized
taaaattcctttgctgactc

SEQ ID NO: 307708 - DNA, 20 bp, Artificial Sequence
  chemically synthesized
gtaaaattcctttgctgact

SEQ ID NO: 307709 - DNA, 20 bp, Artificial Sequence
  chemically synthesized
attcactgcctgagtcagca

SEQ ID NO: 307710 - DNA, 20 bp, Artificial Sequence
  chemically synthesized
ttcactgcctgagtcagcaa

SEQ ID NO: 307711 - DNA, 20 bp, Artificial Sequence
  chemically synthesized
aggaattttacctcaaattc

SEQ ID NO: 307712 - DNA, 20 bp, Artificial Sequence
  chemically synthesized
gacagctggtctagaatttg

SEQ ID NO: 307713 - DNA, 20 bp, Artificial Sequence
  chemically synthesized
tgacagctggtctagaattt

SEQ ID NO: 307714 - DNA, 20 bp, Artificial Sequence
  chemically synthesized
ttttacctcaaattctagac

SEQ ID NO: 307715 - DNA, 20 bp, Artificial Sequence
  chemically synthesized
acaaaacctgacagctggtc

SEQ ID NO: 307716 - DNA, 20 bp, Artificial Sequence
  chemically synthesized
tcaaattctagaccagctgt

SEQ ID NO: 307717 - DNA, 20 bp, Artificial Sequence
  chemically synthesized
caaattctagaccagctgtc

SEQ ID NO: 307718 - DNA, 20 bp, Artificial Sequence
  chemically synthesized
aattaacaaaacctgacagc

SEQ ID NO: 307719 - DNA, 20 bp, Artificial Sequence
  chemically synthesized
agccaattaacaaaacctga

SEQ ID NO: 307720 - DNA, 20 bp, Artificial Sequence
  chemically synthesized
agctgtcaggttttgttaat

SEQ ID NO: 307721 - DNA, 20 bp, Artificial Sequence
  chemically synthesized
gtcttgtcatttgatagttt

SEQ ID NO: 307722 - DNA, 20 bp, Artificial Sequence
  chemically synthesized
ctataggtcttgtcatttga

SEQ ID NO: 307723 - DNA, 20 bp, Artificial Sequence
  chemically synthesized
ggcttaaactatcaaatgac

SEQ ID NO: 307724 - DNA, 20 bp, Artificial Sequence
  chemically synthesized
ctatcaaatgacaagaccta

SEQ ID NO: 307725 - DNA, 20 bp, Artificial Sequence
  chemically synthesized
agagaaaatatgttttctat

SEQ ID NO: 307726 - DNA, 20 bp, Artificial Sequence
  chemically synthesized
aagagaaaatatgttttcta

SEQ ID NO: 307727 - DNA, 20 bp, Artificial Sequence
  chemically synthesized
tcaccttgcttgtgaacaaa

SEQ ID NO: 307728 - DNA, 20 bp, Artificial Sequence
  chemically synthesized
catattttctctttgttcac

SEQ ID NO: 307729 - DNA, 20 bp, Artificial Sequence
  chemically synthesized
tgtcaccttgcttgtgaaca

SEQ ID NO: 307730 - DNA, 20 bp, Artificial Sequence
  chemically synthesized
ttttctctttgttcacaagc

SEQ ID NO: 307731 - DNA, 20 bp, Artificial Sequence
  chemically synthesized
tttctctttgttcacaagca

SEQ ID NO: 307732 - DNA, 20 bp, Artificial Sequence
  chemically synthesized
aacacaaattttaatcctat

SEQ ID NO: 307733 - DNA, 20 bp, Artificial Sequence
  chemically synthesized
aaagtcaataattttccaat

SEQ ID NO: 307734 - DNA, 20 bp, Artificial Sequence
  chemically synthesized
gaaagtcaataattttccaa

SEQ ID NO: 307735 - DNA, 20 bp, Artificial Sequence
  chemically synthesized
aaaattattgactttcttaa

SEQ ID NO: 307736 - DNA, 20 bp, Artificial Sequence
  chemically synthesized
ataaaaatgctcttttaaga

SEQ ID NO: 307737 - DNA, 20 bp, Artificial Sequence
  chemically synthesized
aattattgactttcttaaaa

SEQ ID NO: 307738 - DNA, 20 bp, Artificial Sequence
  chemically synthesized
ggccataaaaatgctctttt

SEQ ID NO: 307739 - DNA, 20 bp, Artificial Sequence
  chemically synthesized
ttcttaaaagagcattttta

SEQ ID NO: 307740 - DNA, 20 bp, Artificial Sequence
  chemically synthesized
aagagcatttttatggccct

SEQ ID NO: 307741 - DNA, 20 bp, Artificial Sequence
  chemically synthesized
agagcatttttatggccctg

SEQ ID NO: 307742 - DNA, 20 bp, Artificial Sequence
  chemically synthesized
catttttatggccctgaggc

SEQ ID NO: 307743 - DNA, 20 bp, Artificial Sequence
  chemically synthesized
agaaatcttggctagcctca

SEQ ID NO: 307744 - DNA, 20 bp, Artificial Sequence
  chemically synthesized
cagaaatcttggctagcctc

SEQ ID NO: 307745 - DNA, 20 bp, Artificial Sequence
  chemically synthesized
gcagaaatcttggctagcct

SEQ ID NO: 307746 - DNA, 20 bp, Artificial Sequence
  chemically synthesized
ttatggccctgaggctagcc

SEQ ID NO: 307747 - DNA, 20 bp, Artificial Sequence
  chemically synthesized
ttgtgagcagaaatcttggc

SEQ ID NO: 307748 - DNA, 20 bp, Artificial Sequence
  chemically synthesized
atttttgtgagcagaaatct

SEQ ID NO: 307749 - DNA, 20 bp, Artificial Sequence
  chemically synthesized
tatgttaacatttttgtgag

SEQ ID NO: 307750 - DNA, 20 bp, Artificial Sequence
  chemically synthesized
ctctatgttaacatttttgt

SEQ ID NO: 307751 - DNA, 20 bp, Artificial Sequence
  chemically synthesized
tgctcacaaaaatgttaaca

SEQ ID NO: 307752 - DNA, 20 bp, Artificial Sequence
  chemically synthesized
ctcacaaaaatgttaacata

SEQ ID NO: 307753 - DNA, 20 bp, Artificial Sequence
  chemically synthesized
tcacaaaaatgttaacatag

SEQ ID NO: 307754 - DNA, 20 bp, Artificial Sequence
  chemically synthesized
acatagaggcacattattgt

SEQ ID NO: 307755 - DNA, 20 bp, Artificial Sequence
  chemically synthesized
cacattattgttagaaatga

SEQ ID NO: 307756 - DNA, 20 bp, Artificial Sequence
  chemically synthesized
ttgttagaaatgacagttct

SEQ ID NO: 307757 - DNA, 20 bp, Artificial Sequence
  chemically synthesized
gaaatgacagttctcagttg

SEQ ID NO: 307758 - DNA, 20 bp, Artificial Sequence
  chemically synthesized
tggaaaaaataactgcaact

SEQ ID NO: 307759 - DNA, 20 bp, Artificial Sequence
  chemically synthesized
cagttgcagttattttttcc

SEQ ID NO: 307760 - DNA, 20 bp, Artificial Sequence
  chemically synthesized
agttgcagttattttttcca

SEQ ID NO: 307761 - DNA, 20 bp, Artificial Sequence
  chemically synthesized
cctcatatcagttgattcct

SEQ ID NO: 307762 - DNA, 20 bp, Artificial Sequence
  chemically synthesized
tccaaggaatcaactgatat

SEQ ID NO: 307763 - DNA, 20 bp, Artificial Sequence
  chemically synthesized
ccaaggaatcaactgatatg

SEQ ID NO: 307764 - DNA, 20 bp, Artificial Sequence
  chemically synthesized
tatttcagtagtcctcatat

SEQ ID NO: 307765 - DNA, 20 bp, Artificial Sequence
  chemically synthesized
tgatatgaggactactgaaa

SEQ ID NO: 307766 - DNA, 20 bp, Artificial Sequence
  chemically synthesized
ggcctttcaatctatttcag

SEQ ID NO: 307767 - DNA, 20 bp, Artificial Sequence
  chemically synthesized
ccaggcctttcaatctattt

SEQ ID NO: 307768 - DNA, 20 bp, Artificial Sequence
  chemically synthesized
ggactactgaaatagattga

SEQ ID NO: 307769 - DNA, 20 bp, Artificial Sequence
  chemically synthesized
gactactgaaatagattgaa

SEQ ID NO: 307770 - DNA, 20 bp, Artificial Sequence
  chemically synthesized
ctgaaatagattgaaaggcc

SEQ ID NO: 307771 - DNA, 20 bp, Artificial Sequence
  chemically synthesized
agattgaaaggcctggacct

SEQ ID NO: 307772 - DNA, 20 bp, Artificial Sequence
  chemically synthesized
agacatccagactcaggtcc

SEQ ID NO: 307773 - DNA, 20 bp, Artificial Sequence
  chemically synthesized
aagacatccagactcaggtc

SEQ ID NO: 307774 - DNA, 20 bp, Artificial Sequence
  chemically synthesized
gaaaggcctggacctgagtc

SEQ ID NO: 307775 - DNA, 20 bp, Artificial Sequence
  chemically synthesized
acactaagacatccagactc

SEQ ID NO: 307776 - DNA, 20 bp, Artificial Sequence
  chemically synthesized
aacactaagacatccagact

SEQ ID NO: 307777 - DNA, 20 bp, Artificial Sequence
  chemically synthesized
ggacctgagtctggatgtct

SEQ ID NO: 307778 - DNA, 20 bp, Artificial Sequence
  chemically synthesized
aaaatgaacactaagacatc

SEQ ID NO: 307779 - DNA, 20 bp, Artificial Sequence
  chemically synthesized
tcagacttaaaatgaacact

SEQ ID NO: 307780 - DNA, 20 bp, Artificial Sequence
  chemically synthesized
gatgtcttagtgttcatttt

SEQ ID NO: 307781 - DNA, 20 bp, Artificial Sequence
  chemically synthesized
gtatcctacaacattagtat

SEQ ID NO: 307782 - DNA, 20 bp, Artificial Sequence
  chemically synthesized
taagtctgatactaatgttg

SEQ ID NO: 307783 - DNA, 20 bp, Artificial Sequence
  chemically synthesized
aagtctgatactaatgttgt

SEQ ID NO: 307784 - DNA, 20 bp, Artificial Sequence
  chemically synthesized
ggatctgtatcctacaacat

SEQ ID NO: 307785 - DNA, 20 bp, Artificial Sequence
  chemically synthesized
gatactaatgttgtaggata

SEQ ID NO: 307786 - DNA, 20 bp, Artificial Sequence
  chemically synthesized
tcgagatcaagaaaaaacac

SEQ ID NO: 307787 - DNA, 20 bp, Artificial Sequence
  chemically synthesized
atcgagatcaagaaaaaaca

SEQ ID NO: 307788 - DNA, 20 bp, Artificial Sequence
  chemically synthesized
tccaagagaaaatcgagatc

SEQ ID NO: 307789 - DNA, 20 bp, Artificial Sequence
  chemically synthesized
tttgtttccaagagaaaatc

SEQ ID NO: 307790 - DNA, 20 bp, Artificial Sequence
  chemically synthesized
tcttgatctcgattttctct

SEQ ID NO: 307791 - DNA, 20 bp, Artificial Sequence
  chemically synthesized
tctactcagtttgtttccaa

SEQ ID NO: 307792 - DNA, 20 bp, Artificial Sequence
  chemically synthesized
catctactcagtttgtttcc

SEQ ID NO: 307793 - DNA, 20 bp, Artificial Sequence
  chemically synthesized
ttttctcttggaaacaaact

SEQ ID NO: 307794 - DNA, 20 bp, Artificial Sequence
  chemically synthesized
tctcttggaaacaaactgag

SEQ ID NO: 307795 - DNA, 20 bp, Artificial Sequence
  chemically synthesized
ttggaaacaaactgagtaga

SEQ ID NO: 307796 - DNA, 20 bp, Artificial Sequence
  chemically synthesized
gttcattaggaccatctact

SEQ ID NO: 307797 - DNA, 20 bp, Artificial Sequence
  chemically synthesized
ttacacatgtaaagttcatt

SEQ ID NO: 307798 - DNA, 20 bp, Artificial Sequence
  chemically synthesized
attacacatgtaaagttcat

SEQ ID NO: 307799 - DNA, 20 bp, Artificial Sequence
  chemically synthesized
tcaatctcattacacatgta

SEQ ID NO: 307800 - DNA, 20 bp, Artificial Sequence
  chemically synthesized
atgaactttacatgtgtaat

SEQ ID NO: 307801 - DNA, 20 bp, Artificial Sequence
  chemically synthesized
ttacatgtgtaatgagattg

SEQ ID NO: 307802 - DNA, 20 bp, Artificial Sequence
  chemically synthesized
taatgagattgaagaaacac

SEQ ID NO: 307803 - DNA, 20 bp, Artificial Sequence
  chemically synthesized
agattgaagaaacactagat

SEQ ID NO: 307804 - DNA, 20 bp, Artificial Sequence
  chemically synthesized
atgagattttgcatctcatc

SEQ ID NO: 307805 - DNA, 20 bp, Artificial Sequence
  chemically synthesized
atgagatgcaaaatctcatc

SEQ ID NO: 307806 - DNA, 20 bp, Artificial Sequence
  chemically synthesized
caaatatgttaaagctagat

SEQ ID NO: 307807 - DNA, 20 bp, Artificial Sequence
  chemically synthesized
aaatccaaatatgttaaagc

SEQ ID NO: 307808 - DNA, 20 bp, Artificial Sequence
  chemically synthesized
gacaaaatccaaatatgtta

SEQ ID NO: 307809 - DNA, 20 bp, Artificial Sequence
  chemically synthesized
tcatctagctttaacatatt

SEQ ID NO: 307810 - DNA, 20 bp, Artificial Sequence
  chemically synthesized
ttaacatatttggattttgt

SEQ ID NO: 307811 - DNA, 20 bp, Artificial Sequence
  chemically synthesized
atttggattttgtcagtttg

SEQ ID NO: 307812 - DNA, 20 bp, Artificial Sequence
  chemically synthesized
ttgtcagtttgtggcttcct

SEQ ID NO: 307813 - DNA, 20 bp, Artificial Sequence
  chemically synthesized
tcaagaaagttgttcttagg

SEQ ID NO: 307814 - DNA, 20 bp, Artificial Sequence
  chemically synthesized
caatcaagaaagttgttctt

SEQ ID NO: 307815 - DNA, 20 bp, Artificial Sequence
  chemically synthesized
ccaatcaagaaagttgttct

SEQ ID NO: 307816 - DNA, 20 bp, Artificial Sequence
  chemically synthesized
ctaagaacaactttcttgat

SEQ ID NO: 307817 - DNA, 20 bp, Artificial Sequence
  chemically synthesized
actagatttaccaatcaaga

SEQ ID NO: 307818 - DNA, 20 bp, Artificial Sequence
  chemically synthesized
gttgactagatttaccaatc

SEQ ID NO: 307819 - DNA, 20 bp, Artificial Sequence
  chemically synthesized
actttcttgattggtaaatc

SEQ ID NO: 307820 - DNA, 20 bp, Artificial Sequence
  chemically synthesized
ttcctgcatatattgttgac

SEQ ID NO: 307821 - DNA, 20 bp, Artificial Sequence
  chemically synthesized
aatctagtcaacaatatatg

SEQ ID NO: 307822 - DNA, 20 bp, Artificial Sequence
  chemically synthesized
atctagtcaacaatatatgc

SEQ ID NO: 307823 - DNA, 20 bp, Artificial Sequence
  chemically synthesized
atatatgcaggaactttgac

SEQ ID NO: 307824 - DNA, 20 bp, Artificial Sequence
  chemically synthesized
caaatcttaatatctagtca

SEQ ID NO: 307825 - DNA, 20 bp, Artificial Sequence
  chemically synthesized
aggaactttgactagatatt

SEQ ID NO: 307826 - DNA, 20 bp, Artificial Sequence
  chemically synthesized
aaattccaaatcttaatatc

SEQ ID NO: 307827 - DNA, 20 bp, Artificial Sequence
  chemically synthesized
tttgactagatattaagatt

SEQ ID NO: 307828 - DNA, 20 bp, Artificial Sequence
  chemically synthesized
taccacatgccagaatagta

SEQ ID NO: 307829 - DNA, 20 bp, Artificial Sequence
  chemically synthesized
gtaaaataactgtactattc

SEQ ID NO: 307830 - DNA, 20 bp, Artificial Sequence
  chemically synthesized
gaaagtaccacatgccagaa

SEQ ID NO: 307831 - DNA, 20 bp, Artificial Sequence
  chemically synthesized
aactgtactattctggcatg

SEQ ID NO: 307832 - DNA, 20 bp, Artificial Sequence
  chemically synthesized
ctttggaaagtaccacatgc

SEQ ID NO: 307833 - DNA, 20 bp, Artificial Sequence
  chemically synthesized
ctggcatgtggtactttcca

SEQ ID NO: 307834 - DNA, 20 bp, Artificial Sequence
  chemically synthesized
attttacagccatctttgga

SEQ ID NO: 307835 - DNA, 20 bp, Artificial Sequence
  chemically synthesized
catgtggtactttccaaaga

SEQ ID NO: 307836 - DNA, 20 bp, Artificial Sequence
  chemically synthesized
ggatattttacagccatctt

SEQ ID NO: 307837 - DNA, 20 bp, Artificial Sequence
  chemically synthesized
tctgagatgaggatatttta

SEQ ID NO: 307838 - DNA, 20 bp, Artificial Sequence
  chemically synthesized
gctgtaaaatatcctcatct

SEQ ID NO: 307839 - DNA, 20 bp, Artificial Sequence
  chemically synthesized
atagcaaagcatctgagatg

SEQ ID NO: 307840 - DNA, 20 bp, Artificial Sequence
  chemically synthesized
tatagcaaagcatctgagat

SEQ ID NO: 307841 - DNA, 20 bp, Artificial Sequence
  chemically synthesized
caagttatagcaaagcatct

SEQ ID NO: 307842 - DNA, 20 bp, Artificial Sequence
  chemically synthesized
accaaggtcaagttatagca

SEQ ID NO: 307843 - DNA, 20 bp, Artificial Sequence
  chemically synthesized
gaaacaccaaggtcaagtta

SEQ ID NO: 307844 - DNA, 20 bp, Artificial Sequence
  chemically synthesized
gctttgctataacttgacct

SEQ ID NO: 307845 - DNA, 20 bp, Artificial Sequence
  chemically synthesized
catggagaaacaccaaggtc

SEQ ID NO: 307846 - DNA, 20 bp, Artificial Sequence
  chemically synthesized
ttcctcatggagaaacacca

SEQ ID NO: 307847 - DNA, 20 bp, Artificial Sequence
  chemically synthesized
tttcctcatggagaaacacc

SEQ ID NO: 307848 - DNA, 20 bp, Artificial Sequence
  chemically synthesized
tgaccttggtgtttctccat

SEQ ID NO: 307849 - DNA, 20 bp, Artificial Sequence
  chemically synthesized
gaccttggtgtttctccatg

SEQ ID NO: 307850 - DNA, 20 bp, Artificial Sequence
  chemically synthesized
ttagatttcatttcctcatg

SEQ ID NO: 307851 - DNA, 20 bp, Artificial Sequence
  chemically synthesized
aattagatttcatttcctca

SEQ ID NO: 307852 - DNA, 20 bp, Artificial Sequence
  chemically synthesized
agattcaaggaaaagggaat

SEQ ID NO: 307853 - DNA, 20 bp, Artificial Sequence
  chemically synthesized
ctgcccagattcaaggaaaa

SEQ ID NO: 307854 - DNA, 20 bp, Artificial Sequence
  chemically synthesized
cctgcccagattcaaggaaa

SEQ ID NO: 307855 - DNA, 20 bp, Artificial Sequence
  chemically synthesized
gcctgcccagattcaaggaa

SEQ ID NO: 307856 - DNA, 20 bp, Artificial Sequence
  chemically synthesized
aattcccttttccttgaatc

SEQ ID NO: 307857 - DNA, 20 bp, Artificial Sequence
  chemically synthesized
attcccttttccttgaatct

SEQ ID NO: 307858 - DNA, 20 bp, Artificial Sequence
  chemically synthesized
cacaagcctgcccagattca

SEQ ID NO: 307859 - DNA, 20 bp, Artificial Sequence
  chemically synthesized
tcacaagcctgcccagattc

SEQ ID NO: 307860 - DNA, 20 bp, Artificial Sequence
  chemically synthesized
cccttttccttgaatctggg

SEQ ID NO: 307861 - DNA, 20 bp, Artificial Sequence
  chemically synthesized
ccttttccttgaatctgggc

SEQ ID NO: 307862 - DNA, 20 bp, Artificial Sequence
  chemically synthesized
gaaaaagtcacaagcctgcc

SEQ ID NO: 307863 - DNA, 20 bp, Artificial Sequence
  chemically synthesized
ctgtgtgctgaaaaagtcac

SEQ ID NO: 307864 - DNA, 20 bp, Artificial Sequence
  chemically synthesized
gggcaggcttgtgacttttt

SEQ ID NO: 307865 - DNA, 20 bp, Artificial Sequence
  chemically synthesized
tcatattctgtgtgctgaaa

SEQ ID NO: 307866 - DNA, 20 bp, Artificial Sequence
  chemically synthesized
cttgtgactttttcagcaca

SEQ ID NO: 307867 - DNA, 20 bp, Artificial Sequence
  chemically synthesized
tcaatcataatggtgatggt

SEQ ID NO: 307868 - DNA, 20 bp, Artificial Sequence
  chemically synthesized
acggtcaatcataatggtga

SEQ ID NO: 307869 - DNA, 20 bp, Artificial Sequence
  chemically synthesized
cttcagacggtcaatcataa

SEQ ID NO: 307870 - DNA, 20 bp, Artificial Sequence
  chemically synthesized
ccattatgattgaccgtctg

SEQ ID NO: 307871 - DNA, 20 bp, Artificial Sequence
  chemically synthesized
acagaatcatgtgcttcaga

SEQ ID NO: 307872 - DNA, 20 bp, Artificial Sequence
  chemically synthesized
aaatacagaatcatgtgctt

SEQ ID NO: 307873 - DNA, 20 bp, Artificial Sequence
  chemically synthesized
gatatattgctagttaaata

SEQ ID NO: 307874 - DNA, 20 bp, Artificial Sequence
  chemically synthesized
cacatgattctgtatttaac

SEQ ID NO: 307875 - DNA, 20 bp, Artificial Sequence
  chemically synthesized
taggagcgaagatatattgc

SEQ ID NO: 307876 - DNA, 20 bp, Artificial Sequence
  chemically synthesized
atgccctctgattaggagcg

SEQ ID NO: 307877 - DNA, 20 bp, Artificial Sequence
  chemically synthesized
aatatatcttcgctcctaat

SEQ ID NO: 307878 - DNA, 20 bp, Artificial Sequence
  chemically synthesized
tatatcttcgctcctaatca

SEQ ID NO: 307879 - DNA, 20 bp, Artificial Sequence
  chemically synthesized
cagtcatgccctctgattag

SEQ ID NO: 307880 - DNA, 20 bp, Artificial Sequence
  chemically synthesized
atatcttcgctcctaatcag

SEQ ID NO: 307881 - DNA, 20 bp, Artificial Sequence
  chemically synthesized
tatcttcgctcctaatcaga

SEQ ID NO: 307882 - DNA, 20 bp, Artificial Sequence
  chemically synthesized
tgcagtcatgccctctgatt

SEQ ID NO: 307883 - DNA, 20 bp, Artificial Sequence
  chemically synthesized
atgcagtcatgccctctgat

SEQ ID NO: 307884 - DNA, 20 bp, Artificial Sequence
  chemically synthesized
gaccactgattatcaaaatg

SEQ ID NO: 307885 - DNA, 20 bp, Artificial Sequence
  chemically synthesized
catgactgcattttgataat

SEQ ID NO: 307886 - DNA, 20 bp, Artificial Sequence
  chemically synthesized
gactgcattttgataatcag

SEQ ID NO: 307887 - DNA, 20 bp, Artificial Sequence
  chemically synthesized
aatcctttcagtaaataagt

SEQ ID NO: 307888 - DNA, 20 bp, Artificial Sequence
  chemically synthesized
tgtgaatcctttcagtaaat

SEQ ID NO: 307889 - DNA, 20 bp, Artificial Sequence
  chemically synthesized
gtcactcacttatttactga

SEQ ID NO: 307890 - DNA, 20 bp, Artificial Sequence
  chemically synthesized
tcactcacttatttactgaa

SEQ ID NO: 307891 - DNA, 20 bp, Artificial Sequence
  chemically synthesized
aggcaaaatgtgaatccttt

SEQ ID NO: 307892 - DNA, 20 bp, Artificial Sequence
  chemically synthesized
aaaggattcacattttgcct

SEQ ID NO: 307893 - DNA, 20 bp, Artificial Sequence
  chemically synthesized
ggattcacattttgcctgag

SEQ ID NO: 307894 - DNA, 20 bp, Artificial Sequence
  chemically synthesized
ttacaaacattgttcttctc

SEQ ID NO: 307895 - DNA, 20 bp, Artificial Sequence
  chemically synthesized
cttacaaacattgttcttct

SEQ ID NO: 307896 - DNA, 20 bp, Artificial Sequence
  chemically synthesized
ctgagaagaacaatgtttgt

SEQ ID NO: 307897 - DNA, 20 bp, Artificial Sequence
  chemically synthesized
tgagaagaacaatgtttgta

SEQ ID NO: 307898 - DNA, 20 bp, Artificial Sequence
  chemically synthesized
tgtaaggaatattctgcttt

SEQ ID NO: 307899 - DNA, 20 bp, Artificial Sequence
  chemically synthesized
gtaaggaatattctgcttta

SEQ ID NO: 307900 - DNA, 20 bp, Artificial Sequence
  chemically synthesized
aaggaatattctgctttaag

SEQ ID NO: 307901 - DNA, 20 bp, Artificial Sequence
  chemically synthesized
tggattacatctccttaaag

SEQ ID NO: 307902 - DNA, 20 bp, Artificial Sequence
  chemically synthesized
gcatggattacatctcctta

SEQ ID NO: 307903 - DNA, 20 bp, Artificial Sequence
  chemically synthesized
tatctagaggaatggatgca

SEQ ID NO: 307904 - DNA, 20 bp, Artificial Sequence
  chemically synthesized
aatccatgcatccattcctc

SEQ ID NO: 307905 - DNA, 20 bp, Artificial Sequence
  chemically synthesized
ttctatcatatctagaggaa

SEQ ID NO: 307906 - DNA, 20 bp, Artificial Sequence
  chemically synthesized
agggattctatcatatctag

SEQ ID NO: 307907 - DNA, 20 bp, Artificial Sequence
  chemically synthesized
gagggattctatcatatcta

SEQ ID NO: 307908 - DNA, 20 bp, Artificial Sequence
  chemically synthesized
atccattcctctagatatga

SEQ ID NO: 307909 - DNA, 20 bp, Artificial Sequence
  chemically synthesized
atgagggattctatcatatc

SEQ ID NO: 307910 - DNA, 20 bp, Artificial Sequence
  chemically synthesized
aggagaggataaattcatga

SEQ ID NO: 307911 - DNA, 20 bp, Artificial Sequence
  chemically synthesized
gaggagaggataaattcatg

SEQ ID NO: 307912 - DNA, 20 bp, Artificial Sequence
  chemically synthesized
agaggagaggataaattcat

SEQ ID NO: 307913 - DNA, 20 bp, Artificial Sequence
  chemically synthesized
tcacatgccacagagaggag

SEQ ID NO: 307914 - DNA, 20 bp, Artificial Sequence
  chemically synthesized
gtcacatgccacagagagga

SEQ ID NO: 307915 - DNA, 20 bp, Artificial Sequence
  chemically synthesized
aatttatcctctcctctctg

SEQ ID NO: 307916 - DNA, 20 bp, Artificial Sequence
  chemically synthesized
ctgtcacatgccacagagag

SEQ ID NO: 307917 - DNA, 20 bp, Artificial Sequence
  chemically synthesized
cactgtcacatgccacagag

SEQ ID NO: 307918 - DNA, 20 bp, Artificial Sequence
  chemically synthesized
acactgtcacatgccacaga

SEQ ID NO: 307919 - DNA, 20 bp, Artificial Sequence
  chemically synthesized
acacactgtcacatgccaca

SEQ ID NO: 307920 - DNA, 20 bp, Artificial Sequence
  chemically synthesized
gtacacactgtcacatgcca

SEQ ID NO: 307921 - DNA, 20 bp, Artificial Sequence
  chemically synthesized
ctcctctctgtggcatgtga

SEQ ID NO: 307922 - DNA, 20 bp, Artificial Sequence
  chemically synthesized
gatttcaaaaaagtaggaag

SEQ ID NO: 307923 - DNA, 20 bp, Artificial Sequence
  chemically synthesized
aaagatttcaaaaaagtagg

SEQ ID NO: 307924 - DNA, 20 bp, Artificial Sequence
  chemically synthesized
aataaagatttcaaaaaagt

SEQ ID NO: 307925 - DNA, 20 bp, Artificial Sequence
  chemically synthesized
gaataaagatttcaaaaaag

SEQ ID NO: 307926 - DNA, 20 bp, Artificial Sequence
  chemically synthesized
ggagaataaagatttcaaaa

SEQ ID NO: 307927 - DNA, 20 bp, Artificial Sequence
  chemically synthesized
tcacaaaagtgaggagaata

SEQ ID NO: 307928 - DNA, 20 bp, Artificial Sequence
  chemically synthesized
agtggtatcacaaaagtgag

SEQ ID NO: 307929 - DNA, 20 bp, Artificial Sequence
  chemically synthesized
aaagtggtatcacaaaagtg

SEQ ID NO: 307930 - DNA, 20 bp, Artificial Sequence
  chemically synthesized
gaaagtggtatcacaaaagt

SEQ ID NO: 307931 - DNA, 20 bp, Artificial Sequence
  chemically synthesized
aggggaaagtggtatcacaa

SEQ ID NO: 307932 - DNA, 20 bp, Artificial Sequence
  chemically synthesized
cagataccacaaggggaaag

SEQ ID NO: 307933 - DNA, 20 bp, Artificial Sequence
  chemically synthesized
gagcagataccacaagggga

SEQ ID NO: 307934 - DNA, 20 bp, Artificial Sequence
  chemically synthesized
gtgataccactttccccttg

SEQ ID NO: 307935 - DNA, 20 bp, Artificial Sequence
  chemically synthesized
gattgagcagataccacaag

SEQ ID NO: 307936 - DNA, 20 bp, Artificial Sequence
  chemically synthesized
agattgagcagataccacaa

SEQ ID NO: 307937 - DNA, 20 bp, Artificial Sequence
  chemically synthesized
aagattgagcagataccaca

SEQ ID NO: 307938 - DNA, 20 bp, Artificial Sequence
  chemically synthesized
aaagattgagcagataccac

SEQ ID NO: 307939 - DNA, 20 bp, Artificial Sequence
  chemically synthesized
atgttgaccaaaagattgag

SEQ ID NO: 307940 - DNA, 20 bp, Artificial Sequence
  chemically synthesized
gtggtatctgctcaatcttt

SEQ ID NO: 307941 - DNA, 20 bp, Artificial Sequence
  chemically synthesized
aagatgttgaccaaaagatt

SEQ ID NO: 307942 - DNA, 20 bp, Artificial Sequence
  chemically synthesized
gaggataagatgttgaccaa

SEQ ID NO: 307943 - DNA, 20 bp, Artificial Sequence
  chemically synthesized
tcaaggagtaggcagaggat

SEQ ID NO: 307944 - DNA, 20 bp, Artificial Sequence
  chemically synthesized
tacaatcaaggagtaggcag

SEQ ID NO: 307945 - DNA, 20 bp, Artificial Sequence
  chemically synthesized
ctacaatcaaggagtaggca

SEQ ID NO: 307946 - DNA, 20 bp, Artificial Sequence
  chemically synthesized
gtctacaatcaaggagtagg

SEQ ID NO: 307947 - DNA, 20 bp, Artificial Sequence
  chemically synthesized
aatgtctacaatcaaggagt

SEQ ID NO: 307948 - DNA, 20 bp, Artificial Sequence
  chemically synthesized
gaatgtctacaatcaaggag

SEQ ID NO: 307949 - DNA, 20 bp, Artificial Sequence
  chemically synthesized
gaggaatgtctacaatcaag

SEQ ID NO: 307950 - DNA, 20 bp, Artificial Sequence
  chemically synthesized
ctctgcctactccttgattg

SEQ ID NO: 307951 - DNA, 20 bp, Artificial Sequence
  chemically synthesized
gggaggaatgtctacaatca

SEQ ID NO: 307952 - DNA, 20 bp, Artificial Sequence
  chemically synthesized
agggaggaatgtctacaatc

SEQ ID NO: 307953 - DNA, 20 bp, Artificial Sequence
  chemically synthesized
gaaacgaatagatttcaggg

SEQ ID NO: 307954 - DNA, 20 bp, Artificial Sequence
  chemically synthesized
tgaaacgaatagatttcagg

SEQ ID NO: 307955 - DNA, 20 bp, Artificial Sequence
  chemically synthesized
agtgaaacgaatagatttca

SEQ ID NO: 307956 - DNA, 20 bp, Artificial Sequence
  chemically synthesized
aagtgaaacgaatagatttc

SEQ ID NO: 307957 - DNA, 20 bp, Artificial Sequence
  chemically synthesized
taagtgaaacgaatagattt

SEQ ID NO: 307958 - DNA, 20 bp, Artificial Sequence
  chemically synthesized
gacacattaagtgaaacgaa

SEQ ID NO: 307959 - DNA, 20 bp, Artificial Sequence
  chemically synthesized
attgtgtagagtgacacatt

SEQ ID NO: 307960 - DNA, 20 bp, Artificial Sequence
  chemically synthesized
tgcttctgagggattgtgta

SEQ ID NO: 307961 - DNA, 20 bp, Artificial Sequence
  chemically synthesized
aatgcttctgagggattgtg

SEQ ID NO: 307962 - DNA, 20 bp, Artificial Sequence
  chemically synthesized
tgtcactctacacaatccct

SEQ ID NO: 307963 - DNA, 20 bp, Artificial Sequence
  chemically synthesized
cactctacacaatccctcag

SEQ ID NO: 307964 - DNA, 20 bp, Artificial Sequence
  chemically synthesized
agcaatcaaaatgcttctga

SEQ ID NO: 307965 - DNA, 20 bp, Artificial Sequence
  chemically synthesized
aagcaatcaaaatgcttctg

SEQ ID NO: 307966 - DNA, 20 bp, Artificial Sequence
  chemically synthesized
gaagcaatcaaaatgcttct

SEQ ID NO: 307967 - DNA, 20 bp, Artificial Sequence
  chemically synthesized
atgactagttattgattcag

SEQ ID NO: 307968 - DNA, 20 bp, Artificial Sequence
  chemically synthesized
ttcatgactagttattgatt

SEQ ID NO: 307969 - DNA, 20 bp, Artificial Sequence
  chemically synthesized
attgcttctgaatcaataac

SEQ ID NO: 307970 - DNA, 20 bp, Artificial Sequence
  chemically synthesized
ctcagaaaatggttcatgac

SEQ ID NO: 307971 - DNA, 20 bp, Artificial Sequence
  chemically synthesized
ctagtcatgaaccattttct

SEQ ID NO: 307972 - DNA, 20 bp, Artificial Sequence
  chemically synthesized
acaactagaatctcagaaaa

SEQ ID NO: 307973 - DNA, 20 bp, Artificial Sequence
  chemically synthesized
tgaaccattttctgagattc

SEQ ID NO: 307974 - DNA, 20 bp, Artificial Sequence
  chemically synthesized
ggtttacacaactagaatct

SEQ ID NO: 307975 - DNA, 20 bp, Artificial Sequence
  chemically synthesized
aatcagttggtttacacaac

SEQ ID NO: 307976 - DNA, 20 bp, Artificial Sequence
  chemically synthesized
aatcctttccattaatcagt

SEQ ID NO: 307977 - DNA, 20 bp, Artificial Sequence
  chemically synthesized
tgtgtaaaccaactgattaa

SEQ ID NO: 307978 - DNA, 20 bp, Artificial Sequence
  chemically synthesized
taaaaatcctttccattaat

SEQ ID NO: 307979 - DNA, 20 bp, Artificial Sequence
  chemically synthesized
taaaccaactgattaatgga

SEQ ID NO: 307980 - DNA, 20 bp, Artificial Sequence
  chemically synthesized
aaaccaactgattaatggaa

SEQ ID NO: 307981 - DNA, 20 bp, Artificial Sequence
  chemically synthesized
aatggaaaggatttttaact

SEQ ID NO: 307982 - DNA, 20 bp, Artificial Sequence
  chemically synthesized
aaaatgtctttgagacatcc

SEQ ID NO: 307983 - DNA, 20 bp, Artificial Sequence
  chemically synthesized
tttttaacttggatgtctca

SEQ ID NO: 307984 - DNA, 20 bp, Artificial Sequence
  chemically synthesized
attccgtgtaaaatgtcttt

SEQ ID NO: 307985 - DNA, 20 bp, Artificial Sequence
  chemically synthesized
tgtctcaaagacattttaca

SEQ ID NO: 307986 - DNA, 20 bp, Artificial Sequence
  chemically synthesized
aatgataattatttcagatt

SEQ ID NO: 307987 - DNA, 20 bp, Artificial Sequence
  chemically synthesized
gacaaaaatgataattattt

SEQ ID NO: 307988 - DNA, 20 bp, Artificial Sequence
  chemically synthesized
aattatcatttttgtcattc

SEQ ID NO: 307989 - DNA, 20 bp, Artificial Sequence
  chemically synthesized
gagaatagaagaggaattgc

SEQ ID NO: 307990 - DNA, 20 bp, Artificial Sequence
  chemically synthesized
ccctaacaggagaatagaag

SEQ ID NO: 307991 - DNA, 20 bp, Artificial Sequence
  chemically synthesized
gccctaacaggagaatagaa

SEQ ID NO: 307992 - DNA, 20 bp, Artificial Sequence
  chemically synthesized
tagccctaacaggagaatag

SEQ ID NO: 307993 - DNA, 20 bp, Artificial Sequence
  chemically synthesized
tattagccctaacaggagaa

SEQ ID NO: 307994 - DNA, 20 bp, Artificial Sequence
  chemically synthesized
ttcctcttctattctcctgt

SEQ ID NO: 307995 - DNA, 20 bp, Artificial Sequence
  chemically synthesized
tcctcttctattctcctgtt

SEQ ID NO: 307996 - DNA, 20 bp, Artificial Sequence
  chemically synthesized
cctcttctattctcctgtta

SEQ ID NO: 307997 - DNA, 20 bp, Artificial Sequence
  chemically synthesized
agggttattagccctaacag

SEQ ID NO: 307998 - DNA, 20 bp, Artificial Sequence
  chemically synthesized
ggagggttattagccctaac

SEQ ID NO: 307999 - DNA, 20 bp, Artificial Sequence
  chemically synthesized
aggagggttattagccctaa

SEQ ID NO: 308000 - DNA, 20 bp, Artificial Sequence
  chemically synthesized
tgggttcctaggagggttat

SEQ ID NO: 308001 - DNA, 20 bp, Artificial Sequence
  chemically synthesized
gttagggctaataaccctcc

SEQ ID NO: 308002 - DNA, 20 bp, Artificial Sequence
  chemically synthesized
ttagggctaataaccctcct

SEQ ID NO: 308003 - DNA, 20 bp, Artificial Sequence
  chemically synthesized
gggtgactgggttcctagga

SEQ ID NO: 308004 - DNA, 20 bp, Artificial Sequence
  chemically synthesized
tgggtgactgggttcctagg

SEQ ID NO: 308005 - DNA, 20 bp, Artificial Sequence
  chemically synthesized
ttgggtgactgggttcctag

SEQ ID NO: 308006 - DNA, 20 bp, Artificial Sequence
  chemically synthesized
taataaccctcctaggaacc

SEQ ID NO: 308007 - DNA, 20 bp, Artificial Sequence
  chemically synthesized
atttgggtgactgggttcct

SEQ ID NO: 308008 - DNA, 20 bp, Artificial Sequence
  chemically synthesized
catttgggtgactgggttcc

SEQ ID NO: 308009 - DNA, 20 bp, Artificial Sequence
  chemically synthesized
gacatttcatttgggtgact

SEQ ID NO: 308010 - DNA, 20 bp, Artificial Sequence
  chemically synthesized
agacatttcatttgggtgac

SEQ ID NO: 308011 - DNA, 20 bp, Artificial Sequence
  chemically synthesized
ggttcctagacatttcattt

SEQ ID NO: 308012 - DNA, 20 bp, Artificial Sequence
  chemically synthesized
tggttcctagacatttcatt

SEQ ID NO: 308013 - DNA, 20 bp, Artificial Sequence
  chemically synthesized
agtcacccaaatgaaatgtc

SEQ ID NO: 308014 - DNA, 20 bp, Artificial Sequence
  chemically synthesized
gtcacccaaatgaaatgtct

SEQ ID NO: 308015 - DNA, 20 bp, Artificial Sequence
  chemically synthesized
cagaagtttgaaatggttcc

SEQ ID NO: 308016 - DNA, 20 bp, Artificial Sequence
  chemically synthesized
taagaggcagaagtttgaaa

SEQ ID NO: 308017 - DNA, 20 bp, Artificial Sequence
  chemically synthesized
aaacttgtgataagaggcag

SEQ ID NO: 308018 - DNA, 20 bp, Artificial Sequence
  chemically synthesized
atgaaacttgtgataagagg

SEQ ID NO: 308019 - DNA, 20 bp, Artificial Sequence
  chemically synthesized
tgaatgaaacttgtgataag

SEQ ID NO: 308020 - DNA, 20 bp, Artificial Sequence
  chemically synthesized
aaacttctgcctcttatcac

SEQ ID NO: 308021 - DNA, 20 bp, Artificial Sequence
  chemically synthesized
atgaatgaaacttgtgataa

SEQ ID NO: 308022 - DNA, 20 bp, Artificial Sequence
  chemically synthesized
tgatgaatgaaacttgtgat

SEQ ID NO: 308023 - DNA, 20 bp, Artificial Sequence
  chemically synthesized
aagagaaacattagaatgtt

SEQ ID NO: 308024 - DNA, 20 bp, Artificial Sequence
  chemically synthesized
taagataagaagagaaacat

SEQ ID NO: 308025 - DNA, 20 bp, Artificial Sequence
  chemically synthesized
attgggcattaagataagaa

SEQ ID NO: 308026 - DNA, 20 bp, Artificial Sequence
  chemically synthesized
gcattgggcattaagataag

SEQ ID NO: 308027 - DNA, 20 bp, Artificial Sequence
  chemically synthesized
gtagcattgggcattaagat

SEQ ID NO: 308028 - DNA, 20 bp, Artificial Sequence
  chemically synthesized
actaagtagcattgggcatt

SEQ ID NO: 308029 - DNA, 20 bp, Artificial Sequence
  chemically synthesized
gacctgaactaagtagcatt

SEQ ID NO: 308030 - DNA, 20 bp, Artificial Sequence
  chemically synthesized
agacctgaactaagtagcat

SEQ ID NO: 308031 - DNA, 20 bp, Artificial Sequence
  chemically synthesized
tcttaatgcccaatgctact

SEQ ID NO: 308032 - DNA, 20 bp, Artificial Sequence
  chemically synthesized
atgcccaatgctacttagtt

SEQ ID NO: 308033 - DNA, 20 bp, Artificial Sequence
  chemically synthesized
atcagaagacctgaactaag

SEQ ID NO: 308034 - DNA, 20 bp, Artificial Sequence
  chemically synthesized
tgcccaatgctacttagttc

SEQ ID NO: 308035 - DNA, 20 bp, Artificial Sequence
  chemically synthesized
ctaatcagaagacctgaact

SEQ ID NO: 308036 - DNA, 20 bp, Artificial Sequence
  chemically synthesized
cttagttcaggtcttctgat

SEQ ID NO: 308037 - DNA, 20 bp, Artificial Sequence
  chemically synthesized
atggtacgaggactaatcag

SEQ ID NO: 308038 - DNA, 20 bp, Artificial Sequence
  chemically synthesized
ttgatggtacgaggactaat

SEQ ID NO: 308039 - DNA, 20 bp, Artificial Sequence
  chemically synthesized
ggaagatgtttgatggtacg

SEQ ID NO: 308040 - DNA, 20 bp, Artificial Sequence
  chemically synthesized
aggaagatgtttgatggtac

SEQ ID NO: 308041 - DNA, 20 bp, Artificial Sequence
  chemically synthesized
tttggtaggaagatgtttga

SEQ ID NO: 308042 - DNA, 20 bp, Artificial Sequence
  chemically synthesized
ttgtaattctttttggtagg

SEQ ID NO: 308043 - DNA, 20 bp, Artificial Sequence
  chemically synthesized
tcaaacatcttcctaccaaa

SEQ ID NO: 308044 - DNA, 20 bp, Artificial Sequence
  chemically synthesized
tttttgtaattctttttggt

SEQ ID NO: 308045 - DNA, 20 bp, Artificial Sequence
  chemically synthesized
atttttgtaattctttttgg

SEQ ID NO: 308046 - DNA, 20 bp, Artificial Sequence
  chemically synthesized
tgcatttttgtaattctttt

SEQ ID NO: 308047 - DNA, 20 bp, Artificial Sequence
  chemically synthesized
gagccattgagagtttgcaa

SEQ ID NO: 308048 - DNA, 20 bp, Artificial Sequence
  chemically synthesized
attcttttgcaaactctcaa

SEQ ID NO: 308049 - DNA, 20 bp, Artificial Sequence
  chemically synthesized
agctgatggggagccattga

SEQ ID NO: 308050 - DNA, 20 bp, Artificial Sequence
  chemically synthesized
gcagctgatggggagccatt

SEQ ID NO: 308051 - DNA, 20 bp, Artificial Sequence
  chemically synthesized
aactctcaatggctccccat

SEQ ID NO: 308052 - DNA, 20 bp, Artificial Sequence
  chemically synthesized
tttggcctgcagctgatggg

SEQ ID NO: 308053 - DNA, 20 bp, Artificial Sequence
  chemically synthesized
gttttggcctgcagctgatg

SEQ ID NO: 308054 - DNA, 20 bp, Artificial Sequence
  chemically synthesized
agttttggcctgcagctgat

SEQ ID NO: 308055 - DNA, 20 bp, Artificial Sequence
  chemically synthesized
caatggctccccatcagctg

SEQ ID NO: 308056 - DNA, 20 bp, Artificial Sequence
  chemically synthesized
tagttttggcctgcagctga

SEQ ID NO: 308057 - DNA, 20 bp, Artificial Sequence
  chemically synthesized
aatggctccccatcagctgc

SEQ ID NO: 308058 - DNA, 20 bp, Artificial Sequence
  chemically synthesized
gtatttgtagttttggcctg

SEQ ID NO: 308059 - DNA, 20 bp, Artificial Sequence
  chemically synthesized
atcagctgtatttgtagttt

SEQ ID NO: 308060 - DNA, 20 bp, Artificial Sequence
  chemically synthesized
gcaggccaaaactacaaata

SEQ ID NO: 308061 - DNA, 20 bp, Artificial Sequence
  chemically synthesized
aaaaatatcagctgtatttg

SEQ ID NO: 308062 - DNA, 20 bp, Artificial Sequence
  chemically synthesized
aaacacgagtgcaaaaatat

SEQ ID NO: 308063 - DNA, 20 bp, Artificial Sequence
  chemically synthesized
ctgtatatgtttgaaaacac

SEQ ID NO: 308064 - DNA, 20 bp, Artificial Sequence
  chemically synthesized
ctcgtgttttcaaacatata

SEQ ID NO: 308065 - DNA, 20 bp, Artificial Sequence
  chemically synthesized
tcgtgttttcaaacatatac

SEQ ID NO: 308066 - DNA, 20 bp, Artificial Sequence
  chemically synthesized
gccgaaaatagagttcagaa

SEQ ID NO: 308067 - DNA, 20 bp, Artificial Sequence
  chemically synthesized
tgactgccgaaaatagagtt

SEQ ID NO: 308068 - DNA, 20 bp, Artificial Sequence
  chemically synthesized
acttttctgaactctatttt

SEQ ID NO: 308069 - DNA, 20 bp, Artificial Sequence
  chemically synthesized
tgatgtgactgccgaaaata

SEQ ID NO: 308070 - DNA, 20 bp, Artificial Sequence
  chemically synthesized
tttctgaactctattttcgg

SEQ ID NO: 308071 - DNA, 20 bp, Artificial Sequence
  chemically synthesized
agtgatgtgactgccgaaaa

SEQ ID NO: 308072 - DNA, 20 bp, Artificial Sequence
  chemically synthesized
ggcagtcacatcacttaata

SEQ ID NO: 308073 - DNA, 20 bp, Artificial Sequence
  chemically synthesized
caaagaatatggactttatt

SEQ ID NO: 308074 - DNA, 20 bp, Artificial Sequence
  chemically synthesized
aaattattgctcaaagaata

SEQ ID NO: 308075 - DNA, 20 bp, Artificial Sequence
  chemically synthesized
taataaagtccatattcttt

SEQ ID NO: 308076 - DNA, 20 bp, Artificial Sequence
  chemically synthesized
tgataagaaattattgctca

SEQ ID NO: 308077 - DNA, 20 bp, Artificial Sequence
  chemically synthesized
caagctagcttattattgat

SEQ ID NO: 308078 - DNA, 20 bp, Artificial Sequence
  chemically synthesized
aataatttcttatcaataat

SEQ ID NO: 308079 - DNA, 20 bp, Artificial Sequence
  chemically synthesized
atttcttatcaataataagc

SEQ ID NO: 308080 - DNA, 20 bp, Artificial Sequence
  chemically synthesized
tattacttgttattacaagc

SEQ ID NO: 308081 - DNA, 20 bp, Artificial Sequence
  chemically synthesized
tatgtattacttgttattac

SEQ ID NO: 308082 - DNA, 20 bp, Artificial Sequence
  chemically synthesized
ataagctagcttgtaataac

SEQ ID NO: 308083 - DNA, 20 bp, Artificial Sequence
  chemically synthesized
tgtaataacaagtaatacat

SEQ ID NO: 308084 - DNA, 20 bp, Artificial Sequence
  chemically synthesized
attggtcttttaatttaaaa

SEQ ID NO: 308085 - DNA, 20 bp, Artificial Sequence
  chemically synthesized
gtgaatctattttaaattaa

SEQ ID NO: 308086 - DNA, 20 bp, Artificial Sequence
  chemically synthesized
ttttaaattaaaagaccaat

SEQ ID NO: 308087 - DNA, 20 bp, Artificial Sequence
  chemically synthesized
tttaaattaaaagaccaatg

SEQ ID NO: 308088 - DNA, 20 bp, Artificial Sequence
  chemically synthesized
ttaaattaaaagaccaatga

SEQ ID NO: 308089 - DNA, 20 bp, Artificial Sequence
  chemically synthesized
ccataaatgctaaccctcat

SEQ ID NO: 308090 - DNA, 20 bp, Artificial Sequence
  chemically synthesized
attaaaagaccaatgagggt

SEQ ID NO: 308091 - DNA, 20 bp, Artificial Sequence
  chemically synthesized
ccaatgagggttagcattta

SEQ ID NO: 308092 - DNA, 20 bp, Artificial Sequence
  chemically synthesized
aatgagggttagcatttatg

SEQ ID NO: 308093 - DNA, 20 bp, Artificial Sequence
  chemically synthesized
aaatgtatgaaacaaataaa

SEQ ID NO: 308094 - DNA, 20 bp, Artificial Sequence
  chemically synthesized
gtatgaaacaaataaatagc

SEQ ID NO: 308095 - DNA, 20 bp, Artificial Sequence
  chemically synthesized
caaataaatagctggtaaaa

SEQ ID NO: 308096 - DNA, 20 bp, Artificial Sequence
  chemically synthesized
ttaaatacgtaccattttac

SEQ ID NO: 308097 - DNA, 20 bp, Artificial Sequence
  chemically synthesized
aaatggtacgtatttaaaat

SEQ ID NO: 308098 - DNA, 20 bp, Artificial Sequence
  chemically synthesized
tggtacgtatttaaaatgag

SEQ ID NO: 308099 - DNA, 20 bp, Artificial Sequence
  chemically synthesized
atgagtggaaaaatttactt

SEQ ID NO: 308100 - DNA, 20 bp, Artificial Sequence
  chemically synthesized
tggaaaaatttacttaagtt

SEQ ID NO: 308101 - DNA, 20 bp, Artificial Sequence
  chemically synthesized
atgcaataatttctaaactt

SEQ ID NO: 308102 - DNA, 20 bp, Artificial Sequence
  chemically synthesized
gaaattattgcattattatg

SEQ ID NO: 308103 - DNA, 20 bp, Artificial Sequence
  chemically synthesized
tgaagtacaatgcaataata

SEQ ID NO: 308104 - DNA, 20 bp, Artificial Sequence
  chemically synthesized
gaagtacaatgcaataataa

SEQ ID NO: 308105 - DNA, 20 bp, Artificial Sequence
  chemically synthesized
caataataaaggtgaaatta

SEQ ID NO: 308106 - DNA, 20 bp, Artificial Sequence
  chemically synthesized
taaaacaaaatggttgtaag

SEQ ID NO: 308107 - DNA, 20 bp, Artificial Sequence
  chemically synthesized
ttataaaacaaaatggttgt

SEQ ID NO: 308108 - DNA, 20 bp, Artificial Sequence
  chemically synthesized
tgaacttttataaaacaaaa

SEQ ID NO: 308109 - DNA, 20 bp, Artificial Sequence
  chemically synthesized
acaaccattttgttttataa

SEQ ID NO: 308110 - DNA, 20 bp, Artificial Sequence
  chemically synthesized
tgatttcttaaaatttttga

SEQ ID NO: 308111 - DNA, 20 bp, Artificial Sequence
  chemically synthesized
tcaaatctatcaaaaatttt

SEQ ID NO: 308112 - DNA, 20 bp, Artificial Sequence
  chemically synthesized
aaaaattttaagaaatcata

SEQ ID NO: 308113 - DNA, 20 bp, Artificial Sequence
  chemically synthesized
aattttaagaaatcataaag

SEQ ID NO: 308114 - DNA, 20 bp, Artificial Sequence
  chemically synthesized
cacgtgaaaaattaaactca

SEQ ID NO: 308115 - DNA, 20 bp, Artificial Sequence
  chemically synthesized
aaaaattaaactcatagtat

SEQ ID NO: 308116 - DNA, 20 bp, Artificial Sequence
  chemically synthesized
agaggccggtctgatactat

SEQ ID NO: 308117 - DNA, 20 bp, Artificial Sequence
  chemically synthesized
ttaaactcatagtatcagac

SEQ ID NO: 308118 - DNA, 20 bp, Artificial Sequence
  chemically synthesized
tcatttctagtaaaagaggc

SEQ ID NO: 308119 - DNA, 20 bp, Artificial Sequence
  chemically synthesized
atcagaccggcctcttttac

SEQ ID NO: 308120 - DNA, 20 bp, Artificial Sequence
  chemically synthesized
tttatcatttctagtaaaag

SEQ ID NO: 308121 - DNA, 20 bp, Artificial Sequence
  chemically synthesized
ttttatcatttctagtaaaa

SEQ ID NO: 308122 - DNA, 20 bp, Artificial Sequence
  chemically synthesized
aattttatcatttctagtaa

SEQ ID NO: 308123 - DNA, 20 bp, Artificial Sequence
  chemically synthesized
tctgtgaattttatcatttc

SEQ ID NO: 308124 - DNA, 20 bp, Artificial Sequence
  chemically synthesized
actagaaatgataaaattca

SEQ ID NO: 308125 - DNA, 20 bp, Artificial Sequence
  chemically synthesized
tagaaatgataaaattcaca

SEQ ID NO: 308126 - DNA, 20 bp, Artificial Sequence
  chemically synthesized
aatgataaaattcacagagt

SEQ ID NO: 308127 - DNA, 20 bp, Artificial Sequence
  chemically synthesized
tgataaaattcacagagtaa

SEQ ID NO: 308128 - DNA, 20 bp, Artificial Sequence
  chemically synthesized
tcacagagtaagagaaactt

SEQ ID NO: 308129 - DNA, 20 bp, Artificial Sequence
  chemically synthesized
acagagtaagagaaacttta

SEQ ID NO: 308130 - DNA, 20 bp, Artificial Sequence
  chemically synthesized
aaaaaaaaaaaaaaactcta

SEQ ID NO: 308131 - DNA, 20 bp, Artificial Sequence
  chemically synthesized
ttttttttttttttaaatct

SEQ ID NO: 308132 - DNA, 20 bp, Artificial Sequence
  chemically synthesized
tggtttcagcaggaatttcc

SEQ ID NO: 308133 - DNA, 20 bp, Artificial Sequence
  chemically synthesized
ttgaagcatttggtttcagc

SEQ ID NO: 308134 - DNA, 20 bp, Artificial Sequence
  chemically synthesized
attgaagcatttggtttcag

SEQ ID NO: 308135 - DNA, 20 bp, Artificial Sequence
  chemically synthesized
ttcattgaagcatttggttt

SEQ ID NO: 308136 - DNA, 20 bp, Artificial Sequence
  chemically synthesized
aaagacttcattgaagcatt

SEQ ID NO: 308137 - DNA, 20 bp, Artificial Sequence
  chemically synthesized
tgaaaccaaatgcttcaatg

SEQ ID NO: 308138 - DNA, 20 bp, Artificial Sequence
  chemically synthesized
tttcagaaaagacttcattg

SEQ ID NO: 308139 - DNA, 20 bp, Artificial Sequence
  chemically synthesized
gcaataaatggatttcagaa

SEQ ID NO: 308140 - DNA, 20 bp, Artificial Sequence
  chemically synthesized
ctttggcaataaatggattt

SEQ ID NO: 308141 - DNA, 20 bp, Artificial Sequence
  chemically synthesized
gagatttctttggcaataaa

SEQ ID NO: 308142 - DNA, 20 bp, Artificial Sequence
  chemically synthesized
ctgaaatccatttattgcca

SEQ ID NO: 308143 - DNA, 20 bp, Artificial Sequence
  chemically synthesized
ttttgagaatgagatttctt

SEQ ID NO: 308144 - DNA, 20 bp, Artificial Sequence
  chemically synthesized
acctcgagtgttttgagaat

SEQ ID NO: 308145 - DNA, 20 bp, Artificial Sequence
  chemically synthesized
ataaatacctcgagtgtttt

SEQ ID NO: 308146 - DNA, 20 bp, Artificial Sequence
  chemically synthesized
atctcattctcaaaacactc

SEQ ID NO: 308147 - DNA, 20 bp, Artificial Sequence
  chemically synthesized
tctcattctcaaaacactcg

SEQ ID NO: 308148 - DNA, 20 bp, Artificial Sequence
  chemically synthesized
acattgattataaatacctc

SEQ ID NO: 308149 - DNA, 20 bp, Artificial Sequence
  chemically synthesized
ttataatcaatgtcatttga

SEQ ID NO: 308150 - DNA, 20 bp, Artificial Sequence
  chemically synthesized
tataatcaatgtcatttgat

SEQ ID NO: 308151 - DNA, 20 bp, Artificial Sequence
  chemically synthesized
tttcaagcaaaaaaaaatta

SEQ ID NO: 308152 - DNA, 20 bp, Artificial Sequence
  chemically synthesized
tttttttttgcttgaaaaac

SEQ ID NO: 308153 - DNA, 20 bp, Artificial Sequence
  chemically synthesized
acaatatcacctagtttttc

SEQ ID NO: 308154 - DNA, 20 bp, Artificial Sequence
  chemically synthesized
ttttttttgcttgaaaaact

SEQ ID NO: 308155 - DNA, 20 bp, Artificial Sequence
  chemically synthesized
gagatccaaacaatatcacc

SEQ ID NO: 308156 - DNA, 20 bp, Artificial Sequence
  chemically synthesized
aaaaactaggtgatattgtt

SEQ ID NO: 308157 - DNA, 20 bp, Artificial Sequence
  chemically synthesized
aacatgagatttggagaaca

SEQ ID NO: 308158 - DNA, 20 bp, Artificial Sequence
  chemically synthesized
tcaacatgagatttggagaa

SEQ ID NO: 308159 - DNA, 20 bp, Artificial Sequence
  chemically synthesized
acatttcaacatgagatttg

SEQ ID NO: 308160 - DNA, 20 bp, Artificial Sequence
  chemically synthesized
tcacatttcaacatgagatt

SEQ ID NO: 308161 - DNA, 20 bp, Artificial Sequence
  chemically synthesized
tgggaatcacatttcaacat

SEQ ID NO: 308162 - DNA, 20 bp, Artificial Sequence
  chemically synthesized
tcatgttgaaatgtgattcc

SEQ ID NO: 308163 - DNA, 20 bp, Artificial Sequence
  chemically synthesized
tgaaatgtgattcccagcat

SEQ ID NO: 308164 - DNA, 20 bp, Artificial Sequence
  chemically synthesized
aaatgtgattcccagcattg

SEQ ID NO: 308165 - DNA, 20 bp, Artificial Sequence
  chemically synthesized
caggccctacctccaatgct

SEQ ID NO: 308166 - DNA, 20 bp, Artificial Sequence
  chemically synthesized
aatgtgattcccagcattgg

SEQ ID NO: 308167 - DNA, 20 bp, Artificial Sequence
  chemically synthesized
ccaggccctacctccaatgc

SEQ ID NO: 308168 - DNA, 20 bp, Artificial Sequence
  chemically synthesized
gtgattcccagcattggagg

SEQ ID NO: 308169 - DNA, 20 bp, Artificial Sequence
  chemically synthesized
tgattcccagcattggaggt

SEQ ID NO: 308170 - DNA, 20 bp, Artificial Sequence
  chemically synthesized
gattcccagcattggaggta

SEQ ID NO: 308171 - DNA, 20 bp, Artificial Sequence
  chemically synthesized
ccagcattggaggtagggcc

SEQ ID NO: 308172 - DNA, 20 bp, Artificial Sequence
  chemically synthesized
gcattggaggtagggcctgg

SEQ ID NO: 308173 - DNA, 20 bp, Artificial Sequence
  chemically synthesized
cattggaggtagggcctggt

SEQ ID NO: 308174 - DNA, 20 bp, Artificial Sequence
  chemically synthesized
ttggaggtagggcctggtgg

SEQ ID NO: 308175 - DNA, 20 bp, Artificial Sequence
  chemically synthesized
tggaggtagggcctggtggg

SEQ ID NO: 308176 - DNA, 20 bp, Artificial Sequence
  chemically synthesized
tgagccaatcacctcccacc

SEQ ID NO: 308177 - DNA, 20 bp, Artificial Sequence
  chemically synthesized
atgagccaatcacctcccac

SEQ ID NO: 308178 - DNA, 20 bp, Artificial Sequence
  chemically synthesized
agggcctggtgggaggtgat

SEQ ID NO: 308179 - DNA, 20 bp, Artificial Sequence
  chemically synthesized
gtgggaggtgattggctcat

SEQ ID NO: 308180 - DNA, 20 bp, Artificial Sequence
  chemically synthesized
tgggaggtgattggctcatg

SEQ ID NO: 308181 - DNA, 20 bp, Artificial Sequence
  chemically synthesized
gggaggtgattggctcatga

SEQ ID NO: 308182 - DNA, 20 bp, Artificial Sequence
  chemically synthesized
aggtgattggctcatgaggg

SEQ ID NO: 308183 - DNA, 20 bp, Artificial Sequence
  chemically synthesized
catgagacatccgccctcat

SEQ ID NO: 308184 - DNA, 20 bp, Artificial Sequence
  chemically synthesized
gagggcggatgtctcatgaa

SEQ ID NO: 308185 - DNA, 20 bp, Artificial Sequence
  chemically synthesized
gattgtgctaagccattcat

SEQ ID NO: 308186 - DNA, 20 bp, Artificial Sequence
  chemically synthesized
cggatgtctcatgaatggct

SEQ ID NO: 308187 - DNA, 20 bp, Artificial Sequence
  chemically synthesized
atcatgaaagggattgtgct

SEQ ID NO: 308188 - DNA, 20 bp, Artificial Sequence
  chemically synthesized
ggaactgactcatcatgaaa

SEQ ID NO: 308189 - DNA, 20 bp, Artificial Sequence
  chemically synthesized
gggaactgactcatcatgaa

SEQ ID NO: 308190 - DNA, 20 bp, Artificial Sequence
  chemically synthesized
agcacaatccctttcatgat

SEQ ID NO: 308191 - DNA, 20 bp, Artificial Sequence
  chemically synthesized
tgggaactgactcatcatga

SEQ ID NO: 308192 - DNA, 20 bp, Artificial Sequence
  chemically synthesized
caatccctttcatgatgagt

SEQ ID NO: 308193 - DNA, 20 bp, Artificial Sequence
  chemically synthesized
atgatgagtcagttcccatt

SEQ ID NO: 308194 - DNA, 20 bp, Artificial Sequence
  chemically synthesized
tgagtcagttcccattcagt

SEQ ID NO: 308195 - DNA, 20 bp, Artificial Sequence
  chemically synthesized
ttcatgtgaactaactgaat

SEQ ID NO: 308196 - DNA, 20 bp, Artificial Sequence
  chemically synthesized
tttcatgtgaactaactgaa

SEQ ID NO: 308197 - DNA, 20 bp, Artificial Sequence
  chemically synthesized
cagttagttcacatgaaatc

SEQ ID NO: 308198 - DNA, 20 bp, Artificial Sequence
  chemically synthesized
cccagactcttttaaacaac

SEQ ID NO: 308199 - DNA, 20 bp, Artificial Sequence
  chemically synthesized
catgaaatctggttgtttaa

SEQ ID NO: 308200 - DNA, 20 bp, Artificial Sequence
  chemically synthesized
tgaaatctggttgtttaaaa

SEQ ID NO: 308201 - DNA, 20 bp, Artificial Sequence
  chemically synthesized
tctggttgtttaaaagagtc

SEQ ID NO: 308202 - DNA, 20 bp, Artificial Sequence
  chemically synthesized
ctggttgtttaaaagagtct

SEQ ID NO: 308203 - DNA, 20 bp, Artificial Sequence
  chemically synthesized
aagagataagaggaaggtcc

SEQ ID NO: 308204 - DNA, 20 bp, Artificial Sequence
  chemically synthesized
aaacaaaagagataagagga

SEQ ID NO: 308205 - DNA, 20 bp, Artificial Sequence
  chemically synthesized
gaaacaaaagagataagagg

SEQ ID NO: 308206 - DNA, 20 bp, Artificial Sequence
  chemically synthesized
gtggaaacaaaagagataag

SEQ ID NO: 308207 - DNA, 20 bp, Artificial Sequence
  chemically synthesized
agtggaaacaaaagagataa

SEQ ID NO: 308208 - DNA, 20 bp, Artificial Sequence
  chemically synthesized
agagtggaaacaaaagagat

SEQ ID NO: 308209 - DNA, 20 bp, Artificial Sequence
  chemically synthesized
ttgcaagagtggaaacaaaa

SEQ ID NO: 308210 - DNA, 20 bp, Artificial Sequence
  chemically synthesized
cattgcaagagtggaaacaa

SEQ ID NO: 308211 - DNA, 20 bp, Artificial Sequence
  chemically synthesized
tgtatatcacattgcaagag

SEQ ID NO: 308212 - DNA, 20 bp, Artificial Sequence
  chemically synthesized
cagtgtatatcacattgcaa

SEQ ID NO: 308213 - DNA, 20 bp, Artificial Sequence
  chemically synthesized
gccagtgtatatcacattgc

SEQ ID NO: 308214 - DNA, 20 bp, Artificial Sequence
  chemically synthesized
tcttgcaatgtgatatacac

SEQ ID NO: 308215 - DNA, 20 bp, Artificial Sequence
  chemically synthesized
ggcagaaggagaaggggagc

SEQ ID NO: 308216 - DNA, 20 bp, Artificial Sequence
  chemically synthesized
tcatggcagaaggagaaggg

SEQ ID NO: 308217 - DNA, 20 bp, Artificial Sequence
  chemically synthesized
aatcatggcagaaggagaag

SEQ ID NO: 308218 - DNA, 20 bp, Artificial Sequence
  chemically synthesized
caatcatggcagaaggagaa

SEQ ID NO: 308219 - DNA, 20 bp, Artificial Sequence
  chemically synthesized
acaatcatggcagaaggaga

SEQ ID NO: 308220 - DNA, 20 bp, Artificial Sequence
  chemically synthesized
tacaatcatggcagaaggag

SEQ ID NO: 308221 - DNA, 20 bp, Artificial Sequence
  chemically synthesized
gcttacaatcatggcagaag

SEQ ID NO: 308222 - DNA, 20 bp, Artificial Sequence
  chemically synthesized
aagcttacaatcatggcaga

SEQ ID NO: 308223 - DNA, 20 bp, Artificial Sequence
  chemically synthesized
gaagcttacaatcatggcag

SEQ ID NO: 308224 - DNA, 20 bp, Artificial Sequence
  chemically synthesized
caggaagcttacaatcatgg

SEQ ID NO: 308225 - DNA, 20 bp, Artificial Sequence
  chemically synthesized
tctccttctgccatgattgt

SEQ ID NO: 308226 - DNA, 20 bp, Artificial Sequence
  chemically synthesized
cctcaggaagcttacaatca

SEQ ID NO: 308227 - DNA, 20 bp, Artificial Sequence
  chemically synthesized
gccatgattgtaagcttcct

SEQ ID NO: 308228 - DNA, 20 bp, Artificial Sequence
  chemically synthesized
ccatgattgtaagcttcctg

SEQ ID NO: 308229 - DNA, 20 bp, Artificial Sequence
  chemically synthesized
ctcctggtaagtgcctcagg

SEQ ID NO: 308230 - DNA, 20 bp, Artificial Sequence
  chemically synthesized
ctgctcctggtaagtgcctc

SEQ ID NO: 308231 - DNA, 20 bp, Artificial Sequence
  chemically synthesized
tctgctcctggtaagtgcct

SEQ ID NO: 308232 - DNA, 20 bp, Artificial Sequence
  chemically synthesized
aagcttcctgaggcacttac

SEQ ID NO: 308233 - DNA, 20 bp, Artificial Sequence
  chemically synthesized
agcttcctgaggcacttacc

SEQ ID NO: 308234 - DNA, 20 bp, Artificial Sequence
  chemically synthesized
cttcctgaggcacttaccag

SEQ ID NO: 308235 - DNA, 20 bp, Artificial Sequence
  chemically synthesized
caccagcatctgctcctggt

SEQ ID NO: 308236 - DNA, 20 bp, Artificial Sequence
  chemically synthesized
cctgaggcacttaccaggag

SEQ ID NO: 308237 - DNA, 20 bp, Artificial Sequence
  chemically synthesized
atgacaccagcatctgctcc

SEQ ID NO: 308238 - DNA, 20 bp, Artificial Sequence
  chemically synthesized
cacttaccaggagcagatgc

SEQ ID NO: 308239 - DNA, 20 bp, Artificial Sequence
  chemically synthesized
ctgtacaagaagcatgacac

SEQ ID NO: 308240 - DNA, 20 bp, Artificial Sequence
  chemically synthesized
ctggtgtcatgcttcttgta

SEQ ID NO: 308241 - DNA, 20 bp, Artificial Sequence
  chemically synthesized
ggttctgcaggctgtacaag

SEQ ID NO: 308242 - DNA, 20 bp, Artificial Sequence
  chemically synthesized
catggttctgcaggctgtac

SEQ ID NO: 308243 - DNA, 20 bp, Artificial Sequence
  chemically synthesized
catgcttcttgtacagcctg

SEQ ID NO: 308244 - DNA, 20 bp, Artificial Sequence
  chemically synthesized
taactggctcatggttctgc

SEQ ID NO: 308245 - DNA, 20 bp, Artificial Sequence
  chemically synthesized
ttaactggctcatggttctg

SEQ ID NO: 308246 - DNA, 20 bp, Artificial Sequence
  chemically synthesized
tgtacagcctgcagaaccat

SEQ ID NO: 308247 - DNA, 20 bp, Artificial Sequence
  chemically synthesized
cagcctgcagaaccatgagc

SEQ ID NO: 308248 - DNA, 20 bp, Artificial Sequence
  chemically synthesized
aaagaggtttaactggctca

SEQ ID NO: 308249 - DNA, 20 bp, Artificial Sequence
  chemically synthesized
atgaaataaagaggtttaac

SEQ ID NO: 308250 - DNA, 20 bp, Artificial Sequence
  chemically synthesized
gggtaacttatgaaataaag

SEQ ID NO: 308251 - DNA, 20 bp, Artificial Sequence
  chemically synthesized
tgggtaacttatgaaataaa

SEQ ID NO: 308252 - DNA, 20 bp, Artificial Sequence
  chemically synthesized
actgggtaacttatgaaata

SEQ ID NO: 308253 - DNA, 20 bp, Artificial Sequence
  chemically synthesized
gttaaacctctttatttcat

SEQ ID NO: 308254 - DNA, 20 bp, Artificial Sequence
  chemically synthesized
tctttatttcataagttacc

SEQ ID NO: 308255 - DNA, 20 bp, Artificial Sequence
  chemically synthesized
tttcataagttacccagtcc

SEQ ID NO: 308256 - DNA, 20 bp, Artificial Sequence
  chemically synthesized
gggtacctgagactgggact

SEQ ID NO: 308257 - DNA, 20 bp, Artificial Sequence
  chemically synthesized
ggggtacctgagactgggac

SEQ ID NO: 308258 - DNA, 20 bp, Artificial Sequence
  chemically synthesized
aagttacccagtcccagtct

SEQ ID NO: 308259 - DNA, 20 bp, Artificial Sequence
  chemically synthesized
agttacccagtcccagtctc

SEQ ID NO: 308260 - DNA, 20 bp, Artificial Sequence
  chemically synthesized
ataaaggggtacctgagact

SEQ ID NO: 308261 - DNA, 20 bp, Artificial Sequence
  chemically synthesized
tataaaggggtacctgagac

SEQ ID NO: 308262 - DNA, 20 bp, Artificial Sequence
  chemically synthesized
tttattataaaggggtacct

SEQ ID NO: 308263 - DNA, 20 bp, Artificial Sequence
  chemically synthesized
aaccttagtttattataaag

SEQ ID NO: 308264 - DNA, 20 bp, Artificial Sequence
  chemically synthesized
taaccttagtttattataaa

SEQ ID NO: 308265 - DNA, 20 bp, Artificial Sequence
  chemically synthesized
ttaaccttagtttattataa

SEQ ID NO: 308266 - DNA, 20 bp, Artificial Sequence
  chemically synthesized
tttaaccttagtttattata

SEQ ID NO: 308267 - DNA, 20 bp, Artificial Sequence
  chemically synthesized
gtacccctttataataaact

SEQ ID NO: 308268 - DNA, 20 bp, Artificial Sequence
  chemically synthesized
tacccctttataataaacta

SEQ ID NO: 308269 - DNA, 20 bp, Artificial Sequence
  chemically synthesized
acattgatggagtttaacct

SEQ ID NO: 308270 - DNA, 20 bp, Artificial Sequence
  chemically synthesized
cggttatcctgacattgatg

SEQ ID NO: 308271 - DNA, 20 bp, Artificial Sequence
  chemically synthesized
aggttaaactccatcaatgt

SEQ ID NO: 308272 - DNA, 20 bp, Artificial Sequence
  chemically synthesized
gacggttatcctgacattga

SEQ ID NO: 308273 - DNA, 20 bp, Artificial Sequence
  chemically synthesized
ggttaaactccatcaatgtc

SEQ ID NO: 308274 - DNA, 20 bp, Artificial Sequence
  chemically synthesized
tatgtgagagttacaagcga

SEQ ID NO: 308275 - DNA, 20 bp, Artificial Sequence
  chemically synthesized
gaataatatgtgagagttac

SEQ ID NO: 308276 - DNA, 20 bp, Artificial Sequence
  chemically synthesized
attctcagaataatatgtga

SEQ ID NO: 308277 - DNA, 20 bp, Artificial Sequence
  chemically synthesized
tgattctcagaataatatgt

SEQ ID NO: 308278 - DNA, 20 bp, Artificial Sequence
  chemically synthesized
taactctcacatattattct

SEQ ID NO: 308279 - DNA, 20 bp, Artificial Sequence
  chemically synthesized
aatagactgacgttgattct

SEQ ID NO: 308280 - DNA, 20 bp, Artificial Sequence
  chemically synthesized
attattctgagaatcaacgt

SEQ ID NO: 308281 - DNA, 20 bp, Artificial Sequence
  chemically synthesized
tcaacgtcagtctatttttt

SEQ ID NO: 308282 - DNA, 20 bp, Artificial Sequence
  chemically synthesized
gcagcatagttctaaaaaaa

SEQ ID NO: 308283 - DNA, 20 bp, Artificial Sequence
  chemically synthesized
ttttttagaactatgctgct

SEQ ID NO: 308284 - DNA, 20 bp, Artificial Sequence
  chemically synthesized
tcataaagttctaagcagca

SEQ ID NO: 308285 - DNA, 20 bp, Artificial Sequence
  chemically synthesized
gcctttcataaagttctaag

SEQ ID NO: 308286 - DNA, 20 bp, Artificial Sequence
  chemically synthesized
tgagcctttcataaagttct

SEQ ID NO: 308287 - DNA, 20 bp, Artificial Sequence
  chemically synthesized
tgctgcttagaactttatga

SEQ ID NO: 308288 - DNA, 20 bp, Artificial Sequence
  chemically synthesized
gctgcttagaactttatgaa

SEQ ID NO: 308289 - DNA, 20 bp, Artificial Sequence
  chemically synthesized
atgtctgtgagcctttcata

SEQ ID NO: 308290 - DNA, 20 bp, Artificial Sequence
  chemically synthesized
agaactttatgaaaggctca

SEQ ID NO: 308291 - DNA, 20 bp, Artificial Sequence
  chemically synthesized
taatactaagaaatgtctgt

SEQ ID NO: 308292 - DNA, 20 bp, Artificial Sequence
  chemically synthesized
aaaggctcacagacatttct

SEQ ID NO: 308293 - DNA, 20 bp, Artificial Sequence
  chemically synthesized
aaaattaataaagtaatact

SEQ ID NO: 308294 - DNA, 20 bp, Artificial Sequence
  chemically synthesized
gacttcaattaaaattaata

SEQ ID NO: 308295 - DNA, 20 bp, Artificial Sequence
  chemically synthesized
tactttattaattttaattg

SEQ ID NO: 308296 - DNA, 20 bp, Artificial Sequence
  chemically synthesized
ttttaattgaagtcttattc

SEQ ID NO: 308297 - DNA, 20 bp, Artificial Sequence
  chemically synthesized
aaaacatagcataccagaat

SEQ ID NO: 308298 - DNA, 20 bp, Artificial Sequence
  chemically synthesized
cttgataaaacatagcatac

SEQ ID NO: 308299 - DNA, 20 bp, Artificial Sequence
  chemically synthesized
gttgtactcttgataaaaca

SEQ ID NO: 308300 - DNA, 20 bp, Artificial Sequence
  chemically synthesized
ctggtatgctatgttttatc

SEQ ID NO: 308301 - DNA, 20 bp, Artificial Sequence
  chemically synthesized
ggtatgctatgttttatcaa

SEQ ID NO: 308302 - DNA, 20 bp, Artificial Sequence
  chemically synthesized
attttcaactttgtttttca

SEQ ID NO: 308303 - DNA, 20 bp, Artificial Sequence
  chemically synthesized
gagtacaactttgaaaaaca

SEQ ID NO: 308304 - DNA, 20 bp, Artificial Sequence
  chemically synthesized
caaagttgaaaatccaccta

SEQ ID NO: 308305 - DNA, 20 bp, Artificial Sequence
  chemically synthesized
aagtgggaaaaaactatagg

SEQ ID NO: 308306 - DNA, 20 bp, Artificial Sequence
  chemically synthesized
ttaaagtgggaaaaaactat

SEQ ID NO: 308307 - DNA, 20 bp, Artificial Sequence
  chemically synthesized
attaaagtgggaaaaaacta

SEQ ID NO: 308308 - DNA, 20 bp, Artificial Sequence
  chemically synthesized
ctacttttctgaattaaagt

SEQ ID NO: 308309 - DNA, 20 bp, Artificial Sequence
  chemically synthesized
gctacttttctgaattaaag

SEQ ID NO: 308310 - DNA, 20 bp, Artificial Sequence
  chemically synthesized
agttttttcccactttaatt

SEQ ID NO: 308311 - DNA, 20 bp, Artificial Sequence
  chemically synthesized
attgctacttttctgaatta

SEQ ID NO: 308312 - DNA, 20 bp, Artificial Sequence
  chemically synthesized
tttcccactttaattcagaa

SEQ ID NO: 308313 - DNA, 20 bp, Artificial Sequence
  chemically synthesized
cccactttaattcagaaaag

SEQ ID NO: 308314 - DNA, 20 bp, Artificial Sequence
  chemically synthesized
cttggatcatagattattca

SEQ ID NO: 308315 - DNA, 20 bp, Artificial Sequence
  chemically synthesized
ctttgaataatctatgatcc

SEQ ID NO: 308316 - DNA, 20 bp, Artificial Sequence
  chemically synthesized
gtttatttttgcttggatca

SEQ ID NO: 308317 - DNA, 20 bp, Artificial Sequence
  chemically synthesized
attaaatgtttatttttgct

SEQ ID NO: 308318 - DNA, 20 bp, Artificial Sequence
  chemically synthesized
aataaacatttaatattcaa

SEQ ID NO: 308319 - DNA, 20 bp, Artificial Sequence
  chemically synthesized
acatttaatattcaatagca

SEQ ID NO: 308320 - DNA, 20 bp, Artificial Sequence
  chemically synthesized
tttaatattcaatagcatag

SEQ ID NO: 308321 - DNA, 20 bp, Artificial Sequence
  chemically synthesized
taatattcaatagcatagaa

SEQ ID NO: 308322 - DNA, 20 bp, Artificial Sequence
  chemically synthesized
gcatagaagagactaaataa

SEQ ID NO: 308323 - DNA, 20 bp, Artificial Sequence
  chemically synthesized
tgtatattatcactattatt

SEQ ID NO: 308324 - DNA, 20 bp, Artificial Sequence
  chemically synthesized
taaataatagtgataatata

SEQ ID NO: 308325 - DNA, 20 bp, Artificial Sequence
  chemically synthesized
atagtgataatatacagtac

SEQ ID NO: 308326 - DNA, 20 bp, Artificial Sequence
  chemically synthesized
tagtgataatatacagtact

SEQ ID NO: 308327 - DNA, 20 bp, Artificial Sequence
  chemically synthesized
tcaatggtcttataaaaacc

SEQ ID NO: 308328 - DNA, 20 bp, Artificial Sequence
  chemically synthesized
atacagtactgggtttttat

SEQ ID NO: 308329 - DNA, 20 bp, Artificial Sequence
  chemically synthesized
ggtttttataagaccattga

SEQ ID NO: 308330 - DNA, 20 bp, Artificial Sequence
  chemically synthesized
atgtactttctagctttcaa

SEQ ID NO: 308331 - DNA, 20 bp, Artificial Sequence
  chemically synthesized
tttataagaccattgaaagc

SEQ ID NO: 308332 - DNA, 20 bp, Artificial Sequence
  chemically synthesized
taagaccattgaaagctaga

SEQ ID NO: 308333 - DNA, 20 bp, Artificial Sequence
  chemically synthesized
aactggccgtatgtactttc

SEQ ID NO: 308334 - DNA, 20 bp, Artificial Sequence
  chemically synthesized
tgaaagctagaaagtacata

SEQ ID NO: 308335 - DNA, 20 bp, Artificial Sequence
  chemically synthesized
agctagaaagtacatacggc

SEQ ID NO: 308336 - DNA, 20 bp, Artificial Sequence
  chemically synthesized
gtacatacggccagtttttg

SEQ ID NO: 308337 - DNA, 20 bp, Artificial Sequence
  chemically synthesized
gttatcaagtcttcaaaaac

SEQ ID NO: 308338 - DNA, 20 bp, Artificial Sequence
  chemically synthesized
gatcaaaatgaaatgttatc

SEQ ID NO: 308339 - DNA, 20 bp, Artificial Sequence
  chemically synthesized
acatttcattttgatcttta

SEQ ID NO: 308340 - DNA, 20 bp, Artificial Sequence
  chemically synthesized
ttcattttgatctttaaagc

SEQ ID NO: 308341 - DNA, 20 bp, Artificial Sequence
  chemically synthesized
gattcacacaactggcttta

SEQ ID NO: 308342 - DNA, 20 bp, Artificial Sequence
  chemically synthesized
gtgaacaagattcacacaac

SEQ ID NO: 308343 - DNA, 20 bp, Artificial Sequence
  chemically synthesized
aaaaagaagatgcagtgaac

SEQ ID NO: 308344 - DNA, 20 bp, Artificial Sequence
  chemically synthesized
gctttcagaaaaagaagatg

SEQ ID NO: 308345 - DNA, 20 bp, Artificial Sequence
  chemically synthesized
tgcatggctttcagaaaaag

SEQ ID NO: 308346 - DNA, 20 bp, Artificial Sequence
  chemically synthesized
actgcatcttctttttctga

SEQ ID NO: 308347 - DNA, 20 bp, Artificial Sequence
  chemically synthesized
tagtgcatggctttcagaaa

SEQ ID NO: 308348 - DNA, 20 bp, Artificial Sequence
  chemically synthesized
cctttttagtgcatggcttt

SEQ ID NO: 308349 - DNA, 20 bp, Artificial Sequence
  chemically synthesized
tgcagtgcctttttagtgca

SEQ ID NO: 308350 - DNA, 20 bp, Artificial Sequence
  chemically synthesized
tctgaaagccatgcactaaa

SEQ ID NO: 308351 - DNA, 20 bp, Artificial Sequence
  chemically synthesized
ctgaaagccatgcactaaaa

SEQ ID NO: 308352 - DNA, 20 bp, Artificial Sequence
  chemically synthesized
aatgtcttgcagtgcctttt

SEQ ID NO: 308353 - DNA, 20 bp, Artificial Sequence
  chemically synthesized
atgcactaaaaaggcactgc

SEQ ID NO: 308354 - DNA, 20 bp, Artificial Sequence
  chemically synthesized
tggaattctttaatgtcttg

SEQ ID NO: 308355 - DNA, 20 bp, Artificial Sequence
  chemically synthesized
aaaggcactgcaagacatta

SEQ ID NO: 308356 - DNA, 20 bp, Artificial Sequence
  chemically synthesized
gcaagacattaaagaattcc

SEQ ID NO: 308357 - DNA, 20 bp, Artificial Sequence
  chemically synthesized
caagacattaaagaattcca

SEQ ID NO: 308358 - DNA, 20 bp, Artificial Sequence
  chemically synthesized
atttatgtttatttattcct

SEQ ID NO: 308359 - DNA, 20 bp, Artificial Sequence
  chemically synthesized
gatattaaattggaaaagta

SEQ ID NO: 308360 - DNA, 20 bp, Artificial Sequence
  chemically synthesized
ggggggatattaaattggaa

SEQ ID NO: 308361 - DNA, 20 bp, Artificial Sequence
  chemically synthesized
gacacggggggatattaaat

SEQ ID NO: 308362 - DNA, 20 bp, Artificial Sequence
  chemically synthesized
ctagctgtaaaagacacggg

SEQ ID NO: 308363 - DNA, 20 bp, Artificial Sequence
  chemically synthesized
actagctgtaaaagacacgg

SEQ ID NO: 308364 - DNA, 20 bp, Artificial Sequence
  chemically synthesized
aactagctgtaaaagacacg

SEQ ID NO: 308365 - DNA, 20 bp, Artificial Sequence
  chemically synthesized
aaactagctgtaaaagacac

SEQ ID NO: 308366 - DNA, 20 bp, Artificial Sequence
  chemically synthesized
gaaactagctgtaaaagaca

SEQ ID NO: 308367 - DNA, 20 bp, Artificial Sequence
  chemically synthesized
atatccccccgtgtctttta

SEQ ID NO: 308368 - DNA, 20 bp, Artificial Sequence
  chemically synthesized
ccccccgtgtcttttacagc

SEQ ID NO: 308369 - DNA, 20 bp, Artificial Sequence
  chemically synthesized
gtgtgagaaactagctgtaa

SEQ ID NO: 308370 - DNA, 20 bp, Artificial Sequence
  chemically synthesized
gtgtgtcatgtgtgagaaac

SEQ ID NO: 308371 - DNA, 20 bp, Artificial Sequence
  chemically synthesized
agaacaggtgtgtcatgtgt

SEQ ID NO: 308372 - DNA, 20 bp, Artificial Sequence
  chemically synthesized
cacatgacacacctgttctt

SEQ ID NO: 308373 - DNA, 20 bp, Artificial Sequence
  chemically synthesized
gcaacgtcttactgaagaac

SEQ ID NO: 308374 - DNA, 20 bp, Artificial Sequence
  chemically synthesized
ggcaacgtcttactgaagaa

SEQ ID NO: 308375 - DNA, 20 bp, Artificial Sequence
  chemically synthesized
tgacacacctgttcttcagt

SEQ ID NO: 308376 - DNA, 20 bp, Artificial Sequence
  chemically synthesized
caaatggcaacgtcttactg

SEQ ID NO: 308377 - DNA, 20 bp, Artificial Sequence
  chemically synthesized
tcagtaagacgttgccattt

SEQ ID NO: 308378 - DNA, 20 bp, Artificial Sequence
  chemically synthesized
gtaagacgttgccatttgag

SEQ ID NO: 308379 - DNA, 20 bp, Artificial Sequence
  chemically synthesized
taagacgttgccatttgaga

SEQ ID NO: 308380 - DNA, 20 bp, Artificial Sequence
  chemically synthesized
tacaagacatccttctcaaa

SEQ ID NO: 308381 - DNA, 20 bp, Artificial Sequence
  chemically synthesized
ttgagaaggatgtcttgtaa

SEQ ID NO: 308382 - DNA, 20 bp, Artificial Sequence
  chemically synthesized
agaccgctgggttcttttac

SEQ ID NO: 308383 - DNA, 20 bp, Artificial Sequence
  chemically synthesized
ggatgtcttgtaaaagaacc

SEQ ID NO: 308384 - DNA, 20 bp, Artificial Sequence
  chemically synthesized
tgtcttgtaaaagaacccag

SEQ ID NO: 308385 - DNA, 20 bp, Artificial Sequence
  chemically synthesized
tagatggacagaagaccgct

SEQ ID NO: 308386 - DNA, 20 bp, Artificial Sequence
  chemically synthesized
gtagatggacagaagaccgc

SEQ ID NO: 308387 - DNA, 20 bp, Artificial Sequence
  chemically synthesized
aaacatctgtagatggacag

SEQ ID NO: 308388 - DNA, 20 bp, Artificial Sequence
  chemically synthesized
ggcaaacatctgtagatgga

SEQ ID NO: 308389 - DNA, 20 bp, Artificial Sequence
  chemically synthesized
agcggtcttctgtccatcta

SEQ ID NO: 308390 - DNA, 20 bp, Artificial Sequence
  chemically synthesized
gatgggcaaacatctgtaga

SEQ ID NO: 308391 - DNA, 20 bp, Artificial Sequence
  chemically synthesized
gatcgatgggcaaacatctg

SEQ ID NO: 308392 - DNA, 20 bp, Artificial Sequence
  chemically synthesized
ccaggtattgggagatcgat

SEQ ID NO: 308393 - DNA, 20 bp, Artificial Sequence
  chemically synthesized
tccaggtattgggagatcga

SEQ ID NO: 308394 - DNA, 20 bp, Artificial Sequence
  chemically synthesized
gtctcttctccaggtattgg

SEQ ID NO: 308395 - DNA, 20 bp, Artificial Sequence
  chemically synthesized
cccatcgatctcccaatacc

SEQ ID NO: 308396 - DNA, 20 bp, Artificial Sequence
  chemically synthesized
ttgtctcttctccaggtatt

SEQ ID NO: 308397 - DNA, 20 bp, Artificial Sequence
  chemically synthesized
catcgatctcccaatacctg

SEQ ID NO: 308398 - DNA, 20 bp, Artificial Sequence
  chemically synthesized
attgtctcttctccaggtat

SEQ ID NO: 308399 - DNA, 20 bp, Artificial Sequence
  chemically synthesized
cgatctcccaatacctggag

SEQ ID NO: 308400 - DNA, 20 bp, Artificial Sequence
  chemically synthesized
atctcccaatacctggagaa

SEQ ID NO: 308401 - DNA, 20 bp, Artificial Sequence
  chemically synthesized
tgcttgattgtctcttctcc

SEQ ID NO: 308402 - DNA, 20 bp, Artificial Sequence
  chemically synthesized
gtgcttgattgtctcttctc

SEQ ID NO: 308403 - DNA, 20 bp, Artificial Sequence
  chemically synthesized
tacctggagaagagacaatc

SEQ ID NO: 308404 - DNA, 20 bp, Artificial Sequence
  chemically synthesized
ggagaagagacaatcaagca

SEQ ID NO: 308405 - DNA, 20 bp, Artificial Sequence
  chemically synthesized
gagacaatcaagcacagcat

SEQ ID NO: 308406 - DNA, 20 bp, Artificial Sequence
  chemically synthesized
gcacagcatcagcaaacaat

SEQ ID NO: 308407 - DNA, 20 bp, Artificial Sequence
  chemically synthesized
atgccatttttaataaaacg

SEQ ID NO: 308408 - DNA, 20 bp, Artificial Sequence
  chemically synthesized
taactacgttttattaaaaa

SEQ ID NO: 308409 - DNA, 20 bp, Artificial Sequence
  chemically synthesized
atggcatgaataatttgcca

SEQ ID NO: 308410 - DNA, 20 bp, Artificial Sequence
  chemically synthesized
cataggagactgagatactt

SEQ ID NO: 308411 - DNA, 20 bp, Artificial Sequence
  chemically synthesized
aataatttgccaaagtatct

SEQ ID NO: 308412 - DNA, 20 bp, Artificial Sequence
  chemically synthesized
tctagcgtacataggagact

SEQ ID NO: 308413 - DNA, 20 bp, Artificial Sequence
  chemically synthesized
ccaacttctagcgtacatag

SEQ ID NO: 308414 - DNA, 20 bp, Artificial Sequence
  chemically synthesized
ttccaacttctagcgtacat

SEQ ID NO: 308415 - DNA, 20 bp, Artificial Sequence
  chemically synthesized
tctcagtctcctatgtacgc

SEQ ID NO: 308416 - DNA, 20 bp, Artificial Sequence
  chemically synthesized
cttccaacttctagcgtaca

SEQ ID NO: 308417 - DNA, 20 bp, Artificial Sequence
  chemically synthesized
cagtctcctatgtacgctag

SEQ ID NO: 308418 - DNA, 20 bp, Artificial Sequence
  chemically synthesized
ctcctatgtacgctagaagt

SEQ ID NO: 308419 - DNA, 20 bp, Artificial Sequence
  chemically synthesized
agagtgtcccttccaacttc

SEQ ID NO: 308420 - DNA, 20 bp, Artificial Sequence
  chemically synthesized
ctatgtacgctagaagttgg

SEQ ID NO: 308421 - DNA, 20 bp, Artificial Sequence
  chemically synthesized
tatgtacgctagaagttgga

SEQ ID NO: 308422 - DNA, 20 bp, Artificial Sequence
  chemically synthesized
atgtacgctagaagttggaa

SEQ ID NO: 308423 - DNA, 20 bp, Artificial Sequence
  chemically synthesized
aaatgtaagcagatcagaaa

SEQ ID NO: 308424 - DNA, 20 bp, Artificial Sequence
  chemically synthesized
ttaaatgtaagcagatcaga

SEQ ID NO: 308425 - DNA, 20 bp, Artificial Sequence
  chemically synthesized
ttatttaaatgtaagcagat

SEQ ID NO: 308426 - DNA, 20 bp, Artificial Sequence
  chemically synthesized
accacttatttaaatgtaag

SEQ ID NO: 308427 - DNA, 20 bp, Artificial Sequence
  chemically synthesized
cacaccacttatttaaatgt

SEQ ID NO: 308428 - DNA, 20 bp, Artificial Sequence
  chemically synthesized
tgatctgcttacatttaaat

SEQ ID NO: 308429 - DNA, 20 bp, Artificial Sequence
  chemically synthesized
tctgcttacatttaaataag

SEQ ID NO: 308430 - DNA, 20 bp, Artificial Sequence
  chemically synthesized
ggtgagataaagacaaatga

SEQ ID NO: 308431 - DNA, 20 bp, Artificial Sequence
  chemically synthesized
gtacaagacttggtgagata

SEQ ID NO: 308432 - DNA, 20 bp, Artificial Sequence
  chemically synthesized
tcatttgtctttatctcacc

SEQ ID NO: 308433 - DNA, 20 bp, Artificial Sequence
  chemically synthesized
tgaaaggtacaagacttggt

SEQ ID NO: 308434 - DNA, 20 bp, Artificial Sequence
  chemically synthesized
tctatgaaaggtacaagact

SEQ ID NO: 308435 - DNA, 20 bp, Artificial Sequence
  chemically synthesized
tgcttttctatgaaaggtac

SEQ ID NO: 308436 - DNA, 20 bp, Artificial Sequence
  chemically synthesized
accaagtcttgtacctttca

SEQ ID NO: 308437 - DNA, 20 bp, Artificial Sequence
  chemically synthesized
tctctttgcttttctatgaa

SEQ ID NO: 308438 - DNA, 20 bp, Artificial Sequence
  chemically synthesized
gtctctttgcttttctatga

SEQ ID NO: 308439 - DNA, 20 bp, Artificial Sequence
  chemically synthesized
gtcttgtacctttcatagaa

SEQ ID NO: 308440 - DNA, 20 bp, Artificial Sequence
  chemically synthesized
gtacctttcatagaaaagca

SEQ ID NO: 308441 - DNA, 20 bp, Artificial Sequence
  chemically synthesized
acctttcatagaaaagcaaa

SEQ ID NO: 308442 - DNA, 20 bp, Artificial Sequence
  chemically synthesized
tcatagaaaagcaaagagac

SEQ ID NO: 308443 - DNA, 20 bp, Artificial Sequence
  chemically synthesized
gcaaagagacaagcaatatg

SEQ ID NO: 308444 - DNA, 20 bp, Artificial Sequence
  chemically synthesized
aagagacaagcaatatgaag

SEQ ID NO: 308445 - DNA, 20 bp, Artificial Sequence
  chemically synthesized
tatggagccattttatatag

SEQ ID NO: 308446 - DNA, 20 bp, Artificial Sequence
  chemically synthesized
tattataccactatataaaa

SEQ ID NO: 308447 - DNA, 20 bp, Artificial Sequence
  chemically synthesized
tgctatggagccattttata

SEQ ID NO: 308448 - DNA, 20 bp, Artificial Sequence
  chemically synthesized
cactatataaaatggctcca

SEQ ID NO: 308449 - DNA, 20 bp, Artificial Sequence
  chemically synthesized
gttatcttacatttgctatg

SEQ ID NO: 308450 - DNA, 20 bp, Artificial Sequence
  chemically synthesized
ttgttatcttacatttgcta

SEQ ID NO: 308451 - DNA, 20 bp, Artificial Sequence
  chemically synthesized
aatggctccatagcaaatgt

SEQ ID NO: 308452 - DNA, 20 bp, Artificial Sequence
  chemically synthesized
atagcaaatgtaagataaca

SEQ ID NO: 308453 - DNA, 20 bp, Artificial Sequence
  chemically synthesized
agataacaaagacatacata

SEQ ID NO: 308454 - DNA, 20 bp, Artificial Sequence
  chemically synthesized
ataacaaagacatacatata

SEQ ID NO: 308455 - DNA, 20 bp, Artificial Sequence
  chemically synthesized
aacaaagacatacatataga

SEQ ID NO: 308456 - DNA, 20 bp, Artificial Sequence
  chemically synthesized
acaaagacatacatatagag

SEQ ID NO: 308457 - DNA, 20 bp, Artificial Sequence
  chemically synthesized
tacatatagagaggattttg

SEQ ID NO: 308458 - DNA, 20 bp, Artificial Sequence
  chemically synthesized
tatagagaggattttgcagt

SEQ ID NO: 308459 - DNA, 20 bp, Artificial Sequence
  chemically synthesized
gaggattttgcagtgagaac

SEQ ID NO: 308460 - DNA, 20 bp, Artificial Sequence
  chemically synthesized
tttgcagtgagaacaagtaa

SEQ ID NO: 308461 - DNA, 20 bp, Artificial Sequence
  chemically synthesized
ttgcagtgagaacaagtaaa

SEQ ID NO: 308462 - DNA, 20 bp, Artificial Sequence
  chemically synthesized
agtaaaaggtgtattttcct

SEQ ID NO: 308463 - DNA, 20 bp, Artificial Sequence
  chemically synthesized
gtaaaaggtgtattttcctt

SEQ ID NO: 308464 - DNA, 20 bp, Artificial Sequence
  chemically synthesized
agggtgtattttcaaaccta

SEQ ID NO: 308465 - DNA, 20 bp, Artificial Sequence
  chemically synthesized
tagggtgtattttcaaacct

SEQ ID NO: 308466 - DNA, 20 bp, Artificial Sequence
  chemically synthesized
aggtttgaaaatacacccta

SEQ ID NO: 308467 - DNA, 20 bp, Artificial Sequence
  chemically synthesized
agttagacttttattcttta

SEQ ID NO: 308468 - DNA, 20 bp, Artificial Sequence
  chemically synthesized
tagttagacttttattcttt

SEQ ID NO: 308469 - DNA, 20 bp, Artificial Sequence
  chemically synthesized
gtagttagacttttattctt

SEQ ID NO: 308470 - DNA, 20 bp, Artificial Sequence
  chemically synthesized
aaatacaccctaaagaataa

SEQ ID NO: 308471 - DNA, 20 bp, Artificial Sequence
  chemically synthesized
gaggcattctatttagtagt

SEQ ID NO: 308472 - DNA, 20 bp, Artificial Sequence
  chemically synthesized
ataaaagtctaactactaaa

SEQ ID NO: 308473 - DNA, 20 bp, Artificial Sequence
  chemically synthesized
ttttgaggcattctatttag

SEQ ID NO: 308474 - DNA, 20 bp, Artificial Sequence
  chemically synthesized
gtcttttgaggcattctatt

SEQ ID NO: 308475 - DNA, 20 bp, Artificial Sequence
  chemically synthesized
tactaaatagaatgcctcaa

SEQ ID NO: 308476 - DNA, 20 bp, Artificial Sequence
  chemically synthesized
tttcaattaagagtcttttg

SEQ ID NO: 308477 - DNA, 20 bp, Artificial Sequence
  chemically synthesized
gtttcaattaagagtctttt

SEQ ID NO: 308478 - DNA, 20 bp, Artificial Sequence
  chemically synthesized
tgcaagattgtttcaattaa

SEQ ID NO: 308479 - DNA, 20 bp, Artificial Sequence
  chemically synthesized
tatgcaagattgtttcaatt

SEQ ID NO: 308480 - DNA, 20 bp, Artificial Sequence
  chemically synthesized
ttgaaacaatcttgcataat

SEQ ID NO: 308481 - DNA, 20 bp, Artificial Sequence
  chemically synthesized
gtaggcaattctcattatgc

SEQ ID NO: 308482 - DNA, 20 bp, Artificial Sequence
  chemically synthesized
aatgagaattgcctaccatt

SEQ ID NO: 308483 - DNA, 20 bp, Artificial Sequence
  chemically synthesized
tcttctacaatccaaatggt

SEQ ID NO: 308484 - DNA, 20 bp, Artificial Sequence
  chemically synthesized
ttcttctacaatccaaatgg

SEQ ID NO: 308485 - DNA, 20 bp, Artificial Sequence
  chemically synthesized
attttcttctacaatccaaa

SEQ ID NO: 308486 - DNA, 20 bp, Artificial Sequence
  chemically synthesized
attgcctaccatttggattg

SEQ ID NO: 308487 - DNA, 20 bp, Artificial Sequence
  chemically synthesized
gcctaccatttggattgtag

SEQ ID NO: 308488 - DNA, 20 bp, Artificial Sequence
  chemically synthesized
ggattgtagaagaaaattct

SEQ ID NO: 308489 - DNA, 20 bp, Artificial Sequence
  chemically synthesized
gtaatagaatttaagttact

SEQ ID NO: 308490 - DNA, 20 bp, Artificial Sequence
  chemically synthesized
tctacatagtaatagaattt

SEQ ID NO: 308491 - DNA, 20 bp, Artificial Sequence
  chemically synthesized
ttgaaaaatctacatagtaa

SEQ ID NO: 308492 - DNA, 20 bp, Artificial Sequence
  chemically synthesized
acttaaattctattactatg

SEQ ID NO: 308493 - DNA, 20 bp, Artificial Sequence
  chemically synthesized
agaaaattgaaaaatctaca

SEQ ID NO: 308494 - DNA, 20 bp, Artificial Sequence
  chemically synthesized
ttaatacttttgtaataatt

SEQ ID NO: 308495 - DNA, 20 bp, Artificial Sequence
  chemically synthesized
aattttctcaattattacaa

SEQ ID NO: 308496 - DNA, 20 bp, Artificial Sequence
  chemically synthesized
tcactagagtagtttagaaa

SEQ ID NO: 308497 - DNA, 20 bp, Artificial Sequence
  chemically synthesized
gttttctcactagagtagtt

SEQ ID NO: 308498 - DNA, 20 bp, Artificial Sequence
  chemically synthesized
tttctgtttctaaactactc

SEQ ID NO: 308499 - DNA, 20 bp, Artificial Sequence
  chemically synthesized
tgtttctaaactactctagt

SEQ ID NO: 308500 - DNA, 20 bp, Artificial Sequence
  chemically synthesized
tgttagttttctcactagag

SEQ ID NO: 308501 - DNA, 20 bp, Artificial Sequence
  chemically synthesized
gattgttagttttctcacta

SEQ ID NO: 308502 - DNA, 20 bp, Artificial Sequence
  chemically synthesized
gagattgttagttttctcac

SEQ ID NO: 308503 - DNA, 20 bp, Artificial Sequence
  chemically synthesized
agtttttactcagagattgt

SEQ ID NO: 308504 - DNA, 20 bp, Artificial Sequence
  chemically synthesized
tgagaaaactaacaatctct

SEQ ID NO: 308505 - DNA, 20 bp, Artificial Sequence
  chemically synthesized
gatatagtagtttttactca

SEQ ID NO: 308506 - DNA, 20 bp, Artificial Sequence
  chemically synthesized
atgatatagtagtttttact

SEQ ID NO: 308507 - DNA, 20 bp, Artificial Sequence
  chemically synthesized
gtgacatgttaatgatatag

SEQ ID NO: 308508 - DNA, 20 bp, Artificial Sequence
  chemically synthesized
ttagtgacatgttaatgata

SEQ ID NO: 308509 - DNA, 20 bp, Artificial Sequence
  chemically synthesized
ttaacatgtcactaatgtct

SEQ ID NO: 308510 - DNA, 20 bp, Artificial Sequence
  chemically synthesized
tagtgtgtgttcttagacat

SEQ ID NO: 308511 - DNA, 20 bp, Artificial Sequence
  chemically synthesized
attaaaatagtgtgtgttct

SEQ ID NO: 308512 - DNA, 20 bp, Artificial Sequence
  chemically synthesized
gtttatgttacatattaaaa

SEQ ID NO: 308513 - DNA, 20 bp, Artificial Sequence
  chemically synthesized
ttccaaaaatcattgatagt

SEQ ID NO: 308514 - DNA, 20 bp, Artificial Sequence
  chemically synthesized
ttccttccaaaaatcattga

SEQ ID NO: 308515 - DNA, 20 bp, Artificial Sequence
  chemically synthesized
aaccaactatcaatgatttt

SEQ ID NO: 308516 - DNA, 20 bp, Artificial Sequence
  chemically synthesized
caactatcaatgatttttgg

SEQ ID NO: 308517 - DNA, 20 bp, Artificial Sequence
  chemically synthesized
aactatcaatgatttttgga

SEQ ID NO: 308518 - DNA, 20 bp, Artificial Sequence
  chemically synthesized
aaatgcttcctttgcataga

SEQ ID NO: 308519 - DNA, 20 bp, Artificial Sequence
  chemically synthesized
attgtgatgctttctatgca

SEQ ID NO: 308520 - DNA, 20 bp, Artificial Sequence
  chemically synthesized
ttgtgatgctttctatgcaa

SEQ ID NO: 308521 - DNA, 20 bp, Artificial Sequence
  chemically synthesized
tttgaaatgcttcctttgca

SEQ ID NO: 308522 - DNA, 20 bp, Artificial Sequence
  chemically synthesized
tgatgctttctatgcaaagg

SEQ ID NO: 308523 - DNA, 20 bp, Artificial Sequence
  chemically synthesized
gcaaaggaagcatttcaaaa

SEQ ID NO: 308524 - DNA, 20 bp, Artificial Sequence
  chemically synthesized
aaggaagcatttcaaaatgg

SEQ ID NO: 308525 - DNA, 20 bp, Artificial Sequence
  chemically synthesized
aagcatttcaaaatggcagt

SEQ ID NO: 308526 - DNA, 20 bp, Artificial Sequence
  chemically synthesized
aagtgcatcataatgaggtt

SEQ ID NO: 308527 - DNA, 20 bp, Artificial Sequence
  chemically synthesized
ctataaagtgcatcataatg

SEQ ID NO: 308528 - DNA, 20 bp, Artificial Sequence
  chemically synthesized
gctataaagtgcatcataat

SEQ ID NO: 308529 - DNA, 20 bp, Artificial Sequence
  chemically synthesized
cctcattatgatgcacttta

SEQ ID NO: 308530 - DNA, 20 bp, Artificial Sequence
  chemically synthesized
agttgaaaattcaggctata

SEQ ID NO: 308531 - DNA, 20 bp, Artificial Sequence
  chemically synthesized
ttacaaaaagttgaaaattc

SEQ ID NO: 308532 - DNA, 20 bp, Artificial Sequence
  chemically synthesized
gttacaaaaagttgaaaatt

SEQ ID NO: 308533 - DNA, 20 bp, Artificial Sequence
  chemically synthesized
ttatatgaaaaagttacaaa

SEQ ID NO: 308534 - DNA, 20 bp, Artificial Sequence
  chemically synthesized
agtttcttatttatatgaaa

SEQ ID NO: 308535 - DNA, 20 bp, Artificial Sequence
  chemically synthesized
tgtaactttttcatataaat

SEQ ID NO: 308536 - DNA, 20 bp, Artificial Sequence
  chemically synthesized
caatatatatatgagaaaat

SEQ ID NO: 308537 - DNA, 20 bp, Artificial Sequence
  chemically synthesized
taaaggtccaatatatatat

SEQ ID NO: 308538 - DNA, 20 bp, Artificial Sequence
  chemically synthesized
ttattttctcatatatatat

SEQ ID NO: 308539 - DNA, 20 bp, Artificial Sequence
  chemically synthesized
atatatatattggaccttta

SEQ ID NO: 308540 - DNA, 20 bp, Artificial Sequence
  chemically synthesized
atatattggacctttaaagc

SEQ ID NO: 308541 - DNA, 20 bp, Artificial Sequence
  chemically synthesized
tttatgatttctagctttaa

SEQ ID NO: 308542 - DNA, 20 bp, Artificial Sequence
  chemically synthesized
ttttatgatttctagcttta

SEQ ID NO: 308543 - DNA, 20 bp, Artificial Sequence
  chemically synthesized
cgtcaatattttatgatttc

SEQ ID NO: 308544 - DNA, 20 bp, Artificial Sequence
  chemically synthesized
ctctaattctatataaaata

SEQ ID NO: 308545 - DNA, 20 bp, Artificial Sequence
  chemically synthesized
ttgacgtgctttattttata

SEQ ID NO: 308546 - DNA, 20 bp, Artificial Sequence
  chemically synthesized
tgctttattttatatagaat

SEQ ID NO: 308547 - DNA, 20 bp, Artificial Sequence
  chemically synthesized
ctttattttatatagaatta

SEQ ID NO: 308548 - DNA, 20 bp, Artificial Sequence
  chemically synthesized
attttatatagaattagagt

SEQ ID NO: 308549 - DNA, 20 bp, Artificial Sequence
  chemically synthesized
agtagatttttcaaaaatat

SEQ ID NO: 308550 - DNA, 20 bp, Artificial Sequence
  chemically synthesized
atatttttgaaaaatctact

SEQ ID NO: 308551 - DNA, 20 bp, Artificial Sequence
  chemically synthesized
atgagaccttagacactgag

SEQ ID NO: 308552 - DNA, 20 bp, Artificial Sequence
  chemically synthesized
gaaaaatctactcagtgtct

SEQ ID NO: 308553 - DNA, 20 bp, Artificial Sequence
  chemically synthesized
attatgagaccttagacact

SEQ ID NO: 308554 - DNA, 20 bp, Artificial Sequence
  chemically synthesized
aaaaatctactcagtgtcta

SEQ ID NO: 308555 - DNA, 20 bp, Artificial Sequence
  chemically synthesized
acatagaaattatgagacct

SEQ ID NO: 308556 - DNA, 20 bp, Artificial Sequence
  chemically synthesized
taaagtaacatagaaattat

SEQ ID NO: 308557 - DNA, 20 bp, Artificial Sequence
  chemically synthesized
atatgtagtataaagtaaca

SEQ ID NO: 308558 - DNA, 20 bp, Artificial Sequence
  chemically synthesized
taatacacatatgtagtata

SEQ ID NO: 308559 - DNA, 20 bp, Artificial Sequence
  chemically synthesized
ggtgggttaatacacatatg

SEQ ID NO: 308560 - DNA, 20 bp, Artificial Sequence
  chemically synthesized
catatgtgtattaacccacc

SEQ ID NO: 308561 - DNA, 20 bp, Artificial Sequence
  chemically synthesized
tatgtgtattaacccaccta

SEQ ID NO: 308562 - DNA, 20 bp, Artificial Sequence
  chemically synthesized
atgtgtattaacccacctag

SEQ ID NO: 308563 - DNA, 20 bp, Artificial Sequence
  chemically synthesized
tgtgttaatatcctctaggt

SEQ ID NO: 308564 - DNA, 20 bp, Artificial Sequence
  chemically synthesized
atgtgttaatatcctctagg

SEQ ID NO: 308565 - DNA, 20 bp, Artificial Sequence
  chemically synthesized
atcatgtgttaatatcctct

SEQ ID NO: 308566 - DNA, 20 bp, Artificial Sequence
  chemically synthesized
aatcatgtgttaatatcctc

SEQ ID NO: 308567 - DNA, 20 bp, Artificial Sequence
  chemically synthesized
ttaaacaatgcaaatgaaat

SEQ ID NO: 308568 - DNA, 20 bp, Artificial Sequence
  chemically synthesized
acaaaaaaaaaaaaaatagg

SEQ ID NO: 308569 - DNA, 20 bp, Artificial Sequence
  chemically synthesized
tctacaaaaaaaaaaaaaat

SEQ ID NO: 308570 - DNA, 20 bp, Artificial Sequence
  chemically synthesized
gtctacaaaaaaaaaaaaaa

SEQ ID NO: 308571 - DNA, 20 bp, Artificial Sequence
  chemically synthesized
acctattttttttttttttg

SEQ ID NO: 308572 - DNA, 20 bp, Artificial Sequence
  chemically synthesized
attttttttttttttgtaga

SEQ ID NO: 308573 - DNA, 20 bp, Artificial Sequence
  chemically synthesized
tttttttttttttgtagaca

SEQ ID NO: 308574 - DNA, 20 bp, Artificial Sequence
  chemically synthesized
cactccagcctgggtgacag

SEQ ID NO: 308575 - DNA, 20 bp, Artificial Sequence
  chemically synthesized
agagttttgctcctgtcacc

SEQ ID NO: 308576 - DNA, 20 bp, Artificial Sequence
  chemically synthesized
gagttttgctcctgtcaccc

SEQ ID NO: 308577 - DNA, 20 bp, Artificial Sequence
  chemically synthesized
tgcactccagcctgggtgac

SEQ ID NO: 308578 - DNA, 20 bp, Artificial Sequence
  chemically synthesized
ttgcactccagcctgggtga

SEQ ID NO: 308579 - DNA, 20 bp, Artificial Sequence
  chemically synthesized
tttgctcctgtcacccaggc

SEQ ID NO: 308580 - DNA, 20 bp, Artificial Sequence
  chemically synthesized
tgctcctgtcacccaggctg

SEQ ID NO: 308581 - DNA, 20 bp, Artificial Sequence
  chemically synthesized
gtgccattgcactccagcct

SEQ ID NO: 308582 - DNA, 20 bp, Artificial Sequence
  chemically synthesized
agtgccattgcactccagcc

SEQ ID NO: 308583 - DNA, 20 bp, Artificial Sequence
  chemically synthesized
gagatagtgccattgcactc

SEQ ID NO: 308584 - DNA, 20 bp, Artificial Sequence
  chemically synthesized
tcacccaggctggagtgcaa

SEQ ID NO: 308585 - DNA, 20 bp, Artificial Sequence
  chemically synthesized
ggagtgcaatggcactatct

SEQ ID NO: 308586 - DNA, 20 bp, Artificial Sequence
  chemically synthesized
gaggttgcagtgagctgaga

SEQ ID NO: 308587 - DNA, 20 bp, Artificial Sequence
  chemically synthesized
ggtggaggttgcagtgagct

SEQ ID NO: 308588 - DNA, 20 bp, Artificial Sequence
  chemically synthesized
caggaggtggaggttgcagt

SEQ ID NO: 308589 - DNA, 20 bp, Artificial Sequence
  chemically synthesized
aatccaggaggtggaggttg

SEQ ID NO: 308590 - DNA, 20 bp, Artificial Sequence
  chemically synthesized
tccctgaatccaggaggtgg

SEQ ID NO: 308591 - DNA, 20 bp, Artificial Sequence
  chemically synthesized
tcactgcaacctccacctcc

SEQ ID NO: 308592 - DNA, 20 bp, Artificial Sequence
  chemically synthesized
ttccctgaatccaggaggtg

SEQ ID NO: 308593 - DNA, 20 bp, Artificial Sequence
  chemically synthesized
aattccctgaatccaggagg

SEQ ID NO: 308594 - DNA, 20 bp, Artificial Sequence
  chemically synthesized
gagaattccctgaatccagg

SEQ ID NO: 308595 - DNA, 20 bp, Artificial Sequence
  chemically synthesized
caacctccacctcctggatt

SEQ ID NO: 308596 - DNA, 20 bp, Artificial Sequence
  chemically synthesized
ggagaattccctgaatccag

SEQ ID NO: 308597 - DNA, 20 bp, Artificial Sequence
  chemically synthesized
aacctccacctcctggattc

SEQ ID NO: 308598 - DNA, 20 bp, Artificial Sequence
  chemically synthesized
acctccacctcctggattca

SEQ ID NO: 308599 - DNA, 20 bp, Artificial Sequence
  chemically synthesized
caggagaattccctgaatcc

SEQ ID NO: 308600 - DNA, 20 bp, Artificial Sequence
  chemically synthesized
gcaggagaattccctgaatc

SEQ ID NO: 308601 - DNA, 20 bp, Artificial Sequence
  chemically synthesized
ttcagggaattctcctgcct

SEQ ID NO: 308602 - DNA, 20 bp, Artificial Sequence
  chemically synthesized
tactggggaggctgaggcag

SEQ ID NO: 308603 - DNA, 20 bp, Artificial Sequence
  chemically synthesized
gctactggggaggctgaggc

SEQ ID NO: 308604 - DNA, 20 bp, Artificial Sequence
  chemically synthesized
agctactggggaggctgagg

SEQ ID NO: 308605 - DNA, 20 bp, Artificial Sequence
  chemically synthesized
ctcagctactggggaggctg

SEQ ID NO: 308606 - DNA, 20 bp, Artificial Sequence
  chemically synthesized
tctcagctactggggaggct

SEQ ID NO: 308607 - DNA, 20 bp, Artificial Sequence
  chemically synthesized
ttctcctgcctcagcctccc

SEQ ID NO: 308608 - DNA, 20 bp, Artificial Sequence
  chemically synthesized
tcctgcctcagcctccccag

SEQ ID NO: 308609 - DNA, 20 bp, Artificial Sequence
  chemically synthesized
tgtaatctcagctactgggg

SEQ ID NO: 308610 - DNA, 20 bp, Artificial Sequence
  chemically synthesized
ctgtaatctcagctactggg

SEQ ID NO: 308611 - DNA, 20 bp, Artificial Sequence
  chemically synthesized
gcctgtaatctcagctactg

SEQ ID NO: 308612 - DNA, 20 bp, Artificial Sequence
  chemically synthesized
cctcagcctccccagtagct

SEQ ID NO: 308613 - DNA, 20 bp, Artificial Sequence
  chemically synthesized
tgcctgtaatctcagctact

SEQ ID NO: 308614 - DNA, 20 bp, Artificial Sequence
  chemically synthesized
atgcctgtaatctcagctac

SEQ ID NO: 308615 - DNA, 20 bp, Artificial Sequence
  chemically synthesized
ctccccagtagctgagatta

SEQ ID NO: 308616 - DNA, 20 bp, Artificial Sequence
  chemically synthesized
tccccagtagctgagattac

SEQ ID NO: 308617 - DNA, 20 bp, Artificial Sequence
  chemically synthesized
gtggtggatgcctgtaatct

SEQ ID NO: 308618 - DNA, 20 bp, Artificial Sequence
  chemically synthesized
aaattagccagacatggtgg

SEQ ID NO: 308619 - DNA, 20 bp, Artificial Sequence
  chemically synthesized
caggcatccaccaccatgtc

SEQ ID NO: 308620 - DNA, 20 bp, Artificial Sequence
  chemically synthesized
caaaaattagccagacatgg

SEQ ID NO: 308621 - DNA, 20 bp, Artificial Sequence
  chemically synthesized
atacaaaaattagccagaca

SEQ ID NO: 308622 - DNA, 20 bp, Artificial Sequence
  chemically synthesized
ctaaaaatacaaaaattagc

SEQ ID NO: 308623 - DNA, 20 bp, Artificial Sequence
  chemically synthesized
tctactaaaaatacaaaaat

SEQ ID NO: 308624 - DNA, 20 bp, Artificial Sequence
  chemically synthesized
ctggctaatttttgtatttt

SEQ ID NO: 308625 - DNA, 20 bp, Artificial Sequence
  chemically synthesized
gctaatttttgtatttttag

SEQ ID NO: 308626 - DNA, 20 bp, Artificial Sequence
  chemically synthesized
ttttgtatttttagtagaca

SEQ ID NO: 308627 - DNA, 20 bp, Artificial Sequence
  chemically synthesized
tttgtatttttagtagacac

SEQ ID NO: 308628 - DNA, 20 bp, Artificial Sequence
  chemically synthesized
ttgtatttttagtagacacg

SEQ ID NO: 308629 - DNA, 20 bp, Artificial Sequence
  chemically synthesized
gacacggggtttcgccatct

SEQ ID NO: 308630 - DNA, 20 bp, Artificial Sequence
  chemically synthesized
cggggtttcgccatcttggc

SEQ ID NO: 308631 - DNA, 20 bp, Artificial Sequence
  chemically synthesized
cgagagcagcctggccaaga

SEQ ID NO: 308632 - DNA, 20 bp, Artificial Sequence
  chemically synthesized
ggggtttcgccatcttggcc

SEQ ID NO: 308633 - DNA, 20 bp, Artificial Sequence
  chemically synthesized
agttcgagagcagcctggcc

SEQ ID NO: 308634 - DNA, 20 bp, Artificial Sequence
  chemically synthesized
tcaggagttcgagagcagcc

SEQ ID NO: 308635 - DNA, 20 bp, Artificial Sequence
  chemically synthesized
tgaggtcaggagttcgagag

SEQ ID NO: 308636 - DNA, 20 bp, Artificial Sequence
  chemically synthesized
acctgaggtcaggagttcga

SEQ ID NO: 308637 - DNA, 20 bp, Artificial Sequence
  chemically synthesized
tcacctgaggtcaggagttc

SEQ ID NO: 308638 - DNA, 20 bp, Artificial Sequence
  chemically synthesized
tgctctcgaactcctgacct

SEQ ID NO: 308639 - DNA, 20 bp, Artificial Sequence
  chemically synthesized
ggtggatcacctgaggtcag

SEQ ID NO: 308640 - DNA, 20 bp, Artificial Sequence
  chemically synthesized
gctctcgaactcctgacctc

SEQ ID NO: 308641 - DNA, 20 bp, Artificial Sequence
  chemically synthesized
caggtggatcacctgaggtc

SEQ ID NO: 308642 - DNA, 20 bp, Artificial Sequence
  chemically synthesized
gcaggtggatcacctgaggt

SEQ ID NO: 308643 - DNA, 20 bp, Artificial Sequence
  chemically synthesized
tgaggcaggtggatcacctg

SEQ ID NO: 308644 - DNA, 20 bp, Artificial Sequence
  chemically synthesized
ctgaggcaggtggatcacct

SEQ ID NO: 308645 - DNA, 20 bp, Artificial Sequence
  chemically synthesized
ctcaggtgatccacctgcct

SEQ ID NO: 308646 - DNA, 20 bp, Artificial Sequence
  chemically synthesized
ctttgggaggctgaggcagg

SEQ ID NO: 308647 - DNA, 20 bp, Artificial Sequence
  chemically synthesized
tcactttgggaggctgaggc

SEQ ID NO: 308648 - DNA, 20 bp, Artificial Sequence
  chemically synthesized
atcactttgggaggctgagg

SEQ ID NO: 308649 - DNA, 20 bp, Artificial Sequence
  chemically synthesized
cccatcactttgggaggctg

SEQ ID NO: 308650 - DNA, 20 bp, Artificial Sequence
  chemically synthesized
tcccatcactttgggaggct

SEQ ID NO: 308651 - DNA, 20 bp, Artificial Sequence
  chemically synthesized
ccacctgcctcagcctccca

SEQ ID NO: 308652 - DNA, 20 bp, Artificial Sequence
  chemically synthesized
tgtaatcccatcactttggg

SEQ ID NO: 308653 - DNA, 20 bp, Artificial Sequence
  chemically synthesized
ctgtaatcccatcactttgg

SEQ ID NO: 308654 - DNA, 20 bp, Artificial Sequence
  chemically synthesized
gcctcagcctcccaaagtga

SEQ ID NO: 308655 - DNA, 20 bp, Artificial Sequence
  chemically synthesized
gcctgtaatcccatcacttt

SEQ ID NO: 308656 - DNA, 20 bp, Artificial Sequence
  chemically synthesized
cctcagcctcccaaagtgat

SEQ ID NO: 308657 - DNA, 20 bp, Artificial Sequence
  chemically synthesized
tgcctgtaatcccatcactt

SEQ ID NO: 308658 - DNA, 20 bp, Artificial Sequence
  chemically synthesized
ctcccaaagtgatgggatta

SEQ ID NO: 308659 - DNA, 20 bp, Artificial Sequence
  chemically synthesized
tcccaaagtgatgggattac

SEQ ID NO: 308660 - DNA, 20 bp, Artificial Sequence
  chemically synthesized
agtgatgggattacaggcat

SEQ ID NO: 308661 - DNA, 20 bp, Artificial Sequence
  chemically synthesized
caggcatgagccactgcacc

SEQ ID NO: 308662 - DNA, 20 bp, Artificial Sequence
  chemically synthesized
tggattagggccaggtgcag

SEQ ID NO: 308663 - DNA, 20 bp, Artificial Sequence
  chemically synthesized
aggtggattagggccaggtg

SEQ ID NO: 308664 - DNA, 20 bp, Artificial Sequence
  chemically synthesized
gaaataggtggattagggcc

SEQ ID NO: 308665 - DNA, 20 bp, Artificial Sequence
  chemically synthesized
agaaataggtggattagggc

SEQ ID NO: 308666 - DNA, 20 bp, Artificial Sequence
  chemically synthesized
acttagaaataggtggatta

SEQ ID NO: 308667 - DNA, 20 bp, Artificial Sequence
  chemically synthesized
cacttagaaataggtggatt

SEQ ID NO: 308668 - DNA, 20 bp, Artificial Sequence
  chemically synthesized
tcacttagaaataggtggat

SEQ ID NO: 308669 - DNA, 20 bp, Artificial Sequence
  chemically synthesized
cctagtcacttagaaatagg

SEQ ID NO: 308670 - DNA, 20 bp, Artificial Sequence
  chemically synthesized
gccctaatccacctatttct

SEQ ID NO: 308671 - DNA, 20 bp, Artificial Sequence
  chemically synthesized
tctcctagtcacttagaaat

SEQ ID NO: 308672 - DNA, 20 bp, Artificial Sequence
  chemically synthesized
ctctcctagtcacttagaaa

SEQ ID NO: 308673 - DNA, 20 bp, Artificial Sequence
  chemically synthesized
tccacctatttctaagtgac

SEQ ID NO: 308674 - DNA, 20 bp, Artificial Sequence
  chemically synthesized
ccacctatttctaagtgact

SEQ ID NO: 308675 - DNA, 20 bp, Artificial Sequence
  chemically synthesized
acgtgactctcctagtcact

SEQ ID NO: 308676 - DNA, 20 bp, Artificial Sequence
  chemically synthesized
acctatttctaagtgactag

SEQ ID NO: 308677 - DNA, 20 bp, Artificial Sequence
  chemically synthesized
ctatttctaagtgactagga

SEQ ID NO: 308678 - DNA, 20 bp, Artificial Sequence
  chemically synthesized
tttaagaaacgtgactctcc

SEQ ID NO: 308679 - DNA, 20 bp, Artificial Sequence
  chemically synthesized
ggtgatagattaaacaattt

SEQ ID NO: 308680 - DNA, 20 bp, Artificial Sequence
  chemically synthesized
tatttttttttaagtggtga

SEQ ID NO: 308681 - DNA, 20 bp, Artificial Sequence
  chemically synthesized
tgcgtgtatttttttttaag

SEQ ID NO: 308682 - DNA, 20 bp, Artificial Sequence
  chemically synthesized
ccatgcgtgtattttttttt

SEQ ID NO: 308683 - DNA, 20 bp, Artificial Sequence
  chemically synthesized
cttaaaaaaaaatacacgca

SEQ ID NO: 308684 - DNA, 20 bp, Artificial Sequence
  chemically synthesized
ttaaaaaaaaatacacgcat

SEQ ID NO: 308685 - DNA, 20 bp, Artificial Sequence
  chemically synthesized
aaaatacacgcatgggtaaa

SEQ ID NO: 308686 - DNA, 20 bp, Artificial Sequence
  chemically synthesized
atacacgcatgggtaaacag

SEQ ID NO: 308687 - DNA, 20 bp, Artificial Sequence
  chemically synthesized
tacacgcatgggtaaacaga

SEQ ID NO: 308688 - DNA, 20 bp, Artificial Sequence
  chemically synthesized
acgcatgggtaaacagaagg

SEQ ID NO: 308689 - DNA, 20 bp, Artificial Sequence
  chemically synthesized
aggcagtcaacattttccta

SEQ ID NO: 308690 - DNA, 20 bp, Artificial Sequence
  chemically synthesized
catgattatgttaatactgt

SEQ ID NO: 308691 - DNA, 20 bp, Artificial Sequence
  chemically synthesized
acatgattatgttaatactg

SEQ ID NO: 308692 - DNA, 20 bp, Artificial Sequence
  chemically synthesized
cataatcatgtacttatatg

SEQ ID NO: 308693 - DNA, 20 bp, Artificial Sequence
  chemically synthesized
cttatgattgagctgcatat

SEQ ID NO: 308694 - DNA, 20 bp, Artificial Sequence
  chemically synthesized
cttatatgcagctcaatcat

SEQ ID NO: 308695 - DNA, 20 bp, Artificial Sequence
  chemically synthesized
ctgaaaactcacttatgatt

SEQ ID NO: 308696 - DNA, 20 bp, Artificial Sequence
  chemically synthesized
tatgcagctcaatcataagt

SEQ ID NO: 308697 - DNA, 20 bp, Artificial Sequence
  chemically synthesized
ctcaatcataagtgagtttt

SEQ ID NO: 308698 - DNA, 20 bp, Artificial Sequence
  chemically synthesized
caataacattgatatttatg

SEQ ID NO: 308699 - DNA, 20 bp, Artificial Sequence
  chemically synthesized
aatatcaatgttattgcttt

SEQ ID NO: 308700 - DNA, 20 bp, Artificial Sequence
  chemically synthesized
taacagttacattatgctga

SEQ ID NO: 308701 - DNA, 20 bp, Artificial Sequence
  chemically synthesized
gtgaaactacaaaaaattaa

SEQ ID NO: 308702 - DNA, 20 bp, Artificial Sequence
  chemically synthesized
atgtaactgttaattttttg

SEQ ID NO: 308703 - DNA, 20 bp, Artificial Sequence
  chemically synthesized
ttcaaaataagttgagtaga

SEQ ID NO: 308704 - DNA, 20 bp, Artificial Sequence
  chemically synthesized
ataattcaaaataagttgag

SEQ ID NO: 308705 - DNA, 20 bp, Artificial Sequence
  chemically synthesized
aacataattcaaaataagtt

SEQ ID NO: 308706 - DNA, 20 bp, Artificial Sequence
  chemically synthesized
ttgtaaacataattcaaaat

SEQ ID NO: 308707 - DNA, 20 bp, Artificial Sequence
  chemically synthesized
ttgaattatgtttacaataa

SEQ ID NO: 308708 - DNA, 20 bp, Artificial Sequence
  chemically synthesized
tatgtttacaataaaagcca

SEQ ID NO: 308709 - DNA, 20 bp, Artificial Sequence
  chemically synthesized
gcatcactgtttgagcgcta

SEQ ID NO: 308710 - DNA, 20 bp, Artificial Sequence
  chemically synthesized
taaaagccatagcgctcaaa

SEQ ID NO: 308711 - DNA, 20 bp, Artificial Sequence
  chemically synthesized
ggtatctcgcatcactgttt

SEQ ID NO: 308712 - DNA, 20 bp, Artificial Sequence
  chemically synthesized
tagcgctcaaacagtgatgc

SEQ ID NO: 308713 - DNA, 20 bp, Artificial Sequence
  chemically synthesized
acagtgatgcgagataccca

SEQ ID NO: 308714 - DNA, 20 bp, Artificial Sequence
  chemically synthesized
cagtgatgcgagatacccac

SEQ ID NO: 308715 - DNA, 20 bp, Artificial Sequence
  chemically synthesized
taagctcgcacatttcctgt

SEQ ID NO: 308716 - DNA, 20 bp, Artificial Sequence
  chemically synthesized
ttaagctcgcacatttcctg

SEQ ID NO: 308717 - DNA, 20 bp, Artificial Sequence
  chemically synthesized
gatacccacaggaaatgtgc

SEQ ID NO: 308718 - DNA, 20 bp, Artificial Sequence
  chemically synthesized
gtgactaaattcattgattt

SEQ ID NO: 308719 - DNA, 20 bp, Artificial Sequence
  chemically synthesized
cgagcttaaatcaatgaatt

SEQ ID NO: 308720 - DNA, 20 bp, Artificial Sequence
  chemically synthesized
tcgtaataattagatggttg

SEQ ID NO: 308721 - DNA, 20 bp, Artificial Sequence
  chemically synthesized
actgcttcgtaataattaga

SEQ ID NO: 308722 - DNA, 20 bp, Artificial Sequence
  chemically synthesized
atatactgcttcgtaataat

SEQ ID NO: 308723 - DNA, 20 bp, Artificial Sequence
  chemically synthesized
tcaaccatctaattattacg

SEQ ID NO: 308724 - DNA, 20 bp, Artificial Sequence
  chemically synthesized
accatctaattattacgaag

SEQ ID NO: 308725 - DNA, 20 bp, Artificial Sequence
  chemically synthesized
ttattacgaagcagtatata

SEQ ID NO: 308726 - DNA, 20 bp, Artificial Sequence
  chemically synthesized
tattacgaagcagtatatat

SEQ ID NO: 308727 - DNA, 20 bp, Artificial Sequence
  chemically synthesized
aaaaaaatgcaagtatgttt

SEQ ID NO: 308728 - DNA, 20 bp, Artificial Sequence
  chemically synthesized
gaagttagctaaaaaaatgc

SEQ ID NO: 308729 - DNA, 20 bp, Artificial Sequence
  chemically synthesized
aaaacatacttgcatttttt

SEQ ID NO: 308730 - DNA, 20 bp, Artificial Sequence
  chemically synthesized
catttttttagctaacttcc

SEQ ID NO: 308731 - DNA, 20 bp, Artificial Sequence
  chemically synthesized
tgacagggtcactaggaagt

SEQ ID NO: 308732 - DNA, 20 bp, Artificial Sequence
  chemically synthesized
gcactgacagggtcactagg

SEQ ID NO: 308733 - DNA, 20 bp, Artificial Sequence
  chemically synthesized
catgcactgacagggtcact

SEQ ID NO: 308734 - DNA, 20 bp, Artificial Sequence
  chemically synthesized
acatgcactgacagggtcac

SEQ ID NO: 308735 - DNA, 20 bp, Artificial Sequence
  chemically synthesized
taacttcctagtgaccctgt

SEQ ID NO: 308736 - DNA, 20 bp, Artificial Sequence
  chemically synthesized
ttacctgacatgcactgaca

SEQ ID NO: 308737 - DNA, 20 bp, Artificial Sequence
  chemically synthesized
tttacctgacatgcactgac

SEQ ID NO: 308738 - DNA, 20 bp, Artificial Sequence
  chemically synthesized
ttttacctgacatgcactga

SEQ ID NO: 308739 - DNA, 20 bp, Artificial Sequence
  chemically synthesized
gtgaccctgtcagtgcatgt

SEQ ID NO: 308740 - DNA, 20 bp, Artificial Sequence
  chemically synthesized
tgaccctgtcagtgcatgtc

SEQ ID NO: 308741 - DNA, 20 bp, Artificial Sequence
  chemically synthesized
tcagtgcatgtcaggtaaaa

SEQ ID NO: 308742 - DNA, 20 bp, Artificial Sequence
  chemically synthesized
taaaatggcacgtaacaaaa

SEQ ID NO: 308743 - DNA, 20 bp, Artificial Sequence
  chemically synthesized
gcacgtaacaaaatggttaa

SEQ ID NO: 308744 - DNA, 20 bp, Artificial Sequence
  chemically synthesized
taacaaaatggttaatagat

SEQ ID NO: 308745 - DNA, 20 bp, Artificial Sequence
  chemically synthesized
aatggttaatagattagttg

SEQ ID NO: 308746 - DNA, 20 bp, Artificial Sequence
  chemically synthesized
atggttaatagattagttgt

SEQ ID NO: 308747 - DNA, 20 bp, Artificial Sequence
  chemically synthesized
ggttaatagattagttgtgg

SEQ ID NO: 308748 - DNA, 20 bp, Artificial Sequence
  chemically synthesized
agattagttgtgggagaaaa

SEQ ID NO: 308749 - DNA, 20 bp, Artificial Sequence
  chemically synthesized
tgggagaaaaaagcttcaaa

SEQ ID NO: 308750 - DNA, 20 bp, Artificial Sequence
  chemically synthesized
ggagaaaaaagcttcaaatg

SEQ ID NO: 308751 - DNA, 20 bp, Artificial Sequence
  chemically synthesized
gataagattttctccatttg

SEQ ID NO: 308752 - DNA, 20 bp, Artificial Sequence
  chemically synthesized
tggagaaaatcttatctctt

SEQ ID NO: 308753 - DNA, 20 bp, Artificial Sequence
  chemically synthesized
gtagtttatacttaagagat

SEQ ID NO: 308754 - DNA, 20 bp, Artificial Sequence
  chemically synthesized
atggtgtagtttatacttaa

SEQ ID NO: 308755 - DNA, 20 bp, Artificial Sequence
  chemically synthesized
agatggtgtagtttatactt

SEQ ID NO: 308756 - DNA, 20 bp, Artificial Sequence
  chemically synthesized
atcacgtcaggtagatggtg

SEQ ID NO: 308757 - DNA, 20 bp, Artificial Sequence
  chemically synthesized
gcatcatcacgtcaggtaga

SEQ ID NO: 308758 - DNA, 20 bp, Artificial Sequence
  chemically synthesized
atctgcatcatcacgtcagg

SEQ ID NO: 308759 - DNA, 20 bp, Artificial Sequence
  chemically synthesized
tagatctgcatcatcacgtc

SEQ ID NO: 308760 - DNA, 20 bp, Artificial Sequence
  chemically synthesized
gtagatctgcatcatcacgt

SEQ ID NO: 308761 - DNA, 20 bp, Artificial Sequence
  chemically synthesized
atctacctgacgtgatgatg

SEQ ID NO: 308762 - DNA, 20 bp, Artificial Sequence
  chemically synthesized
cgtgatgatgcagatctaca

SEQ ID NO: 308763 - DNA, 20 bp, Artificial Sequence
  chemically synthesized
tttcccacattttgactttg

SEQ ID NO: 308764 - DNA, 20 bp, Artificial Sequence
  chemically synthesized
agatctacaaagtcaaaatg

SEQ ID NO: 308765 - DNA, 20 bp, Artificial Sequence
  chemically synthesized
gatctacaaagtcaaaatgt

SEQ ID NO: 308766 - DNA, 20 bp, Artificial Sequence
  chemically synthesized
aaaatgtgggaaatttattg

SEQ ID NO: 308767 - DNA, 20 bp, Artificial Sequence
  chemically synthesized
tcttcttcactggagttgat

SEQ ID NO: 308768 - DNA, 20 bp, Artificial Sequence
  chemically synthesized
ttattgtagcccatcaactc

SEQ ID NO: 308769 - DNA, 20 bp, Artificial Sequence
  chemically synthesized
gtcttcttcactggagttga

SEQ ID NO: 308770 - DNA, 20 bp, Artificial Sequence
  chemically synthesized
gtagcccatcaactccagtg

SEQ ID NO: 308771 - DNA, 20 bp, Artificial Sequence
  chemically synthesized
cttgactgtcttcttcactg

SEQ ID NO: 308772 - DNA, 20 bp, Artificial Sequence
  chemically synthesized
gcccatcaactccagtgaag

SEQ ID NO: 308773 - DNA, 20 bp, Artificial Sequence
  chemically synthesized
cccttgactgtcttcttcac

SEQ ID NO: 308774 - DNA, 20 bp, Artificial Sequence
  chemically synthesized
atcaactccagtgaagaaga

SEQ ID NO: 308775 - DNA, 20 bp, Artificial Sequence
  chemically synthesized
ctccagtgaagaagacagtc

SEQ ID NO: 308776 - DNA, 20 bp, Artificial Sequence
  chemically synthesized
tccagtgaagaagacagtca

SEQ ID NO: 308777 - DNA, 20 bp, Artificial Sequence
  chemically synthesized
ccagtgaagaagacagtcaa

SEQ ID NO: 308778 - DNA, 20 bp, Artificial Sequence
  chemically synthesized
gtgaagaagacagtcaaggg

SEQ ID NO: 308779 - DNA, 20 bp, Artificial Sequence
  chemically synthesized
aagaagacagtcaagggaag

SEQ ID NO: 308780 - DNA, 20 bp, Artificial Sequence
  chemically synthesized
agaagacagtcaagggaaga

SEQ ID NO: 308781 - DNA, 20 bp, Artificial Sequence
  chemically synthesized
gaagacagtcaagggaagaa

SEQ ID NO: 308782 - DNA, 20 bp, Artificial Sequence
  chemically synthesized
agggaagaagggacaaactc

SEQ ID NO: 308783 - DNA, 20 bp, Artificial Sequence
  chemically synthesized
gaagggacaaactcaagcta

SEQ ID NO: 308784 - DNA, 20 bp, Artificial Sequence
  chemically synthesized
tgaatatgatgctatagctt

SEQ ID NO: 308785 - DNA, 20 bp, Artificial Sequence
  chemically synthesized
tgtttatgaatatgatgcta

SEQ ID NO: 308786 - DNA, 20 bp, Artificial Sequence
  chemically synthesized
catcatattcataaacaaaa

SEQ ID NO: 308787 - DNA, 20 bp, Artificial Sequence
  chemically synthesized
cataaacaaaaaagactttc

SEQ ID NO: 308788 - DNA, 20 bp, Artificial Sequence
  chemically synthesized
aagatgctatatatacttga

SEQ ID NO: 308789 - DNA, 20 bp, Artificial Sequence
  chemically synthesized
aaaagactttcaagtatata

SEQ ID NO: 308790 - DNA, 20 bp, Artificial Sequence
  chemically synthesized
tatatatagcatcttctctc

SEQ ID NO: 308791 - DNA, 20 bp, Artificial Sequence
  chemically synthesized
tgtcttgtagcactagagag

SEQ ID NO: 308792 - DNA, 20 bp, Artificial Sequence
  chemically synthesized
atatgtcttgtagcactaga

SEQ ID NO: 308793 - DNA, 20 bp, Artificial Sequence
  chemically synthesized
ctatatgtcttgtagcacta

SEQ ID NO: 308794 - DNA, 20 bp, Artificial Sequence
  chemically synthesized
catcttctctctagtgctac

SEQ ID NO: 308795 - DNA, 20 bp, Artificial Sequence
  chemically synthesized
tactatatgtcttgtagcac

SEQ ID NO: 308796 - DNA, 20 bp, Artificial Sequence
  chemically synthesized
agtggatactatatgtcttg

SEQ ID NO: 308797 - DNA, 20 bp, Artificial Sequence
  chemically synthesized
ctctagtgctacaagacata

SEQ ID NO: 308798 - DNA, 20 bp, Artificial Sequence
  chemically synthesized
aagacatatagtatccactg

SEQ ID NO: 308799 - DNA, 20 bp, Artificial Sequence
  chemically synthesized
acatatagtatccactgaag

SEQ ID NO: 308800 - DNA, 20 bp, Artificial Sequence
  chemically synthesized
agcttaaaatgctgcttcag

SEQ ID NO: 308801 - DNA, 20 bp, Artificial Sequence
  chemically synthesized
acaagcttaaaatgctgctt

SEQ ID NO: 308802 - DNA, 20 bp, Artificial Sequence
  chemically synthesized
atccactgaagcagcatttt

SEQ ID NO: 308803 - DNA, 20 bp, Artificial Sequence
  chemically synthesized
atttccacctatggggttac

SEQ ID NO: 308804 - DNA, 20 bp, Artificial Sequence
  chemically synthesized
attttaagcttgtaacccca

SEQ ID NO: 308805 - DNA, 20 bp, Artificial Sequence
  chemically synthesized
ttttaagcttgtaaccccat

SEQ ID NO: 308806 - DNA, 20 bp, Artificial Sequence
  chemically synthesized
taagcttgtaaccccatagg

SEQ ID NO: 308807 - DNA, 20 bp, Artificial Sequence
  chemically synthesized
attatacatttccacctatg

SEQ ID NO: 308808 - DNA, 20 bp, Artificial Sequence
  chemically synthesized
aattatacatttccacctat

SEQ ID NO: 308809 - DNA, 20 bp, Artificial Sequence
  chemically synthesized
aaattatacatttccaccta

SEQ ID NO: 308810 - DNA, 20 bp, Artificial Sequence
  chemically synthesized
aatgtataatttattaattt

SEQ ID NO: 308811 - DNA, 20 bp, Artificial Sequence
  chemically synthesized
gtataatttattaattttag

SEQ ID NO: 308812 - DNA, 20 bp, Artificial Sequence
  chemically synthesized
tataatttattaattttagt

SEQ ID NO: 308813 - DNA, 20 bp, Artificial Sequence
  chemically synthesized
tgggaatacaaatccaaata

SEQ ID NO: 308814 - DNA, 20 bp, Artificial Sequence
  chemically synthesized
tggaataggggatctttatt

SEQ ID NO: 308815 - DNA, 20 bp, Artificial Sequence
  chemically synthesized
caaataaagatcccctattc

SEQ ID NO: 308816 - DNA, 20 bp, Artificial Sequence
  chemically synthesized
aaataaagatcccctattcc

SEQ ID NO: 308817 - DNA, 20 bp, Artificial Sequence
  chemically synthesized
tgttatacaacctggaatag

SEQ ID NO: 308818 - DNA, 20 bp, Artificial Sequence
  chemically synthesized
atgttatacaacctggaata

SEQ ID NO: 308819 - DNA, 20 bp, Artificial Sequence
  chemically synthesized
aatgttatacaacctggaat

SEQ ID NO: 308820 - DNA, 20 bp, Artificial Sequence
  chemically synthesized
aaatgttatacaacctggaa

SEQ ID NO: 308821 - DNA, 20 bp, Artificial Sequence
  chemically synthesized
tttgaaaatgttatacaacc

SEQ ID NO: 308822 - DNA, 20 bp, Artificial Sequence
  chemically synthesized
ttcaaatttattgaaattct

SEQ ID NO: 308823 - DNA, 20 bp, Artificial Sequence
  chemically synthesized
tgcatcccattagtacatct

SEQ ID NO: 308824 - DNA, 20 bp, Artificial Sequence
  chemically synthesized
gaaattctgagatgtactaa

SEQ ID NO: 308825 - DNA, 20 bp, Artificial Sequence
  chemically synthesized
aaattctgagatgtactaat

SEQ ID NO: 308826 - DNA, 20 bp, Artificial Sequence
  chemically synthesized
caatattaaatgcatcccat

SEQ ID NO: 308827 - DNA, 20 bp, Artificial Sequence
  chemically synthesized
atgggatgcatttaatattg

SEQ ID NO: 308828 - DNA, 20 bp, Artificial Sequence
  chemically synthesized
tgcagttttgttcactgtat

SEQ ID NO: 308829 - DNA, 20 bp, Artificial Sequence
  chemically synthesized
ttagttttttgtgactcata

SEQ ID NO: 308830 - DNA, 20 bp, Artificial Sequence
  chemically synthesized
tatgagtcacaaaaaactaa

SEQ ID NO: 308831 - DNA, 20 bp, Artificial Sequence
  chemically synthesized
tgagtcacaaaaaactaata

SEQ ID NO: 308832 - DNA, 20 bp, Artificial Sequence
  chemically synthesized
gtcacaaaaaactaatagag

SEQ ID NO: 308833 - DNA, 20 bp, Artificial Sequence
  chemically synthesized
ataaaggagaactactctat

SEQ ID NO: 308834 - DNA, 20 bp, Artificial Sequence
  chemically synthesized
catatcccctatggataaag

SEQ ID NO: 308835 - DNA, 20 bp, Artificial Sequence
  chemically synthesized
gagtagttctcctttatcca

SEQ ID NO: 308836 - DNA, 20 bp, Artificial Sequence
  chemically synthesized
agcatatcccctatggataa

SEQ ID NO: 308837 - DNA, 20 bp, Artificial Sequence
  chemically synthesized
agtagttctcctttatccat

SEQ ID NO: 308838 - DNA, 20 bp, Artificial Sequence
  chemically synthesized
aagcatatcccctatggata

SEQ ID NO: 308839 - DNA, 20 bp, Artificial Sequence
  chemically synthesized
gtagttctcctttatccata

SEQ ID NO: 308840 - DNA, 20 bp, Artificial Sequence
  chemically synthesized
tagttctcctttatccatag

SEQ ID NO: 308841 - DNA, 20 bp, Artificial Sequence
  chemically synthesized
attttgaagcatatccccta

SEQ ID NO: 308842 - DNA, 20 bp, Artificial Sequence
  chemically synthesized
gcatccacctgaggattttg

SEQ ID NO: 308843 - DNA, 20 bp, Artificial Sequence
  chemically synthesized
gggatatgcttcaaaatcct

SEQ ID NO: 308844 - DNA, 20 bp, Artificial Sequence
  chemically synthesized
ggatatgcttcaaaatcctc

SEQ ID NO: 308845 - DNA, 20 bp, Artificial Sequence
  chemically synthesized
tatgcttcaaaatcctcagg

SEQ ID NO: 308846 - DNA, 20 bp, Artificial Sequence
  chemically synthesized
cagttttaggcatccacctg

SEQ ID NO: 308847 - DNA, 20 bp, Artificial Sequence
  chemically synthesized
gcagttttaggcatccacct

SEQ ID NO: 308848 - DNA, 20 bp, Artificial Sequence
  chemically synthesized
caggtggatgcctaaaactg

SEQ ID NO: 308849 - DNA, 20 bp, Artificial Sequence
  chemically synthesized
tttgtactacctgcagtttt

SEQ ID NO: 308850 - DNA, 20 bp, Artificial Sequence
  chemically synthesized
aggtggatgcctaaaactgc

SEQ ID NO: 308851 - DNA, 20 bp, Artificial Sequence
  chemically synthesized
ttttgtactacctgcagttt

SEQ ID NO: 308852 - DNA, 20 bp, Artificial Sequence
  chemically synthesized
tggatgcctaaaactgcagg

SEQ ID NO: 308853 - DNA, 20 bp, Artificial Sequence
  chemically synthesized
atagggttttgtactacctg

SEQ ID NO: 308854 - DNA, 20 bp, Artificial Sequence
  chemically synthesized
gtagtacaaaaccctatata

SEQ ID NO: 308855 - DNA, 20 bp, Artificial Sequence
  chemically synthesized
attcataaatactatatata

SEQ ID NO: 308856 - DNA, 20 bp, Artificial Sequence
  chemically synthesized
aattcataaatactatatat

SEQ ID NO: 308857 - DNA, 20 bp, Artificial Sequence
  chemically synthesized
aaattcataaatactatata

SEQ ID NO: 308858 - DNA, 20 bp, Artificial Sequence
  chemically synthesized
tatccgtgaaattgcgaaga

SEQ ID NO: 308859 - DNA, 20 bp, Artificial Sequence
  chemically synthesized
agtctatccgtgaaattgcg

SEQ ID NO: 308860 - DNA, 20 bp, Artificial Sequence
  chemically synthesized
tttctttcttcgcaatttca

SEQ ID NO: 308861 - DNA, 20 bp, Artificial Sequence
  chemically synthesized
tttcttcgcaatttcacgga

SEQ ID NO: 308862 - DNA, 20 bp, Artificial Sequence
  chemically synthesized
tcaaaatctgtggtaagagc

SEQ ID NO: 308863 - DNA, 20 bp, Artificial Sequence
  chemically synthesized
ggatagacttgctcttacca

SEQ ID NO: 308864 - DNA, 20 bp, Artificial Sequence
  chemically synthesized
ttgctcaaaatctgtggtaa

SEQ ID NO: 308865 - DNA, 20 bp, Artificial Sequence
  chemically synthesized
ggttgctcaaaatctgtggt

SEQ ID NO: 308866 - DNA, 20 bp, Artificial Sequence
  chemically synthesized
ctggggttgctcaaaatctg

SEQ ID NO: 308867 - DNA, 20 bp, Artificial Sequence
  chemically synthesized
ttgctcttaccacagatttt

SEQ ID NO: 308868 - DNA, 20 bp, Artificial Sequence
  chemically synthesized
ccacagattttgagcaaccc

SEQ ID NO: 308869 - DNA, 20 bp, Artificial Sequence
  chemically synthesized
aagaaaaaaatcgcatgctg

SEQ ID NO: 308870 - DNA, 20 bp, Artificial Sequence
  chemically synthesized
caagaaaaaaatcgcatgct

SEQ ID NO: 308871 - DNA, 20 bp, Artificial Sequence
  chemically synthesized
gcaagaaaaaaatcgcatgc

SEQ ID NO: 308872 - DNA, 20 bp, Artificial Sequence
  chemically synthesized
ggttcccaacttaataaggc

SEQ ID NO: 308873 - DNA, 20 bp, Artificial Sequence
  chemically synthesized
gatttttttcttgccttatt

SEQ ID NO: 308874 - DNA, 20 bp, Artificial Sequence
  chemically synthesized
aaaaggttcccaacttaata

SEQ ID NO: 308875 - DNA, 20 bp, Artificial Sequence
  chemically synthesized
tttttcttgccttattaagt

SEQ ID NO: 308876 - DNA, 20 bp, Artificial Sequence
  chemically synthesized
gaaaaggttcccaacttaat

SEQ ID NO: 308877 - DNA, 20 bp, Artificial Sequence
  chemically synthesized
ttttcttgccttattaagtt

SEQ ID NO: 308878 - DNA, 20 bp, Artificial Sequence
  chemically synthesized
agggttttctttatgtgaaa

SEQ ID NO: 308879 - DNA, 20 bp, Artificial Sequence
  chemically synthesized
aagggttttctttatgtgaa

SEQ ID NO: 308880 - DNA, 20 bp, Artificial Sequence
  chemically synthesized
gttgggaaccttttcacata

SEQ ID NO: 308881 - DNA, 20 bp, Artificial Sequence
  chemically synthesized
cacataaagaaaacccttca

SEQ ID NO: 308882 - DNA, 20 bp, Artificial Sequence
  chemically synthesized
tgccaaagaaaaactgtgaa

SEQ ID NO: 308883 - DNA, 20 bp, Artificial Sequence
  chemically synthesized
atgccaaagaaaaactgtga

SEQ ID NO: 308884 - DNA, 20 bp, Artificial Sequence
  chemically synthesized
tatgccaaagaaaaactgtg

SEQ ID NO: 308885 - DNA, 20 bp, Artificial Sequence
  chemically synthesized
aacccttcacagtttttctt

SEQ ID NO: 308886 - DNA, 20 bp, Artificial Sequence
  chemically synthesized
gtggcagttcaaatatgcca

SEQ ID NO: 308887 - DNA, 20 bp, Artificial Sequence
  chemically synthesized
tgcaagagtagttatggtgg

SEQ ID NO: 308888 - DNA, 20 bp, Artificial Sequence
  chemically synthesized
aagtgcaagagtagttatgg

SEQ ID NO: 308889 - DNA, 20 bp, Artificial Sequence
  chemically synthesized
ccaaagtgcaagagtagtta

SEQ ID NO: 308890 - DNA, 20 bp, Artificial Sequence
  chemically synthesized
atggccccaaagtgcaagag

SEQ ID NO: 308891 - DNA, 20 bp, Artificial Sequence
  chemically synthesized
gtcatggccccaaagtgcaa

SEQ ID NO: 308892 - DNA, 20 bp, Artificial Sequence
  chemically synthesized
ccataactactcttgcactt

SEQ ID NO: 308893 - DNA, 20 bp, Artificial Sequence
  chemically synthesized
cataactactcttgcacttt

SEQ ID NO: 308894 - DNA, 20 bp, Artificial Sequence
  chemically synthesized
tagtcatggccccaaagtgc

SEQ ID NO: 308895 - DNA, 20 bp, Artificial Sequence
  chemically synthesized
ataactactcttgcactttg

SEQ ID NO: 308896 - DNA, 20 bp, Artificial Sequence
  chemically synthesized
tttacttagtcatggcccca

SEQ ID NO: 308897 - DNA, 20 bp, Artificial Sequence
  chemically synthesized
tgcactttggggccatgact

SEQ ID NO: 308898 - DNA, 20 bp, Artificial Sequence
  chemically synthesized
accctagttttacttagtca

SEQ ID NO: 308899 - DNA, 20 bp, Artificial Sequence
  chemically synthesized
caagtcaccctagttttact

SEQ ID NO: 308900 - DNA, 20 bp, Artificial Sequence
  chemically synthesized
gggccatgactaagtaaaac

SEQ ID NO: 308901 - DNA, 20 bp, Artificial Sequence
  chemically synthesized
ggccatgactaagtaaaact

SEQ ID NO: 308902 - DNA, 20 bp, Artificial Sequence
  chemically synthesized
gccatgactaagtaaaacta

SEQ ID NO: 308903 - DNA, 20 bp, Artificial Sequence
  chemically synthesized
tgcttgtgttcaagtcaccc

SEQ ID NO: 308904 - DNA, 20 bp, Artificial Sequence
  chemically synthesized
aactagggtgacttgaacac

SEQ ID NO: 308905 - DNA, 20 bp, Artificial Sequence
  chemically synthesized
gtatcgcagtgcttgtgttc

SEQ ID NO: 308906 - DNA, 20 bp, Artificial Sequence
  chemically synthesized
gaaacactgtcatggtatcg

SEQ ID NO: 308907 - DNA, 20 bp, Artificial Sequence
  chemically synthesized
caagcactgcgataccatga

SEQ ID NO: 308908 - DNA, 20 bp, Artificial Sequence
  chemically synthesized
ggttcttagaaacactgtca

SEQ ID NO: 308909 - DNA, 20 bp, Artificial Sequence
  chemically synthesized
gataccatgacagtgtttct

SEQ ID NO: 308910 - DNA, 20 bp, Artificial Sequence
  chemically synthesized
tgacagtgtttctaagaacc

SEQ ID NO: 308911 - DNA, 20 bp, Artificial Sequence
  chemically synthesized
tcagtacctgtctaggttct

SEQ ID NO: 308912 - DNA, 20 bp, Artificial Sequence
  chemically synthesized
agtgtttctaagaacctaga

SEQ ID NO: 308913 - DNA, 20 bp, Artificial Sequence
  chemically synthesized
gtgtttctaagaacctagac

SEQ ID NO: 308914 - DNA, 20 bp, Artificial Sequence
  chemically synthesized
ccattactcagtacctgtct

SEQ ID NO: 308915 - DNA, 20 bp, Artificial Sequence
  chemically synthesized
cccattactcagtacctgtc

SEQ ID NO: 308916 - DNA, 20 bp, Artificial Sequence
  chemically synthesized
taagaacctagacaggtact

SEQ ID NO: 308917 - DNA, 20 bp, Artificial Sequence
  chemically synthesized
cctagacaggtactgagtaa

SEQ ID NO: 308918 - DNA, 20 bp, Artificial Sequence
  chemically synthesized
ctagacaggtactgagtaat

SEQ ID NO: 308919 - DNA, 20 bp, Artificial Sequence
  chemically synthesized
aatgttacccgcccattact

SEQ ID NO: 308920 - DNA, 20 bp, Artificial Sequence
  chemically synthesized
gacaggtactgagtaatggg

SEQ ID NO: 308921 - DNA, 20 bp, Artificial Sequence
  chemically synthesized
acaggtactgagtaatgggc

SEQ ID NO: 308922 - DNA, 20 bp, Artificial Sequence
  chemically synthesized
taatgggcgggtaacattga

SEQ ID NO: 308923 - DNA, 20 bp, Artificial Sequence
  chemically synthesized
cgggtaacattgacagcatg

SEQ ID NO: 308924 - DNA, 20 bp, Artificial Sequence
  chemically synthesized
cattgacagcatgaagacgc

SEQ ID NO: 308925 - DNA, 20 bp, Artificial Sequence
  chemically synthesized
cagcatgaagacgctggaca

SEQ ID NO: 308926 - DNA, 20 bp, Artificial Sequence
  chemically synthesized
agcatgaagacgctggacaa

SEQ ID NO: 308927 - DNA, 20 bp, Artificial Sequence
  chemically synthesized
gcatgaagacgctggacaaa

SEQ ID NO: 308928 - DNA, 20 bp, Artificial Sequence
  chemically synthesized
catgaagacgctggacaaag

SEQ ID NO: 308929 - DNA, 20 bp, Artificial Sequence
  chemically synthesized
gactgaatcacccctttgtc

SEQ ID NO: 308930 - DNA, 20 bp, Artificial Sequence
  chemically synthesized
cgctggacaaaggggtgatt

SEQ ID NO: 308931 - DNA, 20 bp, Artificial Sequence
  chemically synthesized
acaaaggggtgattcagtcc

SEQ ID NO: 308932 - DNA, 20 bp, Artificial Sequence
  chemically synthesized
caaaggggtgattcagtcct

SEQ ID NO: 308933 - DNA, 20 bp, Artificial Sequence
  chemically synthesized
ggggtgattcagtcctgggt

SEQ ID NO: 308934 - DNA, 20 bp, Artificial Sequence
  chemically synthesized
atcccacctctgtctcaccc

SEQ ID NO: 308935 - DNA, 20 bp, Artificial Sequence
  chemically synthesized
tgattcagtcctgggtgaga

SEQ ID NO: 308936 - DNA, 20 bp, Artificial Sequence
  chemically synthesized
tatcccacctctgtctcacc

SEQ ID NO: 308937 - DNA, 20 bp, Artificial Sequence
  chemically synthesized
attcagtcctgggtgagaca

SEQ ID NO: 308938 - DNA, 20 bp, Artificial Sequence
  chemically synthesized
ttcagtcctgggtgagacag

SEQ ID NO: 308939 - DNA, 20 bp, Artificial Sequence
  chemically synthesized
agtcctgggtgagacagagg

SEQ ID NO: 308940 - DNA, 20 bp, Artificial Sequence
  chemically synthesized
gtcctgggtgagacagaggt

SEQ ID NO: 308941 - DNA, 20 bp, Artificial Sequence
  chemically synthesized
tgggtgagacagaggtggga

SEQ ID NO: 308942 - DNA, 20 bp, Artificial Sequence
  chemically synthesized
agacagaggtgggatagcac

SEQ ID NO: 308943 - DNA, 20 bp, Artificial Sequence
  chemically synthesized
tttcattatgctactcaaaa

SEQ ID NO: 308944 - DNA, 20 bp, Artificial Sequence
  chemically synthesized
aaattgcatgctgttttgag

SEQ ID NO: 308945 - DNA, 20 bp, Artificial Sequence
  chemically synthesized
tttaaattgcatgctgtttt

SEQ ID NO: 308946 - DNA, 20 bp, Artificial Sequence
  chemically synthesized
atttatgaattgtttatttc

SEQ ID NO: 308947 - DNA, 20 bp, Artificial Sequence
  chemically synthesized
aaatattaaatgaaaaattc

SEQ ID NO: 308948 - DNA, 20 bp, Artificial Sequence
  chemically synthesized
catttaatattttctgactg

SEQ ID NO: 308949 - DNA, 20 bp, Artificial Sequence
  chemically synthesized
tactggcagtcaaccacagt

SEQ ID NO: 308950 - DNA, 20 bp, Artificial Sequence
  chemically synthesized
caattactggcagtcaacca

SEQ ID NO: 308951 - DNA, 20 bp, Artificial Sequence
  chemically synthesized
ttctgactgtggttgactgc

SEQ ID NO: 308952 - DNA, 20 bp, Artificial Sequence
  chemically synthesized
tccttggcttcaattactgg

SEQ ID NO: 308953 - DNA, 20 bp, Artificial Sequence
  chemically synthesized
tggttgactgccagtaattg

SEQ ID NO: 308954 - DNA, 20 bp, Artificial Sequence
  chemically synthesized
ctctccttggcttcaattac

SEQ ID NO: 308955 - DNA, 20 bp, Artificial Sequence
  chemically synthesized
gactgccagtaattgaagcc

SEQ ID NO: 308956 - DNA, 20 bp, Artificial Sequence
  chemically synthesized
actgccagtaattgaagcca

SEQ ID NO: 308957 - DNA, 20 bp, Artificial Sequence
  chemically synthesized
tgccagtaattgaagccaag

SEQ ID NO: 308958 - DNA, 20 bp, Artificial Sequence
  chemically synthesized
ccagtaattgaagccaagga

SEQ ID NO: 308959 - DNA, 20 bp, Artificial Sequence
  chemically synthesized
atccatggttttgctctcct

SEQ ID NO: 308960 - DNA, 20 bp, Artificial Sequence
  chemically synthesized
agccaaggagagcaaaacca

SEQ ID NO: 308961 - DNA, 20 bp, Artificial Sequence
  chemically synthesized
aggagagcaaaaccatggat

SEQ ID NO: 308962 - DNA, 20 bp, Artificial Sequence
  chemically synthesized
ggagagcaaaaccatggatg

SEQ ID NO: 308963 - DNA, 20 bp, Artificial Sequence
  chemically synthesized
gagagcaaaaccatggatga

SEQ ID NO: 308964 - DNA, 20 bp, Artificial Sequence
  chemically synthesized
ctccctccctccctcatcca

SEQ ID NO: 308965 - DNA, 20 bp, Artificial Sequence
  chemically synthesized
gagcaaaaccatggatgagg

SEQ ID NO: 308966 - DNA, 20 bp, Artificial Sequence
  chemically synthesized
agcaaaaccatggatgaggg

SEQ ID NO: 308967 - DNA, 20 bp, Artificial Sequence
  chemically synthesized
gcaaaaccatggatgaggga

SEQ ID NO: 308968 - DNA, 20 bp, Artificial Sequence
  chemically synthesized
aaaaccatggatgagggagg

SEQ ID NO: 308969 - DNA, 20 bp, Artificial Sequence
  chemically synthesized
aaaccatggatgagggaggg

SEQ ID NO: 308970 - DNA, 20 bp, Artificial Sequence
  chemically synthesized
aaccatggatgagggaggga

SEQ ID NO: 308971 - DNA, 20 bp, Artificial Sequence
  chemically synthesized
ccatggatgagggagggagg

SEQ ID NO: 308972 - DNA, 20 bp, Artificial Sequence
  chemically synthesized
catggatgagggagggaggg

SEQ ID NO: 308973 - DNA, 20 bp, Artificial Sequence
  chemically synthesized
atggatgagggagggaggga

SEQ ID NO: 308974 - DNA, 20 bp, Artificial Sequence
  chemically synthesized
ggatgagggagggagggagg

SEQ ID NO: 308975 - DNA, 20 bp, Artificial Sequence
  chemically synthesized
gatgagggagggagggaggg

SEQ ID NO: 308976 - DNA, 20 bp, Artificial Sequence
  chemically synthesized
atgagggagggagggaggga

SEQ ID NO: 308977 - DNA, 20 bp, Artificial Sequence
  chemically synthesized
gagggagggagggagggagg

SEQ ID NO: 308978 - DNA, 20 bp, Artificial Sequence
  chemically synthesized
agggagggagggagggaggg

SEQ ID NO: 308979 - DNA, 20 bp, Artificial Sequence
  chemically synthesized
gggagggagggagggaggga

SEQ ID NO: 308980 - DNA, 20 bp, Artificial Sequence
  chemically synthesized
gagggagggagggagggagg

SEQ ID NO: 308981 - DNA, 20 bp, Artificial Sequence
  chemically synthesized
agggagggagggagggaggg

SEQ ID NO: 308982 - DNA, 20 bp, Artificial Sequence
  chemically synthesized
gggagggagggagggaggga

SEQ ID NO: 308983 - DNA, 20 bp, Artificial Sequence
  chemically synthesized
cctaaaagagtgtttaatta

SEQ ID NO: 308984 - DNA, 20 bp, Artificial Sequence
  chemically synthesized
gctgtaattaaacactcttt

SEQ ID NO: 308985 - DNA, 20 bp, Artificial Sequence
  chemically synthesized
ctgtaattaaacactctttt

SEQ ID NO: 308986 - DNA, 20 bp, Artificial Sequence
  chemically synthesized
ggttgcctatgtacctaaaa

SEQ ID NO: 308987 - DNA, 20 bp, Artificial Sequence
  chemically synthesized
taggttgcctatgtacctaa

SEQ ID NO: 308988 - DNA, 20 bp, Artificial Sequence
  chemically synthesized
taaacactcttttaggtaca

SEQ ID NO: 308989 - DNA, 20 bp, Artificial Sequence
  chemically synthesized
aaacactcttttaggtacat

SEQ ID NO: 308990 - DNA, 20 bp, Artificial Sequence
  chemically synthesized
tttaaatagttatgttaaat

SEQ ID NO: 308991 - DNA, 20 bp, Artificial Sequence
  chemically synthesized
ttttaaatagttatgttaaa

SEQ ID NO: 308992 - DNA, 20 bp, Artificial Sequence
  chemically synthesized
tttaagtggcattttttaaa

SEQ ID NO: 308993 - DNA, 20 bp, Artificial Sequence
  chemically synthesized
tatttaaaaaatgccactta

SEQ ID NO: 308994 - DNA, 20 bp, Artificial Sequence
  chemically synthesized
gatataaagaacactttaag

SEQ ID NO: 308995 - DNA, 20 bp, Artificial Sequence
  chemically synthesized
ttggatataaagaacacttt

SEQ ID NO: 308996 - DNA, 20 bp, Artificial Sequence
  chemically synthesized
tgctccattatttggatata

SEQ ID NO: 308997 - DNA, 20 bp, Artificial Sequence
  chemically synthesized
tgttctttatatccaaataa

SEQ ID NO: 308998 - DNA, 20 bp, Artificial Sequence
  chemically synthesized
ttctttatatccaaataatg

SEQ ID NO: 308999 - DNA, 20 bp, Artificial Sequence
  chemically synthesized
cataaacttgctccattatt

SEQ ID NO: 309000 - DNA, 20 bp, Artificial Sequence
  chemically synthesized
ttatatccaaataatggagc

SEQ ID NO: 309001 - DNA, 20 bp, Artificial Sequence
  chemically synthesized
aatggagcaagtttatgatt

SEQ ID NO: 309002 - DNA, 20 bp, Artificial Sequence
  chemically synthesized
tttatgattcagctaatatc

SEQ ID NO: 309003 - DNA, 20 bp, Artificial Sequence
  chemically synthesized
ttatgattcagctaatatct

SEQ ID NO: 309004 - DNA, 20 bp, Artificial Sequence
  chemically synthesized
attaactgtaacctagatat

SEQ ID NO: 309005 - DNA, 20 bp, Artificial Sequence
  chemically synthesized
ttcagctaatatctaggtta

SEQ ID NO: 309006 - DNA, 20 bp, Artificial Sequence
  chemically synthesized
ggctgtcattaactgtaacc

SEQ ID NO: 309007 - DNA, 20 bp, Artificial Sequence
  chemically synthesized
atctaggttacagttaatga

SEQ ID NO: 309008 - DNA, 20 bp, Artificial Sequence
  chemically synthesized
tcaatgaatgaatgcattga

SEQ ID NO: 309009 - DNA, 20 bp, Artificial Sequence
  chemically synthesized
acaaatatgtaccaaatatc

SEQ ID NO: 309010 - DNA, 20 bp, Artificial Sequence
  chemically synthesized
atttggcatatccagatatt

SEQ ID NO: 309011 - DNA, 20 bp, Artificial Sequence
  chemically synthesized
ctcttaatatttggcatatc

SEQ ID NO: 309012 - DNA, 20 bp, Artificial Sequence
  chemically synthesized
atctggatatgccaaatatt

SEQ ID NO: 309013 - DNA, 20 bp, Artificial Sequence
  chemically synthesized
taacatcttctcttaatatt

SEQ ID NO: 309014 - DNA, 20 bp, Artificial Sequence
  chemically synthesized
ctggatatgccaaatattaa

SEQ ID NO: 309015 - DNA, 20 bp, Artificial Sequence
  chemically synthesized
gatatgccaaatattaagag

SEQ ID NO: 309016 - DNA, 20 bp, Artificial Sequence
  chemically synthesized
aatattaagagaagatgtta

SEQ ID NO: 309017 - DNA, 20 bp, Artificial Sequence
  chemically synthesized
atattaagagaagatgttac

SEQ ID NO: 309018 - DNA, 20 bp, Artificial Sequence
  chemically synthesized
ggatttcatgggacacaatt

SEQ ID NO: 309019 - DNA, 20 bp, Artificial Sequence
  chemically synthesized
ggcttcaacatggatttcat

SEQ ID NO: 309020 - DNA, 20 bp, Artificial Sequence
  chemically synthesized
gggcttcaacatggatttca

SEQ ID NO: 309021 - DNA, 20 bp, Artificial Sequence
  chemically synthesized
gtcccatgaaatccatgttg

SEQ ID NO: 309022 - DNA, 20 bp, Artificial Sequence
  chemically synthesized
tggggcatagggcttcaaca

SEQ ID NO: 309023 - DNA, 20 bp, Artificial Sequence
  chemically synthesized
gatgtagtaggtggggcata

SEQ ID NO: 309024 - DNA, 20 bp, Artificial Sequence
  chemically synthesized
cgatgtagtaggtggggcat

SEQ ID NO: 309025 - DNA, 20 bp, Artificial Sequence
  chemically synthesized
ccgatgtagtaggtggggca

SEQ ID NO: 309026 - DNA, 20 bp, Artificial Sequence
  chemically synthesized
acattccgatgtagtaggtg

SEQ ID NO: 309027 - DNA, 20 bp, Artificial Sequence
  chemically synthesized
cacattccgatgtagtaggt

SEQ ID NO: 309028 - DNA, 20 bp, Artificial Sequence
  chemically synthesized
gcacattccgatgtagtagg

SEQ ID NO: 309029 - DNA, 20 bp, Artificial Sequence
  chemically synthesized
ctatgccccacctactacat

SEQ ID NO: 309030 - DNA, 20 bp, Artificial Sequence
  chemically synthesized
tgggcacattccgatgtagt

SEQ ID NO: 309031 - DNA, 20 bp, Artificial Sequence
  chemically synthesized
atgggcacattccgatgtag

SEQ ID NO: 309032 - DNA, 20 bp, Artificial Sequence
  chemically synthesized
aatatgggcacattccgatg

SEQ ID NO: 309033 - DNA, 20 bp, Artificial Sequence
  chemically synthesized
catcggaatgtgcccatatt

SEQ ID NO: 309034 - DNA, 20 bp, Artificial Sequence
  chemically synthesized
tcggaatgtgcccatatttg

SEQ ID NO: 309035 - DNA, 20 bp, Artificial Sequence
  chemically synthesized
taggctctatctccaaatat

SEQ ID NO: 309036 - DNA, 20 bp, Artificial Sequence
  chemically synthesized
ataggctctatctccaaata

SEQ ID NO: 309037 - DNA, 20 bp, Artificial Sequence
  chemically synthesized
aatgtgcccatatttggaga

SEQ ID NO: 309038 - DNA, 20 bp, Artificial Sequence
  chemically synthesized
tgtgcccatatttggagata

SEQ ID NO: 309039 - DNA, 20 bp, Artificial Sequence
  chemically synthesized
ttggagatagagcctataaa

SEQ ID NO: 309040 - DNA, 20 bp, Artificial Sequence
  chemically synthesized
taacttaatggtctatttat

SEQ ID NO: 309041 - DNA, 20 bp, Artificial Sequence
  chemically synthesized
gtaacttaatggtctattta

SEQ ID NO: 309042 - DNA, 20 bp, Artificial Sequence
  chemically synthesized
gagcctataaatagaccatt

SEQ ID NO: 309043 - DNA, 20 bp, Artificial Sequence
  chemically synthesized
atagactcattgtaacttaa

SEQ ID NO: 309044 - DNA, 20 bp, Artificial Sequence
  chemically synthesized
atagaccattaagttacaat

SEQ ID NO: 309045 - DNA, 20 bp, Artificial Sequence
  chemically synthesized
ttaagttacaatgagtctat

SEQ ID NO: 309046 - DNA, 20 bp, Artificial Sequence
  chemically synthesized
taagttacaatgagtctatt

SEQ ID NO: 309047 - DNA, 20 bp, Artificial Sequence
  chemically synthesized
aagttacaatgagtctatta

SEQ ID NO: 309048 - DNA, 20 bp, Artificial Sequence
  chemically synthesized
ttggactagagtaaccctaa

SEQ ID NO: 309049 - DNA, 20 bp, Artificial Sequence
  chemically synthesized
tgagtctattagggttactc

SEQ ID NO: 309050 - DNA, 20 bp, Artificial Sequence
  chemically synthesized
atacccatcatattggacta

SEQ ID NO: 309051 - DNA, 20 bp, Artificial Sequence
  chemically synthesized
ggatacccatcatattggac

SEQ ID NO: 309052 - DNA, 20 bp, Artificial Sequence
  chemically synthesized
gttactctagtccaatatga

SEQ ID NO: 309053 - DNA, 20 bp, Artificial Sequence
  chemically synthesized
ttactctagtccaatatgat

SEQ ID NO: 309054 - DNA, 20 bp, Artificial Sequence
  chemically synthesized
cataaggatacccatcatat

SEQ ID NO: 309055 - DNA, 20 bp, Artificial Sequence
  chemically synthesized
aatatgatgggtatccttat

SEQ ID NO: 309056 - DNA, 20 bp, Artificial Sequence
  chemically synthesized
atgatgggtatccttatgag

SEQ ID NO: 309057 - DNA, 20 bp, Artificial Sequence
  chemically synthesized
ccaaatttcctcttctcata

SEQ ID NO: 309058 - DNA, 20 bp, Artificial Sequence
  chemically synthesized
gatgggtatccttatgagaa

SEQ ID NO: 309059 - DNA, 20 bp, Artificial Sequence
  chemically synthesized
tccaaatttcctcttctcat

SEQ ID NO: 309060 - DNA, 20 bp, Artificial Sequence
  chemically synthesized
atgggtatccttatgagaag

SEQ ID NO: 309061 - DNA, 20 bp, Artificial Sequence
  chemically synthesized
ccttatgagaagaggaaatt

SEQ ID NO: 309062 - DNA, 20 bp, Artificial Sequence
  chemically synthesized
gagaagaggaaatttggaca

SEQ ID NO: 309063 - DNA, 20 bp, Artificial Sequence
  chemically synthesized
atttggacacagcaaaacac

SEQ ID NO: 309064 - DNA, 20 bp, Artificial Sequence
  chemically synthesized
tttggacacagcaaaacacc

SEQ ID NO: 309065 - DNA, 20 bp, Artificial Sequence
  chemically synthesized
ttggacacagcaaaacacca

SEQ ID NO: 309066 - DNA, 20 bp, Artificial Sequence
  chemically synthesized
ctctgtgttgcacatatccc

SEQ ID NO: 309067 - DNA, 20 bp, Artificial Sequence
  chemically synthesized
caccagggatatgtgcaaca

SEQ ID NO: 309068 - DNA, 20 bp, Artificial Sequence
  chemically synthesized
ccagggatatgtgcaacaca

SEQ ID NO: 309069 - DNA, 20 bp, Artificial Sequence
  chemically synthesized
cagggatatgtgcaacacag

SEQ ID NO: 309070 - DNA, 20 bp, Artificial Sequence
  chemically synthesized
gggatatgtgcaacacagag

SEQ ID NO: 309071 - DNA, 20 bp, Artificial Sequence
  chemically synthesized
gatatgtgcaacacagagga

SEQ ID NO: 309072 - DNA, 20 bp, Artificial Sequence
  chemically synthesized
acacagaggagagaccacgt

SEQ ID NO: 309073 - DNA, 20 bp, Artificial Sequence
  chemically synthesized
cacagaggagagaccacgtg

SEQ ID NO: 309074 - DNA, 20 bp, Artificial Sequence
  chemically synthesized
cttgttcctgtatcctcacg

SEQ ID NO: 309075 - DNA, 20 bp, Artificial Sequence
  chemically synthesized
ggagagaccacgtgaggata

SEQ ID NO: 309076 - DNA, 20 bp, Artificial Sequence
  chemically synthesized
gagagaccacgtgaggatac

SEQ ID NO: 309077 - DNA, 20 bp, Artificial Sequence
  chemically synthesized
ccacgtgaggatacaggaac

SEQ ID NO: 309078 - DNA, 20 bp, Artificial Sequence
  chemically synthesized
cacgtgaggatacaggaaca

SEQ ID NO: 309079 - DNA, 20 bp, Artificial Sequence
  chemically synthesized
aaggcattcatctgcaatcc

SEQ ID NO: 309080 - DNA, 20 bp, Artificial Sequence
  chemically synthesized
aggcattcatctgcaatcca

SEQ ID NO: 309081 - DNA, 20 bp, Artificial Sequence
  chemically synthesized
aggcctctctccttggattg

SEQ ID NO: 309082 - DNA, 20 bp, Artificial Sequence
  chemically synthesized
gcattcatctgcaatccaag

SEQ ID NO: 309083 - DNA, 20 bp, Artificial Sequence
  chemically synthesized
attcatctgcaatccaagga

SEQ ID NO: 309084 - DNA, 20 bp, Artificial Sequence
  chemically synthesized
tcatctgcaatccaaggaga

SEQ ID NO: 309085 - DNA, 20 bp, Artificial Sequence
  chemically synthesized
catctgcaatccaaggagag

SEQ ID NO: 309086 - DNA, 20 bp, Artificial Sequence
  chemically synthesized
tcttgtgaggcctctctcct

SEQ ID NO: 309087 - DNA, 20 bp, Artificial Sequence
  chemically synthesized
tccaaggagagaggcctcac

SEQ ID NO: 309088 - DNA, 20 bp, Artificial Sequence
  chemically synthesized
caaggagagaggcctcacaa

SEQ ID NO: 309089 - DNA, 20 bp, Artificial Sequence
  chemically synthesized
gcaaggattggtctcttgtg

SEQ ID NO: 309090 - DNA, 20 bp, Artificial Sequence
  chemically synthesized
ggcaaggattggtctcttgt

SEQ ID NO: 309091 - DNA, 20 bp, Artificial Sequence
  chemically synthesized
accaaggtactggcaaggat

SEQ ID NO: 309092 - DNA, 20 bp, Artificial Sequence
  chemically synthesized
cacaagagaccaatccttgc

SEQ ID NO: 309093 - DNA, 20 bp, Artificial Sequence
  chemically synthesized
tcaagaccaaggtactggca

SEQ ID NO: 309094 - DNA, 20 bp, Artificial Sequence
  chemically synthesized
ttcaagaccaaggtactggc

SEQ ID NO: 309095 - DNA, 20 bp, Artificial Sequence
  chemically synthesized
accaatccttgccagtacct

SEQ ID NO: 309096 - DNA, 20 bp, Artificial Sequence
  chemically synthesized
gaagttcaagaccaaggtac

SEQ ID NO: 309097 - DNA, 20 bp, Artificial Sequence
  chemically synthesized
gggccagaagttcaagacca

SEQ ID NO: 309098 - DNA, 20 bp, Artificial Sequence
  chemically synthesized
ggggccagaagttcaagacc

SEQ ID NO: 309099 - DNA, 20 bp, Artificial Sequence
  chemically synthesized
gtaccttggtcttgaacttc

SEQ ID NO: 309100 - DNA, 20 bp, Artificial Sequence
  chemically synthesized
attctgggggccagaagttc

SEQ ID NO: 309101 - DNA, 20 bp, Artificial Sequence
  chemically synthesized
ctcaccattctgggggccag

SEQ ID NO: 309102 - DNA, 20 bp, Artificial Sequence
  chemically synthesized
ggtcttgaacttctggcccc

SEQ ID NO: 309103 - DNA, 20 bp, Artificial Sequence
  chemically synthesized
tttctcaccattctgggggc

SEQ ID NO: 309104 - DNA, 20 bp, Artificial Sequence
  chemically synthesized
tgaacttctggcccccagaa

SEQ ID NO: 309105 - DNA, 20 bp, Artificial Sequence
  chemically synthesized
acactttctcaccattctgg

SEQ ID NO: 309106 - DNA, 20 bp, Artificial Sequence
  chemically synthesized
aacactttctcaccattctg

SEQ ID NO: 309107 - DNA, 20 bp, Artificial Sequence
  chemically synthesized
aaacactttctcaccattct

SEQ ID NO: 309108 - DNA, 20 bp, Artificial Sequence
  chemically synthesized
cttctggcccccagaatggt

SEQ ID NO: 309109 - DNA, 20 bp, Artificial Sequence
  chemically synthesized
caaacactttctcaccattc

SEQ ID NO: 309110 - DNA, 20 bp, Artificial Sequence
  chemically synthesized
tggcccccagaatggtgaga

SEQ ID NO: 309111 - DNA, 20 bp, Artificial Sequence
  chemically synthesized
agaaagtgtttgtattgttt

SEQ ID NO: 309112 - DNA, 20 bp, Artificial Sequence
  chemically synthesized
gtttgtattgtttaagccac

SEQ ID NO: 309113 - DNA, 20 bp, Artificial Sequence
  chemically synthesized
taaaaaataacatggactgg

SEQ ID NO: 309114 - DNA, 20 bp, Artificial Sequence
  chemically synthesized
cattaaaaaataacatggac

SEQ ID NO: 309115 - DNA, 20 bp, Artificial Sequence
  chemically synthesized
gctatcattaaaaaataaca

SEQ ID NO: 309116 - DNA, 20 bp, Artificial Sequence
  chemically synthesized
tccatgttattttttaatga

SEQ ID NO: 309117 - DNA, 20 bp, Artificial Sequence
  chemically synthesized
ttttaatgatagccctcaca

SEQ ID NO: 309118 - DNA, 20 bp, Artificial Sequence
  chemically synthesized
tttaatgatagccctcacaa

SEQ ID NO: 309119 - DNA, 20 bp, Artificial Sequence
  chemically synthesized
tttgtattactcctttgtga

SEQ ID NO: 309120 - DNA, 20 bp, Artificial Sequence
  chemically synthesized
taatgatagccctcacaaag

SEQ ID NO: 309121 - DNA, 20 bp, Artificial Sequence
  chemically synthesized
ttttgtattactcctttgtg

SEQ ID NO: 309122 - DNA, 20 bp, Artificial Sequence
  chemically synthesized
cttttgtattactcctttgt

SEQ ID NO: 309123 - DNA, 20 bp, Artificial Sequence
  chemically synthesized
ctcacaaaggagtaatacaa

SEQ ID NO: 309124 - DNA, 20 bp, Artificial Sequence
  chemically synthesized
gagtaatacaaaagacaatt

SEQ ID NO: 309125 - DNA, 20 bp, Artificial Sequence
  chemically synthesized
aatacaaaagacaattaaga

SEQ ID NO: 309126 - DNA, 20 bp, Artificial Sequence
  chemically synthesized
caaaagacaattaagataga

SEQ ID NO: 309127 - DNA, 20 bp, Artificial Sequence
  chemically synthesized
agatagatggattctttttc

SEQ ID NO: 309128 - DNA, 20 bp, Artificial Sequence
  chemically synthesized
tagccaagtatttcttgaaa

SEQ ID NO: 309129 - DNA, 20 bp, Artificial Sequence
  chemically synthesized
attctttttcaagaaatact

SEQ ID NO: 309130 - DNA, 20 bp, Artificial Sequence
  chemically synthesized
tattcgacagacatttagcc

SEQ ID NO: 309131 - DNA, 20 bp, Artificial Sequence
  chemically synthesized
attattattcgacagacatt

SEQ ID NO: 309132 - DNA, 20 bp, Artificial Sequence
  chemically synthesized
gggttggtattattattcga

SEQ ID NO: 309133 - DNA, 20 bp, Artificial Sequence
  chemically synthesized
tttgcaattctttaacgggt

SEQ ID NO: 309134 - DNA, 20 bp, Artificial Sequence
  chemically synthesized
ataataataccaacccgtta

SEQ ID NO: 309135 - DNA, 20 bp, Artificial Sequence
  chemically synthesized
aacatttgcaattctttaac

SEQ ID NO: 309136 - DNA, 20 bp, Artificial Sequence
  chemically synthesized
taacatttgcaattctttaa

SEQ ID NO: 309137 - DNA, 20 bp, Artificial Sequence
  chemically synthesized
aagaattgcaaatgttaaac

SEQ ID NO: 309138 - DNA, 20 bp, Artificial Sequence
  chemically synthesized
gaattgcaaatgttaaacaa

SEQ ID NO: 309139 - DNA, 20 bp, Artificial Sequence
  chemically synthesized
atgttaaacaagagtatgta

SEQ ID NO: 309140 - DNA, 20 bp, Artificial Sequence
  chemically synthesized
tgttaaacaagagtatgtat

SEQ ID NO: 309141 - DNA, 20 bp, Artificial Sequence
  chemically synthesized
aaacaagagtatgtatggga

SEQ ID NO: 309142 - DNA, 20 bp, Artificial Sequence
  chemically synthesized
aagtattattaatttgaaac

SEQ ID NO: 309143 - DNA, 20 bp, Artificial Sequence
  chemically synthesized
taatttgaaacaagttattt

SEQ ID NO: 309144 - DNA, 20 bp, Artificial Sequence
  chemically synthesized
atttgaaacaagttatttaa

SEQ ID NO: 309145 - DNA, 20 bp, Artificial Sequence
  chemically synthesized
gaaacaagttatttaagagt

SEQ ID NO: 309146 - DNA, 20 bp, Artificial Sequence
  chemically synthesized
gtttacaatttgcttgatca

SEQ ID NO: 309147 - DNA, 20 bp, Artificial Sequence
  chemically synthesized
ttgatgtaagaaccatgatc

SEQ ID NO: 309148 - DNA, 20 bp, Artificial Sequence
  chemically synthesized
gcagttcttagatttgatgt

SEQ ID NO: 309149 - DNA, 20 bp, Artificial Sequence
  chemically synthesized
atggttcttacatcaaatct

SEQ ID NO: 309150 - DNA, 20 bp, Artificial Sequence
  chemically synthesized
agatgacccttggcagttct

SEQ ID NO: 309151 - DNA, 20 bp, Artificial Sequence
  chemically synthesized
catcaaatctaagaactgcc

SEQ ID NO: 309152 - DNA, 20 bp, Artificial Sequence
  chemically synthesized
atcaaatctaagaactgcca

SEQ ID NO: 309153 - DNA, 20 bp, Artificial Sequence
  chemically synthesized
tcaaatctaagaactgccaa

SEQ ID NO: 309154 - DNA, 20 bp, Artificial Sequence
  chemically synthesized
gtaaaatagatgacccttgg

SEQ ID NO: 309155 - DNA, 20 bp, Artificial Sequence
  chemically synthesized
acagtaaaatagatgaccct

SEQ ID NO: 309156 - DNA, 20 bp, Artificial Sequence
  chemically synthesized
ctacagtgaatacagtaaaa

SEQ ID NO: 309157 - DNA, 20 bp, Artificial Sequence
  chemically synthesized
gtgcctttctacagtgaata

SEQ ID NO: 309158 - DNA, 20 bp, Artificial Sequence
  chemically synthesized
ctattttactgtattcactg

SEQ ID NO: 309159 - DNA, 20 bp, Artificial Sequence
  chemically synthesized
tttactgtattcactgtaga

SEQ ID NO: 309160 - DNA, 20 bp, Artificial Sequence
  chemically synthesized
ttactgtattcactgtagaa

SEQ ID NO: 309161 - DNA, 20 bp, Artificial Sequence
  chemically synthesized
atttaatgggtgcctttcta

SEQ ID NO: 309162 - DNA, 20 bp, Artificial Sequence
  chemically synthesized
tttattcgtaaagatttaat

SEQ ID NO: 309163 - DNA, 20 bp, Artificial Sequence
  chemically synthesized
atttattcgtaaagatttaa

SEQ ID NO: 309164 - DNA, 20 bp, Artificial Sequence
  chemically synthesized
agactaaacatttattcgta

SEQ ID NO: 309165 - DNA, 20 bp, Artificial Sequence
  chemically synthesized
aatctttacgaataaatgtt

SEQ ID NO: 309166 - DNA, 20 bp, Artificial Sequence
  chemically synthesized
cgaataaatgtttagtcttc

SEQ ID NO: 309167 - DNA, 20 bp, Artificial Sequence
  chemically synthesized
acctttaaagaatatacttg

SEQ ID NO: 309168 - DNA, 20 bp, Artificial Sequence
  chemically synthesized
gtcttcaagtatattcttta

SEQ ID NO: 309169 - DNA, 20 bp, Artificial Sequence
  chemically synthesized
tcttcaagtatattctttaa

SEQ ID NO: 309170 - DNA, 20 bp, Artificial Sequence
  chemically synthesized
tcttgtgttggaaaccttta

SEQ ID NO: 309171 - DNA, 20 bp, Artificial Sequence
  chemically synthesized
tctttaaaggtttccaacac

SEQ ID NO: 309172 - DNA, 20 bp, Artificial Sequence
  chemically synthesized
gtgttcatgctgtcttgtgt

SEQ ID NO: 309173 - DNA, 20 bp, Artificial Sequence
  chemically synthesized
taaaggtttccaacacaaga

SEQ ID NO: 309174 - DNA, 20 bp, Artificial Sequence
  chemically synthesized
cagcatgaacacatatcctt

SEQ ID NO: 309175 - DNA, 20 bp, Artificial Sequence
  chemically synthesized
gcaatagaatatgttactaa

SEQ ID NO: 309176 - DNA, 20 bp, Artificial Sequence
  chemically synthesized
agcaatagaatatgttacta

SEQ ID NO: 309177 - DNA, 20 bp, Artificial Sequence
  chemically synthesized
agtaagataggtttaagcaa

SEQ ID NO: 309178 - DNA, 20 bp, Artificial Sequence
  chemically synthesized
tctaagagtaagataggttt

SEQ ID NO: 309179 - DNA, 20 bp, Artificial Sequence
  chemically synthesized
gtattttctaagagtaagat

SEQ ID NO: 309180 - DNA, 20 bp, Artificial Sequence
  chemically synthesized
agtattttctaagagtaaga

SEQ ID NO: 309181 - DNA, 20 bp, Artificial Sequence
  chemically synthesized
gcttaaacctatcttactct

SEQ ID NO: 309182 - DNA, 20 bp, Artificial Sequence
  chemically synthesized
attgagtattttctaagagt

SEQ ID NO: 309183 - DNA, 20 bp, Artificial Sequence
  chemically synthesized
attcattgagtattttctaa

SEQ ID NO: 309184 - DNA, 20 bp, Artificial Sequence
  chemically synthesized
caattcattgagtattttct

SEQ ID NO: 309185 - DNA, 20 bp, Artificial Sequence
  chemically synthesized
tgacttagattcaattcatt

SEQ ID NO: 309186 - DNA, 20 bp, Artificial Sequence
  chemically synthesized
atactcaatgaattgaatct

SEQ ID NO: 309187 - DNA, 20 bp, Artificial Sequence
  chemically synthesized
gccttgctacagaagtgact

SEQ ID NO: 309188 - DNA, 20 bp, Artificial Sequence
  chemically synthesized
ttgaatctaagtcacttctg

SEQ ID NO: 309189 - DNA, 20 bp, Artificial Sequence
  chemically synthesized
atctaagtcacttctgtagc

SEQ ID NO: 309190 - DNA, 20 bp, Artificial Sequence
  chemically synthesized
ctatgcctgccttgctacag

SEQ ID NO: 309191 - DNA, 20 bp, Artificial Sequence
  chemically synthesized
tctaagtcacttctgtagca

SEQ ID NO: 309192 - DNA, 20 bp, Artificial Sequence
  chemically synthesized
gcactatgcctgccttgcta

SEQ ID NO: 309193 - DNA, 20 bp, Artificial Sequence
  chemically synthesized
aagtcacttctgtagcaagg

SEQ ID NO: 309194 - DNA, 20 bp, Artificial Sequence
  chemically synthesized
agtcacttctgtagcaaggc

SEQ ID NO: 309195 - DNA, 20 bp, Artificial Sequence
  chemically synthesized
cttctgtagcaaggcaggca

SEQ ID NO: 309196 - DNA, 20 bp, Artificial Sequence
  chemically synthesized
cttacactgagatcagtgga

SEQ ID NO: 309197 - DNA, 20 bp, Artificial Sequence
  chemically synthesized
atagtgctttccactgatct

SEQ ID NO: 309198 - DNA, 20 bp, Artificial Sequence
  chemically synthesized
tccgcttacactgagatcag

SEQ ID NO: 309199 - DNA, 20 bp, Artificial Sequence
  chemically synthesized
ttttccgcttacactgagat

SEQ ID NO: 309200 - DNA, 20 bp, Artificial Sequence
  chemically synthesized
ctttccactgatctcagtgt

SEQ ID NO: 309201 - DNA, 20 bp, Artificial Sequence
  chemically synthesized
ttcacttttccgcttacact

SEQ ID NO: 309202 - DNA, 20 bp, Artificial Sequence
  chemically synthesized
tccactgatctcagtgtaag

SEQ ID NO: 309203 - DNA, 20 bp, Artificial Sequence
  chemically synthesized
tgatctcagtgtaagcggaa

SEQ ID NO: 309204 - DNA, 20 bp, Artificial Sequence
  chemically synthesized
gtgtaagcggaaaagtgaat

SEQ ID NO: 309205 - DNA, 20 bp, Artificial Sequence
  chemically synthesized
gatgtttacagcgtatgagc

SEQ ID NO: 309206 - DNA, 20 bp, Artificial Sequence
  chemically synthesized
ggcagatgtttacagcgtat

SEQ ID NO: 309207 - DNA, 20 bp, Artificial Sequence
  chemically synthesized
aatgtatgggcagatgttta

SEQ ID NO: 309208 - DNA, 20 bp, Artificial Sequence
  chemically synthesized
gcatcacaaaaatgtatggg

SEQ ID NO: 309209 - DNA, 20 bp, Artificial Sequence
  chemically synthesized
atggcatcacaaaaatgtat

SEQ ID NO: 309210 - DNA, 20 bp, Artificial Sequence
  chemically synthesized
tatggcatcacaaaaatgta

SEQ ID NO: 309211 - DNA, 20 bp, Artificial Sequence
  chemically synthesized
ttttgtgatgccatatgcac

SEQ ID NO: 309212 - DNA, 20 bp, Artificial Sequence
  chemically synthesized
tctatttatacttgtgcata

SEQ ID NO: 309213 - DNA, 20 bp, Artificial Sequence
  chemically synthesized
gccatatgcacaagtataaa

SEQ ID NO: 309214 - DNA, 20 bp, Artificial Sequence
  chemically synthesized
gtataaatagataatacacg

SEQ ID NO: 309215 - DNA, 20 bp, Artificial Sequence
  chemically synthesized
taggtaaatccataaattta

SEQ ID NO: 309216 - DNA, 20 bp, Artificial Sequence
  chemically synthesized
cacgaagtgctttaaattta

SEQ ID NO: 309217 - DNA, 20 bp, Artificial Sequence
  chemically synthesized
aatattgctaagcaataaat

SEQ ID NO: 309218 - DNA, 20 bp, Artificial Sequence
  chemically synthesized
caatattgctaagcaataaa

SEQ ID NO: 309219 - DNA, 20 bp, Artificial Sequence
  chemically synthesized
ggatttacctatttattgct

SEQ ID NO: 309220 - DNA, 20 bp, Artificial Sequence
  chemically synthesized
aaattaaggccaatattgct

SEQ ID NO: 309221 - DNA, 20 bp, Artificial Sequence
  chemically synthesized
tatttattgcttagcaatat

SEQ ID NO: 309222 - DNA, 20 bp, Artificial Sequence
  chemically synthesized
attctttgtaattcaaatta

SEQ ID NO: 309223 - DNA, 20 bp, Artificial Sequence
  chemically synthesized
cattctttgtaattcaaatt

SEQ ID NO: 309224 - DNA, 20 bp, Artificial Sequence
  chemically synthesized
tggccttaatttgaattaca

SEQ ID NO: 309225 - DNA, 20 bp, Artificial Sequence
  chemically synthesized
aatttgaattacaaagaatg

SEQ ID NO: 309226 - DNA, 20 bp, Artificial Sequence
  chemically synthesized
gaattacaaagaatgaagca

SEQ ID NO: 309227 - DNA, 20 bp, Artificial Sequence
  chemically synthesized
aaagaatgaagcaaagcaat

SEQ ID NO: 309228 - DNA, 20 bp, Artificial Sequence
  chemically synthesized
gaatgaagcaaagcaattgg

SEQ ID NO: 309229 - DNA, 20 bp, Artificial Sequence
  chemically synthesized
aattggaagactatatccct

SEQ ID NO: 309230 - DNA, 20 bp, Artificial Sequence
  chemically synthesized
gattccagagctgagggata

SEQ ID NO: 309231 - DNA, 20 bp, Artificial Sequence
  chemically synthesized
aagactatatccctcagctc

SEQ ID NO: 309232 - DNA, 20 bp, Artificial Sequence
  chemically synthesized
ttgagtgattccagagctga

SEQ ID NO: 309233 - DNA, 20 bp, Artificial Sequence
  chemically synthesized
tttgagtgattccagagctg

SEQ ID NO: 309234 - DNA, 20 bp, Artificial Sequence
  chemically synthesized
ctttgagtgattccagagct

SEQ ID NO: 309235 - DNA, 20 bp, Artificial Sequence
  chemically synthesized
agcatctttgagtgattcca

SEQ ID NO: 309236 - DNA, 20 bp, Artificial Sequence
  chemically synthesized
ccagcatctttgagtgattc

SEQ ID NO: 309237 - DNA, 20 bp, Artificial Sequence
  chemically synthesized
ctcagctctggaatcactca

SEQ ID NO: 309238 - DNA, 20 bp, Artificial Sequence
  chemically synthesized
tgataggaaccagcatcttt

SEQ ID NO: 309239 - DNA, 20 bp, Artificial Sequence
  chemically synthesized
ctggaatcactcaaagatgc

SEQ ID NO: 309240 - DNA, 20 bp, Artificial Sequence
  chemically synthesized
attcaggcaatgataggaac

SEQ ID NO: 309241 - DNA, 20 bp, Artificial Sequence
  chemically synthesized
atagccattcaggcaatgat

SEQ ID NO: 309242 - DNA, 20 bp, Artificial Sequence
  chemically synthesized
tatagccattcaggcaatga

SEQ ID NO: 309243 - DNA, 20 bp, Artificial Sequence
  chemically synthesized
ggttcctatcattgcctgaa

SEQ ID NO: 309244 - DNA, 20 bp, Artificial Sequence
  chemically synthesized
caattttgttatagccattc

SEQ ID NO: 309245 - DNA, 20 bp, Artificial Sequence
  chemically synthesized
acaattttgttatagccatt

SEQ ID NO: 309246 - DNA, 20 bp, Artificial Sequence
  chemically synthesized
cttgtctaacaattttgtta

SEQ ID NO: 309247 - DNA, 20 bp, Artificial Sequence
  chemically synthesized
aatggctataacaaaattgt

SEQ ID NO: 309248 - DNA, 20 bp, Artificial Sequence
  chemically synthesized
ctataacaaaattgttagac

SEQ ID NO: 309249 - DNA, 20 bp, Artificial Sequence
  chemically synthesized
caaaattgttagacaagtgt

SEQ ID NO: 309250 - DNA, 20 bp, Artificial Sequence
  chemically synthesized
gttagacaagtgtaagaaat

SEQ ID NO: 309251 - DNA, 20 bp, Artificial Sequence
  chemically synthesized
gtgtaagaaattggataaaa

SEQ ID NO: 309252 - DNA, 20 bp, Artificial Sequence
  chemically synthesized
tgtaagaaattggataaaat

SEQ ID NO: 309253 - DNA, 20 bp, Artificial Sequence
  chemically synthesized
gtaagaaattggataaaatg

SEQ ID NO: 309254 - DNA, 20 bp, Artificial Sequence
  chemically synthesized
tctttaaaaaatatatgtat

SEQ ID NO: 309255 - DNA, 20 bp, Artificial Sequence
  chemically synthesized
gctaatacatatatttttta

SEQ ID NO: 309256 - DNA, 20 bp, Artificial Sequence
  chemically synthesized
tttttaaagaaccactgtat

SEQ ID NO: 309257 - DNA, 20 bp, Artificial Sequence
  chemically synthesized
ttttaaagaaccactgtatt

SEQ ID NO: 309258 - DNA, 20 bp, Artificial Sequence
  chemically synthesized
ggtttctaatcctaatacag

SEQ ID NO: 309259 - DNA, 20 bp, Artificial Sequence
  chemically synthesized
agaggtttctaatcctaata

SEQ ID NO: 309260 - DNA, 20 bp, Artificial Sequence
  chemically synthesized
aagaaccactgtattaggat

SEQ ID NO: 309261 - DNA, 20 bp, Artificial Sequence
  chemically synthesized
aggattagaaacctcttctc

SEQ ID NO: 309262 - DNA, 20 bp, Artificial Sequence
  chemically synthesized
tttttttttctctagagaag

SEQ ID NO: 309263 - DNA, 20 bp, Artificial Sequence
  chemically synthesized
gattagaaacctcttctcta

SEQ ID NO: 309264 - DNA, 20 bp, Artificial Sequence
  chemically synthesized
ttttttttttctctagagaa

SEQ ID NO: 309265 - DNA, 20 bp, Artificial Sequence
  chemically synthesized
tattttttttttctctagag

SEQ ID NO: 309266 - DNA, 20 bp, Artificial Sequence
  chemically synthesized
acatattttttttttctcta

SEQ ID NO: 309267 - DNA, 20 bp, Artificial Sequence
  chemically synthesized
ttacatattttttttttctc

SEQ ID NO: 309268 - DNA, 20 bp, Artificial Sequence
  chemically synthesized
aactcagagaaacagagttg

SEQ ID NO: 309269 - DNA, 20 bp, Artificial Sequence
  chemically synthesized
aatagaaactcagagaaaca

SEQ ID NO: 309270 - DNA, 20 bp, Artificial Sequence
  chemically synthesized
aacttcaactctgtttctct

SEQ ID NO: 309271 - DNA, 20 bp, Artificial Sequence
  chemically synthesized
taaatagaaactcagagaaa

SEQ ID NO: 309272 - DNA, 20 bp, Artificial Sequence
  chemically synthesized
tatacgtaaatagaaactca

SEQ ID NO: 309273 - DNA, 20 bp, Artificial Sequence
  chemically synthesized
cctatacgtaaatagaaact

SEQ ID NO: 309274 - DNA, 20 bp, Artificial Sequence
  chemically synthesized
aagggattcctatacgtaaa

SEQ ID NO: 309275 - DNA, 20 bp, Artificial Sequence
  chemically synthesized
tctgagtttctatttacgta

SEQ ID NO: 309276 - DNA, 20 bp, Artificial Sequence
  chemically synthesized
ctgagtttctatttacgtat

SEQ ID NO: 309277 - DNA, 20 bp, Artificial Sequence
  chemically synthesized
tttacgtataggaatccctt

SEQ ID NO: 309278 - DNA, 20 bp, Artificial Sequence
  chemically synthesized
cattattgctaaaagctcaa

SEQ ID NO: 309279 - DNA, 20 bp, Artificial Sequence
  chemically synthesized
gcattattgctaaaagctca

SEQ ID NO: 309280 - DNA, 20 bp, Artificial Sequence
  chemically synthesized
ataggaatcccttgagcttt

SEQ ID NO: 309281 - DNA, 20 bp, Artificial Sequence
  chemically synthesized
tgcattattgctaaaagctc

SEQ ID NO: 309282 - DNA, 20 bp, Artificial Sequence
  chemically synthesized
aaaatatgcattattgctaa

SEQ ID NO: 309283 - DNA, 20 bp, Artificial Sequence
  chemically synthesized
agcaataatgcatattttta

SEQ ID NO: 309284 - DNA, 20 bp, Artificial Sequence
  chemically synthesized
caataatgcatatttttata

SEQ ID NO: 309285 - DNA, 20 bp, Artificial Sequence
  chemically synthesized
acatttatgtgtagaatgtt

SEQ ID NO: 309286 - DNA, 20 bp, Artificial Sequence
  chemically synthesized
attggttttacatttatgtg

SEQ ID NO: 309287 - DNA, 20 bp, Artificial Sequence
  chemically synthesized
tgtgagactttgtaattcat

SEQ ID NO: 309288 - DNA, 20 bp, Artificial Sequence
  chemically synthesized
tgtaaaaccaatgaattaca

SEQ ID NO: 309289 - DNA, 20 bp, Artificial Sequence
  chemically synthesized
aattacaaagtctcacaaaa

SEQ ID NO: 309290 - DNA, 20 bp, Artificial Sequence
  chemically synthesized
aacttcttttaccattttgt

SEQ ID NO: 309291 - DNA, 20 bp, Artificial Sequence
  chemically synthesized
aaagtctcacaaaatggtaa

SEQ ID NO: 309292 - DNA, 20 bp, Artificial Sequence
  chemically synthesized
gtctcacaaaatggtaaaag

SEQ ID NO: 309293 - DNA, 20 bp, Artificial Sequence
  chemically synthesized
acttactgctgagacaaaat

SEQ ID NO: 309294 - DNA, 20 bp, Artificial Sequence
  chemically synthesized
tttatattctcattttgtct

SEQ ID NO: 309295 - DNA, 20 bp, Artificial Sequence
  chemically synthesized
atattctcattttgtctcag

SEQ ID NO: 309296 - DNA, 20 bp, Artificial Sequence
  chemically synthesized
tctcattttgtctcagcagt

SEQ ID NO: 309297 - DNA, 20 bp, Artificial Sequence
  chemically synthesized
ctttagcttcacttactgct

SEQ ID NO: 309298 - DNA, 20 bp, Artificial Sequence
  chemically synthesized
ttttgtctcagcagtaagtg

SEQ ID NO: 309299 - DNA, 20 bp, Artificial Sequence
  chemically synthesized
ctcagcagtaagtgaagcta

SEQ ID NO: 309300 - DNA, 20 bp, Artificial Sequence
  chemically synthesized
tcagcagtaagtgaagctaa

SEQ ID NO: 309301 - DNA, 20 bp, Artificial Sequence
  chemically synthesized
cagtaagtgaagctaaaggt

SEQ ID NO: 309302 - DNA, 20 bp, Artificial Sequence
  chemically synthesized
agacgaagtgagctgacctt

SEQ ID NO: 309303 - DNA, 20 bp, Artificial Sequence
  chemically synthesized
atgaaaatgttagacgaagt

SEQ ID NO: 309304 - DNA, 20 bp, Artificial Sequence
  chemically synthesized
gtccatgaaaatgttagacg

SEQ ID NO: 309305 - DNA, 20 bp, Artificial Sequence
  chemically synthesized
gatttagtccatgaaaatgt

SEQ ID NO: 309306 - DNA, 20 bp, Artificial Sequence
  chemically synthesized
cacttcgtctaacattttca

SEQ ID NO: 309307 - DNA, 20 bp, Artificial Sequence
  chemically synthesized
acgataatggagttgtgatt

SEQ ID NO: 309308 - DNA, 20 bp, Artificial Sequence
  chemically synthesized
tctgagcatggacgataatg

SEQ ID NO: 309309 - DNA, 20 bp, Artificial Sequence
  chemically synthesized
gatctgagcatggacgataa

SEQ ID NO: 309310 - DNA, 20 bp, Artificial Sequence
  chemically synthesized
actccattatcgtccatgct

SEQ ID NO: 309311 - DNA, 20 bp, Artificial Sequence
  chemically synthesized
ccccgttgtggatctgagca

SEQ ID NO: 309312 - DNA, 20 bp, Artificial Sequence
  chemically synthesized
atcctccccgttgtggatct

SEQ ID NO: 309313 - DNA, 20 bp, Artificial Sequence
  chemically synthesized
gtccatgctcagatccacaa

SEQ ID NO: 309314 - DNA, 20 bp, Artificial Sequence
  chemically synthesized
tccatgctcagatccacaac

SEQ ID NO: 309315 - DNA, 20 bp, Artificial Sequence
  chemically synthesized
ccatgctcagatccacaacg

SEQ ID NO: 309316 - DNA, 20 bp, Artificial Sequence
  chemically synthesized
atgctcagatccacaacggg

SEQ ID NO: 309317 - DNA, 20 bp, Artificial Sequence
  chemically synthesized
ggaaaaaatcctccccgttg

SEQ ID NO: 309318 - DNA, 20 bp, Artificial Sequence
  chemically synthesized
tgctcagatccacaacgggg

SEQ ID NO: 309319 - DNA, 20 bp, Artificial Sequence
  chemically synthesized
tgacatgtgaattaaatggg

SEQ ID NO: 309320 - DNA, 20 bp, Artificial Sequence
  chemically synthesized
atgacatgtgaattaaatgg

SEQ ID NO: 309321 - DNA, 20 bp, Artificial Sequence
  chemically synthesized
atatgacatgtgaattaaat

SEQ ID NO: 309322 - DNA, 20 bp, Artificial Sequence
  chemically synthesized
aatatgacatgtgaattaaa

SEQ ID NO: 309323 - DNA, 20 bp, Artificial Sequence
  chemically synthesized
gtcatattgttgtacgtgcc

SEQ ID NO: 309324 - DNA, 20 bp, Artificial Sequence
  chemically synthesized
tcatattgttgtacgtgcca

SEQ ID NO: 309325 - DNA, 20 bp, Artificial Sequence
  chemically synthesized
attcagatgagaaatgtcct

SEQ ID NO: 309326 - DNA, 20 bp, Artificial Sequence
  chemically synthesized
ccaaacaaaggaattcagat

SEQ ID NO: 309327 - DNA, 20 bp, Artificial Sequence
  chemically synthesized
ctcaaccaaacaaaggaatt

SEQ ID NO: 309328 - DNA, 20 bp, Artificial Sequence
  chemically synthesized
ctcatctgaattcctttgtt

SEQ ID NO: 309329 - DNA, 20 bp, Artificial Sequence
  chemically synthesized
atagcaactcaaccaaacaa

SEQ ID NO: 309330 - DNA, 20 bp, Artificial Sequence
  chemically synthesized
aatagcaactcaaccaaaca

SEQ ID NO: 309331 - DNA, 20 bp, Artificial Sequence
  chemically synthesized
ctgaattcctttgtttggtt

SEQ ID NO: 309332 - DNA, 20 bp, Artificial Sequence
  chemically synthesized
ttttcacttttgaattgaaa

SEQ ID NO: 309333 - DNA, 20 bp, Artificial Sequence
  chemically synthesized
gagttgctatttcaattcaa

SEQ ID NO: 309334 - DNA, 20 bp, Artificial Sequence
  chemically synthesized
ttcaattcaaaagtgaaaaa

SEQ ID NO: 309335 - DNA, 20 bp, Artificial Sequence
  chemically synthesized
aagtgaaaaatggctactaa

SEQ ID NO: 309336 - DNA, 20 bp, Artificial Sequence
  chemically synthesized
ttatccaaatgttcttttag

SEQ ID NO: 309337 - DNA, 20 bp, Artificial Sequence
  chemically synthesized
cctttatccaaatgttcttt

SEQ ID NO: 309338 - DNA, 20 bp, Artificial Sequence
  chemically synthesized
atggctactaaaagaacatt

SEQ ID NO: 309339 - DNA, 20 bp, Artificial Sequence
  chemically synthesized
actaaaagaacatttggata

SEQ ID NO: 309340 - DNA, 20 bp, Artificial Sequence
  chemically synthesized
ctaaaagaacatttggataa

SEQ ID NO: 309341 - DNA, 20 bp, Artificial Sequence
  chemically synthesized
acatttggataaaggtaact

SEQ ID NO: 309342 - DNA, 20 bp, Artificial Sequence
  chemically synthesized
catttggataaaggtaactg

SEQ ID NO: 309343 - DNA, 20 bp, Artificial Sequence
  chemically synthesized
caggcttgtcagattttcct

SEQ ID NO: 309344 - DNA, 20 bp, Artificial Sequence
  chemically synthesized
gtaactgaggaaaatctgac

SEQ ID NO: 309345 - DNA, 20 bp, Artificial Sequence
  chemically synthesized
tgaggaaaatctgacaagcc

SEQ ID NO: 309346 - DNA, 20 bp, Artificial Sequence
  chemically synthesized
gatttacctcccaggcttgt

SEQ ID NO: 309347 - DNA, 20 bp, Artificial Sequence
  chemically synthesized
gaggaaaatctgacaagcct

SEQ ID NO: 309348 - DNA, 20 bp, Artificial Sequence
  chemically synthesized
ggaaaatctgacaagcctgg

SEQ ID NO: 309349 - DNA, 20 bp, Artificial Sequence
  chemically synthesized
gaaaatctgacaagcctggg

SEQ ID NO: 309350 - DNA, 20 bp, Artificial Sequence
  chemically synthesized
atacttaagatttacctccc

SEQ ID NO: 309351 - DNA, 20 bp, Artificial Sequence
  chemically synthesized
catacttaagatttacctcc

SEQ ID NO: 309352 - DNA, 20 bp, Artificial Sequence
  chemically synthesized
aagcctgggaggtaaatctt

SEQ ID NO: 309353 - DNA, 20 bp, Artificial Sequence
  chemically synthesized
tgggaggtaaatcttaagta

SEQ ID NO: 309354 - DNA, 20 bp, Artificial Sequence
  chemically synthesized
attcaagggtcaccatactt

SEQ ID NO: 309355 - DNA, 20 bp, Artificial Sequence
  chemically synthesized
cctggctccagtaaattcaa

SEQ ID NO: 309356 - DNA, 20 bp, Artificial Sequence
  chemically synthesized
ccctggctccagtaaattca

SEQ ID NO: 309357 - DNA, 20 bp, Artificial Sequence
  chemically synthesized
tccctggctccagtaaattc

SEQ ID NO: 309358 - DNA, 20 bp, Artificial Sequence
  chemically synthesized
atggtgacccttgaatttac

SEQ ID NO: 309359 - DNA, 20 bp, Artificial Sequence
  chemically synthesized
ggtgacccttgaatttactg

SEQ ID NO: 309360 - DNA, 20 bp, Artificial Sequence
  chemically synthesized
acccttgaatttactggagc

SEQ ID NO: 309361 - DNA, 20 bp, Artificial Sequence
  chemically synthesized
cccttgaatttactggagcc

SEQ ID NO: 309362 - DNA, 20 bp, Artificial Sequence
  chemically synthesized
ccttgaatttactggagcca

SEQ ID NO: 309363 - DNA, 20 bp, Artificial Sequence
  chemically synthesized
tcatattctatccctggctc

SEQ ID NO: 309364 - DNA, 20 bp, Artificial Sequence
  chemically synthesized
gaatttactggagccaggga

SEQ ID NO: 309365 - DNA, 20 bp, Artificial Sequence
  chemically synthesized
taggtttcatattctatccc

SEQ ID NO: 309366 - DNA, 20 bp, Artificial Sequence
  chemically synthesized
aatactgatgggcacagttt

SEQ ID NO: 309367 - DNA, 20 bp, Artificial Sequence
  chemically synthesized
caatactgatgggcacagtt

SEQ ID NO: 309368 - DNA, 20 bp, Artificial Sequence
  chemically synthesized
gaaacctaaactgtgcccat

SEQ ID NO: 309369 - DNA, 20 bp, Artificial Sequence
  chemically synthesized
aacgccaatactgatgggca

SEQ ID NO: 309370 - DNA, 20 bp, Artificial Sequence
  chemically synthesized
ctcttaacgccaatactgat

SEQ ID NO: 309371 - DNA, 20 bp, Artificial Sequence
  chemically synthesized
taaactgtgcccatcagtat

SEQ ID NO: 309372 - DNA, 20 bp, Artificial Sequence
  chemically synthesized
tctcttaacgccaatactga

SEQ ID NO: 309373 - DNA, 20 bp, Artificial Sequence
  chemically synthesized
tgcccatcagtattggcgtt

SEQ ID NO: 309374 - DNA, 20 bp, Artificial Sequence
  chemically synthesized
cccatcagtattggcgttaa

SEQ ID NO: 309375 - DNA, 20 bp, Artificial Sequence
  chemically synthesized
tcagtattggcgttaagaga

SEQ ID NO: 309376 - DNA, 20 bp, Artificial Sequence
  chemically synthesized
agtattggcgttaagagata

SEQ ID NO: 309377 - DNA, 20 bp, Artificial Sequence
  chemically synthesized
gttaagagatagagtgttcc

SEQ ID NO: 309378 - DNA, 20 bp, Artificial Sequence
  chemically synthesized
ttaagagatagagtgttccc

SEQ ID NO: 309379 - DNA, 20 bp, Artificial Sequence
  chemically synthesized
gccttagtggatatacgcct

SEQ ID NO: 309380 - DNA, 20 bp, Artificial Sequence
  chemically synthesized
cgccttagtggatatacgcc

SEQ ID NO: 309381 - DNA, 20 bp, Artificial Sequence
  chemically synthesized
ttcccaggcgtatatccact

SEQ ID NO: 309382 - DNA, 20 bp, Artificial Sequence
  chemically synthesized
tcccaggcgtatatccacta

SEQ ID NO: 309383 - DNA, 20 bp, Artificial Sequence
  chemically synthesized
caggcgtatatccactaagg

SEQ ID NO: 309384 - DNA, 20 bp, Artificial Sequence
  chemically synthesized
cataattgtttccgccttag

SEQ ID NO: 309385 - DNA, 20 bp, Artificial Sequence
  chemically synthesized
gcacataattgtttccgcct

SEQ ID NO: 309386 - DNA, 20 bp, Artificial Sequence
  chemically synthesized
gcggaaacaattatgtgcca

SEQ ID NO: 309387 - DNA, 20 bp, Artificial Sequence
  chemically synthesized
ctgatgcattgtgtggtcca

SEQ ID NO: 309388 - DNA, 20 bp, Artificial Sequence
  chemically synthesized
cccgttgctgatgcattgtg

SEQ ID NO: 309389 - DNA, 20 bp, Artificial Sequence
  chemically synthesized
ccatggaccacacaatgcat

SEQ ID NO: 309390 - DNA, 20 bp, Artificial Sequence
  chemically synthesized
accacacaatgcatcagcaa

SEQ ID NO: 309391 - DNA, 20 bp, Artificial Sequence
  chemically synthesized
ccacacaatgcatcagcaac

SEQ ID NO: 309392 - DNA, 20 bp, Artificial Sequence
  chemically synthesized
cacacaatgcatcagcaacg

SEQ ID NO: 309393 - DNA, 20 bp, Artificial Sequence
  chemically synthesized
tcagcaacggggctttatga

SEQ ID NO: 309394 - DNA, 20 bp, Artificial Sequence
  chemically synthesized
agcaacggggctttatgaaa

SEQ ID NO: 309395 - DNA, 20 bp, Artificial Sequence
  chemically synthesized
ttctgcctccctctttcata

SEQ ID NO: 309396 - DNA, 20 bp, Artificial Sequence
  chemically synthesized
gcaacggggctttatgaaag

SEQ ID NO: 309397 - DNA, 20 bp, Artificial Sequence
  chemically synthesized
caacggggctttatgaaaga

SEQ ID NO: 309398 - DNA, 20 bp, Artificial Sequence
  chemically synthesized
acggggctttatgaaagagg

SEQ ID NO: 309399 - DNA, 20 bp, Artificial Sequence
  chemically synthesized
cggggctttatgaaagaggg

SEQ ID NO: 309400 - DNA, 20 bp, Artificial Sequence
  chemically synthesized
ggctttatgaaagagggagg

SEQ ID NO: 309401 - DNA, 20 bp, Artificial Sequence
  chemically synthesized
aacctgcaataaaataagat

SEQ ID NO: 309402 - DNA, 20 bp, Artificial Sequence
  chemically synthesized
taacctgcaataaaataaga

SEQ ID NO: 309403 - DNA, 20 bp, Artificial Sequence
  chemically synthesized
gtcttaacctgcaataaaat

SEQ ID NO: 309404 - DNA, 20 bp, Artificial Sequence
  chemically synthesized
caacccatcttattttattg

SEQ ID NO: 309405 - DNA, 20 bp, Artificial Sequence
  chemically synthesized
aacccatcttattttattgc

SEQ ID NO: 309406 - DNA, 20 bp, Artificial Sequence
  chemically synthesized
atcttattttattgcaggtt

SEQ ID NO: 309407 - DNA, 20 bp, Artificial Sequence
  chemically synthesized
tagcagagaagtgtattata

SEQ ID NO: 309408 - DNA, 20 bp, Artificial Sequence
  chemically synthesized
ttagcagagaagtgtattat

SEQ ID NO: 309409 - DNA, 20 bp, Artificial Sequence
  chemically synthesized
tttagcagagaagtgtatta

SEQ ID NO: 309410 - DNA, 20 bp, Artificial Sequence
  chemically synthesized
ataaaattcatttagcagag

SEQ ID NO: 309411 - DNA, 20 bp, Artificial Sequence
  chemically synthesized
cacataaaattcatttagca

SEQ ID NO: 309412 - DNA, 20 bp, Artificial Sequence
  chemically synthesized
tacacataaaattcatttag

SEQ ID NO: 309413 - DNA, 20 bp, Artificial Sequence
  chemically synthesized
cattacacataaaattcatt

SEQ ID NO: 309414 - DNA, 20 bp, Artificial Sequence
  chemically synthesized
aaatgaattttatgtgtaat

SEQ ID NO: 309415 - DNA, 20 bp, Artificial Sequence
  chemically synthesized
agaaataagggattttcaga

SEQ ID NO: 309416 - DNA, 20 bp, Artificial Sequence
  chemically synthesized
aagaaataagggattttcag

SEQ ID NO: 309417 - DNA, 20 bp, Artificial Sequence
  chemically synthesized
caagaaataagggattttca

SEQ ID NO: 309418 - DNA, 20 bp, Artificial Sequence
  chemically synthesized
atcaagaaataagggatttt

SEQ ID NO: 309419 - DNA, 20 bp, Artificial Sequence
  chemically synthesized
agagaaaaatcaagaaataa

SEQ ID NO: 309420 - DNA, 20 bp, Artificial Sequence
  chemically synthesized
aagagaaaaatcaagaaata

SEQ ID NO: 309421 - DNA, 20 bp, Artificial Sequence
  chemically synthesized
taagagaaaaatcaagaaat

SEQ ID NO: 309422 - DNA, 20 bp, Artificial Sequence
  chemically synthesized
gataaagtaagagaaaaatc

SEQ ID NO: 309423 - DNA, 20 bp, Artificial Sequence
  chemically synthesized
catagttgttgataaagtaa

SEQ ID NO: 309424 - DNA, 20 bp, Artificial Sequence
  chemically synthesized
tgcatagttgttgataaagt

SEQ ID NO: 309425 - DNA, 20 bp, Artificial Sequence
  chemically synthesized
taactgcatagttgttgata

SEQ ID NO: 309426 - DNA, 20 bp, Artificial Sequence
  chemically synthesized
ttactttatcaacaactatg

SEQ ID NO: 309427 - DNA, 20 bp, Artificial Sequence
  chemically synthesized
gcttatacgttttaactgca

SEQ ID NO: 309428 - DNA, 20 bp, Artificial Sequence
  chemically synthesized
actatgcagttaaaacgtat

SEQ ID NO: 309429 - DNA, 20 bp, Artificial Sequence
  chemically synthesized
atttcaacatcagtaagagt

SEQ ID NO: 309430 - DNA, 20 bp, Artificial Sequence
  chemically synthesized
ttccatttcaacatcagtaa

SEQ ID NO: 309431 - DNA, 20 bp, Artificial Sequence
  chemically synthesized
atttccatttcaacatcagt

SEQ ID NO: 309432 - DNA, 20 bp, Artificial Sequence
  chemically synthesized
tgtgatttccatttcaacat

SEQ ID NO: 309433 - DNA, 20 bp, Artificial Sequence
  chemically synthesized
tactcttactgatgttgaaa

SEQ ID NO: 309434 - DNA, 20 bp, Artificial Sequence
  chemically synthesized
tggatttttgtttttttcaa

SEQ ID NO: 309435 - DNA, 20 bp, Artificial Sequence
  chemically synthesized
aaaaaacaaaaatccattat

SEQ ID NO: 309436 - DNA, 20 bp, Artificial Sequence
  chemically synthesized
aaaaacaaaaatccattatg

SEQ ID NO: 309437 - DNA, 20 bp, Artificial Sequence
  chemically synthesized
gccacatttctgcctcataa

SEQ ID NO: 309438 - DNA, 20 bp, Artificial Sequence
  chemically synthesized
aacaaaaatccattatgagg

SEQ ID NO: 309439 - DNA, 20 bp, Artificial Sequence
  chemically synthesized
tccattatgaggcagaaatg

SEQ ID NO: 309440 - DNA, 20 bp, Artificial Sequence
  chemically synthesized
attatgaggcagaaatgtgg

SEQ ID NO: 309441 - DNA, 20 bp, Artificial Sequence
  chemically synthesized
tatgaggcagaaatgtggca

SEQ ID NO: 309442 - DNA, 20 bp, Artificial Sequence
  chemically synthesized
tgtggcagagtcctactgaa

SEQ ID NO: 309443 - DNA, 20 bp, Artificial Sequence
  chemically synthesized
ttggctaaacactattcagt

SEQ ID NO: 309444 - DNA, 20 bp, Artificial Sequence
  chemically synthesized
cttggctaaacactattcag

SEQ ID NO: 309445 - DNA, 20 bp, Artificial Sequence
  chemically synthesized
acccttggctaaacactatt

SEQ ID NO: 309446 - DNA, 20 bp, Artificial Sequence
  chemically synthesized
gagtcctactgaatagtgtt

SEQ ID NO: 309447 - DNA, 20 bp, Artificial Sequence
  chemically synthesized
ctactgaatagtgtttagcc

SEQ ID NO: 309448 - DNA, 20 bp, Artificial Sequence
  chemically synthesized
tactgaatagtgtttagcca

SEQ ID NO: 309449 - DNA, 20 bp, Artificial Sequence
  chemically synthesized
actgaatagtgtttagccaa

SEQ ID NO: 309450 - DNA, 20 bp, Artificial Sequence
  chemically synthesized
atagtgtttagccaagggta

SEQ ID NO: 309451 - DNA, 20 bp, Artificial Sequence
  chemically synthesized
tgagaaccaagccataccct

SEQ ID NO: 309452 - DNA, 20 bp, Artificial Sequence
  chemically synthesized
gtttagccaagggtatggct

SEQ ID NO: 309453 - DNA, 20 bp, Artificial Sequence
  chemically synthesized
caagggtatggcttggttct

SEQ ID NO: 309454 - DNA, 20 bp, Artificial Sequence
  chemically synthesized
aatgtgtaaaactgagaacc

SEQ ID NO: 309455 - DNA, 20 bp, Artificial Sequence
  chemically synthesized
ttgtagaaatgtgtaaaact

SEQ ID NO: 309456 - DNA, 20 bp, Artificial Sequence
  chemically synthesized
tggtgcttcagttcagtttg

SEQ ID NO: 309457 - DNA, 20 bp, Artificial Sequence
  chemically synthesized
catttctacaaactgaactg

SEQ ID NO: 309458 - DNA, 20 bp, Artificial Sequence
  chemically synthesized
tatagtatggtgcttcagtt

SEQ ID NO: 309459 - DNA, 20 bp, Artificial Sequence
  chemically synthesized
cattttatagtatggtgctt

SEQ ID NO: 309460 - DNA, 20 bp, Artificial Sequence
  chemically synthesized
aggtacaccattttatagta

SEQ ID NO: 309461 - DNA, 20 bp, Artificial Sequence
  chemically synthesized
tgaagcaccatactataaaa

SEQ ID NO: 309462 - DNA, 20 bp, Artificial Sequence
  chemically synthesized
atataaggtacaccatttta

SEQ ID NO: 309463 - DNA, 20 bp, Artificial Sequence
  chemically synthesized
tgttatacagtgaagatata

SEQ ID NO: 309464 - DNA, 20 bp, Artificial Sequence
  chemically synthesized
atgttatacagtgaagatat

SEQ ID NO: 309465 - DNA, 20 bp, Artificial Sequence
  chemically synthesized
gtaccatatgttatacagtg

SEQ ID NO: 309466 - DNA, 20 bp, Artificial Sequence
  chemically synthesized
gccctgtaccatatgttata

SEQ ID NO: 309467 - DNA, 20 bp, Artificial Sequence
  chemically synthesized
tatcttcactgtataacata

SEQ ID NO: 309468 - DNA, 20 bp, Artificial Sequence
  chemically synthesized
tcactgtataacatatggta

SEQ ID NO: 309469 - DNA, 20 bp, Artificial Sequence
  chemically synthesized
cactgtataacatatggtac

SEQ ID NO: 309470 - DNA, 20 bp, Artificial Sequence
  chemically synthesized
actgtataacatatggtaca

SEQ ID NO: 309471 - DNA, 20 bp, Artificial Sequence
  chemically synthesized
gtataacatatggtacaggg

SEQ ID NO: 309472 - DNA, 20 bp, Artificial Sequence
  chemically synthesized
gtttcataactcatcaaaat

SEQ ID NO: 309473 - DNA, 20 bp, Artificial Sequence
  chemically synthesized
gcggataaacctattttgat

SEQ ID NO: 309474 - DNA, 20 bp, Artificial Sequence
  chemically synthesized
tgtttcataactcatcaaaa

SEQ ID NO: 309475 - DNA, 20 bp, Artificial Sequence
  chemically synthesized
atgagttatgaaacaactac

SEQ ID NO: 309476 - DNA, 20 bp, Artificial Sequence
  chemically synthesized
agttatgaaacaactactgg

SEQ ID NO: 309477 - DNA, 20 bp, Artificial Sequence
  chemically synthesized
acttttgaaaaaacttccag

SEQ ID NO: 309478 - DNA, 20 bp, Artificial Sequence
  chemically synthesized
tatacttttgaaaaaacttc

SEQ ID NO: 309479 - DNA, 20 bp, Artificial Sequence
  chemically synthesized
actactggaagttttttcaa

SEQ ID NO: 309480 - DNA, 20 bp, Artificial Sequence
  chemically synthesized
aggatcatttaaatagaagt

SEQ ID NO: 309481 - DNA, 20 bp, Artificial Sequence
  chemically synthesized
ttacaggatcatttaaatag

SEQ ID NO: 309482 - DNA, 20 bp, Artificial Sequence
  chemically synthesized
ttattacaggatcatttaaa

SEQ ID NO: 309483 - DNA, 20 bp, Artificial Sequence
  chemically synthesized
ttcagacaggagattattac

SEQ ID NO: 309484 - DNA, 20 bp, Artificial Sequence
  chemically synthesized
gttcagacaggagattatta

SEQ ID NO: 309485 - DNA, 20 bp, Artificial Sequence
  chemically synthesized
aattccttgagttcagacag

SEQ ID NO: 309486 - DNA, 20 bp, Artificial Sequence
  chemically synthesized
aaaattccttgagttcagac

SEQ ID NO: 309487 - DNA, 20 bp, Artificial Sequence
  chemically synthesized
aaaaattccttgagttcaga

SEQ ID NO: 309488 - DNA, 20 bp, Artificial Sequence
  chemically synthesized
ataatctcctgtctgaactc

SEQ ID NO: 309489 - DNA, 20 bp, Artificial Sequence
  chemically synthesized
taatctcctgtctgaactca

SEQ ID NO: 309490 - DNA, 20 bp, Artificial Sequence
  chemically synthesized
agctaaaaattccttgagtt

SEQ ID NO: 309491 - DNA, 20 bp, Artificial Sequence
  chemically synthesized
gtgacagctaaaaattcctt

SEQ ID NO: 309492 - DNA, 20 bp, Artificial Sequence
  chemically synthesized
gtctgaactcaaggaatttt

SEQ ID NO: 309493 - DNA, 20 bp, Artificial Sequence
  chemically synthesized
acctgcccctttggaagtga

SEQ ID NO: 309494 - DNA, 20 bp, Artificial Sequence
  chemically synthesized
atttttagctgtcacttcca

SEQ ID NO: 309495 - DNA, 20 bp, Artificial Sequence
  chemically synthesized
tttttagctgtcacttccaa

SEQ ID NO: 309496 - DNA, 20 bp, Artificial Sequence
  chemically synthesized
ttttagctgtcacttccaaa

SEQ ID NO: 309497 - DNA, 20 bp, Artificial Sequence
  chemically synthesized
tttagctgtcacttccaaag

SEQ ID NO: 309498 - DNA, 20 bp, Artificial Sequence
  chemically synthesized
tctgtaacctgcccctttgg

SEQ ID NO: 309499 - DNA, 20 bp, Artificial Sequence
  chemically synthesized
agctgtcacttccaaagggg

SEQ ID NO: 309500 - DNA, 20 bp, Artificial Sequence
  chemically synthesized
gctgtcacttccaaaggggc

SEQ ID NO: 309501 - DNA, 20 bp, Artificial Sequence
  chemically synthesized
tcatctgtaacctgcccctt

SEQ ID NO: 309502 - DNA, 20 bp, Artificial Sequence
  chemically synthesized
acttccaaaggggcaggtta

SEQ ID NO: 309503 - DNA, 20 bp, Artificial Sequence
  chemically synthesized
caaaggggcaggttacagat

SEQ ID NO: 309504 - DNA, 20 bp, Artificial Sequence
  chemically synthesized
aaaggggcaggttacagatg

SEQ ID NO: 309505 - DNA, 20 bp, Artificial Sequence
  chemically synthesized
gttacagatgaggaaactga

SEQ ID NO: 309506 - DNA, 20 bp, Artificial Sequence
  chemically synthesized
cagatgaggaaactgacaga

SEQ ID NO: 309507 - DNA, 20 bp, Artificial Sequence
  chemically synthesized
agatgaggaaactgacagat

SEQ ID NO: 309508 - DNA, 20 bp, Artificial Sequence
  chemically synthesized
aagttacttaacctatctgt

SEQ ID NO: 309509 - DNA, 20 bp, Artificial Sequence
  chemically synthesized
aggaaactgacagataggtt

SEQ ID NO: 309510 - DNA, 20 bp, Artificial Sequence
  chemically synthesized
ataggttaagtaacttgtct

SEQ ID NO: 309511 - DNA, 20 bp, Artificial Sequence
  chemically synthesized
taggttaagtaacttgtctg

SEQ ID NO: 309512 - DNA, 20 bp, Artificial Sequence
  chemically synthesized
tggcttctgtgacctcagac

SEQ ID NO: 309513 - DNA, 20 bp, Artificial Sequence
  chemically synthesized
aagtaacttgtctgaggtca

SEQ ID NO: 309514 - DNA, 20 bp, Artificial Sequence
  chemically synthesized
tactgtggcttctgtgacct

SEQ ID NO: 309515 - DNA, 20 bp, Artificial Sequence
  chemically synthesized
taacttgtctgaggtcacag

SEQ ID NO: 309516 - DNA, 20 bp, Artificial Sequence
  chemically synthesized
gtctgaggtcacagaagcca

SEQ ID NO: 309517 - DNA, 20 bp, Artificial Sequence
  chemically synthesized
gtcacagaagccacagtact

SEQ ID NO: 309518 - DNA, 20 bp, Artificial Sequence
  chemically synthesized
atcccagacactcagtactg

SEQ ID NO: 309519 - DNA, 20 bp, Artificial Sequence
  chemically synthesized
aagccacagtactgagtgtc

SEQ ID NO: 309520 - DNA, 20 bp, Artificial Sequence
  chemically synthesized
agccacagtactgagtgtct

SEQ ID NO: 309521 - DNA, 20 bp, Artificial Sequence
  chemically synthesized
gaggtcaaatcccagacact

SEQ ID NO: 309522 - DNA, 20 bp, Artificial Sequence
  chemically synthesized
atggatctgaggtcaaatcc

SEQ ID NO: 309523 - DNA, 20 bp, Artificial Sequence
  chemically synthesized
gagtgtctgggatttgacct

SEQ ID NO: 309524 - DNA, 20 bp, Artificial Sequence
  chemically synthesized
cttgtagccaaatggatctg

SEQ ID NO: 309525 - DNA, 20 bp, Artificial Sequence
  chemically synthesized
acttgtagccaaatggatct

SEQ ID NO: 309526 - DNA, 20 bp, Artificial Sequence
  chemically synthesized
gatttgacctcagatccatt

SEQ ID NO: 309527 - DNA, 20 bp, Artificial Sequence
  chemically synthesized
agcatgaacttgtagccaaa

SEQ ID NO: 309528 - DNA, 20 bp, Artificial Sequence
  chemically synthesized
cctcagatccatttggctac

SEQ ID NO: 309529 - DNA, 20 bp, Artificial Sequence
  chemically synthesized
tatgaacgagcatgaacttg

SEQ ID NO: 309530 - DNA, 20 bp, Artificial Sequence
  chemically synthesized
gaatgaataccattatgaac

SEQ ID NO: 309531 - DNA, 20 bp, Artificial Sequence
  chemically synthesized
aagttcatgctcgttcataa

SEQ ID NO: 309532 - DNA, 20 bp, Artificial Sequence
  chemically synthesized
cgttcataatggtattcatt

SEQ ID NO: 309533 - DNA, 20 bp, Artificial Sequence
  chemically synthesized
tcataatggtattcattcag

SEQ ID NO: 309534 - DNA, 20 bp, Artificial Sequence
  chemically synthesized
cataatggtattcattcagt

SEQ ID NO: 309535 - DNA, 20 bp, Artificial Sequence
  chemically synthesized
ataatggtattcattcagta

SEQ ID NO: 309536 - DNA, 20 bp, Artificial Sequence
  chemically synthesized
cagtagggcattcattataa

SEQ ID NO: 309537 - DNA, 20 bp, Artificial Sequence
  chemically synthesized
gttgtgtagcacaaattaga

SEQ ID NO: 309538 - DNA, 20 bp, Artificial Sequence
  chemically synthesized
ggttgtgtagcacaaattag

SEQ ID NO: 309539 - DNA, 20 bp, Artificial Sequence
  chemically synthesized
gtaggttgtgtagcacaaat

SEQ ID NO: 309540 - DNA, 20 bp, Artificial Sequence
  chemically synthesized
atatctcactgtaggttgtg

SEQ ID NO: 309541 - DNA, 20 bp, Artificial Sequence
  chemically synthesized
aatttgtgctacacaaccta

SEQ ID NO: 309542 - DNA, 20 bp, Artificial Sequence
  chemically synthesized
tgtgctacacaacctacagt

SEQ ID NO: 309543 - DNA, 20 bp, Artificial Sequence
  chemically synthesized
gcatctggatatctcactgt

SEQ ID NO: 309544 - DNA, 20 bp, Artificial Sequence
  chemically synthesized
ggcatctggatatctcactg

SEQ ID NO: 309545 - DNA, 20 bp, Artificial Sequence
  chemically synthesized
acaacctacagtgagatatc

SEQ ID NO: 309546 - DNA, 20 bp, Artificial Sequence
  chemically synthesized
ctccaaagggattcggcatc

SEQ ID NO: 309547 - DNA, 20 bp, Artificial Sequence
  chemically synthesized
gaaaagactccaaagggatt

SEQ ID NO: 309548 - DNA, 20 bp, Artificial Sequence
  chemically synthesized
atccagatgccgaatccctt

SEQ ID NO: 309549 - DNA, 20 bp, Artificial Sequence
  chemically synthesized
ccagatgccgaatccctttg

SEQ ID NO: 309550 - DNA, 20 bp, Artificial Sequence
  chemically synthesized
aaatatgaaaagactccaaa

SEQ ID NO: 309551 - DNA, 20 bp, Artificial Sequence
  chemically synthesized
aaaatatgaaaagactccaa

SEQ ID NO: 309552 - DNA, 20 bp, Artificial Sequence
  chemically synthesized
caaaatatgaaaagactcca

SEQ ID NO: 309553 - DNA, 20 bp, Artificial Sequence
  chemically synthesized
ctgctaaaacaaaatatgaa

SEQ ID NO: 309554 - DNA, 20 bp, Artificial Sequence
  chemically synthesized
agtcttttcatattttgttt

SEQ ID NO: 309555 - DNA, 20 bp, Artificial Sequence
  chemically synthesized
cttttcatattttgttttag

SEQ ID NO: 309556 - DNA, 20 bp, Artificial Sequence
  chemically synthesized
ttcatattttgttttagcag

SEQ ID NO: 309557 - DNA, 20 bp, Artificial Sequence
  chemically synthesized
tgttttagcagaagtttgac

SEQ ID NO: 309558 - DNA, 20 bp, Artificial Sequence
  chemically synthesized
attagattaaatgttaaatc

SEQ ID NO: 309559 - DNA, 20 bp, Artificial Sequence
  chemically synthesized
cacatccttgtgaagcagat

SEQ ID NO: 309560 - DNA, 20 bp, Artificial Sequence
  chemically synthesized
tttaatctaatctgcttcac

SEQ ID NO: 309561 - DNA, 20 bp, Artificial Sequence
  chemically synthesized
ttaatctaatctgcttcaca

SEQ ID NO: 309562 - DNA, 20 bp, Artificial Sequence
  chemically synthesized
agcttcacatccttgtgaag

SEQ ID NO: 309563 - DNA, 20 bp, Artificial Sequence
  chemically synthesized
ttaagcttcacatccttgtg

SEQ ID NO: 309564 - DNA, 20 bp, Artificial Sequence
  chemically synthesized
atctgcttcacaaggatgtg

SEQ ID NO: 309565 - DNA, 20 bp, Artificial Sequence
  chemically synthesized
ttgaatcaaattataacatt

SEQ ID NO: 309566 - DNA, 20 bp, Artificial Sequence
  chemically synthesized
attaaacaaatacagagtta

SEQ ID NO: 309567 - DNA, 20 bp, Artificial Sequence
  chemically synthesized
tttatgattaaacaaataca

SEQ ID NO: 309568 - DNA, 20 bp, Artificial Sequence
  chemically synthesized
gttttatgattaaacaaata

SEQ ID NO: 309569 - DNA, 20 bp, Artificial Sequence
  chemically synthesized
tttgtttaatcataaaacgt

SEQ ID NO: 309570 - DNA, 20 bp, Artificial Sequence
  chemically synthesized
tcagcaaatacttgcacttc

SEQ ID NO: 309571 - DNA, 20 bp, Artificial Sequence
  chemically synthesized
tgttcttaatctggaagtgc

SEQ ID NO: 309572 - DNA, 20 bp, Artificial Sequence
  chemically synthesized
aatacttgcacttccagatt

SEQ ID NO: 309573 - DNA, 20 bp, Artificial Sequence
  chemically synthesized
gccacatgttcttaatctgg

SEQ ID NO: 309574 - DNA, 20 bp, Artificial Sequence
  chemically synthesized
aaggccacatgttcttaatc

SEQ ID NO: 309575 - DNA, 20 bp, Artificial Sequence
  chemically synthesized
acttccagattaagaacatg

SEQ ID NO: 309576 - DNA, 20 bp, Artificial Sequence
  chemically synthesized
ttaagaacatgtggcctttg

SEQ ID NO: 309577 - DNA, 20 bp, Artificial Sequence
  chemically synthesized
taagaacatgtggcctttgc

SEQ ID NO: 309578 - DNA, 20 bp, Artificial Sequence
  chemically synthesized
tttaaaaataagtcctgcaa

SEQ ID NO: 309579 - DNA, 20 bp, Artificial Sequence
  chemically synthesized
ttttaaaaataagtcctgca

SEQ ID NO: 309580 - DNA, 20 bp, Artificial Sequence
  chemically synthesized
catacttaccttttaaaaat

SEQ ID NO: 309581 - DNA, 20 bp, Artificial Sequence
  chemically synthesized
tttgcaggacttatttttaa

SEQ ID NO: 309582 - DNA, 20 bp, Artificial Sequence
  chemically synthesized
ttgcaggacttatttttaaa

SEQ ID NO: 309583 - DNA, 20 bp, Artificial Sequence
  chemically synthesized
aggacttatttttaaaaggt

SEQ ID NO: 309584 - DNA, 20 bp, Artificial Sequence
  chemically synthesized
gcagaatttaatgaacaaat

SEQ ID NO: 309585 - DNA, 20 bp, Artificial Sequence
  chemically synthesized
tttcagcacaattgcaaagg

SEQ ID NO: 309586 - DNA, 20 bp, Artificial Sequence
  chemically synthesized
cactttcagcacaattgcaa

SEQ ID NO: 309587 - DNA, 20 bp, Artificial Sequence
  chemically synthesized
acactttcagcacaattgca

SEQ ID NO: 309588 - DNA, 20 bp, Artificial Sequence
  chemically synthesized
tgcctttgcaattgtgctga

SEQ ID NO: 309589 - DNA, 20 bp, Artificial Sequence
  chemically synthesized
ttgcaattgtgctgaaagtg

SEQ ID NO: 309590 - DNA, 20 bp, Artificial Sequence
  chemically synthesized
ttaaaatctcactacacttt

SEQ ID NO: 309591 - DNA, 20 bp, Artificial Sequence
  chemically synthesized
aattgtgctgaaagtgtagt

SEQ ID NO: 309592 - DNA, 20 bp, Artificial Sequence
  chemically synthesized
tgtagtgagattttaacacg

SEQ ID NO: 309593 - DNA, 20 bp, Artificial Sequence
  chemically synthesized
agtgagattttaacacgaag

SEQ ID NO: 309594 - DNA, 20 bp, Artificial Sequence
  chemically synthesized
ctgactgaaatagcgtagag

SEQ ID NO: 309595 - DNA, 20 bp, Artificial Sequence
  chemically synthesized
aaactgactgaaatagcgta

SEQ ID NO: 309596 - DNA, 20 bp, Artificial Sequence
  chemically synthesized
ggaaactgactgaaatagcg

SEQ ID NO: 309597 - DNA, 20 bp, Artificial Sequence
  chemically synthesized
tgttcttctctacgctattt

SEQ ID NO: 309598 - DNA, 20 bp, Artificial Sequence
  chemically synthesized
cttctctacgctatttcagt

SEQ ID NO: 309599 - DNA, 20 bp, Artificial Sequence
  chemically synthesized
atataggaaactgactgaaa

SEQ ID NO: 309600 - DNA, 20 bp, Artificial Sequence
  chemically synthesized
ctcacacaaataaataatat

SEQ ID NO: 309601 - DNA, 20 bp, Artificial Sequence
  chemically synthesized
actcacacaaataaataata

SEQ ID NO: 309602 - DNA, 20 bp, Artificial Sequence
  chemically synthesized
cctatattatttatttgtgt

SEQ ID NO: 309603 - DNA, 20 bp, Artificial Sequence
  chemically synthesized
tttatttgtgtgagtataca

SEQ ID NO: 309604 - DNA, 20 bp, Artificial Sequence
  chemically synthesized
gcttttccagatttattcat

SEQ ID NO: 309605 - DNA, 20 bp, Artificial Sequence
  chemically synthesized
aaagtgctaatgaataaatc

SEQ ID NO: 309606 - DNA, 20 bp, Artificial Sequence
  chemically synthesized
gctaatgaataaatctggaa

SEQ ID NO: 309607 - DNA, 20 bp, Artificial Sequence
  chemically synthesized
acaacaacaaaaggcttttc

SEQ ID NO: 309608 - DNA, 20 bp, Artificial Sequence
  chemically synthesized
acagcagtgacaacaacaaa

SEQ ID NO: 309609 - DNA, 20 bp, Artificial Sequence
  chemically synthesized
aacagcagtgacaacaacaa

SEQ ID NO: 309610 - DNA, 20 bp, Artificial Sequence
  chemically synthesized
tatcctgcaaagaataacag

SEQ ID NO: 309611 - DNA, 20 bp, Artificial Sequence
  chemically synthesized
taatatcctgcaaagaataa

SEQ ID NO: 309612 - DNA, 20 bp, Artificial Sequence
  chemically synthesized
gtcactgctgttattctttg

SEQ ID NO: 309613 - DNA, 20 bp, Artificial Sequence
  chemically synthesized
tcactgctgttattctttgc

SEQ ID NO: 309614 - DNA, 20 bp, Artificial Sequence
  chemically synthesized
acattaaataatatcctgca

SEQ ID NO: 309615 - DNA, 20 bp, Artificial Sequence
  chemically synthesized
gctgccaaaaaaaaaaaaaa

SEQ ID NO: 309616 - DNA, 20 bp, Artificial Sequence
  chemically synthesized
atgtcttttttttttttttt

SEQ ID NO: 309617 - DNA, 20 bp, Artificial Sequence
  chemically synthesized
tcttttttttttttttttgg

SEQ ID NO: 309618 - DNA, 20 bp, Artificial Sequence
  chemically synthesized
tggagagtacagagtttatt

SEQ ID NO: 309619 - DNA, 20 bp, Artificial Sequence
  chemically synthesized
ggtgggagctggagagtaca

SEQ ID NO: 309620 - DNA, 20 bp, Artificial Sequence
  chemically synthesized
ttaataaactctgtactctc

SEQ ID NO: 309621 - DNA, 20 bp, Artificial Sequence
  chemically synthesized
ctggtgggagctggagagta

SEQ ID NO: 309622 - DNA, 20 bp, Artificial Sequence
  chemically synthesized
acagactggtgggagctgga

SEQ ID NO: 309623 - DNA, 20 bp, Artificial Sequence
  chemically synthesized
gaacagactggtgggagctg

SEQ ID NO: 309624 - DNA, 20 bp, Artificial Sequence
  chemically synthesized
ttgaacagactggtgggagc

SEQ ID NO: 309625 - DNA, 20 bp, Artificial Sequence
  chemically synthesized
ctgtactctccagctcccac

SEQ ID NO: 309626 - DNA, 20 bp, Artificial Sequence
  chemically synthesized
ccaattgaacagactggtgg

SEQ ID NO: 309627 - DNA, 20 bp, Artificial Sequence
  chemically synthesized
tcccaattgaacagactggt

SEQ ID NO: 309628 - DNA, 20 bp, Artificial Sequence
  chemically synthesized
atcccaattgaacagactgg

SEQ ID NO: 309629 - DNA, 20 bp, Artificial Sequence
  chemically synthesized
ggtatcccaattgaacagac

SEQ ID NO: 309630 - DNA, 20 bp, Artificial Sequence
  chemically synthesized
ctcccaccagtctgttcaat

SEQ ID NO: 309631 - DNA, 20 bp, Artificial Sequence
  chemically synthesized
tcccaccagtctgttcaatt

SEQ ID NO: 309632 - DNA, 20 bp, Artificial Sequence
  chemically synthesized
tttctggtatcccaattgaa

SEQ ID NO: 309633 - DNA, 20 bp, Artificial Sequence
  chemically synthesized
agtctgttcaattgggatac

SEQ ID NO: 309634 - DNA, 20 bp, Artificial Sequence
  chemically synthesized
aattgggataccagaaaata

SEQ ID NO: 309635 - DNA, 20 bp, Artificial Sequence
  chemically synthesized
aactcctgctctttattttc

SEQ ID NO: 309636 - DNA, 20 bp, Artificial Sequence
  chemically synthesized
ttgggataccagaaaataaa

SEQ ID NO: 309637 - DNA, 20 bp, Artificial Sequence
  chemically synthesized
ggataccagaaaataaagag

SEQ ID NO: 309638 - DNA, 20 bp, Artificial Sequence
  chemically synthesized
gataccagaaaataaagagc

SEQ ID NO: 309639 - DNA, 20 bp, Artificial Sequence
  chemically synthesized
taccagaaaataaagagcag

SEQ ID NO: 309640 - DNA, 20 bp, Artificial Sequence
  chemically synthesized
aaataaagagcaggagttct

SEQ ID NO: 309641 - DNA, 20 bp, Artificial Sequence
  chemically synthesized
aataaagagcaggagttcta

SEQ ID NO: 309642 - DNA, 20 bp, Artificial Sequence
  chemically synthesized
taaagagcaggagttctaag

SEQ ID NO: 309643 - DNA, 20 bp, Artificial Sequence
  chemically synthesized
tgttacgctggaatgctcct

SEQ ID NO: 309644 - DNA, 20 bp, Artificial Sequence
  chemically synthesized
aggagttctaaggagcattc

SEQ ID NO: 309645 - DNA, 20 bp, Artificial Sequence
  chemically synthesized
taaggagcattccagcgtaa

SEQ ID NO: 309646 - DNA, 20 bp, Artificial Sequence
  chemically synthesized
tggaaggaacactgttacgc

SEQ ID NO: 309647 - DNA, 20 bp, Artificial Sequence
  chemically synthesized
cagcgtaacagtgttccttc

SEQ ID NO: 309648 - DNA, 20 bp, Artificial Sequence
  chemically synthesized
ggaatgtgatgaatgctgga

SEQ ID NO: 309649 - DNA, 20 bp, Artificial Sequence
  chemically synthesized
gggaatgtgatgaatgctgg

SEQ ID NO: 309650 - DNA, 20 bp, Artificial Sequence
  chemically synthesized
cctgggaatgtgatgaatgc

SEQ ID NO: 309651 - DNA, 20 bp, Artificial Sequence
  chemically synthesized
tccagcattcatcacattcc

SEQ ID NO: 309652 - DNA, 20 bp, Artificial Sequence
  chemically synthesized
ccagcattcatcacattccc

SEQ ID NO: 309653 - DNA, 20 bp, Artificial Sequence
  chemically synthesized
caagctaccaaggaatgcct

SEQ ID NO: 309654 - DNA, 20 bp, Artificial Sequence
  chemically synthesized
tcaagctaccaaggaatgcc

SEQ ID NO: 309655 - DNA, 20 bp, Artificial Sequence
  chemically synthesized
tcacattcccaggcattcct

SEQ ID NO: 309656 - DNA, 20 bp, Artificial Sequence
  chemically synthesized
cattcccaggcattccttgg

SEQ ID NO: 309657 - DNA, 20 bp, Artificial Sequence
  chemically synthesized
gaggaaacctcaagctacca

SEQ ID NO: 309658 - DNA, 20 bp, Artificial Sequence
  chemically synthesized
agaggaaacctcaagctacc

SEQ ID NO: 309659 - DNA, 20 bp, Artificial Sequence
  chemically synthesized
caggcattccttggtagctt

SEQ ID NO: 309660 - DNA, 20 bp, Artificial Sequence
  chemically synthesized
aggcattccttggtagcttg

SEQ ID NO: 309661 - DNA, 20 bp, Artificial Sequence
  chemically synthesized
gataaggaagaggaaacctc

SEQ ID NO: 309662 - DNA, 20 bp, Artificial Sequence
  chemically synthesized
ggtataaaacgataaggaag

SEQ ID NO: 309663 - DNA, 20 bp, Artificial Sequence
  chemically synthesized
aggtataaaacgataaggaa

SEQ ID NO: 309664 - DNA, 20 bp, Artificial Sequence
  chemically synthesized
cgaggtataaaacgataagg

SEQ ID NO: 309665 - DNA, 20 bp, Artificial Sequence
  chemically synthesized
ctgcgaggtataaaacgata

SEQ ID NO: 309666 - DNA, 20 bp, Artificial Sequence
  chemically synthesized
tctgcgaggtataaaacgat

SEQ ID NO: 309667 - DNA, 20 bp, Artificial Sequence
  chemically synthesized
ccttatcgttttatacctcg

SEQ ID NO: 309668 - DNA, 20 bp, Artificial Sequence
  chemically synthesized
caaggagctcagagtctgcg

SEQ ID NO: 309669 - DNA, 20 bp, Artificial Sequence
  chemically synthesized
tcaaggagctcagagtctgc

SEQ ID NO: 309670 - DNA, 20 bp, Artificial Sequence
  chemically synthesized
ttttatacctcgcagactct

SEQ ID NO: 309671 - DNA, 20 bp, Artificial Sequence
  chemically synthesized
agcccacctcaaggagctca

SEQ ID NO: 309672 - DNA, 20 bp, Artificial Sequence
  chemically synthesized
ggagcccacctcaaggagct

SEQ ID NO: 309673 - DNA, 20 bp, Artificial Sequence
  chemically synthesized
tcgcagactctgagctcctt

SEQ ID NO: 309674 - DNA, 20 bp, Artificial Sequence
  chemically synthesized
cgcagactctgagctccttg

SEQ ID NO: 309675 - DNA, 20 bp, Artificial Sequence
  chemically synthesized
agactctgagctccttgagg

SEQ ID NO: 309676 - DNA, 20 bp, Artificial Sequence
  chemically synthesized
ggtaaggagcccacctcaag

SEQ ID NO: 309677 - DNA, 20 bp, Artificial Sequence
  chemically synthesized
gactctgagctccttgaggt

SEQ ID NO: 309678 - DNA, 20 bp, Artificial Sequence
  chemically synthesized
aaggtaaggagcccacctca

SEQ ID NO: 309679 - DNA, 20 bp, Artificial Sequence
  chemically synthesized
aaaggtaaggagcccacctc

SEQ ID NO: 309680 - DNA, 20 bp, Artificial Sequence
  chemically synthesized
acattaacctcaaaggtaag

SEQ ID NO: 309681 - DNA, 20 bp, Artificial Sequence
  chemically synthesized
gaggtgggctccttaccttt

SEQ ID NO: 309682 - DNA, 20 bp, Artificial Sequence
  chemically synthesized
agacattaacctcaaaggta

SEQ ID NO: 309683 - DNA, 20 bp, Artificial Sequence
  chemically synthesized
aggtgggctccttacctttg

SEQ ID NO: 309684 - DNA, 20 bp, Artificial Sequence
  chemically synthesized
aagacattaacctcaaaggt

SEQ ID NO: 309685 - DNA, 20 bp, Artificial Sequence
  chemically synthesized
gtgcaagacattaacctcaa

SEQ ID NO: 309686 - DNA, 20 bp, Artificial Sequence
  chemically synthesized
tgtgcaagacattaacctca

SEQ ID NO: 309687 - DNA, 20 bp, Artificial Sequence
  chemically synthesized
cagttttgggatatttgtgc

SEQ ID NO: 309688 - DNA, 20 bp, Artificial Sequence
  chemically synthesized
cagtagtagtattcagtttt

SEQ ID NO: 309689 - DNA, 20 bp, Artificial Sequence
  chemically synthesized
acagtagtagtattcagttt

SEQ ID NO: 309690 - DNA, 20 bp, Artificial Sequence
  chemically synthesized
ataacgacagtagtagtatt

SEQ ID NO: 309691 - DNA, 20 bp, Artificial Sequence
  chemically synthesized
cctattgataacgacagtag

SEQ ID NO: 309692 - DNA, 20 bp, Artificial Sequence
  chemically synthesized
ccacctattgataacgacag

SEQ ID NO: 309693 - DNA, 20 bp, Artificial Sequence
  chemically synthesized
aagccacctattgataacga

SEQ ID NO: 309694 - DNA, 20 bp, Artificial Sequence
  chemically synthesized
actactactgtcgttatcaa

SEQ ID NO: 309695 - DNA, 20 bp, Artificial Sequence
  chemically synthesized
ctactactgtcgttatcaat

SEQ ID NO: 309696 - DNA, 20 bp, Artificial Sequence
  chemically synthesized
ctactgtcgttatcaatagg

SEQ ID NO: 309697 - DNA, 20 bp, Artificial Sequence
  chemically synthesized
agacaaaagttgggtgggga

SEQ ID NO: 309698 - DNA, 20 bp, Artificial Sequence
  chemically synthesized
tctaagacaaaagttgggtg

SEQ ID NO: 309699 - DNA, 20 bp, Artificial Sequence
  chemically synthesized
ttctaagacaaaagttgggt

SEQ ID NO: 309700 - DNA, 20 bp, Artificial Sequence
  chemically synthesized
gttctaagacaaaagttggg

SEQ ID NO: 309701 - DNA, 20 bp, Artificial Sequence
  chemically synthesized
atggttctaagacaaaagtt

SEQ ID NO: 309702 - DNA, 20 bp, Artificial Sequence
  chemically synthesized
gatggttctaagacaaaagt

SEQ ID NO: 309703 - DNA, 20 bp, Artificial Sequence
  chemically synthesized
tccccacccaacttttgtct

SEQ ID NO: 309704 - DNA, 20 bp, Artificial Sequence
  chemically synthesized
aaaagatggttctaagacaa

SEQ ID NO: 309705 - DNA, 20 bp, Artificial Sequence
  chemically synthesized
gatccaaaaaagatggttct

SEQ ID NO: 309706 - DNA, 20 bp, Artificial Sequence
  chemically synthesized
tgtcttagaaccatcttttt

SEQ ID NO: 309707 - DNA, 20 bp, Artificial Sequence
  chemically synthesized
attgaaagatccaaaaaaga

SEQ ID NO: 309708 - DNA, 20 bp, Artificial Sequence
  chemically synthesized
gcagattgaaagatccaaaa

SEQ ID NO: 309709 - DNA, 20 bp, Artificial Sequence
  chemically synthesized
tgtaatgattagcagattga

SEQ ID NO: 309710 - DNA, 20 bp, Artificial Sequence
  chemically synthesized
atactttatgtaatgattag

SEQ ID NO: 309711 - DNA, 20 bp, Artificial Sequence
  chemically synthesized
tttatactttatgtaatgat

SEQ ID NO: 309712 - DNA, 20 bp, Artificial Sequence
  chemically synthesized
aatctgctaatcattacata

SEQ ID NO: 309713 - DNA, 20 bp, Artificial Sequence
  chemically synthesized
aactgaagtgggaatgcagg

SEQ ID NO: 309714 - DNA, 20 bp, Artificial Sequence
  chemically synthesized
tagaactgaagtgggaatgc

SEQ ID NO: 309715 - DNA, 20 bp, Artificial Sequence
  chemically synthesized
gtagaactgaagtgggaatg

SEQ ID NO: 309716 - DNA, 20 bp, Artificial Sequence
  chemically synthesized
aacttcctgcattcccactt

SEQ ID NO: 309717 - DNA, 20 bp, Artificial Sequence
  chemically synthesized
ggcaacagtagaactgaagt

SEQ ID NO: 309718 - DNA, 20 bp, Artificial Sequence
  chemically synthesized
gggcaacagtagaactgaag

SEQ ID NO: 309719 - DNA, 20 bp, Artificial Sequence
  chemically synthesized
gttgggcaacagtagaactg

SEQ ID NO: 309720 - DNA, 20 bp, Artificial Sequence
  chemically synthesized
attacaaagttgggcaacag

SEQ ID NO: 309721 - DNA, 20 bp, Artificial Sequence
  chemically synthesized
gatattacaaagttgggcaa

SEQ ID NO: 309722 - DNA, 20 bp, Artificial Sequence
  chemically synthesized
ttcacagatattacaaagtt

SEQ ID NO: 309723 - DNA, 20 bp, Artificial Sequence
  chemically synthesized
gttcacagatattacaaagt

SEQ ID NO: 309724 - DNA, 20 bp, Artificial Sequence
  chemically synthesized
gtttgttcacagatattaca

SEQ ID NO: 309725 - DNA, 20 bp, Artificial Sequence
  chemically synthesized
agcaagattgagtttgttca

SEQ ID NO: 309726 - DNA, 20 bp, Artificial Sequence
  chemically synthesized
aactaaagcacagcaagatt

SEQ ID NO: 309727 - DNA, 20 bp, Artificial Sequence
  chemically synthesized
tgagaaaactaaagcacagc

SEQ ID NO: 309728 - DNA, 20 bp, Artificial Sequence
  chemically synthesized
aactcaatcttgctgtgctt

SEQ ID NO: 309729 - DNA, 20 bp, Artificial Sequence
  chemically synthesized
ctggtgagaaaactaaagca

SEQ ID NO: 309730 - DNA, 20 bp, Artificial Sequence
  chemically synthesized
tttcactggtgagaaaacta

SEQ ID NO: 309731 - DNA, 20 bp, Artificial Sequence
  chemically synthesized
ctgtgctttagttttctcac

SEQ ID NO: 309732 - DNA, 20 bp, Artificial Sequence
  chemically synthesized
attatctctatttcactggt

SEQ ID NO: 309733 - DNA, 20 bp, Artificial Sequence
  chemically synthesized
tagttttctcaccagtgaaa

SEQ ID NO: 309734 - DNA, 20 bp, Artificial Sequence
  chemically synthesized
tactattatctctatttcac

SEQ ID NO: 309735 - DNA, 20 bp, Artificial Sequence
  chemically synthesized
gttttctcaccagtgaaata

SEQ ID NO: 309736 - DNA, 20 bp, Artificial Sequence
  chemically synthesized
caccagtgaaatagagataa

SEQ ID NO: 309737 - DNA, 20 bp, Artificial Sequence
  chemically synthesized
gtgaaatagagataatagta

SEQ ID NO: 309738 - DNA, 20 bp, Artificial Sequence
  chemically synthesized
gataatagtacagactctcc

SEQ ID NO: 309739 - DNA, 20 bp, Artificial Sequence
  chemically synthesized
atagtacagactctcctaga

SEQ ID NO: 309740 - DNA, 20 bp, Artificial Sequence
  chemically synthesized
tagcagttacctgtctagga

SEQ ID NO: 309741 - DNA, 20 bp, Artificial Sequence
  chemically synthesized
tagtacagactctcctagac

SEQ ID NO: 309742 - DNA, 20 bp, Artificial Sequence
  chemically synthesized
cctagcagttacctgtctag

SEQ ID NO: 309743 - DNA, 20 bp, Artificial Sequence
  chemically synthesized
accctagcagttacctgtct

SEQ ID NO: 309744 - DNA, 20 bp, Artificial Sequence
  chemically synthesized
gaccctagcagttacctgtc

SEQ ID NO: 309745 - DNA, 20 bp, Artificial Sequence
  chemically synthesized
tctcctagacaggtaactgc

SEQ ID NO: 309746 - DNA, 20 bp, Artificial Sequence
  chemically synthesized
ctcctagacaggtaactgct

SEQ ID NO: 309747 - DNA, 20 bp, Artificial Sequence
  chemically synthesized
tcctagacaggtaactgcta

SEQ ID NO: 309748 - DNA, 20 bp, Artificial Sequence
  chemically synthesized
agacaggtaactgctagggt

SEQ ID NO: 309749 - DNA, 20 bp, Artificial Sequence
  chemically synthesized
attgatctatctgaccctag

SEQ ID NO: 309750 - DNA, 20 bp, Artificial Sequence
  chemically synthesized
tttattgatctatctgaccc

SEQ ID NO: 309751 - DNA, 20 bp, Artificial Sequence
  chemically synthesized
aggtaactgctagggtcaga

SEQ ID NO: 309752 - DNA, 20 bp, Artificial Sequence
  chemically synthesized
agatagatcaataaatgtga

SEQ ID NO: 309753 - DNA, 20 bp, Artificial Sequence
  chemically synthesized
ataattcatcacagatttaa

SEQ ID NO: 309754 - DNA, 20 bp, Artificial Sequence
  chemically synthesized
caataattcatcacagattt

SEQ ID NO: 309755 - DNA, 20 bp, Artificial Sequence
  chemically synthesized
agcatctcaataattcatca

SEQ ID NO: 309756 - DNA, 20 bp, Artificial Sequence
  chemically synthesized
taaatctgtgatgaattatt

SEQ ID NO: 309757 - DNA, 20 bp, Artificial Sequence
  chemically synthesized
aattattgagatgcttgtga

SEQ ID NO: 309758 - DNA, 20 bp, Artificial Sequence
  chemically synthesized
ctctaaatccttactatcac

SEQ ID NO: 309759 - DNA, 20 bp, Artificial Sequence
  chemically synthesized
attgagatgcttgtgatagt

SEQ ID NO: 309760 - DNA, 20 bp, Artificial Sequence
  chemically synthesized
ttgagatgcttgtgatagta

SEQ ID NO: 309761 - DNA, 20 bp, Artificial Sequence
  chemically synthesized
tgcttgtgatagtaaggatt

SEQ ID NO: 309762 - DNA, 20 bp, Artificial Sequence
  chemically synthesized
cttgtgatagtaaggattta

SEQ ID NO: 309763 - DNA, 20 bp, Artificial Sequence
  chemically synthesized
gatagtaaggatttagagct

SEQ ID NO: 309764 - DNA, 20 bp, Artificial Sequence
  chemically synthesized
ggctgatttttttatcgact

SEQ ID NO: 309765 - DNA, 20 bp, Artificial Sequence
  chemically synthesized
agctcagtcgataaaaaaat

SEQ ID NO: 309766 - DNA, 20 bp, Artificial Sequence
  chemically synthesized
aaaaaaatcagcctttattc

SEQ ID NO: 309767 - DNA, 20 bp, Artificial Sequence
  chemically synthesized
atttatcacatctggaataa

SEQ ID NO: 309768 - DNA, 20 bp, Artificial Sequence
  chemically synthesized
gatttatcacatctggaata

SEQ ID NO: 309769 - DNA, 20 bp, Artificial Sequence
  chemically synthesized
tgctccagatttatcacatc

SEQ ID NO: 309770 - DNA, 20 bp, Artificial Sequence
  chemically synthesized
tattccagatgtgataaatc

SEQ ID NO: 309771 - DNA, 20 bp, Artificial Sequence
  chemically synthesized
ttccagatgtgataaatctg

SEQ ID NO: 309772 - DNA, 20 bp, Artificial Sequence
  chemically synthesized
attaaaattctatcatgctc

SEQ ID NO: 309773 - DNA, 20 bp, Artificial Sequence
  chemically synthesized
gtgataaatctggagcatga

SEQ ID NO: 309774 - DNA, 20 bp, Artificial Sequence
  chemically synthesized
agcatgatagaattttaata

SEQ ID NO: 309775 - DNA, 20 bp, Artificial Sequence
  chemically synthesized
tagaattttaatatagaaca

SEQ ID NO: 309776 - DNA, 20 bp, Artificial Sequence
  chemically synthesized
tagaacacagtgaaacattt

SEQ ID NO: 309777 - DNA, 20 bp, Artificial Sequence
  chemically synthesized
aacacagtgaaacattttag

SEQ ID NO: 309778 - DNA, 20 bp, Artificial Sequence
  chemically synthesized
acacagtgaaacattttaga

SEQ ID NO: 309779 - DNA, 20 bp, Artificial Sequence
  chemically synthesized
aacataagctttatcaagta

SEQ ID NO: 309780 - DNA, 20 bp, Artificial Sequence
  chemically synthesized
atttttttctatacttgata

SEQ ID NO: 309781 - DNA, 20 bp, Artificial Sequence
  chemically synthesized
tataaaacataagctttatc

SEQ ID NO: 309782 - DNA, 20 bp, Artificial Sequence
  chemically synthesized
tcaattcttgtataaaacat

SEQ ID NO: 309783 - DNA, 20 bp, Artificial Sequence
  chemically synthesized
ataaagcttatgttttatac

SEQ ID NO: 309784 - DNA, 20 bp, Artificial Sequence
  chemically synthesized
cctgttgtttaaaattgtaa

SEQ ID NO: 309785 - DNA, 20 bp, Artificial Sequence
  chemically synthesized
ccctgttgtttaaaattgta

SEQ ID NO: 309786 - DNA, 20 bp, Artificial Sequence
  chemically synthesized
acctttacaattttaaacaa

SEQ ID NO: 309787 - DNA, 20 bp, Artificial Sequence
  chemically synthesized
cctttacaattttaaacaac

SEQ ID NO: 309788 - DNA, 20 bp, Artificial Sequence
  chemically synthesized
ctttacaattttaaacaaca

SEQ ID NO: 309789 - DNA, 20 bp, Artificial Sequence
  chemically synthesized
aaaggatacctattggaata

SEQ ID NO: 309790 - DNA, 20 bp, Artificial Sequence
  chemically synthesized
acaacagggccatattccaa

SEQ ID NO: 309791 - DNA, 20 bp, Artificial Sequence
  chemically synthesized
caacagggccatattccaat

SEQ ID NO: 309792 - DNA, 20 bp, Artificial Sequence
  chemically synthesized
aagaaaaaaaggatacctat

SEQ ID NO: 309793 - DNA, 20 bp, Artificial Sequence
  chemically synthesized
tctcaaagaaaaagaaaaaa

SEQ ID NO: 309794 - DNA, 20 bp, Artificial Sequence
  chemically synthesized
gtctcaaagaaaaagaaaaa

SEQ ID NO: 309795 - DNA, 20 bp, Artificial Sequence
  chemically synthesized
tcctttttttctttttcttt

SEQ ID NO: 309796 - DNA, 20 bp, Artificial Sequence
  chemically synthesized
aagactctgtctcaaagaaa

SEQ ID NO: 309797 - DNA, 20 bp, Artificial Sequence
  chemically synthesized
ttttttctttttctttgaga

SEQ ID NO: 309798 - DNA, 20 bp, Artificial Sequence
  chemically synthesized
ttttctttttctttgagaca

SEQ ID NO: 309799 - DNA, 20 bp, Artificial Sequence
  chemically synthesized
cagagaaagactctgtctca

SEQ ID NO: 309800 - DNA, 20 bp, Artificial Sequence
  chemically synthesized
tccagcctaggggacagaga

SEQ ID NO: 309801 - DNA, 20 bp, Artificial Sequence
  chemically synthesized
cagagtctttctctgtcccc

SEQ ID NO: 309802 - DNA, 20 bp, Artificial Sequence
  chemically synthesized
gctctccagcctaggggaca

SEQ ID NO: 309803 - DNA, 20 bp, Artificial Sequence
  chemically synthesized
agagtctttctctgtcccct

SEQ ID NO: 309804 - DNA, 20 bp, Artificial Sequence
  chemically synthesized
ctgctctccagcctagggga

SEQ ID NO: 309805 - DNA, 20 bp, Artificial Sequence
  chemically synthesized
tctttctctgtcccctaggc

SEQ ID NO: 309806 - DNA, 20 bp, Artificial Sequence
  chemically synthesized
gccactgctctccagcctag

SEQ ID NO: 309807 - DNA, 20 bp, Artificial Sequence
  chemically synthesized
tttctctgtcccctaggctg

SEQ ID NO: 309808 - DNA, 20 bp, Artificial Sequence
  chemically synthesized
cgccactgctctccagccta

SEQ ID NO: 309809 - DNA, 20 bp, Artificial Sequence
  chemically synthesized
gcgccactgctctccagcct

SEQ ID NO: 309810 - DNA, 20 bp, Artificial Sequence
  chemically synthesized
tctctgtcccctaggctgga

SEQ ID NO: 309811 - DNA, 20 bp, Artificial Sequence
  chemically synthesized
cgcgccactgctctccagcc

SEQ ID NO: 309812 - DNA, 20 bp, Artificial Sequence
  chemically synthesized
ctgtcccctaggctggagag

SEQ ID NO: 309813 - DNA, 20 bp, Artificial Sequence
  chemically synthesized
gagatcgcgccactgctctc

SEQ ID NO: 309814 - DNA, 20 bp, Artificial Sequence
  chemically synthesized
tcccctaggctggagagcag

SEQ ID NO: 309815 - DNA, 20 bp, Artificial Sequence
  chemically synthesized
ggagagcagtggcgcgatct

SEQ ID NO: 309816 - DNA, 20 bp, Artificial Sequence
  chemically synthesized
ggtggaggttgcagtgagcc

SEQ ID NO: 309817 - DNA, 20 bp, Artificial Sequence
  chemically synthesized
tgggtggtggaggttgcagt

SEQ ID NO: 309818 - DNA, 20 bp, Artificial Sequence
  chemically synthesized
aacttgggtggtggaggttg

SEQ ID NO: 309819 - DNA, 20 bp, Artificial Sequence
  chemically synthesized
cccttgaacttgggtggtgg

SEQ ID NO: 309820 - DNA, 20 bp, Artificial Sequence
  chemically synthesized
tcccttgaacttgggtggtg

SEQ ID NO: 309821 - DNA, 20 bp, Artificial Sequence
  chemically synthesized
cactgcaacctccaccaccc

SEQ ID NO: 309822 - DNA, 20 bp, Artificial Sequence
  chemically synthesized
aatcccttgaacttgggtgg

SEQ ID NO: 309823 - DNA, 20 bp, Artificial Sequence
  chemically synthesized
aagaatcccttgaacttggg

SEQ ID NO: 309824 - DNA, 20 bp, Artificial Sequence
  chemically synthesized
aacctccaccacccaagttc

SEQ ID NO: 309825 - DNA, 20 bp, Artificial Sequence
  chemically synthesized
acctccaccacccaagttca

SEQ ID NO: 309826 - DNA, 20 bp, Artificial Sequence
  chemically synthesized
cacaagaatcccttgaactt

SEQ ID NO: 309827 - DNA, 20 bp, Artificial Sequence
  chemically synthesized
cctccaccacccaagttcaa

SEQ ID NO: 309828 - DNA, 20 bp, Artificial Sequence
  chemically synthesized
gcacaagaatcccttgaact

SEQ ID NO: 309829 - DNA, 20 bp, Artificial Sequence
  chemically synthesized
ttcaagggattcttgtgcct

SEQ ID NO: 309830 - DNA, 20 bp, Artificial Sequence
  chemically synthesized
tacttgggaaactgaggcac

SEQ ID NO: 309831 - DNA, 20 bp, Artificial Sequence
  chemically synthesized
cccagctacttgggaaactg

SEQ ID NO: 309832 - DNA, 20 bp, Artificial Sequence
  chemically synthesized
tcccagctacttgggaaact

SEQ ID NO: 309833 - DNA, 20 bp, Artificial Sequence
  chemically synthesized
ttcttgtgcctcagtttccc

SEQ ID NO: 309834 - DNA, 20 bp, Artificial Sequence
  chemically synthesized
ttgtgcctcagtttcccaag

SEQ ID NO: 309835 - DNA, 20 bp, Artificial Sequence
  chemically synthesized
gcctcagtttcccaagtagc

SEQ ID NO: 309836 - DNA, 20 bp, Artificial Sequence
  chemically synthesized
acctgtaatcccagctactt

SEQ ID NO: 309837 - DNA, 20 bp, Artificial Sequence
  chemically synthesized
cctcagtttcccaagtagct

SEQ ID NO: 309838 - DNA, 20 bp, Artificial Sequence
  chemically synthesized
cacctgtaatcccagctact

SEQ ID NO: 309839 - DNA, 20 bp, Artificial Sequence
  chemically synthesized
ttcccaagtagctgggatta

SEQ ID NO: 309840 - DNA, 20 bp, Artificial Sequence
  chemically synthesized
tcccaagtagctgggattac

SEQ ID NO: 309841 - DNA, 20 bp, Artificial Sequence
  chemically synthesized
gtgtctcacacctgtaatcc

SEQ ID NO: 309842 - DNA, 20 bp, Artificial Sequence
  chemically synthesized
gtagctgggattacaggtgt

SEQ ID NO: 309843 - DNA, 20 bp, Artificial Sequence
  chemically synthesized
caggtgtgagacaccacacc

SEQ ID NO: 309844 - DNA, 20 bp, Artificial Sequence
  chemically synthesized
atacaaaaaagagccaggtg

SEQ ID NO: 309845 - DNA, 20 bp, Artificial Sequence
  chemically synthesized
ctaaaatacaaaaaagagcc

SEQ ID NO: 309846 - DNA, 20 bp, Artificial Sequence
  chemically synthesized
actaaaatacaaaaaagagc

SEQ ID NO: 309847 - DNA, 20 bp, Artificial Sequence
  chemically synthesized
ctctactaaaatacaaaaaa

SEQ ID NO: 309848 - DNA, 20 bp, Artificial Sequence
  chemically synthesized
atctctactaaaatacaaaa

SEQ ID NO: 309849 - DNA, 20 bp, Artificial Sequence
  chemically synthesized
cctggctcttttttgtattt

SEQ ID NO: 309850 - DNA, 20 bp, Artificial Sequence
  chemically synthesized
ggctcttttttgtattttag

SEQ ID NO: 309851 - DNA, 20 bp, Artificial Sequence
  chemically synthesized
ctcttttttgtattttagta

SEQ ID NO: 309852 - DNA, 20 bp, Artificial Sequence
  chemically synthesized
tttttgtattttagtagaga

SEQ ID NO: 309853 - DNA, 20 bp, Artificial Sequence
  chemically synthesized
ttttgtattttagtagagat

SEQ ID NO: 309854 - DNA, 20 bp, Artificial Sequence
  chemically synthesized
tttgtattttagtagagatg

SEQ ID NO: 309855 - DNA, 20 bp, Artificial Sequence
  chemically synthesized
gagatggggtttcaccatgt

SEQ ID NO: 309856 - DNA, 20 bp, Artificial Sequence
  chemically synthesized
tggggtttcaccatgttggc

SEQ ID NO: 309857 - DNA, 20 bp, Artificial Sequence
  chemically synthesized
tgagatgagaccagccaaca

SEQ ID NO: 309858 - DNA, 20 bp, Artificial Sequence
  chemically synthesized
tcaggagtttgagatgagac

SEQ ID NO: 309859 - DNA, 20 bp, Artificial Sequence
  chemically synthesized
tgaggtcaggagtttgagat

SEQ ID NO: 309860 - DNA, 20 bp, Artificial Sequence
  chemically synthesized
tcacttgaggtcaggagttt

SEQ ID NO: 309861 - DNA, 20 bp, Artificial Sequence
  chemically synthesized
ggcagatcacttgaggtcag

SEQ ID NO: 309862 - DNA, 20 bp, Artificial Sequence
  chemically synthesized
catctcaaactcctgacctc

SEQ ID NO: 309863 - DNA, 20 bp, Artificial Sequence
  chemically synthesized
cgggcagatcacttgaggtc

SEQ ID NO: 309864 - DNA, 20 bp, Artificial Sequence
  chemically synthesized
gcgggcagatcacttgaggt

SEQ ID NO: 309865 - DNA, 20 bp, Artificial Sequence
  chemically synthesized
cgaggcgggcagatcacttg

SEQ ID NO: 309866 - DNA, 20 bp, Artificial Sequence
  chemically synthesized
ccgaggcgggcagatcactt

SEQ ID NO: 309867 - DNA, 20 bp, Artificial Sequence
  chemically synthesized
ctcaagtgatctgcccgcct

SEQ ID NO: 309868 - DNA, 20 bp, Artificial Sequence
  chemically synthesized
ctttgcgaggccgaggcggg

SEQ ID NO: 309869 - DNA, 20 bp, Artificial Sequence
  chemically synthesized
gcactttgcgaggccgaggc

SEQ ID NO: 309870 - DNA, 20 bp, Artificial Sequence
  chemically synthesized
agcactttgcgaggccgagg

SEQ ID NO: 309871 - DNA, 20 bp, Artificial Sequence
  chemically synthesized
cccagcactttgcgaggccg

SEQ ID NO: 309872 - DNA, 20 bp, Artificial Sequence
  chemically synthesized
tcccagcactttgcgaggcc

SEQ ID NO: 309873 - DNA, 20 bp, Artificial Sequence
  chemically synthesized
ctgcccgcctcggcctcgca

SEQ ID NO: 309874 - DNA, 20 bp, Artificial Sequence
  chemically synthesized
tgcaatcccagcactttgcg

SEQ ID NO: 309875 - DNA, 20 bp, Artificial Sequence
  chemically synthesized
ctgcaatcccagcactttgc

SEQ ID NO: 309876 - DNA, 20 bp, Artificial Sequence
  chemically synthesized
gcctcggcctcgcaaagtgc

SEQ ID NO: 309877 - DNA, 20 bp, Artificial Sequence
  chemically synthesized
cctcggcctcgcaaagtgct

SEQ ID NO: 309878 - DNA, 20 bp, Artificial Sequence
  chemically synthesized
ctcgcaaagtgctgggattg

SEQ ID NO: 309879 - DNA, 20 bp, Artificial Sequence
  chemically synthesized
tcgcaaagtgctgggattgc

SEQ ID NO: 309880 - DNA, 20 bp, Artificial Sequence
  chemically synthesized
gtggctcacgcctgcaatcc

SEQ ID NO: 309881 - DNA, 20 bp, Artificial Sequence
  chemically synthesized
agtgctgggattgcaggcgt

SEQ ID NO: 309882 - DNA, 20 bp, Artificial Sequence
  chemically synthesized
gattgcaggcgtgagccact

SEQ ID NO: 309883 - DNA, 20 bp, Artificial Sequence
  chemically synthesized
caggcgtgagccactgagca

SEQ ID NO: 309884 - DNA, 20 bp, Artificial Sequence
  chemically synthesized
cttttggagcccgtgctcag

SEQ ID NO: 309885 - DNA, 20 bp, Artificial Sequence
  chemically synthesized
aggcgtgagccactgagcac

SEQ ID NO: 309886 - DNA, 20 bp, Artificial Sequence
  chemically synthesized
taccttttggagcccgtgct

SEQ ID NO: 309887 - DNA, 20 bp, Artificial Sequence
  chemically synthesized
ccactgagcacgggctccaa

SEQ ID NO: 309888 - DNA, 20 bp, Artificial Sequence
  chemically synthesized
cactgagcacgggctccaaa

SEQ ID NO: 309889 - DNA, 20 bp, Artificial Sequence
  chemically synthesized
ttcaaataagataccttttg

SEQ ID NO: 309890 - DNA, 20 bp, Artificial Sequence
  chemically synthesized
ctttcaaataagataccttt

SEQ ID NO: 309891 - DNA, 20 bp, Artificial Sequence
  chemically synthesized
ccaaaaggtatcttatttga

SEQ ID NO: 309892 - DNA, 20 bp, Artificial Sequence
  chemically synthesized
ctatgcacttgctttcaaat

SEQ ID NO: 309893 - DNA, 20 bp, Artificial Sequence
  chemically synthesized
aaggtatcttatttgaaagc

SEQ ID NO: 309894 - DNA, 20 bp, Artificial Sequence
  chemically synthesized
cttatttgaaagcaagtgca

SEQ ID NO: 309895 - DNA, 20 bp, Artificial Sequence
  chemically synthesized
atttgaaagcaagtgcatag

SEQ ID NO: 309896 - DNA, 20 bp, Artificial Sequence
  chemically synthesized
gagttggcatgagacataga

SEQ ID NO: 309897 - DNA, 20 bp, Artificial Sequence
  chemically synthesized
agagttggcatgagacatag

SEQ ID NO: 309898 - DNA, 20 bp, Artificial Sequence
  chemically synthesized
aagagttggcatgagacata

SEQ ID NO: 309899 - DNA, 20 bp, Artificial Sequence
  chemically synthesized
tcaagagttggcatgagaca

SEQ ID NO: 309900 - DNA, 20 bp, Artificial Sequence
  chemically synthesized
gtgatgtcaagagttggcat

SEQ ID NO: 309901 - DNA, 20 bp, Artificial Sequence
  chemically synthesized
aaagttgtgatgtcaagagt

SEQ ID NO: 309902 - DNA, 20 bp, Artificial Sequence
  chemically synthesized
atgaaaagttgtgatgtcaa

SEQ ID NO: 309903 - DNA, 20 bp, Artificial Sequence
  chemically synthesized
ggatgaaaagttgtgatgtc

SEQ ID NO: 309904 - DNA, 20 bp, Artificial Sequence
  chemically synthesized
tgtgatttcttgtggatgaa

SEQ ID NO: 309905 - DNA, 20 bp, Artificial Sequence
  chemically synthesized
catcacaacttttcatccac

SEQ ID NO: 309906 - DNA, 20 bp, Artificial Sequence
  chemically synthesized
ttagaatttgtgatttcttg

SEQ ID NO: 309907 - DNA, 20 bp, Artificial Sequence
  chemically synthesized
attttattaggtatgtacgt

SEQ ID NO: 309908 - DNA, 20 bp, Artificial Sequence
  chemically synthesized
attatcttatgcattttatt

SEQ ID NO: 309909 - DNA, 20 bp, Artificial Sequence
  chemically synthesized
cattatcttatgcattttat

SEQ ID NO: 309910 - DNA, 20 bp, Artificial Sequence
  chemically synthesized
acatacctaataaaatgcat

SEQ ID NO: 309911 - DNA, 20 bp, Artificial Sequence
  chemically synthesized
ataaaatgcataagataatg

SEQ ID NO: 309912 - DNA, 20 bp, Artificial Sequence
  chemically synthesized
taaaatgcataagataatgt

SEQ ID NO: 309913 - DNA, 20 bp, Artificial Sequence
  chemically synthesized
ataagataatgtaggtgtaa

SEQ ID NO: 309914 - DNA, 20 bp, Artificial Sequence
  chemically synthesized
ataatgtaggtgtaacagaa

SEQ ID NO: 309915 - DNA, 20 bp, Artificial Sequence
  chemically synthesized
taatgtaggtgtaacagaat

SEQ ID NO: 309916 - DNA, 20 bp, Artificial Sequence
  chemically synthesized
tgtaggtgtaacagaatagg

SEQ ID NO: 309917 - DNA, 20 bp, Artificial Sequence
  chemically synthesized
tgtaacagaataggtagtaa

SEQ ID NO: 309918 - DNA, 20 bp, Artificial Sequence
  chemically synthesized
gtaacagaataggtagtaat

SEQ ID NO: 309919 - DNA, 20 bp, Artificial Sequence
  chemically synthesized
taacagaataggtagtaatg

SEQ ID NO: 309920 - DNA, 20 bp, Artificial Sequence
  chemically synthesized
ataggtagtaatggggactg

SEQ ID NO: 309921 - DNA, 20 bp, Artificial Sequence
  chemically synthesized
acaggctcttcatttagcca

SEQ ID NO: 309922 - DNA, 20 bp, Artificial Sequence
  chemically synthesized
atggggactgtggctaaatg

SEQ ID NO: 309923 - DNA, 20 bp, Artificial Sequence
  chemically synthesized
ggggactgtggctaaatgaa

SEQ ID NO: 309924 - DNA, 20 bp, Artificial Sequence
  chemically synthesized
tctagcacaggctcttcatt

SEQ ID NO: 309925 - DNA, 20 bp, Artificial Sequence
  chemically synthesized
gctaaatgaagagcctgtgc

SEQ ID NO: 309926 - DNA, 20 bp, Artificial Sequence
  chemically synthesized
taaatgaagagcctgtgcta

SEQ ID NO: 309927 - DNA, 20 bp, Artificial Sequence
  chemically synthesized
tgccctgttttctctagcac

SEQ ID NO: 309928 - DNA, 20 bp, Artificial Sequence
  chemically synthesized
ttgccctgttttctctagca

SEQ ID NO: 309929 - DNA, 20 bp, Artificial Sequence
  chemically synthesized
agagcctgtgctagagaaaa

SEQ ID NO: 309930 - DNA, 20 bp, Artificial Sequence
  chemically synthesized
tcaagttgccctgttttctc

SEQ ID NO: 309931 - DNA, 20 bp, Artificial Sequence
  chemically synthesized
gagcctgtgctagagaaaac

SEQ ID NO: 309932 - DNA, 20 bp, Artificial Sequence
  chemically synthesized
agcctgtgctagagaaaaca

SEQ ID NO: 309933 - DNA, 20 bp, Artificial Sequence
  chemically synthesized
tagtaaccagagcaggagtc

SEQ ID NO: 309934 - DNA, 20 bp, Artificial Sequence
  chemically synthesized
gggcaacttgactcctgctc

SEQ ID NO: 309935 - DNA, 20 bp, Artificial Sequence
  chemically synthesized
ctacatagtaaccagagcag

SEQ ID NO: 309936 - DNA, 20 bp, Artificial Sequence
  chemically synthesized
ttctacatagtaaccagagc

SEQ ID NO: 309937 - DNA, 20 bp, Artificial Sequence
  chemically synthesized
tttctacatagtaaccagag

SEQ ID NO: 309938 - DNA, 20 bp, Artificial Sequence
  chemically synthesized
gtttttctacatagtaacca

SEQ ID NO: 309939 - DNA, 20 bp, Artificial Sequence
  chemically synthesized
ctgtttttctacatagtaac

SEQ ID NO: 309940 - DNA, 20 bp, Artificial Sequence
  chemically synthesized
ctcctgctctggttactatg

SEQ ID NO: 309941 - DNA, 20 bp, Artificial Sequence
  chemically synthesized
ccttagtctgtttttctaca

SEQ ID NO: 309942 - DNA, 20 bp, Artificial Sequence
  chemically synthesized
ctggttactatgtagaaaaa

SEQ ID NO: 309943 - DNA, 20 bp, Artificial Sequence
  chemically synthesized
actatgtagaaaaacagact

SEQ ID NO: 309944 - DNA, 20 bp, Artificial Sequence
  chemically synthesized
ctatgtagaaaaacagacta

SEQ ID NO: 309945 - DNA, 20 bp, Artificial Sequence
  chemically synthesized
gcaaatgatctgatgatcct

SEQ ID NO: 309946 - DNA, 20 bp, Artificial Sequence
  chemically synthesized
aaaaacagactaaggatcat

SEQ ID NO: 309947 - DNA, 20 bp, Artificial Sequence
  chemically synthesized
atcagatcatttgctttctc

SEQ ID NO: 309948 - DNA, 20 bp, Artificial Sequence
  chemically synthesized
cagatcatttgctttctcta

SEQ ID NO: 309949 - DNA, 20 bp, Artificial Sequence
  chemically synthesized
atttctaacctctctagaga

SEQ ID NO: 309950 - DNA, 20 bp, Artificial Sequence
  chemically synthesized
gatcatttgctttctctaga

SEQ ID NO: 309951 - DNA, 20 bp, Artificial Sequence
  chemically synthesized
atcatttgctttctctagag

SEQ ID NO: 309952 - DNA, 20 bp, Artificial Sequence
  chemically synthesized
aagaatttctaacctctcta

SEQ ID NO: 309953 - DNA, 20 bp, Artificial Sequence
  chemically synthesized
tttgctttctctagagaggt

SEQ ID NO: 309954 - DNA, 20 bp, Artificial Sequence
  chemically synthesized
ctaagaatttctaacctctc

SEQ ID NO: 309955 - DNA, 20 bp, Artificial Sequence
  chemically synthesized
ctagagaggttagaaattct

SEQ ID NO: 309956 - DNA, 20 bp, Artificial Sequence
  chemically synthesized
aaaaaaatgtgacatgaact

SEQ ID NO: 309957 - DNA, 20 bp, Artificial Sequence
  chemically synthesized
tttttttcaatttcaaacaa

SEQ ID NO: 309958 - DNA, 20 bp, Artificial Sequence
  chemically synthesized
ttttcaatttcaaacaatgg

SEQ ID NO: 309959 - DNA, 20 bp, Artificial Sequence
  chemically synthesized
ggtatttaatagtagtttat

SEQ ID NO: 309960 - DNA, 20 bp, Artificial Sequence
  chemically synthesized
gtccctatggtatttaatag

SEQ ID NO: 309961 - DNA, 20 bp, Artificial Sequence
  chemically synthesized
ttagtccctatggtatttaa

SEQ ID NO: 309962 - DNA, 20 bp, Artificial Sequence
  chemically synthesized
taaactactattaaatacca

SEQ ID NO: 309963 - DNA, 20 bp, Artificial Sequence
  chemically synthesized
aaactactattaaataccat

SEQ ID NO: 309964 - DNA, 20 bp, Artificial Sequence
  chemically synthesized
aactactattaaataccata

SEQ ID NO: 309965 - DNA, 20 bp, Artificial Sequence
  chemically synthesized
aaagttctatttagtcccta

SEQ ID NO: 309966 - DNA, 20 bp, Artificial Sequence
  chemically synthesized
taaataccatagggactaaa

SEQ ID NO: 309967 - DNA, 20 bp, Artificial Sequence
  chemically synthesized
tatttagataaagttctatt

SEQ ID NO: 309968 - DNA, 20 bp, Artificial Sequence
  chemically synthesized
attacagatgtatttagata

SEQ ID NO: 309969 - DNA, 20 bp, Artificial Sequence
  chemically synthesized
tctaaaattacagatgtatt

SEQ ID NO: 309970 - DNA, 20 bp, Artificial Sequence
  chemically synthesized
tctaaatacatctgtaattt

SEQ ID NO: 309971 - DNA, 20 bp, Artificial Sequence
  chemically synthesized
gtctattgcatctaaaatta

SEQ ID NO: 309972 - DNA, 20 bp, Artificial Sequence
  chemically synthesized
atctgtaattttagatgcaa

SEQ ID NO: 309973 - DNA, 20 bp, Artificial Sequence
  chemically synthesized
agatgcaatagaccaattcc

SEQ ID NO: 309974 - DNA, 20 bp, Artificial Sequence
  chemically synthesized
atttgtgtctttctaggaat

SEQ ID NO: 309975 - DNA, 20 bp, Artificial Sequence
  chemically synthesized
gcaatagaccaattcctaga

SEQ ID NO: 309976 - DNA, 20 bp, Artificial Sequence
  chemically synthesized
cgaatcatttgtgtctttct

SEQ ID NO: 309977 - DNA, 20 bp, Artificial Sequence
  chemically synthesized
tcgaatcatttgtgtctttc

SEQ ID NO: 309978 - DNA, 20 bp, Artificial Sequence
  chemically synthesized
tagaaagacacaaatgattc

SEQ ID NO: 309979 - DNA, 20 bp, Artificial Sequence
  chemically synthesized
cagattttccgttttggagt

SEQ ID NO: 309980 - DNA, 20 bp, Artificial Sequence
  chemically synthesized
gattcgagctgactccaaaa

SEQ ID NO: 309981 - DNA, 20 bp, Artificial Sequence
  chemically synthesized
tttccagattttccgttttg

SEQ ID NO: 309982 - DNA, 20 bp, Artificial Sequence
  chemically synthesized
tttttccagattttccgttt

SEQ ID NO: 309983 - DNA, 20 bp, Artificial Sequence
  chemically synthesized
tgactccaaaacggaaaatc

SEQ ID NO: 309984 - DNA, 20 bp, Artificial Sequence
  chemically synthesized
atttcaacattacatttttc

SEQ ID NO: 309985 - DNA, 20 bp, Artificial Sequence
  chemically synthesized
taaaaatgtccatttttaat

SEQ ID NO: 309986 - DNA, 20 bp, Artificial Sequence
  chemically synthesized
gttgaaattccaattaaaaa

SEQ ID NO: 309987 - DNA, 20 bp, Artificial Sequence
  chemically synthesized
cataactggaatttgcaaat

SEQ ID NO: 309988 - DNA, 20 bp, Artificial Sequence
  chemically synthesized
tcataactggaatttgcaaa

SEQ ID NO: 309989 - DNA, 20 bp, Artificial Sequence
  chemically synthesized
aatttcccatttgcaaattc

SEQ ID NO: 309990 - DNA, 20 bp, Artificial Sequence
  chemically synthesized
atttgcaaattccagttatg

SEQ ID NO: 309991 - DNA, 20 bp, Artificial Sequence
  chemically synthesized
ttggtaactggcttcataac

SEQ ID NO: 309992 - DNA, 20 bp, Artificial Sequence
  chemically synthesized
gcaaattccagttatgaagc

SEQ ID NO: 309993 - DNA, 20 bp, Artificial Sequence
  chemically synthesized
cagttatgaagccagttacc

SEQ ID NO: 309994 - DNA, 20 bp, Artificial Sequence
  chemically synthesized
gattatgcaggcttggtaac

SEQ ID NO: 309995 - DNA, 20 bp, Artificial Sequence
  chemically synthesized
agtacctgattatgcaggct

SEQ ID NO: 309996 - DNA, 20 bp, Artificial Sequence
  chemically synthesized
agttaccaagcctgcataat

SEQ ID NO: 309997 - DNA, 20 bp, Artificial Sequence
  chemically synthesized
gtttaagtacctgattatgc

SEQ ID NO: 309998 - DNA, 20 bp, Artificial Sequence
  chemically synthesized
gttaccaagcctgcataatc

SEQ ID NO: 309999 - DNA, 20 bp, Artificial Sequence
  chemically synthesized
ggtttaagtacctgattatg

SEQ ID NO: 310000 - DNA, 20 bp, Artificial Sequence
  chemically synthesized
cataatcaggtacttaaacc

SEQ ID NO: 310001 - DNA, 20 bp, Artificial Sequence
  chemically synthesized
gtaatatgcttgctaggttt

SEQ ID NO: 310002 - DNA, 20 bp, Artificial Sequence
  chemically synthesized
atcaggtacttaaacctagc

SEQ ID NO: 310003 - DNA, 20 bp, Artificial Sequence
  chemically synthesized
tttcttgtaatatgcttgct

SEQ ID NO: 310004 - DNA, 20 bp, Artificial Sequence
  chemically synthesized
ctttcttgtaatatgcttgc

SEQ ID NO: 310005 - DNA, 20 bp, Artificial Sequence
  chemically synthesized
aaacctagcaagcatattac

SEQ ID NO: 310006 - DNA, 20 bp, Artificial Sequence
  chemically synthesized
ctagcaagcatattacaaga

SEQ ID NO: 310007 - DNA, 20 bp, Artificial Sequence
  chemically synthesized
tagcaagcatattacaagaa

SEQ ID NO: 310008 - DNA, 20 bp, Artificial Sequence
  chemically synthesized
attacaagaaaggaaaataa

SEQ ID NO: 310009 - DNA, 20 bp, Artificial Sequence
  chemically synthesized
ttacaagaaaggaaaataac

SEQ ID NO: 310010 - DNA, 20 bp, Artificial Sequence
  chemically synthesized
tttacgtccatgaaagtgat

SEQ ID NO: 310011 - DNA, 20 bp, Artificial Sequence
  chemically synthesized
taacaggccaatcactttca

SEQ ID NO: 310012 - DNA, 20 bp, Artificial Sequence
  chemically synthesized
tttttcctttacgtccatga

SEQ ID NO: 310013 - DNA, 20 bp, Artificial Sequence
  chemically synthesized
caatcactttcatggacgta

SEQ ID NO: 310014 - DNA, 20 bp, Artificial Sequence
  chemically synthesized
aatcactttcatggacgtaa

SEQ ID NO: 310015 - DNA, 20 bp, Artificial Sequence
  chemically synthesized
aaaggaaaaactatgaatca

SEQ ID NO: 310016 - DNA, 20 bp, Artificial Sequence
  chemically synthesized
gctagattttctttgattca

SEQ ID NO: 310017 - DNA, 20 bp, Artificial Sequence
  chemically synthesized
actatgaatcaaagaaaatc

SEQ ID NO: 310018 - DNA, 20 bp, Artificial Sequence
  chemically synthesized
taatcttttttgtgtattgc

SEQ ID NO: 310019 - DNA, 20 bp, Artificial Sequence
  chemically synthesized
aaatctagcaatacacaaaa

SEQ ID NO: 310020 - DNA, 20 bp, Artificial Sequence
  chemically synthesized
aaaagattatacgtcttatc

SEQ ID NO: 310021 - DNA, 20 bp, Artificial Sequence
  chemically synthesized
aaagattatacgtcttatcc

SEQ ID NO: 310022 - DNA, 20 bp, Artificial Sequence
  chemically synthesized
gtaataaactaaacctggat

SEQ ID NO: 310023 - DNA, 20 bp, Artificial Sequence
  chemically synthesized
ttatacgtcttatccaggtt

SEQ ID NO: 310024 - DNA, 20 bp, Artificial Sequence
  chemically synthesized
ttcctgtaataaactaaacc

SEQ ID NO: 310025 - DNA, 20 bp, Artificial Sequence
  chemically synthesized
tatccaggtttagtttatta

SEQ ID NO: 310026 - DNA, 20 bp, Artificial Sequence
  chemically synthesized
atccaggtttagtttattac

SEQ ID NO: 310027 - DNA, 20 bp, Artificial Sequence
  chemically synthesized
caggtttagtttattacagg

SEQ ID NO: 310028 - DNA, 20 bp, Artificial Sequence
  chemically synthesized
tttagtttattacaggaaga

SEQ ID NO: 310029 - DNA, 20 bp, Artificial Sequence
  chemically synthesized
ttagtttattacaggaagaa

SEQ ID NO: 310030 - DNA, 20 bp, Artificial Sequence
  chemically synthesized
tacaggaagaaaggcttttt

SEQ ID NO: 310031 - DNA, 20 bp, Artificial Sequence
  chemically synthesized
ttagttttctaatgctaaaa

SEQ ID NO: 310032 - DNA, 20 bp, Artificial Sequence
  chemically synthesized
aagaaaggcttttttagcat

SEQ ID NO: 310033 - DNA, 20 bp, Artificial Sequence
  chemically synthesized
ttttttagcattagaaaact

SEQ ID NO: 310034 - DNA, 20 bp, Artificial Sequence
  chemically synthesized
atatgtcaaatcacatgact

SEQ ID NO: 310035 - DNA, 20 bp, Artificial Sequence
  chemically synthesized
aagtcatgtgatttgacata

SEQ ID NO: 310036 - DNA, 20 bp, Artificial Sequence
  chemically synthesized
tcatgtgatttgacatatag

SEQ ID NO: 310037 - DNA, 20 bp, Artificial Sequence
  chemically synthesized
atttgacatatagcagaata

SEQ ID NO: 310038 - DNA, 20 bp, Artificial Sequence
  chemically synthesized
tgacatatagcagaataaag

SEQ ID NO: 310039 - DNA, 20 bp, Artificial Sequence
  chemically synthesized
ttttccagaatcatttgaga

SEQ ID NO: 310040 - DNA, 20 bp, Artificial Sequence
  chemically synthesized
atatttttccagaatcattt

SEQ ID NO: 310041 - DNA, 20 bp, Artificial Sequence
  chemically synthesized
acgaccatctcaaatgattc

SEQ ID NO: 310042 - DNA, 20 bp, Artificial Sequence
  chemically synthesized
aattttatcatatatttttc

SEQ ID NO: 310043 - DNA, 20 bp, Artificial Sequence
  chemically synthesized
gaaaaatatatgataaaatt

SEQ ID NO: 310044 - DNA, 20 bp, Artificial Sequence
  chemically synthesized
atatgataaaatttggcatc

SEQ ID NO: 310045 - DNA, 20 bp, Artificial Sequence
  chemically synthesized
tgataaaatttggcatccgg

SEQ ID NO: 310046 - DNA, 20 bp, Artificial Sequence
  chemically synthesized
ctaagaggttttatcactac

SEQ ID NO: 310047 - DNA, 20 bp, Artificial Sequence
  chemically synthesized
ccggtagtgataaaacctct

SEQ ID NO: 310048 - DNA, 20 bp, Artificial Sequence
  chemically synthesized
tctgttcttaatattctaag

SEQ ID NO: 310049 - DNA, 20 bp, Artificial Sequence
  chemically synthesized
ttctgttcttaatattctaa

SEQ ID NO: 310050 - DNA, 20 bp, Artificial Sequence
  chemically synthesized
ccttctgttcttaatattct

SEQ ID NO: 310051 - DNA, 20 bp, Artificial Sequence
  chemically synthesized
ataaaacctcttagaatatt

SEQ ID NO: 310052 - DNA, 20 bp, Artificial Sequence
  chemically synthesized
acctcttagaatattaagaa

SEQ ID NO: 310053 - DNA, 20 bp, Artificial Sequence
  chemically synthesized
tcttagaatattaagaacag

SEQ ID NO: 310054 - DNA, 20 bp, Artificial Sequence
  chemically synthesized
cttagaatattaagaacaga

SEQ ID NO: 310055 - DNA, 20 bp, Artificial Sequence
  chemically synthesized
tctttcctgtaggtttgttg

SEQ ID NO: 310056 - DNA, 20 bp, Artificial Sequence
  chemically synthesized
aggtatctacaacaaaccta

SEQ ID NO: 310057 - DNA, 20 bp, Artificial Sequence
  chemically synthesized
ggtatctacaacaaacctac

SEQ ID NO: 310058 - DNA, 20 bp, Artificial Sequence
  chemically synthesized
tctacaacaaacctacagga

SEQ ID NO: 310059 - DNA, 20 bp, Artificial Sequence
  chemically synthesized
ttaagtatgatctttcctgt

SEQ ID NO: 310060 - DNA, 20 bp, Artificial Sequence
  chemically synthesized
attaagtatgatctttcctg

SEQ ID NO: 310061 - DNA, 20 bp, Artificial Sequence
  chemically synthesized
aactttaataaataatcatt

SEQ ID NO: 310062 - DNA, 20 bp, Artificial Sequence
  chemically synthesized
tacttaatgattatttatta

SEQ ID NO: 310063 - DNA, 20 bp, Artificial Sequence
  chemically synthesized
ttattaaagttcttccctct

SEQ ID NO: 310064 - DNA, 20 bp, Artificial Sequence
  chemically synthesized
tcattttaagtctcagaggg

SEQ ID NO: 310065 - DNA, 20 bp, Artificial Sequence
  chemically synthesized
ttctcattttaagtctcaga

SEQ ID NO: 310066 - DNA, 20 bp, Artificial Sequence
  chemically synthesized
tttctcattttaagtctcag

SEQ ID NO: 310067 - DNA, 20 bp, Artificial Sequence
  chemically synthesized
atttctcattttaagtctca

SEQ ID NO: 310068 - DNA, 20 bp, Artificial Sequence
  chemically synthesized
ttatttctcattttaagtct

SEQ ID NO: 310069 - DNA, 20 bp, Artificial Sequence
  chemically synthesized
ttccctctgagacttaaaat

SEQ ID NO: 310070 - DNA, 20 bp, Artificial Sequence
  chemically synthesized
ggatatttatttctcatttt

SEQ ID NO: 310071 - DNA, 20 bp, Artificial Sequence
  chemically synthesized
ctagtacaatgggagtattg

SEQ ID NO: 310072 - DNA, 20 bp, Artificial Sequence
  chemically synthesized
taaatactctagtacaatgg

SEQ ID NO: 310073 - DNA, 20 bp, Artificial Sequence
  chemically synthesized
ccacaatactcccattgtac

SEQ ID NO: 310074 - DNA, 20 bp, Artificial Sequence
  chemically synthesized
tataaatactctagtacaat

SEQ ID NO: 310075 - DNA, 20 bp, Artificial Sequence
  chemically synthesized
gtataaatactctagtacaa

SEQ ID NO: 310076 - DNA, 20 bp, Artificial Sequence
  chemically synthesized
acaatactcccattgtacta

SEQ ID NO: 310077 - DNA, 20 bp, Artificial Sequence
  chemically synthesized
attgtactgtataaatactc

SEQ ID NO: 310078 - DNA, 20 bp, Artificial Sequence
  chemically synthesized
attgtactagagtatttata

SEQ ID NO: 310079 - DNA, 20 bp, Artificial Sequence
  chemically synthesized
atttatacagtacaatatgt

SEQ ID NO: 310080 - DNA, 20 bp, Artificial Sequence
  chemically synthesized
tttatacagtacaatatgtc

SEQ ID NO: 310081 - DNA, 20 bp, Artificial Sequence
  chemically synthesized
ttatacagtacaatatgtca

SEQ ID NO: 310082 - DNA, 20 bp, Artificial Sequence
  chemically synthesized
ttaatgacatgaaaaataat

SEQ ID NO: 310083 - DNA, 20 bp, Artificial Sequence
  chemically synthesized
tgacatgaaaaataattgga

SEQ ID NO: 310084 - DNA, 20 bp, Artificial Sequence
  chemically synthesized
gacatgaaaaataattggaa

SEQ ID NO: 310085 - DNA, 20 bp, Artificial Sequence
  chemically synthesized
acatgaaaaataattggaaa

SEQ ID NO: 310086 - DNA, 20 bp, Artificial Sequence
  chemically synthesized
atgaaaaataattggaaagg

SEQ ID NO: 310087 - DNA, 20 bp, Artificial Sequence
  chemically synthesized
aaaataattggaaagggaga

SEQ ID NO: 310088 - DNA, 20 bp, Artificial Sequence
  chemically synthesized
aggttgtttttgagtaatga

SEQ ID NO: 310089 - DNA, 20 bp, Artificial Sequence
  chemically synthesized
tacatatataggttgttttt

SEQ ID NO: 310090 - DNA, 20 bp, Artificial Sequence
  chemically synthesized
ttattcagatgtacatatat

SEQ ID NO: 310091 - DNA, 20 bp, Artificial Sequence
  chemically synthesized
attattcagatgtacatata

SEQ ID NO: 310092 - DNA, 20 bp, Artificial Sequence
  chemically synthesized
acattatctgtagtattatt

SEQ ID NO: 310093 - DNA, 20 bp, Artificial Sequence
  chemically synthesized
tgtacatctgaataatacta

SEQ ID NO: 310094 - DNA, 20 bp, Artificial Sequence
  chemically synthesized
taatttgaatacattatctg

SEQ ID NO: 310095 - DNA, 20 bp, Artificial Sequence
  chemically synthesized
gataatgtattcaaattatt

SEQ ID NO: 310096 - DNA, 20 bp, Artificial Sequence
  chemically synthesized
ttcaaattattaagtaaatg

SEQ ID NO: 310097 - DNA, 20 bp, Artificial Sequence
  chemically synthesized
attattaagtaaatgtagca

SEQ ID NO: 310098 - DNA, 20 bp, Artificial Sequence
  chemically synthesized
agtaaatgtagcatggtacc

SEQ ID NO: 310099 - DNA, 20 bp, Artificial Sequence
  chemically synthesized
gtagcatggtacctggatac

SEQ ID NO: 310100 - DNA, 20 bp, Artificial Sequence
  chemically synthesized
tttttcttggtcttgtatcc

SEQ ID NO: 310101 - DNA, 20 bp, Artificial Sequence
  chemically synthesized
ttttttcttggtcttgtatc

SEQ ID NO: 310102 - DNA, 20 bp, Artificial Sequence
  chemically synthesized
tggtacctggatacaagacc

SEQ ID NO: 310103 - DNA, 20 bp, Artificial Sequence
  chemically synthesized
atacagttgattttttttct

SEQ ID NO: 310104 - DNA, 20 bp, Artificial Sequence
  chemically synthesized
tgtgctgatataaagaaata

SEQ ID NO: 310105 - DNA, 20 bp, Artificial Sequence
  chemically synthesized
tcaactgtatttctttatat

SEQ ID NO: 310106 - DNA, 20 bp, Artificial Sequence
  chemically synthesized
tttctatttgtgctgatata

SEQ ID NO: 310107 - DNA, 20 bp, Artificial Sequence
  chemically synthesized
tttctttatatcagcacaaa

SEQ ID NO: 310108 - DNA, 20 bp, Artificial Sequence
  chemically synthesized
tttcaaaaatatattcataa

SEQ ID NO: 310109 - DNA, 20 bp, Artificial Sequence
  chemically synthesized
cagcaaaaatataaaaaccc

SEQ ID NO: 310110 - DNA, 20 bp, Artificial Sequence
  chemically synthesized
ttctctgagatttatttctt

SEQ ID NO: 310111 - DNA, 20 bp, Artificial Sequence
  chemically synthesized
tttctctgagatttatttct

SEQ ID NO: 310112 - DNA, 20 bp, Artificial Sequence
  chemically synthesized
aaaacccaagaaataaatct

SEQ ID NO: 310113 - DNA, 20 bp, Artificial Sequence
  chemically synthesized
aacccaagaaataaatctca

SEQ ID NO: 310114 - DNA, 20 bp, Artificial Sequence
  chemically synthesized
caagaaataaatctcagaga

SEQ ID NO: 310115 - DNA, 20 bp, Artificial Sequence
  chemically synthesized
aaggctcttaaactttctct

SEQ ID NO: 310116 - DNA, 20 bp, Artificial Sequence
  chemically synthesized
ataaatctcagagaaagttt

SEQ ID NO: 310117 - DNA, 20 bp, Artificial Sequence
  chemically synthesized
aaatctcagagaaagtttaa

SEQ ID NO: 310118 - DNA, 20 bp, Artificial Sequence
  chemically synthesized
ttttatagtttttaaagtaa

SEQ ID NO: 310119 - DNA, 20 bp, Artificial Sequence
  chemically synthesized
gttttatagtttttaaagta

SEQ ID NO: 310120 - DNA, 20 bp, Artificial Sequence
  chemically synthesized
ataatgttttatagttttta

SEQ ID NO: 310121 - DNA, 20 bp, Artificial Sequence
  chemically synthesized
tttctctcaataatgtttta

SEQ ID NO: 310122 - DNA, 20 bp, Artificial Sequence
  chemically synthesized
aaaaactataaaacattatt

SEQ ID NO: 310123 - DNA, 20 bp, Artificial Sequence
  chemically synthesized
aaactataaaacattattga

SEQ ID NO: 310124 - DNA, 20 bp, Artificial Sequence
  chemically synthesized
aacattattgagagaaaata

SEQ ID NO: 310125 - DNA, 20 bp, Artificial Sequence
  chemically synthesized
ttcaatcctttcatttagtt

SEQ ID NO: 310126 - DNA, 20 bp, Artificial Sequence
  chemically synthesized
tttcaatcctttcatttagt

SEQ ID NO: 310127 - DNA, 20 bp, Artificial Sequence
  chemically synthesized
ataaagacctaactaaatga

SEQ ID NO: 310128 - DNA, 20 bp, Artificial Sequence
  chemically synthesized
taaagacctaactaaatgaa

SEQ ID NO: 310129 - DNA, 20 bp, Artificial Sequence
  chemically synthesized
agtctttcaatcctttcatt

SEQ ID NO: 310130 - DNA, 20 bp, Artificial Sequence
  chemically synthesized
taactaaatgaaaggattga

SEQ ID NO: 310131 - DNA, 20 bp, Artificial Sequence
  chemically synthesized
atcaacatttttattatgta

SEQ ID NO: 310132 - DNA, 20 bp, Artificial Sequence
  chemically synthesized
taaaaatgttgattctgtac

SEQ ID NO: 310133 - DNA, 20 bp, Artificial Sequence
  chemically synthesized
attctctggatcaacttgta

SEQ ID NO: 310134 - DNA, 20 bp, Artificial Sequence
  chemically synthesized
tgattctgtacaagttgatc

SEQ ID NO: 310135 - DNA, 20 bp, Artificial Sequence
  chemically synthesized
attctgtacaagttgatcca

SEQ ID NO: 310136 - DNA, 20 bp, Artificial Sequence
  chemically synthesized
gtacaagttgatccagagaa

SEQ ID NO: 310137 - DNA, 20 bp, Artificial Sequence
  chemically synthesized
attggatttcatctattctc

SEQ ID NO: 310138 - DNA, 20 bp, Artificial Sequence
  chemically synthesized
gaatctgctgtggttttaat

SEQ ID NO: 310139 - DNA, 20 bp, Artificial Sequence
  chemically synthesized
atgaaatccaattaaaacca

SEQ ID NO: 310140 - DNA, 20 bp, Artificial Sequence
  chemically synthesized
aaatccaattaaaaccacag

SEQ ID NO: 310141 - DNA, 20 bp, Artificial Sequence
  chemically synthesized
cccccaaaaagaatctgctg

SEQ ID NO: 310142 - DNA, 20 bp, Artificial Sequence
  chemically synthesized
aaaccacagcagattctttt

SEQ ID NO: 310143 - DNA, 20 bp, Artificial Sequence
  chemically synthesized
aaccacagcagattcttttt

SEQ ID NO: 310144 - DNA, 20 bp, Artificial Sequence
  chemically synthesized
accacagcagattctttttg

SEQ ID NO: 310145 - DNA, 20 bp, Artificial Sequence
  chemically synthesized
ccacagcagattctttttgg

SEQ ID NO: 310146 - DNA, 20 bp, Artificial Sequence
  chemically synthesized
ttgtgaaccctgcccccaaa

SEQ ID NO: 310147 - DNA, 20 bp, Artificial Sequence
  chemically synthesized
cagcagattctttttggggg

SEQ ID NO: 310148 - DNA, 20 bp, Artificial Sequence
  chemically synthesized
agcagattctttttgggggc

SEQ ID NO: 310149 - DNA, 20 bp, Artificial Sequence
  chemically synthesized
gcagattctttttgggggca

SEQ ID NO: 310150 - DNA, 20 bp, Artificial Sequence
  chemically synthesized
tttttgggggcagggttcac

SEQ ID NO: 310151 - DNA, 20 bp, Artificial Sequence
  chemically synthesized
ctccatatgaattttaagaa

SEQ ID NO: 310152 - DNA, 20 bp, Artificial Sequence
  chemically synthesized
tcgatctccatatgaatttt

SEQ ID NO: 310153 - DNA, 20 bp, Artificial Sequence
  chemically synthesized
agctgttcttaaaattcata

SEQ ID NO: 310154 - DNA, 20 bp, Artificial Sequence
  chemically synthesized
ctgttcttaaaattcatatg

SEQ ID NO: 310155 - DNA, 20 bp, Artificial Sequence
  chemically synthesized
aattcatatggagatcgaaa

SEQ ID NO: 310156 - DNA, 20 bp, Artificial Sequence
  chemically synthesized
atggagatcgaaatggccaa

SEQ ID NO: 310157 - DNA, 20 bp, Artificial Sequence
  chemically synthesized
gagatcgaaatggccaaaag

SEQ ID NO: 310158 - DNA, 20 bp, Artificial Sequence
  chemically synthesized
aagattatcttgactgcttt

SEQ ID NO: 310159 - DNA, 20 bp, Artificial Sequence
  chemically synthesized
cgaaatggccaaaagcagtc

SEQ ID NO: 310160 - DNA, 20 bp, Artificial Sequence
  chemically synthesized
cagtcaagataatctttaaa

SEQ ID NO: 310161 - DNA, 20 bp, Artificial Sequence
  chemically synthesized
agtcaagataatctttaaaa

SEQ ID NO: 310162 - DNA, 20 bp, Artificial Sequence
  chemically synthesized
ttttattttcttccttttta

SEQ ID NO: 310163 - DNA, 20 bp, Artificial Sequence
  chemically synthesized
caagataatctttaaaaagg

SEQ ID NO: 310164 - DNA, 20 bp, Artificial Sequence
  chemically synthesized
taaaaaggaagaaaataaaa

SEQ ID NO: 310165 - DNA, 20 bp, Artificial Sequence
  chemically synthesized
tttggtcagttggtcagtaa

SEQ ID NO: 310166 - DNA, 20 bp, Artificial Sequence
  chemically synthesized
gtttgttttggtcagttggt

SEQ ID NO: 310167 - DNA, 20 bp, Artificial Sequence
  chemically synthesized
ttaagtttgttttggtcagt

SEQ ID NO: 310168 - DNA, 20 bp, Artificial Sequence
  chemically synthesized
cacattaagtttgttttggt

SEQ ID NO: 310169 - DNA, 20 bp, Artificial Sequence
  chemically synthesized
tagtcacattaagtttgttt

SEQ ID NO: 310170 - DNA, 20 bp, Artificial Sequence
  chemically synthesized
gtctagagtttagtcacatt

SEQ ID NO: 310171 - DNA, 20 bp, Artificial Sequence
  chemically synthesized
aacttaatgtgactaaactc

SEQ ID NO: 310172 - DNA, 20 bp, Artificial Sequence
  chemically synthesized
ataaaagcctgtctagagtt

SEQ ID NO: 310173 - DNA, 20 bp, Artificial Sequence
  chemically synthesized
taatgtgactaaactctaga

SEQ ID NO: 310174 - DNA, 20 bp, Artificial Sequence
  chemically synthesized
aatgtgactaaactctagac

SEQ ID NO: 310175 - DNA, 20 bp, Artificial Sequence
  chemically synthesized
gtcaaataaaagcctgtcta

SEQ ID NO: 310176 - DNA, 20 bp, Artificial Sequence
  chemically synthesized
tagtcaaataaaagcctgtc

SEQ ID NO: 310177 - DNA, 20 bp, Artificial Sequence
  chemically synthesized
aggagcctatagtcaaataa

SEQ ID NO: 310178 - DNA, 20 bp, Artificial Sequence
  chemically synthesized
gacaggcttttatttgacta

SEQ ID NO: 310179 - DNA, 20 bp, Artificial Sequence
  chemically synthesized
acaggcttttatttgactat

SEQ ID NO: 310180 - DNA, 20 bp, Artificial Sequence
  chemically synthesized
aaagagaggtcaggagccta

SEQ ID NO: 310181 - DNA, 20 bp, Artificial Sequence
  chemically synthesized
tctaagaaaagagaggtcag

SEQ ID NO: 310182 - DNA, 20 bp, Artificial Sequence
  chemically synthesized
gctctaagaaaagagaggtc

SEQ ID NO: 310183 - DNA, 20 bp, Artificial Sequence
  chemically synthesized
cgctctaagaaaagagaggt

SEQ ID NO: 310184 - DNA, 20 bp, Artificial Sequence
  chemically synthesized
taagcgctctaagaaaagag

SEQ ID NO: 310185 - DNA, 20 bp, Artificial Sequence
  chemically synthesized
gtaagcgctctaagaaaaga

SEQ ID NO: 310186 - DNA, 20 bp, Artificial Sequence
  chemically synthesized
gctcctgacctctcttttct

SEQ ID NO: 310187 - DNA, 20 bp, Artificial Sequence
  chemically synthesized
aagtaagcgctctaagaaaa

SEQ ID NO: 310188 - DNA, 20 bp, Artificial Sequence
  chemically synthesized
tcctgacctctcttttctta

SEQ ID NO: 310189 - DNA, 20 bp, Artificial Sequence
  chemically synthesized
taaagtaagcgctctaagaa

SEQ ID NO: 310190 - DNA, 20 bp, Artificial Sequence
  chemically synthesized
ttccctaaagtaagcgctct

SEQ ID NO: 310191 - DNA, 20 bp, Artificial Sequence
  chemically synthesized
ttttcttagagcgcttactt

SEQ ID NO: 310192 - DNA, 20 bp, Artificial Sequence
  chemically synthesized
tttcttagagcgcttacttt

SEQ ID NO: 310193 - DNA, 20 bp, Artificial Sequence
  chemically synthesized
ttcttagagcgcttacttta

SEQ ID NO: 310194 - DNA, 20 bp, Artificial Sequence
  chemically synthesized
gttgcaagtttccctaaagt

SEQ ID NO: 310195 - DNA, 20 bp, Artificial Sequence
  chemically synthesized
tttggttgcaagtttcccta

SEQ ID NO: 310196 - DNA, 20 bp, Artificial Sequence
  chemically synthesized
gagaatatgtttttggttgc

SEQ ID NO: 310197 - DNA, 20 bp, Artificial Sequence
  chemically synthesized
agaggcagagaatatgtttt

SEQ ID NO: 310198 - DNA, 20 bp, Artificial Sequence
  chemically synthesized
atttacatctcaaagaggca

SEQ ID NO: 310199 - DNA, 20 bp, Artificial Sequence
  chemically synthesized
aacatattctctgcctcttt

SEQ ID NO: 310200 - DNA, 20 bp, Artificial Sequence
  chemically synthesized
agatttacatctcaaagagg

SEQ ID NO: 310201 - DNA, 20 bp, Artificial Sequence
  chemically synthesized
agaagatttacatctcaaag

SEQ ID NO: 310202 - DNA, 20 bp, Artificial Sequence
  chemically synthesized
tagaagatttacatctcaaa

SEQ ID NO: 310203 - DNA, 20 bp, Artificial Sequence
  chemically synthesized
tgtagaagatttacatctca

SEQ ID NO: 310204 - DNA, 20 bp, Artificial Sequence
  chemically synthesized
aagatattcccggattgtag

SEQ ID NO: 310205 - DNA, 20 bp, Artificial Sequence
  chemically synthesized
gatgtaaatcttctacaatc

SEQ ID NO: 310206 - DNA, 20 bp, Artificial Sequence
  chemically synthesized
atgtaaatcttctacaatcc

SEQ ID NO: 310207 - DNA, 20 bp, Artificial Sequence
  chemically synthesized
agaaagatattcccggattg

SEQ ID NO: 310208 - DNA, 20 bp, Artificial Sequence
  chemically synthesized
gtccttgagaaagatattcc

SEQ ID NO: 310209 - DNA, 20 bp, Artificial Sequence
  chemically synthesized
aatccgggaatatctttctc

SEQ ID NO: 310210 - DNA, 20 bp, Artificial Sequence
  chemically synthesized
atccgggaatatctttctca

SEQ ID NO: 310211 - DNA, 20 bp, Artificial Sequence
  chemically synthesized
tggctcctaggtccttgaga

SEQ ID NO: 310212 - DNA, 20 bp, Artificial Sequence
  chemically synthesized
gaatatctttctcaaggacc

SEQ ID NO: 310213 - DNA, 20 bp, Artificial Sequence
  chemically synthesized
gagatggctcctaggtcctt

SEQ ID NO: 310214 - DNA, 20 bp, Artificial Sequence
  chemically synthesized
aatatctttctcaaggacct

SEQ ID NO: 310215 - DNA, 20 bp, Artificial Sequence
  chemically synthesized
tatctttctcaaggacctag

SEQ ID NO: 310216 - DNA, 20 bp, Artificial Sequence
  chemically synthesized
atttcaaagagatggctcct

SEQ ID NO: 310217 - DNA, 20 bp, Artificial Sequence
  chemically synthesized
catttcaaagagatggctcc

SEQ ID NO: 310218 - DNA, 20 bp, Artificial Sequence
  chemically synthesized
acaattacatttcaaagaga

SEQ ID NO: 310219 - DNA, 20 bp, Artificial Sequence
  chemically synthesized
attaacaattacatttcaaa

SEQ ID NO: 310220 - DNA, 20 bp, Artificial Sequence
  chemically synthesized
tcattaacaattacatttca

SEQ ID NO: 310221 - DNA, 20 bp, Artificial Sequence
  chemically synthesized
tgaaatgtaattgttaatga

SEQ ID NO: 310222 - DNA, 20 bp, Artificial Sequence
  chemically synthesized
atgatagcacgcctatctcc

SEQ ID NO: 310223 - DNA, 20 bp, Artificial Sequence
  chemically synthesized
tcccacagagactgggagat

SEQ ID NO: 310224 - DNA, 20 bp, Artificial Sequence
  chemically synthesized
gtcccacagagactgggaga

SEQ ID NO: 310225 - DNA, 20 bp, Artificial Sequence
  chemically synthesized
tactgtcccacagagactgg

SEQ ID NO: 310226 - DNA, 20 bp, Artificial Sequence
  chemically synthesized
cctactgtcccacagagact

SEQ ID NO: 310227 - DNA, 20 bp, Artificial Sequence
  chemically synthesized
cgcctatctcccagtctctg

SEQ ID NO: 310228 - DNA, 20 bp, Artificial Sequence
  chemically synthesized
tcctactgtcccacagagac

SEQ ID NO: 310229 - DNA, 20 bp, Artificial Sequence
  chemically synthesized
gcctatctcccagtctctgt

SEQ ID NO: 310230 - DNA, 20 bp, Artificial Sequence
  chemically synthesized
atctcccagtctctgtggga

SEQ ID NO: 310231 - DNA, 20 bp, Artificial Sequence
  chemically synthesized
taggctcctactgtcccaca

SEQ ID NO: 310232 - DNA, 20 bp, Artificial Sequence
  chemically synthesized
gttaggctcctactgtccca

SEQ ID NO: 310233 - DNA, 20 bp, Artificial Sequence
  chemically synthesized
tcccagtctctgtgggacag

SEQ ID NO: 310234 - DNA, 20 bp, Artificial Sequence
  chemically synthesized
cccagtctctgtgggacagt

SEQ ID NO: 310235 - DNA, 20 bp, Artificial Sequence
  chemically synthesized
cagtctctgtgggacagtag

SEQ ID NO: 310236 - DNA, 20 bp, Artificial Sequence
  chemically synthesized
aattggcacttaatgaagtt

SEQ ID NO: 310237 - DNA, 20 bp, Artificial Sequence
  chemically synthesized
taattggcacttaatgaagt

SEQ ID NO: 310238 - DNA, 20 bp, Artificial Sequence
  chemically synthesized
agtaggagcctaacttcatt

SEQ ID NO: 310239 - DNA, 20 bp, Artificial Sequence
  chemically synthesized
ttgttaattggcacttaatg

SEQ ID NO: 310240 - DNA, 20 bp, Artificial Sequence
  chemically synthesized
ggcaatctgtgattgttaat

SEQ ID NO: 310241 - DNA, 20 bp, Artificial Sequence
  chemically synthesized
taagtgccaattaacaatca

SEQ ID NO: 310242 - DNA, 20 bp, Artificial Sequence
  chemically synthesized
agggggttaggatggtgatt

SEQ ID NO: 310243 - DNA, 20 bp, Artificial Sequence
  chemically synthesized
tagggggttaggatggtgat

SEQ ID NO: 310244 - DNA, 20 bp, Artificial Sequence
  chemically synthesized
aagatattagggggttagga

SEQ ID NO: 310245 - DNA, 20 bp, Artificial Sequence
  chemically synthesized
ctggaagatattagggggtt

SEQ ID NO: 310246 - DNA, 20 bp, Artificial Sequence
  chemically synthesized
actggaagatattagggggt

SEQ ID NO: 310247 - DNA, 20 bp, Artificial Sequence
  chemically synthesized
aaatactggaagatattagg

SEQ ID NO: 310248 - DNA, 20 bp, Artificial Sequence
  chemically synthesized
aaaatactggaagatattag

SEQ ID NO: 310249 - DNA, 20 bp, Artificial Sequence
  chemically synthesized
aaaaatactggaagatatta

SEQ ID NO: 310250 - DNA, 20 bp, Artificial Sequence
  chemically synthesized
gaaaaatactggaagatatt

SEQ ID NO: 310251 - DNA, 20 bp, Artificial Sequence
  chemically synthesized
agaaaaatactggaagatat

SEQ ID NO: 310252 - DNA, 20 bp, Artificial Sequence
  chemically synthesized
cctaaccccctaatatcttc

SEQ ID NO: 310253 - DNA, 20 bp, Artificial Sequence
  chemically synthesized
agctagtagaaaaatactgg

SEQ ID NO: 310254 - DNA, 20 bp, Artificial Sequence
  chemically synthesized
gagagctagtagaaaaatac

SEQ ID NO: 310255 - DNA, 20 bp, Artificial Sequence
  chemically synthesized
atcttccagtatttttctac

SEQ ID NO: 310256 - DNA, 20 bp, Artificial Sequence
  chemically synthesized
taagcactgaggagagctag

SEQ ID NO: 310257 - DNA, 20 bp, Artificial Sequence
  chemically synthesized
atttaagcactgaggagagc

SEQ ID NO: 310258 - DNA, 20 bp, Artificial Sequence
  chemically synthesized
atttttctactagctctcct

SEQ ID NO: 310259 - DNA, 20 bp, Artificial Sequence
  chemically synthesized
gagaatttaagcactgagga

SEQ ID NO: 310260 - DNA, 20 bp, Artificial Sequence
  chemically synthesized
gagagaatttaagcactgag

SEQ ID NO: 310261 - DNA, 20 bp, Artificial Sequence
  chemically synthesized
aggagagaatttaagcactg

SEQ ID NO: 310262 - DNA, 20 bp, Artificial Sequence
  chemically synthesized
caggagagaatttaagcact

SEQ ID NO: 310263 - DNA, 20 bp, Artificial Sequence
  chemically synthesized
agaaagacaggagagaattt

SEQ ID NO: 310264 - DNA, 20 bp, Artificial Sequence
  chemically synthesized
ctactgaaagaaagacagga

SEQ ID NO: 310265 - DNA, 20 bp, Artificial Sequence
  chemically synthesized
ttctactgaaagaaagacag

SEQ ID NO: 310266 - DNA, 20 bp, Artificial Sequence
  chemically synthesized
atttctactgaaagaaagac

SEQ ID NO: 310267 - DNA, 20 bp, Artificial Sequence
  chemically synthesized
catttctactgaaagaaaga

SEQ ID NO: 310268 - DNA, 20 bp, Artificial Sequence
  chemically synthesized
attctctcctgtctttcttt

SEQ ID NO: 310269 - DNA, 20 bp, Artificial Sequence
  chemically synthesized
aaatcatttctactgaaaga

SEQ ID NO: 310270 - DNA, 20 bp, Artificial Sequence
  chemically synthesized
ctctcctgtctttctttcag

SEQ ID NO: 310271 - DNA, 20 bp, Artificial Sequence
  chemically synthesized
atggaaatcatttctactga

SEQ ID NO: 310272 - DNA, 20 bp, Artificial Sequence
  chemically synthesized
attgccataggagagagaga

SEQ ID NO: 310273 - DNA, 20 bp, Artificial Sequence
  chemically synthesized
gactattgccataggagaga

SEQ ID NO: 310274 - DNA, 20 bp, Artificial Sequence
  chemically synthesized
atttccatctctctctccta

SEQ ID NO: 310275 - DNA, 20 bp, Artificial Sequence
  chemically synthesized
aagactattgccataggaga

SEQ ID NO: 310276 - DNA, 20 bp, Artificial Sequence
  chemically synthesized
tcaagactattgccatagga

SEQ ID NO: 310277 - DNA, 20 bp, Artificial Sequence
  chemically synthesized
gatcaagactattgccatag

SEQ ID NO: 310278 - DNA, 20 bp, Artificial Sequence
  chemically synthesized
atctctctctcctatggcaa

SEQ ID NO: 310279 - DNA, 20 bp, Artificial Sequence
  chemically synthesized
tggatcaagactattgccat

SEQ ID NO: 310280 - DNA, 20 bp, Artificial Sequence
  chemically synthesized
atggatcaagactattgcca

SEQ ID NO: 310281 - DNA, 20 bp, Artificial Sequence
  chemically synthesized
agactactgaattatggatc

SEQ ID NO: 310282 - DNA, 20 bp, Artificial Sequence
  chemically synthesized
aatagtcttgatccataatt

SEQ ID NO: 310283 - DNA, 20 bp, Artificial Sequence
  chemically synthesized
tattcaagactactgaatta

SEQ ID NO: 310284 - DNA, 20 bp, Artificial Sequence
  chemically synthesized
agtcttgatccataattcag

SEQ ID NO: 310285 - DNA, 20 bp, Artificial Sequence
  chemically synthesized
taattcagtagtcttgaata

SEQ ID NO: 310286 - DNA, 20 bp, Artificial Sequence
  chemically synthesized
aggcaagaaagactttattc

SEQ ID NO: 310287 - DNA, 20 bp, Artificial Sequence
  chemically synthesized
caccagacaaacaggcaaga

SEQ ID NO: 310288 - DNA, 20 bp, Artificial Sequence
  chemically synthesized
aatgcaccagacaaacaggc

SEQ ID NO: 310289 - DNA, 20 bp, Artificial Sequence
  chemically synthesized
gtctttcttgcctgtttgtc

SEQ ID NO: 310290 - DNA, 20 bp, Artificial Sequence
  chemically synthesized
aaaaaatgcaccagacaaac

SEQ ID NO: 310291 - DNA, 20 bp, Artificial Sequence
  chemically synthesized
gaaaaaatgcaccagacaaa

SEQ ID NO: 310292 - DNA, 20 bp, Artificial Sequence
  chemically synthesized
ttgtaaaagaaaaaatgcac

SEQ ID NO: 310293 - DNA, 20 bp, Artificial Sequence
  chemically synthesized
tgtatctggtaatattgtaa

SEQ ID NO: 310294 - DNA, 20 bp, Artificial Sequence
  chemically synthesized
tttttcttttacaatattac

SEQ ID NO: 310295 - DNA, 20 bp, Artificial Sequence
  chemically synthesized
ttttacaatattaccagata

SEQ ID NO: 310296 - DNA, 20 bp, Artificial Sequence
  chemically synthesized
tttacaatattaccagatac

SEQ ID NO: 310297 - DNA, 20 bp, Artificial Sequence
  chemically synthesized
taccaggcccagcctgtatc

SEQ ID NO: 310298 - DNA, 20 bp, Artificial Sequence
  chemically synthesized
caatattaccagatacaggc

SEQ ID NO: 310299 - DNA, 20 bp, Artificial Sequence
  chemically synthesized
aatattaccagatacaggct

SEQ ID NO: 310300 - DNA, 20 bp, Artificial Sequence
  chemically synthesized
taccagatacaggctgggcc

SEQ ID NO: 310301 - DNA, 20 bp, Artificial Sequence
  chemically synthesized
cagatacaggctgggcctgg

SEQ ID NO: 310302 - DNA, 20 bp, Artificial Sequence
  chemically synthesized
caggcgtgagctaccaggcc

SEQ ID NO: 310303 - DNA, 20 bp, Artificial Sequence
  chemically synthesized
gattgcaggcgtgagctacc

SEQ ID NO: 310304 - DNA, 20 bp, Artificial Sequence
  chemically synthesized
ggattgcaggcgtgagctac

SEQ ID NO: 310305 - DNA, 20 bp, Artificial Sequence
  chemically synthesized
agtgttgggattgcaggcgt

SEQ ID NO: 310306 - DNA, 20 bp, Artificial Sequence
  chemically synthesized
tgccgaagtgttgggattgc

SEQ ID NO: 310307 - DNA, 20 bp, Artificial Sequence
  chemically synthesized
ctgccgaagtgttgggattg

SEQ ID NO: 310308 - DNA, 20 bp, Artificial Sequence
  chemically synthesized
cgcctgcaatcccaacactt

SEQ ID NO: 310309 - DNA, 20 bp, Artificial Sequence
  chemically synthesized
cctcggcctgccgaagtgtt

SEQ ID NO: 310310 - DNA, 20 bp, Artificial Sequence
  chemically synthesized
gcctcggcctgccgaagtgt

SEQ ID NO: 310311 - DNA, 20 bp, Artificial Sequence
  chemically synthesized
ctgcaatcccaacacttcgg

SEQ ID NO: 310312 - DNA, 20 bp, Artificial Sequence
  chemically synthesized
tgcaatcccaacacttcggc

SEQ ID NO: 310313 - DNA, 20 bp, Artificial Sequence
  chemically synthesized
ctgccagcctcggcctgccg

SEQ ID NO: 310314 - DNA, 20 bp, Artificial Sequence
  chemically synthesized
tcccaacacttcggcaggcc

SEQ ID NO: 310315 - DNA, 20 bp, Artificial Sequence
  chemically synthesized
cccaacacttcggcaggccg

SEQ ID NO: 310316 - DNA, 20 bp, Artificial Sequence
  chemically synthesized
acacttcggcaggccgaggc

SEQ ID NO: 310317 - DNA, 20 bp, Artificial Sequence
  chemically synthesized
cttcggcaggccgaggctgg

SEQ ID NO: 310318 - DNA, 20 bp, Artificial Sequence
  chemically synthesized
ctcaggtgatctgccagcct

SEQ ID NO: 310319 - DNA, 20 bp, Artificial Sequence
  chemically synthesized
cctgacctcaggtgatctgc

SEQ ID NO: 310320 - DNA, 20 bp, Artificial Sequence
  chemically synthesized
ccgaggctggcagatcacct

SEQ ID NO: 310321 - DNA, 20 bp, Artificial Sequence
  chemically synthesized
cgaggctggcagatcacctg

SEQ ID NO: 310322 - DNA, 20 bp, Artificial Sequence
  chemically synthesized
gctggcagatcacctgaggt

SEQ ID NO: 310323 - DNA, 20 bp, Artificial Sequence
  chemically synthesized
ctggcagatcacctgaggtc

SEQ ID NO: 310324 - DNA, 20 bp, Artificial Sequence
  chemically synthesized
ggtcttgaactcctgacctc

SEQ ID NO: 310325 - DNA, 20 bp, Artificial Sequence
  chemically synthesized
ggcagatcacctgaggtcag

SEQ ID NO: 310326 - DNA, 20 bp, Artificial Sequence
  chemically synthesized
tggtcttgaactcctgacct

SEQ ID NO: 310327 - DNA, 20 bp, Artificial Sequence
  chemically synthesized
tcacctgaggtcaggagttc

SEQ ID NO: 310328 - DNA, 20 bp, Artificial Sequence
  chemically synthesized
tttcaccatgttggtcaggt

SEQ ID NO: 310329 - DNA, 20 bp, Artificial Sequence
  chemically synthesized
agggtttcaccatgttggtc

SEQ ID NO: 310330 - DNA, 20 bp, Artificial Sequence
  chemically synthesized
caagaccaacctgaccaaca

SEQ ID NO: 310331 - DNA, 20 bp, Artificial Sequence
  chemically synthesized
cagggtttcaccatgttggt

SEQ ID NO: 310332 - DNA, 20 bp, Artificial Sequence
  chemically synthesized
gagacagggtttcaccatgt

SEQ ID NO: 310333 - DNA, 20 bp, Artificial Sequence
  chemically synthesized
ttgtattttgagtagagaca

SEQ ID NO: 310334 - DNA, 20 bp, Artificial Sequence
  chemically synthesized
tttgtattttgagtagagac

SEQ ID NO: 310335 - DNA, 20 bp, Artificial Sequence
  chemically synthesized
ttttgtattttgagtagaga

SEQ ID NO: 310336 - DNA, 20 bp, Artificial Sequence
  chemically synthesized
ttttttttgtattttgagta

SEQ ID NO: 310337 - DNA, 20 bp, Artificial Sequence
  chemically synthesized
aattttttttgtattttgag

SEQ ID NO: 310338 - DNA, 20 bp, Artificial Sequence
  chemically synthesized
gctaattttttttgtatttt

SEQ ID NO: 310339 - DNA, 20 bp, Artificial Sequence
  chemically synthesized
actcaaaatacaaaaaaaat

SEQ ID NO: 310340 - DNA, 20 bp, Artificial Sequence
  chemically synthesized
aaaatacaaaaaaaattagc

SEQ ID NO: 310341 - DNA, 20 bp, Artificial Sequence
  chemically synthesized
aaatacaaaaaaaattagcc

SEQ ID NO: 310342 - DNA, 20 bp, Artificial Sequence
  chemically synthesized
aaaaaattagccaggcatga

SEQ ID NO: 310343 - DNA, 20 bp, Artificial Sequence
  chemically synthesized
caggtgcccaccatcatgcc

SEQ ID NO: 310344 - DNA, 20 bp, Artificial Sequence
  chemically synthesized
aaattagccaggcatgatgg

SEQ ID NO: 310345 - DNA, 20 bp, Artificial Sequence
  chemically synthesized
aattagccaggcatgatggt

SEQ ID NO: 310346 - DNA, 20 bp, Artificial Sequence
  chemically synthesized
atggtgggcacctgcaaacc

SEQ ID NO: 310347 - DNA, 20 bp, Artificial Sequence
  chemically synthesized
tcctgaatagctgggtttgc

SEQ ID NO: 310348 - DNA, 20 bp, Artificial Sequence
  chemically synthesized
ctcctgaatagctgggtttg

SEQ ID NO: 310349 - DNA, 20 bp, Artificial Sequence
  chemically synthesized
cacctgcaaacccagctatt

SEQ ID NO: 310350 - DNA, 20 bp, Artificial Sequence
  chemically synthesized
cctcaacctcctgaatagct

SEQ ID NO: 310351 - DNA, 20 bp, Artificial Sequence
  chemically synthesized
acctgcaaacccagctattc

SEQ ID NO: 310352 - DNA, 20 bp, Artificial Sequence
  chemically synthesized
gcctcaacctcctgaatagc

SEQ ID NO: 310353 - DNA, 20 bp, Artificial Sequence
  chemically synthesized
ctgcaaacccagctattcag

SEQ ID NO: 310354 - DNA, 20 bp, Artificial Sequence
  chemically synthesized
tgcaaacccagctattcagg

SEQ ID NO: 310355 - DNA, 20 bp, Artificial Sequence
  chemically synthesized
tcctgcctcaacctcctgaa

SEQ ID NO: 310356 - DNA, 20 bp, Artificial Sequence
  chemically synthesized
acccagctattcaggaggtt

SEQ ID NO: 310357 - DNA, 20 bp, Artificial Sequence
  chemically synthesized
cccagctattcaggaggttg

SEQ ID NO: 310358 - DNA, 20 bp, Artificial Sequence
  chemically synthesized
agctattcaggaggttgagg

SEQ ID NO: 310359 - DNA, 20 bp, Artificial Sequence
  chemically synthesized
gctattcaggaggttgaggc

SEQ ID NO: 310360 - DNA, 20 bp, Artificial Sequence
  chemically synthesized
tattcaggaggttgaggcag

SEQ ID NO: 310361 - DNA, 20 bp, Artificial Sequence
  chemically synthesized
ggcaggagaattgcttgaac

SEQ ID NO: 310362 - DNA, 20 bp, Artificial Sequence
  chemically synthesized
gcaggagaattgcttgaacc

SEQ ID NO: 310363 - DNA, 20 bp, Artificial Sequence
  chemically synthesized
caggagaattgcttgaacca

SEQ ID NO: 310364 - DNA, 20 bp, Artificial Sequence
  chemically synthesized
aacatccgcctccctggttc

SEQ ID NO: 310365 - DNA, 20 bp, Artificial Sequence
  chemically synthesized
ggagaattgcttgaaccagg

SEQ ID NO: 310366 - DNA, 20 bp, Artificial Sequence
  chemically synthesized
gagaattgcttgaaccaggg

SEQ ID NO: 310367 - DNA, 20 bp, Artificial Sequence
  chemically synthesized
aattgcttgaaccagggagg

SEQ ID NO: 310368 - DNA, 20 bp, Artificial Sequence
  chemically synthesized
caatgcaacatccgcctccc

SEQ ID NO: 310369 - DNA, 20 bp, Artificial Sequence
  chemically synthesized
agggaggcggatgttgcatt

SEQ ID NO: 310370 - DNA, 20 bp, Artificial Sequence
  chemically synthesized
ggcggatgttgcattgagct

SEQ ID NO: 310371 - DNA, 20 bp, Artificial Sequence
  chemically synthesized
ggagtgcagtggcaagatct

SEQ ID NO: 310372 - DNA, 20 bp, Artificial Sequence
  chemically synthesized
ccaggctggagtgcagtggc

SEQ ID NO: 310373 - DNA, 20 bp, Artificial Sequence
  chemically synthesized
ctacccaggctggagtgcag

SEQ ID NO: 310374 - DNA, 20 bp, Artificial Sequence
  chemically synthesized
gagatcttgccactgcactc

SEQ ID NO: 310375 - DNA, 20 bp, Artificial Sequence
  chemically synthesized
tttctacccaggctggagtg

SEQ ID NO: 310376 - DNA, 20 bp, Artificial Sequence
  chemically synthesized
cttgccactgcactccagcc

SEQ ID NO: 310377 - DNA, 20 bp, Artificial Sequence
  chemically synthesized
ttgccactgcactccagcct

SEQ ID NO: 310378 - DNA, 20 bp, Artificial Sequence
  chemically synthesized
cgctgtttctacccaggctg

SEQ ID NO: 310379 - DNA, 20 bp, Artificial Sequence
  chemically synthesized
ccactgcactccagcctggg

SEQ ID NO: 310380 - DNA, 20 bp, Artificial Sequence
  chemically synthesized
ttcgctgtttctacccaggc

SEQ ID NO: 310381 - DNA, 20 bp, Artificial Sequence
  chemically synthesized
gagtttcgctgtttctaccc

SEQ ID NO: 310382 - DNA, 20 bp, Artificial Sequence
  chemically synthesized
ggagtttcgctgtttctacc

SEQ ID NO: 310383 - DNA, 20 bp, Artificial Sequence
  chemically synthesized
cactccagcctgggtagaaa

SEQ ID NO: 310384 - DNA, 20 bp, Artificial Sequence
  chemically synthesized
ggtaatatttttttgagatg

SEQ ID NO: 310385 - DNA, 20 bp, Artificial Sequence
  chemically synthesized
atggtaatatttttttgaga

SEQ ID NO: 310386 - DNA, 20 bp, Artificial Sequence
  chemically synthesized
atatatggtaatattttttt

SEQ ID NO: 310387 - DNA, 20 bp, Artificial Sequence
  chemically synthesized
ttatgacaagttttaatata

SEQ ID NO: 310388 - DNA, 20 bp, Artificial Sequence
  chemically synthesized
aattactatagcattatgac

SEQ ID NO: 310389 - DNA, 20 bp, Artificial Sequence
  chemically synthesized
taaaacttgtcataatgcta

SEQ ID NO: 310390 - DNA, 20 bp, Artificial Sequence
  chemically synthesized
ccacattgttttaattacta

SEQ ID NO: 310391 - DNA, 20 bp, Artificial Sequence
  chemically synthesized
ctatagtaattaaaacaatg

SEQ ID NO: 310392 - DNA, 20 bp, Artificial Sequence
  chemically synthesized
taattaaaacaatgtggaat

SEQ ID NO: 310393 - DNA, 20 bp, Artificial Sequence
  chemically synthesized
aaacaatgtggaattagcat

SEQ ID NO: 310394 - DNA, 20 bp, Artificial Sequence
  chemically synthesized
aacaatgtggaattagcatg

SEQ ID NO: 310395 - DNA, 20 bp, Artificial Sequence
  chemically synthesized
atgtggaattagcatgagga

SEQ ID NO: 310396 - DNA, 20 bp, Artificial Sequence
  chemically synthesized
tgtggaattagcatgaggac

SEQ ID NO: 310397 - DNA, 20 bp, Artificial Sequence
  chemically synthesized
gaattagcatgaggacaggc

SEQ ID NO: 310398 - DNA, 20 bp, Artificial Sequence
  chemically synthesized
ttagcatgaggacaggcaag

SEQ ID NO: 310399 - DNA, 20 bp, Artificial Sequence
  chemically synthesized
agcatgaggacaggcaagta

SEQ ID NO: 310400 - DNA, 20 bp, Artificial Sequence
  chemically synthesized
agtagagaaataaaactgat

SEQ ID NO: 310401 - DNA, 20 bp, Artificial Sequence
  chemically synthesized
tagagaaataaaactgatta

SEQ ID NO: 310402 - DNA, 20 bp, Artificial Sequence
  chemically synthesized
atcagtttatggactctaat

SEQ ID NO: 310403 - DNA, 20 bp, Artificial Sequence
  chemically synthesized
tacgtgcatggatcagttta

SEQ ID NO: 310404 - DNA, 20 bp, Artificial Sequence
  chemically synthesized
atgcctatacgtgcatggat

SEQ ID NO: 310405 - DNA, 20 bp, Artificial Sequence
  chemically synthesized
ataaaatgcctatacgtgca

SEQ ID NO: 310406 - DNA, 20 bp, Artificial Sequence
  chemically synthesized
taaactgatccatgcacgta

SEQ ID NO: 310407 - DNA, 20 bp, Artificial Sequence
  chemically synthesized
aaactgatccatgcacgtat

SEQ ID NO: 310408 - DNA, 20 bp, Artificial Sequence
  chemically synthesized
gtcatctttgacgaaaatat

SEQ ID NO: 310409 - DNA, 20 bp, Artificial Sequence
  chemically synthesized
tatttctaatattttcgtca

SEQ ID NO: 310410 - DNA, 20 bp, Artificial Sequence
  chemically synthesized
tttcgtcaaagatgacacca

SEQ ID NO: 310411 - DNA, 20 bp, Artificial Sequence
  chemically synthesized
atcctttcctcaatattctg

SEQ ID NO: 310412 - DNA, 20 bp, Artificial Sequence
  chemically synthesized
agatgacaccacagaatatt

SEQ ID NO: 310413 - DNA, 20 bp, Artificial Sequence
  chemically synthesized
gatgacaccacagaatattg

SEQ ID NO: 310414 - DNA, 20 bp, Artificial Sequence
  chemically synthesized
acaccacagaatattgagga

SEQ ID NO: 310415 - DNA, 20 bp, Artificial Sequence
  chemically synthesized
caccacagaatattgaggaa

SEQ ID NO: 310416 - DNA, 20 bp, Artificial Sequence
  chemically synthesized
acagaatattgaggaaagga

SEQ ID NO: 310417 - DNA, 20 bp, Artificial Sequence
  chemically synthesized
ttattgcaaagattttcaat

SEQ ID NO: 310418 - DNA, 20 bp, Artificial Sequence
  chemically synthesized
ttattgaaaatctttgcaat

SEQ ID NO: 310419 - DNA, 20 bp, Artificial Sequence
  chemically synthesized
gaaaagatggtcttattgca

SEQ ID NO: 310420 - DNA, 20 bp, Artificial Sequence
  chemically synthesized
gtagaatattgaggaaaaga

SEQ ID NO: 310421 - DNA, 20 bp, Artificial Sequence
  chemically synthesized
cactgtagaatattgaggaa

SEQ ID NO: 310422 - DNA, 20 bp, Artificial Sequence
  chemically synthesized
gttggcactgtagaatattg

SEQ ID NO: 310423 - DNA, 20 bp, Artificial Sequence
  chemically synthesized
agttggcactgtagaatatt

SEQ ID NO: 310424 - DNA, 20 bp, Artificial Sequence
  chemically synthesized
atcttttcctcaatattcta

SEQ ID NO: 310425 - DNA, 20 bp, Artificial Sequence
  chemically synthesized
gaaacaacaagttggcactg

SEQ ID NO: 310426 - DNA, 20 bp, Artificial Sequence
  chemically synthesized
atccaactgaaacaacaagt

SEQ ID NO: 310427 - DNA, 20 bp, Artificial Sequence
  chemically synthesized
acagtgccaacttgttgttt

SEQ ID NO: 310428 - DNA, 20 bp, Artificial Sequence
  chemically synthesized
atagatccaactgaaacaac

SEQ ID NO: 310429 - DNA, 20 bp, Artificial Sequence
  chemically synthesized
tgccaacttgttgtttcagt

SEQ ID NO: 310430 - DNA, 20 bp, Artificial Sequence
  chemically synthesized
ttgtttcagttggatctata

SEQ ID NO: 310431 - DNA, 20 bp, Artificial Sequence
  chemically synthesized
tgtttcagttggatctatat

SEQ ID NO: 310432 - DNA, 20 bp, Artificial Sequence
  chemically synthesized
aatgtccattttttcccata

SEQ ID NO: 310433 - DNA, 20 bp, Artificial Sequence
  chemically synthesized
tggatctatatgggaaaaaa

SEQ ID NO: 310434 - DNA, 20 bp, Artificial Sequence
  chemically synthesized
attattacaggtatgaggaa

SEQ ID NO: 310435 - DNA, 20 bp, Artificial Sequence
  chemically synthesized
tattattacaggtatgagga

SEQ ID NO: 310436 - DNA, 20 bp, Artificial Sequence
  chemically synthesized
ctattattacaggtatgagg

SEQ ID NO: 310437 - DNA, 20 bp, Artificial Sequence
  chemically synthesized
cacctattattacaggtatg

SEQ ID NO: 310438 - DNA, 20 bp, Artificial Sequence
  chemically synthesized
ccacctattattacaggtat

SEQ ID NO: 310439 - DNA, 20 bp, Artificial Sequence
  chemically synthesized
cttcctcatacctgtaataa

SEQ ID NO: 310440 - DNA, 20 bp, Artificial Sequence
  chemically synthesized
tacaatccacctattattac

SEQ ID NO: 310441 - DNA, 20 bp, Artificial Sequence
  chemically synthesized
ttcctcatacctgtaataat

SEQ ID NO: 310442 - DNA, 20 bp, Artificial Sequence
  chemically synthesized
ttacaatccacctattatta

SEQ ID NO: 310443 - DNA, 20 bp, Artificial Sequence
  chemically synthesized
ctcatacctgtaataatagg

SEQ ID NO: 310444 - DNA, 20 bp, Artificial Sequence
  chemically synthesized
ataggtggattgtaatacga

SEQ ID NO: 310445 - DNA, 20 bp, Artificial Sequence
  chemically synthesized
taggtggattgtaatacgaa

SEQ ID NO: 310446 - DNA, 20 bp, Artificial Sequence
  chemically synthesized
aatacgaaaggtaaaacaaa

SEQ ID NO: 310447 - DNA, 20 bp, Artificial Sequence
  chemically synthesized
taaaacaaacagttcctata

SEQ ID NO: 310448 - DNA, 20 bp, Artificial Sequence
  chemically synthesized
atggtcctgggttgctatat

SEQ ID NO: 310449 - DNA, 20 bp, Artificial Sequence
  chemically synthesized
tatggtcctgggttgctata

SEQ ID NO: 310450 - DNA, 20 bp, Artificial Sequence
  chemically synthesized
acagttcctatatagcaacc

SEQ ID NO: 310451 - DNA, 20 bp, Artificial Sequence
  chemically synthesized
cagttcctatatagcaaccc

SEQ ID NO: 310452 - DNA, 20 bp, Artificial Sequence
  chemically synthesized
tatatagcaacccaggacca

SEQ ID NO: 310453 - DNA, 20 bp, Artificial Sequence
  chemically synthesized
aattctgaagctatggtcct

SEQ ID NO: 310454 - DNA, 20 bp, Artificial Sequence
  chemically synthesized
aaattctgaagctatggtcc

SEQ ID NO: 310455 - DNA, 20 bp, Artificial Sequence
  chemically synthesized
gcaacccaggaccatagctt

SEQ ID NO: 310456 - DNA, 20 bp, Artificial Sequence
  chemically synthesized
actttaaaattctgaagcta

SEQ ID NO: 310457 - DNA, 20 bp, Artificial Sequence
  chemically synthesized
ctctctactttaaaattctg

SEQ ID NO: 310458 - DNA, 20 bp, Artificial Sequence
  chemically synthesized
accatagcttcagaatttta

SEQ ID NO: 310459 - DNA, 20 bp, Artificial Sequence
  chemically synthesized
atagcttcagaattttaaag

SEQ ID NO: 310460 - DNA, 20 bp, Artificial Sequence
  chemically synthesized
agcttcagaattttaaagta

SEQ ID NO: 310461 - DNA, 20 bp, Artificial Sequence
  chemically synthesized
cttcagaattttaaagtaga

SEQ ID NO: 310462 - DNA, 20 bp, Artificial Sequence
  chemically synthesized
gagagttttatttttaaact

SEQ ID NO: 310463 - DNA, 20 bp, Artificial Sequence
  chemically synthesized
agagttttatttttaaactg

SEQ ID NO: 310464 - DNA, 20 bp, Artificial Sequence
  chemically synthesized
tatttttaaactgaggacaa

SEQ ID NO: 310465 - DNA, 20 bp, Artificial Sequence
  chemically synthesized
gtttagtgtacttttgtcct

SEQ ID NO: 310466 - DNA, 20 bp, Artificial Sequence
  chemically synthesized
caaaagtacactaaacataa

SEQ ID NO: 310467 - DNA, 20 bp, Artificial Sequence
  chemically synthesized
tcaatattttctgttatgtt

SEQ ID NO: 310468 - DNA, 20 bp, Artificial Sequence
  chemically synthesized
aaacataacagaaaatattg

SEQ ID NO: 310469 - DNA, 20 bp, Artificial Sequence
  chemically synthesized
acagaagtttaaatttaaca

SEQ ID NO: 310470 - DNA, 20 bp, Artificial Sequence
  chemically synthesized
atatatctcttcataaacag

SEQ ID NO: 310471 - DNA, 20 bp, Artificial Sequence
  chemically synthesized
aatttaaacttctgtttatg

SEQ ID NO: 310472 - DNA, 20 bp, Artificial Sequence
  chemically synthesized
atgatatatctcttcataaa

SEQ ID NO: 310473 - DNA, 20 bp, Artificial Sequence
  chemically synthesized
tttaaacttctgtttatgaa

SEQ ID NO: 310474 - DNA, 20 bp, Artificial Sequence
  chemically synthesized
tatgaagagatatatcatta

SEQ ID NO: 310475 - DNA, 20 bp, Artificial Sequence
  chemically synthesized
tgaagagatatatcattacg

SEQ ID NO: 310476 - DNA, 20 bp, Artificial Sequence
  chemically synthesized
atatatcattacggagtgaa

SEQ ID NO: 310477 - DNA, 20 bp, Artificial Sequence
  chemically synthesized
tatatcattacggagtgaaa

SEQ ID NO: 310478 - DNA, 20 bp, Artificial Sequence
  chemically synthesized
tcattacggagtgaaaaggc

SEQ ID NO: 310479 - DNA, 20 bp, Artificial Sequence
  chemically synthesized
cattacggagtgaaaaggca

SEQ ID NO: 310480 - DNA, 20 bp, Artificial Sequence
  chemically synthesized
aggcaaggtacccattcaaa

SEQ ID NO: 310481 - DNA, 20 bp, Artificial Sequence
  chemically synthesized
ttacatttttctttttgaat

SEQ ID NO: 310482 - DNA, 20 bp, Artificial Sequence
  chemically synthesized
attacatttttctttttgaa

SEQ ID NO: 310483 - DNA, 20 bp, Artificial Sequence
  chemically synthesized
aaagaaaaatgtaatataaa

SEQ ID NO: 310484 - DNA, 20 bp, Artificial Sequence
  chemically synthesized
aaaatgtaatataaacagca

SEQ ID NO: 310485 - DNA, 20 bp, Artificial Sequence
  chemically synthesized
tataaacagcaaagaatacc

SEQ ID NO: 310486 - DNA, 20 bp, Artificial Sequence
  chemically synthesized
gtttaaaatatatatattct

SEQ ID NO: 310487 - DNA, 20 bp, Artificial Sequence
  chemically synthesized
agtttaaaatatatatattc

SEQ ID NO: 310488 - DNA, 20 bp, Artificial Sequence
  chemically synthesized
tttctcttactgatttattt

SEQ ID NO: 310489 - DNA, 20 bp, Artificial Sequence
  chemically synthesized
tattttaaactaaaataaat

SEQ ID NO: 310490 - DNA, 20 bp, Artificial Sequence
  chemically synthesized
ttaaactaaaataaatcagt

SEQ ID NO: 310491 - DNA, 20 bp, Artificial Sequence
  chemically synthesized
aaactaaaataaatcagtaa

SEQ ID NO: 310492 - DNA, 20 bp, Artificial Sequence
  chemically synthesized
ataaatcagtaagagaaata

SEQ ID NO: 310493 - DNA, 20 bp, Artificial Sequence
  chemically synthesized
taagagaaatatagaaaatc

SEQ ID NO: 310494 - DNA, 20 bp, Artificial Sequence
  chemically synthesized
gagaaatatagaaaatccag

SEQ ID NO: 310495 - DNA, 20 bp, Artificial Sequence
  chemically synthesized
tgaaatgcctgtttttctac

SEQ ID NO: 310496 - DNA, 20 bp, Artificial Sequence
  chemically synthesized
tagaaaatccagtagaaaaa

SEQ ID NO: 310497 - DNA, 20 bp, Artificial Sequence
  chemically synthesized
agaaaatccagtagaaaaac

SEQ ID NO: 310498 - DNA, 20 bp, Artificial Sequence
  chemically synthesized
cagtagaaaaacaggcattt

SEQ ID NO: 310499 - DNA, 20 bp, Artificial Sequence
  chemically synthesized
gtagaaaaacaggcatttca

SEQ ID NO: 310500 - DNA, 20 bp, Artificial Sequence
  chemically synthesized
gaaaaacaggcatttcagag

SEQ ID NO: 310501 - DNA, 20 bp, Artificial Sequence
  chemically synthesized
aaaacaggcatttcagagaa

SEQ ID NO: 310502 - DNA, 20 bp, Artificial Sequence
  chemically synthesized
cagagaagagttcatttaaa

SEQ ID NO: 310503 - DNA, 20 bp, Artificial Sequence
  chemically synthesized
aatactatttcagttgttat

SEQ ID NO: 310504 - DNA, 20 bp, Artificial Sequence
  chemically synthesized
atggccaataacaactgaaa

SEQ ID NO: 310505 - DNA, 20 bp, Artificial Sequence
  chemically synthesized
agtgaggcggaatactattt

SEQ ID NO: 310506 - DNA, 20 bp, Artificial Sequence
  chemically synthesized
gaaatagtattccgcctcac

SEQ ID NO: 310507 - DNA, 20 bp, Artificial Sequence
  chemically synthesized
tatactgatgaccagtgagg

SEQ ID NO: 310508 - DNA, 20 bp, Artificial Sequence
  chemically synthesized
gtatatactgatgaccagtg

SEQ ID NO: 310509 - DNA, 20 bp, Artificial Sequence
  chemically synthesized
tgtatatactgatgaccagt

SEQ ID NO: 310510 - DNA, 20 bp, Artificial Sequence
  chemically synthesized
tattccgcctcactggtcat

SEQ ID NO: 310511 - DNA, 20 bp, Artificial Sequence
  chemically synthesized
catttgtatatactgatgac

SEQ ID NO: 310512 - DNA, 20 bp, Artificial Sequence
  chemically synthesized
agtatatacaaatgaaaaat

SEQ ID NO: 310513 - DNA, 20 bp, Artificial Sequence
  chemically synthesized
tatatacaaatgaaaaatga

SEQ ID NO: 310514 - DNA, 20 bp, Artificial Sequence
  chemically synthesized
aaatgagagatgacattata

SEQ ID NO: 310515 - DNA, 20 bp, Artificial Sequence
  chemically synthesized
agatgacattataaagtcac

SEQ ID NO: 310516 - DNA, 20 bp, Artificial Sequence
  chemically synthesized
gacattataaagtcaccaga

SEQ ID NO: 310517 - DNA, 20 bp, Artificial Sequence
  chemically synthesized
acattataaagtcaccagaa

SEQ ID NO: 310518 - DNA, 20 bp, Artificial Sequence
  chemically synthesized
ctttttaatttgagcctttc

SEQ ID NO: 310519 - DNA, 20 bp, Artificial Sequence
  chemically synthesized
tttgttaaactttttaattt

SEQ ID NO: 310520 - DNA, 20 bp, Artificial Sequence
  chemically synthesized
ccagaaaggctcaaattaaa

SEQ ID NO: 310521 - DNA, 20 bp, Artificial Sequence
  chemically synthesized
aattaaaaagtttaacaaac

SEQ ID NO: 310522 - DNA, 20 bp, Artificial Sequence
  chemically synthesized
agtttaacaaacaagtattc

SEQ ID NO: 310523 - DNA, 20 bp, Artificial Sequence
  chemically synthesized
ttaacaaacaagtattcaag

SEQ ID NO: 310524 - DNA, 20 bp, Artificial Sequence
  chemically synthesized
caagtattcaagaagatatg

SEQ ID NO: 310525 - DNA, 20 bp, Artificial Sequence
  chemically synthesized
gtattcaagaagatatgaag

SEQ ID NO: 310526 - DNA, 20 bp, Artificial Sequence
  chemically synthesized
ttctcaccagtagtaaatga

SEQ ID NO: 310527 - DNA, 20 bp, Artificial Sequence
  chemically synthesized
tttgtactttcatttactac

SEQ ID NO: 310528 - DNA, 20 bp, Artificial Sequence
  chemically synthesized
tactttcatttactactggt

SEQ ID NO: 310529 - DNA, 20 bp, Artificial Sequence
  chemically synthesized
taaattcatattctcaccag

SEQ ID NO: 310530 - DNA, 20 bp, Artificial Sequence
  chemically synthesized
gtataaattcatattctcac

SEQ ID NO: 310531 - DNA, 20 bp, Artificial Sequence
  chemically synthesized
aatatgaatttatacaactt

SEQ ID NO: 310532 - DNA, 20 bp, Artificial Sequence
  chemically synthesized
tattaacaaagggttttcca

SEQ ID NO: 310533 - DNA, 20 bp, Artificial Sequence
  chemically synthesized
gctttcaagatattaacaaa

SEQ ID NO: 310534 - DNA, 20 bp, Artificial Sequence
  chemically synthesized
agctttcaagatattaacaa

SEQ ID NO: 310535 - DNA, 20 bp, Artificial Sequence
  chemically synthesized
tagctttcaagatattaaca

SEQ ID NO: 310536 - DNA, 20 bp, Artificial Sequence
  chemically synthesized
accctttgttaatatcttga

SEQ ID NO: 310537 - DNA, 20 bp, Artificial Sequence
  chemically synthesized
tatatgcatatttagctttc

SEQ ID NO: 310538 - DNA, 20 bp, Artificial Sequence
  chemically synthesized
tcattgggtatatgcatatt

SEQ ID NO: 310539 - DNA, 20 bp, Artificial Sequence
  chemically synthesized
tatgcatatacccaatgatt

SEQ ID NO: 310540 - DNA, 20 bp, Artificial Sequence
  chemically synthesized
aatagcatttcttaatcatt

SEQ ID NO: 310541 - DNA, 20 bp, Artificial Sequence
  chemically synthesized
gaatagcatttcttaatcat

SEQ ID NO: 310542 - DNA, 20 bp, Artificial Sequence
  chemically synthesized
tgattaagaaatgctattct

SEQ ID NO: 310543 - DNA, 20 bp, Artificial Sequence
  chemically synthesized
gattaagaaatgctattctt

SEQ ID NO: 310544 - DNA, 20 bp, Artificial Sequence
  chemically synthesized
attaggtatttacctaagaa

SEQ ID NO: 310545 - DNA, 20 bp, Artificial Sequence
  chemically synthesized
tttgtattaggtatttacct

SEQ ID NO: 310546 - DNA, 20 bp, Artificial Sequence
  chemically synthesized
taggtaaatacctaatacaa

SEQ ID NO: 310547 - DNA, 20 bp, Artificial Sequence
  chemically synthesized
tatatgtaaacttttgtatt

SEQ ID NO: 310548 - DNA, 20 bp, Artificial Sequence
  chemically synthesized
atatatgtaaacttttgtat

SEQ ID NO: 310549 - DNA, 20 bp, Artificial Sequence
  chemically synthesized
atacgtacaatttatgttga

SEQ ID NO: 310550 - DNA, 20 bp, Artificial Sequence
  chemically synthesized
tatttgtaatgcttccgaac

SEQ ID NO: 310551 - DNA, 20 bp, Artificial Sequence
  chemically synthesized
tggggttgtttccagttcgg

SEQ ID NO: 310552 - DNA, 20 bp, Artificial Sequence
  chemically synthesized
aattggggttgtttccagtt

SEQ ID NO: 310553 - DNA, 20 bp, Artificial Sequence
  chemically synthesized
cagaaaattggggttgtttc

SEQ ID NO: 310554 - DNA, 20 bp, Artificial Sequence
  chemically synthesized
atattctgttcagaaaattg

SEQ ID NO: 310555 - DNA, 20 bp, Artificial Sequence
  chemically synthesized
catattctgttcagaaaatt

SEQ ID NO: 310556 - DNA, 20 bp, Artificial Sequence
  chemically synthesized
acatattctgttcagaaaat

SEQ ID NO: 310557 - DNA, 20 bp, Artificial Sequence
  chemically synthesized
aacaaccccaattttctgaa

SEQ ID NO: 310558 - DNA, 20 bp, Artificial Sequence
  chemically synthesized
cacattttacatattctgtt

SEQ ID NO: 310559 - DNA, 20 bp, Artificial Sequence
  chemically synthesized
tgaacagaatatgtaaaatg

SEQ ID NO: 310560 - DNA, 20 bp, Artificial Sequence
  chemically synthesized
aaatgtggtatattcataca

SEQ ID NO: 310561 - DNA, 20 bp, Artificial Sequence
  chemically synthesized
tcatacaaagtaattctatc

SEQ ID NO: 310562 - DNA, 20 bp, Artificial Sequence
  chemically synthesized
tattaattttcatcgctgga

SEQ ID NO: 310563 - DNA, 20 bp, Artificial Sequence
  chemically synthesized
actttattaattttcatcgc

SEQ ID NO: 310564 - DNA, 20 bp, Artificial Sequence
  chemically synthesized
tccagcgatgaaaattaata

SEQ ID NO: 310565 - DNA, 20 bp, Artificial Sequence
  chemically synthesized
gagattcactatgttgcata

SEQ ID NO: 310566 - DNA, 20 bp, Artificial Sequence
  chemically synthesized
aagtaatgctatatgcaaca

SEQ ID NO: 310567 - DNA, 20 bp, Artificial Sequence
  chemically synthesized
catagtgaatctcacaaata

SEQ ID NO: 310568 - DNA, 20 bp, Artificial Sequence
  chemically synthesized
tcactggatactatatttgt

SEQ ID NO: 310569 - DNA, 20 bp, Artificial Sequence
  chemically synthesized
aatctcacaaatatagtatc

SEQ ID NO: 310570 - DNA, 20 bp, Artificial Sequence
  chemically synthesized
aatatagtatccagtgaaaa

SEQ ID NO: 310571 - DNA, 20 bp, Artificial Sequence
  chemically synthesized
ttttaactggcttttttcac

SEQ ID NO: 310572 - DNA, 20 bp, Artificial Sequence
  chemically synthesized
tagtatccagtgaaaaaagc

SEQ ID NO: 310573 - DNA, 20 bp, Artificial Sequence
  chemically synthesized
tatatatgcagttttttaac

SEQ ID NO: 310574 - DNA, 20 bp, Artificial Sequence
  chemically synthesized
aaatgaaacttttatatatg

SEQ ID NO: 310575 - DNA, 20 bp, Artificial Sequence
  chemically synthesized
ttaaaaaactgcatatataa

SEQ ID NO: 310576 - DNA, 20 bp, Artificial Sequence
  chemically synthesized
ataaaagtttcatttacatc

SEQ ID NO: 310577 - DNA, 20 bp, Artificial Sequence
  chemically synthesized
tttacatcaagttaaaaata

SEQ ID NO: 310578 - DNA, 20 bp, Artificial Sequence
  chemically synthesized
catcaagttaaaaatatagc

SEQ ID NO: 310579 - DNA, 20 bp, Artificial Sequence
  chemically synthesized
aatatagcaagactaacctg

SEQ ID NO: 310580 - DNA, 20 bp, Artificial Sequence
  chemically synthesized
tgagttataatgctgcaggt

SEQ ID NO: 310581 - DNA, 20 bp, Artificial Sequence
  chemically synthesized
atcttgagttataatgctgc

SEQ ID NO: 310582 - DNA, 20 bp, Artificial Sequence
  chemically synthesized
tatcttgagttataatgctg

SEQ ID NO: 310583 - DNA, 20 bp, Artificial Sequence
  chemically synthesized
aacctgcagcattataactc

SEQ ID NO: 310584 - DNA, 20 bp, Artificial Sequence
  chemically synthesized
tcaaaggtaacatgtatctt

SEQ ID NO: 310585 - DNA, 20 bp, Artificial Sequence
  chemically synthesized
tcaagatacatgttaccttt

SEQ ID NO: 310586 - DNA, 20 bp, Artificial Sequence
  chemically synthesized
caagatacatgttacctttg

SEQ ID NO: 310587 - DNA, 20 bp, Artificial Sequence
  chemically synthesized
agatacatgttacctttgag

SEQ ID NO: 310588 - DNA, 20 bp, Artificial Sequence
  chemically synthesized
aactcttcccatctcctcaa

SEQ ID NO: 310589 - DNA, 20 bp, Artificial Sequence
  chemically synthesized
aaactcttcccatctcctca

SEQ ID NO: 310590 - DNA, 20 bp, Artificial Sequence
  chemically synthesized
acatgttacctttgaggaga

SEQ ID NO: 310591 - DNA, 20 bp, Artificial Sequence
  chemically synthesized
catgttacctttgaggagat

SEQ ID NO: 310592 - DNA, 20 bp, Artificial Sequence
  chemically synthesized
gttacctttgaggagatggg

SEQ ID NO: 310593 - DNA, 20 bp, Artificial Sequence
  chemically synthesized
tacctttgaggagatgggaa

SEQ ID NO: 310594 - DNA, 20 bp, Artificial Sequence
  chemically synthesized
gggaagagtttatgatacca

SEQ ID NO: 310595 - DNA, 20 bp, Artificial Sequence
  chemically synthesized
ggaagagtttatgataccat

SEQ ID NO: 310596 - DNA, 20 bp, Artificial Sequence
  chemically synthesized
gaagagtttatgataccata

SEQ ID NO: 310597 - DNA, 20 bp, Artificial Sequence
  chemically synthesized
gaaacctccatcaagcccta

SEQ ID NO: 310598 - DNA, 20 bp, Artificial Sequence
  chemically synthesized
tatgataccatagggcttga

SEQ ID NO: 310599 - DNA, 20 bp, Artificial Sequence
  chemically synthesized
tgataccatagggcttgatg

SEQ ID NO: 310600 - DNA, 20 bp, Artificial Sequence
  chemically synthesized
gataccatagggcttgatgg

SEQ ID NO: 310601 - DNA, 20 bp, Artificial Sequence
  chemically synthesized
gcaaccaggaaacctccatc

SEQ ID NO: 310602 - DNA, 20 bp, Artificial Sequence
  chemically synthesized
agggcttgatggaggtttcc

SEQ ID NO: 310603 - DNA, 20 bp, Artificial Sequence
  chemically synthesized
gatggaggtttcctggttgc

SEQ ID NO: 310604 - DNA, 20 bp, Artificial Sequence
  chemically synthesized
atagtatgttaccagcaacc

SEQ ID NO: 310605 - DNA, 20 bp, Artificial Sequence
  chemically synthesized
gatagtatgttaccagcaac

SEQ ID NO: 310606 - DNA, 20 bp, Artificial Sequence
  chemically synthesized
agaaaaagatagtatgttac

SEQ ID NO: 310607 - DNA, 20 bp, Artificial Sequence
  chemically synthesized
attccacatccagaaaaaga

SEQ ID NO: 310608 - DNA, 20 bp, Artificial Sequence
  chemically synthesized
ggtaacatactatctttttc

SEQ ID NO: 310609 - DNA, 20 bp, Artificial Sequence
  chemically synthesized
tatgattccacatccagaaa

SEQ ID NO: 310610 - DNA, 20 bp, Artificial Sequence
  chemically synthesized
atactatctttttctggatg

SEQ ID NO: 310611 - DNA, 20 bp, Artificial Sequence
  chemically synthesized
acatactatgattccacatc

SEQ ID NO: 310612 - DNA, 20 bp, Artificial Sequence
  chemically synthesized
tttttctggatgtggaatca

SEQ ID NO: 310613 - DNA, 20 bp, Artificial Sequence
  chemically synthesized
tagtatgttacttctgtaat

SEQ ID NO: 310614 - DNA, 20 bp, Artificial Sequence
  chemically synthesized
agcttaaagacttattacag

SEQ ID NO: 310615 - DNA, 20 bp, Artificial Sequence
  chemically synthesized
tatagcttaaagacttatta

SEQ ID NO: 310616 - DNA, 20 bp, Artificial Sequence
  chemically synthesized
tacttctgtaataagtcttt

SEQ ID NO: 310617 - DNA, 20 bp, Artificial Sequence
  chemically synthesized
taagttataattatagctta

SEQ ID NO: 310618 - DNA, 20 bp, Artificial Sequence
  chemically synthesized
aaggacataagttataatta

SEQ ID NO: 310619 - DNA, 20 bp, Artificial Sequence
  chemically synthesized
aagtatcaagcaaaggacat

SEQ ID NO: 310620 - DNA, 20 bp, Artificial Sequence
  chemically synthesized
taaattgaagtatcaagcaa

SEQ ID NO: 310621 - DNA, 20 bp, Artificial Sequence
  chemically synthesized
ttaaattgaagtatcaagca

SEQ ID NO: 310622 - DNA, 20 bp, Artificial Sequence
  chemically synthesized
actttttaaattgaagtatc

SEQ ID NO: 310623 - DNA, 20 bp, Artificial Sequence
  chemically synthesized
ttatggtactttttaaattg

SEQ ID NO: 310624 - DNA, 20 bp, Artificial Sequence
  chemically synthesized
gcttgatacttcaatttaaa

SEQ ID NO: 310625 - DNA, 20 bp, Artificial Sequence
  chemically synthesized
tcaatttaaaaagtaccata

SEQ ID NO: 310626 - DNA, 20 bp, Artificial Sequence
  chemically synthesized
aaaaaaaaatgcaaacttta

SEQ ID NO: 310627 - DNA, 20 bp, Artificial Sequence
  chemically synthesized
taaagtttgcattttttttt

SEQ ID NO: 310628 - DNA, 20 bp, Artificial Sequence
  chemically synthesized
ttttttttcagaaccatcaa

SEQ ID NO: 310629 - DNA, 20 bp, Artificial Sequence
  chemically synthesized
gttatctgtttatctgttga

SEQ ID NO: 310630 - DNA, 20 bp, Artificial Sequence
  chemically synthesized
cagaaccatcaacagataaa

SEQ ID NO: 310631 - DNA, 20 bp, Artificial Sequence
  chemically synthesized
atcaacagataaacagataa

SEQ ID NO: 310632 - DNA, 20 bp, Artificial Sequence
  chemically synthesized
tcaacagataaacagataac

SEQ ID NO: 310633 - DNA, 20 bp, Artificial Sequence
  chemically synthesized
atacataatgcaatgttatt

SEQ ID NO: 310634 - DNA, 20 bp, Artificial Sequence
  chemically synthesized
caatgttatttggccataaa

SEQ ID NO: 310635 - DNA, 20 bp, Artificial Sequence
  chemically synthesized
aatgttatttggccataaaa

SEQ ID NO: 310636 - DNA, 20 bp, Artificial Sequence
  chemically synthesized
ctatatttcattccttttta

SEQ ID NO: 310637 - DNA, 20 bp, Artificial Sequence
  chemically synthesized
ccataaaaaggaatgaaata

SEQ ID NO: 310638 - DNA, 20 bp, Artificial Sequence
  chemically synthesized
tccatttatgttgttgcaaa

SEQ ID NO: 310639 - DNA, 20 bp, Artificial Sequence
  chemically synthesized
gctatttgcaacaacataaa

SEQ ID NO: 310640 - DNA, 20 bp, Artificial Sequence
  chemically synthesized
tgcaacaacataaatggaac

SEQ ID NO: 310641 - DNA, 20 bp, Artificial Sequence
  chemically synthesized
caacaacataaatggaactg

SEQ ID NO: 310642 - DNA, 20 bp, Artificial Sequence
  chemically synthesized
aacaacataaatggaactgg

SEQ ID NO: 310643 - DNA, 20 bp, Artificial Sequence
  chemically synthesized
ttatttaacataatgacctc

SEQ ID NO: 310644 - DNA, 20 bp, Artificial Sequence
  chemically synthesized
tggaggtcattatgttaaat

SEQ ID NO: 310645 - DNA, 20 bp, Artificial Sequence
  chemically synthesized
aggtcattatgttaaataag

SEQ ID NO: 310646 - DNA, 20 bp, Artificial Sequence
  chemically synthesized
ggtcattatgttaaataagc

SEQ ID NO: 310647 - DNA, 20 bp, Artificial Sequence
  chemically synthesized
ttatgttaaataagcaggca

SEQ ID NO: 310648 - DNA, 20 bp, Artificial Sequence
  chemically synthesized
gttaaataagcaggcacaga

SEQ ID NO: 310649 - DNA, 20 bp, Artificial Sequence
  chemically synthesized
cacatgtgaatgagaacatg

SEQ ID NO: 310650 - DNA, 20 bp, Artificial Sequence
  chemically synthesized
tttagctcccacatgtgaat

SEQ ID NO: 310651 - DNA, 20 bp, Artificial Sequence
  chemically synthesized
cacatgttctcattcacatg

SEQ ID NO: 310652 - DNA, 20 bp, Artificial Sequence
  chemically synthesized
acatgttctcattcacatgt

SEQ ID NO: 310653 - DNA, 20 bp, Artificial Sequence
  chemically synthesized
atgttctcattcacatgtgg

SEQ ID NO: 310654 - DNA, 20 bp, Artificial Sequence
  chemically synthesized
acatgtgggagctaaaaaat

SEQ ID NO: 310655 - DNA, 20 bp, Artificial Sequence
  chemically synthesized
ctctatgagatccaattttt

SEQ ID NO: 310656 - DNA, 20 bp, Artificial Sequence
  chemically synthesized
agctaaaaaattggatctca

SEQ ID NO: 310657 - DNA, 20 bp, Artificial Sequence
  chemically synthesized
ctaaaaaattggatctcata

SEQ ID NO: 310658 - DNA, 20 bp, Artificial Sequence
  chemically synthesized
aaaattggatctcatagagc

SEQ ID NO: 310659 - DNA, 20 bp, Artificial Sequence
  chemically synthesized
attctaatctctagctctat

SEQ ID NO: 310660 - DNA, 20 bp, Artificial Sequence
  chemically synthesized
aattggatctcatagagcta

SEQ ID NO: 310661 - DNA, 20 bp, Artificial Sequence
  chemically synthesized
gatctcatagagctagagat

SEQ ID NO: 310662 - DNA, 20 bp, Artificial Sequence
  chemically synthesized
gtatctatcattctaatctc

SEQ ID NO: 310663 - DNA, 20 bp, Artificial Sequence
  chemically synthesized
agagctagagattagaatga

SEQ ID NO: 310664 - DNA, 20 bp, Artificial Sequence
  chemically synthesized
gagattagaatgatagatac

SEQ ID NO: 310665 - DNA, 20 bp, Artificial Sequence
  chemically synthesized
gattagaatgatagatactg

SEQ ID NO: 310666 - DNA, 20 bp, Artificial Sequence
  chemically synthesized
gaatgatagatactggagac

SEQ ID NO: 310667 - DNA, 20 bp, Artificial Sequence
  chemically synthesized
aatgatagatactggagact

SEQ ID NO: 310668 - DNA, 20 bp, Artificial Sequence
  chemically synthesized
cacacactcttcccagtctc

SEQ ID NO: 310669 - DNA, 20 bp, Artificial Sequence
  chemically synthesized
gatagatactggagactggg

SEQ ID NO: 310670 - DNA, 20 bp, Artificial Sequence
  chemically synthesized
tagatactggagactgggaa

SEQ ID NO: 310671 - DNA, 20 bp, Artificial Sequence
  chemically synthesized
ttccatccacacactcttcc

SEQ ID NO: 310672 - DNA, 20 bp, Artificial Sequence
  chemically synthesized
tggagactgggaagagtgtg

SEQ ID NO: 310673 - DNA, 20 bp, Artificial Sequence
  chemically synthesized
gactgggaagagtgtgtgga

SEQ ID NO: 310674 - DNA, 20 bp, Artificial Sequence
  chemically synthesized
aagagtgtgtggatggaatg

SEQ ID NO: 310675 - DNA, 20 bp, Artificial Sequence
  chemically synthesized
gagtgtgtggatggaatgaa

SEQ ID NO: 310676 - DNA, 20 bp, Artificial Sequence
  chemically synthesized
gtgtgtggatggaatgaaga

SEQ ID NO: 310677 - DNA, 20 bp, Artificial Sequence
  chemically synthesized
tgtgtggatggaatgaagag

SEQ ID NO: 310678 - DNA, 20 bp, Artificial Sequence
  chemically synthesized
aatgaagagaggttgtttaa

SEQ ID NO: 310679 - DNA, 20 bp, Artificial Sequence
  chemically synthesized
atgaagagaggttgtttaat

SEQ ID NO: 310680 - DNA, 20 bp, Artificial Sequence
  chemically synthesized
gtttaatgggtacatacgct

SEQ ID NO: 310681 - DNA, 20 bp, Artificial Sequence
  chemically synthesized
aatgggtacatacgcttaga

SEQ ID NO: 310682 - DNA, 20 bp, Artificial Sequence
  chemically synthesized
gggtacatacgcttagatag

SEQ ID NO: 310683 - DNA, 20 bp, Artificial Sequence
  chemically synthesized
ggtacatacgcttagataga

SEQ ID NO: 310684 - DNA, 20 bp, Artificial Sequence
  chemically synthesized
agaacttattccttctatct

SEQ ID NO: 310685 - DNA, 20 bp, Artificial Sequence
  chemically synthesized
tacgcttagatagaaggaat

SEQ ID NO: 310686 - DNA, 20 bp, Artificial Sequence
  chemically synthesized
cctactctgctatcgaacat

SEQ ID NO: 310687 - DNA, 20 bp, Artificial Sequence
  chemically synthesized
gaataagttctaatgttcga

SEQ ID NO: 310688 - DNA, 20 bp, Artificial Sequence
  chemically synthesized
taagttctaatgttcgatag

SEQ ID NO: 310689 - DNA, 20 bp, Artificial Sequence
  chemically synthesized
agttctaatgttcgatagca

SEQ ID NO: 310690 - DNA, 20 bp, Artificial Sequence
  chemically synthesized
tctaatgttcgatagcagag

SEQ ID NO: 310691 - DNA, 20 bp, Artificial Sequence
  chemically synthesized
ctaatgttcgatagcagagt

SEQ ID NO: 310692 - DNA, 20 bp, Artificial Sequence
  chemically synthesized
atgttcgatagcagagtagg

SEQ ID NO: 310693 - DNA, 20 bp, Artificial Sequence
  chemically synthesized
cactgttgtatataattata

SEQ ID NO: 310694 - DNA, 20 bp, Artificial Sequence
  chemically synthesized
gactatataattatatacaa

SEQ ID NO: 310695 - DNA, 20 bp, Artificial Sequence
  chemically synthesized
aaatatcacatgtactctat

SEQ ID NO: 310696 - DNA, 20 bp, Artificial Sequence
  chemically synthesized
aatatttgtacatacttata

SEQ ID NO: 310697 - DNA, 20 bp, Artificial Sequence
  chemically synthesized
ataatatttgtacatactta

SEQ ID NO: 310698 - DNA, 20 bp, Artificial Sequence
  chemically synthesized
tacatttacaaaaaattttt

SEQ ID NO: 310699 - DNA, 20 bp, Artificial Sequence
  chemically synthesized
ataatattctttatgaatgc

SEQ ID NO: 310700 - DNA, 20 bp, Artificial Sequence
  chemically synthesized
tattaacacttgcattcata

SEQ ID NO: 310701 - DNA, 20 bp, Artificial Sequence
  chemically synthesized
gcattcataaagaatattat

SEQ ID NO: 310702 - DNA, 20 bp, Artificial Sequence
  chemically synthesized
tcataaagaatattattggc

SEQ ID NO: 310703 - DNA, 20 bp, Artificial Sequence
  chemically synthesized
cataaagaatattattggcc

SEQ ID NO: 310704 - DNA, 20 bp, Artificial Sequence
  chemically synthesized
aaagaatattattggccggg

SEQ ID NO: 310705 - DNA, 20 bp, Artificial Sequence
  chemically synthesized
aatattattggccgggtggc

SEQ ID NO: 310706 - DNA, 20 bp, Artificial Sequence
  chemically synthesized
atattattggccgggtggcc

SEQ ID NO: 310707 - DNA, 20 bp, Artificial Sequence
  chemically synthesized
agccaccacgcccggccacc

SEQ ID NO: 310708 - DNA, 20 bp, Artificial Sequence
  chemically synthesized
attggccgggtggccgggcg

SEQ ID NO: 310709 - DNA, 20 bp, Artificial Sequence
  chemically synthesized
ggccgggtggccgggcgtgg

SEQ ID NO: 310710 - DNA, 20 bp, Artificial Sequence
  chemically synthesized
caggcgtgagccaccacgcc

SEQ ID NO: 310711 - DNA, 20 bp, Artificial Sequence
  chemically synthesized
agtgctgggattacaggcgt

SEQ ID NO: 310712 - DNA, 20 bp, Artificial Sequence
  chemically synthesized
gtggctcacgcctgtaatcc

SEQ ID NO: 310713 - DNA, 20 bp, Artificial Sequence
  chemically synthesized
tcccaaagtgctgggattac

SEQ ID NO: 310714 - DNA, 20 bp, Artificial Sequence
  chemically synthesized
ctcccaaagtgctgggatta

SEQ ID NO: 310715 - DNA, 20 bp, Artificial Sequence
  chemically synthesized
cgcctgtaatcccagcactt

SEQ ID NO: 310716 - DNA, 20 bp, Artificial Sequence
  chemically synthesized
cctcggcctcccaaagtgct

SEQ ID NO: 310717 - DNA, 20 bp, Artificial Sequence
  chemically synthesized
gcctgtaatcccagcacttt

SEQ ID NO: 310718 - DNA, 20 bp, Artificial Sequence
  chemically synthesized
gcctcggcctcccaaagtgc

SEQ ID NO: 310719 - DNA, 20 bp, Artificial Sequence
  chemically synthesized
ctgtaatcccagcactttgg

SEQ ID NO: 310720 - DNA, 20 bp, Artificial Sequence
  chemically synthesized
tgtaatcccagcactttggg

SEQ ID NO: 310721 - DNA, 20 bp, Artificial Sequence
  chemically synthesized
ccgccagcctcggcctccca

SEQ ID NO: 310722 - DNA, 20 bp, Artificial Sequence
  chemically synthesized
tcccagcactttgggaggcc

SEQ ID NO: 310723 - DNA, 20 bp, Artificial Sequence
  chemically synthesized
cccagcactttgggaggccg

SEQ ID NO: 310724 - DNA, 20 bp, Artificial Sequence
  chemically synthesized
gcactttgggaggccgaggc

SEQ ID NO: 310725 - DNA, 20 bp, Artificial Sequence
  chemically synthesized
ctttgggaggccgaggctgg

SEQ ID NO: 310726 - DNA, 20 bp, Artificial Sequence
  chemically synthesized
acctcgtgatccgccagcct

SEQ ID NO: 310727 - DNA, 20 bp, Artificial Sequence
  chemically synthesized
ctcctgacctcgtgatccgc

SEQ ID NO: 310728 - DNA, 20 bp, Artificial Sequence
  chemically synthesized
ggccgaggctggcggatcac

SEQ ID NO: 310729 - DNA, 20 bp, Artificial Sequence
  chemically synthesized
gccgaggctggcggatcacg

SEQ ID NO: 310730 - DNA, 20 bp, Artificial Sequence
  chemically synthesized
aggctggcggatcacgaggt

SEQ ID NO: 310731 - DNA, 20 bp, Artificial Sequence
  chemically synthesized
ggctggcggatcacgaggtc

SEQ ID NO: 310732 - DNA, 20 bp, Artificial Sequence
  chemically synthesized
ctggcggatcacgaggtcag

SEQ ID NO: 310733 - DNA, 20 bp, Artificial Sequence
  chemically synthesized
gatcacgaggtcaggagatc

SEQ ID NO: 310734 - DNA, 20 bp, Artificial Sequence
  chemically synthesized
tcaggagatcaagaccaacc

SEQ ID NO: 310735 - DNA, 20 bp, Artificial Sequence
  chemically synthesized
tttcactgtgttagccaggt

SEQ ID NO: 310736 - DNA, 20 bp, Artificial Sequence
  chemically synthesized
tgggtttcactgtgttagcc

SEQ ID NO: 310737 - DNA, 20 bp, Artificial Sequence
  chemically synthesized
caagaccaacctggctaaca

SEQ ID NO: 310738 - DNA, 20 bp, Artificial Sequence
  chemically synthesized
atgggtttcactgtgttagc

SEQ ID NO: 310739 - DNA, 20 bp, Artificial Sequence
  chemically synthesized
agagatgggtttcactgtgt

SEQ ID NO: 310740 - DNA, 20 bp, Artificial Sequence
  chemically synthesized
cacagtgaaacccatctcta

SEQ ID NO: 310741 - DNA, 20 bp, Artificial Sequence
  chemically synthesized
tttgtattttctgtagagat

SEQ ID NO: 310742 - DNA, 20 bp, Artificial Sequence
  chemically synthesized
ttttgtattttctgtagaga

SEQ ID NO: 310743 - DNA, 20 bp, Artificial Sequence
  chemically synthesized
aattttttgtattttctgta

SEQ ID NO: 310744 - DNA, 20 bp, Artificial Sequence
  chemically synthesized
ctaattttttgtattttctg

SEQ ID NO: 310745 - DNA, 20 bp, Artificial Sequence
  chemically synthesized
ctacagaaaatacaaaaaat

SEQ ID NO: 310746 - DNA, 20 bp, Artificial Sequence
  chemically synthesized
agaaaatacaaaaaattagc

SEQ ID NO: 310747 - DNA, 20 bp, Artificial Sequence
  chemically synthesized
gaaaatacaaaaaattagcc

SEQ ID NO: 310748 - DNA, 20 bp, Artificial Sequence
  chemically synthesized
tacaaaaaattagccaggcg

SEQ ID NO: 310749 - DNA, 20 bp, Artificial Sequence
  chemically synthesized
aaaaaattagccaggcgtgg

SEQ ID NO: 310750 - DNA, 20 bp, Artificial Sequence
  chemically synthesized
caggcgcctgccaccacgcc

SEQ ID NO: 310751 - DNA, 20 bp, Artificial Sequence
  chemically synthesized
aaattagccaggcgtggtgg

SEQ ID NO: 310752 - DNA, 20 bp, Artificial Sequence
  chemically synthesized
aattagccaggcgtggtggc

SEQ ID NO: 310753 - DNA, 20 bp, Artificial Sequence
  chemically synthesized
ggcgtggtggcaggcgcctg

SEQ ID NO: 310754 - DNA, 20 bp, Artificial Sequence
  chemically synthesized
gtggcaggcgcctgcagtcc

SEQ ID NO: 310755 - DNA, 20 bp, Artificial Sequence
  chemically synthesized
tcccgagtagctgggactgc

SEQ ID NO: 310756 - DNA, 20 bp, Artificial Sequence
  chemically synthesized
ctcccgagtagctgggactg

SEQ ID NO: 310757 - DNA, 20 bp, Artificial Sequence
  chemically synthesized
cgcctgcagtcccagctact

SEQ ID NO: 310758 - DNA, 20 bp, Artificial Sequence
  chemically synthesized
cctcagactcccgagtagct

SEQ ID NO: 310759 - DNA, 20 bp, Artificial Sequence
  chemically synthesized
gcctgcagtcccagctactc

SEQ ID NO: 310760 - DNA, 20 bp, Artificial Sequence
  chemically synthesized
acctcagactcccgagtagc

SEQ ID NO: 310761 - DNA, 20 bp, Artificial Sequence
  chemically synthesized
ctgcagtcccagctactcgg

SEQ ID NO: 310762 - DNA, 20 bp, Artificial Sequence
  chemically synthesized
tcctacctcagactcccgag

SEQ ID NO: 310763 - DNA, 20 bp, Artificial Sequence
  chemically synthesized
ttctcctacctcagactccc

SEQ ID NO: 310764 - DNA, 20 bp, Artificial Sequence
  chemically synthesized
tcccagctactcgggagtct

SEQ ID NO: 310765 - DNA, 20 bp, Artificial Sequence
  chemically synthesized
cccagctactcgggagtctg

SEQ ID NO: 310766 - DNA, 20 bp, Artificial Sequence
  chemically synthesized
agctactcgggagtctgagg

SEQ ID NO: 310767 - DNA, 20 bp, Artificial Sequence
  chemically synthesized
gctactcgggagtctgaggt

SEQ ID NO: 310768 - DNA, 20 bp, Artificial Sequence
  chemically synthesized
tactcgggagtctgaggtag

SEQ ID NO: 310769 - DNA, 20 bp, Artificial Sequence
  chemically synthesized
ttcatgccattctcctacct

SEQ ID NO: 310770 - DNA, 20 bp, Artificial Sequence
  chemically synthesized
gggagtctgaggtaggagaa

SEQ ID NO: 310771 - DNA, 20 bp, Artificial Sequence
  chemically synthesized
gtaggagaatggcatgaacc

SEQ ID NO: 310772 - DNA, 20 bp, Artificial Sequence
  chemically synthesized
taggagaatggcatgaaccc

SEQ ID NO: 310773 - DNA, 20 bp, Artificial Sequence
  chemically synthesized
ggagaatggcatgaacccgg

SEQ ID NO: 310774 - DNA, 20 bp, Artificial Sequence
  chemically synthesized
gagaatggcatgaacccggg

SEQ ID NO: 310775 - DNA, 20 bp, Artificial Sequence
  chemically synthesized
aatggcatgaacccgggagg

SEQ ID NO: 310776 - DNA, 20 bp, Artificial Sequence
  chemically synthesized
cactgtaagctctgcctccc

SEQ ID NO: 310777 - DNA, 20 bp, Artificial Sequence
  chemically synthesized
tggcatgaacccgggaggca

SEQ ID NO: 310778 - DNA, 20 bp, Artificial Sequence
  chemically synthesized
tcactgtaagctctgcctcc

SEQ ID NO: 310779 - DNA, 20 bp, Artificial Sequence
  chemically synthesized
aacccgggaggcagagctta

SEQ ID NO: 310780 - DNA, 20 bp, Artificial Sequence
  chemically synthesized
cgggaggcagagcttacagt

SEQ ID NO: 310781 - DNA, 20 bp, Artificial Sequence
  chemically synthesized
gcgcgatctcggctcactgt

SEQ ID NO: 310782 - DNA, 20 bp, Artificial Sequence
  chemically synthesized
ggcagagcttacagtgagcc

SEQ ID NO: 310783 - DNA, 20 bp, Artificial Sequence
  chemically synthesized
ggagtgcagtggcgcgatct

SEQ ID NO: 310784 - DNA, 20 bp, Artificial Sequence
  chemically synthesized
tcacccaggctggagtgcag

SEQ ID NO: 310785 - DNA, 20 bp, Artificial Sequence
  chemically synthesized
gagatcgcgccactgcactc

SEQ ID NO: 310786 - DNA, 20 bp, Artificial Sequence
  chemically synthesized
ctgtcacccaggctggagtg

SEQ ID NO: 310787 - DNA, 20 bp, Artificial Sequence
  chemically synthesized
cgcgccactgcactccagcc

SEQ ID NO: 310788 - DNA, 20 bp, Artificial Sequence
  chemically synthesized
gcgccactgcactccagcct

SEQ ID NO: 310789 - DNA, 20 bp, Artificial Sequence
  chemically synthesized
ctgctctgtcacccaggctg

SEQ ID NO: 310790 - DNA, 20 bp, Artificial Sequence
  chemically synthesized
tcctgctctgtcacccaggc

SEQ ID NO: 310791 - DNA, 20 bp, Artificial Sequence
  chemically synthesized
ctgcactccagcctgggtga

SEQ ID NO: 310792 - DNA, 20 bp, Artificial Sequence
  chemically synthesized
ggagtcctgctctgtcaccc

SEQ ID NO: 310793 - DNA, 20 bp, Artificial Sequence
  chemically synthesized
gcactccagcctgggtgaca

SEQ ID NO: 310794 - DNA, 20 bp, Artificial Sequence
  chemically synthesized
cggagtcctgctctgtcacc

SEQ ID NO: 310795 - DNA, 20 bp, Artificial Sequence
  chemically synthesized
ctccagcctgggtgacagag

SEQ ID NO: 310796 - DNA, 20 bp, Artificial Sequence
  chemically synthesized
tccagcctgggtgacagagc

SEQ ID NO: 310797 - DNA, 20 bp, Artificial Sequence
  chemically synthesized
ttttttttttttttgagacg

SEQ ID NO: 310798 - DNA, 20 bp, Artificial Sequence
  chemically synthesized
ttttttttttttttttgaga

SEQ ID NO: 310799 - DNA, 20 bp, Artificial Sequence
  chemically synthesized
tttttttttttttttttttt

SEQ ID NO: 310800 - DNA, 20 bp, Artificial Sequence
  chemically synthesized
aaaaaaaaaaaaaaaaaaaa

SEQ ID NO: 310801 - DNA, 20 bp, Artificial Sequence
  chemically synthesized
aaaaaagaatattattgttc

SEQ ID NO: 310802 - DNA, 20 bp, Artificial Sequence
  chemically synthesized
ggaaatataagcaagtatgc

SEQ ID NO: 310803 - DNA, 20 bp, Artificial Sequence
  chemically synthesized
attacaggggaaatataagc

SEQ ID NO: 310804 - DNA, 20 bp, Artificial Sequence
  chemically synthesized
caaaattacaggggaaatat

SEQ ID NO: 310805 - DNA, 20 bp, Artificial Sequence
  chemically synthesized
cccaccatacaaaattacag

SEQ ID NO: 310806 - DNA, 20 bp, Artificial Sequence
  chemically synthesized
acccaccatacaaaattaca

SEQ ID NO: 310807 - DNA, 20 bp, Artificial Sequence
  chemically synthesized
tacccaccatacaaaattac

SEQ ID NO: 310808 - DNA, 20 bp, Artificial Sequence
  chemically synthesized
atacccaccatacaaaatta

SEQ ID NO: 310809 - DNA, 20 bp, Artificial Sequence
  chemically synthesized
atttcccctgtaattttgta

SEQ ID NO: 310810 - DNA, 20 bp, Artificial Sequence
  chemically synthesized
tcccctgtaattttgtatgg

SEQ ID NO: 310811 - DNA, 20 bp, Artificial Sequence
  chemically synthesized
cccctgtaattttgtatggt

SEQ ID NO: 310812 - DNA, 20 bp, Artificial Sequence
  chemically synthesized
caaatgaaactcaaagataa

SEQ ID NO: 310813 - DNA, 20 bp, Artificial Sequence
  chemically synthesized
ttatgatcactgttatcttt

SEQ ID NO: 310814 - DNA, 20 bp, Artificial Sequence
  chemically synthesized
aaattatcaaatgaaactca

SEQ ID NO: 310815 - DNA, 20 bp, Artificial Sequence
  chemically synthesized
catttgataatttttatcat

SEQ ID NO: 310816 - DNA, 20 bp, Artificial Sequence
  chemically synthesized
tttgataatttttatcatga

SEQ ID NO: 310817 - DNA, 20 bp, Artificial Sequence
  chemically synthesized
attctgactttataatttat

SEQ ID NO: 310818 - DNA, 20 bp, Artificial Sequence
  chemically synthesized
tgttcaactcataaattata

SEQ ID NO: 310819 - DNA, 20 bp, Artificial Sequence
  chemically synthesized
caactcataaattataaagt

SEQ ID NO: 310820 - DNA, 20 bp, Artificial Sequence
  chemically synthesized
cataaattataaagtcagaa

SEQ ID NO: 310821 - DNA, 20 bp, Artificial Sequence
  chemically synthesized
tataaagtcagaatagaaaa

SEQ ID NO: 310822 - DNA, 20 bp, Artificial Sequence
  chemically synthesized
gtcagaatagaaaacagatt

SEQ ID NO: 310823 - DNA, 20 bp, Artificial Sequence
  chemically synthesized
agaaaacagattgagtaatc

SEQ ID NO: 310824 - DNA, 20 bp, Artificial Sequence
  chemically synthesized
atttgaaagaacacaatgtc

SEQ ID NO: 310825 - DNA, 20 bp, Artificial Sequence
  chemically synthesized
agggtgttaggtagatttga

SEQ ID NO: 310826 - DNA, 20 bp, Artificial Sequence
  chemically synthesized
ttggccaatagggtgttagg

SEQ ID NO: 310827 - DNA, 20 bp, Artificial Sequence
  chemically synthesized
catttggccaatagggtgtt

SEQ ID NO: 310828 - DNA, 20 bp, Artificial Sequence
  chemically synthesized
acatttggccaatagggtgt

SEQ ID NO: 310829 - DNA, 20 bp, Artificial Sequence
  chemically synthesized
aaatctacctaacaccctat

SEQ ID NO: 310830 - DNA, 20 bp, Artificial Sequence
  chemically synthesized
tgtaatacatttggccaata

SEQ ID NO: 310831 - DNA, 20 bp, Artificial Sequence
  chemically synthesized
ttgtaatacatttggccaat

SEQ ID NO: 310832 - DNA, 20 bp, Artificial Sequence
  chemically synthesized
gttgtaatacatttggccaa

SEQ ID NO: 310833 - DNA, 20 bp, Artificial Sequence
  chemically synthesized
acggtctgttgtaatacatt

SEQ ID NO: 310834 - DNA, 20 bp, Artificial Sequence
  chemically synthesized
attggccaaatgtattacaa

SEQ ID NO: 310835 - DNA, 20 bp, Artificial Sequence
  chemically synthesized
tttcaatttatgttaataca

SEQ ID NO: 310836 - DNA, 20 bp, Artificial Sequence
  chemically synthesized
tattaacataaattgaaatc

SEQ ID NO: 310837 - DNA, 20 bp, Artificial Sequence
  chemically synthesized
tgtaagtatacagttaacgc

SEQ ID NO: 310838 - DNA, 20 bp, Artificial Sequence
  chemically synthesized
gccaatgtgctgtaagtata

SEQ ID NO: 310839 - DNA, 20 bp, Artificial Sequence
  chemically synthesized
tagcgttaactgtatactta

SEQ ID NO: 310840 - DNA, 20 bp, Artificial Sequence
  chemically synthesized
atccaaagccaatgtgctgt

SEQ ID NO: 310841 - DNA, 20 bp, Artificial Sequence
  chemically synthesized
actgtatacttacagcacat

SEQ ID NO: 310842 - DNA, 20 bp, Artificial Sequence
  chemically synthesized
tacttacagcacattggctt

SEQ ID NO: 310843 - DNA, 20 bp, Artificial Sequence
  chemically synthesized
taatgaaatttgaacatcca

SEQ ID NO: 310844 - DNA, 20 bp, Artificial Sequence
  chemically synthesized
tttggatgttcaaatttcat

SEQ ID NO: 310845 - DNA, 20 bp, Artificial Sequence
  chemically synthesized
tttcaactgcacattgtatc

SEQ ID NO: 310846 - DNA, 20 bp, Artificial Sequence
  chemically synthesized
tttatacttgatacaatgtg

SEQ ID NO: 310847 - DNA, 20 bp, Artificial Sequence
  chemically synthesized
aaaaaacaatgcacatatca

SEQ ID NO: 310848 - DNA, 20 bp, Artificial Sequence
  chemically synthesized
acttttgagtatgttttgat

SEQ ID NO: 310849 - DNA, 20 bp, Artificial Sequence
  chemically synthesized
gctgatcaaaacatactcaa

SEQ ID NO: 310850 - DNA, 20 bp, Artificial Sequence
  chemically synthesized
tcagttattagaaaactttt

SEQ ID NO: 310851 - DNA, 20 bp, Artificial Sequence
  chemically synthesized
atggcacatgattcagttat

SEQ ID NO: 310852 - DNA, 20 bp, Artificial Sequence
  chemically synthesized
atataaaatggcacatgatt

SEQ ID NO: 310853 - DNA, 20 bp, Artificial Sequence
  chemically synthesized
ttatttacttaaatataaaa

SEQ ID NO: 310854 - DNA, 20 bp, Artificial Sequence
  chemically synthesized
tcatgtgccattttatattt

SEQ ID NO: 310855 - DNA, 20 bp, Artificial Sequence
  chemically synthesized
agtaaataaaataaaaaatc

SEQ ID NO: 310856 - DNA, 20 bp, Artificial Sequence
  chemically synthesized
aataaaaaatccagttcctc

SEQ ID NO: 310857 - DNA, 20 bp, Artificial Sequence
  chemically synthesized
gactggtatgcttgaggaac

SEQ ID NO: 310858 - DNA, 20 bp, Artificial Sequence
  chemically synthesized
aattgtgactggtatgcttg

SEQ ID NO: 310859 - DNA, 20 bp, Artificial Sequence
  chemically synthesized
gaattgtgactggtatgctt

SEQ ID NO: 310860 - DNA, 20 bp, Artificial Sequence
  chemically synthesized
atccagttcctcaagcatac

SEQ ID NO: 310861 - DNA, 20 bp, Artificial Sequence
  chemically synthesized
ttgagcacttgaattgtgac

SEQ ID NO: 310862 - DNA, 20 bp, Artificial Sequence
  chemically synthesized
aagcataccagtcacaattc

SEQ ID NO: 310863 - DNA, 20 bp, Artificial Sequence
  chemically synthesized
cacaattcaagtgctcaaaa

SEQ ID NO: 310864 - DNA, 20 bp, Artificial Sequence
  chemically synthesized
tatacacctttggctatttt

SEQ ID NO: 310865 - DNA, 20 bp, Artificial Sequence
  chemically synthesized
tcaagtgctcaaaatagcca

SEQ ID NO: 310866 - DNA, 20 bp, Artificial Sequence
  chemically synthesized
caagtgctcaaaatagccaa

SEQ ID NO: 310867 - DNA, 20 bp, Artificial Sequence
  chemically synthesized
aggaagttgctatacacctt

SEQ ID NO: 310868 - DNA, 20 bp, Artificial Sequence
  chemically synthesized
tcaaaatagccaaaggtgta

SEQ ID NO: 310869 - DNA, 20 bp, Artificial Sequence
  chemically synthesized
aacgacactgttcagtaagg

SEQ ID NO: 310870 - DNA, 20 bp, Artificial Sequence
  chemically synthesized
atagcaacttccttactgaa

SEQ ID NO: 310871 - DNA, 20 bp, Artificial Sequence
  chemically synthesized
tagaacgacactgttcagta

SEQ ID NO: 310872 - DNA, 20 bp, Artificial Sequence
  chemically synthesized
ctagaacgacactgttcagt

SEQ ID NO: 310873 - DNA, 20 bp, Artificial Sequence
  chemically synthesized
ttttctagaacgacactgtt

SEQ ID NO: 310874 - DNA, 20 bp, Artificial Sequence
  chemically synthesized
cttactgaacagtgtcgttc

SEQ ID NO: 310875 - DNA, 20 bp, Artificial Sequence
  chemically synthesized
tgaacagtgtcgttctagaa

SEQ ID NO: 310876 - DNA, 20 bp, Artificial Sequence
  chemically synthesized
tataaaatttttttcttttc

SEQ ID NO: 310877 - DNA, 20 bp, Artificial Sequence
  chemically synthesized
cctgtcacactcgattgcat

SEQ ID NO: 310878 - DNA, 20 bp, Artificial Sequence
  chemically synthesized
ttttatatactaatgcaatc

SEQ ID NO: 310879 - DNA, 20 bp, Artificial Sequence
  chemically synthesized
actaatgcaatcgagtgtga

SEQ ID NO: 310880 - DNA, 20 bp, Artificial Sequence
  chemically synthesized
ctaatgcaatcgagtgtgac

SEQ ID NO: 310881 - DNA, 20 bp, Artificial Sequence
  chemically synthesized
atgtatatagtttatataag

SEQ ID NO: 310882 - DNA, 20 bp, Artificial Sequence
  chemically synthesized
tatatgtatatagtttatat

SEQ ID NO: 310883 - DNA, 20 bp, Artificial Sequence
  chemically synthesized
gaatggtttatatatgtata

SEQ ID NO: 310884 - DNA, 20 bp, Artificial Sequence
  chemically synthesized
aacactgttctagaagagaa

SEQ ID NO: 310885 - DNA, 20 bp, Artificial Sequence
  chemically synthesized
atatataaaccattctcttc

SEQ ID NO: 310886 - DNA, 20 bp, Artificial Sequence
  chemically synthesized
agaacaacactgttctagaa

SEQ ID NO: 310887 - DNA, 20 bp, Artificial Sequence
  chemically synthesized
taaaccattctcttctagaa

SEQ ID NO: 310888 - DNA, 20 bp, Artificial Sequence
  chemically synthesized
ctagaacaacactgttctag

SEQ ID NO: 310889 - DNA, 20 bp, Artificial Sequence
  chemically synthesized
cttctagaacaacactgttc

SEQ ID NO: 310890 - DNA, 20 bp, Artificial Sequence
  chemically synthesized
cttctagaacagtgttgttc

SEQ ID NO: 310891 - DNA, 20 bp, Artificial Sequence
  chemically synthesized
ctagaacagtgttgttctag

SEQ ID NO: 310892 - DNA, 20 bp, Artificial Sequence
  chemically synthesized
agaacagtgttgttctagaa

SEQ ID NO: 310893 - DNA, 20 bp, Artificial Sequence
  chemically synthesized
acataaatatttttctcttc

SEQ ID NO: 310894 - DNA, 20 bp, Artificial Sequence
  chemically synthesized
cctgtcccactcaattgcat

SEQ ID NO: 310895 - DNA, 20 bp, Artificial Sequence
  chemically synthesized
atttatgtactaatgcaatt

SEQ ID NO: 310896 - DNA, 20 bp, Artificial Sequence
  chemically synthesized
tatgtactaatgcaattgag

SEQ ID NO: 310897 - DNA, 20 bp, Artificial Sequence
  chemically synthesized
atgtactaatgcaattgagt

SEQ ID NO: 310898 - DNA, 20 bp, Artificial Sequence
  chemically synthesized
actaatgcaattgagtggga

SEQ ID NO: 310899 - DNA, 20 bp, Artificial Sequence
  chemically synthesized
ctaatgcaattgagtgggac

SEQ ID NO: 310900 - DNA, 20 bp, Artificial Sequence
  chemically synthesized
acatatatatttatttattt

SEQ ID NO: 310901 - DNA, 20 bp, Artificial Sequence
  chemically synthesized
catgaatgagttaaatttac

SEQ ID NO: 310902 - DNA, 20 bp, Artificial Sequence
  chemically synthesized
gatatagcatttgcatgaat

SEQ ID NO: 310903 - DNA, 20 bp, Artificial Sequence
  chemically synthesized
catatatatatgaatagata

SEQ ID NO: 310904 - DNA, 20 bp, Artificial Sequence
  chemically synthesized
tctattcatatatatatgaa

SEQ ID NO: 310905 - DNA, 20 bp, Artificial Sequence
  chemically synthesized
tctattcatatatatatgaa

SEQ ID NO: 310906 - DNA, 20 bp, Artificial Sequence
  chemically synthesized
aatagatattgcattttata

SEQ ID NO: 310907 - DNA, 20 bp, Artificial Sequence
  chemically synthesized
gatattgcattttatacaga

SEQ ID NO: 310908 - DNA, 20 bp, Artificial Sequence
  chemically synthesized
ttgcattttatacagataga

SEQ ID NO: 310909 - DNA, 20 bp, Artificial Sequence
  chemically synthesized
tagatagtatttgcatgaat

SEQ ID NO: 310910 - DNA, 20 bp, Artificial Sequence
  chemically synthesized
gcatgaatgagttaaattta

SEQ ID NO: 310911 - DNA, 20 bp, Artificial Sequence
  chemically synthesized
catgaatgagttaaatttac

SEQ ID NO: 310912 - DNA, 20 bp, Artificial Sequence
  chemically synthesized
gaatacattactgtgttaca

SEQ ID NO: 310913 - DNA, 20 bp, Artificial Sequence
  chemically synthesized
atacagaaacctatgtaaca

SEQ ID NO: 310914 - DNA, 20 bp, Artificial Sequence
  chemically synthesized
aatacattactgtgttacat

SEQ ID NO: 310915 - DNA, 20 bp, Artificial Sequence
  chemically synthesized
taatcagcaacgggggaata

SEQ ID NO: 310916 - DNA, 20 bp, Artificial Sequence
  chemically synthesized
ggtttactaatcagcaacgg

SEQ ID NO: 310917 - DNA, 20 bp, Artificial Sequence
  chemically synthesized
tggtttactaatcagcaacg

SEQ ID NO: 310918 - DNA, 20 bp, Artificial Sequence
  chemically synthesized
ttggtttactaatcagcaac

SEQ ID NO: 310919 - DNA, 20 bp, Artificial Sequence
  chemically synthesized
tttggtttactaatcagcaa

SEQ ID NO: 310920 - DNA, 20 bp, Artificial Sequence
  chemically synthesized
tgtattcccccgttgctgat

SEQ ID NO: 310921 - DNA, 20 bp, Artificial Sequence
  chemically synthesized
ttcagttttggtttactaat

SEQ ID NO: 310922 - DNA, 20 bp, Artificial Sequence
  chemically synthesized
tatgtgatttttttcagttt

SEQ ID NO: 310923 - DNA, 20 bp, Artificial Sequence
  chemically synthesized
gaaaattatgtgattttttt

SEQ ID NO: 310924 - DNA, 20 bp, Artificial Sequence
  chemically synthesized
aaaaatcacataattttcac

SEQ ID NO: 310925 - DNA, 20 bp, Artificial Sequence
  chemically synthesized
aaaatcacataattttcaca

SEQ ID NO: 310926 - DNA, 20 bp, Artificial Sequence
  chemically synthesized
ataattttcacaaggccaca

SEQ ID NO: 310927 - DNA, 20 bp, Artificial Sequence
  chemically synthesized
catagtagaaatttgctatg

SEQ ID NO: 310928 - DNA, 20 bp, Artificial Sequence
  chemically synthesized
ccaatctctcaaattcatag

SEQ ID NO: 310929 - DNA, 20 bp, Artificial Sequence
  chemically synthesized
caaatttctactatgaattt

SEQ ID NO: 310930 - DNA, 20 bp, Artificial Sequence
  chemically synthesized
ctcccaatctctcaaattca

SEQ ID NO: 310931 - DNA, 20 bp, Artificial Sequence
  chemically synthesized
aatttctactatgaatttga

SEQ ID NO: 310932 - DNA, 20 bp, Artificial Sequence
  chemically synthesized
ctactatgaatttgagagat

SEQ ID NO: 310933 - DNA, 20 bp, Artificial Sequence
  chemically synthesized
tactatgaatttgagagatt

SEQ ID NO: 310934 - DNA, 20 bp, Artificial Sequence
  chemically synthesized
ctatgaatttgagagattgg

SEQ ID NO: 310935 - DNA, 20 bp, Artificial Sequence
  chemically synthesized
tgagagattgggagaaatct

SEQ ID NO: 310936 - DNA, 20 bp, Artificial Sequence
  chemically synthesized
gagagattgggagaaatctc

SEQ ID NO: 310937 - DNA, 20 bp, Artificial Sequence
  chemically synthesized
attgggagaaatctcaggtt

SEQ ID NO: 310938 - DNA, 20 bp, Artificial Sequence
  chemically synthesized
gatgtgtgacaactcaacct

SEQ ID NO: 310939 - DNA, 20 bp, Artificial Sequence
  chemically synthesized
gttgtcacacatctgaatac

SEQ ID NO: 310940 - DNA, 20 bp, Artificial Sequence
  chemically synthesized
gcaaggctgacactggtatt

SEQ ID NO: 310941 - DNA, 20 bp, Artificial Sequence
  chemically synthesized
acacatctgaataccagtgt

SEQ ID NO: 310942 - DNA, 20 bp, Artificial Sequence
  chemically synthesized
gcaggtggcaaggctgacac

SEQ ID NO: 310943 - DNA, 20 bp, Artificial Sequence
  chemically synthesized
catatagcttgcaggtggca

SEQ ID NO: 310944 - DNA, 20 bp, Artificial Sequence
  chemically synthesized
tcatatagcttgcaggtggc

SEQ ID NO: 310945 - DNA, 20 bp, Artificial Sequence
  chemically synthesized
gtgtcagccttgccacctgc

SEQ ID NO: 310946 - DNA, 20 bp, Artificial Sequence
  chemically synthesized
aagttcatatagcttgcagg

SEQ ID NO: 310947 - DNA, 20 bp, Artificial Sequence
  chemically synthesized
tccaagttcatatagcttgc

SEQ ID NO: 310948 - DNA, 20 bp, Artificial Sequence
  chemically synthesized
atccaagttcatatagcttg

SEQ ID NO: 310949 - DNA, 20 bp, Artificial Sequence
  chemically synthesized
aagttaaatccaagttcata

SEQ ID NO: 310950 - DNA, 20 bp, Artificial Sequence
  chemically synthesized
acctgcaagctatatgaact

SEQ ID NO: 310951 - DNA, 20 bp, Artificial Sequence
  chemically synthesized
tgcataatgaagttaaatcc

SEQ ID NO: 310952 - DNA, 20 bp, Artificial Sequence
  chemically synthesized
gagaaagccaatgcataatg

SEQ ID NO: 310953 - DNA, 20 bp, Artificial Sequence
  chemically synthesized
gatttaacttcattatgcat

SEQ ID NO: 310954 - DNA, 20 bp, Artificial Sequence
  chemically synthesized
accctatatcacaaatgaga

SEQ ID NO: 310955 - DNA, 20 bp, Artificial Sequence
  chemically synthesized
gccaaccctatatcacaaat

SEQ ID NO: 310956 - DNA, 20 bp, Artificial Sequence
  chemically synthesized
tggctttctcatttgtgata

SEQ ID NO: 310957 - DNA, 20 bp, Artificial Sequence
  chemically synthesized
ggctttctcatttgtgatat

SEQ ID NO: 310958 - DNA, 20 bp, Artificial Sequence
  chemically synthesized
gctttctcatttgtgatata

SEQ ID NO: 310959 - DNA, 20 bp, Artificial Sequence
  chemically synthesized
tctcatttgtgatatagggt

SEQ ID NO: 310960 - DNA, 20 bp, Artificial Sequence
  chemically synthesized
tagggttggcattacataca

SEQ ID NO: 310961 - DNA, 20 bp, Artificial Sequence
  chemically synthesized
attagattattatttttcag

SEQ ID NO: 310962 - DNA, 20 bp, Artificial Sequence
  chemically synthesized
ttattagattattatttttc

SEQ ID NO: 310963 - DNA, 20 bp, Artificial Sequence
  chemically synthesized
attattagattattattttt

SEQ ID NO: 310964 - DNA, 20 bp, Artificial Sequence
  chemically synthesized
gaagcaataattataattat

SEQ ID NO: 310965 - DNA, 20 bp, Artificial Sequence
  chemically synthesized
taattataattattgcttct

SEQ ID NO: 310966 - DNA, 20 bp, Artificial Sequence
  chemically synthesized
aattataattattgcttctt

SEQ ID NO: 310967 - DNA, 20 bp, Artificial Sequence
  chemically synthesized
atcaacatttgttgcccaag

SEQ ID NO: 310968 - DNA, 20 bp, Artificial Sequence
  chemically synthesized
agcatcaacatttgttgccc

SEQ ID NO: 310969 - DNA, 20 bp, Artificial Sequence
  chemically synthesized
gggcaacaaatgttgatgct

SEQ ID NO: 310970 - DNA, 20 bp, Artificial Sequence
  chemically synthesized
aatgttgatgcttagctttg

SEQ ID NO: 310971 - DNA, 20 bp, Artificial Sequence
  chemically synthesized
tggaaataatccacaaagct

SEQ ID NO: 310972 - DNA, 20 bp, Artificial Sequence
  chemically synthesized
tgtgatggaaataatccaca

SEQ ID NO: 310973 - DNA, 20 bp, Artificial Sequence
  chemically synthesized
aaaaaaaactttaaatgtga

SEQ ID NO: 310974 - DNA, 20 bp, Artificial Sequence
  chemically synthesized
gattatttccatcacattta

SEQ ID NO: 310975 - DNA, 20 bp, Artificial Sequence
  chemically synthesized
ctagttcctaattttatatt

SEQ ID NO: 310976 - DNA, 20 bp, Artificial Sequence
  chemically synthesized
taattcaccaaatataaaat

SEQ ID NO: 310977 - DNA, 20 bp, Artificial Sequence
  chemically synthesized
aattcaccaaatataaaatt

SEQ ID NO: 310978 - DNA, 20 bp, Artificial Sequence
  chemically synthesized
ccaaatataaaattaggaac

SEQ ID NO: 310979 - DNA, 20 bp, Artificial Sequence
  chemically synthesized
aaatataaaattaggaacta

SEQ ID NO: 310980 - DNA, 20 bp, Artificial Sequence
  chemically synthesized
aacattttgatgtttcgctc

SEQ ID NO: 310981 - DNA, 20 bp, Artificial Sequence
  chemically synthesized
gttatttatgaagaggaata

SEQ ID NO: 310982 - DNA, 20 bp, Artificial Sequence
  chemically synthesized
aatagaagttatttatgaag

SEQ ID NO: 310983 - DNA, 20 bp, Artificial Sequence
  chemically synthesized
aaatagaagttatttatgaa

SEQ ID NO: 310984 - DNA, 20 bp, Artificial Sequence
  chemically synthesized
agaaatagaagttatttatg

SEQ ID NO: 310985 - DNA, 20 bp, Artificial Sequence
  chemically synthesized
cctatcaaattaagaaatag

SEQ ID NO: 310986 - DNA, 20 bp, Artificial Sequence
  chemically synthesized
gaccctatcaaattaagaaa

SEQ ID NO: 310987 - DNA, 20 bp, Artificial Sequence
  chemically synthesized
acttctatttcttaatttga

SEQ ID NO: 310988 - DNA, 20 bp, Artificial Sequence
  chemically synthesized
atgttagaccctatcaaatt

SEQ ID NO: 310989 - DNA, 20 bp, Artificial Sequence
  chemically synthesized
cttctatttcttaatttgat

SEQ ID NO: 310990 - DNA, 20 bp, Artificial Sequence
  chemically synthesized
ttctatttcttaatttgata

SEQ ID NO: 310991 - DNA, 20 bp, Artificial Sequence
  chemically synthesized
aagaaaattttatagaatgt

SEQ ID NO: 310992 - DNA, 20 bp, Artificial Sequence
  chemically synthesized
gtatgagaaagaaaatttta

SEQ ID NO: 310993 - DNA, 20 bp, Artificial Sequence
  chemically synthesized
atcttcgggatagtatgaga

SEQ ID NO: 310994 - DNA, 20 bp, Artificial Sequence
  chemically synthesized
acatatcttcgggatagtat

SEQ ID NO: 310995 - DNA, 20 bp, Artificial Sequence
  chemically synthesized
ttctttctcatactatcccg

SEQ ID NO: 310996 - DNA, 20 bp, Artificial Sequence
  chemically synthesized
tatagtacatatcttcggga

SEQ ID NO: 310997 - DNA, 20 bp, Artificial Sequence
  chemically synthesized
tttttatagtacatatcttc

SEQ ID NO: 310998 - DNA, 20 bp, Artificial Sequence
  chemically synthesized
atttttatagtacatatctt

SEQ ID NO: 310999 - DNA, 20 bp, Artificial Sequence
  chemically synthesized
ttaggtaactgaaattttta

SEQ ID NO: 311000 - DNA, 20 bp, Artificial Sequence
  chemically synthesized
gatatgtactataaaaattt

SEQ ID NO: 311001 - DNA, 20 bp, Artificial Sequence
  chemically synthesized
tcatcacctaaatgtcagtt

SEQ ID NO: 311002 - DNA, 20 bp, Artificial Sequence
  chemically synthesized
ctcatcacctaaatgtcagt

SEQ ID NO: 311003 - DNA, 20 bp, Artificial Sequence
  chemically synthesized
tcagttacctaactgacatt

SEQ ID NO: 311004 - DNA, 20 bp, Artificial Sequence
  chemically synthesized
cagttacctaactgacattt

SEQ ID NO: 311005 - DNA, 20 bp, Artificial Sequence
  chemically synthesized
ttctctcatcacctaaatgt

SEQ ID NO: 311006 - DNA, 20 bp, Artificial Sequence
  chemically synthesized
ctaactgacatttaggtgat

SEQ ID NO: 311007 - DNA, 20 bp, Artificial Sequence
  chemically synthesized
aactgacatttaggtgatga

SEQ ID NO: 311008 - DNA, 20 bp, Artificial Sequence
  chemically synthesized
gttcagaaagacgataaagt

SEQ ID NO: 311009 - DNA, 20 bp, Artificial Sequence
  chemically synthesized
agttgttcagaaagacgata

SEQ ID NO: 311010 - DNA, 20 bp, Artificial Sequence
  chemically synthesized
gtgaaaggtagttgttcaga

SEQ ID NO: 311011 - DNA, 20 bp, Artificial Sequence
  chemically synthesized
tactgtgaaaggtagttgtt

SEQ ID NO: 311012 - DNA, 20 bp, Artificial Sequence
  chemically synthesized
ttctgaacaactacctttca

SEQ ID NO: 311013 - DNA, 20 bp, Artificial Sequence
  chemically synthesized
aaatgctatactgtgaaagg

SEQ ID NO: 311014 - DNA, 20 bp, Artificial Sequence
  chemically synthesized
agaaaatgctatactgtgaa

SEQ ID NO: 311015 - DNA, 20 bp, Artificial Sequence
  chemically synthesized
aagaaaatgctatactgtga

SEQ ID NO: 311016 - DNA, 20 bp, Artificial Sequence
  chemically synthesized
aacaactacctttcacagta

SEQ ID NO: 311017 - DNA, 20 bp, Artificial Sequence
  chemically synthesized
cagtatagcattttctttcc

SEQ ID NO: 311018 - DNA, 20 bp, Artificial Sequence
  chemically synthesized
tatagcattttctttccaag

SEQ ID NO: 311019 - DNA, 20 bp, Artificial Sequence
  chemically synthesized
aaataacaaagccacttgga

SEQ ID NO: 311020 - DNA, 20 bp, Artificial Sequence
  chemically synthesized
gttaaaataacaaagccact

SEQ ID NO: 311021 - DNA, 20 bp, Artificial Sequence
  chemically synthesized
aagagaatgttaaaataaca

SEQ ID NO: 311022 - DNA, 20 bp, Artificial Sequence
  chemically synthesized
tgctatatctcagttacaaa

SEQ ID NO: 311023 - DNA, 20 bp, Artificial Sequence
  chemically synthesized
ttaacattctctttgtaact

SEQ ID NO: 311024 - DNA, 20 bp, Artificial Sequence
  chemically synthesized
tgtgctatatctcagttaca

SEQ ID NO: 311025 - DNA, 20 bp, Artificial Sequence
  chemically synthesized
ttctctttgtaactgagata

SEQ ID NO: 311026 - DNA, 20 bp, Artificial Sequence
  chemically synthesized
aaagggaatgtgctatatct

SEQ ID NO: 311027 - DNA, 20 bp, Artificial Sequence
  chemically synthesized
agtatcacacaggttacaaa

SEQ ID NO: 311028 - DNA, 20 bp, Artificial Sequence
  chemically synthesized
gagtatcacacaggttacaa

SEQ ID NO: 311029 - DNA, 20 bp, Artificial Sequence
  chemically synthesized
tgagtatcacacaggttaca

SEQ ID NO: 311030 - DNA, 20 bp, Artificial Sequence
  chemically synthesized
gtgtaacatgagtatcacac

SEQ ID NO: 311031 - DNA, 20 bp, Artificial Sequence
  chemically synthesized
tgtgtaacatgagtatcaca

SEQ ID NO: 311032 - DNA, 20 bp, Artificial Sequence
  chemically synthesized
agttttaacttgtgtaacat

SEQ ID NO: 311033 - DNA, 20 bp, Artificial Sequence
  chemically synthesized
gtgtgatactcatgttacac

SEQ ID NO: 311034 - DNA, 20 bp, Artificial Sequence
  chemically synthesized
attgctgttagtgtcgttaa

SEQ ID NO: 311035 - DNA, 20 bp, Artificial Sequence
  chemically synthesized
aaaactattaacgacactaa

SEQ ID NO: 311036 - DNA, 20 bp, Artificial Sequence
  chemically synthesized
atctctttggacattgctgt

SEQ ID NO: 311037 - DNA, 20 bp, Artificial Sequence
  chemically synthesized
gacactaacagcaatgtcca

SEQ ID NO: 311038 - DNA, 20 bp, Artificial Sequence
  chemically synthesized
cactaacagcaatgtccaaa

SEQ ID NO: 311039 - DNA, 20 bp, Artificial Sequence
  chemically synthesized
atttaatggtaacatctctt

SEQ ID NO: 311040 - DNA, 20 bp, Artificial Sequence
  chemically synthesized
taagaatgacagacatttaa

SEQ ID NO: 311041 - DNA, 20 bp, Artificial Sequence
  chemically synthesized
taagtagacaataagaatga

SEQ ID NO: 311042 - DNA, 20 bp, Artificial Sequence
  chemically synthesized
aatctggataagtagacaat

SEQ ID NO: 311043 - DNA, 20 bp, Artificial Sequence
  chemically synthesized
attcttattgtctacttatc

SEQ ID NO: 311044 - DNA, 20 bp, Artificial Sequence
  chemically synthesized
aggtgacaaatctggataag

SEQ ID NO: 311045 - DNA, 20 bp, Artificial Sequence
  chemically synthesized
taaaggtgacaaatctggat

SEQ ID NO: 311046 - DNA, 20 bp, Artificial Sequence
  chemically synthesized
atttttaaaggtgacaaatc

SEQ ID NO: 311047 - DNA, 20 bp, Artificial Sequence
  chemically synthesized
ccaacagtgataatttttaa

SEQ ID NO: 311048 - DNA, 20 bp, Artificial Sequence
  chemically synthesized
accaacagtgataattttta

SEQ ID NO: 311049 - DNA, 20 bp, Artificial Sequence
  chemically synthesized
cctttaaaaattatcactgt

SEQ ID NO: 311050 - DNA, 20 bp, Artificial Sequence
  chemically synthesized
ctgccaattattttgaccaa

SEQ ID NO: 311051 - DNA, 20 bp, Artificial Sequence
  chemically synthesized
tcactgttggtcaaaataat

SEQ ID NO: 311052 - DNA, 20 bp, Artificial Sequence
  chemically synthesized
ctgttggtcaaaataattgg

SEQ ID NO: 311053 - DNA, 20 bp, Artificial Sequence
  chemically synthesized
tcaaaataattggcagaatg

SEQ ID NO: 311054 - DNA, 20 bp, Artificial Sequence
  chemically synthesized
tataatggcaaaatataaag

SEQ ID NO: 311055 - DNA, 20 bp, Artificial Sequence
  chemically synthesized
gaatataatggcaaaatata

SEQ ID NO: 311056 - DNA, 20 bp, Artificial Sequence
  chemically synthesized
ttatattttgccattatatt

SEQ ID NO: 311057 - DNA, 20 bp, Artificial Sequence
  chemically synthesized
aaaaaacaatctgaatataa

SEQ ID NO: 311058 - DNA, 20 bp, Artificial Sequence
  chemically synthesized
cagattgttttttcttatga

SEQ ID NO: 311059 - DNA, 20 bp, Artificial Sequence
  chemically synthesized
attctcaaaattactttcat

SEQ ID NO: 311060 - DNA, 20 bp, Artificial Sequence
  chemically synthesized
tttcttatgaaagtaatttt

SEQ ID NO: 311061 - DNA, 20 bp, Artificial Sequence
  chemically synthesized
tttgagaatcatgcttttta

SEQ ID NO: 311062 - DNA, 20 bp, Artificial Sequence
  chemically synthesized
tagagaacttcagctttaaa

SEQ ID NO: 311063 - DNA, 20 bp, Artificial Sequence
  chemically synthesized
aatcatgctttttaaagctg

SEQ ID NO: 311064 - DNA, 20 bp, Artificial Sequence
  chemically synthesized
cctcattctgtagagaactt

SEQ ID NO: 311065 - DNA, 20 bp, Artificial Sequence
  chemically synthesized
tttaaagctgaagttctcta

SEQ ID NO: 311066 - DNA, 20 bp, Artificial Sequence
  chemically synthesized
taattctccctcattctgta

SEQ ID NO: 311067 - DNA, 20 bp, Artificial Sequence
  chemically synthesized
gctgaagttctctacagaat

SEQ ID NO: 311068 - DNA, 20 bp, Artificial Sequence
  chemically synthesized
ctgaagttctctacagaatg

SEQ ID NO: 311069 - DNA, 20 bp, Artificial Sequence
  chemically synthesized
cataattctccctcattctg

SEQ ID NO: 311070 - DNA, 20 bp, Artificial Sequence
  chemically synthesized
tgaagttctctacagaatga

SEQ ID NO: 311071 - DNA, 20 bp, Artificial Sequence
  chemically synthesized
aagttctctacagaatgagg

SEQ ID NO: 311072 - DNA, 20 bp, Artificial Sequence
  chemically synthesized
agggagaattatgcttctac

SEQ ID NO: 311073 - DNA, 20 bp, Artificial Sequence
  chemically synthesized
tgcccaatcttatctagtag

SEQ ID NO: 311074 - DNA, 20 bp, Artificial Sequence
  chemically synthesized
gaattatgcttctactagat

SEQ ID NO: 311075 - DNA, 20 bp, Artificial Sequence
  chemically synthesized
tactgcccaatcttatctag

SEQ ID NO: 311076 - DNA, 20 bp, Artificial Sequence
  chemically synthesized
aaatactgcccaatcttatc

SEQ ID NO: 311077 - DNA, 20 bp, Artificial Sequence
  chemically synthesized
atgcttctactagataagat

SEQ ID NO: 311078 - DNA, 20 bp, Artificial Sequence
  chemically synthesized
tgcttctactagataagatt

SEQ ID NO: 311079 - DNA, 20 bp, Artificial Sequence
  chemically synthesized
ttctactagataagattggg

SEQ ID NO: 311080 - DNA, 20 bp, Artificial Sequence
  chemically synthesized
gtggagtgcaagaaaataaa

SEQ ID NO: 311081 - DNA, 20 bp, Artificial Sequence
  chemically synthesized
ggtggagtgcaagaaaataa

SEQ ID NO: 311082 - DNA, 20 bp, Artificial Sequence
  chemically synthesized
ttccaatacaggtggagtgc

SEQ ID NO: 311083 - DNA, 20 bp, Artificial Sequence
  chemically synthesized
tgtcccttccaatacaggtg

SEQ ID NO: 311084 - DNA, 20 bp, Artificial Sequence
  chemically synthesized
ttcttgcactccacctgtat

SEQ ID NO: 311085 - DNA, 20 bp, Artificial Sequence
  chemically synthesized
aatgtcccttccaatacagg

SEQ ID NO: 311086 - DNA, 20 bp, Artificial Sequence
  chemically synthesized
ttgcactccacctgtattgg

SEQ ID NO: 311087 - DNA, 20 bp, Artificial Sequence
  chemically synthesized
tccaatgtcccttccaatac

SEQ ID NO: 311088 - DNA, 20 bp, Artificial Sequence
  chemically synthesized
tgcactccacctgtattgga

SEQ ID NO: 311089 - DNA, 20 bp, Artificial Sequence
  chemically synthesized
ctccaatgtcccttccaata

SEQ ID NO: 311090 - DNA, 20 bp, Artificial Sequence
  chemically synthesized
gcactccacctgtattggaa

SEQ ID NO: 311091 - DNA, 20 bp, Artificial Sequence
  chemically synthesized
acctgtattggaagggacat

SEQ ID NO: 311092 - DNA, 20 bp, Artificial Sequence
  chemically synthesized
ctgtattggaagggacattg

SEQ ID NO: 311093 - DNA, 20 bp, Artificial Sequence
  chemically synthesized
tgtattggaagggacattgg

SEQ ID NO: 311094 - DNA, 20 bp, Artificial Sequence
  chemically synthesized
aagggacattggaggctatc

SEQ ID NO: 311095 - DNA, 20 bp, Artificial Sequence
  chemically synthesized
gagtgggaagttagacttga

SEQ ID NO: 311096 - DNA, 20 bp, Artificial Sequence
  chemically synthesized
tgacatactgagtgggaagt

SEQ ID NO: 311097 - DNA, 20 bp, Artificial Sequence
  chemically synthesized
atcaagtctaacttcccact

SEQ ID NO: 311098 - DNA, 20 bp, Artificial Sequence
  chemically synthesized
gaggtgacatactgagtggg

SEQ ID NO: 311099 - DNA, 20 bp, Artificial Sequence
  chemically synthesized
aaagaggtgacatactgagt

SEQ ID NO: 311100 - DNA, 20 bp, Artificial Sequence
  chemically synthesized
aaaagaggtgacatactgag

SEQ ID NO: 311101 - DNA, 20 bp, Artificial Sequence
  chemically synthesized
tttaaaagaggtgacatact

SEQ ID NO: 311102 - DNA, 20 bp, Artificial Sequence
  chemically synthesized
gttcaagtatgttttaaaag

SEQ ID NO: 311103 - DNA, 20 bp, Artificial Sequence
  chemically synthesized
tgttcaagtatgttttaaaa

SEQ ID NO: 311104 - DNA, 20 bp, Artificial Sequence
  chemically synthesized
catgttcaagtatgttttaa

SEQ ID NO: 311105 - DNA, 20 bp, Artificial Sequence
  chemically synthesized
tttaaaacatacttgaacat

SEQ ID NO: 311106 - DNA, 20 bp, Artificial Sequence
  chemically synthesized
caaactggaatctcatgttc

SEQ ID NO: 311107 - DNA, 20 bp, Artificial Sequence
  chemically synthesized
catacttgaacatgagattc

SEQ ID NO: 311108 - DNA, 20 bp, Artificial Sequence
  chemically synthesized
taataatatttaacacaaac

SEQ ID NO: 311109 - DNA, 20 bp, Artificial Sequence
  chemically synthesized
tgtgttaaatattattaatg

SEQ ID NO: 311110 - DNA, 20 bp, Artificial Sequence
  chemically synthesized
taaatattattaatgaagaa

SEQ ID NO: 311111 - DNA, 20 bp, Artificial Sequence
  chemically synthesized
taagagctgtggaaagtggt

SEQ ID NO: 311112 - DNA, 20 bp, Artificial Sequence
  chemically synthesized
gaacagctcaccactttcca

SEQ ID NO: 311113 - DNA, 20 bp, Artificial Sequence
  chemically synthesized
gcgataagagctgtggaaag

SEQ ID NO: 311114 - DNA, 20 bp, Artificial Sequence
  chemically synthesized
aatgcgataagagctgtgga

SEQ ID NO: 311115 - DNA, 20 bp, Artificial Sequence
  chemically synthesized
ttacaatgcgataagagctg

SEQ ID NO: 311116 - DNA, 20 bp, Artificial Sequence
  chemically synthesized
gcattcttacaatgcgataa

SEQ ID NO: 311117 - DNA, 20 bp, Artificial Sequence
  chemically synthesized
gagcattcttacaatgcgat

SEQ ID NO: 311118 - DNA, 20 bp, Artificial Sequence
  chemically synthesized
cacagctcttatcgcattgt

SEQ ID NO: 311119 - DNA, 20 bp, Artificial Sequence
  chemically synthesized
atcgcattgtaagaatgctc

SEQ ID NO: 311120 - DNA, 20 bp, Artificial Sequence
  chemically synthesized
tcgcattgtaagaatgctct

SEQ ID NO: 311121 - DNA, 20 bp, Artificial Sequence
  chemically synthesized
ttattatcatcatcagccca

SEQ ID NO: 311122 - DNA, 20 bp, Artificial Sequence
  chemically synthesized
tattattatcatcatcagcc

SEQ ID NO: 311123 - DNA, 20 bp, Artificial Sequence
  chemically synthesized
gttactattattatcatcat

SEQ ID NO: 311124 - DNA, 20 bp, Artificial Sequence
  chemically synthesized
tgggctgatgatgataataa

SEQ ID NO: 311125 - DNA, 20 bp, Artificial Sequence
  chemically synthesized
atagtaagcaataataatat

SEQ ID NO: 311126 - DNA, 20 bp, Artificial Sequence
  chemically synthesized
aaaaatcactgaaatatagt

SEQ ID NO: 311127 - DNA, 20 bp, Artificial Sequence
  chemically synthesized
tattattgcttactatattt

SEQ ID NO: 311128 - DNA, 20 bp, Artificial Sequence
  chemically synthesized
atttaaaaatcactgaaata

SEQ ID NO: 311129 - DNA, 20 bp, Artificial Sequence
  chemically synthesized
tcagtgatttttaaatgctt

SEQ ID NO: 311130 - DNA, 20 bp, Artificial Sequence
  chemically synthesized
aaagggtagttgagaagcta

SEQ ID NO: 311131 - DNA, 20 bp, Artificial Sequence
  chemically synthesized
agggtaaaagggtagttgag

SEQ ID NO: 311132 - DNA, 20 bp, Artificial Sequence
  chemically synthesized
taaagggtaaaagggtagtt

SEQ ID NO: 311133 - DNA, 20 bp, Artificial Sequence
  chemically synthesized
atctgtaaagggtaaaaggg

SEQ ID NO: 311134 - DNA, 20 bp, Artificial Sequence
  chemically synthesized
gatatctgtaaagggtaaaa

SEQ ID NO: 311135 - DNA, 20 bp, Artificial Sequence
  chemically synthesized
agatatctgtaaagggtaaa

SEQ ID NO: 311136 - DNA, 20 bp, Artificial Sequence
  chemically synthesized
cagatatctgtaaagggtaa

SEQ ID NO: 311137 - DNA, 20 bp, Artificial Sequence
  chemically synthesized
aactacccttttacccttta

SEQ ID NO: 311138 - DNA, 20 bp, Artificial Sequence
  chemically synthesized
cattatcagatatctgtaaa

SEQ ID NO: 311139 - DNA, 20 bp, Artificial Sequence
  chemically synthesized
acattatcagatatctgtaa

SEQ ID NO: 311140 - DNA, 20 bp, Artificial Sequence
  chemically synthesized
tacattatcagatatctgta

SEQ ID NO: 311141 - DNA, 20 bp, Artificial Sequence
  chemically synthesized
tttacagatatctgataatg

SEQ ID NO: 311142 - DNA, 20 bp, Artificial Sequence
  chemically synthesized
ttacagatatctgataatgt

SEQ ID NO: 311143 - DNA, 20 bp, Artificial Sequence
  chemically synthesized
tgtattagaacctacattat

SEQ ID NO: 311144 - DNA, 20 bp, Artificial Sequence
  chemically synthesized
ctttaatatgaagattgtat

SEQ ID NO: 311145 - DNA, 20 bp, Artificial Sequence
  chemically synthesized
ctaatacaatcttcatatta

SEQ ID NO: 311146 - DNA, 20 bp, Artificial Sequence
  chemically synthesized
gtttccccatctttaatatg

SEQ ID NO: 311147 - DNA, 20 bp, Artificial Sequence
  chemically synthesized
tacaatcttcatattaaaga

SEQ ID NO: 311148 - DNA, 20 bp, Artificial Sequence
  chemically synthesized
acaatcttcatattaaagat

SEQ ID NO: 311149 - DNA, 20 bp, Artificial Sequence
  chemically synthesized
caatcttcatattaaagatg

SEQ ID NO: 311150 - DNA, 20 bp, Artificial Sequence
  chemically synthesized
tattaaagatggggaaacta

SEQ ID NO: 311151 - DNA, 20 bp, Artificial Sequence
  chemically synthesized
aagatggggaaactaaagcc

SEQ ID NO: 311152 - DNA, 20 bp, Artificial Sequence
  chemically synthesized
agatggggaaactaaagcca

SEQ ID NO: 311153 - DNA, 20 bp, Artificial Sequence
  chemically synthesized
cacttaaccatccttggctt

SEQ ID NO: 311154 - DNA, 20 bp, Artificial Sequence
  chemically synthesized
ggggaaactaaagccaagga

SEQ ID NO: 311155 - DNA, 20 bp, Artificial Sequence
  chemically synthesized
gcaagtcacttaaccatcct

SEQ ID NO: 311156 - DNA, 20 bp, Artificial Sequence
  chemically synthesized
aactaaagccaaggatggtt

SEQ ID NO: 311157 - DNA, 20 bp, Artificial Sequence
  chemically synthesized
atggttaagtgacttgccca

SEQ ID NO: 311158 - DNA, 20 bp, Artificial Sequence
  chemically synthesized
tggttaagtgacttgcccaa

SEQ ID NO: 311159 - DNA, 20 bp, Artificial Sequence
  chemically synthesized
tctacagtatacctttgggc

SEQ ID NO: 311160 - DNA, 20 bp, Artificial Sequence
  chemically synthesized
cttatctacagtataccttt

SEQ ID NO: 311161 - DNA, 20 bp, Artificial Sequence
  chemically synthesized
ccttatctacagtatacctt

SEQ ID NO: 311162 - DNA, 20 bp, Artificial Sequence
  chemically synthesized
acttgcccaaaggtatactg

SEQ ID NO: 311163 - DNA, 20 bp, Artificial Sequence
  chemically synthesized
cccaaaggtatactgtagat

SEQ ID NO: 311164 - DNA, 20 bp, Artificial Sequence
  chemically synthesized
ccaaaggtatactgtagata

SEQ ID NO: 311165 - DNA, 20 bp, Artificial Sequence
  chemically synthesized
cctgctctgttccttatcta

SEQ ID NO: 311166 - DNA, 20 bp, Artificial Sequence
  chemically synthesized
ggtatactgtagataaggaa

SEQ ID NO: 311167 - DNA, 20 bp, Artificial Sequence
  chemically synthesized
tatactgtagataaggaaca

SEQ ID NO: 311168 - DNA, 20 bp, Artificial Sequence
  chemically synthesized
actgtagataaggaacagag

SEQ ID NO: 311169 - DNA, 20 bp, Artificial Sequence
  chemically synthesized
ctgtagataaggaacagagc

SEQ ID NO: 311170 - DNA, 20 bp, Artificial Sequence
  chemically synthesized
tagataaggaacagagcagg

SEQ ID NO: 311171 - DNA, 20 bp, Artificial Sequence
  chemically synthesized
agataaggaacagagcagga

SEQ ID NO: 311172 - DNA, 20 bp, Artificial Sequence
  chemically synthesized
gataaggaacagagcaggaa

SEQ ID NO: 311173 - DNA, 20 bp, Artificial Sequence
  chemically synthesized
gagcaggaagggtctatttc

SEQ ID NO: 311174 - DNA, 20 bp, Artificial Sequence
  chemically synthesized
gcaggaagggtctatttcta

SEQ ID NO: 311175 - DNA, 20 bp, Artificial Sequence
  chemically synthesized
aagaggagaaactctagaaa

SEQ ID NO: 311176 - DNA, 20 bp, Artificial Sequence
  chemically synthesized
gtaattaagaggagaaactc

SEQ ID NO: 311177 - DNA, 20 bp, Artificial Sequence
  chemically synthesized
tgttgtaaggtaattaagag

SEQ ID NO: 311178 - DNA, 20 bp, Artificial Sequence
  chemically synthesized
tttgttgtaaggtaattaag

SEQ ID NO: 311179 - DNA, 20 bp, Artificial Sequence
  chemically synthesized
ttttgttgtaaggtaattaa

SEQ ID NO: 311180 - DNA, 20 bp, Artificial Sequence
  chemically synthesized
ctttttgttgtaaggtaatt

SEQ ID NO: 311181 - DNA, 20 bp, Artificial Sequence
  chemically synthesized
agggagagctttttgttgta

SEQ ID NO: 311182 - DNA, 20 bp, Artificial Sequence
  chemically synthesized
aagggagagctttttgttgt

SEQ ID NO: 311183 - DNA, 20 bp, Artificial Sequence
  chemically synthesized
cttaattaccttacaacaaa

SEQ ID NO: 311184 - DNA, 20 bp, Artificial Sequence
  chemically synthesized
tttttttgacttaaaaggga

SEQ ID NO: 311185 - DNA, 20 bp, Artificial Sequence
  chemically synthesized
aacaaaaagctctccctttt

SEQ ID NO: 311186 - DNA, 20 bp, Artificial Sequence
  chemically synthesized
gatttttttgacttaaaagg

SEQ ID NO: 311187 - DNA, 20 bp, Artificial Sequence
  chemically synthesized
aagatttttttgacttaaaa

SEQ ID NO: 311188 - DNA, 20 bp, Artificial Sequence
  chemically synthesized
aaagatttttttgacttaaa

SEQ ID NO: 311189 - DNA, 20 bp, Artificial Sequence
  chemically synthesized
gaaagatttttttgacttaa

SEQ ID NO: 311190 - DNA, 20 bp, Artificial Sequence
  chemically synthesized
taagtcaaaaaaatctttct

SEQ ID NO: 311191 - DNA, 20 bp, Artificial Sequence
  chemically synthesized
ggttggatataattccaaga

SEQ ID NO: 311192 - DNA, 20 bp, Artificial Sequence
  chemically synthesized
agacggttggatataattcc

SEQ ID NO: 311193 - DNA, 20 bp, Artificial Sequence
  chemically synthesized
tgaacctatgaacagacggt

SEQ ID NO: 311194 - DNA, 20 bp, Artificial Sequence
  chemically synthesized
tgaatgaacctatgaacaga

SEQ ID NO: 311195 - DNA, 20 bp, Artificial Sequence
  chemically synthesized
tatatccaaccgtctgttca

SEQ ID NO: 311196 - DNA, 20 bp, Artificial Sequence
  chemically synthesized
atatccaaccgtctgttcat

SEQ ID NO: 311197 - DNA, 20 bp, Artificial Sequence
  chemically synthesized
taactgaatgaacctatgaa

SEQ ID NO: 311198 - DNA, 20 bp, Artificial Sequence
  chemically synthesized
cgtctgttcataggttcatt

SEQ ID NO: 311199 - DNA, 20 bp, Artificial Sequence
  chemically synthesized
ggttcattcagttatcttac

SEQ ID NO: 311200 - DNA, 20 bp, Artificial Sequence
  chemically synthesized
aagtaatcagtaattcttgt

SEQ ID NO: 311201 - DNA, 20 bp, Artificial Sequence
  chemically synthesized
cattgtcagatacaagtaat

SEQ ID NO: 311202 - DNA, 20 bp, Artificial Sequence
  chemically synthesized
ttgcctgcattgtcagatac

SEQ ID NO: 311203 - DNA, 20 bp, Artificial Sequence
  chemically synthesized
attacttgtatctgacaatg

SEQ ID NO: 311204 - DNA, 20 bp, Artificial Sequence
  chemically synthesized
ttacttgtatctgacaatgc

SEQ ID NO: 311205 - DNA, 20 bp, Artificial Sequence
  chemically synthesized
cacattcttgcctgcattgt

SEQ ID NO: 311206 - DNA, 20 bp, Artificial Sequence
  chemically synthesized
ttgtatctgacaatgcaggc

SEQ ID NO: 311207 - DNA, 20 bp, Artificial Sequence
  chemically synthesized
caatgcaggcaagaatgtgt

SEQ ID NO: 311208 - DNA, 20 bp, Artificial Sequence
  chemically synthesized
tattagaatctaaattacat

SEQ ID NO: 311209 - DNA, 20 bp, Artificial Sequence
  chemically synthesized
aagacacatctcatgtaatt

SEQ ID NO: 311210 - DNA, 20 bp, Artificial Sequence
  chemically synthesized
tgtaatttagattctaataa

SEQ ID NO: 311211 - DNA, 20 bp, Artificial Sequence
  chemically synthesized
taatttagattctaataaaa

SEQ ID NO: 311212 - DNA, 20 bp, Artificial Sequence
  chemically synthesized
aatgtgctttactcttttat

SEQ ID NO: 311213 - DNA, 20 bp, Artificial Sequence
  chemically synthesized
tagattctaataaaagagta

SEQ ID NO: 311214 - DNA, 20 bp, Artificial Sequence
  chemically synthesized
cacattaatattaactgcaa

SEQ ID NO: 311215 - DNA, 20 bp, Artificial Sequence
  chemically synthesized
gcaccgatcatatacttttg

SEQ ID NO: 311216 - DNA, 20 bp, Artificial Sequence
  chemically synthesized
taactgcaaaagtatatgat

SEQ ID NO: 311217 - DNA, 20 bp, Artificial Sequence
  chemically synthesized
gtatatgatcggtgcccaaa

SEQ ID NO: 311218 - DNA, 20 bp, Artificial Sequence
  chemically synthesized
taccctaattgtgtctgttt

SEQ ID NO: 311219 - DNA, 20 bp, Artificial Sequence
  chemically synthesized
gtaccctaattgtgtctgtt

SEQ ID NO: 311220 - DNA, 20 bp, Artificial Sequence
  chemically synthesized
ggtgcccaaacagacacaat

SEQ ID NO: 311221 - DNA, 20 bp, Artificial Sequence
  chemically synthesized
gtgcccaaacagacacaatt

SEQ ID NO: 311222 - DNA, 20 bp, Artificial Sequence
  chemically synthesized
tgcccaaacagacacaatta

SEQ ID NO: 311223 - DNA, 20 bp, Artificial Sequence
  chemically synthesized
aaacagacacaattagggta

SEQ ID NO: 311224 - DNA, 20 bp, Artificial Sequence
  chemically synthesized
acacaattagggtacagaca

SEQ ID NO: 311225 - DNA, 20 bp, Artificial Sequence
  chemically synthesized
tagggtacagacatggcaca

SEQ ID NO: 311226 - DNA, 20 bp, Artificial Sequence
  chemically synthesized
gggtacagacatggcacaaa

SEQ ID NO: 311227 - DNA, 20 bp, Artificial Sequence
  chemically synthesized
ggtacagacatggcacaaag

SEQ ID NO: 311228 - DNA, 20 bp, Artificial Sequence
  chemically synthesized
gtacagacatggcacaaaga

SEQ ID NO: 311229 - DNA, 20 bp, Artificial Sequence
  chemically synthesized
acagacatggcacaaagagg

SEQ ID NO: 311230 - DNA, 20 bp, Artificial Sequence
  chemically synthesized
gacatggcacaaagagggag

SEQ ID NO: 311231 - DNA, 20 bp, Artificial Sequence
  chemically synthesized
aaagagggagtagtcatcac

SEQ ID NO: 311232 - DNA, 20 bp, Artificial Sequence
  chemically synthesized
aagagggagtagtcatcact

SEQ ID NO: 311233 - DNA, 20 bp, Artificial Sequence
  chemically synthesized
agggagtagtcatcactagg

SEQ ID NO: 311234 - DNA, 20 bp, Artificial Sequence
  chemically synthesized
ggagtagtcatcactaggta

SEQ ID NO: 311235 - DNA, 20 bp, Artificial Sequence
  chemically synthesized
gtagtcatcactaggtagag

SEQ ID NO: 311236 - DNA, 20 bp, Artificial Sequence
  chemically synthesized
atgaaattggccactctacc

SEQ ID NO: 311237 - DNA, 20 bp, Artificial Sequence
  chemically synthesized
aggtagagtggccaatttca

SEQ ID NO: 311238 - DNA, 20 bp, Artificial Sequence
  chemically synthesized
caagttttcctccatgaaat

SEQ ID NO: 311239 - DNA, 20 bp, Artificial Sequence
  chemically synthesized
gtagagtggccaatttcatg

SEQ ID NO: 311240 - DNA, 20 bp, Artificial Sequence
  chemically synthesized
tagagtggccaatttcatgg

SEQ ID NO: 311241 - DNA, 20 bp, Artificial Sequence
  chemically synthesized
catggaggaaaacttgaaat

SEQ ID NO: 311242 - DNA, 20 bp, Artificial Sequence
  chemically synthesized
atgtatagaaaactcatttc

SEQ ID NO: 311243 - DNA, 20 bp, Artificial Sequence
  chemically synthesized
tgaaatgagttttctataca

SEQ ID NO: 311244 - DNA, 20 bp, Artificial Sequence
  chemically synthesized
ttgataatttcatctatgta

SEQ ID NO: 311245 - DNA, 20 bp, Artificial Sequence
  chemically synthesized
atacatagatgaaattatca

SEQ ID NO: 311246 - DNA, 20 bp, Artificial Sequence
  chemically synthesized
catagatgaaattatcaaag

SEQ ID NO: 311247 - DNA, 20 bp, Artificial Sequence
  chemically synthesized
ttatcaaagcagatcttatg

SEQ ID NO: 311248 - DNA, 20 bp, Artificial Sequence
  chemically synthesized
tcaaagcagatcttatgaag

SEQ ID NO: 311249 - DNA, 20 bp, Artificial Sequence
  chemically synthesized
aacagacgactctgcttcat

SEQ ID NO: 311250 - DNA, 20 bp, Artificial Sequence
  chemically synthesized
aaagcagatcttatgaagca

SEQ ID NO: 311251 - DNA, 20 bp, Artificial Sequence
  chemically synthesized
cacataccaccgggtttaaa

SEQ ID NO: 311252 - DNA, 20 bp, Artificial Sequence
  chemically synthesized
cagagtcgtctgtttaaacc

SEQ ID NO: 311253 - DNA, 20 bp, Artificial Sequence
  chemically synthesized
agtcgtctgtttaaacccgg

SEQ ID NO: 311254 - DNA, 20 bp, Artificial Sequence
  chemically synthesized
acctctttgcacataccacc

SEQ ID NO: 311255 - DNA, 20 bp, Artificial Sequence
  chemically synthesized
gacctctttgcacataccac

SEQ ID NO: 311256 - DNA, 20 bp, Artificial Sequence
  chemically synthesized
taaacccggtggtatgtgca

SEQ ID NO: 311257 - DNA, 20 bp, Artificial Sequence
  chemically synthesized
aacccggtggtatgtgcaaa

SEQ ID NO: 311258 - DNA, 20 bp, Artificial Sequence
  chemically synthesized
acccggtggtatgtgcaaag

SEQ ID NO: 311259 - DNA, 20 bp, Artificial Sequence
  chemically synthesized
tgcaaagaggtcgtaacata

SEQ ID NO: 311260 - DNA, 20 bp, Artificial Sequence
  chemically synthesized
gcaaagaggtcgtaacatac

SEQ ID NO: 311261 - DNA, 20 bp, Artificial Sequence
  chemically synthesized
caaagaggtcgtaacataca

SEQ ID NO: 311262 - DNA, 20 bp, Artificial Sequence
  chemically synthesized
ggtcgtaacatacagggtat

SEQ ID NO: 311263 - DNA, 20 bp, Artificial Sequence
  chemically synthesized
aacatacagggtatcagaaa

SEQ ID NO: 311264 - DNA, 20 bp, Artificial Sequence
  chemically synthesized
aacctgcatttgattcatac

SEQ ID NO: 311265 - DNA, 20 bp, Artificial Sequence
  chemically synthesized
cagcttgtatgaatcaaatg

SEQ ID NO: 311266 - DNA, 20 bp, Artificial Sequence
  chemically synthesized
agcttgtatgaatcaaatgc

SEQ ID NO: 311267 - DNA, 20 bp, Artificial Sequence
  chemically synthesized
gtatgaatcaaatgcaggtt

SEQ ID NO: 311268 - DNA, 20 bp, Artificial Sequence
  chemically synthesized
tatgaatcaaatgcaggttg

SEQ ID NO: 311269 - DNA, 20 bp, Artificial Sequence
  chemically synthesized
atgaatcaaatgcaggttga

SEQ ID NO: 311270 - DNA, 20 bp, Artificial Sequence
  chemically synthesized
aatgcaggttgagggacata

SEQ ID NO: 311271 - DNA, 20 bp, Artificial Sequence
  chemically synthesized
gcaggttgagggacataaag

SEQ ID NO: 311272 - DNA, 20 bp, Artificial Sequence
  chemically synthesized
ggacataaagcagataacat

SEQ ID NO: 311273 - DNA, 20 bp, Artificial Sequence
  chemically synthesized
taaagcagataacatgagac

SEQ ID NO: 311274 - DNA, 20 bp, Artificial Sequence
  chemically synthesized
gataacatgagacaagtcta

SEQ ID NO: 311275 - DNA, 20 bp, Artificial Sequence
  chemically synthesized
taacatgagacaagtctata

SEQ ID NO: 311276 - DNA, 20 bp, Artificial Sequence
  chemically synthesized
tgagacaagtctatagagac

SEQ ID NO: 311277 - DNA, 20 bp, Artificial Sequence
  chemically synthesized
ctgactcctaccagtctcta

SEQ ID NO: 311278 - DNA, 20 bp, Artificial Sequence
  chemically synthesized
gacaagtctatagagactgg

SEQ ID NO: 311279 - DNA, 20 bp, Artificial Sequence
  chemically synthesized
acaagtctatagagactggt

SEQ ID NO: 311280 - DNA, 20 bp, Artificial Sequence
  chemically synthesized
aagtctatagagactggtag

SEQ ID NO: 311281 - DNA, 20 bp, Artificial Sequence
  chemically synthesized
tttgattacctgactcctac

SEQ ID NO: 311282 - DNA, 20 bp, Artificial Sequence
  chemically synthesized
ctatagagactggtaggagt

SEQ ID NO: 311283 - DNA, 20 bp, Artificial Sequence
  chemically synthesized
tatagagactggtaggagtc

SEQ ID NO: 311284 - DNA, 20 bp, Artificial Sequence
  chemically synthesized
tcaggtaatcaaataccttg

SEQ ID NO: 311285 - DNA, 20 bp, Artificial Sequence
  chemically synthesized
caggtaatcaaataccttgt

SEQ ID NO: 311286 - DNA, 20 bp, Artificial Sequence
  chemically synthesized
ttctgatactttggcctaca

SEQ ID NO: 311287 - DNA, 20 bp, Artificial Sequence
  chemically synthesized
attctgatactttggcctac

SEQ ID NO: 311288 - DNA, 20 bp, Artificial Sequence
  chemically synthesized
atcaaataccttgtaggcca

SEQ ID NO: 311289 - DNA, 20 bp, Artificial Sequence
  chemically synthesized
taccttgtaggccaaagtat

SEQ ID NO: 311290 - DNA, 20 bp, Artificial Sequence
  chemically synthesized
ctttccagattctgatactt

SEQ ID NO: 311291 - DNA, 20 bp, Artificial Sequence
  chemically synthesized
taggccaaagtatcagaatc

SEQ ID NO: 311292 - DNA, 20 bp, Artificial Sequence
  chemically synthesized
ccaaagtatcagaatctgga

SEQ ID NO: 311293 - DNA, 20 bp, Artificial Sequence
  chemically synthesized
taaaatcctgagtcactttc

SEQ ID NO: 311294 - DNA, 20 bp, Artificial Sequence
  chemically synthesized
tcagaatctggaaagtgact

SEQ ID NO: 311295 - DNA, 20 bp, Artificial Sequence
  chemically synthesized
cagaatctggaaagtgactc

SEQ ID NO: 311296 - DNA, 20 bp, Artificial Sequence
  chemically synthesized
tctcctttgcttaaaatcct

SEQ ID NO: 311297 - DNA, 20 bp, Artificial Sequence
  chemically synthesized
ggaaagtgactcaggatttt

SEQ ID NO: 311298 - DNA, 20 bp, Artificial Sequence
  chemically synthesized
gtgactcaggattttaagca

SEQ ID NO: 311299 - DNA, 20 bp, Artificial Sequence
  chemically synthesized
tgactcaggattttaagcaa

SEQ ID NO: 311300 - DNA, 20 bp, Artificial Sequence
  chemically synthesized
actcaggattttaagcaaag

SEQ ID NO: 311301 - DNA, 20 bp, Artificial Sequence
  chemically synthesized
agcaaaggagaacgattaaa

SEQ ID NO: 311302 - DNA, 20 bp, Artificial Sequence
  chemically synthesized
gcaaaggagaacgattaaac

SEQ ID NO: 311303 - DNA, 20 bp, Artificial Sequence
  chemically synthesized
agaacgattaaacaggctct

SEQ ID NO: 311304 - DNA, 20 bp, Artificial Sequence
  chemically synthesized
gaacgattaaacaggctctt

SEQ ID NO: 311305 - DNA, 20 bp, Artificial Sequence
  chemically synthesized
aagtcagtgtgggttcccaa

SEQ ID NO: 311306 - DNA, 20 bp, Artificial Sequence
  chemically synthesized
tgaagtcagtgtgggttccc

SEQ ID NO: 311307 - DNA, 20 bp, Artificial Sequence
  chemically synthesized
ctccacattgaagtcagtgt

SEQ ID NO: 311308 - DNA, 20 bp, Artificial Sequence
  chemically synthesized
tctccacattgaagtcagtg

SEQ ID NO: 311309 - DNA, 20 bp, Artificial Sequence
  chemically synthesized
tccaatctccacattgaagt

SEQ ID NO: 311310 - DNA, 20 bp, Artificial Sequence
  chemically synthesized
aacccacactgacttcaatg

SEQ ID NO: 311311 - DNA, 20 bp, Artificial Sequence
  chemically synthesized
cccacactgacttcaatgtg

SEQ ID NO: 311312 - DNA, 20 bp, Artificial Sequence
  chemically synthesized
tccatccaatctccacattg

SEQ ID NO: 311313 - DNA, 20 bp, Artificial Sequence
  chemically synthesized
actgacttcaatgtggagat

SEQ ID NO: 311314 - DNA, 20 bp, Artificial Sequence
  chemically synthesized
acttcaatgtggagattgga

SEQ ID NO: 311315 - DNA, 20 bp, Artificial Sequence
  chemically synthesized
tcaatgtggagattggatgg

SEQ ID NO: 311316 - DNA, 20 bp, Artificial Sequence
  chemically synthesized
aatgtggagattggatggaa

SEQ ID NO: 311317 - DNA, 20 bp, Artificial Sequence
  chemically synthesized
gtggagattggatggaagag

SEQ ID NO: 311318 - DNA, 20 bp, Artificial Sequence
  chemically synthesized
agattggatggaagagcggt

SEQ ID NO: 311319 - DNA, 20 bp, Artificial Sequence
  chemically synthesized
atggaagagcggtaagactg

SEQ ID NO: 311320 - DNA, 20 bp, Artificial Sequence
  chemically synthesized
tggaagagcggtaagactga

SEQ ID NO: 311321 - DNA, 20 bp, Artificial Sequence
  chemically synthesized
agagcggtaagactgaaggc

SEQ ID NO: 311322 - DNA, 20 bp, Artificial Sequence
  chemically synthesized
gagcggtaagactgaaggca

SEQ ID NO: 311323 - DNA, 20 bp, Artificial Sequence
  chemically synthesized
gcccccaaagtccttgcctt

SEQ ID NO: 311324 - DNA, 20 bp, Artificial Sequence
  chemically synthesized
aagactgaaggcaaggactt

SEQ ID NO: 311325 - DNA, 20 bp, Artificial Sequence
  chemically synthesized
agactgaaggcaaggacttt

SEQ ID NO: 311326 - DNA, 20 bp, Artificial Sequence
  chemically synthesized
gactgaaggcaaggactttg

SEQ ID NO: 311327 - DNA, 20 bp, Artificial Sequence
  chemically synthesized
actgaaggcaaggactttgg

SEQ ID NO: 311328 - DNA, 20 bp, Artificial Sequence
  chemically synthesized
ggccatatcataagccccca

SEQ ID NO: 311329 - DNA, 20 bp, Artificial Sequence
  chemically synthesized
gactttgggggcttatgata

SEQ ID NO: 311330 - DNA, 20 bp, Artificial Sequence
  chemically synthesized
caaggtataggccatatcat

SEQ ID NO: 311331 - DNA, 20 bp, Artificial Sequence
  chemically synthesized
tatgatatggcctatacctt

SEQ ID NO: 311332 - DNA, 20 bp, Artificial Sequence
  chemically synthesized
gtcaacatttctcaaggtat

SEQ ID NO: 311333 - DNA, 20 bp, Artificial Sequence
  chemically synthesized
tgtcaacatttctcaaggta

SEQ ID NO: 311334 - DNA, 20 bp, Artificial Sequence
  chemically synthesized
gttcttgtcaacatttctca

SEQ ID NO: 311335 - DNA, 20 bp, Artificial Sequence
  chemically synthesized
tgttcttgtcaacatttctc

SEQ ID NO: 311336 - DNA, 20 bp, Artificial Sequence
  chemically synthesized
ataccttgagaaatgttgac

SEQ ID NO: 311337 - DNA, 20 bp, Artificial Sequence
  chemically synthesized
gagaaatgttgacaagaaca

SEQ ID NO: 311338 - DNA, 20 bp, Artificial Sequence
  chemically synthesized
aaagatgaaataataaatac

SEQ ID NO: 311339 - DNA, 20 bp, Artificial Sequence
  chemically synthesized
tgaaataataaatacaagat

SEQ ID NO: 311340 - DNA, 20 bp, Artificial Sequence
  chemically synthesized
gaaataataaatacaagata

SEQ ID NO: 311341 - DNA, 20 bp, Artificial Sequence
  chemically synthesized
aataaatacaagataaggtt

SEQ ID NO: 311342 - DNA, 20 bp, Artificial Sequence
  chemically synthesized
atattttgacattgcatgca

SEQ ID NO: 311343 - DNA, 20 bp, Artificial Sequence
  chemically synthesized
tattttgacattgcatgcaa

SEQ ID NO: 311344 - DNA, 20 bp, Artificial Sequence
  chemically synthesized
attttgacattgcatgcaaa

SEQ ID NO: 311345 - DNA, 20 bp, Artificial Sequence
  chemically synthesized
attgcatgcaaagggctcat

SEQ ID NO: 311346 - DNA, 20 bp, Artificial Sequence
  chemically synthesized
ttgcatgcaaagggctcata

SEQ ID NO: 311347 - DNA, 20 bp, Artificial Sequence
  chemically synthesized
tgcatgcaaagggctcataa

SEQ ID NO: 311348 - DNA, 20 bp, Artificial Sequence
  chemically synthesized
atccctgtcctttcccttat

SEQ ID NO: 311349 - DNA, 20 bp, Artificial Sequence
  chemically synthesized
tgcaaagggctcataaggga

SEQ ID NO: 311350 - DNA, 20 bp, Artificial Sequence
  chemically synthesized
gcaaagggctcataagggaa

SEQ ID NO: 311351 - DNA, 20 bp, Artificial Sequence
  chemically synthesized
agggctcataagggaaagga

SEQ ID NO: 311352 - DNA, 20 bp, Artificial Sequence
  chemically synthesized
gggctcataagggaaaggac

SEQ ID NO: 311353 - DNA, 20 bp, Artificial Sequence
  chemically synthesized
ggctcataagggaaaggaca

SEQ ID NO: 311354 - DNA, 20 bp, Artificial Sequence
  chemically synthesized
ggaaaggacagggatgaatt

SEQ ID NO: 311355 - DNA, 20 bp, Artificial Sequence
  chemically synthesized
gaaaggacagggatgaattt

SEQ ID NO: 311356 - DNA, 20 bp, Artificial Sequence
  chemically synthesized
aaaggacagggatgaatttg

SEQ ID NO: 311357 - DNA, 20 bp, Artificial Sequence
  chemically synthesized
gatgaatttggggatgactc

SEQ ID NO: 311358 - DNA, 20 bp, Artificial Sequence
  chemically synthesized
atgaatttggggatgactct

SEQ ID NO: 311359 - DNA, 20 bp, Artificial Sequence
  chemically synthesized
acacctgtaccagaaaccta

SEQ ID NO: 311360 - DNA, 20 bp, Artificial Sequence
  chemically synthesized
tggggatgactctaggtttc

SEQ ID NO: 311361 - DNA, 20 bp, Artificial Sequence
  chemically synthesized
tgacacctgtaccagaaacc

SEQ ID NO: 311362 - DNA, 20 bp, Artificial Sequence
  chemically synthesized
atgactctaggtttctggta

SEQ ID NO: 311363 - DNA, 20 bp, Artificial Sequence
  chemically synthesized
tgactctaggtttctggtac

SEQ ID NO: 311364 - DNA, 20 bp, Artificial Sequence
  chemically synthesized
acttatcatgacacctgtac

SEQ ID NO: 311365 - DNA, 20 bp, Artificial Sequence
  chemically synthesized
tctggtacaggtgtcatgat

SEQ ID NO: 311366 - DNA, 20 bp, Artificial Sequence
  chemically synthesized
acaggtgtcatgataagtgc

SEQ ID NO: 311367 - DNA, 20 bp, Artificial Sequence
  chemically synthesized
tcttatttttgtcattgcac

SEQ ID NO: 311368 - DNA, 20 bp, Artificial Sequence
  chemically synthesized
gccagtgcaatgacaaaaat

SEQ ID NO: 311369 - DNA, 20 bp, Artificial Sequence
  chemically synthesized
aatgacaaaaataagaaatt

SEQ ID NO: 311370 - DNA, 20 bp, Artificial Sequence
  chemically synthesized
acaaaaataagaaattcagt

SEQ ID NO: 311371 - DNA, 20 bp, Artificial Sequence
  chemically synthesized
caaaaataagaaattcagta

SEQ ID NO: 311372 - DNA, 20 bp, Artificial Sequence
  chemically synthesized
aataagaaattcagtaagga

SEQ ID NO: 311373 - DNA, 20 bp, Artificial Sequence
  chemically synthesized
aagaaattcagtaaggaaag

SEQ ID NO: 311374 - DNA, 20 bp, Artificial Sequence
  chemically synthesized
agaaattcagtaaggaaagc

SEQ ID NO: 311375 - DNA, 20 bp, Artificial Sequence
  chemically synthesized
cagtaaggaaagcaggttta

SEQ ID NO: 311376 - DNA, 20 bp, Artificial Sequence
  chemically synthesized
agtaaggaaagcaggtttaa

SEQ ID NO: 311377 - DNA, 20 bp, Artificial Sequence
  chemically synthesized
aaggaaagcaggtttaaagg

SEQ ID NO: 311378 - DNA, 20 bp, Artificial Sequence
  chemically synthesized
aggaaagcaggtttaaagga

SEQ ID NO: 311379 - DNA, 20 bp, Artificial Sequence
  chemically synthesized
gtttaaaggaaggcaatgta

SEQ ID NO: 311380 - DNA, 20 bp, Artificial Sequence
  chemically synthesized
aaaggaaggcaatgtacagt

SEQ ID NO: 311381 - DNA, 20 bp, Artificial Sequence
  chemically synthesized
aaggaaggcaatgtacagtg

SEQ ID NO: 311382 - DNA, 20 bp, Artificial Sequence
  chemically synthesized
aaggcaatgtacagtgaggt

SEQ ID NO: 311383 - DNA, 20 bp, Artificial Sequence
  chemically synthesized
gaggtaagtttcatcttgtt

SEQ ID NO: 311384 - DNA, 20 bp, Artificial Sequence
  chemically synthesized
aacaacacttcaaactcaac

SEQ ID NO: 311385 - DNA, 20 bp, Artificial Sequence
  chemically synthesized
gtttcatcttgttgagtttg

SEQ ID NO: 311386 - DNA, 20 bp, Artificial Sequence
  chemically synthesized
gttgagtttgaagtgttgtt

SEQ ID NO: 311387 - DNA, 20 bp, Artificial Sequence
  chemically synthesized
tgaagtgttgtttggacttc

SEQ ID NO: 311388 - DNA, 20 bp, Artificial Sequence
  chemically synthesized
gaagtgttgtttggacttca

SEQ ID NO: 311389 - DNA, 20 bp, Artificial Sequence
  chemically synthesized
atcttctgaacacatccttg

SEQ ID NO: 311390 - DNA, 20 bp, Artificial Sequence
  chemically synthesized
ttggacttcaaggatgtgtt

SEQ ID NO: 311391 - DNA, 20 bp, Artificial Sequence
  chemically synthesized
gacttcaaggatgtgttcag

SEQ ID NO: 311392 - DNA, 20 bp, Artificial Sequence
  chemically synthesized
ggatgtgttcagaagataat

SEQ ID NO: 311393 - DNA, 20 bp, Artificial Sequence
  chemically synthesized
tgtgttcagaagataattag

SEQ ID NO: 311394 - DNA, 20 bp, Artificial Sequence
  chemically synthesized
agaagataattagaagaaaa

SEQ ID NO: 311395 - DNA, 20 bp, Artificial Sequence
  chemically synthesized
taattagaagaaaatggact

SEQ ID NO: 311396 - DNA, 20 bp, Artificial Sequence
  chemically synthesized
aattagaagaaaatggactc

SEQ ID NO: 311397 - DNA, 20 bp, Artificial Sequence
  chemically synthesized
agaagaaaatggactcagga

SEQ ID NO: 311398 - DNA, 20 bp, Artificial Sequence
  chemically synthesized
cttctgcccagatctttcct

SEQ ID NO: 311399 - DNA, 20 bp, Artificial Sequence
  chemically synthesized
aaatggactcaggaaagatc

SEQ ID NO: 311400 - DNA, 20 bp, Artificial Sequence
  chemically synthesized
aatggactcaggaaagatct

SEQ ID NO: 311401 - DNA, 20 bp, Artificial Sequence
  chemically synthesized
ggactcaggaaagatctggg

SEQ ID NO: 311402 - DNA, 20 bp, Artificial Sequence
  chemically synthesized
ctcaggaaagatctgggcag

SEQ ID NO: 311403 - DNA, 20 bp, Artificial Sequence
  chemically synthesized
aactctggatgtcttctgcc

SEQ ID NO: 311404 - DNA, 20 bp, Artificial Sequence
  chemically synthesized
agatctgggcagaagacatc

SEQ ID NO: 311405 - DNA, 20 bp, Artificial Sequence
  chemically synthesized
atctgggcagaagacatcca

SEQ ID NO: 311406 - DNA, 20 bp, Artificial Sequence
  chemically synthesized
cagacagaagttggtaactc

SEQ ID NO: 311407 - DNA, 20 bp, Artificial Sequence
  chemically synthesized
tatcagaagcagacagaagt

SEQ ID NO: 311408 - DNA, 20 bp, Artificial Sequence
  chemically synthesized
ataatatcagaagcagacag

SEQ ID NO: 311409 - DNA, 20 bp, Artificial Sequence
  chemically synthesized
gtcataatatcagaagcaga

SEQ ID NO: 311410 - DNA, 20 bp, Artificial Sequence
  chemically synthesized
aaatgtcataatatcagaag

SEQ ID NO: 311411 - DNA, 20 bp, Artificial Sequence
  chemically synthesized
tcaaaatgtcataatatcag

SEQ ID NO: 311412 - DNA, 20 bp, Artificial Sequence
  chemically synthesized
ttttcaaaatgtcataatat

SEQ ID NO: 311413 - DNA, 20 bp, Artificial Sequence
  chemically synthesized
tatgacattttgaaaaacca

SEQ ID NO: 311414 - DNA, 20 bp, Artificial Sequence
  chemically synthesized
tgacattttgaaaaaccata

SEQ ID NO: 311415 - DNA, 20 bp, Artificial Sequence
  chemically synthesized
attttgaaaaaccatagaga

SEQ ID NO: 311416 - DNA, 20 bp, Artificial Sequence
  chemically synthesized
aaaggaaggcactttctcta

SEQ ID NO: 311417 - DNA, 20 bp, Artificial Sequence
  chemically synthesized
attgtgatggtgaaaaagga

SEQ ID NO: 311418 - DNA, 20 bp, Artificial Sequence
  chemically synthesized
tattgtgatggtgaaaaagg

SEQ ID NO: 311419 - DNA, 20 bp, Artificial Sequence
  chemically synthesized
cactattgtgatggtgaaaa

SEQ ID NO: 311420 - DNA, 20 bp, Artificial Sequence
  chemically synthesized
acactattgtgatggtgaaa

SEQ ID NO: 311421 - DNA, 20 bp, Artificial Sequence
  chemically synthesized
ttcctttttcaccatcacaa

SEQ ID NO: 311422 - DNA, 20 bp, Artificial Sequence
  chemically synthesized
gcacatgaacactattgtga

SEQ ID NO: 311423 - DNA, 20 bp, Artificial Sequence
  chemically synthesized
aataactaatcatagggaaa

SEQ ID NO: 311424 - DNA, 20 bp, Artificial Sequence
  chemically synthesized
atgtgccatttccctatgat

SEQ ID NO: 311425 - DNA, 20 bp, Artificial Sequence
  chemically synthesized
ttaaaaaataactaatcata

SEQ ID NO: 311426 - DNA, 20 bp, Artificial Sequence
  chemically synthesized
attaaaaaataactaatcat

SEQ ID NO: 311427 - DNA, 20 bp, Artificial Sequence
  chemically synthesized
aattaaaaaataactaatca

SEQ ID NO: 311428 - DNA, 20 bp, Artificial Sequence
  chemically synthesized
gtgaagaatatttgtagagt

SEQ ID NO: 311429 - DNA, 20 bp, Artificial Sequence
  chemically synthesized
tgtgaagaatatttgtagag

SEQ ID NO: 311430 - DNA, 20 bp, Artificial Sequence
  chemically synthesized
tcctgtgaagaatatttgta

SEQ ID NO: 311431 - DNA, 20 bp, Artificial Sequence
  chemically synthesized
catcctgtgaagaatatttg

SEQ ID NO: 311432 - DNA, 20 bp, Artificial Sequence
  chemically synthesized
cactctacaaatattcttca

SEQ ID NO: 311433 - DNA, 20 bp, Artificial Sequence
  chemically synthesized
actctacaaatattcttcac

SEQ ID NO: 311434 - DNA, 20 bp, Artificial Sequence
  chemically synthesized
tcagatggcagcatcctgtg

SEQ ID NO: 311435 - DNA, 20 bp, Artificial Sequence
  chemically synthesized
ttcacaggatgctgccatct

SEQ ID NO: 311436 - DNA, 20 bp, Artificial Sequence
  chemically synthesized
agcaggattttctcagatgg

SEQ ID NO: 311437 - DNA, 20 bp, Artificial Sequence
  chemically synthesized
cttagcaggattttctcaga

SEQ ID NO: 311438 - DNA, 20 bp, Artificial Sequence
  chemically synthesized
ctatcttagcaggattttct

SEQ ID NO: 311439 - DNA, 20 bp, Artificial Sequence
  chemically synthesized
ccatctgagaaaatcctgct

SEQ ID NO: 311440 - DNA, 20 bp, Artificial Sequence
  chemically synthesized
ctgagaaaatcctgctaaga

SEQ ID NO: 311441 - DNA, 20 bp, Artificial Sequence
  chemically synthesized
gattggtactctatcttagc

SEQ ID NO: 311442 - DNA, 20 bp, Artificial Sequence
  chemically synthesized
cgattggtactctatcttag

SEQ ID NO: 311443 - DNA, 20 bp, Artificial Sequence
  chemically synthesized
gagaaaatcctgctaagata

SEQ ID NO: 311444 - DNA, 20 bp, Artificial Sequence
  chemically synthesized
ccacgattggtactctatct

SEQ ID NO: 311445 - DNA, 20 bp, Artificial Sequence
  chemically synthesized
ctaagatagagtaccaatcg

SEQ ID NO: 311446 - DNA, 20 bp, Artificial Sequence
  chemically synthesized
taagatagagtaccaatcgt

SEQ ID NO: 311447 - DNA, 20 bp, Artificial Sequence
  chemically synthesized
ctgtattttacgcccacgat

SEQ ID NO: 311448 - DNA, 20 bp, Artificial Sequence
  chemically synthesized
ccaatcgtgggcgtaaaata

SEQ ID NO: 311449 - DNA, 20 bp, Artificial Sequence
  chemically synthesized
aaaatacagtgtattcaaat

SEQ ID NO: 311450 - DNA, 20 bp, Artificial Sequence
  chemically synthesized
acagtgtattcaaatcagca

SEQ ID NO: 311451 - DNA, 20 bp, Artificial Sequence
  chemically synthesized
agtgtattcaaatcagcata

SEQ ID NO: 311452 - DNA, 20 bp, Artificial Sequence
  chemically synthesized
tcagcatagagtataattat

SEQ ID NO: 311453 - DNA, 20 bp, Artificial Sequence
  chemically synthesized
aattattagttcatgtaatc

SEQ ID NO: 311454 - DNA, 20 bp, Artificial Sequence
  chemically synthesized
acagactgtgatatagtgtc

SEQ ID NO: 311455 - DNA, 20 bp, Artificial Sequence
  chemically synthesized
gtaatctagacactatatca

SEQ ID NO: 311456 - DNA, 20 bp, Artificial Sequence
  chemically synthesized
tgcaatcacagactgtgata

SEQ ID NO: 311457 - DNA, 20 bp, Artificial Sequence
  chemically synthesized
attcttagttaatgcaatca

SEQ ID NO: 311458 - DNA, 20 bp, Artificial Sequence
  chemically synthesized
agtctgtgattgcattaact

SEQ ID NO: 311459 - DNA, 20 bp, Artificial Sequence
  chemically synthesized
ttaaggatgatacagattct

SEQ ID NO: 311460 - DNA, 20 bp, Artificial Sequence
  chemically synthesized
gcttgatattaaggatgata

SEQ ID NO: 311461 - DNA, 20 bp, Artificial Sequence
  chemically synthesized
tctgtatcatccttaatatc

SEQ ID NO: 311462 - DNA, 20 bp, Artificial Sequence
  chemically synthesized
ttgaaacaagcttgatatta

SEQ ID NO: 311463 - DNA, 20 bp, Artificial Sequence
  chemically synthesized
tttgaaacaagcttgatatt

SEQ ID NO: 311464 - DNA, 20 bp, Artificial Sequence
  chemically synthesized
ttaatatcaagcttgtttca

SEQ ID NO: 311465 - DNA, 20 bp, Artificial Sequence
  chemically synthesized
gcacatgcttactttgaaac

SEQ ID NO: 311466 - DNA, 20 bp, Artificial Sequence
  chemically synthesized
tatcaagcttgtttcaaagt

SEQ ID NO: 311467 - DNA, 20 bp, Artificial Sequence
  chemically synthesized
acataagcacatatgagata

SEQ ID NO: 311468 - DNA, 20 bp, Artificial Sequence
  chemically synthesized
aaacataagcacatatgaga

SEQ ID NO: 311469 - DNA, 20 bp, Artificial Sequence
  chemically synthesized
acataaacataagcacatat

SEQ ID NO: 311470 - DNA, 20 bp, Artificial Sequence
  chemically synthesized
acatacatatacataaacat

SEQ ID NO: 311471 - DNA, 20 bp, Artificial Sequence
  chemically synthesized
catatatatacatatgcaca

SEQ ID NO: 311472 - DNA, 20 bp, Artificial Sequence
  chemically synthesized
gatgtacgtatgtatatata

SEQ ID NO: 311473 - DNA, 20 bp, Artificial Sequence
  chemically synthesized
tgtatatatatagaaacata

SEQ ID NO: 311474 - DNA, 20 bp, Artificial Sequence
  chemically synthesized
tatatatatagaaacataaa

SEQ ID NO: 311475 - DNA, 20 bp, Artificial Sequence
  chemically synthesized
tatatgtataaatgtgtata

SEQ ID NO: 311476 - DNA, 20 bp, Artificial Sequence
  chemically synthesized
tttatacatatatttttata

SEQ ID NO: 311477 - DNA, 20 bp, Artificial Sequence
  chemically synthesized
atgtaaatatatataaatgt

SEQ ID NO: 311478 - DNA, 20 bp, Artificial Sequence
  chemically synthesized
tatatttacatttatatcta

SEQ ID NO: 311479 - DNA, 20 bp, Artificial Sequence
  chemically synthesized
tttacatttatatctataga

SEQ ID NO: 311480 - DNA, 20 bp, Artificial Sequence
  chemically synthesized
ttacatttatatctatagat

SEQ ID NO: 311481 - DNA, 20 bp, Artificial Sequence
  chemically synthesized
agggtctgacttcccatcta

SEQ ID NO: 311482 - DNA, 20 bp, Artificial Sequence
  chemically synthesized
catttatatctatagatggg

SEQ ID NO: 311483 - DNA, 20 bp, Artificial Sequence
  chemically synthesized
tatatctatagatgggaagt

SEQ ID NO: 311484 - DNA, 20 bp, Artificial Sequence
  chemically synthesized
gaattagtttgagatacaaa

SEQ ID NO: 311485 - DNA, 20 bp, Artificial Sequence
  chemically synthesized
tgaattagtttgagatacaa

SEQ ID NO: 311486 - DNA, 20 bp, Artificial Sequence
  chemically synthesized
ttgaattagtttgagataca

SEQ ID NO: 311487 - DNA, 20 bp, Artificial Sequence
  chemically synthesized
taaatcagttgaattagttt

SEQ ID NO: 311488 - DNA, 20 bp, Artificial Sequence
  chemically synthesized
gtagtataaatcagttgaat

SEQ ID NO: 311489 - DNA, 20 bp, Artificial Sequence
  chemically synthesized
aaaatgcaagtagtataaat

SEQ ID NO: 311490 - DNA, 20 bp, Artificial Sequence
  chemically synthesized
ctgctttttaaaaatgcaag

SEQ ID NO: 311491 - DNA, 20 bp, Artificial Sequence
  chemically synthesized
ttgctgctttttaaaaatgc

SEQ ID NO: 311492 - DNA, 20 bp, Artificial Sequence
  chemically synthesized
atactacttgcatttttaaa

SEQ ID NO: 311493 - DNA, 20 bp, Artificial Sequence
  chemically synthesized
ctacttgcatttttaaaaag

SEQ ID NO: 311494 - DNA, 20 bp, Artificial Sequence
  chemically synthesized
acatttcgaactataaacat

SEQ ID NO: 311495 - DNA, 20 bp, Artificial Sequence
  chemically synthesized
agtcagaaaactcatgttta

SEQ ID NO: 311496 - DNA, 20 bp, Artificial Sequence
  chemically synthesized
tacatcctattgttttaagt

SEQ ID NO: 311497 - DNA, 20 bp, Artificial Sequence
  chemically synthesized
agttttctgacttaaaacaa

SEQ ID NO: 311498 - DNA, 20 bp, Artificial Sequence
  chemically synthesized
atgttacatcctattgtttt

SEQ ID NO: 311499 - DNA, 20 bp, Artificial Sequence
  chemically synthesized
gttttctgacttaaaacaat

SEQ ID NO: 311500 - DNA, 20 bp, Artificial Sequence
  chemically synthesized
tatatgatattctaactcct

SEQ ID NO: 311501 - DNA, 20 bp, Artificial Sequence
  chemically synthesized
atatgatattctaactcctc

SEQ ID NO: 311502 - DNA, 20 bp, Artificial Sequence
  chemically synthesized
atagctatgtcctgaggagt

SEQ ID NO: 311503 - DNA, 20 bp, Artificial Sequence
  chemically synthesized
gtttatagctatgtcctgag

SEQ ID NO: 311504 - DNA, 20 bp, Artificial Sequence
  chemically synthesized
tattctaactcctcaggaca

SEQ ID NO: 311505 - DNA, 20 bp, Artificial Sequence
  chemically synthesized
aggtttatagctatgtcctg

SEQ ID NO: 311506 - DNA, 20 bp, Artificial Sequence
  chemically synthesized
aaggtttatagctatgtcct

SEQ ID NO: 311507 - DNA, 20 bp, Artificial Sequence
  chemically synthesized
atattaacttagaaggttta

SEQ ID NO: 311508 - DNA, 20 bp, Artificial Sequence
  chemically synthesized
gacatagctataaaccttct

SEQ ID NO: 311509 - DNA, 20 bp, Artificial Sequence
  chemically synthesized
tgctcccatattaacttaga

SEQ ID NO: 311510 - DNA, 20 bp, Artificial Sequence
  chemically synthesized
ctgctcccatattaacttag

SEQ ID NO: 311511 - DNA, 20 bp, Artificial Sequence
  chemically synthesized
tttctgctcccatattaact

SEQ ID NO: 311512 - DNA, 20 bp, Artificial Sequence
  chemically synthesized
ataaaccttctaagttaata

SEQ ID NO: 311513 - DNA, 20 bp, Artificial Sequence
  chemically synthesized
taaaccttctaagttaatat

SEQ ID NO: 311514 - DNA, 20 bp, Artificial Sequence
  chemically synthesized
aaccttctaagttaatatgg

SEQ ID NO: 311515 - DNA, 20 bp, Artificial Sequence
  chemically synthesized
cttctaagttaatatgggag

SEQ ID NO: 311516 - DNA, 20 bp, Artificial Sequence
  chemically synthesized
gcccctgtaggagtggttaa

SEQ ID NO: 311517 - DNA, 20 bp, Artificial Sequence
  chemically synthesized
tattccattaaccactccta

SEQ ID NO: 311518 - DNA, 20 bp, Artificial Sequence
  chemically synthesized
attccattaaccactcctac

SEQ ID NO: 311519 - DNA, 20 bp, Artificial Sequence
  chemically synthesized
aaagtgtgcccctgtaggag

SEQ ID NO: 311520 - DNA, 20 bp, Artificial Sequence
  chemically synthesized
ttccattaaccactcctaca

SEQ ID NO: 311521 - DNA, 20 bp, Artificial Sequence
  chemically synthesized
tccattaaccactcctacag

SEQ ID NO: 311522 - DNA, 20 bp, Artificial Sequence
  chemically synthesized
tgtaaagtgtgcccctgtag

SEQ ID NO: 311523 - DNA, 20 bp, Artificial Sequence
  chemically synthesized
tgtgtaaagtgtgcccctgt

SEQ ID NO: 311524 - DNA, 20 bp, Artificial Sequence
  chemically synthesized
ctgtgtaaagtgtgcccctg

SEQ ID NO: 311525 - DNA, 20 bp, Artificial Sequence
  chemically synthesized
ctacaggggcacactttaca

SEQ ID NO: 311526 - DNA, 20 bp, Artificial Sequence
  chemically synthesized
acaggggcacactttacaca

SEQ ID NO: 311527 - DNA, 20 bp, Artificial Sequence
  chemically synthesized
tttagctggggctctgtgta

SEQ ID NO: 311528 - DNA, 20 bp, Artificial Sequence
  chemically synthesized
gcacactttacacagagccc

SEQ ID NO: 311529 - DNA, 20 bp, Artificial Sequence
  chemically synthesized
gccatttgaggatttagctg

SEQ ID NO: 311530 - DNA, 20 bp, Artificial Sequence
  chemically synthesized
agccatttgaggatttagct

SEQ ID NO: 311531 - DNA, 20 bp, Artificial Sequence
  chemically synthesized
aagccatttgaggatttagc

SEQ ID NO: 311532 - DNA, 20 bp, Artificial Sequence
  chemically synthesized
aaggaagccatttgaggatt

SEQ ID NO: 311533 - DNA, 20 bp, Artificial Sequence
  chemically synthesized
gccccagctaaatcctcaaa

SEQ ID NO: 311534 - DNA, 20 bp, Artificial Sequence
  chemically synthesized
ctggggaaggaagccatttg

SEQ ID NO: 311535 - DNA, 20 bp, Artificial Sequence
  chemically synthesized
tctggggaaggaagccattt

SEQ ID NO: 311536 - DNA, 20 bp, Artificial Sequence
  chemically synthesized
cctcaaatggcttccttccc

SEQ ID NO: 311537 - DNA, 20 bp, Artificial Sequence
  chemically synthesized
gctgaaaattctggggaagg

SEQ ID NO: 311538 - DNA, 20 bp, Artificial Sequence
  chemically synthesized
cgtgctgaaaattctgggga

SEQ ID NO: 311539 - DNA, 20 bp, Artificial Sequence
  chemically synthesized
acgtgctgaaaattctgggg

SEQ ID NO: 311540 - DNA, 20 bp, Artificial Sequence
  chemically synthesized
tttacgtgctgaaaattctg

SEQ ID NO: 311541 - DNA, 20 bp, Artificial Sequence
  chemically synthesized
atttacgtgctgaaaattct

SEQ ID NO: 311542 - DNA, 20 bp, Artificial Sequence
  chemically synthesized
gcttccttccccagaatttt

SEQ ID NO: 311543 - DNA, 20 bp, Artificial Sequence
  chemically synthesized
gatttacgtgctgaaaattc

SEQ ID NO: 311544 - DNA, 20 bp, Artificial Sequence
  chemically synthesized
agaattttcagcacgtaaat

SEQ ID NO: 311545 - DNA, 20 bp, Artificial Sequence
  chemically synthesized
tcagcacgtaaatcagatac

SEQ ID NO: 311546 - DNA, 20 bp, Artificial Sequence
  chemically synthesized
cacgtaaatcagatactaga

SEQ ID NO: 311547 - DNA, 20 bp, Artificial Sequence
  chemically synthesized
acgtaaatcagatactagaa

SEQ ID NO: 311548 - DNA, 20 bp, Artificial Sequence
  chemically synthesized
tgttttaatatattcctttc

SEQ ID NO: 311549 - DNA, 20 bp, Artificial Sequence
  chemically synthesized
gaaaggaatatattaaaaca

SEQ ID NO: 311550 - DNA, 20 bp, Artificial Sequence
  chemically synthesized
ctctatgagtgttcgtgggt

SEQ ID NO: 311551 - DNA, 20 bp, Artificial Sequence
  chemically synthesized
ctttctctatgagtgttcgt

SEQ ID NO: 311552 - DNA, 20 bp, Artificial Sequence
  chemically synthesized
tctttctctatgagtgttcg

SEQ ID NO: 311553 - DNA, 20 bp, Artificial Sequence
  chemically synthesized
gactcacccacgaacactca

SEQ ID NO: 311554 - DNA, 20 bp, Artificial Sequence
  chemically synthesized
ctcacccacgaacactcata

SEQ ID NO: 311555 - DNA, 20 bp, Artificial Sequence
  chemically synthesized
cccacgaacactcatagaga

SEQ ID NO: 311556 - DNA, 20 bp, Artificial Sequence
  chemically synthesized
gtgagtctatctttctctat

SEQ ID NO: 311557 - DNA, 20 bp, Artificial Sequence
  chemically synthesized
cgaacactcatagagaaaga

SEQ ID NO: 311558 - DNA, 20 bp, Artificial Sequence
  chemically synthesized
atactgtttattggtaaggt

SEQ ID NO: 311559 - DNA, 20 bp, Artificial Sequence
  chemically synthesized
cgtgatactgtttattggta

SEQ ID NO: 311560 - DNA, 20 bp, Artificial Sequence
  chemically synthesized
gcgtgatactgtttattggt

SEQ ID NO: 311561 - DNA, 20 bp, Artificial Sequence
  chemically synthesized
agactcaccttaccaataaa

SEQ ID NO: 311562 - DNA, 20 bp, Artificial Sequence
  chemically synthesized
ctctgcgtgatactgtttat

SEQ ID NO: 311563 - DNA, 20 bp, Artificial Sequence
  chemically synthesized
taccaataaacagtatcacg

SEQ ID NO: 311564 - DNA, 20 bp, Artificial Sequence
  chemically synthesized
ccaataaacagtatcacgca

SEQ ID NO: 311565 - DNA, 20 bp, Artificial Sequence
  chemically synthesized
caataaacagtatcacgcag

SEQ ID NO: 311566 - DNA, 20 bp, Artificial Sequence
  chemically synthesized
tcacgcagaggctttgctaa

SEQ ID NO: 311567 - DNA, 20 bp, Artificial Sequence
  chemically synthesized
cacgcagaggctttgctaaa

SEQ ID NO: 311568 - DNA, 20 bp, Artificial Sequence
  chemically synthesized
ttttcctgaaccttttagca

SEQ ID NO: 311569 - DNA, 20 bp, Artificial Sequence
  chemically synthesized
agaggctttgctaaaaggtt

SEQ ID NO: 311570 - DNA, 20 bp, Artificial Sequence
  chemically synthesized
tctgattttcctgaaccttt

SEQ ID NO: 311571 - DNA, 20 bp, Artificial Sequence
  chemically synthesized
gaggctttgctaaaaggttc

SEQ ID NO: 311572 - DNA, 20 bp, Artificial Sequence
  chemically synthesized
gctaaaaggttcaggaaaat

SEQ ID NO: 311573 - DNA, 20 bp, Artificial Sequence
  chemically synthesized
aatggaatggaatgaatttg

SEQ ID NO: 311574 - DNA, 20 bp, Artificial Sequence
  chemically synthesized
caatggaatggaatgaattt

SEQ ID NO: 311575 - DNA, 20 bp, Artificial Sequence
  chemically synthesized
tcaaattcattccattccat

SEQ ID NO: 311576 - DNA, 20 bp, Artificial Sequence
  chemically synthesized
aattggctgatccaatggaa

SEQ ID NO: 311577 - DNA, 20 bp, Artificial Sequence
  chemically synthesized
ttcattccattccattggat

SEQ ID NO: 311578 - DNA, 20 bp, Artificial Sequence
  chemically synthesized
tattaaattggctgatccaa

SEQ ID NO: 311579 - DNA, 20 bp, Artificial Sequence
  chemically synthesized
attggatcagccaatttaat

SEQ ID NO: 311580 - DNA, 20 bp, Artificial Sequence
  chemically synthesized
ttttgttagacttattaaat

SEQ ID NO: 311581 - DNA, 20 bp, Artificial Sequence
  chemically synthesized
attaagacaaattattttgt

SEQ ID NO: 311582 - DNA, 20 bp, Artificial Sequence
  chemically synthesized
aaatactttgtggtagtatt

SEQ ID NO: 311583 - DNA, 20 bp, Artificial Sequence
  chemically synthesized
tttgtcttaatactaccaca

SEQ ID NO: 311584 - DNA, 20 bp, Artificial Sequence
  chemically synthesized
tttgtagaaatactttgtgg

SEQ ID NO: 311585 - DNA, 20 bp, Artificial Sequence
  chemically synthesized
caatttgtagaaatactttg

SEQ ID NO: 311586 - DNA, 20 bp, Artificial Sequence
  chemically synthesized
agatgacattaaacaatttg

SEQ ID NO: 311587 - DNA, 20 bp, Artificial Sequence
  chemically synthesized
gtttaatgtcatctgatata

SEQ ID NO: 311588 - DNA, 20 bp, Artificial Sequence
  chemically synthesized
catgtaaaccaactttatat

SEQ ID NO: 311589 - DNA, 20 bp, Artificial Sequence
  chemically synthesized
aatgtcatctgatataaagt

SEQ ID NO: 311590 - DNA, 20 bp, Artificial Sequence
  chemically synthesized
tggtttacatgactcaattt

SEQ ID NO: 311591 - DNA, 20 bp, Artificial Sequence
  chemically synthesized
aagctacattcgctaaaatt

SEQ ID NO: 311592 - DNA, 20 bp, Artificial Sequence
  chemically synthesized
tgactcaattttagcgaatg

SEQ ID NO: 311593 - DNA, 20 bp, Artificial Sequence
  chemically synthesized
caattttagcgaatgtagct

SEQ ID NO: 311594 - DNA, 20 bp, Artificial Sequence
  chemically synthesized
agcgaatgtagcttagttct

SEQ ID NO: 311595 - DNA, 20 bp, Artificial Sequence
  chemically synthesized
gagatagttttctaagaact

SEQ ID NO: 311596 - DNA, 20 bp, Artificial Sequence
  chemically synthesized
tgcagatgagatagttttct

SEQ ID NO: 311597 - DNA, 20 bp, Artificial Sequence
  chemically synthesized
aataatttttgcagatgaga

SEQ ID NO: 311598 - DNA, 20 bp, Artificial Sequence
  chemically synthesized
aaggaataatttttgcagat

SEQ ID NO: 311599 - DNA, 20 bp, Artificial Sequence
  chemically synthesized
gcctgaaggaataatttttg

SEQ ID NO: 311600 - DNA, 20 bp, Artificial Sequence
  chemically synthesized
atctgcaaaaattattcctt

SEQ ID NO: 311601 - DNA, 20 bp, Artificial Sequence
  chemically synthesized
tctgcaaaaattattccttc

SEQ ID NO: 311602 - DNA, 20 bp, Artificial Sequence
  chemically synthesized
taaacatatttattgcctga

SEQ ID NO: 311603 - DNA, 20 bp, Artificial Sequence
  chemically synthesized
ataaacatatttattgcctg

SEQ ID NO: 311604 - DNA, 20 bp, Artificial Sequence
  chemically synthesized
aatatgtttattaactgcat

SEQ ID NO: 311605 - DNA, 20 bp, Artificial Sequence
  chemically synthesized
ggtttctcacttatctcatg

SEQ ID NO: 311606 - DNA, 20 bp, Artificial Sequence
  chemically synthesized
gtttattaactgcatgagat

SEQ ID NO: 311607 - DNA, 20 bp, Artificial Sequence
  chemically synthesized
attaactgcatgagataagt

SEQ ID NO: 311608 - DNA, 20 bp, Artificial Sequence
  chemically synthesized
agataagtgagaaaccatac

SEQ ID NO: 311609 - DNA, 20 bp, Artificial Sequence
  chemically synthesized
aagtgagaaaccataccagt

SEQ ID NO: 311610 - DNA, 20 bp, Artificial Sequence
  chemically synthesized
tgaggccatgctcactggta

SEQ ID NO: 311611 - DNA, 20 bp, Artificial Sequence
  chemically synthesized
agaaaccataccagtgagca

SEQ ID NO: 311612 - DNA, 20 bp, Artificial Sequence
  chemically synthesized
aaacatgaggccatgctcac

SEQ ID NO: 311613 - DNA, 20 bp, Artificial Sequence
  chemically synthesized
ggatcagattattaaacatg

SEQ ID NO: 311614 - DNA, 20 bp, Artificial Sequence
  chemically synthesized
tggatcagattattaaacat

SEQ ID NO: 311615 - DNA, 20 bp, Artificial Sequence
  chemically synthesized
tggaaaacacaattttggat

SEQ ID NO: 311616 - DNA, 20 bp, Artificial Sequence
  chemically synthesized
aaacctggaaaacacaattt

SEQ ID NO: 311617 - DNA, 20 bp, Artificial Sequence
  chemically synthesized
tgatccaaaattgtgttttc

SEQ ID NO: 311618 - DNA, 20 bp, Artificial Sequence
  chemically synthesized
gatccaaaattgtgttttcc

SEQ ID NO: 311619 - DNA, 20 bp, Artificial Sequence
  chemically synthesized
tattttcaagaaggaaaacc

SEQ ID NO: 311620 - DNA, 20 bp, Artificial Sequence
  chemically synthesized
caagtattctattttcaaga

SEQ ID NO: 311621 - DNA, 20 bp, Artificial Sequence
  chemically synthesized
acaagtattctattttcaag

SEQ ID NO: 311622 - DNA, 20 bp, Artificial Sequence
  chemically synthesized
caggttttccttcttgaaaa

SEQ ID NO: 311623 - DNA, 20 bp, Artificial Sequence
  chemically synthesized
acaacaagtattctattttc

SEQ ID NO: 311624 - DNA, 20 bp, Artificial Sequence
  chemically synthesized
aaatagaatacttgttgtga

SEQ ID NO: 311625 - DNA, 20 bp, Artificial Sequence
  chemically synthesized
ataatattaaccgtcacaac

SEQ ID NO: 311626 - DNA, 20 bp, Artificial Sequence
  chemically synthesized
aatattatgtgtcaacttca

SEQ ID NO: 311627 - DNA, 20 bp, Artificial Sequence
  chemically synthesized
aggcatccctcaattccatg

SEQ ID NO: 311628 - DNA, 20 bp, Artificial Sequence
  chemically synthesized
tgtgtcaacttcatggaatt

SEQ ID NO: 311629 - DNA, 20 bp, Artificial Sequence
  chemically synthesized
gtgtcaacttcatggaattg

SEQ ID NO: 311630 - DNA, 20 bp, Artificial Sequence
  chemically synthesized
tgtcaacttcatggaattga

SEQ ID NO: 311631 - DNA, 20 bp, Artificial Sequence
  chemically synthesized
tcatggaattgagggatgcc

SEQ ID NO: 311632 - DNA, 20 bp, Artificial Sequence
  chemically synthesized
caatacttcatcagtgatct

SEQ ID NO: 311633 - DNA, 20 bp, Artificial Sequence
  chemically synthesized
acaatacttcatcagtgatc

SEQ ID NO: 311634 - DNA, 20 bp, Artificial Sequence
  chemically synthesized
ggatgcctagatcactgatg

SEQ ID NO: 311635 - DNA, 20 bp, Artificial Sequence
  chemically synthesized
cggaagaaacaatacttcat

SEQ ID NO: 311636 - DNA, 20 bp, Artificial Sequence
  chemically synthesized
tgatgaagtattgtttcttc

SEQ ID NO: 311637 - DNA, 20 bp, Artificial Sequence
  chemically synthesized
gatgaagtattgtttcttcc

SEQ ID NO: 311638 - DNA, 20 bp, Artificial Sequence
  chemically synthesized
actctcacagacacacccgg

SEQ ID NO: 311639 - DNA, 20 bp, Artificial Sequence
  chemically synthesized
tacactctcacagacacacc

SEQ ID NO: 311640 - DNA, 20 bp, Artificial Sequence
  chemically synthesized
tttcttccgggtgtgtctgt

SEQ ID NO: 311641 - DNA, 20 bp, Artificial Sequence
  chemically synthesized
tcttccgggtgtgtctgtga

SEQ ID NO: 311642 - DNA, 20 bp, Artificial Sequence
  chemically synthesized
cttctttggctacactctca

SEQ ID NO: 311643 - DNA, 20 bp, Artificial Sequence
  chemically synthesized
cgggtgtgtctgtgagagtg

SEQ ID NO: 311644 - DNA, 20 bp, Artificial Sequence
  chemically synthesized
tgtctgtgagagtgtagcca

SEQ ID NO: 311645 - DNA, 20 bp, Artificial Sequence
  chemically synthesized
ctgtgagagtgtagccaaag

SEQ ID NO: 311646 - DNA, 20 bp, Artificial Sequence
  chemically synthesized
tgtgagagtgtagccaaaga

SEQ ID NO: 311647 - DNA, 20 bp, Artificial Sequence
  chemically synthesized
gtccacatgtcagccttctt

SEQ ID NO: 311648 - DNA, 20 bp, Artificial Sequence
  chemically synthesized
agccaaagaaggctgacatg

SEQ ID NO: 311649 - DNA, 20 bp, Artificial Sequence
  chemically synthesized
cagtccactggtccacatgt

SEQ ID NO: 311650 - DNA, 20 bp, Artificial Sequence
  chemically synthesized
aagaaggctgacatgtggac

SEQ ID NO: 311651 - DNA, 20 bp, Artificial Sequence
  chemically synthesized
aaggctgacatgtggaccag

SEQ ID NO: 311652 - DNA, 20 bp, Artificial Sequence
  chemically synthesized
tgacatgtggaccagtggac

SEQ ID NO: 311653 - DNA, 20 bp, Artificial Sequence
  chemically synthesized
gacatgtggaccagtggact

SEQ ID NO: 311654 - DNA, 20 bp, Artificial Sequence
  chemically synthesized
gccttcctctcccagtccac

SEQ ID NO: 311655 - DNA, 20 bp, Artificial Sequence
  chemically synthesized
catgtggaccagtggactgg

SEQ ID NO: 311656 - DNA, 20 bp, Artificial Sequence
  chemically synthesized
tgtggaccagtggactggga

SEQ ID NO: 311657 - DNA, 20 bp, Artificial Sequence
  chemically synthesized
gtggaccagtggactgggag

SEQ ID NO: 311658 - DNA, 20 bp, Artificial Sequence
  chemically synthesized
gaccagtggactgggagagg

SEQ ID NO: 311659 - DNA, 20 bp, Artificial Sequence
  chemically synthesized
gagggtgggccttcctctcc

SEQ ID NO: 311660 - DNA, 20 bp, Artificial Sequence
  chemically synthesized
accagtggactgggagagga

SEQ ID NO: 311661 - DNA, 20 bp, Artificial Sequence
  chemically synthesized
tgcccacccacattgagggt

SEQ ID NO: 311662 - DNA, 20 bp, Artificial Sequence
  chemically synthesized
gtgcccacccacattgaggg

SEQ ID NO: 311663 - DNA, 20 bp, Artificial Sequence
  chemically synthesized
aggaaggcccaccctcaatg

SEQ ID NO: 311664 - DNA, 20 bp, Artificial Sequence
  chemically synthesized
ggaaggcccaccctcaatgt

SEQ ID NO: 311665 - DNA, 20 bp, Artificial Sequence
  chemically synthesized
gtggtgcccacccacattga

SEQ ID NO: 311666 - DNA, 20 bp, Artificial Sequence
  chemically synthesized
ggtggtgcccacccacattg

SEQ ID NO: 311667 - DNA, 20 bp, Artificial Sequence
  chemically synthesized
gggtggtgcccacccacatt

SEQ ID NO: 311668 - DNA, 20 bp, Artificial Sequence
  chemically synthesized
aggcccaccctcaatgtggg

SEQ ID NO: 311669 - DNA, 20 bp, Artificial Sequence
  chemically synthesized
ggcccaccctcaatgtgggt

SEQ ID NO: 311670 - DNA, 20 bp, Artificial Sequence
  chemically synthesized
gtgggtgggcaccacccaat

SEQ ID NO: 311671 - DNA, 20 bp, Artificial Sequence
  chemically synthesized
ctaactggcagctgattggg

SEQ ID NO: 311672 - DNA, 20 bp, Artificial Sequence
  chemically synthesized
agtctaactggcagctgatt

SEQ ID NO: 311673 - DNA, 20 bp, Artificial Sequence
  chemically synthesized
tagtctaactggcagctgat

SEQ ID NO: 311674 - DNA, 20 bp, Artificial Sequence
  chemically synthesized
ggcaccacccaatcagctgc

SEQ ID NO: 311675 - DNA, 20 bp, Artificial Sequence
  chemically synthesized
ccacccaatcagctgccagt

SEQ ID NO: 311676 - DNA, 20 bp, Artificial Sequence
  chemically synthesized
ctttgttctagtctaactgg

SEQ ID NO: 311677 - DNA, 20 bp, Artificial Sequence
  chemically synthesized
caatcagctgccagttagac

SEQ ID NO: 311678 - DNA, 20 bp, Artificial Sequence
  chemically synthesized
tggctttgttctagtctaac

SEQ ID NO: 311679 - DNA, 20 bp, Artificial Sequence
  chemically synthesized
ctgccagttagactagaaca

SEQ ID NO: 311680 - DNA, 20 bp, Artificial Sequence
  chemically synthesized
ctgttctcctggctttgttc

SEQ ID NO: 311681 - DNA, 20 bp, Artificial Sequence
  chemically synthesized
cagttagactagaacaaagc

SEQ ID NO: 311682 - DNA, 20 bp, Artificial Sequence
  chemically synthesized
agttagactagaacaaagcc

SEQ ID NO: 311683 - DNA, 20 bp, Artificial Sequence
  chemically synthesized
ttagactagaacaaagccag

SEQ ID NO: 311684 - DNA, 20 bp, Artificial Sequence
  chemically synthesized
ctagaacaaagccaggagaa

SEQ ID NO: 311685 - DNA, 20 bp, Artificial Sequence
  chemically synthesized
tagaacaaagccaggagaac

SEQ ID NO: 311686 - DNA, 20 bp, Artificial Sequence
  chemically synthesized
ctactttatccctgttctcc

SEQ ID NO: 311687 - DNA, 20 bp, Artificial Sequence
  chemically synthesized
agaacaaagccaggagaaca

SEQ ID NO: 311688 - DNA, 20 bp, Artificial Sequence
  chemically synthesized
aagccaggagaacagggata

SEQ ID NO: 311689 - DNA, 20 bp, Artificial Sequence
  chemically synthesized
ccaggagaacagggataaag

SEQ ID NO: 311690 - DNA, 20 bp, Artificial Sequence
  chemically synthesized
cagggataaagtagcttgct

SEQ ID NO: 311691 - DNA, 20 bp, Artificial Sequence
  chemically synthesized
gataaagtagcttgcttggt

SEQ ID NO: 311692 - DNA, 20 bp, Artificial Sequence
  chemically synthesized
agtgagtaaacttaccaagc

SEQ ID NO: 311693 - DNA, 20 bp, Artificial Sequence
  chemically synthesized
agagagtgagtaaacttacc

SEQ ID NO: 311694 - DNA, 20 bp, Artificial Sequence
  chemically synthesized
gcagggcacaggaagagagt

SEQ ID NO: 311695 - DNA, 20 bp, Artificial Sequence
  chemically synthesized
ccccgcagggcacaggaaga

SEQ ID NO: 311696 - DNA, 20 bp, Artificial Sequence
  chemically synthesized
tgccccgcagggcacaggaa

SEQ ID NO: 311697 - DNA, 20 bp, Artificial Sequence
  chemically synthesized
actgccccgcagggcacagg

SEQ ID NO: 311698 - DNA, 20 bp, Artificial Sequence
  chemically synthesized
ccaactgccccgcagggcac

SEQ ID NO: 311699 - DNA, 20 bp, Artificial Sequence
  chemically synthesized
cactctcttcctgtgccctg

SEQ ID NO: 311700 - DNA, 20 bp, Artificial Sequence
  chemically synthesized
gccaactgccccgcagggca

SEQ ID NO: 311701 - DNA, 20 bp, Artificial Sequence
  chemically synthesized
actctcttcctgtgccctgc

SEQ ID NO: 311702 - DNA, 20 bp, Artificial Sequence
  chemically synthesized
ctctcttcctgtgccctgcg

SEQ ID NO: 311703 - DNA, 20 bp, Artificial Sequence
  chemically synthesized
tcttcctgtgccctgcgggg

SEQ ID NO: 311704 - DNA, 20 bp, Artificial Sequence
  chemically synthesized
aggaagccaactgccccgca

SEQ ID NO: 311705 - DNA, 20 bp, Artificial Sequence
  chemically synthesized
gaggaagccaactgccccgc

SEQ ID NO: 311706 - DNA, 20 bp, Artificial Sequence
  chemically synthesized
agaggaagccaactgccccg

SEQ ID NO: 311707 - DNA, 20 bp, Artificial Sequence
  chemically synthesized
cctgtgccctgcggggcagt

SEQ ID NO: 311708 - DNA, 20 bp, Artificial Sequence
  chemically synthesized
tccgagggcaggaggagagg

SEQ ID NO: 311709 - DNA, 20 bp, Artificial Sequence
  chemically synthesized
atgtccgagggcaggaggag

SEQ ID NO: 311710 - DNA, 20 bp, Artificial Sequence
  chemically synthesized
gatgtccgagggcaggagga

SEQ ID NO: 311711 - DNA, 20 bp, Artificial Sequence
  chemically synthesized
ctgatgtccgagggcaggag

SEQ ID NO: 311712 - DNA, 20 bp, Artificial Sequence
  chemically synthesized
gtctgatgtccgagggcagg

SEQ ID NO: 311713 - DNA, 20 bp, Artificial Sequence
  chemically synthesized
gcttcctctcctcctgccct

SEQ ID NO: 311714 - DNA, 20 bp, Artificial Sequence
  chemically synthesized
agtctgatgtccgagggcag

SEQ ID NO: 311715 - DNA, 20 bp, Artificial Sequence
  chemically synthesized
ggagtctgatgtccgagggc

SEQ ID NO: 311716 - DNA, 20 bp, Artificial Sequence
  chemically synthesized
tggagtctgatgtccgaggg

SEQ ID NO: 311717 - DNA, 20 bp, Artificial Sequence
  chemically synthesized
tcctggagtctgatgtccga

SEQ ID NO: 311718 - DNA, 20 bp, Artificial Sequence
  chemically synthesized
ctcctcctgccctcggacat

SEQ ID NO: 311719 - DNA, 20 bp, Artificial Sequence
  chemically synthesized
gtcctggagtctgatgtccg

SEQ ID NO: 311720 - DNA, 20 bp, Artificial Sequence
  chemically synthesized
agtcctggagtctgatgtcc

SEQ ID NO: 311721 - DNA, 20 bp, Artificial Sequence
  chemically synthesized
tgccctcggacatcagactc

SEQ ID NO: 311722 - DNA, 20 bp, Artificial Sequence
  chemically synthesized
gccctcggacatcagactcc

SEQ ID NO: 311723 - DNA, 20 bp, Artificial Sequence
  chemically synthesized
ctggagaacctggagtcctg

SEQ ID NO: 311724 - DNA, 20 bp, Artificial Sequence
  chemically synthesized
gacatcagactccaggactc

SEQ ID NO: 311725 - DNA, 20 bp, Artificial Sequence
  chemically synthesized
acatcagactccaggactcc

SEQ ID NO: 311726 - DNA, 20 bp, Artificial Sequence
  chemically synthesized
gactggagaacctggagtcc

SEQ ID NO: 311727 - DNA, 20 bp, Artificial Sequence
  chemically synthesized
tccaaagactggagaacctg

SEQ ID NO: 311728 - DNA, 20 bp, Artificial Sequence
  chemically synthesized
ctccaggactccaggttctc

SEQ ID NO: 311729 - DNA, 20 bp, Artificial Sequence
  chemically synthesized
agtccaaagactggagaacc

SEQ ID NO: 311730 - DNA, 20 bp, Artificial Sequence
  chemically synthesized
actccaggttctccagtctt

SEQ ID NO: 311731 - DNA, 20 bp, Artificial Sequence
  chemically synthesized
gtcccccagtccaaagactg

SEQ ID NO: 311732 - DNA, 20 bp, Artificial Sequence
  chemically synthesized
aagtcccccagtccaaagac

SEQ ID NO: 311733 - DNA, 20 bp, Artificial Sequence
  chemically synthesized
aggttctccagtctttggac

SEQ ID NO: 311734 - DNA, 20 bp, Artificial Sequence
  chemically synthesized
ggttctccagtctttggact

SEQ ID NO: 311735 - DNA, 20 bp, Artificial Sequence
  chemically synthesized
gttctccagtctttggactg

SEQ ID NO: 311736 - DNA, 20 bp, Artificial Sequence
  chemically synthesized
ggtgtaagtcccccagtcca

SEQ ID NO: 311737 - DNA, 20 bp, Artificial Sequence
  chemically synthesized
ttctccagtctttggactgg

SEQ ID NO: 311738 - DNA, 20 bp, Artificial Sequence
  chemically synthesized
aatcactggtgtaagtcccc

SEQ ID NO: 311739 - DNA, 20 bp, Artificial Sequence
  chemically synthesized
ttggactgggggacttacac

SEQ ID NO: 311740 - DNA, 20 bp, Artificial Sequence
  chemically synthesized
ccctgggaaatcactggtgt

SEQ ID NO: 311741 - DNA, 20 bp, Artificial Sequence
  chemically synthesized
tagagcccctgggaaatcac

SEQ ID NO: 311742 - DNA, 20 bp, Artificial Sequence
  chemically synthesized
gacttacaccagtgatttcc

SEQ ID NO: 311743 - DNA, 20 bp, Artificial Sequence
  chemically synthesized
acttacaccagtgatttccc

SEQ ID NO: 311744 - DNA, 20 bp, Artificial Sequence
  chemically synthesized
cttacaccagtgatttccca

SEQ ID NO: 311745 - DNA, 20 bp, Artificial Sequence
  chemically synthesized
ttacaccagtgatttcccag

SEQ ID NO: 311746 - DNA, 20 bp, Artificial Sequence
  chemically synthesized
ccaaaggccttagagcccct

SEQ ID NO: 311747 - DNA, 20 bp, Artificial Sequence
  chemically synthesized
gccaaaggccttagagcccc

SEQ ID NO: 311748 - DNA, 20 bp, Artificial Sequence
  chemically synthesized
agtgatttcccaggggctct

SEQ ID NO: 311749 - DNA, 20 bp, Artificial Sequence
  chemically synthesized
gtgatttcccaggggctcta

SEQ ID NO: 311750 - DNA, 20 bp, Artificial Sequence
  chemically synthesized
gtgtgaggccaaaggcctta

SEQ ID NO: 311751 - DNA, 20 bp, Artificial Sequence
  chemically synthesized
cccaggggctctaaggcctt

SEQ ID NO: 311752 - DNA, 20 bp, Artificial Sequence
  chemically synthesized
cagtgtgaggccaaaggcct

SEQ ID NO: 311753 - DNA, 20 bp, Artificial Sequence
  chemically synthesized
agctctcagtgtgaggccaa

SEQ ID NO: 311754 - DNA, 20 bp, Artificial Sequence
  chemically synthesized
cagctctcagtgtgaggcca

SEQ ID NO: 311755 - DNA, 20 bp, Artificial Sequence
  chemically synthesized
aaggcctttggcctcacact

SEQ ID NO: 311756 - DNA, 20 bp, Artificial Sequence
  chemically synthesized
acagtgcagctctcagtgtg

SEQ ID NO: 311757 - DNA, 20 bp, Artificial Sequence
  chemically synthesized
ggcctttggcctcacactga

SEQ ID NO: 311758 - DNA, 20 bp, Artificial Sequence
  chemically synthesized
gacagtgcagctctcagtgt

SEQ ID NO: 311759 - DNA, 20 bp, Artificial Sequence
  chemically synthesized
gaagctgacagtgcagctct

SEQ ID NO: 311760 - DNA, 20 bp, Artificial Sequence
  chemically synthesized
cacactgagagctgcactgt

SEQ ID NO: 311761 - DNA, 20 bp, Artificial Sequence
  chemically synthesized
gaccagagaagctgacagtg

SEQ ID NO: 311762 - DNA, 20 bp, Artificial Sequence
  chemically synthesized
ctcaagaccagagaagctga

SEQ ID NO: 311763 - DNA, 20 bp, Artificial Sequence
  chemically synthesized
agctgcactgtcagcttctc

SEQ ID NO: 311764 - DNA, 20 bp, Artificial Sequence
  chemically synthesized
caaaagcctcaagaccagag

SEQ ID NO: 311765 - DNA, 20 bp, Artificial Sequence
  chemically synthesized
ctgtcagcttctctggtctt

SEQ ID NO: 311766 - DNA, 20 bp, Artificial Sequence
  chemically synthesized
gtccaaaagcctcaagacca

SEQ ID NO: 311767 - DNA, 20 bp, Artificial Sequence
  chemically synthesized
tgtcagcttctctggtcttg

SEQ ID NO: 311768 - DNA, 20 bp, Artificial Sequence
  chemically synthesized
aagtccaaaagcctcaagac

SEQ ID NO: 311769 - DNA, 20 bp, Artificial Sequence
  chemically synthesized
agtccaagtccaaaagcctc

SEQ ID NO: 311770 - DNA, 20 bp, Artificial Sequence
  chemically synthesized
ttctctggtcttgaggcttt

SEQ ID NO: 311771 - DNA, 20 bp, Artificial Sequence
  chemically synthesized
ggtcttgaggcttttggact

SEQ ID NO: 311772 - DNA, 20 bp, Artificial Sequence
  chemically synthesized
ctggtgcagtccaagtccaa

SEQ ID NO: 311773 - DNA, 20 bp, Artificial Sequence
  chemically synthesized
ctagtagcctggtgcagtcc

SEQ ID NO: 311774 - DNA, 20 bp, Artificial Sequence
  chemically synthesized
cttttggacttggactgcac

SEQ ID NO: 311775 - DNA, 20 bp, Artificial Sequence
  chemically synthesized
ttttggacttggactgcacc

SEQ ID NO: 311776 - DNA, 20 bp, Artificial Sequence
  chemically synthesized
gagaacctagtagcctggtg

SEQ ID NO: 311777 - DNA, 20 bp, Artificial Sequence
  chemically synthesized
cttggactgcaccaggctac

SEQ ID NO: 311778 - DNA, 20 bp, Artificial Sequence
  chemically synthesized
ttggactgcaccaggctact

SEQ ID NO: 311779 - DNA, 20 bp, Artificial Sequence
  chemically synthesized
gaagagagaacctagtagcc

SEQ ID NO: 311780 - DNA, 20 bp, Artificial Sequence
  chemically synthesized
tgggagaagagagaacctag

SEQ ID NO: 311781 - DNA, 20 bp, Artificial Sequence
  chemically synthesized
agctgggagaagagagaacc

SEQ ID NO: 311782 - DNA, 20 bp, Artificial Sequence
  chemically synthesized
atctgcaagctgggagaaga

SEQ ID NO: 311783 - DNA, 20 bp, Artificial Sequence
  chemically synthesized
tactaggttctctcttctcc

SEQ ID NO: 311784 - DNA, 20 bp, Artificial Sequence
  chemically synthesized
ccatctgcaagctgggagaa

SEQ ID NO: 311785 - DNA, 20 bp, Artificial Sequence
  chemically synthesized
cgccatctgcaagctgggag

SEQ ID NO: 311786 - DNA, 20 bp, Artificial Sequence
  chemically synthesized
atacgccatctgcaagctgg

SEQ ID NO: 311787 - DNA, 20 bp, Artificial Sequence
  chemically synthesized
ttctctcttctcccagcttg

SEQ ID NO: 311788 - DNA, 20 bp, Artificial Sequence
  chemically synthesized
tgatacgccatctgcaagct

SEQ ID NO: 311789 - DNA, 20 bp, Artificial Sequence
  chemically synthesized
atgatacgccatctgcaagc

SEQ ID NO: 311790 - DNA, 20 bp, Artificial Sequence
  chemically synthesized
ctcttctcccagcttgcaga

SEQ ID NO: 311791 - DNA, 20 bp, Artificial Sequence
  chemically synthesized
tcccatgatacgccatctgc

SEQ ID NO: 311792 - DNA, 20 bp, Artificial Sequence
  chemically synthesized
agcttgcagatggcgtatca

SEQ ID NO: 311793 - DNA, 20 bp, Artificial Sequence
  chemically synthesized
gcttgcagatggcgtatcat

SEQ ID NO: 311794 - DNA, 20 bp, Artificial Sequence
  chemically synthesized
gctcacatgattacaaggtg

SEQ ID NO: 311795 - DNA, 20 bp, Artificial Sequence
  chemically synthesized
aattggctcacatgattaca

SEQ ID NO: 311796 - DNA, 20 bp, Artificial Sequence
  chemically synthesized
gaattggctcacatgattac

SEQ ID NO: 311797 - DNA, 20 bp, Artificial Sequence
  chemically synthesized
acttcaccttgtaatcatgt

SEQ ID NO: 311798 - DNA, 20 bp, Artificial Sequence
  chemically synthesized
aggagtttatcatggagaat

SEQ ID NO: 311799 - DNA, 20 bp, Artificial Sequence
  chemically synthesized
acatttaggagtttatcatg

SEQ ID NO: 311800 - DNA, 20 bp, Artificial Sequence
  chemically synthesized
atacatttaggagtttatca

SEQ ID NO: 311801 - DNA, 20 bp, Artificial Sequence
  chemically synthesized
tatataaaatatacatttag

SEQ ID NO: 311802 - DNA, 20 bp, Artificial Sequence
  chemically synthesized
tgtatataaaatatacattt

SEQ ID NO: 311803 - DNA, 20 bp, Artificial Sequence
  chemically synthesized
gtgtatataaaatatacatt

SEQ ID NO: 311804 - DNA, 20 bp, Artificial Sequence
  chemically synthesized
tggatggatggatggataga

SEQ ID NO: 311805 - DNA, 20 bp, Artificial Sequence
  chemically synthesized
tggatggatggatggatgga

SEQ ID NO: 311806 - DNA, 20 bp, Artificial Sequence
  chemically synthesized
ccactggatggatggatgga

SEQ ID NO: 311807 - DNA, 20 bp, Artificial Sequence
  chemically synthesized
gaacccactggatggatgga

SEQ ID NO: 311808 - DNA, 20 bp, Artificial Sequence
  chemically synthesized
tatccatccatccatccatc

SEQ ID NO: 311809 - DNA, 20 bp, Artificial Sequence
  chemically synthesized
gacagaacccactggatgga

SEQ ID NO: 311810 - DNA, 20 bp, Artificial Sequence
  chemically synthesized
ccatccatccatccatccag

SEQ ID NO: 311811 - DNA, 20 bp, Artificial Sequence
  chemically synthesized
catccatccatccatccagt

SEQ ID NO: 311812 - DNA, 20 bp, Artificial Sequence
  chemically synthesized
gaaggacagaacccactgga

SEQ ID NO: 311813 - DNA, 20 bp, Artificial Sequence
  chemically synthesized
tctagaaggacagaacccac

SEQ ID NO: 311814 - DNA, 20 bp, Artificial Sequence
  chemically synthesized
tccagtgggttctgtccttc

SEQ ID NO: 311815 - DNA, 20 bp, Artificial Sequence
  chemically synthesized
attaaggttctctagaagga

SEQ ID NO: 311816 - DNA, 20 bp, Artificial Sequence
  chemically synthesized
cagtgggttctgtccttcta

SEQ ID NO: 311817 - DNA, 20 bp, Artificial Sequence
  chemically synthesized
gtgtattaaggttctctaga

SEQ ID NO: 311818 - DNA, 20 bp, Artificial Sequence
  chemically synthesized
agtgtattaaggttctctag

SEQ ID NO: 311819 - DNA, 20 bp, Artificial Sequence
  chemically synthesized
cagagtgtattaaggttctc

SEQ ID NO: 311820 - DNA, 20 bp, Artificial Sequence
  chemically synthesized
gataaagacagagtgtatta

SEQ ID NO: 311821 - DNA, 20 bp, Artificial Sequence
  chemically synthesized
ggataaagacagagtgtatt

SEQ ID NO: 311822 - DNA, 20 bp, Artificial Sequence
  chemically synthesized
ataaagaatggataaagaca

SEQ ID NO: 311823 - DNA, 20 bp, Artificial Sequence
  chemically synthesized
ttataaagaatggataaaga

SEQ ID NO: 311824 - DNA, 20 bp, Artificial Sequence
  chemically synthesized
ataattataaagaatggata

SEQ ID NO: 311825 - DNA, 20 bp, Artificial Sequence
  chemically synthesized
ataaaaataattataaagaa

SEQ ID NO: 311826 - DNA, 20 bp, Artificial Sequence
  chemically synthesized
tcctaataaaaataattata

SEQ ID NO: 311827 - DNA, 20 bp, Artificial Sequence
  chemically synthesized
ttctttataattatttttat

SEQ ID NO: 311828 - DNA, 20 bp, Artificial Sequence
  chemically synthesized
tctttataattatttttatt

SEQ ID NO: 311829 - DNA, 20 bp, Artificial Sequence
  chemically synthesized
aaaatcaaaatacgatatga

SEQ ID NO: 311830 - DNA, 20 bp, Artificial Sequence
  chemically synthesized
attagcctgggcaacatagc

SEQ ID NO: 311831 - DNA, 20 bp, Artificial Sequence
  chemically synthesized
gatagtcttgctatgttgcc

SEQ ID NO: 311832 - DNA, 20 bp, Artificial Sequence
  chemically synthesized
aaagattagcctgggcaaca

SEQ ID NO: 311833 - DNA, 20 bp, Artificial Sequence
  chemically synthesized
atagtcttgctatgttgccc

SEQ ID NO: 311834 - DNA, 20 bp, Artificial Sequence
  chemically synthesized
agaagttcaaagattagcct

SEQ ID NO: 311835 - DNA, 20 bp, Artificial Sequence
  chemically synthesized
cagaagttcaaagattagcc

SEQ ID NO: 311836 - DNA, 20 bp, Artificial Sequence
  chemically synthesized
gagcccagaagttcaaagat

SEQ ID NO: 311837 - DNA, 20 bp, Artificial Sequence
  chemically synthesized
tgcttgagcccagaagttca

SEQ ID NO: 311838 - DNA, 20 bp, Artificial Sequence
  chemically synthesized
caggctaatctttgaacttc

SEQ ID NO: 311839 - DNA, 20 bp, Artificial Sequence
  chemically synthesized
aggctaatctttgaacttct

SEQ ID NO: 311840 - DNA, 20 bp, Artificial Sequence
  chemically synthesized
agaatattgcttgagcccag

SEQ ID NO: 311841 - DNA, 20 bp, Artificial Sequence
  chemically synthesized
atctttgaacttctgggctc

SEQ ID NO: 311842 - DNA, 20 bp, Artificial Sequence
  chemically synthesized
gagagaatattgcttgagcc

SEQ ID NO: 311843 - DNA, 20 bp, Artificial Sequence
  chemically synthesized
ctggggagagaatattgctt

SEQ ID NO: 311844 - DNA, 20 bp, Artificial Sequence
  chemically synthesized
ctcaagcaatattctctccc

SEQ ID NO: 311845 - DNA, 20 bp, Artificial Sequence
  chemically synthesized
gcactttggaaggctgggga

SEQ ID NO: 311846 - DNA, 20 bp, Artificial Sequence
  chemically synthesized
cagcactttggaaggctggg

SEQ ID NO: 311847 - DNA, 20 bp, Artificial Sequence
  chemically synthesized
cccagcactttggaaggctg

SEQ ID NO: 311848 - DNA, 20 bp, Artificial Sequence
  chemically synthesized
tcccagcactttggaaggct

SEQ ID NO: 311849 - DNA, 20 bp, Artificial Sequence
  chemically synthesized
atcccagcactttggaaggc

SEQ ID NO: 311850 - DNA, 20 bp, Artificial Sequence
  chemically synthesized
attctctccccagccttcca

SEQ ID NO: 311851 - DNA, 20 bp, Artificial Sequence
  chemically synthesized
tgtaatcccagcactttgga

SEQ ID NO: 311852 - DNA, 20 bp, Artificial Sequence
  chemically synthesized
ctgtaatcccagcactttgg

SEQ ID NO: 311853 - DNA, 20 bp, Artificial Sequence
  chemically synthesized
tccccagccttccaaagtgc

SEQ ID NO: 311854 - DNA, 20 bp, Artificial Sequence
  chemically synthesized
ccccagccttccaaagtgct

SEQ ID NO: 311855 - DNA, 20 bp, Artificial Sequence
  chemically synthesized
cacctgtaatcccagcactt

SEQ ID NO: 311856 - DNA, 20 bp, Artificial Sequence
  chemically synthesized
cttccaaagtgctgggatta

SEQ ID NO: 311857 - DNA, 20 bp, Artificial Sequence
  chemically synthesized
ttccaaagtgctgggattac

SEQ ID NO: 311858 - DNA, 20 bp, Artificial Sequence
  chemically synthesized
gtggctcacacctgtaatcc

SEQ ID NO: 311859 - DNA, 20 bp, Artificial Sequence
  chemically synthesized
agtgctgggattacaggtgt

SEQ ID NO: 311860 - DNA, 20 bp, Artificial Sequence
  chemically synthesized
caggtgtgagccactgtacc

SEQ ID NO: 311861 - DNA, 20 bp, Artificial Sequence
  chemically synthesized
aagaatgaggctaggtacag

SEQ ID NO: 311862 - DNA, 20 bp, Artificial Sequence
  chemically synthesized
gaaaagaatgaggctaggta

SEQ ID NO: 311863 - DNA, 20 bp, Artificial Sequence
  chemically synthesized
tatatgaaaagaatgaggct

SEQ ID NO: 311864 - DNA, 20 bp, Artificial Sequence
  chemically synthesized
gtatatgaaaagaatgaggc

SEQ ID NO: 311865 - DNA, 20 bp, Artificial Sequence
  chemically synthesized
aaaagtatatgaaaagaatg

SEQ ID NO: 311866 - DNA, 20 bp, Artificial Sequence
  chemically synthesized
taaaagtatatgaaaagaat

SEQ ID NO: 311867 - DNA, 20 bp, Artificial Sequence
  chemically synthesized
gagaattaaaagtatatgaa

SEQ ID NO: 311868 - DNA, 20 bp, Artificial Sequence
  chemically synthesized
ctaatattttggagaattaa

SEQ ID NO: 311869 - DNA, 20 bp, Artificial Sequence
  chemically synthesized
agttactgcctaatattttg

SEQ ID NO: 311870 - DNA, 20 bp, Artificial Sequence
  chemically synthesized
cttttaattctccaaaatat

SEQ ID NO: 311871 - DNA, 20 bp, Artificial Sequence
  chemically synthesized
ttttaattctccaaaatatt

SEQ ID NO: 311872 - DNA, 20 bp, Artificial Sequence
  chemically synthesized
gaagttactgcctaatattt

SEQ ID NO: 311873 - DNA, 20 bp, Artificial Sequence
  chemically synthesized
taattctccaaaatattagg

SEQ ID NO: 311874 - DNA, 20 bp, Artificial Sequence
  chemically synthesized
gttaaaatactttaatattg

SEQ ID NO: 311875 - DNA, 20 bp, Artificial Sequence
  chemically synthesized
aggcagtaacttcaatatta

SEQ ID NO: 311876 - DNA, 20 bp, Artificial Sequence
  chemically synthesized
taattcaaatgccttttata

SEQ ID NO: 311877 - DNA, 20 bp, Artificial Sequence
  chemically synthesized
gagaatttctgccatataaa

SEQ ID NO: 311878 - DNA, 20 bp, Artificial Sequence
  chemically synthesized
ggagaatttctgccatataa

SEQ ID NO: 311879 - DNA, 20 bp, Artificial Sequence
  chemically synthesized
ttcaaatgccttttatatgg

SEQ ID NO: 311880 - DNA, 20 bp, Artificial Sequence
  chemically synthesized
ttatatggcagaaattctcc

SEQ ID NO: 311881 - DNA, 20 bp, Artificial Sequence
  chemically synthesized
ctgtgtggtcatagaaccag

SEQ ID NO: 311882 - DNA, 20 bp, Artificial Sequence
  chemically synthesized
gtctgtgtggtcatagaacc

SEQ ID NO: 311883 - DNA, 20 bp, Artificial Sequence
  chemically synthesized
ggtctgtgtggtcatagaac

SEQ ID NO: 311884 - DNA, 20 bp, Artificial Sequence
  chemically synthesized
attgaaggtctgtgtggtca

SEQ ID NO: 311885 - DNA, 20 bp, Artificial Sequence
  chemically synthesized
ctcctggttctatgaccaca

SEQ ID NO: 311886 - DNA, 20 bp, Artificial Sequence
  chemically synthesized
agatgtattgaaggtctgtg

SEQ ID NO: 311887 - DNA, 20 bp, Artificial Sequence
  chemically synthesized
gccaactatagatgtattga

SEQ ID NO: 311888 - DNA, 20 bp, Artificial Sequence
  chemically synthesized
agccaactatagatgtattg

SEQ ID NO: 311889 - DNA, 20 bp, Artificial Sequence
  chemically synthesized
acagaccttcaatacatcta

SEQ ID NO: 311890 - DNA, 20 bp, Artificial Sequence
  chemically synthesized
accttcaatacatctatagt

SEQ ID NO: 311891 - DNA, 20 bp, Artificial Sequence
  chemically synthesized
taaaagttgagagccaacta

SEQ ID NO: 311892 - DNA, 20 bp, Artificial Sequence
  chemically synthesized
ctgtacaagttaaaagttga

SEQ ID NO: 311893 - DNA, 20 bp, Artificial Sequence
  chemically synthesized
ttctgtacaagttaaaagtt

SEQ ID NO: 311894 - DNA, 20 bp, Artificial Sequence
  chemically synthesized
tgttattctgtacaagttaa

SEQ ID NO: 311895 - DNA, 20 bp, Artificial Sequence
  chemically synthesized
ctctcaacttttaacttgta

SEQ ID NO: 311896 - DNA, 20 bp, Artificial Sequence
  chemically synthesized
ttaggtatgttattctgtac

SEQ ID NO: 311897 - DNA, 20 bp, Artificial Sequence
  chemically synthesized
cagaataacatacctaaaaa

SEQ ID NO: 311898 - DNA, 20 bp, Artificial Sequence
  chemically synthesized
agaataacatacctaaaaat

SEQ ID NO: 311899 - DNA, 20 bp, Artificial Sequence
  chemically synthesized
gaataacatacctaaaaata

SEQ ID NO: 311900 - DNA, 20 bp, Artificial Sequence
  chemically synthesized
accattaaaaccctattttt

SEQ ID NO: 311901 - DNA, 20 bp, Artificial Sequence
  chemically synthesized
aaccattaaaaccctatttt

SEQ ID NO: 311902 - DNA, 20 bp, Artificial Sequence
  chemically synthesized
acctaaaaatagggttttaa

SEQ ID NO: 311903 - DNA, 20 bp, Artificial Sequence
  chemically synthesized
taatggttttgctttttctt

SEQ ID NO: 311904 - DNA, 20 bp, Artificial Sequence
  chemically synthesized
gaaaatgtcttccaaagaaa

SEQ ID NO: 311905 - DNA, 20 bp, Artificial Sequence
  chemically synthesized
tggttttgctttttctttgg

SEQ ID NO: 311906 - DNA, 20 bp, Artificial Sequence
  chemically synthesized
tctaatgaaaatgtcttcca

SEQ ID NO: 311907 - DNA, 20 bp, Artificial Sequence
  chemically synthesized
tctttggaagacattttcat

SEQ ID NO: 311908 - DNA, 20 bp, Artificial Sequence
  chemically synthesized
tttggaagacattttcatta

SEQ ID NO: 311909 - DNA, 20 bp, Artificial Sequence
  chemically synthesized
ttcattagagcatcttctat

SEQ ID NO: 311910 - DNA, 20 bp, Artificial Sequence
  chemically synthesized
gttaagcccatagcttatag

SEQ ID NO: 311911 - DNA, 20 bp, Artificial Sequence
  chemically synthesized
agagcatcttctataagcta

SEQ ID NO: 311912 - DNA, 20 bp, Artificial Sequence
  chemically synthesized
atggttaagcccatagctta

SEQ ID NO: 311913 - DNA, 20 bp, Artificial Sequence
  chemically synthesized
gagcatcttctataagctat

SEQ ID NO: 311914 - DNA, 20 bp, Artificial Sequence
  chemically synthesized
gagaaacatggttaagccca

SEQ ID NO: 311915 - DNA, 20 bp, Artificial Sequence
  chemically synthesized
aaagaaggagaaacatggtt

SEQ ID NO: 311916 - DNA, 20 bp, Artificial Sequence
  chemically synthesized
taaagaaagaaggagaaaca

SEQ ID NO: 311917 - DNA, 20 bp, Artificial Sequence
  chemically synthesized
gtttctaataaagaaagaag

SEQ ID NO: 311918 - DNA, 20 bp, Artificial Sequence
  chemically synthesized
ctgtttctaataaagaaaga

SEQ ID NO: 311919 - DNA, 20 bp, Artificial Sequence
  chemically synthesized
actgtttctaataaagaaag

SEQ ID NO: 311920 - DNA, 20 bp, Artificial Sequence
  chemically synthesized
gtttctccttctttctttat

SEQ ID NO: 311921 - DNA, 20 bp, Artificial Sequence
  chemically synthesized
ataactgtttctaataaaga

SEQ ID NO: 311922 - DNA, 20 bp, Artificial Sequence
  chemically synthesized
ggagataactgtttctaata

SEQ ID NO: 311923 - DNA, 20 bp, Artificial Sequence
  chemically synthesized
ccttctttctttattagaaa

SEQ ID NO: 311924 - DNA, 20 bp, Artificial Sequence
  chemically synthesized
attagaaacagttatctccc

SEQ ID NO: 311925 - DNA, 20 bp, Artificial Sequence
  chemically synthesized
agaaagccttttgttcttgg

SEQ ID NO: 311926 - DNA, 20 bp, Artificial Sequence
  chemically synthesized
aaagaaagccttttgttctt

SEQ ID NO: 311927 - DNA, 20 bp, Artificial Sequence
  chemically synthesized
cagttatctcccaagaacaa

SEQ ID NO: 311928 - DNA, 20 bp, Artificial Sequence
  chemically synthesized
taaagaaagccttttgttct

SEQ ID NO: 311929 - DNA, 20 bp, Artificial Sequence
  chemically synthesized
agttatctcccaagaacaaa

SEQ ID NO: 311930 - DNA, 20 bp, Artificial Sequence
  chemically synthesized
agaacaaaaggctttcttta

SEQ ID NO: 311931 - DNA, 20 bp, Artificial Sequence
  chemically synthesized
ctataaaaagaccataaaga

SEQ ID NO: 311932 - DNA, 20 bp, Artificial Sequence
  chemically synthesized
aagactataaaaagaccata

SEQ ID NO: 311933 - DNA, 20 bp, Artificial Sequence
  chemically synthesized
ctttctttatggtcttttta

SEQ ID NO: 311934 - DNA, 20 bp, Artificial Sequence
  chemically synthesized
gcatgaaaaaagactataaa

SEQ ID NO: 311935 - DNA, 20 bp, Artificial Sequence
  chemically synthesized
tataaaaacttgcatgaaaa

SEQ ID NO: 311936 - DNA, 20 bp, Artificial Sequence
  chemically synthesized
tttatagtcttttttcatgc

SEQ ID NO: 311937 - DNA, 20 bp, Artificial Sequence
  chemically synthesized
aatggtaaatcaagagagcg

SEQ ID NO: 311938 - DNA, 20 bp, Artificial Sequence
  chemically synthesized
ggataaatggtaaatcaaga

SEQ ID NO: 311939 - DNA, 20 bp, Artificial Sequence
  chemically synthesized
atggataaatggtaaatcaa

SEQ ID NO: 311940 - DNA, 20 bp, Artificial Sequence
  chemically synthesized
ggatggataaatggtaaatc

SEQ ID NO: 311941 - DNA, 20 bp, Artificial Sequence
  chemically synthesized
gagtttctaggatggataaa

SEQ ID NO: 311942 - DNA, 20 bp, Artificial Sequence
  chemically synthesized
gatttaccatttatccatcc

SEQ ID NO: 311943 - DNA, 20 bp, Artificial Sequence
  chemically synthesized
ggtgggtagagtttctagga

SEQ ID NO: 311944 - DNA, 20 bp, Artificial Sequence
  chemically synthesized
tggaggtgggtagagtttct

SEQ ID NO: 311945 - DNA, 20 bp, Artificial Sequence
  chemically synthesized
gtggaggtgggtagagtttc

SEQ ID NO: 311946 - DNA, 20 bp, Artificial Sequence
  chemically synthesized
gagattggtggaggtgggta

SEQ ID NO: 311947 - DNA, 20 bp, Artificial Sequence
  chemically synthesized
gtgagattggtggaggtggg

SEQ ID NO: 311948 - DNA, 20 bp, Artificial Sequence
  chemically synthesized
taagtgagattggtggaggt

SEQ ID NO: 311949 - DNA, 20 bp, Artificial Sequence
  chemically synthesized
ataagtgagattggtggagg

SEQ ID NO: 311950 - DNA, 20 bp, Artificial Sequence
  chemically synthesized
atcataagtgagattggtgg

SEQ ID NO: 311951 - DNA, 20 bp, Artificial Sequence
  chemically synthesized
catcataagtgagattggtg

SEQ ID NO: 311952 - DNA, 20 bp, Artificial Sequence
  chemically synthesized
gccatcataagtgagattgg

SEQ ID NO: 311953 - DNA, 20 bp, Artificial Sequence
  chemically synthesized
gctgccatcataagtgagat

SEQ ID NO: 311954 - DNA, 20 bp, Artificial Sequence
  chemically synthesized
ctgctgctgccatcataagt

SEQ ID NO: 311955 - DNA, 20 bp, Artificial Sequence
  chemically synthesized
tccaccaatctcacttatga

SEQ ID NO: 311956 - DNA, 20 bp, Artificial Sequence
  chemically synthesized
accaatctcacttatgatgg

SEQ ID NO: 311957 - DNA, 20 bp, Artificial Sequence
  chemically synthesized
caggctgctgctgccatcat

SEQ ID NO: 311958 - DNA, 20 bp, Artificial Sequence
  chemically synthesized
aatctcacttatgatggcag

SEQ ID NO: 311959 - DNA, 20 bp, Artificial Sequence
  chemically synthesized
ctcacttatgatggcagcag

SEQ ID NO: 311960 - DNA, 20 bp, Artificial Sequence
  chemically synthesized
gatggcagcagcagcctgtc

SEQ ID NO: 311961 - DNA, 20 bp, Artificial Sequence
  chemically synthesized
tggcagcagcagcctgtctg

SEQ ID NO: 311962 - DNA, 20 bp, Artificial Sequence
  chemically synthesized
ttgcagtggccgctccagac

SEQ ID NO: 311963 - DNA, 20 bp, Artificial Sequence
  chemically synthesized
cagcagcagcctgtctggag

SEQ ID NO: 311964 - DNA, 20 bp, Artificial Sequence
  chemically synthesized
tttgcagtggccgctccaga

SEQ ID NO: 311965 - DNA, 20 bp, Artificial Sequence
  chemically synthesized
catctttgcagtggccgctc

SEQ ID NO: 311966 - DNA, 20 bp, Artificial Sequence
  chemically synthesized
tgtctggagcggccactgca

SEQ ID NO: 311967 - DNA, 20 bp, Artificial Sequence
  chemically synthesized
tgcagctggcatctttgcag

SEQ ID NO: 311968 - DNA, 20 bp, Artificial Sequence
  chemically synthesized
tgctgcagctggcatctttg

SEQ ID NO: 311969 - DNA, 20 bp, Artificial Sequence
  chemically synthesized
agcggccactgcaaagatgc

SEQ ID NO: 311970 - DNA, 20 bp, Artificial Sequence
  chemically synthesized
cactgcaaagatgccagctg

SEQ ID NO: 311971 - DNA, 20 bp, Artificial Sequence
  chemically synthesized
cacgcctcccttgctgcagc

SEQ ID NO: 311972 - DNA, 20 bp, Artificial Sequence
  chemically synthesized
gcaaagatgccagctgcagc

SEQ ID NO: 311973 - DNA, 20 bp, Artificial Sequence
  chemically synthesized
caaagatgccagctgcagca

SEQ ID NO: 311974 - DNA, 20 bp, Artificial Sequence
  chemically synthesized
aaagatgccagctgcagcaa

SEQ ID NO: 311975 - DNA, 20 bp, Artificial Sequence
  chemically synthesized
tggccacgcctcccttgctg

SEQ ID NO: 311976 - DNA, 20 bp, Artificial Sequence
  chemically synthesized
agatgccagctgcagcaagg

SEQ ID NO: 311977 - DNA, 20 bp, Artificial Sequence
  chemically synthesized
gatgccagctgcagcaaggg

SEQ ID NO: 311978 - DNA, 20 bp, Artificial Sequence
  chemically synthesized
cagctgcagcaagggaggcg

SEQ ID NO: 311979 - DNA, 20 bp, Artificial Sequence
  chemically synthesized
tgcagcaagggaggcgtggc

SEQ ID NO: 311980 - DNA, 20 bp, Artificial Sequence
  chemically synthesized
gcagcaagggaggcgtggcc

SEQ ID NO: 311981 - DNA, 20 bp, Artificial Sequence
  chemically synthesized
cagcaagggaggcgtggcca

SEQ ID NO: 311982 - DNA, 20 bp, Artificial Sequence
  chemically synthesized
ctccacacagtgcacagccc

SEQ ID NO: 311983 - DNA, 20 bp, Artificial Sequence
  chemically synthesized
tggtggctccacacagtgca

SEQ ID NO: 311984 - DNA, 20 bp, Artificial Sequence
  chemically synthesized
ggccagggctgtgcactgtg

SEQ ID NO: 311985 - DNA, 20 bp, Artificial Sequence
  chemically synthesized
ccagggctgtgcactgtgtg

SEQ ID NO: 311986 - DNA, 20 bp, Artificial Sequence
  chemically synthesized
tggcccttggtggctccaca

SEQ ID NO: 311987 - DNA, 20 bp, Artificial Sequence
  chemically synthesized
gtgcactgtgtggagccacc

SEQ ID NO: 311988 - DNA, 20 bp, Artificial Sequence
  chemically synthesized
tgcactgtgtggagccacca

SEQ ID NO: 311989 - DNA, 20 bp, Artificial Sequence
  chemically synthesized
gcactgtgtggagccaccaa

SEQ ID NO: 311990 - DNA, 20 bp, Artificial Sequence
  chemically synthesized
tgcttgttcctggcccttgg

SEQ ID NO: 311991 - DNA, 20 bp, Artificial Sequence
  chemically synthesized
tgtgtggagccaccaagggc

SEQ ID NO: 311992 - DNA, 20 bp, Artificial Sequence
  chemically synthesized
gtgtggagccaccaagggcc

SEQ ID NO: 311993 - DNA, 20 bp, Artificial Sequence
  chemically synthesized
tcctgcttgttcctggccct

SEQ ID NO: 311994 - DNA, 20 bp, Artificial Sequence
  chemically synthesized
agccaccaagggccaggaac

SEQ ID NO: 311995 - DNA, 20 bp, Artificial Sequence
  chemically synthesized
gcagcgctcctgcttgttcc

SEQ ID NO: 311996 - DNA, 20 bp, Artificial Sequence
  chemically synthesized
caccaagggccaggaacaag

SEQ ID NO: 311997 - DNA, 20 bp, Artificial Sequence
  chemically synthesized
accaagggccaggaacaagc

SEQ ID NO: 311998 - DNA, 20 bp, Artificial Sequence
  chemically synthesized
caagggccaggaacaagcag

SEQ ID NO: 311999 - DNA, 20 bp, Artificial Sequence
  chemically synthesized
cctgccaactcagtagggag

SEQ ID NO: 312000 - DNA, 20 bp, Artificial Sequence
  chemically synthesized
caggagcgctgctccctact

SEQ ID NO: 312001 - DNA, 20 bp, Artificial Sequence
  chemically synthesized
caccctgccaactcagtagg

SEQ ID NO: 312002 - DNA, 20 bp, Artificial Sequence
  chemically synthesized
cccaccctgccaactcagta

SEQ ID NO: 312003 - DNA, 20 bp, Artificial Sequence
  chemically synthesized
agcgctgctccctactgagt

SEQ ID NO: 312004 - DNA, 20 bp, Artificial Sequence
  chemically synthesized
tcccaccctgccaactcagt

SEQ ID NO: 312005 - DNA, 20 bp, Artificial Sequence
  chemically synthesized
ctcccaccctgccaactcag

SEQ ID NO: 312006 - DNA, 20 bp, Artificial Sequence
  chemically synthesized
gctgctccctactgagttgg

SEQ ID NO: 312007 - DNA, 20 bp, Artificial Sequence
  chemically synthesized
ctgctccctactgagttggc

SEQ ID NO: 312008 - DNA, 20 bp, Artificial Sequence
  chemically synthesized
gggctcccaccctgccaact

SEQ ID NO: 312009 - DNA, 20 bp, Artificial Sequence
  chemically synthesized
tgctccctactgagttggca

SEQ ID NO: 312010 - DNA, 20 bp, Artificial Sequence
  chemically synthesized
tccctactgagttggcaggg

SEQ ID NO: 312011 - DNA, 20 bp, Artificial Sequence
  chemically synthesized
ccctactgagttggcagggt

SEQ ID NO: 312012 - DNA, 20 bp, Artificial Sequence
  chemically synthesized
ctactgagttggcagggtgg

SEQ ID NO: 312013 - DNA, 20 bp, Artificial Sequence
  chemically synthesized
cagctgcacctggaagcatg

SEQ ID NO: 312014 - DNA, 20 bp, Artificial Sequence
  chemically synthesized
gggtgggagccccatgcttc

SEQ ID NO: 312015 - DNA, 20 bp, Artificial Sequence
  chemically synthesized
gcagctgcacctggaagcat

SEQ ID NO: 312016 - DNA, 20 bp, Artificial Sequence
  chemically synthesized
ggtgggagccccatgcttcc

SEQ ID NO: 312017 - DNA, 20 bp, Artificial Sequence
  chemically synthesized
tgcagctgcacctggaagca

SEQ ID NO: 312018 - DNA, 20 bp, Artificial Sequence
  chemically synthesized
gagccccatgcttccaggtg

SEQ ID NO: 312019 - DNA, 20 bp, Artificial Sequence
  chemically synthesized
gtggctgcagctgcacctgg

SEQ ID NO: 312020 - DNA, 20 bp, Artificial Sequence
  chemically synthesized
tgggtggctgcagctgcacc

SEQ ID NO: 312021 - DNA, 20 bp, Artificial Sequence
  chemically synthesized
catgcttccaggtgcagctg

SEQ ID NO: 312022 - DNA, 20 bp, Artificial Sequence
  chemically synthesized
gagctgtggctgggtggctg

SEQ ID NO: 312023 - DNA, 20 bp, Artificial Sequence
  chemically synthesized
caggtgcagctgcagccacc

SEQ ID NO: 312024 - DNA, 20 bp, Artificial Sequence
  chemically synthesized
ggtccggagctgtggctggg

SEQ ID NO: 312025 - DNA, 20 bp, Artificial Sequence
  chemically synthesized
cagctgcagccacccagcca

SEQ ID NO: 312026 - DNA, 20 bp, Artificial Sequence
  chemically synthesized
ccaggtccggagctgtggct

SEQ ID NO: 312027 - DNA, 20 bp, Artificial Sequence
  chemically synthesized
cccaggtccggagctgtggc

SEQ ID NO: 312028 - DNA, 20 bp, Artificial Sequence
  chemically synthesized
cagccacccagccacagctc

SEQ ID NO: 312029 - DNA, 20 bp, Artificial Sequence
  chemically synthesized
aatgcccaggtccggagctg

SEQ ID NO: 312030 - DNA, 20 bp, Artificial Sequence
  chemically synthesized
cccagccacagctccggacc

SEQ ID NO: 312031 - DNA, 20 bp, Artificial Sequence
  chemically synthesized
ccagccacagctccggacct

SEQ ID NO: 312032 - DNA, 20 bp, Artificial Sequence
  chemically synthesized
cgcaggaatgcccaggtccg

SEQ ID NO: 312033 - DNA, 20 bp, Artificial Sequence
  chemically synthesized
agcgcaggaatgcccaggtc

SEQ ID NO: 312034 - DNA, 20 bp, Artificial Sequence
  chemically synthesized
ccaagagcgcaggaatgccc

SEQ ID NO: 312035 - DNA, 20 bp, Artificial Sequence
  chemically synthesized
cccaagagcgcaggaatgcc

SEQ ID NO: 312036 - DNA, 20 bp, Artificial Sequence
  chemically synthesized
cctgggcattcctgcgctct

SEQ ID NO: 312037 - DNA, 20 bp, Artificial Sequence
  chemically synthesized
tcccaggcccccaagagcgc

SEQ ID NO: 312038 - DNA, 20 bp, Artificial Sequence
  chemically synthesized
ctgggcattcctgcgctctt

SEQ ID NO: 312039 - DNA, 20 bp, Artificial Sequence
  chemically synthesized
ttcccaggcccccaagagcg

SEQ ID NO: 312040 - DNA, 20 bp, Artificial Sequence
  chemically synthesized
tgggcattcctgcgctcttg

SEQ ID NO: 312041 - DNA, 20 bp, Artificial Sequence
  chemically synthesized
gggcattcctgcgctcttgg

SEQ ID NO: 312042 - DNA, 20 bp, Artificial Sequence
  chemically synthesized
ggggcttcccaggcccccaa

SEQ ID NO: 312043 - DNA, 20 bp, Artificial Sequence
  chemically synthesized
ttcctgcgctcttgggggcc

SEQ ID NO: 312044 - DNA, 20 bp, Artificial Sequence
  chemically synthesized
ggggggcttcccaggccccc

SEQ ID NO: 312045 - DNA, 20 bp, Artificial Sequence
  chemically synthesized
tcctgcgctcttgggggcct

SEQ ID NO: 312046 - DNA, 20 bp, Artificial Sequence
  chemically synthesized
tgcgctcttgggggcctggg

SEQ ID NO: 312047 - DNA, 20 bp, Artificial Sequence
  chemically synthesized
tggaggcaggggggcttccc

SEQ ID NO: 312048 - DNA, 20 bp, Artificial Sequence
  chemically synthesized
gtggaggcaggggggcttcc

SEQ ID NO: 312049 - DNA, 20 bp, Artificial Sequence
  chemically synthesized
cttagtatgtggaggcaggg

SEQ ID NO: 312050 - DNA, 20 bp, Artificial Sequence
  chemically synthesized
tcttagtatgtggaggcagg

SEQ ID NO: 312051 - DNA, 20 bp, Artificial Sequence
  chemically synthesized
ttcttagtatgtggaggcag

SEQ ID NO: 312052 - DNA, 20 bp, Artificial Sequence
  chemically synthesized
cttcttagtatgtggaggca

SEQ ID NO: 312053 - DNA, 20 bp, Artificial Sequence
  chemically synthesized
acttcttagtatgtggaggc

SEQ ID NO: 312054 - DNA, 20 bp, Artificial Sequence
  chemically synthesized
cacttcttagtatgtggagg

SEQ ID NO: 312055 - DNA, 20 bp, Artificial Sequence
  chemically synthesized
aggcacttcttagtatgtgg

SEQ ID NO: 312056 - DNA, 20 bp, Artificial Sequence
  chemically synthesized
caggcacttcttagtatgtg

SEQ ID NO: 312057 - DNA, 20 bp, Artificial Sequence
  chemically synthesized
cccccctgcctccacatact

SEQ ID NO: 312058 - DNA, 20 bp, Artificial Sequence
  chemically synthesized
agcaggcacttcttagtatg

SEQ ID NO: 312059 - DNA, 20 bp, Artificial Sequence
  chemically synthesized
ccctgcctccacatactaag

SEQ ID NO: 312060 - DNA, 20 bp, Artificial Sequence
  chemically synthesized
gagtgggagcaggcacttct

SEQ ID NO: 312061 - DNA, 20 bp, Artificial Sequence
  chemically synthesized
agatgccagggagtgggagc

SEQ ID NO: 312062 - DNA, 20 bp, Artificial Sequence
  chemically synthesized
gagatgccagggagtgggag

SEQ ID NO: 312063 - DNA, 20 bp, Artificial Sequence
  chemically synthesized
gaggagatgccagggagtgg

SEQ ID NO: 312064 - DNA, 20 bp, Artificial Sequence
  chemically synthesized
aagtgcctgctcccactccc

SEQ ID NO: 312065 - DNA, 20 bp, Artificial Sequence
  chemically synthesized
gcgaggagatgccagggagt

SEQ ID NO: 312066 - DNA, 20 bp, Artificial Sequence
  chemically synthesized
agcgaggagatgccagggag

SEQ ID NO: 312067 - DNA, 20 bp, Artificial Sequence
  chemically synthesized
gggagcgaggagatgccagg

SEQ ID NO: 312068 - DNA, 20 bp, Artificial Sequence
  chemically synthesized
cggggagcgaggagatgcca

SEQ ID NO: 312069 - DNA, 20 bp, Artificial Sequence
  chemically synthesized
gcggggagcgaggagatgcc

SEQ ID NO: 312070 - DNA, 20 bp, Artificial Sequence
  chemically synthesized
tgcggggagcgaggagatgc

SEQ ID NO: 312071 - DNA, 20 bp, Artificial Sequence
  chemically synthesized
gagccagtgcggggagcgag

SEQ ID NO: 312072 - DNA, 20 bp, Artificial Sequence
  chemically synthesized
aggagccagtgcggggagcg

SEQ ID NO: 312073 - DNA, 20 bp, Artificial Sequence
  chemically synthesized
caggagccagtgcggggagc

SEQ ID NO: 312074 - DNA, 20 bp, Artificial Sequence
  chemically synthesized
catctcctcgctccccgcac

SEQ ID NO: 312075 - DNA, 20 bp, Artificial Sequence
  chemically synthesized
ctcccaggagccagtgcggg

SEQ ID NO: 312076 - DNA, 20 bp, Artificial Sequence
  chemically synthesized
ttctcccaggagccagtgcg

SEQ ID NO: 312077 - DNA, 20 bp, Artificial Sequence
  chemically synthesized
cttctcccaggagccagtgc

SEQ ID NO: 312078 - DNA, 20 bp, Artificial Sequence
  chemically synthesized
gcttctcccaggagccagtg

SEQ ID NO: 312079 - DNA, 20 bp, Artificial Sequence
  chemically synthesized
tcgctccccgcactggctcc

SEQ ID NO: 312080 - DNA, 20 bp, Artificial Sequence
  chemically synthesized
cgctccccgcactggctcct

SEQ ID NO: 312081 - DNA, 20 bp, Artificial Sequence
  chemically synthesized
actttgcttctcccaggagc

SEQ ID NO: 312082 - DNA, 20 bp, Artificial Sequence
  chemically synthesized
ctccccgcactggctcctgg

SEQ ID NO: 312083 - DNA, 20 bp, Artificial Sequence
  chemically synthesized
cccgcactggctcctgggag

SEQ ID NO: 312084 - DNA, 20 bp, Artificial Sequence
  chemically synthesized
cgcaactttgcttctcccag

SEQ ID NO: 312085 - DNA, 20 bp, Artificial Sequence
  chemically synthesized
gccgcaactttgcttctccc

SEQ ID NO: 312086 - DNA, 20 bp, Artificial Sequence
  chemically synthesized
ggccgcaactttgcttctcc

SEQ ID NO: 312087 - DNA, 20 bp, Artificial Sequence
  chemically synthesized
actggctcctgggagaagca

SEQ ID NO: 312088 - DNA, 20 bp, Artificial Sequence
  chemically synthesized
tcctgggagaagcaaagttg

SEQ ID NO: 312089 - DNA, 20 bp, Artificial Sequence
  chemically synthesized
ggagaagcaaagttgcggcc

SEQ ID NO: 312090 - DNA, 20 bp, Artificial Sequence
  chemically synthesized
agcaaagttgcggccaagac

SEQ ID NO: 312091 - DNA, 20 bp, Artificial Sequence
  chemically synthesized
gcaaagttgcggccaagacc

SEQ ID NO: 312092 - DNA, 20 bp, Artificial Sequence
  chemically synthesized
gttgcgacaacacctggtct

SEQ ID NO: 312093 - DNA, 20 bp, Artificial Sequence
  chemically synthesized
agtcaggttgcgacaacacc

SEQ ID NO: 312094 - DNA, 20 bp, Artificial Sequence
  chemically synthesized
aggtgttgtcgcaacctgac

SEQ ID NO: 312095 - DNA, 20 bp, Artificial Sequence
  chemically synthesized
gagcacacacataaccagtc

SEQ ID NO: 312096 - DNA, 20 bp, Artificial Sequence
  chemically synthesized
cgagcacacacataaccagt

SEQ ID NO: 312097 - DNA, 20 bp, Artificial Sequence
  chemically synthesized
gtcccgagcacacacataac

SEQ ID NO: 312098 - DNA, 20 bp, Artificial Sequence
  chemically synthesized
tgactggttatgtgtgtgct

SEQ ID NO: 312099 - DNA, 20 bp, Artificial Sequence
  chemically synthesized
gactggttatgtgtgtgctc

SEQ ID NO: 312100 - DNA, 20 bp, Artificial Sequence
  chemically synthesized
ggttatgtgtgtgctcggga

SEQ ID NO: 312101 - DNA, 20 bp, Artificial Sequence
  chemically synthesized
tggcatgccagcactgtccc

SEQ ID NO: 312102 - DNA, 20 bp, Artificial Sequence
  chemically synthesized
gtgtgtgctcgggacagtgc

SEQ ID NO: 312103 - DNA, 20 bp, Artificial Sequence
  chemically synthesized
tcgggacagtgctggcatgc

SEQ ID NO: 312104 - DNA, 20 bp, Artificial Sequence
  chemically synthesized
gcagcagggggctggcatgc

SEQ ID NO: 312105 - DNA, 20 bp, Artificial Sequence
  chemically synthesized
ggcgcaaggcagcagggggc

SEQ ID NO: 312106 - DNA, 20 bp, Artificial Sequence
  chemically synthesized
gacgggcgcaaggcagcagg

SEQ ID NO: 312107 - DNA, 20 bp, Artificial Sequence
  chemically synthesized
agacgggcgcaaggcagcag

SEQ ID NO: 312108 - DNA, 20 bp, Artificial Sequence
  chemically synthesized
cagacgggcgcaaggcagca

SEQ ID NO: 312109 - DNA, 20 bp, Artificial Sequence
  chemically synthesized
ccagacgggcgcaaggcagc

SEQ ID NO: 312110 - DNA, 20 bp, Artificial Sequence
  chemically synthesized
tccagacgggcgcaaggcag

SEQ ID NO: 312111 - DNA, 20 bp, Artificial Sequence
  chemically synthesized
aagtccagacgggcgcaagg

SEQ ID NO: 312112 - DNA, 20 bp, Artificial Sequence
  chemically synthesized
ccaaagtccagacgggcgca

SEQ ID NO: 312113 - DNA, 20 bp, Artificial Sequence
  chemically synthesized
cccaaagtccagacgggcgc

SEQ ID NO: 312114 - DNA, 20 bp, Artificial Sequence
  chemically synthesized
cctgctgccttgcgcccgtc

SEQ ID NO: 312115 - DNA, 20 bp, Artificial Sequence
  chemically synthesized
tcagtgcccaaagtccagac

SEQ ID NO: 312116 - DNA, 20 bp, Artificial Sequence
  chemically synthesized
atcagtgcccaaagtccaga

SEQ ID NO: 312117 - DNA, 20 bp, Artificial Sequence
  chemically synthesized
ccttgcgcccgtctggactt

SEQ ID NO: 312118 - DNA, 20 bp, Artificial Sequence
  chemically synthesized
cttgcgcccgtctggacttt

SEQ ID NO: 312119 - DNA, 20 bp, Artificial Sequence
  chemically synthesized
gctcatcagtgcccaaagtc

SEQ ID NO: 312120 - DNA, 20 bp, Artificial Sequence
  chemically synthesized
cccatgctcatcagtgccca

SEQ ID NO: 312121 - DNA, 20 bp, Artificial Sequence
  chemically synthesized
tctggactttgggcactgat

SEQ ID NO: 312122 - DNA, 20 bp, Artificial Sequence
  chemically synthesized
actttgggcactgatgagca

SEQ ID NO: 312123 - DNA, 20 bp, Artificial Sequence
  chemically synthesized
agcctctctcccatgctcat

SEQ ID NO: 312124 - DNA, 20 bp, Artificial Sequence
  chemically synthesized
ctttgggcactgatgagcat

SEQ ID NO: 312125 - DNA, 20 bp, Artificial Sequence
  chemically synthesized
ttgggcactgatgagcatgg

SEQ ID NO: 312126 - DNA, 20 bp, Artificial Sequence
  chemically synthesized
gggcactgatgagcatggga

SEQ ID NO: 312127 - DNA, 20 bp, Artificial Sequence
  chemically synthesized
gcactgatgagcatgggaga

SEQ ID NO: 312128 - DNA, 20 bp, Artificial Sequence
  chemically synthesized
cactgatgagcatgggagag

SEQ ID NO: 312129 - DNA, 20 bp, Artificial Sequence
  chemically synthesized
atgagcatgggagagaggct

SEQ ID NO: 312130 - DNA, 20 bp, Artificial Sequence
  chemically synthesized
agcatgggagagaggctgag

SEQ ID NO: 312131 - DNA, 20 bp, Artificial Sequence
  chemically synthesized
gcatgggagagaggctgagt

SEQ ID NO: 312132 - DNA, 20 bp, Artificial Sequence
  chemically synthesized
catgggagagaggctgagtg

SEQ ID NO: 312133 - DNA, 20 bp, Artificial Sequence
  chemically synthesized
aaccatcctcagtccccact

SEQ ID NO: 312134 - DNA, 20 bp, Artificial Sequence
  chemically synthesized
agagaggctgagtggggact

SEQ ID NO: 312135 - DNA, 20 bp, Artificial Sequence
  chemically synthesized
gagaggctgagtggggactg

SEQ ID NO: 312136 - DNA, 20 bp, Artificial Sequence
  chemically synthesized
ggctgagtggggactgagga

SEQ ID NO: 312137 - DNA, 20 bp, Artificial Sequence
  chemically synthesized
ggcccacaccgaaccatcct

SEQ ID NO: 312138 - DNA, 20 bp, Artificial Sequence
  chemically synthesized
agtggggactgaggatggtt

SEQ ID NO: 312139 - DNA, 20 bp, Artificial Sequence
  chemically synthesized
ggactgaggatggttcggtg

SEQ ID NO: 312140 - DNA, 20 bp, Artificial Sequence
  chemically synthesized
gactgaggatggttcggtgt

SEQ ID NO: 312141 - DNA, 20 bp, Artificial Sequence
  chemically synthesized
gatggttcggtgtgggcctg

SEQ ID NO: 312142 - DNA, 20 bp, Artificial Sequence
  chemically synthesized
atggttcggtgtgggcctgc

SEQ ID NO: 312143 - DNA, 20 bp, Artificial Sequence
  chemically synthesized
ttataccaaggggtacctgc

SEQ ID NO: 312144 - DNA, 20 bp, Artificial Sequence
  chemically synthesized
tttataccaaggggtacctg

SEQ ID NO: 312145 - DNA, 20 bp, Artificial Sequence
  chemically synthesized
gtgggcctgcaggtacccct

SEQ ID NO: 312146 - DNA, 20 bp, Artificial Sequence
  chemically synthesized
cctaggcagtttataccaag

SEQ ID NO: 312147 - DNA, 20 bp, Artificial Sequence
  chemically synthesized
gcctaggcagtttataccaa

SEQ ID NO: 312148 - DNA, 20 bp, Artificial Sequence
  chemically synthesized
agcctaggcagtttatacca

SEQ ID NO: 312149 - DNA, 20 bp, Artificial Sequence
  chemically synthesized
tagcctaggcagtttatacc

SEQ ID NO: 312150 - DNA, 20 bp, Artificial Sequence
  chemically synthesized
accccttggtataaactgcc

SEQ ID NO: 312151 - DNA, 20 bp, Artificial Sequence
  chemically synthesized
ccccttggtataaactgcct

SEQ ID NO: 312152 - DNA, 20 bp, Artificial Sequence
  chemically synthesized
tgccatccatgtagcctagg

SEQ ID NO: 312153 - DNA, 20 bp, Artificial Sequence
  chemically synthesized
acatgccatccatgtagcct

SEQ ID NO: 312154 - DNA, 20 bp, Artificial Sequence
  chemically synthesized
tataaactgcctaggctaca

SEQ ID NO: 312155 - DNA, 20 bp, Artificial Sequence
  chemically synthesized
aacatgccatccatgtagcc

SEQ ID NO: 312156 - DNA, 20 bp, Artificial Sequence
  chemically synthesized
aactgcctaggctacatgga

SEQ ID NO: 312157 - DNA, 20 bp, Artificial Sequence
  chemically synthesized
ccatcaacatgccatccatg

SEQ ID NO: 312158 - DNA, 20 bp, Artificial Sequence
  chemically synthesized
ctacatggatggcatgttga

SEQ ID NO: 312159 - DNA, 20 bp, Artificial Sequence
  chemically synthesized
catggatggcatgttgatgg

SEQ ID NO: 312160 - DNA, 20 bp, Artificial Sequence
  chemically synthesized
ggatggcatgttgatggtgg

SEQ ID NO: 312161 - DNA, 20 bp, Artificial Sequence
  chemically synthesized
gatggcatgttgatggtggc

SEQ ID NO: 312162 - DNA, 20 bp, Artificial Sequence
  chemically synthesized
tggcatgttgatggtggcag

SEQ ID NO: 312163 - DNA, 20 bp, Artificial Sequence
  chemically synthesized
ggcatgttgatggtggcagg

SEQ ID NO: 312164 - DNA, 20 bp, Artificial Sequence
  chemically synthesized
atgttgatggtggcaggagg

SEQ ID NO: 312165 - DNA, 20 bp, Artificial Sequence
  chemically synthesized
gatggtggcaggaggcagac

SEQ ID NO: 312166 - DNA, 20 bp, Artificial Sequence
  chemically synthesized
gcaggaggcagactggctcc

SEQ ID NO: 312167 - DNA, 20 bp, Artificial Sequence
  chemically synthesized
caggaggcagactggctcct

SEQ ID NO: 312168 - DNA, 20 bp, Artificial Sequence
  chemically synthesized
gctcctttctgcccaggagc

SEQ ID NO: 312169 - DNA, 20 bp, Artificial Sequence
  chemically synthesized
gaggcagactggctcctggg

SEQ ID NO: 312170 - DNA, 20 bp, Artificial Sequence
  chemically synthesized
atctgctcctttctgcccag

SEQ ID NO: 312171 - DNA, 20 bp, Artificial Sequence
  chemically synthesized
cagactggctcctgggcaga

SEQ ID NO: 312172 - DNA, 20 bp, Artificial Sequence
  chemically synthesized
ggatctgctcctttctgccc

SEQ ID NO: 312173 - DNA, 20 bp, Artificial Sequence
  chemically synthesized
agactggctcctgggcagaa

SEQ ID NO: 312174 - DNA, 20 bp, Artificial Sequence
  chemically synthesized
tggatctgctcctttctgcc

SEQ ID NO: 312175 - DNA, 20 bp, Artificial Sequence
  chemically synthesized
actggctcctgggcagaaag

SEQ ID NO: 312176 - DNA, 20 bp, Artificial Sequence
  chemically synthesized
ggctcctgggcagaaaggag

SEQ ID NO: 312177 - DNA, 20 bp, Artificial Sequence
  chemically synthesized
ggcagaaaggagcagatcca

SEQ ID NO: 312178 - DNA, 20 bp, Artificial Sequence
  chemically synthesized
cagaaaggagcagatccaca

SEQ ID NO: 312179 - DNA, 20 bp, Artificial Sequence
  chemically synthesized
ttgaaggaggggtttctctg

SEQ ID NO: 312180 - DNA, 20 bp, Artificial Sequence
  chemically synthesized
cacagagaaacccctccttc

SEQ ID NO: 312181 - DNA, 20 bp, Artificial Sequence
  chemically synthesized
ccattcttggcttgaaggag

SEQ ID NO: 312182 - DNA, 20 bp, Artificial Sequence
  chemically synthesized
gccattcttggcttgaagga

SEQ ID NO: 312183 - DNA, 20 bp, Artificial Sequence
  chemically synthesized
ggccattcttggcttgaagg

SEQ ID NO: 312184 - DNA, 20 bp, Artificial Sequence
  chemically synthesized
aggccattcttggcttgaag

SEQ ID NO: 312185 - DNA, 20 bp, Artificial Sequence
  chemically synthesized
agaaacccctccttcaagcc

SEQ ID NO: 312186 - DNA, 20 bp, Artificial Sequence
  chemically synthesized
tcaggccattcttggcttga

SEQ ID NO: 312187 - DNA, 20 bp, Artificial Sequence
  chemically synthesized
ttcaggccattcttggcttg

SEQ ID NO: 312188 - DNA, 20 bp, Artificial Sequence
  chemically synthesized
cccctccttcaagccaagaa

SEQ ID NO: 312189 - DNA, 20 bp, Artificial Sequence
  chemically synthesized
cccaggcttcaggccattct

SEQ ID NO: 312190 - DNA, 20 bp, Artificial Sequence
  chemically synthesized
ttcaagccaagaatggcctg

SEQ ID NO: 312191 - DNA, 20 bp, Artificial Sequence
  chemically synthesized
gccaagaatggcctgaagcc

SEQ ID NO: 312192 - DNA, 20 bp, Artificial Sequence
  chemically synthesized
ccaagaatggcctgaagcct

SEQ ID NO: 312193 - DNA, 20 bp, Artificial Sequence
  chemically synthesized
cagcccagcccccaggcttc

SEQ ID NO: 312194 - DNA, 20 bp, Artificial Sequence
  chemically synthesized
caagaatggcctgaagcctg

SEQ ID NO: 312195 - DNA, 20 bp, Artificial Sequence
  chemically synthesized
gcagcccagcccccaggctt

SEQ ID NO: 312196 - DNA, 20 bp, Artificial Sequence
  chemically synthesized
aagaatggcctgaagcctgg

SEQ ID NO: 312197 - DNA, 20 bp, Artificial Sequence
  chemically synthesized
atggcctgaagcctgggggc

SEQ ID NO: 312198 - DNA, 20 bp, Artificial Sequence
  chemically synthesized
tggcctgaagcctgggggct

SEQ ID NO: 312199 - DNA, 20 bp, Artificial Sequence
  chemically synthesized
gaactggcagcccagccccc

SEQ ID NO: 312200 - DNA, 20 bp, Artificial Sequence
  chemically synthesized
agaactggcagcccagcccc

SEQ ID NO: 312201 - DNA, 20 bp, Artificial Sequence
  chemically synthesized
aagcctgggggctgggctgc

SEQ ID NO: 312202 - DNA, 20 bp, Artificial Sequence
  chemically synthesized
tccacccagaactggcagcc

SEQ ID NO: 312203 - DNA, 20 bp, Artificial Sequence
  chemically synthesized
gggggctgggctgccagttc

SEQ ID NO: 312204 - DNA, 20 bp, Artificial Sequence
  chemically synthesized
caaactccacccagaactgg

SEQ ID NO: 312205 - DNA, 20 bp, Artificial Sequence
  chemically synthesized
ggggctgggctgccagttct

SEQ ID NO: 312206 - DNA, 20 bp, Artificial Sequence
  chemically synthesized
ccacaaactccacccagaac

SEQ ID NO: 312207 - DNA, 20 bp, Artificial Sequence
  chemically synthesized
gctgggctgccagttctggg

SEQ ID NO: 312208 - DNA, 20 bp, Artificial Sequence
  chemically synthesized
tgggctgccagttctgggtg

SEQ ID NO: 312209 - DNA, 20 bp, Artificial Sequence
  chemically synthesized
tctgggccacaaactccacc

SEQ ID NO: 312210 - DNA, 20 bp, Artificial Sequence
  chemically synthesized
ccagttctgggtggagtttg

SEQ ID NO: 312211 - DNA, 20 bp, Artificial Sequence
  chemically synthesized
tctgggtggagtttgtggcc

SEQ ID NO: 312212 - DNA, 20 bp, Artificial Sequence
  chemically synthesized
tggagtttgtggcccagaat

SEQ ID NO: 312213 - DNA, 20 bp, Artificial Sequence
  chemically synthesized
gcaccataagttctcattct

SEQ ID NO: 312214 - DNA, 20 bp, Artificial Sequence
  chemically synthesized
agcaccataagttctcattc

SEQ ID NO: 312215 - DNA, 20 bp, Artificial Sequence
  chemically synthesized
tggcccagaatgagaactta

SEQ ID NO: 312216 - DNA, 20 bp, Artificial Sequence
  chemically synthesized
aggcccagaaaaagcaccat

SEQ ID NO: 312217 - DNA, 20 bp, Artificial Sequence
  chemically synthesized
agaacttatggtgctttttc

SEQ ID NO: 312218 - DNA, 20 bp, Artificial Sequence
  chemically synthesized
gaacttatggtgctttttct

SEQ ID NO: 312219 - DNA, 20 bp, Artificial Sequence
  chemically synthesized
tccatggataggcccagaaa

SEQ ID NO: 312220 - DNA, 20 bp, Artificial Sequence
  chemically synthesized
tggacatccatggataggcc

SEQ ID NO: 312221 - DNA, 20 bp, Artificial Sequence
  chemically synthesized
gctttttctgggcctatcca

SEQ ID NO: 312222 - DNA, 20 bp, Artificial Sequence
  chemically synthesized
gtccatggacatccatggat

SEQ ID NO: 312223 - DNA, 20 bp, Artificial Sequence
  chemically synthesized
ggtccatggacatccatgga

SEQ ID NO: 312224 - DNA, 20 bp, Artificial Sequence
  chemically synthesized
aattggtccatggacatcca

SEQ ID NO: 312225 - DNA, 20 bp, Artificial Sequence
  chemically synthesized
ggcctatccatggatgtcca

SEQ ID NO: 312226 - DNA, 20 bp, Artificial Sequence
  chemically synthesized
ggtacattctaattggtcca

SEQ ID NO: 312227 - DNA, 20 bp, Artificial Sequence
  chemically synthesized
atggatgtccatggaccaat

SEQ ID NO: 312228 - DNA, 20 bp, Artificial Sequence
  chemically synthesized
gggaggaggtacattctaat

SEQ ID NO: 312229 - DNA, 20 bp, Artificial Sequence
  chemically synthesized
ttatgggctcggaagggagg

SEQ ID NO: 312230 - DNA, 20 bp, Artificial Sequence
  chemically synthesized
tttatgggctcggaagggag

SEQ ID NO: 312231 - DNA, 20 bp, Artificial Sequence
  chemically synthesized
gaatgtacctcctcccttcc

SEQ ID NO: 312232 - DNA, 20 bp, Artificial Sequence
  chemically synthesized
tttttatgggctcggaaggg

SEQ ID NO: 312233 - DNA, 20 bp, Artificial Sequence
  chemically synthesized
gtttttatgggctcggaagg

SEQ ID NO: 312234 - DNA, 20 bp, Artificial Sequence
  chemically synthesized
gggtttttatgggctcggaa

SEQ ID NO: 312235 - DNA, 20 bp, Artificial Sequence
  chemically synthesized
ggggtttttatgggctcgga

SEQ ID NO: 312236 - DNA, 20 bp, Artificial Sequence
  chemically synthesized
tggggtttttatgggctcgg

SEQ ID NO: 312237 - DNA, 20 bp, Artificial Sequence
  chemically synthesized
gtctggggtttttatgggct

SEQ ID NO: 312238 - DNA, 20 bp, Artificial Sequence
  chemically synthesized
tctgagtctggggtttttat

SEQ ID NO: 312239 - DNA, 20 bp, Artificial Sequence
  chemically synthesized
gtctgagtctggggttttta

SEQ ID NO: 312240 - DNA, 20 bp, Artificial Sequence
  chemically synthesized
ttccgagcccataaaaaccc

SEQ ID NO: 312241 - DNA, 20 bp, Artificial Sequence
  chemically synthesized
gcccataaaaaccccagact

SEQ ID NO: 312242 - DNA, 20 bp, Artificial Sequence
  chemically synthesized
tctaagtttgtctgagtctg

SEQ ID NO: 312243 - DNA, 20 bp, Artificial Sequence
  chemically synthesized
gtctaagtttgtctgagtct

SEQ ID NO: 312244 - DNA, 20 bp, Artificial Sequence
  chemically synthesized
tgtctaagtttgtctgagtc

SEQ ID NO: 312245 - DNA, 20 bp, Artificial Sequence
  chemically synthesized
cccaatgtctaagtttgtct

SEQ ID NO: 312246 - DNA, 20 bp, Artificial Sequence
  chemically synthesized
accccagactcagacaaact

SEQ ID NO: 312247 - DNA, 20 bp, Artificial Sequence
  chemically synthesized
actcagacaaacttagacat

SEQ ID NO: 312248 - DNA, 20 bp, Artificial Sequence
  chemically synthesized
ctcagacaaacttagacatt

SEQ ID NO: 312249 - DNA, 20 bp, Artificial Sequence
  chemically synthesized
ggctggtagtcccaatgtct

SEQ ID NO: 312250 - DNA, 20 bp, Artificial Sequence
  chemically synthesized
aacttagacattgggactac

SEQ ID NO: 312251 - DNA, 20 bp, Artificial Sequence
  chemically synthesized
gacattgggactaccagccg

SEQ ID NO: 312252 - DNA, 20 bp, Artificial Sequence
  chemically synthesized
tagctccttcctgcggctgg

SEQ ID NO: 312253 - DNA, 20 bp, Artificial Sequence
  chemically synthesized
acattgggactaccagccgc

SEQ ID NO: 312254 - DNA, 20 bp, Artificial Sequence
  chemically synthesized
aggtagctccttcctgcggc

SEQ ID NO: 312255 - DNA, 20 bp, Artificial Sequence
  chemically synthesized
ttgggactaccagccgcagg

SEQ ID NO: 312256 - DNA, 20 bp, Artificial Sequence
  chemically synthesized
tgggactaccagccgcagga

SEQ ID NO: 312257 - DNA, 20 bp, Artificial Sequence
  chemically synthesized
ggactaccagccgcaggaag

SEQ ID NO: 312258 - DNA, 20 bp, Artificial Sequence
  chemically synthesized
aagtaggtagctccttcctg

SEQ ID NO: 312259 - DNA, 20 bp, Artificial Sequence
  chemically synthesized
tcaaggagacacaaagtagg

SEQ ID NO: 312260 - DNA, 20 bp, Artificial Sequence
  chemically synthesized
gagtcaaggagacacaaagt

SEQ ID NO: 312261 - DNA, 20 bp, Artificial Sequence
  chemically synthesized
agagtcaaggagacacaaag

SEQ ID NO: 312262 - DNA, 20 bp, Artificial Sequence
  chemically synthesized
tgaagagtcaaggagacaca

SEQ ID NO: 312263 - DNA, 20 bp, Artificial Sequence
  chemically synthesized
ggtcatcctgaagagtcaag

SEQ ID NO: 312264 - DNA, 20 bp, Artificial Sequence
  chemically synthesized
caggtcatcctgaagagtca

SEQ ID NO: 312265 - DNA, 20 bp, Artificial Sequence
  chemically synthesized
tttgtgtctccttgactctt

SEQ ID NO: 312266 - DNA, 20 bp, Artificial Sequence
  chemically synthesized
gcaggtcatcctgaagagtc

SEQ ID NO: 312267 - DNA, 20 bp, Artificial Sequence
  chemically synthesized
ttgtgtctccttgactcttc

SEQ ID NO: 312268 - DNA, 20 bp, Artificial Sequence
  chemically synthesized
tgcaggcaggtcatcctgaa

SEQ ID NO: 312269 - DNA, 20 bp, Artificial Sequence
  chemically synthesized
tatgcaggcaggtcatcctg

SEQ ID NO: 312270 - DNA, 20 bp, Artificial Sequence
  chemically synthesized
ggtggctcctttatgcaggc

SEQ ID NO: 312271 - DNA, 20 bp, Artificial Sequence
  chemically synthesized
gggtggctcctttatgcagg

SEQ ID NO: 312272 - DNA, 20 bp, Artificial Sequence
  chemically synthesized
caggatgacctgcctgcata

SEQ ID NO: 312273 - DNA, 20 bp, Artificial Sequence
  chemically synthesized
aggatgacctgcctgcataa

SEQ ID NO: 312274 - DNA, 20 bp, Artificial Sequence
  chemically synthesized
ggtgggtggctcctttatgc

SEQ ID NO: 312275 - DNA, 20 bp, Artificial Sequence
  chemically synthesized
gatgacctgcctgcataaag

SEQ ID NO: 312276 - DNA, 20 bp, Artificial Sequence
  chemically synthesized
tggtgggtggctcctttatg

SEQ ID NO: 312277 - DNA, 20 bp, Artificial Sequence
  chemically synthesized
cataaaggagccacccacca

SEQ ID NO: 312278 - DNA, 20 bp, Artificial Sequence
  chemically synthesized
gagaggagacccatggtggg

SEQ ID NO: 312279 - DNA, 20 bp, Artificial Sequence
  chemically synthesized
ataaaggagccacccaccat

SEQ ID NO: 312280 - DNA, 20 bp, Artificial Sequence
  chemically synthesized
gtagagaggagacccatggt

SEQ ID NO: 312281 - DNA, 20 bp, Artificial Sequence
  chemically synthesized
agtagagaggagacccatgg

SEQ ID NO: 312282 - DNA, 20 bp, Artificial Sequence
  chemically synthesized
gtgagtagagaggagaccca

SEQ ID NO: 312283 - DNA, 20 bp, Artificial Sequence
  chemically synthesized
gtgcagctgtgagtagagag

SEQ ID NO: 312284 - DNA, 20 bp, Artificial Sequence
  chemically synthesized
gtgtgcagctgtgagtagag

SEQ ID NO: 312285 - DNA, 20 bp, Artificial Sequence
  chemically synthesized
agtgtgcagctgtgagtaga

SEQ ID NO: 312286 - DNA, 20 bp, Artificial Sequence
  chemically synthesized
atgggtctcctctctactca

SEQ ID NO: 312287 - DNA, 20 bp, Artificial Sequence
  chemically synthesized
ggagtgtgcagctgtgagta

SEQ ID NO: 312288 - DNA, 20 bp, Artificial Sequence
  chemically synthesized
agggagtgtgcagctgtgag

SEQ ID NO: 312289 - DNA, 20 bp, Artificial Sequence
  chemically synthesized
cccagggagtgtgcagctgt

SEQ ID NO: 312290 - DNA, 20 bp, Artificial Sequence
  chemically synthesized
aggtcgtcccagggagtgtg

SEQ ID NO: 312291 - DNA, 20 bp, Artificial Sequence
  chemically synthesized
actcacagctgcacactccc

SEQ ID NO: 312292 - DNA, 20 bp, Artificial Sequence
  chemically synthesized
ctcacagctgcacactccct

SEQ ID NO: 312293 - DNA, 20 bp, Artificial Sequence
  chemically synthesized
cacaggcaggtcgtcccagg

SEQ ID NO: 312294 - DNA, 20 bp, Artificial Sequence
  chemically synthesized
tccacaggcaggtcgtccca

SEQ ID NO: 312295 - DNA, 20 bp, Artificial Sequence
  chemically synthesized
ttccacaggcaggtcgtccc

SEQ ID NO: 312296 - DNA, 20 bp, Artificial Sequence
  chemically synthesized
tttccacaggcaggtcgtcc

SEQ ID NO: 312297 - DNA, 20 bp, Artificial Sequence
  chemically synthesized
tccctgggacgacctgcctg

SEQ ID NO: 312298 - DNA, 20 bp, Artificial Sequence
  chemically synthesized
ggtagctcctttccacaggc

SEQ ID NO: 312299 - DNA, 20 bp, Artificial Sequence
  chemically synthesized
gggtagctcctttccacagg

SEQ ID NO: 312300 - DNA, 20 bp, Artificial Sequence
  chemically synthesized
tgggacgacctgcctgtgga

SEQ ID NO: 312301 - DNA, 20 bp, Artificial Sequence
  chemically synthesized
gggacgacctgcctgtggaa

SEQ ID NO: 312302 - DNA, 20 bp, Artificial Sequence
  chemically synthesized
ggtgggtagctcctttccac

SEQ ID NO: 312303 - DNA, 20 bp, Artificial Sequence
  chemically synthesized
gacgacctgcctgtggaaag

SEQ ID NO: 312304 - DNA, 20 bp, Artificial Sequence
  chemically synthesized
cggtgggtagctcctttcca

SEQ ID NO: 312305 - DNA, 20 bp, Artificial Sequence
  chemically synthesized
tggaaaggagctacccaccg

SEQ ID NO: 312306 - DNA, 20 bp, Artificial Sequence
  chemically synthesized
tctcaggataccacggtggg

SEQ ID NO: 312307 - DNA, 20 bp, Artificial Sequence
  chemically synthesized
agctctcaggataccacggt

SEQ ID NO: 312308 - DNA, 20 bp, Artificial Sequence
  chemically synthesized
cagctctcaggataccacgg

SEQ ID NO: 312309 - DNA, 20 bp, Artificial Sequence
  chemically synthesized
gaacagctctcaggatacca

SEQ ID NO: 312310 - DNA, 20 bp, Artificial Sequence
  chemically synthesized
gctacccaccgtggtatcct

SEQ ID NO: 312311 - DNA, 20 bp, Artificial Sequence
  chemically synthesized
tacccaccgtggtatcctga

SEQ ID NO: 312312 - DNA, 20 bp, Artificial Sequence
  chemically synthesized
tgagcgagagaacagctctc

SEQ ID NO: 312313 - DNA, 20 bp, Artificial Sequence
  chemically synthesized
ttgagcgagagaacagctct

SEQ ID NO: 312314 - DNA, 20 bp, Artificial Sequence
  chemically synthesized
agcttcattgagcgagagaa

SEQ ID NO: 312315 - DNA, 20 bp, Artificial Sequence
  chemically synthesized
agaggagcttcattgagcga

SEQ ID NO: 312316 - DNA, 20 bp, Artificial Sequence
  chemically synthesized
gcagaggagcttcattgagc

SEQ ID NO: 312317 - DNA, 20 bp, Artificial Sequence
  chemically synthesized
agctgttctctcgctcaatg

SEQ ID NO: 312318 - DNA, 20 bp, Artificial Sequence
  chemically synthesized
aggtgcagaggagcttcatt

SEQ ID NO: 312319 - DNA, 20 bp, Artificial Sequence
  chemically synthesized
agggtgagcaaggtgcagag

SEQ ID NO: 312320 - DNA, 20 bp, Artificial Sequence
  chemically synthesized
ggagggtgagcaaggtgcag

SEQ ID NO: 312321 - DNA, 20 bp, Artificial Sequence
  chemically synthesized
tggagggtgagcaaggtgca

SEQ ID NO: 312322 - DNA, 20 bp, Artificial Sequence
  chemically synthesized
actggagggtgagcaaggtg

SEQ ID NO: 312323 - DNA, 20 bp, Artificial Sequence
  chemically synthesized
ggacaactggagggtgagca

SEQ ID NO: 312324 - DNA, 20 bp, Artificial Sequence
  chemically synthesized
tggacaactggagggtgagc

SEQ ID NO: 312325 - DNA, 20 bp, Artificial Sequence
  chemically synthesized
tctgcaccttgctcaccctc

SEQ ID NO: 312326 - DNA, 20 bp, Artificial Sequence
  chemically synthesized
tacatggacaactggagggt

SEQ ID NO: 312327 - DNA, 20 bp, Artificial Sequence
  chemically synthesized
gaggtacatggacaactgga

SEQ ID NO: 312328 - DNA, 20 bp, Artificial Sequence
  chemically synthesized
tgaggtacatggacaactgg

SEQ ID NO: 312329 - DNA, 20 bp, Artificial Sequence
  chemically synthesized
atgaggtacatggacaactg

SEQ ID NO: 312330 - DNA, 20 bp, Artificial Sequence
  chemically synthesized
gaatgaggtacatggacaac

SEQ ID NO: 312331 - DNA, 20 bp, Artificial Sequence
  chemically synthesized
tccaggaagaatgaggtaca

SEQ ID NO: 312332 - DNA, 20 bp, Artificial Sequence
  chemically synthesized
tcccatgtccaggaagaatg

SEQ ID NO: 312333 - DNA, 20 bp, Artificial Sequence
  chemically synthesized
gtcccatgtccaggaagaat

SEQ ID NO: 312334 - DNA, 20 bp, Artificial Sequence
  chemically synthesized
tccatgtacctcattcttcc

SEQ ID NO: 312335 - DNA, 20 bp, Artificial Sequence
  chemically synthesized
gttcttgtcccatgtccagg

SEQ ID NO: 312336 - DNA, 20 bp, Artificial Sequence
  chemically synthesized
tacctcattcttcctggaca

SEQ ID NO: 312337 - DNA, 20 bp, Artificial Sequence
  chemically synthesized
acctcattcttcctggacat

SEQ ID NO: 312338 - DNA, 20 bp, Artificial Sequence
  chemically synthesized
tgagttcttgtcccatgtcc

SEQ ID NO: 312339 - DNA, 20 bp, Artificial Sequence
  chemically synthesized
ctgagttcttgtcccatgtc

SEQ ID NO: 312340 - DNA, 20 bp, Artificial Sequence
  chemically synthesized
attcttcctggacatgggac

SEQ ID NO: 312341 - DNA, 20 bp, Artificial Sequence
  chemically synthesized
ctggacatgggacaagaact

SEQ ID NO: 312342 - DNA, 20 bp, Artificial Sequence
  chemically synthesized
tggacatgggacaagaactc

SEQ ID NO: 312343 - DNA, 20 bp, Artificial Sequence
  chemically synthesized
cctgccattcagcaagtcct

SEQ ID NO: 312344 - DNA, 20 bp, Artificial Sequence
  chemically synthesized
agaactcaggacttgctgaa

SEQ ID NO: 312345 - DNA, 20 bp, Artificial Sequence
  chemically synthesized
tttttgtcctgccattcagc

SEQ ID NO: 312346 - DNA, 20 bp, Artificial Sequence
  chemically synthesized
actcaggacttgctgaatgg

SEQ ID NO: 312347 - DNA, 20 bp, Artificial Sequence
  chemically synthesized
ctcaggacttgctgaatggc

SEQ ID NO: 312348 - DNA, 20 bp, Artificial Sequence
  chemically synthesized
gctctttttgtcctgccatt

SEQ ID NO: 312349 - DNA, 20 bp, Artificial Sequence
  chemically synthesized
ttgctgaatggcaggacaaa

SEQ ID NO: 312350 - DNA, 20 bp, Artificial Sequence
  chemically synthesized
gctgaatggcaggacaaaaa

SEQ ID NO: 312351 - DNA, 20 bp, Artificial Sequence
  chemically synthesized
tttcagccctgtttgtgtta

SEQ ID NO: 312352 - DNA, 20 bp, Artificial Sequence
  chemically synthesized
aaaaagagctgtaacacaaa

SEQ ID NO: 312353 - DNA, 20 bp, Artificial Sequence
  chemically synthesized
aaaagagctgtaacacaaac

SEQ ID NO: 312354 - DNA, 20 bp, Artificial Sequence
  chemically synthesized
aaagagctgtaacacaaaca

SEQ ID NO: 312355 - DNA, 20 bp, Artificial Sequence
  chemically synthesized
ggtgagtggggggcatgttt

SEQ ID NO: 312356 - DNA, 20 bp, Artificial Sequence
  chemically synthesized
cccatagcatggtgagtggg

SEQ ID NO: 312357 - DNA, 20 bp, Artificial Sequence
  chemically synthesized
gcccatagcatggtgagtgg

SEQ ID NO: 312358 - DNA, 20 bp, Artificial Sequence
  chemically synthesized
tgcccatagcatggtgagtg

SEQ ID NO: 312359 - DNA, 20 bp, Artificial Sequence
  chemically synthesized
ttgcccatagcatggtgagt

SEQ ID NO: 312360 - DNA, 20 bp, Artificial Sequence
  chemically synthesized
attgcccatagcatggtgag

SEQ ID NO: 312361 - DNA, 20 bp, Artificial Sequence
  chemically synthesized
ctcattgcccatagcatggt

SEQ ID NO: 312362 - DNA, 20 bp, Artificial Sequence
  chemically synthesized
gccccccactcaccatgcta

SEQ ID NO: 312363 - DNA, 20 bp, Artificial Sequence
  chemically synthesized
ccccccactcaccatgctat

SEQ ID NO: 312364 - DNA, 20 bp, Artificial Sequence
  chemically synthesized
gtttctcattgcccatagca

SEQ ID NO: 312365 - DNA, 20 bp, Artificial Sequence
  chemically synthesized
tctctgtttctcattgccca

SEQ ID NO: 312366 - DNA, 20 bp, Artificial Sequence
  chemically synthesized
ctcaccatgctatgggcaat

SEQ ID NO: 312367 - DNA, 20 bp, Artificial Sequence
  chemically synthesized
atgctatgggcaatgagaaa

SEQ ID NO: 312368 - DNA, 20 bp, Artificial Sequence
  chemically synthesized
gctatgggcaatgagaaaca

SEQ ID NO: 312369 - DNA, 20 bp, Artificial Sequence
  chemically synthesized
atgggcaatgagaaacagag

SEQ ID NO: 312370 - DNA, 20 bp, Artificial Sequence
  chemically synthesized
gggcaatgagaaacagagaa

SEQ ID NO: 312371 - DNA, 20 bp, Artificial Sequence
  chemically synthesized
tgagaaacagagaagagctg

SEQ ID NO: 312372 - DNA, 20 bp, Artificial Sequence
  chemically synthesized
ctgggctctgcaaaaggcca

SEQ ID NO: 312373 - DNA, 20 bp, Artificial Sequence
  chemically synthesized
agaagagctgtggccttttg

SEQ ID NO: 312374 - DNA, 20 bp, Artificial Sequence
  chemically synthesized
aagagctgtggccttttgca

SEQ ID NO: 312375 - DNA, 20 bp, Artificial Sequence
  chemically synthesized
caaggtctgggctctgcaaa

SEQ ID NO: 312376 - DNA, 20 bp, Artificial Sequence
  chemically synthesized
ccaaggtctgggctctgcaa

SEQ ID NO: 312377 - DNA, 20 bp, Artificial Sequence
  chemically synthesized
ctgtggccttttgcagagcc

SEQ ID NO: 312378 - DNA, 20 bp, Artificial Sequence
  chemically synthesized
cttttgcagagcccagacct

SEQ ID NO: 312379 - DNA, 20 bp, Artificial Sequence
  chemically synthesized
ttttgcagagcccagacctt

SEQ ID NO: 312380 - DNA, 20 bp, Artificial Sequence
  chemically synthesized
cttgaggagccccaaggtct

SEQ ID NO: 312381 - DNA, 20 bp, Artificial Sequence
  chemically synthesized
tttgcagagcccagaccttg

SEQ ID NO: 312382 - DNA, 20 bp, Artificial Sequence
  chemically synthesized
gcttgaggagccccaaggtc

SEQ ID NO: 312383 - DNA, 20 bp, Artificial Sequence
  chemically synthesized
ccctggcttgaggagcccca

SEQ ID NO: 312384 - DNA, 20 bp, Artificial Sequence
  chemically synthesized
accctggcttgaggagcccc

SEQ ID NO: 312385 - DNA, 20 bp, Artificial Sequence
  chemically synthesized
cccagaccttggggctcctc

SEQ ID NO: 312386 - DNA, 20 bp, Artificial Sequence
  chemically synthesized
gaccttggggctcctcaagc

SEQ ID NO: 312387 - DNA, 20 bp, Artificial Sequence
  chemically synthesized
tgccacaaccctggcttgag

SEQ ID NO: 312388 - DNA, 20 bp, Artificial Sequence
  chemically synthesized
accttggggctcctcaagcc

SEQ ID NO: 312389 - DNA, 20 bp, Artificial Sequence
  chemically synthesized
ccttggggctcctcaagcca

SEQ ID NO: 312390 - DNA, 20 bp, Artificial Sequence
  chemically synthesized
catgccacaaccctggcttg

SEQ ID NO: 312391 - DNA, 20 bp, Artificial Sequence
  chemically synthesized
gcatgccacaaccctggctt

SEQ ID NO: 312392 - DNA, 20 bp, Artificial Sequence
  chemically synthesized
ggctcctcaagccagggttg

SEQ ID NO: 312393 - DNA, 20 bp, Artificial Sequence
  chemically synthesized
gttacagcatgccacaaccc

SEQ ID NO: 312394 - DNA, 20 bp, Artificial Sequence
  chemically synthesized
gagccccaaggagcatgtta

SEQ ID NO: 312395 - DNA, 20 bp, Artificial Sequence
  chemically synthesized
gcatgctgtaacatgctcct

SEQ ID NO: 312396 - DNA, 20 bp, Artificial Sequence
  chemically synthesized
catgctgtaacatgctcctt

SEQ ID NO: 312397 - DNA, 20 bp, Artificial Sequence
  chemically synthesized
atgctgtaacatgctccttg

SEQ ID NO: 312398 - DNA, 20 bp, Artificial Sequence
  chemically synthesized
aggaaccacagagccccaag

SEQ ID NO: 312399 - DNA, 20 bp, Artificial Sequence
  chemically synthesized
ccaggaaccacagagcccca

SEQ ID NO: 312400 - DNA, 20 bp, Artificial Sequence
  chemically synthesized
accaggaaccacagagcccc

SEQ ID NO: 312401 - DNA, 20 bp, Artificial Sequence
  chemically synthesized
acatgctccttggggctctg

SEQ ID NO: 312402 - DNA, 20 bp, Artificial Sequence
  chemically synthesized
cagagacaccaggaaccaca

SEQ ID NO: 312403 - DNA, 20 bp, Artificial Sequence
  chemically synthesized
ccttggggctctgtggttcc

SEQ ID NO: 312404 - DNA, 20 bp, Artificial Sequence
  chemically synthesized
ctcagagacaccaggaacca

SEQ ID NO: 312405 - DNA, 20 bp, Artificial Sequence
  chemically synthesized
cctgaaagctcagagacacc

SEQ ID NO: 312406 - DNA, 20 bp, Artificial Sequence
  chemically synthesized
acctgaaagctcagagacac

SEQ ID NO: 312407 - DNA, 20 bp, Artificial Sequence
  chemically synthesized
ctgtggttcctggtgtctct

SEQ ID NO: 312408 - DNA, 20 bp, Artificial Sequence
  chemically synthesized
cggtggcacctgaaagctca

SEQ ID NO: 312409 - DNA, 20 bp, Artificial Sequence
  chemically synthesized
tcctggtgtctctgagcttt

SEQ ID NO: 312410 - DNA, 20 bp, Artificial Sequence
  chemically synthesized
cctggtgtctctgagctttc

SEQ ID NO: 312411 - DNA, 20 bp, Artificial Sequence
  chemically synthesized
cgcggtggcacctgaaagct

SEQ ID NO: 312412 - DNA, 20 bp, Artificial Sequence
  chemically synthesized
gggatcgcggtggcacctga

SEQ ID NO: 312413 - DNA, 20 bp, Artificial Sequence
  chemically synthesized
gtctggacaggggatcgcgg

SEQ ID NO: 312414 - DNA, 20 bp, Artificial Sequence
  chemically synthesized
aatgtctggacaggggatcg

SEQ ID NO: 312415 - DNA, 20 bp, Artificial Sequence
  chemically synthesized
tgccaccgcgatcccctgtc

SEQ ID NO: 312416 - DNA, 20 bp, Artificial Sequence
  chemically synthesized
aggcaccaatgtctggacag

SEQ ID NO: 312417 - DNA, 20 bp, Artificial Sequence
  chemically synthesized
caggcaccaatgtctggaca

SEQ ID NO: 312418 - DNA, 20 bp, Artificial Sequence
  chemically synthesized
gcaggcaccaatgtctggac

SEQ ID NO: 312419 - DNA, 20 bp, Artificial Sequence
  chemically synthesized
tgcaggcaccaatgtctgga

SEQ ID NO: 312420 - DNA, 20 bp, Artificial Sequence
  chemically synthesized
gcgatcccctgtccagacat

SEQ ID NO: 312421 - DNA, 20 bp, Artificial Sequence
  chemically synthesized
ctgctgcaggcaccaatgtc

SEQ ID NO: 312422 - DNA, 20 bp, Artificial Sequence
  chemically synthesized
tgtccagacattggtgcctg

SEQ ID NO: 312423 - DNA, 20 bp, Artificial Sequence
  chemically synthesized
ccagacattggtgcctgcag

SEQ ID NO: 312424 - DNA, 20 bp, Artificial Sequence
  chemically synthesized
gacattggtgcctgcagcag

SEQ ID NO: 312425 - DNA, 20 bp, Artificial Sequence
  chemically synthesized
ccacaagtagcttctgctgc

SEQ ID NO: 312426 - DNA, 20 bp, Artificial Sequence
  chemically synthesized
accacaagtagcttctgctg

SEQ ID NO: 312427 - DNA, 20 bp, Artificial Sequence
  chemically synthesized
cctgcagcagaagctacttg

SEQ ID NO: 312428 - DNA, 20 bp, Artificial Sequence
  chemically synthesized
tggaccagatgtaccacaag

SEQ ID NO: 312429 - DNA, 20 bp, Artificial Sequence
  chemically synthesized
ggctggaccagatgtaccac

SEQ ID NO: 312430 - DNA, 20 bp, Artificial Sequence
  chemically synthesized
gaagctacttgtggtacatc

SEQ ID NO: 312431 - DNA, 20 bp, Artificial Sequence
  chemically synthesized
tacttgtggtacatctggtc

SEQ ID NO: 312432 - DNA, 20 bp, Artificial Sequence
  chemically synthesized
atgtgaggctgtggctggac

SEQ ID NO: 312433 - DNA, 20 bp, Artificial Sequence
  chemically synthesized
tggtacatctggtccagcca

SEQ ID NO: 312434 - DNA, 20 bp, Artificial Sequence
  chemically synthesized
gctccatgtgaggctgtggc

SEQ ID NO: 312435 - DNA, 20 bp, Artificial Sequence
  chemically synthesized
ggcagctccatgtgaggctg

SEQ ID NO: 312436 - DNA, 20 bp, Artificial Sequence
  chemically synthesized
ggtccagccacagcctcaca

SEQ ID NO: 312437 - DNA, 20 bp, Artificial Sequence
  chemically synthesized
tccagccacagcctcacatg

SEQ ID NO: 312438 - DNA, 20 bp, Artificial Sequence
  chemically synthesized
actggtggcagctccatgtg

SEQ ID NO: 312439 - DNA, 20 bp, Artificial Sequence
  chemically synthesized
tactggtggcagctccatgt

SEQ ID NO: 312440 - DNA, 20 bp, Artificial Sequence
  chemically synthesized
gcctcacatggagctgccac

SEQ ID NO: 312441 - DNA, 20 bp, Artificial Sequence
  chemically synthesized
acaggcaccagtactggtgg

SEQ ID NO: 312442 - DNA, 20 bp, Artificial Sequence
  chemically synthesized
catggagctgccaccagtac

SEQ ID NO: 312443 - DNA, 20 bp, Artificial Sequence
  chemically synthesized
gctacaggcaccagtactgg

SEQ ID NO: 312444 - DNA, 20 bp, Artificial Sequence
  chemically synthesized
gcagctacaggcaccagtac

SEQ ID NO: 312445 - DNA, 20 bp, Artificial Sequence
  chemically synthesized
gccaccagtactggtgcctg

SEQ ID NO: 312446 - DNA, 20 bp, Artificial Sequence
  chemically synthesized
cggaaggcagctacaggcac

SEQ ID NO: 312447 - DNA, 20 bp, Artificial Sequence
  chemically synthesized
ctgcagcggaaggcagctac

SEQ ID NO: 312448 - DNA, 20 bp, Artificial Sequence
  chemically synthesized
gctgcagcggaaggcagcta

SEQ ID NO: 312449 - DNA, 20 bp, Artificial Sequence
  chemically synthesized
atgccagctgcagcggaagg

SEQ ID NO: 312450 - DNA, 20 bp, Artificial Sequence
  chemically synthesized
cctgtagctgccttccgctg

SEQ ID NO: 312451 - DNA, 20 bp, Artificial Sequence
  chemically synthesized
ggcatgccagctgcagcgga

SEQ ID NO: 312452 - DNA, 20 bp, Artificial Sequence
  chemically synthesized
aggcatgccagctgcagcgg

SEQ ID NO: 312453 - DNA, 20 bp, Artificial Sequence
  chemically synthesized
tagctgccttccgctgcagc

SEQ ID NO: 312454 - DNA, 20 bp, Artificial Sequence
  chemically synthesized
gacaggcatgccagctgcag

SEQ ID NO: 312455 - DNA, 20 bp, Artificial Sequence
  chemically synthesized
acagacaggcatgccagctg

SEQ ID NO: 312456 - DNA, 20 bp, Artificial Sequence
  chemically synthesized
ctgtgcacagacaggcatgc

SEQ ID NO: 312457 - DNA, 20 bp, Artificial Sequence
  chemically synthesized
cctggccactgtgcacagac

SEQ ID NO: 312458 - DNA, 20 bp, Artificial Sequence
  chemically synthesized
gcctggccactgtgcacaga

SEQ ID NO: 312459 - DNA, 20 bp, Artificial Sequence
  chemically synthesized
ctggcatgcctgtctgtgca

SEQ ID NO: 312460 - DNA, 20 bp, Artificial Sequence
  chemically synthesized
gcatgcctgtctgtgcacag

SEQ ID NO: 312461 - DNA, 20 bp, Artificial Sequence
  chemically synthesized
tgaggcctggccactgtgca

SEQ ID NO: 312462 - DNA, 20 bp, Artificial Sequence
  chemically synthesized
gcctgtctgtgcacagtggc

SEQ ID NO: 312463 - DNA, 20 bp, Artificial Sequence
  chemically synthesized
cctgtctgtgcacagtggcc

SEQ ID NO: 312464 - DNA, 20 bp, Artificial Sequence
  chemically synthesized
gagcaagcgagcatgaggcc

SEQ ID NO: 312465 - DNA, 20 bp, Artificial Sequence
  chemically synthesized
tatgtgagcaagcgagcatg

SEQ ID NO: 312466 - DNA, 20 bp, Artificial Sequence
  chemically synthesized
gtatgtgagcaagcgagcat

SEQ ID NO: 312467 - DNA, 20 bp, Artificial Sequence
  chemically synthesized
taagaggtatgtgagcaagc

SEQ ID NO: 312468 - DNA, 20 bp, Artificial Sequence
  chemically synthesized
gcagtaagaggtatgtgagc

SEQ ID NO: 312469 - DNA, 20 bp, Artificial Sequence
  chemically synthesized
cagagcagtaagaggtatgt

SEQ ID NO: 312470 - DNA, 20 bp, Artificial Sequence
  chemically synthesized
gccaggcacagagcagtaag

SEQ ID NO: 312471 - DNA, 20 bp, Artificial Sequence
  chemically synthesized
agccaggcacagagcagtaa

SEQ ID NO: 312472 - DNA, 20 bp, Artificial Sequence
  chemically synthesized
caagccaggcacagagcagt

SEQ ID NO: 312473 - DNA, 20 bp, Artificial Sequence
  chemically synthesized
agggcaagccaggcacagag

SEQ ID NO: 312474 - DNA, 20 bp, Artificial Sequence
  chemically synthesized
acctcttactgctctgtgcc

SEQ ID NO: 312475 - DNA, 20 bp, Artificial Sequence
  chemically synthesized
ccaagggcaagccaggcaca

SEQ ID NO: 312476 - DNA, 20 bp, Artificial Sequence
  chemically synthesized
tgccaagggcaagccaggca

SEQ ID NO: 312477 - DNA, 20 bp, Artificial Sequence
  chemically synthesized
atgcctgccaagggcaagcc

SEQ ID NO: 312478 - DNA, 20 bp, Artificial Sequence
  chemically synthesized
catgcctgccaagggcaagc

SEQ ID NO: 312479 - DNA, 20 bp, Artificial Sequence
  chemically synthesized
ctctgtgcctggcttgccct

SEQ ID NO: 312480 - DNA, 20 bp, Artificial Sequence
  chemically synthesized
tccccatgcctgccaagggc

SEQ ID NO: 312481 - DNA, 20 bp, Artificial Sequence
  chemically synthesized
tgtgcctggcttgcccttgg

SEQ ID NO: 312482 - DNA, 20 bp, Artificial Sequence
  chemically synthesized
gtgcctggcttgcccttggc

SEQ ID NO: 312483 - DNA, 20 bp, Artificial Sequence
  chemically synthesized
cggatccccatgcctgccaa

SEQ ID NO: 312484 - DNA, 20 bp, Artificial Sequence
  chemically synthesized
ccggatccccatgcctgcca

SEQ ID NO: 312485 - DNA, 20 bp, Artificial Sequence
  chemically synthesized
cccggatccccatgcctgcc

SEQ ID NO: 312486 - DNA, 20 bp, Artificial Sequence
  chemically synthesized
tggcttgcccttggcaggca

SEQ ID NO: 312487 - DNA, 20 bp, Artificial Sequence
  chemically synthesized
ggcttgcccttggcaggcat

SEQ ID NO: 312488 - DNA, 20 bp, Artificial Sequence
  chemically synthesized
gcttgcccttggcaggcatg

SEQ ID NO: 312489 - DNA, 20 bp, Artificial Sequence
  chemically synthesized
ccttggcaggcatggggatc

SEQ ID NO: 312490 - DNA, 20 bp, Artificial Sequence
  chemically synthesized
cttggcaggcatggggatcc

SEQ ID NO: 312491 - DNA, 20 bp, Artificial Sequence
  chemically synthesized
gcaggcatggggatccgggc

SEQ ID NO: 312492 - DNA, 20 bp, Artificial Sequence
  chemically synthesized
ggcatggggatccgggccag

SEQ ID NO: 312493 - DNA, 20 bp, Artificial Sequence
  chemically synthesized
cttggcttgcactactggcc

SEQ ID NO: 312494 - DNA, 20 bp, Artificial Sequence
  chemically synthesized
gggatccgggccagtagtgc

SEQ ID NO: 312495 - DNA, 20 bp, Artificial Sequence
  chemically synthesized
ctgtgcttggcttgcactac

SEQ ID NO: 312496 - DNA, 20 bp, Artificial Sequence
  chemically synthesized
ccgggccagtagtgcaagcc

SEQ ID NO: 312497 - DNA, 20 bp, Artificial Sequence
  chemically synthesized
ccagtagtgcaagccaagca

SEQ ID NO: 312498 - DNA, 20 bp, Artificial Sequence
  chemically synthesized
tcagcctggcaggctgtgct

SEQ ID NO: 312499 - DNA, 20 bp, Artificial Sequence
  chemically synthesized
gcaagccaagcacagcctgc

SEQ ID NO: 312500 - DNA, 20 bp, Artificial Sequence
  chemically synthesized
caagccaagcacagcctgcc

SEQ ID NO: 312501 - DNA, 20 bp, Artificial Sequence
  chemically synthesized
ttgcacccactcagcctggc

SEQ ID NO: 312502 - DNA, 20 bp, Artificial Sequence
  chemically synthesized
caagcacagcctgccaggct

SEQ ID NO: 312503 - DNA, 20 bp, Artificial Sequence
  chemically synthesized
cttgcacccactcagcctgg

SEQ ID NO: 312504 - DNA, 20 bp, Artificial Sequence
  chemically synthesized
gcacagcctgccaggctgag

SEQ ID NO: 312505 - DNA, 20 bp, Artificial Sequence
  chemically synthesized
ctccttgcacccactcagcc

SEQ ID NO: 312506 - DNA, 20 bp, Artificial Sequence
  chemically synthesized
cacagcctgccaggctgagt

SEQ ID NO: 312507 - DNA, 20 bp, Artificial Sequence
  chemically synthesized
ctgggctccttgcacccact

SEQ ID NO: 312508 - DNA, 20 bp, Artificial Sequence
  chemically synthesized
ctgccaggctgagtgggtgc

SEQ ID NO: 312509 - DNA, 20 bp, Artificial Sequence
  chemically synthesized
tgccaggctgagtgggtgca

SEQ ID NO: 312510 - DNA, 20 bp, Artificial Sequence
  chemically synthesized
ccaggctgagtgggtgcaag

SEQ ID NO: 312511 - DNA, 20 bp, Artificial Sequence
  chemically synthesized
ctgagtgggtgcaaggagcc

SEQ ID NO: 312512 - DNA, 20 bp, Artificial Sequence
  chemically synthesized
agtgggtgcaaggagcccag

SEQ ID NO: 312513 - DNA, 20 bp, Artificial Sequence
  chemically synthesized
gtgggtgcaaggagcccagc

SEQ ID NO: 312514 - DNA, 20 bp, Artificial Sequence
  chemically synthesized
gggttttgcttgtgcccgct

SEQ ID NO: 312515 - DNA, 20 bp, Artificial Sequence
  chemically synthesized
tgggttttgcttgtgcccgc

SEQ ID NO: 312516 - DNA, 20 bp, Artificial Sequence
  chemically synthesized
gcaaggagcccagcgggcac

SEQ ID NO: 312517 - DNA, 20 bp, Artificial Sequence
  chemically synthesized
cagcgggcacaagcaaaacc

SEQ ID NO: 312518 - DNA, 20 bp, Artificial Sequence
  chemically synthesized
gggcacaagcaaaacccaga

SEQ ID NO: 312519 - DNA, 20 bp, Artificial Sequence
  chemically synthesized
gcacaagcaaaacccagaca

SEQ ID NO: 312520 - DNA, 20 bp, Artificial Sequence
  chemically synthesized
cacaagcaaaacccagacag

SEQ ID NO: 312521 - DNA, 20 bp, Artificial Sequence
  chemically synthesized
ggccggcagcacctctgtct

SEQ ID NO: 312522 - DNA, 20 bp, Artificial Sequence
  chemically synthesized
tggccggcagcacctctgtc

SEQ ID NO: 312523 - DNA, 20 bp, Artificial Sequence
  chemically synthesized
aacccagacagaggtgctgc

SEQ ID NO: 312524 - DNA, 20 bp, Artificial Sequence
  chemically synthesized
gacagaggtgctgccggcca

SEQ ID NO: 312525 - DNA, 20 bp, Artificial Sequence
  chemically synthesized
ccagaaacctctgtggccgg

SEQ ID NO: 312526 - DNA, 20 bp, Artificial Sequence
  chemically synthesized
cagaggtgctgccggccaca

SEQ ID NO: 312527 - DNA, 20 bp, Artificial Sequence
  chemically synthesized
agaggtgctgccggccacag

SEQ ID NO: 312528 - DNA, 20 bp, Artificial Sequence
  chemically synthesized
cagccagaaacctctgtggc

SEQ ID NO: 312529 - DNA, 20 bp, Artificial Sequence
  chemically synthesized
ttgccagccagaaacctctg

SEQ ID NO: 312530 - DNA, 20 bp, Artificial Sequence
  chemically synthesized
ctgccggccacagaggtttc

SEQ ID NO: 312531 - DNA, 20 bp, Artificial Sequence
  chemically synthesized
cggccacagaggtttctggc

SEQ ID NO: 312532 - DNA, 20 bp, Artificial Sequence
  chemically synthesized
acagaggtttctggctggca

SEQ ID NO: 312533 - DNA, 20 bp, Artificial Sequence
  chemically synthesized
ttgggtgtcactttgccagc

SEQ ID NO: 312534 - DNA, 20 bp, Artificial Sequence
  chemically synthesized
atccttgggtgtcactttgc

SEQ ID NO: 312535 - DNA, 20 bp, Artificial Sequence
  chemically synthesized
tggctggcaaagtgacaccc

SEQ ID NO: 312536 - DNA, 20 bp, Artificial Sequence
  chemically synthesized
ggctggcaaagtgacaccca

SEQ ID NO: 312537 - DNA, 20 bp, Artificial Sequence
  chemically synthesized
gtaagtgtcatgggatcctt

SEQ ID NO: 312538 - DNA, 20 bp, Artificial Sequence
  chemically synthesized
tgtaagtgtcatgggatcct

SEQ ID NO: 312539 - DNA, 20 bp, Artificial Sequence
  chemically synthesized
agtgtgcatgtaagtgtcat

SEQ ID NO: 312540 - DNA, 20 bp, Artificial Sequence
  chemically synthesized
aagtgtgcatgtaagtgtca

SEQ ID NO: 312541 - DNA, 20 bp, Artificial Sequence
  chemically synthesized
aatggataaagtgtgcatgt

SEQ ID NO: 312542 - DNA, 20 bp, Artificial Sequence
  chemically synthesized
acattggaggaaaatggata

SEQ ID NO: 312543 - DNA, 20 bp, Artificial Sequence
  chemically synthesized
aatcatacattggaggaaaa

SEQ ID NO: 312544 - DNA, 20 bp, Artificial Sequence
  chemically synthesized
agatctaaatcatacattgg

SEQ ID NO: 312545 - DNA, 20 bp, Artificial Sequence
  chemically synthesized
aagatctaaatcatacattg

SEQ ID NO: 312546 - DNA, 20 bp, Artificial Sequence
  chemically synthesized
ctaagatctaaatcatacat

SEQ ID NO: 312547 - DNA, 20 bp, Artificial Sequence
  chemically synthesized
ttttcctccaatgtatgatt

SEQ ID NO: 312548 - DNA, 20 bp, Artificial Sequence
  chemically synthesized
ccaatgtatgatttagatct

SEQ ID NO: 312549 - DNA, 20 bp, Artificial Sequence
  chemically synthesized
atgatttagatcttagctta

SEQ ID NO: 312550 - DNA, 20 bp, Artificial Sequence
  chemically synthesized
aggaaagttttctttaagct

SEQ ID NO: 312551 - DNA, 20 bp, Artificial Sequence
  chemically synthesized
tcctgaggaaagttttcttt

SEQ ID NO: 312552 - DNA, 20 bp, Artificial Sequence
  chemically synthesized
agcttaaagaaaactttcct

SEQ ID NO: 312553 - DNA, 20 bp, Artificial Sequence
  chemically synthesized
gcttaaagaaaactttcctc

SEQ ID NO: 312554 - DNA, 20 bp, Artificial Sequence
  chemically synthesized
caacagatgattcctgagga

SEQ ID NO: 312555 - DNA, 20 bp, Artificial Sequence
  chemically synthesized
aacgcaacagatgattcctg

SEQ ID NO: 312556 - DNA, 20 bp, Artificial Sequence
  chemically synthesized
gaacgcaacagatgattcct

SEQ ID NO: 312557 - DNA, 20 bp, Artificial Sequence
  chemically synthesized
agactgaactttgaacgcaa

SEQ ID NO: 312558 - DNA, 20 bp, Artificial Sequence
  chemically synthesized
ggaatcatctgttgcgttca

SEQ ID NO: 312559 - DNA, 20 bp, Artificial Sequence
  chemically synthesized
catctgttgcgttcaaagtt

SEQ ID NO: 312560 - DNA, 20 bp, Artificial Sequence
  chemically synthesized
ttgcgttcaaagttcagtct

SEQ ID NO: 312561 - DNA, 20 bp, Artificial Sequence
  chemically synthesized
gttcaaagttcagtctaagt

SEQ ID NO: 312562 - DNA, 20 bp, Artificial Sequence
  chemically synthesized
tcaaagttcagtctaagtca

SEQ ID NO: 312563 - DNA, 20 bp, Artificial Sequence
  chemically synthesized
gacaggaaattactctgact

SEQ ID NO: 312564 - DNA, 20 bp, Artificial Sequence
  chemically synthesized
agagtaatttcctgtcacaa

SEQ ID NO: 312565 - DNA, 20 bp, Artificial Sequence
  chemically synthesized
aaaaaataagcttttgtgac

SEQ ID NO: 312566 - DNA, 20 bp, Artificial Sequence
  chemically synthesized
caaaaaataagcttttgtga

SEQ ID NO: 312567 - DNA, 20 bp, Artificial Sequence
  chemically synthesized
tatttataaaggcaaaaaat

SEQ ID NO: 312568 - DNA, 20 bp, Artificial Sequence
  chemically synthesized
tggatgcaacttatttataa

SEQ ID NO: 312569 - DNA, 20 bp, Artificial Sequence
  chemically synthesized
tattttttgcctttataaat

SEQ ID NO: 312570 - DNA, 20 bp, Artificial Sequence
  chemically synthesized
atggatgcaacttatttata

SEQ ID NO: 312571 - DNA, 20 bp, Artificial Sequence
  chemically synthesized
aatgagcaaatgttaaagaa

SEQ ID NO: 312572 - DNA, 20 bp, Artificial Sequence
  chemically synthesized
ttaaaaatgagcaaatgtta

SEQ ID NO: 312573 - DNA, 20 bp, Artificial Sequence
  chemically synthesized
aataaagtatttttaaaaat

SEQ ID NO: 312574 - DNA, 20 bp, Artificial Sequence
  chemically synthesized
tataaaaatagacattaata

SEQ ID NO: 312575 - DNA, 20 bp, Artificial Sequence
  chemically synthesized
catgcaatccagtataaaaa

SEQ ID NO: 312576 - DNA, 20 bp, Artificial Sequence
  chemically synthesized
attaatgtctatttttatac

SEQ ID NO: 312577 - DNA, 20 bp, Artificial Sequence
  chemically synthesized
cgctcttggtacatgcaatc

SEQ ID NO: 312578 - DNA, 20 bp, Artificial Sequence
  chemically synthesized
tatactggattgcatgtacc

SEQ ID NO: 312579 - DNA, 20 bp, Artificial Sequence
  chemically synthesized
tactggattgcatgtaccaa

SEQ ID NO: 312580 - DNA, 20 bp, Artificial Sequence
  chemically synthesized
gattgcatgtaccaagagcg

SEQ ID NO: 312581 - DNA, 20 bp, Artificial Sequence
  chemically synthesized
aggcatgggaactgcgctct

SEQ ID NO: 312582 - DNA, 20 bp, Artificial Sequence
  chemically synthesized
tatgataggcaggtaggcat

SEQ ID NO: 312583 - DNA, 20 bp, Artificial Sequence
  chemically synthesized
ctatgataggcaggtaggca

SEQ ID NO: 312584 - DNA, 20 bp, Artificial Sequence
  chemically synthesized
ggtcactatgataggcaggt

SEQ ID NO: 312585 - DNA, 20 bp, Artificial Sequence
  chemically synthesized
tggtcactatgataggcagg

SEQ ID NO: 312586 - DNA, 20 bp, Artificial Sequence
  chemically synthesized
ccatggtcactatgataggc

SEQ ID NO: 312587 - DNA, 20 bp, Artificial Sequence
  chemically synthesized
ccatgcctacctgcctatca

SEQ ID NO: 312588 - DNA, 20 bp, Artificial Sequence
  chemically synthesized
tccatggtcactatgatagg

SEQ ID NO: 312589 - DNA, 20 bp, Artificial Sequence
  chemically synthesized
tcatccatggtcactatgat

SEQ ID NO: 312590 - DNA, 20 bp, Artificial Sequence
  chemically synthesized
gtcatccatggtcactatga

SEQ ID NO: 312591 - DNA, 20 bp, Artificial Sequence
  chemically synthesized
cctgcctatcatagtgacca

SEQ ID NO: 312592 - DNA, 20 bp, Artificial Sequence
  chemically synthesized
tgctaattccttgtcatcca

SEQ ID NO: 312593 - DNA, 20 bp, Artificial Sequence
  chemically synthesized
tcatagtgaccatggatgac

SEQ ID NO: 312594 - DNA, 20 bp, Artificial Sequence
  chemically synthesized
catagtgaccatggatgaca

SEQ ID NO: 312595 - DNA, 20 bp, Artificial Sequence
  chemically synthesized
gaccatggatgacaaggaat

SEQ ID NO: 312596 - DNA, 20 bp, Artificial Sequence
  chemically synthesized
ggaattagcattctactaca

SEQ ID NO: 312597 - DNA, 20 bp, Artificial Sequence
  chemically synthesized
aattagcattctactacaaa

SEQ ID NO: 312598 - DNA, 20 bp, Artificial Sequence
  chemically synthesized
ctcagtctccctctttgtag

SEQ ID NO: 312599 - DNA, 20 bp, Artificial Sequence
  chemically synthesized
attagcattctactacaaag

SEQ ID NO: 312600 - DNA, 20 bp, Artificial Sequence
  chemically synthesized
ttagcattctactacaaaga

SEQ ID NO: 312601 - DNA, 20 bp, Artificial Sequence
  chemically synthesized
tatctcagtctccctctttg

SEQ ID NO: 312602 - DNA, 20 bp, Artificial Sequence
  chemically synthesized
agcattctactacaaagagg

SEQ ID NO: 312603 - DNA, 20 bp, Artificial Sequence
  chemically synthesized
ctactacaaagagggagact

SEQ ID NO: 312604 - DNA, 20 bp, Artificial Sequence
  chemically synthesized
caaagagggagactgagata

SEQ ID NO: 312605 - DNA, 20 bp, Artificial Sequence
  chemically synthesized
gaacaatggtgactatatct

SEQ ID NO: 312606 - DNA, 20 bp, Artificial Sequence
  chemically synthesized
agatatagtcaccattgttc

SEQ ID NO: 312607 - DNA, 20 bp, Artificial Sequence
  chemically synthesized
gatatagtcaccattgttcc

SEQ ID NO: 312608 - DNA, 20 bp, Artificial Sequence
  chemically synthesized
tccttggaaccctggaacaa

SEQ ID NO: 312609 - DNA, 20 bp, Artificial Sequence
  chemically synthesized
atatagtcaccattgttcca

SEQ ID NO: 312610 - DNA, 20 bp, Artificial Sequence
  chemically synthesized
caccattgttccagggttcc

SEQ ID NO: 312611 - DNA, 20 bp, Artificial Sequence
  chemically synthesized
tactgccttccttggaaccc

SEQ ID NO: 312612 - DNA, 20 bp, Artificial Sequence
  chemically synthesized
accattgttccagggttcca

SEQ ID NO: 312613 - DNA, 20 bp, Artificial Sequence
  chemically synthesized
attgttccagggttccaagg

SEQ ID NO: 312614 - DNA, 20 bp, Artificial Sequence
  chemically synthesized
ttgttccagggttccaagga

SEQ ID NO: 312615 - DNA, 20 bp, Artificial Sequence
  chemically synthesized
ttccagggttccaaggaagg

SEQ ID NO: 312616 - DNA, 20 bp, Artificial Sequence
  chemically synthesized
tgagagcctactgccttcct

SEQ ID NO: 312617 - DNA, 20 bp, Artificial Sequence
  chemically synthesized
cagggttccaaggaaggcag

SEQ ID NO: 312618 - DNA, 20 bp, Artificial Sequence
  chemically synthesized
agggttccaaggaaggcagt

SEQ ID NO: 312619 - DNA, 20 bp, Artificial Sequence
  chemically synthesized
ggttgcgatgggtaatttga

SEQ ID NO: 312620 - DNA, 20 bp, Artificial Sequence
  chemically synthesized
ctggttgcgatgggtaattt

SEQ ID NO: 312621 - DNA, 20 bp, Artificial Sequence
  chemically synthesized
ctatctaccctggttgcgat

SEQ ID NO: 312622 - DNA, 20 bp, Artificial Sequence
  chemically synthesized
ctcaaattacccatcgcaac

SEQ ID NO: 312623 - DNA, 20 bp, Artificial Sequence
  chemically synthesized
actatctaccctggttgcga

SEQ ID NO: 312624 - DNA, 20 bp, Artificial Sequence
  chemically synthesized
tcaaattacccatcgcaacc

SEQ ID NO: 312625 - DNA, 20 bp, Artificial Sequence
  chemically synthesized
caaattacccatcgcaacca

SEQ ID NO: 312626 - DNA, 20 bp, Artificial Sequence
  chemically synthesized
attacccatcgcaaccaggg

SEQ ID NO: 312627 - DNA, 20 bp, Artificial Sequence
  chemically synthesized
cccatcgcaaccagggtaga

SEQ ID NO: 312628 - DNA, 20 bp, Artificial Sequence
  chemically synthesized
gaatttgtcactatctaccc

SEQ ID NO: 312629 - DNA, 20 bp, Artificial Sequence
  chemically synthesized
caggtaagacagttaaaaaa

SEQ ID NO: 312630 - DNA, 20 bp, Artificial Sequence
  chemically synthesized
ttttttttaactgtcttacc

SEQ ID NO: 312631 - DNA, 20 bp, Artificial Sequence
  chemically synthesized
tgttgggtaaccaggtaaga

SEQ ID NO: 312632 - DNA, 20 bp, Artificial Sequence
  chemically synthesized
attgtgttgggtaaccaggt

SEQ ID NO: 312633 - DNA, 20 bp, Artificial Sequence
  chemically synthesized
agggattgtgttgggtaacc

SEQ ID NO: 312634 - DNA, 20 bp, Artificial Sequence
  chemically synthesized
cagggattgtgttgggtaac

SEQ ID NO: 312635 - DNA, 20 bp, Artificial Sequence
  chemically synthesized
tatgtcccagggattgtgtt

SEQ ID NO: 312636 - DNA, 20 bp, Artificial Sequence
  chemically synthesized
ctatgtcccagggattgtgt

SEQ ID NO: 312637 - DNA, 20 bp, Artificial Sequence
  chemically synthesized
tggttacccaacacaatccc

SEQ ID NO: 312638 - DNA, 20 bp, Artificial Sequence
  chemically synthesized
ggttacccaacacaatccct

SEQ ID NO: 312639 - DNA, 20 bp, Artificial Sequence
  chemically synthesized
ccaacacaatccctgggaca

SEQ ID NO: 312640 - DNA, 20 bp, Artificial Sequence
  chemically synthesized
tatgttcttactatgtccca

SEQ ID NO: 312641 - DNA, 20 bp, Artificial Sequence
  chemically synthesized
ttatgttcttactatgtccc

SEQ ID NO: 312642 - DNA, 20 bp, Artificial Sequence
  chemically synthesized
gttatgttcttactatgtcc

SEQ ID NO: 312643 - DNA, 20 bp, Artificial Sequence
  chemically synthesized
cacaatccctgggacatagt

SEQ ID NO: 312644 - DNA, 20 bp, Artificial Sequence
  chemically synthesized
ggacatagtaagaacataac

SEQ ID NO: 312645 - DNA, 20 bp, Artificial Sequence
  chemically synthesized
ccatttgaatttttttcaac

SEQ ID NO: 312646 - DNA, 20 bp, Artificial Sequence
  chemically synthesized
cttgttgaaaaaaattcaaa

SEQ ID NO: 312647 - DNA, 20 bp, Artificial Sequence
  chemically synthesized
ttgttgaaaaaaattcaaat

SEQ ID NO: 312648 - DNA, 20 bp, Artificial Sequence
  chemically synthesized
aaaaaaattcaaatgggatg

SEQ ID NO: 312649 - DNA, 20 bp, Artificial Sequence
  chemically synthesized
caaatgggatgtggaatgct

SEQ ID NO: 312650 - DNA, 20 bp, Artificial Sequence
  chemically synthesized
tgggatgtggaatgcttaga

SEQ ID NO: 312651 - DNA, 20 bp, Artificial Sequence
  chemically synthesized
ggatgtggaatgcttagaaa

SEQ ID NO: 312652 - DNA, 20 bp, Artificial Sequence
  chemically synthesized
tcattaccacatctctttct

SEQ ID NO: 312653 - DNA, 20 bp, Artificial Sequence
  chemically synthesized
ggaatgcttagaaagagatg

SEQ ID NO: 312654 - DNA, 20 bp, Artificial Sequence
  chemically synthesized
tatatagtcttcagttttag

SEQ ID NO: 312655 - DNA, 20 bp, Artificial Sequence
  chemically synthesized
ttatatagtcttcagtttta

SEQ ID NO: 312656 - DNA, 20 bp, Artificial Sequence
  chemically synthesized
ggtaatgacctctaaaactg

SEQ ID NO: 312657 - DNA, 20 bp, Artificial Sequence
  chemically synthesized
atttatatagtcttcagttt

SEQ ID NO: 312658 - DNA, 20 bp, Artificial Sequence
  chemically synthesized
ttggtcatttatatagtctt

SEQ ID NO: 312659 - DNA, 20 bp, Artificial Sequence
  chemically synthesized
actaaaattggtcatttata

SEQ ID NO: 312660 - DNA, 20 bp, Artificial Sequence
  chemically synthesized
actatataaatgaccaattt

SEQ ID NO: 312661 - DNA, 20 bp, Artificial Sequence
  chemically synthesized
ctaaattttataactaaaat

SEQ ID NO: 312662 - DNA, 20 bp, Artificial Sequence
  chemically synthesized
ccaattttagttataaaatt

SEQ ID NO: 312663 - DNA, 20 bp, Artificial Sequence
  chemically synthesized
gccagttaacttatttgatt

SEQ ID NO: 312664 - DNA, 20 bp, Artificial Sequence
  chemically synthesized
aaaatatttctcaatcaaat

SEQ ID NO: 312665 - DNA, 20 bp, Artificial Sequence
  chemically synthesized
tctcaatcaaataagttaac

SEQ ID NO: 312666 - DNA, 20 bp, Artificial Sequence
  chemically synthesized
tgtttcataggcagtgatgc

SEQ ID NO: 312667 - DNA, 20 bp, Artificial Sequence
  chemically synthesized
tagagagtctgtttcatagg

SEQ ID NO: 312668 - DNA, 20 bp, Artificial Sequence
  chemically synthesized
tggcatcactgcctatgaaa

SEQ ID NO: 312669 - DNA, 20 bp, Artificial Sequence
  chemically synthesized
gcgtagagagtctgtttcat

SEQ ID NO: 312670 - DNA, 20 bp, Artificial Sequence
  chemically synthesized
tgcgtagagagtctgtttca

SEQ ID NO: 312671 - DNA, 20 bp, Artificial Sequence
  chemically synthesized
ccaggatgtcagtgcgtaga

SEQ ID NO: 312672 - DNA, 20 bp, Artificial Sequence
  chemically synthesized
ttccaggatgtcagtgcgta

SEQ ID NO: 312673 - DNA, 20 bp, Artificial Sequence
  chemically synthesized
gcttccaggatgtcagtgcg

SEQ ID NO: 312674 - DNA, 20 bp, Artificial Sequence
  chemically synthesized
ctctctacgcactgacatcc

SEQ ID NO: 312675 - DNA, 20 bp, Artificial Sequence
  chemically synthesized
tttagaggcttccaggatgt

SEQ ID NO: 312676 - DNA, 20 bp, Artificial Sequence
  chemically synthesized
tctacgcactgacatcctgg

SEQ ID NO: 312677 - DNA, 20 bp, Artificial Sequence
  chemically synthesized
ccttaactttagaggcttcc

SEQ ID NO: 312678 - DNA, 20 bp, Artificial Sequence
  chemically synthesized
tccttaactttagaggcttc

SEQ ID NO: 312679 - DNA, 20 bp, Artificial Sequence
  chemically synthesized
tgacatcctggaagcctcta

SEQ ID NO: 312680 - DNA, 20 bp, Artificial Sequence
  chemically synthesized
agtcttgtccttaactttag

SEQ ID NO: 312681 - DNA, 20 bp, Artificial Sequence
  chemically synthesized
tcctggaagcctctaaagtt

SEQ ID NO: 312682 - DNA, 20 bp, Artificial Sequence
  chemically synthesized
gagtcttgtccttaacttta

SEQ ID NO: 312683 - DNA, 20 bp, Artificial Sequence
  chemically synthesized
cctggaagcctctaaagtta

SEQ ID NO: 312684 - DNA, 20 bp, Artificial Sequence
  chemically synthesized
tagagtcttgtccttaactt

SEQ ID NO: 312685 - DNA, 20 bp, Artificial Sequence
  chemically synthesized
aagcctctaaagttaaggac

SEQ ID NO: 312686 - DNA, 20 bp, Artificial Sequence
  chemically synthesized
aaggacaagactctaatctg

SEQ ID NO: 312687 - DNA, 20 bp, Artificial Sequence
  chemically synthesized
agcaatgttactgcagatta

SEQ ID NO: 312688 - DNA, 20 bp, Artificial Sequence
  chemically synthesized
tcagcaatgttactgcagat

SEQ ID NO: 312689 - DNA, 20 bp, Artificial Sequence
  chemically synthesized
gtccctcagcaatgttactg

SEQ ID NO: 312690 - DNA, 20 bp, Artificial Sequence
  chemically synthesized
taatctgcagtaacattgct

SEQ ID NO: 312691 - DNA, 20 bp, Artificial Sequence
  chemically synthesized
aatctgcagtaacattgctg

SEQ ID NO: 312692 - DNA, 20 bp, Artificial Sequence
  chemically synthesized
atctgcagtaacattgctga

SEQ ID NO: 312693 - DNA, 20 bp, Artificial Sequence
  chemically synthesized
cagtaacattgctgagggac

SEQ ID NO: 312694 - DNA, 20 bp, Artificial Sequence
  chemically synthesized
caaaggttcagcttgtccct

SEQ ID NO: 312695 - DNA, 20 bp, Artificial Sequence
  chemically synthesized
gagggacaagctgaaccttt

SEQ ID NO: 312696 - DNA, 20 bp, Artificial Sequence
  chemically synthesized
gattctttctctcaaaggtt

SEQ ID NO: 312697 - DNA, 20 bp, Artificial Sequence
  chemically synthesized
gggacaagctgaacctttga

SEQ ID NO: 312698 - DNA, 20 bp, Artificial Sequence
  chemically synthesized
aattagattctttctctcaa

SEQ ID NO: 312699 - DNA, 20 bp, Artificial Sequence
  chemically synthesized
caagctgaacctttgagaga

SEQ ID NO: 312700 - DNA, 20 bp, Artificial Sequence
  chemically synthesized
taattagattctttctctca

SEQ ID NO: 312701 - DNA, 20 bp, Artificial Sequence
  chemically synthesized
gagagaaagaatctaattat

SEQ ID NO: 312702 - DNA, 20 bp, Artificial Sequence
  chemically synthesized
gagaaagaatctaattatcg

SEQ ID NO: 312703 - DNA, 20 bp, Artificial Sequence
  chemically synthesized
aaagtgtgctctccgataat

SEQ ID NO: 312704 - DNA, 20 bp, Artificial Sequence
  chemically synthesized
gaaagaatctaattatcgga

SEQ ID NO: 312705 - DNA, 20 bp, Artificial Sequence
  chemically synthesized
ttatcggagagcacactttt

SEQ ID NO: 312706 - DNA, 20 bp, Artificial Sequence
  chemically synthesized
atgaagtgtaatattctgaa

SEQ ID NO: 312707 - DNA, 20 bp, Artificial Sequence
  chemically synthesized
ttcagaatattacacttcat

SEQ ID NO: 312708 - DNA, 20 bp, Artificial Sequence
  chemically synthesized
gaaagatgacatagcttatg

SEQ ID NO: 312709 - DNA, 20 bp, Artificial Sequence
  chemically synthesized
agagtttctgaaagatgaca

SEQ ID NO: 312710 - DNA, 20 bp, Artificial Sequence
  chemically synthesized
tcataagctatgtcatcttt

SEQ ID NO: 312711 - DNA, 20 bp, Artificial Sequence
  chemically synthesized
tatatgcttagagtttctga

SEQ ID NO: 312712 - DNA, 20 bp, Artificial Sequence
  chemically synthesized
tgtcatctttcagaaactct

SEQ ID NO: 312713 - DNA, 20 bp, Artificial Sequence
  chemically synthesized
caggtcagaatatatgctta

SEQ ID NO: 312714 - DNA, 20 bp, Artificial Sequence
  chemically synthesized
gacaggtcagaatatatgct

SEQ ID NO: 312715 - DNA, 20 bp, Artificial Sequence
  chemically synthesized
gaagaaaaccaaagacaggt

SEQ ID NO: 312716 - DNA, 20 bp, Artificial Sequence
  chemically synthesized
catatattctgacctgtctt

SEQ ID NO: 312717 - DNA, 20 bp, Artificial Sequence
  chemically synthesized
gtttgaagaaaaccaaagac

SEQ ID NO: 312718 - DNA, 20 bp, Artificial Sequence
  chemically synthesized
ggtttgaagaaaaccaaaga

SEQ ID NO: 312719 - DNA, 20 bp, Artificial Sequence
  chemically synthesized
aaaaggtttgaagaaaacca

SEQ ID NO: 312720 - DNA, 20 bp, Artificial Sequence
  chemically synthesized
tcttctttggaaaaggtttg

SEQ ID NO: 312721 - DNA, 20 bp, Artificial Sequence
  chemically synthesized
ttttcttcaaaccttttcca

SEQ ID NO: 312722 - DNA, 20 bp, Artificial Sequence
  chemically synthesized
tttagagtcttctttggaaa

SEQ ID NO: 312723 - DNA, 20 bp, Artificial Sequence
  chemically synthesized
ctttagagtcttctttggaa

SEQ ID NO: 312724 - DNA, 20 bp, Artificial Sequence
  chemically synthesized
tcttcaaaccttttccaaag

SEQ ID NO: 312725 - DNA, 20 bp, Artificial Sequence
  chemically synthesized
aatacctttagagtcttctt

SEQ ID NO: 312726 - DNA, 20 bp, Artificial Sequence
  chemically synthesized
cttttccaaagaagactcta

SEQ ID NO: 312727 - DNA, 20 bp, Artificial Sequence
  chemically synthesized
ttttccaaagaagactctaa

SEQ ID NO: 312728 - DNA, 20 bp, Artificial Sequence
  chemically synthesized
ctaactttaaaataccttta

SEQ ID NO: 312729 - DNA, 20 bp, Artificial Sequence
  chemically synthesized
ctctaactttaaaatacctt

SEQ ID NO: 312730 - DNA, 20 bp, Artificial Sequence
  chemically synthesized
aagactctaaaggtatttta

SEQ ID NO: 312731 - DNA, 20 bp, Artificial Sequence
  chemically synthesized
ctctaaaggtattttaaagt

SEQ ID NO: 312732 - DNA, 20 bp, Artificial Sequence
  chemically synthesized
ctaaaggtattttaaagtta

SEQ ID NO: 312733 - DNA, 20 bp, Artificial Sequence
  chemically synthesized
ttctattatgatgatatttt

SEQ ID NO: 312734 - DNA, 20 bp, Artificial Sequence
  chemically synthesized
attctattatgatgatattt

SEQ ID NO: 312735 - DNA, 20 bp, Artificial Sequence
  chemically synthesized
atcctaaaatatcatcataa

SEQ ID NO: 312736 - DNA, 20 bp, Artificial Sequence
  chemically synthesized
tatcatcataatagaattta

SEQ ID NO: 312737 - DNA, 20 bp, Artificial Sequence
  chemically synthesized
acagaataaatcaatacatg

SEQ ID NO: 312738 - DNA, 20 bp, Artificial Sequence
  chemically synthesized
tacatgcagatatatcctat

SEQ ID NO: 312739 - DNA, 20 bp, Artificial Sequence
  chemically synthesized
atgcagatatatcctattgg

SEQ ID NO: 312740 - DNA, 20 bp, Artificial Sequence
  chemically synthesized
actctaaaaatacttccaat

SEQ ID NO: 312741 - DNA, 20 bp, Artificial Sequence
  chemically synthesized
aactctaaaaatacttccaa

SEQ ID NO: 312742 - DNA, 20 bp, Artificial Sequence
  chemically synthesized
tatcctattggaagtatttt

SEQ ID NO: 312743 - DNA, 20 bp, Artificial Sequence
  chemically synthesized
tcctattggaagtattttta

SEQ ID NO: 312744 - DNA, 20 bp, Artificial Sequence
  chemically synthesized
gtatttttagagttctaact

SEQ ID NO: 312745 - DNA, 20 bp, Artificial Sequence
  chemically synthesized
tatttttagagttctaactc

SEQ ID NO: 312746 - DNA, 20 bp, Artificial Sequence
  chemically synthesized
atttttagagttctaactca

SEQ ID NO: 312747 - DNA, 20 bp, Artificial Sequence
  chemically synthesized
gcatacttaacaccctgagt

SEQ ID NO: 312748 - DNA, 20 bp, Artificial Sequence
  chemically synthesized
agatgcatacttaacaccct

SEQ ID NO: 312749 - DNA, 20 bp, Artificial Sequence
  chemically synthesized
gagttctaactcagggtgtt

SEQ ID NO: 312750 - DNA, 20 bp, Artificial Sequence
  chemically synthesized
atttagtccaataaggaaga

SEQ ID NO: 312751 - DNA, 20 bp, Artificial Sequence
  chemically synthesized
ccatttagtccaataaggaa

SEQ ID NO: 312752 - DNA, 20 bp, Artificial Sequence
  chemically synthesized
tatgcatctctcttccttat

SEQ ID NO: 312753 - DNA, 20 bp, Artificial Sequence
  chemically synthesized
ccccatttagtccaataagg

SEQ ID NO: 312754 - DNA, 20 bp, Artificial Sequence
  chemically synthesized
agtccccatttagtccaata

SEQ ID NO: 312755 - DNA, 20 bp, Artificial Sequence
  chemically synthesized
aagtccccatttagtccaat

SEQ ID NO: 312756 - DNA, 20 bp, Artificial Sequence
  chemically synthesized
ctcttccttattggactaaa

SEQ ID NO: 312757 - DNA, 20 bp, Artificial Sequence
  chemically synthesized
tcttccttattggactaaat

SEQ ID NO: 312758 - DNA, 20 bp, Artificial Sequence
  chemically synthesized
cttccttattggactaaatg

SEQ ID NO: 312759 - DNA, 20 bp, Artificial Sequence
  chemically synthesized
taggaagggaagtccccatt

SEQ ID NO: 312760 - DNA, 20 bp, Artificial Sequence
  chemically synthesized
atgggggaaagtaggaaggg

SEQ ID NO: 312761 - DNA, 20 bp, Artificial Sequence
  chemically synthesized
cagatgggggaaagtaggaa

SEQ ID NO: 312762 - DNA, 20 bp, Artificial Sequence
  chemically synthesized
acagatgggggaaagtagga

SEQ ID NO: 312763 - DNA, 20 bp, Artificial Sequence
  chemically synthesized
tacagatgggggaaagtagg

SEQ ID NO: 312764 - DNA, 20 bp, Artificial Sequence
  chemically synthesized
aggtacagatgggggaaagt

SEQ ID NO: 312765 - DNA, 20 bp, Artificial Sequence
  chemically synthesized
gaggtacagatgggggaaag

SEQ ID NO: 312766 - DNA, 20 bp, Artificial Sequence
  chemically synthesized
aaagaggtacagatggggga

SEQ ID NO: 312767 - DNA, 20 bp, Artificial Sequence
  chemically synthesized
tggtaaagaggtacagatgg

SEQ ID NO: 312768 - DNA, 20 bp, Artificial Sequence
  chemically synthesized
ttggtaaagaggtacagatg

SEQ ID NO: 312769 - DNA, 20 bp, Artificial Sequence
  chemically synthesized
tttggtaaagaggtacagat

SEQ ID NO: 312770 - DNA, 20 bp, Artificial Sequence
  chemically synthesized
ctttggtaaagaggtacaga

SEQ ID NO: 312771 - DNA, 20 bp, Artificial Sequence
  chemically synthesized
ctgtctttggtaaagaggta

SEQ ID NO: 312772 - DNA, 20 bp, Artificial Sequence
  chemically synthesized
gccagctgtctttggtaaag

SEQ ID NO: 312773 - DNA, 20 bp, Artificial Sequence
  chemically synthesized
ccatctgtacctctttacca

SEQ ID NO: 312774 - DNA, 20 bp, Artificial Sequence
  chemically synthesized
agccagctgtctttggtaaa

SEQ ID NO: 312775 - DNA, 20 bp, Artificial Sequence
  chemically synthesized
atagccagctgtctttggta

SEQ ID NO: 312776 - DNA, 20 bp, Artificial Sequence
  chemically synthesized
ctgtacctctttaccaaaga

SEQ ID NO: 312777 - DNA, 20 bp, Artificial Sequence
  chemically synthesized
aaaggatagccagctgtctt

SEQ ID NO: 312778 - DNA, 20 bp, Artificial Sequence
  chemically synthesized
acctctttaccaaagacagc

SEQ ID NO: 312779 - DNA, 20 bp, Artificial Sequence
  chemically synthesized
agaggctcaaaaaggatagc

SEQ ID NO: 312780 - DNA, 20 bp, Artificial Sequence
  chemically synthesized
atccagaggctcaaaaagga

SEQ ID NO: 312781 - DNA, 20 bp, Artificial Sequence
  chemically synthesized
gacagctggctatccttttt

SEQ ID NO: 312782 - DNA, 20 bp, Artificial Sequence
  chemically synthesized
tgccatccagaggctcaaaa

SEQ ID NO: 312783 - DNA, 20 bp, Artificial Sequence
  chemically synthesized
atgccatccagaggctcaaa

SEQ ID NO: 312784 - DNA, 20 bp, Artificial Sequence
  chemically synthesized
ggctatcctttttgagcctc

SEQ ID NO: 312785 - DNA, 20 bp, Artificial Sequence
  chemically synthesized
atcctttttgagcctctgga

SEQ ID NO: 312786 - DNA, 20 bp, Artificial Sequence
  chemically synthesized
tctgttgaaatgccatccag

SEQ ID NO: 312787 - DNA, 20 bp, Artificial Sequence
  chemically synthesized
ttctgttgaaatgccatcca

SEQ ID NO: 312788 - DNA, 20 bp, Artificial Sequence
  chemically synthesized
aattctgttgaaatgccatc

SEQ ID NO: 312789 - DNA, 20 bp, Artificial Sequence
  chemically synthesized
gcctctggatggcatttcaa

SEQ ID NO: 312790 - DNA, 20 bp, Artificial Sequence
  chemically synthesized
atggcatttcaacagaattt

SEQ ID NO: 312791 - DNA, 20 bp, Artificial Sequence
  chemically synthesized
tcaacagaattttagtgcaa

SEQ ID NO: 312792 - DNA, 20 bp, Artificial Sequence
  chemically synthesized
gaattttagtgcaatggatg

SEQ ID NO: 312793 - DNA, 20 bp, Artificial Sequence
  chemically synthesized
aattttagtgcaatggatga

SEQ ID NO: 312794 - DNA, 20 bp, Artificial Sequence
  chemically synthesized
tgcaatggatgaaggaattg

SEQ ID NO: 312795 - DNA, 20 bp, Artificial Sequence
  chemically synthesized
gatgaaggaattgtggtgat

SEQ ID NO: 312796 - DNA, 20 bp, Artificial Sequence
  chemically synthesized
atgaaggaattgtggtgatg

SEQ ID NO: 312797 - DNA, 20 bp, Artificial Sequence
  chemically synthesized
tgaaggaattgtggtgatga

SEQ ID NO: 312798 - DNA, 20 bp, Artificial Sequence
  chemically synthesized
attgtggtgatgagggatgc

SEQ ID NO: 312799 - DNA, 20 bp, Artificial Sequence
  chemically synthesized
ttgtggtgatgagggatgcc

SEQ ID NO: 312800 - DNA, 20 bp, Artificial Sequence
  chemically synthesized
tgtggtgatgagggatgcca

SEQ ID NO: 312801 - DNA, 20 bp, Artificial Sequence
  chemically synthesized
tgatgagggatgccagggcg

SEQ ID NO: 312802 - DNA, 20 bp, Artificial Sequence
  chemically synthesized
gatgagggatgccagggcga

SEQ ID NO: 312803 - DNA, 20 bp, Artificial Sequence
  chemically synthesized
cgccttctcttccttcgccc

SEQ ID NO: 312804 - DNA, 20 bp, Artificial Sequence
  chemically synthesized
gagggatgccagggcgaagg

SEQ ID NO: 312805 - DNA, 20 bp, Artificial Sequence
  chemically synthesized
gggatgccagggcgaaggaa

SEQ ID NO: 312806 - DNA, 20 bp, Artificial Sequence
  chemically synthesized
atgccagggcgaaggaagag

SEQ ID NO: 312807 - DNA, 20 bp, Artificial Sequence
  chemically synthesized
tgccagggcgaaggaagaga

SEQ ID NO: 312808 - DNA, 20 bp, Artificial Sequence
  chemically synthesized
ggcgaaggaagagaaggcgt

SEQ ID NO: 312809 - DNA, 20 bp, Artificial Sequence
  chemically synthesized
aaggaagagaaggcgtgaga

SEQ ID NO: 312810 - DNA, 20 bp, Artificial Sequence
  chemically synthesized
aggaagagaaggcgtgagat

SEQ ID NO: 312811 - DNA, 20 bp, Artificial Sequence
  chemically synthesized
cctcaaaacctattagtgtt

SEQ ID NO: 312812 - DNA, 20 bp, Artificial Sequence
  chemically synthesized
agatgggcactcaacactaa

SEQ ID NO: 312813 - DNA, 20 bp, Artificial Sequence
  chemically synthesized
gatgggcactcaacactaat

SEQ ID NO: 312814 - DNA, 20 bp, Artificial Sequence
  chemically synthesized
acttattcctcaaaacctat

SEQ ID NO: 312815 - DNA, 20 bp, Artificial Sequence
  chemically synthesized
actcaacactaataggtttt

SEQ ID NO: 312816 - DNA, 20 bp, Artificial Sequence
  chemically synthesized
ctcaacactaataggttttg

SEQ ID NO: 312817 - DNA, 20 bp, Artificial Sequence
  chemically synthesized
actaataggttttgaggaat

SEQ ID NO: 312818 - DNA, 20 bp, Artificial Sequence
  chemically synthesized
taggttttgaggaataagtt

SEQ ID NO: 312819 - DNA, 20 bp, Artificial Sequence
  chemically synthesized
aggttttgaggaataagtta

SEQ ID NO: 312820 - DNA, 20 bp, Artificial Sequence
  chemically synthesized
tttgaggaataagttaagga

SEQ ID NO: 312821 - DNA, 20 bp, Artificial Sequence
  chemically synthesized
aggaataagttaaggatagc

SEQ ID NO: 312822 - DNA, 20 bp, Artificial Sequence
  chemically synthesized
ctttttattagagcagagtc

SEQ ID NO: 312823 - DNA, 20 bp, Artificial Sequence
  chemically synthesized
gcaggctttttattagagca

SEQ ID NO: 312824 - DNA, 20 bp, Artificial Sequence
  chemically synthesized
tagcaggctttttattagag

SEQ ID NO: 312825 - DNA, 20 bp, Artificial Sequence
  chemically synthesized
ccagactctgctctaataaa

SEQ ID NO: 312826 - DNA, 20 bp, Artificial Sequence
  chemically synthesized
tcttagcaggctttttatta

SEQ ID NO: 312827 - DNA, 20 bp, Artificial Sequence
  chemically synthesized
gatcttagcaggctttttat

SEQ ID NO: 312828 - DNA, 20 bp, Artificial Sequence
  chemically synthesized
gctctaataaaaagcctgct

SEQ ID NO: 312829 - DNA, 20 bp, Artificial Sequence
  chemically synthesized
actcagagaaggatcttagc

SEQ ID NO: 312830 - DNA, 20 bp, Artificial Sequence
  chemically synthesized
gactcagagaaggatcttag

SEQ ID NO: 312831 - DNA, 20 bp, Artificial Sequence
  chemically synthesized
caggactcagagaaggatct

SEQ ID NO: 312832 - DNA, 20 bp, Artificial Sequence
  chemically synthesized
gcctgctaagatccttctct

SEQ ID NO: 312833 - DNA, 20 bp, Artificial Sequence
  chemically synthesized
caatcatcaggactcagaga

SEQ ID NO: 312834 - DNA, 20 bp, Artificial Sequence
  chemically synthesized
acaatcatcaggactcagag

SEQ ID NO: 312835 - DNA, 20 bp, Artificial Sequence
  chemically synthesized
aaaacaatcatcaggactca

SEQ ID NO: 312836 - DNA, 20 bp, Artificial Sequence
  chemically synthesized
gaaaaacaatcatcaggact

SEQ ID NO: 312837 - DNA, 20 bp, Artificial Sequence
  chemically synthesized
ctaaaagaaaaacaatcatc

SEQ ID NO: 312838 - DNA, 20 bp, Artificial Sequence
  chemically synthesized
cctaaaagaaaaacaatcat

SEQ ID NO: 312839 - DNA, 20 bp, Artificial Sequence
  chemically synthesized
cctgatgattgtttttcttt

SEQ ID NO: 312840 - DNA, 20 bp, Artificial Sequence
  chemically synthesized
ctgatgattgtttttctttt

SEQ ID NO: 312841 - DNA, 20 bp, Artificial Sequence
  chemically synthesized
tgatgattgtttttctttta

SEQ ID NO: 312842 - DNA, 20 bp, Artificial Sequence
  chemically synthesized
gatgattgtttttcttttag

SEQ ID NO: 312843 - DNA, 20 bp, Artificial Sequence
  chemically synthesized
caggtatttggatcccctaa

SEQ ID NO: 312844 - DNA, 20 bp, Artificial Sequence
  chemically synthesized
aggaaagagaaacaggtatt

SEQ ID NO: 312845 - DNA, 20 bp, Artificial Sequence
  chemically synthesized
gaattacaggaaagagaaac

SEQ ID NO: 312846 - DNA, 20 bp, Artificial Sequence
  chemically synthesized
agaattacaggaaagagaaa

SEQ ID NO: 312847 - DNA, 20 bp, Artificial Sequence
  chemically synthesized
attagaagaattacaggaaa

SEQ ID NO: 312848 - DNA, 20 bp, Artificial Sequence
  chemically synthesized
taattagaagaattacagga

SEQ ID NO: 312849 - DNA, 20 bp, Artificial Sequence
  chemically synthesized
gacgtaattagaagaattac

SEQ ID NO: 312850 - DNA, 20 bp, Artificial Sequence
  chemically synthesized
agacgtaattagaagaatta

SEQ ID NO: 312851 - DNA, 20 bp, Artificial Sequence
  chemically synthesized
attctggtagacgtaattag

SEQ ID NO: 312852 - DNA, 20 bp, Artificial Sequence
  chemically synthesized
gggattctggtagacgtaat

SEQ ID NO: 312853 - DNA, 20 bp, Artificial Sequence
  chemically synthesized
attcttctaattacgtctac

SEQ ID NO: 312854 - DNA, 20 bp, Artificial Sequence
  chemically synthesized
tggactgagagggattctgg

SEQ ID NO: 312855 - DNA, 20 bp, Artificial Sequence
  chemically synthesized
tactggactgagagggattc

SEQ ID NO: 312856 - DNA, 20 bp, Artificial Sequence
  chemically synthesized
acgtctaccagaatccctct

SEQ ID NO: 312857 - DNA, 20 bp, Artificial Sequence
  chemically synthesized
tgtttaatactggactgaga

SEQ ID NO: 312858 - DNA, 20 bp, Artificial Sequence
  chemically synthesized
taccagaatccctctcagtc

SEQ ID NO: 312859 - DNA, 20 bp, Artificial Sequence
  chemically synthesized
atgtttaatactggactgag

SEQ ID NO: 312860 - DNA, 20 bp, Artificial Sequence
  chemically synthesized
tatgtttaatactggactga

SEQ ID NO: 312861 - DNA, 20 bp, Artificial Sequence
  chemically synthesized
aatatgtttaatactggact

SEQ ID NO: 312862 - DNA, 20 bp, Artificial Sequence
  chemically synthesized
gactttaatatgtttaatac

SEQ ID NO: 312863 - DNA, 20 bp, Artificial Sequence
  chemically synthesized
gtccagtattaaacatatta

SEQ ID NO: 312864 - DNA, 20 bp, Artificial Sequence
  chemically synthesized
attaaacatattaaagtcca

SEQ ID NO: 312865 - DNA, 20 bp, Artificial Sequence
  chemically synthesized
tagggtagcttcagagactg

SEQ ID NO: 312866 - DNA, 20 bp, Artificial Sequence
  chemically synthesized
attaaagtccacagtctctg

SEQ ID NO: 312867 - DNA, 20 bp, Artificial Sequence
  chemically synthesized
ataattctagggtagcttca

SEQ ID NO: 312868 - DNA, 20 bp, Artificial Sequence
  chemically synthesized
ttataattctagggtagctt

SEQ ID NO: 312869 - DNA, 20 bp, Artificial Sequence
  chemically synthesized
cacagtctctgaagctaccc

SEQ ID NO: 312870 - DNA, 20 bp, Artificial Sequence
  chemically synthesized
ggtatattataattctaggg

SEQ ID NO: 312871 - DNA, 20 bp, Artificial Sequence
  chemically synthesized
ctgggtatattataattcta

SEQ ID NO: 312872 - DNA, 20 bp, Artificial Sequence
  chemically synthesized
cctgggtatattataattct

SEQ ID NO: 312873 - DNA, 20 bp, Artificial Sequence
  chemically synthesized
ccctgggtatattataattc

SEQ ID NO: 312874 - DNA, 20 bp, Artificial Sequence
  chemically synthesized
ccctagaattataatatacc

SEQ ID NO: 312875 - DNA, 20 bp, Artificial Sequence
  chemically synthesized
cctagaattataatataccc

SEQ ID NO: 312876 - DNA, 20 bp, Artificial Sequence
  chemically synthesized
ctagaattataatataccca

SEQ ID NO: 312877 - DNA, 20 bp, Artificial Sequence
  chemically synthesized
aaatttaacacaaataccct

SEQ ID NO: 312878 - DNA, 20 bp, Artificial Sequence
  chemically synthesized
aaaatttaacacaaataccc

SEQ ID NO: 312879 - DNA, 20 bp, Artificial Sequence
  chemically synthesized
aaagtattaaaagattgata

SEQ ID NO: 312880 - DNA, 20 bp, Artificial Sequence
  chemically synthesized
gagaaatcataaagtattaa

SEQ ID NO: 312881 - DNA, 20 bp, Artificial Sequence
  chemically synthesized
aggagtaaggagaaatcata

SEQ ID NO: 312882 - DNA, 20 bp, Artificial Sequence
  chemically synthesized
ggtacagaaggaggagtaag

SEQ ID NO: 312883 - DNA, 20 bp, Artificial Sequence
  chemically synthesized
atggtacagaaggaggagta

SEQ ID NO: 312884 - DNA, 20 bp, Artificial Sequence
  chemically synthesized
gatggtacagaaggaggagt

SEQ ID NO: 312885 - DNA, 20 bp, Artificial Sequence
  chemically synthesized
agaagatggtacagaaggag

SEQ ID NO: 312886 - DNA, 20 bp, Artificial Sequence
  chemically synthesized
cgagaagatggtacagaagg

SEQ ID NO: 312887 - DNA, 20 bp, Artificial Sequence
  chemically synthesized
acgagaagatggtacagaag

SEQ ID NO: 312888 - DNA, 20 bp, Artificial Sequence
  chemically synthesized
ggacgagaagatggtacaga

SEQ ID NO: 312889 - DNA, 20 bp, Artificial Sequence
  chemically synthesized
aggacgagaagatggtacag

SEQ ID NO: 312890 - DNA, 20 bp, Artificial Sequence
  chemically synthesized
aagaggacgagaagatggta

SEQ ID NO: 312891 - DNA, 20 bp, Artificial Sequence
  chemically synthesized
agaagaagaggacgagaaga

SEQ ID NO: 312892 - DNA, 20 bp, Artificial Sequence
  chemically synthesized
agcaagaagaagaggacgag

SEQ ID NO: 312893 - DNA, 20 bp, Artificial Sequence
  chemically synthesized
aaaagcaagaagaagaggac

SEQ ID NO: 312894 - DNA, 20 bp, Artificial Sequence
  chemically synthesized
tttttaaaagcaagaagaag

SEQ ID NO: 312895 - DNA, 20 bp, Artificial Sequence
  chemically synthesized
ctttttaaaagcaagaagaa

SEQ ID NO: 312896 - DNA, 20 bp, Artificial Sequence
  chemically synthesized
tactttttaaaagcaagaag

SEQ ID NO: 312897 - DNA, 20 bp, Artificial Sequence
  chemically synthesized
gtttactttttaaaagcaag

SEQ ID NO: 312898 - DNA, 20 bp, Artificial Sequence
  chemically synthesized
ctagtttactttttaaaagc

SEQ ID NO: 312899 - DNA, 20 bp, Artificial Sequence
  chemically synthesized
ctcttcttcttgcttttaaa

SEQ ID NO: 312900 - DNA, 20 bp, Artificial Sequence
  chemically synthesized
ttacctagtttactttttaa

SEQ ID NO: 312901 - DNA, 20 bp, Artificial Sequence
  chemically synthesized
cttgcttttaaaaagtaaac

SEQ ID NO: 312902 - DNA, 20 bp, Artificial Sequence
  chemically synthesized
ttgcttttaaaaagtaaact

SEQ ID NO: 312903 - DNA, 20 bp, Artificial Sequence
  chemically synthesized
ttttaaaaagtaaactaggt

SEQ ID NO: 312904 - DNA, 20 bp, Artificial Sequence
  chemically synthesized
tgatataatcttgtcttacc

SEQ ID NO: 312905 - DNA, 20 bp, Artificial Sequence
  chemically synthesized
aaaagtaaactaggtaagac

SEQ ID NO: 312906 - DNA, 20 bp, Artificial Sequence
  chemically synthesized
acaagattatatcacttgca

SEQ ID NO: 312907 - DNA, 20 bp, Artificial Sequence
  chemically synthesized
atgattcttaggttctttgc

SEQ ID NO: 312908 - DNA, 20 bp, Artificial Sequence
  chemically synthesized
atatcacttgcaaagaacct

SEQ ID NO: 312909 - DNA, 20 bp, Artificial Sequence
  chemically synthesized
ttgaaacagagatgattctt

SEQ ID NO: 312910 - DNA, 20 bp, Artificial Sequence
  chemically synthesized
tttgaaacagagatgattct

SEQ ID NO: 312911 - DNA, 20 bp, Artificial Sequence
  chemically synthesized
taagaatcatctctgtttca

SEQ ID NO: 312912 - DNA, 20 bp, Artificial Sequence
  chemically synthesized
ttccatttgactttgaaaca

SEQ ID NO: 312913 - DNA, 20 bp, Artificial Sequence
  chemically synthesized
gcttccatttgactttgaaa

SEQ ID NO: 312914 - DNA, 20 bp, Artificial Sequence
  chemically synthesized
atctctgtttcaaagtcaaa

SEQ ID NO: 312915 - DNA, 20 bp, Artificial Sequence
  chemically synthesized
tctgtttcaaagtcaaatgg

SEQ ID NO: 312916 - DNA, 20 bp, Artificial Sequence
  chemically synthesized
gtttcaaagtcaaatggaag

SEQ ID NO: 312917 - DNA, 20 bp, Artificial Sequence
  chemically synthesized
ttcaaagtcaaatggaagca

SEQ ID NO: 312918 - DNA, 20 bp, Artificial Sequence
  chemically synthesized
actattggctggaattgtcg

SEQ ID NO: 312919 - DNA, 20 bp, Artificial Sequence
  chemically synthesized
agagcattccacgacaattc

SEQ ID NO: 312920 - DNA, 20 bp, Artificial Sequence
  chemically synthesized
tccacgacaattccagccaa

SEQ ID NO: 312921 - DNA, 20 bp, Artificial Sequence
  chemically synthesized
tactttatttaactattggc

SEQ ID NO: 312922 - DNA, 20 bp, Artificial Sequence
  chemically synthesized
tctatactttatttaactat

SEQ ID NO: 312923 - DNA, 20 bp, Artificial Sequence
  chemically synthesized
ttccagccaatagttaaata

SEQ ID NO: 312924 - DNA, 20 bp, Artificial Sequence
  chemically synthesized
gccaatagttaaataaagta

SEQ ID NO: 312925 - DNA, 20 bp, Artificial Sequence
  chemically synthesized
ttaaataaagtatagaactc

SEQ ID NO: 312926 - DNA, 20 bp, Artificial Sequence
  chemically synthesized
taaagtatagaactcaagca

SEQ ID NO: 312927 - DNA, 20 bp, Artificial Sequence
  chemically synthesized
tcccaaaagaatccatgctt

SEQ ID NO: 312928 - DNA, 20 bp, Artificial Sequence
  chemically synthesized
aactcaagcatggattcttt

SEQ ID NO: 312929 - DNA, 20 bp, Artificial Sequence
  chemically synthesized
actcaagcatggattctttt

SEQ ID NO: 312930 - DNA, 20 bp, Artificial Sequence
  chemically synthesized
atcagttccttcagtcccaa

SEQ ID NO: 312931 - DNA, 20 bp, Artificial Sequence
  chemically synthesized
catggattcttttgggactg

SEQ ID NO: 312932 - DNA, 20 bp, Artificial Sequence
  chemically synthesized
atggattcttttgggactga

SEQ ID NO: 312933 - DNA, 20 bp, Artificial Sequence
  chemically synthesized
ttccatcccatcagttcctt

SEQ ID NO: 312934 - DNA, 20 bp, Artificial Sequence
  chemically synthesized
tttgggactgaaggaactga

SEQ ID NO: 312935 - DNA, 20 bp, Artificial Sequence
  chemically synthesized
ttgggactgaaggaactgat

SEQ ID NO: 312936 - DNA, 20 bp, Artificial Sequence
  chemically synthesized
gactgaaggaactgatggga

SEQ ID NO: 312937 - DNA, 20 bp, Artificial Sequence
  chemically synthesized
tttctttgattccatcccat

SEQ ID NO: 312938 - DNA, 20 bp, Artificial Sequence
  chemically synthesized
gaactgatgggatggaatca

SEQ ID NO: 312939 - DNA, 20 bp, Artificial Sequence
  chemically synthesized
gatgggatggaatcaaagaa

SEQ ID NO: 312940 - DNA, 20 bp, Artificial Sequence
  chemically synthesized
atggaatcaaagaaaagtta

SEQ ID NO: 312941 - DNA, 20 bp, Artificial Sequence
  chemically synthesized
aatcaaagaaaagttatagc

SEQ ID NO: 312942 - DNA, 20 bp, Artificial Sequence
  chemically synthesized
atcaaagaaaagttatagca

SEQ ID NO: 312943 - DNA, 20 bp, Artificial Sequence
  chemically synthesized
tcaaagaaaagttatagcaa

SEQ ID NO: 312944 - DNA, 20 bp, Artificial Sequence
  chemically synthesized
aaaggaatcaagtggagaga

SEQ ID NO: 312945 - DNA, 20 bp, Artificial Sequence
  chemically synthesized
attaaaaggaatcaagtgga

SEQ ID NO: 312946 - DNA, 20 bp, Artificial Sequence
  chemically synthesized
gcattaaaaggaatcaagtg

SEQ ID NO: 312947 - DNA, 20 bp, Artificial Sequence
  chemically synthesized
cagcattaaaaggaatcaag

SEQ ID NO: 312948 - DNA, 20 bp, Artificial Sequence
  chemically synthesized
gggcagcattaaaaggaatc

SEQ ID NO: 312949 - DNA, 20 bp, Artificial Sequence
  chemically synthesized
tctaaaagggcagcattaaa

SEQ ID NO: 312950 - DNA, 20 bp, Artificial Sequence
  chemically synthesized
atctaaaagggcagcattaa

SEQ ID NO: 312951 - DNA, 20 bp, Artificial Sequence
  chemically synthesized
tccttttaatgctgcccttt

SEQ ID NO: 312952 - DNA, 20 bp, Artificial Sequence
  chemically synthesized
tagactagtatctaaaaggg

SEQ ID NO: 312953 - DNA, 20 bp, Artificial Sequence
  chemically synthesized
atctagactagtatctaaaa

SEQ ID NO: 312954 - DNA, 20 bp, Artificial Sequence
  chemically synthesized
aatctagactagtatctaaa

SEQ ID NO: 312955 - DNA, 20 bp, Artificial Sequence
  chemically synthesized
taatctagactagtatctaa

SEQ ID NO: 312956 - DNA, 20 bp, Artificial Sequence
  chemically synthesized
aatgctgcccttttagatac

SEQ ID NO: 312957 - DNA, 20 bp, Artificial Sequence
  chemically synthesized
tgcccttttagatactagtc

SEQ ID NO: 312958 - DNA, 20 bp, Artificial Sequence
  chemically synthesized
gactttaagataatctagac

SEQ ID NO: 312959 - DNA, 20 bp, Artificial Sequence
  chemically synthesized
catgtgactttaagataatc

SEQ ID NO: 312960 - DNA, 20 bp, Artificial Sequence
  chemically synthesized
tactagtctagattatctta

SEQ ID NO: 312961 - DNA, 20 bp, Artificial Sequence
  chemically synthesized
ctgtagtgtcatgtgacttt

SEQ ID NO: 312962 - DNA, 20 bp, Artificial Sequence
  chemically synthesized
cttaaagtcacatgacacta

SEQ ID NO: 312963 - DNA, 20 bp, Artificial Sequence
  chemically synthesized
taaagtcacatgacactaca

SEQ ID NO: 312964 - DNA, 20 bp, Artificial Sequence
  chemically synthesized
tttgcctctatatagctctg

SEQ ID NO: 312965 - DNA, 20 bp, Artificial Sequence
  chemically synthesized
catgacactacagagctata

SEQ ID NO: 312966 - DNA, 20 bp, Artificial Sequence
  chemically synthesized
tgacactacagagctatata

SEQ ID NO: 312967 - DNA, 20 bp, Artificial Sequence
  chemically synthesized
gacactacagagctatatag

SEQ ID NO: 312968 - DNA, 20 bp, Artificial Sequence
  chemically synthesized
gttctcattttgcctctata

SEQ ID NO: 312969 - DNA, 20 bp, Artificial Sequence
  chemically synthesized
gagctatatagaggcaaaat

SEQ ID NO: 312970 - DNA, 20 bp, Artificial Sequence
  chemically synthesized
aggcaaaatgagaacatcaa

SEQ ID NO: 312971 - DNA, 20 bp, Artificial Sequence
  chemically synthesized
gcaaaatgagaacatcaaaa

SEQ ID NO: 312972 - DNA, 20 bp, Artificial Sequence
  chemically synthesized
caaaatgagaacatcaaaag

SEQ ID NO: 312973 - DNA, 20 bp, Artificial Sequence
  chemically synthesized
atgagaacatcaaaagagga

SEQ ID NO: 312974 - DNA, 20 bp, Artificial Sequence
  chemically synthesized
agaacatcaaaagaggaaag

SEQ ID NO: 312975 - DNA, 20 bp, Artificial Sequence
  chemically synthesized
caaaagaggaaagaagattg

SEQ ID NO: 312976 - DNA, 20 bp, Artificial Sequence
  chemically synthesized
ggaaagaagattgaagacaa

SEQ ID NO: 312977 - DNA, 20 bp, Artificial Sequence
  chemically synthesized
aaagaagattgaagacaaaa

SEQ ID NO: 312978 - DNA, 20 bp, Artificial Sequence
  chemically synthesized
aagaagattgaagacaaaag

SEQ ID NO: 312979 - DNA, 20 bp, Artificial Sequence
  chemically synthesized
gaagattgaagacaaaagag

SEQ ID NO: 312980 - DNA, 20 bp, Artificial Sequence
  chemically synthesized
aagattgaagacaaaagagg

SEQ ID NO: 312981 - DNA, 20 bp, Artificial Sequence
  chemically synthesized
ttgaagacaaaagaggaggc

SEQ ID NO: 312982 - DNA, 20 bp, Artificial Sequence
  chemically synthesized
aagacaaaagaggaggctgg

SEQ ID NO: 312983 - DNA, 20 bp, Artificial Sequence
  chemically synthesized
agacaaaagaggaggctgga

SEQ ID NO: 312984 - DNA, 20 bp, Artificial Sequence
  chemically synthesized
caaaagaggaggctggaagg

SEQ ID NO: 312985 - DNA, 20 bp, Artificial Sequence
  chemically synthesized
ctttaatggctactgccttc

SEQ ID NO: 312986 - DNA, 20 bp, Artificial Sequence
  chemically synthesized
aagaggaggctggaaggcag

SEQ ID NO: 312987 - DNA, 20 bp, Artificial Sequence
  chemically synthesized
ctggaaggcagtagccatta

SEQ ID NO: 312988 - DNA, 20 bp, Artificial Sequence
  chemically synthesized
tggaaggcagtagccattaa

SEQ ID NO: 312989 - DNA, 20 bp, Artificial Sequence
  chemically synthesized
ggaaggcagtagccattaaa

SEQ ID NO: 312990 - DNA, 20 bp, Artificial Sequence
  chemically synthesized
gaaggcagtagccattaaag

SEQ ID NO: 312991 - DNA, 20 bp, Artificial Sequence
  chemically synthesized
atgattgcatacccctttaa

SEQ ID NO: 312992 - DNA, 20 bp, Artificial Sequence
  chemically synthesized
attaaaggggtatgcaatca

SEQ ID NO: 312993 - DNA, 20 bp, Artificial Sequence
  chemically synthesized
tatgcaatcatggacaaatg

SEQ ID NO: 312994 - DNA, 20 bp, Artificial Sequence
  chemically synthesized
caatcatggacaaatgcaga

SEQ ID NO: 312995 - DNA, 20 bp, Artificial Sequence
  chemically synthesized
atcatggacaaatgcagata

SEQ ID NO: 312996 - DNA, 20 bp, Artificial Sequence
  chemically synthesized
gacaaatgcagatagagttt

SEQ ID NO: 312997 - DNA, 20 bp, Artificial Sequence
  chemically synthesized
cagatagagtttaagcaaat

SEQ ID NO: 312998 - DNA, 20 bp, Artificial Sequence
  chemically synthesized
agatagagtttaagcaaatt

SEQ ID NO: 312999 - DNA, 20 bp, Artificial Sequence
  chemically synthesized
gatagagtttaagcaaatta

SEQ ID NO: 313000 - DNA, 20 bp, Artificial Sequence
  chemically synthesized
ttaagcaaattagggataat

SEQ ID NO: 313001 - DNA, 20 bp, Artificial Sequence
  chemically synthesized
tcagtacatttaccgatatt

SEQ ID NO: 313002 - DNA, 20 bp, Artificial Sequence
  chemically synthesized
caaagacatctactaaatat

SEQ ID NO: 313003 - DNA, 20 bp, Artificial Sequence
  chemically synthesized
gtacatttaccgatatttag

SEQ ID NO: 313004 - DNA, 20 bp, Artificial Sequence
  chemically synthesized
cgatatttagtagatgtctt

SEQ ID NO: 313005 - DNA, 20 bp, Artificial Sequence
  chemically synthesized
gatatttagtagatgtcttt

SEQ ID NO: 313006 - DNA, 20 bp, Artificial Sequence
  chemically synthesized
tagtagatgtctttgggcca

SEQ ID NO: 313007 - DNA, 20 bp, Artificial Sequence
  chemically synthesized
gcctttatttctttggccca

SEQ ID NO: 313008 - DNA, 20 bp, Artificial Sequence
  chemically synthesized
attttctgcctttatttctt

SEQ ID NO: 313009 - DNA, 20 bp, Artificial Sequence
  chemically synthesized
gtctttgggccaaagaaata

SEQ ID NO: 313010 - DNA, 20 bp, Artificial Sequence
  chemically synthesized
tctttgggccaaagaaataa

SEQ ID NO: 313011 - DNA, 20 bp, Artificial Sequence
  chemically synthesized
ttgggccaaagaaataaagg

SEQ ID NO: 313012 - DNA, 20 bp, Artificial Sequence
  chemically synthesized
aagaaataaaggcagaaaat

SEQ ID NO: 313013 - DNA, 20 bp, Artificial Sequence
  chemically synthesized
agaaataaaggcagaaaata

SEQ ID NO: 313014 - DNA, 20 bp, Artificial Sequence
  chemically synthesized
agaaaataaggtgaaaatga

SEQ ID NO: 313015 - DNA, 20 bp, Artificial Sequence
  chemically synthesized
aataaggtgaaaatgaaagc

SEQ ID NO: 313016 - DNA, 20 bp, Artificial Sequence
  chemically synthesized
aaggtgaaaatgaaagcaag

SEQ ID NO: 313017 - DNA, 20 bp, Artificial Sequence
  chemically synthesized
aagcaagtagaaaacaaata

SEQ ID NO: 313018 - DNA, 20 bp, Artificial Sequence
  chemically synthesized
caagtagaaaacaaatacag

SEQ ID NO: 313019 - DNA, 20 bp, Artificial Sequence
  chemically synthesized
agtagaaaacaaatacagaa

SEQ ID NO: 313020 - DNA, 20 bp, Artificial Sequence
  chemically synthesized
aaaacaaatacagaagagta

SEQ ID NO: 313021 - DNA, 20 bp, Artificial Sequence
  chemically synthesized
aaacaaatacagaagagtat

SEQ ID NO: 313022 - DNA, 20 bp, Artificial Sequence
  chemically synthesized
ctcacagatggttgtatggt

SEQ ID NO: 313023 - DNA, 20 bp, Artificial Sequence
  chemically synthesized
actcacagatggttgtatgg

SEQ ID NO: 313024 - DNA, 20 bp, Artificial Sequence
  chemically synthesized
agaactcacagatggttgta

SEQ ID NO: 313025 - DNA, 20 bp, Artificial Sequence
  chemically synthesized
cccaccatacaaccatctgt

SEQ ID NO: 313026 - DNA, 20 bp, Artificial Sequence
  chemically synthesized
cagtccgtagaactcacaga

SEQ ID NO: 313027 - DNA, 20 bp, Artificial Sequence
  chemically synthesized
aaaacagtccgtagaactca

SEQ ID NO: 313028 - DNA, 20 bp, Artificial Sequence
  chemically synthesized
acaaccatctgtgagttcta

SEQ ID NO: 313029 - DNA, 20 bp, Artificial Sequence
  chemically synthesized
gcatcttgaaaaacagtccg

SEQ ID NO: 313030 - DNA, 20 bp, Artificial Sequence
  chemically synthesized
agttctacggactgtttttc

SEQ ID NO: 313031 - DNA, 20 bp, Artificial Sequence
  chemically synthesized
ggttaaggcatcttgaaaaa

SEQ ID NO: 313032 - DNA, 20 bp, Artificial Sequence
  chemically synthesized
aggtgatgcttgtgtggtta

SEQ ID NO: 313033 - DNA, 20 bp, Artificial Sequence
  chemically synthesized
aaggtgatgcttgtgtggtt

SEQ ID NO: 313034 - DNA, 20 bp, Artificial Sequence
  chemically synthesized
tcaagatgccttaaccacac

SEQ ID NO: 313035 - DNA, 20 bp, Artificial Sequence
  chemically synthesized
catccaaggtgatgcttgtg

SEQ ID NO: 313036 - DNA, 20 bp, Artificial Sequence
  chemically synthesized
taaccacacaagcatcacct

SEQ ID NO: 313037 - DNA, 20 bp, Artificial Sequence
  chemically synthesized
ttttcaatataattcatcca

SEQ ID NO: 313038 - DNA, 20 bp, Artificial Sequence
  chemically synthesized
cttttcaatataattcatcc

SEQ ID NO: 313039 - DNA, 20 bp, Artificial Sequence
  chemically synthesized
cttggatgaattatattgaa

SEQ ID NO: 313040 - DNA, 20 bp, Artificial Sequence
  chemically synthesized
tattgaaaagctattcacac

SEQ ID NO: 313041 - DNA, 20 bp, Artificial Sequence
  chemically synthesized
attagctgacccagtgtgaa

SEQ ID NO: 313042 - DNA, 20 bp, Artificial Sequence
  chemically synthesized
attgaaaagctattcacact

SEQ ID NO: 313043 - DNA, 20 bp, Artificial Sequence
  chemically synthesized
aaaagctattcacactgggt

SEQ ID NO: 313044 - DNA, 20 bp, Artificial Sequence
  chemically synthesized
catttcatcattagctgacc

SEQ ID NO: 313045 - DNA, 20 bp, Artificial Sequence
  chemically synthesized
gaaagcacccatttcatcat

SEQ ID NO: 313046 - DNA, 20 bp, Artificial Sequence
  chemically synthesized
tgggtcagctaatgatgaaa

SEQ ID NO: 313047 - DNA, 20 bp, Artificial Sequence
  chemically synthesized
gggtcagctaatgatgaaat

SEQ ID NO: 313048 - DNA, 20 bp, Artificial Sequence
  chemically synthesized
ccatttaaaataacaattga

SEQ ID NO: 313049 - DNA, 20 bp, Artificial Sequence
  chemically synthesized
ctttcaattgttattttaaa

SEQ ID NO: 313050 - DNA, 20 bp, Artificial Sequence
  chemically synthesized
aatggaaatactccatgcct

SEQ ID NO: 313051 - DNA, 20 bp, Artificial Sequence
  chemically synthesized
agacatttttctaaggcatg

SEQ ID NO: 313052 - DNA, 20 bp, Artificial Sequence
  chemically synthesized
gcagacatttttctaaggca

SEQ ID NO: 313053 - DNA, 20 bp, Artificial Sequence
  chemically synthesized
taaatgcagacatttttcta

SEQ ID NO: 313054 - DNA, 20 bp, Artificial Sequence
  chemically synthesized
ttaaatgcagacatttttct

SEQ ID NO: 313055 - DNA, 20 bp, Artificial Sequence
  chemically synthesized
ggttaaaaaaaatttaaatg

SEQ ID NO: 313056 - DNA, 20 bp, Artificial Sequence
  chemically synthesized
gcatttaaattttttttaac

SEQ ID NO: 313057 - DNA, 20 bp, Artificial Sequence
  chemically synthesized
aggggttgaagggaggttac

SEQ ID NO: 313058 - DNA, 20 bp, Artificial Sequence
  chemically synthesized
gggaagcaggggttgaaggg

SEQ ID NO: 313059 - DNA, 20 bp, Artificial Sequence
  chemically synthesized
tgggaagcaggggttgaagg

SEQ ID NO: 313060 - DNA, 20 bp, Artificial Sequence
  chemically synthesized
gctgggaagcaggggttgaa

SEQ ID NO: 313061 - DNA, 20 bp, Artificial Sequence
  chemically synthesized
ggctgggaagcaggggttga

SEQ ID NO: 313062 - DNA, 20 bp, Artificial Sequence
  chemically synthesized
aggctgggaagcaggggttg

SEQ ID NO: 313063 - DNA, 20 bp, Artificial Sequence
  chemically synthesized
taaataaggctgggaagcag

SEQ ID NO: 313064 - DNA, 20 bp, Artificial Sequence
  chemically synthesized
tcccttcaacccctgcttcc

SEQ ID NO: 313065 - DNA, 20 bp, Artificial Sequence
  chemically synthesized
ttaaataaggctgggaagca

SEQ ID NO: 313066 - DNA, 20 bp, Artificial Sequence
  chemically synthesized
attaaataaggctgggaagc

SEQ ID NO: 313067 - DNA, 20 bp, Artificial Sequence
  chemically synthesized
tattaaataaggctgggaag

SEQ ID NO: 313068 - DNA, 20 bp, Artificial Sequence
  chemically synthesized
taatattaaataaggctggg

SEQ ID NO: 313069 - DNA, 20 bp, Artificial Sequence
  chemically synthesized
aattaatattaaataaggct

SEQ ID NO: 313070 - DNA, 20 bp, Artificial Sequence
  chemically synthesized
caattaatattaaataaggc

SEQ ID NO: 313071 - DNA, 20 bp, Artificial Sequence
  chemically synthesized
atttcaattaatattaaata

SEQ ID NO: 313072 - DNA, 20 bp, Artificial Sequence
  chemically synthesized
aatttcaattaatattaaat

SEQ ID NO: 313073 - DNA, 20 bp, Artificial Sequence
  chemically synthesized
taatattaattgaaattttc

SEQ ID NO: 313074 - DNA, 20 bp, Artificial Sequence
  chemically synthesized
ttaattgaaattttctggta

SEQ ID NO: 313075 - DNA, 20 bp, Artificial Sequence
  chemically synthesized
ggtaaaatctaatactttac

SEQ ID NO: 313076 - DNA, 20 bp, Artificial Sequence
  chemically synthesized
gaaattttctggtaaagtat

SEQ ID NO: 313077 - DNA, 20 bp, Artificial Sequence
  chemically synthesized
tattagattttacccatccg

SEQ ID NO: 313078 - DNA, 20 bp, Artificial Sequence
  chemically synthesized
aatagtaactaactgcggat

SEQ ID NO: 313079 - DNA, 20 bp, Artificial Sequence
  chemically synthesized
caatagtaactaactgcgga

SEQ ID NO: 313080 - DNA, 20 bp, Artificial Sequence
  chemically synthesized
agattttacccatccgcagt

SEQ ID NO: 313081 - DNA, 20 bp, Artificial Sequence
  chemically synthesized
gatacaatagtaactaactg

SEQ ID NO: 313082 - DNA, 20 bp, Artificial Sequence
  chemically synthesized
gcagttagttactattgtat

SEQ ID NO: 313083 - DNA, 20 bp, Artificial Sequence
  chemically synthesized
attccataattctgatacaa

SEQ ID NO: 313084 - DNA, 20 bp, Artificial Sequence
  chemically synthesized
ttactattgtatcagaatta

SEQ ID NO: 313085 - DNA, 20 bp, Artificial Sequence
  chemically synthesized
ttatggaattctttaaatca

SEQ ID NO: 313086 - DNA, 20 bp, Artificial Sequence
  chemically synthesized
agctgaagtgctgtgattta

SEQ ID NO: 313087 - DNA, 20 bp, Artificial Sequence
  chemically synthesized
ttctttaaatcacagcactt

SEQ ID NO: 313088 - DNA, 20 bp, Artificial Sequence
  chemically synthesized
cacacactcataatcagctg

SEQ ID NO: 313089 - DNA, 20 bp, Artificial Sequence
  chemically synthesized
acagcacttcagctgattat

SEQ ID NO: 313090 - DNA, 20 bp, Artificial Sequence
  chemically synthesized
aatatacacacactcataat

SEQ ID NO: 313091 - DNA, 20 bp, Artificial Sequence
  chemically synthesized
ttgtacacatattgtattct

SEQ ID NO: 313092 - DNA, 20 bp, Artificial Sequence
  chemically synthesized
aatttatatattaaaatact

SEQ ID NO: 313093 - DNA, 20 bp, Artificial Sequence
  chemically synthesized
tgaaaagtattttaaaaatt

SEQ ID NO: 313094 - DNA, 20 bp, Artificial Sequence
  chemically synthesized
aaatttttaaaatacttttc

SEQ ID NO: 313095 - DNA, 20 bp, Artificial Sequence
  chemically synthesized
taaaagaactataacttgaa

SEQ ID NO: 313096 - DNA, 20 bp, Artificial Sequence
  chemically synthesized
ttaaaatacttttcaagtta

SEQ ID NO: 313097 - DNA, 20 bp, Artificial Sequence
  chemically synthesized
ttcaagttatagttctttta

SEQ ID NO: 313098 - DNA, 20 bp, Artificial Sequence
  chemically synthesized
tcaagttatagttcttttaa

SEQ ID NO: 313099 - DNA, 20 bp, Artificial Sequence
  chemically synthesized
aaactaaatatgtcctttaa

SEQ ID NO: 313100 - DNA, 20 bp, Artificial Sequence
  chemically synthesized
gttcttttaaaggacatatt

SEQ ID NO: 313101 - DNA, 20 bp, Artificial Sequence
  chemically synthesized
aaggacatatttagtttact

SEQ ID NO: 313102 - DNA, 20 bp, Artificial Sequence
  chemically synthesized
taaggtcagattattttgct

SEQ ID NO: 313103 - DNA, 20 bp, Artificial Sequence
  chemically synthesized
aagcaaaataatctgacctt

SEQ ID NO: 313104 - DNA, 20 bp, Artificial Sequence
  chemically synthesized
ttggaagaacaacttaaggt

SEQ ID NO: 313105 - DNA, 20 bp, Artificial Sequence
  chemically synthesized
tgctttggaagaacaactta

SEQ ID NO: 313106 - DNA, 20 bp, Artificial Sequence
  chemically synthesized
ctgctttggaagaacaactt

SEQ ID NO: 313107 - DNA, 20 bp, Artificial Sequence
  chemically synthesized
gaccttaagttgttcttcca

SEQ ID NO: 313108 - DNA, 20 bp, Artificial Sequence
  chemically synthesized
cttaagttgttcttccaaag

SEQ ID NO: 313109 - DNA, 20 bp, Artificial Sequence
  chemically synthesized
tcacgcaactgctgctttgg

SEQ ID NO: 313110 - DNA, 20 bp, Artificial Sequence
  chemically synthesized
aagttgttcttccaaagcag

SEQ ID NO: 313111 - DNA, 20 bp, Artificial Sequence
  chemically synthesized
agatcacgcaactgctgctt

SEQ ID NO: 313112 - DNA, 20 bp, Artificial Sequence
  chemically synthesized
agcagttgcgtgatctccac

SEQ ID NO: 313113 - DNA, 20 bp, Artificial Sequence
  chemically synthesized
ggtagttgatgaatctagtg

SEQ ID NO: 313114 - DNA, 20 bp, Artificial Sequence
  chemically synthesized
gtggtagttgatgaatctag

SEQ ID NO: 313115 - DNA, 20 bp, Artificial Sequence
  chemically synthesized
gtggtggtagttgatgaatc

SEQ ID NO: 313116 - DNA, 20 bp, Artificial Sequence
  chemically synthesized
tctcactcacatggtggtgg

SEQ ID NO: 313117 - DNA, 20 bp, Artificial Sequence
  chemically synthesized
ttctctcactcacatggtgg

SEQ ID NO: 313118 - DNA, 20 bp, Artificial Sequence
  chemically synthesized
atcaactaccaccaccatgt

SEQ ID NO: 313119 - DNA, 20 bp, Artificial Sequence
  chemically synthesized
caattctctcactcacatgg

SEQ ID NO: 313120 - DNA, 20 bp, Artificial Sequence
  chemically synthesized
actaccaccaccatgtgagt

SEQ ID NO: 313121 - DNA, 20 bp, Artificial Sequence
  chemically synthesized
ggtcaattctctcactcaca

SEQ ID NO: 313122 - DNA, 20 bp, Artificial Sequence
  chemically synthesized
taccaccaccatgtgagtga

SEQ ID NO: 313123 - DNA, 20 bp, Artificial Sequence
  chemically synthesized
tctagaacaagaacaagtca

SEQ ID NO: 313124 - DNA, 20 bp, Artificial Sequence
  chemically synthesized
atctagaacaagaacaagtc

SEQ ID NO: 313125 - DNA, 20 bp, Artificial Sequence
  chemically synthesized
gatctagaacaagaacaagt

SEQ ID NO: 313126 - DNA, 20 bp, Artificial Sequence
  chemically synthesized
agaagatctagaacaagaac

SEQ ID NO: 313127 - DNA, 20 bp, Artificial Sequence
  chemically synthesized
accctgacttgttcttgttc

SEQ ID NO: 313128 - DNA, 20 bp, Artificial Sequence
  chemically synthesized
gcttcaagaagatctagaac

SEQ ID NO: 313129 - DNA, 20 bp, Artificial Sequence
  chemically synthesized
tcaggtgcttcaagaagatc

SEQ ID NO: 313130 - DNA, 20 bp, Artificial Sequence
  chemically synthesized
tcttgttctagatcttcttg

SEQ ID NO: 313131 - DNA, 20 bp, Artificial Sequence
  chemically synthesized
tatctttcaggtgcttcaag

SEQ ID NO: 313132 - DNA, 20 bp, Artificial Sequence
  chemically synthesized
ttttatctttcaggtgcttc

SEQ ID NO: 313133 - DNA, 20 bp, Artificial Sequence
  chemically synthesized
gatcttcttgaagcacctga

SEQ ID NO: 313134 - DNA, 20 bp, Artificial Sequence
  chemically synthesized
tttaaaacattttatctttc

SEQ ID NO: 313135 - DNA, 20 bp, Artificial Sequence
  chemically synthesized
ctttaaaacattttatcttt

SEQ ID NO: 313136 - DNA, 20 bp, Artificial Sequence
  chemically synthesized
ctgaaagataaaatgtttta

SEQ ID NO: 313137 - DNA, 20 bp, Artificial Sequence
  chemically synthesized
tgaaagataaaatgttttaa

SEQ ID NO: 313138 - DNA, 20 bp, Artificial Sequence
  chemically synthesized
aatcatttcaacacacatgt

SEQ ID NO: 313139 - DNA, 20 bp, Artificial Sequence
  chemically synthesized
tgaaatgatttgctctcaaa

SEQ ID NO: 313140 - DNA, 20 bp, Artificial Sequence
  chemically synthesized
aaataaatttcaccatttga

SEQ ID NO: 313141 - DNA, 20 bp, Artificial Sequence
  chemically synthesized
agaaataaatttcaccattt

SEQ ID NO: 313142 - DNA, 20 bp, Artificial Sequence
  chemically synthesized
tgggagtacctgagatgtag

SEQ ID NO: 313143 - DNA, 20 bp, Artificial Sequence
  chemically synthesized
aatttatttctgctacatct

SEQ ID NO: 313144 - DNA, 20 bp, Artificial Sequence
  chemically synthesized
atttatttctgctacatctc

SEQ ID NO: 313145 - DNA, 20 bp, Artificial Sequence
  chemically synthesized
aaatgggagtacctgagatg

SEQ ID NO: 313146 - DNA, 20 bp, Artificial Sequence
  chemically synthesized
aataaaaaatgggagtacct

SEQ ID NO: 313147 - DNA, 20 bp, Artificial Sequence
  chemically synthesized
tttaggttaataaaaaatgg

SEQ ID NO: 313148 - DNA, 20 bp, Artificial Sequence
  chemically synthesized
gttttaggttaataaaaaat

SEQ ID NO: 313149 - DNA, 20 bp, Artificial Sequence
  chemically synthesized
ggttttaggttaataaaaaa

SEQ ID NO: 313150 - DNA, 20 bp, Artificial Sequence
  chemically synthesized
aattggcttggaatggtttt

SEQ ID NO: 313151 - DNA, 20 bp, Artificial Sequence
  chemically synthesized
aaattggcttggaatggttt

SEQ ID NO: 313152 - DNA, 20 bp, Artificial Sequence
  chemically synthesized
tattaacctaaaaccattcc

SEQ ID NO: 313153 - DNA, 20 bp, Artificial Sequence
  chemically synthesized
agcagaaaattggcttggaa

SEQ ID NO: 313154 - DNA, 20 bp, Artificial Sequence
  chemically synthesized
gtcatagcagaaaattggct

SEQ ID NO: 313155 - DNA, 20 bp, Artificial Sequence
  chemically synthesized
tgagcgtcatagcagaaaat

SEQ ID NO: 313156 - DNA, 20 bp, Artificial Sequence
  chemically synthesized
aattttgctgagcgtcatag

SEQ ID NO: 313157 - DNA, 20 bp, Artificial Sequence
  chemically synthesized
caattttctgctatgacgct

SEQ ID NO: 313158 - DNA, 20 bp, Artificial Sequence
  chemically synthesized
ataaattttgctgagcgtca

SEQ ID NO: 313159 - DNA, 20 bp, Artificial Sequence
  chemically synthesized
tagaacatataaattttgct

SEQ ID NO: 313160 - DNA, 20 bp, Artificial Sequence
  chemically synthesized
ctttccagttaaattaacaa

SEQ ID NO: 313161 - DNA, 20 bp, Artificial Sequence
  chemically synthesized
tgttctattgttaatttaac

SEQ ID NO: 313162 - DNA, 20 bp, Artificial Sequence
  chemically synthesized
ctattgttaatttaactgga

SEQ ID NO: 313163 - DNA, 20 bp, Artificial Sequence
  chemically synthesized
tgtcttctctagatactttc

SEQ ID NO: 313164 - DNA, 20 bp, Artificial Sequence
  chemically synthesized
taatttaactggaaagtatc

SEQ ID NO: 313165 - DNA, 20 bp, Artificial Sequence
  chemically synthesized
atttaactggaaagtatcta

SEQ ID NO: 313166 - DNA, 20 bp, Artificial Sequence
  chemically synthesized
taactggaaagtatctagag

SEQ ID NO: 313167 - DNA, 20 bp, Artificial Sequence
  chemically synthesized
ttcttaacatttgtcttctc

SEQ ID NO: 313168 - DNA, 20 bp, Artificial Sequence
  chemically synthesized
atctagagaagacaaatgtt

SEQ ID NO: 313169 - DNA, 20 bp, Artificial Sequence
  chemically synthesized
agagaagacaaatgttaaga

SEQ ID NO: 313170 - DNA, 20 bp, Artificial Sequence
  chemically synthesized
gagaagacaaatgttaagaa

SEQ ID NO: 313171 - DNA, 20 bp, Artificial Sequence
  chemically synthesized
gacaaatgttaagaaaggta

SEQ ID NO: 313172 - DNA, 20 bp, Artificial Sequence
  chemically synthesized
aaatgttaagaaaggtacag

SEQ ID NO: 313173 - DNA, 20 bp, Artificial Sequence
  chemically synthesized
aatgttaagaaaggtacagc

SEQ ID NO: 313174 - DNA, 20 bp, Artificial Sequence
  chemically synthesized
aaagggggtgggatgagaag

SEQ ID NO: 313175 - DNA, 20 bp, Artificial Sequence
  chemically synthesized
agaaagggggtgggatgaga

SEQ ID NO: 313176 - DNA, 20 bp, Artificial Sequence
  chemically synthesized
gagaaagggggtgggatgag

SEQ ID NO: 313177 - DNA, 20 bp, Artificial Sequence
  chemically synthesized
agggagaaagggggtgggat

SEQ ID NO: 313178 - DNA, 20 bp, Artificial Sequence
  chemically synthesized
ttgaaagggagaaagggggt

SEQ ID NO: 313179 - DNA, 20 bp, Artificial Sequence
  chemically synthesized
cttgaaagggagaaaggggg

SEQ ID NO: 313180 - DNA, 20 bp, Artificial Sequence
  chemically synthesized
gtccttgaaagggagaaagg

SEQ ID NO: 313181 - DNA, 20 bp, Artificial Sequence
  chemically synthesized
agtccttgaaagggagaaag

SEQ ID NO: 313182 - DNA, 20 bp, Artificial Sequence
  chemically synthesized
aagtccttgaaagggagaaa

SEQ ID NO: 313183 - DNA, 20 bp, Artificial Sequence
  chemically synthesized
aaagtccttgaaagggagaa

SEQ ID NO: 313184 - DNA, 20 bp, Artificial Sequence
  chemically synthesized
aaaagtccttgaaagggaga

SEQ ID NO: 313185 - DNA, 20 bp, Artificial Sequence
  chemically synthesized
ccaccccctttctccctttc

SEQ ID NO: 313186 - DNA, 20 bp, Artificial Sequence
  chemically synthesized
caccccctttctccctttca

SEQ ID NO: 313187 - DNA, 20 bp, Artificial Sequence
  chemically synthesized
ggaaaaaagtccttgaaagg

SEQ ID NO: 313188 - DNA, 20 bp, Artificial Sequence
  chemically synthesized
taggaaaaaagtccttgaaa

SEQ ID NO: 313189 - DNA, 20 bp, Artificial Sequence
  chemically synthesized
gtaggaaaaaagtccttgaa

SEQ ID NO: 313190 - DNA, 20 bp, Artificial Sequence
  chemically synthesized
tgtaggaaaaaagtccttga

SEQ ID NO: 313191 - DNA, 20 bp, Artificial Sequence
  chemically synthesized
tgctgatagttgtaggaaaa

SEQ ID NO: 313192 - DNA, 20 bp, Artificial Sequence
  chemically synthesized
ccagaagtgctgatagttgt

SEQ ID NO: 313193 - DNA, 20 bp, Artificial Sequence
  chemically synthesized
gacttttttcctacaactat

SEQ ID NO: 313194 - DNA, 20 bp, Artificial Sequence
  chemically synthesized
gccagaagtgctgatagttg

SEQ ID NO: 313195 - DNA, 20 bp, Artificial Sequence
  chemically synthesized
gaaaatgccagaagtgctga

SEQ ID NO: 313196 - DNA, 20 bp, Artificial Sequence
  chemically synthesized
cctacaactatcagcacttc

SEQ ID NO: 313197 - DNA, 20 bp, Artificial Sequence
  chemically synthesized
gaagagcctgaaaatgccag

SEQ ID NO: 313198 - DNA, 20 bp, Artificial Sequence
  chemically synthesized
atcagcacttctggcatttt

SEQ ID NO: 313199 - DNA, 20 bp, Artificial Sequence
  chemically synthesized
gaagaagagcctgaaaatgc

SEQ ID NO: 313200 - DNA, 20 bp, Artificial Sequence
  chemically synthesized
tcagcacttctggcattttc

SEQ ID NO: 313201 - DNA, 20 bp, Artificial Sequence
  chemically synthesized
agaagttcagtagagaagaa

SEQ ID NO: 313202 - DNA, 20 bp, Artificial Sequence
  chemically synthesized
ggagaagttcagtagagaag

SEQ ID NO: 313203 - DNA, 20 bp, Artificial Sequence
  chemically synthesized
aatggagaagttcagtagag

SEQ ID NO: 313204 - DNA, 20 bp, Artificial Sequence
  chemically synthesized
ggtaatggagaagttcagta

SEQ ID NO: 313205 - DNA, 20 bp, Artificial Sequence
  chemically synthesized
atggtaatggagaagttcag

SEQ ID NO: 313206 - DNA, 20 bp, Artificial Sequence
  chemically synthesized
tttatggtaatggagaagtt

SEQ ID NO: 313207 - DNA, 20 bp, Artificial Sequence
  chemically synthesized
ttatttttatggtaatggag

SEQ ID NO: 313208 - DNA, 20 bp, Artificial Sequence
  chemically synthesized
gttttatttttatggtaatg

SEQ ID NO: 313209 - DNA, 20 bp, Artificial Sequence
  chemically synthesized
ttgttttatttttatggtaa

SEQ ID NO: 313210 - DNA, 20 bp, Artificial Sequence
  chemically synthesized
aagagtttgttttattttta

SEQ ID NO: 313211 - DNA, 20 bp, Artificial Sequence
  chemically synthesized
ggaccggtttgttggatcaa

SEQ ID NO: 313212 - DNA, 20 bp, Artificial Sequence
  chemically synthesized
gaggaccggtttgttggatc

SEQ ID NO: 313213 - DNA, 20 bp, Artificial Sequence
  chemically synthesized
aaactcttgatccaacaaac

SEQ ID NO: 313214 - DNA, 20 bp, Artificial Sequence
  chemically synthesized
cagtaggaggaccggtttgt

SEQ ID NO: 313215 - DNA, 20 bp, Artificial Sequence
  chemically synthesized
taataggacagtaggaggac

SEQ ID NO: 313216 - DNA, 20 bp, Artificial Sequence
  chemically synthesized
acacataataggacagtagg

SEQ ID NO: 313217 - DNA, 20 bp, Artificial Sequence
  chemically synthesized
aacacataataggacagtag

SEQ ID NO: 313218 - DNA, 20 bp, Artificial Sequence
  chemically synthesized
ggaacacataataggacagt

SEQ ID NO: 313219 - DNA, 20 bp, Artificial Sequence
  chemically synthesized
aggaacacataataggacag

SEQ ID NO: 313220 - DNA, 20 bp, Artificial Sequence
  chemically synthesized
aagaggaacacataatagga

SEQ ID NO: 313221 - DNA, 20 bp, Artificial Sequence
  chemically synthesized
agtgaagaggaacacataat

SEQ ID NO: 313222 - DNA, 20 bp, Artificial Sequence
  chemically synthesized
cagtgaagaggaacacataa

SEQ ID NO: 313223 - DNA, 20 bp, Artificial Sequence
  chemically synthesized
ttttttttttttcagtgaag

SEQ ID NO: 313224 - DNA, 20 bp, Artificial Sequence
  chemically synthesized
tttttttttttttcagtgaa

SEQ ID NO: 313225 - DNA, 20 bp, Artificial Sequence
  chemically synthesized
tgtttttttttttttcagtg

SEQ ID NO: 313226 - DNA, 20 bp, Artificial Sequence
  chemically synthesized
acatttgttttttttttttt

SEQ ID NO: 313227 - DNA, 20 bp, Artificial Sequence
  chemically synthesized
aaaaaaacaaatgtatccta

SEQ ID NO: 313228 - DNA, 20 bp, Artificial Sequence
  chemically synthesized
tatgtaggcacagtaactat

SEQ ID NO: 313229 - DNA, 20 bp, Artificial Sequence
  chemically synthesized
atatgtaggcacagtaacta

SEQ ID NO: 313230 - DNA, 20 bp, Artificial Sequence
  chemically synthesized
gtaggataaatatgtaggca

SEQ ID NO: 313231 - DNA, 20 bp, Artificial Sequence
  chemically synthesized
gaatagtaggataaatatgt

SEQ ID NO: 313232 - DNA, 20 bp, Artificial Sequence
  chemically synthesized
tgaatagtaggataaatatg

SEQ ID NO: 313233 - DNA, 20 bp, Artificial Sequence
  chemically synthesized
tagtgggcaaagtgaatagt

SEQ ID NO: 313234 - DNA, 20 bp, Artificial Sequence
  chemically synthesized
ttagtgggcaaagtgaatag

SEQ ID NO: 313235 - DNA, 20 bp, Artificial Sequence
  chemically synthesized
gggttagtgggcaaagtgaa

SEQ ID NO: 313236 - DNA, 20 bp, Artificial Sequence
  chemically synthesized
tttcaatgggttagtgggca

SEQ ID NO: 313237 - DNA, 20 bp, Artificial Sequence
  chemically synthesized
agatatttcaatgggttagt

SEQ ID NO: 313238 - DNA, 20 bp, Artificial Sequence
  chemically synthesized
aagatatttcaatgggttag

SEQ ID NO: 313239 - DNA, 20 bp, Artificial Sequence
  chemically synthesized
caaaagatatttcaatgggt

SEQ ID NO: 313240 - DNA, 20 bp, Artificial Sequence
  chemically synthesized
tttacaaaagatatttcaat

SEQ ID NO: 313241 - DNA, 20 bp, Artificial Sequence
  chemically synthesized
ctttacaaaagatatttcaa

SEQ ID NO: 313242 - DNA, 20 bp, Artificial Sequence
  chemically synthesized
ccattgaaatatcttttgta

SEQ ID NO: 313243 - DNA, 20 bp, Artificial Sequence
  chemically synthesized
cattgaaatatcttttgtaa

SEQ ID NO: 313244 - DNA, 20 bp, Artificial Sequence
  chemically synthesized
gttgatggtgtcctttacaa

SEQ ID NO: 313245 - DNA, 20 bp, Artificial Sequence
  chemically synthesized
tttaggaacatgaaagttga

SEQ ID NO: 313246 - DNA, 20 bp, Artificial Sequence
  chemically synthesized
tattgaatttaggaacatga

SEQ ID NO: 313247 - DNA, 20 bp, Artificial Sequence
  chemically synthesized
aacaaatggttattgaattt

SEQ ID NO: 313248 - DNA, 20 bp, Artificial Sequence
  chemically synthesized
taacaaatggttattgaatt

SEQ ID NO: 313249 - DNA, 20 bp, Artificial Sequence
  chemically synthesized
aattcaataaccatttgtta

SEQ ID NO: 313250 - DNA, 20 bp, Artificial Sequence
  chemically synthesized
aagtaagacgctataacaaa

SEQ ID NO: 313251 - DNA, 20 bp, Artificial Sequence
  chemically synthesized
tagtaatcaacatgtcaagt

SEQ ID NO: 313252 - DNA, 20 bp, Artificial Sequence
  chemically synthesized
aggttagtaatcaacatgtc

SEQ ID NO: 313253 - DNA, 20 bp, Artificial Sequence
  chemically synthesized
atgttgattactaacctaat

SEQ ID NO: 313254 - DNA, 20 bp, Artificial Sequence
  chemically synthesized
gagggagtggccaattaggt

SEQ ID NO: 313255 - DNA, 20 bp, Artificial Sequence
  chemically synthesized
gaatgagggagtggccaatt

SEQ ID NO: 313256 - DNA, 20 bp, Artificial Sequence
  chemically synthesized
agaatgagggagtggccaat

SEQ ID NO: 313257 - DNA, 20 bp, Artificial Sequence
  chemically synthesized
aggtgtcaagaatgagggag

SEQ ID NO: 313258 - DNA, 20 bp, Artificial Sequence
  chemically synthesized
agaaggtgtcaagaatgagg

SEQ ID NO: 313259 - DNA, 20 bp, Artificial Sequence
  chemically synthesized
agagaaggtgtcaagaatga

SEQ ID NO: 313260 - DNA, 20 bp, Artificial Sequence
  chemically synthesized
aagagaaggtgtcaagaatg

SEQ ID NO: 313261 - DNA, 20 bp, Artificial Sequence
  chemically synthesized
caagagaaggtgtcaagaat

SEQ ID NO: 313262 - DNA, 20 bp, Artificial Sequence
  chemically synthesized
ggtaatcaagagaaggtgtc

SEQ ID NO: 313263 - DNA, 20 bp, Artificial Sequence
  chemically synthesized
gtaggagggtaatcaagaga

SEQ ID NO: 313264 - DNA, 20 bp, Artificial Sequence
  chemically synthesized
ggtaggagggtaatcaagag

SEQ ID NO: 313265 - DNA, 20 bp, Artificial Sequence
  chemically synthesized
ataggtaggagggtaatcaa

SEQ ID NO: 313266 - DNA, 20 bp, Artificial Sequence
  chemically synthesized
acataggtaggagggtaatc

SEQ ID NO: 313267 - DNA, 20 bp, Artificial Sequence
  chemically synthesized
aaagtagcacataggtagga

SEQ ID NO: 313268 - DNA, 20 bp, Artificial Sequence
  chemically synthesized
aaaagtagcacataggtagg

SEQ ID NO: 313269 - DNA, 20 bp, Artificial Sequence
  chemically synthesized
aaaaagtagcacataggtag

SEQ ID NO: 313270 - DNA, 20 bp, Artificial Sequence
  chemically synthesized
aaaaaaagtagcacataggt

SEQ ID NO: 313271 - DNA, 20 bp, Artificial Sequence
  chemically synthesized
taaaaaaagtagcacatagg

SEQ ID NO: 313272 - DNA, 20 bp, Artificial Sequence
  chemically synthesized
aaataaaaaaagtagcacat

SEQ ID NO: 313273 - DNA, 20 bp, Artificial Sequence
  chemically synthesized
aaaataaaaaaagtagcaca

SEQ ID NO: 313274 - DNA, 20 bp, Artificial Sequence
  chemically synthesized
gaaaaaaaaaataaaaaaag

SEQ ID NO: 313275 - DNA, 20 bp, Artificial Sequence
  chemically synthesized
atagaaaaaaaaaataaaaa

SEQ ID NO: 313276 - DNA, 20 bp, Artificial Sequence
  chemically synthesized
tttattttttttttctattt

SEQ ID NO: 313277 - DNA, 20 bp, Artificial Sequence
  chemically synthesized
tattttttttttctattttg

SEQ ID NO: 313278 - DNA, 20 bp, Artificial Sequence
  chemically synthesized
gtgagaatccgtctccaaaa

SEQ ID NO: 313279 - DNA, 20 bp, Artificial Sequence
  chemically synthesized
ttttttttctattttggaga

SEQ ID NO: 313280 - DNA, 20 bp, Artificial Sequence
  chemically synthesized
tccaccctgggtgacacagt

SEQ ID NO: 313281 - DNA, 20 bp, Artificial Sequence
  chemically synthesized
cggattctcactgtgtcacc

SEQ ID NO: 313282 - DNA, 20 bp, Artificial Sequence
  chemically synthesized
gcattccaccctgggtgaca

SEQ ID NO: 313283 - DNA, 20 bp, Artificial Sequence
  chemically synthesized
ggattctcactgtgtcaccc

SEQ ID NO: 313284 - DNA, 20 bp, Artificial Sequence
  chemically synthesized
gattctcactgtgtcaccca

SEQ ID NO: 313285 - DNA, 20 bp, Artificial Sequence
  chemically synthesized
tctcactgtgtcacccaggg

SEQ ID NO: 313286 - DNA, 20 bp, Artificial Sequence
  chemically synthesized
tgccattggcattccaccct

SEQ ID NO: 313287 - DNA, 20 bp, Artificial Sequence
  chemically synthesized
atgccattggcattccaccc

SEQ ID NO: 313288 - DNA, 20 bp, Artificial Sequence
  chemically synthesized
cacccagggtggaatgccaa

SEQ ID NO: 313289 - DNA, 20 bp, Artificial Sequence
  chemically synthesized
gtgagccgagatcatgccat

SEQ ID NO: 313290 - DNA, 20 bp, Artificial Sequence
  chemically synthesized
gaatgccaatggcatgatct

SEQ ID NO: 313291 - DNA, 20 bp, Artificial Sequence
  chemically synthesized
ggtggagtttgcagtgagcc

SEQ ID NO: 313292 - DNA, 20 bp, Artificial Sequence
  chemically synthesized
cggtaggtggagtttgcagt

SEQ ID NO: 313293 - DNA, 20 bp, Artificial Sequence
  chemically synthesized
aacccggtaggtggagtttg

SEQ ID NO: 313294 - DNA, 20 bp, Artificial Sequence
  chemically synthesized
tcactgcaaactccacctac

SEQ ID NO: 313295 - DNA, 20 bp, Artificial Sequence
  chemically synthesized
tcccttgaacccggtaggtg

SEQ ID NO: 313296 - DNA, 20 bp, Artificial Sequence
  chemically synthesized
cactgcaaactccacctacc

SEQ ID NO: 313297 - DNA, 20 bp, Artificial Sequence
  chemically synthesized
aatcccttgaacccggtagg

SEQ ID NO: 313298 - DNA, 20 bp, Artificial Sequence
  chemically synthesized
gagaatcccttgaacccggt

SEQ ID NO: 313299 - DNA, 20 bp, Artificial Sequence
  chemically synthesized
ggagaatcccttgaacccgg

SEQ ID NO: 313300 - DNA, 20 bp, Artificial Sequence
  chemically synthesized
aaactccacctaccgggttc

SEQ ID NO: 313301 - DNA, 20 bp, Artificial Sequence
  chemically synthesized
aactccacctaccgggttca

SEQ ID NO: 313302 - DNA, 20 bp, Artificial Sequence
  chemically synthesized
actccacctaccgggttcaa

SEQ ID NO: 313303 - DNA, 20 bp, Artificial Sequence
  chemically synthesized
gcaggagaatcccttgaacc

SEQ ID NO: 313304 - DNA, 20 bp, Artificial Sequence
  chemically synthesized
ttcaagggattctcctgcct

SEQ ID NO: 313305 - DNA, 20 bp, Artificial Sequence
  chemically synthesized
tactcgggaggctgaggcag

SEQ ID NO: 313306 - DNA, 20 bp, Artificial Sequence
  chemically synthesized
gctactcgggaggctgaggc

SEQ ID NO: 313307 - DNA, 20 bp, Artificial Sequence
  chemically synthesized
agctactcgggaggctgagg

SEQ ID NO: 313308 - DNA, 20 bp, Artificial Sequence
  chemically synthesized
ctcagctactcgggaggctg

SEQ ID NO: 313309 - DNA, 20 bp, Artificial Sequence
  chemically synthesized
tctcagctactcgggaggct

SEQ ID NO: 313310 - DNA, 20 bp, Artificial Sequence
  chemically synthesized
ttctcctgcctcagcctccc

SEQ ID NO: 313311 - DNA, 20 bp, Artificial Sequence
  chemically synthesized
tcctgcctcagcctcccgag

SEQ ID NO: 313312 - DNA, 20 bp, Artificial Sequence
  chemically synthesized
tgtaatctcagctactcggg

SEQ ID NO: 313313 - DNA, 20 bp, Artificial Sequence
  chemically synthesized
ctgtaatctcagctactcgg

SEQ ID NO: 313314 - DNA, 20 bp, Artificial Sequence
  chemically synthesized
acctgtaatctcagctactc

SEQ ID NO: 313315 - DNA, 20 bp, Artificial Sequence
  chemically synthesized
cctcagcctcccgagtagct

SEQ ID NO: 313316 - DNA, 20 bp, Artificial Sequence
  chemically synthesized
cacctgtaatctcagctact

SEQ ID NO: 313317 - DNA, 20 bp, Artificial Sequence
  chemically synthesized
ctcccgagtagctgagatta

SEQ ID NO: 313318 - DNA, 20 bp, Artificial Sequence
  chemically synthesized
tcccgagtagctgagattac

SEQ ID NO: 313319 - DNA, 20 bp, Artificial Sequence
  chemically synthesized
gtggtgtgcacctgtaatct

SEQ ID NO: 313320 - DNA, 20 bp, Artificial Sequence
  chemically synthesized
caggtgcacaccaccacgcc

SEQ ID NO: 313321 - DNA, 20 bp, Artificial Sequence
  chemically synthesized
aaaaaattagctgggcgtgg

SEQ ID NO: 313322 - DNA, 20 bp, Artificial Sequence
  chemically synthesized
tacaaaaaattagctgggcg

SEQ ID NO: 313323 - DNA, 20 bp, Artificial Sequence
  chemically synthesized
gaaaatacaaaaaattagct

SEQ ID NO: 313324 - DNA, 20 bp, Artificial Sequence
  chemically synthesized
tgaaaatacaaaaaattagc

SEQ ID NO: 313325 - DNA, 20 bp, Artificial Sequence
  chemically synthesized
caactgaaaatacaaaaaat

SEQ ID NO: 313326 - DNA, 20 bp, Artificial Sequence
  chemically synthesized
cagctaattttttgtatttt

SEQ ID NO: 313327 - DNA, 20 bp, Artificial Sequence
  chemically synthesized
aattttttgtattttcagtt

SEQ ID NO: 313328 - DNA, 20 bp, Artificial Sequence
  chemically synthesized
ttttgtattttcagttgaga

SEQ ID NO: 313329 - DNA, 20 bp, Artificial Sequence
  chemically synthesized
tttgtattttcagttgagac

SEQ ID NO: 313330 - DNA, 20 bp, Artificial Sequence
  chemically synthesized
gagacgggatttcaccacgt

SEQ ID NO: 313331 - DNA, 20 bp, Artificial Sequence
  chemically synthesized
cgggatttcaccacgttggc

SEQ ID NO: 313332 - DNA, 20 bp, Artificial Sequence
  chemically synthesized
tgagagcagcctggccaacg

SEQ ID NO: 313333 - DNA, 20 bp, Artificial Sequence
  chemically synthesized
gggatttcaccacgttggcc

SEQ ID NO: 313334 - DNA, 20 bp, Artificial Sequence
  chemically synthesized
tcaggagtttgagagcagcc

SEQ ID NO: 313335 - DNA, 20 bp, Artificial Sequence
  chemically synthesized
tgaggtcaggagtttgagag

SEQ ID NO: 313336 - DNA, 20 bp, Artificial Sequence
  chemically synthesized
acctgaggtcaggagtttga

SEQ ID NO: 313337 - DNA, 20 bp, Artificial Sequence
  chemically synthesized
ttacctgaggtcaggagttt

SEQ ID NO: 313338 - DNA, 20 bp, Artificial Sequence
  chemically synthesized
tgctctcaaactcctgacct

SEQ ID NO: 313339 - DNA, 20 bp, Artificial Sequence
  chemically synthesized
ggtagattacctgaggtcag

SEQ ID NO: 313340 - DNA, 20 bp, Artificial Sequence
  chemically synthesized
gctctcaaactcctgacctc

SEQ ID NO: 313341 - DNA, 20 bp, Artificial Sequence
  chemically synthesized
tgggtagattacctgaggtc

SEQ ID NO: 313342 - DNA, 20 bp, Artificial Sequence
  chemically synthesized
gtgggtagattacctgaggt

SEQ ID NO: 313343 - DNA, 20 bp, Artificial Sequence
  chemically synthesized
tgaggtgggtagattacctg

SEQ ID NO: 313344 - DNA, 20 bp, Artificial Sequence
  chemically synthesized
ctgaggtgggtagattacct

SEQ ID NO: 313345 - DNA, 20 bp, Artificial Sequence
  chemically synthesized
ctcaggtaatctacccacct

SEQ ID NO: 313346 - DNA, 20 bp, Artificial Sequence
  chemically synthesized
ctttgggaggctgaggtggg

SEQ ID NO: 313347 - DNA, 20 bp, Artificial Sequence
  chemically synthesized
gcactttgggaggctgaggt

SEQ ID NO: 313348 - DNA, 20 bp, Artificial Sequence
  chemically synthesized
agcactttgggaggctgagg

SEQ ID NO: 313349 - DNA, 20 bp, Artificial Sequence
  chemically synthesized
ctcagcactttgggaggctg

SEQ ID NO: 313350 - DNA, 20 bp, Artificial Sequence
  chemically synthesized
tctcagcactttgggaggct

SEQ ID NO: 313351 - DNA, 20 bp, Artificial Sequence
  chemically synthesized
ctacccacctcagcctccca

SEQ ID NO: 313352 - DNA, 20 bp, Artificial Sequence
  chemically synthesized
tgtaatctcagcactttggg

SEQ ID NO: 313353 - DNA, 20 bp, Artificial Sequence
  chemically synthesized
ttgtaatctcagcactttgg

SEQ ID NO: 313354 - DNA, 20 bp, Artificial Sequence
  chemically synthesized
gtttgtaatctcagcacttt

SEQ ID NO: 313355 - DNA, 20 bp, Artificial Sequence
  chemically synthesized
cctcagcctcccaaagtgct

SEQ ID NO: 313356 - DNA, 20 bp, Artificial Sequence
  chemically synthesized
cgtttgtaatctcagcactt

SEQ ID NO: 313357 - DNA, 20 bp, Artificial Sequence
  chemically synthesized
gtggctcacgtttgtaatct

SEQ ID NO: 313358 - DNA, 20 bp, Artificial Sequence
  chemically synthesized
agtgctgagattacaaacgt

SEQ ID NO: 313359 - DNA, 20 bp, Artificial Sequence
  chemically synthesized
caaacgtgagccactgtgcc

SEQ ID NO: 313360 - DNA, 20 bp, Artificial Sequence
  chemically synthesized
agtgtataggccaggcacag

SEQ ID NO: 313361 - DNA, 20 bp, Artificial Sequence
  chemically synthesized
agtagtgtataggccaggca

SEQ ID NO: 313362 - DNA, 20 bp, Artificial Sequence
  chemically synthesized
taaaaagtagtgtataggcc

SEQ ID NO: 313363 - DNA, 20 bp, Artificial Sequence
  chemically synthesized
ctaaaaagtagtgtataggc

SEQ ID NO: 313364 - DNA, 20 bp, Artificial Sequence
  chemically synthesized
ggagctaaaaagtagtgtat

SEQ ID NO: 313365 - DNA, 20 bp, Artificial Sequence
  chemically synthesized
aggagctaaaaagtagtgta

SEQ ID NO: 313366 - DNA, 20 bp, Artificial Sequence
  chemically synthesized
ctggcctatacactactttt

SEQ ID NO: 313367 - DNA, 20 bp, Artificial Sequence
  chemically synthesized
cgagtaaaggagctaaaaag

SEQ ID NO: 313368 - DNA, 20 bp, Artificial Sequence
  chemically synthesized
aaacgagtaaaggagctaaa

SEQ ID NO: 313369 - DNA, 20 bp, Artificial Sequence
  chemically synthesized
aagggaaaaaacgagtaaag

SEQ ID NO: 313370 - DNA, 20 bp, Artificial Sequence
  chemically synthesized
ggaagggaaaaaacgagtaa

SEQ ID NO: 313371 - DNA, 20 bp, Artificial Sequence
  chemically synthesized
cggaagggaaaaaacgagta

SEQ ID NO: 313372 - DNA, 20 bp, Artificial Sequence
  chemically synthesized
ttgagcggaagggaaaaaac

SEQ ID NO: 313373 - DNA, 20 bp, Artificial Sequence
  chemically synthesized
gatttgtagtttgagcggaa

SEQ ID NO: 313374 - DNA, 20 bp, Artificial Sequence
  chemically synthesized
tgatttgtagtttgagcgga

SEQ ID NO: 313375 - DNA, 20 bp, Artificial Sequence
  chemically synthesized
ctgatttgtagtttgagcgg

SEQ ID NO: 313376 - DNA, 20 bp, Artificial Sequence
  chemically synthesized
catctgatttgtagtttgag

SEQ ID NO: 313377 - DNA, 20 bp, Artificial Sequence
  chemically synthesized
tgacatctgatttgtagttt

SEQ ID NO: 313378 - DNA, 20 bp, Artificial Sequence
  chemically synthesized
cttccgctcaaactacaaat

SEQ ID NO: 313379 - DNA, 20 bp, Artificial Sequence
  chemically synthesized
tcggactgacatctgatttg

SEQ ID NO: 313380 - DNA, 20 bp, Artificial Sequence
  chemically synthesized
tcaaactacaaatcagatgt

SEQ ID NO: 313381 - DNA, 20 bp, Artificial Sequence
  chemically synthesized
atctattggtttttataaat

SEQ ID NO: 313382 - DNA, 20 bp, Artificial Sequence
  chemically synthesized
gtccgatttataaaaaccaa

SEQ ID NO: 313383 - DNA, 20 bp, Artificial Sequence
  chemically synthesized
ttagtatgatagaaatctat

SEQ ID NO: 313384 - DNA, 20 bp, Artificial Sequence
  chemically synthesized
caatagatttctatcatact

SEQ ID NO: 313385 - DNA, 20 bp, Artificial Sequence
  chemically synthesized
aattttctttcttagtatga

SEQ ID NO: 313386 - DNA, 20 bp, Artificial Sequence
  chemically synthesized
agatttctatcatactaaga

SEQ ID NO: 313387 - DNA, 20 bp, Artificial Sequence
  chemically synthesized
agaagttaaattttctttct

SEQ ID NO: 313388 - DNA, 20 bp, Artificial Sequence
  chemically synthesized
tataagaatttcaggtagag

SEQ ID NO: 313389 - DNA, 20 bp, Artificial Sequence
  chemically synthesized
tcatataagaatttcaggta

SEQ ID NO: 313390 - DNA, 20 bp, Artificial Sequence
  chemically synthesized
gatcatataagaatttcagg

SEQ ID NO: 313391 - DNA, 20 bp, Artificial Sequence
  chemically synthesized
ctagatcatataagaatttc

SEQ ID NO: 313392 - DNA, 20 bp, Artificial Sequence
  chemically synthesized
gctagatcatataagaattt

SEQ ID NO: 313393 - DNA, 20 bp, Artificial Sequence
  chemically synthesized
agtcaggtgctagatcatat

SEQ ID NO: 313394 - DNA, 20 bp, Artificial Sequence
  chemically synthesized
cctgaaattcttatatgatc

SEQ ID NO: 313395 - DNA, 20 bp, Artificial Sequence
  chemically synthesized
ctggtgaggtagtcaggtgc

SEQ ID NO: 313396 - DNA, 20 bp, Artificial Sequence
  chemically synthesized
attagactggtgaggtagtc

SEQ ID NO: 313397 - DNA, 20 bp, Artificial Sequence
  chemically synthesized
aattagactggtgaggtagt

SEQ ID NO: 313398 - DNA, 20 bp, Artificial Sequence
  chemically synthesized
ctagcacctgactacctcac

SEQ ID NO: 313399 - DNA, 20 bp, Artificial Sequence
  chemically synthesized
atacaattagactggtgagg

SEQ ID NO: 313400 - DNA, 20 bp, Artificial Sequence
  chemically synthesized
ggtatacaattagactggtg

SEQ ID NO: 313401 - DNA, 20 bp, Artificial Sequence
  chemically synthesized
tggtatacaattagactggt

SEQ ID NO: 313402 - DNA, 20 bp, Artificial Sequence
  chemically synthesized
agaatggtatacaattagac

SEQ ID NO: 313403 - DNA, 20 bp, Artificial Sequence
  chemically synthesized
gggcgagaatggtatacaat

SEQ ID NO: 313404 - DNA, 20 bp, Artificial Sequence
  chemically synthesized
aaacactgtgagggcgagaa

SEQ ID NO: 313405 - DNA, 20 bp, Artificial Sequence
  chemically synthesized
gtataccattctcgccctca

SEQ ID NO: 313406 - DNA, 20 bp, Artificial Sequence
  chemically synthesized
ttctgaaacactgtgagggc

SEQ ID NO: 313407 - DNA, 20 bp, Artificial Sequence
  chemically synthesized
gtcattctgaaacactgtga

SEQ ID NO: 313408 - DNA, 20 bp, Artificial Sequence
  chemically synthesized
agtcattctgaaacactgtg

SEQ ID NO: 313409 - DNA, 20 bp, Artificial Sequence
  chemically synthesized
aagtcattctgaaacactgt

SEQ ID NO: 313410 - DNA, 20 bp, Artificial Sequence
  chemically synthesized
ttctcgccctcacagtgttt

SEQ ID NO: 313411 - DNA, 20 bp, Artificial Sequence
  chemically synthesized
ttttggaagagagacaaagc

SEQ ID NO: 313412 - DNA, 20 bp, Artificial Sequence
  chemically synthesized
acatttttggaagagagaca

SEQ ID NO: 313413 - DNA, 20 bp, Artificial Sequence
  chemically synthesized
cttgacacatttttggaaga

SEQ ID NO: 313414 - DNA, 20 bp, Artificial Sequence
  chemically synthesized
agcttgacacatttttggaa

SEQ ID NO: 313415 - DNA, 20 bp, Artificial Sequence
  chemically synthesized
acagcttgacacatttttgg

SEQ ID NO: 313416 - DNA, 20 bp, Artificial Sequence
  chemically synthesized
ggaacagcttgacacatttt

SEQ ID NO: 313417 - DNA, 20 bp, Artificial Sequence
  chemically synthesized
ctctcttccaaaaatgtgtc

SEQ ID NO: 313418 - DNA, 20 bp, Artificial Sequence
  chemically synthesized
agcaatcctggtagagggaa

SEQ ID NO: 313419 - DNA, 20 bp, Artificial Sequence
  chemically synthesized
tgtcaagctgttccctctac

SEQ ID NO: 313420 - DNA, 20 bp, Artificial Sequence
  chemically synthesized
gtcaagctgttccctctacc

SEQ ID NO: 313421 - DNA, 20 bp, Artificial Sequence
  chemically synthesized
agaaaagcaatcctggtaga

SEQ ID NO: 313422 - DNA, 20 bp, Artificial Sequence
  chemically synthesized
aagaaaagcaatcctggtag

SEQ ID NO: 313423 - DNA, 20 bp, Artificial Sequence
  chemically synthesized
gaagaaaagcaatcctggta

SEQ ID NO: 313424 - DNA, 20 bp, Artificial Sequence
  chemically synthesized
tggaagaaaagcaatcctgg

SEQ ID NO: 313425 - DNA, 20 bp, Artificial Sequence
  chemically synthesized
atctggaagaaaagcaatcc

SEQ ID NO: 313426 - DNA, 20 bp, Artificial Sequence
  chemically synthesized
taccaggattgcttttcttc

SEQ ID NO: 313427 - DNA, 20 bp, Artificial Sequence
  chemically synthesized
gatttaaacatctggaagaa

SEQ ID NO: 313428 - DNA, 20 bp, Artificial Sequence
  chemically synthesized
gaaatgatttaaacatctgg

SEQ ID NO: 313429 - DNA, 20 bp, Artificial Sequence
  chemically synthesized
aaagaaatgatttaaacatc

SEQ ID NO: 313430 - DNA, 20 bp, Artificial Sequence
  chemically synthesized
taaatcatttctttatcatt

SEQ ID NO: 313431 - DNA, 20 bp, Artificial Sequence
  chemically synthesized
acattgagtcctgaatgata

SEQ ID NO: 313432 - DNA, 20 bp, Artificial Sequence
  chemically synthesized
aaatcatttctttatcattc

SEQ ID NO: 313433 - DNA, 20 bp, Artificial Sequence
  chemically synthesized
tatcattcaggactcaatgt

SEQ ID NO: 313434 - DNA, 20 bp, Artificial Sequence
  chemically synthesized
aggtaggtgacacttacatt

SEQ ID NO: 313435 - DNA, 20 bp, Artificial Sequence
  chemically synthesized
caatgtaagtgtcacctacc

SEQ ID NO: 313436 - DNA, 20 bp, Artificial Sequence
  chemically synthesized
atgtaagtgtcacctaccta

SEQ ID NO: 313437 - DNA, 20 bp, Artificial Sequence
  chemically synthesized
catgaaaagctgctctaggt

SEQ ID NO: 313438 - DNA, 20 bp, Artificial Sequence
  chemically synthesized
taagtgtcacctacctagag

SEQ ID NO: 313439 - DNA, 20 bp, Artificial Sequence
  chemically synthesized
tcatgaaaagctgctctagg

SEQ ID NO: 313440 - DNA, 20 bp, Artificial Sequence
  chemically synthesized
tgctcatgaaaagctgctct

SEQ ID NO: 313441 - DNA, 20 bp, Artificial Sequence
  chemically synthesized
ttgctcatgaaaagctgctc

SEQ ID NO: 313442 - DNA, 20 bp, Artificial Sequence
  chemically synthesized
tacctagagcagcttttcat

SEQ ID NO: 313443 - DNA, 20 bp, Artificial Sequence
  chemically synthesized
ttggatagtttgctcatgaa

SEQ ID NO: 313444 - DNA, 20 bp, Artificial Sequence
  chemically synthesized
tactagggagcaacattgga

SEQ ID NO: 313445 - DNA, 20 bp, Artificial Sequence
  chemically synthesized
gaattactagggagcaacat

SEQ ID NO: 313446 - DNA, 20 bp, Artificial Sequence
  chemically synthesized
aactatccaatgttgctccc

SEQ ID NO: 313447 - DNA, 20 bp, Artificial Sequence
  chemically synthesized
agaaatggtgaattactagg

SEQ ID NO: 313448 - DNA, 20 bp, Artificial Sequence
  chemically synthesized
acagaaatggtgaattacta

SEQ ID NO: 313449 - DNA, 20 bp, Artificial Sequence
  chemically synthesized
gacagaaatggtgaattact

SEQ ID NO: 313450 - DNA, 20 bp, Artificial Sequence
  chemically synthesized
tgacagaaatggtgaattac

SEQ ID NO: 313451 - DNA, 20 bp, Artificial Sequence
  chemically synthesized
gattaaaaaaatgacagaaa

SEQ ID NO: 313452 - DNA, 20 bp, Artificial Sequence
  chemically synthesized
tactatgattaaaaaaatga

SEQ ID NO: 313453 - DNA, 20 bp, Artificial Sequence
  chemically synthesized
ttctgtcatttttttaatca

SEQ ID NO: 313454 - DNA, 20 bp, Artificial Sequence
  chemically synthesized
atacataagaaattattgag

SEQ ID NO: 313455 - DNA, 20 bp, Artificial Sequence
  chemically synthesized
ctgatacataagaaattatt

SEQ ID NO: 313456 - DNA, 20 bp, Artificial Sequence
  chemically synthesized
ctcaataatttcttatgtat

SEQ ID NO: 313457 - DNA, 20 bp, Artificial Sequence
  chemically synthesized
aaaggactaagctgatacat

SEQ ID NO: 313458 - DNA, 20 bp, Artificial Sequence
  chemically synthesized
taatttcttatgtatcagct

SEQ ID NO: 313459 - DNA, 20 bp, Artificial Sequence
  chemically synthesized
taagtagagacaaaaggact

SEQ ID NO: 313460 - DNA, 20 bp, Artificial Sequence
  chemically synthesized
ttatagtaagtagagacaaa

SEQ ID NO: 313461 - DNA, 20 bp, Artificial Sequence
  chemically synthesized
attatagtaagtagagacaa

SEQ ID NO: 313462 - DNA, 20 bp, Artificial Sequence
  chemically synthesized
actgcctattatagtaagta

SEQ ID NO: 313463 - DNA, 20 bp, Artificial Sequence
  chemically synthesized
ggactgcctattatagtaag

SEQ ID NO: 313464 - DNA, 20 bp, Artificial Sequence
  chemically synthesized
tttgtctctacttactataa

SEQ ID NO: 313465 - DNA, 20 bp, Artificial Sequence
  chemically synthesized
agtggactgcctattatagt

SEQ ID NO: 313466 - DNA, 20 bp, Artificial Sequence
  chemically synthesized
ttgtctctacttactataat

SEQ ID NO: 313467 - DNA, 20 bp, Artificial Sequence
  chemically synthesized
tctctacttactataatagg

SEQ ID NO: 313468 - DNA, 20 bp, Artificial Sequence
  chemically synthesized
ttctagtggactgcctatta

SEQ ID NO: 313469 - DNA, 20 bp, Artificial Sequence
  chemically synthesized
tactataataggcagtccac

SEQ ID NO: 313470 - DNA, 20 bp, Artificial Sequence
  chemically synthesized
taataggcagtccactagaa

SEQ ID NO: 313471 - DNA, 20 bp, Artificial Sequence
  chemically synthesized
agagggcatctctgttctag

SEQ ID NO: 313472 - DNA, 20 bp, Artificial Sequence
  chemically synthesized
ataggcagtccactagaaca

SEQ ID NO: 313473 - DNA, 20 bp, Artificial Sequence
  chemically synthesized
gacagagggcatctctgttc

SEQ ID NO: 313474 - DNA, 20 bp, Artificial Sequence
  chemically synthesized
tacatagtgagaaggacaga

SEQ ID NO: 313475 - DNA, 20 bp, Artificial Sequence
  chemically synthesized
atacatagtgagaaggacag

SEQ ID NO: 313476 - DNA, 20 bp, Artificial Sequence
  chemically synthesized
aatacatagtgagaaggaca

SEQ ID NO: 313477 - DNA, 20 bp, Artificial Sequence
  chemically synthesized
gtaatacatagtgagaagga

SEQ ID NO: 313478 - DNA, 20 bp, Artificial Sequence
  chemically synthesized
gcttgtaatacatagtgaga

SEQ ID NO: 313479 - DNA, 20 bp, Artificial Sequence
  chemically synthesized
tgcttgtaatacatagtgag

SEQ ID NO: 313480 - DNA, 20 bp, Artificial Sequence
  chemically synthesized
atttgcttgtaatacatagt

SEQ ID NO: 313481 - DNA, 20 bp, Artificial Sequence
  chemically synthesized
ctttatttgcttgtaataca

SEQ ID NO: 313482 - DNA, 20 bp, Artificial Sequence
  chemically synthesized
tccttctcactatgtattac

SEQ ID NO: 313483 - DNA, 20 bp, Artificial Sequence
  chemically synthesized
ctatgtattacaagcaaata

SEQ ID NO: 313484 - DNA, 20 bp, Artificial Sequence
  chemically synthesized
aaagatcaataaacatttgt

SEQ ID NO: 313485 - DNA, 20 bp, Artificial Sequence
  chemically synthesized
ataaacatttgtcagataaa

SEQ ID NO: 313486 - DNA, 20 bp, Artificial Sequence
  chemically synthesized
gtcagataaatggtaccatg

SEQ ID NO: 313487 - DNA, 20 bp, Artificial Sequence
  chemically synthesized
tcagataaatggtaccatgt

SEQ ID NO: 313488 - DNA, 20 bp, Artificial Sequence
  chemically synthesized
cagataaatggtaccatgtg

SEQ ID NO: 313489 - DNA, 20 bp, Artificial Sequence
  chemically synthesized
agataaatggtaccatgtgg

SEQ ID NO: 313490 - DNA, 20 bp, Artificial Sequence
  chemically synthesized
gttttccccaaacccccaca

SEQ ID NO: 313491 - DNA, 20 bp, Artificial Sequence
  chemically synthesized
aatggtaccatgtgggggtt

SEQ ID NO: 313492 - DNA, 20 bp, Artificial Sequence
  chemically synthesized
atggtaccatgtgggggttt

SEQ ID NO: 313493 - DNA, 20 bp, Artificial Sequence
  chemically synthesized
tggtaccatgtgggggtttg

SEQ ID NO: 313494 - DNA, 20 bp, Artificial Sequence
  chemically synthesized
gggtttggggaaaacatgca

SEQ ID NO: 313495 - DNA, 20 bp, Artificial Sequence
  chemically synthesized
tggggaaaacatgcacagat

SEQ ID NO: 313496 - DNA, 20 bp, Artificial Sequence
  chemically synthesized
taatctttgtgcaatcagga

SEQ ID NO: 313497 - DNA, 20 bp, Artificial Sequence
  chemically synthesized
gtaatctttgtgcaatcagg

SEQ ID NO: 313498 - DNA, 20 bp, Artificial Sequence
  chemically synthesized
attgtaatctttgtgcaatc

SEQ ID NO: 313499 - DNA, 20 bp, Artificial Sequence
  chemically synthesized
tattgtaatctttgtgcaat

SEQ ID NO: 313500 - DNA, 20 bp, Artificial Sequence
  chemically synthesized
tgttccttcctgattgcaca

SEQ ID NO: 313501 - DNA, 20 bp, Artificial Sequence
  chemically synthesized
gcacaaagattacaatataa

SEQ ID NO: 313502 - DNA, 20 bp, Artificial Sequence
  chemically synthesized
cacaaagattacaatataat

SEQ ID NO: 313503 - DNA, 20 bp, Artificial Sequence
  chemically synthesized
aaagattacaatataatagg

SEQ ID NO: 313504 - DNA, 20 bp, Artificial Sequence
  chemically synthesized
tacaatataataggaagaat

SEQ ID NO: 313505 - DNA, 20 bp, Artificial Sequence
  chemically synthesized
taggaagaattagtgatttt

SEQ ID NO: 313506 - DNA, 20 bp, Artificial Sequence
  chemically synthesized
cacaattacactaacctcaa

SEQ ID NO: 313507 - DNA, 20 bp, Artificial Sequence
  chemically synthesized
tggttattttctgttgaggt

SEQ ID NO: 313508 - DNA, 20 bp, Artificial Sequence
  chemically synthesized
caagtggttattttctgttg

SEQ ID NO: 313509 - DNA, 20 bp, Artificial Sequence
  chemically synthesized
ccaagtggttattttctgtt

SEQ ID NO: 313510 - DNA, 20 bp, Artificial Sequence
  chemically synthesized
ctcaacagaaaataaccact

SEQ ID NO: 313511 - DNA, 20 bp, Artificial Sequence
  chemically synthesized
agggttcagttgagaccaag

SEQ ID NO: 313512 - DNA, 20 bp, Artificial Sequence
  chemically synthesized
cctagggttcagttgagacc

SEQ ID NO: 313513 - DNA, 20 bp, Artificial Sequence
  chemically synthesized
ttttatcctagggttcagtt

SEQ ID NO: 313514 - DNA, 20 bp, Artificial Sequence
  chemically synthesized
acttggtctcaactgaaccc

SEQ ID NO: 313515 - DNA, 20 bp, Artificial Sequence
  chemically synthesized
cttggtctcaactgaaccct

SEQ ID NO: 313516 - DNA, 20 bp, Artificial Sequence
  chemically synthesized
tctggttttatcctagggtt

SEQ ID NO: 313517 - DNA, 20 bp, Artificial Sequence
  chemically synthesized
attattctggttttatccta

SEQ ID NO: 313518 - DNA, 20 bp, Artificial Sequence
  chemically synthesized
aattattctggttttatcct

SEQ ID NO: 313519 - DNA, 20 bp, Artificial Sequence
  chemically synthesized
gaattattctggttttatcc

SEQ ID NO: 313520 - DNA, 20 bp, Artificial Sequence
  chemically synthesized
actgaaccctaggataaaac

SEQ ID NO: 313521 - DNA, 20 bp, Artificial Sequence
  chemically synthesized
aggcagtatttgaattattc

SEQ ID NO: 313522 - DNA, 20 bp, Artificial Sequence
  chemically synthesized
acatttgtaagttagaaagg

SEQ ID NO: 313523 - DNA, 20 bp, Artificial Sequence
  chemically synthesized
gccacatttgtaagttagaa

SEQ ID NO: 313524 - DNA, 20 bp, Artificial Sequence
  chemically synthesized
agccacatttgtaagttaga

SEQ ID NO: 313525 - DNA, 20 bp, Artificial Sequence
  chemically synthesized
tcagagccacatttgtaagt

SEQ ID NO: 313526 - DNA, 20 bp, Artificial Sequence
  chemically synthesized
gcctttctaacttacaaatg

SEQ ID NO: 313527 - DNA, 20 bp, Artificial Sequence
  chemically synthesized
tttttcagagccacatttgt

SEQ ID NO: 313528 - DNA, 20 bp, Artificial Sequence
  chemically synthesized
agggggaaatgattttttca

SEQ ID NO: 313529 - DNA, 20 bp, Artificial Sequence
  chemically synthesized
atagggggaaatgatttttt

SEQ ID NO: 313530 - DNA, 20 bp, Artificial Sequence
  chemically synthesized
aaaaatcatttccccctatt

SEQ ID NO: 313531 - DNA, 20 bp, Artificial Sequence
  chemically synthesized
tgacagcctcacttaatagg

SEQ ID NO: 313532 - DNA, 20 bp, Artificial Sequence
  chemically synthesized
gtgacagcctcacttaatag

SEQ ID NO: 313533 - DNA, 20 bp, Artificial Sequence
  chemically synthesized
tgtgacagcctcacttaata

SEQ ID NO: 313534 - DNA, 20 bp, Artificial Sequence
  chemically synthesized
atcatttccccctattaagt

SEQ ID NO: 313535 - DNA, 20 bp, Artificial Sequence
  chemically synthesized
ttgtgacagcctcacttaat

SEQ ID NO: 313536 - DNA, 20 bp, Artificial Sequence
  chemically synthesized
tcatttccccctattaagtg

SEQ ID NO: 313537 - DNA, 20 bp, Artificial Sequence
  chemically synthesized
tttgtgacagcctcacttaa

SEQ ID NO: 313538 - DNA, 20 bp, Artificial Sequence
  chemically synthesized
ttggaaatactgttttgtga

SEQ ID NO: 313539 - DNA, 20 bp, Artificial Sequence
  chemically synthesized
taagtgaggctgtcacaaaa

SEQ ID NO: 313540 - DNA, 20 bp, Artificial Sequence
  chemically synthesized
catcatgtttttaaaaagat

SEQ ID NO: 313541 - DNA, 20 bp, Artificial Sequence
  chemically synthesized
ttgtacatcatgtttttaaa

SEQ ID NO: 313542 - DNA, 20 bp, Artificial Sequence
  chemically synthesized
aattattttgtaatgatgaa

SEQ ID NO: 313543 - DNA, 20 bp, Artificial Sequence
  chemically synthesized
attattttgtaatgatgaac

SEQ ID NO: 313544 - DNA, 20 bp, Artificial Sequence
  chemically synthesized
ttattttgtaatgatgaaca

SEQ ID NO: 313545 - DNA, 20 bp, Artificial Sequence
  chemically synthesized
tattttgtaatgatgaacag

SEQ ID NO: 313546 - DNA, 20 bp, Artificial Sequence
  chemically synthesized
atgatgaacaggggtaaaca

SEQ ID NO: 313547 - DNA, 20 bp, Artificial Sequence
  chemically synthesized
tgatgaacaggggtaaacac

SEQ ID NO: 313548 - DNA, 20 bp, Artificial Sequence
  chemically synthesized
gggtaaacacaggaataaat

SEQ ID NO: 313549 - DNA, 20 bp, Artificial Sequence
  chemically synthesized
ggtaaacacaggaataaatt

SEQ ID NO: 313550 - DNA, 20 bp, Artificial Sequence
  chemically synthesized
gtaaacacaggaataaatta

SEQ ID NO: 313551 - DNA, 20 bp, Artificial Sequence
  chemically synthesized
taaacacaggaataaattag

SEQ ID NO: 313552 - DNA, 20 bp, Artificial Sequence
  chemically synthesized
gaataaattaggggtaaaca

SEQ ID NO: 313553 - DNA, 20 bp, Artificial Sequence
  chemically synthesized
aataaattaggggtaaacaa

SEQ ID NO: 313554 - DNA, 20 bp, Artificial Sequence
  chemically synthesized
taaattaggggtaaacaaag

SEQ ID NO: 313555 - DNA, 20 bp, Artificial Sequence
  chemically synthesized
aaattaggggtaaacaaagg

SEQ ID NO: 313556 - DNA, 20 bp, Artificial Sequence
  chemically synthesized
gtaaacaaaggaggctgctc

SEQ ID NO: 313557 - DNA, 20 bp, Artificial Sequence
  chemically synthesized
aacataccttggttctagag

SEQ ID NO: 313558 - DNA, 20 bp, Artificial Sequence
  chemically synthesized
aaggaggctgctctagaacc

SEQ ID NO: 313559 - DNA, 20 bp, Artificial Sequence
  chemically synthesized
ggcaacataccttggttcta

SEQ ID NO: 313560 - DNA, 20 bp, Artificial Sequence
  chemically synthesized
aggaggctgctctagaacca

SEQ ID NO: 313561 - DNA, 20 bp, Artificial Sequence
  chemically synthesized
caggcaacataccttggttc

SEQ ID NO: 313562 - DNA, 20 bp, Artificial Sequence
  chemically synthesized
agcacccaggcaacatacct

SEQ ID NO: 313563 - DNA, 20 bp, Artificial Sequence
  chemically synthesized
tagaaccaaggtatgttgcc

SEQ ID NO: 313564 - DNA, 20 bp, Artificial Sequence
  chemically synthesized
agaaccaaggtatgttgcct

SEQ ID NO: 313565 - DNA, 20 bp, Artificial Sequence
  chemically synthesized
ttatgggatctggagcaccc

SEQ ID NO: 313566 - DNA, 20 bp, Artificial Sequence
  chemically synthesized
ggtatgttgcctgggtgctc

SEQ ID NO: 313567 - DNA, 20 bp, Artificial Sequence
  chemically synthesized
cttatgggatctggagcacc

SEQ ID NO: 313568 - DNA, 20 bp, Artificial Sequence
  chemically synthesized
gtaaggtcttatgggatctg

SEQ ID NO: 313569 - DNA, 20 bp, Artificial Sequence
  chemically synthesized
gggtaaggtcttatgggatc

SEQ ID NO: 313570 - DNA, 20 bp, Artificial Sequence
  chemically synthesized
ctgggtgctccagatcccat

SEQ ID NO: 313571 - DNA, 20 bp, Artificial Sequence
  chemically synthesized
gtaacagggtaaggtcttat

SEQ ID NO: 313572 - DNA, 20 bp, Artificial Sequence
  chemically synthesized
tgtaacagggtaaggtctta

SEQ ID NO: 313573 - DNA, 20 bp, Artificial Sequence
  chemically synthesized
ataaatagtgtaacagggta

SEQ ID NO: 313574 - DNA, 20 bp, Artificial Sequence
  chemically synthesized
aataaatagtgtaacagggt

SEQ ID NO: 313575 - DNA, 20 bp, Artificial Sequence
  chemically synthesized
caataataaatagtgtaaca

SEQ ID NO: 313576 - DNA, 20 bp, Artificial Sequence
  chemically synthesized
ccaataataaatagtgtaac

SEQ ID NO: 313577 - DNA, 20 bp, Artificial Sequence
  chemically synthesized
cccaataataaatagtgtaa

SEQ ID NO: 313578 - DNA, 20 bp, Artificial Sequence
  chemically synthesized
agagaaatcccaataataaa

SEQ ID NO: 313579 - DNA, 20 bp, Artificial Sequence
  chemically synthesized
cctgttacactatttattat

SEQ ID NO: 313580 - DNA, 20 bp, Artificial Sequence
  chemically synthesized
ctgttacactatttattatt

SEQ ID NO: 313581 - DNA, 20 bp, Artificial Sequence
  chemically synthesized
attattgggatttctctgaa

SEQ ID NO: 313582 - DNA, 20 bp, Artificial Sequence
  chemically synthesized
aagtctcaaatagctattca

SEQ ID NO: 313583 - DNA, 20 bp, Artificial Sequence
  chemically synthesized
agaagtctcaaatagctatt

SEQ ID NO: 313584 - DNA, 20 bp, Artificial Sequence
  chemically synthesized
atttctctgaatagctattt

SEQ ID NO: 313585 - DNA, 20 bp, Artificial Sequence
  chemically synthesized
agttgcctagaagtctcaaa

SEQ ID NO: 313586 - DNA, 20 bp, Artificial Sequence
  chemically synthesized
gaatagctatttgagacttc

SEQ ID NO: 313587 - DNA, 20 bp, Artificial Sequence
  chemically synthesized
aatagctatttgagacttct

SEQ ID NO: 313588 - DNA, 20 bp, Artificial Sequence
  chemically synthesized
gaaacaaagtagttgcctag

SEQ ID NO: 313589 - DNA, 20 bp, Artificial Sequence
  chemically synthesized
taagaaacaaagtagttgcc

SEQ ID NO: 313590 - DNA, 20 bp, Artificial Sequence
  chemically synthesized
aaatgttctaagaaacaaag

SEQ ID NO: 313591 - DNA, 20 bp, Artificial Sequence
  chemically synthesized
taggcaactactttgtttct

SEQ ID NO: 313592 - DNA, 20 bp, Artificial Sequence
  chemically synthesized
acaaaatgttctaagaaaca

SEQ ID NO: 313593 - DNA, 20 bp, Artificial Sequence
  chemically synthesized
gttatgtaacaaaatgttct

SEQ ID NO: 313594 - DNA, 20 bp, Artificial Sequence
  chemically synthesized
aacattttgttacataacac

SEQ ID NO: 313595 - DNA, 20 bp, Artificial Sequence
  chemically synthesized
cattttgttacataacacaa

SEQ ID NO: 313596 - DNA, 20 bp, Artificial Sequence
  chemically synthesized
tttgttacataacacaagag

SEQ ID NO: 313597 - DNA, 20 bp, Artificial Sequence
  chemically synthesized
tgttacataacacaagagtg

SEQ ID NO: 313598 - DNA, 20 bp, Artificial Sequence
  chemically synthesized
taacacaagagtggagaaac

SEQ ID NO: 313599 - DNA, 20 bp, Artificial Sequence
  chemically synthesized
caagagtggagaaacaagtt

SEQ ID NO: 313600 - DNA, 20 bp, Artificial Sequence
  chemically synthesized
aagagtggagaaacaagttt

SEQ ID NO: 313601 - DNA, 20 bp, Artificial Sequence
  chemically synthesized
cacgtttgccagaaagtaac

SEQ ID NO: 313602 - DNA, 20 bp, Artificial Sequence
  chemically synthesized
gcacgtttgccagaaagtaa

SEQ ID NO: 313603 - DNA, 20 bp, Artificial Sequence
  chemically synthesized
ggacatttcccgttactttc

SEQ ID NO: 313604 - DNA, 20 bp, Artificial Sequence
  chemically synthesized
gggacagcacgtttgccaga

SEQ ID NO: 313605 - DNA, 20 bp, Artificial Sequence
  chemically synthesized
agtagggacagcacgtttgc

SEQ ID NO: 313606 - DNA, 20 bp, Artificial Sequence
  chemically synthesized
tgttgttttgcaagtaggga

SEQ ID NO: 313607 - DNA, 20 bp, Artificial Sequence
  chemically synthesized
gcactgttgttttgcaagta

SEQ ID NO: 313608 - DNA, 20 bp, Artificial Sequence
  chemically synthesized
agcactgttgttttgcaagt

SEQ ID NO: 313609 - DNA, 20 bp, Artificial Sequence
  chemically synthesized
aagcactgttgttttgcaag

SEQ ID NO: 313610 - DNA, 20 bp, Artificial Sequence
  chemically synthesized
gctaagcactgttgttttgc

SEQ ID NO: 313611 - DNA, 20 bp, Artificial Sequence
  chemically synthesized
tgtccctacttgcaaaacaa

SEQ ID NO: 313612 - DNA, 20 bp, Artificial Sequence
  chemically synthesized
acttgcaaaacaacagtgct

SEQ ID NO: 313613 - DNA, 20 bp, Artificial Sequence
  chemically synthesized
gagctagactgataggtgct

SEQ ID NO: 313614 - DNA, 20 bp, Artificial Sequence
  chemically synthesized
caacagtgcttagcacctat

SEQ ID NO: 313615 - DNA, 20 bp, Artificial Sequence
  chemically synthesized
gtgcttagcacctatcagtc

SEQ ID NO: 313616 - DNA, 20 bp, Artificial Sequence
  chemically synthesized
tacctaagagctagactgat

SEQ ID NO: 313617 - DNA, 20 bp, Artificial Sequence
  chemically synthesized
atacctaagagctagactga

SEQ ID NO: 313618 - DNA, 20 bp, Artificial Sequence
  chemically synthesized
gcacctatcagtctagctct

SEQ ID NO: 313619 - DNA, 20 bp, Artificial Sequence
  chemically synthesized
cacctatcagtctagctctt

SEQ ID NO: 313620 - DNA, 20 bp, Artificial Sequence
  chemically synthesized
gagtttgaatacctaagagc

SEQ ID NO: 313621 - DNA, 20 bp, Artificial Sequence
  chemically synthesized
catagagtttgaatacctaa

SEQ ID NO: 313622 - DNA, 20 bp, Artificial Sequence
  chemically synthesized
gccatagagtttgaatacct

SEQ ID NO: 313623 - DNA, 20 bp, Artificial Sequence
  chemically synthesized
tcttaggtattcaaactcta

SEQ ID NO: 313624 - DNA, 20 bp, Artificial Sequence
  chemically synthesized
taggtattcaaactctatgg

SEQ ID NO: 313625 - DNA, 20 bp, Artificial Sequence
  chemically synthesized
aggtattcaaactctatggc

SEQ ID NO: 313626 - DNA, 20 bp, Artificial Sequence
  chemically synthesized
gttcccttccacctgccata

SEQ ID NO: 313627 - DNA, 20 bp, Artificial Sequence
  chemically synthesized
tattcaaactctatggcagg

SEQ ID NO: 313628 - DNA, 20 bp, Artificial Sequence
  chemically synthesized
aagttcccttccacctgcca

SEQ ID NO: 313629 - DNA, 20 bp, Artificial Sequence
  chemically synthesized
tcaaactctatggcaggtgg

SEQ ID NO: 313630 - DNA, 20 bp, Artificial Sequence
  chemically synthesized
caaactctatggcaggtgga

SEQ ID NO: 313631 - DNA, 20 bp, Artificial Sequence
  chemically synthesized
aaactctatggcaggtggaa

SEQ ID NO: 313632 - DNA, 20 bp, Artificial Sequence
  chemically synthesized
gcaggtggaagggaacttat

SEQ ID NO: 313633 - DNA, 20 bp, Artificial Sequence
  chemically synthesized
caggtggaagggaacttatt

SEQ ID NO: 313634 - DNA, 20 bp, Artificial Sequence
  chemically synthesized
tggaagggaacttattagga

SEQ ID NO: 313635 - DNA, 20 bp, Artificial Sequence
  chemically synthesized
tgtgattcagccatcctaat

SEQ ID NO: 313636 - DNA, 20 bp, Artificial Sequence
  chemically synthesized
atgcatttgagattgtgatt

SEQ ID NO: 313637 - DNA, 20 bp, Artificial Sequence
  chemically synthesized
ataaaaatgctcatgcattt

SEQ ID NO: 313638 - DNA, 20 bp, Artificial Sequence
  chemically synthesized
aatcacaatctcaaatgcat

SEQ ID NO: 313639 - DNA, 20 bp, Artificial Sequence
  chemically synthesized
atgcatgagcatttttatcc

SEQ ID NO: 313640 - DNA, 20 bp, Artificial Sequence
  chemically synthesized
tgcatgagcatttttatcct

SEQ ID NO: 313641 - DNA, 20 bp, Artificial Sequence
  chemically synthesized
gcttcgaaaataagaagcct

SEQ ID NO: 313642 - DNA, 20 bp, Artificial Sequence
  chemically synthesized
ggcttcgaaaataagaagcc

SEQ ID NO: 313643 - DNA, 20 bp, Artificial Sequence
  chemically synthesized
gttgaggcttcgaaaataag

SEQ ID NO: 313644 - DNA, 20 bp, Artificial Sequence
  chemically synthesized
tcctaggcttcttattttcg

SEQ ID NO: 313645 - DNA, 20 bp, Artificial Sequence
  chemically synthesized
aatgttgaggcttcgaaaat

SEQ ID NO: 313646 - DNA, 20 bp, Artificial Sequence
  chemically synthesized
tatagtgttctaaaatgttg

SEQ ID NO: 313647 - DNA, 20 bp, Artificial Sequence
  chemically synthesized
ttttcgaagcctcaacattt

SEQ ID NO: 313648 - DNA, 20 bp, Artificial Sequence
  chemically synthesized
ttatagtgttctaaaatgtt

SEQ ID NO: 313649 - DNA, 20 bp, Artificial Sequence
  chemically synthesized
agtaaaaagaagtgatttta

SEQ ID NO: 313650 - DNA, 20 bp, Artificial Sequence
  chemically synthesized
tagagagacgaagtaaaaag

SEQ ID NO: 313651 - DNA, 20 bp, Artificial Sequence
  chemically synthesized
atctagagagacgaagtaaa

SEQ ID NO: 313652 - DNA, 20 bp, Artificial Sequence
  chemically synthesized
tatgaaaatctagagagacg

SEQ ID NO: 313653 - DNA, 20 bp, Artificial Sequence
  chemically synthesized
ttctttttacttcgtctctc

SEQ ID NO: 313654 - DNA, 20 bp, Artificial Sequence
  chemically synthesized
atgtagtatgaaaatctaga

SEQ ID NO: 313655 - DNA, 20 bp, Artificial Sequence
  chemically synthesized
aaatgtagtatgaaaatcta

SEQ ID NO: 313656 - DNA, 20 bp, Artificial Sequence
  chemically synthesized
gaaaatgtagtatgaaaatc

SEQ ID NO: 313657 - DNA, 20 bp, Artificial Sequence
  chemically synthesized
gattttcatactacattttc

SEQ ID NO: 313658 - DNA, 20 bp, Artificial Sequence
  chemically synthesized
aattgcttcacttgaaaatg

SEQ ID NO: 313659 - DNA, 20 bp, Artificial Sequence
  chemically synthesized
tcatactacattttcaagtg

SEQ ID NO: 313660 - DNA, 20 bp, Artificial Sequence
  chemically synthesized
cattttcaagtgaagcaatt

SEQ ID NO: 313661 - DNA, 20 bp, Artificial Sequence
  chemically synthesized
gcacacacaaaatagatgca

SEQ ID NO: 313662 - DNA, 20 bp, Artificial Sequence
  chemically synthesized
tatagattgcacacacaaaa

SEQ ID NO: 313663 - DNA, 20 bp, Artificial Sequence
  chemically synthesized
caaaggcatgataggcagta

SEQ ID NO: 313664 - DNA, 20 bp, Artificial Sequence
  chemically synthesized
aatgtcaaaggcatgatagg

SEQ ID NO: 313665 - DNA, 20 bp, Artificial Sequence
  chemically synthesized
tggaatgtcaaaggcatgat

SEQ ID NO: 313666 - DNA, 20 bp, Artificial Sequence
  chemically synthesized
ctggaatgtcaaaggcatga

SEQ ID NO: 313667 - DNA, 20 bp, Artificial Sequence
  chemically synthesized
tataagctctggaatgtcaa

SEQ ID NO: 313668 - DNA, 20 bp, Artificial Sequence
  chemically synthesized
ttataagctctggaatgtca

SEQ ID NO: 313669 - DNA, 20 bp, Artificial Sequence
  chemically synthesized
ctatcatgcctttgacattc

SEQ ID NO: 313670 - DNA, 20 bp, Artificial Sequence
  chemically synthesized
atcatgcctttgacattcca

SEQ ID NO: 313671 - DNA, 20 bp, Artificial Sequence
  chemically synthesized
ttattaaccattataagctc

SEQ ID NO: 313672 - DNA, 20 bp, Artificial Sequence
  chemically synthesized
tgacattccagagcttataa

SEQ ID NO: 313673 - DNA, 20 bp, Artificial Sequence
  chemically synthesized
agagttttattaaccattat

SEQ ID NO: 313674 - DNA, 20 bp, Artificial Sequence
  chemically synthesized
ttttggcctcatggcaaaaa

SEQ ID NO: 313675 - DNA, 20 bp, Artificial Sequence
  chemically synthesized
atttttggcctcatggcaaa

SEQ ID NO: 313676 - DNA, 20 bp, Artificial Sequence
  chemically synthesized
aataaaactctttttgccat

SEQ ID NO: 313677 - DNA, 20 bp, Artificial Sequence
  chemically synthesized
ataaaactctttttgccatg

SEQ ID NO: 313678 - DNA, 20 bp, Artificial Sequence
  chemically synthesized
tgtttccatttttggcctca

SEQ ID NO: 313679 - DNA, 20 bp, Artificial Sequence
  chemically synthesized
ttttgccatgaggccaaaaa

SEQ ID NO: 313680 - DNA, 20 bp, Artificial Sequence
  chemically synthesized
aattttaatgtttccatttt

SEQ ID NO: 313681 - DNA, 20 bp, Artificial Sequence
  chemically synthesized
aaaatggaaacattaaaatt

SEQ ID NO: 313682 - DNA, 20 bp, Artificial Sequence
  chemically synthesized
aatggaaacattaaaattca

SEQ ID NO: 313683 - DNA, 20 bp, Artificial Sequence
  chemically synthesized
aaattcagagttgtccttga

SEQ ID NO: 313684 - DNA, 20 bp, Artificial Sequence
  chemically synthesized
cagactcaacatgactgtca

SEQ ID NO: 313685 - DNA, 20 bp, Artificial Sequence
  chemically synthesized
acagactcaacatgactgtc

SEQ ID NO: 313686 - DNA, 20 bp, Artificial Sequence
  chemically synthesized
ttgtccttgacagtcatgtt

SEQ ID NO: 313687 - DNA, 20 bp, Artificial Sequence
  chemically synthesized
cttatataactcagaaaaca

SEQ ID NO: 313688 - DNA, 20 bp, Artificial Sequence
  chemically synthesized
atgttgagtctgtgttttct

SEQ ID NO: 313689 - DNA, 20 bp, Artificial Sequence
  chemically synthesized
cagtcctgtcttatataact

SEQ ID NO: 313690 - DNA, 20 bp, Artificial Sequence
  chemically synthesized
ctgtgttttctgagttatat

SEQ ID NO: 313691 - DNA, 20 bp, Artificial Sequence
  chemically synthesized
gttttctgagttatataaga

SEQ ID NO: 313692 - DNA, 20 bp, Artificial Sequence
  chemically synthesized
ttttctgagttatataagac

SEQ ID NO: 313693 - DNA, 20 bp, Artificial Sequence
  chemically synthesized
tgagttatataagacaggac

SEQ ID NO: 313694 - DNA, 20 bp, Artificial Sequence
  chemically synthesized
gagttatataagacaggact

SEQ ID NO: 313695 - DNA, 20 bp, Artificial Sequence
  chemically synthesized
tgacaccttcaaaatgttcc

SEQ ID NO: 313696 - DNA, 20 bp, Artificial Sequence
  chemically synthesized
acaggactgggaacattttg

SEQ ID NO: 313697 - DNA, 20 bp, Artificial Sequence
  chemically synthesized
caggactgggaacattttga

SEQ ID NO: 313698 - DNA, 20 bp, Artificial Sequence
  chemically synthesized
tgggaacattttgaaggtgt

SEQ ID NO: 313699 - DNA, 20 bp, Artificial Sequence
  chemically synthesized
aacattttgaaggtgtcagc

SEQ ID NO: 313700 - DNA, 20 bp, Artificial Sequence
  chemically synthesized
acattttgaaggtgtcagcc

SEQ ID NO: 313701 - DNA, 20 bp, Artificial Sequence
  chemically synthesized
attattatttgaaacattcc

SEQ ID NO: 313702 - DNA, 20 bp, Artificial Sequence
  chemically synthesized
taataattaaaatgataatt

SEQ ID NO: 313703 - DNA, 20 bp, Artificial Sequence
  chemically synthesized
taattaaaatgataatttgg

SEQ ID NO: 313704 - DNA, 20 bp, Artificial Sequence
  chemically synthesized
taaaatgataatttggtggc

SEQ ID NO: 313705 - DNA, 20 bp, Artificial Sequence
  chemically synthesized
aaaaccaacttatgatacac

SEQ ID NO: 313706 - DNA, 20 bp, Artificial Sequence
  chemically synthesized
tttggtggccagtgtatcat

SEQ ID NO: 313707 - DNA, 20 bp, Artificial Sequence
  chemically synthesized
gtggccagtgtatcataagt

SEQ ID NO: 313708 - DNA, 20 bp, Artificial Sequence
  chemically synthesized
ataagttggttttctgaatt

SEQ ID NO: 313709 - DNA, 20 bp, Artificial Sequence
  chemically synthesized
agaaaagaattgactaaatt

SEQ ID NO: 313710 - DNA, 20 bp, Artificial Sequence
  chemically synthesized
atactcattgaaggacagaa

SEQ ID NO: 313711 - DNA, 20 bp, Artificial Sequence
  chemically synthesized
tatatatactcattgaagga

SEQ ID NO: 313712 - DNA, 20 bp, Artificial Sequence
  chemically synthesized
attcttttctgtccttcaat

SEQ ID NO: 313713 - DNA, 20 bp, Artificial Sequence
  chemically synthesized
taattatatatactcattga

SEQ ID NO: 313714 - DNA, 20 bp, Artificial Sequence
  chemically synthesized
gtaattatatatactcattg

SEQ ID NO: 313715 - DNA, 20 bp, Artificial Sequence
  chemically synthesized
tacatatattacaaaattac

SEQ ID NO: 313716 - DNA, 20 bp, Artificial Sequence
  chemically synthesized
aaattacaagtaaataatgc

SEQ ID NO: 313717 - DNA, 20 bp, Artificial Sequence
  chemically synthesized
ttacatgtaaaaatgaaaac

SEQ ID NO: 313718 - DNA, 20 bp, Artificial Sequence
  chemically synthesized
aatatattaaaattgtgaaa

SEQ ID NO: 313719 - DNA, 20 bp, Artificial Sequence
  chemically synthesized
aattttaatatattttactt

SEQ ID NO: 313720 - DNA, 20 bp, Artificial Sequence
  chemically synthesized
tttaatatattttacttaag

SEQ ID NO: 313721 - DNA, 20 bp, Artificial Sequence
  chemically synthesized
atgtttttcttacacttctt

SEQ ID NO: 313722 - DNA, 20 bp, Artificial Sequence
  chemically synthesized
atattttacttaagaagtgt

SEQ ID NO: 313723 - DNA, 20 bp, Artificial Sequence
  chemically synthesized
aagaagtgtaagaaaaacat

SEQ ID NO: 313724 - DNA, 20 bp, Artificial Sequence
  chemically synthesized
taagaaaaacattggatcca

SEQ ID NO: 313725 - DNA, 20 bp, Artificial Sequence
  chemically synthesized
taagagttggattcattcca

SEQ ID NO: 313726 - DNA, 20 bp, Artificial Sequence
  chemically synthesized
ttaaaagactcaataagagt

SEQ ID NO: 313727 - DNA, 20 bp, Artificial Sequence
  chemically synthesized
gaatgaatccaactcttatt

SEQ ID NO: 313728 - DNA, 20 bp, Artificial Sequence
  chemically synthesized
gactttaaaagactcaataa

SEQ ID NO: 313729 - DNA, 20 bp, Artificial Sequence
  chemically synthesized
tagactttaaaagactcaat

SEQ ID NO: 313730 - DNA, 20 bp, Artificial Sequence
  chemically synthesized
aactcttattgagtctttta

SEQ ID NO: 313731 - DNA, 20 bp, Artificial Sequence
  chemically synthesized
tttgatcacatagactttaa

SEQ ID NO: 313732 - DNA, 20 bp, Artificial Sequence
  chemically synthesized
atatagtacgtttgatcaca

SEQ ID NO: 313733 - DNA, 20 bp, Artificial Sequence
  chemically synthesized
caactaagtaatggagaata

SEQ ID NO: 313734 - DNA, 20 bp, Artificial Sequence
  chemically synthesized
gtactatattctccattact

SEQ ID NO: 313735 - DNA, 20 bp, Artificial Sequence
  chemically synthesized
atcagaacaactaagtaatg

SEQ ID NO: 313736 - DNA, 20 bp, Artificial Sequence
  chemically synthesized
aaatcagaacaactaagtaa

SEQ ID NO: 313737 - DNA, 20 bp, Artificial Sequence
  chemically synthesized
gaaacaaaatcagaacaact

SEQ ID NO: 313738 - DNA, 20 bp, Artificial Sequence
  chemically synthesized
atagatgaacgaaacaaaat

SEQ ID NO: 313739 - DNA, 20 bp, Artificial Sequence
  chemically synthesized
atttccaattataaaacaaa

SEQ ID NO: 313740 - DNA, 20 bp, Artificial Sequence
  chemically synthesized
tcatctatttgttttataat

SEQ ID NO: 313741 - DNA, 20 bp, Artificial Sequence
  chemically synthesized
atttgttttataattggaaa

SEQ ID NO: 313742 - DNA, 20 bp, Artificial Sequence
  chemically synthesized
aaacccttgatcaatatggc

SEQ ID NO: 313743 - DNA, 20 bp, Artificial Sequence
  chemically synthesized
atataaacccttgatcaata

SEQ ID NO: 313744 - DNA, 20 bp, Artificial Sequence
  chemically synthesized
gcattcttgccatattgatc

SEQ ID NO: 313745 - DNA, 20 bp, Artificial Sequence
  chemically synthesized
cattcttgccatattgatca

SEQ ID NO: 313746 - DNA, 20 bp, Artificial Sequence
  chemically synthesized
attcttgccatattgatcaa

SEQ ID NO: 313747 - DNA, 20 bp, Artificial Sequence
  chemically synthesized
aagggtttatattttatgct

SEQ ID NO: 313748 - DNA, 20 bp, Artificial Sequence
  chemically synthesized
ggtttatattttatgcttgg

SEQ ID NO: 313749 - DNA, 20 bp, Artificial Sequence
  chemically synthesized
ttatattttatgcttggcag

SEQ ID NO: 313750 - DNA, 20 bp, Artificial Sequence
  chemically synthesized
tttacgttagcacttctgcc

SEQ ID NO: 313751 - DNA, 20 bp, Artificial Sequence
  chemically synthesized
ttggcagaagtgctaacgta

SEQ ID NO: 313752 - DNA, 20 bp, Artificial Sequence
  chemically synthesized
tctttagtggtactttacgt

SEQ ID NO: 313753 - DNA, 20 bp, Artificial Sequence
  chemically synthesized
gctaacgtaaagtaccacta

SEQ ID NO: 313754 - DNA, 20 bp, Artificial Sequence
  chemically synthesized
taacgtaaagtaccactaaa

SEQ ID NO: 313755 - DNA, 20 bp, Artificial Sequence
  chemically synthesized
acgtaaagtaccactaaaga

SEQ ID NO: 313756 - DNA, 20 bp, Artificial Sequence
  chemically synthesized
catctcacaactctctttag

SEQ ID NO: 313757 - DNA, 20 bp, Artificial Sequence
  chemically synthesized
tatcatctcacaactctctt

SEQ ID NO: 313758 - DNA, 20 bp, Artificial Sequence
  chemically synthesized
gtaccactaaagagagttgt

SEQ ID NO: 313759 - DNA, 20 bp, Artificial Sequence
  chemically synthesized
taaagagagttgtgagatga

SEQ ID NO: 313760 - DNA, 20 bp, Artificial Sequence
  chemically synthesized
atagcattaaaatctaacac

SEQ ID NO: 313761 - DNA, 20 bp, Artificial Sequence
  chemically synthesized
agtccagagggttcttgtgt

SEQ ID NO: 313762 - DNA, 20 bp, Artificial Sequence
  chemically synthesized
aatctaacacaagaaccctc

SEQ ID NO: 313763 - DNA, 20 bp, Artificial Sequence
  chemically synthesized
gtactcaccgtaagtccaga

SEQ ID NO: 313764 - DNA, 20 bp, Artificial Sequence
  chemically synthesized
tgtactcaccgtaagtccag

SEQ ID NO: 313765 - DNA, 20 bp, Artificial Sequence
  chemically synthesized
ttgtactcaccgtaagtcca

SEQ ID NO: 313766 - DNA, 20 bp, Artificial Sequence
  chemically synthesized
acaagaaccctctggactta

SEQ ID NO: 313767 - DNA, 20 bp, Artificial Sequence
  chemically synthesized
ccttgtactcaccgtaagtc

SEQ ID NO: 313768 - DNA, 20 bp, Artificial Sequence
  chemically synthesized
gaaccctctggacttacggt

SEQ ID NO: 313769 - DNA, 20 bp, Artificial Sequence
  chemically synthesized
tatttccttgtactcaccgt

SEQ ID NO: 313770 - DNA, 20 bp, Artificial Sequence
  chemically synthesized
tctggacttacggtgagtac

SEQ ID NO: 313771 - DNA, 20 bp, Artificial Sequence
  chemically synthesized
ctggacttacggtgagtaca

SEQ ID NO: 313772 - DNA, 20 bp, Artificial Sequence
  chemically synthesized
acggtgagtacaaggaaata

SEQ ID NO: 313773 - DNA, 20 bp, Artificial Sequence
  chemically synthesized
cggtgagtacaaggaaataa

SEQ ID NO: 313774 - DNA, 20 bp, Artificial Sequence
  chemically synthesized
gtgagtacaaggaaataaag

SEQ ID NO: 313775 - DNA, 20 bp, Artificial Sequence
  chemically synthesized
agtacaaggaaataaaggag

SEQ ID NO: 313776 - DNA, 20 bp, Artificial Sequence
  chemically synthesized
gtacaaggaaataaaggagt

SEQ ID NO: 313777 - DNA, 20 bp, Artificial Sequence
  chemically synthesized
tacaaggaaataaaggagtg

SEQ ID NO: 313778 - DNA, 20 bp, Artificial Sequence
  chemically synthesized
aggaaataaaggagtgggga

SEQ ID NO: 313779 - DNA, 20 bp, Artificial Sequence
  chemically synthesized
ggaaataaaggagtggggaa

SEQ ID NO: 313780 - DNA, 20 bp, Artificial Sequence
  chemically synthesized
gagtggggaaaggctctcta

SEQ ID NO: 313781 - DNA, 20 bp, Artificial Sequence
  chemically synthesized
acgttcttagtcactgtaga

SEQ ID NO: 313782 - DNA, 20 bp, Artificial Sequence
  chemically synthesized
caacgttcttagtcactgta

SEQ ID NO: 313783 - DNA, 20 bp, Artificial Sequence
  chemically synthesized
ttcaacgttcttagtcactg

SEQ ID NO: 313784 - DNA, 20 bp, Artificial Sequence
  chemically synthesized
aaaggctctctacagtgact

SEQ ID NO: 313785 - DNA, 20 bp, Artificial Sequence
  chemically synthesized
tctggactcttcaacgttct

SEQ ID NO: 313786 - DNA, 20 bp, Artificial Sequence
  chemically synthesized
tacagtgactaagaacgttg

SEQ ID NO: 313787 - DNA, 20 bp, Artificial Sequence
  chemically synthesized
cagtgactaagaacgttgaa

SEQ ID NO: 313788 - DNA, 20 bp, Artificial Sequence
  chemically synthesized
actaagaacgttgaagagtc

SEQ ID NO: 313789 - DNA, 20 bp, Artificial Sequence
  chemically synthesized
taagaacgttgaagagtcca

SEQ ID NO: 313790 - DNA, 20 bp, Artificial Sequence
  chemically synthesized
cgttgaagagtccagagtgc

SEQ ID NO: 313791 - DNA, 20 bp, Artificial Sequence
  chemically synthesized
gcaaatctactccagcactc

SEQ ID NO: 313792 - DNA, 20 bp, Artificial Sequence
  chemically synthesized
ttgaagagtccagagtgctg

SEQ ID NO: 313793 - DNA, 20 bp, Artificial Sequence
  chemically synthesized
aagagtccagagtgctggag

SEQ ID NO: 313794 - DNA, 20 bp, Artificial Sequence
  chemically synthesized
taccttatgcaaatctactc

SEQ ID NO: 313795 - DNA, 20 bp, Artificial Sequence
  chemically synthesized
gtgctggagtagatttgcat

SEQ ID NO: 313796 - DNA, 20 bp, Artificial Sequence
  chemically synthesized
tgctggagtagatttgcata

SEQ ID NO: 313797 - DNA, 20 bp, Artificial Sequence
  chemically synthesized
atttgatttaatgttatttc

SEQ ID NO: 313798 - DNA, 20 bp, Artificial Sequence
  chemically synthesized
tcatagaggagaagagatac

SEQ ID NO: 313799 - DNA, 20 bp, Artificial Sequence
  chemically synthesized
taaaaagtcatagaggagaa

SEQ ID NO: 313800 - DNA, 20 bp, Artificial Sequence
  chemically synthesized
tttaaaaagtcatagaggag

SEQ ID NO: 313801 - DNA, 20 bp, Artificial Sequence
  chemically synthesized
aattttaaaaagtcatagag

SEQ ID NO: 313802 - DNA, 20 bp, Artificial Sequence
  chemically synthesized
acaattttaaaaagtcatag

SEQ ID NO: 313803 - DNA, 20 bp, Artificial Sequence
  chemically synthesized
tacaattttaaaaagtcata

SEQ ID NO: 313804 - DNA, 20 bp, Artificial Sequence
  chemically synthesized
aatacaattttaaaaagtca

SEQ ID NO: 313805 - DNA, 20 bp, Artificial Sequence
  chemically synthesized
agaagaaatacaattttaaa

SEQ ID NO: 313806 - DNA, 20 bp, Artificial Sequence
  chemically synthesized
aaattgtatttcttctttct

SEQ ID NO: 313807 - DNA, 20 bp, Artificial Sequence
  chemically synthesized
ttcctaattagctgagaaag

SEQ ID NO: 313808 - DNA, 20 bp, Artificial Sequence
  chemically synthesized
taattcctaattagctgaga

SEQ ID NO: 313809 - DNA, 20 bp, Artificial Sequence
  chemically synthesized
tttcttctttctcagctaat

SEQ ID NO: 313810 - DNA, 20 bp, Artificial Sequence
  chemically synthesized
agtttaattcctaattagct

SEQ ID NO: 313811 - DNA, 20 bp, Artificial Sequence
  chemically synthesized
ttcttctttctcagctaatt

SEQ ID NO: 313812 - DNA, 20 bp, Artificial Sequence
  chemically synthesized
tttttagtttaattcctaat

SEQ ID NO: 313813 - DNA, 20 bp, Artificial Sequence
  chemically synthesized
aattaggaattaaactaaaa

SEQ ID NO: 313814 - DNA, 20 bp, Artificial Sequence
  chemically synthesized
attaggaattaaactaaaaa

SEQ ID NO: 313815 - DNA, 20 bp, Artificial Sequence
  chemically synthesized
aaagtcagtttaaccttttt

SEQ ID NO: 313816 - DNA, 20 bp, Artificial Sequence
  chemically synthesized
tttagtgtgctcaaaaaagt

SEQ ID NO: 313817 - DNA, 20 bp, Artificial Sequence
  chemically synthesized
aaggttaaactgactttttt

SEQ ID NO: 313818 - DNA, 20 bp, Artificial Sequence
  chemically synthesized
gctatttagtgtgctcaaaa

SEQ ID NO: 313819 - DNA, 20 bp, Artificial Sequence
  chemically synthesized
acttttttgagcacactaaa

SEQ ID NO: 313820 - DNA, 20 bp, Artificial Sequence
  chemically synthesized
gcttttgtcttacagctatt

SEQ ID NO: 313821 - DNA, 20 bp, Artificial Sequence
  chemically synthesized
tgagcacactaaatagctgt

SEQ ID NO: 313822 - DNA, 20 bp, Artificial Sequence
  chemically synthesized
ttaccatagcttttgtctta

SEQ ID NO: 313823 - DNA, 20 bp, Artificial Sequence
  chemically synthesized
actaaatagctgtaagacaa

SEQ ID NO: 313824 - DNA, 20 bp, Artificial Sequence
  chemically synthesized
tagctgtaagacaaaagcta

SEQ ID NO: 313825 - DNA, 20 bp, Artificial Sequence
  chemically synthesized
acgtgcttactgttttacca

SEQ ID NO: 313826 - DNA, 20 bp, Artificial Sequence
  chemically synthesized
agacaaaagctatggtaaaa

SEQ ID NO: 313827 - DNA, 20 bp, Artificial Sequence
  chemically synthesized
aaaagctatggtaaaacagt

SEQ ID NO: 313828 - DNA, 20 bp, Artificial Sequence
  chemically synthesized
tttgaagtctgagaaaatag

SEQ ID NO: 313829 - DNA, 20 bp, Artificial Sequence
  chemically synthesized
aagcacgtctcctattttct

SEQ ID NO: 313830 - DNA, 20 bp, Artificial Sequence
  chemically synthesized
catttgaagtctgagaaaat

SEQ ID NO: 313831 - DNA, 20 bp, Artificial Sequence
  chemically synthesized
gcatttgaagtctgagaaaa

SEQ ID NO: 313832 - DNA, 20 bp, Artificial Sequence
  chemically synthesized
ttatttcgcatttgaagtct

SEQ ID NO: 313833 - DNA, 20 bp, Artificial Sequence
  chemically synthesized
taatatttatttcgcatttg

SEQ ID NO: 313834 - DNA, 20 bp, Artificial Sequence
  chemically synthesized
ttcaaatgcgaaataaatat

SEQ ID NO: 313835 - DNA, 20 bp, Artificial Sequence
  chemically synthesized
attagtgaatataactgtat

SEQ ID NO: 313836 - DNA, 20 bp, Artificial Sequence
  chemically synthesized
attaaggagattagctaata

SEQ ID NO: 313837 - DNA, 20 bp, Artificial Sequence
  chemically synthesized
tttgctgatattaaggagat

SEQ ID NO: 313838 - DNA, 20 bp, Artificial Sequence
  chemically synthesized
tgtattttgctgatattaag

SEQ ID NO: 313839 - DNA, 20 bp, Artificial Sequence
  chemically synthesized
ttagctaatctccttaatat

SEQ ID NO: 313840 - DNA, 20 bp, Artificial Sequence
  chemically synthesized
tctgtattttgctgatatta

SEQ ID NO: 313841 - DNA, 20 bp, Artificial Sequence
  chemically synthesized
atctgtattttgctgatatt

SEQ ID NO: 313842 - DNA, 20 bp, Artificial Sequence
  chemically synthesized
tccttaatatcagcaaaata

SEQ ID NO: 313843 - DNA, 20 bp, Artificial Sequence
  chemically synthesized
agtaaaccctgaacgttgca

SEQ ID NO: 313844 - DNA, 20 bp, Artificial Sequence
  chemically synthesized
attatgaactatgcaacgtt

SEQ ID NO: 313845 - DNA, 20 bp, Artificial Sequence
  chemically synthesized
ttatgaactatgcaacgttc

SEQ ID NO: 313846 - DNA, 20 bp, Artificial Sequence
  chemically synthesized
tatgaactatgcaacgttca

SEQ ID NO: 313847 - DNA, 20 bp, Artificial Sequence
  chemically synthesized
acttgtaagaatcagtgtaa

SEQ ID NO: 313848 - DNA, 20 bp, Artificial Sequence
  chemically synthesized
tttctgctacttgtaagaat

SEQ ID NO: 313849 - DNA, 20 bp, Artificial Sequence
  chemically synthesized
acttttacactgattcttac

SEQ ID NO: 313850 - DNA, 20 bp, Artificial Sequence
  chemically synthesized
tttacactgattcttacaag

SEQ ID NO: 313851 - DNA, 20 bp, Artificial Sequence
  chemically synthesized
ctggcgtttctgctacttgt

SEQ ID NO: 313852 - DNA, 20 bp, Artificial Sequence
  chemically synthesized
acactgattcttacaagtag

SEQ ID NO: 313853 - DNA, 20 bp, Artificial Sequence
  chemically synthesized
cttacaagtagcagaaacgc

SEQ ID NO: 313854 - DNA, 20 bp, Artificial Sequence
  chemically synthesized
taactccagctttttatgtc

SEQ ID NO: 313855 - DNA, 20 bp, Artificial Sequence
  chemically synthesized
gcagaaacgccagacataaa

SEQ ID NO: 313856 - DNA, 20 bp, Artificial Sequence
  chemically synthesized
aaacgccagacataaaaagc

SEQ ID NO: 313857 - DNA, 20 bp, Artificial Sequence
  chemically synthesized
acgccagacataaaaagctg

SEQ ID NO: 313858 - DNA, 20 bp, Artificial Sequence
  chemically synthesized
acaattgaactttttaactc

SEQ ID NO: 313859 - DNA, 20 bp, Artificial Sequence
  chemically synthesized
cataaaaagctggagttaaa

SEQ ID NO: 313860 - DNA, 20 bp, Artificial Sequence
  chemically synthesized
gttcaattgttctgccaaac

SEQ ID NO: 313861 - DNA, 20 bp, Artificial Sequence
  chemically synthesized
ttcaattgttctgccaaact

SEQ ID NO: 313862 - DNA, 20 bp, Artificial Sequence
  chemically synthesized
ttcatggattcctagtttgg

SEQ ID NO: 313863 - DNA, 20 bp, Artificial Sequence
  chemically synthesized
ttattcatggattcctagtt

SEQ ID NO: 313864 - DNA, 20 bp, Artificial Sequence
  chemically synthesized
ggcctttattcatggattcc

SEQ ID NO: 313865 - DNA, 20 bp, Artificial Sequence
  chemically synthesized
aaactaggaatccatgaata

SEQ ID NO: 313866 - DNA, 20 bp, Artificial Sequence
  chemically synthesized
aactaggaatccatgaataa

SEQ ID NO: 313867 - DNA, 20 bp, Artificial Sequence
  chemically synthesized
atgatcaaggcctttattca

SEQ ID NO: 313868 - DNA, 20 bp, Artificial Sequence
  chemically synthesized
tgaataaaggccttgatcat

SEQ ID NO: 313869 - DNA, 20 bp, Artificial Sequence
  chemically synthesized
attctttaccccaatgatca

SEQ ID NO: 313870 - DNA, 20 bp, Artificial Sequence
  chemically synthesized
gaataaaggccttgatcatt

SEQ ID NO: 313871 - DNA, 20 bp, Artificial Sequence
  chemically synthesized
cattctttaccccaatgatc

SEQ ID NO: 313872 - DNA, 20 bp, Artificial Sequence
  chemically synthesized
aataaaggccttgatcattg

SEQ ID NO: 313873 - DNA, 20 bp, Artificial Sequence
  chemically synthesized
aggccttgatcattggggta

SEQ ID NO: 313874 - DNA, 20 bp, Artificial Sequence
  chemically synthesized
ttccaactggagaaacaggc

SEQ ID NO: 313875 - DNA, 20 bp, Artificial Sequence
  chemically synthesized
tttccaactggagaaacagg

SEQ ID NO: 313876 - DNA, 20 bp, Artificial Sequence
  chemically synthesized
agaatgcctgcctgtttctc

SEQ ID NO: 313877 - DNA, 20 bp, Artificial Sequence
  chemically synthesized
ttctttccaactggagaaac

SEQ ID NO: 313878 - DNA, 20 bp, Artificial Sequence
  chemically synthesized
tttctttccaactggagaaa

SEQ ID NO: 313879 - DNA, 20 bp, Artificial Sequence
  chemically synthesized
tgcctgcctgtttctccagt

SEQ ID NO: 313880 - DNA, 20 bp, Artificial Sequence
  chemically synthesized
aattcatttctttccaactg

SEQ ID NO: 313881 - DNA, 20 bp, Artificial Sequence
  chemically synthesized
tgcctgtttctccagttgga

SEQ ID NO: 313882 - DNA, 20 bp, Artificial Sequence
  chemically synthesized
agaattcatttctttccaac

SEQ ID NO: 313883 - DNA, 20 bp, Artificial Sequence
  chemically synthesized
ttggaaagaaatgaattctc

SEQ ID NO: 313884 - DNA, 20 bp, Artificial Sequence
  chemically synthesized
ggaaagaaatgaattctcaa

SEQ ID NO: 313885 - DNA, 20 bp, Artificial Sequence
  chemically synthesized
tattttttttaaatactctt

SEQ ID NO: 313886 - DNA, 20 bp, Artificial Sequence
  chemically synthesized
ttaaaaaaaataatatgcta

SEQ ID NO: 313887 - DNA, 20 bp, Artificial Sequence
  chemically synthesized
aatatagccttacaacactt

SEQ ID NO: 313888 - DNA, 20 bp, Artificial Sequence
  chemically synthesized
ataatatgctaaagtgttgt

SEQ ID NO: 313889 - DNA, 20 bp, Artificial Sequence
  chemically synthesized
taatatgctaaagtgttgta

SEQ ID NO: 313890 - DNA, 20 bp, Artificial Sequence
  chemically synthesized
tttaaaattgtaattaaata

SEQ ID NO: 313891 - DNA, 20 bp, Artificial Sequence
  chemically synthesized
aattgaaatccataagaagt

SEQ ID NO: 313892 - DNA, 20 bp, Artificial Sequence
  chemically synthesized
ttttaaatactgacttctta

SEQ ID NO: 313893 - DNA, 20 bp, Artificial Sequence
  chemically synthesized
gacaaattgaaatccataag

SEQ ID NO: 313894 - DNA, 20 bp, Artificial Sequence
  chemically synthesized
tatgacaaattgaaatccat

SEQ ID NO: 313895 - DNA, 20 bp, Artificial Sequence
  chemically synthesized
ttatggatttcaatttgtca

SEQ ID NO: 313896 - DNA, 20 bp, Artificial Sequence
  chemically synthesized
tcatagatgaatttatacaa

SEQ ID NO: 313897 - DNA, 20 bp, Artificial Sequence
  chemically synthesized
atagatgaatttatacaacg

SEQ ID NO: 313898 - DNA, 20 bp, Artificial Sequence
  chemically synthesized
tatacaacggagatttatat

SEQ ID NO: 313899 - DNA, 20 bp, Artificial Sequence
  chemically synthesized
ttatattggatttgctaatt

SEQ ID NO: 313900 - DNA, 20 bp, Artificial Sequence
  chemically synthesized
gctcatatttcaggcttaat

SEQ ID NO: 313901 - DNA, 20 bp, Artificial Sequence
  chemically synthesized
gctaattaagcctgaaatat

SEQ ID NO: 313902 - DNA, 20 bp, Artificial Sequence
  chemically synthesized
aactatttggctcatatttc

SEQ ID NO: 313903 - DNA, 20 bp, Artificial Sequence
  chemically synthesized
aaactatttggctcatattt

SEQ ID NO: 313904 - DNA, 20 bp, Artificial Sequence
  chemically synthesized
agcctgaaatatgagccaaa

SEQ ID NO: 313905 - DNA, 20 bp, Artificial Sequence
  chemically synthesized
atctatatttggaaactatt

SEQ ID NO: 313906 - DNA, 20 bp, Artificial Sequence
  chemically synthesized
agccaaatagtttccaaata

SEQ ID NO: 313907 - DNA, 20 bp, Artificial Sequence
  chemically synthesized
tctagggatgcatctatatt

SEQ ID NO: 313908 - DNA, 20 bp, Artificial Sequence
  chemically synthesized
tccaaatatagatgcatccc

SEQ ID NO: 313909 - DNA, 20 bp, Artificial Sequence
  chemically synthesized
caaatatagatgcatcccta

SEQ ID NO: 313910 - DNA, 20 bp, Artificial Sequence
  chemically synthesized
atatagatgcatccctagag

SEQ ID NO: 313911 - DNA, 20 bp, Artificial Sequence
  chemically synthesized
catttttgtgtacttctcta

SEQ ID NO: 313912 - DNA, 20 bp, Artificial Sequence
  chemically synthesized
acatttttgtgtacttctct

SEQ ID NO: 313913 - DNA, 20 bp, Artificial Sequence
  chemically synthesized
aacatttttgtgtacttctc

SEQ ID NO: 313914 - DNA, 20 bp, Artificial Sequence
  chemically synthesized
acacaaaaatgtttgtctgt

SEQ ID NO: 313915 - DNA, 20 bp, Artificial Sequence
  chemically synthesized
ttgaaggtattattttctga

SEQ ID NO: 313916 - DNA, 20 bp, Artificial Sequence
  chemically synthesized
attacaatattttaatttga

SEQ ID NO: 313917 - DNA, 20 bp, Artificial Sequence
  chemically synthesized
tattacaatattttaatttg

SEQ ID NO: 313918 - DNA, 20 bp, Artificial Sequence
  chemically synthesized
aaaatgttttcctttattaa

SEQ ID NO: 313919 - DNA, 20 bp, Artificial Sequence
  chemically synthesized
aatctggaagcttttaataa

SEQ ID NO: 313920 - DNA, 20 bp, Artificial Sequence
  chemically synthesized
caatctggaagcttttaata

SEQ ID NO: 313921 - DNA, 20 bp, Artificial Sequence
  chemically synthesized
tttcctttattaaaagcttc

SEQ ID NO: 313922 - DNA, 20 bp, Artificial Sequence
  chemically synthesized
tatgtgtatgtacaatctgg

SEQ ID NO: 313923 - DNA, 20 bp, Artificial Sequence
  chemically synthesized
gtgtatgtgtatgtacaatc

SEQ ID NO: 313924 - DNA, 20 bp, Artificial Sequence
  chemically synthesized
acacatatatacacacatac

SEQ ID NO: 313925 - DNA, 20 bp, Artificial Sequence
  chemically synthesized
cacatatatacacacatact

SEQ ID NO: 313926 - DNA, 20 bp, Artificial Sequence
  chemically synthesized
taaatgcataataaagtacc

SEQ ID NO: 313927 - DNA, 20 bp, Artificial Sequence
  chemically synthesized
atgaaaataaatgcataata

SEQ ID NO: 313928 - DNA, 20 bp, Artificial Sequence
  chemically synthesized
ttattttcattattttatta

SEQ ID NO: 313929 - DNA, 20 bp, Artificial Sequence
  chemically synthesized
tattttcattattttattaa

SEQ ID NO: 313930 - DNA, 20 bp, Artificial Sequence
  chemically synthesized
aaatctggtaagtgttacaa

SEQ ID NO: 313931 - DNA, 20 bp, Artificial Sequence
  chemically synthesized
aatgcttttgtaacacttac

SEQ ID NO: 313932 - DNA, 20 bp, Artificial Sequence
  chemically synthesized
atagatgtttgaaatctggt

SEQ ID NO: 313933 - DNA, 20 bp, Artificial Sequence
  chemically synthesized
catgatagatgtttgaaatc

SEQ ID NO: 313934 - DNA, 20 bp, Artificial Sequence
  chemically synthesized
aaatttaactaggaacatga

SEQ ID NO: 313935 - DNA, 20 bp, Artificial Sequence
  chemically synthesized
tcaaacatctatcatgttcc

SEQ ID NO: 313936 - DNA, 20 bp, Artificial Sequence
  chemically synthesized
aatggtaatgaaatttaact

SEQ ID NO: 313937 - DNA, 20 bp, Artificial Sequence
  chemically synthesized
taatggtaatgaaatttaac

SEQ ID NO: 313938 - DNA, 20 bp, Artificial Sequence
  chemically synthesized
ttaaatttcattaccattat

SEQ ID NO: 313939 - DNA, 20 bp, Artificial Sequence
  chemically synthesized
gtaacatttgtatctaataa

SEQ ID NO: 313940 - DNA, 20 bp, Artificial Sequence
  chemically synthesized
tgacatttgacaacaaacat

SEQ ID NO: 313941 - DNA, 20 bp, Artificial Sequence
  chemically synthesized
tgtatttttttctttatgac

SEQ ID NO: 313942 - DNA, 20 bp, Artificial Sequence
  chemically synthesized
tggccttttctcttgtcata

SEQ ID NO: 313943 - DNA, 20 bp, Artificial Sequence
  chemically synthesized
tatttttttctttatgacaa

SEQ ID NO: 313944 - DNA, 20 bp, Artificial Sequence
  chemically synthesized
ttttctttatgacaagagaa

SEQ ID NO: 313945 - DNA, 20 bp, Artificial Sequence
  chemically synthesized
tttctttatgacaagagaaa

SEQ ID NO: 313946 - DNA, 20 bp, Artificial Sequence
  chemically synthesized
atgacaagagaaaaggccaa

SEQ ID NO: 313947 - DNA, 20 bp, Artificial Sequence
  chemically synthesized
caagagaaaaggccaacagt

SEQ ID NO: 313948 - DNA, 20 bp, Artificial Sequence
  chemically synthesized
ttaatgttacatctcactgt

SEQ ID NO: 313949 - DNA, 20 bp, Artificial Sequence
  chemically synthesized
caacagtgagatgtaacatt

SEQ ID NO: 313950 - DNA, 20 bp, Artificial Sequence
  chemically synthesized
gatgtaacattaagaatgcc

SEQ ID NO: 313951 - DNA, 20 bp, Artificial Sequence
  chemically synthesized
aacattaagaatgcctagat

SEQ ID NO: 313952 - DNA, 20 bp, Artificial Sequence
  chemically synthesized
aaaaactgtttgtccaatct

SEQ ID NO: 313953 - DNA, 20 bp, Artificial Sequence
  chemically synthesized
caaaaactgtttgtccaatc

SEQ ID NO: 313954 - DNA, 20 bp, Artificial Sequence
  chemically synthesized
gaatgcctagattggacaaa

SEQ ID NO: 313955 - DNA, 20 bp, Artificial Sequence
  chemically synthesized
agaaatacaattattcacag

SEQ ID NO: 313956 - DNA, 20 bp, Artificial Sequence
  chemically synthesized
aagaaatacaattattcaca

SEQ ID NO: 313957 - DNA, 20 bp, Artificial Sequence
  chemically synthesized
agaagaaatacaattattca

SEQ ID NO: 313958 - DNA, 20 bp, Artificial Sequence
  chemically synthesized
taattgtatttcttctaaat

SEQ ID NO: 313959 - DNA, 20 bp, Artificial Sequence
  chemically synthesized
ttaactagagacttatttag

SEQ ID NO: 313960 - DNA, 20 bp, Artificial Sequence
  chemically synthesized
cctttaactagagacttatt

SEQ ID NO: 313961 - DNA, 20 bp, Artificial Sequence
  chemically synthesized
atttcttctaaataagtctc

SEQ ID NO: 313962 - DNA, 20 bp, Artificial Sequence
  chemically synthesized
tctaaataagtctctagtta

SEQ ID NO: 313963 - DNA, 20 bp, Artificial Sequence
  chemically synthesized
ctaaataagtctctagttaa

SEQ ID NO: 313964 - DNA, 20 bp, Artificial Sequence
  chemically synthesized
tttgttaagccctttaacta

SEQ ID NO: 313965 - DNA, 20 bp, Artificial Sequence
  chemically synthesized
taaataagtctctagttaaa

SEQ ID NO: 313966 - DNA, 20 bp, Artificial Sequence
  chemically synthesized
attttgttaagccctttaac

SEQ ID NO: 313967 - DNA, 20 bp, Artificial Sequence
  chemically synthesized
agggagtaacaaattttgtt

SEQ ID NO: 313968 - DNA, 20 bp, Artificial Sequence
  chemically synthesized
aacaaaatttgttactccct

SEQ ID NO: 313969 - DNA, 20 bp, Artificial Sequence
  chemically synthesized
attgggaacatgtactaagg

SEQ ID NO: 313970 - DNA, 20 bp, Artificial Sequence
  chemically synthesized
aaattgggaacatgtactaa

SEQ ID NO: 313971 - DNA, 20 bp, Artificial Sequence
  chemically synthesized
aaaattgggaacatgtacta

SEQ ID NO: 313972 - DNA, 20 bp, Artificial Sequence
  chemically synthesized
taaaattgggaacatgtact

SEQ ID NO: 313973 - DNA, 20 bp, Artificial Sequence
  chemically synthesized
caggtttaaataataaaatt

SEQ ID NO: 313974 - DNA, 20 bp, Artificial Sequence
  chemically synthesized
tcaggtttaaataataaaat

SEQ ID NO: 313975 - DNA, 20 bp, Artificial Sequence
  chemically synthesized
aaagaagtacaagaaaagtc

SEQ ID NO: 313976 - DNA, 20 bp, Artificial Sequence
  chemically synthesized
aaaagaagtacaagaaaagt

SEQ ID NO: 313977 - DNA, 20 bp, Artificial Sequence
  chemically synthesized
atttaaaagaagtacaagaa

SEQ ID NO: 313978 - DNA, 20 bp, Artificial Sequence
  chemically synthesized
atggcatttaaaagaagtac

SEQ ID NO: 313979 - DNA, 20 bp, Artificial Sequence
  chemically synthesized
tcactgatggcatttaaaag

SEQ ID NO: 313980 - DNA, 20 bp, Artificial Sequence
  chemically synthesized
gtatcactgatggcatttaa

SEQ ID NO: 313981 - DNA, 20 bp, Artificial Sequence
  chemically synthesized
gtacttcttttaaatgccat

SEQ ID NO: 313982 - DNA, 20 bp, Artificial Sequence
  chemically synthesized
gaagaattcagtatcactga

SEQ ID NO: 313983 - DNA, 20 bp, Artificial Sequence
  chemically synthesized
ggacaagagccagaagaatt

SEQ ID NO: 313984 - DNA, 20 bp, Artificial Sequence
  chemically synthesized
tcagtgatactgaattcttc

SEQ ID NO: 313985 - DNA, 20 bp, Artificial Sequence
  chemically synthesized
ttgacatggacaagagccag

SEQ ID NO: 313986 - DNA, 20 bp, Artificial Sequence
  chemically synthesized
aacttgacatggacaagagc

SEQ ID NO: 313987 - DNA, 20 bp, Artificial Sequence
  chemically synthesized
aaccaacttgacatggacaa

SEQ ID NO: 313988 - DNA, 20 bp, Artificial Sequence
  chemically synthesized
aaaaccaacttgacatggac

SEQ ID NO: 313989 - DNA, 20 bp, Artificial Sequence
  chemically synthesized
ttctggctcttgtccatgtc

SEQ ID NO: 313990 - DNA, 20 bp, Artificial Sequence
  chemically synthesized
ttttgaaaaccaacttgaca

SEQ ID NO: 313991 - DNA, 20 bp, Artificial Sequence
  chemically synthesized
ggctcttgtccatgtcaagt

SEQ ID NO: 313992 - DNA, 20 bp, Artificial Sequence
  chemically synthesized
catgtcaagttggttttcaa

SEQ ID NO: 313993 - DNA, 20 bp, Artificial Sequence
  chemically synthesized
gtcaagttggttttcaaaag

SEQ ID NO: 313994 - DNA, 20 bp, Artificial Sequence
  chemically synthesized
gttggttttcaaaagtggct

SEQ ID NO: 313995 - DNA, 20 bp, Artificial Sequence
  chemically synthesized
ggctctccagtggtttttct

SEQ ID NO: 313996 - DNA, 20 bp, Artificial Sequence
  chemically synthesized
aagtggcttagaaaaaccac

SEQ ID NO: 313997 - DNA, 20 bp, Artificial Sequence
  chemically synthesized
gtggcttagaaaaaccactg

SEQ ID NO: 313998 - DNA, 20 bp, Artificial Sequence
  chemically synthesized
ggcttagaaaaaccactgga

SEQ ID NO: 313999 - DNA, 20 bp, Artificial Sequence
  chemically synthesized
acactgaagtggctctccag

SEQ ID NO: 314000 - DNA, 20 bp, Artificial Sequence
  chemically synthesized
taaacactgaagtggctctc

SEQ ID NO: 314001 - DNA, 20 bp, Artificial Sequence
  chemically synthesized
aaaccactggagagccactt

SEQ ID NO: 314002 - DNA, 20 bp, Artificial Sequence
  chemically synthesized
atctagaataaacactgaag

SEQ ID NO: 314003 - DNA, 20 bp, Artificial Sequence
  chemically synthesized
tagatctagaataaacactg

SEQ ID NO: 314004 - DNA, 20 bp, Artificial Sequence
  chemically synthesized
agccacttcagtgtttattc

SEQ ID NO: 314005 - DNA, 20 bp, Artificial Sequence
  chemically synthesized
agggtaaaatagcatagatc

SEQ ID NO: 314006 - DNA, 20 bp, Artificial Sequence
  chemically synthesized
taagaaagggtaaaatagca

SEQ ID NO: 314007 - DNA, 20 bp, Artificial Sequence
  chemically synthesized
tgttctaagaaagggtaaaa

SEQ ID NO: 314008 - DNA, 20 bp, Artificial Sequence
  chemically synthesized
tatgctattttaccctttct

SEQ ID NO: 314009 - DNA, 20 bp, Artificial Sequence
  chemically synthesized
tttacatgtgttctaagaaa

SEQ ID NO: 314010 - DNA, 20 bp, Artificial Sequence
  chemically synthesized
ttttacatgtgttctaagaa

SEQ ID NO: 314011 - DNA, 20 bp, Artificial Sequence
  chemically synthesized
attttacatgtgttctaaga

SEQ ID NO: 314012 - DNA, 20 bp, Artificial Sequence
  chemically synthesized
tattattttacatgtgttct

SEQ ID NO: 314013 - DNA, 20 bp, Artificial Sequence
  chemically synthesized
aacacatgtaaaataatact

SEQ ID NO: 314014 - DNA, 20 bp, Artificial Sequence
  chemically synthesized
acacatgtaaaataatactt

SEQ ID NO: 314015 - DNA, 20 bp, Artificial Sequence
  chemically synthesized
attccatgtctttatttcct

SEQ ID NO: 314016 - DNA, 20 bp, Artificial Sequence
  chemically synthesized
aaaataatacttaggaaata

SEQ ID NO: 314017 - DNA, 20 bp, Artificial Sequence
  chemically synthesized
atacttaggaaataaagaca

SEQ ID NO: 314018 - DNA, 20 bp, Artificial Sequence
  chemically synthesized
ataaagacatggaattatgt

SEQ ID NO: 314019 - DNA, 20 bp, Artificial Sequence
  chemically synthesized
taaagacatggaattatgta

SEQ ID NO: 314020 - DNA, 20 bp, Artificial Sequence
  chemically synthesized
gacatggaattatgtaaggc

SEQ ID NO: 314021 - DNA, 20 bp, Artificial Sequence
  chemically synthesized
acatggaattatgtaaggct

SEQ ID NO: 314022 - DNA, 20 bp, Artificial Sequence
  chemically synthesized
catggaattatgtaaggcta

SEQ ID NO: 314023 - DNA, 20 bp, Artificial Sequence
  chemically synthesized
catcaaatcaaaaatttccc

SEQ ID NO: 314024 - DNA, 20 bp, Artificial Sequence
  chemically synthesized
aatttttgatttgatgttta

SEQ ID NO: 314025 - DNA, 20 bp, Artificial Sequence
  chemically synthesized
atttttgatttgatgtttaa

SEQ ID NO: 314026 - DNA, 20 bp, Artificial Sequence
  chemically synthesized
tgatttgatgtttaaaggtg

SEQ ID NO: 314027 - DNA, 20 bp, Artificial Sequence
  chemically synthesized
atttgatgtttaaaggtgaa

SEQ ID NO: 314028 - DNA, 20 bp, Artificial Sequence
  chemically synthesized
gaagagcaataattaatcga

SEQ ID NO: 314029 - DNA, 20 bp, Artificial Sequence
  chemically synthesized
aagagcaataattaatcgaa

SEQ ID NO: 314030 - DNA, 20 bp, Artificial Sequence
  chemically synthesized
agcaataattaatcgaaagg

SEQ ID NO: 314031 - DNA, 20 bp, Artificial Sequence
  chemically synthesized
ttaatcgaaaggcagtataa

SEQ ID NO: 314032 - DNA, 20 bp, Artificial Sequence
  chemically synthesized
gtataatagaaaacaaaaac

SEQ ID NO: 314033 - DNA, 20 bp, Artificial Sequence
  chemically synthesized
tataatagaaaacaaaaaca

SEQ ID NO: 314034 - DNA, 20 bp, Artificial Sequence
  chemically synthesized
atagaaaacaaaaacaagga

SEQ ID NO: 314035 - DNA, 20 bp, Artificial Sequence
  chemically synthesized
tagaaaacaaaaacaaggat

SEQ ID NO: 314036 - DNA, 20 bp, Artificial Sequence
  chemically synthesized
gcttctcccatcgaatttac

SEQ ID NO: 314037 - DNA, 20 bp, Artificial Sequence
  chemically synthesized
agcttctcccatcgaattta

SEQ ID NO: 314038 - DNA, 20 bp, Artificial Sequence
  chemically synthesized
tgggtatcctgtaaattcga

SEQ ID NO: 314039 - DNA, 20 bp, Artificial Sequence
  chemically synthesized
gggtatcctgtaaattcgat

SEQ ID NO: 314040 - DNA, 20 bp, Artificial Sequence
  chemically synthesized
gtatcctgtaaattcgatgg

SEQ ID NO: 314041 - DNA, 20 bp, Artificial Sequence
  chemically synthesized
tcctgtaaattcgatgggag

SEQ ID NO: 314042 - DNA, 20 bp, Artificial Sequence
  chemically synthesized
gaaatagacaagtaaaacaa

SEQ ID NO: 314043 - DNA, 20 bp, Artificial Sequence
  chemically synthesized
tatggccaaaagaaatagac

SEQ ID NO: 314044 - DNA, 20 bp, Artificial Sequence
  chemically synthesized
ttttacttgtctatttcttt

SEQ ID NO: 314045 - DNA, 20 bp, Artificial Sequence
  chemically synthesized
tatgctatggccaaaagaaa

SEQ ID NO: 314046 - DNA, 20 bp, Artificial Sequence
  chemically synthesized
ttgtctatttcttttggcca

SEQ ID NO: 314047 - DNA, 20 bp, Artificial Sequence
  chemically synthesized
tgagtctatgctatggccaa

SEQ ID NO: 314048 - DNA, 20 bp, Artificial Sequence
  chemically synthesized
tatttcttttggccatagca

SEQ ID NO: 314049 - DNA, 20 bp, Artificial Sequence
  chemically synthesized
ccatagctgagtctatgcta

SEQ ID NO: 314050 - DNA, 20 bp, Artificial Sequence
  chemically synthesized
ttttggccatagcatagact

SEQ ID NO: 314051 - DNA, 20 bp, Artificial Sequence
  chemically synthesized
ccatagcatagactcagcta

SEQ ID NO: 314052 - DNA, 20 bp, Artificial Sequence
  chemically synthesized
ttcctgttctttccatagct

SEQ ID NO: 314053 - DNA, 20 bp, Artificial Sequence
  chemically synthesized
agcatagactcagctatgga

SEQ ID NO: 314054 - DNA, 20 bp, Artificial Sequence
  chemically synthesized
ttcttttcctgttctttcca

SEQ ID NO: 314055 - DNA, 20 bp, Artificial Sequence
  chemically synthesized
agactcagctatggaaagaa

SEQ ID NO: 314056 - DNA, 20 bp, Artificial Sequence
  chemically synthesized
gactcagctatggaaagaac

SEQ ID NO: 314057 - DNA, 20 bp, Artificial Sequence
  chemically synthesized
agctatggaaagaacaggaa

SEQ ID NO: 314058 - DNA, 20 bp, Artificial Sequence
  chemically synthesized
tggaaagaacaggaaaagaa

SEQ ID NO: 314059 - DNA, 20 bp, Artificial Sequence
  chemically synthesized
aaaactttacatataggtaa

SEQ ID NO: 314060 - DNA, 20 bp, Artificial Sequence
  chemically synthesized
acagctgttacctatatgta

SEQ ID NO: 314061 - DNA, 20 bp, Artificial Sequence
  chemically synthesized
aaaaaaaaaactttacatat

SEQ ID NO: 314062 - DNA, 20 bp, Artificial Sequence
  chemically synthesized
aaaaaaaaaaactttacata

SEQ ID NO: 314063 - DNA, 20 bp, Artificial Sequence
  chemically synthesized
attcaatgaagtcggaggag

SEQ ID NO: 314064 - DNA, 20 bp, Artificial Sequence
  chemically synthesized
ggtattcaatgaagtcggag

SEQ ID NO: 314065 - DNA, 20 bp, Artificial Sequence
  chemically synthesized
tgggtattcaatgaagtcgg

SEQ ID NO: 314066 - DNA, 20 bp, Artificial Sequence
  chemically synthesized
ttgggtattcaatgaagtcg

SEQ ID NO: 314067 - DNA, 20 bp, Artificial Sequence
  chemically synthesized
tgttgggtattcaatgaagt

SEQ ID NO: 314068 - DNA, 20 bp, Artificial Sequence
  chemically synthesized
tagctgttgggtattcaatg

SEQ ID NO: 314069 - DNA, 20 bp, Artificial Sequence
  chemically synthesized
cgacttcattgaatacccaa

SEQ ID NO: 314070 - DNA, 20 bp, Artificial Sequence
  chemically synthesized
agtaccggcaattagctgtt

SEQ ID NO: 314071 - DNA, 20 bp, Artificial Sequence
  chemically synthesized
aagtaccggcaattagctgt

SEQ ID NO: 314072 - DNA, 20 bp, Artificial Sequence
  chemically synthesized
aatacccaacagctaattgc

SEQ ID NO: 314073 - DNA, 20 bp, Artificial Sequence
  chemically synthesized
gacctgcaagtaccggcaat

SEQ ID NO: 314074 - DNA, 20 bp, Artificial Sequence
  chemically synthesized
cagctaattgccggtacttg

SEQ ID NO: 314075 - DNA, 20 bp, Artificial Sequence
  chemically synthesized
tgtgtgtgacctgcaagtac

SEQ ID NO: 314076 - DNA, 20 bp, Artificial Sequence
  chemically synthesized
agctaattgccggtacttgc

SEQ ID NO: 314077 - DNA, 20 bp, Artificial Sequence
  chemically synthesized
tttgtgtgtgtgtgacctgc

SEQ ID NO: 314078 - DNA, 20 bp, Artificial Sequence
  chemically synthesized
acacacacaaaacacacccc

SEQ ID NO: 314079 - DNA, 20 bp, Artificial Sequence
  chemically synthesized
gcgttctgtgttgtttctag

SEQ ID NO: 314080 - DNA, 20 bp, Artificial Sequence
  chemically synthesized
agcgttctgtgttgtttcta

SEQ ID NO: 314081 - DNA, 20 bp, Artificial Sequence
  chemically synthesized
cagcgttctgtgttgtttct

SEQ ID NO: 314082 - DNA, 20 bp, Artificial Sequence
  chemically synthesized
acagcgttctgtgttgtttc

SEQ ID NO: 314083 - DNA, 20 bp, Artificial Sequence
  chemically synthesized
acacacccctagaaacaaca

SEQ ID NO: 314084 - DNA, 20 bp, Artificial Sequence
  chemically synthesized
gccttccaattcatgatgaa

SEQ ID NO: 314085 - DNA, 20 bp, Artificial Sequence
  chemically synthesized
gaacgctgttcatcatgaat

SEQ ID NO: 314086 - DNA, 20 bp, Artificial Sequence
  chemically synthesized
cgctgttcatcatgaattgg

SEQ ID NO: 314087 - DNA, 20 bp, Artificial Sequence
  chemically synthesized
gctgttcatcatgaattgga

SEQ ID NO: 314088 - DNA, 20 bp, Artificial Sequence
  chemically synthesized
aaagtcatttttggagacaa

SEQ ID NO: 314089 - DNA, 20 bp, Artificial Sequence
  chemically synthesized
taattttaaagtcatttttg

SEQ ID NO: 314090 - DNA, 20 bp, Artificial Sequence
  chemically synthesized
attaattttaaagtcatttt

SEQ ID NO: 314091 - DNA, 20 bp, Artificial Sequence
  chemically synthesized
atctaaatatattaatttta

SEQ ID NO: 314092 - DNA, 20 bp, Artificial Sequence
  chemically synthesized
gactttaaaattaatatatt

SEQ ID NO: 314093 - DNA, 20 bp, Artificial Sequence
  chemically synthesized
gatgtttaattacaaatatt

SEQ ID NO: 314094 - DNA, 20 bp, Artificial Sequence
  chemically synthesized
gtttaattacaaatattcag

SEQ ID NO: 314095 - DNA, 20 bp, Artificial Sequence
  chemically synthesized
tacaaatattcagtagtttg

SEQ ID NO: 314096 - DNA, 20 bp, Artificial Sequence
  chemically synthesized
tccttatgtgtgcatttatt

SEQ ID NO: 314097 - DNA, 20 bp, Artificial Sequence
  chemically synthesized
atctcaataaatgcacacat

SEQ ID NO: 314098 - DNA, 20 bp, Artificial Sequence
  chemically synthesized
tctcaataaatgcacacata

SEQ ID NO: 314099 - DNA, 20 bp, Artificial Sequence
  chemically synthesized
aataaatgcacacataagga

SEQ ID NO: 314100 - DNA, 20 bp, Artificial Sequence
  chemically synthesized
acacataaggaaagactaac

SEQ ID NO: 314101 - DNA, 20 bp, Artificial Sequence
  chemically synthesized
tgctacaatttttttctcgt

SEQ ID NO: 314102 - DNA, 20 bp, Artificial Sequence
  chemically synthesized
gactaacgagaaaaaaattg

SEQ ID NO: 314103 - DNA, 20 bp, Artificial Sequence
  chemically synthesized
tagcaaacataaaatttgca

SEQ ID NO: 314104 - DNA, 20 bp, Artificial Sequence
  chemically synthesized
agcaaacataaaatttgcaa

SEQ ID NO: 314105 - DNA, 20 bp, Artificial Sequence
  chemically synthesized
taaaatttgcaaaggacatt

SEQ ID NO: 314106 - DNA, 20 bp, Artificial Sequence
  chemically synthesized
tgcaaaggacattaagaatt

SEQ ID NO: 314107 - DNA, 20 bp, Artificial Sequence
  chemically synthesized
aaaggacattaagaattcag

SEQ ID NO: 314108 - DNA, 20 bp, Artificial Sequence
  chemically synthesized
aaggacattaagaattcaga

SEQ ID NO: 314109 - DNA, 20 bp, Artificial Sequence
  chemically synthesized
attaagaattcagaaggttc

SEQ ID NO: 314110 - DNA, 20 bp, Artificial Sequence
  chemically synthesized
ttaagaattcagaaggttct

SEQ ID NO: 314111 - DNA, 20 bp, Artificial Sequence
  chemically synthesized
aattcagaaggttctaggaa

SEQ ID NO: 314112 - DNA, 20 bp, Artificial Sequence
  chemically synthesized
ttcagaaggttctaggaata

SEQ ID NO: 314113 - DNA, 20 bp, Artificial Sequence
  chemically synthesized
gttagactcaactctattcc

SEQ ID NO: 314114 - DNA, 20 bp, Artificial Sequence
  chemically synthesized
aaggttctaggaatagagtt

SEQ ID NO: 314115 - DNA, 20 bp, Artificial Sequence
  chemically synthesized
atagagttgagtctaacatc

SEQ ID NO: 314116 - DNA, 20 bp, Artificial Sequence
  chemically synthesized
tagagttgagtctaacatcc

SEQ ID NO: 314117 - DNA, 20 bp, Artificial Sequence
  chemically synthesized
gatacttctttcctggatgt

SEQ ID NO: 314118 - DNA, 20 bp, Artificial Sequence
  chemically synthesized
gttgagtctaacatccagga

SEQ ID NO: 314119 - DNA, 20 bp, Artificial Sequence
  chemically synthesized
gagtctaacatccaggaaag

SEQ ID NO: 314120 - DNA, 20 bp, Artificial Sequence
  chemically synthesized
tttttaagatacttctttcc

SEQ ID NO: 314121 - DNA, 20 bp, Artificial Sequence
  chemically synthesized
aggaaagaagtatcttaaaa

SEQ ID NO: 314122 - DNA, 20 bp, Artificial Sequence
  chemically synthesized
gttcatgagacagctttttt

SEQ ID NO: 314123 - DNA, 20 bp, Artificial Sequence
  chemically synthesized
ggatttttttgttcatgaga

SEQ ID NO: 314124 - DNA, 20 bp, Artificial Sequence
  chemically synthesized
ctagggatttttttgttcat

SEQ ID NO: 314125 - DNA, 20 bp, Artificial Sequence
  chemically synthesized
ctcatgaacaaaaaaatccc

SEQ ID NO: 314126 - DNA, 20 bp, Artificial Sequence
  chemically synthesized
aacatgatcattagtatcta

SEQ ID NO: 314127 - DNA, 20 bp, Artificial Sequence
  chemically synthesized
taacatgatcattagtatct

SEQ ID NO: 314128 - DNA, 20 bp, Artificial Sequence
  chemically synthesized
ttaacatgatcattagtatc

SEQ ID NO: 314129 - DNA, 20 bp, Artificial Sequence
  chemically synthesized
tcttgaattaacatgatcat

SEQ ID NO: 314130 - DNA, 20 bp, Artificial Sequence
  chemically synthesized
actaatgatcatgttaattc

SEQ ID NO: 314131 - DNA, 20 bp, Artificial Sequence
  chemically synthesized
tcatgttaattcaagacatc

SEQ ID NO: 314132 - DNA, 20 bp, Artificial Sequence
  chemically synthesized
gttaattcaagacatctgga

SEQ ID NO: 314133 - DNA, 20 bp, Artificial Sequence
  chemically synthesized
ttaattcaagacatctggac

SEQ ID NO: 314134 - DNA, 20 bp, Artificial Sequence
  chemically synthesized
aaaaaaagtcaattcctgtc

SEQ ID NO: 314135 - DNA, 20 bp, Artificial Sequence
  chemically synthesized
tgaagtttttatttgaaaaa

SEQ ID NO: 314136 - DNA, 20 bp, Artificial Sequence
  chemically synthesized
ttttttcaaataaaaacttc

SEQ ID NO: 314137 - DNA, 20 bp, Artificial Sequence
  chemically synthesized
tcaaataaaaacttcaagta

SEQ ID NO: 314138 - DNA, 20 bp, Artificial Sequence
  chemically synthesized
cactttctgatctgtacttg

SEQ ID NO: 314139 - DNA, 20 bp, Artificial Sequence
  chemically synthesized
taaaaacttcaagtacagat

SEQ ID NO: 314140 - DNA, 20 bp, Artificial Sequence
  chemically synthesized
aacttcaagtacagatcaga

SEQ ID NO: 314141 - DNA, 20 bp, Artificial Sequence
  chemically synthesized
aagtacagatcagaaagtgt

SEQ ID NO: 314142 - DNA, 20 bp, Artificial Sequence
  chemically synthesized
agtacagatcagaaagtgtt

SEQ ID NO: 314143 - DNA, 20 bp, Artificial Sequence
  chemically synthesized
cagaaagtgttaggatttct

SEQ ID NO: 314144 - DNA, 20 bp, Artificial Sequence
  chemically synthesized
agaaagtgttaggatttctt

SEQ ID NO: 314145 - DNA, 20 bp, Artificial Sequence
  chemically synthesized
ctaccaccccatcatttccc

SEQ ID NO: 314146 - DNA, 20 bp, Artificial Sequence
  chemically synthesized
taggatttcttgggaaatga

SEQ ID NO: 314147 - DNA, 20 bp, Artificial Sequence
  chemically synthesized
aggatttcttgggaaatgat

SEQ ID NO: 314148 - DNA, 20 bp, Artificial Sequence
  chemically synthesized
ggatttcttgggaaatgatg

SEQ ID NO: 314149 - DNA, 20 bp, Artificial Sequence
  chemically synthesized
tttcttgggaaatgatgggg

SEQ ID NO: 314150 - DNA, 20 bp, Artificial Sequence
  chemically synthesized
cttgggaaatgatggggtgg

SEQ ID NO: 314151 - DNA, 20 bp, Artificial Sequence
  chemically synthesized
ttgggaaatgatggggtggt

SEQ ID NO: 314152 - DNA, 20 bp, Artificial Sequence
  chemically synthesized
gaatggggcatagaggaaaa

SEQ ID NO: 314153 - DNA, 20 bp, Artificial Sequence
  chemically synthesized
aggaatggggcatagaggaa

SEQ ID NO: 314154 - DNA, 20 bp, Artificial Sequence
  chemically synthesized
gtagaaggaatggggcatag

SEQ ID NO: 314155 - DNA, 20 bp, Artificial Sequence
  chemically synthesized
ggtagaaggaatggggcata

SEQ ID NO: 314156 - DNA, 20 bp, Artificial Sequence
  chemically synthesized
gtggtagaaggaatggggca

SEQ ID NO: 314157 - DNA, 20 bp, Artificial Sequence
  chemically synthesized
tagaggtggtagaaggaatg

SEQ ID NO: 314158 - DNA, 20 bp, Artificial Sequence
  chemically synthesized
gtagaggtggtagaaggaat

SEQ ID NO: 314159 - DNA, 20 bp, Artificial Sequence
  chemically synthesized
tgtagaggtggtagaaggaa

SEQ ID NO: 314160 - DNA, 20 bp, Artificial Sequence
  chemically synthesized
cccagtgtagaggtggtaga

SEQ ID NO: 314161 - DNA, 20 bp, Artificial Sequence
  chemically synthesized
gcccagtgtagaggtggtag

SEQ ID NO: 314162 - DNA, 20 bp, Artificial Sequence
  chemically synthesized
ctagcccagtgtagaggtgg

SEQ ID NO: 314163 - DNA, 20 bp, Artificial Sequence
  chemically synthesized
agcctagcccagtgtagagg

SEQ ID NO: 314164 - DNA, 20 bp, Artificial Sequence
  chemically synthesized
tccttctaccacctctacac

SEQ ID NO: 314165 - DNA, 20 bp, Artificial Sequence
  chemically synthesized
ccttctaccacctctacact

SEQ ID NO: 314166 - DNA, 20 bp, Artificial Sequence
  chemically synthesized
tagagcctagcccagtgtag

SEQ ID NO: 314167 - DNA, 20 bp, Artificial Sequence
  chemically synthesized
atagagcctagcccagtgta

SEQ ID NO: 314168 - DNA, 20 bp, Artificial Sequence
  chemically synthesized
atatagagcctagcccagtg

SEQ ID NO: 314169 - DNA, 20 bp, Artificial Sequence
  chemically synthesized
ctaccacctctacactgggc

SEQ ID NO: 314170 - DNA, 20 bp, Artificial Sequence
  chemically synthesized
taccacctctacactgggct

SEQ ID NO: 314171 - DNA, 20 bp, Artificial Sequence
  chemically synthesized
aagggatatagagcctagcc

SEQ ID NO: 314172 - DNA, 20 bp, Artificial Sequence
  chemically synthesized
ccagcaagggatatagagcc

SEQ ID NO: 314173 - DNA, 20 bp, Artificial Sequence
  chemically synthesized
tcaggccagcaagggatata

SEQ ID NO: 314174 - DNA, 20 bp, Artificial Sequence
  chemically synthesized
attcaggccagcaagggata

SEQ ID NO: 314175 - DNA, 20 bp, Artificial Sequence
  chemically synthesized
ctaggctctatatcccttgc

SEQ ID NO: 314176 - DNA, 20 bp, Artificial Sequence
  chemically synthesized
catatcattcaggccagcaa

SEQ ID NO: 314177 - DNA, 20 bp, Artificial Sequence
  chemically synthesized
tcatatcattcaggccagca

SEQ ID NO: 314178 - DNA, 20 bp, Artificial Sequence
  chemically synthesized
atcatatcattcaggccagc

SEQ ID NO: 314179 - DNA, 20 bp, Artificial Sequence
  chemically synthesized
ccagatcatatcattcaggc

SEQ ID NO: 314180 - DNA, 20 bp, Artificial Sequence
  chemically synthesized
ctttccagatcatatcattc

SEQ ID NO: 314181 - DNA, 20 bp, Artificial Sequence
  chemically synthesized
cctttccagatcatatcatt

SEQ ID NO: 314182 - DNA, 20 bp, Artificial Sequence
  chemically synthesized
ctggcctgaatgatatgatc

SEQ ID NO: 314183 - DNA, 20 bp, Artificial Sequence
  chemically synthesized
cctgaatgatatgatctgga

SEQ ID NO: 314184 - DNA, 20 bp, Artificial Sequence
  chemically synthesized
ctgaatgatatgatctggaa

SEQ ID NO: 314185 - DNA, 20 bp, Artificial Sequence
  chemically synthesized
ataaaatcgaaagtcctttc

SEQ ID NO: 314186 - DNA, 20 bp, Artificial Sequence
  chemically synthesized
ttcactgcaaataaaatcga

SEQ ID NO: 314187 - DNA, 20 bp, Artificial Sequence
  chemically synthesized
aggactttcgattttatttg

SEQ ID NO: 314188 - DNA, 20 bp, Artificial Sequence
  chemically synthesized
agtgaaatattcactttgct

SEQ ID NO: 314189 - DNA, 20 bp, Artificial Sequence
  chemically synthesized
gtgaccagccaggcttagca

SEQ ID NO: 314190 - DNA, 20 bp, Artificial Sequence
  chemically synthesized
aatattcactttgctaagcc

SEQ ID NO: 314191 - DNA, 20 bp, Artificial Sequence
  chemically synthesized
atactgtgaccagccaggct

SEQ ID NO: 314192 - DNA, 20 bp, Artificial Sequence
  chemically synthesized
ttcactttgctaagcctggc

SEQ ID NO: 314193 - DNA, 20 bp, Artificial Sequence
  chemically synthesized
agacaatactgtgaccagcc

SEQ ID NO: 314194 - DNA, 20 bp, Artificial Sequence
  chemically synthesized
tagacaatactgtgaccagc

SEQ ID NO: 314195 - DNA, 20 bp, Artificial Sequence
  chemically synthesized
ttgctaagcctggctggtca

SEQ ID NO: 314196 - DNA, 20 bp, Artificial Sequence
  chemically synthesized
aagctagacaatactgtgac

SEQ ID NO: 314197 - DNA, 20 bp, Artificial Sequence
  chemically synthesized
tggctggtcacagtattgtc

SEQ ID NO: 314198 - DNA, 20 bp, Artificial Sequence
  chemically synthesized
aatagatcttcatggaaagc

SEQ ID NO: 314199 - DNA, 20 bp, Artificial Sequence
  chemically synthesized
gtattgtctagctttccatg

SEQ ID NO: 314200 - DNA, 20 bp, Artificial Sequence
  chemically synthesized
cgtaaatagatcttcatgga

SEQ ID NO: 314201 - DNA, 20 bp, Artificial Sequence
  chemically synthesized
ataccgtaaatagatcttca

SEQ ID NO: 314202 - DNA, 20 bp, Artificial Sequence
  chemically synthesized
tttccatgaagatctattta

SEQ ID NO: 314203 - DNA, 20 bp, Artificial Sequence
  chemically synthesized
acaaagttatataccgtaaa

SEQ ID NO: 314204 - DNA, 20 bp, Artificial Sequence
  chemically synthesized
tattcagcaaatttataaca

SEQ ID NO: 314205 - DNA, 20 bp, Artificial Sequence
  chemically synthesized
ggaagattatttaaaatatt

SEQ ID NO: 314206 - DNA, 20 bp, Artificial Sequence
  chemically synthesized
ttttaaataatcttcctcaa

SEQ ID NO: 314207 - DNA, 20 bp, Artificial Sequence
  chemically synthesized
tttaaataatcttcctcaac

SEQ ID NO: 314208 - DNA, 20 bp, Artificial Sequence
  chemically synthesized
tctagggtagcctgttgagg

SEQ ID NO: 314209 - DNA, 20 bp, Artificial Sequence
  chemically synthesized
ttttctagggtagcctgttg

SEQ ID NO: 314210 - DNA, 20 bp, Artificial Sequence
  chemically synthesized
cttttctagggtagcctgtt

SEQ ID NO: 314211 - DNA, 20 bp, Artificial Sequence
  chemically synthesized
tcttcctcaacaggctaccc

SEQ ID NO: 314212 - DNA, 20 bp, Artificial Sequence
  chemically synthesized
tatcaaaagcttttctaggg

SEQ ID NO: 314213 - DNA, 20 bp, Artificial Sequence
  chemically synthesized
ctcaacaggctaccctagaa

SEQ ID NO: 314214 - DNA, 20 bp, Artificial Sequence
  chemically synthesized
gaatatcaaaagcttttcta

SEQ ID NO: 314215 - DNA, 20 bp, Artificial Sequence
  chemically synthesized
tgaatatcaaaagcttttct

SEQ ID NO: 314216 - DNA, 20 bp, Artificial Sequence
  chemically synthesized
gtgaatatcaaaagcttttc

SEQ ID NO: 314217 - DNA, 20 bp, Artificial Sequence
  chemically synthesized
tttaagtaagtgaatatcaa

SEQ ID NO: 314218 - DNA, 20 bp, Artificial Sequence
  chemically synthesized
atattcaatcacatttaagt

SEQ ID NO: 314219 - DNA, 20 bp, Artificial Sequence
  chemically synthesized
aaagatattcaatcacattt

SEQ ID NO: 314220 - DNA, 20 bp, Artificial Sequence
  chemically synthesized
atgtgattgaatatctttat

SEQ ID NO: 314221 - DNA, 20 bp, Artificial Sequence
  chemically synthesized
ttctgatataagaactaata

SEQ ID NO: 314222 - DNA, 20 bp, Artificial Sequence
  chemically synthesized
atctttattagttcttatat

SEQ ID NO: 314223 - DNA, 20 bp, Artificial Sequence
  chemically synthesized
aaatcagtgtgttctgatat

SEQ ID NO: 314224 - DNA, 20 bp, Artificial Sequence
  chemically synthesized
ttctaacaaaaagataaaat

SEQ ID NO: 314225 - DNA, 20 bp, Artificial Sequence
  chemically synthesized
cactgattttatctttttgt

SEQ ID NO: 314226 - DNA, 20 bp, Artificial Sequence
  chemically synthesized
aaacattcatttctaacaaa

SEQ ID NO: 314227 - DNA, 20 bp, Artificial Sequence
  chemically synthesized
tttggtagcttaggagttgg

SEQ ID NO: 314228 - DNA, 20 bp, Artificial Sequence
  chemically synthesized
ttatgtttctgccaactcct

SEQ ID NO: 314229 - DNA, 20 bp, Artificial Sequence
  chemically synthesized
ccatttggtagcttaggagt

SEQ ID NO: 314230 - DNA, 20 bp, Artificial Sequence
  chemically synthesized
acccccatttggtagcttag

SEQ ID NO: 314231 - DNA, 20 bp, Artificial Sequence
  chemically synthesized
gaacccccatttggtagctt

SEQ ID NO: 314232 - DNA, 20 bp, Artificial Sequence
  chemically synthesized
agaacccccatttggtagct

SEQ ID NO: 314233 - DNA, 20 bp, Artificial Sequence
  chemically synthesized
ccaactcctaagctaccaaa

SEQ ID NO: 314234 - DNA, 20 bp, Artificial Sequence
  chemically synthesized
caactcctaagctaccaaat

SEQ ID NO: 314235 - DNA, 20 bp, Artificial Sequence
  chemically synthesized
aactcctaagctaccaaatg

SEQ ID NO: 314236 - DNA, 20 bp, Artificial Sequence
  chemically synthesized
ctttcagaacccccatttgg

SEQ ID NO: 314237 - DNA, 20 bp, Artificial Sequence
  chemically synthesized
actcctaagctaccaaatgg

SEQ ID NO: 314238 - DNA, 20 bp, Artificial Sequence
  chemically synthesized
agtctttcagaacccccatt

SEQ ID NO: 314239 - DNA, 20 bp, Artificial Sequence
  chemically synthesized
ctaccaaatgggggttctga

SEQ ID NO: 314240 - DNA, 20 bp, Artificial Sequence
  chemically synthesized
tctccattgaaacagtcttt

SEQ ID NO: 314241 - DNA, 20 bp, Artificial Sequence
  chemically synthesized
gttctgaaagactgtttcaa

SEQ ID NO: 314242 - DNA, 20 bp, Artificial Sequence
  chemically synthesized
ttcaaatctctccattgaaa

SEQ ID NO: 314243 - DNA, 20 bp, Artificial Sequence
  chemically synthesized
tctgaaagactgtttcaatg

SEQ ID NO: 314244 - DNA, 20 bp, Artificial Sequence
  chemically synthesized
tgaaagactgtttcaatgga

SEQ ID NO: 314245 - DNA, 20 bp, Artificial Sequence
  chemically synthesized
gtttcaatggagagatttga

SEQ ID NO: 314246 - DNA, 20 bp, Artificial Sequence
  chemically synthesized
tttcaatggagagatttgaa

SEQ ID NO: 314247 - DNA, 20 bp, Artificial Sequence
  chemically synthesized
agagatttgaaaggctatac

SEQ ID NO: 314248 - DNA, 20 bp, Artificial Sequence
  chemically synthesized
aagcatttagtgtgcttgta

SEQ ID NO: 314249 - DNA, 20 bp, Artificial Sequence
  chemically synthesized
tcaggctattgagaagcatt

SEQ ID NO: 314250 - DNA, 20 bp, Artificial Sequence
  chemically synthesized
gcacactaaatgcttctcaa

SEQ ID NO: 314251 - DNA, 20 bp, Artificial Sequence
  chemically synthesized
gtccccttcaggctattgag

SEQ ID NO: 314252 - DNA, 20 bp, Artificial Sequence
  chemically synthesized
tgagtccccttcaggctatt

SEQ ID NO: 314253 - DNA, 20 bp, Artificial Sequence
  chemically synthesized
aaatgcttctcaatagcctg

SEQ ID NO: 314254 - DNA, 20 bp, Artificial Sequence
  chemically synthesized
aatgcttctcaatagcctga

SEQ ID NO: 314255 - DNA, 20 bp, Artificial Sequence
  chemically synthesized
atgcttctcaatagcctgaa

SEQ ID NO: 314256 - DNA, 20 bp, Artificial Sequence
  chemically synthesized
tgcttctcaatagcctgaag

SEQ ID NO: 314257 - DNA, 20 bp, Artificial Sequence
  chemically synthesized
gtatttattgagtccccttc

SEQ ID NO: 314258 - DNA, 20 bp, Artificial Sequence
  chemically synthesized
cgtatttattgagtcccctt

SEQ ID NO: 314259 - DNA, 20 bp, Artificial Sequence
  chemically synthesized
agtttcttttcgtatttatt

SEQ ID NO: 314260 - DNA, 20 bp, Artificial Sequence
  chemically synthesized
ggggactcaataaatacgaa

SEQ ID NO: 314261 - DNA, 20 bp, Artificial Sequence
  chemically synthesized
tgtctactttatttttaaaa

SEQ ID NO: 314262 - DNA, 20 bp, Artificial Sequence
  chemically synthesized
aagaaactgttttaaaaata

SEQ ID NO: 314263 - DNA, 20 bp, Artificial Sequence
  chemically synthesized
aaactgttttaaaaataaag

SEQ ID NO: 314264 - DNA, 20 bp, Artificial Sequence
  chemically synthesized
aattaatgtactcctacata

SEQ ID NO: 314265 - DNA, 20 bp, Artificial Sequence
  chemically synthesized
atgtccttttccatatgtag

SEQ ID NO: 314266 - DNA, 20 bp, Artificial Sequence
  chemically synthesized
ctatgtccttttccatatgt

SEQ ID NO: 314267 - DNA, 20 bp, Artificial Sequence
  chemically synthesized
cctatgtccttttccatatg

SEQ ID NO: 314268 - DNA, 20 bp, Artificial Sequence
  chemically synthesized
atgtactcctacatatggaa

SEQ ID NO: 314269 - DNA, 20 bp, Artificial Sequence
  chemically synthesized
tgtactcctacatatggaaa

SEQ ID NO: 314270 - DNA, 20 bp, Artificial Sequence
  chemically synthesized
cctacatatggaaaaggaca

SEQ ID NO: 314271 - DNA, 20 bp, Artificial Sequence
  chemically synthesized
ctacatatggaaaaggacat

SEQ ID NO: 314272 - DNA, 20 bp, Artificial Sequence
  chemically synthesized
gaaaaggacataggatgaaa

SEQ ID NO: 314273 - DNA, 20 bp, Artificial Sequence
  chemically synthesized
tcatagtcatgcacaagttt

SEQ ID NO: 314274 - DNA, 20 bp, Artificial Sequence
  chemically synthesized
gtctcctcatagtcatgcac

SEQ ID NO: 314275 - DNA, 20 bp, Artificial Sequence
  chemically synthesized
caaaacttgtgcatgactat

SEQ ID NO: 314276 - DNA, 20 bp, Artificial Sequence
  chemically synthesized
aaaacttgtgcatgactatg

SEQ ID NO: 314277 - DNA, 20 bp, Artificial Sequence
  chemically synthesized
aacttgtgcatgactatgag

SEQ ID NO: 314278 - DNA, 20 bp, Artificial Sequence
  chemically synthesized
acagttttactgtctcctca

SEQ ID NO: 314279 - DNA, 20 bp, Artificial Sequence
  chemically synthesized
tgtgcatgactatgaggaga

SEQ ID NO: 314280 - DNA, 20 bp, Artificial Sequence
  chemically synthesized
atgaggagacagtaaaactg

SEQ ID NO: 314281 - DNA, 20 bp, Artificial Sequence
  chemically synthesized
gacagtaaaactgtagtcaa

SEQ ID NO: 314282 - DNA, 20 bp, Artificial Sequence
  chemically synthesized
agatgctacacttttgacta

SEQ ID NO: 314283 - DNA, 20 bp, Artificial Sequence
  chemically synthesized
taaaactgtagtcaaaagtg

SEQ ID NO: 314284 - DNA, 20 bp, Artificial Sequence
  chemically synthesized
aaaagtgtagcatctgaaat

SEQ ID NO: 314285 - DNA, 20 bp, Artificial Sequence
  chemically synthesized
acacatagaaaatctgattt

SEQ ID NO: 314286 - DNA, 20 bp, Artificial Sequence
  chemically synthesized
atgcttccaggaattacaca

SEQ ID NO: 314287 - DNA, 20 bp, Artificial Sequence
  chemically synthesized
gattttctatgtgtaattcc

SEQ ID NO: 314288 - DNA, 20 bp, Artificial Sequence
  chemically synthesized
tttctatgtgtaattcctgg

SEQ ID NO: 314289 - DNA, 20 bp, Artificial Sequence
  chemically synthesized
gattggttattgatgcttcc

SEQ ID NO: 314290 - DNA, 20 bp, Artificial Sequence
  chemically synthesized
tgattggttattgatgcttc

SEQ ID NO: 314291 - DNA, 20 bp, Artificial Sequence
  chemically synthesized
ctttctcaaagtcacgtgat

SEQ ID NO: 314292 - DNA, 20 bp, Artificial Sequence
  chemically synthesized
ataaccaatcacgtgacttt

SEQ ID NO: 314293 - DNA, 20 bp, Artificial Sequence
  chemically synthesized
ccaatcacgtgactttgaga

SEQ ID NO: 314294 - DNA, 20 bp, Artificial Sequence
  chemically synthesized
tgtggttgatgactttctca

SEQ ID NO: 314295 - DNA, 20 bp, Artificial Sequence
  chemically synthesized
agaaagtcatcaaccacacc

SEQ ID NO: 314296 - DNA, 20 bp, Artificial Sequence
  chemically synthesized
taggaagctgaggcttggtg

SEQ ID NO: 314297 - DNA, 20 bp, Artificial Sequence
  chemically synthesized
tcatcaaccacaccaagcct

SEQ ID NO: 314298 - DNA, 20 bp, Artificial Sequence
  chemically synthesized
caaattaggaagctgaggct

SEQ ID NO: 314299 - DNA, 20 bp, Artificial Sequence
  chemically synthesized
ttttacaaattaggaagctg

SEQ ID NO: 314300 - DNA, 20 bp, Artificial Sequence
  chemically synthesized
gttttacaaattaggaagct

SEQ ID NO: 314301 - DNA, 20 bp, Artificial Sequence
  chemically synthesized
tcttagttttacaaattagg

SEQ ID NO: 314302 - DNA, 20 bp, Artificial Sequence
  chemically synthesized
ttatcttagttttacaaatt

SEQ ID NO: 314303 - DNA, 20 bp, Artificial Sequence
  chemically synthesized
attatcttagttttacaaat

SEQ ID NO: 314304 - DNA, 20 bp, Artificial Sequence
  chemically synthesized
gcttcctaatttgtaaaact

SEQ ID NO: 314305 - DNA, 20 bp, Artificial Sequence
  chemically synthesized
aataggcagttttattatct

SEQ ID NO: 314306 - DNA, 20 bp, Artificial Sequence
  chemically synthesized
taaccacataaagaaatagg

SEQ ID NO: 314307 - DNA, 20 bp, Artificial Sequence
  chemically synthesized
tcttaaccacataaagaaat

SEQ ID NO: 314308 - DNA, 20 bp, Artificial Sequence
  chemically synthesized
ttcttaaccacataaagaaa

SEQ ID NO: 314309 - DNA, 20 bp, Artificial Sequence
  chemically synthesized
aaactgcctatttctttatg

SEQ ID NO: 314310 - DNA, 20 bp, Artificial Sequence
  chemically synthesized
tcaatcttcttaaccacata

SEQ ID NO: 314311 - DNA, 20 bp, Artificial Sequence
  chemically synthesized
gcctatttctttatgtggtt

SEQ ID NO: 314312 - DNA, 20 bp, Artificial Sequence
  chemically synthesized
tatttctttatgtggttaag

SEQ ID NO: 314313 - DNA, 20 bp, Artificial Sequence
  chemically synthesized
tgtggttaagaagattgaat

SEQ ID NO: 314314 - DNA, 20 bp, Artificial Sequence
  chemically synthesized
gtggttaagaagattgaata

SEQ ID NO: 314315 - DNA, 20 bp, Artificial Sequence
  chemically synthesized
tttccaggcaaaatgcaaaa

SEQ ID NO: 314316 - DNA, 20 bp, Artificial Sequence
  chemically synthesized
aaactgttttgcattttgcc

SEQ ID NO: 314317 - DNA, 20 bp, Artificial Sequence
  chemically synthesized
tggaatttatattgttttcc

SEQ ID NO: 314318 - DNA, 20 bp, Artificial Sequence
  chemically synthesized
ttggaatttatattgttttc

SEQ ID NO: 314319 - DNA, 20 bp, Artificial Sequence
  chemically synthesized
aatataaattccaaaaatat

SEQ ID NO: 314320 - DNA, 20 bp, Artificial Sequence
  chemically synthesized
taattagatgctaatatttt

SEQ ID NO: 314321 - DNA, 20 bp, Artificial Sequence
  chemically synthesized
caaaaatattagcatctaat

SEQ ID NO: 314322 - DNA, 20 bp, Artificial Sequence
  chemically synthesized
tatgaattctttcaactaat

SEQ ID NO: 314323 - DNA, 20 bp, Artificial Sequence
  chemically synthesized
attagcatctaattagttga

SEQ ID NO: 314324 - DNA, 20 bp, Artificial Sequence
  chemically synthesized
tagttgaaagaattcatatt

SEQ ID NO: 314325 - DNA, 20 bp, Artificial Sequence
  chemically synthesized
tcaaaactttgatataaata

SEQ ID NO: 314326 - DNA, 20 bp, Artificial Sequence
  chemically synthesized
atttagccatatttatatca

SEQ ID NO: 314327 - DNA, 20 bp, Artificial Sequence
  chemically synthesized
taggttaggtcattgcagtt

SEQ ID NO: 314328 - DNA, 20 bp, Artificial Sequence
  chemically synthesized
agtattaggttaggtcattg

SEQ ID NO: 314329 - DNA, 20 bp, Artificial Sequence
  chemically synthesized
aaatagattagtattaggtt

SEQ ID NO: 314330 - DNA, 20 bp, Artificial Sequence
  chemically synthesized
aaaatagattagtattaggt

SEQ ID NO: 314331 - DNA, 20 bp, Artificial Sequence
  chemically synthesized
gggtaaaatagattagtatt

SEQ ID NO: 314332 - DNA, 20 bp, Artificial Sequence
  chemically synthesized
agggtaaaatagattagtat

SEQ ID NO: 314333 - DNA, 20 bp, Artificial Sequence
  chemically synthesized
tagatgagggtaaaatagat

SEQ ID NO: 314334 - DNA, 20 bp, Artificial Sequence
  chemically synthesized
tgtattagatgagggtaaaa

SEQ ID NO: 314335 - DNA, 20 bp, Artificial Sequence
  chemically synthesized
agtcagaatgtattagatga

SEQ ID NO: 314336 - DNA, 20 bp, Artificial Sequence
  chemically synthesized
tagtcagaatgtattagatg

SEQ ID NO: 314337 - DNA, 20 bp, Artificial Sequence
  chemically synthesized
atagtcagaatgtattagat

SEQ ID NO: 314338 - DNA, 20 bp, Artificial Sequence
  chemically synthesized
ggatgatagtcagaatgtat

SEQ ID NO: 314339 - DNA, 20 bp, Artificial Sequence
  chemically synthesized
ctattagaaaggatgatagt

SEQ ID NO: 314340 - DNA, 20 bp, Artificial Sequence
  chemically synthesized
atgtctattagaaaggatga

SEQ ID NO: 314341 - DNA, 20 bp, Artificial Sequence
  chemically synthesized
ctgactatcatcctttctaa

SEQ ID NO: 314342 - DNA, 20 bp, Artificial Sequence
  chemically synthesized
acttatgatgtctattagaa

SEQ ID NO: 314343 - DNA, 20 bp, Artificial Sequence
  chemically synthesized
cacttatgatgtctattaga

SEQ ID NO: 314344 - DNA, 20 bp, Artificial Sequence
  chemically synthesized
cctgcacttatgatgtctat

SEQ ID NO: 314345 - DNA, 20 bp, Artificial Sequence
  chemically synthesized
tcctttctaatagacatcat

SEQ ID NO: 314346 - DNA, 20 bp, Artificial Sequence
  chemically synthesized
tctaatagacatcataagtg

SEQ ID NO: 314347 - DNA, 20 bp, Artificial Sequence
  chemically synthesized
ctaatagacatcataagtgc

SEQ ID NO: 314348 - DNA, 20 bp, Artificial Sequence
  chemically synthesized
atagacatcataagtgcagg

SEQ ID NO: 314349 - DNA, 20 bp, Artificial Sequence
  chemically synthesized
agacatcataagtgcaggaa

SEQ ID NO: 314350 - DNA, 20 bp, Artificial Sequence
  chemically synthesized
aagagaatgtgatttttgaa

SEQ ID NO: 314351 - DNA, 20 bp, Artificial Sequence
  chemically synthesized
ttttgaaaagtcatgaaaac

SEQ ID NO: 314352 - DNA, 20 bp, Artificial Sequence
  chemically synthesized
aaaagtcatgaaaacaagtg

SEQ ID NO: 314353 - DNA, 20 bp, Artificial Sequence
  chemically synthesized
catgaaaacaagtgaagtta

SEQ ID NO: 314354 - DNA, 20 bp, Artificial Sequence
  chemically synthesized
aaacaagtgaagttacagca

SEQ ID NO: 314355 - DNA, 20 bp, Artificial Sequence
  chemically synthesized
tgaagttacagcaaagtttt

SEQ ID NO: 314356 - DNA, 20 bp, Artificial Sequence
  chemically synthesized
gaagttacagcaaagtttta

SEQ ID NO: 314357 - DNA, 20 bp, Artificial Sequence
  chemically synthesized
tacagcaaagttttaaggtc

SEQ ID NO: 314358 - DNA, 20 bp, Artificial Sequence
  chemically synthesized
cagcaaagttttaaggtctg

SEQ ID NO: 314359 - DNA, 20 bp, Artificial Sequence
  chemically synthesized
acacttactgtatatttctc

SEQ ID NO: 314360 - DNA, 20 bp, Artificial Sequence
  chemically synthesized
ttaaggtctggagaaatata

SEQ ID NO: 314361 - DNA, 20 bp, Artificial Sequence
  chemically synthesized
ggtctggagaaatatacagt

SEQ ID NO: 314362 - DNA, 20 bp, Artificial Sequence
  chemically synthesized
ggaagttcaggtattattta

SEQ ID NO: 314363 - DNA, 20 bp, Artificial Sequence
  chemically synthesized
tggaagttcaggtattattt

SEQ ID NO: 314364 - DNA, 20 bp, Artificial Sequence
  chemically synthesized
tgtaaataaattggaagttc

SEQ ID NO: 314365 - DNA, 20 bp, Artificial Sequence
  chemically synthesized
gtgtaaataaattggaagtt

SEQ ID NO: 314366 - DNA, 20 bp, Artificial Sequence
  chemically synthesized
atgtagtgtaaataaattgg

SEQ ID NO: 314367 - DNA, 20 bp, Artificial Sequence
  chemically synthesized
ttaatgtagtgtaaataaat

SEQ ID NO: 314368 - DNA, 20 bp, Artificial Sequence
  chemically synthesized
tgaacctacttttattaatg

SEQ ID NO: 314369 - DNA, 20 bp, Artificial Sequence
  chemically synthesized
tatttacactacattaataa

SEQ ID NO: 314370 - DNA, 20 bp, Artificial Sequence
  chemically synthesized
ttacactacattaataaaag

SEQ ID NO: 314371 - DNA, 20 bp, Artificial Sequence
  chemically synthesized
tacactacattaataaaagt

SEQ ID NO: 314372 - DNA, 20 bp, Artificial Sequence
  chemically synthesized
gtgataaccatcagatgagg

SEQ ID NO: 314373 - DNA, 20 bp, Artificial Sequence
  chemically synthesized
gttcaaactacctcatctga

SEQ ID NO: 314374 - DNA, 20 bp, Artificial Sequence
  chemically synthesized
tctgtgataaccatcagatg

SEQ ID NO: 314375 - DNA, 20 bp, Artificial Sequence
  chemically synthesized
ttctgtgataaccatcagat

SEQ ID NO: 314376 - DNA, 20 bp, Artificial Sequence
  chemically synthesized
aatttttctgtgataaccat

SEQ ID NO: 314377 - DNA, 20 bp, Artificial Sequence
  chemically synthesized
acctcatctgatggttatca

SEQ ID NO: 314378 - DNA, 20 bp, Artificial Sequence
  chemically synthesized
ttatcacagaaaaatttgca

SEQ ID NO: 314379 - DNA, 20 bp, Artificial Sequence
  chemically synthesized
tatcacagaaaaatttgcat

SEQ ID NO: 314380 - DNA, 20 bp, Artificial Sequence
  chemically synthesized
cacagaaaaatttgcatggg

SEQ ID NO: 314381 - DNA, 20 bp, Artificial Sequence
  chemically synthesized
gcatgggcagacatatgtca

SEQ ID NO: 314382 - DNA, 20 bp, Artificial Sequence
  chemically synthesized
atgggcagacatatgtcatg

SEQ ID NO: 314383 - DNA, 20 bp, Artificial Sequence
  chemically synthesized
gcagacatatgtcatggagt

SEQ ID NO: 314384 - DNA, 20 bp, Artificial Sequence
  chemically synthesized
cagacatatgtcatggagtg

SEQ ID NO: 314385 - DNA, 20 bp, Artificial Sequence
  chemically synthesized
catatgtcatggagtgagga

SEQ ID NO: 314386 - DNA, 20 bp, Artificial Sequence
  chemically synthesized
gggctaccatttcgtgatta

SEQ ID NO: 314387 - DNA, 20 bp, Artificial Sequence
  chemically synthesized
agggctaccatttcgtgatt

SEQ ID NO: 314388 - DNA, 20 bp, Artificial Sequence
  chemically synthesized
gagggctaccatttcgtgat

SEQ ID NO: 314389 - DNA, 20 bp, Artificial Sequence
  chemically synthesized
gacagtccctaatcacgaaa

SEQ ID NO: 314390 - DNA, 20 bp, Artificial Sequence
  chemically synthesized
agtccctaatcacgaaatgg

SEQ ID NO: 314391 - DNA, 20 bp, Artificial Sequence
  chemically synthesized
aggaaaggcaagagaattga

SEQ ID NO: 314392 - DNA, 20 bp, Artificial Sequence
  chemically synthesized
taggaaaggcaagagaattg

SEQ ID NO: 314393 - DNA, 20 bp, Artificial Sequence
  chemically synthesized
gtaggaaaggcaagagaatt

SEQ ID NO: 314394 - DNA, 20 bp, Artificial Sequence
  chemically synthesized
agaaagagtaggaaaggcaa

SEQ ID NO: 314395 - DNA, 20 bp, Artificial Sequence
  chemically synthesized
gtagaaagagtaggaaaggc

SEQ ID NO: 314396 - DNA, 20 bp, Artificial Sequence
  chemically synthesized
gattgtagaaagagtaggaa

SEQ ID NO: 314397 - DNA, 20 bp, Artificial Sequence
  chemically synthesized
ggattgtagaaagagtagga

SEQ ID NO: 314398 - DNA, 20 bp, Artificial Sequence
  chemically synthesized
gcatggattgtagaaagagt

SEQ ID NO: 314399 - DNA, 20 bp, Artificial Sequence
  chemically synthesized
tgcatggattgtagaaagag

SEQ ID NO: 314400 - DNA, 20 bp, Artificial Sequence
  chemically synthesized
gcatgcatggattgtagaaa

SEQ ID NO: 314401 - DNA, 20 bp, Artificial Sequence
  chemically synthesized
gtgcatgcatggattgtaga

SEQ ID NO: 314402 - DNA, 20 bp, Artificial Sequence
  chemically synthesized
gtgggtgcatgcatggattg

SEQ ID NO: 314403 - DNA, 20 bp, Artificial Sequence
  chemically synthesized
tgtatgggtgggtgcatgca

SEQ ID NO: 314404 - DNA, 20 bp, Artificial Sequence
  chemically synthesized
tatatgcagaatgtatgggt

SEQ ID NO: 314405 - DNA, 20 bp, Artificial Sequence
  chemically synthesized
ctatatgcagaatgtatggg

SEQ ID NO: 314406 - DNA, 20 bp, Artificial Sequence
  chemically synthesized
taactatatgcagaatgtat

SEQ ID NO: 314407 - DNA, 20 bp, Artificial Sequence
  chemically synthesized
gtaactatatgcagaatgta

SEQ ID NO: 314408 - DNA, 20 bp, Artificial Sequence
  chemically synthesized
ccacccatacattctgcata

SEQ ID NO: 314409 - DNA, 20 bp, Artificial Sequence
  chemically synthesized
tttaattctgtaactatatg

SEQ ID NO: 314410 - DNA, 20 bp, Artificial Sequence
  chemically synthesized
atacattctgcatatagtta

SEQ ID NO: 314411 - DNA, 20 bp, Artificial Sequence
  chemically synthesized
tatagttacagaattaaaat

SEQ ID NO: 314412 - DNA, 20 bp, Artificial Sequence
  chemically synthesized
aattatttattcaatgttat

SEQ ID NO: 314413 - DNA, 20 bp, Artificial Sequence
  chemically synthesized
tcaataattattttcagtaa

SEQ ID NO: 314414 - DNA, 20 bp, Artificial Sequence
  chemically synthesized
ttcaataattattttcagta

SEQ ID NO: 314415 - DNA, 20 bp, Artificial Sequence
  chemically synthesized
tctttttcaataattatttt

SEQ ID NO: 314416 - DNA, 20 bp, Artificial Sequence
  chemically synthesized
actgaaaataattattgaaa

SEQ ID NO: 314417 - DNA, 20 bp, Artificial Sequence
  chemically synthesized
aaataattattgaaaaagaa

SEQ ID NO: 314418 - DNA, 20 bp, Artificial Sequence
  chemically synthesized
taattattgaaaaagaaaag

SEQ ID NO: 314419 - DNA, 20 bp, Artificial Sequence
  chemically synthesized
gaaaaagaaaagaagattat

SEQ ID NO: 314420 - DNA, 20 bp, Artificial Sequence
  chemically synthesized
aaaaagaaaagaagattatt

SEQ ID NO: 314421 - DNA, 20 bp, Artificial Sequence
  chemically synthesized
aaagaaaagaagattattgg

SEQ ID NO: 314422 - DNA, 20 bp, Artificial Sequence
  chemically synthesized
agaaaagaagattattggga

SEQ ID NO: 314423 - DNA, 20 bp, Artificial Sequence
  chemically synthesized
aaaagaagattattgggaga

SEQ ID NO: 314424 - DNA, 20 bp, Artificial Sequence
  chemically synthesized
gaagattattgggagagagt

SEQ ID NO: 314425 - DNA, 20 bp, Artificial Sequence
  chemically synthesized
aagattattgggagagagtt

SEQ ID NO: 314426 - DNA, 20 bp, Artificial Sequence
  chemically synthesized
agattattgggagagagttg

SEQ ID NO: 314427 - DNA, 20 bp, Artificial Sequence
  chemically synthesized
ttattgggagagagttgggg

SEQ ID NO: 314428 - DNA, 20 bp, Artificial Sequence
  chemically synthesized
tgggagagagttggggtgga

SEQ ID NO: 314429 - DNA, 20 bp, Artificial Sequence
  chemically synthesized
agagttggggtggaaagttt

SEQ ID NO: 314430 - DNA, 20 bp, Artificial Sequence
  chemically synthesized
gagttggggtggaaagtttc

SEQ ID NO: 314431 - DNA, 20 bp, Artificial Sequence
  chemically synthesized
ttggggtggaaagtttcagg

SEQ ID NO: 314432 - DNA, 20 bp, Artificial Sequence
  chemically synthesized
ggggtggaaagtttcaggca

SEQ ID NO: 314433 - DNA, 20 bp, Artificial Sequence
  chemically synthesized
ggaaagtttcaggcagagca

SEQ ID NO: 314434 - DNA, 20 bp, Artificial Sequence
  chemically synthesized
aaagtttcaggcagagcaca

SEQ ID NO: 314435 - DNA, 20 bp, Artificial Sequence
  chemically synthesized
aagtttcaggcagagcacag

SEQ ID NO: 314436 - DNA, 20 bp, Artificial Sequence
  chemically synthesized
tctgttagcagcacaatgca

SEQ ID NO: 314437 - DNA, 20 bp, Artificial Sequence
  chemically synthesized
gctatgcattgtgctgctaa

SEQ ID NO: 314438 - DNA, 20 bp, Artificial Sequence
  chemically synthesized
tcacaactatattctgttag

SEQ ID NO: 314439 - DNA, 20 bp, Artificial Sequence
  chemically synthesized
atttcacaactatattctgt

SEQ ID NO: 314440 - DNA, 20 bp, Artificial Sequence
  chemically synthesized
attgtgctgctaacagaata

SEQ ID NO: 314441 - DNA, 20 bp, Artificial Sequence
  chemically synthesized
cagaatatagttgtgaaatt

SEQ ID NO: 314442 - DNA, 20 bp, Artificial Sequence
  chemically synthesized
ctgagcaggaggataatcat

SEQ ID NO: 314443 - DNA, 20 bp, Artificial Sequence
  chemically synthesized
ccaatgattatcctcctgct

SEQ ID NO: 314444 - DNA, 20 bp, Artificial Sequence
  chemically synthesized
ggcaataccgtctgagcagg

SEQ ID NO: 314445 - DNA, 20 bp, Artificial Sequence
  chemically synthesized
tggcaataccgtctgagcag

SEQ ID NO: 314446 - DNA, 20 bp, Artificial Sequence
  chemically synthesized
tgattatcctcctgctcaga

SEQ ID NO: 314447 - DNA, 20 bp, Artificial Sequence
  chemically synthesized
aatggcaataccgtctgagc

SEQ ID NO: 314448 - DNA, 20 bp, Artificial Sequence
  chemically synthesized
gaatggcaataccgtctgag

SEQ ID NO: 314449 - DNA, 20 bp, Artificial Sequence
  chemically synthesized
taagaatggcaataccgtct

SEQ ID NO: 314450 - DNA, 20 bp, Artificial Sequence
  chemically synthesized
atataggcttatgataagaa

SEQ ID NO: 314451 - DNA, 20 bp, Artificial Sequence
  chemically synthesized
ggtattgccattcttatcat

SEQ ID NO: 314452 - DNA, 20 bp, Artificial Sequence
  chemically synthesized
caggaatataggcttatgat

SEQ ID NO: 314453 - DNA, 20 bp, Artificial Sequence
  chemically synthesized
tataagggaaacaggaatat

SEQ ID NO: 314454 - DNA, 20 bp, Artificial Sequence
  chemically synthesized
ctataagggaaacaggaata

SEQ ID NO: 314455 - DNA, 20 bp, Artificial Sequence
  chemically synthesized
aaagagactataagggaaac

SEQ ID NO: 314456 - DNA, 20 bp, Artificial Sequence
  chemically synthesized
aaaagagactataagggaaa

SEQ ID NO: 314457 - DNA, 20 bp, Artificial Sequence
  chemically synthesized
ctatattcctgtttccctta

SEQ ID NO: 314458 - DNA, 20 bp, Artificial Sequence
  chemically synthesized
agaggaaaaagagactataa

SEQ ID NO: 314459 - DNA, 20 bp, Artificial Sequence
  chemically synthesized
tagaggaaaaagagactata

SEQ ID NO: 314460 - DNA, 20 bp, Artificial Sequence
  chemically synthesized
atagaggaaaaagagactat

SEQ ID NO: 314461 - DNA, 20 bp, Artificial Sequence
  chemically synthesized
tctttaaaatagaggaaaaa

SEQ ID NO: 314462 - DNA, 20 bp, Artificial Sequence
  chemically synthesized
gttctttaaaatagaggaaa

SEQ ID NO: 314463 - DNA, 20 bp, Artificial Sequence
  chemically synthesized
cctgtagttctttaaaatag

SEQ ID NO: 314464 - DNA, 20 bp, Artificial Sequence
  chemically synthesized
tctctttttcctctatttta

SEQ ID NO: 314465 - DNA, 20 bp, Artificial Sequence
  chemically synthesized
tcctgtagttctttaaaata

SEQ ID NO: 314466 - DNA, 20 bp, Artificial Sequence
  chemically synthesized
actcctgtagttctttaaaa

SEQ ID NO: 314467 - DNA, 20 bp, Artificial Sequence
  chemically synthesized
tcctctattttaaagaacta

SEQ ID NO: 314468 - DNA, 20 bp, Artificial Sequence
  chemically synthesized
cctctattttaaagaactac

SEQ ID NO: 314469 - DNA, 20 bp, Artificial Sequence
  chemically synthesized
tctattttaaagaactacag

SEQ ID NO: 314470 - DNA, 20 bp, Artificial Sequence
  chemically synthesized
attcatcaccattactcctg

SEQ ID NO: 314471 - DNA, 20 bp, Artificial Sequence
  chemically synthesized
ttaaagaactacaggagtaa

SEQ ID NO: 314472 - DNA, 20 bp, Artificial Sequence
  chemically synthesized
tggtgatgaattatttcatt

SEQ ID NO: 314473 - DNA, 20 bp, Artificial Sequence
  chemically synthesized
tcattaagcattttgattct

SEQ ID NO: 314474 - DNA, 20 bp, Artificial Sequence
  chemically synthesized
gtagctacacattaaatact

SEQ ID NO: 314475 - DNA, 20 bp, Artificial Sequence
  chemically synthesized
gattctgagtatttaatgtg

SEQ ID NO: 314476 - DNA, 20 bp, Artificial Sequence
  chemically synthesized
catagagtaagcagtagtgg

SEQ ID NO: 314477 - DNA, 20 bp, Artificial Sequence
  chemically synthesized
aaacatagagtaagcagtag

SEQ ID NO: 314478 - DNA, 20 bp, Artificial Sequence
  chemically synthesized
ttcaaacatagagtaagcag

SEQ ID NO: 314479 - DNA, 20 bp, Artificial Sequence
  chemically synthesized
gtcttcaaacatagagtaag

SEQ ID NO: 314480 - DNA, 20 bp, Artificial Sequence
  chemically synthesized
tgagtcttcaaacatagagt

SEQ ID NO: 314481 - DNA, 20 bp, Artificial Sequence
  chemically synthesized
catatgagtcttcaaacata

SEQ ID NO: 314482 - DNA, 20 bp, Artificial Sequence
  chemically synthesized
tactgcttactctatgtttg

SEQ ID NO: 314483 - DNA, 20 bp, Artificial Sequence
  chemically synthesized
tgcatatgagtcttcaaaca

SEQ ID NO: 314484 - DNA, 20 bp, Artificial Sequence
  chemically synthesized
tacagagactgtgtgcatat

SEQ ID NO: 314485 - DNA, 20 bp, Artificial Sequence
  chemically synthesized
tttgaagactcatatgcaca

SEQ ID NO: 314486 - DNA, 20 bp, Artificial Sequence
  chemically synthesized
atgtctagatagaaggtaca

SEQ ID NO: 314487 - DNA, 20 bp, Artificial Sequence
  chemically synthesized
gaatgtctagatagaaggta

SEQ ID NO: 314488 - DNA, 20 bp, Artificial Sequence
  chemically synthesized
cagtctctgtaccttctatc

SEQ ID NO: 314489 - DNA, 20 bp, Artificial Sequence
  chemically synthesized
attgggaatgtctagataga

SEQ ID NO: 314490 - DNA, 20 bp, Artificial Sequence
  chemically synthesized
gattgggaatgtctagatag

SEQ ID NO: 314491 - DNA, 20 bp, Artificial Sequence
  chemically synthesized
caggattgggaatgtctaga

SEQ ID NO: 314492 - DNA, 20 bp, Artificial Sequence
  chemically synthesized
ttcccaggattgggaatgtc

SEQ ID NO: 314493 - DNA, 20 bp, Artificial Sequence
  chemically synthesized
tatctagacattcccaatcc

SEQ ID NO: 314494 - DNA, 20 bp, Artificial Sequence
  chemically synthesized
atctagacattcccaatcct

SEQ ID NO: 314495 - DNA, 20 bp, Artificial Sequence
  chemically synthesized
gcatttggattcccaggatt

SEQ ID NO: 314496 - DNA, 20 bp, Artificial Sequence
  chemically synthesized
ggcatttggattcccaggat

SEQ ID NO: 314497 - DNA, 20 bp, Artificial Sequence
  chemically synthesized
gttgtggcatttggattccc

SEQ ID NO: 314498 - DNA, 20 bp, Artificial Sequence
  chemically synthesized
tgttgtggcatttggattcc

SEQ ID NO: 314499 - DNA, 20 bp, Artificial Sequence
  chemically synthesized
tttgaagatgttgtggcatt

SEQ ID NO: 314500 - DNA, 20 bp, Artificial Sequence
  chemically synthesized
aaagagatttgaagatgttg

SEQ ID NO: 314501 - DNA, 20 bp, Artificial Sequence
  chemically synthesized
agaagtgacaaagagatttg

SEQ ID NO: 314502 - DNA, 20 bp, Artificial Sequence
  chemically synthesized
agttgcagagaagtgacaaa

SEQ ID NO: 314503 - DNA, 20 bp, Artificial Sequence
  chemically synthesized
gcagttgcagagaagtgaca

SEQ ID NO: 314504 - DNA, 20 bp, Artificial Sequence
  chemically synthesized
agactagagcagttgcagag

SEQ ID NO: 314505 - DNA, 20 bp, Artificial Sequence
  chemically synthesized
tagagactagagcagttgca

SEQ ID NO: 314506 - DNA, 20 bp, Artificial Sequence
  chemically synthesized
cctagagactagagcagttg

SEQ ID NO: 314507 - DNA, 20 bp, Artificial Sequence
  chemically synthesized
tcacttctctgcaactgctc

SEQ ID NO: 314508 - DNA, 20 bp, Artificial Sequence
  chemically synthesized
tgagatcctagagactagag

SEQ ID NO: 314509 - DNA, 20 bp, Artificial Sequence
  chemically synthesized
tctgcaactgctctagtctc

SEQ ID NO: 314510 - DNA, 20 bp, Artificial Sequence
  chemically synthesized
acctgagatcctagagacta

SEQ ID NO: 314511 - DNA, 20 bp, Artificial Sequence
  chemically synthesized
ctgcaactgctctagtctct

SEQ ID NO: 314512 - DNA, 20 bp, Artificial Sequence
  chemically synthesized
ccacctgagatcctagagac

SEQ ID NO: 314513 - DNA, 20 bp, Artificial Sequence
  chemically synthesized
tgactccacctgagatccta

SEQ ID NO: 314514 - DNA, 20 bp, Artificial Sequence
  chemically synthesized
tgctctagtctctaggatct

SEQ ID NO: 314515 - DNA, 20 bp, Artificial Sequence
  chemically synthesized
gctctagtctctaggatctc

SEQ ID NO: 314516 - DNA, 20 bp, Artificial Sequence
  chemically synthesized
cttgactccacctgagatcc

SEQ ID NO: 314517 - DNA, 20 bp, Artificial Sequence
  chemically synthesized
ctagtctctaggatctcagg

SEQ ID NO: 314518 - DNA, 20 bp, Artificial Sequence
  chemically synthesized
agtctctaggatctcaggtg

SEQ ID NO: 314519 - DNA, 20 bp, Artificial Sequence
  chemically synthesized
agtgaagcttgactccacct

SEQ ID NO: 314520 - DNA, 20 bp, Artificial Sequence
  chemically synthesized
ctaggatctcaggtggagtc

SEQ ID NO: 314521 - DNA, 20 bp, Artificial Sequence
  chemically synthesized
caggtggagtcaagcttcac

SEQ ID NO: 314522 - DNA, 20 bp, Artificial Sequence
  chemically synthesized
tccattttgagattccagtg

SEQ ID NO: 314523 - DNA, 20 bp, Artificial Sequence
  chemically synthesized
ttctctccattttgagattc

SEQ ID NO: 314524 - DNA, 20 bp, Artificial Sequence
  chemically synthesized
gcttcactggaatctcaaaa

SEQ ID NO: 314525 - DNA, 20 bp, Artificial Sequence
  chemically synthesized
ttcactggaatctcaaaatg

SEQ ID NO: 314526 - DNA, 20 bp, Artificial Sequence
  chemically synthesized
agaccatttctctccatttt

SEQ ID NO: 314527 - DNA, 20 bp, Artificial Sequence
  chemically synthesized
cactggaatctcaaaatgga

SEQ ID NO: 314528 - DNA, 20 bp, Artificial Sequence
  chemically synthesized
aatctcaaaatggagagaaa

SEQ ID NO: 314529 - DNA, 20 bp, Artificial Sequence
  chemically synthesized
aatggagagaaatggtctca

SEQ ID NO: 314530 - DNA, 20 bp, Artificial Sequence
  chemically synthesized
atggagagaaatggtctcaa

SEQ ID NO: 314531 - DNA, 20 bp, Artificial Sequence
  chemically synthesized
gagagaaatggtctcaaagg

SEQ ID NO: 314532 - DNA, 20 bp, Artificial Sequence
  chemically synthesized
actttgacctgtctgccttt

SEQ ID NO: 314533 - DNA, 20 bp, Artificial Sequence
  chemically synthesized
gaaatggtctcaaaggcaga

SEQ ID NO: 314534 - DNA, 20 bp, Artificial Sequence
  chemically synthesized
aaatggtctcaaaggcagac

SEQ ID NO: 314535 - DNA, 20 bp, Artificial Sequence
  chemically synthesized
tctcaaaggcagacaggtca

SEQ ID NO: 314536 - DNA, 20 bp, Artificial Sequence
  chemically synthesized
agacaggtcaaagttaaaat

SEQ ID NO: 314537 - DNA, 20 bp, Artificial Sequence
  chemically synthesized
gtaacttcagtattaattgg

SEQ ID NO: 314538 - DNA, 20 bp, Artificial Sequence
  chemically synthesized
aaggtaacttcagtattaat

SEQ ID NO: 314539 - DNA, 20 bp, Artificial Sequence
  chemically synthesized
gaatctaccaattaatactg

SEQ ID NO: 314540 - DNA, 20 bp, Artificial Sequence
  chemically synthesized
ggagttgttcaaggtaactt

SEQ ID NO: 314541 - DNA, 20 bp, Artificial Sequence
  chemically synthesized
agagtttaaggagttgttca

SEQ ID NO: 314542 - DNA, 20 bp, Artificial Sequence
  chemically synthesized
aagagtttaaggagttgttc

SEQ ID NO: 314543 - DNA, 20 bp, Artificial Sequence
  chemically synthesized
atgtgttcaaagagtttaag

SEQ ID NO: 314544 - DNA, 20 bp, Artificial Sequence
  chemically synthesized
agatgtgttcaaagagttta

SEQ ID NO: 314545 - DNA, 20 bp, Artificial Sequence
  chemically synthesized
tagatgtgttcaaagagttt

SEQ ID NO: 314546 - DNA, 20 bp, Artificial Sequence
  chemically synthesized
gacaaatagatgtgttcaaa

SEQ ID NO: 314547 - DNA, 20 bp, Artificial Sequence
  chemically synthesized
cagacaaatagatgtgttca

SEQ ID NO: 314548 - DNA, 20 bp, Artificial Sequence
  chemically synthesized
tacttgattttacagacaaa

SEQ ID NO: 314549 - DNA, 20 bp, Artificial Sequence
  chemically synthesized
atctatttgtctgtaaaatc

SEQ ID NO: 314550 - DNA, 20 bp, Artificial Sequence
  chemically synthesized
gatattaatacttgatttta

SEQ ID NO: 314551 - DNA, 20 bp, Artificial Sequence
  chemically synthesized
atcaagtattaatatccttc

SEQ ID NO: 314552 - DNA, 20 bp, Artificial Sequence
  chemically synthesized
tcaagtattaatatccttcc

SEQ ID NO: 314553 - DNA, 20 bp, Artificial Sequence
  chemically synthesized
gtattaatatccttccaggc

SEQ ID NO: 314554 - DNA, 20 bp, Artificial Sequence
  chemically synthesized
ctgtaagtgtctggcctgga

SEQ ID NO: 314555 - DNA, 20 bp, Artificial Sequence
  chemically synthesized
tctgtaagtgtctggcctgg

SEQ ID NO: 314556 - DNA, 20 bp, Artificial Sequence
  chemically synthesized
tgttctgtaagtgtctggcc

SEQ ID NO: 314557 - DNA, 20 bp, Artificial Sequence
  chemically synthesized
tagaatgttctgtaagtgtc

SEQ ID NO: 314558 - DNA, 20 bp, Artificial Sequence
  chemically synthesized
ccttccaggccagacactta

SEQ ID NO: 314559 - DNA, 20 bp, Artificial Sequence
  chemically synthesized
ggtagaatagaatgttctgt

SEQ ID NO: 314560 - DNA, 20 bp, Artificial Sequence
  chemically synthesized
tacattctgtggtggtagaa

SEQ ID NO: 314561 - DNA, 20 bp, Artificial Sequence
  chemically synthesized
aacattctattctaccacca

SEQ ID NO: 314562 - DNA, 20 bp, Artificial Sequence
  chemically synthesized
taatgtacattctgtggtgg

SEQ ID NO: 314563 - DNA, 20 bp, Artificial Sequence
  chemically synthesized
gaataatgtacattctgtgg

SEQ ID NO: 314564 - DNA, 20 bp, Artificial Sequence
  chemically synthesized
tgagaataatgtacattctg

SEQ ID NO: 314565 - DNA, 20 bp, Artificial Sequence
  chemically synthesized
ataatgatccacgtgcagat

SEQ ID NO: 314566 - DNA, 20 bp, Artificial Sequence
  chemically synthesized
acattattctcatctgcacg

SEQ ID NO: 314567 - DNA, 20 bp, Artificial Sequence
  chemically synthesized
ttttgataatgatccacgtg

SEQ ID NO: 314568 - DNA, 20 bp, Artificial Sequence
  chemically synthesized
atcaaaaattgaaaatgtgc

SEQ ID NO: 314569 - DNA, 20 bp, Artificial Sequence
  chemically synthesized
tcaaaaattgaaaatgtgct

SEQ ID NO: 314570 - DNA, 20 bp, Artificial Sequence
  chemically synthesized
ttgaaaatgtgctaggccac

SEQ ID NO: 314571 - DNA, 20 bp, Artificial Sequence
  chemically synthesized
tgaaaatgtgctaggccaca

SEQ ID NO: 314572 - DNA, 20 bp, Artificial Sequence
  chemically synthesized
ttaagaaccaccttgtggcc

SEQ ID NO: 314573 - DNA, 20 bp, Artificial Sequence
  chemically synthesized
aaatgtgctaggccacaagg

SEQ ID NO: 314574 - DNA, 20 bp, Artificial Sequence
  chemically synthesized
atgtgttaagaaccaccttg

SEQ ID NO: 314575 - DNA, 20 bp, Artificial Sequence
  chemically synthesized
gatttttttaaaaatgtgtt

SEQ ID NO: 314576 - DNA, 20 bp, Artificial Sequence
  chemically synthesized
aaaaaaatcaaaatcatatc

SEQ ID NO: 314577 - DNA, 20 bp, Artificial Sequence
  chemically synthesized
tttttccactgtggtgcaag

SEQ ID NO: 314578 - DNA, 20 bp, Artificial Sequence
  chemically synthesized
tcaagcatcttcttgcacca

SEQ ID NO: 314579 - DNA, 20 bp, Artificial Sequence
  chemically synthesized
gtttttttccactgtggtgc

SEQ ID NO: 314580 - DNA, 20 bp, Artificial Sequence
  chemically synthesized
agcatcttcttgcaccacag

SEQ ID NO: 314581 - DNA, 20 bp, Artificial Sequence
  chemically synthesized
tttctagtttttttccactg

SEQ ID NO: 314582 - DNA, 20 bp, Artificial Sequence
  chemically synthesized
gcaccacagtggaaaaaaac

SEQ ID NO: 314583 - DNA, 20 bp, Artificial Sequence
  chemically synthesized
agtggaaaaaaactagaaat

SEQ ID NO: 314584 - DNA, 20 bp, Artificial Sequence
  chemically synthesized
gtcttcttggtactcatttc

SEQ ID NO: 314585 - DNA, 20 bp, Artificial Sequence
  chemically synthesized
aaaaactagaaatgagtacc

SEQ ID NO: 314586 - DNA, 20 bp, Artificial Sequence
  chemically synthesized
aactagaaatgagtaccaag

SEQ ID NO: 314587 - DNA, 20 bp, Artificial Sequence
  chemically synthesized
atagatttaaggagtcttct

SEQ ID NO: 314588 - DNA, 20 bp, Artificial Sequence
  chemically synthesized
tgtatttgtatagatttaag

SEQ ID NO: 314589 - DNA, 20 bp, Artificial Sequence
  chemically synthesized
catgtatttgtatagattta

SEQ ID NO: 314590 - DNA, 20 bp, Artificial Sequence
  chemically synthesized
ccatgtatttgtatagattt

SEQ ID NO: 314591 - DNA, 20 bp, Artificial Sequence
  chemically synthesized
ttaatttccatgtatttgta

SEQ ID NO: 314592 - DNA, 20 bp, Artificial Sequence
  chemically synthesized
cttaaatctatacaaataca

SEQ ID NO: 314593 - DNA, 20 bp, Artificial Sequence
  chemically synthesized
tccaaagatcattcaggagc

SEQ ID NO: 314594 - DNA, 20 bp, Artificial Sequence
  chemically synthesized
gtccaaagatcattcaggag

SEQ ID NO: 314595 - DNA, 20 bp, Artificial Sequence
  chemically synthesized
attgtccaaagatcattcag

SEQ ID NO: 314596 - DNA, 20 bp, Artificial Sequence
  chemically synthesized
tcattgtccaaagatcattc

SEQ ID NO: 314597 - DNA, 20 bp, Artificial Sequence
  chemically synthesized
ttcattgtccaaagatcatt

SEQ ID NO: 314598 - DNA, 20 bp, Artificial Sequence
  chemically synthesized
acctgctcctgaatgatctt

SEQ ID NO: 314599 - DNA, 20 bp, Artificial Sequence
  chemically synthesized
ttccttgatttcattgtcca

SEQ ID NO: 314600 - DNA, 20 bp, Artificial Sequence
  chemically synthesized
gatctttggacaatgaaatc

SEQ ID NO: 314601 - DNA, 20 bp, Artificial Sequence
  chemically synthesized
atctttggacaatgaaatca

SEQ ID NO: 314602 - DNA, 20 bp, Artificial Sequence
  chemically synthesized
tttggacaatgaaatcaagg

SEQ ID NO: 314603 - DNA, 20 bp, Artificial Sequence
  chemically synthesized
ctctttttatttgtttcaaa

SEQ ID NO: 314604 - DNA, 20 bp, Artificial Sequence
  chemically synthesized
aactttttgaaacaaataaa

SEQ ID NO: 314605 - DNA, 20 bp, Artificial Sequence
  chemically synthesized
ctttttgaaacaaataaaaa

SEQ ID NO: 314606 - DNA, 20 bp, Artificial Sequence
  chemically synthesized
atacaacatacctccacctc

SEQ ID NO: 314607 - DNA, 20 bp, Artificial Sequence
  chemically synthesized
ttgctgtatcccagaggtgg

SEQ ID NO: 314608 - DNA, 20 bp, Artificial Sequence
  chemically synthesized
tacaacatacctccacctct

SEQ ID NO: 314609 - DNA, 20 bp, Artificial Sequence
  chemically synthesized
tttgctgtatcccagaggtg

SEQ ID NO: 314610 - DNA, 20 bp, Artificial Sequence
  chemically synthesized
cttttgctgtatcccagagg

SEQ ID NO: 314611 - DNA, 20 bp, Artificial Sequence
  chemically synthesized
ctgcttttgctgtatcccag

SEQ ID NO: 314612 - DNA, 20 bp, Artificial Sequence
  chemically synthesized
atacctccacctctgggata

SEQ ID NO: 314613 - DNA, 20 bp, Artificial Sequence
  chemically synthesized
actgcttttgctgtatccca

SEQ ID NO: 314614 - DNA, 20 bp, Artificial Sequence
  chemically synthesized
ggactgcttttgctgtatcc

SEQ ID NO: 314615 - DNA, 20 bp, Artificial Sequence
  chemically synthesized
ccacctctgggatacagcaa

SEQ ID NO: 314616 - DNA, 20 bp, Artificial Sequence
  chemically synthesized
cctctgggatacagcaaaag

SEQ ID NO: 314617 - DNA, 20 bp, Artificial Sequence
  chemically synthesized
gatacagcaaaagcagtcct

SEQ ID NO: 314618 - DNA, 20 bp, Artificial Sequence
  chemically synthesized
cagcaaaagcagtcctaaga

SEQ ID NO: 314619 - DNA, 20 bp, Artificial Sequence
  chemically synthesized
atgctataaatttccatctt

SEQ ID NO: 314620 - DNA, 20 bp, Artificial Sequence
  chemically synthesized
aatgctataaatttccatct

SEQ ID NO: 314621 - DNA, 20 bp, Artificial Sequence
  chemically synthesized
agtcctaagatggaaattta

SEQ ID NO: 314622 - DNA, 20 bp, Artificial Sequence
  chemically synthesized
ttctatctttttggtgtagg

SEQ ID NO: 314623 - DNA, 20 bp, Artificial Sequence
  chemically synthesized
tctttctatctttttggtgt

SEQ ID NO: 314624 - DNA, 20 bp, Artificial Sequence
  chemically synthesized
cattaactgcctacaccaaa

SEQ ID NO: 314625 - DNA, 20 bp, Artificial Sequence
  chemically synthesized
atctttctatctttttggtg

SEQ ID NO: 314626 - DNA, 20 bp, Artificial Sequence
  chemically synthesized
aactgcctacaccaaaaaga

SEQ ID NO: 314627 - DNA, 20 bp, Artificial Sequence
  chemically synthesized
tttagatctttctatctttt

SEQ ID NO: 314628 - DNA, 20 bp, Artificial Sequence
  chemically synthesized
gcctacaccaaaaagataga

SEQ ID NO: 314629 - DNA, 20 bp, Artificial Sequence
  chemically synthesized
aagatagaaagatctaaaat

SEQ ID NO: 314630 - DNA, 20 bp, Artificial Sequence
  chemically synthesized
caatattagtttgctaattt

SEQ ID NO: 314631 - DNA, 20 bp, Artificial Sequence
  chemically synthesized
agttcattgaagtacaatat

SEQ ID NO: 314632 - DNA, 20 bp, Artificial Sequence
  chemically synthesized
cttggttttctagttcattg

SEQ ID NO: 314633 - DNA, 20 bp, Artificial Sequence
  chemically synthesized
aatattgtacttcaatgaac

SEQ ID NO: 314634 - DNA, 20 bp, Artificial Sequence
  chemically synthesized
cttcaatgaactagaaaacc

SEQ ID NO: 314635 - DNA, 20 bp, Artificial Sequence
  chemically synthesized
tcggtttgttcttggttttc

SEQ ID NO: 314636 - DNA, 20 bp, Artificial Sequence
  chemically synthesized
ctttggtttcggtttgttct

SEQ ID NO: 314637 - DNA, 20 bp, Artificial Sequence
  chemically synthesized
ccaagaacaaaccgaaacca

SEQ ID NO: 314638 - DNA, 20 bp, Artificial Sequence
  chemically synthesized
tattctgctagctttggttt

SEQ ID NO: 314639 - DNA, 20 bp, Artificial Sequence
  chemically synthesized
gaacaaaccgaaaccaaagc

SEQ ID NO: 314640 - DNA, 20 bp, Artificial Sequence
  chemically synthesized
caaaccgaaaccaaagctag

SEQ ID NO: 314641 - DNA, 20 bp, Artificial Sequence
  chemically synthesized
ttcttatattctgctagctt

SEQ ID NO: 314642 - DNA, 20 bp, Artificial Sequence
  chemically synthesized
tgttatttcttatattctgc

SEQ ID NO: 314643 - DNA, 20 bp, Artificial Sequence
  chemically synthesized
aaccaaagctagcagaatat

SEQ ID NO: 314644 - DNA, 20 bp, Artificial Sequence
  chemically synthesized
atataagaaataacaatgat

SEQ ID NO: 314645 - DNA, 20 bp, Artificial Sequence
  chemically synthesized
ataagaaataacaatgatca

SEQ ID NO: 314646 - DNA, 20 bp, Artificial Sequence
  chemically synthesized
agaaataacaatgatcagag

SEQ ID NO: 314647 - DNA, 20 bp, Artificial Sequence
  chemically synthesized
tttattatctcagtttcatt

SEQ ID NO: 314648 - DNA, 20 bp, Artificial Sequence
  chemically synthesized
gagcagaactaaatgaaact

SEQ ID NO: 314649 - DNA, 20 bp, Artificial Sequence
  chemically synthesized
ttttttgtcttttattatct

SEQ ID NO: 314650 - DNA, 20 bp, Artificial Sequence
  chemically synthesized
aaatgaaactgagataataa

SEQ ID NO: 314651 - DNA, 20 bp, Artificial Sequence
  chemically synthesized
agacaaaaaattaaaaaaat

SEQ ID NO: 314652 - DNA, 20 bp, Artificial Sequence
  chemically synthesized
acaaaaaattaaaaaaatta

SEQ ID NO: 314653 - DNA, 20 bp, Artificial Sequence
  chemically synthesized
aaaaaattaaaaaaattaga

SEQ ID NO: 314654 - DNA, 20 bp, Artificial Sequence
  chemically synthesized
attagagagttttctttgaa

SEQ ID NO: 314655 - DNA, 20 bp, Artificial Sequence
  chemically synthesized
taattttgtttatcttttca

SEQ ID NO: 314656 - DNA, 20 bp, Artificial Sequence
  chemically synthesized
gaaaagataaacaaaattaa

SEQ ID NO: 314657 - DNA, 20 bp, Artificial Sequence
  chemically synthesized
aaaagataaacaaaattaat

SEQ ID NO: 314658 - DNA, 20 bp, Artificial Sequence
  chemically synthesized
aaacaaaattaataggccac

SEQ ID NO: 314659 - DNA, 20 bp, Artificial Sequence
  chemically synthesized
aaaattaataggccactagc

SEQ ID NO: 314660 - DNA, 20 bp, Artificial Sequence
  chemically synthesized
ttcttggttaatctagctag

SEQ ID NO: 314661 - DNA, 20 bp, Artificial Sequence
  chemically synthesized
tttttcttggttaatctagc

SEQ ID NO: 314662 - DNA, 20 bp, Artificial Sequence
  chemically synthesized
tgtttttttcttggttaatc

SEQ ID NO: 314663 - DNA, 20 bp, Artificial Sequence
  chemically synthesized
ggccactagctagattaacc

SEQ ID NO: 314664 - DNA, 20 bp, Artificial Sequence
  chemically synthesized
tgattcttctgtttttttct

SEQ ID NO: 314665 - DNA, 20 bp, Artificial Sequence
  chemically synthesized
tagattaaccaagaaaaaaa

SEQ ID NO: 314666 - DNA, 20 bp, Artificial Sequence
  chemically synthesized
attaaccaagaaaaaaacag

SEQ ID NO: 314667 - DNA, 20 bp, Artificial Sequence
  chemically synthesized
aaaaaacagaagaatcaaat

SEQ ID NO: 314668 - DNA, 20 bp, Artificial Sequence
  chemically synthesized
acagaagaatcaaataagca

SEQ ID NO: 314669 - DNA, 20 bp, Artificial Sequence
  chemically synthesized
aagaatcaaataagcaaagt

SEQ ID NO: 314670 - DNA, 20 bp, Artificial Sequence
  chemically synthesized
gaatcaaataagcaaagtca

SEQ ID NO: 314671 - DNA, 20 bp, Artificial Sequence
  chemically synthesized
ataagcaaagtcagagatga

SEQ ID NO: 314672 - DNA, 20 bp, Artificial Sequence
  chemically synthesized
tgacgttacaactgatacca

SEQ ID NO: 314673 - DNA, 20 bp, Artificial Sequence
  chemically synthesized
ctttcgtatttctatggtat

SEQ ID NO: 314674 - DNA, 20 bp, Artificial Sequence
  chemically synthesized
gataatctttcgtatttcta

SEQ ID NO: 314675 - DNA, 20 bp, Artificial Sequence
  chemically synthesized
ctgataccatagaaatacga

SEQ ID NO: 314676 - DNA, 20 bp, Artificial Sequence
  chemically synthesized
atagaaatacgaaagattat

SEQ ID NO: 314677 - DNA, 20 bp, Artificial Sequence
  chemically synthesized
gaaagattatcagactacta

SEQ ID NO: 314678 - DNA, 20 bp, Artificial Sequence
  chemically synthesized
aaagattatcagactactat

SEQ ID NO: 314679 - DNA, 20 bp, Artificial Sequence
  chemically synthesized
gtacctagagatgcccatag

SEQ ID NO: 314680 - DNA, 20 bp, Artificial Sequence
  chemically synthesized
tgtgtacctagagatgccca

SEQ ID NO: 314681 - DNA, 20 bp, Artificial Sequence
  chemically synthesized
cagactactatgggcatctc

SEQ ID NO: 314682 - DNA, 20 bp, Artificial Sequence
  chemically synthesized
agactactatgggcatctct

SEQ ID NO: 314683 - DNA, 20 bp, Artificial Sequence
  chemically synthesized
ttttctaatttgtgtaccta

SEQ ID NO: 314684 - DNA, 20 bp, Artificial Sequence
  chemically synthesized
gattttctaatttgtgtacc

SEQ ID NO: 314685 - DNA, 20 bp, Artificial Sequence
  chemically synthesized
gcatctctaggtacacaaat

SEQ ID NO: 314686 - DNA, 20 bp, Artificial Sequence
  chemically synthesized
ggtacacaaattagaaaatc

SEQ ID NO: 314687 - DNA, 20 bp, Artificial Sequence
  chemically synthesized
tacacaaattagaaaatctg

SEQ ID NO: 314688 - DNA, 20 bp, Artificial Sequence
  chemically synthesized
acacaaattagaaaatctgg

SEQ ID NO: 314689 - DNA, 20 bp, Artificial Sequence
  chemically synthesized
aggaatttattcatttcctc

SEQ ID NO: 314690 - DNA, 20 bp, Artificial Sequence
  chemically synthesized
ggaggaaatgaataaattcc

SEQ ID NO: 314691 - DNA, 20 bp, Artificial Sequence
  chemically synthesized
ttgggagttgatatgtatcc

SEQ ID NO: 314692 - DNA, 20 bp, Artificial Sequence
  chemically synthesized
tttgggagttgatatgtatc

SEQ ID NO: 314693 - DNA, 20 bp, Artificial Sequence
  chemically synthesized
ttcttgtggttcaattttgg

SEQ ID NO: 314694 - DNA, 20 bp, Artificial Sequence
  chemically synthesized
gcttcttgtggttcaatttt

SEQ ID NO: 314695 - DNA, 20 bp, Artificial Sequence
  chemically synthesized
tgcttcttgtggttcaattt

SEQ ID NO: 314696 - DNA, 20 bp, Artificial Sequence
  chemically synthesized
aactcccaaaattgaaccac

SEQ ID NO: 314697 - DNA, 20 bp, Artificial Sequence
  chemically synthesized
tcccaaaattgaaccacaag

SEQ ID NO: 314698 - DNA, 20 bp, Artificial Sequence
  chemically synthesized
tccaagatttttgcttcttg

SEQ ID NO: 314699 - DNA, 20 bp, Artificial Sequence
  chemically synthesized
accacaagaagcaaaaatct

SEQ ID NO: 314700 - DNA, 20 bp, Artificial Sequence
  chemically synthesized
caagaagcaaaaatcttgga

SEQ ID NO: 314701 - DNA, 20 bp, Artificial Sequence
  chemically synthesized
tatttgttattggtctgtcc

SEQ ID NO: 314702 - DNA, 20 bp, Artificial Sequence
  chemically synthesized
tcagtttcactatttgttat

SEQ ID NO: 314703 - DNA, 20 bp, Artificial Sequence
  chemically synthesized
ttggacagaccaataacaaa

SEQ ID NO: 314704 - DNA, 20 bp, Artificial Sequence
  chemically synthesized
aacaaatagtgaaactgaat

SEQ ID NO: 314705 - DNA, 20 bp, Artificial Sequence
  chemically synthesized
ggagatatttattactgatt

SEQ ID NO: 314706 - DNA, 20 bp, Artificial Sequence
  chemically synthesized
cctgagctttattttattgg

SEQ ID NO: 314707 - DNA, 20 bp, Artificial Sequence
  chemically synthesized
gtcctgagctttattttatt

SEQ ID NO: 314708 - DNA, 20 bp, Artificial Sequence
  chemically synthesized
ggtcctgagctttattttat

SEQ ID NO: 314709 - DNA, 20 bp, Artificial Sequence
  chemically synthesized
aaatatctcccaataaaata

SEQ ID NO: 314710 - DNA, 20 bp, Artificial Sequence
  chemically synthesized
tctcccaataaaataaagct

SEQ ID NO: 314711 - DNA, 20 bp, Artificial Sequence
  chemically synthesized
ctcccaataaaataaagctc

SEQ ID NO: 314712 - DNA, 20 bp, Artificial Sequence
  chemically synthesized
aataaaataaagctcaggac

SEQ ID NO: 314713 - DNA, 20 bp, Artificial Sequence
  chemically synthesized
ctgtgaatacgtctggtcct

SEQ ID NO: 314714 - DNA, 20 bp, Artificial Sequence
  chemically synthesized
aattcggctgtgaatacgtc

SEQ ID NO: 314715 - DNA, 20 bp, Artificial Sequence
  chemically synthesized
ctcaggaccagacgtattca

SEQ ID NO: 314716 - DNA, 20 bp, Artificial Sequence
  chemically synthesized
tttgcatgtctggtagaatt

SEQ ID NO: 314717 - DNA, 20 bp, Artificial Sequence
  chemically synthesized
tattcacagccgaattctac

SEQ ID NO: 314718 - DNA, 20 bp, Artificial Sequence
  chemically synthesized
ccagttctttgcatgtctgg

SEQ ID NO: 314719 - DNA, 20 bp, Artificial Sequence
  chemically synthesized
gtaccagttctttgcatgtc

SEQ ID NO: 314720 - DNA, 20 bp, Artificial Sequence
  chemically synthesized
cgaattctaccagacatgca

SEQ ID NO: 314721 - DNA, 20 bp, Artificial Sequence
  chemically synthesized
ctaccagacatgcaaagaac

SEQ ID NO: 314722 - DNA, 20 bp, Artificial Sequence
  chemically synthesized
agttacaataggattggtac

SEQ ID NO: 314723 - DNA, 20 bp, Artificial Sequence
  chemically synthesized
tgcaacagttacaataggat

SEQ ID NO: 314724 - DNA, 20 bp, Artificial Sequence
  chemically synthesized
tattttgcaacagttacaat

SEQ ID NO: 314725 - DNA, 20 bp, Artificial Sequence
  chemically synthesized
atattttgcaacagttacaa

SEQ ID NO: 314726 - DNA, 20 bp, Artificial Sequence
  chemically synthesized
tcttgtttgatattttgcaa

SEQ ID NO: 314727 - DNA, 20 bp, Artificial Sequence
  chemically synthesized
actgttgcaaaatatcaaac

SEQ ID NO: 314728 - DNA, 20 bp, Artificial Sequence
  chemically synthesized
tgttgcaaaatatcaaacaa

SEQ ID NO: 314729 - DNA, 20 bp, Artificial Sequence
  chemically synthesized
gttgcaaaatatcaaacaag

SEQ ID NO: 314730 - DNA, 20 bp, Artificial Sequence
  chemically synthesized
gcttcgtagaattaattagg

SEQ ID NO: 314731 - DNA, 20 bp, Artificial Sequence
  chemically synthesized
tggcttcgtagaattaatta

SEQ ID NO: 314732 - DNA, 20 bp, Artificial Sequence
  chemically synthesized
ctggcttcgtagaattaatt

SEQ ID NO: 314733 - DNA, 20 bp, Artificial Sequence
  chemically synthesized
actggcttcgtagaattaat

SEQ ID NO: 314734 - DNA, 20 bp, Artificial Sequence
  chemically synthesized
tctccctaattaattctacg

SEQ ID NO: 314735 - DNA, 20 bp, Artificial Sequence
  chemically synthesized
cctaattaattctacgaagc

SEQ ID NO: 314736 - DNA, 20 bp, Artificial Sequence
  chemically synthesized
tcatggtgatactggcttcg

SEQ ID NO: 314737 - DNA, 20 bp, Artificial Sequence
  chemically synthesized
ctttggtatcatggtgatac

SEQ ID NO: 314738 - DNA, 20 bp, Artificial Sequence
  chemically synthesized
cttacctgcctttggtatca

SEQ ID NO: 314739 - DNA, 20 bp, Artificial Sequence
  chemically synthesized
ccagtatcaccatgatacca

SEQ ID NO: 314740 - DNA, 20 bp, Artificial Sequence
  chemically synthesized
cagtatcaccatgataccaa

SEQ ID NO: 314741 - DNA, 20 bp, Artificial Sequence
  chemically synthesized
tatcaccatgataccaaagg

SEQ ID NO: 314742 - DNA, 20 bp, Artificial Sequence
  chemically synthesized
atcaccatgataccaaaggc

SEQ ID NO: 314743 - DNA, 20 bp, Artificial Sequence
  chemically synthesized
gttgtgtccttacctgcctt

SEQ ID NO: 314744 - DNA, 20 bp, Artificial Sequence
  chemically synthesized
ccatgataccaaaggcaggt

SEQ ID NO: 314745 - DNA, 20 bp, Artificial Sequence
  chemically synthesized
catgataccaaaggcaggta

SEQ ID NO: 314746 - DNA, 20 bp, Artificial Sequence
  chemically synthesized
gcaggtaaggacacaacaaa

SEQ ID NO: 314747 - DNA, 20 bp, Artificial Sequence
  chemically synthesized
caggtaaggacacaacaaaa

SEQ ID NO: 314748 - DNA, 20 bp, Artificial Sequence
  chemically synthesized
acacaacaaaaaggaaacca

SEQ ID NO: 314749 - DNA, 20 bp, Artificial Sequence
  chemically synthesized
cacaacaaaaaggaaaccac

SEQ ID NO: 314750 - DNA, 20 bp, Artificial Sequence
  chemically synthesized
tcatcagggatattggcctg

SEQ ID NO: 314751 - DNA, 20 bp, Artificial Sequence
  chemically synthesized
tctatgttcatcagggatat

SEQ ID NO: 314752 - DNA, 20 bp, Artificial Sequence
  chemically synthesized
ttttgcatctatgttcatca

SEQ ID NO: 314753 - DNA, 20 bp, Artificial Sequence
  chemically synthesized
tttttgcatctatgttcatc

SEQ ID NO: 314754 - DNA, 20 bp, Artificial Sequence
  chemically synthesized
gccaatatccctgatgaaca

SEQ ID NO: 314755 - DNA, 20 bp, Artificial Sequence
  chemically synthesized
atttttgcatctatgttcat

SEQ ID NO: 314756 - DNA, 20 bp, Artificial Sequence
  chemically synthesized
atagatgcaaaaatcctcaa

SEQ ID NO: 314757 - DNA, 20 bp, Artificial Sequence
  chemically synthesized
ggtttgctagcattctgttg

SEQ ID NO: 314758 - DNA, 20 bp, Artificial Sequence
  chemically synthesized
tggtttgctagcattctgtt

SEQ ID NO: 314759 - DNA, 20 bp, Artificial Sequence
  chemically synthesized
aaaaatcctcaacagaatgc

SEQ ID NO: 314760 - DNA, 20 bp, Artificial Sequence
  chemically synthesized
tgcttttgggtttggtttgc

SEQ ID NO: 314761 - DNA, 20 bp, Artificial Sequence
  chemically synthesized
tgctagcaaaccaaacccaa

SEQ ID NO: 314762 - DNA, 20 bp, Artificial Sequence
  chemically synthesized
ttttgttatgcttttgggtt

SEQ ID NO: 314763 - DNA, 20 bp, Artificial Sequence
  chemically synthesized
tatctttttgttatgctttt

SEQ ID NO: 314764 - DNA, 20 bp, Artificial Sequence
  chemically synthesized
ttatctttttgttatgcttt

SEQ ID NO: 314765 - DNA, 20 bp, Artificial Sequence
  chemically synthesized
aaacccaaaagcataacaaa

SEQ ID NO: 314766 - DNA, 20 bp, Artificial Sequence
  chemically synthesized
ataatacatgacaataacgt

SEQ ID NO: 314767 - DNA, 20 bp, Artificial Sequence
  chemically synthesized
caataacgtgagctttatgc

SEQ ID NO: 314768 - DNA, 20 bp, Artificial Sequence
  chemically synthesized
aataacgtgagctttatgcc

SEQ ID NO: 314769 - DNA, 20 bp, Artificial Sequence
  chemically synthesized
atccctgcctacctggcata

SEQ ID NO: 314770 - DNA, 20 bp, Artificial Sequence
  chemically synthesized
aacgtgagctttatgccagg

SEQ ID NO: 314771 - DNA, 20 bp, Artificial Sequence
  chemically synthesized
acgtgagctttatgccaggt

SEQ ID NO: 314772 - DNA, 20 bp, Artificial Sequence
  chemically synthesized
tgagctttatgccaggtagg

SEQ ID NO: 314773 - DNA, 20 bp, Artificial Sequence
  chemically synthesized
gagctttatgccaggtaggc

SEQ ID NO: 314774 - DNA, 20 bp, Artificial Sequence
  chemically synthesized
tgcatatatccctgcctacc

SEQ ID NO: 314775 - DNA, 20 bp, Artificial Sequence
  chemically synthesized
agctttatgccaggtaggca

SEQ ID NO: 314776 - DNA, 20 bp, Artificial Sequence
  chemically synthesized
caggtaggcagggatatatg

SEQ ID NO: 314777 - DNA, 20 bp, Artificial Sequence
  chemically synthesized
ggtaggcagggatatatgca

SEQ ID NO: 314778 - DNA, 20 bp, Artificial Sequence
  chemically synthesized
ttgtgttatgtggtgaatca

SEQ ID NO: 314779 - DNA, 20 bp, Artificial Sequence
  chemically synthesized
aaaacatatattgtgttatg

SEQ ID NO: 314780 - DNA, 20 bp, Artificial Sequence
  chemically synthesized
aacacaatatatgttttgtg

SEQ ID NO: 314781 - DNA, 20 bp, Artificial Sequence
  chemically synthesized
tttgtgtggtgcaatatatg

SEQ ID NO: 314782 - DNA, 20 bp, Artificial Sequence
  chemically synthesized
tgtgtggtgcaatatatgca

SEQ ID NO: 314783 - DNA, 20 bp, Artificial Sequence
  chemically synthesized
tatgtgattcaccacataaa

SEQ ID NO: 314784 - DNA, 20 bp, Artificial Sequence
  chemically synthesized
tgtttttaattctttttatg

SEQ ID NO: 314785 - DNA, 20 bp, Artificial Sequence
  chemically synthesized
aaaacatatgatcatctcaa

SEQ ID NO: 314786 - DNA, 20 bp, Artificial Sequence
  chemically synthesized
atgccttttctgcatctatt

SEQ ID NO: 314787 - DNA, 20 bp, Artificial Sequence
  chemically synthesized
tatgatcatctcaatagatg

SEQ ID NO: 314788 - DNA, 20 bp, Artificial Sequence
  chemically synthesized
tcatctcaatagatgcagaa

SEQ ID NO: 314789 - DNA, 20 bp, Artificial Sequence
  chemically synthesized
catctcaatagatgcagaaa

SEQ ID NO: 314790 - DNA, 20 bp, Artificial Sequence
  chemically synthesized
aaaaggcatttgataaaatc

SEQ ID NO: 314791 - DNA, 20 bp, Artificial Sequence
  chemically synthesized
tctttatcttggggagaggc

SEQ ID NO: 314792 - DNA, 20 bp, Artificial Sequence
  chemically synthesized
ataaaatccagcctctcccc

SEQ ID NO: 314793 - DNA, 20 bp, Artificial Sequence
  chemically synthesized
agggtctttatcttggggag

SEQ ID NO: 314794 - DNA, 20 bp, Artificial Sequence
  chemically synthesized
gagggtctttatcttgggga

SEQ ID NO: 314795 - DNA, 20 bp, Artificial Sequence
  chemically synthesized
ttgagggtctttatcttggg

SEQ ID NO: 314796 - DNA, 20 bp, Artificial Sequence
  chemically synthesized
tccagcctctccccaagata

SEQ ID NO: 314797 - DNA, 20 bp, Artificial Sequence
  chemically synthesized
tgttgagggtctttatcttg

SEQ ID NO: 314798 - DNA, 20 bp, Artificial Sequence
  chemically synthesized
ttgttgagggtctttatctt

SEQ ID NO: 314799 - DNA, 20 bp, Artificial Sequence
  chemically synthesized
gttgttgagggtctttatct

SEQ ID NO: 314800 - DNA, 20 bp, Artificial Sequence
  chemically synthesized
tttcaatgcctagttgttga

SEQ ID NO: 314801 - DNA, 20 bp, Artificial Sequence
  chemically synthesized
agataaagaccctcaacaac

SEQ ID NO: 314802 - DNA, 20 bp, Artificial Sequence
  chemically synthesized
ctttcaatgcctagttgttg

SEQ ID NO: 314803 - DNA, 20 bp, Artificial Sequence
  chemically synthesized
gataaagaccctcaacaact

SEQ ID NO: 314804 - DNA, 20 bp, Artificial Sequence
  chemically synthesized
tctttcaatgcctagttgtt

SEQ ID NO: 314805 - DNA, 20 bp, Artificial Sequence
  chemically synthesized
agatatgttctttcaatgcc

SEQ ID NO: 314806 - DNA, 20 bp, Artificial Sequence
  chemically synthesized
cctcaacaactaggcattga

SEQ ID NO: 314807 - DNA, 20 bp, Artificial Sequence
  chemically synthesized
tatatgacttttgttatttt

SEQ ID NO: 314808 - DNA, 20 bp, Artificial Sequence
  chemically synthesized
aacatatctcaaaataacaa

SEQ ID NO: 314809 - DNA, 20 bp, Artificial Sequence
  chemically synthesized
aaagtcatatatgacaaacc

SEQ ID NO: 314810 - DNA, 20 bp, Artificial Sequence
  chemically synthesized
agtcatatatgacaaaccaa

SEQ ID NO: 314811 - DNA, 20 bp, Artificial Sequence
  chemically synthesized
tttagtatgatgttggctct

SEQ ID NO: 314812 - DNA, 20 bp, Artificial Sequence
  chemically synthesized
gttcctgtttagtatgatgt

SEQ ID NO: 314813 - DNA, 20 bp, Artificial Sequence
  chemically synthesized
agagccaacatcatactaaa

SEQ ID NO: 314814 - DNA, 20 bp, Artificial Sequence
  chemically synthesized
gagccaacatcatactaaac

SEQ ID NO: 314815 - DNA, 20 bp, Artificial Sequence
  chemically synthesized
gctctcaacatgttcctgtt

SEQ ID NO: 314816 - DNA, 20 bp, Artificial Sequence
  chemically synthesized
atactaaacaggaacatgtt

SEQ ID NO: 314817 - DNA, 20 bp, Artificial Sequence
  chemically synthesized
actaaacaggaacatgttga

SEQ ID NO: 314818 - DNA, 20 bp, Artificial Sequence
  chemically synthesized
ttgtagttcttgggggaggg

SEQ ID NO: 314819 - DNA, 20 bp, Artificial Sequence
  chemically synthesized
gttgtagttcttgggggagg

SEQ ID NO: 314820 - DNA, 20 bp, Artificial Sequence
  chemically synthesized
tgagagcacccccctccccc

SEQ ID NO: 314821 - DNA, 20 bp, Artificial Sequence
  chemically synthesized
tgttgtagttcttgggggag

SEQ ID NO: 314822 - DNA, 20 bp, Artificial Sequence
  chemically synthesized
ttgttgtagttcttggggga

SEQ ID NO: 314823 - DNA, 20 bp, Artificial Sequence
  chemically synthesized
cttgttgtagttcttggggg

SEQ ID NO: 314824 - DNA, 20 bp, Artificial Sequence
  chemically synthesized
tcttgttgtagttcttgggg

SEQ ID NO: 314825 - DNA, 20 bp, Artificial Sequence
  chemically synthesized
tgtcttgttgtagttcttgg

SEQ ID NO: 314826 - DNA, 20 bp, Artificial Sequence
  chemically synthesized
ttgtcttgttgtagttcttg

SEQ ID NO: 314827 - DNA, 20 bp, Artificial Sequence
  chemically synthesized
cttgtcttgttgtagttctt

SEQ ID NO: 314828 - DNA, 20 bp, Artificial Sequence
  chemically synthesized
ccttgtcttgttgtagttct

SEQ ID NO: 314829 - DNA, 20 bp, Artificial Sequence
  chemically synthesized
cctcccccaagaactacaac

SEQ ID NO: 314830 - DNA, 20 bp, Artificial Sequence
  chemically synthesized
tgggtatccttgtcttgttg

SEQ ID NO: 314831 - DNA, 20 bp, Artificial Sequence
  chemically synthesized
cccaagaactacaacaagac

SEQ ID NO: 314832 - DNA, 20 bp, Artificial Sequence
  chemically synthesized
ccaagaactacaacaagaca

SEQ ID NO: 314833 - DNA, 20 bp, Artificial Sequence
  chemically synthesized
tgaattggagcagtgaaaat

SEQ ID NO: 314834 - DNA, 20 bp, Artificial Sequence
  chemically synthesized
ttgaattggagcagtgaaaa

SEQ ID NO: 314835 - DNA, 20 bp, Artificial Sequence
  chemically synthesized
agtactatgttgaattggag

SEQ ID NO: 314836 - DNA, 20 bp, Artificial Sequence
  chemically synthesized
tccagtactatgttgaattg

SEQ ID NO: 314837 - DNA, 20 bp, Artificial Sequence
  chemically synthesized
cttccagtactatgttgaat

SEQ ID NO: 314838 - DNA, 20 bp, Artificial Sequence
  chemically synthesized
ttcactgctccaattcaaca

SEQ ID NO: 314839 - DNA, 20 bp, Artificial Sequence
  chemically synthesized
gctccaattcaacatagtac

SEQ ID NO: 314840 - DNA, 20 bp, Artificial Sequence
  chemically synthesized
ccaattcaacatagtactgg

SEQ ID NO: 314841 - DNA, 20 bp, Artificial Sequence
  chemically synthesized
caacatagtactggaagtcc

SEQ ID NO: 314842 - DNA, 20 bp, Artificial Sequence
  chemically synthesized
attgctctagctaggacttc

SEQ ID NO: 314843 - DNA, 20 bp, Artificial Sequence
  chemically synthesized
atagtactggaagtcctagc

SEQ ID NO: 314844 - DNA, 20 bp, Artificial Sequence
  chemically synthesized
agtactggaagtcctagcta

SEQ ID NO: 314845 - DNA, 20 bp, Artificial Sequence
  chemically synthesized
cttgcctgattgctctagct

SEQ ID NO: 314846 - DNA, 20 bp, Artificial Sequence
  chemically synthesized
tcttgcctgattgctctagc

SEQ ID NO: 314847 - DNA, 20 bp, Artificial Sequence
  chemically synthesized
gaagtcctagctagagcaat

SEQ ID NO: 314848 - DNA, 20 bp, Artificial Sequence
  chemically synthesized
tttctcttgcctgattgctc

SEQ ID NO: 314849 - DNA, 20 bp, Artificial Sequence
  chemically synthesized
aagtcctagctagagcaatc

SEQ ID NO: 314850 - DNA, 20 bp, Artificial Sequence
  chemically synthesized
cctagctagagcaatcaggc

SEQ ID NO: 314851 - DNA, 20 bp, Artificial Sequence
  chemically synthesized
tagctagagcaatcaggcaa

SEQ ID NO: 314852 - DNA, 20 bp, Artificial Sequence
  chemically synthesized
tagagcaatcaggcaagaga

SEQ ID NO: 314853 - DNA, 20 bp, Artificial Sequence
  chemically synthesized
caggcaagagaaagaaataa

SEQ ID NO: 314854 - DNA, 20 bp, Artificial Sequence
  chemically synthesized
aggcaagagaaagaaataaa

SEQ ID NO: 314855 - DNA, 20 bp, Artificial Sequence
  chemically synthesized
gaaataaaaggcatccaaat

SEQ ID NO: 314856 - DNA, 20 bp, Artificial Sequence
  chemically synthesized
aaataaaaggcatccaaatt

SEQ ID NO: 314857 - DNA, 20 bp, Artificial Sequence
  chemically synthesized
tgactttctttttcccaatt

SEQ ID NO: 314858 - DNA, 20 bp, Artificial Sequence
  chemically synthesized
aaggcatccaaattgggaaa

SEQ ID NO: 314859 - DNA, 20 bp, Artificial Sequence
  chemically synthesized
catccaaattgggaaaaaga

SEQ ID NO: 314860 - DNA, 20 bp, Artificial Sequence
  chemically synthesized
aaaatcctatcatcagtgaa

SEQ ID NO: 314861 - DNA, 20 bp, Artificial Sequence
  chemically synthesized
gtaaaatcctatcatcagtg

SEQ ID NO: 314862 - DNA, 20 bp, Artificial Sequence
  chemically synthesized
tgatttctcttcactgatga

SEQ ID NO: 314863 - DNA, 20 bp, Artificial Sequence
  chemically synthesized
gatttctcttcactgatgat

SEQ ID NO: 314864 - DNA, 20 bp, Artificial Sequence
  chemically synthesized
tagatgtaaaatcctatcat

SEQ ID NO: 314865 - DNA, 20 bp, Artificial Sequence
  chemically synthesized
tgatgataggattttacatc

SEQ ID NO: 314866 - DNA, 20 bp, Artificial Sequence
  chemically synthesized
gaggagtcttaagggttttc

SEQ ID NO: 314867 - DNA, 20 bp, Artificial Sequence
  chemically synthesized
tttacatctagaaaaccctt

SEQ ID NO: 314868 - DNA, 20 bp, Artificial Sequence
  chemically synthesized
tccttttggaggagtcttaa

SEQ ID NO: 314869 - DNA, 20 bp, Artificial Sequence
  chemically synthesized
gtccttttggaggagtctta

SEQ ID NO: 314870 - DNA, 20 bp, Artificial Sequence
  chemically synthesized
ggtccttttggaggagtctt

SEQ ID NO: 314871 - DNA, 20 bp, Artificial Sequence
  chemically synthesized
aacccttaagactcctccaa

SEQ ID NO: 314872 - DNA, 20 bp, Artificial Sequence
  chemically synthesized
acccttaagactcctccaaa

SEQ ID NO: 314873 - DNA, 20 bp, Artificial Sequence
  chemically synthesized
aatatagggtccttttggag

SEQ ID NO: 314874 - DNA, 20 bp, Artificial Sequence
  chemically synthesized
caaatatagggtccttttgg

SEQ ID NO: 314875 - DNA, 20 bp, Artificial Sequence
  chemically synthesized
tcaaatatagggtccttttg

SEQ ID NO: 314876 - DNA, 20 bp, Artificial Sequence
  chemically synthesized
tatcaaatatagggtccttt

SEQ ID NO: 314877 - DNA, 20 bp, Artificial Sequence
  chemically synthesized
gaagtcatttatcaaatata

SEQ ID NO: 314878 - DNA, 20 bp, Artificial Sequence
  chemically synthesized
tgaagtcatttatcaaatat

SEQ ID NO: 314879 - DNA, 20 bp, Artificial Sequence
  chemically synthesized
ctgaagtcatttatcaaata

SEQ ID NO: 314880 - DNA, 20 bp, Artificial Sequence
  chemically synthesized
ctatatttgataaatgactt

SEQ ID NO: 314881 - DNA, 20 bp, Artificial Sequence
  chemically synthesized
tttgataaatgacttcagta

SEQ ID NO: 314882 - DNA, 20 bp, Artificial Sequence
  chemically synthesized
catatcctgaaactttactg

SEQ ID NO: 314883 - DNA, 20 bp, Artificial Sequence
  chemically synthesized
aaatgacttcagtaaagttt

SEQ ID NO: 314884 - DNA, 20 bp, Artificial Sequence
  chemically synthesized
aatgacttcagtaaagtttc

SEQ ID NO: 314885 - DNA, 20 bp, Artificial Sequence
  chemically synthesized
atgaaatcaatgtacaaaat

SEQ ID NO: 314886 - DNA, 20 bp, Artificial Sequence
  chemically synthesized
aaatcaatgtacaaaattgg

SEQ ID NO: 314887 - DNA, 20 bp, Artificial Sequence
  chemically synthesized
gcttgatcattattggtgta

SEQ ID NO: 314888 - DNA, 20 bp, Artificial Sequence
  chemically synthesized
gttctcagcttgatcattat

SEQ ID NO: 314889 - DNA, 20 bp, Artificial Sequence
  chemically synthesized
tctatacaccaataatgatc

SEQ ID NO: 314890 - DNA, 20 bp, Artificial Sequence
  chemically synthesized
acaccaataatgatcaagct

SEQ ID NO: 314891 - DNA, 20 bp, Artificial Sequence
  chemically synthesized
tgagttcttgatttggttct

SEQ ID NO: 314892 - DNA, 20 bp, Artificial Sequence
  chemically synthesized
atcaagctgagaaccaaatc

SEQ ID NO: 314893 - DNA, 20 bp, Artificial Sequence
  chemically synthesized
atgagattgagttcttgatt

SEQ ID NO: 314894 - DNA, 20 bp, Artificial Sequence
  chemically synthesized
tagttgttgtaaatgagatt

SEQ ID NO: 314895 - DNA, 20 bp, Artificial Sequence
  chemically synthesized
tttttgtagttgttgtaaat

SEQ ID NO: 314896 - DNA, 20 bp, Artificial Sequence
  chemically synthesized
ctaggtattttttttttttg

SEQ ID NO: 314897 - DNA, 20 bp, Artificial Sequence
  chemically synthesized
ctacaaaaaaaaaaaatacc

SEQ ID NO: 314898 - DNA, 20 bp, Artificial Sequence
  chemically synthesized
tacaaaaaaaaaaaatacct

SEQ ID NO: 314899 - DNA, 20 bp, Artificial Sequence
  chemically synthesized
ttttgtttaaaggcattcct

SEQ ID NO: 314900 - DNA, 20 bp, Artificial Sequence
  chemically synthesized
tttttgtttaaaggcattcc

SEQ ID NO: 314901 - DNA, 20 bp, Artificial Sequence
  chemically synthesized
cctttcacttttttgtttaa

SEQ ID NO: 314902 - DNA, 20 bp, Artificial Sequence
  chemically synthesized
acctttcacttttttgttta

SEQ ID NO: 314903 - DNA, 20 bp, Artificial Sequence
  chemically synthesized
aggaatgcctttaaacaaaa

SEQ ID NO: 314904 - DNA, 20 bp, Artificial Sequence
  chemically synthesized
gcctttaaacaaaaaagtga

SEQ ID NO: 314905 - DNA, 20 bp, Artificial Sequence
  chemically synthesized
cctttaaacaaaaaagtgaa

SEQ ID NO: 314906 - DNA, 20 bp, Artificial Sequence
  chemically synthesized
aaaaagtgaaaggtgtctac

SEQ ID NO: 314907 - DNA, 20 bp, Artificial Sequence
  chemically synthesized
aaaagtgaaaggtgtctaca

SEQ ID NO: 314908 - DNA, 20 bp, Artificial Sequence
  chemically synthesized
aagtgaaaggtgtctacaag

SEQ ID NO: 314909 - DNA, 20 bp, Artificial Sequence
  chemically synthesized
gtgttttgtagttctccttg

SEQ ID NO: 314910 - DNA, 20 bp, Artificial Sequence
  chemically synthesized
tttatttcatgggtgttttg

SEQ ID NO: 314911 - DNA, 20 bp, Artificial Sequence
  chemically synthesized
tcatctatgatttatttcat

SEQ ID NO: 314912 - DNA, 20 bp, Artificial Sequence
  chemically synthesized
gtcatctatgatttatttca

SEQ ID NO: 314913 - DNA, 20 bp, Artificial Sequence
  chemically synthesized
aacacccatgaaataaatca

SEQ ID NO: 314914 - DNA, 20 bp, Artificial Sequence
  chemically synthesized
tcatagatgacacaaacaaa

SEQ ID NO: 314915 - DNA, 20 bp, Artificial Sequence
  chemically synthesized
tcccaatccatgagcaggga

SEQ ID NO: 314916 - DNA, 20 bp, Artificial Sequence
  chemically synthesized
ggaaaaactttccctgctca

SEQ ID NO: 314917 - DNA, 20 bp, Artificial Sequence
  chemically synthesized
atgctcccaatccatgagca

SEQ ID NO: 314918 - DNA, 20 bp, Artificial Sequence
  chemically synthesized
gatgctcccaatccatgagc

SEQ ID NO: 314919 - DNA, 20 bp, Artificial Sequence
  chemically synthesized
tgatgctcccaatccatgag

SEQ ID NO: 314920 - DNA, 20 bp, Artificial Sequence
  chemically synthesized
aactttccctgctcatggat

SEQ ID NO: 314921 - DNA, 20 bp, Artificial Sequence
  chemically synthesized
actttccctgctcatggatt

SEQ ID NO: 314922 - DNA, 20 bp, Artificial Sequence
  chemically synthesized
tattgatgctcccaatccat

SEQ ID NO: 314923 - DNA, 20 bp, Artificial Sequence
  chemically synthesized
tttccctgctcatggattgg

SEQ ID NO: 314924 - DNA, 20 bp, Artificial Sequence
  chemically synthesized
gtaaattgctttgagcagtg

SEQ ID NO: 314925 - DNA, 20 bp, Artificial Sequence
  chemically synthesized
taaaataaccacactgctca

SEQ ID NO: 314926 - DNA, 20 bp, Artificial Sequence
  chemically synthesized
aatctgtaaattgctttgag

SEQ ID NO: 314927 - DNA, 20 bp, Artificial Sequence
  chemically synthesized
ttcaatctgtaaattgcttt

SEQ ID NO: 314928 - DNA, 20 bp, Artificial Sequence
  chemically synthesized
acactgctcaaagcaattta

SEQ ID NO: 314929 - DNA, 20 bp, Artificial Sequence
  chemically synthesized
agcaatttacagattgaaca

SEQ ID NO: 314930 - DNA, 20 bp, Artificial Sequence
  chemically synthesized
aatgatgttggtaatttata

SEQ ID NO: 314931 - DNA, 20 bp, Artificial Sequence
  chemically synthesized
aaatgatgttggtaatttat

SEQ ID NO: 314932 - DNA, 20 bp, Artificial Sequence
  chemically synthesized
aattctgtgaaaaatgatgt

SEQ ID NO: 314933 - DNA, 20 bp, Artificial Sequence
  chemically synthesized
attaccaacatcatttttca

SEQ ID NO: 314934 - DNA, 20 bp, Artificial Sequence
  chemically synthesized
aacatcatttttcacagaat

SEQ ID NO: 314935 - DNA, 20 bp, Artificial Sequence
  chemically synthesized
atttttcacagaattagaaa

SEQ ID NO: 314936 - DNA, 20 bp, Artificial Sequence
  chemically synthesized
ttcacagaattagaaaaaga

SEQ ID NO: 314937 - DNA, 20 bp, Artificial Sequence
  chemically synthesized
gaaaaagatagtaaaataca

SEQ ID NO: 314938 - DNA, 20 bp, Artificial Sequence
  chemically synthesized
aaaagatagtaaaatacata

SEQ ID NO: 314939 - DNA, 20 bp, Artificial Sequence
  chemically synthesized
aaatacatagagaatcaaaa

SEQ ID NO: 314940 - DNA, 20 bp, Artificial Sequence
  chemically synthesized
atacatagagaatcaaaaaa

SEQ ID NO: 314941 - DNA, 20 bp, Artificial Sequence
  chemically synthesized
gaatcaaaaaagagcccaaa

SEQ ID NO: 314942 - DNA, 20 bp, Artificial Sequence
  chemically synthesized
tagcattgctttgactattt

SEQ ID NO: 314943 - DNA, 20 bp, Artificial Sequence
  chemically synthesized
ttagcattgctttgactatt

SEQ ID NO: 314944 - DNA, 20 bp, Artificial Sequence
  chemically synthesized
aaaaagagcccaaatagtca

SEQ ID NO: 314945 - DNA, 20 bp, Artificial Sequence
  chemically synthesized
caaatagtcaaagcaatgct

SEQ ID NO: 314946 - DNA, 20 bp, Artificial Sequence
  chemically synthesized
tagtcaaagcaatgctaagc

SEQ ID NO: 314947 - DNA, 20 bp, Artificial Sequence
  chemically synthesized
tcaaagcaatgctaagcaag

SEQ ID NO: 314948 - DNA, 20 bp, Artificial Sequence
  chemically synthesized
tcaactttattcttcttgct

SEQ ID NO: 314949 - DNA, 20 bp, Artificial Sequence
  chemically synthesized
aatgctaagcaagaagaata

SEQ ID NO: 314950 - DNA, 20 bp, Artificial Sequence
  chemically synthesized
aagcaagaagaataaagttg

SEQ ID NO: 314951 - DNA, 20 bp, Artificial Sequence
  chemically synthesized
agcaagaagaataaagttga

SEQ ID NO: 314952 - DNA, 20 bp, Artificial Sequence
  chemically synthesized
ttttagtataatttgaagtc

SEQ ID NO: 314953 - DNA, 20 bp, Artificial Sequence
  chemically synthesized
cttttagtataatttgaagt

SEQ ID NO: 314954 - DNA, 20 bp, Artificial Sequence
  chemically synthesized
tagccttttagtataatttg

SEQ ID NO: 314955 - DNA, 20 bp, Artificial Sequence
  chemically synthesized
ctgacttcaaattatactaa

SEQ ID NO: 314956 - DNA, 20 bp, Artificial Sequence
  chemically synthesized
tgacttcaaattatactaaa

SEQ ID NO: 314957 - DNA, 20 bp, Artificial Sequence
  chemically synthesized
ttttggttactgtagccttt

SEQ ID NO: 314958 - DNA, 20 bp, Artificial Sequence
  chemically synthesized
caaattatactaaaaggcta

SEQ ID NO: 314959 - DNA, 20 bp, Artificial Sequence
  chemically synthesized
ccatactgttttggttactg

SEQ ID NO: 314960 - DNA, 20 bp, Artificial Sequence
  chemically synthesized
aaaggctacagtaaccaaaa

SEQ ID NO: 314961 - DNA, 20 bp, Artificial Sequence
  chemically synthesized
ataccagtaccatactgttt

SEQ ID NO: 314962 - DNA, 20 bp, Artificial Sequence
  chemically synthesized
ctacagtaaccaaaacagta

SEQ ID NO: 314963 - DNA, 20 bp, Artificial Sequence
  chemically synthesized
taaccaaaacagtatggtac

SEQ ID NO: 314964 - DNA, 20 bp, Artificial Sequence
  chemically synthesized
atatgtatctgtttttatac

SEQ ID NO: 314965 - DNA, 20 bp, Artificial Sequence
  chemically synthesized
gtatggtactggtataaaaa

SEQ ID NO: 314966 - DNA, 20 bp, Artificial Sequence
  chemically synthesized
ggtataaaaacagatacata

SEQ ID NO: 314967 - DNA, 20 bp, Artificial Sequence
  chemically synthesized
tagattgatttaaccaaatt

SEQ ID NO: 314968 - DNA, 20 bp, Artificial Sequence
  chemically synthesized
ttatatctgggttcttaatt

SEQ ID NO: 314969 - DNA, 20 bp, Artificial Sequence
  chemically synthesized
atttaaccaaattaagaacc

SEQ ID NO: 314970 - DNA, 20 bp, Artificial Sequence
  chemically synthesized
agatatgtggttttatatct

SEQ ID NO: 314971 - DNA, 20 bp, Artificial Sequence
  chemically synthesized
tagatatgtggttttatatc

SEQ ID NO: 314972 - DNA, 20 bp, Artificial Sequence
  chemically synthesized
atgtgttggtcatagatatg

SEQ ID NO: 314973 - DNA, 20 bp, Artificial Sequence
  chemically synthesized
tgttaaagatgtgttggtca

SEQ ID NO: 314974 - DNA, 20 bp, Artificial Sequence
  chemically synthesized
ttactttgttaaagatgtgt

SEQ ID NO: 314975 - DNA, 20 bp, Artificial Sequence
  chemically synthesized
tgaccaacacatctttaaca

SEQ ID NO: 314976 - DNA, 20 bp, Artificial Sequence
  chemically synthesized
tacatttttttactttgtta

SEQ ID NO: 314977 - DNA, 20 bp, Artificial Sequence
  chemically synthesized
aaaaaaatgtatatatacac

SEQ ID NO: 314978 - DNA, 20 bp, Artificial Sequence
  chemically synthesized
aaaaaatgtatatatacact

SEQ ID NO: 314979 - DNA, 20 bp, Artificial Sequence
  chemically synthesized
aaaaatgtatatatacactg

SEQ ID NO: 314980 - DNA, 20 bp, Artificial Sequence
  chemically synthesized
atgtatatatacactgggga

SEQ ID NO: 314981 - DNA, 20 bp, Artificial Sequence
  chemically synthesized
tgtatatatacactggggaa

SEQ ID NO: 314982 - DNA, 20 bp, Artificial Sequence
  chemically synthesized
tgaataggatgtcctttccc

SEQ ID NO: 314983 - DNA, 20 bp, Artificial Sequence
  chemically synthesized
tggggaaaggacatcctatt

SEQ ID NO: 314984 - DNA, 20 bp, Artificial Sequence
  chemically synthesized
tacagcacaatttactgaat

SEQ ID NO: 314985 - DNA, 20 bp, Artificial Sequence
  chemically synthesized
ttacagcacaatttactgaa

SEQ ID NO: 314986 - DNA, 20 bp, Artificial Sequence
  chemically synthesized
gtaaattgtgctgtaaatat

SEQ ID NO: 314987 - DNA, 20 bp, Artificial Sequence
  chemically synthesized
ttatgactatccaatattta

SEQ ID NO: 314988 - DNA, 20 bp, Artificial Sequence
  chemically synthesized
attgtgctgtaaatattgga

SEQ ID NO: 314989 - DNA, 20 bp, Artificial Sequence
  chemically synthesized
tgtaaatattggatagtcat

SEQ ID NO: 314990 - DNA, 20 bp, Artificial Sequence
  chemically synthesized
aaatattggatagtcataag

SEQ ID NO: 314991 - DNA, 20 bp, Artificial Sequence
  chemically synthesized
tattggatagtcataagcag

SEQ ID NO: 314992 - DNA, 20 bp, Artificial Sequence
  chemically synthesized
cataagcagaagaatgaaac

SEQ ID NO: 314993 - DNA, 20 bp, Artificial Sequence
  chemically synthesized
ataagcagaagaatgaaact

SEQ ID NO: 314994 - DNA, 20 bp, Artificial Sequence
  chemically synthesized
gtatatggtgatttatgacc

SEQ ID NO: 314995 - DNA, 20 bp, Artificial Sequence
  chemically synthesized
tttgagttaatttttgtata

SEQ ID NO: 314996 - DNA, 20 bp, Artificial Sequence
  chemically synthesized
ttaagtctttaatacatttt

SEQ ID NO: 314997 - DNA, 20 bp, Artificial Sequence
  chemically synthesized
aattaactcaaaatgtatta

SEQ ID NO: 314998 - DNA, 20 bp, Artificial Sequence
  chemically synthesized
tgtattaaagacttaaatgt

SEQ ID NO: 314999 - DNA, 20 bp, Artificial Sequence
  chemically synthesized
tattttcaggtcttacattt

SEQ ID NO: 315000 - DNA, 20 bp, Artificial Sequence
  chemically synthesized
tttaggatttttatattttc

SEQ ID NO: 315001 - DNA, 20 bp, Artificial Sequence
  chemically synthesized
ttttaggatttttatatttt

SEQ ID NO: 315002 - DNA, 20 bp, Artificial Sequence
  chemically synthesized
tgaaaatataaaaatcctaa

SEQ ID NO: 315003 - DNA, 20 bp, Artificial Sequence
  chemically synthesized
tttttcctaggttttctttt

SEQ ID NO: 315004 - DNA, 20 bp, Artificial Sequence
  chemically synthesized
gtttttcctaggttttcttt

SEQ ID NO: 315005 - DNA, 20 bp, Artificial Sequence
  chemically synthesized
aaaaatcctaaaagaaaacc

SEQ ID NO: 315006 - DNA, 20 bp, Artificial Sequence
  chemically synthesized
aaaatcctaaaagaaaacct

SEQ ID NO: 315007 - DNA, 20 bp, Artificial Sequence
  chemically synthesized
tgtcgagaagagtttttcct

SEQ ID NO: 315008 - DNA, 20 bp, Artificial Sequence
  chemically synthesized
gtgtcgagaagagtttttcc

SEQ ID NO: 315009 - DNA, 20 bp, Artificial Sequence
  chemically synthesized
gcccaagccagtgtcgagaa

SEQ ID NO: 315010 - DNA, 20 bp, Artificial Sequence
  chemically synthesized
ttgcccaagccagtgtcgag

SEQ ID NO: 315011 - DNA, 20 bp, Artificial Sequence
  chemically synthesized
ggaaaaactcttctcgacac

SEQ ID NO: 315012 - DNA, 20 bp, Artificial Sequence
  chemically synthesized
tctttgcccaagccagtgtc

SEQ ID NO: 315013 - DNA, 20 bp, Artificial Sequence
  chemically synthesized
aactcttctcgacactggct

SEQ ID NO: 315014 - DNA, 20 bp, Artificial Sequence
  chemically synthesized
actcttctcgacactggctt

SEQ ID NO: 315015 - DNA, 20 bp, Artificial Sequence
  chemically synthesized
cataaattctttgcccaagc

SEQ ID NO: 315016 - DNA, 20 bp, Artificial Sequence
  chemically synthesized
tctcgacactggcttgggca

SEQ ID NO: 315017 - DNA, 20 bp, Artificial Sequence
  chemically synthesized
tagtcataaattctttgccc

SEQ ID NO: 315018 - DNA, 20 bp, Artificial Sequence
  chemically synthesized
tgggcaaagaatttatgact

SEQ ID NO: 315019 - DNA, 20 bp, Artificial Sequence
  chemically synthesized
tacttttgtttttgagtact

SEQ ID NO: 315020 - DNA, 20 bp, Artificial Sequence
  chemically synthesized
atttgtctacttttgttttt

SEQ ID NO: 315021 - DNA, 20 bp, Artificial Sequence
  chemically synthesized
gactaagtactcaaaaacaa

SEQ ID NO: 315022 - DNA, 20 bp, Artificial Sequence
  chemically synthesized
taagtactcaaaaacaaaag

SEQ ID NO: 315023 - DNA, 20 bp, Artificial Sequence
  chemically synthesized
caaaaacaaaagtagacaaa

SEQ ID NO: 315024 - DNA, 20 bp, Artificial Sequence
  chemically synthesized
gttcagaagattttaaaatt

SEQ ID NO: 315025 - DNA, 20 bp, Artificial Sequence
  chemically synthesized
taattttaaaatcttctgaa

SEQ ID NO: 315026 - DNA, 20 bp, Artificial Sequence
  chemically synthesized
tgtttgtttttgctgttcag

SEQ ID NO: 315027 - DNA, 20 bp, Artificial Sequence
  chemically synthesized
gtttgtttgtttttgctgtt

SEQ ID NO: 315028 - DNA, 20 bp, Artificial Sequence
  chemically synthesized
aaaaaacaaaaaacaatcaa

SEQ ID NO: 315029 - DNA, 20 bp, Artificial Sequence
  chemically synthesized
aaaacaatcaacagaatgaa

SEQ ID NO: 315030 - DNA, 20 bp, Artificial Sequence
  chemically synthesized
cagaatgaacagacaactta

SEQ ID NO: 315031 - DNA, 20 bp, Artificial Sequence
  chemically synthesized
tgaacagacaacttatagaa

SEQ ID NO: 315032 - DNA, 20 bp, Artificial Sequence
  chemically synthesized
ggaattgttttccattctat

SEQ ID NO: 315033 - DNA, 20 bp, Artificial Sequence
  chemically synthesized
tttttgttagatgtatagtt

SEQ ID NO: 315034 - DNA, 20 bp, Artificial Sequence
  chemically synthesized
ttagttttttgttagatgta

SEQ ID NO: 315035 - DNA, 20 bp, Artificial Sequence
  chemically synthesized
tctagatattagttttttgt

SEQ ID NO: 315036 - DNA, 20 bp, Artificial Sequence
  chemically synthesized
tctaacaaaaaactaatatc

SEQ ID NO: 315037 - DNA, 20 bp, Artificial Sequence
  chemically synthesized
tacttttagattctagatat

SEQ ID NO: 315038 - DNA, 20 bp, Artificial Sequence
  chemically synthesized
gttgagttacttttagattc

SEQ ID NO: 315039 - DNA, 20 bp, Artificial Sequence
  chemically synthesized
aactaatatctagaatctaa

SEQ ID NO: 315040 - DNA, 20 bp, Artificial Sequence
  chemically synthesized
tcttcttgttgagttacttt

SEQ ID NO: 315041 - DNA, 20 bp, Artificial Sequence
  chemically synthesized
gaatctaaaagtaactcaac

SEQ ID NO: 315042 - DNA, 20 bp, Artificial Sequence
  chemically synthesized
tctaaaagtaactcaacaag

SEQ ID NO: 315043 - DNA, 20 bp, Artificial Sequence
  chemically synthesized
tatctatttttcttcttgtt

SEQ ID NO: 315044 - DNA, 20 bp, Artificial Sequence
  chemically synthesized
taactcaacaagaagaaaaa

SEQ ID NO: 315045 - DNA, 20 bp, Artificial Sequence
  chemically synthesized
aaatagataaccccattaaa

SEQ ID NO: 315046 - DNA, 20 bp, Artificial Sequence
  chemically synthesized
cctttgcctactttttaatg

SEQ ID NO: 315047 - DNA, 20 bp, Artificial Sequence
  chemically synthesized
tcctttgcctactttttaat

SEQ ID NO: 315048 - DNA, 20 bp, Artificial Sequence
  chemically synthesized
gtcctttgcctactttttaa

SEQ ID NO: 315049 - DNA, 20 bp, Artificial Sequence
  chemically synthesized
tagataaccccattaaaaag

SEQ ID NO: 315050 - DNA, 20 bp, Artificial Sequence
  chemically synthesized
agataaccccattaaaaagt

SEQ ID NO: 315051 - DNA, 20 bp, Artificial Sequence
  chemically synthesized
accccattaaaaagtaggca

SEQ ID NO: 315052 - DNA, 20 bp, Artificial Sequence
  chemically synthesized
ccccattaaaaagtaggcaa

SEQ ID NO: 315053 - DNA, 20 bp, Artificial Sequence
  chemically synthesized
aaaaagtaggcaaaggacat

SEQ ID NO: 315054 - DNA, 20 bp, Artificial Sequence
  chemically synthesized
aagtaggcaaaggacattag

SEQ ID NO: 315055 - DNA, 20 bp, Artificial Sequence
  chemically synthesized
cattagcagacattttttaa

SEQ ID NO: 315056 - DNA, 20 bp, Artificial Sequence
  chemically synthesized
tagcagacattttttaaaag

SEQ ID NO: 315057 - DNA, 20 bp, Artificial Sequence
  chemically synthesized
ttttttaaaagaagatatac

SEQ ID NO: 315058 - DNA, 20 bp, Artificial Sequence
  chemically synthesized
tttaaaagaagatatacaag

SEQ ID NO: 315059 - DNA, 20 bp, Artificial Sequence
  chemically synthesized
gcattttctcatatgtttgt

SEQ ID NO: 315060 - DNA, 20 bp, Artificial Sequence
  chemically synthesized
caagtggccaacaaacatat

SEQ ID NO: 315061 - DNA, 20 bp, Artificial Sequence
  chemically synthesized
ctctgatgattagtgatgtt

SEQ ID NO: 315062 - DNA, 20 bp, Artificial Sequence
  chemically synthesized
tgctcaacatcactaatcat

SEQ ID NO: 315063 - DNA, 20 bp, Artificial Sequence
  chemically synthesized
ctcaacatcactaatcatca

SEQ ID NO: 315064 - DNA, 20 bp, Artificial Sequence
  chemically synthesized
atttgcatttctctgatgat

SEQ ID NO: 315065 - DNA, 20 bp, Artificial Sequence
  chemically synthesized
gaaatgcaaattaaaaccac

SEQ ID NO: 315066 - DNA, 20 bp, Artificial Sequence
  chemically synthesized
aaatgcaaattaaaaccaca

SEQ ID NO: 315067 - DNA, 20 bp, Artificial Sequence
  chemically synthesized
atgcaaattaaaaccacaag

SEQ ID NO: 315068 - DNA, 20 bp, Artificial Sequence
  chemically synthesized
tgtgagatcatatctccttg

SEQ ID NO: 315069 - DNA, 20 bp, Artificial Sequence
  chemically synthesized
atagccatactgattggtgt

SEQ ID NO: 315070 - DNA, 20 bp, Artificial Sequence
  chemically synthesized
agatatgatctcacaccaat

SEQ ID NO: 315071 - DNA, 20 bp, Artificial Sequence
  chemically synthesized
tgatctcacaccaatcagta

SEQ ID NO: 315072 - DNA, 20 bp, Artificial Sequence
  chemically synthesized
caaataatagccatactgat

SEQ ID NO: 315073 - DNA, 20 bp, Artificial Sequence
  chemically synthesized
acattgaaaaaaacaaataa

SEQ ID NO: 315074 - DNA, 20 bp, Artificial Sequence
  chemically synthesized
caatgtcatttaaaaatttg

SEQ ID NO: 315075 - DNA, 20 bp, Artificial Sequence
  chemically synthesized
aatgtcatttaaaaatttgt

SEQ ID NO: 315076 - DNA, 20 bp, Artificial Sequence
  chemically synthesized
catttaaaaatttgtgggta

SEQ ID NO: 315077 - DNA, 20 bp, Artificial Sequence
  chemically synthesized
tttaaaaatttgtgggtaca

SEQ ID NO: 315078 - DNA, 20 bp, Artificial Sequence
  chemically synthesized
aaaaatttgtgggtacagag

SEQ ID NO: 315079 - DNA, 20 bp, Artificial Sequence
  chemically synthesized
aaaatttgtgggtacagagt

SEQ ID NO: 315080 - DNA, 20 bp, Artificial Sequence
  chemically synthesized
gtacagagtaggtgtatttg

SEQ ID NO: 315081 - DNA, 20 bp, Artificial Sequence
  chemically synthesized
tacagagtaggtgtatttgt

SEQ ID NO: 315082 - DNA, 20 bp, Artificial Sequence
  chemically synthesized
acagagtaggtgtatttgtg

SEQ ID NO: 315083 - DNA, 20 bp, Artificial Sequence
  chemically synthesized
ggtgtatttgtggggtacat

SEQ ID NO: 315084 - DNA, 20 bp, Artificial Sequence
  chemically synthesized
gtacatgagatgttttgata

SEQ ID NO: 315085 - DNA, 20 bp, Artificial Sequence
  chemically synthesized
tacatgagatgttttgatac

SEQ ID NO: 315086 - DNA, 20 bp, Artificial Sequence
  chemically synthesized
tgttttgatacaggcatgca

SEQ ID NO: 315087 - DNA, 20 bp, Artificial Sequence
  chemically synthesized
aaagtgaaataatcacatca

SEQ ID NO: 315088 - DNA, 20 bp, Artificial Sequence
  chemically synthesized
agtgaaataatcacatcatg

SEQ ID NO: 315089 - DNA, 20 bp, Artificial Sequence
  chemically synthesized
taatcacatcatggagaatt

SEQ ID NO: 315090 - DNA, 20 bp, Artificial Sequence
  chemically synthesized
aatttagtatctatcacctt

SEQ ID NO: 315091 - DNA, 20 bp, Artificial Sequence
  chemically synthesized
aggacaaatgcttaaggtga

SEQ ID NO: 315092 - DNA, 20 bp, Artificial Sequence
  chemically synthesized
agacaaaggacaaatgctta

SEQ ID NO: 315093 - DNA, 20 bp, Artificial Sequence
  chemically synthesized
aagacaaaggacaaatgctt

SEQ ID NO: 315094 - DNA, 20 bp, Artificial Sequence
  chemically synthesized
ttaggttgcttgtaagacaa

SEQ ID NO: 315095 - DNA, 20 bp, Artificial Sequence
  chemically synthesized
attaggttgcttgtaagaca

SEQ ID NO: 315096 - DNA, 20 bp, Artificial Sequence
  chemically synthesized
gcatttgtcctttgtcttac

SEQ ID NO: 315097 - DNA, 20 bp, Artificial Sequence
  chemically synthesized
catataattaggttgcttgt

SEQ ID NO: 315098 - DNA, 20 bp, Artificial Sequence
  chemically synthesized
aactgtgaaagcatataatt

SEQ ID NO: 315099 - DNA, 20 bp, Artificial Sequence
  chemically synthesized
taactgtgaaagcatataat

SEQ ID NO: 315100 - DNA, 20 bp, Artificial Sequence
  chemically synthesized
aacctaattatatgctttca

SEQ ID NO: 315101 - DNA, 20 bp, Artificial Sequence
  chemically synthesized
acattttacaataactgtga

SEQ ID NO: 315102 - DNA, 20 bp, Artificial Sequence
  chemically synthesized
acagttattgtaaaatgtac

SEQ ID NO: 315103 - DNA, 20 bp, Artificial Sequence
  chemically synthesized
gtacaagttattattgacca

SEQ ID NO: 315104 - DNA, 20 bp, Artificial Sequence
  chemically synthesized
atcatatcatacagtaacta

SEQ ID NO: 315105 - DNA, 20 bp, Artificial Sequence
  chemically synthesized
taatatttgatcatatcata

SEQ ID NO: 315106 - DNA, 20 bp, Artificial Sequence
  chemically synthesized
ttacagttagaaagaatgaa

SEQ ID NO: 315107 - DNA, 20 bp, Artificial Sequence
  chemically synthesized
gtacaaaaattacagttaga

SEQ ID NO: 315108 - DNA, 20 bp, Artificial Sequence
  chemically synthesized
ttgggtacaaaaattacagt

SEQ ID NO: 315109 - DNA, 20 bp, Artificial Sequence
  chemically synthesized
gttattgggtacaaaaatta

SEQ ID NO: 315110 - DNA, 20 bp, Artificial Sequence
  chemically synthesized
gggaggtggggatggttatt

SEQ ID NO: 315111 - DNA, 20 bp, Artificial Sequence
  chemically synthesized
agggaggtggggatggttat

SEQ ID NO: 315112 - DNA, 20 bp, Artificial Sequence
  chemically synthesized
tggtggaagggaggtgggga

SEQ ID NO: 315113 - DNA, 20 bp, Artificial Sequence
  chemically synthesized
agggtggtggaagggaggtg

SEQ ID NO: 315114 - DNA, 20 bp, Artificial Sequence
  chemically synthesized
aagggtggtggaagggaggt

SEQ ID NO: 315115 - DNA, 20 bp, Artificial Sequence
  chemically synthesized
gaagggtggtggaagggagg

SEQ ID NO: 315116 - DNA, 20 bp, Artificial Sequence
  chemically synthesized
tgggaagggtggtggaaggg

SEQ ID NO: 315117 - DNA, 20 bp, Artificial Sequence
  chemically synthesized
ctgggaagggtggtggaagg

SEQ ID NO: 315118 - DNA, 20 bp, Artificial Sequence
  chemically synthesized
gactgggaagggtggtggaa

SEQ ID NO: 315119 - DNA, 20 bp, Artificial Sequence
  chemically synthesized
agactgggaagggtggtgga

SEQ ID NO: 315120 - DNA, 20 bp, Artificial Sequence
  chemically synthesized
gagactgggaagggtggtgg

SEQ ID NO: 315121 - DNA, 20 bp, Artificial Sequence
  chemically synthesized
tcagagactgggaagggtgg

SEQ ID NO: 315122 - DNA, 20 bp, Artificial Sequence
  chemically synthesized
ctcccttccaccacccttcc

SEQ ID NO: 315123 - DNA, 20 bp, Artificial Sequence
  chemically synthesized
ttatcagagactgggaaggg

SEQ ID NO: 315124 - DNA, 20 bp, Artificial Sequence
  chemically synthesized
tggttatcagagactgggaa

SEQ ID NO: 315125 - DNA, 20 bp, Artificial Sequence
  chemically synthesized
atggttatcagagactggga

SEQ ID NO: 315126 - DNA, 20 bp, Artificial Sequence
  chemically synthesized
gatggttatcagagactggg

SEQ ID NO: 315127 - DNA, 20 bp, Artificial Sequence
  chemically synthesized
aaggatggttatcagagact

SEQ ID NO: 315128 - DNA, 20 bp, Artificial Sequence
  chemically synthesized
gaaggatggttatcagagac

SEQ ID NO: 315129 - DNA, 20 bp, Artificial Sequence
  chemically synthesized
gagtagaaggatggttatca

SEQ ID NO: 315130 - DNA, 20 bp, Artificial Sequence
  chemically synthesized
gagagtagaaggatggttat

SEQ ID NO: 315131 - DNA, 20 bp, Artificial Sequence
  chemically synthesized
ggaaatagagagtagaagga

SEQ ID NO: 315132 - DNA, 20 bp, Artificial Sequence
  chemically synthesized
tcatggaaatagagagtaga

SEQ ID NO: 315133 - DNA, 20 bp, Artificial Sequence
  chemically synthesized
gtcatggaaatagagagtag

SEQ ID NO: 315134 - DNA, 20 bp, Artificial Sequence
  chemically synthesized
gaagtcatggaaatagagag

SEQ ID NO: 315135 - DNA, 20 bp, Artificial Sequence
  chemically synthesized
attgaagtcatggaaataga

SEQ ID NO: 315136 - DNA, 20 bp, Artificial Sequence
  chemically synthesized
caattgaagtcatggaaata

SEQ ID NO: 315137 - DNA, 20 bp, Artificial Sequence
  chemically synthesized
aacaattgaagtcatggaaa

SEQ ID NO: 315138 - DNA, 20 bp, Artificial Sequence
  chemically synthesized
aattaaaacaattgaagtca

SEQ ID NO: 315139 - DNA, 20 bp, Artificial Sequence
  chemically synthesized
tctaaaaattaaaacaattg

SEQ ID NO: 315140 - DNA, 20 bp, Artificial Sequence
  chemically synthesized
acttcaattgttttaatttt

SEQ ID NO: 315141 - DNA, 20 bp, Artificial Sequence
  chemically synthesized
aatttttagatcccacaaat

SEQ ID NO: 315142 - DNA, 20 bp, Artificial Sequence
  chemically synthesized
ttatgttctgacttatttgt

SEQ ID NO: 315143 - DNA, 20 bp, Artificial Sequence
  chemically synthesized
cttatgttctgacttatttg

SEQ ID NO: 315144 - DNA, 20 bp, Artificial Sequence
  chemically synthesized
tttagatcccacaaataagt

SEQ ID NO: 315145 - DNA, 20 bp, Artificial Sequence
  chemically synthesized
ccacaaataagtcagaacat

SEQ ID NO: 315146 - DNA, 20 bp, Artificial Sequence
  chemically synthesized
acaaataagtcagaacataa

SEQ ID NO: 315147 - DNA, 20 bp, Artificial Sequence
  chemically synthesized
tgaaataagccaggcacaga

SEQ ID NO: 315148 - DNA, 20 bp, Artificial Sequence
  chemically synthesized
gatgtttgtctttctgtgcc

SEQ ID NO: 315149 - DNA, 20 bp, Artificial Sequence
  chemically synthesized
taagtgaaataagccaggca

SEQ ID NO: 315150 - DNA, 20 bp, Artificial Sequence
  chemically synthesized
tatgttaagtgaaataagcc

SEQ ID NO: 315151 - DNA, 20 bp, Artificial Sequence
  chemically synthesized
ttatgttaagtgaaataagc

SEQ ID NO: 315152 - DNA, 20 bp, Artificial Sequence
  chemically synthesized
atcgttatgttaagtgaaat

SEQ ID NO: 315153 - DNA, 20 bp, Artificial Sequence
  chemically synthesized
gaactagagatcgttatgtt

SEQ ID NO: 315154 - DNA, 20 bp, Artificial Sequence
  chemically synthesized
tcacttaacataacgatctc

SEQ ID NO: 315155 - DNA, 20 bp, Artificial Sequence
  chemically synthesized
gaacaatgtggatggaacta

SEQ ID NO: 315156 - DNA, 20 bp, Artificial Sequence
  chemically synthesized
tggaacaatgtggatggaac

SEQ ID NO: 315157 - DNA, 20 bp, Artificial Sequence
  chemically synthesized
gtcatttggaacaatgtgga

SEQ ID NO: 315158 - DNA, 20 bp, Artificial Sequence
  chemically synthesized
tactgtcatttggaacaatg

SEQ ID NO: 315159 - DNA, 20 bp, Artificial Sequence
  chemically synthesized
atccacattgttccaaatga

SEQ ID NO: 315160 - DNA, 20 bp, Artificial Sequence
  chemically synthesized
aaaaatgagatactgtcatt

SEQ ID NO: 315161 - DNA, 20 bp, Artificial Sequence
  chemically synthesized
aggtatccccttaaaaaaat

SEQ ID NO: 315162 - DNA, 20 bp, Artificial Sequence
  chemically synthesized
tgacagtatctcattttttt

SEQ ID NO: 315163 - DNA, 20 bp, Artificial Sequence
  chemically synthesized
gacagtatctcattttttta

SEQ ID NO: 315164 - DNA, 20 bp, Artificial Sequence
  chemically synthesized
acagtatctcatttttttaa

SEQ ID NO: 315165 - DNA, 20 bp, Artificial Sequence
  chemically synthesized
cagtatctcatttttttaag

SEQ ID NO: 315166 - DNA, 20 bp, Artificial Sequence
  chemically synthesized
tgtttgacttttttaatgac

SEQ ID NO: 315167 - DNA, 20 bp, Artificial Sequence
  chemically synthesized
ttgtttgacttttttaatga

SEQ ID NO: 315168 - DNA, 20 bp, Artificial Sequence
  chemically synthesized
ggggatacctgtcattaaaa

SEQ ID NO: 315169 - DNA, 20 bp, Artificial Sequence
  chemically synthesized
ttaaaaaagtcaaacaacaa

SEQ ID NO: 315170 - DNA, 20 bp, Artificial Sequence
  chemically synthesized
taaaaaagtcaaacaacaac

SEQ ID NO: 315171 - DNA, 20 bp, Artificial Sequence
  chemically synthesized
agtcaaacaacaacaggtgt

SEQ ID NO: 315172 - DNA, 20 bp, Artificial Sequence
  chemically synthesized
aaacaacaacaggtgttggc

SEQ ID NO: 315173 - DNA, 20 bp, Artificial Sequence
  chemically synthesized
aacaacaacaggtgttggca

SEQ ID NO: 315174 - DNA, 20 bp, Artificial Sequence
  chemically synthesized
aacaggtgttggcaaggatg

SEQ ID NO: 315175 - DNA, 20 bp, Artificial Sequence
  chemically synthesized
caggtgttggcaaggatgtg

SEQ ID NO: 315176 - DNA, 20 bp, Artificial Sequence
  chemically synthesized
gttggcaaggatgtggagaa

SEQ ID NO: 315177 - DNA, 20 bp, Artificial Sequence
  chemically synthesized
agaaaatgtttattcactct

SEQ ID NO: 315178 - DNA, 20 bp, Artificial Sequence
  chemically synthesized
aaatgtttattcactcttgg

SEQ ID NO: 315179 - DNA, 20 bp, Artificial Sequence
  chemically synthesized
aatgtttattcactcttggt

SEQ ID NO: 315180 - DNA, 20 bp, Artificial Sequence
  chemically synthesized
ttaacttacattcccaccaa

SEQ ID NO: 315181 - DNA, 20 bp, Artificial Sequence
  chemically synthesized
tattaacttacattcccacc

SEQ ID NO: 315182 - DNA, 20 bp, Artificial Sequence
  chemically synthesized
ttcactcttggtgggaatgt

SEQ ID NO: 315183 - DNA, 20 bp, Artificial Sequence
  chemically synthesized
aatataaacattatgtaaaa

SEQ ID NO: 315184 - DNA, 20 bp, Artificial Sequence
  chemically synthesized
aaacattatgtaaaacagta

SEQ ID NO: 315185 - DNA, 20 bp, Artificial Sequence
  chemically synthesized
acattatgtaaaacagtatg

SEQ ID NO: 315186 - DNA, 20 bp, Artificial Sequence
  chemically synthesized
aacagtatggagatttctca

SEQ ID NO: 315187 - DNA, 20 bp, Artificial Sequence
  chemically synthesized
agttgtgttttaagttcttt

SEQ ID NO: 315188 - DNA, 20 bp, Artificial Sequence
  chemically synthesized
ggatccaatagttgtgtttt

SEQ ID NO: 315189 - DNA, 20 bp, Artificial Sequence
  chemically synthesized
agaacttaaaacacaactat

SEQ ID NO: 315190 - DNA, 20 bp, Artificial Sequence
  chemically synthesized
actaggattgcaggatccaa

SEQ ID NO: 315191 - DNA, 20 bp, Artificial Sequence
  chemically synthesized
actattggatcctgcaatcc

SEQ ID NO: 315192 - DNA, 20 bp, Artificial Sequence
  chemically synthesized
atacccagtactaggattgc

SEQ ID NO: 315193 - DNA, 20 bp, Artificial Sequence
  chemically synthesized
tatacccagtactaggattg

SEQ ID NO: 315194 - DNA, 20 bp, Artificial Sequence
  chemically synthesized
ggatcctgcaatcctagtac

SEQ ID NO: 315195 - DNA, 20 bp, Artificial Sequence
  chemically synthesized
gatcctgcaatcctagtact

SEQ ID NO: 315196 - DNA, 20 bp, Artificial Sequence
  chemically synthesized
ttgagtatatacccagtact

SEQ ID NO: 315197 - DNA, 20 bp, Artificial Sequence
  chemically synthesized
gttgagtatatacccagtac

SEQ ID NO: 315198 - DNA, 20 bp, Artificial Sequence
  chemically synthesized
gtttttgttgagtatatacc

SEQ ID NO: 315199 - DNA, 20 bp, Artificial Sequence
  chemically synthesized
cactttttgttgtttttgtt

SEQ ID NO: 315200 - DNA, 20 bp, Artificial Sequence
  chemically synthesized
tactcaacaaaaacaacaaa

SEQ ID NO: 315201 - DNA, 20 bp, Artificial Sequence
  chemically synthesized
acaaaaagtgttacatgaaa

SEQ ID NO: 315202 - DNA, 20 bp, Artificial Sequence
  chemically synthesized
ttacatgaaaaagctacctg

SEQ ID NO: 315203 - DNA, 20 bp, Artificial Sequence
  chemically synthesized
gataaacatacaactgcagg

SEQ ID NO: 315204 - DNA, 20 bp, Artificial Sequence
  chemically synthesized
tatgataaacatacaactgc

SEQ ID NO: 315205 - DNA, 20 bp, Artificial Sequence
  chemically synthesized
ctatgataaacatacaactg

SEQ ID NO: 315206 - DNA, 20 bp, Artificial Sequence
  chemically synthesized
ctgcagttgtatgtttatca

SEQ ID NO: 315207 - DNA, 20 bp, Artificial Sequence
  chemically synthesized
tatcatagcactatttacaa

SEQ ID NO: 315208 - DNA, 20 bp, Artificial Sequence
  chemically synthesized
tgattctttgctattgtaaa

SEQ ID NO: 315209 - DNA, 20 bp, Artificial Sequence
  chemically synthesized
tagcactatttacaatagca

SEQ ID NO: 315210 - DNA, 20 bp, Artificial Sequence
  chemically synthesized
caatagcaaagaatcaacct

SEQ ID NO: 315211 - DNA, 20 bp, Artificial Sequence
  chemically synthesized
tcatttactgatggacgctt

SEQ ID NO: 315212 - DNA, 20 bp, Artificial Sequence
  chemically synthesized
atcatttactgatggacgct

SEQ ID NO: 315213 - DNA, 20 bp, Artificial Sequence
  chemically synthesized
gaatcaacctaagcgtccat

SEQ ID NO: 315214 - DNA, 20 bp, Artificial Sequence
  chemically synthesized
tttatccaatcatttactga

SEQ ID NO: 315215 - DNA, 20 bp, Artificial Sequence
  chemically synthesized
agcgtccatcagtaaatgat

SEQ ID NO: 315216 - DNA, 20 bp, Artificial Sequence
  chemically synthesized
catcagtaaatgattggata

SEQ ID NO: 315217 - DNA, 20 bp, Artificial Sequence
  chemically synthesized
acatatatacacacacacca

SEQ ID NO: 315218 - DNA, 20 bp, Artificial Sequence
  chemically synthesized
ttaggctgtgtagtgttctg

SEQ ID NO: 315219 - DNA, 20 bp, Artificial Sequence
  chemically synthesized
acacaccacagaacactaca

SEQ ID NO: 315220 - DNA, 20 bp, Artificial Sequence
  chemically synthesized
tcatactttcttaggctgtg

SEQ ID NO: 315221 - DNA, 20 bp, Artificial Sequence
  chemically synthesized
cacagaacactacacagcct

SEQ ID NO: 315222 - DNA, 20 bp, Artificial Sequence
  chemically synthesized
gaacactacacagcctaaga

SEQ ID NO: 315223 - DNA, 20 bp, Artificial Sequence
  chemically synthesized
acaggatttcatactttctt

SEQ ID NO: 315224 - DNA, 20 bp, Artificial Sequence
  chemically synthesized
gacaggatttcatactttct

SEQ ID NO: 315225 - DNA, 20 bp, Artificial Sequence
  chemically synthesized
ttcatgtaactgcaaaagac

SEQ ID NO: 315226 - DNA, 20 bp, Artificial Sequence
  chemically synthesized
gtatgaaatcctgtcttttg

SEQ ID NO: 315227 - DNA, 20 bp, Artificial Sequence
  chemically synthesized
attcatgtaactgcaaaaga

SEQ ID NO: 315228 - DNA, 20 bp, Artificial Sequence
  chemically synthesized
tcctattcatgtaactgcaa

SEQ ID NO: 315229 - DNA, 20 bp, Artificial Sequence
  chemically synthesized
gtcttttgcagttacatgaa

SEQ ID NO: 315230 - DNA, 20 bp, Artificial Sequence
  chemically synthesized
tcttttgcagttacatgaat

SEQ ID NO: 315231 - DNA, 20 bp, Artificial Sequence
  chemically synthesized
agttacatgaataggaacta

SEQ ID NO: 315232 - DNA, 20 bp, Artificial Sequence
  chemically synthesized
gttacatgaataggaactat

SEQ ID NO: 315233 - DNA, 20 bp, Artificial Sequence
  chemically synthesized
tcacttaggataatggccta

SEQ ID NO: 315234 - DNA, 20 bp, Artificial Sequence
  chemically synthesized
gaactataggccattatcct

SEQ ID NO: 315235 - DNA, 20 bp, Artificial Sequence
  chemically synthesized
agttacttcacttaggataa

SEQ ID NO: 315236 - DNA, 20 bp, Artificial Sequence
  chemically synthesized
ataggccattatcctaagtg

SEQ ID NO: 315237 - DNA, 20 bp, Artificial Sequence
  chemically synthesized
gtttccaagttacttcactt

SEQ ID NO: 315238 - DNA, 20 bp, Artificial Sequence
  chemically synthesized
tgtttccaagttacttcact

SEQ ID NO: 315239 - DNA, 20 bp, Artificial Sequence
  chemically synthesized
ttatcctaagtgaagtaact

SEQ ID NO: 315240 - DNA, 20 bp, Artificial Sequence
  chemically synthesized
taagtgaagtaacttggaaa

SEQ ID NO: 315241 - DNA, 20 bp, Artificial Sequence
  chemically synthesized
gcatttaggtttctgtttcc

SEQ ID NO: 315242 - DNA, 20 bp, Artificial Sequence
  chemically synthesized
agcgagaacatgttgcattt

SEQ ID NO: 315243 - DNA, 20 bp, Artificial Sequence
  chemically synthesized
aagcgagaacatgttgcatt

SEQ ID NO: 315244 - DNA, 20 bp, Artificial Sequence
  chemically synthesized
tgcaacatgttctcgcttat

SEQ ID NO: 315245 - DNA, 20 bp, Artificial Sequence
  chemically synthesized
tttagtttcttcttataagc

SEQ ID NO: 315246 - DNA, 20 bp, Artificial Sequence
  chemically synthesized
aacatgttctcgcttataag

SEQ ID NO: 315247 - DNA, 20 bp, Artificial Sequence
  chemically synthesized
tttgtttagtttcttcttat

SEQ ID NO: 315248 - DNA, 20 bp, Artificial Sequence
  chemically synthesized
ttataagaagaaactaaaca

SEQ ID NO: 315249 - DNA, 20 bp, Artificial Sequence
  chemically synthesized
tataagaagaaactaaacaa

SEQ ID NO: 315250 - DNA, 20 bp, Artificial Sequence
  chemically synthesized
ataagaagaaactaaacaaa

SEQ ID NO: 315251 - DNA, 20 bp, Artificial Sequence
  chemically synthesized
gtccgtgtgtaccctttgtt

SEQ ID NO: 315252 - DNA, 20 bp, Artificial Sequence
  chemically synthesized
aactaaacaaagggtacaca

SEQ ID NO: 315253 - DNA, 20 bp, Artificial Sequence
  chemically synthesized
aaagggtacacacggacatc

SEQ ID NO: 315254 - DNA, 20 bp, Artificial Sequence
  chemically synthesized
agggtacacacggacatcta

SEQ ID NO: 315255 - DNA, 20 bp, Artificial Sequence
  chemically synthesized
gtacacacggacatctagag

SEQ ID NO: 315256 - DNA, 20 bp, Artificial Sequence
  chemically synthesized
cagtttatattattccactc

SEQ ID NO: 315257 - DNA, 20 bp, Artificial Sequence
  chemically synthesized
tagagtggaataatataaac

SEQ ID NO: 315258 - DNA, 20 bp, Artificial Sequence
  chemically synthesized
ctataatcttttgtagtttc

SEQ ID NO: 315259 - DNA, 20 bp, Artificial Sequence
  chemically synthesized
atataaactggaaactacaa

SEQ ID NO: 315260 - DNA, 20 bp, Artificial Sequence
  chemically synthesized
taccagcctataatcttttg

SEQ ID NO: 315261 - DNA, 20 bp, Artificial Sequence
  chemically synthesized
ctggaaactacaaaagatta

SEQ ID NO: 315262 - DNA, 20 bp, Artificial Sequence
  chemically synthesized
tggaaactacaaaagattat

SEQ ID NO: 315263 - DNA, 20 bp, Artificial Sequence
  chemically synthesized
aactacaaaagattataggc

SEQ ID NO: 315264 - DNA, 20 bp, Artificial Sequence
  chemically synthesized
tacaaaagattataggctgg

SEQ ID NO: 315265 - DNA, 20 bp, Artificial Sequence
  chemically synthesized
acaaaagattataggctggt

SEQ ID NO: 315266 - DNA, 20 bp, Artificial Sequence
  chemically synthesized
caaaagattataggctggta

SEQ ID NO: 315267 - DNA, 20 bp, Artificial Sequence
  chemically synthesized
aaaagattataggctggtag

SEQ ID NO: 315268 - DNA, 20 bp, Artificial Sequence
  chemically synthesized
aaagattataggctggtagg

SEQ ID NO: 315269 - DNA, 20 bp, Artificial Sequence
  chemically synthesized
aagattataggctggtaggg

SEQ ID NO: 315270 - DNA, 20 bp, Artificial Sequence
  chemically synthesized
ttcacccctcacccccctac

SEQ ID NO: 315271 - DNA, 20 bp, Artificial Sequence
  chemically synthesized
ttataggctggtaggggggt

SEQ ID NO: 315272 - DNA, 20 bp, Artificial Sequence
  chemically synthesized
tataggctggtaggggggtg

SEQ ID NO: 315273 - DNA, 20 bp, Artificial Sequence
  chemically synthesized
ataggctggtaggggggtga

SEQ ID NO: 315274 - DNA, 20 bp, Artificial Sequence
  chemically synthesized
taggctggtaggggggtgag

SEQ ID NO: 315275 - DNA, 20 bp, Artificial Sequence
  chemically synthesized
ggggtgaaaaattacctatt

SEQ ID NO: 315276 - DNA, 20 bp, Artificial Sequence
  chemically synthesized
tagcgaacactatactcaat

SEQ ID NO: 315277 - DNA, 20 bp, Artificial Sequence
  chemically synthesized
gaaaaattacctattgagta

SEQ ID NO: 315278 - DNA, 20 bp, Artificial Sequence
  chemically synthesized
atagcgaacactatactcaa

SEQ ID NO: 315279 - DNA, 20 bp, Artificial Sequence
  chemically synthesized
tgagtatagtgttcgctatt

SEQ ID NO: 315280 - DNA, 20 bp, Artificial Sequence
  chemically synthesized
tagtatatccataatctgaa

SEQ ID NO: 315281 - DNA, 20 bp, Artificial Sequence
  chemically synthesized
agtgttcgctattcagatta

SEQ ID NO: 315282 - DNA, 20 bp, Artificial Sequence
  chemically synthesized
ttatggatatactaaaatcc

SEQ ID NO: 315283 - DNA, 20 bp, Artificial Sequence
  chemically synthesized
agtggtggagtctgggattt

SEQ ID NO: 315284 - DNA, 20 bp, Artificial Sequence
  chemically synthesized
atcgtgtagtggtggagtct

SEQ ID NO: 315285 - DNA, 20 bp, Artificial Sequence
  chemically synthesized
tatcgtgtagtggtggagtc

SEQ ID NO: 315286 - DNA, 20 bp, Artificial Sequence
  chemically synthesized
ggatatatcgtgtagtggtg

SEQ ID NO: 315287 - DNA, 20 bp, Artificial Sequence
  chemically synthesized
atggatatatcgtgtagtgg

SEQ ID NO: 315288 - DNA, 20 bp, Artificial Sequence
  chemically synthesized
tacatggatatatcgtgtag

SEQ ID NO: 315289 - DNA, 20 bp, Artificial Sequence
  chemically synthesized
tgttacatggatatatcgtg

SEQ ID NO: 315290 - DNA, 20 bp, Artificial Sequence
  chemically synthesized
gcatgtgcaggtttgttaca

SEQ ID NO: 315291 - DNA, 20 bp, Artificial Sequence
  chemically synthesized
gattgagggggtgcatgtgc

SEQ ID NO: 315292 - DNA, 20 bp, Artificial Sequence
  chemically synthesized
agattgagggggtgcatgtg

SEQ ID NO: 315293 - DNA, 20 bp, Artificial Sequence
  chemically synthesized
agttttaaaatagattgagg

SEQ ID NO: 315294 - DNA, 20 bp, Artificial Sequence
  chemically synthesized
aagttttaaaatagattgag

SEQ ID NO: 315295 - DNA, 20 bp, Artificial Sequence
  chemically synthesized
gaagttttaaaatagattga

SEQ ID NO: 315296 - DNA, 20 bp, Artificial Sequence
  chemically synthesized
agaagttttaaaatagattg

SEQ ID NO: 315297 - DNA, 20 bp, Artificial Sequence
  chemically synthesized
aagaagttttaaaatagatt

SEQ ID NO: 315298 - DNA, 20 bp, Artificial Sequence
  chemically synthesized
tcttagaagaagttttaaaa

SEQ ID NO: 315299 - DNA, 20 bp, Artificial Sequence
  chemically synthesized
tctattttaaaacttcttct

SEQ ID NO: 315300 - DNA, 20 bp, Artificial Sequence
  chemically synthesized
taataagcatgtcttagaag

SEQ ID NO: 315301 - DNA, 20 bp, Artificial Sequence
  chemically synthesized
tagtaataagcatgtcttag

SEQ ID NO: 315302 - DNA, 20 bp, Artificial Sequence
  chemically synthesized
ctctagtaataagcatgtct

SEQ ID NO: 315303 - DNA, 20 bp, Artificial Sequence
  chemically synthesized
ttctaagacatgcttattac

SEQ ID NO: 315304 - DNA, 20 bp, Artificial Sequence
  chemically synthesized
ctaagacatgcttattacta

SEQ ID NO: 315305 - DNA, 20 bp, Artificial Sequence
  chemically synthesized
tctcatttaactctagtaat

SEQ ID NO: 315306 - DNA, 20 bp, Artificial Sequence
  chemically synthesized
tgtattgtctcatttaactc

SEQ ID NO: 315307 - DNA, 20 bp, Artificial Sequence
  chemically synthesized
gcttattactagagttaaat

SEQ ID NO: 315308 - DNA, 20 bp, Artificial Sequence
  chemically synthesized
atgagacaatacattaactt

SEQ ID NO: 315309 - DNA, 20 bp, Artificial Sequence
  chemically synthesized
tctaagcactgtacaagctg

SEQ ID NO: 315310 - DNA, 20 bp, Artificial Sequence
  chemically synthesized
tacattaacttcagcttgta

SEQ ID NO: 315311 - DNA, 20 bp, Artificial Sequence
  chemically synthesized
accaaatctaagcactgtac

SEQ ID NO: 315312 - DNA, 20 bp, Artificial Sequence
  chemically synthesized
acttcagcttgtacagtgct

SEQ ID NO: 315313 - DNA, 20 bp, Artificial Sequence
  chemically synthesized
gcttgtacagtgcttagatt

SEQ ID NO: 315314 - DNA, 20 bp, Artificial Sequence
  chemically synthesized
cctcaccacctaccaaatct

SEQ ID NO: 315315 - DNA, 20 bp, Artificial Sequence
  chemically synthesized
tgtacagtgcttagatttgg

SEQ ID NO: 315316 - DNA, 20 bp, Artificial Sequence
  chemically synthesized
gtacagtgcttagatttggt

SEQ ID NO: 315317 - DNA, 20 bp, Artificial Sequence
  chemically synthesized
cagtgcttagatttggtagg

SEQ ID NO: 315318 - DNA, 20 bp, Artificial Sequence
  chemically synthesized
gcttagatttggtaggtggt

SEQ ID NO: 315319 - DNA, 20 bp, Artificial Sequence
  chemically synthesized
cttagatttggtaggtggtg

SEQ ID NO: 315320 - DNA, 20 bp, Artificial Sequence
  chemically synthesized
cgtcagaaatgaaagaaaat

SEQ ID NO: 315321 - DNA, 20 bp, Artificial Sequence
  chemically synthesized
tgtgaatacgtcagaaatga

SEQ ID NO: 315322 - DNA, 20 bp, Artificial Sequence
  chemically synthesized
caaggataatgtgaatacgt

SEQ ID NO: 315323 - DNA, 20 bp, Artificial Sequence
  chemically synthesized
aatctcagtgtaagaatgca

SEQ ID NO: 315324 - DNA, 20 bp, Artificial Sequence
  chemically synthesized
gaatctcagtgtaagaatgc

SEQ ID NO: 315325 - DNA, 20 bp, Artificial Sequence
  chemically synthesized
tatccttgcattcttacact

SEQ ID NO: 315326 - DNA, 20 bp, Artificial Sequence
  chemically synthesized
atttccatgaatctcagtgt

SEQ ID NO: 315327 - DNA, 20 bp, Artificial Sequence
  chemically synthesized
cattcttacactgagattca

SEQ ID NO: 315328 - DNA, 20 bp, Artificial Sequence
  chemically synthesized
agggctatttccatgaatct

SEQ ID NO: 315329 - DNA, 20 bp, Artificial Sequence
  chemically synthesized
tacactgagattcatggaaa

SEQ ID NO: 315330 - DNA, 20 bp, Artificial Sequence
  chemically synthesized
ttcatggaaatagccctttt

SEQ ID NO: 315331 - DNA, 20 bp, Artificial Sequence
  chemically synthesized
ataaatagtgatgctcaaaa

SEQ ID NO: 315332 - DNA, 20 bp, Artificial Sequence
  chemically synthesized
aataaatagtgatgctcaaa

SEQ ID NO: 315333 - DNA, 20 bp, Artificial Sequence
  chemically synthesized
aaataaatagtgatgctcaa

SEQ ID NO: 315334 - DNA, 20 bp, Artificial Sequence
  chemically synthesized
accaagttattagaaataaa

SEQ ID NO: 315335 - DNA, 20 bp, Artificial Sequence
  chemically synthesized
actatttatttctaataact

SEQ ID NO: 315336 - DNA, 20 bp, Artificial Sequence
  chemically synthesized
taatgtgattaccaagttat

SEQ ID NO: 315337 - DNA, 20 bp, Artificial Sequence
  chemically synthesized
ggaaatataatgtgattacc

SEQ ID NO: 315338 - DNA, 20 bp, Artificial Sequence
  chemically synthesized
acactgaggatatttaataa

SEQ ID NO: 315339 - DNA, 20 bp, Artificial Sequence
  chemically synthesized
tttccattattaaatatcct

SEQ ID NO: 315340 - DNA, 20 bp, Artificial Sequence
  chemically synthesized
tctacagttttggcacactg

SEQ ID NO: 315341 - DNA, 20 bp, Artificial Sequence
  chemically synthesized
gtctacagttttggcacact

SEQ ID NO: 315342 - DNA, 20 bp, Artificial Sequence
  chemically synthesized
tcctcagtgtgccaaaactg

SEQ ID NO: 315343 - DNA, 20 bp, Artificial Sequence
  chemically synthesized
tacataatggtctacagttt

SEQ ID NO: 315344 - DNA, 20 bp, Artificial Sequence
  chemically synthesized
tatttttacataatggtcta

SEQ ID NO: 315345 - DNA, 20 bp, Artificial Sequence
  chemically synthesized
actaaactatttttacataa

SEQ ID NO: 315346 - DNA, 20 bp, Artificial Sequence
  chemically synthesized
tgtagaccattatgtaaaaa

SEQ ID NO: 315347 - DNA, 20 bp, Artificial Sequence
  chemically synthesized
accattatgtaaaaatagtt

SEQ ID NO: 315348 - DNA, 20 bp, Artificial Sequence
  chemically synthesized
aaaatagtttagtgcttttt

SEQ ID NO: 315349 - DNA, 20 bp, Artificial Sequence
  chemically synthesized
catatctagtaagactaaaa

SEQ ID NO: 315350 - DNA, 20 bp, Artificial Sequence
  chemically synthesized
tagtgcttttttagtcttac

SEQ ID NO: 315351 - DNA, 20 bp, Artificial Sequence
  chemically synthesized
ttatctaagtcatatctagt

SEQ ID NO: 315352 - DNA, 20 bp, Artificial Sequence
  chemically synthesized
atttttatctaagtcatatc

SEQ ID NO: 315353 - DNA, 20 bp, Artificial Sequence
  chemically synthesized
tagtcttactagatatgact

SEQ ID NO: 315354 - DNA, 20 bp, Artificial Sequence
  chemically synthesized
taacaattaaatttttatct

SEQ ID NO: 315355 - DNA, 20 bp, Artificial Sequence
  chemically synthesized
agataaaaatttaattgtta

SEQ ID NO: 315356 - DNA, 20 bp, Artificial Sequence
  chemically synthesized
gataaaaatttaattgttaa

SEQ ID NO: 315357 - DNA, 20 bp, Artificial Sequence
  chemically synthesized
aatttaattgttaaaggata

SEQ ID NO: 315358 - DNA, 20 bp, Artificial Sequence
  chemically synthesized
agtactctcttattcattgg

SEQ ID NO: 315359 - DNA, 20 bp, Artificial Sequence
  chemically synthesized
tatcattacttccaatgaat

SEQ ID NO: 315360 - DNA, 20 bp, Artificial Sequence
  chemically synthesized
ggtagtactctcttattcat

SEQ ID NO: 315361 - DNA, 20 bp, Artificial Sequence
  chemically synthesized
tcattacttccaatgaataa

SEQ ID NO: 315362 - DNA, 20 bp, Artificial Sequence
  chemically synthesized
attacttccaatgaataaga

SEQ ID NO: 315363 - DNA, 20 bp, Artificial Sequence
  chemically synthesized
aatgaataagagagtactac

SEQ ID NO: 315364 - DNA, 20 bp, Artificial Sequence
  chemically synthesized
atttctactggtacatctgg

SEQ ID NO: 315365 - DNA, 20 bp, Artificial Sequence
  chemically synthesized
gagagtactaccagatgtac

SEQ ID NO: 315366 - DNA, 20 bp, Artificial Sequence
  chemically synthesized
tagatttctactggtacatc

SEQ ID NO: 315367 - DNA, 20 bp, Artificial Sequence
  chemically synthesized
agtactaccagatgtaccag

SEQ ID NO: 315368 - DNA, 20 bp, Artificial Sequence
  chemically synthesized
taatactagtagatttctac

SEQ ID NO: 315369 - DNA, 20 bp, Artificial Sequence
  chemically synthesized
atgtaccagtagaaatctac

SEQ ID NO: 315370 - DNA, 20 bp, Artificial Sequence
  chemically synthesized
cagtagaaatctactagtat

SEQ ID NO: 315371 - DNA, 20 bp, Artificial Sequence
  chemically synthesized
tagtggatttctaatactag

SEQ ID NO: 315372 - DNA, 20 bp, Artificial Sequence
  chemically synthesized
ttctagtggatttctaatac

SEQ ID NO: 315373 - DNA, 20 bp, Artificial Sequence
  chemically synthesized
tactagtattagaaatccac

SEQ ID NO: 315374 - DNA, 20 bp, Artificial Sequence
  chemically synthesized
gttatgaacagaatttctag

SEQ ID NO: 315375 - DNA, 20 bp, Artificial Sequence
  chemically synthesized
tctgttatgaacagaatttc

SEQ ID NO: 315376 - DNA, 20 bp, Artificial Sequence
  chemically synthesized
actagaaattctgttcataa

SEQ ID NO: 315377 - DNA, 20 bp, Artificial Sequence
  chemically synthesized
tttaatatttctgttatgaa

SEQ ID NO: 315378 - DNA, 20 bp, Artificial Sequence
  chemically synthesized
ttcataacagaaatattaaa

SEQ ID NO: 315379 - DNA, 20 bp, Artificial Sequence
  chemically synthesized
tcataacagaaatattaaac

SEQ ID NO: 315380 - DNA, 20 bp, Artificial Sequence
  chemically synthesized
aacagaaatattaaacagga

SEQ ID NO: 315381 - DNA, 20 bp, Artificial Sequence
  chemically synthesized
tactttttctgaagaatatg

SEQ ID NO: 315382 - DNA, 20 bp, Artificial Sequence
  chemically synthesized
ggatagttctccatattctt

SEQ ID NO: 315383 - DNA, 20 bp, Artificial Sequence
  chemically synthesized
gatactttttctgaagaata

SEQ ID NO: 315384 - DNA, 20 bp, Artificial Sequence
  chemically synthesized
ttctccatattcttcagaaa

SEQ ID NO: 315385 - DNA, 20 bp, Artificial Sequence
  chemically synthesized
tgaatatgatactttttctg

SEQ ID NO: 315386 - DNA, 20 bp, Artificial Sequence
  chemically synthesized
caatcccgtgttaaaatata

SEQ ID NO: 315387 - DNA, 20 bp, Artificial Sequence
  chemically synthesized
ccaatcccgtgttaaaatat

SEQ ID NO: 315388 - DNA, 20 bp, Artificial Sequence
  chemically synthesized
ttcaaccttatattttaaca

SEQ ID NO: 315389 - DNA, 20 bp, Artificial Sequence
  chemically synthesized
tcaaccttatattttaacac

SEQ ID NO: 315390 - DNA, 20 bp, Artificial Sequence
  chemically synthesized
cttatattttaacacgggat

SEQ ID NO: 315391 - DNA, 20 bp, Artificial Sequence
  chemically synthesized
ttaacacgggattggattta

SEQ ID NO: 315392 - DNA, 20 bp, Artificial Sequence
  chemically synthesized
acggacatgcattttgttat

SEQ ID NO: 315393 - DNA, 20 bp, Artificial Sequence
  chemically synthesized
atgcattttgttataagata

SEQ ID NO: 315394 - DNA, 20 bp, Artificial Sequence
  chemically synthesized
gatacggtcatacatttgat

SEQ ID NO: 315395 - DNA, 20 bp, Artificial Sequence
  chemically synthesized
atacggtcatacatttgata

SEQ ID NO: 315396 - DNA, 20 bp, Artificial Sequence
  chemically synthesized
acatgataacatgaatttta

SEQ ID NO: 315397 - DNA, 20 bp, Artificial Sequence
  chemically synthesized
cacatgataacatgaatttt

SEQ ID NO: 315398 - DNA, 20 bp, Artificial Sequence
  chemically synthesized
tcatgttatcatgtgtgtct

SEQ ID NO: 315399 - DNA, 20 bp, Artificial Sequence
  chemically synthesized
ggaaaccttacaagaaagct

SEQ ID NO: 315400 - DNA, 20 bp, Artificial Sequence
  chemically synthesized
gtgtgtcttagctttcttgt

SEQ ID NO: 315401 - DNA, 20 bp, Artificial Sequence
  chemically synthesized
tgtgtcttagctttcttgta

SEQ ID NO: 315402 - DNA, 20 bp, Artificial Sequence
  chemically synthesized
tttagggaaaccttacaaga

SEQ ID NO: 315403 - DNA, 20 bp, Artificial Sequence
  chemically synthesized
gcattttagggaaaccttac

SEQ ID NO: 315404 - DNA, 20 bp, Artificial Sequence
  chemically synthesized
acattttaaaatgcatttta

SEQ ID NO: 315405 - DNA, 20 bp, Artificial Sequence
  chemically synthesized
aacattttaaaatgcatttt

SEQ ID NO: 315406 - DNA, 20 bp, Artificial Sequence
  chemically synthesized
aaacattttaaaatgcattt

SEQ ID NO: 315407 - DNA, 20 bp, Artificial Sequence
  chemically synthesized
tttaaaatgttttttataat

SEQ ID NO: 315408 - DNA, 20 bp, Artificial Sequence
  chemically synthesized
gtaatacaaaattaataatg

SEQ ID NO: 315409 - DNA, 20 bp, Artificial Sequence
  chemically synthesized
attttgtattacctatacga

SEQ ID NO: 315410 - DNA, 20 bp, Artificial Sequence
  chemically synthesized
caatttcagttctttcgtat

SEQ ID NO: 315411 - DNA, 20 bp, Artificial Sequence
  chemically synthesized
tcaatttcagttctttcgta

SEQ ID NO: 315412 - DNA, 20 bp, Artificial Sequence
  chemically synthesized
agtactgtaacaatcaattt

SEQ ID NO: 315413 - DNA, 20 bp, Artificial Sequence
  chemically synthesized
agaactgaaattgattgtta

SEQ ID NO: 315414 - DNA, 20 bp, Artificial Sequence
  chemically synthesized
gaaattgattgttacagtac

SEQ ID NO: 315415 - DNA, 20 bp, Artificial Sequence
  chemically synthesized
tgattgttacagtactggtt

SEQ ID NO: 315416 - DNA, 20 bp, Artificial Sequence
  chemically synthesized
attgttacagtactggttca

SEQ ID NO: 315417 - DNA, 20 bp, Artificial Sequence
  chemically synthesized
tgttacagtactggttcaga

SEQ ID NO: 315418 - DNA, 20 bp, Artificial Sequence
  chemically synthesized
atgtctctctctctctgaac

SEQ ID NO: 315419 - DNA, 20 bp, Artificial Sequence
  chemically synthesized
ttacagtactggttcagaga

SEQ ID NO: 315420 - DNA, 20 bp, Artificial Sequence
  chemically synthesized
acagtactggttcagagaga

SEQ ID NO: 315421 - DNA, 20 bp, Artificial Sequence
  chemically synthesized
agtactggttcagagagaga

SEQ ID NO: 315422 - DNA, 20 bp, Artificial Sequence
  chemically synthesized
gagagagagacattttacat

SEQ ID NO: 315423 - DNA, 20 bp, Artificial Sequence
  chemically synthesized
cattttacatgagactaact

SEQ ID NO: 315424 - DNA, 20 bp, Artificial Sequence
  chemically synthesized
ctatttctaatttactgagt

SEQ ID NO: 315425 - DNA, 20 bp, Artificial Sequence
  chemically synthesized
atgagactaactcagtaaat

SEQ ID NO: 315426 - DNA, 20 bp, Artificial Sequence
  chemically synthesized
taccctatttctaatttact

SEQ ID NO: 315427 - DNA, 20 bp, Artificial Sequence
  chemically synthesized
ctaactcagtaaattagaaa

SEQ ID NO: 315428 - DNA, 20 bp, Artificial Sequence
  chemically synthesized
taactcagtaaattagaaat

SEQ ID NO: 315429 - DNA, 20 bp, Artificial Sequence
  chemically synthesized
aactcagtaaattagaaata

SEQ ID NO: 315430 - DNA, 20 bp, Artificial Sequence
  chemically synthesized
ggtgtttaaaggaaaaaaat

SEQ ID NO: 315431 - DNA, 20 bp, Artificial Sequence
  chemically synthesized
acctctccaatggtgtttaa

SEQ ID NO: 315432 - DNA, 20 bp, Artificial Sequence
  chemically synthesized
gacctctccaatggtgttta

SEQ ID NO: 315433 - DNA, 20 bp, Artificial Sequence
  chemically synthesized
ttttttcctttaaacaccat

SEQ ID NO: 315434 - DNA, 20 bp, Artificial Sequence
  chemically synthesized
ttttcctttaaacaccattg

SEQ ID NO: 315435 - DNA, 20 bp, Artificial Sequence
  chemically synthesized
ttcctttaaacaccattgga

SEQ ID NO: 315436 - DNA, 20 bp, Artificial Sequence
  chemically synthesized
tcctttaaacaccattggag

SEQ ID NO: 315437 - DNA, 20 bp, Artificial Sequence
  chemically synthesized
gaagacactgacctctccaa

SEQ ID NO: 315438 - DNA, 20 bp, Artificial Sequence
  chemically synthesized
ttaaacaccattggagaggt

SEQ ID NO: 315439 - DNA, 20 bp, Artificial Sequence
  chemically synthesized
agaggtcagtgtcttctcat

SEQ ID NO: 315440 - DNA, 20 bp, Artificial Sequence
  chemically synthesized
gaggtcagtgtcttctcatg

SEQ ID NO: 315441 - DNA, 20 bp, Artificial Sequence
  chemically synthesized
ttgtaatacttcctcatgag

SEQ ID NO: 315442 - DNA, 20 bp, Artificial Sequence
  chemically synthesized
gtcagtgtcttctcatgagg

SEQ ID NO: 315443 - DNA, 20 bp, Artificial Sequence
  chemically synthesized
ctcttgtaatacttcctcat

SEQ ID NO: 315444 - DNA, 20 bp, Artificial Sequence
  chemically synthesized
ttctcatgaggaagtattac

SEQ ID NO: 315445 - DNA, 20 bp, Artificial Sequence
  chemically synthesized
ctcatgaggaagtattacaa

SEQ ID NO: 315446 - DNA, 20 bp, Artificial Sequence
  chemically synthesized
gaagtattacaagagtaatg

SEQ ID NO: 315447 - DNA, 20 bp, Artificial Sequence
  chemically synthesized
tgaagtataataactaatgt

SEQ ID NO: 315448 - DNA, 20 bp, Artificial Sequence
  chemically synthesized
catcttagaggcactaacat

SEQ ID NO: 315449 - DNA, 20 bp, Artificial Sequence
  chemically synthesized
taactaatgttagtgcctct

SEQ ID NO: 315450 - DNA, 20 bp, Artificial Sequence
  chemically synthesized
tcaagactctgtcatcttag

SEQ ID NO: 315451 - DNA, 20 bp, Artificial Sequence
  chemically synthesized
atcaagactctgtcatctta

SEQ ID NO: 315452 - DNA, 20 bp, Artificial Sequence
  chemically synthesized
tgttagtgcctctaagatga

SEQ ID NO: 315453 - DNA, 20 bp, Artificial Sequence
  chemically synthesized
tgatcaagactctgtcatct

SEQ ID NO: 315454 - DNA, 20 bp, Artificial Sequence
  chemically synthesized
ttagtgcctctaagatgaca

SEQ ID NO: 315455 - DNA, 20 bp, Artificial Sequence
  chemically synthesized
taagatgacagagtcttgat

SEQ ID NO: 315456 - DNA, 20 bp, Artificial Sequence
  chemically synthesized
aagatgacagagtcttgatc

SEQ ID NO: 315457 - DNA, 20 bp, Artificial Sequence
  chemically synthesized
tacgaaaattatacctgatc

SEQ ID NO: 315458 - DNA, 20 bp, Artificial Sequence
  chemically synthesized
ttgatcaggtataattttcg

SEQ ID NO: 315459 - DNA, 20 bp, Artificial Sequence
  chemically synthesized
tgtttgacagtatatcggta

SEQ ID NO: 315460 - DNA, 20 bp, Artificial Sequence
  chemically synthesized
agctttgtttgacagtatat

SEQ ID NO: 315461 - DNA, 20 bp, Artificial Sequence
  chemically synthesized
taccgatatactgtcaaaca

SEQ ID NO: 315462 - DNA, 20 bp, Artificial Sequence
  chemically synthesized
aatgtcacagctttgtttga

SEQ ID NO: 315463 - DNA, 20 bp, Artificial Sequence
  chemically synthesized
taacattacttagaatgtca

SEQ ID NO: 315464 - DNA, 20 bp, Artificial Sequence
  chemically synthesized
aaacaaagctgtgacattct

SEQ ID NO: 315465 - DNA, 20 bp, Artificial Sequence
  chemically synthesized
attgattcagtaacattact

SEQ ID NO: 315466 - DNA, 20 bp, Artificial Sequence
  chemically synthesized
gaaattactgagtattgatt

SEQ ID NO: 315467 - DNA, 20 bp, Artificial Sequence
  chemically synthesized
aatgttactgaatcaatact

SEQ ID NO: 315468 - DNA, 20 bp, Artificial Sequence
  chemically synthesized
ttactttattagaaattact

SEQ ID NO: 315469 - DNA, 20 bp, Artificial Sequence
  chemically synthesized
atactcagtaatttctaata

SEQ ID NO: 315470 - DNA, 20 bp, Artificial Sequence
  chemically synthesized
cagattattatttactttat

SEQ ID NO: 315471 - DNA, 20 bp, Artificial Sequence
  chemically synthesized
taaagtaaataataatctga

SEQ ID NO: 315472 - DNA, 20 bp, Artificial Sequence
  chemically synthesized
gtaaataataatctgatagc

SEQ ID NO: 315473 - DNA, 20 bp, Artificial Sequence
  chemically synthesized
aatcaagtatttctagctat

SEQ ID NO: 315474 - DNA, 20 bp, Artificial Sequence
  chemically synthesized
ttttacaaatcaagtatttc

SEQ ID NO: 315475 - DNA, 20 bp, Artificial Sequence
  chemically synthesized
atattcttattttacaaatc

SEQ ID NO: 315476 - DNA, 20 bp, Artificial Sequence
  chemically synthesized
aaatacttgatttgtaaaat

SEQ ID NO: 315477 - DNA, 20 bp, Artificial Sequence
  chemically synthesized
tgatttgtaaaataagaata

SEQ ID NO: 315478 - DNA, 20 bp, Artificial Sequence
  chemically synthesized
gatttgtaaaataagaatat

SEQ ID NO: 315479 - DNA, 20 bp, Artificial Sequence
  chemically synthesized
gtaaaataagaatatgggca

SEQ ID NO: 315480 - DNA, 20 bp, Artificial Sequence
  chemically synthesized
attattattttaataatcta

SEQ ID NO: 315481 - DNA, 20 bp, Artificial Sequence
  chemically synthesized
atatttgcacagtaatgcta

SEQ ID NO: 315482 - DNA, 20 bp, Artificial Sequence
  chemically synthesized
attccaagggtatatttgca

SEQ ID NO: 315483 - DNA, 20 bp, Artificial Sequence
  chemically synthesized
ttactgtgcaaatataccct

SEQ ID NO: 315484 - DNA, 20 bp, Artificial Sequence
  chemically synthesized
taacaagcatcatattccaa

SEQ ID NO: 315485 - DNA, 20 bp, Artificial Sequence
  chemically synthesized
ttaacaagcatcatattcca

SEQ ID NO: 315486 - DNA, 20 bp, Artificial Sequence
  chemically synthesized
attaacaagcatcatattcc

SEQ ID NO: 315487 - DNA, 20 bp, Artificial Sequence
  chemically synthesized
tggaatatgatgcttgttaa

SEQ ID NO: 315488 - DNA, 20 bp, Artificial Sequence
  chemically synthesized
cccataagaattctattaac

SEQ ID NO: 315489 - DNA, 20 bp, Artificial Sequence
  chemically synthesized
gcttgttaatagaattctta

SEQ ID NO: 315490 - DNA, 20 bp, Artificial Sequence
  chemically synthesized
cttgttaatagaattcttat

SEQ ID NO: 315491 - DNA, 20 bp, Artificial Sequence
  chemically synthesized
gaagacatctaatatcccat

SEQ ID NO: 315492 - DNA, 20 bp, Artificial Sequence
  chemically synthesized
atagaattcttatgggatat

SEQ ID NO: 315493 - DNA, 20 bp, Artificial Sequence
  chemically synthesized
atttttaaaatcgaattgag

SEQ ID NO: 315494 - DNA, 20 bp, Artificial Sequence
  chemically synthesized
acaatttttaaaatcgaatt

SEQ ID NO: 315495 - DNA, 20 bp, Artificial Sequence
  chemically synthesized
agtagtatgtgcatgatatt

SEQ ID NO: 315496 - DNA, 20 bp, Artificial Sequence
  chemically synthesized
atcatgcacatactactacg

SEQ ID NO: 315497 - DNA, 20 bp, Artificial Sequence
  chemically synthesized
cacttttatagtctacgtag

SEQ ID NO: 315498 - DNA, 20 bp, Artificial Sequence
  chemically synthesized
tcacacttttatagtctacg

SEQ ID NO: 315499 - DNA, 20 bp, Artificial Sequence
  chemically synthesized
tactactacgtagactataa

SEQ ID NO: 315500 - DNA, 20 bp, Artificial Sequence
  chemically synthesized
aaaagaacatcacactttta

SEQ ID NO: 315501 - DNA, 20 bp, Artificial Sequence
  chemically synthesized
gattggaagtttatgtaaaa

SEQ ID NO: 315502 - DNA, 20 bp, Artificial Sequence
  chemically synthesized
attttgacataaatgattgg

SEQ ID NO: 315503 - DNA, 20 bp, Artificial Sequence
  chemically synthesized
attattttgacataaatgat

SEQ ID NO: 315504 - DNA, 20 bp, Artificial Sequence
  chemically synthesized
tatgaaattggtttgagtgg

SEQ ID NO: 315505 - DNA, 20 bp, Artificial Sequence
  chemically synthesized
gactatgaaattggtttgag

SEQ ID NO: 315506 - DNA, 20 bp, Artificial Sequence
  chemically synthesized
attgactatgaaattggttt

SEQ ID NO: 315507 - DNA, 20 bp, Artificial Sequence
  chemically synthesized
taccactcaaaccaatttca

SEQ ID NO: 315508 - DNA, 20 bp, Artificial Sequence
  chemically synthesized
taaaccattgactatgaaat

SEQ ID NO: 315509 - DNA, 20 bp, Artificial Sequence
  chemically synthesized
caaaccaatttcatagtcaa

SEQ ID NO: 315510 - DNA, 20 bp, Artificial Sequence
  chemically synthesized
caatttcatagtcaatggtt

SEQ ID NO: 315511 - DNA, 20 bp, Artificial Sequence
  chemically synthesized
gtcaatggtttagcactatt

SEQ ID NO: 315512 - DNA, 20 bp, Artificial Sequence
  chemically synthesized
cccatatgcaaatatcttaa

SEQ ID NO: 315513 - DNA, 20 bp, Artificial Sequence
  chemically synthesized
actattaagatatttgcata

SEQ ID NO: 315514 - DNA, 20 bp, Artificial Sequence
  chemically synthesized
ctattaagatatttgcatat

SEQ ID NO: 315515 - DNA, 20 bp, Artificial Sequence
  chemically synthesized
atttgcatatgggaatgcaa

SEQ ID NO: 315516 - DNA, 20 bp, Artificial Sequence
  chemically synthesized
ttgcatatgggaatgcaaca

SEQ ID NO: 315517 - DNA, 20 bp, Artificial Sequence
  chemically synthesized
atatgggaatgcaacagaga

SEQ ID NO: 315518 - DNA, 20 bp, Artificial Sequence
  chemically synthesized
tgggaatgcaacagagatag

SEQ ID NO: 315519 - DNA, 20 bp, Artificial Sequence
  chemically synthesized
gggaatgcaacagagataga

SEQ ID NO: 315520 - DNA, 20 bp, Artificial Sequence
  chemically synthesized
caacagagatagaaggaaaa

SEQ ID NO: 315521 - DNA, 20 bp, Artificial Sequence
  chemically synthesized
aacagagatagaaggaaaaa

SEQ ID NO: 315522 - DNA, 20 bp, Artificial Sequence
  chemically synthesized
gagatagaaggaaaaaagga

SEQ ID NO: 315523 - DNA, 20 bp, Artificial Sequence
  chemically synthesized
tagaaggaaaaaaggaaagt

SEQ ID NO: 315524 - DNA, 20 bp, Artificial Sequence
  chemically synthesized
gaaggaaaaaaggaaagtca

SEQ ID NO: 315525 - DNA, 20 bp, Artificial Sequence
  chemically synthesized
aaaaggaaagtcagagattg

SEQ ID NO: 315526 - DNA, 20 bp, Artificial Sequence
  chemically synthesized
aagtcagagattgaagacac

SEQ ID NO: 315527 - DNA, 20 bp, Artificial Sequence
  chemically synthesized
gtcagagattgaagacacca

SEQ ID NO: 315528 - DNA, 20 bp, Artificial Sequence
  chemically synthesized
ttacctggtgatgttatctc

SEQ ID NO: 315529 - DNA, 20 bp, Artificial Sequence
  chemically synthesized
gacaccagagataacatcac

SEQ ID NO: 315530 - DNA, 20 bp, Artificial Sequence
  chemically synthesized
acaccagagataacatcacc

SEQ ID NO: 315531 - DNA, 20 bp, Artificial Sequence
  chemically synthesized
cagagataacatcaccaggt

SEQ ID NO: 315532 - DNA, 20 bp, Artificial Sequence
  chemically synthesized
catctgtaaagtggcttacc

SEQ ID NO: 315533 - DNA, 20 bp, Artificial Sequence
  chemically synthesized
tcaccaggtaagccacttta

SEQ ID NO: 315534 - DNA, 20 bp, Artificial Sequence
  chemically synthesized
agaaaaatacatctgtaaag

SEQ ID NO: 315535 - DNA, 20 bp, Artificial Sequence
  chemically synthesized
tgtagaaaaatacatctgta

SEQ ID NO: 315536 - DNA, 20 bp, Artificial Sequence
  chemically synthesized
tttacagatgtatttttcta

SEQ ID NO: 315537 - DNA, 20 bp, Artificial Sequence
  chemically synthesized
aaaaaaaattcataaagctg

SEQ ID NO: 315538 - DNA, 20 bp, Artificial Sequence
  chemically synthesized
acagcaaaaaaaaattcata

SEQ ID NO: 315539 - DNA, 20 bp, Artificial Sequence
  chemically synthesized
caattaaaacgttgggcata

SEQ ID NO: 315540 - DNA, 20 bp, Artificial Sequence
  chemically synthesized
ataatttcaattaaaacgtt

SEQ ID NO: 315541 - DNA, 20 bp, Artificial Sequence
  chemically synthesized
gataatttcaattaaaacgt

SEQ ID NO: 315542 - DNA, 20 bp, Artificial Sequence
  chemically synthesized
actttctgacaagggcatga

SEQ ID NO: 315543 - DNA, 20 bp, Artificial Sequence
  chemically synthesized
tcaaactttcatgcccttgt

SEQ ID NO: 315544 - DNA, 20 bp, Artificial Sequence
  chemically synthesized
catggctaactttctgacaa

SEQ ID NO: 315545 - DNA, 20 bp, Artificial Sequence
  chemically synthesized
actttcatgcccttgtcaga

SEQ ID NO: 315546 - DNA, 20 bp, Artificial Sequence
  chemically synthesized
tcatggctaactttctgaca

SEQ ID NO: 315547 - DNA, 20 bp, Artificial Sequence
  chemically synthesized
atcatggctaactttctgac

SEQ ID NO: 315548 - DNA, 20 bp, Artificial Sequence
  chemically synthesized
tcatgcccttgtcagaaagt

SEQ ID NO: 315549 - DNA, 20 bp, Artificial Sequence
  chemically synthesized
tgtcagaaagttagccatga

SEQ ID NO: 315550 - DNA, 20 bp, Artificial Sequence
  chemically synthesized
tcagaaagttagccatgatg

SEQ ID NO: 315551 - DNA, 20 bp, Artificial Sequence
  chemically synthesized
tatccaaatcgtctccatca

SEQ ID NO: 315552 - DNA, 20 bp, Artificial Sequence
  chemically synthesized
tagccatgatggagacgatt

SEQ ID NO: 315553 - DNA, 20 bp, Artificial Sequence
  chemically synthesized
gacgatttggataataaaac

SEQ ID NO: 315554 - DNA, 20 bp, Artificial Sequence
  chemically synthesized
catgttctgattatattgac

SEQ ID NO: 315555 - DNA, 20 bp, Artificial Sequence
  chemically synthesized
ataaaactagtcaatataat

SEQ ID NO: 315556 - DNA, 20 bp, Artificial Sequence
  chemically synthesized
tgatgctcagtaaatgtttt

SEQ ID NO: 315557 - DNA, 20 bp, Artificial Sequence
  chemically synthesized
gtgttctaaaaacatttact

SEQ ID NO: 315558 - DNA, 20 bp, Artificial Sequence
  chemically synthesized
cttagtcaataattgatgct

SEQ ID NO: 315559 - DNA, 20 bp, Artificial Sequence
  chemically synthesized
ctgagcatcaattattgact

SEQ ID NO: 315560 - DNA, 20 bp, Artificial Sequence
  chemically synthesized
ttttgtgttttcagagtgct

SEQ ID NO: 315561 - DNA, 20 bp, Artificial Sequence
  chemically synthesized
agatttcttttgtgttttca

SEQ ID NO: 315562 - DNA, 20 bp, Artificial Sequence
  chemically synthesized
ccagatttcttttgtgtttt

SEQ ID NO: 315563 - DNA, 20 bp, Artificial Sequence
  chemically synthesized
taagcactctgaaaacacaa

SEQ ID NO: 315564 - DNA, 20 bp, Artificial Sequence
  chemically synthesized
ctgaaaacacaaaagaaatc

SEQ ID NO: 315565 - DNA, 20 bp, Artificial Sequence
  chemically synthesized
acaaaagaaatctggctctc

SEQ ID NO: 315566 - DNA, 20 bp, Artificial Sequence
  chemically synthesized
ctgtattataaccagagagc

SEQ ID NO: 315567 - DNA, 20 bp, Artificial Sequence
  chemically synthesized
aatactgtattataaccaga

SEQ ID NO: 315568 - DNA, 20 bp, Artificial Sequence
  chemically synthesized
aaaatactgtattataacca

SEQ ID NO: 315569 - DNA, 20 bp, Artificial Sequence
  chemically synthesized
aaaaaatactgtattataac

SEQ ID NO: 315570 - DNA, 20 bp, Artificial Sequence
  chemically synthesized
ctggctctctggttataata

SEQ ID NO: 315571 - DNA, 20 bp, Artificial Sequence
  chemically synthesized
gttataatacagtatttttt

SEQ ID NO: 315572 - DNA, 20 bp, Artificial Sequence
  chemically synthesized
tacagtattttttcagatta

SEQ ID NO: 315573 - DNA, 20 bp, Artificial Sequence
  chemically synthesized
taatggttatgatggtaagg

SEQ ID NO: 315574 - DNA, 20 bp, Artificial Sequence
  chemically synthesized
ttaatggttatgatggtaag

SEQ ID NO: 315575 - DNA, 20 bp, Artificial Sequence
  chemically synthesized
tttaatggttatgatggtaa

SEQ ID NO: 315576 - DNA, 20 bp, Artificial Sequence
  chemically synthesized
gtttaatggttatgatggta

SEQ ID NO: 315577 - DNA, 20 bp, Artificial Sequence
  chemically synthesized
agtttaatggttatgatggt

SEQ ID NO: 315578 - DNA, 20 bp, Artificial Sequence
  chemically synthesized
tgaaagtttaatggttatga

SEQ ID NO: 315579 - DNA, 20 bp, Artificial Sequence
  chemically synthesized
agtgcttaatgaaagtttaa

SEQ ID NO: 315580 - DNA, 20 bp, Artificial Sequence
  chemically synthesized
ataaccattaaactttcatt

SEQ ID NO: 315581 - DNA, 20 bp, Artificial Sequence
  chemically synthesized
ccctcataagtgcttaatga

SEQ ID NO: 315582 - DNA, 20 bp, Artificial Sequence
  chemically synthesized
aactttcattaagcacttat

SEQ ID NO: 315583 - DNA, 20 bp, Artificial Sequence
  chemically synthesized
actttcattaagcacttatg

SEQ ID NO: 315584 - DNA, 20 bp, Artificial Sequence
  chemically synthesized
ctttcattaagcacttatga

SEQ ID NO: 315585 - DNA, 20 bp, Artificial Sequence
  chemically synthesized
ttcctgtcttttgccctcat

SEQ ID NO: 315586 - DNA, 20 bp, Artificial Sequence
  chemically synthesized
ttaagcacttatgagggcaa

SEQ ID NO: 315587 - DNA, 20 bp, Artificial Sequence
  chemically synthesized
gcacttatgagggcaaaaga

SEQ ID NO: 315588 - DNA, 20 bp, Artificial Sequence
  chemically synthesized
cacttatgagggcaaaagac

SEQ ID NO: 315589 - DNA, 20 bp, Artificial Sequence
  chemically synthesized
ggaaataaaatgaaacttca

SEQ ID NO: 315590 - DNA, 20 bp, Artificial Sequence
  chemically synthesized
aataaaatgaaacttcatag

SEQ ID NO: 315591 - DNA, 20 bp, Artificial Sequence
  chemically synthesized
tgttgtttgtttctgctatg

SEQ ID NO: 315592 - DNA, 20 bp, Artificial Sequence
  chemically synthesized
actcactctcatatttagca

SEQ ID NO: 315593 - DNA, 20 bp, Artificial Sequence
  chemically synthesized
aactcactctcatatttagc

SEQ ID NO: 315594 - DNA, 20 bp, Artificial Sequence
  chemically synthesized
attttaaccttgctaaatat

SEQ ID NO: 315595 - DNA, 20 bp, Artificial Sequence
  chemically synthesized
tttaaccttgctaaatatga

SEQ ID NO: 315596 - DNA, 20 bp, Artificial Sequence
  chemically synthesized
agcaaactcactctcatatt

SEQ ID NO: 315597 - DNA, 20 bp, Artificial Sequence
  chemically synthesized
accttgctaaatatgagagt

SEQ ID NO: 315598 - DNA, 20 bp, Artificial Sequence
  chemically synthesized
caagtggtgcttttagtggt

SEQ ID NO: 315599 - DNA, 20 bp, Artificial Sequence
  chemically synthesized
gtgagtttgctaaccactaa

SEQ ID NO: 315600 - DNA, 20 bp, Artificial Sequence
  chemically synthesized
ggatcaagtggtgcttttag

SEQ ID NO: 315601 - DNA, 20 bp, Artificial Sequence
  chemically synthesized
ataggatcaagtggtgcttt

SEQ ID NO: 315602 - DNA, 20 bp, Artificial Sequence
  chemically synthesized
gacagtgccataggatcaag

SEQ ID NO: 315603 - DNA, 20 bp, Artificial Sequence
  chemically synthesized
aaaagcaccacttgatccta

SEQ ID NO: 315604 - DNA, 20 bp, Artificial Sequence
  chemically synthesized
tttgacagtgccataggatc

SEQ ID NO: 315605 - DNA, 20 bp, Artificial Sequence
  chemically synthesized
gttaagtttgacagtgccat

SEQ ID NO: 315606 - DNA, 20 bp, Artificial Sequence
  chemically synthesized
agttaagtttgacagtgcca

SEQ ID NO: 315607 - DNA, 20 bp, Artificial Sequence
  chemically synthesized
agtgattcagttaagtttga

SEQ ID NO: 315608 - DNA, 20 bp, Artificial Sequence
  chemically synthesized
gaaggataagtgattcagtt

SEQ ID NO: 315609 - DNA, 20 bp, Artificial Sequence
  chemically synthesized
tggaagaaggataagtgatt

SEQ ID NO: 315610 - DNA, 20 bp, Artificial Sequence
  chemically synthesized
gcaatagttggaagaaggat

SEQ ID NO: 315611 - DNA, 20 bp, Artificial Sequence
  chemically synthesized
gaaatgcaatagttggaaga

SEQ ID NO: 315612 - DNA, 20 bp, Artificial Sequence
  chemically synthesized
agaaatgcaatagttggaag

SEQ ID NO: 315613 - DNA, 20 bp, Artificial Sequence
  chemically synthesized
aagagaaatgcaatagttgg

SEQ ID NO: 315614 - DNA, 20 bp, Artificial Sequence
  chemically synthesized
aaaaagagaaatgcaatagt

SEQ ID NO: 315615 - DNA, 20 bp, Artificial Sequence
  chemically synthesized
agtgaaaaagagaaatgcaa

SEQ ID NO: 315616 - DNA, 20 bp, Artificial Sequence
  chemically synthesized
agaaaataggcagtgaaaaa

SEQ ID NO: 315617 - DNA, 20 bp, Artificial Sequence
  chemically synthesized
taagaaaataggcagtgaaa

SEQ ID NO: 315618 - DNA, 20 bp, Artificial Sequence
  chemically synthesized
ttggtaattaagaaaatagg

SEQ ID NO: 315619 - DNA, 20 bp, Artificial Sequence
  chemically synthesized
agattggtaattaagaaaat

SEQ ID NO: 315620 - DNA, 20 bp, Artificial Sequence
  chemically synthesized
gagattggtaattaagaaaa

SEQ ID NO: 315621 - DNA, 20 bp, Artificial Sequence
  chemically synthesized
gggacttgagattggtaatt

SEQ ID NO: 315622 - DNA, 20 bp, Artificial Sequence
  chemically synthesized
ttttcttaattaccaatctc

SEQ ID NO: 315623 - DNA, 20 bp, Artificial Sequence
  chemically synthesized
gggcaattgggacttgagat

SEQ ID NO: 315624 - DNA, 20 bp, Artificial Sequence
  chemically synthesized
ggactgggcaattgggactt

SEQ ID NO: 315625 - DNA, 20 bp, Artificial Sequence
  chemically synthesized
aatctcaagtcccaattgcc

SEQ ID NO: 315626 - DNA, 20 bp, Artificial Sequence
  chemically synthesized
gattctgggactgggcaatt

SEQ ID NO: 315627 - DNA, 20 bp, Artificial Sequence
  chemically synthesized
agattctgggactgggcaat

SEQ ID NO: 315628 - DNA, 20 bp, Artificial Sequence
  chemically synthesized
aagtcccaattgcccagtcc

SEQ ID NO: 315629 - DNA, 20 bp, Artificial Sequence
  chemically synthesized
aagtaatagattctgggact

SEQ ID NO: 315630 - DNA, 20 bp, Artificial Sequence
  chemically synthesized
aaagtaatagattctgggac

SEQ ID NO: 315631 - DNA, 20 bp, Artificial Sequence
  chemically synthesized
agctcaaagtaatagattct

SEQ ID NO: 315632 - DNA, 20 bp, Artificial Sequence
  chemically synthesized
aagctcaaagtaatagattc

SEQ ID NO: 315633 - DNA, 20 bp, Artificial Sequence
  chemically synthesized
gtcccagaatctattacttt

SEQ ID NO: 315634 - DNA, 20 bp, Artificial Sequence
  chemically synthesized
gaacaaaaagctcaaagtaa

SEQ ID NO: 315635 - DNA, 20 bp, Artificial Sequence
  chemically synthesized
ggatatgaacaaaaagctca

SEQ ID NO: 315636 - DNA, 20 bp, Artificial Sequence
  chemically synthesized
agatttaggatatgaacaaa

SEQ ID NO: 315637 - DNA, 20 bp, Artificial Sequence
  chemically synthesized
ttttgttcatatcctaaatc

SEQ ID NO: 315638 - DNA, 20 bp, Artificial Sequence
  chemically synthesized
aaaccaataggactagattt

SEQ ID NO: 315639 - DNA, 20 bp, Artificial Sequence
  chemically synthesized
aaaaccaataggactagatt

SEQ ID NO: 315640 - DNA, 20 bp, Artificial Sequence
  chemically synthesized
tatcctaaatctagtcctat

SEQ ID NO: 315641 - DNA, 20 bp, Artificial Sequence
  chemically synthesized
caaatcaaaaccaataggac

SEQ ID NO: 315642 - DNA, 20 bp, Artificial Sequence
  chemically synthesized
gatatcaaatcaaaaccaat

SEQ ID NO: 315643 - DNA, 20 bp, Artificial Sequence
  chemically synthesized
ggatatcaaatcaaaaccaa

SEQ ID NO: 315644 - DNA, 20 bp, Artificial Sequence
  chemically synthesized
attggttttgatttgatatc

SEQ ID NO: 315645 - DNA, 20 bp, Artificial Sequence
  chemically synthesized
taaacaggtacaaagcattc

SEQ ID NO: 315646 - DNA, 20 bp, Artificial Sequence
  chemically synthesized
aaaaattgtaaacaggtaca

SEQ ID NO: 315647 - DNA, 20 bp, Artificial Sequence
  chemically synthesized
tgacaacaaaaattgtaaac

SEQ ID NO: 315648 - DNA, 20 bp, Artificial Sequence
  chemically synthesized
atgacaacaaaaattgtaaa

SEQ ID NO: 315649 - DNA, 20 bp, Artificial Sequence
  chemically synthesized
ttgttgtcattgctttcatt

SEQ ID NO: 315650 - DNA, 20 bp, Artificial Sequence
  chemically synthesized
tgttgtcattgctttcattc

SEQ ID NO: 315651 - DNA, 20 bp, Artificial Sequence
  chemically synthesized
agtatatagagcctgaatga

SEQ ID NO: 315652 - DNA, 20 bp, Artificial Sequence
  chemically synthesized
gatattgctgaaagtatata

SEQ ID NO: 315653 - DNA, 20 bp, Artificial Sequence
  chemically synthesized
aggatattgctgaaagtata

SEQ ID NO: 315654 - DNA, 20 bp, Artificial Sequence
  chemically synthesized
attcaggctctatatacttt

SEQ ID NO: 315655 - DNA, 20 bp, Artificial Sequence
  chemically synthesized
tgttaagaggatattgctga

SEQ ID NO: 315656 - DNA, 20 bp, Artificial Sequence
  chemically synthesized
aggccggaaaacatgttaag

SEQ ID NO: 315657 - DNA, 20 bp, Artificial Sequence
  chemically synthesized
gaggccggaaaacatgttaa

SEQ ID NO: 315658 - DNA, 20 bp, Artificial Sequence
  chemically synthesized
aggaggccggaaaacatgtt

SEQ ID NO: 315659 - DNA, 20 bp, Artificial Sequence
  chemically synthesized
tatcctcttaacatgttttc

SEQ ID NO: 315660 - DNA, 20 bp, Artificial Sequence
  chemically synthesized
agagcagagaaacaggaggc

SEQ ID NO: 315661 - DNA, 20 bp, Artificial Sequence
  chemically synthesized
taaaagagcagagaaacagg

SEQ ID NO: 315662 - DNA, 20 bp, Artificial Sequence
  chemically synthesized
ataaaagagcagagaaacag

SEQ ID NO: 315663 - DNA, 20 bp, Artificial Sequence
  chemically synthesized
aaataaaagagcagagaaac

SEQ ID NO: 315664 - DNA, 20 bp, Artificial Sequence
  chemically synthesized
taaataaaagagcagagaaa

SEQ ID NO: 315665 - DNA, 20 bp, Artificial Sequence
  chemically synthesized
tgaggataaataaaagagca

SEQ ID NO: 315666 - DNA, 20 bp, Artificial Sequence
  chemically synthesized
tttgaggataaataaaagag

SEQ ID NO: 315667 - DNA, 20 bp, Artificial Sequence
  chemically synthesized
ttttttgaggataaataaaa

SEQ ID NO: 315668 - DNA, 20 bp, Artificial Sequence
  chemically synthesized
tattttttgaggataaataa

SEQ ID NO: 315669 - DNA, 20 bp, Artificial Sequence
  chemically synthesized
atttaagaagatattttttg

SEQ ID NO: 315670 - DNA, 20 bp, Artificial Sequence
  chemically synthesized
tatttaagaagatatttttt

SEQ ID NO: 315671 - DNA, 20 bp, Artificial Sequence
  chemically synthesized
aacttatcttaatatttaag

SEQ ID NO: 315672 - DNA, 20 bp, Artificial Sequence
  chemically synthesized
aaaatatcttcttaaatatt

SEQ ID NO: 315673 - DNA, 20 bp, Artificial Sequence
  chemically synthesized
gaaaacttatcttaatattt

SEQ ID NO: 315674 - DNA, 20 bp, Artificial Sequence
  chemically synthesized
atcttcttaaatattaagat

SEQ ID NO: 315675 - DNA, 20 bp, Artificial Sequence
  chemically synthesized
actagaaatagcagcaattt

SEQ ID NO: 315676 - DNA, 20 bp, Artificial Sequence
  chemically synthesized
aactagaaatagcagcaatt

SEQ ID NO: 315677 - DNA, 20 bp, Artificial Sequence
  chemically synthesized
tcctaaattgctgctatttc

SEQ ID NO: 315678 - DNA, 20 bp, Artificial Sequence
  chemically synthesized
agaaattaaactagaaatag

SEQ ID NO: 315679 - DNA, 20 bp, Artificial Sequence
  chemically synthesized
atgagaaattaaactagaaa

SEQ ID NO: 315680 - DNA, 20 bp, Artificial Sequence
  chemically synthesized
ttattcatgagaaattaaac

SEQ ID NO: 315681 - DNA, 20 bp, Artificial Sequence
  chemically synthesized
aacaggaaaccattattcat

SEQ ID NO: 315682 - DNA, 20 bp, Artificial Sequence
  chemically synthesized
gtttaatttctcatgaataa

SEQ ID NO: 315683 - DNA, 20 bp, Artificial Sequence
  chemically synthesized
gtagtagttctatgagtaac

SEQ ID NO: 315684 - DNA, 20 bp, Artificial Sequence
  chemically synthesized
taatggtttcctgttactca

SEQ ID NO: 315685 - DNA, 20 bp, Artificial Sequence
  chemically synthesized
agtagtagttctatgagtaa

SEQ ID NO: 315686 - DNA, 20 bp, Artificial Sequence
  chemically synthesized
atttgcagtagtagttctat

SEQ ID NO: 315687 - DNA, 20 bp, Artificial Sequence
  chemically synthesized
gactcaggcatttgcagtag

SEQ ID NO: 315688 - DNA, 20 bp, Artificial Sequence
  chemically synthesized
aaagactcaggcatttgcag

SEQ ID NO: 315689 - DNA, 20 bp, Artificial Sequence
  chemically synthesized
ataaaagactcaggcatttg

SEQ ID NO: 315690 - DNA, 20 bp, Artificial Sequence
  chemically synthesized
aactactactgcaaatgcct

SEQ ID NO: 315691 - DNA, 20 bp, Artificial Sequence
  chemically synthesized
gagtcttatataaaagactc

SEQ ID NO: 315692 - DNA, 20 bp, Artificial Sequence
  chemically synthesized
tgagtcttatataaaagact

SEQ ID NO: 315693 - DNA, 20 bp, Artificial Sequence
  chemically synthesized
aatgcctgagtcttttatat

SEQ ID NO: 315694 - DNA, 20 bp, Artificial Sequence
  chemically synthesized
tgatcatgagtcttatataa

SEQ ID NO: 315695 - DNA, 20 bp, Artificial Sequence
  chemically synthesized
tgatcatggagggtgatcat

SEQ ID NO: 315696 - DNA, 20 bp, Artificial Sequence
  chemically synthesized
gatttaagcctgatcatgga

SEQ ID NO: 315697 - DNA, 20 bp, Artificial Sequence
  chemically synthesized
tcatgatcaccctccatgat

SEQ ID NO: 315698 - DNA, 20 bp, Artificial Sequence
  chemically synthesized
ggatttaagcctgatcatgg

SEQ ID NO: 315699 - DNA, 20 bp, Artificial Sequence
  chemically synthesized
catgatcaccctccatgatc

SEQ ID NO: 315700 - DNA, 20 bp, Artificial Sequence
  chemically synthesized
aggatttaagcctgatcatg

SEQ ID NO: 315701 - DNA, 20 bp, Artificial Sequence
  chemically synthesized
ggaggatttaagcctgatca

SEQ ID NO: 315702 - DNA, 20 bp, Artificial Sequence
  chemically synthesized
tactgaatgctggaggattt

SEQ ID NO: 315703 - DNA, 20 bp, Artificial Sequence
  chemically synthesized
atgatcaggcttaaatcctc

SEQ ID NO: 315704 - DNA, 20 bp, Artificial Sequence
  chemically synthesized
tgtactatactgaatgctgg

SEQ ID NO: 315705 - DNA, 20 bp, Artificial Sequence
  chemically synthesized
ggcttaaatcctccagcatt

SEQ ID NO: 315706 - DNA, 20 bp, Artificial Sequence
  chemically synthesized
ttgtactatactgaatgctg

SEQ ID NO: 315707 - DNA, 20 bp, Artificial Sequence
  chemically synthesized
tcttgtactatactgaatgc

SEQ ID NO: 315708 - DNA, 20 bp, Artificial Sequence
  chemically synthesized
aaatcctccagcattcagta

SEQ ID NO: 315709 - DNA, 20 bp, Artificial Sequence
  chemically synthesized
tccagcattcagtatagtac

SEQ ID NO: 315710 - DNA, 20 bp, Artificial Sequence
  chemically synthesized
tacaagacatcgtaaatgat

SEQ ID NO: 315711 - DNA, 20 bp, Artificial Sequence
  chemically synthesized
catgggtgctgtgaagaatg

SEQ ID NO: 315712 - DNA, 20 bp, Artificial Sequence
  chemically synthesized
attggtttctgcattcttca

SEQ ID NO: 315713 - DNA, 20 bp, Artificial Sequence
  chemically synthesized
tatagcacatgggtgctgtg

SEQ ID NO: 315714 - DNA, 20 bp, Artificial Sequence
  chemically synthesized
aaaccctcattatagcacat

SEQ ID NO: 315715 - DNA, 20 bp, Artificial Sequence
  chemically synthesized
caaaccctcattatagcaca

SEQ ID NO: 315716 - DNA, 20 bp, Artificial Sequence
  chemically synthesized
cagcacccatgtgctataat

SEQ ID NO: 315717 - DNA, 20 bp, Artificial Sequence
  chemically synthesized
agcacccatgtgctataatg

SEQ ID NO: 315718 - DNA, 20 bp, Artificial Sequence
  chemically synthesized
gcacccatgtgctataatga

SEQ ID NO: 315719 - DNA, 20 bp, Artificial Sequence
  chemically synthesized
cactgaacaaaccctcatta

SEQ ID NO: 315720 - DNA, 20 bp, Artificial Sequence
  chemically synthesized
tgctataatgagggtttgtt

SEQ ID NO: 315721 - DNA, 20 bp, Artificial Sequence
  chemically synthesized
tgagggtttgttcagtgata

SEQ ID NO: 315722 - DNA, 20 bp, Artificial Sequence
  chemically synthesized
gtttgttcagtgatatggaa

SEQ ID NO: 315723 - DNA, 20 bp, Artificial Sequence
  chemically synthesized
tgatatggaatagaatgcaa

SEQ ID NO: 315724 - DNA, 20 bp, Artificial Sequence
  chemically synthesized
aatggaatgaaatgaaatgt

SEQ ID NO: 315725 - DNA, 20 bp, Artificial Sequence
  chemically synthesized
aaatgaaatgtcagatcctt

SEQ ID NO: 315726 - DNA, 20 bp, Artificial Sequence
  chemically synthesized
tgaaatgtcagatcctttgg

SEQ ID NO: 315727 - DNA, 20 bp, Artificial Sequence
  chemically synthesized
attaggtataattctgccaa

SEQ ID NO: 315728 - DNA, 20 bp, Artificial Sequence
  chemically synthesized
gattaggtataattctgcca

SEQ ID NO: 315729 - DNA, 20 bp, Artificial Sequence
  chemically synthesized
tcatgttacagagaaggatt

SEQ ID NO: 315730 - DNA, 20 bp, Artificial Sequence
  chemically synthesized
ttcatgttacagagaaggat

SEQ ID NO: 315731 - DNA, 20 bp, Artificial Sequence
  chemically synthesized
agatgttcatgttacagaga

SEQ ID NO: 315732 - DNA, 20 bp, Artificial Sequence
  chemically synthesized
tagatgttcatgttacagag

SEQ ID NO: 315733 - DNA, 20 bp, Artificial Sequence
  chemically synthesized
atctagatgttcatgttaca

SEQ ID NO: 315734 - DNA, 20 bp, Artificial Sequence
  chemically synthesized
tgatctagatgttcatgtta

SEQ ID NO: 315735 - DNA, 20 bp, Artificial Sequence
  chemically synthesized
ttctctgtaacatgaacatc

SEQ ID NO: 315736 - DNA, 20 bp, Artificial Sequence
  chemically synthesized
tggtgacctttaaaatgatc

SEQ ID NO: 315737 - DNA, 20 bp, Artificial Sequence
  chemically synthesized
tgaacatctagatcatttta

SEQ ID NO: 315738 - DNA, 20 bp, Artificial Sequence
  chemically synthesized
gaacatctagatcattttaa

SEQ ID NO: 315739 - DNA, 20 bp, Artificial Sequence
  chemically synthesized
tagatcattttaaaggtcac

SEQ ID NO: 315740 - DNA, 20 bp, Artificial Sequence
  chemically synthesized
cattttaaaggtcaccagat

SEQ ID NO: 315741 - DNA, 20 bp, Artificial Sequence
  chemically synthesized
attttaaaggtcaccagatg

SEQ ID NO: 315742 - DNA, 20 bp, Artificial Sequence
  chemically synthesized
gattgtgaaatatcctcatc

SEQ ID NO: 315743 - DNA, 20 bp, Artificial Sequence
  chemically synthesized
atgaggatatttcacaatct

SEQ ID NO: 315744 - DNA, 20 bp, Artificial Sequence
  chemically synthesized
aggcagacatttgggttgcc

SEQ ID NO: 315745 - DNA, 20 bp, Artificial Sequence
  chemically synthesized
ttagttaaaggcagacattt

SEQ ID NO: 315746 - DNA, 20 bp, Artificial Sequence
  chemically synthesized
gttagttaaaggcagacatt

SEQ ID NO: 315747 - DNA, 20 bp, Artificial Sequence
  chemically synthesized
tcttgaaggttagttaaagg

SEQ ID NO: 315748 - DNA, 20 bp, Artificial Sequence
  chemically synthesized
ttttcttgaaggttagttaa

SEQ ID NO: 315749 - DNA, 20 bp, Artificial Sequence
  chemically synthesized
cttttcttgaaggttagtta

SEQ ID NO: 315750 - DNA, 20 bp, Artificial Sequence
  chemically synthesized
tctgcctttaactaaccttc

SEQ ID NO: 315751 - DNA, 20 bp, Artificial Sequence
  chemically synthesized
cctatccttttcttgaaggt

SEQ ID NO: 315752 - DNA, 20 bp, Artificial Sequence
  chemically synthesized
ctttaactaaccttcaagaa

SEQ ID NO: 315753 - DNA, 20 bp, Artificial Sequence
  chemically synthesized
gtcacctatccttttcttga

SEQ ID NO: 315754 - DNA, 20 bp, Artificial Sequence
  chemically synthesized
tttaactaaccttcaagaaa

SEQ ID NO: 315755 - DNA, 20 bp, Artificial Sequence
  chemically synthesized
agtcacctatccttttcttg

SEQ ID NO: 315756 - DNA, 20 bp, Artificial Sequence
  chemically synthesized
actaaccttcaagaaaagga

SEQ ID NO: 315757 - DNA, 20 bp, Artificial Sequence
  chemically synthesized
ctaaccttcaagaaaaggat

SEQ ID NO: 315758 - DNA, 20 bp, Artificial Sequence
  chemically synthesized
caagaaaaggataggtgact

SEQ ID NO: 315759 - DNA, 20 bp, Artificial Sequence
  chemically synthesized
ggataggtgactgagtttct

SEQ ID NO: 315760 - DNA, 20 bp, Artificial Sequence
  chemically synthesized
taagtagcctcttagaaact

SEQ ID NO: 315761 - DNA, 20 bp, Artificial Sequence
  chemically synthesized
ataggtgactgagtttctaa

SEQ ID NO: 315762 - DNA, 20 bp, Artificial Sequence
  chemically synthesized
taggtgactgagtttctaag

SEQ ID NO: 315763 - DNA, 20 bp, Artificial Sequence
  chemically synthesized
atacaaactaagtagcctct

SEQ ID NO: 315764 - DNA, 20 bp, Artificial Sequence
  chemically synthesized
tgagtttctaagaggctact

SEQ ID NO: 315765 - DNA, 20 bp, Artificial Sequence
  chemically synthesized
actgattaatacaaactaag

SEQ ID NO: 315766 - DNA, 20 bp, Artificial Sequence
  chemically synthesized
aatactgattaatacaaact

SEQ ID NO: 315767 - DNA, 20 bp, Artificial Sequence
  chemically synthesized
gctacttagtttgtattaat

SEQ ID NO: 315768 - DNA, 20 bp, Artificial Sequence
  chemically synthesized
ttcacatataaccttcactg

SEQ ID NO: 315769 - DNA, 20 bp, Artificial Sequence
  chemically synthesized
ctatattctgacttcagtga

SEQ ID NO: 315770 - DNA, 20 bp, Artificial Sequence
  chemically synthesized
tctatattctgacttcagtg

SEQ ID NO: 315771 - DNA, 20 bp, Artificial Sequence
  chemically synthesized
catataaccttcactgaagt

SEQ ID NO: 315772 - DNA, 20 bp, Artificial Sequence
  chemically synthesized
tatactctatattctgactt

SEQ ID NO: 315773 - DNA, 20 bp, Artificial Sequence
  chemically synthesized
ccttcactgaagtcagaata

SEQ ID NO: 315774 - DNA, 20 bp, Artificial Sequence
  chemically synthesized
ttcactgaagtcagaatata

SEQ ID NO: 315775 - DNA, 20 bp, Artificial Sequence
  chemically synthesized
tatagagtatatattcacat

SEQ ID NO: 315776 - DNA, 20 bp, Artificial Sequence
  chemically synthesized
acaaagactttacaaattac

SEQ ID NO: 315777 - DNA, 20 bp, Artificial Sequence
  chemically synthesized
gcaaattcttgtaatttgta

SEQ ID NO: 315778 - DNA, 20 bp, Artificial Sequence
  chemically synthesized
ccttggtgacagcatcaaca

SEQ ID NO: 315779 - DNA, 20 bp, Artificial Sequence
  chemically synthesized
tctttgttgatgctgtcacc

SEQ ID NO: 315780 - DNA, 20 bp, Artificial Sequence
  chemically synthesized
ctttgttgatgctgtcacca

SEQ ID NO: 315781 - DNA, 20 bp, Artificial Sequence
  chemically synthesized
tagatgcataaccttggtga

SEQ ID NO: 315782 - DNA, 20 bp, Artificial Sequence
  chemically synthesized
tgtgcatagatgcataacct

SEQ ID NO: 315783 - DNA, 20 bp, Artificial Sequence
  chemically synthesized
ggttatgcatctatgcacaa

SEQ ID NO: 315784 - DNA, 20 bp, Artificial Sequence
  chemically synthesized
gagatttagacttttgtgca

SEQ ID NO: 315785 - DNA, 20 bp, Artificial Sequence
  chemically synthesized
ttccattcttttgagagatt

SEQ ID NO: 315786 - DNA, 20 bp, Artificial Sequence
  chemically synthesized
caaaagtctaaatctctcaa

SEQ ID NO: 315787 - DNA, 20 bp, Artificial Sequence
  chemically synthesized
taggttttccattcttttga

SEQ ID NO: 315788 - DNA, 20 bp, Artificial Sequence
  chemically synthesized
gtctaaatctctcaaaagaa

SEQ ID NO: 315789 - DNA, 20 bp, Artificial Sequence
  chemically synthesized
gctaggttttccattctttt

SEQ ID NO: 315790 - DNA, 20 bp, Artificial Sequence
  chemically synthesized
tctcaaaagaatggaaaacc

SEQ ID NO: 315791 - DNA, 20 bp, Artificial Sequence
  chemically synthesized
aaaagaatggaaaacctagc

SEQ ID NO: 315792 - DNA, 20 bp, Artificial Sequence
  chemically synthesized
taaagctgagtttactagct

SEQ ID NO: 315793 - DNA, 20 bp, Artificial Sequence
  chemically synthesized
ttaaagctgagtttactagc

SEQ ID NO: 315794 - DNA, 20 bp, Artificial Sequence
  chemically synthesized
gaaaacctagctagtaaact

SEQ ID NO: 315795 - DNA, 20 bp, Artificial Sequence
  chemically synthesized
aagtttaaagctgagtttac

SEQ ID NO: 315796 - DNA, 20 bp, Artificial Sequence
  chemically synthesized
ctgcgatgaagtttaaagct

SEQ ID NO: 315797 - DNA, 20 bp, Artificial Sequence
  chemically synthesized
tgagactgcgatgaagttta

SEQ ID NO: 315798 - DNA, 20 bp, Artificial Sequence
  chemically synthesized
ctcagctttaaacttcatcg

SEQ ID NO: 315799 - DNA, 20 bp, Artificial Sequence
  chemically synthesized
ggcacagtgagactgcgatg

SEQ ID NO: 315800 - DNA, 20 bp, Artificial Sequence
  chemically synthesized
tcatcgcagtctcactgtgc

SEQ ID NO: 315801 - DNA, 20 bp, Artificial Sequence
  chemically synthesized
cttttgtctcctggcacagt

SEQ ID NO: 315802 - DNA, 20 bp, Artificial Sequence
  chemically synthesized
catcgcagtctcactgtgcc

SEQ ID NO: 315803 - DNA, 20 bp, Artificial Sequence
  chemically synthesized
tcgcagtctcactgtgccag

SEQ ID NO: 315804 - DNA, 20 bp, Artificial Sequence
  chemically synthesized
aaatcttttgtctcctggca

SEQ ID NO: 315805 - DNA, 20 bp, Artificial Sequence
  chemically synthesized
cagtgaaatcttttgtctcc

SEQ ID NO: 315806 - DNA, 20 bp, Artificial Sequence
  chemically synthesized
ctcactgtgccaggagacaa

SEQ ID NO: 315807 - DNA, 20 bp, Artificial Sequence
  chemically synthesized
ttcaaaaggaaaatatttaa

SEQ ID NO: 315808 - DNA, 20 bp, Artificial Sequence
  chemically synthesized
ttggaggcatttttttcaaa

SEQ ID NO: 315809 - DNA, 20 bp, Artificial Sequence
  chemically synthesized
tttggaggcatttttttcaa

SEQ ID NO: 315810 - DNA, 20 bp, Artificial Sequence
  chemically synthesized
tgaaaaaaatgcctccaaaa

SEQ ID NO: 315811 - DNA, 20 bp, Artificial Sequence
  chemically synthesized
aaagaagtttgccattttgg

SEQ ID NO: 315812 - DNA, 20 bp, Artificial Sequence
  chemically synthesized
taaagaagtttgccattttg

SEQ ID NO: 315813 - DNA, 20 bp, Artificial Sequence
  chemically synthesized
agtaaagaagtttgccattt

SEQ ID NO: 315814 - DNA, 20 bp, Artificial Sequence
  chemically synthesized
agctttcattaatagtaaag

SEQ ID NO: 315815 - DNA, 20 bp, Artificial Sequence
  chemically synthesized
ttgagctttcattaatagta

SEQ ID NO: 315816 - DNA, 20 bp, Artificial Sequence
  chemically synthesized
aacttctttactattaatga

SEQ ID NO: 315817 - DNA, 20 bp, Artificial Sequence
  chemically synthesized
aagccttgagctttcattaa

SEQ ID NO: 315818 - DNA, 20 bp, Artificial Sequence
  chemically synthesized
tttactattaatgaaagctc

SEQ ID NO: 315819 - DNA, 20 bp, Artificial Sequence
  chemically synthesized
ttactattaatgaaagctca

SEQ ID NO: 315820 - DNA, 20 bp, Artificial Sequence
  chemically synthesized
tattgaggaggaaaagcctt

SEQ ID NO: 315821 - DNA, 20 bp, Artificial Sequence
  chemically synthesized
atgatgctattgaggaggaa

SEQ ID NO: 315822 - DNA, 20 bp, Artificial Sequence
  chemically synthesized
tcaaggcttttcctcctcaa

SEQ ID NO: 315823 - DNA, 20 bp, Artificial Sequence
  chemically synthesized
gtggcatgatgctattgagg

SEQ ID NO: 315824 - DNA, 20 bp, Artificial Sequence
  chemically synthesized
agtggcatgatgctattgag

SEQ ID NO: 315825 - DNA, 20 bp, Artificial Sequence
  chemically synthesized
ggagtggcatgatgctattg

SEQ ID NO: 315826 - DNA, 20 bp, Artificial Sequence
  chemically synthesized
aggagtggcatgatgctatt

SEQ ID NO: 315827 - DNA, 20 bp, Artificial Sequence
  chemically synthesized
tagcatcatgccactccttc

SEQ ID NO: 315828 - DNA, 20 bp, Artificial Sequence
  chemically synthesized
aaggatttccctcgaaggag

SEQ ID NO: 315829 - DNA, 20 bp, Artificial Sequence
  chemically synthesized
agcatcatgccactccttcg

SEQ ID NO: 315830 - DNA, 20 bp, Artificial Sequence
  chemically synthesized
gcatcatgccactccttcga

SEQ ID NO: 315831 - DNA, 20 bp, Artificial Sequence
  chemically synthesized
tgaaaggatttccctcgaag

SEQ ID NO: 315832 - DNA, 20 bp, Artificial Sequence
  chemically synthesized
aatgaaaggatttccctcga

SEQ ID NO: 315833 - DNA, 20 bp, Artificial Sequence
  chemically synthesized
gaatgaaaggatttccctcg

SEQ ID NO: 315834 - DNA, 20 bp, Artificial Sequence
  chemically synthesized
tgatgttgacaaagaatgaa

SEQ ID NO: 315835 - DNA, 20 bp, Artificial Sequence
  chemically synthesized
gtgatgttgacaaagaatga

SEQ ID NO: 315836 - DNA, 20 bp, Artificial Sequence
  chemically synthesized
atttattagtgatgttgaca

SEQ ID NO: 315837 - DNA, 20 bp, Artificial Sequence
  chemically synthesized
tcttaaggggtagaatttat

SEQ ID NO: 315838 - DNA, 20 bp, Artificial Sequence
  chemically synthesized
actaataaattctacccctt

SEQ ID NO: 315839 - DNA, 20 bp, Artificial Sequence
  chemically synthesized
gtcttttttgtcttaagggg

SEQ ID NO: 315840 - DNA, 20 bp, Artificial Sequence
  chemically synthesized
ctggtcttttttgtcttaag

SEQ ID NO: 315841 - DNA, 20 bp, Artificial Sequence
  chemically synthesized
gctggtcttttttgtcttaa

SEQ ID NO: 315842 - DNA, 20 bp, Artificial Sequence
  chemically synthesized
agctggtcttttttgtctta

SEQ ID NO: 315843 - DNA, 20 bp, Artificial Sequence
  chemically synthesized
tagctggtcttttttgtctt

SEQ ID NO: 315844 - DNA, 20 bp, Artificial Sequence
  chemically synthesized
ttctaccccttaagacaaaa

SEQ ID NO: 315845 - DNA, 20 bp, Artificial Sequence
  chemically synthesized
ccccttaagacaaaaaagac

SEQ ID NO: 315846 - DNA, 20 bp, Artificial Sequence
  chemically synthesized
ttaagacaaaaaagaccagc

SEQ ID NO: 315847 - DNA, 20 bp, Artificial Sequence
  chemically synthesized
atatcacatataattctagc

SEQ ID NO: 315848 - DNA, 20 bp, Artificial Sequence
  chemically synthesized
aaatatatcacatataattc

SEQ ID NO: 315849 - DNA, 20 bp, Artificial Sequence
  chemically synthesized
atatgtgatatattttttca

SEQ ID NO: 315850 - DNA, 20 bp, Artificial Sequence
  chemically synthesized
tatgtgatatattttttcac

SEQ ID NO: 315851 - DNA, 20 bp, Artificial Sequence
  chemically synthesized
atgtgatatattttttcaca

SEQ ID NO: 315852 - DNA, 20 bp, Artificial Sequence
  chemically synthesized
tgtgatatattttttcacag

SEQ ID NO: 315853 - DNA, 20 bp, Artificial Sequence
  chemically synthesized
atattttttcacaggggaat

SEQ ID NO: 315854 - DNA, 20 bp, Artificial Sequence
  chemically synthesized
attttttcacaggggaatga

SEQ ID NO: 315855 - DNA, 20 bp, Artificial Sequence
  chemically synthesized
ttttttcacaggggaatgag

SEQ ID NO: 315856 - DNA, 20 bp, Artificial Sequence
  chemically synthesized
ggttcgatttgtttactccc

SEQ ID NO: 315857 - DNA, 20 bp, Artificial Sequence
  chemically synthesized
cgatttgtttactccccaga

SEQ ID NO: 315858 - DNA, 20 bp, Artificial Sequence
  chemically synthesized
caagagtgagtctttctggg

SEQ ID NO: 315859 - DNA, 20 bp, Artificial Sequence
  chemically synthesized
cccaagagtgagtctttctg

SEQ ID NO: 315860 - DNA, 20 bp, Artificial Sequence
  chemically synthesized
acccaagagtgagtctttct

SEQ ID NO: 315861 - DNA, 20 bp, Artificial Sequence
  chemically synthesized
cacccaagagtgagtctttc

SEQ ID NO: 315862 - DNA, 20 bp, Artificial Sequence
  chemically synthesized
tccccagaaagactcactct

SEQ ID NO: 315863 - DNA, 20 bp, Artificial Sequence
  chemically synthesized
ccccagaaagactcactctt

SEQ ID NO: 315864 - DNA, 20 bp, Artificial Sequence
  chemically synthesized
gctttgaggcacccaagagt

SEQ ID NO: 315865 - DNA, 20 bp, Artificial Sequence
  chemically synthesized
tttagctttgaggcacccaa

SEQ ID NO: 315866 - DNA, 20 bp, Artificial Sequence
  chemically synthesized
gctttagctttgaggcaccc

SEQ ID NO: 315867 - DNA, 20 bp, Artificial Sequence
  chemically synthesized
actcactcttgggtgcctca

SEQ ID NO: 315868 - DNA, 20 bp, Artificial Sequence
  chemically synthesized
agaggtttgctttagctttg

SEQ ID NO: 315869 - DNA, 20 bp, Artificial Sequence
  chemically synthesized
tcttgggtgcctcaaagcta

SEQ ID NO: 315870 - DNA, 20 bp, Artificial Sequence
  chemically synthesized
tagaggtttgctttagcttt

SEQ ID NO: 315871 - DNA, 20 bp, Artificial Sequence
  chemically synthesized
gagaatttagaggtttgctt

SEQ ID NO: 315872 - DNA, 20 bp, Artificial Sequence
  chemically synthesized
gctgtagggagagaatttag

SEQ ID NO: 315873 - DNA, 20 bp, Artificial Sequence
  chemically synthesized
tgctgtagggagagaattta

SEQ ID NO: 315874 - DNA, 20 bp, Artificial Sequence
  chemically synthesized
attgctgtagggagagaatt

SEQ ID NO: 315875 - DNA, 20 bp, Artificial Sequence
  chemically synthesized
acctctaaattctctcccta

SEQ ID NO: 315876 - DNA, 20 bp, Artificial Sequence
  chemically synthesized
catagacattgctgtaggga

SEQ ID NO: 315877 - DNA, 20 bp, Artificial Sequence
  chemically synthesized
ttcatagacattgctgtagg

SEQ ID NO: 315878 - DNA, 20 bp, Artificial Sequence
  chemically synthesized
ccttcatagacattgctgta

SEQ ID NO: 315879 - DNA, 20 bp, Artificial Sequence
  chemically synthesized
tccttcatagacattgctgt

SEQ ID NO: 315880 - DNA, 20 bp, Artificial Sequence
  chemically synthesized
atccttcatagacattgctg

SEQ ID NO: 315881 - DNA, 20 bp, Artificial Sequence
  chemically synthesized
tccctacagcaatgtctatg

SEQ ID NO: 315882 - DNA, 20 bp, Artificial Sequence
  chemically synthesized
ccctacagcaatgtctatga

SEQ ID NO: 315883 - DNA, 20 bp, Artificial Sequence
  chemically synthesized
gagaaaccactcatccttca

SEQ ID NO: 315884 - DNA, 20 bp, Artificial Sequence
  chemically synthesized
cagcaatgtctatgaaggat

SEQ ID NO: 315885 - DNA, 20 bp, Artificial Sequence
  chemically synthesized
caatgtctatgaaggatgag

SEQ ID NO: 315886 - DNA, 20 bp, Artificial Sequence
  chemically synthesized
gatgagtggtttctcccaaa

SEQ ID NO: 315887 - DNA, 20 bp, Artificial Sequence
  chemically synthesized
caattggctgcaccatttgg

SEQ ID NO: 315888 - DNA, 20 bp, Artificial Sequence
  chemically synthesized
ttcaattggctgcaccattt

SEQ ID NO: 315889 - DNA, 20 bp, Artificial Sequence
  chemically synthesized
gtggtttctcccaaatggtg

SEQ ID NO: 315890 - DNA, 20 bp, Artificial Sequence
  chemically synthesized
gttcaattggctgcaccatt

SEQ ID NO: 315891 - DNA, 20 bp, Artificial Sequence
  chemically synthesized
gtaaccaagaaaagttcaat

SEQ ID NO: 315892 - DNA, 20 bp, Artificial Sequence
  chemically synthesized
gcagccaattgaacttttct

SEQ ID NO: 315893 - DNA, 20 bp, Artificial Sequence
  chemically synthesized
ttactctgggtaaccaagaa

SEQ ID NO: 315894 - DNA, 20 bp, Artificial Sequence
  chemically synthesized
ttgaacttttcttggttacc

SEQ ID NO: 315895 - DNA, 20 bp, Artificial Sequence
  chemically synthesized
actctttactctgggtaacc

SEQ ID NO: 315896 - DNA, 20 bp, Artificial Sequence
  chemically synthesized
gaacttttcttggttaccca

SEQ ID NO: 315897 - DNA, 20 bp, Artificial Sequence
  chemically synthesized
tttcttggttacccagagta

SEQ ID NO: 315898 - DNA, 20 bp, Artificial Sequence
  chemically synthesized
ctagccaaactctttactct

SEQ ID NO: 315899 - DNA, 20 bp, Artificial Sequence
  chemically synthesized
tcttggttacccagagtaaa

SEQ ID NO: 315900 - DNA, 20 bp, Artificial Sequence
  chemically synthesized
tctagccaaactctttactc

SEQ ID NO: 315901 - DNA, 20 bp, Artificial Sequence
  chemically synthesized
gttacccagagtaaagagtt

SEQ ID NO: 315902 - DNA, 20 bp, Artificial Sequence
  chemically synthesized
cccagagtaaagagtttggc

SEQ ID NO: 315903 - DNA, 20 bp, Artificial Sequence
  chemically synthesized
aagagtttggctagatttaa

SEQ ID NO: 315904 - DNA, 20 bp, Artificial Sequence
  chemically synthesized
atggtggttactattaaatc

SEQ ID NO: 315905 - DNA, 20 bp, Artificial Sequence
  chemically synthesized
atttaatagtaaccaccata

SEQ ID NO: 315906 - DNA, 20 bp, Artificial Sequence
  chemically synthesized
tttaatagtaaccaccatat

SEQ ID NO: 315907 - DNA, 20 bp, Artificial Sequence
  chemically synthesized
aagcaattgatcctatatgg

SEQ ID NO: 315908 - DNA, 20 bp, Artificial Sequence
  chemically synthesized
gtaaagcaattgatcctata

SEQ ID NO: 315909 - DNA, 20 bp, Artificial Sequence
  chemically synthesized
cctggcaattaggtaaggta

SEQ ID NO: 315910 - DNA, 20 bp, Artificial Sequence
  chemically synthesized
ctgaacctggcaattaggta

SEQ ID NO: 315911 - DNA, 20 bp, Artificial Sequence
  chemically synthesized
actgaacctggcaattaggt

SEQ ID NO: 315912 - DNA, 20 bp, Artificial Sequence
  chemically synthesized
gctttaccttacctaattgc

SEQ ID NO: 315913 - DNA, 20 bp, Artificial Sequence
  chemically synthesized
ctttaccttacctaattgcc

SEQ ID NO: 315914 - DNA, 20 bp, Artificial Sequence
  chemically synthesized
ttttactgaacctggcaatt

SEQ ID NO: 315915 - DNA, 20 bp, Artificial Sequence
  chemically synthesized
cttttactgaacctggcaat

SEQ ID NO: 315916 - DNA, 20 bp, Artificial Sequence
  chemically synthesized
ccttacctaattgccaggtt

SEQ ID NO: 315917 - DNA, 20 bp, Artificial Sequence
  chemically synthesized
taagtcacttttactgaacc

SEQ ID NO: 315918 - DNA, 20 bp, Artificial Sequence
  chemically synthesized
ctaattgccaggttcagtaa

SEQ ID NO: 315919 - DNA, 20 bp, Artificial Sequence
  chemically synthesized
ctgtgaaatgtcaggaagat

SEQ ID NO: 315920 - DNA, 20 bp, Artificial Sequence
  chemically synthesized
agacactgtgaaatgtcagg

SEQ ID NO: 315921 - DNA, 20 bp, Artificial Sequence
  chemically synthesized
ttcagacactgtgaaatgtc

SEQ ID NO: 315922 - DNA, 20 bp, Artificial Sequence
  chemically synthesized
attcagacactgtgaaatgt

SEQ ID NO: 315923 - DNA, 20 bp, Artificial Sequence
  chemically synthesized
cttatcttcctgacatttca

SEQ ID NO: 315924 - DNA, 20 bp, Artificial Sequence
  chemically synthesized
tttcacagtgtctgaatttc

SEQ ID NO: 315925 - DNA, 20 bp, Artificial Sequence
  chemically synthesized
tatgaggcaggctagaaatt

SEQ ID NO: 315926 - DNA, 20 bp, Artificial Sequence
  chemically synthesized
cattttattatgaggcaggc

SEQ ID NO: 315927 - DNA, 20 bp, Artificial Sequence
  chemically synthesized
acagcattttattatgaggc

SEQ ID NO: 315928 - DNA, 20 bp, Artificial Sequence
  chemically synthesized
aacagcattttattatgagg

SEQ ID NO: 315929 - DNA, 20 bp, Artificial Sequence
  chemically synthesized
ttcaacagcattttattatg

SEQ ID NO: 315930 - DNA, 20 bp, Artificial Sequence
  chemically synthesized
tttcaacagcattttattat

SEQ ID NO: 315931 - DNA, 20 bp, Artificial Sequence
  chemically synthesized
ctttgctatcttcatttcaa

SEQ ID NO: 315932 - DNA, 20 bp, Artificial Sequence
  chemically synthesized
aataaaatgctgttgaaatg

SEQ ID NO: 315933 - DNA, 20 bp, Artificial Sequence
  chemically synthesized
aaatgctgttgaaatgaaga

SEQ ID NO: 315934 - DNA, 20 bp, Artificial Sequence
  chemically synthesized
ctgttgaaatgaagatagca

SEQ ID NO: 315935 - DNA, 20 bp, Artificial Sequence
  chemically synthesized
tgttgaaatgaagatagcaa

SEQ ID NO: 315936 - DNA, 20 bp, Artificial Sequence
  chemically synthesized
gatagcaaaggatcctgtca

SEQ ID NO: 315937 - DNA, 20 bp, Artificial Sequence
  chemically synthesized
gcttctgtatattctgtgac

SEQ ID NO: 315938 - DNA, 20 bp, Artificial Sequence
  chemically synthesized
tgcttctgtatattctgtga

SEQ ID NO: 315939 - DNA, 20 bp, Artificial Sequence
  chemically synthesized
ggatcctgtcacagaatata

SEQ ID NO: 315940 - DNA, 20 bp, Artificial Sequence
  chemically synthesized
tcctgtcacagaatatacag

SEQ ID NO: 315941 - DNA, 20 bp, Artificial Sequence
  chemically synthesized
caagtacactgtgaatatta

SEQ ID NO: 315942 - DNA, 20 bp, Artificial Sequence
  chemically synthesized
aagcatatctgtaatattca

SEQ ID NO: 315943 - DNA, 20 bp, Artificial Sequence
  chemically synthesized
aatattcacagtgtacttgc

SEQ ID NO: 315944 - DNA, 20 bp, Artificial Sequence
  chemically synthesized
aaaatgtttgcaaatcttgc

SEQ ID NO: 315945 - DNA, 20 bp, Artificial Sequence
  chemically synthesized
aacattttaatcttgccctc

SEQ ID NO: 315946 - DNA, 20 bp, Artificial Sequence
  chemically synthesized
ctctctctcaactggagggc

SEQ ID NO: 315947 - DNA, 20 bp, Artificial Sequence
  chemically synthesized
tttaatcttgccctccagtt

SEQ ID NO: 315948 - DNA, 20 bp, Artificial Sequence
  chemically synthesized
ctctctctctctcaactgga

SEQ ID NO: 315949 - DNA, 20 bp, Artificial Sequence
  chemically synthesized
gctctctctctctcaactgg

SEQ ID NO: 315950 - DNA, 20 bp, Artificial Sequence
  chemically synthesized
taatcttgccctccagttga

SEQ ID NO: 315951 - DNA, 20 bp, Artificial Sequence
  chemically synthesized
tgctctctctctctcaactg

SEQ ID NO: 315952 - DNA, 20 bp, Artificial Sequence
  chemically synthesized
atcttgccctccagttgaga

SEQ ID NO: 315953 - DNA, 20 bp, Artificial Sequence
  chemically synthesized
cctgctctctctctctcaac

SEQ ID NO: 315954 - DNA, 20 bp, Artificial Sequence
  chemically synthesized
cttgccctccagttgagaga

SEQ ID NO: 315955 - DNA, 20 bp, Artificial Sequence
  chemically synthesized
tgccctccagttgagagaga

SEQ ID NO: 315956 - DNA, 20 bp, Artificial Sequence
  chemically synthesized
ccctccagttgagagagaga

SEQ ID NO: 315957 - DNA, 20 bp, Artificial Sequence
  chemically synthesized
tccagttgagagagagagag

SEQ ID NO: 315958 - DNA, 20 bp, Artificial Sequence
  chemically synthesized
ccagttgagagagagagagc

SEQ ID NO: 315959 - DNA, 20 bp, Artificial Sequence
  chemically synthesized
gagcaggcgacctctgatct

SEQ ID NO: 315960 - DNA, 20 bp, Artificial Sequence
  chemically synthesized
ttaaattctgctcagatcag

SEQ ID NO: 315961 - DNA, 20 bp, Artificial Sequence
  chemically synthesized
tttaaattctgctcagatca

SEQ ID NO: 315962 - DNA, 20 bp, Artificial Sequence
  chemically synthesized
caggcgacctctgatctgag

SEQ ID NO: 315963 - DNA, 20 bp, Artificial Sequence
  chemically synthesized
gatttaaattctgctcagat

SEQ ID NO: 315964 - DNA, 20 bp, Artificial Sequence
  chemically synthesized
gaattgatttaaattctgct

SEQ ID NO: 315965 - DNA, 20 bp, Artificial Sequence
  chemically synthesized
gcagaatttaaatcaattcc

SEQ ID NO: 315966 - DNA, 20 bp, Artificial Sequence
  chemically synthesized
aagatacagattttattgct

SEQ ID NO: 315967 - DNA, 20 bp, Artificial Sequence
  chemically synthesized
aaagatacagattttattgc

SEQ ID NO: 315968 - DNA, 20 bp, Artificial Sequence
  chemically synthesized
acaaaattaaagaaaagata

SEQ ID NO: 315969 - DNA, 20 bp, Artificial Sequence
  chemically synthesized
cagatgacaaaattaaagaa

SEQ ID NO: 315970 - DNA, 20 bp, Artificial Sequence
  chemically synthesized
gattgcagatgacaaaatta

SEQ ID NO: 315971 - DNA, 20 bp, Artificial Sequence
  chemically synthesized
ttttttcttaaagatgattg

SEQ ID NO: 315972 - DNA, 20 bp, Artificial Sequence
  chemically synthesized
tgtcatctgcaatcatcttt

SEQ ID NO: 315973 - DNA, 20 bp, Artificial Sequence
  chemically synthesized
gccatcaccattttttctta

SEQ ID NO: 315974 - DNA, 20 bp, Artificial Sequence
  chemically synthesized
caatcatctttaagaaaaaa

SEQ ID NO: 315975 - DNA, 20 bp, Artificial Sequence
  chemically synthesized
tctttaagaaaaaatggtga

SEQ ID NO: 315976 - DNA, 20 bp, Artificial Sequence
  chemically synthesized
agaaaaaatggtgatggcac

SEQ ID NO: 315977 - DNA, 20 bp, Artificial Sequence
  chemically synthesized
gaaaaaatggtgatggcaca

SEQ ID NO: 315978 - DNA, 20 bp, Artificial Sequence
  chemically synthesized
tatttttagctttgtgtaga

SEQ ID NO: 315979 - DNA, 20 bp, Artificial Sequence
  chemically synthesized
atttaatgtctatctacaca

SEQ ID NO: 315980 - DNA, 20 bp, Artificial Sequence
  chemically synthesized
tatttatttttagctttgtg

SEQ ID NO: 315981 - DNA, 20 bp, Artificial Sequence
  chemically synthesized
cctaatataatatttatttt

SEQ ID NO: 315982 - DNA, 20 bp, Artificial Sequence
  chemically synthesized
gctaaaaataaatattatat

SEQ ID NO: 315983 - DNA, 20 bp, Artificial Sequence
  chemically synthesized
ctaaaaataaatattatatt

SEQ ID NO: 315984 - DNA, 20 bp, Artificial Sequence
  chemically synthesized
aaataaatattatattaggt

SEQ ID NO: 315985 - DNA, 20 bp, Artificial Sequence
  chemically synthesized
taaatattatattaggttag

SEQ ID NO: 315986 - DNA, 20 bp, Artificial Sequence
  chemically synthesized
attatattaggttagaagtt

SEQ ID NO: 315987 - DNA, 20 bp, Artificial Sequence
  chemically synthesized
aggttagaagtttggtgatg

SEQ ID NO: 315988 - DNA, 20 bp, Artificial Sequence
  chemically synthesized
ttagaagtttggtgatgcag

SEQ ID NO: 315989 - DNA, 20 bp, Artificial Sequence
  chemically synthesized
aagtttggtgatgcagcaga

SEQ ID NO: 315990 - DNA, 20 bp, Artificial Sequence
  chemically synthesized
agtttggtgatgcagcagat

SEQ ID NO: 315991 - DNA, 20 bp, Artificial Sequence
  chemically synthesized
tttggtgatgcagcagatgg

SEQ ID NO: 315992 - DNA, 20 bp, Artificial Sequence
  chemically synthesized
gcagatgggagttgcttttg

SEQ ID NO: 315993 - DNA, 20 bp, Artificial Sequence
  chemically synthesized
cagatgggagttgcttttgt

SEQ ID NO: 315994 - DNA, 20 bp, Artificial Sequence
  chemically synthesized
agatgggagttgcttttgtg

SEQ ID NO: 315995 - DNA, 20 bp, Artificial Sequence
  chemically synthesized
taaccttagagtccccacaa

SEQ ID NO: 315996 - DNA, 20 bp, Artificial Sequence
  chemically synthesized
gttgcttttgtggggactct

SEQ ID NO: 315997 - DNA, 20 bp, Artificial Sequence
  chemically synthesized
ttgcttttgtggggactcta

SEQ ID NO: 315998 - DNA, 20 bp, Artificial Sequence
  chemically synthesized
aaaatgcatcagtaacctta

SEQ ID NO: 315999 - DNA, 20 bp, Artificial Sequence
  chemically synthesized
acaaaatgcatcagtaacct

SEQ ID NO: 316000 - DNA, 20 bp, Artificial Sequence
  chemically synthesized
cttctgacaacaaaatgcat

SEQ ID NO: 316001 - DNA, 20 bp, Artificial Sequence
  chemically synthesized
ttactgatgcattttgttgt

SEQ ID NO: 316002 - DNA, 20 bp, Artificial Sequence
  chemically synthesized
ctgatgcattttgttgtcag

SEQ ID NO: 316003 - DNA, 20 bp, Artificial Sequence
  chemically synthesized
tgatgcattttgttgtcaga

SEQ ID NO: 316004 - DNA, 20 bp, Artificial Sequence
  chemically synthesized
atgcattttgttgtcagaag

SEQ ID NO: 316005 - DNA, 20 bp, Artificial Sequence
  chemically synthesized
attgtaaatcattgaaagta

SEQ ID NO: 316006 - DNA, 20 bp, Artificial Sequence
  chemically synthesized
aattgtaaatcattgaaagt

SEQ ID NO: 316007 - DNA, 20 bp, Artificial Sequence
  chemically synthesized
caagaattgtaaatcattga

SEQ ID NO: 316008 - DNA, 20 bp, Artificial Sequence
  chemically synthesized
tttcaatgatttacaattct

SEQ ID NO: 316009 - DNA, 20 bp, Artificial Sequence
  chemically synthesized
ttcaatgatttacaattctt

SEQ ID NO: 316010 - DNA, 20 bp, Artificial Sequence
  chemically synthesized
gctttgcagctttttttccc

SEQ ID NO: 316011 - DNA, 20 bp, Artificial Sequence
  chemically synthesized
tttacaattcttgggaaaaa

SEQ ID NO: 316012 - DNA, 20 bp, Artificial Sequence
  chemically synthesized
tcttgggaaaaaaagctgca

SEQ ID NO: 316013 - DNA, 20 bp, Artificial Sequence
  chemically synthesized
atagtcgttgaatcgctttg

SEQ ID NO: 316014 - DNA, 20 bp, Artificial Sequence
  chemically synthesized
gattcaacgactatataaat

SEQ ID NO: 316015 - DNA, 20 bp, Artificial Sequence
  chemically synthesized
aaactaaagccttatttata

SEQ ID NO: 316016 - DNA, 20 bp, Artificial Sequence
  chemically synthesized
attcaacgactatataaata

SEQ ID NO: 316017 - DNA, 20 bp, Artificial Sequence
  chemically synthesized
cgactatataaataaggctt

SEQ ID NO: 316018 - DNA, 20 bp, Artificial Sequence
  chemically synthesized
gggtaactgagttcaaacta

SEQ ID NO: 316019 - DNA, 20 bp, Artificial Sequence
  chemically synthesized
ataaggctttagtttgaact

SEQ ID NO: 316020 - DNA, 20 bp, Artificial Sequence
  chemically synthesized
tgttacttctttgggtaact

SEQ ID NO: 316021 - DNA, 20 bp, Artificial Sequence
  chemically synthesized
agtttgaactcagttaccca

SEQ ID NO: 316022 - DNA, 20 bp, Artificial Sequence
  chemically synthesized
ttgaactcagttacccaaag

SEQ ID NO: 316023 - DNA, 20 bp, Artificial Sequence
  chemically synthesized
aaaataaatgttacttcttt

SEQ ID NO: 316024 - DNA, 20 bp, Artificial Sequence
  chemically synthesized
gaaaataaatgttacttctt

SEQ ID NO: 316025 - DNA, 20 bp, Artificial Sequence
  chemically synthesized
tgccacacttcataaaacaa

SEQ ID NO: 316026 - DNA, 20 bp, Artificial Sequence
  chemically synthesized
ttattttcttttgttttatg

SEQ ID NO: 316027 - DNA, 20 bp, Artificial Sequence
  chemically synthesized
ttcttttgttttatgaagtg

SEQ ID NO: 316028 - DNA, 20 bp, Artificial Sequence
  chemically synthesized
tttgttttatgaagtgtggc

SEQ ID NO: 316029 - DNA, 20 bp, Artificial Sequence
  chemically synthesized
gtgtggcaagactaacaaaa

SEQ ID NO: 316030 - DNA, 20 bp, Artificial Sequence
  chemically synthesized
ttaaaggaacactgttttgt

SEQ ID NO: 316031 - DNA, 20 bp, Artificial Sequence
  chemically synthesized
gagcatacatacagaattaa

SEQ ID NO: 316032 - DNA, 20 bp, Artificial Sequence
  chemically synthesized
ggagcatacatacagaatta

SEQ ID NO: 316033 - DNA, 20 bp, Artificial Sequence
  chemically synthesized
gactaaaaggagcatacata

SEQ ID NO: 316034 - DNA, 20 bp, Artificial Sequence
  chemically synthesized
ttctgtatgtatgctccttt

SEQ ID NO: 316035 - DNA, 20 bp, Artificial Sequence
  chemically synthesized
ttgtcttttaagactaaaag

SEQ ID NO: 316036 - DNA, 20 bp, Artificial Sequence
  chemically synthesized
tattgtcttttaagactaaa

SEQ ID NO: 316037 - DNA, 20 bp, Artificial Sequence
  chemically synthesized
atattgtcttttaagactaa

SEQ ID NO: 316038 - DNA, 20 bp, Artificial Sequence
  chemically synthesized
tatgctccttttagtcttaa

SEQ ID NO: 316039 - DNA, 20 bp, Artificial Sequence
  chemically synthesized
tgtacattatattgtctttt

SEQ ID NO: 316040 - DNA, 20 bp, Artificial Sequence
  chemically synthesized
acaatataatgtacatgttt

SEQ ID NO: 316041 - DNA, 20 bp, Artificial Sequence
  chemically synthesized
caatataatgtacatgtttc

SEQ ID NO: 316042 - DNA, 20 bp, Artificial Sequence
  chemically synthesized
acatgtttcaggtttaaata

SEQ ID NO: 316043 - DNA, 20 bp, Artificial Sequence
  chemically synthesized
acatcaaacaatttagcaaa

SEQ ID NO: 316044 - DNA, 20 bp, Artificial Sequence
  chemically synthesized
taacatcaaacaatttagca

SEQ ID NO: 316045 - DNA, 20 bp, Artificial Sequence
  chemically synthesized
tgacttaacatcaaacaatt

SEQ ID NO: 316046 - DNA, 20 bp, Artificial Sequence
  chemically synthesized
ttgctaaattgtttgatgtt

SEQ ID NO: 316047 - DNA, 20 bp, Artificial Sequence
  chemically synthesized
caacaattttggcgagaaga

SEQ ID NO: 316048 - DNA, 20 bp, Artificial Sequence
  chemically synthesized
gcaacaattttggcgagaag

SEQ ID NO: 316049 - DNA, 20 bp, Artificial Sequence
  chemically synthesized
ttggcaacaattttggcgag

SEQ ID NO: 316050 - DNA, 20 bp, Artificial Sequence
  chemically synthesized
ttcttggcaacaattttggc

SEQ ID NO: 316051 - DNA, 20 bp, Artificial Sequence
  chemically synthesized
ttgtttcttggcaacaattt

SEQ ID NO: 316052 - DNA, 20 bp, Artificial Sequence
  chemically synthesized
ttctcgccaaaattgttgcc

SEQ ID NO: 316053 - DNA, 20 bp, Artificial Sequence
  chemically synthesized
gataatgctcttttgtttct

SEQ ID NO: 316054 - DNA, 20 bp, Artificial Sequence
  chemically synthesized
aaattgttgccaagaaacaa

SEQ ID NO: 316055 - DNA, 20 bp, Artificial Sequence
  chemically synthesized
attgttgccaagaaacaaaa

SEQ ID NO: 316056 - DNA, 20 bp, Artificial Sequence
  chemically synthesized
aaaagagcattatcaatatt

SEQ ID NO: 316057 - DNA, 20 bp, Artificial Sequence
  chemically synthesized
aaagagcattatcaatattc

SEQ ID NO: 316058 - DNA, 20 bp, Artificial Sequence
  chemically synthesized
taagggaaagattcatattc

SEQ ID NO: 316059 - DNA, 20 bp, Artificial Sequence
  chemically synthesized
tttttataaaaattaaggga

SEQ ID NO: 316060 - DNA, 20 bp, Artificial Sequence
  chemically synthesized
tttttttttataaaaattaa

SEQ ID NO: 316061 - DNA, 20 bp, Artificial Sequence
  chemically synthesized
ttttttttttataaaaatta

SEQ ID NO: 316062 - DNA, 20 bp, Artificial Sequence
  chemically synthesized
attttttttttataaaaatt

SEQ ID NO: 316063 - DNA, 20 bp, Artificial Sequence
  chemically synthesized
atattttttgaaatatttga

SEQ ID NO: 316064 - DNA, 20 bp, Artificial Sequence
  chemically synthesized
ttgagcactcttttttttga

SEQ ID NO: 316065 - DNA, 20 bp, Artificial Sequence
  chemically synthesized
ttgtcaaatctgtcaaaaaa

SEQ ID NO: 316066 - DNA, 20 bp, Artificial Sequence
  chemically synthesized
gtcaaatctgtcaaaaaaaa

SEQ ID NO: 316067 - DNA, 20 bp, Artificial Sequence
  chemically synthesized
caaaaaaaagagtgctcaaa

SEQ ID NO: 316068 - DNA, 20 bp, Artificial Sequence
  chemically synthesized
actcctacttttaactattt

SEQ ID NO: 316069 - DNA, 20 bp, Artificial Sequence
  chemically synthesized
aagagtgctcaaatagttaa

SEQ ID NO: 316070 - DNA, 20 bp, Artificial Sequence
  chemically synthesized
agtgctcaaatagttaaaag

SEQ ID NO: 316071 - DNA, 20 bp, Artificial Sequence
  chemically synthesized
gtgctcaaatagttaaaagt

SEQ ID NO: 316072 - DNA, 20 bp, Artificial Sequence
  chemically synthesized
gctcaaatagttaaaagtag

SEQ ID NO: 316073 - DNA, 20 bp, Artificial Sequence
  chemically synthesized
aaatagttaaaagtaggagt

SEQ ID NO: 316074 - DNA, 20 bp, Artificial Sequence
  chemically synthesized
gttttctggctcagagagta

SEQ ID NO: 316075 - DNA, 20 bp, Artificial Sequence
  chemically synthesized
aggagttggccttactctct

SEQ ID NO: 316076 - DNA, 20 bp, Artificial Sequence
  chemically synthesized
ggttttctggctcagagagt

SEQ ID NO: 316077 - DNA, 20 bp, Artificial Sequence
  chemically synthesized
gttggccttactctctgagc

SEQ ID NO: 316078 - DNA, 20 bp, Artificial Sequence
  chemically synthesized
cattggttttctggctcaga

SEQ ID NO: 316079 - DNA, 20 bp, Artificial Sequence
  chemically synthesized
ggcattggttttctggctca

SEQ ID NO: 316080 - DNA, 20 bp, Artificial Sequence
  chemically synthesized
aaggcattggttttctggct

SEQ ID NO: 316081 - DNA, 20 bp, Artificial Sequence
  chemically synthesized
gccagaaggcattggttttc

SEQ ID NO: 316082 - DNA, 20 bp, Artificial Sequence
  chemically synthesized
ataaagaggccagaaggcat

SEQ ID NO: 316083 - DNA, 20 bp, Artificial Sequence
  chemically synthesized
gccagaaaaccaatgccttc

SEQ ID NO: 316084 - DNA, 20 bp, Artificial Sequence
  chemically synthesized
aagggcataaagaggccaga

SEQ ID NO: 316085 - DNA, 20 bp, Artificial Sequence
  chemically synthesized
aaagggcataaagaggccag

SEQ ID NO: 316086 - DNA, 20 bp, Artificial Sequence
  chemically synthesized
tttaaagggcataaagaggc

SEQ ID NO: 316087 - DNA, 20 bp, Artificial Sequence
  chemically synthesized
tttatttaaagggcataaag

SEQ ID NO: 316088 - DNA, 20 bp, Artificial Sequence
  chemically synthesized
atttatttaaagggcataaa

SEQ ID NO: 316089 - DNA, 20 bp, Artificial Sequence
  chemically synthesized
ttatttatttaaagggcata

SEQ ID NO: 316090 - DNA, 20 bp, Artificial Sequence
  chemically synthesized
gcattatttatttatttaaa

SEQ ID NO: 316091 - DNA, 20 bp, Artificial Sequence
  chemically synthesized
ggcattatttatttatttaa

SEQ ID NO: 316092 - DNA, 20 bp, Artificial Sequence
  chemically synthesized
aggcattatttatttattta

SEQ ID NO: 316093 - DNA, 20 bp, Artificial Sequence
  chemically synthesized
ttaaataaataaataatgcc

SEQ ID NO: 316094 - DNA, 20 bp, Artificial Sequence
  chemically synthesized
aaataaataaataatgcctg

SEQ ID NO: 316095 - DNA, 20 bp, Artificial Sequence
  chemically synthesized
aataaataaataatgcctgg

SEQ ID NO: 316096 - DNA, 20 bp, Artificial Sequence
  chemically synthesized
ttatgtaacattttacctcc

SEQ ID NO: 316097 - DNA, 20 bp, Artificial Sequence
  chemically synthesized
attatgtaacattttacctc

SEQ ID NO: 316098 - DNA, 20 bp, Artificial Sequence
  chemically synthesized
aaggcaacaggagtatatgc

SEQ ID NO: 316099 - DNA, 20 bp, Artificial Sequence
  chemically synthesized
gaaacaaaagaaggcaacag

SEQ ID NO: 316100 - DNA, 20 bp, Artificial Sequence
  chemically synthesized
gtgaaacaaaagaaggcaac

SEQ ID NO: 316101 - DNA, 20 bp, Artificial Sequence
  chemically synthesized
tgtgaaacaaaagaaggcaa

SEQ ID NO: 316102 - DNA, 20 bp, Artificial Sequence
  chemically synthesized
aaaaaatgtgaaacaaaaga

SEQ ID NO: 316103 - DNA, 20 bp, Artificial Sequence
  chemically synthesized
gaaaaaatgtgaaacaaaag

SEQ ID NO: 316104 - DNA, 20 bp, Artificial Sequence
  chemically synthesized
gaagaaaaaatgtgaaacaa

SEQ ID NO: 316105 - DNA, 20 bp, Artificial Sequence
  chemically synthesized
ttgtttcacattttttcttc

SEQ ID NO: 316106 - DNA, 20 bp, Artificial Sequence
  chemically synthesized
tgtttcacattttttcttca

SEQ ID NO: 316107 - DNA, 20 bp, Artificial Sequence
  chemically synthesized
atgactatgaaattgccttg

SEQ ID NO: 316108 - DNA, 20 bp, Artificial Sequence
  chemically synthesized
ttttcttcaaggcaatttca

SEQ ID NO: 316109 - DNA, 20 bp, Artificial Sequence
  chemically synthesized
caaggcaatttcatagtcat

SEQ ID NO: 316110 - DNA, 20 bp, Artificial Sequence
  chemically synthesized
aatttcatagtcattagaaa

SEQ ID NO: 316111 - DNA, 20 bp, Artificial Sequence
  chemically synthesized
attagaaatggcatactttc

SEQ ID NO: 316112 - DNA, 20 bp, Artificial Sequence
  chemically synthesized
atatattattcattacttga

SEQ ID NO: 316113 - DNA, 20 bp, Artificial Sequence
  chemically synthesized
aagatataatgtgaatgaaa

SEQ ID NO: 316114 - DNA, 20 bp, Artificial Sequence
  chemically synthesized
ttcattcacattatatcttt

SEQ ID NO: 316115 - DNA, 20 bp, Artificial Sequence
  chemically synthesized
tgttttgtagttttttctga

SEQ ID NO: 316116 - DNA, 20 bp, Artificial Sequence
  chemically synthesized
caggtacctgaaatgttttg

SEQ ID NO: 316117 - DNA, 20 bp, Artificial Sequence
  chemically synthesized
gaaaaaactacaaaacattt

SEQ ID NO: 316118 - DNA, 20 bp, Artificial Sequence
  chemically synthesized
aaaaaactacaaaacatttc

SEQ ID NO: 316119 - DNA, 20 bp, Artificial Sequence
  chemically synthesized
tacaaaacatttcaggtacc

SEQ ID NO: 316120 - DNA, 20 bp, Artificial Sequence
  chemically synthesized
aaaacatttcaggtacctgg

SEQ ID NO: 316121 - DNA, 20 bp, Artificial Sequence
  chemically synthesized
caggatcttaatattctgcc

SEQ ID NO: 316122 - DNA, 20 bp, Artificial Sequence
  chemically synthesized
ccaggatcttaatattctgc

SEQ ID NO: 316123 - DNA, 20 bp, Artificial Sequence
  chemically synthesized
caggtacctggcagaatatt

SEQ ID NO: 316124 - DNA, 20 bp, Artificial Sequence
  chemically synthesized
ctggcagaatattaagatcc

SEQ ID NO: 316125 - DNA, 20 bp, Artificial Sequence
  chemically synthesized
cagaatattaagatcctgga

SEQ ID NO: 316126 - DNA, 20 bp, Artificial Sequence
  chemically synthesized
taaggtgagacaagctatcc

SEQ ID NO: 316127 - DNA, 20 bp, Artificial Sequence
  chemically synthesized
ttaaggtgagacaagctatc

SEQ ID NO: 316128 - DNA, 20 bp, Artificial Sequence
  chemically synthesized
actcttcattaaggtgagac

SEQ ID NO: 316129 - DNA, 20 bp, Artificial Sequence
  chemically synthesized
aacagactcttcattaaggt

SEQ ID NO: 316130 - DNA, 20 bp, Artificial Sequence
  chemically synthesized
tagcttgtctcaccttaatg

SEQ ID NO: 316131 - DNA, 20 bp, Artificial Sequence
  chemically synthesized
gcttgtctcaccttaatgaa

SEQ ID NO: 316132 - DNA, 20 bp, Artificial Sequence
  chemically synthesized
gctgaacagactcttcatta

SEQ ID NO: 316133 - DNA, 20 bp, Artificial Sequence
  chemically synthesized
cgctgaacagactcttcatt

SEQ ID NO: 316134 - DNA, 20 bp, Artificial Sequence
  chemically synthesized
accttaatgaagagtctgtt

SEQ ID NO: 316135 - DNA, 20 bp, Artificial Sequence
  chemically synthesized
tcttagcttgggacgctgaa

SEQ ID NO: 316136 - DNA, 20 bp, Artificial Sequence
  chemically synthesized
aagagtctgttcagcgtccc

SEQ ID NO: 316137 - DNA, 20 bp, Artificial Sequence
  chemically synthesized
tctgttcagcgtcccaagct

SEQ ID NO: 316138 - DNA, 20 bp, Artificial Sequence
  chemically synthesized
atgaaggaagttcttagctt

SEQ ID NO: 316139 - DNA, 20 bp, Artificial Sequence
  chemically synthesized
tatgaaggaagttcttagct

SEQ ID NO: 316140 - DNA, 20 bp, Artificial Sequence
  chemically synthesized
gcagctatgaaggaagttct

SEQ ID NO: 316141 - DNA, 20 bp, Artificial Sequence
  chemically synthesized
caagctaagaacttccttca

SEQ ID NO: 316142 - DNA, 20 bp, Artificial Sequence
  chemically synthesized
acctagggcagctatgaagg

SEQ ID NO: 316143 - DNA, 20 bp, Artificial Sequence
  chemically synthesized
ataacctagggcagctatga

SEQ ID NO: 316144 - DNA, 20 bp, Artificial Sequence
  chemically synthesized
gataacctagggcagctatg

SEQ ID NO: 316145 - DNA, 20 bp, Artificial Sequence
  chemically synthesized
aacttccttcatagctgccc

SEQ ID NO: 316146 - DNA, 20 bp, Artificial Sequence
  chemically synthesized
acttccttcatagctgccct

SEQ ID NO: 316147 - DNA, 20 bp, Artificial Sequence
  chemically synthesized
taagtacggataacctaggg

SEQ ID NO: 316148 - DNA, 20 bp, Artificial Sequence
  chemically synthesized
agctaagtacggataaccta

SEQ ID NO: 316149 - DNA, 20 bp, Artificial Sequence
  chemically synthesized
tagctaagtacggataacct

SEQ ID NO: 316150 - DNA, 20 bp, Artificial Sequence
  chemically synthesized
atagctaagtacggataacc

SEQ ID NO: 316151 - DNA, 20 bp, Artificial Sequence
  chemically synthesized
tgccctaggttatccgtact

SEQ ID NO: 316152 - DNA, 20 bp, Artificial Sequence
  chemically synthesized
aatgttagcatagctaagta

SEQ ID NO: 316153 - DNA, 20 bp, Artificial Sequence
  chemically synthesized
agaagaatgttagcatagct

SEQ ID NO: 316154 - DNA, 20 bp, Artificial Sequence
  chemically synthesized
gtagaagaagaatgttagca

SEQ ID NO: 316155 - DNA, 20 bp, Artificial Sequence
  chemically synthesized
gagcagtagaagaagaatgt

SEQ ID NO: 316156 - DNA, 20 bp, Artificial Sequence
  chemically synthesized
ctccaaaagagcagtagaag

SEQ ID NO: 316157 - DNA, 20 bp, Artificial Sequence
  chemically synthesized
gagctccaaaagagcagtag

SEQ ID NO: 316158 - DNA, 20 bp, Artificial Sequence
  chemically synthesized
gaagagctccaaaagagcag

SEQ ID NO: 316159 - DNA, 20 bp, Artificial Sequence
  chemically synthesized
ttcttcttctactgctcttt

SEQ ID NO: 316160 - DNA, 20 bp, Artificial Sequence
  chemically synthesized
ggagaagagctccaaaagag

SEQ ID NO: 316161 - DNA, 20 bp, Artificial Sequence
  chemically synthesized
cttcttctactgctcttttg

SEQ ID NO: 316162 - DNA, 20 bp, Artificial Sequence
  chemically synthesized
cagggagaagagctccaaaa

SEQ ID NO: 316163 - DNA, 20 bp, Artificial Sequence
  chemically synthesized
tccagggagaagagctccaa

SEQ ID NO: 316164 - DNA, 20 bp, Artificial Sequence
  chemically synthesized
tcttttggagctcttctccc

SEQ ID NO: 316165 - DNA, 20 bp, Artificial Sequence
  chemically synthesized
aaagcgaaatccagggagaa

SEQ ID NO: 316166 - DNA, 20 bp, Artificial Sequence
  chemically synthesized
gtaaagcgaaatccagggag

SEQ ID NO: 316167 - DNA, 20 bp, Artificial Sequence
  chemically synthesized
agtgtaaagcgaaatccagg

SEQ ID NO: 316168 - DNA, 20 bp, Artificial Sequence
  chemically synthesized
ggagtgtaaagcgaaatcca

SEQ ID NO: 316169 - DNA, 20 bp, Artificial Sequence
  chemically synthesized
tggagtgtaaagcgaaatcc

SEQ ID NO: 316170 - DNA, 20 bp, Artificial Sequence
  chemically synthesized
ctggagtgtaaagcgaaatc

SEQ ID NO: 316171 - DNA, 20 bp, Artificial Sequence
  chemically synthesized
ctggatttcgctttacactc

SEQ ID NO: 316172 - DNA, 20 bp, Artificial Sequence
  chemically synthesized
tgctggatgcctggagtgta

SEQ ID NO: 316173 - DNA, 20 bp, Artificial Sequence
  chemically synthesized
tggatttcgctttacactcc

SEQ ID NO: 316174 - DNA, 20 bp, Artificial Sequence
  chemically synthesized
acactgctgctggatgcctg

SEQ ID NO: 316175 - DNA, 20 bp, Artificial Sequence
  chemically synthesized
cgctttacactccaggcatc

SEQ ID NO: 316176 - DNA, 20 bp, Artificial Sequence
  chemically synthesized
ggacactgctgctggatgcc

SEQ ID NO: 316177 - DNA, 20 bp, Artificial Sequence
  chemically synthesized
tttacactccaggcatccag

SEQ ID NO: 316178 - DNA, 20 bp, Artificial Sequence
  chemically synthesized
acactccaggcatccagcag

SEQ ID NO: 316179 - DNA, 20 bp, Artificial Sequence
  chemically synthesized
agaaggcaggacactgctgc

SEQ ID NO: 316180 - DNA, 20 bp, Artificial Sequence
  chemically synthesized
aacactgaacatcagaaggc

SEQ ID NO: 316181 - DNA, 20 bp, Artificial Sequence
  chemically synthesized
taacactgaacatcagaagg

SEQ ID NO: 316182 - DNA, 20 bp, Artificial Sequence
  chemically synthesized
acgtaacactgaacatcaga

SEQ ID NO: 316183 - DNA, 20 bp, Artificial Sequence
  chemically synthesized
cacgtaacactgaacatcag

SEQ ID NO: 316184 - DNA, 20 bp, Artificial Sequence
  chemically synthesized
gtgtcctgccttctgatgtt

SEQ ID NO: 316185 - DNA, 20 bp, Artificial Sequence
  chemically synthesized
ggccacgtaacactgaacat

SEQ ID NO: 316186 - DNA, 20 bp, Artificial Sequence
  chemically synthesized
ttctgatgttcagtgttacg

SEQ ID NO: 316187 - DNA, 20 bp, Artificial Sequence
  chemically synthesized
agtgttacgtggcctaatct

SEQ ID NO: 316188 - DNA, 20 bp, Artificial Sequence
  chemically synthesized
ttttagaaaaggccaagatt

SEQ ID NO: 316189 - DNA, 20 bp, Artificial Sequence
  chemically synthesized
attttagaaaaggccaagat

SEQ ID NO: 316190 - DNA, 20 bp, Artificial Sequence
  chemically synthesized
gaagtattttagaaaaggcc

SEQ ID NO: 316191 - DNA, 20 bp, Artificial Sequence
  chemically synthesized
aagttgaagtattttagaaa

SEQ ID NO: 316192 - DNA, 20 bp, Artificial Sequence
  chemically synthesized
gaagttgaagtattttagaa

SEQ ID NO: 316193 - DNA, 20 bp, Artificial Sequence
  chemically synthesized
ttttggaagttgaagtattt

SEQ ID NO: 316194 - DNA, 20 bp, Artificial Sequence
  chemically synthesized
tccaatacttttggaagttg

SEQ ID NO: 316195 - DNA, 20 bp, Artificial Sequence
  chemically synthesized
taaaatacttcaacttccaa

SEQ ID NO: 316196 - DNA, 20 bp, Artificial Sequence
  chemically synthesized
aatgtgtccaatacttttgg

SEQ ID NO: 316197 - DNA, 20 bp, Artificial Sequence
  chemically synthesized
acttcaacttccaaaagtat

SEQ ID NO: 316198 - DNA, 20 bp, Artificial Sequence
  chemically synthesized
ttaaatgtgtccaatacttt

SEQ ID NO: 316199 - DNA, 20 bp, Artificial Sequence
  chemically synthesized
ggacacatttaaactgtgac

SEQ ID NO: 316200 - DNA, 20 bp, Artificial Sequence
  chemically synthesized
cacatttaaactgtgactgg

SEQ ID NO: 316201 - DNA, 20 bp, Artificial Sequence
  chemically synthesized
tctagtgttccttccagtca

SEQ ID NO: 316202 - DNA, 20 bp, Artificial Sequence
  chemically synthesized
acatttaaactgtgactgga

SEQ ID NO: 316203 - DNA, 20 bp, Artificial Sequence
  chemically synthesized
tttgtttctagtgttccttc

SEQ ID NO: 316204 - DNA, 20 bp, Artificial Sequence
  chemically synthesized
actgtgactggaaggaacac

SEQ ID NO: 316205 - DNA, 20 bp, Artificial Sequence
  chemically synthesized
taaaagagtgagtttgtttc

SEQ ID NO: 316206 - DNA, 20 bp, Artificial Sequence
  chemically synthesized
tactttggaaataaaagagt

SEQ ID NO: 316207 - DNA, 20 bp, Artificial Sequence
  chemically synthesized
tctttactttggaaataaaa

SEQ ID NO: 316208 - DNA, 20 bp, Artificial Sequence
  chemically synthesized
tatctttactttggaaataa

SEQ ID NO: 316209 - DNA, 20 bp, Artificial Sequence
  chemically synthesized
aactcactcttttatttcca

SEQ ID NO: 316210 - DNA, 20 bp, Artificial Sequence
  chemically synthesized
actcttttatttccaaagta

SEQ ID NO: 316211 - DNA, 20 bp, Artificial Sequence
  chemically synthesized
ggttctctgtatctttactt

SEQ ID NO: 316212 - DNA, 20 bp, Artificial Sequence
  chemically synthesized
ttatttccaaagtaaagata

SEQ ID NO: 316213 - DNA, 20 bp, Artificial Sequence
  chemically synthesized
atttccaaagtaaagataca

SEQ ID NO: 316214 - DNA, 20 bp, Artificial Sequence
  chemically synthesized
aagtaaagatacagagaacc

SEQ ID NO: 316215 - DNA, 20 bp, Artificial Sequence
  chemically synthesized
agtaaagatacagagaacct

SEQ ID NO: 316216 - DNA, 20 bp, Artificial Sequence
  chemically synthesized
caaacatcacttaatgtccc

SEQ ID NO: 316217 - DNA, 20 bp, Artificial Sequence
  chemically synthesized
tacagagaacctgggacatt

SEQ ID NO: 316218 - DNA, 20 bp, Artificial Sequence
  chemically synthesized
ccaaacatcacttaatgtcc

SEQ ID NO: 316219 - DNA, 20 bp, Artificial Sequence
  chemically synthesized
ctgggacattaagtgatgtt

SEQ ID NO: 316220 - DNA, 20 bp, Artificial Sequence
  chemically synthesized
atgtttggaaaatgacaatt

SEQ ID NO: 316221 - DNA, 20 bp, Artificial Sequence
  chemically synthesized
ttggaaaatgacaatttagt

SEQ ID NO: 316222 - DNA, 20 bp, Artificial Sequence
  chemically synthesized
gaaaatgacaatttagttag

SEQ ID NO: 316223 - DNA, 20 bp, Artificial Sequence
  chemically synthesized
aatgacaatttagttagtgg

SEQ ID NO: 316224 - DNA, 20 bp, Artificial Sequence
  chemically synthesized
aatttagttagtggtagaac

SEQ ID NO: 316225 - DNA, 20 bp, Artificial Sequence
  chemically synthesized
tttagttagtggtagaactg

SEQ ID NO: 316226 - DNA, 20 bp, Artificial Sequence
  chemically synthesized
agaagccagaattcgagctc

SEQ ID NO: 316227 - DNA, 20 bp, Artificial Sequence
  chemically synthesized
tagaactggagctcgaattc

SEQ ID NO: 316228 - DNA, 20 bp, Artificial Sequence
  chemically synthesized
cccactagaagccagaattc

SEQ ID NO: 316229 - DNA, 20 bp, Artificial Sequence
  chemically synthesized
ggagctcgaattctggcttc

SEQ ID NO: 316230 - DNA, 20 bp, Artificial Sequence
  chemically synthesized
aaacttctcccactagaagc

SEQ ID NO: 316231 - DNA, 20 bp, Artificial Sequence
  chemically synthesized
gctcgaattctggcttctag

SEQ ID NO: 316232 - DNA, 20 bp, Artificial Sequence
  chemically synthesized
ctcgaattctggcttctagt

SEQ ID NO: 316233 - DNA, 20 bp, Artificial Sequence
  chemically synthesized
cgaattctggcttctagtgg

SEQ ID NO: 316234 - DNA, 20 bp, Artificial Sequence
  chemically synthesized
agacaaacttctcccactag

SEQ ID NO: 316235 - DNA, 20 bp, Artificial Sequence
  chemically synthesized
attctggcttctagtgggag

SEQ ID NO: 316236 - DNA, 20 bp, Artificial Sequence
  chemically synthesized
ccaagacaaacttctcccac

SEQ ID NO: 316237 - DNA, 20 bp, Artificial Sequence
  chemically synthesized
ctagtgggagaagtttgtct

SEQ ID NO: 316238 - DNA, 20 bp, Artificial Sequence
  chemically synthesized
tagtgggagaagtttgtctt

SEQ ID NO: 316239 - DNA, 20 bp, Artificial Sequence
  chemically synthesized
gggagaagtttgtcttgggt

SEQ ID NO: 316240 - DNA, 20 bp, Artificial Sequence
  chemically synthesized
tttttggaggaatctaaccc

SEQ ID NO: 316241 - DNA, 20 bp, Artificial Sequence
  chemically synthesized
tgttcaggatgtgtttttgg

SEQ ID NO: 316242 - DNA, 20 bp, Artificial Sequence
  chemically synthesized
ttgttcaggatgtgtttttg

SEQ ID NO: 316243 - DNA, 20 bp, Artificial Sequence
  chemically synthesized
ttttgttcaggatgtgtttt

SEQ ID NO: 316244 - DNA, 20 bp, Artificial Sequence
  chemically synthesized
caaaaacacatcctgaacaa

SEQ ID NO: 316245 - DNA, 20 bp, Artificial Sequence
  chemically synthesized
tgttcacaaatcttttgttc

SEQ ID NO: 316246 - DNA, 20 bp, Artificial Sequence
  chemically synthesized
ttgttcacaaatcttttgtt

SEQ ID NO: 316247 - DNA, 20 bp, Artificial Sequence
  chemically synthesized
aagatttgtgaacaaataaa

SEQ ID NO: 316248 - DNA, 20 bp, Artificial Sequence
  chemically synthesized
gaacaaataaatggtttatt

SEQ ID NO: 316249 - DNA, 20 bp, Artificial Sequence
  chemically synthesized
acaaataaatggtttatttg

SEQ ID NO: 316250 - DNA, 20 bp, Artificial Sequence
  chemically synthesized
caaataaatggtttatttgg

SEQ ID NO: 316251 - DNA, 20 bp, Artificial Sequence
  chemically synthesized
aaataaatggtttatttgga

SEQ ID NO: 316252 - DNA, 20 bp, Artificial Sequence
  chemically synthesized
tatttggagggtgaactcgt

SEQ ID NO: 316253 - DNA, 20 bp, Artificial Sequence
  chemically synthesized
atttggagggtgaactcgta

SEQ ID NO: 316254 - DNA, 20 bp, Artificial Sequence
  chemically synthesized
gtgctctcataatgccttac

SEQ ID NO: 316255 - DNA, 20 bp, Artificial Sequence
  chemically synthesized
gtgaactcgtaaggcattat

SEQ ID NO: 316256 - DNA, 20 bp, Artificial Sequence
  chemically synthesized
gaactcgtaaggcattatga

SEQ ID NO: 316257 - DNA, 20 bp, Artificial Sequence
  chemically synthesized
cgtaaggcattatgagagca

SEQ ID NO: 316258 - DNA, 20 bp, Artificial Sequence
  chemically synthesized
gtaaggcattatgagagcac

SEQ ID NO: 316259 - DNA, 20 bp, Artificial Sequence
  chemically synthesized
taaggcattatgagagcacg

SEQ ID NO: 316260 - DNA, 20 bp, Artificial Sequence
  chemically synthesized
tatgagagcacggggacgtt

SEQ ID NO: 316261 - DNA, 20 bp, Artificial Sequence
  chemically synthesized
atgagagcacggggacgttc

SEQ ID NO: 316262 - DNA, 20 bp, Artificial Sequence
  chemically synthesized
agagcacggggacgttcagg

SEQ ID NO: 316263 - DNA, 20 bp, Artificial Sequence
  chemically synthesized
acgttcaggaagttaccctg

SEQ ID NO: 316264 - DNA, 20 bp, Artificial Sequence
  chemically synthesized
ctgagctccaggtatccaca

SEQ ID NO: 316265 - DNA, 20 bp, Artificial Sequence
  chemically synthesized
actgagctccaggtatccac

SEQ ID NO: 316266 - DNA, 20 bp, Artificial Sequence
  chemically synthesized
gactgagctccaggtatcca

SEQ ID NO: 316267 - DNA, 20 bp, Artificial Sequence
  chemically synthesized
gaagttaccctgtggatacc

SEQ ID NO: 316268 - DNA, 20 bp, Artificial Sequence
  chemically synthesized
agttaccctgtggatacctg

SEQ ID NO: 316269 - DNA, 20 bp, Artificial Sequence
  chemically synthesized
ccctgtggatacctggagct

SEQ ID NO: 316270 - DNA, 20 bp, Artificial Sequence
  chemically synthesized
ccccagtaagactgagctcc

SEQ ID NO: 316271 - DNA, 20 bp, Artificial Sequence
  chemically synthesized
tccccagtaagactgagctc

SEQ ID NO: 316272 - DNA, 20 bp, Artificial Sequence
  chemically synthesized
agagattccccagtaagact

SEQ ID NO: 316273 - DNA, 20 bp, Artificial Sequence
  chemically synthesized
tacctggagctcagtcttac

SEQ ID NO: 316274 - DNA, 20 bp, Artificial Sequence
  chemically synthesized
acctggagctcagtcttact

SEQ ID NO: 316275 - DNA, 20 bp, Artificial Sequence
  chemically synthesized
cctggagctcagtcttactg

SEQ ID NO: 316276 - DNA, 20 bp, Artificial Sequence
  chemically synthesized
tctttcagagattccccagt

SEQ ID NO: 316277 - DNA, 20 bp, Artificial Sequence
  chemically synthesized
acagtctttcagagattccc

SEQ ID NO: 316278 - DNA, 20 bp, Artificial Sequence
  chemically synthesized
tcttactggggaatctctga

SEQ ID NO: 316279 - DNA, 20 bp, Artificial Sequence
  chemically synthesized
atattctccacagtctttca

SEQ ID NO: 316280 - DNA, 20 bp, Artificial Sequence
  chemically synthesized
gtatattctccacagtcttt

SEQ ID NO: 316281 - DNA, 20 bp, Artificial Sequence
  chemically synthesized
ggggaatctctgaaagactg

SEQ ID NO: 316282 - DNA, 20 bp, Artificial Sequence
  chemically synthesized
ggaatctctgaaagactgtg

SEQ ID NO: 316283 - DNA, 20 bp, Artificial Sequence
  chemically synthesized
tttctaaggtatattctcca

SEQ ID NO: 316284 - DNA, 20 bp, Artificial Sequence
  chemically synthesized
agactgtggagaatatacct

SEQ ID NO: 316285 - DNA, 20 bp, Artificial Sequence
  chemically synthesized
cccatagtgggacatttcta

SEQ ID NO: 316286 - DNA, 20 bp, Artificial Sequence
  chemically synthesized
tcccatagtgggacatttct

SEQ ID NO: 316287 - DNA, 20 bp, Artificial Sequence
  chemically synthesized
accttagaaatgtcccacta

SEQ ID NO: 316288 - DNA, 20 bp, Artificial Sequence
  chemically synthesized
ccttagaaatgtcccactat

SEQ ID NO: 316289 - DNA, 20 bp, Artificial Sequence
  chemically synthesized
tagaatctttgtcccatagt

SEQ ID NO: 316290 - DNA, 20 bp, Artificial Sequence
  chemically synthesized
gtagaatctttgtcccatag

SEQ ID NO: 316291 - DNA, 20 bp, Artificial Sequence
  chemically synthesized
aaatgtcccactatgggaca

SEQ ID NO: 316292 - DNA, 20 bp, Artificial Sequence
  chemically synthesized
cctgtagaatctttgtccca

SEQ ID NO: 316293 - DNA, 20 bp, Artificial Sequence
  chemically synthesized
actatgggacaaagattcta

SEQ ID NO: 316294 - DNA, 20 bp, Artificial Sequence
  chemically synthesized
ctatgggacaaagattctac

SEQ ID NO: 316295 - DNA, 20 bp, Artificial Sequence
  chemically synthesized
aagttgatagagaaatcctg

SEQ ID NO: 316296 - DNA, 20 bp, Artificial Sequence
  chemically synthesized
atgaggagtaaaagttgata

SEQ ID NO: 316297 - DNA, 20 bp, Artificial Sequence
  chemically synthesized
caatgaggagtaaaagttga

SEQ ID NO: 316298 - DNA, 20 bp, Artificial Sequence
  chemically synthesized
ccttagccaatgaggagtaa

SEQ ID NO: 316299 - DNA, 20 bp, Artificial Sequence
  chemically synthesized
tatcaacttttactcctcat

SEQ ID NO: 316300 - DNA, 20 bp, Artificial Sequence
  chemically synthesized
agctgcccttagccaatgag

SEQ ID NO: 316301 - DNA, 20 bp, Artificial Sequence
  chemically synthesized
agagctgcccttagccaatg

SEQ ID NO: 316302 - DNA, 20 bp, Artificial Sequence
  chemically synthesized
acttttactcctcattggct

SEQ ID NO: 316303 - DNA, 20 bp, Artificial Sequence
  chemically synthesized
cagagctgcccttagccaat

SEQ ID NO: 316304 - DNA, 20 bp, Artificial Sequence
  chemically synthesized
cttttactcctcattggcta

SEQ ID NO: 316305 - DNA, 20 bp, Artificial Sequence
  chemically synthesized
ttttactcctcattggctaa

SEQ ID NO: 316306 - DNA, 20 bp, Artificial Sequence
  chemically synthesized
tactcctcattggctaaggg

SEQ ID NO: 316307 - DNA, 20 bp, Artificial Sequence
  chemically synthesized
agtgccaccagagctgccct

SEQ ID NO: 316308 - DNA, 20 bp, Artificial Sequence
  chemically synthesized
tcattggctaagggcagctc

SEQ ID NO: 316309 - DNA, 20 bp, Artificial Sequence
  chemically synthesized
ttggctaagggcagctctgg

SEQ ID NO: 316310 - DNA, 20 bp, Artificial Sequence
  chemically synthesized
aagtggaattagtgccacca

SEQ ID NO: 316311 - DNA, 20 bp, Artificial Sequence
  chemically synthesized
ggaagtggaattagtgccac

SEQ ID NO: 316312 - DNA, 20 bp, Artificial Sequence
  chemically synthesized
aggtggacaggaagtggaat

SEQ ID NO: 316313 - DNA, 20 bp, Artificial Sequence
  chemically synthesized
gtttgaaggtggacaggaag

SEQ ID NO: 316314 - DNA, 20 bp, Artificial Sequence
  chemically synthesized
ccagtttgaaggtggacagg

SEQ ID NO: 316315 - DNA, 20 bp, Artificial Sequence
  chemically synthesized
cagccagtttgaaggtggac

SEQ ID NO: 316316 - DNA, 20 bp, Artificial Sequence
  chemically synthesized
tcagccagtttgaaggtgga

SEQ ID NO: 316317 - DNA, 20 bp, Artificial Sequence
  chemically synthesized
catttcagccagtttgaagg

SEQ ID NO: 316318 - DNA, 20 bp, Artificial Sequence
  chemically synthesized
cttcctgtccaccttcaaac

SEQ ID NO: 316319 - DNA, 20 bp, Artificial Sequence
  chemically synthesized
aaccatttcagccagtttga

SEQ ID NO: 316320 - DNA, 20 bp, Artificial Sequence
  chemically synthesized
gaaccatttcagccagtttg

SEQ ID NO: 316321 - DNA, 20 bp, Artificial Sequence
  chemically synthesized
caccttcaaactggctgaaa

SEQ ID NO: 316322 - DNA, 20 bp, Artificial Sequence
  chemically synthesized
tggtgcagaaccatttcagc

SEQ ID NO: 316323 - DNA, 20 bp, Artificial Sequence
  chemically synthesized
tttctggtgcagaaccattt

SEQ ID NO: 316324 - DNA, 20 bp, Artificial Sequence
  chemically synthesized
tggctgaaatggttctgcac

SEQ ID NO: 316325 - DNA, 20 bp, Artificial Sequence
  chemically synthesized
accggagggtatttctggtg

SEQ ID NO: 316326 - DNA, 20 bp, Artificial Sequence
  chemically synthesized
tctctaccggagggtatttc

SEQ ID NO: 316327 - DNA, 20 bp, Artificial Sequence
  chemically synthesized
tctgcaccagaaataccctc

SEQ ID NO: 316328 - DNA, 20 bp, Artificial Sequence
  chemically synthesized
gcaccagaaataccctccgg

SEQ ID NO: 316329 - DNA, 20 bp, Artificial Sequence
  chemically synthesized
accagaaataccctccggta

SEQ ID NO: 316330 - DNA, 20 bp, Artificial Sequence
  chemically synthesized
aatggcttctctctaccgga

SEQ ID NO: 316331 - DNA, 20 bp, Artificial Sequence
  chemically synthesized
caatggcttctctctaccgg

SEQ ID NO: 316332 - DNA, 20 bp, Artificial Sequence
  chemically synthesized
cagaaataccctccggtaga

SEQ ID NO: 316333 - DNA, 20 bp, Artificial Sequence
  chemically synthesized
gcaatggcttctctctaccg

SEQ ID NO: 316334 - DNA, 20 bp, Artificial Sequence
  chemically synthesized
cagcaatggcttctctctac

SEQ ID NO: 316335 - DNA, 20 bp, Artificial Sequence
  chemically synthesized
aaataccctccggtagagag

SEQ ID NO: 316336 - DNA, 20 bp, Artificial Sequence
  chemically synthesized
acaaggttgatgtacagcaa

SEQ ID NO: 316337 - DNA, 20 bp, Artificial Sequence
  chemically synthesized
gattggacaaggttgatgta

SEQ ID NO: 316338 - DNA, 20 bp, Artificial Sequence
  chemically synthesized
cctgggtcatggattggaca

SEQ ID NO: 316339 - DNA, 20 bp, Artificial Sequence
  chemically synthesized
tcctgggtcatggattggac

SEQ ID NO: 316340 - DNA, 20 bp, Artificial Sequence
  chemically synthesized
agccatcctgggtcatggat

SEQ ID NO: 316341 - DNA, 20 bp, Artificial Sequence
  chemically synthesized
accttgtccaatccatgacc

SEQ ID NO: 316342 - DNA, 20 bp, Artificial Sequence
  chemically synthesized
ccttgtccaatccatgaccc

SEQ ID NO: 316343 - DNA, 20 bp, Artificial Sequence
  chemically synthesized
ttgaaagccatcctgggtca

SEQ ID NO: 316344 - DNA, 20 bp, Artificial Sequence
  chemically synthesized
gtccaatccatgacccagga

SEQ ID NO: 316345 - DNA, 20 bp, Artificial Sequence
  chemically synthesized
gccacattgaaagccatcct

SEQ ID NO: 316346 - DNA, 20 bp, Artificial Sequence
  chemically synthesized
ggccacattgaaagccatcc

SEQ ID NO: 316347 - DNA, 20 bp, Artificial Sequence
  chemically synthesized
acccaggatggctttcaatg

SEQ ID NO: 316348 - DNA, 20 bp, Artificial Sequence
  chemically synthesized
tttgtgttgggccacattga

SEQ ID NO: 316349 - DNA, 20 bp, Artificial Sequence
  chemically synthesized
aaagtttacaaatttgtgtt

SEQ ID NO: 316350 - DNA, 20 bp, Artificial Sequence
  chemically synthesized
gaaagtttacaaatttgtgt

SEQ ID NO: 316351 - DNA, 20 bp, Artificial Sequence
  chemically synthesized
attgaaaaaatattttaaga

SEQ ID NO: 316352 - DNA, 20 bp, Artificial Sequence
  chemically synthesized
aataattgaaaaaatatttt

SEQ ID NO: 316353 - DNA, 20 bp, Artificial Sequence
  chemically synthesized
attttttcaattatttcttt

SEQ ID NO: 316354 - DNA, 20 bp, Artificial Sequence
  chemically synthesized
aatgatagctggtgaactaa

SEQ ID NO: 316355 - DNA, 20 bp, Artificial Sequence
  chemically synthesized
aattatttcttttagttcac

SEQ ID NO: 316356 - DNA, 20 bp, Artificial Sequence
  chemically synthesized
atactaacactaatgatagc

SEQ ID NO: 316357 - DNA, 20 bp, Artificial Sequence
  chemically synthesized
tttagttcaccagctatcat

SEQ ID NO: 316358 - DNA, 20 bp, Artificial Sequence
  chemically synthesized
aaatatactaacactaatga

SEQ ID NO: 316359 - DNA, 20 bp, Artificial Sequence
  chemically synthesized
tcaccagctatcattagtgt

SEQ ID NO: 316360 - DNA, 20 bp, Artificial Sequence
  chemically synthesized
gtgttagtatattttatgtg

SEQ ID NO: 316361 - DNA, 20 bp, Artificial Sequence
  chemically synthesized
gtatattttatgtgtggccc

SEQ ID NO: 316362 - DNA, 20 bp, Artificial Sequence
  chemically synthesized
gacattggaagaattgtctt

SEQ ID NO: 316363 - DNA, 20 bp, Artificial Sequence
  chemically synthesized
cgacattggaagaattgtct

SEQ ID NO: 316364 - DNA, 20 bp, Artificial Sequence
  chemically synthesized
gcttccctgggcgacattgg

SEQ ID NO: 316365 - DNA, 20 bp, Artificial Sequence
  chemically synthesized
ttggcttccctgggcgacat

SEQ ID NO: 316366 - DNA, 20 bp, Artificial Sequence
  chemically synthesized
acaattcttccaatgtcgcc

SEQ ID NO: 316367 - DNA, 20 bp, Artificial Sequence
  chemically synthesized
caattcttccaatgtcgccc

SEQ ID NO: 316368 - DNA, 20 bp, Artificial Sequence
  chemically synthesized
aattcttccaatgtcgccca

SEQ ID NO: 316369 - DNA, 20 bp, Artificial Sequence
  chemically synthesized
tcttccaatgtcgcccaggg

SEQ ID NO: 316370 - DNA, 20 bp, Artificial Sequence
  chemically synthesized
tccaacccgttggcttccct

SEQ ID NO: 316371 - DNA, 20 bp, Artificial Sequence
  chemically synthesized
gtccaacccgttggcttccc

SEQ ID NO: 316372 - DNA, 20 bp, Artificial Sequence
  chemically synthesized
atgtcgcccagggaagccaa

SEQ ID NO: 316373 - DNA, 20 bp, Artificial Sequence
  chemically synthesized
tgtcgcccagggaagccaac

SEQ ID NO: 316374 - DNA, 20 bp, Artificial Sequence
  chemically synthesized
gcccagggaagccaacgggt

SEQ ID NO: 316375 - DNA, 20 bp, Artificial Sequence
  chemically synthesized
accaggggtgtccaacccgt

SEQ ID NO: 316376 - DNA, 20 bp, Artificial Sequence
  chemically synthesized
gccaacgggttggacacccc

SEQ ID NO: 316377 - DNA, 20 bp, Artificial Sequence
  chemically synthesized
aaagtgtctatataaaccag

SEQ ID NO: 316378 - DNA, 20 bp, Artificial Sequence
  chemically synthesized
gaaagtgtctatataaacca

SEQ ID NO: 316379 - DNA, 20 bp, Artificial Sequence
  chemically synthesized
agaaagtgtctatataaacc

SEQ ID NO: 316380 - DNA, 20 bp, Artificial Sequence
  chemically synthesized
ttggacacccctggtttata

SEQ ID NO: 316381 - DNA, 20 bp, Artificial Sequence
  chemically synthesized
cagaaagtgtctatataaac

SEQ ID NO: 316382 - DNA, 20 bp, Artificial Sequence
  chemically synthesized
cactggaagttacatgcaga

SEQ ID NO: 316383 - DNA, 20 bp, Artificial Sequence
  chemically synthesized
cctacactggaagttacatg

SEQ ID NO: 316384 - DNA, 20 bp, Artificial Sequence
  chemically synthesized
cactttctgcatgtaacttc

SEQ ID NO: 316385 - DNA, 20 bp, Artificial Sequence
  chemically synthesized
tctgcatgtaacttccagtg

SEQ ID NO: 316386 - DNA, 20 bp, Artificial Sequence
  chemically synthesized
ctgcatgtaacttccagtgt

SEQ ID NO: 316387 - DNA, 20 bp, Artificial Sequence
  chemically synthesized
tttcccttggcctacactgg

SEQ ID NO: 316388 - DNA, 20 bp, Artificial Sequence
  chemically synthesized
ctctttcccttggcctacac

SEQ ID NO: 316389 - DNA, 20 bp, Artificial Sequence
  chemically synthesized
tgtaacttccagtgtaggcc

SEQ ID NO: 316390 - DNA, 20 bp, Artificial Sequence
  chemically synthesized
gtaacttccagtgtaggcca

SEQ ID NO: 316391 - DNA, 20 bp, Artificial Sequence
  chemically synthesized
taacttccagtgtaggccaa

SEQ ID NO: 316392 - DNA, 20 bp, Artificial Sequence
  chemically synthesized
ttccagtgtaggccaaggga

SEQ ID NO: 316393 - DNA, 20 bp, Artificial Sequence
  chemically synthesized
ccagtgtaggccaagggaaa

SEQ ID NO: 316394 - DNA, 20 bp, Artificial Sequence
  chemically synthesized
tatatctgccctctttccct

SEQ ID NO: 316395 - DNA, 20 bp, Artificial Sequence
  chemically synthesized
cagtgtaggccaagggaaag

SEQ ID NO: 316396 - DNA, 20 bp, Artificial Sequence
  chemically synthesized
agtgtaggccaagggaaaga

SEQ ID NO: 316397 - DNA, 20 bp, Artificial Sequence
  chemically synthesized
gtaggccaagggaaagaggg

SEQ ID NO: 316398 - DNA, 20 bp, Artificial Sequence
  chemically synthesized
caagggaaagagggcagata

SEQ ID NO: 316399 - DNA, 20 bp, Artificial Sequence
  chemically synthesized
agggcagatatagtgtcaac

SEQ ID NO: 316400 - DNA, 20 bp, Artificial Sequence
  chemically synthesized
ggcagatatagtgtcaacga

SEQ ID NO: 316401 - DNA, 20 bp, Artificial Sequence
  chemically synthesized
agatatagtgtcaacgagag

SEQ ID NO: 316402 - DNA, 20 bp, Artificial Sequence
  chemically synthesized
gagaagcaaatgtgccacat

SEQ ID NO: 316403 - DNA, 20 bp, Artificial Sequence
  chemically synthesized
accgtaccgcttttccgatg

SEQ ID NO: 316404 - DNA, 20 bp, Artificial Sequence
  chemically synthesized
gcaaatgtgccacatcggaa

SEQ ID NO: 316405 - DNA, 20 bp, Artificial Sequence
  chemically synthesized
aatgtgccacatcggaaaag

SEQ ID NO: 316406 - DNA, 20 bp, Artificial Sequence
  chemically synthesized
gccacatcggaaaagcggta

SEQ ID NO: 316407 - DNA, 20 bp, Artificial Sequence
  chemically synthesized
catcggaaaagcggtacggt

SEQ ID NO: 316408 - DNA, 20 bp, Artificial Sequence
  chemically synthesized
tcggaaaagcggtacggtta

SEQ ID NO: 316409 - DNA, 20 bp, Artificial Sequence
  chemically synthesized
aagcggtacggttagagaac

SEQ ID NO: 316410 - DNA, 20 bp, Artificial Sequence
  chemically synthesized
gaagaagttaggtacagtgc

SEQ ID NO: 316411 - DNA, 20 bp, Artificial Sequence
  chemically synthesized
cctgaagaagaagttaggta

SEQ ID NO: 316412 - DNA, 20 bp, Artificial Sequence
  chemically synthesized
gagcacctgaagaagaagtt

SEQ ID NO: 316413 - DNA, 20 bp, Artificial Sequence
  chemically synthesized
tgagcacctgaagaagaagt

SEQ ID NO: 316414 - DNA, 20 bp, Artificial Sequence
  chemically synthesized
actgtacctaacttcttctt

SEQ ID NO: 316415 - DNA, 20 bp, Artificial Sequence
  chemically synthesized
ctgtacctaacttcttcttc

SEQ ID NO: 316416 - DNA, 20 bp, Artificial Sequence
  chemically synthesized
taattgagcacctgaagaag

SEQ ID NO: 316417 - DNA, 20 bp, Artificial Sequence
  chemically synthesized
tactaattgagcacctgaag

SEQ ID NO: 316418 - DNA, 20 bp, Artificial Sequence
  chemically synthesized
agatactaattgagcacctg

SEQ ID NO: 316419 - DNA, 20 bp, Artificial Sequence
  chemically synthesized
ttcttcttcaggtgctcaat

SEQ ID NO: 316420 - DNA, 20 bp, Artificial Sequence
  chemically synthesized
ttgtcatatagatactaatt

SEQ ID NO: 316421 - DNA, 20 bp, Artificial Sequence
  chemically synthesized
tcaattagtatctatatgac

SEQ ID NO: 316422 - DNA, 20 bp, Artificial Sequence
  chemically synthesized
aactgtgattacttgtcata

SEQ ID NO: 316423 - DNA, 20 bp, Artificial Sequence
  chemically synthesized
atctatatgacaagtaatca

SEQ ID NO: 316424 - DNA, 20 bp, Artificial Sequence
  chemically synthesized
tcaactgtattgcaattatg

SEQ ID NO: 316425 - DNA, 20 bp, Artificial Sequence
  chemically synthesized
atttctacataattgcaata

SEQ ID NO: 316426 - DNA, 20 bp, Artificial Sequence
  chemically synthesized
agttgatgtttttttcctga

SEQ ID NO: 316427 - DNA, 20 bp, Artificial Sequence
  chemically synthesized
atgtttttttcctgatggca

SEQ ID NO: 316428 - DNA, 20 bp, Artificial Sequence
  chemically synthesized
tccccgtctgctatgccatc

SEQ ID NO: 316429 - DNA, 20 bp, Artificial Sequence
  chemically synthesized
atccccgtctgctatgccat

SEQ ID NO: 316430 - DNA, 20 bp, Artificial Sequence
  chemically synthesized
tttttttcctgatggcatag

SEQ ID NO: 316431 - DNA, 20 bp, Artificial Sequence
  chemically synthesized
tttcctgatggcatagcaga

SEQ ID NO: 316432 - DNA, 20 bp, Artificial Sequence
  chemically synthesized
ttcctgatggcatagcagac

SEQ ID NO: 316433 - DNA, 20 bp, Artificial Sequence
  chemically synthesized
tcctgatggcatagcagacg

SEQ ID NO: 316434 - DNA, 20 bp, Artificial Sequence
  chemically synthesized
atagcagacggggattacca

SEQ ID NO: 316435 - DNA, 20 bp, Artificial Sequence
  chemically synthesized
gacggggattaccatagtta

SEQ ID NO: 316436 - DNA, 20 bp, Artificial Sequence
  chemically synthesized
tttaagaagaactgtaacta

SEQ ID NO: 316437 - DNA, 20 bp, Artificial Sequence
  chemically synthesized
tctaagatctagcatttaag

SEQ ID NO: 316438 - DNA, 20 bp, Artificial Sequence
  chemically synthesized
ttacagttcttcttaaatgc

SEQ ID NO: 316439 - DNA, 20 bp, Artificial Sequence
  chemically synthesized
tcctctaagatctagcattt

SEQ ID NO: 316440 - DNA, 20 bp, Artificial Sequence
  chemically synthesized
tcttcttaaatgctagatct

SEQ ID NO: 316441 - DNA, 20 bp, Artificial Sequence
  chemically synthesized
ttcttaaatgctagatctta

SEQ ID NO: 316442 - DNA, 20 bp, Artificial Sequence
  chemically synthesized
cccaggagtcctctaagatc

SEQ ID NO: 316443 - DNA, 20 bp, Artificial Sequence
  chemically synthesized
tcttaaatgctagatcttag

SEQ ID NO: 316444 - DNA, 20 bp, Artificial Sequence
  chemically synthesized
ttgacccccaggagtcctct

SEQ ID NO: 316445 - DNA, 20 bp, Artificial Sequence
  chemically synthesized
gctagatcttagaggactcc

SEQ ID NO: 316446 - DNA, 20 bp, Artificial Sequence
  chemically synthesized
ctagatcttagaggactcct

SEQ ID NO: 316447 - DNA, 20 bp, Artificial Sequence
  chemically synthesized
tagatcttagaggactcctg

SEQ ID NO: 316448 - DNA, 20 bp, Artificial Sequence
  chemically synthesized
agatcttagaggactcctgg

SEQ ID NO: 316449 - DNA, 20 bp, Artificial Sequence
  chemically synthesized
ttactattattgacccccag

SEQ ID NO: 316450 - DNA, 20 bp, Artificial Sequence
  chemically synthesized
ccttactattattgaccccc

SEQ ID NO: 316451 - DNA, 20 bp, Artificial Sequence
  chemically synthesized
cccttactattattgacccc

SEQ ID NO: 316452 - DNA, 20 bp, Artificial Sequence
  chemically synthesized
ggactcctgggggtcaataa

SEQ ID NO: 316453 - DNA, 20 bp, Artificial Sequence
  chemically synthesized
tcctgggggtcaataatagt

SEQ ID NO: 316454 - DNA, 20 bp, Artificial Sequence
  chemically synthesized
cctgggggtcaataatagta

SEQ ID NO: 316455 - DNA, 20 bp, Artificial Sequence
  chemically synthesized
ctgggggtcaataatagtaa

SEQ ID NO: 316456 - DNA, 20 bp, Artificial Sequence
  chemically synthesized
gggtcaataatagtaagggc

SEQ ID NO: 316457 - DNA, 20 bp, Artificial Sequence
  chemically synthesized
ttttgaatgacaaatggggc

SEQ ID NO: 316458 - DNA, 20 bp, Artificial Sequence
  chemically synthesized
tcagttttgaatgacaaatg

SEQ ID NO: 316459 - DNA, 20 bp, Artificial Sequence
  chemically synthesized
ttcagttttgaatgacaaat

SEQ ID NO: 316460 - DNA, 20 bp, Artificial Sequence
  chemically synthesized
cttcagttttgaatgacaaa

SEQ ID NO: 316461 - DNA, 20 bp, Artificial Sequence
  chemically synthesized
ccatttgtcattcaaaactg

SEQ ID NO: 316462 - DNA, 20 bp, Artificial Sequence
  chemically synthesized
tttttaagtttaatgagctt

SEQ ID NO: 316463 - DNA, 20 bp, Artificial Sequence
  chemically synthesized
gagttttttttaagtttaat

SEQ ID NO: 316464 - DNA, 20 bp, Artificial Sequence
  chemically synthesized
taagttctagagtttttttt

SEQ ID NO: 316465 - DNA, 20 bp, Artificial Sequence
  chemically synthesized
attaaacttaaaaaaaactc

SEQ ID NO: 316466 - DNA, 20 bp, Artificial Sequence
  chemically synthesized
ttaaaaaaaactctagaact

SEQ ID NO: 316467 - DNA, 20 bp, Artificial Sequence
  chemically synthesized
acatttatttctaagttcta

SEQ ID NO: 316468 - DNA, 20 bp, Artificial Sequence
  chemically synthesized
atacatttatttctaagttc

SEQ ID NO: 316469 - DNA, 20 bp, Artificial Sequence
  chemically synthesized
tgaaagatacatttatttct

SEQ ID NO: 316470 - DNA, 20 bp, Artificial Sequence
  chemically synthesized
cagttcttccatgcaaatga

SEQ ID NO: 316471 - DNA, 20 bp, Artificial Sequence
  chemically synthesized
aaatgtatctttcatttgca

SEQ ID NO: 316472 - DNA, 20 bp, Artificial Sequence
  chemically synthesized
tgtatctttcatttgcatgg

SEQ ID NO: 316473 - DNA, 20 bp, Artificial Sequence
  chemically synthesized
atttgcatggaagaactgta

SEQ ID NO: 316474 - DNA, 20 bp, Artificial Sequence
  chemically synthesized
ttcagtcatatatagcttta

SEQ ID NO: 316475 - DNA, 20 bp, Artificial Sequence
  chemically synthesized
ttataatattcagtcatata

SEQ ID NO: 316476 - DNA, 20 bp, Artificial Sequence
  chemically synthesized
ttctctctttttataatatt

SEQ ID NO: 316477 - DNA, 20 bp, Artificial Sequence
  chemically synthesized
atatgactgaatattataaa

SEQ ID NO: 316478 - DNA, 20 bp, Artificial Sequence
  chemically synthesized
atgactgaatattataaaaa

SEQ ID NO: 316479 - DNA, 20 bp, Artificial Sequence
  chemically synthesized
gactgaatattataaaaaga

SEQ ID NO: 316480 - DNA, 20 bp, Artificial Sequence
  chemically synthesized
tattataaaaagagagaatt

SEQ ID NO: 316481 - DNA, 20 bp, Artificial Sequence
  chemically synthesized
gagagaattaagtttgacaa

SEQ ID NO: 316482 - DNA, 20 bp, Artificial Sequence
  chemically synthesized
agagaattaagtttgacaaa

SEQ ID NO: 316483 - DNA, 20 bp, Artificial Sequence
  chemically synthesized
gaattaagtttgacaaaagg

SEQ ID NO: 316484 - DNA, 20 bp, Artificial Sequence
  chemically synthesized
ttgacaaaaggcagatttcg

SEQ ID NO: 316485 - DNA, 20 bp, Artificial Sequence
  chemically synthesized
tgacaaaaggcagatttcga

SEQ ID NO: 316486 - DNA, 20 bp, Artificial Sequence
  chemically synthesized
aaggcagatttcgaaggtat

SEQ ID NO: 316487 - DNA, 20 bp, Artificial Sequence
  chemically synthesized
aggcagatttcgaaggtatg

SEQ ID NO: 316488 - DNA, 20 bp, Artificial Sequence
  chemically synthesized
gatttcgaaggtatgaggta

SEQ ID NO: 316489 - DNA, 20 bp, Artificial Sequence
  chemically synthesized
atttcgaaggtatgaggtaa

SEQ ID NO: 316490 - DNA, 20 bp, Artificial Sequence
  chemically synthesized
ttcgaaggtatgaggtaaag

SEQ ID NO: 316491 - DNA, 20 bp, Artificial Sequence
  chemically synthesized
gaaggtatgaggtaaaggag

SEQ ID NO: 316492 - DNA, 20 bp, Artificial Sequence
  chemically synthesized
ggagcagatattcctattca

SEQ ID NO: 316493 - DNA, 20 bp, Artificial Sequence
  chemically synthesized
ttggatttatggctttgaat

SEQ ID NO: 316494 - DNA, 20 bp, Artificial Sequence
  chemically synthesized
tttggatttatggctttgaa

SEQ ID NO: 316495 - DNA, 20 bp, Artificial Sequence
  chemically synthesized
atctgtggtttttggattta

SEQ ID NO: 316496 - DNA, 20 bp, Artificial Sequence
  chemically synthesized
agccataaatccaaaaacca

SEQ ID NO: 316497 - DNA, 20 bp, Artificial Sequence
  chemically synthesized
tacttatgatctgtggtttt

SEQ ID NO: 316498 - DNA, 20 bp, Artificial Sequence
  chemically synthesized
gcaactctacttatgatctg

SEQ ID NO: 316499 - DNA, 20 bp, Artificial Sequence
  chemically synthesized
atccaaaaaccacagatcat

SEQ ID NO: 316500 - DNA, 20 bp, Artificial Sequence
  chemically synthesized
caaaaaccacagatcataag

SEQ ID NO: 316501 - DNA, 20 bp, Artificial Sequence
  chemically synthesized
aaaaccacagatcataagta

SEQ ID NO: 316502 - DNA, 20 bp, Artificial Sequence
  chemically synthesized
cagatcataagtagagttgc

SEQ ID NO: 316503 - DNA, 20 bp, Artificial Sequence
  chemically synthesized
tgagtgtcttttattttatc

SEQ ID NO: 316504 - DNA, 20 bp, Artificial Sequence
  chemically synthesized
agagttgccagataaaataa

SEQ ID NO: 316505 - DNA, 20 bp, Artificial Sequence
  chemically synthesized
cagataaaataaaagacact

SEQ ID NO: 316506 - DNA, 20 bp, Artificial Sequence
  chemically synthesized
tctgaaattcacattttgct

SEQ ID NO: 316507 - DNA, 20 bp, Artificial Sequence
  chemically synthesized
actcagcaaaatgtgaattt

SEQ ID NO: 316508 - DNA, 20 bp, Artificial Sequence
  chemically synthesized
cagataaacaatgaacaatt

SEQ ID NO: 316509 - DNA, 20 bp, Artificial Sequence
  chemically synthesized
agataaacaatgaacaattt

SEQ ID NO: 316510 - DNA, 20 bp, Artificial Sequence
  chemically synthesized
aacaatttgggacacacact

SEQ ID NO: 316511 - DNA, 20 bp, Artificial Sequence
  chemically synthesized
taaacaacaaataattttct

SEQ ID NO: 316512 - DNA, 20 bp, Artificial Sequence
  chemically synthesized
gcctacttaaatgtaaattt

SEQ ID NO: 316513 - DNA, 20 bp, Artificial Sequence
  chemically synthesized
tttatctgaaatttacattt

SEQ ID NO: 316514 - DNA, 20 bp, Artificial Sequence
  chemically synthesized
atctgaaatttacatttaag

SEQ ID NO: 316515 - DNA, 20 bp, Artificial Sequence
  chemically synthesized
tctgaaatttacatttaagt

SEQ ID NO: 316516 - DNA, 20 bp, Artificial Sequence
  chemically synthesized
ttagcagacacaaataaaag

SEQ ID NO: 316517 - DNA, 20 bp, Artificial Sequence
  chemically synthesized
catttagcagacacaaataa

SEQ ID NO: 316518 - DNA, 20 bp, Artificial Sequence
  chemically synthesized
ttatttgtgtctgctaaatg

SEQ ID NO: 316519 - DNA, 20 bp, Artificial Sequence
  chemically synthesized
attagggttgccacatttag

SEQ ID NO: 316520 - DNA, 20 bp, Artificial Sequence
  chemically synthesized
aggattagggttgccacatt

SEQ ID NO: 316521 - DNA, 20 bp, Artificial Sequence
  chemically synthesized
aaatgtggcaaccctaatcc

SEQ ID NO: 316522 - DNA, 20 bp, Artificial Sequence
  chemically synthesized
aatgtggcaaccctaatcct

SEQ ID NO: 316523 - DNA, 20 bp, Artificial Sequence
  chemically synthesized
ttgtaattgtcccaggatta

SEQ ID NO: 316524 - DNA, 20 bp, Artificial Sequence
  chemically synthesized
tttgtaattgtcccaggatt

SEQ ID NO: 316525 - DNA, 20 bp, Artificial Sequence
  chemically synthesized
ctttgtaattgtcccaggat

SEQ ID NO: 316526 - DNA, 20 bp, Artificial Sequence
  chemically synthesized
agatcctttgtaattgtccc

SEQ ID NO: 316527 - DNA, 20 bp, Artificial Sequence
  chemically synthesized
aagatcctttgtaattgtcc

SEQ ID NO: 316528 - DNA, 20 bp, Artificial Sequence
  chemically synthesized
ctaatcctgggacaattaca

SEQ ID NO: 316529 - DNA, 20 bp, Artificial Sequence
  chemically synthesized
taatcctgggacaattacaa

SEQ ID NO: 316530 - DNA, 20 bp, Artificial Sequence
  chemically synthesized
gaggaaacacacacacacac

SEQ ID NO: 316531 - DNA, 20 bp, Artificial Sequence
  chemically synthesized
aggctcctgctcaattcatg

SEQ ID NO: 316532 - DNA, 20 bp, Artificial Sequence
  chemically synthesized
tgtgtgtttcctcatgaatt

SEQ ID NO: 316533 - DNA, 20 bp, Artificial Sequence
  chemically synthesized
taggctcctgctcaattcat

SEQ ID NO: 316534 - DNA, 20 bp, Artificial Sequence
  chemically synthesized
gtgtttcctcatgaattgag

SEQ ID NO: 316535 - DNA, 20 bp, Artificial Sequence
  chemically synthesized
tgtttcctcatgaattgagc

SEQ ID NO: 316536 - DNA, 20 bp, Artificial Sequence
  chemically synthesized
tttcctcatgaattgagcag

SEQ ID NO: 316537 - DNA, 20 bp, Artificial Sequence
  chemically synthesized
ctgagttttattgttgaaat

SEQ ID NO: 316538 - DNA, 20 bp, Artificial Sequence
  chemically synthesized
tctgagttttattgttgaaa

SEQ ID NO: 316539 - DNA, 20 bp, Artificial Sequence
  chemically synthesized
cctatttcaacaataaaact

SEQ ID NO: 316540 - DNA, 20 bp, Artificial Sequence
  chemically synthesized
tatttcaacaataaaactca

SEQ ID NO: 316541 - DNA, 20 bp, Artificial Sequence
  chemically synthesized
aaaatattacaattagctct

SEQ ID NO: 316542 - DNA, 20 bp, Artificial Sequence
  chemically synthesized
gtgccataaaatattacaat

SEQ ID NO: 316543 - DNA, 20 bp, Artificial Sequence
  chemically synthesized
gagctaattgtaatatttta

SEQ ID NO: 316544 - DNA, 20 bp, Artificial Sequence
  chemically synthesized
tgagggtgctttattttaat

SEQ ID NO: 316545 - DNA, 20 bp, Artificial Sequence
  chemically synthesized
ttatggcacttattaaaata

SEQ ID NO: 316546 - DNA, 20 bp, Artificial Sequence
  chemically synthesized
tttcttatccaaaattatga

SEQ ID NO: 316547 - DNA, 20 bp, Artificial Sequence
  chemically synthesized
atttcttatccaaaattatg

SEQ ID NO: 316548 - DNA, 20 bp, Artificial Sequence
  chemically synthesized
ataaagcaccctcataattt

SEQ ID NO: 316549 - DNA, 20 bp, Artificial Sequence
  chemically synthesized
tatttcttatccaaaattat

SEQ ID NO: 316550 - DNA, 20 bp, Artificial Sequence
  chemically synthesized
gcaccctcataattttggat

SEQ ID NO: 316551 - DNA, 20 bp, Artificial Sequence
  chemically synthesized
ttggataagaaatattattg

SEQ ID NO: 316552 - DNA, 20 bp, Artificial Sequence
  chemically synthesized
gataagaaatattattgtag

SEQ ID NO: 316553 - DNA, 20 bp, Artificial Sequence
  chemically synthesized
tattgtagaagtctcaataa

SEQ ID NO: 316554 - DNA, 20 bp, Artificial Sequence
  chemically synthesized
ttttttttgtttctgttatt

SEQ ID NO: 316555 - DNA, 20 bp, Artificial Sequence
  chemically synthesized
aaacaaaaaaaaatgctttc

SEQ ID NO: 316556 - DNA, 20 bp, Artificial Sequence
  chemically synthesized
caaaaaaaaatgctttctgg

SEQ ID NO: 316557 - DNA, 20 bp, Artificial Sequence
  chemically synthesized
tatgctccctcgctgccaga

SEQ ID NO: 316558 - DNA, 20 bp, Artificial Sequence
  chemically synthesized
aaaaaatgctttctggcagc

SEQ ID NO: 316559 - DNA, 20 bp, Artificial Sequence
  chemically synthesized
aaaaatgctttctggcagcg

SEQ ID NO: 316560 - DNA, 20 bp, Artificial Sequence
  chemically synthesized
aaaatgctttctggcagcga

SEQ ID NO: 316561 - DNA, 20 bp, Artificial Sequence
  chemically synthesized
cagttatgctccctcgctgc

SEQ ID NO: 316562 - DNA, 20 bp, Artificial Sequence
  chemically synthesized
aatgctttctggcagcgagg

SEQ ID NO: 316563 - DNA, 20 bp, Artificial Sequence
  chemically synthesized
tggcagcgagggagcataac

SEQ ID NO: 316564 - DNA, 20 bp, Artificial Sequence
  chemically synthesized
tcagtttacttgtacatttc

SEQ ID NO: 316565 - DNA, 20 bp, Artificial Sequence
  chemically synthesized
gagcataactggaaatgtac

SEQ ID NO: 316566 - DNA, 20 bp, Artificial Sequence
  chemically synthesized
ggaaatgtacaagtaaactg

SEQ ID NO: 316567 - DNA, 20 bp, Artificial Sequence
  chemically synthesized
tacaagtaaactgaagaaaa

SEQ ID NO: 316568 - DNA, 20 bp, Artificial Sequence
  chemically synthesized
atatttccatcttttttctt

SEQ ID NO: 316569 - DNA, 20 bp, Artificial Sequence
  chemically synthesized
agtaaactgaagaaaaaaga

SEQ ID NO: 316570 - DNA, 20 bp, Artificial Sequence
  chemically synthesized
ttaaaaaatgtcatattcta

SEQ ID NO: 316571 - DNA, 20 bp, Artificial Sequence
  chemically synthesized
aaatgtcatattctatagaa

SEQ ID NO: 316572 - DNA, 20 bp, Artificial Sequence
  chemically synthesized
tctgaagcattgcttttcta

SEQ ID NO: 316573 - DNA, 20 bp, Artificial Sequence
  chemically synthesized
tctatagaaaagcaatgctt

SEQ ID NO: 316574 - DNA, 20 bp, Artificial Sequence
  chemically synthesized
tgatgataaatgagagtctg

SEQ ID NO: 316575 - DNA, 20 bp, Artificial Sequence
  chemically synthesized
ccaagcttgatgataaatga

SEQ ID NO: 316576 - DNA, 20 bp, Artificial Sequence
  chemically synthesized
ggccaagcttgatgataaat

SEQ ID NO: 316577 - DNA, 20 bp, Artificial Sequence
  chemically synthesized
tcagactctcatttatcatc

SEQ ID NO: 316578 - DNA, 20 bp, Artificial Sequence
  chemically synthesized
ctctcatttatcatcaagct

SEQ ID NO: 316579 - DNA, 20 bp, Artificial Sequence
  chemically synthesized
catttatcatcaagcttggc

SEQ ID NO: 316580 - DNA, 20 bp, Artificial Sequence
  chemically synthesized
atagtaaattgaagctggcc

SEQ ID NO: 316581 - DNA, 20 bp, Artificial Sequence
  chemically synthesized
aatttatagtaaattgaagc

SEQ ID NO: 316582 - DNA, 20 bp, Artificial Sequence
  chemically synthesized
attcaatttatagtaaattg

SEQ ID NO: 316583 - DNA, 20 bp, Artificial Sequence
  chemically synthesized
gtaattttacattcaattta

SEQ ID NO: 316584 - DNA, 20 bp, Artificial Sequence
  chemically synthesized
aattacattaaaaaaaatcg

SEQ ID NO: 316585 - DNA, 20 bp, Artificial Sequence
  chemically synthesized
taatgcaaatttaaataata

SEQ ID NO: 316586 - DNA, 20 bp, Artificial Sequence
  chemically synthesized
gtaatgcaaatttaaataat

SEQ ID NO: 316587 - DNA, 20 bp, Artificial Sequence
  chemically synthesized
attatttaaatttgcattac

SEQ ID NO: 316588 - DNA, 20 bp, Artificial Sequence
  chemically synthesized
cattacaagtaatccctatg

SEQ ID NO: 316589 - DNA, 20 bp, Artificial Sequence
  chemically synthesized
cctggaagacagacttcata

SEQ ID NO: 316590 - DNA, 20 bp, Artificial Sequence
  chemically synthesized
tcctggaagacagacttcat

SEQ ID NO: 316591 - DNA, 20 bp, Artificial Sequence
  chemically synthesized
ttcctggaagacagacttca

SEQ ID NO: 316592 - DNA, 20 bp, Artificial Sequence
  chemically synthesized
tccctatgaagtctgtcttc

SEQ ID NO: 316593 - DNA, 20 bp, Artificial Sequence
  chemically synthesized
ccctatgaagtctgtcttcc

SEQ ID NO: 316594 - DNA, 20 bp, Artificial Sequence
  chemically synthesized
aaatttgctttcctggaaga

SEQ ID NO: 316595 - DNA, 20 bp, Artificial Sequence
  chemically synthesized
atgaagtctgtcttccagga

SEQ ID NO: 316596 - DNA, 20 bp, Artificial Sequence
  chemically synthesized
ttaaaaatttgctttcctgg

SEQ ID NO: 316597 - DNA, 20 bp, Artificial Sequence
  chemically synthesized
ttattaaaaatttgctttcc

SEQ ID NO: 316598 - DNA, 20 bp, Artificial Sequence
  chemically synthesized
ttgtggatgagaacaacgca

SEQ ID NO: 316599 - DNA, 20 bp, Artificial Sequence
  chemically synthesized
tttgtggatgagaacaacgc

SEQ ID NO: 316600 - DNA, 20 bp, Artificial Sequence
  chemically synthesized
atttgtggatgagaacaacg

SEQ ID NO: 316601 - DNA, 20 bp, Artificial Sequence
  chemically synthesized
aatcaaacatatttgtggat

SEQ ID NO: 316602 - DNA, 20 bp, Artificial Sequence
  chemically synthesized
aaagaaatcaaacatatttg

SEQ ID NO: 316603 - DNA, 20 bp, Artificial Sequence
  chemically synthesized
taggcttttcgtatttggaa

SEQ ID NO: 316604 - DNA, 20 bp, Artificial Sequence
  chemically synthesized
atagctaggcttttcgtatt

SEQ ID NO: 316605 - DNA, 20 bp, Artificial Sequence
  chemically synthesized
atttcttttccaaatacgaa

SEQ ID NO: 316606 - DNA, 20 bp, Artificial Sequence
  chemically synthesized
ttttccaaatacgaaaagcc

SEQ ID NO: 316607 - DNA, 20 bp, Artificial Sequence
  chemically synthesized
ttaaaaaatacagcatagct

SEQ ID NO: 316608 - DNA, 20 bp, Artificial Sequence
  chemically synthesized
tttaaaaaatacagcatagc

SEQ ID NO: 316609 - DNA, 20 bp, Artificial Sequence
  chemically synthesized
tttttttaaaaaatacagca

SEQ ID NO: 316610 - DNA, 20 bp, Artificial Sequence
  chemically synthesized
tgttgtttttttaaaaaata

SEQ ID NO: 316611 - DNA, 20 bp, Artificial Sequence
  chemically synthesized
acagcagcacaaaatggatt

SEQ ID NO: 316612 - DNA, 20 bp, Artificial Sequence
  chemically synthesized
tttgttacagcagcacaaaa

SEQ ID NO: 316613 - DNA, 20 bp, Artificial Sequence
  chemically synthesized
ctcagttatttttgttacag

SEQ ID NO: 316614 - DNA, 20 bp, Artificial Sequence
  chemically synthesized
attctcagttatttttgtta

SEQ ID NO: 316615 - DNA, 20 bp, Artificial Sequence
  chemically synthesized
ctgctgtaacaaaaataact

SEQ ID NO: 316616 - DNA, 20 bp, Artificial Sequence
  chemically synthesized
taacaaaaataactgagaat

SEQ ID NO: 316617 - DNA, 20 bp, Artificial Sequence
  chemically synthesized
aacaaaaataactgagaatg

SEQ ID NO: 316618 - DNA, 20 bp, Artificial Sequence
  chemically synthesized
ttcctaaattacctcattct

SEQ ID NO: 316619 - DNA, 20 bp, Artificial Sequence
  chemically synthesized
taactgagaatgaggtaatt

SEQ ID NO: 316620 - DNA, 20 bp, Artificial Sequence
  chemically synthesized
aactgagaatgaggtaattt

SEQ ID NO: 316621 - DNA, 20 bp, Artificial Sequence
  chemically synthesized
tgagaatgaggtaatttagg

SEQ ID NO: 316622 - DNA, 20 bp, Artificial Sequence
  chemically synthesized
cgagaactgtgaaaaaataa

SEQ ID NO: 316623 - DNA, 20 bp, Artificial Sequence
  chemically synthesized
tcgagaactgtgaaaaaata

SEQ ID NO: 316624 - DNA, 20 bp, Artificial Sequence
  chemically synthesized
aatgtacctttattttttca

SEQ ID NO: 316625 - DNA, 20 bp, Artificial Sequence
  chemically synthesized
tttattttttcacagttctc

SEQ ID NO: 316626 - DNA, 20 bp, Artificial Sequence
  chemically synthesized
tttttcacagttctcgagtt

SEQ ID NO: 316627 - DNA, 20 bp, Artificial Sequence
  chemically synthesized
ttttcacagttctcgagttt

SEQ ID NO: 316628 - DNA, 20 bp, Artificial Sequence
  chemically synthesized
atcttggatttcccaaactc

SEQ ID NO: 316629 - DNA, 20 bp, Artificial Sequence
  chemically synthesized
ttctcgagtttgggaaatcc

SEQ ID NO: 316630 - DNA, 20 bp, Artificial Sequence
  chemically synthesized
agtttgggaaatccaagatc

SEQ ID NO: 316631 - DNA, 20 bp, Artificial Sequence
  chemically synthesized
agatgctaacatcttgatct

SEQ ID NO: 316632 - DNA, 20 bp, Artificial Sequence
  chemically synthesized
gaaatccaagatcaagatgt

SEQ ID NO: 316633 - DNA, 20 bp, Artificial Sequence
  chemically synthesized
aagatcaagatgttagcatc

SEQ ID NO: 316634 - DNA, 20 bp, Artificial Sequence
  chemically synthesized
tcaagatgttagcatctggt

SEQ ID NO: 316635 - DNA, 20 bp, Artificial Sequence
  chemically synthesized
caagatgttagcatctggtg

SEQ ID NO: 316636 - DNA, 20 bp, Artificial Sequence
  chemically synthesized
aagatgttagcatctggtga

SEQ ID NO: 316637 - DNA, 20 bp, Artificial Sequence
  chemically synthesized
ctctgtgaaaaggccctcac

SEQ ID NO: 316638 - DNA, 20 bp, Artificial Sequence
  chemically synthesized
atctggtgagggccttttca

SEQ ID NO: 316639 - DNA, 20 bp, Artificial Sequence
  chemically synthesized
ctggtgagggccttttcaca

SEQ ID NO: 316640 - DNA, 20 bp, Artificial Sequence
  chemically synthesized
catgtgaaaactctgtgaaa

SEQ ID NO: 316641 - DNA, 20 bp, Artificial Sequence
  chemically synthesized
ccatgtgaaaactctgtgaa

SEQ ID NO: 316642 - DNA, 20 bp, Artificial Sequence
  chemically synthesized
cttttcacagagttttcaca

SEQ ID NO: 316643 - DNA, 20 bp, Artificial Sequence
  chemically synthesized
ttcacagagttttcacatgg

SEQ ID NO: 316644 - DNA, 20 bp, Artificial Sequence
  chemically synthesized
agttttcacatggtggtgca

SEQ ID NO: 316645 - DNA, 20 bp, Artificial Sequence
  chemically synthesized
tttcacatggtggtgcatgg

SEQ ID NO: 316646 - DNA, 20 bp, Artificial Sequence
  chemically synthesized
tcacatggtggtgcatggtg

SEQ ID NO: 316647 - DNA, 20 bp, Artificial Sequence
  chemically synthesized
cacatggtggtgcatggtgg

SEQ ID NO: 316648 - DNA, 20 bp, Artificial Sequence
  chemically synthesized
acatggtggtgcatggtgga

SEQ ID NO: 316649 - DNA, 20 bp, Artificial Sequence
  chemically synthesized
gtggtgcatggtggagggtc

SEQ ID NO: 316650 - DNA, 20 bp, Artificial Sequence
  chemically synthesized
ggtgcatggtggagggtcaa

SEQ ID NO: 316651 - DNA, 20 bp, Artificial Sequence
  chemically synthesized
catggtggagggtcaagaga

SEQ ID NO: 316652 - DNA, 20 bp, Artificial Sequence
  chemically synthesized
atggtggagggtcaagagat

SEQ ID NO: 316653 - DNA, 20 bp, Artificial Sequence
  chemically synthesized
ggtggagggtcaagagatag

SEQ ID NO: 316654 - DNA, 20 bp, Artificial Sequence
  chemically synthesized
agataggagaacactgtgtg

SEQ ID NO: 316655 - DNA, 20 bp, Artificial Sequence
  chemically synthesized
catataaaagaggcttcaca

SEQ ID NO: 316656 - DNA, 20 bp, Artificial Sequence
  chemically synthesized
gatcaagtcccatataaaag

SEQ ID NO: 316657 - DNA, 20 bp, Artificial Sequence
  chemically synthesized
tgtgtgaagcctcttttata

SEQ ID NO: 316658 - DNA, 20 bp, Artificial Sequence
  chemically synthesized
ggatcaagtcccatataaaa

SEQ ID NO: 316659 - DNA, 20 bp, Artificial Sequence
  chemically synthesized
gtgtgaagcctcttttatat

SEQ ID NO: 316660 - DNA, 20 bp, Artificial Sequence
  chemically synthesized
taggatcaagtcccatataa

SEQ ID NO: 316661 - DNA, 20 bp, Artificial Sequence
  chemically synthesized
cctcccttaagaataggatc

SEQ ID NO: 316662 - DNA, 20 bp, Artificial Sequence
  chemically synthesized
tgggacttgatcctattctt

SEQ ID NO: 316663 - DNA, 20 bp, Artificial Sequence
  chemically synthesized
gggacttgatcctattctta

SEQ ID NO: 316664 - DNA, 20 bp, Artificial Sequence
  chemically synthesized
agggctcctcccttaagaat

SEQ ID NO: 316665 - DNA, 20 bp, Artificial Sequence
  chemically synthesized
ggacttgatcctattcttaa

SEQ ID NO: 316666 - DNA, 20 bp, Artificial Sequence
  chemically synthesized
cagggctcctcccttaagaa

SEQ ID NO: 316667 - DNA, 20 bp, Artificial Sequence
  chemically synthesized
acttgatcctattcttaagg

SEQ ID NO: 316668 - DNA, 20 bp, Artificial Sequence
  chemically synthesized
cttgatcctattcttaaggg

SEQ ID NO: 316669 - DNA, 20 bp, Artificial Sequence
  chemically synthesized
tgatcctattcttaagggag

SEQ ID NO: 316670 - DNA, 20 bp, Artificial Sequence
  chemically synthesized
tccatcagggctcctccctt

SEQ ID NO: 316671 - DNA, 20 bp, Artificial Sequence
  chemically synthesized
tcttaagggaggagccctga

SEQ ID NO: 316672 - DNA, 20 bp, Artificial Sequence
  chemically synthesized
taagggtgaataatccatca

SEQ ID NO: 316673 - DNA, 20 bp, Artificial Sequence
  chemically synthesized
ttaagggtgaataatccatc

SEQ ID NO: 316674 - DNA, 20 bp, Artificial Sequence
  chemically synthesized
tttaagggtgaataatccat

SEQ ID NO: 316675 - DNA, 20 bp, Artificial Sequence
  chemically synthesized
ttaggagatggaatatttaa

SEQ ID NO: 316676 - DNA, 20 bp, Artificial Sequence
  chemically synthesized
attaggagatggaatattta

SEQ ID NO: 316677 - DNA, 20 bp, Artificial Sequence
  chemically synthesized
tattaggagatggaatattt

SEQ ID NO: 316678 - DNA, 20 bp, Artificial Sequence
  chemically synthesized
caggtgattgtattaggaga

SEQ ID NO: 316679 - DNA, 20 bp, Artificial Sequence
  chemically synthesized
aattcaggtgattgtattag

SEQ ID NO: 316680 - DNA, 20 bp, Artificial Sequence
  chemically synthesized
aaaattcaggtgattgtatt

SEQ ID NO: 316681 - DNA, 20 bp, Artificial Sequence
  chemically synthesized
caaaattcaggtgattgtat

SEQ ID NO: 316682 - DNA, 20 bp, Artificial Sequence
  chemically synthesized
taatacaatcacctgaattt

SEQ ID NO: 316683 - DNA, 20 bp, Artificial Sequence
  chemically synthesized
ataagtcccctccaaaattc

SEQ ID NO: 316684 - DNA, 20 bp, Artificial Sequence
  chemically synthesized
atacaatcacctgaattttg

SEQ ID NO: 316685 - DNA, 20 bp, Artificial Sequence
  chemically synthesized
aataagtcccctccaaaatt

SEQ ID NO: 316686 - DNA, 20 bp, Artificial Sequence
  chemically synthesized
tacaatcacctgaattttgg

SEQ ID NO: 316687 - DNA, 20 bp, Artificial Sequence
  chemically synthesized
acaatcacctgaattttgga

SEQ ID NO: 316688 - DNA, 20 bp, Artificial Sequence
  chemically synthesized
caatcacctgaattttggag

SEQ ID NO: 316689 - DNA, 20 bp, Artificial Sequence
  chemically synthesized
attttggaggggacttattc

SEQ ID NO: 316690 - DNA, 20 bp, Artificial Sequence
  chemically synthesized
tttgttgcaatggcttgaat

SEQ ID NO: 316691 - DNA, 20 bp, Artificial Sequence
  chemically synthesized
ttttgcaatctttgttgcaa

SEQ ID NO: 316692 - DNA, 20 bp, Artificial Sequence
  chemically synthesized
ttattcaagccattgcaaca

SEQ ID NO: 316693 - DNA, 20 bp, Artificial Sequence
  chemically synthesized
acaaagattgcaaaaacaat

SEQ ID NO: 316694 - DNA, 20 bp, Artificial Sequence
  chemically synthesized
caaagattgcaaaaacaatt

SEQ ID NO: 316695 - DNA, 20 bp, Artificial Sequence
  chemically synthesized
taaaaataatttttaaaata

SEQ ID NO: 316696 - DNA, 20 bp, Artificial Sequence
  chemically synthesized
tttaaaatatggctgacttt

SEQ ID NO: 316697 - DNA, 20 bp, Artificial Sequence
  chemically synthesized
agagaattaaaacttaaagt

SEQ ID NO: 316698 - DNA, 20 bp, Artificial Sequence
  chemically synthesized
tgggagagaattaaaactta

SEQ ID NO: 316699 - DNA, 20 bp, Artificial Sequence
  chemically synthesized
agatgacatggttgatggga

SEQ ID NO: 316700 - DNA, 20 bp, Artificial Sequence
  chemically synthesized
acagatgacatggttgatgg

SEQ ID NO: 316701 - DNA, 20 bp, Artificial Sequence
  chemically synthesized
acacagatgacatggttgat

SEQ ID NO: 316702 - DNA, 20 bp, Artificial Sequence
  chemically synthesized
aacacagatgacatggttga

SEQ ID NO: 316703 - DNA, 20 bp, Artificial Sequence
  chemically synthesized
acacagtaacacagatgaca

SEQ ID NO: 316704 - DNA, 20 bp, Artificial Sequence
  chemically synthesized
agtacctatacacagtaaca

SEQ ID NO: 316705 - DNA, 20 bp, Artificial Sequence
  chemically synthesized
gtcatctgtgttactgtgta

SEQ ID NO: 316706 - DNA, 20 bp, Artificial Sequence
  chemically synthesized
tcatctgtgttactgtgtat

SEQ ID NO: 316707 - DNA, 20 bp, Artificial Sequence
  chemically synthesized
ctgtgtatagtacctataca

SEQ ID NO: 316708 - DNA, 20 bp, Artificial Sequence
  chemically synthesized
ctgtgtataggtactataca

SEQ ID NO: 316709 - DNA, 20 bp, Artificial Sequence
  chemically synthesized
gtgtataggtactatacaca

SEQ ID NO: 316710 - DNA, 20 bp, Artificial Sequence
  chemically synthesized
tagaaagcaaactctgtgta

SEQ ID NO: 316711 - DNA, 20 bp, Artificial Sequence
  chemically synthesized
tatacacagagtttgctttc

SEQ ID NO: 316712 - DNA, 20 bp, Artificial Sequence
  chemically synthesized
acacagagtttgctttctag

SEQ ID NO: 316713 - DNA, 20 bp, Artificial Sequence
  chemically synthesized
gttgcgtgctttctactaga

SEQ ID NO: 316714 - DNA, 20 bp, Artificial Sequence
  chemically synthesized
agagtttgctttctagtaga

SEQ ID NO: 316715 - DNA, 20 bp, Artificial Sequence
  chemically synthesized
ttatgttgcgtgctttctac

SEQ ID NO: 316716 - DNA, 20 bp, Artificial Sequence
  chemically synthesized
tagtagaaagcacgcaacat

SEQ ID NO: 316717 - DNA, 20 bp, Artificial Sequence
  chemically synthesized
caagtacaacaacataaggt

SEQ ID NO: 316718 - DNA, 20 bp, Artificial Sequence
  chemically synthesized
ccaagtacaacaacataagg

SEQ ID NO: 316719 - DNA, 20 bp, Artificial Sequence
  chemically synthesized
acgccaagtacaacaacata

SEQ ID NO: 316720 - DNA, 20 bp, Artificial Sequence
  chemically synthesized
aacgccaagtacaacaacat

SEQ ID NO: 316721 - DNA, 20 bp, Artificial Sequence
  chemically synthesized
ctaccttatgttgttgtact

SEQ ID NO: 316722 - DNA, 20 bp, Artificial Sequence
  chemically synthesized
tgttgttgtacttggcgttt

SEQ ID NO: 316723 - DNA, 20 bp, Artificial Sequence
  chemically synthesized
tcttgaagacctaaaacgcc

SEQ ID NO: 316724 - DNA, 20 bp, Artificial Sequence
  chemically synthesized
gttgttgtacttggcgtttt

SEQ ID NO: 316725 - DNA, 20 bp, Artificial Sequence
  chemically synthesized
acttggcgttttaggtcttc

SEQ ID NO: 316726 - DNA, 20 bp, Artificial Sequence
  chemically synthesized
gcgttttaggtcttcaagat

SEQ ID NO: 316727 - DNA, 20 bp, Artificial Sequence
  chemically synthesized
cgttttaggtcttcaagatc

SEQ ID NO: 316728 - DNA, 20 bp, Artificial Sequence
  chemically synthesized
gcctcttggacctgatcttg

SEQ ID NO: 316729 - DNA, 20 bp, Artificial Sequence
  chemically synthesized
aggtcttcaagatcaggtcc

SEQ ID NO: 316730 - DNA, 20 bp, Artificial Sequence
  chemically synthesized
gtcttcaagatcaggtccaa

SEQ ID NO: 316731 - DNA, 20 bp, Artificial Sequence
  chemically synthesized
tcttcaagatcaggtccaag

SEQ ID NO: 316732 - DNA, 20 bp, Artificial Sequence
  chemically synthesized
aaaatggaggaagagcctct

SEQ ID NO: 316733 - DNA, 20 bp, Artificial Sequence
  chemically synthesized
gaacaaggaaaatggaggaa

SEQ ID NO: 316734 - DNA, 20 bp, Artificial Sequence
  chemically synthesized
aagaacaaggaaaatggagg

SEQ ID NO: 316735 - DNA, 20 bp, Artificial Sequence
  chemically synthesized
agaaagaacaaggaaaatgg

SEQ ID NO: 316736 - DNA, 20 bp, Artificial Sequence
  chemically synthesized
aagaaagaacaaggaaaatg

SEQ ID NO: 316737 - DNA, 20 bp, Artificial Sequence
  chemically synthesized
agaagaaagaacaaggaaaa

SEQ ID NO: 316738 - DNA, 20 bp, Artificial Sequence
  chemically synthesized
caaaaacagaagaaagaaca

SEQ ID NO: 316739 - DNA, 20 bp, Artificial Sequence
  chemically synthesized
acaaaaacagaagaaagaac

SEQ ID NO: 316740 - DNA, 20 bp, Artificial Sequence
  chemically synthesized
tggctaacaaaaacagaaga

SEQ ID NO: 316741 - DNA, 20 bp, Artificial Sequence
  chemically synthesized
tgactggctaacaaaaacag

SEQ ID NO: 316742 - DNA, 20 bp, Artificial Sequence
  chemically synthesized
gttctttcttctgtttttgt

SEQ ID NO: 316743 - DNA, 20 bp, Artificial Sequence
  chemically synthesized
gaatgactggctaacaaaaa

SEQ ID NO: 316744 - DNA, 20 bp, Artificial Sequence
  chemically synthesized
tttcttctgtttttgttagc

SEQ ID NO: 316745 - DNA, 20 bp, Artificial Sequence
  chemically synthesized
aactgaaagagttgaatgac

SEQ ID NO: 316746 - DNA, 20 bp, Artificial Sequence
  chemically synthesized
agccagtcattcaactcttt

SEQ ID NO: 316747 - DNA, 20 bp, Artificial Sequence
  chemically synthesized
tccagaatcagaaactgaaa

SEQ ID NO: 316748 - DNA, 20 bp, Artificial Sequence
  chemically synthesized
tctccagaatcagaaactga

SEQ ID NO: 316749 - DNA, 20 bp, Artificial Sequence
  chemically synthesized
actctttcagtttctgattc

SEQ ID NO: 316750 - DNA, 20 bp, Artificial Sequence
  chemically synthesized
tctttcagtttctgattctg

SEQ ID NO: 316751 - DNA, 20 bp, Artificial Sequence
  chemically synthesized
ttttaatggatctccagaat

SEQ ID NO: 316752 - DNA, 20 bp, Artificial Sequence
  chemically synthesized
atagagttttaatggatctc

SEQ ID NO: 316753 - DNA, 20 bp, Artificial Sequence
  chemically synthesized
cagtttacatagagttttaa

SEQ ID NO: 316754 - DNA, 20 bp, Artificial Sequence
  chemically synthesized
tcaaattttcagtttacata

SEQ ID NO: 316755 - DNA, 20 bp, Artificial Sequence
  chemically synthesized
tttcaaattttcagtttaca

SEQ ID NO: 316756 - DNA, 20 bp, Artificial Sequence
  chemically synthesized
ataggcttctttcaaatttt

SEQ ID NO: 316757 - DNA, 20 bp, Artificial Sequence
  chemically synthesized
tatgtaaactgaaaatttga

SEQ ID NO: 316758 - DNA, 20 bp, Artificial Sequence
  chemically synthesized
gtaaactgaaaatttgaaag

SEQ ID NO: 316759 - DNA, 20 bp, Artificial Sequence
  chemically synthesized
gctttcaaagaggtcataat

SEQ ID NO: 316760 - DNA, 20 bp, Artificial Sequence
  chemically synthesized
tgctttcaaagaggtcataa

SEQ ID NO: 316761 - DNA, 20 bp, Artificial Sequence
  chemically synthesized
gcctattatgacctctttga

SEQ ID NO: 316762 - DNA, 20 bp, Artificial Sequence
  chemically synthesized
gtaataagttgctttcaaag

SEQ ID NO: 316763 - DNA, 20 bp, Artificial Sequence
  chemically synthesized
agtaataagttgctttcaaa

SEQ ID NO: 316764 - DNA, 20 bp, Artificial Sequence
  chemically synthesized
tcagtaataagttgctttca

SEQ ID NO: 316765 - DNA, 20 bp, Artificial Sequence
  chemically synthesized
acattgtgatgttcagtaat

SEQ ID NO: 316766 - DNA, 20 bp, Artificial Sequence
  chemically synthesized
ttgttttacattgtgatgtt

SEQ ID NO: 316767 - DNA, 20 bp, Artificial Sequence
  chemically synthesized
aacatcacaatgtaaaacaa

SEQ ID NO: 316768 - DNA, 20 bp, Artificial Sequence
  chemically synthesized
acaatagaatttataatata

SEQ ID NO: 316769 - DNA, 20 bp, Artificial Sequence
  chemically synthesized
atatatggaatgttcgcatt

SEQ ID NO: 316770 - DNA, 20 bp, Artificial Sequence
  chemically synthesized
tatatggaatgttcgcattt

SEQ ID NO: 316771 - DNA, 20 bp, Artificial Sequence
  chemically synthesized
atatggaatgttcgcatttg

SEQ ID NO: 316772 - DNA, 20 bp, Artificial Sequence
  chemically synthesized
tatggaatgttcgcatttgg

SEQ ID NO: 316773 - DNA, 20 bp, Artificial Sequence
  chemically synthesized
tcgcatttgggggcatctat

SEQ ID NO: 316774 - DNA, 20 bp, Artificial Sequence
  chemically synthesized
acatccttctcaatgtccaa

SEQ ID NO: 316775 - DNA, 20 bp, Artificial Sequence
  chemically synthesized
gggggcatctattggacatt

SEQ ID NO: 316776 - DNA, 20 bp, Artificial Sequence
  chemically synthesized
ggcatctattggacattgag

SEQ ID NO: 316777 - DNA, 20 bp, Artificial Sequence
  chemically synthesized
gcatctattggacattgaga

SEQ ID NO: 316778 - DNA, 20 bp, Artificial Sequence
  chemically synthesized
ttggacattgagaaggatgt

SEQ ID NO: 316779 - DNA, 20 bp, Artificial Sequence
  chemically synthesized
cattgagaaggatgtaagta

SEQ ID NO: 316780 - DNA, 20 bp, Artificial Sequence
  chemically synthesized
atgtaagtaaagcccactat

SEQ ID NO: 316781 - DNA, 20 bp, Artificial Sequence
  chemically synthesized
gttccggggtgactgatagt

SEQ ID NO: 316782 - DNA, 20 bp, Artificial Sequence
  chemically synthesized
agttccggggtgactgatag

SEQ ID NO: 316783 - DNA, 20 bp, Artificial Sequence
  chemically synthesized
aatagttccggggtgactga

SEQ ID NO: 316784 - DNA, 20 bp, Artificial Sequence
  chemically synthesized
aagcccactatcagtcaccc

SEQ ID NO: 316785 - DNA, 20 bp, Artificial Sequence
  chemically synthesized
tctgagaaataatagttccg

SEQ ID NO: 316786 - DNA, 20 bp, Artificial Sequence
  chemically synthesized
gtctgagaaataatagttcc

SEQ ID NO: 316787 - DNA, 20 bp, Artificial Sequence
  chemically synthesized
agtctgagaaataatagttc

SEQ ID NO: 316788 - DNA, 20 bp, Artificial Sequence
  chemically synthesized
attataagtctgagaaataa

SEQ ID NO: 316789 - DNA, 20 bp, Artificial Sequence
  chemically synthesized
accccggaactattatttct

SEQ ID NO: 316790 - DNA, 20 bp, Artificial Sequence
  chemically synthesized
ttgtgaactattataagtct

SEQ ID NO: 316791 - DNA, 20 bp, Artificial Sequence
  chemically synthesized
attatttctcagacttataa

SEQ ID NO: 316792 - DNA, 20 bp, Artificial Sequence
  chemically synthesized
caggatttgtgaactattat

SEQ ID NO: 316793 - DNA, 20 bp, Artificial Sequence
  chemically synthesized
tgtgaaagtttttagaaatc

SEQ ID NO: 316794 - DNA, 20 bp, Artificial Sequence
  chemically synthesized
atgtgaaagtttttagaaat

SEQ ID NO: 316795 - DNA, 20 bp, Artificial Sequence
  chemically synthesized
gttgactatgtgaaagtttt

SEQ ID NO: 316796 - DNA, 20 bp, Artificial Sequence
  chemically synthesized
gatttctaaaaactttcaca

SEQ ID NO: 316797 - DNA, 20 bp, Artificial Sequence
  chemically synthesized
acatttagttgactatgtga

SEQ ID NO: 316798 - DNA, 20 bp, Artificial Sequence
  chemically synthesized
tcagttagcatgttcacatt

SEQ ID NO: 316799 - DNA, 20 bp, Artificial Sequence
  chemically synthesized
aaatgtgaacatgctaactg

SEQ ID NO: 316800 - DNA, 20 bp, Artificial Sequence
  chemically synthesized
cagatgctttgcacttcagt

SEQ ID NO: 316801 - DNA, 20 bp, Artificial Sequence
  chemically synthesized
aacatgctaactgaagtgca

SEQ ID NO: 316802 - DNA, 20 bp, Artificial Sequence
  chemically synthesized
ttatcagatgctttgcactt

SEQ ID NO: 316803 - DNA, 20 bp, Artificial Sequence
  chemically synthesized
tatactacttagtcaattat

SEQ ID NO: 316804 - DNA, 20 bp, Artificial Sequence
  chemically synthesized
aaagcatctgataattgact

SEQ ID NO: 316805 - DNA, 20 bp, Artificial Sequence
  chemically synthesized
gcatctgataattgactaag

SEQ ID NO: 316806 - DNA, 20 bp, Artificial Sequence
  chemically synthesized
aactgccaaaatatactact

SEQ ID NO: 316807 - DNA, 20 bp, Artificial Sequence
  chemically synthesized
attgactaagtagtatattt

SEQ ID NO: 316808 - DNA, 20 bp, Artificial Sequence
  chemically synthesized
gactaagtagtatattttgg

SEQ ID NO: 316809 - DNA, 20 bp, Artificial Sequence
  chemically synthesized
tcgtttacattctcattatt

SEQ ID NO: 316810 - DNA, 20 bp, Artificial Sequence
  chemically synthesized
caccacacatactaaataat

SEQ ID NO: 316811 - DNA, 20 bp, Artificial Sequence
  chemically synthesized
ttctcattatttagtatgtg

SEQ ID NO: 316812 - DNA, 20 bp, Artificial Sequence
  chemically synthesized
tcattatttagtatgtgtgg

SEQ ID NO: 316813 - DNA, 20 bp, Artificial Sequence
  chemically synthesized
tttagtatgtgtggtggtta

SEQ ID NO: 316814 - DNA, 20 bp, Artificial Sequence
  chemically synthesized
gtatgtgtggtggttaaaga

SEQ ID NO: 316815 - DNA, 20 bp, Artificial Sequence
  chemically synthesized
gaaaagtgacaaagaatttg

SEQ ID NO: 316816 - DNA, 20 bp, Artificial Sequence
  chemically synthesized
tcttgaagggaaaagtgaca

SEQ ID NO: 316817 - DNA, 20 bp, Artificial Sequence
  chemically synthesized
acctcatctcttgaagggaa

SEQ ID NO: 316818 - DNA, 20 bp, Artificial Sequence
  chemically synthesized
tctttgtcacttttcccttc

SEQ ID NO: 316819 - DNA, 20 bp, Artificial Sequence
  chemically synthesized
tttgtcacttttcccttcaa

SEQ ID NO: 316820 - DNA, 20 bp, Artificial Sequence
  chemically synthesized
aatagacctcatctcttgaa

SEQ ID NO: 316821 - DNA, 20 bp, Artificial Sequence
  chemically synthesized
aaatagacctcatctcttga

SEQ ID NO: 316822 - DNA, 20 bp, Artificial Sequence
  chemically synthesized
aaaatagacctcatctcttg

SEQ ID NO: 316823 - DNA, 20 bp, Artificial Sequence
  chemically synthesized
cacttttcccttcaagagat

SEQ ID NO: 316824 - DNA, 20 bp, Artificial Sequence
  chemically synthesized
acttttcccttcaagagatg

SEQ ID NO: 316825 - DNA, 20 bp, Artificial Sequence
  chemically synthesized
atattcacagggatggaaaa

SEQ ID NO: 316826 - DNA, 20 bp, Artificial Sequence
  chemically synthesized
ccagatcatattcacaggga

SEQ ID NO: 316827 - DNA, 20 bp, Artificial Sequence
  chemically synthesized
aagtccagatcatattcaca

SEQ ID NO: 316828 - DNA, 20 bp, Artificial Sequence
  chemically synthesized
caagtccagatcatattcac

SEQ ID NO: 316829 - DNA, 20 bp, Artificial Sequence
  chemically synthesized
acaagtccagatcatattca

SEQ ID NO: 316830 - DNA, 20 bp, Artificial Sequence
  chemically synthesized
ccatccctgtgaatatgatc

SEQ ID NO: 316831 - DNA, 20 bp, Artificial Sequence
  chemically synthesized
caaaaaaaaaaacacaagtc

SEQ ID NO: 316832 - DNA, 20 bp, Artificial Sequence
  chemically synthesized
gtggtcaaaaaaaaaaacac

SEQ ID NO: 316833 - DNA, 20 bp, Artificial Sequence
  chemically synthesized
tgtgtttttttttttgacca

SEQ ID NO: 316834 - DNA, 20 bp, Artificial Sequence
  chemically synthesized
ttttttttgaccacagaatg

SEQ ID NO: 316835 - DNA, 20 bp, Artificial Sequence
  chemically synthesized
gtcagttatgccacattctg

SEQ ID NO: 316836 - DNA, 20 bp, Artificial Sequence
  chemically synthesized
acttggaattggtgtggtgt

SEQ ID NO: 316837 - DNA, 20 bp, Artificial Sequence
  chemically synthesized
gcctacacttggaattggtg

SEQ ID NO: 316838 - DNA, 20 bp, Artificial Sequence
  chemically synthesized
actgacaccacaccaattcc

SEQ ID NO: 316839 - DNA, 20 bp, Artificial Sequence
  chemically synthesized
ttatagcctacacttggaat

SEQ ID NO: 316840 - DNA, 20 bp, Artificial Sequence
  chemically synthesized
caccacaccaattccaagtg

SEQ ID NO: 316841 - DNA, 20 bp, Artificial Sequence
  chemically synthesized
accacaccaattccaagtgt

SEQ ID NO: 316842 - DNA, 20 bp, Artificial Sequence
  chemically synthesized
gttcttttatagcctacact

SEQ ID NO: 316843 - DNA, 20 bp, Artificial Sequence
  chemically synthesized
attccaagtgtaggctataa

SEQ ID NO: 316844 - DNA, 20 bp, Artificial Sequence
  chemically synthesized
aaatgctgccagttctttta

SEQ ID NO: 316845 - DNA, 20 bp, Artificial Sequence
  chemically synthesized
agtgtaggctataaaagaac

SEQ ID NO: 316846 - DNA, 20 bp, Artificial Sequence
  chemically synthesized
gtaggctataaaagaactgg

SEQ ID NO: 316847 - DNA, 20 bp, Artificial Sequence
  chemically synthesized
ggaagaaatacaaatgctgc

SEQ ID NO: 316848 - DNA, 20 bp, Artificial Sequence
  chemically synthesized
aatctaggcttcaagagagg

SEQ ID NO: 316849 - DNA, 20 bp, Artificial Sequence
  chemically synthesized
ttgtatttcttcctctcttg

SEQ ID NO: 316850 - DNA, 20 bp, Artificial Sequence
  chemically synthesized
tggaatctaggcttcaagag

SEQ ID NO: 316851 - DNA, 20 bp, Artificial Sequence
  chemically synthesized
atggaatctaggcttcaaga

SEQ ID NO: 316852 - DNA, 20 bp, Artificial Sequence
  chemically synthesized
gcatggaatctaggcttcaa

SEQ ID NO: 316853 - DNA, 20 bp, Artificial Sequence
  chemically synthesized
tttcttcctctcttgaagcc

SEQ ID NO: 316854 - DNA, 20 bp, Artificial Sequence
  chemically synthesized
cagcatggaatctaggcttc

SEQ ID NO: 316855 - DNA, 20 bp, Artificial Sequence
  chemically synthesized
tcctttacagcatggaatct

SEQ ID NO: 316856 - DNA, 20 bp, Artificial Sequence
  chemically synthesized
ctcctttacagcatggaatc

SEQ ID NO: 316857 - DNA, 20 bp, Artificial Sequence
  chemically synthesized
agcctagattccatgctgta

SEQ ID NO: 316858 - DNA, 20 bp, Artificial Sequence
  chemically synthesized
gcctggcctcctttacagca

SEQ ID NO: 316859 - DNA, 20 bp, Artificial Sequence
  chemically synthesized
gcctagattccatgctgtaa

SEQ ID NO: 316860 - DNA, 20 bp, Artificial Sequence
  chemically synthesized
ctagattccatgctgtaaag

SEQ ID NO: 316861 - DNA, 20 bp, Artificial Sequence
  chemically synthesized
tagattccatgctgtaaagg

SEQ ID NO: 316862 - DNA, 20 bp, Artificial Sequence
  chemically synthesized
gtgtagcctggcctccttta

SEQ ID NO: 316863 - DNA, 20 bp, Artificial Sequence
  chemically synthesized
ttccatgctgtaaaggaggc

SEQ ID NO: 316864 - DNA, 20 bp, Artificial Sequence
  chemically synthesized
tccatgctgtaaaggaggcc

SEQ ID NO: 316865 - DNA, 20 bp, Artificial Sequence
  chemically synthesized
aatgattcggtagtgtagcc

SEQ ID NO: 316866 - DNA, 20 bp, Artificial Sequence
  chemically synthesized
tctctaatgattcggtagtg

SEQ ID NO: 316867 - DNA, 20 bp, Artificial Sequence
  chemically synthesized
tatggtctctaatgattcgg

SEQ ID NO: 316868 - DNA, 20 bp, Artificial Sequence
  chemically synthesized
aggctacactaccgaatcat

SEQ ID NO: 316869 - DNA, 20 bp, Artificial Sequence
  chemically synthesized
ctatatggtctctaatgatt

SEQ ID NO: 316870 - DNA, 20 bp, Artificial Sequence
  chemically synthesized
gctacactaccgaatcatta

SEQ ID NO: 316871 - DNA, 20 bp, Artificial Sequence
  chemically synthesized
ccgaatcattagagaccata

SEQ ID NO: 316872 - DNA, 20 bp, Artificial Sequence
  chemically synthesized
cgaatcattagagaccatat

SEQ ID NO: 316873 - DNA, 20 bp, Artificial Sequence
  chemically synthesized
aatcattagagaccatatag

SEQ ID NO: 316874 - DNA, 20 bp, Artificial Sequence
  chemically synthesized
cctgcagaatcactcctata

SEQ ID NO: 316875 - DNA, 20 bp, Artificial Sequence
  chemically synthesized
accatataggagtgattctg

SEQ ID NO: 316876 - DNA, 20 bp, Artificial Sequence
  chemically synthesized
ccatataggagtgattctgc

SEQ ID NO: 316877 - DNA, 20 bp, Artificial Sequence
  chemically synthesized
taatacagtattttatcctg

SEQ ID NO: 316878 - DNA, 20 bp, Artificial Sequence
  chemically synthesized
tgcaggataaaatactgtat

SEQ ID NO: 316879 - DNA, 20 bp, Artificial Sequence
  chemically synthesized
aggataaaatactgtattag

SEQ ID NO: 316880 - DNA, 20 bp, Artificial Sequence
  chemically synthesized
ctggaagctcacttctaata

SEQ ID NO: 316881 - DNA, 20 bp, Artificial Sequence
  chemically synthesized
taaaatactgtattagaagt

SEQ ID NO: 316882 - DNA, 20 bp, Artificial Sequence
  chemically synthesized
ctgtattagaagtgagcttc

SEQ ID NO: 316883 - DNA, 20 bp, Artificial Sequence
  chemically synthesized
ttagaagtgagcttccagct

SEQ ID NO: 316884 - DNA, 20 bp, Artificial Sequence
  chemically synthesized
cttgggctgtgctgagctgg

SEQ ID NO: 316885 - DNA, 20 bp, Artificial Sequence
  chemically synthesized
ccccttgggctgtgctgagc

SEQ ID NO: 316886 - DNA, 20 bp, Artificial Sequence
  chemically synthesized
agtgagcttccagctcagca

SEQ ID NO: 316887 - DNA, 20 bp, Artificial Sequence
  chemically synthesized
gtcaccccttgggctgtgct

SEQ ID NO: 316888 - DNA, 20 bp, Artificial Sequence
  chemically synthesized
cttccagctcagcacagccc

SEQ ID NO: 316889 - DNA, 20 bp, Artificial Sequence
  chemically synthesized
ttccagctcagcacagccca

SEQ ID NO: 316890 - DNA, 20 bp, Artificial Sequence
  chemically synthesized
tccagctcagcacagcccaa

SEQ ID NO: 316891 - DNA, 20 bp, Artificial Sequence
  chemically synthesized
ccagctcagcacagcccaag

SEQ ID NO: 316892 - DNA, 20 bp, Artificial Sequence
  chemically synthesized
atagctgggggtcacccctt

SEQ ID NO: 316893 - DNA, 20 bp, Artificial Sequence
  chemically synthesized
tatagctgggggtcacccct

SEQ ID NO: 316894 - DNA, 20 bp, Artificial Sequence
  chemically synthesized
acagcccaaggggtgacccc

SEQ ID NO: 316895 - DNA, 20 bp, Artificial Sequence
  chemically synthesized
attactagttttatagctgg

SEQ ID NO: 316896 - DNA, 20 bp, Artificial Sequence
  chemically synthesized
tattactagttttatagctg

SEQ ID NO: 316897 - DNA, 20 bp, Artificial Sequence
  chemically synthesized
atattactagttttatagct

SEQ ID NO: 316898 - DNA, 20 bp, Artificial Sequence
  chemically synthesized
tatattactagttttatagc

SEQ ID NO: 316899 - DNA, 20 bp, Artificial Sequence
  chemically synthesized
gtgacccccagctataaaac

SEQ ID NO: 316900 - DNA, 20 bp, Artificial Sequence
  chemically synthesized
tttttatattactagtttta

SEQ ID NO: 316901 - DNA, 20 bp, Artificial Sequence
  chemically synthesized
ccaggttgtttttatattac

SEQ ID NO: 316902 - DNA, 20 bp, Artificial Sequence
  chemically synthesized
ctagtaatataaaaacaacc

SEQ ID NO: 316903 - DNA, 20 bp, Artificial Sequence
  chemically synthesized
aatataaaaacaacctggct

SEQ ID NO: 316904 - DNA, 20 bp, Artificial Sequence
  chemically synthesized
aatataagcagggctcagcc

SEQ ID NO: 316905 - DNA, 20 bp, Artificial Sequence
  chemically synthesized
gaatataagcagggctcagc

SEQ ID NO: 316906 - DNA, 20 bp, Artificial Sequence
  chemically synthesized
ccgagaatataagcagggct

SEQ ID NO: 316907 - DNA, 20 bp, Artificial Sequence
  chemically synthesized
gaagaccgagaatataagca

SEQ ID NO: 316908 - DNA, 20 bp, Artificial Sequence
  chemically synthesized
tgaagaccgagaatataagc

SEQ ID NO: 316909 - DNA, 20 bp, Artificial Sequence
  chemically synthesized
ctgaagaccgagaatataag

SEQ ID NO: 316910 - DNA, 20 bp, Artificial Sequence
  chemically synthesized
ctgagccctgcttatattct

SEQ ID NO: 316911 - DNA, 20 bp, Artificial Sequence
  chemically synthesized
gatctgaagaccgagaatat

SEQ ID NO: 316912 - DNA, 20 bp, Artificial Sequence
  chemically synthesized
ctgcttatattctcggtctt

SEQ ID NO: 316913 - DNA, 20 bp, Artificial Sequence
  chemically synthesized
tgcgtcatgatctgaagacc

SEQ ID NO: 316914 - DNA, 20 bp, Artificial Sequence
  chemically synthesized
tataattgcgtcatgatctg

SEQ ID NO: 316915 - DNA, 20 bp, Artificial Sequence
  chemically synthesized
ataaattgttttaacccatt

SEQ ID NO: 316916 - DNA, 20 bp, Artificial Sequence
  chemically synthesized
aaatgacgtccaaacttaat

SEQ ID NO: 316917 - DNA, 20 bp, Artificial Sequence
  chemically synthesized
ttgttttaacccattaagtt

SEQ ID NO: 316918 - DNA, 20 bp, Artificial Sequence
  chemically synthesized
caaatgacgtccaaacttaa

SEQ ID NO: 316919 - DNA, 20 bp, Artificial Sequence
  chemically synthesized
cgtcatttgatacacacaaa

SEQ ID NO: 316920 - DNA, 20 bp, Artificial Sequence
  chemically synthesized
tttgatacacacaaatagac

SEQ ID NO: 316921 - DNA, 20 bp, Artificial Sequence
  chemically synthesized
tgatacacacaaatagacta

SEQ ID NO: 316922 - DNA, 20 bp, Artificial Sequence
  chemically synthesized
acacacaaatagactagaga

SEQ ID NO: 316923 - DNA, 20 bp, Artificial Sequence
  chemically synthesized
cacacaaatagactagagaa

SEQ ID NO: 316924 - DNA, 20 bp, Artificial Sequence
  chemically synthesized
acacaaatagactagagaaa

SEQ ID NO: 316925 - DNA, 20 bp, Artificial Sequence
  chemically synthesized
gggaaaaagcaccctttctc

SEQ ID NO: 316926 - DNA, 20 bp, Artificial Sequence
  chemically synthesized
tctatatctttgtggggaaa

SEQ ID NO: 316927 - DNA, 20 bp, Artificial Sequence
  chemically synthesized
aagggtgctttttccccaca

SEQ ID NO: 316928 - DNA, 20 bp, Artificial Sequence
  chemically synthesized
ctattttctatatctttgtg

SEQ ID NO: 316929 - DNA, 20 bp, Artificial Sequence
  chemically synthesized
actattttctatatctttgt

SEQ ID NO: 316930 - DNA, 20 bp, Artificial Sequence
  chemically synthesized
cactattttctatatctttg

SEQ ID NO: 316931 - DNA, 20 bp, Artificial Sequence
  chemically synthesized
gctttttccccacaaagata

SEQ ID NO: 316932 - DNA, 20 bp, Artificial Sequence
  chemically synthesized
ccccacaaagatatagaaaa

SEQ ID NO: 316933 - DNA, 20 bp, Artificial Sequence
  chemically synthesized
cacaaagatatagaaaatag

SEQ ID NO: 316934 - DNA, 20 bp, Artificial Sequence
  chemically synthesized
acaaagatatagaaaatagt

SEQ ID NO: 316935 - DNA, 20 bp, Artificial Sequence
  chemically synthesized
agatatagaaaatagtgggc

SEQ ID NO: 316936 - DNA, 20 bp, Artificial Sequence
  chemically synthesized
gatatagaaaatagtgggct

SEQ ID NO: 316937 - DNA, 20 bp, Artificial Sequence
  chemically synthesized
tggactttaaattcattacc

SEQ ID NO: 316938 - DNA, 20 bp, Artificial Sequence
  chemically synthesized
tgggctgggtaatgaattta

SEQ ID NO: 316939 - DNA, 20 bp, Artificial Sequence
  chemically synthesized
ggtaatgaatttaaagtcca

SEQ ID NO: 316940 - DNA, 20 bp, Artificial Sequence
  chemically synthesized
gtaatgaatttaaagtccaa

SEQ ID NO: 316941 - DNA, 20 bp, Artificial Sequence
  chemically synthesized
gaatttaaagtccaaaggcc

SEQ ID NO: 316942 - DNA, 20 bp, Artificial Sequence
  chemically synthesized
aatttaaagtccaaaggcct

SEQ ID NO: 316943 - DNA, 20 bp, Artificial Sequence
  chemically synthesized
gggctgtgaacctaggcctt

SEQ ID NO: 316944 - DNA, 20 bp, Artificial Sequence
  chemically synthesized
agtccaaaggcctaggttca

SEQ ID NO: 316945 - DNA, 20 bp, Artificial Sequence
  chemically synthesized
taccgctgggctgtgaacct

SEQ ID NO: 316946 - DNA, 20 bp, Artificial Sequence
  chemically synthesized
ttaccgctgggctgtgaacc

SEQ ID NO: 316947 - DNA, 20 bp, Artificial Sequence
  chemically synthesized
aaaggcctaggttcacagcc

SEQ ID NO: 316948 - DNA, 20 bp, Artificial Sequence
  chemically synthesized
ggcctaggttcacagcccag

SEQ ID NO: 316949 - DNA, 20 bp, Artificial Sequence
  chemically synthesized
taggttcacagcccagcggt

SEQ ID NO: 316950 - DNA, 20 bp, Artificial Sequence
  chemically synthesized
tggttgtagagcttaccgct

SEQ ID NO: 316951 - DNA, 20 bp, Artificial Sequence
  chemically synthesized
ctggttgtagagcttaccgc

SEQ ID NO: 316952 - DNA, 20 bp, Artificial Sequence
  chemically synthesized
ccagcggtaagctctacaac

SEQ ID NO: 316953 - DNA, 20 bp, Artificial Sequence
  chemically synthesized
cagcggtaagctctacaacc

SEQ ID NO: 316954 - DNA, 20 bp, Artificial Sequence
  chemically synthesized
cgtttaagaacctggttgta

SEQ ID NO: 316955 - DNA, 20 bp, Artificial Sequence
  chemically synthesized
aacgtttaagaacctggttg

SEQ ID NO: 316956 - DNA, 20 bp, Artificial Sequence
  chemically synthesized
attgagaacgtttaagaacc

SEQ ID NO: 316957 - DNA, 20 bp, Artificial Sequence
  chemically synthesized
aaatgtaattgagaacgttt

SEQ ID NO: 316958 - DNA, 20 bp, Artificial Sequence
  chemically synthesized
ctgatgctggaaatgtaatt

SEQ ID NO: 316959 - DNA, 20 bp, Artificial Sequence
  chemically synthesized
aacgttctcaattacatttc

SEQ ID NO: 316960 - DNA, 20 bp, Artificial Sequence
  chemically synthesized
ctcaattacatttccagcat

SEQ ID NO: 316961 - DNA, 20 bp, Artificial Sequence
  chemically synthesized
tcaattacatttccagcatc

SEQ ID NO: 316962 - DNA, 20 bp, Artificial Sequence
  chemically synthesized
caattacatttccagcatca

SEQ ID NO: 316963 - DNA, 20 bp, Artificial Sequence
  chemically synthesized
ttatcccatgtccctgatgc

SEQ ID NO: 316964 - DNA, 20 bp, Artificial Sequence
  chemically synthesized
catttccagcatcagggaca

SEQ ID NO: 316965 - DNA, 20 bp, Artificial Sequence
  chemically synthesized
atttccagcatcagggacat

SEQ ID NO: 316966 - DNA, 20 bp, Artificial Sequence
  chemically synthesized
cataaagttgtgtaattaat

SEQ ID NO: 316967 - DNA, 20 bp, Artificial Sequence
  chemically synthesized
acataaagttgtgtaattaa

SEQ ID NO: 316968 - DNA, 20 bp, Artificial Sequence
  chemically synthesized
taattacacaactttatgtt

SEQ ID NO: 316969 - DNA, 20 bp, Artificial Sequence
  chemically synthesized
aattacacaactttatgttg

SEQ ID NO: 316970 - DNA, 20 bp, Artificial Sequence
  chemically synthesized
gtgttttcatcctcaacata

SEQ ID NO: 316971 - DNA, 20 bp, Artificial Sequence
  chemically synthesized
cattaattcaaccaaaattt

SEQ ID NO: 316972 - DNA, 20 bp, Artificial Sequence
  chemically synthesized
ctcatttgcatctcaaattt

SEQ ID NO: 316973 - DNA, 20 bp, Artificial Sequence
  chemically synthesized
ccaaaatttgagatgcaaat

SEQ ID NO: 316974 - DNA, 20 bp, Artificial Sequence
  chemically synthesized
aaatttgagatgcaaatgag

SEQ ID NO: 316975 - DNA, 20 bp, Artificial Sequence
  chemically synthesized
atgcaaatgagaagtgctga

SEQ ID NO: 316976 - DNA, 20 bp, Artificial Sequence
  chemically synthesized
atttcctttaaaataaccat

SEQ ID NO: 316977 - DNA, 20 bp, Artificial Sequence
  chemically synthesized
aagtgctgatggttatttta

SEQ ID NO: 316978 - DNA, 20 bp, Artificial Sequence
  chemically synthesized
agtgctgatggttattttaa

SEQ ID NO: 316979 - DNA, 20 bp, Artificial Sequence
  chemically synthesized
ttaaacatgatgtttataaa

SEQ ID NO: 316980 - DNA, 20 bp, Artificial Sequence
  chemically synthesized
ctttaaacatgatgtttata

SEQ ID NO: 316981 - DNA, 20 bp, Artificial Sequence
  chemically synthesized
ctttataaacatcatgttta

SEQ ID NO: 316982 - DNA, 20 bp, Artificial Sequence
  chemically synthesized
taagatcaatgttcagaata

SEQ ID NO: 316983 - DNA, 20 bp, Artificial Sequence
  chemically synthesized
caaattataagatcaatgtt

SEQ ID NO: 316984 - DNA, 20 bp, Artificial Sequence
  chemically synthesized
atattcctaattcaaattat

SEQ ID NO: 316985 - DNA, 20 bp, Artificial Sequence
  chemically synthesized
attgatcttataatttgaat

SEQ ID NO: 316986 - DNA, 20 bp, Artificial Sequence
  chemically synthesized
ttgatcttataatttgaatt

SEQ ID NO: 316987 - DNA, 20 bp, Artificial Sequence
  chemically synthesized
aacttccagtaaagatttta

SEQ ID NO: 316988 - DNA, 20 bp, Artificial Sequence
  chemically synthesized
gaaacttccagtaaagattt

SEQ ID NO: 316989 - DNA, 20 bp, Artificial Sequence
  chemically synthesized
ttttactctaaaatctttac

SEQ ID NO: 316990 - DNA, 20 bp, Artificial Sequence
  chemically synthesized
tactctaaaatctttactgg

SEQ ID NO: 316991 - DNA, 20 bp, Artificial Sequence
  chemically synthesized
attaatggaaacttccagta

SEQ ID NO: 316992 - DNA, 20 bp, Artificial Sequence
  chemically synthesized
tgatgattaatggaaacttc

SEQ ID NO: 316993 - DNA, 20 bp, Artificial Sequence
  chemically synthesized
tgtttaaatgtgatgattaa

SEQ ID NO: 316994 - DNA, 20 bp, Artificial Sequence
  chemically synthesized
tcatcacatttaaacacaca

SEQ ID NO: 316995 - DNA, 20 bp, Artificial Sequence
  chemically synthesized
aaacacacaaagtgcacaca

SEQ ID NO: 316996 - DNA, 20 bp, Artificial Sequence
  chemically synthesized
cacaaagtgcacacatagct

SEQ ID NO: 316997 - DNA, 20 bp, Artificial Sequence
  chemically synthesized
caaagtgcacacatagctga

SEQ ID NO: 316998 - DNA, 20 bp, Artificial Sequence
  chemically synthesized
aatctgttaaaaaacactct

SEQ ID NO: 316999 - DNA, 20 bp, Artificial Sequence
  chemically synthesized
tagctgagagtgttttttaa

SEQ ID NO: 317000 - DNA, 20 bp, Artificial Sequence
  chemically synthesized
ttttaacagatttaattttt

SEQ ID NO: 317001 - DNA, 20 bp, Artificial Sequence
  chemically synthesized
atttaattttttggctgttt

SEQ ID NO: 317002 - DNA, 20 bp, Artificial Sequence
  chemically synthesized
aatttttcgtgaatctaaaa

SEQ ID NO: 317003 - DNA, 20 bp, Artificial Sequence
  chemically synthesized
tagattcacgaaaaattaat

SEQ ID NO: 317004 - DNA, 20 bp, Artificial Sequence
  chemically synthesized
attaatgagattataataca

SEQ ID NO: 317005 - DNA, 20 bp, Artificial Sequence
  chemically synthesized
taatgagattataatacaaa

SEQ ID NO: 317006 - DNA, 20 bp, Artificial Sequence
  chemically synthesized
gttatcatataacttgcact

SEQ ID NO: 317007 - DNA, 20 bp, Artificial Sequence
  chemically synthesized
taaaacgggagactgagtgc

SEQ ID NO: 317008 - DNA, 20 bp, Artificial Sequence
  chemically synthesized
tgttaataaaacgggagact

SEQ ID NO: 317009 - DNA, 20 bp, Artificial Sequence
  chemically synthesized
ataagatgttaataaaacgg

SEQ ID NO: 317010 - DNA, 20 bp, Artificial Sequence
  chemically synthesized
acataagatgttaataaaac

SEQ ID NO: 317011 - DNA, 20 bp, Artificial Sequence
  chemically synthesized
aacataagatgttaataaaa

SEQ ID NO: 317012 - DNA, 20 bp, Artificial Sequence
  chemically synthesized
gagatgttccataataacat

SEQ ID NO: 317013 - DNA, 20 bp, Artificial Sequence
  chemically synthesized
attaacatcttatgttatta

SEQ ID NO: 317014 - DNA, 20 bp, Artificial Sequence
  chemically synthesized
tattggttcattaattgtaa

SEQ ID NO: 317015 - DNA, 20 bp, Artificial Sequence
  chemically synthesized
aatattggttcattaattgt

SEQ ID NO: 317016 - DNA, 20 bp, Artificial Sequence
  chemically synthesized
tccagctaatgcacaaatat

SEQ ID NO: 317017 - DNA, 20 bp, Artificial Sequence
  chemically synthesized
atgaaccaatatttgtgcat

SEQ ID NO: 317018 - DNA, 20 bp, Artificial Sequence
  chemically synthesized
accaatatttgtgcattagc

SEQ ID NO: 317019 - DNA, 20 bp, Artificial Sequence
  chemically synthesized
caatatttgtgcattagctg

SEQ ID NO: 317020 - DNA, 20 bp, Artificial Sequence
  chemically synthesized
cagaatataataatagtctc

SEQ ID NO: 317021 - DNA, 20 bp, Artificial Sequence
  chemically synthesized
aggaaatcagaatataataa

SEQ ID NO: 317022 - DNA, 20 bp, Artificial Sequence
  chemically synthesized
aaaaaatagtttaaggaaat

SEQ ID NO: 317023 - DNA, 20 bp, Artificial Sequence
  chemically synthesized
gaaatacaaaaaatagttta

SEQ ID NO: 317024 - DNA, 20 bp, Artificial Sequence
  chemically synthesized
tgaaatacaaaaaatagttt

SEQ ID NO: 317025 - DNA, 20 bp, Artificial Sequence
  chemically synthesized
agatactgaaatacaaaaaa

SEQ ID NO: 317026 - DNA, 20 bp, Artificial Sequence
  chemically synthesized
ttaaactattttttgtattt

SEQ ID NO: 317027 - DNA, 20 bp, Artificial Sequence
  chemically synthesized
ttgtatttcagtatctctcc

SEQ ID NO: 317028 - DNA, 20 bp, Artificial Sequence
  chemically synthesized
tgtatttcagtatctctcca

SEQ ID NO: 317029 - DNA, 20 bp, Artificial Sequence
  chemically synthesized
tgtaatatggaatccttgga

SEQ ID NO: 317030 - DNA, 20 bp, Artificial Sequence
  chemically synthesized
agtgtaatatggaatccttg

SEQ ID NO: 317031 - DNA, 20 bp, Artificial Sequence
  chemically synthesized
tgagtgtaatatggaatcct

SEQ ID NO: 317032 - DNA, 20 bp, Artificial Sequence
  chemically synthesized
caggacaattgagtgtaata

SEQ ID NO: 317033 - DNA, 20 bp, Artificial Sequence
  chemically synthesized
attaaggaaacaggacaatt

SEQ ID NO: 317034 - DNA, 20 bp, Artificial Sequence
  chemically synthesized
caaaagcagattaaggaaac

SEQ ID NO: 317035 - DNA, 20 bp, Artificial Sequence
  chemically synthesized
ccaaaagcagattaaggaaa

SEQ ID NO: 317036 - DNA, 20 bp, Artificial Sequence
  chemically synthesized
tcatagccaaaagcagatta

SEQ ID NO: 317037 - DNA, 20 bp, Artificial Sequence
  chemically synthesized
gtcatagccaaaagcagatt

SEQ ID NO: 317038 - DNA, 20 bp, Artificial Sequence
  chemically synthesized
ctgtttccttaatctgcttt

SEQ ID NO: 317039 - DNA, 20 bp, Artificial Sequence
  chemically synthesized
gaaactgtcatagccaaaag

SEQ ID NO: 317040 - DNA, 20 bp, Artificial Sequence
  chemically synthesized
tgagaaactgtcatagccaa

SEQ ID NO: 317041 - DNA, 20 bp, Artificial Sequence
  chemically synthesized
taatctgcttttggctatga

SEQ ID NO: 317042 - DNA, 20 bp, Artificial Sequence
  chemically synthesized
aaaattctgagaaactgtca

SEQ ID NO: 317043 - DNA, 20 bp, Artificial Sequence
  chemically synthesized
ttttggctatgacagtttct

SEQ ID NO: 317044 - DNA, 20 bp, Artificial Sequence
  chemically synthesized
aaaactgccagaaaaattct

SEQ ID NO: 317045 - DNA, 20 bp, Artificial Sequence
  chemically synthesized
acagtttctcagaatttttc

SEQ ID NO: 317046 - DNA, 20 bp, Artificial Sequence
  chemically synthesized
gtttctcagaatttttctgg

SEQ ID NO: 317047 - DNA, 20 bp, Artificial Sequence
  chemically synthesized
ccagcacttttaaaaactgc

SEQ ID NO: 317048 - DNA, 20 bp, Artificial Sequence
  chemically synthesized
atttttctggcagtttttaa

SEQ ID NO: 317049 - DNA, 20 bp, Artificial Sequence
  chemically synthesized
ctggcagtttttaaaagtgc

SEQ ID NO: 317050 - DNA, 20 bp, Artificial Sequence
  chemically synthesized
cagtttttaaaagtgctggc

SEQ ID NO: 317051 - DNA, 20 bp, Artificial Sequence
  chemically synthesized
agtttttaaaagtgctggcc

SEQ ID NO: 317052 - DNA, 20 bp, Artificial Sequence
  chemically synthesized
tttaaaagtgctggccaggc

SEQ ID NO: 317053 - DNA, 20 bp, Artificial Sequence
  chemically synthesized
ctacaaaataccagcctggc

SEQ ID NO: 317054 - DNA, 20 bp, Artificial Sequence
  chemically synthesized
catactacaaaataccagcc

SEQ ID NO: 317055 - DNA, 20 bp, Artificial Sequence
  chemically synthesized
agaggcatactacaaaatac

SEQ ID NO: 317056 - DNA, 20 bp, Artificial Sequence
  chemically synthesized
ctggccaggctggtattttg

SEQ ID NO: 317057 - DNA, 20 bp, Artificial Sequence
  chemically synthesized
gtattttgtagtatgcctct

SEQ ID NO: 317058 - DNA, 20 bp, Artificial Sequence
  chemically synthesized
ttttgtagtatgcctctcag

SEQ ID NO: 317059 - DNA, 20 bp, Artificial Sequence
  chemically synthesized
tttgtagtatgcctctcagt

SEQ ID NO: 317060 - DNA, 20 bp, Artificial Sequence
  chemically synthesized
ttgtagtatgcctctcagtg

SEQ ID NO: 317061 - DNA, 20 bp, Artificial Sequence
  chemically synthesized
tcagacaaatccccactgag

SEQ ID NO: 317062 - DNA, 20 bp, Artificial Sequence
  chemically synthesized
atcagacaaatccccactga

SEQ ID NO: 317063 - DNA, 20 bp, Artificial Sequence
  chemically synthesized
aaatcagacaaatccccact

SEQ ID NO: 317064 - DNA, 20 bp, Artificial Sequence
  chemically synthesized
taattatgaggaaaaaaaat

SEQ ID NO: 317065 - DNA, 20 bp, Artificial Sequence
  chemically synthesized
aaaaccccagtttaattatg

SEQ ID NO: 317066 - DNA, 20 bp, Artificial Sequence
  chemically synthesized
aaaaaccccagtttaattat

SEQ ID NO: 317067 - DNA, 20 bp, Artificial Sequence
  chemically synthesized
ttttttcctcataattaaac

SEQ ID NO: 317068 - DNA, 20 bp, Artificial Sequence
  chemically synthesized
tttttcctcataattaaact

SEQ ID NO: 317069 - DNA, 20 bp, Artificial Sequence
  chemically synthesized
ttttcctcataattaaactg

SEQ ID NO: 317070 - DNA, 20 bp, Artificial Sequence
  chemically synthesized
ctgtggtctttcaaaaaccc

SEQ ID NO: 317071 - DNA, 20 bp, Artificial Sequence
  chemically synthesized
aattaaactggggtttttga

SEQ ID NO: 317072 - DNA, 20 bp, Artificial Sequence
  chemically synthesized
ctggggtttttgaaagacca

SEQ ID NO: 317073 - DNA, 20 bp, Artificial Sequence
  chemically synthesized
gggtttttgaaagaccacag

SEQ ID NO: 317074 - DNA, 20 bp, Artificial Sequence
  chemically synthesized
aaaatggcccattacttctg

SEQ ID NO: 317075 - DNA, 20 bp, Artificial Sequence
  chemically synthesized
ttgaaagaccacagaagtaa

SEQ ID NO: 317076 - DNA, 20 bp, Artificial Sequence
  chemically synthesized
tgaaagaccacagaagtaat

SEQ ID NO: 317077 - DNA, 20 bp, Artificial Sequence
  chemically synthesized
cagaagtaatgggccatttt

SEQ ID NO: 317078 - DNA, 20 bp, Artificial Sequence
  chemically synthesized
tttataaaatgtgcttaaaa

SEQ ID NO: 317079 - DNA, 20 bp, Artificial Sequence
  chemically synthesized
cattttaagcacattttata

SEQ ID NO: 317080 - DNA, 20 bp, Artificial Sequence
  chemically synthesized
acattgataagtcacgttga

SEQ ID NO: 317081 - DNA, 20 bp, Artificial Sequence
  chemically synthesized
aacattgataagtcacgttg

SEQ ID NO: 317082 - DNA, 20 bp, Artificial Sequence
  chemically synthesized
taacattgataagtcacgtt

SEQ ID NO: 317083 - DNA, 20 bp, Artificial Sequence
  chemically synthesized
tggtcacatttaacattgat

SEQ ID NO: 317084 - DNA, 20 bp, Artificial Sequence
  chemically synthesized
caatgttaaatgtgaccacc

SEQ ID NO: 317085 - DNA, 20 bp, Artificial Sequence
  chemically synthesized
cacctattactttagccagg

SEQ ID NO: 317086 - DNA, 20 bp, Artificial Sequence
  chemically synthesized
taaatgtgaccacctggcta

SEQ ID NO: 317087 - DNA, 20 bp, Artificial Sequence
  chemically synthesized
tgacacctattactttagcc

SEQ ID NO: 317088 - DNA, 20 bp, Artificial Sequence
  chemically synthesized
atgacacctattactttagc

SEQ ID NO: 317089 - DNA, 20 bp, Artificial Sequence
  chemically synthesized
tgaccacctggctaaagtaa

SEQ ID NO: 317090 - DNA, 20 bp, Artificial Sequence
  chemically synthesized
gaccacctggctaaagtaat

SEQ ID NO: 317091 - DNA, 20 bp, Artificial Sequence
  chemically synthesized
aaacatgacacctattactt

SEQ ID NO: 317092 - DNA, 20 bp, Artificial Sequence
  chemically synthesized
tgtcatgtttatccactata

SEQ ID NO: 317093 - DNA, 20 bp, Artificial Sequence
  chemically synthesized
gggaaagagtaactttatag

SEQ ID NO: 317094 - DNA, 20 bp, Artificial Sequence
  chemically synthesized
agggggaaagagtaacttta

SEQ ID NO: 317095 - DNA, 20 bp, Artificial Sequence
  chemically synthesized
agtgtgaaaagagggggaaa

SEQ ID NO: 317096 - DNA, 20 bp, Artificial Sequence
  chemically synthesized
acagtgtgaaaagaggggga

SEQ ID NO: 317097 - DNA, 20 bp, Artificial Sequence
  chemically synthesized
aaaaacagtgtgaaaagagg

SEQ ID NO: 317098 - DNA, 20 bp, Artificial Sequence
  chemically synthesized
aaaaaacagtgtgaaaagag

SEQ ID NO: 317099 - DNA, 20 bp, Artificial Sequence
  chemically synthesized
taaaaaacagtgtgaaaaga

SEQ ID NO: 317100 - DNA, 20 bp, Artificial Sequence
  chemically synthesized
ttaaaaaacagtgtgaaaag

SEQ ID NO: 317101 - DNA, 20 bp, Artificial Sequence
  chemically synthesized
attaaaaaacagtgtgaaaa

SEQ ID NO: 317102 - DNA, 20 bp, Artificial Sequence
  chemically synthesized
ttattaaaaaacagtgtgaa

SEQ ID NO: 317103 - DNA, 20 bp, Artificial Sequence
  chemically synthesized
gtgactttcttattaaaaaa

SEQ ID NO: 317104 - DNA, 20 bp, Artificial Sequence
  chemically synthesized
ttttcacactgttttttaat

SEQ ID NO: 317105 - DNA, 20 bp, Artificial Sequence
  chemically synthesized
cacactgttttttaataaga

SEQ ID NO: 317106 - DNA, 20 bp, Artificial Sequence
  chemically synthesized
aataagaaagtcactataca

SEQ ID NO: 317107 - DNA, 20 bp, Artificial Sequence
  chemically synthesized
cactccacaggggctgtgta

SEQ ID NO: 317108 - DNA, 20 bp, Artificial Sequence
  chemically synthesized
gtcactatacacagcccctg

SEQ ID NO: 317109 - DNA, 20 bp, Artificial Sequence
  chemically synthesized
cactatacacagcccctgtg

SEQ ID NO: 317110 - DNA, 20 bp, Artificial Sequence
  chemically synthesized
tgtaactccccactccacag

SEQ ID NO: 317111 - DNA, 20 bp, Artificial Sequence
  chemically synthesized
tatacacagcccctgtggag

SEQ ID NO: 317112 - DNA, 20 bp, Artificial Sequence
  chemically synthesized
atgtaactccccactccaca

SEQ ID NO: 317113 - DNA, 20 bp, Artificial Sequence
  chemically synthesized
atacacagcccctgtggagt

SEQ ID NO: 317114 - DNA, 20 bp, Artificial Sequence
  chemically synthesized
aatgtaactccccactccac

SEQ ID NO: 317115 - DNA, 20 bp, Artificial Sequence
  chemically synthesized
tacacagcccctgtggagtg

SEQ ID NO: 317116 - DNA, 20 bp, Artificial Sequence
  chemically synthesized
gaatgtaactccccactcca

SEQ ID NO: 317117 - DNA, 20 bp, Artificial Sequence
  chemically synthesized
cacagcccctgtggagtggg

SEQ ID NO: 317118 - DNA, 20 bp, Artificial Sequence
  chemically synthesized
gagttacattccctctccgt

SEQ ID NO: 317119 - DNA, 20 bp, Artificial Sequence
  chemically synthesized
cttctctgccctcacggaga

SEQ ID NO: 317120 - DNA, 20 bp, Artificial Sequence
  chemically synthesized
agttacattccctctccgtg

SEQ ID NO: 317121 - DNA, 20 bp, Artificial Sequence
  chemically synthesized
acttctctgccctcacggag

SEQ ID NO: 317122 - DNA, 20 bp, Artificial Sequence
  chemically synthesized
gttacattccctctccgtga

SEQ ID NO: 317123 - DNA, 20 bp, Artificial Sequence
  chemically synthesized
aacttctctgccctcacgga

SEQ ID NO: 317124 - DNA, 20 bp, Artificial Sequence
  chemically synthesized
gtaacttctctgccctcacg

SEQ ID NO: 317125 - DNA, 20 bp, Artificial Sequence
  chemically synthesized
acattccctctccgtgaggg

SEQ ID NO: 317126 - DNA, 20 bp, Artificial Sequence
  chemically synthesized
atgtaacttctctgccctca

SEQ ID NO: 317127 - DNA, 20 bp, Artificial Sequence
  chemically synthesized
attccctctccgtgagggca

SEQ ID NO: 317128 - DNA, 20 bp, Artificial Sequence
  chemically synthesized
ccctctccgtgagggcagag

SEQ ID NO: 317129 - DNA, 20 bp, Artificial Sequence
  chemically synthesized
tgagggcagagaagttacat

SEQ ID NO: 317130 - DNA, 20 bp, Artificial Sequence
  chemically synthesized
agagaagttacataagtttt

SEQ ID NO: 317131 - DNA, 20 bp, Artificial Sequence
  chemically synthesized
agaagttacataagtttttg

SEQ ID NO: 317132 - DNA, 20 bp, Artificial Sequence
  chemically synthesized
ttttggagttttttctgcat

SEQ ID NO: 317133 - DNA, 20 bp, Artificial Sequence
  chemically synthesized
ttggagttttttctgcattg

SEQ ID NO: 317134 - DNA, 20 bp, Artificial Sequence
  chemically synthesized
atagagacaaatctccaatg

SEQ ID NO: 317135 - DNA, 20 bp, Artificial Sequence
  chemically synthesized
cataaataaatggaggaata

SEQ ID NO: 317136 - DNA, 20 bp, Artificial Sequence
  chemically synthesized
ttcataaataaatggaggaa

SEQ ID NO: 317137 - DNA, 20 bp, Artificial Sequence
  chemically synthesized
ataatttcataaataaatgg

SEQ ID NO: 317138 - DNA, 20 bp, Artificial Sequence
  chemically synthesized
aataatttcataaataaatg

SEQ ID NO: 317139 - DNA, 20 bp, Artificial Sequence
  chemically synthesized
taaataatttcataaataaa

SEQ ID NO: 317140 - DNA, 20 bp, Artificial Sequence
  chemically synthesized
tatgaaattatttatttaca

SEQ ID NO: 317141 - DNA, 20 bp, Artificial Sequence
  chemically synthesized
aattatttatttacatagca

SEQ ID NO: 317142 - DNA, 20 bp, Artificial Sequence
  chemically synthesized
acatagcatggactcatgta

SEQ ID NO: 317143 - DNA, 20 bp, Artificial Sequence
  chemically synthesized
agtatcaaataactatacat

SEQ ID NO: 317144 - DNA, 20 bp, Artificial Sequence
  chemically synthesized
tgtatagttatttgatactt

SEQ ID NO: 317145 - DNA, 20 bp, Artificial Sequence
  chemically synthesized
gtatagttatttgatacttt

SEQ ID NO: 317146 - DNA, 20 bp, Artificial Sequence
  chemically synthesized
ctagtattggatttagccca

SEQ ID NO: 317147 - DNA, 20 bp, Artificial Sequence
  chemically synthesized
gcaaaaactagtattggatt

SEQ ID NO: 317148 - DNA, 20 bp, Artificial Sequence
  chemically synthesized
ctttgggctaaatccaatac

SEQ ID NO: 317149 - DNA, 20 bp, Artificial Sequence
  chemically synthesized
tccaaagcaaaaactagtat

SEQ ID NO: 317150 - DNA, 20 bp, Artificial Sequence
  chemically synthesized
caaaaatccaaagcaaaaac

SEQ ID NO: 317151 - DNA, 20 bp, Artificial Sequence
  chemically synthesized
tccaatactagtttttgctt

SEQ ID NO: 317152 - DNA, 20 bp, Artificial Sequence
  chemically synthesized
actatttgagcaaaaatcca

SEQ ID NO: 317153 - DNA, 20 bp, Artificial Sequence
  chemically synthesized
gctttggatttttgctcaaa

SEQ ID NO: 317154 - DNA, 20 bp, Artificial Sequence
  chemically synthesized
gtccaaagctggaactattt

SEQ ID NO: 317155 - DNA, 20 bp, Artificial Sequence
  chemically synthesized
gatttttgctcaaatagttc

SEQ ID NO: 317156 - DNA, 20 bp, Artificial Sequence
  chemically synthesized
tgctcaaatagttccagctt

SEQ ID NO: 317157 - DNA, 20 bp, Artificial Sequence
  chemically synthesized
gacttcccaatgtccaaagc

SEQ ID NO: 317158 - DNA, 20 bp, Artificial Sequence
  chemically synthesized
atagttccagctttggacat

SEQ ID NO: 317159 - DNA, 20 bp, Artificial Sequence
  chemically synthesized
aagagacttcccaatgtcca

SEQ ID NO: 317160 - DNA, 20 bp, Artificial Sequence
  chemically synthesized
tagttccagctttggacatt

SEQ ID NO: 317161 - DNA, 20 bp, Artificial Sequence
  chemically synthesized
ttccagctttggacattggg

SEQ ID NO: 317162 - DNA, 20 bp, Artificial Sequence
  chemically synthesized
ttggacattgggaagtctct

SEQ ID NO: 317163 - DNA, 20 bp, Artificial Sequence
  chemically synthesized
acattgggaagtctcttagt

SEQ ID NO: 317164 - DNA, 20 bp, Artificial Sequence
  chemically synthesized
gtgtcaaagaagccaactaa

SEQ ID NO: 317165 - DNA, 20 bp, Artificial Sequence
  chemically synthesized
atgtgtcaaagaagccaact

SEQ ID NO: 317166 - DNA, 20 bp, Artificial Sequence
  chemically synthesized
actgatgggatgtgtcaaag

SEQ ID NO: 317167 - DNA, 20 bp, Artificial Sequence
  chemically synthesized
aacactgatgggatgtgtca

SEQ ID NO: 317168 - DNA, 20 bp, Artificial Sequence
  chemically synthesized
gcttctttgacacatcccat

SEQ ID NO: 317169 - DNA, 20 bp, Artificial Sequence
  chemically synthesized
tctaaacaaaaaacactgat

SEQ ID NO: 317170 - DNA, 20 bp, Artificial Sequence
  chemically synthesized
ctctaaacaaaaaacactga

SEQ ID NO: 317171 - DNA, 20 bp, Artificial Sequence
  chemically synthesized
tcccatcagtgttttttgtt

SEQ ID NO: 317172 - DNA, 20 bp, Artificial Sequence
  chemically synthesized
ccatcagtgttttttgttta

SEQ ID NO: 317173 - DNA, 20 bp, Artificial Sequence
  chemically synthesized
cagtgttttttgtttagagc

SEQ ID NO: 317174 - DNA, 20 bp, Artificial Sequence
  chemically synthesized
ttttgtttagagcgagaccg

SEQ ID NO: 317175 - DNA, 20 bp, Artificial Sequence
  chemically synthesized
ttgtttagagcgagaccgtg

SEQ ID NO: 317176 - DNA, 20 bp, Artificial Sequence
  chemically synthesized
tagagcgagaccgtggagtt

SEQ ID NO: 317177 - DNA, 20 bp, Artificial Sequence
  chemically synthesized
taagaacatgctaaactcca

SEQ ID NO: 317178 - DNA, 20 bp, Artificial Sequence
  chemically synthesized
tttagcatgttcttactatc

SEQ ID NO: 317179 - DNA, 20 bp, Artificial Sequence
  chemically synthesized
atttggtagtgccagatagt

SEQ ID NO: 317180 - DNA, 20 bp, Artificial Sequence
  chemically synthesized
gaacatttggtagtgccaga

SEQ ID NO: 317181 - DNA, 20 bp, Artificial Sequence
  chemically synthesized
cctggaacatttggtagtgc

SEQ ID NO: 317182 - DNA, 20 bp, Artificial Sequence
  chemically synthesized
aatgagcctggaacatttgg

SEQ ID NO: 317183 - DNA, 20 bp, Artificial Sequence
  chemically synthesized
tctggcactaccaaatgttc

SEQ ID NO: 317184 - DNA, 20 bp, Artificial Sequence
  chemically synthesized
gaaaatgagcctggaacatt

SEQ ID NO: 317185 - DNA, 20 bp, Artificial Sequence
  chemically synthesized
ctggcactaccaaatgttcc

SEQ ID NO: 317186 - DNA, 20 bp, Artificial Sequence
  chemically synthesized
gggaatatagaaaatgagcc

SEQ ID NO: 317187 - DNA, 20 bp, Artificial Sequence
  chemically synthesized
ggaaagggaatatagaaaat

SEQ ID NO: 317188 - DNA, 20 bp, Artificial Sequence
  chemically synthesized
taacactaggaaagggaata

SEQ ID NO: 317189 - DNA, 20 bp, Artificial Sequence
  chemically synthesized
attttctatattccctttcc

SEQ ID NO: 317190 - DNA, 20 bp, Artificial Sequence
  chemically synthesized
ctgattctaacactaggaaa

SEQ ID NO: 317191 - DNA, 20 bp, Artificial Sequence
  chemically synthesized
gctgattctaacactaggaa

SEQ ID NO: 317192 - DNA, 20 bp, Artificial Sequence
  chemically synthesized
agctgattctaacactagga

SEQ ID NO: 317193 - DNA, 20 bp, Artificial Sequence
  chemically synthesized
tatattccctttcctagtgt

SEQ ID NO: 317194 - DNA, 20 bp, Artificial Sequence
  chemically synthesized
aaacagctgattctaacact

SEQ ID NO: 317195 - DNA, 20 bp, Artificial Sequence
  chemically synthesized
gaaacagctgattctaacac

SEQ ID NO: 317196 - DNA, 20 bp, Artificial Sequence
  chemically synthesized
ccctttcctagtgttagaat

SEQ ID NO: 317197 - DNA, 20 bp, Artificial Sequence
  chemically synthesized
accagaacactgtggagaaa

SEQ ID NO: 317198 - DNA, 20 bp, Artificial Sequence
  chemically synthesized
tagaatcagctgtttctcca

SEQ ID NO: 317199 - DNA, 20 bp, Artificial Sequence
  chemically synthesized
aaaggaaccagaacactgtg

SEQ ID NO: 317200 - DNA, 20 bp, Artificial Sequence
  chemically synthesized
aaaaaggaaccagaacactg

SEQ ID NO: 317201 - DNA, 20 bp, Artificial Sequence
  chemically synthesized
gctgtttctccacagtgttc

SEQ ID NO: 317202 - DNA, 20 bp, Artificial Sequence
  chemically synthesized
aaaaaaaaaaaaaaaggaac

SEQ ID NO: 317203 - DNA, 20 bp, Artificial Sequence
  chemically synthesized
aaaaaaaaaaaaaaaaaaaa

SEQ ID NO: 317204 - DNA, 20 bp, Artificial Sequence
  chemically synthesized
aaaaaaaaaaaaaaaaaaaa

SEQ ID NO: 317205 - DNA, 20 bp, Artificial Sequence
  chemically synthesized
tttttttttttttttcttta

SEQ ID NO: 317206 - DNA, 20 bp, Artificial Sequence
  chemically synthesized
ggtttcagtaacattcttta

SEQ ID NO: 317207 - DNA, 20 bp, Artificial Sequence
  chemically synthesized
aaagaatgttactgaaaccc

SEQ ID NO: 317208 - DNA, 20 bp, Artificial Sequence
  chemically synthesized
agcaacaggatcttgggttt

SEQ ID NO: 317209 - DNA, 20 bp, Artificial Sequence
  chemically synthesized
atacctagcaacaggatctt

SEQ ID NO: 317210 - DNA, 20 bp, Artificial Sequence
  chemically synthesized
catacctagcaacaggatct

SEQ ID NO: 317211 - DNA, 20 bp, Artificial Sequence
  chemically synthesized
gaaacccaagatcctgttgc

SEQ ID NO: 317212 - DNA, 20 bp, Artificial Sequence
  chemically synthesized
aaacccaagatcctgttgct

SEQ ID NO: 317213 - DNA, 20 bp, Artificial Sequence
  chemically synthesized
caaggagcatacctagcaac

SEQ ID NO: 317214 - DNA, 20 bp, Artificial Sequence
  chemically synthesized
gcaaggagcatacctagcaa

SEQ ID NO: 317215 - DNA, 20 bp, Artificial Sequence
  chemically synthesized
ctagaagcaaggagcatacc

SEQ ID NO: 317216 - DNA, 20 bp, Artificial Sequence
  chemically synthesized
tacaacaccctagaagcaag

SEQ ID NO: 317217 - DNA, 20 bp, Artificial Sequence
  chemically synthesized
ctaggtatgctccttgcttc

SEQ ID NO: 317218 - DNA, 20 bp, Artificial Sequence
  chemically synthesized
taggtatgctccttgcttct

SEQ ID NO: 317219 - DNA, 20 bp, Artificial Sequence
  chemically synthesized
gctacaacaccctagaagca

SEQ ID NO: 317220 - DNA, 20 bp, Artificial Sequence
  chemically synthesized
aggtatgctccttgcttcta

SEQ ID NO: 317221 - DNA, 20 bp, Artificial Sequence
  chemically synthesized
agctacaacaccctagaagc

SEQ ID NO: 317222 - DNA, 20 bp, Artificial Sequence
  chemically synthesized
tgtaagctacaacaccctag

SEQ ID NO: 317223 - DNA, 20 bp, Artificial Sequence
  chemically synthesized
tcctgtaagctacaacaccc

SEQ ID NO: 317224 - DNA, 20 bp, Artificial Sequence
  chemically synthesized
tccttgcttctagggtgttg

SEQ ID NO: 317225 - DNA, 20 bp, Artificial Sequence
  chemically synthesized
ttctagggtgttgtagctta

SEQ ID NO: 317226 - DNA, 20 bp, Artificial Sequence
  chemically synthesized
tctagggtgttgtagcttac

SEQ ID NO: 317227 - DNA, 20 bp, Artificial Sequence
  chemically synthesized
tgtcaacccagaggtcctgt

SEQ ID NO: 317228 - DNA, 20 bp, Artificial Sequence
  chemically synthesized
gttgtagcttacaggacctc

SEQ ID NO: 317229 - DNA, 20 bp, Artificial Sequence
  chemically synthesized
ttgtagcttacaggacctct

SEQ ID NO: 317230 - DNA, 20 bp, Artificial Sequence
  chemically synthesized
acttctttatgtcaacccag

SEQ ID NO: 317231 - DNA, 20 bp, Artificial Sequence
  chemically synthesized
cacttctttatgtcaaccca

SEQ ID NO: 317232 - DNA, 20 bp, Artificial Sequence
  chemically synthesized
tccacttctttatgtcaacc

SEQ ID NO: 317233 - DNA, 20 bp, Artificial Sequence
  chemically synthesized
aggacctctgggttgacata

SEQ ID NO: 317234 - DNA, 20 bp, Artificial Sequence
  chemically synthesized
acctctgggttgacataaag

SEQ ID NO: 317235 - DNA, 20 bp, Artificial Sequence
  chemically synthesized
tctgggttgacataaagaag

SEQ ID NO: 317236 - DNA, 20 bp, Artificial Sequence
  chemically synthesized
acataaagaagtggatgtgt

SEQ ID NO: 317237 - DNA, 20 bp, Artificial Sequence
  chemically synthesized
atatagaagtatttatgggt

SEQ ID NO: 317238 - DNA, 20 bp, Artificial Sequence
  chemically synthesized
ttatatatagaagtatttat

SEQ ID NO: 317239 - DNA, 20 bp, Artificial Sequence
  chemically synthesized
attatatatagaagtattta

SEQ ID NO: 317240 - DNA, 20 bp, Artificial Sequence
  chemically synthesized
gatgagataattatatatag

SEQ ID NO: 317241 - DNA, 20 bp, Artificial Sequence
  chemically synthesized
acagatgagataattatata

SEQ ID NO: 317242 - DNA, 20 bp, Artificial Sequence
  chemically synthesized
aatattaggttaatacagat

SEQ ID NO: 317243 - DNA, 20 bp, Artificial Sequence
  chemically synthesized
aaattaatattaggttaata

SEQ ID NO: 317244 - DNA, 20 bp, Artificial Sequence
  chemically synthesized
gagatggataaattaatatt

SEQ ID NO: 317245 - DNA, 20 bp, Artificial Sequence
  chemically synthesized
agagatggataaattaatat

SEQ ID NO: 317246 - DNA, 20 bp, Artificial Sequence
  chemically synthesized
agtcacaaggtggagagaga

SEQ ID NO: 317247 - DNA, 20 bp, Artificial Sequence
  chemically synthesized
cagaagtcacaaggtggaga

SEQ ID NO: 317248 - DNA, 20 bp, Artificial Sequence
  chemically synthesized
aacagaagtcacaaggtgga

SEQ ID NO: 317249 - DNA, 20 bp, Artificial Sequence
  chemically synthesized
ggaacagaagtcacaaggtg

SEQ ID NO: 317250 - DNA, 20 bp, Artificial Sequence
  chemically synthesized
aaggaacagaagtcacaagg

SEQ ID NO: 317251 - DNA, 20 bp, Artificial Sequence
  chemically synthesized
gataaggaacagaagtcaca

SEQ ID NO: 317252 - DNA, 20 bp, Artificial Sequence
  chemically synthesized
agataaggaacagaagtcac

SEQ ID NO: 317253 - DNA, 20 bp, Artificial Sequence
  chemically synthesized
agttcacagataaggaacag

SEQ ID NO: 317254 - DNA, 20 bp, Artificial Sequence
  chemically synthesized
ggtagttcacagataaggaa

SEQ ID NO: 317255 - DNA, 20 bp, Artificial Sequence
  chemically synthesized
gaagaggtagttcacagata

SEQ ID NO: 317256 - DNA, 20 bp, Artificial Sequence
  chemically synthesized
tgaagaggtagttcacagat

SEQ ID NO: 317257 - DNA, 20 bp, Artificial Sequence
  chemically synthesized
aaagttgaagaggtagttca

SEQ ID NO: 317258 - DNA, 20 bp, Artificial Sequence
  chemically synthesized
tcaaaaaaaagttgaagagg

SEQ ID NO: 317259 - DNA, 20 bp, Artificial Sequence
  chemically synthesized
agttcaaaaaaaagttgaag

SEQ ID NO: 317260 - DNA, 20 bp, Artificial Sequence
  chemically synthesized
tagttcaaaaaaaagttgaa

SEQ ID NO: 317261 - DNA, 20 bp, Artificial Sequence
  chemically synthesized
ggtagttcaaaaaaaagttg

SEQ ID NO: 317262 - DNA, 20 bp, Artificial Sequence
  chemically synthesized
tgaagaggtagttcaaaaaa

SEQ ID NO: 317263 - DNA, 20 bp, Artificial Sequence
  chemically synthesized
aactcaaaatgttgaagagg

SEQ ID NO: 317264 - DNA, 20 bp, Artificial Sequence
  chemically synthesized
tataactcaaaatgttgaag

SEQ ID NO: 317265 - DNA, 20 bp, Artificial Sequence
  chemically synthesized
ttataactcaaaatgttgaa

SEQ ID NO: 317266 - DNA, 20 bp, Artificial Sequence
  chemically synthesized
tcttataactcaaaatgttg

SEQ ID NO: 317267 - DNA, 20 bp, Artificial Sequence
  chemically synthesized
aactacctcttcaacatttt

SEQ ID NO: 317268 - DNA, 20 bp, Artificial Sequence
  chemically synthesized
tcttcaacattttgagttat

SEQ ID NO: 317269 - DNA, 20 bp, Artificial Sequence
  chemically synthesized
agtttaaagaaatcattttt

SEQ ID NO: 317270 - DNA, 20 bp, Artificial Sequence
  chemically synthesized
caaaaatgatttctttaaac

SEQ ID NO: 317271 - DNA, 20 bp, Artificial Sequence
  chemically synthesized
tcatctcaacttctagttta

SEQ ID NO: 317272 - DNA, 20 bp, Artificial Sequence
  chemically synthesized
aaatgatttctttaaactag

SEQ ID NO: 317273 - DNA, 20 bp, Artificial Sequence
  chemically synthesized
atttctttaaactagaagtt

SEQ ID NO: 317274 - DNA, 20 bp, Artificial Sequence
  chemically synthesized
acagcggtcatctcaacttc

SEQ ID NO: 317275 - DNA, 20 bp, Artificial Sequence
  chemically synthesized
gaggagccaaacatgaacag

SEQ ID NO: 317276 - DNA, 20 bp, Artificial Sequence
  chemically synthesized
catgaggagccaaacatgaa

SEQ ID NO: 317277 - DNA, 20 bp, Artificial Sequence
  chemically synthesized
agatgaccgctgttcatgtt

SEQ ID NO: 317278 - DNA, 20 bp, Artificial Sequence
  chemically synthesized
tgtggattcagcagcatgag

SEQ ID NO: 317279 - DNA, 20 bp, Artificial Sequence
  chemically synthesized
tctgtggattcagcagcatg

SEQ ID NO: 317280 - DNA, 20 bp, Artificial Sequence
  chemically synthesized
gtctgtggattcagcagcat

SEQ ID NO: 317281 - DNA, 20 bp, Artificial Sequence
  chemically synthesized
ttctctgtctgtggattcag

SEQ ID NO: 317282 - DNA, 20 bp, Artificial Sequence
  chemically synthesized
tcctcatgctgctgaatcca

SEQ ID NO: 317283 - DNA, 20 bp, Artificial Sequence
  chemically synthesized
cctttctctgtctgtggatt

SEQ ID NO: 317284 - DNA, 20 bp, Artificial Sequence
  chemically synthesized
catgctgctgaatccacaga

SEQ ID NO: 317285 - DNA, 20 bp, Artificial Sequence
  chemically synthesized
tgctgctgaatccacagaca

SEQ ID NO: 317286 - DNA, 20 bp, Artificial Sequence
  chemically synthesized
gtaacccctttctctgtctg

SEQ ID NO: 317287 - DNA, 20 bp, Artificial Sequence
  chemically synthesized
gctgaatccacagacagaga

SEQ ID NO: 317288 - DNA, 20 bp, Artificial Sequence
  chemically synthesized
ctgaatccacagacagagaa

SEQ ID NO: 317289 - DNA, 20 bp, Artificial Sequence
  chemically synthesized
tgaatccacagacagagaaa

SEQ ID NO: 317290 - DNA, 20 bp, Artificial Sequence
  chemically synthesized
gaatccacagacagagaaag

SEQ ID NO: 317291 - DNA, 20 bp, Artificial Sequence
  chemically synthesized
cagagaaaggggttaccata

SEQ ID NO: 317292 - DNA, 20 bp, Artificial Sequence
  chemically synthesized
atttgtgcttaggttctgta

SEQ ID NO: 317293 - DNA, 20 bp, Artificial Sequence
  chemically synthesized
ggggttaccatacagaacct

SEQ ID NO: 317294 - DNA, 20 bp, Artificial Sequence
  chemically synthesized
tcagttgaccatttgtgctt

SEQ ID NO: 317295 - DNA, 20 bp, Artificial Sequence
  chemically synthesized
ctcagttgaccatttgtgct

SEQ ID NO: 317296 - DNA, 20 bp, Artificial Sequence
  chemically synthesized
atacagaacctaagcacaaa

SEQ ID NO: 317297 - DNA, 20 bp, Artificial Sequence
  chemically synthesized
ctaagcacaaatggtcaact

SEQ ID NO: 317298 - DNA, 20 bp, Artificial Sequence
  chemically synthesized
cgcattgtattgggtgaact

SEQ ID NO: 317299 - DNA, 20 bp, Artificial Sequence
  chemically synthesized
tacttgccccgcattgtatt

SEQ ID NO: 317300 - DNA, 20 bp, Artificial Sequence
  chemically synthesized
ctacttgccccgcattgtat

SEQ ID NO: 317301 - DNA, 20 bp, Artificial Sequence
  chemically synthesized
tgagttcacccaatacaatg

SEQ ID NO: 317302 - DNA, 20 bp, Artificial Sequence
  chemically synthesized
gagttcacccaatacaatgc

SEQ ID NO: 317303 - DNA, 20 bp, Artificial Sequence
  chemically synthesized
agttcacccaatacaatgcg

SEQ ID NO: 317304 - DNA, 20 bp, Artificial Sequence
  chemically synthesized
cacccaatacaatgcggggc

SEQ ID NO: 317305 - DNA, 20 bp, Artificial Sequence
  chemically synthesized
ccaatacaatgcggggcaag

SEQ ID NO: 317306 - DNA, 20 bp, Artificial Sequence
  chemically synthesized
cggggcaagtagtactacat

SEQ ID NO: 317307 - DNA, 20 bp, Artificial Sequence
  chemically synthesized
atgcccatagttttctaatg

SEQ ID NO: 317308 - DNA, 20 bp, Artificial Sequence
  chemically synthesized
agtactacattagaaaacta

SEQ ID NO: 317309 - DNA, 20 bp, Artificial Sequence
  chemically synthesized
gtactacattagaaaactat

SEQ ID NO: 317310 - DNA, 20 bp, Artificial Sequence
  chemically synthesized
agactcctggcaaatgccca

SEQ ID NO: 317311 - DNA, 20 bp, Artificial Sequence
  chemically synthesized
agaaaactatgggcatttgc

SEQ ID NO: 317312 - DNA, 20 bp, Artificial Sequence
  chemically synthesized
gaaaactatgggcatttgcc

SEQ ID NO: 317313 - DNA, 20 bp, Artificial Sequence
  chemically synthesized
aaactatgggcatttgccag

SEQ ID NO: 317314 - DNA, 20 bp, Artificial Sequence
  chemically synthesized
tgggtatactaagagactcc

SEQ ID NO: 317315 - DNA, 20 bp, Artificial Sequence
  chemically synthesized
ggcatttgccaggagtctct

SEQ ID NO: 317316 - DNA, 20 bp, Artificial Sequence
  chemically synthesized
atcatatatgggtatactaa

SEQ ID NO: 317317 - DNA, 20 bp, Artificial Sequence
  chemically synthesized
ctatcatatatgggtatact

SEQ ID NO: 317318 - DNA, 20 bp, Artificial Sequence
  chemically synthesized
tggttaacactatcatatat

SEQ ID NO: 317319 - DNA, 20 bp, Artificial Sequence
  chemically synthesized
cttagtatacccatatatga

SEQ ID NO: 317320 - DNA, 20 bp, Artificial Sequence
  chemically synthesized
ttggttaacactatcatata

SEQ ID NO: 317321 - DNA, 20 bp, Artificial Sequence
  chemically synthesized
gtatcttctgttttttttat

SEQ ID NO: 317322 - DNA, 20 bp, Artificial Sequence
  chemically synthesized
gtgttaaccaataaaaaaaa

SEQ ID NO: 317323 - DNA, 20 bp, Artificial Sequence
  chemically synthesized
ttaaccaataaaaaaaacag

SEQ ID NO: 317324 - DNA, 20 bp, Artificial Sequence
  chemically synthesized
ttagtgtttccatattgatc

SEQ ID NO: 317325 - DNA, 20 bp, Artificial Sequence
  chemically synthesized
cagaagatactcgatcaata

SEQ ID NO: 317326 - DNA, 20 bp, Artificial Sequence
  chemically synthesized
atatggaaacactaataata

SEQ ID NO: 317327 - DNA, 20 bp, Artificial Sequence
  chemically synthesized
cttccaaagaaccatattat

SEQ ID NO: 317328 - DNA, 20 bp, Artificial Sequence
  chemically synthesized
acactaataatatggttctt

SEQ ID NO: 317329 - DNA, 20 bp, Artificial Sequence
  chemically synthesized
ctaataatatggttctttgg

SEQ ID NO: 317330 - DNA, 20 bp, Artificial Sequence
  chemically synthesized
taataatatggttctttgga

SEQ ID NO: 317331 - DNA, 20 bp, Artificial Sequence
  chemically synthesized
aaataaaaaacatccttcca

SEQ ID NO: 317332 - DNA, 20 bp, Artificial Sequence
  chemically synthesized
gatgttttttatttcccact

SEQ ID NO: 317333 - DNA, 20 bp, Artificial Sequence
  chemically synthesized
atgttttttatttcccacta

SEQ ID NO: 317334 - DNA, 20 bp, Artificial Sequence
  chemically synthesized
ttgcgtactttgaccttagt

SEQ ID NO: 317335 - DNA, 20 bp, Artificial Sequence
  chemically synthesized
gttgcgtactttgaccttag

SEQ ID NO: 317336 - DNA, 20 bp, Artificial Sequence
  chemically synthesized
tttatttcccactaaggtca

SEQ ID NO: 317337 - DNA, 20 bp, Artificial Sequence
  chemically synthesized
ctagttgcgtactttgacct

SEQ ID NO: 317338 - DNA, 20 bp, Artificial Sequence
  chemically synthesized
ctaaggtcaaagtacgcaac

SEQ ID NO: 317339 - DNA, 20 bp, Artificial Sequence
  chemically synthesized
aggtcaaagtacgcaactag

SEQ ID NO: 317340 - DNA, 20 bp, Artificial Sequence
  chemically synthesized
tactatggcagaatttcttc

SEQ ID NO: 317341 - DNA, 20 bp, Artificial Sequence
  chemically synthesized
aactagaagaaattctgcca

SEQ ID NO: 317342 - DNA, 20 bp, Artificial Sequence
  chemically synthesized
tgctgtcttggttactatgg

SEQ ID NO: 317343 - DNA, 20 bp, Artificial Sequence
  chemically synthesized
caatgctgtcttggttacta

SEQ ID NO: 317344 - DNA, 20 bp, Artificial Sequence
  chemically synthesized
gaaattctgccatagtaacc

SEQ ID NO: 317345 - DNA, 20 bp, Artificial Sequence
  chemically synthesized
ttctgccatagtaaccaaga

SEQ ID NO: 317346 - DNA, 20 bp, Artificial Sequence
  chemically synthesized
atgctaatacaatgctgtct

SEQ ID NO: 317347 - DNA, 20 bp, Artificial Sequence
  chemically synthesized
taaccaagacagcattgtat

SEQ ID NO: 317348 - DNA, 20 bp, Artificial Sequence
  chemically synthesized
gtattagcataaaaactgat

SEQ ID NO: 317349 - DNA, 20 bp, Artificial Sequence
  chemically synthesized
ttagcataaaaactgatcag

SEQ ID NO: 317350 - DNA, 20 bp, Artificial Sequence
  chemically synthesized
ctctattatgttccactgat

SEQ ID NO: 317351 - DNA, 20 bp, Artificial Sequence
  chemically synthesized
aactgatcagtggaacataa

SEQ ID NO: 317352 - DNA, 20 bp, Artificial Sequence
  chemically synthesized
ctgatcagtggaacataata

SEQ ID NO: 317353 - DNA, 20 bp, Artificial Sequence
  chemically synthesized
gtggaacataatagagaacc

SEQ ID NO: 317354 - DNA, 20 bp, Artificial Sequence
  chemically synthesized
tggaacataatagagaaccc

SEQ ID NO: 317355 - DNA, 20 bp, Artificial Sequence
  chemically synthesized
aaatgcattaatttattcct

SEQ ID NO: 317356 - DNA, 20 bp, Artificial Sequence
  chemically synthesized
caaatgcattaatttattcc

SEQ ID NO: 317357 - DNA, 20 bp, Artificial Sequence
  chemically synthesized
catttgcattcaactgattt

SEQ ID NO: 317358 - DNA, 20 bp, Artificial Sequence
  chemically synthesized
ttgacacccatgtccaaaat

SEQ ID NO: 317359 - DNA, 20 bp, Artificial Sequence
  chemically synthesized
cattcaactgattttggaca

SEQ ID NO: 317360 - DNA, 20 bp, Artificial Sequence
  chemically synthesized
attcaactgattttggacat

SEQ ID NO: 317361 - DNA, 20 bp, Artificial Sequence
  chemically synthesized
tgattttggacatgggtgtc

SEQ ID NO: 317362 - DNA, 20 bp, Artificial Sequence
  chemically synthesized
gggtgtcaagaacacaccgt

SEQ ID NO: 317363 - DNA, 20 bp, Artificial Sequence
  chemically synthesized
ggtgtcaagaacacaccgtg

SEQ ID NO: 317364 - DNA, 20 bp, Artificial Sequence
  chemically synthesized
tcaagaacacaccgtgagga

SEQ ID NO: 317365 - DNA, 20 bp, Artificial Sequence
  chemically synthesized
caagaacacaccgtgaggac

SEQ ID NO: 317366 - DNA, 20 bp, Artificial Sequence
  chemically synthesized
aagagggtgtcctgtcctca

SEQ ID NO: 317367 - DNA, 20 bp, Artificial Sequence
  chemically synthesized
tgaggacaggacaccctctt

SEQ ID NO: 317368 - DNA, 20 bp, Artificial Sequence
  chemically synthesized
ctggtagcatttgctgaaga

SEQ ID NO: 317369 - DNA, 20 bp, Artificial Sequence
  chemically synthesized
cctggtagcatttgctgaag

SEQ ID NO: 317370 - DNA, 20 bp, Artificial Sequence
  chemically synthesized
tcctggtagcatttgctgaa

SEQ ID NO: 317371 - DNA, 20 bp, Artificial Sequence
  chemically synthesized
tttcctggtagcatttgctg

SEQ ID NO: 317372 - DNA, 20 bp, Artificial Sequence
  chemically synthesized
ccctcttcagcaaatgctac

SEQ ID NO: 317373 - DNA, 20 bp, Artificial Sequence
  chemically synthesized
cctcttcagcaaatgctacc

SEQ ID NO: 317374 - DNA, 20 bp, Artificial Sequence
  chemically synthesized
tcagcaaatgctaccaggaa

SEQ ID NO: 317375 - DNA, 20 bp, Artificial Sequence
  chemically synthesized
tagattcttacttttcctgg

SEQ ID NO: 317376 - DNA, 20 bp, Artificial Sequence
  chemically synthesized
atgtagattcttacttttcc

SEQ ID NO: 317377 - DNA, 20 bp, Artificial Sequence
  chemically synthesized
caaatgctaccaggaaaagt

SEQ ID NO: 317378 - DNA, 20 bp, Artificial Sequence
  chemically synthesized
gaaaagtaagaatctacatg

SEQ ID NO: 317379 - DNA, 20 bp, Artificial Sequence
  chemically synthesized
aagtaagaatctacatgcag

SEQ ID NO: 317380 - DNA, 20 bp, Artificial Sequence
  chemically synthesized
taatttcattcttctgcatg

SEQ ID NO: 317381 - DNA, 20 bp, Artificial Sequence
  chemically synthesized
tacatgcagaagaatgaaat

SEQ ID NO: 317382 - DNA, 20 bp, Artificial Sequence
  chemically synthesized
ttgtatgtggcaagggataa

SEQ ID NO: 317383 - DNA, 20 bp, Artificial Sequence
  chemically synthesized
tttgtatgtggcaagggata

SEQ ID NO: 317384 - DNA, 20 bp, Artificial Sequence
  chemically synthesized
ttttgtatgtggcaagggat

SEQ ID NO: 317385 - DNA, 20 bp, Artificial Sequence
  chemically synthesized
ttggtttttgtatgtggcaa

SEQ ID NO: 317386 - DNA, 20 bp, Artificial Sequence
  chemically synthesized
attggtttttgtatgtggca

SEQ ID NO: 317387 - DNA, 20 bp, Artificial Sequence
  chemically synthesized
aattggtttttgtatgtggc

SEQ ID NO: 317388 - DNA, 20 bp, Artificial Sequence
  chemically synthesized
ttcaaattggtttttgtatg

SEQ ID NO: 317389 - DNA, 20 bp, Artificial Sequence
  chemically synthesized
gtttttaatccatttcaaat

SEQ ID NO: 317390 - DNA, 20 bp, Artificial Sequence
  chemically synthesized
atacaaaaaccaatttgaaa

SEQ ID NO: 317391 - DNA, 20 bp, Artificial Sequence
  chemically synthesized
tggattaaaaacttaaattt

SEQ ID NO: 317392 - DNA, 20 bp, Artificial Sequence
  chemically synthesized
gagttttgagtcttaaattt

SEQ ID NO: 317393 - DNA, 20 bp, Artificial Sequence
  chemically synthesized
actaatagattgagagtttt

SEQ ID NO: 317394 - DNA, 20 bp, Artificial Sequence
  chemically synthesized
gttttctactaatagattga

SEQ ID NO: 317395 - DNA, 20 bp, Artificial Sequence
  chemically synthesized
actcaaaactctcaatctat

SEQ ID NO: 317396 - DNA, 20 bp, Artificial Sequence
  chemically synthesized
atgttttctactaatagatt

SEQ ID NO: 317397 - DNA, 20 bp, Artificial Sequence
  chemically synthesized
caaaactctcaatctattag

SEQ ID NO: 317398 - DNA, 20 bp, Artificial Sequence
  chemically synthesized
tcctctatgttttctactaa

SEQ ID NO: 317399 - DNA, 20 bp, Artificial Sequence
  chemically synthesized
caatctattagtagaaaaca

SEQ ID NO: 317400 - DNA, 20 bp, Artificial Sequence
  chemically synthesized
atctattagtagaaaacata

SEQ ID NO: 317401 - DNA, 20 bp, Artificial Sequence
  chemically synthesized
tctattagtagaaaacatag

SEQ ID NO: 317402 - DNA, 20 bp, Artificial Sequence
  chemically synthesized
tagtagaaaacatagaggac

SEQ ID NO: 317403 - DNA, 20 bp, Artificial Sequence
  chemically synthesized
ttgcccaaataattgtgatg

SEQ ID NO: 317404 - DNA, 20 bp, Artificial Sequence
  chemically synthesized
caagcttcatcacaattatt

SEQ ID NO: 317405 - DNA, 20 bp, Artificial Sequence
  chemically synthesized
aagcttcatcacaattattt

SEQ ID NO: 317406 - DNA, 20 bp, Artificial Sequence
  chemically synthesized
gcttttacagtcatattcaa

SEQ ID NO: 317407 - DNA, 20 bp, Artificial Sequence
  chemically synthesized
acttttgaatatgactgtaa

SEQ ID NO: 317408 - DNA, 20 bp, Artificial Sequence
  chemically synthesized
ttttgttgcttgtgctttta

SEQ ID NO: 317409 - DNA, 20 bp, Artificial Sequence
  chemically synthesized
gaatatgactgtaaaagcac

SEQ ID NO: 317410 - DNA, 20 bp, Artificial Sequence
  chemically synthesized
tgtaaaagcacaagcaacaa

SEQ ID NO: 317411 - DNA, 20 bp, Artificial Sequence
  chemically synthesized
acaagcaacaaaagcaaaaa

SEQ ID NO: 317412 - DNA, 20 bp, Artificial Sequence
  chemically synthesized
aacaaaagcaaaaatagact

SEQ ID NO: 317413 - DNA, 20 bp, Artificial Sequence
  chemically synthesized
acaaaagcaaaaatagactg

SEQ ID NO: 317414 - DNA, 20 bp, Artificial Sequence
  chemically synthesized
tttagtttggtataagtcct

SEQ ID NO: 317415 - DNA, 20 bp, Artificial Sequence
  chemically synthesized
agaaatttttagtttggtat

SEQ ID NO: 317416 - DNA, 20 bp, Artificial Sequence
  chemically synthesized
ctgtgcagaaatttttagtt

SEQ ID NO: 317417 - DNA, 20 bp, Artificial Sequence
  chemically synthesized
ttttgctgtgcagaaatttt

SEQ ID NO: 317418 - DNA, 20 bp, Artificial Sequence
  chemically synthesized
ccaaactaaaaatttctgca

SEQ ID NO: 317419 - DNA, 20 bp, Artificial Sequence
  chemically synthesized
attttaatttttttgctgtg

SEQ ID NO: 317420 - DNA, 20 bp, Artificial Sequence
  chemically synthesized
aaattaaaattaaaaattaa

SEQ ID NO: 317421 - DNA, 20 bp, Artificial Sequence
  chemically synthesized
attaaaattaaaaattaaca

SEQ ID NO: 317422 - DNA, 20 bp, Artificial Sequence
  chemically synthesized
aattaaaaattaacagagta

SEQ ID NO: 317423 - DNA, 20 bp, Artificial Sequence
  chemically synthesized
ttaaaaattaacagagtaaa

SEQ ID NO: 317424 - DNA, 20 bp, Artificial Sequence
  chemically synthesized
cagagtaaagagatatccaa

SEQ ID NO: 317425 - DNA, 20 bp, Artificial Sequence
  chemically synthesized
aaagagatatccaatagaat

SEQ ID NO: 317426 - DNA, 20 bp, Artificial Sequence
  chemically synthesized
aaatatttttctcattctat

SEQ ID NO: 317427 - DNA, 20 bp, Artificial Sequence
  chemically synthesized
atgaacccccatcagatata

SEQ ID NO: 317428 - DNA, 20 bp, Artificial Sequence
  chemically synthesized
tttgcaaactatatatctga

SEQ ID NO: 317429 - DNA, 20 bp, Artificial Sequence
  chemically synthesized
ttgcaaactatatatctgat

SEQ ID NO: 317430 - DNA, 20 bp, Artificial Sequence
  chemically synthesized
tgcaaactatatatctgatg

SEQ ID NO: 317431 - DNA, 20 bp, Artificial Sequence
  chemically synthesized
gcaaactatatatctgatgg

SEQ ID NO: 317432 - DNA, 20 bp, Artificial Sequence
  chemically synthesized
atttttatatgaacccccat

SEQ ID NO: 317433 - DNA, 20 bp, Artificial Sequence
  chemically synthesized
tgggggttcatataaaaata

SEQ ID NO: 317434 - DNA, 20 bp, Artificial Sequence
  chemically synthesized
gggttcatataaaaatatgg

SEQ ID NO: 317435 - DNA, 20 bp, Artificial Sequence
  chemically synthesized
aagaaattcaaccaactcca

SEQ ID NO: 317436 - DNA, 20 bp, Artificial Sequence
  chemically synthesized
ttgttttcttgctatggagt

SEQ ID NO: 317437 - DNA, 20 bp, Artificial Sequence
  chemically synthesized
aattcaaccaactccatagc

SEQ ID NO: 317438 - DNA, 20 bp, Artificial Sequence
  chemically synthesized
ttatttgttttcttgctatg

SEQ ID NO: 317439 - DNA, 20 bp, Artificial Sequence
  chemically synthesized
ggttatttgttttcttgcta

SEQ ID NO: 317440 - DNA, 20 bp, Artificial Sequence
  chemically synthesized
tcttttgcctatttttaatc

SEQ ID NO: 317441 - DNA, 20 bp, Artificial Sequence
  chemically synthesized
gtcttttgcctatttttaat

SEQ ID NO: 317442 - DNA, 20 bp, Artificial Sequence
  chemically synthesized
acaaataacctgattaaaaa

SEQ ID NO: 317443 - DNA, 20 bp, Artificial Sequence
  chemically synthesized
caaataacctgattaaaaat

SEQ ID NO: 317444 - DNA, 20 bp, Artificial Sequence
  chemically synthesized
acctgattaaaaataggcaa

SEQ ID NO: 317445 - DNA, 20 bp, Artificial Sequence
  chemically synthesized
aaataggcaaaagaccaaaa

SEQ ID NO: 317446 - DNA, 20 bp, Artificial Sequence
  chemically synthesized
tttatgataaatgtctattt

SEQ ID NO: 317447 - DNA, 20 bp, Artificial Sequence
  chemically synthesized
aaaatagacatttatcataa

SEQ ID NO: 317448 - DNA, 20 bp, Artificial Sequence
  chemically synthesized
aaatagacatttatcataaa

SEQ ID NO: 317449 - DNA, 20 bp, Artificial Sequence
  chemically synthesized
aatagacatttatcataaaa

SEQ ID NO: 317450 - DNA, 20 bp, Artificial Sequence
  chemically synthesized
tttatcataaaagggacaaa

SEQ ID NO: 317451 - DNA, 20 bp, Artificial Sequence
  chemically synthesized
aaagggacaaatggataaca

SEQ ID NO: 317452 - DNA, 20 bp, Artificial Sequence
  chemically synthesized
agatatgaaaaaatgctcaa

SEQ ID NO: 317453 - DNA, 20 bp, Artificial Sequence
  chemically synthesized
cccagatgattagtgctgtt

SEQ ID NO: 317454 - DNA, 20 bp, Artificial Sequence
  chemically synthesized
gctcaacagcactaatcatc

SEQ ID NO: 317455 - DNA, 20 bp, Artificial Sequence
  chemically synthesized
ctcaacagcactaatcatct

SEQ ID NO: 317456 - DNA, 20 bp, Artificial Sequence
  chemically synthesized
atttgcatttcccagatgat

SEQ ID NO: 317457 - DNA, 20 bp, Artificial Sequence
  chemically synthesized
tggttttaatttgcatttcc

SEQ ID NO: 317458 - DNA, 20 bp, Artificial Sequence
  chemically synthesized
atgcaaattaaaaccacaat

SEQ ID NO: 317459 - DNA, 20 bp, Artificial Sequence
  chemically synthesized
tgcaaattaaaaccacaatg

SEQ ID NO: 317460 - DNA, 20 bp, Artificial Sequence
  chemically synthesized
agtaagctgatacctcattg

SEQ ID NO: 317461 - DNA, 20 bp, Artificial Sequence
  chemically synthesized
ttaaaaccacaatgaggtat

SEQ ID NO: 317462 - DNA, 20 bp, Artificial Sequence
  chemically synthesized
gaggtatcagcttacttgca

SEQ ID NO: 317463 - DNA, 20 bp, Artificial Sequence
  chemically synthesized
gttcccttttctttgcaagt

SEQ ID NO: 317464 - DNA, 20 bp, Artificial Sequence
  chemically synthesized
aagtgttcccttttctttgc

SEQ ID NO: 317465 - DNA, 20 bp, Artificial Sequence
  chemically synthesized
atcagcttacttgcaaagaa

SEQ ID NO: 317466 - DNA, 20 bp, Artificial Sequence
  chemically synthesized
tcagcttacttgcaaagaaa

SEQ ID NO: 317467 - DNA, 20 bp, Artificial Sequence
  chemically synthesized
cagcttacttgcaaagaaaa

SEQ ID NO: 317468 - DNA, 20 bp, Artificial Sequence
  chemically synthesized
cactcccacaaacagtgtat

SEQ ID NO: 317469 - DNA, 20 bp, Artificial Sequence
  chemically synthesized
gaacacttatacactgtttg

SEQ ID NO: 317470 - DNA, 20 bp, Artificial Sequence
  chemically synthesized
aacacttatacactgtttgt

SEQ ID NO: 317471 - DNA, 20 bp, Artificial Sequence
  chemically synthesized
cacttatacactgtttgtgg

SEQ ID NO: 317472 - DNA, 20 bp, Artificial Sequence
  chemically synthesized
ataatttacactcccacaaa

SEQ ID NO: 317473 - DNA, 20 bp, Artificial Sequence
  chemically synthesized
caccacactgttttcaacaa

SEQ ID NO: 317474 - DNA, 20 bp, Artificial Sequence
  chemically synthesized
atttcaactattgttgaaaa

SEQ ID NO: 317475 - DNA, 20 bp, Artificial Sequence
  chemically synthesized
aactattgttgaaaacagtg

SEQ ID NO: 317476 - DNA, 20 bp, Artificial Sequence
  chemically synthesized
aacagtgtggtgattccaca

SEQ ID NO: 317477 - DNA, 20 bp, Artificial Sequence
  chemically synthesized
gttctgttttgaggtctttg

SEQ ID NO: 317478 - DNA, 20 bp, Artificial Sequence
  chemically synthesized
attccacaaagacctcaaaa

SEQ ID NO: 317479 - DNA, 20 bp, Artificial Sequence
  chemically synthesized
ccaatggtagttctgttttg

SEQ ID NO: 317480 - DNA, 20 bp, Artificial Sequence
  chemically synthesized
tccaatggtagttctgtttt

SEQ ID NO: 317481 - DNA, 20 bp, Artificial Sequence
  chemically synthesized
cctcaaaacagaactaccat

SEQ ID NO: 317482 - DNA, 20 bp, Artificial Sequence
  chemically synthesized
aggattgctgggtccaatgg

SEQ ID NO: 317483 - DNA, 20 bp, Artificial Sequence
  chemically synthesized
aacagaactaccattggacc

SEQ ID NO: 317484 - DNA, 20 bp, Artificial Sequence
  chemically synthesized
aataggattgctgggtccaa

SEQ ID NO: 317485 - DNA, 20 bp, Artificial Sequence
  chemically synthesized
tacacaataataggattgct

SEQ ID NO: 317486 - DNA, 20 bp, Artificial Sequence
  chemically synthesized
atacacaataataggattgc

SEQ ID NO: 317487 - DNA, 20 bp, Artificial Sequence
  chemically synthesized
ttaagtgtatacacaataat

SEQ ID NO: 317488 - DNA, 20 bp, Artificial Sequence
  chemically synthesized
tttaagtgtatacacaataa

SEQ ID NO: 317489 - DNA, 20 bp, Artificial Sequence
  chemically synthesized
tattattgtgtatacactta

SEQ ID NO: 317490 - DNA, 20 bp, Artificial Sequence
  chemically synthesized
attattgtgtatacacttaa

SEQ ID NO: 317491 - DNA, 20 bp, Artificial Sequence
  chemically synthesized
agaatgatttatattccttt

SEQ ID NO: 317492 - DNA, 20 bp, Artificial Sequence
  chemically synthesized
atataaatcattctaccaaa

SEQ ID NO: 317493 - DNA, 20 bp, Artificial Sequence
  chemically synthesized
gtgtgcatgtgtctttttgg

SEQ ID NO: 317494 - DNA, 20 bp, Artificial Sequence
  chemically synthesized
tatgtgtgcatgtgtctttt

SEQ ID NO: 317495 - DNA, 20 bp, Artificial Sequence
  chemically synthesized
cacatgcacacatatgttcg

SEQ ID NO: 317496 - DNA, 20 bp, Artificial Sequence
  chemically synthesized
atgcacacatatgttcgtgg

SEQ ID NO: 317497 - DNA, 20 bp, Artificial Sequence
  chemically synthesized
attgtctttgtgattgtgaa

SEQ ID NO: 317498 - DNA, 20 bp, Artificial Sequence
  chemically synthesized
cagcactattcacaatcaca

SEQ ID NO: 317499 - DNA, 20 bp, Artificial Sequence
  chemically synthesized
tttaccactgataagcattt

SEQ ID NO: 317500 - DNA, 20 bp, Artificial Sequence
  chemically synthesized
gtttaccactgataagcatt

SEQ ID NO: 317501 - DNA, 20 bp, Artificial Sequence
  chemically synthesized
caatcaacctaaatgcttat

SEQ ID NO: 317502 - DNA, 20 bp, Artificial Sequence
  chemically synthesized
tcaacctaaatgcttatcag

SEQ ID NO: 317503 - DNA, 20 bp, Artificial Sequence
  chemically synthesized
ttatccagtttaccactgat

SEQ ID NO: 317504 - DNA, 20 bp, Artificial Sequence
  chemically synthesized
aatgcttatcagtggtaaac

SEQ ID NO: 317505 - DNA, 20 bp, Artificial Sequence
  chemically synthesized
tatcagtggtaaactggata

SEQ ID NO: 317506 - DNA, 20 bp, Artificial Sequence
  chemically synthesized
tttaccacattttctttatc

SEQ ID NO: 317507 - DNA, 20 bp, Artificial Sequence
  chemically synthesized
taaactggataaagaaaatg

SEQ ID NO: 317508 - DNA, 20 bp, Artificial Sequence
  chemically synthesized
aatgtggtaaacacatacca

SEQ ID NO: 317509 - DNA, 20 bp, Artificial Sequence
  chemically synthesized
catggccgcatagtattcca

SEQ ID NO: 317510 - DNA, 20 bp, Artificial Sequence
  chemically synthesized
acataccatggaatactatg

SEQ ID NO: 317511 - DNA, 20 bp, Artificial Sequence
  chemically synthesized
tactctttttcatggccgca

SEQ ID NO: 317512 - DNA, 20 bp, Artificial Sequence
  chemically synthesized
aatactatgcggccatgaaa

SEQ ID NO: 317513 - DNA, 20 bp, Artificial Sequence
  chemically synthesized
tactatgcggccatgaaaaa

SEQ ID NO: 317514 - DNA, 20 bp, Artificial Sequence
  chemically synthesized
cataatcttactctttttca

SEQ ID NO: 317515 - DNA, 20 bp, Artificial Sequence
  chemically synthesized
atgcggccatgaaaaagagt

SEQ ID NO: 317516 - DNA, 20 bp, Artificial Sequence
  chemically synthesized
gagtaagattatgttctttg

SEQ ID NO: 317517 - DNA, 20 bp, Artificial Sequence
  chemically synthesized
gcttcatctacgtttctgca

SEQ ID NO: 317518 - DNA, 20 bp, Artificial Sequence
  chemically synthesized
ttatgttctttgcagaaacg

SEQ ID NO: 317519 - DNA, 20 bp, Artificial Sequence
  chemically synthesized
tctttgcagaaacgtagatg

SEQ ID NO: 317520 - DNA, 20 bp, Artificial Sequence
  chemically synthesized
tgcagaaacgtagatgaagc

SEQ ID NO: 317521 - DNA, 20 bp, Artificial Sequence
  chemically synthesized
cagaaacgtagatgaagctg

SEQ ID NO: 317522 - DNA, 20 bp, Artificial Sequence
  chemically synthesized
agaaacgtagatgaagctgg

SEQ ID NO: 317523 - DNA, 20 bp, Artificial Sequence
  chemically synthesized
ttgctaaggataatggcctc

SEQ ID NO: 317524 - DNA, 20 bp, Artificial Sequence
  chemically synthesized
aagctggaggccattatcct

SEQ ID NO: 317525 - DNA, 20 bp, Artificial Sequence
  chemically synthesized
cgttattttgctaaggataa

SEQ ID NO: 317526 - DNA, 20 bp, Artificial Sequence
  chemically synthesized
gtttctgcgttattttgcta

SEQ ID NO: 317527 - DNA, 20 bp, Artificial Sequence
  chemically synthesized
tgtttctgcgttattttgct

SEQ ID NO: 317528 - DNA, 20 bp, Artificial Sequence
  chemically synthesized
ttatccttagcaaaataacg

SEQ ID NO: 317529 - DNA, 20 bp, Artificial Sequence
  chemically synthesized
ttagcaaaataacgcagaaa

SEQ ID NO: 317530 - DNA, 20 bp, Artificial Sequence
  chemically synthesized
aagtgagaacgtggtgtatt

SEQ ID NO: 317531 - DNA, 20 bp, Artificial Sequence
  chemically synthesized
cccacttataagtgagaacg

SEQ ID NO: 317532 - DNA, 20 bp, Artificial Sequence
  chemically synthesized
tacaccacgttctcacttat

SEQ ID NO: 317533 - DNA, 20 bp, Artificial Sequence
  chemically synthesized
tttagctcccacttataagt

SEQ ID NO: 317534 - DNA, 20 bp, Artificial Sequence
  chemically synthesized
accacgttctcacttataag

SEQ ID NO: 317535 - DNA, 20 bp, Artificial Sequence
  chemically synthesized
ccacgttctcacttataagt

SEQ ID NO: 317536 - DNA, 20 bp, Artificial Sequence
  chemically synthesized
atcatttagctcccacttat

SEQ ID NO: 317537 - DNA, 20 bp, Artificial Sequence
  chemically synthesized
acgttctcacttataagtgg

SEQ ID NO: 317538 - DNA, 20 bp, Artificial Sequence
  chemically synthesized
ataagtgggagctaaatgat

SEQ ID NO: 317539 - DNA, 20 bp, Artificial Sequence
  chemically synthesized
gcccatgtgttctcatcatt

SEQ ID NO: 317540 - DNA, 20 bp, Artificial Sequence
  chemically synthesized
agctaaatgatgagaacaca

SEQ ID NO: 317541 - DNA, 20 bp, Artificial Sequence
  chemically synthesized
gctaaatgatgagaacacat

SEQ ID NO: 317542 - DNA, 20 bp, Artificial Sequence
  chemically synthesized
gatgagaacacatgggcaca

SEQ ID NO: 317543 - DNA, 20 bp, Artificial Sequence
  chemically synthesized
tgagaacacatgggcacata

SEQ ID NO: 317544 - DNA, 20 bp, Artificial Sequence
  chemically synthesized
gagaacacatgggcacatag

SEQ ID NO: 317545 - DNA, 20 bp, Artificial Sequence
  chemically synthesized
agaacacatgggcacataga

SEQ ID NO: 317546 - DNA, 20 bp, Artificial Sequence
  chemically synthesized
gggcacatagagggaaacaa

SEQ ID NO: 317547 - DNA, 20 bp, Artificial Sequence
  chemically synthesized
atagagggaaacaacagaca

SEQ ID NO: 317548 - DNA, 20 bp, Artificial Sequence
  chemically synthesized
tagagggaaacaacagacat

SEQ ID NO: 317549 - DNA, 20 bp, Artificial Sequence
  chemically synthesized
agagggaaacaacagacatg

SEQ ID NO: 317550 - DNA, 20 bp, Artificial Sequence
  chemically synthesized
acaacagacatggggcctat

SEQ ID NO: 317551 - DNA, 20 bp, Artificial Sequence
  chemically synthesized
aacagacatggggcctattg

SEQ ID NO: 317552 - DNA, 20 bp, Artificial Sequence
  chemically synthesized
gccaccctccaaactccaat

SEQ ID NO: 317553 - DNA, 20 bp, Artificial Sequence
  chemically synthesized
tgccaccctccaaactccaa

SEQ ID NO: 317554 - DNA, 20 bp, Artificial Sequence
  chemically synthesized
acatggggcctattggagtt

SEQ ID NO: 317555 - DNA, 20 bp, Artificial Sequence
  chemically synthesized
atggggcctattggagtttg

SEQ ID NO: 317556 - DNA, 20 bp, Artificial Sequence
  chemically synthesized
tggggcctattggagtttgg

SEQ ID NO: 317557 - DNA, 20 bp, Artificial Sequence
  chemically synthesized
ggggcctattggagtttgga

SEQ ID NO: 317558 - DNA, 20 bp, Artificial Sequence
  chemically synthesized
gcctattggagtttggaggg

SEQ ID NO: 317559 - DNA, 20 bp, Artificial Sequence
  chemically synthesized
tattggagtttggagggtgg

SEQ ID NO: 317560 - DNA, 20 bp, Artificial Sequence
  chemically synthesized
tggagtttggagggtggcag

SEQ ID NO: 317561 - DNA, 20 bp, Artificial Sequence
  chemically synthesized
ggagtttggagggtggcaga

SEQ ID NO: 317562 - DNA, 20 bp, Artificial Sequence
  chemically synthesized
tttggagggtggcagaagga

SEQ ID NO: 317563 - DNA, 20 bp, Artificial Sequence
  chemically synthesized
gggtggcagaaggaaagaat

SEQ ID NO: 317564 - DNA, 20 bp, Artificial Sequence
  chemically synthesized
ggtggcagaaggaaagaatt

SEQ ID NO: 317565 - DNA, 20 bp, Artificial Sequence
  chemically synthesized
attaggaaaaaataactaat

SEQ ID NO: 317566 - DNA, 20 bp, Artificial Sequence
  chemically synthesized
ggtataagcttagtactcat

SEQ ID NO: 317567 - DNA, 20 bp, Artificial Sequence
  chemically synthesized
aaaaataactaatgagtact

SEQ ID NO: 317568 - DNA, 20 bp, Artificial Sequence
  chemically synthesized
ttcatcaccaggtataagct

SEQ ID NO: 317569 - DNA, 20 bp, Artificial Sequence
  chemically synthesized
atgagtactaagcttatacc

SEQ ID NO: 317570 - DNA, 20 bp, Artificial Sequence
  chemically synthesized
attatttcatcaccaggtat

SEQ ID NO: 317571 - DNA, 20 bp, Artificial Sequence
  chemically synthesized
gtacagattatttcatcacc

SEQ ID NO: 317572 - DNA, 20 bp, Artificial Sequence
  chemically synthesized
tgtacagattatttcatcac

SEQ ID NO: 317573 - DNA, 20 bp, Artificial Sequence
  chemically synthesized
tgtcatggaagtttattgta

SEQ ID NO: 317574 - DNA, 20 bp, Artificial Sequence
  chemically synthesized
tgggtaaacttgtgtcatgg

SEQ ID NO: 317575 - DNA, 20 bp, Artificial Sequence
  chemically synthesized
acaataaacttccatgacac

SEQ ID NO: 317576 - DNA, 20 bp, Artificial Sequence
  chemically synthesized
acatgggtaaacttgtgtca

SEQ ID NO: 317577 - DNA, 20 bp, Artificial Sequence
  chemically synthesized
catgtgcagttttgttacat

SEQ ID NO: 317578 - DNA, 20 bp, Artificial Sequence
  chemically synthesized
acatgtgcagttttgttaca

SEQ ID NO: 317579 - DNA, 20 bp, Artificial Sequence
  chemically synthesized
taggtgcaagggtacatgtg

SEQ ID NO: 317580 - DNA, 20 bp, Artificial Sequence
  chemically synthesized
attttaacttttaggtgcaa

SEQ ID NO: 317581 - DNA, 20 bp, Artificial Sequence
  chemically synthesized
tattttaacttttaggtgca

SEQ ID NO: 317582 - DNA, 20 bp, Artificial Sequence
  chemically synthesized
atattttaacttttaggtgc

SEQ ID NO: 317583 - DNA, 20 bp, Artificial Sequence
  chemically synthesized
acatgtacccttgcacctaa

SEQ ID NO: 317584 - DNA, 20 bp, Artificial Sequence
  chemically synthesized
actattatattttaactttt

SEQ ID NO: 317585 - DNA, 20 bp, Artificial Sequence
  chemically synthesized
tactattatattttaacttt

SEQ ID NO: 317586 - DNA, 20 bp, Artificial Sequence
  chemically synthesized
acctaaaagttaaaatataa

SEQ ID NO: 317587 - DNA, 20 bp, Artificial Sequence
  chemically synthesized
attaacgatatctttgtcaa

SEQ ID NO: 317588 - DNA, 20 bp, Artificial Sequence
  chemically synthesized
tcttcttttttcttttgaca

SEQ ID NO: 317589 - DNA, 20 bp, Artificial Sequence
  chemically synthesized
atatctttgtcaaaagaaaa

SEQ ID NO: 317590 - DNA, 20 bp, Artificial Sequence
  chemically synthesized
tctttgtcaaaagaaaaaag

SEQ ID NO: 317591 - DNA, 20 bp, Artificial Sequence
  chemically synthesized
tttgtcaaaagaaaaaagaa

SEQ ID NO: 317592 - DNA, 20 bp, Artificial Sequence
  chemically synthesized
tagccatgctaacaaaagtg

SEQ ID NO: 317593 - DNA, 20 bp, Artificial Sequence
  chemically synthesized
gtagccatgctaacaaaagt

SEQ ID NO: 317594 - DNA, 20 bp, Artificial Sequence
  chemically synthesized
gattatcacctcacttttgt

SEQ ID NO: 317595 - DNA, 20 bp, Artificial Sequence
  chemically synthesized
gatagtagccatgctaacaa

SEQ ID NO: 317596 - DNA, 20 bp, Artificial Sequence
  chemically synthesized
tcacctcacttttgttagca

SEQ ID NO: 317597 - DNA, 20 bp, Artificial Sequence
  chemically synthesized
tctttttttgttttggatag

SEQ ID NO: 317598 - DNA, 20 bp, Artificial Sequence
  chemically synthesized
ttatctttttttgttttgga

SEQ ID NO: 317599 - DNA, 20 bp, Artificial Sequence
  chemically synthesized
acatttatctttttttgttt

SEQ ID NO: 317600 - DNA, 20 bp, Artificial Sequence
  chemically synthesized
gctactatccaaaacaaaaa

SEQ ID NO: 317601 - DNA, 20 bp, Artificial Sequence
  chemically synthesized
gataaatgttgataacgatt

SEQ ID NO: 317602 - DNA, 20 bp, Artificial Sequence
  chemically synthesized
ataaatgttgataacgattt

SEQ ID NO: 317603 - DNA, 20 bp, Artificial Sequence
  chemically synthesized
gttgataacgatttaggaaa

SEQ ID NO: 317604 - DNA, 20 bp, Artificial Sequence
  chemically synthesized
ttgataacgatttaggaaaa

SEQ ID NO: 317605 - DNA, 20 bp, Artificial Sequence
  chemically synthesized
catgtattacgtacctgcaa

SEQ ID NO: 317606 - DNA, 20 bp, Artificial Sequence
  chemically synthesized
tagtaatttttaacttttgc

SEQ ID NO: 317607 - DNA, 20 bp, Artificial Sequence
  chemically synthesized
ttagtaatttttaacttttg

SEQ ID NO: 317608 - DNA, 20 bp, Artificial Sequence
  chemically synthesized
aaggttttcttttttttaat

SEQ ID NO: 317609 - DNA, 20 bp, Artificial Sequence
  chemically synthesized
aaaaattactaattaaaaaa

SEQ ID NO: 317610 - DNA, 20 bp, Artificial Sequence
  chemically synthesized
ttcccatttacagtgtgtaa

SEQ ID NO: 317611 - DNA, 20 bp, Artificial Sequence
  chemically synthesized
attcccatttacagtgtgta

SEQ ID NO: 317612 - DNA, 20 bp, Artificial Sequence
  chemically synthesized
aaacctttacacactgtaaa

SEQ ID NO: 317613 - DNA, 20 bp, Artificial Sequence
  chemically synthesized
aacctttacacactgtaaat

SEQ ID NO: 317614 - DNA, 20 bp, Artificial Sequence
  chemically synthesized
ctgattgccattcccattta

SEQ ID NO: 317615 - DNA, 20 bp, Artificial Sequence
  chemically synthesized
ttacacactgtaaatgggaa

SEQ ID NO: 317616 - DNA, 20 bp, Artificial Sequence
  chemically synthesized
ctgtaaatgggaatggcaat

SEQ ID NO: 317617 - DNA, 20 bp, Artificial Sequence
  chemically synthesized
aatgggaatggcaatcagta

SEQ ID NO: 317618 - DNA, 20 bp, Artificial Sequence
  chemically synthesized
atgggaatggcaatcagtac

SEQ ID NO: 317619 - DNA, 20 bp, Artificial Sequence
  chemically synthesized
ggcaatcagtacaggcatca

SEQ ID NO: 317620 - DNA, 20 bp, Artificial Sequence
  chemically synthesized
agtacaggcatcatggaaaa

SEQ ID NO: 317621 - DNA, 20 bp, Artificial Sequence
  chemically synthesized
gcatcatggaaaacagtatg

SEQ ID NO: 317622 - DNA, 20 bp, Artificial Sequence
  chemically synthesized
catcatggaaaacagtatga

SEQ ID NO: 317623 - DNA, 20 bp, Artificial Sequence
  chemically synthesized
tttgttgttcatatttcaag

SEQ ID NO: 317624 - DNA, 20 bp, Artificial Sequence
  chemically synthesized
gttttgttgttcatatttca

SEQ ID NO: 317625 - DNA, 20 bp, Artificial Sequence
  chemically synthesized
agttttgttgttcatatttc

SEQ ID NO: 317626 - DNA, 20 bp, Artificial Sequence
  chemically synthesized
tgggattttgtatcatattg

SEQ ID NO: 317627 - DNA, 20 bp, Artificial Sequence
  chemically synthesized
ttgtatatataattcatagt

SEQ ID NO: 317628 - DNA, 20 bp, Artificial Sequence
  chemically synthesized
tttgtatatataattcatag

SEQ ID NO: 317629 - DNA, 20 bp, Artificial Sequence
  chemically synthesized
tcctttgtatatataattca

SEQ ID NO: 317630 - DNA, 20 bp, Artificial Sequence
  chemically synthesized
cactatgaattatatataca

SEQ ID NO: 317631 - DNA, 20 bp, Artificial Sequence
  chemically synthesized
actatgaattatatatacaa

SEQ ID NO: 317632 - DNA, 20 bp, Artificial Sequence
  chemically synthesized
atatacaaaggaaatgaaat

SEQ ID NO: 317633 - DNA, 20 bp, Artificial Sequence
  chemically synthesized
gaaatgaaatcagtatgtca

SEQ ID NO: 317634 - DNA, 20 bp, Artificial Sequence
  chemically synthesized
ctgcaataaaaatggtagtg

SEQ ID NO: 317635 - DNA, 20 bp, Artificial Sequence
  chemically synthesized
tagtgctgcaataaaaatgg

SEQ ID NO: 317636 - DNA, 20 bp, Artificial Sequence
  chemically synthesized
gaatagtgctgcaataaaaa

SEQ ID NO: 317637 - DNA, 20 bp, Artificial Sequence
  chemically synthesized
ctgcactaccatttttattg

SEQ ID NO: 317638 - DNA, 20 bp, Artificial Sequence
  chemically synthesized
ttttattgcagcactattca

SEQ ID NO: 317639 - DNA, 20 bp, Artificial Sequence
  chemically synthesized
ttccatatcttggccatgaa

SEQ ID NO: 317640 - DNA, 20 bp, Artificial Sequence
  chemically synthesized
ttgcagcactattcatggcc

SEQ ID NO: 317641 - DNA, 20 bp, Artificial Sequence
  chemically synthesized
cactattcatggccaagata

SEQ ID NO: 317642 - DNA, 20 bp, Artificial Sequence
  chemically synthesized
tttggattgattccatatct

SEQ ID NO: 317643 - DNA, 20 bp, Artificial Sequence
  chemically synthesized
ttcatatgttggtggatatt

SEQ ID NO: 317644 - DNA, 20 bp, Artificial Sequence
  chemically synthesized
tttatccgttcatatgttgg

SEQ ID NO: 317645 - DNA, 20 bp, Artificial Sequence
  chemically synthesized
ttctttatccgttcatatgt

SEQ ID NO: 317646 - DNA, 20 bp, Artificial Sequence
  chemically synthesized
aatatccaccaacatatgaa

SEQ ID NO: 317647 - DNA, 20 bp, Artificial Sequence
  chemically synthesized
caccaacatatgaacggata

SEQ ID NO: 317648 - DNA, 20 bp, Artificial Sequence
  chemically synthesized
atgaacggataaagaaaatg

SEQ ID NO: 317649 - DNA, 20 bp, Artificial Sequence
  chemically synthesized
tgtggtatacatatatacaa

SEQ ID NO: 317650 - DNA, 20 bp, Artificial Sequence
  chemically synthesized
atatacaatggaatactatt

SEQ ID NO: 317651 - DNA, 20 bp, Artificial Sequence
  chemically synthesized
tattcttttttatggctgaa

SEQ ID NO: 317652 - DNA, 20 bp, Artificial Sequence
  chemically synthesized
aatactattcagccataaaa

SEQ ID NO: 317653 - DNA, 20 bp, Artificial Sequence
  chemically synthesized
cagtattttattctttttta

SEQ ID NO: 317654 - DNA, 20 bp, Artificial Sequence
  chemically synthesized
atccatgttgttgcaaatga

SEQ ID NO: 317655 - DNA, 20 bp, Artificial Sequence
  chemically synthesized
tactgtcatttgcaacaaca

SEQ ID NO: 317656 - DNA, 20 bp, Artificial Sequence
  chemically synthesized
tgcaacaacatggatgaacc

SEQ ID NO: 317657 - DNA, 20 bp, Artificial Sequence
  chemically synthesized
caacaacatggatgaacctg

SEQ ID NO: 317658 - DNA, 20 bp, Artificial Sequence
  chemically synthesized
aacaacatggatgaacctgg

SEQ ID NO: 317659 - DNA, 20 bp, Artificial Sequence
  chemically synthesized
cacttaacataatatcctcc

SEQ ID NO: 317660 - DNA, 20 bp, Artificial Sequence
  chemically synthesized
tcacttaacataatatcctc

SEQ ID NO: 317661 - DNA, 20 bp, Artificial Sequence
  chemically synthesized
aacctggaggatattatgtt

SEQ ID NO: 317662 - DNA, 20 bp, Artificial Sequence
  chemically synthesized
gatattatgttaagtgaaat

SEQ ID NO: 317663 - DNA, 20 bp, Artificial Sequence
  chemically synthesized
ttatgttaagtgaaataagc

SEQ ID NO: 317664 - DNA, 20 bp, Artificial Sequence
  chemically synthesized
ttaagtgaaataagccagta

SEQ ID NO: 317665 - DNA, 20 bp, Artificial Sequence
  chemically synthesized
gtgaaataagccagtaaaga

SEQ ID NO: 317666 - DNA, 20 bp, Artificial Sequence
  chemically synthesized
cagtggttttctttctttac

SEQ ID NO: 317667 - DNA, 20 bp, Artificial Sequence
  chemically synthesized
atataagtgaaattaggcag

SEQ ID NO: 317668 - DNA, 20 bp, Artificial Sequence
  chemically synthesized
cacatataagtgaaattagg

SEQ ID NO: 317669 - DNA, 20 bp, Artificial Sequence
  chemically synthesized
ttccacatataagtgaaatt

SEQ ID NO: 317670 - DNA, 20 bp, Artificial Sequence
  chemically synthesized
attccacatataagtgaaat

SEQ ID NO: 317671 - DNA, 20 bp, Artificial Sequence
  chemically synthesized
tgcctaatttcacttatatg

SEQ ID NO: 317672 - DNA, 20 bp, Artificial Sequence
  chemically synthesized
ctcttttagattccacatat

SEQ ID NO: 317673 - DNA, 20 bp, Artificial Sequence
  chemically synthesized
cacttatatgtggaatctaa

SEQ ID NO: 317674 - DNA, 20 bp, Artificial Sequence
  chemically synthesized
cttatatgtggaatctaaaa

SEQ ID NO: 317675 - DNA, 20 bp, Artificial Sequence
  chemically synthesized
ttctgtgggatcagctcttt

SEQ ID NO: 317676 - DNA, 20 bp, Artificial Sequence
  chemically synthesized
atctaaaagagctgatccca

SEQ ID NO: 317677 - DNA, 20 bp, Artificial Sequence
  chemically synthesized
attccctacttctgtgggat

SEQ ID NO: 317678 - DNA, 20 bp, Artificial Sequence
  chemically synthesized
taaaagagctgatcccacag

SEQ ID NO: 317679 - DNA, 20 bp, Artificial Sequence
  chemically synthesized
aagagctgatcccacagaag

SEQ ID NO: 317680 - DNA, 20 bp, Artificial Sequence
  chemically synthesized
tattcattccctacttctgt

SEQ ID NO: 317681 - DNA, 20 bp, Artificial Sequence
  chemically synthesized
agagctgatcccacagaagt

SEQ ID NO: 317682 - DNA, 20 bp, Artificial Sequence
  chemically synthesized
ctattcattccctacttctg

SEQ ID NO: 317683 - DNA, 20 bp, Artificial Sequence
  chemically synthesized
gagctgatcccacagaagta

SEQ ID NO: 317684 - DNA, 20 bp, Artificial Sequence
  chemically synthesized
ccacagaagtagggaatgaa

SEQ ID NO: 317685 - DNA, 20 bp, Artificial Sequence
  chemically synthesized
cagaagtagggaatgaatag

SEQ ID NO: 317686 - DNA, 20 bp, Artificial Sequence
  chemically synthesized
agggaatgaatagtggttac

SEQ ID NO: 317687 - DNA, 20 bp, Artificial Sequence
  chemically synthesized
ggaatgaatagtggttacca

SEQ ID NO: 317688 - DNA, 20 bp, Artificial Sequence
  chemically synthesized
gaatgaatagtggttaccag

SEQ ID NO: 317689 - DNA, 20 bp, Artificial Sequence
  chemically synthesized
aatagtggttaccagaggct

SEQ ID NO: 317690 - DNA, 20 bp, Artificial Sequence
  chemically synthesized
atagtggttaccagaggctg

SEQ ID NO: 317691 - DNA, 20 bp, Artificial Sequence
  chemically synthesized
cccataaccacctcagcctc

SEQ ID NO: 317692 - DNA, 20 bp, Artificial Sequence
  chemically synthesized
gtggttaccagaggctgagg

SEQ ID NO: 317693 - DNA, 20 bp, Artificial Sequence
  chemically synthesized
ccccttccccataaccacct

SEQ ID NO: 317694 - DNA, 20 bp, Artificial Sequence
  chemically synthesized
accagaggctgaggtggtta

SEQ ID NO: 317695 - DNA, 20 bp, Artificial Sequence
  chemically synthesized
ccagaggctgaggtggttat

SEQ ID NO: 317696 - DNA, 20 bp, Artificial Sequence
  chemically synthesized
cagaggctgaggtggttatg

SEQ ID NO: 317697 - DNA, 20 bp, Artificial Sequence
  chemically synthesized
aggctgaggtggttatgggg

SEQ ID NO: 317698 - DNA, 20 bp, Artificial Sequence
  chemically synthesized
ggctgaggtggttatgggga

SEQ ID NO: 317699 - DNA, 20 bp, Artificial Sequence
  chemically synthesized
gctgaggtggttatggggaa

SEQ ID NO: 317700 - DNA, 20 bp, Artificial Sequence
  chemically synthesized
ctgaggtggttatggggaag

SEQ ID NO: 317701 - DNA, 20 bp, Artificial Sequence
  chemically synthesized
tgaggtggttatggggaagg

SEQ ID NO: 317702 - DNA, 20 bp, Artificial Sequence
  chemically synthesized
aggtggttatggggaagggg

SEQ ID NO: 317703 - DNA, 20 bp, Artificial Sequence
  chemically synthesized
ggtggttatggggaaggggg

SEQ ID NO: 317704 - DNA, 20 bp, Artificial Sequence
  chemically synthesized
ttatggggaagggggaggta

SEQ ID NO: 317705 - DNA, 20 bp, Artificial Sequence
  chemically synthesized
atggggaagggggaggtatg

SEQ ID NO: 317706 - DNA, 20 bp, Artificial Sequence
  chemically synthesized
gaggtatggagatacttttc

SEQ ID NO: 317707 - DNA, 20 bp, Artificial Sequence
  chemically synthesized
aggtatggagatacttttca

SEQ ID NO: 317708 - DNA, 20 bp, Artificial Sequence
  chemically synthesized
ggtatggagatacttttcaa

SEQ ID NO: 317709 - DNA, 20 bp, Artificial Sequence
  chemically synthesized
gtgactatatatcccttgaa

SEQ ID NO: 317710 - DNA, 20 bp, Artificial Sequence
  chemically synthesized
gatacttttcaagggatata

SEQ ID NO: 317711 - DNA, 20 bp, Artificial Sequence
  chemically synthesized
tttcaagggatatatagtca

SEQ ID NO: 317712 - DNA, 20 bp, Artificial Sequence
  chemically synthesized
tagtcacagtcaaaatattc

SEQ ID NO: 317713 - DNA, 20 bp, Artificial Sequence
  chemically synthesized
tattcaagtgatgtatttta

SEQ ID NO: 317714 - DNA, 20 bp, Artificial Sequence
  chemically synthesized
aagtgatgtattttacagca

SEQ ID NO: 317715 - DNA, 20 bp, Artificial Sequence
  chemically synthesized
attttacagcatggtgacta

SEQ ID NO: 317716 - DNA, 20 bp, Artificial Sequence
  chemically synthesized
gagtatattttcattagctg

SEQ ID NO: 317717 - DNA, 20 bp, Artificial Sequence
  chemically synthesized
tttcaagagtatattttcat

SEQ ID NO: 317718 - DNA, 20 bp, Artificial Sequence
  chemically synthesized
tctctctctacatttttcaa

SEQ ID NO: 317719 - DNA, 20 bp, Artificial Sequence
  chemically synthesized
cctctctctctacatttttc

SEQ ID NO: 317720 - DNA, 20 bp, Artificial Sequence
  chemically synthesized
aaatatactcttgaaaaatg

SEQ ID NO: 317721 - DNA, 20 bp, Artificial Sequence
  chemically synthesized
atatactcttgaaaaatgta

SEQ ID NO: 317722 - DNA, 20 bp, Artificial Sequence
  chemically synthesized
atactcttgaaaaatgtaga

SEQ ID NO: 317723 - DNA, 20 bp, Artificial Sequence
  chemically synthesized
actcttgaaaaatgtagaga

SEQ ID NO: 317724 - DNA, 20 bp, Artificial Sequence
  chemically synthesized
tcttgaaaaatgtagagaga

SEQ ID NO: 317725 - DNA, 20 bp, Artificial Sequence
  chemically synthesized
cttgaaaaatgtagagagag

SEQ ID NO: 317726 - DNA, 20 bp, Artificial Sequence
  chemically synthesized
atatttatcatttttatggt

SEQ ID NO: 317727 - DNA, 20 bp, Artificial Sequence
  chemically synthesized
catatttatcatttttatgg

SEQ ID NO: 317728 - DNA, 20 bp, Artificial Sequence
  chemically synthesized
ttacatatttatcattttta

SEQ ID NO: 317729 - DNA, 20 bp, Artificial Sequence
  chemically synthesized
cataaaaatgataaatatgt

SEQ ID NO: 317730 - DNA, 20 bp, Artificial Sequence
  chemically synthesized
ataaaaatgataaatatgta

SEQ ID NO: 317731 - DNA, 20 bp, Artificial Sequence
  chemically synthesized
aaggtaatgcatatgttaat

SEQ ID NO: 317732 - DNA, 20 bp, Artificial Sequence
  chemically synthesized
taatgcatatgttaattagc

SEQ ID NO: 317733 - DNA, 20 bp, Artificial Sequence
  chemically synthesized
tattgtggaacagttgaatc

SEQ ID NO: 317734 - DNA, 20 bp, Artificial Sequence
  chemically synthesized
agtaaatatatattgtggaa

SEQ ID NO: 317735 - DNA, 20 bp, Artificial Sequence
  chemically synthesized
ttctgagtaaatatatattg

SEQ ID NO: 317736 - DNA, 20 bp, Artificial Sequence
  chemically synthesized
ttccacaatatatatttact

SEQ ID NO: 317737 - DNA, 20 bp, Artificial Sequence
  chemically synthesized
cacaatatatatttactcag

SEQ ID NO: 317738 - DNA, 20 bp, Artificial Sequence
  chemically synthesized
atgtacaacgtgatgcttct

SEQ ID NO: 317739 - DNA, 20 bp, Artificial Sequence
  chemically synthesized
taaaccctactttaaattga

SEQ ID NO: 317740 - DNA, 20 bp, Artificial Sequence
  chemically synthesized
caattttatctgtcaattta

SEQ ID NO: 317741 - DNA, 20 bp, Artificial Sequence
  chemically synthesized
ttttatctgtcaatttaaag

SEQ ID NO: 317742 - DNA, 20 bp, Artificial Sequence
  chemically synthesized
tttatctgtcaatttaaagt

SEQ ID NO: 317743 - DNA, 20 bp, Artificial Sequence
  chemically synthesized
ttatctgtcaatttaaagta

SEQ ID NO: 317744 - DNA, 20 bp, Artificial Sequence
  chemically synthesized
aatttaaagtagggtttaaa

SEQ ID NO: 317745 - DNA, 20 bp, Artificial Sequence
  chemically synthesized
agggtttaaaaagcaatgtt

SEQ ID NO: 317746 - DNA, 20 bp, Artificial Sequence
  chemically synthesized
aagcaatgtttagaaattga

SEQ ID NO: 317747 - DNA, 20 bp, Artificial Sequence
  chemically synthesized
tttcaaacaataaaatataa

SEQ ID NO: 317748 - DNA, 20 bp, Artificial Sequence
  chemically synthesized
aaacaataaaatataaaagt

SEQ ID NO: 317749 - DNA, 20 bp, Artificial Sequence
  chemically synthesized
aacaataaaatataaaagtt

SEQ ID NO: 317750 - DNA, 20 bp, Artificial Sequence
  chemically synthesized
atataaaagttgggtctgtt

SEQ ID NO: 317751 - DNA, 20 bp, Artificial Sequence
  chemically synthesized
gcatccacacacacactcaa

SEQ ID NO: 317752 - DNA, 20 bp, Artificial Sequence
  chemically synthesized
gggtctgttgagtgtgtgtg

SEQ ID NO: 317753 - DNA, 20 bp, Artificial Sequence
  chemically synthesized
tctttcctgccaatagtatg

SEQ ID NO: 317754 - DNA, 20 bp, Artificial Sequence
  chemically synthesized
gtgtggatgctgcatactat

SEQ ID NO: 317755 - DNA, 20 bp, Artificial Sequence
  chemically synthesized
tggatgctgcatactattgg

SEQ ID NO: 317756 - DNA, 20 bp, Artificial Sequence
  chemically synthesized
ggatgctgcatactattggc

SEQ ID NO: 317757 - DNA, 20 bp, Artificial Sequence
  chemically synthesized
tgttctatctttcctgccaa

SEQ ID NO: 317758 - DNA, 20 bp, Artificial Sequence
  chemically synthesized
gctgcatactattggcagga

SEQ ID NO: 317759 - DNA, 20 bp, Artificial Sequence
  chemically synthesized
catactattggcaggaaaga

SEQ ID NO: 317760 - DNA, 20 bp, Artificial Sequence
  chemically synthesized
ctactgagcgaaacatattt

SEQ ID NO: 317761 - DNA, 20 bp, Artificial Sequence
  chemically synthesized
acactcaaatatgtttcgct

SEQ ID NO: 317762 - DNA, 20 bp, Artificial Sequence
  chemically synthesized
ctcaaatatgtttcgctcag

SEQ ID NO: 317763 - DNA, 20 bp, Artificial Sequence
  chemically synthesized
aaatgtgtaagtagtctact

SEQ ID NO: 317764 - DNA, 20 bp, Artificial Sequence
  chemically synthesized
ccttcacataaatgtgtaag

SEQ ID NO: 317765 - DNA, 20 bp, Artificial Sequence
  chemically synthesized
gacccttcacataaatgtgt

SEQ ID NO: 317766 - DNA, 20 bp, Artificial Sequence
  chemically synthesized
actacttacacatttatgtg

SEQ ID NO: 317767 - DNA, 20 bp, Artificial Sequence
  chemically synthesized
ctacttacacatttatgtga

SEQ ID NO: 317768 - DNA, 20 bp, Artificial Sequence
  chemically synthesized
tacttacacatttatgtgaa

SEQ ID NO: 317769 - DNA, 20 bp, Artificial Sequence
  chemically synthesized
tacacatttatgtgaagggt

SEQ ID NO: 317770 - DNA, 20 bp, Artificial Sequence
  chemically synthesized
acacatttatgtgaagggtc

SEQ ID NO: 317771 - DNA, 20 bp, Artificial Sequence
  chemically synthesized
cacatttatgtgaagggtcg

SEQ ID NO: 317772 - DNA, 20 bp, Artificial Sequence
  chemically synthesized
acatttatgtgaagggtcgg

SEQ ID NO: 317773 - DNA, 20 bp, Artificial Sequence
  chemically synthesized
gggggaaaaataataaacga

SEQ ID NO: 317774 - DNA, 20 bp, Artificial Sequence
  chemically synthesized
aaaaataataaacgatagtg

SEQ ID NO: 317775 - DNA, 20 bp, Artificial Sequence
  chemically synthesized
aaaataataaacgatagtga

SEQ ID NO: 317776 - DNA, 20 bp, Artificial Sequence
  chemically synthesized
aataataaacgatagtgaag

SEQ ID NO: 317777 - DNA, 20 bp, Artificial Sequence
  chemically synthesized
ataaacgatagtgaaggagc

SEQ ID NO: 317778 - DNA, 20 bp, Artificial Sequence
  chemically synthesized
taaacgatagtgaaggagcc

SEQ ID NO: 317779 - DNA, 20 bp, Artificial Sequence
  chemically synthesized
ttgtctttgttgttaggtcc

SEQ ID NO: 317780 - DNA, 20 bp, Artificial Sequence
  chemically synthesized
ggagccaggacctaacaaca

SEQ ID NO: 317781 - DNA, 20 bp, Artificial Sequence
  chemically synthesized
ggtcagttgtctttgttgtt

SEQ ID NO: 317782 - DNA, 20 bp, Artificial Sequence
  chemically synthesized
aggtcagttgtctttgttgt

SEQ ID NO: 317783 - DNA, 20 bp, Artificial Sequence
  chemically synthesized
aacaacaaagacaactgacc

SEQ ID NO: 317784 - DNA, 20 bp, Artificial Sequence
  chemically synthesized
cagttccggggatgctaggt

SEQ ID NO: 317785 - DNA, 20 bp, Artificial Sequence
  chemically synthesized
cttccagttccggggatgct

SEQ ID NO: 317786 - DNA, 20 bp, Artificial Sequence
  chemically synthesized
gacaactgacctagcatccc

SEQ ID NO: 317787 - DNA, 20 bp, Artificial Sequence
  chemically synthesized
tcttccagttccggggatgc

SEQ ID NO: 317788 - DNA, 20 bp, Artificial Sequence
  chemically synthesized
tgacctagcatccccggaac

SEQ ID NO: 317789 - DNA, 20 bp, Artificial Sequence
  chemically synthesized
ccttttttcttccagttccg

SEQ ID NO: 317790 - DNA, 20 bp, Artificial Sequence
  chemically synthesized
tccttttttcttccagttcc

SEQ ID NO: 317791 - DNA, 20 bp, Artificial Sequence
  chemically synthesized
cctagcatccccggaactgg

SEQ ID NO: 317792 - DNA, 20 bp, Artificial Sequence
  chemically synthesized
ttccttttttcttccagttc

SEQ ID NO: 317793 - DNA, 20 bp, Artificial Sequence
  chemically synthesized
gctctcttccttttttcttc

SEQ ID NO: 317794 - DNA, 20 bp, Artificial Sequence
  chemically synthesized
tccccggaactggaagaaaa

SEQ ID NO: 317795 - DNA, 20 bp, Artificial Sequence
  chemically synthesized
ccccggaactggaagaaaaa

SEQ ID NO: 317796 - DNA, 20 bp, Artificial Sequence
  chemically synthesized
cggaactggaagaaaaaagg

SEQ ID NO: 317797 - DNA, 20 bp, Artificial Sequence
  chemically synthesized
gaactggaagaaaaaaggaa

SEQ ID NO: 317798 - DNA, 20 bp, Artificial Sequence
  chemically synthesized
actggaagaaaaaaggaaga

SEQ ID NO: 317799 - DNA, 20 bp, Artificial Sequence
  chemically synthesized
aaaaggaagagagctgttgc

SEQ ID NO: 317800 - DNA, 20 bp, Artificial Sequence
  chemically synthesized
aaggaagagagctgttgccg

SEQ ID NO: 317801 - DNA, 20 bp, Artificial Sequence
  chemically synthesized
ttctcactgagctccggcaa

SEQ ID NO: 317802 - DNA, 20 bp, Artificial Sequence
  chemically synthesized
agagagctgttgccggagct

SEQ ID NO: 317803 - DNA, 20 bp, Artificial Sequence
  chemically synthesized
ctctaattctcactgagctc

SEQ ID NO: 317804 - DNA, 20 bp, Artificial Sequence
  chemically synthesized
agctgttgccggagctcagt

SEQ ID NO: 317805 - DNA, 20 bp, Artificial Sequence
  chemically synthesized
ccatgtctctaattctcact

SEQ ID NO: 317806 - DNA, 20 bp, Artificial Sequence
  chemically synthesized
tgccggagctcagtgagaat

SEQ ID NO: 317807 - DNA, 20 bp, Artificial Sequence
  chemically synthesized
ccggagctcagtgagaatta

SEQ ID NO: 317808 - DNA, 20 bp, Artificial Sequence
  chemically synthesized
ctcagtgagaattagagaca

SEQ ID NO: 317809 - DNA, 20 bp, Artificial Sequence
  chemically synthesized
gagaattagagacatggaac

SEQ ID NO: 317810 - DNA, 20 bp, Artificial Sequence
  chemically synthesized
gaattagagacatggaacaa

SEQ ID NO: 317811 - DNA, 20 bp, Artificial Sequence
  chemically synthesized
atggaacaagagctgtccaa

SEQ ID NO: 317812 - DNA, 20 bp, Artificial Sequence
  chemically synthesized
aaactacagctactgttgga

SEQ ID NO: 317813 - DNA, 20 bp, Artificial Sequence
  chemically synthesized
gaacaagagctgtccaacag

SEQ ID NO: 317814 - DNA, 20 bp, Artificial Sequence
  chemically synthesized
tcttaaactacagctactgt

SEQ ID NO: 317815 - DNA, 20 bp, Artificial Sequence
  chemically synthesized
gagctgtccaacagtagctg

SEQ ID NO: 317816 - DNA, 20 bp, Artificial Sequence
  chemically synthesized
tccaacagtagctgtagttt

SEQ ID NO: 317817 - DNA, 20 bp, Artificial Sequence
  chemically synthesized
attgtgttcctcttaaacta

SEQ ID NO: 317818 - DNA, 20 bp, Artificial Sequence
  chemically synthesized
caacagtagctgtagtttaa

SEQ ID NO: 317819 - DNA, 20 bp, Artificial Sequence
  chemically synthesized
aacagtagctgtagtttaag

SEQ ID NO: 317820 - DNA, 20 bp, Artificial Sequence
  chemically synthesized
gtttaagaggaacacaattc

SEQ ID NO: 317821 - DNA, 20 bp, Artificial Sequence
  chemically synthesized
gtttcttactgtggagtggc

SEQ ID NO: 317822 - DNA, 20 bp, Artificial Sequence
  chemically synthesized
acacaattccagccactcca

SEQ ID NO: 317823 - DNA, 20 bp, Artificial Sequence
  chemically synthesized
ttctgtttcttactgtggag

SEQ ID NO: 317824 - DNA, 20 bp, Artificial Sequence
  chemically synthesized
aattccagccactccacagt

SEQ ID NO: 317825 - DNA, 20 bp, Artificial Sequence
  chemically synthesized
ctcttctgtttcttactgtg

SEQ ID NO: 317826 - DNA, 20 bp, Artificial Sequence
  chemically synthesized
tcctcttctgtttcttactg

SEQ ID NO: 317827 - DNA, 20 bp, Artificial Sequence
  chemically synthesized
agccactccacagtaagaaa

SEQ ID NO: 317828 - DNA, 20 bp, Artificial Sequence
  chemically synthesized
cactccacagtaagaaacag

SEQ ID NO: 317829 - DNA, 20 bp, Artificial Sequence
  chemically synthesized
ctccacagtaagaaacagaa

SEQ ID NO: 317830 - DNA, 20 bp, Artificial Sequence
  chemically synthesized
tccacagtaagaaacagaag

SEQ ID NO: 317831 - DNA, 20 bp, Artificial Sequence
  chemically synthesized
acagtaagaaacagaagagg

SEQ ID NO: 317832 - DNA, 20 bp, Artificial Sequence
  chemically synthesized
agtaagaaacagaagaggaa

SEQ ID NO: 317833 - DNA, 20 bp, Artificial Sequence
  chemically synthesized
gaaacagaagaggaagagaa

SEQ ID NO: 317834 - DNA, 20 bp, Artificial Sequence
  chemically synthesized
gagggtgaaagcagagattg

SEQ ID NO: 317835 - DNA, 20 bp, Artificial Sequence
  chemically synthesized
ctggcaagagggtgaaagca

SEQ ID NO: 317836 - DNA, 20 bp, Artificial Sequence
  chemically synthesized
cactggcaagagggtgaaag

SEQ ID NO: 317837 - DNA, 20 bp, Artificial Sequence
  chemically synthesized
aggcactggcaagagggtga

SEQ ID NO: 317838 - DNA, 20 bp, Artificial Sequence
  chemically synthesized
ctctgctttcaccctcttgc

SEQ ID NO: 317839 - DNA, 20 bp, Artificial Sequence
  chemically synthesized
aatgggaggcactggcaaga

SEQ ID NO: 317840 - DNA, 20 bp, Artificial Sequence
  chemically synthesized
caatgggaggcactggcaag

SEQ ID NO: 317841 - DNA, 20 bp, Artificial Sequence
  chemically synthesized
ccaatgggaggcactggcaa

SEQ ID NO: 317842 - DNA, 20 bp, Artificial Sequence
  chemically synthesized
agccaatgggaggcactggc

SEQ ID NO: 317843 - DNA, 20 bp, Artificial Sequence
  chemically synthesized
cttcagccaatgggaggcac

SEQ ID NO: 317844 - DNA, 20 bp, Artificial Sequence
  chemically synthesized
ctcttgccagtgcctcccat

SEQ ID NO: 317845 - DNA, 20 bp, Artificial Sequence
  chemically synthesized
aaagtacttcagccaatggg

SEQ ID NO: 317846 - DNA, 20 bp, Artificial Sequence
  chemically synthesized
taaagtacttcagccaatgg

SEQ ID NO: 317847 - DNA, 20 bp, Artificial Sequence
  chemically synthesized
gctaaagtacttcagccaat

SEQ ID NO: 317848 - DNA, 20 bp, Artificial Sequence
  chemically synthesized
ccagtgcctcccattggctg

SEQ ID NO: 317849 - DNA, 20 bp, Artificial Sequence
  chemically synthesized
tgctaaagtacttcagccaa

SEQ ID NO: 317850 - DNA, 20 bp, Artificial Sequence
  chemically synthesized
ctttggttgctaaagtactt

SEQ ID NO: 317851 - DNA, 20 bp, Artificial Sequence
  chemically synthesized
tcccattggctgaagtactt

SEQ ID NO: 317852 - DNA, 20 bp, Artificial Sequence
  chemically synthesized
ctcttggcctttggttgcta

SEQ ID NO: 317853 - DNA, 20 bp, Artificial Sequence
  chemically synthesized
ctgaagtactttagcaacca

SEQ ID NO: 317854 - DNA, 20 bp, Artificial Sequence
  chemically synthesized
tgaagtactttagcaaccaa

SEQ ID NO: 317855 - DNA, 20 bp, Artificial Sequence
  chemically synthesized
tactttagcaaccaaaggcc

SEQ ID NO: 317856 - DNA, 20 bp, Artificial Sequence
  chemically synthesized
cccaggttcctcttggcctt

SEQ ID NO: 317857 - DNA, 20 bp, Artificial Sequence
  chemically synthesized
ctttagcaaccaaaggccaa

SEQ ID NO: 317858 - DNA, 20 bp, Artificial Sequence
  chemically synthesized
tttagcaaccaaaggccaag

SEQ ID NO: 317859 - DNA, 20 bp, Artificial Sequence
  chemically synthesized
tctgttacccaggttcctct

SEQ ID NO: 317860 - DNA, 20 bp, Artificial Sequence
  chemically synthesized
accaaaggccaagaggaacc

SEQ ID NO: 317861 - DNA, 20 bp, Artificial Sequence
  chemically synthesized
ccaaaggccaagaggaacct

SEQ ID NO: 317862 - DNA, 20 bp, Artificial Sequence
  chemically synthesized
gccaagaggaacctgggtaa

SEQ ID NO: 317863 - DNA, 20 bp, Artificial Sequence
  chemically synthesized
gtctagattttctgttaccc

SEQ ID NO: 317864 - DNA, 20 bp, Artificial Sequence
  chemically synthesized
agtctagattttctgttacc

SEQ ID NO: 317865 - DNA, 20 bp, Artificial Sequence
  chemically synthesized
aacctgggtaacagaaaatc

SEQ ID NO: 317866 - DNA, 20 bp, Artificial Sequence
  chemically synthesized
tgttcaaagaggatgaagtc

SEQ ID NO: 317867 - DNA, 20 bp, Artificial Sequence
  chemically synthesized
tgctctgttcaaagaggatg

SEQ ID NO: 317868 - DNA, 20 bp, Artificial Sequence
  chemically synthesized
tagacttcatcctctttgaa

SEQ ID NO: 317869 - DNA, 20 bp, Artificial Sequence
  chemically synthesized
ccttcttgctctgttcaaag

SEQ ID NO: 317870 - DNA, 20 bp, Artificial Sequence
  chemically synthesized
tccttcttgctctgttcaaa

SEQ ID NO: 317871 - DNA, 20 bp, Artificial Sequence
  chemically synthesized
gacttcatcctctttgaaca

SEQ ID NO: 317872 - DNA, 20 bp, Artificial Sequence
  chemically synthesized
tctccttcttgctctgttca

SEQ ID NO: 317873 - DNA, 20 bp, Artificial Sequence
  chemically synthesized
tcatcctctttgaacagagc

SEQ ID NO: 317874 - DNA, 20 bp, Artificial Sequence
  chemically synthesized
tcctctttgaacagagcaag

SEQ ID NO: 317875 - DNA, 20 bp, Artificial Sequence
  chemically synthesized
cctctttgaacagagcaaga

SEQ ID NO: 317876 - DNA, 20 bp, Artificial Sequence
  chemically synthesized
tctttgaacagagcaagaag

SEQ ID NO: 317877 - DNA, 20 bp, Artificial Sequence
  chemically synthesized
gaacagagcaagaaggagaa

SEQ ID NO: 317878 - DNA, 20 bp, Artificial Sequence
  chemically synthesized
agtgaaatgaatctgctaaa

SEQ ID NO: 317879 - DNA, 20 bp, Artificial Sequence
  chemically synthesized
tgaaatgaatctgctaaaca

SEQ ID NO: 317880 - DNA, 20 bp, Artificial Sequence
  chemically synthesized
ttgatagttactctgtttag

SEQ ID NO: 317881 - DNA, 20 bp, Artificial Sequence
  chemically synthesized
attttgatagttactctgtt

SEQ ID NO: 317882 - DNA, 20 bp, Artificial Sequence
  chemically synthesized
tactaatttaagtattttga

SEQ ID NO: 317883 - DNA, 20 bp, Artificial Sequence
  chemically synthesized
aactatcaaaatacttaaat

SEQ ID NO: 317884 - DNA, 20 bp, Artificial Sequence
  chemically synthesized
aaatacacttatactaattt

SEQ ID NO: 317885 - DNA, 20 bp, Artificial Sequence
  chemically synthesized
caaaatacttaaattagtat

SEQ ID NO: 317886 - DNA, 20 bp, Artificial Sequence
  chemically synthesized
tataagtgtatttaaaacaa

SEQ ID NO: 317887 - DNA, 20 bp, Artificial Sequence
  chemically synthesized
ataagtgtatttaaaacaaa

SEQ ID NO: 317888 - DNA, 20 bp, Artificial Sequence
  chemically synthesized
aaaaggatacaaaattccat

SEQ ID NO: 317889 - DNA, 20 bp, Artificial Sequence
  chemically synthesized
tatgaggataaagatgctga

SEQ ID NO: 317890 - DNA, 20 bp, Artificial Sequence
  chemically synthesized
ggcattagtgtatgaggata

SEQ ID NO: 317891 - DNA, 20 bp, Artificial Sequence
  chemically synthesized
tagcctggcattagtgtatg

SEQ ID NO: 317892 - DNA, 20 bp, Artificial Sequence
  chemically synthesized
atagcctggcattagtgtat

SEQ ID NO: 317893 - DNA, 20 bp, Artificial Sequence
  chemically synthesized
ttatcctcatacactaatgc

SEQ ID NO: 317894 - DNA, 20 bp, Artificial Sequence
  chemically synthesized
tatcctcatacactaatgcc

SEQ ID NO: 317895 - DNA, 20 bp, Artificial Sequence
  chemically synthesized
gggtttaaatagcctggcat

SEQ ID NO: 317896 - DNA, 20 bp, Artificial Sequence
  chemically synthesized
atgttggggtttaaatagcc

SEQ ID NO: 317897 - DNA, 20 bp, Artificial Sequence
  chemically synthesized
gttccatgttggggtttaaa

SEQ ID NO: 317898 - DNA, 20 bp, Artificial Sequence
  chemically synthesized
aggctatttaaaccccaaca

SEQ ID NO: 317899 - DNA, 20 bp, Artificial Sequence
  chemically synthesized
tacatacaggttccatgttg

SEQ ID NO: 317900 - DNA, 20 bp, Artificial Sequence
  chemically synthesized
ttacatacaggttccatgtt

SEQ ID NO: 317901 - DNA, 20 bp, Artificial Sequence
  chemically synthesized
attacatacaggttccatgt

SEQ ID NO: 317902 - DNA, 20 bp, Artificial Sequence
  chemically synthesized
tggtatgtaacattacatac

SEQ ID NO: 317903 - DNA, 20 bp, Artificial Sequence
  chemically synthesized
gtggtatgtaacattacata

SEQ ID NO: 317904 - DNA, 20 bp, Artificial Sequence
  chemically synthesized
ttttatatgaagagtgtgag

SEQ ID NO: 317905 - DNA, 20 bp, Artificial Sequence
  chemically synthesized
taattttatatgaagagtgt

SEQ ID NO: 317906 - DNA, 20 bp, Artificial Sequence
  chemically synthesized
tccctgtaattttatatgaa

SEQ ID NO: 317907 - DNA, 20 bp, Artificial Sequence
  chemically synthesized
tttccctgtaattttatatg

SEQ ID NO: 317908 - DNA, 20 bp, Artificial Sequence
  chemically synthesized
acactcttcatataaaatta

SEQ ID NO: 317909 - DNA, 20 bp, Artificial Sequence
  chemically synthesized
cactcttcatataaaattac

SEQ ID NO: 317910 - DNA, 20 bp, Artificial Sequence
  chemically synthesized
actcttcatataaaattaca

SEQ ID NO: 317911 - DNA, 20 bp, Artificial Sequence
  chemically synthesized
catataaaattacagggaaa

SEQ ID NO: 317912 - DNA, 20 bp, Artificial Sequence
  chemically synthesized
atataaaattacagggaaac

SEQ ID NO: 317913 - DNA, 20 bp, Artificial Sequence
  chemically synthesized
tataaaattacagggaaaca

SEQ ID NO: 317914 - DNA, 20 bp, Artificial Sequence
  chemically synthesized
ataaaattacagggaaacag

SEQ ID NO: 317915 - DNA, 20 bp, Artificial Sequence
  chemically synthesized
aaattacagggaaacagggg

SEQ ID NO: 317916 - DNA, 20 bp, Artificial Sequence
  chemically synthesized
gggaaacaggggaagtaaac

SEQ ID NO: 317917 - DNA, 20 bp, Artificial Sequence
  chemically synthesized
tcttttatattttattttac

SEQ ID NO: 317918 - DNA, 20 bp, Artificial Sequence
  chemically synthesized
accagtaaaataaaatataa

SEQ ID NO: 317919 - DNA, 20 bp, Artificial Sequence
  chemically synthesized
aaataaaatataaaagataa

SEQ ID NO: 317920 - DNA, 20 bp, Artificial Sequence
  chemically synthesized
tataaaagataatggctcca

SEQ ID NO: 317921 - DNA, 20 bp, Artificial Sequence
  chemically synthesized
aaagataatggctccatagc

SEQ ID NO: 317922 - DNA, 20 bp, Artificial Sequence
  chemically synthesized
aatacttcggaccagctatg

SEQ ID NO: 317923 - DNA, 20 bp, Artificial Sequence
  chemically synthesized
ccaatacttcggaccagcta

SEQ ID NO: 317924 - DNA, 20 bp, Artificial Sequence
  chemically synthesized
atggctccatagctggtccg

SEQ ID NO: 317925 - DNA, 20 bp, Artificial Sequence
  chemically synthesized
acaaccccaatacttcggac

SEQ ID NO: 317926 - DNA, 20 bp, Artificial Sequence
  chemically synthesized
ccatagctggtccgaagtat

SEQ ID NO: 317927 - DNA, 20 bp, Artificial Sequence
  chemically synthesized
catagctggtccgaagtatt

SEQ ID NO: 317928 - DNA, 20 bp, Artificial Sequence
  chemically synthesized
tgataacaaccccaatactt

SEQ ID NO: 317929 - DNA, 20 bp, Artificial Sequence
  chemically synthesized
atagctggtccgaagtattg

SEQ ID NO: 317930 - DNA, 20 bp, Artificial Sequence
  chemically synthesized
cgaagtattggggttgttat

SEQ ID NO: 317931 - DNA, 20 bp, Artificial Sequence
  chemically synthesized
aagtattggggttgttatca

SEQ ID NO: 317932 - DNA, 20 bp, Artificial Sequence
  chemically synthesized
atgaaatgcatattggaaga

SEQ ID NO: 317933 - DNA, 20 bp, Artificial Sequence
  chemically synthesized
gaatatgaaatgcatattgg

SEQ ID NO: 317934 - DNA, 20 bp, Artificial Sequence
  chemically synthesized
aaggaatatgaaatgcatat

SEQ ID NO: 317935 - DNA, 20 bp, Artificial Sequence
  chemically synthesized
atgcatttcatattcctttt

SEQ ID NO: 317936 - DNA, 20 bp, Artificial Sequence
  chemically synthesized
gcatttcatattccttttga

SEQ ID NO: 317937 - DNA, 20 bp, Artificial Sequence
  chemically synthesized
ttattgtaaacactctcaaa

SEQ ID NO: 317938 - DNA, 20 bp, Artificial Sequence
  chemically synthesized
attattgtaaacactctcaa

SEQ ID NO: 317939 - DNA, 20 bp, Artificial Sequence
  chemically synthesized
tgagagtgtttacaataatt

SEQ ID NO: 317940 - DNA, 20 bp, Artificial Sequence
  chemically synthesized
aaatgttaaaagtcaataaa

SEQ ID NO: 317941 - DNA, 20 bp, Artificial Sequence
  chemically synthesized
atgtgtctctaaaatgttaa

SEQ ID NO: 317942 - DNA, 20 bp, Artificial Sequence
  chemically synthesized
tttattgacttttaacattt

SEQ ID NO: 317943 - DNA, 20 bp, Artificial Sequence
  chemically synthesized
tattgacttttaacatttta

SEQ ID NO: 317944 - DNA, 20 bp, Artificial Sequence
  chemically synthesized
tttagagacacatttaccat

SEQ ID NO: 317945 - DNA, 20 bp, Artificial Sequence
  chemically synthesized
ttagagacacatttaccatg

SEQ ID NO: 317946 - DNA, 20 bp, Artificial Sequence
  chemically synthesized
tctgattgcaatgttcctca

SEQ ID NO: 317947 - DNA, 20 bp, Artificial Sequence
  chemically synthesized
accatgaggaacattgcaat

SEQ ID NO: 317948 - DNA, 20 bp, Artificial Sequence
  chemically synthesized
atgaggaacattgcaatcag

SEQ ID NO: 317949 - DNA, 20 bp, Artificial Sequence
  chemically synthesized
acattgcaatcagaagttat

SEQ ID NO: 317950 - DNA, 20 bp, Artificial Sequence
  chemically synthesized
tttttgtgtttgataaatga

SEQ ID NO: 317951 - DNA, 20 bp, Artificial Sequence
  chemically synthesized
tttcatttatcaaacacaaa

SEQ ID NO: 317952 - DNA, 20 bp, Artificial Sequence
  chemically synthesized
catttatcaaacacaaaaag

SEQ ID NO: 317953 - DNA, 20 bp, Artificial Sequence
  chemically synthesized
agtagacattttatttttat

SEQ ID NO: 317954 - DNA, 20 bp, Artificial Sequence
  chemically synthesized
tttatttttatgagaaacaa

SEQ ID NO: 317955 - DNA, 20 bp, Artificial Sequence
  chemically synthesized
tatttttatgagaaacaaca

SEQ ID NO: 317956 - DNA, 20 bp, Artificial Sequence
  chemically synthesized
ttatgagaaacaacagagat

SEQ ID NO: 317957 - DNA, 20 bp, Artificial Sequence
  chemically synthesized
cagagatgagatatccattt

SEQ ID NO: 317958 - DNA, 20 bp, Artificial Sequence
  chemically synthesized
agatgagatatccatttaag

SEQ ID NO: 317959 - DNA, 20 bp, Artificial Sequence
  chemically synthesized
agtttttgcttccacttaaa

SEQ ID NO: 317960 - DNA, 20 bp, Artificial Sequence
  chemically synthesized
tgagatatccatttaagtgg

SEQ ID NO: 317961 - DNA, 20 bp, Artificial Sequence
  chemically synthesized
taagtggaagcaaaaactga

SEQ ID NO: 317962 - DNA, 20 bp, Artificial Sequence
  chemically synthesized
tttcaaatactagcaacttt

SEQ ID NO: 317963 - DNA, 20 bp, Artificial Sequence
  chemically synthesized
aagcaaaaactgaaagttgc

SEQ ID NO: 317964 - DNA, 20 bp, Artificial Sequence
  chemically synthesized
taaatgatgctttcaaatac

SEQ ID NO: 317965 - DNA, 20 bp, Artificial Sequence
  chemically synthesized
tgaaagttgctagtatttga

SEQ ID NO: 317966 - DNA, 20 bp, Artificial Sequence
  chemically synthesized
aatgtctgtccaaaagcaaa

SEQ ID NO: 317967 - DNA, 20 bp, Artificial Sequence
  chemically synthesized
catcatttactttttgcttt

SEQ ID NO: 317968 - DNA, 20 bp, Artificial Sequence
  chemically synthesized
atttactttttgcttttgga

SEQ ID NO: 317969 - DNA, 20 bp, Artificial Sequence
  chemically synthesized
tgaaggaaatgtctgtccaa

SEQ ID NO: 317970 - DNA, 20 bp, Artificial Sequence
  chemically synthesized
actcagtaaagatttgttga

SEQ ID NO: 317971 - DNA, 20 bp, Artificial Sequence
  chemically synthesized
aactcagtaaagatttgttg

SEQ ID NO: 317972 - DNA, 20 bp, Artificial Sequence
  chemically synthesized
tccttcaacaaatctttact

SEQ ID NO: 317973 - DNA, 20 bp, Artificial Sequence
  chemically synthesized
catagatatgaaactcagta

SEQ ID NO: 317974 - DNA, 20 bp, Artificial Sequence
  chemically synthesized
tcctgcatagatatgaaact

SEQ ID NO: 317975 - DNA, 20 bp, Artificial Sequence
  chemically synthesized
tactgagtttcatatctatg

SEQ ID NO: 317976 - DNA, 20 bp, Artificial Sequence
  chemically synthesized
actgagtttcatatctatgc

SEQ ID NO: 317977 - DNA, 20 bp, Artificial Sequence
  chemically synthesized
acaaatatgagtttcctgca

SEQ ID NO: 317978 - DNA, 20 bp, Artificial Sequence
  chemically synthesized
tgtccattcctaacaaatat

SEQ ID NO: 317979 - DNA, 20 bp, Artificial Sequence
  chemically synthesized
tgcaggaaactcatatttgt

SEQ ID NO: 317980 - DNA, 20 bp, Artificial Sequence
  chemically synthesized
gcaggaaactcatatttgtt

SEQ ID NO: 317981 - DNA, 20 bp, Artificial Sequence
  chemically synthesized
aaactcatatttgttaggaa

SEQ ID NO: 317982 - DNA, 20 bp, Artificial Sequence
  chemically synthesized
agctacttgaaattgaagat

SEQ ID NO: 317983 - DNA, 20 bp, Artificial Sequence
  chemically synthesized
aagctacttgaaattgaaga

SEQ ID NO: 317984 - DNA, 20 bp, Artificial Sequence
  chemically synthesized
aaatacctatcttcaatttc

SEQ ID NO: 317985 - DNA, 20 bp, Artificial Sequence
  chemically synthesized
ctctaagctacttgaaattg

SEQ ID NO: 317986 - DNA, 20 bp, Artificial Sequence
  chemically synthesized
tacctatcttcaatttcaag

SEQ ID NO: 317987 - DNA, 20 bp, Artificial Sequence
  chemically synthesized
atcttcaatttcaagtagct

SEQ ID NO: 317988 - DNA, 20 bp, Artificial Sequence
  chemically synthesized
cttcaatttcaagtagctta

SEQ ID NO: 317989 - DNA, 20 bp, Artificial Sequence
  chemically synthesized
ttatgtctctaatagtctct

SEQ ID NO: 317990 - DNA, 20 bp, Artificial Sequence
  chemically synthesized
tcaagtagcttagagactat

SEQ ID NO: 317991 - DNA, 20 bp, Artificial Sequence
  chemically synthesized
aagtagcttagagactatta

SEQ ID NO: 317992 - DNA, 20 bp, Artificial Sequence
  chemically synthesized
ttttgtatttatgtctctaa

SEQ ID NO: 317993 - DNA, 20 bp, Artificial Sequence
  chemically synthesized
gacataaatacaaaaataat

SEQ ID NO: 317994 - DNA, 20 bp, Artificial Sequence
  chemically synthesized
tacaaaaataattagaatat

SEQ ID NO: 317995 - DNA, 20 bp, Artificial Sequence
  chemically synthesized
tataagaaatccattataat

SEQ ID NO: 317996 - DNA, 20 bp, Artificial Sequence
  chemically synthesized
gtatataaatctaattataa

SEQ ID NO: 317997 - DNA, 20 bp, Artificial Sequence
  chemically synthesized
ttagatttatatacattcct

SEQ ID NO: 317998 - DNA, 20 bp, Artificial Sequence
  chemically synthesized
tagatttatatacattcctg

SEQ ID NO: 317999 - DNA, 20 bp, Artificial Sequence
  chemically synthesized
agatttatatacattcctga

SEQ ID NO: 318000 - DNA, 20 bp, Artificial Sequence
  chemically synthesized
atttatatacattcctgagg

SEQ ID NO: 318001 - DNA, 20 bp, Artificial Sequence
  chemically synthesized
tatcctctccttactccctc

SEQ ID NO: 318002 - DNA, 20 bp, Artificial Sequence
  chemically synthesized
atatacattcctgagggagt

SEQ ID NO: 318003 - DNA, 20 bp, Artificial Sequence
  chemically synthesized
gtatcctctccttactccct

SEQ ID NO: 318004 - DNA, 20 bp, Artificial Sequence
  chemically synthesized
tatacattcctgagggagta

SEQ ID NO: 318005 - DNA, 20 bp, Artificial Sequence
  chemically synthesized
tacattcctgagggagtaag

SEQ ID NO: 318006 - DNA, 20 bp, Artificial Sequence
  chemically synthesized
cattcctgagggagtaagga

SEQ ID NO: 318007 - DNA, 20 bp, Artificial Sequence
  chemically synthesized
attcctgagggagtaaggag

SEQ ID NO: 318008 - DNA, 20 bp, Artificial Sequence
  chemically synthesized
agaggatacaaattgacctg

SEQ ID NO: 318009 - DNA, 20 bp, Artificial Sequence
  chemically synthesized
acactgttcccaatgactgc

SEQ ID NO: 318010 - DNA, 20 bp, Artificial Sequence
  chemically synthesized
acaaattgacctgcagtcat

SEQ ID NO: 318011 - DNA, 20 bp, Artificial Sequence
  chemically synthesized
gacactgttcccaatgactg

SEQ ID NO: 318012 - DNA, 20 bp, Artificial Sequence
  chemically synthesized
caaattgacctgcagtcatt

SEQ ID NO: 318013 - DNA, 20 bp, Artificial Sequence
  chemically synthesized
tgacctgcagtcattgggaa

SEQ ID NO: 318014 - DNA, 20 bp, Artificial Sequence
  chemically synthesized
cattgggaacagtgtcctcg

SEQ ID NO: 318015 - DNA, 20 bp, Artificial Sequence
  chemically synthesized
cttaggctgtgtgttctgcg

SEQ ID NO: 318016 - DNA, 20 bp, Artificial Sequence
  chemically synthesized
tcttaggctgtgtgttctgc

SEQ ID NO: 318017 - DNA, 20 bp, Artificial Sequence
  chemically synthesized
cagtgtcctcgcagaacaca

SEQ ID NO: 318018 - DNA, 20 bp, Artificial Sequence
  chemically synthesized
cctcgcagaacacacagcct

SEQ ID NO: 318019 - DNA, 20 bp, Artificial Sequence
  chemically synthesized
tcgcagaacacacagcctaa

SEQ ID NO: 318020 - DNA, 20 bp, Artificial Sequence
  chemically synthesized
gaacacacagcctaagagtt

SEQ ID NO: 318021 - DNA, 20 bp, Artificial Sequence
  chemically synthesized
tttttcaagtctcaactctt

SEQ ID NO: 318022 - DNA, 20 bp, Artificial Sequence
  chemically synthesized
atttttcaagtctcaactct

SEQ ID NO: 318023 - DNA, 20 bp, Artificial Sequence
  chemically synthesized
aattaatgaatgaatttttc

SEQ ID NO: 318024 - DNA, 20 bp, Artificial Sequence
  chemically synthesized
ttacgaaatatacaattatt

SEQ ID NO: 318025 - DNA, 20 bp, Artificial Sequence
  chemically synthesized
atatacaattattgagtacc

SEQ ID NO: 318026 - DNA, 20 bp, Artificial Sequence
  chemically synthesized
cctctccatccgtagtatcc

SEQ ID NO: 318027 - DNA, 20 bp, Artificial Sequence
  chemically synthesized
tattgagtacctggatacta

SEQ ID NO: 318028 - DNA, 20 bp, Artificial Sequence
  chemically synthesized
gcctctccatccgtagtatc

SEQ ID NO: 318029 - DNA, 20 bp, Artificial Sequence
  chemically synthesized
gagtacctggatactacgga

SEQ ID NO: 318030 - DNA, 20 bp, Artificial Sequence
  chemically synthesized
gtacctggatactacggatg

SEQ ID NO: 318031 - DNA, 20 bp, Artificial Sequence
  chemically synthesized
cttccttgcctctccatccg

SEQ ID NO: 318032 - DNA, 20 bp, Artificial Sequence
  chemically synthesized
acctggatactacggatgga

SEQ ID NO: 318033 - DNA, 20 bp, Artificial Sequence
  chemically synthesized
cctggatactacggatggag

SEQ ID NO: 318034 - DNA, 20 bp, Artificial Sequence
  chemically synthesized
gatactacggatggagaggc

SEQ ID NO: 318035 - DNA, 20 bp, Artificial Sequence
  chemically synthesized
atactacggatggagaggca

SEQ ID NO: 318036 - DNA, 20 bp, Artificial Sequence
  chemically synthesized
ctacggatggagaggcaagg

SEQ ID NO: 318037 - DNA, 20 bp, Artificial Sequence
  chemically synthesized
agaggcaaggaagaccaaca

SEQ ID NO: 318038 - DNA, 20 bp, Artificial Sequence
  chemically synthesized
aagatagcaaggggctgtgt

SEQ ID NO: 318039 - DNA, 20 bp, Artificial Sequence
  chemically synthesized
ataaactccaagatagcaag

SEQ ID NO: 318040 - DNA, 20 bp, Artificial Sequence
  chemically synthesized
tataaactccaagatagcaa

SEQ ID NO: 318041 - DNA, 20 bp, Artificial Sequence
  chemically synthesized
atataaactccaagatagca

SEQ ID NO: 318042 - DNA, 20 bp, Artificial Sequence
  chemically synthesized
aacacagccccttgctatct

SEQ ID NO: 318043 - DNA, 20 bp, Artificial Sequence
  chemically synthesized
catataaactccaagatagc

SEQ ID NO: 318044 - DNA, 20 bp, Artificial Sequence
  chemically synthesized
cacagccccttgctatcttg

SEQ ID NO: 318045 - DNA, 20 bp, Artificial Sequence
  chemically synthesized
catccatataaactccaaga

SEQ ID NO: 318046 - DNA, 20 bp, Artificial Sequence
  chemically synthesized
ccgccatccatataaactcc

SEQ ID NO: 318047 - DNA, 20 bp, Artificial Sequence
  chemically synthesized
ttgctatcttggagtttata

SEQ ID NO: 318048 - DNA, 20 bp, Artificial Sequence
  chemically synthesized
tatcttggagtttatatgga

SEQ ID NO: 318049 - DNA, 20 bp, Artificial Sequence
  chemically synthesized
cttggagtttatatggatgg

SEQ ID NO: 318050 - DNA, 20 bp, Artificial Sequence
  chemically synthesized
ttggagtttatatggatggc

SEQ ID NO: 318051 - DNA, 20 bp, Artificial Sequence
  chemically synthesized
agtttatatggatggcgggt

SEQ ID NO: 318052 - DNA, 20 bp, Artificial Sequence
  chemically synthesized
gtttatatggatggcgggtg

SEQ ID NO: 318053 - DNA, 20 bp, Artificial Sequence
  chemically synthesized
tttatatggatggcgggtga

SEQ ID NO: 318054 - DNA, 20 bp, Artificial Sequence
  chemically synthesized
tggatggcgggtgagggcca

SEQ ID NO: 318055 - DNA, 20 bp, Artificial Sequence
  chemically synthesized
tgagctatatgtattatctg

SEQ ID NO: 318056 - DNA, 20 bp, Artificial Sequence
  chemically synthesized
agggccacagataatacata

SEQ ID NO: 318057 - DNA, 20 bp, Artificial Sequence
  chemically synthesized
agataatacatatagctcaa

SEQ ID NO: 318058 - DNA, 20 bp, Artificial Sequence
  chemically synthesized
gataatacatatagctcaac

SEQ ID NO: 318059 - DNA, 20 bp, Artificial Sequence
  chemically synthesized
taaccaactaatggcctgtt

SEQ ID NO: 318060 - DNA, 20 bp, Artificial Sequence
  chemically synthesized
catatagctcaacaggccat

SEQ ID NO: 318061 - DNA, 20 bp, Artificial Sequence
  chemically synthesized
tagctcaacaggccattagt

SEQ ID NO: 318062 - DNA, 20 bp, Artificial Sequence
  chemically synthesized
atcacattataaccaactaa

SEQ ID NO: 318063 - DNA, 20 bp, Artificial Sequence
  chemically synthesized
atgtgatcatactatgaaat

SEQ ID NO: 318064 - DNA, 20 bp, Artificial Sequence
  chemically synthesized
attcaattgctctcatttca

SEQ ID NO: 318065 - DNA, 20 bp, Artificial Sequence
  chemically synthesized
gtgatcatactatgaaatga

SEQ ID NO: 318066 - DNA, 20 bp, Artificial Sequence
  chemically synthesized
gaaatgagagcaattgaatt

SEQ ID NO: 318067 - DNA, 20 bp, Artificial Sequence
  chemically synthesized
gcaattgaattgagtctgta

SEQ ID NO: 318068 - DNA, 20 bp, Artificial Sequence
  chemically synthesized
caattgaattgagtctgtaa

SEQ ID NO: 318069 - DNA, 20 bp, Artificial Sequence
  chemically synthesized
aattgaattgagtctgtaaa

SEQ ID NO: 318070 - DNA, 20 bp, Artificial Sequence
  chemically synthesized
attgaattgagtctgtaaag

SEQ ID NO: 318071 - DNA, 20 bp, Artificial Sequence
  chemically synthesized
ttgaattgagtctgtaaagg

SEQ ID NO: 318072 - DNA, 20 bp, Artificial Sequence
  chemically synthesized
tgaattgagtctgtaaaggg

SEQ ID NO: 318073 - DNA, 20 bp, Artificial Sequence
  chemically synthesized
gcactaaaggccccccttta

SEQ ID NO: 318074 - DNA, 20 bp, Artificial Sequence
  chemically synthesized
agtctgtaaaggggggcctt

SEQ ID NO: 318075 - DNA, 20 bp, Artificial Sequence
  chemically synthesized
gtaaaggggggcctttagtg

SEQ ID NO: 318076 - DNA, 20 bp, Artificial Sequence
  chemically synthesized
gttgtccagtactgcactaa

SEQ ID NO: 318077 - DNA, 20 bp, Artificial Sequence
  chemically synthesized
agttgtccagtactgcacta

SEQ ID NO: 318078 - DNA, 20 bp, Artificial Sequence
  chemically synthesized
gggggcctttagtgcagtac

SEQ ID NO: 318079 - DNA, 20 bp, Artificial Sequence
  chemically synthesized
cttcagtcttcacagttgtc

SEQ ID NO: 318080 - DNA, 20 bp, Artificial Sequence
  chemically synthesized
tgcagtactggacaactgtg

SEQ ID NO: 318081 - DNA, 20 bp, Artificial Sequence
  chemically synthesized
acttctgacttcagtcttca

SEQ ID NO: 318082 - DNA, 20 bp, Artificial Sequence
  chemically synthesized
ctggacaactgtgaagactg

SEQ ID NO: 318083 - DNA, 20 bp, Artificial Sequence
  chemically synthesized
acaactgtgaagactgaagt

SEQ ID NO: 318084 - DNA, 20 bp, Artificial Sequence
  chemically synthesized
actgtgaagactgaagtcag

SEQ ID NO: 318085 - DNA, 20 bp, Artificial Sequence
  chemically synthesized
tttttcactacttctgactt

SEQ ID NO: 318086 - DNA, 20 bp, Artificial Sequence
  chemically synthesized
gtgaagactgaagtcagaag

SEQ ID NO: 318087 - DNA, 20 bp, Artificial Sequence
  chemically synthesized
tgaagtcagaagtagtgaaa

SEQ ID NO: 318088 - DNA, 20 bp, Artificial Sequence
  chemically synthesized
agtcagaagtagtgaaaaag

SEQ ID NO: 318089 - DNA, 20 bp, Artificial Sequence
  chemically synthesized
gtcagaagtagtgaaaaaga

SEQ ID NO: 318090 - DNA, 20 bp, Artificial Sequence
  chemically synthesized
aagaaggtataaactctttc

SEQ ID NO: 318091 - DNA, 20 bp, Artificial Sequence
  chemically synthesized
tctttctttccgtctagaaa

SEQ ID NO: 318092 - DNA, 20 bp, Artificial Sequence
  chemically synthesized
aggtataaactctttctaga

SEQ ID NO: 318093 - DNA, 20 bp, Artificial Sequence
  chemically synthesized
ggtctttctttccgtctaga

SEQ ID NO: 318094 - DNA, 20 bp, Artificial Sequence
  chemically synthesized
ataaactctttctagacgga

SEQ ID NO: 318095 - DNA, 20 bp, Artificial Sequence
  chemically synthesized
cacaggtctttctttccgtc

SEQ ID NO: 318096 - DNA, 20 bp, Artificial Sequence
  chemically synthesized
actctttctagacggaaaga

SEQ ID NO: 318097 - DNA, 20 bp, Artificial Sequence
  chemically synthesized
acggaaagaaagacctgtga

SEQ ID NO: 318098 - DNA, 20 bp, Artificial Sequence
  chemically synthesized
cggaaagaaagacctgtgaa

SEQ ID NO: 318099 - DNA, 20 bp, Artificial Sequence
  chemically synthesized
gatgtgacagggcctttcac

SEQ ID NO: 318100 - DNA, 20 bp, Artificial Sequence
  chemically synthesized
tgatgtgacagggcctttca

SEQ ID NO: 318101 - DNA, 20 bp, Artificial Sequence
  chemically synthesized
ggttcctctgtgatgtgaca

SEQ ID NO: 318102 - DNA, 20 bp, Artificial Sequence
  chemically synthesized
cggttcctctgtgatgtgac

SEQ ID NO: 318103 - DNA, 20 bp, Artificial Sequence
  chemically synthesized
ccggttcctctgtgatgtga

SEQ ID NO: 318104 - DNA, 20 bp, Artificial Sequence
  chemically synthesized
tgaaaggccctgtcacatca

SEQ ID NO: 318105 - DNA, 20 bp, Artificial Sequence
  chemically synthesized
aaaggccctgtcacatcaca

SEQ ID NO: 318106 - DNA, 20 bp, Artificial Sequence
  chemically synthesized
aaggccctgtcacatcacag

SEQ ID NO: 318107 - DNA, 20 bp, Artificial Sequence
  chemically synthesized
ctgtcacatcacagaggaac

SEQ ID NO: 318108 - DNA, 20 bp, Artificial Sequence
  chemically synthesized
tcacagaggaaccggaaatc

SEQ ID NO: 318109 - DNA, 20 bp, Artificial Sequence
  chemically synthesized
atcaagctgcactggatttc

SEQ ID NO: 318110 - DNA, 20 bp, Artificial Sequence
  chemically synthesized
gaggaaccggaaatccagtg

SEQ ID NO: 318111 - DNA, 20 bp, Artificial Sequence
  chemically synthesized
cttgtgcgatcaagctgcac

SEQ ID NO: 318112 - DNA, 20 bp, Artificial Sequence
  chemically synthesized
atcctgcaccttgtgcgatc

SEQ ID NO: 318113 - DNA, 20 bp, Artificial Sequence
  chemically synthesized
ccagtgcagcttgatcgcac

SEQ ID NO: 318114 - DNA, 20 bp, Artificial Sequence
  chemically synthesized
cagtgcagcttgatcgcaca

SEQ ID NO: 318115 - DNA, 20 bp, Artificial Sequence
  chemically synthesized
cagcttgatcgcacaaggtg

SEQ ID NO: 318116 - DNA, 20 bp, Artificial Sequence
  chemically synthesized
agcttgatcgcacaaggtgc

SEQ ID NO: 318117 - DNA, 20 bp, Artificial Sequence
  chemically synthesized
tgatcgcacaaggtgcagga

SEQ ID NO: 318118 - DNA, 20 bp, Artificial Sequence
  chemically synthesized
caaggtgcaggatggttgta

SEQ ID NO: 318119 - DNA, 20 bp, Artificial Sequence
  chemically synthesized
aggatggttgtacagtatca

SEQ ID NO: 318120 - DNA, 20 bp, Artificial Sequence
  chemically synthesized
gtggacccacagattaaggt

SEQ ID NO: 318121 - DNA, 20 bp, Artificial Sequence
  chemically synthesized
tgtggacccacagattaagg

SEQ ID NO: 318122 - DNA, 20 bp, Artificial Sequence
  chemically synthesized
tcatagcctaccttaatctg

SEQ ID NO: 318123 - DNA, 20 bp, Artificial Sequence
  chemically synthesized
ctctgtggacccacagatta

SEQ ID NO: 318124 - DNA, 20 bp, Artificial Sequence
  chemically synthesized
catagcctaccttaatctgt

SEQ ID NO: 318125 - DNA, 20 bp, Artificial Sequence
  chemically synthesized
tctctgtggacccacagatt

SEQ ID NO: 318126 - DNA, 20 bp, Artificial Sequence
  chemically synthesized
aagaaatctctgtggaccca

SEQ ID NO: 318127 - DNA, 20 bp, Artificial Sequence
  chemically synthesized
taccttaatctgtgggtcca

SEQ ID NO: 318128 - DNA, 20 bp, Artificial Sequence
  chemically synthesized
ccttaatctgtgggtccaca

SEQ ID NO: 318129 - DNA, 20 bp, Artificial Sequence
  chemically synthesized
cagagctcaagaaatctctg

SEQ ID NO: 318130 - DNA, 20 bp, Artificial Sequence
  chemically synthesized
tgggtccacagagatttctt

SEQ ID NO: 318131 - DNA, 20 bp, Artificial Sequence
  chemically synthesized
tcagatttggggcagagctc

SEQ ID NO: 318132 - DNA, 20 bp, Artificial Sequence
  chemically synthesized
caaatttcagatttggggca

SEQ ID NO: 318133 - DNA, 20 bp, Artificial Sequence
  chemically synthesized
ttcaaatttcagatttgggg

SEQ ID NO: 318134 - DNA, 20 bp, Artificial Sequence
  chemically synthesized
gtgttcaaatttcagatttg

SEQ ID NO: 318135 - DNA, 20 bp, Artificial Sequence
  chemically synthesized
ggtgttcaaatttcagattt

SEQ ID NO: 318136 - DNA, 20 bp, Artificial Sequence
  chemically synthesized
gggtgttcaaatttcagatt

SEQ ID NO: 318137 - DNA, 20 bp, Artificial Sequence
  chemically synthesized
attactgggtgttcaaattt

SEQ ID NO: 318138 - DNA, 20 bp, Artificial Sequence
  chemically synthesized
aaatctgaaatttgaacacc

SEQ ID NO: 318139 - DNA, 20 bp, Artificial Sequence
  chemically synthesized
atagaacatgaaagattact

SEQ ID NO: 318140 - DNA, 20 bp, Artificial Sequence
  chemically synthesized
gatagaacatgaaagattac

SEQ ID NO: 318141 - DNA, 20 bp, Artificial Sequence
  chemically synthesized
gaaaccacgatagaacatga

SEQ ID NO: 318142 - DNA, 20 bp, Artificial Sequence
  chemically synthesized
taatctttcatgttctatcg

SEQ ID NO: 318143 - DNA, 20 bp, Artificial Sequence
  chemically synthesized
tttgtaaaatgaaaccacga

SEQ ID NO: 318144 - DNA, 20 bp, Artificial Sequence
  chemically synthesized
gtggtttcattttacaaact

SEQ ID NO: 318145 - DNA, 20 bp, Artificial Sequence
  chemically synthesized
tcattttacaaacttggact

SEQ ID NO: 318146 - DNA, 20 bp, Artificial Sequence
  chemically synthesized
attttacaaacttggactca

SEQ ID NO: 318147 - DNA, 20 bp, Artificial Sequence
  chemically synthesized
attggtcaatctctgagtcc

SEQ ID NO: 318148 - DNA, 20 bp, Artificial Sequence
  chemically synthesized
cttcttattggtcaatctct

SEQ ID NO: 318149 - DNA, 20 bp, Artificial Sequence
  chemically synthesized
ggactcagagattgaccaat

SEQ ID NO: 318150 - DNA, 20 bp, Artificial Sequence
  chemically synthesized
ctcagagattgaccaataag

SEQ ID NO: 318151 - DNA, 20 bp, Artificial Sequence
  chemically synthesized
cagagattgaccaataagaa

SEQ ID NO: 318152 - DNA, 20 bp, Artificial Sequence
  chemically synthesized
atgtgtacatctcttcttat

SEQ ID NO: 318153 - DNA, 20 bp, Artificial Sequence
  chemically synthesized
ataagaagagatgtacacat

SEQ ID NO: 318154 - DNA, 20 bp, Artificial Sequence
  chemically synthesized
taagagaaaaaaaaaaaaag

SEQ ID NO: 318155 - DNA, 20 bp, Artificial Sequence
  chemically synthesized
tattaagagaaaaaaaaaaa

SEQ ID NO: 318156 - DNA, 20 bp, Artificial Sequence
  chemically synthesized
tttttttttttttctcttaa

SEQ ID NO: 318157 - DNA, 20 bp, Artificial Sequence
  chemically synthesized
tttttttttttctcttaata

SEQ ID NO: 318158 - DNA, 20 bp, Artificial Sequence
  chemically synthesized
tgagaccttgtctctattaa

SEQ ID NO: 318159 - DNA, 20 bp, Artificial Sequence
  chemically synthesized
aatgagaccttgtctctatt

SEQ ID NO: 318160 - DNA, 20 bp, Artificial Sequence
  chemically synthesized
ttttttctcttaatagagac

SEQ ID NO: 318161 - DNA, 20 bp, Artificial Sequence
  chemically synthesized
tttttctcttaatagagaca

SEQ ID NO: 318162 - DNA, 20 bp, Artificial Sequence
  chemically synthesized
accagcctgggcaacataat

SEQ ID NO: 318163 - DNA, 20 bp, Artificial Sequence
  chemically synthesized
caaggtctcattatgttgcc

SEQ ID NO: 318164 - DNA, 20 bp, Artificial Sequence
  chemically synthesized
aaggtctcattatgttgccc

SEQ ID NO: 318165 - DNA, 20 bp, Artificial Sequence
  chemically synthesized
tctcattatgttgcccaggc

SEQ ID NO: 318166 - DNA, 20 bp, Artificial Sequence
  chemically synthesized
aaggagttgaagaccagcct

SEQ ID NO: 318167 - DNA, 20 bp, Artificial Sequence
  chemically synthesized
taaggagttgaagaccagcc

SEQ ID NO: 318168 - DNA, 20 bp, Artificial Sequence
  chemically synthesized
tgagctaaggagttgaagac

SEQ ID NO: 318169 - DNA, 20 bp, Artificial Sequence
  chemically synthesized
ttgcttgagctaaggagttg

SEQ ID NO: 318170 - DNA, 20 bp, Artificial Sequence
  chemically synthesized
caggctggtcttcaactcct

SEQ ID NO: 318171 - DNA, 20 bp, Artificial Sequence
  chemically synthesized
agaggattgcttgagctaag

SEQ ID NO: 318172 - DNA, 20 bp, Artificial Sequence
  chemically synthesized
ggtcttcaactccttagctc

SEQ ID NO: 318173 - DNA, 20 bp, Artificial Sequence
  chemically synthesized
ggagaggattgcttgagcta

SEQ ID NO: 318174 - DNA, 20 bp, Artificial Sequence
  chemically synthesized
gggagaggattgcttgagct

SEQ ID NO: 318175 - DNA, 20 bp, Artificial Sequence
  chemically synthesized
ccaaggggagaggattgctt

SEQ ID NO: 318176 - DNA, 20 bp, Artificial Sequence
  chemically synthesized
ctcaagcaatcctctcccct

SEQ ID NO: 318177 - DNA, 20 bp, Artificial Sequence
  chemically synthesized
ttttgggaggccaaggggag

SEQ ID NO: 318178 - DNA, 20 bp, Artificial Sequence
  chemically synthesized
cttttgggaggccaagggga

SEQ ID NO: 318179 - DNA, 20 bp, Artificial Sequence
  chemically synthesized
cacttttgggaggccaaggg

SEQ ID NO: 318180 - DNA, 20 bp, Artificial Sequence
  chemically synthesized
agcacttttgggaggccaag

SEQ ID NO: 318181 - DNA, 20 bp, Artificial Sequence
  chemically synthesized
cagcacttttgggaggccaa

SEQ ID NO: 318182 - DNA, 20 bp, Artificial Sequence
  chemically synthesized
ccagcacttttgggaggcca

SEQ ID NO: 318183 - DNA, 20 bp, Artificial Sequence
  chemically synthesized
cccagcacttttgggaggcc

SEQ ID NO: 318184 - DNA, 20 bp, Artificial Sequence
  chemically synthesized
ctctccccttggcctcccaa

SEQ ID NO: 318185 - DNA, 20 bp, Artificial Sequence
  chemically synthesized
ataatcccagcacttttggg

SEQ ID NO: 318186 - DNA, 20 bp, Artificial Sequence
  chemically synthesized
tataatcccagcacttttgg

SEQ ID NO: 318187 - DNA, 20 bp, Artificial Sequence
  chemically synthesized
cctataatcccagcactttt

SEQ ID NO: 318188 - DNA, 20 bp, Artificial Sequence
  chemically synthesized
ccttggcctcccaaaagtgc

SEQ ID NO: 318189 - DNA, 20 bp, Artificial Sequence
  chemically synthesized
gcctataatcccagcacttt

SEQ ID NO: 318190 - DNA, 20 bp, Artificial Sequence
  chemically synthesized
cttggcctcccaaaagtgct

SEQ ID NO: 318191 - DNA, 20 bp, Artificial Sequence
  chemically synthesized
tcccaaaagtgctgggatta

SEQ ID NO: 318192 - DNA, 20 bp, Artificial Sequence
  chemically synthesized
cccaaaagtgctgggattat

SEQ ID NO: 318193 - DNA, 20 bp, Artificial Sequence
  chemically synthesized
gggactcgcgcctataatcc

SEQ ID NO: 318194 - DNA, 20 bp, Artificial Sequence
  chemically synthesized
agtgctgggattataggcgc

SEQ ID NO: 318195 - DNA, 20 bp, Artificial Sequence
  chemically synthesized
taggcgcgagtccccgaacc

SEQ ID NO: 318196 - DNA, 20 bp, Artificial Sequence
  chemically synthesized
aaaacacctggctgggttcg

SEQ ID NO: 318197 - DNA, 20 bp, Artificial Sequence
  chemically synthesized
gaaaacacctggctgggttc

SEQ ID NO: 318198 - DNA, 20 bp, Artificial Sequence
  chemically synthesized
agaaaacacctggctgggtt

SEQ ID NO: 318199 - DNA, 20 bp, Artificial Sequence
  chemically synthesized
cgcgagtccccgaacccagc

SEQ ID NO: 318200 - DNA, 20 bp, Artificial Sequence
  chemically synthesized
gcgagtccccgaacccagcc

SEQ ID NO: 318201 - DNA, 20 bp, Artificial Sequence
  chemically synthesized
taaagagaaaacacctggct

SEQ ID NO: 318202 - DNA, 20 bp, Artificial Sequence
  chemically synthesized
ataaagagaaaacacctggc

SEQ ID NO: 318203 - DNA, 20 bp, Artificial Sequence
  chemically synthesized
acttataaagagaaaacacc

SEQ ID NO: 318204 - DNA, 20 bp, Artificial Sequence
  chemically synthesized
gccaggtgttttctctttat

SEQ ID NO: 318205 - DNA, 20 bp, Artificial Sequence
  chemically synthesized
ttctgtatcccacttataaa

SEQ ID NO: 318206 - DNA, 20 bp, Artificial Sequence
  chemically synthesized
aggtgttttctctttataag

SEQ ID NO: 318207 - DNA, 20 bp, Artificial Sequence
  chemically synthesized
ggtgttttctctttataagt

SEQ ID NO: 318208 - DNA, 20 bp, Artificial Sequence
  chemically synthesized
gtttctgtatcccacttata

SEQ ID NO: 318209 - DNA, 20 bp, Artificial Sequence
  chemically synthesized
ttctctttataagtgggata

SEQ ID NO: 318210 - DNA, 20 bp, Artificial Sequence
  chemically synthesized
aagtgggatacagaaacatc

SEQ ID NO: 318211 - DNA, 20 bp, Artificial Sequence
  chemically synthesized
gggatacagaaacatctggt

SEQ ID NO: 318212 - DNA, 20 bp, Artificial Sequence
  chemically synthesized
ggatacagaaacatctggtt

SEQ ID NO: 318213 - DNA, 20 bp, Artificial Sequence
  chemically synthesized
gatacagaaacatctggttg

SEQ ID NO: 318214 - DNA, 20 bp, Artificial Sequence
  chemically synthesized
ctaccccaaaaatccccaac

SEQ ID NO: 318215 - DNA, 20 bp, Artificial Sequence
  chemically synthesized
aacatctggttggggatttt

SEQ ID NO: 318216 - DNA, 20 bp, Artificial Sequence
  chemically synthesized
acatctggttggggattttt

SEQ ID NO: 318217 - DNA, 20 bp, Artificial Sequence
  chemically synthesized
catctggttggggatttttg

SEQ ID NO: 318218 - DNA, 20 bp, Artificial Sequence
  chemically synthesized
ctggttggggatttttgggg

SEQ ID NO: 318219 - DNA, 20 bp, Artificial Sequence
  chemically synthesized
tggttggggatttttggggt

SEQ ID NO: 318220 - DNA, 20 bp, Artificial Sequence
  chemically synthesized
ggttggggatttttggggta

SEQ ID NO: 318221 - DNA, 20 bp, Artificial Sequence
  chemically synthesized
gggatttttggggtagggac

SEQ ID NO: 318222 - DNA, 20 bp, Artificial Sequence
  chemically synthesized
ttttggggtagggaccagaa

SEQ ID NO: 318223 - DNA, 20 bp, Artificial Sequence
  chemically synthesized
ggggtagggaccagaatggc

SEQ ID NO: 318224 - DNA, 20 bp, Artificial Sequence
  chemically synthesized
ttgcacacacccagccattc

SEQ ID NO: 318225 - DNA, 20 bp, Artificial Sequence
  chemically synthesized
gggtagggaccagaatggct

SEQ ID NO: 318226 - DNA, 20 bp, Artificial Sequence
  chemically synthesized
ccatcccgtttgcacacacc

SEQ ID NO: 318227 - DNA, 20 bp, Artificial Sequence
  chemically synthesized
aatggctgggtgtgtgcaaa

SEQ ID NO: 318228 - DNA, 20 bp, Artificial Sequence
  chemically synthesized
atggctgggtgtgtgcaaac

SEQ ID NO: 318229 - DNA, 20 bp, Artificial Sequence
  chemically synthesized
ctgggtgtgtgcaaacggga

SEQ ID NO: 318230 - DNA, 20 bp, Artificial Sequence
  chemically synthesized
gtaccagtcattaaaatatt

SEQ ID NO: 318231 - DNA, 20 bp, Artificial Sequence
  chemically synthesized
tggctcaatattttaatgac

SEQ ID NO: 318232 - DNA, 20 bp, Artificial Sequence
  chemically synthesized
caatattttaatgactggta

SEQ ID NO: 318233 - DNA, 20 bp, Artificial Sequence
  chemically synthesized
agacattgatgtgactgtac

SEQ ID NO: 318234 - DNA, 20 bp, Artificial Sequence
  chemically synthesized
acagtcacatcaatgtctcc

SEQ ID NO: 318235 - DNA, 20 bp, Artificial Sequence
  chemically synthesized
gcagggctctatttggctgg

SEQ ID NO: 318236 - DNA, 20 bp, Artificial Sequence
  chemically synthesized
atcaatgtctcccagccaaa

SEQ ID NO: 318237 - DNA, 20 bp, Artificial Sequence
  chemically synthesized
aagcagggctctatttggct

SEQ ID NO: 318238 - DNA, 20 bp, Artificial Sequence
  chemically synthesized
aaagcagggctctatttggc

SEQ ID NO: 318239 - DNA, 20 bp, Artificial Sequence
  chemically synthesized
caatgtctcccagccaaata

SEQ ID NO: 318240 - DNA, 20 bp, Artificial Sequence
  chemically synthesized
agaaaaagcagggctctatt

SEQ ID NO: 318241 - DNA, 20 bp, Artificial Sequence
  chemically synthesized
taatgaagagagaaaaagca

SEQ ID NO: 318242 - DNA, 20 bp, Artificial Sequence
  chemically synthesized
ctaatgaagagagaaaaagc

SEQ ID NO: 318243 - DNA, 20 bp, Artificial Sequence
  chemically synthesized
actaatgaagagagaaaaag

SEQ ID NO: 318244 - DNA, 20 bp, Artificial Sequence
  chemically synthesized
accactaatgaagagagaaa

SEQ ID NO: 318245 - DNA, 20 bp, Artificial Sequence
  chemically synthesized
cctgctttttctctcttcat

SEQ ID NO: 318246 - DNA, 20 bp, Artificial Sequence
  chemically synthesized
ttcagaaccactaatgaaga

SEQ ID NO: 318247 - DNA, 20 bp, Artificial Sequence
  chemically synthesized
ctttcagaaccactaatgaa

SEQ ID NO: 318248 - DNA, 20 bp, Artificial Sequence
  chemically synthesized
gctttttctctcttcattag

SEQ ID NO: 318249 - DNA, 20 bp, Artificial Sequence
  chemically synthesized
cactttcagaaccactaatg

SEQ ID NO: 318250 - DNA, 20 bp, Artificial Sequence
  chemically synthesized
ctcttcattagtggttctga

SEQ ID NO: 318251 - DNA, 20 bp, Artificial Sequence
  chemically synthesized
cattagtggttctgaaagtg

SEQ ID NO: 318252 - DNA, 20 bp, Artificial Sequence
  chemically synthesized
gggtccagtaaccacacttt

SEQ ID NO: 318253 - DNA, 20 bp, Artificial Sequence
  chemically synthesized
ggttctgaaagtgtggttac

SEQ ID NO: 318254 - DNA, 20 bp, Artificial Sequence
  chemically synthesized
aaagtgtggttactggaccc

SEQ ID NO: 318255 - DNA, 20 bp, Artificial Sequence
  chemically synthesized
gatgctgttggtccagggtc

SEQ ID NO: 318256 - DNA, 20 bp, Artificial Sequence
  chemically synthesized
gggctgatgctgttggtcca

SEQ ID NO: 318257 - DNA, 20 bp, Artificial Sequence
  chemically synthesized
gttactggaccctggaccaa

SEQ ID NO: 318258 - DNA, 20 bp, Artificial Sequence
  chemically synthesized
tgggctgatgctgttggtcc

SEQ ID NO: 318259 - DNA, 20 bp, Artificial Sequence
  chemically synthesized
atgggctgatgctgttggtc

SEQ ID NO: 318260 - DNA, 20 bp, Artificial Sequence
  chemically synthesized
ggaccctggaccaacagcat

SEQ ID NO: 318261 - DNA, 20 bp, Artificial Sequence
  chemically synthesized
aggggatgggctgatgctgt

SEQ ID NO: 318262 - DNA, 20 bp, Artificial Sequence
  chemically synthesized
aacagcatcagcccatcccc

SEQ ID NO: 318263 - DNA, 20 bp, Artificial Sequence
  chemically synthesized
ctagcaagtttctaggggat

SEQ ID NO: 318264 - DNA, 20 bp, Artificial Sequence
  chemically synthesized
tctagcaagtttctagggga

SEQ ID NO: 318265 - DNA, 20 bp, Artificial Sequence
  chemically synthesized
cacttctagcaagtttctag

SEQ ID NO: 318266 - DNA, 20 bp, Artificial Sequence
  chemically synthesized
gcacttctagcaagtttcta

SEQ ID NO: 318267 - DNA, 20 bp, Artificial Sequence
  chemically synthesized
tgcacttctagcaagtttct

SEQ ID NO: 318268 - DNA, 20 bp, Artificial Sequence
  chemically synthesized
ttgcacttctagcaagtttc

SEQ ID NO: 318269 - DNA, 20 bp, Artificial Sequence
  chemically synthesized
cccatcccctagaaacttgc

SEQ ID NO: 318270 - DNA, 20 bp, Artificial Sequence
  chemically synthesized
atcccctagaaacttgctag

SEQ ID NO: 318271 - DNA, 20 bp, Artificial Sequence
  chemically synthesized
tttgaatttgcacttctagc

SEQ ID NO: 318272 - DNA, 20 bp, Artificial Sequence
  chemically synthesized
aagttttgaatttgcacttc

SEQ ID NO: 318273 - DNA, 20 bp, Artificial Sequence
  chemically synthesized
agtgcaaattcaaaacttgc

SEQ ID NO: 318274 - DNA, 20 bp, Artificial Sequence
  chemically synthesized
gcaaattcaaaacttgctag

SEQ ID NO: 318275 - DNA, 20 bp, Artificial Sequence
  chemically synthesized
gtcttgcacacacttctagc

SEQ ID NO: 318276 - DNA, 20 bp, Artificial Sequence
  chemically synthesized
gtgagtcttgcacacacttc

SEQ ID NO: 318277 - DNA, 20 bp, Artificial Sequence
  chemically synthesized
aacttgctagaagtgtgtgc

SEQ ID NO: 318278 - DNA, 20 bp, Artificial Sequence
  chemically synthesized
gtttctgattcagtaagtgt

SEQ ID NO: 318279 - DNA, 20 bp, Artificial Sequence
  chemically synthesized
aagactcacacttactgaat

SEQ ID NO: 318280 - DNA, 20 bp, Artificial Sequence
  chemically synthesized
cccagagtttctgattcagt

SEQ ID NO: 318281 - DNA, 20 bp, Artificial Sequence
  chemically synthesized
tcatcccagagtttctgatt

SEQ ID NO: 318282 - DNA, 20 bp, Artificial Sequence
  chemically synthesized
acttactgaatcagaaactc

SEQ ID NO: 318283 - DNA, 20 bp, Artificial Sequence
  chemically synthesized
cttactgaatcagaaactct

SEQ ID NO: 318284 - DNA, 20 bp, Artificial Sequence
  chemically synthesized
tgaatcagaaactctgggat

SEQ ID NO: 318285 - DNA, 20 bp, Artificial Sequence
  chemically synthesized
gaatcagaaactctgggatg

SEQ ID NO: 318286 - DNA, 20 bp, Artificial Sequence
  chemically synthesized
catttctagacctcatccca

SEQ ID NO: 318287 - DNA, 20 bp, Artificial Sequence
  chemically synthesized
cacatttctagacctcatcc

SEQ ID NO: 318288 - DNA, 20 bp, Artificial Sequence
  chemically synthesized
agaaactctgggatgaggtc

SEQ ID NO: 318289 - DNA, 20 bp, Artificial Sequence
  chemically synthesized
cctgttaaaatacacatttc

SEQ ID NO: 318290 - DNA, 20 bp, Artificial Sequence
  chemically synthesized
tctagaaatgtgtattttaa

SEQ ID NO: 318291 - DNA, 20 bp, Artificial Sequence
  chemically synthesized
ctagaaatgtgtattttaac

SEQ ID NO: 318292 - DNA, 20 bp, Artificial Sequence
  chemically synthesized
gtgtattttaacaggacttc

SEQ ID NO: 318293 - DNA, 20 bp, Artificial Sequence
  chemically synthesized
tgtattttaacaggacttcc

SEQ ID NO: 318294 - DNA, 20 bp, Artificial Sequence
  chemically synthesized
agtatgcatcagtcacctgg

SEQ ID NO: 318295 - DNA, 20 bp, Artificial Sequence
  chemically synthesized
gtgagtatgcatcagtcacc

SEQ ID NO: 318296 - DNA, 20 bp, Artificial Sequence
  chemically synthesized
tttcaagtgtgagtatgcat

SEQ ID NO: 318297 - DNA, 20 bp, Artificial Sequence
  chemically synthesized
gagcagtaattttcaagtgt

SEQ ID NO: 318298 - DNA, 20 bp, Artificial Sequence
  chemically synthesized
tacctagagcagtaattttc

SEQ ID NO: 318299 - DNA, 20 bp, Artificial Sequence
  chemically synthesized
acacttgaaaattactgctc

SEQ ID NO: 318300 - DNA, 20 bp, Artificial Sequence
  chemically synthesized
cacttgaaaattactgctct

SEQ ID NO: 318301 - DNA, 20 bp, Artificial Sequence
  chemically synthesized
tagaataaagttacctagag

SEQ ID NO: 318302 - DNA, 20 bp, Artificial Sequence
  chemically synthesized
ttgtagaataaagttaccta

SEQ ID NO: 318303 - DNA, 20 bp, Artificial Sequence
  chemically synthesized
gtttgtagaataaagttacc

SEQ ID NO: 318304 - DNA, 20 bp, Artificial Sequence
  chemically synthesized
tgagttgtgtttgtagaata

SEQ ID NO: 318305 - DNA, 20 bp, Artificial Sequence
  chemically synthesized
atttgggtgagttgtgtttg

SEQ ID NO: 318306 - DNA, 20 bp, Artificial Sequence
  chemically synthesized
ggtctctgcagaatttgggt

SEQ ID NO: 318307 - DNA, 20 bp, Artificial Sequence
  chemically synthesized
tcttggtctctgcagaattt

SEQ ID NO: 318308 - DNA, 20 bp, Artificial Sequence
  chemically synthesized
cacaactcacccaaattctg

SEQ ID NO: 318309 - DNA, 20 bp, Artificial Sequence
  chemically synthesized
atcttggtctctgcagaatt

SEQ ID NO: 318310 - DNA, 20 bp, Artificial Sequence
  chemically synthesized
caactcacccaaattctgca

SEQ ID NO: 318311 - DNA, 20 bp, Artificial Sequence
  chemically synthesized
tgttaatatcttggtctctg

SEQ ID NO: 318312 - DNA, 20 bp, Artificial Sequence
  chemically synthesized
acccaaattctgcagagacc

SEQ ID NO: 318313 - DNA, 20 bp, Artificial Sequence
  chemically synthesized
tcctattaatgttaatatct

SEQ ID NO: 318314 - DNA, 20 bp, Artificial Sequence
  chemically synthesized
gaccaagatattaacattaa

SEQ ID NO: 318315 - DNA, 20 bp, Artificial Sequence
  chemically synthesized
accaagatattaacattaat

SEQ ID NO: 318316 - DNA, 20 bp, Artificial Sequence
  chemically synthesized
caagatattaacattaatag

SEQ ID NO: 318317 - DNA, 20 bp, Artificial Sequence
  chemically synthesized
aagatattaacattaatagg

SEQ ID NO: 318318 - DNA, 20 bp, Artificial Sequence
  chemically synthesized
agtaatctcctggggattgg

SEQ ID NO: 318319 - DNA, 20 bp, Artificial Sequence
  chemically synthesized
ggaggacaactgccaatccc

SEQ ID NO: 318320 - DNA, 20 bp, Artificial Sequence
  chemically synthesized
gaggacaactgccaatcccc

SEQ ID NO: 318321 - DNA, 20 bp, Artificial Sequence
  chemically synthesized
catagtaatctcctggggat

SEQ ID NO: 318322 - DNA, 20 bp, Artificial Sequence
  chemically synthesized
ggacaactgccaatccccag

SEQ ID NO: 318323 - DNA, 20 bp, Artificial Sequence
  chemically synthesized
taattcatagtaatctcctg

SEQ ID NO: 318324 - DNA, 20 bp, Artificial Sequence
  chemically synthesized
ataattcatagtaatctcct

SEQ ID NO: 318325 - DNA, 20 bp, Artificial Sequence
  chemically synthesized
aataattcatagtaatctcc

SEQ ID NO: 318326 - DNA, 20 bp, Artificial Sequence
  chemically synthesized
tctcatgtcaaaataattca

SEQ ID NO: 318327 - DNA, 20 bp, Artificial Sequence
  chemically synthesized
actatgaattattttgacat

SEQ ID NO: 318328 - DNA, 20 bp, Artificial Sequence
  chemically synthesized
aagtcaggaagagaatgtaa

SEQ ID NO: 318329 - DNA, 20 bp, Artificial Sequence
  chemically synthesized
agtggaggtgaagtcaggaa

SEQ ID NO: 318330 - DNA, 20 bp, Artificial Sequence
  chemically synthesized
taagtggaggtgaagtcagg

SEQ ID NO: 318331 - DNA, 20 bp, Artificial Sequence
  chemically synthesized
ctgtaagtggaggtgaagtc

SEQ ID NO: 318332 - DNA, 20 bp, Artificial Sequence
  chemically synthesized
tctgtaagtggaggtgaagt

SEQ ID NO: 318333 - DNA, 20 bp, Artificial Sequence
  chemically synthesized
tctctctgtaagtggaggtg

SEQ ID NO: 318334 - DNA, 20 bp, Artificial Sequence
  chemically synthesized
cctgacttcacctccactta

SEQ ID NO: 318335 - DNA, 20 bp, Artificial Sequence
  chemically synthesized
acacttctctctgtaagtgg

SEQ ID NO: 318336 - DNA, 20 bp, Artificial Sequence
  chemically synthesized
cacacttctctctgtaagtg

SEQ ID NO: 318337 - DNA, 20 bp, Artificial Sequence
  chemically synthesized
tgacttcacctccacttaca

SEQ ID NO: 318338 - DNA, 20 bp, Artificial Sequence
  chemically synthesized
gtcacacttctctctgtaag

SEQ ID NO: 318339 - DNA, 20 bp, Artificial Sequence
  chemically synthesized
acttcacctccacttacaga

SEQ ID NO: 318340 - DNA, 20 bp, Artificial Sequence
  chemically synthesized
gcagtcacacttctctctgt

SEQ ID NO: 318341 - DNA, 20 bp, Artificial Sequence
  chemically synthesized
tcacctccacttacagagag

SEQ ID NO: 318342 - DNA, 20 bp, Artificial Sequence
  chemically synthesized
acccattctttggcagttgg

SEQ ID NO: 318343 - DNA, 20 bp, Artificial Sequence
  chemically synthesized
agtgtgactgccaactgcca

SEQ ID NO: 318344 - DNA, 20 bp, Artificial Sequence
  chemically synthesized
agaacccattctttggcagt

SEQ ID NO: 318345 - DNA, 20 bp, Artificial Sequence
  chemically synthesized
aggtagaacccattctttgg

SEQ ID NO: 318346 - DNA, 20 bp, Artificial Sequence
  chemically synthesized
gactgccaactgccaaagaa

SEQ ID NO: 318347 - DNA, 20 bp, Artificial Sequence
  chemically synthesized
actgccaactgccaaagaat

SEQ ID NO: 318348 - DNA, 20 bp, Artificial Sequence
  chemically synthesized
ctcaggtagaacccattctt

SEQ ID NO: 318349 - DNA, 20 bp, Artificial Sequence
  chemically synthesized
ccaaagaatgggttctacct

SEQ ID NO: 318350 - DNA, 20 bp, Artificial Sequence
  chemically synthesized
caaagaatgggttctacctg

SEQ ID NO: 318351 - DNA, 20 bp, Artificial Sequence
  chemically synthesized
ctgctttttggagcctcagg

SEQ ID NO: 318352 - DNA, 20 bp, Artificial Sequence
  chemically synthesized
atcctgctttttggagcctc

SEQ ID NO: 318353 - DNA, 20 bp, Artificial Sequence
  chemically synthesized
aatcctgctttttggagcct

SEQ ID NO: 318354 - DNA, 20 bp, Artificial Sequence
  chemically synthesized
gttctacctgaggctccaaa

SEQ ID NO: 318355 - DNA, 20 bp, Artificial Sequence
  chemically synthesized
ctacctgaggctccaaaaag

SEQ ID NO: 318356 - DNA, 20 bp, Artificial Sequence
  chemically synthesized
acatgaaatcctgctttttg

SEQ ID NO: 318357 - DNA, 20 bp, Artificial Sequence
  chemically synthesized
tacctgaggctccaaaaagc

SEQ ID NO: 318358 - DNA, 20 bp, Artificial Sequence
  chemically synthesized
acacatgaaatcctgctttt

SEQ ID NO: 318359 - DNA, 20 bp, Artificial Sequence
  chemically synthesized
agcaggatttcatgtgtctg

SEQ ID NO: 318360 - DNA, 20 bp, Artificial Sequence
  chemically synthesized
ctgaggttaatttcatgctt

SEQ ID NO: 318361 - DNA, 20 bp, Artificial Sequence
  chemically synthesized
ctgaagcatgaaattaacct

SEQ ID NO: 318362 - DNA, 20 bp, Artificial Sequence
  chemically synthesized
catgaaattaacctcagaac

SEQ ID NO: 318363 - DNA, 20 bp, Artificial Sequence
  chemically synthesized
ctgttttcaaacttgttctg

SEQ ID NO: 318364 - DNA, 20 bp, Artificial Sequence
  chemically synthesized
tctgttttcaaacttgttct

SEQ ID NO: 318365 - DNA, 20 bp, Artificial Sequence
  chemically synthesized
cctcagaacaagtttgaaaa

SEQ ID NO: 318366 - DNA, 20 bp, Artificial Sequence
  chemically synthesized
cagaacaagtttgaaaacag

SEQ ID NO: 318367 - DNA, 20 bp, Artificial Sequence
  chemically synthesized
gtttgaaaacagaagaacct

SEQ ID NO: 318368 - DNA, 20 bp, Artificial Sequence
  chemically synthesized
tttgaaaacagaagaaccta

SEQ ID NO: 318369 - DNA, 20 bp, Artificial Sequence
  chemically synthesized
atcacacctccacaatcctt

SEQ ID NO: 318370 - DNA, 20 bp, Artificial Sequence
  chemically synthesized
acagaagaacctaaggattg

SEQ ID NO: 318371 - DNA, 20 bp, Artificial Sequence
  chemically synthesized
tatcacacctccacaatcct

SEQ ID NO: 318372 - DNA, 20 bp, Artificial Sequence
  chemically synthesized
agaagaacctaaggattgtg

SEQ ID NO: 318373 - DNA, 20 bp, Artificial Sequence
  chemically synthesized
gaagaacctaaggattgtgg

SEQ ID NO: 318374 - DNA, 20 bp, Artificial Sequence
  chemically synthesized
tgtggaggtgtgatactaat

SEQ ID NO: 318375 - DNA, 20 bp, Artificial Sequence
  chemically synthesized
ctttttgttttcgtgcttat

SEQ ID NO: 318376 - DNA, 20 bp, Artificial Sequence
  chemically synthesized
ctaataagcacgaaaacaaa

SEQ ID NO: 318377 - DNA, 20 bp, Artificial Sequence
  chemically synthesized
aaaagcattcatcccattgt

SEQ ID NO: 318378 - DNA, 20 bp, Artificial Sequence
  chemically synthesized
tcagaatcctttccaacaat

SEQ ID NO: 318379 - DNA, 20 bp, Artificial Sequence
  chemically synthesized
ctcagaatcctttccaacaa

SEQ ID NO: 318380 - DNA, 20 bp, Artificial Sequence
  chemically synthesized
gcattcatcccattgttgga

SEQ ID NO: 318381 - DNA, 20 bp, Artificial Sequence
  chemically synthesized
cattcatcccattgttggaa

SEQ ID NO: 318382 - DNA, 20 bp, Artificial Sequence
  chemically synthesized
ccattgttggaaaggattct

SEQ ID NO: 318383 - DNA, 20 bp, Artificial Sequence
  chemically synthesized
ttttctcaattaaaacatct

SEQ ID NO: 318384 - DNA, 20 bp, Artificial Sequence
  chemically synthesized
gattctgagatgttttaatt

SEQ ID NO: 318385 - DNA, 20 bp, Artificial Sequence
  chemically synthesized
tcaaggcctgtagtaaggaa

SEQ ID NO: 318386 - DNA, 20 bp, Artificial Sequence
  chemically synthesized
aatatttcttttccttacta

SEQ ID NO: 318387 - DNA, 20 bp, Artificial Sequence
  chemically synthesized
atatttcttttccttactac

SEQ ID NO: 318388 - DNA, 20 bp, Artificial Sequence
  chemically synthesized
tctagtcaaggcctgtagta

SEQ ID NO: 318389 - DNA, 20 bp, Artificial Sequence
  chemically synthesized
atctagtcaaggcctgtagt

SEQ ID NO: 318390 - DNA, 20 bp, Artificial Sequence
  chemically synthesized
taatatctagtcaaggcctg

SEQ ID NO: 318391 - DNA, 20 bp, Artificial Sequence
  chemically synthesized
tccttactacaggccttgac

SEQ ID NO: 318392 - DNA, 20 bp, Artificial Sequence
  chemically synthesized
tatttgctaatatctagtca

SEQ ID NO: 318393 - DNA, 20 bp, Artificial Sequence
  chemically synthesized
ctatttgctaatatctagtc

SEQ ID NO: 318394 - DNA, 20 bp, Artificial Sequence
  chemically synthesized
tacaggccttgactagatat

SEQ ID NO: 318395 - DNA, 20 bp, Artificial Sequence
  chemically synthesized
gactactatttgctaatatc

SEQ ID NO: 318396 - DNA, 20 bp, Artificial Sequence
  chemically synthesized
cttgactagatattagcaaa

SEQ ID NO: 318397 - DNA, 20 bp, Artificial Sequence
  chemically synthesized
gactagatattagcaaatag

SEQ ID NO: 318398 - DNA, 20 bp, Artificial Sequence
  chemically synthesized
gcaaatagtagtccatatgc

SEQ ID NO: 318399 - DNA, 20 bp, Artificial Sequence
  chemically synthesized
atgagaccaaatccagcata

SEQ ID NO: 318400 - DNA, 20 bp, Artificial Sequence
  chemically synthesized
agtagtccatatgctggatt

SEQ ID NO: 318401 - DNA, 20 bp, Artificial Sequence
  chemically synthesized
aattagtatgagaccaaatc

SEQ ID NO: 318402 - DNA, 20 bp, Artificial Sequence
  chemically synthesized
aatttattttcaattagtat

SEQ ID NO: 318403 - DNA, 20 bp, Artificial Sequence
  chemically synthesized
aatttcaatttattttcaat

SEQ ID NO: 318404 - DNA, 20 bp, Artificial Sequence
  chemically synthesized
aaataaattgaaatttttgc

SEQ ID NO: 318405 - DNA, 20 bp, Artificial Sequence
  chemically synthesized
taaattgaaatttttgccag

SEQ ID NO: 318406 - DNA, 20 bp, Artificial Sequence
  chemically synthesized
atatctcaaattttaactac

SEQ ID NO: 318407 - DNA, 20 bp, Artificial Sequence
  chemically synthesized
tttgccagtagttaaaattt

SEQ ID NO: 318408 - DNA, 20 bp, Artificial Sequence
  chemically synthesized
gtagttaaaatttgagatat

SEQ ID NO: 318409 - DNA, 20 bp, Artificial Sequence
  chemically synthesized
gtggtcagatttgatatttg

SEQ ID NO: 318410 - DNA, 20 bp, Artificial Sequence
  chemically synthesized
taaatatgatcaagagtggt

SEQ ID NO: 318411 - DNA, 20 bp, Artificial Sequence
  chemically synthesized
ctattaaatatgatcaagag

SEQ ID NO: 318412 - DNA, 20 bp, Artificial Sequence
  chemically synthesized
atcctattaaatatgatcaa

SEQ ID NO: 318413 - DNA, 20 bp, Artificial Sequence
  chemically synthesized
gaatcctattaaatatgatc

SEQ ID NO: 318414 - DNA, 20 bp, Artificial Sequence
  chemically synthesized
ccactcttgatcatatttaa

SEQ ID NO: 318415 - DNA, 20 bp, Artificial Sequence
  chemically synthesized
cactcttgatcatatttaat

SEQ ID NO: 318416 - DNA, 20 bp, Artificial Sequence
  chemically synthesized
tgatcatatttaataggatt

SEQ ID NO: 318417 - DNA, 20 bp, Artificial Sequence
  chemically synthesized
cctataggaaggaaggttta

SEQ ID NO: 318418 - DNA, 20 bp, Artificial Sequence
  chemically synthesized
tcctataggaaggaaggttt

SEQ ID NO: 318419 - DNA, 20 bp, Artificial Sequence
  chemically synthesized
gtcctataggaaggaaggtt

SEQ ID NO: 318420 - DNA, 20 bp, Artificial Sequence
  chemically synthesized
attttgtcctataggaagga

SEQ ID NO: 318421 - DNA, 20 bp, Artificial Sequence
  chemically synthesized
aattttgtcctataggaagg

SEQ ID NO: 318422 - DNA, 20 bp, Artificial Sequence
  chemically synthesized
accctaaaccttccttccta

SEQ ID NO: 318423 - DNA, 20 bp, Artificial Sequence
  chemically synthesized
ccctaaaccttccttcctat

SEQ ID NO: 318424 - DNA, 20 bp, Artificial Sequence
  chemically synthesized
ctcaattttgtcctatagga

SEQ ID NO: 318425 - DNA, 20 bp, Artificial Sequence
  chemically synthesized
actcaattttgtcctatagg

SEQ ID NO: 318426 - DNA, 20 bp, Artificial Sequence
  chemically synthesized
gatactcaattttgtcctat

SEQ ID NO: 318427 - DNA, 20 bp, Artificial Sequence
  chemically synthesized
tgatactcaattttgtccta

SEQ ID NO: 318428 - DNA, 20 bp, Artificial Sequence
  chemically synthesized
ccttcctataggacaaaatt

SEQ ID NO: 318429 - DNA, 20 bp, Artificial Sequence
  chemically synthesized
gcgaagtataattggatgtg

SEQ ID NO: 318430 - DNA, 20 bp, Artificial Sequence
  chemically synthesized
aattggatgcgaagtataat

SEQ ID NO: 318431 - DNA, 20 bp, Artificial Sequence
  chemically synthesized
atgaagtataattggatgcg

SEQ ID NO: 318432 - DNA, 20 bp, Artificial Sequence
  chemically synthesized
ctttgtatatgaagtataat

SEQ ID NO: 318433 - DNA, 20 bp, Artificial Sequence
  chemically synthesized
gagcttatactttgtatatg

SEQ ID NO: 318434 - DNA, 20 bp, Artificial Sequence
  chemically synthesized
ccaattatacttcatataca

SEQ ID NO: 318435 - DNA, 20 bp, Artificial Sequence
  chemically synthesized
atacttcatatacaaagtat

SEQ ID NO: 318436 - DNA, 20 bp, Artificial Sequence
  chemically synthesized
tatacaaagtataagctctc

SEQ ID NO: 318437 - DNA, 20 bp, Artificial Sequence
  chemically synthesized
gaggactacagcaaactgga

SEQ ID NO: 318438 - DNA, 20 bp, Artificial Sequence
  chemically synthesized
atgaggactacagcaaactg

SEQ ID NO: 318439 - DNA, 20 bp, Artificial Sequence
  chemically synthesized
tgatgaggactacagcaaac

SEQ ID NO: 318440 - DNA, 20 bp, Artificial Sequence
  chemically synthesized
ataagctctccagtttgctg

SEQ ID NO: 318441 - DNA, 20 bp, Artificial Sequence
  chemically synthesized
atagggagtgatgaggacta

SEQ ID NO: 318442 - DNA, 20 bp, Artificial Sequence
  chemically synthesized
aaaaaggatagggagtgatg

SEQ ID NO: 318443 - DNA, 20 bp, Artificial Sequence
  chemically synthesized
aaaaaaggatagggagtgat

SEQ ID NO: 318444 - DNA, 20 bp, Artificial Sequence
  chemically synthesized
tgcgtataaaaaaggatagg

SEQ ID NO: 318445 - DNA, 20 bp, Artificial Sequence
  chemically synthesized
gttgcgtataaaaaaggata

SEQ ID NO: 318446 - DNA, 20 bp, Artificial Sequence
  chemically synthesized
agttgcgtataaaaaaggat

SEQ ID NO: 318447 - DNA, 20 bp, Artificial Sequence
  chemically synthesized
gagttgcgtataaaaaagga

SEQ ID NO: 318448 - DNA, 20 bp, Artificial Sequence
  chemically synthesized
agatgagttgcgtataaaaa

SEQ ID NO: 318449 - DNA, 20 bp, Artificial Sequence
  chemically synthesized
gagatgagttgcgtataaaa

SEQ ID NO: 318450 - DNA, 20 bp, Artificial Sequence
  chemically synthesized
ataacataaggaagtgagat

SEQ ID NO: 318451 - DNA, 20 bp, Artificial Sequence
  chemically synthesized
gaaacataacataaggaagt

SEQ ID NO: 318452 - DNA, 20 bp, Artificial Sequence
  chemically synthesized
gccagaaacataacataagg

SEQ ID NO: 318453 - DNA, 20 bp, Artificial Sequence
  chemically synthesized
gaagccagaaacataacata

SEQ ID NO: 318454 - DNA, 20 bp, Artificial Sequence
  chemically synthesized
agaagccagaaacataacat

SEQ ID NO: 318455 - DNA, 20 bp, Artificial Sequence
  chemically synthesized
acttccttatgttatgtttc

SEQ ID NO: 318456 - DNA, 20 bp, Artificial Sequence
  chemically synthesized
caaatgcctattgtagaagc

SEQ ID NO: 318457 - DNA, 20 bp, Artificial Sequence
  chemically synthesized
tatgtttctggcttctacaa

SEQ ID NO: 318458 - DNA, 20 bp, Artificial Sequence
  chemically synthesized
atgtttctggcttctacaat

SEQ ID NO: 318459 - DNA, 20 bp, Artificial Sequence
  chemically synthesized
aatccaaatgcctattgtag

SEQ ID NO: 318460 - DNA, 20 bp, Artificial Sequence
  chemically synthesized
ccaaatccaaatgcctattg

SEQ ID NO: 318461 - DNA, 20 bp, Artificial Sequence
  chemically synthesized
tggcttctacaataggcatt

SEQ ID NO: 318462 - DNA, 20 bp, Artificial Sequence
  chemically synthesized
ctacaataggcatttggatt

SEQ ID NO: 318463 - DNA, 20 bp, Artificial Sequence
  chemically synthesized
catttggatttggtgccccc

SEQ ID NO: 318464 - DNA, 20 bp, Artificial Sequence
  chemically synthesized
atttggatttggtgcccccc

SEQ ID NO: 318465 - DNA, 20 bp, Artificial Sequence
  chemically synthesized
tttggatttggtgccccccg

SEQ ID NO: 318466 - DNA, 20 bp, Artificial Sequence
  chemically synthesized
gctgtgatcaagaccccggg

SEQ ID NO: 318467 - DNA, 20 bp, Artificial Sequence
  chemically synthesized
agctgtgatcaagaccccgg

SEQ ID NO: 318468 - DNA, 20 bp, Artificial Sequence
  chemically synthesized
aagctgtgatcaagaccccg

SEQ ID NO: 318469 - DNA, 20 bp, Artificial Sequence
  chemically synthesized
gaagctgtgatcaagacccc

SEQ ID NO: 318470 - DNA, 20 bp, Artificial Sequence
  chemically synthesized
agaagctgtgatcaagaccc

SEQ ID NO: 318471 - DNA, 20 bp, Artificial Sequence
  chemically synthesized
gccccccggggtcttgatca

SEQ ID NO: 318472 - DNA, 20 bp, Artificial Sequence
  chemically synthesized
aagtttgagaagctgtgatc

SEQ ID NO: 318473 - DNA, 20 bp, Artificial Sequence
  chemically synthesized
tatccatatttaagtttgag

SEQ ID NO: 318474 - DNA, 20 bp, Artificial Sequence
  chemically synthesized
ctgtatccatatttaagttt

SEQ ID NO: 318475 - DNA, 20 bp, Artificial Sequence
  chemically synthesized
cagcttctcaaacttaaata

SEQ ID NO: 318476 - DNA, 20 bp, Artificial Sequence
  chemically synthesized
ggtgggctgtatccatattt

SEQ ID NO: 318477 - DNA, 20 bp, Artificial Sequence
  chemically synthesized
ctcaaacttaaatatggata

SEQ ID NO: 318478 - DNA, 20 bp, Artificial Sequence
  chemically synthesized
aaatatggatacagcccacc

SEQ ID NO: 318479 - DNA, 20 bp, Artificial Sequence
  chemically synthesized
ttaaatcagaatcaccaggt

SEQ ID NO: 318480 - DNA, 20 bp, Artificial Sequence
  chemically synthesized
tttaaatcagaatcaccagg

SEQ ID NO: 318481 - DNA, 20 bp, Artificial Sequence
  chemically synthesized
gaatttaaatcagaatcacc

SEQ ID NO: 318482 - DNA, 20 bp, Artificial Sequence
  chemically synthesized
tgaatttaaatcagaatcac

SEQ ID NO: 318483 - DNA, 20 bp, Artificial Sequence
  chemically synthesized
ccaaccccgtgaatttaaat

SEQ ID NO: 318484 - DNA, 20 bp, Artificial Sequence
  chemically synthesized
gtgattctgatttaaattca

SEQ ID NO: 318485 - DNA, 20 bp, Artificial Sequence
  chemically synthesized
tgattctgatttaaattcac

SEQ ID NO: 318486 - DNA, 20 bp, Artificial Sequence
  chemically synthesized
gattctgatttaaattcacg

SEQ ID NO: 318487 - DNA, 20 bp, Artificial Sequence
  chemically synthesized
ctgatttaaattcacggggt

SEQ ID NO: 318488 - DNA, 20 bp, Artificial Sequence
  chemically synthesized
tgatttaaattcacggggtt

SEQ ID NO: 318489 - DNA, 20 bp, Artificial Sequence
  chemically synthesized
aaattcacggggttgggtcg

SEQ ID NO: 318490 - DNA, 20 bp, Artificial Sequence
  chemically synthesized
cggggttgggtcgaagaatt

SEQ ID NO: 318491 - DNA, 20 bp, Artificial Sequence
  chemically synthesized
tcgaagaattcagttctaac

SEQ ID NO: 318492 - DNA, 20 bp, Artificial Sequence
  chemically synthesized
ggtttcacctggaagctggt

SEQ ID NO: 318493 - DNA, 20 bp, Artificial Sequence
  chemically synthesized
attcagttctaaccagcttc

SEQ ID NO: 318494 - DNA, 20 bp, Artificial Sequence
  chemically synthesized
ttcagttctaaccagcttcc

SEQ ID NO: 318495 - DNA, 20 bp, Artificial Sequence
  chemically synthesized
cattggtttcacctggaagc

SEQ ID NO: 318496 - DNA, 20 bp, Artificial Sequence
  chemically synthesized
gcaacattggtttcacctgg

SEQ ID NO: 318497 - DNA, 20 bp, Artificial Sequence
  chemically synthesized
ccagcaacattggtttcacc

SEQ ID NO: 318498 - DNA, 20 bp, Artificial Sequence
  chemically synthesized
ccaggtgaaaccaatgttgc

SEQ ID NO: 318499 - DNA, 20 bp, Artificial Sequence
  chemically synthesized
gatccatgacccagcaacat

SEQ ID NO: 318500 - DNA, 20 bp, Artificial Sequence
  chemically synthesized
caggtgaaaccaatgttgct

SEQ ID NO: 318501 - DNA, 20 bp, Artificial Sequence
  chemically synthesized
aaaccaatgttgctgggtca

SEQ ID NO: 318502 - DNA, 20 bp, Artificial Sequence
  chemically synthesized
tcaaagtgtgatccatgacc

SEQ ID NO: 318503 - DNA, 20 bp, Artificial Sequence
  chemically synthesized
acctggaatgttgtcattca

SEQ ID NO: 318504 - DNA, 20 bp, Artificial Sequence
  chemically synthesized
cactttgaatgacaacattc

SEQ ID NO: 318505 - DNA, 20 bp, Artificial Sequence
  chemically synthesized
actttgaatgacaacattcc

SEQ ID NO: 318506 - DNA, 20 bp, Artificial Sequence
  chemically synthesized
tgaatgacaacattccaggt

SEQ ID NO: 318507 - DNA, 20 bp, Artificial Sequence
  chemically synthesized
aaataaataatattcttacc

SEQ ID NO: 318508 - DNA, 20 bp, Artificial Sequence
  chemically synthesized
atttatttgaaaaccactgc

SEQ ID NO: 318509 - DNA, 20 bp, Artificial Sequence
  chemically synthesized
taccttaagtagactagcag

SEQ ID NO: 318510 - DNA, 20 bp, Artificial Sequence
  chemically synthesized
acataccttaagtagactag

SEQ ID NO: 318511 - DNA, 20 bp, Artificial Sequence
  chemically synthesized
aacacataccttaagtagac

SEQ ID NO: 318512 - DNA, 20 bp, Artificial Sequence
  chemically synthesized
aaaccactgctagtctactt

SEQ ID NO: 318513 - DNA, 20 bp, Artificial Sequence
  chemically synthesized
aaccactgctagtctactta

SEQ ID NO: 318514 - DNA, 20 bp, Artificial Sequence
  chemically synthesized
gatcgaacacataccttaag

SEQ ID NO: 318515 - DNA, 20 bp, Artificial Sequence
  chemically synthesized
atagatcgaacacatacctt

SEQ ID NO: 318516 - DNA, 20 bp, Artificial Sequence
  chemically synthesized
aaggtatgtgttcgatctat

SEQ ID NO: 318517 - DNA, 20 bp, Artificial Sequence
  chemically synthesized
gttttagcagtagtaactaa

SEQ ID NO: 318518 - DNA, 20 bp, Artificial Sequence
  chemically synthesized
tatcttctgagttttagcag

SEQ ID NO: 318519 - DNA, 20 bp, Artificial Sequence
  chemically synthesized
ctatatcttctgagttttag

SEQ ID NO: 318520 - DNA, 20 bp, Artificial Sequence
  chemically synthesized
tagttactactgctaaaact

SEQ ID NO: 318521 - DNA, 20 bp, Artificial Sequence
  chemically synthesized
aatctatatcttctgagttt

SEQ ID NO: 318522 - DNA, 20 bp, Artificial Sequence
  chemically synthesized
ttactactgctaaaactcag

SEQ ID NO: 318523 - DNA, 20 bp, Artificial Sequence
  chemically synthesized
cacataaatctatatcttct

SEQ ID NO: 318524 - DNA, 20 bp, Artificial Sequence
  chemically synthesized
ctgctaaaactcagaagata

SEQ ID NO: 318525 - DNA, 20 bp, Artificial Sequence
  chemically synthesized
gatatagatttatgtgacac

SEQ ID NO: 318526 - DNA, 20 bp, Artificial Sequence
  chemically synthesized
atagatttatgtgacactgg

SEQ ID NO: 318527 - DNA, 20 bp, Artificial Sequence
  chemically synthesized
tagatttatgtgacactggc

SEQ ID NO: 318528 - DNA, 20 bp, Artificial Sequence
  chemically synthesized
agatttatgtgacactggca

SEQ ID NO: 318529 - DNA, 20 bp, Artificial Sequence
  chemically synthesized
tttatgtgacactggcaggg

SEQ ID NO: 318530 - DNA, 20 bp, Artificial Sequence
  chemically synthesized
accctttgatacttccctgc

SEQ ID NO: 318531 - DNA, 20 bp, Artificial Sequence
  chemically synthesized
acactggcagggaagtatca

SEQ ID NO: 318532 - DNA, 20 bp, Artificial Sequence
  chemically synthesized
cactggcagggaagtatcaa

SEQ ID NO: 318533 - DNA, 20 bp, Artificial Sequence
  chemically synthesized
actggcagggaagtatcaaa

SEQ ID NO: 318534 - DNA, 20 bp, Artificial Sequence
  chemically synthesized
agggaagtatcaaagggtat

SEQ ID NO: 318535 - DNA, 20 bp, Artificial Sequence
  chemically synthesized
gtatcaaagggtatcagact

SEQ ID NO: 318536 - DNA, 20 bp, Artificial Sequence
  chemically synthesized
agggcatacttgggcattct

SEQ ID NO: 318537 - DNA, 20 bp, Artificial Sequence
  chemically synthesized
gtatcagactcagaatgccc

SEQ ID NO: 318538 - DNA, 20 bp, Artificial Sequence
  chemically synthesized
ctttactgaagggcatactt

SEQ ID NO: 318539 - DNA, 20 bp, Artificial Sequence
  chemically synthesized
actttactgaagggcatact

SEQ ID NO: 318540 - DNA, 20 bp, Artificial Sequence
  chemically synthesized
gaatgcccaagtatgccctt

SEQ ID NO: 318541 - DNA, 20 bp, Artificial Sequence
  chemically synthesized
cccaagtatgcccttcagta

SEQ ID NO: 318542 - DNA, 20 bp, Artificial Sequence
  chemically synthesized
cccttccttactttactgaa

SEQ ID NO: 318543 - DNA, 20 bp, Artificial Sequence
  chemically synthesized
gcccttccttactttactga

SEQ ID NO: 318544 - DNA, 20 bp, Artificial Sequence
  chemically synthesized
agcccttccttactttactg

SEQ ID NO: 318545 - DNA, 20 bp, Artificial Sequence
  chemically synthesized
agtatgcccttcagtaaagt

SEQ ID NO: 318546 - DNA, 20 bp, Artificial Sequence
  chemically synthesized
gtatgcccttcagtaaagta

SEQ ID NO: 318547 - DNA, 20 bp, Artificial Sequence
  chemically synthesized
tgcccttcagtaaagtaagg

SEQ ID NO: 318548 - DNA, 20 bp, Artificial Sequence
  chemically synthesized
gcccttcagtaaagtaagga

SEQ ID NO: 318549 - DNA, 20 bp, Artificial Sequence
  chemically synthesized
cccttcagtaaagtaaggaa

SEQ ID NO: 318550 - DNA, 20 bp, Artificial Sequence
  chemically synthesized
agtaaggaagggctttatta

SEQ ID NO: 318551 - DNA, 20 bp, Artificial Sequence
  chemically synthesized
cacatatcagtactgtaata

SEQ ID NO: 318552 - DNA, 20 bp, Artificial Sequence
  chemically synthesized
ctttagagtttttcacatat

SEQ ID NO: 318553 - DNA, 20 bp, Artificial Sequence
  chemically synthesized
ctgatatgtgaaaaactcta

SEQ ID NO: 318554 - DNA, 20 bp, Artificial Sequence
  chemically synthesized
actagttatttcaatcttta

SEQ ID NO: 318555 - DNA, 20 bp, Artificial Sequence
  chemically synthesized
ttactagttatttcaatctt

SEQ ID NO: 318556 - DNA, 20 bp, Artificial Sequence
  chemically synthesized
actctaaagattgaaataac

SEQ ID NO: 318557 - DNA, 20 bp, Artificial Sequence
  chemically synthesized
gattgaaataactagtaatg

SEQ ID NO: 318558 - DNA, 20 bp, Artificial Sequence
  chemically synthesized
ggaagcgtcctcttcattac

SEQ ID NO: 318559 - DNA, 20 bp, Artificial Sequence
  chemically synthesized
ttgaaataactagtaatgaa

SEQ ID NO: 318560 - DNA, 20 bp, Artificial Sequence
  chemically synthesized
tgaaataactagtaatgaag

SEQ ID NO: 318561 - DNA, 20 bp, Artificial Sequence
  chemically synthesized
caggcctcagtgaaggaagg

SEQ ID NO: 318562 - DNA, 20 bp, Artificial Sequence
  chemically synthesized
tcacaggcctcagtgaagga

SEQ ID NO: 318563 - DNA, 20 bp, Artificial Sequence
  chemically synthesized
ttcacaggcctcagtgaagg

SEQ ID NO: 318564 - DNA, 20 bp, Artificial Sequence
  chemically synthesized
ggacgcttccttccttcact

SEQ ID NO: 318565 - DNA, 20 bp, Artificial Sequence
  chemically synthesized
gacgcttccttccttcactg

SEQ ID NO: 318566 - DNA, 20 bp, Artificial Sequence
  chemically synthesized
cttttcacaggcctcagtga

SEQ ID NO: 318567 - DNA, 20 bp, Artificial Sequence
  chemically synthesized
tcttttcacaggcctcagtg

SEQ ID NO: 318568 - DNA, 20 bp, Artificial Sequence
  chemically synthesized
gatgctcttttcacaggcct

SEQ ID NO: 318569 - DNA, 20 bp, Artificial Sequence
  chemically synthesized
ccttcactgaggcctgtgaa

SEQ ID NO: 318570 - DNA, 20 bp, Artificial Sequence
  chemically synthesized
ttcactgaggcctgtgaaaa

SEQ ID NO: 318571 - DNA, 20 bp, Artificial Sequence
  chemically synthesized
tttactgatgctcttttcac

SEQ ID NO: 318572 - DNA, 20 bp, Artificial Sequence
  chemically synthesized
ctttactgatgctcttttca

SEQ ID NO: 318573 - DNA, 20 bp, Artificial Sequence
  chemically synthesized
gaggcctgtgaaaagagcat

SEQ ID NO: 318574 - DNA, 20 bp, Artificial Sequence
  chemically synthesized
ctgtgaaaagagcatcagta

SEQ ID NO: 318575 - DNA, 20 bp, Artificial Sequence
  chemically synthesized
aaaagagcatcagtaaagtg

SEQ ID NO: 318576 - DNA, 20 bp, Artificial Sequence
  chemically synthesized
aaagagcatcagtaaagtgc

SEQ ID NO: 318577 - DNA, 20 bp, Artificial Sequence
  chemically synthesized
agtaaagtgcaggtgaatta

SEQ ID NO: 318578 - DNA, 20 bp, Artificial Sequence
  chemically synthesized
gtaaagtgcaggtgaattat

SEQ ID NO: 318579 - DNA, 20 bp, Artificial Sequence
  chemically synthesized
agtgcaggtgaattataggc

SEQ ID NO: 318580 - DNA, 20 bp, Artificial Sequence
  chemically synthesized
tgcaggtgaattataggcca

SEQ ID NO: 318581 - DNA, 20 bp, Artificial Sequence
  chemically synthesized
gctaatcacccagaaaactc

SEQ ID NO: 318582 - DNA, 20 bp, Artificial Sequence
  chemically synthesized
aattataggccagagttttc

SEQ ID NO: 318583 - DNA, 20 bp, Artificial Sequence
  chemically synthesized
attataggccagagttttct

SEQ ID NO: 318584 - DNA, 20 bp, Artificial Sequence
  chemically synthesized
gccagagttttctgggtgat

SEQ ID NO: 318585 - DNA, 20 bp, Artificial Sequence
  chemically synthesized
tcacttccttgctaatcacc

SEQ ID NO: 318586 - DNA, 20 bp, Artificial Sequence
  chemically synthesized
gagttttctgggtgattagc

SEQ ID NO: 318587 - DNA, 20 bp, Artificial Sequence
  chemically synthesized
agttttctgggtgattagca

SEQ ID NO: 318588 - DNA, 20 bp, Artificial Sequence
  chemically synthesized
tttctgggtgattagcaagg

SEQ ID NO: 318589 - DNA, 20 bp, Artificial Sequence
  chemically synthesized
tgggtgattagcaaggaagt

SEQ ID NO: 318590 - DNA, 20 bp, Artificial Sequence
  chemically synthesized
gtgattagcaaggaagtgag

SEQ ID NO: 318591 - DNA, 20 bp, Artificial Sequence
  chemically synthesized
attagcaaggaagtgagtag

SEQ ID NO: 318592 - DNA, 20 bp, Artificial Sequence
  chemically synthesized
agtgagtagtggtccattgc

SEQ ID NO: 318593 - DNA, 20 bp, Artificial Sequence
  chemically synthesized
gtgagtagtggtccattgca

SEQ ID NO: 318594 - DNA, 20 bp, Artificial Sequence
  chemically synthesized
cctctggttcagccttgcaa

SEQ ID NO: 318595 - DNA, 20 bp, Artificial Sequence
  chemically synthesized
ggtccattgcaaggctgaac

SEQ ID NO: 318596 - DNA, 20 bp, Artificial Sequence
  chemically synthesized
tccattgcaaggctgaacca

SEQ ID NO: 318597 - DNA, 20 bp, Artificial Sequence
  chemically synthesized
ccattgcaaggctgaaccag

SEQ ID NO: 318598 - DNA, 20 bp, Artificial Sequence
  chemically synthesized
ttttgcttcttcctctggtt

SEQ ID NO: 318599 - DNA, 20 bp, Artificial Sequence
  chemically synthesized
ttgcaaggctgaaccagagg

SEQ ID NO: 318600 - DNA, 20 bp, Artificial Sequence
  chemically synthesized
caaggctgaaccagaggaag

SEQ ID NO: 318601 - DNA, 20 bp, Artificial Sequence
  chemically synthesized
ttcaattttgcttcttcctc

SEQ ID NO: 318602 - DNA, 20 bp, Artificial Sequence
  chemically synthesized
cagaggaagaagcaaaattg

SEQ ID NO: 318603 - DNA, 20 bp, Artificial Sequence
  chemically synthesized
agaggaagaagcaaaattga

SEQ ID NO: 318604 - DNA, 20 bp, Artificial Sequence
  chemically synthesized
aggaagaagcaaaattgaag

SEQ ID NO: 318605 - DNA, 20 bp, Artificial Sequence
  chemically synthesized
ggaagaagcaaaattgaagg

SEQ ID NO: 318606 - DNA, 20 bp, Artificial Sequence
  chemically synthesized
attgaaggaggcactgatat

SEQ ID NO: 318607 - DNA, 20 bp, Artificial Sequence
  chemically synthesized
gaaggaggcactgatatcag

SEQ ID NO: 318608 - DNA, 20 bp, Artificial Sequence
  chemically synthesized
ttaaactcaccttctgatat

SEQ ID NO: 318609 - DNA, 20 bp, Artificial Sequence
  chemically synthesized
aaggaggcactgatatcaga

SEQ ID NO: 318610 - DNA, 20 bp, Artificial Sequence
  chemically synthesized
aggcactgatatcagaaggt

SEQ ID NO: 318611 - DNA, 20 bp, Artificial Sequence
  chemically synthesized
atatcagaaggtgagtttaa

SEQ ID NO: 318612 - DNA, 20 bp, Artificial Sequence
  chemically synthesized
aaaggacatttgtgtcatga

SEQ ID NO: 318613 - DNA, 20 bp, Artificial Sequence
  chemically synthesized
aaaaggacatttgtgtcatg

SEQ ID NO: 318614 - DNA, 20 bp, Artificial Sequence
  chemically synthesized
ttaaaccatctttgggaaaa

SEQ ID NO: 318615 - DNA, 20 bp, Artificial Sequence
  chemically synthesized
cacaaatgtcctttttccca

SEQ ID NO: 318616 - DNA, 20 bp, Artificial Sequence
  chemically synthesized
tttaaaccatctttgggaaa

SEQ ID NO: 318617 - DNA, 20 bp, Artificial Sequence
  chemically synthesized
aatgtcctttttcccaaaga

SEQ ID NO: 318618 - DNA, 20 bp, Artificial Sequence
  chemically synthesized
cctttatttaaaccatcttt

SEQ ID NO: 318619 - DNA, 20 bp, Artificial Sequence
  chemically synthesized
ccctttatttaaaccatctt

SEQ ID NO: 318620 - DNA, 20 bp, Artificial Sequence
  chemically synthesized
tcccaaagatggtttaaata

SEQ ID NO: 318621 - DNA, 20 bp, Artificial Sequence
  chemically synthesized
cccaaagatggtttaaataa

SEQ ID NO: 318622 - DNA, 20 bp, Artificial Sequence
  chemically synthesized
ccaaagatggtttaaataaa

SEQ ID NO: 318623 - DNA, 20 bp, Artificial Sequence
  chemically synthesized
caaagatggtttaaataaag

SEQ ID NO: 318624 - DNA, 20 bp, Artificial Sequence
  chemically synthesized
tttaaataaaggggtgactt

SEQ ID NO: 318625 - DNA, 20 bp, Artificial Sequence
  chemically synthesized
ttaaataaaggggtgacttc

SEQ ID NO: 318626 - DNA, 20 bp, Artificial Sequence
  chemically synthesized
taaataaaggggtgacttca

SEQ ID NO: 318627 - DNA, 20 bp, Artificial Sequence
  chemically synthesized
aataaaggggtgacttcagg

SEQ ID NO: 318628 - DNA, 20 bp, Artificial Sequence
  chemically synthesized
aaaggggtgacttcagggag

SEQ ID NO: 318629 - DNA, 20 bp, Artificial Sequence
  chemically synthesized
gttaacctccccactccctg

SEQ ID NO: 318630 - DNA, 20 bp, Artificial Sequence
  chemically synthesized
aaggggtgacttcagggagt

SEQ ID NO: 318631 - DNA, 20 bp, Artificial Sequence
  chemically synthesized
aggggtgacttcagggagtg

SEQ ID NO: 318632 - DNA, 20 bp, Artificial Sequence
  chemically synthesized
gggtgacttcagggagtggg

SEQ ID NO: 318633 - DNA, 20 bp, Artificial Sequence
  chemically synthesized
ggtgacttcagggagtgggg

SEQ ID NO: 318634 - DNA, 20 bp, Artificial Sequence
  chemically synthesized
ggagtggggaggttaacctc

SEQ ID NO: 318635 - DNA, 20 bp, Artificial Sequence
  chemically synthesized
gagtggggaggttaacctct

SEQ ID NO: 318636 - DNA, 20 bp, Artificial Sequence
  chemically synthesized
ttaatgacattttaacccag

SEQ ID NO: 318637 - DNA, 20 bp, Artificial Sequence
  chemically synthesized
attaatgacattttaaccca

SEQ ID NO: 318638 - DNA, 20 bp, Artificial Sequence
  chemically synthesized
atattaatgacattttaacc

SEQ ID NO: 318639 - DNA, 20 bp, Artificial Sequence
  chemically synthesized
ggttaaaatgtcattaatat

SEQ ID NO: 318640 - DNA, 20 bp, Artificial Sequence
  chemically synthesized
atattagttgtaaaatacac

SEQ ID NO: 318641 - DNA, 20 bp, Artificial Sequence
  chemically synthesized
aaagttgaataaatgttagc

SEQ ID NO: 318642 - DNA, 20 bp, Artificial Sequence
  chemically synthesized
aaaaaaagttgaataaatgt

SEQ ID NO: 318643 - DNA, 20 bp, Artificial Sequence
  chemically synthesized
tggcaaggttatgttaaaaa

SEQ ID NO: 318644 - DNA, 20 bp, Artificial Sequence
  chemically synthesized
ttttttaacataaccttgcc

SEQ ID NO: 318645 - DNA, 20 bp, Artificial Sequence
  chemically synthesized
tttttaacataaccttgcca

SEQ ID NO: 318646 - DNA, 20 bp, Artificial Sequence
  chemically synthesized
tataaatctttaccttggca

SEQ ID NO: 318647 - DNA, 20 bp, Artificial Sequence
  chemically synthesized
ttataaatctttaccttggc

SEQ ID NO: 318648 - DNA, 20 bp, Artificial Sequence
  chemically synthesized
aacataaccttgccaaggta

SEQ ID NO: 318649 - DNA, 20 bp, Artificial Sequence
  chemically synthesized
agtattataaatctttacct

SEQ ID NO: 318650 - DNA, 20 bp, Artificial Sequence
  chemically synthesized
aaggtaaagatttataatac

SEQ ID NO: 318651 - DNA, 20 bp, Artificial Sequence
  chemically synthesized
aaaaaaaaaaaaaaaaatac

SEQ ID NO: 318652 - DNA, 20 bp, Artificial Sequence
  chemically synthesized
gtattttttttttttttttt

SEQ ID NO: 318653 - DNA, 20 bp, Artificial Sequence
  chemically synthesized
ttttttttttttttttgaga

SEQ ID NO: 318654 - DNA, 20 bp, Artificial Sequence
  chemically synthesized
tttttttttttttttgagac

SEQ ID NO: 318655 - DNA, 20 bp, Artificial Sequence
  chemically synthesized
ttttttttttttttgagaca

SEQ ID NO: 318656 - DNA, 20 bp, Artificial Sequence
  chemically synthesized
tcgagcctgggtaacagaat

SEQ ID NO: 318657 - DNA, 20 bp, Artificial Sequence
  chemically synthesized
cagggtctcattctgttacc

SEQ ID NO: 318658 - DNA, 20 bp, Artificial Sequence
  chemically synthesized
agggtctcattctgttaccc

SEQ ID NO: 318659 - DNA, 20 bp, Artificial Sequence
  chemically synthesized
ctgtactcgagcctgggtaa

SEQ ID NO: 318660 - DNA, 20 bp, Artificial Sequence
  chemically synthesized
tcattctgttacccaggctc

SEQ ID NO: 318661 - DNA, 20 bp, Artificial Sequence
  chemically synthesized
gtgtcactgtactcgagcct

SEQ ID NO: 318662 - DNA, 20 bp, Artificial Sequence
  chemically synthesized
tgtgtcactgtactcgagcc

SEQ ID NO: 318663 - DNA, 20 bp, Artificial Sequence
  chemically synthesized
ctgttacccaggctcgagta

SEQ ID NO: 318664 - DNA, 20 bp, Artificial Sequence
  chemically synthesized
atgattgtgtcactgtactc

SEQ ID NO: 318665 - DNA, 20 bp, Artificial Sequence
  chemically synthesized
gacacaatcataactcactg

SEQ ID NO: 318666 - DNA, 20 bp, Artificial Sequence
  chemically synthesized
tgggaggtcaaggcttcagt

SEQ ID NO: 318667 - DNA, 20 bp, Artificial Sequence
  chemically synthesized
ggcctgggaggtcaaggctt

SEQ ID NO: 318668 - DNA, 20 bp, Artificial Sequence
  chemically synthesized
catttgggcctgggaggtca

SEQ ID NO: 318669 - DNA, 20 bp, Artificial Sequence
  chemically synthesized
tcactgaagccttgacctcc

SEQ ID NO: 318670 - DNA, 20 bp, Artificial Sequence
  chemically synthesized
tcatttgggcctgggaggtc

SEQ ID NO: 318671 - DNA, 20 bp, Artificial Sequence
  chemically synthesized
cactgaagccttgacctccc

SEQ ID NO: 318672 - DNA, 20 bp, Artificial Sequence
  chemically synthesized
gaggatcatttgggcctggg

SEQ ID NO: 318673 - DNA, 20 bp, Artificial Sequence
  chemically synthesized
ggaggatcatttgggcctgg

SEQ ID NO: 318674 - DNA, 20 bp, Artificial Sequence
  chemically synthesized
caggaggatcatttgggcct

SEQ ID NO: 318675 - DNA, 20 bp, Artificial Sequence
  chemically synthesized
gcaggaggatcatttgggcc

SEQ ID NO: 318676 - DNA, 20 bp, Artificial Sequence
  chemically synthesized
ctgaggcaggaggatcattt

SEQ ID NO: 318677 - DNA, 20 bp, Artificial Sequence
  chemically synthesized
gctgaggcaggaggatcatt

SEQ ID NO: 318678 - DNA, 20 bp, Artificial Sequence
  chemically synthesized
cccaaatgatcctcctgcct

SEQ ID NO: 318679 - DNA, 20 bp, Artificial Sequence
  chemically synthesized
actcaggaggctgaggcagg

SEQ ID NO: 318680 - DNA, 20 bp, Artificial Sequence
  chemically synthesized
tactcaggaggctgaggcag

SEQ ID NO: 318681 - DNA, 20 bp, Artificial Sequence
  chemically synthesized
gctactcaggaggctgaggc

SEQ ID NO: 318682 - DNA, 20 bp, Artificial Sequence
  chemically synthesized
agctactcaggaggctgagg

SEQ ID NO: 318683 - DNA, 20 bp, Artificial Sequence
  chemically synthesized
ctcagctactcaggaggctg

SEQ ID NO: 318684 - DNA, 20 bp, Artificial Sequence
  chemically synthesized
tctcagctactcaggaggct

SEQ ID NO: 318685 - DNA, 20 bp, Artificial Sequence
  chemically synthesized
tcctcctgcctcagcctcct

SEQ ID NO: 318686 - DNA, 20 bp, Artificial Sequence
  chemically synthesized
tcctgcctcagcctcctgag

SEQ ID NO: 318687 - DNA, 20 bp, Artificial Sequence
  chemically synthesized
tgtagtctcagctactcagg

SEQ ID NO: 318688 - DNA, 20 bp, Artificial Sequence
  chemically synthesized
ctgtagtctcagctactcag

SEQ ID NO: 318689 - DNA, 20 bp, Artificial Sequence
  chemically synthesized
acctgtagtctcagctactc

SEQ ID NO: 318690 - DNA, 20 bp, Artificial Sequence
  chemically synthesized
cctcagcctcctgagtagct

SEQ ID NO: 318691 - DNA, 20 bp, Artificial Sequence
  chemically synthesized
cacctgtagtctcagctact

SEQ ID NO: 318692 - DNA, 20 bp, Artificial Sequence
  chemically synthesized
ctcctgagtagctgagacta

SEQ ID NO: 318693 - DNA, 20 bp, Artificial Sequence
  chemically synthesized
tcctgagtagctgagactac

SEQ ID NO: 318694 - DNA, 20 bp, Artificial Sequence
  chemically synthesized
aggtggtgcacctgtagtct

SEQ ID NO: 318695 - DNA, 20 bp, Artificial Sequence
  chemically synthesized
cagggaaggtggtgcacctg

SEQ ID NO: 318696 - DNA, 20 bp, Artificial Sequence
  chemically synthesized
tacaggtgcaccaccttccc

SEQ ID NO: 318697 - DNA, 20 bp, Artificial Sequence
  chemically synthesized
taaaaatttgccagggaagg

SEQ ID NO: 318698 - DNA, 20 bp, Artificial Sequence
  chemically synthesized
agttaaaaatttgccaggga

SEQ ID NO: 318699 - DNA, 20 bp, Artificial Sequence
  chemically synthesized
gagttaaaaatttgccaggg

SEQ ID NO: 318700 - DNA, 20 bp, Artificial Sequence
  chemically synthesized
aaagagttaaaaatttgcca

SEQ ID NO: 318701 - DNA, 20 bp, Artificial Sequence
  chemically synthesized
aaaagagttaaaaatttgcc

SEQ ID NO: 318702 - DNA, 20 bp, Artificial Sequence
  chemically synthesized
aaaaagagttaaaaatttgc

SEQ ID NO: 318703 - DNA, 20 bp, Artificial Sequence
  chemically synthesized
agaccacatctatacaaaaa

SEQ ID NO: 318704 - DNA, 20 bp, Artificial Sequence
  chemically synthesized
aatttttaactctttttgta

SEQ ID NO: 318705 - DNA, 20 bp, Artificial Sequence
  chemically synthesized
ggagaccacatctatacaaa

SEQ ID NO: 318706 - DNA, 20 bp, Artificial Sequence
  chemically synthesized
taactctttttgtatagatg

SEQ ID NO: 318707 - DNA, 20 bp, Artificial Sequence
  chemically synthesized
actagcctgggcaacatagg

SEQ ID NO: 318708 - DNA, 20 bp, Artificial Sequence
  chemically synthesized
agactagcctgggcaacata

SEQ ID NO: 318709 - DNA, 20 bp, Artificial Sequence
  chemically synthesized
aagactagcctgggcaacat

SEQ ID NO: 318710 - DNA, 20 bp, Artificial Sequence
  chemically synthesized
tgtggtctccctatgttgcc

SEQ ID NO: 318711 - DNA, 20 bp, Artificial Sequence
  chemically synthesized
caagactagcctgggcaaca

SEQ ID NO: 318712 - DNA, 20 bp, Artificial Sequence
  chemically synthesized
gtggtctccctatgttgccc

SEQ ID NO: 318713 - DNA, 20 bp, Artificial Sequence
  chemically synthesized
tctccctatgttgcccaggc

SEQ ID NO: 318714 - DNA, 20 bp, Artificial Sequence
  chemically synthesized
caggagttcaagactagcct

SEQ ID NO: 318715 - DNA, 20 bp, Artificial Sequence
  chemically synthesized
ccaggagttcaagactagcc

SEQ ID NO: 318716 - DNA, 20 bp, Artificial Sequence
  chemically synthesized
ggagaccaggagttcaagac

SEQ ID NO: 318717 - DNA, 20 bp, Artificial Sequence
  chemically synthesized
ccaggctagtcttgaactcc

SEQ ID NO: 318718 - DNA, 20 bp, Artificial Sequence
  chemically synthesized
tagctggagaccaggagttc

SEQ ID NO: 318719 - DNA, 20 bp, Artificial Sequence
  chemically synthesized
ggaggatagctggagaccag

SEQ ID NO: 318720 - DNA, 20 bp, Artificial Sequence
  chemically synthesized
agtcttgaactcctggtctc

SEQ ID NO: 318721 - DNA, 20 bp, Artificial Sequence
  chemically synthesized
caggaggatagctggagacc

SEQ ID NO: 318722 - DNA, 20 bp, Artificial Sequence
  chemically synthesized
gcaggaggatagctggagac

SEQ ID NO: 318723 - DNA, 20 bp, Artificial Sequence
  chemically synthesized
tcgaggcaggaggatagctg

SEQ ID NO: 318724 - DNA, 20 bp, Artificial Sequence
  chemically synthesized
ggtcgaggcaggaggatagc

SEQ ID NO: 318725 - DNA, 20 bp, Artificial Sequence
  chemically synthesized
gggaggtcgaggcaggagga

SEQ ID NO: 318726 - DNA, 20 bp, Artificial Sequence
  chemically synthesized
ctttgggaggtcgaggcagg

SEQ ID NO: 318727 - DNA, 20 bp, Artificial Sequence
  chemically synthesized
actttgggaggtcgaggcag

SEQ ID NO: 318728 - DNA, 20 bp, Artificial Sequence
  chemically synthesized
gaactttgggaggtcgaggc

SEQ ID NO: 318729 - DNA, 20 bp, Artificial Sequence
  chemically synthesized
agaactttgggaggtcgagg

SEQ ID NO: 318730 - DNA, 20 bp, Artificial Sequence
  chemically synthesized
cccagaactttgggaggtcg

SEQ ID NO: 318731 - DNA, 20 bp, Artificial Sequence
  chemically synthesized
tcccagaactttgggaggtc

SEQ ID NO: 318732 - DNA, 20 bp, Artificial Sequence
  chemically synthesized
cctcctgcctcgacctccca

SEQ ID NO: 318733 - DNA, 20 bp, Artificial Sequence
  chemically synthesized
tgtaatcccagaactttggg

SEQ ID NO: 318734 - DNA, 20 bp, Artificial Sequence
  chemically synthesized
ctgtaatcccagaactttgg

SEQ ID NO: 318735 - DNA, 20 bp, Artificial Sequence
  chemically synthesized
gcctcgacctcccaaagttc

SEQ ID NO: 318736 - DNA, 20 bp, Artificial Sequence
  chemically synthesized
gcctgtaatcccagaacttt

SEQ ID NO: 318737 - DNA, 20 bp, Artificial Sequence
  chemically synthesized
cctcgacctcccaaagttct

SEQ ID NO: 318738 - DNA, 20 bp, Artificial Sequence
  chemically synthesized
cgcctgtaatcccagaactt

SEQ ID NO: 318739 - DNA, 20 bp, Artificial Sequence
  chemically synthesized
ctcccaaagttctgggatta

SEQ ID NO: 318740 - DNA, 20 bp, Artificial Sequence
  chemically synthesized
tcccaaagttctgggattac

SEQ ID NO: 318741 - DNA, 20 bp, Artificial Sequence
  chemically synthesized
gtggctcacgcctgtaatcc

SEQ ID NO: 318742 - DNA, 20 bp, Artificial Sequence
  chemically synthesized
agttctgggattacaggcgt

SEQ ID NO: 318743 - DNA, 20 bp, Artificial Sequence
  chemically synthesized
caggcgtgagccaccgcacc

SEQ ID NO: 318744 - DNA, 20 bp, Artificial Sequence
  chemically synthesized
ataacagtagctaggtgcgg

SEQ ID NO: 318745 - DNA, 20 bp, Artificial Sequence
  chemically synthesized
aaaataacagtagctaggtg

SEQ ID NO: 318746 - DNA, 20 bp, Artificial Sequence
  chemically synthesized
gaaataaaataacagtagct

SEQ ID NO: 318747 - DNA, 20 bp, Artificial Sequence
  chemically synthesized
agaaataaaataacagtagc

SEQ ID NO: 318748 - DNA, 20 bp, Artificial Sequence
  chemically synthesized
cctcagaaataaaataacag

SEQ ID NO: 318749 - DNA, 20 bp, Artificial Sequence
  chemically synthesized
tatcctcagaaataaaataa

SEQ ID NO: 318750 - DNA, 20 bp, Artificial Sequence
  chemically synthesized
gctactgttattttatttct

SEQ ID NO: 318751 - DNA, 20 bp, Artificial Sequence
  chemically synthesized
ctactgttattttatttctg

SEQ ID NO: 318752 - DNA, 20 bp, Artificial Sequence
  chemically synthesized
tgttattttatttctgagga

SEQ ID NO: 318753 - DNA, 20 bp, Artificial Sequence
  chemically synthesized
tattttatttctgaggatag

SEQ ID NO: 318754 - DNA, 20 bp, Artificial Sequence
  chemically synthesized
ctttaacctaccactatcct

SEQ ID NO: 318755 - DNA, 20 bp, Artificial Sequence
  chemically synthesized
tttatttctgaggatagtgg

SEQ ID NO: 318756 - DNA, 20 bp, Artificial Sequence
  chemically synthesized
ttatttctgaggatagtggt

SEQ ID NO: 318757 - DNA, 20 bp, Artificial Sequence
  chemically synthesized
ctgaggatagtggtaggtta

SEQ ID NO: 318758 - DNA, 20 bp, Artificial Sequence
  chemically synthesized
gaggatagtggtaggttaaa

SEQ ID NO: 318759 - DNA, 20 bp, Artificial Sequence
  chemically synthesized
atagtggtaggttaaagagc

SEQ ID NO: 318760 - DNA, 20 bp, Artificial Sequence
  chemically synthesized
ggtaggttaaagagctggca

SEQ ID NO: 318761 - DNA, 20 bp, Artificial Sequence
  chemically synthesized
aggttaaagagctggcacag

SEQ ID NO: 318762 - DNA, 20 bp, Artificial Sequence
  chemically synthesized
ggcttcacatgccactgtgc

SEQ ID NO: 318763 - DNA, 20 bp, Artificial Sequence
  chemically synthesized
agctggcacagtggcatgtg

SEQ ID NO: 318764 - DNA, 20 bp, Artificial Sequence
  chemically synthesized
ggcacagtggcatgtgaagc

SEQ ID NO: 318765 - DNA, 20 bp, Artificial Sequence
  chemically synthesized
agtggcatgtgaagccagta

SEQ ID NO: 318766 - DNA, 20 bp, Artificial Sequence
  chemically synthesized
agggtttgtgatttctatac

SEQ ID NO: 318767 - DNA, 20 bp, Artificial Sequence
  chemically synthesized
gcacagtcttgggtcacaca

SEQ ID NO: 318768 - DNA, 20 bp, Artificial Sequence
  chemically synthesized
tgcacagtcttgggtcacac

SEQ ID NO: 318769 - DNA, 20 bp, Artificial Sequence
  chemically synthesized
gtgcacagtcttgggtcaca

SEQ ID NO: 318770 - DNA, 20 bp, Artificial Sequence
  chemically synthesized
tcacaaaccctgtgtgaccc

SEQ ID NO: 318771 - DNA, 20 bp, Artificial Sequence
  chemically synthesized
ataaaatagtgcacagtctt

SEQ ID NO: 318772 - DNA, 20 bp, Artificial Sequence
  chemically synthesized
aataaaatagtgcacagtct

SEQ ID NO: 318773 - DNA, 20 bp, Artificial Sequence
  chemically synthesized
gaaaaaaataaaatagtgca

SEQ ID NO: 318774 - DNA, 20 bp, Artificial Sequence
  chemically synthesized
tgcccatgaaaaaaataaaa

SEQ ID NO: 318775 - DNA, 20 bp, Artificial Sequence
  chemically synthesized
gcactattttatttttttca

SEQ ID NO: 318776 - DNA, 20 bp, Artificial Sequence
  chemically synthesized
cactattttatttttttcat

SEQ ID NO: 318777 - DNA, 20 bp, Artificial Sequence
  chemically synthesized
tcatgggcaaaatattgtat

SEQ ID NO: 318778 - DNA, 20 bp, Artificial Sequence
  chemically synthesized
caacaaagaaattgaaatat

SEQ ID NO: 318779 - DNA, 20 bp, Artificial Sequence
  chemically synthesized
tgaagccattttcatcaaca

SEQ ID NO: 318780 - DNA, 20 bp, Artificial Sequence
  chemically synthesized
aatttctttgttgatgaaaa

SEQ ID NO: 318781 - DNA, 20 bp, Artificial Sequence
  chemically synthesized
ttgatgaaaatggcttcata

SEQ ID NO: 318782 - DNA, 20 bp, Artificial Sequence
  chemically synthesized
gttttaaattgaactatatg

SEQ ID NO: 318783 - DNA, 20 bp, Artificial Sequence
  chemically synthesized
atttaaaacatgatgaaaat

SEQ ID NO: 318784 - DNA, 20 bp, Artificial Sequence
  chemically synthesized
aaaacatgatgaaaatgaga

SEQ ID NO: 318785 - DNA, 20 bp, Artificial Sequence
  chemically synthesized
aaacatgatgaaaatgagac

SEQ ID NO: 318786 - DNA, 20 bp, Artificial Sequence
  chemically synthesized
acatgatgaaaatgagacag

SEQ ID NO: 318787 - DNA, 20 bp, Artificial Sequence
  chemically synthesized
agacaggagtttcttatttc

SEQ ID NO: 318788 - DNA, 20 bp, Artificial Sequence
  chemically synthesized
ttagaatgttagctggaaat

SEQ ID NO: 318789 - DNA, 20 bp, Artificial Sequence
  chemically synthesized
tacatctttagaatgttagc

SEQ ID NO: 318790 - DNA, 20 bp, Artificial Sequence
  chemically synthesized
tatttacatctttagaatgt

SEQ ID NO: 318791 - DNA, 20 bp, Artificial Sequence
  chemically synthesized
tatttccagctaacattcta

SEQ ID NO: 318792 - DNA, 20 bp, Artificial Sequence
  chemically synthesized
tccaaatttatttacatctt

SEQ ID NO: 318793 - DNA, 20 bp, Artificial Sequence
  chemically synthesized
tctaaagatgtaaataaatt

SEQ ID NO: 318794 - DNA, 20 bp, Artificial Sequence
  chemically synthesized
taaatttggaaaaattgtca

SEQ ID NO: 318795 - DNA, 20 bp, Artificial Sequence
  chemically synthesized
aaataaaaatctaccatgca

SEQ ID NO: 318796 - DNA, 20 bp, Artificial Sequence
  chemically synthesized
tttttcctatctgtgcatgg

SEQ ID NO: 318797 - DNA, 20 bp, Artificial Sequence
  chemically synthesized
cattttttcctatctgtgca

SEQ ID NO: 318798 - DNA, 20 bp, Artificial Sequence
  chemically synthesized
aaaaatctaccatgcacaga

SEQ ID NO: 318799 - DNA, 20 bp, Artificial Sequence
  chemically synthesized
aaaatctaccatgcacagat

SEQ ID NO: 318800 - DNA, 20 bp, Artificial Sequence
  chemically synthesized
aaaaaatgtttgcatttttc

SEQ ID NO: 318801 - DNA, 20 bp, Artificial Sequence
  chemically synthesized
aaaaatgtttgcatttttcc

SEQ ID NO: 318802 - DNA, 20 bp, Artificial Sequence
  chemically synthesized
gaaggatataaaatgaaacc

SEQ ID NO: 318803 - DNA, 20 bp, Artificial Sequence
  chemically synthesized
ggtttcattttatatccttc

SEQ ID NO: 318804 - DNA, 20 bp, Artificial Sequence
  chemically synthesized
ccgtctaaatgacgacttga

SEQ ID NO: 318805 - DNA, 20 bp, Artificial Sequence
  chemically synthesized
cccgtctaaatgacgacttg

SEQ ID NO: 318806 - DNA, 20 bp, Artificial Sequence
  chemically synthesized
atatccttcaagtcgtcatt

SEQ ID NO: 318807 - DNA, 20 bp, Artificial Sequence
  chemically synthesized
ccttcaagtcgtcatttaga

SEQ ID NO: 318808 - DNA, 20 bp, Artificial Sequence
  chemically synthesized
cttcaagtcgtcatttagac

SEQ ID NO: 318809 - DNA, 20 bp, Artificial Sequence
  chemically synthesized
aagtcgtcatttagacggga

SEQ ID NO: 318810 - DNA, 20 bp, Artificial Sequence
  chemically synthesized
tcatttagacgggaaagtaa

SEQ ID NO: 318811 - DNA, 20 bp, Artificial Sequence
  chemically synthesized
agacgggaaagtaaaagcaa

SEQ ID NO: 318812 - DNA, 20 bp, Artificial Sequence
  chemically synthesized
gacgggaaagtaaaagcaaa

SEQ ID NO: 318813 - DNA, 20 bp, Artificial Sequence
  chemically synthesized
aagtaaaagcaaaaggtgaa

SEQ ID NO: 318814 - DNA, 20 bp, Artificial Sequence
  chemically synthesized
gtaaaagcaaaaggtgaatg

SEQ ID NO: 318815 - DNA, 20 bp, Artificial Sequence
  chemically synthesized
atggagtatacatatatgac

SEQ ID NO: 318816 - DNA, 20 bp, Artificial Sequence
  chemically synthesized
tatacatatatgactggcaa

SEQ ID NO: 318817 - DNA, 20 bp, Artificial Sequence
  chemically synthesized
tacatatatgactggcaata

SEQ ID NO: 318818 - DNA, 20 bp, Artificial Sequence
  chemically synthesized
ctccctcggctctctattgc

SEQ ID NO: 318819 - DNA, 20 bp, Artificial Sequence
  chemically synthesized
catatatgactggcaataga

SEQ ID NO: 318820 - DNA, 20 bp, Artificial Sequence
  chemically synthesized
atgactggcaatagagagcc

SEQ ID NO: 318821 - DNA, 20 bp, Artificial Sequence
  chemically synthesized
tgactggcaatagagagccg

SEQ ID NO: 318822 - DNA, 20 bp, Artificial Sequence
  chemically synthesized
gactggcaatagagagccga

SEQ ID NO: 318823 - DNA, 20 bp, Artificial Sequence
  chemically synthesized
ctggcaatagagagccgagg

SEQ ID NO: 318824 - DNA, 20 bp, Artificial Sequence
  chemically synthesized
gcaatagagagccgagggag

SEQ ID NO: 318825 - DNA, 20 bp, Artificial Sequence
  chemically synthesized
ttattctaattccactccct

SEQ ID NO: 318826 - DNA, 20 bp, Artificial Sequence
  chemically synthesized
gagagccgagggagtggaat

SEQ ID NO: 318827 - DNA, 20 bp, Artificial Sequence
  chemically synthesized
gagggagtggaattagaata

SEQ ID NO: 318828 - DNA, 20 bp, Artificial Sequence
  chemically synthesized
ggagtggaattagaataaag

SEQ ID NO: 318829 - DNA, 20 bp, Artificial Sequence
  chemically synthesized
ggaattagaataaagtagta

SEQ ID NO: 318830 - DNA, 20 bp, Artificial Sequence
  chemically synthesized
gaattagaataaagtagtat

SEQ ID NO: 318831 - DNA, 20 bp, Artificial Sequence
  chemically synthesized
aattagaataaagtagtata

SEQ ID NO: 318832 - DNA, 20 bp, Artificial Sequence
  chemically synthesized
tagaataaagtagtataggg

SEQ ID NO: 318833 - DNA, 20 bp, Artificial Sequence
  chemically synthesized
agaataaagtagtatagggc

SEQ ID NO: 318834 - DNA, 20 bp, Artificial Sequence
  chemically synthesized
aataaagtagtatagggcag

SEQ ID NO: 318835 - DNA, 20 bp, Artificial Sequence
  chemically synthesized
aagtagtatagggcaggagt

SEQ ID NO: 318836 - DNA, 20 bp, Artificial Sequence
  chemically synthesized
agggcaggagttggtcctga

SEQ ID NO: 318837 - DNA, 20 bp, Artificial Sequence
  chemically synthesized
gcaggagttggtcctgacag

SEQ ID NO: 318838 - DNA, 20 bp, Artificial Sequence
  chemically synthesized
caggagttggtcctgacagt

SEQ ID NO: 318839 - DNA, 20 bp, Artificial Sequence
  chemically synthesized
ttttgcctatacctactgtc

SEQ ID NO: 318840 - DNA, 20 bp, Artificial Sequence
  chemically synthesized
cttttgcctatacctactgt

SEQ ID NO: 318841 - DNA, 20 bp, Artificial Sequence
  chemically synthesized
gttggtcctgacagtaggta

SEQ ID NO: 318842 - DNA, 20 bp, Artificial Sequence
  chemically synthesized
ttggtcctgacagtaggtat

SEQ ID NO: 318843 - DNA, 20 bp, Artificial Sequence
  chemically synthesized
ctgacagtaggtataggcaa

SEQ ID NO: 318844 - DNA, 20 bp, Artificial Sequence
  chemically synthesized
aggtataggcaaaagcatat

SEQ ID NO: 318845 - DNA, 20 bp, Artificial Sequence
  chemically synthesized
ggtataggcaaaagcatatc

SEQ ID NO: 318846 - DNA, 20 bp, Artificial Sequence
  chemically synthesized
agcatatcaggacatgatac

SEQ ID NO: 318847 - DNA, 20 bp, Artificial Sequence
  chemically synthesized
gcatatcaggacatgatact

SEQ ID NO: 318848 - DNA, 20 bp, Artificial Sequence
  chemically synthesized
aagtttaccgtagcagttcc

SEQ ID NO: 318849 - DNA, 20 bp, Artificial Sequence
  chemically synthesized
catgatactaggaactgcta

SEQ ID NO: 318850 - DNA, 20 bp, Artificial Sequence
  chemically synthesized
cgattggaagtttaccgtag

SEQ ID NO: 318851 - DNA, 20 bp, Artificial Sequence
  chemically synthesized
gaacgattggaagtttaccg

SEQ ID NO: 318852 - DNA, 20 bp, Artificial Sequence
  chemically synthesized
cagatgatctgaacgattgg

SEQ ID NO: 318853 - DNA, 20 bp, Artificial Sequence
  chemically synthesized
acggtaaacttccaatcgtt

SEQ ID NO: 318854 - DNA, 20 bp, Artificial Sequence
  chemically synthesized
tctcagatgatctgaacgat

SEQ ID NO: 318855 - DNA, 20 bp, Artificial Sequence
  chemically synthesized
tccaatcgttcagatcatct

SEQ ID NO: 318856 - DNA, 20 bp, Artificial Sequence
  chemically synthesized
tcgttcagatcatctgagaa

SEQ ID NO: 318857 - DNA, 20 bp, Artificial Sequence
  chemically synthesized
gttcagatcatctgagaata

SEQ ID NO: 318858 - DNA, 20 bp, Artificial Sequence
  chemically synthesized
tgctagcccctctctattct

SEQ ID NO: 318859 - DNA, 20 bp, Artificial Sequence
  chemically synthesized
tcagatcatctgagaataga

SEQ ID NO: 318860 - DNA, 20 bp, Artificial Sequence
  chemically synthesized
cagatcatctgagaatagag

SEQ ID NO: 318861 - DNA, 20 bp, Artificial Sequence
  chemically synthesized
agatcatctgagaatagaga

SEQ ID NO: 318862 - DNA, 20 bp, Artificial Sequence
  chemically synthesized
gatcatctgagaatagagag

SEQ ID NO: 318863 - DNA, 20 bp, Artificial Sequence
  chemically synthesized
atctgagaatagagaggggc

SEQ ID NO: 318864 - DNA, 20 bp, Artificial Sequence
  chemically synthesized
atagagaggggctagcaaaa

SEQ ID NO: 318865 - DNA, 20 bp, Artificial Sequence
  chemically synthesized
ttacaacttatctgttttgc

SEQ ID NO: 318866 - DNA, 20 bp, Artificial Sequence
  chemically synthesized
gaggggctagcaaaacagat

SEQ ID NO: 318867 - DNA, 20 bp, Artificial Sequence
  chemically synthesized
tagcaaaacagataagttgt

SEQ ID NO: 318868 - DNA, 20 bp, Artificial Sequence
  chemically synthesized
acagataagttgtaagaact

SEQ ID NO: 318869 - DNA, 20 bp, Artificial Sequence
  chemically synthesized
gttgtaagaacttggaactt

SEQ ID NO: 318870 - DNA, 20 bp, Artificial Sequence
  chemically synthesized
ctctatgttgccaaagttcc

SEQ ID NO: 318871 - DNA, 20 bp, Artificial Sequence
  chemically synthesized
tctgtaactctatgttgcca

SEQ ID NO: 318872 - DNA, 20 bp, Artificial Sequence
  chemically synthesized
aacttggaactttggcaaca

SEQ ID NO: 318873 - DNA, 20 bp, Artificial Sequence
  chemically synthesized
cttggaactttggcaacata

SEQ ID NO: 318874 - DNA, 20 bp, Artificial Sequence
  chemically synthesized
actttggcaacatagagtta

SEQ ID NO: 318875 - DNA, 20 bp, Artificial Sequence
  chemically synthesized
acatagagttacagacctaa

SEQ ID NO: 318876 - DNA, 20 bp, Artificial Sequence
  chemically synthesized
cgttgacgctagagaccatt

SEQ ID NO: 318877 - DNA, 20 bp, Artificial Sequence
  chemically synthesized
tcgttgacgctagagaccat

SEQ ID NO: 318878 - DNA, 20 bp, Artificial Sequence
  chemically synthesized
gttacagacctaatggtctc

SEQ ID NO: 318879 - DNA, 20 bp, Artificial Sequence
  chemically synthesized
caaaaatgtcgttgacgcta

SEQ ID NO: 318880 - DNA, 20 bp, Artificial Sequence
  chemically synthesized
atcaaaaatgtcgttgacgc

SEQ ID NO: 318881 - DNA, 20 bp, Artificial Sequence
  chemically synthesized
cgacatttttgatatattgt

SEQ ID NO: 318882 - DNA, 20 bp, Artificial Sequence
  chemically synthesized
tttgatatattgttagataa

SEQ ID NO: 318883 - DNA, 20 bp, Artificial Sequence
  chemically synthesized
aaacactgggcacaatcata

SEQ ID NO: 318884 - DNA, 20 bp, Artificial Sequence
  chemically synthesized
gaaacactgggcacaatcat

SEQ ID NO: 318885 - DNA, 20 bp, Artificial Sequence
  chemically synthesized
gacatccttatgattgtgcc

SEQ ID NO: 318886 - DNA, 20 bp, Artificial Sequence
  chemically synthesized
attaaagtttgagaaacact

SEQ ID NO: 318887 - DNA, 20 bp, Artificial Sequence
  chemically synthesized
cattaaagtttgagaaacac

SEQ ID NO: 318888 - DNA, 20 bp, Artificial Sequence
  chemically synthesized
tcatatgtacattaaagttt

SEQ ID NO: 318889 - DNA, 20 bp, Artificial Sequence
  chemically synthesized
ggtgattcatatgtacatta

SEQ ID NO: 318890 - DNA, 20 bp, Artificial Sequence
  chemically synthesized
taatgtacatatgaatcacc

SEQ ID NO: 318891 - DNA, 20 bp, Artificial Sequence
  chemically synthesized
atgtacatatgaatcacctg

SEQ ID NO: 318892 - DNA, 20 bp, Artificial Sequence
  chemically synthesized
gtacatatgaatcacctgga

SEQ ID NO: 318893 - DNA, 20 bp, Artificial Sequence
  chemically synthesized
tgcatagtttgacactctcc

SEQ ID NO: 318894 - DNA, 20 bp, Artificial Sequence
  chemically synthesized
atgcatagtttgacactctc

SEQ ID NO: 318895 - DNA, 20 bp, Artificial Sequence
  chemically synthesized
gcctactgacttagaatgca

SEQ ID NO: 318896 - DNA, 20 bp, Artificial Sequence
  chemically synthesized
agtgtcaaactatgcattct

SEQ ID NO: 318897 - DNA, 20 bp, Artificial Sequence
  chemically synthesized
tcaaactatgcattctaagt

SEQ ID NO: 318898 - DNA, 20 bp, Artificial Sequence
  chemically synthesized
aactatgcattctaagtcag

SEQ ID NO: 318899 - DNA, 20 bp, Artificial Sequence
  chemically synthesized
actatgcattctaagtcagt

SEQ ID NO: 318900 - DNA, 20 bp, Artificial Sequence
  chemically synthesized
ccaacccaggcctactgact

SEQ ID NO: 318901 - DNA, 20 bp, Artificial Sequence
  chemically synthesized
gcattctaagtcagtaggcc

SEQ ID NO: 318902 - DNA, 20 bp, Artificial Sequence
  chemically synthesized
cattctaagtcagtaggcct

SEQ ID NO: 318903 - DNA, 20 bp, Artificial Sequence
  chemically synthesized
ctaagtcagtaggcctgggt

SEQ ID NO: 318904 - DNA, 20 bp, Artificial Sequence
  chemically synthesized
taagtcagtaggcctgggtt

SEQ ID NO: 318905 - DNA, 20 bp, Artificial Sequence
  chemically synthesized
aagtcagtaggcctgggttg

SEQ ID NO: 318906 - DNA, 20 bp, Artificial Sequence
  chemically synthesized
agaatctcaggccccaaccc

SEQ ID NO: 318907 - DNA, 20 bp, Artificial Sequence
  chemically synthesized
cagaatctcaggccccaacc

SEQ ID NO: 318908 - DNA, 20 bp, Artificial Sequence
  chemically synthesized
gtaggcctgggttggggcct

SEQ ID NO: 318909 - DNA, 20 bp, Artificial Sequence
  chemically synthesized
tgttagaaatgcagaatctc

SEQ ID NO: 318910 - DNA, 20 bp, Artificial Sequence
  chemically synthesized
ttgttagaaatgcagaatct

SEQ ID NO: 318911 - DNA, 20 bp, Artificial Sequence
  chemically synthesized
ttgggcagttgttagaaatg

SEQ ID NO: 318912 - DNA, 20 bp, Artificial Sequence
  chemically synthesized
gatatcccttgggcagttgt

SEQ ID NO: 318913 - DNA, 20 bp, Artificial Sequence
  chemically synthesized
tgcatttctaacaactgccc

SEQ ID NO: 318914 - DNA, 20 bp, Artificial Sequence
  chemically synthesized
gcatttctaacaactgccca

SEQ ID NO: 318915 - DNA, 20 bp, Artificial Sequence
  chemically synthesized
catttctaacaactgcccaa

SEQ ID NO: 318916 - DNA, 20 bp, Artificial Sequence
  chemically synthesized
aagcattgatatcccttggg

SEQ ID NO: 318917 - DNA, 20 bp, Artificial Sequence
  chemically synthesized
ccgaagcattgatatccctt

SEQ ID NO: 318918 - DNA, 20 bp, Artificial Sequence
  chemically synthesized
tccgaagcattgatatccct

SEQ ID NO: 318919 - DNA, 20 bp, Artificial Sequence
  chemically synthesized
cccaagggatatcaatgctt

SEQ ID NO: 318920 - DNA, 20 bp, Artificial Sequence
  chemically synthesized
aaatgtgattaatggatccg

SEQ ID NO: 318921 - DNA, 20 bp, Artificial Sequence
  chemically synthesized
gctccttaaaatgtgattaa

SEQ ID NO: 318922 - DNA, 20 bp, Artificial Sequence
  chemically synthesized
ggatccattaatcacatttt

SEQ ID NO: 318923 - DNA, 20 bp, Artificial Sequence
  chemically synthesized
gatccattaatcacatttta

SEQ ID NO: 318924 - DNA, 20 bp, Artificial Sequence
  chemically synthesized
tccattaatcacattttaag

SEQ ID NO: 318925 - DNA, 20 bp, Artificial Sequence
  chemically synthesized
aatcacattttaaggagcaa

SEQ ID NO: 318926 - DNA, 20 bp, Artificial Sequence
  chemically synthesized
attttaaggagcaatggtat

SEQ ID NO: 318927 - DNA, 20 bp, Artificial Sequence
  chemically synthesized
gcaatggtataagtcacttt

SEQ ID NO: 318928 - DNA, 20 bp, Artificial Sequence
  chemically synthesized
tggtataagtcactttgagt

SEQ ID NO: 318929 - DNA, 20 bp, Artificial Sequence
  chemically synthesized
atgacaaaaaggccaactca

SEQ ID NO: 318930 - DNA, 20 bp, Artificial Sequence
  chemically synthesized
atttactgcaaatgacaaaa

SEQ ID NO: 318931 - DNA, 20 bp, Artificial Sequence
  chemically synthesized
catttactgcaaatgacaaa

SEQ ID NO: 318932 - DNA, 20 bp, Artificial Sequence
  chemically synthesized
gttggcctttttgtcatttg

SEQ ID NO: 318933 - DNA, 20 bp, Artificial Sequence
  chemically synthesized
tttttgtcatttgcagtaaa

SEQ ID NO: 318934 - DNA, 20 bp, Artificial Sequence
  chemically synthesized
tttgcagtaaatggcattct

SEQ ID NO: 318935 - DNA, 20 bp, Artificial Sequence
  chemically synthesized
gtaaatggcattctaagacg

SEQ ID NO: 318936 - DNA, 20 bp, Artificial Sequence
  chemically synthesized
atttgaaaaatactacgtct

SEQ ID NO: 318937 - DNA, 20 bp, Artificial Sequence
  chemically synthesized
tttttcaaatgattttactc

SEQ ID NO: 318938 - DNA, 20 bp, Artificial Sequence
  chemically synthesized
tttcaaatgattttactcga

SEQ ID NO: 318939 - DNA, 20 bp, Artificial Sequence
  chemically synthesized
ggggtgggatgacagctctc

SEQ ID NO: 318940 - DNA, 20 bp, Artificial Sequence
  chemically synthesized
catgtccgggggtgggatga

SEQ ID NO: 318941 - DNA, 20 bp, Artificial Sequence
  chemically synthesized
gagagctgtcatcccacccc

SEQ ID NO: 318942 - DNA, 20 bp, Artificial Sequence
  chemically synthesized
acgttttcatgtccgggggt

SEQ ID NO: 318943 - DNA, 20 bp, Artificial Sequence
  chemically synthesized
tacgttttcatgtccggggg

SEQ ID NO: 318944 - DNA, 20 bp, Artificial Sequence
  chemically synthesized
agatacgttttcatgtccgg

SEQ ID NO: 318945 - DNA, 20 bp, Artificial Sequence
  chemically synthesized
cagatacgttttcatgtccg

SEQ ID NO: 318946 - DNA, 20 bp, Artificial Sequence
  chemically synthesized
acagatacgttttcatgtcc

SEQ ID NO: 318947 - DNA, 20 bp, Artificial Sequence
  chemically synthesized
tacagatacgttttcatgtc

SEQ ID NO: 318948 - DNA, 20 bp, Artificial Sequence
  chemically synthesized
tgaattcctttatgttcata

SEQ ID NO: 318949 - DNA, 20 bp, Artificial Sequence
  chemically synthesized
aacgtatctgtatgaacata

SEQ ID NO: 318950 - DNA, 20 bp, Artificial Sequence
  chemically synthesized
acgtatctgtatgaacataa

SEQ ID NO: 318951 - DNA, 20 bp, Artificial Sequence
  chemically synthesized
atgaacataaaggaattcaa

SEQ ID NO: 318952 - DNA, 20 bp, Artificial Sequence
  chemically synthesized
tgaacataaaggaattcaat

SEQ ID NO: 318953 - DNA, 20 bp, Artificial Sequence
  chemically synthesized
aaggaattcaatgggaatgc

SEQ ID NO: 318954 - DNA, 20 bp, Artificial Sequence
  chemically synthesized
gagtttctgtaaagcaaagc

SEQ ID NO: 318955 - DNA, 20 bp, Artificial Sequence
  chemically synthesized
ggaatgccagctttgcttta

SEQ ID NO: 318956 - DNA, 20 bp, Artificial Sequence
  chemically synthesized
aacagagtttctgtaaagca

SEQ ID NO: 318957 - DNA, 20 bp, Artificial Sequence
  chemically synthesized
attctaacagagtttctgta

SEQ ID NO: 318958 - DNA, 20 bp, Artificial Sequence
  chemically synthesized
ttgctttacagaaactctgt

SEQ ID NO: 318959 - DNA, 20 bp, Artificial Sequence
  chemically synthesized
cgccttcctacattctaaca

SEQ ID NO: 318960 - DNA, 20 bp, Artificial Sequence
  chemically synthesized
gccgccttcctacattctaa

SEQ ID NO: 318961 - DNA, 20 bp, Artificial Sequence
  chemically synthesized
acagaaactctgttagaatg

SEQ ID NO: 318962 - DNA, 20 bp, Artificial Sequence
  chemically synthesized
cagaaactctgttagaatgt

SEQ ID NO: 318963 - DNA, 20 bp, Artificial Sequence
  chemically synthesized
aaactctgttagaatgtagg

SEQ ID NO: 318964 - DNA, 20 bp, Artificial Sequence
  chemically synthesized
aactctgttagaatgtagga

SEQ ID NO: 318965 - DNA, 20 bp, Artificial Sequence
  chemically synthesized
tctgttagaatgtaggaagg

SEQ ID NO: 318966 - DNA, 20 bp, Artificial Sequence
  chemically synthesized
ttagaatgtaggaaggcggc

SEQ ID NO: 318967 - DNA, 20 bp, Artificial Sequence
  chemically synthesized
tagaatgtaggaaggcggct

SEQ ID NO: 318968 - DNA, 20 bp, Artificial Sequence
  chemically synthesized
aggaaggcggctgggtgcga

SEQ ID NO: 318969 - DNA, 20 bp, Artificial Sequence
  chemically synthesized
caggcgtgagccatcgcacc

SEQ ID NO: 318970 - DNA, 20 bp, Artificial Sequence
  chemically synthesized
agtgatgagattacaggcgt

SEQ ID NO: 318971 - DNA, 20 bp, Artificial Sequence
  chemically synthesized
tcccaaagtgatgagattac

SEQ ID NO: 318972 - DNA, 20 bp, Artificial Sequence
  chemically synthesized
ctcccaaagtgatgagatta

SEQ ID NO: 318973 - DNA, 20 bp, Artificial Sequence
  chemically synthesized
cgcctgtaatctcatcactt

SEQ ID NO: 318974 - DNA, 20 bp, Artificial Sequence
  chemically synthesized
cctcagcctcccaaagtgat

SEQ ID NO: 318975 - DNA, 20 bp, Artificial Sequence
  chemically synthesized
gcctgtaatctcatcacttt

SEQ ID NO: 318976 - DNA, 20 bp, Artificial Sequence
  chemically synthesized
ctgtaatctcatcactttgg

SEQ ID NO: 318977 - DNA, 20 bp, Artificial Sequence
  chemically synthesized
tgtaatctcatcactttggg

SEQ ID NO: 318978 - DNA, 20 bp, Artificial Sequence
  chemically synthesized
tccgccgcctcagcctccca

SEQ ID NO: 318979 - DNA, 20 bp, Artificial Sequence
  chemically synthesized
tctcatcactttgggaggct

SEQ ID NO: 318980 - DNA, 20 bp, Artificial Sequence
  chemically synthesized
ctcatcactttgggaggctg

SEQ ID NO: 318981 - DNA, 20 bp, Artificial Sequence
  chemically synthesized
atcactttgggaggctgagg

SEQ ID NO: 318982 - DNA, 20 bp, Artificial Sequence
  chemically synthesized
actttgggaggctgaggcgg

SEQ ID NO: 318983 - DNA, 20 bp, Artificial Sequence
  chemically synthesized
gaccttgtgatccgccgcct

SEQ ID NO: 318984 - DNA, 20 bp, Artificial Sequence
  chemically synthesized
aggctgaggcggcggatcac

SEQ ID NO: 318985 - DNA, 20 bp, Artificial Sequence
  chemically synthesized
ggctgaggcggcggatcaca

SEQ ID NO: 318986 - DNA, 20 bp, Artificial Sequence
  chemically synthesized
gaggcggcggatcacaaggt

SEQ ID NO: 318987 - DNA, 20 bp, Artificial Sequence
  chemically synthesized
aggcggcggatcacaaggtc

SEQ ID NO: 318988 - DNA, 20 bp, Artificial Sequence
  chemically synthesized
gcggcggatcacaaggtcag

SEQ ID NO: 318989 - DNA, 20 bp, Artificial Sequence
  chemically synthesized
tcacaaggtcaggagttcga

SEQ ID NO: 318990 - DNA, 20 bp, Artificial Sequence
  chemically synthesized
tcaggagttcgaaagcatcc

SEQ ID NO: 318991 - DNA, 20 bp, Artificial Sequence
  chemically synthesized
ggggtttcaccatgttggcc

SEQ ID NO: 318992 - DNA, 20 bp, Artificial Sequence
  chemically synthesized
cgaaagcatcctggccaaca

SEQ ID NO: 318993 - DNA, 20 bp, Artificial Sequence
  chemically synthesized
tggggtttcaccatgttggc

SEQ ID NO: 318994 - DNA, 20 bp, Artificial Sequence
  chemically synthesized
gagatggggtttcaccatgt

SEQ ID NO: 318995 - DNA, 20 bp, Artificial Sequence
  chemically synthesized
ttgtatttttagtggagatg

SEQ ID NO: 318996 - DNA, 20 bp, Artificial Sequence
  chemically synthesized
tttgtatttttagtggagat

SEQ ID NO: 318997 - DNA, 20 bp, Artificial Sequence
  chemically synthesized
ttttgtatttttagtggaga

SEQ ID NO: 318998 - DNA, 20 bp, Artificial Sequence
  chemically synthesized
taatttttgtatttttagtg

SEQ ID NO: 318999 - DNA, 20 bp, Artificial Sequence
  chemically synthesized
gctaatttttgtatttttag

SEQ ID NO: 319000 - DNA, 20 bp, Artificial Sequence
  chemically synthesized
ccggctaatttttgtatttt

SEQ ID NO: 319001 - DNA, 20 bp, Artificial Sequence
  chemically synthesized
tccactaaaaatacaaaaat

SEQ ID NO: 319002 - DNA, 20 bp, Artificial Sequence
  chemically synthesized
ctaaaaatacaaaaattagc

SEQ ID NO: 319003 - DNA, 20 bp, Artificial Sequence
  chemically synthesized
taaaaatacaaaaattagcc

SEQ ID NO: 319004 - DNA, 20 bp, Artificial Sequence
  chemically synthesized
aaaatacaaaaattagccgg

SEQ ID NO: 319005 - DNA, 20 bp, Artificial Sequence
  chemically synthesized
atacaaaaattagccgggag

SEQ ID NO: 319006 - DNA, 20 bp, Artificial Sequence
  chemically synthesized
caaaaattagccgggagtgg

SEQ ID NO: 319007 - DNA, 20 bp, Artificial Sequence
  chemically synthesized
caggcatgtgccaccactcc

SEQ ID NO: 319008 - DNA, 20 bp, Artificial Sequence
  chemically synthesized
ggagtggtggcacatgcctg

SEQ ID NO: 319009 - DNA, 20 bp, Artificial Sequence
  chemically synthesized
gtggcacatgcctgtagtcc

SEQ ID NO: 319010 - DNA, 20 bp, Artificial Sequence
  chemically synthesized
tcctgagtagctgggactac

SEQ ID NO: 319011 - DNA, 20 bp, Artificial Sequence
  chemically synthesized
ctcctgagtagctgggacta

SEQ ID NO: 319012 - DNA, 20 bp, Artificial Sequence
  chemically synthesized
tgcctgtagtcccagctact

SEQ ID NO: 319013 - DNA, 20 bp, Artificial Sequence
  chemically synthesized
cctcagcctcctgagtagct

SEQ ID NO: 319014 - DNA, 20 bp, Artificial Sequence
  chemically synthesized
gcctgtagtcccagctactc

SEQ ID NO: 319015 - DNA, 20 bp, Artificial Sequence
  chemically synthesized
gcctcagcctcctgagtagc

SEQ ID NO: 319016 - DNA, 20 bp, Artificial Sequence
  chemically synthesized
ctgtagtcccagctactcag

SEQ ID NO: 319017 - DNA, 20 bp, Artificial Sequence
  chemically synthesized
tgtagtcccagctactcagg

SEQ ID NO: 319018 - DNA, 20 bp, Artificial Sequence
  chemically synthesized
tcctgcctcagcctcctgag

SEQ ID NO: 319019 - DNA, 20 bp, Artificial Sequence
  chemically synthesized
ttgtcctgcctcagcctcct

SEQ ID NO: 319020 - DNA, 20 bp, Artificial Sequence
  chemically synthesized
tcccagctactcaggaggct

SEQ ID NO: 319021 - DNA, 20 bp, Artificial Sequence
  chemically synthesized
cccagctactcaggaggctg

SEQ ID NO: 319022 - DNA, 20 bp, Artificial Sequence
  chemically synthesized
agctactcaggaggctgagg

SEQ ID NO: 319023 - DNA, 20 bp, Artificial Sequence
  chemically synthesized
gctactcaggaggctgaggc

SEQ ID NO: 319024 - DNA, 20 bp, Artificial Sequence
  chemically synthesized
ttcaagcaattgtcctgcct

SEQ ID NO: 319025 - DNA, 20 bp, Artificial Sequence
  chemically synthesized
gcaggacaattgcttgaacc

SEQ ID NO: 319026 - DNA, 20 bp, Artificial Sequence
  chemically synthesized
caggacaattgcttgaaccc

SEQ ID NO: 319027 - DNA, 20 bp, Artificial Sequence
  chemically synthesized
aacctccgcctcccgggttc

SEQ ID NO: 319028 - DNA, 20 bp, Artificial Sequence
  chemically synthesized
ggacaattgcttgaacccgg

SEQ ID NO: 319029 - DNA, 20 bp, Artificial Sequence
  chemically synthesized
gacaattgcttgaacccggg

SEQ ID NO: 319030 - DNA, 20 bp, Artificial Sequence
  chemically synthesized
aattgcttgaacccgggagg

SEQ ID NO: 319031 - DNA, 20 bp, Artificial Sequence
  chemically synthesized
cactgcaacctccgcctccc

SEQ ID NO: 319032 - DNA, 20 bp, Artificial Sequence
  chemically synthesized
ttgcttgaacccgggaggcg

SEQ ID NO: 319033 - DNA, 20 bp, Artificial Sequence
  chemically synthesized
tcactgcaacctccgcctcc

SEQ ID NO: 319034 - DNA, 20 bp, Artificial Sequence
  chemically synthesized
tgcttgaacccgggaggcgg

SEQ ID NO: 319035 - DNA, 20 bp, Artificial Sequence
  chemically synthesized
aacccgggaggcggaggttg

SEQ ID NO: 319036 - DNA, 20 bp, Artificial Sequence
  chemically synthesized
cgggaggcggaggttgcagt

SEQ ID NO: 319037 - DNA, 20 bp, Artificial Sequence
  chemically synthesized
ggcggaggttgcagtgagct

SEQ ID NO: 319038 - DNA, 20 bp, Artificial Sequence
  chemically synthesized
ggagtctaatggtgcgaact

SEQ ID NO: 319039 - DNA, 20 bp, Artificial Sequence
  chemically synthesized
gtgagctgagttcgcaccat

SEQ ID NO: 319040 - DNA, 20 bp, Artificial Sequence
  chemically synthesized
tcactcaggctggagtctaa

SEQ ID NO: 319041 - DNA, 20 bp, Artificial Sequence
  chemically synthesized
gagttcgcaccattagactc

SEQ ID NO: 319042 - DNA, 20 bp, Artificial Sequence
  chemically synthesized
gcaccattagactccagcct

SEQ ID NO: 319043 - DNA, 20 bp, Artificial Sequence
  chemically synthesized
tcactctgtcactcaggctg

SEQ ID NO: 319044 - DNA, 20 bp, Artificial Sequence
  chemically synthesized
tttcactctgtcactcaggc

SEQ ID NO: 319045 - DNA, 20 bp, Artificial Sequence
  chemically synthesized
ttagactccagcctgagtga

SEQ ID NO: 319046 - DNA, 20 bp, Artificial Sequence
  chemically synthesized
ggcgtttcactctgtcactc

SEQ ID NO: 319047 - DNA, 20 bp, Artificial Sequence
  chemically synthesized
agactccagcctgagtgaca

SEQ ID NO: 319048 - DNA, 20 bp, Artificial Sequence
  chemically synthesized
cggcgtttcactctgtcact

SEQ ID NO: 319049 - DNA, 20 bp, Artificial Sequence
  chemically synthesized
ttcttttttgttttttgaaa

SEQ ID NO: 319050 - DNA, 20 bp, Artificial Sequence
  chemically synthesized
cgccgtttcaaaaaacaaaa

SEQ ID NO: 319051 - DNA, 20 bp, Artificial Sequence
  chemically synthesized
gtttcaaaaaacaaaaaaga

SEQ ID NO: 319052 - DNA, 20 bp, Artificial Sequence
  chemically synthesized
aaaacaaaaaagaaagaatg

SEQ ID NO: 319053 - DNA, 20 bp, Artificial Sequence
  chemically synthesized
aaacaaaaaagaaagaatgt

SEQ ID NO: 319054 - DNA, 20 bp, Artificial Sequence
  chemically synthesized
caaaaaagaaagaatgtagg

SEQ ID NO: 319055 - DNA, 20 bp, Artificial Sequence
  chemically synthesized
aaaaaagaaagaatgtagga

SEQ ID NO: 319056 - DNA, 20 bp, Artificial Sequence
  chemically synthesized
gaaggcaattattctttaac

SEQ ID NO: 319057 - DNA, 20 bp, Artificial Sequence
  chemically synthesized
gttctggacaacactggtta

SEQ ID NO: 319058 - DNA, 20 bp, Artificial Sequence
  chemically synthesized
tagtaagttctggacaacac

SEQ ID NO: 319059 - DNA, 20 bp, Artificial Sequence
  chemically synthesized
attctttaaccagtgttgtc

SEQ ID NO: 319060 - DNA, 20 bp, Artificial Sequence
  chemically synthesized
tacatcattttagtaagttc

SEQ ID NO: 319061 - DNA, 20 bp, Artificial Sequence
  chemically synthesized
aatatttacatcattttagt

SEQ ID NO: 319062 - DNA, 20 bp, Artificial Sequence
  chemically synthesized
atagaatatttacatcattt

SEQ ID NO: 319063 - DNA, 20 bp, Artificial Sequence
  chemically synthesized
gtatacctatagtgcacaca

SEQ ID NO: 319064 - DNA, 20 bp, Artificial Sequence
  chemically synthesized
aatattctatgtgtgcacta

SEQ ID NO: 319065 - DNA, 20 bp, Artificial Sequence
  chemically synthesized
atattctatgtgtgcactat

SEQ ID NO: 319066 - DNA, 20 bp, Artificial Sequence
  chemically synthesized
ccattatatatgtataccta

SEQ ID NO: 319067 - DNA, 20 bp, Artificial Sequence
  chemically synthesized
ctataggtatacatatataa

SEQ ID NO: 319068 - DNA, 20 bp, Artificial Sequence
  chemically synthesized
tatacatatataatggacac

SEQ ID NO: 319069 - DNA, 20 bp, Artificial Sequence
  chemically synthesized
catatataatggacactagt

SEQ ID NO: 319070 - DNA, 20 bp, Artificial Sequence
  chemically synthesized
atatataatggacactagtc

SEQ ID NO: 319071 - DNA, 20 bp, Artificial Sequence
  chemically synthesized
tataatggacactagtcagg

SEQ ID NO: 319072 - DNA, 20 bp, Artificial Sequence
  chemically synthesized
ataatggacactagtcaggt

SEQ ID NO: 319073 - DNA, 20 bp, Artificial Sequence
  chemically synthesized
gttcattattcccacctgac

SEQ ID NO: 319074 - DNA, 20 bp, Artificial Sequence
  chemically synthesized
ttactagccatacatatttc

SEQ ID NO: 319075 - DNA, 20 bp, Artificial Sequence
  chemically synthesized
atgaacacttgaaatatgta

SEQ ID NO: 319076 - DNA, 20 bp, Artificial Sequence
  chemically synthesized
acacttgaaatatgtatggc

SEQ ID NO: 319077 - DNA, 20 bp, Artificial Sequence
  chemically synthesized
ttgaaatatgtatggctagt

SEQ ID NO: 319078 - DNA, 20 bp, Artificial Sequence
  chemically synthesized
tgaaatatgtatggctagta

SEQ ID NO: 319079 - DNA, 20 bp, Artificial Sequence
  chemically synthesized
attcagtttctgagccttac

SEQ ID NO: 319080 - DNA, 20 bp, Artificial Sequence
  chemically synthesized
tatgtatggctagtaaggct

SEQ ID NO: 319081 - DNA, 20 bp, Artificial Sequence
  chemically synthesized
tagttaaaaattcagtttct

SEQ ID NO: 319082 - DNA, 20 bp, Artificial Sequence
  chemically synthesized
attaaatatagttaaaaatt

SEQ ID NO: 319083 - DNA, 20 bp, Artificial Sequence
  chemically synthesized
ataattattataattaaata

SEQ ID NO: 319084 - DNA, 20 bp, Artificial Sequence
  chemically synthesized
aattataatttacctacaca

SEQ ID NO: 319085 - DNA, 20 bp, Artificial Sequence
  chemically synthesized
tgcagccgctagctatgtgt

SEQ ID NO: 319086 - DNA, 20 bp, Artificial Sequence
  chemically synthesized
ttgcagccgctagctatgtg

SEQ ID NO: 319087 - DNA, 20 bp, Artificial Sequence
  chemically synthesized
ataatttacctacacatagc

SEQ ID NO: 319088 - DNA, 20 bp, Artificial Sequence
  chemically synthesized
atttacctacacatagctag

SEQ ID NO: 319089 - DNA, 20 bp, Artificial Sequence
  chemically synthesized
ctgtccaatattgcagccgc

SEQ ID NO: 319090 - DNA, 20 bp, Artificial Sequence
  chemically synthesized
atagctagcggctgcaatat

SEQ ID NO: 319091 - DNA, 20 bp, Artificial Sequence
  chemically synthesized
agctgtgctgtccaatattg

SEQ ID NO: 319092 - DNA, 20 bp, Artificial Sequence
  chemically synthesized
ctagcggctgcaatattgga

SEQ ID NO: 319093 - DNA, 20 bp, Artificial Sequence
  chemically synthesized
ggctgcaatattggacagca

SEQ ID NO: 319094 - DNA, 20 bp, Artificial Sequence
  chemically synthesized
tctaattatctgtcggttta

SEQ ID NO: 319095 - DNA, 20 bp, Artificial Sequence
  chemically synthesized
acagcacagctataaaccga

SEQ ID NO: 319096 - DNA, 20 bp, Artificial Sequence
  chemically synthesized
ttggtaatctaattatctgt

SEQ ID NO: 319097 - DNA, 20 bp, Artificial Sequence
  chemically synthesized
gctataaaccgacagataat

SEQ ID NO: 319098 - DNA, 20 bp, Artificial Sequence
  chemically synthesized
aaataaggattcacggatat

SEQ ID NO: 319099 - DNA, 20 bp, Artificial Sequence
  chemically synthesized
tacttgcaaataaggattca

SEQ ID NO: 319100 - DNA, 20 bp, Artificial Sequence
  chemically synthesized
atccgtgaatccttatttgc

SEQ ID NO: 319101 - DNA, 20 bp, Artificial Sequence
  chemically synthesized
tggataagtacttgcaaata

SEQ ID NO: 319102 - DNA, 20 bp, Artificial Sequence
  chemically synthesized
atggataagtacttgcaaat

SEQ ID NO: 319103 - DNA, 20 bp, Artificial Sequence
  chemically synthesized
caaaataaattggtatggat

SEQ ID NO: 319104 - DNA, 20 bp, Artificial Sequence
  chemically synthesized
gaggacaaaataaattggta

SEQ ID NO: 319105 - DNA, 20 bp, Artificial Sequence
  chemically synthesized
cattggaggacaaaataaat

SEQ ID NO: 319106 - DNA, 20 bp, Artificial Sequence
  chemically synthesized
tcattcctcatagacattgg

SEQ ID NO: 319107 - DNA, 20 bp, Artificial Sequence
  chemically synthesized
gtcattcctcatagacattg

SEQ ID NO: 319108 - DNA, 20 bp, Artificial Sequence
  chemically synthesized
atgtcattcctcatagacat

SEQ ID NO: 319109 - DNA, 20 bp, Artificial Sequence
  chemically synthesized
ttttgtcctccaatgtctat

SEQ ID NO: 319110 - DNA, 20 bp, Artificial Sequence
  chemically synthesized
tttgtcctccaatgtctatg

SEQ ID NO: 319111 - DNA, 20 bp, Artificial Sequence
  chemically synthesized
acttaggatgtcattcctca

SEQ ID NO: 319112 - DNA, 20 bp, Artificial Sequence
  chemically synthesized
tctatgaggaatgacatcct

SEQ ID NO: 319113 - DNA, 20 bp, Artificial Sequence
  chemically synthesized
gaggaatgacatcctaagtt

SEQ ID NO: 319114 - DNA, 20 bp, Artificial Sequence
  chemically synthesized
attgctagattgctaaactt

SEQ ID NO: 319115 - DNA, 20 bp, Artificial Sequence
  chemically synthesized
tattgctagattgctaaact

SEQ ID NO: 319116 - DNA, 20 bp, Artificial Sequence
  chemically synthesized
acatcctaagtttagcaatc

SEQ ID NO: 319117 - DNA, 20 bp, Artificial Sequence
  chemically synthesized
atgctattaatgtttattgc

SEQ ID NO: 319118 - DNA, 20 bp, Artificial Sequence
  chemically synthesized
aatctagcaataaacattaa

SEQ ID NO: 319119 - DNA, 20 bp, Artificial Sequence
  chemically synthesized
tgcatttataaatttgtata

SEQ ID NO: 319120 - DNA, 20 bp, Artificial Sequence
  chemically synthesized
acaaatttataaatgcaaaa

SEQ ID NO: 319121 - DNA, 20 bp, Artificial Sequence
  chemically synthesized
gtacatgttttcattaattt

SEQ ID NO: 319122 - DNA, 20 bp, Artificial Sequence
  chemically synthesized
ctattaggaccatcaaatac

SEQ ID NO: 319123 - DNA, 20 bp, Artificial Sequence
  chemically synthesized
taatttcagcctgtatttga

SEQ ID NO: 319124 - DNA, 20 bp, Artificial Sequence
  chemically synthesized
gctattaggaccatcaaata

SEQ ID NO: 319125 - DNA, 20 bp, Artificial Sequence
  chemically synthesized
cctgtatttgatggtcctaa

SEQ ID NO: 319126 - DNA, 20 bp, Artificial Sequence
  chemically synthesized
aaagcacaaaaaatgctatt

SEQ ID NO: 319127 - DNA, 20 bp, Artificial Sequence
  chemically synthesized
taaagcacaaaaaatgctat

SEQ ID NO: 319128 - DNA, 20 bp, Artificial Sequence
  chemically synthesized
atagcattttttgtgcttta

SEQ ID NO: 319129 - DNA, 20 bp, Artificial Sequence
  chemically synthesized
ttttataatgtatttccata

SEQ ID NO: 319130 - DNA, 20 bp, Artificial Sequence
  chemically synthesized
atgaaaacataatcatatgc

SEQ ID NO: 319131 - DNA, 20 bp, Artificial Sequence
  chemically synthesized
tgaaaacataatcatatgct

SEQ ID NO: 319132 - DNA, 20 bp, Artificial Sequence
  chemically synthesized
tgcctttattagttagtgcc

SEQ ID NO: 319133 - DNA, 20 bp, Artificial Sequence
  chemically synthesized
atgctaggcactaactaata

SEQ ID NO: 319134 - DNA, 20 bp, Artificial Sequence
  chemically synthesized
ccatttatgcctttattagt

SEQ ID NO: 319135 - DNA, 20 bp, Artificial Sequence
  chemically synthesized
tgctaggcactaactaataa

SEQ ID NO: 319136 - DNA, 20 bp, Artificial Sequence
  chemically synthesized
ctatccatttatgcctttat

SEQ ID NO: 319137 - DNA, 20 bp, Artificial Sequence
  chemically synthesized
ctaactaataaaggcataaa

SEQ ID NO: 319138 - DNA, 20 bp, Artificial Sequence
  chemically synthesized
ctaataaaggcataaatgga

SEQ ID NO: 319139 - DNA, 20 bp, Artificial Sequence
  chemically synthesized
gtagtcctctaggttttata

SEQ ID NO: 319140 - DNA, 20 bp, Artificial Sequence
  chemically synthesized
tggatagactttataaaacc

SEQ ID NO: 319141 - DNA, 20 bp, Artificial Sequence
  chemically synthesized
gatagactttataaaaccta

SEQ ID NO: 319142 - DNA, 20 bp, Artificial Sequence
  chemically synthesized
atagactttataaaacctag

SEQ ID NO: 319143 - DNA, 20 bp, Artificial Sequence
  chemically synthesized
agttttaattgtagtcctct

SEQ ID NO: 319144 - DNA, 20 bp, Artificial Sequence
  chemically synthesized
aagttttaattgtagtcctc

SEQ ID NO: 319145 - DNA, 20 bp, Artificial Sequence
  chemically synthesized
taatttgtaagttttaattg

SEQ ID NO: 319146 - DNA, 20 bp, Artificial Sequence
  chemically synthesized
cacacctcttggtaatttgt

SEQ ID NO: 319147 - DNA, 20 bp, Artificial Sequence
  chemically synthesized
attaaaacttacaaattacc

SEQ ID NO: 319148 - DNA, 20 bp, Artificial Sequence
  chemically synthesized
taaaacttacaaattaccaa

SEQ ID NO: 319149 - DNA, 20 bp, Artificial Sequence
  chemically synthesized
aaaacttacaaattaccaag

SEQ ID NO: 319150 - DNA, 20 bp, Artificial Sequence
  chemically synthesized
cctaaagagctcacacctct

SEQ ID NO: 319151 - DNA, 20 bp, Artificial Sequence
  chemically synthesized
tacaaattaccaagaggtgt

SEQ ID NO: 319152 - DNA, 20 bp, Artificial Sequence
  chemically synthesized
accaagaggtgtgagctctt

SEQ ID NO: 319153 - DNA, 20 bp, Artificial Sequence
  chemically synthesized
ccaagaggtgtgagctcttt

SEQ ID NO: 319154 - DNA, 20 bp, Artificial Sequence
  chemically synthesized
agaggtgtgagctctttagg

SEQ ID NO: 319155 - DNA, 20 bp, Artificial Sequence
  chemically synthesized
tgagagcctgtcttcctaaa

SEQ ID NO: 319156 - DNA, 20 bp, Artificial Sequence
  chemically synthesized
cctgagagcctgtcttccta

SEQ ID NO: 319157 - DNA, 20 bp, Artificial Sequence
  chemically synthesized
gtgtgagctctttaggaaga

SEQ ID NO: 319158 - DNA, 20 bp, Artificial Sequence
  chemically synthesized
tgtgagctctttaggaagac

SEQ ID NO: 319159 - DNA, 20 bp, Artificial Sequence
  chemically synthesized
tctttaggaagacaggctct

SEQ ID NO: 319160 - DNA, 20 bp, Artificial Sequence
  chemically synthesized
ctttaggaagacaggctctc

SEQ ID NO: 319161 - DNA, 20 bp, Artificial Sequence
  chemically synthesized
ttctagggaattgggcctga

SEQ ID NO: 319162 - DNA, 20 bp, Artificial Sequence
  chemically synthesized
aattctagggaattgggcct

SEQ ID NO: 319163 - DNA, 20 bp, Artificial Sequence
  chemically synthesized
ggctctcaggcccaattccc

SEQ ID NO: 319164 - DNA, 20 bp, Artificial Sequence
  chemically synthesized
actgtgaattctagggaatt

SEQ ID NO: 319165 - DNA, 20 bp, Artificial Sequence
  chemically synthesized
aactgtgaattctagggaat

SEQ ID NO: 319166 - DNA, 20 bp, Artificial Sequence
  chemically synthesized
gccagtaactgtgaattcta

SEQ ID NO: 319167 - DNA, 20 bp, Artificial Sequence
  chemically synthesized
tgccagtaactgtgaattct

SEQ ID NO: 319168 - DNA, 20 bp, Artificial Sequence
  chemically synthesized
gcccaattccctagaattca

SEQ ID NO: 319169 - DNA, 20 bp, Artificial Sequence
  chemically synthesized
atgccagtaactgtgaattc

SEQ ID NO: 319170 - DNA, 20 bp, Artificial Sequence
  chemically synthesized
tccctagaattcacagttac

SEQ ID NO: 319171 - DNA, 20 bp, Artificial Sequence
  chemically synthesized
attgaggattgcatatatgc

SEQ ID NO: 319172 - DNA, 20 bp, Artificial Sequence
  chemically synthesized
aggtgtatttttttaaattg

SEQ ID NO: 319173 - DNA, 20 bp, Artificial Sequence
  chemically synthesized
taggtgtatttttttaaatt

SEQ ID NO: 319174 - DNA, 20 bp, Artificial Sequence
  chemically synthesized
taaaaaaatacacctaataa

SEQ ID NO: 319175 - DNA, 20 bp, Artificial Sequence
  chemically synthesized
aaaaaaatacacctaataaa

SEQ ID NO: 319176 - DNA, 20 bp, Artificial Sequence
  chemically synthesized
atacattacctccttttatt

SEQ ID NO: 319177 - DNA, 20 bp, Artificial Sequence
  chemically synthesized
aaaaatacacctaataaaag

SEQ ID NO: 319178 - DNA, 20 bp, Artificial Sequence
  chemically synthesized
aatacattacctccttttat

SEQ ID NO: 319179 - DNA, 20 bp, Artificial Sequence
  chemically synthesized
aaaatacacctaataaaagg

SEQ ID NO: 319180 - DNA, 20 bp, Artificial Sequence
  chemically synthesized
gaggtaatgtattataatga

SEQ ID NO: 319181 - DNA, 20 bp, Artificial Sequence
  chemically synthesized
aatgtattataatgaaagtc

SEQ ID NO: 319182 - DNA, 20 bp, Artificial Sequence
  chemically synthesized
attataatgaaagtctagat

SEQ ID NO: 319183 - DNA, 20 bp, Artificial Sequence
  chemically synthesized
ctggtagttcttttctaatc

SEQ ID NO: 319184 - DNA, 20 bp, Artificial Sequence
  chemically synthesized
aatgaaagtctagattagaa

SEQ ID NO: 319185 - DNA, 20 bp, Artificial Sequence
  chemically synthesized
ctagattagaaaagaactac

SEQ ID NO: 319186 - DNA, 20 bp, Artificial Sequence
  chemically synthesized
tgtcaattgaacatcactgg

SEQ ID NO: 319187 - DNA, 20 bp, Artificial Sequence
  chemically synthesized
acatgtcaattgaacatcac

SEQ ID NO: 319188 - DNA, 20 bp, Artificial Sequence
  chemically synthesized
tgtaattgtattttacatgt

SEQ ID NO: 319189 - DNA, 20 bp, Artificial Sequence
  chemically synthesized
aaaatacaattacatgattt

SEQ ID NO: 319190 - DNA, 20 bp, Artificial Sequence
  chemically synthesized
tacaattacatgatttaagt

SEQ ID NO: 319191 - DNA, 20 bp, Artificial Sequence
  chemically synthesized
tcccttaaatcatattatac

SEQ ID NO: 319192 - DNA, 20 bp, Artificial Sequence
  chemically synthesized
ttcccttaaatcatattata

SEQ ID NO: 319193 - DNA, 20 bp, Artificial Sequence
  chemically synthesized
aaacctgtataatatgattt

SEQ ID NO: 319194 - DNA, 20 bp, Artificial Sequence
  chemically synthesized
aacctgtataatatgattta

SEQ ID NO: 319195 - DNA, 20 bp, Artificial Sequence
  chemically synthesized
acctgtataatatgatttaa

SEQ ID NO: 319196 - DNA, 20 bp, Artificial Sequence
  chemically synthesized
gtataatatgatttaaggga

SEQ ID NO: 319197 - DNA, 20 bp, Artificial Sequence
  chemically synthesized
atgatttaagggaaagatac

SEQ ID NO: 319198 - DNA, 20 bp, Artificial Sequence
  chemically synthesized
taagtttctctaatttgtac

SEQ ID NO: 319199 - DNA, 20 bp, Artificial Sequence
  chemically synthesized
ggaaagataccagtacaaat

SEQ ID NO: 319200 - DNA, 20 bp, Artificial Sequence
  chemically synthesized
aaagataccagtacaaatta

SEQ ID NO: 319201 - DNA, 20 bp, Artificial Sequence
  chemically synthesized
aaaaacatgcattaaaaatt

SEQ ID NO: 319202 - DNA, 20 bp, Artificial Sequence
  chemically synthesized
tctaaatggcgtgcatttaa

SEQ ID NO: 319203 - DNA, 20 bp, Artificial Sequence
  chemically synthesized
acttttaaatgcacgccatt

SEQ ID NO: 319204 - DNA, 20 bp, Artificial Sequence
  chemically synthesized
gtacaattttagtttctaaa

SEQ ID NO: 319205 - DNA, 20 bp, Artificial Sequence
  chemically synthesized
aattttcatcagtacaattt

SEQ ID NO: 319206 - DNA, 20 bp, Artificial Sequence
  chemically synthesized
aaatcaattccaattttcat

SEQ ID NO: 319207 - DNA, 20 bp, Artificial Sequence
  chemically synthesized
aaaattgtactgatgaaaat

SEQ ID NO: 319208 - DNA, 20 bp, Artificial Sequence
  chemically synthesized
cctgagccatcattttgaat

SEQ ID NO: 319209 - DNA, 20 bp, Artificial Sequence
  chemically synthesized
tatttacttattcaaaatga

SEQ ID NO: 319210 - DNA, 20 bp, Artificial Sequence
  chemically synthesized
acttattcaaaatgatggct

SEQ ID NO: 319211 - DNA, 20 bp, Artificial Sequence
  chemically synthesized
cttattcaaaatgatggctc

SEQ ID NO: 319212 - DNA, 20 bp, Artificial Sequence
  chemically synthesized
ttcaaaatgatggctcaggc

SEQ ID NO: 319213 - DNA, 20 bp, Artificial Sequence
  chemically synthesized
tcaaaatgatggctcaggct

SEQ ID NO: 319214 - DNA, 20 bp, Artificial Sequence
  chemically synthesized
tgagccactgtgcccagcct

SEQ ID NO: 319215 - DNA, 20 bp, Artificial Sequence
  chemically synthesized
atgatggctcaggctgggca

SEQ ID NO: 319216 - DNA, 20 bp, Artificial Sequence
  chemically synthesized
atggctcaggctgggcacag

SEQ ID NO: 319217 - DNA, 20 bp, Artificial Sequence
  chemically synthesized
caggcctgagccactgtgcc

SEQ ID NO: 319218 - DNA, 20 bp, Artificial Sequence
  chemically synthesized
tcaggctgggcacagtggct

SEQ ID NO: 319219 - DNA, 20 bp, Artificial Sequence
  chemically synthesized
caggctgggcacagtggctc

SEQ ID NO: 319220 - DNA, 20 bp, Artificial Sequence
  chemically synthesized
aatgctgggattacaggcct

SEQ ID NO: 319221 - DNA, 20 bp, Artificial Sequence
  chemically synthesized
gtggctcaggcctgtaatcc

SEQ ID NO: 319222 - DNA, 20 bp, Artificial Sequence
  chemically synthesized
tcccaaaatgctgggattac

SEQ ID NO: 319223 - DNA, 20 bp, Artificial Sequence
  chemically synthesized
ctcccaaaatgctgggatta

SEQ ID NO: 319224 - DNA, 20 bp, Artificial Sequence
  chemically synthesized
ggcctgtaatcccagcattt

SEQ ID NO: 319225 - DNA, 20 bp, Artificial Sequence
  chemically synthesized
cctcggcctcccaaaatgct

SEQ ID NO: 319226 - DNA, 20 bp, Artificial Sequence
  chemically synthesized
gcctgtaatcccagcatttt

SEQ ID NO: 319227 - DNA, 20 bp, Artificial Sequence
  chemically synthesized
acctcggcctcccaaaatgc

SEQ ID NO: 319228 - DNA, 20 bp, Artificial Sequence
  chemically synthesized
ctgtaatcccagcattttgg

SEQ ID NO: 319229 - DNA, 20 bp, Artificial Sequence
  chemically synthesized
tgtaatcccagcattttggg

SEQ ID NO: 319230 - DNA, 20 bp, Artificial Sequence
  chemically synthesized
tcccagcattttgggaggcc

SEQ ID NO: 319231 - DNA, 20 bp, Artificial Sequence
  chemically synthesized
cccagcattttgggaggccg

SEQ ID NO: 319232 - DNA, 20 bp, Artificial Sequence
  chemically synthesized
agcattttgggaggccgagg

SEQ ID NO: 319233 - DNA, 20 bp, Artificial Sequence
  chemically synthesized
ttttgggaggccgaggtggc

SEQ ID NO: 319234 - DNA, 20 bp, Artificial Sequence
  chemically synthesized
ctcaggtgatccagccacct

SEQ ID NO: 319235 - DNA, 20 bp, Artificial Sequence
  chemically synthesized
actcctgacctcaggtgatc

SEQ ID NO: 319236 - DNA, 20 bp, Artificial Sequence
  chemically synthesized
ccgaggtggctggatcacct

SEQ ID NO: 319237 - DNA, 20 bp, Artificial Sequence
  chemically synthesized
cgaggtggctggatcacctg

SEQ ID NO: 319238 - DNA, 20 bp, Artificial Sequence
  chemically synthesized
gtggctggatcacctgaggt

SEQ ID NO: 319239 - DNA, 20 bp, Artificial Sequence
  chemically synthesized
tggctggatcacctgaggtc

SEQ ID NO: 319240 - DNA, 20 bp, Artificial Sequence
  chemically synthesized
ggtcttgaactcctgacctc

SEQ ID NO: 319241 - DNA, 20 bp, Artificial Sequence
  chemically synthesized
gctggatcacctgaggtcag

SEQ ID NO: 319242 - DNA, 20 bp, Artificial Sequence
  chemically synthesized
tggtcttgaactcctgacct

SEQ ID NO: 319243 - DNA, 20 bp, Artificial Sequence
  chemically synthesized
tcacctgaggtcaggagttc

SEQ ID NO: 319244 - DNA, 20 bp, Artificial Sequence
  chemically synthesized
tgaggtcaggagttcaagac

SEQ ID NO: 319245 - DNA, 20 bp, Artificial Sequence
  chemically synthesized
tcaggagttcaagaccagcc

SEQ ID NO: 319246 - DNA, 20 bp, Artificial Sequence
  chemically synthesized
ggggtttctattggccaggc

SEQ ID NO: 319247 - DNA, 20 bp, Artificial Sequence
  chemically synthesized
ttcaagaccagcctggccaa

SEQ ID NO: 319248 - DNA, 20 bp, Artificial Sequence
  chemically synthesized
agatggggtttctattggcc

SEQ ID NO: 319249 - DNA, 20 bp, Artificial Sequence
  chemically synthesized
gagatggggtttctattggc

SEQ ID NO: 319250 - DNA, 20 bp, Artificial Sequence
  chemically synthesized
agtagagatggggtttctat

SEQ ID NO: 319251 - DNA, 20 bp, Artificial Sequence
  chemically synthesized
ttgtatttttagtagagatg

SEQ ID NO: 319252 - DNA, 20 bp, Artificial Sequence
  chemically synthesized
tttgtatttttagtagagat

SEQ ID NO: 319253 - DNA, 20 bp, Artificial Sequence
  chemically synthesized
ttttgtatttttagtagaga

SEQ ID NO: 319254 - DNA, 20 bp, Artificial Sequence
  chemically synthesized
taatttttgtatttttagta

SEQ ID NO: 319255 - DNA, 20 bp, Artificial Sequence
  chemically synthesized
gctaatttttgtatttttag

SEQ ID NO: 319256 - DNA, 20 bp, Artificial Sequence
  chemically synthesized
ccagctaatttttgtatttt

SEQ ID NO: 319257 - DNA, 20 bp, Artificial Sequence
  chemically synthesized
tctactaaaaatacaaaaat

SEQ ID NO: 319258 - DNA, 20 bp, Artificial Sequence
  chemically synthesized
ctaaaaatacaaaaattagc

SEQ ID NO: 319259 - DNA, 20 bp, Artificial Sequence
  chemically synthesized
taaaaatacaaaaattagct

SEQ ID NO: 319260 - DNA, 20 bp, Artificial Sequence
  chemically synthesized
atacaaaaattagctgggcg

SEQ ID NO: 319261 - DNA, 20 bp, Artificial Sequence
  chemically synthesized
caaaaattagctgggcgtgg

SEQ ID NO: 319262 - DNA, 20 bp, Artificial Sequence
  chemically synthesized
aaagtgcttgccaccacgcc

SEQ ID NO: 319263 - DNA, 20 bp, Artificial Sequence
  chemically synthesized
aattagctgggcgtggtggc

SEQ ID NO: 319264 - DNA, 20 bp, Artificial Sequence
  chemically synthesized
cctgagtagccgggattaaa

SEQ ID NO: 319265 - DNA, 20 bp, Artificial Sequence
  chemically synthesized
tggcaagcactttttaatcc

SEQ ID NO: 319266 - DNA, 20 bp, Artificial Sequence
  chemically synthesized
actttttaatcccggctact

SEQ ID NO: 319267 - DNA, 20 bp, Artificial Sequence
  chemically synthesized
cctcagcctcctgagtagcc

SEQ ID NO: 319268 - DNA, 20 bp, Artificial Sequence
  chemically synthesized
ctttttaatcccggctactc

SEQ ID NO: 319269 - DNA, 20 bp, Artificial Sequence
  chemically synthesized
gcctcagcctcctgagtagc

SEQ ID NO: 319270 - DNA, 20 bp, Artificial Sequence
  chemically synthesized
ttttaatcccggctactcag

SEQ ID NO: 319271 - DNA, 20 bp, Artificial Sequence
  chemically synthesized
tttaatcccggctactcagg

SEQ ID NO: 319272 - DNA, 20 bp, Artificial Sequence
  chemically synthesized
tcctgcctcagcctcctgag

SEQ ID NO: 319273 - DNA, 20 bp, Artificial Sequence
  chemically synthesized
ttctcctgcctcagcctcct

SEQ ID NO: 319274 - DNA, 20 bp, Artificial Sequence
  chemically synthesized
tcccggctactcaggaggct

SEQ ID NO: 319275 - DNA, 20 bp, Artificial Sequence
  chemically synthesized
cccggctactcaggaggctg

SEQ ID NO: 319276 - DNA, 20 bp, Artificial Sequence
  chemically synthesized
ggctactcaggaggctgagg

SEQ ID NO: 319277 - DNA, 20 bp, Artificial Sequence
  chemically synthesized
gctactcaggaggctgaggc

SEQ ID NO: 319278 - DNA, 20 bp, Artificial Sequence
  chemically synthesized
tactcaggaggctgaggcag

SEQ ID NO: 319279 - DNA, 20 bp, Artificial Sequence
  chemically synthesized
ttcaagtgattctcctgcct

SEQ ID NO: 319280 - DNA, 20 bp, Artificial Sequence
  chemically synthesized
gcaggagaatcacttgaacc

SEQ ID NO: 319281 - DNA, 20 bp, Artificial Sequence
  chemically synthesized
caggagaatcacttgaaccc

SEQ ID NO: 319282 - DNA, 20 bp, Artificial Sequence
  chemically synthesized
aggagaatcacttgaacccg

SEQ ID NO: 319283 - DNA, 20 bp, Artificial Sequence
  chemically synthesized
acctctgtccccccgggttc

SEQ ID NO: 319284 - DNA, 20 bp, Artificial Sequence
  chemically synthesized
ggagaatcacttgaacccgg

SEQ ID NO: 319285 - DNA, 20 bp, Artificial Sequence
  chemically synthesized
gagaatcacttgaacccggg

SEQ ID NO: 319286 - DNA, 20 bp, Artificial Sequence
  chemically synthesized
atcacttgaacccgggggga

SEQ ID NO: 319287 - DNA, 20 bp, Artificial Sequence
  chemically synthesized
actgcaacctctgtcccccc

SEQ ID NO: 319288 - DNA, 20 bp, Artificial Sequence
  chemically synthesized
cactgcaacctctgtccccc

SEQ ID NO: 319289 - DNA, 20 bp, Artificial Sequence
  chemically synthesized
cacttgaacccggggggaca

SEQ ID NO: 319290 - DNA, 20 bp, Artificial Sequence
  chemically synthesized
acttgaacccggggggacag

SEQ ID NO: 319291 - DNA, 20 bp, Artificial Sequence
  chemically synthesized
acccggggggacagaggttg

SEQ ID NO: 319292 - DNA, 20 bp, Artificial Sequence
  chemically synthesized
ggggggacagaggttgcagt

SEQ ID NO: 319293 - DNA, 20 bp, Artificial Sequence
  chemically synthesized
gacagaggttgcagtgagct

SEQ ID NO: 319294 - DNA, 20 bp, Artificial Sequence
  chemically synthesized
ggagtgaagtggtgtgatct

SEQ ID NO: 319295 - DNA, 20 bp, Artificial Sequence
  chemically synthesized
tcacccaggctggagtgaag

SEQ ID NO: 319296 - DNA, 20 bp, Artificial Sequence
  chemically synthesized
gagatcacaccacttcactc

SEQ ID NO: 319297 - DNA, 20 bp, Artificial Sequence
  chemically synthesized
ctttcacccaggctggagtg

SEQ ID NO: 319298 - DNA, 20 bp, Artificial Sequence
  chemically synthesized
cacaccacttcactccagcc

SEQ ID NO: 319299 - DNA, 20 bp, Artificial Sequence
  chemically synthesized
acaccacttcactccagcct

SEQ ID NO: 319300 - DNA, 20 bp, Artificial Sequence
  chemically synthesized
ttgttctttcacccaggctg

SEQ ID NO: 319301 - DNA, 20 bp, Artificial Sequence
  chemically synthesized
ttttgttctttcacccaggc

SEQ ID NO: 319302 - DNA, 20 bp, Artificial Sequence
  chemically synthesized
cttcactccagcctgggtga

SEQ ID NO: 319303 - DNA, 20 bp, Artificial Sequence
  chemically synthesized
ggagttttgttctttcaccc

SEQ ID NO: 319304 - DNA, 20 bp, Artificial Sequence
  chemically synthesized
cggagttttgttctttcacc

SEQ ID NO: 319305 - DNA, 20 bp, Artificial Sequence
  chemically synthesized
ttatctatttttttaagacg

SEQ ID NO: 319306 - DNA, 20 bp, Artificial Sequence
  chemically synthesized
ttttatctatttttttaaga

SEQ ID NO: 319307 - DNA, 20 bp, Artificial Sequence
  chemically synthesized
aaaactccgtcttaaaaaaa

SEQ ID NO: 319308 - DNA, 20 bp, Artificial Sequence
  chemically synthesized
ttatttttatctattttttt

SEQ ID NO: 319309 - DNA, 20 bp, Artificial Sequence
  chemically synthesized
agataaaaataacaaaacga

SEQ ID NO: 319310 - DNA, 20 bp, Artificial Sequence
  chemically synthesized
accaccttgctagaattttt

SEQ ID NO: 319311 - DNA, 20 bp, Artificial Sequence
  chemically synthesized
aaacgatggctcaaaaattc

SEQ ID NO: 319312 - DNA, 20 bp, Artificial Sequence
  chemically synthesized
gatggctcaaaaattctagc

SEQ ID NO: 319313 - DNA, 20 bp, Artificial Sequence
  chemically synthesized
atggctcaaaaattctagca

SEQ ID NO: 319314 - DNA, 20 bp, Artificial Sequence
  chemically synthesized
gctcaaaaattctagcaagg

SEQ ID NO: 319315 - DNA, 20 bp, Artificial Sequence
  chemically synthesized
atctataagaaccaccttgc

SEQ ID NO: 319316 - DNA, 20 bp, Artificial Sequence
  chemically synthesized
ttctagcaaggtggttctta

SEQ ID NO: 319317 - DNA, 20 bp, Artificial Sequence
  chemically synthesized
agcaaggtggttcttataga

SEQ ID NO: 319318 - DNA, 20 bp, Artificial Sequence
  chemically synthesized
accaaaactaatctatctat

SEQ ID NO: 319319 - DNA, 20 bp, Artificial Sequence
  chemically synthesized
ggtggttcttatagatagat

SEQ ID NO: 319320 - DNA, 20 bp, Artificial Sequence
  chemically synthesized
tcttatagatagattagttt

SEQ ID NO: 319321 - DNA, 20 bp, Artificial Sequence
  chemically synthesized
agatagattagttttggttt

SEQ ID NO: 319322 - DNA, 20 bp, Artificial Sequence
  chemically synthesized
gttgcatataaagaattgtt

SEQ ID NO: 319323 - DNA, 20 bp, Artificial Sequence
  chemically synthesized
gaagcatctagttgcatata

SEQ ID NO: 319324 - DNA, 20 bp, Artificial Sequence
  chemically synthesized
aacaattctttatatgcaac

SEQ ID NO: 319325 - DNA, 20 bp, Artificial Sequence
  chemically synthesized
gacagcattctagaagcatc

SEQ ID NO: 319326 - DNA, 20 bp, Artificial Sequence
  chemically synthesized
tatatgcaactagatgcttc

SEQ ID NO: 319327 - DNA, 20 bp, Artificial Sequence
  chemically synthesized
agcagatgacagcattctag

SEQ ID NO: 319328 - DNA, 20 bp, Artificial Sequence
  chemically synthesized
ttaagcagatgacagcattc

SEQ ID NO: 319329 - DNA, 20 bp, Artificial Sequence
  chemically synthesized
ttacttatttaagcagatga

SEQ ID NO: 319330 - DNA, 20 bp, Artificial Sequence
  chemically synthesized
atgctgtcatctgcttaaat

SEQ ID NO: 319331 - DNA, 20 bp, Artificial Sequence
  chemically synthesized
ttaaaaattacttatttaag

SEQ ID NO: 319332 - DNA, 20 bp, Artificial Sequence
  chemically synthesized
attttaaaaattacttattt

SEQ ID NO: 319333 - DNA, 20 bp, Artificial Sequence
  chemically synthesized
ttttaaaatcaactttgttt

SEQ ID NO: 319334 - DNA, 20 bp, Artificial Sequence
  chemically synthesized
atgaaacaaaagctgaaaca

SEQ ID NO: 319335 - DNA, 20 bp, Artificial Sequence
  chemically synthesized
cttaatagagaatgaaacaa

SEQ ID NO: 319336 - DNA, 20 bp, Artificial Sequence
  chemically synthesized
cttttgtttcattctctatt

SEQ ID NO: 319337 - DNA, 20 bp, Artificial Sequence
  chemically synthesized
ccccaatacctttcttaata

SEQ ID NO: 319338 - DNA, 20 bp, Artificial Sequence
  chemically synthesized
tgtttcattctctattaaga

SEQ ID NO: 319339 - DNA, 20 bp, Artificial Sequence
  chemically synthesized
gtttcattctctattaagaa

SEQ ID NO: 319340 - DNA, 20 bp, Artificial Sequence
  chemically synthesized
gcccccaatacctttcttaa

SEQ ID NO: 319341 - DNA, 20 bp, Artificial Sequence
  chemically synthesized
ttctctattaagaaaggtat

SEQ ID NO: 319342 - DNA, 20 bp, Artificial Sequence
  chemically synthesized
tctctattaagaaaggtatt

SEQ ID NO: 319343 - DNA, 20 bp, Artificial Sequence
  chemically synthesized
ctctattaagaaaggtattg

SEQ ID NO: 319344 - DNA, 20 bp, Artificial Sequence
  chemically synthesized
tctattaagaaaggtattgg

SEQ ID NO: 319345 - DNA, 20 bp, Artificial Sequence
  chemically synthesized
ttaagaaaggtattgggggc

SEQ ID NO: 319346 - DNA, 20 bp, Artificial Sequence
  chemically synthesized
taagaaaggtattgggggct

SEQ ID NO: 319347 - DNA, 20 bp, Artificial Sequence
  chemically synthesized
aagaaaggtattgggggctg

SEQ ID NO: 319348 - DNA, 20 bp, Artificial Sequence
  chemically synthesized
aaaggtattgggggctgggg

SEQ ID NO: 319349 - DNA, 20 bp, Artificial Sequence
  chemically synthesized
aaggtattgggggctgggga

SEQ ID NO: 319350 - DNA, 20 bp, Artificial Sequence
  chemically synthesized
tcctaatgctattccttccc

SEQ ID NO: 319351 - DNA, 20 bp, Artificial Sequence
  chemically synthesized
attgggggctggggaaggaa

SEQ ID NO: 319352 - DNA, 20 bp, Artificial Sequence
  chemically synthesized
ggctggggaaggaatagcat

SEQ ID NO: 319353 - DNA, 20 bp, Artificial Sequence
  chemically synthesized
gctggggaaggaatagcatt

SEQ ID NO: 319354 - DNA, 20 bp, Artificial Sequence
  chemically synthesized
tggggaaggaatagcattag

SEQ ID NO: 319355 - DNA, 20 bp, Artificial Sequence
  chemically synthesized
cccatcagctcatttacatt

SEQ ID NO: 319356 - DNA, 20 bp, Artificial Sequence
  chemically synthesized
acccatcagctcatttacat

SEQ ID NO: 319357 - DNA, 20 bp, Artificial Sequence
  chemically synthesized
gagaaatacctaatgtaaat

SEQ ID NO: 319358 - DNA, 20 bp, Artificial Sequence
  chemically synthesized
acctaatgtaaatgagctga

SEQ ID NO: 319359 - DNA, 20 bp, Artificial Sequence
  chemically synthesized
cctaatgtaaatgagctgat

SEQ ID NO: 319360 - DNA, 20 bp, Artificial Sequence
  chemically synthesized
tgtaaatgagctgatgggtg

SEQ ID NO: 319361 - DNA, 20 bp, Artificial Sequence
  chemically synthesized
tgttggtttgctgcacccat

SEQ ID NO: 319362 - DNA, 20 bp, Artificial Sequence
  chemically synthesized
atgggtgcagcaaaccaaca

SEQ ID NO: 319363 - DNA, 20 bp, Artificial Sequence
  chemically synthesized
taggtatacatgtgccatgt

SEQ ID NO: 319364 - DNA, 20 bp, Artificial Sequence
  chemically synthesized
aactcgcaggtttgatacat

SEQ ID NO: 319365 - DNA, 20 bp, Artificial Sequence
  chemically synthesized
caactcgcaggtttgataca

SEQ ID NO: 319366 - DNA, 20 bp, Artificial Sequence
  chemically synthesized
tacctatgtatcaaacctgc

SEQ ID NO: 319367 - DNA, 20 bp, Artificial Sequence
  chemically synthesized
gatgcatgtgcacaactcgc

SEQ ID NO: 319368 - DNA, 20 bp, Artificial Sequence
  chemically synthesized
ggatgcatgtgcacaactcg

SEQ ID NO: 319369 - DNA, 20 bp, Artificial Sequence
  chemically synthesized
cgagttgtgcacatgcatcc

SEQ ID NO: 319370 - DNA, 20 bp, Artificial Sequence
  chemically synthesized
attattatactttaatttct

SEQ ID NO: 319371 - DNA, 20 bp, Artificial Sequence
  chemically synthesized
cacatgcatcctagaaatta

SEQ ID NO: 319372 - DNA, 20 bp, Artificial Sequence
  chemically synthesized
tattattatactttaatttc

SEQ ID NO: 319373 - DNA, 20 bp, Artificial Sequence
  chemically synthesized
aagtataataataataataa

SEQ ID NO: 319374 - DNA, 20 bp, Artificial Sequence
  chemically synthesized
gtataataataataataaaa

SEQ ID NO: 319375 - DNA, 20 bp, Artificial Sequence
  chemically synthesized
tataataataataataaaag

SEQ ID NO: 319376 - DNA, 20 bp, Artificial Sequence
  chemically synthesized
ataataataataataaaaga

SEQ ID NO: 319377 - DNA, 20 bp, Artificial Sequence
  chemically synthesized
aataataataataaaagagg

SEQ ID NO: 319378 - DNA, 20 bp, Artificial Sequence
  chemically synthesized
taataataataaaagaggga

SEQ ID NO: 319379 - DNA, 20 bp, Artificial Sequence
  chemically synthesized
aataaaagagggagagaaaa

SEQ ID NO: 319380 - DNA, 20 bp, Artificial Sequence
  chemically synthesized
aagagggagagaaaaaagaa

SEQ ID NO: 319381 - DNA, 20 bp, Artificial Sequence
  chemically synthesized
agaaaaaagaaaagaaatcc

SEQ ID NO: 319382 - DNA, 20 bp, Artificial Sequence
  chemically synthesized
aaaagaaaagaaatccaaga

SEQ ID NO: 319383 - DNA, 20 bp, Artificial Sequence
  chemically synthesized
aaagaaaagaaatccaagat

SEQ ID NO: 319384 - DNA, 20 bp, Artificial Sequence
  chemically synthesized
ttctgttttttaacctatct

SEQ ID NO: 319385 - DNA, 20 bp, Artificial Sequence
  chemically synthesized
atccaagataggttaaaaaa

SEQ ID NO: 319386 - DNA, 20 bp, Artificial Sequence
  chemically synthesized
aagataggttaaaaaacaga

SEQ ID NO: 319387 - DNA, 20 bp, Artificial Sequence
  chemically synthesized
aaaacagaaagttattaatt

SEQ ID NO: 319388 - DNA, 20 bp, Artificial Sequence
  chemically synthesized
aaacagaaagttattaattg

SEQ ID NO: 319389 - DNA, 20 bp, Artificial Sequence
  chemically synthesized
tattaattgaggtaatgttt

SEQ ID NO: 319390 - DNA, 20 bp, Artificial Sequence
  chemically synthesized
attgaggtaatgtttaagtc

SEQ ID NO: 319391 - DNA, 20 bp, Artificial Sequence
  chemically synthesized
gtgatagtttgaataaaagc

SEQ ID NO: 319392 - DNA, 20 bp, Artificial Sequence
  chemically synthesized
atctgtgatagtttgaataa

SEQ ID NO: 319393 - DNA, 20 bp, Artificial Sequence
  chemically synthesized
ggcttttattcaaactatca

SEQ ID NO: 319394 - DNA, 20 bp, Artificial Sequence
  chemically synthesized
tttattcaaactatcacaga

SEQ ID NO: 319395 - DNA, 20 bp, Artificial Sequence
  chemically synthesized
actaattcacctatctgtga

SEQ ID NO: 319396 - DNA, 20 bp, Artificial Sequence
  chemically synthesized
ttattcaaactatcacagat

SEQ ID NO: 319397 - DNA, 20 bp, Artificial Sequence
  chemically synthesized
actatcacagataggtgaat

SEQ ID NO: 319398 - DNA, 20 bp, Artificial Sequence
  chemically synthesized
atcacagataggtgaattag

SEQ ID NO: 319399 - DNA, 20 bp, Artificial Sequence
  chemically synthesized
attagtacctttttatatta

SEQ ID NO: 319400 - DNA, 20 bp, Artificial Sequence
  chemically synthesized
aattagtacctttttatatt

SEQ ID NO: 319401 - DNA, 20 bp, Artificial Sequence
  chemically synthesized
aaataatgccttaatataaa

SEQ ID NO: 319402 - DNA, 20 bp, Artificial Sequence
  chemically synthesized
aataatgccttaatataaaa

SEQ ID NO: 319403 - DNA, 20 bp, Artificial Sequence
  chemically synthesized
ataaaaaggtactaattgat

SEQ ID NO: 319404 - DNA, 20 bp, Artificial Sequence
  chemically synthesized
tctcagtgattctaatcaat

SEQ ID NO: 319405 - DNA, 20 bp, Artificial Sequence
  chemically synthesized
actaattgattagaatcact

SEQ ID NO: 319406 - DNA, 20 bp, Artificial Sequence
  chemically synthesized
taattgattagaatcactga

SEQ ID NO: 319407 - DNA, 20 bp, Artificial Sequence
  chemically synthesized
gtcattttgaaaagttctct

SEQ ID NO: 319408 - DNA, 20 bp, Artificial Sequence
  chemically synthesized
ggctgggacgtcattttgaa

SEQ ID NO: 319409 - DNA, 20 bp, Artificial Sequence
  chemically synthesized
aacttttcaaaatgacgtcc

SEQ ID NO: 319410 - DNA, 20 bp, Artificial Sequence
  chemically synthesized
aattgttggggaatggggct

SEQ ID NO: 319411 - DNA, 20 bp, Artificial Sequence
  chemically synthesized
gaattgttggggaatggggc

SEQ ID NO: 319412 - DNA, 20 bp, Artificial Sequence
  chemically synthesized
gattgaattgttggggaatg

SEQ ID NO: 319413 - DNA, 20 bp, Artificial Sequence
  chemically synthesized
tgattgaattgttggggaat

SEQ ID NO: 319414 - DNA, 20 bp, Artificial Sequence
  chemically synthesized
ctgattgaattgttggggaa

SEQ ID NO: 319415 - DNA, 20 bp, Artificial Sequence
  chemically synthesized
atattctgattgaattgttg

SEQ ID NO: 319416 - DNA, 20 bp, Artificial Sequence
  chemically synthesized
gatattctgattgaattgtt

SEQ ID NO: 319417 - DNA, 20 bp, Artificial Sequence
  chemically synthesized
agatattctgattgaattgt

SEQ ID NO: 319418 - DNA, 20 bp, Artificial Sequence
  chemically synthesized
ccattccccaacaattcaat

SEQ ID NO: 319419 - DNA, 20 bp, Artificial Sequence
  chemically synthesized
aacaattcaatcagaatatc

SEQ ID NO: 319420 - DNA, 20 bp, Artificial Sequence
  chemically synthesized
acaattcaatcagaatatct

SEQ ID NO: 319421 - DNA, 20 bp, Artificial Sequence
  chemically synthesized
tcaatcagaatatctgggaa

SEQ ID NO: 319422 - DNA, 20 bp, Artificial Sequence
  chemically synthesized
aatcagaatatctgggaatg

SEQ ID NO: 319423 - DNA, 20 bp, Artificial Sequence
  chemically synthesized
caatacctgggctccattcc

SEQ ID NO: 319424 - DNA, 20 bp, Artificial Sequence
  chemically synthesized
gaatatctgggaatggagcc

SEQ ID NO: 319425 - DNA, 20 bp, Artificial Sequence
  chemically synthesized
aatatctgggaatggagccc

SEQ ID NO: 319426 - DNA, 20 bp, Artificial Sequence
  chemically synthesized
tgggaatggagcccaggtat

SEQ ID NO: 319427 - DNA, 20 bp, Artificial Sequence
  chemically synthesized
tttttacagaaccaatacct

SEQ ID NO: 319428 - DNA, 20 bp, Artificial Sequence
  chemically synthesized
ttttttacagaaccaatacc

SEQ ID NO: 319429 - DNA, 20 bp, Artificial Sequence
  chemically synthesized
cctggttggatagtttttta

SEQ ID NO: 319430 - DNA, 20 bp, Artificial Sequence
  chemically synthesized
tctgtaaaaaactatccaac

SEQ ID NO: 319431 - DNA, 20 bp, Artificial Sequence
  chemically synthesized
ctgtaaaaaactatccaacc

SEQ ID NO: 319432 - DNA, 20 bp, Artificial Sequence
  chemically synthesized
attcgaattacctggttgga

SEQ ID NO: 319433 - DNA, 20 bp, Artificial Sequence
  chemically synthesized
gttcattcgaattacctggt

SEQ ID NO: 319434 - DNA, 20 bp, Artificial Sequence
  chemically synthesized
ggatgttcattcgaattacc

SEQ ID NO: 319435 - DNA, 20 bp, Artificial Sequence
  chemically synthesized
aggtaattcgaatgaacatc

SEQ ID NO: 319436 - DNA, 20 bp, Artificial Sequence
  chemically synthesized
ggtaattcgaatgaacatcc

SEQ ID NO: 319437 - DNA, 20 bp, Artificial Sequence
  chemically synthesized
gtaattcgaatgaacatcca

SEQ ID NO: 319438 - DNA, 20 bp, Artificial Sequence
  chemically synthesized
tcgaatgaacatccagggtt

SEQ ID NO: 319439 - DNA, 20 bp, Artificial Sequence
  chemically synthesized
ggcacaatcgttctcaaccc

SEQ ID NO: 319440 - DNA, 20 bp, Artificial Sequence
  chemically synthesized
cgggggggggggcggggaag

SEQ ID NO: 319441 - DNA, 20 bp, Artificial Sequence
  chemically synthesized
gcgggggggggggcggggaa

SEQ ID NO: 319442 - DNA, 20 bp, Artificial Sequence
  chemically synthesized
gggcgggggggggggcgggg

SEQ ID NO: 319443 - DNA, 20 bp, Artificial Sequence
  chemically synthesized
ctggggcgggggggggggcg

SEQ ID NO: 319444 - DNA, 20 bp, Artificial Sequence
  chemically synthesized
cctggggcgggggggggggc

SEQ ID NO: 319445 - DNA, 20 bp, Artificial Sequence
  chemically synthesized
tcctggggcggggggggggg

SEQ ID NO: 319446 - DNA, 20 bp, Artificial Sequence
  chemically synthesized
gtgtcctggggcgggggggg

SEQ ID NO: 319447 - DNA, 20 bp, Artificial Sequence
  chemically synthesized
tgtgtcctggggcggggggg

SEQ ID NO: 319448 - DNA, 20 bp, Artificial Sequence
  chemically synthesized
ctgtgtcctggggcgggggg

SEQ ID NO: 319449 - DNA, 20 bp, Artificial Sequence
  chemically synthesized
gctgtgtcctggggcggggg

SEQ ID NO: 319450 - DNA, 20 bp, Artificial Sequence
  chemically synthesized
ggctgtgtcctggggcgggg

SEQ ID NO: 319451 - DNA, 20 bp, Artificial Sequence
  chemically synthesized
ccccgcccccccccccgccc

SEQ ID NO: 319452 - DNA, 20 bp, Artificial Sequence
  chemically synthesized
tggctgtgtcctggggcggg

SEQ ID NO: 319453 - DNA, 20 bp, Artificial Sequence
  chemically synthesized
cccgcccccccccccgcccc

SEQ ID NO: 319454 - DNA, 20 bp, Artificial Sequence
  chemically synthesized
atggctgtgtcctggggcgg

SEQ ID NO: 319455 - DNA, 20 bp, Artificial Sequence
  chemically synthesized
tatggctgtgtcctggggcg

SEQ ID NO: 319456 - DNA, 20 bp, Artificial Sequence
  chemically synthesized
ttatggctgtgtcctggggc

SEQ ID NO: 319457 - DNA, 20 bp, Artificial Sequence
  chemically synthesized
attatggctgtgtcctgggg

SEQ ID NO: 319458 - DNA, 20 bp, Artificial Sequence
  chemically synthesized
cccccccccgccccaggaca

SEQ ID NO: 319459 - DNA, 20 bp, Artificial Sequence
  chemically synthesized
aaaattatggctgtgtcctg

SEQ ID NO: 319460 - DNA, 20 bp, Artificial Sequence
  chemically synthesized
aaaaattatggctgtgtcct

SEQ ID NO: 319461 - DNA, 20 bp, Artificial Sequence
  chemically synthesized
taaaaattatggctgtgtcc

SEQ ID NO: 319462 - DNA, 20 bp, Artificial Sequence
  chemically synthesized
aagggctaaagtaaaaatta

SEQ ID NO: 319463 - DNA, 20 bp, Artificial Sequence
  chemically synthesized
cacagccataatttttactt

SEQ ID NO: 319464 - DNA, 20 bp, Artificial Sequence
  chemically synthesized
ataatttttactttagccct

SEQ ID NO: 319465 - DNA, 20 bp, Artificial Sequence
  chemically synthesized
ttgtgaggacccaagggcta

SEQ ID NO: 319466 - DNA, 20 bp, Artificial Sequence
  chemically synthesized
taatttttactttagccctt

SEQ ID NO: 319467 - DNA, 20 bp, Artificial Sequence
  chemically synthesized
tgccacttgtgaggacccaa

SEQ ID NO: 319468 - DNA, 20 bp, Artificial Sequence
  chemically synthesized
ttgccacttgtgaggaccca

SEQ ID NO: 319469 - DNA, 20 bp, Artificial Sequence
  chemically synthesized
tttgccacttgtgaggaccc

SEQ ID NO: 319470 - DNA, 20 bp, Artificial Sequence
  chemically synthesized
tttagcccttgggtcctcac

SEQ ID NO: 319471 - DNA, 20 bp, Artificial Sequence
  chemically synthesized
agcccttgggtcctcacaag

SEQ ID NO: 319472 - DNA, 20 bp, Artificial Sequence
  chemically synthesized
ccaggtatttgccacttgtg

SEQ ID NO: 319473 - DNA, 20 bp, Artificial Sequence
  chemically synthesized
tccaggtatttgccacttgt

SEQ ID NO: 319474 - DNA, 20 bp, Artificial Sequence
  chemically synthesized
cctcacaagtggcaaatacc

SEQ ID NO: 319475 - DNA, 20 bp, Artificial Sequence
  chemically synthesized
acaagtggcaaatacctgga

SEQ ID NO: 319476 - DNA, 20 bp, Artificial Sequence
  chemically synthesized
ttgtctggatacagctttcc

SEQ ID NO: 319477 - DNA, 20 bp, Artificial Sequence
  chemically synthesized
gttgtctggatacagctttc

SEQ ID NO: 319478 - DNA, 20 bp, Artificial Sequence
  chemically synthesized
aatacctggaaagctgtatc

SEQ ID NO: 319479 - DNA, 20 bp, Artificial Sequence
  chemically synthesized
caagtcatgttgtctggata

SEQ ID NO: 319480 - DNA, 20 bp, Artificial Sequence
  chemically synthesized
ccctaacaagtcatgttgtc

SEQ ID NO: 319481 - DNA, 20 bp, Artificial Sequence
  chemically synthesized
atccagacaacatgacttgt

SEQ ID NO: 319482 - DNA, 20 bp, Artificial Sequence
  chemically synthesized
tccagacaacatgacttgtt

SEQ ID NO: 319483 - DNA, 20 bp, Artificial Sequence
  chemically synthesized
ccagacaacatgacttgtta

SEQ ID NO: 319484 - DNA, 20 bp, Artificial Sequence
  chemically synthesized
tggttcatgttaaccctaac

SEQ ID NO: 319485 - DNA, 20 bp, Artificial Sequence
  chemically synthesized
ttgttagggttaacatgaac

SEQ ID NO: 319486 - DNA, 20 bp, Artificial Sequence
  chemically synthesized
gttaacatgaaccagatgca

SEQ ID NO: 319487 - DNA, 20 bp, Artificial Sequence
  chemically synthesized
ccatgttacctctgtgcatc

SEQ ID NO: 319488 - DNA, 20 bp, Artificial Sequence
  chemically synthesized
taacatgaaccagatgcaca

SEQ ID NO: 319489 - DNA, 20 bp, Artificial Sequence
  chemically synthesized
aacatgaaccagatgcacag

SEQ ID NO: 319490 - DNA, 20 bp, Artificial Sequence
  chemically synthesized
ccagatgcacagaggtaaca

SEQ ID NO: 319491 - DNA, 20 bp, Artificial Sequence
  chemically synthesized
agatgcacagaggtaacatg

SEQ ID NO: 319492 - DNA, 20 bp, Artificial Sequence
  chemically synthesized
acagaggtaacatggagaca

SEQ ID NO: 319493 - DNA, 20 bp, Artificial Sequence
  chemically synthesized
cagaggtaacatggagacaa

SEQ ID NO: 319494 - DNA, 20 bp, Artificial Sequence
  chemically synthesized
gtaacatggagacaaaggat

SEQ ID NO: 319495 - DNA, 20 bp, Artificial Sequence
  chemically synthesized
taacatggagacaaaggatc

SEQ ID NO: 319496 - DNA, 20 bp, Artificial Sequence
  chemically synthesized
tgtggaagtcatttataaat

SEQ ID NO: 319497 - DNA, 20 bp, Artificial Sequence
  chemically synthesized
tatttataaatgacttccac

SEQ ID NO: 319498 - DNA, 20 bp, Artificial Sequence
  chemically synthesized
agatattttagtacttgtgg

SEQ ID NO: 319499 - DNA, 20 bp, Artificial Sequence
  chemically synthesized
aatagatattttagtacttg

SEQ ID NO: 319500 - DNA, 20 bp, Artificial Sequence
  chemically synthesized
ggggtacataatagatattt

SEQ ID NO: 319501 - DNA, 20 bp, Artificial Sequence
  chemically synthesized
taatttctgggggtacataa

SEQ ID NO: 319502 - DNA, 20 bp, Artificial Sequence
  chemically synthesized
aaatatctattatgtacccc

SEQ ID NO: 319503 - DNA, 20 bp, Artificial Sequence
  chemically synthesized
tttttatttgtaatttctgg

SEQ ID NO: 319504 - DNA, 20 bp, Artificial Sequence
  chemically synthesized
ttttttatttgtaatttctg

SEQ ID NO: 319505 - DNA, 20 bp, Artificial Sequence
  chemically synthesized
cttttttatttgtaatttct

SEQ ID NO: 319506 - DNA, 20 bp, Artificial Sequence
  chemically synthesized
tcttttttatttgtaatttc

SEQ ID NO: 319507 - DNA, 20 bp, Artificial Sequence
  chemically synthesized
cccagaaattacaaataaaa

SEQ ID NO: 319508 - DNA, 20 bp, Artificial Sequence
  chemically synthesized
agaaattacaaataaaaaag

SEQ ID NO: 319509 - DNA, 20 bp, Artificial Sequence
  chemically synthesized
ataaaaaagaagacttacta

SEQ ID NO: 319510 - DNA, 20 bp, Artificial Sequence
  chemically synthesized
aaaaaagaagacttactaaa

SEQ ID NO: 319511 - DNA, 20 bp, Artificial Sequence
  chemically synthesized
gatcaaaattactctttagt

SEQ ID NO: 319512 - DNA, 20 bp, Artificial Sequence
  chemically synthesized
acaagatcaaaattactctt

SEQ ID NO: 319513 - DNA, 20 bp, Artificial Sequence
  chemically synthesized
aaagagtaattttgatcttg

SEQ ID NO: 319514 - DNA, 20 bp, Artificial Sequence
  chemically synthesized
ttaaaagccccaaattctac

SEQ ID NO: 319515 - DNA, 20 bp, Artificial Sequence
  chemically synthesized
aattttgatcttgtagaatt

SEQ ID NO: 319516 - DNA, 20 bp, Artificial Sequence
  chemically synthesized
attttgatcttgtagaattt

SEQ ID NO: 319517 - DNA, 20 bp, Artificial Sequence
  chemically synthesized
ttttgatcttgtagaatttg

SEQ ID NO: 319518 - DNA, 20 bp, Artificial Sequence
  chemically synthesized
tatttaaaaattatatttaa

SEQ ID NO: 319519 - DNA, 20 bp, Artificial Sequence
  chemically synthesized
acaaaataataattgtgtgt

SEQ ID NO: 319520 - DNA, 20 bp, Artificial Sequence
  chemically synthesized
ataattgtgtgtcagaaaaa

SEQ ID NO: 319521 - DNA, 20 bp, Artificial Sequence
  chemically synthesized
aattgtgtgtcagaaaaaaa

SEQ ID NO: 319522 - DNA, 20 bp, Artificial Sequence
  chemically synthesized
attgtgtgtcagaaaaaaag

SEQ ID NO: 319523 - DNA, 20 bp, Artificial Sequence
  chemically synthesized
tgtaattaatcctattgatt

SEQ ID NO: 319524 - DNA, 20 bp, Artificial Sequence
  chemically synthesized
atatcagttgctgaatcaat

SEQ ID NO: 319525 - DNA, 20 bp, Artificial Sequence
  chemically synthesized
aatatcagttgctgaatcaa

SEQ ID NO: 319526 - DNA, 20 bp, Artificial Sequence
  chemically synthesized
attgattcagcaactgatat

SEQ ID NO: 319527 - DNA, 20 bp, Artificial Sequence
  chemically synthesized
ctgtaaattggggctaatat

SEQ ID NO: 319528 - DNA, 20 bp, Artificial Sequence
  chemically synthesized
ctgatattagccccaattta

SEQ ID NO: 319529 - DNA, 20 bp, Artificial Sequence
  chemically synthesized
gtttccccacctgtaaattg

SEQ ID NO: 319530 - DNA, 20 bp, Artificial Sequence
  chemically synthesized
tgatattagccccaatttac

SEQ ID NO: 319531 - DNA, 20 bp, Artificial Sequence
  chemically synthesized
tgtttccccacctgtaaatt

SEQ ID NO: 319532 - DNA, 20 bp, Artificial Sequence
  chemically synthesized
ttgtttccccacctgtaaat

SEQ ID NO: 319533 - DNA, 20 bp, Artificial Sequence
  chemically synthesized
tattagccccaatttacagg

SEQ ID NO: 319534 - DNA, 20 bp, Artificial Sequence
  chemically synthesized
attagccccaatttacaggt

SEQ ID NO: 319535 - DNA, 20 bp, Artificial Sequence
  chemically synthesized
ttagccccaatttacaggtg

SEQ ID NO: 319536 - DNA, 20 bp, Artificial Sequence
  chemically synthesized
aatttacaggtggggaaaca

SEQ ID NO: 319537 - DNA, 20 bp, Artificial Sequence
  chemically synthesized
atttacaggtggggaaacaa

SEQ ID NO: 319538 - DNA, 20 bp, Artificial Sequence
  chemically synthesized
tggggaaacaaaggcttact

SEQ ID NO: 319539 - DNA, 20 bp, Artificial Sequence
  chemically synthesized
ggggaaacaaaggcttactt

SEQ ID NO: 319540 - DNA, 20 bp, Artificial Sequence
  chemically synthesized
gtttgcgttttgacccaagt

SEQ ID NO: 319541 - DNA, 20 bp, Artificial Sequence
  chemically synthesized
ccttgtttgcgttttgaccc

SEQ ID NO: 319542 - DNA, 20 bp, Artificial Sequence
  chemically synthesized
acttgggtcaaaacgcaaac

SEQ ID NO: 319543 - DNA, 20 bp, Artificial Sequence
  chemically synthesized
cttgggtcaaaacgcaaaca

SEQ ID NO: 319544 - DNA, 20 bp, Artificial Sequence
  chemically synthesized
ttgggtcaaaacgcaaacaa

SEQ ID NO: 319545 - DNA, 20 bp, Artificial Sequence
  chemically synthesized
ggtcaaaacgcaaacaaggg

SEQ ID NO: 319546 - DNA, 20 bp, Artificial Sequence
  chemically synthesized
gtcaaaacgcaaacaaggga

SEQ ID NO: 319547 - DNA, 20 bp, Artificial Sequence
  chemically synthesized
gcaaacaagggaaggtgaca

SEQ ID NO: 319548 - DNA, 20 bp, Artificial Sequence
  chemically synthesized
aacaagggaaggtgacaaag

SEQ ID NO: 319549 - DNA, 20 bp, Artificial Sequence
  chemically synthesized
acaagggaaggtgacaaagt

SEQ ID NO: 319550 - DNA, 20 bp, Artificial Sequence
  chemically synthesized
aaggtgacaaagtgggaact

SEQ ID NO: 319551 - DNA, 20 bp, Artificial Sequence
  chemically synthesized
aggtgacaaagtgggaactc

SEQ ID NO: 319552 - DNA, 20 bp, Artificial Sequence
  chemically synthesized
tgacaaagtgggaactcagg

SEQ ID NO: 319553 - DNA, 20 bp, Artificial Sequence
  chemically synthesized
gccccggagccaaactacct

SEQ ID NO: 319554 - DNA, 20 bp, Artificial Sequence
  chemically synthesized
aagtgggaactcaggtagtt

SEQ ID NO: 319555 - DNA, 20 bp, Artificial Sequence
  chemically synthesized
gaactcaggtagtttggctc

SEQ ID NO: 319556 - DNA, 20 bp, Artificial Sequence
  chemically synthesized
aactcaggtagtttggctcc

SEQ ID NO: 319557 - DNA, 20 bp, Artificial Sequence
  chemically synthesized
actcaggtagtttggctccg

SEQ ID NO: 319558 - DNA, 20 bp, Artificial Sequence
  chemically synthesized
tgattgtgaagcaggccccg

SEQ ID NO: 319559 - DNA, 20 bp, Artificial Sequence
  chemically synthesized
catgattgtgaagcaggccc

SEQ ID NO: 319560 - DNA, 20 bp, Artificial Sequence
  chemically synthesized
atattgcatgattgtgaagc

SEQ ID NO: 319561 - DNA, 20 bp, Artificial Sequence
  chemically synthesized
aatattgcatgattgtgaag

SEQ ID NO: 319562 - DNA, 20 bp, Artificial Sequence
  chemically synthesized
ggcaatattgcatgattgtg

SEQ ID NO: 319563 - DNA, 20 bp, Artificial Sequence
  chemically synthesized
taaaaagttaattttagttc

SEQ ID NO: 319564 - DNA, 20 bp, Artificial Sequence
  chemically synthesized
ctaaaaagttaattttagtt

SEQ ID NO: 319565 - DNA, 20 bp, Artificial Sequence
  chemically synthesized
aatctctaaaaagttaattt

SEQ ID NO: 319566 - DNA, 20 bp, Artificial Sequence
  chemically synthesized
ctgaactaaaattaactttt

SEQ ID NO: 319567 - DNA, 20 bp, Artificial Sequence
  chemically synthesized
gaactaaaattaacttttta

SEQ ID NO: 319568 - DNA, 20 bp, Artificial Sequence
  chemically synthesized
atataaagttaatctctaaa

SEQ ID NO: 319569 - DNA, 20 bp, Artificial Sequence
  chemically synthesized
atgactttataatagatata

SEQ ID NO: 319570 - DNA, 20 bp, Artificial Sequence
  chemically synthesized
ttaactttatatctattata

SEQ ID NO: 319571 - DNA, 20 bp, Artificial Sequence
  chemically synthesized
tgccataaatgactttataa

SEQ ID NO: 319572 - DNA, 20 bp, Artificial Sequence
  chemically synthesized
atctattataaagtcattta

SEQ ID NO: 319573 - DNA, 20 bp, Artificial Sequence
  chemically synthesized
atttttttaatatttataat

SEQ ID NO: 319574 - DNA, 20 bp, Artificial Sequence
  chemically synthesized
gattataaatattaaaaaaa

SEQ ID NO: 319575 - DNA, 20 bp, Artificial Sequence
  chemically synthesized
aatattaaaaaaatagaaaa

SEQ ID NO: 319576 - DNA, 20 bp, Artificial Sequence
  chemically synthesized
attaaaaaaatagaaaacag

SEQ ID NO: 319577 - DNA, 20 bp, Artificial Sequence
  chemically synthesized
atagaaaacagaagttcatt

SEQ ID NO: 319578 - DNA, 20 bp, Artificial Sequence
  chemically synthesized
gaaaacagaagttcatttgg

SEQ ID NO: 319579 - DNA, 20 bp, Artificial Sequence
  chemically synthesized
tcatttggtggaattttata

SEQ ID NO: 319580 - DNA, 20 bp, Artificial Sequence
  chemically synthesized
atttggtggaattttataca

SEQ ID NO: 319581 - DNA, 20 bp, Artificial Sequence
  chemically synthesized
aacaactgtaattttcgttt

SEQ ID NO: 319582 - DNA, 20 bp, Artificial Sequence
  chemically synthesized
tttcaccaaaacgaaaatta

SEQ ID NO: 319583 - DNA, 20 bp, Artificial Sequence
  chemically synthesized
aaattacagttgttactctt

SEQ ID NO: 319584 - DNA, 20 bp, Artificial Sequence
  chemically synthesized
gctaagaacaattgtctcaa

SEQ ID NO: 319585 - DNA, 20 bp, Artificial Sequence
  chemically synthesized
atgctaagaacaattgtctc

SEQ ID NO: 319586 - DNA, 20 bp, Artificial Sequence
  chemically synthesized
actcttgagacaattgttct

SEQ ID NO: 319587 - DNA, 20 bp, Artificial Sequence
  chemically synthesized
attaaagtaaacatcatgct

SEQ ID NO: 319588 - DNA, 20 bp, Artificial Sequence
  chemically synthesized
catgatgtttactttaatga

SEQ ID NO: 319589 - DNA, 20 bp, Artificial Sequence
  chemically synthesized
tattgtggtttctatcatta

SEQ ID NO: 319590 - DNA, 20 bp, Artificial Sequence
  chemically synthesized
atttaaaaaatagggtattg

SEQ ID NO: 319591 - DNA, 20 bp, Artificial Sequence
  chemically synthesized
aaataaaaatttaaaaaata

SEQ ID NO: 319592 - DNA, 20 bp, Artificial Sequence
  chemically synthesized
aaaataaaaatttaaaaaat

SEQ ID NO: 319593 - DNA, 20 bp, Artificial Sequence
  chemically synthesized
aaaaataaaaatttaaaaaa

SEQ ID NO: 319594 - DNA, 20 bp, Artificial Sequence
  chemically synthesized
tttttaaatttttatttttt

SEQ ID NO: 319595 - DNA, 20 bp, Artificial Sequence
  chemically synthesized
ttttaaatttttattttttt

SEQ ID NO: 319596 - DNA, 20 bp, Artificial Sequence
  chemically synthesized
tttttatttttttgggtata

SEQ ID NO: 319597 - DNA, 20 bp, Artificial Sequence
  chemically synthesized
atagtatgtgtttatattta

SEQ ID NO: 319598 - DNA, 20 bp, Artificial Sequence
  chemically synthesized
tagtatgtgtttatatttat

SEQ ID NO: 319599 - DNA, 20 bp, Artificial Sequence
  chemically synthesized
tgtttatatttatgggatac

SEQ ID NO: 319600 - DNA, 20 bp, Artificial Sequence
  chemically synthesized
tttatatttatgggatacaa

SEQ ID NO: 319601 - DNA, 20 bp, Artificial Sequence
  chemically synthesized
atacaagagacatattcata

SEQ ID NO: 319602 - DNA, 20 bp, Artificial Sequence
  chemically synthesized
tacaagagacatattcatac

SEQ ID NO: 319603 - DNA, 20 bp, Artificial Sequence
  chemically synthesized
gacatattcatacaggcata

SEQ ID NO: 319604 - DNA, 20 bp, Artificial Sequence
  chemically synthesized
acatattcatacaggcatac

SEQ ID NO: 319605 - DNA, 20 bp, Artificial Sequence
  chemically synthesized
atacaggcataatatgacat

SEQ ID NO: 319606 - DNA, 20 bp, Artificial Sequence
  chemically synthesized
tacaggcataatatgacatt

SEQ ID NO: 319607 - DNA, 20 bp, Artificial Sequence
  chemically synthesized
acaggcataatatgacatta

SEQ ID NO: 319608 - DNA, 20 bp, Artificial Sequence
  chemically synthesized
taatatgacattagggttaa

SEQ ID NO: 319609 - DNA, 20 bp, Artificial Sequence
  chemically synthesized
aatatgacattagggttaat

SEQ ID NO: 319610 - DNA, 20 bp, Artificial Sequence
  chemically synthesized
atatgacattagggttaata

SEQ ID NO: 319611 - DNA, 20 bp, Artificial Sequence
  chemically synthesized
aatagggtatccatcacctc

SEQ ID NO: 319612 - DNA, 20 bp, Artificial Sequence
  chemically synthesized
atgataagtgctcgaggtga

SEQ ID NO: 319613 - DNA, 20 bp, Artificial Sequence
  chemically synthesized
aaagaaatgataagtgctcg

SEQ ID NO: 319614 - DNA, 20 bp, Artificial Sequence
  chemically synthesized
taaagaaatgataagtgctc

SEQ ID NO: 319615 - DNA, 20 bp, Artificial Sequence
  chemically synthesized
ttgtcacataaagaaatgat

SEQ ID NO: 319616 - DNA, 20 bp, Artificial Sequence
  chemically synthesized
attggaatgtttgtcacata

SEQ ID NO: 319617 - DNA, 20 bp, Artificial Sequence
  chemically synthesized
aaaataacaaaaagtataat

SEQ ID NO: 319618 - DNA, 20 bp, Artificial Sequence
  chemically synthesized
gtacgttttaaaataacaaa

SEQ ID NO: 319619 - DNA, 20 bp, Artificial Sequence
  chemically synthesized
gtacaacaaattatgtttga

SEQ ID NO: 319620 - DNA, 20 bp, Artificial Sequence
  chemically synthesized
gtagtatttgatagcacgac

SEQ ID NO: 319621 - DNA, 20 bp, Artificial Sequence
  chemically synthesized
tgtagtatttgatagcacga

SEQ ID NO: 319622 - DNA, 20 bp, Artificial Sequence
  chemically synthesized
gaatgtgatgtagtatttga

SEQ ID NO: 319623 - DNA, 20 bp, Artificial Sequence
  chemically synthesized
tagattgaatgaatgtgatg

SEQ ID NO: 319624 - DNA, 20 bp, Artificial Sequence
  chemically synthesized
aatgggtacaaaaatatagt

SEQ ID NO: 319625 - DNA, 20 bp, Artificial Sequence
  chemically synthesized
cattaatgggtacaaaaata

SEQ ID NO: 319626 - DNA, 20 bp, Artificial Sequence
  chemically synthesized
gggcagtggggatcattaat

SEQ ID NO: 319627 - DNA, 20 bp, Artificial Sequence
  chemically synthesized
ggggcagtggggatcattaa

SEQ ID NO: 319628 - DNA, 20 bp, Artificial Sequence
  chemically synthesized
ctagtgggtcgggggcagtg

SEQ ID NO: 319629 - DNA, 20 bp, Artificial Sequence
  chemically synthesized
gctagtgggtcgggggcagt

SEQ ID NO: 319630 - DNA, 20 bp, Artificial Sequence
  chemically synthesized
tgctagtgggtcgggggcag

SEQ ID NO: 319631 - DNA, 20 bp, Artificial Sequence
  chemically synthesized
gaatgctagtgggtcggggg

SEQ ID NO: 319632 - DNA, 20 bp, Artificial Sequence
  chemically synthesized
tgggaatgctagtgggtcgg

SEQ ID NO: 319633 - DNA, 20 bp, Artificial Sequence
  chemically synthesized
atgggaatgctagtgggtcg

SEQ ID NO: 319634 - DNA, 20 bp, Artificial Sequence
  chemically synthesized
ccccactgcccccgacccac

SEQ ID NO: 319635 - DNA, 20 bp, Artificial Sequence
  chemically synthesized
gatgggaatgctagtgggtc

SEQ ID NO: 319636 - DNA, 20 bp, Artificial Sequence
  chemically synthesized
ggatgggaatgctagtgggt

SEQ ID NO: 319637 - DNA, 20 bp, Artificial Sequence
  chemically synthesized
cagaggatgggaatgctagt

SEQ ID NO: 319638 - DNA, 20 bp, Artificial Sequence
  chemically synthesized
ccagaggatgggaatgctag

SEQ ID NO: 319639 - DNA, 20 bp, Artificial Sequence
  chemically synthesized
ttaccagaggatgggaatgc

SEQ ID NO: 319640 - DNA, 20 bp, Artificial Sequence
  chemically synthesized
ccactagcattcccatcctc

SEQ ID NO: 319641 - DNA, 20 bp, Artificial Sequence
  chemically synthesized
aatgatggttaccagaggat

SEQ ID NO: 319642 - DNA, 20 bp, Artificial Sequence
  chemically synthesized
gaatgatggttaccagagga

SEQ ID NO: 319643 - DNA, 20 bp, Artificial Sequence
  chemically synthesized
actagaatgatggttaccag

SEQ ID NO: 319644 - DNA, 20 bp, Artificial Sequence
  chemically synthesized
gactagaatgatggttacca

SEQ ID NO: 319645 - DNA, 20 bp, Artificial Sequence
  chemically synthesized
gagactagaatgatggttac

SEQ ID NO: 319646 - DNA, 20 bp, Artificial Sequence
  chemically synthesized
tcctctggtaaccatcattc

SEQ ID NO: 319647 - DNA, 20 bp, Artificial Sequence
  chemically synthesized
ggagatagagactagaatga

SEQ ID NO: 319648 - DNA, 20 bp, Artificial Sequence
  chemically synthesized
gaactcatggagatagagac

SEQ ID NO: 319649 - DNA, 20 bp, Artificial Sequence
  chemically synthesized
caactgaactcatggagata

SEQ ID NO: 319650 - DNA, 20 bp, Artificial Sequence
  chemically synthesized
attctagtctctatctccat

SEQ ID NO: 319651 - DNA, 20 bp, Artificial Sequence
  chemically synthesized
aacaactgaactcatggaga

SEQ ID NO: 319652 - DNA, 20 bp, Artificial Sequence
  chemically synthesized
ttaaaacaactgaactcatg

SEQ ID NO: 319653 - DNA, 20 bp, Artificial Sequence
  chemically synthesized
agtctctatctccatgagtt

SEQ ID NO: 319654 - DNA, 20 bp, Artificial Sequence
  chemically synthesized
aattaaaacaactgaactca

SEQ ID NO: 319655 - DNA, 20 bp, Artificial Sequence
  chemically synthesized
tttttttttttttttttttt

SEQ ID NO: 319656 - DNA, 20 bp, Artificial Sequence
  chemically synthesized
ttttttttttaagctctcac

SEQ ID NO: 319657 - DNA, 20 bp, Artificial Sequence
  chemically synthesized
atgttctcacttacttgtga

SEQ ID NO: 319658 - DNA, 20 bp, Artificial Sequence
  chemically synthesized
ttttttaagctctcacaagt

SEQ ID NO: 319659 - DNA, 20 bp, Artificial Sequence
  chemically synthesized
gcatgttctcacttacttgt

SEQ ID NO: 319660 - DNA, 20 bp, Artificial Sequence
  chemically synthesized
ttaagctctcacaagtaagt

SEQ ID NO: 319661 - DNA, 20 bp, Artificial Sequence
  chemically synthesized
caagtaagtgagaacatgca

SEQ ID NO: 319662 - DNA, 20 bp, Artificial Sequence
  chemically synthesized
caaagtttgtttttctgtgc

SEQ ID NO: 319663 - DNA, 20 bp, Artificial Sequence
  chemically synthesized
aaagtttgtttttctgtgcc

SEQ ID NO: 319664 - DNA, 20 bp, Artificial Sequence
  chemically synthesized
tgattaaaataagcccggca

SEQ ID NO: 319665 - DNA, 20 bp, Artificial Sequence
  chemically synthesized
tatgttgattaaaataagcc

SEQ ID NO: 319666 - DNA, 20 bp, Artificial Sequence
  chemically synthesized
gacgttatgttgattaaaat

SEQ ID NO: 319667 - DNA, 20 bp, Artificial Sequence
  chemically synthesized
ttaatcaacataacgtcctc

SEQ ID NO: 319668 - DNA, 20 bp, Artificial Sequence
  chemically synthesized
aacaacatggatggaactgg

SEQ ID NO: 319669 - DNA, 20 bp, Artificial Sequence
  chemically synthesized
caacaacatggatggaactg

SEQ ID NO: 319670 - DNA, 20 bp, Artificial Sequence
  chemically synthesized
tacaacaacatggatggaac

SEQ ID NO: 319671 - DNA, 20 bp, Artificial Sequence
  chemically synthesized
gtcacttacaacaacatgga

SEQ ID NO: 319672 - DNA, 20 bp, Artificial Sequence
  chemically synthesized
tccagtcacttacaacaaca

SEQ ID NO: 319673 - DNA, 20 bp, Artificial Sequence
  chemically synthesized
agttccatccatgttgttgt

SEQ ID NO: 319674 - DNA, 20 bp, Artificial Sequence
  chemically synthesized
tccatgttgttgtaagtgac

SEQ ID NO: 319675 - DNA, 20 bp, Artificial Sequence
  chemically synthesized
gactaagaaagaatgagatc

SEQ ID NO: 319676 - DNA, 20 bp, Artificial Sequence
  chemically synthesized
aagcttgactaagaaagaat

SEQ ID NO: 319677 - DNA, 20 bp, Artificial Sequence
  chemically synthesized
gactggatctcattctttct

SEQ ID NO: 319678 - DNA, 20 bp, Artificial Sequence
  chemically synthesized
agtcttaagcttgactaaga

SEQ ID NO: 319679 - DNA, 20 bp, Artificial Sequence
  chemically synthesized
gatctcattctttcttagtc

SEQ ID NO: 319680 - DNA, 20 bp, Artificial Sequence
  chemically synthesized
gacaagtcttaagcttgact

SEQ ID NO: 319681 - DNA, 20 bp, Artificial Sequence
  chemically synthesized
attctttcttagtcaagctt

SEQ ID NO: 319682 - DNA, 20 bp, Artificial Sequence
  chemically synthesized
tgacaaaaatgacaagtctt

SEQ ID NO: 319683 - DNA, 20 bp, Artificial Sequence
  chemically synthesized
aaagggttgacaaaaatgac

SEQ ID NO: 319684 - DNA, 20 bp, Artificial Sequence
  chemically synthesized
aaaagaaggtttttttgaaa

SEQ ID NO: 319685 - DNA, 20 bp, Artificial Sequence
  chemically synthesized
aaaaagaaggtttttttgaa

SEQ ID NO: 319686 - DNA, 20 bp, Artificial Sequence
  chemically synthesized
caaaaagaaggtttttttga

SEQ ID NO: 319687 - DNA, 20 bp, Artificial Sequence
  chemically synthesized
agatcaacaaaacaaaaaga

SEQ ID NO: 319688 - DNA, 20 bp, Artificial Sequence
  chemically synthesized
aagatcaacaaaacaaaaag

SEQ ID NO: 319689 - DNA, 20 bp, Artificial Sequence
  chemically synthesized
caaaagatcaacaaaacaaa

SEQ ID NO: 319690 - DNA, 20 bp, Artificial Sequence
  chemically synthesized
agtacaacaaaatgatacaa

SEQ ID NO: 319691 - DNA, 20 bp, Artificial Sequence
  chemically synthesized
aacagagctgaaatacatta

SEQ ID NO: 319692 - DNA, 20 bp, Artificial Sequence
  chemically synthesized
tgttgtactttaatgtattt

SEQ ID NO: 319693 - DNA, 20 bp, Artificial Sequence
  chemically synthesized
aaatattacagtaaggaaca

SEQ ID NO: 319694 - DNA, 20 bp, Artificial Sequence
  chemically synthesized
ataaatattacagtaaggaa

SEQ ID NO: 319695 - DNA, 20 bp, Artificial Sequence
  chemically synthesized
agaaaataaatattacagta

SEQ ID NO: 319696 - DNA, 20 bp, Artificial Sequence
  chemically synthesized
gagaaaataaatattacagt

SEQ ID NO: 319697 - DNA, 20 bp, Artificial Sequence
  chemically synthesized
gtatgagaaaataaatatta

SEQ ID NO: 319698 - DNA, 20 bp, Artificial Sequence
  chemically synthesized
accaaacccaaaattagtat

SEQ ID NO: 319699 - DNA, 20 bp, Artificial Sequence
  chemically synthesized
ttattttctcatactaattt

SEQ ID NO: 319700 - DNA, 20 bp, Artificial Sequence
  chemically synthesized
tattttctcatactaatttt

SEQ ID NO: 319701 - DNA, 20 bp, Artificial Sequence
  chemically synthesized
gagcaaaccaaacccaaaat

SEQ ID NO: 319702 - DNA, 20 bp, Artificial Sequence
  chemically synthesized
tctcatactaattttgggtt

SEQ ID NO: 319703 - DNA, 20 bp, Artificial Sequence
  chemically synthesized
ttaaagagctagaaaagaag

SEQ ID NO: 319704 - DNA, 20 bp, Artificial Sequence
  chemically synthesized
ttggtttgctccttcttttc

SEQ ID NO: 319705 - DNA, 20 bp, Artificial Sequence
  chemically synthesized
ccttaaagagctagaaaaga

SEQ ID NO: 319706 - DNA, 20 bp, Artificial Sequence
  chemically synthesized
accttaaagagctagaaaag

SEQ ID NO: 319707 - DNA, 20 bp, Artificial Sequence
  chemically synthesized
tacaccttaaagagctagaa

SEQ ID NO: 319708 - DNA, 20 bp, Artificial Sequence
  chemically synthesized
tccttcttttctagctcttt

SEQ ID NO: 319709 - DNA, 20 bp, Artificial Sequence
  chemically synthesized
aatgatacaccttaaagagc

SEQ ID NO: 319710 - DNA, 20 bp, Artificial Sequence
  chemically synthesized
ccttcttttctagctcttta

SEQ ID NO: 319711 - DNA, 20 bp, Artificial Sequence
  chemically synthesized
attgaatgatacaccttaaa

SEQ ID NO: 319712 - DNA, 20 bp, Artificial Sequence
  chemically synthesized
taattgaatgatacacctta

SEQ ID NO: 319713 - DNA, 20 bp, Artificial Sequence
  chemically synthesized
tgtatcattcaattatttga

SEQ ID NO: 319714 - DNA, 20 bp, Artificial Sequence
  chemically synthesized
tacctacatcaaaaaagcag

SEQ ID NO: 319715 - DNA, 20 bp, Artificial Sequence
  chemically synthesized
aaatacctacatcaaaaaag

SEQ ID NO: 319716 - DNA, 20 bp, Artificial Sequence
  chemically synthesized
tataaatacctacatcaaaa

SEQ ID NO: 319717 - DNA, 20 bp, Artificial Sequence
  chemically synthesized
gttcttctgcttttttgatg

SEQ ID NO: 319718 - DNA, 20 bp, Artificial Sequence
  chemically synthesized
ttcttctgcttttttgatgt

SEQ ID NO: 319719 - DNA, 20 bp, Artificial Sequence
  chemically synthesized
gtactatgaggaaagtttat

SEQ ID NO: 319720 - DNA, 20 bp, Artificial Sequence
  chemically synthesized
agtactatgaggaaagttta

SEQ ID NO: 319721 - DNA, 20 bp, Artificial Sequence
  chemically synthesized
atacctataaactttcctca

SEQ ID NO: 319722 - DNA, 20 bp, Artificial Sequence
  chemically synthesized
tgaaagcagtactatgagga

SEQ ID NO: 319723 - DNA, 20 bp, Artificial Sequence
  chemically synthesized
gcagtgaaagcagtactatg

SEQ ID NO: 319724 - DNA, 20 bp, Artificial Sequence
  chemically synthesized
agcagtgaaagcagtactat

SEQ ID NO: 319725 - DNA, 20 bp, Artificial Sequence
  chemically synthesized
cctatgggaagcagtgaaag

SEQ ID NO: 319726 - DNA, 20 bp, Artificial Sequence
  chemically synthesized
aaacctatgggaagcagtga

SEQ ID NO: 319727 - DNA, 20 bp, Artificial Sequence
  chemically synthesized
actgctttcactgcttccca

SEQ ID NO: 319728 - DNA, 20 bp, Artificial Sequence
  chemically synthesized
taaccaaaacctatgggaag

SEQ ID NO: 319729 - DNA, 20 bp, Artificial Sequence
  chemically synthesized
ctgctttcactgcttcccat

SEQ ID NO: 319730 - DNA, 20 bp, Artificial Sequence
  chemically synthesized
atgtaaccaaaacctatggg

SEQ ID NO: 319731 - DNA, 20 bp, Artificial Sequence
  chemically synthesized
gcaatgtaaccaaaacctat

SEQ ID NO: 319732 - DNA, 20 bp, Artificial Sequence
  chemically synthesized
tcactgcttcccataggttt

SEQ ID NO: 319733 - DNA, 20 bp, Artificial Sequence
  chemically synthesized
cgcaatgtaaccaaaaccta

SEQ ID NO: 319734 - DNA, 20 bp, Artificial Sequence
  chemically synthesized
tttcttgaaacgaatgaaaa

SEQ ID NO: 319735 - DNA, 20 bp, Artificial Sequence
  chemically synthesized
atttcttgaaacgaatgaaa

SEQ ID NO: 319736 - DNA, 20 bp, Artificial Sequence
  chemically synthesized
tttcctttttcattcgtttc

SEQ ID NO: 319737 - DNA, 20 bp, Artificial Sequence
  chemically synthesized
attcgtttcaagaaattcta

SEQ ID NO: 319738 - DNA, 20 bp, Artificial Sequence
  chemically synthesized
agaagttaagaaggaaacta

SEQ ID NO: 319739 - DNA, 20 bp, Artificial Sequence
  chemically synthesized
ggtcaaagaagaagttaaga

SEQ ID NO: 319740 - DNA, 20 bp, Artificial Sequence
  chemically synthesized
gggtcaaagaagaagttaag

SEQ ID NO: 319741 - DNA, 20 bp, Artificial Sequence
  chemically synthesized
agtgggtcaaagaagaagtt

SEQ ID NO: 319742 - DNA, 20 bp, Artificial Sequence
  chemically synthesized
ttatcagtgggtcaaagaag

SEQ ID NO: 319743 - DNA, 20 bp, Artificial Sequence
  chemically synthesized
gaattatcagtgggtcaaag

SEQ ID NO: 319744 - DNA, 20 bp, Artificial Sequence
  chemically synthesized
cttgaattatcagtgggtca

SEQ ID NO: 319745 - DNA, 20 bp, Artificial Sequence
  chemically synthesized
tatgctcttgaattatcagt

SEQ ID NO: 319746 - DNA, 20 bp, Artificial Sequence
  chemically synthesized
atatgctcttgaattatcag

SEQ ID NO: 319747 - DNA, 20 bp, Artificial Sequence
  chemically synthesized
ctttgacccactgataattc

SEQ ID NO: 319748 - DNA, 20 bp, Artificial Sequence
  chemically synthesized
acaatatgctcttgaattat

SEQ ID NO: 319749 - DNA, 20 bp, Artificial Sequence
  chemically synthesized
ttgacccactgataattcaa

SEQ ID NO: 319750 - DNA, 20 bp, Artificial Sequence
  chemically synthesized
ttggaaactatagagacaca

SEQ ID NO: 319751 - DNA, 20 bp, Artificial Sequence
  chemically synthesized
ttaatttccatgtgtctcta

SEQ ID NO: 319752 - DNA, 20 bp, Artificial Sequence
  chemically synthesized
gaagaattttggaaactata

SEQ ID NO: 319753 - DNA, 20 bp, Artificial Sequence
  chemically synthesized
aggaagaattttggaaacta

SEQ ID NO: 319754 - DNA, 20 bp, Artificial Sequence
  chemically synthesized
gatatcagtaggaagaattt

SEQ ID NO: 319755 - DNA, 20 bp, Artificial Sequence
  chemically synthesized
tatatcaagatatcagtagg

SEQ ID NO: 319756 - DNA, 20 bp, Artificial Sequence
  chemically synthesized
gaatatatcaagatatcagt

SEQ ID NO: 319757 - DNA, 20 bp, Artificial Sequence
  chemically synthesized
tgaatatatcaagatatcag

SEQ ID NO: 319758 - DNA, 20 bp, Artificial Sequence
  chemically synthesized
aactgaatatatcaagatat

SEQ ID NO: 319759 - DNA, 20 bp, Artificial Sequence
  chemically synthesized
tgatcacaactgaatatatc

SEQ ID NO: 319760 - DNA, 20 bp, Artificial Sequence
  chemically synthesized
tactgatatcttgatatatt

SEQ ID NO: 319761 - DNA, 20 bp, Artificial Sequence
  chemically synthesized
ttgatatattcagttgtgat

SEQ ID NO: 319762 - DNA, 20 bp, Artificial Sequence
  chemically synthesized
atattcagttgtgatcagaa

SEQ ID NO: 319763 - DNA, 20 bp, Artificial Sequence
  chemically synthesized
aaaatcaaaataacataaat

SEQ ID NO: 319764 - DNA, 20 bp, Artificial Sequence
  chemically synthesized
ttttgatttttgaattttct

SEQ ID NO: 319765 - DNA, 20 bp, Artificial Sequence
  chemically synthesized
ttctgccacgaaacaagtct

SEQ ID NO: 319766 - DNA, 20 bp, Artificial Sequence
  chemically synthesized
attttctaagacttgtttcg

SEQ ID NO: 319767 - DNA, 20 bp, Artificial Sequence
  chemically synthesized
catatgttctgccacgaaac

SEQ ID NO: 319768 - DNA, 20 bp, Artificial Sequence
  chemically synthesized
ttctaagacttgtttcgtgg

SEQ ID NO: 319769 - DNA, 20 bp, Artificial Sequence
  chemically synthesized
ttgtttcgtggcagaacata

SEQ ID NO: 319770 - DNA, 20 bp, Artificial Sequence
  chemically synthesized
catggataattttcaaggac

SEQ ID NO: 319771 - DNA, 20 bp, Artificial Sequence
  chemically synthesized
cagcacatggataattttca

SEQ ID NO: 319772 - DNA, 20 bp, Artificial Sequence
  chemically synthesized
tcagcacatggataattttc

SEQ ID NO: 319773 - DNA, 20 bp, Artificial Sequence
  chemically synthesized
ttgaaaattatccatgtgct

SEQ ID NO: 319774 - DNA, 20 bp, Artificial Sequence
  chemically synthesized
atattcttcttctcagcaca

SEQ ID NO: 319775 - DNA, 20 bp, Artificial Sequence
  chemically synthesized
aaaattatccatgtgctgag

SEQ ID NO: 319776 - DNA, 20 bp, Artificial Sequence
  chemically synthesized
attatccatgtgctgagaag

SEQ ID NO: 319777 - DNA, 20 bp, Artificial Sequence
  chemically synthesized
agagtacatattcttcttct

SEQ ID NO: 319778 - DNA, 20 bp, Artificial Sequence
  chemically synthesized
gaagaagaatatgtactctg

SEQ ID NO: 319779 - DNA, 20 bp, Artificial Sequence
  chemically synthesized
cattttatccaacagctgca

SEQ ID NO: 319780 - DNA, 20 bp, Artificial Sequence
  chemically synthesized
aatatgtactctgcagctgt

SEQ ID NO: 319781 - DNA, 20 bp, Artificial Sequence
  chemically synthesized
aacattttatccaacagctg

SEQ ID NO: 319782 - DNA, 20 bp, Artificial Sequence
  chemically synthesized
ttacagaacattttatccaa

SEQ ID NO: 319783 - DNA, 20 bp, Artificial Sequence
  chemically synthesized
tttgaactaatagatattta

SEQ ID NO: 319784 - DNA, 20 bp, Artificial Sequence
  chemically synthesized
aatgttctgtaaatatctat

SEQ ID NO: 319785 - DNA, 20 bp, Artificial Sequence
  chemically synthesized
tgtagaccaatttgaactaa

SEQ ID NO: 319786 - DNA, 20 bp, Artificial Sequence
  chemically synthesized
aaatatctattagttcaaat

SEQ ID NO: 319787 - DNA, 20 bp, Artificial Sequence
  chemically synthesized
atcagacttattatgcagtg

SEQ ID NO: 319788 - DNA, 20 bp, Artificial Sequence
  chemically synthesized
attggtctacactgcataat

SEQ ID NO: 319789 - DNA, 20 bp, Artificial Sequence
  chemically synthesized
gaaacatcagacttattatg

SEQ ID NO: 319790 - DNA, 20 bp, Artificial Sequence
  chemically synthesized
taaaatcaacaaagaaacat

SEQ ID NO: 319791 - DNA, 20 bp, Artificial Sequence
  chemically synthesized
atccagacataaaatcaaca

SEQ ID NO: 319792 - DNA, 20 bp, Artificial Sequence
  chemically synthesized
ttctttgttgattttatgtc

SEQ ID NO: 319793 - DNA, 20 bp, Artificial Sequence
  chemically synthesized
cagtggccagatagatcatc

SEQ ID NO: 319794 - DNA, 20 bp, Artificial Sequence
  chemically synthesized
ttatgtctggatgatctatc

SEQ ID NO: 319795 - DNA, 20 bp, Artificial Sequence
  chemically synthesized
cattttcagcagtggccaga

SEQ ID NO: 319796 - DNA, 20 bp, Artificial Sequence
  chemically synthesized
tccccattttcagcagtggc

SEQ ID NO: 319797 - DNA, 20 bp, Artificial Sequence
  chemically synthesized
caattccccattttcagcag

SEQ ID NO: 319798 - DNA, 20 bp, Artificial Sequence
  chemically synthesized
tatctggccactgctgaaaa

SEQ ID NO: 319799 - DNA, 20 bp, Artificial Sequence
  chemically synthesized
tttcaattccccattttcag

SEQ ID NO: 319800 - DNA, 20 bp, Artificial Sequence
  chemically synthesized
atctggccactgctgaaaat

SEQ ID NO: 319801 - DNA, 20 bp, Artificial Sequence
  chemically synthesized
tctggccactgctgaaaatg

SEQ ID NO: 319802 - DNA, 20 bp, Artificial Sequence
  chemically synthesized
tgatttcaattccccatttt

SEQ ID NO: 319803 - DNA, 20 bp, Artificial Sequence
  chemically synthesized
aaatggggaattgaaatcac

SEQ ID NO: 319804 - DNA, 20 bp, Artificial Sequence
  chemically synthesized
gaccccaaaacagtaatagc

SEQ ID NO: 319805 - DNA, 20 bp, Artificial Sequence
  chemically synthesized
gatagaccccaaaacagtaa

SEQ ID NO: 319806 - DNA, 20 bp, Artificial Sequence
  chemically synthesized
atcaccggctattactgttt

SEQ ID NO: 319807 - DNA, 20 bp, Artificial Sequence
  chemically synthesized
tcaccggctattactgtttt

SEQ ID NO: 319808 - DNA, 20 bp, Artificial Sequence
  chemically synthesized
caccggctattactgttttg

SEQ ID NO: 319809 - DNA, 20 bp, Artificial Sequence
  chemically synthesized
tagagagatagaccccaaaa

SEQ ID NO: 319810 - DNA, 20 bp, Artificial Sequence
  chemically synthesized
tattattagagttagagaga

SEQ ID NO: 319811 - DNA, 20 bp, Artificial Sequence
  chemically synthesized
caaatattattagagttaga

SEQ ID NO: 319812 - DNA, 20 bp, Artificial Sequence
  chemically synthesized
atcaaatattattagagtta

SEQ ID NO: 319813 - DNA, 20 bp, Artificial Sequence
  chemically synthesized
aaatcaaatattattagagt

SEQ ID NO: 319814 - DNA, 20 bp, Artificial Sequence
  chemically synthesized
gtataaatcaaatattatta

SEQ ID NO: 319815 - DNA, 20 bp, Artificial Sequence
  chemically synthesized
acgtataaatcaaatattat

SEQ ID NO: 319816 - DNA, 20 bp, Artificial Sequence
  chemically synthesized
taatatttgatttatacgtc

SEQ ID NO: 319817 - DNA, 20 bp, Artificial Sequence
  chemically synthesized
aatatttgatttatacgtct

SEQ ID NO: 319818 - DNA, 20 bp, Artificial Sequence
  chemically synthesized
gtacccaacattggaacacc

SEQ ID NO: 319819 - DNA, 20 bp, Artificial Sequence
  chemically synthesized
acgtctgggtgttccaatgt

SEQ ID NO: 319820 - DNA, 20 bp, Artificial Sequence
  chemically synthesized
cgtctgggtgttccaatgtt

SEQ ID NO: 319821 - DNA, 20 bp, Artificial Sequence
  chemically synthesized
aataaatatgtacccaacat

SEQ ID NO: 319822 - DNA, 20 bp, Artificial Sequence
  chemically synthesized
aaaggggtcaattcagcaag

SEQ ID NO: 319823 - DNA, 20 bp, Artificial Sequence
  chemically synthesized
taaaggggtcaattcagcaa

SEQ ID NO: 319824 - DNA, 20 bp, Artificial Sequence
  chemically synthesized
gataaaggggtcaattcagc

SEQ ID NO: 319825 - DNA, 20 bp, Artificial Sequence
  chemically synthesized
gaatgataaaggggtcaatt

SEQ ID NO: 319826 - DNA, 20 bp, Artificial Sequence
  chemically synthesized
gtcattgtagaatgataaag

SEQ ID NO: 319827 - DNA, 20 bp, Artificial Sequence
  chemically synthesized
ggtcattgtagaatgataaa

SEQ ID NO: 319828 - DNA, 20 bp, Artificial Sequence
  chemically synthesized
cggtcattgtagaatgataa

SEQ ID NO: 319829 - DNA, 20 bp, Artificial Sequence
  chemically synthesized
ccggtcattgtagaatgata

SEQ ID NO: 319830 - DNA, 20 bp, Artificial Sequence
  chemically synthesized
ctttatcattctacaatgac

SEQ ID NO: 319831 - DNA, 20 bp, Artificial Sequence
  chemically synthesized
agggacaacgccggtcattg

SEQ ID NO: 319832 - DNA, 20 bp, Artificial Sequence
  chemically synthesized
actataaaaagggacaacgc

SEQ ID NO: 319833 - DNA, 20 bp, Artificial Sequence
  chemically synthesized
accggcgttgtcccttttta

SEQ ID NO: 319834 - DNA, 20 bp, Artificial Sequence
  chemically synthesized
caagacaaaaactataaaaa

SEQ ID NO: 319835 - DNA, 20 bp, Artificial Sequence
  chemically synthesized
tcaagacaaaaactataaaa

SEQ ID NO: 319836 - DNA, 20 bp, Artificial Sequence
  chemically synthesized
ttcaagacaaaaactataaa

SEQ ID NO: 319837 - DNA, 20 bp, Artificial Sequence
  chemically synthesized
tatcagacaaaataggtttc

SEQ ID NO: 319838 - DNA, 20 bp, Artificial Sequence
  chemically synthesized
attcttttatcagacaaaat

SEQ ID NO: 319839 - DNA, 20 bp, Artificial Sequence
  chemically synthesized
tattcttttatcagacaaaa

SEQ ID NO: 319840 - DNA, 20 bp, Artificial Sequence
  chemically synthesized
aaacctattttgtctgataa

SEQ ID NO: 319841 - DNA, 20 bp, Artificial Sequence
  chemically synthesized
aggattagctattcttttat

SEQ ID NO: 319842 - DNA, 20 bp, Artificial Sequence
  chemically synthesized
tattttgtctgataaaagaa

SEQ ID NO: 319843 - DNA, 20 bp, Artificial Sequence
  chemically synthesized
aaaccaaaaaagaacaggat

SEQ ID NO: 319844 - DNA, 20 bp, Artificial Sequence
  chemically synthesized
aatcgaaaccaaaaaagaac

SEQ ID NO: 319845 - DNA, 20 bp, Artificial Sequence
  chemically synthesized
caatcgaaaccaaaaaagaa

SEQ ID NO: 319846 - DNA, 20 bp, Artificial Sequence
  chemically synthesized
tagctaatcctgttcttttt

SEQ ID NO: 319847 - DNA, 20 bp, Artificial Sequence
  chemically synthesized
catgccaatcgaaaccaaaa

SEQ ID NO: 319848 - DNA, 20 bp, Artificial Sequence
  chemically synthesized
tgttcttttttggtttcgat

SEQ ID NO: 319849 - DNA, 20 bp, Artificial Sequence
  chemically synthesized
ttttttggtttcgattggca

SEQ ID NO: 319850 - DNA, 20 bp, Artificial Sequence
  chemically synthesized
tgaaaataaagggatggaac

SEQ ID NO: 319851 - DNA, 20 bp, Artificial Sequence
  chemically synthesized
atagactgaaaataaaggga

SEQ ID NO: 319852 - DNA, 20 bp, Artificial Sequence
  chemically synthesized
aaagatagactgaaaataaa

SEQ ID NO: 319853 - DNA, 20 bp, Artificial Sequence
  chemically synthesized
ttgttccatccctttatttt

SEQ ID NO: 319854 - DNA, 20 bp, Artificial Sequence
  chemically synthesized
taaagatagactgaaaataa

SEQ ID NO: 319855 - DNA, 20 bp, Artificial Sequence
  chemically synthesized
ataaagatagactgaaaata

SEQ ID NO: 319856 - DNA, 20 bp, Artificial Sequence
  chemically synthesized
ttgaccaataaagataaaga

SEQ ID NO: 319857 - DNA, 20 bp, Artificial Sequence
  chemically synthesized
acacttgaccaataaagata

SEQ ID NO: 319858 - DNA, 20 bp, Artificial Sequence
  chemically synthesized
cagtctatctttatctttat

SEQ ID NO: 319859 - DNA, 20 bp, Artificial Sequence
  chemically synthesized
agaaacacacttgaccaata

SEQ ID NO: 319860 - DNA, 20 bp, Artificial Sequence
  chemically synthesized
tatctttatctttattggtc

SEQ ID NO: 319861 - DNA, 20 bp, Artificial Sequence
  chemically synthesized
tggtcaagtgtgtttcttgt

SEQ ID NO: 319862 - DNA, 20 bp, Artificial Sequence
  chemically synthesized
cacaataatctgttacttac

SEQ ID NO: 319863 - DNA, 20 bp, Artificial Sequence
  chemically synthesized
agtgtgtttcttgtaagtaa

SEQ ID NO: 319864 - DNA, 20 bp, Artificial Sequence
  chemically synthesized
gaatggataaaagaatatac

SEQ ID NO: 319865 - DNA, 20 bp, Artificial Sequence
  chemically synthesized
ttgagtgacagaatggataa

SEQ ID NO: 319866 - DNA, 20 bp, Artificial Sequence
  chemically synthesized
aaatacattgagtgacagaa

SEQ ID NO: 319867 - DNA, 20 bp, Artificial Sequence
  chemically synthesized
aatctaaatacattgagtga

SEQ ID NO: 319868 - DNA, 20 bp, Artificial Sequence
  chemically synthesized
ctatccaatctaaatacatt

SEQ ID NO: 319869 - DNA, 20 bp, Artificial Sequence
  chemically synthesized
attctgtcactcaatgtatt

SEQ ID NO: 319870 - DNA, 20 bp, Artificial Sequence
  chemically synthesized
gtcactcaatgtatttagat

SEQ ID NO: 319871 - DNA, 20 bp, Artificial Sequence
  chemically synthesized
ctcaatgtatttagattgga

SEQ ID NO: 319872 - DNA, 20 bp, Artificial Sequence
  chemically synthesized
tgtatttagattggatagtt

SEQ ID NO: 319873 - DNA, 20 bp, Artificial Sequence
  chemically synthesized
ttaacgtaccaatgataaca

SEQ ID NO: 319874 - DNA, 20 bp, Artificial Sequence
  chemically synthesized
tttacattccatgttatcat

SEQ ID NO: 319875 - DNA, 20 bp, Artificial Sequence
  chemically synthesized
catgttatcattggtacgtt

SEQ ID NO: 319876 - DNA, 20 bp, Artificial Sequence
  chemically synthesized
atgttatcattggtacgtta

SEQ ID NO: 319877 - DNA, 20 bp, Artificial Sequence
  chemically synthesized
tagcaaaatgggaagtgttt

SEQ ID NO: 319878 - DNA, 20 bp, Artificial Sequence
  chemically synthesized
aaaggaaatagcaaaatggg

SEQ ID NO: 319879 - DNA, 20 bp, Artificial Sequence
  chemically synthesized
cagaaaggaaatagcaaaat

SEQ ID NO: 319880 - DNA, 20 bp, Artificial Sequence
  chemically synthesized
ccagaaaggaaatagcaaaa

SEQ ID NO: 319881 - DNA, 20 bp, Artificial Sequence
  chemically synthesized
caaaacaaccagaaaggaaa

SEQ ID NO: 319882 - DNA, 20 bp, Artificial Sequence
  chemically synthesized
ccattttgctatttcctttc

SEQ ID NO: 319883 - DNA, 20 bp, Artificial Sequence
  chemically synthesized
aggccacaaaacaaccagaa

SEQ ID NO: 319884 - DNA, 20 bp, Artificial Sequence
  chemically synthesized
aaggccacaaaacaaccaga

SEQ ID NO: 319885 - DNA, 20 bp, Artificial Sequence
  chemically synthesized
agagaaggccacaaaacaac

SEQ ID NO: 319886 - DNA, 20 bp, Artificial Sequence
  chemically synthesized
tttcctttctggttgttttg

SEQ ID NO: 319887 - DNA, 20 bp, Artificial Sequence
  chemically synthesized
ggaaagagagaatgaagaga

SEQ ID NO: 319888 - DNA, 20 bp, Artificial Sequence
  chemically synthesized
aggaaagagagaatgaagag

SEQ ID NO: 319889 - DNA, 20 bp, Artificial Sequence
  chemically synthesized
ggaaggaaagagagaatgaa

SEQ ID NO: 319890 - DNA, 20 bp, Artificial Sequence
  chemically synthesized
caggaaggaaagagagaatg

SEQ ID NO: 319891 - DNA, 20 bp, Artificial Sequence
  chemically synthesized
agtaagacaggaaggaaaga

SEQ ID NO: 319892 - DNA, 20 bp, Artificial Sequence
  chemically synthesized
atagtaagacaggaaggaaa

SEQ ID NO: 319893 - DNA, 20 bp, Artificial Sequence
  chemically synthesized
taatagtaagacaggaagga

SEQ ID NO: 319894 - DNA, 20 bp, Artificial Sequence
  chemically synthesized
tcattaatagtaagacagga

SEQ ID NO: 319895 - DNA, 20 bp, Artificial Sequence
  chemically synthesized
ttcattaatagtaagacagg

SEQ ID NO: 319896 - DNA, 20 bp, Artificial Sequence
  chemically synthesized
actttcattaatagtaagac

SEQ ID NO: 319897 - DNA, 20 bp, Artificial Sequence
  chemically synthesized
tactttcattaatagtaaga

SEQ ID NO: 319898 - DNA, 20 bp, Artificial Sequence
  chemically synthesized
aaattactttcattaatagt

SEQ ID NO: 319899 - DNA, 20 bp, Artificial Sequence
  chemically synthesized
tcctgtcttactattaatga

SEQ ID NO: 319900 - DNA, 20 bp, Artificial Sequence
  chemically synthesized
gagaaaattactttcattaa

SEQ ID NO: 319901 - DNA, 20 bp, Artificial Sequence
  chemically synthesized
ttaatgaaagtaattttctc

SEQ ID NO: 319902 - DNA, 20 bp, Artificial Sequence
  chemically synthesized
gaatgtataacatatgacca

SEQ ID NO: 319903 - DNA, 20 bp, Artificial Sequence
  chemically synthesized
aagaatgtataacatatgac

SEQ ID NO: 319904 - DNA, 20 bp, Artificial Sequence
  chemically synthesized
tcaggtacataaaaattaat

SEQ ID NO: 319905 - DNA, 20 bp, Artificial Sequence
  chemically synthesized
ttattaatttttatgtacct

SEQ ID NO: 319906 - DNA, 20 bp, Artificial Sequence
  chemically synthesized
acaaatcaaataatgtactc

SEQ ID NO: 319907 - DNA, 20 bp, Artificial Sequence
  chemically synthesized
cacaaatcaaataatgtact

SEQ ID NO: 319908 - DNA, 20 bp, Artificial Sequence
  chemically synthesized
tgagtacattatttgatttg

SEQ ID NO: 319909 - DNA, 20 bp, Artificial Sequence
  chemically synthesized
atttgatttgtggtaactat

SEQ ID NO: 319910 - DNA, 20 bp, Artificial Sequence
  chemically synthesized
tttgatttgtggtaactatg

SEQ ID NO: 319911 - DNA, 20 bp, Artificial Sequence
  chemically synthesized
cttattctttacaaacctca

SEQ ID NO: 319912 - DNA, 20 bp, Artificial Sequence
  chemically synthesized
tggtaactatgaggtttgta

SEQ ID NO: 319913 - DNA, 20 bp, Artificial Sequence
  chemically synthesized
ctatgaggtttgtaaagaat

SEQ ID NO: 319914 - DNA, 20 bp, Artificial Sequence
  chemically synthesized
ttgtcatgaatttcaaataa

SEQ ID NO: 319915 - DNA, 20 bp, Artificial Sequence
  chemically synthesized
tttgaaattcatgacaacac

SEQ ID NO: 319916 - DNA, 20 bp, Artificial Sequence
  chemically synthesized
tgcttatttgtttatgcaac

SEQ ID NO: 319917 - DNA, 20 bp, Artificial Sequence
  chemically synthesized
cactggttgcataaacaaat

SEQ ID NO: 319918 - DNA, 20 bp, Artificial Sequence
  chemically synthesized
gttgcataaacaaataagca

SEQ ID NO: 319919 - DNA, 20 bp, Artificial Sequence
  chemically synthesized
tgcataaacaaataagcaaa

SEQ ID NO: 319920 - DNA, 20 bp, Artificial Sequence
  chemically synthesized
tgtagcattttttttttttt

SEQ ID NO: 319921 - DNA, 20 bp, Artificial Sequence
  chemically synthesized
ggggggatgaagttaaagtg

SEQ ID NO: 319922 - DNA, 20 bp, Artificial Sequence
  chemically synthesized
agagtggggggatgaagtta

SEQ ID NO: 319923 - DNA, 20 bp, Artificial Sequence
  chemically synthesized
acaaaaagagtggggggatg

SEQ ID NO: 319924 - DNA, 20 bp, Artificial Sequence
  chemically synthesized
gaaacaacaaaaagagtggg

SEQ ID NO: 319925 - DNA, 20 bp, Artificial Sequence
  chemically synthesized
agaaacaacaaaaagagtgg

SEQ ID NO: 319926 - DNA, 20 bp, Artificial Sequence
  chemically synthesized
tagaaacaacaaaaagagtg

SEQ ID NO: 319927 - DNA, 20 bp, Artificial Sequence
  chemically synthesized
atagaaacaacaaaaagagt

SEQ ID NO: 319928 - DNA, 20 bp, Artificial Sequence
  chemically synthesized
aatagaaacaacaaaaagag

SEQ ID NO: 319929 - DNA, 20 bp, Artificial Sequence
  chemically synthesized
ataaatagaaacaacaaaaa

SEQ ID NO: 319930 - DNA, 20 bp, Artificial Sequence
  chemically synthesized
atataaatagaaacaacaaa

SEQ ID NO: 319931 - DNA, 20 bp, Artificial Sequence
  chemically synthesized
acactataataagatataaa

SEQ ID NO: 319932 - DNA, 20 bp, Artificial Sequence
  chemically synthesized
tttctatttatatcttatta

SEQ ID NO: 319933 - DNA, 20 bp, Artificial Sequence
  chemically synthesized
caagacatagacactataat

SEQ ID NO: 319934 - DNA, 20 bp, Artificial Sequence
  chemically synthesized
tgcaacaacttttcaagaca

SEQ ID NO: 319935 - DNA, 20 bp, Artificial Sequence
  chemically synthesized
tatagtgtctatgtcttgaa

SEQ ID NO: 319936 - DNA, 20 bp, Artificial Sequence
  chemically synthesized
aataactgcaacaacttttc

SEQ ID NO: 319937 - DNA, 20 bp, Artificial Sequence
  chemically synthesized
tatgtcttgaaaagttgttg

SEQ ID NO: 319938 - DNA, 20 bp, Artificial Sequence
  chemically synthesized
gttgttgcagttatttttga

SEQ ID NO: 319939 - DNA, 20 bp, Artificial Sequence
  chemically synthesized
ttgttgcagttatttttgat

SEQ ID NO: 319940 - DNA, 20 bp, Artificial Sequence
  chemically synthesized
tttttgataggttcgtcttt

SEQ ID NO: 319941 - DNA, 20 bp, Artificial Sequence
  chemically synthesized
atcttgagtaaaaagactaa

SEQ ID NO: 319942 - DNA, 20 bp, Artificial Sequence
  chemically synthesized
gtcttttagtctttttactc

SEQ ID NO: 319943 - DNA, 20 bp, Artificial Sequence
  chemically synthesized
ctacccatatcttgagtaaa

SEQ ID NO: 319944 - DNA, 20 bp, Artificial Sequence
  chemically synthesized
tagtctttttactcaagata

SEQ ID NO: 319945 - DNA, 20 bp, Artificial Sequence
  chemically synthesized
agtctttttactcaagatat

SEQ ID NO: 319946 - DNA, 20 bp, Artificial Sequence
  chemically synthesized
gtctcaactacccatatctt

SEQ ID NO: 319947 - DNA, 20 bp, Artificial Sequence
  chemically synthesized
ctttttactcaagatatggg

SEQ ID NO: 319948 - DNA, 20 bp, Artificial Sequence
  chemically synthesized
tactcaagatatgggtagtt

SEQ ID NO: 319949 - DNA, 20 bp, Artificial Sequence
  chemically synthesized
tagttgagacatcataatca

SEQ ID NO: 319950 - DNA, 20 bp, Artificial Sequence
  chemically synthesized
ttataatattctctttgtaa

SEQ ID NO: 319951 - DNA, 20 bp, Artificial Sequence
  chemically synthesized
tgttactattctgttacaaa

SEQ ID NO: 319952 - DNA, 20 bp, Artificial Sequence
  chemically synthesized
tttgttactattctgttaca

SEQ ID NO: 319953 - DNA, 20 bp, Artificial Sequence
  chemically synthesized
atattctctttgtaacagaa

SEQ ID NO: 319954 - DNA, 20 bp, Artificial Sequence
  chemically synthesized
aaaactcactggtgatagta

SEQ ID NO: 319955 - DNA, 20 bp, Artificial Sequence
  chemically synthesized
caaaactcactggtgatagt

SEQ ID NO: 319956 - DNA, 20 bp, Artificial Sequence
  chemically synthesized
gtaacaaaccttactatcac

SEQ ID NO: 319957 - DNA, 20 bp, Artificial Sequence
  chemically synthesized
gtaacaaaactcactggtga

SEQ ID NO: 319958 - DNA, 20 bp, Artificial Sequence
  chemically synthesized
caaaccttactatcaccagt

SEQ ID NO: 319959 - DNA, 20 bp, Artificial Sequence
  chemically synthesized
tctgaagtaacaaaactcac

SEQ ID NO: 319960 - DNA, 20 bp, Artificial Sequence
  chemically synthesized
accagtgagttttgttactt

SEQ ID NO: 319961 - DNA, 20 bp, Artificial Sequence
  chemically synthesized
gagcaatgagtcatcatctg

SEQ ID NO: 319962 - DNA, 20 bp, Artificial Sequence
  chemically synthesized
aaaggatgttaatgagcaat

SEQ ID NO: 319963 - DNA, 20 bp, Artificial Sequence
  chemically synthesized
ttaaagaaaaggatgttaat

SEQ ID NO: 319964 - DNA, 20 bp, Artificial Sequence
  chemically synthesized
tcattaacatccttttcttt

SEQ ID NO: 319965 - DNA, 20 bp, Artificial Sequence
  chemically synthesized
gttcttcaatcttaaagaaa

SEQ ID NO: 319966 - DNA, 20 bp, Artificial Sequence
  chemically synthesized
cgttcttcaatcttaaagaa

SEQ ID NO: 319967 - DNA, 20 bp, Artificial Sequence
  chemically synthesized
aagggcgttcttcaatctta

SEQ ID NO: 319968 - DNA, 20 bp, Artificial Sequence
  chemically synthesized
catccttttctttaagattg

SEQ ID NO: 319969 - DNA, 20 bp, Artificial Sequence
  chemically synthesized
tttctacaagaaatggtaaa

SEQ ID NO: 319970 - DNA, 20 bp, Artificial Sequence
  chemically synthesized
ttttctacaagaaatggtaa

SEQ ID NO: 319971 - DNA, 20 bp, Artificial Sequence
  chemically synthesized
cttttctacaagaaatggta

SEQ ID NO: 319972 - DNA, 20 bp, Artificial Sequence
  chemically synthesized
acgccctttaccatttcttg

SEQ ID NO: 319973 - DNA, 20 bp, Artificial Sequence
  chemically synthesized
caaaccttttctacaagaaa

SEQ ID NO: 319974 - DNA, 20 bp, Artificial Sequence
  chemically synthesized
ctttaccatttcttgtagaa

SEQ ID NO: 319975 - DNA, 20 bp, Artificial Sequence
  chemically synthesized
tttaccatttcttgtagaaa

SEQ ID NO: 319976 - DNA, 20 bp, Artificial Sequence
  chemically synthesized
taacaccaaaccttttctac

SEQ ID NO: 319977 - DNA, 20 bp, Artificial Sequence
  chemically synthesized
catttcttgtagaaaaggtt

SEQ ID NO: 319978 - DNA, 20 bp, Artificial Sequence
  chemically synthesized
ttggtgttaatgaaatctgt

SEQ ID NO: 319979 - DNA, 20 bp, Artificial Sequence
  chemically synthesized
ctaagacaaagaaaagctga

SEQ ID NO: 319980 - DNA, 20 bp, Artificial Sequence
  chemically synthesized
agactttctaagacaaagaa

SEQ ID NO: 319981 - DNA, 20 bp, Artificial Sequence
  chemically synthesized
ctgtcagcttttctttgtct

SEQ ID NO: 319982 - DNA, 20 bp, Artificial Sequence
  chemically synthesized
aatgaagactttctaagaca

SEQ ID NO: 319983 - DNA, 20 bp, Artificial Sequence
  chemically synthesized
cagcttttctttgtcttaga

SEQ ID NO: 319984 - DNA, 20 bp, Artificial Sequence
  chemically synthesized
aggagaaatgaagactttct

SEQ ID NO: 319985 - DNA, 20 bp, Artificial Sequence
  chemically synthesized
tcatacttgaaggagaaatg

SEQ ID NO: 319986 - DNA, 20 bp, Artificial Sequence
  chemically synthesized
aaagtcttcatttctccttc

SEQ ID NO: 319987 - DNA, 20 bp, Artificial Sequence
  chemically synthesized
aatcctcttcatacttgaag

SEQ ID NO: 319988 - DNA, 20 bp, Artificial Sequence
  chemically synthesized
aaaatcctcttcatacttga

SEQ ID NO: 319989 - DNA, 20 bp, Artificial Sequence
  chemically synthesized
gaaaatcctcttcatacttg

SEQ ID NO: 319990 - DNA, 20 bp, Artificial Sequence
  chemically synthesized
tcatttctccttcaagtatg

SEQ ID NO: 319991 - DNA, 20 bp, Artificial Sequence
  chemically synthesized
atttctccttcaagtatgaa

SEQ ID NO: 319992 - DNA, 20 bp, Artificial Sequence
  chemically synthesized
tttctccttcaagtatgaag

SEQ ID NO: 319993 - DNA, 20 bp, Artificial Sequence
  chemically synthesized
aagtatgaagaggattttca

SEQ ID NO: 319994 - DNA, 20 bp, Artificial Sequence
  chemically synthesized
ttttcatagatatactattc

SEQ ID NO: 319995 - DNA, 20 bp, Artificial Sequence
  chemically synthesized
aaaagacttttattctagaa

SEQ ID NO: 319996 - DNA, 20 bp, Artificial Sequence
  chemically synthesized
gatatactattctagaataa

SEQ ID NO: 319997 - DNA, 20 bp, Artificial Sequence
  chemically synthesized
gaaggaaaagacttttattc

SEQ ID NO: 319998 - DNA, 20 bp, Artificial Sequence
  chemically synthesized
agaataaaagtcttttcctt

SEQ ID NO: 319999 - DNA, 20 bp, Artificial Sequence
  chemically synthesized
catttaaagtgctgaaggaa

SEQ ID NO: 320000 - DNA, 20 bp, Artificial Sequence
  chemically synthesized
tgatacatttaaagtgctga

SEQ ID NO: 320001 - DNA, 20 bp, Artificial Sequence
  chemically synthesized
atgatacatttaaagtgctg

SEQ ID NO: 320002 - DNA, 20 bp, Artificial Sequence
  chemically synthesized
agagtggcatgatacattta

SEQ ID NO: 320003 - DNA, 20 bp, Artificial Sequence
  chemically synthesized
aatgtatcatgccactctcc

SEQ ID NO: 320004 - DNA, 20 bp, Artificial Sequence
  chemically synthesized
aaacttccaggccaggagag

SEQ ID NO: 320005 - DNA, 20 bp, Artificial Sequence
  chemically synthesized
ggaaaacttccaggccagga

SEQ ID NO: 320006 - DNA, 20 bp, Artificial Sequence
  chemically synthesized
atcatgccactctcctggcc

SEQ ID NO: 320007 - DNA, 20 bp, Artificial Sequence
  chemically synthesized
gtggaaaacttccaggccag

SEQ ID NO: 320008 - DNA, 20 bp, Artificial Sequence
  chemically synthesized
atgccactctcctggcctgg

SEQ ID NO: 320009 - DNA, 20 bp, Artificial Sequence
  chemically synthesized
cagtggaaaacttccaggcc

SEQ ID NO: 320010 - DNA, 20 bp, Artificial Sequence
  chemically synthesized
tcagtggaaaacttccaggc

SEQ ID NO: 320011 - DNA, 20 bp, Artificial Sequence
  chemically synthesized
attttcagtggaaaacttcc

SEQ ID NO: 320012 - DNA, 20 bp, Artificial Sequence
  chemically synthesized
aattttcagtggaaaacttc

SEQ ID NO: 320013 - DNA, 20 bp, Artificial Sequence
  chemically synthesized
tctggcagcacaattttcag

SEQ ID NO: 320014 - DNA, 20 bp, Artificial Sequence
  chemically synthesized
atgtctggcagcacaatttt

SEQ ID NO: 320015 - DNA, 20 bp, Artificial Sequence
  chemically synthesized
tccactgaaaattgtgctgc

SEQ ID NO: 320016 - DNA, 20 bp, Artificial Sequence
  chemically synthesized
aatagctccagtatgtctgg

SEQ ID NO: 320017 - DNA, 20 bp, Artificial Sequence
  chemically synthesized
aattgtgctgccagacatac

SEQ ID NO: 320018 - DNA, 20 bp, Artificial Sequence
  chemically synthesized
agaaatagctccagtatgtc

SEQ ID NO: 320019 - DNA, 20 bp, Artificial Sequence
  chemically synthesized
ttgtgctgccagacatactg

SEQ ID NO: 320020 - DNA, 20 bp, Artificial Sequence
  chemically synthesized
aaatcacatagaaatagctc

SEQ ID NO: 320021 - DNA, 20 bp, Artificial Sequence
  chemically synthesized
aaaaaaaaatcacatagaaa

SEQ ID NO: 320022 - DNA, 20 bp, Artificial Sequence
  chemically synthesized
atataaaaaaaaaaatcaca

SEQ ID NO: 320023 - DNA, 20 bp, Artificial Sequence
  chemically synthesized
tttatatgattaccgctttt

SEQ ID NO: 320024 - DNA, 20 bp, Artificial Sequence
  chemically synthesized
taaagaaaagatcttaaaag

SEQ ID NO: 320025 - DNA, 20 bp, Artificial Sequence
  chemically synthesized
ggataaagaaaagatcttaa

SEQ ID NO: 320026 - DNA, 20 bp, Artificial Sequence
  chemically synthesized
caaaggtcaaggataaagaa

SEQ ID NO: 320027 - DNA, 20 bp, Artificial Sequence
  chemically synthesized
acttccaaaggtcaaggata

SEQ ID NO: 320028 - DNA, 20 bp, Artificial Sequence
  chemically synthesized
ttttctttatccttgacctt

SEQ ID NO: 320029 - DNA, 20 bp, Artificial Sequence
  chemically synthesized
aatcaaacttccaaaggtca

SEQ ID NO: 320030 - DNA, 20 bp, Artificial Sequence
  chemically synthesized
aaatcaaacttccaaaggtc

SEQ ID NO: 320031 - DNA, 20 bp, Artificial Sequence
  chemically synthesized
tctttatccttgacctttgg

SEQ ID NO: 320032 - DNA, 20 bp, Artificial Sequence
  chemically synthesized
tttaaaaatcaaacttccaa

SEQ ID NO: 320033 - DNA, 20 bp, Artificial Sequence
  chemically synthesized
atttaaaaatcaaacttcca

SEQ ID NO: 320034 - DNA, 20 bp, Artificial Sequence
  chemically synthesized
gtttgatttttaaatgccct

SEQ ID NO: 320035 - DNA, 20 bp, Artificial Sequence
  chemically synthesized
tttgatttttaaatgccctg

SEQ ID NO: 320036 - DNA, 20 bp, Artificial Sequence
  chemically synthesized
gatttttaaatgccctgagg

SEQ ID NO: 320037 - DNA, 20 bp, Artificial Sequence
  chemically synthesized
atataaataagactacctca

SEQ ID NO: 320038 - DNA, 20 bp, Artificial Sequence
  chemically synthesized
aatataaataagactacctc

SEQ ID NO: 320039 - DNA, 20 bp, Artificial Sequence
  chemically synthesized
taatataaataagactacct

SEQ ID NO: 320040 - DNA, 20 bp, Artificial Sequence
  chemically synthesized
caaggagatataatataaat

SEQ ID NO: 320041 - DNA, 20 bp, Artificial Sequence
  chemically synthesized
ttatttatattatatctcct

SEQ ID NO: 320042 - DNA, 20 bp, Artificial Sequence
  chemically synthesized
gaagataatagaacaccaag

SEQ ID NO: 320043 - DNA, 20 bp, Artificial Sequence
  chemically synthesized
aagaagataatagaacacca

SEQ ID NO: 320044 - DNA, 20 bp, Artificial Sequence
  chemically synthesized
caagaagataatagaacacc

SEQ ID NO: 320045 - DNA, 20 bp, Artificial Sequence
  chemically synthesized
attcaagtacaagaagataa

SEQ ID NO: 320046 - DNA, 20 bp, Artificial Sequence
  chemically synthesized
gattaaaattcaagtacaag

SEQ ID NO: 320047 - DNA, 20 bp, Artificial Sequence
  chemically synthesized
agagattaaaattcaagtac

SEQ ID NO: 320048 - DNA, 20 bp, Artificial Sequence
  chemically synthesized
agagagagagattaaaattc

SEQ ID NO: 320049 - DNA, 20 bp, Artificial Sequence
  chemically synthesized
tgaattttaatctctctctc

SEQ ID NO: 320050 - DNA, 20 bp, Artificial Sequence
  chemically synthesized
gaattttaatctctctctct

SEQ ID NO: 320051 - DNA, 20 bp, Artificial Sequence
  chemically synthesized
acttcccccacctagagaga

SEQ ID NO: 320052 - DNA, 20 bp, Artificial Sequence
  chemically synthesized
gaacttcccccacctagaga

SEQ ID NO: 320053 - DNA, 20 bp, Artificial Sequence
  chemically synthesized
ttttaatctctctctctagg

SEQ ID NO: 320054 - DNA, 20 bp, Artificial Sequence
  chemically synthesized
tttaatctctctctctaggt

SEQ ID NO: 320055 - DNA, 20 bp, Artificial Sequence
  chemically synthesized
cagaacttcccccacctaga

SEQ ID NO: 320056 - DNA, 20 bp, Artificial Sequence
  chemically synthesized
ttaatctctctctctaggtg

SEQ ID NO: 320057 - DNA, 20 bp, Artificial Sequence
  chemically synthesized
taatctctctctctaggtgg

SEQ ID NO: 320058 - DNA, 20 bp, Artificial Sequence
  chemically synthesized
cacagaacttcccccaccta

SEQ ID NO: 320059 - DNA, 20 bp, Artificial Sequence
  chemically synthesized
aacacagaacttcccccacc

SEQ ID NO: 320060 - DNA, 20 bp, Artificial Sequence
  chemically synthesized
tctctctctctaggtggggg

SEQ ID NO: 320061 - DNA, 20 bp, Artificial Sequence
  chemically synthesized
tattgaagagggtaataaca

SEQ ID NO: 320062 - DNA, 20 bp, Artificial Sequence
  chemically synthesized
cctaaaaagtttattgaaga

SEQ ID NO: 320063 - DNA, 20 bp, Artificial Sequence
  chemically synthesized
tcctaaaaagtttattgaag

SEQ ID NO: 320064 - DNA, 20 bp, Artificial Sequence
  chemically synthesized
gtcctaaaaagtttattgaa

SEQ ID NO: 320065 - DNA, 20 bp, Artificial Sequence
  chemically synthesized
aagtcctaaaaagtttattg

SEQ ID NO: 320066 - DNA, 20 bp, Artificial Sequence
  chemically synthesized
accctcttcaataaactttt

SEQ ID NO: 320067 - DNA, 20 bp, Artificial Sequence
  chemically synthesized
ccctcttcaataaacttttt

SEQ ID NO: 320068 - DNA, 20 bp, Artificial Sequence
  chemically synthesized
ggagacaaaaaagtcctaaa

SEQ ID NO: 320069 - DNA, 20 bp, Artificial Sequence
  chemically synthesized
tacagtcagaggagacaaaa

SEQ ID NO: 320070 - DNA, 20 bp, Artificial Sequence
  chemically synthesized
atttgtaaatacagtcagag

SEQ ID NO: 320071 - DNA, 20 bp, Artificial Sequence
  chemically synthesized
ctatttgtaaatacagtcag

SEQ ID NO: 320072 - DNA, 20 bp, Artificial Sequence
  chemically synthesized
gctatttgtaaatacagtca

SEQ ID NO: 320073 - DNA, 20 bp, Artificial Sequence
  chemically synthesized
aagctatttgtaaatacagt

SEQ ID NO: 320074 - DNA, 20 bp, Artificial Sequence
  chemically synthesized
agacaagctatttgtaaata

SEQ ID NO: 320075 - DNA, 20 bp, Artificial Sequence
  chemically synthesized
cctctgactgtatttacaaa

SEQ ID NO: 320076 - DNA, 20 bp, Artificial Sequence
  chemically synthesized
tttacaaatagcttgtcttc

SEQ ID NO: 320077 - DNA, 20 bp, Artificial Sequence
  chemically synthesized
gaaagaattagcttgaagac

SEQ ID NO: 320078 - DNA, 20 bp, Artificial Sequence
  chemically synthesized
caggagaaagaattagcttg

SEQ ID NO: 320079 - DNA, 20 bp, Artificial Sequence
  chemically synthesized
gatcaagcaggagaaagaat

SEQ ID NO: 320080 - DNA, 20 bp, Artificial Sequence
  chemically synthesized
agaattgatcaagcaggaga

SEQ ID NO: 320081 - DNA, 20 bp, Artificial Sequence
  chemically synthesized
cagaagaattgatcaagcag

SEQ ID NO: 320082 - DNA, 20 bp, Artificial Sequence
  chemically synthesized
aacagaagaattgatcaagc

SEQ ID NO: 320083 - DNA, 20 bp, Artificial Sequence
  chemically synthesized
taacagaagaattgatcaag

SEQ ID NO: 320084 - DNA, 20 bp, Artificial Sequence
  chemically synthesized
gagtaacagaagaattgatc

SEQ ID NO: 320085 - DNA, 20 bp, Artificial Sequence
  chemically synthesized
gcgtcagagacgagtaacag

SEQ ID NO: 320086 - DNA, 20 bp, Artificial Sequence
  chemically synthesized
aatgcgtcagagacgagtaa

SEQ ID NO: 320087 - DNA, 20 bp, Artificial Sequence
  chemically synthesized
ctgaagaatgcgtcagagac

SEQ ID NO: 320088 - DNA, 20 bp, Artificial Sequence
  chemically synthesized
acatactgaagaatgcgtca

SEQ ID NO: 320089 - DNA, 20 bp, Artificial Sequence
  chemically synthesized
tgacatactgaagaatgcgt

SEQ ID NO: 320090 - DNA, 20 bp, Artificial Sequence
  chemically synthesized
ctcgtctctgacgcattctt

SEQ ID NO: 320091 - DNA, 20 bp, Artificial Sequence
  chemically synthesized
aagatttaactgacatactg

SEQ ID NO: 320092 - DNA, 20 bp, Artificial Sequence
  chemically synthesized
tgacgcattcttcagtatgt

SEQ ID NO: 320093 - DNA, 20 bp, Artificial Sequence
  chemically synthesized
tcagttaaatctttcaactc

SEQ ID NO: 320094 - DNA, 20 bp, Artificial Sequence
  chemically synthesized
aacaaaaattctggagttga

SEQ ID NO: 320095 - DNA, 20 bp, Artificial Sequence
  chemically synthesized
agaatcgaacaaaaattctg

SEQ ID NO: 320096 - DNA, 20 bp, Artificial Sequence
  chemically synthesized
aaagaatcgaacaaaaattc

SEQ ID NO: 320097 - DNA, 20 bp, Artificial Sequence
  chemically synthesized
aacaaagggattgaaataaa

SEQ ID NO: 320098 - DNA, 20 bp, Artificial Sequence
  chemically synthesized
ctacacataaatttaacaaa

SEQ ID NO: 320099 - DNA, 20 bp, Artificial Sequence
  chemically synthesized
cctacacataaatttaacaa

SEQ ID NO: 320100 - DNA, 20 bp, Artificial Sequence
  chemically synthesized
tcctacacataaatttaaca

SEQ ID NO: 320101 - DNA, 20 bp, Artificial Sequence
  chemically synthesized
ccctttgttaaatttatgtg

SEQ ID NO: 320102 - DNA, 20 bp, Artificial Sequence
  chemically synthesized
cctttgttaaatttatgtgt

SEQ ID NO: 320103 - DNA, 20 bp, Artificial Sequence
  chemically synthesized
gatagtacagagaaggaatt

SEQ ID NO: 320104 - DNA, 20 bp, Artificial Sequence
  chemically synthesized
aatccaagatagtacagaga

SEQ ID NO: 320105 - DNA, 20 bp, Artificial Sequence
  chemically synthesized
aaatccaagatagtacagag

SEQ ID NO: 320106 - DNA, 20 bp, Artificial Sequence
  chemically synthesized
ataaaatccaagatagtaca

SEQ ID NO: 320107 - DNA, 20 bp, Artificial Sequence
  chemically synthesized
caataaaatccaagatagta

SEQ ID NO: 320108 - DNA, 20 bp, Artificial Sequence
  chemically synthesized
attccttctctgtactatct

SEQ ID NO: 320109 - DNA, 20 bp, Artificial Sequence
  chemically synthesized
atgctcaataaaatccaaga

SEQ ID NO: 320110 - DNA, 20 bp, Artificial Sequence
  chemically synthesized
gaggatgctcaataaaatcc

SEQ ID NO: 320111 - DNA, 20 bp, Artificial Sequence
  chemically synthesized
gtactatcttggattttatt

SEQ ID NO: 320112 - DNA, 20 bp, Artificial Sequence
  chemically synthesized
tttattgagcatcctcaaat

SEQ ID NO: 320113 - DNA, 20 bp, Artificial Sequence
  chemically synthesized
aattccaaatggctgatttg

SEQ ID NO: 320114 - DNA, 20 bp, Artificial Sequence
  chemically synthesized
gaattccaaatggctgattt

SEQ ID NO: 320115 - DNA, 20 bp, Artificial Sequence
  chemically synthesized
gcatcctcaaatcagccatt

SEQ ID NO: 320116 - DNA, 20 bp, Artificial Sequence
  chemically synthesized
ttcagacagagaattccaaa

SEQ ID NO: 320117 - DNA, 20 bp, Artificial Sequence
  chemically synthesized
atttggaattctctgtctga

SEQ ID NO: 320118 - DNA, 20 bp, Artificial Sequence
  chemically synthesized
gatatgtgacctttcagaca

SEQ ID NO: 320119 - DNA, 20 bp, Artificial Sequence
  chemically synthesized
tttggaattctctgtctgaa

SEQ ID NO: 320120 - DNA, 20 bp, Artificial Sequence
  chemically synthesized
cagatatgtgacctttcaga

SEQ ID NO: 320121 - DNA, 20 bp, Artificial Sequence
  chemically synthesized
gagacagatatgtgaccttt

SEQ ID NO: 320122 - DNA, 20 bp, Artificial Sequence
  chemically synthesized
ggtcacatatctgtctctcc

SEQ ID NO: 320123 - DNA, 20 bp, Artificial Sequence
  chemically synthesized
gctgaccaatcttggagaga

SEQ ID NO: 320124 - DNA, 20 bp, Artificial Sequence
  chemically synthesized
catcgctgaccaatcttgga

SEQ ID NO: 320125 - DNA, 20 bp, Artificial Sequence
  chemically synthesized
catatctgtctctccaagat

SEQ ID NO: 320126 - DNA, 20 bp, Artificial Sequence
  chemically synthesized
ggcatcgctgaccaatcttg

SEQ ID NO: 320127 - DNA, 20 bp, Artificial Sequence
  chemically synthesized
aaggcatcgctgaccaatct

SEQ ID NO: 320128 - DNA, 20 bp, Artificial Sequence
  chemically synthesized
tctgtctctccaagattggt

SEQ ID NO: 320129 - DNA, 20 bp, Artificial Sequence
  chemically synthesized
ttggtcagcgatgccttatt

SEQ ID NO: 320130 - DNA, 20 bp, Artificial Sequence
  chemically synthesized
ctcaccaactgaactaaata

SEQ ID NO: 320131 - DNA, 20 bp, Artificial Sequence
  chemically synthesized
tctcaccaactgaactaaat

SEQ ID NO: 320132 - DNA, 20 bp, Artificial Sequence
  chemically synthesized
cagcgatgccttatttagtt

SEQ ID NO: 320133 - DNA, 20 bp, Artificial Sequence
  chemically synthesized
gatgccttatttagttcagt

SEQ ID NO: 320134 - DNA, 20 bp, Artificial Sequence
  chemically synthesized
ccttatttagttcagttggt

SEQ ID NO: 320135 - DNA, 20 bp, Artificial Sequence
  chemically synthesized
ttggtgagatcatgttttct

SEQ ID NO: 320136 - DNA, 20 bp, Artificial Sequence
  chemically synthesized
tgagatcatgttttcttgga

SEQ ID NO: 320137 - DNA, 20 bp, Artificial Sequence
  chemically synthesized
cggaagcatcaagaccatcc

SEQ ID NO: 320138 - DNA, 20 bp, Artificial Sequence
  chemically synthesized
gatgaacatccggaagcatc

SEQ ID NO: 320139 - DNA, 20 bp, Artificial Sequence
  chemically synthesized
ttggatggtcttgatgcttc

SEQ ID NO: 320140 - DNA, 20 bp, Artificial Sequence
  chemically synthesized
agacattgatgaacatccgg

SEQ ID NO: 320141 - DNA, 20 bp, Artificial Sequence
  chemically synthesized
cccagacattgatgaacatc

SEQ ID NO: 320142 - DNA, 20 bp, Artificial Sequence
  chemically synthesized
tccggatgttcatcaatgtc

SEQ ID NO: 320143 - DNA, 20 bp, Artificial Sequence
  chemically synthesized
ccggatgttcatcaatgtct

SEQ ID NO: 320144 - DNA, 20 bp, Artificial Sequence
  chemically synthesized
tcatcaatgtctgggcattg

SEQ ID NO: 320145 - DNA, 20 bp, Artificial Sequence
  chemically synthesized
ataccaaagtcttcaatgcc

SEQ ID NO: 320146 - DNA, 20 bp, Artificial Sequence
  chemically synthesized
tgtctgggcattgaagactt

SEQ ID NO: 320147 - DNA, 20 bp, Artificial Sequence
  chemically synthesized
aaagactacaataaatacca

SEQ ID NO: 320148 - DNA, 20 bp, Artificial Sequence
  chemically synthesized
gaagactttggtatttattg

SEQ ID NO: 320149 - DNA, 20 bp, Artificial Sequence
  chemically synthesized
ggtatttattgtagtctttg

SEQ ID NO: 320150 - DNA, 20 bp, Artificial Sequence
  chemically synthesized
acaaacaagccgatactgca

SEQ ID NO: 320151 - DNA, 20 bp, Artificial Sequence
  chemically synthesized
tattgtagtctttgcagtat

SEQ ID NO: 320152 - DNA, 20 bp, Artificial Sequence
  chemically synthesized
tgagaagtatggatacaaac

SEQ ID NO: 320153 - DNA, 20 bp, Artificial Sequence
  chemically synthesized
ttgtttgtatccatacttct

SEQ ID NO: 320154 - DNA, 20 bp, Artificial Sequence
  chemically synthesized
gaaagccctcctgagaagta

SEQ ID NO: 320155 - DNA, 20 bp, Artificial Sequence
  chemically synthesized
tgtttgtatccatacttctc

SEQ ID NO: 320156 - DNA, 20 bp, Artificial Sequence
  chemically synthesized
tttgtatccatacttctcag

SEQ ID NO: 320157 - DNA, 20 bp, Artificial Sequence
  chemically synthesized
ttgtatccatacttctcagg

SEQ ID NO: 320158 - DNA, 20 bp, Artificial Sequence
  chemically synthesized
tgtatccatacttctcagga

SEQ ID NO: 320159 - DNA, 20 bp, Artificial Sequence
  chemically synthesized
acctggaaagccctcctgag

SEQ ID NO: 320160 - DNA, 20 bp, Artificial Sequence
  chemically synthesized
aatacctggaaagccctcct

SEQ ID NO: 320161 - DNA, 20 bp, Artificial Sequence
  chemically synthesized
tacttctcaggagggctttc

SEQ ID NO: 320162 - DNA, 20 bp, Artificial Sequence
  chemically synthesized
acttctcaggagggctttcc

SEQ ID NO: 320163 - DNA, 20 bp, Artificial Sequence
  chemically synthesized
agaacctttaaatacctgga

SEQ ID NO: 320164 - DNA, 20 bp, Artificial Sequence
  chemically synthesized
cccaagaacctttaaatacc

SEQ ID NO: 320165 - DNA, 20 bp, Artificial Sequence
  chemically synthesized
gagggctttccaggtattta

SEQ ID NO: 320166 - DNA, 20 bp, Artificial Sequence
  chemically synthesized
agggctttccaggtatttaa

SEQ ID NO: 320167 - DNA, 20 bp, Artificial Sequence
  chemically synthesized
tccaggtatttaaaggttct

SEQ ID NO: 320168 - DNA, 20 bp, Artificial Sequence
  chemically synthesized
ccaggtatttaaaggttctt

SEQ ID NO: 320169 - DNA, 20 bp, Artificial Sequence
  chemically synthesized
aggaataaatcacaacaccc

SEQ ID NO: 320170 - DNA, 20 bp, Artificial Sequence
  chemically synthesized
ggtgttgtgatttattcctt

SEQ ID NO: 320171 - DNA, 20 bp, Artificial Sequence
  chemically synthesized
tatatggctgcagtgaccaa

SEQ ID NO: 320172 - DNA, 20 bp, Artificial Sequence
  chemically synthesized
atatatggctgcagtgacca

SEQ ID NO: 320173 - DNA, 20 bp, Artificial Sequence
  chemically synthesized
atttattcctttggtcactg

SEQ ID NO: 320174 - DNA, 20 bp, Artificial Sequence
  chemically synthesized
ccccagtgcatatatggctg

SEQ ID NO: 320175 - DNA, 20 bp, Artificial Sequence
  chemically synthesized
ggtgcaccccagtgcatata

SEQ ID NO: 320176 - DNA, 20 bp, Artificial Sequence
  chemically synthesized
cactgcagccatatatgcac

SEQ ID NO: 320177 - DNA, 20 bp, Artificial Sequence
  chemically synthesized
actgcagccatatatgcact

SEQ ID NO: 320178 - DNA, 20 bp, Artificial Sequence
  chemically synthesized
ctgcagccatatatgcactg

SEQ ID NO: 320179 - DNA, 20 bp, Artificial Sequence
  chemically synthesized
tactgggcttgggtgcaccc

SEQ ID NO: 320180 - DNA, 20 bp, Artificial Sequence
  chemically synthesized
atatgcactggggtgcaccc

SEQ ID NO: 320181 - DNA, 20 bp, Artificial Sequence
  chemically synthesized
cactggggtgcacccaagcc

SEQ ID NO: 320182 - DNA, 20 bp, Artificial Sequence
  chemically synthesized
gtcacagcattactgggctt

SEQ ID NO: 320183 - DNA, 20 bp, Artificial Sequence
  chemically synthesized
agtcacagcattactgggct

SEQ ID NO: 320184 - DNA, 20 bp, Artificial Sequence
  chemically synthesized
gcaagagtcacagcattact

SEQ ID NO: 320185 - DNA, 20 bp, Artificial Sequence
  chemically synthesized
tgcaagagtcacagcattac

SEQ ID NO: 320186 - DNA, 20 bp, Artificial Sequence
  chemically synthesized
ttaacagtctgcaagagtca

SEQ ID NO: 320187 - DNA, 20 bp, Artificial Sequence
  chemically synthesized
cagtaatgctgtgactcttg

SEQ ID NO: 320188 - DNA, 20 bp, Artificial Sequence
  chemically synthesized
gtacgtttaacagtctgcaa

SEQ ID NO: 320189 - DNA, 20 bp, Artificial Sequence
  chemically synthesized
cagtacgtttaacagtctgc

SEQ ID NO: 320190 - DNA, 20 bp, Artificial Sequence
  chemically synthesized
caccaaggcagtacgtttaa

SEQ ID NO: 320191 - DNA, 20 bp, Artificial Sequence
  chemically synthesized
gactgttaaacgtactgcct

SEQ ID NO: 320192 - DNA, 20 bp, Artificial Sequence
  chemically synthesized
cttcccaaagatcaccaagg

SEQ ID NO: 320193 - DNA, 20 bp, Artificial Sequence
  chemically synthesized
aatcttcccaaagatcacca

SEQ ID NO: 320194 - DNA, 20 bp, Artificial Sequence
  chemically synthesized
gaatcttcccaaagatcacc

SEQ ID NO: 320195 - DNA, 20 bp, Artificial Sequence
  chemically synthesized
cgtactgccttggtgatctt

SEQ ID NO: 320196 - DNA, 20 bp, Artificial Sequence
  chemically synthesized
gtactgccttggtgatcttt

SEQ ID NO: 320197 - DNA, 20 bp, Artificial Sequence
  chemically synthesized
ctgccttggtgatctttggg

SEQ ID NO: 320198 - DNA, 20 bp, Artificial Sequence
  chemically synthesized
gattttcctgaatcttccca

SEQ ID NO: 320199 - DNA, 20 bp, Artificial Sequence
  chemically synthesized
tggtgatctttgggaagatt

SEQ ID NO: 320200 - DNA, 20 bp, Artificial Sequence
  chemically synthesized
ggtgatctttgggaagattc

SEQ ID NO: 320201 - DNA, 20 bp, Artificial Sequence
  chemically synthesized
ttatctaccaggtaatacag

SEQ ID NO: 320202 - DNA, 20 bp, Artificial Sequence
  chemically synthesized
attatctaccaggtaataca

SEQ ID NO: 320203 - DNA, 20 bp, Artificial Sequence
  chemically synthesized
gattatctaccaggtaatac

SEQ ID NO: 320204 - DNA, 20 bp, Artificial Sequence
  chemically synthesized
ggaaaatcccctgtattacc

SEQ ID NO: 320205 - DNA, 20 bp, Artificial Sequence
  chemically synthesized
agattatctaccaggtaata

SEQ ID NO: 320206 - DNA, 20 bp, Artificial Sequence
  chemically synthesized
aaatcccctgtattacctgg

SEQ ID NO: 320207 - DNA, 20 bp, Artificial Sequence
  chemically synthesized
agagaaaaagattatctacc

SEQ ID NO: 320208 - DNA, 20 bp, Artificial Sequence
  chemically synthesized
aagagaaaaagattatctac

SEQ ID NO: 320209 - DNA, 20 bp, Artificial Sequence
  chemically synthesized
tgaggggaaggaaagagaaa

SEQ ID NO: 320210 - DNA, 20 bp, Artificial Sequence
  chemically synthesized
ctttgttgaggggaaggaaa

SEQ ID NO: 320211 - DNA, 20 bp, Artificial Sequence
  chemically synthesized
ctctttgttgaggggaagga

SEQ ID NO: 320212 - DNA, 20 bp, Artificial Sequence
  chemically synthesized
gactctctttgttgagggga

SEQ ID NO: 320213 - DNA, 20 bp, Artificial Sequence
  chemically synthesized
agactctctttgttgagggg

SEQ ID NO: 320214 - DNA, 20 bp, Artificial Sequence
  chemically synthesized
ctctttccttcccctcaaca

SEQ ID NO: 320215 - DNA, 20 bp, Artificial Sequence
  chemically synthesized
gagagactctctttgttgag

SEQ ID NO: 320216 - DNA, 20 bp, Artificial Sequence
  chemically synthesized
agagagactctctttgttga

SEQ ID NO: 320217 - DNA, 20 bp, Artificial Sequence
  chemically synthesized
ctttccttcccctcaacaaa

SEQ ID NO: 320218 - DNA, 20 bp, Artificial Sequence
  chemically synthesized
gagagagactctctttgttg

SEQ ID NO: 320219 - DNA, 20 bp, Artificial Sequence
  chemically synthesized
agagagagactctctttgtt

SEQ ID NO: 320220 - DNA, 20 bp, Artificial Sequence
  chemically synthesized
ttccttcccctcaacaaaga

SEQ ID NO: 320221 - DNA, 20 bp, Artificial Sequence
  chemically synthesized
caggcagctcatcacagaga

SEQ ID NO: 320222 - DNA, 20 bp, Artificial Sequence
  chemically synthesized
tccaggcagctcatcacaga

SEQ ID NO: 320223 - DNA, 20 bp, Artificial Sequence
  chemically synthesized
agagagtctctctctgtgat

SEQ ID NO: 320224 - DNA, 20 bp, Artificial Sequence
  chemically synthesized
gctccaggcagctcatcaca

SEQ ID NO: 320225 - DNA, 20 bp, Artificial Sequence
  chemically synthesized
tagctccaggcagctcatca

SEQ ID NO: 320226 - DNA, 20 bp, Artificial Sequence
  chemically synthesized
tctctctgtgatgagctgcc

SEQ ID NO: 320227 - DNA, 20 bp, Artificial Sequence
  chemically synthesized
tctctgtgatgagctgcctg

SEQ ID NO: 320228 - DNA, 20 bp, Artificial Sequence
  chemically synthesized
acctctcctttagctccagg

SEQ ID NO: 320229 - DNA, 20 bp, Artificial Sequence
  chemically synthesized
tgatgagctgcctggagcta

SEQ ID NO: 320230 - DNA, 20 bp, Artificial Sequence
  chemically synthesized
gtcacctctcctttagctcc

SEQ ID NO: 320231 - DNA, 20 bp, Artificial Sequence
  chemically synthesized
gatgagctgcctggagctaa

SEQ ID NO: 320232 - DNA, 20 bp, Artificial Sequence
  chemically synthesized
tgtcacctctcctttagctc

SEQ ID NO: 320233 - DNA, 20 bp, Artificial Sequence
  chemically synthesized
tgagctgcctggagctaaag

SEQ ID NO: 320234 - DNA, 20 bp, Artificial Sequence
  chemically synthesized
agctgcctggagctaaagga

SEQ ID NO: 320235 - DNA, 20 bp, Artificial Sequence
  chemically synthesized
gctgcctggagctaaaggag

SEQ ID NO: 320236 - DNA, 20 bp, Artificial Sequence
  chemically synthesized
tgcttgtgtcacctctcctt

SEQ ID NO: 320237 - DNA, 20 bp, Artificial Sequence
  chemically synthesized
agctaaaggagaggtgacac

SEQ ID NO: 320238 - DNA, 20 bp, Artificial Sequence
  chemically synthesized
aggtgacacaagcacccctg

SEQ ID NO: 320239 - DNA, 20 bp, Artificial Sequence
  chemically synthesized
cctagtcgtggtagctacag

SEQ ID NO: 320240 - DNA, 20 bp, Artificial Sequence
  chemically synthesized
tcctagtcgtggtagctaca

SEQ ID NO: 320241 - DNA, 20 bp, Artificial Sequence
  chemically synthesized
atcctagtcgtggtagctac

SEQ ID NO: 320242 - DNA, 20 bp, Artificial Sequence
  chemically synthesized
aatcctagtcgtggtagcta

SEQ ID NO: 320243 - DNA, 20 bp, Artificial Sequence
  chemically synthesized
acccctgtagctaccacgac

SEQ ID NO: 320244 - DNA, 20 bp, Artificial Sequence
  chemically synthesized
caacacaatcctagtcgtgg

SEQ ID NO: 320245 - DNA, 20 bp, Artificial Sequence
  chemically synthesized
cccctgtagctaccacgact

SEQ ID NO: 320246 - DNA, 20 bp, Artificial Sequence
  chemically synthesized
acccaacacaatcctagtcg

SEQ ID NO: 320247 - DNA, 20 bp, Artificial Sequence
  chemically synthesized
ggagtgacccaacacaatcc

SEQ ID NO: 320248 - DNA, 20 bp, Artificial Sequence
  chemically synthesized
taccacgactaggattgtgt

SEQ ID NO: 320249 - DNA, 20 bp, Artificial Sequence
  chemically synthesized
accacgactaggattgtgtt

SEQ ID NO: 320250 - DNA, 20 bp, Artificial Sequence
  chemically synthesized
attgtgttgggtcactccta

SEQ ID NO: 320251 - DNA, 20 bp, Artificial Sequence
  chemically synthesized
tgttgggtcactcctaaagc

SEQ ID NO: 320252 - DNA, 20 bp, Artificial Sequence
  chemically synthesized
cagtgttgtactggctttag

SEQ ID NO: 320253 - DNA, 20 bp, Artificial Sequence
  chemically synthesized
cccagtgttgtactggcttt

SEQ ID NO: 320254 - DNA, 20 bp, Artificial Sequence
  chemically synthesized
acccagtgttgtactggctt

SEQ ID NO: 320255 - DNA, 20 bp, Artificial Sequence
  chemically synthesized
atcaagacccagtgttgtac

SEQ ID NO: 320256 - DNA, 20 bp, Artificial Sequence
  chemically synthesized
tcctaaagccagtacaacac

SEQ ID NO: 320257 - DNA, 20 bp, Artificial Sequence
  chemically synthesized
cctaaagccagtacaacact

SEQ ID NO: 320258 - DNA, 20 bp, Artificial Sequence
  chemically synthesized
tgtgggccttgatcaagacc

SEQ ID NO: 320259 - DNA, 20 bp, Artificial Sequence
  chemically synthesized
tacaacactgggtcttgatc

SEQ ID NO: 320260 - DNA, 20 bp, Artificial Sequence
  chemically synthesized
acaacactgggtcttgatca

SEQ ID NO: 320261 - DNA, 20 bp, Artificial Sequence
  chemically synthesized
ggtcagtgtgggccttgatc

SEQ ID NO: 320262 - DNA, 20 bp, Artificial Sequence
  chemically synthesized
agccagtcagtggtcagtgt

SEQ ID NO: 320263 - DNA, 20 bp, Artificial Sequence
  chemically synthesized
tagccagtcagtggtcagtg

SEQ ID NO: 320264 - DNA, 20 bp, Artificial Sequence
  chemically synthesized
ggtgatagccagtcagtggt

SEQ ID NO: 320265 - DNA, 20 bp, Artificial Sequence
  chemically synthesized
ggcccacactgaccactgac

SEQ ID NO: 320266 - DNA, 20 bp, Artificial Sequence
  chemically synthesized
tgtaggtgatagccagtcag

SEQ ID NO: 320267 - DNA, 20 bp, Artificial Sequence
  chemically synthesized
gaatgtaggtgatagccagt

SEQ ID NO: 320268 - DNA, 20 bp, Artificial Sequence
  chemically synthesized
gagtgaatgtaggtgatagc

SEQ ID NO: 320269 - DNA, 20 bp, Artificial Sequence
  chemically synthesized
ccctgagtgaatgtaggtga

SEQ ID NO: 320270 - DNA, 20 bp, Artificial Sequence
  chemically synthesized
cttgggccctgagtgaatgt

SEQ ID NO: 320271 - DNA, 20 bp, Artificial Sequence
  chemically synthesized
ccttgggccctgagtgaatg

SEQ ID NO: 320272 - DNA, 20 bp, Artificial Sequence
  chemically synthesized
ggctatcacctacattcact

SEQ ID NO: 320273 - DNA, 20 bp, Artificial Sequence
  chemically synthesized
gctatcacctacattcactc

SEQ ID NO: 320274 - DNA, 20 bp, Artificial Sequence
  chemically synthesized
ctatcacctacattcactca

SEQ ID NO: 320275 - DNA, 20 bp, Artificial Sequence
  chemically synthesized
cctacattcactcagggccc

SEQ ID NO: 320276 - DNA, 20 bp, Artificial Sequence
  chemically synthesized
ttgtagagtccttgggccct

SEQ ID NO: 320277 - DNA, 20 bp, Artificial Sequence
  chemically synthesized
ctacattcactcagggccca

SEQ ID NO: 320278 - DNA, 20 bp, Artificial Sequence
  chemically synthesized
ctgccgattgtagagtcctt

SEQ ID NO: 320279 - DNA, 20 bp, Artificial Sequence
  chemically synthesized
cctgccgattgtagagtcct

SEQ ID NO: 320280 - DNA, 20 bp, Artificial Sequence
  chemically synthesized
gggcccaaggactctacaat

SEQ ID NO: 320281 - DNA, 20 bp, Artificial Sequence
  chemically synthesized
tttgccacctgccgattgta

SEQ ID NO: 320282 - DNA, 20 bp, Artificial Sequence
  chemically synthesized
cccaaggactctacaatcgg

SEQ ID NO: 320283 - DNA, 20 bp, Artificial Sequence
  chemically synthesized
gatttgccacctgccgattg

SEQ ID NO: 320284 - DNA, 20 bp, Artificial Sequence
  chemically synthesized
ccaaggactctacaatcggc

SEQ ID NO: 320285 - DNA, 20 bp, Artificial Sequence
  chemically synthesized
aggactctacaatcggcagg

SEQ ID NO: 320286 - DNA, 20 bp, Artificial Sequence
  chemically synthesized
ggcaggtggcaaatccaatg

SEQ ID NO: 320287 - DNA, 20 bp, Artificial Sequence
  chemically synthesized
gtgaaaaacacaagcttcat

SEQ ID NO: 320288 - DNA, 20 bp, Artificial Sequence
  chemically synthesized
taccctgaagtgaaaaacac

SEQ ID NO: 320289 - DNA, 20 bp, Artificial Sequence
  chemically synthesized
gaagcttgtgtttttcactt

SEQ ID NO: 320290 - DNA, 20 bp, Artificial Sequence
  chemically synthesized
aagcttgtgtttttcacttc

SEQ ID NO: 320291 - DNA, 20 bp, Artificial Sequence
  chemically synthesized
agcttgtgtttttcacttca

SEQ ID NO: 320292 - DNA, 20 bp, Artificial Sequence
  chemically synthesized
ttgtgtttttcacttcaggg

SEQ ID NO: 320293 - DNA, 20 bp, Artificial Sequence
  chemically synthesized
agggaaaaattgctaccctg

SEQ ID NO: 320294 - DNA, 20 bp, Artificial Sequence
  chemically synthesized
tcagggtagcaatttttccc

SEQ ID NO: 320295 - DNA, 20 bp, Artificial Sequence
  chemically synthesized
gggtagcaatttttccctgg

SEQ ID NO: 320296 - DNA, 20 bp, Artificial Sequence
  chemically synthesized
ggtagcaatttttccctggt

SEQ ID NO: 320297 - DNA, 20 bp, Artificial Sequence
  chemically synthesized
aggatcttgcaaacccacca

SEQ ID NO: 320298 - DNA, 20 bp, Artificial Sequence
  chemically synthesized
taggatcttgcaaacccacc

SEQ ID NO: 320299 - DNA, 20 bp, Artificial Sequence
  chemically synthesized
ataggatcttgcaaacccac

SEQ ID NO: 320300 - DNA, 20 bp, Artificial Sequence
  chemically synthesized
tttttccctggtgggtttgc

SEQ ID NO: 320301 - DNA, 20 bp, Artificial Sequence
  chemically synthesized
gtttgcaagatcctatatgt

SEQ ID NO: 320302 - DNA, 20 bp, Artificial Sequence
  chemically synthesized
ccaggccctggcttacatat

SEQ ID NO: 320303 - DNA, 20 bp, Artificial Sequence
  chemically synthesized
cccaggccctggcttacata

SEQ ID NO: 320304 - DNA, 20 bp, Artificial Sequence
  chemically synthesized
gcaagatcctatatgtaagc

SEQ ID NO: 320305 - DNA, 20 bp, Artificial Sequence
  chemically synthesized
caagatcctatatgtaagcc

SEQ ID NO: 320306 - DNA, 20 bp, Artificial Sequence
  chemically synthesized
aagatcctatatgtaagcca

SEQ ID NO: 320307 - DNA, 20 bp, Artificial Sequence
  chemically synthesized
cctatatgtaagccagggcc

SEQ ID NO: 320308 - DNA, 20 bp, Artificial Sequence
  chemically synthesized
ctatatgtaagccagggcct

SEQ ID NO: 320309 - DNA, 20 bp, Artificial Sequence
  chemically synthesized
tatatgtaagccagggcctg

SEQ ID NO: 320310 - DNA, 20 bp, Artificial Sequence
  chemically synthesized
taatacatgaccccaggccc

SEQ ID NO: 320311 - DNA, 20 bp, Artificial Sequence
  chemically synthesized
atggcctaatacatgacccc

SEQ ID NO: 320312 - DNA, 20 bp, Artificial Sequence
  chemically synthesized
aatggcctaatacatgaccc

SEQ ID NO: 320313 - DNA, 20 bp, Artificial Sequence
  chemically synthesized
cagggcctggggtcatgtat

SEQ ID NO: 320314 - DNA, 20 bp, Artificial Sequence
  chemically synthesized
agggcctggggtcatgtatt

SEQ ID NO: 320315 - DNA, 20 bp, Artificial Sequence
  chemically synthesized
tctttatagcattgtgagaa

SEQ ID NO: 320316 - DNA, 20 bp, Artificial Sequence
  chemically synthesized
atatttctttatagcattgt

SEQ ID NO: 320317 - DNA, 20 bp, Artificial Sequence
  chemically synthesized
gccattctcacaatgctata

SEQ ID NO: 320318 - DNA, 20 bp, Artificial Sequence
  chemically synthesized
cagtatcagatatttcttta

SEQ ID NO: 320319 - DNA, 20 bp, Artificial Sequence
  chemically synthesized
tataaagaaatatctgatac

SEQ ID NO: 320320 - DNA, 20 bp, Artificial Sequence
  chemically synthesized
ataaagaaatatctgatact

SEQ ID NO: 320321 - DNA, 20 bp, Artificial Sequence
  chemically synthesized
cttcataaattacccagtat

SEQ ID NO: 320322 - DNA, 20 bp, Artificial Sequence
  chemically synthesized
tcttttcttcataaattacc

SEQ ID NO: 320323 - DNA, 20 bp, Artificial Sequence
  chemically synthesized
ctgatactgggtaatttatg

SEQ ID NO: 320324 - DNA, 20 bp, Artificial Sequence
  chemically synthesized
actgggtaatttatgaagaa

SEQ ID NO: 320325 - DNA, 20 bp, Artificial Sequence
  chemically synthesized
tgggtaatttatgaagaaaa

SEQ ID NO: 320326 - DNA, 20 bp, Artificial Sequence
  chemically synthesized
gggtaatttatgaagaaaag

SEQ ID NO: 320327 - DNA, 20 bp, Artificial Sequence
  chemically synthesized
atgaagaaaagaggcttaaa

SEQ ID NO: 320328 - DNA, 20 bp, Artificial Sequence
  chemically synthesized
tgcagaaccatgagccattt

SEQ ID NO: 320329 - DNA, 20 bp, Artificial Sequence
  chemically synthesized
aaagaggcttaaatggctca

SEQ ID NO: 320330 - DNA, 20 bp, Artificial Sequence
  chemically synthesized
gggacaacctgcagaaccat

SEQ ID NO: 320331 - DNA, 20 bp, Artificial Sequence
  chemically synthesized
ttaaatggctcatggttctg

SEQ ID NO: 320332 - DNA, 20 bp, Artificial Sequence
  chemically synthesized
taaatggctcatggttctgc

SEQ ID NO: 320333 - DNA, 20 bp, Artificial Sequence
  chemically synthesized
catgtctcagggacaacctg

SEQ ID NO: 320334 - DNA, 20 bp, Artificial Sequence
  chemically synthesized
tggttctgcaggttgtccct

SEQ ID NO: 320335 - DNA, 20 bp, Artificial Sequence
  chemically synthesized
gatgccagcatcatgtctca

SEQ ID NO: 320336 - DNA, 20 bp, Artificial Sequence
  chemically synthesized
agatgccagcatcatgtctc

SEQ ID NO: 320337 - DNA, 20 bp, Artificial Sequence
  chemically synthesized
cagatgccagcatcatgtct

SEQ ID NO: 320338 - DNA, 20 bp, Artificial Sequence
  chemically synthesized
ttgtccctgagacatgatgc

SEQ ID NO: 320339 - DNA, 20 bp, Artificial Sequence
  chemically synthesized
cgcagaagcagagcagatgc

SEQ ID NO: 320340 - DNA, 20 bp, Artificial Sequence
  chemically synthesized
aggcctccgcagaagcagag

SEQ ID NO: 320341 - DNA, 20 bp, Artificial Sequence
  chemically synthesized
ctgaggcctccgcagaagca

SEQ ID NO: 320342 - DNA, 20 bp, Artificial Sequence
  chemically synthesized
tggcatctgctctgcttctg

SEQ ID NO: 320343 - DNA, 20 bp, Artificial Sequence
  chemically synthesized
tcctgaggcctccgcagaag

SEQ ID NO: 320344 - DNA, 20 bp, Artificial Sequence
  chemically synthesized
gcatctgctctgcttctgcg

SEQ ID NO: 320345 - DNA, 20 bp, Artificial Sequence
  chemically synthesized
catctgctctgcttctgcgg

SEQ ID NO: 320346 - DNA, 20 bp, Artificial Sequence
  chemically synthesized
atctcctgaggcctccgcag

SEQ ID NO: 320347 - DNA, 20 bp, Artificial Sequence
  chemically synthesized
taaatctcctgaggcctccg

SEQ ID NO: 320348 - DNA, 20 bp, Artificial Sequence
  chemically synthesized
ctctgcttctgcggaggcct

SEQ ID NO: 320349 - DNA, 20 bp, Artificial Sequence
  chemically synthesized
tctgcttctgcggaggcctc

SEQ ID NO: 320350 - DNA, 20 bp, Artificial Sequence
  chemically synthesized
tgcttctgcggaggcctcag

SEQ ID NO: 320351 - DNA, 20 bp, Artificial Sequence
  chemically synthesized
ccatgattgtaaatctcctg

SEQ ID NO: 320352 - DNA, 20 bp, Artificial Sequence
  chemically synthesized
gccatgattgtaaatctcct

SEQ ID NO: 320353 - DNA, 20 bp, Artificial Sequence
  chemically synthesized
cctcaggagatttacaatca

SEQ ID NO: 320354 - DNA, 20 bp, Artificial Sequence
  chemically synthesized
tacaatcatggcaaattgcg

SEQ ID NO: 320355 - DNA, 20 bp, Artificial Sequence
  chemically synthesized
acaatcatggcaaattgcga

SEQ ID NO: 320356 - DNA, 20 bp, Artificial Sequence
  chemically synthesized
aatcatggcaaattgcgaag

SEQ ID NO: 320357 - DNA, 20 bp, Artificial Sequence
  chemically synthesized
atcatggcaaattgcgaagg

SEQ ID NO: 320358 - DNA, 20 bp, Artificial Sequence
  chemically synthesized
catggcaaattgcgaaggag

SEQ ID NO: 320359 - DNA, 20 bp, Artificial Sequence
  chemically synthesized
ggcaaattgcgaaggaggag

SEQ ID NO: 320360 - DNA, 20 bp, Artificial Sequence
  chemically synthesized
ggaggagcagtcatgtcaca

SEQ ID NO: 320361 - DNA, 20 bp, Artificial Sequence
  chemically synthesized
gagcagtcatgtcacacggc

SEQ ID NO: 320362 - DNA, 20 bp, Artificial Sequence
  chemically synthesized
agcagtcatgtcacacggcc

SEQ ID NO: 320363 - DNA, 20 bp, Artificial Sequence
  chemically synthesized
gcagtcatgtcacacggcca

SEQ ID NO: 320364 - DNA, 20 bp, Artificial Sequence
  chemically synthesized
gtcatgtcacacggccaggg

SEQ ID NO: 320365 - DNA, 20 bp, Artificial Sequence
  chemically synthesized
catgtcacacggccagggaa

SEQ ID NO: 320366 - DNA, 20 bp, Artificial Sequence
  chemically synthesized
atgtcacacggccagggaag

SEQ ID NO: 320367 - DNA, 20 bp, Artificial Sequence
  chemically synthesized
cctcccactcacctcttccc

SEQ ID NO: 320368 - DNA, 20 bp, Artificial Sequence
  chemically synthesized
cacacggccagggaagaggt

SEQ ID NO: 320369 - DNA, 20 bp, Artificial Sequence
  chemically synthesized
acggccagggaagaggtgag

SEQ ID NO: 320370 - DNA, 20 bp, Artificial Sequence
  chemically synthesized
cggccagggaagaggtgagt

SEQ ID NO: 320371 - DNA, 20 bp, Artificial Sequence
  chemically synthesized
gccagggaagaggtgagtgg

SEQ ID NO: 320372 - DNA, 20 bp, Artificial Sequence
  chemically synthesized
ccagggaagaggtgagtggg

SEQ ID NO: 320373 - DNA, 20 bp, Artificial Sequence
  chemically synthesized
cagggaagaggtgagtggga

SEQ ID NO: 320374 - DNA, 20 bp, Artificial Sequence
  chemically synthesized
tccagttggttaaaagtgtg

SEQ ID NO: 320375 - DNA, 20 bp, Artificial Sequence
  chemically synthesized
tgtcagatccagttggttaa

SEQ ID NO: 320376 - DNA, 20 bp, Artificial Sequence
  chemically synthesized
accacacacttttaaccaac

SEQ ID NO: 320377 - DNA, 20 bp, Artificial Sequence
  chemically synthesized
gaattcttgtcagatccagt

SEQ ID NO: 320378 - DNA, 20 bp, Artificial Sequence
  chemically synthesized
gggtgaattcttgtcagatc

SEQ ID NO: 320379 - DNA, 20 bp, Artificial Sequence
  chemically synthesized
tttaaccaactggatctgac

SEQ ID NO: 320380 - DNA, 20 bp, Artificial Sequence
  chemically synthesized
gatagtgggtgaattcttgt

SEQ ID NO: 320381 - DNA, 20 bp, Artificial Sequence
  chemically synthesized
agtgctgttttcatgatagt

SEQ ID NO: 320382 - DNA, 20 bp, Artificial Sequence
  chemically synthesized
tagtgctgttttcatgatag

SEQ ID NO: 320383 - DNA, 20 bp, Artificial Sequence
  chemically synthesized
tcttagtgctgttttcatga

SEQ ID NO: 320384 - DNA, 20 bp, Artificial Sequence
  chemically synthesized
ttcacccactatcatgaaaa

SEQ ID NO: 320385 - DNA, 20 bp, Artificial Sequence
  chemically synthesized
actatcatgaaaacagcact

SEQ ID NO: 320386 - DNA, 20 bp, Artificial Sequence
  chemically synthesized
tatcatgaaaacagcactaa

SEQ ID NO: 320387 - DNA, 20 bp, Artificial Sequence
  chemically synthesized
atcatgaaaacagcactaag

SEQ ID NO: 320388 - DNA, 20 bp, Artificial Sequence
  chemically synthesized
tgaaaacagcactaagagga

SEQ ID NO: 320389 - DNA, 20 bp, Artificial Sequence
  chemically synthesized
atggtttagcactatcctct

SEQ ID NO: 320390 - DNA, 20 bp, Artificial Sequence
  chemically synthesized
tgaatttctcatgaatggtt

SEQ ID NO: 320391 - DNA, 20 bp, Artificial Sequence
  chemically synthesized
gatagtgctaaaccattcat

SEQ ID NO: 320392 - DNA, 20 bp, Artificial Sequence
  chemically synthesized
ggcgttgaatttctcatgaa

SEQ ID NO: 320393 - DNA, 20 bp, Artificial Sequence
  chemically synthesized
ggtgggagccgaatgaatca

SEQ ID NO: 320394 - DNA, 20 bp, Artificial Sequence
  chemically synthesized
attcaacgccatgattcatt

SEQ ID NO: 320395 - DNA, 20 bp, Artificial Sequence
  chemically synthesized
tgattcattcggctcccacc

SEQ ID NO: 320396 - DNA, 20 bp, Artificial Sequence
  chemically synthesized
gattcattcggctcccaccc

SEQ ID NO: 320397 - DNA, 20 bp, Artificial Sequence
  chemically synthesized
cagaggtggggcctgggtgg

SEQ ID NO: 320398 - DNA, 20 bp, Artificial Sequence
  chemically synthesized
gtcagaggtggggcctgggt

SEQ ID NO: 320399 - DNA, 20 bp, Artificial Sequence
  chemically synthesized
tgtcagaggtggggcctggg

SEQ ID NO: 320400 - DNA, 20 bp, Artificial Sequence
  chemically synthesized
cactgtcagaggtggggcct

SEQ ID NO: 320401 - DNA, 20 bp, Artificial Sequence
  chemically synthesized
tcactgtcagaggtggggcc

SEQ ID NO: 320402 - DNA, 20 bp, Artificial Sequence
  chemically synthesized
aatcctcactgtcagaggtg

SEQ ID NO: 320403 - DNA, 20 bp, Artificial Sequence
  chemically synthesized
caatcctcactgtcagaggt

SEQ ID NO: 320404 - DNA, 20 bp, Artificial Sequence
  chemically synthesized
cacccaggccccacctctga

SEQ ID NO: 320405 - DNA, 20 bp, Artificial Sequence
  chemically synthesized
acaatcctcactgtcagagg

SEQ ID NO: 320406 - DNA, 20 bp, Artificial Sequence
  chemically synthesized
attacaatcctcactgtcag

SEQ ID NO: 320407 - DNA, 20 bp, Artificial Sequence
  chemically synthesized
caggccccacctctgacagt

SEQ ID NO: 320408 - DNA, 20 bp, Artificial Sequence
  chemically synthesized
aattacaatcctcactgtca

SEQ ID NO: 320409 - DNA, 20 bp, Artificial Sequence
  chemically synthesized
aggccccacctctgacagtg

SEQ ID NO: 320410 - DNA, 20 bp, Artificial Sequence
  chemically synthesized
tgaattacaatcctcactgt

SEQ ID NO: 320411 - DNA, 20 bp, Artificial Sequence
  chemically synthesized
tgaggattgtaattcaatgt

SEQ ID NO: 320412 - DNA, 20 bp, Artificial Sequence
  chemically synthesized
ttgtaattcaatgtgagatc

SEQ ID NO: 320413 - DNA, 20 bp, Artificial Sequence
  chemically synthesized
tgtaattcaatgtgagatct

SEQ ID NO: 320414 - DNA, 20 bp, Artificial Sequence
  chemically synthesized
attcaatgtgagatctgggc

SEQ ID NO: 320415 - DNA, 20 bp, Artificial Sequence
  chemically synthesized
tttggatgtatgttcttgcc

SEQ ID NO: 320416 - DNA, 20 bp, Artificial Sequence
  chemically synthesized
caggatggaatagtatggtt

SEQ ID NO: 320417 - DNA, 20 bp, Artificial Sequence
  chemically synthesized
ggggccaggatggaatagta

SEQ ID NO: 320418 - DNA, 20 bp, Artificial Sequence
  chemically synthesized
tgggaggggccaggatggaa

SEQ ID NO: 320419 - DNA, 20 bp, Artificial Sequence
  chemically synthesized
caaaccatactattccatcc

SEQ ID NO: 320420 - DNA, 20 bp, Artificial Sequence
  chemically synthesized
agatttgggaggggccagga

SEQ ID NO: 320421 - DNA, 20 bp, Artificial Sequence
  chemically synthesized
cttgagatttgggaggggcc

SEQ ID NO: 320422 - DNA, 20 bp, Artificial Sequence
  chemically synthesized
acttgagatttgggaggggc

SEQ ID NO: 320423 - DNA, 20 bp, Artificial Sequence
  chemically synthesized
aaggacttgagatttgggag

SEQ ID NO: 320424 - DNA, 20 bp, Artificial Sequence
  chemically synthesized
gaaggacttgagatttggga

SEQ ID NO: 320425 - DNA, 20 bp, Artificial Sequence
  chemically synthesized
agaaggacttgagatttggg

SEQ ID NO: 320426 - DNA, 20 bp, Artificial Sequence
  chemically synthesized
gagaaggacttgagatttgg

SEQ ID NO: 320427 - DNA, 20 bp, Artificial Sequence
  chemically synthesized
cctggcccctcccaaatctc

SEQ ID NO: 320428 - DNA, 20 bp, Artificial Sequence
  chemically synthesized
gtgagaaggacttgagattt

SEQ ID NO: 320429 - DNA, 20 bp, Artificial Sequence
  chemically synthesized
tgtgagaaggacttgagatt

SEQ ID NO: 320430 - DNA, 20 bp, Artificial Sequence
  chemically synthesized
tttaaatgtgagaaggactt

SEQ ID NO: 320431 - DNA, 20 bp, Artificial Sequence
  chemically synthesized
ttgtatgtttaaatgtgaga

SEQ ID NO: 320432 - DNA, 20 bp, Artificial Sequence
  chemically synthesized
attgtatgtttaaatgtgag

SEQ ID NO: 320433 - DNA, 20 bp, Artificial Sequence
  chemically synthesized
atgattgtatgtttaaatgt

SEQ ID NO: 320434 - DNA, 20 bp, Artificial Sequence
  chemically synthesized
atacaatcatgtcttccaaa

SEQ ID NO: 320435 - DNA, 20 bp, Artificial Sequence
  chemically synthesized
gaccttgggggactgtttgg

SEQ ID NO: 320436 - DNA, 20 bp, Artificial Sequence
  chemically synthesized
aaagaccttgggggactgtt

SEQ ID NO: 320437 - DNA, 20 bp, Artificial Sequence
  chemically synthesized
tgtcttccaaacagtccccc

SEQ ID NO: 320438 - DNA, 20 bp, Artificial Sequence
  chemically synthesized
gtcttccaaacagtccccca

SEQ ID NO: 320439 - DNA, 20 bp, Artificial Sequence
  chemically synthesized
ggaataagtaaagaccttgg

SEQ ID NO: 320440 - DNA, 20 bp, Artificial Sequence
  chemically synthesized
tggaataagtaaagaccttg

SEQ ID NO: 320441 - DNA, 20 bp, Artificial Sequence
  chemically synthesized
ctggaataagtaaagacctt

SEQ ID NO: 320442 - DNA, 20 bp, Artificial Sequence
  chemically synthesized
tctggaataagtaaagacct

SEQ ID NO: 320443 - DNA, 20 bp, Artificial Sequence
  chemically synthesized
agttaattctggaataagta

SEQ ID NO: 320444 - DNA, 20 bp, Artificial Sequence
  chemically synthesized
cccaaggtctttacttattc

SEQ ID NO: 320445 - DNA, 20 bp, Artificial Sequence
  chemically synthesized
ttttgagttaattctggaat

SEQ ID NO: 320446 - DNA, 20 bp, Artificial Sequence
  chemically synthesized
ccggacttttgagttaattc

SEQ ID NO: 320447 - DNA, 20 bp, Artificial Sequence
  chemically synthesized
ttattccagaattaactcaa

SEQ ID NO: 320448 - DNA, 20 bp, Artificial Sequence
  chemically synthesized
ccagaattaactcaaaagtc

SEQ ID NO: 320449 - DNA, 20 bp, Artificial Sequence
  chemically synthesized
agatgagactccggactttt

SEQ ID NO: 320450 - DNA, 20 bp, Artificial Sequence
  chemically synthesized
agaattaactcaaaagtccg

SEQ ID NO: 320451 - DNA, 20 bp, Artificial Sequence
  chemically synthesized
ccttgtctcagatgagactc

SEQ ID NO: 320452 - DNA, 20 bp, Artificial Sequence
  chemically synthesized
aaaagtccggagtctcatct

SEQ ID NO: 320453 - DNA, 20 bp, Artificial Sequence
  chemically synthesized
aaacttaccttgtctcagat

SEQ ID NO: 320454 - DNA, 20 bp, Artificial Sequence
  chemically synthesized
tccggagtctcatctgagac

SEQ ID NO: 320455 - DNA, 20 bp, Artificial Sequence
  chemically synthesized
ccggagtctcatctgagaca

SEQ ID NO: 320456 - DNA, 20 bp, Artificial Sequence
  chemically synthesized
agaagaaacttaccttgtct

SEQ ID NO: 320457 - DNA, 20 bp, Artificial Sequence
  chemically synthesized
agtctcatctgagacaaggt

SEQ ID NO: 320458 - DNA, 20 bp, Artificial Sequence
  chemically synthesized
ttttacgggctcataggtag

SEQ ID NO: 320459 - DNA, 20 bp, Artificial Sequence
  chemically synthesized
ggtaagtttcttctacctat

SEQ ID NO: 320460 - DNA, 20 bp, Artificial Sequence
  chemically synthesized
tgattttacgggctcatagg

SEQ ID NO: 320461 - DNA, 20 bp, Artificial Sequence
  chemically synthesized
ttttgattttacgggctcat

SEQ ID NO: 320462 - DNA, 20 bp, Artificial Sequence
  chemically synthesized
tttttgattttacgggctca

SEQ ID NO: 320463 - DNA, 20 bp, Artificial Sequence
  chemically synthesized
taattggtttttgattttac

SEQ ID NO: 320464 - DNA, 20 bp, Artificial Sequence
  chemically synthesized
ctaattggtttttgatttta

SEQ ID NO: 320465 - DNA, 20 bp, Artificial Sequence
  chemically synthesized
ccgtaaaatcaaaaaccaat

SEQ ID NO: 320466 - DNA, 20 bp, Artificial Sequence
  chemically synthesized
gtatcttggaagtaactaat

SEQ ID NO: 320467 - DNA, 20 bp, Artificial Sequence
  chemically synthesized
aaaaccaattagttacttcc

SEQ ID NO: 320468 - DNA, 20 bp, Artificial Sequence
  chemically synthesized
ataatcccattgtatcttgg

SEQ ID NO: 320469 - DNA, 20 bp, Artificial Sequence
  chemically synthesized
cttataatcccattgtatct

SEQ ID NO: 320470 - DNA, 20 bp, Artificial Sequence
  chemically synthesized
tagttacttccaagatacaa

SEQ ID NO: 320471 - DNA, 20 bp, Artificial Sequence
  chemically synthesized
agttacttccaagatacaat

SEQ ID NO: 320472 - DNA, 20 bp, Artificial Sequence
  chemically synthesized
ccaagatacaatgggattat

SEQ ID NO: 320473 - DNA, 20 bp, Artificial Sequence
  chemically synthesized
acaatgggattataagcatt

SEQ ID NO: 320474 - DNA, 20 bp, Artificial Sequence
  chemically synthesized
atttcacccttttggaatag

SEQ ID NO: 320475 - DNA, 20 bp, Artificial Sequence
  chemically synthesized
agtcaacactcctattccaa

SEQ ID NO: 320476 - DNA, 20 bp, Artificial Sequence
  chemically synthesized
caatttcacccttttggaat

SEQ ID NO: 320477 - DNA, 20 bp, Artificial Sequence
  chemically synthesized
gtcaacactcctattccaaa

SEQ ID NO: 320478 - DNA, 20 bp, Artificial Sequence
  chemically synthesized
ccaatttcacccttttggaa

SEQ ID NO: 320479 - DNA, 20 bp, Artificial Sequence
  chemically synthesized
tcaacactcctattccaaaa

SEQ ID NO: 320480 - DNA, 20 bp, Artificial Sequence
  chemically synthesized
tttgaccaatttcacccttt

SEQ ID NO: 320481 - DNA, 20 bp, Artificial Sequence
  chemically synthesized
ctattccaaaagggtgaaat

SEQ ID NO: 320482 - DNA, 20 bp, Artificial Sequence
  chemically synthesized
aaaagggtgaaattggtcaa

SEQ ID NO: 320483 - DNA, 20 bp, Artificial Sequence
  chemically synthesized
gggtgaaattggtcaaaaga

SEQ ID NO: 320484 - DNA, 20 bp, Artificial Sequence
  chemically synthesized
ggtgaaattggtcaaaagaa

SEQ ID NO: 320485 - DNA, 20 bp, Artificial Sequence
  chemically synthesized
tcaaaagaaaggtctcatgc

SEQ ID NO: 320486 - DNA, 20 bp, Artificial Sequence
  chemically synthesized
gctgggtttcagacttgcat

SEQ ID NO: 320487 - DNA, 20 bp, Artificial Sequence
  chemically synthesized
tctcatgcaagtctgaaacc

SEQ ID NO: 320488 - DNA, 20 bp, Artificial Sequence
  chemically synthesized
atgactaccctgctgggttt

SEQ ID NO: 320489 - DNA, 20 bp, Artificial Sequence
  chemically synthesized
catgcaagtctgaaacccag

SEQ ID NO: 320490 - DNA, 20 bp, Artificial Sequence
  chemically synthesized
atgcaagtctgaaacccagc

SEQ ID NO: 320491 - DNA, 20 bp, Artificial Sequence
  chemically synthesized
tgcaagtctgaaacccagca

SEQ ID NO: 320492 - DNA, 20 bp, Artificial Sequence
  chemically synthesized
aagtctgaaacccagcaggg

SEQ ID NO: 320493 - DNA, 20 bp, Artificial Sequence
  chemically synthesized
gatttaatgactaccctgct

SEQ ID NO: 320494 - DNA, 20 bp, Artificial Sequence
  chemically synthesized
agatttaatgactaccctgc

SEQ ID NO: 320495 - DNA, 20 bp, Artificial Sequence
  chemically synthesized
gcagataattttggagtttt

SEQ ID NO: 320496 - DNA, 20 bp, Artificial Sequence
  chemically synthesized
agtcaaagcagataattttg

SEQ ID NO: 320497 - DNA, 20 bp, Artificial Sequence
  chemically synthesized
ggagtcaaagcagataattt

SEQ ID NO: 320498 - DNA, 20 bp, Artificial Sequence
  chemically synthesized
tgtaggacatggagtcaaag

SEQ ID NO: 320499 - DNA, 20 bp, Artificial Sequence
  chemically synthesized
ggatgtaggacatggagtca

SEQ ID NO: 320500 - DNA, 20 bp, Artificial Sequence
  chemically synthesized
taccctggatgtaggacatg

SEQ ID NO: 320501 - DNA, 20 bp, Artificial Sequence
  chemically synthesized
tttaccctggatgtaggaca

SEQ ID NO: 320502 - DNA, 20 bp, Artificial Sequence
  chemically synthesized
ttgactccatgtcctacatc

SEQ ID NO: 320503 - DNA, 20 bp, Artificial Sequence
  chemically synthesized
tgactccatgtcctacatcc

SEQ ID NO: 320504 - DNA, 20 bp, Artificial Sequence
  chemically synthesized
gactccatgtcctacatcca

SEQ ID NO: 320505 - DNA, 20 bp, Artificial Sequence
  chemically synthesized
caccagtttaccctggatgt

SEQ ID NO: 320506 - DNA, 20 bp, Artificial Sequence
  chemically synthesized
ccaccagtttaccctggatg

SEQ ID NO: 320507 - DNA, 20 bp, Artificial Sequence
  chemically synthesized
ccactcccaccagtttaccc

SEQ ID NO: 320508 - DNA, 20 bp, Artificial Sequence
  chemically synthesized
gtcctacatccagggtaaac

SEQ ID NO: 320509 - DNA, 20 bp, Artificial Sequence
  chemically synthesized
ctacatccagggtaaactgg

SEQ ID NO: 320510 - DNA, 20 bp, Artificial Sequence
  chemically synthesized
tacatccagggtaaactggt

SEQ ID NO: 320511 - DNA, 20 bp, Artificial Sequence
  chemically synthesized
catccagggtaaactggtgg

SEQ ID NO: 320512 - DNA, 20 bp, Artificial Sequence
  chemically synthesized
ccagggtaaactggtgggag

SEQ ID NO: 320513 - DNA, 20 bp, Artificial Sequence
  chemically synthesized
tgggagcacaccactcccac

SEQ ID NO: 320514 - DNA, 20 bp, Artificial Sequence
  chemically synthesized
ggtgggagtggtgtgctccc

SEQ ID NO: 320515 - DNA, 20 bp, Artificial Sequence
  chemically synthesized
gtgggagtggtgtgctccca

SEQ ID NO: 320516 - DNA, 20 bp, Artificial Sequence
  chemically synthesized
gagtctgcccaaggccttgg

SEQ ID NO: 320517 - DNA, 20 bp, Artificial Sequence
  chemically synthesized
gtggtgtgctcccaaggcct

SEQ ID NO: 320518 - DNA, 20 bp, Artificial Sequence
  chemically synthesized
tggagtctgcccaaggcctt

SEQ ID NO: 320519 - DNA, 20 bp, Artificial Sequence
  chemically synthesized
tggtgtgctcccaaggcctt

SEQ ID NO: 320520 - DNA, 20 bp, Artificial Sequence
  chemically synthesized
ttggagtctgcccaaggcct

SEQ ID NO: 320521 - DNA, 20 bp, Artificial Sequence
  chemically synthesized
tgtgctcccaaggccttggg

SEQ ID NO: 320522 - DNA, 20 bp, Artificial Sequence
  chemically synthesized
acaaagttggagtctgccca

SEQ ID NO: 320523 - DNA, 20 bp, Artificial Sequence
  chemically synthesized
cacaaagttggagtctgccc

SEQ ID NO: 320524 - DNA, 20 bp, Artificial Sequence
  chemically synthesized
cctagaaagccacaaagttg

SEQ ID NO: 320525 - DNA, 20 bp, Artificial Sequence
  chemically synthesized
ttgggcagactccaactttg

SEQ ID NO: 320526 - DNA, 20 bp, Artificial Sequence
  chemically synthesized
accctagaaagccacaaagt

SEQ ID NO: 320527 - DNA, 20 bp, Artificial Sequence
  chemically synthesized
ctgaaccctagaaagccaca

SEQ ID NO: 320528 - DNA, 20 bp, Artificial Sequence
  chemically synthesized
actccaactttgtggctttc

SEQ ID NO: 320529 - DNA, 20 bp, Artificial Sequence
  chemically synthesized
ctccaactttgtggctttct

SEQ ID NO: 320530 - DNA, 20 bp, Artificial Sequence
  chemically synthesized
tccaactttgtggctttcta

SEQ ID NO: 320531 - DNA, 20 bp, Artificial Sequence
  chemically synthesized
tttggaagctgaaccctaga

SEQ ID NO: 320532 - DNA, 20 bp, Artificial Sequence
  chemically synthesized
ctttgtggctttctagggtt

SEQ ID NO: 320533 - DNA, 20 bp, Artificial Sequence
  chemically synthesized
cagctttggaagctgaaccc

SEQ ID NO: 320534 - DNA, 20 bp, Artificial Sequence
  chemically synthesized
tttctagggttcagcttcca

SEQ ID NO: 320535 - DNA, 20 bp, Artificial Sequence
  chemically synthesized
gaccataagagcagctttgg

SEQ ID NO: 320536 - DNA, 20 bp, Artificial Sequence
  chemically synthesized
ccagaccataagagcagctt

SEQ ID NO: 320537 - DNA, 20 bp, Artificial Sequence
  chemically synthesized
agcttccaaagctgctctta

SEQ ID NO: 320538 - DNA, 20 bp, Artificial Sequence
  chemically synthesized
tcagcaccagaccataagag

SEQ ID NO: 320539 - DNA, 20 bp, Artificial Sequence
  chemically synthesized
cactcagcaccagaccataa

SEQ ID NO: 320540 - DNA, 20 bp, Artificial Sequence
  chemically synthesized
ccaaagctgctcttatggtc

SEQ ID NO: 320541 - DNA, 20 bp, Artificial Sequence
  chemically synthesized
cacactcagcaccagaccat

SEQ ID NO: 320542 - DNA, 20 bp, Artificial Sequence
  chemically synthesized
tgctcttatggtctggtgct

SEQ ID NO: 320543 - DNA, 20 bp, Artificial Sequence
  chemically synthesized
atgaaacacacactcagcac

SEQ ID NO: 320544 - DNA, 20 bp, Artificial Sequence
  chemically synthesized
ctggaaatgaaacacacact

SEQ ID NO: 320545 - DNA, 20 bp, Artificial Sequence
  chemically synthesized
ctgagtgtgtgtttcatttc

SEQ ID NO: 320546 - DNA, 20 bp, Artificial Sequence
  chemically synthesized
tgtgtttcatttccagatac

SEQ ID NO: 320547 - DNA, 20 bp, Artificial Sequence
  chemically synthesized
gtgtttcatttccagataca

SEQ ID NO: 320548 - DNA, 20 bp, Artificial Sequence
  chemically synthesized
tgtttcatttccagatacaa

SEQ ID NO: 320549 - DNA, 20 bp, Artificial Sequence
  chemically synthesized
gacagcttgacccttgtatc

SEQ ID NO: 320550 - DNA, 20 bp, Artificial Sequence
  chemically synthesized
catttccagatacaagggtc

SEQ ID NO: 320551 - DNA, 20 bp, Artificial Sequence
  chemically synthesized
agatacaagggtcaagctgt

SEQ ID NO: 320552 - DNA, 20 bp, Artificial Sequence
  chemically synthesized
tacaagggtcaagctgtcag

SEQ ID NO: 320553 - DNA, 20 bp, Artificial Sequence
  chemically synthesized
cagaatggtagatccactga

SEQ ID NO: 320554 - DNA, 20 bp, Artificial Sequence
  chemically synthesized
tgtcagtggatctaccattc

SEQ ID NO: 320555 - DNA, 20 bp, Artificial Sequence
  chemically synthesized
tcctccagactccagaatgg

SEQ ID NO: 320556 - DNA, 20 bp, Artificial Sequence
  chemically synthesized
tcagtggatctaccattctg

SEQ ID NO: 320557 - DNA, 20 bp, Artificial Sequence
  chemically synthesized
ctgtcctccagactccagaa

SEQ ID NO: 320558 - DNA, 20 bp, Artificial Sequence
  chemically synthesized
ggatctaccattctggagtc

SEQ ID NO: 320559 - DNA, 20 bp, Artificial Sequence
  chemically synthesized
atctaccattctggagtctg

SEQ ID NO: 320560 - DNA, 20 bp, Artificial Sequence
  chemically synthesized
ggccactgtcctccagactc

SEQ ID NO: 320561 - DNA, 20 bp, Artificial Sequence
  chemically synthesized
tctaccattctggagtctgg

SEQ ID NO: 320562 - DNA, 20 bp, Artificial Sequence
  chemically synthesized
ccattctggagtctggagga

SEQ ID NO: 320563 - DNA, 20 bp, Artificial Sequence
  chemically synthesized
agaagagggccactgtcctc

SEQ ID NO: 320564 - DNA, 20 bp, Artificial Sequence
  chemically synthesized
ttctggagtctggaggacag

SEQ ID NO: 320565 - DNA, 20 bp, Artificial Sequence
  chemically synthesized
ctagtggacctgtaagaaga

SEQ ID NO: 320566 - DNA, 20 bp, Artificial Sequence
  chemically synthesized
ggacagtggccctcttctta

SEQ ID NO: 320567 - DNA, 20 bp, Artificial Sequence
  chemically synthesized
cctagtggacctgtaagaag

SEQ ID NO: 320568 - DNA, 20 bp, Artificial Sequence
  chemically synthesized
gacagtggccctcttcttac

SEQ ID NO: 320569 - DNA, 20 bp, Artificial Sequence
  chemically synthesized
gcctagtggacctgtaagaa

SEQ ID NO: 320570 - DNA, 20 bp, Artificial Sequence
  chemically synthesized
ttgcctagtggacctgtaag

SEQ ID NO: 320571 - DNA, 20 bp, Artificial Sequence
  chemically synthesized
gcattgcctagtggacctgt

SEQ ID NO: 320572 - DNA, 20 bp, Artificial Sequence
  chemically synthesized
ccctcttcttacaggtccac

SEQ ID NO: 320573 - DNA, 20 bp, Artificial Sequence
  chemically synthesized
cctcttcttacaggtccact

SEQ ID NO: 320574 - DNA, 20 bp, Artificial Sequence
  chemically synthesized
cccactggggcattgcctag

SEQ ID NO: 320575 - DNA, 20 bp, Artificial Sequence
  chemically synthesized
gtccccactggggcattgcc

SEQ ID NO: 320576 - DNA, 20 bp, Artificial Sequence
  chemically synthesized
aggtccactaggcaatgccc

SEQ ID NO: 320577 - DNA, 20 bp, Artificial Sequence
  chemically synthesized
tccactaggcaatgccccag

SEQ ID NO: 320578 - DNA, 20 bp, Artificial Sequence
  chemically synthesized
ccactaggcaatgccccagt

SEQ ID NO: 320579 - DNA, 20 bp, Artificial Sequence
  chemically synthesized
cactaggcaatgccccagtg

SEQ ID NO: 320580 - DNA, 20 bp, Artificial Sequence
  chemically synthesized
cccacacgtagtccccactg

SEQ ID NO: 320581 - DNA, 20 bp, Artificial Sequence
  chemically synthesized
ccccacacgtagtccccact

SEQ ID NO: 320582 - DNA, 20 bp, Artificial Sequence
  chemically synthesized
cccccacacgtagtccccac

SEQ ID NO: 320583 - DNA, 20 bp, Artificial Sequence
  chemically synthesized
gccccagtggggactacgtg

SEQ ID NO: 320584 - DNA, 20 bp, Artificial Sequence
  chemically synthesized
ccccagtggggactacgtgt

SEQ ID NO: 320585 - DNA, 20 bp, Artificial Sequence
  chemically synthesized
cccagtggggactacgtgtg

SEQ ID NO: 320586 - DNA, 20 bp, Artificial Sequence
  chemically synthesized
ccagtggggactacgtgtgg

SEQ ID NO: 320587 - DNA, 20 bp, Artificial Sequence
  chemically synthesized
gggctttgatcccccacacg

SEQ ID NO: 320588 - DNA, 20 bp, Artificial Sequence
  chemically synthesized
ggactacgtgtgggggatca

SEQ ID NO: 320589 - DNA, 20 bp, Artificial Sequence
  chemically synthesized
gcaatgcagagggaaaatgt

SEQ ID NO: 320590 - DNA, 20 bp, Artificial Sequence
  chemically synthesized
ggcaatgcagagggaaaatg

SEQ ID NO: 320591 - DNA, 20 bp, Artificial Sequence
  chemically synthesized
ttctcctggggcaatgcaga

SEQ ID NO: 320592 - DNA, 20 bp, Artificial Sequence
  chemically synthesized
cttctcctggggcaatgcag

SEQ ID NO: 320593 - DNA, 20 bp, Artificial Sequence
  chemically synthesized
acttctcctggggcaatgca

SEQ ID NO: 320594 - DNA, 20 bp, Artificial Sequence
  chemically synthesized
gaacttctcctggggcaatg

SEQ ID NO: 320595 - DNA, 20 bp, Artificial Sequence
  chemically synthesized
attttccctctgcattgccc

SEQ ID NO: 320596 - DNA, 20 bp, Artificial Sequence
  chemically synthesized
ttttccctctgcattgcccc

SEQ ID NO: 320597 - DNA, 20 bp, Artificial Sequence
  chemically synthesized
ttccctctgcattgccccag

SEQ ID NO: 320598 - DNA, 20 bp, Artificial Sequence
  chemically synthesized
cctctgcattgccccaggag

SEQ ID NO: 320599 - DNA, 20 bp, Artificial Sequence
  chemically synthesized
ctcacagagaacttctcctg

SEQ ID NO: 320600 - DNA, 20 bp, Artificial Sequence
  chemically synthesized
cctcacagagaacttctcct

SEQ ID NO: 320601 - DNA, 20 bp, Artificial Sequence
  chemically synthesized
ccctcacagagaacttctcc

SEQ ID NO: 320602 - DNA, 20 bp, Artificial Sequence
  chemically synthesized
ccccaggagaagttctctgt

SEQ ID NO: 320603 - DNA, 20 bp, Artificial Sequence
  chemically synthesized
cccaggagaagttctctgtg

SEQ ID NO: 320604 - DNA, 20 bp, Artificial Sequence
  chemically synthesized
ccaggagaagttctctgtga

SEQ ID NO: 320605 - DNA, 20 bp, Artificial Sequence
  chemically synthesized
ccaggggcagaaccctcaca

SEQ ID NO: 320606 - DNA, 20 bp, Artificial Sequence
  chemically synthesized
ctccaggggcagaaccctca

SEQ ID NO: 320607 - DNA, 20 bp, Artificial Sequence
  chemically synthesized
ctctgtgagggttctgcccc

SEQ ID NO: 320608 - DNA, 20 bp, Artificial Sequence
  chemically synthesized
ctgtgagggttctgcccctg

SEQ ID NO: 320609 - DNA, 20 bp, Artificial Sequence
  chemically synthesized
gcagaagcctgctccagggg

SEQ ID NO: 320610 - DNA, 20 bp, Artificial Sequence
  chemically synthesized
tgagggttctgcccctggag

SEQ ID NO: 320611 - DNA, 20 bp, Artificial Sequence
  chemically synthesized
gagggttctgcccctggagc

SEQ ID NO: 320612 - DNA, 20 bp, Artificial Sequence
  chemically synthesized
caggcagaagcctgctccag

SEQ ID NO: 320613 - DNA, 20 bp, Artificial Sequence
  chemically synthesized
ccaggcagaagcctgctcca

SEQ ID NO: 320614 - DNA, 20 bp, Artificial Sequence
  chemically synthesized
tccaggcagaagcctgctcc

SEQ ID NO: 320615 - DNA, 20 bp, Artificial Sequence
  chemically synthesized
ttccaggcagaagcctgctc

SEQ ID NO: 320616 - DNA, 20 bp, Artificial Sequence
  chemically synthesized
ccctggagcaggcttctgcc

SEQ ID NO: 320617 - DNA, 20 bp, Artificial Sequence
  chemically synthesized
aagcctgggtttccaggcag

SEQ ID NO: 320618 - DNA, 20 bp, Artificial Sequence
  chemically synthesized
gaaaagcctgggtttccagg

SEQ ID NO: 320619 - DNA, 20 bp, Artificial Sequence
  chemically synthesized
caggcttctgcctggaaacc

SEQ ID NO: 320620 - DNA, 20 bp, Artificial Sequence
  chemically synthesized
atggaaaagcctgggtttcc

SEQ ID NO: 320621 - DNA, 20 bp, Artificial Sequence
  chemically synthesized
aggcttctgcctggaaaccc

SEQ ID NO: 320622 - DNA, 20 bp, Artificial Sequence
  chemically synthesized
tatggaaaagcctgggtttc

SEQ ID NO: 320623 - DNA, 20 bp, Artificial Sequence
  chemically synthesized
gaggttgtatggaaaagcct

SEQ ID NO: 320624 - DNA, 20 bp, Artificial Sequence
  chemically synthesized
agaggttgtatggaaaagcc

SEQ ID NO: 320625 - DNA, 20 bp, Artificial Sequence
  chemically synthesized
attttagaggttgtatggaa

SEQ ID NO: 320626 - DNA, 20 bp, Artificial Sequence
  chemically synthesized
tctagattttagaggttgta

SEQ ID NO: 320627 - DNA, 20 bp, Artificial Sequence
  chemically synthesized
aacatccatctagattttag

SEQ ID NO: 320628 - DNA, 20 bp, Artificial Sequence
  chemically synthesized
tccatacaacctctaaaatc

SEQ ID NO: 320629 - DNA, 20 bp, Artificial Sequence
  chemically synthesized
gaacatccatctagatttta

SEQ ID NO: 320630 - DNA, 20 bp, Artificial Sequence
  chemically synthesized
gggaacatccatctagattt

SEQ ID NO: 320631 - DNA, 20 bp, Artificial Sequence
  chemically synthesized
tacaacctctaaaatctaga

SEQ ID NO: 320632 - DNA, 20 bp, Artificial Sequence
  chemically synthesized
gaggcttgggaacatccatc

SEQ ID NO: 320633 - DNA, 20 bp, Artificial Sequence
  chemically synthesized
aaatctagatggatgttccc

SEQ ID NO: 320634 - DNA, 20 bp, Artificial Sequence
  chemically synthesized
gagtgcaagagttgaggctt

SEQ ID NO: 320635 - DNA, 20 bp, Artificial Sequence
  chemically synthesized
agagtgcaagagttgaggct

SEQ ID NO: 320636 - DNA, 20 bp, Artificial Sequence
  chemically synthesized
tgcacagagtgcaagagttg

SEQ ID NO: 320637 - DNA, 20 bp, Artificial Sequence
  chemically synthesized
gtgcacagagtgcaagagtt

SEQ ID NO: 320638 - DNA, 20 bp, Artificial Sequence
  chemically synthesized
tgcaggtgcacagagtgcaa

SEQ ID NO: 320639 - DNA, 20 bp, Artificial Sequence
  chemically synthesized
cctgcaggtgcacagagtgc

SEQ ID NO: 320640 - DNA, 20 bp, Artificial Sequence
  chemically synthesized
cataagcctgcaggtgcaca

SEQ ID NO: 320641 - DNA, 20 bp, Artificial Sequence
  chemically synthesized
gccataagcctgcaggtgca

SEQ ID NO: 320642 - DNA, 20 bp, Artificial Sequence
  chemically synthesized
tcttgcactctgtgcacctg

SEQ ID NO: 320643 - DNA, 20 bp, Artificial Sequence
  chemically synthesized
cttgcactctgtgcacctgc

SEQ ID NO: 320644 - DNA, 20 bp, Artificial Sequence
  chemically synthesized
ggtacaagccataagcctgc

SEQ ID NO: 320645 - DNA, 20 bp, Artificial Sequence
  chemically synthesized
gggtacaagccataagcctg

SEQ ID NO: 320646 - DNA, 20 bp, Artificial Sequence
  chemically synthesized
tctgtgcacctgcaggctta

SEQ ID NO: 320647 - DNA, 20 bp, Artificial Sequence
  chemically synthesized
ctccagcgggtacaagccat

SEQ ID NO: 320648 - DNA, 20 bp, Artificial Sequence
  chemically synthesized
gccacagctccagcgggtac

SEQ ID NO: 320649 - DNA, 20 bp, Artificial Sequence
  chemically synthesized
ggcttatggcttgtacccgc

SEQ ID NO: 320650 - DNA, 20 bp, Artificial Sequence
  chemically synthesized
cttatggcttgtacccgctg

SEQ ID NO: 320651 - DNA, 20 bp, Artificial Sequence
  chemically synthesized
gcttgggccacagctccagc

SEQ ID NO: 320652 - DNA, 20 bp, Artificial Sequence
  chemically synthesized
agcttgggccacagctccag

SEQ ID NO: 320653 - DNA, 20 bp, Artificial Sequence
  chemically synthesized
gcttgtacccgctggagctg

SEQ ID NO: 320654 - DNA, 20 bp, Artificial Sequence
  chemically synthesized
tacagcttgggccacagctc

SEQ ID NO: 320655 - DNA, 20 bp, Artificial Sequence
  chemically synthesized
acccgctggagctgtggccc

SEQ ID NO: 320656 - DNA, 20 bp, Artificial Sequence
  chemically synthesized
cccaagtacagcttgggcca

SEQ ID NO: 320657 - DNA, 20 bp, Artificial Sequence
  chemically synthesized
gagtggcccaagtacagctt

SEQ ID NO: 320658 - DNA, 20 bp, Artificial Sequence
  chemically synthesized
agagtggcccaagtacagct

SEQ ID NO: 320659 - DNA, 20 bp, Artificial Sequence
  chemically synthesized
gctgtggcccaagctgtact

SEQ ID NO: 320660 - DNA, 20 bp, Artificial Sequence
  chemically synthesized
ctgtggcccaagctgtactt

SEQ ID NO: 320661 - DNA, 20 bp, Artificial Sequence
  chemically synthesized
ggctcagagtggcccaagta

SEQ ID NO: 320662 - DNA, 20 bp, Artificial Sequence
  chemically synthesized
gctgtggctcagagtggccc

SEQ ID NO: 320663 - DNA, 20 bp, Artificial Sequence
  chemically synthesized
agctgtacttgggccactct

SEQ ID NO: 320664 - DNA, 20 bp, Artificial Sequence
  chemically synthesized
gctccagctgtggctcagag

SEQ ID NO: 320665 - DNA, 20 bp, Artificial Sequence
  chemically synthesized
acttgggccactctgagcca

SEQ ID NO: 320666 - DNA, 20 bp, Artificial Sequence
  chemically synthesized
gtagctccagctgtggctca

SEQ ID NO: 320667 - DNA, 20 bp, Artificial Sequence
  chemically synthesized
ctgtagctccagctgtggct

SEQ ID NO: 320668 - DNA, 20 bp, Artificial Sequence
  chemically synthesized
gggccactctgagccacagc

SEQ ID NO: 320669 - DNA, 20 bp, Artificial Sequence
  chemically synthesized
gccactctgagccacagctg

SEQ ID NO: 320670 - DNA, 20 bp, Artificial Sequence
  chemically synthesized
ggccactgtagctccagctg

SEQ ID NO: 320671 - DNA, 20 bp, Artificial Sequence
  chemically synthesized
ctgagccacagctggagcta

SEQ ID NO: 320672 - DNA, 20 bp, Artificial Sequence
  chemically synthesized
cgtcctggccactgtagctc

SEQ ID NO: 320673 - DNA, 20 bp, Artificial Sequence
  chemically synthesized
agccacagctggagctacag

SEQ ID NO: 320674 - DNA, 20 bp, Artificial Sequence
  chemically synthesized
acagctggagctacagtggc

SEQ ID NO: 320675 - DNA, 20 bp, Artificial Sequence
  chemically synthesized
acccagcgtcctggccactg

SEQ ID NO: 320676 - DNA, 20 bp, Artificial Sequence
  chemically synthesized
cagctggagctacagtggcc

SEQ ID NO: 320677 - DNA, 20 bp, Artificial Sequence
  chemically synthesized
agctacagtggccaggacgc

SEQ ID NO: 320678 - DNA, 20 bp, Artificial Sequence
  chemically synthesized
gctacagtggccaggacgct

SEQ ID NO: 320679 - DNA, 20 bp, Artificial Sequence
  chemically synthesized
cccccccgcacccagcgtcc

SEQ ID NO: 320680 - DNA, 20 bp, Artificial Sequence
  chemically synthesized
agtggccaggacgctgggtg

SEQ ID NO: 320681 - DNA, 20 bp, Artificial Sequence
  chemically synthesized
gtggccaggacgctgggtgc

SEQ ID NO: 320682 - DNA, 20 bp, Artificial Sequence
  chemically synthesized
tggccaggacgctgggtgcg

SEQ ID NO: 320683 - DNA, 20 bp, Artificial Sequence
  chemically synthesized
ggccaggacgctgggtgcgg

SEQ ID NO: 320684 - DNA, 20 bp, Artificial Sequence
  chemically synthesized
caacccctcccccccgcacc

SEQ ID NO: 320685 - DNA, 20 bp, Artificial Sequence
  chemically synthesized
gccaggacgctgggtgcggg

SEQ ID NO: 320686 - DNA, 20 bp, Artificial Sequence
  chemically synthesized
ccaggacgctgggtgcgggg

SEQ ID NO: 320687 - DNA, 20 bp, Artificial Sequence
  chemically synthesized
aggacgctgggtgcgggggg

SEQ ID NO: 320688 - DNA, 20 bp, Artificial Sequence
  chemically synthesized
ggacgctgggtgcggggggg

SEQ ID NO: 320689 - DNA, 20 bp, Artificial Sequence
  chemically synthesized
gacgctgggtgcggggggga

SEQ ID NO: 320690 - DNA, 20 bp, Artificial Sequence
  chemically synthesized
acgctgggtgcgggggggag

SEQ ID NO: 320691 - DNA, 20 bp, Artificial Sequence
  chemically synthesized
tgggtgcgggggggaggggt

SEQ ID NO: 320692 - DNA, 20 bp, Artificial Sequence
  chemically synthesized
gggtgcgggggggaggggtt

SEQ ID NO: 320693 - DNA, 20 bp, Artificial Sequence
  chemically synthesized
ggtgcgggggggaggggttg

SEQ ID NO: 320694 - DNA, 20 bp, Artificial Sequence
  chemically synthesized
gcgggggggaggggttgggg

SEQ ID NO: 320695 - DNA, 20 bp, Artificial Sequence
  chemically synthesized
cgggggggaggggttggggc

SEQ ID NO: 320696 - DNA, 20 bp, Artificial Sequence
  chemically synthesized
gggggggaggggttggggcg

SEQ ID NO: 320697 - DNA, 20 bp, Artificial Sequence
  chemically synthesized
ggggggaggggttggggcgg

SEQ ID NO: 320698 - DNA, 20 bp, Artificial Sequence
  chemically synthesized
gaggggttggggcgggggca

SEQ ID NO: 320699 - DNA, 20 bp, Artificial Sequence
  chemically synthesized
ggggcgggggcacagtgtac

SEQ ID NO: 320700 - DNA, 20 bp, Artificial Sequence
  chemically synthesized
gggcgggggcacagtgtacg

SEQ ID NO: 320701 - DNA, 20 bp, Artificial Sequence
  chemically synthesized
gcacagtgtacgaggttgaa

SEQ ID NO: 320702 - DNA, 20 bp, Artificial Sequence
  chemically synthesized
cacagtgtacgaggttgaac

SEQ ID NO: 320703 - DNA, 20 bp, Artificial Sequence
  chemically synthesized
acagtgtacgaggttgaaca

SEQ ID NO: 320704 - DNA, 20 bp, Artificial Sequence
  chemically synthesized
gtgtacgaggttgaacaggg

SEQ ID NO: 320705 - DNA, 20 bp, Artificial Sequence
  chemically synthesized
acgaggttgaacagggcagc

SEQ ID NO: 320706 - DNA, 20 bp, Artificial Sequence
  chemically synthesized
cgaggttgaacagggcagct

SEQ ID NO: 320707 - DNA, 20 bp, Artificial Sequence
  chemically synthesized
gaacagggcagctgggaccc

SEQ ID NO: 320708 - DNA, 20 bp, Artificial Sequence
  chemically synthesized
aacagggcagctgggaccct

SEQ ID NO: 320709 - DNA, 20 bp, Artificial Sequence
  chemically synthesized
ctgggccaggcccagggtcc

SEQ ID NO: 320710 - DNA, 20 bp, Artificial Sequence
  chemically synthesized
ggcagctgggaccctgggcc

SEQ ID NO: 320711 - DNA, 20 bp, Artificial Sequence
  chemically synthesized
ggtttcctgggccaggccca

SEQ ID NO: 320712 - DNA, 20 bp, Artificial Sequence
  chemically synthesized
tggtttcctgggccaggccc

SEQ ID NO: 320713 - DNA, 20 bp, Artificial Sequence
  chemically synthesized
atggtttcctgggccaggcc

SEQ ID NO: 320714 - DNA, 20 bp, Artificial Sequence
  chemically synthesized
ctgggaccctgggcctggcc

SEQ ID NO: 320715 - DNA, 20 bp, Artificial Sequence
  chemically synthesized
tgggaccctgggcctggccc

SEQ ID NO: 320716 - DNA, 20 bp, Artificial Sequence
  chemically synthesized
acagaatggtttcctgggcc

SEQ ID NO: 320717 - DNA, 20 bp, Artificial Sequence
  chemically synthesized
gacagaatggtttcctgggc

SEQ ID NO: 320718 - DNA, 20 bp, Artificial Sequence
  chemically synthesized
agaggacagaatggtttcct

SEQ ID NO: 320719 - DNA, 20 bp, Artificial Sequence
  chemically synthesized
aagaggacagaatggtttcc

SEQ ID NO: 320720 - DNA, 20 bp, Artificial Sequence
  chemically synthesized
ggaggcctaagaggacagaa

SEQ ID NO: 320721 - DNA, 20 bp, Artificial Sequence
  chemically synthesized
aggaaaccattctgtcctct

SEQ ID NO: 320722 - DNA, 20 bp, Artificial Sequence
  chemically synthesized
ggaaaccattctgtcctctt

SEQ ID NO: 320723 - DNA, 20 bp, Artificial Sequence
  chemically synthesized
gatccggaggcctaagagga

SEQ ID NO: 320724 - DNA, 20 bp, Artificial Sequence
  chemically synthesized
tatagatccggaggcctaag

SEQ ID NO: 320725 - DNA, 20 bp, Artificial Sequence
  chemically synthesized
ttatagatccggaggcctaa

SEQ ID NO: 320726 - DNA, 20 bp, Artificial Sequence
  chemically synthesized
attctgtcctcttaggcctc

SEQ ID NO: 320727 - DNA, 20 bp, Artificial Sequence
  chemically synthesized
cattatagatccggaggcct

SEQ ID NO: 320728 - DNA, 20 bp, Artificial Sequence
  chemically synthesized
ccctcccattatagatccgg

SEQ ID NO: 320729 - DNA, 20 bp, Artificial Sequence
  chemically synthesized
cccctcccattatagatccg

SEQ ID NO: 320730 - DNA, 20 bp, Artificial Sequence
  chemically synthesized
agcccctcccattatagatc

SEQ ID NO: 320731 - DNA, 20 bp, Artificial Sequence
  chemically synthesized
ttaggcctccggatctataa

SEQ ID NO: 320732 - DNA, 20 bp, Artificial Sequence
  chemically synthesized
taggcctccggatctataat

SEQ ID NO: 320733 - DNA, 20 bp, Artificial Sequence
  chemically synthesized
ggcctccggatctataatgg

SEQ ID NO: 320734 - DNA, 20 bp, Artificial Sequence
  chemically synthesized
gcctccggatctataatggg

SEQ ID NO: 320735 - DNA, 20 bp, Artificial Sequence
  chemically synthesized
aaaggcagcccctcccatta

SEQ ID NO: 320736 - DNA, 20 bp, Artificial Sequence
  chemically synthesized
cctccggatctataatggga

SEQ ID NO: 320737 - DNA, 20 bp, Artificial Sequence
  chemically synthesized
ctccggatctataatgggag

SEQ ID NO: 320738 - DNA, 20 bp, Artificial Sequence
  chemically synthesized
taatgggaggggctgccttt

SEQ ID NO: 320739 - DNA, 20 bp, Artificial Sequence
  chemically synthesized
catttcagagatctaaaagg

SEQ ID NO: 320740 - DNA, 20 bp, Artificial Sequence
  chemically synthesized
aggcatttcagagatctaaa

SEQ ID NO: 320741 - DNA, 20 bp, Artificial Sequence
  chemically synthesized
aaggcatttcagagatctaa

SEQ ID NO: 320742 - DNA, 20 bp, Artificial Sequence
  chemically synthesized
aaggcctggaaggcatttca

SEQ ID NO: 320743 - DNA, 20 bp, Artificial Sequence
  chemically synthesized
aaaaggcctggaaggcattt

SEQ ID NO: 320744 - DNA, 20 bp, Artificial Sequence
  chemically synthesized
tagatctctgaaatgccttc

SEQ ID NO: 320745 - DNA, 20 bp, Artificial Sequence
  chemically synthesized
agatctctgaaatgccttcc

SEQ ID NO: 320746 - DNA, 20 bp, Artificial Sequence
  chemically synthesized
aatggggaaaaaggcctgga

SEQ ID NO: 320747 - DNA, 20 bp, Artificial Sequence
  chemically synthesized
caatggggaaaaaggcctgg

SEQ ID NO: 320748 - DNA, 20 bp, Artificial Sequence
  chemically synthesized
agacaatggggaaaaaggcc

SEQ ID NO: 320749 - DNA, 20 bp, Artificial Sequence
  chemically synthesized
agccaagacaatggggaaaa

SEQ ID NO: 320750 - DNA, 20 bp, Artificial Sequence
  chemically synthesized
tagccaagacaatggggaaa

SEQ ID NO: 320751 - DNA, 20 bp, Artificial Sequence
  chemically synthesized
tgctgatagccaagacaatg

SEQ ID NO: 320752 - DNA, 20 bp, Artificial Sequence
  chemically synthesized
ggcctttttccccattgtct

SEQ ID NO: 320753 - DNA, 20 bp, Artificial Sequence
  chemically synthesized
gtgctgatagccaagacaat

SEQ ID NO: 320754 - DNA, 20 bp, Artificial Sequence
  chemically synthesized
agtgctgatagccaagacaa

SEQ ID NO: 320755 - DNA, 20 bp, Artificial Sequence
  chemically synthesized
ttccccattgtcttggctat

SEQ ID NO: 320756 - DNA, 20 bp, Artificial Sequence
  chemically synthesized
gaaggcaagtgctgatagcc

SEQ ID NO: 320757 - DNA, 20 bp, Artificial Sequence
  chemically synthesized
acaaagaaggcaagtgctga

SEQ ID NO: 320758 - DNA, 20 bp, Artificial Sequence
  chemically synthesized
tgtatacctacaaagaaggc

SEQ ID NO: 320759 - DNA, 20 bp, Artificial Sequence
  chemically synthesized
atcagcacttgccttctttg

SEQ ID NO: 320760 - DNA, 20 bp, Artificial Sequence
  chemically synthesized
tcagcacttgccttctttgt

SEQ ID NO: 320761 - DNA, 20 bp, Artificial Sequence
  chemically synthesized
aatttgtatacctacaaaga

SEQ ID NO: 320762 - DNA, 20 bp, Artificial Sequence
  chemically synthesized
aaatttgtatacctacaaag

SEQ ID NO: 320763 - DNA, 20 bp, Artificial Sequence
  chemically synthesized
gaaaaatttgtatacctaca

SEQ ID NO: 320764 - DNA, 20 bp, Artificial Sequence
  chemically synthesized
tgtaggtatacaaatttttc

SEQ ID NO: 320765 - DNA, 20 bp, Artificial Sequence
  chemically synthesized
ggtatacaaatttttctagc

SEQ ID NO: 320766 - DNA, 20 bp, Artificial Sequence
  chemically synthesized
atacaaatttttctagcaag

SEQ ID NO: 320767 - DNA, 20 bp, Artificial Sequence
  chemically synthesized
gcttctgagcaaccacttgc

SEQ ID NO: 320768 - DNA, 20 bp, Artificial Sequence
  chemically synthesized
ttttctagcaagtggttgct

SEQ ID NO: 320769 - DNA, 20 bp, Artificial Sequence
  chemically synthesized
tctagcaagtggttgctcag

SEQ ID NO: 320770 - DNA, 20 bp, Artificial Sequence
  chemically synthesized
gagaactcaagaaggcttct

SEQ ID NO: 320771 - DNA, 20 bp, Artificial Sequence
  chemically synthesized
ggttgctcagaagccttctt

SEQ ID NO: 320772 - DNA, 20 bp, Artificial Sequence
  chemically synthesized
attttcaggagaactcaaga

SEQ ID NO: 320773 - DNA, 20 bp, Artificial Sequence
  chemically synthesized
cattttcaggagaactcaag

SEQ ID NO: 320774 - DNA, 20 bp, Artificial Sequence
  chemically synthesized
gcccattttcaggagaactc

SEQ ID NO: 320775 - DNA, 20 bp, Artificial Sequence
  chemically synthesized
ttcttgagttctcctgaaaa

SEQ ID NO: 320776 - DNA, 20 bp, Artificial Sequence
  chemically synthesized
aaataaaagcccattttcag

SEQ ID NO: 320777 - DNA, 20 bp, Artificial Sequence
  chemically synthesized
tcttgagttctcctgaaaat

SEQ ID NO: 320778 - DNA, 20 bp, Artificial Sequence
  chemically synthesized
gaaaataaaagcccattttc

SEQ ID NO: 320779 - DNA, 20 bp, Artificial Sequence
  chemically synthesized
agaaaataaaagcccatttt

SEQ ID NO: 320780 - DNA, 20 bp, Artificial Sequence
  chemically synthesized
ggatatgtggtagaaaataa

SEQ ID NO: 320781 - DNA, 20 bp, Artificial Sequence
  chemically synthesized
tttgcaacatggatatgtgg

SEQ ID NO: 320782 - DNA, 20 bp, Artificial Sequence
  chemically synthesized
aaatttgcaacatggatatg

SEQ ID NO: 320783 - DNA, 20 bp, Artificial Sequence
  chemically synthesized
ggttttcaaaatttgcaaca

SEQ ID NO: 320784 - DNA, 20 bp, Artificial Sequence
  chemically synthesized
gcaaattttgaaaaccttta

SEQ ID NO: 320785 - DNA, 20 bp, Artificial Sequence
  chemically synthesized
aaaaggaaagcagaccataa

SEQ ID NO: 320786 - DNA, 20 bp, Artificial Sequence
  chemically synthesized
taaaaggaaagcagaccata

SEQ ID NO: 320787 - DNA, 20 bp, Artificial Sequence
  chemically synthesized
atgtatatttaaaaggaaag

SEQ ID NO: 320788 - DNA, 20 bp, Artificial Sequence
  chemically synthesized
tacatgtatatttaaaagga

SEQ ID NO: 320789 - DNA, 20 bp, Artificial Sequence
  chemically synthesized
tttatacatgtatatttaaa

SEQ ID NO: 320790 - DNA, 20 bp, Artificial Sequence
  chemically synthesized
atttatacatgtatatttaa

SEQ ID NO: 320791 - DNA, 20 bp, Artificial Sequence
  chemically synthesized
gatacatgtgcagaacgtgc

SEQ ID NO: 320792 - DNA, 20 bp, Artificial Sequence
  chemically synthesized
agatacatgtgcagaacgtg

SEQ ID NO: 320793 - DNA, 20 bp, Artificial Sequence
  chemically synthesized
taagttctgagatacatgtg

SEQ ID NO: 320794 - DNA, 20 bp, Artificial Sequence
  chemically synthesized
cacgttctgcacatgtatct

SEQ ID NO: 320795 - DNA, 20 bp, Artificial Sequence
  chemically synthesized
tttattgtactttaagttct

SEQ ID NO: 320796 - DNA, 20 bp, Artificial Sequence
  chemically synthesized
cacatgtatctcagaactta

SEQ ID NO: 320797 - DNA, 20 bp, Artificial Sequence
  chemically synthesized
attttattttattgtacttt

SEQ ID NO: 320798 - DNA, 20 bp, Artificial Sequence
  chemically synthesized
gcaggagcaaagaaataaga

SEQ ID NO: 320799 - DNA, 20 bp, Artificial Sequence
  chemically synthesized
tgatgcaggagcaaagaaat

SEQ ID NO: 320800 - DNA, 20 bp, Artificial Sequence
  chemically synthesized
tactctctgatgcaggagca

SEQ ID NO: 320801 - DNA, 20 bp, Artificial Sequence
  chemically synthesized
ttatttctttgctcctgcat

SEQ ID NO: 320802 - DNA, 20 bp, Artificial Sequence
  chemically synthesized
caacctactctctgatgcag

SEQ ID NO: 320803 - DNA, 20 bp, Artificial Sequence
  chemically synthesized
atttctttgctcctgcatca

SEQ ID NO: 320804 - DNA, 20 bp, Artificial Sequence
  chemically synthesized
aacaacctactctctgatgc

SEQ ID NO: 320805 - DNA, 20 bp, Artificial Sequence
  chemically synthesized
ttctttgctcctgcatcaga

SEQ ID NO: 320806 - DNA, 20 bp, Artificial Sequence
  chemically synthesized
taacaacctactctctgatg

SEQ ID NO: 320807 - DNA, 20 bp, Artificial Sequence
  chemically synthesized
tttgctcctgcatcagagag

SEQ ID NO: 320808 - DNA, 20 bp, Artificial Sequence
  chemically synthesized
ttgctcctgcatcagagagt

SEQ ID NO: 320809 - DNA, 20 bp, Artificial Sequence
  chemically synthesized
tgcatcagagagtaggttgt

SEQ ID NO: 320810 - DNA, 20 bp, Artificial Sequence
  chemically synthesized
atcagagagtaggttgttag

SEQ ID NO: 320811 - DNA, 20 bp, Artificial Sequence
  chemically synthesized
agagagtaggttgttagaag

SEQ ID NO: 320812 - DNA, 20 bp, Artificial Sequence
  chemically synthesized
aaaatgttcaagacgttgtg

SEQ ID NO: 320813 - DNA, 20 bp, Artificial Sequence
  chemically synthesized
ttctaagcagcaaaatgttc

SEQ ID NO: 320814 - DNA, 20 bp, Artificial Sequence
  chemically synthesized
gtcttgaacattttgctgct

SEQ ID NO: 320815 - DNA, 20 bp, Artificial Sequence
  chemically synthesized
tgacggaatgaatttctaag

SEQ ID NO: 320816 - DNA, 20 bp, Artificial Sequence
  chemically synthesized
gtctgacggaatgaatttct

SEQ ID NO: 320817 - DNA, 20 bp, Artificial Sequence
  chemically synthesized
tgcttagaaattcattccgt

SEQ ID NO: 320818 - DNA, 20 bp, Artificial Sequence
  chemically synthesized
tgatgatctcgtgtgtctga

SEQ ID NO: 320819 - DNA, 20 bp, Artificial Sequence
  chemically synthesized
attcattccgtcagacacac

SEQ ID NO: 320820 - DNA, 20 bp, Artificial Sequence
  chemically synthesized
cacacgagatcatcactctc

SEQ ID NO: 320821 - DNA, 20 bp, Artificial Sequence
  chemically synthesized
ctgtgaaagtttgaacttga

SEQ ID NO: 320822 - DNA, 20 bp, Artificial Sequence
  chemically synthesized
atctgtgaaagtttgaactt

SEQ ID NO: 320823 - DNA, 20 bp, Artificial Sequence
  chemically synthesized
ctctcaagttcaaactttca

SEQ ID NO: 320824 - DNA, 20 bp, Artificial Sequence
  chemically synthesized
catgctctagatatctgtga

SEQ ID NO: 320825 - DNA, 20 bp, Artificial Sequence
  chemically synthesized
ttcaaactttcacagatatc

SEQ ID NO: 320826 - DNA, 20 bp, Artificial Sequence
  chemically synthesized
caaactttcacagatatcta

SEQ ID NO: 320827 - DNA, 20 bp, Artificial Sequence
  chemically synthesized
tttcacagatatctagagca

SEQ ID NO: 320828 - DNA, 20 bp, Artificial Sequence
  chemically synthesized
gctgtattatgtccatgctc

SEQ ID NO: 320829 - DNA, 20 bp, Artificial Sequence
  chemically synthesized
tctagagcatggacataata

SEQ ID NO: 320830 - DNA, 20 bp, Artificial Sequence
  chemically synthesized
ttatcccttagcaaagaagt

SEQ ID NO: 320831 - DNA, 20 bp, Artificial Sequence
  chemically synthesized
atacagccaacttctttgct

SEQ ID NO: 320832 - DNA, 20 bp, Artificial Sequence
  chemically synthesized
tttgttatcccttagcaaag

SEQ ID NO: 320833 - DNA, 20 bp, Artificial Sequence
  chemically synthesized
tacagccaacttctttgcta

SEQ ID NO: 320834 - DNA, 20 bp, Artificial Sequence
  chemically synthesized
acagccaacttctttgctaa

SEQ ID NO: 320835 - DNA, 20 bp, Artificial Sequence
  chemically synthesized
atgtttgttatcccttagca

SEQ ID NO: 320836 - DNA, 20 bp, Artificial Sequence
  chemically synthesized
atgacatgtttgttatccct

SEQ ID NO: 320837 - DNA, 20 bp, Artificial Sequence
  chemically synthesized
aacaaacatgtcatttactc

SEQ ID NO: 320838 - DNA, 20 bp, Artificial Sequence
  chemically synthesized
aatgaacttattggcaactg

SEQ ID NO: 320839 - DNA, 20 bp, Artificial Sequence
  chemically synthesized
agaatgaacttattggcaac

SEQ ID NO: 320840 - DNA, 20 bp, Artificial Sequence
  chemically synthesized
catttactccagttgccaat

SEQ ID NO: 320841 - DNA, 20 bp, Artificial Sequence
  chemically synthesized
gatggaaagaatgaacttat

SEQ ID NO: 320842 - DNA, 20 bp, Artificial Sequence
  chemically synthesized
taagttcattctttccatct

SEQ ID NO: 320843 - DNA, 20 bp, Artificial Sequence
  chemically synthesized
ctgtcgaggtctcagatgga

SEQ ID NO: 320844 - DNA, 20 bp, Artificial Sequence
  chemically synthesized
caagctgtcgaggtctcaga

SEQ ID NO: 320845 - DNA, 20 bp, Artificial Sequence
  chemically synthesized
agtccaagctgtcgaggtct

SEQ ID NO: 320846 - DNA, 20 bp, Artificial Sequence
  chemically synthesized
ctttccatctgagacctcga

SEQ ID NO: 320847 - DNA, 20 bp, Artificial Sequence
  chemically synthesized
cagtgaagtccaagctgtcg

SEQ ID NO: 320848 - DNA, 20 bp, Artificial Sequence
  chemically synthesized
catctgagacctcgacagct

SEQ ID NO: 320849 - DNA, 20 bp, Artificial Sequence
  chemically synthesized
acagtgaagtccaagctgtc

SEQ ID NO: 320850 - DNA, 20 bp, Artificial Sequence
  chemically synthesized
tgatatgcacagtgaagtcc

SEQ ID NO: 320851 - DNA, 20 bp, Artificial Sequence
  chemically synthesized
tgatactgatatgcacagtg

SEQ ID NO: 320852 - DNA, 20 bp, Artificial Sequence
  chemically synthesized
ttggacttcactgtgcatat

SEQ ID NO: 320853 - DNA, 20 bp, Artificial Sequence
  chemically synthesized
agtgctgatactgatatgca

SEQ ID NO: 320854 - DNA, 20 bp, Artificial Sequence
  chemically synthesized
ttcactgtgcatatcagtat

SEQ ID NO: 320855 - DNA, 20 bp, Artificial Sequence
  chemically synthesized
gcatatcagtatcagcactt

SEQ ID NO: 320856 - DNA, 20 bp, Artificial Sequence
  chemically synthesized
tggttaaatgattgttacca

SEQ ID NO: 320857 - DNA, 20 bp, Artificial Sequence
  chemically synthesized
tttggtaacaatcatttaac

SEQ ID NO: 320858 - DNA, 20 bp, Artificial Sequence
  chemically synthesized
caatcatttaaccagtctct

SEQ ID NO: 320859 - DNA, 20 bp, Artificial Sequence
  chemically synthesized
atttggaatgtcttagagac

SEQ ID NO: 320860 - DNA, 20 bp, Artificial Sequence
  chemically synthesized
ggaaaatttggaatgtctta

SEQ ID NO: 320861 - DNA, 20 bp, Artificial Sequence
  chemically synthesized
agggaaaatttggaatgtct

SEQ ID NO: 320862 - DNA, 20 bp, Artificial Sequence
  chemically synthesized
aagacagatgagggaaaatt

SEQ ID NO: 320863 - DNA, 20 bp, Artificial Sequence
  chemically synthesized
gctcagaagaagacagatga

SEQ ID NO: 320864 - DNA, 20 bp, Artificial Sequence
  chemically synthesized
ggctcagaagaagacagatg

SEQ ID NO: 320865 - DNA, 20 bp, Artificial Sequence
  chemically synthesized
gggctcagaagaagacagat

SEQ ID NO: 320866 - DNA, 20 bp, Artificial Sequence
  chemically synthesized
ttggagggctcagaagaaga

SEQ ID NO: 320867 - DNA, 20 bp, Artificial Sequence
  chemically synthesized
tccctcatctgtcttcttct

SEQ ID NO: 320868 - DNA, 20 bp, Artificial Sequence
  chemically synthesized
gagtttggagggctcagaag

SEQ ID NO: 320869 - DNA, 20 bp, Artificial Sequence
  chemically synthesized
gatgagtttggagggctcag

SEQ ID NO: 320870 - DNA, 20 bp, Artificial Sequence
  chemically synthesized
ttggatgagtttggagggct

SEQ ID NO: 320871 - DNA, 20 bp, Artificial Sequence
  chemically synthesized
agaagttggatgagtttgga

SEQ ID NO: 320872 - DNA, 20 bp, Artificial Sequence
  chemically synthesized
cagaagttggatgagtttgg

SEQ ID NO: 320873 - DNA, 20 bp, Artificial Sequence
  chemically synthesized
acagaagttggatgagtttg

SEQ ID NO: 320874 - DNA, 20 bp, Artificial Sequence
  chemically synthesized
agacagaagttggatgagtt

SEQ ID NO: 320875 - DNA, 20 bp, Artificial Sequence
  chemically synthesized
gtaacagacagaagttggat

SEQ ID NO: 320876 - DNA, 20 bp, Artificial Sequence
  chemically synthesized
attgggtaacagacagaagt

SEQ ID NO: 320877 - DNA, 20 bp, Artificial Sequence
  chemically synthesized
tgaaattgggtaacagacag

SEQ ID NO: 320878 - DNA, 20 bp, Artificial Sequence
  chemically synthesized
ctttgaaattgggtaacaga

SEQ ID NO: 320879 - DNA, 20 bp, Artificial Sequence
  chemically synthesized
gctgctttgaaattgggtaa

SEQ ID NO: 320880 - DNA, 20 bp, Artificial Sequence
  chemically synthesized
ctgtctgttacccaatttca

SEQ ID NO: 320881 - DNA, 20 bp, Artificial Sequence
  chemically synthesized
gtagaagctgctttgaaatt

SEQ ID NO: 320882 - DNA, 20 bp, Artificial Sequence
  chemically synthesized
tgtagaagctgctttgaaat

SEQ ID NO: 320883 - DNA, 20 bp, Artificial Sequence
  chemically synthesized
tctgttacccaatttcaaag

SEQ ID NO: 320884 - DNA, 20 bp, Artificial Sequence
  chemically synthesized
caagatacttgaaaatgtag

SEQ ID NO: 320885 - DNA, 20 bp, Artificial Sequence
  chemically synthesized
aaagcagcttctacattttc

SEQ ID NO: 320886 - DNA, 20 bp, Artificial Sequence
  chemically synthesized
tgtcaagatacttgaaaatg

SEQ ID NO: 320887 - DNA, 20 bp, Artificial Sequence
  chemically synthesized
tacattttcaagtatcttga

SEQ ID NO: 320888 - DNA, 20 bp, Artificial Sequence
  chemically synthesized
tttcaagtatcttgacagca

SEQ ID NO: 320889 - DNA, 20 bp, Artificial Sequence
  chemically synthesized
agaagtggggctttgctgtc

SEQ ID NO: 320890 - DNA, 20 bp, Artificial Sequence
  chemically synthesized
gacagcaaagccccacttct

SEQ ID NO: 320891 - DNA, 20 bp, Artificial Sequence
  chemically synthesized
aaaattgttaccaagaagtg

SEQ ID NO: 320892 - DNA, 20 bp, Artificial Sequence
  chemically synthesized
gaaaattgttaccaagaagt

SEQ ID NO: 320893 - DNA, 20 bp, Artificial Sequence
  chemically synthesized
agaaaattgttaccaagaag

SEQ ID NO: 320894 - DNA, 20 bp, Artificial Sequence
  chemically synthesized
tacagaaaattgttaccaag

SEQ ID NO: 320895 - DNA, 20 bp, Artificial Sequence
  chemically synthesized
tagtacagaaaattgttacc

SEQ ID NO: 320896 - DNA, 20 bp, Artificial Sequence
  chemically synthesized
ttggtaacaattttctgtac

SEQ ID NO: 320897 - DNA, 20 bp, Artificial Sequence
  chemically synthesized
tggtaacaattttctgtact

SEQ ID NO: 320898 - DNA, 20 bp, Artificial Sequence
  chemically synthesized
aatgcgagagtggcctagta

SEQ ID NO: 320899 - DNA, 20 bp, Artificial Sequence
  chemically synthesized
atagcaatgcgagagtggcc

SEQ ID NO: 320900 - DNA, 20 bp, Artificial Sequence
  chemically synthesized
tcttgatagcaatgcgagag

SEQ ID NO: 320901 - DNA, 20 bp, Artificial Sequence
  chemically synthesized
atttcttgatagcaatgcga

SEQ ID NO: 320902 - DNA, 20 bp, Artificial Sequence
  chemically synthesized
gtatttcttgatagcaatgc

SEQ ID NO: 320903 - DNA, 20 bp, Artificial Sequence
  chemically synthesized
gccactctcgcattgctatc

SEQ ID NO: 320904 - DNA, 20 bp, Artificial Sequence
  chemically synthesized
cagtctcaggtatttcttga

SEQ ID NO: 320905 - DNA, 20 bp, Artificial Sequence
  chemically synthesized
attgctatcaagaaatacct

SEQ ID NO: 320906 - DNA, 20 bp, Artificial Sequence
  chemically synthesized
atcaagaaatacctgagact

SEQ ID NO: 320907 - DNA, 20 bp, Artificial Sequence
  chemically synthesized
tttataaattactcagtctc

SEQ ID NO: 320908 - DNA, 20 bp, Artificial Sequence
  chemically synthesized
ctttataaattactcagtct

SEQ ID NO: 320909 - DNA, 20 bp, Artificial Sequence
  chemically synthesized
tcttttctttataaattact

SEQ ID NO: 320910 - DNA, 20 bp, Artificial Sequence
  chemically synthesized
ctgagactgagtaatttata

SEQ ID NO: 320911 - DNA, 20 bp, Artificial Sequence
  chemically synthesized
actgagtaatttataaagaa

SEQ ID NO: 320912 - DNA, 20 bp, Artificial Sequence
  chemically synthesized
ataaagaaaagacgcttaat

SEQ ID NO: 320913 - DNA, 20 bp, Artificial Sequence
  chemically synthesized
tgtagaactgtgagccaatt

SEQ ID NO: 320914 - DNA, 20 bp, Artificial Sequence
  chemically synthesized
aaagacgcttaattggctca

SEQ ID NO: 320915 - DNA, 20 bp, Artificial Sequence
  chemically synthesized
tgtacagcctgtagaactgt

SEQ ID NO: 320916 - DNA, 20 bp, Artificial Sequence
  chemically synthesized
ttaattggctcacagttcta

SEQ ID NO: 320917 - DNA, 20 bp, Artificial Sequence
  chemically synthesized
taattggctcacagttctac

SEQ ID NO: 320918 - DNA, 20 bp, Artificial Sequence
  chemically synthesized
catatttcctgtacagcctg

SEQ ID NO: 320919 - DNA, 20 bp, Artificial Sequence
  chemically synthesized
tcacagttctacaggctgta

SEQ ID NO: 320920 - DNA, 20 bp, Artificial Sequence
  chemically synthesized
cacagttctacaggctgtac

SEQ ID NO: 320921 - DNA, 20 bp, Artificial Sequence
  chemically synthesized
ccagcatcatatttcctgta

SEQ ID NO: 320922 - DNA, 20 bp, Artificial Sequence
  chemically synthesized
ctgtacaggaaatatgatgc

SEQ ID NO: 320923 - DNA, 20 bp, Artificial Sequence
  chemically synthesized
cccagcagctgagcagatgc

SEQ ID NO: 320924 - DNA, 20 bp, Artificial Sequence
  chemically synthesized
atatgatgctggcatctgct

SEQ ID NO: 320925 - DNA, 20 bp, Artificial Sequence
  chemically synthesized
aggcctccccagcagctgag

SEQ ID NO: 320926 - DNA, 20 bp, Artificial Sequence
  chemically synthesized
gctggcatctgctcagctgc

SEQ ID NO: 320927 - DNA, 20 bp, Artificial Sequence
  chemically synthesized
ctggcatctgctcagctgct

SEQ ID NO: 320928 - DNA, 20 bp, Artificial Sequence
  chemically synthesized
ctgaggcctccccagcagct

SEQ ID NO: 320929 - DNA, 20 bp, Artificial Sequence
  chemically synthesized
tggcatctgctcagctgctg

SEQ ID NO: 320930 - DNA, 20 bp, Artificial Sequence
  chemically synthesized
gcatctgctcagctgctggg

SEQ ID NO: 320931 - DNA, 20 bp, Artificial Sequence
  chemically synthesized
catctgctcagctgctgggg

SEQ ID NO: 320932 - DNA, 20 bp, Artificial Sequence
  chemically synthesized
gtttcctgaggcctccccag

SEQ ID NO: 320933 - DNA, 20 bp, Artificial Sequence
  chemically synthesized
taagtttcctgaggcctccc

SEQ ID NO: 320934 - DNA, 20 bp, Artificial Sequence
  chemically synthesized
ctcagctgctggggaggcct

SEQ ID NO: 320935 - DNA, 20 bp, Artificial Sequence
  chemically synthesized
tcagctgctggggaggcctc

SEQ ID NO: 320936 - DNA, 20 bp, Artificial Sequence
  chemically synthesized
ccataattgtaagtttcctg

SEQ ID NO: 320937 - DNA, 20 bp, Artificial Sequence
  chemically synthesized
gccataattgtaagtttcct

SEQ ID NO: 320938 - DNA, 20 bp, Artificial Sequence
  chemically synthesized
cctcaggaaacttacaatta

SEQ ID NO: 320939 - DNA, 20 bp, Artificial Sequence
  chemically synthesized
tcaccttctgccataattgt

SEQ ID NO: 320940 - DNA, 20 bp, Artificial Sequence
  chemically synthesized
caggaaacttacaattatgg

SEQ ID NO: 320941 - DNA, 20 bp, Artificial Sequence
  chemically synthesized
gaaacttacaattatggcag

SEQ ID NO: 320942 - DNA, 20 bp, Artificial Sequence
  chemically synthesized
aaacttacaattatggcaga

SEQ ID NO: 320943 - DNA, 20 bp, Artificial Sequence
  chemically synthesized
tacaattatggcagaaggtg

SEQ ID NO: 320944 - DNA, 20 bp, Artificial Sequence
  chemically synthesized
acaattatggcagaaggtga

SEQ ID NO: 320945 - DNA, 20 bp, Artificial Sequence
  chemically synthesized
aattatggcagaaggtgaag

SEQ ID NO: 320946 - DNA, 20 bp, Artificial Sequence
  chemically synthesized
attatggcagaaggtgaagg

SEQ ID NO: 320947 - DNA, 20 bp, Artificial Sequence
  chemically synthesized
ggcagaaggtgaaggaggaa

SEQ ID NO: 320948 - DNA, 20 bp, Artificial Sequence
  chemically synthesized
gcagaaggtgaaggaggaac

SEQ ID NO: 320949 - DNA, 20 bp, Artificial Sequence
  chemically synthesized
ggaggaacaggtacatcaca

SEQ ID NO: 320950 - DNA, 20 bp, Artificial Sequence
  chemically synthesized
acaggtacatcacatggcca

SEQ ID NO: 320951 - DNA, 20 bp, Artificial Sequence
  chemically synthesized
ggtacatcacatggccacag

SEQ ID NO: 320952 - DNA, 20 bp, Artificial Sequence
  chemically synthesized
gtacatcacatggccacagc

SEQ ID NO: 320953 - DNA, 20 bp, Artificial Sequence
  chemically synthesized
acatcacatggccacagcag

SEQ ID NO: 320954 - DNA, 20 bp, Artificial Sequence
  chemically synthesized
tctcactcttgctcctgctg

SEQ ID NO: 320955 - DNA, 20 bp, Artificial Sequence
  chemically synthesized
cacatggccacagcaggagc

SEQ ID NO: 320956 - DNA, 20 bp, Artificial Sequence
  chemically synthesized
catggccacagcaggagcaa

SEQ ID NO: 320957 - DNA, 20 bp, Artificial Sequence
  chemically synthesized
gccacagcaggagcaagagt

SEQ ID NO: 320958 - DNA, 20 bp, Artificial Sequence
  chemically synthesized
cacagcaggagcaagagtga

SEQ ID NO: 320959 - DNA, 20 bp, Artificial Sequence
  chemically synthesized
acagcaggagcaagagtgag

SEQ ID NO: 320960 - DNA, 20 bp, Artificial Sequence
  chemically synthesized
cagcaggagcaagagtgaga

SEQ ID NO: 320961 - DNA, 20 bp, Artificial Sequence
  chemically synthesized
gcaggagcaagagtgagagg

SEQ ID NO: 320962 - DNA, 20 bp, Artificial Sequence
  chemically synthesized
caggagcaagagtgagaggg

SEQ ID NO: 320963 - DNA, 20 bp, Artificial Sequence
  chemically synthesized
aggagcaagagtgagaggga

SEQ ID NO: 320964 - DNA, 20 bp, Artificial Sequence
  chemically synthesized
gatctggttgtttaaaagcg

SEQ ID NO: 320965 - DNA, 20 bp, Artificial Sequence
  chemically synthesized
tgcaagatctggttgtttaa

SEQ ID NO: 320966 - DNA, 20 bp, Artificial Sequence
  chemically synthesized
gtgccacgcttttaaacaac

SEQ ID NO: 320967 - DNA, 20 bp, Artificial Sequence
  chemically synthesized
gagtaaattcttgcaagatc

SEQ ID NO: 320968 - DNA, 20 bp, Artificial Sequence
  chemically synthesized
tttaaacaaccagatcttgc

SEQ ID NO: 320969 - DNA, 20 bp, Artificial Sequence
  chemically synthesized
aatagtgagtaaattcttgc

SEQ ID NO: 320970 - DNA, 20 bp, Artificial Sequence
  chemically synthesized
gctactgtccttgcaatagt

SEQ ID NO: 320971 - DNA, 20 bp, Artificial Sequence
  chemically synthesized
aagaatttactcactattgc

SEQ ID NO: 320972 - DNA, 20 bp, Artificial Sequence
  chemically synthesized
agaatttactcactattgca

SEQ ID NO: 320973 - DNA, 20 bp, Artificial Sequence
  chemically synthesized
ggttgctactgtccttgcaa

SEQ ID NO: 320974 - DNA, 20 bp, Artificial Sequence
  chemically synthesized
tttactcactattgcaagga

SEQ ID NO: 320975 - DNA, 20 bp, Artificial Sequence
  chemically synthesized
actcactattgcaaggacag

SEQ ID NO: 320976 - DNA, 20 bp, Artificial Sequence
  chemically synthesized
gggggcaaatttttcataat

SEQ ID NO: 320977 - DNA, 20 bp, Artificial Sequence
  chemically synthesized
gggagctcattggatcatgg

SEQ ID NO: 320978 - DNA, 20 bp, Artificial Sequence
  chemically synthesized
tgggagctcattggatcatg

SEQ ID NO: 320979 - DNA, 20 bp, Artificial Sequence
  chemically synthesized
gtgggagctcattggatcat

SEQ ID NO: 320980 - DNA, 20 bp, Artificial Sequence
  chemically synthesized
agtgggagctcattggatca

SEQ ID NO: 320981 - DNA, 20 bp, Artificial Sequence
  chemically synthesized
atttgcccccatgatccaat

SEQ ID NO: 320982 - DNA, 20 bp, Artificial Sequence
  chemically synthesized
agggcctagtgggagctcat

SEQ ID NO: 320983 - DNA, 20 bp, Artificial Sequence
  chemically synthesized
atgatccaatgagctcccac

SEQ ID NO: 320984 - DNA, 20 bp, Artificial Sequence
  chemically synthesized
tgatccaatgagctcccact

SEQ ID NO: 320985 - DNA, 20 bp, Artificial Sequence
  chemically synthesized
tttgaggtagggcctagtgg

SEQ ID NO: 320986 - DNA, 20 bp, Artificial Sequence
  chemically synthesized
tgtttgaggtagggcctagt

SEQ ID NO: 320987 - DNA, 20 bp, Artificial Sequence
  chemically synthesized
gtgtttgaggtagggcctag

SEQ ID NO: 320988 - DNA, 20 bp, Artificial Sequence
  chemically synthesized
gcagtgtttgaggtagggcc

SEQ ID NO: 320989 - DNA, 20 bp, Artificial Sequence
  chemically synthesized
aatctgcagtgtttgaggta

SEQ ID NO: 320990 - DNA, 20 bp, Artificial Sequence
  chemically synthesized
taatctgcagtgtttgaggt

SEQ ID NO: 320991 - DNA, 20 bp, Artificial Sequence
  chemically synthesized
gtaatctgcagtgtttgagg

SEQ ID NO: 320992 - DNA, 20 bp, Artificial Sequence
  chemically synthesized
gtagtaatctgcagtgtttg

SEQ ID NO: 320993 - DNA, 20 bp, Artificial Sequence
  chemically synthesized
tgtagtaatctgcagtgttt

SEQ ID NO: 320994 - DNA, 20 bp, Artificial Sequence
  chemically synthesized
aggccctacctcaaacactg

SEQ ID NO: 320995 - DNA, 20 bp, Artificial Sequence
  chemically synthesized
cgttgaattgtagtaatctg

SEQ ID NO: 320996 - DNA, 20 bp, Artificial Sequence
  chemically synthesized
tcaaatctcacgttgaattg

SEQ ID NO: 320997 - DNA, 20 bp, Artificial Sequence
  chemically synthesized
agattactacaattcaacgt

SEQ ID NO: 320998 - DNA, 20 bp, Artificial Sequence
  chemically synthesized
tacaattcaacgtgagattt

SEQ ID NO: 320999 - DNA, 20 bp, Artificial Sequence
  chemically synthesized
aattcaacgtgagatttgag

SEQ ID NO: 321000 - DNA, 20 bp, Artificial Sequence
  chemically synthesized
attcaacgtgagatttgagc

SEQ ID NO: 321001 - DNA, 20 bp, Artificial Sequence
  chemically synthesized
gttcttgagttgatatagtt

SEQ ID NO: 321002 - DNA, 20 bp, Artificial Sequence
  chemically synthesized
cttaggttcttgagttgata

SEQ ID NO: 321003 - DNA, 20 bp, Artificial Sequence
  chemically synthesized
tgtccaaactatatcaactc

SEQ ID NO: 321004 - DNA, 20 bp, Artificial Sequence
  chemically synthesized
ggtagatttcttaggttctt

SEQ ID NO: 321005 - DNA, 20 bp, Artificial Sequence
  chemically synthesized
ctatatcaactcaagaacct

SEQ ID NO: 321006 - DNA, 20 bp, Artificial Sequence
  chemically synthesized
gagcaccaggtagatttctt

SEQ ID NO: 321007 - DNA, 20 bp, Artificial Sequence
  chemically synthesized
agagcaccaggtagatttct

SEQ ID NO: 321008 - DNA, 20 bp, Artificial Sequence
  chemically synthesized
aagaacctaagaaatctacc

SEQ ID NO: 321009 - DNA, 20 bp, Artificial Sequence
  chemically synthesized
cagtagaatagagcaccagg

SEQ ID NO: 321010 - DNA, 20 bp, Artificial Sequence
  chemically synthesized
ccacagtagaatagagcacc

SEQ ID NO: 321011 - DNA, 20 bp, Artificial Sequence
  chemically synthesized
gccacagtagaatagagcac

SEQ ID NO: 321012 - DNA, 20 bp, Artificial Sequence
  chemically synthesized
agcttagccacagtagaata

SEQ ID NO: 321013 - DNA, 20 bp, Artificial Sequence
  chemically synthesized
ccagcttagccacagtagaa

SEQ ID NO: 321014 - DNA, 20 bp, Artificial Sequence
  chemically synthesized
cctggtgctctattctactg

SEQ ID NO: 321015 - DNA, 20 bp, Artificial Sequence
  chemically synthesized
gggtgccagcttagccacag

SEQ ID NO: 321016 - DNA, 20 bp, Artificial Sequence
  chemically synthesized
tgctctattctactgtggct

SEQ ID NO: 321017 - DNA, 20 bp, Artificial Sequence
  chemically synthesized
gtggggtgccagcttagcca

SEQ ID NO: 321018 - DNA, 20 bp, Artificial Sequence
  chemically synthesized
ctattctactgtggctaagc

SEQ ID NO: 321019 - DNA, 20 bp, Artificial Sequence
  chemically synthesized
ttttgggtggggtgccagct

SEQ ID NO: 321020 - DNA, 20 bp, Artificial Sequence
  chemically synthesized
ttatcttttgggtggggtgc

SEQ ID NO: 321021 - DNA, 20 bp, Artificial Sequence
  chemically synthesized
taagctggcaccccacccaa

SEQ ID NO: 321022 - DNA, 20 bp, Artificial Sequence
  chemically synthesized
aggactttatcttttgggtg

SEQ ID NO: 321023 - DNA, 20 bp, Artificial Sequence
  chemically synthesized
aaggactttatcttttgggt

SEQ ID NO: 321024 - DNA, 20 bp, Artificial Sequence
  chemically synthesized
gaaggactttatcttttggg

SEQ ID NO: 321025 - DNA, 20 bp, Artificial Sequence
  chemically synthesized
agggaaggactttatctttt

SEQ ID NO: 321026 - DNA, 20 bp, Artificial Sequence
  chemically synthesized
ggcaccccacccaaaagata

SEQ ID NO: 321027 - DNA, 20 bp, Artificial Sequence
  chemically synthesized
gagggaaggactttatcttt

SEQ ID NO: 321028 - DNA, 20 bp, Artificial Sequence
  chemically synthesized
aaggggagagaagagaggga

SEQ ID NO: 321029 - DNA, 20 bp, Artificial Sequence
  chemically synthesized
aaaggggagagaagagaggg

SEQ ID NO: 321030 - DNA, 20 bp, Artificial Sequence
  chemically synthesized
tggaaaggggagagaagaga

SEQ ID NO: 321031 - DNA, 20 bp, Artificial Sequence
  chemically synthesized
gtggaaaggggagagaagag

SEQ ID NO: 321032 - DNA, 20 bp, Artificial Sequence
  chemically synthesized
tgtggaaaggggagagaaga

SEQ ID NO: 321033 - DNA, 20 bp, Artificial Sequence
  chemically synthesized
tttgtggaaaggggagagaa

SEQ ID NO: 321034 - DNA, 20 bp, Artificial Sequence
  chemically synthesized
tgtttgtggaaaggggagag

SEQ ID NO: 321035 - DNA, 20 bp, Artificial Sequence
  chemically synthesized
ctctgtttgtggaaagggga

SEQ ID NO: 321036 - DNA, 20 bp, Artificial Sequence
  chemically synthesized
atctctgtttgtggaaaggg

SEQ ID NO: 321037 - DNA, 20 bp, Artificial Sequence
  chemically synthesized
acatctctgtttgtggaaag

SEQ ID NO: 321038 - DNA, 20 bp, Artificial Sequence
  chemically synthesized
gacatctctgtttgtggaaa

SEQ ID NO: 321039 - DNA, 20 bp, Artificial Sequence
  chemically synthesized
agacatctctgtttgtggaa

SEQ ID NO: 321040 - DNA, 20 bp, Artificial Sequence
  chemically synthesized
gagacatctctgtttgtgga

SEQ ID NO: 321041 - DNA, 20 bp, Artificial Sequence
  chemically synthesized
ttctctcccctttccacaaa

SEQ ID NO: 321042 - DNA, 20 bp, Artificial Sequence
  chemically synthesized
ctctcccctttccacaaaca

SEQ ID NO: 321043 - DNA, 20 bp, Artificial Sequence
  chemically synthesized
aggagagacatctctgtttg

SEQ ID NO: 321044 - DNA, 20 bp, Artificial Sequence
  chemically synthesized
aacagagatgtctctcctca

SEQ ID NO: 321045 - DNA, 20 bp, Artificial Sequence
  chemically synthesized
agtcgtcgtggccatgagga

SEQ ID NO: 321046 - DNA, 20 bp, Artificial Sequence
  chemically synthesized
gtagtcgtcgtggccatgag

SEQ ID NO: 321047 - DNA, 20 bp, Artificial Sequence
  chemically synthesized
cagtagtcgtcgtggccatg

SEQ ID NO: 321048 - DNA, 20 bp, Artificial Sequence
  chemically synthesized
tcagtagtcgtcgtggccat

SEQ ID NO: 321049 - DNA, 20 bp, Artificial Sequence
  chemically synthesized
ctttggttcagtagtcgtcg

SEQ ID NO: 321050 - DNA, 20 bp, Artificial Sequence
  chemically synthesized
cagtactctctttggttcag

SEQ ID NO: 321051 - DNA, 20 bp, Artificial Sequence
  chemically synthesized
ccacgacgactactgaacca

SEQ ID NO: 321052 - DNA, 20 bp, Artificial Sequence
  chemically synthesized
acgacgactactgaaccaaa

SEQ ID NO: 321053 - DNA, 20 bp, Artificial Sequence
  chemically synthesized
agacagtactctctttggtt

SEQ ID NO: 321054 - DNA, 20 bp, Artificial Sequence
  chemically synthesized
gacgactactgaaccaaaga

SEQ ID NO: 321055 - DNA, 20 bp, Artificial Sequence
  chemically synthesized
acctcagacagtactctctt

SEQ ID NO: 321056 - DNA, 20 bp, Artificial Sequence
  chemically synthesized
aaccaaagagagtactgtct

SEQ ID NO: 321057 - DNA, 20 bp, Artificial Sequence
  chemically synthesized
accaaagagagtactgtctg

SEQ ID NO: 321058 - DNA, 20 bp, Artificial Sequence
  chemically synthesized
agtgaacattggacctcaga

SEQ ID NO: 321059 - DNA, 20 bp, Artificial Sequence
  chemically synthesized
cttgagtgaacattggacct

SEQ ID NO: 321060 - DNA, 20 bp, Artificial Sequence
  chemically synthesized
cttggcccttgagtgaacat

SEQ ID NO: 321061 - DNA, 20 bp, Artificial Sequence
  chemically synthesized
ctgaggtccaatgttcactc

SEQ ID NO: 321062 - DNA, 20 bp, Artificial Sequence
  chemically synthesized
tgaggtccaatgttcactca

SEQ ID NO: 321063 - DNA, 20 bp, Artificial Sequence
  chemically synthesized
gaggtccaatgttcactcaa

SEQ ID NO: 321064 - DNA, 20 bp, Artificial Sequence
  chemically synthesized
ccaatgttcactcaagggcc

SEQ ID NO: 321065 - DNA, 20 bp, Artificial Sequence
  chemically synthesized
ccaaagtggccttggccctt

SEQ ID NO: 321066 - DNA, 20 bp, Artificial Sequence
  chemically synthesized
caatgttcactcaagggcca

SEQ ID NO: 321067 - DNA, 20 bp, Artificial Sequence
  chemically synthesized
caggctggccaaagtggcct

SEQ ID NO: 321068 - DNA, 20 bp, Artificial Sequence
  chemically synthesized
ctcaagggccaaggccactt

SEQ ID NO: 321069 - DNA, 20 bp, Artificial Sequence
  chemically synthesized
agggccaaggccactttggc

SEQ ID NO: 321070 - DNA, 20 bp, Artificial Sequence
  chemically synthesized
tcaccacaggctggccaaag

SEQ ID NO: 321071 - DNA, 20 bp, Artificial Sequence
  chemically synthesized
cattcaccacaggctggcca

SEQ ID NO: 321072 - DNA, 20 bp, Artificial Sequence
  chemically synthesized
aggccactttggccagcctg

SEQ ID NO: 321073 - DNA, 20 bp, Artificial Sequence
  chemically synthesized
tgacagcattcaccacaggc

SEQ ID NO: 321074 - DNA, 20 bp, Artificial Sequence
  chemically synthesized
ggactgacagcattcaccac

SEQ ID NO: 321075 - DNA, 20 bp, Artificial Sequence
  chemically synthesized
aggactgacagcattcacca

SEQ ID NO: 321076 - DNA, 20 bp, Artificial Sequence
  chemically synthesized
cagcctgtggtgaatgctgt

SEQ ID NO: 321077 - DNA, 20 bp, Artificial Sequence
  chemically synthesized
agggagagactcaggactga

SEQ ID NO: 321078 - DNA, 20 bp, Artificial Sequence
  chemically synthesized
tggtgaatgctgtcagtcct

SEQ ID NO: 321079 - DNA, 20 bp, Artificial Sequence
  chemically synthesized
tgccctgaagggagagactc

SEQ ID NO: 321080 - DNA, 20 bp, Artificial Sequence
  chemically synthesized
ctgccctgaagggagagact

SEQ ID NO: 321081 - DNA, 20 bp, Artificial Sequence
  chemically synthesized
cagtcctgagtctctccctt

SEQ ID NO: 321082 - DNA, 20 bp, Artificial Sequence
  chemically synthesized
agtcctgagtctctcccttc

SEQ ID NO: 321083 - DNA, 20 bp, Artificial Sequence
  chemically synthesized
ttcttactgccctgaaggga

SEQ ID NO: 321084 - DNA, 20 bp, Artificial Sequence
  chemically synthesized
gtcctgagtctctcccttca

SEQ ID NO: 321085 - DNA, 20 bp, Artificial Sequence
  chemically synthesized
ttttcttactgccctgaagg

SEQ ID NO: 321086 - DNA, 20 bp, Artificial Sequence
  chemically synthesized
ctgagtctctcccttcaggg

SEQ ID NO: 321087 - DNA, 20 bp, Artificial Sequence
  chemically synthesized
cattttcttactgccctgaa

SEQ ID NO: 321088 - DNA, 20 bp, Artificial Sequence
  chemically synthesized
ccattttcttactgccctga

SEQ ID NO: 321089 - DNA, 20 bp, Artificial Sequence
  chemically synthesized
tccattttcttactgccctg

SEQ ID NO: 321090 - DNA, 20 bp, Artificial Sequence
  chemically synthesized
gtctctcccttcagggcagt

SEQ ID NO: 321091 - DNA, 20 bp, Artificial Sequence
  chemically synthesized
ccttcagggcagtaagaaaa

SEQ ID NO: 321092 - DNA, 20 bp, Artificial Sequence
  chemically synthesized
ggcagtaagaaaatggaatc

SEQ ID NO: 321093 - DNA, 20 bp, Artificial Sequence
  chemically synthesized
gcagtaagaaaatggaatcc

SEQ ID NO: 321094 - DNA, 20 bp, Artificial Sequence
  chemically synthesized
agtaagaaaatggaatccag

SEQ ID NO: 321095 - DNA, 20 bp, Artificial Sequence
  chemically synthesized
tgattccagagtttggctcc

SEQ ID NO: 321096 - DNA, 20 bp, Artificial Sequence
  chemically synthesized
ggaatccaggagccaaactc

SEQ ID NO: 321097 - DNA, 20 bp, Artificial Sequence
  chemically synthesized
gggtccctgattccagagtt

SEQ ID NO: 321098 - DNA, 20 bp, Artificial Sequence
  chemically synthesized
caggagccaaactctggaat

SEQ ID NO: 321099 - DNA, 20 bp, Artificial Sequence
  chemically synthesized
aggagccaaactctggaatc

SEQ ID NO: 321100 - DNA, 20 bp, Artificial Sequence
  chemically synthesized
tcctagggtccctgattcca

SEQ ID NO: 321101 - DNA, 20 bp, Artificial Sequence
  chemically synthesized
ggagccaaactctggaatca

SEQ ID NO: 321102 - DNA, 20 bp, Artificial Sequence
  chemically synthesized
gctcctagggtccctgattc

SEQ ID NO: 321103 - DNA, 20 bp, Artificial Sequence
  chemically synthesized
aactctggaatcagggaccc

SEQ ID NO: 321104 - DNA, 20 bp, Artificial Sequence
  chemically synthesized
actctggaatcagggaccct

SEQ ID NO: 321105 - DNA, 20 bp, Artificial Sequence
  chemically synthesized
tctggaatcagggaccctag

SEQ ID NO: 321106 - DNA, 20 bp, Artificial Sequence
  chemically synthesized
gagcatcaagtgggctccta

SEQ ID NO: 321107 - DNA, 20 bp, Artificial Sequence
  chemically synthesized
agagcatcaagtgggctcct

SEQ ID NO: 321108 - DNA, 20 bp, Artificial Sequence
  chemically synthesized
cagagcatcaagtgggctcc

SEQ ID NO: 321109 - DNA, 20 bp, Artificial Sequence
  chemically synthesized
agtggggcagagcatcaagt

SEQ ID NO: 321110 - DNA, 20 bp, Artificial Sequence
  chemically synthesized
cagtggggcagagcatcaag

SEQ ID NO: 321111 - DNA, 20 bp, Artificial Sequence
  chemically synthesized
ccacagtggggcagagcatc

SEQ ID NO: 321112 - DNA, 20 bp, Artificial Sequence
  chemically synthesized
agtttgaccacagtggggca

SEQ ID NO: 321113 - DNA, 20 bp, Artificial Sequence
  chemically synthesized
ccagtttgaccacagtgggg

SEQ ID NO: 321114 - DNA, 20 bp, Artificial Sequence
  chemically synthesized
cttgatgctctgccccactg

SEQ ID NO: 321115 - DNA, 20 bp, Artificial Sequence
  chemically synthesized
gttccagtttgaccacagtg

SEQ ID NO: 321116 - DNA, 20 bp, Artificial Sequence
  chemically synthesized
ggttccagtttgaccacagt

SEQ ID NO: 321117 - DNA, 20 bp, Artificial Sequence
  chemically synthesized
gggttccagtttgaccacag

SEQ ID NO: 321118 - DNA, 20 bp, Artificial Sequence
  chemically synthesized
cttgggttccagtttgacca

SEQ ID NO: 321119 - DNA, 20 bp, Artificial Sequence
  chemically synthesized
ctgccccactgtggtcaaac

SEQ ID NO: 321120 - DNA, 20 bp, Artificial Sequence
  chemically synthesized
ctgtggtcaaactggaaccc

SEQ ID NO: 321121 - DNA, 20 bp, Artificial Sequence
  chemically synthesized
ttggcttgcagcttgggttc

SEQ ID NO: 321122 - DNA, 20 bp, Artificial Sequence
  chemically synthesized
caaactggaacccaagctgc

SEQ ID NO: 321123 - DNA, 20 bp, Artificial Sequence
  chemically synthesized
gggactttggcttgcagctt

SEQ ID NO: 321124 - DNA, 20 bp, Artificial Sequence
  chemically synthesized
ggggactttggcttgcagct

SEQ ID NO: 321125 - DNA, 20 bp, Artificial Sequence
  chemically synthesized
ggaacccaagctgcaagcca

SEQ ID NO: 321126 - DNA, 20 bp, Artificial Sequence
  chemically synthesized
gtaaaggggactttggcttg

SEQ ID NO: 321127 - DNA, 20 bp, Artificial Sequence
  chemically synthesized
ggtgagagtaaaggggactt

SEQ ID NO: 321128 - DNA, 20 bp, Artificial Sequence
  chemically synthesized
aaggagaggtgagagtaaag

SEQ ID NO: 321129 - DNA, 20 bp, Artificial Sequence
  chemically synthesized
aaaggagaggtgagagtaaa

SEQ ID NO: 321130 - DNA, 20 bp, Artificial Sequence
  chemically synthesized
gaaaggagaggtgagagtaa

SEQ ID NO: 321131 - DNA, 20 bp, Artificial Sequence
  chemically synthesized
ggaaaggagaggtgagagta

SEQ ID NO: 321132 - DNA, 20 bp, Artificial Sequence
  chemically synthesized
cttcaggaaaggagaggtga

SEQ ID NO: 321133 - DNA, 20 bp, Artificial Sequence
  chemically synthesized
tgcttcaggaaaggagaggt

SEQ ID NO: 321134 - DNA, 20 bp, Artificial Sequence
  chemically synthesized
cttctgcttcaggaaaggag

SEQ ID NO: 321135 - DNA, 20 bp, Artificial Sequence
  chemically synthesized
ccttctgcttcaggaaagga

SEQ ID NO: 321136 - DNA, 20 bp, Artificial Sequence
  chemically synthesized
atccttctgcttcaggaaag

SEQ ID NO: 321137 - DNA, 20 bp, Artificial Sequence
  chemically synthesized
ctctcacctctcctttcctg

SEQ ID NO: 321138 - DNA, 20 bp, Artificial Sequence
  chemically synthesized
gaatccttctgcttcaggaa

SEQ ID NO: 321139 - DNA, 20 bp, Artificial Sequence
  chemically synthesized
agaatccttctgcttcagga

SEQ ID NO: 321140 - DNA, 20 bp, Artificial Sequence
  chemically synthesized
tcacctctcctttcctgaag

SEQ ID NO: 321141 - DNA, 20 bp, Artificial Sequence
  chemically synthesized
cctctcctttcctgaagcag

SEQ ID NO: 321142 - DNA, 20 bp, Artificial Sequence
  chemically synthesized
ggagagaatccttctgcttc

SEQ ID NO: 321143 - DNA, 20 bp, Artificial Sequence
  chemically synthesized
ctctcctttcctgaagcaga

SEQ ID NO: 321144 - DNA, 20 bp, Artificial Sequence
  chemically synthesized
gggagagaatccttctgctt

SEQ ID NO: 321145 - DNA, 20 bp, Artificial Sequence
  chemically synthesized
gcagaaggattctctccctg

SEQ ID NO: 321146 - DNA, 20 bp, Artificial Sequence
  chemically synthesized
agctgtggtggctacaggga

SEQ ID NO: 321147 - DNA, 20 bp, Artificial Sequence
  chemically synthesized
ccagctgtggtggctacagg

SEQ ID NO: 321148 - DNA, 20 bp, Artificial Sequence
  chemically synthesized
tcccagctgtggtggctaca

SEQ ID NO: 321149 - DNA, 20 bp, Artificial Sequence
  chemically synthesized
ttcccagctgtggtggctac

SEQ ID NO: 321150 - DNA, 20 bp, Artificial Sequence
  chemically synthesized
attcccagctgtggtggcta

SEQ ID NO: 321151 - DNA, 20 bp, Artificial Sequence
  chemically synthesized
ttctctccctgtagccacca

SEQ ID NO: 321152 - DNA, 20 bp, Artificial Sequence
  chemically synthesized
ctccctgtagccaccacagc

SEQ ID NO: 321153 - DNA, 20 bp, Artificial Sequence
  chemically synthesized
cagtacattcccagctgtgg

SEQ ID NO: 321154 - DNA, 20 bp, Artificial Sequence
  chemically synthesized
tccctgtagccaccacagct

SEQ ID NO: 321155 - DNA, 20 bp, Artificial Sequence
  chemically synthesized
acccagtacattcccagctg

SEQ ID NO: 321156 - DNA, 20 bp, Artificial Sequence
  chemically synthesized
ggtgtgacccagtacattcc

SEQ ID NO: 321157 - DNA, 20 bp, Artificial Sequence
  chemically synthesized
caccacagctgggaatgtac

SEQ ID NO: 321158 - DNA, 20 bp, Artificial Sequence
  chemically synthesized
accacagctgggaatgtact

SEQ ID NO: 321159 - DNA, 20 bp, Artificial Sequence
  chemically synthesized
tgatggtttcaggtgtgacc

SEQ ID NO: 321160 - DNA, 20 bp, Artificial Sequence
  chemically synthesized
ctcagagctgtgatggtttc

SEQ ID NO: 321161 - DNA, 20 bp, Artificial Sequence
  chemically synthesized
actcagagctgtgatggttt

SEQ ID NO: 321162 - DNA, 20 bp, Artificial Sequence
  chemically synthesized
ggtcacacctgaaaccatca

SEQ ID NO: 321163 - DNA, 20 bp, Artificial Sequence
  chemically synthesized
ggtgagactcagagctgtga

SEQ ID NO: 321164 - DNA, 20 bp, Artificial Sequence
  chemically synthesized
cctgaaaccatcacagctct

SEQ ID NO: 321165 - DNA, 20 bp, Artificial Sequence
  chemically synthesized
tgggtattgggtgagactca

SEQ ID NO: 321166 - DNA, 20 bp, Artificial Sequence
  chemically synthesized
tgtgggtattgggtgagact

SEQ ID NO: 321167 - DNA, 20 bp, Artificial Sequence
  chemically synthesized
acttgctgtgggtattgggt

SEQ ID NO: 321168 - DNA, 20 bp, Artificial Sequence
  chemically synthesized
cagtacttgctgtgggtatt

SEQ ID NO: 321169 - DNA, 20 bp, Artificial Sequence
  chemically synthesized
tgagtctcacccaataccca

SEQ ID NO: 321170 - DNA, 20 bp, Artificial Sequence
  chemically synthesized
gcagtacttgctgtgggtat

SEQ ID NO: 321171 - DNA, 20 bp, Artificial Sequence
  chemically synthesized
tctcacccaatacccacagc

SEQ ID NO: 321172 - DNA, 20 bp, Artificial Sequence
  chemically synthesized
agccaggcagtacttgctgt

SEQ ID NO: 321173 - DNA, 20 bp, Artificial Sequence
  chemically synthesized
tagccaggcagtacttgctg

SEQ ID NO: 321174 - DNA, 20 bp, Artificial Sequence
  chemically synthesized
tacccacagcaagtactgcc

SEQ ID NO: 321175 - DNA, 20 bp, Artificial Sequence
  chemically synthesized
aatcagcagctgtagccagg

SEQ ID NO: 321176 - DNA, 20 bp, Artificial Sequence
  chemically synthesized
cagcaagtactgcctggcta

SEQ ID NO: 321177 - DNA, 20 bp, Artificial Sequence
  chemically synthesized
aataatcagcagctgtagcc

SEQ ID NO: 321178 - DNA, 20 bp, Artificial Sequence
  chemically synthesized
gaataatcagcagctgtagc

SEQ ID NO: 321179 - DNA, 20 bp, Artificial Sequence
  chemically synthesized
ccctgaataatcagcagctg

SEQ ID NO: 321180 - DNA, 20 bp, Artificial Sequence
  chemically synthesized
ctagggccctgaataatcag

SEQ ID NO: 321181 - DNA, 20 bp, Artificial Sequence
  chemically synthesized
ggctacagctgctgattatt

SEQ ID NO: 321182 - DNA, 20 bp, Artificial Sequence
  chemically synthesized
gctacagctgctgattattc

SEQ ID NO: 321183 - DNA, 20 bp, Artificial Sequence
  chemically synthesized
gacctagggccctgaataat

SEQ ID NO: 321184 - DNA, 20 bp, Artificial Sequence
  chemically synthesized
ctacagctgctgattattca

SEQ ID NO: 321185 - DNA, 20 bp, Artificial Sequence
  chemically synthesized
ctgctgattattcagggccc

SEQ ID NO: 321186 - DNA, 20 bp, Artificial Sequence
  chemically synthesized
tgctgattattcagggccct

SEQ ID NO: 321187 - DNA, 20 bp, Artificial Sequence
  chemically synthesized
atgctgaccaaagggaccta

SEQ ID NO: 321188 - DNA, 20 bp, Artificial Sequence
  chemically synthesized
catgctgaccaaagggacct

SEQ ID NO: 321189 - DNA, 20 bp, Artificial Sequence
  chemically synthesized
acatgctgaccaaagggacc

SEQ ID NO: 321190 - DNA, 20 bp, Artificial Sequence
  chemically synthesized
ttcagggccctaggtccctt

SEQ ID NO: 321191 - DNA, 20 bp, Artificial Sequence
  chemically synthesized
gggccctaggtccctttggt

SEQ ID NO: 321192 - DNA, 20 bp, Artificial Sequence
  chemically synthesized
ttcatgacatgctgaccaaa

SEQ ID NO: 321193 - DNA, 20 bp, Artificial Sequence
  chemically synthesized
attcatgacatgctgaccaa

SEQ ID NO: 321194 - DNA, 20 bp, Artificial Sequence
  chemically synthesized
aattcatgacatgctgacca

SEQ ID NO: 321195 - DNA, 20 bp, Artificial Sequence
  chemically synthesized
cagcatgtcatgaattctgc

SEQ ID NO: 321196 - DNA, 20 bp, Artificial Sequence
  chemically synthesized
agcatgtcatgaattctgcc

SEQ ID NO: 321197 - DNA, 20 bp, Artificial Sequence
  chemically synthesized
tgtcatgaattctgccagga

SEQ ID NO: 321198 - DNA, 20 bp, Artificial Sequence
  chemically synthesized
gtcatgaattctgccaggac

SEQ ID NO: 321199 - DNA, 20 bp, Artificial Sequence
  chemically synthesized
agagaaggaccccgtcctgg

SEQ ID NO: 321200 - DNA, 20 bp, Artificial Sequence
  chemically synthesized
tcatgaattctgccaggacg

SEQ ID NO: 321201 - DNA, 20 bp, Artificial Sequence
  chemically synthesized
tgaagagaaggaccccgtcc

SEQ ID NO: 321202 - DNA, 20 bp, Artificial Sequence
  chemically synthesized
aggacggggtccttctcttc

SEQ ID NO: 321203 - DNA, 20 bp, Artificial Sequence
  chemically synthesized
agcctgtcaccttgaagaga

SEQ ID NO: 321204 - DNA, 20 bp, Artificial Sequence
  chemically synthesized
ggacggggtccttctcttca

SEQ ID NO: 321205 - DNA, 20 bp, Artificial Sequence
  chemically synthesized
gagcctgtcaccttgaagag

SEQ ID NO: 321206 - DNA, 20 bp, Artificial Sequence
  chemically synthesized
agagagcctgtcaccttgaa

SEQ ID NO: 321207 - DNA, 20 bp, Artificial Sequence
  chemically synthesized
gaagagagcctgtcaccttg

SEQ ID NO: 321208 - DNA, 20 bp, Artificial Sequence
  chemically synthesized
ggtccttctcttcaaggtga

SEQ ID NO: 321209 - DNA, 20 bp, Artificial Sequence
  chemically synthesized
gtccttctcttcaaggtgac

SEQ ID NO: 321210 - DNA, 20 bp, Artificial Sequence
  chemically synthesized
caaggtgacaggctctcttc

SEQ ID NO: 321211 - DNA, 20 bp, Artificial Sequence
  chemically synthesized
acacaccctgggccagaaga

SEQ ID NO: 321212 - DNA, 20 bp, Artificial Sequence
  chemically synthesized
gaacacaccctgggccagaa

SEQ ID NO: 321213 - DNA, 20 bp, Artificial Sequence
  chemically synthesized
tgacaggctctcttctggcc

SEQ ID NO: 321214 - DNA, 20 bp, Artificial Sequence
  chemically synthesized
gacaggctctcttctggccc

SEQ ID NO: 321215 - DNA, 20 bp, Artificial Sequence
  chemically synthesized
ctgaacacaccctgggccag

SEQ ID NO: 321216 - DNA, 20 bp, Artificial Sequence
  chemically synthesized
acaggctctcttctggccca

SEQ ID NO: 321217 - DNA, 20 bp, Artificial Sequence
  chemically synthesized
tttctgaacacaccctgggc

SEQ ID NO: 321218 - DNA, 20 bp, Artificial Sequence
  chemically synthesized
aacatttctgaacacaccct

SEQ ID NO: 321219 - DNA, 20 bp, Artificial Sequence
  chemically synthesized
taacatttctgaacacaccc

SEQ ID NO: 321220 - DNA, 20 bp, Artificial Sequence
  chemically synthesized
cttctggcccagggtgtgtt

SEQ ID NO: 321221 - DNA, 20 bp, Artificial Sequence
  chemically synthesized
tgttcagaaatgttatctgt

SEQ ID NO: 321222 - DNA, 20 bp, Artificial Sequence
  chemically synthesized
cagaaatgttatctgtgagc

SEQ ID NO: 321223 - DNA, 20 bp, Artificial Sequence
  chemically synthesized
agaaatgttatctgtgagct

SEQ ID NO: 321224 - DNA, 20 bp, Artificial Sequence
  chemically synthesized
gaaatgttatctgtgagcta

SEQ ID NO: 321225 - DNA, 20 bp, Artificial Sequence
  chemically synthesized
ccattccaggccctagctca

SEQ ID NO: 321226 - DNA, 20 bp, Artificial Sequence
  chemically synthesized
gttatctgtgagctagggcc

SEQ ID NO: 321227 - DNA, 20 bp, Artificial Sequence
  chemically synthesized
gaggtccccattccaggccc

SEQ ID NO: 321228 - DNA, 20 bp, Artificial Sequence
  chemically synthesized
ctgtgagctagggcctggaa

SEQ ID NO: 321229 - DNA, 20 bp, Artificial Sequence
  chemically synthesized
tgtgagctagggcctggaat

SEQ ID NO: 321230 - DNA, 20 bp, Artificial Sequence
  chemically synthesized
gtgagctagggcctggaatg

SEQ ID NO: 321231 - DNA, 20 bp, Artificial Sequence
  chemically synthesized
agtcttgaggtccccattcc

SEQ ID NO: 321232 - DNA, 20 bp, Artificial Sequence
  chemically synthesized
gagtcttgaggtccccattc

SEQ ID NO: 321233 - DNA, 20 bp, Artificial Sequence
  chemically synthesized
gggcctggaatggggacctc

SEQ ID NO: 321234 - DNA, 20 bp, Artificial Sequence
  chemically synthesized
gggcaccaggcagagtcttg

SEQ ID NO: 321235 - DNA, 20 bp, Artificial Sequence
  chemically synthesized
agggcaccaggcagagtctt

SEQ ID NO: 321236 - DNA, 20 bp, Artificial Sequence
  chemically synthesized
ggggacctcaagactctgcc

SEQ ID NO: 321237 - DNA, 20 bp, Artificial Sequence
  chemically synthesized
ataggatagggcaccaggca

SEQ ID NO: 321238 - DNA, 20 bp, Artificial Sequence
  chemically synthesized
caataggatagggcaccagg

SEQ ID NO: 321239 - DNA, 20 bp, Artificial Sequence
  chemically synthesized
atacaataggatagggcacc

SEQ ID NO: 321240 - DNA, 20 bp, Artificial Sequence
  chemically synthesized
catacaataggatagggcac

SEQ ID NO: 321241 - DNA, 20 bp, Artificial Sequence
  chemically synthesized
ctcagacatacaataggata

SEQ ID NO: 321242 - DNA, 20 bp, Artificial Sequence
  chemically synthesized
gctcagacatacaataggat

SEQ ID NO: 321243 - DNA, 20 bp, Artificial Sequence
  chemically synthesized
agctcagacatacaatagga

SEQ ID NO: 321244 - DNA, 20 bp, Artificial Sequence
  chemically synthesized
taccagctcagacatacaat

SEQ ID NO: 321245 - DNA, 20 bp, Artificial Sequence
  chemically synthesized
ataccagctcagacatacaa

SEQ ID NO: 321246 - DNA, 20 bp, Artificial Sequence
  chemically synthesized
ccctatcctattgtatgtct

SEQ ID NO: 321247 - DNA, 20 bp, Artificial Sequence
  chemically synthesized
atcctattgtatgtctgagc

SEQ ID NO: 321248 - DNA, 20 bp, Artificial Sequence
  chemically synthesized
ttgctgcttggataccagct

SEQ ID NO: 321249 - DNA, 20 bp, Artificial Sequence
  chemically synthesized
gtatgtctgagctggtatcc

SEQ ID NO: 321250 - DNA, 20 bp, Artificial Sequence
  chemically synthesized
ttgtcttgctgcttggatac

SEQ ID NO: 321251 - DNA, 20 bp, Artificial Sequence
  chemically synthesized
tgtctgagctggtatccaag

SEQ ID NO: 321252 - DNA, 20 bp, Artificial Sequence
  chemically synthesized
tgagctggtatccaagcagc

SEQ ID NO: 321253 - DNA, 20 bp, Artificial Sequence
  chemically synthesized
gagaactttgtcttgctgct

SEQ ID NO: 321254 - DNA, 20 bp, Artificial Sequence
  chemically synthesized
ggtatccaagcagcaagaca

SEQ ID NO: 321255 - DNA, 20 bp, Artificial Sequence
  chemically synthesized
agaagagaggagacaagaaa

SEQ ID NO: 321256 - DNA, 20 bp, Artificial Sequence
  chemically synthesized
gaagaagagaggagacaaga

SEQ ID NO: 321257 - DNA, 20 bp, Artificial Sequence
  chemically synthesized
ttatgaagaagagaggagac

SEQ ID NO: 321258 - DNA, 20 bp, Artificial Sequence
  chemically synthesized
tccgcttatgaagaagagag

SEQ ID NO: 321259 - DNA, 20 bp, Artificial Sequence
  chemically synthesized
cttccgcttatgaagaagag

SEQ ID NO: 321260 - DNA, 20 bp, Artificial Sequence
  chemically synthesized
ccttccgcttatgaagaaga

SEQ ID NO: 321261 - DNA, 20 bp, Artificial Sequence
  chemically synthesized
ttccttccgcttatgaagaa

SEQ ID NO: 321262 - DNA, 20 bp, Artificial Sequence
  chemically synthesized
ttgtctcctctcttcttcat

SEQ ID NO: 321263 - DNA, 20 bp, Artificial Sequence
  chemically synthesized
ccttccttccgcttatgaag

SEQ ID NO: 321264 - DNA, 20 bp, Artificial Sequence
  chemically synthesized
tctcctctcttcttcataag

SEQ ID NO: 321265 - DNA, 20 bp, Artificial Sequence
  chemically synthesized
actccttccttccgcttatg

SEQ ID NO: 321266 - DNA, 20 bp, Artificial Sequence
  chemically synthesized
cctctcttcttcataagcgg

SEQ ID NO: 321267 - DNA, 20 bp, Artificial Sequence
  chemically synthesized
ctctcttcttcataagcgga

SEQ ID NO: 321268 - DNA, 20 bp, Artificial Sequence
  chemically synthesized
tcttcttcataagcggaagg

SEQ ID NO: 321269 - DNA, 20 bp, Artificial Sequence
  chemically synthesized
cttcttcataagcggaagga

SEQ ID NO: 321270 - DNA, 20 bp, Artificial Sequence
  chemically synthesized
tcttcataagcggaaggaag

SEQ ID NO: 321271 - DNA, 20 bp, Artificial Sequence
  chemically synthesized
cggaaggaaggagtctttcc

SEQ ID NO: 321272 - DNA, 20 bp, Artificial Sequence
  chemically synthesized
gaaggaaggagtctttcctg

SEQ ID NO: 321273 - DNA, 20 bp, Artificial Sequence
  chemically synthesized
cacagctcacagctccagga

SEQ ID NO: 321274 - DNA, 20 bp, Artificial Sequence
  chemically synthesized
gcagcacagctcacagctcc

SEQ ID NO: 321275 - DNA, 20 bp, Artificial Sequence
  chemically synthesized
ggagtctttcctggagctgt

SEQ ID NO: 321276 - DNA, 20 bp, Artificial Sequence
  chemically synthesized
ggcagcacagctcacagctc

SEQ ID NO: 321277 - DNA, 20 bp, Artificial Sequence
  chemically synthesized
accccaggcagcacagctca

SEQ ID NO: 321278 - DNA, 20 bp, Artificial Sequence
  chemically synthesized
gagctgtgagctgtgctgcc

SEQ ID NO: 321279 - DNA, 20 bp, Artificial Sequence
  chemically synthesized
tcccccaaccccaggcagca

SEQ ID NO: 321280 - DNA, 20 bp, Artificial Sequence
  chemically synthesized
agctgtgagctgtgctgcct

SEQ ID NO: 321281 - DNA, 20 bp, Artificial Sequence
  chemically synthesized
gctgtgagctgtgctgcctg

SEQ ID NO: 321282 - DNA, 20 bp, Artificial Sequence
  chemically synthesized
tcccttcccccaaccccagg

SEQ ID NO: 321283 - DNA, 20 bp, Artificial Sequence
  chemically synthesized
tgagctgtgctgcctggggt

SEQ ID NO: 321284 - DNA, 20 bp, Artificial Sequence
  chemically synthesized
gagctgtgctgcctggggtt

SEQ ID NO: 321285 - DNA, 20 bp, Artificial Sequence
  chemically synthesized
agctgtgctgcctggggttg

SEQ ID NO: 321286 - DNA, 20 bp, Artificial Sequence
  chemically synthesized
gcttcccttcccccaacccc

SEQ ID NO: 321287 - DNA, 20 bp, Artificial Sequence
  chemically synthesized
gctgtgctgcctggggttgg

SEQ ID NO: 321288 - DNA, 20 bp, Artificial Sequence
  chemically synthesized
tgcttcccttcccccaaccc

SEQ ID NO: 321289 - DNA, 20 bp, Artificial Sequence
  chemically synthesized
gtgctgcctggggttggggg

SEQ ID NO: 321290 - DNA, 20 bp, Artificial Sequence
  chemically synthesized
tgctgcctggggttggggga

SEQ ID NO: 321291 - DNA, 20 bp, Artificial Sequence
  chemically synthesized
gctgcctggggttgggggaa

SEQ ID NO: 321292 - DNA, 20 bp, Artificial Sequence
  chemically synthesized
gcctggggttgggggaaggg

SEQ ID NO: 321293 - DNA, 20 bp, Artificial Sequence
  chemically synthesized
ggttgggggaagggaagcac

SEQ ID NO: 321294 - DNA, 20 bp, Artificial Sequence
  chemically synthesized
tgggggaagggaagcacaag

SEQ ID NO: 321295 - DNA, 20 bp, Artificial Sequence
  chemically synthesized
gggaagcacaagcagtccct

SEQ ID NO: 321296 - DNA, 20 bp, Artificial Sequence
  chemically synthesized
acatccgctggggcagctaa

SEQ ID NO: 321297 - DNA, 20 bp, Artificial Sequence
  chemically synthesized
gacatccgctggggcagcta

SEQ ID NO: 321298 - DNA, 20 bp, Artificial Sequence
  chemically synthesized
agacatccgctggggcagct

SEQ ID NO: 321299 - DNA, 20 bp, Artificial Sequence
  chemically synthesized
aagcagtcccttagctgccc

SEQ ID NO: 321300 - DNA, 20 bp, Artificial Sequence
  chemically synthesized
cagtcccttagctgccccag

SEQ ID NO: 321301 - DNA, 20 bp, Artificial Sequence
  chemically synthesized
tagtgagacatccgctgggg

SEQ ID NO: 321302 - DNA, 20 bp, Artificial Sequence
  chemically synthesized
acctagtgagacatccgctg

SEQ ID NO: 321303 - DNA, 20 bp, Artificial Sequence
  chemically synthesized
aacctagtgagacatccgct

SEQ ID NO: 321304 - DNA, 20 bp, Artificial Sequence
  chemically synthesized
caacctagtgagacatccgc

SEQ ID NO: 321305 - DNA, 20 bp, Artificial Sequence
  chemically synthesized
tgccccagcggatgtctcac

SEQ ID NO: 321306 - DNA, 20 bp, Artificial Sequence
  chemically synthesized
gccccagcggatgtctcact

SEQ ID NO: 321307 - DNA, 20 bp, Artificial Sequence
  chemically synthesized
tgggatacatacaacctagt

SEQ ID NO: 321308 - DNA, 20 bp, Artificial Sequence
  chemically synthesized
gacttgggatacatacaacc

SEQ ID NO: 321309 - DNA, 20 bp, Artificial Sequence
  chemically synthesized
cactaggttgtatgtatccc

SEQ ID NO: 321310 - DNA, 20 bp, Artificial Sequence
  chemically synthesized
ggctcagagtcagtggactt

SEQ ID NO: 321311 - DNA, 20 bp, Artificial Sequence
  chemically synthesized
gggctcagagtcagtggact

SEQ ID NO: 321312 - DNA, 20 bp, Artificial Sequence
  chemically synthesized
tgtgccgggctcagagtcag

SEQ ID NO: 321313 - DNA, 20 bp, Artificial Sequence
  chemically synthesized
atcccaagtccactgactct

SEQ ID NO: 321314 - DNA, 20 bp, Artificial Sequence
  chemically synthesized
tgctgtgccgggctcagagt

SEQ ID NO: 321315 - DNA, 20 bp, Artificial Sequence
  chemically synthesized
aagtccactgactctgagcc

SEQ ID NO: 321316 - DNA, 20 bp, Artificial Sequence
  chemically synthesized
ctggtgctgtgccgggctca

SEQ ID NO: 321317 - DNA, 20 bp, Artificial Sequence
  chemically synthesized
tcctggtgctgtgccgggct

SEQ ID NO: 321318 - DNA, 20 bp, Artificial Sequence
  chemically synthesized
cactgactctgagcccggca

SEQ ID NO: 321319 - DNA, 20 bp, Artificial Sequence
  chemically synthesized
gcaagtcctggtgctgtgcc

SEQ ID NO: 321320 - DNA, 20 bp, Artificial Sequence
  chemically synthesized
tgcaagtcctggtgctgtgc

SEQ ID NO: 321321 - DNA, 20 bp, Artificial Sequence
  chemically synthesized
ctctgagcccggcacagcac

SEQ ID NO: 321322 - DNA, 20 bp, Artificial Sequence
  chemically synthesized
tctgagcccggcacagcacc

SEQ ID NO: 321323 - DNA, 20 bp, Artificial Sequence
  chemically synthesized
tgcagttcctttgcaagtcc

SEQ ID NO: 321324 - DNA, 20 bp, Artificial Sequence
  chemically synthesized
gcacagcaccaggacttgca

SEQ ID NO: 321325 - DNA, 20 bp, Artificial Sequence
  chemically synthesized
cacagcaccaggacttgcaa

SEQ ID NO: 321326 - DNA, 20 bp, Artificial Sequence
  chemically synthesized
aaggactgcagttcctttgc

SEQ ID NO: 321327 - DNA, 20 bp, Artificial Sequence
  chemically synthesized
caggacttgcaaaggaactg

SEQ ID NO: 321328 - DNA, 20 bp, Artificial Sequence
  chemically synthesized
agtctaggccacaaggactg

SEQ ID NO: 321329 - DNA, 20 bp, Artificial Sequence
  chemically synthesized
caaaggaactgcagtccttg

SEQ ID NO: 321330 - DNA, 20 bp, Artificial Sequence
  chemically synthesized
gaactgcagtccttgtggcc

SEQ ID NO: 321331 - DNA, 20 bp, Artificial Sequence
  chemically synthesized
caaaggtagtctaggccaca

SEQ ID NO: 321332 - DNA, 20 bp, Artificial Sequence
  chemically synthesized
tcaaaggtagtctaggccac

SEQ ID NO: 321333 - DNA, 20 bp, Artificial Sequence
  chemically synthesized
ataaacttcaaaggtagtct

SEQ ID NO: 321334 - DNA, 20 bp, Artificial Sequence
  chemically synthesized
aataaacttcaaaggtagtc

SEQ ID NO: 321335 - DNA, 20 bp, Artificial Sequence
  chemically synthesized
tgtggcctagactacctttg

SEQ ID NO: 321336 - DNA, 20 bp, Artificial Sequence
  chemically synthesized
ttctaaataaacttcaaagg

SEQ ID NO: 321337 - DNA, 20 bp, Artificial Sequence
  chemically synthesized
tggttctaaataaacttcaa

SEQ ID NO: 321338 - DNA, 20 bp, Artificial Sequence
  chemically synthesized
gtggttctaaataaacttca

SEQ ID NO: 321339 - DNA, 20 bp, Artificial Sequence
  chemically synthesized
gactacctttgaagtttatt

SEQ ID NO: 321340 - DNA, 20 bp, Artificial Sequence
  chemically synthesized
ttgaagtttatttagaacca

SEQ ID NO: 321341 - DNA, 20 bp, Artificial Sequence
  chemically synthesized
gaagtttatttagaaccaca

SEQ ID NO: 321342 - DNA, 20 bp, Artificial Sequence
  chemically synthesized
tcatggattagagtgctctg

SEQ ID NO: 321343 - DNA, 20 bp, Artificial Sequence
  chemically synthesized
agccttgtcatcatggatta

SEQ ID NO: 321344 - DNA, 20 bp, Artificial Sequence
  chemically synthesized
caagccttgtcatcatggat

SEQ ID NO: 321345 - DNA, 20 bp, Artificial Sequence
  chemically synthesized
gcactctaatccatgatgac

SEQ ID NO: 321346 - DNA, 20 bp, Artificial Sequence
  chemically synthesized
tccggcaagccttgtcatca

SEQ ID NO: 321347 - DNA, 20 bp, Artificial Sequence
  chemically synthesized
cactctaatccatgatgaca

SEQ ID NO: 321348 - DNA, 20 bp, Artificial Sequence
  chemically synthesized
tccatgatgacaaggcttgc

SEQ ID NO: 321349 - DNA, 20 bp, Artificial Sequence
  chemically synthesized
tttggaacctgagttccggc

SEQ ID NO: 321350 - DNA, 20 bp, Artificial Sequence
  chemically synthesized
tgacaaggcttgccggaact

SEQ ID NO: 321351 - DNA, 20 bp, Artificial Sequence
  chemically synthesized
gacaaggcttgccggaactc

SEQ ID NO: 321352 - DNA, 20 bp, Artificial Sequence
  chemically synthesized
agtgtttggaacctgagttc

SEQ ID NO: 321353 - DNA, 20 bp, Artificial Sequence
  chemically synthesized
catcccagtgtttggaacct

SEQ ID NO: 321354 - DNA, 20 bp, Artificial Sequence
  chemically synthesized
ggaactcaggttccaaacac

SEQ ID NO: 321355 - DNA, 20 bp, Artificial Sequence
  chemically synthesized
gaactcaggttccaaacact

SEQ ID NO: 321356 - DNA, 20 bp, Artificial Sequence
  chemically synthesized
gaatcatccatcccagtgtt

SEQ ID NO: 321357 - DNA, 20 bp, Artificial Sequence
  chemically synthesized
tcaggttccaaacactggga

SEQ ID NO: 321358 - DNA, 20 bp, Artificial Sequence
  chemically synthesized
cagggaagaatcatccatcc

SEQ ID NO: 321359 - DNA, 20 bp, Artificial Sequence
  chemically synthesized
atggatgattcttccctgtc

SEQ ID NO: 321360 - DNA, 20 bp, Artificial Sequence
  chemically synthesized
tagatgaaccctagacaggg

SEQ ID NO: 321361 - DNA, 20 bp, Artificial Sequence
  chemically synthesized
tggatgattcttccctgtct

SEQ ID NO: 321362 - DNA, 20 bp, Artificial Sequence
  chemically synthesized
ggatgattcttccctgtcta

SEQ ID NO: 321363 - DNA, 20 bp, Artificial Sequence
  chemically synthesized
atttagatgaaccctagaca

SEQ ID NO: 321364 - DNA, 20 bp, Artificial Sequence
  chemically synthesized
catttagatgaaccctagac

SEQ ID NO: 321365 - DNA, 20 bp, Artificial Sequence
  chemically synthesized
gcatttagatgaaccctaga

SEQ ID NO: 321366 - DNA, 20 bp, Artificial Sequence
  chemically synthesized
gggagcatttagatgaaccc

SEQ ID NO: 321367 - DNA, 20 bp, Artificial Sequence
  chemically synthesized
aatcccgcagagggagcatt

SEQ ID NO: 321368 - DNA, 20 bp, Artificial Sequence
  chemically synthesized
tcatctaaatgctccctctg

SEQ ID NO: 321369 - DNA, 20 bp, Artificial Sequence
  chemically synthesized
catctaaatgctccctctgc

SEQ ID NO: 321370 - DNA, 20 bp, Artificial Sequence
  chemically synthesized
tcagccaaatcccgcagagg

SEQ ID NO: 321371 - DNA, 20 bp, Artificial Sequence
  chemically synthesized
actcagccaaatcccgcaga

SEQ ID NO: 321372 - DNA, 20 bp, Artificial Sequence
  chemically synthesized
aactcagccaaatcccgcag

SEQ ID NO: 321373 - DNA, 20 bp, Artificial Sequence
  chemically synthesized
gaactcagccaaatcccgca

SEQ ID NO: 321374 - DNA, 20 bp, Artificial Sequence
  chemically synthesized
aatgctccctctgcgggatt

SEQ ID NO: 321375 - DNA, 20 bp, Artificial Sequence
  chemically synthesized
cagaactcagccaaatcccg

SEQ ID NO: 321376 - DNA, 20 bp, Artificial Sequence
  chemically synthesized
tccctctgcgggatttggct

SEQ ID NO: 321377 - DNA, 20 bp, Artificial Sequence
  chemically synthesized
aaccgacaaagaacagaact

SEQ ID NO: 321378 - DNA, 20 bp, Artificial Sequence
  chemically synthesized
cagtggaaaccgacaaagaa

SEQ ID NO: 321379 - DNA, 20 bp, Artificial Sequence
  chemically synthesized
ggctgagttctgttctttgt

SEQ ID NO: 321380 - DNA, 20 bp, Artificial Sequence
  chemically synthesized
tgtcacagtggaaaccgaca

SEQ ID NO: 321381 - DNA, 20 bp, Artificial Sequence
  chemically synthesized
tttgtcggtttccactgtga

SEQ ID NO: 321382 - DNA, 20 bp, Artificial Sequence
  chemically synthesized
ttgtcggtttccactgtgac

SEQ ID NO: 321383 - DNA, 20 bp, Artificial Sequence
  chemically synthesized
tcagtgctgccctgtcacag

SEQ ID NO: 321384 - DNA, 20 bp, Artificial Sequence
  chemically synthesized
tgtcggtttccactgtgaca

SEQ ID NO: 321385 - DNA, 20 bp, Artificial Sequence
  chemically synthesized
aaatcagtgctgccctgtca

SEQ ID NO: 321386 - DNA, 20 bp, Artificial Sequence
  chemically synthesized
cggtttccactgtgacaggg

SEQ ID NO: 321387 - DNA, 20 bp, Artificial Sequence
  chemically synthesized
taggactttgcattgaaaat

SEQ ID NO: 321388 - DNA, 20 bp, Artificial Sequence
  chemically synthesized
cagcactgattttcaatgca

SEQ ID NO: 321389 - DNA, 20 bp, Artificial Sequence
  chemically synthesized
agggagattgcagtgattat

SEQ ID NO: 321390 - DNA, 20 bp, Artificial Sequence
  chemically synthesized
aagggagattgcagtgatta

SEQ ID NO: 321391 - DNA, 20 bp, Artificial Sequence
  chemically synthesized
tgcttgcagaagggagattg

SEQ ID NO: 321392 - DNA, 20 bp, Artificial Sequence
  chemically synthesized
gtctatgtgcttgcagaagg

SEQ ID NO: 321393 - DNA, 20 bp, Artificial Sequence
  chemically synthesized
cactgcaatctcccttctgc

SEQ ID NO: 321394 - DNA, 20 bp, Artificial Sequence
  chemically synthesized
gagtctatgtgcttgcagaa

SEQ ID NO: 321395 - DNA, 20 bp, Artificial Sequence
  chemically synthesized
agagtctatgtgcttgcaga

SEQ ID NO: 321396 - DNA, 20 bp, Artificial Sequence
  chemically synthesized
gagagtctatgtgcttgcag

SEQ ID NO: 321397 - DNA, 20 bp, Artificial Sequence
  chemically synthesized
agagagagtctatgtgcttg

SEQ ID NO: 321398 - DNA, 20 bp, Artificial Sequence
  chemically synthesized
atctcccttctgcaagcaca

SEQ ID NO: 321399 - DNA, 20 bp, Artificial Sequence
  chemically synthesized
agtcacatggcatgaagaga

SEQ ID NO: 321400 - DNA, 20 bp, Artificial Sequence
  chemically synthesized
gcagtcacatggcatgaaga

SEQ ID NO: 321401 - DNA, 20 bp, Artificial Sequence
  chemically synthesized
cagcagtcacatggcatgaa

SEQ ID NO: 321402 - DNA, 20 bp, Artificial Sequence
  chemically synthesized
ggcagcagtcacatggcatg

SEQ ID NO: 321403 - DNA, 20 bp, Artificial Sequence
  chemically synthesized
catccatggcagcagtcaca

SEQ ID NO: 321404 - DNA, 20 bp, Artificial Sequence
  chemically synthesized
atgccatgtgactgctgcca

SEQ ID NO: 321405 - DNA, 20 bp, Artificial Sequence
  chemically synthesized
ctctccctcatccatggcag

SEQ ID NO: 321406 - DNA, 20 bp, Artificial Sequence
  chemically synthesized
cagctctccctcatccatgg

SEQ ID NO: 321407 - DNA, 20 bp, Artificial Sequence
  chemically synthesized
atgtgactgctgccatggat

SEQ ID NO: 321408 - DNA, 20 bp, Artificial Sequence
  chemically synthesized
tgtgactgctgccatggatg

SEQ ID NO: 321409 - DNA, 20 bp, Artificial Sequence
  chemically synthesized
gtgactgctgccatggatga

SEQ ID NO: 321410 - DNA, 20 bp, Artificial Sequence
  chemically synthesized
taccagctctccctcatcca

SEQ ID NO: 321411 - DNA, 20 bp, Artificial Sequence
  chemically synthesized
gactgctgccatggatgagg

SEQ ID NO: 321412 - DNA, 20 bp, Artificial Sequence
  chemically synthesized
ctgctgccatggatgaggga

SEQ ID NO: 321413 - DNA, 20 bp, Artificial Sequence
  chemically synthesized
tgccatggatgagggagagc

SEQ ID NO: 321414 - DNA, 20 bp, Artificial Sequence
  chemically synthesized
tggatgagggagagctggta

SEQ ID NO: 321415 - DNA, 20 bp, Artificial Sequence
  chemically synthesized
ggatgagggagagctggtat

SEQ ID NO: 321416 - DNA, 20 bp, Artificial Sequence
  chemically synthesized
caatattctatcacctatac

SEQ ID NO: 321417 - DNA, 20 bp, Artificial Sequence
  chemically synthesized
gggagagctggtataggtga

SEQ ID NO: 321418 - DNA, 20 bp, Artificial Sequence
  chemically synthesized
ggcacagaagagggtagtaa

SEQ ID NO: 321419 - DNA, 20 bp, Artificial Sequence
  chemically synthesized
aggcacagaagagggtagta

SEQ ID NO: 321420 - DNA, 20 bp, Artificial Sequence
  chemically synthesized
gaaagaggcacagaagaggg

SEQ ID NO: 321421 - DNA, 20 bp, Artificial Sequence
  chemically synthesized
acagaaagaggcacagaaga

SEQ ID NO: 321422 - DNA, 20 bp, Artificial Sequence
  chemically synthesized
cacagaaagaggcacagaag

SEQ ID NO: 321423 - DNA, 20 bp, Artificial Sequence
  chemically synthesized
tcacagaaagaggcacagaa

SEQ ID NO: 321424 - DNA, 20 bp, Artificial Sequence
  chemically synthesized
tatcacagaaagaggcacag

SEQ ID NO: 321425 - DNA, 20 bp, Artificial Sequence
  chemically synthesized
ttgtatcacagaaagaggca

SEQ ID NO: 321426 - DNA, 20 bp, Artificial Sequence
  chemically synthesized
ttgggttgtatcacagaaag

SEQ ID NO: 321427 - DNA, 20 bp, Artificial Sequence
  chemically synthesized
tttgggttgtatcacagaaa

SEQ ID NO: 321428 - DNA, 20 bp, Artificial Sequence
  chemically synthesized
tttttgggttgtatcacaga

SEQ ID NO: 321429 - DNA, 20 bp, Artificial Sequence
  chemically synthesized
ctggtttttgggttgtatca

SEQ ID NO: 321430 - DNA, 20 bp, Artificial Sequence
  chemically synthesized
ctgtgatacaacccaaaaac

SEQ ID NO: 321431 - DNA, 20 bp, Artificial Sequence
  chemically synthesized
tgtgatacaacccaaaaacc

SEQ ID NO: 321432 - DNA, 20 bp, Artificial Sequence
  chemically synthesized
gatcgtagtacctggttttt

SEQ ID NO: 321433 - DNA, 20 bp, Artificial Sequence
  chemically synthesized
tgatcgtagtacctggtttt

SEQ ID NO: 321434 - DNA, 20 bp, Artificial Sequence
  chemically synthesized
aggtgcatgatcgtagtacc

SEQ ID NO: 321435 - DNA, 20 bp, Artificial Sequence
  chemically synthesized
aaaaattaggtgcatgatcg

SEQ ID NO: 321436 - DNA, 20 bp, Artificial Sequence
  chemically synthesized
cttcataagagtgaaaaatt

SEQ ID NO: 321437 - DNA, 20 bp, Artificial Sequence
  chemically synthesized
ccttcataagagtgaaaaat

SEQ ID NO: 321438 - DNA, 20 bp, Artificial Sequence
  chemically synthesized
cctaatttttcactcttatg

SEQ ID NO: 321439 - DNA, 20 bp, Artificial Sequence
  chemically synthesized
ctaatttttcactcttatga

SEQ ID NO: 321440 - DNA, 20 bp, Artificial Sequence
  chemically synthesized
ctagaaaagcaccttcataa

SEQ ID NO: 321441 - DNA, 20 bp, Artificial Sequence
  chemically synthesized
cactagaaaagcaccttcat

SEQ ID NO: 321442 - DNA, 20 bp, Artificial Sequence
  chemically synthesized
ctcttatgaaggtgcttttc

SEQ ID NO: 321443 - DNA, 20 bp, Artificial Sequence
  chemically synthesized
aacaactgtccacactagaa

SEQ ID NO: 321444 - DNA, 20 bp, Artificial Sequence
  chemically synthesized
atgaaggtgcttttctagtg

SEQ ID NO: 321445 - DNA, 20 bp, Artificial Sequence
  chemically synthesized
aggtgcttttctagtgtgga

SEQ ID NO: 321446 - DNA, 20 bp, Artificial Sequence
  chemically synthesized
aattgaacaactgtccacac

SEQ ID NO: 321447 - DNA, 20 bp, Artificial Sequence
  chemically synthesized
tcaatttgatgttcctgcaa

SEQ ID NO: 321448 - DNA, 20 bp, Artificial Sequence
  chemically synthesized
caatttgatgttcctgcaac

SEQ ID NO: 321449 - DNA, 20 bp, Artificial Sequence
  chemically synthesized
aatttgatgttcctgcaaca

SEQ ID NO: 321450 - DNA, 20 bp, Artificial Sequence
  chemically synthesized
ccagtaattatccctgttgc

SEQ ID NO: 321451 - DNA, 20 bp, Artificial Sequence
  chemically synthesized
tccagtaattatccctgttg

SEQ ID NO: 321452 - DNA, 20 bp, Artificial Sequence
  chemically synthesized
cctgcaacagggataattac

SEQ ID NO: 321453 - DNA, 20 bp, Artificial Sequence
  chemically synthesized
tgcaacagggataattactg

SEQ ID NO: 321454 - DNA, 20 bp, Artificial Sequence
  chemically synthesized
gcaacagggataattactgg

SEQ ID NO: 321455 - DNA, 20 bp, Artificial Sequence
  chemically synthesized
aatcgccaaacagaagcctc

SEQ ID NO: 321456 - DNA, 20 bp, Artificial Sequence
  chemically synthesized
aattactggaggcttctgtt

SEQ ID NO: 321457 - DNA, 20 bp, Artificial Sequence
  chemically synthesized
ggagaaaaatcgccaaacag

SEQ ID NO: 321458 - DNA, 20 bp, Artificial Sequence
  chemically synthesized
ggtggagaaaaatcgccaaa

SEQ ID NO: 321459 - DNA, 20 bp, Artificial Sequence
  chemically synthesized
agtttattgtggaggaggtg

SEQ ID NO: 321460 - DNA, 20 bp, Artificial Sequence
  chemically synthesized
gaagtttattgtggaggagg

SEQ ID NO: 321461 - DNA, 20 bp, Artificial Sequence
  chemically synthesized
ctcgaagtttattgtggagg

SEQ ID NO: 321462 - DNA, 20 bp, Artificial Sequence
  chemically synthesized
tctcgaagtttattgtggag

SEQ ID NO: 321463 - DNA, 20 bp, Artificial Sequence
  chemically synthesized
agtctcgaagtttattgtgg

SEQ ID NO: 321464 - DNA, 20 bp, Artificial Sequence
  chemically synthesized
gagtctcgaagtttattgtg

SEQ ID NO: 321465 - DNA, 20 bp, Artificial Sequence
  chemically synthesized
atgagtctcgaagtttattg

SEQ ID NO: 321466 - DNA, 20 bp, Artificial Sequence
  chemically synthesized
cctcctccacaataaacttc

SEQ ID NO: 321467 - DNA, 20 bp, Artificial Sequence
  chemically synthesized
ttgagggaaaatgagtctcg

SEQ ID NO: 321468 - DNA, 20 bp, Artificial Sequence
  chemically synthesized
ccatatatttgagggaaaat

SEQ ID NO: 321469 - DNA, 20 bp, Artificial Sequence
  chemically synthesized
tatggtcaccatatatttga

SEQ ID NO: 321470 - DNA, 20 bp, Artificial Sequence
  chemically synthesized
atatggtcaccatatatttg

SEQ ID NO: 321471 - DNA, 20 bp, Artificial Sequence
  chemically synthesized
ctcattttccctcaaatata

SEQ ID NO: 321472 - DNA, 20 bp, Artificial Sequence
  chemically synthesized
tatatggtcaccatatattt

SEQ ID NO: 321473 - DNA, 20 bp, Artificial Sequence
  chemically synthesized
aaatatctagtcattttata

SEQ ID NO: 321474 - DNA, 20 bp, Artificial Sequence
  chemically synthesized
tggtgaccatataaaatgac

SEQ ID NO: 321475 - DNA, 20 bp, Artificial Sequence
  chemically synthesized
ccatacattttaaaaatatc

SEQ ID NO: 321476 - DNA, 20 bp, Artificial Sequence
  chemically synthesized
ctagatatttttaaaatgta

SEQ ID NO: 321477 - DNA, 20 bp, Artificial Sequence
  chemically synthesized
gtatggtgtatcattaaata

SEQ ID NO: 321478 - DNA, 20 bp, Artificial Sequence
  chemically synthesized
tatggtgtatcattaaatat

SEQ ID NO: 321479 - DNA, 20 bp, Artificial Sequence
  chemically synthesized
gtatcattaaatataggaat

SEQ ID NO: 321480 - DNA, 20 bp, Artificial Sequence
  chemically synthesized
atcatgatatattataatcc

SEQ ID NO: 321481 - DNA, 20 bp, Artificial Sequence
  chemically synthesized
atatattataatccaagaaa

SEQ ID NO: 321482 - DNA, 20 bp, Artificial Sequence
  chemically synthesized
aaaacatgtttgccatttct

SEQ ID NO: 321483 - DNA, 20 bp, Artificial Sequence
  chemically synthesized
atggcaaacatgttttaata

SEQ ID NO: 321484 - DNA, 20 bp, Artificial Sequence
  chemically synthesized
aaacatgttttaatatagaa

SEQ ID NO: 321485 - DNA, 20 bp, Artificial Sequence
  chemically synthesized
gaaaagcaacattcatttaa

SEQ ID NO: 321486 - DNA, 20 bp, Artificial Sequence
  chemically synthesized
gcaacattcatttaaaagaa

SEQ ID NO: 321487 - DNA, 20 bp, Artificial Sequence
  chemically synthesized
ttcatttaaaagaaaagctt

SEQ ID NO: 321488 - DNA, 20 bp, Artificial Sequence
  chemically synthesized
atttaaaagaaaagcttgag

SEQ ID NO: 321489 - DNA, 20 bp, Artificial Sequence
  chemically synthesized
tgtttgtacatgcactactc

SEQ ID NO: 321490 - DNA, 20 bp, Artificial Sequence
  chemically synthesized
catgtacaaacatatgcaca

SEQ ID NO: 321491 - DNA, 20 bp, Artificial Sequence
  chemically synthesized
agttttttgttgttgttgca

SEQ ID NO: 321492 - DNA, 20 bp, Artificial Sequence
  chemically synthesized
tgttgcatggcaataatgaa

SEQ ID NO: 321493 - DNA, 20 bp, Artificial Sequence
  chemically synthesized
tggcaataatgaatggtcca

SEQ ID NO: 321494 - DNA, 20 bp, Artificial Sequence
  chemically synthesized
ggcaataatgaatggtccat

SEQ ID NO: 321495 - DNA, 20 bp, Artificial Sequence
  chemically synthesized
aataatgaatggtccatagg

SEQ ID NO: 321496 - DNA, 20 bp, Artificial Sequence
  chemically synthesized
aaatactaatatgcttccta

SEQ ID NO: 321497 - DNA, 20 bp, Artificial Sequence
  chemically synthesized
atggtccataggaagcatat

SEQ ID NO: 321498 - DNA, 20 bp, Artificial Sequence
  chemically synthesized
attagtatttttcaactccc

SEQ ID NO: 321499 - DNA, 20 bp, Artificial Sequence
  chemically synthesized
ataaacgttataaatcttgg

SEQ ID NO: 321500 - DNA, 20 bp, Artificial Sequence
  chemically synthesized
tgataaacgttataaatctt

SEQ ID NO: 321501 - DNA, 20 bp, Artificial Sequence
  chemically synthesized
ttgataaacgttataaatct

SEQ ID NO: 321502 - DNA, 20 bp, Artificial Sequence
  chemically synthesized
aagatttataacgtttatca

SEQ ID NO: 321503 - DNA, 20 bp, Artificial Sequence
  chemically synthesized
aacgtttatcaaagttcaat

SEQ ID NO: 321504 - DNA, 20 bp, Artificial Sequence
  chemically synthesized
gtttatcaaagttcaataag

SEQ ID NO: 321505 - DNA, 20 bp, Artificial Sequence
  chemically synthesized
ctttaaagcttatatttcac

SEQ ID NO: 321506 - DNA, 20 bp, Artificial Sequence
  chemically synthesized
gctttaaagcttatatttca

SEQ ID NO: 321507 - DNA, 20 bp, Artificial Sequence
  chemically synthesized
ataagtggcctgtgaaatat

SEQ ID NO: 321508 - DNA, 20 bp, Artificial Sequence
  chemically synthesized
cctgtgaaatataagcttta

SEQ ID NO: 321509 - DNA, 20 bp, Artificial Sequence
  chemically synthesized
tgaaatataagctttaaagc

SEQ ID NO: 321510 - DNA, 20 bp, Artificial Sequence
  chemically synthesized
ctgtttggattctggcttta

SEQ ID NO: 321511 - DNA, 20 bp, Artificial Sequence
  chemically synthesized
aattggttctgtttggattc

SEQ ID NO: 321512 - DNA, 20 bp, Artificial Sequence
  chemically synthesized
ctttaaagccagaatccaaa

SEQ ID NO: 321513 - DNA, 20 bp, Artificial Sequence
  chemically synthesized
agggggtaattggttctgtt

SEQ ID NO: 321514 - DNA, 20 bp, Artificial Sequence
  chemically synthesized
tacacatttgagggggtaat

SEQ ID NO: 321515 - DNA, 20 bp, Artificial Sequence
  chemically synthesized
gaagtcttacacatttgagg

SEQ ID NO: 321516 - DNA, 20 bp, Artificial Sequence
  chemically synthesized
tgaagtcttacacatttgag

SEQ ID NO: 321517 - DNA, 20 bp, Artificial Sequence
  chemically synthesized
ctgaagtcttacacatttga

SEQ ID NO: 321518 - DNA, 20 bp, Artificial Sequence
  chemically synthesized
gctgaagtcttacacatttg

SEQ ID NO: 321519 - DNA, 20 bp, Artificial Sequence
  chemically synthesized
agctgaagtcttacacattt

SEQ ID NO: 321520 - DNA, 20 bp, Artificial Sequence
  chemically synthesized
aattaccccctcaaatgtgt

SEQ ID NO: 321521 - DNA, 20 bp, Artificial Sequence
  chemically synthesized
ccctcaaatgtgtaagactt

SEQ ID NO: 321522 - DNA, 20 bp, Artificial Sequence
  chemically synthesized
agtgaaaacagtgacagctg

SEQ ID NO: 321523 - DNA, 20 bp, Artificial Sequence
  chemically synthesized
tgagatagtgaaaacagtga

SEQ ID NO: 321524 - DNA, 20 bp, Artificial Sequence
  chemically synthesized
aggtgatgagatagtgaaaa

SEQ ID NO: 321525 - DNA, 20 bp, Artificial Sequence
  chemically synthesized
ttgtggtaaaggtgatgaga

SEQ ID NO: 321526 - DNA, 20 bp, Artificial Sequence
  chemically synthesized
gtacttgtggtaaaggtgat

SEQ ID NO: 321527 - DNA, 20 bp, Artificial Sequence
  chemically synthesized
tatctcatcacctttaccac

SEQ ID NO: 321528 - DNA, 20 bp, Artificial Sequence
  chemically synthesized
gatggatgtacttgtggtaa

SEQ ID NO: 321529 - DNA, 20 bp, Artificial Sequence
  chemically synthesized
cgatggatgtacttgtggta

SEQ ID NO: 321530 - DNA, 20 bp, Artificial Sequence
  chemically synthesized
aatagcgatggatgtacttg

SEQ ID NO: 321531 - DNA, 20 bp, Artificial Sequence
  chemically synthesized
gaactagaggacaatagcga

SEQ ID NO: 321532 - DNA, 20 bp, Artificial Sequence
  chemically synthesized
gcatgagaactagaggacaa

SEQ ID NO: 321533 - DNA, 20 bp, Artificial Sequence
  chemically synthesized
catccatcgctattgtcctc

SEQ ID NO: 321534 - DNA, 20 bp, Artificial Sequence
  chemically synthesized
aaagttagcatgagaactag

SEQ ID NO: 321535 - DNA, 20 bp, Artificial Sequence
  chemically synthesized
gaaagttagcatgagaacta

SEQ ID NO: 321536 - DNA, 20 bp, Artificial Sequence
  chemically synthesized
cagaaagttagcatgagaac

SEQ ID NO: 321537 - DNA, 20 bp, Artificial Sequence
  chemically synthesized
cccattcagaaagttagcat

SEQ ID NO: 321538 - DNA, 20 bp, Artificial Sequence
  chemically synthesized
agggtacccattcagaaagt

SEQ ID NO: 321539 - DNA, 20 bp, Artificial Sequence
  chemically synthesized
tctcatgctaactttctgaa

SEQ ID NO: 321540 - DNA, 20 bp, Artificial Sequence
  chemically synthesized
ctcatgctaactttctgaat

SEQ ID NO: 321541 - DNA, 20 bp, Artificial Sequence
  chemically synthesized
gctgagggtacccattcaga

SEQ ID NO: 321542 - DNA, 20 bp, Artificial Sequence
  chemically synthesized
agatgctgagggtacccatt

SEQ ID NO: 321543 - DNA, 20 bp, Artificial Sequence
  chemically synthesized
actttctgaatgggtaccct

SEQ ID NO: 321544 - DNA, 20 bp, Artificial Sequence
  chemically synthesized
tacagcttcacagatgctga

SEQ ID NO: 321545 - DNA, 20 bp, Artificial Sequence
  chemically synthesized
ctacagcttcacagatgctg

SEQ ID NO: 321546 - DNA, 20 bp, Artificial Sequence
  chemically synthesized
tctacagcttcacagatgct

SEQ ID NO: 321547 - DNA, 20 bp, Artificial Sequence
  chemically synthesized
gggtaccctcagcatctgtg

SEQ ID NO: 321548 - DNA, 20 bp, Artificial Sequence
  chemically synthesized
gtagggtttctacagcttca

SEQ ID NO: 321549 - DNA, 20 bp, Artificial Sequence
  chemically synthesized
cctcagcatctgtgaagctg

SEQ ID NO: 321550 - DNA, 20 bp, Artificial Sequence
  chemically synthesized
ctaggccagtagggtttcta

SEQ ID NO: 321551 - DNA, 20 bp, Artificial Sequence
  chemically synthesized
tgaagctgtagaaaccctac

SEQ ID NO: 321552 - DNA, 20 bp, Artificial Sequence
  chemically synthesized
gtaggtaaactaggccagta

SEQ ID NO: 321553 - DNA, 20 bp, Artificial Sequence
  chemically synthesized
ctgtagaaaccctactggcc

SEQ ID NO: 321554 - DNA, 20 bp, Artificial Sequence
  chemically synthesized
agtaggtaaactaggccagt

SEQ ID NO: 321555 - DNA, 20 bp, Artificial Sequence
  chemically synthesized
aagtaggtaaactaggccag

SEQ ID NO: 321556 - DNA, 20 bp, Artificial Sequence
  chemically synthesized
ggcaagtaggtaaactaggc

SEQ ID NO: 321557 - DNA, 20 bp, Artificial Sequence
  chemically synthesized
ctgaggcaagtaggtaaact

SEQ ID NO: 321558 - DNA, 20 bp, Artificial Sequence
  chemically synthesized
actgaggcaagtaggtaaac

SEQ ID NO: 321559 - DNA, 20 bp, Artificial Sequence
  chemically synthesized
atctagttactgaggcaagt

SEQ ID NO: 321560 - DNA, 20 bp, Artificial Sequence
  chemically synthesized
cctagtttacctacttgcct

SEQ ID NO: 321561 - DNA, 20 bp, Artificial Sequence
  chemically synthesized
gatctagttactgaggcaag

SEQ ID NO: 321562 - DNA, 20 bp, Artificial Sequence
  chemically synthesized
gcagatctagttactgaggc

SEQ ID NO: 321563 - DNA, 20 bp, Artificial Sequence
  chemically synthesized
tacctacttgcctcagtaac

SEQ ID NO: 321564 - DNA, 20 bp, Artificial Sequence
  chemically synthesized
gaaagcagatctagttactg

SEQ ID NO: 321565 - DNA, 20 bp, Artificial Sequence
  chemically synthesized
ggaaagcagatctagttact

SEQ ID NO: 321566 - DNA, 20 bp, Artificial Sequence
  chemically synthesized
aatttggaggaaagcagatc

SEQ ID NO: 321567 - DNA, 20 bp, Artificial Sequence
  chemically synthesized
taccagaatttggaggaaag

SEQ ID NO: 321568 - DNA, 20 bp, Artificial Sequence
  chemically synthesized
gaataccagaatttggagga

SEQ ID NO: 321569 - DNA, 20 bp, Artificial Sequence
  chemically synthesized
taaggaataccagaatttgg

SEQ ID NO: 321570 - DNA, 20 bp, Artificial Sequence
  chemically synthesized
atctgctttcctccaaattc

SEQ ID NO: 321571 - DNA, 20 bp, Artificial Sequence
  chemically synthesized
gtaaggaataccagaatttg

SEQ ID NO: 321572 - DNA, 20 bp, Artificial Sequence
  chemically synthesized
tagtaaggaataccagaatt

SEQ ID NO: 321573 - DNA, 20 bp, Artificial Sequence
  chemically synthesized
ctgagtctagtaaggaatac

SEQ ID NO: 321574 - DNA, 20 bp, Artificial Sequence
  chemically synthesized
caaattctggtattccttac

SEQ ID NO: 321575 - DNA, 20 bp, Artificial Sequence
  chemically synthesized
ctttgcagctgagtctagta

SEQ ID NO: 321576 - DNA, 20 bp, Artificial Sequence
  chemically synthesized
gctttgcagctgagtctagt

SEQ ID NO: 321577 - DNA, 20 bp, Artificial Sequence
  chemically synthesized
ctggtattccttactagact

SEQ ID NO: 321578 - DNA, 20 bp, Artificial Sequence
  chemically synthesized
tcaggctttgcagctgagtc

SEQ ID NO: 321579 - DNA, 20 bp, Artificial Sequence
  chemically synthesized
ccttactagactcagctgca

SEQ ID NO: 321580 - DNA, 20 bp, Artificial Sequence
  chemically synthesized
cagtgtcaggctttgcagct

SEQ ID NO: 321581 - DNA, 20 bp, Artificial Sequence
  chemically synthesized
ccatgcagtgtcaggctttg

SEQ ID NO: 321582 - DNA, 20 bp, Artificial Sequence
  chemically synthesized
ccgtgacaccatgcagtgtc

SEQ ID NO: 321583 - DNA, 20 bp, Artificial Sequence
  chemically synthesized
accgtgacaccatgcagtgt

SEQ ID NO: 321584 - DNA, 20 bp, Artificial Sequence
  chemically synthesized
ctgcaaagcctgacactgca

SEQ ID NO: 321585 - DNA, 20 bp, Artificial Sequence
  chemically synthesized
atacacaccgtgacaccatg

SEQ ID NO: 321586 - DNA, 20 bp, Artificial Sequence
  chemically synthesized
cctgacactgcatggtgtca

SEQ ID NO: 321587 - DNA, 20 bp, Artificial Sequence
  chemically synthesized
gtcacggtgtgtataaatct

SEQ ID NO: 321588 - DNA, 20 bp, Artificial Sequence
  chemically synthesized
tcacggtgtgtataaatctt

SEQ ID NO: 321589 - DNA, 20 bp, Artificial Sequence
  chemically synthesized
aaactactatattagtgcct

SEQ ID NO: 321590 - DNA, 20 bp, Artificial Sequence
  chemically synthesized
ataaatcttaggcactaata

SEQ ID NO: 321591 - DNA, 20 bp, Artificial Sequence
  chemically synthesized
aatcttaggcactaatatag

SEQ ID NO: 321592 - DNA, 20 bp, Artificial Sequence
  chemically synthesized
tccaatggaaactactatat

SEQ ID NO: 321593 - DNA, 20 bp, Artificial Sequence
  chemically synthesized
actaatatagtagtttccat

SEQ ID NO: 321594 - DNA, 20 bp, Artificial Sequence
  chemically synthesized
taatatagtagtttccattg

SEQ ID NO: 321595 - DNA, 20 bp, Artificial Sequence
  chemically synthesized
tgcctcacttcattctccaa

SEQ ID NO: 321596 - DNA, 20 bp, Artificial Sequence
  chemically synthesized
gtagtttccattggagaatg

SEQ ID NO: 321597 - DNA, 20 bp, Artificial Sequence
  chemically synthesized
tttccattggagaatgaagt

SEQ ID NO: 321598 - DNA, 20 bp, Artificial Sequence
  chemically synthesized
ttccattggagaatgaagtg

SEQ ID NO: 321599 - DNA, 20 bp, Artificial Sequence
  chemically synthesized
attggagaatgaagtgaggc

SEQ ID NO: 321600 - DNA, 20 bp, Artificial Sequence
  chemically synthesized
ttggagaatgaagtgaggca

SEQ ID NO: 321601 - DNA, 20 bp, Artificial Sequence
  chemically synthesized
taaaaactgtataattttgt

SEQ ID NO: 321602 - DNA, 20 bp, Artificial Sequence
  chemically synthesized
caaggtctgacaaaattata

SEQ ID NO: 321603 - DNA, 20 bp, Artificial Sequence
  chemically synthesized
atgaacacattagttttagg

SEQ ID NO: 321604 - DNA, 20 bp, Artificial Sequence
  chemically synthesized
aatgaacacattagttttag

SEQ ID NO: 321605 - DNA, 20 bp, Artificial Sequence
  chemically synthesized
gaatgaacacattagtttta

SEQ ID NO: 321606 - DNA, 20 bp, Artificial Sequence
  chemically synthesized
agaatgaacacattagtttt

SEQ ID NO: 321607 - DNA, 20 bp, Artificial Sequence
  chemically synthesized
gagaatgaacacattagttt

SEQ ID NO: 321608 - DNA, 20 bp, Artificial Sequence
  chemically synthesized
aaagaggagaatgaacacat

SEQ ID NO: 321609 - DNA, 20 bp, Artificial Sequence
  chemically synthesized
tgtgttcattctcctcttta

SEQ ID NO: 321610 - DNA, 20 bp, Artificial Sequence
  chemically synthesized
aaagaaggtgctgtaaagag

SEQ ID NO: 321611 - DNA, 20 bp, Artificial Sequence
  chemically synthesized
ggaaagaaggtgctgtaaag

SEQ ID NO: 321612 - DNA, 20 bp, Artificial Sequence
  chemically synthesized
gggaaagaaggtgctgtaaa

SEQ ID NO: 321613 - DNA, 20 bp, Artificial Sequence
  chemically synthesized
ttgggaaagaaggtgctgta

SEQ ID NO: 321614 - DNA, 20 bp, Artificial Sequence
  chemically synthesized
atacttcgtgttgggaaaga

SEQ ID NO: 321615 - DNA, 20 bp, Artificial Sequence
  chemically synthesized
catacttcgtgttgggaaag

SEQ ID NO: 321616 - DNA, 20 bp, Artificial Sequence
  chemically synthesized
cagcatacttcgtgttggga

SEQ ID NO: 321617 - DNA, 20 bp, Artificial Sequence
  chemically synthesized
gcaccttctttcccaacacg

SEQ ID NO: 321618 - DNA, 20 bp, Artificial Sequence
  chemically synthesized
atgtcagcatacttcgtgtt

SEQ ID NO: 321619 - DNA, 20 bp, Artificial Sequence
  chemically synthesized
gatgtcagcatacttcgtgt

SEQ ID NO: 321620 - DNA, 20 bp, Artificial Sequence
  chemically synthesized
cacgaagtatgctgacatct

SEQ ID NO: 321621 - DNA, 20 bp, Artificial Sequence
  chemically synthesized
acgaagtatgctgacatctt

SEQ ID NO: 321622 - DNA, 20 bp, Artificial Sequence
  chemically synthesized
tctttcctagcccaagatgt

SEQ ID NO: 321623 - DNA, 20 bp, Artificial Sequence
  chemically synthesized
agtatgctgacatcttgggc

SEQ ID NO: 321624 - DNA, 20 bp, Artificial Sequence
  chemically synthesized
gtatgctgacatcttgggct

SEQ ID NO: 321625 - DNA, 20 bp, Artificial Sequence
  chemically synthesized
cttggcttctttcctagccc

SEQ ID NO: 321626 - DNA, 20 bp, Artificial Sequence
  chemically synthesized
gctgacatcttgggctagga

SEQ ID NO: 321627 - DNA, 20 bp, Artificial Sequence
  chemically synthesized
gacatcttgggctaggaaag

SEQ ID NO: 321628 - DNA, 20 bp, Artificial Sequence
  chemically synthesized
gctctccttggcttctttcc

SEQ ID NO: 321629 - DNA, 20 bp, Artificial Sequence
  chemically synthesized
cttgggctaggaaagaagcc

SEQ ID NO: 321630 - DNA, 20 bp, Artificial Sequence
  chemically synthesized
ttgggctaggaaagaagcca

SEQ ID NO: 321631 - DNA, 20 bp, Artificial Sequence
  chemically synthesized
gggctaggaaagaagccaag

SEQ ID NO: 321632 - DNA, 20 bp, Artificial Sequence
  chemically synthesized
gctaggaaagaagccaagga

SEQ ID NO: 321633 - DNA, 20 bp, Artificial Sequence
  chemically synthesized
gatacatgacatgctctcct

SEQ ID NO: 321634 - DNA, 20 bp, Artificial Sequence
  chemically synthesized
taataactatggcaattagt

SEQ ID NO: 321635 - DNA, 20 bp, Artificial Sequence
  chemically synthesized
ataataactatggcaattag

SEQ ID NO: 321636 - DNA, 20 bp, Artificial Sequence
  chemically synthesized
aaaattcccactaattgcca

SEQ ID NO: 321637 - DNA, 20 bp, Artificial Sequence
  chemically synthesized
agtataataactatggcaat

SEQ ID NO: 321638 - DNA, 20 bp, Artificial Sequence
  chemically synthesized
agggtgcagtataataacta

SEQ ID NO: 321639 - DNA, 20 bp, Artificial Sequence
  chemically synthesized
caagatcaggttgcagggtg

SEQ ID NO: 321640 - DNA, 20 bp, Artificial Sequence
  chemically synthesized
acctccaagatcaggttgca

SEQ ID NO: 321641 - DNA, 20 bp, Artificial Sequence
  chemically synthesized
gacctccaagatcaggttgc

SEQ ID NO: 321642 - DNA, 20 bp, Artificial Sequence
  chemically synthesized
tgacctccaagatcaggttg

SEQ ID NO: 321643 - DNA, 20 bp, Artificial Sequence
  chemically synthesized
tgcaccctgcaacctgatct

SEQ ID NO: 321644 - DNA, 20 bp, Artificial Sequence
  chemically synthesized
caccctgcaacctgatcttg

SEQ ID NO: 321645 - DNA, 20 bp, Artificial Sequence
  chemically synthesized
aaagtttgacctccaagatc

SEQ ID NO: 321646 - DNA, 20 bp, Artificial Sequence
  chemically synthesized
accctgcaacctgatcttgg

SEQ ID NO: 321647 - DNA, 20 bp, Artificial Sequence
  chemically synthesized
taaagtttgacctccaagat

SEQ ID NO: 321648 - DNA, 20 bp, Artificial Sequence
  chemically synthesized
taatttaaagtttgacctcc

SEQ ID NO: 321649 - DNA, 20 bp, Artificial Sequence
  chemically synthesized
tactgtgaggttgtaattta

SEQ ID NO: 321650 - DNA, 20 bp, Artificial Sequence
  chemically synthesized
aactttaaattacaacctca

SEQ ID NO: 321651 - DNA, 20 bp, Artificial Sequence
  chemically synthesized
tttctgaactatttactgtg

SEQ ID NO: 321652 - DNA, 20 bp, Artificial Sequence
  chemically synthesized
ctttctgaactatttactgt

SEQ ID NO: 321653 - DNA, 20 bp, Artificial Sequence
  chemically synthesized
aattacaacctcacagtaaa

SEQ ID NO: 321654 - DNA, 20 bp, Artificial Sequence
  chemically synthesized
caacctcacagtaaatagtt

SEQ ID NO: 321655 - DNA, 20 bp, Artificial Sequence
  chemically synthesized
ctcacagtaaatagttcaga

SEQ ID NO: 321656 - DNA, 20 bp, Artificial Sequence
  chemically synthesized
ttcagaaagaacctaatata

SEQ ID NO: 321657 - DNA, 20 bp, Artificial Sequence
  chemically synthesized
tggatggggaactttatatt

SEQ ID NO: 321658 - DNA, 20 bp, Artificial Sequence
  chemically synthesized
ttggatggggaactttatat

SEQ ID NO: 321659 - DNA, 20 bp, Artificial Sequence
  chemically synthesized
tcatttctagttgttggatg

SEQ ID NO: 321660 - DNA, 20 bp, Artificial Sequence
  chemically synthesized
ttcatttctagttgttggat

SEQ ID NO: 321661 - DNA, 20 bp, Artificial Sequence
  chemically synthesized
cttcatttctagttgttgga

SEQ ID NO: 321662 - DNA, 20 bp, Artificial Sequence
  chemically synthesized
aaagttccccatccaacaac

SEQ ID NO: 321663 - DNA, 20 bp, Artificial Sequence
  chemically synthesized
tttccttcatttctagttgt

SEQ ID NO: 321664 - DNA, 20 bp, Artificial Sequence
  chemically synthesized
ccatccaacaactagaaatg

SEQ ID NO: 321665 - DNA, 20 bp, Artificial Sequence
  chemically synthesized
catccaacaactagaaatga

SEQ ID NO: 321666 - DNA, 20 bp, Artificial Sequence
  chemically synthesized
ggaacattttccttcatttc

SEQ ID NO: 321667 - DNA, 20 bp, Artificial Sequence
  chemically synthesized
agaaatgaaggaaaatgttc

SEQ ID NO: 321668 - DNA, 20 bp, Artificial Sequence
  chemically synthesized
tgtttaattttgtgaaaaac

SEQ ID NO: 321669 - DNA, 20 bp, Artificial Sequence
  chemically synthesized
ttaagtaggaaaataaatgt

SEQ ID NO: 321670 - DNA, 20 bp, Artificial Sequence
  chemically synthesized
acatttattttcctacttaa

SEQ ID NO: 321671 - DNA, 20 bp, Artificial Sequence
  chemically synthesized
tttctcacattccattaagt

SEQ ID NO: 321672 - DNA, 20 bp, Artificial Sequence
  chemically synthesized
atttctcacattccattaag

SEQ ID NO: 321673 - DNA, 20 bp, Artificial Sequence
  chemically synthesized
actatttctcacattccatt

SEQ ID NO: 321674 - DNA, 20 bp, Artificial Sequence
  chemically synthesized
tttcctacttaatggaatgt

SEQ ID NO: 321675 - DNA, 20 bp, Artificial Sequence
  chemically synthesized
acttaatggaatgtgagaaa

SEQ ID NO: 321676 - DNA, 20 bp, Artificial Sequence
  chemically synthesized
ttcgattttctcatagaatt

SEQ ID NO: 321677 - DNA, 20 bp, Artificial Sequence
  chemically synthesized
gtttttatactgaattctat

SEQ ID NO: 321678 - DNA, 20 bp, Artificial Sequence
  chemically synthesized
acacattttcgattttctca

SEQ ID NO: 321679 - DNA, 20 bp, Artificial Sequence
  chemically synthesized
atggaggacaaaaatggatc

SEQ ID NO: 321680 - DNA, 20 bp, Artificial Sequence
  chemically synthesized
gatggaggacaaaaatggat

SEQ ID NO: 321681 - DNA, 20 bp, Artificial Sequence
  chemically synthesized
atatggatggaggacaaaaa

SEQ ID NO: 321682 - DNA, 20 bp, Artificial Sequence
  chemically synthesized
ctgttcagctatatggatgg

SEQ ID NO: 321683 - DNA, 20 bp, Artificial Sequence
  chemically synthesized
actgttcagctatatggatg

SEQ ID NO: 321684 - DNA, 20 bp, Artificial Sequence
  chemically synthesized
atttttgtcctccatccata

SEQ ID NO: 321685 - DNA, 20 bp, Artificial Sequence
  chemically synthesized
aaactgttcagctatatgga

SEQ ID NO: 321686 - DNA, 20 bp, Artificial Sequence
  chemically synthesized
aattaaactgttcagctata

SEQ ID NO: 321687 - DNA, 20 bp, Artificial Sequence
  chemically synthesized
cctccatccatatagctgaa

SEQ ID NO: 321688 - DNA, 20 bp, Artificial Sequence
  chemically synthesized
atattaataattaaactgtt

SEQ ID NO: 321689 - DNA, 20 bp, Artificial Sequence
  chemically synthesized
ttaatatttttcaactatcc

SEQ ID NO: 321690 - DNA, 20 bp, Artificial Sequence
  chemically synthesized
taatatttttcaactatccg

SEQ ID NO: 321691 - DNA, 20 bp, Artificial Sequence
  chemically synthesized
aactttaatgttgcctcgga

SEQ ID NO: 321692 - DNA, 20 bp, Artificial Sequence
  chemically synthesized
tttgaactttaatgttgcct

SEQ ID NO: 321693 - DNA, 20 bp, Artificial Sequence
  chemically synthesized
aactatccgaggcaacatta

SEQ ID NO: 321694 - DNA, 20 bp, Artificial Sequence
  chemically synthesized
tcattttgaaaacataaatt

SEQ ID NO: 321695 - DNA, 20 bp, Artificial Sequence
  chemically synthesized
ttgaaaacataaattcagtt

SEQ ID NO: 321696 - DNA, 20 bp, Artificial Sequence
  chemically synthesized
agtttagtaacaataacata

SEQ ID NO: 321697 - DNA, 20 bp, Artificial Sequence
  chemically synthesized
ttagtaacaataacataaag

SEQ ID NO: 321698 - DNA, 20 bp, Artificial Sequence
  chemically synthesized
aataacataaagaagctgcg

SEQ ID NO: 321699 - DNA, 20 bp, Artificial Sequence
  chemically synthesized
acataaagaagctgcgtggc

SEQ ID NO: 321700 - DNA, 20 bp, Artificial Sequence
  chemically synthesized
atcttttgcatccagccacg

SEQ ID NO: 321701 - DNA, 20 bp, Artificial Sequence
  chemically synthesized
agctgcgtggctggatgcaa

SEQ ID NO: 321702 - DNA, 20 bp, Artificial Sequence
  chemically synthesized
ggccaagaatcttttgcatc

SEQ ID NO: 321703 - DNA, 20 bp, Artificial Sequence
  chemically synthesized
ggctggatgcaaaagattct

SEQ ID NO: 321704 - DNA, 20 bp, Artificial Sequence
  chemically synthesized
ggatgcaaaagattcttggc

SEQ ID NO: 321705 - DNA, 20 bp, Artificial Sequence
  chemically synthesized
gatgcaaaagattcttggcc

SEQ ID NO: 321706 - DNA, 20 bp, Artificial Sequence
  chemically synthesized
atgagccaccacgcctggcc

SEQ ID NO: 321707 - DNA, 20 bp, Artificial Sequence
  chemically synthesized
aaaagattcttggccaggcg

SEQ ID NO: 321708 - DNA, 20 bp, Artificial Sequence
  chemically synthesized
agattcttggccaggcgtgg

SEQ ID NO: 321709 - DNA, 20 bp, Artificial Sequence
  chemically synthesized
caggcatgagccaccacgcc

SEQ ID NO: 321710 - DNA, 20 bp, Artificial Sequence
  chemically synthesized
agtgctgggattacaggcat

SEQ ID NO: 321711 - DNA, 20 bp, Artificial Sequence
  chemically synthesized
gtggctcatgcctgtaatcc

SEQ ID NO: 321712 - DNA, 20 bp, Artificial Sequence
  chemically synthesized
agcctcagtgctgggattac

SEQ ID NO: 321713 - DNA, 20 bp, Artificial Sequence
  chemically synthesized
cagcctcagtgctgggatta

SEQ ID NO: 321714 - DNA, 20 bp, Artificial Sequence
  chemically synthesized
atgcctgtaatcccagcact

SEQ ID NO: 321715 - DNA, 20 bp, Artificial Sequence
  chemically synthesized
tgcctgtaatcccagcactg

SEQ ID NO: 321716 - DNA, 20 bp, Artificial Sequence
  chemically synthesized
gcctcctcagcctcagtgct

SEQ ID NO: 321717 - DNA, 20 bp, Artificial Sequence
  chemically synthesized
agcctcctcagcctcagtgc

SEQ ID NO: 321718 - DNA, 20 bp, Artificial Sequence
  chemically synthesized
gtaatcccagcactgaggct

SEQ ID NO: 321719 - DNA, 20 bp, Artificial Sequence
  chemically synthesized
taatcccagcactgaggctg

SEQ ID NO: 321720 - DNA, 20 bp, Artificial Sequence
  chemically synthesized
tgccttagcctcctcagcct

SEQ ID NO: 321721 - DNA, 20 bp, Artificial Sequence
  chemically synthesized
atcccagcactgaggctgag

SEQ ID NO: 321722 - DNA, 20 bp, Artificial Sequence
  chemically synthesized
tcccagcactgaggctgagg

SEQ ID NO: 321723 - DNA, 20 bp, Artificial Sequence
  chemically synthesized
tccacctgccttagcctcct

SEQ ID NO: 321724 - DNA, 20 bp, Artificial Sequence
  chemically synthesized
gcactgaggctgaggaggct

SEQ ID NO: 321725 - DNA, 20 bp, Artificial Sequence
  chemically synthesized
cactgaggctgaggaggcta

SEQ ID NO: 321726 - DNA, 20 bp, Artificial Sequence
  chemically synthesized
tgaggctgaggaggctaagg

SEQ ID NO: 321727 - DNA, 20 bp, Artificial Sequence
  chemically synthesized
gaggctgaggaggctaaggc

SEQ ID NO: 321728 - DNA, 20 bp, Artificial Sequence
  chemically synthesized
gctgaggaggctaaggcagg

SEQ ID NO: 321729 - DNA, 20 bp, Artificial Sequence
  chemically synthesized
acctcgtgatccacctgcct

SEQ ID NO: 321730 - DNA, 20 bp, Artificial Sequence
  chemically synthesized
ggctaaggcaggtggatcac

SEQ ID NO: 321731 - DNA, 20 bp, Artificial Sequence
  chemically synthesized
gctaaggcaggtggatcacg

SEQ ID NO: 321732 - DNA, 20 bp, Artificial Sequence
  chemically synthesized
aggcaggtggatcacgaggt

SEQ ID NO: 321733 - DNA, 20 bp, Artificial Sequence
  chemically synthesized
ggcaggtggatcacgaggtc

SEQ ID NO: 321734 - DNA, 20 bp, Artificial Sequence
  chemically synthesized
caggtggatcacgaggtcag

SEQ ID NO: 321735 - DNA, 20 bp, Artificial Sequence
  chemically synthesized
aggtggatcacgaggtcagg

SEQ ID NO: 321736 - DNA, 20 bp, Artificial Sequence
  chemically synthesized
gatcacgaggtcaggaggtc

SEQ ID NO: 321737 - DNA, 20 bp, Artificial Sequence
  chemically synthesized
tttcaccatgttattcagga

SEQ ID NO: 321738 - DNA, 20 bp, Artificial Sequence
  chemically synthesized
ggggtttcaccatgttattc

SEQ ID NO: 321739 - DNA, 20 bp, Artificial Sequence
  chemically synthesized
cgagaccatcctgaataaca

SEQ ID NO: 321740 - DNA, 20 bp, Artificial Sequence
  chemically synthesized
cggggtttcaccatgttatt

SEQ ID NO: 321741 - DNA, 20 bp, Artificial Sequence
  chemically synthesized
ttgtatttttagtagagacg

SEQ ID NO: 321742 - DNA, 20 bp, Artificial Sequence
  chemically synthesized
tttgtatttttagtagagac

SEQ ID NO: 321743 - DNA, 20 bp, Artificial Sequence
  chemically synthesized
ttttgtatttttagtagaga

SEQ ID NO: 321744 - DNA, 20 bp, Artificial Sequence
  chemically synthesized
aactttttgtatttttagta

SEQ ID NO: 321745 - DNA, 20 bp, Artificial Sequence
  chemically synthesized
ctaactttttgtatttttag

SEQ ID NO: 321746 - DNA, 20 bp, Artificial Sequence
  chemically synthesized
cggctaactttttgtatttt

SEQ ID NO: 321747 - DNA, 20 bp, Artificial Sequence
  chemically synthesized
gtctctactaaaaatacaaa

SEQ ID NO: 321748 - DNA, 20 bp, Artificial Sequence
  chemically synthesized
ctactaaaaatacaaaaagt

SEQ ID NO: 321749 - DNA, 20 bp, Artificial Sequence
  chemically synthesized
aaaaatacaaaaagttagcc

SEQ ID NO: 321750 - DNA, 20 bp, Artificial Sequence
  chemically synthesized
tacaaaaagttagccgagcg

SEQ ID NO: 321751 - DNA, 20 bp, Artificial Sequence
  chemically synthesized
aaaaagttagccgagcgtgg

SEQ ID NO: 321752 - DNA, 20 bp, Artificial Sequence
  chemically synthesized
caggtgcccgccaccacgct

SEQ ID NO: 321753 - DNA, 20 bp, Artificial Sequence
  chemically synthesized
aagttagccgagcgtggtgg

SEQ ID NO: 321754 - DNA, 20 bp, Artificial Sequence
  chemically synthesized
agttagccgagcgtggtggc

SEQ ID NO: 321755 - DNA, 20 bp, Artificial Sequence
  chemically synthesized
agcgtggtggcgggcacctg

SEQ ID NO: 321756 - DNA, 20 bp, Artificial Sequence
  chemically synthesized
tccccagtagttgggactac

SEQ ID NO: 321757 - DNA, 20 bp, Artificial Sequence
  chemically synthesized
ctccccagtagttgggacta

SEQ ID NO: 321758 - DNA, 20 bp, Artificial Sequence
  chemically synthesized
gcacctgtagtcccaactac

SEQ ID NO: 321759 - DNA, 20 bp, Artificial Sequence
  chemically synthesized
cacctgtagtcccaactact

SEQ ID NO: 321760 - DNA, 20 bp, Artificial Sequence
  chemically synthesized
gttcagcctccccagtagtt

SEQ ID NO: 321761 - DNA, 20 bp, Artificial Sequence
  chemically synthesized
acctgtagtcccaactactg

SEQ ID NO: 321762 - DNA, 20 bp, Artificial Sequence
  chemically synthesized
ggttcagcctccccagtagt

SEQ ID NO: 321763 - DNA, 20 bp, Artificial Sequence
  chemically synthesized
ctgtagtcccaactactggg

SEQ ID NO: 321764 - DNA, 20 bp, Artificial Sequence
  chemically synthesized
tgtagtcccaactactgggg

SEQ ID NO: 321765 - DNA, 20 bp, Artificial Sequence
  chemically synthesized
tcctggttcagcctccccag

SEQ ID NO: 321766 - DNA, 20 bp, Artificial Sequence
  chemically synthesized
ttctcctggttcagcctccc

SEQ ID NO: 321767 - DNA, 20 bp, Artificial Sequence
  chemically synthesized
aactactggggaggctgaac

SEQ ID NO: 321768 - DNA, 20 bp, Artificial Sequence
  chemically synthesized
actactggggaggctgaacc

SEQ ID NO: 321769 - DNA, 20 bp, Artificial Sequence
  chemically synthesized
tactggggaggctgaaccag

SEQ ID NO: 321770 - DNA, 20 bp, Artificial Sequence
  chemically synthesized
ttcacgccattctcctggtt

SEQ ID NO: 321771 - DNA, 20 bp, Artificial Sequence
  chemically synthesized
gggaggctgaaccaggagaa

SEQ ID NO: 321772 - DNA, 20 bp, Artificial Sequence
  chemically synthesized
ccgggttcacgccattctcc

SEQ ID NO: 321773 - DNA, 20 bp, Artificial Sequence
  chemically synthesized
ccaggagaatggcgtgaacc

SEQ ID NO: 321774 - DNA, 20 bp, Artificial Sequence
  chemically synthesized
caggagaatggcgtgaaccc

SEQ ID NO: 321775 - DNA, 20 bp, Artificial Sequence
  chemically synthesized
aggagaatggcgtgaacccg

SEQ ID NO: 321776 - DNA, 20 bp, Artificial Sequence
  chemically synthesized
ggagaatggcgtgaacccgg

SEQ ID NO: 321777 - DNA, 20 bp, Artificial Sequence
  chemically synthesized
gagaatggcgtgaacccggg

SEQ ID NO: 321778 - DNA, 20 bp, Artificial Sequence
  chemically synthesized
aatggcgtgaacccgggggg

SEQ ID NO: 321779 - DNA, 20 bp, Artificial Sequence
  chemically synthesized
cactgcaagctccgcccccc

SEQ ID NO: 321780 - DNA, 20 bp, Artificial Sequence
  chemically synthesized
tggcgtgaacccggggggcg

SEQ ID NO: 321781 - DNA, 20 bp, Artificial Sequence
  chemically synthesized
tcactgcaagctccgccccc

SEQ ID NO: 321782 - DNA, 20 bp, Artificial Sequence
  chemically synthesized
aacccggggggcggagcttg

SEQ ID NO: 321783 - DNA, 20 bp, Artificial Sequence
  chemically synthesized
cggggggcggagcttgcagt

SEQ ID NO: 321784 - DNA, 20 bp, Artificial Sequence
  chemically synthesized
gcgctatctcggctcactgc

SEQ ID NO: 321785 - DNA, 20 bp, Artificial Sequence
  chemically synthesized
ggcggagcttgcagtgagcc

SEQ ID NO: 321786 - DNA, 20 bp, Artificial Sequence
  chemically synthesized
gagcttgcagtgagccgaga

SEQ ID NO: 321787 - DNA, 20 bp, Artificial Sequence
  chemically synthesized
ggagtgcagtggcgctatct

SEQ ID NO: 321788 - DNA, 20 bp, Artificial Sequence
  chemically synthesized
tctcccaggctggagtgcag

SEQ ID NO: 321789 - DNA, 20 bp, Artificial Sequence
  chemically synthesized
gagatagcgccactgcactc

SEQ ID NO: 321790 - DNA, 20 bp, Artificial Sequence
  chemically synthesized
ctgtctcccaggctggagtg

SEQ ID NO: 321791 - DNA, 20 bp, Artificial Sequence
  chemically synthesized
agcgccactgcactccagcc

SEQ ID NO: 321792 - DNA, 20 bp, Artificial Sequence
  chemically synthesized
gcgccactgcactccagcct

SEQ ID NO: 321793 - DNA, 20 bp, Artificial Sequence
  chemically synthesized
tctccctgtctcccaggctg

SEQ ID NO: 321794 - DNA, 20 bp, Artificial Sequence
  chemically synthesized
gccactgcactccagcctgg

SEQ ID NO: 321795 - DNA, 20 bp, Artificial Sequence
  chemically synthesized
agtctccctgtctcccaggc

SEQ ID NO: 321796 - DNA, 20 bp, Artificial Sequence
  chemically synthesized
ctgcactccagcctgggaga

SEQ ID NO: 321797 - DNA, 20 bp, Artificial Sequence
  chemically synthesized
tgcactccagcctgggagac

SEQ ID NO: 321798 - DNA, 20 bp, Artificial Sequence
  chemically synthesized
acagagtctccctgtctccc

SEQ ID NO: 321799 - DNA, 20 bp, Artificial Sequence
  chemically synthesized
gcactccagcctgggagaca

SEQ ID NO: 321800 - DNA, 20 bp, Artificial Sequence
  chemically synthesized
gacagagtctccctgtctcc

SEQ ID NO: 321801 - DNA, 20 bp, Artificial Sequence
  chemically synthesized
actccagcctgggagacagg

SEQ ID NO: 321802 - DNA, 20 bp, Artificial Sequence
  chemically synthesized
tttcttttttttttgagaca

SEQ ID NO: 321803 - DNA, 20 bp, Artificial Sequence
  chemically synthesized
tttttcttttttttttgaga

SEQ ID NO: 321804 - DNA, 20 bp, Artificial Sequence
  chemically synthesized
tttctttttctttttttttt

SEQ ID NO: 321805 - DNA, 20 bp, Artificial Sequence
  chemically synthesized
agactctgtctcaaaaaaaa

SEQ ID NO: 321806 - DNA, 20 bp, Artificial Sequence
  chemically synthesized
tgtctcaaaaaaaaaagaaa

SEQ ID NO: 321807 - DNA, 20 bp, Artificial Sequence
  chemically synthesized
aaaaaaaaaagaaaaagaaa

SEQ ID NO: 321808 - DNA, 20 bp, Artificial Sequence
  chemically synthesized
aaaagaaaaagaaaaagaaa

SEQ ID NO: 321809 - DNA, 20 bp, Artificial Sequence
  chemically synthesized
gaaaaagaaaaagattcttg

SEQ ID NO: 321810 - DNA, 20 bp, Artificial Sequence
  chemically synthesized
tgccataatgtatttgccac

SEQ ID NO: 321811 - DNA, 20 bp, Artificial Sequence
  chemically synthesized
ttcttgtggcaaatacatta

SEQ ID NO: 321812 - DNA, 20 bp, Artificial Sequence
  chemically synthesized
aatcaggaagattgatttga

SEQ ID NO: 321813 - DNA, 20 bp, Artificial Sequence
  chemically synthesized
taatcaggaagattgatttg

SEQ ID NO: 321814 - DNA, 20 bp, Artificial Sequence
  chemically synthesized
ttaatcaggaagattgattt

SEQ ID NO: 321815 - DNA, 20 bp, Artificial Sequence
  chemically synthesized
tttaaaagcatttaatcagg

SEQ ID NO: 321816 - DNA, 20 bp, Artificial Sequence
  chemically synthesized
ttctttaaaagcatttaatc

SEQ ID NO: 321817 - DNA, 20 bp, Artificial Sequence
  chemically synthesized
tttctttaaaagcatttaat

SEQ ID NO: 321818 - DNA, 20 bp, Artificial Sequence
  chemically synthesized
ttcctgattaaatgctttta

SEQ ID NO: 321819 - DNA, 20 bp, Artificial Sequence
  chemically synthesized
aatttctttattttctttaa

SEQ ID NO: 321820 - DNA, 20 bp, Artificial Sequence
  chemically synthesized
aaatgcttttaaagaaaata

SEQ ID NO: 321821 - DNA, 20 bp, Artificial Sequence
  chemically synthesized
tttaaagaaaataaagaaat

SEQ ID NO: 321822 - DNA, 20 bp, Artificial Sequence
  chemically synthesized
aaagaaaataaagaaattgg

SEQ ID NO: 321823 - DNA, 20 bp, Artificial Sequence
  chemically synthesized
aagaaattggcagatgtcat

SEQ ID NO: 321824 - DNA, 20 bp, Artificial Sequence
  chemically synthesized
agaaattggcagatgtcatc

SEQ ID NO: 321825 - DNA, 20 bp, Artificial Sequence
  chemically synthesized
aaattggcagatgtcatcag

SEQ ID NO: 321826 - DNA, 20 bp, Artificial Sequence
  chemically synthesized
ggcagatgtcatcaggagcc

SEQ ID NO: 321827 - DNA, 20 bp, Artificial Sequence
  chemically synthesized
gcagatgtcatcaggagcca

SEQ ID NO: 321828 - DNA, 20 bp, Artificial Sequence
  chemically synthesized
gatatattcatatttgtcct

SEQ ID NO: 321829 - DNA, 20 bp, Artificial Sequence
  chemically synthesized
aaatatgaatatatcacgtt

SEQ ID NO: 321830 - DNA, 20 bp, Artificial Sequence
  chemically synthesized
tatgaatatatcacgtttgg

SEQ ID NO: 321831 - DNA, 20 bp, Artificial Sequence
  chemically synthesized
cttactagagataatttaaa

SEQ ID NO: 321832 - DNA, 20 bp, Artificial Sequence
  chemically synthesized
aagactgtttaaattatctc

SEQ ID NO: 321833 - DNA, 20 bp, Artificial Sequence
  chemically synthesized
ctgtttaaattatctctagt

SEQ ID NO: 321834 - DNA, 20 bp, Artificial Sequence
  chemically synthesized
aacattacctattcttacta

SEQ ID NO: 321835 - DNA, 20 bp, Artificial Sequence
  chemically synthesized
taaattatctctagtaagaa

SEQ ID NO: 321836 - DNA, 20 bp, Artificial Sequence
  chemically synthesized
tcaacattacctattcttac

SEQ ID NO: 321837 - DNA, 20 bp, Artificial Sequence
  chemically synthesized
aaattatctctagtaagaat

SEQ ID NO: 321838 - DNA, 20 bp, Artificial Sequence
  chemically synthesized
cataaatgaatagaatttca

SEQ ID NO: 321839 - DNA, 20 bp, Artificial Sequence
  chemically synthesized
cacataaatgaatagaattt

SEQ ID NO: 321840 - DNA, 20 bp, Artificial Sequence
  chemically synthesized
tctatttccacataaatgaa

SEQ ID NO: 321841 - DNA, 20 bp, Artificial Sequence
  chemically synthesized
tgaaattctattcatttatg

SEQ ID NO: 321842 - DNA, 20 bp, Artificial Sequence
  chemically synthesized
tctattcatttatgtggaaa

SEQ ID NO: 321843 - DNA, 20 bp, Artificial Sequence
  chemically synthesized
attcatttatgtggaaatag

SEQ ID NO: 321844 - DNA, 20 bp, Artificial Sequence
  chemically synthesized
aaatttttgaagttgagagt

SEQ ID NO: 321845 - DNA, 20 bp, Artificial Sequence
  chemically synthesized
ggcaaaatttttgaagttga

SEQ ID NO: 321846 - DNA, 20 bp, Artificial Sequence
  chemically synthesized
gtggcaaaatttttgaagtt

SEQ ID NO: 321847 - DNA, 20 bp, Artificial Sequence
  chemically synthesized
atgtagtggcaaaatttttg

SEQ ID NO: 321848 - DNA, 20 bp, Artificial Sequence
  chemically synthesized
tcaaaaattttgccactaca

SEQ ID NO: 321849 - DNA, 20 bp, Artificial Sequence
  chemically synthesized
ctgtgccagatgctatgtag

SEQ ID NO: 321850 - DNA, 20 bp, Artificial Sequence
  chemically synthesized
gcactgtgccagatgctatg

SEQ ID NO: 321851 - DNA, 20 bp, Artificial Sequence
  chemically synthesized
ttttgccactacatagcatc

SEQ ID NO: 321852 - DNA, 20 bp, Artificial Sequence
  chemically synthesized
ccactacatagcatctggca

SEQ ID NO: 321853 - DNA, 20 bp, Artificial Sequence
  chemically synthesized
gtatgtgccaggcactgtgc

SEQ ID NO: 321854 - DNA, 20 bp, Artificial Sequence
  chemically synthesized
atagcatctggcacagtgcc

SEQ ID NO: 321855 - DNA, 20 bp, Artificial Sequence
  chemically synthesized
ttgagtgtgtagtatgtgcc

SEQ ID NO: 321856 - DNA, 20 bp, Artificial Sequence
  chemically synthesized
attgagtgtgtagtatgtgc

SEQ ID NO: 321857 - DNA, 20 bp, Artificial Sequence
  chemically synthesized
agaaatatttattgagtgtg

SEQ ID NO: 321858 - DNA, 20 bp, Artificial Sequence
  chemically synthesized
acattgaagaaatatttatt

SEQ ID NO: 321859 - DNA, 20 bp, Artificial Sequence
  chemically synthesized
gttatactacttatacattg

SEQ ID NO: 321860 - DNA, 20 bp, Artificial Sequence
  chemically synthesized
taaatatttcttcaatgtat

SEQ ID NO: 321861 - DNA, 20 bp, Artificial Sequence
  chemically synthesized
atatttcttcaatgtataag

SEQ ID NO: 321862 - DNA, 20 bp, Artificial Sequence
  chemically synthesized
actatgtcttgttcataatt

SEQ ID NO: 321863 - DNA, 20 bp, Artificial Sequence
  chemically synthesized
agtataacttaattatgaac

SEQ ID NO: 321864 - DNA, 20 bp, Artificial Sequence
  chemically synthesized
acttaattatgaacaagaca

SEQ ID NO: 321865 - DNA, 20 bp, Artificial Sequence
  chemically synthesized
atagttttgatatttctgat

SEQ ID NO: 321866 - DNA, 20 bp, Artificial Sequence
  chemically synthesized
tagttttgatatttctgatt

SEQ ID NO: 321867 - DNA, 20 bp, Artificial Sequence
  chemically synthesized
ttagtacaaaaattcccaat

SEQ ID NO: 321868 - DNA, 20 bp, Artificial Sequence
  chemically synthesized
tgattgggaatttttgtact

SEQ ID NO: 321869 - DNA, 20 bp, Artificial Sequence
  chemically synthesized
agaagttgacattttaatct

SEQ ID NO: 321870 - DNA, 20 bp, Artificial Sequence
  chemically synthesized
tcagagagcagatttaatag

SEQ ID NO: 321871 - DNA, 20 bp, Artificial Sequence
  chemically synthesized
atctcagagagcagatttaa

SEQ ID NO: 321872 - DNA, 20 bp, Artificial Sequence
  chemically synthesized
ttctattaaatctgctctct

SEQ ID NO: 321873 - DNA, 20 bp, Artificial Sequence
  chemically synthesized
taatagactatctcagagag

SEQ ID NO: 321874 - DNA, 20 bp, Artificial Sequence
  chemically synthesized
attaaatctgctctctgaga

SEQ ID NO: 321875 - DNA, 20 bp, Artificial Sequence
  chemically synthesized
aactaatagactatctcaga

SEQ ID NO: 321876 - DNA, 20 bp, Artificial Sequence
  chemically synthesized
taaactaatagactatctca

SEQ ID NO: 321877 - DNA, 20 bp, Artificial Sequence
  chemically synthesized
attaaactaatagactatct

SEQ ID NO: 321878 - DNA, 20 bp, Artificial Sequence
  chemically synthesized
tgctctctgagatagtctat

SEQ ID NO: 321879 - DNA, 20 bp, Artificial Sequence
  chemically synthesized
aacaattcaaattaaactaa

SEQ ID NO: 321880 - DNA, 20 bp, Artificial Sequence
  chemically synthesized
atttgaattgttccaacccc

SEQ ID NO: 321881 - DNA, 20 bp, Artificial Sequence
  chemically synthesized
actgggtaacagccaggggt

SEQ ID NO: 321882 - DNA, 20 bp, Artificial Sequence
  chemically synthesized
tggaactgggtaacagccag

SEQ ID NO: 321883 - DNA, 20 bp, Artificial Sequence
  chemically synthesized
ttggaactgggtaacagcca

SEQ ID NO: 321884 - DNA, 20 bp, Artificial Sequence
  chemically synthesized
tttggaactgggtaacagcc

SEQ ID NO: 321885 - DNA, 20 bp, Artificial Sequence
  chemically synthesized
ctttggaactgggtaacagc

SEQ ID NO: 321886 - DNA, 20 bp, Artificial Sequence
  chemically synthesized
tccaacccctggctgttacc

SEQ ID NO: 321887 - DNA, 20 bp, Artificial Sequence
  chemically synthesized
gtgactttggaactgggtaa

SEQ ID NO: 321888 - DNA, 20 bp, Artificial Sequence
  chemically synthesized
ctggctgttacccagttcca

SEQ ID NO: 321889 - DNA, 20 bp, Artificial Sequence
  chemically synthesized
gtggaagtgactttggaact

SEQ ID NO: 321890 - DNA, 20 bp, Artificial Sequence
  chemically synthesized
cgtggaagtgactttggaac

SEQ ID NO: 321891 - DNA, 20 bp, Artificial Sequence
  chemically synthesized
cgaacacgtggaagtgactt

SEQ ID NO: 321892 - DNA, 20 bp, Artificial Sequence
  chemically synthesized
aaagatacccgaacacgtgg

SEQ ID NO: 321893 - DNA, 20 bp, Artificial Sequence
  chemically synthesized
caaagtcacttccacgtgtt

SEQ ID NO: 321894 - DNA, 20 bp, Artificial Sequence
  chemically synthesized
aaagtcacttccacgtgttc

SEQ ID NO: 321895 - DNA, 20 bp, Artificial Sequence
  chemically synthesized
tataaagatacccgaacacg

SEQ ID NO: 321896 - DNA, 20 bp, Artificial Sequence
  chemically synthesized
cacgtgttcgggtatcttta

SEQ ID NO: 321897 - DNA, 20 bp, Artificial Sequence
  chemically synthesized
gtgttcgggtatctttatag

SEQ ID NO: 321898 - DNA, 20 bp, Artificial Sequence
  chemically synthesized
gagagtggggtgctgctata

SEQ ID NO: 321899 - DNA, 20 bp, Artificial Sequence
  chemically synthesized
cattggtaccgcagagagtg

SEQ ID NO: 321900 - DNA, 20 bp, Artificial Sequence
  chemically synthesized
acattggtaccgcagagagt

SEQ ID NO: 321901 - DNA, 20 bp, Artificial Sequence
  chemically synthesized
tagcagcaccccactctctg

SEQ ID NO: 321902 - DNA, 20 bp, Artificial Sequence
  chemically synthesized
tacattggtaccgcagagag

SEQ ID NO: 321903 - DNA, 20 bp, Artificial Sequence
  chemically synthesized
cagtacattggtaccgcaga

SEQ ID NO: 321904 - DNA, 20 bp, Artificial Sequence
  chemically synthesized
tacagtacattggtaccgca

SEQ ID NO: 321905 - DNA, 20 bp, Artificial Sequence
  chemically synthesized
agtacagtacattggtaccg

SEQ ID NO: 321906 - DNA, 20 bp, Artificial Sequence
  chemically synthesized
aacagactagtacagtacat

SEQ ID NO: 321907 - DNA, 20 bp, Artificial Sequence
  chemically synthesized
gcggtaccaatgtactgtac

SEQ ID NO: 321908 - DNA, 20 bp, Artificial Sequence
  chemically synthesized
agcgtgagaacagactagta

SEQ ID NO: 321909 - DNA, 20 bp, Artificial Sequence
  chemically synthesized
ttagcagcgtgagaacagac

SEQ ID NO: 321910 - DNA, 20 bp, Artificial Sequence
  chemically synthesized
tttaattagcagcgtgagaa

SEQ ID NO: 321911 - DNA, 20 bp, Artificial Sequence
  chemically synthesized
atgtctttaattagcagcgt

SEQ ID NO: 321912 - DNA, 20 bp, Artificial Sequence
  chemically synthesized
tgttctcacgctgctaatta

SEQ ID NO: 321913 - DNA, 20 bp, Artificial Sequence
  chemically synthesized
tctattatgtctttaattag

SEQ ID NO: 321914 - DNA, 20 bp, Artificial Sequence
  chemically synthesized
gtctctattatgtctttaat

SEQ ID NO: 321915 - DNA, 20 bp, Artificial Sequence
  chemically synthesized
gctgctaattaaagacataa

SEQ ID NO: 321916 - DNA, 20 bp, Artificial Sequence
  chemically synthesized
tgctaattaaagacataata

SEQ ID NO: 321917 - DNA, 20 bp, Artificial Sequence
  chemically synthesized
attaaagacataatagagac

SEQ ID NO: 321918 - DNA, 20 bp, Artificial Sequence
  chemically synthesized
tgttttctttataaattatc

SEQ ID NO: 321919 - DNA, 20 bp, Artificial Sequence
  chemically synthesized
tagagactggataatttata

SEQ ID NO: 321920 - DNA, 20 bp, Artificial Sequence
  chemically synthesized
ggataatttataaagaaaac

SEQ ID NO: 321921 - DNA, 20 bp, Artificial Sequence
  chemically synthesized
aaacaagtttaattgactca

SEQ ID NO: 321922 - DNA, 20 bp, Artificial Sequence
  chemically synthesized
agtttaattgactcacagtt

SEQ ID NO: 321923 - DNA, 20 bp, Artificial Sequence
  chemically synthesized
ccccagccatgccgaactgt

SEQ ID NO: 321924 - DNA, 20 bp, Artificial Sequence
  chemically synthesized
aattgactcacagttcggca

SEQ ID NO: 321925 - DNA, 20 bp, Artificial Sequence
  chemically synthesized
gactcacagttcggcatggc

SEQ ID NO: 321926 - DNA, 20 bp, Artificial Sequence
  chemically synthesized
actcacagttcggcatggct

SEQ ID NO: 321927 - DNA, 20 bp, Artificial Sequence
  chemically synthesized
ctcacagttcggcatggctg

SEQ ID NO: 321928 - DNA, 20 bp, Artificial Sequence
  chemically synthesized
cacagttcggcatggctggg

SEQ ID NO: 321929 - DNA, 20 bp, Artificial Sequence
  chemically synthesized
acagttcggcatggctgggg

SEQ ID NO: 321930 - DNA, 20 bp, Artificial Sequence
  chemically synthesized
gattttttctgaggcctccc

SEQ ID NO: 321931 - DNA, 20 bp, Artificial Sequence
  chemically synthesized
cggcatggctggggaggcct

SEQ ID NO: 321932 - DNA, 20 bp, Artificial Sequence
  chemically synthesized
ttccatcatgattttttctg

SEQ ID NO: 321933 - DNA, 20 bp, Artificial Sequence
  chemically synthesized
cttccatcatgattttttct

SEQ ID NO: 321934 - DNA, 20 bp, Artificial Sequence
  chemically synthesized
ggcctcagaaaaaatcatga

SEQ ID NO: 321935 - DNA, 20 bp, Artificial Sequence
  chemically synthesized
ctcagaaaaaatcatgatgg

SEQ ID NO: 321936 - DNA, 20 bp, Artificial Sequence
  chemically synthesized
tcagaaaaaatcatgatgga

SEQ ID NO: 321937 - DNA, 20 bp, Artificial Sequence
  chemically synthesized
cagaaaaaatcatgatggaa

SEQ ID NO: 321938 - DNA, 20 bp, Artificial Sequence
  chemically synthesized
agaaaaaatcatgatggaag

SEQ ID NO: 321939 - DNA, 20 bp, Artificial Sequence
  chemically synthesized
aaaaatcatgatggaagggg

SEQ ID NO: 321940 - DNA, 20 bp, Artificial Sequence
  chemically synthesized
ttcctgctgccatgtgaaga

SEQ ID NO: 321941 - DNA, 20 bp, Artificial Sequence
  chemically synthesized
caaacatgtccttcttcaca

SEQ ID NO: 321942 - DNA, 20 bp, Artificial Sequence
  chemically synthesized
cttcctgctgccatgtgaag

SEQ ID NO: 321943 - DNA, 20 bp, Artificial Sequence
  chemically synthesized
acatgtccttcttcacatgg

SEQ ID NO: 321944 - DNA, 20 bp, Artificial Sequence
  chemically synthesized
cttcttcctgctgccatgtg

SEQ ID NO: 321945 - DNA, 20 bp, Artificial Sequence
  chemically synthesized
tgtccttcttcacatggcag

SEQ ID NO: 321946 - DNA, 20 bp, Artificial Sequence
  chemically synthesized
gtccttcttcacatggcagc

SEQ ID NO: 321947 - DNA, 20 bp, Artificial Sequence
  chemically synthesized
cttcttcacatggcagcagg

SEQ ID NO: 321948 - DNA, 20 bp, Artificial Sequence
  chemically synthesized
cttcacatggcagcaggaag

SEQ ID NO: 321949 - DNA, 20 bp, Artificial Sequence
  chemically synthesized
ttcacatggcagcaggaaga

SEQ ID NO: 321950 - DNA, 20 bp, Artificial Sequence
  chemically synthesized
tcacatggcagcaggaagaa

SEQ ID NO: 321951 - DNA, 20 bp, Artificial Sequence
  chemically synthesized
tggcagcaggaagaagggcc

SEQ ID NO: 321952 - DNA, 20 bp, Artificial Sequence
  chemically synthesized
caggaagaagggccaagcaa

SEQ ID NO: 321953 - DNA, 20 bp, Artificial Sequence
  chemically synthesized
aggaagaagggccaagcaaa

SEQ ID NO: 321954 - DNA, 20 bp, Artificial Sequence
  chemically synthesized
ggaagaagggccaagcaaaa

SEQ ID NO: 321955 - DNA, 20 bp, Artificial Sequence
  chemically synthesized
ggggcctttccccttttgct

SEQ ID NO: 321956 - DNA, 20 bp, Artificial Sequence
  chemically synthesized
gaagaagggccaagcaaaag

SEQ ID NO: 321957 - DNA, 20 bp, Artificial Sequence
  chemically synthesized
aagggccaagcaaaagggga

SEQ ID NO: 321958 - DNA, 20 bp, Artificial Sequence
  chemically synthesized
agggccaagcaaaaggggaa

SEQ ID NO: 321959 - DNA, 20 bp, Artificial Sequence
  chemically synthesized
agatctgatggttttataag

SEQ ID NO: 321960 - DNA, 20 bp, Artificial Sequence
  chemically synthesized
aagatctgatggttttataa

SEQ ID NO: 321961 - DNA, 20 bp, Artificial Sequence
  chemically synthesized
caagatctgatggttttata

SEQ ID NO: 321962 - DNA, 20 bp, Artificial Sequence
  chemically synthesized
acaagatctgatggttttat

SEQ ID NO: 321963 - DNA, 20 bp, Artificial Sequence
  chemically synthesized
aaggccccttataaaaccat

SEQ ID NO: 321964 - DNA, 20 bp, Artificial Sequence
  chemically synthesized
tgagttctcacaagatctga

SEQ ID NO: 321965 - DNA, 20 bp, Artificial Sequence
  chemically synthesized
ataaaaccatcagatcttgt

SEQ ID NO: 321966 - DNA, 20 bp, Artificial Sequence
  chemically synthesized
gatagtgagtgagttctcac

SEQ ID NO: 321967 - DNA, 20 bp, Artificial Sequence
  chemically synthesized
ctgttctcatgatagtgagt

SEQ ID NO: 321968 - DNA, 20 bp, Artificial Sequence
  chemically synthesized
catgctgttctcatgatagt

SEQ ID NO: 321969 - DNA, 20 bp, Artificial Sequence
  chemically synthesized
gagaactcactcactatcat

SEQ ID NO: 321970 - DNA, 20 bp, Artificial Sequence
  chemically synthesized
ccctcatgctgttctcatga

SEQ ID NO: 321971 - DNA, 20 bp, Artificial Sequence
  chemically synthesized
ctcactcactatcatgagaa

SEQ ID NO: 321972 - DNA, 20 bp, Artificial Sequence
  chemically synthesized
cactatcatgagaacagcat

SEQ ID NO: 321973 - DNA, 20 bp, Artificial Sequence
  chemically synthesized
actatcatgagaacagcatg

SEQ ID NO: 321974 - DNA, 20 bp, Artificial Sequence
  chemically synthesized
ctatcatgagaacagcatga

SEQ ID NO: 321975 - DNA, 20 bp, Artificial Sequence
  chemically synthesized
ggaaggtaattgaatcatgg

SEQ ID NO: 321976 - DNA, 20 bp, Artificial Sequence
  chemically synthesized
gtggaaggtaattgaatcat

SEQ ID NO: 321977 - DNA, 20 bp, Artificial Sequence
  chemically synthesized
ggtggaaggtaattgaatca

SEQ ID NO: 321978 - DNA, 20 bp, Artificial Sequence
  chemically synthesized
atgattcaattaccttccac

SEQ ID NO: 321979 - DNA, 20 bp, Artificial Sequence
  chemically synthesized
tgattcaattaccttccacc

SEQ ID NO: 321980 - DNA, 20 bp, Artificial Sequence
  chemically synthesized
tgtgggagggacctggtgga

SEQ ID NO: 321981 - DNA, 20 bp, Artificial Sequence
  chemically synthesized
ttgtgggagggacctggtgg

SEQ ID NO: 321982 - DNA, 20 bp, Artificial Sequence
  chemically synthesized
gtgttgtgggagggacctgg

SEQ ID NO: 321983 - DNA, 20 bp, Artificial Sequence
  chemically synthesized
catgtgttgtgggagggacc

SEQ ID NO: 321984 - DNA, 20 bp, Artificial Sequence
  chemically synthesized
aatccccatgtgttgtggga

SEQ ID NO: 321985 - DNA, 20 bp, Artificial Sequence
  chemically synthesized
taatccccatgtgttgtggg

SEQ ID NO: 321986 - DNA, 20 bp, Artificial Sequence
  chemically synthesized
ataatccccatgtgttgtgg

SEQ ID NO: 321987 - DNA, 20 bp, Artificial Sequence
  chemically synthesized
tcataatccccatgtgttgt

SEQ ID NO: 321988 - DNA, 20 bp, Artificial Sequence
  chemically synthesized
caggtccctcccacaacaca

SEQ ID NO: 321989 - DNA, 20 bp, Artificial Sequence
  chemically synthesized
ctcataatccccatgtgttg

SEQ ID NO: 321990 - DNA, 20 bp, Artificial Sequence
  chemically synthesized
aggtccctcccacaacacat

SEQ ID NO: 321991 - DNA, 20 bp, Artificial Sequence
  chemically synthesized
ggtccctcccacaacacatg

SEQ ID NO: 321992 - DNA, 20 bp, Artificial Sequence
  chemically synthesized
ccacaacacatggggattat

SEQ ID NO: 321993 - DNA, 20 bp, Artificial Sequence
  chemically synthesized
gattatgagaactacaattc

SEQ ID NO: 321994 - DNA, 20 bp, Artificial Sequence
  chemically synthesized
gtttggctcatcttgaattg

SEQ ID NO: 321995 - DNA, 20 bp, Artificial Sequence
  chemically synthesized
tgagaactacaattcaagat

SEQ ID NO: 321996 - DNA, 20 bp, Artificial Sequence
  chemically synthesized
taaataatgctgatatggtt

SEQ ID NO: 321997 - DNA, 20 bp, Artificial Sequence
  chemically synthesized
caagatgagccaaaccatat

SEQ ID NO: 321998 - DNA, 20 bp, Artificial Sequence
  chemically synthesized
aaagataaataatgctgata

SEQ ID NO: 321999 - DNA, 20 bp, Artificial Sequence
  chemically synthesized
tcagcattatttatctttgt

SEQ ID NO: 322000 - DNA, 20 bp, Artificial Sequence
  chemically synthesized
cattatttatctttgtgaga

SEQ ID NO: 322001 - DNA, 20 bp, Artificial Sequence
  chemically synthesized
aaaaacaatgctttctcaca

SEQ ID NO: 322002 - DNA, 20 bp, Artificial Sequence
  chemically synthesized
gtgagaaagcattgtttttg

SEQ ID NO: 322003 - DNA, 20 bp, Artificial Sequence
  chemically synthesized
aagcattgtttttgaagata

SEQ ID NO: 322004 - DNA, 20 bp, Artificial Sequence
  chemically synthesized
tggaattcacagaaatgaga

SEQ ID NO: 322005 - DNA, 20 bp, Artificial Sequence
  chemically synthesized
tctggaattcacagaaatga

SEQ ID NO: 322006 - DNA, 20 bp, Artificial Sequence
  chemically synthesized
tttctggaattcacagaaat

SEQ ID NO: 322007 - DNA, 20 bp, Artificial Sequence
  chemically synthesized
tctctcatttctgtgaattc

SEQ ID NO: 322008 - DNA, 20 bp, Artificial Sequence
  chemically synthesized
agctaaatttctggaattca

SEQ ID NO: 322009 - DNA, 20 bp, Artificial Sequence
  chemically synthesized
ttctgtgaattccagaaatt

SEQ ID NO: 322010 - DNA, 20 bp, Artificial Sequence
  chemically synthesized
ttacaggaaagctaaatttc

SEQ ID NO: 322011 - DNA, 20 bp, Artificial Sequence
  chemically synthesized
tcatagtttaaattacagga

SEQ ID NO: 322012 - DNA, 20 bp, Artificial Sequence
  chemically synthesized
tgactcatagtttaaattac

SEQ ID NO: 322013 - DNA, 20 bp, Artificial Sequence
  chemically synthesized
gtgactcatagtttaaatta

SEQ ID NO: 322014 - DNA, 20 bp, Artificial Sequence
  chemically synthesized
tttcctgtaatttaaactat

SEQ ID NO: 322015 - DNA, 20 bp, Artificial Sequence
  chemically synthesized
aatacaatgcatgtgactca

SEQ ID NO: 322016 - DNA, 20 bp, Artificial Sequence
  chemically synthesized
agtcacatgcattgtattat

SEQ ID NO: 322017 - DNA, 20 bp, Artificial Sequence
  chemically synthesized
atgcattgtattattagtac

SEQ ID NO: 322018 - DNA, 20 bp, Artificial Sequence
  chemically synthesized
gcattgtattattagtacaa

SEQ ID NO: 322019 - DNA, 20 bp, Artificial Sequence
  chemically synthesized
gtacaagagatgtccacatt

SEQ ID NO: 322020 - DNA, 20 bp, Artificial Sequence
  chemically synthesized
tgtgataatgcagctaaatg

SEQ ID NO: 322021 - DNA, 20 bp, Artificial Sequence
  chemically synthesized
taattaaaaatgtgataatg

SEQ ID NO: 322022 - DNA, 20 bp, Artificial Sequence
  chemically synthesized
atcacatttttaattattga

SEQ ID NO: 322023 - DNA, 20 bp, Artificial Sequence
  chemically synthesized
gttaggttgcacatggatta

SEQ ID NO: 322024 - DNA, 20 bp, Artificial Sequence
  chemically synthesized
acattcggttaggttgcaca

SEQ ID NO: 322025 - DNA, 20 bp, Artificial Sequence
  chemically synthesized
tgataacgtgacattcggtt

SEQ ID NO: 322026 - DNA, 20 bp, Artificial Sequence
  chemically synthesized
atgataacgtgacattcggt

SEQ ID NO: 322027 - DNA, 20 bp, Artificial Sequence
  chemically synthesized
atagatgataacgtgacatt

SEQ ID NO: 322028 - DNA, 20 bp, Artificial Sequence
  chemically synthesized
taagaagtaggaattattta

SEQ ID NO: 322029 - DNA, 20 bp, Artificial Sequence
  chemically synthesized
ctattggactaataagaagt

SEQ ID NO: 322030 - DNA, 20 bp, Artificial Sequence
  chemically synthesized
gctattggactaataagaag

SEQ ID NO: 322031 - DNA, 20 bp, Artificial Sequence
  chemically synthesized
aaataattcctacttcttat

SEQ ID NO: 322032 - DNA, 20 bp, Artificial Sequence
  chemically synthesized
taagctattggactaataag

SEQ ID NO: 322033 - DNA, 20 bp, Artificial Sequence
  chemically synthesized
aattaagctattggactaat

SEQ ID NO: 322034 - DNA, 20 bp, Artificial Sequence
  chemically synthesized
cctacttcttattagtccaa

SEQ ID NO: 322035 - DNA, 20 bp, Artificial Sequence
  chemically synthesized
agtattgataattaagctat

SEQ ID NO: 322036 - DNA, 20 bp, Artificial Sequence
  chemically synthesized
gttgatgagtattgataatt

SEQ ID NO: 322037 - DNA, 20 bp, Artificial Sequence
  chemically synthesized
gacaatatatgagtgttgat

SEQ ID NO: 322038 - DNA, 20 bp, Artificial Sequence
  chemically synthesized
atatataacagacaatatat

SEQ ID NO: 322039 - DNA, 20 bp, Artificial Sequence
  chemically synthesized
tctggtgcaataatatataa

SEQ ID NO: 322040 - DNA, 20 bp, Artificial Sequence
  chemically synthesized
tctgttatatattattgcac

SEQ ID NO: 322041 - DNA, 20 bp, Artificial Sequence
  chemically synthesized
attaagcagtagcaagattc

SEQ ID NO: 322042 - DNA, 20 bp, Artificial Sequence
  chemically synthesized
atgggtgattaagcagtagc

SEQ ID NO: 322043 - DNA, 20 bp, Artificial Sequence
  chemically synthesized
ccccatgggtgattaagcag

SEQ ID NO: 322044 - DNA, 20 bp, Artificial Sequence
  chemically synthesized
ataccccatgggtgattaag

SEQ ID NO: 322045 - DNA, 20 bp, Artificial Sequence
  chemically synthesized
atcataccccatgggtgatt

SEQ ID NO: 322046 - DNA, 20 bp, Artificial Sequence
  chemically synthesized
tgctactgcttaatcaccca

SEQ ID NO: 322047 - DNA, 20 bp, Artificial Sequence
  chemically synthesized
gctactgcttaatcacccat

SEQ ID NO: 322048 - DNA, 20 bp, Artificial Sequence
  chemically synthesized
ctactgcttaatcacccatg

SEQ ID NO: 322049 - DNA, 20 bp, Artificial Sequence
  chemically synthesized
atgttgatatcataccccat

SEQ ID NO: 322050 - DNA, 20 bp, Artificial Sequence
  chemically synthesized
tatgttgatatcatacccca

SEQ ID NO: 322051 - DNA, 20 bp, Artificial Sequence
  chemically synthesized
ggggtatgatatcaacatat

SEQ ID NO: 322052 - DNA, 20 bp, Artificial Sequence
  chemically synthesized
gggtatgatatcaacatatg

SEQ ID NO: 322053 - DNA, 20 bp, Artificial Sequence
  chemically synthesized
aatggtgctgatatttcatt

SEQ ID NO: 322054 - DNA, 20 bp, Artificial Sequence
  chemically synthesized
atgaggactgaatgaaatat

SEQ ID NO: 322055 - DNA, 20 bp, Artificial Sequence
  chemically synthesized
tgaaatatcagcaccatttt

SEQ ID NO: 322056 - DNA, 20 bp, Artificial Sequence
  chemically synthesized
aaatatcagcaccattttta

SEQ ID NO: 322057 - DNA, 20 bp, Artificial Sequence
  chemically synthesized
tttctcaggagctctaaaaa

SEQ ID NO: 322058 - DNA, 20 bp, Artificial Sequence
  chemically synthesized
gcaccatttttagagctcct

SEQ ID NO: 322059 - DNA, 20 bp, Artificial Sequence
  chemically synthesized
catttttagagctcctgaga

SEQ ID NO: 322060 - DNA, 20 bp, Artificial Sequence
  chemically synthesized
tattttaattactttctcag

SEQ ID NO: 322061 - DNA, 20 bp, Artificial Sequence
  chemically synthesized
aatattttaattactttctc

SEQ ID NO: 322062 - DNA, 20 bp, Artificial Sequence
  chemically synthesized
aaatattttaattactttct

SEQ ID NO: 322063 - DNA, 20 bp, Artificial Sequence
  chemically synthesized
gagaaagtaattaaaatatt

SEQ ID NO: 322064 - DNA, 20 bp, Artificial Sequence
  chemically synthesized
atttttctatcaagtgacgt

SEQ ID NO: 322065 - DNA, 20 bp, Artificial Sequence
  chemically synthesized
tatttttctatcaagtgacg

SEQ ID NO: 322066 - DNA, 20 bp, Artificial Sequence
  chemically synthesized
atttggcccacgtcacttga

SEQ ID NO: 322067 - DNA, 20 bp, Artificial Sequence
  chemically synthesized
tctgttcctatttttctatc

SEQ ID NO: 322068 - DNA, 20 bp, Artificial Sequence
  chemically synthesized
cacgtcacttgatagaaaaa

SEQ ID NO: 322069 - DNA, 20 bp, Artificial Sequence
  chemically synthesized
acgtcacttgatagaaaaat

SEQ ID NO: 322070 - DNA, 20 bp, Artificial Sequence
  chemically synthesized
acttgatagaaaaataggaa

SEQ ID NO: 322071 - DNA, 20 bp, Artificial Sequence
  chemically synthesized
tgatagaaaaataggaacag

SEQ ID NO: 322072 - DNA, 20 bp, Artificial Sequence
  chemically synthesized
aataggaacagaagatatct

SEQ ID NO: 322073 - DNA, 20 bp, Artificial Sequence
  chemically synthesized
aggaacagaagatatctaag

SEQ ID NO: 322074 - DNA, 20 bp, Artificial Sequence
  chemically synthesized
gaacagaagatatctaagta

SEQ ID NO: 322075 - DNA, 20 bp, Artificial Sequence
  chemically synthesized
aacagaagatatctaagtag

SEQ ID NO: 322076 - DNA, 20 bp, Artificial Sequence
  chemically synthesized
cttctttgtaaacctctact

SEQ ID NO: 322077 - DNA, 20 bp, Artificial Sequence
  chemically synthesized
tatctaagtagaggtttaca

SEQ ID NO: 322078 - DNA, 20 bp, Artificial Sequence
  chemically synthesized
ctaagtagaggtttacaaag

SEQ ID NO: 322079 - DNA, 20 bp, Artificial Sequence
  chemically synthesized
tagaggtttacaaagaagtt

SEQ ID NO: 322080 - DNA, 20 bp, Artificial Sequence
  chemically synthesized
taactgaaattaagacagag

SEQ ID NO: 322081 - DNA, 20 bp, Artificial Sequence
  chemically synthesized
atctaactgaaattaagaca

SEQ ID NO: 322082 - DNA, 20 bp, Artificial Sequence
  chemically synthesized
tgatctaactgaaattaaga

SEQ ID NO: 322083 - DNA, 20 bp, Artificial Sequence
  chemically synthesized
tttctactctgtcttaattt

SEQ ID NO: 322084 - DNA, 20 bp, Artificial Sequence
  chemically synthesized
gcactgatctaactgaaatt

SEQ ID NO: 322085 - DNA, 20 bp, Artificial Sequence
  chemically synthesized
tactctgtcttaatttcagt

SEQ ID NO: 322086 - DNA, 20 bp, Artificial Sequence
  chemically synthesized
tgtcttaatttcagttagat

SEQ ID NO: 322087 - DNA, 20 bp, Artificial Sequence
  chemically synthesized
ctgatcagtttaagtttgag

SEQ ID NO: 322088 - DNA, 20 bp, Artificial Sequence
  chemically synthesized
tccctgatcagtttaagttt

SEQ ID NO: 322089 - DNA, 20 bp, Artificial Sequence
  chemically synthesized
aggtgatccctgatcagttt

SEQ ID NO: 322090 - DNA, 20 bp, Artificial Sequence
  chemically synthesized
cttctcaaacttaaactgat

SEQ ID NO: 322091 - DNA, 20 bp, Artificial Sequence
  chemically synthesized
ttctcaaacttaaactgatc

SEQ ID NO: 322092 - DNA, 20 bp, Artificial Sequence
  chemically synthesized
tctcaaacttaaactgatca

SEQ ID NO: 322093 - DNA, 20 bp, Artificial Sequence
  chemically synthesized
tatcccaggtgatccctgat

SEQ ID NO: 322094 - DNA, 20 bp, Artificial Sequence
  chemically synthesized
taaactgatcagggatcacc

SEQ ID NO: 322095 - DNA, 20 bp, Artificial Sequence
  chemically synthesized
aaactgatcagggatcacct

SEQ ID NO: 322096 - DNA, 20 bp, Artificial Sequence
  chemically synthesized
gtgcagtttagcaatatccc

SEQ ID NO: 322097 - DNA, 20 bp, Artificial Sequence
  chemically synthesized
tgtgcagtttagcaatatcc

SEQ ID NO: 322098 - DNA, 20 bp, Artificial Sequence
  chemically synthesized
agaatcagaattgtgcagtt

SEQ ID NO: 322099 - DNA, 20 bp, Artificial Sequence
  chemically synthesized
tatacagaatcagaattgtg

SEQ ID NO: 322100 - DNA, 20 bp, Artificial Sequence
  chemically synthesized
cattctgatatatacagaat

SEQ ID NO: 322101 - DNA, 20 bp, Artificial Sequence
  chemically synthesized
aattctgattctgtatatat

SEQ ID NO: 322102 - DNA, 20 bp, Artificial Sequence
  chemically synthesized
agctctcattctgatatata

SEQ ID NO: 322103 - DNA, 20 bp, Artificial Sequence
  chemically synthesized
gattctgtatatatcagaat

SEQ ID NO: 322104 - DNA, 20 bp, Artificial Sequence
  chemically synthesized
ttctgtatatatcagaatga

SEQ ID NO: 322105 - DNA, 20 bp, Artificial Sequence
  chemically synthesized
tatatatcagaatgagagct

SEQ ID NO: 322106 - DNA, 20 bp, Artificial Sequence
  chemically synthesized
tatatcagaatgagagctga

SEQ ID NO: 322107 - DNA, 20 bp, Artificial Sequence
  chemically synthesized
ttgttaaaaatgcagactct

SEQ ID NO: 322108 - DNA, 20 bp, Artificial Sequence
  chemically synthesized
ctgagaacttgttaaaaatg

SEQ ID NO: 322109 - DNA, 20 bp, Artificial Sequence
  chemically synthesized
tgagagtctgcatttttaac

SEQ ID NO: 322110 - DNA, 20 bp, Artificial Sequence
  chemically synthesized
ctgcatttttaacaagttct

SEQ ID NO: 322111 - DNA, 20 bp, Artificial Sequence
  chemically synthesized
tgcatttttaacaagttctc

SEQ ID NO: 322112 - DNA, 20 bp, Artificial Sequence
  chemically synthesized
cagtagcatcagcgtcacct

SEQ ID NO: 322113 - DNA, 20 bp, Artificial Sequence
  chemically synthesized
tcaggtgacgctgatgctac

SEQ ID NO: 322114 - DNA, 20 bp, Artificial Sequence
  chemically synthesized
tggtgtaggaccagtagcat

SEQ ID NO: 322115 - DNA, 20 bp, Artificial Sequence
  chemically synthesized
tcaaggtggtgtaggaccag

SEQ ID NO: 322116 - DNA, 20 bp, Artificial Sequence
  chemically synthesized
agatcaaggtggtgtaggac

SEQ ID NO: 322117 - DNA, 20 bp, Artificial Sequence
  chemically synthesized
cttgcagatcaaggtggtgt

SEQ ID NO: 322118 - DNA, 20 bp, Artificial Sequence
  chemically synthesized
acttgcagatcaaggtggtg

SEQ ID NO: 322119 - DNA, 20 bp, Artificial Sequence
  chemically synthesized
tagtaacttgcagatcaagg

SEQ ID NO: 322120 - DNA, 20 bp, Artificial Sequence
  chemically synthesized
caatagtaacttgcagatca

SEQ ID NO: 322121 - DNA, 20 bp, Artificial Sequence
  chemically synthesized
cctacaccaccttgatctgc

SEQ ID NO: 322122 - DNA, 20 bp, Artificial Sequence
  chemically synthesized
gcaatagtaacttgcagatc

SEQ ID NO: 322123 - DNA, 20 bp, Artificial Sequence
  chemically synthesized
tgttaagcaatagtaacttg

SEQ ID NO: 322124 - DNA, 20 bp, Artificial Sequence
  chemically synthesized
cttccagtaatgttaagcaa

SEQ ID NO: 322125 - DNA, 20 bp, Artificial Sequence
  chemically synthesized
ttacttcttccagtaatgtt

SEQ ID NO: 322126 - DNA, 20 bp, Artificial Sequence
  chemically synthesized
ttactattgcttaacattac

SEQ ID NO: 322127 - DNA, 20 bp, Artificial Sequence
  chemically synthesized
ctattgcttaacattactgg

SEQ ID NO: 322128 - DNA, 20 bp, Artificial Sequence
  chemically synthesized
ttgcttaacattactggaag

SEQ ID NO: 322129 - DNA, 20 bp, Artificial Sequence
  chemically synthesized
tttttctgttttacttcttc

SEQ ID NO: 322130 - DNA, 20 bp, Artificial Sequence
  chemically synthesized
cattactggaagaagtaaaa

SEQ ID NO: 322131 - DNA, 20 bp, Artificial Sequence
  chemically synthesized
attttatttcacaatttggt

SEQ ID NO: 322132 - DNA, 20 bp, Artificial Sequence
  chemically synthesized
tgtgattttatttcacaatt

SEQ ID NO: 322133 - DNA, 20 bp, Artificial Sequence
  chemically synthesized
ttgtgaaataaaatcacaat

SEQ ID NO: 322134 - DNA, 20 bp, Artificial Sequence
  chemically synthesized
tgtgaaataaaatcacaatt

SEQ ID NO: 322135 - DNA, 20 bp, Artificial Sequence
  chemically synthesized
tgaaataaaatcacaattag

SEQ ID NO: 322136 - DNA, 20 bp, Artificial Sequence
  chemically synthesized
aaaatcacaattaggagttt

SEQ ID NO: 322137 - DNA, 20 bp, Artificial Sequence
  chemically synthesized
tttgagattgtgcacctcca

SEQ ID NO: 322138 - DNA, 20 bp, Artificial Sequence
  chemically synthesized
cgttgcagtaaatactttgg

SEQ ID NO: 322139 - DNA, 20 bp, Artificial Sequence
  chemically synthesized
tcgttgcagtaaatactttg

SEQ ID NO: 322140 - DNA, 20 bp, Artificial Sequence
  chemically synthesized
attcgttgcagtaaatactt

SEQ ID NO: 322141 - DNA, 20 bp, Artificial Sequence
  chemically synthesized
tcttggaattgaattcgttg

SEQ ID NO: 322142 - DNA, 20 bp, Artificial Sequence
  chemically synthesized
actgcaacgaattcaattcc

SEQ ID NO: 322143 - DNA, 20 bp, Artificial Sequence
  chemically synthesized
aacgaattcaattccaagat

SEQ ID NO: 322144 - DNA, 20 bp, Artificial Sequence
  chemically synthesized
tattcaggtaattccaatct

SEQ ID NO: 322145 - DNA, 20 bp, Artificial Sequence
  chemically synthesized
acaactaaattaagttattc

SEQ ID NO: 322146 - DNA, 20 bp, Artificial Sequence
  chemically synthesized
aacaactaaattaagttatt

SEQ ID NO: 322147 - DNA, 20 bp, Artificial Sequence
  chemically synthesized
attacctgaataacttaatt

SEQ ID NO: 322148 - DNA, 20 bp, Artificial Sequence
  chemically synthesized
aatagatgaacaactaaatt

SEQ ID NO: 322149 - DNA, 20 bp, Artificial Sequence
  chemically synthesized
tatgtgaatatatgaatgaa

SEQ ID NO: 322150 - DNA, 20 bp, Artificial Sequence
  chemically synthesized
attttctcccaagtgcagtg

SEQ ID NO: 322151 - DNA, 20 bp, Artificial Sequence
  chemically synthesized
tacgcaaacttcactgcact

SEQ ID NO: 322152 - DNA, 20 bp, Artificial Sequence
  chemically synthesized
acgcaaacttcactgcactt

SEQ ID NO: 322153 - DNA, 20 bp, Artificial Sequence
  chemically synthesized
gcaaacttcactgcacttgg

SEQ ID NO: 322154 - DNA, 20 bp, Artificial Sequence
  chemically synthesized
gggttattttctcccaagtg

SEQ ID NO: 322155 - DNA, 20 bp, Artificial Sequence
  chemically synthesized
tgagtgggttattttctccc

SEQ ID NO: 322156 - DNA, 20 bp, Artificial Sequence
  chemically synthesized
gaggtgctgaacaaatgagt

SEQ ID NO: 322157 - DNA, 20 bp, Artificial Sequence
  chemically synthesized
ggaggtgctgaacaaatgag

SEQ ID NO: 322158 - DNA, 20 bp, Artificial Sequence
  chemically synthesized
aaataacccactcatttgtt

SEQ ID NO: 322159 - DNA, 20 bp, Artificial Sequence
  chemically synthesized
aaaggaggtgctgaacaaat

SEQ ID NO: 322160 - DNA, 20 bp, Artificial Sequence
  chemically synthesized
gagagtggatagagaaaagg

SEQ ID NO: 322161 - DNA, 20 bp, Artificial Sequence
  chemically synthesized
tgagagtggatagagaaaag

SEQ ID NO: 322162 - DNA, 20 bp, Artificial Sequence
  chemically synthesized
tgtgagagtggatagagaaa

SEQ ID NO: 322163 - DNA, 20 bp, Artificial Sequence
  chemically synthesized
atgtgagagtggatagagaa

SEQ ID NO: 322164 - DNA, 20 bp, Artificial Sequence
  chemically synthesized
ggcatatgtgagagtggata

SEQ ID NO: 322165 - DNA, 20 bp, Artificial Sequence
  chemically synthesized
atggcatatgtgagagtgga

SEQ ID NO: 322166 - DNA, 20 bp, Artificial Sequence
  chemically synthesized
taagatggcatatgtgagag

SEQ ID NO: 322167 - DNA, 20 bp, Artificial Sequence
  chemically synthesized
aaataagatggcatatgtga

SEQ ID NO: 322168 - DNA, 20 bp, Artificial Sequence
  chemically synthesized
ggaaataagatggcatatgt

SEQ ID NO: 322169 - DNA, 20 bp, Artificial Sequence
  chemically synthesized
atttgactctggaaataaga

SEQ ID NO: 322170 - DNA, 20 bp, Artificial Sequence
  chemically synthesized
cacatatgccatcttatttc

SEQ ID NO: 322171 - DNA, 20 bp, Artificial Sequence
  chemically synthesized
catatgccatcttatttcca

SEQ ID NO: 322172 - DNA, 20 bp, Artificial Sequence
  chemically synthesized
gtctatttgactctggaaat

SEQ ID NO: 322173 - DNA, 20 bp, Artificial Sequence
  chemically synthesized
cccaagtgtctatttgactc

SEQ ID NO: 322174 - DNA, 20 bp, Artificial Sequence
  chemically synthesized
atcttatttccagagtcaaa

SEQ ID NO: 322175 - DNA, 20 bp, Artificial Sequence
  chemically synthesized
tccagagtcaaatagacact

SEQ ID NO: 322176 - DNA, 20 bp, Artificial Sequence
  chemically synthesized
ccagagtcaaatagacactt

SEQ ID NO: 322177 - DNA, 20 bp, Artificial Sequence
  chemically synthesized
cagagtcaaatagacacttg

SEQ ID NO: 322178 - DNA, 20 bp, Artificial Sequence
  chemically synthesized
agagtcaaatagacacttgg

SEQ ID NO: 322179 - DNA, 20 bp, Artificial Sequence
  chemically synthesized
catctctttttttttccccc

SEQ ID NO: 322180 - DNA, 20 bp, Artificial Sequence
  chemically synthesized
agacacttgggggaaaaaaa

SEQ ID NO: 322181 - DNA, 20 bp, Artificial Sequence
  chemically synthesized
acacttgggggaaaaaaaaa

SEQ ID NO: 322182 - DNA, 20 bp, Artificial Sequence
  chemically synthesized
tgggggaaaaaaaaagagat

SEQ ID NO: 322183 - DNA, 20 bp, Artificial Sequence
  chemically synthesized
aagagatgagccatatttgt

SEQ ID NO: 322184 - DNA, 20 bp, Artificial Sequence
  chemically synthesized
aaaaatacatctaacaaata

SEQ ID NO: 322185 - DNA, 20 bp, Artificial Sequence
  chemically synthesized
gttagatgtatttttctgtc

SEQ ID NO: 322186 - DNA, 20 bp, Artificial Sequence
  chemically synthesized
ccatcaatgctttgactgga

SEQ ID NO: 322187 - DNA, 20 bp, Artificial Sequence
  chemically synthesized
tgtatttttctgtccagtca

SEQ ID NO: 322188 - DNA, 20 bp, Artificial Sequence
  chemically synthesized
atcaccatcaatgctttgac

SEQ ID NO: 322189 - DNA, 20 bp, Artificial Sequence
  chemically synthesized
ctgtccagtcaaagcattga

SEQ ID NO: 322190 - DNA, 20 bp, Artificial Sequence
  chemically synthesized
cacaattattttccatatta

SEQ ID NO: 322191 - DNA, 20 bp, Artificial Sequence
  chemically synthesized
tagatacacaagccataata

SEQ ID NO: 322192 - DNA, 20 bp, Artificial Sequence
  chemically synthesized
tagtatctgggtagatacac

SEQ ID NO: 322193 - DNA, 20 bp, Artificial Sequence
  chemically synthesized
ttatggcttgtgtatctacc

SEQ ID NO: 322194 - DNA, 20 bp, Artificial Sequence
  chemically synthesized
agatatgaatagtatctggg

SEQ ID NO: 322195 - DNA, 20 bp, Artificial Sequence
  chemically synthesized
gagagatatgaatagtatct

SEQ ID NO: 322196 - DNA, 20 bp, Artificial Sequence
  chemically synthesized
ggagagatatgaatagtatc

SEQ ID NO: 322197 - DNA, 20 bp, Artificial Sequence
  chemically synthesized
agcaggaggagagatatgaa

SEQ ID NO: 322198 - DNA, 20 bp, Artificial Sequence
  chemically synthesized
ggtttatatcagcaggagga

SEQ ID NO: 322199 - DNA, 20 bp, Artificial Sequence
  chemically synthesized
ttggtttatatcagcaggag

SEQ ID NO: 322200 - DNA, 20 bp, Artificial Sequence
  chemically synthesized
ttttggtttatatcagcagg

SEQ ID NO: 322201 - DNA, 20 bp, Artificial Sequence
  chemically synthesized
tttttggtttatatcagcag

SEQ ID NO: 322202 - DNA, 20 bp, Artificial Sequence
  chemically synthesized
gttttttggtttatatcagc

SEQ ID NO: 322203 - DNA, 20 bp, Artificial Sequence
  chemically synthesized
tgttttttggtttatatcag

SEQ ID NO: 322204 - DNA, 20 bp, Artificial Sequence
  chemically synthesized
ttgtgttttttggtttatat

SEQ ID NO: 322205 - DNA, 20 bp, Artificial Sequence
  chemically synthesized
ccaagtgaagttgtgttttt

SEQ ID NO: 322206 - DNA, 20 bp, Artificial Sequence
  chemically synthesized
ccaaaaaacacaacttcact

SEQ ID NO: 322207 - DNA, 20 bp, Artificial Sequence
  chemically synthesized
gcaagtcaggaggccaagtg

SEQ ID NO: 322208 - DNA, 20 bp, Artificial Sequence
  chemically synthesized
tgaaagcaagtcaggaggcc

SEQ ID NO: 322209 - DNA, 20 bp, Artificial Sequence
  chemically synthesized
aaaaatgaaagcaagtcagg

SEQ ID NO: 322210 - DNA, 20 bp, Artificial Sequence
  chemically synthesized
aaaaaatgaaagcaagtcag

SEQ ID NO: 322211 - DNA, 20 bp, Artificial Sequence
  chemically synthesized
gaaaaaaatgaaagcaagtc

SEQ ID NO: 322212 - DNA, 20 bp, Artificial Sequence
  chemically synthesized
ggaaaaaaatgaaagcaagt

SEQ ID NO: 322213 - DNA, 20 bp, Artificial Sequence
  chemically synthesized
taagggaaaaaaatgaaagc

SEQ ID NO: 322214 - DNA, 20 bp, Artificial Sequence
  chemically synthesized
acggtaagggaaaaaaatga

SEQ ID NO: 322215 - DNA, 20 bp, Artificial Sequence
  chemically synthesized
taaaacttctgtgacggtaa

SEQ ID NO: 322216 - DNA, 20 bp, Artificial Sequence
  chemically synthesized
ctaaaacttctgtgacggta

SEQ ID NO: 322217 - DNA, 20 bp, Artificial Sequence
  chemically synthesized
atttttttcccttaccgtca

SEQ ID NO: 322218 - DNA, 20 bp, Artificial Sequence
  chemically synthesized
actaaaacttctgtgacggt

SEQ ID NO: 322219 - DNA, 20 bp, Artificial Sequence
  chemically synthesized
tttttcccttaccgtcacag

SEQ ID NO: 322220 - DNA, 20 bp, Artificial Sequence
  chemically synthesized
agaaactaaaacttctgtga

SEQ ID NO: 322221 - DNA, 20 bp, Artificial Sequence
  chemically synthesized
ccttaccgtcacagaagttt

SEQ ID NO: 322222 - DNA, 20 bp, Artificial Sequence
  chemically synthesized
ttgtagttaggacatgcagg

SEQ ID NO: 322223 - DNA, 20 bp, Artificial Sequence
  chemically synthesized
taattgtagttaggacatgc

SEQ ID NO: 322224 - DNA, 20 bp, Artificial Sequence
  chemically synthesized
ataattgtagttaggacatg

SEQ ID NO: 322225 - DNA, 20 bp, Artificial Sequence
  chemically synthesized
cttttctgataattgtagtt

SEQ ID NO: 322226 - DNA, 20 bp, Artificial Sequence
  chemically synthesized
acttttctgataattgtagt

SEQ ID NO: 322227 - DNA, 20 bp, Artificial Sequence
  chemically synthesized
catgtcctaactacaattat

SEQ ID NO: 322228 - DNA, 20 bp, Artificial Sequence
  chemically synthesized
atcaacttttctgataattg

SEQ ID NO: 322229 - DNA, 20 bp, Artificial Sequence
  chemically synthesized
cctaactacaattatcagaa

SEQ ID NO: 322230 - DNA, 20 bp, Artificial Sequence
  chemically synthesized
acaattatcagaaaagttga

SEQ ID NO: 322231 - DNA, 20 bp, Artificial Sequence
  chemically synthesized
gactcaaagttaagcacagc

SEQ ID NO: 322232 - DNA, 20 bp, Artificial Sequence
  chemically synthesized
taaggactcaaagttaagca

SEQ ID NO: 322233 - DNA, 20 bp, Artificial Sequence
  chemically synthesized
aacttgctgtgcttaacttt

SEQ ID NO: 322234 - DNA, 20 bp, Artificial Sequence
  chemically synthesized
ttttataaggactcaaagtt

SEQ ID NO: 322235 - DNA, 20 bp, Artificial Sequence
  chemically synthesized
gacatttttataaggactca

SEQ ID NO: 322236 - DNA, 20 bp, Artificial Sequence
  chemically synthesized
gatttactgacatttttata

SEQ ID NO: 322237 - DNA, 20 bp, Artificial Sequence
  chemically synthesized
agatttactgacatttttat

SEQ ID NO: 322238 - DNA, 20 bp, Artificial Sequence
  chemically synthesized
ttgagtccttataaaaatgt

SEQ ID NO: 322239 - DNA, 20 bp, Artificial Sequence
  chemically synthesized
gcaacctgcagagagcaaaa

SEQ ID NO: 322240 - DNA, 20 bp, Artificial Sequence
  chemically synthesized
taaatcttttttgctctctg

SEQ ID NO: 322241 - DNA, 20 bp, Artificial Sequence
  chemically synthesized
aaatcttttttgctctctgc

SEQ ID NO: 322242 - DNA, 20 bp, Artificial Sequence
  chemically synthesized
tgaaaaatgcaacctgcaga

SEQ ID NO: 322243 - DNA, 20 bp, Artificial Sequence
  chemically synthesized
attgaaaaatgcaacctgca

SEQ ID NO: 322244 - DNA, 20 bp, Artificial Sequence
  chemically synthesized
tgattgaaaaatgcaacctg

SEQ ID NO: 322245 - DNA, 20 bp, Artificial Sequence
  chemically synthesized
catttttcaatcaaattaat

SEQ ID NO: 322246 - DNA, 20 bp, Artificial Sequence
  chemically synthesized
caaattaattagtttattca

SEQ ID NO: 322247 - DNA, 20 bp, Artificial Sequence
  chemically synthesized
aattaattagtttattcata

SEQ ID NO: 322248 - DNA, 20 bp, Artificial Sequence
  chemically synthesized
taattagtttattcatagag

SEQ ID NO: 322249 - DNA, 20 bp, Artificial Sequence
  chemically synthesized
aactggcacagggaaaacag

SEQ ID NO: 322250 - DNA, 20 bp, Artificial Sequence
  chemically synthesized
gacaactggcacagggaaaa

SEQ ID NO: 322251 - DNA, 20 bp, Artificial Sequence
  chemically synthesized
atcttctgttttccctgtgc

SEQ ID NO: 322252 - DNA, 20 bp, Artificial Sequence
  chemically synthesized
gcaagaagacaactggcaca

SEQ ID NO: 322253 - DNA, 20 bp, Artificial Sequence
  chemically synthesized
tgcaagaagacaactggcac

SEQ ID NO: 322254 - DNA, 20 bp, Artificial Sequence
  chemically synthesized
gtgcaagaagacaactggca

SEQ ID NO: 322255 - DNA, 20 bp, Artificial Sequence
  chemically synthesized
tggaagtgcaagaagacaac

SEQ ID NO: 322256 - DNA, 20 bp, Artificial Sequence
  chemically synthesized
tccaactgtggaagtgcaag

SEQ ID NO: 322257 - DNA, 20 bp, Artificial Sequence
  chemically synthesized
acttccaactgtggaagtgc

SEQ ID NO: 322258 - DNA, 20 bp, Artificial Sequence
  chemically synthesized
gttgtcttcttgcacttcca

SEQ ID NO: 322259 - DNA, 20 bp, Artificial Sequence
  chemically synthesized
tcttcttgcacttccacagt

SEQ ID NO: 322260 - DNA, 20 bp, Artificial Sequence
  chemically synthesized
cacacaacttccaactgtgg

SEQ ID NO: 322261 - DNA, 20 bp, Artificial Sequence
  chemically synthesized
tcttgcacttccacagttgg

SEQ ID NO: 322262 - DNA, 20 bp, Artificial Sequence
  chemically synthesized
aaacacacaacttccaactg

SEQ ID NO: 322263 - DNA, 20 bp, Artificial Sequence
  chemically synthesized
gtaggaggtaaggaattcgg

SEQ ID NO: 322264 - DNA, 20 bp, Artificial Sequence
  chemically synthesized
atggtaggaggtaaggaatt

SEQ ID NO: 322265 - DNA, 20 bp, Artificial Sequence
  chemically synthesized
acttgggatggtaggaggta

SEQ ID NO: 322266 - DNA, 20 bp, Artificial Sequence
  chemically synthesized
cacttgggatggtaggaggt

SEQ ID NO: 322267 - DNA, 20 bp, Artificial Sequence
  chemically synthesized
aatacacttgggatggtagg

SEQ ID NO: 322268 - DNA, 20 bp, Artificial Sequence
  chemically synthesized
gaatacacttgggatggtag

SEQ ID NO: 322269 - DNA, 20 bp, Artificial Sequence
  chemically synthesized
tggaatacacttgggatggt

SEQ ID NO: 322270 - DNA, 20 bp, Artificial Sequence
  chemically synthesized
tccttacctcctaccatccc

SEQ ID NO: 322271 - DNA, 20 bp, Artificial Sequence
  chemically synthesized
gtggaatacacttgggatgg

SEQ ID NO: 322272 - DNA, 20 bp, Artificial Sequence
  chemically synthesized
gctgtggaatacacttggga

SEQ ID NO: 322273 - DNA, 20 bp, Artificial Sequence
  chemically synthesized
taatgctgtggaatacactt

SEQ ID NO: 322274 - DNA, 20 bp, Artificial Sequence
  chemically synthesized
ttaatgctgtggaatacact

SEQ ID NO: 322275 - DNA, 20 bp, Artificial Sequence
  chemically synthesized
accatcccaagtgtattcca

SEQ ID NO: 322276 - DNA, 20 bp, Artificial Sequence
  chemically synthesized
tgattttttttttaatgctg

SEQ ID NO: 322277 - DNA, 20 bp, Artificial Sequence
  chemically synthesized
agcattaaaaaaaaaatcat

SEQ ID NO: 322278 - DNA, 20 bp, Artificial Sequence
  chemically synthesized
tagaaccccttaagaggagt

SEQ ID NO: 322279 - DNA, 20 bp, Artificial Sequence
  chemically synthesized
atcattggcttactcctctt

SEQ ID NO: 322280 - DNA, 20 bp, Artificial Sequence
  chemically synthesized
tcattggcttactcctctta

SEQ ID NO: 322281 - DNA, 20 bp, Artificial Sequence
  chemically synthesized
cattggcttactcctcttaa

SEQ ID NO: 322282 - DNA, 20 bp, Artificial Sequence
  chemically synthesized
ttgttagaaccccttaagag

SEQ ID NO: 322283 - DNA, 20 bp, Artificial Sequence
  chemically synthesized
attggcttactcctcttaag

SEQ ID NO: 322284 - DNA, 20 bp, Artificial Sequence
  chemically synthesized
ttttgttagaaccccttaag

SEQ ID NO: 322285 - DNA, 20 bp, Artificial Sequence
  chemically synthesized
gttttgttagaaccccttaa

SEQ ID NO: 322286 - DNA, 20 bp, Artificial Sequence
  chemically synthesized
tggttttgttagaacccctt

SEQ ID NO: 322287 - DNA, 20 bp, Artificial Sequence
  chemically synthesized
gaatattgatgtggttttgt

SEQ ID NO: 322288 - DNA, 20 bp, Artificial Sequence
  chemically synthesized
aaaacaagagaatattgatg

SEQ ID NO: 322289 - DNA, 20 bp, Artificial Sequence
  chemically synthesized
taatgtagtgtttaaaacaa

SEQ ID NO: 322290 - DNA, 20 bp, Artificial Sequence
  chemically synthesized
cataatgtagtgtttaaaac

SEQ ID NO: 322291 - DNA, 20 bp, Artificial Sequence
  chemically synthesized
gtgccattcctttcataatg

SEQ ID NO: 322292 - DNA, 20 bp, Artificial Sequence
  chemically synthesized
ttttaaacactacattatga

SEQ ID NO: 322293 - DNA, 20 bp, Artificial Sequence
  chemically synthesized
tttaaacactacattatgaa

SEQ ID NO: 322294 - DNA, 20 bp, Artificial Sequence
  chemically synthesized
acactacattatgaaaggaa

SEQ ID NO: 322295 - DNA, 20 bp, Artificial Sequence
  chemically synthesized
attatgaaaggaatggcact

SEQ ID NO: 322296 - DNA, 20 bp, Artificial Sequence
  chemically synthesized
atgatttaaatgagaaaact

SEQ ID NO: 322297 - DNA, 20 bp, Artificial Sequence
  chemically synthesized
aatgtttatatgatttaaat

SEQ ID NO: 322298 - DNA, 20 bp, Artificial Sequence
  chemically synthesized
catttaaatcatataaacat

SEQ ID NO: 322299 - DNA, 20 bp, Artificial Sequence
  chemically synthesized
aaatcatataaacattggta

SEQ ID NO: 322300 - DNA, 20 bp, Artificial Sequence
  chemically synthesized
ggtaaagttttgtaattgac

SEQ ID NO: 322301 - DNA, 20 bp, Artificial Sequence
  chemically synthesized
gttttgtaattgaccagtat

SEQ ID NO: 322302 - DNA, 20 bp, Artificial Sequence
  chemically synthesized
agtttggcacgtgccgatac

SEQ ID NO: 322303 - DNA, 20 bp, Artificial Sequence
  chemically synthesized
tctccagtcacaaatgagtt

SEQ ID NO: 322304 - DNA, 20 bp, Artificial Sequence
  chemically synthesized
acacatctccagtcacaaat

SEQ ID NO: 322305 - DNA, 20 bp, Artificial Sequence
  chemically synthesized
gtgccaaactcatttgtgac

SEQ ID NO: 322306 - DNA, 20 bp, Artificial Sequence
  chemically synthesized
gccaaactcatttgtgactg

SEQ ID NO: 322307 - DNA, 20 bp, Artificial Sequence
  chemically synthesized
gaagtttattaacacatctc

SEQ ID NO: 322308 - DNA, 20 bp, Artificial Sequence
  chemically synthesized
taaaagctaatacaataaag

SEQ ID NO: 322309 - DNA, 20 bp, Artificial Sequence
  chemically synthesized
aggtaaaagctaatacaata

SEQ ID NO: 322310 - DNA, 20 bp, Artificial Sequence
  chemically synthesized
aataaacttctttattgtat

SEQ ID NO: 322311 - DNA, 20 bp, Artificial Sequence
  chemically synthesized
ataaatttctgatgaggtaa

SEQ ID NO: 322312 - DNA, 20 bp, Artificial Sequence
  chemically synthesized
tgtattagcttttacctcat

SEQ ID NO: 322313 - DNA, 20 bp, Artificial Sequence
  chemically synthesized
atggacataaatttctgatg

SEQ ID NO: 322314 - DNA, 20 bp, Artificial Sequence
  chemically synthesized
tatggacataaatttctgat

SEQ ID NO: 322315 - DNA, 20 bp, Artificial Sequence
  chemically synthesized
tcagaaatttatgtccataa

SEQ ID NO: 322316 - DNA, 20 bp, Artificial Sequence
  chemically synthesized
ctccaattctgttgctttta

SEQ ID NO: 322317 - DNA, 20 bp, Artificial Sequence
  chemically synthesized
atttatgtccataaaagcaa

SEQ ID NO: 322318 - DNA, 20 bp, Artificial Sequence
  chemically synthesized
gtccataaaagcaacagaat

SEQ ID NO: 322319 - DNA, 20 bp, Artificial Sequence
  chemically synthesized
ccataaaagcaacagaattg

SEQ ID NO: 322320 - DNA, 20 bp, Artificial Sequence
  chemically synthesized
cataaaagcaacagaattgg

SEQ ID NO: 322321 - DNA, 20 bp, Artificial Sequence
  chemically synthesized
ataaaagcaacagaattgga

SEQ ID NO: 322322 - DNA, 20 bp, Artificial Sequence
  chemically synthesized
gaattggagggaaaatacaa

SEQ ID NO: 322323 - DNA, 20 bp, Artificial Sequence
  chemically synthesized
tggagggaaaatacaatagc

SEQ ID NO: 322324 - DNA, 20 bp, Artificial Sequence
  chemically synthesized
ggagggaaaatacaatagca

SEQ ID NO: 322325 - DNA, 20 bp, Artificial Sequence
  chemically synthesized
ggaaaatacaatagcaagga

SEQ ID NO: 322326 - DNA, 20 bp, Artificial Sequence
  chemically synthesized
tagcaaggaaagaatcaaat

SEQ ID NO: 322327 - DNA, 20 bp, Artificial Sequence
  chemically synthesized
gcaaggaaagaatcaaatga

SEQ ID NO: 322328 - DNA, 20 bp, Artificial Sequence
  chemically synthesized
gaaagaatcaaatgagagtg

SEQ ID NO: 322329 - DNA, 20 bp, Artificial Sequence
  chemically synthesized
caaatgagagtgtggttatg

SEQ ID NO: 322330 - DNA, 20 bp, Artificial Sequence
  chemically synthesized
aaatgagagtgtggttatga

SEQ ID NO: 322331 - DNA, 20 bp, Artificial Sequence
  chemically synthesized
atgagagtgtggttatgaag

SEQ ID NO: 322332 - DNA, 20 bp, Artificial Sequence
  chemically synthesized
gagtgtggttatgaaggaga

SEQ ID NO: 322333 - DNA, 20 bp, Artificial Sequence
  chemically synthesized
gtggttatgaaggagaaaga

SEQ ID NO: 322334 - DNA, 20 bp, Artificial Sequence
  chemically synthesized
tggttatgaaggagaaagaa

SEQ ID NO: 322335 - DNA, 20 bp, Artificial Sequence
  chemically synthesized
gttatgaaggagaaagaaag

SEQ ID NO: 322336 - DNA, 20 bp, Artificial Sequence
  chemically synthesized
ttatgaaggagaaagaaagg

SEQ ID NO: 322337 - DNA, 20 bp, Artificial Sequence
  chemically synthesized
tgaaggagaaagaaaggagg

SEQ ID NO: 322338 - DNA, 20 bp, Artificial Sequence
  chemically synthesized
gaaaggaggaagtatctgta

SEQ ID NO: 322339 - DNA, 20 bp, Artificial Sequence
  chemically synthesized
tgtcaggaaagataaccata

SEQ ID NO: 322340 - DNA, 20 bp, Artificial Sequence
  chemically synthesized
cttacaaaggaatgtcagga

SEQ ID NO: 322341 - DNA, 20 bp, Artificial Sequence
  chemically synthesized
tatgcttacaaaggaatgtc

SEQ ID NO: 322342 - DNA, 20 bp, Artificial Sequence
  chemically synthesized
atatgcttacaaaggaatgt

SEQ ID NO: 322343 - DNA, 20 bp, Artificial Sequence
  chemically synthesized
ctttcctgacattcctttgt

SEQ ID NO: 322344 - DNA, 20 bp, Artificial Sequence
  chemically synthesized
atttaaaaatatgcttacaa

SEQ ID NO: 322345 - DNA, 20 bp, Artificial Sequence
  chemically synthesized
catttaaaaatatgcttaca

SEQ ID NO: 322346 - DNA, 20 bp, Artificial Sequence
  chemically synthesized
ttgcagttattttttcacaa

SEQ ID NO: 322347 - DNA, 20 bp, Artificial Sequence
  chemically synthesized
gatgattagaaatacatttg

SEQ ID NO: 322348 - DNA, 20 bp, Artificial Sequence
  chemically synthesized
gggagcatgagcaggatgat

SEQ ID NO: 322349 - DNA, 20 bp, Artificial Sequence
  chemically synthesized
ggggataagggagcatgagc

SEQ ID NO: 322350 - DNA, 20 bp, Artificial Sequence
  chemically synthesized
tggggataagggagcatgag

SEQ ID NO: 322351 - DNA, 20 bp, Artificial Sequence
  chemically synthesized
gtatggggataagggagcat

SEQ ID NO: 322352 - DNA, 20 bp, Artificial Sequence
  chemically synthesized
tattttgtatggggataagg

SEQ ID NO: 322353 - DNA, 20 bp, Artificial Sequence
  chemically synthesized
gttattttgtatggggataa

SEQ ID NO: 322354 - DNA, 20 bp, Artificial Sequence
  chemically synthesized
ggttattttgtatggggata

SEQ ID NO: 322355 - DNA, 20 bp, Artificial Sequence
  chemically synthesized
tggttattttgtatggggat

SEQ ID NO: 322356 - DNA, 20 bp, Artificial Sequence
  chemically synthesized
agctgtggttattttgtatg

SEQ ID NO: 322357 - DNA, 20 bp, Artificial Sequence
  chemically synthesized
tagctgtggttattttgtat

SEQ ID NO: 322358 - DNA, 20 bp, Artificial Sequence
  chemically synthesized
atagctgtggttattttgta

SEQ ID NO: 322359 - DNA, 20 bp, Artificial Sequence
  chemically synthesized
atccccatacaaaataacca

SEQ ID NO: 322360 - DNA, 20 bp, Artificial Sequence
  chemically synthesized
tttcccaaagagtatagctg

SEQ ID NO: 322361 - DNA, 20 bp, Artificial Sequence
  chemically synthesized
ataaccacagctatactctt

SEQ ID NO: 322362 - DNA, 20 bp, Artificial Sequence
  chemically synthesized
tttttttttcccaaagagta

SEQ ID NO: 322363 - DNA, 20 bp, Artificial Sequence
  chemically synthesized
taaccacagctatactcttt

SEQ ID NO: 322364 - DNA, 20 bp, Artificial Sequence
  chemically synthesized
agtcatttttttttcccaaa

SEQ ID NO: 322365 - DNA, 20 bp, Artificial Sequence
  chemically synthesized
tcagtcatttttttttccca

SEQ ID NO: 322366 - DNA, 20 bp, Artificial Sequence
  chemically synthesized
tttgggaaaaaaaaatgact

SEQ ID NO: 322367 - DNA, 20 bp, Artificial Sequence
  chemically synthesized
ttgggaaaaaaaaatgactg

SEQ ID NO: 322368 - DNA, 20 bp, Artificial Sequence
  chemically synthesized
aaaaaaatgactgaggcaat

SEQ ID NO: 322369 - DNA, 20 bp, Artificial Sequence
  chemically synthesized
ccagccttttctaattgcct

SEQ ID NO: 322370 - DNA, 20 bp, Artificial Sequence
  chemically synthesized
aatgactgaggcaattagaa

SEQ ID NO: 322371 - DNA, 20 bp, Artificial Sequence
  chemically synthesized
atgactgaggcaattagaaa

SEQ ID NO: 322372 - DNA, 20 bp, Artificial Sequence
  chemically synthesized
ctgaggcaattagaaaaggc

SEQ ID NO: 322373 - DNA, 20 bp, Artificial Sequence
  chemically synthesized
gaggcaattagaaaaggctg

SEQ ID NO: 322374 - DNA, 20 bp, Artificial Sequence
  chemically synthesized
tgttttttactttttttctc

SEQ ID NO: 322375 - DNA, 20 bp, Artificial Sequence
  chemically synthesized
tagaaaaggctggagaaaaa

SEQ ID NO: 322376 - DNA, 20 bp, Artificial Sequence
  chemically synthesized
aaaaagtaaaaaacatctat

SEQ ID NO: 322377 - DNA, 20 bp, Artificial Sequence
  chemically synthesized
aaaagtaaaaaacatctatg

SEQ ID NO: 322378 - DNA, 20 bp, Artificial Sequence
  chemically synthesized
aaagtaaaaaacatctatga

SEQ ID NO: 322379 - DNA, 20 bp, Artificial Sequence
  chemically synthesized
taaaaaacatctatgagggt

SEQ ID NO: 322380 - DNA, 20 bp, Artificial Sequence
  chemically synthesized
gctaccaaacctgaccctca

SEQ ID NO: 322381 - DNA, 20 bp, Artificial Sequence
  chemically synthesized
aaaaaacatctatgagggtc

SEQ ID NO: 322382 - DNA, 20 bp, Artificial Sequence
  chemically synthesized
acatctatgagggtcaggtt

SEQ ID NO: 322383 - DNA, 20 bp, Artificial Sequence
  chemically synthesized
tctatgagggtcaggtttgg

SEQ ID NO: 322384 - DNA, 20 bp, Artificial Sequence
  chemically synthesized
gagggtcaggtttggtagct

SEQ ID NO: 322385 - DNA, 20 bp, Artificial Sequence
  chemically synthesized
agggtcaggtttggtagctc

SEQ ID NO: 322386 - DNA, 20 bp, Artificial Sequence
  chemically synthesized
agtactagtattacagacct

SEQ ID NO: 322387 - DNA, 20 bp, Artificial Sequence
  chemically synthesized
gtagctcaggtctgtaatac

SEQ ID NO: 322388 - DNA, 20 bp, Artificial Sequence
  chemically synthesized
ctcccaaagtactagtatta

SEQ ID NO: 322389 - DNA, 20 bp, Artificial Sequence
  chemically synthesized
ggtctgtaatactagtactt

SEQ ID NO: 322390 - DNA, 20 bp, Artificial Sequence
  chemically synthesized
gtctgtaatactagtacttt

SEQ ID NO: 322391 - DNA, 20 bp, Artificial Sequence
  chemically synthesized
accttggcctcccaaagtac

SEQ ID NO: 322392 - DNA, 20 bp, Artificial Sequence
  chemically synthesized
ctgtaatactagtactttgg

SEQ ID NO: 322393 - DNA, 20 bp, Artificial Sequence
  chemically synthesized
tgtaatactagtactttggg

SEQ ID NO: 322394 - DNA, 20 bp, Artificial Sequence
  chemically synthesized
tctcccaccttggcctccca

SEQ ID NO: 322395 - DNA, 20 bp, Artificial Sequence
  chemically synthesized
tactagtactttgggaggcc

SEQ ID NO: 322396 - DNA, 20 bp, Artificial Sequence
  chemically synthesized
actagtactttgggaggcca

SEQ ID NO: 322397 - DNA, 20 bp, Artificial Sequence
  chemically synthesized
agtactttgggaggccaagg

SEQ ID NO: 322398 - DNA, 20 bp, Artificial Sequence
  chemically synthesized
gtactttgggaggccaaggt

SEQ ID NO: 322399 - DNA, 20 bp, Artificial Sequence
  chemically synthesized
actttgggaggccaaggtgg

SEQ ID NO: 322400 - DNA, 20 bp, Artificial Sequence
  chemically synthesized
caagtgatcctctcccacct

SEQ ID NO: 322401 - DNA, 20 bp, Artificial Sequence
  chemically synthesized
tttgggaggccaaggtggga

SEQ ID NO: 322402 - DNA, 20 bp, Artificial Sequence
  chemically synthesized
ttgggaggccaaggtgggag

SEQ ID NO: 322403 - DNA, 20 bp, Artificial Sequence
  chemically synthesized
aaggtgggagaggatcactt

SEQ ID NO: 322404 - DNA, 20 bp, Artificial Sequence
  chemically synthesized
aggtgggagaggatcacttg

SEQ ID NO: 322405 - DNA, 20 bp, Artificial Sequence
  chemically synthesized
gggagaggatcacttgaggc

SEQ ID NO: 322406 - DNA, 20 bp, Artificial Sequence
  chemically synthesized
ggagaggatcacttgaggcc

SEQ ID NO: 322407 - DNA, 20 bp, Artificial Sequence
  chemically synthesized
agtctcaagctcctggcctc

SEQ ID NO: 322408 - DNA, 20 bp, Artificial Sequence
  chemically synthesized
agaggatcacttgaggccag

SEQ ID NO: 322409 - DNA, 20 bp, Artificial Sequence
  chemically synthesized
tcacttgaggccaggagctt

SEQ ID NO: 322410 - DNA, 20 bp, Artificial Sequence
  chemically synthesized
ccaggctagtctcaagctcc

SEQ ID NO: 322411 - DNA, 20 bp, Artificial Sequence
  chemically synthesized
tgaggccaggagcttgagac

SEQ ID NO: 322412 - DNA, 20 bp, Artificial Sequence
  chemically synthesized
atgtttcccaggctagtctc

SEQ ID NO: 322413 - DNA, 20 bp, Artificial Sequence
  chemically synthesized
ccaggagcttgagactagcc

SEQ ID NO: 322414 - DNA, 20 bp, Artificial Sequence
  chemically synthesized
caggagcttgagactagcct

SEQ ID NO: 322415 - DNA, 20 bp, Artificial Sequence
  chemically synthesized
tcttgttatgtttcccaggc

SEQ ID NO: 322416 - DNA, 20 bp, Artificial Sequence
  chemically synthesized
gaggtcttgttatgtttccc

SEQ ID NO: 322417 - DNA, 20 bp, Artificial Sequence
  chemically synthesized
tgaggtcttgttatgtttcc

SEQ ID NO: 322418 - DNA, 20 bp, Artificial Sequence
  chemically synthesized
actagcctgggaaacataac

SEQ ID NO: 322419 - DNA, 20 bp, Artificial Sequence
  chemically synthesized
aaaaaattttgcagggaatg

SEQ ID NO: 322420 - DNA, 20 bp, Artificial Sequence
  chemically synthesized
aaaaaaattttgcagggaat

SEQ ID NO: 322421 - DNA, 20 bp, Artificial Sequence
  chemically synthesized
acttttaaaaaaattttgca

SEQ ID NO: 322422 - DNA, 20 bp, Artificial Sequence
  chemically synthesized
aacttttaaaaaaattttgc

SEQ ID NO: 322423 - DNA, 20 bp, Artificial Sequence
  chemically synthesized
taacttttaaaaaaattttg

SEQ ID NO: 322424 - DNA, 20 bp, Artificial Sequence
  chemically synthesized
tccctgcaaaatttttttaa

SEQ ID NO: 322425 - DNA, 20 bp, Artificial Sequence
  chemically synthesized
aaagttaaaaaattatatat

SEQ ID NO: 322426 - DNA, 20 bp, Artificial Sequence
  chemically synthesized
aaattatataatacttcata

SEQ ID NO: 322427 - DNA, 20 bp, Artificial Sequence
  chemically synthesized
aatttgatattttctatatg

SEQ ID NO: 322428 - DNA, 20 bp, Artificial Sequence
  chemically synthesized
aatatcaaattacatataaa

SEQ ID NO: 322429 - DNA, 20 bp, Artificial Sequence
  chemically synthesized
attacatataaaaagtgaca

SEQ ID NO: 322430 - DNA, 20 bp, Artificial Sequence
  chemically synthesized
atataaaaagtgacatggta

SEQ ID NO: 322431 - DNA, 20 bp, Artificial Sequence
  chemically synthesized
agtgacatggtatggtaaaa

SEQ ID NO: 322432 - DNA, 20 bp, Artificial Sequence
  chemically synthesized
atggtaaaatagttaactga

SEQ ID NO: 322433 - DNA, 20 bp, Artificial Sequence
  chemically synthesized
taaataagatgatgagctgt

SEQ ID NO: 322434 - DNA, 20 bp, Artificial Sequence
  chemically synthesized
actgtgataaataagatgat

SEQ ID NO: 322435 - DNA, 20 bp, Artificial Sequence
  chemically synthesized
gaaagataactgtgataaat

SEQ ID NO: 322436 - DNA, 20 bp, Artificial Sequence
  chemically synthesized
gctcatcatcttatttatca

SEQ ID NO: 322437 - DNA, 20 bp, Artificial Sequence
  chemically synthesized
attattataaaatgtgaaga

SEQ ID NO: 322438 - DNA, 20 bp, Artificial Sequence
  chemically synthesized
caaaattattataaaatgtg

SEQ ID NO: 322439 - DNA, 20 bp, Artificial Sequence
  chemically synthesized
tgagatagggtataaaaagt

SEQ ID NO: 322440 - DNA, 20 bp, Artificial Sequence
  chemically synthesized
tagatgagatagggtataaa

SEQ ID NO: 322441 - DNA, 20 bp, Artificial Sequence
  chemically synthesized
gaaagatactagatgagata

SEQ ID NO: 322442 - DNA, 20 bp, Artificial Sequence
  chemically synthesized
tgaaagatactagatgagat

SEQ ID NO: 322443 - DNA, 20 bp, Artificial Sequence
  chemically synthesized
tttttataccctatctcatc

SEQ ID NO: 322444 - DNA, 20 bp, Artificial Sequence
  chemically synthesized
ctgaaagatactagatgaga

SEQ ID NO: 322445 - DNA, 20 bp, Artificial Sequence
  chemically synthesized
acctctgaaagatactagat

SEQ ID NO: 322446 - DNA, 20 bp, Artificial Sequence
  chemically synthesized
gacatacctctgaaagatac

SEQ ID NO: 322447 - DNA, 20 bp, Artificial Sequence
  chemically synthesized
ctatctcatctagtatcttt

SEQ ID NO: 322448 - DNA, 20 bp, Artificial Sequence
  chemically synthesized
atctcatctagtatctttca

SEQ ID NO: 322449 - DNA, 20 bp, Artificial Sequence
  chemically synthesized
tctcatctagtatctttcag

SEQ ID NO: 322450 - DNA, 20 bp, Artificial Sequence
  chemically synthesized
tgaggctgacatacctctga

SEQ ID NO: 322451 - DNA, 20 bp, Artificial Sequence
  chemically synthesized
agtatctttcagaggtatgt

SEQ ID NO: 322452 - DNA, 20 bp, Artificial Sequence
  chemically synthesized
aaaacagcaatagtgtcatg

SEQ ID NO: 322453 - DNA, 20 bp, Artificial Sequence
  chemically synthesized
taaaacagcaatagtgtcat

SEQ ID NO: 322454 - DNA, 20 bp, Artificial Sequence
  chemically synthesized
atagttttgtaaaacagcaa

SEQ ID NO: 322455 - DNA, 20 bp, Artificial Sequence
  chemically synthesized
tactttatagttttgtaaaa

SEQ ID NO: 322456 - DNA, 20 bp, Artificial Sequence
  chemically synthesized
tgctgttttacaaaactata

SEQ ID NO: 322457 - DNA, 20 bp, Artificial Sequence
  chemically synthesized
tgttttacaaaactataaag

SEQ ID NO: 322458 - DNA, 20 bp, Artificial Sequence
  chemically synthesized
ttttacaaaactataaagta

SEQ ID NO: 322459 - DNA, 20 bp, Artificial Sequence
  chemically synthesized
cttttctgttctctacttta

SEQ ID NO: 322460 - DNA, 20 bp, Artificial Sequence
  chemically synthesized
caaaactataaagtagagaa

SEQ ID NO: 322461 - DNA, 20 bp, Artificial Sequence
  chemically synthesized
ctataaagtagagaacagaa

SEQ ID NO: 322462 - DNA, 20 bp, Artificial Sequence
  chemically synthesized
aagtagagaacagaaaagaa

SEQ ID NO: 322463 - DNA, 20 bp, Artificial Sequence
  chemically synthesized
aaaagaaaagtatattgccc

SEQ ID NO: 322464 - DNA, 20 bp, Artificial Sequence
  chemically synthesized
acacttatttatgtgaactg

SEQ ID NO: 322465 - DNA, 20 bp, Artificial Sequence
  chemically synthesized
aacacttatttatgtgaact

SEQ ID NO: 322466 - DNA, 20 bp, Artificial Sequence
  chemically synthesized
aaacacttatttatgtgaac

SEQ ID NO: 322467 - DNA, 20 bp, Artificial Sequence
  chemically synthesized
ttgccccagttcacataaat

SEQ ID NO: 322468 - DNA, 20 bp, Artificial Sequence
  chemically synthesized
gttcacataaataagtgttt

SEQ ID NO: 322469 - DNA, 20 bp, Artificial Sequence
  chemically synthesized
acataaataagtgtttgaga

SEQ ID NO: 322470 - DNA, 20 bp, Artificial Sequence
  chemically synthesized
aaataagtgtttgagaaagc

SEQ ID NO: 322471 - DNA, 20 bp, Artificial Sequence
  chemically synthesized
ccagtttgcctaaggaataa

SEQ ID NO: 322472 - DNA, 20 bp, Artificial Sequence
  chemically synthesized
gaaagcaagcccttattcct

SEQ ID NO: 322473 - DNA, 20 bp, Artificial Sequence
  chemically synthesized
tccagtttgcctaaggaata

SEQ ID NO: 322474 - DNA, 20 bp, Artificial Sequence
  chemically synthesized
aaagcaagcccttattcctt

SEQ ID NO: 322475 - DNA, 20 bp, Artificial Sequence
  chemically synthesized
ctccagtttgcctaaggaat

SEQ ID NO: 322476 - DNA, 20 bp, Artificial Sequence
  chemically synthesized
aatcctctccagtttgccta

SEQ ID NO: 322477 - DNA, 20 bp, Artificial Sequence
  chemically synthesized
aaatcctctccagtttgcct

SEQ ID NO: 322478 - DNA, 20 bp, Artificial Sequence
  chemically synthesized
cccttattccttaggcaaac

SEQ ID NO: 322479 - DNA, 20 bp, Artificial Sequence
  chemically synthesized
cttattccttaggcaaactg

SEQ ID NO: 322480 - DNA, 20 bp, Artificial Sequence
  chemically synthesized
tattccttaggcaaactgga

SEQ ID NO: 322481 - DNA, 20 bp, Artificial Sequence
  chemically synthesized
attccttaggcaaactggag

SEQ ID NO: 322482 - DNA, 20 bp, Artificial Sequence
  chemically synthesized
gccttacataaaatcctctc

SEQ ID NO: 322483 - DNA, 20 bp, Artificial Sequence
  chemically synthesized
aactggagaggattttatgt

SEQ ID NO: 322484 - DNA, 20 bp, Artificial Sequence
  chemically synthesized
actggagaggattttatgta

SEQ ID NO: 322485 - DNA, 20 bp, Artificial Sequence
  chemically synthesized
ggagaggattttatgtaagg

SEQ ID NO: 322486 - DNA, 20 bp, Artificial Sequence
  chemically synthesized
attttatgtaaggcagaaat

SEQ ID NO: 322487 - DNA, 20 bp, Artificial Sequence
  chemically synthesized
ttttatgtaaggcagaaatc

SEQ ID NO: 322488 - DNA, 20 bp, Artificial Sequence
  chemically synthesized
tttatgtaaggcagaaatca

SEQ ID NO: 322489 - DNA, 20 bp, Artificial Sequence
  chemically synthesized
tattaaaaatacaaagataa

SEQ ID NO: 322490 - DNA, 20 bp, Artificial Sequence
  chemically synthesized
caagaaatattaaaaataca

SEQ ID NO: 322491 - DNA, 20 bp, Artificial Sequence
  chemically synthesized
catcaacaattatgcaaaac

SEQ ID NO: 322492 - DNA, 20 bp, Artificial Sequence
  chemically synthesized
ttgttttgcataattgttga

SEQ ID NO: 322493 - DNA, 20 bp, Artificial Sequence
  chemically synthesized
gcataattgttgatggttta

SEQ ID NO: 322494 - DNA, 20 bp, Artificial Sequence
  chemically synthesized
cataattgttgatggtttat

SEQ ID NO: 322495 - DNA, 20 bp, Artificial Sequence
  chemically synthesized
atgggataaatattatttcc

SEQ ID NO: 322496 - DNA, 20 bp, Artificial Sequence
  chemically synthesized
ctattattcaagttgcatct

SEQ ID NO: 322497 - DNA, 20 bp, Artificial Sequence
  chemically synthesized
actattattcaagttgcatc

SEQ ID NO: 322498 - DNA, 20 bp, Artificial Sequence
  chemically synthesized
cctagatgcaacttgaataa

SEQ ID NO: 322499 - DNA, 20 bp, Artificial Sequence
  chemically synthesized
gcccacagttactattattc

SEQ ID NO: 322500 - DNA, 20 bp, Artificial Sequence
  chemically synthesized
aacttgaataatagtaactg

SEQ ID NO: 322501 - DNA, 20 bp, Artificial Sequence
  chemically synthesized
acttgaataatagtaactgt

SEQ ID NO: 322502 - DNA, 20 bp, Artificial Sequence
  chemically synthesized
actgcttcaatttgtgccca

SEQ ID NO: 322503 - DNA, 20 bp, Artificial Sequence
  chemically synthesized
gtaactgtgggcacaaattg

SEQ ID NO: 322504 - DNA, 20 bp, Artificial Sequence
  chemically synthesized
actgtgggcacaaattgaag

SEQ ID NO: 322505 - DNA, 20 bp, Artificial Sequence
  chemically synthesized
attgaagcagtctatttcca

SEQ ID NO: 322506 - DNA, 20 bp, Artificial Sequence
  chemically synthesized
ttgaagcagtctatttccaa

SEQ ID NO: 322507 - DNA, 20 bp, Artificial Sequence
  chemically synthesized
agtgctttttcctttggaaa

SEQ ID NO: 322508 - DNA, 20 bp, Artificial Sequence
  chemically synthesized
cagtctatttccaaaggaaa

SEQ ID NO: 322509 - DNA, 20 bp, Artificial Sequence
  chemically synthesized
agtaaaagtgctttttcctt

SEQ ID NO: 322510 - DNA, 20 bp, Artificial Sequence
  chemically synthesized
ttttttccttttgacagtaa

SEQ ID NO: 322511 - DNA, 20 bp, Artificial Sequence
  chemically synthesized
aaaagcacttttactgtcaa

SEQ ID NO: 322512 - DNA, 20 bp, Artificial Sequence
  chemically synthesized
aaagcacttttactgtcaaa

SEQ ID NO: 322513 - DNA, 20 bp, Artificial Sequence
  chemically synthesized
ctatttttttttccttttga

SEQ ID NO: 322514 - DNA, 20 bp, Artificial Sequence
  chemically synthesized
ctgtcaaaaggaaaaaaaaa

SEQ ID NO: 322515 - DNA, 20 bp, Artificial Sequence
  chemically synthesized
tgtcaaaaggaaaaaaaaat

SEQ ID NO: 322516 - DNA, 20 bp, Artificial Sequence
  chemically synthesized
accacttctctgtttagttt

SEQ ID NO: 322517 - DNA, 20 bp, Artificial Sequence
  chemically synthesized
aaataggaactaaaactaaa

SEQ ID NO: 322518 - DNA, 20 bp, Artificial Sequence
  chemically synthesized
ataggaactaaaactaaaca

SEQ ID NO: 322519 - DNA, 20 bp, Artificial Sequence
  chemically synthesized
ggaactaaaactaaacagag

SEQ ID NO: 322520 - DNA, 20 bp, Artificial Sequence
  chemically synthesized
ttaaaaaccacttctctgtt

SEQ ID NO: 322521 - DNA, 20 bp, Artificial Sequence
  chemically synthesized
actaaaactaaacagagaag

SEQ ID NO: 322522 - DNA, 20 bp, Artificial Sequence
  chemically synthesized
tggtttttaaaataactaaa

SEQ ID NO: 322523 - DNA, 20 bp, Artificial Sequence
  chemically synthesized
tttaaaataactaaatggct

SEQ ID NO: 322524 - DNA, 20 bp, Artificial Sequence
  chemically synthesized
actttactatcttagccatt

SEQ ID NO: 322525 - DNA, 20 bp, Artificial Sequence
  chemically synthesized
aaataactaaatggctaaga

SEQ ID NO: 322526 - DNA, 20 bp, Artificial Sequence
  chemically synthesized
aaaagtatactttactatct

SEQ ID NO: 322527 - DNA, 20 bp, Artificial Sequence
  chemically synthesized
actaaatggctaagatagta

SEQ ID NO: 322528 - DNA, 20 bp, Artificial Sequence
  chemically synthesized
ccagctggtagttgtgataa

SEQ ID NO: 322529 - DNA, 20 bp, Artificial Sequence
  chemically synthesized
tatacttttatcacaactac

SEQ ID NO: 322530 - DNA, 20 bp, Artificial Sequence
  chemically synthesized
cttttatcacaactaccagc

SEQ ID NO: 322531 - DNA, 20 bp, Artificial Sequence
  chemically synthesized
tagtgtcttagaccagctgg

SEQ ID NO: 322532 - DNA, 20 bp, Artificial Sequence
  chemically synthesized
cagtagtgtcttagaccagc

SEQ ID NO: 322533 - DNA, 20 bp, Artificial Sequence
  chemically synthesized
tcacaactaccagctggtct

SEQ ID NO: 322534 - DNA, 20 bp, Artificial Sequence
  chemically synthesized
gacacagtagtgtcttagac

SEQ ID NO: 322535 - DNA, 20 bp, Artificial Sequence
  chemically synthesized
gttaagacacagtagtgtct

SEQ ID NO: 322536 - DNA, 20 bp, Artificial Sequence
  chemically synthesized
gttggccagttaagacacag

SEQ ID NO: 322537 - DNA, 20 bp, Artificial Sequence
  chemically synthesized
gaagttggccagttaagaca

SEQ ID NO: 322538 - DNA, 20 bp, Artificial Sequence
  chemically synthesized
agacactactgtgtcttaac

SEQ ID NO: 322539 - DNA, 20 bp, Artificial Sequence
  chemically synthesized
gccagtgaagttggccagtt

SEQ ID NO: 322540 - DNA, 20 bp, Artificial Sequence
  chemically synthesized
attaggccagtgaagttggc

SEQ ID NO: 322541 - DNA, 20 bp, Artificial Sequence
  chemically synthesized
tcttaactggccaacttcac

SEQ ID NO: 322542 - DNA, 20 bp, Artificial Sequence
  chemically synthesized
agttattaggccagtgaagt

SEQ ID NO: 322543 - DNA, 20 bp, Artificial Sequence
  chemically synthesized
ggacagttattaggccagtg

SEQ ID NO: 322544 - DNA, 20 bp, Artificial Sequence
  chemically synthesized
agagaggacagttattaggc

SEQ ID NO: 322545 - DNA, 20 bp, Artificial Sequence
  chemically synthesized
aggaagagaggacagttatt

SEQ ID NO: 322546 - DNA, 20 bp, Artificial Sequence
  chemically synthesized
gaggaagagaggacagttat

SEQ ID NO: 322547 - DNA, 20 bp, Artificial Sequence
  chemically synthesized
gccactggaggaagagagga

SEQ ID NO: 322548 - DNA, 20 bp, Artificial Sequence
  chemically synthesized
gaaggccactggaggaagag

SEQ ID NO: 322549 - DNA, 20 bp, Artificial Sequence
  chemically synthesized
ggaaggccactggaggaaga

SEQ ID NO: 322550 - DNA, 20 bp, Artificial Sequence
  chemically synthesized
ataactgtcctctcttcctc

SEQ ID NO: 322551 - DNA, 20 bp, Artificial Sequence
  chemically synthesized
caggaaggccactggaggaa

SEQ ID NO: 322552 - DNA, 20 bp, Artificial Sequence
  chemically synthesized
actgtcctctcttcctccag

SEQ ID NO: 322553 - DNA, 20 bp, Artificial Sequence
  chemically synthesized
atcaggaaggccactggagg

SEQ ID NO: 322554 - DNA, 20 bp, Artificial Sequence
  chemically synthesized
cctatcaggaaggccactgg

SEQ ID NO: 322555 - DNA, 20 bp, Artificial Sequence
  chemically synthesized
acctatcaggaaggccactg

SEQ ID NO: 322556 - DNA, 20 bp, Artificial Sequence
  chemically synthesized
aaacctatcaggaaggccac

SEQ ID NO: 322557 - DNA, 20 bp, Artificial Sequence
  chemically synthesized
tcctccagtggccttcctga

SEQ ID NO: 322558 - DNA, 20 bp, Artificial Sequence
  chemically synthesized
cctccagtggccttcctgat

SEQ ID NO: 322559 - DNA, 20 bp, Artificial Sequence
  chemically synthesized
gtcaagaaaacctatcagga

SEQ ID NO: 322560 - DNA, 20 bp, Artificial Sequence
  chemically synthesized
ggtcaagaaaacctatcagg

SEQ ID NO: 322561 - DNA, 20 bp, Artificial Sequence
  chemically synthesized
ataggtcaagaaaacctatc

SEQ ID NO: 322562 - DNA, 20 bp, Artificial Sequence
  chemically synthesized
gataggtcaagaaaacctat

SEQ ID NO: 322563 - DNA, 20 bp, Artificial Sequence
  chemically synthesized
atgtaggtgagagataggtc

SEQ ID NO: 322564 - DNA, 20 bp, Artificial Sequence
  chemically synthesized
attttatgtaggtgagagat

SEQ ID NO: 322565 - DNA, 20 bp, Artificial Sequence
  chemically synthesized
gattttatgtaggtgagaga

SEQ ID NO: 322566 - DNA, 20 bp, Artificial Sequence
  chemically synthesized
atcagattttatgtaggtga

SEQ ID NO: 322567 - DNA, 20 bp, Artificial Sequence
  chemically synthesized
ccatcagattttatgtaggt

SEQ ID NO: 322568 - DNA, 20 bp, Artificial Sequence
  chemically synthesized
aaagccatcagattttatgt

SEQ ID NO: 322569 - DNA, 20 bp, Artificial Sequence
  chemically synthesized
caaagccatcagattttatg

SEQ ID NO: 322570 - DNA, 20 bp, Artificial Sequence
  chemically synthesized
ctcacctacataaaatctga

SEQ ID NO: 322571 - DNA, 20 bp, Artificial Sequence
  chemically synthesized
taagtgcaagacaaagccat

SEQ ID NO: 322572 - DNA, 20 bp, Artificial Sequence
  chemically synthesized
tctagactaagtgcaagaca

SEQ ID NO: 322573 - DNA, 20 bp, Artificial Sequence
  chemically synthesized
tgatggctttgtcttgcact

SEQ ID NO: 322574 - DNA, 20 bp, Artificial Sequence
  chemically synthesized
ttgaattctagactaagtgc

SEQ ID NO: 322575 - DNA, 20 bp, Artificial Sequence
  chemically synthesized
gctttgtcttgcacttagtc

SEQ ID NO: 322576 - DNA, 20 bp, Artificial Sequence
  chemically synthesized
agggctttgaattctagact

SEQ ID NO: 322577 - DNA, 20 bp, Artificial Sequence
  chemically synthesized
tgcacttagtctagaattca

SEQ ID NO: 322578 - DNA, 20 bp, Artificial Sequence
  chemically synthesized
tgaataagggctttgaattc

SEQ ID NO: 322579 - DNA, 20 bp, Artificial Sequence
  chemically synthesized
gaattcaaagcccttattca

SEQ ID NO: 322580 - DNA, 20 bp, Artificial Sequence
  chemically synthesized
tcagtcagggctttgaataa

SEQ ID NO: 322581 - DNA, 20 bp, Artificial Sequence
  chemically synthesized
gtcagtcagggctttgaata

SEQ ID NO: 322582 - DNA, 20 bp, Artificial Sequence
  chemically synthesized
tgtcagtcagggctttgaat

SEQ ID NO: 322583 - DNA, 20 bp, Artificial Sequence
  chemically synthesized
acatattgtagtgtcagtca

SEQ ID NO: 322584 - DNA, 20 bp, Artificial Sequence
  chemically synthesized
tacatattgtagtgtcagtc

SEQ ID NO: 322585 - DNA, 20 bp, Artificial Sequence
  chemically synthesized
ttacatattgtagtgtcagt

SEQ ID NO: 322586 - DNA, 20 bp, Artificial Sequence
  chemically synthesized
ctgattacatattgtagtgt

SEQ ID NO: 322587 - DNA, 20 bp, Artificial Sequence
  chemically synthesized
aggagactgattacatattg

SEQ ID NO: 322588 - DNA, 20 bp, Artificial Sequence
  chemically synthesized
ctgacactacaatatgtaat

SEQ ID NO: 322589 - DNA, 20 bp, Artificial Sequence
  chemically synthesized
tggggttgaaatataggtag

SEQ ID NO: 322590 - DNA, 20 bp, Artificial Sequence
  chemically synthesized
gatggggttgaaatataggt

SEQ ID NO: 322591 - DNA, 20 bp, Artificial Sequence
  chemically synthesized
agatggggttgaaatatagg

SEQ ID NO: 322592 - DNA, 20 bp, Artificial Sequence
  chemically synthesized
ctgagatggggttgaaatat

SEQ ID NO: 322593 - DNA, 20 bp, Artificial Sequence
  chemically synthesized
tctgagatggggttgaaata

SEQ ID NO: 322594 - DNA, 20 bp, Artificial Sequence
  chemically synthesized
cctatatttcaaccccatct

SEQ ID NO: 322595 - DNA, 20 bp, Artificial Sequence
  chemically synthesized
gatggctgaggtctgagatg

SEQ ID NO: 322596 - DNA, 20 bp, Artificial Sequence
  chemically synthesized
agatggctgaggtctgagat

SEQ ID NO: 322597 - DNA, 20 bp, Artificial Sequence
  chemically synthesized
tagatggctgaggtctgaga

SEQ ID NO: 322598 - DNA, 20 bp, Artificial Sequence
  chemically synthesized
ttcaaccccatctcagacct

SEQ ID NO: 322599 - DNA, 20 bp, Artificial Sequence
  chemically synthesized
aagttagatggctgaggtct

SEQ ID NO: 322600 - DNA, 20 bp, Artificial Sequence
  chemically synthesized
ggtggtaagttagatggctg

SEQ ID NO: 322601 - DNA, 20 bp, Artificial Sequence
  chemically synthesized
gggtggtaagttagatggct

SEQ ID NO: 322602 - DNA, 20 bp, Artificial Sequence
  chemically synthesized
ttgcagggtggtaagttaga

SEQ ID NO: 322603 - DNA, 20 bp, Artificial Sequence
  chemically synthesized
agagttgcagggtggtaagt

SEQ ID NO: 322604 - DNA, 20 bp, Artificial Sequence
  chemically synthesized
ctgtagagttgcagggtggt

SEQ ID NO: 322605 - DNA, 20 bp, Artificial Sequence
  chemically synthesized
gggactgtagagttgcaggg

SEQ ID NO: 322606 - DNA, 20 bp, Artificial Sequence
  chemically synthesized
agggggactgtagagttgca

SEQ ID NO: 322607 - DNA, 20 bp, Artificial Sequence
  chemically synthesized
cagggggactgtagagttgc

SEQ ID NO: 322608 - DNA, 20 bp, Artificial Sequence
  chemically synthesized
ccagggggactgtagagttg

SEQ ID NO: 322609 - DNA, 20 bp, Artificial Sequence
  chemically synthesized
cttaccaccctgcaactcta

SEQ ID NO: 322610 - DNA, 20 bp, Artificial Sequence
  chemically synthesized
aaaaggccagggggactgta

SEQ ID NO: 322611 - DNA, 20 bp, Artificial Sequence
  chemically synthesized
ccaaaaggccagggggactg

SEQ ID NO: 322612 - DNA, 20 bp, Artificial Sequence
  chemically synthesized
ctgcaactctacagtccccc

SEQ ID NO: 322613 - DNA, 20 bp, Artificial Sequence
  chemically synthesized
ggaggaaccaaaaggccagg

SEQ ID NO: 322614 - DNA, 20 bp, Artificial Sequence
  chemically synthesized
tggaggaaccaaaaggccag

SEQ ID NO: 322615 - DNA, 20 bp, Artificial Sequence
  chemically synthesized
ctggaggaaccaaaaggcca

SEQ ID NO: 322616 - DNA, 20 bp, Artificial Sequence
  chemically synthesized
ctacagtccccctggccttt

SEQ ID NO: 322617 - DNA, 20 bp, Artificial Sequence
  chemically synthesized
gctggaggaaccaaaaggcc

SEQ ID NO: 322618 - DNA, 20 bp, Artificial Sequence
  chemically synthesized
tgctggaggaaccaaaaggc

SEQ ID NO: 322619 - DNA, 20 bp, Artificial Sequence
  chemically synthesized
ggcttgctggaggaaccaaa

SEQ ID NO: 322620 - DNA, 20 bp, Artificial Sequence
  chemically synthesized
tggcttgctggaggaaccaa

SEQ ID NO: 322621 - DNA, 20 bp, Artificial Sequence
  chemically synthesized
ccctggccttttggttcctc

SEQ ID NO: 322622 - DNA, 20 bp, Artificial Sequence
  chemically synthesized
ggccttttggttcctccagc

SEQ ID NO: 322623 - DNA, 20 bp, Artificial Sequence
  chemically synthesized
gggacagtttggcttgctgg

SEQ ID NO: 322624 - DNA, 20 bp, Artificial Sequence
  chemically synthesized
agggacagtttggcttgctg

SEQ ID NO: 322625 - DNA, 20 bp, Artificial Sequence
  chemically synthesized
atagggacagtttggcttgc

SEQ ID NO: 322626 - DNA, 20 bp, Artificial Sequence
  chemically synthesized
gcccaaaaatagggacagtt

SEQ ID NO: 322627 - DNA, 20 bp, Artificial Sequence
  chemically synthesized
caaaggcccaaaaataggga

SEQ ID NO: 322628 - DNA, 20 bp, Artificial Sequence
  chemically synthesized
agccaaactgtccctatttt

SEQ ID NO: 322629 - DNA, 20 bp, Artificial Sequence
  chemically synthesized
gccaaactgtccctattttt

SEQ ID NO: 322630 - DNA, 20 bp, Artificial Sequence
  chemically synthesized
aatgcaaaggcccaaaaata

SEQ ID NO: 322631 - DNA, 20 bp, Artificial Sequence
  chemically synthesized
taatgcaaaggcccaaaaat

SEQ ID NO: 322632 - DNA, 20 bp, Artificial Sequence
  chemically synthesized
ctaatgcaaaggcccaaaaa

SEQ ID NO: 322633 - DNA, 20 bp, Artificial Sequence
  chemically synthesized
ctatttttgggcctttgcat

SEQ ID NO: 322634 - DNA, 20 bp, Artificial Sequence
  chemically synthesized
attaggaacagctaatgcaa

SEQ ID NO: 322635 - DNA, 20 bp, Artificial Sequence
  chemically synthesized
gattaggaacagctaatgca

SEQ ID NO: 322636 - DNA, 20 bp, Artificial Sequence
  chemically synthesized
tgtggttcacggattaggaa

SEQ ID NO: 322637 - DNA, 20 bp, Artificial Sequence
  chemically synthesized
ggaagtgtggttcacggatt

SEQ ID NO: 322638 - DNA, 20 bp, Artificial Sequence
  chemically synthesized
aggaagtgtggttcacggat

SEQ ID NO: 322639 - DNA, 20 bp, Artificial Sequence
  chemically synthesized
tcacaaggaagtgtggttca

SEQ ID NO: 322640 - DNA, 20 bp, Artificial Sequence
  chemically synthesized
ttgcagatcacaaggaagtg

SEQ ID NO: 322641 - DNA, 20 bp, Artificial Sequence
  chemically synthesized
actatttgcagatcacaagg

SEQ ID NO: 322642 - DNA, 20 bp, Artificial Sequence
  chemically synthesized
accactatttgcagatcaca

SEQ ID NO: 322643 - DNA, 20 bp, Artificial Sequence
  chemically synthesized
taccactatttgcagatcac

SEQ ID NO: 322644 - DNA, 20 bp, Artificial Sequence
  chemically synthesized
acttccttgtgatctgcaaa

SEQ ID NO: 322645 - DNA, 20 bp, Artificial Sequence
  chemically synthesized
tccttgtgatctgcaaatag

SEQ ID NO: 322646 - DNA, 20 bp, Artificial Sequence
  chemically synthesized
caagaaggtaccactatttg

SEQ ID NO: 322647 - DNA, 20 bp, Artificial Sequence
  chemically synthesized
ttgagatttgaatgacaaga

SEQ ID NO: 322648 - DNA, 20 bp, Artificial Sequence
  chemically synthesized
tttgagatttgaatgacaag

SEQ ID NO: 322649 - DNA, 20 bp, Artificial Sequence
  chemically synthesized
tagtttgagatttgaatgac

SEQ ID NO: 322650 - DNA, 20 bp, Artificial Sequence
  chemically synthesized
aggttggtaccatttagttt

SEQ ID NO: 322651 - DNA, 20 bp, Artificial Sequence
  chemically synthesized
cattcaaatctcaaactaaa

SEQ ID NO: 322652 - DNA, 20 bp, Artificial Sequence
  chemically synthesized
ctttgaaggttggtaccatt

SEQ ID NO: 322653 - DNA, 20 bp, Artificial Sequence
  chemically synthesized
ctaaatggtaccaaccttca

SEQ ID NO: 322654 - DNA, 20 bp, Artificial Sequence
  chemically synthesized
ccaggtaagactttgaaggt

SEQ ID NO: 322655 - DNA, 20 bp, Artificial Sequence
  chemically synthesized
tgatccaggtaagactttga

SEQ ID NO: 322656 - DNA, 20 bp, Artificial Sequence
  chemically synthesized
gtgatccaggtaagactttg

SEQ ID NO: 322657 - DNA, 20 bp, Artificial Sequence
  chemically synthesized
ccaaccttcaaagtcttacc

SEQ ID NO: 322658 - DNA, 20 bp, Artificial Sequence
  chemically synthesized
ttagactttgtgatccaggt

SEQ ID NO: 322659 - DNA, 20 bp, Artificial Sequence
  chemically synthesized
tactttagactttgtgatcc

SEQ ID NO: 322660 - DNA, 20 bp, Artificial Sequence
  chemically synthesized
aaagtcttacctggatcaca

SEQ ID NO: 322661 - DNA, 20 bp, Artificial Sequence
  chemically synthesized
ctactttagactttgtgatc

SEQ ID NO: 322662 - DNA, 20 bp, Artificial Sequence
  chemically synthesized
tacctggatcacaaagtcta

SEQ ID NO: 322663 - DNA, 20 bp, Artificial Sequence
  chemically synthesized
ctggatcacaaagtctaaag

SEQ ID NO: 322664 - DNA, 20 bp, Artificial Sequence
  chemically synthesized
tggttgaggggaggctactt

SEQ ID NO: 322665 - DNA, 20 bp, Artificial Sequence
  chemically synthesized
gatagagaatggttgagggg

SEQ ID NO: 322666 - DNA, 20 bp, Artificial Sequence
  chemically synthesized
tgatagagaatggttgaggg

SEQ ID NO: 322667 - DNA, 20 bp, Artificial Sequence
  chemically synthesized
tgtgatagagaatggttgag

SEQ ID NO: 322668 - DNA, 20 bp, Artificial Sequence
  chemically synthesized
atgtgatagagaatggttga

SEQ ID NO: 322669 - DNA, 20 bp, Artificial Sequence
  chemically synthesized
aatgtgatagagaatggttg

SEQ ID NO: 322670 - DNA, 20 bp, Artificial Sequence
  chemically synthesized
taatgtgatagagaatggtt

SEQ ID NO: 322671 - DNA, 20 bp, Artificial Sequence
  chemically synthesized
aaatgtaatgtgatagagaa

SEQ ID NO: 322672 - DNA, 20 bp, Artificial Sequence
  chemically synthesized
gattaaaatgtaatgtgata

SEQ ID NO: 322673 - DNA, 20 bp, Artificial Sequence
  chemically synthesized
gagattaaaatgtaatgtga

SEQ ID NO: 322674 - DNA, 20 bp, Artificial Sequence
  chemically synthesized
ataggaatatagtttttgaa

SEQ ID NO: 322675 - DNA, 20 bp, Artificial Sequence
  chemically synthesized
ggataggaatatagtttttg

SEQ ID NO: 322676 - DNA, 20 bp, Artificial Sequence
  chemically synthesized
aaaaataccggataggaata

SEQ ID NO: 322677 - DNA, 20 bp, Artificial Sequence
  chemically synthesized
tcaaaaactatattcctatc

SEQ ID NO: 322678 - DNA, 20 bp, Artificial Sequence
  chemically synthesized
acacaagaaaaataccggat

SEQ ID NO: 322679 - DNA, 20 bp, Artificial Sequence
  chemically synthesized
aacacaagaaaaataccgga

SEQ ID NO: 322680 - DNA, 20 bp, Artificial Sequence
  chemically synthesized
aaagaacacaagaaaaatac

SEQ ID NO: 322681 - DNA, 20 bp, Artificial Sequence
  chemically synthesized
gccaagaaaaaaaagaacac

SEQ ID NO: 322682 - DNA, 20 bp, Artificial Sequence
  chemically synthesized
ggctggcagccaagaaaaaa

SEQ ID NO: 322683 - DNA, 20 bp, Artificial Sequence
  chemically synthesized
tcttgtgttcttttttttct

SEQ ID NO: 322684 - DNA, 20 bp, Artificial Sequence
  chemically synthesized
ttcttttttttcttggctgc

SEQ ID NO: 322685 - DNA, 20 bp, Artificial Sequence
  chemically synthesized
ttctgtagaggctggcagcc

SEQ ID NO: 322686 - DNA, 20 bp, Artificial Sequence
  chemically synthesized
acatattctgtagaggctgg

SEQ ID NO: 322687 - DNA, 20 bp, Artificial Sequence
  chemically synthesized
ttcttggctgccagcctcta

SEQ ID NO: 322688 - DNA, 20 bp, Artificial Sequence
  chemically synthesized
gaaacatattctgtagaggc

SEQ ID NO: 322689 - DNA, 20 bp, Artificial Sequence
  chemically synthesized
tcatgaaacatattctgtag

SEQ ID NO: 322690 - DNA, 20 bp, Artificial Sequence
  chemically synthesized
ctcatgaaacatattctgta

SEQ ID NO: 322691 - DNA, 20 bp, Artificial Sequence
  chemically synthesized
atctcatgaaacatattctg

SEQ ID NO: 322692 - DNA, 20 bp, Artificial Sequence
  chemically synthesized
ctctacagaatatgtttcat

SEQ ID NO: 322693 - DNA, 20 bp, Artificial Sequence
  chemically synthesized
agaatatgtttcatgagatc

SEQ ID NO: 322694 - DNA, 20 bp, Artificial Sequence
  chemically synthesized
gaatatgtttcatgagatct

SEQ ID NO: 322695 - DNA, 20 bp, Artificial Sequence
  chemically synthesized
aatatgtttcatgagatctg

SEQ ID NO: 322696 - DNA, 20 bp, Artificial Sequence
  chemically synthesized
tgtttcatgagatctggggc

SEQ ID NO: 322697 - DNA, 20 bp, Artificial Sequence
  chemically synthesized
gatcatacaaggtctggccc

SEQ ID NO: 322698 - DNA, 20 bp, Artificial Sequence
  chemically synthesized
aataatgatcatacaaggtc

SEQ ID NO: 322699 - DNA, 20 bp, Artificial Sequence
  chemically synthesized
gactcaataatgatcataca

SEQ ID NO: 322700 - DNA, 20 bp, Artificial Sequence
  chemically synthesized
agactcaataatgatcatac

SEQ ID NO: 322701 - DNA, 20 bp, Artificial Sequence
  chemically synthesized
gaccttgtatgatcattatt

SEQ ID NO: 322702 - DNA, 20 bp, Artificial Sequence
  chemically synthesized
tatgatcattattgagtctc

SEQ ID NO: 322703 - DNA, 20 bp, Artificial Sequence
  chemically synthesized
aaaaacaattaatggcactg

SEQ ID NO: 322704 - DNA, 20 bp, Artificial Sequence
  chemically synthesized
tcaaaaacaattaatggcac

SEQ ID NO: 322705 - DNA, 20 bp, Artificial Sequence
  chemically synthesized
acattatcaaaaacaattaa

SEQ ID NO: 322706 - DNA, 20 bp, Artificial Sequence
  chemically synthesized
tctatatgaacaaatattaa

SEQ ID NO: 322707 - DNA, 20 bp, Artificial Sequence
  chemically synthesized
tccattaatatttgttcata

SEQ ID NO: 322708 - DNA, 20 bp, Artificial Sequence
  chemically synthesized
cattaatatttgttcatata

SEQ ID NO: 322709 - DNA, 20 bp, Artificial Sequence
  chemically synthesized
ttaatatttgttcatataga

SEQ ID NO: 322710 - DNA, 20 bp, Artificial Sequence
  chemically synthesized
atttgatatatagtcattgt

SEQ ID NO: 322711 - DNA, 20 bp, Artificial Sequence
  chemically synthesized
atcaaattatatttgatata

SEQ ID NO: 322712 - DNA, 20 bp, Artificial Sequence
  chemically synthesized
atataatttgatgttgctat

SEQ ID NO: 322713 - DNA, 20 bp, Artificial Sequence
  chemically synthesized
tataatttgatgttgctatt

SEQ ID NO: 322714 - DNA, 20 bp, Artificial Sequence
  chemically synthesized
atttgatgttgctattaggt

SEQ ID NO: 322715 - DNA, 20 bp, Artificial Sequence
  chemically synthesized
ttacttttgtaccaacctaa

SEQ ID NO: 322716 - DNA, 20 bp, Artificial Sequence
  chemically synthesized
ttgctattaggttggtacaa

SEQ ID NO: 322717 - DNA, 20 bp, Artificial Sequence
  chemically synthesized
ggttggtacaaaagtaatta

SEQ ID NO: 322718 - DNA, 20 bp, Artificial Sequence
  chemically synthesized
ttttttccattgtaagtaat

SEQ ID NO: 322719 - DNA, 20 bp, Artificial Sequence
  chemically synthesized
tttttttccattgtaagtaa

SEQ ID NO: 322720 - DNA, 20 bp, Artificial Sequence
  chemically synthesized
gtttttcccattacttacaa

SEQ ID NO: 322721 - DNA, 20 bp, Artificial Sequence
  chemically synthesized
atcatgtttttttccattgt

SEQ ID NO: 322722 - DNA, 20 bp, Artificial Sequence
  chemically synthesized
aaaaaacatgattacttttg

SEQ ID NO: 322723 - DNA, 20 bp, Artificial Sequence
  chemically synthesized
ttactattaggttgctgcaa

SEQ ID NO: 322724 - DNA, 20 bp, Artificial Sequence
  chemically synthesized
ttacttttgcagcaacctaa

SEQ ID NO: 322725 - DNA, 20 bp, Artificial Sequence
  chemically synthesized
ttttgcagcaacctaatagt

SEQ ID NO: 322726 - DNA, 20 bp, Artificial Sequence
  chemically synthesized
ctaccaacatacttactatt

SEQ ID NO: 322727 - DNA, 20 bp, Artificial Sequence
  chemically synthesized
tctaccaacatacttactat

SEQ ID NO: 322728 - DNA, 20 bp, Artificial Sequence
  chemically synthesized
caacctaatagtaagtatgt

SEQ ID NO: 322729 - DNA, 20 bp, Artificial Sequence
  chemically synthesized
cctaatagtaagtatgttgg

SEQ ID NO: 322730 - DNA, 20 bp, Artificial Sequence
  chemically synthesized
atagtaagtatgttggtaga

SEQ ID NO: 322731 - DNA, 20 bp, Artificial Sequence
  chemically synthesized
tagtaagtatgttggtagat

SEQ ID NO: 322732 - DNA, 20 bp, Artificial Sequence
  chemically synthesized
agataggattaataattgct

SEQ ID NO: 322733 - DNA, 20 bp, Artificial Sequence
  chemically synthesized
aatctatgaacatttacact

SEQ ID NO: 322734 - DNA, 20 bp, Artificial Sequence
  chemically synthesized
ttgctaagtgtaaatgttca

SEQ ID NO: 322735 - DNA, 20 bp, Artificial Sequence
  chemically synthesized
gtgtaaatgttcatagattt

SEQ ID NO: 322736 - DNA, 20 bp, Artificial Sequence
  chemically synthesized
tgttcatagattttagtgat

SEQ ID NO: 322737 - DNA, 20 bp, Artificial Sequence
  chemically synthesized
aacttcttgtaaatacagat

SEQ ID NO: 322738 - DNA, 20 bp, Artificial Sequence
  chemically synthesized
ataagcttatctgtatttac

SEQ ID NO: 322739 - DNA, 20 bp, Artificial Sequence
  chemically synthesized
ttaaaaacttcttgtaaata

SEQ ID NO: 322740 - DNA, 20 bp, Artificial Sequence
  chemically synthesized
agcttatctgtatttacaag

SEQ ID NO: 322741 - DNA, 20 bp, Artificial Sequence
  chemically synthesized
tttctaagttgatataacaa

SEQ ID NO: 322742 - DNA, 20 bp, Artificial Sequence
  chemically synthesized
taacttttgttatatcaact

SEQ ID NO: 322743 - DNA, 20 bp, Artificial Sequence
  chemically synthesized
aaagctatgctataatttct

SEQ ID NO: 322744 - DNA, 20 bp, Artificial Sequence
  chemically synthesized
ttatatcaacttagaaatta

SEQ ID NO: 322745 - DNA, 20 bp, Artificial Sequence
  chemically synthesized
tcaacttagaaattatagca

SEQ ID NO: 322746 - DNA, 20 bp, Artificial Sequence
  chemically synthesized
tagaaattatagcatagctt

SEQ ID NO: 322747 - DNA, 20 bp, Artificial Sequence
  chemically synthesized
agtcatattaagtatatcca

SEQ ID NO: 322748 - DNA, 20 bp, Artificial Sequence
  chemically synthesized
aacatttgtctagtcatatt

SEQ ID NO: 322749 - DNA, 20 bp, Artificial Sequence
  chemically synthesized
ttggatatacttaatatgac

SEQ ID NO: 322750 - DNA, 20 bp, Artificial Sequence
  chemically synthesized
aatgataattaacatttgtc

SEQ ID NO: 322751 - DNA, 20 bp, Artificial Sequence
  chemically synthesized
aagccttggtttagcgatta

SEQ ID NO: 322752 - DNA, 20 bp, Artificial Sequence
  chemically synthesized
ctaagccttggtttagcgat

SEQ ID NO: 322753 - DNA, 20 bp, Artificial Sequence
  chemically synthesized
atttctctaatcgctaaacc

SEQ ID NO: 322754 - DNA, 20 bp, Artificial Sequence
  chemically synthesized
tttctctaatcgctaaacca

SEQ ID NO: 322755 - DNA, 20 bp, Artificial Sequence
  chemically synthesized
ttcctgcctaagccttggtt

SEQ ID NO: 322756 - DNA, 20 bp, Artificial Sequence
  chemically synthesized
ctaatcgctaaaccaaggct

SEQ ID NO: 322757 - DNA, 20 bp, Artificial Sequence
  chemically synthesized
taatcgctaaaccaaggctt

SEQ ID NO: 322758 - DNA, 20 bp, Artificial Sequence
  chemically synthesized
attatttcctgcctaagcct

SEQ ID NO: 322759 - DNA, 20 bp, Artificial Sequence
  chemically synthesized
tcgctaaaccaaggcttagg

SEQ ID NO: 322760 - DNA, 20 bp, Artificial Sequence
  chemically synthesized
cgctaaaccaaggcttaggc

SEQ ID NO: 322761 - DNA, 20 bp, Artificial Sequence
  chemically synthesized
gaagccattatttcctgcct

SEQ ID NO: 322762 - DNA, 20 bp, Artificial Sequence
  chemically synthesized
aaggcttaggcaggaaataa

SEQ ID NO: 322763 - DNA, 20 bp, Artificial Sequence
  chemically synthesized
aggaaataatggcttccgac

SEQ ID NO: 322764 - DNA, 20 bp, Artificial Sequence
  chemically synthesized
gtttggatagatccagtcgg

SEQ ID NO: 322765 - DNA, 20 bp, Artificial Sequence
  chemically synthesized
agggtttggatagatccagt

SEQ ID NO: 322766 - DNA, 20 bp, Artificial Sequence
  chemically synthesized
agacagggtttggatagatc

SEQ ID NO: 322767 - DNA, 20 bp, Artificial Sequence
  chemically synthesized
tacctaagacagggtttgga

SEQ ID NO: 322768 - DNA, 20 bp, Artificial Sequence
  chemically synthesized
tctctacctaagacagggtt

SEQ ID NO: 322769 - DNA, 20 bp, Artificial Sequence
  chemically synthesized
gatctatccaaaccctgtct

SEQ ID NO: 322770 - DNA, 20 bp, Artificial Sequence
  chemically synthesized
atctatccaaaccctgtctt

SEQ ID NO: 322771 - DNA, 20 bp, Artificial Sequence
  chemically synthesized
ttctctctctacctaagaca

SEQ ID NO: 322772 - DNA, 20 bp, Artificial Sequence
  chemically synthesized
tttctctctctacctaagac

SEQ ID NO: 322773 - DNA, 20 bp, Artificial Sequence
  chemically synthesized
tatccaaaccctgtcttagg

SEQ ID NO: 322774 - DNA, 20 bp, Artificial Sequence
  chemically synthesized
ttttctctctctacctaaga

SEQ ID NO: 322775 - DNA, 20 bp, Artificial Sequence
  chemically synthesized
tccaaaccctgtcttaggta

SEQ ID NO: 322776 - DNA, 20 bp, Artificial Sequence
  chemically synthesized
caaaccctgtcttaggtaga

SEQ ID NO: 322777 - DNA, 20 bp, Artificial Sequence
  chemically synthesized
cttcttttctctctctacct

SEQ ID NO: 322778 - DNA, 20 bp, Artificial Sequence
  chemically synthesized
aaccctgtcttaggtagaga

SEQ ID NO: 322779 - DNA, 20 bp, Artificial Sequence
  chemically synthesized
tgtcttaggtagagagagaa

SEQ ID NO: 322780 - DNA, 20 bp, Artificial Sequence
  chemically synthesized
cttaggtagagagagaaaag

SEQ ID NO: 322781 - DNA, 20 bp, Artificial Sequence
  chemically synthesized
agattactagtaaacaaaaa

SEQ ID NO: 322782 - DNA, 20 bp, Artificial Sequence
  chemically synthesized
atgaatccatttttgtttac

SEQ ID NO: 322783 - DNA, 20 bp, Artificial Sequence
  chemically synthesized
acttcagagtagaagattac

SEQ ID NO: 322784 - DNA, 20 bp, Artificial Sequence
  chemically synthesized
atatgattacttcagagtag

SEQ ID NO: 322785 - DNA, 20 bp, Artificial Sequence
  chemically synthesized
actagtaatcttctactctg

SEQ ID NO: 322786 - DNA, 20 bp, Artificial Sequence
  chemically synthesized
aatatatgattacttcagag

SEQ ID NO: 322787 - DNA, 20 bp, Artificial Sequence
  chemically synthesized
ctaaatatatgattacttca

SEQ ID NO: 322788 - DNA, 20 bp, Artificial Sequence
  chemically synthesized
ttctaaatatatgattactt

SEQ ID NO: 322789 - DNA, 20 bp, Artificial Sequence
  chemically synthesized
ctctgaagtaatcatatatt

SEQ ID NO: 322790 - DNA, 20 bp, Artificial Sequence
  chemically synthesized
tcatatatttagaaaaaaaa

SEQ ID NO: 322791 - DNA, 20 bp, Artificial Sequence
  chemically synthesized
catatatttagaaaaaaaat

SEQ ID NO: 322792 - DNA, 20 bp, Artificial Sequence
  chemically synthesized
aaaaaaataggtaatgctcc

SEQ ID NO: 322793 - DNA, 20 bp, Artificial Sequence
  chemically synthesized
ataggtaatgctccaagttg

SEQ ID NO: 322794 - DNA, 20 bp, Artificial Sequence
  chemically synthesized
caatgattagcttcaacttg

SEQ ID NO: 322795 - DNA, 20 bp, Artificial Sequence
  chemically synthesized
tccaatgattagcttcaact

SEQ ID NO: 322796 - DNA, 20 bp, Artificial Sequence
  chemically synthesized
tccaagttgaagctaatcat

SEQ ID NO: 322797 - DNA, 20 bp, Artificial Sequence
  chemically synthesized
caagttgaagctaatcattg

SEQ ID NO: 322798 - DNA, 20 bp, Artificial Sequence
  chemically synthesized
aatggattatctccaatgat

SEQ ID NO: 322799 - DNA, 20 bp, Artificial Sequence
  chemically synthesized
cattatcatggtcatgagaa

SEQ ID NO: 322800 - DNA, 20 bp, Artificial Sequence
  chemically synthesized
gtttccattatcatggtcat

SEQ ID NO: 322801 - DNA, 20 bp, Artificial Sequence
  chemically synthesized
cattctcatgaccatgataa

SEQ ID NO: 322802 - DNA, 20 bp, Artificial Sequence
  chemically synthesized
ctgttcagtttccattatca

SEQ ID NO: 322803 - DNA, 20 bp, Artificial Sequence
  chemically synthesized
ccatgataatggaaactgaa

SEQ ID NO: 322804 - DNA, 20 bp, Artificial Sequence
  chemically synthesized
catgataatggaaactgaac

SEQ ID NO: 322805 - DNA, 20 bp, Artificial Sequence
  chemically synthesized
caaataaattataacctgtt

SEQ ID NO: 322806 - DNA, 20 bp, Artificial Sequence
  chemically synthesized
aacaggttataatttatttg

SEQ ID NO: 322807 - DNA, 20 bp, Artificial Sequence
  chemically synthesized
tataatttatttgaagcatt

SEQ ID NO: 322808 - DNA, 20 bp, Artificial Sequence
  chemically synthesized
ttgaagcattaagtaaaacc

SEQ ID NO: 322809 - DNA, 20 bp, Artificial Sequence
  chemically synthesized
gcattaagtaaaacctagat

SEQ ID NO: 322810 - DNA, 20 bp, Artificial Sequence
  chemically synthesized
tatttttaaaaaactaatct

SEQ ID NO: 322811 - DNA, 20 bp, Artificial Sequence
  chemically synthesized
ttatttttaaaaaactaatc

SEQ ID NO: 322812 - DNA, 20 bp, Artificial Sequence
  chemically synthesized
aaaacgtgattatgaaaaga

SEQ ID NO: 322813 - DNA, 20 bp, Artificial Sequence
  chemically synthesized
aaaaacgtgattatgaaaag

SEQ ID NO: 322814 - DNA, 20 bp, Artificial Sequence
  chemically synthesized
aaaaaacgtgattatgaaaa

SEQ ID NO: 322815 - DNA, 20 bp, Artificial Sequence
  chemically synthesized
acaaaaaacgtgattatgaa

SEQ ID NO: 322816 - DNA, 20 bp, Artificial Sequence
  chemically synthesized
tttttgaaagattttgtgag

SEQ ID NO: 322817 - DNA, 20 bp, Artificial Sequence
  chemically synthesized
atttttgaaagattttgtga

SEQ ID NO: 322818 - DNA, 20 bp, Artificial Sequence
  chemically synthesized
tgatttttgaaagattttgt

SEQ ID NO: 322819 - DNA, 20 bp, Artificial Sequence
  chemically synthesized
ttgctgaacctgatttttga

SEQ ID NO: 322820 - DNA, 20 bp, Artificial Sequence
  chemically synthesized
tcacaaaatctttcaaaaat

SEQ ID NO: 322821 - DNA, 20 bp, Artificial Sequence
  chemically synthesized
cacaaaatctttcaaaaatc

SEQ ID NO: 322822 - DNA, 20 bp, Artificial Sequence
  chemically synthesized
aatctttcaaaaatcaggtt

SEQ ID NO: 322823 - DNA, 20 bp, Artificial Sequence
  chemically synthesized
ttcaaaaatcaggttcagca

SEQ ID NO: 322824 - DNA, 20 bp, Artificial Sequence
  chemically synthesized
gttcagcaaagcttacataa

SEQ ID NO: 322825 - DNA, 20 bp, Artificial Sequence
  chemically synthesized
aatgtgataagccattatgt

SEQ ID NO: 322826 - DNA, 20 bp, Artificial Sequence
  chemically synthesized
tacataatggcttatcacat

SEQ ID NO: 322827 - DNA, 20 bp, Artificial Sequence
  chemically synthesized
ctattaaattctaatgtgat

SEQ ID NO: 322828 - DNA, 20 bp, Artificial Sequence
  chemically synthesized
cttatcacattagaatttaa

SEQ ID NO: 322829 - DNA, 20 bp, Artificial Sequence
  chemically synthesized
ttatcacattagaatttaat

SEQ ID NO: 322830 - DNA, 20 bp, Artificial Sequence
  chemically synthesized
tttatgcacgaacacataca

SEQ ID NO: 322831 - DNA, 20 bp, Artificial Sequence
  chemically synthesized
cacgaacacatacatagtca

SEQ ID NO: 322832 - DNA, 20 bp, Artificial Sequence
  chemically synthesized
gaacacatacatagtcaaag

SEQ ID NO: 322833 - DNA, 20 bp, Artificial Sequence
  chemically synthesized
acatacatagtcaaagtggc

SEQ ID NO: 322834 - DNA, 20 bp, Artificial Sequence
  chemically synthesized
catacatagtcaaagtggca

SEQ ID NO: 322835 - DNA, 20 bp, Artificial Sequence
  chemically synthesized
acatagtcaaagtggcaagg

SEQ ID NO: 322836 - DNA, 20 bp, Artificial Sequence
  chemically synthesized
atatgagagtttataaataa

SEQ ID NO: 322837 - DNA, 20 bp, Artificial Sequence
  chemically synthesized
caaattcagaaataatatga

SEQ ID NO: 322838 - DNA, 20 bp, Artificial Sequence
  chemically synthesized
cacaaattcagaaataatat

SEQ ID NO: 322839 - DNA, 20 bp, Artificial Sequence
  chemically synthesized
ttatttgagcaacacaaatt

SEQ ID NO: 322840 - DNA, 20 bp, Artificial Sequence
  chemically synthesized
gaatatacaaagcattattt

SEQ ID NO: 322841 - DNA, 20 bp, Artificial Sequence
  chemically synthesized
tccttaaaaatgaatataca

SEQ ID NO: 322842 - DNA, 20 bp, Artificial Sequence
  chemically synthesized
tgctttgtatattcattttt

SEQ ID NO: 322843 - DNA, 20 bp, Artificial Sequence
  chemically synthesized
gctttgtatattcattttta

SEQ ID NO: 322844 - DNA, 20 bp, Artificial Sequence
  chemically synthesized
ttcatttttaaggaattttc

SEQ ID NO: 322845 - DNA, 20 bp, Artificial Sequence
  chemically synthesized
ttttaaggaattttccagaa

SEQ ID NO: 322846 - DNA, 20 bp, Artificial Sequence
  chemically synthesized
ttctatcacatagacttttc

SEQ ID NO: 322847 - DNA, 20 bp, Artificial Sequence
  chemically synthesized
ttccagaaaagtctatgtga

SEQ ID NO: 322848 - DNA, 20 bp, Artificial Sequence
  chemically synthesized
atgtaaccacttctatcaca

SEQ ID NO: 322849 - DNA, 20 bp, Artificial Sequence
  chemically synthesized
cagaaaagtctatgtgatag

SEQ ID NO: 322850 - DNA, 20 bp, Artificial Sequence
  chemically synthesized
aaaagtctatgtgatagaag

SEQ ID NO: 322851 - DNA, 20 bp, Artificial Sequence
  chemically synthesized
tctcacagagtttttaaaat

SEQ ID NO: 322852 - DNA, 20 bp, Artificial Sequence
  chemically synthesized
tctcattttaaaaactctgt

SEQ ID NO: 322853 - DNA, 20 bp, Artificial Sequence
  chemically synthesized
ttttgctaaaacatctcaca

SEQ ID NO: 322854 - DNA, 20 bp, Artificial Sequence
  chemically synthesized
gcttttgctaaaacatctca

SEQ ID NO: 322855 - DNA, 20 bp, Artificial Sequence
  chemically synthesized
aaaaactctgtgagatgttt

SEQ ID NO: 322856 - DNA, 20 bp, Artificial Sequence
  chemically synthesized
tctgtgagatgttttagcaa

SEQ ID NO: 322857 - DNA, 20 bp, Artificial Sequence
  chemically synthesized
tgttttagcaaaagctatac

SEQ ID NO: 322858 - DNA, 20 bp, Artificial Sequence
  chemically synthesized
ttagcaaaagctataccagc

SEQ ID NO: 322859 - DNA, 20 bp, Artificial Sequence
  chemically synthesized
ggagagccttctagctggta

SEQ ID NO: 322860 - DNA, 20 bp, Artificial Sequence
  chemically synthesized
gcaaaagctataccagctag

SEQ ID NO: 322861 - DNA, 20 bp, Artificial Sequence
  chemically synthesized
caaaagctataccagctaga

SEQ ID NO: 322862 - DNA, 20 bp, Artificial Sequence
  chemically synthesized
ggcaaggagagccttctagc

SEQ ID NO: 322863 - DNA, 20 bp, Artificial Sequence
  chemically synthesized
agaaggcaaggagagccttc

SEQ ID NO: 322864 - DNA, 20 bp, Artificial Sequence
  chemically synthesized
aattattaagaaggcaagga

SEQ ID NO: 322865 - DNA, 20 bp, Artificial Sequence
  chemically synthesized
ataattattaagaaggcaag

SEQ ID NO: 322866 - DNA, 20 bp, Artificial Sequence
  chemically synthesized
gaataattattaagaaggca

SEQ ID NO: 322867 - DNA, 20 bp, Artificial Sequence
  chemically synthesized
agaataattattaagaaggc

SEQ ID NO: 322868 - DNA, 20 bp, Artificial Sequence
  chemically synthesized
ttttagaataattattaaga

SEQ ID NO: 322869 - DNA, 20 bp, Artificial Sequence
  chemically synthesized
cttttagaataattattaag

SEQ ID NO: 322870 - DNA, 20 bp, Artificial Sequence
  chemically synthesized
cagcttttagaataattatt

SEQ ID NO: 322871 - DNA, 20 bp, Artificial Sequence
  chemically synthesized
cttcttaataattattctaa

SEQ ID NO: 322872 - DNA, 20 bp, Artificial Sequence
  chemically synthesized
tttgtacgtgttacagcttt

SEQ ID NO: 322873 - DNA, 20 bp, Artificial Sequence
  chemically synthesized
aagagcttttgtacgtgtta

SEQ ID NO: 322874 - DNA, 20 bp, Artificial Sequence
  chemically synthesized
aaaagctgtaacacgtacaa

SEQ ID NO: 322875 - DNA, 20 bp, Artificial Sequence
  chemically synthesized
tgtccttagggaagattcaa

SEQ ID NO: 322876 - DNA, 20 bp, Artificial Sequence
  chemically synthesized
tttgtccttagggaagattc

SEQ ID NO: 322877 - DNA, 20 bp, Artificial Sequence
  chemically synthesized
aaagctcttgaatcttccct

SEQ ID NO: 322878 - DNA, 20 bp, Artificial Sequence
  chemically synthesized
aagctcttgaatcttcccta

SEQ ID NO: 322879 - DNA, 20 bp, Artificial Sequence
  chemically synthesized
aaattagtttgtccttaggg

SEQ ID NO: 322880 - DNA, 20 bp, Artificial Sequence
  chemically synthesized
aaaaaattagtttgtcctta

SEQ ID NO: 322881 - DNA, 20 bp, Artificial Sequence
  chemically synthesized
taaaaaattagtttgtcctt

SEQ ID NO: 322882 - DNA, 20 bp, Artificial Sequence
  chemically synthesized
ataaaaaattagtttgtcct

SEQ ID NO: 322883 - DNA, 20 bp, Artificial Sequence
  chemically synthesized
ctgagattgacataaaaaat

SEQ ID NO: 322884 - DNA, 20 bp, Artificial Sequence
  chemically synthesized
ctaattttttatgtcaatct

SEQ ID NO: 322885 - DNA, 20 bp, Artificial Sequence
  chemically synthesized
ttttttatgtcaatctcagc

SEQ ID NO: 322886 - DNA, 20 bp, Artificial Sequence
  chemically synthesized
tttttatgtcaatctcagct

SEQ ID NO: 322887 - DNA, 20 bp, Artificial Sequence
  chemically synthesized
ttatgtcaatctcagctagg

SEQ ID NO: 322888 - DNA, 20 bp, Artificial Sequence
  chemically synthesized
ggcagtattaccacctagct

SEQ ID NO: 322889 - DNA, 20 bp, Artificial Sequence
  chemically synthesized
aaaatggcagtattaccacc

SEQ ID NO: 322890 - DNA, 20 bp, Artificial Sequence
  chemically synthesized
aggtggtaatactgccattt

SEQ ID NO: 322891 - DNA, 20 bp, Artificial Sequence
  chemically synthesized
gaatggaaatgctaaaatgg

SEQ ID NO: 322892 - DNA, 20 bp, Artificial Sequence
  chemically synthesized
agagaatggaaatgctaaaa

SEQ ID NO: 322893 - DNA, 20 bp, Artificial Sequence
  chemically synthesized
attttagcatttccattctc

SEQ ID NO: 322894 - DNA, 20 bp, Artificial Sequence
  chemically synthesized
atccccatcccactagagaa

SEQ ID NO: 322895 - DNA, 20 bp, Artificial Sequence
  chemically synthesized
ttagcatttccattctctag

SEQ ID NO: 322896 - DNA, 20 bp, Artificial Sequence
  chemically synthesized
tagcatttccattctctagt

SEQ ID NO: 322897 - DNA, 20 bp, Artificial Sequence
  chemically synthesized
tcctcatccccatcccacta

SEQ ID NO: 322898 - DNA, 20 bp, Artificial Sequence
  chemically synthesized
atttccattctctagtggga

SEQ ID NO: 322899 - DNA, 20 bp, Artificial Sequence
  chemically synthesized
tttccattctctagtgggat

SEQ ID NO: 322900 - DNA, 20 bp, Artificial Sequence
  chemically synthesized
tttcctcatccccatcccac

SEQ ID NO: 322901 - DNA, 20 bp, Artificial Sequence
  chemically synthesized
ttccattctctagtgggatg

SEQ ID NO: 322902 - DNA, 20 bp, Artificial Sequence
  chemically synthesized
ttctctagtgggatggggat

SEQ ID NO: 322903 - DNA, 20 bp, Artificial Sequence
  chemically synthesized
tctctagtgggatggggatg

SEQ ID NO: 322904 - DNA, 20 bp, Artificial Sequence
  chemically synthesized
ggatgaggaaattacacgca

SEQ ID NO: 322905 - DNA, 20 bp, Artificial Sequence
  chemically synthesized
tgaggaaattacacgcacag

SEQ ID NO: 322906 - DNA, 20 bp, Artificial Sequence
  chemically synthesized
aaattacacgcacagaagtc

SEQ ID NO: 322907 - DNA, 20 bp, Artificial Sequence
  chemically synthesized
aattacacgcacagaagtct

SEQ ID NO: 322908 - DNA, 20 bp, Artificial Sequence
  chemically synthesized
agtgaaggatgacagacacc

SEQ ID NO: 322909 - DNA, 20 bp, Artificial Sequence
  chemically synthesized
tgccattaagtgaaggatga

SEQ ID NO: 322910 - DNA, 20 bp, Artificial Sequence
  chemically synthesized
ggatgtctgccattaagtga

SEQ ID NO: 322911 - DNA, 20 bp, Artificial Sequence
  chemically synthesized
gtctgtcatccttcacttaa

SEQ ID NO: 322912 - DNA, 20 bp, Artificial Sequence
  chemically synthesized
gggatgtctgccattaagtg

SEQ ID NO: 322913 - DNA, 20 bp, Artificial Sequence
  chemically synthesized
tgtcatccttcacttaatgg

SEQ ID NO: 322914 - DNA, 20 bp, Artificial Sequence
  chemically synthesized
ttcaagggatgtctgccatt

SEQ ID NO: 322915 - DNA, 20 bp, Artificial Sequence
  chemically synthesized
ttaatggcagacatcccttg

SEQ ID NO: 322916 - DNA, 20 bp, Artificial Sequence
  chemically synthesized
taatggcagacatcccttga

SEQ ID NO: 322917 - DNA, 20 bp, Artificial Sequence
  chemically synthesized
aatggcagacatcccttgaa

SEQ ID NO: 322918 - DNA, 20 bp, Artificial Sequence
  chemically synthesized
atggcagacatcccttgaag

SEQ ID NO: 322919 - DNA, 20 bp, Artificial Sequence
  chemically synthesized
tggcagacatcccttgaagg

SEQ ID NO: 322920 - DNA, 20 bp, Artificial Sequence
  chemically synthesized
tcaaaaattccccccttcaa

SEQ ID NO: 322921 - DNA, 20 bp, Artificial Sequence
  chemically synthesized
ggcagacatcccttgaaggg

SEQ ID NO: 322922 - DNA, 20 bp, Artificial Sequence
  chemically synthesized
ttcaaaaattccccccttca

SEQ ID NO: 322923 - DNA, 20 bp, Artificial Sequence
  chemically synthesized
attcaaaaattccccccttc

SEQ ID NO: 322924 - DNA, 20 bp, Artificial Sequence
  chemically synthesized
ctgtgattctaacatttaaa

SEQ ID NO: 322925 - DNA, 20 bp, Artificial Sequence
  chemically synthesized
atgaacatctttttaaatgt

SEQ ID NO: 322926 - DNA, 20 bp, Artificial Sequence
  chemically synthesized
ctttttaaatgttagaatca

SEQ ID NO: 322927 - DNA, 20 bp, Artificial Sequence
  chemically synthesized
aatgttagaatcacagataa

SEQ ID NO: 322928 - DNA, 20 bp, Artificial Sequence
  chemically synthesized
gcttatctgaaacataaaaa

SEQ ID NO: 322929 - DNA, 20 bp, Artificial Sequence
  chemically synthesized
aaaagactttttttatgttt

SEQ ID NO: 322930 - DNA, 20 bp, Artificial Sequence
  chemically synthesized
actttttttatgtttcagat

SEQ ID NO: 322931 - DNA, 20 bp, Artificial Sequence
  chemically synthesized
ttttatgtttcagataagca

SEQ ID NO: 322932 - DNA, 20 bp, Artificial Sequence
  chemically synthesized
gtttcagataagcaaagaaa

SEQ ID NO: 322933 - DNA, 20 bp, Artificial Sequence
  chemically synthesized
aaaagttgcaattttaattc

SEQ ID NO: 322934 - DNA, 20 bp, Artificial Sequence
  chemically synthesized
aaagttgcaattttaattcc

SEQ ID NO: 322935 - DNA, 20 bp, Artificial Sequence
  chemically synthesized
agttgcaattttaattccag

SEQ ID NO: 322936 - DNA, 20 bp, Artificial Sequence
  chemically synthesized
gttgcaattttaattccagg

SEQ ID NO: 322937 - DNA, 20 bp, Artificial Sequence
  chemically synthesized
aagaaaatatgaattcctcc

SEQ ID NO: 322938 - DNA, 20 bp, Artificial Sequence
  chemically synthesized
gctgtgtgaaattgagttgc

SEQ ID NO: 322939 - DNA, 20 bp, Artificial Sequence
  chemically synthesized
attaattgctgtgtgaaatt

SEQ ID NO: 322940 - DNA, 20 bp, Artificial Sequence
  chemically synthesized
tcttgcaactcaatttcaca

SEQ ID NO: 322941 - DNA, 20 bp, Artificial Sequence
  chemically synthesized
acagcaattaattaactgat

SEQ ID NO: 322942 - DNA, 20 bp, Artificial Sequence
  chemically synthesized
cattaattattcatactaat

SEQ ID NO: 322943 - DNA, 20 bp, Artificial Sequence
  chemically synthesized
aataattaatgccatattgt

SEQ ID NO: 322944 - DNA, 20 bp, Artificial Sequence
  chemically synthesized
tttcaataaaactaacaata

SEQ ID NO: 322945 - DNA, 20 bp, Artificial Sequence
  chemically synthesized
attgttagttttattgaaaa

SEQ ID NO: 322946 - DNA, 20 bp, Artificial Sequence
  chemically synthesized
ttgttagttttattgaaaat

SEQ ID NO: 322947 - DNA, 20 bp, Artificial Sequence
  chemically synthesized
tgttagttttattgaaaatg

SEQ ID NO: 322948 - DNA, 20 bp, Artificial Sequence
  chemically synthesized
ttagttttattgaaaatggg

SEQ ID NO: 322949 - DNA, 20 bp, Artificial Sequence
  chemically synthesized
ttattgaaaatggggagtgt

SEQ ID NO: 322950 - DNA, 20 bp, Artificial Sequence
  chemically synthesized
atggggagtgtaagaaaaat

SEQ ID NO: 322951 - DNA, 20 bp, Artificial Sequence
  chemically synthesized
ggggagtgtaagaaaaatga

SEQ ID NO: 322952 - DNA, 20 bp, Artificial Sequence
  chemically synthesized
gtaagaaaaatgagagcatt

SEQ ID NO: 322953 - DNA, 20 bp, Artificial Sequence
  chemically synthesized
aaatgagagcatttagcctc

SEQ ID NO: 322954 - DNA, 20 bp, Artificial Sequence
  chemically synthesized
aatgagagcatttagcctcc

SEQ ID NO: 322955 - DNA, 20 bp, Artificial Sequence
  chemically synthesized
tgagagcatttagcctccag

SEQ ID NO: 322956 - DNA, 20 bp, Artificial Sequence
  chemically synthesized
agagcatttagcctccagga

SEQ ID NO: 322957 - DNA, 20 bp, Artificial Sequence
  chemically synthesized
gagcatttagcctccaggag

SEQ ID NO: 322958 - DNA, 20 bp, Artificial Sequence
  chemically synthesized
aggtttccatcctctcctgg

SEQ ID NO: 322959 - DNA, 20 bp, Artificial Sequence
  chemically synthesized
taggtttccatcctctcctg

SEQ ID NO: 322960 - DNA, 20 bp, Artificial Sequence
  chemically synthesized
tctaggtttccatcctctcc

SEQ ID NO: 322961 - DNA, 20 bp, Artificial Sequence
  chemically synthesized
atttagcctccaggagagga

SEQ ID NO: 322962 - DNA, 20 bp, Artificial Sequence
  chemically synthesized
tccaggagaggatggaaacc

SEQ ID NO: 322963 - DNA, 20 bp, Artificial Sequence
  chemically synthesized
caggagaggatggaaaccta

SEQ ID NO: 322964 - DNA, 20 bp, Artificial Sequence
  chemically synthesized
tcttctcctttgtgcactct

SEQ ID NO: 322965 - DNA, 20 bp, Artificial Sequence
  chemically synthesized
gtcttctcctttgtgcactc

SEQ ID NO: 322966 - DNA, 20 bp, Artificial Sequence
  chemically synthesized
atggaaacctagagtgcaca

SEQ ID NO: 322967 - DNA, 20 bp, Artificial Sequence
  chemically synthesized
tggaaacctagagtgcacaa

SEQ ID NO: 322968 - DNA, 20 bp, Artificial Sequence
  chemically synthesized
gaaacctagagtgcacaaag

SEQ ID NO: 322969 - DNA, 20 bp, Artificial Sequence
  chemically synthesized
acctagagtgcacaaaggag

SEQ ID NO: 322970 - DNA, 20 bp, Artificial Sequence
  chemically synthesized
gtgcacaaaggagaagacac

SEQ ID NO: 322971 - DNA, 20 bp, Artificial Sequence
  chemically synthesized
cacaaaggagaagacactgg

SEQ ID NO: 322972 - DNA, 20 bp, Artificial Sequence
  chemically synthesized
gtccttgccataatagccac

SEQ ID NO: 322973 - DNA, 20 bp, Artificial Sequence
  chemically synthesized
gaagacactggtggctatta

SEQ ID NO: 322974 - DNA, 20 bp, Artificial Sequence
  chemically synthesized
acactggtggctattatggc

SEQ ID NO: 322975 - DNA, 20 bp, Artificial Sequence
  chemically synthesized
ctttactgtccttgccataa

SEQ ID NO: 322976 - DNA, 20 bp, Artificial Sequence
  chemically synthesized
cactggtggctattatggca

SEQ ID NO: 322977 - DNA, 20 bp, Artificial Sequence
  chemically synthesized
ggtggctattatggcaagga

SEQ ID NO: 322978 - DNA, 20 bp, Artificial Sequence
  chemically synthesized
ctattatggcaaggacagta

SEQ ID NO: 322979 - DNA, 20 bp, Artificial Sequence
  chemically synthesized
attatggcaaggacagtaaa

SEQ ID NO: 322980 - DNA, 20 bp, Artificial Sequence
  chemically synthesized
ttatggcaaggacagtaaag

SEQ ID NO: 322981 - DNA, 20 bp, Artificial Sequence
  chemically synthesized
tggcaaggacagtaaagagg

SEQ ID NO: 322982 - DNA, 20 bp, Artificial Sequence
  chemically synthesized
aaggacagtaaagaggtggt

SEQ ID NO: 322983 - DNA, 20 bp, Artificial Sequence
  chemically synthesized
caacctcaaacaaaattaga

SEQ ID NO: 322984 - DNA, 20 bp, Artificial Sequence
  chemically synthesized
aaagcaacctcaaacaaaat

SEQ ID NO: 322985 - DNA, 20 bp, Artificial Sequence
  chemically synthesized
aaaactttctaattttgttt

SEQ ID NO: 322986 - DNA, 20 bp, Artificial Sequence
  chemically synthesized
aaactttctaattttgtttg

SEQ ID NO: 322987 - DNA, 20 bp, Artificial Sequence
  chemically synthesized
attttgtttgaggttgcttt

SEQ ID NO: 322988 - DNA, 20 bp, Artificial Sequence
  chemically synthesized
gcagtgatctgtggaactta

SEQ ID NO: 322989 - DNA, 20 bp, Artificial Sequence
  chemically synthesized
tgaggttgctttaagttcca

SEQ ID NO: 322990 - DNA, 20 bp, Artificial Sequence
  chemically synthesized
cttctatttgcagtgatctg

SEQ ID NO: 322991 - DNA, 20 bp, Artificial Sequence
  chemically synthesized
gttccacagatcactgcaaa

SEQ ID NO: 322992 - DNA, 20 bp, Artificial Sequence
  chemically synthesized
ccacagatcactgcaaatag

SEQ ID NO: 322993 - DNA, 20 bp, Artificial Sequence
  chemically synthesized
caggttagaacttctatttg

SEQ ID NO: 322994 - DNA, 20 bp, Artificial Sequence
  chemically synthesized
caaatagaagttctaacctg

SEQ ID NO: 322995 - DNA, 20 bp, Artificial Sequence
  chemically synthesized
tatgccaacattcttcaggt

SEQ ID NO: 322996 - DNA, 20 bp, Artificial Sequence
  chemically synthesized
gtcatatgccaacattcttc

SEQ ID NO: 322997 - DNA, 20 bp, Artificial Sequence
  chemically synthesized
ggtcatatgccaacattctt

SEQ ID NO: 322998 - DNA, 20 bp, Artificial Sequence
  chemically synthesized
agttctaacctgaagaatgt

SEQ ID NO: 322999 - DNA, 20 bp, Artificial Sequence
  chemically synthesized
agaatgttggcatatgacca

SEQ ID NO: 323000 - DNA, 20 bp, Artificial Sequence
  chemically synthesized
atgttggcatatgaccacag

SEQ ID NO: 323001 - DNA, 20 bp, Artificial Sequence
  chemically synthesized
tgttggcatatgaccacaga

SEQ ID NO: 323002 - DNA, 20 bp, Artificial Sequence
  chemically synthesized
tggcatatgaccacagaagg

SEQ ID NO: 323003 - DNA, 20 bp, Artificial Sequence
  chemically synthesized
aagatataagctgccttctg

SEQ ID NO: 323004 - DNA, 20 bp, Artificial Sequence
  chemically synthesized
tattatcgatattaagatat

SEQ ID NO: 323005 - DNA, 20 bp, Artificial Sequence
  chemically synthesized
ctccatctattatcgatatt

SEQ ID NO: 323006 - DNA, 20 bp, Artificial Sequence
  chemically synthesized
ttatatcttaatatcgataa

SEQ ID NO: 323007 - DNA, 20 bp, Artificial Sequence
  chemically synthesized
atcttaatatcgataataga

SEQ ID NO: 323008 - DNA, 20 bp, Artificial Sequence
  chemically synthesized
cttaatatcgataatagatg

SEQ ID NO: 323009 - DNA, 20 bp, Artificial Sequence
  chemically synthesized
cgataatagatggagtaaat

SEQ ID NO: 323010 - DNA, 20 bp, Artificial Sequence
  chemically synthesized
taatagatggagtaaattag

SEQ ID NO: 323011 - DNA, 20 bp, Artificial Sequence
  chemically synthesized
atggagtaaattagtggacc

SEQ ID NO: 323012 - DNA, 20 bp, Artificial Sequence
  chemically synthesized
cccactccccagtgtttacc

SEQ ID NO: 323013 - DNA, 20 bp, Artificial Sequence
  chemically synthesized
gcccactccccagtgtttac

SEQ ID NO: 323014 - DNA, 20 bp, Artificial Sequence
  chemically synthesized
ttagtggacctggtaaacac

SEQ ID NO: 323015 - DNA, 20 bp, Artificial Sequence
  chemically synthesized
tagtggacctggtaaacact

SEQ ID NO: 323016 - DNA, 20 bp, Artificial Sequence
  chemically synthesized
agtggacctggtaaacactg

SEQ ID NO: 323017 - DNA, 20 bp, Artificial Sequence
  chemically synthesized
tggacctggtaaacactggg

SEQ ID NO: 323018 - DNA, 20 bp, Artificial Sequence
  chemically synthesized
acctggtaaacactggggag

SEQ ID NO: 323019 - DNA, 20 bp, Artificial Sequence
  chemically synthesized
cctggtaaacactggggagt

SEQ ID NO: 323020 - DNA, 20 bp, Artificial Sequence
  chemically synthesized
tgttgagtctgcccactccc

SEQ ID NO: 323021 - DNA, 20 bp, Artificial Sequence
  chemically synthesized
ggtaaacactggggagtggg

SEQ ID NO: 323022 - DNA, 20 bp, Artificial Sequence
  chemically synthesized
tggggagtgggcagactcaa

SEQ ID NO: 323023 - DNA, 20 bp, Artificial Sequence
  chemically synthesized
ataatcatattataactgtt

SEQ ID NO: 323024 - DNA, 20 bp, Artificial Sequence
  chemically synthesized
tcactacccctagatgtgag

SEQ ID NO: 323025 - DNA, 20 bp, Artificial Sequence
  chemically synthesized
attattgtacctctcacatc

SEQ ID NO: 323026 - DNA, 20 bp, Artificial Sequence
  chemically synthesized
gtcactacccctagatgtga

SEQ ID NO: 323027 - DNA, 20 bp, Artificial Sequence
  chemically synthesized
ttattgtacctctcacatct

SEQ ID NO: 323028 - DNA, 20 bp, Artificial Sequence
  chemically synthesized
tattgtacctctcacatcta

SEQ ID NO: 323029 - DNA, 20 bp, Artificial Sequence
  chemically synthesized
ttgtcactacccctagatgt

SEQ ID NO: 323030 - DNA, 20 bp, Artificial Sequence
  chemically synthesized
attgtacctctcacatctag

SEQ ID NO: 323031 - DNA, 20 bp, Artificial Sequence
  chemically synthesized
gtacctctcacatctagggg

SEQ ID NO: 323032 - DNA, 20 bp, Artificial Sequence
  chemically synthesized
gtgatgattgtcactacccc

SEQ ID NO: 323033 - DNA, 20 bp, Artificial Sequence
  chemically synthesized
gacaatcatcaccacgatca

SEQ ID NO: 323034 - DNA, 20 bp, Artificial Sequence
  chemically synthesized
ttattcgcctgctgtgatcg

SEQ ID NO: 323035 - DNA, 20 bp, Artificial Sequence
  chemically synthesized
aatcatcaccacgatcacag

SEQ ID NO: 323036 - DNA, 20 bp, Artificial Sequence
  chemically synthesized
atcatcaccacgatcacagc

SEQ ID NO: 323037 - DNA, 20 bp, Artificial Sequence
  chemically synthesized
gcgaataatatcaatatgca

SEQ ID NO: 323038 - DNA, 20 bp, Artificial Sequence
  chemically synthesized
taatatcaatatgcatagat

SEQ ID NO: 323039 - DNA, 20 bp, Artificial Sequence
  chemically synthesized
atgcatagattagtatctcc

SEQ ID NO: 323040 - DNA, 20 bp, Artificial Sequence
  chemically synthesized
tagattagtatctcctggct

SEQ ID NO: 323041 - DNA, 20 bp, Artificial Sequence
  chemically synthesized
atatatgtattccaagccag

SEQ ID NO: 323042 - DNA, 20 bp, Artificial Sequence
  chemically synthesized
ctatatatgtattccaagcc

SEQ ID NO: 323043 - DNA, 20 bp, Artificial Sequence
  chemically synthesized
actatatatgtattccaagc

SEQ ID NO: 323044 - DNA, 20 bp, Artificial Sequence
  chemically synthesized
cataactatatatgtattcc

SEQ ID NO: 323045 - DNA, 20 bp, Artificial Sequence
  chemically synthesized
cctggcttggaatacatata

SEQ ID NO: 323046 - DNA, 20 bp, Artificial Sequence
  chemically synthesized
ataaggtacatgtaagatag

SEQ ID NO: 323047 - DNA, 20 bp, Artificial Sequence
  chemically synthesized
aataaggtacatgtaagata

SEQ ID NO: 323048 - DNA, 20 bp, Artificial Sequence
  chemically synthesized
taaataaggtacatgtaaga

SEQ ID NO: 323049 - DNA, 20 bp, Artificial Sequence
  chemically synthesized
agaataaataaggtacatgt

SEQ ID NO: 323050 - DNA, 20 bp, Artificial Sequence
  chemically synthesized
gccttttgaaagaataaata

SEQ ID NO: 323051 - DNA, 20 bp, Artificial Sequence
  chemically synthesized
ggccttttgaaagaataaat

SEQ ID NO: 323052 - DNA, 20 bp, Artificial Sequence
  chemically synthesized
taccttatttattctttcaa

SEQ ID NO: 323053 - DNA, 20 bp, Artificial Sequence
  chemically synthesized
accttatttattctttcaaa

SEQ ID NO: 323054 - DNA, 20 bp, Artificial Sequence
  chemically synthesized
tttaagctcaggccttttga

SEQ ID NO: 323055 - DNA, 20 bp, Artificial Sequence
  chemically synthesized
tttattctttcaaaaggcct

SEQ ID NO: 323056 - DNA, 20 bp, Artificial Sequence
  chemically synthesized
aaaaacacatttttaagctc

SEQ ID NO: 323057 - DNA, 20 bp, Artificial Sequence
  chemically synthesized
gaaaaacacatttttaagct

SEQ ID NO: 323058 - DNA, 20 bp, Artificial Sequence
  chemically synthesized
gaggggaaaaacacattttt

SEQ ID NO: 323059 - DNA, 20 bp, Artificial Sequence
  chemically synthesized
tatagtgtgaaattatggag

SEQ ID NO: 323060 - DNA, 20 bp, Artificial Sequence
  chemically synthesized
ttatagtgtgaaattatgga

SEQ ID NO: 323061 - DNA, 20 bp, Artificial Sequence
  chemically synthesized
attatagtgtgaaattatgg

SEQ ID NO: 323062 - DNA, 20 bp, Artificial Sequence
  chemically synthesized
aattatagtgtgaaattatg

SEQ ID NO: 323063 - DNA, 20 bp, Artificial Sequence
  chemically synthesized
taaattatagtgtgaaatta

SEQ ID NO: 323064 - DNA, 20 bp, Artificial Sequence
  chemically synthesized
cataatttcacactataatt

SEQ ID NO: 323065 - DNA, 20 bp, Artificial Sequence
  chemically synthesized
ggtattccagtactaaatta

SEQ ID NO: 323066 - DNA, 20 bp, Artificial Sequence
  chemically synthesized
ttcacactataatttagtac

SEQ ID NO: 323067 - DNA, 20 bp, Artificial Sequence
  chemically synthesized
tgctagaaggattggtattc

SEQ ID NO: 323068 - DNA, 20 bp, Artificial Sequence
  chemically synthesized
tactggaataccaatccttc

SEQ ID NO: 323069 - DNA, 20 bp, Artificial Sequence
  chemically synthesized
attagatatgctagaaggat

SEQ ID NO: 323070 - DNA, 20 bp, Artificial Sequence
  chemically synthesized
aactcattagatatgctaga

SEQ ID NO: 323071 - DNA, 20 bp, Artificial Sequence
  chemically synthesized
aaactcattagatatgctag

SEQ ID NO: 323072 - DNA, 20 bp, Artificial Sequence
  chemically synthesized
aggaaactcattagatatgc

SEQ ID NO: 323073 - DNA, 20 bp, Artificial Sequence
  chemically synthesized
atccttctagcatatctaat

SEQ ID NO: 323074 - DNA, 20 bp, Artificial Sequence
  chemically synthesized
aaaggaccaaggaaactcat

SEQ ID NO: 323075 - DNA, 20 bp, Artificial Sequence
  chemically synthesized
gcatatctaatgagtttcct

SEQ ID NO: 323076 - DNA, 20 bp, Artificial Sequence
  chemically synthesized
ttaaaaaaaaaaaaggacca

SEQ ID NO: 323077 - DNA, 20 bp, Artificial Sequence
  chemically synthesized
gttaaaaaaaaaaaaggacc

SEQ ID NO: 323078 - DNA, 20 bp, Artificial Sequence
  chemically synthesized
aaaagcgttaaaaaaaaaaa

SEQ ID NO: 323079 - DNA, 20 bp, Artificial Sequence
  chemically synthesized
caaaagcgttaaaaaaaaaa

SEQ ID NO: 323080 - DNA, 20 bp, Artificial Sequence
  chemically synthesized
ctattatttatgaagttcaa

SEQ ID NO: 323081 - DNA, 20 bp, Artificial Sequence
  chemically synthesized
ttatttaactattatttatg

SEQ ID NO: 323082 - DNA, 20 bp, Artificial Sequence
  chemically synthesized
cttttgaacttcataaataa

SEQ ID NO: 323083 - DNA, 20 bp, Artificial Sequence
  chemically synthesized
aataatagttaaataaactt

SEQ ID NO: 323084 - DNA, 20 bp, Artificial Sequence
  chemically synthesized
ataatagttaaataaactta

SEQ ID NO: 323085 - DNA, 20 bp, Artificial Sequence
  chemically synthesized
aaaaattgtccaaatgcctt

SEQ ID NO: 323086 - DNA, 20 bp, Artificial Sequence
  chemically synthesized
ttaaataaacttaaggcatt

SEQ ID NO: 323087 - DNA, 20 bp, Artificial Sequence
  chemically synthesized
actgtggatttgaatacatt

SEQ ID NO: 323088 - DNA, 20 bp, Artificial Sequence
  chemically synthesized
acttaatgtattcaaatcca

SEQ ID NO: 323089 - DNA, 20 bp, Artificial Sequence
  chemically synthesized
aatgtattcaaatccacagt

SEQ ID NO: 323090 - DNA, 20 bp, Artificial Sequence
  chemically synthesized
aagaaatgaagtgccaactg

SEQ ID NO: 323091 - DNA, 20 bp, Artificial Sequence
  chemically synthesized
tttttaaatgaaaagaaatg

SEQ ID NO: 323092 - DNA, 20 bp, Artificial Sequence
  chemically synthesized
tagatttatttttaaatgaa

SEQ ID NO: 323093 - DNA, 20 bp, Artificial Sequence
  chemically synthesized
taaagcctatcaagacaaga

SEQ ID NO: 323094 - DNA, 20 bp, Artificial Sequence
  chemically synthesized
ataaatctatcttgtcttga

SEQ ID NO: 323095 - DNA, 20 bp, Artificial Sequence
  chemically synthesized
catgtaaagcctatcaagac

SEQ ID NO: 323096 - DNA, 20 bp, Artificial Sequence
  chemically synthesized
taaatctatcttgtcttgat

SEQ ID NO: 323097 - DNA, 20 bp, Artificial Sequence
  chemically synthesized
atattcatgtaaagcctatc

SEQ ID NO: 323098 - DNA, 20 bp, Artificial Sequence
  chemically synthesized
taggtgtgtatattcatgta

SEQ ID NO: 323099 - DNA, 20 bp, Artificial Sequence
  chemically synthesized
gtgttttgatttatattgtt

SEQ ID NO: 323100 - DNA, 20 bp, Artificial Sequence
  chemically synthesized
tgtgttttgatttatattgt

SEQ ID NO: 323101 - DNA, 20 bp, Artificial Sequence
  chemically synthesized
tataaatcaaaacacatatc

SEQ ID NO: 323102 - DNA, 20 bp, Artificial Sequence
  chemically synthesized
aaacacatatccagaatgat

SEQ ID NO: 323103 - DNA, 20 bp, Artificial Sequence
  chemically synthesized
acaagcagatctcatcattc

SEQ ID NO: 323104 - DNA, 20 bp, Artificial Sequence
  chemically synthesized
tttcttataaaggtaacaag

SEQ ID NO: 323105 - DNA, 20 bp, Artificial Sequence
  chemically synthesized
atatttcttataaaggtaac

SEQ ID NO: 323106 - DNA, 20 bp, Artificial Sequence
  chemically synthesized
gatctgcttgttacctttat

SEQ ID NO: 323107 - DNA, 20 bp, Artificial Sequence
  chemically synthesized
aaatgacatatttcttataa

SEQ ID NO: 323108 - DNA, 20 bp, Artificial Sequence
  chemically synthesized
aaaatgacatatttcttata

SEQ ID NO: 323109 - DNA, 20 bp, Artificial Sequence
  chemically synthesized
ataagaaatatgtcattttt

SEQ ID NO: 323110 - DNA, 20 bp, Artificial Sequence
  chemically synthesized
cttaataaaaaagaggattt

SEQ ID NO: 323111 - DNA, 20 bp, Artificial Sequence
  chemically synthesized
atattgacttaataaaaaag

SEQ ID NO: 323112 - DNA, 20 bp, Artificial Sequence
  chemically synthesized
tatattgacttaataaaaaa

SEQ ID NO: 323113 - DNA, 20 bp, Artificial Sequence
  chemically synthesized
ctcaaatcctcttttttatt

SEQ ID NO: 323114 - DNA, 20 bp, Artificial Sequence
  chemically synthesized
tatatattgacttaataaaa

SEQ ID NO: 323115 - DNA, 20 bp, Artificial Sequence
  chemically synthesized
ttaagtcaatatatattctt

SEQ ID NO: 323116 - DNA, 20 bp, Artificial Sequence
  chemically synthesized
gtatggctatgaattatctt

SEQ ID NO: 323117 - DNA, 20 bp, Artificial Sequence
  chemically synthesized
tatattcttaagataattca

SEQ ID NO: 323118 - DNA, 20 bp, Artificial Sequence
  chemically synthesized
attcttattaaaatacagta

SEQ ID NO: 323119 - DNA, 20 bp, Artificial Sequence
  chemically synthesized
gggaaattcttattaaaata

SEQ ID NO: 323120 - DNA, 20 bp, Artificial Sequence
  chemically synthesized
tagccatactgtattttaat

SEQ ID NO: 323121 - DNA, 20 bp, Artificial Sequence
  chemically synthesized
aaacattattcaaacgtttt

SEQ ID NO: 323122 - DNA, 20 bp, Artificial Sequence
  chemically synthesized
aaaacattattcaaacgttt

SEQ ID NO: 323123 - DNA, 20 bp, Artificial Sequence
  chemically synthesized
acgtttgaataatgtttttc

SEQ ID NO: 323124 - DNA, 20 bp, Artificial Sequence
  chemically synthesized
gtttgaataatgtttttcaa

SEQ ID NO: 323125 - DNA, 20 bp, Artificial Sequence
  chemically synthesized
tttgaataatgtttttcaag

SEQ ID NO: 323126 - DNA, 20 bp, Artificial Sequence
  chemically synthesized
ttcaagaggatttccatata

SEQ ID NO: 323127 - DNA, 20 bp, Artificial Sequence
  chemically synthesized
aagagttactcatctatata

SEQ ID NO: 323128 - DNA, 20 bp, Artificial Sequence
  chemically synthesized
gaggatttccatatatagat

SEQ ID NO: 323129 - DNA, 20 bp, Artificial Sequence
  chemically synthesized
aagcccttgaaaatattaaa

SEQ ID NO: 323130 - DNA, 20 bp, Artificial Sequence
  chemically synthesized
aaaagcccttgaaaatatta

SEQ ID NO: 323131 - DNA, 20 bp, Artificial Sequence
  chemically synthesized
agtaactctttaatattttc

SEQ ID NO: 323132 - DNA, 20 bp, Artificial Sequence
  chemically synthesized
gtaactctttaatattttca

SEQ ID NO: 323133 - DNA, 20 bp, Artificial Sequence
  chemically synthesized
taactctttaatattttcaa

SEQ ID NO: 323134 - DNA, 20 bp, Artificial Sequence
  chemically synthesized
attttcaagggctttttctt

SEQ ID NO: 323135 - DNA, 20 bp, Artificial Sequence
  chemically synthesized
aaacttctcttctgaagaaa

SEQ ID NO: 323136 - DNA, 20 bp, Artificial Sequence
  chemically synthesized
ttcaagggctttttcttcag

SEQ ID NO: 323137 - DNA, 20 bp, Artificial Sequence
  chemically synthesized
caagggctttttcttcagaa

SEQ ID NO: 323138 - DNA, 20 bp, Artificial Sequence
  chemically synthesized
gacacgaaacttctcttctg

SEQ ID NO: 323139 - DNA, 20 bp, Artificial Sequence
  chemically synthesized
gggctttttcttcagaagag

SEQ ID NO: 323140 - DNA, 20 bp, Artificial Sequence
  chemically synthesized
gagaagtttcgtgtcaacta

SEQ ID NO: 323141 - DNA, 20 bp, Artificial Sequence
  chemically synthesized
ttcgtgtcaactatagctaa

SEQ ID NO: 323142 - DNA, 20 bp, Artificial Sequence
  chemically synthesized
ataaaatcacctattagcta

SEQ ID NO: 323143 - DNA, 20 bp, Artificial Sequence
  chemically synthesized
tcgtgtcaactatagctaat

SEQ ID NO: 323144 - DNA, 20 bp, Artificial Sequence
  chemically synthesized
gtgtacataaaatcacctat

SEQ ID NO: 323145 - DNA, 20 bp, Artificial Sequence
  chemically synthesized
aggcacagaagcatgcacag

SEQ ID NO: 323146 - DNA, 20 bp, Artificial Sequence
  chemically synthesized
aaaggcacagaagcatgcac

SEQ ID NO: 323147 - DNA, 20 bp, Artificial Sequence
  chemically synthesized
aaaaggcacagaagcatgca

SEQ ID NO: 323148 - DNA, 20 bp, Artificial Sequence
  chemically synthesized
tgtcactataaaaggcacag

SEQ ID NO: 323149 - DNA, 20 bp, Artificial Sequence
  chemically synthesized
aaatgtcactataaaaggca

SEQ ID NO: 323150 - DNA, 20 bp, Artificial Sequence
  chemically synthesized
gcatgcttctgtgcctttta

SEQ ID NO: 323151 - DNA, 20 bp, Artificial Sequence
  chemically synthesized
cattaaaatgtcactataaa

SEQ ID NO: 323152 - DNA, 20 bp, Artificial Sequence
  chemically synthesized
acattaaaatgtcactataa

SEQ ID NO: 323153 - DNA, 20 bp, Artificial Sequence
  chemically synthesized
tatagtgacattttaatgtt

SEQ ID NO: 323154 - DNA, 20 bp, Artificial Sequence
  chemically synthesized
tagtgacattttaatgtttg

SEQ ID NO: 323155 - DNA, 20 bp, Artificial Sequence
  chemically synthesized
agtgacattttaatgtttgg

SEQ ID NO: 323156 - DNA, 20 bp, Artificial Sequence
  chemically synthesized
ttaatgtttggaggaaaacc

SEQ ID NO: 323157 - DNA, 20 bp, Artificial Sequence
  chemically synthesized
tgtcatagttattattttct

SEQ ID NO: 323158 - DNA, 20 bp, Artificial Sequence
  chemically synthesized
ctgtcatagttattattttc

SEQ ID NO: 323159 - DNA, 20 bp, Artificial Sequence
  chemically synthesized
ctagaaaataataactatga

SEQ ID NO: 323160 - DNA, 20 bp, Artificial Sequence
  chemically synthesized
gatttgccaaaattctgtca

SEQ ID NO: 323161 - DNA, 20 bp, Artificial Sequence
  chemically synthesized
taataactatgacagaattt

SEQ ID NO: 323162 - DNA, 20 bp, Artificial Sequence
  chemically synthesized
ttttggcaaatcttaaaaca

SEQ ID NO: 323163 - DNA, 20 bp, Artificial Sequence
  chemically synthesized
tatctacagaactatgtttt

SEQ ID NO: 323164 - DNA, 20 bp, Artificial Sequence
  chemically synthesized
aatcttaaaacatagttctg

SEQ ID NO: 323165 - DNA, 20 bp, Artificial Sequence
  chemically synthesized
aaacatagttctgtagataa

SEQ ID NO: 323166 - DNA, 20 bp, Artificial Sequence
  chemically synthesized
gatagatgcactgttatcta

SEQ ID NO: 323167 - DNA, 20 bp, Artificial Sequence
  chemically synthesized
ctaaaagagcagatgttaga

SEQ ID NO: 323168 - DNA, 20 bp, Artificial Sequence
  chemically synthesized
gtaactaaaagagcagatgt

SEQ ID NO: 323169 - DNA, 20 bp, Artificial Sequence
  chemically synthesized
ctatctaacatctgctcttt

SEQ ID NO: 323170 - DNA, 20 bp, Artificial Sequence
  chemically synthesized
cacttttgtaactaaaagag

SEQ ID NO: 323171 - DNA, 20 bp, Artificial Sequence
  chemically synthesized
tttcacttttgtaactaaaa

SEQ ID NO: 323172 - DNA, 20 bp, Artificial Sequence
  chemically synthesized
gttttcacttttgtaactaa

SEQ ID NO: 323173 - DNA, 20 bp, Artificial Sequence
  chemically synthesized
atctgctcttttagttacaa

SEQ ID NO: 323174 - DNA, 20 bp, Artificial Sequence
  chemically synthesized
ttttcatagaaataacattt

SEQ ID NO: 323175 - DNA, 20 bp, Artificial Sequence
  chemically synthesized
ggagactggttggattttca

SEQ ID NO: 323176 - DNA, 20 bp, Artificial Sequence
  chemically synthesized
tatttctatgaaaatccaac

SEQ ID NO: 323177 - DNA, 20 bp, Artificial Sequence
  chemically synthesized
ttctttcaagggagactggt

SEQ ID NO: 323178 - DNA, 20 bp, Artificial Sequence
  chemically synthesized
agctttctttcaagggagac

SEQ ID NO: 323179 - DNA, 20 bp, Artificial Sequence
  chemically synthesized
atccaaccagtctcccttga

SEQ ID NO: 323180 - DNA, 20 bp, Artificial Sequence
  chemically synthesized
cacacagctttctttcaagg

SEQ ID NO: 323181 - DNA, 20 bp, Artificial Sequence
  chemically synthesized
ggcacacagctttctttcaa

SEQ ID NO: 323182 - DNA, 20 bp, Artificial Sequence
  chemically synthesized
aaccagtctcccttgaaaga

SEQ ID NO: 323183 - DNA, 20 bp, Artificial Sequence
  chemically synthesized
aggcacacagctttctttca

SEQ ID NO: 323184 - DNA, 20 bp, Artificial Sequence
  chemically synthesized
aaggcacacagctttctttc

SEQ ID NO: 323185 - DNA, 20 bp, Artificial Sequence
  chemically synthesized
tgaaagaaagctgtgtgcct

SEQ ID NO: 323186 - DNA, 20 bp, Artificial Sequence
  chemically synthesized
cagtttgttcccaaggcaca

SEQ ID NO: 323187 - DNA, 20 bp, Artificial Sequence
  chemically synthesized
gaaagaaagctgtgtgcctt

SEQ ID NO: 323188 - DNA, 20 bp, Artificial Sequence
  chemically synthesized
cgattctcagtttgttccca

SEQ ID NO: 323189 - DNA, 20 bp, Artificial Sequence
  chemically synthesized
acgattctcagtttgttccc

SEQ ID NO: 323190 - DNA, 20 bp, Artificial Sequence
  chemically synthesized
gtgtgccttgggaacaaact

SEQ ID NO: 323191 - DNA, 20 bp, Artificial Sequence
  chemically synthesized
gatggttaagttacgattct

SEQ ID NO: 323192 - DNA, 20 bp, Artificial Sequence
  chemically synthesized
tttgatgtggtttgatggtt

SEQ ID NO: 323193 - DNA, 20 bp, Artificial Sequence
  chemically synthesized
attattttgatgtggtttga

SEQ ID NO: 323194 - DNA, 20 bp, Artificial Sequence
  chemically synthesized
agcttgtgattattttgatg

SEQ ID NO: 323195 - DNA, 20 bp, Artificial Sequence
  chemically synthesized
aaccacatcaaaataatcac

SEQ ID NO: 323196 - DNA, 20 bp, Artificial Sequence
  chemically synthesized
agaagactaacaagttttgg

SEQ ID NO: 323197 - DNA, 20 bp, Artificial Sequence
  chemically synthesized
ttaagaagactaacaagttt

SEQ ID NO: 323198 - DNA, 20 bp, Artificial Sequence
  chemically synthesized
cacaagcttccaaaacttgt

SEQ ID NO: 323199 - DNA, 20 bp, Artificial Sequence
  chemically synthesized
ttttaattaagaagactaac

SEQ ID NO: 323200 - DNA, 20 bp, Artificial Sequence
  chemically synthesized
cttatttgtttttaattaag

SEQ ID NO: 323201 - DNA, 20 bp, Artificial Sequence
  chemically synthesized
gtccttatttgtttttaatt

SEQ ID NO: 323202 - DNA, 20 bp, Artificial Sequence
  chemically synthesized
cttcttaattaaaaacaaat

SEQ ID NO: 323203 - DNA, 20 bp, Artificial Sequence
  chemically synthesized
ttcttaattaaaaacaaata

SEQ ID NO: 323204 - DNA, 20 bp, Artificial Sequence
  chemically synthesized
catggaaaaacaaagcaagt

SEQ ID NO: 323205 - DNA, 20 bp, Artificial Sequence
  chemically synthesized
ctagcatggaaaaacaaagc

SEQ ID NO: 323206 - DNA, 20 bp, Artificial Sequence
  chemically synthesized
gtagctagcatggaaaaaca

SEQ ID NO: 323207 - DNA, 20 bp, Artificial Sequence
  chemically synthesized
cttgctttgtttttccatgc

SEQ ID NO: 323208 - DNA, 20 bp, Artificial Sequence
  chemically synthesized
atgcctcagggtagctagca

SEQ ID NO: 323209 - DNA, 20 bp, Artificial Sequence
  chemically synthesized
tgggaatgcctcagggtagc

SEQ ID NO: 323210 - DNA, 20 bp, Artificial Sequence
  chemically synthesized
ttttccatgctagctaccct

SEQ ID NO: 323211 - DNA, 20 bp, Artificial Sequence
  chemically synthesized
tttccatgctagctaccctg

SEQ ID NO: 323212 - DNA, 20 bp, Artificial Sequence
  chemically synthesized
aagatgggaatgcctcaggg

SEQ ID NO: 323213 - DNA, 20 bp, Artificial Sequence
  chemically synthesized
ttcaagatgggaatgcctca

SEQ ID NO: 323214 - DNA, 20 bp, Artificial Sequence
  chemically synthesized
attcaagatgggaatgcctc

SEQ ID NO: 323215 - DNA, 20 bp, Artificial Sequence
  chemically synthesized
aattcaagatgggaatgcct

SEQ ID NO: 323216 - DNA, 20 bp, Artificial Sequence
  chemically synthesized
gaatctcctaaattcaagat

SEQ ID NO: 323217 - DNA, 20 bp, Artificial Sequence
  chemically synthesized
tgaatctcctaaattcaaga

SEQ ID NO: 323218 - DNA, 20 bp, Artificial Sequence
  chemically synthesized
aggcattcccatcttgaatt

SEQ ID NO: 323219 - DNA, 20 bp, Artificial Sequence
  chemically synthesized
ggcattcccatcttgaattt

SEQ ID NO: 323220 - DNA, 20 bp, Artificial Sequence
  chemically synthesized
cagatgaatctcctaaattc

SEQ ID NO: 323221 - DNA, 20 bp, Artificial Sequence
  chemically synthesized
cattcccatcttgaatttag

SEQ ID NO: 323222 - DNA, 20 bp, Artificial Sequence
  chemically synthesized
aagaaactgaagtacaagag

SEQ ID NO: 323223 - DNA, 20 bp, Artificial Sequence
  chemically synthesized
atgaagaaactgaagtacaa

SEQ ID NO: 323224 - DNA, 20 bp, Artificial Sequence
  chemically synthesized
attcatctgctcttgtactt

SEQ ID NO: 323225 - DNA, 20 bp, Artificial Sequence
  chemically synthesized
agatgaagaaactgaagtac

SEQ ID NO: 323226 - DNA, 20 bp, Artificial Sequence
  chemically synthesized
atcagaagatgaagaaactg

SEQ ID NO: 323227 - DNA, 20 bp, Artificial Sequence
  chemically synthesized
aggaaaattatcagaagatg

SEQ ID NO: 323228 - DNA, 20 bp, Artificial Sequence
  chemically synthesized
tggaacaggaaaattatcag

SEQ ID NO: 323229 - DNA, 20 bp, Artificial Sequence
  chemically synthesized
gattggaacaggaaaattat

SEQ ID NO: 323230 - DNA, 20 bp, Artificial Sequence
  chemically synthesized
ggaagtaagctgattggaac

SEQ ID NO: 323231 - DNA, 20 bp, Artificial Sequence
  chemically synthesized
gataattttcctgttccaat

SEQ ID NO: 323232 - DNA, 20 bp, Artificial Sequence
  chemically synthesized
gggaagtaagctgattggaa

SEQ ID NO: 323233 - DNA, 20 bp, Artificial Sequence
  chemically synthesized
caattgggaagtaagctgat

SEQ ID NO: 323234 - DNA, 20 bp, Artificial Sequence
  chemically synthesized
atattctacaattgggaagt

SEQ ID NO: 323235 - DNA, 20 bp, Artificial Sequence
  chemically synthesized
ggtaatattctacaattggg

SEQ ID NO: 323236 - DNA, 20 bp, Artificial Sequence
  chemically synthesized
atcagcttacttcccaattg

SEQ ID NO: 323237 - DNA, 20 bp, Artificial Sequence
  chemically synthesized
gttggtaatattctacaatt

SEQ ID NO: 323238 - DNA, 20 bp, Artificial Sequence
  chemically synthesized
ggttggtaatattctacaat

SEQ ID NO: 323239 - DNA, 20 bp, Artificial Sequence
  chemically synthesized
attgtagaatattaccaacc

SEQ ID NO: 323240 - DNA, 20 bp, Artificial Sequence
  chemically synthesized
acagcccatcagggccgggt

SEQ ID NO: 323241 - DNA, 20 bp, Artificial Sequence
  chemically synthesized
tttgacagcccatcagggcc

SEQ ID NO: 323242 - DNA, 20 bp, Artificial Sequence
  chemically synthesized
tattaccaacccggccctga

SEQ ID NO: 323243 - DNA, 20 bp, Artificial Sequence
  chemically synthesized
atttgacagcccatcagggc

SEQ ID NO: 323244 - DNA, 20 bp, Artificial Sequence
  chemically synthesized
attaccaacccggccctgat

SEQ ID NO: 323245 - DNA, 20 bp, Artificial Sequence
  chemically synthesized
atggatttgacagcccatca

SEQ ID NO: 323246 - DNA, 20 bp, Artificial Sequence
  chemically synthesized
gatggatttgacagcccatc

SEQ ID NO: 323247 - DNA, 20 bp, Artificial Sequence
  chemically synthesized
tgatggatttgacagcccat

SEQ ID NO: 323248 - DNA, 20 bp, Artificial Sequence
  chemically synthesized
ggggtacatgatggatttga

SEQ ID NO: 323249 - DNA, 20 bp, Artificial Sequence
  chemically synthesized
tctttgtcaggggtacatga

SEQ ID NO: 323250 - DNA, 20 bp, Artificial Sequence
  chemically synthesized
tccatcatgtacccctgaca

SEQ ID NO: 323251 - DNA, 20 bp, Artificial Sequence
  chemically synthesized
ttaacttccttctttgtcag

SEQ ID NO: 323252 - DNA, 20 bp, Artificial Sequence
  chemically synthesized
gttaacttccttctttgtca

SEQ ID NO: 323253 - DNA, 20 bp, Artificial Sequence
  chemically synthesized
atcatgtacccctgacaaag

SEQ ID NO: 323254 - DNA, 20 bp, Artificial Sequence
  chemically synthesized
tgttaacttccttctttgtc

SEQ ID NO: 323255 - DNA, 20 bp, Artificial Sequence
  chemically synthesized
tcatgtacccctgacaaaga

SEQ ID NO: 323256 - DNA, 20 bp, Artificial Sequence
  chemically synthesized
ttgttaacttccttctttgt

SEQ ID NO: 323257 - DNA, 20 bp, Artificial Sequence
  chemically synthesized
tgtacccctgacaaagaagg

SEQ ID NO: 323258 - DNA, 20 bp, Artificial Sequence
  chemically synthesized
aggaagttaacaattgtaat

SEQ ID NO: 323259 - DNA, 20 bp, Artificial Sequence
  chemically synthesized
aacaattgtaattagaactc

SEQ ID NO: 323260 - DNA, 20 bp, Artificial Sequence
  chemically synthesized
acaattgtaattagaactct

SEQ ID NO: 323261 - DNA, 20 bp, Artificial Sequence
  chemically synthesized
aaaccacaccgatttaccta

SEQ ID NO: 323262 - DNA, 20 bp, Artificial Sequence
  chemically synthesized
aattagaactctaggtaaat

SEQ ID NO: 323263 - DNA, 20 bp, Artificial Sequence
  chemically synthesized
caaaaccacaccgatttacc

SEQ ID NO: 323264 - DNA, 20 bp, Artificial Sequence
  chemically synthesized
gaactctaggtaaatcggtg

SEQ ID NO: 323265 - DNA, 20 bp, Artificial Sequence
  chemically synthesized
aggtaaatcggtgtggtttt

SEQ ID NO: 323266 - DNA, 20 bp, Artificial Sequence
  chemically synthesized
ttttgagttttatttgtttg

SEQ ID NO: 323267 - DNA, 20 bp, Artificial Sequence
  chemically synthesized
tgtttgcagttttaaacttg

SEQ ID NO: 323268 - DNA, 20 bp, Artificial Sequence
  chemically synthesized
tataaatctaaatgggccac

SEQ ID NO: 323269 - DNA, 20 bp, Artificial Sequence
  chemically synthesized
ttttaaacttgtggcccatt

SEQ ID NO: 323270 - DNA, 20 bp, Artificial Sequence
  chemically synthesized
ctgggaatataaatctaaat

SEQ ID NO: 323271 - DNA, 20 bp, Artificial Sequence
  chemically synthesized
actgggaatataaatctaaa

SEQ ID NO: 323272 - DNA, 20 bp, Artificial Sequence
  chemically synthesized
cccatttagatttatattcc

SEQ ID NO: 323273 - DNA, 20 bp, Artificial Sequence
  chemically synthesized
tagatttatattcccagtaa

SEQ ID NO: 323274 - DNA, 20 bp, Artificial Sequence
  chemically synthesized
agatttatattcccagtaaa

SEQ ID NO: 323275 - DNA, 20 bp, Artificial Sequence
  chemically synthesized
caaattaaattccttttact

SEQ ID NO: 323276 - DNA, 20 bp, Artificial Sequence
  chemically synthesized
acaaattaaattccttttac

SEQ ID NO: 323277 - DNA, 20 bp, Artificial Sequence
  chemically synthesized
aggaatttaatttgtatttg

SEQ ID NO: 323278 - DNA, 20 bp, Artificial Sequence
  chemically synthesized
ttcatattaaaagtggtttt

SEQ ID NO: 323279 - DNA, 20 bp, Artificial Sequence
  chemically synthesized
attcatattaaaagtggttt

SEQ ID NO: 323280 - DNA, 20 bp, Artificial Sequence
  chemically synthesized
tccttaattcatattaaaag

SEQ ID NO: 323281 - DNA, 20 bp, Artificial Sequence
  chemically synthesized
ttttccttaattcatattaa

SEQ ID NO: 323282 - DNA, 20 bp, Artificial Sequence
  chemically synthesized
aaccacttttaatatgaatt

SEQ ID NO: 323283 - DNA, 20 bp, Artificial Sequence
  chemically synthesized
accacttttaatatgaatta

SEQ ID NO: 323284 - DNA, 20 bp, Artificial Sequence
  chemically synthesized
gaattaaggaaaattatctt

SEQ ID NO: 323285 - DNA, 20 bp, Artificial Sequence
  chemically synthesized
aaggaaaattatcttaagtc

SEQ ID NO: 323286 - DNA, 20 bp, Artificial Sequence
  chemically synthesized
gcttctgaagaacttgactt

SEQ ID NO: 323287 - DNA, 20 bp, Artificial Sequence
  chemically synthesized
ttatcttaagtcaagttctt

SEQ ID NO: 323288 - DNA, 20 bp, Artificial Sequence
  chemically synthesized
tcttaagtcaagttcttcag

SEQ ID NO: 323289 - DNA, 20 bp, Artificial Sequence
  chemically synthesized
taagtcaagttcttcagaag

SEQ ID NO: 323290 - DNA, 20 bp, Artificial Sequence
  chemically synthesized
aagtcaagttcttcagaagc

SEQ ID NO: 323291 - DNA, 20 bp, Artificial Sequence
  chemically synthesized
tatctcggggcctgcttctg

SEQ ID NO: 323292 - DNA, 20 bp, Artificial Sequence
  chemically synthesized
gttcttcagaagcaggcccc

SEQ ID NO: 323293 - DNA, 20 bp, Artificial Sequence
  chemically synthesized
tcagaagcaggccccgagat

SEQ ID NO: 323294 - DNA, 20 bp, Artificial Sequence
  chemically synthesized
cagaagcaggccccgagata

SEQ ID NO: 323295 - DNA, 20 bp, Artificial Sequence
  chemically synthesized
gcactgaagtccttatctcg

SEQ ID NO: 323296 - DNA, 20 bp, Artificial Sequence
  chemically synthesized
tgcactgaagtccttatctc

SEQ ID NO: 323297 - DNA, 20 bp, Artificial Sequence
  chemically synthesized
ttgcactgaagtccttatct

SEQ ID NO: 323298 - DNA, 20 bp, Artificial Sequence
  chemically synthesized
aggccccgagataaggactt

SEQ ID NO: 323299 - DNA, 20 bp, Artificial Sequence
  chemically synthesized
cgagataaggacttcagtgc

SEQ ID NO: 323300 - DNA, 20 bp, Artificial Sequence
  chemically synthesized
ttaataaatcacttgcactg

SEQ ID NO: 323301 - DNA, 20 bp, Artificial Sequence
  chemically synthesized
ttcagtgcaagtgatttatt

SEQ ID NO: 323302 - DNA, 20 bp, Artificial Sequence
  chemically synthesized
tcagtgcaagtgatttatta

SEQ ID NO: 323303 - DNA, 20 bp, Artificial Sequence
  chemically synthesized
gtgcaagtgatttattaagg

SEQ ID NO: 323304 - DNA, 20 bp, Artificial Sequence
  chemically synthesized
gcaagtgatttattaaggaa

SEQ ID NO: 323305 - DNA, 20 bp, Artificial Sequence
  chemically synthesized
atttattaaggaagagctcc

SEQ ID NO: 323306 - DNA, 20 bp, Artificial Sequence
  chemically synthesized
tttattaaggaagagctccc

SEQ ID NO: 323307 - DNA, 20 bp, Artificial Sequence
  chemically synthesized
attaaggaagagctcccagg

SEQ ID NO: 323308 - DNA, 20 bp, Artificial Sequence
  chemically synthesized
tcccttgcggaacttcctgg

SEQ ID NO: 323309 - DNA, 20 bp, Artificial Sequence
  chemically synthesized
actcccttgcggaacttcct

SEQ ID NO: 323310 - DNA, 20 bp, Artificial Sequence
  chemically synthesized
aactcccttgcggaacttcc

SEQ ID NO: 323311 - DNA, 20 bp, Artificial Sequence
  chemically synthesized
gagctcccaggaagttccgc

SEQ ID NO: 323312 - DNA, 20 bp, Artificial Sequence
  chemically synthesized
agctcccaggaagttccgca

SEQ ID NO: 323313 - DNA, 20 bp, Artificial Sequence
  chemically synthesized
gctcccaggaagttccgcaa

SEQ ID NO: 323314 - DNA, 20 bp, Artificial Sequence
  chemically synthesized
tcccaggaagttccgcaagg

SEQ ID NO: 323315 - DNA, 20 bp, Artificial Sequence
  chemically synthesized
ctccatcttcaactcccttg

SEQ ID NO: 323316 - DNA, 20 bp, Artificial Sequence
  chemically synthesized
gaagttccgcaagggagttg

SEQ ID NO: 323317 - DNA, 20 bp, Artificial Sequence
  chemically synthesized
ttccgcaagggagttgaaga

SEQ ID NO: 323318 - DNA, 20 bp, Artificial Sequence
  chemically synthesized
ccgcaagggagttgaagatg

SEQ ID NO: 323319 - DNA, 20 bp, Artificial Sequence
  chemically synthesized
cgcaagggagttgaagatgg

SEQ ID NO: 323320 - DNA, 20 bp, Artificial Sequence
  chemically synthesized
ggagttgaagatggaggaaa

SEQ ID NO: 323321 - DNA, 20 bp, Artificial Sequence
  chemically synthesized
gagttgaagatggaggaaaa

SEQ ID NO: 323322 - DNA, 20 bp, Artificial Sequence
  chemically synthesized
tgaagatggaggaaaaagga

SEQ ID NO: 323323 - DNA, 20 bp, Artificial Sequence
  chemically synthesized
gaagatggaggaaaaaggac

SEQ ID NO: 323324 - DNA, 20 bp, Artificial Sequence
  chemically synthesized
aagatggaggaaaaaggaca

SEQ ID NO: 323325 - DNA, 20 bp, Artificial Sequence
  chemically synthesized
atggaggaaaaaggacaggg

SEQ ID NO: 323326 - DNA, 20 bp, Artificial Sequence
  chemically synthesized
tggaggaaaaaggacaggga

SEQ ID NO: 323327 - DNA, 20 bp, Artificial Sequence
  chemically synthesized
ggaggaaaaaggacagggaa

SEQ ID NO: 323328 - DNA, 20 bp, Artificial Sequence
  chemically synthesized
gaaaaaggacagggaaggga

SEQ ID NO: 323329 - DNA, 20 bp, Artificial Sequence
  chemically synthesized
aaaggacagggaagggaaag

SEQ ID NO: 323330 - DNA, 20 bp, Artificial Sequence
  chemically synthesized
ggaagggaaagaagccaaac

SEQ ID NO: 323331 - DNA, 20 bp, Artificial Sequence
  chemically synthesized
cctgagatgatacactcgtt

SEQ ID NO: 323332 - DNA, 20 bp, Artificial Sequence
  chemically synthesized
gccaaacgagtgtatcatct

SEQ ID NO: 323333 - DNA, 20 bp, Artificial Sequence
  chemically synthesized
ccaaacgagtgtatcatctc

SEQ ID NO: 323334 - DNA, 20 bp, Artificial Sequence
  chemically synthesized
cgagtgtatcatctcaggaa

SEQ ID NO: 323335 - DNA, 20 bp, Artificial Sequence
  chemically synthesized
ctcagtgggagacttttcct

SEQ ID NO: 323336 - DNA, 20 bp, Artificial Sequence
  chemically synthesized
ctcaggaaaagtctcccact

SEQ ID NO: 323337 - DNA, 20 bp, Artificial Sequence
  chemically synthesized
caggaaaagtctcccactga

SEQ ID NO: 323338 - DNA, 20 bp, Artificial Sequence
  chemically synthesized
ggcttaacttctctcagtgg

SEQ ID NO: 323339 - DNA, 20 bp, Artificial Sequence
  chemically synthesized
tgggcttaacttctctcagt

SEQ ID NO: 323340 - DNA, 20 bp, Artificial Sequence
  chemically synthesized
gaaaagtctcccactgagag

SEQ ID NO: 323341 - DNA, 20 bp, Artificial Sequence
  chemically synthesized
ttgggcttaacttctctcag

SEQ ID NO: 323342 - DNA, 20 bp, Artificial Sequence
  chemically synthesized
gtattgggcttaacttctct

SEQ ID NO: 323343 - DNA, 20 bp, Artificial Sequence
  chemically synthesized
gtctcccactgagagaagtt

SEQ ID NO: 323344 - DNA, 20 bp, Artificial Sequence
  chemically synthesized
ctgagttgatgtatggtatt

SEQ ID NO: 323345 - DNA, 20 bp, Artificial Sequence
  chemically synthesized
cctgagttgatgtatggtat

SEQ ID NO: 323346 - DNA, 20 bp, Artificial Sequence
  chemically synthesized
tacattcctgagttgatgta

SEQ ID NO: 323347 - DNA, 20 bp, Artificial Sequence
  chemically synthesized
cccaataccatacatcaact

SEQ ID NO: 323348 - DNA, 20 bp, Artificial Sequence
  chemically synthesized
ccaataccatacatcaactc

SEQ ID NO: 323349 - DNA, 20 bp, Artificial Sequence
  chemically synthesized
gaggcattacttacattcct

SEQ ID NO: 323350 - DNA, 20 bp, Artificial Sequence
  chemically synthesized
atacatcaactcaggaatgt

SEQ ID NO: 323351 - DNA, 20 bp, Artificial Sequence
  chemically synthesized
caggaatgtaagtaatgcct

SEQ ID NO: 323352 - DNA, 20 bp, Artificial Sequence
  chemically synthesized
cttgtgtcaaggcagtgctg

SEQ ID NO: 323353 - DNA, 20 bp, Artificial Sequence
  chemically synthesized
tcttgtgtcaaggcagtgct

SEQ ID NO: 323354 - DNA, 20 bp, Artificial Sequence
  chemically synthesized
ttctttctcttgtgtcaagg

SEQ ID NO: 323355 - DNA, 20 bp, Artificial Sequence
  chemically synthesized
cctcagcactgccttgacac

SEQ ID NO: 323356 - DNA, 20 bp, Artificial Sequence
  chemically synthesized
aacttctttctcttgtgtca

SEQ ID NO: 323357 - DNA, 20 bp, Artificial Sequence
  chemically synthesized
tcagcactgccttgacacaa

SEQ ID NO: 323358 - DNA, 20 bp, Artificial Sequence
  chemically synthesized
caacttctttctcttgtgtc

SEQ ID NO: 323359 - DNA, 20 bp, Artificial Sequence
  chemically synthesized
cactgccttgacacaagaga

SEQ ID NO: 323360 - DNA, 20 bp, Artificial Sequence
  chemically synthesized
tgccttgacacaagagaaag

SEQ ID NO: 323361 - DNA, 20 bp, Artificial Sequence
  chemically synthesized
ttgacacaagagaaagaagt

SEQ ID NO: 323362 - DNA, 20 bp, Artificial Sequence
  chemically synthesized
tgacacaagagaaagaagtt

SEQ ID NO: 323363 - DNA, 20 bp, Artificial Sequence
  chemically synthesized
atcggccaacaggaatacga

SEQ ID NO: 323364 - DNA, 20 bp, Artificial Sequence
  chemically synthesized
ttgggctttcgtattcctgt

SEQ ID NO: 323365 - DNA, 20 bp, Artificial Sequence
  chemically synthesized
tttctacctgatcggccaac

SEQ ID NO: 323366 - DNA, 20 bp, Artificial Sequence
  chemically synthesized
atttctacctgatcggccaa

SEQ ID NO: 323367 - DNA, 20 bp, Artificial Sequence
  chemically synthesized
tcgtattcctgttggccgat

SEQ ID NO: 323368 - DNA, 20 bp, Artificial Sequence
  chemically synthesized
cgtattcctgttggccgatc

SEQ ID NO: 323369 - DNA, 20 bp, Artificial Sequence
  chemically synthesized
attcctgttggccgatcagg

SEQ ID NO: 323370 - DNA, 20 bp, Artificial Sequence
  chemically synthesized
tgaaggcatttctacctgat

SEQ ID NO: 323371 - DNA, 20 bp, Artificial Sequence
  chemically synthesized
tcaggtagaaatgccttcaa

SEQ ID NO: 323372 - DNA, 20 bp, Artificial Sequence
  chemically synthesized
ttttggagagcaaccattga

SEQ ID NO: 323373 - DNA, 20 bp, Artificial Sequence
  chemically synthesized
cttttggagagcaaccattg

SEQ ID NO: 323374 - DNA, 20 bp, Artificial Sequence
  chemically synthesized
cttcaatggttgctctccaa

SEQ ID NO: 323375 - DNA, 20 bp, Artificial Sequence
  chemically synthesized
ttttgaagttttcttttgga

SEQ ID NO: 323376 - DNA, 20 bp, Artificial Sequence
  chemically synthesized
gattttgaagttttcttttg

SEQ ID NO: 323377 - DNA, 20 bp, Artificial Sequence
  chemically synthesized
cagattttgaagttttcttt

SEQ ID NO: 323378 - DNA, 20 bp, Artificial Sequence
  chemically synthesized
attccaacagtcagattttg

SEQ ID NO: 323379 - DNA, 20 bp, Artificial Sequence
  chemically synthesized
aaacttcaaaatctgactgt

SEQ ID NO: 323380 - DNA, 20 bp, Artificial Sequence
  chemically synthesized
gtgcttgggattccaacagt

SEQ ID NO: 323381 - DNA, 20 bp, Artificial Sequence
  chemically synthesized
tgatgtgcttgggattccaa

SEQ ID NO: 323382 - DNA, 20 bp, Artificial Sequence
  chemically synthesized
aatctgactgttggaatccc

SEQ ID NO: 323383 - DNA, 20 bp, Artificial Sequence
  chemically synthesized
ttagttactatgatgtgctt

SEQ ID NO: 323384 - DNA, 20 bp, Artificial Sequence
  chemically synthesized
tttagttactatgatgtgct

SEQ ID NO: 323385 - DNA, 20 bp, Artificial Sequence
  chemically synthesized
ttggaatcccaagcacatca

SEQ ID NO: 323386 - DNA, 20 bp, Artificial Sequence
  chemically synthesized
atccttgtattttggaaatt

SEQ ID NO: 323387 - DNA, 20 bp, Artificial Sequence
  chemically synthesized
taactaaatttccaaaatac

SEQ ID NO: 323388 - DNA, 20 bp, Artificial Sequence
  chemically synthesized
aactaaatttccaaaataca

SEQ ID NO: 323389 - DNA, 20 bp, Artificial Sequence
  chemically synthesized
tctcttacatccttgtattt

SEQ ID NO: 323390 - DNA, 20 bp, Artificial Sequence
  chemically synthesized
tttccaaaatacaaggatgt

SEQ ID NO: 323391 - DNA, 20 bp, Artificial Sequence
  chemically synthesized
tccaaaatacaaggatgtaa

SEQ ID NO: 323392 - DNA, 20 bp, Artificial Sequence
  chemically synthesized
caaaatacaaggatgtaaga

SEQ ID NO: 323393 - DNA, 20 bp, Artificial Sequence
  chemically synthesized
aaggatgtaagagagtaatt

SEQ ID NO: 323394 - DNA, 20 bp, Artificial Sequence
  chemically synthesized
aggatgtaagagagtaattg

SEQ ID NO: 323395 - DNA, 20 bp, Artificial Sequence
  chemically synthesized
taagagagtaattgaggaaa

SEQ ID NO: 323396 - DNA, 20 bp, Artificial Sequence
  chemically synthesized
aagagagtaattgaggaaaa

SEQ ID NO: 323397 - DNA, 20 bp, Artificial Sequence
  chemically synthesized
atatgacttgttataatggc

SEQ ID NO: 323398 - DNA, 20 bp, Artificial Sequence
  chemically synthesized
ggatgacttgccattataac

SEQ ID NO: 323399 - DNA, 20 bp, Artificial Sequence
  chemically synthesized
aaacatatgacttgttataa

SEQ ID NO: 323400 - DNA, 20 bp, Artificial Sequence
  chemically synthesized
tgttttgtaaattaacgttt

SEQ ID NO: 323401 - DNA, 20 bp, Artificial Sequence
  chemically synthesized
aacgttttagtttacctcat

SEQ ID NO: 323402 - DNA, 20 bp, Artificial Sequence
  chemically synthesized
agaccagtttcatactcatg

SEQ ID NO: 323403 - DNA, 20 bp, Artificial Sequence
  chemically synthesized
aagaccagtttcatactcat

SEQ ID NO: 323404 - DNA, 20 bp, Artificial Sequence
  chemically synthesized
ttacctcatgagtatgaaac

SEQ ID NO: 323405 - DNA, 20 bp, Artificial Sequence
  chemically synthesized
atgtggaagtggtgaaagac

SEQ ID NO: 323406 - DNA, 20 bp, Artificial Sequence
  chemically synthesized
taatgatgtggaagtggtga

SEQ ID NO: 323407 - DNA, 20 bp, Artificial Sequence
  chemically synthesized
gatttctaatgatgtggaag

SEQ ID NO: 323408 - DNA, 20 bp, Artificial Sequence
  chemically synthesized
agagatttctaatgatgtgg

SEQ ID NO: 323409 - DNA, 20 bp, Artificial Sequence
  chemically synthesized
tttcaccacttccacatcat

SEQ ID NO: 323410 - DNA, 20 bp, Artificial Sequence
  chemically synthesized
aggagagatttctaatgatg

SEQ ID NO: 323411 - DNA, 20 bp, Artificial Sequence
  chemically synthesized
acacattgcaagcacaagga

SEQ ID NO: 323412 - DNA, 20 bp, Artificial Sequence
  chemically synthesized
ggacacattgcaagcacaag

SEQ ID NO: 323413 - DNA, 20 bp, Artificial Sequence
  chemically synthesized
gaggacacattgcaagcaca

SEQ ID NO: 323414 - DNA, 20 bp, Artificial Sequence
  chemically synthesized
tgaggacacattgcaagcac

SEQ ID NO: 323415 - DNA, 20 bp, Artificial Sequence
  chemically synthesized
ttctgctgaggacacattgc

SEQ ID NO: 323416 - DNA, 20 bp, Artificial Sequence
  chemically synthesized
ttgtgcttgcaatgtgtcct

SEQ ID NO: 323417 - DNA, 20 bp, Artificial Sequence
  chemically synthesized
tgcttgcaatgtgtcctcag

SEQ ID NO: 323418 - DNA, 20 bp, Artificial Sequence
  chemically synthesized
tgcaatgtgtcctcagcaga

SEQ ID NO: 323419 - DNA, 20 bp, Artificial Sequence
  chemically synthesized
atcgtggcttctttctgctg

SEQ ID NO: 323420 - DNA, 20 bp, Artificial Sequence
  chemically synthesized
tatcgtggcttctttctgct

SEQ ID NO: 323421 - DNA, 20 bp, Artificial Sequence
  chemically synthesized
aatgtgtcctcagcagaaag

SEQ ID NO: 323422 - DNA, 20 bp, Artificial Sequence
  chemically synthesized
ctttagaagaagtattatcg

SEQ ID NO: 323423 - DNA, 20 bp, Artificial Sequence
  chemically synthesized
ccacgataatacttcttcta

SEQ ID NO: 323424 - DNA, 20 bp, Artificial Sequence
  chemically synthesized
ttatcaaacagctttagaag

SEQ ID NO: 323425 - DNA, 20 bp, Artificial Sequence
  chemically synthesized
ccgttatcaaacagctttag

SEQ ID NO: 323426 - DNA, 20 bp, Artificial Sequence
  chemically synthesized
ggaccgttatcaaacagctt

SEQ ID NO: 323427 - DNA, 20 bp, Artificial Sequence
  chemically synthesized
aaacctggaccgttatcaaa

SEQ ID NO: 323428 - DNA, 20 bp, Artificial Sequence
  chemically synthesized
cttctaaagctgtttgataa

SEQ ID NO: 323429 - DNA, 20 bp, Artificial Sequence
  chemically synthesized
aaagctgtttgataacggtc

SEQ ID NO: 323430 - DNA, 20 bp, Artificial Sequence
  chemically synthesized
aagctgtttgataacggtcc

SEQ ID NO: 323431 - DNA, 20 bp, Artificial Sequence
  chemically synthesized
gatggagagtgaagtaaacc

SEQ ID NO: 323432 - DNA, 20 bp, Artificial Sequence
  chemically synthesized
cagttcattgatggagagtg

SEQ ID NO: 323433 - DNA, 20 bp, Artificial Sequence
  chemically synthesized
tttggcagttcattgatgga

SEQ ID NO: 323434 - DNA, 20 bp, Artificial Sequence
  chemically synthesized
catttggcagttcattgatg

SEQ ID NO: 323435 - DNA, 20 bp, Artificial Sequence
  chemically synthesized
gtcatttggcagttcattga

SEQ ID NO: 323436 - DNA, 20 bp, Artificial Sequence
  chemically synthesized
cctgaagacaagtcatttgg

SEQ ID NO: 323437 - DNA, 20 bp, Artificial Sequence
  chemically synthesized
gctcctgaagacaagtcatt

SEQ ID NO: 323438 - DNA, 20 bp, Artificial Sequence
  chemically synthesized
actgccaaatgacttgtctt

SEQ ID NO: 323439 - DNA, 20 bp, Artificial Sequence
  chemically synthesized
ctgccaaatgacttgtcttc

SEQ ID NO: 323440 - DNA, 20 bp, Artificial Sequence
  chemically synthesized
atttggaagctcctgaagac

SEQ ID NO: 323441 - DNA, 20 bp, Artificial Sequence
  chemically synthesized
gccaaatgacttgtcttcag

SEQ ID NO: 323442 - DNA, 20 bp, Artificial Sequence
  chemically synthesized
gcagcatttggaagctcctg

SEQ ID NO: 323443 - DNA, 20 bp, Artificial Sequence
  chemically synthesized
ttttattgtgcagcatttgg

SEQ ID NO: 323444 - DNA, 20 bp, Artificial Sequence
  chemically synthesized
ttattttattgtgcagcatt

SEQ ID NO: 323445 - DNA, 20 bp, Artificial Sequence
  chemically synthesized
acccaatttattttattgtg

SEQ ID NO: 323446 - DNA, 20 bp, Artificial Sequence
  chemically synthesized
tgctgcacaataaaataaat

SEQ ID NO: 323447 - DNA, 20 bp, Artificial Sequence
  chemically synthesized
gctgcacaataaaataaatt

SEQ ID NO: 323448 - DNA, 20 bp, Artificial Sequence
  chemically synthesized
ttacacaattaatgtctttg

SEQ ID NO: 323449 - DNA, 20 bp, Artificial Sequence
  chemically synthesized
atgtactggaacaatctgca

SEQ ID NO: 323450 - DNA, 20 bp, Artificial Sequence
  chemically synthesized
aatgtctttgcagattgttc

SEQ ID NO: 323451 - DNA, 20 bp, Artificial Sequence
  chemically synthesized
cgattcatcatttaatgtac

SEQ ID NO: 323452 - DNA, 20 bp, Artificial Sequence
  chemically synthesized
gaatgaaatatttaaaatgc

SEQ ID NO: 323453 - DNA, 20 bp, Artificial Sequence
  chemically synthesized
aatgaaatatttaaaatgct

SEQ ID NO: 323454 - DNA, 20 bp, Artificial Sequence
  chemically synthesized
ataatgccagtggacagtcc

SEQ ID NO: 323455 - DNA, 20 bp, Artificial Sequence
  chemically synthesized
aaaatgctaggactgtccac

SEQ ID NO: 323456 - DNA, 20 bp, Artificial Sequence
  chemically synthesized
tgtttgataatgccagtgga

SEQ ID NO: 323457 - DNA, 20 bp, Artificial Sequence
  chemically synthesized
cctgtgtttgataatgccag

SEQ ID NO: 323458 - DNA, 20 bp, Artificial Sequence
  chemically synthesized
gttcctgtgtttgataatgc

SEQ ID NO: 323459 - DNA, 20 bp, Artificial Sequence
  chemically synthesized
tccactggcattatcaaaca

SEQ ID NO: 323460 - DNA, 20 bp, Artificial Sequence
  chemically synthesized
ccactggcattatcaaacac

SEQ ID NO: 323461 - DNA, 20 bp, Artificial Sequence
  chemically synthesized
ggcattatcaaacacaggaa

SEQ ID NO: 323462 - DNA, 20 bp, Artificial Sequence
  chemically synthesized
attatcaaacacaggaacag

SEQ ID NO: 323463 - DNA, 20 bp, Artificial Sequence
  chemically synthesized
aaacacaggaacagcagata

SEQ ID NO: 323464 - DNA, 20 bp, Artificial Sequence
  chemically synthesized
ggaacagcagatacagacaa

SEQ ID NO: 323465 - DNA, 20 bp, Artificial Sequence
  chemically synthesized
gaacagcagatacagacaat

SEQ ID NO: 323466 - DNA, 20 bp, Artificial Sequence
  chemically synthesized
aacagcagatacagacaata

SEQ ID NO: 323467 - DNA, 20 bp, Artificial Sequence
  chemically synthesized
cagcagatacagacaatagg

SEQ ID NO: 323468 - DNA, 20 bp, Artificial Sequence
  chemically synthesized
aaattgatgtatgcatgagg

SEQ ID NO: 323469 - DNA, 20 bp, Artificial Sequence
  chemically synthesized
tgaaaattgatgtatgcatg

SEQ ID NO: 323470 - DNA, 20 bp, Artificial Sequence
  chemically synthesized
ttgaaaattgatgtatgcat

SEQ ID NO: 323471 - DNA, 20 bp, Artificial Sequence
  chemically synthesized
tgcatacatcaattttcaaa

SEQ ID NO: 323472 - DNA, 20 bp, Artificial Sequence
  chemically synthesized
atacatcaattttcaaatag

SEQ ID NO: 323473 - DNA, 20 bp, Artificial Sequence
  chemically synthesized
aatacaatattaatttggtg

SEQ ID NO: 323474 - DNA, 20 bp, Artificial Sequence
  chemically synthesized
gctttaatacaatattaatt

SEQ ID NO: 323475 - DNA, 20 bp, Artificial Sequence
  chemically synthesized
accaaattaatattgtatta

SEQ ID NO: 323476 - DNA, 20 bp, Artificial Sequence
  chemically synthesized
atattgtattaaagctcttc

SEQ ID NO: 323477 - DNA, 20 bp, Artificial Sequence
  chemically synthesized
ctccttccagtaatctagaa

SEQ ID NO: 323478 - DNA, 20 bp, Artificial Sequence
  chemically synthesized
tactccttccagtaatctag

SEQ ID NO: 323479 - DNA, 20 bp, Artificial Sequence
  chemically synthesized
ttaaagctcttctagattac

SEQ ID NO: 323480 - DNA, 20 bp, Artificial Sequence
  chemically synthesized
atttactccttccagtaatc

SEQ ID NO: 323481 - DNA, 20 bp, Artificial Sequence
  chemically synthesized
aagctcttctagattactgg

SEQ ID NO: 323482 - DNA, 20 bp, Artificial Sequence
  chemically synthesized
agctcttctagattactgga

SEQ ID NO: 323483 - DNA, 20 bp, Artificial Sequence
  chemically synthesized
ctcttctagattactggaag

SEQ ID NO: 323484 - DNA, 20 bp, Artificial Sequence
  chemically synthesized
atatactaatttactccttc

SEQ ID NO: 323485 - DNA, 20 bp, Artificial Sequence
  chemically synthesized
gattactggaaggagtaaat

SEQ ID NO: 323486 - DNA, 20 bp, Artificial Sequence
  chemically synthesized
agcatttaaaaagcaacatg

SEQ ID NO: 323487 - DNA, 20 bp, Artificial Sequence
  chemically synthesized
tagcatttaaaaagcaacat

SEQ ID NO: 323488 - DNA, 20 bp, Artificial Sequence
  chemically synthesized
caatatttatagcatttaaa

SEQ ID NO: 323489 - DNA, 20 bp, Artificial Sequence
  chemically synthesized
ttcctacagatcaatattta

SEQ ID NO: 323490 - DNA, 20 bp, Artificial Sequence
  chemically synthesized
atgctataaatattgatctg

SEQ ID NO: 323491 - DNA, 20 bp, Artificial Sequence
  chemically synthesized
tgctataaatattgatctgt

SEQ ID NO: 323492 - DNA, 20 bp, Artificial Sequence
  chemically synthesized
agaaatgaggaaagttccta

SEQ ID NO: 323493 - DNA, 20 bp, Artificial Sequence
  chemically synthesized
ttataaataagaaatgagga

SEQ ID NO: 323494 - DNA, 20 bp, Artificial Sequence
  chemically synthesized
gttattataaataagaaatg

SEQ ID NO: 323495 - DNA, 20 bp, Artificial Sequence
  chemically synthesized
agttattataaataagaaat

SEQ ID NO: 323496 - DNA, 20 bp, Artificial Sequence
  chemically synthesized
atatgtaagttattataaat

SEQ ID NO: 323497 - DNA, 20 bp, Artificial Sequence
  chemically synthesized
aattctgataatgtatatgt

SEQ ID NO: 323498 - DNA, 20 bp, Artificial Sequence
  chemically synthesized
ataacttacatatacattat

SEQ ID NO: 323499 - DNA, 20 bp, Artificial Sequence
  chemically synthesized
atatttacatacctctgcaa

SEQ ID NO: 323500 - DNA, 20 bp, Artificial Sequence
  chemically synthesized
ttcctttaatgccattgcag

SEQ ID NO: 323501 - DNA, 20 bp, Artificial Sequence
  chemically synthesized
tttcctttaatgccattgca

SEQ ID NO: 323502 - DNA, 20 bp, Artificial Sequence
  chemically synthesized
tatttcctttaatgccattg

SEQ ID NO: 323503 - DNA, 20 bp, Artificial Sequence
  chemically synthesized
atacctctgcaatggcatta

SEQ ID NO: 323504 - DNA, 20 bp, Artificial Sequence
  chemically synthesized
tacctctgcaatggcattaa

SEQ ID NO: 323505 - DNA, 20 bp, Artificial Sequence
  chemically synthesized
taaaggaaatatctcttcct

SEQ ID NO: 323506 - DNA, 20 bp, Artificial Sequence
  chemically synthesized
aaggaaatatctcttcctga

SEQ ID NO: 323507 - DNA, 20 bp, Artificial Sequence
  chemically synthesized
tacctagggcctctcaggaa

SEQ ID NO: 323508 - DNA, 20 bp, Artificial Sequence
  chemically synthesized
aggaaatatctcttcctgag

SEQ ID NO: 323509 - DNA, 20 bp, Artificial Sequence
  chemically synthesized
attacctagggcctctcagg

SEQ ID NO: 323510 - DNA, 20 bp, Artificial Sequence
  chemically synthesized
ttcattacctagggcctctc

SEQ ID NO: 323511 - DNA, 20 bp, Artificial Sequence
  chemically synthesized
tttcattacctagggcctct

SEQ ID NO: 323512 - DNA, 20 bp, Artificial Sequence
  chemically synthesized
tatctcttcctgagaggccc

SEQ ID NO: 323513 - DNA, 20 bp, Artificial Sequence
  chemically synthesized
atctcttcctgagaggccct

SEQ ID NO: 323514 - DNA, 20 bp, Artificial Sequence
  chemically synthesized
tggaaatatttcattaccta

SEQ ID NO: 323515 - DNA, 20 bp, Artificial Sequence
  chemically synthesized
ttggaaatatttcattacct

SEQ ID NO: 323516 - DNA, 20 bp, Artificial Sequence
  chemically synthesized
tttggaaatatttcattacc

SEQ ID NO: 323517 - DNA, 20 bp, Artificial Sequence
  chemically synthesized
tttactggtctgtaaatatt

SEQ ID NO: 323518 - DNA, 20 bp, Artificial Sequence
  chemically synthesized
gaaatatttccaaatattta

SEQ ID NO: 323519 - DNA, 20 bp, Artificial Sequence
  chemically synthesized
atttccaaatatttacagac

SEQ ID NO: 323520 - DNA, 20 bp, Artificial Sequence
  chemically synthesized
caaatatttacagaccagta

SEQ ID NO: 323521 - DNA, 20 bp, Artificial Sequence
  chemically synthesized
aaatatttacagaccagtaa

SEQ ID NO: 323522 - DNA, 20 bp, Artificial Sequence
  chemically synthesized
tttcttactgatgcctttac

SEQ ID NO: 323523 - DNA, 20 bp, Artificial Sequence
  chemically synthesized
ttacagaccagtaaaggcat

SEQ ID NO: 323524 - DNA, 20 bp, Artificial Sequence
  chemically synthesized
agaccagtaaaggcatcagt

SEQ ID NO: 323525 - DNA, 20 bp, Artificial Sequence
  chemically synthesized
aaaggcatcagtaagaaaac

SEQ ID NO: 323526 - DNA, 20 bp, Artificial Sequence
  chemically synthesized
aaggcatcagtaagaaaaca

SEQ ID NO: 323527 - DNA, 20 bp, Artificial Sequence
  chemically synthesized
ggcatcagtaagaaaacaag

SEQ ID NO: 323528 - DNA, 20 bp, Artificial Sequence
  chemically synthesized
gcatcagtaagaaaacaagg

SEQ ID NO: 323529 - DNA, 20 bp, Artificial Sequence
  chemically synthesized
tcagtaagaaaacaaggagg

SEQ ID NO: 323530 - DNA, 20 bp, Artificial Sequence
  chemically synthesized
cagtaagaaaacaaggaggt

SEQ ID NO: 323531 - DNA, 20 bp, Artificial Sequence
  chemically synthesized
agtaagaaaacaaggaggta

SEQ ID NO: 323532 - DNA, 20 bp, Artificial Sequence
  chemically synthesized
gtaagaaaacaaggaggtag

SEQ ID NO: 323533 - DNA, 20 bp, Artificial Sequence
  chemically synthesized
gaaaacaaggaggtagggga

SEQ ID NO: 323534 - DNA, 20 bp, Artificial Sequence
  chemically synthesized
aaaacaaggaggtaggggaa

SEQ ID NO: 323535 - DNA, 20 bp, Artificial Sequence
  chemically synthesized
acaaggaggtaggggaaagg

SEQ ID NO: 323536 - DNA, 20 bp, Artificial Sequence
  chemically synthesized
caaggaggtaggggaaagga

SEQ ID NO: 323537 - DNA, 20 bp, Artificial Sequence
  chemically synthesized
ggggaaaggaaggcaaaatt

SEQ ID NO: 323538 - DNA, 20 bp, Artificial Sequence
  chemically synthesized
aaaggaaggcaaaatttaga

SEQ ID NO: 323539 - DNA, 20 bp, Artificial Sequence
  chemically synthesized
aaattttagatgggtgggtg

SEQ ID NO: 323540 - DNA, 20 bp, Artificial Sequence
  chemically synthesized
gaaattttagatgggtgggt

SEQ ID NO: 323541 - DNA, 20 bp, Artificial Sequence
  chemically synthesized
gttagaaattttagatgggt

SEQ ID NO: 323542 - DNA, 20 bp, Artificial Sequence
  chemically synthesized
tgttagaaattttagatggg

SEQ ID NO: 323543 - DNA, 20 bp, Artificial Sequence
  chemically synthesized
tgctgttagaaattttagat

SEQ ID NO: 323544 - DNA, 20 bp, Artificial Sequence
  chemically synthesized
atgctgttagaaattttaga

SEQ ID NO: 323545 - DNA, 20 bp, Artificial Sequence
  chemically synthesized
cattatgctgttagaaattt

SEQ ID NO: 323546 - DNA, 20 bp, Artificial Sequence
  chemically synthesized
cacccatctaaaatttctaa

SEQ ID NO: 323547 - DNA, 20 bp, Artificial Sequence
  chemically synthesized
cacagaagtcattatgctgt

SEQ ID NO: 323548 - DNA, 20 bp, Artificial Sequence
  chemically synthesized
aaataaaggctaaatcacag

SEQ ID NO: 323549 - DNA, 20 bp, Artificial Sequence
  chemically synthesized
gcataatgacttctgtgatt

SEQ ID NO: 323550 - DNA, 20 bp, Artificial Sequence
  chemically synthesized
tggaaataaaggctaaatca

SEQ ID NO: 323551 - DNA, 20 bp, Artificial Sequence
  chemically synthesized
tgtgatttagcctttatttc

SEQ ID NO: 323552 - DNA, 20 bp, Artificial Sequence
  chemically synthesized
tcgtggccttctggaaataa

SEQ ID NO: 323553 - DNA, 20 bp, Artificial Sequence
  chemically synthesized
atcgtggccttctggaaata

SEQ ID NO: 323554 - DNA, 20 bp, Artificial Sequence
  chemically synthesized
gatttagcctttatttccag

SEQ ID NO: 323555 - DNA, 20 bp, Artificial Sequence
  chemically synthesized
atttagcctttatttccaga

SEQ ID NO: 323556 - DNA, 20 bp, Artificial Sequence
  chemically synthesized
ctatttaaatcgtggccttc

SEQ ID NO: 323557 - DNA, 20 bp, Artificial Sequence
  chemically synthesized
atgtcttactatttaaatcg

SEQ ID NO: 323558 - DNA, 20 bp, Artificial Sequence
  chemically synthesized
ccagaaggccacgatttaaa

SEQ ID NO: 323559 - DNA, 20 bp, Artificial Sequence
  chemically synthesized
aaggccacgatttaaatagt

SEQ ID NO: 323560 - DNA, 20 bp, Artificial Sequence
  chemically synthesized
taaatagtaagacattatct

SEQ ID NO: 323561 - DNA, 20 bp, Artificial Sequence
  chemically synthesized
atagtaagacattatcttag

SEQ ID NO: 323562 - DNA, 20 bp, Artificial Sequence
  chemically synthesized
cttcatattttagttcttct

SEQ ID NO: 323563 - DNA, 20 bp, Artificial Sequence
  chemically synthesized
cttagaagaactaaaatatg

SEQ ID NO: 323564 - DNA, 20 bp, Artificial Sequence
  chemically synthesized
gtaaagcatacttcatattt

SEQ ID NO: 323565 - DNA, 20 bp, Artificial Sequence
  chemically synthesized
cctgctaattaaattgggta

SEQ ID NO: 323566 - DNA, 20 bp, Artificial Sequence
  chemically synthesized
aatatcctgctaattaaatt

SEQ ID NO: 323567 - DNA, 20 bp, Artificial Sequence
  chemically synthesized
tatgctttacccaatttaat

SEQ ID NO: 323568 - DNA, 20 bp, Artificial Sequence
  chemically synthesized
taatatcctgctaattaaat

SEQ ID NO: 323569 - DNA, 20 bp, Artificial Sequence
  chemically synthesized
gctttacccaatttaattag

SEQ ID NO: 323570 - DNA, 20 bp, Artificial Sequence
  chemically synthesized
ctttacccaatttaattagc

SEQ ID NO: 323571 - DNA, 20 bp, Artificial Sequence
  chemically synthesized
aatttaattagcaggatatt

SEQ ID NO: 323572 - DNA, 20 bp, Artificial Sequence
  chemically synthesized
taattagcaggatattaagt

SEQ ID NO: 323573 - DNA, 20 bp, Artificial Sequence
  chemically synthesized
atattaagtgagaatgcaaa

SEQ ID NO: 323574 - DNA, 20 bp, Artificial Sequence
  chemically synthesized
gagaatgcaaatggttgtct

SEQ ID NO: 323575 - DNA, 20 bp, Artificial Sequence
  chemically synthesized
agggtccagacggaaattcc

SEQ ID NO: 323576 - DNA, 20 bp, Artificial Sequence
  chemically synthesized
gttgtcttggaatttccgtc

SEQ ID NO: 323577 - DNA, 20 bp, Artificial Sequence
  chemically synthesized
tcttggctttagggtccaga

SEQ ID NO: 323578 - DNA, 20 bp, Artificial Sequence
  chemically synthesized
gaatttccgtctggacccta

SEQ ID NO: 323579 - DNA, 20 bp, Artificial Sequence
  chemically synthesized
ttgctcttggctttagggtc

SEQ ID NO: 323580 - DNA, 20 bp, Artificial Sequence
  chemically synthesized
tccgtctggaccctaaagcc

SEQ ID NO: 323581 - DNA, 20 bp, Artificial Sequence
  chemically synthesized
acactttgctcttggcttta

SEQ ID NO: 323582 - DNA, 20 bp, Artificial Sequence
  chemically synthesized
tacactttgctcttggcttt

SEQ ID NO: 323583 - DNA, 20 bp, Artificial Sequence
  chemically synthesized
cgtctggaccctaaagccaa

SEQ ID NO: 323584 - DNA, 20 bp, Artificial Sequence
  chemically synthesized
gtacactttgctcttggctt

SEQ ID NO: 323585 - DNA, 20 bp, Artificial Sequence
  chemically synthesized
ggaccctaaagccaagagca

SEQ ID NO: 323586 - DNA, 20 bp, Artificial Sequence
  chemically synthesized
tgcttcgtacactttgctct

SEQ ID NO: 323587 - DNA, 20 bp, Artificial Sequence
  chemically synthesized
agccaagagcaaagtgtacg

SEQ ID NO: 323588 - DNA, 20 bp, Artificial Sequence
  chemically synthesized
ggatcttctctttagaatta

SEQ ID NO: 323589 - DNA, 20 bp, Artificial Sequence
  chemically synthesized
acgaagcatccataattcta

SEQ ID NO: 323590 - DNA, 20 bp, Artificial Sequence
  chemically synthesized
gaagcatccataattctaaa

SEQ ID NO: 323591 - DNA, 20 bp, Artificial Sequence
  chemically synthesized
gcatccataattctaaagag

SEQ ID NO: 323592 - DNA, 20 bp, Artificial Sequence
  chemically synthesized
ggtaccctggatcttctctt

SEQ ID NO: 323593 - DNA, 20 bp, Artificial Sequence
  chemically synthesized
ataattctaaagagaagatc

SEQ ID NO: 323594 - DNA, 20 bp, Artificial Sequence
  chemically synthesized
taattctaaagagaagatcc

SEQ ID NO: 323595 - DNA, 20 bp, Artificial Sequence
  chemically synthesized
aattctaaagagaagatcca

SEQ ID NO: 323596 - DNA, 20 bp, Artificial Sequence
  chemically synthesized
caattttttaacaggtaccc

SEQ ID NO: 323597 - DNA, 20 bp, Artificial Sequence
  chemically synthesized
cttcttagcaattttttaac

SEQ ID NO: 323598 - DNA, 20 bp, Artificial Sequence
  chemically synthesized
acttcttagcaattttttaa

SEQ ID NO: 323599 - DNA, 20 bp, Artificial Sequence
  chemically synthesized
gtacctgttaaaaaattgct

SEQ ID NO: 323600 - DNA, 20 bp, Artificial Sequence
  chemically synthesized
cctgttaaaaaattgctaag

SEQ ID NO: 323601 - DNA, 20 bp, Artificial Sequence
  chemically synthesized
ccaattttgtgatcacttct

SEQ ID NO: 323602 - DNA, 20 bp, Artificial Sequence
  chemically synthesized
ctaagaagtgatcacaaaat

SEQ ID NO: 323603 - DNA, 20 bp, Artificial Sequence
  chemically synthesized
gatattggattaagggttgt

SEQ ID NO: 323604 - DNA, 20 bp, Artificial Sequence
  chemically synthesized
taagctagatattggattaa

SEQ ID NO: 323605 - DNA, 20 bp, Artificial Sequence
  chemically synthesized
ttaagctagatattggatta

SEQ ID NO: 323606 - DNA, 20 bp, Artificial Sequence
  chemically synthesized
tttaagctagatattggatt

SEQ ID NO: 323607 - DNA, 20 bp, Artificial Sequence
  chemically synthesized
acaacccttaatccaatatc

SEQ ID NO: 323608 - DNA, 20 bp, Artificial Sequence
  chemically synthesized
cacacctttaagctagatat

SEQ ID NO: 323609 - DNA, 20 bp, Artificial Sequence
  chemically synthesized
ttaatccaatatctagctta

SEQ ID NO: 323610 - DNA, 20 bp, Artificial Sequence
  chemically synthesized
taatccaatatctagcttaa

SEQ ID NO: 323611 - DNA, 20 bp, Artificial Sequence
  chemically synthesized
gctcttacacacctttaagc

SEQ ID NO: 323612 - DNA, 20 bp, Artificial Sequence
  chemically synthesized
gcttgctcttacacaccttt

SEQ ID NO: 323613 - DNA, 20 bp, Artificial Sequence
  chemically synthesized
tatctagcttaaaggtgtgt

SEQ ID NO: 323614 - DNA, 20 bp, Artificial Sequence
  chemically synthesized
tctagcttaaaggtgtgtaa

SEQ ID NO: 323615 - DNA, 20 bp, Artificial Sequence
  chemically synthesized
gcttaaaggtgtgtaagagc

SEQ ID NO: 323616 - DNA, 20 bp, Artificial Sequence
  chemically synthesized
aaaggtgtgtaagagcaagc

SEQ ID NO: 323617 - DNA, 20 bp, Artificial Sequence
  chemically synthesized
aaggtgtgtaagagcaagca

SEQ ID NO: 323618 - DNA, 20 bp, Artificial Sequence
  chemically synthesized
ggtgtgtaagagcaagcaag

SEQ ID NO: 323619 - DNA, 20 bp, Artificial Sequence
  chemically synthesized
gtgtgtaagagcaagcaagg

SEQ ID NO: 323620 - DNA, 20 bp, Artificial Sequence
  chemically synthesized
gagcaagcaaggaggtcgat

SEQ ID NO: 323621 - DNA, 20 bp, Artificial Sequence
  chemically synthesized
ggaggtcgattagaaaaatc

SEQ ID NO: 323622 - DNA, 20 bp, Artificial Sequence
  chemically synthesized
gtcgattagaaaaatctggt

SEQ ID NO: 323623 - DNA, 20 bp, Artificial Sequence
  chemically synthesized
attagaaaaatctggtgaga

SEQ ID NO: 323624 - DNA, 20 bp, Artificial Sequence
  chemically synthesized
ttagaaaaatctggtgagaa

SEQ ID NO: 323625 - DNA, 20 bp, Artificial Sequence
  chemically synthesized
ccagaggaagcctttctcac

SEQ ID NO: 323626 - DNA, 20 bp, Artificial Sequence
  chemically synthesized
ctggtgagaaaggcttcctc

SEQ ID NO: 323627 - DNA, 20 bp, Artificial Sequence
  chemically synthesized
ggtgagaaaggcttcctctg

SEQ ID NO: 323628 - DNA, 20 bp, Artificial Sequence
  chemically synthesized
cgctccagcctctccagagg

SEQ ID NO: 323629 - DNA, 20 bp, Artificial Sequence
  chemically synthesized
tgagaaaggcttcctctgga

SEQ ID NO: 323630 - DNA, 20 bp, Artificial Sequence
  chemically synthesized
gagaaaggcttcctctggag

SEQ ID NO: 323631 - DNA, 20 bp, Artificial Sequence
  chemically synthesized
gagcgctccagcctctccag

SEQ ID NO: 323632 - DNA, 20 bp, Artificial Sequence
  chemically synthesized
agagcgctccagcctctcca

SEQ ID NO: 323633 - DNA, 20 bp, Artificial Sequence
  chemically synthesized
aaggcttcctctggagaggc

SEQ ID NO: 323634 - DNA, 20 bp, Artificial Sequence
  chemically synthesized
gcagagcgctccagcctctc

SEQ ID NO: 323635 - DNA, 20 bp, Artificial Sequence
  chemically synthesized
ggcttcctctggagaggctg

SEQ ID NO: 323636 - DNA, 20 bp, Artificial Sequence
  chemically synthesized
tagagccacgcagagcgctc

SEQ ID NO: 323637 - DNA, 20 bp, Artificial Sequence
  chemically synthesized
agaggctggagcgctctgcg

SEQ ID NO: 323638 - DNA, 20 bp, Artificial Sequence
  chemically synthesized
ggagaagttagagccacgca

SEQ ID NO: 323639 - DNA, 20 bp, Artificial Sequence
  chemically synthesized
ggggagaagttagagccacg

SEQ ID NO: 323640 - DNA, 20 bp, Artificial Sequence
  chemically synthesized
cttcagatggggagaagtta

SEQ ID NO: 323641 - DNA, 20 bp, Artificial Sequence
  chemically synthesized
ggcttcagatggggagaagt

SEQ ID NO: 323642 - DNA, 20 bp, Artificial Sequence
  chemically synthesized
acttggcttcagatggggag

SEQ ID NO: 323643 - DNA, 20 bp, Artificial Sequence
  chemically synthesized
attacttggcttcagatggg

SEQ ID NO: 323644 - DNA, 20 bp, Artificial Sequence
  chemically synthesized
ctctaacttctccccatctg

SEQ ID NO: 323645 - DNA, 20 bp, Artificial Sequence
  chemically synthesized
ctattacttggcttcagatg

SEQ ID NO: 323646 - DNA, 20 bp, Artificial Sequence
  chemically synthesized
tctattacttggcttcagat

SEQ ID NO: 323647 - DNA, 20 bp, Artificial Sequence
  chemically synthesized
ctctattacttggcttcaga

SEQ ID NO: 323648 - DNA, 20 bp, Artificial Sequence
  chemically synthesized
acttctccccatctgaagcc

SEQ ID NO: 323649 - DNA, 20 bp, Artificial Sequence
  chemically synthesized
ccgtctctattacttggctt

SEQ ID NO: 323650 - DNA, 20 bp, Artificial Sequence
  chemically synthesized
ccccatctgaagccaagtaa

SEQ ID NO: 323651 - DNA, 20 bp, Artificial Sequence
  chemically synthesized
ccatctgaagccaagtaata

SEQ ID NO: 323652 - DNA, 20 bp, Artificial Sequence
  chemically synthesized
actaccccgtctctattact

SEQ ID NO: 323653 - DNA, 20 bp, Artificial Sequence
  chemically synthesized
ctgaagccaagtaatagaga

SEQ ID NO: 323654 - DNA, 20 bp, Artificial Sequence
  chemically synthesized
tgaagccaagtaatagagac

SEQ ID NO: 323655 - DNA, 20 bp, Artificial Sequence
  chemically synthesized
gaagccaagtaatagagacg

SEQ ID NO: 323656 - DNA, 20 bp, Artificial Sequence
  chemically synthesized
gccaagtaatagagacgggg

SEQ ID NO: 323657 - DNA, 20 bp, Artificial Sequence
  chemically synthesized
agagacggggtagtttacat

SEQ ID NO: 323658 - DNA, 20 bp, Artificial Sequence
  chemically synthesized
gtttacatgagctgtaaacc

SEQ ID NO: 323659 - DNA, 20 bp, Artificial Sequence
  chemically synthesized
caaacatatggccaggttta

SEQ ID NO: 323660 - DNA, 20 bp, Artificial Sequence
  chemically synthesized
atctctgcaaacatatggcc

SEQ ID NO: 323661 - DNA, 20 bp, Artificial Sequence
  chemically synthesized
aatctctgcaaacatatggc

SEQ ID NO: 323662 - DNA, 20 bp, Artificial Sequence
  chemically synthesized
tgcaaatctctgcaaacata

SEQ ID NO: 323663 - DNA, 20 bp, Artificial Sequence
  chemically synthesized
taaacctggccatatgtttg

SEQ ID NO: 323664 - DNA, 20 bp, Artificial Sequence
  chemically synthesized
aacctggccatatgtttgca

SEQ ID NO: 323665 - DNA, 20 bp, Artificial Sequence
  chemically synthesized
ttgcagagatttgcatgcta

SEQ ID NO: 323666 - DNA, 20 bp, Artificial Sequence
  chemically synthesized
tgcagagatttgcatgctat

SEQ ID NO: 323667 - DNA, 20 bp, Artificial Sequence
  chemically synthesized
acttgagtgtatggttccta

SEQ ID NO: 323668 - DNA, 20 bp, Artificial Sequence
  chemically synthesized
gctataggaaccatacactc

SEQ ID NO: 323669 - DNA, 20 bp, Artificial Sequence
  chemically synthesized
tctcctgtcacttgagtgta

SEQ ID NO: 323670 - DNA, 20 bp, Artificial Sequence
  chemically synthesized
ggaaccatacactcaagtga

SEQ ID NO: 323671 - DNA, 20 bp, Artificial Sequence
  chemically synthesized
gaaccatacactcaagtgac

SEQ ID NO: 323672 - DNA, 20 bp, Artificial Sequence
  chemically synthesized
agaagcctctcctgtcactt

SEQ ID NO: 323673 - DNA, 20 bp, Artificial Sequence
  chemically synthesized
accatacactcaagtgacag

SEQ ID NO: 323674 - DNA, 20 bp, Artificial Sequence
  chemically synthesized
catacactcaagtgacagga

SEQ ID NO: 323675 - DNA, 20 bp, Artificial Sequence
  chemically synthesized
atacactcaagtgacaggag

SEQ ID NO: 323676 - DNA, 20 bp, Artificial Sequence
  chemically synthesized
aagtgacaggagaggcttct

SEQ ID NO: 323677 - DNA, 20 bp, Artificial Sequence
  chemically synthesized
agtgacaggagaggcttctt

SEQ ID NO: 323678 - DNA, 20 bp, Artificial Sequence
  chemically synthesized
gacatgtagtttatcccaag

SEQ ID NO: 323679 - DNA, 20 bp, Artificial Sequence
  chemically synthesized
gcagacatgtagtttatccc

SEQ ID NO: 323680 - DNA, 20 bp, Artificial Sequence
  chemically synthesized
aggttaaagcagcagacatg

SEQ ID NO: 323681 - DNA, 20 bp, Artificial Sequence
  chemically synthesized
atgcctttaggttaaagcag

SEQ ID NO: 323682 - DNA, 20 bp, Artificial Sequence
  chemically synthesized
taaatgcctttaggttaaag

SEQ ID NO: 323683 - DNA, 20 bp, Artificial Sequence
  chemically synthesized
atgtctgctgctttaaccta

SEQ ID NO: 323684 - DNA, 20 bp, Artificial Sequence
  chemically synthesized
tgataaatgcctttaggtta

SEQ ID NO: 323685 - DNA, 20 bp, Artificial Sequence
  chemically synthesized
tgtctgctgctttaacctaa

SEQ ID NO: 323686 - DNA, 20 bp, Artificial Sequence
  chemically synthesized
tgcccttgataaatgccttt

SEQ ID NO: 323687 - DNA, 20 bp, Artificial Sequence
  chemically synthesized
ttgcccttgataaatgcctt

SEQ ID NO: 323688 - DNA, 20 bp, Artificial Sequence
  chemically synthesized
ttaacctaaaggcatttatc

SEQ ID NO: 323689 - DNA, 20 bp, Artificial Sequence
  chemically synthesized
taacctaaaggcatttatca

SEQ ID NO: 323690 - DNA, 20 bp, Artificial Sequence
  chemically synthesized
aacctaaaggcatttatcaa

SEQ ID NO: 323691 - DNA, 20 bp, Artificial Sequence
  chemically synthesized
tttatcaagggcaaaaattt

SEQ ID NO: 323692 - DNA, 20 bp, Artificial Sequence
  chemically synthesized
aaaaatttgagtaaactact

SEQ ID NO: 323693 - DNA, 20 bp, Artificial Sequence
  chemically synthesized
aaaacctcctgcaaacttag

SEQ ID NO: 323694 - DNA, 20 bp, Artificial Sequence
  chemically synthesized
tgagtaaactactaagtttg

SEQ ID NO: 323695 - DNA, 20 bp, Artificial Sequence
  chemically synthesized
gagtaaactactaagtttgc

SEQ ID NO: 323696 - DNA, 20 bp, Artificial Sequence
  chemically synthesized
agcaaaacctcctgcaaact

SEQ ID NO: 323697 - DNA, 20 bp, Artificial Sequence
  chemically synthesized
gtaaactactaagtttgcag

SEQ ID NO: 323698 - DNA, 20 bp, Artificial Sequence
  chemically synthesized
taaactactaagtttgcagg

SEQ ID NO: 323699 - DNA, 20 bp, Artificial Sequence
  chemically synthesized
gtttgcaggaggttttgctt

SEQ ID NO: 323700 - DNA, 20 bp, Artificial Sequence
  chemically synthesized
tttgcaggaggttttgcttt

SEQ ID NO: 323701 - DNA, 20 bp, Artificial Sequence
  chemically synthesized
tgcaggaggttttgctttgg

SEQ ID NO: 323702 - DNA, 20 bp, Artificial Sequence
  chemically synthesized
gcaggaggttttgctttggg

SEQ ID NO: 323703 - DNA, 20 bp, Artificial Sequence
  chemically synthesized
aggaggttttgctttgggag

SEQ ID NO: 323704 - DNA, 20 bp, Artificial Sequence
  chemically synthesized
caaggagtacactcctccca

SEQ ID NO: 323705 - DNA, 20 bp, Artificial Sequence
  chemically synthesized
tgggaggagtgtactccttg

SEQ ID NO: 323706 - DNA, 20 bp, Artificial Sequence
  chemically synthesized
gggaggagtgtactccttgc

SEQ ID NO: 323707 - DNA, 20 bp, Artificial Sequence
  chemically synthesized
gaagcccggcgacctgcaag

SEQ ID NO: 323708 - DNA, 20 bp, Artificial Sequence
  chemically synthesized
ttgaagcccggcgacctgca

SEQ ID NO: 323709 - DNA, 20 bp, Artificial Sequence
  chemically synthesized
tttgaagcccggcgacctgc

SEQ ID NO: 323710 - DNA, 20 bp, Artificial Sequence
  chemically synthesized
gtgtactccttgcaggtcgc

SEQ ID NO: 323711 - DNA, 20 bp, Artificial Sequence
  chemically synthesized
tgtactccttgcaggtcgcc

SEQ ID NO: 323712 - DNA, 20 bp, Artificial Sequence
  chemically synthesized
ttctcaggatttttgaagcc

SEQ ID NO: 323713 - DNA, 20 bp, Artificial Sequence
  chemically synthesized
gcatgttctcaggatttttg

SEQ ID NO: 323714 - DNA, 20 bp, Artificial Sequence
  chemically synthesized
cgccgggcttcaaaaatcct

SEQ ID NO: 323715 - DNA, 20 bp, Artificial Sequence
  chemically synthesized
tccctcttgagcatgttctc

SEQ ID NO: 323716 - DNA, 20 bp, Artificial Sequence
  chemically synthesized
gtccctcttgagcatgttct

SEQ ID NO: 323717 - DNA, 20 bp, Artificial Sequence
  chemically synthesized
aaaatcctgagaacatgctc

SEQ ID NO: 323718 - DNA, 20 bp, Artificial Sequence
  chemically synthesized
aatcctgagaacatgctcaa

SEQ ID NO: 323719 - DNA, 20 bp, Artificial Sequence
  chemically synthesized
atcctgagaacatgctcaag

SEQ ID NO: 323720 - DNA, 20 bp, Artificial Sequence
  chemically synthesized
tcctgagaacatgctcaaga

SEQ ID NO: 323721 - DNA, 20 bp, Artificial Sequence
  chemically synthesized
acctcagcaaagtccctctt

SEQ ID NO: 323722 - DNA, 20 bp, Artificial Sequence
  chemically synthesized
tgctcaagagggactttgct

SEQ ID NO: 323723 - DNA, 20 bp, Artificial Sequence
  chemically synthesized
gctcaagagggactttgctg

SEQ ID NO: 323724 - DNA, 20 bp, Artificial Sequence
  chemically synthesized
ctatgtccttgacctcagca

SEQ ID NO: 323725 - DNA, 20 bp, Artificial Sequence
  chemically synthesized
agagggactttgctgaggtc

SEQ ID NO: 323726 - DNA, 20 bp, Artificial Sequence
  chemically synthesized
gagggactttgctgaggtca

SEQ ID NO: 323727 - DNA, 20 bp, Artificial Sequence
  chemically synthesized
tatgcctatgtccttgacct

SEQ ID NO: 323728 - DNA, 20 bp, Artificial Sequence
  chemically synthesized
ctttgctgaggtcaaggaca

SEQ ID NO: 323729 - DNA, 20 bp, Artificial Sequence
  chemically synthesized
tttgctgaggtcaaggacat

SEQ ID NO: 323730 - DNA, 20 bp, Artificial Sequence
  chemically synthesized
ggacataggcatactattta

SEQ ID NO: 323731 - DNA, 20 bp, Artificial Sequence
  chemically synthesized
acataggcatactatttacg

SEQ ID NO: 323732 - DNA, 20 bp, Artificial Sequence
  chemically synthesized
cataggcatactatttacgg

SEQ ID NO: 323733 - DNA, 20 bp, Artificial Sequence
  chemically synthesized
gttctgctcacctccgtaaa

SEQ ID NO: 323734 - DNA, 20 bp, Artificial Sequence
  chemically synthesized
ggcatactatttacggaggt

SEQ ID NO: 323735 - DNA, 20 bp, Artificial Sequence
  chemically synthesized
atactatttacggaggtgag

SEQ ID NO: 323736 - DNA, 20 bp, Artificial Sequence
  chemically synthesized
tgagcagaacaaacaaatat

SEQ ID NO: 323737 - DNA, 20 bp, Artificial Sequence
  chemically synthesized
agcagaacaaacaaatattg

SEQ ID NO: 323738 - DNA, 20 bp, Artificial Sequence
  chemically synthesized
aaatattggagaaatatttg

SEQ ID NO: 323739 - DNA, 20 bp, Artificial Sequence
  chemically synthesized
tattggagaaatatttgtag

SEQ ID NO: 323740 - DNA, 20 bp, Artificial Sequence
  chemically synthesized
gcaatatttgtggaatgcag

SEQ ID NO: 323741 - DNA, 20 bp, Artificial Sequence
  chemically synthesized
cttgcaatatttgtggaatg

SEQ ID NO: 323742 - DNA, 20 bp, Artificial Sequence
  chemically synthesized
gtgcttgcttgcaatatttg

SEQ ID NO: 323743 - DNA, 20 bp, Artificial Sequence
  chemically synthesized
ctgcattccacaaatattgc

SEQ ID NO: 323744 - DNA, 20 bp, Artificial Sequence
  chemically synthesized
attccacaaatattgcaagc

SEQ ID NO: 323745 - DNA, 20 bp, Artificial Sequence
  chemically synthesized
acaaatattgcaagcaagca

SEQ ID NO: 323746 - DNA, 20 bp, Artificial Sequence
  chemically synthesized
caaatattgcaagcaagcac

SEQ ID NO: 323747 - DNA, 20 bp, Artificial Sequence
  chemically synthesized
aaatattgcaagcaagcacg

SEQ ID NO: 323748 - DNA, 20 bp, Artificial Sequence
  chemically synthesized
acaaaaccctgtttgttagg

SEQ ID NO: 323749 - DNA, 20 bp, Artificial Sequence
  chemically synthesized
tacaaaaccctgtttgttag

SEQ ID NO: 323750 - DNA, 20 bp, Artificial Sequence
  chemically synthesized
gcacggggccccctaacaaa

SEQ ID NO: 323751 - DNA, 20 bp, Artificial Sequence
  chemically synthesized
ttacaaaaccctgtttgtta

SEQ ID NO: 323752 - DNA, 20 bp, Artificial Sequence
  chemically synthesized
cacggggccccctaacaaac

SEQ ID NO: 323753 - DNA, 20 bp, Artificial Sequence
  chemically synthesized
tttacaaaaccctgtttgtt

SEQ ID NO: 323754 - DNA, 20 bp, Artificial Sequence
  chemically synthesized
acggggccccctaacaaaca

SEQ ID NO: 323755 - DNA, 20 bp, Artificial Sequence
  chemically synthesized
ctttacaaaaccctgtttgt

SEQ ID NO: 323756 - DNA, 20 bp, Artificial Sequence
  chemically synthesized
ctaacaaacagggttttgta

SEQ ID NO: 323757 - DNA, 20 bp, Artificial Sequence
  chemically synthesized
taacaaacagggttttgtaa

SEQ ID NO: 323758 - DNA, 20 bp, Artificial Sequence
  chemically synthesized
ggttttgtaaaggaatcaaa

SEQ ID NO: 323759 - DNA, 20 bp, Artificial Sequence
  chemically synthesized
tttgtaaaggaatcaaaaag

SEQ ID NO: 323760 - DNA, 20 bp, Artificial Sequence
  chemically synthesized
aaaggaatcaaaaagcagtg

SEQ ID NO: 323761 - DNA, 20 bp, Artificial Sequence
  chemically synthesized
caaaaagcagtgtagaacaa

SEQ ID NO: 323762 - DNA, 20 bp, Artificial Sequence
  chemically synthesized
aaagcagtgtagaacaacag

SEQ ID NO: 323763 - DNA, 20 bp, Artificial Sequence
  chemically synthesized
gtagaacaacagaagctgtt

SEQ ID NO: 323764 - DNA, 20 bp, Artificial Sequence
  chemically synthesized
tagaacaacagaagctgttt

SEQ ID NO: 323765 - DNA, 20 bp, Artificial Sequence
  chemically synthesized
agaacaacagaagctgtttg

SEQ ID NO: 323766 - DNA, 20 bp, Artificial Sequence
  chemically synthesized
gaacaacagaagctgtttgg

SEQ ID NO: 323767 - DNA, 20 bp, Artificial Sequence
  chemically synthesized
agattatgaaatcccccaaa

SEQ ID NO: 323768 - DNA, 20 bp, Artificial Sequence
  chemically synthesized
ggggatttcataatctcacc

SEQ ID NO: 323769 - DNA, 20 bp, Artificial Sequence
  chemically synthesized
ggatttcataatctcaccca

SEQ ID NO: 323770 - DNA, 20 bp, Artificial Sequence
  chemically synthesized
aggttgaattttctctgggt

SEQ ID NO: 323771 - DNA, 20 bp, Artificial Sequence
  chemically synthesized
ccaaaggttgaattttctct

SEQ ID NO: 323772 - DNA, 20 bp, Artificial Sequence
  chemically synthesized
accaaaggttgaattttctc

SEQ ID NO: 323773 - DNA, 20 bp, Artificial Sequence
  chemically synthesized
cccagagaaaattcaacctt

SEQ ID NO: 323774 - DNA, 20 bp, Artificial Sequence
  chemically synthesized
agagaaaattcaacctttgg

SEQ ID NO: 323775 - DNA, 20 bp, Artificial Sequence
  chemically synthesized
caccaggggaaagccaccaa

SEQ ID NO: 323776 - DNA, 20 bp, Artificial Sequence
  chemically synthesized
acaccaggggaaagccacca

SEQ ID NO: 323777 - DNA, 20 bp, Artificial Sequence
  chemically synthesized
aacctttggtggctttcccc

SEQ ID NO: 323778 - DNA, 20 bp, Artificial Sequence
  chemically synthesized
agcacatacacaccagggga

SEQ ID NO: 323779 - DNA, 20 bp, Artificial Sequence
  chemically synthesized
atgtagcacatacacaccag

SEQ ID NO: 323780 - DNA, 20 bp, Artificial Sequence
  chemically synthesized
aatgtagcacatacacacca

SEQ ID NO: 323781 - DNA, 20 bp, Artificial Sequence
  chemically synthesized
aaatgtagcacatacacacc

SEQ ID NO: 323782 - DNA, 20 bp, Artificial Sequence
  chemically synthesized
gaaatgtagcacatacacac

SEQ ID NO: 323783 - DNA, 20 bp, Artificial Sequence
  chemically synthesized
actgagaaggacaggaaatg

SEQ ID NO: 323784 - DNA, 20 bp, Artificial Sequence
  chemically synthesized
ttcccagaactgagaaggac

SEQ ID NO: 323785 - DNA, 20 bp, Artificial Sequence
  chemically synthesized
gctacatttcctgtccttct

SEQ ID NO: 323786 - DNA, 20 bp, Artificial Sequence
  chemically synthesized
attcccagaactgagaagga

SEQ ID NO: 323787 - DNA, 20 bp, Artificial Sequence
  chemically synthesized
gttaattcccagaactgaga

SEQ ID NO: 323788 - DNA, 20 bp, Artificial Sequence
  chemically synthesized
ggttaattcccagaactgag

SEQ ID NO: 323789 - DNA, 20 bp, Artificial Sequence
  chemically synthesized
tttcctgtccttctcagttc

SEQ ID NO: 323790 - DNA, 20 bp, Artificial Sequence
  chemically synthesized
ttcctgtccttctcagttct

SEQ ID NO: 323791 - DNA, 20 bp, Artificial Sequence
  chemically synthesized
gtgggttaattcccagaact

SEQ ID NO: 323792 - DNA, 20 bp, Artificial Sequence
  chemically synthesized
cagcttagtgggttaattcc

SEQ ID NO: 323793 - DNA, 20 bp, Artificial Sequence
  chemically synthesized
gttctgggaattaacccact

SEQ ID NO: 323794 - DNA, 20 bp, Artificial Sequence
  chemically synthesized
gttggtgctggcagcttagt

SEQ ID NO: 323795 - DNA, 20 bp, Artificial Sequence
  chemically synthesized
agttggtgctggcagcttag

SEQ ID NO: 323796 - DNA, 20 bp, Artificial Sequence
  chemically synthesized
gaattaacccactaagctgc

SEQ ID NO: 323797 - DNA, 20 bp, Artificial Sequence
  chemically synthesized
gtaagttggtgctggcagct

SEQ ID NO: 323798 - DNA, 20 bp, Artificial Sequence
  chemically synthesized
cacaagtaagttggtgctgg

SEQ ID NO: 323799 - DNA, 20 bp, Artificial Sequence
  chemically synthesized
gagcacaagtaagttggtgc

SEQ ID NO: 323800 - DNA, 20 bp, Artificial Sequence
  chemically synthesized
tcagaagagcacaagtaagt

SEQ ID NO: 323801 - DNA, 20 bp, Artificial Sequence
  chemically synthesized
tttatcagaagagcacaagt

SEQ ID NO: 323802 - DNA, 20 bp, Artificial Sequence
  chemically synthesized
agcatttatcagaagagcac

SEQ ID NO: 323803 - DNA, 20 bp, Artificial Sequence
  chemically synthesized
aatttgagcatttatcagaa

SEQ ID NO: 323804 - DNA, 20 bp, Artificial Sequence
  chemically synthesized
aaaatttgagcatttatcag

SEQ ID NO: 323805 - DNA, 20 bp, Artificial Sequence
  chemically synthesized
ttcaaaatttgagcatttat

SEQ ID NO: 323806 - DNA, 20 bp, Artificial Sequence
  chemically synthesized
atattgaattttcaaaattt

SEQ ID NO: 323807 - DNA, 20 bp, Artificial Sequence
  chemically synthesized
ctcgaaggacttaacagttg

SEQ ID NO: 323808 - DNA, 20 bp, Artificial Sequence
  chemically synthesized
tttaaatttccccaactgtt

SEQ ID NO: 323809 - DNA, 20 bp, Artificial Sequence
  chemically synthesized
tctcgaaggacttaacagtt

SEQ ID NO: 323810 - DNA, 20 bp, Artificial Sequence
  chemically synthesized
atctcgaaggacttaacagt

SEQ ID NO: 323811 - DNA, 20 bp, Artificial Sequence
  chemically synthesized
tgtcatctcgaaggacttaa

SEQ ID NO: 323812 - DNA, 20 bp, Artificial Sequence
  chemically synthesized
ccccaactgttaagtccttc

SEQ ID NO: 323813 - DNA, 20 bp, Artificial Sequence
  chemically synthesized
actatgccttgtcatctcga

SEQ ID NO: 323814 - DNA, 20 bp, Artificial Sequence
  chemically synthesized
cactatgccttgtcatctcg

SEQ ID NO: 323815 - DNA, 20 bp, Artificial Sequence
  chemically synthesized
gttaagtccttcgagatgac

SEQ ID NO: 323816 - DNA, 20 bp, Artificial Sequence
  chemically synthesized
ttaagtccttcgagatgaca

SEQ ID NO: 323817 - DNA, 20 bp, Artificial Sequence
  chemically synthesized
tccttcgagatgacaaggca

SEQ ID NO: 323818 - DNA, 20 bp, Artificial Sequence
  chemically synthesized
ttcgagatgacaaggcatag

SEQ ID NO: 323819 - DNA, 20 bp, Artificial Sequence
  chemically synthesized
gagatgacaaggcatagtgg

SEQ ID NO: 323820 - DNA, 20 bp, Artificial Sequence
  chemically synthesized
caaatgatgcactctttttc

SEQ ID NO: 323821 - DNA, 20 bp, Artificial Sequence
  chemically synthesized
ttttatagaaactggaaaaa

SEQ ID NO: 323822 - DNA, 20 bp, Artificial Sequence
  chemically synthesized
acttttatagaaactggaaa

SEQ ID NO: 323823 - DNA, 20 bp, Artificial Sequence
  chemically synthesized
tctgccacttttatagaaac

SEQ ID NO: 323824 - DNA, 20 bp, Artificial Sequence
  chemically synthesized
tctttttccagtttctataa

SEQ ID NO: 323825 - DNA, 20 bp, Artificial Sequence
  chemically synthesized
ttttccagtttctataaaag

SEQ ID NO: 323826 - DNA, 20 bp, Artificial Sequence
  chemically synthesized
acctttctctgccactttta

SEQ ID NO: 323827 - DNA, 20 bp, Artificial Sequence
  chemically synthesized
tccagtttctataaaagtgg

SEQ ID NO: 323828 - DNA, 20 bp, Artificial Sequence
  chemically synthesized
cagtttctataaaagtggca

SEQ ID NO: 323829 - DNA, 20 bp, Artificial Sequence
  chemically synthesized
ttctataaaagtggcagaga

SEQ ID NO: 323830 - DNA, 20 bp, Artificial Sequence
  chemically synthesized
tctataaaagtggcagagaa

SEQ ID NO: 323831 - DNA, 20 bp, Artificial Sequence
  chemically synthesized
gtggcagagaaaggtcatcc

SEQ ID NO: 323832 - DNA, 20 bp, Artificial Sequence
  chemically synthesized
cagagaaaggtcatcctggt

SEQ ID NO: 323833 - DNA, 20 bp, Artificial Sequence
  chemically synthesized
ttcggtgattttgacttacc

SEQ ID NO: 323834 - DNA, 20 bp, Artificial Sequence
  chemically synthesized
gttcggtgattttgacttac

SEQ ID NO: 323835 - DNA, 20 bp, Artificial Sequence
  chemically synthesized
ctctttgatatgatgaagtt

SEQ ID NO: 323836 - DNA, 20 bp, Artificial Sequence
  chemically synthesized
ttaccctctttgatatgatg

SEQ ID NO: 323837 - DNA, 20 bp, Artificial Sequence
  chemically synthesized
caccgaacttcatcatatca

SEQ ID NO: 323838 - DNA, 20 bp, Artificial Sequence
  chemically synthesized
ccgaacttcatcatatcaaa

SEQ ID NO: 323839 - DNA, 20 bp, Artificial Sequence
  chemically synthesized
cgaacttcatcatatcaaag

SEQ ID NO: 323840 - DNA, 20 bp, Artificial Sequence
  chemically synthesized
gaacttcatcatatcaaaga

SEQ ID NO: 323841 - DNA, 20 bp, Artificial Sequence
  chemically synthesized
ttcatcatatcaaagagggt

SEQ ID NO: 323842 - DNA, 20 bp, Artificial Sequence
  chemically synthesized
aaagagggtaagtgcactga

SEQ ID NO: 323843 - DNA, 20 bp, Artificial Sequence
  chemically synthesized
aagagggtaagtgcactgaa

SEQ ID NO: 323844 - DNA, 20 bp, Artificial Sequence
  chemically synthesized
agagggtaagtgcactgaaa

SEQ ID NO: 323845 - DNA, 20 bp, Artificial Sequence
  chemically synthesized
ttccatgcaaatagcccttt

SEQ ID NO: 323846 - DNA, 20 bp, Artificial Sequence
  chemically synthesized
cactgaaagggctatttgca

SEQ ID NO: 323847 - DNA, 20 bp, Artificial Sequence
  chemically synthesized
agacaagggttccatgcaaa

SEQ ID NO: 323848 - DNA, 20 bp, Artificial Sequence
  chemically synthesized
attgccttactgttagacaa

SEQ ID NO: 323849 - DNA, 20 bp, Artificial Sequence
  chemically synthesized
tgcatggaacccttgtctaa

SEQ ID NO: 323850 - DNA, 20 bp, Artificial Sequence
  chemically synthesized
aattgccttactgttagaca

SEQ ID NO: 323851 - DNA, 20 bp, Artificial Sequence
  chemically synthesized
aaattgccttactgttagac

SEQ ID NO: 323852 - DNA, 20 bp, Artificial Sequence
  chemically synthesized
tggaacccttgtctaacagt

SEQ ID NO: 323853 - DNA, 20 bp, Artificial Sequence
  chemically synthesized
ggaacccttgtctaacagta

SEQ ID NO: 323854 - DNA, 20 bp, Artificial Sequence
  chemically synthesized
ttcagaaattgccttactgt

SEQ ID NO: 323855 - DNA, 20 bp, Artificial Sequence
  chemically synthesized
taacagtaaggcaatttctg

SEQ ID NO: 323856 - DNA, 20 bp, Artificial Sequence
  chemically synthesized
aacagtaaggcaatttctga

SEQ ID NO: 323857 - DNA, 20 bp, Artificial Sequence
  chemically synthesized
aaggcaatttctgaaggtct

SEQ ID NO: 323858 - DNA, 20 bp, Artificial Sequence
  chemically synthesized
gttctaacccctaagacctt

SEQ ID NO: 323859 - DNA, 20 bp, Artificial Sequence
  chemically synthesized
aggcaatttctgaaggtctt

SEQ ID NO: 323860 - DNA, 20 bp, Artificial Sequence
  chemically synthesized
ggcaatttctgaaggtctta

SEQ ID NO: 323861 - DNA, 20 bp, Artificial Sequence
  chemically synthesized
gcaatttctgaaggtcttag

SEQ ID NO: 323862 - DNA, 20 bp, Artificial Sequence
  chemically synthesized
tttctgaaggtcttaggggt

SEQ ID NO: 323863 - DNA, 20 bp, Artificial Sequence
  chemically synthesized
tggaagttgttctaacccct

SEQ ID NO: 323864 - DNA, 20 bp, Artificial Sequence
  chemically synthesized
aggggttagaacaacttcca

SEQ ID NO: 323865 - DNA, 20 bp, Artificial Sequence
  chemically synthesized
acggaagagatacaccatgg

SEQ ID NO: 323866 - DNA, 20 bp, Artificial Sequence
  chemically synthesized
gagacggaagagatacacca

SEQ ID NO: 323867 - DNA, 20 bp, Artificial Sequence
  chemically synthesized
aatagtatttagagacggaa

SEQ ID NO: 323868 - DNA, 20 bp, Artificial Sequence
  chemically synthesized
ttaatagtatttagagacgg

SEQ ID NO: 323869 - DNA, 20 bp, Artificial Sequence
  chemically synthesized
ttattaatagtatttagaga

SEQ ID NO: 323870 - DNA, 20 bp, Artificial Sequence
  chemically synthesized
gttattattaatagtattta

SEQ ID NO: 323871 - DNA, 20 bp, Artificial Sequence
  chemically synthesized
tagttattattaatagtatt

SEQ ID NO: 323872 - DNA, 20 bp, Artificial Sequence
  chemically synthesized
actttgatagttattattaa

SEQ ID NO: 323873 - DNA, 20 bp, Artificial Sequence
  chemically synthesized
actattaataataactatca

SEQ ID NO: 323874 - DNA, 20 bp, Artificial Sequence
  chemically synthesized
ttaataataactatcaaagt

SEQ ID NO: 323875 - DNA, 20 bp, Artificial Sequence
  chemically synthesized
ccccttaatgctgactttga

SEQ ID NO: 323876 - DNA, 20 bp, Artificial Sequence
  chemically synthesized
taactatcaaagtcagcatt

SEQ ID NO: 323877 - DNA, 20 bp, Artificial Sequence
  chemically synthesized
aactatcaaagtcagcatta

SEQ ID NO: 323878 - DNA, 20 bp, Artificial Sequence
  chemically synthesized
actatcaaagtcagcattaa

SEQ ID NO: 323879 - DNA, 20 bp, Artificial Sequence
  chemically synthesized
ctatcaaagtcagcattaag

SEQ ID NO: 323880 - DNA, 20 bp, Artificial Sequence
  chemically synthesized
tatcaaagtcagcattaagg

SEQ ID NO: 323881 - DNA, 20 bp, Artificial Sequence
  chemically synthesized
ttaagggggaaaatgatata

SEQ ID NO: 323882 - DNA, 20 bp, Artificial Sequence
  chemically synthesized
taagggggaaaatgatataa

SEQ ID NO: 323883 - DNA, 20 bp, Artificial Sequence
  chemically synthesized
gggggaaaatgatataaagg

SEQ ID NO: 323884 - DNA, 20 bp, Artificial Sequence
  chemically synthesized
aaatgatataaaggcagcct

SEQ ID NO: 323885 - DNA, 20 bp, Artificial Sequence
  chemically synthesized
atgatataaaggcagcctga

SEQ ID NO: 323886 - DNA, 20 bp, Artificial Sequence
  chemically synthesized
tccacctgcgcacatctctc

SEQ ID NO: 323887 - DNA, 20 bp, Artificial Sequence
  chemically synthesized
ttccacctgcgcacatctct

SEQ ID NO: 323888 - DNA, 20 bp, Artificial Sequence
  chemically synthesized
ggcagcctgagagatgtgcg

SEQ ID NO: 323889 - DNA, 20 bp, Artificial Sequence
  chemically synthesized
gcagcctgagagatgtgcgc

SEQ ID NO: 323890 - DNA, 20 bp, Artificial Sequence
  chemically synthesized
gcctgagagatgtgcgcagg

SEQ ID NO: 323891 - DNA, 20 bp, Artificial Sequence
  chemically synthesized
gagatgtgcgcaggtggaac

SEQ ID NO: 323892 - DNA, 20 bp, Artificial Sequence
  chemically synthesized
aggttgcacaaacgtgaagc

SEQ ID NO: 323893 - DNA, 20 bp, Artificial Sequence
  chemically synthesized
gctcaggttgcacaaacgtg

SEQ ID NO: 323894 - DNA, 20 bp, Artificial Sequence
  chemically synthesized
gcttcacgtttgtgcaacct

SEQ ID NO: 323895 - DNA, 20 bp, Artificial Sequence
  chemically synthesized
tcacgtttgtgcaacctgag

SEQ ID NO: 323896 - DNA, 20 bp, Artificial Sequence
  chemically synthesized
agggccctgtgcaactgctc

SEQ ID NO: 323897 - DNA, 20 bp, Artificial Sequence
  chemically synthesized
cagggccctgtgcaactgct

SEQ ID NO: 323898 - DNA, 20 bp, Artificial Sequence
  chemically synthesized
gtgcaacctgagcagttgca

SEQ ID NO: 323899 - DNA, 20 bp, Artificial Sequence
  chemically synthesized
tgcaacctgagcagttgcac

SEQ ID NO: 323900 - DNA, 20 bp, Artificial Sequence
  chemically synthesized
gcaacctgagcagttgcaca

SEQ ID NO: 323901 - DNA, 20 bp, Artificial Sequence
  chemically synthesized
gagcagttgcacagggccct

SEQ ID NO: 323902 - DNA, 20 bp, Artificial Sequence
  chemically synthesized
gttgcacagggccctgagcg

SEQ ID NO: 323903 - DNA, 20 bp, Artificial Sequence
  chemically synthesized
atgtgtttcttctgcgctca

SEQ ID NO: 323904 - DNA, 20 bp, Artificial Sequence
  chemically synthesized
catgtgtttcttctgcgctc

SEQ ID NO: 323905 - DNA, 20 bp, Artificial Sequence
  chemically synthesized
gcacagggccctgagcgcag

SEQ ID NO: 323906 - DNA, 20 bp, Artificial Sequence
  chemically synthesized
gcatgtgtttcttctgcgct

SEQ ID NO: 323907 - DNA, 20 bp, Artificial Sequence
  chemically synthesized
atagtatcagcagataatag

SEQ ID NO: 323908 - DNA, 20 bp, Artificial Sequence
  chemically synthesized
gatagtatcagcagataata

SEQ ID NO: 323909 - DNA, 20 bp, Artificial Sequence
  chemically synthesized
aggatagtatcagcagataa

SEQ ID NO: 323910 - DNA, 20 bp, Artificial Sequence
  chemically synthesized
caatttcaggatagtatcag

SEQ ID NO: 323911 - DNA, 20 bp, Artificial Sequence
  chemically synthesized
ttacaatttcaggatagtat

SEQ ID NO: 323912 - DNA, 20 bp, Artificial Sequence
  chemically synthesized
aattatttacaatttcagga

SEQ ID NO: 323913 - DNA, 20 bp, Artificial Sequence
  chemically synthesized
ataaaattatttacaatttc

SEQ ID NO: 323914 - DNA, 20 bp, Artificial Sequence
  chemically synthesized
aataaaattatttacaattt

SEQ ID NO: 323915 - DNA, 20 bp, Artificial Sequence
  chemically synthesized
ttatttttgaatttgtgttt

SEQ ID NO: 323916 - DNA, 20 bp, Artificial Sequence
  chemically synthesized
tttttgaatttgtgttttag

SEQ ID NO: 323917 - DNA, 20 bp, Artificial Sequence
  chemically synthesized
gaatttgtgttttagaagtg

SEQ ID NO: 323918 - DNA, 20 bp, Artificial Sequence
  chemically synthesized
gtgcatccttcattgcacat

SEQ ID NO: 323919 - DNA, 20 bp, Artificial Sequence
  chemically synthesized
tgtgcatccttcattgcaca

SEQ ID NO: 323920 - DNA, 20 bp, Artificial Sequence
  chemically synthesized
gtgaagtcctatgtgcaatg

SEQ ID NO: 323921 - DNA, 20 bp, Artificial Sequence
  chemically synthesized
tgaagtcctatgtgcaatga

SEQ ID NO: 323922 - DNA, 20 bp, Artificial Sequence
  chemically synthesized
caatgaaggatgcacatgcg

SEQ ID NO: 323923 - DNA, 20 bp, Artificial Sequence
  chemically synthesized
atgaaggatgcacatgcgca

SEQ ID NO: 323924 - DNA, 20 bp, Artificial Sequence
  chemically synthesized
tgaaggatgcacatgcgcag

SEQ ID NO: 323925 - DNA, 20 bp, Artificial Sequence
  chemically synthesized
aaggatgcacatgcgcagag

SEQ ID NO: 323926 - DNA, 20 bp, Artificial Sequence
  chemically synthesized
atgcacatgcgcagaggaga

SEQ ID NO: 323927 - DNA, 20 bp, Artificial Sequence
  chemically synthesized
tgcacatgcgcagaggagac

SEQ ID NO: 323928 - DNA, 20 bp, Artificial Sequence
  chemically synthesized
acatgcgcagaggagacagg

SEQ ID NO: 323929 - DNA, 20 bp, Artificial Sequence
  chemically synthesized
aatgctatatgcaaatagga

SEQ ID NO: 323930 - DNA, 20 bp, Artificial Sequence
  chemically synthesized
tgaaaatgctatatgcaaat

SEQ ID NO: 323931 - DNA, 20 bp, Artificial Sequence
  chemically synthesized
ttgaaaatgctatatgcaaa

SEQ ID NO: 323932 - DNA, 20 bp, Artificial Sequence
  chemically synthesized
gtatctgtcctatttgcata

SEQ ID NO: 323933 - DNA, 20 bp, Artificial Sequence
  chemically synthesized
atatagcattttcaatgccc

SEQ ID NO: 323934 - DNA, 20 bp, Artificial Sequence
  chemically synthesized
tagcattttcaatgccctag

SEQ ID NO: 323935 - DNA, 20 bp, Artificial Sequence
  chemically synthesized
accagacttctgtgcttcta

SEQ ID NO: 323936 - DNA, 20 bp, Artificial Sequence
  chemically synthesized
ttttcaatgccctagaagca

SEQ ID NO: 323937 - DNA, 20 bp, Artificial Sequence
  chemically synthesized
caccagacttctgtgcttct

SEQ ID NO: 323938 - DNA, 20 bp, Artificial Sequence
  chemically synthesized
tcaccagacttctgtgcttc

SEQ ID NO: 323939 - DNA, 20 bp, Artificial Sequence
  chemically synthesized
tcaatgccctagaagcacag

SEQ ID NO: 323940 - DNA, 20 bp, Artificial Sequence
  chemically synthesized
gccctagaagcacagaagtc

SEQ ID NO: 323941 - DNA, 20 bp, Artificial Sequence
  chemically synthesized
tagaagcacagaagtctggt

SEQ ID NO: 323942 - DNA, 20 bp, Artificial Sequence
  chemically synthesized
taaacttactgtgagctcac

SEQ ID NO: 323943 - DNA, 20 bp, Artificial Sequence
  chemically synthesized
acagaagtctggtgagctca

SEQ ID NO: 323944 - DNA, 20 bp, Artificial Sequence
  chemically synthesized
aagtctggtgagctcacagt

SEQ ID NO: 323945 - DNA, 20 bp, Artificial Sequence
  chemically synthesized
aatcttactaaacttactgt

SEQ ID NO: 323946 - DNA, 20 bp, Artificial Sequence
  chemically synthesized
tggtgagctcacagtaagtt

SEQ ID NO: 323947 - DNA, 20 bp, Artificial Sequence
  chemically synthesized
gagctcacagtaagtttagt

SEQ ID NO: 323948 - DNA, 20 bp, Artificial Sequence
  chemically synthesized
agtaagtttagtaagattca

SEQ ID NO: 323949 - DNA, 20 bp, Artificial Sequence
  chemically synthesized
ttagtaagattcaaagaata

SEQ ID NO: 323950 - DNA, 20 bp, Artificial Sequence
  chemically synthesized
agattcaaagaatatggcgt

SEQ ID NO: 323951 - DNA, 20 bp, Artificial Sequence
  chemically synthesized
agtgtgttatgtctataact

SEQ ID NO: 323952 - DNA, 20 bp, Artificial Sequence
  chemically synthesized
caaccttgtttactcagtta

SEQ ID NO: 323953 - DNA, 20 bp, Artificial Sequence
  chemically synthesized
atgtctataactgagtaaac

SEQ ID NO: 323954 - DNA, 20 bp, Artificial Sequence
  chemically synthesized
tgccagcaaccttgtttact

SEQ ID NO: 323955 - DNA, 20 bp, Artificial Sequence
  chemically synthesized
tgtctataactgagtaaaca

SEQ ID NO: 323956 - DNA, 20 bp, Artificial Sequence
  chemically synthesized
aactgagtaaacaaggttgc

SEQ ID NO: 323957 - DNA, 20 bp, Artificial Sequence
  chemically synthesized
tgagtaaacaaggttgctgg

SEQ ID NO: 323958 - DNA, 20 bp, Artificial Sequence
  chemically synthesized
aacaaggttgctggcagccc

SEQ ID NO: 323959 - DNA, 20 bp, Artificial Sequence
  chemically synthesized
gcattatctcccagggctgc

SEQ ID NO: 323960 - DNA, 20 bp, Artificial Sequence
  chemically synthesized
acaaggttgctggcagccct

SEQ ID NO: 323961 - DNA, 20 bp, Artificial Sequence
  chemically synthesized
aaggttgctggcagccctgg

SEQ ID NO: 323962 - DNA, 20 bp, Artificial Sequence
  chemically synthesized
ataggaagcattatctccca

SEQ ID NO: 323963 - DNA, 20 bp, Artificial Sequence
  chemically synthesized
gataggaagcattatctccc

SEQ ID NO: 323964 - DNA, 20 bp, Artificial Sequence
  chemically synthesized
agataggaagcattatctcc

SEQ ID NO: 323965 - DNA, 20 bp, Artificial Sequence
  chemically synthesized
cagggtctggttcagatagg

SEQ ID NO: 323966 - DNA, 20 bp, Artificial Sequence
  chemically synthesized
aagcagggtctggttcagat

SEQ ID NO: 323967 - DNA, 20 bp, Artificial Sequence
  chemically synthesized
ataatgcttcctatctgaac

SEQ ID NO: 323968 - DNA, 20 bp, Artificial Sequence
  chemically synthesized
gaagcagggtctggttcaga

SEQ ID NO: 323969 - DNA, 20 bp, Artificial Sequence
  chemically synthesized
atttgaagcagggtctggtt

SEQ ID NO: 323970 - DNA, 20 bp, Artificial Sequence
  chemically synthesized
gctgcatttgaagcagggtc

SEQ ID NO: 323971 - DNA, 20 bp, Artificial Sequence
  chemically synthesized
ttcttgctgcatttgaagca

SEQ ID NO: 323972 - DNA, 20 bp, Artificial Sequence
  chemically synthesized
cttcttgctgcatttgaagc

SEQ ID NO: 323973 - DNA, 20 bp, Artificial Sequence
  chemically synthesized
ccttcttgctgcatttgaag

SEQ ID NO: 323974 - DNA, 20 bp, Artificial Sequence
  chemically synthesized
accagaccctgcttcaaatg

SEQ ID NO: 323975 - DNA, 20 bp, Artificial Sequence
  chemically synthesized
ttgccttcttgctgcatttg

SEQ ID NO: 323976 - DNA, 20 bp, Artificial Sequence
  chemically synthesized
gaccctgcttcaaatgcagc

SEQ ID NO: 323977 - DNA, 20 bp, Artificial Sequence
  chemically synthesized
cctgcttcaaatgcagcaag

SEQ ID NO: 323978 - DNA, 20 bp, Artificial Sequence
  chemically synthesized
ctgcttcaaatgcagcaaga

SEQ ID NO: 323979 - DNA, 20 bp, Artificial Sequence
  chemically synthesized
agcaagaaggcaattttttc

SEQ ID NO: 323980 - DNA, 20 bp, Artificial Sequence
  chemically synthesized
tcaagaaaatacaaacgacc

SEQ ID NO: 323981 - DNA, 20 bp, Artificial Sequence
  chemically synthesized
aaggatatgatagggtttct

SEQ ID NO: 323982 - DNA, 20 bp, Artificial Sequence
  chemically synthesized
gagtaggaaaggatatgata

SEQ ID NO: 323983 - DNA, 20 bp, Artificial Sequence
  chemically synthesized
ggagtaggaaaggatatgat

SEQ ID NO: 323984 - DNA, 20 bp, Artificial Sequence
  chemically synthesized
aggagtaggaaaggatatga

SEQ ID NO: 323985 - DNA, 20 bp, Artificial Sequence
  chemically synthesized
gaacataacaggagtaggaa

SEQ ID NO: 323986 - DNA, 20 bp, Artificial Sequence
  chemically synthesized
ggaacataacaggagtagga

SEQ ID NO: 323987 - DNA, 20 bp, Artificial Sequence
  chemically synthesized
tataggaacataacaggagt

SEQ ID NO: 323988 - DNA, 20 bp, Artificial Sequence
  chemically synthesized
atataggaacataacaggag

SEQ ID NO: 323989 - DNA, 20 bp, Artificial Sequence
  chemically synthesized
ttcatataggaacataacag

SEQ ID NO: 323990 - DNA, 20 bp, Artificial Sequence
  chemically synthesized
ggttcatataggaacataac

SEQ ID NO: 323991 - DNA, 20 bp, Artificial Sequence
  chemically synthesized
tggttcatataggaacataa

SEQ ID NO: 323992 - DNA, 20 bp, Artificial Sequence
  chemically synthesized
cataagtggttggttcatat

SEQ ID NO: 323993 - DNA, 20 bp, Artificial Sequence
  chemically synthesized
gcataagtggttggttcata

SEQ ID NO: 323994 - DNA, 20 bp, Artificial Sequence
  chemically synthesized
tcaatttcagcataagtggt

SEQ ID NO: 323995 - DNA, 20 bp, Artificial Sequence
  chemically synthesized
atcatcaatttcagcataag

SEQ ID NO: 323996 - DNA, 20 bp, Artificial Sequence
  chemically synthesized
tatatcatcaatttcagcat

SEQ ID NO: 323997 - DNA, 20 bp, Artificial Sequence
  chemically synthesized
tctttctatatcatcaattt

SEQ ID NO: 323998 - DNA, 20 bp, Artificial Sequence
  chemically synthesized
ttatgctgaaattgatgata

SEQ ID NO: 323999 - DNA, 20 bp, Artificial Sequence
  chemically synthesized
gctgaaattgatgatataga

SEQ ID NO: 324000 - DNA, 20 bp, Artificial Sequence
  chemically synthesized
aaattgatgatatagaaaga

SEQ ID NO: 324001 - DNA, 20 bp, Artificial Sequence
  chemically synthesized
aattgatgatatagaaagaa

SEQ ID NO: 324002 - DNA, 20 bp, Artificial Sequence
  chemically synthesized
attgatgatatagaaagaaa

SEQ ID NO: 324003 - DNA, 20 bp, Artificial Sequence
  chemically synthesized
gaaagggaatcttgtgactt

SEQ ID NO: 324004 - DNA, 20 bp, Artificial Sequence
  chemically synthesized
taggtaactcccaaagtcac

SEQ ID NO: 324005 - DNA, 20 bp, Artificial Sequence
  chemically synthesized
aaagggaatcttgtgacttt

SEQ ID NO: 324006 - DNA, 20 bp, Artificial Sequence
  chemically synthesized
agggaatcttgtgactttgg

SEQ ID NO: 324007 - DNA, 20 bp, Artificial Sequence
  chemically synthesized
gcagggctaggtaactccca

SEQ ID NO: 324008 - DNA, 20 bp, Artificial Sequence
  chemically synthesized
ttgtgactttgggagttacc

SEQ ID NO: 324009 - DNA, 20 bp, Artificial Sequence
  chemically synthesized
actaaggcttatgcagggct

SEQ ID NO: 324010 - DNA, 20 bp, Artificial Sequence
  chemically synthesized
aactaaggcttatgcagggc

SEQ ID NO: 324011 - DNA, 20 bp, Artificial Sequence
  chemically synthesized
ggagttacctagccctgcat

SEQ ID NO: 324012 - DNA, 20 bp, Artificial Sequence
  chemically synthesized
cagaaactaaggcttatgca

SEQ ID NO: 324013 - DNA, 20 bp, Artificial Sequence
  chemically synthesized
gcagaaactaaggcttatgc

SEQ ID NO: 324014 - DNA, 20 bp, Artificial Sequence
  chemically synthesized
agcagaaactaaggcttatg

SEQ ID NO: 324015 - DNA, 20 bp, Artificial Sequence
  chemically synthesized
acctagccctgcataagcct

SEQ ID NO: 324016 - DNA, 20 bp, Artificial Sequence
  chemically synthesized
ttttacagaagcagaaacta

SEQ ID NO: 324017 - DNA, 20 bp, Artificial Sequence
  chemically synthesized
attttacagaagcagaaact

SEQ ID NO: 324018 - DNA, 20 bp, Artificial Sequence
  chemically synthesized
ttgttcccattttacagaag

SEQ ID NO: 324019 - DNA, 20 bp, Artificial Sequence
  chemically synthesized
ttattgttcccattttacag

SEQ ID NO: 324020 - DNA, 20 bp, Artificial Sequence
  chemically synthesized
tagtttctgcttctgtaaaa

SEQ ID NO: 324021 - DNA, 20 bp, Artificial Sequence
  chemically synthesized
agtttctgcttctgtaaaat

SEQ ID NO: 324022 - DNA, 20 bp, Artificial Sequence
  chemically synthesized
gtattattgttcccatttta

SEQ ID NO: 324023 - DNA, 20 bp, Artificial Sequence
  chemically synthesized
aacaataatacttccataat

SEQ ID NO: 324024 - DNA, 20 bp, Artificial Sequence
  chemically synthesized
ttaccacaatcttattatgg

SEQ ID NO: 324025 - DNA, 20 bp, Artificial Sequence
  chemically synthesized
ttcttaccacaatcttatta

SEQ ID NO: 324026 - DNA, 20 bp, Artificial Sequence
  chemically synthesized
atacttccataataagattg

SEQ ID NO: 324027 - DNA, 20 bp, Artificial Sequence
  chemically synthesized
ttccataataagattgtggt

SEQ ID NO: 324028 - DNA, 20 bp, Artificial Sequence
  chemically synthesized
taagattgtggtaagaatta

SEQ ID NO: 324029 - DNA, 20 bp, Artificial Sequence
  chemically synthesized
agattgtggtaagaattaaa

SEQ ID NO: 324030 - DNA, 20 bp, Artificial Sequence
  chemically synthesized
agagtgcataatgcacttca

SEQ ID NO: 324031 - DNA, 20 bp, Artificial Sequence
  chemically synthesized
agtgcataatgcacttcaca

SEQ ID NO: 324032 - DNA, 20 bp, Artificial Sequence
  chemically synthesized
ttatacaaggtcactctgtg

SEQ ID NO: 324033 - DNA, 20 bp, Artificial Sequence
  chemically synthesized
ctttatttagttgttataca

SEQ ID NO: 324034 - DNA, 20 bp, Artificial Sequence
  chemically synthesized
actttatttagttgttatac

SEQ ID NO: 324035 - DNA, 20 bp, Artificial Sequence
  chemically synthesized
ccttgtataacaactaaata

SEQ ID NO: 324036 - DNA, 20 bp, Artificial Sequence
  chemically synthesized
cagccgtaacatactttatt

SEQ ID NO: 324037 - DNA, 20 bp, Artificial Sequence
  chemically synthesized
caactaaataaagtatgtta

SEQ ID NO: 324038 - DNA, 20 bp, Artificial Sequence
  chemically synthesized
gaggaatttgataataatta

SEQ ID NO: 324039 - DNA, 20 bp, Artificial Sequence
  chemically synthesized
aacacttcttatatatgcag

SEQ ID NO: 324040 - DNA, 20 bp, Artificial Sequence
  chemically synthesized
aaacacttcttatatatgca

SEQ ID NO: 324041 - DNA, 20 bp, Artificial Sequence
  chemically synthesized
tcaaattcctctgcatatat

SEQ ID NO: 324042 - DNA, 20 bp, Artificial Sequence
  chemically synthesized
caaaacacttcttatatatg

SEQ ID NO: 324043 - DNA, 20 bp, Artificial Sequence
  chemically synthesized
aattcctctgcatatataag

SEQ ID NO: 324044 - DNA, 20 bp, Artificial Sequence
  chemically synthesized
catatataagaagtgttttg

SEQ ID NO: 324045 - DNA, 20 bp, Artificial Sequence
  chemically synthesized
tttgaagcataaattgcccc

SEQ ID NO: 324046 - DNA, 20 bp, Artificial Sequence
  chemically synthesized
gacttaagaaggtaatcttg

SEQ ID NO: 324047 - DNA, 20 bp, Artificial Sequence
  chemically synthesized
tgacttaagaaggtaatctt

SEQ ID NO: 324048 - DNA, 20 bp, Artificial Sequence
  chemically synthesized
gtgacttaagaaggtaatct

SEQ ID NO: 324049 - DNA, 20 bp, Artificial Sequence
  chemically synthesized
tgccccaagattaccttctt

SEQ ID NO: 324050 - DNA, 20 bp, Artificial Sequence
  chemically synthesized
acctgaacagtgacttaaga

SEQ ID NO: 324051 - DNA, 20 bp, Artificial Sequence
  chemically synthesized
aacctgaacagtgacttaag

SEQ ID NO: 324052 - DNA, 20 bp, Artificial Sequence
  chemically synthesized
tgaaacctgaacagtgactt

SEQ ID NO: 324053 - DNA, 20 bp, Artificial Sequence
  chemically synthesized
taccttcttaagtcactgtt

SEQ ID NO: 324054 - DNA, 20 bp, Artificial Sequence
  chemically synthesized
accttcttaagtcactgttc

SEQ ID NO: 324055 - DNA, 20 bp, Artificial Sequence
  chemically synthesized
tccatctcctgaaacctgaa

SEQ ID NO: 324056 - DNA, 20 bp, Artificial Sequence
  chemically synthesized
ttaagtcactgttcaggttt

SEQ ID NO: 324057 - DNA, 20 bp, Artificial Sequence
  chemically synthesized
taagtcactgttcaggtttc

SEQ ID NO: 324058 - DNA, 20 bp, Artificial Sequence
  chemically synthesized
agtcactgttcaggtttcag

SEQ ID NO: 324059 - DNA, 20 bp, Artificial Sequence
  chemically synthesized
actgttcaggtttcaggaga

SEQ ID NO: 324060 - DNA, 20 bp, Artificial Sequence
  chemically synthesized
ttgctcttacacatttttgg

SEQ ID NO: 324061 - DNA, 20 bp, Artificial Sequence
  chemically synthesized
tttgctcttacacatttttg

SEQ ID NO: 324062 - DNA, 20 bp, Artificial Sequence
  chemically synthesized
gtttgctcttacacattttt

SEQ ID NO: 324063 - DNA, 20 bp, Artificial Sequence
  chemically synthesized
tgtttgctcttacacatttt

SEQ ID NO: 324064 - DNA, 20 bp, Artificial Sequence
  chemically synthesized
atacgcccccaaaaatgtgt

SEQ ID NO: 324065 - DNA, 20 bp, Artificial Sequence
  chemically synthesized
acgcccccaaaaatgtgtaa

SEQ ID NO: 324066 - DNA, 20 bp, Artificial Sequence
  chemically synthesized
taaggttcagatttcaaaaa

SEQ ID NO: 324067 - DNA, 20 bp, Artificial Sequence
  chemically synthesized
gttaaggttcagatttcaaa

SEQ ID NO: 324068 - DNA, 20 bp, Artificial Sequence
  chemically synthesized
atacgagctaggttaaggtt

SEQ ID NO: 324069 - DNA, 20 bp, Artificial Sequence
  chemically synthesized
ttgaaatctgaaccttaacc

SEQ ID NO: 324070 - DNA, 20 bp, Artificial Sequence
  chemically synthesized
cttaaatacgagctaggtta

SEQ ID NO: 324071 - DNA, 20 bp, Artificial Sequence
  chemically synthesized
tcttaaatacgagctaggtt

SEQ ID NO: 324072 - DNA, 20 bp, Artificial Sequence
  chemically synthesized
agaactcttaaatacgagct

SEQ ID NO: 324073 - DNA, 20 bp, Artificial Sequence
  chemically synthesized
aagaactcttaaatacgagc

SEQ ID NO: 324074 - DNA, 20 bp, Artificial Sequence
  chemically synthesized
ccttaacctagctcgtattt

SEQ ID NO: 324075 - DNA, 20 bp, Artificial Sequence
  chemically synthesized
ttttaagaactcttaaatac

SEQ ID NO: 324076 - DNA, 20 bp, Artificial Sequence
  chemically synthesized
ttaacctagctcgtatttaa

SEQ ID NO: 324077 - DNA, 20 bp, Artificial Sequence
  chemically synthesized
caagatagttaatgattttt

SEQ ID NO: 324078 - DNA, 20 bp, Artificial Sequence
  chemically synthesized
taaaaatcattaactatctt

SEQ ID NO: 324079 - DNA, 20 bp, Artificial Sequence
  chemically synthesized
aagattatttgaactcaaga

SEQ ID NO: 324080 - DNA, 20 bp, Artificial Sequence
  chemically synthesized
ggagaagattatttgaactc

SEQ ID NO: 324081 - DNA, 20 bp, Artificial Sequence
  chemically synthesized
ttacaatgcttcgtttggag

SEQ ID NO: 324082 - DNA, 20 bp, Artificial Sequence
  chemically synthesized
caaataatcttctccaaacg

SEQ ID NO: 324083 - DNA, 20 bp, Artificial Sequence
  chemically synthesized
tgtttacaatgcttcgtttg

SEQ ID NO: 324084 - DNA, 20 bp, Artificial Sequence
  chemically synthesized
gctgtttacaatgcttcgtt

SEQ ID NO: 324085 - DNA, 20 bp, Artificial Sequence
  chemically synthesized
tccaaacgaagcattgtaaa

SEQ ID NO: 324086 - DNA, 20 bp, Artificial Sequence
  chemically synthesized
tgtaaacagcactaatactc

SEQ ID NO: 324087 - DNA, 20 bp, Artificial Sequence
  chemically synthesized
gtattgtgttacttgagtat

SEQ ID NO: 324088 - DNA, 20 bp, Artificial Sequence
  chemically synthesized
tgtaaagtattgtgttactt

SEQ ID NO: 324089 - DNA, 20 bp, Artificial Sequence
  chemically synthesized
gattcaaattgcacagtgta

SEQ ID NO: 324090 - DNA, 20 bp, Artificial Sequence
  chemically synthesized
atattttgattcaaattgca

SEQ ID NO: 324091 - DNA, 20 bp, Artificial Sequence
  chemically synthesized
gtaaatatcaataaatcata

SEQ ID NO: 324092 - DNA, 20 bp, Artificial Sequence
  chemically synthesized
atgatttattgatatttaca

SEQ ID NO: 324093 - DNA, 20 bp, Artificial Sequence
  chemically synthesized
tgatttattgatatttacac

SEQ ID NO: 324094 - DNA, 20 bp, Artificial Sequence
  chemically synthesized
atttacacaggattgaattt

SEQ ID NO: 324095 - DNA, 20 bp, Artificial Sequence
  chemically synthesized
tacacaggattgaattttgg

SEQ ID NO: 324096 - DNA, 20 bp, Artificial Sequence
  chemically synthesized
attttggaagaaaatattaa

SEQ ID NO: 324097 - DNA, 20 bp, Artificial Sequence
  chemically synthesized
ttttggaagaaaatattaaa

SEQ ID NO: 324098 - DNA, 20 bp, Artificial Sequence
  chemically synthesized
aaaggtgtatacttatactc

SEQ ID NO: 324099 - DNA, 20 bp, Artificial Sequence
  chemically synthesized
aaggtgtatacttatactca

SEQ ID NO: 324100 - DNA, 20 bp, Artificial Sequence
  chemically synthesized
gatgtcatgtccttgagtat

SEQ ID NO: 324101 - DNA, 20 bp, Artificial Sequence
  chemically synthesized
gtactagatgtcatgtcctt

SEQ ID NO: 324102 - DNA, 20 bp, Artificial Sequence
  chemically synthesized
atactcaaggacatgacatc

SEQ ID NO: 324103 - DNA, 20 bp, Artificial Sequence
  chemically synthesized
taggttcagaatttgagtac

SEQ ID NO: 324104 - DNA, 20 bp, Artificial Sequence
  chemically synthesized
aatatttaggttcagaattt

SEQ ID NO: 324105 - DNA, 20 bp, Artificial Sequence
  chemically synthesized
tcagacaaaatatttaggtt

SEQ ID NO: 324106 - DNA, 20 bp, Artificial Sequence
  chemically synthesized
catcctcagacaaaatattt

SEQ ID NO: 324107 - DNA, 20 bp, Artificial Sequence
  chemically synthesized
acatcctcagacaaaatatt

SEQ ID NO: 324108 - DNA, 20 bp, Artificial Sequence
  chemically synthesized
tgaacctaaatattttgtct

SEQ ID NO: 324109 - DNA, 20 bp, Artificial Sequence
  chemically synthesized
gaacctaaatattttgtctg

SEQ ID NO: 324110 - DNA, 20 bp, Artificial Sequence
  chemically synthesized
ttttgttttatgcacatcct

SEQ ID NO: 324111 - DNA, 20 bp, Artificial Sequence
  chemically synthesized
cataaaacaaaaacatttca

SEQ ID NO: 324112 - DNA, 20 bp, Artificial Sequence
  chemically synthesized
aaacaaaaacatttcaaaga

SEQ ID NO: 324113 - DNA, 20 bp, Artificial Sequence
  chemically synthesized
tttcaaagacagccttctta

SEQ ID NO: 324114 - DNA, 20 bp, Artificial Sequence
  chemically synthesized
atttgaatttatctttaaga

SEQ ID NO: 324115 - DNA, 20 bp, Artificial Sequence
  chemically synthesized
gatttgaatttatctttaag

SEQ ID NO: 324116 - DNA, 20 bp, Artificial Sequence
  chemically synthesized
tcagatttgaatttatcttt

SEQ ID NO: 324117 - DNA, 20 bp, Artificial Sequence
  chemically synthesized
agataaattcaaatctgaat

SEQ ID NO: 324118 - DNA, 20 bp, Artificial Sequence
  chemically synthesized
aaaattttgcatagcttatt

SEQ ID NO: 324119 - DNA, 20 bp, Artificial Sequence
  chemically synthesized
tataaatataaaattttgca

SEQ ID NO: 324120 - DNA, 20 bp, Artificial Sequence
  chemically synthesized
tatatatatagttgaattga

SEQ ID NO: 324121 - DNA, 20 bp, Artificial Sequence
  chemically synthesized
attataattctgtatatata

SEQ ID NO: 324122 - DNA, 20 bp, Artificial Sequence
  chemically synthesized
tcaattcaactatatatata

SEQ ID NO: 324123 - DNA, 20 bp, Artificial Sequence
  chemically synthesized
tataatcaaaatttgaattt

SEQ ID NO: 324124 - DNA, 20 bp, Artificial Sequence
  chemically synthesized
aaaatttgaatttaagatct

SEQ ID NO: 324125 - DNA, 20 bp, Artificial Sequence
  chemically synthesized
tatctagacaaataattact

SEQ ID NO: 324126 - DNA, 20 bp, Artificial Sequence
  chemically synthesized
gatctgagtaattatttgtc

SEQ ID NO: 324127 - DNA, 20 bp, Artificial Sequence
  chemically synthesized
tgagtaattatttgtctaga

SEQ ID NO: 324128 - DNA, 20 bp, Artificial Sequence
  chemically synthesized
ttgaaaaacaatagtctatc

SEQ ID NO: 324129 - DNA, 20 bp, Artificial Sequence
  chemically synthesized
acttacaatttgaaaaacaa

SEQ ID NO: 324130 - DNA, 20 bp, Artificial Sequence
  chemically synthesized
actattgtttttcaaattgt

SEQ ID NO: 324131 - DNA, 20 bp, Artificial Sequence
  chemically synthesized
ttgtttttcaaattgtaagt

SEQ ID NO: 324132 - DNA, 20 bp, Artificial Sequence
  chemically synthesized
tgtaagtcagaatccattca

SEQ ID NO: 324133 - DNA, 20 bp, Artificial Sequence
  chemically synthesized
atgattttatgaaccatgaa

SEQ ID NO: 324134 - DNA, 20 bp, Artificial Sequence
  chemically synthesized
catggttcataaaatcatgt

SEQ ID NO: 324135 - DNA, 20 bp, Artificial Sequence
  chemically synthesized
ggttcataaaatcatgttag

SEQ ID NO: 324136 - DNA, 20 bp, Artificial Sequence
  chemically synthesized
gttcataaaatcatgttagt

SEQ ID NO: 324137 - DNA, 20 bp, Artificial Sequence
  chemically synthesized
tcatgttagtaggttatgac

SEQ ID NO: 324138 - DNA, 20 bp, Artificial Sequence
  chemically synthesized
catgttagtaggttatgact

SEQ ID NO: 324139 - DNA, 20 bp, Artificial Sequence
  chemically synthesized
gtttaattttaaaatattcc

SEQ ID NO: 324140 - DNA, 20 bp, Artificial Sequence
  chemically synthesized
aggaatattttaaaattaaa

SEQ ID NO: 324141 - DNA, 20 bp, Artificial Sequence
  chemically synthesized
tttaaaattaaacagaaaaa

SEQ ID NO: 324142 - DNA, 20 bp, Artificial Sequence
  chemically synthesized
aaaattaaacagaaaaatag

SEQ ID NO: 324143 - DNA, 20 bp, Artificial Sequence
  chemically synthesized
ttagtattatataagtgaca

SEQ ID NO: 324144 - DNA, 20 bp, Artificial Sequence
  chemically synthesized
aataattgttagtattatat

SEQ ID NO: 324145 - DNA, 20 bp, Artificial Sequence
  chemically synthesized
aaaattgagacaataattgt

SEQ ID NO: 324146 - DNA, 20 bp, Artificial Sequence
  chemically synthesized
gcacatctgaaacaaaaatt

SEQ ID NO: 324147 - DNA, 20 bp, Artificial Sequence
  chemically synthesized
tattgtctcaatttttgttt

SEQ ID NO: 324148 - DNA, 20 bp, Artificial Sequence
  chemically synthesized
ttttgtttcagatgtgcata

SEQ ID NO: 324149 - DNA, 20 bp, Artificial Sequence
  chemically synthesized
tttgtttcagatgtgcatat

SEQ ID NO: 324150 - DNA, 20 bp, Artificial Sequence
  chemically synthesized
tgtatatgtatatatgttct

SEQ ID NO: 324151 - DNA, 20 bp, Artificial Sequence
  chemically synthesized
gtatatgtatatatgttcta

SEQ ID NO: 324152 - DNA, 20 bp, Artificial Sequence
  chemically synthesized
atgtatatatgttctaaggt

SEQ ID NO: 324153 - DNA, 20 bp, Artificial Sequence
  chemically synthesized
aaaaaagtttaatctcacct

SEQ ID NO: 324154 - DNA, 20 bp, Artificial Sequence
  chemically synthesized
tgagattaaacttttttctg

SEQ ID NO: 324155 - DNA, 20 bp, Artificial Sequence
  chemically synthesized
gttttacaaactgcagaaaa

SEQ ID NO: 324156 - DNA, 20 bp, Artificial Sequence
  chemically synthesized
caattttgttttacaaactg

SEQ ID NO: 324157 - DNA, 20 bp, Artificial Sequence
  chemically synthesized
tgcagtttgtaaaacaaaat

SEQ ID NO: 324158 - DNA, 20 bp, Artificial Sequence
  chemically synthesized
ttgtaaaacaaaattggaaa

SEQ ID NO: 324159 - DNA, 20 bp, Artificial Sequence
  chemically synthesized
aacaaaattggaaatggctc

SEQ ID NO: 324160 - DNA, 20 bp, Artificial Sequence
  chemically synthesized
ttgcttagtctgaaattcta

SEQ ID NO: 324161 - DNA, 20 bp, Artificial Sequence
  chemically synthesized
tggaaatggctctagaattt

SEQ ID NO: 324162 - DNA, 20 bp, Artificial Sequence
  chemically synthesized
gtttgcttagtctgaaattc

SEQ ID NO: 324163 - DNA, 20 bp, Artificial Sequence
  chemically synthesized
tggctctagaatttcagact

SEQ ID NO: 324164 - DNA, 20 bp, Artificial Sequence
  chemically synthesized
tcttttttcgtcggtttgct

SEQ ID NO: 324165 - DNA, 20 bp, Artificial Sequence
  chemically synthesized
actaagcaaaccgacgaaaa

SEQ ID NO: 324166 - DNA, 20 bp, Artificial Sequence
  chemically synthesized
aggcaaatttcttttttcgt

SEQ ID NO: 324167 - DNA, 20 bp, Artificial Sequence
  chemically synthesized
aatatacaaatgtagaattc

SEQ ID NO: 324168 - DNA, 20 bp, Artificial Sequence
  chemically synthesized
aaatatacaaatgtagaatt

SEQ ID NO: 324169 - DNA, 20 bp, Artificial Sequence
  chemically synthesized
ctatggaaaatatacaaatg

SEQ ID NO: 324170 - DNA, 20 bp, Artificial Sequence
  chemically synthesized
ctacatttgtatattttcca

SEQ ID NO: 324171 - DNA, 20 bp, Artificial Sequence
  chemically synthesized
acatttgtatattttccata

SEQ ID NO: 324172 - DNA, 20 bp, Artificial Sequence
  chemically synthesized
cttttattccaaggtctcta

SEQ ID NO: 324173 - DNA, 20 bp, Artificial Sequence
  chemically synthesized
tatattttccatagagacct

SEQ ID NO: 324174 - DNA, 20 bp, Artificial Sequence
  chemically synthesized
ttaaaatgtcttttattcca

SEQ ID NO: 324175 - DNA, 20 bp, Artificial Sequence
  chemically synthesized
ccatagagaccttggaataa

SEQ ID NO: 324176 - DNA, 20 bp, Artificial Sequence
  chemically synthesized
tttaaaatgtcttttattcc

SEQ ID NO: 324177 - DNA, 20 bp, Artificial Sequence
  chemically synthesized
aataaaacgatgtttaatct

SEQ ID NO: 324178 - DNA, 20 bp, Artificial Sequence
  chemically synthesized
cgatgtttaatctgagaatt

SEQ ID NO: 324179 - DNA, 20 bp, Artificial Sequence
  chemically synthesized
tatctttatttccaaattct

SEQ ID NO: 324180 - DNA, 20 bp, Artificial Sequence
  chemically synthesized
aatctgagaatttggaaata

SEQ ID NO: 324181 - DNA, 20 bp, Artificial Sequence
  chemically synthesized
tttggaaataaagatataaa

SEQ ID NO: 324182 - DNA, 20 bp, Artificial Sequence
  chemically synthesized
ggaaataaagatataaaaag

SEQ ID NO: 324183 - DNA, 20 bp, Artificial Sequence
  chemically synthesized
ggggtgctgaaacaaagcat

SEQ ID NO: 324184 - DNA, 20 bp, Artificial Sequence
  chemically synthesized
aagtggcttatgctttgttt

SEQ ID NO: 324185 - DNA, 20 bp, Artificial Sequence
  chemically synthesized
tattttggggtgctgaaaca

SEQ ID NO: 324186 - DNA, 20 bp, Artificial Sequence
  chemically synthesized
gatgataaaaacatattttg

SEQ ID NO: 324187 - DNA, 20 bp, Artificial Sequence
  chemically synthesized
tgatgataaaaacatatttt

SEQ ID NO: 324188 - DNA, 20 bp, Artificial Sequence
  chemically synthesized
gtgatgataaaaacatattt

SEQ ID NO: 324189 - DNA, 20 bp, Artificial Sequence
  chemically synthesized
aaaatatgtttttatcatca

SEQ ID NO: 324190 - DNA, 20 bp, Artificial Sequence
  chemically synthesized
cagaattttacattgtacct

SEQ ID NO: 324191 - DNA, 20 bp, Artificial Sequence
  chemically synthesized
ttttacattgtacctaagat

SEQ ID NO: 324192 - DNA, 20 bp, Artificial Sequence
  chemically synthesized
ttacattgtacctaagattg

SEQ ID NO: 324193 - DNA, 20 bp, Artificial Sequence
  chemically synthesized
atgaagtgatctccaatctt

SEQ ID NO: 324194 - DNA, 20 bp, Artificial Sequence
  chemically synthesized
tatgaagtgatctccaatct

SEQ ID NO: 324195 - DNA, 20 bp, Artificial Sequence
  chemically synthesized
ttgatgccatgacatgtatg

SEQ ID NO: 324196 - DNA, 20 bp, Artificial Sequence
  chemically synthesized
agatcacttcatacatgtca

SEQ ID NO: 324197 - DNA, 20 bp, Artificial Sequence
  chemically synthesized
acatgtcatggcatcaaatg

SEQ ID NO: 324198 - DNA, 20 bp, Artificial Sequence
  chemically synthesized
atgtcatggcatcaaatgaa

SEQ ID NO: 324199 - DNA, 20 bp, Artificial Sequence
  chemically synthesized
catcaaatgaagagattttc

SEQ ID NO: 324200 - DNA, 20 bp, Artificial Sequence
  chemically synthesized
atcaaatgaagagattttct

SEQ ID NO: 324201 - DNA, 20 bp, Artificial Sequence
  chemically synthesized
aatgaagagattttctagga

SEQ ID NO: 324202 - DNA, 20 bp, Artificial Sequence
  chemically synthesized
aagagattttctaggaaagt

SEQ ID NO: 324203 - DNA, 20 bp, Artificial Sequence
  chemically synthesized
agaacaaaaaccaactttcc

SEQ ID NO: 324204 - DNA, 20 bp, Artificial Sequence
  chemically synthesized
aagttggtttttgttcttta

SEQ ID NO: 324205 - DNA, 20 bp, Artificial Sequence
  chemically synthesized
ttcttataaatagatctata

SEQ ID NO: 324206 - DNA, 20 bp, Artificial Sequence
  chemically synthesized
ttctttatagatctatttat

SEQ ID NO: 324207 - DNA, 20 bp, Artificial Sequence
  chemically synthesized
gggtctatctttcttataaa

SEQ ID NO: 324208 - DNA, 20 bp, Artificial Sequence
  chemically synthesized
ttatagatctatttataaga

SEQ ID NO: 324209 - DNA, 20 bp, Artificial Sequence
  chemically synthesized
agatctatttataagaaaga

SEQ ID NO: 324210 - DNA, 20 bp, Artificial Sequence
  chemically synthesized
cttcattcatgaaacgattg

SEQ ID NO: 324211 - DNA, 20 bp, Artificial Sequence
  chemically synthesized
tcttcattcatgaaacgatt

SEQ ID NO: 324212 - DNA, 20 bp, Artificial Sequence
  chemically synthesized
atcttcattcatgaaacgat

SEQ ID NO: 324213 - DNA, 20 bp, Artificial Sequence
  chemically synthesized
ccccaatcgtttcatgaatg

SEQ ID NO: 324214 - DNA, 20 bp, Artificial Sequence
  chemically synthesized
cgtttcatgaatgaagatgc

SEQ ID NO: 324215 - DNA, 20 bp, Artificial Sequence
  chemically synthesized
ttagttccagttgatgatac

SEQ ID NO: 324216 - DNA, 20 bp, Artificial Sequence
  chemically synthesized
aagatgccagtatcatcaac

SEQ ID NO: 324217 - DNA, 20 bp, Artificial Sequence
  chemically synthesized
ataggaaaaataattagttc

SEQ ID NO: 324218 - DNA, 20 bp, Artificial Sequence
  chemically synthesized
tgaagcataggaaaaataat

SEQ ID NO: 324219 - DNA, 20 bp, Artificial Sequence
  chemically synthesized
acaaaataggattgaagcat

SEQ ID NO: 324220 - DNA, 20 bp, Artificial Sequence
  chemically synthesized
gacaaaataggattgaagca

SEQ ID NO: 324221 - DNA, 20 bp, Artificial Sequence
  chemically synthesized
ataaagacaaaataggattg

SEQ ID NO: 324222 - DNA, 20 bp, Artificial Sequence
  chemically synthesized
tactgtgataaagacaaaat

SEQ ID NO: 324223 - DNA, 20 bp, Artificial Sequence
  chemically synthesized
ctactgtgataaagacaaaa

SEQ ID NO: 324224 - DNA, 20 bp, Artificial Sequence
  chemically synthesized
atcctattttgtctttatca

SEQ ID NO: 324225 - DNA, 20 bp, Artificial Sequence
  chemically synthesized
aaacataaactactgtgata

SEQ ID NO: 324226 - DNA, 20 bp, Artificial Sequence
  chemically synthesized
ctattttgtctttatcacag

SEQ ID NO: 324227 - DNA, 20 bp, Artificial Sequence
  chemically synthesized
cagtagtttatgtttctctt

SEQ ID NO: 324228 - DNA, 20 bp, Artificial Sequence
  chemically synthesized
tatttgcccaatgtactgaa

SEQ ID NO: 324229 - DNA, 20 bp, Artificial Sequence
  chemically synthesized
attatttgcccaatgtactg

SEQ ID NO: 324230 - DNA, 20 bp, Artificial Sequence
  chemically synthesized
tatgtttctcttcagtacat

SEQ ID NO: 324231 - DNA, 20 bp, Artificial Sequence
  chemically synthesized
atgtttctcttcagtacatt

SEQ ID NO: 324232 - DNA, 20 bp, Artificial Sequence
  chemically synthesized
gggcaaataatgattacgat

SEQ ID NO: 324233 - DNA, 20 bp, Artificial Sequence
  chemically synthesized
gcaaataatgattacgatga

SEQ ID NO: 324234 - DNA, 20 bp, Artificial Sequence
  chemically synthesized
caaataatgattacgatgag

SEQ ID NO: 324235 - DNA, 20 bp, Artificial Sequence
  chemically synthesized
gattacgatgagaggcatga

SEQ ID NO: 324236 - DNA, 20 bp, Artificial Sequence
  chemically synthesized
atgagaggcatgacagtgaa

SEQ ID NO: 324237 - DNA, 20 bp, Artificial Sequence
  chemically synthesized
ggaaaaaaaaaaaacaaaaa

SEQ ID NO: 324238 - DNA, 20 bp, Artificial Sequence
  chemically synthesized
ttgagtgtactcaattttgg

SEQ ID NO: 324239 - DNA, 20 bp, Artificial Sequence
  chemically synthesized
tttttttttcccccaaaatt

SEQ ID NO: 324240 - DNA, 20 bp, Artificial Sequence
  chemically synthesized
tttgagtgtactcaattttg

SEQ ID NO: 324241 - DNA, 20 bp, Artificial Sequence
  chemically synthesized
atttgagtgtactcaatttt

SEQ ID NO: 324242 - DNA, 20 bp, Artificial Sequence
  chemically synthesized
aatttgagtgtactcaattt

SEQ ID NO: 324243 - DNA, 20 bp, Artificial Sequence
  chemically synthesized
ggataacgttgaataaattt

SEQ ID NO: 324244 - DNA, 20 bp, Artificial Sequence
  chemically synthesized
aatttattcaacgttatcca

SEQ ID NO: 324245 - DNA, 20 bp, Artificial Sequence
  chemically synthesized
tcaacgttatccacagactt

SEQ ID NO: 324246 - DNA, 20 bp, Artificial Sequence
  chemically synthesized
aattaagcctctgaagtctg

SEQ ID NO: 324247 - DNA, 20 bp, Artificial Sequence
  chemically synthesized
aacgttatccacagacttca

SEQ ID NO: 324248 - DNA, 20 bp, Artificial Sequence
  chemically synthesized
acgttatccacagacttcag

SEQ ID NO: 324249 - DNA, 20 bp, Artificial Sequence
  chemically synthesized
aggcagtaattaagcctctg

SEQ ID NO: 324250 - DNA, 20 bp, Artificial Sequence
  chemically synthesized
aaatctaacaggcagtaatt

SEQ ID NO: 324251 - DNA, 20 bp, Artificial Sequence
  chemically synthesized
gaggcttaattactgcctgt

SEQ ID NO: 324252 - DNA, 20 bp, Artificial Sequence
  chemically synthesized
tacttcctaaatctaacagg

SEQ ID NO: 324253 - DNA, 20 bp, Artificial Sequence
  chemically synthesized
taatacttcctaaatctaac

SEQ ID NO: 324254 - DNA, 20 bp, Artificial Sequence
  chemically synthesized
taattactgcctgttagatt

SEQ ID NO: 324255 - DNA, 20 bp, Artificial Sequence
  chemically synthesized
ctaatacttcctaaatctaa

SEQ ID NO: 324256 - DNA, 20 bp, Artificial Sequence
  chemically synthesized
aattactgcctgttagattt

SEQ ID NO: 324257 - DNA, 20 bp, Artificial Sequence
  chemically synthesized
tactgcctgttagatttagg

SEQ ID NO: 324258 - DNA, 20 bp, Artificial Sequence
  chemically synthesized
ctgttagatttaggaagtat

SEQ ID NO: 324259 - DNA, 20 bp, Artificial Sequence
  chemically synthesized
gcgatgtcttcaaggaacat

SEQ ID NO: 324260 - DNA, 20 bp, Artificial Sequence
  chemically synthesized
agcgatgtcttcaaggaaca

SEQ ID NO: 324261 - DNA, 20 bp, Artificial Sequence
  chemically synthesized
attgtcacctatgttccttg

SEQ ID NO: 324262 - DNA, 20 bp, Artificial Sequence
  chemically synthesized
tttaatgagcgatgtcttca

SEQ ID NO: 324263 - DNA, 20 bp, Artificial Sequence
  chemically synthesized
ttttaatgagcgatgtcttc

SEQ ID NO: 324264 - DNA, 20 bp, Artificial Sequence
  chemically synthesized
gaagacatcgctcattaaaa

SEQ ID NO: 324265 - DNA, 20 bp, Artificial Sequence
  chemically synthesized
cctcttccaccttttttaat

SEQ ID NO: 324266 - DNA, 20 bp, Artificial Sequence
  chemically synthesized
aagacatcgctcattaaaaa

SEQ ID NO: 324267 - DNA, 20 bp, Artificial Sequence
  chemically synthesized
acatcgctcattaaaaaagg

SEQ ID NO: 324268 - DNA, 20 bp, Artificial Sequence
  chemically synthesized
tcgctcattaaaaaaggtgg

SEQ ID NO: 324269 - DNA, 20 bp, Artificial Sequence
  chemically synthesized
gctcattaaaaaaggtggaa

SEQ ID NO: 324270 - DNA, 20 bp, Artificial Sequence
  chemically synthesized
ctcattaaaaaaggtggaag

SEQ ID NO: 324271 - DNA, 20 bp, Artificial Sequence
  chemically synthesized
ttaaaaaaggtggaagaggc

SEQ ID NO: 324272 - DNA, 20 bp, Artificial Sequence
  chemically synthesized
taaaaaaggtggaagaggcc

SEQ ID NO: 324273 - DNA, 20 bp, Artificial Sequence
  chemically synthesized
aaggtggaagaggccgggtg

SEQ ID NO: 324274 - DNA, 20 bp, Artificial Sequence
  chemically synthesized
gtggaagaggccgggtgcgg

SEQ ID NO: 324275 - DNA, 20 bp, Artificial Sequence
  chemically synthesized
caggtctgagccaccgcacc

SEQ ID NO: 324276 - DNA, 20 bp, Artificial Sequence
  chemically synthesized
agaggccgggtgcggtggct

SEQ ID NO: 324277 - DNA, 20 bp, Artificial Sequence
  chemically synthesized
agtgctgggattacaggtct

SEQ ID NO: 324278 - DNA, 20 bp, Artificial Sequence
  chemically synthesized
gtggctcagacctgtaatcc

SEQ ID NO: 324279 - DNA, 20 bp, Artificial Sequence
  chemically synthesized
tcccaaagtgctgggattac

SEQ ID NO: 324280 - DNA, 20 bp, Artificial Sequence
  chemically synthesized
ctcccaaagtgctgggatta

SEQ ID NO: 324281 - DNA, 20 bp, Artificial Sequence
  chemically synthesized
gacctgtaatcccagcactt

SEQ ID NO: 324282 - DNA, 20 bp, Artificial Sequence
  chemically synthesized
cctcagcctcccaaagtgct

SEQ ID NO: 324283 - DNA, 20 bp, Artificial Sequence
  chemically synthesized
acctgtaatcccagcacttt

SEQ ID NO: 324284 - DNA, 20 bp, Artificial Sequence
  chemically synthesized
gcctcagcctcccaaagtgc

SEQ ID NO: 324285 - DNA, 20 bp, Artificial Sequence
  chemically synthesized
ctgtaatcccagcactttgg

SEQ ID NO: 324286 - DNA, 20 bp, Artificial Sequence
  chemically synthesized
tgtaatcccagcactttggg

SEQ ID NO: 324287 - DNA, 20 bp, Artificial Sequence
  chemically synthesized
ccgcctgcctcagcctccca

SEQ ID NO: 324288 - DNA, 20 bp, Artificial Sequence
  chemically synthesized
tcccagcactttgggaggct

SEQ ID NO: 324289 - DNA, 20 bp, Artificial Sequence
  chemically synthesized
cccagcactttgggaggctg

SEQ ID NO: 324290 - DNA, 20 bp, Artificial Sequence
  chemically synthesized
agcactttgggaggctgagg

SEQ ID NO: 324291 - DNA, 20 bp, Artificial Sequence
  chemically synthesized
gcactttgggaggctgaggc

SEQ ID NO: 324292 - DNA, 20 bp, Artificial Sequence
  chemically synthesized
ctttgggaggctgaggcagg

SEQ ID NO: 324293 - DNA, 20 bp, Artificial Sequence
  chemically synthesized
acctcgtgatccgcctgcct

SEQ ID NO: 324294 - DNA, 20 bp, Artificial Sequence
  chemically synthesized
ggctgaggcaggcggatcac

SEQ ID NO: 324295 - DNA, 20 bp, Artificial Sequence
  chemically synthesized
gctgaggcaggcggatcacg

SEQ ID NO: 324296 - DNA, 20 bp, Artificial Sequence
  chemically synthesized
aggcaggcggatcacgaggt

SEQ ID NO: 324297 - DNA, 20 bp, Artificial Sequence
  chemically synthesized
ggcaggcggatcacgaggtc

SEQ ID NO: 324298 - DNA, 20 bp, Artificial Sequence
  chemically synthesized
caggcggatcacgaggtcag

SEQ ID NO: 324299 - DNA, 20 bp, Artificial Sequence
  chemically synthesized
gatcacgaggtcaggagatc

SEQ ID NO: 324300 - DNA, 20 bp, Artificial Sequence
  chemically synthesized
tttaaccatgttagcgaaga

SEQ ID NO: 324301 - DNA, 20 bp, Artificial Sequence
  chemically synthesized
ggggtttaaccatgttagcg

SEQ ID NO: 324302 - DNA, 20 bp, Artificial Sequence
  chemically synthesized
cgagaccatcttcgctaaca

SEQ ID NO: 324303 - DNA, 20 bp, Artificial Sequence
  chemically synthesized
gagacggggtttaaccatgt

SEQ ID NO: 324304 - DNA, 20 bp, Artificial Sequence
  chemically synthesized
ttgtatttttagtagagacg

SEQ ID NO: 324305 - DNA, 20 bp, Artificial Sequence
  chemically synthesized
tttgtatttttagtagagac

SEQ ID NO: 324306 - DNA, 20 bp, Artificial Sequence
  chemically synthesized
ttttgtatttttagtagaga

SEQ ID NO: 324307 - DNA, 20 bp, Artificial Sequence
  chemically synthesized
aattttttgtatttttagta

SEQ ID NO: 324308 - DNA, 20 bp, Artificial Sequence
  chemically synthesized
ctaattttttgtatttttag

SEQ ID NO: 324309 - DNA, 20 bp, Artificial Sequence
  chemically synthesized
cggctaattttttgtatttt

SEQ ID NO: 324310 - DNA, 20 bp, Artificial Sequence
  chemically synthesized
ctactaaaaatacaaaaaat

SEQ ID NO: 324311 - DNA, 20 bp, Artificial Sequence
  chemically synthesized
taaaaatacaaaaaattagc

SEQ ID NO: 324312 - DNA, 20 bp, Artificial Sequence
  chemically synthesized
aaaaatacaaaaaattagcc

SEQ ID NO: 324313 - DNA, 20 bp, Artificial Sequence
  chemically synthesized
tacaaaaaattagccgggcg

SEQ ID NO: 324314 - DNA, 20 bp, Artificial Sequence
  chemically synthesized
aaaaaattagccgggcgcgg

SEQ ID NO: 324315 - DNA, 20 bp, Artificial Sequence
  chemically synthesized
acaggcgccgccaccgcgcc

SEQ ID NO: 324316 - DNA, 20 bp, Artificial Sequence
  chemically synthesized
aaattagccgggcgcggtgg

SEQ ID NO: 324317 - DNA, 20 bp, Artificial Sequence
  chemically synthesized
gggcgcggtggcggcgcctg

SEQ ID NO: 324318 - DNA, 20 bp, Artificial Sequence
  chemically synthesized
ggtggcggcgcctgtagtcc

SEQ ID NO: 324319 - DNA, 20 bp, Artificial Sequence
  chemically synthesized
tcccgagtaactgggactac

SEQ ID NO: 324320 - DNA, 20 bp, Artificial Sequence
  chemically synthesized
ctcccgagtaactgggacta

SEQ ID NO: 324321 - DNA, 20 bp, Artificial Sequence
  chemically synthesized
cgcctgtagtcccagttact

SEQ ID NO: 324322 - DNA, 20 bp, Artificial Sequence
  chemically synthesized
cctcagcctcccgagtaact

SEQ ID NO: 324323 - DNA, 20 bp, Artificial Sequence
  chemically synthesized
gcctgtagtcccagttactc

SEQ ID NO: 324324 - DNA, 20 bp, Artificial Sequence
  chemically synthesized
acctcagcctcccgagtaac

SEQ ID NO: 324325 - DNA, 20 bp, Artificial Sequence
  chemically synthesized
ctgtagtcccagttactcgg

SEQ ID NO: 324326 - DNA, 20 bp, Artificial Sequence
  chemically synthesized
tgtagtcccagttactcggg

SEQ ID NO: 324327 - DNA, 20 bp, Artificial Sequence
  chemically synthesized
tcctcctacctcagcctccc

SEQ ID NO: 324328 - DNA, 20 bp, Artificial Sequence
  chemically synthesized
tcccagttactcgggaggct

SEQ ID NO: 324329 - DNA, 20 bp, Artificial Sequence
  chemically synthesized
cccagttactcgggaggctg

SEQ ID NO: 324330 - DNA, 20 bp, Artificial Sequence
  chemically synthesized
agttactcgggaggctgagg

SEQ ID NO: 324331 - DNA, 20 bp, Artificial Sequence
  chemically synthesized
gttactcgggaggctgaggt

SEQ ID NO: 324332 - DNA, 20 bp, Artificial Sequence
  chemically synthesized
tactcgggaggctgaggtag

SEQ ID NO: 324333 - DNA, 20 bp, Artificial Sequence
  chemically synthesized
actcgggaggctgaggtagg

SEQ ID NO: 324334 - DNA, 20 bp, Artificial Sequence
  chemically synthesized
acgcctttctcctcctacct

SEQ ID NO: 324335 - DNA, 20 bp, Artificial Sequence
  chemically synthesized
tcgggaggctgaggtaggag

SEQ ID NO: 324336 - DNA, 20 bp, Artificial Sequence
  chemically synthesized
gaggctgaggtaggaggaga

SEQ ID NO: 324337 - DNA, 20 bp, Artificial Sequence
  chemically synthesized
aggctgaggtaggaggagaa

SEQ ID NO: 324338 - DNA, 20 bp, Artificial Sequence
  chemically synthesized
ggaggagaaaggcgtgaacc

SEQ ID NO: 324339 - DNA, 20 bp, Artificial Sequence
  chemically synthesized
gaggagaaaggcgtgaaccc

SEQ ID NO: 324340 - DNA, 20 bp, Artificial Sequence
  chemically synthesized
ggagaaaggcgtgaacccgg

SEQ ID NO: 324341 - DNA, 20 bp, Artificial Sequence
  chemically synthesized
gagaaaggcgtgaacccggg

SEQ ID NO: 324342 - DNA, 20 bp, Artificial Sequence
  chemically synthesized
aaaggcgtgaacccgggagg

SEQ ID NO: 324343 - DNA, 20 bp, Artificial Sequence
  chemically synthesized
cactgcaagctccgcctccc

SEQ ID NO: 324344 - DNA, 20 bp, Artificial Sequence
  chemically synthesized
aggcgtgaacccgggaggcg

SEQ ID NO: 324345 - DNA, 20 bp, Artificial Sequence
  chemically synthesized
tcactgcaagctccgcctcc

SEQ ID NO: 324346 - DNA, 20 bp, Artificial Sequence
  chemically synthesized
aacccgggaggcggagcttg

SEQ ID NO: 324347 - DNA, 20 bp, Artificial Sequence
  chemically synthesized
cgggaggcggagcttgcagt

SEQ ID NO: 324348 - DNA, 20 bp, Artificial Sequence
  chemically synthesized
gcgctttctcggctcactgc

SEQ ID NO: 324349 - DNA, 20 bp, Artificial Sequence
  chemically synthesized
ggcggagcttgcagtgagcc

SEQ ID NO: 324350 - DNA, 20 bp, Artificial Sequence
  chemically synthesized
gagcttgcagtgagccgaga

SEQ ID NO: 324351 - DNA, 20 bp, Artificial Sequence
  chemically synthesized
ggagtgcagtggcgctttct

SEQ ID NO: 324352 - DNA, 20 bp, Artificial Sequence
  chemically synthesized
ttgcccaggccggagtgcag

SEQ ID NO: 324353 - DNA, 20 bp, Artificial Sequence
  chemically synthesized
gagaaagcgccactgcactc

SEQ ID NO: 324354 - DNA, 20 bp, Artificial Sequence
  chemically synthesized
gttttgcccaggccggagtg

SEQ ID NO: 324355 - DNA, 20 bp, Artificial Sequence
  chemically synthesized
agcgccactgcactccggcc

SEQ ID NO: 324356 - DNA, 20 bp, Artificial Sequence
  chemically synthesized
gcgccactgcactccggcct

SEQ ID NO: 324357 - DNA, 20 bp, Artificial Sequence
  chemically synthesized
ttgctgttttgcccaggccg

SEQ ID NO: 324358 - DNA, 20 bp, Artificial Sequence
  chemically synthesized
tcttgctgttttgcccaggc

SEQ ID NO: 324359 - DNA, 20 bp, Artificial Sequence
  chemically synthesized
ggagtcttgctgttttgccc

SEQ ID NO: 324360 - DNA, 20 bp, Artificial Sequence
  chemically synthesized
gcactccggcctgggcaaaa

SEQ ID NO: 324361 - DNA, 20 bp, Artificial Sequence
  chemically synthesized
cggagtcttgctgttttgcc

SEQ ID NO: 324362 - DNA, 20 bp, Artificial Sequence
  chemically synthesized
tccggcctgggcaaaacagc

SEQ ID NO: 324363 - DNA, 20 bp, Artificial Sequence
  chemically synthesized
ttttttttttaaaagagacg

SEQ ID NO: 324364 - DNA, 20 bp, Artificial Sequence
  chemically synthesized
ttttttttttttaaaagaga

SEQ ID NO: 324365 - DNA, 20 bp, Artificial Sequence
  chemically synthesized
ttttttttttttttttaaaa

SEQ ID NO: 324366 - DNA, 20 bp, Artificial Sequence
  chemically synthesized
ttttttttttttttttttaa

SEQ ID NO: 324367 - DNA, 20 bp, Artificial Sequence
  chemically synthesized
aaaaaaaaaaaaaaaaaaaa

SEQ ID NO: 324368 - DNA, 20 bp, Artificial Sequence
  chemically synthesized
aaaaaaaaaaaaaaaaaaaa

SEQ ID NO: 324369 - DNA, 20 bp, Artificial Sequence
  chemically synthesized
aaaaaaaaaaaaaaaggtga

SEQ ID NO: 324370 - DNA, 20 bp, Artificial Sequence
  chemically synthesized
aaaaaaaaaaaaaggtgaaa

SEQ ID NO: 324371 - DNA, 20 bp, Artificial Sequence
  chemically synthesized
aaaaaaaaaaggtgaaagag

SEQ ID NO: 324372 - DNA, 20 bp, Artificial Sequence
  chemically synthesized
aaaaaaggtgaaagagcaga

SEQ ID NO: 324373 - DNA, 20 bp, Artificial Sequence
  chemically synthesized
aaaaaggtgaaagagcagaa

SEQ ID NO: 324374 - DNA, 20 bp, Artificial Sequence
  chemically synthesized
aaaggtgaaagagcagaaag

SEQ ID NO: 324375 - DNA, 20 bp, Artificial Sequence
  chemically synthesized
gtgaaagagcagaaaggaga

SEQ ID NO: 324376 - DNA, 20 bp, Artificial Sequence
  chemically synthesized
tgaaagagcagaaaggagaa

SEQ ID NO: 324377 - DNA, 20 bp, Artificial Sequence
  chemically synthesized
aaggagaaaggtaaaaaaat

SEQ ID NO: 324378 - DNA, 20 bp, Artificial Sequence
  chemically synthesized
aggagaaaggtaaaaaaatc

SEQ ID NO: 324379 - DNA, 20 bp, Artificial Sequence
  chemically synthesized
ggagaaaggtaaaaaaatca

SEQ ID NO: 324380 - DNA, 20 bp, Artificial Sequence
  chemically synthesized
gggatgataaatgactgttt

SEQ ID NO: 324381 - DNA, 20 bp, Artificial Sequence
  chemically synthesized
tagacattgctggactaaaa

SEQ ID NO: 324382 - DNA, 20 bp, Artificial Sequence
  chemically synthesized
gataaatgactgttttagtc

SEQ ID NO: 324383 - DNA, 20 bp, Artificial Sequence
  chemically synthesized
gagatttttctagacattgc

SEQ ID NO: 324384 - DNA, 20 bp, Artificial Sequence
  chemically synthesized
tgttttagtccagcaatgtc

SEQ ID NO: 324385 - DNA, 20 bp, Artificial Sequence
  chemically synthesized
tgagtgtctagagatttttc

SEQ ID NO: 324386 - DNA, 20 bp, Artificial Sequence
  chemically synthesized
gcaatgtctagaaaaatctc

SEQ ID NO: 324387 - DNA, 20 bp, Artificial Sequence
  chemically synthesized
tctccagaaatgagtgtcta

SEQ ID NO: 324388 - DNA, 20 bp, Artificial Sequence
  chemically synthesized
tgtctccagaaatgagtgtc

SEQ ID NO: 324389 - DNA, 20 bp, Artificial Sequence
  chemically synthesized
aatctctagacactcatttc

SEQ ID NO: 324390 - DNA, 20 bp, Artificial Sequence
  chemically synthesized
tctctagacactcatttctg

SEQ ID NO: 324391 - DNA, 20 bp, Artificial Sequence
  chemically synthesized
tagaaattgtctccagaaat

SEQ ID NO: 324392 - DNA, 20 bp, Artificial Sequence
  chemically synthesized
ttatgactagaaattgtctc

SEQ ID NO: 324393 - DNA, 20 bp, Artificial Sequence
  chemically synthesized
tcatttctggagacaatttc

SEQ ID NO: 324394 - DNA, 20 bp, Artificial Sequence
  chemically synthesized
ctacgagtagaaattatgac

SEQ ID NO: 324395 - DNA, 20 bp, Artificial Sequence
  chemically synthesized
ctagtcataatttctactcg

SEQ ID NO: 324396 - DNA, 20 bp, Artificial Sequence
  chemically synthesized
agtcagagaaattctacgag

SEQ ID NO: 324397 - DNA, 20 bp, Artificial Sequence
  chemically synthesized
tctagtcagagaaattctac

SEQ ID NO: 324398 - DNA, 20 bp, Artificial Sequence
  chemically synthesized
actcgtagaatttctctgac

SEQ ID NO: 324399 - DNA, 20 bp, Artificial Sequence
  chemically synthesized
attagaaccatttctagtca

SEQ ID NO: 324400 - DNA, 20 bp, Artificial Sequence
  chemically synthesized
tcattagaaccatttctagt

SEQ ID NO: 324401 - DNA, 20 bp, Artificial Sequence
  chemically synthesized
agaatttctctgactagaaa

SEQ ID NO: 324402 - DNA, 20 bp, Artificial Sequence
  chemically synthesized
tacttcattagaaccatttc

SEQ ID NO: 324403 - DNA, 20 bp, Artificial Sequence
  chemically synthesized
gactagaaatggttctaatg

SEQ ID NO: 324404 - DNA, 20 bp, Artificial Sequence
  chemically synthesized
gctattgctgtatacttcat

SEQ ID NO: 324405 - DNA, 20 bp, Artificial Sequence
  chemically synthesized
aatggttctaatgaagtata

SEQ ID NO: 324406 - DNA, 20 bp, Artificial Sequence
  chemically synthesized
tctaatgaagtatacagcaa

SEQ ID NO: 324407 - DNA, 20 bp, Artificial Sequence
  chemically synthesized
ttatatattcagaagtatca

SEQ ID NO: 324408 - DNA, 20 bp, Artificial Sequence
  chemically synthesized
tttatatattcagaagtatc

SEQ ID NO: 324409 - DNA, 20 bp, Artificial Sequence
  chemically synthesized
aaatatatttatatattcag

SEQ ID NO: 324410 - DNA, 20 bp, Artificial Sequence
  chemically synthesized
ttaaaatatatttatatatt

SEQ ID NO: 324411 - DNA, 20 bp, Artificial Sequence
  chemically synthesized
tataaatatattttaaaatc

SEQ ID NO: 324412 - DNA, 20 bp, Artificial Sequence
  chemically synthesized
agatcagacagatagtaaac

SEQ ID NO: 324413 - DNA, 20 bp, Artificial Sequence
  chemically synthesized
aatacccaagatcagacaga

SEQ ID NO: 324414 - DNA, 20 bp, Artificial Sequence
  chemically synthesized
gttaaatacccaagatcaga

SEQ ID NO: 324415 - DNA, 20 bp, Artificial Sequence
  chemically synthesized
gtttactatctgtctgatct

SEQ ID NO: 324416 - DNA, 20 bp, Artificial Sequence
  chemically synthesized
tttactatctgtctgatctt

SEQ ID NO: 324417 - DNA, 20 bp, Artificial Sequence
  chemically synthesized
agaggttaaatacccaagat

SEQ ID NO: 324418 - DNA, 20 bp, Artificial Sequence
  chemically synthesized
tgcagagaggttaaataccc

SEQ ID NO: 324419 - DNA, 20 bp, Artificial Sequence
  chemically synthesized
ggggtaactgagatgcagag

SEQ ID NO: 324420 - DNA, 20 bp, Artificial Sequence
  chemically synthesized
tggggtaactgagatgcaga

SEQ ID NO: 324421 - DNA, 20 bp, Artificial Sequence
  chemically synthesized
tatttaacctctctgcatct

SEQ ID NO: 324422 - DNA, 20 bp, Artificial Sequence
  chemically synthesized
gatggggtaactgagatgca

SEQ ID NO: 324423 - DNA, 20 bp, Artificial Sequence
  chemically synthesized
tagatggggtaactgagatg

SEQ ID NO: 324424 - DNA, 20 bp, Artificial Sequence
  chemically synthesized
gttttatagatggggtaact

SEQ ID NO: 324425 - DNA, 20 bp, Artificial Sequence
  chemically synthesized
tttttcttgttttatagatg

SEQ ID NO: 324426 - DNA, 20 bp, Artificial Sequence
  chemically synthesized
atttttcttgttttatagat

SEQ ID NO: 324427 - DNA, 20 bp, Artificial Sequence
  chemically synthesized
tatttttcttgttttataga

SEQ ID NO: 324428 - DNA, 20 bp, Artificial Sequence
  chemically synthesized
agttaccccatctataaaac

SEQ ID NO: 324429 - DNA, 20 bp, Artificial Sequence
  chemically synthesized
tttttatttttcttgtttta

SEQ ID NO: 324430 - DNA, 20 bp, Artificial Sequence
  chemically synthesized
aaataaaaatatacgtacgt

SEQ ID NO: 324431 - DNA, 20 bp, Artificial Sequence
  chemically synthesized
aataaaaatatacgtacgta

SEQ ID NO: 324432 - DNA, 20 bp, Artificial Sequence
  chemically synthesized
atatacgtacgtaaggctgc

SEQ ID NO: 324433 - DNA, 20 bp, Artificial Sequence
  chemically synthesized
acgtacgtaaggctgctgga

SEQ ID NO: 324434 - DNA, 20 bp, Artificial Sequence
  chemically synthesized
atctcatctaatctttccag

SEQ ID NO: 324435 - DNA, 20 bp, Artificial Sequence
  chemically synthesized
cgtaaggctgctggaaagat

SEQ ID NO: 324436 - DNA, 20 bp, Artificial Sequence
  chemically synthesized
actatctcatctaatctttc

SEQ ID NO: 324437 - DNA, 20 bp, Artificial Sequence
  chemically synthesized
ggctgctggaaagattagat

SEQ ID NO: 324438 - DNA, 20 bp, Artificial Sequence
  chemically synthesized
gctggaaagattagatgaga

SEQ ID NO: 324439 - DNA, 20 bp, Artificial Sequence
  chemically synthesized
gatagtgcatataaaatgct

SEQ ID NO: 324440 - DNA, 20 bp, Artificial Sequence
  chemically synthesized
cttgggatctagaatgtgct

SEQ ID NO: 324441 - DNA, 20 bp, Artificial Sequence
  chemically synthesized
ataaaatgctaagcacattc

SEQ ID NO: 324442 - DNA, 20 bp, Artificial Sequence
  chemically synthesized
ctaagcacattctagatccc

SEQ ID NO: 324443 - DNA, 20 bp, Artificial Sequence
  chemically synthesized
gcagagcatttcttgggatc

SEQ ID NO: 324444 - DNA, 20 bp, Artificial Sequence
  chemically synthesized
ggcattgcagagcatttctt

SEQ ID NO: 324445 - DNA, 20 bp, Artificial Sequence
  chemically synthesized
aggcattgcagagcatttct

SEQ ID NO: 324446 - DNA, 20 bp, Artificial Sequence
  chemically synthesized
ccccaaacacaggcattgca

SEQ ID NO: 324447 - DNA, 20 bp, Artificial Sequence
  chemically synthesized
gcccccaaacacaggcattg

SEQ ID NO: 324448 - DNA, 20 bp, Artificial Sequence
  chemically synthesized
tgctctgcaatgcctgtgtt

SEQ ID NO: 324449 - DNA, 20 bp, Artificial Sequence
  chemically synthesized
gctctgcaatgcctgtgttt

SEQ ID NO: 324450 - DNA, 20 bp, Artificial Sequence
  chemically synthesized
ctctgcaatgcctgtgtttg

SEQ ID NO: 324451 - DNA, 20 bp, Artificial Sequence
  chemically synthesized
gaactttggcccccaaacac

SEQ ID NO: 324452 - DNA, 20 bp, Artificial Sequence
  chemically synthesized
tctgcaatgcctgtgtttgg

SEQ ID NO: 324453 - DNA, 20 bp, Artificial Sequence
  chemically synthesized
tgaactttggcccccaaaca

SEQ ID NO: 324454 - DNA, 20 bp, Artificial Sequence
  chemically synthesized
atgcctgtgtttgggggcca

SEQ ID NO: 324455 - DNA, 20 bp, Artificial Sequence
  chemically synthesized
tttatcatttcaatgaactt

SEQ ID NO: 324456 - DNA, 20 bp, Artificial Sequence
  chemically synthesized
gaaatgataaatgattttta

SEQ ID NO: 324457 - DNA, 20 bp, Artificial Sequence
  chemically synthesized
aaatgataaatgatttttat

SEQ ID NO: 324458 - DNA, 20 bp, Artificial Sequence
  chemically synthesized
aatgataaatgatttttatg

SEQ ID NO: 324459 - DNA, 20 bp, Artificial Sequence
  chemically synthesized
aaatgatttttatggggaaa

SEQ ID NO: 324460 - DNA, 20 bp, Artificial Sequence
  chemically synthesized
aatgatttttatggggaaac

SEQ ID NO: 324461 - DNA, 20 bp, Artificial Sequence
  chemically synthesized
ttatggggaaacaggtgaat

SEQ ID NO: 324462 - DNA, 20 bp, Artificial Sequence
  chemically synthesized
catgcttccagaaacacaca

SEQ ID NO: 324463 - DNA, 20 bp, Artificial Sequence
  chemically synthesized
atcatgcttccagaaacaca

SEQ ID NO: 324464 - DNA, 20 bp, Artificial Sequence
  chemically synthesized
gaatgagctctgtgtgtttc

SEQ ID NO: 324465 - DNA, 20 bp, Artificial Sequence
  chemically synthesized
tgagctctgtgtgtttctgg

SEQ ID NO: 324466 - DNA, 20 bp, Artificial Sequence
  chemically synthesized
aattgcccaaatcatgcttc

SEQ ID NO: 324467 - DNA, 20 bp, Artificial Sequence
  chemically synthesized
gtgtttctggaagcatgatt

SEQ ID NO: 324468 - DNA, 20 bp, Artificial Sequence
  chemically synthesized
tgtttctggaagcatgattt

SEQ ID NO: 324469 - DNA, 20 bp, Artificial Sequence
  chemically synthesized
tgatttgggcaattcaaact

SEQ ID NO: 324470 - DNA, 20 bp, Artificial Sequence
  chemically synthesized
tgggcaattcaaactgagat

SEQ ID NO: 324471 - DNA, 20 bp, Artificial Sequence
  chemically synthesized
agccacttgattacttatct

SEQ ID NO: 324472 - DNA, 20 bp, Artificial Sequence
  chemically synthesized
tcaaactgagataagtaatc

SEQ ID NO: 324473 - DNA, 20 bp, Artificial Sequence
  chemically synthesized
aactgagataagtaatcaag

SEQ ID NO: 324474 - DNA, 20 bp, Artificial Sequence
  chemically synthesized
agtaatcaagtggctacatg

SEQ ID NO: 324475 - DNA, 20 bp, Artificial Sequence
  chemically synthesized
gtaatcaagtggctacatgt

SEQ ID NO: 324476 - DNA, 20 bp, Artificial Sequence
  chemically synthesized
ctggtttcactacctacatg

SEQ ID NO: 324477 - DNA, 20 bp, Artificial Sequence
  chemically synthesized
atcaagtggctacatgtagg

SEQ ID NO: 324478 - DNA, 20 bp, Artificial Sequence
  chemically synthesized
ctacatgtaggtagtgaaac

SEQ ID NO: 324479 - DNA, 20 bp, Artificial Sequence
  chemically synthesized
catgtaggtagtgaaaccag

SEQ ID NO: 324480 - DNA, 20 bp, Artificial Sequence
  chemically synthesized
aggtagtgaaaccagcagcc

SEQ ID NO: 324481 - DNA, 20 bp, Artificial Sequence
  chemically synthesized
tttgtggtttgctgggctgc

SEQ ID NO: 324482 - DNA, 20 bp, Artificial Sequence
  chemically synthesized
taagagctttgtggtttgct

SEQ ID NO: 324483 - DNA, 20 bp, Artificial Sequence
  chemically synthesized
ctaagagctttgtggtttgc

SEQ ID NO: 324484 - DNA, 20 bp, Artificial Sequence
  chemically synthesized
cagcagcccagcaaaccaca

SEQ ID NO: 324485 - DNA, 20 bp, Artificial Sequence
  chemically synthesized
tattttttctaagagctttg

SEQ ID NO: 324486 - DNA, 20 bp, Artificial Sequence
  chemically synthesized
ccagcaaaccacaaagctct

SEQ ID NO: 324487 - DNA, 20 bp, Artificial Sequence
  chemically synthesized
gtcccagctattttttctaa

SEQ ID NO: 324488 - DNA, 20 bp, Artificial Sequence
  chemically synthesized
gtgtcccagctattttttct

SEQ ID NO: 324489 - DNA, 20 bp, Artificial Sequence
  chemically synthesized
cacaaagctcttagaaaaaa

SEQ ID NO: 324490 - DNA, 20 bp, Artificial Sequence
  chemically synthesized
aagctcttagaaaaaatagc

SEQ ID NO: 324491 - DNA, 20 bp, Artificial Sequence
  chemically synthesized
agctcttagaaaaaatagct

SEQ ID NO: 324492 - DNA, 20 bp, Artificial Sequence
  chemically synthesized
tgtgccctctcatagtgtcc

SEQ ID NO: 324493 - DNA, 20 bp, Artificial Sequence
  chemically synthesized
aaaaatagctgggacactat

SEQ ID NO: 324494 - DNA, 20 bp, Artificial Sequence
  chemically synthesized
aaatagctgggacactatga

SEQ ID NO: 324495 - DNA, 20 bp, Artificial Sequence
  chemically synthesized
aatagctgggacactatgag

SEQ ID NO: 324496 - DNA, 20 bp, Artificial Sequence
  chemically synthesized
atagctgggacactatgaga

SEQ ID NO: 324497 - DNA, 20 bp, Artificial Sequence
  chemically synthesized
tgatagactgtgccctctca

SEQ ID NO: 324498 - DNA, 20 bp, Artificial Sequence
  chemically synthesized
tgggacactatgagagggca

SEQ ID NO: 324499 - DNA, 20 bp, Artificial Sequence
  chemically synthesized
agagggcacagtctatcact

SEQ ID NO: 324500 - DNA, 20 bp, Artificial Sequence
  chemically synthesized
gatataaaactgctcagtga

SEQ ID NO: 324501 - DNA, 20 bp, Artificial Sequence
  chemically synthesized
gggcacagtctatcactgag

SEQ ID NO: 324502 - DNA, 20 bp, Artificial Sequence
  chemically synthesized
atcagtgatataaaactgct

SEQ ID NO: 324503 - DNA, 20 bp, Artificial Sequence
  chemically synthesized
gttttatatcactgataaaa

SEQ ID NO: 324504 - DNA, 20 bp, Artificial Sequence
  chemically synthesized
attgccaaaatccattttat

SEQ ID NO: 324505 - DNA, 20 bp, Artificial Sequence
  chemically synthesized
atcactgataaaatggattt

SEQ ID NO: 324506 - DNA, 20 bp, Artificial Sequence
  chemically synthesized
tttggcaatttatctaaatt

SEQ ID NO: 324507 - DNA, 20 bp, Artificial Sequence
  chemically synthesized
tcatactttaaggctgaatt

SEQ ID NO: 324508 - DNA, 20 bp, Artificial Sequence
  chemically synthesized
tttatctaaattcagcctta

SEQ ID NO: 324509 - DNA, 20 bp, Artificial Sequence
  chemically synthesized
aacagtcgtatcatacttta

SEQ ID NO: 324510 - DNA, 20 bp, Artificial Sequence
  chemically synthesized
taacagtcgtatcatacttt

SEQ ID NO: 324511 - DNA, 20 bp, Artificial Sequence
  chemically synthesized
gtatgatacgactgttaacc

SEQ ID NO: 324512 - DNA, 20 bp, Artificial Sequence
  chemically synthesized
ctgtttttgatccaggttaa

SEQ ID NO: 324513 - DNA, 20 bp, Artificial Sequence
  chemically synthesized
aataaaactgtttttgatcc

SEQ ID NO: 324514 - DNA, 20 bp, Artificial Sequence
  chemically synthesized
caataaaactgtttttgatc

SEQ ID NO: 324515 - DNA, 20 bp, Artificial Sequence
  chemically synthesized
ctgttaacctggatcaaaaa

SEQ ID NO: 324516 - DNA, 20 bp, Artificial Sequence
  chemically synthesized
tggatcaaaaacagttttat

SEQ ID NO: 324517 - DNA, 20 bp, Artificial Sequence
  chemically synthesized
cttgaagcatttatgcattc

SEQ ID NO: 324518 - DNA, 20 bp, Artificial Sequence
  chemically synthesized
cttgaatgcataaatgcttc

SEQ ID NO: 324519 - DNA, 20 bp, Artificial Sequence
  chemically synthesized
aaaatttgcaaatgttcttg

SEQ ID NO: 324520 - DNA, 20 bp, Artificial Sequence
  chemically synthesized
tttgcaaattttatcattct

SEQ ID NO: 324521 - DNA, 20 bp, Artificial Sequence
  chemically synthesized
atgatacatttaaatgaact

SEQ ID NO: 324522 - DNA, 20 bp, Artificial Sequence
  chemically synthesized
acttagactccatgaaaaag

SEQ ID NO: 324523 - DNA, 20 bp, Artificial Sequence
  chemically synthesized
tgtatcatacttctttttca

SEQ ID NO: 324524 - DNA, 20 bp, Artificial Sequence
  chemically synthesized
tatcatacttctttttcatg

SEQ ID NO: 324525 - DNA, 20 bp, Artificial Sequence
  chemically synthesized
ttgacttagactccatgaaa

SEQ ID NO: 324526 - DNA, 20 bp, Artificial Sequence
  chemically synthesized
acttctttttcatggagtct

SEQ ID NO: 324527 - DNA, 20 bp, Artificial Sequence
  chemically synthesized
tcaccatccatgcattgact

SEQ ID NO: 324528 - DNA, 20 bp, Artificial Sequence
  chemically synthesized
atggagtctaagtcaatgca

SEQ ID NO: 324529 - DNA, 20 bp, Artificial Sequence
  chemically synthesized
agtctaagtcaatgcatgga

SEQ ID NO: 324530 - DNA, 20 bp, Artificial Sequence
  chemically synthesized
tgcatggatggtgaattttt

SEQ ID NO: 324531 - DNA, 20 bp, Artificial Sequence
  chemically synthesized
actgaggggtaaaaagatta

SEQ ID NO: 324532 - DNA, 20 bp, Artificial Sequence
  chemically synthesized
atcttttactgaggggtaaa

SEQ ID NO: 324533 - DNA, 20 bp, Artificial Sequence
  chemically synthesized
tctataatctttttacccct

SEQ ID NO: 324534 - DNA, 20 bp, Artificial Sequence
  chemically synthesized
ggaaataatcttttactgag

SEQ ID NO: 324535 - DNA, 20 bp, Artificial Sequence
  chemically synthesized
atctttttacccctcagtaa

SEQ ID NO: 324536 - DNA, 20 bp, Artificial Sequence
  chemically synthesized
tggaaataatcttttactga

SEQ ID NO: 324537 - DNA, 20 bp, Artificial Sequence
  chemically synthesized
ttggaaataatcttttactg

SEQ ID NO: 324538 - DNA, 20 bp, Artificial Sequence
  chemically synthesized
cttggaaataatcttttact

SEQ ID NO: 324539 - DNA, 20 bp, Artificial Sequence
  chemically synthesized
ctcagtaaaagattatttcc

SEQ ID NO: 324540 - DNA, 20 bp, Artificial Sequence
  chemically synthesized
aaaagattatttccaagata

SEQ ID NO: 324541 - DNA, 20 bp, Artificial Sequence
  chemically synthesized
aaagattatttccaagataa

SEQ ID NO: 324542 - DNA, 20 bp, Artificial Sequence
  chemically synthesized
ccctctgtaatcctttatct

SEQ ID NO: 324543 - DNA, 20 bp, Artificial Sequence
  chemically synthesized
atttccaagataaaggatta

SEQ ID NO: 324544 - DNA, 20 bp, Artificial Sequence
  chemically synthesized
ttccaagataaaggattaca

SEQ ID NO: 324545 - DNA, 20 bp, Artificial Sequence
  chemically synthesized
tccaagataaaggattacag

SEQ ID NO: 324546 - DNA, 20 bp, Artificial Sequence
  chemically synthesized
ccaagataaaggattacaga

SEQ ID NO: 324547 - DNA, 20 bp, Artificial Sequence
  chemically synthesized
aggattacagagggataacc

SEQ ID NO: 324548 - DNA, 20 bp, Artificial Sequence
  chemically synthesized
attacagagggataaccaag

SEQ ID NO: 324549 - DNA, 20 bp, Artificial Sequence
  chemically synthesized
tatttagtgaaagaaccgct

SEQ ID NO: 324550 - DNA, 20 bp, Artificial Sequence
  chemically synthesized
gctcttctgttatttagtga

SEQ ID NO: 324551 - DNA, 20 bp, Artificial Sequence
  chemically synthesized
gcggttctttcactaaataa

SEQ ID NO: 324552 - DNA, 20 bp, Artificial Sequence
  chemically synthesized
agaaatgctcttctgttatt

SEQ ID NO: 324553 - DNA, 20 bp, Artificial Sequence
  chemically synthesized
gttctttcactaaataacag

SEQ ID NO: 324554 - DNA, 20 bp, Artificial Sequence
  chemically synthesized
tctttcactaaataacagaa

SEQ ID NO: 324555 - DNA, 20 bp, Artificial Sequence
  chemically synthesized
gaagagcatttctgaacaac

SEQ ID NO: 324556 - DNA, 20 bp, Artificial Sequence
  chemically synthesized
aagagcatttctgaacaacc

SEQ ID NO: 324557 - DNA, 20 bp, Artificial Sequence
  chemically synthesized
aggtactaatcctggttgtt

SEQ ID NO: 324558 - DNA, 20 bp, Artificial Sequence
  chemically synthesized
catttctgaacaaccaggat

SEQ ID NO: 324559 - DNA, 20 bp, Artificial Sequence
  chemically synthesized
atatttccaggtactaatcc

SEQ ID NO: 324560 - DNA, 20 bp, Artificial Sequence
  chemically synthesized
gaacaaccaggattagtacc

SEQ ID NO: 324561 - DNA, 20 bp, Artificial Sequence
  chemically synthesized
aatgtgtcaagaatatttcc

SEQ ID NO: 324562 - DNA, 20 bp, Artificial Sequence
  chemically synthesized
aaatgtgtcaagaatatttc

SEQ ID NO: 324563 - DNA, 20 bp, Artificial Sequence
  chemically synthesized
aaacacagcggaaatgtgtc

SEQ ID NO: 324564 - DNA, 20 bp, Artificial Sequence
  chemically synthesized
atatctgtgagaaaacacag

SEQ ID NO: 324565 - DNA, 20 bp, Artificial Sequence
  chemically synthesized
gttatatctgtgagaaaaca

SEQ ID NO: 324566 - DNA, 20 bp, Artificial Sequence
  chemically synthesized
atttccgctgtgttttctca

SEQ ID NO: 324567 - DNA, 20 bp, Artificial Sequence
  chemically synthesized
ggtttacgtgttatatctgt

SEQ ID NO: 324568 - DNA, 20 bp, Artificial Sequence
  chemically synthesized
acagatataacacgtaaacc

SEQ ID NO: 324569 - DNA, 20 bp, Artificial Sequence
  chemically synthesized
cagatataacacgtaaacca

SEQ ID NO: 324570 - DNA, 20 bp, Artificial Sequence
  chemically synthesized
ttatgctttgaatagtacct

SEQ ID NO: 324571 - DNA, 20 bp, Artificial Sequence
  chemically synthesized
gtaaaccaaggtactattca

SEQ ID NO: 324572 - DNA, 20 bp, Artificial Sequence
  chemically synthesized
aatcatttttatgctttgaa

SEQ ID NO: 324573 - DNA, 20 bp, Artificial Sequence
  chemically synthesized
aagcataaaaatgattactg

SEQ ID NO: 324574 - DNA, 20 bp, Artificial Sequence
  chemically synthesized
taatttctcataaatcactt

SEQ ID NO: 324575 - DNA, 20 bp, Artificial Sequence
  chemically synthesized
tgattactgaagtgatttat

SEQ ID NO: 324576 - DNA, 20 bp, Artificial Sequence
  chemically synthesized
tcatgtacagtgttgcatga

SEQ ID NO: 324577 - DNA, 20 bp, Artificial Sequence
  chemically synthesized
attaggttgaatgtcatgta

SEQ ID NO: 324578 - DNA, 20 bp, Artificial Sequence
  chemically synthesized
acctatttaatagtgtcatt

SEQ ID NO: 324579 - DNA, 20 bp, Artificial Sequence
  chemically synthesized
tacctatttaatagtgtcat

SEQ ID NO: 324580 - DNA, 20 bp, Artificial Sequence
  chemically synthesized
aacctaatgacactattaaa

SEQ ID NO: 324581 - DNA, 20 bp, Artificial Sequence
  chemically synthesized
acctaatgacactattaaat

SEQ ID NO: 324582 - DNA, 20 bp, Artificial Sequence
  chemically synthesized
attaaaaattacctatttaa

SEQ ID NO: 324583 - DNA, 20 bp, Artificial Sequence
  chemically synthesized
taaataggtaatttttaata

SEQ ID NO: 324584 - DNA, 20 bp, Artificial Sequence
  chemically synthesized
taggtaatttttaatataga

SEQ ID NO: 324585 - DNA, 20 bp, Artificial Sequence
  chemically synthesized
aggtaatttttaatatagat

SEQ ID NO: 324586 - DNA, 20 bp, Artificial Sequence
  chemically synthesized
ggtaatttttaatatagata

SEQ ID NO: 324587 - DNA, 20 bp, Artificial Sequence
  chemically synthesized
tatagatagggcctgaaatt

SEQ ID NO: 324588 - DNA, 20 bp, Artificial Sequence
  chemically synthesized
ttaactttgaactcaatttc

SEQ ID NO: 324589 - DNA, 20 bp, Artificial Sequence
  chemically synthesized
cttaactttgaactcaattt

SEQ ID NO: 324590 - DNA, 20 bp, Artificial Sequence
  chemically synthesized
agggcctgaaattgagttca

SEQ ID NO: 324591 - DNA, 20 bp, Artificial Sequence
  chemically synthesized
ctgaaattgagttcaaagtt

SEQ ID NO: 324592 - DNA, 20 bp, Artificial Sequence
  chemically synthesized
gttcaaagttaagccctaat

SEQ ID NO: 324593 - DNA, 20 bp, Artificial Sequence
  chemically synthesized
ttcaaagttaagccctaatg

SEQ ID NO: 324594 - DNA, 20 bp, Artificial Sequence
  chemically synthesized
tttttcctaaatcctcatta

SEQ ID NO: 324595 - DNA, 20 bp, Artificial Sequence
  chemically synthesized
atttttcctaaatcctcatt

SEQ ID NO: 324596 - DNA, 20 bp, Artificial Sequence
  chemically synthesized
gatttttcctaaatcctcat

SEQ ID NO: 324597 - DNA, 20 bp, Artificial Sequence
  chemically synthesized
gttaagccctaatgaggatt

SEQ ID NO: 324598 - DNA, 20 bp, Artificial Sequence
  chemically synthesized
ttaagccctaatgaggattt

SEQ ID NO: 324599 - DNA, 20 bp, Artificial Sequence
  chemically synthesized
tgaggatttaggaaaaatca

SEQ ID NO: 324600 - DNA, 20 bp, Artificial Sequence
  chemically synthesized
gaaaaatcatggcctgctgt

SEQ ID NO: 324601 - DNA, 20 bp, Artificial Sequence
  chemically synthesized
aaaaatcatggcctgctgtt

SEQ ID NO: 324602 - DNA, 20 bp, Artificial Sequence
  chemically synthesized
aaaatcatggcctgctgtta

SEQ ID NO: 324603 - DNA, 20 bp, Artificial Sequence
  chemically synthesized
ttgattgttgccctaacagc

SEQ ID NO: 324604 - DNA, 20 bp, Artificial Sequence
  chemically synthesized
gttgattgttgccctaacag

SEQ ID NO: 324605 - DNA, 20 bp, Artificial Sequence
  chemically synthesized
gttgttgattgttgccctaa

SEQ ID NO: 324606 - DNA, 20 bp, Artificial Sequence
  chemically synthesized
tgctgttgtatatgcggtag

SEQ ID NO: 324607 - DNA, 20 bp, Artificial Sequence
  chemically synthesized
tattgctgttgtatatgcgg

SEQ ID NO: 324608 - DNA, 20 bp, Artificial Sequence
  chemically synthesized
tgttattgctgttgtatatg

SEQ ID NO: 324609 - DNA, 20 bp, Artificial Sequence
  chemically synthesized
aactactaccgcatatacaa

SEQ ID NO: 324610 - DNA, 20 bp, Artificial Sequence
  chemically synthesized
atatacaacagcaataacaa

SEQ ID NO: 324611 - DNA, 20 bp, Artificial Sequence
  chemically synthesized
aagtactcaataaataatgg

SEQ ID NO: 324612 - DNA, 20 bp, Artificial Sequence
  chemically synthesized
actaagtactcaataaataa

SEQ ID NO: 324613 - DNA, 20 bp, Artificial Sequence
  chemically synthesized
aacagctgccattatttatt

SEQ ID NO: 324614 - DNA, 20 bp, Artificial Sequence
  chemically synthesized
gccattatttattgagtact

SEQ ID NO: 324615 - DNA, 20 bp, Artificial Sequence
  chemically synthesized
atttattgagtacttagtgt

SEQ ID NO: 324616 - DNA, 20 bp, Artificial Sequence
  chemically synthesized
ttagcaaattgactgacact

SEQ ID NO: 324617 - DNA, 20 bp, Artificial Sequence
  chemically synthesized
tataatgcgtgttaagtgat

SEQ ID NO: 324618 - DNA, 20 bp, Artificial Sequence
  chemically synthesized
aaaatgatataatgcgtgtt

SEQ ID NO: 324619 - DNA, 20 bp, Artificial Sequence
  chemically synthesized
tatatcatttttcactacaa

SEQ ID NO: 324620 - DNA, 20 bp, Artificial Sequence
  chemically synthesized
tctatcaccctgatctgttg

SEQ ID NO: 324621 - DNA, 20 bp, Artificial Sequence
  chemically synthesized
catttttcactacaacagat

SEQ ID NO: 324622 - DNA, 20 bp, Artificial Sequence
  chemically synthesized
atttttcactacaacagatc

SEQ ID NO: 324623 - DNA, 20 bp, Artificial Sequence
  chemically synthesized
tttttcactacaacagatca

SEQ ID NO: 324624 - DNA, 20 bp, Artificial Sequence
  chemically synthesized
actacaacagatcagggtga

SEQ ID NO: 324625 - DNA, 20 bp, Artificial Sequence
  chemically synthesized
cagatcagggtgatagaaat

SEQ ID NO: 324626 - DNA, 20 bp, Artificial Sequence
  chemically synthesized
atcagggtgatagaaattag

SEQ ID NO: 324627 - DNA, 20 bp, Artificial Sequence
  chemically synthesized
tcagggtgatagaaattagt

SEQ ID NO: 324628 - DNA, 20 bp, Artificial Sequence
  chemically synthesized
gtgatagaaattagtaggat

SEQ ID NO: 324629 - DNA, 20 bp, Artificial Sequence
  chemically synthesized
tgatagaaattagtaggatg

SEQ ID NO: 324630 - DNA, 20 bp, Artificial Sequence
  chemically synthesized
aaattagtaggatgaggaaa

SEQ ID NO: 324631 - DNA, 20 bp, Artificial Sequence
  chemically synthesized
gtaggatgaggaaatggaaa

SEQ ID NO: 324632 - DNA, 20 bp, Artificial Sequence
  chemically synthesized
ggaaatggaaatagaaaaat

SEQ ID NO: 324633 - DNA, 20 bp, Artificial Sequence
  chemically synthesized
aaaaattagatgacttgcca

SEQ ID NO: 324634 - DNA, 20 bp, Artificial Sequence
  chemically synthesized
aaaattagatgacttgccaa

SEQ ID NO: 324635 - DNA, 20 bp, Artificial Sequence
  chemically synthesized
ttacctttgtgacctttggc

SEQ ID NO: 324636 - DNA, 20 bp, Artificial Sequence
  chemically synthesized
ccagttacctttgtgacctt

SEQ ID NO: 324637 - DNA, 20 bp, Artificial Sequence
  chemically synthesized
atgacttgccaaaggtcaca

SEQ ID NO: 324638 - DNA, 20 bp, Artificial Sequence
  chemically synthesized
tgacttgccaaaggtcacaa

SEQ ID NO: 324639 - DNA, 20 bp, Artificial Sequence
  chemically synthesized
ccaaaggtcacaaaggtaac

SEQ ID NO: 324640 - DNA, 20 bp, Artificial Sequence
  chemically synthesized
aaggtcacaaaggtaactgg

SEQ ID NO: 324641 - DNA, 20 bp, Artificial Sequence
  chemically synthesized
acaaaggtaactggtggttc

SEQ ID NO: 324642 - DNA, 20 bp, Artificial Sequence
  chemically synthesized
gttttaagtcccagaaccac

SEQ ID NO: 324643 - DNA, 20 bp, Artificial Sequence
  chemically synthesized
caaaggtaactggtggttct

SEQ ID NO: 324644 - DNA, 20 bp, Artificial Sequence
  chemically synthesized
aacaacctggttttaagtcc

SEQ ID NO: 324645 - DNA, 20 bp, Artificial Sequence
  chemically synthesized
gtggttctgggacttaaaac

SEQ ID NO: 324646 - DNA, 20 bp, Artificial Sequence
  chemically synthesized
tggttctgggacttaaaacc

SEQ ID NO: 324647 - DNA, 20 bp, Artificial Sequence
  chemically synthesized
aatccaaacaacctggtttt

SEQ ID NO: 324648 - DNA, 20 bp, Artificial Sequence
  chemically synthesized
ggacttaaaaccaggttgtt

SEQ ID NO: 324649 - DNA, 20 bp, Artificial Sequence
  chemically synthesized
gttttggaatccaaacaacc

SEQ ID NO: 324650 - DNA, 20 bp, Artificial Sequence
  chemically synthesized
attgggataaagacgtgttt

SEQ ID NO: 324651 - DNA, 20 bp, Artificial Sequence
  chemically synthesized
agattgatcatattgggata

SEQ ID NO: 324652 - DNA, 20 bp, Artificial Sequence
  chemically synthesized
ttaaagagattgatcatatt

SEQ ID NO: 324653 - DNA, 20 bp, Artificial Sequence
  chemically synthesized
tttaaagagattgatcatat

SEQ ID NO: 324654 - DNA, 20 bp, Artificial Sequence
  chemically synthesized
attcattttcttcatttaaa

SEQ ID NO: 324655 - DNA, 20 bp, Artificial Sequence
  chemically synthesized
atgatcaatctctttaaatg

SEQ ID NO: 324656 - DNA, 20 bp, Artificial Sequence
  chemically synthesized
taattcattttcttcattta

SEQ ID NO: 324657 - DNA, 20 bp, Artificial Sequence
  chemically synthesized
ttaaatgaagaaaatgaatt

SEQ ID NO: 324658 - DNA, 20 bp, Artificial Sequence
  chemically synthesized
aaatgaagaaaatgaattaa

SEQ ID NO: 324659 - DNA, 20 bp, Artificial Sequence
  chemically synthesized
agaaaatgaattaagagtct

SEQ ID NO: 324660 - DNA, 20 bp, Artificial Sequence
  chemically synthesized
tgaattaagagtctaagcaa

SEQ ID NO: 324661 - DNA, 20 bp, Artificial Sequence
  chemically synthesized
tttttaaaagtgctgttgct

SEQ ID NO: 324662 - DNA, 20 bp, Artificial Sequence
  chemically synthesized
gttatattatatttttttaa

SEQ ID NO: 324663 - DNA, 20 bp, Artificial Sequence
  chemically synthesized
caaaaaaacagaaaaaaaaa

SEQ ID NO: 324664 - DNA, 20 bp, Artificial Sequence
  chemically synthesized
ttttttttttctgttttttt

SEQ ID NO: 324665 - DNA, 20 bp, Artificial Sequence
  chemically synthesized
aatactcaatctcaaaaaaa

SEQ ID NO: 324666 - DNA, 20 bp, Artificial Sequence
  chemically synthesized
ttttctgtttttttgagatt

SEQ ID NO: 324667 - DNA, 20 bp, Artificial Sequence
  chemically synthesized
cactccagcctgggcaggaa

SEQ ID NO: 324668 - DNA, 20 bp, Artificial Sequence
  chemically synthesized
tgagtattgctcttcctgcc

SEQ ID NO: 324669 - DNA, 20 bp, Artificial Sequence
  chemically synthesized
gagtattgctcttcctgccc

SEQ ID NO: 324670 - DNA, 20 bp, Artificial Sequence
  chemically synthesized
tgcactccagcctgggcagg

SEQ ID NO: 324671 - DNA, 20 bp, Artificial Sequence
  chemically synthesized
cattgcactccagcctgggc

SEQ ID NO: 324672 - DNA, 20 bp, Artificial Sequence
  chemically synthesized
attgctcttcctgcccaggc

SEQ ID NO: 324673 - DNA, 20 bp, Artificial Sequence
  chemically synthesized
ccattgcactccagcctggg

SEQ ID NO: 324674 - DNA, 20 bp, Artificial Sequence
  chemically synthesized
tgctcttcctgcccaggctg

SEQ ID NO: 324675 - DNA, 20 bp, Artificial Sequence
  chemically synthesized
ccaccattgcactccagcct

SEQ ID NO: 324676 - DNA, 20 bp, Artificial Sequence
  chemically synthesized
cccaccattgcactccagcc

SEQ ID NO: 324677 - DNA, 20 bp, Artificial Sequence
  chemically synthesized
gagatcccaccattgcactc

SEQ ID NO: 324678 - DNA, 20 bp, Artificial Sequence
  chemically synthesized
ctgcccaggctggagtgcaa

SEQ ID NO: 324679 - DNA, 20 bp, Artificial Sequence
  chemically synthesized
cccaggctggagtgcaatgg

SEQ ID NO: 324680 - DNA, 20 bp, Artificial Sequence
  chemically synthesized
ccaggctggagtgcaatggt

SEQ ID NO: 324681 - DNA, 20 bp, Artificial Sequence
  chemically synthesized
ggagtgcaatggtgggatct

SEQ ID NO: 324682 - DNA, 20 bp, Artificial Sequence
  chemically synthesized
gggagaggctgcagtgagcc

SEQ ID NO: 324683 - DNA, 20 bp, Artificial Sequence
  chemically synthesized
ggtgggatctcggctcactg

SEQ ID NO: 324684 - DNA, 20 bp, Artificial Sequence
  chemically synthesized
cagaagggagaggctgcagt

SEQ ID NO: 324685 - DNA, 20 bp, Artificial Sequence
  chemically synthesized
aacccagaagggagaggctg

SEQ ID NO: 324686 - DNA, 20 bp, Artificial Sequence
  chemically synthesized
ggcttgaacccagaagggag

SEQ ID NO: 324687 - DNA, 20 bp, Artificial Sequence
  chemically synthesized
tcactgcagcctctcccttc

SEQ ID NO: 324688 - DNA, 20 bp, Artificial Sequence
  chemically synthesized
tggcttgaacccagaaggga

SEQ ID NO: 324689 - DNA, 20 bp, Artificial Sequence
  chemically synthesized
cactgcagcctctcccttct

SEQ ID NO: 324690 - DNA, 20 bp, Artificial Sequence
  chemically synthesized
aatggcttgaacccagaagg

SEQ ID NO: 324691 - DNA, 20 bp, Artificial Sequence
  chemically synthesized
agaatggcttgaacccagaa

SEQ ID NO: 324692 - DNA, 20 bp, Artificial Sequence
  chemically synthesized
gagaatggcttgaacccaga

SEQ ID NO: 324693 - DNA, 20 bp, Artificial Sequence
  chemically synthesized
ggagaatggcttgaacccag

SEQ ID NO: 324694 - DNA, 20 bp, Artificial Sequence
  chemically synthesized
agcctctcccttctgggttc

SEQ ID NO: 324695 - DNA, 20 bp, Artificial Sequence
  chemically synthesized
gcaggagaatggcttgaacc

SEQ ID NO: 324696 - DNA, 20 bp, Artificial Sequence
  chemically synthesized
gggaggctgaggcaggagaa

SEQ ID NO: 324697 - DNA, 20 bp, Artificial Sequence
  chemically synthesized
ttcaagccattctcctgcct

SEQ ID NO: 324698 - DNA, 20 bp, Artificial Sequence
  chemically synthesized
tactcgggaggctgaggcag

SEQ ID NO: 324699 - DNA, 20 bp, Artificial Sequence
  chemically synthesized
gctactcgggaggctgaggc

SEQ ID NO: 324700 - DNA, 20 bp, Artificial Sequence
  chemically synthesized
agctactcgggaggctgagg

SEQ ID NO: 324701 - DNA, 20 bp, Artificial Sequence
  chemically synthesized
cccagctactcgggaggctg

SEQ ID NO: 324702 - DNA, 20 bp, Artificial Sequence
  chemically synthesized
tcccagctactcgggaggct

SEQ ID NO: 324703 - DNA, 20 bp, Artificial Sequence
  chemically synthesized
ttctcctgcctcagcctccc

SEQ ID NO: 324704 - DNA, 20 bp, Artificial Sequence
  chemically synthesized
tcctgcctcagcctcccgag

SEQ ID NO: 324705 - DNA, 20 bp, Artificial Sequence
  chemically synthesized
tgtaatcccagctactcggg

SEQ ID NO: 324706 - DNA, 20 bp, Artificial Sequence
  chemically synthesized
ctgtaatcccagctactcgg

SEQ ID NO: 324707 - DNA, 20 bp, Artificial Sequence
  chemically synthesized
gcctcagcctcccgagtagc

SEQ ID NO: 324708 - DNA, 20 bp, Artificial Sequence
  chemically synthesized
gcctgtaatcccagctactc

SEQ ID NO: 324709 - DNA, 20 bp, Artificial Sequence
  chemically synthesized
cctcagcctcccgagtagct

SEQ ID NO: 324710 - DNA, 20 bp, Artificial Sequence
  chemically synthesized
tgcctgtaatcccagctact

SEQ ID NO: 324711 - DNA, 20 bp, Artificial Sequence
  chemically synthesized
ctcccgagtagctgggatta

SEQ ID NO: 324712 - DNA, 20 bp, Artificial Sequence
  chemically synthesized
tcccgagtagctgggattac

SEQ ID NO: 324713 - DNA, 20 bp, Artificial Sequence
  chemically synthesized
gtggcttgtgcctgtaatcc

SEQ ID NO: 324714 - DNA, 20 bp, Artificial Sequence
  chemically synthesized
gtagctgggattacaggcac

SEQ ID NO: 324715 - DNA, 20 bp, Artificial Sequence
  chemically synthesized
acaggcacaagccaccacac

SEQ ID NO: 324716 - DNA, 20 bp, Artificial Sequence
  chemically synthesized
caggcacaagccaccacacc

SEQ ID NO: 324717 - DNA, 20 bp, Artificial Sequence
  chemically synthesized
taaaaattagcccggtgtgg

SEQ ID NO: 324718 - DNA, 20 bp, Artificial Sequence
  chemically synthesized
atataaaaattagcccggtg

SEQ ID NO: 324719 - DNA, 20 bp, Artificial Sequence
  chemically synthesized
taaaaatataaaaattagcc

SEQ ID NO: 324720 - DNA, 20 bp, Artificial Sequence
  chemically synthesized
tctattaaaaatataaaaat

SEQ ID NO: 324721 - DNA, 20 bp, Artificial Sequence
  chemically synthesized
gctaatttttatatttttaa

SEQ ID NO: 324722 - DNA, 20 bp, Artificial Sequence
  chemically synthesized
taatttttatatttttaata

SEQ ID NO: 324723 - DNA, 20 bp, Artificial Sequence
  chemically synthesized
ttttatatttttaatagaga

SEQ ID NO: 324724 - DNA, 20 bp, Artificial Sequence
  chemically synthesized
tttatatttttaatagagac

SEQ ID NO: 324725 - DNA, 20 bp, Artificial Sequence
  chemically synthesized
ttatatttttaatagagaca

SEQ ID NO: 324726 - DNA, 20 bp, Artificial Sequence
  chemically synthesized
gagacagggtttcaacacgt

SEQ ID NO: 324727 - DNA, 20 bp, Artificial Sequence
  chemically synthesized
cagggtttcaacacgttggc

SEQ ID NO: 324728 - DNA, 20 bp, Artificial Sequence
  chemically synthesized
agggtttcaacacgttggcc

SEQ ID NO: 324729 - DNA, 20 bp, Artificial Sequence
  chemically synthesized
tttcaacacgttggccaggc

SEQ ID NO: 324730 - DNA, 20 bp, Artificial Sequence
  chemically synthesized
tcaggagtttgagaccagcc

SEQ ID NO: 324731 - DNA, 20 bp, Artificial Sequence
  chemically synthesized
tgaggtcaggagtttgagac

SEQ ID NO: 324732 - DNA, 20 bp, Artificial Sequence
  chemically synthesized
tgacctgaggtcaggagttt

SEQ ID NO: 324733 - DNA, 20 bp, Artificial Sequence
  chemically synthesized
tggtctcaaactcctgacct

SEQ ID NO: 324734 - DNA, 20 bp, Artificial Sequence
  chemically synthesized
ggcggatgacctgaggtcag

SEQ ID NO: 324735 - DNA, 20 bp, Artificial Sequence
  chemically synthesized
ggtctcaaactcctgacctc

SEQ ID NO: 324736 - DNA, 20 bp, Artificial Sequence
  chemically synthesized
tgggcggatgacctgaggtc

SEQ ID NO: 324737 - DNA, 20 bp, Artificial Sequence
  chemically synthesized
gtgggcggatgacctgaggt

SEQ ID NO: 324738 - DNA, 20 bp, Artificial Sequence
  chemically synthesized
tgaggtgggcggatgacctg

SEQ ID NO: 324739 - DNA, 20 bp, Artificial Sequence
  chemically synthesized
ctgaggtgggcggatgacct

SEQ ID NO: 324740 - DNA, 20 bp, Artificial Sequence
  chemically synthesized
ctcaggtcatccgcccacct

SEQ ID NO: 324741 - DNA, 20 bp, Artificial Sequence
  chemically synthesized
ctttgggaggctgaggtggg

SEQ ID NO: 324742 - DNA, 20 bp, Artificial Sequence
  chemically synthesized
gcactttgggaggctgaggt

SEQ ID NO: 324743 - DNA, 20 bp, Artificial Sequence
  chemically synthesized
agcactttgggaggctgagg

SEQ ID NO: 324744 - DNA, 20 bp, Artificial Sequence
  chemically synthesized
cccagcactttgggaggctg

SEQ ID NO: 324745 - DNA, 20 bp, Artificial Sequence
  chemically synthesized
tcccagcactttgggaggct

SEQ ID NO: 324746 - DNA, 20 bp, Artificial Sequence
  chemically synthesized
ccgcccacctcagcctccca

SEQ ID NO: 324747 - DNA, 20 bp, Artificial Sequence
  chemically synthesized
tgtaatcccagcactttggg

SEQ ID NO: 324748 - DNA, 20 bp, Artificial Sequence
  chemically synthesized
ctgtaatcccagcactttgg

SEQ ID NO: 324749 - DNA, 20 bp, Artificial Sequence
  chemically synthesized
acctcagcctcccaaagtgc

SEQ ID NO: 324750 - DNA, 20 bp, Artificial Sequence
  chemically synthesized
acctgtaatcccagcacttt

SEQ ID NO: 324751 - DNA, 20 bp, Artificial Sequence
  chemically synthesized
cctcagcctcccaaagtgct

SEQ ID NO: 324752 - DNA, 20 bp, Artificial Sequence
  chemically synthesized
cacctgtaatcccagcactt

SEQ ID NO: 324753 - DNA, 20 bp, Artificial Sequence
  chemically synthesized
ctcccaaagtgctgggatta

SEQ ID NO: 324754 - DNA, 20 bp, Artificial Sequence
  chemically synthesized
tcccaaagtgctgggattac

SEQ ID NO: 324755 - DNA, 20 bp, Artificial Sequence
  chemically synthesized
gtggctcacacctgtaatcc

SEQ ID NO: 324756 - DNA, 20 bp, Artificial Sequence
  chemically synthesized
agtgctgggattacaggtgt

SEQ ID NO: 324757 - DNA, 20 bp, Artificial Sequence
  chemically synthesized
gggattacaggtgtgagcca

SEQ ID NO: 324758 - DNA, 20 bp, Artificial Sequence
  chemically synthesized
caggtgtgagccacggtgtc

SEQ ID NO: 324759 - DNA, 20 bp, Artificial Sequence
  chemically synthesized
tacgtgagggccggacaccg

SEQ ID NO: 324760 - DNA, 20 bp, Artificial Sequence
  chemically synthesized
ttaagaagttacgtgagggc

SEQ ID NO: 324761 - DNA, 20 bp, Artificial Sequence
  chemically synthesized
atttttaagaagttacgtga

SEQ ID NO: 324762 - DNA, 20 bp, Artificial Sequence
  chemically synthesized
tatttttaagaagttacgtg

SEQ ID NO: 324763 - DNA, 20 bp, Artificial Sequence
  chemically synthesized
ttatttttaagaagttacgt

SEQ ID NO: 324764 - DNA, 20 bp, Artificial Sequence
  chemically synthesized
cactttgacttatttttaag

SEQ ID NO: 324765 - DNA, 20 bp, Artificial Sequence
  chemically synthesized
tcacgtaacttcttaaaaat

SEQ ID NO: 324766 - DNA, 20 bp, Artificial Sequence
  chemically synthesized
atacactttgacttattttt

SEQ ID NO: 324767 - DNA, 20 bp, Artificial Sequence
  chemically synthesized
aacttcttaaaaataagtca

SEQ ID NO: 324768 - DNA, 20 bp, Artificial Sequence
  chemically synthesized
tgattgaatttgtggaaatt

SEQ ID NO: 324769 - DNA, 20 bp, Artificial Sequence
  chemically synthesized
caaaccattgattgaatttg

SEQ ID NO: 324770 - DNA, 20 bp, Artificial Sequence
  chemically synthesized
atttccacaaattcaatcaa

SEQ ID NO: 324771 - DNA, 20 bp, Artificial Sequence
  chemically synthesized
cacaaattcaatcaatggtt

SEQ ID NO: 324772 - DNA, 20 bp, Artificial Sequence
  chemically synthesized
aaattcaatcaatggtttgg

SEQ ID NO: 324773 - DNA, 20 bp, Artificial Sequence
  chemically synthesized
atcaatggtttggaagctac

SEQ ID NO: 324774 - DNA, 20 bp, Artificial Sequence
  chemically synthesized
tcaatggtttggaagctact

SEQ ID NO: 324775 - DNA, 20 bp, Artificial Sequence
  chemically synthesized
aagacgaggtattttcctag

SEQ ID NO: 324776 - DNA, 20 bp, Artificial Sequence
  chemically synthesized
atgaagacgaggtattttcc

SEQ ID NO: 324777 - DNA, 20 bp, Artificial Sequence
  chemically synthesized
tcagcaacgtaatgaagacg

SEQ ID NO: 324778 - DNA, 20 bp, Artificial Sequence
  chemically synthesized
ctcagcaacgtaatgaagac

SEQ ID NO: 324779 - DNA, 20 bp, Artificial Sequence
  chemically synthesized
tcctactcagcaacgtaatg

SEQ ID NO: 324780 - DNA, 20 bp, Artificial Sequence
  chemically synthesized
ctcgtcttcattacgttgct

SEQ ID NO: 324781 - DNA, 20 bp, Artificial Sequence
  chemically synthesized
gtcttcattacgttgctgag

SEQ ID NO: 324782 - DNA, 20 bp, Artificial Sequence
  chemically synthesized
tcttcattacgttgctgagt

SEQ ID NO: 324783 - DNA, 20 bp, Artificial Sequence
  chemically synthesized
ttgacatttgatttcctact

SEQ ID NO: 324784 - DNA, 20 bp, Artificial Sequence
  chemically synthesized
tgagtaggaaatcaaatgtc

SEQ ID NO: 324785 - DNA, 20 bp, Artificial Sequence
  chemically synthesized
tgtgacttgcgtgcattatt

SEQ ID NO: 324786 - DNA, 20 bp, Artificial Sequence
  chemically synthesized
caagtctaaataatgcacgc

SEQ ID NO: 324787 - DNA, 20 bp, Artificial Sequence
  chemically synthesized
taaataatgcacgcaagtca

SEQ ID NO: 324788 - DNA, 20 bp, Artificial Sequence
  chemically synthesized
tatcttcctcagtgtgatat

SEQ ID NO: 324789 - DNA, 20 bp, Artificial Sequence
  chemically synthesized
acagacactgatatcacact

SEQ ID NO: 324790 - DNA, 20 bp, Artificial Sequence
  chemically synthesized
cagacactgatatcacactg

SEQ ID NO: 324791 - DNA, 20 bp, Artificial Sequence
  chemically synthesized
acactgatatcacactgagg

SEQ ID NO: 324792 - DNA, 20 bp, Artificial Sequence
  chemically synthesized
tggtattctggtatcttcct

SEQ ID NO: 324793 - DNA, 20 bp, Artificial Sequence
  chemically synthesized
tatcacactgaggaagatac

SEQ ID NO: 324794 - DNA, 20 bp, Artificial Sequence
  chemically synthesized
tgaggaagataccagaatac

SEQ ID NO: 324795 - DNA, 20 bp, Artificial Sequence
  chemically synthesized
ttgctgtctttctggtattc

SEQ ID NO: 324796 - DNA, 20 bp, Artificial Sequence
  chemically synthesized
gaagataccagaataccaga

SEQ ID NO: 324797 - DNA, 20 bp, Artificial Sequence
  chemically synthesized
ataccagaataccagaaaga

SEQ ID NO: 324798 - DNA, 20 bp, Artificial Sequence
  chemically synthesized
gtgtcccattgctgtctttc

SEQ ID NO: 324799 - DNA, 20 bp, Artificial Sequence
  chemically synthesized
gaataccagaaagacagcaa

SEQ ID NO: 324800 - DNA, 20 bp, Artificial Sequence
  chemically synthesized
aataccagaaagacagcaat

SEQ ID NO: 324801 - DNA, 20 bp, Artificial Sequence
  chemically synthesized
agaaagacagcaatgggaca

SEQ ID NO: 324802 - DNA, 20 bp, Artificial Sequence
  chemically synthesized
gacagcaatgggacacagcc

SEQ ID NO: 324803 - DNA, 20 bp, Artificial Sequence
  chemically synthesized
gcaatgggacacagcccaga

SEQ ID NO: 324804 - DNA, 20 bp, Artificial Sequence
  chemically synthesized
atgggacacagcccagatgg

SEQ ID NO: 324805 - DNA, 20 bp, Artificial Sequence
  chemically synthesized
ccgggtctgtactaccatct

SEQ ID NO: 324806 - DNA, 20 bp, Artificial Sequence
  chemically synthesized
accgggtctgtactaccatc

SEQ ID NO: 324807 - DNA, 20 bp, Artificial Sequence
  chemically synthesized
acacagcccagatggtagta

SEQ ID NO: 324808 - DNA, 20 bp, Artificial Sequence
  chemically synthesized
cccagatggtagtacagacc

SEQ ID NO: 324809 - DNA, 20 bp, Artificial Sequence
  chemically synthesized
tggataatggaggatttacc

SEQ ID NO: 324810 - DNA, 20 bp, Artificial Sequence
  chemically synthesized
atggataatggaggatttac

SEQ ID NO: 324811 - DNA, 20 bp, Artificial Sequence
  chemically synthesized
aaggacatcatggataatgg

SEQ ID NO: 324812 - DNA, 20 bp, Artificial Sequence
  chemically synthesized
taaggacatcatggataatg

SEQ ID NO: 324813 - DNA, 20 bp, Artificial Sequence
  chemically synthesized
aataaggacatcatggataa

SEQ ID NO: 324814 - DNA, 20 bp, Artificial Sequence
  chemically synthesized
agtgtgaaataaggacatca

SEQ ID NO: 324815 - DNA, 20 bp, Artificial Sequence
  chemically synthesized
cagacatgcagtgtgaaata

SEQ ID NO: 324816 - DNA, 20 bp, Artificial Sequence
  chemically synthesized
acagacatgcagtgtgaaat

SEQ ID NO: 324817 - DNA, 20 bp, Artificial Sequence
  chemically synthesized
gatgttttgatacagacatg

SEQ ID NO: 324818 - DNA, 20 bp, Artificial Sequence
  chemically synthesized
gtacatgagatgttttgata

SEQ ID NO: 324819 - DNA, 20 bp, Artificial Sequence
  chemically synthesized
tatgtatttatggggtacat

SEQ ID NO: 324820 - DNA, 20 bp, Artificial Sequence
  chemically synthesized
agtaggtgtatgtatttatg

SEQ ID NO: 324821 - DNA, 20 bp, Artificial Sequence
  chemically synthesized
tagtaggtgtatgtatttat

SEQ ID NO: 324822 - DNA, 20 bp, Artificial Sequence
  chemically synthesized
gtagtaggtgtatgtattta

SEQ ID NO: 324823 - DNA, 20 bp, Artificial Sequence
  chemically synthesized
aaatacatacacctactacg

SEQ ID NO: 324824 - DNA, 20 bp, Artificial Sequence
  chemically synthesized
aatttttgtggctacgtagt

SEQ ID NO: 324825 - DNA, 20 bp, Artificial Sequence
  chemically synthesized
aaatttttgtggctacgtag

SEQ ID NO: 324826 - DNA, 20 bp, Artificial Sequence
  chemically synthesized
tttaaatttttgtggctacg

SEQ ID NO: 324827 - DNA, 20 bp, Artificial Sequence
  chemically synthesized
aattatgttttaaatttttg

SEQ ID NO: 324828 - DNA, 20 bp, Artificial Sequence
  chemically synthesized
aatttaaaacataattttaa

SEQ ID NO: 324829 - DNA, 20 bp, Artificial Sequence
  chemically synthesized
cagttttttaaaaacataaa

SEQ ID NO: 324830 - DNA, 20 bp, Artificial Sequence
  chemically synthesized
tttaaaaacataaacagaaa

SEQ ID NO: 324831 - DNA, 20 bp, Artificial Sequence
  chemically synthesized
aaaaacataaacagaaaaag

SEQ ID NO: 324832 - DNA, 20 bp, Artificial Sequence
  chemically synthesized
acataaacagaaaaagaagt

SEQ ID NO: 324833 - DNA, 20 bp, Artificial Sequence
  chemically synthesized
taaacagaaaaagaagtcag

SEQ ID NO: 324834 - DNA, 20 bp, Artificial Sequence
  chemically synthesized
acagaaaaagaagtcagaag

SEQ ID NO: 324835 - DNA, 20 bp, Artificial Sequence
  chemically synthesized
aaaagaagtcagaagaagct

SEQ ID NO: 324836 - DNA, 20 bp, Artificial Sequence
  chemically synthesized
tgttagctttattttttgct

SEQ ID NO: 324837 - DNA, 20 bp, Artificial Sequence
  chemically synthesized
aagaagctgagcaaaaaata

SEQ ID NO: 324838 - DNA, 20 bp, Artificial Sequence
  chemically synthesized
ttcttttagaaagaatttgt

SEQ ID NO: 324839 - DNA, 20 bp, Artificial Sequence
  chemically synthesized
agctaacaaattctttctaa

SEQ ID NO: 324840 - DNA, 20 bp, Artificial Sequence
  chemically synthesized
gacacatgccttcttttaga

SEQ ID NO: 324841 - DNA, 20 bp, Artificial Sequence
  chemically synthesized
taacaaattctttctaaaag

SEQ ID NO: 324842 - DNA, 20 bp, Artificial Sequence
  chemically synthesized
aacaaattctttctaaaaga

SEQ ID NO: 324843 - DNA, 20 bp, Artificial Sequence
  chemically synthesized
acttgacacatgccttcttt

SEQ ID NO: 324844 - DNA, 20 bp, Artificial Sequence
  chemically synthesized
tctaaaagaaggcatgtgtc

SEQ ID NO: 324845 - DNA, 20 bp, Artificial Sequence
  chemically synthesized
aaggcgcagagttcgaatgg

SEQ ID NO: 324846 - DNA, 20 bp, Artificial Sequence
  chemically synthesized
cagaaggcgcagagttcgaa

SEQ ID NO: 324847 - DNA, 20 bp, Artificial Sequence
  chemically synthesized
agggattaacagaaggcgca

SEQ ID NO: 324848 - DNA, 20 bp, Artificial Sequence
  chemically synthesized
atagggattaacagaaggcg

SEQ ID NO: 324849 - DNA, 20 bp, Artificial Sequence
  chemically synthesized
aaatcatagggattaacaga

SEQ ID NO: 324850 - DNA, 20 bp, Artificial Sequence
  chemically synthesized
caaatcatagggattaacag

SEQ ID NO: 324851 - DNA, 20 bp, Artificial Sequence
  chemically synthesized
aggcaaatcatagggattaa

SEQ ID NO: 324852 - DNA, 20 bp, Artificial Sequence
  chemically synthesized
aacatcaaaggcaaatcata

SEQ ID NO: 324853 - DNA, 20 bp, Artificial Sequence
  chemically synthesized
taacatcaaaggcaaatcat

SEQ ID NO: 324854 - DNA, 20 bp, Artificial Sequence
  chemically synthesized
ttaacatcaaaggcaaatca

SEQ ID NO: 324855 - DNA, 20 bp, Artificial Sequence
  chemically synthesized
ttgctgacatttaacatcaa

SEQ ID NO: 324856 - DNA, 20 bp, Artificial Sequence
  chemically synthesized
tttgctgacatttaacatca

SEQ ID NO: 324857 - DNA, 20 bp, Artificial Sequence
  chemically synthesized
ttgcctttgatgttaaatgt

SEQ ID NO: 324858 - DNA, 20 bp, Artificial Sequence
  chemically synthesized
tgagtggttctgcaatagtg

SEQ ID NO: 324859 - DNA, 20 bp, Artificial Sequence
  chemically synthesized
tttaacattcttcactattg

SEQ ID NO: 324860 - DNA, 20 bp, Artificial Sequence
  chemically synthesized
ttctgtgagtggttctgcaa

SEQ ID NO: 324861 - DNA, 20 bp, Artificial Sequence
  chemically synthesized
cactattgcagaaccactca

SEQ ID NO: 324862 - DNA, 20 bp, Artificial Sequence
  chemically synthesized
caatgtagcatttctgtgag

SEQ ID NO: 324863 - DNA, 20 bp, Artificial Sequence
  chemically synthesized
gcacaatgtagcatttctgt

SEQ ID NO: 324864 - DNA, 20 bp, Artificial Sequence
  chemically synthesized
ggagcatcggaggcacaatg

SEQ ID NO: 324865 - DNA, 20 bp, Artificial Sequence
  chemically synthesized
cttcttaactggagcatcgg

SEQ ID NO: 324866 - DNA, 20 bp, Artificial Sequence
  chemically synthesized
tcttcttaactggagcatcg

SEQ ID NO: 324867 - DNA, 20 bp, Artificial Sequence
  chemically synthesized
acattgtgcctccgatgctc

SEQ ID NO: 324868 - DNA, 20 bp, Artificial Sequence
  chemically synthesized
tgtcttcttaactggagcat

SEQ ID NO: 324869 - DNA, 20 bp, Artificial Sequence
  chemically synthesized
gtgcctccgatgctccagtt

SEQ ID NO: 324870 - DNA, 20 bp, Artificial Sequence
  chemically synthesized
catttttgtcttcttaactg

SEQ ID NO: 324871 - DNA, 20 bp, Artificial Sequence
  chemically synthesized
cctccgatgctccagttaag

SEQ ID NO: 324872 - DNA, 20 bp, Artificial Sequence
  chemically synthesized
cccatttttgtcttcttaac

SEQ ID NO: 324873 - DNA, 20 bp, Artificial Sequence
  chemically synthesized
tccagttaagaagacaaaaa

SEQ ID NO: 324874 - DNA, 20 bp, Artificial Sequence
  chemically synthesized
ccagttaagaagacaaaaat

SEQ ID NO: 324875 - DNA, 20 bp, Artificial Sequence
  chemically synthesized
gggtatcatacgtacacata

SEQ ID NO: 324876 - DNA, 20 bp, Artificial Sequence
  chemically synthesized
ggtatcatacgtacacatat

SEQ ID NO: 324877 - DNA, 20 bp, Artificial Sequence
  chemically synthesized
gtatcatacgtacacatatg

SEQ ID NO: 324878 - DNA, 20 bp, Artificial Sequence
  chemically synthesized
cgtacacatatggggtattt

SEQ ID NO: 324879 - DNA, 20 bp, Artificial Sequence
  chemically synthesized
tttttaaaaatctcattcta

SEQ ID NO: 324880 - DNA, 20 bp, Artificial Sequence
  chemically synthesized
tgtttaataggctatagaat

SEQ ID NO: 324881 - DNA, 20 bp, Artificial Sequence
  chemically synthesized
accttttgtttaataggcta

SEQ ID NO: 324882 - DNA, 20 bp, Artificial Sequence
  chemically synthesized
tctagaaccttttgtttaat

SEQ ID NO: 324883 - DNA, 20 bp, Artificial Sequence
  chemically synthesized
ctctagaaccttttgtttaa

SEQ ID NO: 324884 - DNA, 20 bp, Artificial Sequence
  chemically synthesized
ttctatagcctattaaacaa

SEQ ID NO: 324885 - DNA, 20 bp, Artificial Sequence
  chemically synthesized
tctatagcctattaaacaaa

SEQ ID NO: 324886 - DNA, 20 bp, Artificial Sequence
  chemically synthesized
gcctattaaacaaaaggttc

SEQ ID NO: 324887 - DNA, 20 bp, Artificial Sequence
  chemically synthesized
ctattaaacaaaaggttcta

SEQ ID NO: 324888 - DNA, 20 bp, Artificial Sequence
  chemically synthesized
aagattaatgtttttggctc

SEQ ID NO: 324889 - DNA, 20 bp, Artificial Sequence
  chemically synthesized
aaaaaaaagattaatgtttt

SEQ ID NO: 324890 - DNA, 20 bp, Artificial Sequence
  chemically synthesized
gtatttaaagtataaaaaaa

SEQ ID NO: 324891 - DNA, 20 bp, Artificial Sequence
  chemically synthesized
tttttttatactttaaatac

SEQ ID NO: 324892 - DNA, 20 bp, Artificial Sequence
  chemically synthesized
cacatgtaccctagtattta

SEQ ID NO: 324893 - DNA, 20 bp, Artificial Sequence
  chemically synthesized
ttttttatactttaaatact

SEQ ID NO: 324894 - DNA, 20 bp, Artificial Sequence
  chemically synthesized
tttttatactttaaatacta

SEQ ID NO: 324895 - DNA, 20 bp, Artificial Sequence
  chemically synthesized
aacgttgtgcacatgtaccc

SEQ ID NO: 324896 - DNA, 20 bp, Artificial Sequence
  chemically synthesized
gggtacatgtgcacaacgtt

SEQ ID NO: 324897 - DNA, 20 bp, Artificial Sequence
  chemically synthesized
ggtacatgtgcacaacgttc

SEQ ID NO: 324898 - DNA, 20 bp, Artificial Sequence
  chemically synthesized
tatgtatacatgtgccatga

SEQ ID NO: 324899 - DNA, 20 bp, Artificial Sequence
  chemically synthesized
atgggtgtagcacaccatca

SEQ ID NO: 324900 - DNA, 20 bp, Artificial Sequence
  chemically synthesized
aaatgacgagttaatgggtg

SEQ ID NO: 324901 - DNA, 20 bp, Artificial Sequence
  chemically synthesized
atgttaaatgacgagttaat

SEQ ID NO: 324902 - DNA, 20 bp, Artificial Sequence
  chemically synthesized
gatgttaaatgacgagttaa

SEQ ID NO: 324903 - DNA, 20 bp, Artificial Sequence
  chemically synthesized
tatacctgatgttaaatgac

SEQ ID NO: 324904 - DNA, 20 bp, Artificial Sequence
  chemically synthesized
attaactcgtcatttaacat

SEQ ID NO: 324905 - DNA, 20 bp, Artificial Sequence
  chemically synthesized
ttaactcgtcatttaacatc

SEQ ID NO: 324906 - DNA, 20 bp, Artificial Sequence
  chemically synthesized
ggggggagggatagtattag

SEQ ID NO: 324907 - DNA, 20 bp, Artificial Sequence
  chemically synthesized
gaggggggagggatagtatt

SEQ ID NO: 324908 - DNA, 20 bp, Artificial Sequence
  chemically synthesized
ggaggggggagggatagtat

SEQ ID NO: 324909 - DNA, 20 bp, Artificial Sequence
  chemically synthesized
gtggggggaggggggaggga

SEQ ID NO: 324910 - DNA, 20 bp, Artificial Sequence
  chemically synthesized
tggggtggggggagggggga

SEQ ID NO: 324911 - DNA, 20 bp, Artificial Sequence
  chemically synthesized
gtggggtggggggagggggg

SEQ ID NO: 324912 - DNA, 20 bp, Artificial Sequence
  chemically synthesized
agtggggtggggggaggggg

SEQ ID NO: 324913 - DNA, 20 bp, Artificial Sequence
  chemically synthesized
gtagtggggtggggggaggg

SEQ ID NO: 324914 - DNA, 20 bp, Artificial Sequence
  chemically synthesized
cgtagtggggtggggggagg

SEQ ID NO: 324915 - DNA, 20 bp, Artificial Sequence
  chemically synthesized
ccgtagtggggtggggggag

SEQ ID NO: 324916 - DNA, 20 bp, Artificial Sequence
  chemically synthesized
cccgtagtggggtgggggga

SEQ ID NO: 324917 - DNA, 20 bp, Artificial Sequence
  chemically synthesized
tcccgtagtggggtgggggg

SEQ ID NO: 324918 - DNA, 20 bp, Artificial Sequence
  chemically synthesized
gtcccgtagtggggtggggg

SEQ ID NO: 324919 - DNA, 20 bp, Artificial Sequence
  chemically synthesized
gggtcccgtagtggggtggg

SEQ ID NO: 324920 - DNA, 20 bp, Artificial Sequence
  chemically synthesized
tgggtcccgtagtggggtgg

SEQ ID NO: 324921 - DNA, 20 bp, Artificial Sequence
  chemically synthesized
ctgggtcccgtagtggggtg

SEQ ID NO: 324922 - DNA, 20 bp, Artificial Sequence
  chemically synthesized
actgggtcccgtagtggggt

SEQ ID NO: 324923 - DNA, 20 bp, Artificial Sequence
  chemically synthesized
cactgggtcccgtagtgggg

SEQ ID NO: 324924 - DNA, 20 bp, Artificial Sequence
  chemically synthesized
cccctccccccaccccacta

SEQ ID NO: 324925 - DNA, 20 bp, Artificial Sequence
  chemically synthesized
ccctccccccaccccactac

SEQ ID NO: 324926 - DNA, 20 bp, Artificial Sequence
  chemically synthesized
acacactgggtcccgtagtg

SEQ ID NO: 324927 - DNA, 20 bp, Artificial Sequence
  chemically synthesized
cacacactgggtcccgtagt

SEQ ID NO: 324928 - DNA, 20 bp, Artificial Sequence
  chemically synthesized
tcacacactgggtcccgtag

SEQ ID NO: 324929 - DNA, 20 bp, Artificial Sequence
  chemically synthesized
ccccaccccactacgggacc

SEQ ID NO: 324930 - DNA, 20 bp, Artificial Sequence
  chemically synthesized
acatcacacactgggtcccg

SEQ ID NO: 324931 - DNA, 20 bp, Artificial Sequence
  chemically synthesized
gaaggggaacatcacacact

SEQ ID NO: 324932 - DNA, 20 bp, Artificial Sequence
  chemically synthesized
ggaaggggaacatcacacac

SEQ ID NO: 324933 - DNA, 20 bp, Artificial Sequence
  chemically synthesized
gaacccttggacacaggaag

SEQ ID NO: 324934 - DNA, 20 bp, Artificial Sequence
  chemically synthesized
agaacccttggacacaggaa

SEQ ID NO: 324935 - DNA, 20 bp, Artificial Sequence
  chemically synthesized
gagaacccttggacacagga

SEQ ID NO: 324936 - DNA, 20 bp, Artificial Sequence
  chemically synthesized
tgagaacccttggacacagg

SEQ ID NO: 324937 - DNA, 20 bp, Artificial Sequence
  chemically synthesized
atgttccccttcctgtgtcc

SEQ ID NO: 324938 - DNA, 20 bp, Artificial Sequence
  chemically synthesized
tgttccccttcctgtgtcca

SEQ ID NO: 324939 - DNA, 20 bp, Artificial Sequence
  chemically synthesized
caatgagaacccttggacac

SEQ ID NO: 324940 - DNA, 20 bp, Artificial Sequence
  chemically synthesized
gttccccttcctgtgtccaa

SEQ ID NO: 324941 - DNA, 20 bp, Artificial Sequence
  chemically synthesized
acaatgagaacccttggaca

SEQ ID NO: 324942 - DNA, 20 bp, Artificial Sequence
  chemically synthesized
aattgaacaatgagaaccct

SEQ ID NO: 324943 - DNA, 20 bp, Artificial Sequence
  chemically synthesized
atgggtgggaattgaacaat

SEQ ID NO: 324944 - DNA, 20 bp, Artificial Sequence
  chemically synthesized
attgttcaattcccacccat

SEQ ID NO: 324945 - DNA, 20 bp, Artificial Sequence
  chemically synthesized
acatgttctcactcatgggt

SEQ ID NO: 324946 - DNA, 20 bp, Artificial Sequence
  chemically synthesized
cacatgttctcactcatggg

SEQ ID NO: 324947 - DNA, 20 bp, Artificial Sequence
  chemically synthesized
ttcaattcccacccatgagt

SEQ ID NO: 324948 - DNA, 20 bp, Artificial Sequence
  chemically synthesized
taccacatgttctcactcat

SEQ ID NO: 324949 - DNA, 20 bp, Artificial Sequence
  chemically synthesized
ataccacatgttctcactca

SEQ ID NO: 324950 - DNA, 20 bp, Artificial Sequence
  chemically synthesized
cacccatgagtgagaacatg

SEQ ID NO: 324951 - DNA, 20 bp, Artificial Sequence
  chemically synthesized
gagtgagaacatgtggtatt

SEQ ID NO: 324952 - DNA, 20 bp, Artificial Sequence
  chemically synthesized
ttggttttttgtccttgcgt

SEQ ID NO: 324953 - DNA, 20 bp, Artificial Sequence
  chemically synthesized
attctcagcaagctaacgca

SEQ ID NO: 324954 - DNA, 20 bp, Artificial Sequence
  chemically synthesized
cattctcagcaagctaacgc

SEQ ID NO: 324955 - DNA, 20 bp, Artificial Sequence
  chemically synthesized
tgtccttgcgttagcttgct

SEQ ID NO: 324956 - DNA, 20 bp, Artificial Sequence
  chemically synthesized
tggagaccatcattctcagc

SEQ ID NO: 324957 - DNA, 20 bp, Artificial Sequence
  chemically synthesized
cgttagcttgctgagaatga

SEQ ID NO: 324958 - DNA, 20 bp, Artificial Sequence
  chemically synthesized
aagctggagaccatcattct

SEQ ID NO: 324959 - DNA, 20 bp, Artificial Sequence
  chemically synthesized
ttgctgagaatgatggtctc

SEQ ID NO: 324960 - DNA, 20 bp, Artificial Sequence
  chemically synthesized
tagggacatggatgaagctg

SEQ ID NO: 324961 - DNA, 20 bp, Artificial Sequence
  chemically synthesized
tgtagggacatggatgaagc

SEQ ID NO: 324962 - DNA, 20 bp, Artificial Sequence
  chemically synthesized
cctttgtagggacatggatg

SEQ ID NO: 324963 - DNA, 20 bp, Artificial Sequence
  chemically synthesized
tcatgtcctttgtagggaca

SEQ ID NO: 324964 - DNA, 20 bp, Artificial Sequence
  chemically synthesized
gcttcatccatgtccctaca

SEQ ID NO: 324965 - DNA, 20 bp, Artificial Sequence
  chemically synthesized
cttcatccatgtccctacaa

SEQ ID NO: 324966 - DNA, 20 bp, Artificial Sequence
  chemically synthesized
atgagttcatgtcctttgta

SEQ ID NO: 324967 - DNA, 20 bp, Artificial Sequence
  chemically synthesized
gatgagttcatgtcctttgt

SEQ ID NO: 324968 - DNA, 20 bp, Artificial Sequence
  chemically synthesized
ggatgagttcatgtcctttg

SEQ ID NO: 324969 - DNA, 20 bp, Artificial Sequence
  chemically synthesized
atgcagccataaaacaggat

SEQ ID NO: 324970 - DNA, 20 bp, Artificial Sequence
  chemically synthesized
catgaactcatcctgtttta

SEQ ID NO: 324971 - DNA, 20 bp, Artificial Sequence
  chemically synthesized
atactatgcagccataaaac

SEQ ID NO: 324972 - DNA, 20 bp, Artificial Sequence
  chemically synthesized
aatactatgcagccataaaa

SEQ ID NO: 324973 - DNA, 20 bp, Artificial Sequence
  chemically synthesized
catcctgttttatggctgca

SEQ ID NO: 324974 - DNA, 20 bp, Artificial Sequence
  chemically synthesized
atacaccatgaaatactatg

SEQ ID NO: 324975 - DNA, 20 bp, Artificial Sequence
  chemically synthesized
tatggctgcatagtatttca

SEQ ID NO: 324976 - DNA, 20 bp, Artificial Sequence
  chemically synthesized
tagactggattaagaaaatg

SEQ ID NO: 324977 - DNA, 20 bp, Artificial Sequence
  chemically synthesized
tgtgccacattttcttaatc

SEQ ID NO: 324978 - DNA, 20 bp, Artificial Sequence
  chemically synthesized
catcgatgatagactggatt

SEQ ID NO: 324979 - DNA, 20 bp, Artificial Sequence
  chemically synthesized
aatgtccatcgatgatagac

SEQ ID NO: 324980 - DNA, 20 bp, Artificial Sequence
  chemically synthesized
ttaatccagtctatcatcga

SEQ ID NO: 324981 - DNA, 20 bp, Artificial Sequence
  chemically synthesized
acccaaatgtccatcgatga

SEQ ID NO: 324982 - DNA, 20 bp, Artificial Sequence
  chemically synthesized
gtctatcatcgatggacatt

SEQ ID NO: 324983 - DNA, 20 bp, Artificial Sequence
  chemically synthesized
tctatcatcgatggacattt

SEQ ID NO: 324984 - DNA, 20 bp, Artificial Sequence
  chemically synthesized
tcatcgatggacatttgggt

SEQ ID NO: 324985 - DNA, 20 bp, Artificial Sequence
  chemically synthesized
tggacatttgggttggttcc

SEQ ID NO: 324986 - DNA, 20 bp, Artificial Sequence
  chemically synthesized
tattcacaatagcaaagact

SEQ ID NO: 324987 - DNA, 20 bp, Artificial Sequence
  chemically synthesized
cggcactattcacaatagca

SEQ ID NO: 324988 - DNA, 20 bp, Artificial Sequence
  chemically synthesized
caagtctttgctattgtgaa

SEQ ID NO: 324989 - DNA, 20 bp, Artificial Sequence
  chemically synthesized
tattgcggcactattcacaa

SEQ ID NO: 324990 - DNA, 20 bp, Artificial Sequence
  chemically synthesized
atgcacacgtatgtttattg

SEQ ID NO: 324991 - DNA, 20 bp, Artificial Sequence
  chemically synthesized
tacgtgtgcatctgtcttta

SEQ ID NO: 324992 - DNA, 20 bp, Artificial Sequence
  chemically synthesized
aaatcatgctgctataaaga

SEQ ID NO: 324993 - DNA, 20 bp, Artificial Sequence
  chemically synthesized
gtgtgcatctgtctttatag

SEQ ID NO: 324994 - DNA, 20 bp, Artificial Sequence
  chemically synthesized
ttaaaaatcatgctgctata

SEQ ID NO: 324995 - DNA, 20 bp, Artificial Sequence
  chemically synthesized
cagcatgatttttaatcctt

SEQ ID NO: 324996 - DNA, 20 bp, Artificial Sequence
  chemically synthesized
agcatgatttttaatccttt

SEQ ID NO: 324997 - DNA, 20 bp, Artificial Sequence
  chemically synthesized
attactgggtatattcccaa

SEQ ID NO: 324998 - DNA, 20 bp, Artificial Sequence
  chemically synthesized
cattactgggtatattccca

SEQ ID NO: 324999 - DNA, 20 bp, Artificial Sequence
  chemically synthesized
taatcctttgggaatatacc

SEQ ID NO: 325000 - DNA, 20 bp, Artificial Sequence
  chemically synthesized
tttgggaatatacccagtaa

SEQ ID NO: 325001 - DNA, 20 bp, Artificial Sequence
  chemically synthesized
ttgggaatatacccagtaat

SEQ ID NO: 325002 - DNA, 20 bp, Artificial Sequence
  chemically synthesized
acagtaatatacccattact

SEQ ID NO: 325003 - DNA, 20 bp, Artificial Sequence
  chemically synthesized
tacagtaatatacccattac

SEQ ID NO: 325004 - DNA, 20 bp, Artificial Sequence
  chemically synthesized
taatgggtatattactgtaa

SEQ ID NO: 325005 - DNA, 20 bp, Artificial Sequence
  chemically synthesized
aatgggtatattactgtaat

SEQ ID NO: 325006 - DNA, 20 bp, Artificial Sequence
  chemically synthesized
catcccattttatcccatta

SEQ ID NO: 325007 - DNA, 20 bp, Artificial Sequence
  chemically synthesized
attactgtaatgggataaaa

SEQ ID NO: 325008 - DNA, 20 bp, Artificial Sequence
  chemically synthesized
ttactgtaatgggataaaat

SEQ ID NO: 325009 - DNA, 20 bp, Artificial Sequence
  chemically synthesized
tgtaatgggataaaatggga

SEQ ID NO: 325010 - DNA, 20 bp, Artificial Sequence
  chemically synthesized
atgggataaaatgggatggc

SEQ ID NO: 325011 - DNA, 20 bp, Artificial Sequence
  chemically synthesized
tgggataaaatgggatggct

SEQ ID NO: 325012 - DNA, 20 bp, Artificial Sequence
  chemically synthesized
aatgggatggctgggtcaaa

SEQ ID NO: 325013 - DNA, 20 bp, Artificial Sequence
  chemically synthesized
actagaaataccatttgacc

SEQ ID NO: 325014 - DNA, 20 bp, Artificial Sequence
  chemically synthesized
gctgggtcaaatggtatttc

SEQ ID NO: 325015 - DNA, 20 bp, Artificial Sequence
  chemically synthesized
tcaaatggtatttctagttc

SEQ ID NO: 325016 - DNA, 20 bp, Artificial Sequence
  chemically synthesized
attcctcaaggatctagaac

SEQ ID NO: 325017 - DNA, 20 bp, Artificial Sequence
  chemically synthesized
atttctagttctagatcctt

SEQ ID NO: 325018 - DNA, 20 bp, Artificial Sequence
  chemically synthesized
tgtgcaattcctcaaggatc

SEQ ID NO: 325019 - DNA, 20 bp, Artificial Sequence
  chemically synthesized
tttctagttctagatccttg

SEQ ID NO: 325020 - DNA, 20 bp, Artificial Sequence
  chemically synthesized
agagagtgtgcaattcctca

SEQ ID NO: 325021 - DNA, 20 bp, Artificial Sequence
  chemically synthesized
aagagagtgtgcaattcctc

SEQ ID NO: 325022 - DNA, 20 bp, Artificial Sequence
  chemically synthesized
agttcaaccattgtggaaga

SEQ ID NO: 325023 - DNA, 20 bp, Artificial Sequence
  chemically synthesized
ctagttcaaccattgtggaa

SEQ ID NO: 325024 - DNA, 20 bp, Artificial Sequence
  chemically synthesized
ttgcacactctcttccacaa

SEQ ID NO: 325025 - DNA, 20 bp, Artificial Sequence
  chemically synthesized
aactagttcaaccattgtgg

SEQ ID NO: 325026 - DNA, 20 bp, Artificial Sequence
  chemically synthesized
gtaaactagttcaaccattg

SEQ ID NO: 325027 - DNA, 20 bp, Artificial Sequence
  chemically synthesized
ctcttccacaatggttgaac

SEQ ID NO: 325028 - DNA, 20 bp, Artificial Sequence
  chemically synthesized
ctgttgatgggattgtaaac

SEQ ID NO: 325029 - DNA, 20 bp, Artificial Sequence
  chemically synthesized
ctagtttacaatcccatcaa

SEQ ID NO: 325030 - DNA, 20 bp, Artificial Sequence
  chemically synthesized
agcacttttacactgttgat

SEQ ID NO: 325031 - DNA, 20 bp, Artificial Sequence
  chemically synthesized
gagcacttttacactgttga

SEQ ID NO: 325032 - DNA, 20 bp, Artificial Sequence
  chemically synthesized
caatcccatcaacagtgtaa

SEQ ID NO: 325033 - DNA, 20 bp, Artificial Sequence
  chemically synthesized
gagaggatgtggagaaataa

SEQ ID NO: 325034 - DNA, 20 bp, Artificial Sequence
  chemically synthesized
tggagaggatgtggagaaat

SEQ ID NO: 325035 - DNA, 20 bp, Artificial Sequence
  chemically synthesized
caggtgctggagaggatgtg

SEQ ID NO: 325036 - DNA, 20 bp, Artificial Sequence
  chemically synthesized
aacaggtgctggagaggatg

SEQ ID NO: 325037 - DNA, 20 bp, Artificial Sequence
  chemically synthesized
ttatttctccacatcctctc

SEQ ID NO: 325038 - DNA, 20 bp, Artificial Sequence
  chemically synthesized
ggaaacaacaggtgctggag

SEQ ID NO: 325039 - DNA, 20 bp, Artificial Sequence
  chemically synthesized
aggaaacaacaggtgctgga

SEQ ID NO: 325040 - DNA, 20 bp, Artificial Sequence
  chemically synthesized
tcaggaaacaacaggtgctg

SEQ ID NO: 325041 - DNA, 20 bp, Artificial Sequence
  chemically synthesized
agtcaggaaacaacaggtgc

SEQ ID NO: 325042 - DNA, 20 bp, Artificial Sequence
  chemically synthesized
ataaaaagtcaggaaacaac

SEQ ID NO: 325043 - DNA, 20 bp, Artificial Sequence
  chemically synthesized
aataaaaagtcaggaaacaa

SEQ ID NO: 325044 - DNA, 20 bp, Artificial Sequence
  chemically synthesized
atggtgaacaataaaaagtc

SEQ ID NO: 325045 - DNA, 20 bp, Artificial Sequence
  chemically synthesized
aatggtgaacaataaaaagt

SEQ ID NO: 325046 - DNA, 20 bp, Artificial Sequence
  chemically synthesized
ttagaatggtgaacaataaa

SEQ ID NO: 325047 - DNA, 20 bp, Artificial Sequence
  chemically synthesized
accattgcacatagttagaa

SEQ ID NO: 325048 - DNA, 20 bp, Artificial Sequence
  chemically synthesized
gagataccattgcacatagt

SEQ ID NO: 325049 - DNA, 20 bp, Artificial Sequence
  chemically synthesized
accattctaactatgtgcaa

SEQ ID NO: 325050 - DNA, 20 bp, Artificial Sequence
  chemically synthesized
caatgagataccattgcaca

SEQ ID NO: 325051 - DNA, 20 bp, Artificial Sequence
  chemically synthesized
tgtgcaatggtatctcattg

SEQ ID NO: 325052 - DNA, 20 bp, Artificial Sequence
  chemically synthesized
atgcaaatcaaaaccacaat

SEQ ID NO: 325053 - DNA, 20 bp, Artificial Sequence
  chemically synthesized
tttgatttgcatttctctga

SEQ ID NO: 325054 - DNA, 20 bp, Artificial Sequence
  chemically synthesized
atttgcatttctctgatggc

SEQ ID NO: 325055 - DNA, 20 bp, Artificial Sequence
  chemically synthesized
ctcatcatcactggccatca

SEQ ID NO: 325056 - DNA, 20 bp, Artificial Sequence
  chemically synthesized
tgctcatcatcactggccat

SEQ ID NO: 325057 - DNA, 20 bp, Artificial Sequence
  chemically synthesized
aaaaaaatgctcatcatcac

SEQ ID NO: 325058 - DNA, 20 bp, Artificial Sequence
  chemically synthesized
ctctgatggccagtgatgat

SEQ ID NO: 325059 - DNA, 20 bp, Artificial Sequence
  chemically synthesized
catttttttcatgtgtctgt

SEQ ID NO: 325060 - DNA, 20 bp, Artificial Sequence
  chemically synthesized
aaaggcattgatgcagccaa

SEQ ID NO: 325061 - DNA, 20 bp, Artificial Sequence
  chemically synthesized
tctcaaaaaaggcattgatg

SEQ ID NO: 325062 - DNA, 20 bp, Artificial Sequence
  chemically synthesized
gctgcatcaatgcctttttt

SEQ ID NO: 325063 - DNA, 20 bp, Artificial Sequence
  chemically synthesized
gaacagacacttctcaaaaa

SEQ ID NO: 325064 - DNA, 20 bp, Artificial Sequence
  chemically synthesized
gcatcaatgccttttttgag

SEQ ID NO: 325065 - DNA, 20 bp, Artificial Sequence
  chemically synthesized
tgaacagacacttctcaaaa

SEQ ID NO: 325066 - DNA, 20 bp, Artificial Sequence
  chemically synthesized
aagtgggcaaaggatatgaa

SEQ ID NO: 325067 - DNA, 20 bp, Artificial Sequence
  chemically synthesized
ccctatcaaaaagtgggcaa

SEQ ID NO: 325068 - DNA, 20 bp, Artificial Sequence
  chemically synthesized
accctatcaaaaagtgggca

SEQ ID NO: 325069 - DNA, 20 bp, Artificial Sequence
  chemically synthesized
aaacaaccctatcaaaaagt

SEQ ID NO: 325070 - DNA, 20 bp, Artificial Sequence
  chemically synthesized
aaaacaaccctatcaaaaag

SEQ ID NO: 325071 - DNA, 20 bp, Artificial Sequence
  chemically synthesized
atcctttgcccactttttga

SEQ ID NO: 325072 - DNA, 20 bp, Artificial Sequence
  chemically synthesized
tcctttgcccactttttgat

SEQ ID NO: 325073 - DNA, 20 bp, Artificial Sequence
  chemically synthesized
cctttgcccactttttgata

SEQ ID NO: 325074 - DNA, 20 bp, Artificial Sequence
  chemically synthesized
aaaaaaacaaccctatcaaa

SEQ ID NO: 325075 - DNA, 20 bp, Artificial Sequence
  chemically synthesized
aagaagtcaaacaaatttac

SEQ ID NO: 325076 - DNA, 20 bp, Artificial Sequence
  chemically synthesized
aaatttgtttgacttctttg

SEQ ID NO: 325077 - DNA, 20 bp, Artificial Sequence
  chemically synthesized
aatatccagaatctacaaag

SEQ ID NO: 325078 - DNA, 20 bp, Artificial Sequence
  chemically synthesized
gctaatatccagaatctaca

SEQ ID NO: 325079 - DNA, 20 bp, Artificial Sequence
  chemically synthesized
tttgacttctttgtagattc

SEQ ID NO: 325080 - DNA, 20 bp, Artificial Sequence
  chemically synthesized
tctttgtagattctggatat

SEQ ID NO: 325081 - DNA, 20 bp, Artificial Sequence
  chemically synthesized
tctggcaaagggctaatatc

SEQ ID NO: 325082 - DNA, 20 bp, Artificial Sequence
  chemically synthesized
tctggatattagccctttgc

SEQ ID NO: 325083 - DNA, 20 bp, Artificial Sequence
  chemically synthesized
caatctaatcatctggcaaa

SEQ ID NO: 325084 - DNA, 20 bp, Artificial Sequence
  chemically synthesized
acaatctaatcatctggcaa

SEQ ID NO: 325085 - DNA, 20 bp, Artificial Sequence
  chemically synthesized
tacaatctaatcatctggca

SEQ ID NO: 325086 - DNA, 20 bp, Artificial Sequence
  chemically synthesized
ttagccctttgccagatgat

SEQ ID NO: 325087 - DNA, 20 bp, Artificial Sequence
  chemically synthesized
atttttacaatctaatcatc

SEQ ID NO: 325088 - DNA, 20 bp, Artificial Sequence
  chemically synthesized
acaggcaacctacagaatgg

SEQ ID NO: 325089 - DNA, 20 bp, Artificial Sequence
  chemically synthesized
aaaaattttctcccattctg

SEQ ID NO: 325090 - DNA, 20 bp, Artificial Sequence
  chemically synthesized
aaaattttctcccattctgt

SEQ ID NO: 325091 - DNA, 20 bp, Artificial Sequence
  chemically synthesized
gaacaggcaacctacagaat

SEQ ID NO: 325092 - DNA, 20 bp, Artificial Sequence
  chemically synthesized
tgaacaggcaacctacagaa

SEQ ID NO: 325093 - DNA, 20 bp, Artificial Sequence
  chemically synthesized
catagtgaacaggcaaccta

SEQ ID NO: 325094 - DNA, 20 bp, Artificial Sequence
  chemically synthesized
aaactaccatcatagtgaac

SEQ ID NO: 325095 - DNA, 20 bp, Artificial Sequence
  chemically synthesized
gaaactaccatcatagtgaa

SEQ ID NO: 325096 - DNA, 20 bp, Artificial Sequence
  chemically synthesized
aggttgcctgttcactatga

SEQ ID NO: 325097 - DNA, 20 bp, Artificial Sequence
  chemically synthesized
ttgcctgttcactatgatgg

SEQ ID NO: 325098 - DNA, 20 bp, Artificial Sequence
  chemically synthesized
agcaaaagaaactaccatca

SEQ ID NO: 325099 - DNA, 20 bp, Artificial Sequence
  chemically synthesized
aaggagcttctgcaaagcaa

SEQ ID NO: 325100 - DNA, 20 bp, Artificial Sequence
  chemically synthesized
tggtagtttcttttgctttg

SEQ ID NO: 325101 - DNA, 20 bp, Artificial Sequence
  chemically synthesized
tagtttcttttgctttgcag

SEQ ID NO: 325102 - DNA, 20 bp, Artificial Sequence
  chemically synthesized
taaaccaaggagcttctgca

SEQ ID NO: 325103 - DNA, 20 bp, Artificial Sequence
  chemically synthesized
tttgctttgcagaagctcct

SEQ ID NO: 325104 - DNA, 20 bp, Artificial Sequence
  chemically synthesized
tgggatctaattaaaccaag

SEQ ID NO: 325105 - DNA, 20 bp, Artificial Sequence
  chemically synthesized
aatgggatctaattaaacca

SEQ ID NO: 325106 - DNA, 20 bp, Artificial Sequence
  chemically synthesized
aaatgggatctaattaaacc

SEQ ID NO: 325107 - DNA, 20 bp, Artificial Sequence
  chemically synthesized
cagaagctccttggtttaat

SEQ ID NO: 325108 - DNA, 20 bp, Artificial Sequence
  chemically synthesized
aagagtcaaaattgacaaat

SEQ ID NO: 325109 - DNA, 20 bp, Artificial Sequence
  chemically synthesized
caagagtcaaaattgacaaa

SEQ ID NO: 325110 - DNA, 20 bp, Artificial Sequence
  chemically synthesized
accaaaagcaatggcaacaa

SEQ ID NO: 325111 - DNA, 20 bp, Artificial Sequence
  chemically synthesized
acaccaaaagcaatggcaac

SEQ ID NO: 325112 - DNA, 20 bp, Artificial Sequence
  chemically synthesized
actcttgttgccattgcttt

SEQ ID NO: 325113 - DNA, 20 bp, Artificial Sequence
  chemically synthesized
gtccaaaacaccaaaagcaa

SEQ ID NO: 325114 - DNA, 20 bp, Artificial Sequence
  chemically synthesized
cttcatgtccaaaacaccaa

SEQ ID NO: 325115 - DNA, 20 bp, Artificial Sequence
  chemically synthesized
tgccattgcttttggtgttt

SEQ ID NO: 325116 - DNA, 20 bp, Artificial Sequence
  chemically synthesized
cttttggtgttttggacatg

SEQ ID NO: 325117 - DNA, 20 bp, Artificial Sequence
  chemically synthesized
tcaggacataggcatgggta

SEQ ID NO: 325118 - DNA, 20 bp, Artificial Sequence
  chemically synthesized
ttcaggacataggcatgggt

SEQ ID NO: 325119 - DNA, 20 bp, Artificial Sequence
  chemically synthesized
acctttcaggacataggcat

SEQ ID NO: 325120 - DNA, 20 bp, Artificial Sequence
  chemically synthesized
tacctttcaggacataggca

SEQ ID NO: 325121 - DNA, 20 bp, Artificial Sequence
  chemically synthesized
ggcaatacctttcaggacat

SEQ ID NO: 325122 - DNA, 20 bp, Artificial Sequence
  chemically synthesized
aggcaatacctttcaggaca

SEQ ID NO: 325123 - DNA, 20 bp, Artificial Sequence
  chemically synthesized
tacccatgcctatgtcctga

SEQ ID NO: 325124 - DNA, 20 bp, Artificial Sequence
  chemically synthesized
acccatgcctatgtcctgaa

SEQ ID NO: 325125 - DNA, 20 bp, Artificial Sequence
  chemically synthesized
aaacctaggcaatacctttc

SEQ ID NO: 325126 - DNA, 20 bp, Artificial Sequence
  chemically synthesized
aaaacctaggcaataccttt

SEQ ID NO: 325127 - DNA, 20 bp, Artificial Sequence
  chemically synthesized
atgtcctgaaaggtattgcc

SEQ ID NO: 325128 - DNA, 20 bp, Artificial Sequence
  chemically synthesized
tgtcctgaaaggtattgcct

SEQ ID NO: 325129 - DNA, 20 bp, Artificial Sequence
  chemically synthesized
aaaaacctagaagaaaacct

SEQ ID NO: 325130 - DNA, 20 bp, Artificial Sequence
  chemically synthesized
taaaaacctagaagaaaacc

SEQ ID NO: 325131 - DNA, 20 bp, Artificial Sequence
  chemically synthesized
gtattgcctaggttttcttc

SEQ ID NO: 325132 - DNA, 20 bp, Artificial Sequence
  chemically synthesized
tattgcctaggttttcttct

SEQ ID NO: 325133 - DNA, 20 bp, Artificial Sequence
  chemically synthesized
ctaaaaccataaaaacctag

SEQ ID NO: 325134 - DNA, 20 bp, Artificial Sequence
  chemically synthesized
gacctaaaaccataaaaacc

SEQ ID NO: 325135 - DNA, 20 bp, Artificial Sequence
  chemically synthesized
ggttttcttctaggttttta

SEQ ID NO: 325136 - DNA, 20 bp, Artificial Sequence
  chemically synthesized
cttctaggtttttatggttt

SEQ ID NO: 325137 - DNA, 20 bp, Artificial Sequence
  chemically synthesized
ttctaggtttttatggtttt

SEQ ID NO: 325138 - DNA, 20 bp, Artificial Sequence
  chemically synthesized
tggttttaggtctaacattt

SEQ ID NO: 325139 - DNA, 20 bp, Artificial Sequence
  chemically synthesized
tggatcaaagacttaaatgt

SEQ ID NO: 325140 - DNA, 20 bp, Artificial Sequence
  chemically synthesized
aatgaattcaagatggatca

SEQ ID NO: 325141 - DNA, 20 bp, Artificial Sequence
  chemically synthesized
atacaaaaatgaattcaaga

SEQ ID NO: 325142 - DNA, 20 bp, Artificial Sequence
  chemically synthesized
cattatacaaaaatgaattc

SEQ ID NO: 325143 - DNA, 20 bp, Artificial Sequence
  chemically synthesized
ttcatttttgtataatgtgt

SEQ ID NO: 325144 - DNA, 20 bp, Artificial Sequence
  chemically synthesized
tcatttttgtataatgtgta

SEQ ID NO: 325145 - DNA, 20 bp, Artificial Sequence
  chemically synthesized
tttttgtataatgtgtaagg

SEQ ID NO: 325146 - DNA, 20 bp, Artificial Sequence
  chemically synthesized
ttttgtataatgtgtaagga

SEQ ID NO: 325147 - DNA, 20 bp, Artificial Sequence
  chemically synthesized
tttgtataatgtgtaaggaa

SEQ ID NO: 325148 - DNA, 20 bp, Artificial Sequence
  chemically synthesized
taatgtgtaaggaagggatc

SEQ ID NO: 325149 - DNA, 20 bp, Artificial Sequence
  chemically synthesized
gtaaggaagggatccagttt

SEQ ID NO: 325150 - DNA, 20 bp, Artificial Sequence
  chemically synthesized
catatgtagaaagctgaaac

SEQ ID NO: 325151 - DNA, 20 bp, Artificial Sequence
  chemically synthesized
actggctagccatatgtaga

SEQ ID NO: 325152 - DNA, 20 bp, Artificial Sequence
  chemically synthesized
cagtttcagctttctacata

SEQ ID NO: 325153 - DNA, 20 bp, Artificial Sequence
  chemically synthesized
gaaaactggctagccatatg

SEQ ID NO: 325154 - DNA, 20 bp, Artificial Sequence
  chemically synthesized
ttcagctttctacatatggc

SEQ ID NO: 325155 - DNA, 20 bp, Artificial Sequence
  chemically synthesized
gctttctacatatggctagc

SEQ ID NO: 325156 - DNA, 20 bp, Artificial Sequence
  chemically synthesized
atggtgctgggaaaactggc

SEQ ID NO: 325157 - DNA, 20 bp, Artificial Sequence
  chemically synthesized
atatggctagccagttttcc

SEQ ID NO: 325158 - DNA, 20 bp, Artificial Sequence
  chemically synthesized
ataaatggtgctgggaaaac

SEQ ID NO: 325159 - DNA, 20 bp, Artificial Sequence
  chemically synthesized
cctatttaataaatggtgct

SEQ ID NO: 325160 - DNA, 20 bp, Artificial Sequence
  chemically synthesized
ccctatttaataaatggtgc

SEQ ID NO: 325161 - DNA, 20 bp, Artificial Sequence
  chemically synthesized
aggattccctatttaataaa

SEQ ID NO: 325162 - DNA, 20 bp, Artificial Sequence
  chemically synthesized
tcccagcaccatttattaaa

SEQ ID NO: 325163 - DNA, 20 bp, Artificial Sequence
  chemically synthesized
cccagcaccatttattaaat

SEQ ID NO: 325164 - DNA, 20 bp, Artificial Sequence
  chemically synthesized
ccagcaccatttattaaata

SEQ ID NO: 325165 - DNA, 20 bp, Artificial Sequence
  chemically synthesized
gaaaaacaagcaatggggaa

SEQ ID NO: 325166 - DNA, 20 bp, Artificial Sequence
  chemically synthesized
agaaaaacaagcaatgggga

SEQ ID NO: 325167 - DNA, 20 bp, Artificial Sequence
  chemically synthesized
cctgagaaaaacaagcaatg

SEQ ID NO: 325168 - DNA, 20 bp, Artificial Sequence
  chemically synthesized
acctgagaaaaacaagcaat

SEQ ID NO: 325169 - DNA, 20 bp, Artificial Sequence
  chemically synthesized
aacctgagaaaaacaagcaa

SEQ ID NO: 325170 - DNA, 20 bp, Artificial Sequence
  chemically synthesized
ttgacaaacctgagaaaaac

SEQ ID NO: 325171 - DNA, 20 bp, Artificial Sequence
  chemically synthesized
tccccattgcttgtttttct

SEQ ID NO: 325172 - DNA, 20 bp, Artificial Sequence
  chemically synthesized
ccccattgcttgtttttctc

SEQ ID NO: 325173 - DNA, 20 bp, Artificial Sequence
  chemically synthesized
atctgatctttgacaaacct

SEQ ID NO: 325174 - DNA, 20 bp, Artificial Sequence
  chemically synthesized
tgtttttctcaggtttgtca

SEQ ID NO: 325175 - DNA, 20 bp, Artificial Sequence
  chemically synthesized
ttctcaggtttgtcaaagat

SEQ ID NO: 325176 - DNA, 20 bp, Artificial Sequence
  chemically synthesized
caggtttgtcaaagatcaga

SEQ ID NO: 325177 - DNA, 20 bp, Artificial Sequence
  chemically synthesized
gtttgtcaaagatcagatag

SEQ ID NO: 325178 - DNA, 20 bp, Artificial Sequence
  chemically synthesized
tgtcaaagatcagatagtag

SEQ ID NO: 325179 - DNA, 20 bp, Artificial Sequence
  chemically synthesized
atcagatagtagtagatatg

SEQ ID NO: 325180 - DNA, 20 bp, Artificial Sequence
  chemically synthesized
agatatgtggcattatttct

SEQ ID NO: 325181 - DNA, 20 bp, Artificial Sequence
  chemically synthesized
gatatgtggcattatttctg

SEQ ID NO: 325182 - DNA, 20 bp, Artificial Sequence
  chemically synthesized
atatgtggcattatttctga

SEQ ID NO: 325183 - DNA, 20 bp, Artificial Sequence
  chemically synthesized
atggaacagaacaaagccct

SEQ ID NO: 325184 - DNA, 20 bp, Artificial Sequence
  chemically synthesized
tagaccaatggaacagaaca

SEQ ID NO: 325185 - DNA, 20 bp, Artificial Sequence
  chemically synthesized
agggctttgttctgttccat

SEQ ID NO: 325186 - DNA, 20 bp, Artificial Sequence
  chemically synthesized
agagatatagaccaatggaa

SEQ ID NO: 325187 - DNA, 20 bp, Artificial Sequence
  chemically synthesized
agaatagagatatagaccaa

SEQ ID NO: 325188 - DNA, 20 bp, Artificial Sequence
  chemically synthesized
ctggtatcagaatagagata

SEQ ID NO: 325189 - DNA, 20 bp, Artificial Sequence
  chemically synthesized
atggtactggtatcagaata

SEQ ID NO: 325190 - DNA, 20 bp, Artificial Sequence
  chemically synthesized
gcatggtactggtatcagaa

SEQ ID NO: 325191 - DNA, 20 bp, Artificial Sequence
  chemically synthesized
ctatatctctattctgatac

SEQ ID NO: 325192 - DNA, 20 bp, Artificial Sequence
  chemically synthesized
aaacagcatggtactggtat

SEQ ID NO: 325193 - DNA, 20 bp, Artificial Sequence
  chemically synthesized
taaccaaaacagcatggtac

SEQ ID NO: 325194 - DNA, 20 bp, Artificial Sequence
  chemically synthesized
ctacagtaaccaaaacagca

SEQ ID NO: 325195 - DNA, 20 bp, Artificial Sequence
  chemically synthesized
ataccagtaccatgctgttt

SEQ ID NO: 325196 - DNA, 20 bp, Artificial Sequence
  chemically synthesized
caaggctacagtaaccaaaa

SEQ ID NO: 325197 - DNA, 20 bp, Artificial Sequence
  chemically synthesized
ccatgctgttttggttactg

SEQ ID NO: 325198 - DNA, 20 bp, Artificial Sequence
  chemically synthesized
taaactatactacaaggcta

SEQ ID NO: 325199 - DNA, 20 bp, Artificial Sequence
  chemically synthesized
ttttggttactgtagccttg

SEQ ID NO: 325200 - DNA, 20 bp, Artificial Sequence
  chemically synthesized
gttactgtagccttgtagta

SEQ ID NO: 325201 - DNA, 20 bp, Artificial Sequence
  chemically synthesized
tgattttaaactatactaca

SEQ ID NO: 325202 - DNA, 20 bp, Artificial Sequence
  chemically synthesized
ctgattttaaactatactac

SEQ ID NO: 325203 - DNA, 20 bp, Artificial Sequence
  chemically synthesized
cttgtagtatagtttaaaat

SEQ ID NO: 325204 - DNA, 20 bp, Artificial Sequence
  chemically synthesized
ttgtagtatagtttaaaatc

SEQ ID NO: 325205 - DNA, 20 bp, Artificial Sequence
  chemically synthesized
tagtatagtttaaaatcagg

SEQ ID NO: 325206 - DNA, 20 bp, Artificial Sequence
  chemically synthesized
atcaggtagtgtgatacctc

SEQ ID NO: 325207 - DNA, 20 bp, Artificial Sequence
  chemically synthesized
agccaaaagaacaaagctgg

SEQ ID NO: 325208 - DNA, 20 bp, Artificial Sequence
  chemically synthesized
aagccaaaagaacaaagctg

SEQ ID NO: 325209 - DNA, 20 bp, Artificial Sequence
  chemically synthesized
ctaagccaaaagaacaaagc

SEQ ID NO: 325210 - DNA, 20 bp, Artificial Sequence
  chemically synthesized
aatcctaagccaaaagaaca

SEQ ID NO: 325211 - DNA, 20 bp, Artificial Sequence
  chemically synthesized
tacctccagctttgttcttt

SEQ ID NO: 325212 - DNA, 20 bp, Artificial Sequence
  chemically synthesized
ccagctttgttcttttggct

SEQ ID NO: 325213 - DNA, 20 bp, Artificial Sequence
  chemically synthesized
cagctttgttcttttggctt

SEQ ID NO: 325214 - DNA, 20 bp, Artificial Sequence
  chemically synthesized
ccaggtcaatcctaagccaa

SEQ ID NO: 325215 - DNA, 20 bp, Artificial Sequence
  chemically synthesized
cacattgccaggtcaatcct

SEQ ID NO: 325216 - DNA, 20 bp, Artificial Sequence
  chemically synthesized
cttttggcttaggattgacc

SEQ ID NO: 325217 - DNA, 20 bp, Artificial Sequence
  chemically synthesized
ttaggattgacctggcaatg

SEQ ID NO: 325218 - DNA, 20 bp, Artificial Sequence
  chemically synthesized
aaaaaagagcccacattgcc

SEQ ID NO: 325219 - DNA, 20 bp, Artificial Sequence
  chemically synthesized
taggattgacctggcaatgt

SEQ ID NO: 325220 - DNA, 20 bp, Artificial Sequence
  chemically synthesized
caaaaaagagcccacattgc

SEQ ID NO: 325221 - DNA, 20 bp, Artificial Sequence
  chemically synthesized
tggcaatgtgggctcttttt

SEQ ID NO: 325222 - DNA, 20 bp, Artificial Sequence
  chemically synthesized
gttcatatggaaccaaaaaa

SEQ ID NO: 325223 - DNA, 20 bp, Artificial Sequence
  chemically synthesized
aagttcatatggaaccaaaa

SEQ ID NO: 325224 - DNA, 20 bp, Artificial Sequence
  chemically synthesized
aaactactttaaagttcata

SEQ ID NO: 325225 - DNA, 20 bp, Artificial Sequence
  chemically synthesized
ttggttccatatgaacttta

SEQ ID NO: 325226 - DNA, 20 bp, Artificial Sequence
  chemically synthesized
gttccatatgaactttaaag

SEQ ID NO: 325227 - DNA, 20 bp, Artificial Sequence
  chemically synthesized
aattggaaaaaactacttta

SEQ ID NO: 325228 - DNA, 20 bp, Artificial Sequence
  chemically synthesized
aatgactttctacacggaat

SEQ ID NO: 325229 - DNA, 20 bp, Artificial Sequence
  chemically synthesized
tagttttttccaattccgtg

SEQ ID NO: 325230 - DNA, 20 bp, Artificial Sequence
  chemically synthesized
tttttccaattccgtgtaga

SEQ ID NO: 325231 - DNA, 20 bp, Artificial Sequence
  chemically synthesized
gctaccaatgactttctaca

SEQ ID NO: 325232 - DNA, 20 bp, Artificial Sequence
  chemically synthesized
aattccgtgtagaaagtcat

SEQ ID NO: 325233 - DNA, 20 bp, Artificial Sequence
  chemically synthesized
tccgtgtagaaagtcattgg

SEQ ID NO: 325234 - DNA, 20 bp, Artificial Sequence
  chemically synthesized
gaaagtcattggtagcttga

SEQ ID NO: 325235 - DNA, 20 bp, Artificial Sequence
  chemically synthesized
aaagtcattggtagcttgat

SEQ ID NO: 325236 - DNA, 20 bp, Artificial Sequence
  chemically synthesized
aagtcattggtagcttgatg

SEQ ID NO: 325237 - DNA, 20 bp, Artificial Sequence
  chemically synthesized
gattcaatgccatccccatc

SEQ ID NO: 325238 - DNA, 20 bp, Artificial Sequence
  chemically synthesized
cattggtagcttgatgggga

SEQ ID NO: 325239 - DNA, 20 bp, Artificial Sequence
  chemically synthesized
atactgcccaaggtaattta

SEQ ID NO: 325240 - DNA, 20 bp, Artificial Sequence
  chemically synthesized
attgaatctataaattacct

SEQ ID NO: 325241 - DNA, 20 bp, Artificial Sequence
  chemically synthesized
ttgaatctataaattacctt

SEQ ID NO: 325242 - DNA, 20 bp, Artificial Sequence
  chemically synthesized
aatctataaattaccttggg

SEQ ID NO: 325243 - DNA, 20 bp, Artificial Sequence
  chemically synthesized
gaaaatggccatactgccca

SEQ ID NO: 325244 - DNA, 20 bp, Artificial Sequence
  chemically synthesized
tgaaaatggccatactgccc

SEQ ID NO: 325245 - DNA, 20 bp, Artificial Sequence
  chemically synthesized
ataaattaccttgggcagta

SEQ ID NO: 325246 - DNA, 20 bp, Artificial Sequence
  chemically synthesized
aagaatcaatattgtgaaaa

SEQ ID NO: 325247 - DNA, 20 bp, Artificial Sequence
  chemically synthesized
attctatgctcatggatagg

SEQ ID NO: 325248 - DNA, 20 bp, Artificial Sequence
  chemically synthesized
tattgattcttcctatccat

SEQ ID NO: 325249 - DNA, 20 bp, Artificial Sequence
  chemically synthesized
aacattctatgctcatggat

SEQ ID NO: 325250 - DNA, 20 bp, Artificial Sequence
  chemically synthesized
gaacattctatgctcatgga

SEQ ID NO: 325251 - DNA, 20 bp, Artificial Sequence
  chemically synthesized
attcttcctatccatgagca

SEQ ID NO: 325252 - DNA, 20 bp, Artificial Sequence
  chemically synthesized
ggaagaacattctatgctca

SEQ ID NO: 325253 - DNA, 20 bp, Artificial Sequence
  chemically synthesized
aagaggacacaaacaaatgg

SEQ ID NO: 325254 - DNA, 20 bp, Artificial Sequence
  chemically synthesized
tacaagaggacacaaacaaa

SEQ ID NO: 325255 - DNA, 20 bp, Artificial Sequence
  chemically synthesized
actgctcaccaaaatacaag

SEQ ID NO: 325256 - DNA, 20 bp, Artificial Sequence
  chemically synthesized
cactgctcaccaaaatacaa

SEQ ID NO: 325257 - DNA, 20 bp, Artificial Sequence
  chemically synthesized
gtttgtgtcctcttgtattt

SEQ ID NO: 325258 - DNA, 20 bp, Artificial Sequence
  chemically synthesized
accactgctcaccaaaatac

SEQ ID NO: 325259 - DNA, 20 bp, Artificial Sequence
  chemically synthesized
gtgtcctcttgtattttggt

SEQ ID NO: 325260 - DNA, 20 bp, Artificial Sequence
  chemically synthesized
tcctcttgtattttggtgag

SEQ ID NO: 325261 - DNA, 20 bp, Artificial Sequence
  chemically synthesized
tcttgtattttggtgagcag

SEQ ID NO: 325262 - DNA, 20 bp, Artificial Sequence
  chemically synthesized
ttttggtgagcagtggtttg

SEQ ID NO: 325263 - DNA, 20 bp, Artificial Sequence
  chemically synthesized
gtggtttgtagttctccttg

SEQ ID NO: 325264 - DNA, 20 bp, Artificial Sequence
  chemically synthesized
ggtttgtagttctccttgaa

SEQ ID NO: 325265 - DNA, 20 bp, Artificial Sequence
  chemically synthesized
gtttgtagttctccttgaag

SEQ ID NO: 325266 - DNA, 20 bp, Artificial Sequence
  chemically synthesized
atgtgaaggacctcttcaag

SEQ ID NO: 325267 - DNA, 20 bp, Artificial Sequence
  chemically synthesized
ggatgtgaaggacctcttca

SEQ ID NO: 325268 - DNA, 20 bp, Artificial Sequence
  chemically synthesized
gggatgtgaaggacctcttc

SEQ ID NO: 325269 - DNA, 20 bp, Artificial Sequence
  chemically synthesized
ccaacttgcaagggatgtga

SEQ ID NO: 325270 - DNA, 20 bp, Artificial Sequence
  chemically synthesized
tccaacttgcaagggatgtg

SEQ ID NO: 325271 - DNA, 20 bp, Artificial Sequence
  chemically synthesized
aggtccttcacatcccttgc

SEQ ID NO: 325272 - DNA, 20 bp, Artificial Sequence
  chemically synthesized
cctaggaatccaacttgcaa

SEQ ID NO: 325273 - DNA, 20 bp, Artificial Sequence
  chemically synthesized
ccttcacatcccttgcaagt

SEQ ID NO: 325274 - DNA, 20 bp, Artificial Sequence
  chemically synthesized
acctaggaatccaacttgca

SEQ ID NO: 325275 - DNA, 20 bp, Artificial Sequence
  chemically synthesized
tacctaggaatccaacttgc

SEQ ID NO: 325276 - DNA, 20 bp, Artificial Sequence
  chemically synthesized
tcccttgcaagttggattcc

SEQ ID NO: 325277 - DNA, 20 bp, Artificial Sequence
  chemically synthesized
cccttgcaagttggattcct

SEQ ID NO: 325278 - DNA, 20 bp, Artificial Sequence
  chemically synthesized
tcaaagagaataaaatacct

SEQ ID NO: 325279 - DNA, 20 bp, Artificial Sequence
  chemically synthesized
ttcaaagagaataaaatacc

SEQ ID NO: 325280 - DNA, 20 bp, Artificial Sequence
  chemically synthesized
taggtattttattctctttg

SEQ ID NO: 325281 - DNA, 20 bp, Artificial Sequence
  chemically synthesized
ccattcacaattgcttcaaa

SEQ ID NO: 325282 - DNA, 20 bp, Artificial Sequence
  chemically synthesized
ctccattcacaattgcttca

SEQ ID NO: 325283 - DNA, 20 bp, Artificial Sequence
  chemically synthesized
ctctttgaagcaattgtgaa

SEQ ID NO: 325284 - DNA, 20 bp, Artificial Sequence
  chemically synthesized
ctttgaagcaattgtgaatg

SEQ ID NO: 325285 - DNA, 20 bp, Artificial Sequence
  chemically synthesized
aacagacagaggcaaatcat

SEQ ID NO: 325286 - DNA, 20 bp, Artificial Sequence
  chemically synthesized
tatacaccaataacagacag

SEQ ID NO: 325287 - DNA, 20 bp, Artificial Sequence
  chemically synthesized
ttatacaccaataacagaca

SEQ ID NO: 325288 - DNA, 20 bp, Artificial Sequence
  chemically synthesized
tcttatacaccaataacaga

SEQ ID NO: 325289 - DNA, 20 bp, Artificial Sequence
  chemically synthesized
gatttgcctctgtctgttat

SEQ ID NO: 325290 - DNA, 20 bp, Artificial Sequence
  chemically synthesized
gcattcttatacaccaataa

SEQ ID NO: 325291 - DNA, 20 bp, Artificial Sequence
  chemically synthesized
tctgtctgttattggtgtat

SEQ ID NO: 325292 - DNA, 20 bp, Artificial Sequence
  chemically synthesized
aatcaatgtgcaaaaatcac

SEQ ID NO: 325293 - DNA, 20 bp, Artificial Sequence
  chemically synthesized
tgcacattgatttgtatcct

SEQ ID NO: 325294 - DNA, 20 bp, Artificial Sequence
  chemically synthesized
agcaacttcagcaaagtctc

SEQ ID NO: 325295 - DNA, 20 bp, Artificial Sequence
  chemically synthesized
aagcaacttcagcaaagtct

SEQ ID NO: 325296 - DNA, 20 bp, Artificial Sequence
  chemically synthesized
tgtatcctgagactttgctg

SEQ ID NO: 325297 - DNA, 20 bp, Artificial Sequence
  chemically synthesized
gctgataagcaacttcagca

SEQ ID NO: 325298 - DNA, 20 bp, Artificial Sequence
  chemically synthesized
cttaagctgataagcaactt

SEQ ID NO: 325299 - DNA, 20 bp, Artificial Sequence
  chemically synthesized
actttgctgaagttgcttat

SEQ ID NO: 325300 - DNA, 20 bp, Artificial Sequence
  chemically synthesized
caaaatctacttaagctgat

SEQ ID NO: 325301 - DNA, 20 bp, Artificial Sequence
  chemically synthesized
ctgaagttgcttatcagctt

SEQ ID NO: 325302 - DNA, 20 bp, Artificial Sequence
  chemically synthesized
aagttgcttatcagcttaag

SEQ ID NO: 325303 - DNA, 20 bp, Artificial Sequence
  chemically synthesized
tctcagcccaaaatctactt

SEQ ID NO: 325304 - DNA, 20 bp, Artificial Sequence
  chemically synthesized
ttatcagcttaagtagattt

SEQ ID NO: 325305 - DNA, 20 bp, Artificial Sequence
  chemically synthesized
tatcagcttaagtagatttt

SEQ ID NO: 325306 - DNA, 20 bp, Artificial Sequence
  chemically synthesized
gcttaagtagattttgggct

SEQ ID NO: 325307 - DNA, 20 bp, Artificial Sequence
  chemically synthesized
tagattttgggctgagacaa

SEQ ID NO: 325308 - DNA, 20 bp, Artificial Sequence
  chemically synthesized
agattttgggctgagacaat

SEQ ID NO: 325309 - DNA, 20 bp, Artificial Sequence
  chemically synthesized
tctagaaaaccccattgtct

SEQ ID NO: 325310 - DNA, 20 bp, Artificial Sequence
  chemically synthesized
gattttgggctgagacaatg

SEQ ID NO: 325311 - DNA, 20 bp, Artificial Sequence
  chemically synthesized
gctgagacaatggggttttc

SEQ ID NO: 325312 - DNA, 20 bp, Artificial Sequence
  chemically synthesized
agatgacatgattgtatatc

SEQ ID NO: 325313 - DNA, 20 bp, Artificial Sequence
  chemically synthesized
acaatcatgtcatctgcaaa

SEQ ID NO: 325314 - DNA, 20 bp, Artificial Sequence
  chemically synthesized
caatcatgtcatctgcaaac

SEQ ID NO: 325315 - DNA, 20 bp, Artificial Sequence
  chemically synthesized
aatcatgtcatctgcaaaca

SEQ ID NO: 325316 - DNA, 20 bp, Artificial Sequence
  chemically synthesized
agtcaaattgtccctgtttg

SEQ ID NO: 325317 - DNA, 20 bp, Artificial Sequence
  chemically synthesized
tattcaattaggaaaagagg

SEQ ID NO: 325318 - DNA, 20 bp, Artificial Sequence
  chemically synthesized
gggtattcaattaggaaaag

SEQ ID NO: 325319 - DNA, 20 bp, Artificial Sequence
  chemically synthesized
agggtattcaattaggaaaa

SEQ ID NO: 325320 - DNA, 20 bp, Artificial Sequence
  chemically synthesized
aaagggtattcaattaggaa

SEQ ID NO: 325321 - DNA, 20 bp, Artificial Sequence
  chemically synthesized
gaaataaagggtattcaatt

SEQ ID NO: 325322 - DNA, 20 bp, Artificial Sequence
  chemically synthesized
ggaaataaagggtattcaat

SEQ ID NO: 325323 - DNA, 20 bp, Artificial Sequence
  chemically synthesized
aggcagaagaaggaaataaa

SEQ ID NO: 325324 - DNA, 20 bp, Artificial Sequence
  chemically synthesized
caggcagaagaaggaaataa

SEQ ID NO: 325325 - DNA, 20 bp, Artificial Sequence
  chemically synthesized
tcaggcagaagaaggaaata

SEQ ID NO: 325326 - DNA, 20 bp, Artificial Sequence
  chemically synthesized
cagggcaatcaggcagaaga

SEQ ID NO: 325327 - DNA, 20 bp, Artificial Sequence
  chemically synthesized
ccagggcaatcaggcagaag

SEQ ID NO: 325328 - DNA, 20 bp, Artificial Sequence
  chemically synthesized
cggccagggcaatcaggcag

SEQ ID NO: 325329 - DNA, 20 bp, Artificial Sequence
  chemically synthesized
ttccggccagggcaatcagg

SEQ ID NO: 325330 - DNA, 20 bp, Artificial Sequence
  chemically synthesized
aagttccggccagggcaatc

SEQ ID NO: 325331 - DNA, 20 bp, Artificial Sequence
  chemically synthesized
cttcttctgcctgattgccc

SEQ ID NO: 325332 - DNA, 20 bp, Artificial Sequence
  chemically synthesized
gaagttccggccagggcaat

SEQ ID NO: 325333 - DNA, 20 bp, Artificial Sequence
  chemically synthesized
ttctgcctgattgccctggc

SEQ ID NO: 325334 - DNA, 20 bp, Artificial Sequence
  chemically synthesized
agtgttggaagttccggcca

SEQ ID NO: 325335 - DNA, 20 bp, Artificial Sequence
  chemically synthesized
tagtgttggaagttccggcc

SEQ ID NO: 325336 - DNA, 20 bp, Artificial Sequence
  chemically synthesized
atagtgttggaagttccggc

SEQ ID NO: 325337 - DNA, 20 bp, Artificial Sequence
  chemically synthesized
caacatagtgttggaagttc

SEQ ID NO: 325338 - DNA, 20 bp, Artificial Sequence
  chemically synthesized
cctattcaacatagtgttgg

SEQ ID NO: 325339 - DNA, 20 bp, Artificial Sequence
  chemically synthesized
actcctattcaacatagtgt

SEQ ID NO: 325340 - DNA, 20 bp, Artificial Sequence
  chemically synthesized
acttccaacactatgttgaa

SEQ ID NO: 325341 - DNA, 20 bp, Artificial Sequence
  chemically synthesized
ctcaccactcctattcaaca

SEQ ID NO: 325342 - DNA, 20 bp, Artificial Sequence
  chemically synthesized
cttccaacactatgttgaat

SEQ ID NO: 325343 - DNA, 20 bp, Artificial Sequence
  chemically synthesized
tccaacactatgttgaatag

SEQ ID NO: 325344 - DNA, 20 bp, Artificial Sequence
  chemically synthesized
aacactatgttgaataggag

SEQ ID NO: 325345 - DNA, 20 bp, Artificial Sequence
  chemically synthesized
ctatgttgaataggagtggt

SEQ ID NO: 325346 - DNA, 20 bp, Artificial Sequence
  chemically synthesized
atgttgaataggagtggtga

SEQ ID NO: 325347 - DNA, 20 bp, Artificial Sequence
  chemically synthesized
gttgaataggagtggtgaga

SEQ ID NO: 325348 - DNA, 20 bp, Artificial Sequence
  chemically synthesized
ttgaataggagtggtgagag

SEQ ID NO: 325349 - DNA, 20 bp, Artificial Sequence
  chemically synthesized
tgaataggagtggtgagaga

SEQ ID NO: 325350 - DNA, 20 bp, Artificial Sequence
  chemically synthesized
ttgaaaactggcacaagaca

SEQ ID NO: 325351 - DNA, 20 bp, Artificial Sequence
  chemically synthesized
tttgaaaactggcacaagac

SEQ ID NO: 325352 - DNA, 20 bp, Artificial Sequence
  chemically synthesized
ctttgaaaactggcacaaga

SEQ ID NO: 325353 - DNA, 20 bp, Artificial Sequence
  chemically synthesized
agggcatccctgtcttgtgc

SEQ ID NO: 325354 - DNA, 20 bp, Artificial Sequence
  chemically synthesized
ttccctttgaaaactggcac

SEQ ID NO: 325355 - DNA, 20 bp, Artificial Sequence
  chemically synthesized
ctgtcttgtgccagttttca

SEQ ID NO: 325356 - DNA, 20 bp, Artificial Sequence
  chemically synthesized
gaagcattccctttgaaaac

SEQ ID NO: 325357 - DNA, 20 bp, Artificial Sequence
  chemically synthesized
tgtcttgtgccagttttcaa

SEQ ID NO: 325358 - DNA, 20 bp, Artificial Sequence
  chemically synthesized
gtcttgtgccagttttcaaa

SEQ ID NO: 325359 - DNA, 20 bp, Artificial Sequence
  chemically synthesized
gttttcaaagggaatgcttc

SEQ ID NO: 325360 - DNA, 20 bp, Artificial Sequence
  chemically synthesized
attgaatgggcaaaaactgg

SEQ ID NO: 325361 - DNA, 20 bp, Artificial Sequence
  chemically synthesized
catattgaatgggcaaaaac

SEQ ID NO: 325362 - DNA, 20 bp, Artificial Sequence
  chemically synthesized
cagccactatcatattgaat

SEQ ID NO: 325363 - DNA, 20 bp, Artificial Sequence
  chemically synthesized
acagccactatcatattgaa

SEQ ID NO: 325364 - DNA, 20 bp, Artificial Sequence
  chemically synthesized
tttttgcccattcaatatga

SEQ ID NO: 325365 - DNA, 20 bp, Artificial Sequence
  chemically synthesized
ttgcccattcaatatgatag

SEQ ID NO: 325366 - DNA, 20 bp, Artificial Sequence
  chemically synthesized
attcaatatgatagtggctg

SEQ ID NO: 325367 - DNA, 20 bp, Artificial Sequence
  chemically synthesized
ttcaatatgatagtggctgt

SEQ ID NO: 325368 - DNA, 20 bp, Artificial Sequence
  chemically synthesized
agctatgtatgacaaaccca

SEQ ID NO: 325369 - DNA, 20 bp, Artificial Sequence
  chemically synthesized
ggctgtgggtttgtcataca

SEQ ID NO: 325370 - DNA, 20 bp, Artificial Sequence
  chemically synthesized
gacgtatcttaaaataataa

SEQ ID NO: 325371 - DNA, 20 bp, Artificial Sequence
  chemically synthesized
gggacgtatcttaaaataat

SEQ ID NO: 325372 - DNA, 20 bp, Artificial Sequence
  chemically synthesized
tacatagctcttattatttt

SEQ ID NO: 325373 - DNA, 20 bp, Artificial Sequence
  chemically synthesized
tcaataaattaggtattgat

SEQ ID NO: 325374 - DNA, 20 bp, Artificial Sequence
  chemically synthesized
ctcaataaattaggtattga

SEQ ID NO: 325375 - DNA, 20 bp, Artificial Sequence
  chemically synthesized
ctaaaaactctcaataaatt

SEQ ID NO: 325376 - DNA, 20 bp, Artificial Sequence
  chemically synthesized
ccatcaatacctaatttatt

SEQ ID NO: 325377 - DNA, 20 bp, Artificial Sequence
  chemically synthesized
gctaaaaactctcaataaat

SEQ ID NO: 325378 - DNA, 20 bp, Artificial Sequence
  chemically synthesized
atcaatacctaatttattga

SEQ ID NO: 325379 - DNA, 20 bp, Artificial Sequence
  chemically synthesized
cctaatttattgagagtttt

SEQ ID NO: 325380 - DNA, 20 bp, Artificial Sequence
  chemically synthesized
tattgagagtttttagcatg

SEQ ID NO: 325381 - DNA, 20 bp, Artificial Sequence
  chemically synthesized
attgagagtttttagcatga

SEQ ID NO: 325382 - DNA, 20 bp, Artificial Sequence
  chemically synthesized
aaggttgttgaattttgtca

SEQ ID NO: 325383 - DNA, 20 bp, Artificial Sequence
  chemically synthesized
aggttgttgaattttgtcaa

SEQ ID NO: 325384 - DNA, 20 bp, Artificial Sequence
  chemically synthesized
tatctccatagatgcagaaa

SEQ ID NO: 325385 - DNA, 20 bp, Artificial Sequence
  chemically synthesized
ttatctccatagatgcagaa

SEQ ID NO: 325386 - DNA, 20 bp, Artificial Sequence
  chemically synthesized
aaaggccttttctgcatcta

SEQ ID NO: 325387 - DNA, 20 bp, Artificial Sequence
  chemically synthesized
catgattatctccatagatg

SEQ ID NO: 325388 - DNA, 20 bp, Artificial Sequence
  chemically synthesized
aggccttttctgcatctatg

SEQ ID NO: 325389 - DNA, 20 bp, Artificial Sequence
  chemically synthesized
aaaccacatgattatctcca

SEQ ID NO: 325390 - DNA, 20 bp, Artificial Sequence
  chemically synthesized
catctatggagataatcatg

SEQ ID NO: 325391 - DNA, 20 bp, Artificial Sequence
  chemically synthesized
aatcatgtggtttctatctt

SEQ ID NO: 325392 - DNA, 20 bp, Artificial Sequence
  chemically synthesized
catataaacagaaccaaaga

SEQ ID NO: 325393 - DNA, 20 bp, Artificial Sequence
  chemically synthesized
gcagcatataaacagaacca

SEQ ID NO: 325394 - DNA, 20 bp, Artificial Sequence
  chemically synthesized
aatataatgcagcatataaa

SEQ ID NO: 325395 - DNA, 20 bp, Artificial Sequence
  chemically synthesized
acaaatcaataaatataatg

SEQ ID NO: 325396 - DNA, 20 bp, Artificial Sequence
  chemically synthesized
ttgatttgtgtgtgttgaac

SEQ ID NO: 325397 - DNA, 20 bp, Artificial Sequence
  chemically synthesized
tcatccctgggatgcagggc

SEQ ID NO: 325398 - DNA, 20 bp, Artificial Sequence
  chemically synthesized
gttgaaccagccctgcatcc

SEQ ID NO: 325399 - DNA, 20 bp, Artificial Sequence
  chemically synthesized
ggcttcatccctgggatgca

SEQ ID NO: 325400 - DNA, 20 bp, Artificial Sequence
  chemically synthesized
ttgaaccagccctgcatccc

SEQ ID NO: 325401 - DNA, 20 bp, Artificial Sequence
  chemically synthesized
gggcttcatccctgggatgc

SEQ ID NO: 325402 - DNA, 20 bp, Artificial Sequence
  chemically synthesized
tgaaccagccctgcatccca

SEQ ID NO: 325403 - DNA, 20 bp, Artificial Sequence
  chemically synthesized
tgggcttcatccctgggatg

SEQ ID NO: 325404 - DNA, 20 bp, Artificial Sequence
  chemically synthesized
agccctgcatcccagggatg

SEQ ID NO: 325405 - DNA, 20 bp, Artificial Sequence
  chemically synthesized
atcaagtgggcttcatccct

SEQ ID NO: 325406 - DNA, 20 bp, Artificial Sequence
  chemically synthesized
tatcaagtgggcttcatccc

SEQ ID NO: 325407 - DNA, 20 bp, Artificial Sequence
  chemically synthesized
cttatccaccattatcaagt

SEQ ID NO: 325408 - DNA, 20 bp, Artificial Sequence
  chemically synthesized
gcttatccaccattatcaag

SEQ ID NO: 325409 - DNA, 20 bp, Artificial Sequence
  chemically synthesized
ggatgaagcccacttgataa

SEQ ID NO: 325410 - DNA, 20 bp, Artificial Sequence
  chemically synthesized
aaagcttatccaccattatc

SEQ ID NO: 325411 - DNA, 20 bp, Artificial Sequence
  chemically synthesized
tgaagcccacttgataatgg

SEQ ID NO: 325412 - DNA, 20 bp, Artificial Sequence
  chemically synthesized
cccacttgataatggtggat

SEQ ID NO: 325413 - DNA, 20 bp, Artificial Sequence
  chemically synthesized
gaatccagcagcacatcaaa

SEQ ID NO: 325414 - DNA, 20 bp, Artificial Sequence
  chemically synthesized
taagctttttgatgtgctgc

SEQ ID NO: 325415 - DNA, 20 bp, Artificial Sequence
  chemically synthesized
ttttgatgtgctgctggatt

SEQ ID NO: 325416 - DNA, 20 bp, Artificial Sequence
  chemically synthesized
tactggcaatccgaatccag

SEQ ID NO: 325417 - DNA, 20 bp, Artificial Sequence
  chemically synthesized
aaatactggcaatccgaatc

SEQ ID NO: 325418 - DNA, 20 bp, Artificial Sequence
  chemically synthesized
tgctgctggattcggattgc

SEQ ID NO: 325419 - DNA, 20 bp, Artificial Sequence
  chemically synthesized
aaaaatcctcaataaaatac

SEQ ID NO: 325420 - DNA, 20 bp, Artificial Sequence
  chemically synthesized
cggattgccagtattttatt

SEQ ID NO: 325421 - DNA, 20 bp, Artificial Sequence
  chemically synthesized
ggattgccagtattttattg

SEQ ID NO: 325422 - DNA, 20 bp, Artificial Sequence
  chemically synthesized
tttttgcatcaatgttcatc

SEQ ID NO: 325423 - DNA, 20 bp, Artificial Sequence
  chemically synthesized
ttttgcatcaatgttcatca

SEQ ID NO: 325424 - DNA, 20 bp, Artificial Sequence
  chemically synthesized
tcaatgttcatcaaggatat

SEQ ID NO: 325425 - DNA, 20 bp, Artificial Sequence
  chemically synthesized
aaacaaaaaaaagagaattt

SEQ ID NO: 325426 - DNA, 20 bp, Artificial Sequence
  chemically synthesized
cagagacaaaacaaaaaaaa

SEQ ID NO: 325427 - DNA, 20 bp, Artificial Sequence
  chemically synthesized
ggcagagacaaaacaaaaaa

SEQ ID NO: 325428 - DNA, 20 bp, Artificial Sequence
  chemically synthesized
tttttttgttttgtctctgc

SEQ ID NO: 325429 - DNA, 20 bp, Artificial Sequence
  chemically synthesized
ttttttgttttgtctctgcc

SEQ ID NO: 325430 - DNA, 20 bp, Artificial Sequence
  chemically synthesized
cctgataccaaagcctggca

SEQ ID NO: 325431 - DNA, 20 bp, Artificial Sequence
  chemically synthesized
atcctgataccaaagcctgg

SEQ ID NO: 325432 - DNA, 20 bp, Artificial Sequence
  chemically synthesized
gttttgtctctgccaggctt

SEQ ID NO: 325433 - DNA, 20 bp, Artificial Sequence
  chemically synthesized
atcatcctgataccaaagcc

SEQ ID NO: 325434 - DNA, 20 bp, Artificial Sequence
  chemically synthesized
tctctgccaggctttggtat

SEQ ID NO: 325435 - DNA, 20 bp, Artificial Sequence
  chemically synthesized
ctctgccaggctttggtatc

SEQ ID NO: 325436 - DNA, 20 bp, Artificial Sequence
  chemically synthesized
caagcatcatcctgatacca

SEQ ID NO: 325437 - DNA, 20 bp, Artificial Sequence
  chemically synthesized
cctaactcattttatgaggc

SEQ ID NO: 325438 - DNA, 20 bp, Artificial Sequence
  chemically synthesized
cctccctaactcattttatg

SEQ ID NO: 325439 - DNA, 20 bp, Artificial Sequence
  chemically synthesized
tgatgcttgcctcataaaat

SEQ ID NO: 325440 - DNA, 20 bp, Artificial Sequence
  chemically synthesized
tcctccctaactcattttat

SEQ ID NO: 325441 - DNA, 20 bp, Artificial Sequence
  chemically synthesized
gcttgcctcataaaatgagt

SEQ ID NO: 325442 - DNA, 20 bp, Artificial Sequence
  chemically synthesized
cttgcctcataaaatgagtt

SEQ ID NO: 325443 - DNA, 20 bp, Artificial Sequence
  chemically synthesized
ttgcctcataaaatgagtta

SEQ ID NO: 325444 - DNA, 20 bp, Artificial Sequence
  chemically synthesized
gcctcataaaatgagttagg

SEQ ID NO: 325445 - DNA, 20 bp, Artificial Sequence
  chemically synthesized
cctcataaaatgagttaggg

SEQ ID NO: 325446 - DNA, 20 bp, Artificial Sequence
  chemically synthesized
ttccaatgaatagaaaaaga

SEQ ID NO: 325447 - DNA, 20 bp, Artificial Sequence
  chemically synthesized
attccaatgaatagaaaaag

SEQ ID NO: 325448 - DNA, 20 bp, Artificial Sequence
  chemically synthesized
tattccaatgaatagaaaaa

SEQ ID NO: 325449 - DNA, 20 bp, Artificial Sequence
  chemically synthesized
actattccaatgaatagaaa

SEQ ID NO: 325450 - DNA, 20 bp, Artificial Sequence
  chemically synthesized
ttccctctttttctattcat

SEQ ID NO: 325451 - DNA, 20 bp, Artificial Sequence
  chemically synthesized
tctgaaactattccaatgaa

SEQ ID NO: 325452 - DNA, 20 bp, Artificial Sequence
  chemically synthesized
tctttttctattcattggaa

SEQ ID NO: 325453 - DNA, 20 bp, Artificial Sequence
  chemically synthesized
tctattcattggaatagttt

SEQ ID NO: 325454 - DNA, 20 bp, Artificial Sequence
  chemically synthesized
attcattggaatagtttcag

SEQ ID NO: 325455 - DNA, 20 bp, Artificial Sequence
  chemically synthesized
ttcattggaatagtttcaga

SEQ ID NO: 325456 - DNA, 20 bp, Artificial Sequence
  chemically synthesized
tggaatagtttcagaaggaa

SEQ ID NO: 325457 - DNA, 20 bp, Artificial Sequence
  chemically synthesized
agtttcagaaggaatggtac

SEQ ID NO: 325458 - DNA, 20 bp, Artificial Sequence
  chemically synthesized
ccagaggtacaaggaagagc

SEQ ID NO: 325459 - DNA, 20 bp, Artificial Sequence
  chemically synthesized
tctaccagaggtacaaggaa

SEQ ID NO: 325460 - DNA, 20 bp, Artificial Sequence
  chemically synthesized
attctaccagaggtacaagg

SEQ ID NO: 325461 - DNA, 20 bp, Artificial Sequence
  chemically synthesized
cgaattctaccagaggtaca

SEQ ID NO: 325462 - DNA, 20 bp, Artificial Sequence
  chemically synthesized
ccagctcttccttgtacctc

SEQ ID NO: 325463 - DNA, 20 bp, Artificial Sequence
  chemically synthesized
ccgaattctaccagaggtac

SEQ ID NO: 325464 - DNA, 20 bp, Artificial Sequence
  chemically synthesized
gctcttccttgtacctctgg

SEQ ID NO: 325465 - DNA, 20 bp, Artificial Sequence
  chemically synthesized
tcacagccgaattctaccag

SEQ ID NO: 325466 - DNA, 20 bp, Artificial Sequence
  chemically synthesized
ttcacagccgaattctacca

SEQ ID NO: 325467 - DNA, 20 bp, Artificial Sequence
  chemically synthesized
gattcacagccgaattctac

SEQ ID NO: 325468 - DNA, 20 bp, Artificial Sequence
  chemically synthesized
cttgtacctctggtagaatt

SEQ ID NO: 325469 - DNA, 20 bp, Artificial Sequence
  chemically synthesized
tccaggaccagatggattca

SEQ ID NO: 325470 - DNA, 20 bp, Artificial Sequence
  chemically synthesized
aattcggctgtgaatccatc

SEQ ID NO: 325471 - DNA, 20 bp, Artificial Sequence
  chemically synthesized
aaaaaaagtccaggaccaga

SEQ ID NO: 325472 - DNA, 20 bp, Artificial Sequence
  chemically synthesized
gctgtgaatccatctggtcc

SEQ ID NO: 325473 - DNA, 20 bp, Artificial Sequence
  chemically synthesized
aaccaaaaaaagtccaggac

SEQ ID NO: 325474 - DNA, 20 bp, Artificial Sequence
  chemically synthesized
ctaccaaccaaaaaaagtcc

SEQ ID NO: 325475 - DNA, 20 bp, Artificial Sequence
  chemically synthesized
cctaccaaccaaaaaaagtc

SEQ ID NO: 325476 - DNA, 20 bp, Artificial Sequence
  chemically synthesized
atctggtcctggactttttt

SEQ ID NO: 325477 - DNA, 20 bp, Artificial Sequence
  chemically synthesized
aatagcctaccaaccaaaaa

SEQ ID NO: 325478 - DNA, 20 bp, Artificial Sequence
  chemically synthesized
ggtcctggactttttttggt

SEQ ID NO: 325479 - DNA, 20 bp, Artificial Sequence
  chemically synthesized
cctggactttttttggttgg

SEQ ID NO: 325480 - DNA, 20 bp, Artificial Sequence
  chemically synthesized
ctggactttttttggttggt

SEQ ID NO: 325481 - DNA, 20 bp, Artificial Sequence
  chemically synthesized
gaaattgaggcaataattaa

SEQ ID NO: 325482 - DNA, 20 bp, Artificial Sequence
  chemically synthesized
attaattattgcctcaattt

SEQ ID NO: 325483 - DNA, 20 bp, Artificial Sequence
  chemically synthesized
aataacaggctctgaaattg

SEQ ID NO: 325484 - DNA, 20 bp, Artificial Sequence
  chemically synthesized
taattattgcctcaatttca

SEQ ID NO: 325485 - DNA, 20 bp, Artificial Sequence
  chemically synthesized
caataacaggctctgaaatt

SEQ ID NO: 325486 - DNA, 20 bp, Artificial Sequence
  chemically synthesized
tcaatttcagagcctgttat

SEQ ID NO: 325487 - DNA, 20 bp, Artificial Sequence
  chemically synthesized
tccctgaatagaccaataac

SEQ ID NO: 325488 - DNA, 20 bp, Artificial Sequence
  chemically synthesized
atccctgaatagaccaataa

SEQ ID NO: 325489 - DNA, 20 bp, Artificial Sequence
  chemically synthesized
gagcctgttattggtctatt

SEQ ID NO: 325490 - DNA, 20 bp, Artificial Sequence
  chemically synthesized
agcctgttattggtctattc

SEQ ID NO: 325491 - DNA, 20 bp, Artificial Sequence
  chemically synthesized
gcctgttattggtctattca

SEQ ID NO: 325492 - DNA, 20 bp, Artificial Sequence
  chemically synthesized
caggaagttgaatccctgaa

SEQ ID NO: 325493 - DNA, 20 bp, Artificial Sequence
  chemically synthesized
tattcagggattcaacttcc

SEQ ID NO: 325494 - DNA, 20 bp, Artificial Sequence
  chemically synthesized
agggattcaacttcctggtt

SEQ ID NO: 325495 - DNA, 20 bp, Artificial Sequence
  chemically synthesized
cctcccaagactaaaccagg

SEQ ID NO: 325496 - DNA, 20 bp, Artificial Sequence
  chemically synthesized
caccctcccaagactaaacc

SEQ ID NO: 325497 - DNA, 20 bp, Artificial Sequence
  chemically synthesized
acaccctcccaagactaaac

SEQ ID NO: 325498 - DNA, 20 bp, Artificial Sequence
  chemically synthesized
tcaacttcctggtttagtct

SEQ ID NO: 325499 - DNA, 20 bp, Artificial Sequence
  chemically synthesized
caacttcctggtttagtctt

SEQ ID NO: 325500 - DNA, 20 bp, Artificial Sequence
  chemically synthesized
acttcctggtttagtcttgg

SEQ ID NO: 325501 - DNA, 20 bp, Artificial Sequence
  chemically synthesized
cttcctggtttagtcttggg

SEQ ID NO: 325502 - DNA, 20 bp, Artificial Sequence
  chemically synthesized
ttcctggtttagtcttggga

SEQ ID NO: 325503 - DNA, 20 bp, Artificial Sequence
  chemically synthesized
gtggacacatacaccctccc

SEQ ID NO: 325504 - DNA, 20 bp, Artificial Sequence
  chemically synthesized
agaaggaatggataaattcg

SEQ ID NO: 325505 - DNA, 20 bp, Artificial Sequence
  chemically synthesized
acgaatttatccattccttc

SEQ ID NO: 325506 - DNA, 20 bp, Artificial Sequence
  chemically synthesized
actagaaaatctagaaggaa

SEQ ID NO: 325507 - DNA, 20 bp, Artificial Sequence
  chemically synthesized
aataaactagaaaatctaga

SEQ ID NO: 325508 - DNA, 20 bp, Artificial Sequence
  chemically synthesized
aaataaactagaaaatctag

SEQ ID NO: 325509 - DNA, 20 bp, Artificial Sequence
  chemically synthesized
tccattccttctagattttc

SEQ ID NO: 325510 - DNA, 20 bp, Artificial Sequence
  chemically synthesized
cgcaaataaactagaaaatc

SEQ ID NO: 325511 - DNA, 20 bp, Artificial Sequence
  chemically synthesized
acacctctacgcaaataaac

SEQ ID NO: 325512 - DNA, 20 bp, Artificial Sequence
  chemically synthesized
gattttctagtttatttgcg

SEQ ID NO: 325513 - DNA, 20 bp, Artificial Sequence
  chemically synthesized
ttttctagtttatttgcgta

SEQ ID NO: 325514 - DNA, 20 bp, Artificial Sequence
  chemically synthesized
tttctagtttatttgcgtag

SEQ ID NO: 325515 - DNA, 20 bp, Artificial Sequence
  chemically synthesized
tatttgcgtagaggtgttta

SEQ ID NO: 325516 - DNA, 20 bp, Artificial Sequence
  chemically synthesized
gtgtttacagttttctctga

SEQ ID NO: 325517 - DNA, 20 bp, Artificial Sequence
  chemically synthesized
tttacagttttctctgatgg

SEQ ID NO: 325518 - DNA, 20 bp, Artificial Sequence
  chemically synthesized
agaaattcaaactaccatca

SEQ ID NO: 325519 - DNA, 20 bp, Artificial Sequence
  chemically synthesized
acagaaattcaaactaccat

SEQ ID NO: 325520 - DNA, 20 bp, Artificial Sequence
  chemically synthesized
gatggtagtttgaatttctg

SEQ ID NO: 325521 - DNA, 20 bp, Artificial Sequence
  chemically synthesized
atggtagtttgaatttctgt

SEQ ID NO: 325522 - DNA, 20 bp, Artificial Sequence
  chemically synthesized
agtttgaatttctgtgggat

SEQ ID NO: 325523 - DNA, 20 bp, Artificial Sequence
  chemically synthesized
ggatatcaccaccgatccca

SEQ ID NO: 325524 - DNA, 20 bp, Artificial Sequence
  chemically synthesized
ttgaatttctgtgggatcgg

SEQ ID NO: 325525 - DNA, 20 bp, Artificial Sequence
  chemically synthesized
tgcaataaaaaataataaag

SEQ ID NO: 325526 - DNA, 20 bp, Artificial Sequence
  chemically synthesized
atgcaataaaaaataataaa

SEQ ID NO: 325527 - DNA, 20 bp, Artificial Sequence
  chemically synthesized
gatgcaataaaaaataataa

SEQ ID NO: 325528 - DNA, 20 bp, Artificial Sequence
  chemically synthesized
agatgcaataaaaaataata

SEQ ID NO: 325529 - DNA, 20 bp, Artificial Sequence
  chemically synthesized
gaaaagagagaagaatcaaa

SEQ ID NO: 325530 - DNA, 20 bp, Artificial Sequence
  chemically synthesized
agactaataagaaaagagag

SEQ ID NO: 325531 - DNA, 20 bp, Artificial Sequence
  chemically synthesized
gcaagactaataagaaaaga

SEQ ID NO: 325532 - DNA, 20 bp, Artificial Sequence
  chemically synthesized
tagcaagactaataagaaaa

SEQ ID NO: 325533 - DNA, 20 bp, Artificial Sequence
  chemically synthesized
attcttctctcttttcttat

SEQ ID NO: 325534 - DNA, 20 bp, Artificial Sequence
  chemically synthesized
gctagcaagactaataagaa

SEQ ID NO: 325535 - DNA, 20 bp, Artificial Sequence
  chemically synthesized
agatcgctagcaagactaat

SEQ ID NO: 325536 - DNA, 20 bp, Artificial Sequence
  chemically synthesized
tcttttcttattagtcttgc

SEQ ID NO: 325537 - DNA, 20 bp, Artificial Sequence
  chemically synthesized
aaaattgatagatcgctagc

SEQ ID NO: 325538 - DNA, 20 bp, Artificial Sequence
  chemically synthesized
caacaaaattgatagatcgc

SEQ ID NO: 325539 - DNA, 20 bp, Artificial Sequence
  chemically synthesized
gttatgatcaacaaaattga

SEQ ID NO: 325540 - DNA, 20 bp, Artificial Sequence
  chemically synthesized
tcaattttgttgatcataac

SEQ ID NO: 325541 - DNA, 20 bp, Artificial Sequence
  chemically synthesized
tgttgatcataaccagctcc

SEQ ID NO: 325542 - DNA, 20 bp, Artificial Sequence
  chemically synthesized
aaatcaatgaatctaggagc

SEQ ID NO: 325543 - DNA, 20 bp, Artificial Sequence
  chemically synthesized
taaaaaatcaatgaatctag

SEQ ID NO: 325544 - DNA, 20 bp, Artificial Sequence
  chemically synthesized
tttaaaaaatcaatgaatct

SEQ ID NO: 325545 - DNA, 20 bp, Artificial Sequence
  chemically synthesized
ctttaaaaaatcaatgaatc

SEQ ID NO: 325546 - DNA, 20 bp, Artificial Sequence
  chemically synthesized
ctagattcattgatttttta

SEQ ID NO: 325547 - DNA, 20 bp, Artificial Sequence
  chemically synthesized
tagattcattgattttttaa

SEQ ID NO: 325548 - DNA, 20 bp, Artificial Sequence
  chemically synthesized
agattcattgattttttaaa

SEQ ID NO: 325549 - DNA, 20 bp, Artificial Sequence
  chemically synthesized
gaaggaaatagagacacaaa

SEQ ID NO: 325550 - DNA, 20 bp, Artificial Sequence
  chemically synthesized
gagcccaactgaaggaaata

SEQ ID NO: 325551 - DNA, 20 bp, Artificial Sequence
  chemically synthesized
ttttgtgtctctatttcctt

SEQ ID NO: 325552 - DNA, 20 bp, Artificial Sequence
  chemically synthesized
cagagcccaactgaaggaaa

SEQ ID NO: 325553 - DNA, 20 bp, Artificial Sequence
  chemically synthesized
gtgtctctatttccttcagt

SEQ ID NO: 325554 - DNA, 20 bp, Artificial Sequence
  chemically synthesized
tgtctctatttccttcagtt

SEQ ID NO: 325555 - DNA, 20 bp, Artificial Sequence
  chemically synthesized
taagatcagagcccaactga

SEQ ID NO: 325556 - DNA, 20 bp, Artificial Sequence
  chemically synthesized
ctaagatcagagcccaactg

SEQ ID NO: 325557 - DNA, 20 bp, Artificial Sequence
  chemically synthesized
cttcagttgggctctgatct

SEQ ID NO: 325558 - DNA, 20 bp, Artificial Sequence
  chemically synthesized
gcaagaaataactaagatca

SEQ ID NO: 325559 - DNA, 20 bp, Artificial Sequence
  chemically synthesized
aggcaagaaataactaagat

SEQ ID NO: 325560 - DNA, 20 bp, Artificial Sequence
  chemically synthesized
gcagaaggcaagaaataact

SEQ ID NO: 325561 - DNA, 20 bp, Artificial Sequence
  chemically synthesized
ttcaaaagctagcagaaggc

SEQ ID NO: 325562 - DNA, 20 bp, Artificial Sequence
  chemically synthesized
agttatttcttgccttctgc

SEQ ID NO: 325563 - DNA, 20 bp, Artificial Sequence
  chemically synthesized
cacattcaaaagctagcaga

SEQ ID NO: 325564 - DNA, 20 bp, Artificial Sequence
  chemically synthesized
acacattcaaaagctagcag

SEQ ID NO: 325565 - DNA, 20 bp, Artificial Sequence
  chemically synthesized
caaacacattcaaaagctag

SEQ ID NO: 325566 - DNA, 20 bp, Artificial Sequence
  chemically synthesized
gagcaaacacattcaaaagc

SEQ ID NO: 325567 - DNA, 20 bp, Artificial Sequence
  chemically synthesized
gcaagagcaaacacattcaa

SEQ ID NO: 325568 - DNA, 20 bp, Artificial Sequence
  chemically synthesized
taaaagaactagagaagcaa

SEQ ID NO: 325569 - DNA, 20 bp, Artificial Sequence
  chemically synthesized
tgtgtttgctcttgcttctc

SEQ ID NO: 325570 - DNA, 20 bp, Artificial Sequence
  chemically synthesized
attaaaagaactagagaagc

SEQ ID NO: 325571 - DNA, 20 bp, Artificial Sequence
  chemically synthesized
aacaattaaaagaactagag

SEQ ID NO: 325572 - DNA, 20 bp, Artificial Sequence
  chemically synthesized
cataacaattaaaagaacta

SEQ ID NO: 325573 - DNA, 20 bp, Artificial Sequence
  chemically synthesized
aacataacaattaaaagaac

SEQ ID NO: 325574 - DNA, 20 bp, Artificial Sequence
  chemically synthesized
caccctaacataacaattaa

SEQ ID NO: 325575 - DNA, 20 bp, Artificial Sequence
  chemically synthesized
agttcttttaattgttatgt

SEQ ID NO: 325576 - DNA, 20 bp, Artificial Sequence
  chemically synthesized
gttcttttaattgttatgtt

SEQ ID NO: 325577 - DNA, 20 bp, Artificial Sequence
  chemically synthesized
ttcttttaattgttatgtta

SEQ ID NO: 325578 - DNA, 20 bp, Artificial Sequence
  chemically synthesized
ttatgttagggtgtcaattt

SEQ ID NO: 325579 - DNA, 20 bp, Artificial Sequence
  chemically synthesized
gcccacaagagaaagcagga

SEQ ID NO: 325580 - DNA, 20 bp, Artificial Sequence
  chemically synthesized
gaatgcccacaagagaaagc

SEQ ID NO: 325581 - DNA, 20 bp, Artificial Sequence
  chemically synthesized
tgaatgcccacaagagaaag

SEQ ID NO: 325582 - DNA, 20 bp, Artificial Sequence
  chemically synthesized
atctttcctgctttctcttg

SEQ ID NO: 325583 - DNA, 20 bp, Artificial Sequence
  chemically synthesized
cactgaatgcccacaagaga

SEQ ID NO: 325584 - DNA, 20 bp, Artificial Sequence
  chemically synthesized
tctttcctgctttctcttgt

SEQ ID NO: 325585 - DNA, 20 bp, Artificial Sequence
  chemically synthesized
atagcactgaatgcccacaa

SEQ ID NO: 325586 - DNA, 20 bp, Artificial Sequence
  chemically synthesized
ttatagcactgaatgcccac

SEQ ID NO: 325587 - DNA, 20 bp, Artificial Sequence
  chemically synthesized
tgctttctcttgtgggcatt

SEQ ID NO: 325588 - DNA, 20 bp, Artificial Sequence
  chemically synthesized
agtgtgtagagggaaattta

SEQ ID NO: 325589 - DNA, 20 bp, Artificial Sequence
  chemically synthesized
catttaaagcagtgtgtaga

SEQ ID NO: 325590 - DNA, 20 bp, Artificial Sequence
  chemically synthesized
acatttaaagcagtgtgtag

SEQ ID NO: 325591 - DNA, 20 bp, Artificial Sequence
  chemically synthesized
cacatttaaagcagtgtgta

SEQ ID NO: 325592 - DNA, 20 bp, Artificial Sequence
  chemically synthesized
gacacatttaaagcagtgtg

SEQ ID NO: 325593 - DNA, 20 bp, Artificial Sequence
  chemically synthesized
tctgtgggacacatttaaag

SEQ ID NO: 325594 - DNA, 20 bp, Artificial Sequence
  chemically synthesized
gaatctgtgggacacattta

SEQ ID NO: 325595 - DNA, 20 bp, Artificial Sequence
  chemically synthesized
actgctttaaatgtgtccca

SEQ ID NO: 325596 - DNA, 20 bp, Artificial Sequence
  chemically synthesized
cacaacataccagaatctgt

SEQ ID NO: 325597 - DNA, 20 bp, Artificial Sequence
  chemically synthesized
taaatgtgtcccacagattc

SEQ ID NO: 325598 - DNA, 20 bp, Artificial Sequence
  chemically synthesized
acacaacataccagaatctg

SEQ ID NO: 325599 - DNA, 20 bp, Artificial Sequence
  chemically synthesized
agaacaaagacacaacatac

SEQ ID NO: 325600 - DNA, 20 bp, Artificial Sequence
  chemically synthesized
ctttgaaaccaatgagaaca

SEQ ID NO: 325601 - DNA, 20 bp, Artificial Sequence
  chemically synthesized
tgttgtgtctttgttctcat

SEQ ID NO: 325602 - DNA, 20 bp, Artificial Sequence
  chemically synthesized
agatgttctttgaaaccaat

SEQ ID NO: 325603 - DNA, 20 bp, Artificial Sequence
  chemically synthesized
ctttgttctcattggtttca

SEQ ID NO: 325604 - DNA, 20 bp, Artificial Sequence
  chemically synthesized
acgaaatgaaggcagaaata

SEQ ID NO: 325605 - DNA, 20 bp, Artificial Sequence
  chemically synthesized
ggtacataacgaaatgaagg

SEQ ID NO: 325606 - DNA, 20 bp, Artificial Sequence
  chemically synthesized
ctgggtacataacgaaatga

SEQ ID NO: 325607 - DNA, 20 bp, Artificial Sequence
  chemically synthesized
actgggtacataacgaaatg

SEQ ID NO: 325608 - DNA, 20 bp, Artificial Sequence
  chemically synthesized
ccttcatttcgttatgtacc

SEQ ID NO: 325609 - DNA, 20 bp, Artificial Sequence
  chemically synthesized
tcatttcgttatgtacccag

SEQ ID NO: 325610 - DNA, 20 bp, Artificial Sequence
  chemically synthesized
cctgctgctgaatgactact

SEQ ID NO: 325611 - DNA, 20 bp, Artificial Sequence
  chemically synthesized
acctgctgctgaatgactac

SEQ ID NO: 325612 - DNA, 20 bp, Artificial Sequence
  chemically synthesized
ttatgtacccagtagtcatt

SEQ ID NO: 325613 - DNA, 20 bp, Artificial Sequence
  chemically synthesized
tgtacccagtagtcattcag

SEQ ID NO: 325614 - DNA, 20 bp, Artificial Sequence
  chemically synthesized
acccagtagtcattcagcag

SEQ ID NO: 325615 - DNA, 20 bp, Artificial Sequence
  chemically synthesized
cccagtagtcattcagcagc

SEQ ID NO: 325616 - DNA, 20 bp, Artificial Sequence
  chemically synthesized
tcattcagcagcaggttgtt

SEQ ID NO: 325617 - DNA, 20 bp, Artificial Sequence
  chemically synthesized
caggttgttcagtttccatg

SEQ ID NO: 325618 - DNA, 20 bp, Artificial Sequence
  chemically synthesized
tgttcagtttccatgtagtt

SEQ ID NO: 325619 - DNA, 20 bp, Artificial Sequence
  chemically synthesized
ctcaaaaccactcaactaca

SEQ ID NO: 325620 - DNA, 20 bp, Artificial Sequence
  chemically synthesized
tcagtttccatgtagttgag

SEQ ID NO: 325621 - DNA, 20 bp, Artificial Sequence
  chemically synthesized
ccatgtagttgagtggtttt

SEQ ID NO: 325622 - DNA, 20 bp, Artificial Sequence
  chemically synthesized
gtagttgagtggttttgagt

SEQ ID NO: 325623 - DNA, 20 bp, Artificial Sequence
  chemically synthesized
tttgagtgagtttcttaatc

SEQ ID NO: 325624 - DNA, 20 bp, Artificial Sequence
  chemically synthesized
tgagtgagtttcttaatcca

SEQ ID NO: 325625 - DNA, 20 bp, Artificial Sequence
  chemically synthesized
tcaaactagaactctggatt

SEQ ID NO: 325626 - DNA, 20 bp, Artificial Sequence
  chemically synthesized
agtttcttaatccagagttc

SEQ ID NO: 325627 - DNA, 20 bp, Artificial Sequence
  chemically synthesized
gttcaatcaaactagaactc

SEQ ID NO: 325628 - DNA, 20 bp, Artificial Sequence
  chemically synthesized
agaccacagttcaatcaaac

SEQ ID NO: 325629 - DNA, 20 bp, Artificial Sequence
  chemically synthesized
gttctagtttgattgaactg

SEQ ID NO: 325630 - DNA, 20 bp, Artificial Sequence
  chemically synthesized
gtttgattgaactgtggtct

SEQ ID NO: 325631 - DNA, 20 bp, Artificial Sequence
  chemically synthesized
acaaagtgtctctcagacca

SEQ ID NO: 325632 - DNA, 20 bp, Artificial Sequence
  chemically synthesized
ttgattgaactgtggtctga

SEQ ID NO: 325633 - DNA, 20 bp, Artificial Sequence
  chemically synthesized
aattataacaaagtgtctct

SEQ ID NO: 325634 - DNA, 20 bp, Artificial Sequence
  chemically synthesized
aaagaacagaaattataaca

SEQ ID NO: 325635 - DNA, 20 bp, Artificial Sequence
  chemically synthesized
cctcagcaaatgtaaaagaa

SEQ ID NO: 325636 - DNA, 20 bp, Artificial Sequence
  chemically synthesized
gcacccctcagcaaatgtaa

SEQ ID NO: 325637 - DNA, 20 bp, Artificial Sequence
  chemically synthesized
tctgttcttttacatttgct

SEQ ID NO: 325638 - DNA, 20 bp, Artificial Sequence
  chemically synthesized
ctgttcttttacatttgctg

SEQ ID NO: 325639 - DNA, 20 bp, Artificial Sequence
  chemically synthesized
tgttcttttacatttgctga

SEQ ID NO: 325640 - DNA, 20 bp, Artificial Sequence
  chemically synthesized
gttcttttacatttgctgag

SEQ ID NO: 325641 - DNA, 20 bp, Artificial Sequence
  chemically synthesized
ttggaagttaaagcacccct

SEQ ID NO: 325642 - DNA, 20 bp, Artificial Sequence
  chemically synthesized
gaccacatagttggaagtta

SEQ ID NO: 325643 - DNA, 20 bp, Artificial Sequence
  chemically synthesized
aaaattgaccacatagttgg

SEQ ID NO: 325644 - DNA, 20 bp, Artificial Sequence
  chemically synthesized
tgctttaacttccaactatg

SEQ ID NO: 325645 - DNA, 20 bp, Artificial Sequence
  chemically synthesized
tccaaaattgaccacatagt

SEQ ID NO: 325646 - DNA, 20 bp, Artificial Sequence
  chemically synthesized
ttattccaaaattgaccaca

SEQ ID NO: 325647 - DNA, 20 bp, Artificial Sequence
  chemically synthesized
tccaactatgtggtcaattt

SEQ ID NO: 325648 - DNA, 20 bp, Artificial Sequence
  chemically synthesized
tatgtggtcaattttggaat

SEQ ID NO: 325649 - DNA, 20 bp, Artificial Sequence
  chemically synthesized
attttggaataagtgtgatg

SEQ ID NO: 325650 - DNA, 20 bp, Artificial Sequence
  chemically synthesized
aataagtgtgatgtggtgct

SEQ ID NO: 325651 - DNA, 20 bp, Artificial Sequence
  chemically synthesized
aagtgtgatgtggtgctgag

SEQ ID NO: 325652 - DNA, 20 bp, Artificial Sequence
  chemically synthesized
aacagattatacattcttct

SEQ ID NO: 325653 - DNA, 20 bp, Artificial Sequence
  chemically synthesized
agaatgtataatctgttgat

SEQ ID NO: 325654 - DNA, 20 bp, Artificial Sequence
  chemically synthesized
gaatgtataatctgttgatt

SEQ ID NO: 325655 - DNA, 20 bp, Artificial Sequence
  chemically synthesized
aatgtataatctgttgatta

SEQ ID NO: 325656 - DNA, 20 bp, Artificial Sequence
  chemically synthesized
aactctccacccctaatcaa

SEQ ID NO: 325657 - DNA, 20 bp, Artificial Sequence
  chemically synthesized
atgtataatctgttgattag

SEQ ID NO: 325658 - DNA, 20 bp, Artificial Sequence
  chemically synthesized
tataatctgttgattagggg

SEQ ID NO: 325659 - DNA, 20 bp, Artificial Sequence
  chemically synthesized
taatctgttgattaggggtg

SEQ ID NO: 325660 - DNA, 20 bp, Artificial Sequence
  chemically synthesized
atctgttgattaggggtgga

SEQ ID NO: 325661 - DNA, 20 bp, Artificial Sequence
  chemically synthesized
attaggggtggagagttctg

SEQ ID NO: 325662 - DNA, 20 bp, Artificial Sequence
  chemically synthesized
gcggacctcatagacatcta

SEQ ID NO: 325663 - DNA, 20 bp, Artificial Sequence
  chemically synthesized
agagttctgtagatgtctat

SEQ ID NO: 325664 - DNA, 20 bp, Artificial Sequence
  chemically synthesized
gagttctgtagatgtctatg

SEQ ID NO: 325665 - DNA, 20 bp, Artificial Sequence
  chemically synthesized
tctgcaacaagcggacctca

SEQ ID NO: 325666 - DNA, 20 bp, Artificial Sequence
  chemically synthesized
tctatgaggtccgcttgttg

SEQ ID NO: 325667 - DNA, 20 bp, Artificial Sequence
  chemically synthesized
gaactcagctctgcaacaag

SEQ ID NO: 325668 - DNA, 20 bp, Artificial Sequence
  chemically synthesized
tatgaggtccgcttgttgca

SEQ ID NO: 325669 - DNA, 20 bp, Artificial Sequence
  chemically synthesized
attgaactcagctctgcaac

SEQ ID NO: 325670 - DNA, 20 bp, Artificial Sequence
  chemically synthesized
ggtccgcttgttgcagagct

SEQ ID NO: 325671 - DNA, 20 bp, Artificial Sequence
  chemically synthesized
ggatatccaagaattgaact

SEQ ID NO: 325672 - DNA, 20 bp, Artificial Sequence
  chemically synthesized
gcagagctgagttcaattct

SEQ ID NO: 325673 - DNA, 20 bp, Artificial Sequence
  chemically synthesized
gaatgtcaacaaggatatcc

SEQ ID NO: 325674 - DNA, 20 bp, Artificial Sequence
  chemically synthesized
agtgagacagaatgtcaaca

SEQ ID NO: 325675 - DNA, 20 bp, Artificial Sequence
  chemically synthesized
cagtgagacagaatgtcaac

SEQ ID NO: 325676 - DNA, 20 bp, Artificial Sequence
  chemically synthesized
cattagacagatcagtgaga

SEQ ID NO: 325677 - DNA, 20 bp, Artificial Sequence
  chemically synthesized
acaacattagacagatcagt

SEQ ID NO: 325678 - DNA, 20 bp, Artificial Sequence
  chemically synthesized
actgacaacattagacagat

SEQ ID NO: 325679 - DNA, 20 bp, Artificial Sequence
  chemically synthesized
accccactgacaacattaga

SEQ ID NO: 325680 - DNA, 20 bp, Artificial Sequence
  chemically synthesized
actgatctgtctaatgttgt

SEQ ID NO: 325681 - DNA, 20 bp, Artificial Sequence
  chemically synthesized
taacaccccactgacaacat

SEQ ID NO: 325682 - DNA, 20 bp, Artificial Sequence
  chemically synthesized
gatctgtctaatgttgtcag

SEQ ID NO: 325683 - DNA, 20 bp, Artificial Sequence
  chemically synthesized
atctgtctaatgttgtcagt

SEQ ID NO: 325684 - DNA, 20 bp, Artificial Sequence
  chemically synthesized
tctgtctaatgttgtcagtg

SEQ ID NO: 325685 - DNA, 20 bp, Artificial Sequence
  chemically synthesized
atgttgtcagtggggtgtta

SEQ ID NO: 325686 - DNA, 20 bp, Artificial Sequence
  chemically synthesized
ctcccacacgttaataatgg

SEQ ID NO: 325687 - DNA, 20 bp, Artificial Sequence
  chemically synthesized
gactcccacacgttaataat

SEQ ID NO: 325688 - DNA, 20 bp, Artificial Sequence
  chemically synthesized
agactcccacacgttaataa

SEQ ID NO: 325689 - DNA, 20 bp, Artificial Sequence
  chemically synthesized
agtctcccattattaacgtg

SEQ ID NO: 325690 - DNA, 20 bp, Artificial Sequence
  chemically synthesized
gtctcccattattaacgtgt

SEQ ID NO: 325691 - DNA, 20 bp, Artificial Sequence
  chemically synthesized
ctcccattattaacgtgtgg

SEQ ID NO: 325692 - DNA, 20 bp, Artificial Sequence
  chemically synthesized
ttattaacgtgtgggagtct

SEQ ID NO: 325693 - DNA, 20 bp, Artificial Sequence
  chemically synthesized
tatagacctacaaagagact

SEQ ID NO: 325694 - DNA, 20 bp, Artificial Sequence
  chemically synthesized
tgggagtctaagtctctttg

SEQ ID NO: 325695 - DNA, 20 bp, Artificial Sequence
  chemically synthesized
gggagtctaagtctctttgt

SEQ ID NO: 325696 - DNA, 20 bp, Artificial Sequence
  chemically synthesized
agtccttatagacctacaaa

SEQ ID NO: 325697 - DNA, 20 bp, Artificial Sequence
  chemically synthesized
caagtccttatagacctaca

SEQ ID NO: 325698 - DNA, 20 bp, Artificial Sequence
  chemically synthesized
aagtctctttgtaggtctat

SEQ ID NO: 325699 - DNA, 20 bp, Artificial Sequence
  chemically synthesized
agtctctttgtaggtctata

SEQ ID NO: 325700 - DNA, 20 bp, Artificial Sequence
  chemically synthesized
attcataaagcaagtcctta

SEQ ID NO: 325701 - DNA, 20 bp, Artificial Sequence
  chemically synthesized
agcacccagattcataaagc

SEQ ID NO: 325702 - DNA, 20 bp, Artificial Sequence
  chemically synthesized
caggagcacccagattcata

SEQ ID NO: 325703 - DNA, 20 bp, Artificial Sequence
  chemically synthesized
aaggacttgctttatgaatc

SEQ ID NO: 325704 - DNA, 20 bp, Artificial Sequence
  chemically synthesized
aggacttgctttatgaatct

SEQ ID NO: 325705 - DNA, 20 bp, Artificial Sequence
  chemically synthesized
gcacccaattcaggagcacc

SEQ ID NO: 325706 - DNA, 20 bp, Artificial Sequence
  chemically synthesized
gaatctgggtgctcctgaat

SEQ ID NO: 325707 - DNA, 20 bp, Artificial Sequence
  chemically synthesized
aatctgggtgctcctgaatt

SEQ ID NO: 325708 - DNA, 20 bp, Artificial Sequence
  chemically synthesized
tatatatgcacccaattcag

SEQ ID NO: 325709 - DNA, 20 bp, Artificial Sequence
  chemically synthesized
aatatatatgcacccaattc

SEQ ID NO: 325710 - DNA, 20 bp, Artificial Sequence
  chemically synthesized
aaatatatatgcacccaatt

SEQ ID NO: 325711 - DNA, 20 bp, Artificial Sequence
  chemically synthesized
gaattgggtgcatatatatt

SEQ ID NO: 325712 - DNA, 20 bp, Artificial Sequence
  chemically synthesized
aattgggtgcatatatattt

SEQ ID NO: 325713 - DNA, 20 bp, Artificial Sequence
  chemically synthesized
gggtgcatatatatttagga

SEQ ID NO: 325714 - DNA, 20 bp, Artificial Sequence
  chemically synthesized
gcatatatatttaggatagt

SEQ ID NO: 325715 - DNA, 20 bp, Artificial Sequence
  chemically synthesized
agggatcaattcaacaagaa

SEQ ID NO: 325716 - DNA, 20 bp, Artificial Sequence
  chemically synthesized
aaagggatcaattcaacaag

SEQ ID NO: 325717 - DNA, 20 bp, Artificial Sequence
  chemically synthesized
ggtaaagggatcaattcaac

SEQ ID NO: 325718 - DNA, 20 bp, Artificial Sequence
  chemically synthesized
ggccattacataatggtaaa

SEQ ID NO: 325719 - DNA, 20 bp, Artificial Sequence
  chemically synthesized
aggccattacataatggtaa

SEQ ID NO: 325720 - DNA, 20 bp, Artificial Sequence
  chemically synthesized
aaggccattacataatggta

SEQ ID NO: 325721 - DNA, 20 bp, Artificial Sequence
  chemically synthesized
caaagaaggccattacataa

SEQ ID NO: 325722 - DNA, 20 bp, Artificial Sequence
  chemically synthesized
atccctttaccattatgtaa

SEQ ID NO: 325723 - DNA, 20 bp, Artificial Sequence
  chemically synthesized
aagatcaaaagagacaaaga

SEQ ID NO: 325724 - DNA, 20 bp, Artificial Sequence
  chemically synthesized
aaagatcaaaagagacaaag

SEQ ID NO: 325725 - DNA, 20 bp, Artificial Sequence
  chemically synthesized
aacaaagatcaaaagagaca

SEQ ID NO: 325726 - DNA, 20 bp, Artificial Sequence
  chemically synthesized
tagaccaacaaagatcaaaa

SEQ ID NO: 325727 - DNA, 20 bp, Artificial Sequence
  chemically synthesized
tttagaccaacaaagatcaa

SEQ ID NO: 325728 - DNA, 20 bp, Artificial Sequence
  chemically synthesized
ttgtctcttttgatctttgt

SEQ ID NO: 325729 - DNA, 20 bp, Artificial Sequence
  chemically synthesized
aaacagactttagaccaaca

SEQ ID NO: 325730 - DNA, 20 bp, Artificial Sequence
  chemically synthesized
ttttgatctttgttggtcta

SEQ ID NO: 325731 - DNA, 20 bp, Artificial Sequence
  chemically synthesized
gtgtctgataaaacagactt

SEQ ID NO: 325732 - DNA, 20 bp, Artificial Sequence
  chemically synthesized
tggtctaaagtctgttttat

SEQ ID NO: 325733 - DNA, 20 bp, Artificial Sequence
  chemically synthesized
aatcctagtgtctgataaaa

SEQ ID NO: 325734 - DNA, 20 bp, Artificial Sequence
  chemically synthesized
aagtctgttttatcagacac

SEQ ID NO: 325735 - DNA, 20 bp, Artificial Sequence
  chemically synthesized
agtctgttttatcagacact

SEQ ID NO: 325736 - DNA, 20 bp, Artificial Sequence
  chemically synthesized
aaaggcaggggttgcaatcc

SEQ ID NO: 325737 - DNA, 20 bp, Artificial Sequence
  chemically synthesized
tgtttttcaaaaaaaggcag

SEQ ID NO: 325738 - DNA, 20 bp, Artificial Sequence
  chemically synthesized
atgtttttcaaaaaaaggca

SEQ ID NO: 325739 - DNA, 20 bp, Artificial Sequence
  chemically synthesized
aatgtttttcaaaaaaaggc

SEQ ID NO: 325740 - DNA, 20 bp, Artificial Sequence
  chemically synthesized
taatgtttttcaaaaaaagg

SEQ ID NO: 325741 - DNA, 20 bp, Artificial Sequence
  chemically synthesized
gattaatgtttttcaaaaaa

SEQ ID NO: 325742 - DNA, 20 bp, Artificial Sequence
  chemically synthesized
agattaatgtttttcaaaaa

SEQ ID NO: 325743 - DNA, 20 bp, Artificial Sequence
  chemically synthesized
atttttttaatgtaggaatt

SEQ ID NO: 325744 - DNA, 20 bp, Artificial Sequence
  chemically synthesized
cagagccatttttttaatgt

SEQ ID NO: 325745 - DNA, 20 bp, Artificial Sequence
  chemically synthesized
ccagagccatttttttaatg

SEQ ID NO: 325746 - DNA, 20 bp, Artificial Sequence
  chemically synthesized
taattcctacattaaaaaaa

SEQ ID NO: 325747 - DNA, 20 bp, Artificial Sequence
  chemically synthesized
ctacattaaaaaaatggctc

SEQ ID NO: 325748 - DNA, 20 bp, Artificial Sequence
  chemically synthesized
ttaaaaaaatggctctggca

SEQ ID NO: 325749 - DNA, 20 bp, Artificial Sequence
  chemically synthesized
aggatgagcaatctttgcca

SEQ ID NO: 325750 - DNA, 20 bp, Artificial Sequence
  chemically synthesized
ggaggatgagcaatctttgc

SEQ ID NO: 325751 - DNA, 20 bp, Artificial Sequence
  chemically synthesized
aaagatacatattggaggat

SEQ ID NO: 325752 - DNA, 20 bp, Artificial Sequence
  chemically synthesized
tgaagaaagatacatattgg

SEQ ID NO: 325753 - DNA, 20 bp, Artificial Sequence
  chemically synthesized
gtgaagaaagatacatattg

SEQ ID NO: 325754 - DNA, 20 bp, Artificial Sequence
  chemically synthesized
gggtgaagaaagatacatat

SEQ ID NO: 325755 - DNA, 20 bp, Artificial Sequence
  chemically synthesized
tactacataaagggtgaaga

SEQ ID NO: 325756 - DNA, 20 bp, Artificial Sequence
  chemically synthesized
ctaatactacataaagggtg

SEQ ID NO: 325757 - DNA, 20 bp, Artificial Sequence
  chemically synthesized
atctttcttcaccctttatg

SEQ ID NO: 325758 - DNA, 20 bp, Artificial Sequence
  chemically synthesized
actttctaatactacataaa

SEQ ID NO: 325759 - DNA, 20 bp, Artificial Sequence
  chemically synthesized
aactttctaatactacataa

SEQ ID NO: 325760 - DNA, 20 bp, Artificial Sequence
  chemically synthesized
aaactttctaatactacata

SEQ ID NO: 325761 - DNA, 20 bp, Artificial Sequence
  chemically synthesized
cttcaccctttatgtagtat

SEQ ID NO: 325762 - DNA, 20 bp, Artificial Sequence
  chemically synthesized
accctttatgtagtattaga

SEQ ID NO: 325763 - DNA, 20 bp, Artificial Sequence
  chemically synthesized
ttatgtagtattagaaagtt

SEQ ID NO: 325764 - DNA, 20 bp, Artificial Sequence
  chemically synthesized
tatgtagtattagaaagttt

SEQ ID NO: 325765 - DNA, 20 bp, Artificial Sequence
  chemically synthesized
atgtagtattagaaagttta

SEQ ID NO: 325766 - DNA, 20 bp, Artificial Sequence
  chemically synthesized
tgtagtattagaaagtttag

SEQ ID NO: 325767 - DNA, 20 bp, Artificial Sequence
  chemically synthesized
agaaagtttaggggacaatt

SEQ ID NO: 325768 - DNA, 20 bp, Artificial Sequence
  chemically synthesized
taggggacaatttggctatc

SEQ ID NO: 325769 - DNA, 20 bp, Artificial Sequence
  chemically synthesized
actgtagtgacatttctaga

SEQ ID NO: 325770 - DNA, 20 bp, Artificial Sequence
  chemically synthesized
gggaactgtagtgacatttc

SEQ ID NO: 325771 - DNA, 20 bp, Artificial Sequence
  chemically synthesized
gctatctagaaatgtcacta

SEQ ID NO: 325772 - DNA, 20 bp, Artificial Sequence
  chemically synthesized
gcaagggaaagtgggaactg

SEQ ID NO: 325773 - DNA, 20 bp, Artificial Sequence
  chemically synthesized
atctaactgcaagggaaagt

SEQ ID NO: 325774 - DNA, 20 bp, Artificial Sequence
  chemically synthesized
catctaactgcaagggaaag

SEQ ID NO: 325775 - DNA, 20 bp, Artificial Sequence
  chemically synthesized
acagttcccactttcccttg

SEQ ID NO: 325776 - DNA, 20 bp, Artificial Sequence
  chemically synthesized
ccacatctaactgcaaggga

SEQ ID NO: 325777 - DNA, 20 bp, Artificial Sequence
  chemically synthesized
ttcccactttcccttgcagt

SEQ ID NO: 325778 - DNA, 20 bp, Artificial Sequence
  chemically synthesized
catgccacatctaactgcaa

SEQ ID NO: 325779 - DNA, 20 bp, Artificial Sequence
  chemically synthesized
acatgccacatctaactgca

SEQ ID NO: 325780 - DNA, 20 bp, Artificial Sequence
  chemically synthesized
tacatgccacatctaactgc

SEQ ID NO: 325781 - DNA, 20 bp, Artificial Sequence
  chemically synthesized
ctttcccttgcagttagatg

SEQ ID NO: 325782 - DNA, 20 bp, Artificial Sequence
  chemically synthesized
gttagatgtggcatgtaacc

SEQ ID NO: 325783 - DNA, 20 bp, Artificial Sequence
  chemically synthesized
tgtggcatgtaaccaagtat

SEQ ID NO: 325784 - DNA, 20 bp, Artificial Sequence
  chemically synthesized
atatccaactggccaatact

SEQ ID NO: 325785 - DNA, 20 bp, Artificial Sequence
  chemically synthesized
gcatgtaaccaagtattggc

SEQ ID NO: 325786 - DNA, 20 bp, Artificial Sequence
  chemically synthesized
gtaaccaagtattggccagt

SEQ ID NO: 325787 - DNA, 20 bp, Artificial Sequence
  chemically synthesized
ttggatgcgttatatccaac

SEQ ID NO: 325788 - DNA, 20 bp, Artificial Sequence
  chemically synthesized
ttacgtcttaatgacgaagt

SEQ ID NO: 325789 - DNA, 20 bp, Artificial Sequence
  chemically synthesized
acgcatccaacttcgtcatt

SEQ ID NO: 325790 - DNA, 20 bp, Artificial Sequence
  chemically synthesized
ccatttacgtcttaatgacg

SEQ ID NO: 325791 - DNA, 20 bp, Artificial Sequence
  chemically synthesized
cttcgtcattaagacgtaaa

SEQ ID NO: 325792 - DNA, 20 bp, Artificial Sequence
  chemically synthesized
ttcgtcattaagacgtaaat

SEQ ID NO: 325793 - DNA, 20 bp, Artificial Sequence
  chemically synthesized
cattaagacgtaaatgggca

SEQ ID NO: 325794 - DNA, 20 bp, Artificial Sequence
  chemically synthesized
aggagggaggacgaagaaga

SEQ ID NO: 325795 - DNA, 20 bp, Artificial Sequence
  chemically synthesized
tcaggagggaggacgaagaa

SEQ ID NO: 325796 - DNA, 20 bp, Artificial Sequence
  chemically synthesized
cttcaggagggaggacgaag

SEQ ID NO: 325797 - DNA, 20 bp, Artificial Sequence
  chemically synthesized
gaccttcaggagggaggacg

SEQ ID NO: 325798 - DNA, 20 bp, Artificial Sequence
  chemically synthesized
tatcacgaccttcaggaggg

SEQ ID NO: 325799 - DNA, 20 bp, Artificial Sequence
  chemically synthesized
cttcttcgtcctccctcctg

SEQ ID NO: 325800 - DNA, 20 bp, Artificial Sequence
  chemically synthesized
gtatcacgaccttcaggagg

SEQ ID NO: 325801 - DNA, 20 bp, Artificial Sequence
  chemically synthesized
ttcttcgtcctccctcctga

SEQ ID NO: 325802 - DNA, 20 bp, Artificial Sequence
  chemically synthesized
gtgtatcacgaccttcagga

SEQ ID NO: 325803 - DNA, 20 bp, Artificial Sequence
  chemically synthesized
tgtgtatcacgaccttcagg

SEQ ID NO: 325804 - DNA, 20 bp, Artificial Sequence
  chemically synthesized
gtgtgtatcacgaccttcag

SEQ ID NO: 325805 - DNA, 20 bp, Artificial Sequence
  chemically synthesized
atgtgtgtatcacgaccttc

SEQ ID NO: 325806 - DNA, 20 bp, Artificial Sequence
  chemically synthesized
catgtgtgtatcacgacctt

SEQ ID NO: 325807 - DNA, 20 bp, Artificial Sequence
  chemically synthesized
aaggtcgtgatacacacatg

SEQ ID NO: 325808 - DNA, 20 bp, Artificial Sequence
  chemically synthesized
tcgtgatacacacatgaagc

SEQ ID NO: 325809 - DNA, 20 bp, Artificial Sequence
  chemically synthesized
gatacacacatgaagctggt

SEQ ID NO: 325810 - DNA, 20 bp, Artificial Sequence
  chemically synthesized
cacggttgaggatagctcac

SEQ ID NO: 325811 - DNA, 20 bp, Artificial Sequence
  chemically synthesized
ttcgtagtcacggttgagga

SEQ ID NO: 325812 - DNA, 20 bp, Artificial Sequence
  chemically synthesized
tgtcttcgtagtcacggttg

SEQ ID NO: 325813 - DNA, 20 bp, Artificial Sequence
  chemically synthesized
ctgtcttcgtagtcacggtt

SEQ ID NO: 325814 - DNA, 20 bp, Artificial Sequence
  chemically synthesized
ggacgctgtcttcgtagtca

SEQ ID NO: 325815 - DNA, 20 bp, Artificial Sequence
  chemically synthesized
tatcctcaaccgtgactacg

SEQ ID NO: 325816 - DNA, 20 bp, Artificial Sequence
  chemically synthesized
ctcaaccgtgactacgaaga

SEQ ID NO: 325817 - DNA, 20 bp, Artificial Sequence
  chemically synthesized
cccctgggacgctgtcttcg

SEQ ID NO: 325818 - DNA, 20 bp, Artificial Sequence
  chemically synthesized
tgactacgaagacagcgtcc

SEQ ID NO: 325819 - DNA, 20 bp, Artificial Sequence
  chemically synthesized
gactacgaagacagcgtccc

SEQ ID NO: 325820 - DNA, 20 bp, Artificial Sequence
  chemically synthesized
actacgaagacagcgtccca

SEQ ID NO: 325821 - DNA, 20 bp, Artificial Sequence
  chemically synthesized
ctacgaagacagcgtcccag

SEQ ID NO: 325822 - DNA, 20 bp, Artificial Sequence
  chemically synthesized
cagtttttcgatcatcccct

SEQ ID NO: 325823 - DNA, 20 bp, Artificial Sequence
  chemically synthesized
ccagtttttcgatcatcccc

SEQ ID NO: 325824 - DNA, 20 bp, Artificial Sequence
  chemically synthesized
ccaggggatgatcgaaaaac

SEQ ID NO: 325825 - DNA, 20 bp, Artificial Sequence
  chemically synthesized
caggggatgatcgaaaaact

SEQ ID NO: 325826 - DNA, 20 bp, Artificial Sequence
  chemically synthesized
atgatcgaaaaactgggcaa

SEQ ID NO: 325827 - DNA, 20 bp, Artificial Sequence
  chemically synthesized
tgatcgaaaaactgggcaac

SEQ ID NO: 325828 - DNA, 20 bp, Artificial Sequence
  chemically synthesized
ggatccatagtcctgttgcc

SEQ ID NO: 325829 - DNA, 20 bp, Artificial Sequence
  chemically synthesized
aaaactgggcaacaggacta

SEQ ID NO: 325830 - DNA, 20 bp, Artificial Sequence
  chemically synthesized
tctgctcattcagggatcca

SEQ ID NO: 325831 - DNA, 20 bp, Artificial Sequence
  chemically synthesized
aggactatggatccctgaat

SEQ ID NO: 325832 - DNA, 20 bp, Artificial Sequence
  chemically synthesized
aggaagtctctgctcattca

SEQ ID NO: 325833 - DNA, 20 bp, Artificial Sequence
  chemically synthesized
actatggatccctgaatgag

SEQ ID NO: 325834 - DNA, 20 bp, Artificial Sequence
  chemically synthesized
taggaagtctctgctcattc

SEQ ID NO: 325835 - DNA, 20 bp, Artificial Sequence
  chemically synthesized
gtaggaagtctctgctcatt

SEQ ID NO: 325836 - DNA, 20 bp, Artificial Sequence
  chemically synthesized
tatggatccctgaatgagca

SEQ ID NO: 325837 - DNA, 20 bp, Artificial Sequence
  chemically synthesized
aatgagcagagacttcctac

SEQ ID NO: 325838 - DNA, 20 bp, Artificial Sequence
  chemically synthesized
atgagcagagacttcctaca

SEQ ID NO: 325839 - DNA, 20 bp, Artificial Sequence
  chemically synthesized
agtgatggaggccttgtagg

SEQ ID NO: 325840 - DNA, 20 bp, Artificial Sequence
  chemically synthesized
gggagtgatggaggccttgt

SEQ ID NO: 325841 - DNA, 20 bp, Artificial Sequence
  chemically synthesized
tgggagtgatggaggccttg

SEQ ID NO: 325842 - DNA, 20 bp, Artificial Sequence
  chemically synthesized
tgtgtagatgggagtgatgg

SEQ ID NO: 325843 - DNA, 20 bp, Artificial Sequence
  chemically synthesized
ttgtgtagatgggagtgatg

SEQ ID NO: 325844 - DNA, 20 bp, Artificial Sequence
  chemically synthesized
tgttgtgtagatgggagtga

SEQ ID NO: 325845 - DNA, 20 bp, Artificial Sequence
  chemically synthesized
cttaaatgttgtgtagatgg

SEQ ID NO: 325846 - DNA, 20 bp, Artificial Sequence
  chemically synthesized
ctcttaaatgttgtgtagat

SEQ ID NO: 325847 - DNA, 20 bp, Artificial Sequence
  chemically synthesized
tctcttaaatgttgtgtaga

SEQ ID NO: 325848 - DNA, 20 bp, Artificial Sequence
  chemically synthesized
tacttctcttaaatgttgtg

SEQ ID NO: 325849 - DNA, 20 bp, Artificial Sequence
  chemically synthesized
ctcccatctacacaacattt

SEQ ID NO: 325850 - DNA, 20 bp, Artificial Sequence
  chemically synthesized
cccatctacacaacatttaa

SEQ ID NO: 325851 - DNA, 20 bp, Artificial Sequence
  chemically synthesized
atctacacaacatttaagag

SEQ ID NO: 325852 - DNA, 20 bp, Artificial Sequence
  chemically synthesized
acacaacatttaagagaagt

SEQ ID NO: 325853 - DNA, 20 bp, Artificial Sequence
  chemically synthesized
tttaagagaagtaagtctga

SEQ ID NO: 325854 - DNA, 20 bp, Artificial Sequence
  chemically synthesized
taagagaagtaagtctgaaa

SEQ ID NO: 325855 - DNA, 20 bp, Artificial Sequence
  chemically synthesized
aaatgagtttgtttctcttt

SEQ ID NO: 325856 - DNA, 20 bp, Artificial Sequence
  chemically synthesized
agagaaacaaactcattttt

SEQ ID NO: 325857 - DNA, 20 bp, Artificial Sequence
  chemically synthesized
ggatggatgaactaaaaaat

SEQ ID NO: 325858 - DNA, 20 bp, Artificial Sequence
  chemically synthesized
cactaacaaaaacacaagga

SEQ ID NO: 325859 - DNA, 20 bp, Artificial Sequence
  chemically synthesized
gtggcactaacaaaaacaca

SEQ ID NO: 325860 - DNA, 20 bp, Artificial Sequence
  chemically synthesized
cgtggcactaacaaaaacac

SEQ ID NO: 325861 - DNA, 20 bp, Artificial Sequence
  chemically synthesized
atccatccttgtgtttttgt

SEQ ID NO: 325862 - DNA, 20 bp, Artificial Sequence
  chemically synthesized
tgagattgctgtaggtttcg

SEQ ID NO: 325863 - DNA, 20 bp, Artificial Sequence
  chemically synthesized
tgttagtgccacgaaaccta

SEQ ID NO: 325864 - DNA, 20 bp, Artificial Sequence
  chemically synthesized
tcagtatatgagattgctgt

SEQ ID NO: 325865 - DNA, 20 bp, Artificial Sequence
  chemically synthesized
atcagtatatgagattgctg

SEQ ID NO: 325866 - DNA, 20 bp, Artificial Sequence
  chemically synthesized
attagagtatatcagtatat

SEQ ID NO: 325867 - DNA, 20 bp, Artificial Sequence
  chemically synthesized
gctagaaaattagagtatat

SEQ ID NO: 325868 - DNA, 20 bp, Artificial Sequence
  chemically synthesized
tctcagctgctagaaaatta

SEQ ID NO: 325869 - DNA, 20 bp, Artificial Sequence
  chemically synthesized
actgatatactctaattttc

SEQ ID NO: 325870 - DNA, 20 bp, Artificial Sequence
  chemically synthesized
aatctcagctgctagaaaat

SEQ ID NO: 325871 - DNA, 20 bp, Artificial Sequence
  chemically synthesized
gatatactctaattttctag

SEQ ID NO: 325872 - DNA, 20 bp, Artificial Sequence
  chemically synthesized
actctaattttctagcagct

SEQ ID NO: 325873 - DNA, 20 bp, Artificial Sequence
  chemically synthesized
tatagtaaaatctcagctgc

SEQ ID NO: 325874 - DNA, 20 bp, Artificial Sequence
  chemically synthesized
acatttttatagtaaaatct

SEQ ID NO: 325875 - DNA, 20 bp, Artificial Sequence
  chemically synthesized
cttttacagatacattttta

SEQ ID NO: 325876 - DNA, 20 bp, Artificial Sequence
  chemically synthesized
ctataaaaatgtatctgtaa

SEQ ID NO: 325877 - DNA, 20 bp, Artificial Sequence
  chemically synthesized
aactcacatataagctttta

SEQ ID NO: 325878 - DNA, 20 bp, Artificial Sequence
  chemically synthesized
atctgtaaaagcttatatgt

SEQ ID NO: 325879 - DNA, 20 bp, Artificial Sequence
  chemically synthesized
tttattttaaactcacatat

SEQ ID NO: 325880 - DNA, 20 bp, Artificial Sequence
  chemically synthesized
acatctgattttatagtaga

SEQ ID NO: 325881 - DNA, 20 bp, Artificial Sequence
  chemically synthesized
agagacatctgattttatag

SEQ ID NO: 325882 - DNA, 20 bp, Artificial Sequence
  chemically synthesized
taaactttctactataaaat

SEQ ID NO: 325883 - DNA, 20 bp, Artificial Sequence
  chemically synthesized
tagagagacatctgatttta

SEQ ID NO: 325884 - DNA, 20 bp, Artificial Sequence
  chemically synthesized
agacagagtagagttttaga

SEQ ID NO: 325885 - DNA, 20 bp, Artificial Sequence
  chemically synthesized
agagacagagtagagtttta

SEQ ID NO: 325886 - DNA, 20 bp, Artificial Sequence
  chemically synthesized
agagagacagagtagagttt

SEQ ID NO: 325887 - DNA, 20 bp, Artificial Sequence
  chemically synthesized
tgttttagagagacagagta

SEQ ID NO: 325888 - DNA, 20 bp, Artificial Sequence
  chemically synthesized
tatgttttagagagacagag

SEQ ID NO: 325889 - DNA, 20 bp, Artificial Sequence
  chemically synthesized
gagtatgttttagagagaca

SEQ ID NO: 325890 - DNA, 20 bp, Artificial Sequence
  chemically synthesized
gagagtatgttttagagaga

SEQ ID NO: 325891 - DNA, 20 bp, Artificial Sequence
  chemically synthesized
cattgagagtatgttttaga

SEQ ID NO: 325892 - DNA, 20 bp, Artificial Sequence
  chemically synthesized
ttcattgagagtatgtttta

SEQ ID NO: 325893 - DNA, 20 bp, Artificial Sequence
  chemically synthesized
ccttcattgagagtatgttt

SEQ ID NO: 325894 - DNA, 20 bp, Artificial Sequence
  chemically synthesized
tctaaaacatactctcaatg

SEQ ID NO: 325895 - DNA, 20 bp, Artificial Sequence
  chemically synthesized
ctaaaacatactctcaatga

SEQ ID NO: 325896 - DNA, 20 bp, Artificial Sequence
  chemically synthesized
atgactggaaccttcattga

SEQ ID NO: 325897 - DNA, 20 bp, Artificial Sequence
  chemically synthesized
aaatgactggaaccttcatt

SEQ ID NO: 325898 - DNA, 20 bp, Artificial Sequence
  chemically synthesized
catactctcaatgaaggttc

SEQ ID NO: 325899 - DNA, 20 bp, Artificial Sequence
  chemically synthesized
aaacgatgaagcaaaatgac

SEQ ID NO: 325900 - DNA, 20 bp, Artificial Sequence
  chemically synthesized
atgtgacttgaaaaacgatg

SEQ ID NO: 325901 - DNA, 20 bp, Artificial Sequence
  chemically synthesized
attttgcttcatcgtttttc

SEQ ID NO: 325902 - DNA, 20 bp, Artificial Sequence
  chemically synthesized
tttttcaagtcacatacctt

SEQ ID NO: 325903 - DNA, 20 bp, Artificial Sequence
  chemically synthesized
agggttagtgtaatatctaa

SEQ ID NO: 325904 - DNA, 20 bp, Artificial Sequence
  chemically synthesized
aagggttagtgtaatatcta

SEQ ID NO: 325905 - DNA, 20 bp, Artificial Sequence
  chemically synthesized
ccttcctacaatgcaagggt

SEQ ID NO: 325906 - DNA, 20 bp, Artificial Sequence
  chemically synthesized
cccgccttcctacaatgcaa

SEQ ID NO: 325907 - DNA, 20 bp, Artificial Sequence
  chemically synthesized
ttacactaacccttgcattg

SEQ ID NO: 325908 - DNA, 20 bp, Artificial Sequence
  chemically synthesized
ccccgccttcctacaatgca

SEQ ID NO: 325909 - DNA, 20 bp, Artificial Sequence
  chemically synthesized
tacactaacccttgcattgt

SEQ ID NO: 325910 - DNA, 20 bp, Artificial Sequence
  chemically synthesized
tccccgccttcctacaatgc

SEQ ID NO: 325911 - DNA, 20 bp, Artificial Sequence
  chemically synthesized
actaacccttgcattgtagg

SEQ ID NO: 325912 - DNA, 20 bp, Artificial Sequence
  chemically synthesized
ctaacccttgcattgtagga

SEQ ID NO: 325913 - DNA, 20 bp, Artificial Sequence
  chemically synthesized
acccttgcattgtaggaagg

SEQ ID NO: 325914 - DNA, 20 bp, Artificial Sequence
  chemically synthesized
cccttgcattgtaggaaggc

SEQ ID NO: 325915 - DNA, 20 bp, Artificial Sequence
  chemically synthesized
ccttgcattgtaggaaggcg

SEQ ID NO: 325916 - DNA, 20 bp, Artificial Sequence
  chemically synthesized
tgtgctgttaggcacggggt

SEQ ID NO: 325917 - DNA, 20 bp, Artificial Sequence
  chemically synthesized
gtactgtgctgttaggcacg

SEQ ID NO: 325918 - DNA, 20 bp, Artificial Sequence
  chemically synthesized
tgtactgtgctgttaggcac

SEQ ID NO: 325919 - DNA, 20 bp, Artificial Sequence
  chemically synthesized
gacactgaccccgtgcctaa

SEQ ID NO: 325920 - DNA, 20 bp, Artificial Sequence
  chemically synthesized
gtgtactgtgctgttaggca

SEQ ID NO: 325921 - DNA, 20 bp, Artificial Sequence
  chemically synthesized
tgaccccgtgcctaacagca

SEQ ID NO: 325922 - DNA, 20 bp, Artificial Sequence
  chemically synthesized
tatctgtgtactgtgctgtt

SEQ ID NO: 325923 - DNA, 20 bp, Artificial Sequence
  chemically synthesized
ttatctgtgtactgtgctgt

SEQ ID NO: 325924 - DNA, 20 bp, Artificial Sequence
  chemically synthesized
gtgcctaacagcacagtaca

SEQ ID NO: 325925 - DNA, 20 bp, Artificial Sequence
  chemically synthesized
taaatatttactaaattgtt

SEQ ID NO: 325926 - DNA, 20 bp, Artificial Sequence
  chemically synthesized
taaaattaccccaaacaatt

SEQ ID NO: 325927 - DNA, 20 bp, Artificial Sequence
  chemically synthesized
aaatatttactaaattgttt

SEQ ID NO: 325928 - DNA, 20 bp, Artificial Sequence
  chemically synthesized
aatatttactaaattgtttg

SEQ ID NO: 325929 - DNA, 20 bp, Artificial Sequence
  chemically synthesized
gtaattttaatttcttattt

SEQ ID NO: 325930 - DNA, 20 bp, Artificial Sequence
  chemically synthesized
taattttaatttcttattta

SEQ ID NO: 325931 - DNA, 20 bp, Artificial Sequence
  chemically synthesized
aagcacaaatgaccttaaat

SEQ ID NO: 325932 - DNA, 20 bp, Artificial Sequence
  chemically synthesized
gtcatttgtgcttccaattt

SEQ ID NO: 325933 - DNA, 20 bp, Artificial Sequence
  chemically synthesized
tatataaaacctgaaattgg

SEQ ID NO: 325934 - DNA, 20 bp, Artificial Sequence
  chemically synthesized
tcatttgtgcttccaatttc

SEQ ID NO: 325935 - DNA, 20 bp, Artificial Sequence
  chemically synthesized
ttttatataaaacctgaaat

SEQ ID NO: 325936 - DNA, 20 bp, Artificial Sequence
  chemically synthesized
tccattttcaaggtattgat

SEQ ID NO: 325937 - DNA, 20 bp, Artificial Sequence
  chemically synthesized
accaatcaataccttgaaaa

SEQ ID NO: 325938 - DNA, 20 bp, Artificial Sequence
  chemically synthesized
gccatattactccattttca

SEQ ID NO: 325939 - DNA, 20 bp, Artificial Sequence
  chemically synthesized
caatcaataccttgaaaatg

SEQ ID NO: 325940 - DNA, 20 bp, Artificial Sequence
  chemically synthesized
tgccatattactccattttc

SEQ ID NO: 325941 - DNA, 20 bp, Artificial Sequence
  chemically synthesized
accttgaaaatggagtaata

SEQ ID NO: 325942 - DNA, 20 bp, Artificial Sequence
  chemically synthesized
aatatggcataaaatattca

SEQ ID NO: 325943 - DNA, 20 bp, Artificial Sequence
  chemically synthesized
atatgaataggaatattggg

SEQ ID NO: 325944 - DNA, 20 bp, Artificial Sequence
  chemically synthesized
gaaatatgaataggaatatt

SEQ ID NO: 325945 - DNA, 20 bp, Artificial Sequence
  chemically synthesized
tgaaatatgaataggaatat

SEQ ID NO: 325946 - DNA, 20 bp, Artificial Sequence
  chemically synthesized
aacacatatgaaatatgaat

SEQ ID NO: 325947 - DNA, 20 bp, Artificial Sequence
  chemically synthesized
aaacacatatgaaatatgaa

SEQ ID NO: 325948 - DNA, 20 bp, Artificial Sequence
  chemically synthesized
tacatattcacatacatata

SEQ ID NO: 325949 - DNA, 20 bp, Artificial Sequence
  chemically synthesized
acacacacacacatataagt

SEQ ID NO: 325950 - DNA, 20 bp, Artificial Sequence
  chemically synthesized
acacacacacacacacatat

SEQ ID NO: 325951 - DNA, 20 bp, Artificial Sequence
  chemically synthesized
agaattagagaaattagagg

SEQ ID NO: 325952 - DNA, 20 bp, Artificial Sequence
  chemically synthesized
ggtagaattagagaaattag

SEQ ID NO: 325953 - DNA, 20 bp, Artificial Sequence
  chemically synthesized
tggtagaattagagaaatta

SEQ ID NO: 325954 - DNA, 20 bp, Artificial Sequence
  chemically synthesized
aatggtagaattagagaaat

SEQ ID NO: 325955 - DNA, 20 bp, Artificial Sequence
  chemically synthesized
agatataaatggtagaatta

SEQ ID NO: 325956 - DNA, 20 bp, Artificial Sequence
  chemically synthesized
aaagatataaatggtagaat

SEQ ID NO: 325957 - DNA, 20 bp, Artificial Sequence
  chemically synthesized
atacccaaagatataaatgg

SEQ ID NO: 325958 - DNA, 20 bp, Artificial Sequence
  chemically synthesized
tgtatacccaaagatataaa

SEQ ID NO: 325959 - DNA, 20 bp, Artificial Sequence
  chemically synthesized
aattctaccatttatatctt

SEQ ID NO: 325960 - DNA, 20 bp, Artificial Sequence
  chemically synthesized
attctaccatttatatcttt

SEQ ID NO: 325961 - DNA, 20 bp, Artificial Sequence
  chemically synthesized
agaaagtaaatgtataccca

SEQ ID NO: 325962 - DNA, 20 bp, Artificial Sequence
  chemically synthesized
aaaatataaaataagttaga

SEQ ID NO: 325963 - DNA, 20 bp, Artificial Sequence
  chemically synthesized
gaataaaatataaaataagt

SEQ ID NO: 325964 - DNA, 20 bp, Artificial Sequence
  chemically synthesized
aaaggaataaaatataaaat

SEQ ID NO: 325965 - DNA, 20 bp, Artificial Sequence
  chemically synthesized
tgaagtacaggaaaaaataa

SEQ ID NO: 325966 - DNA, 20 bp, Artificial Sequence
  chemically synthesized
gtgaagtacaggaaaaaata

SEQ ID NO: 325967 - DNA, 20 bp, Artificial Sequence
  chemically synthesized
gaaagtctcaggtgaagtac

SEQ ID NO: 325968 - DNA, 20 bp, Artificial Sequence
  chemically synthesized
agaaagtctcaggtgaagta

SEQ ID NO: 325969 - DNA, 20 bp, Artificial Sequence
  chemically synthesized
ttttttcctgtacttcacct

SEQ ID NO: 325970 - DNA, 20 bp, Artificial Sequence
  chemically synthesized
aagacagaaagtctcaggtg

SEQ ID NO: 325971 - DNA, 20 bp, Artificial Sequence
  chemically synthesized
tagccaagacagaaagtctc

SEQ ID NO: 325972 - DNA, 20 bp, Artificial Sequence
  chemically synthesized
atagccaagacagaaagtct

SEQ ID NO: 325973 - DNA, 20 bp, Artificial Sequence
  chemically synthesized
tcacctgagactttctgtct

SEQ ID NO: 325974 - DNA, 20 bp, Artificial Sequence
  chemically synthesized
attataatagccaagacaga

SEQ ID NO: 325975 - DNA, 20 bp, Artificial Sequence
  chemically synthesized
gtggattataatagccaaga

SEQ ID NO: 325976 - DNA, 20 bp, Artificial Sequence
  chemically synthesized
ttgtgtggattataatagcc

SEQ ID NO: 325977 - DNA, 20 bp, Artificial Sequence
  chemically synthesized
ttctattgtgtggattataa

SEQ ID NO: 325978 - DNA, 20 bp, Artificial Sequence
  chemically synthesized
ggctattataatccacacaa

SEQ ID NO: 325979 - DNA, 20 bp, Artificial Sequence
  chemically synthesized
atgagaaaggttctattgtg

SEQ ID NO: 325980 - DNA, 20 bp, Artificial Sequence
  chemically synthesized
ccttcttgattttatgagaa

SEQ ID NO: 325981 - DNA, 20 bp, Artificial Sequence
  chemically synthesized
tccttcttgattttatgaga

SEQ ID NO: 325982 - DNA, 20 bp, Artificial Sequence
  chemically synthesized
ttcttccttcttgattttat

SEQ ID NO: 325983 - DNA, 20 bp, Artificial Sequence
  chemically synthesized
agaacctttctcataaaatc

SEQ ID NO: 325984 - DNA, 20 bp, Artificial Sequence
  chemically synthesized
acctttctcataaaatcaag

SEQ ID NO: 325985 - DNA, 20 bp, Artificial Sequence
  chemically synthesized
cctttctcataaaatcaaga

SEQ ID NO: 325986 - DNA, 20 bp, Artificial Sequence
  chemically synthesized
ttctcataaaatcaagaagg

SEQ ID NO: 325987 - DNA, 20 bp, Artificial Sequence
  chemically synthesized
taaaatcaagaaggaagaaa

SEQ ID NO: 325988 - DNA, 20 bp, Artificial Sequence
  chemically synthesized
aagaaggaagaaaaagaaat

SEQ ID NO: 325989 - DNA, 20 bp, Artificial Sequence
  chemically synthesized
aaaagaaataagcactgtta

SEQ ID NO: 325990 - DNA, 20 bp, Artificial Sequence
  chemically synthesized
tttaggagaatttgccataa

SEQ ID NO: 325991 - DNA, 20 bp, Artificial Sequence
  chemically synthesized
ctgaccttccattgatttag

SEQ ID NO: 325992 - DNA, 20 bp, Artificial Sequence
  chemically synthesized
ggcaaattctcctaaatcaa

SEQ ID NO: 325993 - DNA, 20 bp, Artificial Sequence
  chemically synthesized
ctctgaccttccattgattt

SEQ ID NO: 325994 - DNA, 20 bp, Artificial Sequence
  chemically synthesized
tctctgaccttccattgatt

SEQ ID NO: 325995 - DNA, 20 bp, Artificial Sequence
  chemically synthesized
aaattctcctaaatcaatgg

SEQ ID NO: 325996 - DNA, 20 bp, Artificial Sequence
  chemically synthesized
aattctcctaaatcaatgga

SEQ ID NO: 325997 - DNA, 20 bp, Artificial Sequence
  chemically synthesized
ctcctaaatcaatggaaggt

SEQ ID NO: 325998 - DNA, 20 bp, Artificial Sequence
  chemically synthesized
cctaaatcaatggaaggtca

SEQ ID NO: 325999 - DNA, 20 bp, Artificial Sequence
  chemically synthesized
taaatcaatggaaggtcaga

SEQ ID NO: 326000 - DNA, 20 bp, Artificial Sequence
  chemically synthesized
gaaggtcagagagaaaataa

SEQ ID NO: 326001 - DNA, 20 bp, Artificial Sequence
  chemically synthesized
ggtcagagagaaaataatag

SEQ ID NO: 326002 - DNA, 20 bp, Artificial Sequence
  chemically synthesized
agagaaaataatagaagatt

SEQ ID NO: 326003 - DNA, 20 bp, Artificial Sequence
  chemically synthesized
agaaaataatagaagattta

SEQ ID NO: 326004 - DNA, 20 bp, Artificial Sequence
  chemically synthesized
aagatttagagaaatgtacc

SEQ ID NO: 326005 - DNA, 20 bp, Artificial Sequence
  chemically synthesized
ttgggttattaaattgttct

SEQ ID NO: 326006 - DNA, 20 bp, Artificial Sequence
  chemically synthesized
attgggttattaaattgttc

SEQ ID NO: 326007 - DNA, 20 bp, Artificial Sequence
  chemically synthesized
aatttaataacccaatataa

SEQ ID NO: 326008 - DNA, 20 bp, Artificial Sequence
  chemically synthesized
aaaaagaaatcttttatatt

SEQ ID NO: 326009 - DNA, 20 bp, Artificial Sequence
  chemically synthesized
taaaaagaaatcttttatat

SEQ ID NO: 326010 - DNA, 20 bp, Artificial Sequence
  chemically synthesized
tataaaagatttctttttaa

SEQ ID NO: 326011 - DNA, 20 bp, Artificial Sequence
  chemically synthesized
attataaacttgcttttaaa

SEQ ID NO: 326012 - DNA, 20 bp, Artificial Sequence
  chemically synthesized
aaagatttctttttaaaagc

SEQ ID NO: 326013 - DNA, 20 bp, Artificial Sequence
  chemically synthesized
gtttataataaaattttcat

SEQ ID NO: 326014 - DNA, 20 bp, Artificial Sequence
  chemically synthesized
catcaataaaaaaactttct

SEQ ID NO: 326015 - DNA, 20 bp, Artificial Sequence
  chemically synthesized
catctaataaatttctgaga

SEQ ID NO: 326016 - DNA, 20 bp, Artificial Sequence
  chemically synthesized
gtgccatctaataaatttct

SEQ ID NO: 326017 - DNA, 20 bp, Artificial Sequence
  chemically synthesized
aaactttctcagaaatttat

SEQ ID NO: 326018 - DNA, 20 bp, Artificial Sequence
  chemically synthesized
tttctcagaaatttattaga

SEQ ID NO: 326019 - DNA, 20 bp, Artificial Sequence
  chemically synthesized
atttattagatggcacatga

SEQ ID NO: 326020 - DNA, 20 bp, Artificial Sequence
  chemically synthesized
gatggcacatgaaagacgtc

SEQ ID NO: 326021 - DNA, 20 bp, Artificial Sequence
  chemically synthesized
cacatgaaagacgtctagcc

SEQ ID NO: 326022 - DNA, 20 bp, Artificial Sequence
  chemically synthesized
gaacaaagaaatcactaggc

SEQ ID NO: 326023 - DNA, 20 bp, Artificial Sequence
  chemically synthesized
gtaagaacaaagaaatcact

SEQ ID NO: 326024 - DNA, 20 bp, Artificial Sequence
  chemically synthesized
agtaagaacaaagaaatcac

SEQ ID NO: 326025 - DNA, 20 bp, Artificial Sequence
  chemically synthesized
tatatgaaacagtaagaaca

SEQ ID NO: 326026 - DNA, 20 bp, Artificial Sequence
  chemically synthesized
taagaattatatgaaacagt

SEQ ID NO: 326027 - DNA, 20 bp, Artificial Sequence
  chemically synthesized
tttgtaagaattatatgaaa

SEQ ID NO: 326028 - DNA, 20 bp, Artificial Sequence
  chemically synthesized
cccccttttagggtgtttgt

SEQ ID NO: 326029 - DNA, 20 bp, Artificial Sequence
  chemically synthesized
aattcttacaaacaccctaa

SEQ ID NO: 326030 - DNA, 20 bp, Artificial Sequence
  chemically synthesized
attcttacaaacaccctaaa

SEQ ID NO: 326031 - DNA, 20 bp, Artificial Sequence
  chemically synthesized
ttcttacaaacaccctaaaa

SEQ ID NO: 326032 - DNA, 20 bp, Artificial Sequence
  chemically synthesized
tcttacaaacaccctaaaag

SEQ ID NO: 326033 - DNA, 20 bp, Artificial Sequence
  chemically synthesized
cttacaaacaccctaaaagg

SEQ ID NO: 326034 - DNA, 20 bp, Artificial Sequence
  chemically synthesized
gaaataggtcccccctttta

SEQ ID NO: 326035 - DNA, 20 bp, Artificial Sequence
  chemically synthesized
ttacaaacaccctaaaaggg

SEQ ID NO: 326036 - DNA, 20 bp, Artificial Sequence
  chemically synthesized
ggaaataggtcccccctttt

SEQ ID NO: 326037 - DNA, 20 bp, Artificial Sequence
  chemically synthesized
tggaaataggtccccccttt

SEQ ID NO: 326038 - DNA, 20 bp, Artificial Sequence
  chemically synthesized
aaaaggggggacctatttcc

SEQ ID NO: 326039 - DNA, 20 bp, Artificial Sequence
  chemically synthesized
ctcatcctcatcttggaaat

SEQ ID NO: 326040 - DNA, 20 bp, Artificial Sequence
  chemically synthesized
cctcatcctcatcttggaaa

SEQ ID NO: 326041 - DNA, 20 bp, Artificial Sequence
  chemically synthesized
gggggacctatttccaagat

SEQ ID NO: 326042 - DNA, 20 bp, Artificial Sequence
  chemically synthesized
ggggacctatttccaagatg

SEQ ID NO: 326043 - DNA, 20 bp, Artificial Sequence
  chemically synthesized
ggatttcctcatcctcatct

SEQ ID NO: 326044 - DNA, 20 bp, Artificial Sequence
  chemically synthesized
cctatttccaagatgaggat

SEQ ID NO: 326045 - DNA, 20 bp, Artificial Sequence
  chemically synthesized
ctatttccaagatgaggatg

SEQ ID NO: 326046 - DNA, 20 bp, Artificial Sequence
  chemically synthesized
agatgaggatgaggaaatcc

SEQ ID NO: 326047 - DNA, 20 bp, Artificial Sequence
  chemically synthesized
cacacctcataggtgtgact

SEQ ID NO: 326048 - DNA, 20 bp, Artificial Sequence
  chemically synthesized
gaaatccaagtcacacctat

SEQ ID NO: 326049 - DNA, 20 bp, Artificial Sequence
  chemically synthesized
aaatccaagtcacacctatg

SEQ ID NO: 326050 - DNA, 20 bp, Artificial Sequence
  chemically synthesized
tttttcctcccacacctcat

SEQ ID NO: 326051 - DNA, 20 bp, Artificial Sequence
  chemically synthesized
caagtcacacctatgaggtg

SEQ ID NO: 326052 - DNA, 20 bp, Artificial Sequence
  chemically synthesized
atttttcctcccacacctca

SEQ ID NO: 326053 - DNA, 20 bp, Artificial Sequence
  chemically synthesized
aagtcacacctatgaggtgt

SEQ ID NO: 326054 - DNA, 20 bp, Artificial Sequence
  chemically synthesized
gtcacacctatgaggtgtgg

SEQ ID NO: 326055 - DNA, 20 bp, Artificial Sequence
  chemically synthesized
tcacacctatgaggtgtggg

SEQ ID NO: 326056 - DNA, 20 bp, Artificial Sequence
  chemically synthesized
atgaggtgtgggaggaaaaa

SEQ ID NO: 326057 - DNA, 20 bp, Artificial Sequence
  chemically synthesized
tgaggtgtgggaggaaaaat

SEQ ID NO: 326058 - DNA, 20 bp, Artificial Sequence
  chemically synthesized
gggaggaaaaatgggatacc

SEQ ID NO: 326059 - DNA, 20 bp, Artificial Sequence
  chemically synthesized
ggaatgtcggtttgtttact

SEQ ID NO: 326060 - DNA, 20 bp, Artificial Sequence
  chemically synthesized
aggaatgtcggtttgtttac

SEQ ID NO: 326061 - DNA, 20 bp, Artificial Sequence
  chemically synthesized
ctctgtcagccaaggaatgt

SEQ ID NO: 326062 - DNA, 20 bp, Artificial Sequence
  chemically synthesized
gtaaacaaaccgacattcct

SEQ ID NO: 326063 - DNA, 20 bp, Artificial Sequence
  chemically synthesized
aaccgacattccttggctga

SEQ ID NO: 326064 - DNA, 20 bp, Artificial Sequence
  chemically synthesized
tcatgaatctctgtcagcca

SEQ ID NO: 326065 - DNA, 20 bp, Artificial Sequence
  chemically synthesized
ttcatgaatctctgtcagcc

SEQ ID NO: 326066 - DNA, 20 bp, Artificial Sequence
  chemically synthesized
ccgacattccttggctgaca

SEQ ID NO: 326067 - DNA, 20 bp, Artificial Sequence
  chemically synthesized
tggacttcatgaatctctgt

SEQ ID NO: 326068 - DNA, 20 bp, Artificial Sequence
  chemically synthesized
ttggctgacagagattcatg

SEQ ID NO: 326069 - DNA, 20 bp, Artificial Sequence
  chemically synthesized
tgacagagattcatgaagtc

SEQ ID NO: 326070 - DNA, 20 bp, Artificial Sequence
  chemically synthesized
acagagattcatgaagtcca

SEQ ID NO: 326071 - DNA, 20 bp, Artificial Sequence
  chemically synthesized
gagattcatgaagtccagag

SEQ ID NO: 326072 - DNA, 20 bp, Artificial Sequence
  chemically synthesized
attcatgaagtccagagaag

SEQ ID NO: 326073 - DNA, 20 bp, Artificial Sequence
  chemically synthesized
ttcatgaagtccagagaaga

SEQ ID NO: 326074 - DNA, 20 bp, Artificial Sequence
  chemically synthesized
ttatgttcatccttcttctc

SEQ ID NO: 326075 - DNA, 20 bp, Artificial Sequence
  chemically synthesized
aacatccaccaaacagtaca

SEQ ID NO: 326076 - DNA, 20 bp, Artificial Sequence
  chemically synthesized
cataataactctgtactgtt

SEQ ID NO: 326077 - DNA, 20 bp, Artificial Sequence
  chemically synthesized
gaaacatccaccaaacagta

SEQ ID NO: 326078 - DNA, 20 bp, Artificial Sequence
  chemically synthesized
aataactctgtactgtttgg

SEQ ID NO: 326079 - DNA, 20 bp, Artificial Sequence
  chemically synthesized
ttattgaaacatccaccaaa

SEQ ID NO: 326080 - DNA, 20 bp, Artificial Sequence
  chemically synthesized
ggatgtttcaataattttaa

SEQ ID NO: 326081 - DNA, 20 bp, Artificial Sequence
  chemically synthesized
gtttcaataattttaaaagt

SEQ ID NO: 326082 - DNA, 20 bp, Artificial Sequence
  chemically synthesized
taattttaaaagtcagtatt

SEQ ID NO: 326083 - DNA, 20 bp, Artificial Sequence
  chemically synthesized
tttaaaagtcagtatttggt

SEQ ID NO: 326084 - DNA, 20 bp, Artificial Sequence
  chemically synthesized
tatttggttggaattcatat

SEQ ID NO: 326085 - DNA, 20 bp, Artificial Sequence
  chemically synthesized
tggttggaattcatatgagt

SEQ ID NO: 326086 - DNA, 20 bp, Artificial Sequence
  chemically synthesized
tatgagttggtaattgaaac

SEQ ID NO: 326087 - DNA, 20 bp, Artificial Sequence
  chemically synthesized
attgaaacgagattttgtaa

SEQ ID NO: 326088 - DNA, 20 bp, Artificial Sequence
  chemically synthesized
atcctattttaaattaaatt

SEQ ID NO: 326089 - DNA, 20 bp, Artificial Sequence
  chemically synthesized
gtactaaatttaatttaaaa

SEQ ID NO: 326090 - DNA, 20 bp, Artificial Sequence
  chemically synthesized
tactaaatttaatttaaaat

SEQ ID NO: 326091 - DNA, 20 bp, Artificial Sequence
  chemically synthesized
aaatttaatttaaaatagga

SEQ ID NO: 326092 - DNA, 20 bp, Artificial Sequence
  chemically synthesized
aggatagttacaaaatgtct

SEQ ID NO: 326093 - DNA, 20 bp, Artificial Sequence
  chemically synthesized
atagttacaaaatgtctcag

SEQ ID NO: 326094 - DNA, 20 bp, Artificial Sequence
  chemically synthesized
aagaatttatttggtcttct

SEQ ID NO: 326095 - DNA, 20 bp, Artificial Sequence
  chemically synthesized
aataacattaagaatttatt

SEQ ID NO: 326096 - DNA, 20 bp, Artificial Sequence
  chemically synthesized
ggattaaggaaaataacatt

SEQ ID NO: 326097 - DNA, 20 bp, Artificial Sequence
  chemically synthesized
atgttattttccttaatcct

SEQ ID NO: 326098 - DNA, 20 bp, Artificial Sequence
  chemically synthesized
aattgttaaacttaggatta

SEQ ID NO: 326099 - DNA, 20 bp, Artificial Sequence
  chemically synthesized
aaattgttaaacttaggatt

SEQ ID NO: 326100 - DNA, 20 bp, Artificial Sequence
  chemically synthesized
ttaataaaattgttaaactt

SEQ ID NO: 326101 - DNA, 20 bp, Artificial Sequence
  chemically synthesized
attaataaaattgttaaact

SEQ ID NO: 326102 - DNA, 20 bp, Artificial Sequence
  chemically synthesized
taattttcaaatacgtctca

SEQ ID NO: 326103 - DNA, 20 bp, Artificial Sequence
  chemically synthesized
aagacttggtgtttttccat

SEQ ID NO: 326104 - DNA, 20 bp, Artificial Sequence
  chemically synthesized
acgtctcatggaaaaacacc

SEQ ID NO: 326105 - DNA, 20 bp, Artificial Sequence
  chemically synthesized
tgattaaaataaataagact

SEQ ID NO: 326106 - DNA, 20 bp, Artificial Sequence
  chemically synthesized
aatgactgattaaaataaat

SEQ ID NO: 326107 - DNA, 20 bp, Artificial Sequence
  chemically synthesized
caagtcttatttattttaat

SEQ ID NO: 326108 - DNA, 20 bp, Artificial Sequence
  chemically synthesized
tttaatcagtcatttataaa

SEQ ID NO: 326109 - DNA, 20 bp, Artificial Sequence
  chemically synthesized
ttaatcagtcatttataaat

SEQ ID NO: 326110 - DNA, 20 bp, Artificial Sequence
  chemically synthesized
ataggaaaaaaatgattcac

SEQ ID NO: 326111 - DNA, 20 bp, Artificial Sequence
  chemically synthesized
ttttgcattttaaaagtatc

SEQ ID NO: 326112 - DNA, 20 bp, Artificial Sequence
  chemically synthesized
tgaattattttgcattttaa

SEQ ID NO: 326113 - DNA, 20 bp, Artificial Sequence
  chemically synthesized
ttttaaaatgcaaaataatt

SEQ ID NO: 326114 - DNA, 20 bp, Artificial Sequence
  chemically synthesized
taaaatgcaaaataattcag

SEQ ID NO: 326115 - DNA, 20 bp, Artificial Sequence
  chemically synthesized
aattcagaagtaaactgctt

SEQ ID NO: 326116 - DNA, 20 bp, Artificial Sequence
  chemically synthesized
taaaaaccacttgtctaaag

SEQ ID NO: 326117 - DNA, 20 bp, Artificial Sequence
  chemically synthesized
agaagtaaactgctttagac

SEQ ID NO: 326118 - DNA, 20 bp, Artificial Sequence
  chemically synthesized
atgtaaaaaccacttgtcta

SEQ ID NO: 326119 - DNA, 20 bp, Artificial Sequence
  chemically synthesized
agtaaactgctttagacaag

SEQ ID NO: 326120 - DNA, 20 bp, Artificial Sequence
  chemically synthesized
gtattttgttttgatttttt

SEQ ID NO: 326121 - DNA, 20 bp, Artificial Sequence
  chemically synthesized
ttgaaataataagttttcac

SEQ ID NO: 326122 - DNA, 20 bp, Artificial Sequence
  chemically synthesized
atatgtcaatttgaaataat

SEQ ID NO: 326123 - DNA, 20 bp, Artificial Sequence
  chemically synthesized
agaggaatattatttaagtg

SEQ ID NO: 326124 - DNA, 20 bp, Artificial Sequence
  chemically synthesized
attctagaggaatattattt

SEQ ID NO: 326125 - DNA, 20 bp, Artificial Sequence
  chemically synthesized
gcacttaaataatattcctc

SEQ ID NO: 326126 - DNA, 20 bp, Artificial Sequence
  chemically synthesized
atggactacggtcattctag

SEQ ID NO: 326127 - DNA, 20 bp, Artificial Sequence
  chemically synthesized
tatggactacggtcattcta

SEQ ID NO: 326128 - DNA, 20 bp, Artificial Sequence
  chemically synthesized
tctatggactacggtcattc

SEQ ID NO: 326129 - DNA, 20 bp, Artificial Sequence
  chemically synthesized
atattcctctagaatgaccg

SEQ ID NO: 326130 - DNA, 20 bp, Artificial Sequence
  chemically synthesized
tctagaatgaccgtagtcca

SEQ ID NO: 326131 - DNA, 20 bp, Artificial Sequence
  chemically synthesized
attacaaactctatggacta

SEQ ID NO: 326132 - DNA, 20 bp, Artificial Sequence
  chemically synthesized
tagaatgaccgtagtccata

SEQ ID NO: 326133 - DNA, 20 bp, Artificial Sequence
  chemically synthesized
atatgcaattacaaactcta

SEQ ID NO: 326134 - DNA, 20 bp, Artificial Sequence
  chemically synthesized
tgcatatacaaattaattgt

SEQ ID NO: 326135 - DNA, 20 bp, Artificial Sequence
  chemically synthesized
acaaattaattgtgagctat

SEQ ID NO: 326136 - DNA, 20 bp, Artificial Sequence
  chemically synthesized
caaattaattgtgagctatg

SEQ ID NO: 326137 - DNA, 20 bp, Artificial Sequence
  chemically synthesized
aattaattgtgagctatgag

SEQ ID NO: 326138 - DNA, 20 bp, Artificial Sequence
  chemically synthesized
ttatgtttaggttctcctca

SEQ ID NO: 326139 - DNA, 20 bp, Artificial Sequence
  chemically synthesized
acatgggaatatttatgttt

SEQ ID NO: 326140 - DNA, 20 bp, Artificial Sequence
  chemically synthesized
tacatgggaatatttatgtt

SEQ ID NO: 326141 - DNA, 20 bp, Artificial Sequence
  chemically synthesized
taaacataaatattcccatg

SEQ ID NO: 326142 - DNA, 20 bp, Artificial Sequence
  chemically synthesized
aattccaaaacgggctacat

SEQ ID NO: 326143 - DNA, 20 bp, Artificial Sequence
  chemically synthesized
aaattccaaaacgggctaca

SEQ ID NO: 326144 - DNA, 20 bp, Artificial Sequence
  chemically synthesized
tattcccatgtagcccgttt

SEQ ID NO: 326145 - DNA, 20 bp, Artificial Sequence
  chemically synthesized
aaaaagcaaaattccaaaac

SEQ ID NO: 326146 - DNA, 20 bp, Artificial Sequence
  chemically synthesized
aaaaaagcaaaattccaaaa

SEQ ID NO: 326147 - DNA, 20 bp, Artificial Sequence
  chemically synthesized
attataaatgatgagaaaaa

SEQ ID NO: 326148 - DNA, 20 bp, Artificial Sequence
  chemically synthesized
ctaagaatattataaatgat

SEQ ID NO: 326149 - DNA, 20 bp, Artificial Sequence
  chemically synthesized
ctcatcatttataatattct

SEQ ID NO: 326150 - DNA, 20 bp, Artificial Sequence
  chemically synthesized
gaataaatgagtacatagct

SEQ ID NO: 326151 - DNA, 20 bp, Artificial Sequence
  chemically synthesized
ttgtggaataaatgagtaca

SEQ ID NO: 326152 - DNA, 20 bp, Artificial Sequence
  chemically synthesized
tatagacttgtggaataaat

SEQ ID NO: 326153 - DNA, 20 bp, Artificial Sequence
  chemically synthesized
tatgtactcatttattccac

SEQ ID NO: 326154 - DNA, 20 bp, Artificial Sequence
  chemically synthesized
tttctttacatatagacttg

SEQ ID NO: 326155 - DNA, 20 bp, Artificial Sequence
  chemically synthesized
attccacaagtctatatgta

SEQ ID NO: 326156 - DNA, 20 bp, Artificial Sequence
  chemically synthesized
acttctaatttctttacata

SEQ ID NO: 326157 - DNA, 20 bp, Artificial Sequence
  chemically synthesized
aagtctatatgtaaagaaat

SEQ ID NO: 326158 - DNA, 20 bp, Artificial Sequence
  chemically synthesized
tctatatgtaaagaaattag

SEQ ID NO: 326159 - DNA, 20 bp, Artificial Sequence
  chemically synthesized
tatgtaaagaaattagaagt

SEQ ID NO: 326160 - DNA, 20 bp, Artificial Sequence
  chemically synthesized
aagaaattagaagttagcac

SEQ ID NO: 326161 - DNA, 20 bp, Artificial Sequence
  chemically synthesized
gaaattagaagttagcacaa

SEQ ID NO: 326162 - DNA, 20 bp, Artificial Sequence
  chemically synthesized
caagagatgtccccaaaata

SEQ ID NO: 326163 - DNA, 20 bp, Artificial Sequence
  chemically synthesized
agataagtttctatattttg

SEQ ID NO: 326164 - DNA, 20 bp, Artificial Sequence
  chemically synthesized
tagataagtttctatatttt

SEQ ID NO: 326165 - DNA, 20 bp, Artificial Sequence
  chemically synthesized
gtagataagtttctatattt

SEQ ID NO: 326166 - DNA, 20 bp, Artificial Sequence
  chemically synthesized
aaattagtgtaagtgtagat

SEQ ID NO: 326167 - DNA, 20 bp, Artificial Sequence
  chemically synthesized
cactgaaattagtgtaagtg

SEQ ID NO: 326168 - DNA, 20 bp, Artificial Sequence
  chemically synthesized
attttcactgaaattagtgt

SEQ ID NO: 326169 - DNA, 20 bp, Artificial Sequence
  chemically synthesized
atctacacttacactaattt

SEQ ID NO: 326170 - DNA, 20 bp, Artificial Sequence
  chemically synthesized
aataagattttcactgaaat

SEQ ID NO: 326171 - DNA, 20 bp, Artificial Sequence
  chemically synthesized
gatcaaataacaggaagaat

SEQ ID NO: 326172 - DNA, 20 bp, Artificial Sequence
  chemically synthesized
gtcttggatcaaataacagg

SEQ ID NO: 326173 - DNA, 20 bp, Artificial Sequence
  chemically synthesized
ggagtcttggatcaaataac

SEQ ID NO: 326174 - DNA, 20 bp, Artificial Sequence
  chemically synthesized
aggagtcttggatcaaataa

SEQ ID NO: 326175 - DNA, 20 bp, Artificial Sequence
  chemically synthesized
ttcttcctgttatttgatcc

SEQ ID NO: 326176 - DNA, 20 bp, Artificial Sequence
  chemically synthesized
agcttaaggttaaggagtct

SEQ ID NO: 326177 - DNA, 20 bp, Artificial Sequence
  chemically synthesized
gaaaaaagcttaaggttaag

SEQ ID NO: 326178 - DNA, 20 bp, Artificial Sequence
  chemically synthesized
atccaagactccttaacctt

SEQ ID NO: 326179 - DNA, 20 bp, Artificial Sequence
  chemically synthesized
cagaaaaaagcttaaggtta

SEQ ID NO: 326180 - DNA, 20 bp, Artificial Sequence
  chemically synthesized
acagaaaaaagcttaaggtt

SEQ ID NO: 326181 - DNA, 20 bp, Artificial Sequence
  chemically synthesized
cctttacagaaaaaagctta

SEQ ID NO: 326182 - DNA, 20 bp, Artificial Sequence
  chemically synthesized
ccctttacagaaaaaagctt

SEQ ID NO: 326183 - DNA, 20 bp, Artificial Sequence
  chemically synthesized
atctagccctttacagaaaa

SEQ ID NO: 326184 - DNA, 20 bp, Artificial Sequence
  chemically synthesized
accttaagcttttttctgta

SEQ ID NO: 326185 - DNA, 20 bp, Artificial Sequence
  chemically synthesized
ccttaagcttttttctgtaa

SEQ ID NO: 326186 - DNA, 20 bp, Artificial Sequence
  chemically synthesized
cttaagcttttttctgtaaa

SEQ ID NO: 326187 - DNA, 20 bp, Artificial Sequence
  chemically synthesized
acctattatctagcccttta

SEQ ID NO: 326188 - DNA, 20 bp, Artificial Sequence
  chemically synthesized
agcttttttctgtaaagggc

SEQ ID NO: 326189 - DNA, 20 bp, Artificial Sequence
  chemically synthesized
ttctgtaaagggctagataa

SEQ ID NO: 326190 - DNA, 20 bp, Artificial Sequence
  chemically synthesized
tctgtaaagggctagataat

SEQ ID NO: 326191 - DNA, 20 bp, Artificial Sequence
  chemically synthesized
aattgaagatacctattatc

SEQ ID NO: 326192 - DNA, 20 bp, Artificial Sequence
  chemically synthesized
tttagtggtctgcaaaattg

SEQ ID NO: 326193 - DNA, 20 bp, Artificial Sequence
  chemically synthesized
aataggtatcttcaattttg

SEQ ID NO: 326194 - DNA, 20 bp, Artificial Sequence
  chemically synthesized
ttcaattttgcagaccacta

SEQ ID NO: 326195 - DNA, 20 bp, Artificial Sequence
  chemically synthesized
tgggggcatctggtctttag

SEQ ID NO: 326196 - DNA, 20 bp, Artificial Sequence
  chemically synthesized
ttttgcagaccactaaagac

SEQ ID NO: 326197 - DNA, 20 bp, Artificial Sequence
  chemically synthesized
agttgggggcatctggtctt

SEQ ID NO: 326198 - DNA, 20 bp, Artificial Sequence
  chemically synthesized
agagctgagttgggggcatc

SEQ ID NO: 326199 - DNA, 20 bp, Artificial Sequence
  chemically synthesized
aagaccagatgcccccaact

SEQ ID NO: 326200 - DNA, 20 bp, Artificial Sequence
  chemically synthesized
cagtgacagagctgagttgg

SEQ ID NO: 326201 - DNA, 20 bp, Artificial Sequence
  chemically synthesized
gcagtgacagagctgagttg

SEQ ID NO: 326202 - DNA, 20 bp, Artificial Sequence
  chemically synthesized
tgcagtgacagagctgagtt

SEQ ID NO: 326203 - DNA, 20 bp, Artificial Sequence
  chemically synthesized
ttgcagtgacagagctgagt

SEQ ID NO: 326204 - DNA, 20 bp, Artificial Sequence
  chemically synthesized
caatttgcagtgacagagct

SEQ ID NO: 326205 - DNA, 20 bp, Artificial Sequence
  chemically synthesized
ggctacaatttgcagtgaca

SEQ ID NO: 326206 - DNA, 20 bp, Artificial Sequence
  chemically synthesized
ggggctacaatttgcagtga

SEQ ID NO: 326207 - DNA, 20 bp, Artificial Sequence
  chemically synthesized
agctctgtcactgcaaattg

SEQ ID NO: 326208 - DNA, 20 bp, Artificial Sequence
  chemically synthesized
tgctttggggctacaatttg

SEQ ID NO: 326209 - DNA, 20 bp, Artificial Sequence
  chemically synthesized
cactgcaaattgtagcccca

SEQ ID NO: 326210 - DNA, 20 bp, Artificial Sequence
  chemically synthesized
tattgtctccagatgctttg

SEQ ID NO: 326211 - DNA, 20 bp, Artificial Sequence
  chemically synthesized
gtattgtctccagatgcttt

SEQ ID NO: 326212 - DNA, 20 bp, Artificial Sequence
  chemically synthesized
aattgtagccccaaagcatc

SEQ ID NO: 326213 - DNA, 20 bp, Artificial Sequence
  chemically synthesized
tgtattgtctccagatgctt

SEQ ID NO: 326214 - DNA, 20 bp, Artificial Sequence
  chemically synthesized
ttgtagccccaaagcatctg

SEQ ID NO: 326215 - DNA, 20 bp, Artificial Sequence
  chemically synthesized
ttcacttaatgtattgtctc

SEQ ID NO: 326216 - DNA, 20 bp, Artificial Sequence
  chemically synthesized
gcatctggagacaatacatt

SEQ ID NO: 326217 - DNA, 20 bp, Artificial Sequence
  chemically synthesized
atacattaagtgaataaaca

SEQ ID NO: 326218 - DNA, 20 bp, Artificial Sequence
  chemically synthesized
ttttgtaaataaagttttat

SEQ ID NO: 326219 - DNA, 20 bp, Artificial Sequence
  chemically synthesized
ctacctgatttttgtaaata

SEQ ID NO: 326220 - DNA, 20 bp, Artificial Sequence
  chemically synthesized
aaaactttatttacaaaaat

SEQ ID NO: 326221 - DNA, 20 bp, Artificial Sequence
  chemically synthesized
aaactttatttacaaaaatc

SEQ ID NO: 326222 - DNA, 20 bp, Artificial Sequence
  chemically synthesized
ctttatttacaaaaatcagg

SEQ ID NO: 326223 - DNA, 20 bp, Artificial Sequence
  chemically synthesized
atttacaaaaatcaggtagc

SEQ ID NO: 326224 - DNA, 20 bp, Artificial Sequence
  chemically synthesized
ctatggcctgagggtgaaaa

SEQ ID NO: 326225 - DNA, 20 bp, Artificial Sequence
  chemically synthesized
agcaagtctattttcaccct

SEQ ID NO: 326226 - DNA, 20 bp, Artificial Sequence
  chemically synthesized
gcaagtctattttcaccctc

SEQ ID NO: 326227 - DNA, 20 bp, Artificial Sequence
  chemically synthesized
gatagcaatctatggcctga

SEQ ID NO: 326228 - DNA, 20 bp, Artificial Sequence
  chemically synthesized
ctattttcaccctcaggcca

SEQ ID NO: 326229 - DNA, 20 bp, Artificial Sequence
  chemically synthesized
agatagcaatctatggcctg

SEQ ID NO: 326230 - DNA, 20 bp, Artificial Sequence
  chemically synthesized
gagatagcaatctatggcct

SEQ ID NO: 326231 - DNA, 20 bp, Artificial Sequence
  chemically synthesized
catcaggagatagcaatcta

SEQ ID NO: 326232 - DNA, 20 bp, Artificial Sequence
  chemically synthesized
gcaatttcatcatcaggaga

SEQ ID NO: 326233 - DNA, 20 bp, Artificial Sequence
  chemically synthesized
ggaagcaatttcatcatcag

SEQ ID NO: 326234 - DNA, 20 bp, Artificial Sequence
  chemically synthesized
tgggaagcaatttcatcatc

SEQ ID NO: 326235 - DNA, 20 bp, Artificial Sequence
  chemically synthesized
gtgggaagcaatttcatcat

SEQ ID NO: 326236 - DNA, 20 bp, Artificial Sequence
  chemically synthesized
gaaattagtttaaatgtggg

SEQ ID NO: 326237 - DNA, 20 bp, Artificial Sequence
  chemically synthesized
agagaaattagtttaaatgt

SEQ ID NO: 326238 - DNA, 20 bp, Artificial Sequence
  chemically synthesized
cagagaaattagtttaaatg

SEQ ID NO: 326239 - DNA, 20 bp, Artificial Sequence
  chemically synthesized
agtgagaagttcagagaaat

SEQ ID NO: 326240 - DNA, 20 bp, Artificial Sequence
  chemically synthesized
aatcaacagtgagaagttca

SEQ ID NO: 326241 - DNA, 20 bp, Artificial Sequence
  chemically synthesized
ataatcaacagtgagaagtt

SEQ ID NO: 326242 - DNA, 20 bp, Artificial Sequence
  chemically synthesized
gaaagataatcaacagtgag

SEQ ID NO: 326243 - DNA, 20 bp, Artificial Sequence
  chemically synthesized
gaggaaagataatcaacagt

SEQ ID NO: 326244 - DNA, 20 bp, Artificial Sequence
  chemically synthesized
gagagaggaaagataatcaa

SEQ ID NO: 326245 - DNA, 20 bp, Artificial Sequence
  chemically synthesized
gggagagattggagagagga

SEQ ID NO: 326246 - DNA, 20 bp, Artificial Sequence
  chemically synthesized
gagggggagagattggagag

SEQ ID NO: 326247 - DNA, 20 bp, Artificial Sequence
  chemically synthesized
ggagggggagagattggaga

SEQ ID NO: 326248 - DNA, 20 bp, Artificial Sequence
  chemically synthesized
ttggagggggagagattgga

SEQ ID NO: 326249 - DNA, 20 bp, Artificial Sequence
  chemically synthesized
aattggagggggagagattg

SEQ ID NO: 326250 - DNA, 20 bp, Artificial Sequence
  chemically synthesized
tcaattggagggggagagat

SEQ ID NO: 326251 - DNA, 20 bp, Artificial Sequence
  chemically synthesized
gagaatcaattggaggggga

SEQ ID NO: 326252 - DNA, 20 bp, Artificial Sequence
  chemically synthesized
atgagaatcaattggagggg

SEQ ID NO: 326253 - DNA, 20 bp, Artificial Sequence
  chemically synthesized
caatgagaatcaattggagg

SEQ ID NO: 326254 - DNA, 20 bp, Artificial Sequence
  chemically synthesized
ccaatgagaatcaattggag

SEQ ID NO: 326255 - DNA, 20 bp, Artificial Sequence
  chemically synthesized
cccaatgagaatcaattgga

SEQ ID NO: 326256 - DNA, 20 bp, Artificial Sequence
  chemically synthesized
acccaatgagaatcaattgg

SEQ ID NO: 326257 - DNA, 20 bp, Artificial Sequence
  chemically synthesized
gacccaatgagaatcaattg

SEQ ID NO: 326258 - DNA, 20 bp, Artificial Sequence
  chemically synthesized
gtgacccaatgagaatcaat

SEQ ID NO: 326259 - DNA, 20 bp, Artificial Sequence
  chemically synthesized
cccctccaattgattctcat

SEQ ID NO: 326260 - DNA, 20 bp, Artificial Sequence
  chemically synthesized
ccctccaattgattctcatt

SEQ ID NO: 326261 - DNA, 20 bp, Artificial Sequence
  chemically synthesized
gagtgggaaagtgacccaat

SEQ ID NO: 326262 - DNA, 20 bp, Artificial Sequence
  chemically synthesized
ggacatgcaatagagtggga

SEQ ID NO: 326263 - DNA, 20 bp, Artificial Sequence
  chemically synthesized
gcttggacatgcaatagagt

SEQ ID NO: 326264 - DNA, 20 bp, Artificial Sequence
  chemically synthesized
agcttggacatgcaatagag

SEQ ID NO: 326265 - DNA, 20 bp, Artificial Sequence
  chemically synthesized
gctagcttggacatgcaata

SEQ ID NO: 326266 - DNA, 20 bp, Artificial Sequence
  chemically synthesized
tggctagcttggacatgcaa

SEQ ID NO: 326267 - DNA, 20 bp, Artificial Sequence
  chemically synthesized
tcccactctattgcatgtcc

SEQ ID NO: 326268 - DNA, 20 bp, Artificial Sequence
  chemically synthesized
actctattgcatgtccaagc

SEQ ID NO: 326269 - DNA, 20 bp, Artificial Sequence
  chemically synthesized
gatttcagagatggctagct

SEQ ID NO: 326270 - DNA, 20 bp, Artificial Sequence
  chemically synthesized
agtgagatttcagagatggc

SEQ ID NO: 326271 - DNA, 20 bp, Artificial Sequence
  chemically synthesized
gggcagtgagatttcagaga

SEQ ID NO: 326272 - DNA, 20 bp, Artificial Sequence
  chemically synthesized
gggagggcagtgagatttca

SEQ ID NO: 326273 - DNA, 20 bp, Artificial Sequence
  chemically synthesized
gggggagggcagtgagattt

SEQ ID NO: 326274 - DNA, 20 bp, Artificial Sequence
  chemically synthesized
tagggcagggggagggcagt

SEQ ID NO: 326275 - DNA, 20 bp, Artificial Sequence
  chemically synthesized
gaggtagggcagggggaggg

SEQ ID NO: 326276 - DNA, 20 bp, Artificial Sequence
  chemically synthesized
atggaggtagggcaggggga

SEQ ID NO: 326277 - DNA, 20 bp, Artificial Sequence
  chemically synthesized
aatggaggtagggcaggggg

SEQ ID NO: 326278 - DNA, 20 bp, Artificial Sequence
  chemically synthesized
caatggaggtagggcagggg

SEQ ID NO: 326279 - DNA, 20 bp, Artificial Sequence
  chemically synthesized
agcaatggaggtagggcagg

SEQ ID NO: 326280 - DNA, 20 bp, Artificial Sequence
  chemically synthesized
cagcaatggaggtagggcag

SEQ ID NO: 326281 - DNA, 20 bp, Artificial Sequence
  chemically synthesized
acagcaatggaggtagggca

SEQ ID NO: 326282 - DNA, 20 bp, Artificial Sequence
  chemically synthesized
tacagcaatggaggtagggc

SEQ ID NO: 326283 - DNA, 20 bp, Artificial Sequence
  chemically synthesized
atacagcaatggaggtaggg

SEQ ID NO: 326284 - DNA, 20 bp, Artificial Sequence
  chemically synthesized
tatatacagcaatggaggta

SEQ ID NO: 326285 - DNA, 20 bp, Artificial Sequence
  chemically synthesized
ttatatacagcaatggaggt

SEQ ID NO: 326286 - DNA, 20 bp, Artificial Sequence
  chemically synthesized
gttatatacagcaatggagg

SEQ ID NO: 326287 - DNA, 20 bp, Artificial Sequence
  chemically synthesized
attgttatatacagcaatgg

SEQ ID NO: 326288 - DNA, 20 bp, Artificial Sequence
  chemically synthesized
cattgttatatacagcaatg

SEQ ID NO: 326289 - DNA, 20 bp, Artificial Sequence
  chemically synthesized
gacattgttatatacagcaa

SEQ ID NO: 326290 - DNA, 20 bp, Artificial Sequence
  chemically synthesized
ctttgagacattgttatata

SEQ ID NO: 326291 - DNA, 20 bp, Artificial Sequence
  chemically synthesized
ctgtatataacaatgtctca

SEQ ID NO: 326292 - DNA, 20 bp, Artificial Sequence
  chemically synthesized
ttatgcagcatgatttcttt

SEQ ID NO: 326293 - DNA, 20 bp, Artificial Sequence
  chemically synthesized
atgcggccactggttttatg

SEQ ID NO: 326294 - DNA, 20 bp, Artificial Sequence
  chemically synthesized
gaaatcatgctgcataaaac

SEQ ID NO: 326295 - DNA, 20 bp, Artificial Sequence
  chemically synthesized
atcatgctgcataaaaccag

SEQ ID NO: 326296 - DNA, 20 bp, Artificial Sequence
  chemically synthesized
agtttcccgaatgcggccac

SEQ ID NO: 326297 - DNA, 20 bp, Artificial Sequence
  chemically synthesized
ataaaaccagtggccgcatt

SEQ ID NO: 326298 - DNA, 20 bp, Artificial Sequence
  chemically synthesized
taaaaccagtggccgcattc

SEQ ID NO: 326299 - DNA, 20 bp, Artificial Sequence
  chemically synthesized
gacttaaagtttcccgaatg

SEQ ID NO: 326300 - DNA, 20 bp, Artificial Sequence
  chemically synthesized
ggccgcattcgggaaacttt

SEQ ID NO: 326301 - DNA, 20 bp, Artificial Sequence
  chemically synthesized
gcattcgggaaactttaagt

SEQ ID NO: 326302 - DNA, 20 bp, Artificial Sequence
  chemically synthesized
tccaaagtgaggccgactta

SEQ ID NO: 326303 - DNA, 20 bp, Artificial Sequence
  chemically synthesized
actttaagtcggcctcactt

SEQ ID NO: 326304 - DNA, 20 bp, Artificial Sequence
  chemically synthesized
tttaagtcggcctcactttg

SEQ ID NO: 326305 - DNA, 20 bp, Artificial Sequence
  chemically synthesized
gtttattttactccaaagtg

SEQ ID NO: 326306 - DNA, 20 bp, Artificial Sequence
  chemically synthesized
tgtttattttactccaaagt

SEQ ID NO: 326307 - DNA, 20 bp, Artificial Sequence
  chemically synthesized
ctcatgtttattttactcca

SEQ ID NO: 326308 - DNA, 20 bp, Artificial Sequence
  chemically synthesized
ctttggagtaaaataaacat

SEQ ID NO: 326309 - DNA, 20 bp, Artificial Sequence
  chemically synthesized
tttggagtaaaataaacatg

SEQ ID NO: 326310 - DNA, 20 bp, Artificial Sequence
  chemically synthesized
aataaacatgaggtcaaatt

SEQ ID NO: 326311 - DNA, 20 bp, Artificial Sequence
  chemically synthesized
ataaacatgaggtcaaattc

SEQ ID NO: 326312 - DNA, 20 bp, Artificial Sequence
  chemically synthesized
atgaggtcaaattcaggttc

SEQ ID NO: 326313 - DNA, 20 bp, Artificial Sequence
  chemically synthesized
aattcaggttctggaattta

SEQ ID NO: 326314 - DNA, 20 bp, Artificial Sequence
  chemically synthesized
tacacactacctataaattc

SEQ ID NO: 326315 - DNA, 20 bp, Artificial Sequence
  chemically synthesized
attcaggttctggaatttat

SEQ ID NO: 326316 - DNA, 20 bp, Artificial Sequence
  chemically synthesized
caggttctggaatttatagg

SEQ ID NO: 326317 - DNA, 20 bp, Artificial Sequence
  chemically synthesized
aggtagtgtgtacttgaact

SEQ ID NO: 326318 - DNA, 20 bp, Artificial Sequence
  chemically synthesized
taaaaaactttgccaagttc

SEQ ID NO: 326319 - DNA, 20 bp, Artificial Sequence
  chemically synthesized
gtgtgtacttgaacttggca

SEQ ID NO: 326320 - DNA, 20 bp, Artificial Sequence
  chemically synthesized
tgaaattaaaaaactttgcc

SEQ ID NO: 326321 - DNA, 20 bp, Artificial Sequence
  chemically synthesized
gttttttaatttcacactct

SEQ ID NO: 326322 - DNA, 20 bp, Artificial Sequence
  chemically synthesized
tattttcaggtgtgtaccaa

SEQ ID NO: 326323 - DNA, 20 bp, Artificial Sequence
  chemically synthesized
tctattttcaggtgtgtacc

SEQ ID NO: 326324 - DNA, 20 bp, Artificial Sequence
  chemically synthesized
tcttggtacacacctgaaaa

SEQ ID NO: 326325 - DNA, 20 bp, Artificial Sequence
  chemically synthesized
ttagtatcatatctattttc

SEQ ID NO: 326326 - DNA, 20 bp, Artificial Sequence
  chemically synthesized
attagtatcatatctatttt

SEQ ID NO: 326327 - DNA, 20 bp, Artificial Sequence
  chemically synthesized
aaatagatatgatactaatt

SEQ ID NO: 326328 - DNA, 20 bp, Artificial Sequence
  chemically synthesized
atagatatgatactaattta

SEQ ID NO: 326329 - DNA, 20 bp, Artificial Sequence
  chemically synthesized
tagatatgatactaatttag

SEQ ID NO: 326330 - DNA, 20 bp, Artificial Sequence
  chemically synthesized
agatatgatactaatttaga

SEQ ID NO: 326331 - DNA, 20 bp, Artificial Sequence
  chemically synthesized
cttacaattaccctctaaat

SEQ ID NO: 326332 - DNA, 20 bp, Artificial Sequence
  chemically synthesized
ctaatttagagggtaattgt

SEQ ID NO: 326333 - DNA, 20 bp, Artificial Sequence
  chemically synthesized
taatttagagggtaattgta

SEQ ID NO: 326334 - DNA, 20 bp, Artificial Sequence
  chemically synthesized
gagggtaattgtaaggctca

SEQ ID NO: 326335 - DNA, 20 bp, Artificial Sequence
  chemically synthesized
aatcgctgtatgttgtctgt

SEQ ID NO: 326336 - DNA, 20 bp, Artificial Sequence
  chemically synthesized
taaggctcacagacaacata

SEQ ID NO: 326337 - DNA, 20 bp, Artificial Sequence
  chemically synthesized
acagcgattgtattgacatt

SEQ ID NO: 326338 - DNA, 20 bp, Artificial Sequence
  chemically synthesized
tataaaagttgaatggcaaa

SEQ ID NO: 326339 - DNA, 20 bp, Artificial Sequence
  chemically synthesized
ttataaaagttgaatggcaa

SEQ ID NO: 326340 - DNA, 20 bp, Artificial Sequence
  chemically synthesized
tttataaaagttgaatggca

SEQ ID NO: 326341 - DNA, 20 bp, Artificial Sequence
  chemically synthesized
gtgattttataaaagttgaa

SEQ ID NO: 326342 - DNA, 20 bp, Artificial Sequence
  chemically synthesized
cagtgaaagtgattttataa

SEQ ID NO: 326343 - DNA, 20 bp, Artificial Sequence
  chemically synthesized
taaaaacaatgaggcagtga

SEQ ID NO: 326344 - DNA, 20 bp, Artificial Sequence
  chemically synthesized
actaaataaaaacaatgagg

SEQ ID NO: 326345 - DNA, 20 bp, Artificial Sequence
  chemically synthesized
tgcactaaataaaaacaatg

SEQ ID NO: 326346 - DNA, 20 bp, Artificial Sequence
  chemically synthesized
ttgcactaaataaaaacaat

SEQ ID NO: 326347 - DNA, 20 bp, Artificial Sequence
  chemically synthesized
actgcctcattgtttttatt

SEQ ID NO: 326348 - DNA, 20 bp, Artificial Sequence
  chemically synthesized
tgtttttatttagtgcaacc

SEQ ID NO: 326349 - DNA, 20 bp, Artificial Sequence
  chemically synthesized
ttatttagtgcaacccagaa

SEQ ID NO: 326350 - DNA, 20 bp, Artificial Sequence
  chemically synthesized
atttagtgcaacccagaata

SEQ ID NO: 326351 - DNA, 20 bp, Artificial Sequence
  chemically synthesized
tgttgttagttctctattct

SEQ ID NO: 326352 - DNA, 20 bp, Artificial Sequence
  chemically synthesized
ttgttgttagttctctattc

SEQ ID NO: 326353 - DNA, 20 bp, Artificial Sequence
  chemically synthesized
aaactcctctttattgttgt

SEQ ID NO: 326354 - DNA, 20 bp, Artificial Sequence
  chemically synthesized
atagagaactaacaacaata

SEQ ID NO: 326355 - DNA, 20 bp, Artificial Sequence
  chemically synthesized
agagaactaacaacaataaa

SEQ ID NO: 326356 - DNA, 20 bp, Artificial Sequence
  chemically synthesized
gagaactaacaacaataaag

SEQ ID NO: 326357 - DNA, 20 bp, Artificial Sequence
  chemically synthesized
gaactaacaacaataaagag

SEQ ID NO: 326358 - DNA, 20 bp, Artificial Sequence
  chemically synthesized
aacaacaataaagaggagtt

SEQ ID NO: 326359 - DNA, 20 bp, Artificial Sequence
  chemically synthesized
aaagaggagtttggttcaat

SEQ ID NO: 326360 - DNA, 20 bp, Artificial Sequence
  chemically synthesized
agtttggttcaattagattt

SEQ ID NO: 326361 - DNA, 20 bp, Artificial Sequence
  chemically synthesized
gtttggttcaattagatttt

SEQ ID NO: 326362 - DNA, 20 bp, Artificial Sequence
  chemically synthesized
gaaaagatgtgtcaatttag

SEQ ID NO: 326363 - DNA, 20 bp, Artificial Sequence
  chemically synthesized
ttagaaaagatgtgtcaatt

SEQ ID NO: 326364 - DNA, 20 bp, Artificial Sequence
  chemically synthesized
attgacacatcttttctaac

SEQ ID NO: 326365 - DNA, 20 bp, Artificial Sequence
  chemically synthesized
gaaaatttacctagttagaa

SEQ ID NO: 326366 - DNA, 20 bp, Artificial Sequence
  chemically synthesized
ttgacacatcttttctaact

SEQ ID NO: 326367 - DNA, 20 bp, Artificial Sequence
  chemically synthesized
ttggagaaaatttacctagt

SEQ ID NO: 326368 - DNA, 20 bp, Artificial Sequence
  chemically synthesized
gtccttggagaaaatttacc

SEQ ID NO: 326369 - DNA, 20 bp, Artificial Sequence
  chemically synthesized
taactaggtaaattttctcc

SEQ ID NO: 326370 - DNA, 20 bp, Artificial Sequence
  chemically synthesized
aactaggtaaattttctcca

SEQ ID NO: 326371 - DNA, 20 bp, Artificial Sequence
  chemically synthesized
gaatatagctaatgtccttg

SEQ ID NO: 326372 - DNA, 20 bp, Artificial Sequence
  chemically synthesized
taaattttctccaaggacat

SEQ ID NO: 326373 - DNA, 20 bp, Artificial Sequence
  chemically synthesized
gtgaatatagctaatgtcct

SEQ ID NO: 326374 - DNA, 20 bp, Artificial Sequence
  chemically synthesized
gtatgttaaggaggtgaata

SEQ ID NO: 326375 - DNA, 20 bp, Artificial Sequence
  chemically synthesized
gcaactggtgtatgttaagg

SEQ ID NO: 326376 - DNA, 20 bp, Artificial Sequence
  chemically synthesized
agcaactggtgtatgttaag

SEQ ID NO: 326377 - DNA, 20 bp, Artificial Sequence
  chemically synthesized
caagcaactggtgtatgtta

SEQ ID NO: 326378 - DNA, 20 bp, Artificial Sequence
  chemically synthesized
ccaagcaactggtgtatgtt

SEQ ID NO: 326379 - DNA, 20 bp, Artificial Sequence
  chemically synthesized
ttcacctccttaacatacac

SEQ ID NO: 326380 - DNA, 20 bp, Artificial Sequence
  chemically synthesized
cttaacatacaccagttgct

SEQ ID NO: 326381 - DNA, 20 bp, Artificial Sequence
  chemically synthesized
aacgggataaaccaagcaac

SEQ ID NO: 326382 - DNA, 20 bp, Artificial Sequence
  chemically synthesized
gaaaggtaacgggataaacc

SEQ ID NO: 326383 - DNA, 20 bp, Artificial Sequence
  chemically synthesized
tgatatatgtgaaaggtaac

SEQ ID NO: 326384 - DNA, 20 bp, Artificial Sequence
  chemically synthesized
gtgatatatgtgaaaggtaa

SEQ ID NO: 326385 - DNA, 20 bp, Artificial Sequence
  chemically synthesized
aatttagtgatatatgtgaa

SEQ ID NO: 326386 - DNA, 20 bp, Artificial Sequence
  chemically synthesized
gaatttagtgatatatgtga

SEQ ID NO: 326387 - DNA, 20 bp, Artificial Sequence
  chemically synthesized
aagagaaagcacacagaatt

SEQ ID NO: 326388 - DNA, 20 bp, Artificial Sequence
  chemically synthesized
ataaataaagagaaagcaca

SEQ ID NO: 326389 - DNA, 20 bp, Artificial Sequence
  chemically synthesized
atgtaacataaataaagaga

SEQ ID NO: 326390 - DNA, 20 bp, Artificial Sequence
  chemically synthesized
aggtatgtaacataaataaa

SEQ ID NO: 326391 - DNA, 20 bp, Artificial Sequence
  chemically synthesized
aaaggtatgtaacataaata

SEQ ID NO: 326392 - DNA, 20 bp, Artificial Sequence
  chemically synthesized
ggaataaggaaaagagacaa

SEQ ID NO: 326393 - DNA, 20 bp, Artificial Sequence
  chemically synthesized
aggaataaggaaaagagaca

SEQ ID NO: 326394 - DNA, 20 bp, Artificial Sequence
  chemically synthesized
tgtttaaggaataaggaaaa

SEQ ID NO: 326395 - DNA, 20 bp, Artificial Sequence
  chemically synthesized
tttgtttaaggaataaggaa

SEQ ID NO: 326396 - DNA, 20 bp, Artificial Sequence
  chemically synthesized
acatctttgtttaaggaata

SEQ ID NO: 326397 - DNA, 20 bp, Artificial Sequence
  chemically synthesized
cacatctttgtttaaggaat

SEQ ID NO: 326398 - DNA, 20 bp, Artificial Sequence
  chemically synthesized
ttttccttattccttaaaca

SEQ ID NO: 326399 - DNA, 20 bp, Artificial Sequence
  chemically synthesized
atataccacatctttgttta

SEQ ID NO: 326400 - DNA, 20 bp, Artificial Sequence
  chemically synthesized
gatataccacatctttgttt

SEQ ID NO: 326401 - DNA, 20 bp, Artificial Sequence
  chemically synthesized
ttattccttaaacaaagatg

SEQ ID NO: 326402 - DNA, 20 bp, Artificial Sequence
  chemically synthesized
agatgtggtatatccttcat

SEQ ID NO: 326403 - DNA, 20 bp, Artificial Sequence
  chemically synthesized
gatgtggtatatccttcata

SEQ ID NO: 326404 - DNA, 20 bp, Artificial Sequence
  chemically synthesized
atgtggtatatccttcataa

SEQ ID NO: 326405 - DNA, 20 bp, Artificial Sequence
  chemically synthesized
gggatttctctcccttatga

SEQ ID NO: 326406 - DNA, 20 bp, Artificial Sequence
  chemically synthesized
gtggtatatccttcataagg

SEQ ID NO: 326407 - DNA, 20 bp, Artificial Sequence
  chemically synthesized
agggatttctctcccttatg

SEQ ID NO: 326408 - DNA, 20 bp, Artificial Sequence
  chemically synthesized
ggtatatccttcataaggga

SEQ ID NO: 326409 - DNA, 20 bp, Artificial Sequence
  chemically synthesized
ataagggagagaaatcccta

SEQ ID NO: 326410 - DNA, 20 bp, Artificial Sequence
  chemically synthesized
taagggagagaaatccctat

SEQ ID NO: 326411 - DNA, 20 bp, Artificial Sequence
  chemically synthesized
aagggagagaaatccctatg

SEQ ID NO: 326412 - DNA, 20 bp, Artificial Sequence
  chemically synthesized
agggagagaaatccctatgg

SEQ ID NO: 326413 - DNA, 20 bp, Artificial Sequence
  chemically synthesized
tacccattagttcccccata

SEQ ID NO: 326414 - DNA, 20 bp, Artificial Sequence
  chemically synthesized
ctacccattagttcccccat

SEQ ID NO: 326415 - DNA, 20 bp, Artificial Sequence
  chemically synthesized
gctacccattagttccccca

SEQ ID NO: 326416 - DNA, 20 bp, Artificial Sequence
  chemically synthesized
aatccctatgggggaactaa

SEQ ID NO: 326417 - DNA, 20 bp, Artificial Sequence
  chemically synthesized
atccctatgggggaactaat

SEQ ID NO: 326418 - DNA, 20 bp, Artificial Sequence
  chemically synthesized
cctatgggggaactaatggg

SEQ ID NO: 326419 - DNA, 20 bp, Artificial Sequence
  chemically synthesized
agagacaggaagctacccat

SEQ ID NO: 326420 - DNA, 20 bp, Artificial Sequence
  chemically synthesized
gcccaagaagtagagacagg

SEQ ID NO: 326421 - DNA, 20 bp, Artificial Sequence
  chemically synthesized
gatgcccaagaagtagagac

SEQ ID NO: 326422 - DNA, 20 bp, Artificial Sequence
  chemically synthesized
agatgcccaagaagtagaga

SEQ ID NO: 326423 - DNA, 20 bp, Artificial Sequence
  chemically synthesized
agcttcctgtctctacttct

SEQ ID NO: 326424 - DNA, 20 bp, Artificial Sequence
  chemically synthesized
ctatagatgcccaagaagta

SEQ ID NO: 326425 - DNA, 20 bp, Artificial Sequence
  chemically synthesized
gcttcctgtctctacttctt

SEQ ID NO: 326426 - DNA, 20 bp, Artificial Sequence
  chemically synthesized
cactatagatgcccaagaag

SEQ ID NO: 326427 - DNA, 20 bp, Artificial Sequence
  chemically synthesized
aagcactatagatgcccaag

SEQ ID NO: 326428 - DNA, 20 bp, Artificial Sequence
  chemically synthesized
cagaagcactatagatgccc

SEQ ID NO: 326429 - DNA, 20 bp, Artificial Sequence
  chemically synthesized
ctctacttcttgggcatcta

SEQ ID NO: 326430 - DNA, 20 bp, Artificial Sequence
  chemically synthesized
actatcccacagaagcacta

SEQ ID NO: 326431 - DNA, 20 bp, Artificial Sequence
  chemically synthesized
gggcatctatagtgcttctg

SEQ ID NO: 326432 - DNA, 20 bp, Artificial Sequence
  chemically synthesized
ggcatctatagtgcttctgt

SEQ ID NO: 326433 - DNA, 20 bp, Artificial Sequence
  chemically synthesized
ataatgaaactatcccacag

SEQ ID NO: 326434 - DNA, 20 bp, Artificial Sequence
  chemically synthesized
tctatagtgcttctgtggga

SEQ ID NO: 326435 - DNA, 20 bp, Artificial Sequence
  chemically synthesized
ttaataatgaaactatccca

SEQ ID NO: 326436 - DNA, 20 bp, Artificial Sequence
  chemically synthesized
gatagtttcattattaaaat

SEQ ID NO: 326437 - DNA, 20 bp, Artificial Sequence
  chemically synthesized
atagtttcattattaaaatt

SEQ ID NO: 326438 - DNA, 20 bp, Artificial Sequence
  chemically synthesized
tagtttcattattaaaatta

SEQ ID NO: 326439 - DNA, 20 bp, Artificial Sequence
  chemically synthesized
agggaaataatataaataac

SEQ ID NO: 326440 - DNA, 20 bp, Artificial Sequence
  chemically synthesized
aaataatataaataactagt

SEQ ID NO: 326441 - DNA, 20 bp, Artificial Sequence
  chemically synthesized
tgtcttcctaattagctcac

SEQ ID NO: 326442 - DNA, 20 bp, Artificial Sequence
  chemically synthesized
taaataactagtgagctaat

SEQ ID NO: 326443 - DNA, 20 bp, Artificial Sequence
  chemically synthesized
aaataactagtgagctaatt

SEQ ID NO: 326444 - DNA, 20 bp, Artificial Sequence
  chemically synthesized
taactagtgagctaattagg

SEQ ID NO: 326445 - DNA, 20 bp, Artificial Sequence
  chemically synthesized
cttataattgtcttcctaat

SEQ ID NO: 326446 - DNA, 20 bp, Artificial Sequence
  chemically synthesized
ctaattaggaagacaattat

SEQ ID NO: 326447 - DNA, 20 bp, Artificial Sequence
  chemically synthesized
taattaggaagacaattata

SEQ ID NO: 326448 - DNA, 20 bp, Artificial Sequence
  chemically synthesized
aattaggaagacaattataa

SEQ ID NO: 326449 - DNA, 20 bp, Artificial Sequence
  chemically synthesized
caattataagggtgtgattg

SEQ ID NO: 326450 - DNA, 20 bp, Artificial Sequence
  chemically synthesized
taagggtgtgattgtggaaa

SEQ ID NO: 326451 - DNA, 20 bp, Artificial Sequence
  chemically synthesized
aagggtgtgattgtggaaat

SEQ ID NO: 326452 - DNA, 20 bp, Artificial Sequence
  chemically synthesized
agggtgtgattgtggaaatg

SEQ ID NO: 326453 - DNA, 20 bp, Artificial Sequence
  chemically synthesized
gtgtgattgtggaaatgggg

SEQ ID NO: 326454 - DNA, 20 bp, Artificial Sequence
  chemically synthesized
aaatggggaagttcttttat

SEQ ID NO: 326455 - DNA, 20 bp, Artificial Sequence
  chemically synthesized
atggggaagttcttttatga

SEQ ID NO: 326456 - DNA, 20 bp, Artificial Sequence
  chemically synthesized
tggggaagttcttttatgag

SEQ ID NO: 326457 - DNA, 20 bp, Artificial Sequence
  chemically synthesized
tgctacatcacctctcataa

SEQ ID NO: 326458 - DNA, 20 bp, Artificial Sequence
  chemically synthesized
ttcttttatgagaggtgatg

SEQ ID NO: 326459 - DNA, 20 bp, Artificial Sequence
  chemically synthesized
tgagaggtgatgtagcatct

SEQ ID NO: 326460 - DNA, 20 bp, Artificial Sequence
  chemically synthesized
gaggtgatgtagcatctcgg

SEQ ID NO: 326461 - DNA, 20 bp, Artificial Sequence
  chemically synthesized
tctactgtcgtgaggcttcc

SEQ ID NO: 326462 - DNA, 20 bp, Artificial Sequence
  chemically synthesized
gcatctcggaagcctcacga

SEQ ID NO: 326463 - DNA, 20 bp, Artificial Sequence
  chemically synthesized
ataaactgtctactgtcgtg

SEQ ID NO: 326464 - DNA, 20 bp, Artificial Sequence
  chemically synthesized
tctcggaagcctcacgacag

SEQ ID NO: 326465 - DNA, 20 bp, Artificial Sequence
  chemically synthesized
aataaactgtctactgtcgt

SEQ ID NO: 326466 - DNA, 20 bp, Artificial Sequence
  chemically synthesized
ggaagcctcacgacagtaga

SEQ ID NO: 326467 - DNA, 20 bp, Artificial Sequence
  chemically synthesized
agtagacagtttattttgtt

SEQ ID NO: 326468 - DNA, 20 bp, Artificial Sequence
  chemically synthesized
tttgttcagcacctgacata

SEQ ID NO: 326469 - DNA, 20 bp, Artificial Sequence
  chemically synthesized
agtatgttatactgtatgtc

SEQ ID NO: 326470 - DNA, 20 bp, Artificial Sequence
  chemically synthesized
tagtatgttatactgtatgt

SEQ ID NO: 326471 - DNA, 20 bp, Artificial Sequence
  chemically synthesized
tattgtattcaacaaacata

SEQ ID NO: 326472 - DNA, 20 bp, Artificial Sequence
  chemically synthesized
gaatacaataatgtgtctct

SEQ ID NO: 326473 - DNA, 20 bp, Artificial Sequence
  chemically synthesized
tgttacatgtcatatgctaa

SEQ ID NO: 326474 - DNA, 20 bp, Artificial Sequence
  chemically synthesized
attgttacatgtcatatgct

SEQ ID NO: 326475 - DNA, 20 bp, Artificial Sequence
  chemically synthesized
catatcagtataaggtaaaa

SEQ ID NO: 326476 - DNA, 20 bp, Artificial Sequence
  chemically synthesized
aatgtcctcatatcagtata

SEQ ID NO: 326477 - DNA, 20 bp, Artificial Sequence
  chemically synthesized
aaatgtcctcatatcagtat

SEQ ID NO: 326478 - DNA, 20 bp, Artificial Sequence
  chemically synthesized
attttaccttatactgatat

SEQ ID NO: 326479 - DNA, 20 bp, Artificial Sequence
  chemically synthesized
ttttaccttatactgatatg

SEQ ID NO: 326480 - DNA, 20 bp, Artificial Sequence
  chemically synthesized
gaaaaaaaatgtcctcatat

SEQ ID NO: 326481 - DNA, 20 bp, Artificial Sequence
  chemically synthesized
atgaggacattttttttcct

SEQ ID NO: 326482 - DNA, 20 bp, Artificial Sequence
  chemically synthesized
gaggacattttttttcctaa

SEQ ID NO: 326483 - DNA, 20 bp, Artificial Sequence
  chemically synthesized
tgccttggtctaattctctt

SEQ ID NO: 326484 - DNA, 20 bp, Artificial Sequence
  chemically synthesized
attttttttcctaagagaat

SEQ ID NO: 326485 - DNA, 20 bp, Artificial Sequence
  chemically synthesized
atgccttggtctaattctct

SEQ ID NO: 326486 - DNA, 20 bp, Artificial Sequence
  chemically synthesized
tttcctaagagaattagacc

SEQ ID NO: 326487 - DNA, 20 bp, Artificial Sequence
  chemically synthesized
ttcctaagagaattagacca

SEQ ID NO: 326488 - DNA, 20 bp, Artificial Sequence
  chemically synthesized
tctgtcatggaaagatgcct

SEQ ID NO: 326489 - DNA, 20 bp, Artificial Sequence
  chemically synthesized
accaaggcatctttccatga

SEQ ID NO: 326490 - DNA, 20 bp, Artificial Sequence
  chemically synthesized
tgtccctgctctgtcatgga

SEQ ID NO: 326491 - DNA, 20 bp, Artificial Sequence
  chemically synthesized
caaggcatctttccatgaca

SEQ ID NO: 326492 - DNA, 20 bp, Artificial Sequence
  chemically synthesized
ttcttgtccctgctctgtca

SEQ ID NO: 326493 - DNA, 20 bp, Artificial Sequence
  chemically synthesized
ggcatctttccatgacagag

SEQ ID NO: 326494 - DNA, 20 bp, Artificial Sequence
  chemically synthesized
gcatctttccatgacagagc

SEQ ID NO: 326495 - DNA, 20 bp, Artificial Sequence
  chemically synthesized
catctttccatgacagagca

SEQ ID NO: 326496 - DNA, 20 bp, Artificial Sequence
  chemically synthesized
ttccatgacagagcagggac

SEQ ID NO: 326497 - DNA, 20 bp, Artificial Sequence
  chemically synthesized
gtaagtgaaataaacaagtg

SEQ ID NO: 326498 - DNA, 20 bp, Artificial Sequence
  chemically synthesized
cagtaagtgaaataaacaag

SEQ ID NO: 326499 - DNA, 20 bp, Artificial Sequence
  chemically synthesized
aggcagtaagtgaaataaac

SEQ ID NO: 326500 - DNA, 20 bp, Artificial Sequence
  chemically synthesized
actgcattgaagaaggcagt

SEQ ID NO: 326501 - DNA, 20 bp, Artificial Sequence
  chemically synthesized
caacactgcattgaagaagg

SEQ ID NO: 326502 - DNA, 20 bp, Artificial Sequence
  chemically synthesized
agccaacactgcattgaaga

SEQ ID NO: 326503 - DNA, 20 bp, Artificial Sequence
  chemically synthesized
aagccaacactgcattgaag

SEQ ID NO: 326504 - DNA, 20 bp, Artificial Sequence
  chemically synthesized
acttactgccttcttcaatg

SEQ ID NO: 326505 - DNA, 20 bp, Artificial Sequence
  chemically synthesized
gggaagccaacactgcattg

SEQ ID NO: 326506 - DNA, 20 bp, Artificial Sequence
  chemically synthesized
tgccttcttcaatgcagtgt

SEQ ID NO: 326507 - DNA, 20 bp, Artificial Sequence
  chemically synthesized
atctctttccttgaataggg

SEQ ID NO: 326508 - DNA, 20 bp, Artificial Sequence
  chemically synthesized
cagtgttggcttccctattc

SEQ ID NO: 326509 - DNA, 20 bp, Artificial Sequence
  chemically synthesized
agtgttggcttccctattca

SEQ ID NO: 326510 - DNA, 20 bp, Artificial Sequence
  chemically synthesized
agaatctctttccttgaata

SEQ ID NO: 326511 - DNA, 20 bp, Artificial Sequence
  chemically synthesized
aagaatctctttccttgaat

SEQ ID NO: 326512 - DNA, 20 bp, Artificial Sequence
  chemically synthesized
caagaatctctttccttgaa

SEQ ID NO: 326513 - DNA, 20 bp, Artificial Sequence
  chemically synthesized
ttggcttccctattcaagga

SEQ ID NO: 326514 - DNA, 20 bp, Artificial Sequence
  chemically synthesized
ggcttccctattcaaggaaa

SEQ ID NO: 326515 - DNA, 20 bp, Artificial Sequence
  chemically synthesized
tattcaaggaaagagattct

SEQ ID NO: 326516 - DNA, 20 bp, Artificial Sequence
  chemically synthesized
aaggaataggaagagattcc

SEQ ID NO: 326517 - DNA, 20 bp, Artificial Sequence
  chemically synthesized
gaataggaaaggaataggaa

SEQ ID NO: 326518 - DNA, 20 bp, Artificial Sequence
  chemically synthesized
ttgaataggaaaggaatagg

SEQ ID NO: 326519 - DNA, 20 bp, Artificial Sequence
  chemically synthesized
tccttgaataggaaaggaat

SEQ ID NO: 326520 - DNA, 20 bp, Artificial Sequence
  chemically synthesized
ttccttgaataggaaaggaa

SEQ ID NO: 326521 - DNA, 20 bp, Artificial Sequence
  chemically synthesized
gacctttccttgaataggaa

SEQ ID NO: 326522 - DNA, 20 bp, Artificial Sequence
  chemically synthesized
agacctttccttgaatagga

SEQ ID NO: 326523 - DNA, 20 bp, Artificial Sequence
  chemically synthesized
ttcctattcctttcctattc

SEQ ID NO: 326524 - DNA, 20 bp, Artificial Sequence
  chemically synthesized
tcctattcctttcctattca

SEQ ID NO: 326525 - DNA, 20 bp, Artificial Sequence
  chemically synthesized
ctgaagacctttccttgaat

SEQ ID NO: 326526 - DNA, 20 bp, Artificial Sequence
  chemically synthesized
tctgaagacctttccttgaa

SEQ ID NO: 326527 - DNA, 20 bp, Artificial Sequence
  chemically synthesized
attcctttcctattcaagga

SEQ ID NO: 326528 - DNA, 20 bp, Artificial Sequence
  chemically synthesized
ttcctttcctattcaaggaa

SEQ ID NO: 326529 - DNA, 20 bp, Artificial Sequence
  chemically synthesized
cctattcaaggaaaggtctt

SEQ ID NO: 326530 - DNA, 20 bp, Artificial Sequence
  chemically synthesized
tattcaaggaaaggtcttca

SEQ ID NO: 326531 - DNA, 20 bp, Artificial Sequence
  chemically synthesized
ctttgaaatggcaggctctg

SEQ ID NO: 326532 - DNA, 20 bp, Artificial Sequence
  chemically synthesized
ataccattctttgaaatggc

SEQ ID NO: 326533 - DNA, 20 bp, Artificial Sequence
  chemically synthesized
aataccattctttgaaatgg

SEQ ID NO: 326534 - DNA, 20 bp, Artificial Sequence
  chemically synthesized
cttcagagcctgccatttca

SEQ ID NO: 326535 - DNA, 20 bp, Artificial Sequence
  chemically synthesized
attaataccattctttgaaa

SEQ ID NO: 326536 - DNA, 20 bp, Artificial Sequence
  chemically synthesized
gagcctgccatttcaaagaa

SEQ ID NO: 326537 - DNA, 20 bp, Artificial Sequence
  chemically synthesized
caaagaatggtattaattct

SEQ ID NO: 326538 - DNA, 20 bp, Artificial Sequence
  chemically synthesized
aaagaatggtattaattctt

SEQ ID NO: 326539 - DNA, 20 bp, Artificial Sequence
  chemically synthesized
gaatggtattaattcttggg

SEQ ID NO: 326540 - DNA, 20 bp, Artificial Sequence
  chemically synthesized
aaatctaccagagtcttccc

SEQ ID NO: 326541 - DNA, 20 bp, Artificial Sequence
  chemically synthesized
attaattcttgggaagactc

SEQ ID NO: 326542 - DNA, 20 bp, Artificial Sequence
  chemically synthesized
aattcttgggaagactctgg

SEQ ID NO: 326543 - DNA, 20 bp, Artificial Sequence
  chemically synthesized
ggtgttaatgaaatctacca

SEQ ID NO: 326544 - DNA, 20 bp, Artificial Sequence
  chemically synthesized
caggtgttaatgaaatctac

SEQ ID NO: 326545 - DNA, 20 bp, Artificial Sequence
  chemically synthesized
aggcagagggtggaatttgc

SEQ ID NO: 326546 - DNA, 20 bp, Artificial Sequence
  chemically synthesized
gaggcagagggtggaatttg

SEQ ID NO: 326547 - DNA, 20 bp, Artificial Sequence
  chemically synthesized
actttccttgaggcagaggg

SEQ ID NO: 326548 - DNA, 20 bp, Artificial Sequence
  chemically synthesized
attactttccttgaggcaga

SEQ ID NO: 326549 - DNA, 20 bp, Artificial Sequence
  chemically synthesized
caaattccaccctctgcctc

SEQ ID NO: 326550 - DNA, 20 bp, Artificial Sequence
  chemically synthesized
tattactttccttgaggcag

SEQ ID NO: 326551 - DNA, 20 bp, Artificial Sequence
  chemically synthesized
aaattccaccctctgcctca

SEQ ID NO: 326552 - DNA, 20 bp, Artificial Sequence
  chemically synthesized
ttattactttccttgaggca

SEQ ID NO: 326553 - DNA, 20 bp, Artificial Sequence
  chemically synthesized
ttttattactttccttgagg

SEQ ID NO: 326554 - DNA, 20 bp, Artificial Sequence
  chemically synthesized
tccaccctctgcctcaagga

SEQ ID NO: 326555 - DNA, 20 bp, Artificial Sequence
  chemically synthesized
gacttttattactttccttg

SEQ ID NO: 326556 - DNA, 20 bp, Artificial Sequence
  chemically synthesized
ggacttttattactttcctt

SEQ ID NO: 326557 - DNA, 20 bp, Artificial Sequence
  chemically synthesized
tgcctcaaggaaagtaataa

SEQ ID NO: 326558 - DNA, 20 bp, Artificial Sequence
  chemically synthesized
gctttcagccaacaggatag

SEQ ID NO: 326559 - DNA, 20 bp, Artificial Sequence
  chemically synthesized
tgctttcagccaacaggata

SEQ ID NO: 326560 - DNA, 20 bp, Artificial Sequence
  chemically synthesized
ataaaagtcctctatcctgt

SEQ ID NO: 326561 - DNA, 20 bp, Artificial Sequence
  chemically synthesized
actgctttcagccaacagga

SEQ ID NO: 326562 - DNA, 20 bp, Artificial Sequence
  chemically synthesized
ttccactgctttcagccaac

SEQ ID NO: 326563 - DNA, 20 bp, Artificial Sequence
  chemically synthesized
tttccactgctttcagccaa

SEQ ID NO: 326564 - DNA, 20 bp, Artificial Sequence
  chemically synthesized
tcctctatcctgttggctga

SEQ ID NO: 326565 - DNA, 20 bp, Artificial Sequence
  chemically synthesized
tctatcctgttggctgaaag

SEQ ID NO: 326566 - DNA, 20 bp, Artificial Sequence
  chemically synthesized
atcctgttggctgaaagcag

SEQ ID NO: 326567 - DNA, 20 bp, Artificial Sequence
  chemically synthesized
gaagaactttccactgcttt

SEQ ID NO: 326568 - DNA, 20 bp, Artificial Sequence
  chemically synthesized
tgttggctgaaagcagtgga

SEQ ID NO: 326569 - DNA, 20 bp, Artificial Sequence
  chemically synthesized
aggagccaatgataaaattg

SEQ ID NO: 326570 - DNA, 20 bp, Artificial Sequence
  chemically synthesized
aagttcttcaattttatcat

SEQ ID NO: 326571 - DNA, 20 bp, Artificial Sequence
  chemically synthesized
attttatcattggctcctaa

SEQ ID NO: 326572 - DNA, 20 bp, Artificial Sequence
  chemically synthesized
ttttatcattggctcctaat

SEQ ID NO: 326573 - DNA, 20 bp, Artificial Sequence
  chemically synthesized
ttatcattggctcctaatag

SEQ ID NO: 326574 - DNA, 20 bp, Artificial Sequence
  chemically synthesized
agcatgattactcctattag

SEQ ID NO: 326575 - DNA, 20 bp, Artificial Sequence
  chemically synthesized
gaagcatgattactcctatt

SEQ ID NO: 326576 - DNA, 20 bp, Artificial Sequence
  chemically synthesized
tgaagcatgattactcctat

SEQ ID NO: 326577 - DNA, 20 bp, Artificial Sequence
  chemically synthesized
taataggagtaatcatgctt

SEQ ID NO: 326578 - DNA, 20 bp, Artificial Sequence
  chemically synthesized
aataggagtaatcatgcttc

SEQ ID NO: 326579 - DNA, 20 bp, Artificial Sequence
  chemically synthesized
ataggagtaatcatgcttca

SEQ ID NO: 326580 - DNA, 20 bp, Artificial Sequence
  chemically synthesized
acacagagatacagaccctg

SEQ ID NO: 326581 - DNA, 20 bp, Artificial Sequence
  chemically synthesized
gtctatgggacacagagata

SEQ ID NO: 326582 - DNA, 20 bp, Artificial Sequence
  chemically synthesized
ttagttgtctatgggacaca

SEQ ID NO: 326583 - DNA, 20 bp, Artificial Sequence
  chemically synthesized
gtctgtatctctgtgtccca

SEQ ID NO: 326584 - DNA, 20 bp, Artificial Sequence
  chemically synthesized
ctttagttgtctatgggaca

SEQ ID NO: 326585 - DNA, 20 bp, Artificial Sequence
  chemically synthesized
caaaagctttagttgtctat

SEQ ID NO: 326586 - DNA, 20 bp, Artificial Sequence
  chemically synthesized
tcaaaagctttagttgtcta

SEQ ID NO: 326587 - DNA, 20 bp, Artificial Sequence
  chemically synthesized
ctgtgtcccatagacaacta

SEQ ID NO: 326588 - DNA, 20 bp, Artificial Sequence
  chemically synthesized
aaccctaagatcaaaagctt

SEQ ID NO: 326589 - DNA, 20 bp, Artificial Sequence
  chemically synthesized
acaactaaagcttttgatct

SEQ ID NO: 326590 - DNA, 20 bp, Artificial Sequence
  chemically synthesized
tctatgaaccctaagatcaa

SEQ ID NO: 326591 - DNA, 20 bp, Artificial Sequence
  chemically synthesized
caactaaagcttttgatctt

SEQ ID NO: 326592 - DNA, 20 bp, Artificial Sequence
  chemically synthesized
aactaaagcttttgatctta

SEQ ID NO: 326593 - DNA, 20 bp, Artificial Sequence
  chemically synthesized
ttctcagttctatgaaccct

SEQ ID NO: 326594 - DNA, 20 bp, Artificial Sequence
  chemically synthesized
gcttttgatcttagggttca

SEQ ID NO: 326595 - DNA, 20 bp, Artificial Sequence
  chemically synthesized
atcttagggttcatagaact

SEQ ID NO: 326596 - DNA, 20 bp, Artificial Sequence
  chemically synthesized
ttagggttcatagaactgag

SEQ ID NO: 326597 - DNA, 20 bp, Artificial Sequence
  chemically synthesized
aagacttactgcgttcttct

SEQ ID NO: 326598 - DNA, 20 bp, Artificial Sequence
  chemically synthesized
tcatagaactgagaagaacg

SEQ ID NO: 326599 - DNA, 20 bp, Artificial Sequence
  chemically synthesized
agaactgagaagaacgcagt

SEQ ID NO: 326600 - DNA, 20 bp, Artificial Sequence
  chemically synthesized
tttatttttctgaaatgcaa

SEQ ID NO: 326601 - DNA, 20 bp, Artificial Sequence
  chemically synthesized
gcagtaagtcttttgcattt

SEQ ID NO: 326602 - DNA, 20 bp, Artificial Sequence
  chemically synthesized
tttgcatttcagaaaaataa

SEQ ID NO: 326603 - DNA, 20 bp, Artificial Sequence
  chemically synthesized
aaagtatgaaaccttttgat

SEQ ID NO: 326604 - DNA, 20 bp, Artificial Sequence
  chemically synthesized
agagatggaaacttatcaaa

SEQ ID NO: 326605 - DNA, 20 bp, Artificial Sequence
  chemically synthesized
aagagatggaaacttatcaa

SEQ ID NO: 326606 - DNA, 20 bp, Artificial Sequence
  chemically synthesized
aatgttagtataacaagaga

SEQ ID NO: 326607 - DNA, 20 bp, Artificial Sequence
  chemically synthesized
aagtaatgttagtataacaa

SEQ ID NO: 326608 - DNA, 20 bp, Artificial Sequence
  chemically synthesized
agaagtaatgttagtataac

SEQ ID NO: 326609 - DNA, 20 bp, Artificial Sequence
  chemically synthesized
gaaaatatgagaagtaatgt

SEQ ID NO: 326610 - DNA, 20 bp, Artificial Sequence
  chemically synthesized
tttttacttgaaaatatgag

SEQ ID NO: 326611 - DNA, 20 bp, Artificial Sequence
  chemically synthesized
ttttttttacttgaaaatat

SEQ ID NO: 326612 - DNA, 20 bp, Artificial Sequence
  chemically synthesized
acattacttctcatattttc

SEQ ID NO: 326613 - DNA, 20 bp, Artificial Sequence
  chemically synthesized
gtaaaaaaaaaactcaaaat

SEQ ID NO: 326614 - DNA, 20 bp, Artificial Sequence
  chemically synthesized
taaaaaaaaaactcaaaatc

SEQ ID NO: 326615 - DNA, 20 bp, Artificial Sequence
  chemically synthesized
aaaaaaaaaactcaaaatca

SEQ ID NO: 326616 - DNA, 20 bp, Artificial Sequence
  chemically synthesized
acttagcccaccctgatttt

SEQ ID NO: 326617 - DNA, 20 bp, Artificial Sequence
  chemically synthesized
aaaaaaactcaaaatcaggg

SEQ ID NO: 326618 - DNA, 20 bp, Artificial Sequence
  chemically synthesized
aaaaaactcaaaatcagggt

SEQ ID NO: 326619 - DNA, 20 bp, Artificial Sequence
  chemically synthesized
actcaaaatcagggtgggct

SEQ ID NO: 326620 - DNA, 20 bp, Artificial Sequence
  chemically synthesized
atcagggtgggctaagtgat

SEQ ID NO: 326621 - DNA, 20 bp, Artificial Sequence
  chemically synthesized
aagtgattgctcttatcact

SEQ ID NO: 326622 - DNA, 20 bp, Artificial Sequence
  chemically synthesized
cagggtgggctaagtgataa

SEQ ID NO: 326623 - DNA, 20 bp, Artificial Sequence
  chemically synthesized
aagagcaatcacttctgatt

SEQ ID NO: 326624 - DNA, 20 bp, Artificial Sequence
  chemically synthesized
tagtatcttcaccaaatcag

SEQ ID NO: 326625 - DNA, 20 bp, Artificial Sequence
  chemically synthesized
ttctagtatcttcaccaaat

SEQ ID NO: 326626 - DNA, 20 bp, Artificial Sequence
  chemically synthesized
caatcacttctgatttggtg

SEQ ID NO: 326627 - DNA, 20 bp, Artificial Sequence
  chemically synthesized
ttctgatttggtgaagatac

SEQ ID NO: 326628 - DNA, 20 bp, Artificial Sequence
  chemically synthesized
tgatttggtgaagatactag

SEQ ID NO: 326629 - DNA, 20 bp, Artificial Sequence
  chemically synthesized
atttggtgaagatactagaa

SEQ ID NO: 326630 - DNA, 20 bp, Artificial Sequence
  chemically synthesized
tttggtgaagatactagaag

SEQ ID NO: 326631 - DNA, 20 bp, Artificial Sequence
  chemically synthesized
catatcctttaatcctcttc

SEQ ID NO: 326632 - DNA, 20 bp, Artificial Sequence
  chemically synthesized
aagatactagaagaggatta

SEQ ID NO: 326633 - DNA, 20 bp, Artificial Sequence
  chemically synthesized
agatactagaagaggattaa

SEQ ID NO: 326634 - DNA, 20 bp, Artificial Sequence
  chemically synthesized
agaggattaaaggatatgta

SEQ ID NO: 326635 - DNA, 20 bp, Artificial Sequence
  chemically synthesized
atatgtgtatattaccaact

SEQ ID NO: 326636 - DNA, 20 bp, Artificial Sequence
  chemically synthesized
tatgtgtatattaccaactg

SEQ ID NO: 326637 - DNA, 20 bp, Artificial Sequence
  chemically synthesized
catgcttccatttcctcagt

SEQ ID NO: 326638 - DNA, 20 bp, Artificial Sequence
  chemically synthesized
tatattaccaactgaggaaa

SEQ ID NO: 326639 - DNA, 20 bp, Artificial Sequence
  chemically synthesized
tgctcatgcttccatttcct

SEQ ID NO: 326640 - DNA, 20 bp, Artificial Sequence
  chemically synthesized
attaccaactgaggaaatgg

SEQ ID NO: 326641 - DNA, 20 bp, Artificial Sequence
  chemically synthesized
aactgaggaaatggaagcat

SEQ ID NO: 326642 - DNA, 20 bp, Artificial Sequence
  chemically synthesized
tgaggaaatggaagcatgag

SEQ ID NO: 326643 - DNA, 20 bp, Artificial Sequence
  chemically synthesized
aaatggaagcatgagcagaa

SEQ ID NO: 326644 - DNA, 20 bp, Artificial Sequence
  chemically synthesized
gcatgagcagaaaagcgaaa

SEQ ID NO: 326645 - DNA, 20 bp, Artificial Sequence
  chemically synthesized
gaaaagcgaaacagaaccct

SEQ ID NO: 326646 - DNA, 20 bp, Artificial Sequence
  chemically synthesized
agcgaaacagaaccctaagt

SEQ ID NO: 326647 - DNA, 20 bp, Artificial Sequence
  chemically synthesized
gcgaaacagaaccctaagtg

SEQ ID NO: 326648 - DNA, 20 bp, Artificial Sequence
  chemically synthesized
ttctatgttcacctcactta

SEQ ID NO: 326649 - DNA, 20 bp, Artificial Sequence
  chemically synthesized
tttctatgttcacctcactt

SEQ ID NO: 326650 - DNA, 20 bp, Artificial Sequence
  chemically synthesized
ctttctatgttcacctcact

SEQ ID NO: 326651 - DNA, 20 bp, Artificial Sequence
  chemically synthesized
aaccctaagtgaggtgaaca

SEQ ID NO: 326652 - DNA, 20 bp, Artificial Sequence
  chemically synthesized
ctaagtgaggtgaacataga

SEQ ID NO: 326653 - DNA, 20 bp, Artificial Sequence
  chemically synthesized
catagaaagtaaacgtccta

SEQ ID NO: 326654 - DNA, 20 bp, Artificial Sequence
  chemically synthesized
ttgtctctgtttatgacttt

SEQ ID NO: 326655 - DNA, 20 bp, Artificial Sequence
  chemically synthesized
tttgtctctgtttatgactt

SEQ ID NO: 326656 - DNA, 20 bp, Artificial Sequence
  chemically synthesized
aaacgtcctaaagtcataaa

SEQ ID NO: 326657 - DNA, 20 bp, Artificial Sequence
  chemically synthesized
acgtcctaaagtcataaaca

SEQ ID NO: 326658 - DNA, 20 bp, Artificial Sequence
  chemically synthesized
cagagacaaaacctcactga

SEQ ID NO: 326659 - DNA, 20 bp, Artificial Sequence
  chemically synthesized
ataagtgaaaactttcagtg

SEQ ID NO: 326660 - DNA, 20 bp, Artificial Sequence
  chemically synthesized
tataagtgaaaactttcagt

SEQ ID NO: 326661 - DNA, 20 bp, Artificial Sequence
  chemically synthesized
atattataagtgaaaacttt

SEQ ID NO: 326662 - DNA, 20 bp, Artificial Sequence
  chemically synthesized
aatctgtttaaaaatattat

SEQ ID NO: 326663 - DNA, 20 bp, Artificial Sequence
  chemically synthesized
tcacttataatatttttaaa

SEQ ID NO: 326664 - DNA, 20 bp, Artificial Sequence
  chemically synthesized
acctacagaaaataaatgga

SEQ ID NO: 326665 - DNA, 20 bp, Artificial Sequence
  chemically synthesized
ctatacctacagaaaataaa

SEQ ID NO: 326666 - DNA, 20 bp, Artificial Sequence
  chemically synthesized
ttctttccatttattttctg

SEQ ID NO: 326667 - DNA, 20 bp, Artificial Sequence
  chemically synthesized
tctttccatttattttctgt

SEQ ID NO: 326668 - DNA, 20 bp, Artificial Sequence
  chemically synthesized
ccatttattttctgtaggta

SEQ ID NO: 326669 - DNA, 20 bp, Artificial Sequence
  chemically synthesized
tataaaatattctataccta

SEQ ID NO: 326670 - DNA, 20 bp, Artificial Sequence
  chemically synthesized
tagtcccattataaataggt

SEQ ID NO: 326671 - DNA, 20 bp, Artificial Sequence
  chemically synthesized
gtggtagtcccattataaat

SEQ ID NO: 326672 - DNA, 20 bp, Artificial Sequence
  chemically synthesized
tataactgacctatttataa

SEQ ID NO: 326673 - DNA, 20 bp, Artificial Sequence
  chemically synthesized
ggtggtagtcccattataaa

SEQ ID NO: 326674 - DNA, 20 bp, Artificial Sequence
  chemically synthesized
ataactgacctatttataat

SEQ ID NO: 326675 - DNA, 20 bp, Artificial Sequence
  chemically synthesized
taaaaatggatatttggtgg

SEQ ID NO: 326676 - DNA, 20 bp, Artificial Sequence
  chemically synthesized
ttttaaaaatggatatttgg

SEQ ID NO: 326677 - DNA, 20 bp, Artificial Sequence
  chemically synthesized
gcattttaaaaatggatatt

SEQ ID NO: 326678 - DNA, 20 bp, Artificial Sequence
  chemically synthesized
tggagagagcattttaaaaa

SEQ ID NO: 326679 - DNA, 20 bp, Artificial Sequence
  chemically synthesized
tttttaaaatgctctctcca

SEQ ID NO: 326680 - DNA, 20 bp, Artificial Sequence
  chemically synthesized
agacattcatgctatggaga

SEQ ID NO: 326681 - DNA, 20 bp, Artificial Sequence
  chemically synthesized
taagacattcatgctatgga

SEQ ID NO: 326682 - DNA, 20 bp, Artificial Sequence
  chemically synthesized
tataagacattcatgctatg

SEQ ID NO: 326683 - DNA, 20 bp, Artificial Sequence
  chemically synthesized
tttataagacattcatgcta

SEQ ID NO: 326684 - DNA, 20 bp, Artificial Sequence
  chemically synthesized
agaaagagactagattttat

SEQ ID NO: 326685 - DNA, 20 bp, Artificial Sequence
  chemically synthesized
catgaatgtcttataaaatc

SEQ ID NO: 326686 - DNA, 20 bp, Artificial Sequence
  chemically synthesized
aacaatattaagaaagagac

SEQ ID NO: 326687 - DNA, 20 bp, Artificial Sequence
  chemically synthesized
gtattaacaatattaagaaa

SEQ ID NO: 326688 - DNA, 20 bp, Artificial Sequence
  chemically synthesized
ctgtattaacaatattaaga

SEQ ID NO: 326689 - DNA, 20 bp, Artificial Sequence
  chemically synthesized
gcttctgtattaacaatatt

SEQ ID NO: 326690 - DNA, 20 bp, Artificial Sequence
  chemically synthesized
ctttcttaatattgttaata

SEQ ID NO: 326691 - DNA, 20 bp, Artificial Sequence
  chemically synthesized
tcttaatattgttaatacag

SEQ ID NO: 326692 - DNA, 20 bp, Artificial Sequence
  chemically synthesized
accttcaatctttgaaggag

SEQ ID NO: 326693 - DNA, 20 bp, Artificial Sequence
  chemically synthesized
atacagaagcttctccttca

SEQ ID NO: 326694 - DNA, 20 bp, Artificial Sequence
  chemically synthesized
aaaaccttcaatctttgaag

SEQ ID NO: 326695 - DNA, 20 bp, Artificial Sequence
  chemically synthesized
aaaaaaccttcaatctttga

SEQ ID NO: 326696 - DNA, 20 bp, Artificial Sequence
  chemically synthesized
aaaaaaaccttcaatctttg

SEQ ID NO: 326697 - DNA, 20 bp, Artificial Sequence
  chemically synthesized
agcttctccttcaaagattg

SEQ ID NO: 326698 - DNA, 20 bp, Artificial Sequence
  chemically synthesized
gcttctccttcaaagattga

SEQ ID NO: 326699 - DNA, 20 bp, Artificial Sequence
  chemically synthesized
tgaaggtttttttctgcttt

SEQ ID NO: 326700 - DNA, 20 bp, Artificial Sequence
  chemically synthesized
tctcaaattatttccaaaag

SEQ ID NO: 326701 - DNA, 20 bp, Artificial Sequence
  chemically synthesized
atttctcaaattatttccaa

SEQ ID NO: 326702 - DNA, 20 bp, Artificial Sequence
  chemically synthesized
tctgcttttggaaataattt

SEQ ID NO: 326703 - DNA, 20 bp, Artificial Sequence
  chemically synthesized
aaataatttgagaaataaca

SEQ ID NO: 326704 - DNA, 20 bp, Artificial Sequence
  chemically synthesized
gagaaataacatagtactca

SEQ ID NO: 326705 - DNA, 20 bp, Artificial Sequence
  chemically synthesized
tcaggttggcaagtggctgt

SEQ ID NO: 326706 - DNA, 20 bp, Artificial Sequence
  chemically synthesized
aacattttcaggttggcaag

SEQ ID NO: 326707 - DNA, 20 bp, Artificial Sequence
  chemically synthesized
ctgaacattttcaggttggc

SEQ ID NO: 326708 - DNA, 20 bp, Artificial Sequence
  chemically synthesized
aatgctgaacattttcaggt

SEQ ID NO: 326709 - DNA, 20 bp, Artificial Sequence
  chemically synthesized
cataaatgctgaacattttc

SEQ ID NO: 326710 - DNA, 20 bp, Artificial Sequence
  chemically synthesized
acataaatgctgaacatttt

SEQ ID NO: 326711 - DNA, 20 bp, Artificial Sequence
  chemically synthesized
cttgccaacctgaaaatgtt

SEQ ID NO: 326712 - DNA, 20 bp, Artificial Sequence
  chemically synthesized
actttatttttgaaaaggtc

SEQ ID NO: 326713 - DNA, 20 bp, Artificial Sequence
  chemically synthesized
tatgtactttatttttgaaa

SEQ ID NO: 326714 - DNA, 20 bp, Artificial Sequence
  chemically synthesized
ttatgtactttatttttgaa

SEQ ID NO: 326715 - DNA, 20 bp, Artificial Sequence
  chemically synthesized
acttgaccttttcaaaaata

SEQ ID NO: 326716 - DNA, 20 bp, Artificial Sequence
  chemically synthesized
gcaaagtagttgaaaagatt

SEQ ID NO: 326717 - DNA, 20 bp, Artificial Sequence
  chemically synthesized
ctcatggcaaagtagttgaa

SEQ ID NO: 326718 - DNA, 20 bp, Artificial Sequence
  chemically synthesized
ctggacatctcatggcaaag

SEQ ID NO: 326719 - DNA, 20 bp, Artificial Sequence
  chemically synthesized
cttttcaactactttgccat

SEQ ID NO: 326720 - DNA, 20 bp, Artificial Sequence
  chemically synthesized
gttctggacatctcatggca

SEQ ID NO: 326721 - DNA, 20 bp, Artificial Sequence
  chemically synthesized
gaaatgttctggacatctca

SEQ ID NO: 326722 - DNA, 20 bp, Artificial Sequence
  chemically synthesized
ctactttgccatgagatgtc

SEQ ID NO: 326723 - DNA, 20 bp, Artificial Sequence
  chemically synthesized
tttactacacagaaatgttc

SEQ ID NO: 326724 - DNA, 20 bp, Artificial Sequence
  chemically synthesized
atgtccagaacatttctgtg

SEQ ID NO: 326725 - DNA, 20 bp, Artificial Sequence
  chemically synthesized
aggaaatctattttactaca

SEQ ID NO: 326726 - DNA, 20 bp, Artificial Sequence
  chemically synthesized
aacatttctgtgtagtaaaa

SEQ ID NO: 326727 - DNA, 20 bp, Artificial Sequence
  chemically synthesized
gtgtagtaaaatagatttcc

SEQ ID NO: 326728 - DNA, 20 bp, Artificial Sequence
  chemically synthesized
tgtagtaaaatagatttcct

SEQ ID NO: 326729 - DNA, 20 bp, Artificial Sequence
  chemically synthesized
cagcaaaatcagagtaacct

SEQ ID NO: 326730 - DNA, 20 bp, Artificial Sequence
  chemically synthesized
tcagcaaaatcagagtaacc

SEQ ID NO: 326731 - DNA, 20 bp, Artificial Sequence
  chemically synthesized
aatctttgtcagcaaaatca

SEQ ID NO: 326732 - DNA, 20 bp, Artificial Sequence
  chemically synthesized
aaaatctttgtcagcaaaat

SEQ ID NO: 326733 - DNA, 20 bp, Artificial Sequence
  chemically synthesized
ttactctgattttgctgaca

SEQ ID NO: 326734 - DNA, 20 bp, Artificial Sequence
  chemically synthesized
agaatacttaaaatctttgt

SEQ ID NO: 326735 - DNA, 20 bp, Artificial Sequence
  chemically synthesized
attttgctgacaaagatttt

SEQ ID NO: 326736 - DNA, 20 bp, Artificial Sequence
  chemically synthesized
ttttaagtattctactactt

SEQ ID NO: 326737 - DNA, 20 bp, Artificial Sequence
  chemically synthesized
gattatgttatcttaagtag

SEQ ID NO: 326738 - DNA, 20 bp, Artificial Sequence
  chemically synthesized
atagattatgttatcttaag

SEQ ID NO: 326739 - DNA, 20 bp, Artificial Sequence
  chemically synthesized
tttatagattatgttatctt

SEQ ID NO: 326740 - DNA, 20 bp, Artificial Sequence
  chemically synthesized
tgaacactaaagtgtgttta

SEQ ID NO: 326741 - DNA, 20 bp, Artificial Sequence
  chemically synthesized
cataatctataaacacactt

SEQ ID NO: 326742 - DNA, 20 bp, Artificial Sequence
  chemically synthesized
tgctatgtctatgaacacta

SEQ ID NO: 326743 - DNA, 20 bp, Artificial Sequence
  chemically synthesized
taaacacactttagtgttca

SEQ ID NO: 326744 - DNA, 20 bp, Artificial Sequence
  chemically synthesized
cactttagtgttcatagaca

SEQ ID NO: 326745 - DNA, 20 bp, Artificial Sequence
  chemically synthesized
tttagtgttcatagacatag

SEQ ID NO: 326746 - DNA, 20 bp, Artificial Sequence
  chemically synthesized
catagacatagcagcacatc

SEQ ID NO: 326747 - DNA, 20 bp, Artificial Sequence
  chemically synthesized
tagacatagcagcacatcaa

SEQ ID NO: 326748 - DNA, 20 bp, Artificial Sequence
  chemically synthesized
ctcttatttattagcgtttt

SEQ ID NO: 326749 - DNA, 20 bp, Artificial Sequence
  chemically synthesized
caccaaaaacgctaataaat

SEQ ID NO: 326750 - DNA, 20 bp, Artificial Sequence
  chemically synthesized
caggcctctctcttatttat

SEQ ID NO: 326751 - DNA, 20 bp, Artificial Sequence
  chemically synthesized
ccaaaaacgctaataaataa

SEQ ID NO: 326752 - DNA, 20 bp, Artificial Sequence
  chemically synthesized
aaaaacgctaataaataaga

SEQ ID NO: 326753 - DNA, 20 bp, Artificial Sequence
  chemically synthesized
aaacgctaataaataagaga

SEQ ID NO: 326754 - DNA, 20 bp, Artificial Sequence
  chemically synthesized
aacgctaataaataagagag

SEQ ID NO: 326755 - DNA, 20 bp, Artificial Sequence
  chemically synthesized
ttaataggatgcataatgtc

SEQ ID NO: 326756 - DNA, 20 bp, Artificial Sequence
  chemically synthesized
cttaataggatgcataatgt

SEQ ID NO: 326757 - DNA, 20 bp, Artificial Sequence
  chemically synthesized
ctgacattatgcatcctatt

SEQ ID NO: 326758 - DNA, 20 bp, Artificial Sequence
  chemically synthesized
tgacattatgcatcctatta

SEQ ID NO: 326759 - DNA, 20 bp, Artificial Sequence
  chemically synthesized
gaaaatcagagatccttaat

SEQ ID NO: 326760 - DNA, 20 bp, Artificial Sequence
  chemically synthesized
ggaaaatcagagatccttaa

SEQ ID NO: 326761 - DNA, 20 bp, Artificial Sequence
  chemically synthesized
atatcttctgtggaaaatca

SEQ ID NO: 326762 - DNA, 20 bp, Artificial Sequence
  chemically synthesized
tgatatcttctgtggaaaat

SEQ ID NO: 326763 - DNA, 20 bp, Artificial Sequence
  chemically synthesized
taaggatctctgattttcca

SEQ ID NO: 326764 - DNA, 20 bp, Artificial Sequence
  chemically synthesized
ggatctctgattttccacag

SEQ ID NO: 326765 - DNA, 20 bp, Artificial Sequence
  chemically synthesized
atggtacttgatatcttctg

SEQ ID NO: 326766 - DNA, 20 bp, Artificial Sequence
  chemically synthesized
gattttccacagaagatatc

SEQ ID NO: 326767 - DNA, 20 bp, Artificial Sequence
  chemically synthesized
agataatttgatgtaatata

SEQ ID NO: 326768 - DNA, 20 bp, Artificial Sequence
  chemically synthesized
atttttaatatacaggtttt

SEQ ID NO: 326769 - DNA, 20 bp, Artificial Sequence
  chemically synthesized
tttaccaatttttaatatac

SEQ ID NO: 326770 - DNA, 20 bp, Artificial Sequence
  chemically synthesized
ctttaccaatttttaatata

SEQ ID NO: 326771 - DNA, 20 bp, Artificial Sequence
  chemically synthesized
aaaacctgtatattaaaaat

SEQ ID NO: 326772 - DNA, 20 bp, Artificial Sequence
  chemically synthesized
ctgtatattaaaaattggta

SEQ ID NO: 326773 - DNA, 20 bp, Artificial Sequence
  chemically synthesized
ggcttatttaagaattaaga

SEQ ID NO: 326774 - DNA, 20 bp, Artificial Sequence
  chemically synthesized
cacaggcttatttaagaatt

SEQ ID NO: 326775 - DNA, 20 bp, Artificial Sequence
  chemically synthesized
ttctttcttaattcttaaat

SEQ ID NO: 326776 - DNA, 20 bp, Artificial Sequence
  chemically synthesized
gtctcttcacaggcttattt

SEQ ID NO: 326777 - DNA, 20 bp, Artificial Sequence
  chemically synthesized
aattcttaaataagcctgtg

SEQ ID NO: 326778 - DNA, 20 bp, Artificial Sequence
  chemically synthesized
ttcttaaataagcctgtgaa

SEQ ID NO: 326779 - DNA, 20 bp, Artificial Sequence
  chemically synthesized
atattataatgtctcttcac

SEQ ID NO: 326780 - DNA, 20 bp, Artificial Sequence
  chemically synthesized
catattataatgtctcttca

SEQ ID NO: 326781 - DNA, 20 bp, Artificial Sequence
  chemically synthesized
gacattataatatgtccttc

SEQ ID NO: 326782 - DNA, 20 bp, Artificial Sequence
  chemically synthesized
cgatgaactggggttctaga

SEQ ID NO: 326783 - DNA, 20 bp, Artificial Sequence
  chemically synthesized
acgatgaactggggttctag

SEQ ID NO: 326784 - DNA, 20 bp, Artificial Sequence
  chemically synthesized
aatatgtccttctagaaccc

SEQ ID NO: 326785 - DNA, 20 bp, Artificial Sequence
  chemically synthesized
cacacgatgaactggggttc

SEQ ID NO: 326786 - DNA, 20 bp, Artificial Sequence
  chemically synthesized
gagatacacacgatgaactg

SEQ ID NO: 326787 - DNA, 20 bp, Artificial Sequence
  chemically synthesized
ggagatacacacgatgaact

SEQ ID NO: 326788 - DNA, 20 bp, Artificial Sequence
  chemically synthesized
aggagatacacacgatgaac

SEQ ID NO: 326789 - DNA, 20 bp, Artificial Sequence
  chemically synthesized
gttcatcgtgtgtatctcct

SEQ ID NO: 326790 - DNA, 20 bp, Artificial Sequence
  chemically synthesized
catcgtgtgtatctcctaag

SEQ ID NO: 326791 - DNA, 20 bp, Artificial Sequence
  chemically synthesized
atcgtgtgtatctcctaagt

SEQ ID NO: 326792 - DNA, 20 bp, Artificial Sequence
  chemically synthesized
agtggatagcacccacttag

SEQ ID NO: 326793 - DNA, 20 bp, Artificial Sequence
  chemically synthesized
acagtggatagcacccactt

SEQ ID NO: 326794 - DNA, 20 bp, Artificial Sequence
  chemically synthesized
cacagtggatagcacccact

SEQ ID NO: 326795 - DNA, 20 bp, Artificial Sequence
  chemically synthesized
agcacagtctacacagtgga

SEQ ID NO: 326796 - DNA, 20 bp, Artificial Sequence
  chemically synthesized
agtgggtgctatccactgtg

SEQ ID NO: 326797 - DNA, 20 bp, Artificial Sequence
  chemically synthesized
ttaaagcacagtctacacag

SEQ ID NO: 326798 - DNA, 20 bp, Artificial Sequence
  chemically synthesized
aatttaaagcacagtctaca

SEQ ID NO: 326799 - DNA, 20 bp, Artificial Sequence
  chemically synthesized
cagcattataatttaaagca

SEQ ID NO: 326800 - DNA, 20 bp, Artificial Sequence
  chemically synthesized
gaagacagcattataattta

SEQ ID NO: 326801 - DNA, 20 bp, Artificial Sequence
  chemically synthesized
aagaatttagatgatgaaga

SEQ ID NO: 326802 - DNA, 20 bp, Artificial Sequence
  chemically synthesized
ctaaaagaatttagatgatg

SEQ ID NO: 326803 - DNA, 20 bp, Artificial Sequence
  chemically synthesized
tggtaaattctaaaagaatt

SEQ ID NO: 326804 - DNA, 20 bp, Artificial Sequence
  chemically synthesized
cttcatcatctaaattcttt

SEQ ID NO: 326805 - DNA, 20 bp, Artificial Sequence
  chemically synthesized
gttctggtggtaaattctaa

SEQ ID NO: 326806 - DNA, 20 bp, Artificial Sequence
  chemically synthesized
attcttttagaatttaccac

SEQ ID NO: 326807 - DNA, 20 bp, Artificial Sequence
  chemically synthesized
tcactatacttcagttctgg

SEQ ID NO: 326808 - DNA, 20 bp, Artificial Sequence
  chemically synthesized
agaatttaccaccagaactg

SEQ ID NO: 326809 - DNA, 20 bp, Artificial Sequence
  chemically synthesized
aattcactatacttcagttc

SEQ ID NO: 326810 - DNA, 20 bp, Artificial Sequence
  chemically synthesized
ttaccaccagaactgaagta

SEQ ID NO: 326811 - DNA, 20 bp, Artificial Sequence
  chemically synthesized
acacttaattcactatactt

SEQ ID NO: 326812 - DNA, 20 bp, Artificial Sequence
  chemically synthesized
gaactgaagtatagtgaatt

SEQ ID NO: 326813 - DNA, 20 bp, Artificial Sequence
  chemically synthesized
attaagtgtttaccatttgt

SEQ ID NO: 326814 - DNA, 20 bp, Artificial Sequence
  chemically synthesized
ttaagtgtttaccatttgtg

SEQ ID NO: 326815 - DNA, 20 bp, Artificial Sequence
  chemically synthesized
taagtgtttaccatttgtga

SEQ ID NO: 326816 - DNA, 20 bp, Artificial Sequence
  chemically synthesized
cttacaccatccctcacaaa

SEQ ID NO: 326817 - DNA, 20 bp, Artificial Sequence
  chemically synthesized
tgtttaccatttgtgaggga

SEQ ID NO: 326818 - DNA, 20 bp, Artificial Sequence
  chemically synthesized
ccatttgtgagggatggtgt

SEQ ID NO: 326819 - DNA, 20 bp, Artificial Sequence
  chemically synthesized
ttaaattagatgatttagtg

SEQ ID NO: 326820 - DNA, 20 bp, Artificial Sequence
  chemically synthesized
ggttaaattagatgatttag

SEQ ID NO: 326821 - DNA, 20 bp, Artificial Sequence
  chemically synthesized
tgaggttaaattagatgatt

SEQ ID NO: 326822 - DNA, 20 bp, Artificial Sequence
  chemically synthesized
cttatgttgtgaggttaaat

SEQ ID NO: 326823 - DNA, 20 bp, Artificial Sequence
  chemically synthesized
taatcatcccttatgttgtg

SEQ ID NO: 326824 - DNA, 20 bp, Artificial Sequence
  chemically synthesized
ctaatttaacctcacaacat

SEQ ID NO: 326825 - DNA, 20 bp, Artificial Sequence
  chemically synthesized
ataatcatcccttatgttgt

SEQ ID NO: 326826 - DNA, 20 bp, Artificial Sequence
  chemically synthesized
taatttaacctcacaacata

SEQ ID NO: 326827 - DNA, 20 bp, Artificial Sequence
  chemically synthesized
aatttaacctcacaacataa

SEQ ID NO: 326828 - DNA, 20 bp, Artificial Sequence
  chemically synthesized
ggtctcctcatagtaaaatg

SEQ ID NO: 326829 - DNA, 20 bp, Artificial Sequence
  chemically synthesized
tattgtctacattttactat

SEQ ID NO: 326830 - DNA, 20 bp, Artificial Sequence
  chemically synthesized
attgtctacattttactatg

SEQ ID NO: 326831 - DNA, 20 bp, Artificial Sequence
  chemically synthesized
tgtctacattttactatgag

SEQ ID NO: 326832 - DNA, 20 bp, Artificial Sequence
  chemically synthesized
ttatgaatcaggtctcctca

SEQ ID NO: 326833 - DNA, 20 bp, Artificial Sequence
  chemically synthesized
gtttctaacctttatgaatc

SEQ ID NO: 326834 - DNA, 20 bp, Artificial Sequence
  chemically synthesized
atgaggagacctgattcata

SEQ ID NO: 326835 - DNA, 20 bp, Artificial Sequence
  chemically synthesized
agtttctaacctttatgaat

SEQ ID NO: 326836 - DNA, 20 bp, Artificial Sequence
  chemically synthesized
tgaggagacctgattcataa

SEQ ID NO: 326837 - DNA, 20 bp, Artificial Sequence
  chemically synthesized
gagacctgattcataaaggt

SEQ ID NO: 326838 - DNA, 20 bp, Artificial Sequence
  chemically synthesized
taaaggttagaaacttgccc

SEQ ID NO: 326839 - DNA, 20 bp, Artificial Sequence
  chemically synthesized
aaaggttagaaacttgccca

SEQ ID NO: 326840 - DNA, 20 bp, Artificial Sequence
  chemically synthesized
ttagctcttcgaccttgggc

SEQ ID NO: 326841 - DNA, 20 bp, Artificial Sequence
  chemically synthesized
tagaaacttgcccaaggtcg

SEQ ID NO: 326842 - DNA, 20 bp, Artificial Sequence
  chemically synthesized
tttattagctcttcgacctt

SEQ ID NO: 326843 - DNA, 20 bp, Artificial Sequence
  chemically synthesized
ttttattagctcttcgacct

SEQ ID NO: 326844 - DNA, 20 bp, Artificial Sequence
  chemically synthesized
gaaacttgcccaaggtcgaa

SEQ ID NO: 326845 - DNA, 20 bp, Artificial Sequence
  chemically synthesized
aaggtcgaagagctaataaa

SEQ ID NO: 326846 - DNA, 20 bp, Artificial Sequence
  chemically synthesized
ttcccatctctgctttttat

SEQ ID NO: 326847 - DNA, 20 bp, Artificial Sequence
  chemically synthesized
gtcgaagagctaataaaaag

SEQ ID NO: 326848 - DNA, 20 bp, Artificial Sequence
  chemically synthesized
cgaagagctaataaaaagca

SEQ ID NO: 326849 - DNA, 20 bp, Artificial Sequence
  chemically synthesized
gagctaataaaaagcagaga

SEQ ID NO: 326850 - DNA, 20 bp, Artificial Sequence
  chemically synthesized
agctaataaaaagcagagat

SEQ ID NO: 326851 - DNA, 20 bp, Artificial Sequence
  chemically synthesized
gcagagatgggaactgaatt

SEQ ID NO: 326852 - DNA, 20 bp, Artificial Sequence
  chemically synthesized
cgtgagacagatactgaatt

SEQ ID NO: 326853 - DNA, 20 bp, Artificial Sequence
  chemically synthesized
atattcaggatttcgtgaga

SEQ ID NO: 326854 - DNA, 20 bp, Artificial Sequence
  chemically synthesized
gttaatattcaggatttcgt

SEQ ID NO: 326855 - DNA, 20 bp, Artificial Sequence
  chemically synthesized
ctggcaacaagttaatattc

SEQ ID NO: 326856 - DNA, 20 bp, Artificial Sequence
  chemically synthesized
tctggcaacaagttaatatt

SEQ ID NO: 326857 - DNA, 20 bp, Artificial Sequence
  chemically synthesized
cctgaatattaacttgttgc

SEQ ID NO: 326858 - DNA, 20 bp, Artificial Sequence
  chemically synthesized
ttacaaaaaagtctggcaac

SEQ ID NO: 326859 - DNA, 20 bp, Artificial Sequence
  chemically synthesized
tgagttattacaaaaaagtc

SEQ ID NO: 326860 - DNA, 20 bp, Artificial Sequence
  chemically synthesized
ccccttgagttattacaaaa

SEQ ID NO: 326861 - DNA, 20 bp, Artificial Sequence
  chemically synthesized
agacttttttgtaataactc

SEQ ID NO: 326862 - DNA, 20 bp, Artificial Sequence
  chemically synthesized
gacttttttgtaataactca

SEQ ID NO: 326863 - DNA, 20 bp, Artificial Sequence
  chemically synthesized
acttttttgtaataactcaa

SEQ ID NO: 326864 - DNA, 20 bp, Artificial Sequence
  chemically synthesized
cttttttgtaataactcaag

SEQ ID NO: 326865 - DNA, 20 bp, Artificial Sequence
  chemically synthesized
ttttgtaataactcaagggg

SEQ ID NO: 326866 - DNA, 20 bp, Artificial Sequence
  chemically synthesized
gggaaatgtttcttcccctt

SEQ ID NO: 326867 - DNA, 20 bp, Artificial Sequence
  chemically synthesized
caaggggaagaaacatttcc

SEQ ID NO: 326868 - DNA, 20 bp, Artificial Sequence
  chemically synthesized
aggggaagaaacatttccca

SEQ ID NO: 326869 - DNA, 20 bp, Artificial Sequence
  chemically synthesized
gaagaaacatttcccagaga

SEQ ID NO: 326870 - DNA, 20 bp, Artificial Sequence
  chemically synthesized
ttataaatctagctatctct

SEQ ID NO: 326871 - DNA, 20 bp, Artificial Sequence
  chemically synthesized
tttataaatctagctatctc

SEQ ID NO: 326872 - DNA, 20 bp, Artificial Sequence
  chemically synthesized
aaacatttcccagagatagc

SEQ ID NO: 326873 - DNA, 20 bp, Artificial Sequence
  chemically synthesized
taaattaaattttataaatc

SEQ ID NO: 326874 - DNA, 20 bp, Artificial Sequence
  chemically synthesized
tatgtgaatgtgatcattct

SEQ ID NO: 326875 - DNA, 20 bp, Artificial Sequence
  chemically synthesized
ctgtgagtgtatgagagact

SEQ ID NO: 326876 - DNA, 20 bp, Artificial Sequence
  chemically synthesized
acaattctgtgagtgtatga

SEQ ID NO: 326877 - DNA, 20 bp, Artificial Sequence
  chemically synthesized
ccacaattctgtgagtgtat

SEQ ID NO: 326878 - DNA, 20 bp, Artificial Sequence
  chemically synthesized
ctaagtctctcatacactca

SEQ ID NO: 326879 - DNA, 20 bp, Artificial Sequence
  chemically synthesized
aaatctatccacaattctgt

SEQ ID NO: 326880 - DNA, 20 bp, Artificial Sequence
  chemically synthesized
ctcatacactcacagaattg

SEQ ID NO: 326881 - DNA, 20 bp, Artificial Sequence
  chemically synthesized
tacactcacagaattgtgga

SEQ ID NO: 326882 - DNA, 20 bp, Artificial Sequence
  chemically synthesized
gaaaaagactggatgaatca

SEQ ID NO: 326883 - DNA, 20 bp, Artificial Sequence
  chemically synthesized
atagatttctttgattcatc

SEQ ID NO: 326884 - DNA, 20 bp, Artificial Sequence
  chemically synthesized
tttctaagggtgaaaaagac

SEQ ID NO: 326885 - DNA, 20 bp, Artificial Sequence
  chemically synthesized
agaaatttctaagggtgaaa

SEQ ID NO: 326886 - DNA, 20 bp, Artificial Sequence
  chemically synthesized
catccagtctttttcaccct

SEQ ID NO: 326887 - DNA, 20 bp, Artificial Sequence
  chemically synthesized
ttggtcacagaaatttctaa

SEQ ID NO: 326888 - DNA, 20 bp, Artificial Sequence
  chemically synthesized
attggtcacagaaatttcta

SEQ ID NO: 326889 - DNA, 20 bp, Artificial Sequence
  chemically synthesized
aattggtcacagaaatttct

SEQ ID NO: 326890 - DNA, 20 bp, Artificial Sequence
  chemically synthesized
taaacatataaaattggtca

SEQ ID NO: 326891 - DNA, 20 bp, Artificial Sequence
  chemically synthesized
atattataaacatataaaat

SEQ ID NO: 326892 - DNA, 20 bp, Artificial Sequence
  chemically synthesized
gtttataatatgattgtata

SEQ ID NO: 326893 - DNA, 20 bp, Artificial Sequence
  chemically synthesized
tataatttttgcattctaaa

SEQ ID NO: 326894 - DNA, 20 bp, Artificial Sequence
  chemically synthesized
atttttgcattctaaacaga

SEQ ID NO: 326895 - DNA, 20 bp, Artificial Sequence
  chemically synthesized
atatagacaagctatctgtt

SEQ ID NO: 326896 - DNA, 20 bp, Artificial Sequence
  chemically synthesized
ttttttatttttatatagac

SEQ ID NO: 326897 - DNA, 20 bp, Artificial Sequence
  chemically synthesized
gttcattttttatttttata

SEQ ID NO: 326898 - DNA, 20 bp, Artificial Sequence
  chemically synthesized
aataaaaaatgaactaccat

SEQ ID NO: 326899 - DNA, 20 bp, Artificial Sequence
  chemically synthesized
tgtgctaatgaaacttatgg

SEQ ID NO: 326900 - DNA, 20 bp, Artificial Sequence
  chemically synthesized
cattgtgctaatgaaactta

SEQ ID NO: 326901 - DNA, 20 bp, Artificial Sequence
  chemically synthesized
tgaactaccataagtttcat

SEQ ID NO: 326902 - DNA, 20 bp, Artificial Sequence
  chemically synthesized
taaaatgtgagtaaatttta

SEQ ID NO: 326903 - DNA, 20 bp, Artificial Sequence
  chemically synthesized
ttaaaatgtgagtaaatttt

SEQ ID NO: 326904 - DNA, 20 bp, Artificial Sequence
  chemically synthesized
tgatttaaaatttaaaatgt

SEQ ID NO: 326905 - DNA, 20 bp, Artificial Sequence
  chemically synthesized
tcacattttaaattttaaat

SEQ ID NO: 326906 - DNA, 20 bp, Artificial Sequence
  chemically synthesized
ttaaatcagtacataaaata

SEQ ID NO: 326907 - DNA, 20 bp, Artificial Sequence
  chemically synthesized
tatagatacaatgaaatatg

SEQ ID NO: 326908 - DNA, 20 bp, Artificial Sequence
  chemically synthesized
aaatatgcagcaaatattac

SEQ ID NO: 326909 - DNA, 20 bp, Artificial Sequence
  chemically synthesized
aatatgcagcaaatattact

SEQ ID NO: 326910 - DNA, 20 bp, Artificial Sequence
  chemically synthesized
attatataccaacaaaatcc

SEQ ID NO: 326911 - DNA, 20 bp, Artificial Sequence
  chemically synthesized
aaatattactgggattttgt

SEQ ID NO: 326912 - DNA, 20 bp, Artificial Sequence
  chemically synthesized
tttaagttttgacaggtttc

SEQ ID NO: 326913 - DNA, 20 bp, Artificial Sequence
  chemically synthesized
ttttaagttttgacaggttt

SEQ ID NO: 326914 - DNA, 20 bp, Artificial Sequence
  chemically synthesized
ggtgtgttttaagttttgac

SEQ ID NO: 326915 - DNA, 20 bp, Artificial Sequence
  chemically synthesized
gggtgtgttttaagttttga

SEQ ID NO: 326916 - DNA, 20 bp, Artificial Sequence
  chemically synthesized
tgtaccaatgggtgtgtttt

SEQ ID NO: 326917 - DNA, 20 bp, Artificial Sequence
  chemically synthesized
aaaacttaaaacacacccat

SEQ ID NO: 326918 - DNA, 20 bp, Artificial Sequence
  chemically synthesized
ataagttgaaatgtaccaat

SEQ ID NO: 326919 - DNA, 20 bp, Artificial Sequence
  chemically synthesized
aataagttgaaatgtaccaa

SEQ ID NO: 326920 - DNA, 20 bp, Artificial Sequence
  chemically synthesized
ctttccaaagtagaacaaat

SEQ ID NO: 326921 - DNA, 20 bp, Artificial Sequence
  chemically synthesized
tcaacttatttgttctactt

SEQ ID NO: 326922 - DNA, 20 bp, Artificial Sequence
  chemically synthesized
cttatttgttctactttgga

SEQ ID NO: 326923 - DNA, 20 bp, Artificial Sequence
  chemically synthesized
tccatttctgctttccaaag

SEQ ID NO: 326924 - DNA, 20 bp, Artificial Sequence
  chemically synthesized
atttgttctactttggaaag

SEQ ID NO: 326925 - DNA, 20 bp, Artificial Sequence
  chemically synthesized
ctttccatttctgctttcca

SEQ ID NO: 326926 - DNA, 20 bp, Artificial Sequence
  chemically synthesized
tctactttggaaagcagaaa

SEQ ID NO: 326927 - DNA, 20 bp, Artificial Sequence
  chemically synthesized
ctttggaaagcagaaatgga

SEQ ID NO: 326928 - DNA, 20 bp, Artificial Sequence
  chemically synthesized
aaagcagaaatggaaagaaa

SEQ ID NO: 326929 - DNA, 20 bp, Artificial Sequence
  chemically synthesized
atggaaagaaacagaataaa

SEQ ID NO: 326930 - DNA, 20 bp, Artificial Sequence
  chemically synthesized
tatctcactatgtgacaaaa

SEQ ID NO: 326931 - DNA, 20 bp, Artificial Sequence
  chemically synthesized
ttatctcactatgtgacaaa

SEQ ID NO: 326932 - DNA, 20 bp, Artificial Sequence
  chemically synthesized
agaaatacctttttgtcaca

SEQ ID NO: 326933 - DNA, 20 bp, Artificial Sequence
  chemically synthesized
atacctttttgtcacatagt

SEQ ID NO: 326934 - DNA, 20 bp, Artificial Sequence
  chemically synthesized
agaaactttgtttttaaaca

SEQ ID NO: 326935 - DNA, 20 bp, Artificial Sequence
  chemically synthesized
caatactatgtttaaaaaca

SEQ ID NO: 326936 - DNA, 20 bp, Artificial Sequence
  chemically synthesized
gaggctattttgaaaatata

SEQ ID NO: 326937 - DNA, 20 bp, Artificial Sequence
  chemically synthesized
gtttctttatattttcaaaa

SEQ ID NO: 326938 - DNA, 20 bp, Artificial Sequence
  chemically synthesized
tatattttcaaaatagcctc

SEQ ID NO: 326939 - DNA, 20 bp, Artificial Sequence
  chemically synthesized
attttcaaaatagcctctag

SEQ ID NO: 326940 - DNA, 20 bp, Artificial Sequence
  chemically synthesized
atggtagctgattccactag

SEQ ID NO: 326941 - DNA, 20 bp, Artificial Sequence
  chemically synthesized
tatggtagctgattccacta

SEQ ID NO: 326942 - DNA, 20 bp, Artificial Sequence
  chemically synthesized
aaaatagcctctagtggaat

SEQ ID NO: 326943 - DNA, 20 bp, Artificial Sequence
  chemically synthesized
aatatggtagctgattccac

SEQ ID NO: 326944 - DNA, 20 bp, Artificial Sequence
  chemically synthesized
tatgcaaatcaagaatatgg

SEQ ID NO: 326945 - DNA, 20 bp, Artificial Sequence
  chemically synthesized
tattatgcaaatcaagaata

SEQ ID NO: 326946 - DNA, 20 bp, Artificial Sequence
  chemically synthesized
ttataagtattatgcaaatc

SEQ ID NO: 326947 - DNA, 20 bp, Artificial Sequence
  chemically synthesized
tgagtttgtaggaaatttat

SEQ ID NO: 326948 - DNA, 20 bp, Artificial Sequence
  chemically synthesized
ttataaatttcctacaaact

SEQ ID NO: 326949 - DNA, 20 bp, Artificial Sequence
  chemically synthesized
agaatatgtactgagtttgt

SEQ ID NO: 326950 - DNA, 20 bp, Artificial Sequence
  chemically synthesized
tagaatatgtactgagtttg

SEQ ID NO: 326951 - DNA, 20 bp, Artificial Sequence
  chemically synthesized
ttccaaatagaatatgtact

SEQ ID NO: 326952 - DNA, 20 bp, Artificial Sequence
  chemically synthesized
aactcagtacatattctatt

SEQ ID NO: 326953 - DNA, 20 bp, Artificial Sequence
  chemically synthesized
tcagtacatattctatttgg

SEQ ID NO: 326954 - DNA, 20 bp, Artificial Sequence
  chemically synthesized
tatatataaaaacttccaaa

SEQ ID NO: 326955 - DNA, 20 bp, Artificial Sequence
  chemically synthesized
tatttggaagtttttatata

SEQ ID NO: 326956 - DNA, 20 bp, Artificial Sequence
  chemically synthesized
atttggaagtttttatatat

SEQ ID NO: 326957 - DNA, 20 bp, Artificial Sequence
  chemically synthesized
gacctttttagtgtaatata

SEQ ID NO: 326958 - DNA, 20 bp, Artificial Sequence
  chemically synthesized
aggctttatattacactaaa

SEQ ID NO: 326959 - DNA, 20 bp, Artificial Sequence
  chemically synthesized
ggctttatattacactaaaa

SEQ ID NO: 326960 - DNA, 20 bp, Artificial Sequence
  chemically synthesized
caataatttgatgacctttt

SEQ ID NO: 326961 - DNA, 20 bp, Artificial Sequence
  chemically synthesized
catattttaatttatggacg

SEQ ID NO: 326962 - DNA, 20 bp, Artificial Sequence
  chemically synthesized
gtttaacatattttaattta

SEQ ID NO: 326963 - DNA, 20 bp, Artificial Sequence
  chemically synthesized
ctgccgtactttcatatttg

SEQ ID NO: 326964 - DNA, 20 bp, Artificial Sequence
  chemically synthesized
atgttaaactccaaatatga

SEQ ID NO: 326965 - DNA, 20 bp, Artificial Sequence
  chemically synthesized
agctgccgtactttcatatt

SEQ ID NO: 326966 - DNA, 20 bp, Artificial Sequence
  chemically synthesized
aaactccaaatatgaaagta

SEQ ID NO: 326967 - DNA, 20 bp, Artificial Sequence
  chemically synthesized
ctccaaatatgaaagtacgg

SEQ ID NO: 326968 - DNA, 20 bp, Artificial Sequence
  chemically synthesized
tttatgttaaggtttttgaa

SEQ ID NO: 326969 - DNA, 20 bp, Artificial Sequence
  chemically synthesized
cctttatgttaaggtttttg

SEQ ID NO: 326970 - DNA, 20 bp, Artificial Sequence
  chemically synthesized
tcttcaaaaaccttaacata

SEQ ID NO: 326971 - DNA, 20 bp, Artificial Sequence
  chemically synthesized
tttaatttacctttatgtta

SEQ ID NO: 326972 - DNA, 20 bp, Artificial Sequence
  chemically synthesized
cttcaaaaaccttaacataa

SEQ ID NO: 326973 - DNA, 20 bp, Artificial Sequence
  chemically synthesized
ttttaatttacctttatgtt

SEQ ID NO: 326974 - DNA, 20 bp, Artificial Sequence
  chemically synthesized
aaattaaaattatgcaaatt

SEQ ID NO: 326975 - DNA, 20 bp, Artificial Sequence
  chemically synthesized
ttaaaattatgcaaattgag

SEQ ID NO: 326976 - DNA, 20 bp, Artificial Sequence
  chemically synthesized
aattgagtagaaaactcatg

SEQ ID NO: 326977 - DNA, 20 bp, Artificial Sequence
  chemically synthesized
cagatttacagtttctgcat

SEQ ID NO: 326978 - DNA, 20 bp, Artificial Sequence
  chemically synthesized
tcatgcagaaactgtaaatc

SEQ ID NO: 326979 - DNA, 20 bp, Artificial Sequence
  chemically synthesized
gcttccctattccagattta

SEQ ID NO: 326980 - DNA, 20 bp, Artificial Sequence
  chemically synthesized
cagaaactgtaaatctggaa

SEQ ID NO: 326981 - DNA, 20 bp, Artificial Sequence
  chemically synthesized
agaaactgtaaatctggaat

SEQ ID NO: 326982 - DNA, 20 bp, Artificial Sequence
  chemically synthesized
gaaactgtaaatctggaata

SEQ ID NO: 326983 - DNA, 20 bp, Artificial Sequence
  chemically synthesized
cttaaatggcttccctattc

SEQ ID NO: 326984 - DNA, 20 bp, Artificial Sequence
  chemically synthesized
actgtaaatctggaataggg

SEQ ID NO: 326985 - DNA, 20 bp, Artificial Sequence
  chemically synthesized
ctggaatagggaagccattt

SEQ ID NO: 326986 - DNA, 20 bp, Artificial Sequence
  chemically synthesized
tggaatagggaagccattta

SEQ ID NO: 326987 - DNA, 20 bp, Artificial Sequence
  chemically synthesized
gatttctcttttaccttaaa

SEQ ID NO: 326988 - DNA, 20 bp, Artificial Sequence
  chemically synthesized
agggaagccatttaaggtaa

SEQ ID NO: 326989 - DNA, 20 bp, Artificial Sequence
  chemically synthesized
ggaagccatttaaggtaaaa

SEQ ID NO: 326990 - DNA, 20 bp, Artificial Sequence
  chemically synthesized
ggtaaaagagaaatcgtcac

SEQ ID NO: 326991 - DNA, 20 bp, Artificial Sequence
  chemically synthesized
gaaatcgtcacaagtatgct

SEQ ID NO: 326992 - DNA, 20 bp, Artificial Sequence
  chemically synthesized
tttctaaatcaggaaattct

SEQ ID NO: 326993 - DNA, 20 bp, Artificial Sequence
  chemically synthesized
atgcttagaatttcctgatt

SEQ ID NO: 326994 - DNA, 20 bp, Artificial Sequence
  chemically synthesized
tgtcccactatttctaaatc

SEQ ID NO: 326995 - DNA, 20 bp, Artificial Sequence
  chemically synthesized
ttgtcccactatttctaaat

SEQ ID NO: 326996 - DNA, 20 bp, Artificial Sequence
  chemically synthesized
agaatttcctgatttagaaa

SEQ ID NO: 326997 - DNA, 20 bp, Artificial Sequence
  chemically synthesized
atttcctgatttagaaatag

SEQ ID NO: 326998 - DNA, 20 bp, Artificial Sequence
  chemically synthesized
tttcctgatttagaaatagt

SEQ ID NO: 326999 - DNA, 20 bp, Artificial Sequence
  chemically synthesized
aaaatacaatcctacctatc

SEQ ID NO: 327000 - DNA, 20 bp, Artificial Sequence
  chemically synthesized
atctgaaaagcttgataggt

SEQ ID NO: 327001 - DNA, 20 bp, Artificial Sequence
  chemically synthesized
tatctgaaaagcttgatagg

SEQ ID NO: 327002 - DNA, 20 bp, Artificial Sequence
  chemically synthesized
tattatctgaaaagcttgat

SEQ ID NO: 327003 - DNA, 20 bp, Artificial Sequence
  chemically synthesized
ttattatctgaaaagcttga

SEQ ID NO: 327004 - DNA, 20 bp, Artificial Sequence
  chemically synthesized
atcctacctatcaagctttt

SEQ ID NO: 327005 - DNA, 20 bp, Artificial Sequence
  chemically synthesized
gcacaatgttattatctgaa

SEQ ID NO: 327006 - DNA, 20 bp, Artificial Sequence
  chemically synthesized
tcagataataacattgtgcc

SEQ ID NO: 327007 - DNA, 20 bp, Artificial Sequence
  chemically synthesized
cagataataacattgtgcct

SEQ ID NO: 327008 - DNA, 20 bp, Artificial Sequence
  chemically synthesized
atgcatgtactttcaggcct

SEQ ID NO: 327009 - DNA, 20 bp, Artificial Sequence
  chemically synthesized
aacattgtgcctaggcctga

SEQ ID NO: 327010 - DNA, 20 bp, Artificial Sequence
  chemically synthesized
catgcatgtactttcaggcc

SEQ ID NO: 327011 - DNA, 20 bp, Artificial Sequence
  chemically synthesized
aatgtcatgcatgtactttc

SEQ ID NO: 327012 - DNA, 20 bp, Artificial Sequence
  chemically synthesized
aaatgtcatgcatgtacttt

SEQ ID NO: 327013 - DNA, 20 bp, Artificial Sequence
  chemically synthesized
catgcatgacatttgtttga

SEQ ID NO: 327014 - DNA, 20 bp, Artificial Sequence
  chemically synthesized
atgcatgacatttgtttgaa

SEQ ID NO: 327015 - DNA, 20 bp, Artificial Sequence
  chemically synthesized
atttgtaaaagaagtttaca

SEQ ID NO: 327016 - DNA, 20 bp, Artificial Sequence
  chemically synthesized
aatttgtaaaagaagtttac

SEQ ID NO: 327017 - DNA, 20 bp, Artificial Sequence
  chemically synthesized
tgttaataaatttgtaaaag

SEQ ID NO: 327018 - DNA, 20 bp, Artificial Sequence
  chemically synthesized
ccgtgttaataaatttgtaa

SEQ ID NO: 327019 - DNA, 20 bp, Artificial Sequence
  chemically synthesized
cttttacaaatttattaaca

SEQ ID NO: 327020 - DNA, 20 bp, Artificial Sequence
  chemically synthesized
ttttacaaatttattaacac

SEQ ID NO: 327021 - DNA, 20 bp, Artificial Sequence
  chemically synthesized
ttaacacgggttgttccgta

SEQ ID NO: 327022 - DNA, 20 bp, Artificial Sequence
  chemically synthesized
cacgggttgttccgtatagt

SEQ ID NO: 327023 - DNA, 20 bp, Artificial Sequence
  chemically synthesized
agcaatgttggccaactata

SEQ ID NO: 327024 - DNA, 20 bp, Artificial Sequence
  chemically synthesized
gtggaagaaataagcaatgt

SEQ ID NO: 327025 - DNA, 20 bp, Artificial Sequence
  chemically synthesized
tgtagggcagtggaagaaat

SEQ ID NO: 327026 - DNA, 20 bp, Artificial Sequence
  chemically synthesized
tggttgttgtagggcagtgg

SEQ ID NO: 327027 - DNA, 20 bp, Artificial Sequence
  chemically synthesized
ttatggttgttgtagggcag

SEQ ID NO: 327028 - DNA, 20 bp, Artificial Sequence
  chemically synthesized
agtttatggttgttgtaggg

SEQ ID NO: 327029 - DNA, 20 bp, Artificial Sequence
  chemically synthesized
gggagtttatggttgttgta

SEQ ID NO: 327030 - DNA, 20 bp, Artificial Sequence
  chemically synthesized
tgggagtttatggttgttgt

SEQ ID NO: 327031 - DNA, 20 bp, Artificial Sequence
  chemically synthesized
ttgggagtttatggttgttg

SEQ ID NO: 327032 - DNA, 20 bp, Artificial Sequence
  chemically synthesized
ccagaataattgggagttta

SEQ ID NO: 327033 - DNA, 20 bp, Artificial Sequence
  chemically synthesized
actactcccagaataattgg

SEQ ID NO: 327034 - DNA, 20 bp, Artificial Sequence
  chemically synthesized
aaactactcccagaataatt

SEQ ID NO: 327035 - DNA, 20 bp, Artificial Sequence
  chemically synthesized
ccataaactcccaattattc

SEQ ID NO: 327036 - DNA, 20 bp, Artificial Sequence
  chemically synthesized
taaactactcccagaataat

SEQ ID NO: 327037 - DNA, 20 bp, Artificial Sequence
  chemically synthesized
cataaactcccaattattct

SEQ ID NO: 327038 - DNA, 20 bp, Artificial Sequence
  chemically synthesized
taaactcccaattattctgg

SEQ ID NO: 327039 - DNA, 20 bp, Artificial Sequence
  chemically synthesized
actcccaattattctgggag

SEQ ID NO: 327040 - DNA, 20 bp, Artificial Sequence
  chemically synthesized
gtactctgataaactactcc

SEQ ID NO: 327041 - DNA, 20 bp, Artificial Sequence
  chemically synthesized
ttattctgggagtagtttat

SEQ ID NO: 327042 - DNA, 20 bp, Artificial Sequence
  chemically synthesized
attctgggagtagtttatca

SEQ ID NO: 327043 - DNA, 20 bp, Artificial Sequence
  chemically synthesized
gggagtagtttatcagagta

SEQ ID NO: 327044 - DNA, 20 bp, Artificial Sequence
  chemically synthesized
ttatcagagtacagattatc

SEQ ID NO: 327045 - DNA, 20 bp, Artificial Sequence
  chemically synthesized
atcagagtacagattatctg

SEQ ID NO: 327046 - DNA, 20 bp, Artificial Sequence
  chemically synthesized
tcagagtacagattatctgg

SEQ ID NO: 327047 - DNA, 20 bp, Artificial Sequence
  chemically synthesized
tgaaagagaaataacacctc

SEQ ID NO: 327048 - DNA, 20 bp, Artificial Sequence
  chemically synthesized
ggtgttatttctctttcatt

SEQ ID NO: 327049 - DNA, 20 bp, Artificial Sequence
  chemically synthesized
ctgtgaaaggccaaatgaaa

SEQ ID NO: 327050 - DNA, 20 bp, Artificial Sequence
  chemically synthesized
agctgtgaaaggccaaatga

SEQ ID NO: 327051 - DNA, 20 bp, Artificial Sequence
  chemically synthesized
ctctttcatttggcctttca

SEQ ID NO: 327052 - DNA, 20 bp, Artificial Sequence
  chemically synthesized
aggtactaatgagctgtgaa

SEQ ID NO: 327053 - DNA, 20 bp, Artificial Sequence
  chemically synthesized
gaggtactaatgagctgtga

SEQ ID NO: 327054 - DNA, 20 bp, Artificial Sequence
  chemically synthesized
tttggcctttcacagctcat

SEQ ID NO: 327055 - DNA, 20 bp, Artificial Sequence
  chemically synthesized
tttcttgttgaggtactaat

SEQ ID NO: 327056 - DNA, 20 bp, Artificial Sequence
  chemically synthesized
cagctcattagtacctcaac

SEQ ID NO: 327057 - DNA, 20 bp, Artificial Sequence
  chemically synthesized
ttgccttaactttcttgttg

SEQ ID NO: 327058 - DNA, 20 bp, Artificial Sequence
  chemically synthesized
tcattagtacctcaacaaga

SEQ ID NO: 327059 - DNA, 20 bp, Artificial Sequence
  chemically synthesized
tttgccttaactttcttgtt

SEQ ID NO: 327060 - DNA, 20 bp, Artificial Sequence
  chemically synthesized
agtacctcaacaagaaagtt

SEQ ID NO: 327061 - DNA, 20 bp, Artificial Sequence
  chemically synthesized
gtacctcaacaagaaagtta

SEQ ID NO: 327062 - DNA, 20 bp, Artificial Sequence
  chemically synthesized
tcaacaagaaagttaaggca

SEQ ID NO: 327063 - DNA, 20 bp, Artificial Sequence
  chemically synthesized
caacaagaaagttaaggcaa

SEQ ID NO: 327064 - DNA, 20 bp, Artificial Sequence
  chemically synthesized
aagaaagttaaggcaaagga

SEQ ID NO: 327065 - DNA, 20 bp, Artificial Sequence
  chemically synthesized
aagttaaggcaaaggatgga

SEQ ID NO: 327066 - DNA, 20 bp, Artificial Sequence
  chemically synthesized
agttaaggcaaaggatggaa

SEQ ID NO: 327067 - DNA, 20 bp, Artificial Sequence
  chemically synthesized
ggcaaaggatggaaaggctg

SEQ ID NO: 327068 - DNA, 20 bp, Artificial Sequence
  chemically synthesized
ttatttgtttagaaattctg

SEQ ID NO: 327069 - DNA, 20 bp, Artificial Sequence
  chemically synthesized
aaggagcaaatttatttgtt

SEQ ID NO: 327070 - DNA, 20 bp, Artificial Sequence
  chemically synthesized
caaataaatttgctccttgt

SEQ ID NO: 327071 - DNA, 20 bp, Artificial Sequence
  chemically synthesized
ctgtatatgctgctgacaag

SEQ ID NO: 327072 - DNA, 20 bp, Artificial Sequence
  chemically synthesized
ataaatttgctccttgtcag

SEQ ID NO: 327073 - DNA, 20 bp, Artificial Sequence
  chemically synthesized
ttctgtatatgctgctgaca

SEQ ID NO: 327074 - DNA, 20 bp, Artificial Sequence
  chemically synthesized
gttctgtatatgctgctgac

SEQ ID NO: 327075 - DNA, 20 bp, Artificial Sequence
  chemically synthesized
ctccttgtcagcagcatata

SEQ ID NO: 327076 - DNA, 20 bp, Artificial Sequence
  chemically synthesized
tgtcagcagcatatacagaa

SEQ ID NO: 327077 - DNA, 20 bp, Artificial Sequence
  chemically synthesized
agcatatacagaacagcatt

SEQ ID NO: 327078 - DNA, 20 bp, Artificial Sequence
  chemically synthesized
catatacagaacagcattta

SEQ ID NO: 327079 - DNA, 20 bp, Artificial Sequence
  chemically synthesized
atcacacaaaataactaaaa

SEQ ID NO: 327080 - DNA, 20 bp, Artificial Sequence
  chemically synthesized
tcacacaaaataactaaaat

SEQ ID NO: 327081 - DNA, 20 bp, Artificial Sequence
  chemically synthesized
tatctttgtttatcccattt

SEQ ID NO: 327082 - DNA, 20 bp, Artificial Sequence
  chemically synthesized
taactaaaatgggataaaca

SEQ ID NO: 327083 - DNA, 20 bp, Artificial Sequence
  chemically synthesized
aagatatttaatgtatactg

SEQ ID NO: 327084 - DNA, 20 bp, Artificial Sequence
  chemically synthesized
tcactcaaggaaaattgcca

SEQ ID NO: 327085 - DNA, 20 bp, Artificial Sequence
  chemically synthesized
atactgtggcaattttcctt

SEQ ID NO: 327086 - DNA, 20 bp, Artificial Sequence
  chemically synthesized
acagagggaaaaatcactca

SEQ ID NO: 327087 - DNA, 20 bp, Artificial Sequence
  chemically synthesized
tacagagggaaaaatcactc

SEQ ID NO: 327088 - DNA, 20 bp, Artificial Sequence
  chemically synthesized
aatatttttgacagtacaga

SEQ ID NO: 327089 - DNA, 20 bp, Artificial Sequence
  chemically synthesized
caatatttttgacagtacag

SEQ ID NO: 327090 - DNA, 20 bp, Artificial Sequence
  chemically synthesized
tcaatatttttgacagtaca

SEQ ID NO: 327091 - DNA, 20 bp, Artificial Sequence
  chemically synthesized
agtcaatatttttgacagta

SEQ ID NO: 327092 - DNA, 20 bp, Artificial Sequence
  chemically synthesized
aattcagtcaatatttttga

SEQ ID NO: 327093 - DNA, 20 bp, Artificial Sequence
  chemically synthesized
gccaaaacctacagtcaatt

SEQ ID NO: 327094 - DNA, 20 bp, Artificial Sequence
  chemically synthesized
aatattgactgaattgactg

SEQ ID NO: 327095 - DNA, 20 bp, Artificial Sequence
  chemically synthesized
atattgactgaattgactgt

SEQ ID NO: 327096 - DNA, 20 bp, Artificial Sequence
  chemically synthesized
actgaattgactgtaggttt

SEQ ID NO: 327097 - DNA, 20 bp, Artificial Sequence
  chemically synthesized
ctgttggatgccaaaaccta

SEQ ID NO: 327098 - DNA, 20 bp, Artificial Sequence
  chemically synthesized
ctgtaggttttggcatccaa

SEQ ID NO: 327099 - DNA, 20 bp, Artificial Sequence
  chemically synthesized
caaaggactttgaggtctgt

SEQ ID NO: 327100 - DNA, 20 bp, Artificial Sequence
  chemically synthesized
ttggcatccaacagacctca

SEQ ID NO: 327101 - DNA, 20 bp, Artificial Sequence
  chemically synthesized
gctaaaaacaaaggactttg

SEQ ID NO: 327102 - DNA, 20 bp, Artificial Sequence
  chemically synthesized
tgctaaaaacaaaggacttt

SEQ ID NO: 327103 - DNA, 20 bp, Artificial Sequence
  chemically synthesized
acctcaaagtcctttgtttt

SEQ ID NO: 327104 - DNA, 20 bp, Artificial Sequence
  chemically synthesized
caattacatgctaaaaacaa

SEQ ID NO: 327105 - DNA, 20 bp, Artificial Sequence
  chemically synthesized
tcaattacatgctaaaaaca

SEQ ID NO: 327106 - DNA, 20 bp, Artificial Sequence
  chemically synthesized
agcatgtaattgaccatctt

SEQ ID NO: 327107 - DNA, 20 bp, Artificial Sequence
  chemically synthesized
gcaggtgatatcgctaaaga

SEQ ID NO: 327108 - DNA, 20 bp, Artificial Sequence
  chemically synthesized
aatggcaggtgatatcgcta

SEQ ID NO: 327109 - DNA, 20 bp, Artificial Sequence
  chemically synthesized
tagcgatatcacctgccatt

SEQ ID NO: 327110 - DNA, 20 bp, Artificial Sequence
  chemically synthesized
gtaatgcattactcaatggc

SEQ ID NO: 327111 - DNA, 20 bp, Artificial Sequence
  chemically synthesized
tgtaatgcattactcaatgg

SEQ ID NO: 327112 - DNA, 20 bp, Artificial Sequence
  chemically synthesized
aaatgtaatgcattactcaa

SEQ ID NO: 327113 - DNA, 20 bp, Artificial Sequence
  chemically synthesized
ttgaaaaatagtcaatatat

SEQ ID NO: 327114 - DNA, 20 bp, Artificial Sequence
  chemically synthesized
tttgtcttcacattgaaaaa

SEQ ID NO: 327115 - DNA, 20 bp, Artificial Sequence
  chemically synthesized
attgactatttttcaatgtg

SEQ ID NO: 327116 - DNA, 20 bp, Artificial Sequence
  chemically synthesized
tcctttgcaaatttggtttt

SEQ ID NO: 327117 - DNA, 20 bp, Artificial Sequence
  chemically synthesized
tcaatcttcctttgcaaatt

SEQ ID NO: 327118 - DNA, 20 bp, Artificial Sequence
  chemically synthesized
aactgaaaaccaaatttgca

SEQ ID NO: 327119 - DNA, 20 bp, Artificial Sequence
  chemically synthesized
actgaaaaccaaatttgcaa

SEQ ID NO: 327120 - DNA, 20 bp, Artificial Sequence
  chemically synthesized
gaaaaccaaatttgcaaagg

SEQ ID NO: 327121 - DNA, 20 bp, Artificial Sequence
  chemically synthesized
ggaagattgatgataatctt

SEQ ID NO: 327122 - DNA, 20 bp, Artificial Sequence
  chemically synthesized
agattgatgataatcttgag

SEQ ID NO: 327123 - DNA, 20 bp, Artificial Sequence
  chemically synthesized
attgatgataatcttgagtg

SEQ ID NO: 327124 - DNA, 20 bp, Artificial Sequence
  chemically synthesized
ctttctagtagactccactc

SEQ ID NO: 327125 - DNA, 20 bp, Artificial Sequence
  chemically synthesized
taatcttgagtggagtctac

SEQ ID NO: 327126 - DNA, 20 bp, Artificial Sequence
  chemically synthesized
cttgagtggagtctactaga

SEQ ID NO: 327127 - DNA, 20 bp, Artificial Sequence
  chemically synthesized
aaatcaaacaagctttctag

SEQ ID NO: 327128 - DNA, 20 bp, Artificial Sequence
  chemically synthesized
ctaaaatcaaacaagctttc

SEQ ID NO: 327129 - DNA, 20 bp, Artificial Sequence
  chemically synthesized
tggcaagcctaaaatcaaac

SEQ ID NO: 327130 - DNA, 20 bp, Artificial Sequence
  chemically synthesized
ctagaaagcttgtttgattt

SEQ ID NO: 327131 - DNA, 20 bp, Artificial Sequence
  chemically synthesized
tagaaagcttgtttgatttt

SEQ ID NO: 327132 - DNA, 20 bp, Artificial Sequence
  chemically synthesized
atggcatcgaatgcattggc

SEQ ID NO: 327133 - DNA, 20 bp, Artificial Sequence
  chemically synthesized
gctgatggcatcgaatgcat

SEQ ID NO: 327134 - DNA, 20 bp, Artificial Sequence
  chemically synthesized
gccaatgcattcgatgccat

SEQ ID NO: 327135 - DNA, 20 bp, Artificial Sequence
  chemically synthesized
tgcattcgatgccatcagca

SEQ ID NO: 327136 - DNA, 20 bp, Artificial Sequence
  chemically synthesized
gcattcgatgccatcagcac

SEQ ID NO: 327137 - DNA, 20 bp, Artificial Sequence
  chemically synthesized
gatagatatccctgtgctga

SEQ ID NO: 327138 - DNA, 20 bp, Artificial Sequence
  chemically synthesized
cattcgatgccatcagcaca

SEQ ID NO: 327139 - DNA, 20 bp, Artificial Sequence
  chemically synthesized
atttctcctcaaggcaagga

SEQ ID NO: 327140 - DNA, 20 bp, Artificial Sequence
  chemically synthesized
gggatatctatccttgcctt

SEQ ID NO: 327141 - DNA, 20 bp, Artificial Sequence
  chemically synthesized
ggatatctatccttgccttg

SEQ ID NO: 327142 - DNA, 20 bp, Artificial Sequence
  chemically synthesized
ccttatttctcctcaaggca

SEQ ID NO: 327143 - DNA, 20 bp, Artificial Sequence
  chemically synthesized
cccttatttctcctcaaggc

SEQ ID NO: 327144 - DNA, 20 bp, Artificial Sequence
  chemically synthesized
atatctatccttgccttgag

SEQ ID NO: 327145 - DNA, 20 bp, Artificial Sequence
  chemically synthesized
gattcccttatttctcctca

SEQ ID NO: 327146 - DNA, 20 bp, Artificial Sequence
  chemically synthesized
tgattcccttatttctcctc

SEQ ID NO: 327147 - DNA, 20 bp, Artificial Sequence
  chemically synthesized
tccttgccttgaggagaaat

SEQ ID NO: 327148 - DNA, 20 bp, Artificial Sequence
  chemically synthesized
ccttgccttgaggagaaata

SEQ ID NO: 327149 - DNA, 20 bp, Artificial Sequence
  chemically synthesized
cttgccttgaggagaaataa

SEQ ID NO: 327150 - DNA, 20 bp, Artificial Sequence
  chemically synthesized
ttgaggagaaataagggaat

SEQ ID NO: 327151 - DNA, 20 bp, Artificial Sequence
  chemically synthesized
aataagggaatcagaaaatt

SEQ ID NO: 327152 - DNA, 20 bp, Artificial Sequence
  chemically synthesized
ataagggaatcagaaaatta

SEQ ID NO: 327153 - DNA, 20 bp, Artificial Sequence
  chemically synthesized
tcagaaaattaaggctcttt

SEQ ID NO: 327154 - DNA, 20 bp, Artificial Sequence
  chemically synthesized
ctaatgagtagatactaaaa

SEQ ID NO: 327155 - DNA, 20 bp, Artificial Sequence
  chemically synthesized
ctctaatgagtagatactaa

SEQ ID NO: 327156 - DNA, 20 bp, Artificial Sequence
  chemically synthesized
ctcttttagtatctactcat

SEQ ID NO: 327157 - DNA, 20 bp, Artificial Sequence
  chemically synthesized
cttttagtatctactcatta

SEQ ID NO: 327158 - DNA, 20 bp, Artificial Sequence
  chemically synthesized
gatatatcacctctaatgag

SEQ ID NO: 327159 - DNA, 20 bp, Artificial Sequence
  chemically synthesized
ttttagtatctactcattag

SEQ ID NO: 327160 - DNA, 20 bp, Artificial Sequence
  chemically synthesized
aaggatatatcacctctaat

SEQ ID NO: 327161 - DNA, 20 bp, Artificial Sequence
  chemically synthesized
cattattattttcatgatta

SEQ ID NO: 327162 - DNA, 20 bp, Artificial Sequence
  chemically synthesized
acattattattttcatgatt

SEQ ID NO: 327163 - DNA, 20 bp, Artificial Sequence
  chemically synthesized
attaaaaagcaaaataataa

SEQ ID NO: 327164 - DNA, 20 bp, Artificial Sequence
  chemically synthesized
ttattattttgctttttaat

SEQ ID NO: 327165 - DNA, 20 bp, Artificial Sequence
  chemically synthesized
tatcttacattcttattaaa

SEQ ID NO: 327166 - DNA, 20 bp, Artificial Sequence
  chemically synthesized
ttgctttttaataagaatgt

SEQ ID NO: 327167 - DNA, 20 bp, Artificial Sequence
  chemically synthesized
ataagtttaccaattgatta

SEQ ID NO: 327168 - DNA, 20 bp, Artificial Sequence
  chemically synthesized
gtaagatatccataatcaat

SEQ ID NO: 327169 - DNA, 20 bp, Artificial Sequence
  chemically synthesized
tagataggctagacaaagat

SEQ ID NO: 327170 - DNA, 20 bp, Artificial Sequence
  chemically synthesized
ttggtaaacttatctttgtc

SEQ ID NO: 327171 - DNA, 20 bp, Artificial Sequence
  chemically synthesized
gccagtagataggctagaca

SEQ ID NO: 327172 - DNA, 20 bp, Artificial Sequence
  chemically synthesized
tcaattgccagtagataggc

SEQ ID NO: 327173 - DNA, 20 bp, Artificial Sequence
  chemically synthesized
tctttgtctagcctatctac

SEQ ID NO: 327174 - DNA, 20 bp, Artificial Sequence
  chemically synthesized
ttgttcaattgccagtagat

SEQ ID NO: 327175 - DNA, 20 bp, Artificial Sequence
  chemically synthesized
tttgttcaattgccagtaga

SEQ ID NO: 327176 - DNA, 20 bp, Artificial Sequence
  chemically synthesized
attatttgttcaattgccag

SEQ ID NO: 327177 - DNA, 20 bp, Artificial Sequence
  chemically synthesized
tttattatttgttcaattgc

SEQ ID NO: 327178 - DNA, 20 bp, Artificial Sequence
  chemically synthesized
aataataaaaaaacttcaaa

SEQ ID NO: 327179 - DNA, 20 bp, Artificial Sequence
  chemically synthesized
tgtaaaaaattatctatttg

SEQ ID NO: 327180 - DNA, 20 bp, Artificial Sequence
  chemically synthesized
ttacaaaattattttaatta

SEQ ID NO: 327181 - DNA, 20 bp, Artificial Sequence
  chemically synthesized
tattttaattacagacttgc

SEQ ID NO: 327182 - DNA, 20 bp, Artificial Sequence
  chemically synthesized
attttaattacagacttgcc

SEQ ID NO: 327183 - DNA, 20 bp, Artificial Sequence
  chemically synthesized
ttaattacagacttgccagg

SEQ ID NO: 327184 - DNA, 20 bp, Artificial Sequence
  chemically synthesized
tagttgctcttctacctggc

SEQ ID NO: 327185 - DNA, 20 bp, Artificial Sequence
  chemically synthesized
attacagacttgccaggtag

SEQ ID NO: 327186 - DNA, 20 bp, Artificial Sequence
  chemically synthesized
tacagacttgccaggtagaa

SEQ ID NO: 327187 - DNA, 20 bp, Artificial Sequence
  chemically synthesized
ttgttagttgctcttctacc

SEQ ID NO: 327188 - DNA, 20 bp, Artificial Sequence
  chemically synthesized
ggtagaagagcaactaacaa

SEQ ID NO: 327189 - DNA, 20 bp, Artificial Sequence
  chemically synthesized
tagaagagcaactaacaaaa

SEQ ID NO: 327190 - DNA, 20 bp, Artificial Sequence
  chemically synthesized
atgtataaaggctcttttgt

SEQ ID NO: 327191 - DNA, 20 bp, Artificial Sequence
  chemically synthesized
atgatgtattgaatgtataa

SEQ ID NO: 327192 - DNA, 20 bp, Artificial Sequence
  chemically synthesized
tatgatgtattgaatgtata

SEQ ID NO: 327193 - DNA, 20 bp, Artificial Sequence
  chemically synthesized
tcttctctataaaataaatg

SEQ ID NO: 327194 - DNA, 20 bp, Artificial Sequence
  chemically synthesized
tcataacttcatttatttta

SEQ ID NO: 327195 - DNA, 20 bp, Artificial Sequence
  chemically synthesized
ataacttcatttattttata

SEQ ID NO: 327196 - DNA, 20 bp, Artificial Sequence
  chemically synthesized
acttcatttattttatagag

SEQ ID NO: 327197 - DNA, 20 bp, Artificial Sequence
  chemically synthesized
ttcatttattttatagagaa

SEQ ID NO: 327198 - DNA, 20 bp, Artificial Sequence
  chemically synthesized
cagaattccatatgattttc

SEQ ID NO: 327199 - DNA, 20 bp, Artificial Sequence
  chemically synthesized
agaagagcttgaaaatcata

SEQ ID NO: 327200 - DNA, 20 bp, Artificial Sequence
  chemically synthesized
ttgaaaatcatatggaattc

SEQ ID NO: 327201 - DNA, 20 bp, Artificial Sequence
  chemically synthesized
tttgtactaagtgacagagc

SEQ ID NO: 327202 - DNA, 20 bp, Artificial Sequence
  chemically synthesized
ggaattctggctctgtcact

SEQ ID NO: 327203 - DNA, 20 bp, Artificial Sequence
  chemically synthesized
actatttgtactaagtgaca

SEQ ID NO: 327204 - DNA, 20 bp, Artificial Sequence
  chemically synthesized
acactatttgtactaagtga

SEQ ID NO: 327205 - DNA, 20 bp, Artificial Sequence
  chemically synthesized
aaagcaacactatttgtact

SEQ ID NO: 327206 - DNA, 20 bp, Artificial Sequence
  chemically synthesized
gctctgtcacttagtacaaa

SEQ ID NO: 327207 - DNA, 20 bp, Artificial Sequence
  chemically synthesized
tgcttaataaatatttgtta

SEQ ID NO: 327208 - DNA, 20 bp, Artificial Sequence
  chemically synthesized
tgctttaacaaatatttatt

SEQ ID NO: 327209 - DNA, 20 bp, Artificial Sequence
  chemically synthesized
atatttattaagcaactaca

SEQ ID NO: 327210 - DNA, 20 bp, Artificial Sequence
  chemically synthesized
tatttattaagcaactacaa

SEQ ID NO: 327211 - DNA, 20 bp, Artificial Sequence
  chemically synthesized
aaatagtgcctggtcctttg

SEQ ID NO: 327212 - DNA, 20 bp, Artificial Sequence
  chemically synthesized
attaagcaactacaaaggac

SEQ ID NO: 327213 - DNA, 20 bp, Artificial Sequence
  chemically synthesized
ttaagcaactacaaaggacc

SEQ ID NO: 327214 - DNA, 20 bp, Artificial Sequence
  chemically synthesized
tcattgcctaaaatagtgcc

SEQ ID NO: 327215 - DNA, 20 bp, Artificial Sequence
  chemically synthesized
caaaggaccaggcactattt

SEQ ID NO: 327216 - DNA, 20 bp, Artificial Sequence
  chemically synthesized
aaaggaccaggcactatttt

SEQ ID NO: 327217 - DNA, 20 bp, Artificial Sequence
  chemically synthesized
tatatcatcattgcctaaaa

SEQ ID NO: 327218 - DNA, 20 bp, Artificial Sequence
  chemically synthesized
tattttaggcaatgatgata

SEQ ID NO: 327219 - DNA, 20 bp, Artificial Sequence
  chemically synthesized
atttctgtctgttttgtata

SEQ ID NO: 327220 - DNA, 20 bp, Artificial Sequence
  chemically synthesized
tgatatagccatatacaaaa

SEQ ID NO: 327221 - DNA, 20 bp, Artificial Sequence
  chemically synthesized
atagccatatacaaaacaga

SEQ ID NO: 327222 - DNA, 20 bp, Artificial Sequence
  chemically synthesized
tacaaaacagacagaaatct

SEQ ID NO: 327223 - DNA, 20 bp, Artificial Sequence
  chemically synthesized
tgattcactgaatgagaact

SEQ ID NO: 327224 - DNA, 20 bp, Artificial Sequence
  chemically synthesized
cagaaatctaagttctcatt

SEQ ID NO: 327225 - DNA, 20 bp, Artificial Sequence
  chemically synthesized
agtgacatgattcactgaat

SEQ ID NO: 327226 - DNA, 20 bp, Artificial Sequence
  chemically synthesized
ttcagtgaatcatgtcactg

SEQ ID NO: 327227 - DNA, 20 bp, Artificial Sequence
  chemically synthesized
tcagtgaatcatgtcactga

SEQ ID NO: 327228 - DNA, 20 bp, Artificial Sequence
  chemically synthesized
tctcttgattagcatgcctt

SEQ ID NO: 327229 - DNA, 20 bp, Artificial Sequence
  chemically synthesized
tcactgaaggcatgctaatc

SEQ ID NO: 327230 - DNA, 20 bp, Artificial Sequence
  chemically synthesized
actgaaggcatgctaatcaa

SEQ ID NO: 327231 - DNA, 20 bp, Artificial Sequence
  chemically synthesized
ttttacttatttctcttgat

SEQ ID NO: 327232 - DNA, 20 bp, Artificial Sequence
  chemically synthesized
gcatgctaatcaagagaaat

SEQ ID NO: 327233 - DNA, 20 bp, Artificial Sequence
  chemically synthesized
atcaagagaaataagtaaaa

SEQ ID NO: 327234 - DNA, 20 bp, Artificial Sequence
  chemically synthesized
aagagaaataagtaaaatag

SEQ ID NO: 327235 - DNA, 20 bp, Artificial Sequence
  chemically synthesized
agagaaataagtaaaataga

SEQ ID NO: 327236 - DNA, 20 bp, Artificial Sequence
  chemically synthesized
taagtaaaatagaaggatgt

SEQ ID NO: 327237 - DNA, 20 bp, Artificial Sequence
  chemically synthesized
atagaaggatgtaagtgtta

SEQ ID NO: 327238 - DNA, 20 bp, Artificial Sequence
  chemically synthesized
agaaggatgtaagtgttatg

SEQ ID NO: 327239 - DNA, 20 bp, Artificial Sequence
  chemically synthesized
gatgtaagtgttatggagaa

SEQ ID NO: 327240 - DNA, 20 bp, Artificial Sequence
  chemically synthesized
atgtaagtgttatggagaaa

SEQ ID NO: 327241 - DNA, 20 bp, Artificial Sequence
  chemically synthesized
taagtgttatggagaaaagg

SEQ ID NO: 327242 - DNA, 20 bp, Artificial Sequence
  chemically synthesized
tgttatggagaaaaggaagc

SEQ ID NO: 327243 - DNA, 20 bp, Artificial Sequence
  chemically synthesized
gttatggagaaaaggaagca

SEQ ID NO: 327244 - DNA, 20 bp, Artificial Sequence
  chemically synthesized
atggagaaaaggaagcaagg

SEQ ID NO: 327245 - DNA, 20 bp, Artificial Sequence
  chemically synthesized
tggagaaaaggaagcaagga

SEQ ID NO: 327246 - DNA, 20 bp, Artificial Sequence
  chemically synthesized
ggagaaaaggaagcaaggaa

SEQ ID NO: 327247 - DNA, 20 bp, Artificial Sequence
  chemically synthesized
gagaaaaggaagcaaggaag

SEQ ID NO: 327248 - DNA, 20 bp, Artificial Sequence
  chemically synthesized
aagcaaggaaggggaattga

SEQ ID NO: 327249 - DNA, 20 bp, Artificial Sequence
  chemically synthesized
ggaaggggaattgaaagtac

SEQ ID NO: 327250 - DNA, 20 bp, Artificial Sequence
  chemically synthesized
gaaggggaattgaaagtact

SEQ ID NO: 327251 - DNA, 20 bp, Artificial Sequence
  chemically synthesized
aaggggaattgaaagtacta

SEQ ID NO: 327252 - DNA, 20 bp, Artificial Sequence
  chemically synthesized
tttctcaatgatattttccc

SEQ ID NO: 327253 - DNA, 20 bp, Artificial Sequence
  chemically synthesized
gtactagggaaaatatcatt

SEQ ID NO: 327254 - DNA, 20 bp, Artificial Sequence
  chemically synthesized
gggaaaatatcattgagaaa

SEQ ID NO: 327255 - DNA, 20 bp, Artificial Sequence
  chemically synthesized
atcattgagaaaaagattta

SEQ ID NO: 327256 - DNA, 20 bp, Artificial Sequence
  chemically synthesized
agaaaaagatttaaagatat

SEQ ID NO: 327257 - DNA, 20 bp, Artificial Sequence
  chemically synthesized
aaaaagatttaaagatatga

SEQ ID NO: 327258 - DNA, 20 bp, Artificial Sequence
  chemically synthesized
aaagatttaaagatatgaga

SEQ ID NO: 327259 - DNA, 20 bp, Artificial Sequence
  chemically synthesized
atttaaagatatgagagagt

SEQ ID NO: 327260 - DNA, 20 bp, Artificial Sequence
  chemically synthesized
tatgagagagtaagtcatgt

SEQ ID NO: 327261 - DNA, 20 bp, Artificial Sequence
  chemically synthesized
gagtaagtcatgtgagtatg

SEQ ID NO: 327262 - DNA, 20 bp, Artificial Sequence
  chemically synthesized
gtaagtcatgtgagtatgtg

SEQ ID NO: 327263 - DNA, 20 bp, Artificial Sequence
  chemically synthesized
taagtcatgtgagtatgtgg

SEQ ID NO: 327264 - DNA, 20 bp, Artificial Sequence
  chemically synthesized
tatgtggaggaaatgtgttc

SEQ ID NO: 327265 - DNA, 20 bp, Artificial Sequence
  chemically synthesized
atgtggaggaaatgtgttcc

SEQ ID NO: 327266 - DNA, 20 bp, Artificial Sequence
  chemically synthesized
tggaggaaatgtgttccagg

SEQ ID NO: 327267 - DNA, 20 bp, Artificial Sequence
  chemically synthesized
gaggaaatgtgttccaggta

SEQ ID NO: 327268 - DNA, 20 bp, Artificial Sequence
  chemically synthesized
aggaaatgtgttccaggtag

SEQ ID NO: 327269 - DNA, 20 bp, Artificial Sequence
  chemically synthesized
cagtcatagatgcctctacc

SEQ ID NO: 327270 - DNA, 20 bp, Artificial Sequence
  chemically synthesized
ggtagaggcatctatgactg

SEQ ID NO: 327271 - DNA, 20 bp, Artificial Sequence
  chemically synthesized
ctctcattccaccgcagtca

SEQ ID NO: 327272 - DNA, 20 bp, Artificial Sequence
  chemically synthesized
agaggcatctatgactgcgg

SEQ ID NO: 327273 - DNA, 20 bp, Artificial Sequence
  chemically synthesized
taccgtctctcattccaccg

SEQ ID NO: 327274 - DNA, 20 bp, Artificial Sequence
  chemically synthesized
atctatgactgcggtggaat

SEQ ID NO: 327275 - DNA, 20 bp, Artificial Sequence
  chemically synthesized
ctatgactgcggtggaatga

SEQ ID NO: 327276 - DNA, 20 bp, Artificial Sequence
  chemically synthesized
gactgcggtggaatgagaga

SEQ ID NO: 327277 - DNA, 20 bp, Artificial Sequence
  chemically synthesized
ggaatgagagacggtaacaa

SEQ ID NO: 327278 - DNA, 20 bp, Artificial Sequence
  chemically synthesized
atgagagacggtaacaacgg

SEQ ID NO: 327279 - DNA, 20 bp, Artificial Sequence
  chemically synthesized
agacggtaacaacggtggaa

SEQ ID NO: 327280 - DNA, 20 bp, Artificial Sequence
  chemically synthesized
gacggtaacaacggtggaaa

SEQ ID NO: 327281 - DNA, 20 bp, Artificial Sequence
  chemically synthesized
ggtaacaacggtggaaaagg

SEQ ID NO: 327282 - DNA, 20 bp, Artificial Sequence
  chemically synthesized
acaacggtggaaaaggaagc

SEQ ID NO: 327283 - DNA, 20 bp, Artificial Sequence
  chemically synthesized
aacggtggaaaaggaagcca

SEQ ID NO: 327284 - DNA, 20 bp, Artificial Sequence
  chemically synthesized
ggtggaaaaggaagccagag

SEQ ID NO: 327285 - DNA, 20 bp, Artificial Sequence
  chemically synthesized
ctttctctatgtttcttctc

SEQ ID NO: 327286 - DNA, 20 bp, Artificial Sequence
  chemically synthesized
aggaagccagagaagaaaca

SEQ ID NO: 327287 - DNA, 20 bp, Artificial Sequence
  chemically synthesized
gaagccagagaagaaacata

SEQ ID NO: 327288 - DNA, 20 bp, Artificial Sequence
  chemically synthesized
ccagagaagaaacatagaga

SEQ ID NO: 327289 - DNA, 20 bp, Artificial Sequence
  chemically synthesized
cagagaagaaacatagagaa

SEQ ID NO: 327290 - DNA, 20 bp, Artificial Sequence
  chemically synthesized
gagaagaaacatagagaaag

SEQ ID NO: 327291 - DNA, 20 bp, Artificial Sequence
  chemically synthesized
agaagaaacatagagaaagg

SEQ ID NO: 327292 - DNA, 20 bp, Artificial Sequence
  chemically synthesized
aagaaacatagagaaaggag

SEQ ID NO: 327293 - DNA, 20 bp, Artificial Sequence
  chemically synthesized
agaaacatagagaaaggagg

SEQ ID NO: 327294 - DNA, 20 bp, Artificial Sequence
  chemically synthesized
aaggaggaggtgattgtgca

SEQ ID NO: 327295 - DNA, 20 bp, Artificial Sequence
  chemically synthesized
aggaggaggtgattgtgcat

SEQ ID NO: 327296 - DNA, 20 bp, Artificial Sequence
  chemically synthesized
ttgtgcatgggcttataaaa

SEQ ID NO: 327297 - DNA, 20 bp, Artificial Sequence
  chemically synthesized
atgcagtcctgctgttttat

SEQ ID NO: 327298 - DNA, 20 bp, Artificial Sequence
  chemically synthesized
tgcatgggcttataaaacag

SEQ ID NO: 327299 - DNA, 20 bp, Artificial Sequence
  chemically synthesized
gcatgggcttataaaacagc

SEQ ID NO: 327300 - DNA, 20 bp, Artificial Sequence
  chemically synthesized
gccagacattcagtaaaatg

SEQ ID NO: 327301 - DNA, 20 bp, Artificial Sequence
  chemically synthesized
actgcattttactgaatgtc

SEQ ID NO: 327302 - DNA, 20 bp, Artificial Sequence
  chemically synthesized
cccatgccttgccagacatt

SEQ ID NO: 327303 - DNA, 20 bp, Artificial Sequence
  chemically synthesized
cattttactgaatgtctggc

SEQ ID NO: 327304 - DNA, 20 bp, Artificial Sequence
  chemically synthesized
attttactgaatgtctggca

SEQ ID NO: 327305 - DNA, 20 bp, Artificial Sequence
  chemically synthesized
aaaaccttcccatgccttgc

SEQ ID NO: 327306 - DNA, 20 bp, Artificial Sequence
  chemically synthesized
actgaatgtctggcaaggca

SEQ ID NO: 327307 - DNA, 20 bp, Artificial Sequence
  chemically synthesized
ctgaatgtctggcaaggcat

SEQ ID NO: 327308 - DNA, 20 bp, Artificial Sequence
  chemically synthesized
aatgtctggcaaggcatggg

SEQ ID NO: 327309 - DNA, 20 bp, Artificial Sequence
  chemically synthesized
atgtctggcaaggcatggga

SEQ ID NO: 327310 - DNA, 20 bp, Artificial Sequence
  chemically synthesized
gcaaggcatgggaaggtttt

SEQ ID NO: 327311 - DNA, 20 bp, Artificial Sequence
  chemically synthesized
aggcatgggaaggttttcag

SEQ ID NO: 327312 - DNA, 20 bp, Artificial Sequence
  chemically synthesized
catgggaaggttttcagcag

SEQ ID NO: 327313 - DNA, 20 bp, Artificial Sequence
  chemically synthesized
tgggaaggttttcagcagaa

SEQ ID NO: 327314 - DNA, 20 bp, Artificial Sequence
  chemically synthesized
gatggtcttgttaaaacgta

SEQ ID NO: 327315 - DNA, 20 bp, Artificial Sequence
  chemically synthesized
agatggtcttgttaaaacgt

SEQ ID NO: 327316 - DNA, 20 bp, Artificial Sequence
  chemically synthesized
gatttgccttacgttttaac

SEQ ID NO: 327317 - DNA, 20 bp, Artificial Sequence
  chemically synthesized
tacgttttaacaagaccatc

SEQ ID NO: 327318 - DNA, 20 bp, Artificial Sequence
  chemically synthesized
gttttaacaagaccatctgg

SEQ ID NO: 327319 - DNA, 20 bp, Artificial Sequence
  chemically synthesized
aatccattttgtctgccaga

SEQ ID NO: 327320 - DNA, 20 bp, Artificial Sequence
  chemically synthesized
ctgtaatccattttgtctgc

SEQ ID NO: 327321 - DNA, 20 bp, Artificial Sequence
  chemically synthesized
agaccatctggcagacaaaa

SEQ ID NO: 327322 - DNA, 20 bp, Artificial Sequence
  chemically synthesized
ctggcagacaaaatggatta

SEQ ID NO: 327323 - DNA, 20 bp, Artificial Sequence
  chemically synthesized
tggcagacaaaatggattac

SEQ ID NO: 327324 - DNA, 20 bp, Artificial Sequence
  chemically synthesized
agacaaaatggattacaggt

SEQ ID NO: 327325 - DNA, 20 bp, Artificial Sequence
  chemically synthesized
gacaaaatggattacaggta

SEQ ID NO: 327326 - DNA, 20 bp, Artificial Sequence
  chemically synthesized
aaatggattacaggtaaggc

SEQ ID NO: 327327 - DNA, 20 bp, Artificial Sequence
  chemically synthesized
aatggattacaggtaaggca

SEQ ID NO: 327328 - DNA, 20 bp, Artificial Sequence
  chemically synthesized
ttacaggtaaggcaaggcca

SEQ ID NO: 327329 - DNA, 20 bp, Artificial Sequence
  chemically synthesized
caggtaaggcaaggccaaag

SEQ ID NO: 327330 - DNA, 20 bp, Artificial Sequence
  chemically synthesized
aggtaaggcaaggccaaagc

SEQ ID NO: 327331 - DNA, 20 bp, Artificial Sequence
  chemically synthesized
taaggcaaggccaaagcagg

SEQ ID NO: 327332 - DNA, 20 bp, Artificial Sequence
  chemically synthesized
ttaaacaagcctgcctgctt

SEQ ID NO: 327333 - DNA, 20 bp, Artificial Sequence
  chemically synthesized
aaggcaaggccaaagcaggc

SEQ ID NO: 327334 - DNA, 20 bp, Artificial Sequence
  chemically synthesized
aagcaggcaggcttgtttaa

SEQ ID NO: 327335 - DNA, 20 bp, Artificial Sequence
  chemically synthesized
agcaggcaggcttgtttaaa

SEQ ID NO: 327336 - DNA, 20 bp, Artificial Sequence
  chemically synthesized
agtgaaatagccttttaaac

SEQ ID NO: 327337 - DNA, 20 bp, Artificial Sequence
  chemically synthesized
tctggtctaaattagtgaaa

SEQ ID NO: 327338 - DNA, 20 bp, Artificial Sequence
  chemically synthesized
aaaaggctatttcactaatt

SEQ ID NO: 327339 - DNA, 20 bp, Artificial Sequence
  chemically synthesized
ccatcacctctggtctaaat

SEQ ID NO: 327340 - DNA, 20 bp, Artificial Sequence
  chemically synthesized
gctatttcactaatttagac

SEQ ID NO: 327341 - DNA, 20 bp, Artificial Sequence
  chemically synthesized
tatttcactaatttagacca

SEQ ID NO: 327342 - DNA, 20 bp, Artificial Sequence
  chemically synthesized
atttcactaatttagaccag

SEQ ID NO: 327343 - DNA, 20 bp, Artificial Sequence
  chemically synthesized
ctaatttagaccagaggtga

SEQ ID NO: 327344 - DNA, 20 bp, Artificial Sequence
  chemically synthesized
atggccaccaccatcacctc

SEQ ID NO: 327345 - DNA, 20 bp, Artificial Sequence
  chemically synthesized
atttagaccagaggtgatgg

SEQ ID NO: 327346 - DNA, 20 bp, Artificial Sequence
  chemically synthesized
tagaccagaggtgatggtgg

SEQ ID NO: 327347 - DNA, 20 bp, Artificial Sequence
  chemically synthesized
ggtgatggtggtggccatgt

SEQ ID NO: 327348 - DNA, 20 bp, Artificial Sequence
  chemically synthesized
gatggtggtggccatgtaag

SEQ ID NO: 327349 - DNA, 20 bp, Artificial Sequence
  chemically synthesized
atcacttctgactacttaca

SEQ ID NO: 327350 - DNA, 20 bp, Artificial Sequence
  chemically synthesized
gtggtggccatgtaagtagt

SEQ ID NO: 327351 - DNA, 20 bp, Artificial Sequence
  chemically synthesized
gtggccatgtaagtagtcag

SEQ ID NO: 327352 - DNA, 20 bp, Artificial Sequence
  chemically synthesized
tgtaagtagtcagaagtgat

SEQ ID NO: 327353 - DNA, 20 bp, Artificial Sequence
  chemically synthesized
agtcagaagtgatcagattc

SEQ ID NO: 327354 - DNA, 20 bp, Artificial Sequence
  chemically synthesized
accttaaccaggtatatatc

SEQ ID NO: 327355 - DNA, 20 bp, Artificial Sequence
  chemically synthesized
tcagattctggatatatacc

SEQ ID NO: 327356 - DNA, 20 bp, Artificial Sequence
  chemically synthesized
ttctggatatatacctggtt

SEQ ID NO: 327357 - DNA, 20 bp, Artificial Sequence
  chemically synthesized
tctggatatatacctggtta

SEQ ID NO: 327358 - DNA, 20 bp, Artificial Sequence
  chemically synthesized
atgccaggtccaccttaacc

SEQ ID NO: 327359 - DNA, 20 bp, Artificial Sequence
  chemically synthesized
ggatatatacctggttaagg

SEQ ID NO: 327360 - DNA, 20 bp, Artificial Sequence
  chemically synthesized
tatgccaggtccaccttaac

SEQ ID NO: 327361 - DNA, 20 bp, Artificial Sequence
  chemically synthesized
atacctggttaaggtggacc

SEQ ID NO: 327362 - DNA, 20 bp, Artificial Sequence
  chemically synthesized
tggttaaggtggacctggca

SEQ ID NO: 327363 - DNA, 20 bp, Artificial Sequence
  chemically synthesized
ggttaaggtggacctggcat

SEQ ID NO: 327364 - DNA, 20 bp, Artificial Sequence
  chemically synthesized
aaaaaaaaaaaacctatgcc

SEQ ID NO: 327365 - DNA, 20 bp, Artificial Sequence
  chemically synthesized
aaaaaaaaaaaaacctatgc

SEQ ID NO: 327366 - DNA, 20 bp, Artificial Sequence
  chemically synthesized
tttttttttttttttttttt

SEQ ID NO: 327367 - DNA, 20 bp, Artificial Sequence
  chemically synthesized
ttttttttttttttttgaga

SEQ ID NO: 327368 - DNA, 20 bp, Artificial Sequence
  chemically synthesized
ttttttttttttttgagatg

SEQ ID NO: 327369 - DNA, 20 bp, Artificial Sequence
  chemically synthesized
tccagcctgggtgacagagc

SEQ ID NO: 327370 - DNA, 20 bp, Artificial Sequence
  chemically synthesized
tggagtctcgctctgtcacc

SEQ ID NO: 327371 - DNA, 20 bp, Artificial Sequence
  chemically synthesized
gcactccagcctgggtgaca

SEQ ID NO: 327372 - DNA, 20 bp, Artificial Sequence
  chemically synthesized
ggagtctcgctctgtcaccc

SEQ ID NO: 327373 - DNA, 20 bp, Artificial Sequence
  chemically synthesized
ctgcactccagcctgggtga

SEQ ID NO: 327374 - DNA, 20 bp, Artificial Sequence
  chemically synthesized
tctcgctctgtcacccaggc

SEQ ID NO: 327375 - DNA, 20 bp, Artificial Sequence
  chemically synthesized
tcgctctgtcacccaggctg

SEQ ID NO: 327376 - DNA, 20 bp, Artificial Sequence
  chemically synthesized
gcgctactgcactccagcct

SEQ ID NO: 327377 - DNA, 20 bp, Artificial Sequence
  chemically synthesized
cgcgctactgcactccagcc

SEQ ID NO: 327378 - DNA, 20 bp, Artificial Sequence
  chemically synthesized
ctgtcacccaggctggagtg

SEQ ID NO: 327379 - DNA, 20 bp, Artificial Sequence
  chemically synthesized
gatatcgcgctactgcactc

SEQ ID NO: 327380 - DNA, 20 bp, Artificial Sequence
  chemically synthesized
tcacccaggctggagtgcag

SEQ ID NO: 327381 - DNA, 20 bp, Artificial Sequence
  chemically synthesized
gaggcggagcttgtagtgag

SEQ ID NO: 327382 - DNA, 20 bp, Artificial Sequence
  chemically synthesized
gcgcgatatccgctcactac

SEQ ID NO: 327383 - DNA, 20 bp, Artificial Sequence
  chemically synthesized
cgggaggcggagcttgtagt

SEQ ID NO: 327384 - DNA, 20 bp, Artificial Sequence
  chemically synthesized
aacccgggaggcggagcttg

SEQ ID NO: 327385 - DNA, 20 bp, Artificial Sequence
  chemically synthesized
tcactacaagctccgcctcc

SEQ ID NO: 327386 - DNA, 20 bp, Artificial Sequence
  chemically synthesized
tggcgtgaacccgggaggcg

SEQ ID NO: 327387 - DNA, 20 bp, Artificial Sequence
  chemically synthesized
cactacaagctccgcctccc

SEQ ID NO: 327388 - DNA, 20 bp, Artificial Sequence
  chemically synthesized
aatggcgtgaacccgggagg

SEQ ID NO: 327389 - DNA, 20 bp, Artificial Sequence
  chemically synthesized
gagaatggcgtgaacccggg

SEQ ID NO: 327390 - DNA, 20 bp, Artificial Sequence
  chemically synthesized
ggagaatggcgtgaacccgg

SEQ ID NO: 327391 - DNA, 20 bp, Artificial Sequence
  chemically synthesized
caggagaatggcgtgaaccc

SEQ ID NO: 327392 - DNA, 20 bp, Artificial Sequence
  chemically synthesized
gcaggagaatggcgtgaacc

SEQ ID NO: 327393 - DNA, 20 bp, Artificial Sequence
  chemically synthesized
gggaggctgaggcaggagaa

SEQ ID NO: 327394 - DNA, 20 bp, Artificial Sequence
  chemically synthesized
ttcacgccattctcctgcct

SEQ ID NO: 327395 - DNA, 20 bp, Artificial Sequence
  chemically synthesized
tactcgggaggctgaggcag

SEQ ID NO: 327396 - DNA, 20 bp, Artificial Sequence
  chemically synthesized
gctactcgggaggctgaggc

SEQ ID NO: 327397 - DNA, 20 bp, Artificial Sequence
  chemically synthesized
agctactcgggaggctgagg

SEQ ID NO: 327398 - DNA, 20 bp, Artificial Sequence
  chemically synthesized
cccagctactcgggaggctg

SEQ ID NO: 327399 - DNA, 20 bp, Artificial Sequence
  chemically synthesized
tcccagctactcgggaggct

SEQ ID NO: 327400 - DNA, 20 bp, Artificial Sequence
  chemically synthesized
ttctcctgcctcagcctccc

SEQ ID NO: 327401 - DNA, 20 bp, Artificial Sequence
  chemically synthesized
tcctgcctcagcctcccgag

SEQ ID NO: 327402 - DNA, 20 bp, Artificial Sequence
  chemically synthesized
tgtagtcccagctactcggg

SEQ ID NO: 327403 - DNA, 20 bp, Artificial Sequence
  chemically synthesized
ctgtagtcccagctactcgg

SEQ ID NO: 327404 - DNA, 20 bp, Artificial Sequence
  chemically synthesized
gcctcagcctcccgagtagc

SEQ ID NO: 327405 - DNA, 20 bp, Artificial Sequence
  chemically synthesized
gcctgtagtcccagctactc

SEQ ID NO: 327406 - DNA, 20 bp, Artificial Sequence
  chemically synthesized
cctcagcctcccgagtagct

SEQ ID NO: 327407 - DNA, 20 bp, Artificial Sequence
  chemically synthesized
tgcctgtagtcccagctact

SEQ ID NO: 327408 - DNA, 20 bp, Artificial Sequence
  chemically synthesized
ctcccgagtagctgggacta

SEQ ID NO: 327409 - DNA, 20 bp, Artificial Sequence
  chemically synthesized
tcccgagtagctgggactac

SEQ ID NO: 327410 - DNA, 20 bp, Artificial Sequence
  chemically synthesized
gtggcaggtgcctgtagtcc

SEQ ID NO: 327411 - DNA, 20 bp, Artificial Sequence
  chemically synthesized
gccgtggtggcaggtgcctg

SEQ ID NO: 327412 - DNA, 20 bp, Artificial Sequence
  chemically synthesized
actacaggcacctgccacca

SEQ ID NO: 327413 - DNA, 20 bp, Artificial Sequence
  chemically synthesized
aatttgccggccgtggtggc

SEQ ID NO: 327414 - DNA, 20 bp, Artificial Sequence
  chemically synthesized
aaatttgccggccgtggtgg

SEQ ID NO: 327415 - DNA, 20 bp, Artificial Sequence
  chemically synthesized
caggcacctgccaccacggc

SEQ ID NO: 327416 - DNA, 20 bp, Artificial Sequence
  chemically synthesized
aaaaaatttgccggccgtgg

SEQ ID NO: 327417 - DNA, 20 bp, Artificial Sequence
  chemically synthesized
tacaaaaaatttgccggccg

SEQ ID NO: 327418 - DNA, 20 bp, Artificial Sequence
  chemically synthesized
taaaaatacaaaaaatttgc

SEQ ID NO: 327419 - DNA, 20 bp, Artificial Sequence
  chemically synthesized
cggcaaattttttgtatttt

SEQ ID NO: 327420 - DNA, 20 bp, Artificial Sequence
  chemically synthesized
caaattttttgtatttttag

SEQ ID NO: 327421 - DNA, 20 bp, Artificial Sequence
  chemically synthesized
aattttttgtatttttagta

SEQ ID NO: 327422 - DNA, 20 bp, Artificial Sequence
  chemically synthesized
ttttgtatttttagtagaga

SEQ ID NO: 327423 - DNA, 20 bp, Artificial Sequence
  chemically synthesized
tttgtatttttagtagagac

SEQ ID NO: 327424 - DNA, 20 bp, Artificial Sequence
  chemically synthesized
ttgtatttttagtagagacg

SEQ ID NO: 327425 - DNA, 20 bp, Artificial Sequence
  chemically synthesized
gagacggggtttcaccgtgt

SEQ ID NO: 327426 - DNA, 20 bp, Artificial Sequence
  chemically synthesized
cggggtttcaccgtgttagc

SEQ ID NO: 327427 - DNA, 20 bp, Artificial Sequence
  chemically synthesized
cgagaccatcctggctaaca

SEQ ID NO: 327428 - DNA, 20 bp, Artificial Sequence
  chemically synthesized
ggggtttcaccgtgttagcc

SEQ ID NO: 327429 - DNA, 20 bp, Artificial Sequence
  chemically synthesized
tttcaccgtgttagccagga

SEQ ID NO: 327430 - DNA, 20 bp, Artificial Sequence
  chemically synthesized
tcaggagatcgagaccatcc

SEQ ID NO: 327431 - DNA, 20 bp, Artificial Sequence
  chemically synthesized
gatcacgaggtcaggagatc

SEQ ID NO: 327432 - DNA, 20 bp, Artificial Sequence
  chemically synthesized
cgggcggatcacgaggtcag

SEQ ID NO: 327433 - DNA, 20 bp, Artificial Sequence
  chemically synthesized
ggcgggcggatcacgaggtc

SEQ ID NO: 327434 - DNA, 20 bp, Artificial Sequence
  chemically synthesized
aggcgggcggatcacgaggt

SEQ ID NO: 327435 - DNA, 20 bp, Artificial Sequence
  chemically synthesized
gccgaggcgggcggatcacg

SEQ ID NO: 327436 - DNA, 20 bp, Artificial Sequence
  chemically synthesized
ggccgaggcgggcggatcac

SEQ ID NO: 327437 - DNA, 20 bp, Artificial Sequence
  chemically synthesized
acctcgtgatccgcccgcct

SEQ ID NO: 327438 - DNA, 20 bp, Artificial Sequence
  chemically synthesized
ctttgagaggccgaggcggg

SEQ ID NO: 327439 - DNA, 20 bp, Artificial Sequence
  chemically synthesized
gcactttgagaggccgaggc

SEQ ID NO: 327440 - DNA, 20 bp, Artificial Sequence
  chemically synthesized
agcactttgagaggccgagg

SEQ ID NO: 327441 - DNA, 20 bp, Artificial Sequence
  chemically synthesized
cccagcactttgagaggccg

SEQ ID NO: 327442 - DNA, 20 bp, Artificial Sequence
  chemically synthesized
tcccagcactttgagaggcc

SEQ ID NO: 327443 - DNA, 20 bp, Artificial Sequence
  chemically synthesized
ccgcccgcctcggcctctca

SEQ ID NO: 327444 - DNA, 20 bp, Artificial Sequence
  chemically synthesized
tgtaatcccagcactttgag

SEQ ID NO: 327445 - DNA, 20 bp, Artificial Sequence
  chemically synthesized
ctgtaatcccagcactttga

SEQ ID NO: 327446 - DNA, 20 bp, Artificial Sequence
  chemically synthesized
gcctcggcctctcaaagtgc

SEQ ID NO: 327447 - DNA, 20 bp, Artificial Sequence
  chemically synthesized
gcctgtaatcccagcacttt

SEQ ID NO: 327448 - DNA, 20 bp, Artificial Sequence
  chemically synthesized
cctcggcctctcaaagtgct

SEQ ID NO: 327449 - DNA, 20 bp, Artificial Sequence
  chemically synthesized
ctctcaaagtgctgggatta

SEQ ID NO: 327450 - DNA, 20 bp, Artificial Sequence
  chemically synthesized
tctcaaagtgctgggattac

SEQ ID NO: 327451 - DNA, 20 bp, Artificial Sequence
  chemically synthesized
gtggctcacgcctgtaatcc

SEQ ID NO: 327452 - DNA, 20 bp, Artificial Sequence
  chemically synthesized
agtgctgggattacaggcgt

SEQ ID NO: 327453 - DNA, 20 bp, Artificial Sequence
  chemically synthesized
caggcgtgagccaccgcatc

SEQ ID NO: 327454 - DNA, 20 bp, Artificial Sequence
  chemically synthesized
ccaggtttggccggatgcgg

SEQ ID NO: 327455 - DNA, 20 bp, Artificial Sequence
  chemically synthesized
atgccaggtttggccggatg

SEQ ID NO: 327456 - DNA, 20 bp, Artificial Sequence
  chemically synthesized
aaaactatgccaggtttggc

SEQ ID NO: 327457 - DNA, 20 bp, Artificial Sequence
  chemically synthesized
ccaccgcatccggccaaacc

SEQ ID NO: 327458 - DNA, 20 bp, Artificial Sequence
  chemically synthesized
ttagaaaactatgccaggtt

SEQ ID NO: 327459 - DNA, 20 bp, Artificial Sequence
  chemically synthesized
gcatccggccaaacctggca

SEQ ID NO: 327460 - DNA, 20 bp, Artificial Sequence
  chemically synthesized
gttgattagaaaactatgcc

SEQ ID NO: 327461 - DNA, 20 bp, Artificial Sequence
  chemically synthesized
tgttgattagaaaactatgc

SEQ ID NO: 327462 - DNA, 20 bp, Artificial Sequence
  chemically synthesized
tcacacctgatgttgttgat

SEQ ID NO: 327463 - DNA, 20 bp, Artificial Sequence
  chemically synthesized
agttttctaatcaacaacat

SEQ ID NO: 327464 - DNA, 20 bp, Artificial Sequence
  chemically synthesized
gttttctaatcaacaacatc

SEQ ID NO: 327465 - DNA, 20 bp, Artificial Sequence
  chemically synthesized
taatcaacaacatcaggtgt

SEQ ID NO: 327466 - DNA, 20 bp, Artificial Sequence
  chemically synthesized
caacaacatcaggtgtgaga

SEQ ID NO: 327467 - DNA, 20 bp, Artificial Sequence
  chemically synthesized
catcaggtgtgagaaagaac

SEQ ID NO: 327468 - DNA, 20 bp, Artificial Sequence
  chemically synthesized
gtgtgagaaagaacaagact

SEQ ID NO: 327469 - DNA, 20 bp, Artificial Sequence
  chemically synthesized
gaacatctttgagtcaaact

SEQ ID NO: 327470 - DNA, 20 bp, Artificial Sequence
  chemically synthesized
acaagactaagtttgactca

SEQ ID NO: 327471 - DNA, 20 bp, Artificial Sequence
  chemically synthesized
tgccccaaatgaacatcttt

SEQ ID NO: 327472 - DNA, 20 bp, Artificial Sequence
  chemically synthesized
ttgactcaaagatgttcatt

SEQ ID NO: 327473 - DNA, 20 bp, Artificial Sequence
  chemically synthesized
tgactcaaagatgttcattt

SEQ ID NO: 327474 - DNA, 20 bp, Artificial Sequence
  chemically synthesized
gactcaaagatgttcatttg

SEQ ID NO: 327475 - DNA, 20 bp, Artificial Sequence
  chemically synthesized
agatgttcatttggggcaac

SEQ ID NO: 327476 - DNA, 20 bp, Artificial Sequence
  chemically synthesized
tgttcatttggggcaactgg

SEQ ID NO: 327477 - DNA, 20 bp, Artificial Sequence
  chemically synthesized
gttcatttggggcaactgga

SEQ ID NO: 327478 - DNA, 20 bp, Artificial Sequence
  chemically synthesized
aaggtttcactatagccttc

SEQ ID NO: 327479 - DNA, 20 bp, Artificial Sequence
  chemically synthesized
ttggggcaactggaaggcta

SEQ ID NO: 327480 - DNA, 20 bp, Artificial Sequence
  chemically synthesized
gtgtcagtaaggtttcacta

SEQ ID NO: 327481 - DNA, 20 bp, Artificial Sequence
  chemically synthesized
tagtttttcctgtgtcagta

SEQ ID NO: 327482 - DNA, 20 bp, Artificial Sequence
  chemically synthesized
atagtgaaaccttactgaca

SEQ ID NO: 327483 - DNA, 20 bp, Artificial Sequence
  chemically synthesized
atagtttttcctgtgtcagt

SEQ ID NO: 327484 - DNA, 20 bp, Artificial Sequence
  chemically synthesized
tagtgaaaccttactgacac

SEQ ID NO: 327485 - DNA, 20 bp, Artificial Sequence
  chemically synthesized
gtcaatagtttttcctgtgt

SEQ ID NO: 327486 - DNA, 20 bp, Artificial Sequence
  chemically synthesized
cacaggaaaaactattgacg

SEQ ID NO: 327487 - DNA, 20 bp, Artificial Sequence
  chemically synthesized
acccacatctgcttcgtcaa

SEQ ID NO: 327488 - DNA, 20 bp, Artificial Sequence
  chemically synthesized
aggaaaaactattgacgaag

SEQ ID NO: 327489 - DNA, 20 bp, Artificial Sequence
  chemically synthesized
aactattgacgaagcagatg

SEQ ID NO: 327490 - DNA, 20 bp, Artificial Sequence
  chemically synthesized
actattgacgaagcagatgt

SEQ ID NO: 327491 - DNA, 20 bp, Artificial Sequence
  chemically synthesized
gacgaagcagatgtgggtgt

SEQ ID NO: 327492 - DNA, 20 bp, Artificial Sequence
  chemically synthesized
gatgtgggtgttagtaaatt

SEQ ID NO: 327493 - DNA, 20 bp, Artificial Sequence
  chemically synthesized
ttagtaaatttagttttaca

SEQ ID NO: 327494 - DNA, 20 bp, Artificial Sequence
  chemically synthesized
tagtaaatttagttttacat

SEQ ID NO: 327495 - DNA, 20 bp, Artificial Sequence
  chemically synthesized
agtaaatttagttttacata

SEQ ID NO: 327496 - DNA, 20 bp, Artificial Sequence
  chemically synthesized
tagggtaaatttgaattgac

SEQ ID NO: 327497 - DNA, 20 bp, Artificial Sequence
  chemically synthesized
agggtaaatttgaattgact

SEQ ID NO: 327498 - DNA, 20 bp, Artificial Sequence
  chemically synthesized
cacaactttttatacattcc

SEQ ID NO: 327499 - DNA, 20 bp, Artificial Sequence
  chemically synthesized
attgactaggaatgtataaa

SEQ ID NO: 327500 - DNA, 20 bp, Artificial Sequence
  chemically synthesized
gtataaaaagttgtgtatct

SEQ ID NO: 327501 - DNA, 20 bp, Artificial Sequence
  chemically synthesized
aaaagttgtgtatctaagtt

SEQ ID NO: 327502 - DNA, 20 bp, Artificial Sequence
  chemically synthesized
aagttgtgtatctaagtttg

SEQ ID NO: 327503 - DNA, 20 bp, Artificial Sequence
  chemically synthesized
tttctgccaaactccaaact

SEQ ID NO: 327504 - DNA, 20 bp, Artificial Sequence
  chemically synthesized
gtgtatctaagtttggagtt

SEQ ID NO: 327505 - DNA, 20 bp, Artificial Sequence
  chemically synthesized
tatctaagtttggagtttgg

SEQ ID NO: 327506 - DNA, 20 bp, Artificial Sequence
  chemically synthesized
taagtttggagtttggcaga

SEQ ID NO: 327507 - DNA, 20 bp, Artificial Sequence
  chemically synthesized
ggagtttggcagaaagctct

SEQ ID NO: 327508 - DNA, 20 bp, Artificial Sequence
  chemically synthesized
tttggcagaaagctctgagc

SEQ ID NO: 327509 - DNA, 20 bp, Artificial Sequence
  chemically synthesized
ttggcagaaagctctgagct

SEQ ID NO: 327510 - DNA, 20 bp, Artificial Sequence
  chemically synthesized
tggcagaaagctctgagctg

SEQ ID NO: 327511 - DNA, 20 bp, Artificial Sequence
  chemically synthesized
caatgtttacccccagctca

SEQ ID NO: 327512 - DNA, 20 bp, Artificial Sequence
  chemically synthesized
ggcagaaagctctgagctgg

SEQ ID NO: 327513 - DNA, 20 bp, Artificial Sequence
  chemically synthesized
cccaatgtttacccccagct

SEQ ID NO: 327514 - DNA, 20 bp, Artificial Sequence
  chemically synthesized
tgcctcccaatgtttacccc

SEQ ID NO: 327515 - DNA, 20 bp, Artificial Sequence
  chemically synthesized
tctgagctgggggtaaacat

SEQ ID NO: 327516 - DNA, 20 bp, Artificial Sequence
  chemically synthesized
ctgagctgggggtaaacatt

SEQ ID NO: 327517 - DNA, 20 bp, Artificial Sequence
  chemically synthesized
gagctgggggtaaacattgg

SEQ ID NO: 327518 - DNA, 20 bp, Artificial Sequence
  chemically synthesized
agctgggggtaaacattggg

SEQ ID NO: 327519 - DNA, 20 bp, Artificial Sequence
  chemically synthesized
cattgggaggcatcaactta

SEQ ID NO: 327520 - DNA, 20 bp, Artificial Sequence
  chemically synthesized
gggaggcatcaacttacaga

SEQ ID NO: 327521 - DNA, 20 bp, Artificial Sequence
  chemically synthesized
tggcatcaaatactgtctgt

SEQ ID NO: 327522 - DNA, 20 bp, Artificial Sequence
  chemically synthesized
ttacagacagtatttgatgc

SEQ ID NO: 327523 - DNA, 20 bp, Artificial Sequence
  chemically synthesized
tacagacagtatttgatgcc

SEQ ID NO: 327524 - DNA, 20 bp, Artificial Sequence
  chemically synthesized
cagacagtatttgatgccag

SEQ ID NO: 327525 - DNA, 20 bp, Artificial Sequence
  chemically synthesized
agacagtatttgatgccagg

SEQ ID NO: 327526 - DNA, 20 bp, Artificial Sequence
  chemically synthesized
agtatttgatgccaggaggc

SEQ ID NO: 327527 - DNA, 20 bp, Artificial Sequence
  chemically synthesized
gatgatcttatctagcctcc

SEQ ID NO: 327528 - DNA, 20 bp, Artificial Sequence
  chemically synthesized
ttgatgccaggaggctagat

SEQ ID NO: 327529 - DNA, 20 bp, Artificial Sequence
  chemically synthesized
attttctcgatgatcttatc

SEQ ID NO: 327530 - DNA, 20 bp, Artificial Sequence
  chemically synthesized
ggaggctagataagatcatc

SEQ ID NO: 327531 - DNA, 20 bp, Artificial Sequence
  chemically synthesized
gatcatcgagaaaatgaatg

SEQ ID NO: 327532 - DNA, 20 bp, Artificial Sequence
  chemically synthesized
cgagaaaatgaatgtggtct

SEQ ID NO: 327533 - DNA, 20 bp, Artificial Sequence
  chemically synthesized
agtaaccaggggttggttct

SEQ ID NO: 327534 - DNA, 20 bp, Artificial Sequence
  chemically synthesized
gtggtctaagaaccaacccc

SEQ ID NO: 327535 - DNA, 20 bp, Artificial Sequence
  chemically synthesized
atatgacagtaaccaggggt

SEQ ID NO: 327536 - DNA, 20 bp, Artificial Sequence
  chemically synthesized
cctgatatgacagtaaccag

SEQ ID NO: 327537 - DNA, 20 bp, Artificial Sequence
  chemically synthesized
tcctgatatgacagtaacca

SEQ ID NO: 327538 - DNA, 20 bp, Artificial Sequence
  chemically synthesized
ttcctgatatgacagtaacc

SEQ ID NO: 327539 - DNA, 20 bp, Artificial Sequence
  chemically synthesized
attcctgatatgacagtaac

SEQ ID NO: 327540 - DNA, 20 bp, Artificial Sequence
  chemically synthesized
acccctggttactgtcatat

SEQ ID NO: 327541 - DNA, 20 bp, Artificial Sequence
  chemically synthesized
cccctggttactgtcatatc

SEQ ID NO: 327542 - DNA, 20 bp, Artificial Sequence
  chemically synthesized
aacacaaattcctgatatga

SEQ ID NO: 327543 - DNA, 20 bp, Artificial Sequence
  chemically synthesized
atatcaggaatttgtgttga

SEQ ID NO: 327544 - DNA, 20 bp, Artificial Sequence
  chemically synthesized
tatcaggaatttgtgttgat

SEQ ID NO: 327545 - DNA, 20 bp, Artificial Sequence
  chemically synthesized
atcaggaatttgtgttgatg

SEQ ID NO: 327546 - DNA, 20 bp, Artificial Sequence
  chemically synthesized
aggaatttgtgttgatgggg

SEQ ID NO: 327547 - DNA, 20 bp, Artificial Sequence
  chemically synthesized
ttgtgttgatggggaagaac

SEQ ID NO: 327548 - DNA, 20 bp, Artificial Sequence
  chemically synthesized
ctgctttgattttaatttgc

SEQ ID NO: 327549 - DNA, 20 bp, Artificial Sequence
  chemically synthesized
gaaccagcaaattaaaatca

SEQ ID NO: 327550 - DNA, 20 bp, Artificial Sequence
  chemically synthesized
ccagcaaattaaaatcaaag

SEQ ID NO: 327551 - DNA, 20 bp, Artificial Sequence
  chemically synthesized
attaaaatcaaagcagatgc

SEQ ID NO: 327552 - DNA, 20 bp, Artificial Sequence
  chemically synthesized
caaagcagatgctagaaaaa

SEQ ID NO: 327553 - DNA, 20 bp, Artificial Sequence
  chemically synthesized
aaagcagatgctagaaaaac

SEQ ID NO: 327554 - DNA, 20 bp, Artificial Sequence
  chemically synthesized
aggttttcttcctgtttttc

SEQ ID NO: 327555 - DNA, 20 bp, Artificial Sequence
  chemically synthesized
gcagatgctagaaaaacagg

SEQ ID NO: 327556 - DNA, 20 bp, Artificial Sequence
  chemically synthesized
agaaaaacaggaagaaaacc

SEQ ID NO: 327557 - DNA, 20 bp, Artificial Sequence
  chemically synthesized
tctaaggcaccacacattcc

SEQ ID NO: 327558 - DNA, 20 bp, Artificial Sequence
  chemically synthesized
ggaagaaaacctggaatgtg

SEQ ID NO: 327559 - DNA, 20 bp, Artificial Sequence
  chemically synthesized
ttctaaggcaccacacattc

SEQ ID NO: 327560 - DNA, 20 bp, Artificial Sequence
  chemically synthesized
acctggaatgtgtggtgcct

SEQ ID NO: 327561 - DNA, 20 bp, Artificial Sequence
  chemically synthesized
tttcccctctttgatttcta

SEQ ID NO: 327562 - DNA, 20 bp, Artificial Sequence
  chemically synthesized
ctttcccctctttgatttct

SEQ ID NO: 327563 - DNA, 20 bp, Artificial Sequence
  chemically synthesized
gtgtggtgccttagaaatca

SEQ ID NO: 327564 - DNA, 20 bp, Artificial Sequence
  chemically synthesized
gtggtgccttagaaatcaaa

SEQ ID NO: 327565 - DNA, 20 bp, Artificial Sequence
  chemically synthesized
tggtgccttagaaatcaaag

SEQ ID NO: 327566 - DNA, 20 bp, Artificial Sequence
  chemically synthesized
ggtgccttagaaatcaaaga

SEQ ID NO: 327567 - DNA, 20 bp, Artificial Sequence
  chemically synthesized
gtgccttagaaatcaaagag

SEQ ID NO: 327568 - DNA, 20 bp, Artificial Sequence
  chemically synthesized
cttagaaatcaaagagggga

SEQ ID NO: 327569 - DNA, 20 bp, Artificial Sequence
  chemically synthesized
aagtaaatgtaggaggattt

SEQ ID NO: 327570 - DNA, 20 bp, Artificial Sequence
  chemically synthesized
gtaacttaagtaaatgtagg

SEQ ID NO: 327571 - DNA, 20 bp, Artificial Sequence
  chemically synthesized
agtaacttaagtaaatgtag

SEQ ID NO: 327572 - DNA, 20 bp, Artificial Sequence
  chemically synthesized
taagtaacttaagtaaatgt

SEQ ID NO: 327573 - DNA, 20 bp, Artificial Sequence
  chemically synthesized
ttaagtaacttaagtaaatg

SEQ ID NO: 327574 - DNA, 20 bp, Artificial Sequence
  chemically synthesized
aaatcctcctacatttactt

SEQ ID NO: 327575 - DNA, 20 bp, Artificial Sequence
  chemically synthesized
ctacctaaattaagtaactt

SEQ ID NO: 327576 - DNA, 20 bp, Artificial Sequence
  chemically synthesized
tttacttaagttacttaatt

SEQ ID NO: 327577 - DNA, 20 bp, Artificial Sequence
  chemically synthesized
ttacttaagttacttaattt

SEQ ID NO: 327578 - DNA, 20 bp, Artificial Sequence
  chemically synthesized
ttatatgtactacctaaatt

SEQ ID NO: 327579 - DNA, 20 bp, Artificial Sequence
  chemically synthesized
cttaagttacttaatttagg

SEQ ID NO: 327580 - DNA, 20 bp, Artificial Sequence
  chemically synthesized
ttaatttaggtagtacatat

SEQ ID NO: 327581 - DNA, 20 bp, Artificial Sequence
  chemically synthesized
taatttaggtagtacatata

SEQ ID NO: 327582 - DNA, 20 bp, Artificial Sequence
  chemically synthesized
atataaggaatctcacattg

SEQ ID NO: 327583 - DNA, 20 bp, Artificial Sequence
  chemically synthesized
cagtatgctagccacaatgt

SEQ ID NO: 327584 - DNA, 20 bp, Artificial Sequence
  chemically synthesized
aaggaatctcacattgtggc

SEQ ID NO: 327585 - DNA, 20 bp, Artificial Sequence
  chemically synthesized
attaagtttttacagtatgc

SEQ ID NO: 327586 - DNA, 20 bp, Artificial Sequence
  chemically synthesized
aaacatttattaagttttta

SEQ ID NO: 327587 - DNA, 20 bp, Artificial Sequence
  chemically synthesized
ttgttcaacaaacatttatt

SEQ ID NO: 327588 - DNA, 20 bp, Artificial Sequence
  chemically synthesized
tatcctgatatatgttggtt

SEQ ID NO: 327589 - DNA, 20 bp, Artificial Sequence
  chemically synthesized
gtatcctgatatatgttggt

SEQ ID NO: 327590 - DNA, 20 bp, Artificial Sequence
  chemically synthesized
accagtatcctgatatatgt

SEQ ID NO: 327591 - DNA, 20 bp, Artificial Sequence
  chemically synthesized
ataacccaaccaacatatat

SEQ ID NO: 327592 - DNA, 20 bp, Artificial Sequence
  chemically synthesized
taacccaaccaacatatatc

SEQ ID NO: 327593 - DNA, 20 bp, Artificial Sequence
  chemically synthesized
accaacatatatcaggatac

SEQ ID NO: 327594 - DNA, 20 bp, Artificial Sequence
  chemically synthesized
tattctgcatatatcacaac

SEQ ID NO: 327595 - DNA, 20 bp, Artificial Sequence
  chemically synthesized
gatactggttgtgatatatg

SEQ ID NO: 327596 - DNA, 20 bp, Artificial Sequence
  chemically synthesized
tgatatatgcagaatacatt

SEQ ID NO: 327597 - DNA, 20 bp, Artificial Sequence
  chemically synthesized
gcagaatacatttggcaatt

SEQ ID NO: 327598 - DNA, 20 bp, Artificial Sequence
  chemically synthesized
tagcatgtttgataatatat

SEQ ID NO: 327599 - DNA, 20 bp, Artificial Sequence
  chemically synthesized
caatatattatcaaacatgc

SEQ ID NO: 327600 - DNA, 20 bp, Artificial Sequence
  chemically synthesized
atatattatcaaacatgcta

SEQ ID NO: 327601 - DNA, 20 bp, Artificial Sequence
  chemically synthesized
tattatcaaacatgctagag

SEQ ID NO: 327602 - DNA, 20 bp, Artificial Sequence
  chemically synthesized
ctcggtacactacacttctc

SEQ ID NO: 327603 - DNA, 20 bp, Artificial Sequence
  chemically synthesized
tcaaacatgctagagaagtg

SEQ ID NO: 327604 - DNA, 20 bp, Artificial Sequence
  chemically synthesized
ctagagaagtgtagtgtacc

SEQ ID NO: 327605 - DNA, 20 bp, Artificial Sequence
  chemically synthesized
agtgtagtgtaccgagaatt

SEQ ID NO: 327606 - DNA, 20 bp, Artificial Sequence
  chemically synthesized
cagcccatattcttaattct

SEQ ID NO: 327607 - DNA, 20 bp, Artificial Sequence
  chemically synthesized
tgtaccgagaattaagaata

SEQ ID NO: 327608 - DNA, 20 bp, Artificial Sequence
  chemically synthesized
gtaccgagaattaagaatat

SEQ ID NO: 327609 - DNA, 20 bp, Artificial Sequence
  chemically synthesized
agaattaagaatatgggctg

SEQ ID NO: 327610 - DNA, 20 bp, Artificial Sequence
  chemically synthesized
gtctagatattttgattcca

SEQ ID NO: 327611 - DNA, 20 bp, Artificial Sequence
  chemically synthesized
ggctgtggaatcaaaatatc

SEQ ID NO: 327612 - DNA, 20 bp, Artificial Sequence
  chemically synthesized
tacagaaaagaatttgagtc

SEQ ID NO: 327613 - DNA, 20 bp, Artificial Sequence
  chemically synthesized
agtggtacagaaaagaattt

SEQ ID NO: 327614 - DNA, 20 bp, Artificial Sequence
  chemically synthesized
taaggttcagtggtacagaa

SEQ ID NO: 327615 - DNA, 20 bp, Artificial Sequence
  chemically synthesized
aacactaaggttcagtggta

SEQ ID NO: 327616 - DNA, 20 bp, Artificial Sequence
  chemically synthesized
acgagaacactaaggttcag

SEQ ID NO: 327617 - DNA, 20 bp, Artificial Sequence
  chemically synthesized
ttttctgtaccactgaacct

SEQ ID NO: 327618 - DNA, 20 bp, Artificial Sequence
  chemically synthesized
cagacgagaacactaaggtt

SEQ ID NO: 327619 - DNA, 20 bp, Artificial Sequence
  chemically synthesized
attttcagacgagaacacta

SEQ ID NO: 327620 - DNA, 20 bp, Artificial Sequence
  chemically synthesized
cattttcagacgagaacact

SEQ ID NO: 327621 - DNA, 20 bp, Artificial Sequence
  chemically synthesized
tgttattcccattttcagac

SEQ ID NO: 327622 - DNA, 20 bp, Artificial Sequence
  chemically synthesized
ttagtgttctcgtctgaaaa

SEQ ID NO: 327623 - DNA, 20 bp, Artificial Sequence
  chemically synthesized
tagtgttctcgtctgaaaat

SEQ ID NO: 327624 - DNA, 20 bp, Artificial Sequence
  chemically synthesized
attcttgttattcccatttt

SEQ ID NO: 327625 - DNA, 20 bp, Artificial Sequence
  chemically synthesized
cgtctgaaaatgggaataac

SEQ ID NO: 327626 - DNA, 20 bp, Artificial Sequence
  chemically synthesized
agaatataaactcctaatgt

SEQ ID NO: 327627 - DNA, 20 bp, Artificial Sequence
  chemically synthesized
acttagcttaccaacattag

SEQ ID NO: 327628 - DNA, 20 bp, Artificial Sequence
  chemically synthesized
taacttagcttaccaacatt

SEQ ID NO: 327629 - DNA, 20 bp, Artificial Sequence
  chemically synthesized
ttaacttagcttaccaacat

SEQ ID NO: 327630 - DNA, 20 bp, Artificial Sequence
  chemically synthesized
tataaactcctaatgttggt

SEQ ID NO: 327631 - DNA, 20 bp, Artificial Sequence
  chemically synthesized
actcctaatgttggtaagct

SEQ ID NO: 327632 - DNA, 20 bp, Artificial Sequence
  chemically synthesized
tattattaacatgtttaact

SEQ ID NO: 327633 - DNA, 20 bp, Artificial Sequence
  chemically synthesized
acatgttaataatatacata

SEQ ID NO: 327634 - DNA, 20 bp, Artificial Sequence
  chemically synthesized
ttaataatatacatacagca

SEQ ID NO: 327635 - DNA, 20 bp, Artificial Sequence
  chemically synthesized
ataatatacatacagcatgg

SEQ ID NO: 327636 - DNA, 20 bp, Artificial Sequence
  chemically synthesized
acatacagcatggaagaacc

SEQ ID NO: 327637 - DNA, 20 bp, Artificial Sequence
  chemically synthesized
gcatggaagaacctggtctt

SEQ ID NO: 327638 - DNA, 20 bp, Artificial Sequence
  chemically synthesized
ttgaggatttactgaagacc

SEQ ID NO: 327639 - DNA, 20 bp, Artificial Sequence
  chemically synthesized
gttgaggatttactgaagac

SEQ ID NO: 327640 - DNA, 20 bp, Artificial Sequence
  chemically synthesized
aatttgttgaggatttactg

SEQ ID NO: 327641 - DNA, 20 bp, Artificial Sequence
  chemically synthesized
cacaataacaaaatttgttg

SEQ ID NO: 327642 - DNA, 20 bp, Artificial Sequence
  chemically synthesized
gcacaataacaaaatttgtt

SEQ ID NO: 327643 - DNA, 20 bp, Artificial Sequence
  chemically synthesized
attttgttattgtgccaatt

SEQ ID NO: 327644 - DNA, 20 bp, Artificial Sequence
  chemically synthesized
ttttgttattgtgccaatta

SEQ ID NO: 327645 - DNA, 20 bp, Artificial Sequence
  chemically synthesized
cttcttaagtgtgccttaat

SEQ ID NO: 327646 - DNA, 20 bp, Artificial Sequence
  chemically synthesized
gtgccaattaaggcacactt

SEQ ID NO: 327647 - DNA, 20 bp, Artificial Sequence
  chemically synthesized
ccaattaaggcacacttaag

SEQ ID NO: 327648 - DNA, 20 bp, Artificial Sequence
  chemically synthesized
tacataagacattgcttctt

SEQ ID NO: 327649 - DNA, 20 bp, Artificial Sequence
  chemically synthesized
ttagtattaattgaatacat

SEQ ID NO: 327650 - DNA, 20 bp, Artificial Sequence
  chemically synthesized
tattcaattaatactaaaat

SEQ ID NO: 327651 - DNA, 20 bp, Artificial Sequence
  chemically synthesized
tccacaatatgtgctcattt

SEQ ID NO: 327652 - DNA, 20 bp, Artificial Sequence
  chemically synthesized
actaaaatgagcacatattg

SEQ ID NO: 327653 - DNA, 20 bp, Artificial Sequence
  chemically synthesized
ctaagtgagtgattaataca

SEQ ID NO: 327654 - DNA, 20 bp, Artificial Sequence
  chemically synthesized
ctatgtattaatcactcact

SEQ ID NO: 327655 - DNA, 20 bp, Artificial Sequence
  chemically synthesized
atatccattgtgatctaagt

SEQ ID NO: 327656 - DNA, 20 bp, Artificial Sequence
  chemically synthesized
ctttatatccattgtgatct

SEQ ID NO: 327657 - DNA, 20 bp, Artificial Sequence
  chemically synthesized
atcactcacttagatcacaa

SEQ ID NO: 327658 - DNA, 20 bp, Artificial Sequence
  chemically synthesized
cttagatcacaatggatata

SEQ ID NO: 327659 - DNA, 20 bp, Artificial Sequence
  chemically synthesized
acaatggatataaagaataa

SEQ ID NO: 327660 - DNA, 20 bp, Artificial Sequence
  chemically synthesized
aatggatataaagaataaaa

SEQ ID NO: 327661 - DNA, 20 bp, Artificial Sequence
  chemically synthesized
agaataaaagagctgccctc

SEQ ID NO: 327662 - DNA, 20 bp, Artificial Sequence
  chemically synthesized
gaataaaagagctgccctca

SEQ ID NO: 327663 - DNA, 20 bp, Artificial Sequence
  chemically synthesized
gactatgatttccttgaggg

SEQ ID NO: 327664 - DNA, 20 bp, Artificial Sequence
  chemically synthesized
ctggactatgatttccttga

SEQ ID NO: 327665 - DNA, 20 bp, Artificial Sequence
  chemically synthesized
actggactatgatttccttg

SEQ ID NO: 327666 - DNA, 20 bp, Artificial Sequence
  chemically synthesized
cactggactatgatttcctt

SEQ ID NO: 327667 - DNA, 20 bp, Artificial Sequence
  chemically synthesized
agctgccctcaaggaaatca

SEQ ID NO: 327668 - DNA, 20 bp, Artificial Sequence
  chemically synthesized
ccctcaaggaaatcatagtc

SEQ ID NO: 327669 - DNA, 20 bp, Artificial Sequence
  chemically synthesized
tcaaggaaatcatagtccag

SEQ ID NO: 327670 - DNA, 20 bp, Artificial Sequence
  chemically synthesized
aaggaaatcatagtccagtg

SEQ ID NO: 327671 - DNA, 20 bp, Artificial Sequence
  chemically synthesized
aggaaatcatagtccagtgg

SEQ ID NO: 327672 - DNA, 20 bp, Artificial Sequence
  chemically synthesized
tacttgtaggtttcctccac

SEQ ID NO: 327673 - DNA, 20 bp, Artificial Sequence
  chemically synthesized
gtccagtggaggaaacctac

SEQ ID NO: 327674 - DNA, 20 bp, Artificial Sequence
  chemically synthesized
agtggaggaaacctacaagt

SEQ ID NO: 327675 - DNA, 20 bp, Artificial Sequence
  chemically synthesized
tatattttttgcttacttgt

SEQ ID NO: 327676 - DNA, 20 bp, Artificial Sequence
  chemically synthesized
atatattttttgcttacttg

SEQ ID NO: 327677 - DNA, 20 bp, Artificial Sequence
  chemically synthesized
aaaaatatatgtgctctcat

SEQ ID NO: 327678 - DNA, 20 bp, Artificial Sequence
  chemically synthesized
tcttggacgtgttcttatga

SEQ ID NO: 327679 - DNA, 20 bp, Artificial Sequence
  chemically synthesized
cttcttggacgtgttcttat

SEQ ID NO: 327680 - DNA, 20 bp, Artificial Sequence
  chemically synthesized
gctctcataagaacacgtcc

SEQ ID NO: 327681 - DNA, 20 bp, Artificial Sequence
  chemically synthesized
ctcataagaacacgtccaag

SEQ ID NO: 327682 - DNA, 20 bp, Artificial Sequence
  chemically synthesized
tcaatgcttccatttcttct

SEQ ID NO: 327683 - DNA, 20 bp, Artificial Sequence
  chemically synthesized
agaacacgtccaagaagaaa

SEQ ID NO: 327684 - DNA, 20 bp, Artificial Sequence
  chemically synthesized
acacgtccaagaagaaatgg

SEQ ID NO: 327685 - DNA, 20 bp, Artificial Sequence
  chemically synthesized
gaagaaatggaagcattgaa

SEQ ID NO: 327686 - DNA, 20 bp, Artificial Sequence
  chemically synthesized
aagaaatggaagcattgaaa

SEQ ID NO: 327687 - DNA, 20 bp, Artificial Sequence
  chemically synthesized
agaaatggaagcattgaaaa

SEQ ID NO: 327688 - DNA, 20 bp, Artificial Sequence
  chemically synthesized
aatggaagcattgaaaaggg

SEQ ID NO: 327689 - DNA, 20 bp, Artificial Sequence
  chemically synthesized
agggaagcgaaatatgaact

SEQ ID NO: 327690 - DNA, 20 bp, Artificial Sequence
  chemically synthesized
gaagcgaaatatgaactgag

SEQ ID NO: 327691 - DNA, 20 bp, Artificial Sequence
  chemically synthesized
gcgaaatatgaactgagaag

SEQ ID NO: 327692 - DNA, 20 bp, Artificial Sequence
  chemically synthesized
cgaaatatgaactgagaagt

SEQ ID NO: 327693 - DNA, 20 bp, Artificial Sequence
  chemically synthesized
gtgtaaaaattcctacttct

SEQ ID NO: 327694 - DNA, 20 bp, Artificial Sequence
  chemically synthesized
aggaatttttacacactact

SEQ ID NO: 327695 - DNA, 20 bp, Artificial Sequence
  chemically synthesized
ctaacttgacaaggtcttag

SEQ ID NO: 327696 - DNA, 20 bp, Artificial Sequence
  chemically synthesized
acactaacttgacaaggtct

SEQ ID NO: 327697 - DNA, 20 bp, Artificial Sequence
  chemically synthesized
cacactactaagaccttgtc

SEQ ID NO: 327698 - DNA, 20 bp, Artificial Sequence
  chemically synthesized
gggaagacactaacttgaca

SEQ ID NO: 327699 - DNA, 20 bp, Artificial Sequence
  chemically synthesized
ctactaagaccttgtcaagt

SEQ ID NO: 327700 - DNA, 20 bp, Artificial Sequence
  chemically synthesized
agggaagacactaacttgac

SEQ ID NO: 327701 - DNA, 20 bp, Artificial Sequence
  chemically synthesized
caagttagtgtcttccctta

SEQ ID NO: 327702 - DNA, 20 bp, Artificial Sequence
  chemically synthesized
tagacatggcgccataaggg

SEQ ID NO: 327703 - DNA, 20 bp, Artificial Sequence
  chemically synthesized
tattagacatggcgccataa

SEQ ID NO: 327704 - DNA, 20 bp, Artificial Sequence
  chemically synthesized
gtattagacatggcgccata

SEQ ID NO: 327705 - DNA, 20 bp, Artificial Sequence
  chemically synthesized
tgtattagacatggcgccat

SEQ ID NO: 327706 - DNA, 20 bp, Artificial Sequence
  chemically synthesized
aacgctgagtgtattagaca

SEQ ID NO: 327707 - DNA, 20 bp, Artificial Sequence
  chemically synthesized
ggcgccatgtctaatacact

SEQ ID NO: 327708 - DNA, 20 bp, Artificial Sequence
  chemically synthesized
tgaaacaacgctgagtgtat

SEQ ID NO: 327709 - DNA, 20 bp, Artificial Sequence
  chemically synthesized
cacgttgatgaaacaacgct

SEQ ID NO: 327710 - DNA, 20 bp, Artificial Sequence
  chemically synthesized
gtttcatcaacgtgttttcc

SEQ ID NO: 327711 - DNA, 20 bp, Artificial Sequence
  chemically synthesized
aattcccccaaaagattacc

SEQ ID NO: 327712 - DNA, 20 bp, Artificial Sequence
  chemically synthesized
caattcccccaaaagattac

SEQ ID NO: 327713 - DNA, 20 bp, Artificial Sequence
  chemically synthesized
gtgttttcccggtaatcttt

SEQ ID NO: 327714 - DNA, 20 bp, Artificial Sequence
  chemically synthesized
tgttttcccggtaatctttt

SEQ ID NO: 327715 - DNA, 20 bp, Artificial Sequence
  chemically synthesized
gttttcccggtaatcttttg

SEQ ID NO: 327716 - DNA, 20 bp, Artificial Sequence
  chemically synthesized
ttttcccggtaatcttttgg

SEQ ID NO: 327717 - DNA, 20 bp, Artificial Sequence
  chemically synthesized
ttgactgtcaattcccccaa

SEQ ID NO: 327718 - DNA, 20 bp, Artificial Sequence
  chemically synthesized
taatcttttgggggaattga

SEQ ID NO: 327719 - DNA, 20 bp, Artificial Sequence
  chemically synthesized
gacagtcaaaccatgaacat

SEQ ID NO: 327720 - DNA, 20 bp, Artificial Sequence
  chemically synthesized
aaatgtagtaccaatgttca

SEQ ID NO: 327721 - DNA, 20 bp, Artificial Sequence
  chemically synthesized
atctttcataaatataaatg

SEQ ID NO: 327722 - DNA, 20 bp, Artificial Sequence
  chemically synthesized
tactacatttatatttatga

SEQ ID NO: 327723 - DNA, 20 bp, Artificial Sequence
  chemically synthesized
atatttatgaaagatcattc

SEQ ID NO: 327724 - DNA, 20 bp, Artificial Sequence
  chemically synthesized
atgaaagatcattctggatg

SEQ ID NO: 327725 - DNA, 20 bp, Artificial Sequence
  chemically synthesized
atcattctccacactgcatc

SEQ ID NO: 327726 - DNA, 20 bp, Artificial Sequence
  chemically synthesized
agatcattctggatgcagtg

SEQ ID NO: 327727 - DNA, 20 bp, Artificial Sequence
  chemically synthesized
atcattctggatgcagtgtg

SEQ ID NO: 327728 - DNA, 20 bp, Artificial Sequence
  chemically synthesized
gcagtgtggagaatgatcta

SEQ ID NO: 327729 - DNA, 20 bp, Artificial Sequence
  chemically synthesized
gtgtggagaatgatctatgg

SEQ ID NO: 327730 - DNA, 20 bp, Artificial Sequence
  chemically synthesized
cttgctgccctcatcttcca

SEQ ID NO: 327731 - DNA, 20 bp, Artificial Sequence
  chemically synthesized
gagaatgatctatggaagat

SEQ ID NO: 327732 - DNA, 20 bp, Artificial Sequence
  chemically synthesized
agaatgatctatggaagatg

SEQ ID NO: 327733 - DNA, 20 bp, Artificial Sequence
  chemically synthesized
gaatgatctatggaagatga

SEQ ID NO: 327734 - DNA, 20 bp, Artificial Sequence
  chemically synthesized
tgatctatggaagatgaggg

SEQ ID NO: 327735 - DNA, 20 bp, Artificial Sequence
  chemically synthesized
ctatggaagatgagggcagc

SEQ ID NO: 327736 - DNA, 20 bp, Artificial Sequence
  chemically synthesized
gaagatgagggcagcaagac

SEQ ID NO: 327737 - DNA, 20 bp, Artificial Sequence
  chemically synthesized
atgagggcagcaagaccagt

SEQ ID NO: 327738 - DNA, 20 bp, Artificial Sequence
  chemically synthesized
tcattcactggatatctaac

SEQ ID NO: 327739 - DNA, 20 bp, Artificial Sequence
  chemically synthesized
agcaagaccagttagatatc

SEQ ID NO: 327740 - DNA, 20 bp, Artificial Sequence
  chemically synthesized
tattacatactgtcattcac

SEQ ID NO: 327741 - DNA, 20 bp, Artificial Sequence
  chemically synthesized
gttagatatccagtgaatga

SEQ ID NO: 327742 - DNA, 20 bp, Artificial Sequence
  chemically synthesized
cagtgaatgacagtatgtaa

SEQ ID NO: 327743 - DNA, 20 bp, Artificial Sequence
  chemically synthesized
gaatgacagtatgtaatagt

SEQ ID NO: 327744 - DNA, 20 bp, Artificial Sequence
  chemically synthesized
gagttcttatggcagcagtc

SEQ ID NO: 327745 - DNA, 20 bp, Artificial Sequence
  chemically synthesized
tgagttcttatggcagcagt

SEQ ID NO: 327746 - DNA, 20 bp, Artificial Sequence
  chemically synthesized
cagaacctgactgctgccat

SEQ ID NO: 327747 - DNA, 20 bp, Artificial Sequence
  chemically synthesized
ttcttgagttcttatggcag

SEQ ID NO: 327748 - DNA, 20 bp, Artificial Sequence
  chemically synthesized
cagttcttgagttcttatgg

SEQ ID NO: 327749 - DNA, 20 bp, Artificial Sequence
  chemically synthesized
caacagttcttgagttctta

SEQ ID NO: 327750 - DNA, 20 bp, Artificial Sequence
  chemically synthesized
gactgctgccataagaactc

SEQ ID NO: 327751 - DNA, 20 bp, Artificial Sequence
  chemically synthesized
tcattttttcaacagttctt

SEQ ID NO: 327752 - DNA, 20 bp, Artificial Sequence
  chemically synthesized
tcatcaattcattttttcaa

SEQ ID NO: 327753 - DNA, 20 bp, Artificial Sequence
  chemically synthesized
tgttgaaaaaatgaattgat

SEQ ID NO: 327754 - DNA, 20 bp, Artificial Sequence
  chemically synthesized
gaattgatgagatatatact

SEQ ID NO: 327755 - DNA, 20 bp, Artificial Sequence
  chemically synthesized
aattgatgagatatatactg

SEQ ID NO: 327756 - DNA, 20 bp, Artificial Sequence
  chemically synthesized
ttctgttttgttgaagtcct

SEQ ID NO: 327757 - DNA, 20 bp, Artificial Sequence
  chemically synthesized
tccctacttctgttttgttg

SEQ ID NO: 327758 - DNA, 20 bp, Artificial Sequence
  chemically synthesized
tactgaggacttcaacaaaa

SEQ ID NO: 327759 - DNA, 20 bp, Artificial Sequence
  chemically synthesized
tgaggacttcaacaaaacag

SEQ ID NO: 327760 - DNA, 20 bp, Artificial Sequence
  chemically synthesized
ggacttcaacaaaacagaag

SEQ ID NO: 327761 - DNA, 20 bp, Artificial Sequence
  chemically synthesized
gacttcaacaaaacagaagt

SEQ ID NO: 327762 - DNA, 20 bp, Artificial Sequence
  chemically synthesized
acttcaacaaaacagaagta

SEQ ID NO: 327763 - DNA, 20 bp, Artificial Sequence
  chemically synthesized
caacaaaacagaagtaggga

SEQ ID NO: 327764 - DNA, 20 bp, Artificial Sequence
  chemically synthesized
acaaaacagaagtagggaaa

SEQ ID NO: 327765 - DNA, 20 bp, Artificial Sequence
  chemically synthesized
caaaacagaagtagggaaag

SEQ ID NO: 327766 - DNA, 20 bp, Artificial Sequence
  chemically synthesized
aaaacagaagtagggaaaga

SEQ ID NO: 327767 - DNA, 20 bp, Artificial Sequence
  chemically synthesized
aaacagaagtagggaaagag

SEQ ID NO: 327768 - DNA, 20 bp, Artificial Sequence
  chemically synthesized
aacagaagtagggaaagagg

SEQ ID NO: 327769 - DNA, 20 bp, Artificial Sequence
  chemically synthesized
cagaagtagggaaagagggg

SEQ ID NO: 327770 - DNA, 20 bp, Artificial Sequence
  chemically synthesized
agggaaagagggggagatga

SEQ ID NO: 327771 - DNA, 20 bp, Artificial Sequence
  chemically synthesized
tctaagatcatatatgtcag

SEQ ID NO: 327772 - DNA, 20 bp, Artificial Sequence
  chemically synthesized
cactctaagatcatatatgt

SEQ ID NO: 327773 - DNA, 20 bp, Artificial Sequence
  chemically synthesized
acttctgacatatatgatct

SEQ ID NO: 327774 - DNA, 20 bp, Artificial Sequence
  chemically synthesized
ttctgacatatatgatctta

SEQ ID NO: 327775 - DNA, 20 bp, Artificial Sequence
  chemically synthesized
gcccacgtccaatacactct

SEQ ID NO: 327776 - DNA, 20 bp, Artificial Sequence
  chemically synthesized
tatatgatcttagagtgtat

SEQ ID NO: 327777 - DNA, 20 bp, Artificial Sequence
  chemically synthesized
atcttagagtgtattggacg

SEQ ID NO: 327778 - DNA, 20 bp, Artificial Sequence
  chemically synthesized
tcttagagtgtattggacgt

SEQ ID NO: 327779 - DNA, 20 bp, Artificial Sequence
  chemically synthesized
tactgtccttgtcatattta

SEQ ID NO: 327780 - DNA, 20 bp, Artificial Sequence
  chemically synthesized
gtgggcactataaatatgac

SEQ ID NO: 327781 - DNA, 20 bp, Artificial Sequence
  chemically synthesized
tgggcactataaatatgaca

SEQ ID NO: 327782 - DNA, 20 bp, Artificial Sequence
  chemically synthesized
cactataaatatgacaagga

SEQ ID NO: 327783 - DNA, 20 bp, Artificial Sequence
  chemically synthesized
taaatatgacaaggacagta

SEQ ID NO: 327784 - DNA, 20 bp, Artificial Sequence
  chemically synthesized
acaaggacagtacagttgtt

SEQ ID NO: 327785 - DNA, 20 bp, Artificial Sequence
  chemically synthesized
cagttgttgagaatgattcc

SEQ ID NO: 327786 - DNA, 20 bp, Artificial Sequence
  chemically synthesized
agttgttgagaatgattcct

SEQ ID NO: 327787 - DNA, 20 bp, Artificial Sequence
  chemically synthesized
aataataaaaaaagacacct

SEQ ID NO: 327788 - DNA, 20 bp, Artificial Sequence
  chemically synthesized
taataataaaaaaagacacc

SEQ ID NO: 327789 - DNA, 20 bp, Artificial Sequence
  chemically synthesized
ttgaagtataataataaaaa

SEQ ID NO: 327790 - DNA, 20 bp, Artificial Sequence
  chemically synthesized
tttttttattattatacttc

SEQ ID NO: 327791 - DNA, 20 bp, Artificial Sequence
  chemically synthesized
tattattatacttcaagttc

SEQ ID NO: 327792 - DNA, 20 bp, Artificial Sequence
  chemically synthesized
cacatgtatcccagaacttg

SEQ ID NO: 327793 - DNA, 20 bp, Artificial Sequence
  chemically synthesized
attattatacttcaagttct

SEQ ID NO: 327794 - DNA, 20 bp, Artificial Sequence
  chemically synthesized
cacgttctgcacatgtatcc

SEQ ID NO: 327795 - DNA, 20 bp, Artificial Sequence
  chemically synthesized
caagttctgggatacatgtg

SEQ ID NO: 327796 - DNA, 20 bp, Artificial Sequence
  chemically synthesized
ggatacatgtgcagaacgtg

SEQ ID NO: 327797 - DNA, 20 bp, Artificial Sequence
  chemically synthesized
gatacatgtgcagaacgtgc

SEQ ID NO: 327798 - DNA, 20 bp, Artificial Sequence
  chemically synthesized
acataaatatacatgtgcta

SEQ ID NO: 327799 - DNA, 20 bp, Artificial Sequence
  chemically synthesized
taaatatacatgtgctatag

SEQ ID NO: 327800 - DNA, 20 bp, Artificial Sequence
  chemically synthesized
atgggtgcagcaaaccacta

SEQ ID NO: 327801 - DNA, 20 bp, Artificial Sequence
  chemically synthesized
ggatgacgggttgatgggtg

SEQ ID NO: 327802 - DNA, 20 bp, Artificial Sequence
  chemically synthesized
aacctggatgacgggttgat

SEQ ID NO: 327803 - DNA, 20 bp, Artificial Sequence
  chemically synthesized
aaacctggatgacgggttga

SEQ ID NO: 327804 - DNA, 20 bp, Artificial Sequence
  chemically synthesized
gcacccatcaacccgtcatc

SEQ ID NO: 327805 - DNA, 20 bp, Artificial Sequence
  chemically synthesized
cacccatcaacccgtcatcc

SEQ ID NO: 327806 - DNA, 20 bp, Artificial Sequence
  chemically synthesized
gggcttaaaacctggatgac

SEQ ID NO: 327807 - DNA, 20 bp, Artificial Sequence
  chemically synthesized
agggcttaaaacctggatga

SEQ ID NO: 327808 - DNA, 20 bp, Artificial Sequence
  chemically synthesized
caacccgtcatccaggtttt

SEQ ID NO: 327809 - DNA, 20 bp, Artificial Sequence
  chemically synthesized
tgcatgcagggcttaaaacc

SEQ ID NO: 327810 - DNA, 20 bp, Artificial Sequence
  chemically synthesized
ataaatacctaatgcatgca

SEQ ID NO: 327811 - DNA, 20 bp, Artificial Sequence
  chemically synthesized
gataaatacctaatgcatgc

SEQ ID NO: 327812 - DNA, 20 bp, Artificial Sequence
  chemically synthesized
gttttaagccctgcatgcat

SEQ ID NO: 327813 - DNA, 20 bp, Artificial Sequence
  chemically synthesized
ggataaatacctaatgcatg

SEQ ID NO: 327814 - DNA, 20 bp, Artificial Sequence
  chemically synthesized
ttttaagccctgcatgcatt

SEQ ID NO: 327815 - DNA, 20 bp, Artificial Sequence
  chemically synthesized
gcaagggtagggagagcatt

SEQ ID NO: 327816 - DNA, 20 bp, Artificial Sequence
  chemically synthesized
ggcaagggtagggagagcat

SEQ ID NO: 327817 - DNA, 20 bp, Artificial Sequence
  chemically synthesized
gtggagggcaagggtaggga

SEQ ID NO: 327818 - DNA, 20 bp, Artificial Sequence
  chemically synthesized
gagtggagggcaagggtagg

SEQ ID NO: 327819 - DNA, 20 bp, Artificial Sequence
  chemically synthesized
gggagtggagggcaagggta

SEQ ID NO: 327820 - DNA, 20 bp, Artificial Sequence
  chemically synthesized
tgggagtggagggcaagggt

SEQ ID NO: 327821 - DNA, 20 bp, Artificial Sequence
  chemically synthesized
ctgggagtggagggcaaggg

SEQ ID NO: 327822 - DNA, 20 bp, Artificial Sequence
  chemically synthesized
tgtctgggagtggagggcaa

SEQ ID NO: 327823 - DNA, 20 bp, Artificial Sequence
  chemically synthesized
ctgtctgggagtggagggca

SEQ ID NO: 327824 - DNA, 20 bp, Artificial Sequence
  chemically synthesized
cctgtctgggagtggagggc

SEQ ID NO: 327825 - DNA, 20 bp, Artificial Sequence
  chemically synthesized
atcgcctgtctgggagtgga

SEQ ID NO: 327826 - DNA, 20 bp, Artificial Sequence
  chemically synthesized
ctacccttgccctccactcc

SEQ ID NO: 327827 - DNA, 20 bp, Artificial Sequence
  chemically synthesized
catcgcctgtctgggagtgg

SEQ ID NO: 327828 - DNA, 20 bp, Artificial Sequence
  chemically synthesized
ccatcgcctgtctgggagtg

SEQ ID NO: 327829 - DNA, 20 bp, Artificial Sequence
  chemically synthesized
caccatcgcctgtctgggag

SEQ ID NO: 327830 - DNA, 20 bp, Artificial Sequence
  chemically synthesized
ccttgccctccactcccaga

SEQ ID NO: 327831 - DNA, 20 bp, Artificial Sequence
  chemically synthesized
cttgccctccactcccagac

SEQ ID NO: 327832 - DNA, 20 bp, Artificial Sequence
  chemically synthesized
acacaccatcgcctgtctgg

SEQ ID NO: 327833 - DNA, 20 bp, Artificial Sequence
  chemically synthesized
tcacacaccatcgcctgtct

SEQ ID NO: 327834 - DNA, 20 bp, Artificial Sequence
  chemically synthesized
atcacacaccatcgcctgtc

SEQ ID NO: 327835 - DNA, 20 bp, Artificial Sequence
  chemically synthesized
ctccactcccagacaggcga

SEQ ID NO: 327836 - DNA, 20 bp, Artificial Sequence
  chemically synthesized
gaacacatggacacagggag

SEQ ID NO: 327837 - DNA, 20 bp, Artificial Sequence
  chemically synthesized
agaacacatggacacaggga

SEQ ID NO: 327838 - DNA, 20 bp, Artificial Sequence
  chemically synthesized
gagaacacatggacacaggg

SEQ ID NO: 327839 - DNA, 20 bp, Artificial Sequence
  chemically synthesized
tgagaacacatggacacagg

SEQ ID NO: 327840 - DNA, 20 bp, Artificial Sequence
  chemically synthesized
aatgagaacacatggacaca

SEQ ID NO: 327841 - DNA, 20 bp, Artificial Sequence
  chemically synthesized
caatgagaacacatggacac

SEQ ID NO: 327842 - DNA, 20 bp, Artificial Sequence
  chemically synthesized
acaatgagaacacatggaca

SEQ ID NO: 327843 - DNA, 20 bp, Artificial Sequence
  chemically synthesized
agttgaacaatgagaacaca

SEQ ID NO: 327844 - DNA, 20 bp, Artificial Sequence
  chemically synthesized
ataagtgggagttgaacaat

SEQ ID NO: 327845 - DNA, 20 bp, Artificial Sequence
  chemically synthesized
atgttctcactcataagtgg

SEQ ID NO: 327846 - DNA, 20 bp, Artificial Sequence
  chemically synthesized
attgttcaactcccacttat

SEQ ID NO: 327847 - DNA, 20 bp, Artificial Sequence
  chemically synthesized
gcatgttctcactcataagt

SEQ ID NO: 327848 - DNA, 20 bp, Artificial Sequence
  chemically synthesized
cgcatgttctcactcataag

SEQ ID NO: 327849 - DNA, 20 bp, Artificial Sequence
  chemically synthesized
ttcaactcccacttatgagt

SEQ ID NO: 327850 - DNA, 20 bp, Artificial Sequence
  chemically synthesized
taccgcatgttctcactcat

SEQ ID NO: 327851 - DNA, 20 bp, Artificial Sequence
  chemically synthesized
cacttatgagtgagaacatg

SEQ ID NO: 327852 - DNA, 20 bp, Artificial Sequence
  chemically synthesized
gagtgagaacatgcggtatt

SEQ ID NO: 327853 - DNA, 20 bp, Artificial Sequence
  chemically synthesized
ggtatttggttttctgttcc

SEQ ID NO: 327854 - DNA, 20 bp, Artificial Sequence
  chemically synthesized
gtatttggttttctgttcct

SEQ ID NO: 327855 - DNA, 20 bp, Artificial Sequence
  chemically synthesized
taagcaaactaacccaggaa

SEQ ID NO: 327856 - DNA, 20 bp, Artificial Sequence
  chemically synthesized
ttggttttctgttcctgggt

SEQ ID NO: 327857 - DNA, 20 bp, Artificial Sequence
  chemically synthesized
cattctaagcaaactaaccc

SEQ ID NO: 327858 - DNA, 20 bp, Artificial Sequence
  chemically synthesized
tcattctaagcaaactaacc

SEQ ID NO: 327859 - DNA, 20 bp, Artificial Sequence
  chemically synthesized
tgttcctgggttagtttgct

SEQ ID NO: 327860 - DNA, 20 bp, Artificial Sequence
  chemically synthesized
ggttagtttgcttagaatga

SEQ ID NO: 327861 - DNA, 20 bp, Artificial Sequence
  chemically synthesized
gagctggaaaccatcattct

SEQ ID NO: 327862 - DNA, 20 bp, Artificial Sequence
  chemically synthesized
ttgcttagaatgatggtttc

SEQ ID NO: 327863 - DNA, 20 bp, Artificial Sequence
  chemically synthesized
tgcagggacatggatggagc

SEQ ID NO: 327864 - DNA, 20 bp, Artificial Sequence
  chemically synthesized
cctttgcagggacatggatg

SEQ ID NO: 327865 - DNA, 20 bp, Artificial Sequence
  chemically synthesized
gtcctttgcagggacatgga

SEQ ID NO: 327866 - DNA, 20 bp, Artificial Sequence
  chemically synthesized
tcttgtcctttgcagggaca

SEQ ID NO: 327867 - DNA, 20 bp, Artificial Sequence
  chemically synthesized
gctccatccatgtccctgca

SEQ ID NO: 327868 - DNA, 20 bp, Artificial Sequence
  chemically synthesized
ctccatccatgtccctgcaa

SEQ ID NO: 327869 - DNA, 20 bp, Artificial Sequence
  chemically synthesized
atgagttcttgtcctttgca

SEQ ID NO: 327870 - DNA, 20 bp, Artificial Sequence
  chemically synthesized
aatgagttcttgtcctttgc

SEQ ID NO: 327871 - DNA, 20 bp, Artificial Sequence
  chemically synthesized
gaatgagttcttgtcctttg

SEQ ID NO: 327872 - DNA, 20 bp, Artificial Sequence
  chemically synthesized
tccatgtccctgcaaaggac

SEQ ID NO: 327873 - DNA, 20 bp, Artificial Sequence
  chemically synthesized
atgcgaccataaaatagaat

SEQ ID NO: 327874 - DNA, 20 bp, Artificial Sequence
  chemically synthesized
caagaactcattctatttta

SEQ ID NO: 327875 - DNA, 20 bp, Artificial Sequence
  chemically synthesized
aatactatgcgaccataaaa

SEQ ID NO: 327876 - DNA, 20 bp, Artificial Sequence
  chemically synthesized
cattctattttatggtcgca

SEQ ID NO: 327877 - DNA, 20 bp, Artificial Sequence
  chemically synthesized
gaaaatgtggcacatataca

SEQ ID NO: 327878 - DNA, 20 bp, Artificial Sequence
  chemically synthesized
tagactggataaagaaaatg

SEQ ID NO: 327879 - DNA, 20 bp, Artificial Sequence
  chemically synthesized
tgtgccacattttctttatc

SEQ ID NO: 327880 - DNA, 20 bp, Artificial Sequence
  chemically synthesized
catcaatgatagactggata

SEQ ID NO: 327881 - DNA, 20 bp, Artificial Sequence
  chemically synthesized
cattcccatcaatgatagac

SEQ ID NO: 327882 - DNA, 20 bp, Artificial Sequence
  chemically synthesized
tttatccagtctatcattga

SEQ ID NO: 327883 - DNA, 20 bp, Artificial Sequence
  chemically synthesized
ctgaccattcccatcaatga

SEQ ID NO: 327884 - DNA, 20 bp, Artificial Sequence
  chemically synthesized
ttatccagtctatcattgat

SEQ ID NO: 327885 - DNA, 20 bp, Artificial Sequence
  chemically synthesized
cagtctatcattgatgggaa

SEQ ID NO: 327886 - DNA, 20 bp, Artificial Sequence
  chemically synthesized
ctatcattgatgggaatggt

SEQ ID NO: 327887 - DNA, 20 bp, Artificial Sequence
  chemically synthesized
tatcattgatgggaatggtc

SEQ ID NO: 327888 - DNA, 20 bp, Artificial Sequence
  chemically synthesized
tcattgatgggaatggtcag

SEQ ID NO: 327889 - DNA, 20 bp, Artificial Sequence
  chemically synthesized
atgggaatggtcaggagttc

SEQ ID NO: 327890 - DNA, 20 bp, Artificial Sequence
  chemically synthesized
aatggtcaggagttcgagac

SEQ ID NO: 327891 - DNA, 20 bp, Artificial Sequence
  chemically synthesized
tcaggagttcgagaccagca

SEQ ID NO: 327892 - DNA, 20 bp, Artificial Sequence
  chemically synthesized
tttcaccatgttggccatgc

SEQ ID NO: 327893 - DNA, 20 bp, Artificial Sequence
  chemically synthesized
cgagaccagcatggccaaca

SEQ ID NO: 327894 - DNA, 20 bp, Artificial Sequence
  chemically synthesized
gagacagggtttcaccatgt

SEQ ID NO: 327895 - DNA, 20 bp, Artificial Sequence
  chemically synthesized
ttgttattttagtagagaca

SEQ ID NO: 327896 - DNA, 20 bp, Artificial Sequence
  chemically synthesized
tttgttattttagtagagac

SEQ ID NO: 327897 - DNA, 20 bp, Artificial Sequence
  chemically synthesized
ttttgttattttagtagaga

SEQ ID NO: 327898 - DNA, 20 bp, Artificial Sequence
  chemically synthesized
taatttttgttattttagta

SEQ ID NO: 327899 - DNA, 20 bp, Artificial Sequence
  chemically synthesized
gctaatttttgttattttag

SEQ ID NO: 327900 - DNA, 20 bp, Artificial Sequence
  chemically synthesized
ctggctaatttttgttattt

SEQ ID NO: 327901 - DNA, 20 bp, Artificial Sequence
  chemically synthesized
tctactaaaataacaaaaat

SEQ ID NO: 327902 - DNA, 20 bp, Artificial Sequence
  chemically synthesized
ctaaaataacaaaaattagc

SEQ ID NO: 327903 - DNA, 20 bp, Artificial Sequence
  chemically synthesized
taaaataacaaaaattagcc

SEQ ID NO: 327904 - DNA, 20 bp, Artificial Sequence
  chemically synthesized
taacaaaaattagccaggcg

SEQ ID NO: 327905 - DNA, 20 bp, Artificial Sequence
  chemically synthesized
caaaaattagccaggcgtgg

SEQ ID NO: 327906 - DNA, 20 bp, Artificial Sequence
  chemically synthesized
caggcacccaccaccacgcc

SEQ ID NO: 327907 - DNA, 20 bp, Artificial Sequence
  chemically synthesized
aaattagccaggcgtggtgg

SEQ ID NO: 327908 - DNA, 20 bp, Artificial Sequence
  chemically synthesized
aattagccaggcgtggtggt

SEQ ID NO: 327909 - DNA, 20 bp, Artificial Sequence
  chemically synthesized
ggcgtggtggtgggtgcctg

SEQ ID NO: 327910 - DNA, 20 bp, Artificial Sequence
  chemically synthesized
tcccaagtagatgggactac

SEQ ID NO: 327911 - DNA, 20 bp, Artificial Sequence
  chemically synthesized
ctcccaagtagatgggacta

SEQ ID NO: 327912 - DNA, 20 bp, Artificial Sequence
  chemically synthesized
tgcctgtagtcccatctact

SEQ ID NO: 327913 - DNA, 20 bp, Artificial Sequence
  chemically synthesized
cctcagcctcccaagtagat

SEQ ID NO: 327914 - DNA, 20 bp, Artificial Sequence
  chemically synthesized
gcctgtagtcccatctactt

SEQ ID NO: 327915 - DNA, 20 bp, Artificial Sequence
  chemically synthesized
tcctcagcctcccaagtaga

SEQ ID NO: 327916 - DNA, 20 bp, Artificial Sequence
  chemically synthesized
ctgtagtcccatctacttgg

SEQ ID NO: 327917 - DNA, 20 bp, Artificial Sequence
  chemically synthesized
tgtagtcccatctacttggg

SEQ ID NO: 327918 - DNA, 20 bp, Artificial Sequence
  chemically synthesized
tacttcctcagcctcccaag

SEQ ID NO: 327919 - DNA, 20 bp, Artificial Sequence
  chemically synthesized
ttctacttcctcagcctccc

SEQ ID NO: 327920 - DNA, 20 bp, Artificial Sequence
  chemically synthesized
tcccatctacttgggaggct

SEQ ID NO: 327921 - DNA, 20 bp, Artificial Sequence
  chemically synthesized
cccatctacttgggaggctg

SEQ ID NO: 327922 - DNA, 20 bp, Artificial Sequence
  chemically synthesized
atctacttgggaggctgagg

SEQ ID NO: 327923 - DNA, 20 bp, Artificial Sequence
  chemically synthesized
tacttgggaggctgaggaag

SEQ ID NO: 327924 - DNA, 20 bp, Artificial Sequence
  chemically synthesized
gttcaacgattctacttcct

SEQ ID NO: 327925 - DNA, 20 bp, Artificial Sequence
  chemically synthesized
ggaagtagaatcgttgaacc

SEQ ID NO: 327926 - DNA, 20 bp, Artificial Sequence
  chemically synthesized
gaagtagaatcgttgaacct

SEQ ID NO: 327927 - DNA, 20 bp, Artificial Sequence
  chemically synthesized
agtagaatcgttgaacctgg

SEQ ID NO: 327928 - DNA, 20 bp, Artificial Sequence
  chemically synthesized
gtagaatcgttgaacctggg

SEQ ID NO: 327929 - DNA, 20 bp, Artificial Sequence
  chemically synthesized
gaatcgttgaacctgggagg

SEQ ID NO: 327930 - DNA, 20 bp, Artificial Sequence
  chemically synthesized
aatcgttgaacctgggaggc

SEQ ID NO: 327931 - DNA, 20 bp, Artificial Sequence
  chemically synthesized
tcactgcacccctgcctccc

SEQ ID NO: 327932 - DNA, 20 bp, Artificial Sequence
  chemically synthesized
atcgttgaacctgggaggca

SEQ ID NO: 327933 - DNA, 20 bp, Artificial Sequence
  chemically synthesized
ctcactgcacccctgcctcc

SEQ ID NO: 327934 - DNA, 20 bp, Artificial Sequence
  chemically synthesized
tcgttgaacctgggaggcag

SEQ ID NO: 327935 - DNA, 20 bp, Artificial Sequence
  chemically synthesized
gaacctgggaggcaggggtg

SEQ ID NO: 327936 - DNA, 20 bp, Artificial Sequence
  chemically synthesized
ctgggaggcaggggtgcagt

SEQ ID NO: 327937 - DNA, 20 bp, Artificial Sequence
  chemically synthesized
ggggtgcagtgagctgaaat

SEQ ID NO: 327938 - DNA, 20 bp, Artificial Sequence
  chemically synthesized
gggtgcagtgagctgaaatt

SEQ ID NO: 327939 - DNA, 20 bp, Artificial Sequence
  chemically synthesized
agagttcattgacccaattt

SEQ ID NO: 327940 - DNA, 20 bp, Artificial Sequence
  chemically synthesized
tgggtcaatgaactctaacc

SEQ ID NO: 327941 - DNA, 20 bp, Artificial Sequence
  chemically synthesized
gggtcaatgaactctaacct

SEQ ID NO: 327942 - DNA, 20 bp, Artificial Sequence
  chemically synthesized
ttgctctgttgcccaggtta

SEQ ID NO: 327943 - DNA, 20 bp, Artificial Sequence
  chemically synthesized
tattgctctgttgcccaggt

SEQ ID NO: 327944 - DNA, 20 bp, Artificial Sequence
  chemically synthesized
atgaactctaacctgggcaa

SEQ ID NO: 327945 - DNA, 20 bp, Artificial Sequence
  chemically synthesized
agattattgctctgttgccc

SEQ ID NO: 327946 - DNA, 20 bp, Artificial Sequence
  chemically synthesized
gaactctaacctgggcaaca

SEQ ID NO: 327947 - DNA, 20 bp, Artificial Sequence
  chemically synthesized
cagattattgctctgttgcc

SEQ ID NO: 327948 - DNA, 20 bp, Artificial Sequence
  chemically synthesized
tgtttttttttttttggaga

SEQ ID NO: 327949 - DNA, 20 bp, Artificial Sequence
  chemically synthesized
ttgctgtttttttttttttg

SEQ ID NO: 327950 - DNA, 20 bp, Artificial Sequence
  chemically synthesized
gcttgctgtttttttttttt

SEQ ID NO: 327951 - DNA, 20 bp, Artificial Sequence
  chemically synthesized
tgtctccaaaaaaaaaaaaa

SEQ ID NO: 327952 - DNA, 20 bp, Artificial Sequence
  chemically synthesized
tccaaaaaaaaaaaaacagc

SEQ ID NO: 327953 - DNA, 20 bp, Artificial Sequence
  chemically synthesized
aaaaaaaaaaacagcaagca

SEQ ID NO: 327954 - DNA, 20 bp, Artificial Sequence
  chemically synthesized
aaaaacagcaagcaaagaca

SEQ ID NO: 327955 - DNA, 20 bp, Artificial Sequence
  chemically synthesized
acagcaagcaaagacaaagc

SEQ ID NO: 327956 - DNA, 20 bp, Artificial Sequence
  chemically synthesized
cagcaagcaaagacaaagca

SEQ ID NO: 327957 - DNA, 20 bp, Artificial Sequence
  chemically synthesized
aagacaaagcaaggttttgt

SEQ ID NO: 327958 - DNA, 20 bp, Artificial Sequence
  chemically synthesized
agacaaagcaaggttttgtg

SEQ ID NO: 327959 - DNA, 20 bp, Artificial Sequence
  chemically synthesized
aaagcaaggttttgtgaggc

SEQ ID NO: 327960 - DNA, 20 bp, Artificial Sequence
  chemically synthesized
aagcaaggttttgtgaggca

SEQ ID NO: 327961 - DNA, 20 bp, Artificial Sequence
  chemically synthesized
gggattcttgggtcatatgg

SEQ ID NO: 327962 - DNA, 20 bp, Artificial Sequence
  chemically synthesized
ggagggattcttgggtcata

SEQ ID NO: 327963 - DNA, 20 bp, Artificial Sequence
  chemically synthesized
tcaaaaccaccatatgaccc

SEQ ID NO: 327964 - DNA, 20 bp, Artificial Sequence
  chemically synthesized
gcccagaaggagggattctt

SEQ ID NO: 327965 - DNA, 20 bp, Artificial Sequence
  chemically synthesized
tgcccagaaggagggattct

SEQ ID NO: 327966 - DNA, 20 bp, Artificial Sequence
  chemically synthesized
gacccaagaatccctccttc

SEQ ID NO: 327967 - DNA, 20 bp, Artificial Sequence
  chemically synthesized
acccaagaatccctccttct

SEQ ID NO: 327968 - DNA, 20 bp, Artificial Sequence
  chemically synthesized
tgtgtatatgcccagaagga

SEQ ID NO: 327969 - DNA, 20 bp, Artificial Sequence
  chemically synthesized
ttgtgtatatgcccagaagg

SEQ ID NO: 327970 - DNA, 20 bp, Artificial Sequence
  chemically synthesized
tttgtgtatatgcccagaag

SEQ ID NO: 327971 - DNA, 20 bp, Artificial Sequence
  chemically synthesized
cctttgtgtatatgcccaga

SEQ ID NO: 327972 - DNA, 20 bp, Artificial Sequence
  chemically synthesized
tcctttgtgtatatgcccag

SEQ ID NO: 327973 - DNA, 20 bp, Artificial Sequence
  chemically synthesized
ttttcctttgtgtatatgcc

SEQ ID NO: 327974 - DNA, 20 bp, Artificial Sequence
  chemically synthesized
tccttctgggcatatacaca

SEQ ID NO: 327975 - DNA, 20 bp, Artificial Sequence
  chemically synthesized
ccttctgggcatatacacaa

SEQ ID NO: 327976 - DNA, 20 bp, Artificial Sequence
  chemically synthesized
aaaaataacacaaccttgta

SEQ ID NO: 327977 - DNA, 20 bp, Artificial Sequence
  chemically synthesized
gaagcccggatatctttaca

SEQ ID NO: 327978 - DNA, 20 bp, Artificial Sequence
  chemically synthesized
agaagcccggatatctttac

SEQ ID NO: 327979 - DNA, 20 bp, Artificial Sequence
  chemically synthesized
cacaaccttgtaaagatatc

SEQ ID NO: 327980 - DNA, 20 bp, Artificial Sequence
  chemically synthesized
acaaccttgtaaagatatcc

SEQ ID NO: 327981 - DNA, 20 bp, Artificial Sequence
  chemically synthesized
cttcaatgagcatagaagcc

SEQ ID NO: 327982 - DNA, 20 bp, Artificial Sequence
  chemically synthesized
caatgcttcaatgagcatag

SEQ ID NO: 327983 - DNA, 20 bp, Artificial Sequence
  chemically synthesized
gaacaatgcttcaatgagca

SEQ ID NO: 327984 - DNA, 20 bp, Artificial Sequence
  chemically synthesized
ccgggcttctatgctcattg

SEQ ID NO: 327985 - DNA, 20 bp, Artificial Sequence
  chemically synthesized
actgtgaacaatgcttcaat

SEQ ID NO: 327986 - DNA, 20 bp, Artificial Sequence
  chemically synthesized
gctcattgaagcattgttca

SEQ ID NO: 327987 - DNA, 20 bp, Artificial Sequence
  chemically synthesized
cattgaagcattgttcacag

SEQ ID NO: 327988 - DNA, 20 bp, Artificial Sequence
  chemically synthesized
aagcattgttcacagtagcc

SEQ ID NO: 327989 - DNA, 20 bp, Artificial Sequence
  chemically synthesized
tgttcacagtagccaagata

SEQ ID NO: 327990 - DNA, 20 bp, Artificial Sequence
  chemically synthesized
taaacgttgtttccatatct

SEQ ID NO: 327991 - DNA, 20 bp, Artificial Sequence
  chemically synthesized
aagatatggaaacaacgttt

SEQ ID NO: 327992 - DNA, 20 bp, Artificial Sequence
  chemically synthesized
aaacaacgtttaagtatcca

SEQ ID NO: 327993 - DNA, 20 bp, Artificial Sequence
  chemically synthesized
tgtctttaatcatttatcca

SEQ ID NO: 327994 - DNA, 20 bp, Artificial Sequence
  chemically synthesized
tatccatggataaatgatta

SEQ ID NO: 327995 - DNA, 20 bp, Artificial Sequence
  chemically synthesized
ataaatgattaaagacatta

SEQ ID NO: 327996 - DNA, 20 bp, Artificial Sequence
  chemically synthesized
atatgcaattgaatattatt

SEQ ID NO: 327997 - DNA, 20 bp, Artificial Sequence
  chemically synthesized
tattattcagtccttaaaaa

SEQ ID NO: 327998 - DNA, 20 bp, Artificial Sequence
  chemically synthesized
aagatttcattcttttttta

SEQ ID NO: 327999 - DNA, 20 bp, Artificial Sequence
  chemically synthesized
caagatttcattcttttttt

SEQ ID NO: 328000 - DNA, 20 bp, Artificial Sequence
  chemically synthesized
tccatgttgtagcaaatggc

SEQ ID NO: 328001 - DNA, 20 bp, Artificial Sequence
  chemically synthesized
ctcatccatgttgtagcaaa

SEQ ID NO: 328002 - DNA, 20 bp, Artificial Sequence
  chemically synthesized
tcttgccatttgctacaaca

SEQ ID NO: 328003 - DNA, 20 bp, Artificial Sequence
  chemically synthesized
ttctaggctcatccatgttg

SEQ ID NO: 328004 - DNA, 20 bp, Artificial Sequence
  chemically synthesized
ccatttgctacaacatggat

SEQ ID NO: 328005 - DNA, 20 bp, Artificial Sequence
  chemically synthesized
tgctacaacatggatgagcc

SEQ ID NO: 328006 - DNA, 20 bp, Artificial Sequence
  chemically synthesized
ttcttagtgtaatgtattct

SEQ ID NO: 328007 - DNA, 20 bp, Artificial Sequence
  chemically synthesized
attcttagtgtaatgtattc

SEQ ID NO: 328008 - DNA, 20 bp, Artificial Sequence
  chemically synthesized
agcctagaatacattacact

SEQ ID NO: 328009 - DNA, 20 bp, Artificial Sequence
  chemically synthesized
tcatccaaggtttaaattct

SEQ ID NO: 328010 - DNA, 20 bp, Artificial Sequence
  chemically synthesized
tacactaagaatttaaacct

SEQ ID NO: 328011 - DNA, 20 bp, Artificial Sequence
  chemically synthesized
gagctcattgatgtcatcca

SEQ ID NO: 328012 - DNA, 20 bp, Artificial Sequence
  chemically synthesized
agagctcattgatgtcatcc

SEQ ID NO: 328013 - DNA, 20 bp, Artificial Sequence
  chemically synthesized
aaaccttggatgacatcaat

SEQ ID NO: 328014 - DNA, 20 bp, Artificial Sequence
  chemically synthesized
tggatgacatcaatgagctc

SEQ ID NO: 328015 - DNA, 20 bp, Artificial Sequence
  chemically synthesized
tctacgcatgaggagttcta

SEQ ID NO: 328016 - DNA, 20 bp, Artificial Sequence
  chemically synthesized
tttctacgcatgaggagttc

SEQ ID NO: 328017 - DNA, 20 bp, Artificial Sequence
  chemically synthesized
gggtgatttctacgcatgag

SEQ ID NO: 328018 - DNA, 20 bp, Artificial Sequence
  chemically synthesized
gctctagaactcctcatgcg

SEQ ID NO: 328019 - DNA, 20 bp, Artificial Sequence
  chemically synthesized
tagggtgatttctacgcatg

SEQ ID NO: 328020 - DNA, 20 bp, Artificial Sequence
  chemically synthesized
gtagggtgatttctacgcat

SEQ ID NO: 328021 - DNA, 20 bp, Artificial Sequence
  chemically synthesized
taaactgaaagtcaaatgta

SEQ ID NO: 328022 - DNA, 20 bp, Artificial Sequence
  chemically synthesized
ataaactgaaagtcaaatgt

SEQ ID NO: 328023 - DNA, 20 bp, Artificial Sequence
  chemically synthesized
aataaactgaaagtcaaatg

SEQ ID NO: 328024 - DNA, 20 bp, Artificial Sequence
  chemically synthesized
atcaccctacatttgacttt

SEQ ID NO: 328025 - DNA, 20 bp, Artificial Sequence
  chemically synthesized
ttacctgttaaataaactga

SEQ ID NO: 328026 - DNA, 20 bp, Artificial Sequence
  chemically synthesized
ttgactttcagtttatttaa

SEQ ID NO: 328027 - DNA, 20 bp, Artificial Sequence
  chemically synthesized
tgactttcagtttatttaac

SEQ ID NO: 328028 - DNA, 20 bp, Artificial Sequence
  chemically synthesized
atttaacaggtaacaacttc

SEQ ID NO: 328029 - DNA, 20 bp, Artificial Sequence
  chemically synthesized
tccgggccagtaataaccag

SEQ ID NO: 328030 - DNA, 20 bp, Artificial Sequence
  chemically synthesized
tcttccgggccagtaataac

SEQ ID NO: 328031 - DNA, 20 bp, Artificial Sequence
  chemically synthesized
taacaacttctggttattac

SEQ ID NO: 328032 - DNA, 20 bp, Artificial Sequence
  chemically synthesized
acttctggttattactggcc

SEQ ID NO: 328033 - DNA, 20 bp, Artificial Sequence
  chemically synthesized
tctggttattactggcccgg

SEQ ID NO: 328034 - DNA, 20 bp, Artificial Sequence
  chemically synthesized
actacaaacgtcttccgggc

SEQ ID NO: 328035 - DNA, 20 bp, Artificial Sequence
  chemically synthesized
gtttactacaaacgtcttcc

SEQ ID NO: 328036 - DNA, 20 bp, Artificial Sequence
  chemically synthesized
tgtttactacaaacgtcttc

SEQ ID NO: 328037 - DNA, 20 bp, Artificial Sequence
  chemically synthesized
actggcccggaagacgtttg

SEQ ID NO: 328038 - DNA, 20 bp, Artificial Sequence
  chemically synthesized
cggaagacgtttgtagtaaa

SEQ ID NO: 328039 - DNA, 20 bp, Artificial Sequence
  chemically synthesized
aagacgtttgtagtaaacag

SEQ ID NO: 328040 - DNA, 20 bp, Artificial Sequence
  chemically synthesized
gacgtttgtagtaaacagaa

SEQ ID NO: 328041 - DNA, 20 bp, Artificial Sequence
  chemically synthesized
gagttccatgaggacagaga

SEQ ID NO: 328042 - DNA, 20 bp, Artificial Sequence
  chemically synthesized
gtgtgagttccatgaggaca

SEQ ID NO: 328043 - DNA, 20 bp, Artificial Sequence
  chemically synthesized
gacaactgtctctgtcctca

SEQ ID NO: 328044 - DNA, 20 bp, Artificial Sequence
  chemically synthesized
aagtgtgagttccatgagga

SEQ ID NO: 328045 - DNA, 20 bp, Artificial Sequence
  chemically synthesized
acaaaagtgtgagttccatg

SEQ ID NO: 328046 - DNA, 20 bp, Artificial Sequence
  chemically synthesized
cacaaaagtgtgagttccat

SEQ ID NO: 328047 - DNA, 20 bp, Artificial Sequence
  chemically synthesized
gtataatcacacaaaagtgt

SEQ ID NO: 328048 - DNA, 20 bp, Artificial Sequence
  chemically synthesized
ttgcttgtataatcacacaa

SEQ ID NO: 328049 - DNA, 20 bp, Artificial Sequence
  chemically synthesized
acacttttgtgtgattatac

SEQ ID NO: 328050 - DNA, 20 bp, Artificial Sequence
  chemically synthesized
aaattatattgaacaaaaaa

SEQ ID NO: 328051 - DNA, 20 bp, Artificial Sequence
  chemically synthesized
aagtggctgcaaatataatt

SEQ ID NO: 328052 - DNA, 20 bp, Artificial Sequence
  chemically synthesized
tttgttccaaattatatttg

SEQ ID NO: 328053 - DNA, 20 bp, Artificial Sequence
  chemically synthesized
tcaacaatttattcataaag

SEQ ID NO: 328054 - DNA, 20 bp, Artificial Sequence
  chemically synthesized
agctcaacaatttattcata

SEQ ID NO: 328055 - DNA, 20 bp, Artificial Sequence
  chemically synthesized
cactttatgaataaattgtt

SEQ ID NO: 328056 - DNA, 20 bp, Artificial Sequence
  chemically synthesized
tatgaataaattgttgagct

SEQ ID NO: 328057 - DNA, 20 bp, Artificial Sequence
  chemically synthesized
ttatcgtgtcacacagcact

SEQ ID NO: 328058 - DNA, 20 bp, Artificial Sequence
  chemically synthesized
ctccaatttatcgtgtcaca

SEQ ID NO: 328059 - DNA, 20 bp, Artificial Sequence
  chemically synthesized
tgctgtgtgacacgataaat

SEQ ID NO: 328060 - DNA, 20 bp, Artificial Sequence
  chemically synthesized
ctgtgtgacacgataaattg

SEQ ID NO: 328061 - DNA, 20 bp, Artificial Sequence
  chemically synthesized
tgtgtgacacgataaattgg

SEQ ID NO: 328062 - DNA, 20 bp, Artificial Sequence
  chemically synthesized
acacgataaattggaggatt

SEQ ID NO: 328063 - DNA, 20 bp, Artificial Sequence
  chemically synthesized
ggaggattaagaaatgcatt

SEQ ID NO: 328064 - DNA, 20 bp, Artificial Sequence
  chemically synthesized
atgcattaagcaacaccaac

SEQ ID NO: 328065 - DNA, 20 bp, Artificial Sequence
  chemically synthesized
tgcattaagcaacaccaaca

SEQ ID NO: 328066 - DNA, 20 bp, Artificial Sequence
  chemically synthesized
gcattaagcaacaccaacaa

SEQ ID NO: 328067 - DNA, 20 bp, Artificial Sequence
  chemically synthesized
attaagcaacaccaacaagg

SEQ ID NO: 328068 - DNA, 20 bp, Artificial Sequence
  chemically synthesized
taatatttgtactcccttgt

SEQ ID NO: 328069 - DNA, 20 bp, Artificial Sequence
  chemically synthesized
taaggtccaatgaaatatga

SEQ ID NO: 328070 - DNA, 20 bp, Artificial Sequence
  chemically synthesized
atttaaccatcatatttcat

SEQ ID NO: 328071 - DNA, 20 bp, Artificial Sequence
  chemically synthesized
atcatatttcattggacctt

SEQ ID NO: 328072 - DNA, 20 bp, Artificial Sequence
  chemically synthesized
aactagaagaatggcactta

SEQ ID NO: 328073 - DNA, 20 bp, Artificial Sequence
  chemically synthesized
aaactagaagaatggcactt

SEQ ID NO: 328074 - DNA, 20 bp, Artificial Sequence
  chemically synthesized
gaccttaagtgccattcttc

SEQ ID NO: 328075 - DNA, 20 bp, Artificial Sequence
  chemically synthesized
cctccataaaactagaagaa

SEQ ID NO: 328076 - DNA, 20 bp, Artificial Sequence
  chemically synthesized
catttcctccataaaactag

SEQ ID NO: 328077 - DNA, 20 bp, Artificial Sequence
  chemically synthesized
gtgccattcttctagtttta

SEQ ID NO: 328078 - DNA, 20 bp, Artificial Sequence
  chemically synthesized
atacatttcctccataaaac

SEQ ID NO: 328079 - DNA, 20 bp, Artificial Sequence
  chemically synthesized
gccattcttctagttttatg

SEQ ID NO: 328080 - DNA, 20 bp, Artificial Sequence
  chemically synthesized
ccattcttctagttttatgg

SEQ ID NO: 328081 - DNA, 20 bp, Artificial Sequence
  chemically synthesized
gttttatggaggaaatgtat

SEQ ID NO: 328082 - DNA, 20 bp, Artificial Sequence
  chemically synthesized
ttttatggaggaaatgtatt

SEQ ID NO: 328083 - DNA, 20 bp, Artificial Sequence
  chemically synthesized
tacaatatttagtgcagtat

SEQ ID NO: 328084 - DNA, 20 bp, Artificial Sequence
  chemically synthesized
gtaaactacaatatttagtg

SEQ ID NO: 328085 - DNA, 20 bp, Artificial Sequence
  chemically synthesized
taatactgcactaaatattg

SEQ ID NO: 328086 - DNA, 20 bp, Artificial Sequence
  chemically synthesized
taacagtaaactacaatatt

SEQ ID NO: 328087 - DNA, 20 bp, Artificial Sequence
  chemically synthesized
ttgtagtttactgttactga

SEQ ID NO: 328088 - DNA, 20 bp, Artificial Sequence
  chemically synthesized
ccatcttatgctttcagtaa

SEQ ID NO: 328089 - DNA, 20 bp, Artificial Sequence
  chemically synthesized
tttactgttactgaaagcat

SEQ ID NO: 328090 - DNA, 20 bp, Artificial Sequence
  chemically synthesized
ggatttccatcttatgcttt

SEQ ID NO: 328091 - DNA, 20 bp, Artificial Sequence
  chemically synthesized
ctgttactgaaagcataaga

SEQ ID NO: 328092 - DNA, 20 bp, Artificial Sequence
  chemically synthesized
aaagcataagatggaaatcc

SEQ ID NO: 328093 - DNA, 20 bp, Artificial Sequence
  chemically synthesized
aagcataagatggaaatcct

SEQ ID NO: 328094 - DNA, 20 bp, Artificial Sequence
  chemically synthesized
agcataagatggaaatccta

SEQ ID NO: 328095 - DNA, 20 bp, Artificial Sequence
  chemically synthesized
gcataagatggaaatcctag

SEQ ID NO: 328096 - DNA, 20 bp, Artificial Sequence
  chemically synthesized
gtcacataatgttgacccct

SEQ ID NO: 328097 - DNA, 20 bp, Artificial Sequence
  chemically synthesized
tgtcacataatgttgacccc

SEQ ID NO: 328098 - DNA, 20 bp, Artificial Sequence
  chemically synthesized
taggggtcaacattatgtga

SEQ ID NO: 328099 - DNA, 20 bp, Artificial Sequence
  chemically synthesized
gtcaacattatgtgacagaa

SEQ ID NO: 328100 - DNA, 20 bp, Artificial Sequence
  chemically synthesized
caaatagacaaaatgtagaa

SEQ ID NO: 328101 - DNA, 20 bp, Artificial Sequence
  chemically synthesized
agtgtcaaatagacaaaatg

SEQ ID NO: 328102 - DNA, 20 bp, Artificial Sequence
  chemically synthesized
gtagccgacccagtgtcaaa

SEQ ID NO: 328103 - DNA, 20 bp, Artificial Sequence
  chemically synthesized
acattttgtctatttgacac

SEQ ID NO: 328104 - DNA, 20 bp, Artificial Sequence
  chemically synthesized
cattttgtctatttgacact

SEQ ID NO: 328105 - DNA, 20 bp, Artificial Sequence
  chemically synthesized
ttgtctatttgacactgggt

SEQ ID NO: 328106 - DNA, 20 bp, Artificial Sequence
  chemically synthesized
aagcgaaggtgtagccgacc

SEQ ID NO: 328107 - DNA, 20 bp, Artificial Sequence
  chemically synthesized
agaacttttaagcgaaggtg

SEQ ID NO: 328108 - DNA, 20 bp, Artificial Sequence
  chemically synthesized
tggtgagaacttttaagcga

SEQ ID NO: 328109 - DNA, 20 bp, Artificial Sequence
  chemically synthesized
tcggctacaccttcgcttaa

SEQ ID NO: 328110 - DNA, 20 bp, Artificial Sequence
  chemically synthesized
atggtgagaacttttaagcg

SEQ ID NO: 328111 - DNA, 20 bp, Artificial Sequence
  chemically synthesized
agagaatggtgagaactttt

SEQ ID NO: 328112 - DNA, 20 bp, Artificial Sequence
  chemically synthesized
acacaaaagcagagaatggt

SEQ ID NO: 328113 - DNA, 20 bp, Artificial Sequence
  chemically synthesized
aaaaacacaaaagcagagaa

SEQ ID NO: 328114 - DNA, 20 bp, Artificial Sequence
  chemically synthesized
aaaaaaaaaacacaaaagca

SEQ ID NO: 328115 - DNA, 20 bp, Artificial Sequence
  chemically synthesized
aaaaaaaaaaaacacaaaag

SEQ ID NO: 328116 - DNA, 20 bp, Artificial Sequence
  chemically synthesized
aaaaaaaaaaaaaaacacaa

SEQ ID NO: 328117 - DNA, 20 bp, Artificial Sequence
  chemically synthesized
gttttttttttttttttttc

SEQ ID NO: 328118 - DNA, 20 bp, Artificial Sequence
  chemically synthesized
atctgacttgagtagaaaac

SEQ ID NO: 328119 - DNA, 20 bp, Artificial Sequence
  chemically synthesized
ttttttccagttttctactc

SEQ ID NO: 328120 - DNA, 20 bp, Artificial Sequence
  chemically synthesized
ttccagttttctactcaagt

SEQ ID NO: 328121 - DNA, 20 bp, Artificial Sequence
  chemically synthesized
ttaccattatctgacttgag

SEQ ID NO: 328122 - DNA, 20 bp, Artificial Sequence
  chemically synthesized
gatttaccattatctgactt

SEQ ID NO: 328123 - DNA, 20 bp, Artificial Sequence
  chemically synthesized
tttctactcaagtcagataa

SEQ ID NO: 328124 - DNA, 20 bp, Artificial Sequence
  chemically synthesized
gtagctcatcaagatgcaat

SEQ ID NO: 328125 - DNA, 20 bp, Artificial Sequence
  chemically synthesized
aaatctaattgcatcttgat

SEQ ID NO: 328126 - DNA, 20 bp, Artificial Sequence
  chemically synthesized
gtatttttaagtagctcatc

SEQ ID NO: 328127 - DNA, 20 bp, Artificial Sequence
  chemically synthesized
gccttaagggtatttttaag

SEQ ID NO: 328128 - DNA, 20 bp, Artificial Sequence
  chemically synthesized
ccagccttaagggtattttt

SEQ ID NO: 328129 - DNA, 20 bp, Artificial Sequence
  chemically synthesized
agctacttaaaaataccctt

SEQ ID NO: 328130 - DNA, 20 bp, Artificial Sequence
  chemically synthesized
gctacttaaaaataccctta

SEQ ID NO: 328131 - DNA, 20 bp, Artificial Sequence
  chemically synthesized
cttaaaaatacccttaaggc

SEQ ID NO: 328132 - DNA, 20 bp, Artificial Sequence
  chemically synthesized
gccacagtgcccagccttaa

SEQ ID NO: 328133 - DNA, 20 bp, Artificial Sequence
  chemically synthesized
ttaaaaatacccttaaggct

SEQ ID NO: 328134 - DNA, 20 bp, Artificial Sequence
  chemically synthesized
agccacagtgcccagcctta

SEQ ID NO: 328135 - DNA, 20 bp, Artificial Sequence
  chemically synthesized
gagccacagtgcccagcctt

SEQ ID NO: 328136 - DNA, 20 bp, Artificial Sequence
  chemically synthesized
acccttaaggctgggcactg

SEQ ID NO: 328137 - DNA, 20 bp, Artificial Sequence
  chemically synthesized
caggcatgagccacagtgcc

SEQ ID NO: 328138 - DNA, 20 bp, Artificial Sequence
  chemically synthesized
gggattacaggcatgagcca

SEQ ID NO: 328139 - DNA, 20 bp, Artificial Sequence
  chemically synthesized
agtgctgggattacaggcat

SEQ ID NO: 328140 - DNA, 20 bp, Artificial Sequence
  chemically synthesized
gtggctcatgcctgtaatcc

SEQ ID NO: 328141 - DNA, 20 bp, Artificial Sequence
  chemically synthesized
tcccaaagtgctgggattac

SEQ ID NO: 328142 - DNA, 20 bp, Artificial Sequence
  chemically synthesized
ctcccaaagtgctgggatta

SEQ ID NO: 328143 - DNA, 20 bp, Artificial Sequence
  chemically synthesized
tgcctgtaatcccagcactt

SEQ ID NO: 328144 - DNA, 20 bp, Artificial Sequence
  chemically synthesized
cctcggcctcccaaagtgct

SEQ ID NO: 328145 - DNA, 20 bp, Artificial Sequence
  chemically synthesized
gcctgtaatcccagcacttt

SEQ ID NO: 328146 - DNA, 20 bp, Artificial Sequence
  chemically synthesized
gcctcggcctcccaaagtgc

SEQ ID NO: 328147 - DNA, 20 bp, Artificial Sequence
  chemically synthesized
ctgtaatcccagcactttgg

SEQ ID NO: 328148 - DNA, 20 bp, Artificial Sequence
  chemically synthesized
tgtaatcccagcactttggg

SEQ ID NO: 328149 - DNA, 20 bp, Artificial Sequence
  chemically synthesized
ccgcccgcctcggcctccca

SEQ ID NO: 328150 - DNA, 20 bp, Artificial Sequence
  chemically synthesized
tcccagcactttgggaggcc

SEQ ID NO: 328151 - DNA, 20 bp, Artificial Sequence
  chemically synthesized
cccagcactttgggaggccg

SEQ ID NO: 328152 - DNA, 20 bp, Artificial Sequence
  chemically synthesized
agcactttgggaggccgagg

SEQ ID NO: 328153 - DNA, 20 bp, Artificial Sequence
  chemically synthesized
gcactttgggaggccgaggc

SEQ ID NO: 328154 - DNA, 20 bp, Artificial Sequence
  chemically synthesized
ctttgggaggccgaggcggg

SEQ ID NO: 328155 - DNA, 20 bp, Artificial Sequence
  chemically synthesized
cttaggtgatccgcccgcct

SEQ ID NO: 328156 - DNA, 20 bp, Artificial Sequence
  chemically synthesized
ccgaggcgggcggatcacct

SEQ ID NO: 328157 - DNA, 20 bp, Artificial Sequence
  chemically synthesized
cgaggcgggcggatcaccta

SEQ ID NO: 328158 - DNA, 20 bp, Artificial Sequence
  chemically synthesized
gcgggcggatcacctaaggt

SEQ ID NO: 328159 - DNA, 20 bp, Artificial Sequence
  chemically synthesized
cgggcggatcacctaaggtc

SEQ ID NO: 328160 - DNA, 20 bp, Artificial Sequence
  chemically synthesized
ggtcttgaactcctgacctt

SEQ ID NO: 328161 - DNA, 20 bp, Artificial Sequence
  chemically synthesized
ggcggatcacctaaggtcag

SEQ ID NO: 328162 - DNA, 20 bp, Artificial Sequence
  chemically synthesized
tggtcttgaactcctgacct

SEQ ID NO: 328163 - DNA, 20 bp, Artificial Sequence
  chemically synthesized
tcacctaaggtcaggagttc

SEQ ID NO: 328164 - DNA, 20 bp, Artificial Sequence
  chemically synthesized
taaggtcaggagttcaagac

SEQ ID NO: 328165 - DNA, 20 bp, Artificial Sequence
  chemically synthesized
tcaggagttcaagaccagcc

SEQ ID NO: 328166 - DNA, 20 bp, Artificial Sequence
  chemically synthesized
ttttgctatgttggccaggc

SEQ ID NO: 328167 - DNA, 20 bp, Artificial Sequence
  chemically synthesized
aaggttttgctatgttggcc

SEQ ID NO: 328168 - DNA, 20 bp, Artificial Sequence
  chemically synthesized
caagaccagcctggccaaca

SEQ ID NO: 328169 - DNA, 20 bp, Artificial Sequence
  chemically synthesized
caaggttttgctatgttggc

SEQ ID NO: 328170 - DNA, 20 bp, Artificial Sequence
  chemically synthesized
gtgacaaggttttgctatgt

SEQ ID NO: 328171 - DNA, 20 bp, Artificial Sequence
  chemically synthesized
tttttttttaaatagtgaca

SEQ ID NO: 328172 - DNA, 20 bp, Artificial Sequence
  chemically synthesized
ttttttttttaaatagtgac

SEQ ID NO: 328173 - DNA, 20 bp, Artificial Sequence
  chemically synthesized
tgtatttttttttttttaaa

SEQ ID NO: 328174 - DNA, 20 bp, Artificial Sequence
  chemically synthesized
aaaaaaaaaaatacaaaaat

SEQ ID NO: 328175 - DNA, 20 bp, Artificial Sequence
  chemically synthesized
aaaaaaatacaaaaattagt

SEQ ID NO: 328176 - DNA, 20 bp, Artificial Sequence
  chemically synthesized
aaaaaatacaaaaattagtc

SEQ ID NO: 328177 - DNA, 20 bp, Artificial Sequence
  chemically synthesized
atacaaaaattagtcgggca

SEQ ID NO: 328178 - DNA, 20 bp, Artificial Sequence
  chemically synthesized
caaaaattagtcgggcatgg

SEQ ID NO: 328179 - DNA, 20 bp, Artificial Sequence
  chemically synthesized
aaattagtcgggcatggtgg

SEQ ID NO: 328180 - DNA, 20 bp, Artificial Sequence
  chemically synthesized
aattagtcgggcatggtggc

SEQ ID NO: 328181 - DNA, 20 bp, Artificial Sequence
  chemically synthesized
gtggcaggtgcctgtaatcc

SEQ ID NO: 328182 - DNA, 20 bp, Artificial Sequence
  chemically synthesized
tcactagtagctgggattac

SEQ ID NO: 328183 - DNA, 20 bp, Artificial Sequence
  chemically synthesized
ctcactagtagctgggatta

SEQ ID NO: 328184 - DNA, 20 bp, Artificial Sequence
  chemically synthesized
gtgcctgtaatcccagctac

SEQ ID NO: 328185 - DNA, 20 bp, Artificial Sequence
  chemically synthesized
ccttagcctcactagtagct

SEQ ID NO: 328186 - DNA, 20 bp, Artificial Sequence
  chemically synthesized
gccttagcctcactagtagc

SEQ ID NO: 328187 - DNA, 20 bp, Artificial Sequence
  chemically synthesized
ctgtaatcccagctactagt

SEQ ID NO: 328188 - DNA, 20 bp, Artificial Sequence
  chemically synthesized
tgtaatcccagctactagtg

SEQ ID NO: 328189 - DNA, 20 bp, Artificial Sequence
  chemically synthesized
ttctgccttagcctcactag

SEQ ID NO: 328190 - DNA, 20 bp, Artificial Sequence
  chemically synthesized
ttcttctgccttagcctcac

SEQ ID NO: 328191 - DNA, 20 bp, Artificial Sequence
  chemically synthesized
tcccagctactagtgaggct

SEQ ID NO: 328192 - DNA, 20 bp, Artificial Sequence
  chemically synthesized
cccagctactagtgaggcta

SEQ ID NO: 328193 - DNA, 20 bp, Artificial Sequence
  chemically synthesized
agctactagtgaggctaagg

SEQ ID NO: 328194 - DNA, 20 bp, Artificial Sequence
  chemically synthesized
tactagtgaggctaaggcag

SEQ ID NO: 328195 - DNA, 20 bp, Artificial Sequence
  chemically synthesized
ctcaagcgattcttctgcct

SEQ ID NO: 328196 - DNA, 20 bp, Artificial Sequence
  chemically synthesized
ctaaggcagaagaatcgctt

SEQ ID NO: 328197 - DNA, 20 bp, Artificial Sequence
  chemically synthesized
gcagaagaatcgcttgagcc

SEQ ID NO: 328198 - DNA, 20 bp, Artificial Sequence
  chemically synthesized
cagaagaatcgcttgagccc

SEQ ID NO: 328199 - DNA, 20 bp, Artificial Sequence
  chemically synthesized
aacctccgcctcctgggctc

SEQ ID NO: 328200 - DNA, 20 bp, Artificial Sequence
  chemically synthesized
gaagaatcgcttgagcccag

SEQ ID NO: 328201 - DNA, 20 bp, Artificial Sequence
  chemically synthesized
aagaatcgcttgagcccagg

SEQ ID NO: 328202 - DNA, 20 bp, Artificial Sequence
  chemically synthesized
aatcgcttgagcccaggagg

SEQ ID NO: 328203 - DNA, 20 bp, Artificial Sequence
  chemically synthesized
cactgcaacctccgcctcct

SEQ ID NO: 328204 - DNA, 20 bp, Artificial Sequence
  chemically synthesized
tcgcttgagcccaggaggcg

SEQ ID NO: 328205 - DNA, 20 bp, Artificial Sequence
  chemically synthesized
tcactgcaacctccgcctcc

SEQ ID NO: 328206 - DNA, 20 bp, Artificial Sequence
  chemically synthesized
cgcttgagcccaggaggcgg

SEQ ID NO: 328207 - DNA, 20 bp, Artificial Sequence
  chemically synthesized
agcccaggaggcggaggttg

SEQ ID NO: 328208 - DNA, 20 bp, Artificial Sequence
  chemically synthesized
caggaggcggaggttgcagt

SEQ ID NO: 328209 - DNA, 20 bp, Artificial Sequence
  chemically synthesized
ggcggaggttgcagtgagcc

SEQ ID NO: 328210 - DNA, 20 bp, Artificial Sequence
  chemically synthesized
ggcatgcagtggcacaatct

SEQ ID NO: 328211 - DNA, 20 bp, Artificial Sequence
  chemically synthesized
gtcgccaggctggcatgcag

SEQ ID NO: 328212 - DNA, 20 bp, Artificial Sequence
  chemically synthesized
gagattgtgccactgcatgc

SEQ ID NO: 328213 - DNA, 20 bp, Artificial Sequence
  chemically synthesized
tctgtcgccaggctggcatg

SEQ ID NO: 328214 - DNA, 20 bp, Artificial Sequence
  chemically synthesized
tgtgccactgcatgccagcc

SEQ ID NO: 328215 - DNA, 20 bp, Artificial Sequence
  chemically synthesized
gtctccctctgtcgccaggc

SEQ ID NO: 328216 - DNA, 20 bp, Artificial Sequence
  chemically synthesized
actgcatgccagcctggcga

SEQ ID NO: 328217 - DNA, 20 bp, Artificial Sequence
  chemically synthesized
tgcatgccagcctggcgaca

SEQ ID NO: 328218 - DNA, 20 bp, Artificial Sequence
  chemically synthesized
tggagtctccctctgtcgcc

SEQ ID NO: 328219 - DNA, 20 bp, Artificial Sequence
  chemically synthesized
gcatgccagcctggcgacag

SEQ ID NO: 328220 - DNA, 20 bp, Artificial Sequence
  chemically synthesized
atggagtctccctctgtcgc

SEQ ID NO: 328221 - DNA, 20 bp, Artificial Sequence
  chemically synthesized
catgccagcctggcgacaga

SEQ ID NO: 328222 - DNA, 20 bp, Artificial Sequence
  chemically synthesized
tgccagcctggcgacagagg

SEQ ID NO: 328223 - DNA, 20 bp, Artificial Sequence
  chemically synthesized
gacagagggagactccatct

SEQ ID NO: 328224 - DNA, 20 bp, Artificial Sequence
  chemically synthesized
acagagggagactccatctc

SEQ ID NO: 328225 - DNA, 20 bp, Artificial Sequence
  chemically synthesized
tttttttttttcccgagatg

SEQ ID NO: 328226 - DNA, 20 bp, Artificial Sequence
  chemically synthesized
cttttttttttttcccgaga

SEQ ID NO: 328227 - DNA, 20 bp, Artificial Sequence
  chemically synthesized
tgtacttttttttttttccc

SEQ ID NO: 328228 - DNA, 20 bp, Artificial Sequence
  chemically synthesized
ccatctcgggaaaaaaaaaa

SEQ ID NO: 328229 - DNA, 20 bp, Artificial Sequence
  chemically synthesized
agatgaaatgtatgtcattt

SEQ ID NO: 328230 - DNA, 20 bp, Artificial Sequence
  chemically synthesized
aaatgacatacatttcatct

SEQ ID NO: 328231 - DNA, 20 bp, Artificial Sequence
  chemically synthesized
atgacatacatttcatctca

SEQ ID NO: 328232 - DNA, 20 bp, Artificial Sequence
  chemically synthesized
tacatttcatctcagagcct

SEQ ID NO: 328233 - DNA, 20 bp, Artificial Sequence
  chemically synthesized
tcaaattatacttaggctct

SEQ ID NO: 328234 - DNA, 20 bp, Artificial Sequence
  chemically synthesized
aaatgcttcaaattatactt

SEQ ID NO: 328235 - DNA, 20 bp, Artificial Sequence
  chemically synthesized
gaaatgcttcaaattatact

SEQ ID NO: 328236 - DNA, 20 bp, Artificial Sequence
  chemically synthesized
cagagcctaagtataatttg

SEQ ID NO: 328237 - DNA, 20 bp, Artificial Sequence
  chemically synthesized
tttgaagcatttcaaattgc

SEQ ID NO: 328238 - DNA, 20 bp, Artificial Sequence
  chemically synthesized
gatttgataagcaaatgggc

SEQ ID NO: 328239 - DNA, 20 bp, Artificial Sequence
  chemically synthesized
acaagatttgataagcaaat

SEQ ID NO: 328240 - DNA, 20 bp, Artificial Sequence
  chemically synthesized
aacaagatttgataagcaaa

SEQ ID NO: 328241 - DNA, 20 bp, Artificial Sequence
  chemically synthesized
aaaatataacaagatttgat

SEQ ID NO: 328242 - DNA, 20 bp, Artificial Sequence
  chemically synthesized
atgtgattcaaaaatataac

SEQ ID NO: 328243 - DNA, 20 bp, Artificial Sequence
  chemically synthesized
atttcattgttaaacaccct

SEQ ID NO: 328244 - DNA, 20 bp, Artificial Sequence
  chemically synthesized
catatgagtgtatacactga

SEQ ID NO: 328245 - DNA, 20 bp, Artificial Sequence
  chemically synthesized
acatatgagtgtatacactg

SEQ ID NO: 328246 - DNA, 20 bp, Artificial Sequence
  chemically synthesized
gacatatgagtgtatacact

SEQ ID NO: 328247 - DNA, 20 bp, Artificial Sequence
  chemically synthesized
tgataggcatagggacatat

SEQ ID NO: 328248 - DNA, 20 bp, Artificial Sequence
  chemically synthesized
ccacaaagttgataggcata

SEQ ID NO: 328249 - DNA, 20 bp, Artificial Sequence
  chemically synthesized
tccacaaagttgataggcat

SEQ ID NO: 328250 - DNA, 20 bp, Artificial Sequence
  chemically synthesized
gtccacaaagttgataggca

SEQ ID NO: 328251 - DNA, 20 bp, Artificial Sequence
  chemically synthesized
tctcagtccacaaagttgat

SEQ ID NO: 328252 - DNA, 20 bp, Artificial Sequence
  chemically synthesized
gtctcagtccacaaagttga

SEQ ID NO: 328253 - DNA, 20 bp, Artificial Sequence
  chemically synthesized
ccctatgcctatcaactttg

SEQ ID NO: 328254 - DNA, 20 bp, Artificial Sequence
  chemically synthesized
tattcttgtctcagtccaca

SEQ ID NO: 328255 - DNA, 20 bp, Artificial Sequence
  chemically synthesized
gcctatcaactttgtggact

SEQ ID NO: 328256 - DNA, 20 bp, Artificial Sequence
  chemically synthesized
tcaactttgtggactgagac

SEQ ID NO: 328257 - DNA, 20 bp, Artificial Sequence
  chemically synthesized
taaaaaaaatattcttgtct

SEQ ID NO: 328258 - DNA, 20 bp, Artificial Sequence
  chemically synthesized
aagaatattttttttacctc

SEQ ID NO: 328259 - DNA, 20 bp, Artificial Sequence
  chemically synthesized
attttttttacctcaagtgt

SEQ ID NO: 328260 - DNA, 20 bp, Artificial Sequence
  chemically synthesized
tgattacattcttacacttg

SEQ ID NO: 328261 - DNA, 20 bp, Artificial Sequence
  chemically synthesized
gtgattacattcttacactt

SEQ ID NO: 328262 - DNA, 20 bp, Artificial Sequence
  chemically synthesized
gtaaatagtctgagttttga

SEQ ID NO: 328263 - DNA, 20 bp, Artificial Sequence
  chemically synthesized
atgtaatcactatcaaaact

SEQ ID NO: 328264 - DNA, 20 bp, Artificial Sequence
  chemically synthesized
aaaacatcagtaaatagtct

SEQ ID NO: 328265 - DNA, 20 bp, Artificial Sequence
  chemically synthesized
tttagaaaaacatcagtaaa

SEQ ID NO: 328266 - DNA, 20 bp, Artificial Sequence
  chemically synthesized
tattccatttagaaaaacat

SEQ ID NO: 328267 - DNA, 20 bp, Artificial Sequence
  chemically synthesized
tttactgatgtttttctaaa

SEQ ID NO: 328268 - DNA, 20 bp, Artificial Sequence
  chemically synthesized
tgatgtttttctaaatggaa

SEQ ID NO: 328269 - DNA, 20 bp, Artificial Sequence
  chemically synthesized
atgcaacagactattccatt

SEQ ID NO: 328270 - DNA, 20 bp, Artificial Sequence
  chemically synthesized
ctcatgactgaataatgcaa

SEQ ID NO: 328271 - DNA, 20 bp, Artificial Sequence
  chemically synthesized
gaatagtctgttgcattatt

SEQ ID NO: 328272 - DNA, 20 bp, Artificial Sequence
  chemically synthesized
ctgttgcattattcagtcat

SEQ ID NO: 328273 - DNA, 20 bp, Artificial Sequence
  chemically synthesized
atgagaaatcatgtttttga

SEQ ID NO: 328274 - DNA, 20 bp, Artificial Sequence
  chemically synthesized
tgagaaatcatgtttttgac

SEQ ID NO: 328275 - DNA, 20 bp, Artificial Sequence
  chemically synthesized
gagaaatcatgtttttgaca

SEQ ID NO: 328276 - DNA, 20 bp, Artificial Sequence
  chemically synthesized
tttgacagggcttgtttctc

SEQ ID NO: 328277 - DNA, 20 bp, Artificial Sequence
  chemically synthesized
tttaagccaacttgagaaac

SEQ ID NO: 328278 - DNA, 20 bp, Artificial Sequence
  chemically synthesized
acagggcttgtttctcaagt

SEQ ID NO: 328279 - DNA, 20 bp, Artificial Sequence
  chemically synthesized
ggaaccttttaagccaactt

SEQ ID NO: 328280 - DNA, 20 bp, Artificial Sequence
  chemically synthesized
tgtttctcaagttggcttaa

SEQ ID NO: 328281 - DNA, 20 bp, Artificial Sequence
  chemically synthesized
gtttctcaagttggcttaaa

SEQ ID NO: 328282 - DNA, 20 bp, Artificial Sequence
  chemically synthesized
gagatgcgaaggaacctttt

SEQ ID NO: 328283 - DNA, 20 bp, Artificial Sequence
  chemically synthesized
tgaataatgcagagatgcga

SEQ ID NO: 328284 - DNA, 20 bp, Artificial Sequence
  chemically synthesized
gtgaataatgcagagatgcg

SEQ ID NO: 328285 - DNA, 20 bp, Artificial Sequence
  chemically synthesized
agcaatgtgtgaataatgca

SEQ ID NO: 328286 - DNA, 20 bp, Artificial Sequence
  chemically synthesized
acagcaatgtgtgaataatg

SEQ ID NO: 328287 - DNA, 20 bp, Artificial Sequence
  chemically synthesized
gcattattcacacattgctg

SEQ ID NO: 328288 - DNA, 20 bp, Artificial Sequence
  chemically synthesized
ttattcacacattgctgtag

SEQ ID NO: 328289 - DNA, 20 bp, Artificial Sequence
  chemically synthesized
tattcacacattgctgtaga

SEQ ID NO: 328290 - DNA, 20 bp, Artificial Sequence
  chemically synthesized
caagtttttagcaccttcta

SEQ ID NO: 328291 - DNA, 20 bp, Artificial Sequence
  chemically synthesized
tgtagaaggtgctaaaaact

SEQ ID NO: 328292 - DNA, 20 bp, Artificial Sequence
  chemically synthesized
gtctcctgatgccaagtttt

SEQ ID NO: 328293 - DNA, 20 bp, Artificial Sequence
  chemically synthesized
aggtgctaaaaacttggcat

SEQ ID NO: 328294 - DNA, 20 bp, Artificial Sequence
  chemically synthesized
ggtgctaaaaacttggcatc

SEQ ID NO: 328295 - DNA, 20 bp, Artificial Sequence
  chemically synthesized
ggactctgtctcctgatgcc

SEQ ID NO: 328296 - DNA, 20 bp, Artificial Sequence
  chemically synthesized
tgctaaaaacttggcatcag

SEQ ID NO: 328297 - DNA, 20 bp, Artificial Sequence
  chemically synthesized
aaaaacttggcatcaggaga

SEQ ID NO: 328298 - DNA, 20 bp, Artificial Sequence
  chemically synthesized
aaacttggcatcaggagaca

SEQ ID NO: 328299 - DNA, 20 bp, Artificial Sequence
  chemically synthesized
ggagacagagtcctactgat

SEQ ID NO: 328300 - DNA, 20 bp, Artificial Sequence
  chemically synthesized
atgataacctgctgatcagt

SEQ ID NO: 328301 - DNA, 20 bp, Artificial Sequence
  chemically synthesized
tatgataacctgctgatcag

SEQ ID NO: 328302 - DNA, 20 bp, Artificial Sequence
  chemically synthesized
gacagagtcctactgatcag

SEQ ID NO: 328303 - DNA, 20 bp, Artificial Sequence
  chemically synthesized
acagagtcctactgatcagc

SEQ ID NO: 328304 - DNA, 20 bp, Artificial Sequence
  chemically synthesized
tcatatgataacctgctgat

SEQ ID NO: 328305 - DNA, 20 bp, Artificial Sequence
  chemically synthesized
tcagcaggttatcatatgaa

SEQ ID NO: 328306 - DNA, 20 bp, Artificial Sequence
  chemically synthesized
gcaggttatcatatgaatag

SEQ ID NO: 328307 - DNA, 20 bp, Artificial Sequence
  chemically synthesized
tcatatgaatagtggaattc

SEQ ID NO: 328308 - DNA, 20 bp, Artificial Sequence
  chemically synthesized
tatgaatagtggaattccag

SEQ ID NO: 328309 - DNA, 20 bp, Artificial Sequence
  chemically synthesized
aatagtggaattccagcagc

SEQ ID NO: 328310 - DNA, 20 bp, Artificial Sequence
  chemically synthesized
tgttttaaaacacttgctgc

SEQ ID NO: 328311 - DNA, 20 bp, Artificial Sequence
  chemically synthesized
atgataaaataagtatcagg

SEQ ID NO: 328312 - DNA, 20 bp, Artificial Sequence
  chemically synthesized
aacatgataaaataagtatc

SEQ ID NO: 328313 - DNA, 20 bp, Artificial Sequence
  chemically synthesized
aaacatgataaaataagtat

SEQ ID NO: 328314 - DNA, 20 bp, Artificial Sequence
  chemically synthesized
tttataaaacatgataaaat

SEQ ID NO: 328315 - DNA, 20 bp, Artificial Sequence
  chemically synthesized
caaatcatgttaaactgttc

SEQ ID NO: 328316 - DNA, 20 bp, Artificial Sequence
  chemically synthesized
agaccatgacatcactggaa

SEQ ID NO: 328317 - DNA, 20 bp, Artificial Sequence
  chemically synthesized
agcagagaccatgacatcac

SEQ ID NO: 328318 - DNA, 20 bp, Artificial Sequence
  chemically synthesized
aaactgttccagtgatgtca

SEQ ID NO: 328319 - DNA, 20 bp, Artificial Sequence
  chemically synthesized
atggcatagggaagagagca

SEQ ID NO: 328320 - DNA, 20 bp, Artificial Sequence
  chemically synthesized
agatggcatagggaagagag

SEQ ID NO: 328321 - DNA, 20 bp, Artificial Sequence
  chemically synthesized
gcaagatggcatagggaaga

SEQ ID NO: 328322 - DNA, 20 bp, Artificial Sequence
  chemically synthesized
gagcaagatggcatagggaa

SEQ ID NO: 328323 - DNA, 20 bp, Artificial Sequence
  chemically synthesized
gagagcaagatggcataggg

SEQ ID NO: 328324 - DNA, 20 bp, Artificial Sequence
  chemically synthesized
tcagagagcaagatggcata

SEQ ID NO: 328325 - DNA, 20 bp, Artificial Sequence
  chemically synthesized
atcagagagcaagatggcat

SEQ ID NO: 328326 - DNA, 20 bp, Artificial Sequence
  chemically synthesized
tatcagagagcaagatggca

SEQ ID NO: 328327 - DNA, 20 bp, Artificial Sequence
  chemically synthesized
agttttatcagagagcaaga

SEQ ID NO: 328328 - DNA, 20 bp, Artificial Sequence
  chemically synthesized
ttcaagttttatcagagagc

SEQ ID NO: 328329 - DNA, 20 bp, Artificial Sequence
  chemically synthesized
caagttcaagttttatcaga

SEQ ID NO: 328330 - DNA, 20 bp, Artificial Sequence
  chemically synthesized
ttcaagttcaagttttatca

SEQ ID NO: 328331 - DNA, 20 bp, Artificial Sequence
  chemically synthesized
ctttcaagttcaagttttat

SEQ ID NO: 328332 - DNA, 20 bp, Artificial Sequence
  chemically synthesized
aaaaaaaatctttcaagttc

SEQ ID NO: 328333 - DNA, 20 bp, Artificial Sequence
  chemically synthesized
ctgataaaacttgaacttga

SEQ ID NO: 328334 - DNA, 20 bp, Artificial Sequence
  chemically synthesized
ttaaaaaaaaaaaatctttc

SEQ ID NO: 328335 - DNA, 20 bp, Artificial Sequence
  chemically synthesized
aagattttttttttttaatg

SEQ ID NO: 328336 - DNA, 20 bp, Artificial Sequence
  chemically synthesized
agattttttttttttaatga

SEQ ID NO: 328337 - DNA, 20 bp, Artificial Sequence
  chemically synthesized
gattttttttttttaatgaa

SEQ ID NO: 328338 - DNA, 20 bp, Artificial Sequence
  chemically synthesized
ttttttttttttaatgaagg

SEQ ID NO: 328339 - DNA, 20 bp, Artificial Sequence
  chemically synthesized
tttttttttttaatgaaggg

SEQ ID NO: 328340 - DNA, 20 bp, Artificial Sequence
  chemically synthesized
ttaatgaagggaggaaaata

SEQ ID NO: 328341 - DNA, 20 bp, Artificial Sequence
  chemically synthesized
aatgaagggaggaaaataca

SEQ ID NO: 328342 - DNA, 20 bp, Artificial Sequence
  chemically synthesized
ggaggaaaatacagagacta

SEQ ID NO: 328343 - DNA, 20 bp, Artificial Sequence
  chemically synthesized
cttaattctcttcaatgccg

SEQ ID NO: 328344 - DNA, 20 bp, Artificial Sequence
  chemically synthesized
atacagagactacggcattg

SEQ ID NO: 328345 - DNA, 20 bp, Artificial Sequence
  chemically synthesized
acagagactacggcattgaa

SEQ ID NO: 328346 - DNA, 20 bp, Artificial Sequence
  chemically synthesized
ctacggcattgaagagaatt

SEQ ID NO: 328347 - DNA, 20 bp, Artificial Sequence
  chemically synthesized
cggcattgaagagaattaag

SEQ ID NO: 328348 - DNA, 20 bp, Artificial Sequence
  chemically synthesized
ggcattgaagagaattaagt

SEQ ID NO: 328349 - DNA, 20 bp, Artificial Sequence
  chemically synthesized
ttttagtaagtgattattat

SEQ ID NO: 328350 - DNA, 20 bp, Artificial Sequence
  chemically synthesized
aacatactcccatttttagt

SEQ ID NO: 328351 - DNA, 20 bp, Artificial Sequence
  chemically synthesized
taataatcacttactaaaaa

SEQ ID NO: 328352 - DNA, 20 bp, Artificial Sequence
  chemically synthesized
aataatcacttactaaaaat

SEQ ID NO: 328353 - DNA, 20 bp, Artificial Sequence
  chemically synthesized
taatcacttactaaaaatgg

SEQ ID NO: 328354 - DNA, 20 bp, Artificial Sequence
  chemically synthesized
aactaacatactcccatttt

SEQ ID NO: 328355 - DNA, 20 bp, Artificial Sequence
  chemically synthesized
tactaaaaatgggagtatgt

SEQ ID NO: 328356 - DNA, 20 bp, Artificial Sequence
  chemically synthesized
gtatgttagttaaatactaa

SEQ ID NO: 328357 - DNA, 20 bp, Artificial Sequence
  chemically synthesized
tatgttagttaaatactaat

SEQ ID NO: 328358 - DNA, 20 bp, Artificial Sequence
  chemically synthesized
ataagaagttttaatcccat

SEQ ID NO: 328359 - DNA, 20 bp, Artificial Sequence
  chemically synthesized
gggattaaaacttcttatcg

SEQ ID NO: 328360 - DNA, 20 bp, Artificial Sequence
  chemically synthesized
cagcatacagcttcgataag

SEQ ID NO: 328361 - DNA, 20 bp, Artificial Sequence
  chemically synthesized
attcagcatacagcttcgat

SEQ ID NO: 328362 - DNA, 20 bp, Artificial Sequence
  chemically synthesized
tgtaatgaacattcagcata

SEQ ID NO: 328363 - DNA, 20 bp, Artificial Sequence
  chemically synthesized
agaaaaatgtaatgaacatt

SEQ ID NO: 328364 - DNA, 20 bp, Artificial Sequence
  chemically synthesized
gaatgttcattacatttttc

SEQ ID NO: 328365 - DNA, 20 bp, Artificial Sequence
  chemically synthesized
tttttcaggacaaaaatgtc

SEQ ID NO: 328366 - DNA, 20 bp, Artificial Sequence
  chemically synthesized
cctataaatgttgatttttc

SEQ ID NO: 328367 - DNA, 20 bp, Artificial Sequence
  chemically synthesized
acctataaatgttgattttt

SEQ ID NO: 328368 - DNA, 20 bp, Artificial Sequence
  chemically synthesized
tcctgaaaaatcaacattta

SEQ ID NO: 328369 - DNA, 20 bp, Artificial Sequence
  chemically synthesized
cctgaaaaatcaacatttat

SEQ ID NO: 328370 - DNA, 20 bp, Artificial Sequence
  chemically synthesized
aatgtgctatataaaatatg

SEQ ID NO: 328371 - DNA, 20 bp, Artificial Sequence
  chemically synthesized
ttgataccacatattttata

SEQ ID NO: 328372 - DNA, 20 bp, Artificial Sequence
  chemically synthesized
agcacattgtatgttataca

SEQ ID NO: 328373 - DNA, 20 bp, Artificial Sequence
  chemically synthesized
gcacattgtatgttatacac

SEQ ID NO: 328374 - DNA, 20 bp, Artificial Sequence
  chemically synthesized
atgttatacacaggaattta

SEQ ID NO: 328375 - DNA, 20 bp, Artificial Sequence
  chemically synthesized
caggaatttacggtgtactg

SEQ ID NO: 328376 - DNA, 20 bp, Artificial Sequence
  chemically synthesized
cactctgtggtaggaatcta

SEQ ID NO: 328377 - DNA, 20 bp, Artificial Sequence
  chemically synthesized
tgtactgtagattcctacca

SEQ ID NO: 328378 - DNA, 20 bp, Artificial Sequence
  chemically synthesized
tactgtagattcctaccaca

SEQ ID NO: 328379 - DNA, 20 bp, Artificial Sequence
  chemically synthesized
ttgatgatacactctgtggt

SEQ ID NO: 328380 - DNA, 20 bp, Artificial Sequence
  chemically synthesized
tttgatgatacactctgtgg

SEQ ID NO: 328381 - DNA, 20 bp, Artificial Sequence
  chemically synthesized
aattttgatgatacactctg

SEQ ID NO: 328382 - DNA, 20 bp, Artificial Sequence
  chemically synthesized
acagagtgtatcatcaaaat

SEQ ID NO: 328383 - DNA, 20 bp, Artificial Sequence
  chemically synthesized
cagagtgtatcatcaaaatt

SEQ ID NO: 328384 - DNA, 20 bp, Artificial Sequence
  chemically synthesized
gagtgtatcatcaaaattag

SEQ ID NO: 328385 - DNA, 20 bp, Artificial Sequence
  chemically synthesized
catcaaaattaggagtttat

SEQ ID NO: 328386 - DNA, 20 bp, Artificial Sequence
  chemically synthesized
tcagattgggagagaattaa

SEQ ID NO: 328387 - DNA, 20 bp, Artificial Sequence
  chemically synthesized
tttcagattgggagagaatt

SEQ ID NO: 328388 - DNA, 20 bp, Artificial Sequence
  chemically synthesized
gttaatatttcagattggga

SEQ ID NO: 328389 - DNA, 20 bp, Artificial Sequence
  chemically synthesized
atgttaatatttcagattgg

SEQ ID NO: 328390 - DNA, 20 bp, Artificial Sequence
  chemically synthesized
tgatgttaatatttcagatt

SEQ ID NO: 328391 - DNA, 20 bp, Artificial Sequence
  chemically synthesized
atgatgttaatatttcagat

SEQ ID NO: 328392 - DNA, 20 bp, Artificial Sequence
  chemically synthesized
gaagaatgatgttaatattt

SEQ ID NO: 328393 - DNA, 20 bp, Artificial Sequence
  chemically synthesized
ggagatgggatagttcatag

SEQ ID NO: 328394 - DNA, 20 bp, Artificial Sequence
  chemically synthesized
ggaggagatgggatagttca

SEQ ID NO: 328395 - DNA, 20 bp, Artificial Sequence
  chemically synthesized
aaagtaaggaggagatggga

SEQ ID NO: 328396 - DNA, 20 bp, Artificial Sequence
  chemically synthesized
gatgaaagtaaggaggagat

SEQ ID NO: 328397 - DNA, 20 bp, Artificial Sequence
  chemically synthesized
tgatgaaagtaaggaggaga

SEQ ID NO: 328398 - DNA, 20 bp, Artificial Sequence
  chemically synthesized
tcagtgatgaaagtaaggag

SEQ ID NO: 328399 - DNA, 20 bp, Artificial Sequence
  chemically synthesized
gttcagtgatgaaagtaagg

SEQ ID NO: 328400 - DNA, 20 bp, Artificial Sequence
  chemically synthesized
ggttcagtgatgaaagtaag

SEQ ID NO: 328401 - DNA, 20 bp, Artificial Sequence
  chemically synthesized
gaggttcagtgatgaaagta

SEQ ID NO: 328402 - DNA, 20 bp, Artificial Sequence
  chemically synthesized
tgaggttcagtgatgaaagt

SEQ ID NO: 328403 - DNA, 20 bp, Artificial Sequence
  chemically synthesized
attctgaggttcagtgatga

SEQ ID NO: 328404 - DNA, 20 bp, Artificial Sequence
  chemically synthesized
ttactttcatcactgaacct

SEQ ID NO: 328405 - DNA, 20 bp, Artificial Sequence
  chemically synthesized
gtttaatcaattctgaggtt

SEQ ID NO: 328406 - DNA, 20 bp, Artificial Sequence
  chemically synthesized
ggaaagtttaatcaattctg

SEQ ID NO: 328407 - DNA, 20 bp, Artificial Sequence
  chemically synthesized
aggaaagtttaatcaattct

SEQ ID NO: 328408 - DNA, 20 bp, Artificial Sequence
  chemically synthesized
atgggaaactggaaggagga

SEQ ID NO: 328409 - DNA, 20 bp, Artificial Sequence
  chemically synthesized
tgattaaactttcctccttc

SEQ ID NO: 328410 - DNA, 20 bp, Artificial Sequence
  chemically synthesized
gattatgggaaactggaagg

SEQ ID NO: 328411 - DNA, 20 bp, Artificial Sequence
  chemically synthesized
tgattatgggaaactggaag

SEQ ID NO: 328412 - DNA, 20 bp, Artificial Sequence
  chemically synthesized
gctgattatgggaaactgga

SEQ ID NO: 328413 - DNA, 20 bp, Artificial Sequence
  chemically synthesized
ggctgattatgggaaactgg

SEQ ID NO: 328414 - DNA, 20 bp, Artificial Sequence
  chemically synthesized
tacggctgattatgggaaac

SEQ ID NO: 328415 - DNA, 20 bp, Artificial Sequence
  chemically synthesized
tccttccagtttcccataat

SEQ ID NO: 328416 - DNA, 20 bp, Artificial Sequence
  chemically synthesized
atagaattacggctgattat

SEQ ID NO: 328417 - DNA, 20 bp, Artificial Sequence
  chemically synthesized
catagaattacggctgatta

SEQ ID NO: 328418 - DNA, 20 bp, Artificial Sequence
  chemically synthesized
agaaataatacatagaatta

SEQ ID NO: 328419 - DNA, 20 bp, Artificial Sequence
  chemically synthesized
ggaaaacaagaaataataca

SEQ ID NO: 328420 - DNA, 20 bp, Artificial Sequence
  chemically synthesized
taagtataagtgtggaaaac

SEQ ID NO: 328421 - DNA, 20 bp, Artificial Sequence
  chemically synthesized
gggatttttaagtataagtg

SEQ ID NO: 328422 - DNA, 20 bp, Artificial Sequence
  chemically synthesized
tgagagggatttttaagtat

SEQ ID NO: 328423 - DNA, 20 bp, Artificial Sequence
  chemically synthesized
gtgctgtgagagggattttt

SEQ ID NO: 328424 - DNA, 20 bp, Artificial Sequence
  chemically synthesized
atacttaaaaatccctctca

SEQ ID NO: 328425 - DNA, 20 bp, Artificial Sequence
  chemically synthesized
tatacttgtgtgctgtgaga

SEQ ID NO: 328426 - DNA, 20 bp, Artificial Sequence
  chemically synthesized
gtatacttgtgtgctgtgag

SEQ ID NO: 328427 - DNA, 20 bp, Artificial Sequence
  chemically synthesized
agtatacttgtgtgctgtga

SEQ ID NO: 328428 - DNA, 20 bp, Artificial Sequence
  chemically synthesized
gaagtatacttgtgtgctgt

SEQ ID NO: 328429 - DNA, 20 bp, Artificial Sequence
  chemically synthesized
aaatccctctcacagcacac

SEQ ID NO: 328430 - DNA, 20 bp, Artificial Sequence
  chemically synthesized
acacaagtatacttctaaaa

SEQ ID NO: 328431 - DNA, 20 bp, Artificial Sequence
  chemically synthesized
aactggatctactgttttag

SEQ ID NO: 328432 - DNA, 20 bp, Artificial Sequence
  chemically synthesized
caagtatacttctaaaacag

SEQ ID NO: 328433 - DNA, 20 bp, Artificial Sequence
  chemically synthesized
ggcaactggatctactgttt

SEQ ID NO: 328434 - DNA, 20 bp, Artificial Sequence
  chemically synthesized
tacttctaaaacagtagatc

SEQ ID NO: 328435 - DNA, 20 bp, Artificial Sequence
  chemically synthesized
gcaggtaggggaagggcaac

SEQ ID NO: 328436 - DNA, 20 bp, Artificial Sequence
  chemically synthesized
ggaggatgcaggtaggggaa

SEQ ID NO: 328437 - DNA, 20 bp, Artificial Sequence
  chemically synthesized
aggaggatgcaggtagggga

SEQ ID NO: 328438 - DNA, 20 bp, Artificial Sequence
  chemically synthesized
gaggaggatgcaggtagggg

SEQ ID NO: 328439 - DNA, 20 bp, Artificial Sequence
  chemically synthesized
attgaggaggatgcaggtag

SEQ ID NO: 328440 - DNA, 20 bp, Artificial Sequence
  chemically synthesized
aattgaggaggatgcaggta

SEQ ID NO: 328441 - DNA, 20 bp, Artificial Sequence
  chemically synthesized
gaattgaggaggatgcaggt

SEQ ID NO: 328442 - DNA, 20 bp, Artificial Sequence
  chemically synthesized
tgaattgaggaggatgcagg

SEQ ID NO: 328443 - DNA, 20 bp, Artificial Sequence
  chemically synthesized
aaatgaattgaggaggatgc

SEQ ID NO: 328444 - DNA, 20 bp, Artificial Sequence
  chemically synthesized
caaatgaattgaggaggatg

SEQ ID NO: 328445 - DNA, 20 bp, Artificial Sequence
  chemically synthesized
gtgctgcaaatgaattgagg

SEQ ID NO: 328446 - DNA, 20 bp, Artificial Sequence
  chemically synthesized
agtgctgcaaatgaattgag

SEQ ID NO: 328447 - DNA, 20 bp, Artificial Sequence
  chemically synthesized
acagtgctgcaaatgaattg

SEQ ID NO: 328448 - DNA, 20 bp, Artificial Sequence
  chemically synthesized
aacagtgctgcaaatgaatt

SEQ ID NO: 328449 - DNA, 20 bp, Artificial Sequence
  chemically synthesized
catcctcctcaattcatttg

SEQ ID NO: 328450 - DNA, 20 bp, Artificial Sequence
  chemically synthesized
aagaaggtagttatgttaaa

SEQ ID NO: 328451 - DNA, 20 bp, Artificial Sequence
  chemically synthesized
taaaaagactttaaagaagg

SEQ ID NO: 328452 - DNA, 20 bp, Artificial Sequence
  chemically synthesized
taacataactaccttcttta

SEQ ID NO: 328453 - DNA, 20 bp, Artificial Sequence
  chemically synthesized
atttaaaaagactttaaaga

SEQ ID NO: 328454 - DNA, 20 bp, Artificial Sequence
  chemically synthesized
tatttaaaaagactttaaag

SEQ ID NO: 328455 - DNA, 20 bp, Artificial Sequence
  chemically synthesized
agatatttaaaaagacttta

SEQ ID NO: 328456 - DNA, 20 bp, Artificial Sequence
  chemically synthesized
tcacataacagatatttaaa

SEQ ID NO: 328457 - DNA, 20 bp, Artificial Sequence
  chemically synthesized
aggaaagtaccatcacataa

SEQ ID NO: 328458 - DNA, 20 bp, Artificial Sequence
  chemically synthesized
tttaaatatctgttatgtga

SEQ ID NO: 328459 - DNA, 20 bp, Artificial Sequence
  chemically synthesized
ttatgtgatggtactttcct

SEQ ID NO: 328460 - DNA, 20 bp, Artificial Sequence
  chemically synthesized
tatgtgatggtactttccta

SEQ ID NO: 328461 - DNA, 20 bp, Artificial Sequence
  chemically synthesized
atttaagagtttccttagga

SEQ ID NO: 328462 - DNA, 20 bp, Artificial Sequence
  chemically synthesized
tacgatttaagagtttcctt

SEQ ID NO: 328463 - DNA, 20 bp, Artificial Sequence
  chemically synthesized
gtacgatttaagagtttcct

SEQ ID NO: 328464 - DNA, 20 bp, Artificial Sequence
  chemically synthesized
catagttaggtacgatttaa

SEQ ID NO: 328465 - DNA, 20 bp, Artificial Sequence
  chemically synthesized
gacatagttaggtacgattt

SEQ ID NO: 328466 - DNA, 20 bp, Artificial Sequence
  chemically synthesized
tagaggtgggagacatagtt

SEQ ID NO: 328467 - DNA, 20 bp, Artificial Sequence
  chemically synthesized
ctagaggtgggagacatagt

SEQ ID NO: 328468 - DNA, 20 bp, Artificial Sequence
  chemically synthesized
ggaactagaggtgggagaca

SEQ ID NO: 328469 - DNA, 20 bp, Artificial Sequence
  chemically synthesized
ctaactatgtctcccacctc

SEQ ID NO: 328470 - DNA, 20 bp, Artificial Sequence
  chemically synthesized
ctgtagggaactagaggtgg

SEQ ID NO: 328471 - DNA, 20 bp, Artificial Sequence
  chemically synthesized
atctgtagggaactagaggt

SEQ ID NO: 328472 - DNA, 20 bp, Artificial Sequence
  chemically synthesized
tatctgtagggaactagagg

SEQ ID NO: 328473 - DNA, 20 bp, Artificial Sequence
  chemically synthesized
atctatctgtagggaactag

SEQ ID NO: 328474 - DNA, 20 bp, Artificial Sequence
  chemically synthesized
tatctatctgtagggaacta

SEQ ID NO: 328475 - DNA, 20 bp, Artificial Sequence
  chemically synthesized
tctatctatctgtagggaac

SEQ ID NO: 328476 - DNA, 20 bp, Artificial Sequence
  chemically synthesized
ctcccacctctagttcccta

SEQ ID NO: 328477 - DNA, 20 bp, Artificial Sequence
  chemically synthesized
cacctctagttccctacaga

SEQ ID NO: 328478 - DNA, 20 bp, Artificial Sequence
  chemically synthesized
gatcgatctatctatctgta

SEQ ID NO: 328479 - DNA, 20 bp, Artificial Sequence
  chemically synthesized
tgatcgatctatctatctgt

SEQ ID NO: 328480 - DNA, 20 bp, Artificial Sequence
  chemically synthesized
ttgatcgatctatctatctg

SEQ ID NO: 328481 - DNA, 20 bp, Artificial Sequence
  chemically synthesized
tctagttccctacagataga

SEQ ID NO: 328482 - DNA, 20 bp, Artificial Sequence
  chemically synthesized
aatttgaagaggttcaagga

SEQ ID NO: 328483 - DNA, 20 bp, Artificial Sequence
  chemically synthesized
atcaaatttgaagaggttca

SEQ ID NO: 328484 - DNA, 20 bp, Artificial Sequence
  chemically synthesized
aatcaaatttgaagaggttc

SEQ ID NO: 328485 - DNA, 20 bp, Artificial Sequence
  chemically synthesized
aagtacaatcaaatttgaag

SEQ ID NO: 328486 - DNA, 20 bp, Artificial Sequence
  chemically synthesized
aaagtacaatcaaatttgaa

SEQ ID NO: 328487 - DNA, 20 bp, Artificial Sequence
  chemically synthesized
aaaaagtacaatcaaatttg

SEQ ID NO: 328488 - DNA, 20 bp, Artificial Sequence
  chemically synthesized
tgaaatttcacagagaaaaa

SEQ ID NO: 328489 - DNA, 20 bp, Artificial Sequence
  chemically synthesized
aaagtacatgaaatttcaca

SEQ ID NO: 328490 - DNA, 20 bp, Artificial Sequence
  chemically synthesized
aaaaagtacatgaaatttca

SEQ ID NO: 328491 - DNA, 20 bp, Artificial Sequence
  chemically synthesized
gtgaaatttcatgtactttt

SEQ ID NO: 328492 - DNA, 20 bp, Artificial Sequence
  chemically synthesized
tgaaatttcatgtacttttt

SEQ ID NO: 328493 - DNA, 20 bp, Artificial Sequence
  chemically synthesized
gataacagagtaatcccaaa

SEQ ID NO: 328494 - DNA, 20 bp, Artificial Sequence
  chemically synthesized
tagggtggagagagataaca

SEQ ID NO: 328495 - DNA, 20 bp, Artificial Sequence
  chemically synthesized
gctagggtggagagagataa

SEQ ID NO: 328496 - DNA, 20 bp, Artificial Sequence
  chemically synthesized
tgcaggggctagggtggaga

SEQ ID NO: 328497 - DNA, 20 bp, Artificial Sequence
  chemically synthesized
tctgttatctctctccaccc

SEQ ID NO: 328498 - DNA, 20 bp, Artificial Sequence
  chemically synthesized
attgcaggggctagggtgga

SEQ ID NO: 328499 - DNA, 20 bp, Artificial Sequence
  chemically synthesized
gcattgcaggggctagggtg

SEQ ID NO: 328500 - DNA, 20 bp, Artificial Sequence
  chemically synthesized
tcgcattgcaggggctaggg

SEQ ID NO: 328501 - DNA, 20 bp, Artificial Sequence
  chemically synthesized
gaatcgcattgcaggggcta

SEQ ID NO: 328502 - DNA, 20 bp, Artificial Sequence
  chemically synthesized
agaatcgcattgcaggggct

SEQ ID NO: 328503 - DNA, 20 bp, Artificial Sequence
  chemically synthesized
tagaatcgcattgcaggggc

SEQ ID NO: 328504 - DNA, 20 bp, Artificial Sequence
  chemically synthesized
gtgatagaatcgcattgcag

SEQ ID NO: 328505 - DNA, 20 bp, Artificial Sequence
  chemically synthesized
agtgatagaatcgcattgca

SEQ ID NO: 328506 - DNA, 20 bp, Artificial Sequence
  chemically synthesized
cagtgatagaatcgcattgc

SEQ ID NO: 328507 - DNA, 20 bp, Artificial Sequence
  chemically synthesized
ccagtgatagaatcgcattg

SEQ ID NO: 328508 - DNA, 20 bp, Artificial Sequence
  chemically synthesized
ctgcaatgcgattctatcac

SEQ ID NO: 328509 - DNA, 20 bp, Artificial Sequence
  chemically synthesized
agatcagttaagaccagtga

SEQ ID NO: 328510 - DNA, 20 bp, Artificial Sequence
  chemically synthesized
atcaacagatcagttaagac

SEQ ID NO: 328511 - DNA, 20 bp, Artificial Sequence
  chemically synthesized
ttattatcaacagatcagtt

SEQ ID NO: 328512 - DNA, 20 bp, Artificial Sequence
  chemically synthesized
agggtttattatcaacagat

SEQ ID NO: 328513 - DNA, 20 bp, Artificial Sequence
  chemically synthesized
aaatcagggtttattatcaa

SEQ ID NO: 328514 - DNA, 20 bp, Artificial Sequence
  chemically synthesized
ctaactgtatttggaaatca

SEQ ID NO: 328515 - DNA, 20 bp, Artificial Sequence
  chemically synthesized
gctaactgtatttggaaatc

SEQ ID NO: 328516 - DNA, 20 bp, Artificial Sequence
  chemically synthesized
agctaactgtatttggaaat

SEQ ID NO: 328517 - DNA, 20 bp, Artificial Sequence
  chemically synthesized
taaaccctgatttccaaata

SEQ ID NO: 328518 - DNA, 20 bp, Artificial Sequence
  chemically synthesized
cagaataagctaactgtatt

SEQ ID NO: 328519 - DNA, 20 bp, Artificial Sequence
  chemically synthesized
ccctgatttccaaatacagt

SEQ ID NO: 328520 - DNA, 20 bp, Artificial Sequence
  chemically synthesized
caaatacagttagcttattc

SEQ ID NO: 328521 - DNA, 20 bp, Artificial Sequence
  chemically synthesized
aatacagttagcttattctg

SEQ ID NO: 328522 - DNA, 20 bp, Artificial Sequence
  chemically synthesized
atacagttagcttattctgg

SEQ ID NO: 328523 - DNA, 20 bp, Artificial Sequence
  chemically synthesized
gtcaaggttgcctccagaat

SEQ ID NO: 328524 - DNA, 20 bp, Artificial Sequence
  chemically synthesized
gaaagtgtcaaggttgcctc

SEQ ID NO: 328525 - DNA, 20 bp, Artificial Sequence
  chemically synthesized
atgctgagttgaaagtgtca

SEQ ID NO: 328526 - DNA, 20 bp, Artificial Sequence
  chemically synthesized
catgctgagttgaaagtgtc

SEQ ID NO: 328527 - DNA, 20 bp, Artificial Sequence
  chemically synthesized
caaccttgacactttcaact

SEQ ID NO: 328528 - DNA, 20 bp, Artificial Sequence
  chemically synthesized
aaagggccatgctgagttga

SEQ ID NO: 328529 - DNA, 20 bp, Artificial Sequence
  chemically synthesized
ttgacactttcaactcagca

SEQ ID NO: 328530 - DNA, 20 bp, Artificial Sequence
  chemically synthesized
aaaccaaaaagggccatgct

SEQ ID NO: 328531 - DNA, 20 bp, Artificial Sequence
  chemically synthesized
caactcagcatggccctttt

SEQ ID NO: 328532 - DNA, 20 bp, Artificial Sequence
  chemically synthesized
ttgccaaaaaaaaccaaaaa

SEQ ID NO: 328533 - DNA, 20 bp, Artificial Sequence
  chemically synthesized
attgccaaaaaaaaccaaaa

SEQ ID NO: 328534 - DNA, 20 bp, Artificial Sequence
  chemically synthesized
gattgccaaaaaaaaccaaa

SEQ ID NO: 328535 - DNA, 20 bp, Artificial Sequence
  chemically synthesized
tggccctttttggttttttt

SEQ ID NO: 328536 - DNA, 20 bp, Artificial Sequence
  chemically synthesized
ttttttggcaatccttccta

SEQ ID NO: 328537 - DNA, 20 bp, Artificial Sequence
  chemically synthesized
tttttggcaatccttcctaa

SEQ ID NO: 328538 - DNA, 20 bp, Artificial Sequence
  chemically synthesized
gaggcactttgcctttagga

SEQ ID NO: 328539 - DNA, 20 bp, Artificial Sequence
  chemically synthesized
agaggcactttgcctttagg

SEQ ID NO: 328540 - DNA, 20 bp, Artificial Sequence
  chemically synthesized
ggcaatccttcctaaaggca

SEQ ID NO: 328541 - DNA, 20 bp, Artificial Sequence
  chemically synthesized
tggagaggcactttgccttt

SEQ ID NO: 328542 - DNA, 20 bp, Artificial Sequence
  chemically synthesized
atggagaggcactttgcctt

SEQ ID NO: 328543 - DNA, 20 bp, Artificial Sequence
  chemically synthesized
aggcaaagtgcctctccatt

SEQ ID NO: 328544 - DNA, 20 bp, Artificial Sequence
  chemically synthesized
acttatgaagctgaatggag

SEQ ID NO: 328545 - DNA, 20 bp, Artificial Sequence
  chemically synthesized
gacttatgaagctgaatgga

SEQ ID NO: 328546 - DNA, 20 bp, Artificial Sequence
  chemically synthesized
gggacttatgaagctgaatg

SEQ ID NO: 328547 - DNA, 20 bp, Artificial Sequence
  chemically synthesized
ctgggacttatgaagctgaa

SEQ ID NO: 328548 - DNA, 20 bp, Artificial Sequence
  chemically synthesized
gcctctccattcagcttcat

SEQ ID NO: 328549 - DNA, 20 bp, Artificial Sequence
  chemically synthesized
tttcaaccctgggacttatg

SEQ ID NO: 328550 - DNA, 20 bp, Artificial Sequence
  chemically synthesized
ccattcagcttcataagtcc

SEQ ID NO: 328551 - DNA, 20 bp, Artificial Sequence
  chemically synthesized
cattcagcttcataagtccc

SEQ ID NO: 328552 - DNA, 20 bp, Artificial Sequence
  chemically synthesized
attcagcttcataagtccca

SEQ ID NO: 328553 - DNA, 20 bp, Artificial Sequence
  chemically synthesized
aagtcatgtgtttcaaccct

SEQ ID NO: 328554 - DNA, 20 bp, Artificial Sequence
  chemically synthesized
caagtcatgtgtttcaaccc

SEQ ID NO: 328555 - DNA, 20 bp, Artificial Sequence
  chemically synthesized
attggcaggttttgaataac

SEQ ID NO: 328556 - DNA, 20 bp, Artificial Sequence
  chemically synthesized
ggcaagagaagggcattggc

SEQ ID NO: 328557 - DNA, 20 bp, Artificial Sequence
  chemically synthesized
aggcaagagaagggcattgg

SEQ ID NO: 328558 - DNA, 20 bp, Artificial Sequence
  chemically synthesized
agtaggcaagagaagggcat

SEQ ID NO: 328559 - DNA, 20 bp, Artificial Sequence
  chemically synthesized
ttattcagtaggcaagagaa

SEQ ID NO: 328560 - DNA, 20 bp, Artificial Sequence
  chemically synthesized
tttattcagtaggcaagaga

SEQ ID NO: 328561 - DNA, 20 bp, Artificial Sequence
  chemically synthesized
ttttattcagtaggcaagag

SEQ ID NO: 328562 - DNA, 20 bp, Artificial Sequence
  chemically synthesized
acattttattcagtaggcaa

SEQ ID NO: 328563 - DNA, 20 bp, Artificial Sequence
  chemically synthesized
atacattttattcagtaggc

SEQ ID NO: 328564 - DNA, 20 bp, Artificial Sequence
  chemically synthesized
ggagatacattttattcagt

SEQ ID NO: 328565 - DNA, 20 bp, Artificial Sequence
  chemically synthesized
aggagatacattttattcag

SEQ ID NO: 328566 - DNA, 20 bp, Artificial Sequence
  chemically synthesized
tcaaggagatacattttatt

SEQ ID NO: 328567 - DNA, 20 bp, Artificial Sequence
  chemically synthesized
tgaataaaatgtatctcctt

SEQ ID NO: 328568 - DNA, 20 bp, Artificial Sequence
  chemically synthesized
ttttgcatatcatgctcaag

SEQ ID NO: 328569 - DNA, 20 bp, Artificial Sequence
  chemically synthesized
gattttgcatatcatgctca

SEQ ID NO: 328570 - DNA, 20 bp, Artificial Sequence
  chemically synthesized
ggattttgcatatcatgctc

SEQ ID NO: 328571 - DNA, 20 bp, Artificial Sequence
  chemically synthesized
ggttgaaggacacattgtgg

SEQ ID NO: 328572 - DNA, 20 bp, Artificial Sequence
  chemically synthesized
aggttgaaggacacattgtg

SEQ ID NO: 328573 - DNA, 20 bp, Artificial Sequence
  chemically synthesized
tgaggttgaaggacacattg

SEQ ID NO: 328574 - DNA, 20 bp, Artificial Sequence
  chemically synthesized
cggctggaaaatgaggttga

SEQ ID NO: 328575 - DNA, 20 bp, Artificial Sequence
  chemically synthesized
gcggctggaaaatgaggttg

SEQ ID NO: 328576 - DNA, 20 bp, Artificial Sequence
  chemically synthesized
tgtccttcaacctcattttc

SEQ ID NO: 328577 - DNA, 20 bp, Artificial Sequence
  chemically synthesized
ggagaggcggctggaaaatg

SEQ ID NO: 328578 - DNA, 20 bp, Artificial Sequence
  chemically synthesized
aggagaggcggctggaaaat

SEQ ID NO: 328579 - DNA, 20 bp, Artificial Sequence
  chemically synthesized
ggaggagtaggagaggcggc

SEQ ID NO: 328580 - DNA, 20 bp, Artificial Sequence
  chemically synthesized
gggaggaggagtaggagagg

SEQ ID NO: 328581 - DNA, 20 bp, Artificial Sequence
  chemically synthesized
taggggaggaggagtaggag

SEQ ID NO: 328582 - DNA, 20 bp, Artificial Sequence
  chemically synthesized
ttaggggaggaggagtagga

SEQ ID NO: 328583 - DNA, 20 bp, Artificial Sequence
  chemically synthesized
ggttaggggaggaggagtag

SEQ ID NO: 328584 - DNA, 20 bp, Artificial Sequence
  chemically synthesized
atggttaggggaggaggagt

SEQ ID NO: 328585 - DNA, 20 bp, Artificial Sequence
  chemically synthesized
tatggttaggggaggaggag

SEQ ID NO: 328586 - DNA, 20 bp, Artificial Sequence
  chemically synthesized
gcatatggttaggggaggag

SEQ ID NO: 328587 - DNA, 20 bp, Artificial Sequence
  chemically synthesized
gggcatatggttaggggagg

SEQ ID NO: 328588 - DNA, 20 bp, Artificial Sequence
  chemically synthesized
agggcatatggttaggggag

SEQ ID NO: 328589 - DNA, 20 bp, Artificial Sequence
  chemically synthesized
gtagggcatatggttagggg

SEQ ID NO: 328590 - DNA, 20 bp, Artificial Sequence
  chemically synthesized
tgtagggcatatggttaggg

SEQ ID NO: 328591 - DNA, 20 bp, Artificial Sequence
  chemically synthesized
tgtgtagggcatatggttag

SEQ ID NO: 328592 - DNA, 20 bp, Artificial Sequence
  chemically synthesized
gtgtgtagggcatatggtta

SEQ ID NO: 328593 - DNA, 20 bp, Artificial Sequence
  chemically synthesized
cgtgtgtagggcatatggtt

SEQ ID NO: 328594 - DNA, 20 bp, Artificial Sequence
  chemically synthesized
tcgtgtgtagggcatatggt

SEQ ID NO: 328595 - DNA, 20 bp, Artificial Sequence
  chemically synthesized
cgtttcgtgtgtagggcata

SEQ ID NO: 328596 - DNA, 20 bp, Artificial Sequence
  chemically synthesized
gactgttcgtttcgtgtgta

SEQ ID NO: 328597 - DNA, 20 bp, Artificial Sequence
  chemically synthesized
tgactgttcgtttcgtgtgt

SEQ ID NO: 328598 - DNA, 20 bp, Artificial Sequence
  chemically synthesized
gtgactgttcgtttcgtgtg

SEQ ID NO: 328599 - DNA, 20 bp, Artificial Sequence
  chemically synthesized
tgccctacacacgaaacgaa

SEQ ID NO: 328600 - DNA, 20 bp, Artificial Sequence
  chemically synthesized
gagaaagaagcacgaatcgt

SEQ ID NO: 328601 - DNA, 20 bp, Artificial Sequence
  chemically synthesized
tgtggagctaaatgagaaag

SEQ ID NO: 328602 - DNA, 20 bp, Artificial Sequence
  chemically synthesized
attcgtgcttctttctcatt

SEQ ID NO: 328603 - DNA, 20 bp, Artificial Sequence
  chemically synthesized
ctttgtggagctaaatgaga

SEQ ID NO: 328604 - DNA, 20 bp, Artificial Sequence
  chemically synthesized
ttcactttgtggagctaaat

SEQ ID NO: 328605 - DNA, 20 bp, Artificial Sequence
  chemically synthesized
ctttctcatttagctccaca

SEQ ID NO: 328606 - DNA, 20 bp, Artificial Sequence
  chemically synthesized
aaatattacttcactttgtg

SEQ ID NO: 328607 - DNA, 20 bp, Artificial Sequence
  chemically synthesized
tcatttagctccacaaagtg

SEQ ID NO: 328608 - DNA, 20 bp, Artificial Sequence
  chemically synthesized
agaaatattacttcactttg

SEQ ID NO: 328609 - DNA, 20 bp, Artificial Sequence
  chemically synthesized
aaagtgaagtaatatttcta

SEQ ID NO: 328610 - DNA, 20 bp, Artificial Sequence
  chemically synthesized
aagtgaagtaatatttctat

SEQ ID NO: 328611 - DNA, 20 bp, Artificial Sequence
  chemically synthesized
tttataaggagatcatccca

SEQ ID NO: 328612 - DNA, 20 bp, Artificial Sequence
  chemically synthesized
tcaagtatgatttttataag

SEQ ID NO: 328613 - DNA, 20 bp, Artificial Sequence
  chemically synthesized
agtcaagtatgatttttata

SEQ ID NO: 328614 - DNA, 20 bp, Artificial Sequence
  chemically synthesized
tagtcaagtatgatttttat

SEQ ID NO: 328615 - DNA, 20 bp, Artificial Sequence
  chemically synthesized
aaaaatcatacttgactatc

SEQ ID NO: 328616 - DNA, 20 bp, Artificial Sequence
  chemically synthesized
aatgatgagccttgatagtc

SEQ ID NO: 328617 - DNA, 20 bp, Artificial Sequence
  chemically synthesized
aaaatcatacttgactatca

SEQ ID NO: 328618 - DNA, 20 bp, Artificial Sequence
  chemically synthesized
aactgaatgatgagccttga

SEQ ID NO: 328619 - DNA, 20 bp, Artificial Sequence
  chemically synthesized
gactatcaaggctcatcatt

SEQ ID NO: 328620 - DNA, 20 bp, Artificial Sequence
  chemically synthesized
agaaggtataactgaatgat

SEQ ID NO: 328621 - DNA, 20 bp, Artificial Sequence
  chemically synthesized
ttggcttagcaggtagcaga

SEQ ID NO: 328622 - DNA, 20 bp, Artificial Sequence
  chemically synthesized
cttggcttagcaggtagcag

SEQ ID NO: 328623 - DNA, 20 bp, Artificial Sequence
  chemically synthesized
aatcttggcttagcaggtag

SEQ ID NO: 328624 - DNA, 20 bp, Artificial Sequence
  chemically synthesized
tataccttctgctacctgct

SEQ ID NO: 328625 - DNA, 20 bp, Artificial Sequence
  chemically synthesized
ataaatcttggcttagcagg

SEQ ID NO: 328626 - DNA, 20 bp, Artificial Sequence
  chemically synthesized
ttcataaatcttggcttagc

SEQ ID NO: 328627 - DNA, 20 bp, Artificial Sequence
  chemically synthesized
cttctgctacctgctaagcc

SEQ ID NO: 328628 - DNA, 20 bp, Artificial Sequence
  chemically synthesized
cttcataaatcttggcttag

SEQ ID NO: 328629 - DNA, 20 bp, Artificial Sequence
  chemically synthesized
tagcttcataaatcttggct

SEQ ID NO: 328630 - DNA, 20 bp, Artificial Sequence
  chemically synthesized
aattatagcttcataaatct

SEQ ID NO: 328631 - DNA, 20 bp, Artificial Sequence
  chemically synthesized
ctgctaagccaagatttatg

SEQ ID NO: 328632 - DNA, 20 bp, Artificial Sequence
  chemically synthesized
atttatgaagctataattta

SEQ ID NO: 328633 - DNA, 20 bp, Artificial Sequence
  chemically synthesized
tcctctgggaccataaatta

SEQ ID NO: 328634 - DNA, 20 bp, Artificial Sequence
  chemically synthesized
gaagctataatttatggtcc

SEQ ID NO: 328635 - DNA, 20 bp, Artificial Sequence
  chemically synthesized
agctataatttatggtccca

SEQ ID NO: 328636 - DNA, 20 bp, Artificial Sequence
  chemically synthesized
gctataatttatggtcccag

SEQ ID NO: 328637 - DNA, 20 bp, Artificial Sequence
  chemically synthesized
acttttcatataaatcctct

SEQ ID NO: 328638 - DNA, 20 bp, Artificial Sequence
  chemically synthesized
aacttttcatataaatcctc

SEQ ID NO: 328639 - DNA, 20 bp, Artificial Sequence
  chemically synthesized
tcccagaggatttatatgaa

SEQ ID NO: 328640 - DNA, 20 bp, Artificial Sequence
  chemically synthesized
taagacacagtagagatagg

SEQ ID NO: 328641 - DNA, 20 bp, Artificial Sequence
  chemically synthesized
ctttaagacacagtagagat

SEQ ID NO: 328642 - DNA, 20 bp, Artificial Sequence
  chemically synthesized
gctttaagacacagtagaga

SEQ ID NO: 328643 - DNA, 20 bp, Artificial Sequence
  chemically synthesized
agctgctttaagacacagta

SEQ ID NO: 328644 - DNA, 20 bp, Artificial Sequence
  chemically synthesized
acagctgctttaagacacag

SEQ ID NO: 328645 - DNA, 20 bp, Artificial Sequence
  chemically synthesized
cctatctctactgtgtctta

SEQ ID NO: 328646 - DNA, 20 bp, Artificial Sequence
  chemically synthesized
cttacagctgctttaagaca

SEQ ID NO: 328647 - DNA, 20 bp, Artificial Sequence
  chemically synthesized
atctctactgtgtcttaaag

SEQ ID NO: 328648 - DNA, 20 bp, Artificial Sequence
  chemically synthesized
gacactcttacagctgcttt

SEQ ID NO: 328649 - DNA, 20 bp, Artificial Sequence
  chemically synthesized
ctgtgtcttaaagcagctgt

SEQ ID NO: 328650 - DNA, 20 bp, Artificial Sequence
  chemically synthesized
gtgtcttaaagcagctgtaa

SEQ ID NO: 328651 - DNA, 20 bp, Artificial Sequence
  chemically synthesized
agaggagacagacactctta

SEQ ID NO: 328652 - DNA, 20 bp, Artificial Sequence
  chemically synthesized
tttatgcactagagaggaga

SEQ ID NO: 328653 - DNA, 20 bp, Artificial Sequence
  chemically synthesized
aagagtgtctgtctcctctc

SEQ ID NO: 328654 - DNA, 20 bp, Artificial Sequence
  chemically synthesized
gttctttatgcactagagag

SEQ ID NO: 328655 - DNA, 20 bp, Artificial Sequence
  chemically synthesized
aggttctttatgcactagag

SEQ ID NO: 328656 - DNA, 20 bp, Artificial Sequence
  chemically synthesized
caggttctttatgcactaga

SEQ ID NO: 328657 - DNA, 20 bp, Artificial Sequence
  chemically synthesized
ctcaggttctttatgcacta

SEQ ID NO: 328658 - DNA, 20 bp, Artificial Sequence
  chemically synthesized
tgtctcctctctagtgcata

SEQ ID NO: 328659 - DNA, 20 bp, Artificial Sequence
  chemically synthesized
tcctcaggttctttatgcac

SEQ ID NO: 328660 - DNA, 20 bp, Artificial Sequence
  chemically synthesized
ctctagtgcataaagaacct

SEQ ID NO: 328661 - DNA, 20 bp, Artificial Sequence
  chemically synthesized
tctagtgcataaagaacctg

SEQ ID NO: 328662 - DNA, 20 bp, Artificial Sequence
  chemically synthesized
tgcataaagaacctgaggac

SEQ ID NO: 328663 - DNA, 20 bp, Artificial Sequence
  chemically synthesized
gtgttacttgacttgtcctc

SEQ ID NO: 328664 - DNA, 20 bp, Artificial Sequence
  chemically synthesized
ggtgttacttgacttgtcct

SEQ ID NO: 328665 - DNA, 20 bp, Artificial Sequence
  chemically synthesized
aaagaacctgaggacaagtc

SEQ ID NO: 328666 - DNA, 20 bp, Artificial Sequence
  chemically synthesized
aggacaagtcaagtaacacc

SEQ ID NO: 328667 - DNA, 20 bp, Artificial Sequence
  chemically synthesized
tctaatttgtgttaattact

SEQ ID NO: 328668 - DNA, 20 bp, Artificial Sequence
  chemically synthesized
atctaatttgtgttaattac

SEQ ID NO: 328669 - DNA, 20 bp, Artificial Sequence
  chemically synthesized
acccagtaattaacacaaat

SEQ ID NO: 328670 - DNA, 20 bp, Artificial Sequence
  chemically synthesized
attaacacaaattagatgat

SEQ ID NO: 328671 - DNA, 20 bp, Artificial Sequence
  chemically synthesized
acacaaattagatgatcagt

SEQ ID NO: 328672 - DNA, 20 bp, Artificial Sequence
  chemically synthesized
gatgatcagtaagtacttga

SEQ ID NO: 328673 - DNA, 20 bp, Artificial Sequence
  chemically synthesized
cactagtaatttaatctgtc

SEQ ID NO: 328674 - DNA, 20 bp, Artificial Sequence
  chemically synthesized
tacttgacagattaaattac

SEQ ID NO: 328675 - DNA, 20 bp, Artificial Sequence
  chemically synthesized
catatgtgaaggtcaaacac

SEQ ID NO: 328676 - DNA, 20 bp, Artificial Sequence
  chemically synthesized
cataatagtgtcatatgtga

SEQ ID NO: 328677 - DNA, 20 bp, Artificial Sequence
  chemically synthesized
acataatagtgtcatatgtg

SEQ ID NO: 328678 - DNA, 20 bp, Artificial Sequence
  chemically synthesized
tacttttaaaatatacataa

SEQ ID NO: 328679 - DNA, 20 bp, Artificial Sequence
  chemically synthesized
cactattatgtatattttaa

SEQ ID NO: 328680 - DNA, 20 bp, Artificial Sequence
  chemically synthesized
ttaaaagtatcactgttgat

SEQ ID NO: 328681 - DNA, 20 bp, Artificial Sequence
  chemically synthesized
taaaatttatttctaatcaa

SEQ ID NO: 328682 - DNA, 20 bp, Artificial Sequence
  chemically synthesized
tagaaataaattttaacaca

SEQ ID NO: 328683 - DNA, 20 bp, Artificial Sequence
  chemically synthesized
agaaataaattttaacacaa

SEQ ID NO: 328684 - DNA, 20 bp, Artificial Sequence
  chemically synthesized
ataaattttaacacaaaggc

SEQ ID NO: 328685 - DNA, 20 bp, Artificial Sequence
  chemically synthesized
aattttaacacaaaggccag

SEQ ID NO: 328686 - DNA, 20 bp, Artificial Sequence
  chemically synthesized
gatttctaagttatgtcttc

SEQ ID NO: 328687 - DNA, 20 bp, Artificial Sequence
  chemically synthesized
aaaggccagaagacataact

SEQ ID NO: 328688 - DNA, 20 bp, Artificial Sequence
  chemically synthesized
ttcctaaacctatgatttct

SEQ ID NO: 328689 - DNA, 20 bp, Artificial Sequence
  chemically synthesized
aagacataacttagaaatca

SEQ ID NO: 328690 - DNA, 20 bp, Artificial Sequence
  chemically synthesized
agacataacttagaaatcat

SEQ ID NO: 328691 - DNA, 20 bp, Artificial Sequence
  chemically synthesized
taacttagaaatcataggtt

SEQ ID NO: 328692 - DNA, 20 bp, Artificial Sequence
  chemically synthesized
aacttagaaatcataggttt

SEQ ID NO: 328693 - DNA, 20 bp, Artificial Sequence
  chemically synthesized
aatcataggtttaggaattc

SEQ ID NO: 328694 - DNA, 20 bp, Artificial Sequence
  chemically synthesized
gtttaggaattcaagatgcc

SEQ ID NO: 328695 - DNA, 20 bp, Artificial Sequence
  chemically synthesized
tttaggaattcaagatgcct

SEQ ID NO: 328696 - DNA, 20 bp, Artificial Sequence
  chemically synthesized
aggcagagtaaaatagacct

SEQ ID NO: 328697 - DNA, 20 bp, Artificial Sequence
  chemically synthesized
gaggcagagtaaaatagacc

SEQ ID NO: 328698 - DNA, 20 bp, Artificial Sequence
  chemically synthesized
tagtaagaggcagagtaaaa

SEQ ID NO: 328699 - DNA, 20 bp, Artificial Sequence
  chemically synthesized
ccttgtgctagtaagaggca

SEQ ID NO: 328700 - DNA, 20 bp, Artificial Sequence
  chemically synthesized
gtccttgtgctagtaagagg

SEQ ID NO: 328701 - DNA, 20 bp, Artificial Sequence
  chemically synthesized
tattttactctgcctcttac

SEQ ID NO: 328702 - DNA, 20 bp, Artificial Sequence
  chemically synthesized
agggtccttgtgctagtaag

SEQ ID NO: 328703 - DNA, 20 bp, Artificial Sequence
  chemically synthesized
aagggtccttgtgctagtaa

SEQ ID NO: 328704 - DNA, 20 bp, Artificial Sequence
  chemically synthesized
tgaagggtccttgtgctagt

SEQ ID NO: 328705 - DNA, 20 bp, Artificial Sequence
  chemically synthesized
actctgcctcttactagcac

SEQ ID NO: 328706 - DNA, 20 bp, Artificial Sequence
  chemically synthesized
ctctgcctcttactagcaca

SEQ ID NO: 328707 - DNA, 20 bp, Artificial Sequence
  chemically synthesized
ttactgaagggtccttgtgc

SEQ ID NO: 328708 - DNA, 20 bp, Artificial Sequence
  chemically synthesized
ttactagcacaaggaccctt

SEQ ID NO: 328709 - DNA, 20 bp, Artificial Sequence
  chemically synthesized
tagcacaaggacccttcagt

SEQ ID NO: 328710 - DNA, 20 bp, Artificial Sequence
  chemically synthesized
taagattaagacttactgaa

SEQ ID NO: 328711 - DNA, 20 bp, Artificial Sequence
  chemically synthesized
ttaagattaagacttactga

SEQ ID NO: 328712 - DNA, 20 bp, Artificial Sequence
  chemically synthesized
attaagattaagacttactg

SEQ ID NO: 328713 - DNA, 20 bp, Artificial Sequence
  chemically synthesized
ccactatacagattaagatt

SEQ ID NO: 328714 - DNA, 20 bp, Artificial Sequence
  chemically synthesized
agcttcccactatacagatt

SEQ ID NO: 328715 - DNA, 20 bp, Artificial Sequence
  chemically synthesized
agtcttaatcttaatctgta

SEQ ID NO: 328716 - DNA, 20 bp, Artificial Sequence
  chemically synthesized
cttaatcttaatctgtatag

SEQ ID NO: 328717 - DNA, 20 bp, Artificial Sequence
  chemically synthesized
ttaatcttaatctgtatagt

SEQ ID NO: 328718 - DNA, 20 bp, Artificial Sequence
  chemically synthesized
caatcaagcttcccactata

SEQ ID NO: 328719 - DNA, 20 bp, Artificial Sequence
  chemically synthesized
atcttaatctgtatagtggg

SEQ ID NO: 328720 - DNA, 20 bp, Artificial Sequence
  chemically synthesized
tgtatagtgggaagcttgat

SEQ ID NO: 328721 - DNA, 20 bp, Artificial Sequence
  chemically synthesized
atagtgggaagcttgattgg

SEQ ID NO: 328722 - DNA, 20 bp, Artificial Sequence
  chemically synthesized
tatgaggtttaccaccaatc

SEQ ID NO: 328723 - DNA, 20 bp, Artificial Sequence
  chemically synthesized
cttgaatggcaatatttatg

SEQ ID NO: 328724 - DNA, 20 bp, Artificial Sequence
  chemically synthesized
acttgaatggcaatatttat

SEQ ID NO: 328725 - DNA, 20 bp, Artificial Sequence
  chemically synthesized
cctcataaatattgccattc

SEQ ID NO: 328726 - DNA, 20 bp, Artificial Sequence
  chemically synthesized
gcatgtggcagttacttgaa

SEQ ID NO: 328727 - DNA, 20 bp, Artificial Sequence
  chemically synthesized
aatatggcaggagcatgtgg

SEQ ID NO: 328728 - DNA, 20 bp, Artificial Sequence
  chemically synthesized
tacaatatggcaggagcatg

SEQ ID NO: 328729 - DNA, 20 bp, Artificial Sequence
  chemically synthesized
gtacacttacaatatggcag

SEQ ID NO: 328730 - DNA, 20 bp, Artificial Sequence
  chemically synthesized
ttgtacacttacaatatggc

SEQ ID NO: 328731 - DNA, 20 bp, Artificial Sequence
  chemically synthesized
attgtacacttacaatatgg

SEQ ID NO: 328732 - DNA, 20 bp, Artificial Sequence
  chemically synthesized
acatgctcctgccatattgt

SEQ ID NO: 328733 - DNA, 20 bp, Artificial Sequence
  chemically synthesized
ttcattgtacacttacaata

SEQ ID NO: 328734 - DNA, 20 bp, Artificial Sequence
  chemically synthesized
ctgttttatgataatttagg

SEQ ID NO: 328735 - DNA, 20 bp, Artificial Sequence
  chemically synthesized
tgactgttttatgataattt

SEQ ID NO: 328736 - DNA, 20 bp, Artificial Sequence
  chemically synthesized
ttgactgttttatgataatt

SEQ ID NO: 328737 - DNA, 20 bp, Artificial Sequence
  chemically synthesized
ctacctaaattatcataaaa

SEQ ID NO: 328738 - DNA, 20 bp, Artificial Sequence
  chemically synthesized
aattatcataaaacagtcaa

SEQ ID NO: 328739 - DNA, 20 bp, Artificial Sequence
  chemically synthesized
ttaaaattccaaatagaaca

SEQ ID NO: 328740 - DNA, 20 bp, Artificial Sequence
  chemically synthesized
cttaaaattccaaatagaac

SEQ ID NO: 328741 - DNA, 20 bp, Artificial Sequence
  chemically synthesized
tttgcaaaccttgttctatt

SEQ ID NO: 328742 - DNA, 20 bp, Artificial Sequence
  chemically synthesized
tactttcttaaaattccaaa

SEQ ID NO: 328743 - DNA, 20 bp, Artificial Sequence
  chemically synthesized
cttgttctatttggaatttt

SEQ ID NO: 328744 - DNA, 20 bp, Artificial Sequence
  chemically synthesized
ttctatttggaattttaaga

SEQ ID NO: 328745 - DNA, 20 bp, Artificial Sequence
  chemically synthesized
atttggaattttaagaaagt

SEQ ID NO: 328746 - DNA, 20 bp, Artificial Sequence
  chemically synthesized
agtaagcaacatgaaaccac

SEQ ID NO: 328747 - DNA, 20 bp, Artificial Sequence
  chemically synthesized
gcaacatgaaaccactggtt

SEQ ID NO: 328748 - DNA, 20 bp, Artificial Sequence
  chemically synthesized
aattacatcttctcaaccag

SEQ ID NO: 328749 - DNA, 20 bp, Artificial Sequence
  chemically synthesized
acatgaaaccactggttgag

SEQ ID NO: 328750 - DNA, 20 bp, Artificial Sequence
  chemically synthesized
aataattacatcttctcaac

SEQ ID NO: 328751 - DNA, 20 bp, Artificial Sequence
  chemically synthesized
gatgtaattatttgtaaaca

SEQ ID NO: 328752 - DNA, 20 bp, Artificial Sequence
  chemically synthesized
taaacaaagacctttatttt

SEQ ID NO: 328753 - DNA, 20 bp, Artificial Sequence
  chemically synthesized
tgaatctttactaaaaataa

SEQ ID NO: 328754 - DNA, 20 bp, Artificial Sequence
  chemically synthesized
atgaatctttactaaaaata

SEQ ID NO: 328755 - DNA, 20 bp, Artificial Sequence
  chemically synthesized
aaagacctttatttttagta

SEQ ID NO: 328756 - DNA, 20 bp, Artificial Sequence
  chemically synthesized
tatttttagtaaagattcat

SEQ ID NO: 328757 - DNA, 20 bp, Artificial Sequence
  chemically synthesized
gattcatcagtgcaacctgt

SEQ ID NO: 328758 - DNA, 20 bp, Artificial Sequence
  chemically synthesized
ttgaagtagaaaattctgac

SEQ ID NO: 328759 - DNA, 20 bp, Artificial Sequence
  chemically synthesized
tttgaagtagaaaattctga

SEQ ID NO: 328760 - DNA, 20 bp, Artificial Sequence
  chemically synthesized
tatttttaaatcatttgaag

SEQ ID NO: 328761 - DNA, 20 bp, Artificial Sequence
  chemically synthesized
atttatttttaaatcatttg

SEQ ID NO: 328762 - DNA, 20 bp, Artificial Sequence
  chemically synthesized
tttaaaaataaatgattcaa

SEQ ID NO: 328763 - DNA, 20 bp, Artificial Sequence
  chemically synthesized
aaataaatgattcaaaagta

SEQ ID NO: 328764 - DNA, 20 bp, Artificial Sequence
  chemically synthesized
gtacagtttttttcctgcta

SEQ ID NO: 328765 - DNA, 20 bp, Artificial Sequence
  chemically synthesized
cagtttttttcctgctatgg

SEQ ID NO: 328766 - DNA, 20 bp, Artificial Sequence
  chemically synthesized
gtgttcactactgccatagc

SEQ ID NO: 328767 - DNA, 20 bp, Artificial Sequence
  chemically synthesized
agtgttcactactgccatag

SEQ ID NO: 328768 - DNA, 20 bp, Artificial Sequence
  chemically synthesized
tttttttcctgctatggcag

SEQ ID NO: 328769 - DNA, 20 bp, Artificial Sequence
  chemically synthesized
tacagtgttcactactgcca

SEQ ID NO: 328770 - DNA, 20 bp, Artificial Sequence
  chemically synthesized
agaatctgttcaaattagta

SEQ ID NO: 328771 - DNA, 20 bp, Artificial Sequence
  chemically synthesized
gaacactgtactaatttgaa

SEQ ID NO: 328772 - DNA, 20 bp, Artificial Sequence
  chemically synthesized
ttcacagaatctgttcaaat

SEQ ID NO: 328773 - DNA, 20 bp, Artificial Sequence
  chemically synthesized
tacaatgcttttggcattca

SEQ ID NO: 328774 - DNA, 20 bp, Artificial Sequence
  chemically synthesized
acagattctgtgaatgccaa

SEQ ID NO: 328775 - DNA, 20 bp, Artificial Sequence
  chemically synthesized
tgtcaacattacaatgcttt

SEQ ID NO: 328776 - DNA, 20 bp, Artificial Sequence
  chemically synthesized
gacaaatgtgtacttctaaa

SEQ ID NO: 328777 - DNA, 20 bp, Artificial Sequence
  chemically synthesized
cacacatcctcactgtttag

SEQ ID NO: 328778 - DNA, 20 bp, Artificial Sequence
  chemically synthesized
aatgtgtacttctaaacagt

SEQ ID NO: 328779 - DNA, 20 bp, Artificial Sequence
  chemically synthesized
atgtgtacttctaaacagtg

SEQ ID NO: 328780 - DNA, 20 bp, Artificial Sequence
  chemically synthesized
acacacacatcctcactgtt

SEQ ID NO: 328781 - DNA, 20 bp, Artificial Sequence
  chemically synthesized
gaggatgtgtgtgtgtgtgt

SEQ ID NO: 328782 - DNA, 20 bp, Artificial Sequence
  chemically synthesized
gatgtgtgtgtgtgtgtgag

SEQ ID NO: 328783 - DNA, 20 bp, Artificial Sequence
  chemically synthesized
atgtgtgtgtgtgtgtgagt

SEQ ID NO: 328784 - DNA, 20 bp, Artificial Sequence
  chemically synthesized
gtgtgtgtgtgtgtgagtgg

SEQ ID NO: 328785 - DNA, 20 bp, Artificial Sequence
  chemically synthesized
gggagaataatatacatata

SEQ ID NO: 328786 - DNA, 20 bp, Artificial Sequence
  chemically synthesized
tacatataaagtacattccc

SEQ ID NO: 328787 - DNA, 20 bp, Artificial Sequence
  chemically synthesized
acatataaagtacattcccc

SEQ ID NO: 328788 - DNA, 20 bp, Artificial Sequence
  chemically synthesized
catataaagtacattcccca

SEQ ID NO: 328789 - DNA, 20 bp, Artificial Sequence
  chemically synthesized
caaaacctaagcaaaccctg

SEQ ID NO: 328790 - DNA, 20 bp, Artificial Sequence
  chemically synthesized
tcaaaacctaagcaaaccct

SEQ ID NO: 328791 - DNA, 20 bp, Artificial Sequence
  chemically synthesized
atcaaaacctaagcaaaccc

SEQ ID NO: 328792 - DNA, 20 bp, Artificial Sequence
  chemically synthesized
tacattccccagggtttgct

SEQ ID NO: 328793 - DNA, 20 bp, Artificial Sequence
  chemically synthesized
acattccccagggtttgctt

SEQ ID NO: 328794 - DNA, 20 bp, Artificial Sequence
  chemically synthesized
gggttaggtcatcaaaacct

SEQ ID NO: 328795 - DNA, 20 bp, Artificial Sequence
  chemically synthesized
ggttttgatgacctaaccca

SEQ ID NO: 328796 - DNA, 20 bp, Artificial Sequence
  chemically synthesized
tctttgcgatgctttgggtt

SEQ ID NO: 328797 - DNA, 20 bp, Artificial Sequence
  chemically synthesized
atctttgcgatgctttgggt

SEQ ID NO: 328798 - DNA, 20 bp, Artificial Sequence
  chemically synthesized
gtggatctttgcgatgcttt

SEQ ID NO: 328799 - DNA, 20 bp, Artificial Sequence
  chemically synthesized
ggtggatctttgcgatgctt

SEQ ID NO: 328800 - DNA, 20 bp, Artificial Sequence
  chemically synthesized
acctaacccaaagcatcgca

SEQ ID NO: 328801 - DNA, 20 bp, Artificial Sequence
  chemically synthesized
atcgcaaagatccaccaata

SEQ ID NO: 328802 - DNA, 20 bp, Artificial Sequence
  chemically synthesized
taaactgtcatctatattgg

SEQ ID NO: 328803 - DNA, 20 bp, Artificial Sequence
  chemically synthesized
acataaactgtcatctatat

SEQ ID NO: 328804 - DNA, 20 bp, Artificial Sequence
  chemically synthesized
agatccaccaatatagatga

SEQ ID NO: 328805 - DNA, 20 bp, Artificial Sequence
  chemically synthesized
atatagatgacagtttatgt

SEQ ID NO: 328806 - DNA, 20 bp, Artificial Sequence
  chemically synthesized
tttatgttggaacacaattt

SEQ ID NO: 328807 - DNA, 20 bp, Artificial Sequence
  chemically synthesized
acaatttaagaatatatact

SEQ ID NO: 328808 - DNA, 20 bp, Artificial Sequence
  chemically synthesized
aagaatatatactcagctac

SEQ ID NO: 328809 - DNA, 20 bp, Artificial Sequence
  chemically synthesized
gtaccgacccacttgtagct

SEQ ID NO: 328810 - DNA, 20 bp, Artificial Sequence
  chemically synthesized
aatatatactcagctacaag

SEQ ID NO: 328811 - DNA, 20 bp, Artificial Sequence
  chemically synthesized
atatatactcagctacaagt

SEQ ID NO: 328812 - DNA, 20 bp, Artificial Sequence
  chemically synthesized
aatttgtaccgacccacttg

SEQ ID NO: 328813 - DNA, 20 bp, Artificial Sequence
  chemically synthesized
atactcagctacaagtgggt

SEQ ID NO: 328814 - DNA, 20 bp, Artificial Sequence
  chemically synthesized
tcatgagtagtattgacatt

SEQ ID NO: 328815 - DNA, 20 bp, Artificial Sequence
  chemically synthesized
tcaatgtcaatactactcat

SEQ ID NO: 328816 - DNA, 20 bp, Artificial Sequence
  chemically synthesized
ggtggtaatttactcatgag

SEQ ID NO: 328817 - DNA, 20 bp, Artificial Sequence
  chemically synthesized
cttggtggtaatttactcat

SEQ ID NO: 328818 - DNA, 20 bp, Artificial Sequence
  chemically synthesized
ctcatgagtaaattaccacc

SEQ ID NO: 328819 - DNA, 20 bp, Artificial Sequence
  chemically synthesized
tatatgtataattatcttgg

SEQ ID NO: 328820 - DNA, 20 bp, Artificial Sequence
  chemically synthesized
agatatatgtataattatct

SEQ ID NO: 328821 - DNA, 20 bp, Artificial Sequence
  chemically synthesized
tatacatatatctctcacct

SEQ ID NO: 328822 - DNA, 20 bp, Artificial Sequence
  chemically synthesized
ttctgaaagatccaaggtga

SEQ ID NO: 328823 - DNA, 20 bp, Artificial Sequence
  chemically synthesized
atttctgaaagatccaaggt

SEQ ID NO: 328824 - DNA, 20 bp, Artificial Sequence
  chemically synthesized
ccaaatttctgaaagatcca

SEQ ID NO: 328825 - DNA, 20 bp, Artificial Sequence
  chemically synthesized
gccaaatttctgaaagatcc

SEQ ID NO: 328826 - DNA, 20 bp, Artificial Sequence
  chemically synthesized
atctctcaccttggatcttt

SEQ ID NO: 328827 - DNA, 20 bp, Artificial Sequence
  chemically synthesized
tacctaggccaaatttctga

SEQ ID NO: 328828 - DNA, 20 bp, Artificial Sequence
  chemically synthesized
ccttggatctttcagaaatt

SEQ ID NO: 328829 - DNA, 20 bp, Artificial Sequence
  chemically synthesized
gatctttcagaaatttggcc

SEQ ID NO: 328830 - DNA, 20 bp, Artificial Sequence
  chemically synthesized
atctttcagaaatttggcct

SEQ ID NO: 328831 - DNA, 20 bp, Artificial Sequence
  chemically synthesized
agaacattatataagtacct

SEQ ID NO: 328832 - DNA, 20 bp, Artificial Sequence
  chemically synthesized
cagaacattatataagtacc

SEQ ID NO: 328833 - DNA, 20 bp, Artificial Sequence
  chemically synthesized
cattattcagaacattatat

SEQ ID NO: 328834 - DNA, 20 bp, Artificial Sequence
  chemically synthesized
atggagagagatacattatt

SEQ ID NO: 328835 - DNA, 20 bp, Artificial Sequence
  chemically synthesized
aatttactaaataatggaga

SEQ ID NO: 328836 - DNA, 20 bp, Artificial Sequence
  chemically synthesized
ataatttactaaataatgga

SEQ ID NO: 328837 - DNA, 20 bp, Artificial Sequence
  chemically synthesized
atgtatctctctccattatt

SEQ ID NO: 328838 - DNA, 20 bp, Artificial Sequence
  chemically synthesized
acataatttactaaataatg

SEQ ID NO: 328839 - DNA, 20 bp, Artificial Sequence
  chemically synthesized
tgacataatttactaaataa

SEQ ID NO: 328840 - DNA, 20 bp, Artificial Sequence
  chemically synthesized
cattatttagtaaattatgt

SEQ ID NO: 328841 - DNA, 20 bp, Artificial Sequence
  chemically synthesized
cataaacatttctcaattac

SEQ ID NO: 328842 - DNA, 20 bp, Artificial Sequence
  chemically synthesized
cagtttgatgtctggtaatt

SEQ ID NO: 328843 - DNA, 20 bp, Artificial Sequence
  chemically synthesized
gttgaaaacagtttgatgtc

SEQ ID NO: 328844 - DNA, 20 bp, Artificial Sequence
  chemically synthesized
aataagaagtttgttgaaaa

SEQ ID NO: 328845 - DNA, 20 bp, Artificial Sequence
  chemically synthesized
ttatagttaattggaataag

SEQ ID NO: 328846 - DNA, 20 bp, Artificial Sequence
  chemically synthesized
aagttatagttaattggaat

SEQ ID NO: 328847 - DNA, 20 bp, Artificial Sequence
  chemically synthesized
aaatcgaagttatagttaat

SEQ ID NO: 328848 - DNA, 20 bp, Artificial Sequence
  chemically synthesized
aaatttaaaaatcgaagtta

SEQ ID NO: 328849 - DNA, 20 bp, Artificial Sequence
  chemically synthesized
gtacataaatttaaaaatcg

SEQ ID NO: 328850 - DNA, 20 bp, Artificial Sequence
  chemically synthesized
tacatacacacacacactct

SEQ ID NO: 328851 - DNA, 20 bp, Artificial Sequence
  chemically synthesized
cacacacacactctgagaaa

SEQ ID NO: 328852 - DNA, 20 bp, Artificial Sequence
  chemically synthesized
aactctgtctctttttctca

SEQ ID NO: 328853 - DNA, 20 bp, Artificial Sequence
  chemically synthesized
cacacacactctgagaaaaa

SEQ ID NO: 328854 - DNA, 20 bp, Artificial Sequence
  chemically synthesized
tgaactctgtctctttttct

SEQ ID NO: 328855 - DNA, 20 bp, Artificial Sequence
  chemically synthesized
cacactctgagaaaaagaga

SEQ ID NO: 328856 - DNA, 20 bp, Artificial Sequence
  chemically synthesized
cactctgagaaaaagagaca

SEQ ID NO: 328857 - DNA, 20 bp, Artificial Sequence
  chemically synthesized
gaaaaagagacagagttcac

SEQ ID NO: 328858 - DNA, 20 bp, Artificial Sequence
  chemically synthesized
aaaaagagacagagttcacc

SEQ ID NO: 328859 - DNA, 20 bp, Artificial Sequence
  chemically synthesized
tttgaagataaatgggaacc

SEQ ID NO: 328860 - DNA, 20 bp, Artificial Sequence
  chemically synthesized
ggtcaattttgaagataaat

SEQ ID NO: 328861 - DNA, 20 bp, Artificial Sequence
  chemically synthesized
gggtcaattttgaagataaa

SEQ ID NO: 328862 - DNA, 20 bp, Artificial Sequence
  chemically synthesized
tttatatagggtcaattttg

SEQ ID NO: 328863 - DNA, 20 bp, Artificial Sequence
  chemically synthesized
tttaaaataacatttatata

SEQ ID NO: 328864 - DNA, 20 bp, Artificial Sequence
  chemically synthesized
ttttaaaataacatttatat

SEQ ID NO: 328865 - DNA, 20 bp, Artificial Sequence
  chemically synthesized
gttttaaaataacatttata

SEQ ID NO: 328866 - DNA, 20 bp, Artificial Sequence
  chemically synthesized
taaatgttattttaaaacaa

SEQ ID NO: 328867 - DNA, 20 bp, Artificial Sequence
  chemically synthesized
acaaaagataaaaccataat

SEQ ID NO: 328868 - DNA, 20 bp, Artificial Sequence
  chemically synthesized
caaaagataaaaccataatc

SEQ ID NO: 328869 - DNA, 20 bp, Artificial Sequence
  chemically synthesized
taataatagtatcctgatta

SEQ ID NO: 328870 - DNA, 20 bp, Artificial Sequence
  chemically synthesized
atctgatttgttaataataa

SEQ ID NO: 328871 - DNA, 20 bp, Artificial Sequence
  chemically synthesized
tactattattattaacaaat

SEQ ID NO: 328872 - DNA, 20 bp, Artificial Sequence
  chemically synthesized
tattaacaaatcagattact

SEQ ID NO: 328873 - DNA, 20 bp, Artificial Sequence
  chemically synthesized
aaatatatgcagaaatagcc

SEQ ID NO: 328874 - DNA, 20 bp, Artificial Sequence
  chemically synthesized
gagtaaaatatatgcagaaa

SEQ ID NO: 328875 - DNA, 20 bp, Artificial Sequence
  chemically synthesized
atcagagagtaaaatatatg

SEQ ID NO: 328876 - DNA, 20 bp, Artificial Sequence
  chemically synthesized
attataatatttttatcaga

SEQ ID NO: 328877 - DNA, 20 bp, Artificial Sequence
  chemically synthesized
tgattataatatttttatca

SEQ ID NO: 328878 - DNA, 20 bp, Artificial Sequence
  chemically synthesized
aatgattataatatttttat

SEQ ID NO: 328879 - DNA, 20 bp, Artificial Sequence
  chemically synthesized
gaggtgcagattatatttgg

SEQ ID NO: 328880 - DNA, 20 bp, Artificial Sequence
  chemically synthesized
gcagaggtgcagattatatt

SEQ ID NO: 328881 - DNA, 20 bp, Artificial Sequence
  chemically synthesized
atgagtaattagcagaggtg

SEQ ID NO: 328882 - DNA, 20 bp, Artificial Sequence
  chemically synthesized
ggaaaatgagtaattagcag

SEQ ID NO: 328883 - DNA, 20 bp, Artificial Sequence
  chemically synthesized
tggaaaatgagtaattagca

SEQ ID NO: 328884 - DNA, 20 bp, Artificial Sequence
  chemically synthesized
aatggaaaatgagtaattag

SEQ ID NO: 328885 - DNA, 20 bp, Artificial Sequence
  chemically synthesized
tttaatggaaaatgagtaat

SEQ ID NO: 328886 - DNA, 20 bp, Artificial Sequence
  chemically synthesized
tttacattttaatggaaaat

SEQ ID NO: 328887 - DNA, 20 bp, Artificial Sequence
  chemically synthesized
tattgacttttacattttaa

SEQ ID NO: 328888 - DNA, 20 bp, Artificial Sequence
  chemically synthesized
cattttccattaaaatgtaa

SEQ ID NO: 328889 - DNA, 20 bp, Artificial Sequence
  chemically synthesized
aaaagtcaataaaacttatt

SEQ ID NO: 328890 - DNA, 20 bp, Artificial Sequence
  chemically synthesized
gattttccatttttctaaat

SEQ ID NO: 328891 - DNA, 20 bp, Artificial Sequence
  chemically synthesized
ataaaacttatttagaaaaa

SEQ ID NO: 328892 - DNA, 20 bp, Artificial Sequence
  chemically synthesized
aaaaatggaaaatcatacat

SEQ ID NO: 328893 - DNA, 20 bp, Artificial Sequence
  chemically synthesized
aaaatggaaaatcatacatc

SEQ ID NO: 328894 - DNA, 20 bp, Artificial Sequence
  chemically synthesized
aatcatacatcaggttgacc

SEQ ID NO: 328895 - DNA, 20 bp, Artificial Sequence
  chemically synthesized
atcatacatcaggttgacct

SEQ ID NO: 328896 - DNA, 20 bp, Artificial Sequence
  chemically synthesized
catacatcaggttgacctgg

SEQ ID NO: 328897 - DNA, 20 bp, Artificial Sequence
  chemically synthesized
atacatcaggttgacctggg

SEQ ID NO: 328898 - DNA, 20 bp, Artificial Sequence
  chemically synthesized
caagaataggggagcctccc

SEQ ID NO: 328899 - DNA, 20 bp, Artificial Sequence
  chemically synthesized
acaagaataggggagcctcc

SEQ ID NO: 328900 - DNA, 20 bp, Artificial Sequence
  chemically synthesized
tgtaaaggacaagaataggg

SEQ ID NO: 328901 - DNA, 20 bp, Artificial Sequence
  chemically synthesized
tttgtaaaggacaagaatag

SEQ ID NO: 328902 - DNA, 20 bp, Artificial Sequence
  chemically synthesized
ctttgtaaaggacaagaata

SEQ ID NO: 328903 - DNA, 20 bp, Artificial Sequence
  chemically synthesized
actttgtaaaggacaagaat

SEQ ID NO: 328904 - DNA, 20 bp, Artificial Sequence
  chemically synthesized
tactttgtaaaggacaagaa

SEQ ID NO: 328905 - DNA, 20 bp, Artificial Sequence
  chemically synthesized
tagattactttgtaaaggac

SEQ ID NO: 328906 - DNA, 20 bp, Artificial Sequence
  chemically synthesized
ccctattcttgtcctttaca

SEQ ID NO: 328907 - DNA, 20 bp, Artificial Sequence
  chemically synthesized
ctggttagattactttgtaa

SEQ ID NO: 328908 - DNA, 20 bp, Artificial Sequence
  chemically synthesized
tctggttagattactttgta

SEQ ID NO: 328909 - DNA, 20 bp, Artificial Sequence
  chemically synthesized
cctttacaaagtaatctaac

SEQ ID NO: 328910 - DNA, 20 bp, Artificial Sequence
  chemically synthesized
aatgaagctctttatctggt

SEQ ID NO: 328911 - DNA, 20 bp, Artificial Sequence
  chemically synthesized
caaagtaatctaaccagata

SEQ ID NO: 328912 - DNA, 20 bp, Artificial Sequence
  chemically synthesized
aagtaatctaaccagataaa

SEQ ID NO: 328913 - DNA, 20 bp, Artificial Sequence
  chemically synthesized
ataaaatgaagctctttatc

SEQ ID NO: 328914 - DNA, 20 bp, Artificial Sequence
  chemically synthesized
ttaataagctgaataaaatg

SEQ ID NO: 328915 - DNA, 20 bp, Artificial Sequence
  chemically synthesized
ataaagagcttcattttatt

SEQ ID NO: 328916 - DNA, 20 bp, Artificial Sequence
  chemically synthesized
aacaaaccatagggtttaat

SEQ ID NO: 328917 - DNA, 20 bp, Artificial Sequence
  chemically synthesized
attcagcttattaaacccta

SEQ ID NO: 328918 - DNA, 20 bp, Artificial Sequence
  chemically synthesized
atttacagaaacaaaccata

SEQ ID NO: 328919 - DNA, 20 bp, Artificial Sequence
  chemically synthesized
aatttacagaaacaaaccat

SEQ ID NO: 328920 - DNA, 20 bp, Artificial Sequence
  chemically synthesized
gaatttacagaaacaaacca

SEQ ID NO: 328921 - DNA, 20 bp, Artificial Sequence
  chemically synthesized
aatgtgtactatagaattta

SEQ ID NO: 328922 - DNA, 20 bp, Artificial Sequence
  chemically synthesized
gtttgtttctgtaaattcta

SEQ ID NO: 328923 - DNA, 20 bp, Artificial Sequence
  chemically synthesized
ctggtcttaaatgtgtacta

SEQ ID NO: 328924 - DNA, 20 bp, Artificial Sequence
  chemically synthesized
aaattctatagtacacattt

SEQ ID NO: 328925 - DNA, 20 bp, Artificial Sequence
  chemically synthesized
ctatagtacacatttaagac

SEQ ID NO: 328926 - DNA, 20 bp, Artificial Sequence
  chemically synthesized
attttcttctcacagatgac

SEQ ID NO: 328927 - DNA, 20 bp, Artificial Sequence
  chemically synthesized
atttaagaccagtcatctgt

SEQ ID NO: 328928 - DNA, 20 bp, Artificial Sequence
  chemically synthesized
taagaccagtcatctgtgag

SEQ ID NO: 328929 - DNA, 20 bp, Artificial Sequence
  chemically synthesized
ggtattacattttcttctca

SEQ ID NO: 328930 - DNA, 20 bp, Artificial Sequence
  chemically synthesized
ggattgttatttaaatttgg

SEQ ID NO: 328931 - DNA, 20 bp, Artificial Sequence
  chemically synthesized
tttggattgttatttaaatt

SEQ ID NO: 328932 - DNA, 20 bp, Artificial Sequence
  chemically synthesized
atgcatctactttcatagtt

SEQ ID NO: 328933 - DNA, 20 bp, Artificial Sequence
  chemically synthesized
aataacaatccaaactatga

SEQ ID NO: 328934 - DNA, 20 bp, Artificial Sequence
  chemically synthesized
aacaatccaaactatgaaag

SEQ ID NO: 328935 - DNA, 20 bp, Artificial Sequence
  chemically synthesized
agtatatgcatctactttca

SEQ ID NO: 328936 - DNA, 20 bp, Artificial Sequence
  chemically synthesized
ataaagcataagcatataaa

SEQ ID NO: 328937 - DNA, 20 bp, Artificial Sequence
  chemically synthesized
atacagcttatataaagcat

SEQ ID NO: 328938 - DNA, 20 bp, Artificial Sequence
  chemically synthesized
tatatgcttatgctttatat

SEQ ID NO: 328939 - DNA, 20 bp, Artificial Sequence
  chemically synthesized
catactatacagcttatata

SEQ ID NO: 328940 - DNA, 20 bp, Artificial Sequence
  chemically synthesized
tatgctttatataagctgta

SEQ ID NO: 328941 - DNA, 20 bp, Artificial Sequence
  chemically synthesized
tgagttagttacatactata

SEQ ID NO: 328942 - DNA, 20 bp, Artificial Sequence
  chemically synthesized
gtatagtatgtaactaactc

SEQ ID NO: 328943 - DNA, 20 bp, Artificial Sequence
  chemically synthesized
tagtatgtaactaactcaag

SEQ ID NO: 328944 - DNA, 20 bp, Artificial Sequence
  chemically synthesized
atggatgagcccacttgagt

SEQ ID NO: 328945 - DNA, 20 bp, Artificial Sequence
  chemically synthesized
agtatgtaactaactcaagt

SEQ ID NO: 328946 - DNA, 20 bp, Artificial Sequence
  chemically synthesized
aatgatggatgagcccactt

SEQ ID NO: 328947 - DNA, 20 bp, Artificial Sequence
  chemically synthesized
acaataaaccaatgatggat

SEQ ID NO: 328948 - DNA, 20 bp, Artificial Sequence
  chemically synthesized
caagtgggctcatccatcat

SEQ ID NO: 328949 - DNA, 20 bp, Artificial Sequence
  chemically synthesized
gagaaacaataaaccaatga

SEQ ID NO: 328950 - DNA, 20 bp, Artificial Sequence
  chemically synthesized
ccttgaggggtgttttttca

SEQ ID NO: 328951 - DNA, 20 bp, Artificial Sequence
  chemically synthesized
gaccttgaggggtgtttttt

SEQ ID NO: 328952 - DNA, 20 bp, Artificial Sequence
  chemically synthesized
tctctgaaaaaacacccctc

SEQ ID NO: 328953 - DNA, 20 bp, Artificial Sequence
  chemically synthesized
ctctgaaaaaacacccctca

SEQ ID NO: 328954 - DNA, 20 bp, Artificial Sequence
  chemically synthesized
tatcatataaagaccttgag

SEQ ID NO: 328955 - DNA, 20 bp, Artificial Sequence
  chemically synthesized
ttatcatataaagaccttga

SEQ ID NO: 328956 - DNA, 20 bp, Artificial Sequence
  chemically synthesized
tttatcatataaagaccttg

SEQ ID NO: 328957 - DNA, 20 bp, Artificial Sequence
  chemically synthesized
ttttatcatataaagacctt

SEQ ID NO: 328958 - DNA, 20 bp, Artificial Sequence
  chemically synthesized
atttttcattttatcatata

SEQ ID NO: 328959 - DNA, 20 bp, Artificial Sequence
  chemically synthesized
tatgataaaatgaaaaatga

SEQ ID NO: 328960 - DNA, 20 bp, Artificial Sequence
  chemically synthesized
taaaatgaaaaatgacagaa

SEQ ID NO: 328961 - DNA, 20 bp, Artificial Sequence
  chemically synthesized
aaagaaaaatatgatgatat

SEQ ID NO: 328962 - DNA, 20 bp, Artificial Sequence
  chemically synthesized
aatatgatgatattggaaat

SEQ ID NO: 328963 - DNA, 20 bp, Artificial Sequence
  chemically synthesized
tggaaataagcacattctga

SEQ ID NO: 328964 - DNA, 20 bp, Artificial Sequence
  chemically synthesized
aacaatgacaaattggcttt

SEQ ID NO: 328965 - DNA, 20 bp, Artificial Sequence
  chemically synthesized
gtcataaaacaatgacaaat

SEQ ID NO: 328966 - DNA, 20 bp, Artificial Sequence
  chemically synthesized
taggtgttctcatatacatg

SEQ ID NO: 328967 - DNA, 20 bp, Artificial Sequence
  chemically synthesized
atatttatcttcatgtatat

SEQ ID NO: 328968 - DNA, 20 bp, Artificial Sequence
  chemically synthesized
ttcatgtatatgagaacacc

SEQ ID NO: 328969 - DNA, 20 bp, Artificial Sequence
  chemically synthesized
gtatatgagaacacctagca

SEQ ID NO: 328970 - DNA, 20 bp, Artificial Sequence
  chemically synthesized
tagaagcaaaggactatgct

SEQ ID NO: 328971 - DNA, 20 bp, Artificial Sequence
  chemically synthesized
ttagaagcaaaggactatgc

SEQ ID NO: 328972 - DNA, 20 bp, Artificial Sequence
  chemically synthesized
tgagtacctgttagaagcaa

SEQ ID NO: 328973 - DNA, 20 bp, Artificial Sequence
  chemically synthesized
ttgagtacctgttagaagca

SEQ ID NO: 328974 - DNA, 20 bp, Artificial Sequence
  chemically synthesized
gcatagtcctttgcttctaa

SEQ ID NO: 328975 - DNA, 20 bp, Artificial Sequence
  chemically synthesized
catagtcctttgcttctaac

SEQ ID NO: 328976 - DNA, 20 bp, Artificial Sequence
  chemically synthesized
gtttattgagtacctgttag

SEQ ID NO: 328977 - DNA, 20 bp, Artificial Sequence
  chemically synthesized
aaagtttattgagtacctgt

SEQ ID NO: 328978 - DNA, 20 bp, Artificial Sequence
  chemically synthesized
aaatttagcaaaagtttatt

SEQ ID NO: 328979 - DNA, 20 bp, Artificial Sequence
  chemically synthesized
atatattcaaaatttagcaa

SEQ ID NO: 328980 - DNA, 20 bp, Artificial Sequence
  chemically synthesized
caactaatatattcaaaatt

SEQ ID NO: 328981 - DNA, 20 bp, Artificial Sequence
  chemically synthesized
ttgctaaattttgaatatat

SEQ ID NO: 328982 - DNA, 20 bp, Artificial Sequence
  chemically synthesized
aattttgaatatattagttg

SEQ ID NO: 328983 - DNA, 20 bp, Artificial Sequence
  chemically synthesized
attttgaatatattagttgt

SEQ ID NO: 328984 - DNA, 20 bp, Artificial Sequence
  chemically synthesized
tgaatatattagttgtggga

SEQ ID NO: 328985 - DNA, 20 bp, Artificial Sequence
  chemically synthesized
gaatatattagttgtgggac

SEQ ID NO: 328986 - DNA, 20 bp, Artificial Sequence
  chemically synthesized
tagttgtgggacaggtccta

SEQ ID NO: 328987 - DNA, 20 bp, Artificial Sequence
  chemically synthesized
tatttctagagcaatacttt

SEQ ID NO: 328988 - DNA, 20 bp, Artificial Sequence
  chemically synthesized
atatttctagagcaatactt

SEQ ID NO: 328989 - DNA, 20 bp, Artificial Sequence
  chemically synthesized
caggtcctaaagtattgctc

SEQ ID NO: 328990 - DNA, 20 bp, Artificial Sequence
  chemically synthesized
tgatgaatcaaatatttcta

SEQ ID NO: 328991 - DNA, 20 bp, Artificial Sequence
  chemically synthesized
actgatgaatcaaatatttc

SEQ ID NO: 328992 - DNA, 20 bp, Artificial Sequence
  chemically synthesized
tctagaaatatttgattcat

SEQ ID NO: 328993 - DNA, 20 bp, Artificial Sequence
  chemically synthesized
aatatttgattcatcagtaa

SEQ ID NO: 328994 - DNA, 20 bp, Artificial Sequence
  chemically synthesized
agtcatctttagcataggtt

SEQ ID NO: 328995 - DNA, 20 bp, Artificial Sequence
  chemically synthesized
aagtcatctttagcataggt

SEQ ID NO: 328996 - DNA, 20 bp, Artificial Sequence
  chemically synthesized
taatagcctaacctatgcta

SEQ ID NO: 328997 - DNA, 20 bp, Artificial Sequence
  chemically synthesized
atcaaagtcatctttagcat

SEQ ID NO: 328998 - DNA, 20 bp, Artificial Sequence
  chemically synthesized
aatcaaagtcatctttagca

SEQ ID NO: 328999 - DNA, 20 bp, Artificial Sequence
  chemically synthesized
ctatcaatcaaagtcatctt

SEQ ID NO: 329000 - DNA, 20 bp, Artificial Sequence
  chemically synthesized
ctaaagatgactttgattga

SEQ ID NO: 329001 - DNA, 20 bp, Artificial Sequence
  chemically synthesized
ggactgccctctatcaatca

SEQ ID NO: 329002 - DNA, 20 bp, Artificial Sequence
  chemically synthesized
aaagatgactttgattgata

SEQ ID NO: 329003 - DNA, 20 bp, Artificial Sequence
  chemically synthesized
aagatgactttgattgatag

SEQ ID NO: 329004 - DNA, 20 bp, Artificial Sequence
  chemically synthesized
agatgactttgattgataga

SEQ ID NO: 329005 - DNA, 20 bp, Artificial Sequence
  chemically synthesized
tgactttgattgatagaggg

SEQ ID NO: 329006 - DNA, 20 bp, Artificial Sequence
  chemically synthesized
atagagggcagtccctttga

SEQ ID NO: 329007 - DNA, 20 bp, Artificial Sequence
  chemically synthesized
tcagttggatttctttcaaa

SEQ ID NO: 329008 - DNA, 20 bp, Artificial Sequence
  chemically synthesized
ttcagttggatttctttcaa

SEQ ID NO: 329009 - DNA, 20 bp, Artificial Sequence
  chemically synthesized
tttcagttggatttctttca

SEQ ID NO: 329010 - DNA, 20 bp, Artificial Sequence
  chemically synthesized
tatgttctgtacatttcagt

SEQ ID NO: 329011 - DNA, 20 bp, Artificial Sequence
  chemically synthesized
agaaatccaactgaaatgta

SEQ ID NO: 329012 - DNA, 20 bp, Artificial Sequence
  chemically synthesized
tttttatgttctgtacattt

SEQ ID NO: 329013 - DNA, 20 bp, Artificial Sequence
  chemically synthesized
tacagaacataaaaaaaatg

SEQ ID NO: 329014 - DNA, 20 bp, Artificial Sequence
  chemically synthesized
agaacataaaaaaaatgcag

SEQ ID NO: 329015 - DNA, 20 bp, Artificial Sequence
  chemically synthesized
aatgcagtggatataaaaca

SEQ ID NO: 329016 - DNA, 20 bp, Artificial Sequence
  chemically synthesized
tataaaacacagcattttcc

SEQ ID NO: 329017 - DNA, 20 bp, Artificial Sequence
  chemically synthesized
aaatatgctctattttttct

SEQ ID NO: 329018 - DNA, 20 bp, Artificial Sequence
  chemically synthesized
cagcattttccaagaaaaaa

SEQ ID NO: 329019 - DNA, 20 bp, Artificial Sequence
  chemically synthesized
gcattttccaagaaaaaata

SEQ ID NO: 329020 - DNA, 20 bp, Artificial Sequence
  chemically synthesized
aaaaaatagagcatattttc

SEQ ID NO: 329021 - DNA, 20 bp, Artificial Sequence
  chemically synthesized
gtgtctaattttattggatc

SEQ ID NO: 329022 - DNA, 20 bp, Artificial Sequence
  chemically synthesized
ttttctggatccaataaaat

SEQ ID NO: 329023 - DNA, 20 bp, Artificial Sequence
  chemically synthesized
gtgtgtgtgtctaattttat

SEQ ID NO: 329024 - DNA, 20 bp, Artificial Sequence
  chemically synthesized
tgaattgcaagtgtatttga

SEQ ID NO: 329025 - DNA, 20 bp, Artificial Sequence
  chemically synthesized
taaaatatatcatgaattgc

SEQ ID NO: 329026 - DNA, 20 bp, Artificial Sequence
  chemically synthesized
atgatatattttattctatt

SEQ ID NO: 329027 - DNA, 20 bp, Artificial Sequence
  chemically synthesized
tgatatattttattctatta

SEQ ID NO: 329028 - DNA, 20 bp, Artificial Sequence
  chemically synthesized
ttaataatataaatccttaa

SEQ ID NO: 329029 - DNA, 20 bp, Artificial Sequence
  chemically synthesized
ggatttatattattaaatca

SEQ ID NO: 329030 - DNA, 20 bp, Artificial Sequence
  chemically synthesized
gatttatattattaaatcat

SEQ ID NO: 329031 - DNA, 20 bp, Artificial Sequence
  chemically synthesized
tggtagtatttgaaagagtt

SEQ ID NO: 329032 - DNA, 20 bp, Artificial Sequence
  chemically synthesized
ttttatggtagtatttgaaa

SEQ ID NO: 329033 - DNA, 20 bp, Artificial Sequence
  chemically synthesized
tattttatggtagtatttga

SEQ ID NO: 329034 - DNA, 20 bp, Artificial Sequence
  chemically synthesized
gtttggaaattattttatgg

SEQ ID NO: 329035 - DNA, 20 bp, Artificial Sequence
  chemically synthesized
atagtttggaaattatttta

SEQ ID NO: 329036 - DNA, 20 bp, Artificial Sequence
  chemically synthesized
cataaggatggaatatagtt

SEQ ID NO: 329037 - DNA, 20 bp, Artificial Sequence
  chemically synthesized
tccttcataaggatggaata

SEQ ID NO: 329038 - DNA, 20 bp, Artificial Sequence
  chemically synthesized
acaagattccttcataagga

SEQ ID NO: 329039 - DNA, 20 bp, Artificial Sequence
  chemically synthesized
aactatattccatccttatg

SEQ ID NO: 329040 - DNA, 20 bp, Artificial Sequence
  chemically synthesized
actatattccatccttatga

SEQ ID NO: 329041 - DNA, 20 bp, Artificial Sequence
  chemically synthesized
agccacaagattccttcata

SEQ ID NO: 329042 - DNA, 20 bp, Artificial Sequence
  chemically synthesized
aagccacaagattccttcat

SEQ ID NO: 329043 - DNA, 20 bp, Artificial Sequence
  chemically synthesized
atccttatgaaggaatcttg

SEQ ID NO: 329044 - DNA, 20 bp, Artificial Sequence
  chemically synthesized
tatgaaggaatcttgtggct

SEQ ID NO: 329045 - DNA, 20 bp, Artificial Sequence
  chemically synthesized
atgaaggaatcttgtggctt

SEQ ID NO: 329046 - DNA, 20 bp, Artificial Sequence
  chemically synthesized
attaattgctcccaagccac

SEQ ID NO: 329047 - DNA, 20 bp, Artificial Sequence
  chemically synthesized
gaaggaatcttgtggcttgg

SEQ ID NO: 329048 - DNA, 20 bp, Artificial Sequence
  chemically synthesized
ggaggtgattaattgctccc

SEQ ID NO: 329049 - DNA, 20 bp, Artificial Sequence
  chemically synthesized
acttatgcatgggattgggg

SEQ ID NO: 329050 - DNA, 20 bp, Artificial Sequence
  chemically synthesized
gacttatgcatgggattggg

SEQ ID NO: 329051 - DNA, 20 bp, Artificial Sequence
  chemically synthesized
aggacttatgcatgggattg

SEQ ID NO: 329052 - DNA, 20 bp, Artificial Sequence
  chemically synthesized
caggacttatgcatgggatt

SEQ ID NO: 329053 - DNA, 20 bp, Artificial Sequence
  chemically synthesized
tcaggacttatgcatgggat

SEQ ID NO: 329054 - DNA, 20 bp, Artificial Sequence
  chemically synthesized
acctccccaatcccatgcat

SEQ ID NO: 329055 - DNA, 20 bp, Artificial Sequence
  chemically synthesized
agcaatcaggacttatgcat

SEQ ID NO: 329056 - DNA, 20 bp, Artificial Sequence
  chemically synthesized
aagcaatcaggacttatgca

SEQ ID NO: 329057 - DNA, 20 bp, Artificial Sequence
  chemically synthesized
aggatttatttaaagcaatc

SEQ ID NO: 329058 - DNA, 20 bp, Artificial Sequence
  chemically synthesized
aaggatttatttaaagcaat

SEQ ID NO: 329059 - DNA, 20 bp, Artificial Sequence
  chemically synthesized
tggcaaaaaggatttattta

SEQ ID NO: 329060 - DNA, 20 bp, Artificial Sequence
  chemically synthesized
tttaaataaatcctttttgc

SEQ ID NO: 329061 - DNA, 20 bp, Artificial Sequence
  chemically synthesized
ttaaataaatcctttttgcc

SEQ ID NO: 329062 - DNA, 20 bp, Artificial Sequence
  chemically synthesized
gttctatgtccctggcaaaa

SEQ ID NO: 329063 - DNA, 20 bp, Artificial Sequence
  chemically synthesized
taaataaatcctttttgcca

SEQ ID NO: 329064 - DNA, 20 bp, Artificial Sequence
  chemically synthesized
tgttctatgtccctggcaaa

SEQ ID NO: 329065 - DNA, 20 bp, Artificial Sequence
  chemically synthesized
aatcctttttgccagggaca

SEQ ID NO: 329066 - DNA, 20 bp, Artificial Sequence
  chemically synthesized
ggatttttgttctatgtccc

SEQ ID NO: 329067 - DNA, 20 bp, Artificial Sequence
  chemically synthesized
aaagcataaaatgttgtagt

SEQ ID NO: 329068 - DNA, 20 bp, Artificial Sequence
  chemically synthesized
tgttaaagcataaaatgttg

SEQ ID NO: 329069 - DNA, 20 bp, Artificial Sequence
  chemically synthesized
caacattttatgctttaaca

SEQ ID NO: 329070 - DNA, 20 bp, Artificial Sequence
  chemically synthesized
acagttaatatactgtgtta

SEQ ID NO: 329071 - DNA, 20 bp, Artificial Sequence
  chemically synthesized
ttaacacagtatattaactg

SEQ ID NO: 329072 - DNA, 20 bp, Artificial Sequence
  chemically synthesized
catgttaagtcatgtttcca

SEQ ID NO: 329073 - DNA, 20 bp, Artificial Sequence
  chemically synthesized
ccttctggttggaacatgtt

SEQ ID NO: 329074 - DNA, 20 bp, Artificial Sequence
  chemically synthesized
atgacttaacatgttccaac

SEQ ID NO: 329075 - DNA, 20 bp, Artificial Sequence
  chemically synthesized
acttaacatgttccaaccag

SEQ ID NO: 329076 - DNA, 20 bp, Artificial Sequence
  chemically synthesized
cttaacatgttccaaccaga

SEQ ID NO: 329077 - DNA, 20 bp, Artificial Sequence
  chemically synthesized
aactctggacaccttctggt

SEQ ID NO: 329078 - DNA, 20 bp, Artificial Sequence
  chemically synthesized
gcagaactctggacaccttc

SEQ ID NO: 329079 - DNA, 20 bp, Artificial Sequence
  chemically synthesized
tgttccaaccagaaggtgtc

SEQ ID NO: 329080 - DNA, 20 bp, Artificial Sequence
  chemically synthesized
ttccaaccagaaggtgtcca

SEQ ID NO: 329081 - DNA, 20 bp, Artificial Sequence
  chemically synthesized
ttctcagtcaagcagaactc

SEQ ID NO: 329082 - DNA, 20 bp, Artificial Sequence
  chemically synthesized
gtccagagttctgcttgact

SEQ ID NO: 329083 - DNA, 20 bp, Artificial Sequence
  chemically synthesized
tactttttttctcagtcaag

SEQ ID NO: 329084 - DNA, 20 bp, Artificial Sequence
  chemically synthesized
aagtactttttttctcagtc

SEQ ID NO: 329085 - DNA, 20 bp, Artificial Sequence
  chemically synthesized
ttctgcttgactgagaaaaa

SEQ ID NO: 329086 - DNA, 20 bp, Artificial Sequence
  chemically synthesized
aaaataagtactttttttct

SEQ ID NO: 329087 - DNA, 20 bp, Artificial Sequence
  chemically synthesized
gcttatgtcaaaggaaaaat

SEQ ID NO: 329088 - DNA, 20 bp, Artificial Sequence
  chemically synthesized
acttatttttcctttgacat

SEQ ID NO: 329089 - DNA, 20 bp, Artificial Sequence
  chemically synthesized
tttttctttgcttatgtcaa

SEQ ID NO: 329090 - DNA, 20 bp, Artificial Sequence
  chemically synthesized
ttttttctttgcttatgtca

SEQ ID NO: 329091 - DNA, 20 bp, Artificial Sequence
  chemically synthesized
tttttcctttgacataagca

SEQ ID NO: 329092 - DNA, 20 bp, Artificial Sequence
  chemically synthesized
aagcaaagaaaaaaatgtta

SEQ ID NO: 329093 - DNA, 20 bp, Artificial Sequence
  chemically synthesized
agaaaaaaatgttacagttc

SEQ ID NO: 329094 - DNA, 20 bp, Artificial Sequence
  chemically synthesized
aaaaaatgttacagttctgg

SEQ ID NO: 329095 - DNA, 20 bp, Artificial Sequence
  chemically synthesized
ttgttatgatagatggctgc

SEQ ID NO: 329096 - DNA, 20 bp, Artificial Sequence
  chemically synthesized
tacagttttgttatgataga

SEQ ID NO: 329097 - DNA, 20 bp, Artificial Sequence
  chemically synthesized
cctatacagttttgttatga

SEQ ID NO: 329098 - DNA, 20 bp, Artificial Sequence
  chemically synthesized
tctatcataacaaaactgta

SEQ ID NO: 329099 - DNA, 20 bp, Artificial Sequence
  chemically synthesized
ctatcataacaaaactgtat

SEQ ID NO: 329100 - DNA, 20 bp, Artificial Sequence
  chemically synthesized
tatcataacaaaactgtata

SEQ ID NO: 329101 - DNA, 20 bp, Artificial Sequence
  chemically synthesized
tagttatttctttccctata

SEQ ID NO: 329102 - DNA, 20 bp, Artificial Sequence
  chemically synthesized
ataacaaaactgtataggga

SEQ ID NO: 329103 - DNA, 20 bp, Artificial Sequence
  chemically synthesized
tagggaaagaaataactacc

SEQ ID NO: 329104 - DNA, 20 bp, Artificial Sequence
  chemically synthesized
aaagaaataactacctggca

SEQ ID NO: 329105 - DNA, 20 bp, Artificial Sequence
  chemically synthesized
cttccgttatctatgccagg

SEQ ID NO: 329106 - DNA, 20 bp, Artificial Sequence
  chemically synthesized
actcttccgttatctatgcc

SEQ ID NO: 329107 - DNA, 20 bp, Artificial Sequence
  chemically synthesized
cactcttccgttatctatgc

SEQ ID NO: 329108 - DNA, 20 bp, Artificial Sequence
  chemically synthesized
taactacctggcatagataa

SEQ ID NO: 329109 - DNA, 20 bp, Artificial Sequence
  chemically synthesized
ctacctggcatagataacgg

SEQ ID NO: 329110 - DNA, 20 bp, Artificial Sequence
  chemically synthesized
acctggcatagataacggaa

SEQ ID NO: 329111 - DNA, 20 bp, Artificial Sequence
  chemically synthesized
gcatagataacggaagagtg

SEQ ID NO: 329112 - DNA, 20 bp, Artificial Sequence
  chemically synthesized
atagataacggaagagtgaa

SEQ ID NO: 329113 - DNA, 20 bp, Artificial Sequence
  chemically synthesized
acggaagagtgaagagccaa

SEQ ID NO: 329114 - DNA, 20 bp, Artificial Sequence
  chemically synthesized
ggaagagtgaagagccaaaa

SEQ ID NO: 329115 - DNA, 20 bp, Artificial Sequence
  chemically synthesized
ccgtatctcagtggctcttt

SEQ ID NO: 329116 - DNA, 20 bp, Artificial Sequence
  chemically synthesized
gaagagccaaaagagccact

SEQ ID NO: 329117 - DNA, 20 bp, Artificial Sequence
  chemically synthesized
actgcagctccgtatctcag

SEQ ID NO: 329118 - DNA, 20 bp, Artificial Sequence
  chemically synthesized
ccaaaagagccactgagata

SEQ ID NO: 329119 - DNA, 20 bp, Artificial Sequence
  chemically synthesized
aaaagagccactgagatacg

SEQ ID NO: 329120 - DNA, 20 bp, Artificial Sequence
  chemically synthesized
cacactgcagctccgtatct

SEQ ID NO: 329121 - DNA, 20 bp, Artificial Sequence
  chemically synthesized
gccactgagatacggagctg

SEQ ID NO: 329122 - DNA, 20 bp, Artificial Sequence
  chemically synthesized
ttcacattgtcatcacactg

SEQ ID NO: 329123 - DNA, 20 bp, Artificial Sequence
  chemically synthesized
gtgatgacaatgtgaatatt

SEQ ID NO: 329124 - DNA, 20 bp, Artificial Sequence
  chemically synthesized
caatgtgaatatttggatta

SEQ ID NO: 329125 - DNA, 20 bp, Artificial Sequence
  chemically synthesized
aatgtgaatatttggattaa

SEQ ID NO: 329126 - DNA, 20 bp, Artificial Sequence
  chemically synthesized
tatttggattaaaggcttac

SEQ ID NO: 329127 - DNA, 20 bp, Artificial Sequence
  chemically synthesized
aggaatggcaggattctggt

SEQ ID NO: 329128 - DNA, 20 bp, Artificial Sequence
  chemically synthesized
ccaaaggaatggcaggattc

SEQ ID NO: 329129 - DNA, 20 bp, Artificial Sequence
  chemically synthesized
gaaaattccaaaggaatggc

SEQ ID NO: 329130 - DNA, 20 bp, Artificial Sequence
  chemically synthesized
agaaaattccaaaggaatgg

SEQ ID NO: 329131 - DNA, 20 bp, Artificial Sequence
  chemically synthesized
ccagaatcctgccattcctt

SEQ ID NO: 329132 - DNA, 20 bp, Artificial Sequence
  chemically synthesized
aacagaaaattccaaaggaa

SEQ ID NO: 329133 - DNA, 20 bp, Artificial Sequence
  chemically synthesized
tatgtaacagaaaattccaa

SEQ ID NO: 329134 - DNA, 20 bp, Artificial Sequence
  chemically synthesized
ttatgtaacagaaaattcca

SEQ ID NO: 329135 - DNA, 20 bp, Artificial Sequence
  chemically synthesized
tttggaattttctgttacat

SEQ ID NO: 329136 - DNA, 20 bp, Artificial Sequence
  chemically synthesized
ggaattattggcttatgtaa

SEQ ID NO: 329137 - DNA, 20 bp, Artificial Sequence
  chemically synthesized
aattaaaccttgggaattat

SEQ ID NO: 329138 - DNA, 20 bp, Artificial Sequence
  chemically synthesized
tacataagccaataattccc

SEQ ID NO: 329139 - DNA, 20 bp, Artificial Sequence
  chemically synthesized
acataagccaataattccca

SEQ ID NO: 329140 - DNA, 20 bp, Artificial Sequence
  chemically synthesized
atttcttgtaattaaacctt

SEQ ID NO: 329141 - DNA, 20 bp, Artificial Sequence
  chemically synthesized
gatttcttgtaattaaacct

SEQ ID NO: 329142 - DNA, 20 bp, Artificial Sequence
  chemically synthesized
aattcccaaggtttaattac

SEQ ID NO: 329143 - DNA, 20 bp, Artificial Sequence
  chemically synthesized
taattacaagaaatctttaa

SEQ ID NO: 329144 - DNA, 20 bp, Artificial Sequence
  chemically synthesized
ttacaagaaatctttaatgg

SEQ ID NO: 329145 - DNA, 20 bp, Artificial Sequence
  chemically synthesized
tgacatcttttcttccatta

SEQ ID NO: 329146 - DNA, 20 bp, Artificial Sequence
  chemically synthesized
agaaatctttaatggaagaa

SEQ ID NO: 329147 - DNA, 20 bp, Artificial Sequence
  chemically synthesized
agaaaacatccacattggag

SEQ ID NO: 329148 - DNA, 20 bp, Artificial Sequence
  chemically synthesized
cacatgttactgctccaatg

SEQ ID NO: 329149 - DNA, 20 bp, Artificial Sequence
  chemically synthesized
tacagaaaacatccacattg

SEQ ID NO: 329150 - DNA, 20 bp, Artificial Sequence
  chemically synthesized
catacagaaaacatccacat

SEQ ID NO: 329151 - DNA, 20 bp, Artificial Sequence
  chemically synthesized
catacacatacacacacata

SEQ ID NO: 329152 - DNA, 20 bp, Artificial Sequence
  chemically synthesized
tcaagaaaacttgaaatatg

SEQ ID NO: 329153 - DNA, 20 bp, Artificial Sequence
  chemically synthesized
tgtgtgtgtctgcatatttc

SEQ ID NO: 329154 - DNA, 20 bp, Artificial Sequence
  chemically synthesized
tgcatatttcaagttttctt

SEQ ID NO: 329155 - DNA, 20 bp, Artificial Sequence
  chemically synthesized
atatttcaagttttcttgag

SEQ ID NO: 329156 - DNA, 20 bp, Artificial Sequence
  chemically synthesized
atttcaagttttcttgagaa

SEQ ID NO: 329157 - DNA, 20 bp, Artificial Sequence
  chemically synthesized
aataatggaaaactcttctc

SEQ ID NO: 329158 - DNA, 20 bp, Artificial Sequence
  chemically synthesized
aatgatgtttggtacaataa

SEQ ID NO: 329159 - DNA, 20 bp, Artificial Sequence
  chemically synthesized
atataaactagaatgatgtt

SEQ ID NO: 329160 - DNA, 20 bp, Artificial Sequence
  chemically synthesized
tattgtaccaaacatcattc

SEQ ID NO: 329161 - DNA, 20 bp, Artificial Sequence
  chemically synthesized
aaacatcattctagtttata

SEQ ID NO: 329162 - DNA, 20 bp, Artificial Sequence
  chemically synthesized
ataccaaagtccatataaac

SEQ ID NO: 329163 - DNA, 20 bp, Artificial Sequence
  chemically synthesized
attctagtttatatggactt

SEQ ID NO: 329164 - DNA, 20 bp, Artificial Sequence
  chemically synthesized
gtttatatggactttggtat

SEQ ID NO: 329165 - DNA, 20 bp, Artificial Sequence
  chemically synthesized
tttatatggactttggtatc

SEQ ID NO: 329166 - DNA, 20 bp, Artificial Sequence
  chemically synthesized
caacccacttcctgatacca

SEQ ID NO: 329167 - DNA, 20 bp, Artificial Sequence
  chemically synthesized
atatggactttggtatcagg

SEQ ID NO: 329168 - DNA, 20 bp, Artificial Sequence
  chemically synthesized
tggactttggtatcaggaag

SEQ ID NO: 329169 - DNA, 20 bp, Artificial Sequence
  chemically synthesized
ggactttggtatcaggaagt

SEQ ID NO: 329170 - DNA, 20 bp, Artificial Sequence
  chemically synthesized
atcaggaagtgggttgttga

SEQ ID NO: 329171 - DNA, 20 bp, Artificial Sequence
  chemically synthesized
agtgggttgttgaaagttaa

SEQ ID NO: 329172 - DNA, 20 bp, Artificial Sequence
  chemically synthesized
agttaatagatcctataatg

SEQ ID NO: 329173 - DNA, 20 bp, Artificial Sequence
  chemically synthesized
ttcagcctgttccacattat

SEQ ID NO: 329174 - DNA, 20 bp, Artificial Sequence
  chemically synthesized
attcagcctgttccacatta

SEQ ID NO: 329175 - DNA, 20 bp, Artificial Sequence
  chemically synthesized
atagatcctataatgtggaa

SEQ ID NO: 329176 - DNA, 20 bp, Artificial Sequence
  chemically synthesized
tagatcctataatgtggaac

SEQ ID NO: 329177 - DNA, 20 bp, Artificial Sequence
  chemically synthesized
tgtggaacaggctgaattat

SEQ ID NO: 329178 - DNA, 20 bp, Artificial Sequence
  chemically synthesized
atccttgtcttctcataatt

SEQ ID NO: 329179 - DNA, 20 bp, Artificial Sequence
  chemically synthesized
ggaacaggctgaattatgag

SEQ ID NO: 329180 - DNA, 20 bp, Artificial Sequence
  chemically synthesized
aggctgaattatgagaagac

SEQ ID NO: 329181 - DNA, 20 bp, Artificial Sequence
  chemically synthesized
ggctgaattatgagaagaca

SEQ ID NO: 329182 - DNA, 20 bp, Artificial Sequence
  chemically synthesized
attttgagttggggtggggg

SEQ ID NO: 329183 - DNA, 20 bp, Artificial Sequence
  chemically synthesized
cattttgagttggggtgggg

SEQ ID NO: 329184 - DNA, 20 bp, Artificial Sequence
  chemically synthesized
atcattttgagttggggtgg

SEQ ID NO: 329185 - DNA, 20 bp, Artificial Sequence
  chemically synthesized
tatcattttgagttggggtg

SEQ ID NO: 329186 - DNA, 20 bp, Artificial Sequence
  chemically synthesized
gtatcattttgagttggggt

SEQ ID NO: 329187 - DNA, 20 bp, Artificial Sequence
  chemically synthesized
agtatcattttgagttgggg

SEQ ID NO: 329188 - DNA, 20 bp, Artificial Sequence
  chemically synthesized
ccaagtatcattttgagttg

SEQ ID NO: 329189 - DNA, 20 bp, Artificial Sequence
  chemically synthesized
accaagtatcattttgagtt

SEQ ID NO: 329190 - DNA, 20 bp, Artificial Sequence
  chemically synthesized
taccaagtatcattttgagt

SEQ ID NO: 329191 - DNA, 20 bp, Artificial Sequence
  chemically synthesized
catgtaccaagtatcatttt

SEQ ID NO: 329192 - DNA, 20 bp, Artificial Sequence
  chemically synthesized
ccccaactcaaaatgatact

SEQ ID NO: 329193 - DNA, 20 bp, Artificial Sequence
  chemically synthesized
ctgttttttaatcatgtacc

SEQ ID NO: 329194 - DNA, 20 bp, Artificial Sequence
  chemically synthesized
cttggtacatgattaaaaaa

SEQ ID NO: 329195 - DNA, 20 bp, Artificial Sequence
  chemically synthesized
aaaaacagttgattaaacaa

SEQ ID NO: 329196 - DNA, 20 bp, Artificial Sequence
  chemically synthesized
gcacatgacttaggataaaa

SEQ ID NO: 329197 - DNA, 20 bp, Artificial Sequence
  chemically synthesized
acaatggtctattttatcct

SEQ ID NO: 329198 - DNA, 20 bp, Artificial Sequence
  chemically synthesized
actcgtaaggcacatgactt

SEQ ID NO: 329199 - DNA, 20 bp, Artificial Sequence
  chemically synthesized
tactcgtaaggcacatgact

SEQ ID NO: 329200 - DNA, 20 bp, Artificial Sequence
  chemically synthesized
tcctaagtcatgtgccttac

SEQ ID NO: 329201 - DNA, 20 bp, Artificial Sequence
  chemically synthesized
taatagtgttggtactcgta

SEQ ID NO: 329202 - DNA, 20 bp, Artificial Sequence
  chemically synthesized
ctaatagtgttggtactcgt

SEQ ID NO: 329203 - DNA, 20 bp, Artificial Sequence
  chemically synthesized
cttacgagtaccaacactat

SEQ ID NO: 329204 - DNA, 20 bp, Artificial Sequence
  chemically synthesized
atcaaatctcctaatagtgt

SEQ ID NO: 329205 - DNA, 20 bp, Artificial Sequence
  chemically synthesized
ttacgagtaccaacactatt

SEQ ID NO: 329206 - DNA, 20 bp, Artificial Sequence
  chemically synthesized
acgagtaccaacactattag

SEQ ID NO: 329207 - DNA, 20 bp, Artificial Sequence
  chemically synthesized
gtttctatcaaatctcctaa

SEQ ID NO: 329208 - DNA, 20 bp, Artificial Sequence
  chemically synthesized
aacactattaggagatttga

SEQ ID NO: 329209 - DNA, 20 bp, Artificial Sequence
  chemically synthesized
acaaaaatgttgccacctac

SEQ ID NO: 329210 - DNA, 20 bp, Artificial Sequence
  chemically synthesized
ggtttaaagaggccagtagg

SEQ ID NO: 329211 - DNA, 20 bp, Artificial Sequence
  chemically synthesized
cttggtttaaagaggccagt

SEQ ID NO: 329212 - DNA, 20 bp, Artificial Sequence
  chemically synthesized
tcttggtttaaagaggccag

SEQ ID NO: 329213 - DNA, 20 bp, Artificial Sequence
  chemically synthesized
ctttcttggtttaaagaggc

SEQ ID NO: 329214 - DNA, 20 bp, Artificial Sequence
  chemically synthesized
ttttctttcttggtttaaag

SEQ ID NO: 329215 - DNA, 20 bp, Artificial Sequence
  chemically synthesized
tttttctttcttggtttaaa

SEQ ID NO: 329216 - DNA, 20 bp, Artificial Sequence
  chemically synthesized
cctactggcctctttaaacc

SEQ ID NO: 329217 - DNA, 20 bp, Artificial Sequence
  chemically synthesized
gttttttctttcttggttta

SEQ ID NO: 329218 - DNA, 20 bp, Artificial Sequence
  chemically synthesized
ctggcctctttaaaccaaga

SEQ ID NO: 329219 - DNA, 20 bp, Artificial Sequence
  chemically synthesized
gcatgaggttttttctttct

SEQ ID NO: 329220 - DNA, 20 bp, Artificial Sequence
  chemically synthesized
aacaagtaaccattagcatg

SEQ ID NO: 329221 - DNA, 20 bp, Artificial Sequence
  chemically synthesized
aagaaaaaacctcatgctaa

SEQ ID NO: 329222 - DNA, 20 bp, Artificial Sequence
  chemically synthesized
aaacaagtaaccattagcat

SEQ ID NO: 329223 - DNA, 20 bp, Artificial Sequence
  chemically synthesized
cttcaaaaacaagtaaccat

SEQ ID NO: 329224 - DNA, 20 bp, Artificial Sequence
  chemically synthesized
ctaatggttacttgtttttg

SEQ ID NO: 329225 - DNA, 20 bp, Artificial Sequence
  chemically synthesized
tttttctgtacttcaaaaac

SEQ ID NO: 329226 - DNA, 20 bp, Artificial Sequence
  chemically synthesized
ggttacttgtttttgaagta

SEQ ID NO: 329227 - DNA, 20 bp, Artificial Sequence
  chemically synthesized
tttttgaagtacagaaaaaa

SEQ ID NO: 329228 - DNA, 20 bp, Artificial Sequence
  chemically synthesized
tacagaaaaaaaagaaaata

SEQ ID NO: 329229 - DNA, 20 bp, Artificial Sequence
  chemically synthesized
agaaaatatagctttgtctg

SEQ ID NO: 329230 - DNA, 20 bp, Artificial Sequence
  chemically synthesized
agagagggcttcttcagaca

SEQ ID NO: 329231 - DNA, 20 bp, Artificial Sequence
  chemically synthesized
aaatatagctttgtctgaag

SEQ ID NO: 329232 - DNA, 20 bp, Artificial Sequence
  chemically synthesized
acaggcagagagggcttctt

SEQ ID NO: 329233 - DNA, 20 bp, Artificial Sequence
  chemically synthesized
ttataagccacaggcagaga

SEQ ID NO: 329234 - DNA, 20 bp, Artificial Sequence
  chemically synthesized
gttataagccacaggcagag

SEQ ID NO: 329235 - DNA, 20 bp, Artificial Sequence
  chemically synthesized
cgttataagccacaggcaga

SEQ ID NO: 329236 - DNA, 20 bp, Artificial Sequence
  chemically synthesized
gaagaagccctctctgcctg

SEQ ID NO: 329237 - DNA, 20 bp, Artificial Sequence
  chemically synthesized
cacgttataagccacaggca

SEQ ID NO: 329238 - DNA, 20 bp, Artificial Sequence
  chemically synthesized
ttcacgttataagccacagg

SEQ ID NO: 329239 - DNA, 20 bp, Artificial Sequence
  chemically synthesized
gcgttcacgttataagccac

SEQ ID NO: 329240 - DNA, 20 bp, Artificial Sequence
  chemically synthesized
ggcgttcacgttataagcca

SEQ ID NO: 329241 - DNA, 20 bp, Artificial Sequence
  chemically synthesized
tctcaaggcgttcacgttat

SEQ ID NO: 329242 - DNA, 20 bp, Artificial Sequence
  chemically synthesized
gcttataacgtgaacgcctt

SEQ ID NO: 329243 - DNA, 20 bp, Artificial Sequence
  chemically synthesized
ttataacgtgaacgccttga

SEQ ID NO: 329244 - DNA, 20 bp, Artificial Sequence
  chemically synthesized
tataacgtgaacgccttgag

SEQ ID NO: 329245 - DNA, 20 bp, Artificial Sequence
  chemically synthesized
tccaaattatcagcctctca

SEQ ID NO: 329246 - DNA, 20 bp, Artificial Sequence
  chemically synthesized
ctccaaattatcagcctctc

SEQ ID NO: 329247 - DNA, 20 bp, Artificial Sequence
  chemically synthesized
gccttgagaggctgataatt

SEQ ID NO: 329248 - DNA, 20 bp, Artificial Sequence
  chemically synthesized
catatcaggctccaaattat

SEQ ID NO: 329249 - DNA, 20 bp, Artificial Sequence
  chemically synthesized
cttgagaggctgataatttg

SEQ ID NO: 329250 - DNA, 20 bp, Artificial Sequence
  chemically synthesized
gataatttggagcctgatat

SEQ ID NO: 329251 - DNA, 20 bp, Artificial Sequence
  chemically synthesized
ttggcttttccactcatatc

SEQ ID NO: 329252 - DNA, 20 bp, Artificial Sequence
  chemically synthesized
aatttggagcctgatatgag

SEQ ID NO: 329253 - DNA, 20 bp, Artificial Sequence
  chemically synthesized
attggcttttccactcatat

SEQ ID NO: 329254 - DNA, 20 bp, Artificial Sequence
  chemically synthesized
ggagcctgatatgagtggaa

SEQ ID NO: 329255 - DNA, 20 bp, Artificial Sequence
  chemically synthesized
tttggagtaaaaatacaaat

SEQ ID NO: 329256 - DNA, 20 bp, Artificial Sequence
  chemically synthesized
tcatacaaacattcgatttg

SEQ ID NO: 329257 - DNA, 20 bp, Artificial Sequence
  chemically synthesized
gttcatacaaacattcgatt

SEQ ID NO: 329258 - DNA, 20 bp, Artificial Sequence
  chemically synthesized
aaatcgaatgtttgtatgaa

SEQ ID NO: 329259 - DNA, 20 bp, Artificial Sequence
  chemically synthesized
atcgaatgtttgtatgaaca

SEQ ID NO: 329260 - DNA, 20 bp, Artificial Sequence
  chemically synthesized
aatgtttgtatgaacagaga

SEQ ID NO: 329261 - DNA, 20 bp, Artificial Sequence
  chemically synthesized
atgtttgtatgaacagagac

SEQ ID NO: 329262 - DNA, 20 bp, Artificial Sequence
  chemically synthesized
gtttgtatgaacagagacag

SEQ ID NO: 329263 - DNA, 20 bp, Artificial Sequence
  chemically synthesized
ttgtatgaacagagacagga

SEQ ID NO: 329264 - DNA, 20 bp, Artificial Sequence
  chemically synthesized
tgtatgaacagagacaggag

SEQ ID NO: 329265 - DNA, 20 bp, Artificial Sequence
  chemically synthesized
atgaacagagacaggagagg

SEQ ID NO: 329266 - DNA, 20 bp, Artificial Sequence
  chemically synthesized
agacaggagaggcagaatgt

SEQ ID NO: 329267 - DNA, 20 bp, Artificial Sequence
  chemically synthesized
agaggcagaatgtaagactt

SEQ ID NO: 329268 - DNA, 20 bp, Artificial Sequence
  chemically synthesized
gttgattttttttagtactt

SEQ ID NO: 329269 - DNA, 20 bp, Artificial Sequence
  chemically synthesized
gcactatagttgattttttt

SEQ ID NO: 329270 - DNA, 20 bp, Artificial Sequence
  chemically synthesized
gtactaaaaaaaatcaacta

SEQ ID NO: 329271 - DNA, 20 bp, Artificial Sequence
  chemically synthesized
agtgctttagggaagcacta

SEQ ID NO: 329272 - DNA, 20 bp, Artificial Sequence
  chemically synthesized
tcaactatagtgcttcccta

SEQ ID NO: 329273 - DNA, 20 bp, Artificial Sequence
  chemically synthesized
gtcacaaaagtgctttaggg

SEQ ID NO: 329274 - DNA, 20 bp, Artificial Sequence
  chemically synthesized
tttgtcacaaaagtgcttta

SEQ ID NO: 329275 - DNA, 20 bp, Artificial Sequence
  chemically synthesized
ctttgtcacaaaagtgcttt

SEQ ID NO: 329276 - DNA, 20 bp, Artificial Sequence
  chemically synthesized
actttgtcacaaaagtgctt

SEQ ID NO: 329277 - DNA, 20 bp, Artificial Sequence
  chemically synthesized
gatcgtctactttgtcacaa

SEQ ID NO: 329278 - DNA, 20 bp, Artificial Sequence
  chemically synthesized
cctaaagcacttttgtgaca

SEQ ID NO: 329279 - DNA, 20 bp, Artificial Sequence
  chemically synthesized
aaagcacttttgtgacaaag

SEQ ID NO: 329280 - DNA, 20 bp, Artificial Sequence
  chemically synthesized
gctgcttcttcatgatagga

SEQ ID NO: 329281 - DNA, 20 bp, Artificial Sequence
  chemically synthesized
agctgcttcttcatgatagg

SEQ ID NO: 329282 - DNA, 20 bp, Artificial Sequence
  chemically synthesized
aagctgcttcttcatgatag

SEQ ID NO: 329283 - DNA, 20 bp, Artificial Sequence
  chemically synthesized
agacgatccctcctatcatg

SEQ ID NO: 329284 - DNA, 20 bp, Artificial Sequence
  chemically synthesized
agaagctgcttcttcatgat

SEQ ID NO: 329285 - DNA, 20 bp, Artificial Sequence
  chemically synthesized
tagaagctgcttcttcatga

SEQ ID NO: 329286 - DNA, 20 bp, Artificial Sequence
  chemically synthesized
cgatccctcctatcatgaag

SEQ ID NO: 329287 - DNA, 20 bp, Artificial Sequence
  chemically synthesized
tccctcctatcatgaagaag

SEQ ID NO: 329288 - DNA, 20 bp, Artificial Sequence
  chemically synthesized
ttgaagtatagattacatag

SEQ ID NO: 329289 - DNA, 20 bp, Artificial Sequence
  chemically synthesized
tctttgaagtatagattaca

SEQ ID NO: 329290 - DNA, 20 bp, Artificial Sequence
  chemically synthesized
tctatgtaatctatacttca

SEQ ID NO: 329291 - DNA, 20 bp, Artificial Sequence
  chemically synthesized
ttgagtatatctttgaagta

SEQ ID NO: 329292 - DNA, 20 bp, Artificial Sequence
  chemically synthesized
aatctttgagtatatctttg

SEQ ID NO: 329293 - DNA, 20 bp, Artificial Sequence
  chemically synthesized
atacttcaaagatatactca

SEQ ID NO: 329294 - DNA, 20 bp, Artificial Sequence
  chemically synthesized
tcaaagatatactcaaagat

SEQ ID NO: 329295 - DNA, 20 bp, Artificial Sequence
  chemically synthesized
agagggcatagccaatcttt

SEQ ID NO: 329296 - DNA, 20 bp, Artificial Sequence
  chemically synthesized
cagggttggggtagagggca

SEQ ID NO: 329297 - DNA, 20 bp, Artificial Sequence
  chemically synthesized
cagcacagggttggggtaga

SEQ ID NO: 329298 - DNA, 20 bp, Artificial Sequence
  chemically synthesized
gcagcacagggttggggtag

SEQ ID NO: 329299 - DNA, 20 bp, Artificial Sequence
  chemically synthesized
tgcagcacagggttggggta

SEQ ID NO: 329300 - DNA, 20 bp, Artificial Sequence
  chemically synthesized
tttgcagcacagggttgggg

SEQ ID NO: 329301 - DNA, 20 bp, Artificial Sequence
  chemically synthesized
aaatttgcagcacagggttg

SEQ ID NO: 329302 - DNA, 20 bp, Artificial Sequence
  chemically synthesized
aaaatttgcagcacagggtt

SEQ ID NO: 329303 - DNA, 20 bp, Artificial Sequence
  chemically synthesized
gaaaatttgcagcacagggt

SEQ ID NO: 329304 - DNA, 20 bp, Artificial Sequence
  chemically synthesized
ctgagaaaatttgcagcaca

SEQ ID NO: 329305 - DNA, 20 bp, Artificial Sequence
  chemically synthesized
actgagaaaatttgcagcac

SEQ ID NO: 329306 - DNA, 20 bp, Artificial Sequence
  chemically synthesized
gactgagaaaatttgcagca

SEQ ID NO: 329307 - DNA, 20 bp, Artificial Sequence
  chemically synthesized
cccctgactgagaaaatttg

SEQ ID NO: 329308 - DNA, 20 bp, Artificial Sequence
  chemically synthesized
ccctgtgctgcaaattttct

SEQ ID NO: 329309 - DNA, 20 bp, Artificial Sequence
  chemically synthesized
gtgctgcaaattttctcagt

SEQ ID NO: 329310 - DNA, 20 bp, Artificial Sequence
  chemically synthesized
tgctgcaaattttctcagtc

SEQ ID NO: 329311 - DNA, 20 bp, Artificial Sequence
  chemically synthesized
gctgcaaattttctcagtca

SEQ ID NO: 329312 - DNA, 20 bp, Artificial Sequence
  chemically synthesized
ctgcaaattttctcagtcag

SEQ ID NO: 329313 - DNA, 20 bp, Artificial Sequence
  chemically synthesized
ctttgcacaatcccctgact

SEQ ID NO: 329314 - DNA, 20 bp, Artificial Sequence
  chemically synthesized
ctcagtcaggggattgtgca

SEQ ID NO: 329315 - DNA, 20 bp, Artificial Sequence
  chemically synthesized
tcaggggattgtgcaaagca

SEQ ID NO: 329316 - DNA, 20 bp, Artificial Sequence
  chemically synthesized
aggggattgtgcaaagcaca

SEQ ID NO: 329317 - DNA, 20 bp, Artificial Sequence
  chemically synthesized
ggggattgtgcaaagcacag

SEQ ID NO: 329318 - DNA, 20 bp, Artificial Sequence
  chemically synthesized
caaagcacagaggcctctta

SEQ ID NO: 329319 - DNA, 20 bp, Artificial Sequence
  chemically synthesized
cctcttttgacatctttaag

SEQ ID NO: 329320 - DNA, 20 bp, Artificial Sequence
  chemically synthesized
acctcttttgacatctttaa

SEQ ID NO: 329321 - DNA, 20 bp, Artificial Sequence
  chemically synthesized
taacctcttttgacatcttt

SEQ ID NO: 329322 - DNA, 20 bp, Artificial Sequence
  chemically synthesized
aggcctcttaaagatgtcaa

SEQ ID NO: 329323 - DNA, 20 bp, Artificial Sequence
  chemically synthesized
gcctcttaaagatgtcaaaa

SEQ ID NO: 329324 - DNA, 20 bp, Artificial Sequence
  chemically synthesized
cctcttaaagatgtcaaaag

SEQ ID NO: 329325 - DNA, 20 bp, Artificial Sequence
  chemically synthesized
tcaaaagaggttaacatttg

SEQ ID NO: 329326 - DNA, 20 bp, Artificial Sequence
  chemically synthesized
aaattctatgatttggtttt

SEQ ID NO: 329327 - DNA, 20 bp, Artificial Sequence
  chemically synthesized
caaattctatgatttggttt

SEQ ID NO: 329328 - DNA, 20 bp, Artificial Sequence
  chemically synthesized
tgaagcctaaaaccaaatca

SEQ ID NO: 329329 - DNA, 20 bp, Artificial Sequence
  chemically synthesized
gtaacccaaattctatgatt

SEQ ID NO: 329330 - DNA, 20 bp, Artificial Sequence
  chemically synthesized
taaaaccaaatcatagaatt

SEQ ID NO: 329331 - DNA, 20 bp, Artificial Sequence
  chemically synthesized
aaaaccaaatcatagaattt

SEQ ID NO: 329332 - DNA, 20 bp, Artificial Sequence
  chemically synthesized
aatcatagaatttgggttac

SEQ ID NO: 329333 - DNA, 20 bp, Artificial Sequence
  chemically synthesized
atcatagaatttgggttact

SEQ ID NO: 329334 - DNA, 20 bp, Artificial Sequence
  chemically synthesized
gaatttgggttactgggtca

SEQ ID NO: 329335 - DNA, 20 bp, Artificial Sequence
  chemically synthesized
ttcttatcaattccatgacc

SEQ ID NO: 329336 - DNA, 20 bp, Artificial Sequence
  chemically synthesized
tactgggtcatggaattgat

SEQ ID NO: 329337 - DNA, 20 bp, Artificial Sequence
  chemically synthesized
ttgataagaacaaatactga

SEQ ID NO: 329338 - DNA, 20 bp, Artificial Sequence
  chemically synthesized
gtttactatttataggcttt

SEQ ID NO: 329339 - DNA, 20 bp, Artificial Sequence
  chemically synthesized
aaatactgaaagcctataaa

SEQ ID NO: 329340 - DNA, 20 bp, Artificial Sequence
  chemically synthesized
cagatttgtttactatttat

SEQ ID NO: 329341 - DNA, 20 bp, Artificial Sequence
  chemically synthesized
tcagatttgtttactattta

SEQ ID NO: 329342 - DNA, 20 bp, Artificial Sequence
  chemically synthesized
gtaaacaaatctgattgcca

SEQ ID NO: 329343 - DNA, 20 bp, Artificial Sequence
  chemically synthesized
cctggggtttctttggcaat

SEQ ID NO: 329344 - DNA, 20 bp, Artificial Sequence
  chemically synthesized
agttagacctggggtttctt

SEQ ID NO: 329345 - DNA, 20 bp, Artificial Sequence
  chemically synthesized
tctgattgccaaagaaaccc

SEQ ID NO: 329346 - DNA, 20 bp, Artificial Sequence
  chemically synthesized
ctgattgccaaagaaacccc

SEQ ID NO: 329347 - DNA, 20 bp, Artificial Sequence
  chemically synthesized
ggtgtttttagttagacctg

SEQ ID NO: 329348 - DNA, 20 bp, Artificial Sequence
  chemically synthesized
aggtgtttttagttagacct

SEQ ID NO: 329349 - DNA, 20 bp, Artificial Sequence
  chemically synthesized
aaggtgtttttagttagacc

SEQ ID NO: 329350 - DNA, 20 bp, Artificial Sequence
  chemically synthesized
gataacaaggtgtttttagt

SEQ ID NO: 329351 - DNA, 20 bp, Artificial Sequence
  chemically synthesized
gagtgataacaaggtgtttt

SEQ ID NO: 329352 - DNA, 20 bp, Artificial Sequence
  chemically synthesized
cctaggtttgagtgataaca

SEQ ID NO: 329353 - DNA, 20 bp, Artificial Sequence
  chemically synthesized
ccctaggtttgagtgataac

SEQ ID NO: 329354 - DNA, 20 bp, Artificial Sequence
  chemically synthesized
accttgttatcactcaaacc

SEQ ID NO: 329355 - DNA, 20 bp, Artificial Sequence
  chemically synthesized
ccttgttatcactcaaacct

SEQ ID NO: 329356 - DNA, 20 bp, Artificial Sequence
  chemically synthesized
cttgttatcactcaaaccta

SEQ ID NO: 329357 - DNA, 20 bp, Artificial Sequence
  chemically synthesized
ctggtgcttgccctaggttt

SEQ ID NO: 329358 - DNA, 20 bp, Artificial Sequence
  chemically synthesized
ttatcactcaaacctagggc

SEQ ID NO: 329359 - DNA, 20 bp, Artificial Sequence
  chemically synthesized
aaagtcctggtgcttgccct

SEQ ID NO: 329360 - DNA, 20 bp, Artificial Sequence
  chemically synthesized
aaaagtcctggtgcttgccc

SEQ ID NO: 329361 - DNA, 20 bp, Artificial Sequence
  chemically synthesized
ctcaaacctagggcaagcac

SEQ ID NO: 329362 - DNA, 20 bp, Artificial Sequence
  chemically synthesized
tcaaacctagggcaagcacc

SEQ ID NO: 329363 - DNA, 20 bp, Artificial Sequence
  chemically synthesized
attgtgttgtttaaaagtcc

SEQ ID NO: 329364 - DNA, 20 bp, Artificial Sequence
  chemically synthesized
ctacttattgtgttgtttaa

SEQ ID NO: 329365 - DNA, 20 bp, Artificial Sequence
  chemically synthesized
ggacttttaaacaacacaat

SEQ ID NO: 329366 - DNA, 20 bp, Artificial Sequence
  chemically synthesized
cttttaaacaacacaataag

SEQ ID NO: 329367 - DNA, 20 bp, Artificial Sequence
  chemically synthesized
acacaataagtagaataata

SEQ ID NO: 329368 - DNA, 20 bp, Artificial Sequence
  chemically synthesized
tctgaagttgacatattttg

SEQ ID NO: 329369 - DNA, 20 bp, Artificial Sequence
  chemically synthesized
atctgaagttgacatatttt

SEQ ID NO: 329370 - DNA, 20 bp, Artificial Sequence
  chemically synthesized
tatctgaagttgacatattt

SEQ ID NO: 329371 - DNA, 20 bp, Artificial Sequence
  chemically synthesized
accccaaaatatgtcaactt

SEQ ID NO: 329372 - DNA, 20 bp, Artificial Sequence
  chemically synthesized
tgtcttcatcatgatatctg

SEQ ID NO: 329373 - DNA, 20 bp, Artificial Sequence
  chemically synthesized
caacttcagatatcatgatg

SEQ ID NO: 329374 - DNA, 20 bp, Artificial Sequence
  chemically synthesized
tcagatatcatgatgaagac

SEQ ID NO: 329375 - DNA, 20 bp, Artificial Sequence
  chemically synthesized
tcatgatgaagacaagtatt

SEQ ID NO: 329376 - DNA, 20 bp, Artificial Sequence
  chemically synthesized
ttagcaaaatttataatgaa

SEQ ID NO: 329377 - DNA, 20 bp, Artificial Sequence
  chemically synthesized
gcaaaatttataatgaacag

SEQ ID NO: 329378 - DNA, 20 bp, Artificial Sequence
  chemically synthesized
caaaatttataatgaacaga

SEQ ID NO: 329379 - DNA, 20 bp, Artificial Sequence
  chemically synthesized
tgaacagaaggaaaaatcac

SEQ ID NO: 329380 - DNA, 20 bp, Artificial Sequence
  chemically synthesized
gaacagaaggaaaaatcacc

SEQ ID NO: 329381 - DNA, 20 bp, Artificial Sequence
  chemically synthesized
cagaaggaaaaatcaccagg

SEQ ID NO: 329382 - DNA, 20 bp, Artificial Sequence
  chemically synthesized
agaaggaaaaatcaccagga

SEQ ID NO: 329383 - DNA, 20 bp, Artificial Sequence
  chemically synthesized
ctgcactttcagagccttcc

SEQ ID NO: 329384 - DNA, 20 bp, Artificial Sequence
  chemically synthesized
aatcaccaggaaggctctga

SEQ ID NO: 329385 - DNA, 20 bp, Artificial Sequence
  chemically synthesized
tattatatcctgcactttca

SEQ ID NO: 329386 - DNA, 20 bp, Artificial Sequence
  chemically synthesized
ccaggaaggctctgaaagtg

SEQ ID NO: 329387 - DNA, 20 bp, Artificial Sequence
  chemically synthesized
caggaaggctctgaaagtgc

SEQ ID NO: 329388 - DNA, 20 bp, Artificial Sequence
  chemically synthesized
gatattatatcctgcacttt

SEQ ID NO: 329389 - DNA, 20 bp, Artificial Sequence
  chemically synthesized
taaaagaaaccaaattgaaa

SEQ ID NO: 329390 - DNA, 20 bp, Artificial Sequence
  chemically synthesized
atataatatctgtttcaatt

SEQ ID NO: 329391 - DNA, 20 bp, Artificial Sequence
  chemically synthesized
aaactaaactaaatttataa

SEQ ID NO: 329392 - DNA, 20 bp, Artificial Sequence
  chemically synthesized
tttggtttcttttataaatt

SEQ ID NO: 329393 - DNA, 20 bp, Artificial Sequence
  chemically synthesized
tttcttttataaatttagtt

SEQ ID NO: 329394 - DNA, 20 bp, Artificial Sequence
  chemically synthesized
aaatttagtttagttttaat

SEQ ID NO: 329395 - DNA, 20 bp, Artificial Sequence
  chemically synthesized
aatttagtttagttttaatc

SEQ ID NO: 329396 - DNA, 20 bp, Artificial Sequence
  chemically synthesized
tgctaagtaaaaagttagaa

SEQ ID NO: 329397 - DNA, 20 bp, Artificial Sequence
  chemically synthesized
ctgctaagtaaaaagttaga

SEQ ID NO: 329398 - DNA, 20 bp, Artificial Sequence
  chemically synthesized
actgctaagtaaaaagttag

SEQ ID NO: 329399 - DNA, 20 bp, Artificial Sequence
  chemically synthesized
agtactgctaagtaaaaagt

SEQ ID NO: 329400 - DNA, 20 bp, Artificial Sequence
  chemically synthesized
tgcccttctaactttttact

SEQ ID NO: 329401 - DNA, 20 bp, Artificial Sequence
  chemically synthesized
gtccagtactgctaagtaaa

SEQ ID NO: 329402 - DNA, 20 bp, Artificial Sequence
  chemically synthesized
ccttctaactttttacttag

SEQ ID NO: 329403 - DNA, 20 bp, Artificial Sequence
  chemically synthesized
atttgatgtccagtactgct

SEQ ID NO: 329404 - DNA, 20 bp, Artificial Sequence
  chemically synthesized
aactttttacttagcagtac

SEQ ID NO: 329405 - DNA, 20 bp, Artificial Sequence
  chemically synthesized
aagtgaaaaaatttgatgtc

SEQ ID NO: 329406 - DNA, 20 bp, Artificial Sequence
  chemically synthesized
ggacatcaaattttttcact

SEQ ID NO: 329407 - DNA, 20 bp, Artificial Sequence
  chemically synthesized
caaattttttcacttagtca

SEQ ID NO: 329408 - DNA, 20 bp, Artificial Sequence
  chemically synthesized
ccatccagtggactatgact

SEQ ID NO: 329409 - DNA, 20 bp, Artificial Sequence
  chemically synthesized
ttcacttagtcatagtccac

SEQ ID NO: 329410 - DNA, 20 bp, Artificial Sequence
  chemically synthesized
cttagtcatagtccactgga

SEQ ID NO: 329411 - DNA, 20 bp, Artificial Sequence
  chemically synthesized
agtctttatgatccatccag

SEQ ID NO: 329412 - DNA, 20 bp, Artificial Sequence
  chemically synthesized
attagtctttatgatccatc

SEQ ID NO: 329413 - DNA, 20 bp, Artificial Sequence
  chemically synthesized
agtccactggatggatcata

SEQ ID NO: 329414 - DNA, 20 bp, Artificial Sequence
  chemically synthesized
ggatcataaagactaattga

SEQ ID NO: 329415 - DNA, 20 bp, Artificial Sequence
  chemically synthesized
gatcataaagactaattgaa

SEQ ID NO: 329416 - DNA, 20 bp, Artificial Sequence
  chemically synthesized
atcataaagactaattgaaa

SEQ ID NO: 329417 - DNA, 20 bp, Artificial Sequence
  chemically synthesized
gattagcagtccctttcaat

SEQ ID NO: 329418 - DNA, 20 bp, Artificial Sequence
  chemically synthesized
tgggatatctgggtgattag

SEQ ID NO: 329419 - DNA, 20 bp, Artificial Sequence
  chemically synthesized
gaaagggactgctaatcacc

SEQ ID NO: 329420 - DNA, 20 bp, Artificial Sequence
  chemically synthesized
ggttgggatatctgggtgat

SEQ ID NO: 329421 - DNA, 20 bp, Artificial Sequence
  chemically synthesized
gctccaaggttgggatatct

SEQ ID NO: 329422 - DNA, 20 bp, Artificial Sequence
  chemically synthesized
agctccaaggttgggatatc

SEQ ID NO: 329423 - DNA, 20 bp, Artificial Sequence
  chemically synthesized
tcacccagatatcccaacct

SEQ ID NO: 329424 - DNA, 20 bp, Artificial Sequence
  chemically synthesized
acccagatatcccaaccttg

SEQ ID NO: 329425 - DNA, 20 bp, Artificial Sequence
  chemically synthesized
ttgcattcagctccaaggtt

SEQ ID NO: 329426 - DNA, 20 bp, Artificial Sequence
  chemically synthesized
attgcattcagctccaaggt

SEQ ID NO: 329427 - DNA, 20 bp, Artificial Sequence
  chemically synthesized
agtgattgcattcagctcca

SEQ ID NO: 329428 - DNA, 20 bp, Artificial Sequence
  chemically synthesized
cagtgattgcattcagctcc

SEQ ID NO: 329429 - DNA, 20 bp, Artificial Sequence
  chemically synthesized
cattatccagtgattgcatt

SEQ ID NO: 329430 - DNA, 20 bp, Artificial Sequence
  chemically synthesized
ttggagctgaatgcaatcac

SEQ ID NO: 329431 - DNA, 20 bp, Artificial Sequence
  chemically synthesized
agcaagtataaaacattatc

SEQ ID NO: 329432 - DNA, 20 bp, Artificial Sequence
  chemically synthesized
tcagactcctcaaaaagagc

SEQ ID NO: 329433 - DNA, 20 bp, Artificial Sequence
  chemically synthesized
gttttatacttgctcttttt

SEQ ID NO: 329434 - DNA, 20 bp, Artificial Sequence
  chemically synthesized
ttttatacttgctctttttg

SEQ ID NO: 329435 - DNA, 20 bp, Artificial Sequence
  chemically synthesized
atgctcagactcctcaaaaa

SEQ ID NO: 329436 - DNA, 20 bp, Artificial Sequence
  chemically synthesized
ttatacttgctctttttgag

SEQ ID NO: 329437 - DNA, 20 bp, Artificial Sequence
  chemically synthesized
agatgctcagactcctcaaa

SEQ ID NO: 329438 - DNA, 20 bp, Artificial Sequence
  chemically synthesized
ttgctctttttgaggagtct

SEQ ID NO: 329439 - DNA, 20 bp, Artificial Sequence
  chemically synthesized
tattcactttcaaagatgct

SEQ ID NO: 329440 - DNA, 20 bp, Artificial Sequence
  chemically synthesized
aggagtctgagcatctttga

SEQ ID NO: 329441 - DNA, 20 bp, Artificial Sequence
  chemically synthesized
atagcatatattcactttca

SEQ ID NO: 329442 - DNA, 20 bp, Artificial Sequence
  chemically synthesized
gaaagtgaatatatgctatg

SEQ ID NO: 329443 - DNA, 20 bp, Artificial Sequence
  chemically synthesized
aaagtgaatatatgctatga

SEQ ID NO: 329444 - DNA, 20 bp, Artificial Sequence
  chemically synthesized
aagtgaatatatgctatgaa

SEQ ID NO: 329445 - DNA, 20 bp, Artificial Sequence
  chemically synthesized
acattgctatacacccttca

SEQ ID NO: 329446 - DNA, 20 bp, Artificial Sequence
  chemically synthesized
tatatgctatgaagggtgta

SEQ ID NO: 329447 - DNA, 20 bp, Artificial Sequence
  chemically synthesized
tgaagggtgtatagcaatgt

SEQ ID NO: 329448 - DNA, 20 bp, Artificial Sequence
  chemically synthesized
atagcaatgttggatattca

SEQ ID NO: 329449 - DNA, 20 bp, Artificial Sequence
  chemically synthesized
agcaatgttggatattcaaa

SEQ ID NO: 329450 - DNA, 20 bp, Artificial Sequence
  chemically synthesized
gcaatgttggatattcaaag

SEQ ID NO: 329451 - DNA, 20 bp, Artificial Sequence
  chemically synthesized
aatgttggatattcaaagag

SEQ ID NO: 329452 - DNA, 20 bp, Artificial Sequence
  chemically synthesized
atgttggatattcaaagagg

SEQ ID NO: 329453 - DNA, 20 bp, Artificial Sequence
  chemically synthesized
atattcaaagaggaggactg

SEQ ID NO: 329454 - DNA, 20 bp, Artificial Sequence
  chemically synthesized
tcaaagaggaggactgtagt

SEQ ID NO: 329455 - DNA, 20 bp, Artificial Sequence
  chemically synthesized
tataattgcagtgcttacta

SEQ ID NO: 329456 - DNA, 20 bp, Artificial Sequence
  chemically synthesized
ggatattgactgtataattg

SEQ ID NO: 329457 - DNA, 20 bp, Artificial Sequence
  chemically synthesized
tagtaagcactgcaattata

SEQ ID NO: 329458 - DNA, 20 bp, Artificial Sequence
  chemically synthesized
gccatcagagagtagaagaa

SEQ ID NO: 329459 - DNA, 20 bp, Artificial Sequence
  chemically synthesized
tgccatcagagagtagaaga

SEQ ID NO: 329460 - DNA, 20 bp, Artificial Sequence
  chemically synthesized
actgtgccatcagagagtag

SEQ ID NO: 329461 - DNA, 20 bp, Artificial Sequence
  chemically synthesized
gctactgtgccatcagagag

SEQ ID NO: 329462 - DNA, 20 bp, Artificial Sequence
  chemically synthesized
tcctttcttctactctctga

SEQ ID NO: 329463 - DNA, 20 bp, Artificial Sequence
  chemically synthesized
caggctactgtgccatcaga

SEQ ID NO: 329464 - DNA, 20 bp, Artificial Sequence
  chemically synthesized
accaggctactgtgccatca

SEQ ID NO: 329465 - DNA, 20 bp, Artificial Sequence
  chemically synthesized
tcttctactctctgatggca

SEQ ID NO: 329466 - DNA, 20 bp, Artificial Sequence
  chemically synthesized
tcaccaggctactgtgccat

SEQ ID NO: 329467 - DNA, 20 bp, Artificial Sequence
  chemically synthesized
tctactctctgatggcacag

SEQ ID NO: 329468 - DNA, 20 bp, Artificial Sequence
  chemically synthesized
tctctgatggcacagtagcc

SEQ ID NO: 329469 - DNA, 20 bp, Artificial Sequence
  chemically synthesized
ggcacagtagcctggtgatt

SEQ ID NO: 329470 - DNA, 20 bp, Artificial Sequence
  chemically synthesized
acaatgctttccaaatcacc

SEQ ID NO: 329471 - DNA, 20 bp, Artificial Sequence
  chemically synthesized
aacaatgctttccaaatcac

SEQ ID NO: 329472 - DNA, 20 bp, Artificial Sequence
  chemically synthesized
cagtagcctggtgatttgga

SEQ ID NO: 329473 - DNA, 20 bp, Artificial Sequence
  chemically synthesized
gaaagcattgttattactct

SEQ ID NO: 329474 - DNA, 20 bp, Artificial Sequence
  chemically synthesized
attgttattactctcagttc

SEQ ID NO: 329475 - DNA, 20 bp, Artificial Sequence
  chemically synthesized
gagcgcatatctagaactga

SEQ ID NO: 329476 - DNA, 20 bp, Artificial Sequence
  chemically synthesized
ccgagcgcatatctagaact

SEQ ID NO: 329477 - DNA, 20 bp, Artificial Sequence
  chemically synthesized
acaaaaaccgagcgcatatc

SEQ ID NO: 329478 - DNA, 20 bp, Artificial Sequence
  chemically synthesized
ctcagttctagatatgcgct

SEQ ID NO: 329479 - DNA, 20 bp, Artificial Sequence
  chemically synthesized
acttggcttgcacaaaaacc

SEQ ID NO: 329480 - DNA, 20 bp, Artificial Sequence
  chemically synthesized
tatgcgctcggtttttgtgc

SEQ ID NO: 329481 - DNA, 20 bp, Artificial Sequence
  chemically synthesized
gctcggtttttgtgcaagcc

SEQ ID NO: 329482 - DNA, 20 bp, Artificial Sequence
  chemically synthesized
cggtttttgtgcaagccaag

SEQ ID NO: 329483 - DNA, 20 bp, Artificial Sequence
  chemically synthesized
ggtttttgtgcaagccaagt

SEQ ID NO: 329484 - DNA, 20 bp, Artificial Sequence
  chemically synthesized
gtacatagcagtatcccact

SEQ ID NO: 329485 - DNA, 20 bp, Artificial Sequence
  chemically synthesized
ccctgaagcaaagtacatag

SEQ ID NO: 329486 - DNA, 20 bp, Artificial Sequence
  chemically synthesized
cctccctgaagcaaagtaca

SEQ ID NO: 329487 - DNA, 20 bp, Artificial Sequence
  chemically synthesized
tactgctatgtactttgctt

SEQ ID NO: 329488 - DNA, 20 bp, Artificial Sequence
  chemically synthesized
actgctatgtactttgcttc

SEQ ID NO: 329489 - DNA, 20 bp, Artificial Sequence
  chemically synthesized
ctgctatgtactttgcttca

SEQ ID NO: 329490 - DNA, 20 bp, Artificial Sequence
  chemically synthesized
ctgaacacctccctgaagca

SEQ ID NO: 329491 - DNA, 20 bp, Artificial Sequence
  chemically synthesized
gctatgtactttgcttcagg

SEQ ID NO: 329492 - DNA, 20 bp, Artificial Sequence
  chemically synthesized
ctatgtactttgcttcaggg

SEQ ID NO: 329493 - DNA, 20 bp, Artificial Sequence
  chemically synthesized
ctggcctgaacacctccctg

SEQ ID NO: 329494 - DNA, 20 bp, Artificial Sequence
  chemically synthesized
ctttgcttcagggaggtgtt

SEQ ID NO: 329495 - DNA, 20 bp, Artificial Sequence
  chemically synthesized
tttgcttcagggaggtgttc

SEQ ID NO: 329496 - DNA, 20 bp, Artificial Sequence
  chemically synthesized
cttcagggaggtgttcaggc

SEQ ID NO: 329497 - DNA, 20 bp, Artificial Sequence
  chemically synthesized
ttcagggaggtgttcaggcc

SEQ ID NO: 329498 - DNA, 20 bp, Artificial Sequence
  chemically synthesized
aaactcttagatcatatgcc

SEQ ID NO: 329499 - DNA, 20 bp, Artificial Sequence
  chemically synthesized
tcaggccaggcatatgatct

SEQ ID NO: 329500 - DNA, 20 bp, Artificial Sequence
  chemically synthesized
aggccaggcatatgatctaa

SEQ ID NO: 329501 - DNA, 20 bp, Artificial Sequence
  chemically synthesized
tctctctgcttggaaactct

SEQ ID NO: 329502 - DNA, 20 bp, Artificial Sequence
  chemically synthesized
catatgatctaagagtttcc

SEQ ID NO: 329503 - DNA, 20 bp, Artificial Sequence
  chemically synthesized
atgatctaagagtttccaag

SEQ ID NO: 329504 - DNA, 20 bp, Artificial Sequence
  chemically synthesized
gatctaagagtttccaagca

SEQ ID NO: 329505 - DNA, 20 bp, Artificial Sequence
  chemically synthesized
tctaagagtttccaagcaga

SEQ ID NO: 329506 - DNA, 20 bp, Artificial Sequence
  chemically synthesized
ggtctgagtttctctctgct

SEQ ID NO: 329507 - DNA, 20 bp, Artificial Sequence
  chemically synthesized
tttccaagcagagagaaact

SEQ ID NO: 329508 - DNA, 20 bp, Artificial Sequence
  chemically synthesized
aaataggaaacaaaaggtct

SEQ ID NO: 329509 - DNA, 20 bp, Artificial Sequence
  chemically synthesized
ttacccaaataggaaacaaa

SEQ ID NO: 329510 - DNA, 20 bp, Artificial Sequence
  chemically synthesized
tttacccaaataggaaacaa

SEQ ID NO: 329511 - DNA, 20 bp, Artificial Sequence
  chemically synthesized
cagaccttttgtttcctatt

SEQ ID NO: 329512 - DNA, 20 bp, Artificial Sequence
  chemically synthesized
agaccttttgtttcctattt

SEQ ID NO: 329513 - DNA, 20 bp, Artificial Sequence
  chemically synthesized
gaatatatctttacccaaat

SEQ ID NO: 329514 - DNA, 20 bp, Artificial Sequence
  chemically synthesized
agaatatatctttacccaaa

SEQ ID NO: 329515 - DNA, 20 bp, Artificial Sequence
  chemically synthesized
ttttgtttcctatttgggta

SEQ ID NO: 329516 - DNA, 20 bp, Artificial Sequence
  chemically synthesized
aaagatatattctttacatt

SEQ ID NO: 329517 - DNA, 20 bp, Artificial Sequence
  chemically synthesized
cttgtttacagctaaatgta

SEQ ID NO: 329518 - DNA, 20 bp, Artificial Sequence
  chemically synthesized
ctttacatttagctgtaaac

SEQ ID NO: 329519 - DNA, 20 bp, Artificial Sequence
  chemically synthesized
tttacatttagctgtaaaca

SEQ ID NO: 329520 - DNA, 20 bp, Artificial Sequence
  chemically synthesized
ttacatttagctgtaaacaa

SEQ ID NO: 329521 - DNA, 20 bp, Artificial Sequence
  chemically synthesized
aaactcttttcccttgttta

SEQ ID NO: 329522 - DNA, 20 bp, Artificial Sequence
  chemically synthesized
tttagctgtaaacaagggaa

SEQ ID NO: 329523 - DNA, 20 bp, Artificial Sequence
  chemically synthesized
tagctgtaaacaagggaaaa

SEQ ID NO: 329524 - DNA, 20 bp, Artificial Sequence
  chemically synthesized
aacaagggaaaagagtttcc

SEQ ID NO: 329525 - DNA, 20 bp, Artificial Sequence
  chemically synthesized
cggcttccctcagcagatct

SEQ ID NO: 329526 - DNA, 20 bp, Artificial Sequence
  chemically synthesized
aagagtttccaagatctgct

SEQ ID NO: 329527 - DNA, 20 bp, Artificial Sequence
  chemically synthesized
agagtttccaagatctgctg

SEQ ID NO: 329528 - DNA, 20 bp, Artificial Sequence
  chemically synthesized
gagtttccaagatctgctga

SEQ ID NO: 329529 - DNA, 20 bp, Artificial Sequence
  chemically synthesized
tttccaagatctgctgaggg

SEQ ID NO: 329530 - DNA, 20 bp, Artificial Sequence
  chemically synthesized
tacagaccggcttccctcag

SEQ ID NO: 329531 - DNA, 20 bp, Artificial Sequence
  chemically synthesized
tcatacagaccggcttccct

SEQ ID NO: 329532 - DNA, 20 bp, Artificial Sequence
  chemically synthesized
caagatctgctgagggaagc

SEQ ID NO: 329533 - DNA, 20 bp, Artificial Sequence
  chemically synthesized
cttttcgaactcatacagac

SEQ ID NO: 329534 - DNA, 20 bp, Artificial Sequence
  chemically synthesized
tgagggaagccggtctgtat

SEQ ID NO: 329535 - DNA, 20 bp, Artificial Sequence
  chemically synthesized
cataacttttcgaactcata

SEQ ID NO: 329536 - DNA, 20 bp, Artificial Sequence
  chemically synthesized
ccggtctgtatgagttcgaa

SEQ ID NO: 329537 - DNA, 20 bp, Artificial Sequence
  chemically synthesized
tgtatgagttcgaaaagtta

SEQ ID NO: 329538 - DNA, 20 bp, Artificial Sequence
  chemically synthesized
tatgagttcgaaaagttatg

SEQ ID NO: 329539 - DNA, 20 bp, Artificial Sequence
  chemically synthesized
atgagttcgaaaagttatgg

SEQ ID NO: 329540 - DNA, 20 bp, Artificial Sequence
  chemically synthesized
tgagttcgaaaagttatgga

SEQ ID NO: 329541 - DNA, 20 bp, Artificial Sequence
  chemically synthesized
gttcgaaaagttatggaggg

SEQ ID NO: 329542 - DNA, 20 bp, Artificial Sequence
  chemically synthesized
ttcgaaaagttatggagggt

SEQ ID NO: 329543 - DNA, 20 bp, Artificial Sequence
  chemically synthesized
aaagttatggagggtaggct

SEQ ID NO: 329544 - DNA, 20 bp, Artificial Sequence
  chemically synthesized
ggagggtaggcttagattaa

SEQ ID NO: 329545 - DNA, 20 bp, Artificial Sequence
  chemically synthesized
ctttgcttctctgttaatct

SEQ ID NO: 329546 - DNA, 20 bp, Artificial Sequence
  chemically synthesized
agggtaggcttagattaaca

SEQ ID NO: 329547 - DNA, 20 bp, Artificial Sequence
  chemically synthesized
gtaggcttagattaacagag

SEQ ID NO: 329548 - DNA, 20 bp, Artificial Sequence
  chemically synthesized
cttagattaacagagaagca

SEQ ID NO: 329549 - DNA, 20 bp, Artificial Sequence
  chemically synthesized
tttattatggatttaaggag

SEQ ID NO: 329550 - DNA, 20 bp, Artificial Sequence
  chemically synthesized
agttttattatggatttaag

SEQ ID NO: 329551 - DNA, 20 bp, Artificial Sequence
  chemically synthesized
agagttttattatggattta

SEQ ID NO: 329552 - DNA, 20 bp, Artificial Sequence
  chemically synthesized
cagagttttattatggattt

SEQ ID NO: 329553 - DNA, 20 bp, Artificial Sequence
  chemically synthesized
tttaatacagagttttatta

SEQ ID NO: 329554 - DNA, 20 bp, Artificial Sequence
  chemically synthesized
ttgctcaagggtttaataca

SEQ ID NO: 329555 - DNA, 20 bp, Artificial Sequence
  chemically synthesized
gtttgctcaagggtttaata

SEQ ID NO: 329556 - DNA, 20 bp, Artificial Sequence
  chemically synthesized
aaactctgtattaaaccctt

SEQ ID NO: 329557 - DNA, 20 bp, Artificial Sequence
  chemically synthesized
agagttcaaggtttgctcaa

SEQ ID NO: 329558 - DNA, 20 bp, Artificial Sequence
  chemically synthesized
aagagttcaaggtttgctca

SEQ ID NO: 329559 - DNA, 20 bp, Artificial Sequence
  chemically synthesized
aaagagttcaaggtttgctc

SEQ ID NO: 329560 - DNA, 20 bp, Artificial Sequence
  chemically synthesized
ttggctaagtaaagagttca

SEQ ID NO: 329561 - DNA, 20 bp, Artificial Sequence
  chemically synthesized
gttggctaagtaaagagttc

SEQ ID NO: 329562 - DNA, 20 bp, Artificial Sequence
  chemically synthesized
caaaccttgaactctttact

SEQ ID NO: 329563 - DNA, 20 bp, Artificial Sequence
  chemically synthesized
gaatttgttggctaagtaaa

SEQ ID NO: 329564 - DNA, 20 bp, Artificial Sequence
  chemically synthesized
gagaatttgttggctaagta

SEQ ID NO: 329565 - DNA, 20 bp, Artificial Sequence
  chemically synthesized
acaaagagaatttgttggct

SEQ ID NO: 329566 - DNA, 20 bp, Artificial Sequence
  chemically synthesized
aagatacaaagagaatttgt

SEQ ID NO: 329567 - DNA, 20 bp, Artificial Sequence
  chemically synthesized
aaatgtactcaagatacaaa

SEQ ID NO: 329568 - DNA, 20 bp, Artificial Sequence
  chemically synthesized
tcaaatgtactcaagataca

SEQ ID NO: 329569 - DNA, 20 bp, Artificial Sequence
  chemically synthesized
acaaattctctttgtatctt

SEQ ID NO: 329570 - DNA, 20 bp, Artificial Sequence
  chemically synthesized
gcttggtttcaaatgtactc

SEQ ID NO: 329571 - DNA, 20 bp, Artificial Sequence
  chemically synthesized
tcttgagtacatttgaaacc

SEQ ID NO: 329572 - DNA, 20 bp, Artificial Sequence
  chemically synthesized
cctgtattatttaggatgct

SEQ ID NO: 329573 - DNA, 20 bp, Artificial Sequence
  chemically synthesized
tattatatcctgtattattt

SEQ ID NO: 329574 - DNA, 20 bp, Artificial Sequence
  chemically synthesized
accaagcatcctaaataata

SEQ ID NO: 329575 - DNA, 20 bp, Artificial Sequence
  chemically synthesized
ctattatatcctgtattatt

SEQ ID NO: 329576 - DNA, 20 bp, Artificial Sequence
  chemically synthesized
ccaagcatcctaaataatac

SEQ ID NO: 329577 - DNA, 20 bp, Artificial Sequence
  chemically synthesized
ctaaataatacaggatataa

SEQ ID NO: 329578 - DNA, 20 bp, Artificial Sequence
  chemically synthesized
taagttgatgaagaacatta

SEQ ID NO: 329579 - DNA, 20 bp, Artificial Sequence
  chemically synthesized
aaggatttattaagttgatg

SEQ ID NO: 329580 - DNA, 20 bp, Artificial Sequence
  chemically synthesized
tgattatttaaggatttatt

SEQ ID NO: 329581 - DNA, 20 bp, Artificial Sequence
  chemically synthesized
gaatgattgttgattattta

SEQ ID NO: 329582 - DNA, 20 bp, Artificial Sequence
  chemically synthesized
agaatgattgttgattattt

SEQ ID NO: 329583 - DNA, 20 bp, Artificial Sequence
  chemically synthesized
aagatgatataagtacatat

SEQ ID NO: 329584 - DNA, 20 bp, Artificial Sequence
  chemically synthesized
ttcggcactgaagatgatat

SEQ ID NO: 329585 - DNA, 20 bp, Artificial Sequence
  chemically synthesized
atatgtacttatatcatctt

SEQ ID NO: 329586 - DNA, 20 bp, Artificial Sequence
  chemically synthesized
aatcagaacattcggcactg

SEQ ID NO: 329587 - DNA, 20 bp, Artificial Sequence
  chemically synthesized
gaatttgaaatcagaacatt

SEQ ID NO: 329588 - DNA, 20 bp, Artificial Sequence
  chemically synthesized
ttgaacattgaatttgaaat

SEQ ID NO: 329589 - DNA, 20 bp, Artificial Sequence
  chemically synthesized
aaattcaatgttcaattgct

SEQ ID NO: 329590 - DNA, 20 bp, Artificial Sequence
  chemically synthesized
ttaactagatttggtgaact

SEQ ID NO: 329591 - DNA, 20 bp, Artificial Sequence
  chemically synthesized
attgctcagttcaccaaatc

SEQ ID NO: 329592 - DNA, 20 bp, Artificial Sequence
  chemically synthesized
taacagcaattaactagatt

SEQ ID NO: 329593 - DNA, 20 bp, Artificial Sequence
  chemically synthesized
tttgactaacagcaattaac

SEQ ID NO: 329594 - DNA, 20 bp, Artificial Sequence
  chemically synthesized
caaatctagttaattgctgt

SEQ ID NO: 329595 - DNA, 20 bp, Artificial Sequence
  chemically synthesized
tgagaatgctttttgactaa

SEQ ID NO: 329596 - DNA, 20 bp, Artificial Sequence
  chemically synthesized
gttaattgctgttagtcaaa

SEQ ID NO: 329597 - DNA, 20 bp, Artificial Sequence
  chemically synthesized
atagcatcagtgtcattaat

SEQ ID NO: 329598 - DNA, 20 bp, Artificial Sequence
  chemically synthesized
cattttattgataatagcat

SEQ ID NO: 329599 - DNA, 20 bp, Artificial Sequence
  chemically synthesized
tgactccattttattgataa

SEQ ID NO: 329600 - DNA, 20 bp, Artificial Sequence
  chemically synthesized
tgatgctattatcaataaaa

SEQ ID NO: 329601 - DNA, 20 bp, Artificial Sequence
  chemically synthesized
atgctattatcaataaaatg

SEQ ID NO: 329602 - DNA, 20 bp, Artificial Sequence
  chemically synthesized
aaaatggagtcattttgaat

SEQ ID NO: 329603 - DNA, 20 bp, Artificial Sequence
  chemically synthesized
aaaaattccatttgatgaat

SEQ ID NO: 329604 - DNA, 20 bp, Artificial Sequence
  chemically synthesized
tggtttgcttattcatcaaa

SEQ ID NO: 329605 - DNA, 20 bp, Artificial Sequence
  chemically synthesized
tattcatcaaatggaatttt

SEQ ID NO: 329606 - DNA, 20 bp, Artificial Sequence
  chemically synthesized
catcaaatggaatttttaga

SEQ ID NO: 329607 - DNA, 20 bp, Artificial Sequence
  chemically synthesized
atcaaatggaatttttagaa

SEQ ID NO: 329608 - DNA, 20 bp, Artificial Sequence
  chemically synthesized
tttggcatcctagttgtagt

SEQ ID NO: 329609 - DNA, 20 bp, Artificial Sequence
  chemically synthesized
atgtattatcttactacaac

SEQ ID NO: 329610 - DNA, 20 bp, Artificial Sequence
  chemically synthesized
tgtattatcttactacaact

SEQ ID NO: 329611 - DNA, 20 bp, Artificial Sequence
  chemically synthesized
cccatttggcatcctagttg

SEQ ID NO: 329612 - DNA, 20 bp, Artificial Sequence
  chemically synthesized
taaattcccatttggcatcc

SEQ ID NO: 329613 - DNA, 20 bp, Artificial Sequence
  chemically synthesized
actacaactaggatgccaaa

SEQ ID NO: 329614 - DNA, 20 bp, Artificial Sequence
  chemically synthesized
ctacaactaggatgccaaat

SEQ ID NO: 329615 - DNA, 20 bp, Artificial Sequence
  chemically synthesized
tggtgcattaaattcccatt

SEQ ID NO: 329616 - DNA, 20 bp, Artificial Sequence
  chemically synthesized
atagcaagcctgtgaaaaaa

SEQ ID NO: 329617 - DNA, 20 bp, Artificial Sequence
  chemically synthesized
tttaatgcaccattttttca

SEQ ID NO: 329618 - DNA, 20 bp, Artificial Sequence
  chemically synthesized
ttaatgcaccattttttcac

SEQ ID NO: 329619 - DNA, 20 bp, Artificial Sequence
  chemically synthesized
taaagattctgatttatagc

SEQ ID NO: 329620 - DNA, 20 bp, Artificial Sequence
  chemically synthesized
ttcacaggcttgctataaat

SEQ ID NO: 329621 - DNA, 20 bp, Artificial Sequence
  chemically synthesized
gttttaaagattctgattta

SEQ ID NO: 329622 - DNA, 20 bp, Artificial Sequence
  chemically synthesized
aattggagagaaatgtttta

SEQ ID NO: 329623 - DNA, 20 bp, Artificial Sequence
  chemically synthesized
gtggaagagagagaattgga

SEQ ID NO: 329624 - DNA, 20 bp, Artificial Sequence
  chemically synthesized
gagtggaagagagagaattg

SEQ ID NO: 329625 - DNA, 20 bp, Artificial Sequence
  chemically synthesized
aggagtggaagagagagaat

SEQ ID NO: 329626 - DNA, 20 bp, Artificial Sequence
  chemically synthesized
tctttcaggagtggaagaga

SEQ ID NO: 329627 - DNA, 20 bp, Artificial Sequence
  chemically synthesized
tctctttcaggagtggaaga

SEQ ID NO: 329628 - DNA, 20 bp, Artificial Sequence
  chemically synthesized
catctctttcaggagtggaa

SEQ ID NO: 329629 - DNA, 20 bp, Artificial Sequence
  chemically synthesized
accatctctttcaggagtgg

SEQ ID NO: 329630 - DNA, 20 bp, Artificial Sequence
  chemically synthesized
tctctctcttccactcctga

SEQ ID NO: 329631 - DNA, 20 bp, Artificial Sequence
  chemically synthesized
attaccatctctttcaggag

SEQ ID NO: 329632 - DNA, 20 bp, Artificial Sequence
  chemically synthesized
tctctcttccactcctgaaa

SEQ ID NO: 329633 - DNA, 20 bp, Artificial Sequence
  chemically synthesized
gatattaccatctctttcag

SEQ ID NO: 329634 - DNA, 20 bp, Artificial Sequence
  chemically synthesized
atgatattaccatctctttc

SEQ ID NO: 329635 - DNA, 20 bp, Artificial Sequence
  chemically synthesized
tcttccactcctgaaagaga

SEQ ID NO: 329636 - DNA, 20 bp, Artificial Sequence
  chemically synthesized
gatgatattaccatctcttt

SEQ ID NO: 329637 - DNA, 20 bp, Artificial Sequence
  chemically synthesized
ttttttccttgaaagagatt

SEQ ID NO: 329638 - DNA, 20 bp, Artificial Sequence
  chemically synthesized
atatcatctgaatctctttc

SEQ ID NO: 329639 - DNA, 20 bp, Artificial Sequence
  chemically synthesized
tatcatctgaatctctttca

SEQ ID NO: 329640 - DNA, 20 bp, Artificial Sequence
  chemically synthesized
ttaatcttttttccttgaaa

SEQ ID NO: 329641 - DNA, 20 bp, Artificial Sequence
  chemically synthesized
cattaatcttttttccttga

SEQ ID NO: 329642 - DNA, 20 bp, Artificial Sequence
  chemically synthesized
tgaatctctttcaaggaaaa

SEQ ID NO: 329643 - DNA, 20 bp, Artificial Sequence
  chemically synthesized
tcaaggaaaaaagattaatg

SEQ ID NO: 329644 - DNA, 20 bp, Artificial Sequence
  chemically synthesized
ttaatgaagtcatctgttga

SEQ ID NO: 329645 - DNA, 20 bp, Artificial Sequence
  chemically synthesized
attgctgtgaaatctatcaa

SEQ ID NO: 329646 - DNA, 20 bp, Artificial Sequence
  chemically synthesized
tcatctgttgatagatttca

SEQ ID NO: 329647 - DNA, 20 bp, Artificial Sequence
  chemically synthesized
tttgggaactggtaatgagg

SEQ ID NO: 329648 - DNA, 20 bp, Artificial Sequence
  chemically synthesized
caattattcttcctcattac

SEQ ID NO: 329649 - DNA, 20 bp, Artificial Sequence
  chemically synthesized
aagtttgggaactggtaatg

SEQ ID NO: 329650 - DNA, 20 bp, Artificial Sequence
  chemically synthesized
gaagtttgggaactggtaat

SEQ ID NO: 329651 - DNA, 20 bp, Artificial Sequence
  chemically synthesized
gaaaggtgaagtttgggaac

SEQ ID NO: 329652 - DNA, 20 bp, Artificial Sequence
  chemically synthesized
taaaatgaaaggtgaagttt

SEQ ID NO: 329653 - DNA, 20 bp, Artificial Sequence
  chemically synthesized
ataaaatgaaaggtgaagtt

SEQ ID NO: 329654 - DNA, 20 bp, Artificial Sequence
  chemically synthesized
actttataaaatgaaaggtg

SEQ ID NO: 329655 - DNA, 20 bp, Artificial Sequence
  chemically synthesized
aggttactttataaaatgaa

SEQ ID NO: 329656 - DNA, 20 bp, Artificial Sequence
  chemically synthesized
aaggttactttataaaatga

SEQ ID NO: 329657 - DNA, 20 bp, Artificial Sequence
  chemically synthesized
acttcacctttcattttata

SEQ ID NO: 329658 - DNA, 20 bp, Artificial Sequence
  chemically synthesized
tacaggcaggtttaaaataa

SEQ ID NO: 329659 - DNA, 20 bp, Artificial Sequence
  chemically synthesized
atacaggcaggtttaaaata

SEQ ID NO: 329660 - DNA, 20 bp, Artificial Sequence
  chemically synthesized
taagaaggtaaaatacaggc

SEQ ID NO: 329661 - DNA, 20 bp, Artificial Sequence
  chemically synthesized
ataagaaggtaaaatacagg

SEQ ID NO: 329662 - DNA, 20 bp, Artificial Sequence
  chemically synthesized
aaaataagaaggtaaaatac

SEQ ID NO: 329663 - DNA, 20 bp, Artificial Sequence
  chemically synthesized
gaaaataagaaggtaaaata

SEQ ID NO: 329664 - DNA, 20 bp, Artificial Sequence
  chemically synthesized
caggcaaccagaaaataaga

SEQ ID NO: 329665 - DNA, 20 bp, Artificial Sequence
  chemically synthesized
tcaggcaaccagaaaataag

SEQ ID NO: 329666 - DNA, 20 bp, Artificial Sequence
  chemically synthesized
tattttaccttcttattttc

SEQ ID NO: 329667 - DNA, 20 bp, Artificial Sequence
  chemically synthesized
aaatcaggcaaccagaaaat

SEQ ID NO: 329668 - DNA, 20 bp, Artificial Sequence
  chemically synthesized
caaattataaatcaggcaac

SEQ ID NO: 329669 - DNA, 20 bp, Artificial Sequence
  chemically synthesized
ataatgacaaattataaatc

SEQ ID NO: 329670 - DNA, 20 bp, Artificial Sequence
  chemically synthesized
tataatgacaaattataaat

SEQ ID NO: 329671 - DNA, 20 bp, Artificial Sequence
  chemically synthesized
ctaaaagtggatgaatatat

SEQ ID NO: 329672 - DNA, 20 bp, Artificial Sequence
  chemically synthesized
cttatatattcatccacttt

SEQ ID NO: 329673 - DNA, 20 bp, Artificial Sequence
  chemically synthesized
acttcatgatttactaaaag

SEQ ID NO: 329674 - DNA, 20 bp, Artificial Sequence
  chemically synthesized
cacacttcatgatttactaa

SEQ ID NO: 329675 - DNA, 20 bp, Artificial Sequence
  chemically synthesized
tccacttttagtaaatcatg

SEQ ID NO: 329676 - DNA, 20 bp, Artificial Sequence
  chemically synthesized
aaatcatgaagtgtgtgcat

SEQ ID NO: 329677 - DNA, 20 bp, Artificial Sequence
  chemically synthesized
ctatcattagaggaaaggtt

SEQ ID NO: 329678 - DNA, 20 bp, Artificial Sequence
  chemically synthesized
gctatcattagaggaaaggt

SEQ ID NO: 329679 - DNA, 20 bp, Artificial Sequence
  chemically synthesized
tgaagctatcattagaggaa

SEQ ID NO: 329680 - DNA, 20 bp, Artificial Sequence
  chemically synthesized
atgaagctatcattagagga

SEQ ID NO: 329681 - DNA, 20 bp, Artificial Sequence
  chemically synthesized
cccaacctttcctctaatga

SEQ ID NO: 329682 - DNA, 20 bp, Artificial Sequence
  chemically synthesized
ctttatgaagctatcattag

SEQ ID NO: 329683 - DNA, 20 bp, Artificial Sequence
  chemically synthesized
gctttatgaagctatcatta

SEQ ID NO: 329684 - DNA, 20 bp, Artificial Sequence
  chemically synthesized
gagctttatgaagctatcat

SEQ ID NO: 329685 - DNA, 20 bp, Artificial Sequence
  chemically synthesized
cctctaatgatagcttcata

SEQ ID NO: 329686 - DNA, 20 bp, Artificial Sequence
  chemically synthesized
acacaacatagagctttatg

SEQ ID NO: 329687 - DNA, 20 bp, Artificial Sequence
  chemically synthesized
tgctaaaatgacacaacata

SEQ ID NO: 329688 - DNA, 20 bp, Artificial Sequence
  chemically synthesized
tatgctaaaatgacacaaca

SEQ ID NO: 329689 - DNA, 20 bp, Artificial Sequence
  chemically synthesized
agctctatgttgtgtcattt

SEQ ID NO: 329690 - DNA, 20 bp, Artificial Sequence
  chemically synthesized
tgttgtgtcattttagcata

SEQ ID NO: 329691 - DNA, 20 bp, Artificial Sequence
  chemically synthesized
gttgtgtcattttagcatac

SEQ ID NO: 329692 - DNA, 20 bp, Artificial Sequence
  chemically synthesized
cattttagcatacaggttaa

SEQ ID NO: 329693 - DNA, 20 bp, Artificial Sequence
  chemically synthesized
caggttaatagaatcaattc

SEQ ID NO: 329694 - DNA, 20 bp, Artificial Sequence
  chemically synthesized
aatagaatcaattctggaat

SEQ ID NO: 329695 - DNA, 20 bp, Artificial Sequence
  chemically synthesized
acacacacacaatctcattc

SEQ ID NO: 329696 - DNA, 20 bp, Artificial Sequence
  chemically synthesized
ttgtgtgtgtgttcaaatcc

SEQ ID NO: 329697 - DNA, 20 bp, Artificial Sequence
  chemically synthesized
tgtgtgttcaaatcctggca

SEQ ID NO: 329698 - DNA, 20 bp, Artificial Sequence
  chemically synthesized
acatgaaaagcagctgtgcc

SEQ ID NO: 329699 - DNA, 20 bp, Artificial Sequence
  chemically synthesized
cacatgaaaagcagctgtgc

SEQ ID NO: 329700 - DNA, 20 bp, Artificial Sequence
  chemically synthesized
acagttatgcacatgaaaag

SEQ ID NO: 329701 - DNA, 20 bp, Artificial Sequence
  chemically synthesized
tgcacagttatgcacatgaa

SEQ ID NO: 329702 - DNA, 20 bp, Artificial Sequence
  chemically synthesized
ttcatgtgcataactgtgca

SEQ ID NO: 329703 - DNA, 20 bp, Artificial Sequence
  chemically synthesized
ctggttaagaaatctgtgca

SEQ ID NO: 329704 - DNA, 20 bp, Artificial Sequence
  chemically synthesized
ctgtgcacagatttcttaac

SEQ ID NO: 329705 - DNA, 20 bp, Artificial Sequence
  chemically synthesized
agaaaattgataagctggtt

SEQ ID NO: 329706 - DNA, 20 bp, Artificial Sequence
  chemically synthesized
acttgagaaaattgataagc

SEQ ID NO: 329707 - DNA, 20 bp, Artificial Sequence
  chemically synthesized
ttacacttgagaaaattgat

SEQ ID NO: 329708 - DNA, 20 bp, Artificial Sequence
  chemically synthesized
accagcttatcaattttctc

SEQ ID NO: 329709 - DNA, 20 bp, Artificial Sequence
  chemically synthesized
aatatatccattttacactt

SEQ ID NO: 329710 - DNA, 20 bp, Artificial Sequence
  chemically synthesized
caattttctcaagtgtaaaa

SEQ ID NO: 329711 - DNA, 20 bp, Artificial Sequence
  chemically synthesized
gtgtaaaatggatatattaa

SEQ ID NO: 329712 - DNA, 20 bp, Artificial Sequence
  chemically synthesized
tattaacagaatcttctcaa

SEQ ID NO: 329713 - DNA, 20 bp, Artificial Sequence
  chemically synthesized
attaacagaatcttctcaat

SEQ ID NO: 329714 - DNA, 20 bp, Artificial Sequence
  chemically synthesized
ttaacagaatcttctcaata

SEQ ID NO: 329715 - DNA, 20 bp, Artificial Sequence
  chemically synthesized
tttataacaaccctattgag

SEQ ID NO: 329716 - DNA, 20 bp, Artificial Sequence
  chemically synthesized
atgtttataacaaccctatt

SEQ ID NO: 329717 - DNA, 20 bp, Artificial Sequence
  chemically synthesized
acattgaattaatgtatgaa

SEQ ID NO: 329718 - DNA, 20 bp, Artificial Sequence
  chemically synthesized
taatgtatgaaaagtgttta

SEQ ID NO: 329719 - DNA, 20 bp, Artificial Sequence
  chemically synthesized
atataatgattgtccaatat

SEQ ID NO: 329720 - DNA, 20 bp, Artificial Sequence
  chemically synthesized
caaaaattactaactgatat

SEQ ID NO: 329721 - DNA, 20 bp, Artificial Sequence
  chemically synthesized
aatgattgtccaatatcagt

SEQ ID NO: 329722 - DNA, 20 bp, Artificial Sequence
  chemically synthesized
tgtgacattattcatcatca

SEQ ID NO: 329723 - DNA, 20 bp, Artificial Sequence
  chemically synthesized
catcatcacagacattatct

SEQ ID NO: 329724 - DNA, 20 bp, Artificial Sequence
  chemically synthesized
tcatcacagacattatctaa

SEQ ID NO: 329725 - DNA, 20 bp, Artificial Sequence
  chemically synthesized
gataatgaaccagttactct

SEQ ID NO: 329726 - DNA, 20 bp, Artificial Sequence
  chemically synthesized
agacattatctaagagtaac

SEQ ID NO: 329727 - DNA, 20 bp, Artificial Sequence
  chemically synthesized
gttgatcttagataatgaac

SEQ ID NO: 329728 - DNA, 20 bp, Artificial Sequence
  chemically synthesized
gagtaactggttcattatct

SEQ ID NO: 329729 - DNA, 20 bp, Artificial Sequence
  chemically synthesized
tccttcctgagtgttgatct

SEQ ID NO: 329730 - DNA, 20 bp, Artificial Sequence
  chemically synthesized
cattatctaagatcaacact

SEQ ID NO: 329731 - DNA, 20 bp, Artificial Sequence
  chemically synthesized
attatctaagatcaacactc

SEQ ID NO: 329732 - DNA, 20 bp, Artificial Sequence
  chemically synthesized
atctaagatcaacactcagg

SEQ ID NO: 329733 - DNA, 20 bp, Artificial Sequence
  chemically synthesized
tctaagatcaacactcagga

SEQ ID NO: 329734 - DNA, 20 bp, Artificial Sequence
  chemically synthesized
taagatcaacactcaggaag

SEQ ID NO: 329735 - DNA, 20 bp, Artificial Sequence
  chemically synthesized
attagcctaagctccttcct

SEQ ID NO: 329736 - DNA, 20 bp, Artificial Sequence
  chemically synthesized
tcaacactcaggaaggagct

SEQ ID NO: 329737 - DNA, 20 bp, Artificial Sequence
  chemically synthesized
caacactcaggaaggagctt

SEQ ID NO: 329738 - DNA, 20 bp, Artificial Sequence
  chemically synthesized
ctgaatcattttattagcct

SEQ ID NO: 329739 - DNA, 20 bp, Artificial Sequence
  chemically synthesized
tgggctctgaatcattttat

SEQ ID NO: 329740 - DNA, 20 bp, Artificial Sequence
  chemically synthesized
cttaggctaataaaatgatt

SEQ ID NO: 329741 - DNA, 20 bp, Artificial Sequence
  chemically synthesized
taggctaataaaatgattca

SEQ ID NO: 329742 - DNA, 20 bp, Artificial Sequence
  chemically synthesized
taataaaatgattcagagcc

SEQ ID NO: 329743 - DNA, 20 bp, Artificial Sequence
  chemically synthesized
atgattcagagcccagaaat

SEQ ID NO: 329744 - DNA, 20 bp, Artificial Sequence
  chemically synthesized
acccaagttttccaatttct

SEQ ID NO: 329745 - DNA, 20 bp, Artificial Sequence
  chemically synthesized
aacccaagttttccaatttc

SEQ ID NO: 329746 - DNA, 20 bp, Artificial Sequence
  chemically synthesized
agcccagaaattggaaaact

SEQ ID NO: 329747 - DNA, 20 bp, Artificial Sequence
  chemically synthesized
gcccagaaattggaaaactt

SEQ ID NO: 329748 - DNA, 20 bp, Artificial Sequence
  chemically synthesized
gaaattggaaaacttgggtt

SEQ ID NO: 329749 - DNA, 20 bp, Artificial Sequence
  chemically synthesized
ataggtatgtcactcaaccc

SEQ ID NO: 329750 - DNA, 20 bp, Artificial Sequence
  chemically synthesized
gggttgagtgacatacctat

SEQ ID NO: 329751 - DNA, 20 bp, Artificial Sequence
  chemically synthesized
tagtatggttagaaactgat

SEQ ID NO: 329752 - DNA, 20 bp, Artificial Sequence
  chemically synthesized
gtagtatggttagaaactga

SEQ ID NO: 329753 - DNA, 20 bp, Artificial Sequence
  chemically synthesized
gttgaccaaagtagtatggt

SEQ ID NO: 329754 - DNA, 20 bp, Artificial Sequence
  chemically synthesized
atgagttgaccaaagtagta

SEQ ID NO: 329755 - DNA, 20 bp, Artificial Sequence
  chemically synthesized
agtttctaaccatactactt

SEQ ID NO: 329756 - DNA, 20 bp, Artificial Sequence
  chemically synthesized
cttgaatgagttgaccaaag

SEQ ID NO: 329757 - DNA, 20 bp, Artificial Sequence
  chemically synthesized
tatcttgaatgagttgacca

SEQ ID NO: 329758 - DNA, 20 bp, Artificial Sequence
  chemically synthesized
ctactttggtcaactcattc

SEQ ID NO: 329759 - DNA, 20 bp, Artificial Sequence
  chemically synthesized
caaccttatatatcttgaat

SEQ ID NO: 329760 - DNA, 20 bp, Artificial Sequence
  chemically synthesized
tcaactcattcaagatatat

SEQ ID NO: 329761 - DNA, 20 bp, Artificial Sequence
  chemically synthesized
caactcattcaagatatata

SEQ ID NO: 329762 - DNA, 20 bp, Artificial Sequence
  chemically synthesized
aagatatataaggttgtttt

SEQ ID NO: 329763 - DNA, 20 bp, Artificial Sequence
  chemically synthesized
ataaggttgtttttagttga

SEQ ID NO: 329764 - DNA, 20 bp, Artificial Sequence
  chemically synthesized
aaggttgtttttagttgaca

SEQ ID NO: 329765 - DNA, 20 bp, Artificial Sequence
  chemically synthesized
tgagcttacttgtgagataa

SEQ ID NO: 329766 - DNA, 20 bp, Artificial Sequence
  chemically synthesized
aatttcatcttttatctcac

SEQ ID NO: 329767 - DNA, 20 bp, Artificial Sequence
  chemically synthesized
tcatcttttatctcacaagt

SEQ ID NO: 329768 - DNA, 20 bp, Artificial Sequence
  chemically synthesized
gccccagtgagcttacttgt

SEQ ID NO: 329769 - DNA, 20 bp, Artificial Sequence
  chemically synthesized
tatctcacaagtaagctcac

SEQ ID NO: 329770 - DNA, 20 bp, Artificial Sequence
  chemically synthesized
atctcacaagtaagctcact

SEQ ID NO: 329771 - DNA, 20 bp, Artificial Sequence
  chemically synthesized
tctcacaagtaagctcactg

SEQ ID NO: 329772 - DNA, 20 bp, Artificial Sequence
  chemically synthesized
tgtattatttatgccccagt

SEQ ID NO: 329773 - DNA, 20 bp, Artificial Sequence
  chemically synthesized
gctttgtattatttatgccc

SEQ ID NO: 329774 - DNA, 20 bp, Artificial Sequence
  chemically synthesized
actggggcataaataataca

SEQ ID NO: 329775 - DNA, 20 bp, Artificial Sequence
  chemically synthesized
aaataatacaaagcacgtaa

SEQ ID NO: 329776 - DNA, 20 bp, Artificial Sequence
  chemically synthesized
aataatacaaagcacgtaaa

SEQ ID NO: 329777 - DNA, 20 bp, Artificial Sequence
  chemically synthesized
ataatacaaagcacgtaaaa

SEQ ID NO: 329778 - DNA, 20 bp, Artificial Sequence
  chemically synthesized
aagggatatgaacattttat

SEQ ID NO: 329779 - DNA, 20 bp, Artificial Sequence
  chemically synthesized
agggatatgaacattttata

SEQ ID NO: 329780 - DNA, 20 bp, Artificial Sequence
  chemically synthesized
tgaacattttataaggtgtg

SEQ ID NO: 329781 - DNA, 20 bp, Artificial Sequence
  chemically synthesized
ttatgctcttatgtataaga

SEQ ID NO: 329782 - DNA, 20 bp, Artificial Sequence
  chemically synthesized
gttatgctcttatgtataag

SEQ ID NO: 329783 - DNA, 20 bp, Artificial Sequence
  chemically synthesized
tgttatgctcttatgtataa

SEQ ID NO: 329784 - DNA, 20 bp, Artificial Sequence
  chemically synthesized
gaagaatccctcttatacat

SEQ ID NO: 329785 - DNA, 20 bp, Artificial Sequence
  chemically synthesized
tgtgttatgctcttatgtat

SEQ ID NO: 329786 - DNA, 20 bp, Artificial Sequence
  chemically synthesized
agaatccctcttatacataa

SEQ ID NO: 329787 - DNA, 20 bp, Artificial Sequence
  chemically synthesized
taagagcataacacattctt

SEQ ID NO: 329788 - DNA, 20 bp, Artificial Sequence
  chemically synthesized
cataacacattcttcagttg

SEQ ID NO: 329789 - DNA, 20 bp, Artificial Sequence
  chemically synthesized
gggctctattgcttcaactg

SEQ ID NO: 329790 - DNA, 20 bp, Artificial Sequence
  chemically synthesized
acattcttcagttgaagcaa

SEQ ID NO: 329791 - DNA, 20 bp, Artificial Sequence
  chemically synthesized
attcttcagttgaagcaata

SEQ ID NO: 329792 - DNA, 20 bp, Artificial Sequence
  chemically synthesized
tcccagaacaggtagtgaaa

SEQ ID NO: 329793 - DNA, 20 bp, Artificial Sequence
  chemically synthesized
ttcccagaacaggtagtgaa

SEQ ID NO: 329794 - DNA, 20 bp, Artificial Sequence
  chemically synthesized
attcccagaacaggtagtga

SEQ ID NO: 329795 - DNA, 20 bp, Artificial Sequence
  chemically synthesized
agccctttcactacctgttc

SEQ ID NO: 329796 - DNA, 20 bp, Artificial Sequence
  chemically synthesized
tgagccattcccagaacagg

SEQ ID NO: 329797 - DNA, 20 bp, Artificial Sequence
  chemically synthesized
gccctttcactacctgttct

SEQ ID NO: 329798 - DNA, 20 bp, Artificial Sequence
  chemically synthesized
agttgagccattcccagaac

SEQ ID NO: 329799 - DNA, 20 bp, Artificial Sequence
  chemically synthesized
aagttgagccattcccagaa

SEQ ID NO: 329800 - DNA, 20 bp, Artificial Sequence
  chemically synthesized
ttcactacctgttctgggaa

SEQ ID NO: 329801 - DNA, 20 bp, Artificial Sequence
  chemically synthesized
tacataagttgagccattcc

SEQ ID NO: 329802 - DNA, 20 bp, Artificial Sequence
  chemically synthesized
gagcaagtgctacataagtt

SEQ ID NO: 329803 - DNA, 20 bp, Artificial Sequence
  chemically synthesized
tgggaatggctcaacttatg

SEQ ID NO: 329804 - DNA, 20 bp, Artificial Sequence
  chemically synthesized
gacaagagcaagtgctacat

SEQ ID NO: 329805 - DNA, 20 bp, Artificial Sequence
  chemically synthesized
gttcgtggaaagacaagagc

SEQ ID NO: 329806 - DNA, 20 bp, Artificial Sequence
  chemically synthesized
ttgtgttcgtggaaagacaa

SEQ ID NO: 329807 - DNA, 20 bp, Artificial Sequence
  chemically synthesized
ctttgtgttcgtggaaagac

SEQ ID NO: 329808 - DNA, 20 bp, Artificial Sequence
  chemically synthesized
gcaaactttgtgttcgtgga

SEQ ID NO: 329809 - DNA, 20 bp, Artificial Sequence
  chemically synthesized
agctgcaaactttgtgttcg

SEQ ID NO: 329810 - DNA, 20 bp, Artificial Sequence
  chemically synthesized
cttgtctttccacgaacaca

SEQ ID NO: 329811 - DNA, 20 bp, Artificial Sequence
  chemically synthesized
ttccacgaacacaaagtttg

SEQ ID NO: 329812 - DNA, 20 bp, Artificial Sequence
  chemically synthesized
aggaaagaggtttcatgttt

SEQ ID NO: 329813 - DNA, 20 bp, Artificial Sequence
  chemically synthesized
tagattgggaagcaggaaag

SEQ ID NO: 329814 - DNA, 20 bp, Artificial Sequence
  chemically synthesized
gtagattgggaagcaggaaa

SEQ ID NO: 329815 - DNA, 20 bp, Artificial Sequence
  chemically synthesized
tggtagattgggaagcagga

SEQ ID NO: 329816 - DNA, 20 bp, Artificial Sequence
  chemically synthesized
aatctggtagattgggaagc

SEQ ID NO: 329817 - DNA, 20 bp, Artificial Sequence
  chemically synthesized
aaatctggtagattgggaag

SEQ ID NO: 329818 - DNA, 20 bp, Artificial Sequence
  chemically synthesized
tgaaaatctggtagattggg

SEQ ID NO: 329819 - DNA, 20 bp, Artificial Sequence
  chemically synthesized
tttcctgcttcccaatctac

SEQ ID NO: 329820 - DNA, 20 bp, Artificial Sequence
  chemically synthesized
tgttgaaaatctggtagatt

SEQ ID NO: 329821 - DNA, 20 bp, Artificial Sequence
  chemically synthesized
atgttgaaaatctggtagat

SEQ ID NO: 329822 - DNA, 20 bp, Artificial Sequence
  chemically synthesized
tatccatgttgaaaatctgg

SEQ ID NO: 329823 - DNA, 20 bp, Artificial Sequence
  chemically synthesized
tattatccatgttgaaaatc

SEQ ID NO: 329824 - DNA, 20 bp, Artificial Sequence
  chemically synthesized
aatctaccagattttcaaca

SEQ ID NO: 329825 - DNA, 20 bp, Artificial Sequence
  chemically synthesized
aacatggataatataacata

SEQ ID NO: 329826 - DNA, 20 bp, Artificial Sequence
  chemically synthesized
acatggataatataacataa

SEQ ID NO: 329827 - DNA, 20 bp, Artificial Sequence
  chemically synthesized
tttctatggtacagacagat

SEQ ID NO: 329828 - DNA, 20 bp, Artificial Sequence
  chemically synthesized
acttatttctatggtacaga

SEQ ID NO: 329829 - DNA, 20 bp, Artificial Sequence
  chemically synthesized
ggacttatctgtctgtacca

SEQ ID NO: 329830 - DNA, 20 bp, Artificial Sequence
  chemically synthesized
tactacttatttctatggta

SEQ ID NO: 329831 - DNA, 20 bp, Artificial Sequence
  chemically synthesized
tctgtctgtaccatagaaat

SEQ ID NO: 329832 - DNA, 20 bp, Artificial Sequence
  chemically synthesized
caaaatactacttatttcta

SEQ ID NO: 329833 - DNA, 20 bp, Artificial Sequence
  chemically synthesized
gtctgtaccatagaaataag

SEQ ID NO: 329834 - DNA, 20 bp, Artificial Sequence
  chemically synthesized
gaaataagtagtattttgcc

SEQ ID NO: 329835 - DNA, 20 bp, Artificial Sequence
  chemically synthesized
ctctgaggacttggaaagcc

SEQ ID NO: 329836 - DNA, 20 bp, Artificial Sequence
  chemically synthesized
agtattttgcctggctttcc

SEQ ID NO: 329837 - DNA, 20 bp, Artificial Sequence
  chemically synthesized
actctgaggacttggaaagc

SEQ ID NO: 329838 - DNA, 20 bp, Artificial Sequence
  chemically synthesized
tgagactctgaggacttgga

SEQ ID NO: 329839 - DNA, 20 bp, Artificial Sequence
  chemically synthesized
tgcctggctttccaagtcct

SEQ ID NO: 329840 - DNA, 20 bp, Artificial Sequence
  chemically synthesized
atggtgagactctgaggact

SEQ ID NO: 329841 - DNA, 20 bp, Artificial Sequence
  chemically synthesized
cctggctttccaagtcctca

SEQ ID NO: 329842 - DNA, 20 bp, Artificial Sequence
  chemically synthesized
tagggtatggtgagactctg

SEQ ID NO: 329843 - DNA, 20 bp, Artificial Sequence
  chemically synthesized
atagggtatggtgagactct

SEQ ID NO: 329844 - DNA, 20 bp, Artificial Sequence
  chemically synthesized
tgagaaaaatagggtatggt

SEQ ID NO: 329845 - DNA, 20 bp, Artificial Sequence
  chemically synthesized
attctgagaaaaatagggta

SEQ ID NO: 329846 - DNA, 20 bp, Artificial Sequence
  chemically synthesized
atgaaattctgagaaaaata

SEQ ID NO: 329847 - DNA, 20 bp, Artificial Sequence
  chemically synthesized
aatgaaattctgagaaaaat

SEQ ID NO: 329848 - DNA, 20 bp, Artificial Sequence
  chemically synthesized
tcaccataccctatttttct

SEQ ID NO: 329849 - DNA, 20 bp, Artificial Sequence
  chemically synthesized
caatgaaattctgagaaaaa

SEQ ID NO: 329850 - DNA, 20 bp, Artificial Sequence
  chemically synthesized
caaaatggcaatgaaattct

SEQ ID NO: 329851 - DNA, 20 bp, Artificial Sequence
  chemically synthesized
tcagaatttcattgccattt

SEQ ID NO: 329852 - DNA, 20 bp, Artificial Sequence
  chemically synthesized
cagaatttcattgccatttt

SEQ ID NO: 329853 - DNA, 20 bp, Artificial Sequence
  chemically synthesized
agaatttcattgccattttg

SEQ ID NO: 329854 - DNA, 20 bp, Artificial Sequence
  chemically synthesized
aagaattcattgccccaaaa

SEQ ID NO: 329855 - DNA, 20 bp, Artificial Sequence
  chemically synthesized
ttggggcaatgaattctttt

SEQ ID NO: 329856 - DNA, 20 bp, Artificial Sequence
  chemically synthesized
aatttcaatcatattctcaa

SEQ ID NO: 329857 - DNA, 20 bp, Artificial Sequence
  chemically synthesized
tgagaatatgattgaaattc

SEQ ID NO: 329858 - DNA, 20 bp, Artificial Sequence
  chemically synthesized
tacacatagtgtaaaggatc

SEQ ID NO: 329859 - DNA, 20 bp, Artificial Sequence
  chemically synthesized
tttgtgtacacatagtgtaa

SEQ ID NO: 329860 - DNA, 20 bp, Artificial Sequence
  chemically synthesized
ttttgtgtacacatagtgta

SEQ ID NO: 329861 - DNA, 20 bp, Artificial Sequence
  chemically synthesized
caaacatttttgtgtacaca

SEQ ID NO: 329862 - DNA, 20 bp, Artificial Sequence
  chemically synthesized
tatgtgtacacaaaaatgtt

SEQ ID NO: 329863 - DNA, 20 bp, Artificial Sequence
  chemically synthesized
tgtgtacacaaaaatgtttg

SEQ ID NO: 329864 - DNA, 20 bp, Artificial Sequence
  chemically synthesized
aaaatgtttggagattgtgt

SEQ ID NO: 329865 - DNA, 20 bp, Artificial Sequence
  chemically synthesized
atgtttggagattgtgttag

SEQ ID NO: 329866 - DNA, 20 bp, Artificial Sequence
  chemically synthesized
tgtttggagattgtgttagc

SEQ ID NO: 329867 - DNA, 20 bp, Artificial Sequence
  chemically synthesized
agattgtgttagcgggattg

SEQ ID NO: 329868 - DNA, 20 bp, Artificial Sequence
  chemically synthesized
agtttgttaaatgtgcataa

SEQ ID NO: 329869 - DNA, 20 bp, Artificial Sequence
  chemically synthesized
atgcacatttaacaaactct

SEQ ID NO: 329870 - DNA, 20 bp, Artificial Sequence
  chemically synthesized
tgcacatttaacaaactctt

SEQ ID NO: 329871 - DNA, 20 bp, Artificial Sequence
  chemically synthesized
gcacatttaacaaactctta

SEQ ID NO: 329872 - DNA, 20 bp, Artificial Sequence
  chemically synthesized
cacagtttataaaaccctaa

SEQ ID NO: 329873 - DNA, 20 bp, Artificial Sequence
  chemically synthesized
atcacagtttataaaaccct

SEQ ID NO: 329874 - DNA, 20 bp, Artificial Sequence
  chemically synthesized
aaatggtataacaatcatca

SEQ ID NO: 329875 - DNA, 20 bp, Artificial Sequence
  chemically synthesized
gccggtgcagataaataaaa

SEQ ID NO: 329876 - DNA, 20 bp, Artificial Sequence
  chemically synthesized
accattttatttatctgcac

SEQ ID NO: 329877 - DNA, 20 bp, Artificial Sequence
  chemically synthesized
cttgtaatgataagccggtg

SEQ ID NO: 329878 - DNA, 20 bp, Artificial Sequence
  chemically synthesized
ctgagcttgtaatgataagc

SEQ ID NO: 329879 - DNA, 20 bp, Artificial Sequence
  chemically synthesized
ttaactgagcttgtaatgat

SEQ ID NO: 329880 - DNA, 20 bp, Artificial Sequence
  chemically synthesized
ctgcaccggcttatcattac

SEQ ID NO: 329881 - DNA, 20 bp, Artificial Sequence
  chemically synthesized
ccggcttatcattacaagct

SEQ ID NO: 329882 - DNA, 20 bp, Artificial Sequence
  chemically synthesized
aaggatggagaatgttaact

SEQ ID NO: 329883 - DNA, 20 bp, Artificial Sequence
  chemically synthesized
agttaacattctccatcctt

SEQ ID NO: 329884 - DNA, 20 bp, Artificial Sequence
  chemically synthesized
ttactaattactgaaggatg

SEQ ID NO: 329885 - DNA, 20 bp, Artificial Sequence
  chemically synthesized
cattactaattactgaagga

SEQ ID NO: 329886 - DNA, 20 bp, Artificial Sequence
  chemically synthesized
ctaacattactaattactga

SEQ ID NO: 329887 - DNA, 20 bp, Artificial Sequence
  chemically synthesized
attctccatccttcagtaat

SEQ ID NO: 329888 - DNA, 20 bp, Artificial Sequence
  chemically synthesized
gctaacattactaattactg

SEQ ID NO: 329889 - DNA, 20 bp, Artificial Sequence
  chemically synthesized
ccttcagtaattagtaatgt

SEQ ID NO: 329890 - DNA, 20 bp, Artificial Sequence
  chemically synthesized
gttttgttttttaaagacac

SEQ ID NO: 329891 - DNA, 20 bp, Artificial Sequence
  chemically synthesized
tgttttgttttttaaagaca

SEQ ID NO: 329892 - DNA, 20 bp, Artificial Sequence
  chemically synthesized
tgtgtttgttttgtttttta

SEQ ID NO: 329893 - DNA, 20 bp, Artificial Sequence
  chemically synthesized
aaaacaaacacatatgtatt

SEQ ID NO: 329894 - DNA, 20 bp, Artificial Sequence
  chemically synthesized
aaacaaacacatatgtattg

SEQ ID NO: 329895 - DNA, 20 bp, Artificial Sequence
  chemically synthesized
acattaagatatataatcag

SEQ ID NO: 329896 - DNA, 20 bp, Artificial Sequence
  chemically synthesized
tacattaagatatataatca

SEQ ID NO: 329897 - DNA, 20 bp, Artificial Sequence
  chemically synthesized
actacattaagatatataat

SEQ ID NO: 329898 - DNA, 20 bp, Artificial Sequence
  chemically synthesized
tctgattatatatcttaatg

SEQ ID NO: 329899 - DNA, 20 bp, Artificial Sequence
  chemically synthesized
ataaaataaaatactacatt

SEQ ID NO: 329900 - DNA, 20 bp, Artificial Sequence
  chemically synthesized
taatgtagtattttatttta

SEQ ID NO: 329901 - DNA, 20 bp, Artificial Sequence
  chemically synthesized
ttttatagtgtactatttac

SEQ ID NO: 329902 - DNA, 20 bp, Artificial Sequence
  chemically synthesized
acactggcagaactggtaaa

SEQ ID NO: 329903 - DNA, 20 bp, Artificial Sequence
  chemically synthesized
gtactatttaccagttctgc

SEQ ID NO: 329904 - DNA, 20 bp, Artificial Sequence
  chemically synthesized
atgattaacactggcagaac

SEQ ID NO: 329905 - DNA, 20 bp, Artificial Sequence
  chemically synthesized
cggacaatgattaacactgg

SEQ ID NO: 329906 - DNA, 20 bp, Artificial Sequence
  chemically synthesized
ttacggacaatgattaacac

SEQ ID NO: 329907 - DNA, 20 bp, Artificial Sequence
  chemically synthesized
tgttaatcattgtccgtaat

SEQ ID NO: 329908 - DNA, 20 bp, Artificial Sequence
  chemically synthesized
aggaaataatattctaatta

SEQ ID NO: 329909 - DNA, 20 bp, Artificial Sequence
  chemically synthesized
agaatattatttcctatctt

SEQ ID NO: 329910 - DNA, 20 bp, Artificial Sequence
  chemically synthesized
taatagagaaaactgaagat

SEQ ID NO: 329911 - DNA, 20 bp, Artificial Sequence
  chemically synthesized
ttaatagagaaaactgaaga

SEQ ID NO: 329912 - DNA, 20 bp, Artificial Sequence
  chemically synthesized
caatttaatagagaaaactg

SEQ ID NO: 329913 - DNA, 20 bp, Artificial Sequence
  chemically synthesized
tcaaaaatcacaatttaata

SEQ ID NO: 329914 - DNA, 20 bp, Artificial Sequence
  chemically synthesized
cttcaaaaatcacaatttaa

SEQ ID NO: 329915 - DNA, 20 bp, Artificial Sequence
  chemically synthesized
ctattaaattgtgatttttg

SEQ ID NO: 329916 - DNA, 20 bp, Artificial Sequence
  chemically synthesized
aaatcaggaaaatagtgaca

SEQ ID NO: 329917 - DNA, 20 bp, Artificial Sequence
  chemically synthesized
ataaatgaaaatcaggaaaa

SEQ ID NO: 329918 - DNA, 20 bp, Artificial Sequence
  chemically synthesized
aatttcaataaatgaaaatc

SEQ ID NO: 329919 - DNA, 20 bp, Artificial Sequence
  chemically synthesized
caatttcaataaatgaaaat

SEQ ID NO: 329920 - DNA, 20 bp, Artificial Sequence
  chemically synthesized
tgaaattgaaaaatatatgt

SEQ ID NO: 329921 - DNA, 20 bp, Artificial Sequence
  chemically synthesized
aaattgaaaaatatatgtaa

SEQ ID NO: 329922 - DNA, 20 bp, Artificial Sequence
  chemically synthesized
acatttaaaaatatatgtaa

SEQ ID NO: 329923 - DNA, 20 bp, Artificial Sequence
  chemically synthesized
atttaaaaatatatgtaaaa

SEQ ID NO: 329924 - DNA, 20 bp, Artificial Sequence
  chemically synthesized
ttctctgaattttcatttgt

SEQ ID NO: 329925 - DNA, 20 bp, Artificial Sequence
  chemically synthesized
ttcactgacaaatgaaaatt

SEQ ID NO: 329926 - DNA, 20 bp, Artificial Sequence
  chemically synthesized
cactgacaaatgaaaattca

SEQ ID NO: 329927 - DNA, 20 bp, Artificial Sequence
  chemically synthesized
cttttcaattaattttatag

SEQ ID NO: 329928 - DNA, 20 bp, Artificial Sequence
  chemically synthesized
ctcttttcaattaattttat

SEQ ID NO: 329929 - DNA, 20 bp, Artificial Sequence
  chemically synthesized
actcttttcaattaatttta

SEQ ID NO: 329930 - DNA, 20 bp, Artificial Sequence
  chemically synthesized
ctcctataaaattaattgaa

SEQ ID NO: 329931 - DNA, 20 bp, Artificial Sequence
  chemically synthesized
cctataaaattaattgaaaa

SEQ ID NO: 329932 - DNA, 20 bp, Artificial Sequence
  chemically synthesized
aaaattaattgaaaagagtc

SEQ ID NO: 329933 - DNA, 20 bp, Artificial Sequence
  chemically synthesized
atattcagaatattttacac

SEQ ID NO: 329934 - DNA, 20 bp, Artificial Sequence
  chemically synthesized
cttagaacaaaggttatatt

SEQ ID NO: 329935 - DNA, 20 bp, Artificial Sequence
  chemically synthesized
ctgaatataacctttgttct

SEQ ID NO: 329936 - DNA, 20 bp, Artificial Sequence
  chemically synthesized
tatatatgtacttagaacaa

SEQ ID NO: 329937 - DNA, 20 bp, Artificial Sequence
  chemically synthesized
ctatatatgtacttagaaca

SEQ ID NO: 329938 - DNA, 20 bp, Artificial Sequence
  chemically synthesized
tatacatctatatatgtact

SEQ ID NO: 329939 - DNA, 20 bp, Artificial Sequence
  chemically synthesized
ctttgttctaagtacatata

SEQ ID NO: 329940 - DNA, 20 bp, Artificial Sequence
  chemically synthesized
gaaaaaataaattatttgtg

SEQ ID NO: 329941 - DNA, 20 bp, Artificial Sequence
  chemically synthesized
ataatttattttttcaaaac

SEQ ID NO: 329942 - DNA, 20 bp, Artificial Sequence
  chemically synthesized
agctaagacaacattgtgac

SEQ ID NO: 329943 - DNA, 20 bp, Artificial Sequence
  chemically synthesized
aaccagtcacaatgttgtct

SEQ ID NO: 329944 - DNA, 20 bp, Artificial Sequence
  chemically synthesized
aaataactgaaaatgtagct

SEQ ID NO: 329945 - DNA, 20 bp, Artificial Sequence
  chemically synthesized
tgttgtcttagctacatttt

SEQ ID NO: 329946 - DNA, 20 bp, Artificial Sequence
  chemically synthesized
acattaaataactgaaaatg

SEQ ID NO: 329947 - DNA, 20 bp, Artificial Sequence
  chemically synthesized
tataaaagagtttaattgca

SEQ ID NO: 329948 - DNA, 20 bp, Artificial Sequence
  chemically synthesized
tacaaagttaagatataaaa

SEQ ID NO: 329949 - DNA, 20 bp, Artificial Sequence
  chemically synthesized
actacaaagttaagatataa

SEQ ID NO: 329950 - DNA, 20 bp, Artificial Sequence
  chemically synthesized
tcttttatatcttaactttg

SEQ ID NO: 329951 - DNA, 20 bp, Artificial Sequence
  chemically synthesized
catgaagccactacaaagtt

SEQ ID NO: 329952 - DNA, 20 bp, Artificial Sequence
  chemically synthesized
tttatatcttaactttgtag

SEQ ID NO: 329953 - DNA, 20 bp, Artificial Sequence
  chemically synthesized
aataccatgaagccactaca

SEQ ID NO: 329954 - DNA, 20 bp, Artificial Sequence
  chemically synthesized
ttaactttgtagtggcttca

SEQ ID NO: 329955 - DNA, 20 bp, Artificial Sequence
  chemically synthesized
ccaaatgatataataccatg

SEQ ID NO: 329956 - DNA, 20 bp, Artificial Sequence
  chemically synthesized
cttcatggtattatatcatt

SEQ ID NO: 329957 - DNA, 20 bp, Artificial Sequence
  chemically synthesized
tcatggtattatatcatttg

SEQ ID NO: 329958 - DNA, 20 bp, Artificial Sequence
  chemically synthesized
ttggagatataatttattta

SEQ ID NO: 329959 - DNA, 20 bp, Artificial Sequence
  chemically synthesized
aatttatttaaagaaactaa

SEQ ID NO: 329960 - DNA, 20 bp, Artificial Sequence
  chemically synthesized
tgcacatgtgaatatactgt

SEQ ID NO: 329961 - DNA, 20 bp, Artificial Sequence
  chemically synthesized
tgaaattaatgtgtgttcag

SEQ ID NO: 329962 - DNA, 20 bp, Artificial Sequence
  chemically synthesized
taatgaaattaatgtgtgtt

SEQ ID NO: 329963 - DNA, 20 bp, Artificial Sequence
  chemically synthesized
acattaatttcattaacaaa

SEQ ID NO: 329964 - DNA, 20 bp, Artificial Sequence
  chemically synthesized
tcattaacaaaaagaaatac

SEQ ID NO: 329965 - DNA, 20 bp, Artificial Sequence
  chemically synthesized
caaaaagaaatacaagacca

SEQ ID NO: 329966 - DNA, 20 bp, Artificial Sequence
  chemically synthesized
aaagaaatacaagaccaaag

SEQ ID NO: 329967 - DNA, 20 bp, Artificial Sequence
  chemically synthesized
agtttagaggtcaacttctt

SEQ ID NO: 329968 - DNA, 20 bp, Artificial Sequence
  chemically synthesized
agtataggaagatagtttag

SEQ ID NO: 329969 - DNA, 20 bp, Artificial Sequence
  chemically synthesized
aagtataggaagatagttta

SEQ ID NO: 329970 - DNA, 20 bp, Artificial Sequence
  chemically synthesized
agaagtataggaagatagtt

SEQ ID NO: 329971 - DNA, 20 bp, Artificial Sequence
  chemically synthesized
acattagaagtataggaaga

SEQ ID NO: 329972 - DNA, 20 bp, Artificial Sequence
  chemically synthesized
gttcacattagaagtatagg

SEQ ID NO: 329973 - DNA, 20 bp, Artificial Sequence
  chemically synthesized
agtgttcacattagaagtat

SEQ ID NO: 329974 - DNA, 20 bp, Artificial Sequence
  chemically synthesized
tagtgttcacattagaagta

SEQ ID NO: 329975 - DNA, 20 bp, Artificial Sequence
  chemically synthesized
ttgaatagtgttcacattag

SEQ ID NO: 329976 - DNA, 20 bp, Artificial Sequence
  chemically synthesized
tgattgaatagtgttcacat

SEQ ID NO: 329977 - DNA, 20 bp, Artificial Sequence
  chemically synthesized
taaattatgagatgattgaa

SEQ ID NO: 329978 - DNA, 20 bp, Artificial Sequence
  chemically synthesized
ttcattttaatttaaattat

SEQ ID NO: 329979 - DNA, 20 bp, Artificial Sequence
  chemically synthesized
ttaaaatgaaataaactaca

SEQ ID NO: 329980 - DNA, 20 bp, Artificial Sequence
  chemically synthesized
taaaatgaaataaactacat

SEQ ID NO: 329981 - DNA, 20 bp, Artificial Sequence
  chemically synthesized
acaaaattccagtgcctatg

SEQ ID NO: 329982 - DNA, 20 bp, Artificial Sequence
  chemically synthesized
gaaataaactacataggcac

SEQ ID NO: 329983 - DNA, 20 bp, Artificial Sequence
  chemically synthesized
ggtagaaagaaacaaaattc

SEQ ID NO: 329984 - DNA, 20 bp, Artificial Sequence
  chemically synthesized
tccaaattttaagaggtaga

SEQ ID NO: 329985 - DNA, 20 bp, Artificial Sequence
  chemically synthesized
gcattccaaattttaagagg

SEQ ID NO: 329986 - DNA, 20 bp, Artificial Sequence
  chemically synthesized
ggagcattccaaattttaag

SEQ ID NO: 329987 - DNA, 20 bp, Artificial Sequence
  chemically synthesized
gggagcattccaaattttaa

SEQ ID NO: 329988 - DNA, 20 bp, Artificial Sequence
  chemically synthesized
tctttctacctcttaaaatt

SEQ ID NO: 329989 - DNA, 20 bp, Artificial Sequence
  chemically synthesized
aagggagcattccaaatttt

SEQ ID NO: 329990 - DNA, 20 bp, Artificial Sequence
  chemically synthesized
ggaatctattaattttaagg

SEQ ID NO: 329991 - DNA, 20 bp, Artificial Sequence
  chemically synthesized
ttggaatctattaattttaa

SEQ ID NO: 329992 - DNA, 20 bp, Artificial Sequence
  chemically synthesized
attggaatctattaatttta

SEQ ID NO: 329993 - DNA, 20 bp, Artificial Sequence
  chemically synthesized
tattggaatctattaatttt

SEQ ID NO: 329994 - DNA, 20 bp, Artificial Sequence
  chemically synthesized
gaatgctcccttaaaattaa

SEQ ID NO: 329995 - DNA, 20 bp, Artificial Sequence
  chemically synthesized
ggtattttcttgtaagttat

SEQ ID NO: 329996 - DNA, 20 bp, Artificial Sequence
  chemically synthesized
aatagattccaataacttac

SEQ ID NO: 329997 - DNA, 20 bp, Artificial Sequence
  chemically synthesized
aaaggtgggtattttcttgt

SEQ ID NO: 329998 - DNA, 20 bp, Artificial Sequence
  chemically synthesized
tagtaactttgtgtaaaggt

SEQ ID NO: 329999 - DNA, 20 bp, Artificial Sequence
  chemically synthesized
atagtaactttgtgtaaagg

SEQ ID NO: 330000 - DNA, 20 bp, Artificial Sequence
  chemically synthesized
aaaatacccacctttacaca

SEQ ID NO: 330001 - DNA, 20 bp, Artificial Sequence
  chemically synthesized
tttatagtaactttgtgtaa

SEQ ID NO: 330002 - DNA, 20 bp, Artificial Sequence
  chemically synthesized
ttttatagtaactttgtgta

SEQ ID NO: 330003 - DNA, 20 bp, Artificial Sequence
  chemically synthesized
tcacacatgaaggattttta

SEQ ID NO: 330004 - DNA, 20 bp, Artificial Sequence
  chemically synthesized
tattttttaatcacacatga

SEQ ID NO: 330005 - DNA, 20 bp, Artificial Sequence
  chemically synthesized
ttattttttaatcacacatg

SEQ ID NO: 330006 - DNA, 20 bp, Artificial Sequence
  chemically synthesized
ttacatgtttactttgtgat

SEQ ID NO: 330007 - DNA, 20 bp, Artificial Sequence
  chemically synthesized
taagtataaatctgatcaca

SEQ ID NO: 330008 - DNA, 20 bp, Artificial Sequence
  chemically synthesized
tttgtgatcagatttatact

SEQ ID NO: 330009 - DNA, 20 bp, Artificial Sequence
  chemically synthesized
gtgatcagatttatacttag

SEQ ID NO: 330010 - DNA, 20 bp, Artificial Sequence
  chemically synthesized
attctaaaaattgagctgct

SEQ ID NO: 330011 - DNA, 20 bp, Artificial Sequence
  chemically synthesized
atacttagcagctcaatttt

SEQ ID NO: 330012 - DNA, 20 bp, Artificial Sequence
  chemically synthesized
atatcattattctaaaaatt

SEQ ID NO: 330013 - DNA, 20 bp, Artificial Sequence
  chemically synthesized
aatttttagaataatgatat

SEQ ID NO: 330014 - DNA, 20 bp, Artificial Sequence
  chemically synthesized
atttttagaataatgatatg

SEQ ID NO: 330015 - DNA, 20 bp, Artificial Sequence
  chemically synthesized
atgaggaaataactattatg

SEQ ID NO: 330016 - DNA, 20 bp, Artificial Sequence
  chemically synthesized
ttgataaaatggcttcataa

SEQ ID NO: 330017 - DNA, 20 bp, Artificial Sequence
  chemically synthesized
ttgctctttttttgataaaa

SEQ ID NO: 330018 - DNA, 20 bp, Artificial Sequence
  chemically synthesized
tgaagccattttatcaaaaa

SEQ ID NO: 330019 - DNA, 20 bp, Artificial Sequence
  chemically synthesized
aagccattttatcaaaaaaa

SEQ ID NO: 330020 - DNA, 20 bp, Artificial Sequence
  chemically synthesized
tcaaaaaaagagcaaaatat

SEQ ID NO: 330021 - DNA, 20 bp, Artificial Sequence
  chemically synthesized
caaaaaaagagcaaaatatc

SEQ ID NO: 330022 - DNA, 20 bp, Artificial Sequence
  chemically synthesized
agcaaaatatcaggatctca

SEQ ID NO: 330023 - DNA, 20 bp, Artificial Sequence
  chemically synthesized
caaaatatcaggatctcaaa

SEQ ID NO: 330024 - DNA, 20 bp, Artificial Sequence
  chemically synthesized
tggagtgctaatagctcttt

SEQ ID NO: 330025 - DNA, 20 bp, Artificial Sequence
  chemically synthesized
tcaggatctcaaagagctat

SEQ ID NO: 330026 - DNA, 20 bp, Artificial Sequence
  chemically synthesized
aatgagcactggagtgctaa

SEQ ID NO: 330027 - DNA, 20 bp, Artificial Sequence
  chemically synthesized
tcaaagagctattagcactc

SEQ ID NO: 330028 - DNA, 20 bp, Artificial Sequence
  chemically synthesized
tcgtgctataatgagcactg

SEQ ID NO: 330029 - DNA, 20 bp, Artificial Sequence
  chemically synthesized
aatcgtgctataatgagcac

SEQ ID NO: 330030 - DNA, 20 bp, Artificial Sequence
  chemically synthesized
tagcactccagtgctcatta

SEQ ID NO: 330031 - DNA, 20 bp, Artificial Sequence
  chemically synthesized
atttttaatcgtgctataat

SEQ ID NO: 330032 - DNA, 20 bp, Artificial Sequence
  chemically synthesized
cattatagcacgattaaaaa

SEQ ID NO: 330033 - DNA, 20 bp, Artificial Sequence
  chemically synthesized
gattaaaaatagtcacgatg

SEQ ID NO: 330034 - DNA, 20 bp, Artificial Sequence
  chemically synthesized
attaaaaatagtcacgatgt

SEQ ID NO: 330035 - DNA, 20 bp, Artificial Sequence
  chemically synthesized
ggaacaacgtaaatgcccga

SEQ ID NO: 330036 - DNA, 20 bp, Artificial Sequence
  chemically synthesized
tctttatccattcagctatc

SEQ ID NO: 330037 - DNA, 20 bp, Artificial Sequence
  chemically synthesized
ttctttatccattcagctat

SEQ ID NO: 330038 - DNA, 20 bp, Artificial Sequence
  chemically synthesized
gtaaatgcccgatagctgaa

SEQ ID NO: 330039 - DNA, 20 bp, Artificial Sequence
  chemically synthesized
ccacatcttctttatccatt

SEQ ID NO: 330040 - DNA, 20 bp, Artificial Sequence
  chemically synthesized
gcccgatagctgaatggata

SEQ ID NO: 330041 - DNA, 20 bp, Artificial Sequence
  chemically synthesized
cgatagctgaatggataaag

SEQ ID NO: 330042 - DNA, 20 bp, Artificial Sequence
  chemically synthesized
ctgaatggataaagaagatg

SEQ ID NO: 330043 - DNA, 20 bp, Artificial Sequence
  chemically synthesized
gatgtggtaaatacatacaa

SEQ ID NO: 330044 - DNA, 20 bp, Artificial Sequence
  chemically synthesized
acatacaatggaattttatt

SEQ ID NO: 330045 - DNA, 20 bp, Artificial Sequence
  chemically synthesized
aattttattcagtctttaaa

SEQ ID NO: 330046 - DNA, 20 bp, Artificial Sequence
  chemically synthesized
tttattcagtctttaaaaag

SEQ ID NO: 330047 - DNA, 20 bp, Artificial Sequence
  chemically synthesized
gcaagttttccttcttttta

SEQ ID NO: 330048 - DNA, 20 bp, Artificial Sequence
  chemically synthesized
ttattcagtctttaaaaaga

SEQ ID NO: 330049 - DNA, 20 bp, Artificial Sequence
  chemically synthesized
tccaacttgtcacatattgc

SEQ ID NO: 330050 - DNA, 20 bp, Artificial Sequence
  chemically synthesized
gaaaacttgcaatatgtgac

SEQ ID NO: 330051 - DNA, 20 bp, Artificial Sequence
  chemically synthesized
acttgcaatatgtgacaagt

SEQ ID NO: 330052 - DNA, 20 bp, Artificial Sequence
  chemically synthesized
gacaagttggatgaaccttg

SEQ ID NO: 330053 - DNA, 20 bp, Artificial Sequence
  chemically synthesized
acaagttggatgaaccttga

SEQ ID NO: 330054 - DNA, 20 bp, Artificial Sequence
  chemically synthesized
tcatttacaatataccttca

SEQ ID NO: 330055 - DNA, 20 bp, Artificial Sequence
  chemically synthesized
ttcatttacaatataccttc

SEQ ID NO: 330056 - DNA, 20 bp, Artificial Sequence
  chemically synthesized
aggtatattgtaaatgaaaa

SEQ ID NO: 330057 - DNA, 20 bp, Artificial Sequence
  chemically synthesized
atattgtaaatgaaaaaagc

SEQ ID NO: 330058 - DNA, 20 bp, Artificial Sequence
  chemically synthesized
taaatgaaaaaagctagaca

SEQ ID NO: 330059 - DNA, 20 bp, Artificial Sequence
  chemically synthesized
agtatttgtatttctgtgtc

SEQ ID NO: 330060 - DNA, 20 bp, Artificial Sequence
  chemically synthesized
ctggtgtgagtagaatcatg

SEQ ID NO: 330061 - DNA, 20 bp, Artificial Sequence
  chemically synthesized
cttcatgattctactcacac

SEQ ID NO: 330062 - DNA, 20 bp, Artificial Sequence
  chemically synthesized
ttttagatacctggtgtgag

SEQ ID NO: 330063 - DNA, 20 bp, Artificial Sequence
  chemically synthesized
ttcatgattctactcacacc

SEQ ID NO: 330064 - DNA, 20 bp, Artificial Sequence
  chemically synthesized
caattttagatacctggtgt

SEQ ID NO: 330065 - DNA, 20 bp, Artificial Sequence
  chemically synthesized
gtttggcaattttagatacc

SEQ ID NO: 330066 - DNA, 20 bp, Artificial Sequence
  chemically synthesized
ttctctgagtttggcaattt

SEQ ID NO: 330067 - DNA, 20 bp, Artificial Sequence
  chemically synthesized
gtatctaaaattgccaaact

SEQ ID NO: 330068 - DNA, 20 bp, Artificial Sequence
  chemically synthesized
atctaaaattgccaaactca

SEQ ID NO: 330069 - DNA, 20 bp, Artificial Sequence
  chemically synthesized
aatctctgattctctgagtt

SEQ ID NO: 330070 - DNA, 20 bp, Artificial Sequence
  chemically synthesized
aattgccaaactcagagaat

SEQ ID NO: 330071 - DNA, 20 bp, Artificial Sequence
  chemically synthesized
actctaatctctgattctct

SEQ ID NO: 330072 - DNA, 20 bp, Artificial Sequence
  chemically synthesized
ttgccaaactcagagaatca

SEQ ID NO: 330073 - DNA, 20 bp, Artificial Sequence
  chemically synthesized
aaactcagagaatcagagat

SEQ ID NO: 330074 - DNA, 20 bp, Artificial Sequence
  chemically synthesized
actcagagaatcagagatta

SEQ ID NO: 330075 - DNA, 20 bp, Artificial Sequence
  chemically synthesized
cagagaatcagagattagag

SEQ ID NO: 330076 - DNA, 20 bp, Artificial Sequence
  chemically synthesized
agaatcagagattagagtgg

SEQ ID NO: 330077 - DNA, 20 bp, Artificial Sequence
  chemically synthesized
gagattagagtggtggcttt

SEQ ID NO: 330078 - DNA, 20 bp, Artificial Sequence
  chemically synthesized
gattagagtggtggctttta

SEQ ID NO: 330079 - DNA, 20 bp, Artificial Sequence
  chemically synthesized
attagagtggtggcttttag

SEQ ID NO: 330080 - DNA, 20 bp, Artificial Sequence
  chemically synthesized
ctcctcctttcagcctctaa

SEQ ID NO: 330081 - DNA, 20 bp, Artificial Sequence
  chemically synthesized
tggtggcttttagaggctga

SEQ ID NO: 330082 - DNA, 20 bp, Artificial Sequence
  chemically synthesized
ggtggcttttagaggctgaa

SEQ ID NO: 330083 - DNA, 20 bp, Artificial Sequence
  chemically synthesized
tggcttttagaggctgaaag

SEQ ID NO: 330084 - DNA, 20 bp, Artificial Sequence
  chemically synthesized
ggcttttagaggctgaaagg

SEQ ID NO: 330085 - DNA, 20 bp, Artificial Sequence
  chemically synthesized
cttttagaggctgaaaggag

SEQ ID NO: 330086 - DNA, 20 bp, Artificial Sequence
  chemically synthesized
tccccattttctcctccttt

SEQ ID NO: 330087 - DNA, 20 bp, Artificial Sequence
  chemically synthesized
aggctgaaaggaggagaaaa

SEQ ID NO: 330088 - DNA, 20 bp, Artificial Sequence
  chemically synthesized
ggctgaaaggaggagaaaat

SEQ ID NO: 330089 - DNA, 20 bp, Artificial Sequence
  chemically synthesized
gctgaaaggaggagaaaatg

SEQ ID NO: 330090 - DNA, 20 bp, Artificial Sequence
  chemically synthesized
aatggggaaatgctaattaa

SEQ ID NO: 330091 - DNA, 20 bp, Artificial Sequence
  chemically synthesized
atggggaaatgctaattaat

SEQ ID NO: 330092 - DNA, 20 bp, Artificial Sequence
  chemically synthesized
aaaattttatgcccattaat

SEQ ID NO: 330093 - DNA, 20 bp, Artificial Sequence
  chemically synthesized
gcataaaattttcatcatgc

SEQ ID NO: 330094 - DNA, 20 bp, Artificial Sequence
  chemically synthesized
tgcaagatgaataaattcta

SEQ ID NO: 330095 - DNA, 20 bp, Artificial Sequence
  chemically synthesized
aacgttgtgtagcagatctt

SEQ ID NO: 330096 - DNA, 20 bp, Artificial Sequence
  chemically synthesized
ttagagacaacgttgtgtag

SEQ ID NO: 330097 - DNA, 20 bp, Artificial Sequence
  chemically synthesized
ttattagagacaacgttgtg

SEQ ID NO: 330098 - DNA, 20 bp, Artificial Sequence
  chemically synthesized
tgtacaatacagtattatta

SEQ ID NO: 330099 - DNA, 20 bp, Artificial Sequence
  chemically synthesized
agtgtacaatacagtattat

SEQ ID NO: 330100 - DNA, 20 bp, Artificial Sequence
  chemically synthesized
accattttaagtgtacaata

SEQ ID NO: 330101 - DNA, 20 bp, Artificial Sequence
  chemically synthesized
actgtattgtacacttaaaa

SEQ ID NO: 330102 - DNA, 20 bp, Artificial Sequence
  chemically synthesized
atttatcaaataaccatttt

SEQ ID NO: 330103 - DNA, 20 bp, Artificial Sequence
  chemically synthesized
ggttatttgataaatctgtt

SEQ ID NO: 330104 - DNA, 20 bp, Artificial Sequence
  chemically synthesized
tcttctgtaaggacactcaa

SEQ ID NO: 330105 - DNA, 20 bp, Artificial Sequence
  chemically synthesized
aaatctgttgagtgtcctta

SEQ ID NO: 330106 - DNA, 20 bp, Artificial Sequence
  chemically synthesized
tctgttgagtgtccttacag

SEQ ID NO: 330107 - DNA, 20 bp, Artificial Sequence
  chemically synthesized
aactgttcttttcttctgta

SEQ ID NO: 330108 - DNA, 20 bp, Artificial Sequence
  chemically synthesized
aaactgttcttttcttctgt

SEQ ID NO: 330109 - DNA, 20 bp, Artificial Sequence
  chemically synthesized
tgagtgtccttacagaagaa

SEQ ID NO: 330110 - DNA, 20 bp, Artificial Sequence
  chemically synthesized
gtccttacagaagaaaagaa

SEQ ID NO: 330111 - DNA, 20 bp, Artificial Sequence
  chemically synthesized
caaatgttttatgtatcaca

SEQ ID NO: 330112 - DNA, 20 bp, Artificial Sequence
  chemically synthesized
atgttttatgtatcacaaag

SEQ ID NO: 330113 - DNA, 20 bp, Artificial Sequence
  chemically synthesized
aagcagatgatgatgcccta

SEQ ID NO: 330114 - DNA, 20 bp, Artificial Sequence
  chemically synthesized
tgttagcaagaaacaccata

SEQ ID NO: 330115 - DNA, 20 bp, Artificial Sequence
  chemically synthesized
ttgttagcaagaaacaccat

SEQ ID NO: 330116 - DNA, 20 bp, Artificial Sequence
  chemically synthesized
attgttagcaagaaacacca

SEQ ID NO: 330117 - DNA, 20 bp, Artificial Sequence
  chemically synthesized
atgtgttgaaaattgttagc

SEQ ID NO: 330118 - DNA, 20 bp, Artificial Sequence
  chemically synthesized
aaaaatgtgttgaaaattgt

SEQ ID NO: 330119 - DNA, 20 bp, Artificial Sequence
  chemically synthesized
tttcaacacattttttatgt

SEQ ID NO: 330120 - DNA, 20 bp, Artificial Sequence
  chemically synthesized
ttcaacacattttttatgta

SEQ ID NO: 330121 - DNA, 20 bp, Artificial Sequence
  chemically synthesized
ttttgtctatttggatattt

SEQ ID NO: 330122 - DNA, 20 bp, Artificial Sequence
  chemically synthesized
tgtcaactaaaatatccaaa

SEQ ID NO: 330123 - DNA, 20 bp, Artificial Sequence
  chemically synthesized
tgtgctcacttttgtctatt

SEQ ID NO: 330124 - DNA, 20 bp, Artificial Sequence
  chemically synthesized
taaaatatccaaatagacaa

SEQ ID NO: 330125 - DNA, 20 bp, Artificial Sequence
  chemically synthesized
atatccaaatagacaaaagt

SEQ ID NO: 330126 - DNA, 20 bp, Artificial Sequence
  chemically synthesized
acaaaagtgagcacaatgtg

SEQ ID NO: 330127 - DNA, 20 bp, Artificial Sequence
  chemically synthesized
aatgtgcagtaatatacctt

SEQ ID NO: 330128 - DNA, 20 bp, Artificial Sequence
  chemically synthesized
cttactaaatgtgtgactta

SEQ ID NO: 330129 - DNA, 20 bp, Artificial Sequence
  chemically synthesized
acttactaaatgtgtgactt

SEQ ID NO: 330130 - DNA, 20 bp, Artificial Sequence
  chemically synthesized
tataccttaagtcacacatt

SEQ ID NO: 330131 - DNA, 20 bp, Artificial Sequence
  chemically synthesized
ccttaagtcacacatttagt

SEQ ID NO: 330132 - DNA, 20 bp, Artificial Sequence
  chemically synthesized
taagtcacacatttagtaag

SEQ ID NO: 330133 - DNA, 20 bp, Artificial Sequence
  chemically synthesized
gtcacacatttagtaagtag

SEQ ID NO: 330134 - DNA, 20 bp, Artificial Sequence
  chemically synthesized
catttagtaagtagcagaac

SEQ ID NO: 330135 - DNA, 20 bp, Artificial Sequence
  chemically synthesized
aagtagcagaaccagaatta

SEQ ID NO: 330136 - DNA, 20 bp, Artificial Sequence
  chemically synthesized
ctgacttttatctgtaattc

SEQ ID NO: 330137 - DNA, 20 bp, Artificial Sequence
  chemically synthesized
agaaccagaattacagataa

SEQ ID NO: 330138 - DNA, 20 bp, Artificial Sequence
  chemically synthesized
ccagaattacagataaaagt

SEQ ID NO: 330139 - DNA, 20 bp, Artificial Sequence
  chemically synthesized
cagataaaagtcagactgat

SEQ ID NO: 330140 - DNA, 20 bp, Artificial Sequence
  chemically synthesized
acgcaaacacagttgctaat

SEQ ID NO: 330141 - DNA, 20 bp, Artificial Sequence
  chemically synthesized
cacacacggacacgcaaaca

SEQ ID NO: 330142 - DNA, 20 bp, Artificial Sequence
  chemically synthesized
cacacacacacacacacaca

SEQ ID NO: 330143 - DNA, 20 bp, Artificial Sequence
  chemically synthesized
ttgtgttgtgtatgtgtgta

SEQ ID NO: 330144 - DNA, 20 bp, Artificial Sequence
  chemically synthesized
tgtgttgtgtatgtgtgtat

SEQ ID NO: 330145 - DNA, 20 bp, Artificial Sequence
  chemically synthesized
gttgtgtatgtgtgtatggg

SEQ ID NO: 330146 - DNA, 20 bp, Artificial Sequence
  chemically synthesized
ttgtgtatgtgtgtatgggt

SEQ ID NO: 330147 - DNA, 20 bp, Artificial Sequence
  chemically synthesized
tgggtgggtgcctacatgct

SEQ ID NO: 330148 - DNA, 20 bp, Artificial Sequence
  chemically synthesized
ttaaaatatactaagcatgt

SEQ ID NO: 330149 - DNA, 20 bp, Artificial Sequence
  chemically synthesized
attaaaatatactaagcatg

SEQ ID NO: 330150 - DNA, 20 bp, Artificial Sequence
  chemically synthesized
ttaggagattaaaatatact

SEQ ID NO: 330151 - DNA, 20 bp, Artificial Sequence
  chemically synthesized
cagttgccctttgattttag

SEQ ID NO: 330152 - DNA, 20 bp, Artificial Sequence
  chemically synthesized
attttaatctcctaaaatca

SEQ ID NO: 330153 - DNA, 20 bp, Artificial Sequence
  chemically synthesized
gacagttgccctttgatttt

SEQ ID NO: 330154 - DNA, 20 bp, Artificial Sequence
  chemically synthesized
ttttaatctcctaaaatcaa

SEQ ID NO: 330155 - DNA, 20 bp, Artificial Sequence
  chemically synthesized
ggacagttgccctttgattt

SEQ ID NO: 330156 - DNA, 20 bp, Artificial Sequence
  chemically synthesized
tttaatctcctaaaatcaaa

SEQ ID NO: 330157 - DNA, 20 bp, Artificial Sequence
  chemically synthesized
aaaatcaaagggcaactgtc

SEQ ID NO: 330158 - DNA, 20 bp, Artificial Sequence
  chemically synthesized
aaatcaaagggcaactgtcc

SEQ ID NO: 330159 - DNA, 20 bp, Artificial Sequence
  chemically synthesized
tgtactcatattggcctgga

SEQ ID NO: 330160 - DNA, 20 bp, Artificial Sequence
  chemically synthesized
agaatgtactcatattggcc

SEQ ID NO: 330161 - DNA, 20 bp, Artificial Sequence
  chemically synthesized
gcaactgtccaggccaatat

SEQ ID NO: 330162 - DNA, 20 bp, Artificial Sequence
  chemically synthesized
ttcgtagaatgtactcatat

SEQ ID NO: 330163 - DNA, 20 bp, Artificial Sequence
  chemically synthesized
atgagtacattctacgaaac

SEQ ID NO: 330164 - DNA, 20 bp, Artificial Sequence
  chemically synthesized
tagtgtttattcttgtttcg

SEQ ID NO: 330165 - DNA, 20 bp, Artificial Sequence
  chemically synthesized
gtagagaagggatcacatgt

SEQ ID NO: 330166 - DNA, 20 bp, Artificial Sequence
  chemically synthesized
aatgagggaggagtagagaa

SEQ ID NO: 330167 - DNA, 20 bp, Artificial Sequence
  chemically synthesized
gaatgagggaggagtagaga

SEQ ID NO: 330168 - DNA, 20 bp, Artificial Sequence
  chemically synthesized
agaatgagggaggagtagag

SEQ ID NO: 330169 - DNA, 20 bp, Artificial Sequence
  chemically synthesized
gagagaatgagggaggagta

SEQ ID NO: 330170 - DNA, 20 bp, Artificial Sequence
  chemically synthesized
gtgagagaatgagggaggag

SEQ ID NO: 330171 - DNA, 20 bp, Artificial Sequence
  chemically synthesized
actgtgagagaatgagggag

SEQ ID NO: 330172 - DNA, 20 bp, Artificial Sequence
  chemically synthesized
tgactgtgagagaatgaggg

SEQ ID NO: 330173 - DNA, 20 bp, Artificial Sequence
  chemically synthesized
ctgactgtgagagaatgagg

SEQ ID NO: 330174 - DNA, 20 bp, Artificial Sequence
  chemically synthesized
ctctgactgtgagagaatga

SEQ ID NO: 330175 - DNA, 20 bp, Artificial Sequence
  chemically synthesized
actctgactgtgagagaatg

SEQ ID NO: 330176 - DNA, 20 bp, Artificial Sequence
  chemically synthesized
aactctgactgtgagagaat

SEQ ID NO: 330177 - DNA, 20 bp, Artificial Sequence
  chemically synthesized
actcctccctcattctctca

SEQ ID NO: 330178 - DNA, 20 bp, Artificial Sequence
  chemically synthesized
ctccctcattctctcacagt

SEQ ID NO: 330179 - DNA, 20 bp, Artificial Sequence
  chemically synthesized
taatataactctgactgtga

SEQ ID NO: 330180 - DNA, 20 bp, Artificial Sequence
  chemically synthesized
ccctcattctctcacagtca

SEQ ID NO: 330181 - DNA, 20 bp, Artificial Sequence
  chemically synthesized
gataatataactctgactgt

SEQ ID NO: 330182 - DNA, 20 bp, Artificial Sequence
  chemically synthesized
ttttggtcatggggcaggga

SEQ ID NO: 330183 - DNA, 20 bp, Artificial Sequence
  chemically synthesized
tcttttttggtcatggggca

SEQ ID NO: 330184 - DNA, 20 bp, Artificial Sequence
  chemically synthesized
ttcttttttggtcatggggc

SEQ ID NO: 330185 - DNA, 20 bp, Artificial Sequence
  chemically synthesized
attcttttttggtcatgggg

SEQ ID NO: 330186 - DNA, 20 bp, Artificial Sequence
  chemically synthesized
cagattcttttttggtcatg

SEQ ID NO: 330187 - DNA, 20 bp, Artificial Sequence
  chemically synthesized
acagattcttttttggtcat

SEQ ID NO: 330188 - DNA, 20 bp, Artificial Sequence
  chemically synthesized
cacagattcttttttggtca

SEQ ID NO: 330189 - DNA, 20 bp, Artificial Sequence
  chemically synthesized
tccctgccccatgaccaaaa

SEQ ID NO: 330190 - DNA, 20 bp, Artificial Sequence
  chemically synthesized
gaaaagcacagattcttttt

SEQ ID NO: 330191 - DNA, 20 bp, Artificial Sequence
  chemically synthesized
aggacagaatgtgaaaagca

SEQ ID NO: 330192 - DNA, 20 bp, Artificial Sequence
  chemically synthesized
cacaaaggacagaatgtgaa

SEQ ID NO: 330193 - DNA, 20 bp, Artificial Sequence
  chemically synthesized
aattttctcttcacaaagga

SEQ ID NO: 330194 - DNA, 20 bp, Artificial Sequence
  chemically synthesized
ttcacattctgtcctttgtg

SEQ ID NO: 330195 - DNA, 20 bp, Artificial Sequence
  chemically synthesized
cacattctgtcctttgtgaa

SEQ ID NO: 330196 - DNA, 20 bp, Artificial Sequence
  chemically synthesized
gtcaaattttctcttcacaa

SEQ ID NO: 330197 - DNA, 20 bp, Artificial Sequence
  chemically synthesized
agtcaaattttctcttcaca

SEQ ID NO: 330198 - DNA, 20 bp, Artificial Sequence
  chemically synthesized
ttgtgaagagaaaatttgac

SEQ ID NO: 330199 - DNA, 20 bp, Artificial Sequence
  chemically synthesized
gtgcgtaagtttatgttgac

SEQ ID NO: 330200 - DNA, 20 bp, Artificial Sequence
  chemically synthesized
acaggagtgacaacgtgcgt

SEQ ID NO: 330201 - DNA, 20 bp, Artificial Sequence
  chemically synthesized
tttattagaattattcacag

SEQ ID NO: 330202 - DNA, 20 bp, Artificial Sequence
  chemically synthesized
tatttattagaattattcac

SEQ ID NO: 330203 - DNA, 20 bp, Artificial Sequence
  chemically synthesized
ttatttattagaattattca

SEQ ID NO: 330204 - DNA, 20 bp, Artificial Sequence
  chemically synthesized
gttcctagtcatttatttat

SEQ ID NO: 330205 - DNA, 20 bp, Artificial Sequence
  chemically synthesized
aattctaataaataaatgac

SEQ ID NO: 330206 - DNA, 20 bp, Artificial Sequence
  chemically synthesized
attctaataaataaatgact

SEQ ID NO: 330207 - DNA, 20 bp, Artificial Sequence
  chemically synthesized
aaggagggagtcaaagttcc

SEQ ID NO: 330208 - DNA, 20 bp, Artificial Sequence
  chemically synthesized
aagttgtaaggagggagtca

SEQ ID NO: 330209 - DNA, 20 bp, Artificial Sequence
  chemically synthesized
ttgccaaagttgtaaggagg

SEQ ID NO: 330210 - DNA, 20 bp, Artificial Sequence
  chemically synthesized
tattgccaaagttgtaagga

SEQ ID NO: 330211 - DNA, 20 bp, Artificial Sequence
  chemically synthesized
ttattgccaaagttgtaagg

SEQ ID NO: 330212 - DNA, 20 bp, Artificial Sequence
  chemically synthesized
tttattgccaaagttgtaag

SEQ ID NO: 330213 - DNA, 20 bp, Artificial Sequence
  chemically synthesized
gttttattgccaaagttgta

SEQ ID NO: 330214 - DNA, 20 bp, Artificial Sequence
  chemically synthesized
tgactccctccttacaactt

SEQ ID NO: 330215 - DNA, 20 bp, Artificial Sequence
  chemically synthesized
tgttttattgccaaagttgt

SEQ ID NO: 330216 - DNA, 20 bp, Artificial Sequence
  chemically synthesized
aaaaatctgttttattgcca

SEQ ID NO: 330217 - DNA, 20 bp, Artificial Sequence
  chemically synthesized
ttacaactttggcaataaaa

SEQ ID NO: 330218 - DNA, 20 bp, Artificial Sequence
  chemically synthesized
tttaaacatataatttgcat

SEQ ID NO: 330219 - DNA, 20 bp, Artificial Sequence
  chemically synthesized
acataaaacaaatgtactga

SEQ ID NO: 330220 - DNA, 20 bp, Artificial Sequence
  chemically synthesized
ataatagttgttttttcttt

SEQ ID NO: 330221 - DNA, 20 bp, Artificial Sequence
  chemically synthesized
aaagaaaaaacaactattat

SEQ ID NO: 330222 - DNA, 20 bp, Artificial Sequence
  chemically synthesized
aagaaaaaacaactattatg

SEQ ID NO: 330223 - DNA, 20 bp, Artificial Sequence
  chemically synthesized
tgttatacatgacctcataa

SEQ ID NO: 330224 - DNA, 20 bp, Artificial Sequence
  chemically synthesized
tagtgtgttaggtttatcag

SEQ ID NO: 330225 - DNA, 20 bp, Artificial Sequence
  chemically synthesized
ttttagtgtgttaggtttat

SEQ ID NO: 330226 - DNA, 20 bp, Artificial Sequence
  chemically synthesized
atcttactttttagtgtgtt

SEQ ID NO: 330227 - DNA, 20 bp, Artificial Sequence
  chemically synthesized
tatcttactttttagtgtgt

SEQ ID NO: 330228 - DNA, 20 bp, Artificial Sequence
  chemically synthesized
gataaacctaacacactaaa

SEQ ID NO: 330229 - DNA, 20 bp, Artificial Sequence
  chemically synthesized
aacctaacacactaaaaagt

SEQ ID NO: 330230 - DNA, 20 bp, Artificial Sequence
  chemically synthesized
ttgagacttatcttactttt

SEQ ID NO: 330231 - DNA, 20 bp, Artificial Sequence
  chemically synthesized
aacacactaaaaagtaagat

SEQ ID NO: 330232 - DNA, 20 bp, Artificial Sequence
  chemically synthesized
aaaaagtaagataagtctca

SEQ ID NO: 330233 - DNA, 20 bp, Artificial Sequence
  chemically synthesized
tatttttttccagtgacttt

SEQ ID NO: 330234 - DNA, 20 bp, Artificial Sequence
  chemically synthesized
aagataagtctcaaagtcac

SEQ ID NO: 330235 - DNA, 20 bp, Artificial Sequence
  chemically synthesized
tttcattacatatttttttc

SEQ ID NO: 330236 - DNA, 20 bp, Artificial Sequence
  chemically synthesized
aatatgtaatgaaaaattta

SEQ ID NO: 330237 - DNA, 20 bp, Artificial Sequence
  chemically synthesized
gcactgtcctatatttttgt

SEQ ID NO: 330238 - DNA, 20 bp, Artificial Sequence
  chemically synthesized
ttataaatcttacaaaaata

SEQ ID NO: 330239 - DNA, 20 bp, Artificial Sequence
  chemically synthesized
tataaatcttacaaaaatat

SEQ ID NO: 330240 - DNA, 20 bp, Artificial Sequence
  chemically synthesized
aatcttacaaaaatatagga

SEQ ID NO: 330241 - DNA, 20 bp, Artificial Sequence
  chemically synthesized
tattaatcactcagataatt

SEQ ID NO: 330242 - DNA, 20 bp, Artificial Sequence
  chemically synthesized
aggacagtgcctaattatct

SEQ ID NO: 330243 - DNA, 20 bp, Artificial Sequence
  chemically synthesized
atattaatcactcagataat

SEQ ID NO: 330244 - DNA, 20 bp, Artificial Sequence
  chemically synthesized
acctagcaatattaatcact

SEQ ID NO: 330245 - DNA, 20 bp, Artificial Sequence
  chemically synthesized
atctgagtgattaatattgc

SEQ ID NO: 330246 - DNA, 20 bp, Artificial Sequence
  chemically synthesized
tctgagtgattaatattgct

SEQ ID NO: 330247 - DNA, 20 bp, Artificial Sequence
  chemically synthesized
attaatattgctaggtatgc

SEQ ID NO: 330248 - DNA, 20 bp, Artificial Sequence
  chemically synthesized
ctgatctcccctagcatacc

SEQ ID NO: 330249 - DNA, 20 bp, Artificial Sequence
  chemically synthesized
ttaatattgctaggtatgct

SEQ ID NO: 330250 - DNA, 20 bp, Artificial Sequence
  chemically synthesized
taatattgctaggtatgcta

SEQ ID NO: 330251 - DNA, 20 bp, Artificial Sequence
  chemically synthesized
aatattgctaggtatgctag

SEQ ID NO: 330252 - DNA, 20 bp, Artificial Sequence
  chemically synthesized
tattgctaggtatgctaggg

SEQ ID NO: 330253 - DNA, 20 bp, Artificial Sequence
  chemically synthesized
aagcattggctgatctcccc

SEQ ID NO: 330254 - DNA, 20 bp, Artificial Sequence
  chemically synthesized
ctaggtatgctaggggagat

SEQ ID NO: 330255 - DNA, 20 bp, Artificial Sequence
  chemically synthesized
aggggagatcagccaatgct

SEQ ID NO: 330256 - DNA, 20 bp, Artificial Sequence
  chemically synthesized
tataacactggactaagcat

SEQ ID NO: 330257 - DNA, 20 bp, Artificial Sequence
  chemically synthesized
agatcagccaatgcttagtc

SEQ ID NO: 330258 - DNA, 20 bp, Artificial Sequence
  chemically synthesized
ctcaactataacactggact

SEQ ID NO: 330259 - DNA, 20 bp, Artificial Sequence
  chemically synthesized
caatgcttagtccagtgtta

SEQ ID NO: 330260 - DNA, 20 bp, Artificial Sequence
  chemically synthesized
aaaaggctcaactataacac

SEQ ID NO: 330261 - DNA, 20 bp, Artificial Sequence
  chemically synthesized
cttagtccagtgttatagtt

SEQ ID NO: 330262 - DNA, 20 bp, Artificial Sequence
  chemically synthesized
tataactgtagaaatacaaa

SEQ ID NO: 330263 - DNA, 20 bp, Artificial Sequence
  chemically synthesized
atataactgtagaaatacaa

SEQ ID NO: 330264 - DNA, 20 bp, Artificial Sequence
  chemically synthesized
ttgagccttttgtatttcta

SEQ ID NO: 330265 - DNA, 20 bp, Artificial Sequence
  chemically synthesized
tgaagcaaaacatataactg

SEQ ID NO: 330266 - DNA, 20 bp, Artificial Sequence
  chemically synthesized
atatgttttgcttcatgata

SEQ ID NO: 330267 - DNA, 20 bp, Artificial Sequence
  chemically synthesized
tccaattataccatatcatg

SEQ ID NO: 330268 - DNA, 20 bp, Artificial Sequence
  chemically synthesized
gcttcatgatatggtataat

SEQ ID NO: 330269 - DNA, 20 bp, Artificial Sequence
  chemically synthesized
ttcatgatatggtataattg

SEQ ID NO: 330270 - DNA, 20 bp, Artificial Sequence
  chemically synthesized
gtataattggagttattcca

SEQ ID NO: 330271 - DNA, 20 bp, Artificial Sequence
  chemically synthesized
tataattggagttattccac

SEQ ID NO: 330272 - DNA, 20 bp, Artificial Sequence
  chemically synthesized
ataattggagttattccaca

SEQ ID NO: 330273 - DNA, 20 bp, Artificial Sequence
  chemically synthesized
taattggagttattccacag

SEQ ID NO: 330274 - DNA, 20 bp, Artificial Sequence
  chemically synthesized
ttggagttattccacagggg

SEQ ID NO: 330275 - DNA, 20 bp, Artificial Sequence
  chemically synthesized
ccttctattaacttcccctg

SEQ ID NO: 330276 - DNA, 20 bp, Artificial Sequence
  chemically synthesized
tattccacaggggaagttaa

SEQ ID NO: 330277 - DNA, 20 bp, Artificial Sequence
  chemically synthesized
tccacaggggaagttaatag

SEQ ID NO: 330278 - DNA, 20 bp, Artificial Sequence
  chemically synthesized
ccacaggggaagttaataga

SEQ ID NO: 330279 - DNA, 20 bp, Artificial Sequence
  chemically synthesized
aggggaagttaatagaagga

SEQ ID NO: 330280 - DNA, 20 bp, Artificial Sequence
  chemically synthesized
gttaatagaaggaaagaata

SEQ ID NO: 330281 - DNA, 20 bp, Artificial Sequence
  chemically synthesized
tagaaggaaagaataaagat

SEQ ID NO: 330282 - DNA, 20 bp, Artificial Sequence
  chemically synthesized
aagaataaagatcagaacaa

SEQ ID NO: 330283 - DNA, 20 bp, Artificial Sequence
  chemically synthesized
cagaacaaaagtaaataaaa

SEQ ID NO: 330284 - DNA, 20 bp, Artificial Sequence
  chemically synthesized
aaagtaaataaaatagaaac

SEQ ID NO: 330285 - DNA, 20 bp, Artificial Sequence
  chemically synthesized
actattttctattgtttttc

SEQ ID NO: 330286 - DNA, 20 bp, Artificial Sequence
  chemically synthesized
aatagaaactagaaaaacaa

SEQ ID NO: 330287 - DNA, 20 bp, Artificial Sequence
  chemically synthesized
actagaaaaacaatagaaaa

SEQ ID NO: 330288 - DNA, 20 bp, Artificial Sequence
  chemically synthesized
caatagaaaatagtaacaac

SEQ ID NO: 330289 - DNA, 20 bp, Artificial Sequence
  chemically synthesized
aatagaaaatagtaacaacg

SEQ ID NO: 330290 - DNA, 20 bp, Artificial Sequence
  chemically synthesized
aaatagtaacaacgaggttt

SEQ ID NO: 330291 - DNA, 20 bp, Artificial Sequence
  chemically synthesized
ttggtttttttttttgtgaa

SEQ ID NO: 330292 - DNA, 20 bp, Artificial Sequence
  chemically synthesized
tttttttttttgtgaaaaga

SEQ ID NO: 330293 - DNA, 20 bp, Artificial Sequence
  chemically synthesized
ttttttgtgaaaagatagac

SEQ ID NO: 330294 - DNA, 20 bp, Artificial Sequence
  chemically synthesized
agtaaatgtcaagaacaagc

SEQ ID NO: 330295 - DNA, 20 bp, Artificial Sequence
  chemically synthesized
aatcagtaaatgtcaagaac

SEQ ID NO: 330296 - DNA, 20 bp, Artificial Sequence
  chemically synthesized
ttgtggaatcagtaaatgtc

SEQ ID NO: 330297 - DNA, 20 bp, Artificial Sequence
  chemically synthesized
tgaattgcatattgtggaat

SEQ ID NO: 330298 - DNA, 20 bp, Artificial Sequence
  chemically synthesized
taaatctgaattgcatattg

SEQ ID NO: 330299 - DNA, 20 bp, Artificial Sequence
  chemically synthesized
tgattccacaatatgcaatt

SEQ ID NO: 330300 - DNA, 20 bp, Artificial Sequence
  chemically synthesized
cacaatatgcaattcagatt

SEQ ID NO: 330301 - DNA, 20 bp, Artificial Sequence
  chemically synthesized
tatgcaattcagatttagta

SEQ ID NO: 330302 - DNA, 20 bp, Artificial Sequence
  chemically synthesized
agtaaagaacatttactgaa

SEQ ID NO: 330303 - DNA, 20 bp, Artificial Sequence
  chemically synthesized
gttgggtgacaatttccatt

SEQ ID NO: 330304 - DNA, 20 bp, Artificial Sequence
  chemically synthesized
acaaaaaaccagaaagagtt

SEQ ID NO: 330305 - DNA, 20 bp, Artificial Sequence
  chemically synthesized
gacaaaaaaccagaaagagt

SEQ ID NO: 330306 - DNA, 20 bp, Artificial Sequence
  chemically synthesized
aattgtcacccaactctttc

SEQ ID NO: 330307 - DNA, 20 bp, Artificial Sequence
  chemically synthesized
caaggacaaaaaaccagaaa

SEQ ID NO: 330308 - DNA, 20 bp, Artificial Sequence
  chemically synthesized
aacaaggacaaaaaaccaga

SEQ ID NO: 330309 - DNA, 20 bp, Artificial Sequence
  chemically synthesized
acttaacaaggacaaaaaac

SEQ ID NO: 330310 - DNA, 20 bp, Artificial Sequence
  chemically synthesized
tctggttttttgtccttgtt

SEQ ID NO: 330311 - DNA, 20 bp, Artificial Sequence
  chemically synthesized
ttttgttcattcacttaaca

SEQ ID NO: 330312 - DNA, 20 bp, Artificial Sequence
  chemically synthesized
attttgttcattcacttaac

SEQ ID NO: 330313 - DNA, 20 bp, Artificial Sequence
  chemically synthesized
gttaagtgaatgaacaaaat

SEQ ID NO: 330314 - DNA, 20 bp, Artificial Sequence
  chemically synthesized
gcgaaaaattttatgtccga

SEQ ID NO: 330315 - DNA, 20 bp, Artificial Sequence
  chemically synthesized
ccctagactttaagaacttt

SEQ ID NO: 330316 - DNA, 20 bp, Artificial Sequence
  chemically synthesized
tttatgtccgaaagttctta

SEQ ID NO: 330317 - DNA, 20 bp, Artificial Sequence
  chemically synthesized
gtccgaaagttcttaaagtc

SEQ ID NO: 330318 - DNA, 20 bp, Artificial Sequence
  chemically synthesized
tccgaaagttcttaaagtct

SEQ ID NO: 330319 - DNA, 20 bp, Artificial Sequence
  chemically synthesized
aaatgtttcccctagacttt

SEQ ID NO: 330320 - DNA, 20 bp, Artificial Sequence
  chemically synthesized
ccgaaagttcttaaagtcta

SEQ ID NO: 330321 - DNA, 20 bp, Artificial Sequence
  chemically synthesized
cgaaagttcttaaagtctag

SEQ ID NO: 330322 - DNA, 20 bp, Artificial Sequence
  chemically synthesized
ttcataagaaatgtttcccc

SEQ ID NO: 330323 - DNA, 20 bp, Artificial Sequence
  chemically synthesized
ttgaattacatttagttcat

SEQ ID NO: 330324 - DNA, 20 bp, Artificial Sequence
  chemically synthesized
aaatgtttttgaattacatt

SEQ ID NO: 330325 - DNA, 20 bp, Artificial Sequence
  chemically synthesized
tgtaattcaaaaacatttaa

SEQ ID NO: 330326 - DNA, 20 bp, Artificial Sequence
  chemically synthesized
aattcaaaaacatttaacag

SEQ ID NO: 330327 - DNA, 20 bp, Artificial Sequence
  chemically synthesized
attcaaaaacatttaacaga

SEQ ID NO: 330328 - DNA, 20 bp, Artificial Sequence
  chemically synthesized
aacagaaggaatcttaatgt

SEQ ID NO: 330329 - DNA, 20 bp, Artificial Sequence
  chemically synthesized
acagaaggaatcttaatgtc

SEQ ID NO: 330330 - DNA, 20 bp, Artificial Sequence
  chemically synthesized
ttttctcactgcctgacatt

SEQ ID NO: 330331 - DNA, 20 bp, Artificial Sequence
  chemically synthesized
gaaggaatcttaatgtcagg

SEQ ID NO: 330332 - DNA, 20 bp, Artificial Sequence
  chemically synthesized
gaatcttaatgtcaggcagt

SEQ ID NO: 330333 - DNA, 20 bp, Artificial Sequence
  chemically synthesized
tgtcaggcagtgagaaaaaa

SEQ ID NO: 330334 - DNA, 20 bp, Artificial Sequence
  chemically synthesized
aggcagtgagaaaaaataga

SEQ ID NO: 330335 - DNA, 20 bp, Artificial Sequence
  chemically synthesized
tgagaaaaaatagaaagtca

SEQ ID NO: 330336 - DNA, 20 bp, Artificial Sequence
  chemically synthesized
tagaaagtcaaagatctcta

SEQ ID NO: 330337 - DNA, 20 bp, Artificial Sequence
  chemically synthesized
aagtcaaagatctctaaaga

SEQ ID NO: 330338 - DNA, 20 bp, Artificial Sequence
  chemically synthesized
agtcaaagatctctaaagat

SEQ ID NO: 330339 - DNA, 20 bp, Artificial Sequence
  chemically synthesized
tttcatcacccccatcttta

SEQ ID NO: 330340 - DNA, 20 bp, Artificial Sequence
  chemically synthesized
gtcaaagatctctaaagatg

SEQ ID NO: 330341 - DNA, 20 bp, Artificial Sequence
  chemically synthesized
tcaaagatctctaaagatgg

SEQ ID NO: 330342 - DNA, 20 bp, Artificial Sequence
  chemically synthesized
tttttcatcacccccatctt

SEQ ID NO: 330343 - DNA, 20 bp, Artificial Sequence
  chemically synthesized
taaagatgggggtgatgaaa

SEQ ID NO: 330344 - DNA, 20 bp, Artificial Sequence
  chemically synthesized
atgggggtgatgaaaaagaa

SEQ ID NO: 330345 - DNA, 20 bp, Artificial Sequence
  chemically synthesized
tgggggtgatgaaaaagaaa

SEQ ID NO: 330346 - DNA, 20 bp, Artificial Sequence
  chemically synthesized
atttccattttcataaaagg

SEQ ID NO: 330347 - DNA, 20 bp, Artificial Sequence
  chemically synthesized
agtatttccattttcataaa

SEQ ID NO: 330348 - DNA, 20 bp, Artificial Sequence
  chemically synthesized
tagtatttccattttcataa

SEQ ID NO: 330349 - DNA, 20 bp, Artificial Sequence
  chemically synthesized
ggaactgccttttatgaaaa

SEQ ID NO: 330350 - DNA, 20 bp, Artificial Sequence
  chemically synthesized
ctaccccccagtaaacaaaa

SEQ ID NO: 330351 - DNA, 20 bp, Artificial Sequence
  chemically synthesized
ggaaatactattttgtttac

SEQ ID NO: 330352 - DNA, 20 bp, Artificial Sequence
  chemically synthesized
gaaatactattttgtttact

SEQ ID NO: 330353 - DNA, 20 bp, Artificial Sequence
  chemically synthesized
aaatactattttgtttactg

SEQ ID NO: 330354 - DNA, 20 bp, Artificial Sequence
  chemically synthesized
aatactattttgtttactgg

SEQ ID NO: 330355 - DNA, 20 bp, Artificial Sequence
  chemically synthesized
atactattttgtttactggg

SEQ ID NO: 330356 - DNA, 20 bp, Artificial Sequence
  chemically synthesized
ctattttgtttactgggggg

SEQ ID NO: 330357 - DNA, 20 bp, Artificial Sequence
  chemically synthesized
atttacctaaatctaccccc

SEQ ID NO: 330358 - DNA, 20 bp, Artificial Sequence
  chemically synthesized
tgtttactggggggtagatt

SEQ ID NO: 330359 - DNA, 20 bp, Artificial Sequence
  chemically synthesized
gtttactggggggtagattt

SEQ ID NO: 330360 - DNA, 20 bp, Artificial Sequence
  chemically synthesized
gatttaggtaaataataaaa

SEQ ID NO: 330361 - DNA, 20 bp, Artificial Sequence
  chemically synthesized
ttaggtaaataataaaatag

SEQ ID NO: 330362 - DNA, 20 bp, Artificial Sequence
  chemically synthesized
aataaaatagaagttttaat

SEQ ID NO: 330363 - DNA, 20 bp, Artificial Sequence
  chemically synthesized
aatagaagttttaattggca

SEQ ID NO: 330364 - DNA, 20 bp, Artificial Sequence
  chemically synthesized
ggtctttttcagcatgtttt

SEQ ID NO: 330365 - DNA, 20 bp, Artificial Sequence
  chemically synthesized
acacttaaaacatgctgaaa

SEQ ID NO: 330366 - DNA, 20 bp, Artificial Sequence
  chemically synthesized
ttgattgacgtggtcttttt

SEQ ID NO: 330367 - DNA, 20 bp, Artificial Sequence
  chemically synthesized
gtgagtaaaattgattgacg

SEQ ID NO: 330368 - DNA, 20 bp, Artificial Sequence
  chemically synthesized
gaaaaaaacatgtttaaagt

SEQ ID NO: 330369 - DNA, 20 bp, Artificial Sequence
  chemically synthesized
gaatgaaaaaaacatgttta

SEQ ID NO: 330370 - DNA, 20 bp, Artificial Sequence
  chemically synthesized
tttttttcattcccttttca

SEQ ID NO: 330371 - DNA, 20 bp, Artificial Sequence
  chemically synthesized
gtctcagtatactgtgaaaa

SEQ ID NO: 330372 - DNA, 20 bp, Artificial Sequence
  chemically synthesized
agtctcagtatactgtgaaa

SEQ ID NO: 330373 - DNA, 20 bp, Artificial Sequence
  chemically synthesized
cagtctcagtatactgtgaa

SEQ ID NO: 330374 - DNA, 20 bp, Artificial Sequence
  chemically synthesized
ttcccttttcacagtatact

SEQ ID NO: 330375 - DNA, 20 bp, Artificial Sequence
  chemically synthesized
tcttgtgtcagtttcagtct

SEQ ID NO: 330376 - DNA, 20 bp, Artificial Sequence
  chemically synthesized
aacgtttcttgtgtcagttt

SEQ ID NO: 330377 - DNA, 20 bp, Artificial Sequence
  chemically synthesized
actgagactgaaactgacac

SEQ ID NO: 330378 - DNA, 20 bp, Artificial Sequence
  chemically synthesized
ttagtgaacgtttcttgtgt

SEQ ID NO: 330379 - DNA, 20 bp, Artificial Sequence
  chemically synthesized
cgaaacgaacatcaacaatt

SEQ ID NO: 330380 - DNA, 20 bp, Artificial Sequence
  chemically synthesized
aaaaaaaagtacaaatatta

SEQ ID NO: 330381 - DNA, 20 bp, Artificial Sequence
  chemically synthesized
aaaaaaaaaagtacaaatat

SEQ ID NO: 330382 - DNA, 20 bp, Artificial Sequence
  chemically synthesized
aaaaaaaaaaaaaaaaaaaa

SEQ ID NO: 330383 - DNA, 20 bp, Artificial Sequence
  chemically synthesized
tttttttttttttttttttt

SEQ ID NO: 330384 - DNA, 20 bp, Artificial Sequence
  chemically synthesized
ttttttttttttttttgaga

SEQ ID NO: 330385 - DNA, 20 bp, Artificial Sequence
  chemically synthesized
ttttttttttttttgagacg

SEQ ID NO: 330386 - DNA, 20 bp, Artificial Sequence
  chemically synthesized
tccagcctgggtgacagagt

SEQ ID NO: 330387 - DNA, 20 bp, Artificial Sequence
  chemically synthesized
cggagtcttactctgtcacc

SEQ ID NO: 330388 - DNA, 20 bp, Artificial Sequence
  chemically synthesized
gcactccagcctgggtgaca

SEQ ID NO: 330389 - DNA, 20 bp, Artificial Sequence
  chemically synthesized
ggagtcttactctgtcaccc

SEQ ID NO: 330390 - DNA, 20 bp, Artificial Sequence
  chemically synthesized
ctgcactccagcctgggtga

SEQ ID NO: 330391 - DNA, 20 bp, Artificial Sequence
  chemically synthesized
tcttactctgtcacccaggc

SEQ ID NO: 330392 - DNA, 20 bp, Artificial Sequence
  chemically synthesized
ttactctgtcacccaggctg

SEQ ID NO: 330393 - DNA, 20 bp, Artificial Sequence
  chemically synthesized
gcgccactgcactccagcct

SEQ ID NO: 330394 - DNA, 20 bp, Artificial Sequence
  chemically synthesized
cgcgccactgcactccagcc

SEQ ID NO: 330395 - DNA, 20 bp, Artificial Sequence
  chemically synthesized
ctgtcacccaggctggagtg

SEQ ID NO: 330396 - DNA, 20 bp, Artificial Sequence
  chemically synthesized
gagatcgcgccactgcactc

SEQ ID NO: 330397 - DNA, 20 bp, Artificial Sequence
  chemically synthesized
tcacccaggctggagtgcag

SEQ ID NO: 330398 - DNA, 20 bp, Artificial Sequence
  chemically synthesized
ggagtgcagtggcgcgatct

SEQ ID NO: 330399 - DNA, 20 bp, Artificial Sequence
  chemically synthesized
ggcggaggttgcagtgagcc

SEQ ID NO: 330400 - DNA, 20 bp, Artificial Sequence
  chemically synthesized
ccagaggcggaggttgcagt

SEQ ID NO: 330401 - DNA, 20 bp, Artificial Sequence
  chemically synthesized
aaccccagaggcggaggttg

SEQ ID NO: 330402 - DNA, 20 bp, Artificial Sequence
  chemically synthesized
ctcactgcaacctccgcctc

SEQ ID NO: 330403 - DNA, 20 bp, Artificial Sequence
  chemically synthesized
cgcttgaaccccagaggcgg

SEQ ID NO: 330404 - DNA, 20 bp, Artificial Sequence
  chemically synthesized
tcactgcaacctccgcctct

SEQ ID NO: 330405 - DNA, 20 bp, Artificial Sequence
  chemically synthesized
tcgcttgaaccccagaggcg

SEQ ID NO: 330406 - DNA, 20 bp, Artificial Sequence
  chemically synthesized
cactgcaacctccgcctctg

SEQ ID NO: 330407 - DNA, 20 bp, Artificial Sequence
  chemically synthesized
aatcgcttgaaccccagagg

SEQ ID NO: 330408 - DNA, 20 bp, Artificial Sequence
  chemically synthesized
gagaatcgcttgaaccccag

SEQ ID NO: 330409 - DNA, 20 bp, Artificial Sequence
  chemically synthesized
ggagaatcgcttgaacccca

SEQ ID NO: 330410 - DNA, 20 bp, Artificial Sequence
  chemically synthesized
aacctccgcctctggggttc

SEQ ID NO: 330411 - DNA, 20 bp, Artificial Sequence
  chemically synthesized
caggagaatcgcttgaaccc

SEQ ID NO: 330412 - DNA, 20 bp, Artificial Sequence
  chemically synthesized
ttcaagcgattctcctgcct

SEQ ID NO: 330413 - DNA, 20 bp, Artificial Sequence
  chemically synthesized
ctactcagaggctgaggcag

SEQ ID NO: 330414 - DNA, 20 bp, Artificial Sequence
  chemically synthesized
agctactcagaggctgaggc

SEQ ID NO: 330415 - DNA, 20 bp, Artificial Sequence
  chemically synthesized
cagctactcagaggctgagg

SEQ ID NO: 330416 - DNA, 20 bp, Artificial Sequence
  chemically synthesized
tcccagctactcagaggctg

SEQ ID NO: 330417 - DNA, 20 bp, Artificial Sequence
  chemically synthesized
attctcctgcctcagcctct

SEQ ID NO: 330418 - DNA, 20 bp, Artificial Sequence
  chemically synthesized
ttcccagctactcagaggct

SEQ ID NO: 330419 - DNA, 20 bp, Artificial Sequence
  chemically synthesized
ctcctgcctcagcctctgag

SEQ ID NO: 330420 - DNA, 20 bp, Artificial Sequence
  chemically synthesized
ctgtattcccagctactcag

SEQ ID NO: 330421 - DNA, 20 bp, Artificial Sequence
  chemically synthesized
cctgtattcccagctactca

SEQ ID NO: 330422 - DNA, 20 bp, Artificial Sequence
  chemically synthesized
tgcctcagcctctgagtagc

SEQ ID NO: 330423 - DNA, 20 bp, Artificial Sequence
  chemically synthesized
gcctcagcctctgagtagct

SEQ ID NO: 330424 - DNA, 20 bp, Artificial Sequence
  chemically synthesized
tgcctgtattcccagctact

SEQ ID NO: 330425 - DNA, 20 bp, Artificial Sequence
  chemically synthesized
cctctgagtagctgggaata

SEQ ID NO: 330426 - DNA, 20 bp, Artificial Sequence
  chemically synthesized
ctctgagtagctgggaatac

SEQ ID NO: 330427 - DNA, 20 bp, Artificial Sequence
  chemically synthesized
gtggcacatgcctgtattcc

SEQ ID NO: 330428 - DNA, 20 bp, Artificial Sequence
  chemically synthesized
caggcatgtgccaccacacc

SEQ ID NO: 330429 - DNA, 20 bp, Artificial Sequence
  chemically synthesized
caaaaatcagccaggtgtgg

SEQ ID NO: 330430 - DNA, 20 bp, Artificial Sequence
  chemically synthesized
atacaaaaatcagccaggtg

SEQ ID NO: 330431 - DNA, 20 bp, Artificial Sequence
  chemically synthesized
taaaaatacaaaaatcagcc

SEQ ID NO: 330432 - DNA, 20 bp, Artificial Sequence
  chemically synthesized
gtaaaaatacaaaaatcagc

SEQ ID NO: 330433 - DNA, 20 bp, Artificial Sequence
  chemically synthesized
tcaagtaaaaatacaaaaat

SEQ ID NO: 330434 - DNA, 20 bp, Artificial Sequence
  chemically synthesized
tgatttttgtatttttactt

SEQ ID NO: 330435 - DNA, 20 bp, Artificial Sequence
  chemically synthesized
ttttgtatttttacttgaga

SEQ ID NO: 330436 - DNA, 20 bp, Artificial Sequence
  chemically synthesized
tttgtatttttacttgagac

SEQ ID NO: 330437 - DNA, 20 bp, Artificial Sequence
  chemically synthesized
ttgtatttttacttgagacg

SEQ ID NO: 330438 - DNA, 20 bp, Artificial Sequence
  chemically synthesized
acatggtgaagccccgtctc

SEQ ID NO: 330439 - DNA, 20 bp, Artificial Sequence
  chemically synthesized
ccagcctgaccaacatggtg

SEQ ID NO: 330440 - DNA, 20 bp, Artificial Sequence
  chemically synthesized
gagacggggcttcaccatgt

SEQ ID NO: 330441 - DNA, 20 bp, Artificial Sequence
  chemically synthesized
cggggcttcaccatgttggt

SEQ ID NO: 330442 - DNA, 20 bp, Artificial Sequence
  chemically synthesized
cgagaccagcctgaccaaca

SEQ ID NO: 330443 - DNA, 20 bp, Artificial Sequence
  chemically synthesized
ggggcttcaccatgttggtc

SEQ ID NO: 330444 - DNA, 20 bp, Artificial Sequence
  chemically synthesized
cttcaccatgttggtcaggc

SEQ ID NO: 330445 - DNA, 20 bp, Artificial Sequence
  chemically synthesized
tgagttcaggagttcgagac

SEQ ID NO: 330446 - DNA, 20 bp, Artificial Sequence
  chemically synthesized
gatcatgagttcaggagttc

SEQ ID NO: 330447 - DNA, 20 bp, Artificial Sequence
  chemically synthesized
caggcggatcatgagttcag

SEQ ID NO: 330448 - DNA, 20 bp, Artificial Sequence
  chemically synthesized
agcaggcggatcatgagttc

SEQ ID NO: 330449 - DNA, 20 bp, Artificial Sequence
  chemically synthesized
aagcaggcggatcatgagtt

SEQ ID NO: 330450 - DNA, 20 bp, Artificial Sequence
  chemically synthesized
ggccgaagcaggcggatcat

SEQ ID NO: 330451 - DNA, 20 bp, Artificial Sequence
  chemically synthesized
aactcatgatccgcctgctt

SEQ ID NO: 330452 - DNA, 20 bp, Artificial Sequence
  chemically synthesized
ctctgggaggccgaagcagg

SEQ ID NO: 330453 - DNA, 20 bp, Artificial Sequence
  chemically synthesized
gcactctgggaggccgaagc

SEQ ID NO: 330454 - DNA, 20 bp, Artificial Sequence
  chemically synthesized
agcactctgggaggccgaag

SEQ ID NO: 330455 - DNA, 20 bp, Artificial Sequence
  chemically synthesized
cccagcactctgggaggccg

SEQ ID NO: 330456 - DNA, 20 bp, Artificial Sequence
  chemically synthesized
atccgcctgcttcggcctcc

SEQ ID NO: 330457 - DNA, 20 bp, Artificial Sequence
  chemically synthesized
ccgcctgcttcggcctccca

SEQ ID NO: 330458 - DNA, 20 bp, Artificial Sequence
  chemically synthesized
tgtaatcccagcactctggg

SEQ ID NO: 330459 - DNA, 20 bp, Artificial Sequence
  chemically synthesized
ctgtaatcccagcactctgg

SEQ ID NO: 330460 - DNA, 20 bp, Artificial Sequence
  chemically synthesized
gcttcggcctcccagagtgc

SEQ ID NO: 330461 - DNA, 20 bp, Artificial Sequence
  chemically synthesized
gcctgtaatcccagcactct

SEQ ID NO: 330462 - DNA, 20 bp, Artificial Sequence
  chemically synthesized
cttcggcctcccagagtgct

SEQ ID NO: 330463 - DNA, 20 bp, Artificial Sequence
  chemically synthesized
tgcctgtaatcccagcactc

SEQ ID NO: 330464 - DNA, 20 bp, Artificial Sequence
  chemically synthesized
ctcccagagtgctgggatta

SEQ ID NO: 330465 - DNA, 20 bp, Artificial Sequence
  chemically synthesized
tcccagagtgctgggattac

SEQ ID NO: 330466 - DNA, 20 bp, Artificial Sequence
  chemically synthesized
gtggctcatgcctgtaatcc

SEQ ID NO: 330467 - DNA, 20 bp, Artificial Sequence
  chemically synthesized
agtgctgggattacaggcat

SEQ ID NO: 330468 - DNA, 20 bp, Artificial Sequence
  chemically synthesized
caggcatgagccaccgtgcc

SEQ ID NO: 330469 - DNA, 20 bp, Artificial Sequence
  chemically synthesized
aaaatttaggccaggcacgg

SEQ ID NO: 330470 - DNA, 20 bp, Artificial Sequence
  chemically synthesized
acaaaaatttaggccaggca

SEQ ID NO: 330471 - DNA, 20 bp, Artificial Sequence
  chemically synthesized
agagtacaaaaatttaggcc

SEQ ID NO: 330472 - DNA, 20 bp, Artificial Sequence
  chemically synthesized
aagagtacaaaaatttaggc

SEQ ID NO: 330473 - DNA, 20 bp, Artificial Sequence
  chemically synthesized
ttttaagagtacaaaaattt

SEQ ID NO: 330474 - DNA, 20 bp, Artificial Sequence
  chemically synthesized
tttttaagagtacaaaaatt

SEQ ID NO: 330475 - DNA, 20 bp, Artificial Sequence
  chemically synthesized
atgatagcttagttttttaa

SEQ ID NO: 330476 - DNA, 20 bp, Artificial Sequence
  chemically synthesized
atatgatagcttagtttttt

SEQ ID NO: 330477 - DNA, 20 bp, Artificial Sequence
  chemically synthesized
ttttgtactcttaaaaaact

SEQ ID NO: 330478 - DNA, 20 bp, Artificial Sequence
  chemically synthesized
tcataatcaatatgatagct

SEQ ID NO: 330479 - DNA, 20 bp, Artificial Sequence
  chemically synthesized
catggtcataatcaatatga

SEQ ID NO: 330480 - DNA, 20 bp, Artificial Sequence
  chemically synthesized
tttcatggtcatatgtgtca

SEQ ID NO: 330481 - DNA, 20 bp, Artificial Sequence
  chemically synthesized
atattagaaaaatattttca

SEQ ID NO: 330482 - DNA, 20 bp, Artificial Sequence
  chemically synthesized
ctaaacgttacgttaaatat

SEQ ID NO: 330483 - DNA, 20 bp, Artificial Sequence
  chemically synthesized
ctaatatttaacgtaacgtt

SEQ ID NO: 330484 - DNA, 20 bp, Artificial Sequence
  chemically synthesized
taacgtttagaaacatcact

SEQ ID NO: 330485 - DNA, 20 bp, Artificial Sequence
  chemically synthesized
ttgattgtatttgaagttct

SEQ ID NO: 330486 - DNA, 20 bp, Artificial Sequence
  chemically synthesized
cagtattttgattgtatttg

SEQ ID NO: 330487 - DNA, 20 bp, Artificial Sequence
  chemically synthesized
aaaaaaacaatattcaaagt

SEQ ID NO: 330488 - DNA, 20 bp, Artificial Sequence
  chemically synthesized
tttgaaaaaaacaatattca

SEQ ID NO: 330489 - DNA, 20 bp, Artificial Sequence
  chemically synthesized
tttgaatattgtttttttca

SEQ ID NO: 330490 - DNA, 20 bp, Artificial Sequence
  chemically synthesized
ttgaatattgtttttttcaa

SEQ ID NO: 330491 - DNA, 20 bp, Artificial Sequence
  chemically synthesized
ttgtgttggacaaaaacgtc

SEQ ID NO: 330492 - DNA, 20 bp, Artificial Sequence
  chemically synthesized
tttgtgttggacaaaaacgt

SEQ ID NO: 330493 - DNA, 20 bp, Artificial Sequence
  chemically synthesized
gaagacagtcttatttgtgt

SEQ ID NO: 330494 - DNA, 20 bp, Artificial Sequence
  chemically synthesized
cgtttttgtccaacacaaat

SEQ ID NO: 330495 - DNA, 20 bp, Artificial Sequence
  chemically synthesized
ctgaggaccagttgtgaaga

SEQ ID NO: 330496 - DNA, 20 bp, Artificial Sequence
  chemically synthesized
aataagactgtcttcacaac

SEQ ID NO: 330497 - DNA, 20 bp, Artificial Sequence
  chemically synthesized
gtgcctgaggaccagttgtg

SEQ ID NO: 330498 - DNA, 20 bp, Artificial Sequence
  chemically synthesized
ctgtcttcacaactggtcct

SEQ ID NO: 330499 - DNA, 20 bp, Artificial Sequence
  chemically synthesized
tgtcttcacaactggtcctc

SEQ ID NO: 330500 - DNA, 20 bp, Artificial Sequence
  chemically synthesized
tctactcagtgcctgaggac

SEQ ID NO: 330501 - DNA, 20 bp, Artificial Sequence
  chemically synthesized
cttactctactcagtgcctg

SEQ ID NO: 330502 - DNA, 20 bp, Artificial Sequence
  chemically synthesized
acaactggtcctcaggcact

SEQ ID NO: 330503 - DNA, 20 bp, Artificial Sequence
  chemically synthesized
acttactctactcagtgcct

SEQ ID NO: 330504 - DNA, 20 bp, Artificial Sequence
  chemically synthesized
actggtcctcaggcactgag

SEQ ID NO: 330505 - DNA, 20 bp, Artificial Sequence
  chemically synthesized
tggtcctcaggcactgagta

SEQ ID NO: 330506 - DNA, 20 bp, Artificial Sequence
  chemically synthesized
ttggagaaacttactctact

SEQ ID NO: 330507 - DNA, 20 bp, Artificial Sequence
  chemically synthesized
cctcaggcactgagtagagt

SEQ ID NO: 330508 - DNA, 20 bp, Artificial Sequence
  chemically synthesized
tgagtagagtaagtttctcc

SEQ ID NO: 330509 - DNA, 20 bp, Artificial Sequence
  chemically synthesized
gagtaagtttctccaagcca

SEQ ID NO: 330510 - DNA, 20 bp, Artificial Sequence
  chemically synthesized
tatagacagcctttggcttg

SEQ ID NO: 330511 - DNA, 20 bp, Artificial Sequence
  chemically synthesized
agtaagtttctccaagccaa

SEQ ID NO: 330512 - DNA, 20 bp, Artificial Sequence
  chemically synthesized
tttatagacagcctttggct

SEQ ID NO: 330513 - DNA, 20 bp, Artificial Sequence
  chemically synthesized
taagatttatagacagcctt

SEQ ID NO: 330514 - DNA, 20 bp, Artificial Sequence
  chemically synthesized
agtagattaagatttataga

SEQ ID NO: 330515 - DNA, 20 bp, Artificial Sequence
  chemically synthesized
caaaagtagattaagattta

SEQ ID NO: 330516 - DNA, 20 bp, Artificial Sequence
  chemically synthesized
gtagtgtacaaaagtagatt

SEQ ID NO: 330517 - DNA, 20 bp, Artificial Sequence
  chemically synthesized
attttagtagtgtacaaaag

SEQ ID NO: 330518 - DNA, 20 bp, Artificial Sequence
  chemically synthesized
gaaattttagtagtgtacaa

SEQ ID NO: 330519 - DNA, 20 bp, Artificial Sequence
  chemically synthesized
tccatgagaggaaattttag

SEQ ID NO: 330520 - DNA, 20 bp, Artificial Sequence
  chemically synthesized
cattccatgagaggaaattt

SEQ ID NO: 330521 - DNA, 20 bp, Artificial Sequence
  chemically synthesized
actactaaaatttcctctca

SEQ ID NO: 330522 - DNA, 20 bp, Artificial Sequence
  chemically synthesized
atttttcaccattccatgag

SEQ ID NO: 330523 - DNA, 20 bp, Artificial Sequence
  chemically synthesized
gatttttcaccattccatga

SEQ ID NO: 330524 - DNA, 20 bp, Artificial Sequence
  chemically synthesized
taaaatttcctctcatggaa

SEQ ID NO: 330525 - DNA, 20 bp, Artificial Sequence
  chemically synthesized
gagatttttcaccattccat

SEQ ID NO: 330526 - DNA, 20 bp, Artificial Sequence
  chemically synthesized
ttaaagcataagaattattg

SEQ ID NO: 330527 - DNA, 20 bp, Artificial Sequence
  chemically synthesized
aattaaagcataagaattat

SEQ ID NO: 330528 - DNA, 20 bp, Artificial Sequence
  chemically synthesized
ttctcaataaattaaagcat

SEQ ID NO: 330529 - DNA, 20 bp, Artificial Sequence
  chemically synthesized
ttgtttttctcaataaatta

SEQ ID NO: 330530 - DNA, 20 bp, Artificial Sequence
  chemically synthesized
ttcttatgctttaatttatt

SEQ ID NO: 330531 - DNA, 20 bp, Artificial Sequence
  chemically synthesized
acaattatttcattcaaaat

SEQ ID NO: 330532 - DNA, 20 bp, Artificial Sequence
  chemically synthesized
caattatttcattcaaaatt

SEQ ID NO: 330533 - DNA, 20 bp, Artificial Sequence
  chemically synthesized
atattgggcattcataattt

SEQ ID NO: 330534 - DNA, 20 bp, Artificial Sequence
  chemically synthesized
tgagtcttttaacaaatatt

SEQ ID NO: 330535 - DNA, 20 bp, Artificial Sequence
  chemically synthesized
atgagtcttttaacaaatat

SEQ ID NO: 330536 - DNA, 20 bp, Artificial Sequence
  chemically synthesized
gaatgcccaatatttgttaa

SEQ ID NO: 330537 - DNA, 20 bp, Artificial Sequence
  chemically synthesized
tgaagtaatattaaatatat

SEQ ID NO: 330538 - DNA, 20 bp, Artificial Sequence
  chemically synthesized
tttaatattacttcaaaaat

SEQ ID NO: 330539 - DNA, 20 bp, Artificial Sequence
  chemically synthesized
aaagttttcactaatttttg

SEQ ID NO: 330540 - DNA, 20 bp, Artificial Sequence
  chemically synthesized
aattagtgaaaactttatat

SEQ ID NO: 330541 - DNA, 20 bp, Artificial Sequence
  chemically synthesized
tgaaaatattggcttatata

SEQ ID NO: 330542 - DNA, 20 bp, Artificial Sequence
  chemically synthesized
taagtacattttgaaaatat

SEQ ID NO: 330543 - DNA, 20 bp, Artificial Sequence
  chemically synthesized
tttcaaaatgtacttaaaaa

SEQ ID NO: 330544 - DNA, 20 bp, Artificial Sequence
  chemically synthesized
aaaatgaaatttctattttt

SEQ ID NO: 330545 - DNA, 20 bp, Artificial Sequence
  chemically synthesized
aaaaatagaaatttcatttt

SEQ ID NO: 330546 - DNA, 20 bp, Artificial Sequence
  chemically synthesized
agagacagcaaacaatgttg

SEQ ID NO: 330547 - DNA, 20 bp, Artificial Sequence
  chemically synthesized
gagagacagcaaacaatgtt

SEQ ID NO: 330548 - DNA, 20 bp, Artificial Sequence
  chemically synthesized
agttgatggggggagagaga

SEQ ID NO: 330549 - DNA, 20 bp, Artificial Sequence
  chemically synthesized
ggagagttgatggggggaga

SEQ ID NO: 330550 - DNA, 20 bp, Artificial Sequence
  chemically synthesized
aaggagagttgatgggggga

SEQ ID NO: 330551 - DNA, 20 bp, Artificial Sequence
  chemically synthesized
ggaaggagagttgatggggg

SEQ ID NO: 330552 - DNA, 20 bp, Artificial Sequence
  chemically synthesized
gtggaaggagagttgatggg

SEQ ID NO: 330553 - DNA, 20 bp, Artificial Sequence
  chemically synthesized
ggtggaaggagagttgatgg

SEQ ID NO: 330554 - DNA, 20 bp, Artificial Sequence
  chemically synthesized
gggtggaaggagagttgatg

SEQ ID NO: 330555 - DNA, 20 bp, Artificial Sequence
  chemically synthesized
tgggtggaaggagagttgat

SEQ ID NO: 330556 - DNA, 20 bp, Artificial Sequence
  chemically synthesized
gtgggtggaaggagagttga

SEQ ID NO: 330557 - DNA, 20 bp, Artificial Sequence
  chemically synthesized
ggttggggtgggtggaagga

SEQ ID NO: 330558 - DNA, 20 bp, Artificial Sequence
  chemically synthesized
aaggttggggtgggtggaag

SEQ ID NO: 330559 - DNA, 20 bp, Artificial Sequence
  chemically synthesized
gaaaggttggggtgggtgga

SEQ ID NO: 330560 - DNA, 20 bp, Artificial Sequence
  chemically synthesized
agaaaggttggggtgggtgg

SEQ ID NO: 330561 - DNA, 20 bp, Artificial Sequence
  chemically synthesized
gggagaaaggttggggtggg

SEQ ID NO: 330562 - DNA, 20 bp, Artificial Sequence
  chemically synthesized
ctggggagaaaggttggggt

SEQ ID NO: 330563 - DNA, 20 bp, Artificial Sequence
  chemically synthesized
gctggggagaaaggttgggg

SEQ ID NO: 330564 - DNA, 20 bp, Artificial Sequence
  chemically synthesized
tgtgctggggagaaaggttg

SEQ ID NO: 330565 - DNA, 20 bp, Artificial Sequence
  chemically synthesized
gtgtgctggggagaaaggtt

SEQ ID NO: 330566 - DNA, 20 bp, Artificial Sequence
  chemically synthesized
tgtgtgctggggagaaaggt

SEQ ID NO: 330567 - DNA, 20 bp, Artificial Sequence
  chemically synthesized
cccaccccaacctttctccc

SEQ ID NO: 330568 - DNA, 20 bp, Artificial Sequence
  chemically synthesized
tgtgtgtgtgctggggagaa

SEQ ID NO: 330569 - DNA, 20 bp, Artificial Sequence
  chemically synthesized
gtgtgtgtgtgctggggaga

SEQ ID NO: 330570 - DNA, 20 bp, Artificial Sequence
  chemically synthesized
ttctgtgtgtgtgtgctggg

SEQ ID NO: 330571 - DNA, 20 bp, Artificial Sequence
  chemically synthesized
gtttctgtgtgtgtgtgctg

SEQ ID NO: 330572 - DNA, 20 bp, Artificial Sequence
  chemically synthesized
tgtttctgtgtgtgtgtgct

SEQ ID NO: 330573 - DNA, 20 bp, Artificial Sequence
  chemically synthesized
gtgtttctgtgtgtgtgtgc

SEQ ID NO: 330574 - DNA, 20 bp, Artificial Sequence
  chemically synthesized
ttctccccagcacacacaca

SEQ ID NO: 330575 - DNA, 20 bp, Artificial Sequence
  chemically synthesized
aacacatacacacacacaca

SEQ ID NO: 330576 - DNA, 20 bp, Artificial Sequence
  chemically synthesized
tacacacacacacacagtca

SEQ ID NO: 330577 - DNA, 20 bp, Artificial Sequence
  chemically synthesized
acagtcaaagttgttttgaa

SEQ ID NO: 330578 - DNA, 20 bp, Artificial Sequence
  chemically synthesized
tgttttgaacagaaaaccct

SEQ ID NO: 330579 - DNA, 20 bp, Artificial Sequence
  chemically synthesized
gttttgaacagaaaaccctc

SEQ ID NO: 330580 - DNA, 20 bp, Artificial Sequence
  chemically synthesized
atataaggggcgtagcctga

SEQ ID NO: 330581 - DNA, 20 bp, Artificial Sequence
  chemically synthesized
aatataaggggcgtagcctg

SEQ ID NO: 330582 - DNA, 20 bp, Artificial Sequence
  chemically synthesized
aaatataaggggcgtagcct

SEQ ID NO: 330583 - DNA, 20 bp, Artificial Sequence
  chemically synthesized
cgtctcaaatataaggggcg

SEQ ID NO: 330584 - DNA, 20 bp, Artificial Sequence
  chemically synthesized
actcccgtctcaaatataag

SEQ ID NO: 330585 - DNA, 20 bp, Artificial Sequence
  chemically synthesized
cactcccgtctcaaatataa

SEQ ID NO: 330586 - DNA, 20 bp, Artificial Sequence
  chemically synthesized
aggctacgccccttatattt

SEQ ID NO: 330587 - DNA, 20 bp, Artificial Sequence
  chemically synthesized
ccactcccgtctcaaatata

SEQ ID NO: 330588 - DNA, 20 bp, Artificial Sequence
  chemically synthesized
cccactcccgtctcaaatat

SEQ ID NO: 330589 - DNA, 20 bp, Artificial Sequence
  chemically synthesized
tacgccccttatatttgaga

SEQ ID NO: 330590 - DNA, 20 bp, Artificial Sequence
  chemically synthesized
acgccccttatatttgagac

SEQ ID NO: 330591 - DNA, 20 bp, Artificial Sequence
  chemically synthesized
gccccttatatttgagacgg

SEQ ID NO: 330592 - DNA, 20 bp, Artificial Sequence
  chemically synthesized
ccttatatttgagacgggag

SEQ ID NO: 330593 - DNA, 20 bp, Artificial Sequence
  chemically synthesized
cttatatttgagacgggagt

SEQ ID NO: 330594 - DNA, 20 bp, Artificial Sequence
  chemically synthesized
ttatatttgagacgggagtg

SEQ ID NO: 330595 - DNA, 20 bp, Artificial Sequence
  chemically synthesized
tatatttgagacgggagtgg

SEQ ID NO: 330596 - DNA, 20 bp, Artificial Sequence
  chemically synthesized
tgagacgggagtgggggtaa

SEQ ID NO: 330597 - DNA, 20 bp, Artificial Sequence
  chemically synthesized
ggagtgggggtaacagtcca

SEQ ID NO: 330598 - DNA, 20 bp, Artificial Sequence
  chemically synthesized
cagaagtagatgagcagctg

SEQ ID NO: 330599 - DNA, 20 bp, Artificial Sequence
  chemically synthesized
aggtaccagaagtagatgag

SEQ ID NO: 330600 - DNA, 20 bp, Artificial Sequence
  chemically synthesized
agaaggtaccagaagtagat

SEQ ID NO: 330601 - DNA, 20 bp, Artificial Sequence
  chemically synthesized
cacagctgctcatctacttc

SEQ ID NO: 330602 - DNA, 20 bp, Artificial Sequence
  chemically synthesized
gctagagaaggtaccagaag

SEQ ID NO: 330603 - DNA, 20 bp, Artificial Sequence
  chemically synthesized
aaggctagagaaggtaccag

SEQ ID NO: 330604 - DNA, 20 bp, Artificial Sequence
  chemically synthesized
aataaggctagagaaggtac

SEQ ID NO: 330605 - DNA, 20 bp, Artificial Sequence
  chemically synthesized
tctacttctggtaccttctc

SEQ ID NO: 330606 - DNA, 20 bp, Artificial Sequence
  chemically synthesized
gaaataaataaggctagaga

SEQ ID NO: 330607 - DNA, 20 bp, Artificial Sequence
  chemically synthesized
ggaaataaataaggctagag

SEQ ID NO: 330608 - DNA, 20 bp, Artificial Sequence
  chemically synthesized
ctaggaaataaataaggcta

SEQ ID NO: 330609 - DNA, 20 bp, Artificial Sequence
  chemically synthesized
aactaggaaataaataaggc

SEQ ID NO: 330610 - DNA, 20 bp, Artificial Sequence
  chemically synthesized
atgtaactaggaaataaata

SEQ ID NO: 330611 - DNA, 20 bp, Artificial Sequence
  chemically synthesized
tatgtaactaggaaataaat

SEQ ID NO: 330612 - DNA, 20 bp, Artificial Sequence
  chemically synthesized
ctctagccttatttatttcc

SEQ ID NO: 330613 - DNA, 20 bp, Artificial Sequence
  chemically synthesized
gtgatgtaaaatatgtaact

SEQ ID NO: 330614 - DNA, 20 bp, Artificial Sequence
  chemically synthesized
agtgatgtaaaatatgtaac

SEQ ID NO: 330615 - DNA, 20 bp, Artificial Sequence
  chemically synthesized
atggagaagaaatcagtgaa

SEQ ID NO: 330616 - DNA, 20 bp, Artificial Sequence
  chemically synthesized
aaaatgtatggagaagaaat

SEQ ID NO: 330617 - DNA, 20 bp, Artificial Sequence
  chemically synthesized
aaggtagaaaatgtatggag

SEQ ID NO: 330618 - DNA, 20 bp, Artificial Sequence
  chemically synthesized
tcaaaggtagaaaatgtatg

SEQ ID NO: 330619 - DNA, 20 bp, Artificial Sequence
  chemically synthesized
ggtcaaaggtagaaaatgta

SEQ ID NO: 330620 - DNA, 20 bp, Artificial Sequence
  chemically synthesized
tatcacttactggtcaaagg

SEQ ID NO: 330621 - DNA, 20 bp, Artificial Sequence
  chemically synthesized
atacattttctacctttgac

SEQ ID NO: 330622 - DNA, 20 bp, Artificial Sequence
  chemically synthesized
aactatcacttactggtcaa

SEQ ID NO: 330623 - DNA, 20 bp, Artificial Sequence
  chemically synthesized
aaactatcacttactggtca

SEQ ID NO: 330624 - DNA, 20 bp, Artificial Sequence
  chemically synthesized
attttctacctttgaccagt

SEQ ID NO: 330625 - DNA, 20 bp, Artificial Sequence
  chemically synthesized
agaggaaaactatcacttac

SEQ ID NO: 330626 - DNA, 20 bp, Artificial Sequence
  chemically synthesized
tacctttgaccagtaagtga

SEQ ID NO: 330627 - DNA, 20 bp, Artificial Sequence
  chemically synthesized
agcaaaaagattagataaag

SEQ ID NO: 330628 - DNA, 20 bp, Artificial Sequence
  chemically synthesized
tagcaaaaagattagataaa

SEQ ID NO: 330629 - DNA, 20 bp, Artificial Sequence
  chemically synthesized
aatagcaaaaagattagata

SEQ ID NO: 330630 - DNA, 20 bp, Artificial Sequence
  chemically synthesized
tcgcctaatagcaaaaagat

SEQ ID NO: 330631 - DNA, 20 bp, Artificial Sequence
  chemically synthesized
ctttatcgcctaatagcaaa

SEQ ID NO: 330632 - DNA, 20 bp, Artificial Sequence
  chemically synthesized
ttatctaatctttttgctat

SEQ ID NO: 330633 - DNA, 20 bp, Artificial Sequence
  chemically synthesized
tatctaatctttttgctatt

SEQ ID NO: 330634 - DNA, 20 bp, Artificial Sequence
  chemically synthesized
taagattctttatcgcctaa

SEQ ID NO: 330635 - DNA, 20 bp, Artificial Sequence
  chemically synthesized
ctttttgctattaggcgata

SEQ ID NO: 330636 - DNA, 20 bp, Artificial Sequence
  chemically synthesized
tattaggcgataaagaatct

SEQ ID NO: 330637 - DNA, 20 bp, Artificial Sequence
  chemically synthesized
ttaggcgataaagaatctta

SEQ ID NO: 330638 - DNA, 20 bp, Artificial Sequence
  chemically synthesized
ggcgataaagaatcttagag

SEQ ID NO: 330639 - DNA, 20 bp, Artificial Sequence
  chemically synthesized
tttggaatctttgctgctct

SEQ ID NO: 330640 - DNA, 20 bp, Artificial Sequence
  chemically synthesized
taaagaatcttagagcagca

SEQ ID NO: 330641 - DNA, 20 bp, Artificial Sequence
  chemically synthesized
gatggacgaaacagatattt

SEQ ID NO: 330642 - DNA, 20 bp, Artificial Sequence
  chemically synthesized
tgcttaagagatggacgaaa

SEQ ID NO: 330643 - DNA, 20 bp, Artificial Sequence
  chemically synthesized
atctgtttcgtccatctctt

SEQ ID NO: 330644 - DNA, 20 bp, Artificial Sequence
  chemically synthesized
ataaccctatgcttaagaga

SEQ ID NO: 330645 - DNA, 20 bp, Artificial Sequence
  chemically synthesized
tttcgtccatctcttaagca

SEQ ID NO: 330646 - DNA, 20 bp, Artificial Sequence
  chemically synthesized
ggaaataaccctatgcttaa

SEQ ID NO: 330647 - DNA, 20 bp, Artificial Sequence
  chemically synthesized
ttcgtccatctcttaagcat

SEQ ID NO: 330648 - DNA, 20 bp, Artificial Sequence
  chemically synthesized
tcgtccatctcttaagcata

SEQ ID NO: 330649 - DNA, 20 bp, Artificial Sequence
  chemically synthesized
atggaaataaccctatgctt

SEQ ID NO: 330650 - DNA, 20 bp, Artificial Sequence
  chemically synthesized
taagcatagggttatttcca

SEQ ID NO: 330651 - DNA, 20 bp, Artificial Sequence
  chemically synthesized
tagggttatttccatggctt

SEQ ID NO: 330652 - DNA, 20 bp, Artificial Sequence
  chemically synthesized
aaatggtattactaaagcca

SEQ ID NO: 330653 - DNA, 20 bp, Artificial Sequence
  chemically synthesized
ttcaataaatggtattacta

SEQ ID NO: 330654 - DNA, 20 bp, Artificial Sequence
  chemically synthesized
tgggacatgatttcaataaa

SEQ ID NO: 330655 - DNA, 20 bp, Artificial Sequence
  chemically synthesized
ttgaaatcatgtcccaccta

SEQ ID NO: 330656 - DNA, 20 bp, Artificial Sequence
  chemically synthesized
agaatgaaaatactttaggt

SEQ ID NO: 330657 - DNA, 20 bp, Artificial Sequence
  chemically synthesized
aagaatgaaaatactttagg

SEQ ID NO: 330658 - DNA, 20 bp, Artificial Sequence
  chemically synthesized
gaaaagaatgaaaatacttt

SEQ ID NO: 330659 - DNA, 20 bp, Artificial Sequence
  chemically synthesized
agaaaagaatgaaaatactt

SEQ ID NO: 330660 - DNA, 20 bp, Artificial Sequence
  chemically synthesized
ttacgaggcttagataagaa

SEQ ID NO: 330661 - DNA, 20 bp, Artificial Sequence
  chemically synthesized
ttttcattcttttcttatct

SEQ ID NO: 330662 - DNA, 20 bp, Artificial Sequence
  chemically synthesized
gctttttacgaggcttagat

SEQ ID NO: 330663 - DNA, 20 bp, Artificial Sequence
  chemically synthesized
acagagctttttacgaggct

SEQ ID NO: 330664 - DNA, 20 bp, Artificial Sequence
  chemically synthesized
tcttatctaagcctcgtaaa

SEQ ID NO: 330665 - DNA, 20 bp, Artificial Sequence
  chemically synthesized
cttgaacagagctttttacg

SEQ ID NO: 330666 - DNA, 20 bp, Artificial Sequence
  chemically synthesized
tcttgaacagagctttttac

SEQ ID NO: 330667 - DNA, 20 bp, Artificial Sequence
  chemically synthesized
cctcgtaaaaagctctgttc

SEQ ID NO: 330668 - DNA, 20 bp, Artificial Sequence
  chemically synthesized
gagtaagttcatcttgaaca

SEQ ID NO: 330669 - DNA, 20 bp, Artificial Sequence
  chemically synthesized
tagagtaagttcatcttgaa

SEQ ID NO: 330670 - DNA, 20 bp, Artificial Sequence
  chemically synthesized
ttcaagatgaacttactcta

SEQ ID NO: 330671 - DNA, 20 bp, Artificial Sequence
  chemically synthesized
caggaagatttccatagagt

SEQ ID NO: 330672 - DNA, 20 bp, Artificial Sequence
  chemically synthesized
tactcaggaagatttccata

SEQ ID NO: 330673 - DNA, 20 bp, Artificial Sequence
  chemically synthesized
cgtactcaggaagatttcca

SEQ ID NO: 330674 - DNA, 20 bp, Artificial Sequence
  chemically synthesized
tactctatggaaatcttcct

SEQ ID NO: 330675 - DNA, 20 bp, Artificial Sequence
  chemically synthesized
tccatcgactcgtactcagg

SEQ ID NO: 330676 - DNA, 20 bp, Artificial Sequence
  chemically synthesized
atggaaatcttcctgagtac

SEQ ID NO: 330677 - DNA, 20 bp, Artificial Sequence
  chemically synthesized
tggtccatcgactcgtactc

SEQ ID NO: 330678 - DNA, 20 bp, Artificial Sequence
  chemically synthesized
atggtccatcgactcgtact

SEQ ID NO: 330679 - DNA, 20 bp, Artificial Sequence
  chemically synthesized
tcttcctgagtacgagtcga

SEQ ID NO: 330680 - DNA, 20 bp, Artificial Sequence
  chemically synthesized
tacgagtcgatggaccattg

SEQ ID NO: 330681 - DNA, 20 bp, Artificial Sequence
  chemically synthesized
acgagtcgatggaccattgt

SEQ ID NO: 330682 - DNA, 20 bp, Artificial Sequence
  chemically synthesized
gcagtttatgcatcctacaa

SEQ ID NO: 330683 - DNA, 20 bp, Artificial Sequence
  chemically synthesized
gaatgggatccaagaatcgg

SEQ ID NO: 330684 - DNA, 20 bp, Artificial Sequence
  chemically synthesized
atgcataaactgccgattct

SEQ ID NO: 330685 - DNA, 20 bp, Artificial Sequence
  chemically synthesized
gatgaatgggatccaagaat

SEQ ID NO: 330686 - DNA, 20 bp, Artificial Sequence
  chemically synthesized
tagcgtgatgaatgggatcc

SEQ ID NO: 330687 - DNA, 20 bp, Artificial Sequence
  chemically synthesized
ttattactagcgtgatgaat

SEQ ID NO: 330688 - DNA, 20 bp, Artificial Sequence
  chemically synthesized
cttattactagcgtgatgaa

SEQ ID NO: 330689 - DNA, 20 bp, Artificial Sequence
  chemically synthesized
ttggatcccattcatcacgc

SEQ ID NO: 330690 - DNA, 20 bp, Artificial Sequence
  chemically synthesized
ccattcatcacgctagtaat

SEQ ID NO: 330691 - DNA, 20 bp, Artificial Sequence
  chemically synthesized
ggatatataaggcttattac

SEQ ID NO: 330692 - DNA, 20 bp, Artificial Sequence
  chemically synthesized
cgtacaaatatggatatata

SEQ ID NO: 330693 - DNA, 20 bp, Artificial Sequence
  chemically synthesized
tcgtacaaatatggatatat

SEQ ID NO: 330694 - DNA, 20 bp, Artificial Sequence
  chemically synthesized
ttggagagatcgtacaaata

SEQ ID NO: 330695 - DNA, 20 bp, Artificial Sequence
  chemically synthesized
aactaatttcagtgattgga

SEQ ID NO: 330696 - DNA, 20 bp, Artificial Sequence
  chemically synthesized
caaactaatttcagtgattg

SEQ ID NO: 330697 - DNA, 20 bp, Artificial Sequence
  chemically synthesized
tccaaactaatttcagtgat

SEQ ID NO: 330698 - DNA, 20 bp, Artificial Sequence
  chemically synthesized
atctctccaatcactgaaat

SEQ ID NO: 330699 - DNA, 20 bp, Artificial Sequence
  chemically synthesized
tgatttttccaaactaattt

SEQ ID NO: 330700 - DNA, 20 bp, Artificial Sequence
  chemically synthesized
tccaatcactgaaattagtt

SEQ ID NO: 330701 - DNA, 20 bp, Artificial Sequence
  chemically synthesized
caaacatgtgtttgaaatac

SEQ ID NO: 330702 - DNA, 20 bp, Artificial Sequence
  chemically synthesized
aaacatgtgtttgaaataca

SEQ ID NO: 330703 - DNA, 20 bp, Artificial Sequence
  chemically synthesized
catgtgtttgaaatacaagg

SEQ ID NO: 330704 - DNA, 20 bp, Artificial Sequence
  chemically synthesized
aagaatgagtaatacaaggt

SEQ ID NO: 330705 - DNA, 20 bp, Artificial Sequence
  chemically synthesized
aaagaatgagtaatacaagg

SEQ ID NO: 330706 - DNA, 20 bp, Artificial Sequence
  chemically synthesized
ataaaagaatgagtaataca

SEQ ID NO: 330707 - DNA, 20 bp, Artificial Sequence
  chemically synthesized
tataaaagaatgagtaatac

SEQ ID NO: 330708 - DNA, 20 bp, Artificial Sequence
  chemically synthesized
agagttacgtataaaagaat

SEQ ID NO: 330709 - DNA, 20 bp, Artificial Sequence
  chemically synthesized
aatagaagagttacgtataa

SEQ ID NO: 330710 - DNA, 20 bp, Artificial Sequence
  chemically synthesized
tcaacctcatcgtaatagaa

SEQ ID NO: 330711 - DNA, 20 bp, Artificial Sequence
  chemically synthesized
catcaacctcatcgtaatag

SEQ ID NO: 330712 - DNA, 20 bp, Artificial Sequence
  chemically synthesized
cgtaactcttctattacgat

SEQ ID NO: 330713 - DNA, 20 bp, Artificial Sequence
  chemically synthesized
tcccatcaacctcatcgtaa

SEQ ID NO: 330714 - DNA, 20 bp, Artificial Sequence
  chemically synthesized
gtaactcttctattacgatg

SEQ ID NO: 330715 - DNA, 20 bp, Artificial Sequence
  chemically synthesized
ttctattacgatgaggttga

SEQ ID NO: 330716 - DNA, 20 bp, Artificial Sequence
  chemically synthesized
tctattacgatgaggttgat

SEQ ID NO: 330717 - DNA, 20 bp, Artificial Sequence
  chemically synthesized
ttgatgggattaataattca

SEQ ID NO: 330718 - DNA, 20 bp, Artificial Sequence
  chemically synthesized
tgggattaataattcatagt

SEQ ID NO: 330719 - DNA, 20 bp, Artificial Sequence
  chemically synthesized
ggattaataattcatagtaa

SEQ ID NO: 330720 - DNA, 20 bp, Artificial Sequence
  chemically synthesized
ttaataattcatagtaagag

SEQ ID NO: 330721 - DNA, 20 bp, Artificial Sequence
  chemically synthesized
taataattcatagtaagaga

SEQ ID NO: 330722 - DNA, 20 bp, Artificial Sequence
  chemically synthesized
taattcatagtaagagaagg

SEQ ID NO: 330723 - DNA, 20 bp, Artificial Sequence
  chemically synthesized
gatgacgtaaaactgtgctg

SEQ ID NO: 330724 - DNA, 20 bp, Artificial Sequence
  chemically synthesized
atataaaccctgctgcagca

SEQ ID NO: 330725 - DNA, 20 bp, Artificial Sequence
  chemically synthesized
gacgtaaaactgtgctgcag

SEQ ID NO: 330726 - DNA, 20 bp, Artificial Sequence
  chemically synthesized
acgtaaaactgtgctgcagc

SEQ ID NO: 330727 - DNA, 20 bp, Artificial Sequence
  chemically synthesized
cgtaaaactgtgctgcagca

SEQ ID NO: 330728 - DNA, 20 bp, Artificial Sequence
  chemically synthesized
ctgcaatataaaccctgctg

SEQ ID NO: 330729 - DNA, 20 bp, Artificial Sequence
  chemically synthesized
ctgcagcagggtttatattg

SEQ ID NO: 330730 - DNA, 20 bp, Artificial Sequence
  chemically synthesized
tgcagcagggtttatattgc

SEQ ID NO: 330731 - DNA, 20 bp, Artificial Sequence
  chemically synthesized
attgttcagggttttgaagc

SEQ ID NO: 330732 - DNA, 20 bp, Artificial Sequence
  chemically synthesized
tattgttcagggttttgaag

SEQ ID NO: 330733 - DNA, 20 bp, Artificial Sequence
  chemically synthesized
atatattgttcagggttttg

SEQ ID NO: 330734 - DNA, 20 bp, Artificial Sequence
  chemically synthesized
tgaatctaatatattgttca

SEQ ID NO: 330735 - DNA, 20 bp, Artificial Sequence
  chemically synthesized
gtgaatctaatatattgttc

SEQ ID NO: 330736 - DNA, 20 bp, Artificial Sequence
  chemically synthesized
cgtgaatctaatatattgtt

SEQ ID NO: 330737 - DNA, 20 bp, Artificial Sequence
  chemically synthesized
caaaaccctgaacaatatat

SEQ ID NO: 330738 - DNA, 20 bp, Artificial Sequence
  chemically synthesized
tgaacaatatattagattca

SEQ ID NO: 330739 - DNA, 20 bp, Artificial Sequence
  chemically synthesized
gaacaatatattagattcac

SEQ ID NO: 330740 - DNA, 20 bp, Artificial Sequence
  chemically synthesized
caatatattagattcacggg

SEQ ID NO: 330741 - DNA, 20 bp, Artificial Sequence
  chemically synthesized
tcacgggcagctgctccctt

SEQ ID NO: 330742 - DNA, 20 bp, Artificial Sequence
  chemically synthesized
aacagcaatacttaagggag

SEQ ID NO: 330743 - DNA, 20 bp, Artificial Sequence
  chemically synthesized
gtgaacagcaatacttaagg

SEQ ID NO: 330744 - DNA, 20 bp, Artificial Sequence
  chemically synthesized
gagtgaacagcaatacttaa

SEQ ID NO: 330745 - DNA, 20 bp, Artificial Sequence
  chemically synthesized
tgagtgaacagcaatactta

SEQ ID NO: 330746 - DNA, 20 bp, Artificial Sequence
  chemically synthesized
ttgagtgaacagcaatactt

SEQ ID NO: 330747 - DNA, 20 bp, Artificial Sequence
  chemically synthesized
tattctaagagttgagtgaa

SEQ ID NO: 330748 - DNA, 20 bp, Artificial Sequence
  chemically synthesized
attgctgttcactcaactct

SEQ ID NO: 330749 - DNA, 20 bp, Artificial Sequence
  chemically synthesized
tattgtatattctaagagtt

SEQ ID NO: 330750 - DNA, 20 bp, Artificial Sequence
  chemically synthesized
gattgtattgtatattctaa

SEQ ID NO: 330751 - DNA, 20 bp, Artificial Sequence
  chemically synthesized
gcgattgtattgtatattct

SEQ ID NO: 330752 - DNA, 20 bp, Artificial Sequence
  chemically synthesized
tatacaatacaatcgcaaac

SEQ ID NO: 330753 - DNA, 20 bp, Artificial Sequence
  chemically synthesized
atacaatacaatcgcaaact

SEQ ID NO: 330754 - DNA, 20 bp, Artificial Sequence
  chemically synthesized
tacaatacaatcgcaaactg

SEQ ID NO: 330755 - DNA, 20 bp, Artificial Sequence
  chemically synthesized
cacgtttcttttatatgccc

SEQ ID NO: 330756 - DNA, 20 bp, Artificial Sequence
  chemically synthesized
tcgcaaactggggcatataa

SEQ ID NO: 330757 - DNA, 20 bp, Artificial Sequence
  chemically synthesized
catattgatcaaatgaatga

SEQ ID NO: 330758 - DNA, 20 bp, Artificial Sequence
  chemically synthesized
gaatatatactaggtacata

SEQ ID NO: 330759 - DNA, 20 bp, Artificial Sequence
  chemically synthesized
atcaatatgctttatgtacc

SEQ ID NO: 330760 - DNA, 20 bp, Artificial Sequence
  chemically synthesized
aaaggactagaatatatact

SEQ ID NO: 330761 - DNA, 20 bp, Artificial Sequence
  chemically synthesized
aaaaggactagaatatatac

SEQ ID NO: 330762 - DNA, 20 bp, Artificial Sequence
  chemically synthesized
tatgtacctagtatatattc

SEQ ID NO: 330763 - DNA, 20 bp, Artificial Sequence
  chemically synthesized
aactccaagaggaaaaggac

SEQ ID NO: 330764 - DNA, 20 bp, Artificial Sequence
  chemically synthesized
gtaaaaactccaagaggaaa

SEQ ID NO: 330765 - DNA, 20 bp, Artificial Sequence
  chemically synthesized
tattctagtccttttcctct

SEQ ID NO: 330766 - DNA, 20 bp, Artificial Sequence
  chemically synthesized
agtaaaaactccaagaggaa

SEQ ID NO: 330767 - DNA, 20 bp, Artificial Sequence
  chemically synthesized
ttctagtccttttcctcttg

SEQ ID NO: 330768 - DNA, 20 bp, Artificial Sequence
  chemically synthesized
taatgagtaaaaactccaag

SEQ ID NO: 330769 - DNA, 20 bp, Artificial Sequence
  chemically synthesized
ctaatgagtaaaaactccaa

SEQ ID NO: 330770 - DNA, 20 bp, Artificial Sequence
  chemically synthesized
ccctaatgagtaaaaactcc

SEQ ID NO: 330771 - DNA, 20 bp, Artificial Sequence
  chemically synthesized
ctcttggagtttttactcat

SEQ ID NO: 330772 - DNA, 20 bp, Artificial Sequence
  chemically synthesized
tcttggagtttttactcatt

SEQ ID NO: 330773 - DNA, 20 bp, Artificial Sequence
  chemically synthesized
cttggagtttttactcatta

SEQ ID NO: 330774 - DNA, 20 bp, Artificial Sequence
  chemically synthesized
gcaggtcgtttttccctaat

SEQ ID NO: 330775 - DNA, 20 bp, Artificial Sequence
  chemically synthesized
actgacattacgatatttgc

SEQ ID NO: 330776 - DNA, 20 bp, Artificial Sequence
  chemically synthesized
tactgacattacgatatttg

SEQ ID NO: 330777 - DNA, 20 bp, Artificial Sequence
  chemically synthesized
acctgcaaatatcgtaatgt

SEQ ID NO: 330778 - DNA, 20 bp, Artificial Sequence
  chemically synthesized
tgcaaatatcgtaatgtcag

SEQ ID NO: 330779 - DNA, 20 bp, Artificial Sequence
  chemically synthesized
tcagtagtgataactacaat

SEQ ID NO: 330780 - DNA, 20 bp, Artificial Sequence
  chemically synthesized
cagtagtgataactacaatg

SEQ ID NO: 330781 - DNA, 20 bp, Artificial Sequence
  chemically synthesized
tttaatttttttcctcattg

SEQ ID NO: 330782 - DNA, 20 bp, Artificial Sequence
  chemically synthesized
tacaatgaggaaaaaaatta

SEQ ID NO: 330783 - DNA, 20 bp, Artificial Sequence
  chemically synthesized
gaaaaaaattaaagctttga

SEQ ID NO: 330784 - DNA, 20 bp, Artificial Sequence
  chemically synthesized
aaaaattaaagctttgaaag

SEQ ID NO: 330785 - DNA, 20 bp, Artificial Sequence
  chemically synthesized
cattgttctgtcttctttca

SEQ ID NO: 330786 - DNA, 20 bp, Artificial Sequence
  chemically synthesized
attaaagctttgaaagaaga

SEQ ID NO: 330787 - DNA, 20 bp, Artificial Sequence
  chemically synthesized
tttgaaagaagacagaacaa

SEQ ID NO: 330788 - DNA, 20 bp, Artificial Sequence
  chemically synthesized
gaaagaagacagaacaatgg

SEQ ID NO: 330789 - DNA, 20 bp, Artificial Sequence
  chemically synthesized
agaagacagaacaatggtag

SEQ ID NO: 330790 - DNA, 20 bp, Artificial Sequence
  chemically synthesized
aatggtagtggcatatcaaa

SEQ ID NO: 330791 - DNA, 20 bp, Artificial Sequence
  chemically synthesized
atggtagtggcatatcaaat

SEQ ID NO: 330792 - DNA, 20 bp, Artificial Sequence
  chemically synthesized
tggtagtggcatatcaaata

SEQ ID NO: 330793 - DNA, 20 bp, Artificial Sequence
  chemically synthesized
tagtggcatatcaaataggg

SEQ ID NO: 330794 - DNA, 20 bp, Artificial Sequence
  chemically synthesized
ggcatatcaaatagggtagt

SEQ ID NO: 330795 - DNA, 20 bp, Artificial Sequence
  chemically synthesized
atcaaatagggtagtcagaa

SEQ ID NO: 330796 - DNA, 20 bp, Artificial Sequence
  chemically synthesized
agtcagaaaagatctctttg

SEQ ID NO: 330797 - DNA, 20 bp, Artificial Sequence
  chemically synthesized
cctttaccttagactgcaaa

SEQ ID NO: 330798 - DNA, 20 bp, Artificial Sequence
  chemically synthesized
ttcctttaccttagactgca

SEQ ID NO: 330799 - DNA, 20 bp, Artificial Sequence
  chemically synthesized
aaaagatctctttgcagtct

SEQ ID NO: 330800 - DNA, 20 bp, Artificial Sequence
  chemically synthesized
aaagatctctttgcagtcta

SEQ ID NO: 330801 - DNA, 20 bp, Artificial Sequence
  chemically synthesized
tctctttgcagtctaaggta

SEQ ID NO: 330802 - DNA, 20 bp, Artificial Sequence
  chemically synthesized
ctctttgcagtctaaggtaa

SEQ ID NO: 330803 - DNA, 20 bp, Artificial Sequence
  chemically synthesized
atggcgcacttcctttacct

SEQ ID NO: 330804 - DNA, 20 bp, Artificial Sequence
  chemically synthesized
tttgcagtctaaggtaaagg

SEQ ID NO: 330805 - DNA, 20 bp, Artificial Sequence
  chemically synthesized
ttttcccccagttattcata

SEQ ID NO: 330806 - DNA, 20 bp, Artificial Sequence
  chemically synthesized
aagtgcgccatatgaataac

SEQ ID NO: 330807 - DNA, 20 bp, Artificial Sequence
  chemically synthesized
agtgcgccatatgaataact

SEQ ID NO: 330808 - DNA, 20 bp, Artificial Sequence
  chemically synthesized
gtgcgccatatgaataactg

SEQ ID NO: 330809 - DNA, 20 bp, Artificial Sequence
  chemically synthesized
tgcgccatatgaataactgg

SEQ ID NO: 330810 - DNA, 20 bp, Artificial Sequence
  chemically synthesized
tcctggaagggtttttcccc

SEQ ID NO: 330811 - DNA, 20 bp, Artificial Sequence
  chemically synthesized
aactgggggaaaaacccttc

SEQ ID NO: 330812 - DNA, 20 bp, Artificial Sequence
  chemically synthesized
actgggggaaaaacccttcc

SEQ ID NO: 330813 - DNA, 20 bp, Artificial Sequence
  chemically synthesized
gggggaaaaacccttccagg

SEQ ID NO: 330814 - DNA, 20 bp, Artificial Sequence
  chemically synthesized
gtatctccctcttcctggaa

SEQ ID NO: 330815 - DNA, 20 bp, Artificial Sequence
  chemically synthesized
tgtatctccctcttcctgga

SEQ ID NO: 330816 - DNA, 20 bp, Artificial Sequence
  chemically synthesized
gggaaaaacccttccaggaa

SEQ ID NO: 330817 - DNA, 20 bp, Artificial Sequence
  chemically synthesized
atgtatctccctcttcctgg

SEQ ID NO: 330818 - DNA, 20 bp, Artificial Sequence
  chemically synthesized
ggaaaaacccttccaggaag

SEQ ID NO: 330819 - DNA, 20 bp, Artificial Sequence
  chemically synthesized
gaaaaacccttccaggaaga

SEQ ID NO: 330820 - DNA, 20 bp, Artificial Sequence
  chemically synthesized
cacatgtatctccctcttcc

SEQ ID NO: 330821 - DNA, 20 bp, Artificial Sequence
  chemically synthesized
aaaacccttccaggaagagg

SEQ ID NO: 330822 - DNA, 20 bp, Artificial Sequence
  chemically synthesized
aagagggagatacatgtgta

SEQ ID NO: 330823 - DNA, 20 bp, Artificial Sequence
  chemically synthesized
gtgtaaagtcactgaactca

SEQ ID NO: 330824 - DNA, 20 bp, Artificial Sequence
  chemically synthesized
cgccaagcatactttgagtt

SEQ ID NO: 330825 - DNA, 20 bp, Artificial Sequence
  chemically synthesized
aaatacgccaagcatacttt

SEQ ID NO: 330826 - DNA, 20 bp, Artificial Sequence
  chemically synthesized
cactgaactcaaagtatgct

SEQ ID NO: 330827 - DNA, 20 bp, Artificial Sequence
  chemically synthesized
agcttggcatcaaatacgcc

SEQ ID NO: 330828 - DNA, 20 bp, Artificial Sequence
  chemically synthesized
tgcttggcgtatttgatgcc

SEQ ID NO: 330829 - DNA, 20 bp, Artificial Sequence
  chemically synthesized
tggcgtatttgatgccaagc

SEQ ID NO: 330830 - DNA, 20 bp, Artificial Sequence
  chemically synthesized
cgtatttgatgccaagctag

SEQ ID NO: 330831 - DNA, 20 bp, Artificial Sequence
  chemically synthesized
gtatttgatgccaagctagt

SEQ ID NO: 330832 - DNA, 20 bp, Artificial Sequence
  chemically synthesized
gatacactggcctactagct

SEQ ID NO: 330833 - DNA, 20 bp, Artificial Sequence
  chemically synthesized
ttgatgccaagctagtaggc

SEQ ID NO: 330834 - DNA, 20 bp, Artificial Sequence
  chemically synthesized
ctccagatacactggcctac

SEQ ID NO: 330835 - DNA, 20 bp, Artificial Sequence
  chemically synthesized
agctagtaggccagtgtatc

SEQ ID NO: 330836 - DNA, 20 bp, Artificial Sequence
  chemically synthesized
tttctcagctccagatacac

SEQ ID NO: 330837 - DNA, 20 bp, Artificial Sequence
  chemically synthesized
ctagtaggccagtgtatctg

SEQ ID NO: 330838 - DNA, 20 bp, Artificial Sequence
  chemically synthesized
aggccagtgtatctggagct

SEQ ID NO: 330839 - DNA, 20 bp, Artificial Sequence
  chemically synthesized
ttaaccccatttctcagctc

SEQ ID NO: 330840 - DNA, 20 bp, Artificial Sequence
  chemically synthesized
gtgtatctggagctgagaaa

SEQ ID NO: 330841 - DNA, 20 bp, Artificial Sequence
  chemically synthesized
tgtatctggagctgagaaat

SEQ ID NO: 330842 - DNA, 20 bp, Artificial Sequence
  chemically synthesized
gtatctggagctgagaaatg

SEQ ID NO: 330843 - DNA, 20 bp, Artificial Sequence
  chemically synthesized
ctacccttaaccccatttct

SEQ ID NO: 330844 - DNA, 20 bp, Artificial Sequence
  chemically synthesized
tggagctgagaaatggggtt

SEQ ID NO: 330845 - DNA, 20 bp, Artificial Sequence
  chemically synthesized
ggagctgagaaatggggtta

SEQ ID NO: 330846 - DNA, 20 bp, Artificial Sequence
  chemically synthesized
gagctgagaaatggggttaa

SEQ ID NO: 330847 - DNA, 20 bp, Artificial Sequence
  chemically synthesized
ctgagaaatggggttaaggg

SEQ ID NO: 330848 - DNA, 20 bp, Artificial Sequence
  chemically synthesized
tgagaaatggggttaagggt

SEQ ID NO: 330849 - DNA, 20 bp, Artificial Sequence
  chemically synthesized
aaatggggttaagggtagga

SEQ ID NO: 330850 - DNA, 20 bp, Artificial Sequence
  chemically synthesized
tggggttaagggtaggaaag

SEQ ID NO: 330851 - DNA, 20 bp, Artificial Sequence
  chemically synthesized
ggggttaagggtaggaaaga

SEQ ID NO: 330852 - DNA, 20 bp, Artificial Sequence
  chemically synthesized
gttaagggtaggaaagaagg

SEQ ID NO: 330853 - DNA, 20 bp, Artificial Sequence
  chemically synthesized
ttaagggtaggaaagaaggt

SEQ ID NO: 330854 - DNA, 20 bp, Artificial Sequence
  chemically synthesized
gaaagaaggtaggataccta

SEQ ID NO: 330855 - DNA, 20 bp, Artificial Sequence
  chemically synthesized
aaagaaggtaggatacctat

SEQ ID NO: 330856 - DNA, 20 bp, Artificial Sequence
  chemically synthesized
aagaaggtaggatacctata

SEQ ID NO: 330857 - DNA, 20 bp, Artificial Sequence
  chemically synthesized
catcgtgatttgttccctat

SEQ ID NO: 330858 - DNA, 20 bp, Artificial Sequence
  chemically synthesized
ccatcgtgatttgttcccta

SEQ ID NO: 330859 - DNA, 20 bp, Artificial Sequence
  chemically synthesized
ctatagggaacaaatcacga

SEQ ID NO: 330860 - DNA, 20 bp, Artificial Sequence
  chemically synthesized
aacaaatcacgatggtgttt

SEQ ID NO: 330861 - DNA, 20 bp, Artificial Sequence
  chemically synthesized
ggtgttttggattttcttcc

SEQ ID NO: 330862 - DNA, 20 bp, Artificial Sequence
  chemically synthesized
taatttcactttacactcgg

SEQ ID NO: 330863 - DNA, 20 bp, Artificial Sequence
  chemically synthesized
tggattttcttccgagtgta

SEQ ID NO: 330864 - DNA, 20 bp, Artificial Sequence
  chemically synthesized
aaataatttcactttacact

SEQ ID NO: 330865 - DNA, 20 bp, Artificial Sequence
  chemically synthesized
agtgtaaagtgaaattattt

SEQ ID NO: 330866 - DNA, 20 bp, Artificial Sequence
  chemically synthesized
gtgtaaagtgaaattatttc

SEQ ID NO: 330867 - DNA, 20 bp, Artificial Sequence
  chemically synthesized
agtgaaattatttcaggatt

SEQ ID NO: 330868 - DNA, 20 bp, Artificial Sequence
  chemically synthesized
agtagagaagatgttgagag

SEQ ID NO: 330869 - DNA, 20 bp, Artificial Sequence
  chemically synthesized
gtaagtagagaagatgttga

SEQ ID NO: 330870 - DNA, 20 bp, Artificial Sequence
  chemically synthesized
gagtaagtagagaagatgtt

SEQ ID NO: 330871 - DNA, 20 bp, Artificial Sequence
  chemically synthesized
tacaaactgagtaagtagag

SEQ ID NO: 330872 - DNA, 20 bp, Artificial Sequence
  chemically synthesized
atttacaaactgagtaagta

SEQ ID NO: 330873 - DNA, 20 bp, Artificial Sequence
  chemically synthesized
caacatcttctctacttact

SEQ ID NO: 330874 - DNA, 20 bp, Artificial Sequence
  chemically synthesized
gaatttacaaactgagtaag

SEQ ID NO: 330875 - DNA, 20 bp, Artificial Sequence
  chemically synthesized
aaggaatttacaaactgagt

SEQ ID NO: 330876 - DNA, 20 bp, Artificial Sequence
  chemically synthesized
ccttaaggaatttacaaact

SEQ ID NO: 330877 - DNA, 20 bp, Artificial Sequence
  chemically synthesized
actcagtttgtaaattcctt

SEQ ID NO: 330878 - DNA, 20 bp, Artificial Sequence
  chemically synthesized
ctcagtttgtaaattcctta

SEQ ID NO: 330879 - DNA, 20 bp, Artificial Sequence
  chemically synthesized
tcagtttgtaaattccttaa

SEQ ID NO: 330880 - DNA, 20 bp, Artificial Sequence
  chemically synthesized
tggccatattattgccctta

SEQ ID NO: 330881 - DNA, 20 bp, Artificial Sequence
  chemically synthesized
atggccatattattgccctt

SEQ ID NO: 330882 - DNA, 20 bp, Artificial Sequence
  chemically synthesized
attccttaagggcaataata

SEQ ID NO: 330883 - DNA, 20 bp, Artificial Sequence
  chemically synthesized
ccaagcatggggaacatata

SEQ ID NO: 330884 - DNA, 20 bp, Artificial Sequence
  chemically synthesized
ccatatatgttccccatgct

SEQ ID NO: 330885 - DNA, 20 bp, Artificial Sequence
  chemically synthesized
gagacagtgaaccaagcatg

SEQ ID NO: 330886 - DNA, 20 bp, Artificial Sequence
  chemically synthesized
agagacagtgaaccaagcat

SEQ ID NO: 330887 - DNA, 20 bp, Artificial Sequence
  chemically synthesized
gagagacagtgaaccaagca

SEQ ID NO: 330888 - DNA, 20 bp, Artificial Sequence
  chemically synthesized
ggaatgagagacagtgaacc

SEQ ID NO: 330889 - DNA, 20 bp, Artificial Sequence
  chemically synthesized
aactattatggaatgagaga

SEQ ID NO: 330890 - DNA, 20 bp, Artificial Sequence
  chemically synthesized
tggtaactattatggaatga

SEQ ID NO: 330891 - DNA, 20 bp, Artificial Sequence
  chemically synthesized
agtggtaactattatggaat

SEQ ID NO: 330892 - DNA, 20 bp, Artificial Sequence
  chemically synthesized
cactgtctctcattccataa

SEQ ID NO: 330893 - DNA, 20 bp, Artificial Sequence
  chemically synthesized
tggaatagtggtaactatta

SEQ ID NO: 330894 - DNA, 20 bp, Artificial Sequence
  chemically synthesized
cgatgggtcttgtggaatag

SEQ ID NO: 330895 - DNA, 20 bp, Artificial Sequence
  chemically synthesized
aatagttaccactattccac

SEQ ID NO: 330896 - DNA, 20 bp, Artificial Sequence
  chemically synthesized
aatcgatgggtcttgtggaa

SEQ ID NO: 330897 - DNA, 20 bp, Artificial Sequence
  chemically synthesized
attctaatcgatgggtcttg

SEQ ID NO: 330898 - DNA, 20 bp, Artificial Sequence
  chemically synthesized
attccacaagacccatcgat

SEQ ID NO: 330899 - DNA, 20 bp, Artificial Sequence
  chemically synthesized
aatccataattctaatcgat

SEQ ID NO: 330900 - DNA, 20 bp, Artificial Sequence
  chemically synthesized
aaatccataattctaatcga

SEQ ID NO: 330901 - DNA, 20 bp, Artificial Sequence
  chemically synthesized
agacccatcgattagaatta

SEQ ID NO: 330902 - DNA, 20 bp, Artificial Sequence
  chemically synthesized
tcgattagaattatggattt

SEQ ID NO: 330903 - DNA, 20 bp, Artificial Sequence
  chemically synthesized
cgattagaattatggattta

SEQ ID NO: 330904 - DNA, 20 bp, Artificial Sequence
  chemically synthesized
ttatggatttaaggcttgca

SEQ ID NO: 330905 - DNA, 20 bp, Artificial Sequence
  chemically synthesized
tatggatttaaggcttgcaa

SEQ ID NO: 330906 - DNA, 20 bp, Artificial Sequence
  chemically synthesized
tggatttaaggcttgcaaag

SEQ ID NO: 330907 - DNA, 20 bp, Artificial Sequence
  chemically synthesized
tgagctttcttctcctttgc

SEQ ID NO: 330908 - DNA, 20 bp, Artificial Sequence
  chemically synthesized
atttaaggcttgcaaaggag

SEQ ID NO: 330909 - DNA, 20 bp, Artificial Sequence
  chemically synthesized
aaggcttgcaaaggagaaga

SEQ ID NO: 330910 - DNA, 20 bp, Artificial Sequence
  chemically synthesized
aaggagaagaaagctcatct

SEQ ID NO: 330911 - DNA, 20 bp, Artificial Sequence
  chemically synthesized
accatatagctgtctaagat

SEQ ID NO: 330912 - DNA, 20 bp, Artificial Sequence
  chemically synthesized
agaagaaagctcatcttaga

SEQ ID NO: 330913 - DNA, 20 bp, Artificial Sequence
  chemically synthesized
ctggaaccatatagctgtct

SEQ ID NO: 330914 - DNA, 20 bp, Artificial Sequence
  chemically synthesized
gctcatcttagacagctata

SEQ ID NO: 330915 - DNA, 20 bp, Artificial Sequence
  chemically synthesized
tactatgtactggaaccata

SEQ ID NO: 330916 - DNA, 20 bp, Artificial Sequence
  chemically synthesized
cttagacagctatatggttc

SEQ ID NO: 330917 - DNA, 20 bp, Artificial Sequence
  chemically synthesized
agctatatggttccagtaca

SEQ ID NO: 330918 - DNA, 20 bp, Artificial Sequence
  chemically synthesized
tatgttcacttactatgtac

SEQ ID NO: 330919 - DNA, 20 bp, Artificial Sequence
  chemically synthesized
atatggttccagtacatagt

SEQ ID NO: 330920 - DNA, 20 bp, Artificial Sequence
  chemically synthesized
tagtaagtgaacatattaat

SEQ ID NO: 330921 - DNA, 20 bp, Artificial Sequence
  chemically synthesized
gcagtcggtcacgggacaca

SEQ ID NO: 330922 - DNA, 20 bp, Artificial Sequence
  chemically synthesized
tgtaaaaggcagtcggtcac

SEQ ID NO: 330923 - DNA, 20 bp, Artificial Sequence
  chemically synthesized
ttgtaaaaggcagtcggtca

SEQ ID NO: 330924 - DNA, 20 bp, Artificial Sequence
  chemically synthesized
gactggttgtaaaaggcagt

SEQ ID NO: 330925 - DNA, 20 bp, Artificial Sequence
  chemically synthesized
atgagactggttgtaaaagg

SEQ ID NO: 330926 - DNA, 20 bp, Artificial Sequence
  chemically synthesized
ctaatgagactggttgtaaa

SEQ ID NO: 330927 - DNA, 20 bp, Artificial Sequence
  chemically synthesized
gaccgactgccttttacaac

SEQ ID NO: 330928 - DNA, 20 bp, Artificial Sequence
  chemically synthesized
cctaatgagactggttgtaa

SEQ ID NO: 330929 - DNA, 20 bp, Artificial Sequence
  chemically synthesized
ccttttacaaccagtctcat

SEQ ID NO: 330930 - DNA, 20 bp, Artificial Sequence
  chemically synthesized
tatagactacctaatgagac

SEQ ID NO: 330931 - DNA, 20 bp, Artificial Sequence
  chemically synthesized
cttttacaaccagtctcatt

SEQ ID NO: 330932 - DNA, 20 bp, Artificial Sequence
  chemically synthesized
ttacaaccagtctcattagg

SEQ ID NO: 330933 - DNA, 20 bp, Artificial Sequence
  chemically synthesized
ttaagtatagactacctaat

SEQ ID NO: 330934 - DNA, 20 bp, Artificial Sequence
  chemically synthesized
gtcagagtagtgtttaagta

SEQ ID NO: 330935 - DNA, 20 bp, Artificial Sequence
  chemically synthesized
cctctgtcagagtagtgttt

SEQ ID NO: 330936 - DNA, 20 bp, Artificial Sequence
  chemically synthesized
atacttaaacactactctga

SEQ ID NO: 330937 - DNA, 20 bp, Artificial Sequence
  chemically synthesized
tagtgagccctctgtcagag

SEQ ID NO: 330938 - DNA, 20 bp, Artificial Sequence
  chemically synthesized
acttaaacactactctgaca

SEQ ID NO: 330939 - DNA, 20 bp, Artificial Sequence
  chemically synthesized
cttaaacactactctgacag

SEQ ID NO: 330940 - DNA, 20 bp, Artificial Sequence
  chemically synthesized
ttaaacactactctgacaga

SEQ ID NO: 330941 - DNA, 20 bp, Artificial Sequence
  chemically synthesized
ggatagtgagccctctgtca

SEQ ID NO: 330942 - DNA, 20 bp, Artificial Sequence
  chemically synthesized
ggggatagtgagccctctgt

SEQ ID NO: 330943 - DNA, 20 bp, Artificial Sequence
  chemically synthesized
aaaaggctttgggggatagt

SEQ ID NO: 330944 - DNA, 20 bp, Artificial Sequence
  chemically synthesized
agagggctcactatccccca

SEQ ID NO: 330945 - DNA, 20 bp, Artificial Sequence
  chemically synthesized
caataaaaggctttggggga

SEQ ID NO: 330946 - DNA, 20 bp, Artificial Sequence
  chemically synthesized
aatgcaataaaaggctttgg

SEQ ID NO: 330947 - DNA, 20 bp, Artificial Sequence
  chemically synthesized
aaatgcaataaaaggctttg

SEQ ID NO: 330948 - DNA, 20 bp, Artificial Sequence
  chemically synthesized
aaaatgcaataaaaggcttt

SEQ ID NO: 330949 - DNA, 20 bp, Artificial Sequence
  chemically synthesized
caaaatgcaataaaaggctt

SEQ ID NO: 330950 - DNA, 20 bp, Artificial Sequence
  chemically synthesized
atgtctcaaaatgcaataaa

SEQ ID NO: 330951 - DNA, 20 bp, Artificial Sequence
  chemically synthesized
aatgtctcaaaatgcaataa

SEQ ID NO: 330952 - DNA, 20 bp, Artificial Sequence
  chemically synthesized
aaagccttttattgcatttt

SEQ ID NO: 330953 - DNA, 20 bp, Artificial Sequence
  chemically synthesized
gcattttgagacatttctat

SEQ ID NO: 330954 - DNA, 20 bp, Artificial Sequence
  chemically synthesized
tttgagacatttctattagc

SEQ ID NO: 330955 - DNA, 20 bp, Artificial Sequence
  chemically synthesized
gatatttgaatactcgctaa

SEQ ID NO: 330956 - DNA, 20 bp, Artificial Sequence
  chemically synthesized
ttaacttgctaaaattcatg

SEQ ID NO: 330957 - DNA, 20 bp, Artificial Sequence
  chemically synthesized
gttaacttgctaaaattcat

SEQ ID NO: 330958 - DNA, 20 bp, Artificial Sequence
  chemically synthesized
atatttgaccccatgaattt

SEQ ID NO: 330959 - DNA, 20 bp, Artificial Sequence
  chemically synthesized
agttaacttgctaaaattca

SEQ ID NO: 330960 - DNA, 20 bp, Artificial Sequence
  chemically synthesized
ttgaccccatgaattttagc

SEQ ID NO: 330961 - DNA, 20 bp, Artificial Sequence
  chemically synthesized
tgaattttagcaagttaact

SEQ ID NO: 330962 - DNA, 20 bp, Artificial Sequence
  chemically synthesized
caaaattgaaatcataaact

SEQ ID NO: 330963 - DNA, 20 bp, Artificial Sequence
  chemically synthesized
ttagtttatgatttcaattt

SEQ ID NO: 330964 - DNA, 20 bp, Artificial Sequence
  chemically synthesized
aatttaattttttatgcttg

SEQ ID NO: 330965 - DNA, 20 bp, Artificial Sequence
  chemically synthesized
tttaattttttatgcttgaa

SEQ ID NO: 330966 - DNA, 20 bp, Artificial Sequence
  chemically synthesized
ttttttgatatgaactcttc

SEQ ID NO: 330967 - DNA, 20 bp, Artificial Sequence
  chemically synthesized
tatcaaaaaaaacaaatttt

SEQ ID NO: 330968 - DNA, 20 bp, Artificial Sequence
  chemically synthesized
tcaaaaaaaacaaattttga

SEQ ID NO: 330969 - DNA, 20 bp, Artificial Sequence
  chemically synthesized
aaaaacaaattttgagagca

SEQ ID NO: 330970 - DNA, 20 bp, Artificial Sequence
  chemically synthesized
tgaactatgaaataaaaaca

SEQ ID NO: 330971 - DNA, 20 bp, Artificial Sequence
  chemically synthesized
atggccatgtttttatttca

SEQ ID NO: 330972 - DNA, 20 bp, Artificial Sequence
  chemically synthesized
ttcatagttcattttgtcct

SEQ ID NO: 330973 - DNA, 20 bp, Artificial Sequence
  chemically synthesized
tatgttgtcagaaacatcta

SEQ ID NO: 330974 - DNA, 20 bp, Artificial Sequence
  chemically synthesized
ttatgttgtcagaaacatct

SEQ ID NO: 330975 - DNA, 20 bp, Artificial Sequence
  chemically synthesized
cactgctaaatttatgttgt

SEQ ID NO: 330976 - DNA, 20 bp, Artificial Sequence
  chemically synthesized
tgtttctgacaacataaatt

SEQ ID NO: 330977 - DNA, 20 bp, Artificial Sequence
  chemically synthesized
ttctgacaacataaatttag

SEQ ID NO: 330978 - DNA, 20 bp, Artificial Sequence
  chemically synthesized
acaacataaatttagcagtg

SEQ ID NO: 330979 - DNA, 20 bp, Artificial Sequence
  chemically synthesized
acataaatttagcagtgtag

SEQ ID NO: 330980 - DNA, 20 bp, Artificial Sequence
  chemically synthesized
aagctggaaataaatatgaa

SEQ ID NO: 330981 - DNA, 20 bp, Artificial Sequence
  chemically synthesized
acaccattcatatttatttc

SEQ ID NO: 330982 - DNA, 20 bp, Artificial Sequence
  chemically synthesized
atgtctcaaaggtagaaagc

SEQ ID NO: 330983 - DNA, 20 bp, Artificial Sequence
  chemically synthesized
ttacatgtctcaaaggtaga

SEQ ID NO: 330984 - DNA, 20 bp, Artificial Sequence
  chemically synthesized
atttccagctttctaccttt

SEQ ID NO: 330985 - DNA, 20 bp, Artificial Sequence
  chemically synthesized
cgtattacatgtctcaaagg

SEQ ID NO: 330986 - DNA, 20 bp, Artificial Sequence
  chemically synthesized
attcgtattacatgtctcaa

SEQ ID NO: 330987 - DNA, 20 bp, Artificial Sequence
  chemically synthesized
tattcgtattacatgtctca

SEQ ID NO: 330988 - DNA, 20 bp, Artificial Sequence
  chemically synthesized
tgtaatacgaatatatttct

SEQ ID NO: 330989 - DNA, 20 bp, Artificial Sequence
  chemically synthesized
cgaatatatttcttagttct

SEQ ID NO: 330990 - DNA, 20 bp, Artificial Sequence
  chemically synthesized
gtctcacccaacttagaact

SEQ ID NO: 330991 - DNA, 20 bp, Artificial Sequence
  chemically synthesized
tatatttcttagttctaagt

SEQ ID NO: 330992 - DNA, 20 bp, Artificial Sequence
  chemically synthesized
atatttcttagttctaagtt

SEQ ID NO: 330993 - DNA, 20 bp, Artificial Sequence
  chemically synthesized
ttacatggtctcacccaact

SEQ ID NO: 330994 - DNA, 20 bp, Artificial Sequence
  chemically synthesized
ttcttagttctaagttgggt

SEQ ID NO: 330995 - DNA, 20 bp, Artificial Sequence
  chemically synthesized
gttgggtgagaccatgtaac

SEQ ID NO: 330996 - DNA, 20 bp, Artificial Sequence
  chemically synthesized
cacgagcacaactagttaca

SEQ ID NO: 330997 - DNA, 20 bp, Artificial Sequence
  chemically synthesized
tcacaactcacgagcacaac

SEQ ID NO: 330998 - DNA, 20 bp, Artificial Sequence
  chemically synthesized
atgtaactagttgtgctcgt

SEQ ID NO: 330999 - DNA, 20 bp, Artificial Sequence
  chemically synthesized
tgcttcagttcacaactcac

SEQ ID NO: 331000 - DNA, 20 bp, Artificial Sequence
  chemically synthesized
tgctcgtgagttgtgaactg

SEQ ID NO: 331001 - DNA, 20 bp, Artificial Sequence
  chemically synthesized
tcgtgagttgtgaactgaag

SEQ ID NO: 331002 - DNA, 20 bp, Artificial Sequence
  chemically synthesized
tggaagtgacatatctgctt

SEQ ID NO: 331003 - DNA, 20 bp, Artificial Sequence
  chemically synthesized
tgaagcagatatgtcacttc

SEQ ID NO: 331004 - DNA, 20 bp, Artificial Sequence
  chemically synthesized
agatatgtcacttccagttc

SEQ ID NO: 331005 - DNA, 20 bp, Artificial Sequence
  chemically synthesized
caattaattgcttgaactgg

SEQ ID NO: 331006 - DNA, 20 bp, Artificial Sequence
  chemically synthesized
tggcaattaattgcttgaac

SEQ ID NO: 331007 - DNA, 20 bp, Artificial Sequence
  chemically synthesized
cagttcaagcaattaattgc

SEQ ID NO: 331008 - DNA, 20 bp, Artificial Sequence
  chemically synthesized
aagcaattaattgccagcac

SEQ ID NO: 331009 - DNA, 20 bp, Artificial Sequence
  chemically synthesized
aattctgaaaggtcttgtgc

SEQ ID NO: 331010 - DNA, 20 bp, Artificial Sequence
  chemically synthesized
attgccagcacaagaccttt

SEQ ID NO: 331011 - DNA, 20 bp, Artificial Sequence
  chemically synthesized
aagggaaagaaaattctgaa

SEQ ID NO: 331012 - DNA, 20 bp, Artificial Sequence
  chemically synthesized
aaagggaaagaaaattctga

SEQ ID NO: 331013 - DNA, 20 bp, Artificial Sequence
  chemically synthesized
ccagtcactccgcaaaggga

SEQ ID NO: 331014 - DNA, 20 bp, Artificial Sequence
  chemically synthesized
cagaattttctttccctttg

SEQ ID NO: 331015 - DNA, 20 bp, Artificial Sequence
  chemically synthesized
gaattttctttccctttgcg

SEQ ID NO: 331016 - DNA, 20 bp, Artificial Sequence
  chemically synthesized
actcccagtcactccgcaaa

SEQ ID NO: 331017 - DNA, 20 bp, Artificial Sequence
  chemically synthesized
tactcccagtcactccgcaa

SEQ ID NO: 331018 - DNA, 20 bp, Artificial Sequence
  chemically synthesized
atactcccagtcactccgca

SEQ ID NO: 331019 - DNA, 20 bp, Artificial Sequence
  chemically synthesized
ctttccctttgcggagtgac

SEQ ID NO: 331020 - DNA, 20 bp, Artificial Sequence
  chemically synthesized
tttccctttgcggagtgact

SEQ ID NO: 331021 - DNA, 20 bp, Artificial Sequence
  chemically synthesized
tccctttgcggagtgactgg

SEQ ID NO: 331022 - DNA, 20 bp, Artificial Sequence
  chemically synthesized
gctactatctaggatactcc

SEQ ID NO: 331023 - DNA, 20 bp, Artificial Sequence
  chemically synthesized
cggagtgactgggagtatcc

SEQ ID NO: 331024 - DNA, 20 bp, Artificial Sequence
  chemically synthesized
gtgactgggagtatcctaga

SEQ ID NO: 331025 - DNA, 20 bp, Artificial Sequence
  chemically synthesized
actgggagtatcctagatag

SEQ ID NO: 331026 - DNA, 20 bp, Artificial Sequence
  chemically synthesized
tgatgaaacagctactatct

SEQ ID NO: 331027 - DNA, 20 bp, Artificial Sequence
  chemically synthesized
ctgatgaaacagctactatc

SEQ ID NO: 331028 - DNA, 20 bp, Artificial Sequence
  chemically synthesized
ctagatagtagctgtttcat

SEQ ID NO: 331029 - DNA, 20 bp, Artificial Sequence
  chemically synthesized
tagatagtagctgtttcatc

SEQ ID NO: 331030 - DNA, 20 bp, Artificial Sequence
  chemically synthesized
ggaaacccagcctgatgaaa

SEQ ID NO: 331031 - DNA, 20 bp, Artificial Sequence
  chemically synthesized
tagtagctgtttcatcaggc

SEQ ID NO: 331032 - DNA, 20 bp, Artificial Sequence
  chemically synthesized
agtagctgtttcatcaggct

SEQ ID NO: 331033 - DNA, 20 bp, Artificial Sequence
  chemically synthesized
attgtggtcatttggaaacc

SEQ ID NO: 331034 - DNA, 20 bp, Artificial Sequence
  chemically synthesized
cgctattcattgtggtcatt

SEQ ID NO: 331035 - DNA, 20 bp, Artificial Sequence
  chemically synthesized
ttccaaatgaccacaatgaa

SEQ ID NO: 331036 - DNA, 20 bp, Artificial Sequence
  chemically synthesized
caagggaacgctattcattg

SEQ ID NO: 331037 - DNA, 20 bp, Artificial Sequence
  chemically synthesized
tgtgcactgtgaatcagcaa

SEQ ID NO: 331038 - DNA, 20 bp, Artificial Sequence
  chemically synthesized
atgtgcactgtgaatcagca

SEQ ID NO: 331039 - DNA, 20 bp, Artificial Sequence
  chemically synthesized
aatgtgcactgtgaatcagc

SEQ ID NO: 331040 - DNA, 20 bp, Artificial Sequence
  chemically synthesized
agcgttcccttgctgattca

SEQ ID NO: 331041 - DNA, 20 bp, Artificial Sequence
  chemically synthesized
ttccaatgtgcactgtgaat

SEQ ID NO: 331042 - DNA, 20 bp, Artificial Sequence
  chemically synthesized
tgctgattcacagtgcacat

SEQ ID NO: 331043 - DNA, 20 bp, Artificial Sequence
  chemically synthesized
cagtgcacattggaatgaaa

SEQ ID NO: 331044 - DNA, 20 bp, Artificial Sequence
  chemically synthesized
atgaaaaagttattataaca

SEQ ID NO: 331045 - DNA, 20 bp, Artificial Sequence
  chemically synthesized
acatagtgaaatttaataac

SEQ ID NO: 331046 - DNA, 20 bp, Artificial Sequence
  chemically synthesized
tgaaatttaataaccagatc

SEQ ID NO: 331047 - DNA, 20 bp, Artificial Sequence
  chemically synthesized
taaaccagtcattctagatc

SEQ ID NO: 331048 - DNA, 20 bp, Artificial Sequence
  chemically synthesized
ataaccagatctagaatgac

SEQ ID NO: 331049 - DNA, 20 bp, Artificial Sequence
  chemically synthesized
gccatctaaaccagtcattc

SEQ ID NO: 331050 - DNA, 20 bp, Artificial Sequence
  chemically synthesized
cagatctagaatgactggtt

SEQ ID NO: 331051 - DNA, 20 bp, Artificial Sequence
  chemically synthesized
tctagaatgactggtttaga

SEQ ID NO: 331052 - DNA, 20 bp, Artificial Sequence
  chemically synthesized
ttattaagtgccatctaaac

SEQ ID NO: 331053 - DNA, 20 bp, Artificial Sequence
  chemically synthesized
ctagtcacttaatgtttatt

SEQ ID NO: 331054 - DNA, 20 bp, Artificial Sequence
  chemically synthesized
gatggcacttaataaacatt

SEQ ID NO: 331055 - DNA, 20 bp, Artificial Sequence
  chemically synthesized
cttaataaacattaagtgac

SEQ ID NO: 331056 - DNA, 20 bp, Artificial Sequence
  chemically synthesized
ctgctgttagaatgtgttac

SEQ ID NO: 331057 - DNA, 20 bp, Artificial Sequence
  chemically synthesized
tgactagtaacacattctaa

SEQ ID NO: 331058 - DNA, 20 bp, Artificial Sequence
  chemically synthesized
ctagtaacacattctaacag

SEQ ID NO: 331059 - DNA, 20 bp, Artificial Sequence
  chemically synthesized
tgcaggttaaagactgctgt

SEQ ID NO: 331060 - DNA, 20 bp, Artificial Sequence
  chemically synthesized
gtatcacaatatgcaggtta

SEQ ID NO: 331061 - DNA, 20 bp, Artificial Sequence
  chemically synthesized
actaatgtatcacaatatgc

SEQ ID NO: 331062 - DNA, 20 bp, Artificial Sequence
  chemically synthesized
tactaatgtatcacaatatg

SEQ ID NO: 331063 - DNA, 20 bp, Artificial Sequence
  chemically synthesized
acctgcatattgtgatacat

SEQ ID NO: 331064 - DNA, 20 bp, Artificial Sequence
  chemically synthesized
gataacccaattgtggtttg

SEQ ID NO: 331065 - DNA, 20 bp, Artificial Sequence
  chemically synthesized
atgataacccaattgtggtt

SEQ ID NO: 331066 - DNA, 20 bp, Artificial Sequence
  chemically synthesized
gtaaatctccaaaccacaat

SEQ ID NO: 331067 - DNA, 20 bp, Artificial Sequence
  chemically synthesized
taaatctccaaaccacaatt

SEQ ID NO: 331068 - DNA, 20 bp, Artificial Sequence
  chemically synthesized
ttaccatgataacccaattg

SEQ ID NO: 331069 - DNA, 20 bp, Artificial Sequence
  chemically synthesized
aaaccacaattgggttatca

SEQ ID NO: 331070 - DNA, 20 bp, Artificial Sequence
  chemically synthesized
acaattgggttatcatggta

SEQ ID NO: 331071 - DNA, 20 bp, Artificial Sequence
  chemically synthesized
aattgggttatcatggtaaa

SEQ ID NO: 331072 - DNA, 20 bp, Artificial Sequence
  chemically synthesized
tatcatggtaaagagcttta

SEQ ID NO: 331073 - DNA, 20 bp, Artificial Sequence
  chemically synthesized
catggtaaagagctttatgg

SEQ ID NO: 331074 - DNA, 20 bp, Artificial Sequence
  chemically synthesized
atgtcctagaaactaccata

SEQ ID NO: 331075 - DNA, 20 bp, Artificial Sequence
  chemically synthesized
aagagctttatggtagtttc

SEQ ID NO: 331076 - DNA, 20 bp, Artificial Sequence
  chemically synthesized
agagctttatggtagtttct

SEQ ID NO: 331077 - DNA, 20 bp, Artificial Sequence
  chemically synthesized
attgagtaattagtatgtcc

SEQ ID NO: 331078 - DNA, 20 bp, Artificial Sequence
  chemically synthesized
atagaaaattattgagtaat

SEQ ID NO: 331079 - DNA, 20 bp, Artificial Sequence
  chemically synthesized
tctttcaatagaaaattatt

SEQ ID NO: 331080 - DNA, 20 bp, Artificial Sequence
  chemically synthesized
actcaataattttctattga

SEQ ID NO: 331081 - DNA, 20 bp, Artificial Sequence
  chemically synthesized
caataattttctattgaaag

SEQ ID NO: 331082 - DNA, 20 bp, Artificial Sequence
  chemically synthesized
atcgccactccttctttcaa

SEQ ID NO: 331083 - DNA, 20 bp, Artificial Sequence
  chemically synthesized
aataattttctattgaaaga

SEQ ID NO: 331084 - DNA, 20 bp, Artificial Sequence
  chemically synthesized
taattttctattgaaagaag

SEQ ID NO: 331085 - DNA, 20 bp, Artificial Sequence
  chemically synthesized
ttttctattgaaagaaggag

SEQ ID NO: 331086 - DNA, 20 bp, Artificial Sequence
  chemically synthesized
aagaaggagtggcgattcct

SEQ ID NO: 331087 - DNA, 20 bp, Artificial Sequence
  chemically synthesized
agaaggagtggcgattcctc

SEQ ID NO: 331088 - DNA, 20 bp, Artificial Sequence
  chemically synthesized
gaaggagtggcgattcctca

SEQ ID NO: 331089 - DNA, 20 bp, Artificial Sequence
  chemically synthesized
tttctagttctagatccctg

SEQ ID NO: 331090 - DNA, 20 bp, Artificial Sequence
  chemically synthesized
gtggcgattcctcagggatc

SEQ ID NO: 331091 - DNA, 20 bp, Artificial Sequence
  chemically synthesized
atttctagttctagatccct

SEQ ID NO: 331092 - DNA, 20 bp, Artificial Sequence
  chemically synthesized
attcctcagggatctagaac

SEQ ID NO: 331093 - DNA, 20 bp, Artificial Sequence
  chemically synthesized
tcaagtggtatttctagttc

SEQ ID NO: 331094 - DNA, 20 bp, Artificial Sequence
  chemically synthesized
gctgggtcaagtggtatttc

SEQ ID NO: 331095 - DNA, 20 bp, Artificial Sequence
  chemically synthesized
actagaaataccacttgacc

SEQ ID NO: 331096 - DNA, 20 bp, Artificial Sequence
  chemically synthesized
aatgtgatggctgggtcaag

SEQ ID NO: 331097 - DNA, 20 bp, Artificial Sequence
  chemically synthesized
agtaatgtgatggctgggtc

SEQ ID NO: 331098 - DNA, 20 bp, Artificial Sequence
  chemically synthesized
tacccagtaatgtgatggct

SEQ ID NO: 331099 - DNA, 20 bp, Artificial Sequence
  chemically synthesized
atacccagtaatgtgatggc

SEQ ID NO: 331100 - DNA, 20 bp, Artificial Sequence
  chemically synthesized
gtatatacccagtaatgtga

SEQ ID NO: 331101 - DNA, 20 bp, Artificial Sequence
  chemically synthesized
tgacccagccatcacattac

SEQ ID NO: 331102 - DNA, 20 bp, Artificial Sequence
  chemically synthesized
gacccagccatcacattact

SEQ ID NO: 331103 - DNA, 20 bp, Artificial Sequence
  chemically synthesized
taatcctttgggtatatacc

SEQ ID NO: 331104 - DNA, 20 bp, Artificial Sequence
  chemically synthesized
cattactgggtatataccca

SEQ ID NO: 331105 - DNA, 20 bp, Artificial Sequence
  chemically synthesized
attactgggtatatacccaa

SEQ ID NO: 331106 - DNA, 20 bp, Artificial Sequence
  chemically synthesized
agcatgatttataatccttt

SEQ ID NO: 331107 - DNA, 20 bp, Artificial Sequence
  chemically synthesized
cagcatgatttataatcctt

SEQ ID NO: 331108 - DNA, 20 bp, Artificial Sequence
  chemically synthesized
ttataaatcatgctgctata

SEQ ID NO: 331109 - DNA, 20 bp, Artificial Sequence
  chemically synthesized
gtgtacatgtatctttatag

SEQ ID NO: 331110 - DNA, 20 bp, Artificial Sequence
  chemically synthesized
tacgtgtacatgtatcttta

SEQ ID NO: 331111 - DNA, 20 bp, Artificial Sequence
  chemically synthesized
atgtacacgtatgcttattg

SEQ ID NO: 331112 - DNA, 20 bp, Artificial Sequence
  chemically synthesized
attgtgagtagtgccacaat

SEQ ID NO: 331113 - DNA, 20 bp, Artificial Sequence
  chemically synthesized
tattgtggcactactcacaa

SEQ ID NO: 331114 - DNA, 20 bp, Artificial Sequence
  chemically synthesized
caagtctttgctattgtgag

SEQ ID NO: 331115 - DNA, 20 bp, Artificial Sequence
  chemically synthesized
ttccaagtctttgctattgt

SEQ ID NO: 331116 - DNA, 20 bp, Artificial Sequence
  chemically synthesized
tggcactactcacaatagca

SEQ ID NO: 331117 - DNA, 20 bp, Artificial Sequence
  chemically synthesized
tactcacaatagcaaagact

SEQ ID NO: 331118 - DNA, 20 bp, Artificial Sequence
  chemically synthesized
tggacatttgggttgattcc

SEQ ID NO: 331119 - DNA, 20 bp, Artificial Sequence
  chemically synthesized
tctatcattgttggacattt

SEQ ID NO: 331120 - DNA, 20 bp, Artificial Sequence
  chemically synthesized
gtctatcattgttggacatt

SEQ ID NO: 331121 - DNA, 20 bp, Artificial Sequence
  chemically synthesized
acccaaatgtccaacaatga

SEQ ID NO: 331122 - DNA, 20 bp, Artificial Sequence
  chemically synthesized
ttaatccagtctatcattgt

SEQ ID NO: 331123 - DNA, 20 bp, Artificial Sequence
  chemically synthesized
aatgtccaacaatgatagac

SEQ ID NO: 331124 - DNA, 20 bp, Artificial Sequence
  chemically synthesized
caacaatgatagactggatt

SEQ ID NO: 331125 - DNA, 20 bp, Artificial Sequence
  chemically synthesized
tgtggcacattttcttaatc

SEQ ID NO: 331126 - DNA, 20 bp, Artificial Sequence
  chemically synthesized
agtattccatggtgtatatg

SEQ ID NO: 331127 - DNA, 20 bp, Artificial Sequence
  chemically synthesized
aatgtgccacatatacacca

SEQ ID NO: 331128 - DNA, 20 bp, Artificial Sequence
  chemically synthesized
tatggctgcatagtattcca

SEQ ID NO: 331129 - DNA, 20 bp, Artificial Sequence
  chemically synthesized
atacaccatggaatactatg

SEQ ID NO: 331130 - DNA, 20 bp, Artificial Sequence
  chemically synthesized
catccttttttatggctgca

SEQ ID NO: 331131 - DNA, 20 bp, Artificial Sequence
  chemically synthesized
aatactatgcagccataaaa

SEQ ID NO: 331132 - DNA, 20 bp, Artificial Sequence
  chemically synthesized
atactatgcagccataaaaa

SEQ ID NO: 331133 - DNA, 20 bp, Artificial Sequence
  chemically synthesized
catgaactcatcctttttta

SEQ ID NO: 331134 - DNA, 20 bp, Artificial Sequence
  chemically synthesized
atgcagccataaaaaaggat

SEQ ID NO: 331135 - DNA, 20 bp, Artificial Sequence
  chemically synthesized
ggatgagttcatgtcctttg

SEQ ID NO: 331136 - DNA, 20 bp, Artificial Sequence
  chemically synthesized
gatgagttcatgtcctttgt

SEQ ID NO: 331137 - DNA, 20 bp, Artificial Sequence
  chemically synthesized
atgagttcatgtcctttgta

SEQ ID NO: 331138 - DNA, 20 bp, Artificial Sequence
  chemically synthesized
cttcatccatgtccctacaa

SEQ ID NO: 331139 - DNA, 20 bp, Artificial Sequence
  chemically synthesized
gcttcatccatgtccctaca

SEQ ID NO: 331140 - DNA, 20 bp, Artificial Sequence
  chemically synthesized
tcatgtcctttgtagggaca

SEQ ID NO: 331141 - DNA, 20 bp, Artificial Sequence
  chemically synthesized
cctttgtagggacatggatg

SEQ ID NO: 331142 - DNA, 20 bp, Artificial Sequence
  chemically synthesized
tgtagggacatggatgaagc

SEQ ID NO: 331143 - DNA, 20 bp, Artificial Sequence
  chemically synthesized
ttgctgagaatgatggtttc

SEQ ID NO: 331144 - DNA, 20 bp, Artificial Sequence
  chemically synthesized
aagctggaaaccatcattct

SEQ ID NO: 331145 - DNA, 20 bp, Artificial Sequence
  chemically synthesized
cgatagtttgctgagaatga

SEQ ID NO: 331146 - DNA, 20 bp, Artificial Sequence
  chemically synthesized
tgtccttgcgatagtttgct

SEQ ID NO: 331147 - DNA, 20 bp, Artificial Sequence
  chemically synthesized
cattctcagcaaactatcgc

SEQ ID NO: 331148 - DNA, 20 bp, Artificial Sequence
  chemically synthesized
attctcagcaaactatcgca

SEQ ID NO: 331149 - DNA, 20 bp, Artificial Sequence
  chemically synthesized
ttggttttttgtccttgcga

SEQ ID NO: 331150 - DNA, 20 bp, Artificial Sequence
  chemically synthesized
gagtgagaacatgcggtgtt

SEQ ID NO: 331151 - DNA, 20 bp, Artificial Sequence
  chemically synthesized
cacctatgagtgagaacatg

SEQ ID NO: 331152 - DNA, 20 bp, Artificial Sequence
  chemically synthesized
acaccgcatgttctcactca

SEQ ID NO: 331153 - DNA, 20 bp, Artificial Sequence
  chemically synthesized
caccgcatgttctcactcat

SEQ ID NO: 331154 - DNA, 20 bp, Artificial Sequence
  chemically synthesized
ttcgattcccacctatgagt

SEQ ID NO: 331155 - DNA, 20 bp, Artificial Sequence
  chemically synthesized
cgcatgttctcactcatagg

SEQ ID NO: 331156 - DNA, 20 bp, Artificial Sequence
  chemically synthesized
gcatgttctcactcataggt

SEQ ID NO: 331157 - DNA, 20 bp, Artificial Sequence
  chemically synthesized
attgttcgattcccacctat

SEQ ID NO: 331158 - DNA, 20 bp, Artificial Sequence
  chemically synthesized
ataggtgggaatcgaacaat

SEQ ID NO: 331159 - DNA, 20 bp, Artificial Sequence
  chemically synthesized
aatcgaacaatgagaacaca

SEQ ID NO: 331160 - DNA, 20 bp, Artificial Sequence
  chemically synthesized
acaatgagaacacatggaca

SEQ ID NO: 331161 - DNA, 20 bp, Artificial Sequence
  chemically synthesized
caatgagaacacatggacac

SEQ ID NO: 331162 - DNA, 20 bp, Artificial Sequence
  chemically synthesized
tgagaacacatggacacagg

SEQ ID NO: 331163 - DNA, 20 bp, Artificial Sequence
  chemically synthesized
gagaacacatggacacagga

SEQ ID NO: 331164 - DNA, 20 bp, Artificial Sequence
  chemically synthesized
agaacacatggacacaggaa

SEQ ID NO: 331165 - DNA, 20 bp, Artificial Sequence
  chemically synthesized
gaacacatggacacaggaag

SEQ ID NO: 331166 - DNA, 20 bp, Artificial Sequence
  chemically synthesized
ggaaggggaacatcacacac

SEQ ID NO: 331167 - DNA, 20 bp, Artificial Sequence
  chemically synthesized
gaaggggaacatcacacact

SEQ ID NO: 331168 - DNA, 20 bp, Artificial Sequence
  chemically synthesized
acatcacacactgggtcccg

SEQ ID NO: 331169 - DNA, 20 bp, Artificial Sequence
  chemically synthesized
ccccaccccactacgggacc

SEQ ID NO: 331170 - DNA, 20 bp, Artificial Sequence
  chemically synthesized
tcacacactgggtcccgtag

SEQ ID NO: 331171 - DNA, 20 bp, Artificial Sequence
  chemically synthesized
cacacactgggtcccgtagt

SEQ ID NO: 331172 - DNA, 20 bp, Artificial Sequence
  chemically synthesized
acacactgggtcccgtagtg

SEQ ID NO: 331173 - DNA, 20 bp, Artificial Sequence
  chemically synthesized
ccctccccccaccccactac

SEQ ID NO: 331174 - DNA, 20 bp, Artificial Sequence
  chemically synthesized
cccctccccccaccccacta

SEQ ID NO: 331175 - DNA, 20 bp, Artificial Sequence
  chemically synthesized
cactgggtcccgtagtgggg

SEQ ID NO: 331176 - DNA, 20 bp, Artificial Sequence
  chemically synthesized
actgggtcccgtagtggggt

SEQ ID NO: 331177 - DNA, 20 bp, Artificial Sequence
  chemically synthesized
ctgggtcccgtagtggggtg

SEQ ID NO: 331178 - DNA, 20 bp, Artificial Sequence
  chemically synthesized
tgggtcccgtagtggggtgg

SEQ ID NO: 331179 - DNA, 20 bp, Artificial Sequence
  chemically synthesized
gggtcccgtagtggggtggg

SEQ ID NO: 331180 - DNA, 20 bp, Artificial Sequence
  chemically synthesized
gtcccgtagtggggtggggg

SEQ ID NO: 331181 - DNA, 20 bp, Artificial Sequence
  chemically synthesized
tcccgtagtggggtgggggg

SEQ ID NO: 331182 - DNA, 20 bp, Artificial Sequence
  chemically synthesized
cccgtagtggggtgggggga

SEQ ID NO: 331183 - DNA, 20 bp, Artificial Sequence
  chemically synthesized
ccgtagtggggtggggggag

SEQ ID NO: 331184 - DNA, 20 bp, Artificial Sequence
  chemically synthesized
cgtagtggggtggggggagg

SEQ ID NO: 331185 - DNA, 20 bp, Artificial Sequence
  chemically synthesized
agtggggtggggggaggggg

SEQ ID NO: 331186 - DNA, 20 bp, Artificial Sequence
  chemically synthesized
gtggggtggggggaggggga

SEQ ID NO: 331187 - DNA, 20 bp, Artificial Sequence
  chemically synthesized
tggggtggggggagggggaa

SEQ ID NO: 331188 - DNA, 20 bp, Artificial Sequence
  chemically synthesized
gtggggggagggggaaggga

SEQ ID NO: 331189 - DNA, 20 bp, Artificial Sequence
  chemically synthesized
ggagggggaagggatagcat

SEQ ID NO: 331190 - DNA, 20 bp, Artificial Sequence
  chemically synthesized
gagggggaagggatagcatt

SEQ ID NO: 331191 - DNA, 20 bp, Artificial Sequence
  chemically synthesized
gggggaagggatagcattag

SEQ ID NO: 331192 - DNA, 20 bp, Artificial Sequence
  chemically synthesized
ttaactcatcatttaacatt

SEQ ID NO: 331193 - DNA, 20 bp, Artificial Sequence
  chemically synthesized
attaactcatcatttaacat

SEQ ID NO: 331194 - DNA, 20 bp, Artificial Sequence
  chemically synthesized
tatacctaatgttaaatgat

SEQ ID NO: 331195 - DNA, 20 bp, Artificial Sequence
  chemically synthesized
aatgttaaatgatgagttaa

SEQ ID NO: 331196 - DNA, 20 bp, Artificial Sequence
  chemically synthesized
atgttaaatgatgagttaat

SEQ ID NO: 331197 - DNA, 20 bp, Artificial Sequence
  chemically synthesized
aaatgatgagttaatgggtg

SEQ ID NO: 331198 - DNA, 20 bp, Artificial Sequence
  chemically synthesized
atgggtgcagcacaccaaca

SEQ ID NO: 331199 - DNA, 20 bp, Artificial Sequence
  chemically synthesized
tatgtatacatgtgccatgt

SEQ ID NO: 331200 - DNA, 20 bp, Artificial Sequence
  chemically synthesized
catgtgcacaatgtgcaggt

SEQ ID NO: 331201 - DNA, 20 bp, Artificial Sequence
  chemically synthesized
ggtacatgtgcacaatgtgc

SEQ ID NO: 331202 - DNA, 20 bp, Artificial Sequence
  chemically synthesized
gggtacatgtgcacaatgtg

SEQ ID NO: 331203 - DNA, 20 bp, Artificial Sequence
  chemically synthesized
attgtgcacatgtaccctaa

SEQ ID NO: 331204 - DNA, 20 bp, Artificial Sequence
  chemically synthesized
ttttttttattatactttta

SEQ ID NO: 331205 - DNA, 20 bp, Artificial Sequence
  chemically synthesized
tttttttttattatactttt

SEQ ID NO: 331206 - DNA, 20 bp, Artificial Sequence
  chemically synthesized
ttttttttttattatacttt

SEQ ID NO: 331207 - DNA, 20 bp, Artificial Sequence
  chemically synthesized
aaaagtataataaaaaaaaa

SEQ ID NO: 331208 - DNA, 20 bp, Artificial Sequence
  chemically synthesized
gtataataaaaaaaaaaaga

SEQ ID NO: 331209 - DNA, 20 bp, Artificial Sequence
  chemically synthesized
aataaaaaaaaaaagaaaga

SEQ ID NO: 331210 - DNA, 20 bp, Artificial Sequence
  chemically synthesized
aaaaaaaaaaagaaagaaag

SEQ ID NO: 331211 - DNA, 20 bp, Artificial Sequence
  chemically synthesized
aaaaaaaaaagaaagaaaga

SEQ ID NO: 331212 - DNA, 20 bp, Artificial Sequence
  chemically synthesized
aaaaaaaagaaagaaagaag

SEQ ID NO: 331213 - DNA, 20 bp, Artificial Sequence
  chemically synthesized
aaaacttcttgttaggtgaa

SEQ ID NO: 331214 - DNA, 20 bp, Artificial Sequence
  chemically synthesized
aatgtaaccattcacctaac

SEQ ID NO: 331215 - DNA, 20 bp, Artificial Sequence
  chemically synthesized
gtaaccattcacctaacaag

SEQ ID NO: 331216 - DNA, 20 bp, Artificial Sequence
  chemically synthesized
tgtctcaaaaacttcttgtt

SEQ ID NO: 331217 - DNA, 20 bp, Artificial Sequence
  chemically synthesized
atgtctcaaaaacttcttgt

SEQ ID NO: 331218 - DNA, 20 bp, Artificial Sequence
  chemically synthesized
tcacctaacaagaagttttt

SEQ ID NO: 331219 - DNA, 20 bp, Artificial Sequence
  chemically synthesized
cagtggcccttgaaatattg

SEQ ID NO: 331220 - DNA, 20 bp, Artificial Sequence
  chemically synthesized
tcagtggcccttgaaatatt

SEQ ID NO: 331221 - DNA, 20 bp, Artificial Sequence
  chemically synthesized
acatattgcctcaatatttc

SEQ ID NO: 331222 - DNA, 20 bp, Artificial Sequence
  chemically synthesized
catattgcctcaatatttca

SEQ ID NO: 331223 - DNA, 20 bp, Artificial Sequence
  chemically synthesized
atattgcctcaatatttcaa

SEQ ID NO: 331224 - DNA, 20 bp, Artificial Sequence
  chemically synthesized
tcaatatttcaagggccact

SEQ ID NO: 331225 - DNA, 20 bp, Artificial Sequence
  chemically synthesized
aataagtcattattactcag

SEQ ID NO: 331226 - DNA, 20 bp, Artificial Sequence
  chemically synthesized
acaaataagtcattattact

SEQ ID NO: 331227 - DNA, 20 bp, Artificial Sequence
  chemically synthesized
gtcttaatttttaaacaaat

SEQ ID NO: 331228 - DNA, 20 bp, Artificial Sequence
  chemically synthesized
gacttatttgtttaaaaatt

SEQ ID NO: 331229 - DNA, 20 bp, Artificial Sequence
  chemically synthesized
tatttgtttaaaaattaaga

SEQ ID NO: 331230 - DNA, 20 bp, Artificial Sequence
  chemically synthesized
aaaaattaagacggtaaaaa

SEQ ID NO: 331231 - DNA, 20 bp, Artificial Sequence
  chemically synthesized
attaagacggtaaaaatagt

SEQ ID NO: 331232 - DNA, 20 bp, Artificial Sequence
  chemically synthesized
tatggtgcaatttttttcat

SEQ ID NO: 331233 - DNA, 20 bp, Artificial Sequence
  chemically synthesized
caatgaaaaaaattgcacca

SEQ ID NO: 331234 - DNA, 20 bp, Artificial Sequence
  chemically synthesized
tgaaaaaaattgcaccatag

SEQ ID NO: 331235 - DNA, 20 bp, Artificial Sequence
  chemically synthesized
acatttcacttttgcttcta

SEQ ID NO: 331236 - DNA, 20 bp, Artificial Sequence
  chemically synthesized
aaattgcaccatagaagcaa

SEQ ID NO: 331237 - DNA, 20 bp, Artificial Sequence
  chemically synthesized
gaagcaaaagtgaaatgtta

SEQ ID NO: 331238 - DNA, 20 bp, Artificial Sequence
  chemically synthesized
cacacacacacacacacaca

SEQ ID NO: 331239 - DNA, 20 bp, Artificial Sequence
  chemically synthesized
cacacagtgtgtatacataa

SEQ ID NO: 331240 - DNA, 20 bp, Artificial Sequence
  chemically synthesized
gtgtgtatacataatggatt

SEQ ID NO: 331241 - DNA, 20 bp, Artificial Sequence
  chemically synthesized
gtgtatacataatggattta

SEQ ID NO: 331242 - DNA, 20 bp, Artificial Sequence
  chemically synthesized
acataatggatttagagttc

SEQ ID NO: 331243 - DNA, 20 bp, Artificial Sequence
  chemically synthesized
ggatttagagttctagttat

SEQ ID NO: 331244 - DNA, 20 bp, Artificial Sequence
  chemically synthesized
gatttagagttctagttatg

SEQ ID NO: 331245 - DNA, 20 bp, Artificial Sequence
  chemically synthesized
cctagtctcatcctcataac

SEQ ID NO: 331246 - DNA, 20 bp, Artificial Sequence
  chemically synthesized
agagttctagttatgaggat

SEQ ID NO: 331247 - DNA, 20 bp, Artificial Sequence
  chemically synthesized
tctagttatgaggatgagac

SEQ ID NO: 331248 - DNA, 20 bp, Artificial Sequence
  chemically synthesized
ctagttatgaggatgagact

SEQ ID NO: 331249 - DNA, 20 bp, Artificial Sequence
  chemically synthesized
tagttatgaggatgagacta

SEQ ID NO: 331250 - DNA, 20 bp, Artificial Sequence
  chemically synthesized
tgaggatgagactagggaaa

SEQ ID NO: 331251 - DNA, 20 bp, Artificial Sequence
  chemically synthesized
gaggatgagactagggaaat

SEQ ID NO: 331252 - DNA, 20 bp, Artificial Sequence
  chemically synthesized
tatctctgtgcctatttccc

SEQ ID NO: 331253 - DNA, 20 bp, Artificial Sequence
  chemically synthesized
tgagactagggaaataggca

SEQ ID NO: 331254 - DNA, 20 bp, Artificial Sequence
  chemically synthesized
agactagggaaataggcaca

SEQ ID NO: 331255 - DNA, 20 bp, Artificial Sequence
  chemically synthesized
gggaaataggcacagagata

SEQ ID NO: 331256 - DNA, 20 bp, Artificial Sequence
  chemically synthesized
gcacagagataaagtgctgt

SEQ ID NO: 331257 - DNA, 20 bp, Artificial Sequence
  chemically synthesized
acagagataaagtgctgtta

SEQ ID NO: 331258 - DNA, 20 bp, Artificial Sequence
  chemically synthesized
tacatatgggttgtctctaa

SEQ ID NO: 331259 - DNA, 20 bp, Artificial Sequence
  chemically synthesized
ctattcgaagttatacatat

SEQ ID NO: 331260 - DNA, 20 bp, Artificial Sequence
  chemically synthesized
tctattcgaagttatacata

SEQ ID NO: 331261 - DNA, 20 bp, Artificial Sequence
  chemically synthesized
cccatatgtataacttcgaa

SEQ ID NO: 331262 - DNA, 20 bp, Artificial Sequence
  chemically synthesized
tagggagtatgttctattcg

SEQ ID NO: 331263 - DNA, 20 bp, Artificial Sequence
  chemically synthesized
atagaacatactccctatgt

SEQ ID NO: 331264 - DNA, 20 bp, Artificial Sequence
  chemically synthesized
atactaaacacttacatagg

SEQ ID NO: 331265 - DNA, 20 bp, Artificial Sequence
  chemically synthesized
taatactaaacacttacata

SEQ ID NO: 331266 - DNA, 20 bp, Artificial Sequence
  chemically synthesized
ataatactaaacacttacat

SEQ ID NO: 331267 - DNA, 20 bp, Artificial Sequence
  chemically synthesized
aataatactaaacacttaca

SEQ ID NO: 331268 - DNA, 20 bp, Artificial Sequence
  chemically synthesized
atactccctatgtaagtgtt

SEQ ID NO: 331269 - DNA, 20 bp, Artificial Sequence
  chemically synthesized
atgtaagtgtttagtattat

SEQ ID NO: 331270 - DNA, 20 bp, Artificial Sequence
  chemically synthesized
taagtgtttagtattattgg

SEQ ID NO: 331271 - DNA, 20 bp, Artificial Sequence
  chemically synthesized
tgtgtgtgggtatatacata

SEQ ID NO: 331272 - DNA, 20 bp, Artificial Sequence
  chemically synthesized
gcatatatatgtgtgtgtgt

SEQ ID NO: 331273 - DNA, 20 bp, Artificial Sequence
  chemically synthesized
tgcatatatatgtgtgtgtg

SEQ ID NO: 331274 - DNA, 20 bp, Artificial Sequence
  chemically synthesized
atatatgcacacgtaacaca

SEQ ID NO: 331275 - DNA, 20 bp, Artificial Sequence
  chemically synthesized
ataagcaaagttttcaaata

SEQ ID NO: 331276 - DNA, 20 bp, Artificial Sequence
  chemically synthesized
ttataagcaaagttttcaaa

SEQ ID NO: 331277 - DNA, 20 bp, Artificial Sequence
  chemically synthesized
acatggttagattataagca

SEQ ID NO: 331278 - DNA, 20 bp, Artificial Sequence
  chemically synthesized
ctgatacatggttagattat

SEQ ID NO: 331279 - DNA, 20 bp, Artificial Sequence
  chemically synthesized
agatagcactgatacatggt

SEQ ID NO: 331280 - DNA, 20 bp, Artificial Sequence
  chemically synthesized
cttataatctaaccatgtat

SEQ ID NO: 331281 - DNA, 20 bp, Artificial Sequence
  chemically synthesized
gtaaagatagcactgataca

SEQ ID NO: 331282 - DNA, 20 bp, Artificial Sequence
  chemically synthesized
atgtatcagtgctatcttta

SEQ ID NO: 331283 - DNA, 20 bp, Artificial Sequence
  chemically synthesized
ttaataccatgctgtaaaga

SEQ ID NO: 331284 - DNA, 20 bp, Artificial Sequence
  chemically synthesized
tcagtgctatctttacagca

SEQ ID NO: 331285 - DNA, 20 bp, Artificial Sequence
  chemically synthesized
atacttaataccatgctgta

SEQ ID NO: 331286 - DNA, 20 bp, Artificial Sequence
  chemically synthesized
tatctttacagcatggtatt

SEQ ID NO: 331287 - DNA, 20 bp, Artificial Sequence
  chemically synthesized
tggtattaagtatataacta

SEQ ID NO: 331288 - DNA, 20 bp, Artificial Sequence
  chemically synthesized
aatctttaaaattcatgcta

SEQ ID NO: 331289 - DNA, 20 bp, Artificial Sequence
  chemically synthesized
taactatagcatgaatttta

SEQ ID NO: 331290 - DNA, 20 bp, Artificial Sequence
  chemically synthesized
gcattaaaaatatttaccct

SEQ ID NO: 331291 - DNA, 20 bp, Artificial Sequence
  chemically synthesized
cataggattaataaaactta

SEQ ID NO: 331292 - DNA, 20 bp, Artificial Sequence
  chemically synthesized
ccataggattaataaaactt

SEQ ID NO: 331293 - DNA, 20 bp, Artificial Sequence
  chemically synthesized
accataggattaataaaact

SEQ ID NO: 331294 - DNA, 20 bp, Artificial Sequence
  chemically synthesized
cctaagttttattaatccta

SEQ ID NO: 331295 - DNA, 20 bp, Artificial Sequence
  chemically synthesized
acttgaatagtgatcaccat

SEQ ID NO: 331296 - DNA, 20 bp, Artificial Sequence
  chemically synthesized
cacttgaatagtgatcacca

SEQ ID NO: 331297 - DNA, 20 bp, Artificial Sequence
  chemically synthesized
tcctatggtgatcactattc

SEQ ID NO: 331298 - DNA, 20 bp, Artificial Sequence
  chemically synthesized
aagtttaataaacacttgaa

SEQ ID NO: 331299 - DNA, 20 bp, Artificial Sequence
  chemically synthesized
aacaggttttcaaagaggga

SEQ ID NO: 331300 - DNA, 20 bp, Artificial Sequence
  chemically synthesized
ttaaaacaggttttcaaaga

SEQ ID NO: 331301 - DNA, 20 bp, Artificial Sequence
  chemically synthesized
gttaaaacaggttttcaaag

SEQ ID NO: 331302 - DNA, 20 bp, Artificial Sequence
  chemically synthesized
agttaaaacaggttttcaaa

SEQ ID NO: 331303 - DNA, 20 bp, Artificial Sequence
  chemically synthesized
atagttaaaacaggttttca

SEQ ID NO: 331304 - DNA, 20 bp, Artificial Sequence
  chemically synthesized
atgtaagacatagttaaaac

SEQ ID NO: 331305 - DNA, 20 bp, Artificial Sequence
  chemically synthesized
gatgtaagacatagttaaaa

SEQ ID NO: 331306 - DNA, 20 bp, Artificial Sequence
  chemically synthesized
aaatgaaatgatgtaagaca

SEQ ID NO: 331307 - DNA, 20 bp, Artificial Sequence
  chemically synthesized
tctggtaaatgaaatgatgt

SEQ ID NO: 331308 - DNA, 20 bp, Artificial Sequence
  chemically synthesized
tcttacatcatttcatttac

SEQ ID NO: 331309 - DNA, 20 bp, Artificial Sequence
  chemically synthesized
taaatttaggagtaataatc

SEQ ID NO: 331310 - DNA, 20 bp, Artificial Sequence
  chemically synthesized
atcacaaaatttaaatttag

SEQ ID NO: 331311 - DNA, 20 bp, Artificial Sequence
  chemically synthesized
taatcacaaaatttaaattt

SEQ ID NO: 331312 - DNA, 20 bp, Artificial Sequence
  chemically synthesized
ttaatcacaaaatttaaatt

SEQ ID NO: 331313 - DNA, 20 bp, Artificial Sequence
  chemically synthesized
gtgattaaaaaattatgcac

SEQ ID NO: 331314 - DNA, 20 bp, Artificial Sequence
  chemically synthesized
attaaaaaattatgcaccag

SEQ ID NO: 331315 - DNA, 20 bp, Artificial Sequence
  chemically synthesized
ttaaaaaattatgcaccaga

SEQ ID NO: 331316 - DNA, 20 bp, Artificial Sequence
  chemically synthesized
aaaattatgcaccagaagga

SEQ ID NO: 331317 - DNA, 20 bp, Artificial Sequence
  chemically synthesized
ataaattgatgctgtccttc

SEQ ID NO: 331318 - DNA, 20 bp, Artificial Sequence
  chemically synthesized
gcatcaatttattctgtcat

SEQ ID NO: 331319 - DNA, 20 bp, Artificial Sequence
  chemically synthesized
agttgtaagagggcttatga

SEQ ID NO: 331320 - DNA, 20 bp, Artificial Sequence
  chemically synthesized
aaacatcaaaagttgtaaga

SEQ ID NO: 331321 - DNA, 20 bp, Artificial Sequence
  chemically synthesized
gaaacatcaaaagttgtaag

SEQ ID NO: 331322 - DNA, 20 bp, Artificial Sequence
  chemically synthesized
ggaaacatcaaaagttgtaa

SEQ ID NO: 331323 - DNA, 20 bp, Artificial Sequence
  chemically synthesized
caggaaacatcaaaagttgt

SEQ ID NO: 331324 - DNA, 20 bp, Artificial Sequence
  chemically synthesized
aaagaaacaggaaacatcaa

SEQ ID NO: 331325 - DNA, 20 bp, Artificial Sequence
  chemically synthesized
tttgcagaacataaagaaac

SEQ ID NO: 331326 - DNA, 20 bp, Artificial Sequence
  chemically synthesized
ttttgcagaacataaagaaa

SEQ ID NO: 331327 - DNA, 20 bp, Artificial Sequence
  chemically synthesized
tgataattttgcagaacata

SEQ ID NO: 331328 - DNA, 20 bp, Artificial Sequence
  chemically synthesized
tgataatactgataattttg

SEQ ID NO: 331329 - DNA, 20 bp, Artificial Sequence
  chemically synthesized
tttatgttctgcaaaattat

SEQ ID NO: 331330 - DNA, 20 bp, Artificial Sequence
  chemically synthesized
accagataggcagattgaaa

SEQ ID NO: 331331 - DNA, 20 bp, Artificial Sequence
  chemically synthesized
actgtttcaatctgcctatc

SEQ ID NO: 331332 - DNA, 20 bp, Artificial Sequence
  chemically synthesized
atttttaactaccagatagg

SEQ ID NO: 331333 - DNA, 20 bp, Artificial Sequence
  chemically synthesized
gtttcaatctgcctatctgg

SEQ ID NO: 331334 - DNA, 20 bp, Artificial Sequence
  chemically synthesized
attatttttaactaccagat

SEQ ID NO: 331335 - DNA, 20 bp, Artificial Sequence
  chemically synthesized
aattatttttaactaccaga

SEQ ID NO: 331336 - DNA, 20 bp, Artificial Sequence
  chemically synthesized
atcaaattatttttaactac

SEQ ID NO: 331337 - DNA, 20 bp, Artificial Sequence
  chemically synthesized
ttatattatatttttttatt

SEQ ID NO: 331338 - DNA, 20 bp, Artificial Sequence
  chemically synthesized
tattatatttttttattaag

SEQ ID NO: 331339 - DNA, 20 bp, Artificial Sequence
  chemically synthesized
atatttttttattaagtaga

SEQ ID NO: 331340 - DNA, 20 bp, Artificial Sequence
  chemically synthesized
tatatcattaagtatgtaaa

SEQ ID NO: 331341 - DNA, 20 bp, Artificial Sequence
  chemically synthesized
gaaaaagcccatatatcatt

SEQ ID NO: 331342 - DNA, 20 bp, Artificial Sequence
  chemically synthesized
tttacatacttaatgatata

SEQ ID NO: 331343 - DNA, 20 bp, Artificial Sequence
  chemically synthesized
ttacatacttaatgatatat

SEQ ID NO: 331344 - DNA, 20 bp, Artificial Sequence
  chemically synthesized
agaaaatgacaaaagcgaaa

SEQ ID NO: 331345 - DNA, 20 bp, Artificial Sequence
  chemically synthesized
catgagccagaaaatgacaa

SEQ ID NO: 331346 - DNA, 20 bp, Artificial Sequence
  chemically synthesized
ttttcgcttttgtcattttc

SEQ ID NO: 331347 - DNA, 20 bp, Artificial Sequence
  chemically synthesized
aattcataaagaacatgagc

SEQ ID NO: 331348 - DNA, 20 bp, Artificial Sequence
  chemically synthesized
ggaaaattcataaagaacat

SEQ ID NO: 331349 - DNA, 20 bp, Artificial Sequence
  chemically synthesized
ccccaataggaaaattcata

SEQ ID NO: 331350 - DNA, 20 bp, Artificial Sequence
  chemically synthesized
ttctttatgaattttcctat

SEQ ID NO: 331351 - DNA, 20 bp, Artificial Sequence
  chemically synthesized
tctttatgaattttcctatt

SEQ ID NO: 331352 - DNA, 20 bp, Artificial Sequence
  chemically synthesized
ctttatgaattttcctattg

SEQ ID NO: 331353 - DNA, 20 bp, Artificial Sequence
  chemically synthesized
taaaactagaatgccccaat

SEQ ID NO: 331354 - DNA, 20 bp, Artificial Sequence
  chemically synthesized
gtaaaactagaatgccccaa

SEQ ID NO: 331355 - DNA, 20 bp, Artificial Sequence
  chemically synthesized
attttcctattggggcattc

SEQ ID NO: 331356 - DNA, 20 bp, Artificial Sequence
  chemically synthesized
gataaatcaataagtaaaac

SEQ ID NO: 331357 - DNA, 20 bp, Artificial Sequence
  chemically synthesized
aataatgctgataaatcaat

SEQ ID NO: 331358 - DNA, 20 bp, Artificial Sequence
  chemically synthesized
agttttacttattgatttat

SEQ ID NO: 331359 - DNA, 20 bp, Artificial Sequence
  chemically synthesized
tatcagcattatttatatat

SEQ ID NO: 331360 - DNA, 20 bp, Artificial Sequence
  chemically synthesized
atcagcattatttatatatg

SEQ ID NO: 331361 - DNA, 20 bp, Artificial Sequence
  chemically synthesized
tcagcattatttatatatga

SEQ ID NO: 331362 - DNA, 20 bp, Artificial Sequence
  chemically synthesized
tataacatacgaaggattga

SEQ ID NO: 331363 - DNA, 20 bp, Artificial Sequence
  chemically synthesized
gtaacatttataacatacga

SEQ ID NO: 331364 - DNA, 20 bp, Artificial Sequence
  chemically synthesized
agtaacatttataacatacg

SEQ ID NO: 331365 - DNA, 20 bp, Artificial Sequence
  chemically synthesized
tataaagttgggaaaattat

SEQ ID NO: 331366 - DNA, 20 bp, Artificial Sequence
  chemically synthesized
tagaagtcaaatataaagtt

SEQ ID NO: 331367 - DNA, 20 bp, Artificial Sequence
  chemically synthesized
ttagaagtcaaatataaagt

SEQ ID NO: 331368 - DNA, 20 bp, Artificial Sequence
  chemically synthesized
aaagttagaagtcaaatata

SEQ ID NO: 331369 - DNA, 20 bp, Artificial Sequence
  chemically synthesized
aagactctaaggaaagttag

SEQ ID NO: 331370 - DNA, 20 bp, Artificial Sequence
  chemically synthesized
agaaagactctaaggaaagt

SEQ ID NO: 331371 - DNA, 20 bp, Artificial Sequence
  chemically synthesized
atttgacttctaactttcct

SEQ ID NO: 331372 - DNA, 20 bp, Artificial Sequence
  chemically synthesized
ttgacttctaactttcctta

SEQ ID NO: 331373 - DNA, 20 bp, Artificial Sequence
  chemically synthesized
tttaagaaagactctaagga

SEQ ID NO: 331374 - DNA, 20 bp, Artificial Sequence
  chemically synthesized
tgcttttaagaaagactcta

SEQ ID NO: 331375 - DNA, 20 bp, Artificial Sequence
  chemically synthesized
atgcttttaagaaagactct

SEQ ID NO: 331376 - DNA, 20 bp, Artificial Sequence
  chemically synthesized
ttccttagagtctttcttaa

SEQ ID NO: 331377 - DNA, 20 bp, Artificial Sequence
  chemically synthesized
tggttatgatgcttttaaga

SEQ ID NO: 331378 - DNA, 20 bp, Artificial Sequence
  chemically synthesized
gtattggttatgatgctttt

SEQ ID NO: 331379 - DNA, 20 bp, Artificial Sequence
  chemically synthesized
gcaattcttgcatcatgtat

SEQ ID NO: 331380 - DNA, 20 bp, Artificial Sequence
  chemically synthesized
tcataaccaatacatgatgc

SEQ ID NO: 331381 - DNA, 20 bp, Artificial Sequence
  chemically synthesized
gtcaataaaggaatttagta

SEQ ID NO: 331382 - DNA, 20 bp, Artificial Sequence
  chemically synthesized
atggagtcaataaaggaatt

SEQ ID NO: 331383 - DNA, 20 bp, Artificial Sequence
  chemically synthesized
attatttatggagtcaataa

SEQ ID NO: 331384 - DNA, 20 bp, Artificial Sequence
  chemically synthesized
aattatttatggagtcaata

SEQ ID NO: 331385 - DNA, 20 bp, Artificial Sequence
  chemically synthesized
attatagttaattatttatg

SEQ ID NO: 331386 - DNA, 20 bp, Artificial Sequence
  chemically synthesized
tgattatagttaattattta

SEQ ID NO: 331387 - DNA, 20 bp, Artificial Sequence
  chemically synthesized
tgcttcatagagcatgatta

SEQ ID NO: 331388 - DNA, 20 bp, Artificial Sequence
  chemically synthesized
aactataatcatgctctatg

SEQ ID NO: 331389 - DNA, 20 bp, Artificial Sequence
  chemically synthesized
aacatttctattgcttcata

SEQ ID NO: 331390 - DNA, 20 bp, Artificial Sequence
  chemically synthesized
ttaacatttctattgcttca

SEQ ID NO: 331391 - DNA, 20 bp, Artificial Sequence
  chemically synthesized
aatcatgctctatgaagcaa

SEQ ID NO: 331392 - DNA, 20 bp, Artificial Sequence
  chemically synthesized
tatgaagcaatagaaatgtt

SEQ ID NO: 331393 - DNA, 20 bp, Artificial Sequence
  chemically synthesized
atagaaatgttaagattttt

SEQ ID NO: 331394 - DNA, 20 bp, Artificial Sequence
  chemically synthesized
agaaatgttaagatttttaa

SEQ ID NO: 331395 - DNA, 20 bp, Artificial Sequence
  chemically synthesized
atgtgaaataaagtttttat

SEQ ID NO: 331396 - DNA, 20 bp, Artificial Sequence
  chemically synthesized
ccaggaataaatgtgaaata

SEQ ID NO: 331397 - DNA, 20 bp, Artificial Sequence
  chemically synthesized
ctttatttcacatttattcc

SEQ ID NO: 331398 - DNA, 20 bp, Artificial Sequence
  chemically synthesized
tcacatttattcctggcttc

SEQ ID NO: 331399 - DNA, 20 bp, Artificial Sequence
  chemically synthesized
cacatttattcctggcttct

SEQ ID NO: 331400 - DNA, 20 bp, Artificial Sequence
  chemically synthesized
gccacttgatcctagaagcc

SEQ ID NO: 331401 - DNA, 20 bp, Artificial Sequence
  chemically synthesized
ggccacttgatcctagaagc

SEQ ID NO: 331402 - DNA, 20 bp, Artificial Sequence
  chemically synthesized
tattggccacttgatcctag

SEQ ID NO: 331403 - DNA, 20 bp, Artificial Sequence
  chemically synthesized
tattcctggcttctaggatc

SEQ ID NO: 331404 - DNA, 20 bp, Artificial Sequence
  chemically synthesized
gcttattggccacttgatcc

SEQ ID NO: 331405 - DNA, 20 bp, Artificial Sequence
  chemically synthesized
tcctggcttctaggatcaag

SEQ ID NO: 331406 - DNA, 20 bp, Artificial Sequence
  chemically synthesized
tctaggatcaagtggccaat

SEQ ID NO: 331407 - DNA, 20 bp, Artificial Sequence
  chemically synthesized
ttaatttaataattgcttat

SEQ ID NO: 331408 - DNA, 20 bp, Artificial Sequence
  chemically synthesized
ataagcaattattaaattaa

SEQ ID NO: 331409 - DNA, 20 bp, Artificial Sequence
  chemically synthesized
ttaaattaatggtaatacta

SEQ ID NO: 331410 - DNA, 20 bp, Artificial Sequence
  chemically synthesized
caagtatgccggaagcactg

SEQ ID NO: 331411 - DNA, 20 bp, Artificial Sequence
  chemically synthesized
tggtaatactacagtgcttc

SEQ ID NO: 331412 - DNA, 20 bp, Artificial Sequence
  chemically synthesized
ttcaggaacaagtatgccgg

SEQ ID NO: 331413 - DNA, 20 bp, Artificial Sequence
  chemically synthesized
tagttcaggaacaagtatgc

SEQ ID NO: 331414 - DNA, 20 bp, Artificial Sequence
  chemically synthesized
acctcaaatagttcaggaac

SEQ ID NO: 331415 - DNA, 20 bp, Artificial Sequence
  chemically synthesized
tttggtacctcaaatagttc

SEQ ID NO: 331416 - DNA, 20 bp, Artificial Sequence
  chemically synthesized
atttggtacctcaaatagtt

SEQ ID NO: 331417 - DNA, 20 bp, Artificial Sequence
  chemically synthesized
tacttgttcctgaactattt

SEQ ID NO: 331418 - DNA, 20 bp, Artificial Sequence
  chemically synthesized
acttgttcctgaactatttg

SEQ ID NO: 331419 - DNA, 20 bp, Artificial Sequence
  chemically synthesized
taactatttggtacctcaaa

SEQ ID NO: 331420 - DNA, 20 bp, Artificial Sequence
  chemically synthesized
gaactatttgaggtaccaaa

SEQ ID NO: 331421 - DNA, 20 bp, Artificial Sequence
  chemically synthesized
ttaaagtcattttaactatt

SEQ ID NO: 331422 - DNA, 20 bp, Artificial Sequence
  chemically synthesized
tcaggtgagctaggtgatta

SEQ ID NO: 331423 - DNA, 20 bp, Artificial Sequence
  chemically synthesized
ttaaaatgactttaatcacc

SEQ ID NO: 331424 - DNA, 20 bp, Artificial Sequence
  chemically synthesized
atttaaatttcaggtgagct

SEQ ID NO: 331425 - DNA, 20 bp, Artificial Sequence
  chemically synthesized
aatttaaatttcaggtgagc

SEQ ID NO: 331426 - DNA, 20 bp, Artificial Sequence
  chemically synthesized
ttataatttaaatttcaggt

SEQ ID NO: 331427 - DNA, 20 bp, Artificial Sequence
  chemically synthesized
tactttataatttaaatttc

SEQ ID NO: 331428 - DNA, 20 bp, Artificial Sequence
  chemically synthesized
ctactttataatttaaattt

SEQ ID NO: 331429 - DNA, 20 bp, Artificial Sequence
  chemically synthesized
cacctgaaatttaaattata

SEQ ID NO: 331430 - DNA, 20 bp, Artificial Sequence
  chemically synthesized
ctgaaatttaaattataaag

SEQ ID NO: 331431 - DNA, 20 bp, Artificial Sequence
  chemically synthesized
aaatttaaattataaagtag

SEQ ID NO: 331432 - DNA, 20 bp, Artificial Sequence
  chemically synthesized
tttaaattataaagtagaag

SEQ ID NO: 331433 - DNA, 20 bp, Artificial Sequence
  chemically synthesized
aaattataaagtagaagtag

SEQ ID NO: 331434 - DNA, 20 bp, Artificial Sequence
  chemically synthesized
agtagaagtagaagaatcca

SEQ ID NO: 331435 - DNA, 20 bp, Artificial Sequence
  chemically synthesized
gtagaagtagaagaatccac

SEQ ID NO: 331436 - DNA, 20 bp, Artificial Sequence
  chemically synthesized
tgagaaataagattagcccg

SEQ ID NO: 331437 - DNA, 20 bp, Artificial Sequence
  chemically synthesized
aatggaatgagaaataagat

SEQ ID NO: 331438 - DNA, 20 bp, Artificial Sequence
  chemically synthesized
tcattaatggaatgagaaat

SEQ ID NO: 331439 - DNA, 20 bp, Artificial Sequence
  chemically synthesized
atttagatcattaatggaat

SEQ ID NO: 331440 - DNA, 20 bp, Artificial Sequence
  chemically synthesized
gaagaaatttagatcattaa

SEQ ID NO: 331441 - DNA, 20 bp, Artificial Sequence
  chemically synthesized
agtcatttcaagaagaaatt

SEQ ID NO: 331442 - DNA, 20 bp, Artificial Sequence
  chemically synthesized
cctgaaaaagtcatttcaag

SEQ ID NO: 331443 - DNA, 20 bp, Artificial Sequence
  chemically synthesized
atacctgaaaaagtcatttc

SEQ ID NO: 331444 - DNA, 20 bp, Artificial Sequence
  chemically synthesized
tcttcttgaaatgacttttt

SEQ ID NO: 331445 - DNA, 20 bp, Artificial Sequence
  chemically synthesized
cttcttgaaatgactttttc

SEQ ID NO: 331446 - DNA, 20 bp, Artificial Sequence
  chemically synthesized
ttactttataatacctgaaa

SEQ ID NO: 331447 - DNA, 20 bp, Artificial Sequence
  chemically synthesized
tgactttttcaggtattata

SEQ ID NO: 331448 - DNA, 20 bp, Artificial Sequence
  chemically synthesized
taaagtaaatttgaatgttt

SEQ ID NO: 331449 - DNA, 20 bp, Artificial Sequence
  chemically synthesized
gtaaatttgaatgtttcaga

SEQ ID NO: 331450 - DNA, 20 bp, Artificial Sequence
  chemically synthesized
aaatttgaatgtttcagaaa

SEQ ID NO: 331451 - DNA, 20 bp, Artificial Sequence
  chemically synthesized
aatttgaatgtttcagaaag

SEQ ID NO: 331452 - DNA, 20 bp, Artificial Sequence
  chemically synthesized
agaaagaggactacatatct

SEQ ID NO: 331453 - DNA, 20 bp, Artificial Sequence
  chemically synthesized
tatctgcttcctaagatatg

SEQ ID NO: 331454 - DNA, 20 bp, Artificial Sequence
  chemically synthesized
gaaagaggactacatatctt

SEQ ID NO: 331455 - DNA, 20 bp, Artificial Sequence
  chemically synthesized
agaggactacatatcttagg

SEQ ID NO: 331456 - DNA, 20 bp, Artificial Sequence
  chemically synthesized
ggactacatatcttaggaag

SEQ ID NO: 331457 - DNA, 20 bp, Artificial Sequence
  chemically synthesized
gtggcaattatctgcttcct

SEQ ID NO: 331458 - DNA, 20 bp, Artificial Sequence
  chemically synthesized
aggaagcagataattgccac

SEQ ID NO: 331459 - DNA, 20 bp, Artificial Sequence
  chemically synthesized
cagataattgccactggatt

SEQ ID NO: 331460 - DNA, 20 bp, Artificial Sequence
  chemically synthesized
tgtcagattgctaaatccag

SEQ ID NO: 331461 - DNA, 20 bp, Artificial Sequence
  chemically synthesized
gtgtgtcagattgctaaatc

SEQ ID NO: 331462 - DNA, 20 bp, Artificial Sequence
  chemically synthesized
gaaatttctatattgtgtgt

SEQ ID NO: 331463 - DNA, 20 bp, Artificial Sequence
  chemically synthesized
tagcaatctgacacacaata

SEQ ID NO: 331464 - DNA, 20 bp, Artificial Sequence
  chemically synthesized
aatatagaaatttctaatta

SEQ ID NO: 331465 - DNA, 20 bp, Artificial Sequence
  chemically synthesized
tataaaaatagaactttaat

SEQ ID NO: 331466 - DNA, 20 bp, Artificial Sequence
  chemically synthesized
aaagattagcattataaaaa

SEQ ID NO: 331467 - DNA, 20 bp, Artificial Sequence
  chemically synthesized
tttttataatgctaatcttt

SEQ ID NO: 331468 - DNA, 20 bp, Artificial Sequence
  chemically synthesized
gaaatttttggctgaaagat

SEQ ID NO: 331469 - DNA, 20 bp, Artificial Sequence
  chemically synthesized
ccaaggaaatttttggctga

SEQ ID NO: 331470 - DNA, 20 bp, Artificial Sequence
  chemically synthesized
acatgtcccaaggaaatttt

SEQ ID NO: 331471 - DNA, 20 bp, Artificial Sequence
  chemically synthesized
ctttcagccaaaaatttcct

SEQ ID NO: 331472 - DNA, 20 bp, Artificial Sequence
  chemically synthesized
tttcagccaaaaatttcctt

SEQ ID NO: 331473 - DNA, 20 bp, Artificial Sequence
  chemically synthesized
cttcattataacatgtccca

SEQ ID NO: 331474 - DNA, 20 bp, Artificial Sequence
  chemically synthesized
tcttcattataacatgtccc

SEQ ID NO: 331475 - DNA, 20 bp, Artificial Sequence
  chemically synthesized
ccttgggacatgttataatg

SEQ ID NO: 331476 - DNA, 20 bp, Artificial Sequence
  chemically synthesized
taatgaagataaaatgtact

SEQ ID NO: 331477 - DNA, 20 bp, Artificial Sequence
  chemically synthesized
ctctggtcaatttaaaatct

SEQ ID NO: 331478 - DNA, 20 bp, Artificial Sequence
  chemically synthesized
tactaagattttaaattgac

SEQ ID NO: 331479 - DNA, 20 bp, Artificial Sequence
  chemically synthesized
ctaagattttaaattgacca

SEQ ID NO: 331480 - DNA, 20 bp, Artificial Sequence
  chemically synthesized
tttaaattgaccagagttcc

SEQ ID NO: 331481 - DNA, 20 bp, Artificial Sequence
  chemically synthesized
ttaggtgtctctgggaactc

SEQ ID NO: 331482 - DNA, 20 bp, Artificial Sequence
  chemically synthesized
taaattgaccagagttccca

SEQ ID NO: 331483 - DNA, 20 bp, Artificial Sequence
  chemically synthesized
aatgtttattaggtgtctct

SEQ ID NO: 331484 - DNA, 20 bp, Artificial Sequence
  chemically synthesized
aaatgtttattaggtgtctc

SEQ ID NO: 331485 - DNA, 20 bp, Artificial Sequence
  chemically synthesized
tatttatgaaaatgtttatt

SEQ ID NO: 331486 - DNA, 20 bp, Artificial Sequence
  chemically synthesized
atatttatgaaaatgtttat

SEQ ID NO: 331487 - DNA, 20 bp, Artificial Sequence
  chemically synthesized
ttttcataaatattcactat

SEQ ID NO: 331488 - DNA, 20 bp, Artificial Sequence
  chemically synthesized
cataaatattcactataagt

SEQ ID NO: 331489 - DNA, 20 bp, Artificial Sequence
  chemically synthesized
ttcacaataaaacttactta

SEQ ID NO: 331490 - DNA, 20 bp, Artificial Sequence
  chemically synthesized
tataagtaagttttattgtg

SEQ ID NO: 331491 - DNA, 20 bp, Artificial Sequence
  chemically synthesized
tgagaggtatgtataacaat

SEQ ID NO: 331492 - DNA, 20 bp, Artificial Sequence
  chemically synthesized
atgagaggtatgtataacaa

SEQ ID NO: 331493 - DNA, 20 bp, Artificial Sequence
  chemically synthesized
gtaatgatgccaatgatgag

SEQ ID NO: 331494 - DNA, 20 bp, Artificial Sequence
  chemically synthesized
ttatacatacctctcatcat

SEQ ID NO: 331495 - DNA, 20 bp, Artificial Sequence
  chemically synthesized
tgtaatgatgccaatgatga

SEQ ID NO: 331496 - DNA, 20 bp, Artificial Sequence
  chemically synthesized
agtgtaatgatgccaatgat

SEQ ID NO: 331497 - DNA, 20 bp, Artificial Sequence
  chemically synthesized
ggcatcattacactttaaat

SEQ ID NO: 331498 - DNA, 20 bp, Artificial Sequence
  chemically synthesized
tctattaggtaacttattta

SEQ ID NO: 331499 - DNA, 20 bp, Artificial Sequence
  chemically synthesized
actttaaataagttacctaa

SEQ ID NO: 331500 - DNA, 20 bp, Artificial Sequence
  chemically synthesized
ttaaataagttacctaatag

SEQ ID NO: 331501 - DNA, 20 bp, Artificial Sequence
  chemically synthesized
tttaaatacttacttctatt

SEQ ID NO: 331502 - DNA, 20 bp, Artificial Sequence
  chemically synthesized
ttttaaatacttacttctat

SEQ ID NO: 331503 - DNA, 20 bp, Artificial Sequence
  chemically synthesized
ataagttacctaatagaagt

SEQ ID NO: 331504 - DNA, 20 bp, Artificial Sequence
  chemically synthesized
aagtaagtatttaaaatgct

SEQ ID NO: 331505 - DNA, 20 bp, Artificial Sequence
  chemically synthesized
caaatccagattttcaagct

SEQ ID NO: 331506 - DNA, 20 bp, Artificial Sequence
  chemically synthesized
aaatgctaagcttgaaaatc

SEQ ID NO: 331507 - DNA, 20 bp, Artificial Sequence
  chemically synthesized
tgtagcaaatccagattttc

SEQ ID NO: 331508 - DNA, 20 bp, Artificial Sequence
  chemically synthesized
tcttttatgtgtagcaaatc

SEQ ID NO: 331509 - DNA, 20 bp, Artificial Sequence
  chemically synthesized
tctggatttgctacacataa

SEQ ID NO: 331510 - DNA, 20 bp, Artificial Sequence
  chemically synthesized
tcatgttcctcttttatgtg

SEQ ID NO: 331511 - DNA, 20 bp, Artificial Sequence
  chemically synthesized
tggatttgctacacataaaa

SEQ ID NO: 331512 - DNA, 20 bp, Artificial Sequence
  chemically synthesized
ggatttgctacacataaaag

SEQ ID NO: 331513 - DNA, 20 bp, Artificial Sequence
  chemically synthesized
aagaggaacatgactttatg

SEQ ID NO: 331514 - DNA, 20 bp, Artificial Sequence
  chemically synthesized
cataccaattcagctacata

SEQ ID NO: 331515 - DNA, 20 bp, Artificial Sequence
  chemically synthesized
atgactttatgtagctgaat

SEQ ID NO: 331516 - DNA, 20 bp, Artificial Sequence
  chemically synthesized
agatcatctgcataccaatt

SEQ ID NO: 331517 - DNA, 20 bp, Artificial Sequence
  chemically synthesized
tatgtagctgaattggtatg

SEQ ID NO: 331518 - DNA, 20 bp, Artificial Sequence
  chemically synthesized
gaattggtatgcagatgatc

SEQ ID NO: 331519 - DNA, 20 bp, Artificial Sequence
  chemically synthesized
tatgcagatgatctagaaat

SEQ ID NO: 331520 - DNA, 20 bp, Artificial Sequence
  chemically synthesized
atgcagatgatctagaaatg

SEQ ID NO: 331521 - DNA, 20 bp, Artificial Sequence
  chemically synthesized
gttatgaaactcctcatttc

SEQ ID NO: 331522 - DNA, 20 bp, Artificial Sequence
  chemically synthesized
gcagatgatctagaaatgag

SEQ ID NO: 331523 - DNA, 20 bp, Artificial Sequence
  chemically synthesized
aaggattaatgatgagttga

SEQ ID NO: 331524 - DNA, 20 bp, Artificial Sequence
  chemically synthesized
tctttggaaggattaatgat

SEQ ID NO: 331525 - DNA, 20 bp, Artificial Sequence
  chemically synthesized
actcatcattaatccttcca

SEQ ID NO: 331526 - DNA, 20 bp, Artificial Sequence
  chemically synthesized
ggaaataaactatctttgga

SEQ ID NO: 331527 - DNA, 20 bp, Artificial Sequence
  chemically synthesized
atcattaatccttccaaaga

SEQ ID NO: 331528 - DNA, 20 bp, Artificial Sequence
  chemically synthesized
gggaaataaactatctttgg

SEQ ID NO: 331529 - DNA, 20 bp, Artificial Sequence
  chemically synthesized
ttggggaaataaactatctt

SEQ ID NO: 331530 - DNA, 20 bp, Artificial Sequence
  chemically synthesized
aaagatagtttatttcccca

SEQ ID NO: 331531 - DNA, 20 bp, Artificial Sequence
  chemically synthesized
tgctatcaattaaatctttg

SEQ ID NO: 331532 - DNA, 20 bp, Artificial Sequence
  chemically synthesized
atgctatcaattaaatcttt

SEQ ID NO: 331533 - DNA, 20 bp, Artificial Sequence
  chemically synthesized
aatgctatcaattaaatctt

SEQ ID NO: 331534 - DNA, 20 bp, Artificial Sequence
  chemically synthesized
ttccccaaagatttaattga

SEQ ID NO: 331535 - DNA, 20 bp, Artificial Sequence
  chemically synthesized
acagtcattttttaaattat

SEQ ID NO: 331536 - DNA, 20 bp, Artificial Sequence
  chemically synthesized
tataaagtttaatagaaata

SEQ ID NO: 331537 - DNA, 20 bp, Artificial Sequence
  chemically synthesized
ttgttcattataaagtttaa

SEQ ID NO: 331538 - DNA, 20 bp, Artificial Sequence
  chemically synthesized
cacatattttgttcattata

SEQ ID NO: 331539 - DNA, 20 bp, Artificial Sequence
  chemically synthesized
taaaatcaacacataattaa

SEQ ID NO: 331540 - DNA, 20 bp, Artificial Sequence
  chemically synthesized
ttaattatgtgttgatttta

SEQ ID NO: 331541 - DNA, 20 bp, Artificial Sequence
  chemically synthesized
accttatttagtaataatta

SEQ ID NO: 331542 - DNA, 20 bp, Artificial Sequence
  chemically synthesized
ataccttatttagtaataat

SEQ ID NO: 331543 - DNA, 20 bp, Artificial Sequence
  chemically synthesized
cactctaattattactaaat

SEQ ID NO: 331544 - DNA, 20 bp, Artificial Sequence
  chemically synthesized
actctaattattactaaata

SEQ ID NO: 331545 - DNA, 20 bp, Artificial Sequence
  chemically synthesized
ttttgaagagataccttatt

SEQ ID NO: 331546 - DNA, 20 bp, Artificial Sequence
  chemically synthesized
taaataaggtatctcttcaa

SEQ ID NO: 331547 - DNA, 20 bp, Artificial Sequence
  chemically synthesized
aaaatattaattcttttgaa

SEQ ID NO: 331548 - DNA, 20 bp, Artificial Sequence
  chemically synthesized
gaaaaatattaattcttttg

SEQ ID NO: 331549 - DNA, 20 bp, Artificial Sequence
  chemically synthesized
cccttaagcatgtcaatgta

SEQ ID NO: 331550 - DNA, 20 bp, Artificial Sequence
  chemically synthesized
ttctttacattgacatgctt

SEQ ID NO: 331551 - DNA, 20 bp, Artificial Sequence
  chemically synthesized
tctttacattgacatgctta

SEQ ID NO: 331552 - DNA, 20 bp, Artificial Sequence
  chemically synthesized
ctttacattgacatgcttaa

SEQ ID NO: 331553 - DNA, 20 bp, Artificial Sequence
  chemically synthesized
tttacattgacatgcttaag

SEQ ID NO: 331554 - DNA, 20 bp, Artificial Sequence
  chemically synthesized
ttacattgacatgcttaagg

SEQ ID NO: 331555 - DNA, 20 bp, Artificial Sequence
  chemically synthesized
cactaagagtttaccccctt

SEQ ID NO: 331556 - DNA, 20 bp, Artificial Sequence
  chemically synthesized
tgcttaagggggtaaactct

SEQ ID NO: 331557 - DNA, 20 bp, Artificial Sequence
  chemically synthesized
aacttttttgttttcactaa

SEQ ID NO: 331558 - DNA, 20 bp, Artificial Sequence
  chemically synthesized
caaacttttttgttttcact

SEQ ID NO: 331559 - DNA, 20 bp, Artificial Sequence
  chemically synthesized
aactcttagtgaaaacaaaa

SEQ ID NO: 331560 - DNA, 20 bp, Artificial Sequence
  chemically synthesized
gtgaaaacaaaaaagtttgc

SEQ ID NO: 331561 - DNA, 20 bp, Artificial Sequence
  chemically synthesized
aaaacaaaaaagtttgctag

SEQ ID NO: 331562 - DNA, 20 bp, Artificial Sequence
  chemically synthesized
catgtgggtctcaaatctac

SEQ ID NO: 331563 - DNA, 20 bp, Artificial Sequence
  chemically synthesized
aaaagtttgctagtagattt

SEQ ID NO: 331564 - DNA, 20 bp, Artificial Sequence
  chemically synthesized
tagtagatttgagacccaca

SEQ ID NO: 331565 - DNA, 20 bp, Artificial Sequence
  chemically synthesized
tacatgtgttaaatccatgt

SEQ ID NO: 331566 - DNA, 20 bp, Artificial Sequence
  chemically synthesized
atacatgtgttaaatccatg

SEQ ID NO: 331567 - DNA, 20 bp, Artificial Sequence
  chemically synthesized
ttaacacatgtatgacataa

SEQ ID NO: 331568 - DNA, 20 bp, Artificial Sequence
  chemically synthesized
taacacatgtatgacataat

SEQ ID NO: 331569 - DNA, 20 bp, Artificial Sequence
  chemically synthesized
acacatgtatgacataatag

SEQ ID NO: 331570 - DNA, 20 bp, Artificial Sequence
  chemically synthesized
cacatgtatgacataatagg

SEQ ID NO: 331571 - DNA, 20 bp, Artificial Sequence
  chemically synthesized
caaacttgtagattaacaca

SEQ ID NO: 331572 - DNA, 20 bp, Artificial Sequence
  chemically synthesized
accaaacttgtagattaaca

SEQ ID NO: 331573 - DNA, 20 bp, Artificial Sequence
  chemically synthesized
gaggctctgtgttaatctac

SEQ ID NO: 331574 - DNA, 20 bp, Artificial Sequence
  chemically synthesized
tctgtgttaatctacaagtt

SEQ ID NO: 331575 - DNA, 20 bp, Artificial Sequence
  chemically synthesized
taaacttgttaccaaacttg

SEQ ID NO: 331576 - DNA, 20 bp, Artificial Sequence
  chemically synthesized
taatctacaagtttggtaac

SEQ ID NO: 331577 - DNA, 20 bp, Artificial Sequence
  chemically synthesized
caagtttatgttgattaacc

SEQ ID NO: 331578 - DNA, 20 bp, Artificial Sequence
  chemically synthesized
tgaaaaaatgtaataatgct

SEQ ID NO: 331579 - DNA, 20 bp, Artificial Sequence
  chemically synthesized
tctttatctacaaataatat

SEQ ID NO: 331580 - DNA, 20 bp, Artificial Sequence
  chemically synthesized
tttttcactgatattatttg

SEQ ID NO: 331581 - DNA, 20 bp, Artificial Sequence
  chemically synthesized
actgatattatttgtagata

SEQ ID NO: 331582 - DNA, 20 bp, Artificial Sequence
  chemically synthesized
gcacatatccttgcatattg

SEQ ID NO: 331583 - DNA, 20 bp, Artificial Sequence
  chemically synthesized
agataaagaccacaatatgc

SEQ ID NO: 331584 - DNA, 20 bp, Artificial Sequence
  chemically synthesized
gataaagaccacaatatgca

SEQ ID NO: 331585 - DNA, 20 bp, Artificial Sequence
  chemically synthesized
tatgcaaggatatgtgctgc

SEQ ID NO: 331586 - DNA, 20 bp, Artificial Sequence
  chemically synthesized
tccctgctatagaattctgg

SEQ ID NO: 331587 - DNA, 20 bp, Artificial Sequence
  chemically synthesized
taatccctgctatagaattc

SEQ ID NO: 331588 - DNA, 20 bp, Artificial Sequence
  chemically synthesized
tatgtgctgccagaattcta

SEQ ID NO: 331589 - DNA, 20 bp, Artificial Sequence
  chemically synthesized
gtgctgccagaattctatag

SEQ ID NO: 331590 - DNA, 20 bp, Artificial Sequence
  chemically synthesized
tgctgccagaattctatagc

SEQ ID NO: 331591 - DNA, 20 bp, Artificial Sequence
  chemically synthesized
gctgccagaattctatagca

SEQ ID NO: 331592 - DNA, 20 bp, Artificial Sequence
  chemically synthesized
cctaattttaatccctgcta

SEQ ID NO: 331593 - DNA, 20 bp, Artificial Sequence
  chemically synthesized
tctatagcagggattaaaat

SEQ ID NO: 331594 - DNA, 20 bp, Artificial Sequence
  chemically synthesized
ctatagcagggattaaaatt

SEQ ID NO: 331595 - DNA, 20 bp, Artificial Sequence
  chemically synthesized
gcagggattaaaattaggca

SEQ ID NO: 331596 - DNA, 20 bp, Artificial Sequence
  chemically synthesized
cagggattaaaattaggcat

SEQ ID NO: 331597 - DNA, 20 bp, Artificial Sequence
  chemically synthesized
tccttaaaatgtataattag

SEQ ID NO: 331598 - DNA, 20 bp, Artificial Sequence
  chemically synthesized
tattccttaaaatgtataat

SEQ ID NO: 331599 - DNA, 20 bp, Artificial Sequence
  chemically synthesized
atccactaattatacatttt

SEQ ID NO: 331600 - DNA, 20 bp, Artificial Sequence
  chemically synthesized
tccactaattatacatttta

SEQ ID NO: 331601 - DNA, 20 bp, Artificial Sequence
  chemically synthesized
ttttaaggaatatatctgta

SEQ ID NO: 331602 - DNA, 20 bp, Artificial Sequence
  chemically synthesized
aaggaatatatctgtatggc

SEQ ID NO: 331603 - DNA, 20 bp, Artificial Sequence
  chemically synthesized
aggaatatatctgtatggcc

SEQ ID NO: 331604 - DNA, 20 bp, Artificial Sequence
  chemically synthesized
agccattgtgcccggccata

SEQ ID NO: 331605 - DNA, 20 bp, Artificial Sequence
  chemically synthesized
atctgtatggccgggcacaa

SEQ ID NO: 331606 - DNA, 20 bp, Artificial Sequence
  chemically synthesized
cagatgtgagccattgtgcc

SEQ ID NO: 331607 - DNA, 20 bp, Artificial Sequence
  chemically synthesized
agttctgtgattacagatgt

SEQ ID NO: 331608 - DNA, 20 bp, Artificial Sequence
  chemically synthesized
atggctcacatctgtaatca

SEQ ID NO: 331609 - DNA, 20 bp, Artificial Sequence
  chemically synthesized
catccaaagttctgtgatta

SEQ ID NO: 331610 - DNA, 20 bp, Artificial Sequence
  chemically synthesized
catctgtaatcacagaactt

SEQ ID NO: 331611 - DNA, 20 bp, Artificial Sequence
  chemically synthesized
tgtaatcacagaactttgga

SEQ ID NO: 331612 - DNA, 20 bp, Artificial Sequence
  chemically synthesized
ccagccgccttggccatcca

SEQ ID NO: 331613 - DNA, 20 bp, Artificial Sequence
  chemically synthesized
tcacagaactttggatggcc

SEQ ID NO: 331614 - DNA, 20 bp, Artificial Sequence
  chemically synthesized
cacagaactttggatggcca

SEQ ID NO: 331615 - DNA, 20 bp, Artificial Sequence
  chemically synthesized
agaactttggatggccaagg

SEQ ID NO: 331616 - DNA, 20 bp, Artificial Sequence
  chemically synthesized
ctttggatggccaaggcggc

SEQ ID NO: 331617 - DNA, 20 bp, Artificial Sequence
  chemically synthesized
ctcaggtgatccagccgcct

SEQ ID NO: 331618 - DNA, 20 bp, Artificial Sequence
  chemically synthesized
actcttgacctcaggtgatc

SEQ ID NO: 331619 - DNA, 20 bp, Artificial Sequence
  chemically synthesized
ccaaggcggctggatcacct

SEQ ID NO: 331620 - DNA, 20 bp, Artificial Sequence
  chemically synthesized
caaggcggctggatcacctg

SEQ ID NO: 331621 - DNA, 20 bp, Artificial Sequence
  chemically synthesized
cggctggatcacctgaggtc

SEQ ID NO: 331622 - DNA, 20 bp, Artificial Sequence
  chemically synthesized
ggtctcgaactcttgacctc

SEQ ID NO: 331623 - DNA, 20 bp, Artificial Sequence
  chemically synthesized
gctggatcacctgaggtcaa

SEQ ID NO: 331624 - DNA, 20 bp, Artificial Sequence
  chemically synthesized
tggtctcgaactcttgacct

SEQ ID NO: 331625 - DNA, 20 bp, Artificial Sequence
  chemically synthesized
tcacctgaggtcaagagttc

SEQ ID NO: 331626 - DNA, 20 bp, Artificial Sequence
  chemically synthesized
tgaggtcaagagttcgagac

SEQ ID NO: 331627 - DNA, 20 bp, Artificial Sequence
  chemically synthesized
tcaagagttcgagaccagcc

SEQ ID NO: 331628 - DNA, 20 bp, Artificial Sequence
  chemically synthesized
tttccccattttggccaggc

SEQ ID NO: 331629 - DNA, 20 bp, Artificial Sequence
  chemically synthesized
gaggtttccccattttggcc

SEQ ID NO: 331630 - DNA, 20 bp, Artificial Sequence
  chemically synthesized
cgagaccagcctggccaaaa

SEQ ID NO: 331631 - DNA, 20 bp, Artificial Sequence
  chemically synthesized
cgaggtttccccattttggc

SEQ ID NO: 331632 - DNA, 20 bp, Artificial Sequence
  chemically synthesized
gagaccagcctggccaaaat

SEQ ID NO: 331633 - DNA, 20 bp, Artificial Sequence
  chemically synthesized
agaccagcctggccaaaatg

SEQ ID NO: 331634 - DNA, 20 bp, Artificial Sequence
  chemically synthesized
gagacgaggtttccccattt

SEQ ID NO: 331635 - DNA, 20 bp, Artificial Sequence
  chemically synthesized
tgtatttttcagtagagacg

SEQ ID NO: 331636 - DNA, 20 bp, Artificial Sequence
  chemically synthesized
ttgtatttttcagtagagac

SEQ ID NO: 331637 - DNA, 20 bp, Artificial Sequence
  chemically synthesized
aatttttgtatttttcagta

SEQ ID NO: 331638 - DNA, 20 bp, Artificial Sequence
  chemically synthesized
ctaatttttgtatttttcag

SEQ ID NO: 331639 - DNA, 20 bp, Artificial Sequence
  chemically synthesized
cagctaatttttgtattttt

SEQ ID NO: 331640 - DNA, 20 bp, Artificial Sequence
  chemically synthesized
ctactgaaaaatacaaaaat

SEQ ID NO: 331641 - DNA, 20 bp, Artificial Sequence
  chemically synthesized
tgaaaaatacaaaaattagc

SEQ ID NO: 331642 - DNA, 20 bp, Artificial Sequence
  chemically synthesized
gaaaaatacaaaaattagct

SEQ ID NO: 331643 - DNA, 20 bp, Artificial Sequence
  chemically synthesized
atacaaaaattagctgggtg

SEQ ID NO: 331644 - DNA, 20 bp, Artificial Sequence
  chemically synthesized
caaaaattagctgggtgtgg

SEQ ID NO: 331645 - DNA, 20 bp, Artificial Sequence
  chemically synthesized
caggtgcctgccaccacacc

SEQ ID NO: 331646 - DNA, 20 bp, Artificial Sequence
  chemically synthesized
aaattagctgggtgtggtgg

SEQ ID NO: 331647 - DNA, 20 bp, Artificial Sequence
  chemically synthesized
aattagctgggtgtggtggc

SEQ ID NO: 331648 - DNA, 20 bp, Artificial Sequence
  chemically synthesized
gtggcaggcacctgtaatac

SEQ ID NO: 331649 - DNA, 20 bp, Artificial Sequence
  chemically synthesized
tcctgagtagctggtattac

SEQ ID NO: 331650 - DNA, 20 bp, Artificial Sequence
  chemically synthesized
ctcctgagtagctggtatta

SEQ ID NO: 331651 - DNA, 20 bp, Artificial Sequence
  chemically synthesized
cacctgtaataccagctact

SEQ ID NO: 331652 - DNA, 20 bp, Artificial Sequence
  chemically synthesized
acctgtaataccagctactc

SEQ ID NO: 331653 - DNA, 20 bp, Artificial Sequence
  chemically synthesized
gcctcagcctcctgagtagc

SEQ ID NO: 331654 - DNA, 20 bp, Artificial Sequence
  chemically synthesized
ctgtaataccagctactcag

SEQ ID NO: 331655 - DNA, 20 bp, Artificial Sequence
  chemically synthesized
tgtaataccagctactcagg

SEQ ID NO: 331656 - DNA, 20 bp, Artificial Sequence
  chemically synthesized
tcctgcctcagcctcctgag

SEQ ID NO: 331657 - DNA, 20 bp, Artificial Sequence
  chemically synthesized
ctctcctgcctcagcctcct

SEQ ID NO: 331658 - DNA, 20 bp, Artificial Sequence
  chemically synthesized
taccagctactcaggaggct

SEQ ID NO: 331659 - DNA, 20 bp, Artificial Sequence
  chemically synthesized
accagctactcaggaggctg

SEQ ID NO: 331660 - DNA, 20 bp, Artificial Sequence
  chemically synthesized
agctactcaggaggctgagg

SEQ ID NO: 331661 - DNA, 20 bp, Artificial Sequence
  chemically synthesized
gctactcaggaggctgaggc

SEQ ID NO: 331662 - DNA, 20 bp, Artificial Sequence
  chemically synthesized
tactcaggaggctgaggcag

SEQ ID NO: 331663 - DNA, 20 bp, Artificial Sequence
  chemically synthesized
ttcaagcaactctcctgcct

SEQ ID NO: 331664 - DNA, 20 bp, Artificial Sequence
  chemically synthesized
ctcaggaggctgaggcagga

SEQ ID NO: 331665 - DNA, 20 bp, Artificial Sequence
  chemically synthesized
gcaggagagttgcttgaacc

SEQ ID NO: 331666 - DNA, 20 bp, Artificial Sequence
  chemically synthesized
caggagagttgcttgaaccc

SEQ ID NO: 331667 - DNA, 20 bp, Artificial Sequence
  chemically synthesized
aacctctgcctcctgggttc

SEQ ID NO: 331668 - DNA, 20 bp, Artificial Sequence
  chemically synthesized
ggagagttgcttgaacccag

SEQ ID NO: 331669 - DNA, 20 bp, Artificial Sequence
  chemically synthesized
gagagttgcttgaacccagg

SEQ ID NO: 331670 - DNA, 20 bp, Artificial Sequence
  chemically synthesized
agttgcttgaacccaggagg

SEQ ID NO: 331671 - DNA, 20 bp, Artificial Sequence
  chemically synthesized
caatgcaacctctgcctcct

SEQ ID NO: 331672 - DNA, 20 bp, Artificial Sequence
  chemically synthesized
ttgcttgaacccaggaggca

SEQ ID NO: 331673 - DNA, 20 bp, Artificial Sequence
  chemically synthesized
tcaatgcaacctctgcctcc

SEQ ID NO: 331674 - DNA, 20 bp, Artificial Sequence
  chemically synthesized
tgcttgaacccaggaggcag

SEQ ID NO: 331675 - DNA, 20 bp, Artificial Sequence
  chemically synthesized
caggaggcagaggttgcatt

SEQ ID NO: 331676 - DNA, 20 bp, Artificial Sequence
  chemically synthesized
ggcagaggttgcattgagcc

SEQ ID NO: 331677 - DNA, 20 bp, Artificial Sequence
  chemically synthesized
gaagtgcactggcacgatct

SEQ ID NO: 331678 - DNA, 20 bp, Artificial Sequence
  chemically synthesized
gcattgagccaagatcgtgc

SEQ ID NO: 331679 - DNA, 20 bp, Artificial Sequence
  chemically synthesized
ttgccccggctgaagtgcac

SEQ ID NO: 331680 - DNA, 20 bp, Artificial Sequence
  chemically synthesized
aagatcgtgccagtgcactt

SEQ ID NO: 331681 - DNA, 20 bp, Artificial Sequence
  chemically synthesized
tcgtgccagtgcacttcagc

SEQ ID NO: 331682 - DNA, 20 bp, Artificial Sequence
  chemically synthesized
cgtgccagtgcacttcagcc

SEQ ID NO: 331683 - DNA, 20 bp, Artificial Sequence
  chemically synthesized
gtgccagtgcacttcagccg

SEQ ID NO: 331684 - DNA, 20 bp, Artificial Sequence
  chemically synthesized
ttgctctgttgccccggctg

SEQ ID NO: 331685 - DNA, 20 bp, Artificial Sequence
  chemically synthesized
gtgcacttcagccggggcaa

SEQ ID NO: 331686 - DNA, 20 bp, Artificial Sequence
  chemically synthesized
gagtttttgctctgttgccc

SEQ ID NO: 331687 - DNA, 20 bp, Artificial Sequence
  chemically synthesized
gcacttcagccggggcaaca

SEQ ID NO: 331688 - DNA, 20 bp, Artificial Sequence
  chemically synthesized
ttttttttttttttgagatg

SEQ ID NO: 331689 - DNA, 20 bp, Artificial Sequence
  chemically synthesized
ttttttttttttttttgaga

SEQ ID NO: 331690 - DNA, 20 bp, Artificial Sequence
  chemically synthesized
tttttttttttttttttttt

SEQ ID NO: 331691 - DNA, 20 bp, Artificial Sequence
  chemically synthesized
aaaaaaaaaaaaaaaaaaaa

SEQ ID NO: 331692 - DNA, 20 bp, Artificial Sequence
  chemically synthesized
aaaaaaaaaaaaaaaaagaa

SEQ ID NO: 331693 - DNA, 20 bp, Artificial Sequence
  chemically synthesized
aaaaaaaaaaaagaaaagaa

SEQ ID NO: 331694 - DNA, 20 bp, Artificial Sequence
  chemically synthesized
aaaaaaagaaaagaaaagaa

SEQ ID NO: 331695 - DNA, 20 bp, Artificial Sequence
  chemically synthesized
aaagaaaagaaaagaaaaga

SEQ ID NO: 331696 - DNA, 20 bp, Artificial Sequence
  chemically synthesized
gaaaagaaagaaatgtatct

SEQ ID NO: 331697 - DNA, 20 bp, Artificial Sequence
  chemically synthesized
catgattgaaaatgaaaact

SEQ ID NO: 331698 - DNA, 20 bp, Artificial Sequence
  chemically synthesized
taagttttcattttcaatca

SEQ ID NO: 331699 - DNA, 20 bp, Artificial Sequence
  chemically synthesized
agtgttgtaacatcataatt

SEQ ID NO: 331700 - DNA, 20 bp, Artificial Sequence
  chemically synthesized
atgttacaacactttgaata

SEQ ID NO: 331701 - DNA, 20 bp, Artificial Sequence
  chemically synthesized
ttttaatgaaactatattca

SEQ ID NO: 331702 - DNA, 20 bp, Artificial Sequence
  chemically synthesized
atatagtttcattaaaatat

SEQ ID NO: 331703 - DNA, 20 bp, Artificial Sequence
  chemically synthesized
tatagtttcattaaaatata

SEQ ID NO: 331704 - DNA, 20 bp, Artificial Sequence
  chemically synthesized
aatataaggttaataattta

SEQ ID NO: 331705 - DNA, 20 bp, Artificial Sequence
  chemically synthesized
tataaggttaataatttaaa

SEQ ID NO: 331706 - DNA, 20 bp, Artificial Sequence
  chemically synthesized
ggttaataatttaaagagaa

SEQ ID NO: 331707 - DNA, 20 bp, Artificial Sequence
  chemically synthesized
attacaatctattttgtttt

SEQ ID NO: 331708 - DNA, 20 bp, Artificial Sequence
  chemically synthesized
aatattttctgaaaacaaaa

SEQ ID NO: 331709 - DNA, 20 bp, Artificial Sequence
  chemically synthesized
gtaataaaattaatgcaaaa

SEQ ID NO: 331710 - DNA, 20 bp, Artificial Sequence
  chemically synthesized
ctctagtttctacattcatt

SEQ ID NO: 331711 - DNA, 20 bp, Artificial Sequence
  chemically synthesized
atcaaattacttaatgaatg

SEQ ID NO: 331712 - DNA, 20 bp, Artificial Sequence
  chemically synthesized
tacttaatgaatgtagaaac

SEQ ID NO: 331713 - DNA, 20 bp, Artificial Sequence
  chemically synthesized
cttaatgaatgtagaaacta

SEQ ID NO: 331714 - DNA, 20 bp, Artificial Sequence
  chemically synthesized
attttctgtagggcgatctc

SEQ ID NO: 331715 - DNA, 20 bp, Artificial Sequence
  chemically synthesized
agaaactagagatcgcccta

SEQ ID NO: 331716 - DNA, 20 bp, Artificial Sequence
  chemically synthesized
acactgtcacattttctgta

SEQ ID NO: 331717 - DNA, 20 bp, Artificial Sequence
  chemically synthesized
cacactgtcacattttctgt

SEQ ID NO: 331718 - DNA, 20 bp, Artificial Sequence
  chemically synthesized
tcacactgtcacattttctg

SEQ ID NO: 331719 - DNA, 20 bp, Artificial Sequence
  chemically synthesized
tcgccctacagaaaatgtga

SEQ ID NO: 331720 - DNA, 20 bp, Artificial Sequence
  chemically synthesized
aatgtgacagtgtgatgaat

SEQ ID NO: 331721 - DNA, 20 bp, Artificial Sequence
  chemically synthesized
ttaaggattataattatttt

SEQ ID NO: 331722 - DNA, 20 bp, Artificial Sequence
  chemically synthesized
ttaaaataattataatcctt

SEQ ID NO: 331723 - DNA, 20 bp, Artificial Sequence
  chemically synthesized
aaataattataatccttaag

SEQ ID NO: 331724 - DNA, 20 bp, Artificial Sequence
  chemically synthesized
ttaaacatgatgtcttctta

SEQ ID NO: 331725 - DNA, 20 bp, Artificial Sequence
  chemically synthesized
gttaaacatgatgtcttctt

SEQ ID NO: 331726 - DNA, 20 bp, Artificial Sequence
  chemically synthesized
acatcatgtttaacaaaatt

SEQ ID NO: 331727 - DNA, 20 bp, Artificial Sequence
  chemically synthesized
catcatgtttaacaaaattc

SEQ ID NO: 331728 - DNA, 20 bp, Artificial Sequence
  chemically synthesized
tttaacaaaattcaggatat

SEQ ID NO: 331729 - DNA, 20 bp, Artificial Sequence
  chemically synthesized
ttaacaaaattcaggatatc

SEQ ID NO: 331730 - DNA, 20 bp, Artificial Sequence
  chemically synthesized
aattcaggatatcaggatcc

SEQ ID NO: 331731 - DNA, 20 bp, Artificial Sequence
  chemically synthesized
agagcagaaatatttggtct

SEQ ID NO: 331732 - DNA, 20 bp, Artificial Sequence
  chemically synthesized
cagagcagaaatatttggtc

SEQ ID NO: 331733 - DNA, 20 bp, Artificial Sequence
  chemically synthesized
gattacagagcagaaatatt

SEQ ID NO: 331734 - DNA, 20 bp, Artificial Sequence
  chemically synthesized
atgtacctaagattacagag

SEQ ID NO: 331735 - DNA, 20 bp, Artificial Sequence
  chemically synthesized
gtcatgtacctaagattaca

SEQ ID NO: 331736 - DNA, 20 bp, Artificial Sequence
  chemically synthesized
atatttctgctctgtaatct

SEQ ID NO: 331737 - DNA, 20 bp, Artificial Sequence
  chemically synthesized
tatttctgctctgtaatctt

SEQ ID NO: 331738 - DNA, 20 bp, Artificial Sequence
  chemically synthesized
aagtcatgtacctaagatta

SEQ ID NO: 331739 - DNA, 20 bp, Artificial Sequence
  chemically synthesized
atatgctaagtcatgtacct

SEQ ID NO: 331740 - DNA, 20 bp, Artificial Sequence
  chemically synthesized
gtaatcttaggtacatgact

SEQ ID NO: 331741 - DNA, 20 bp, Artificial Sequence
  chemically synthesized
cactcaagctgagatatgct

SEQ ID NO: 331742 - DNA, 20 bp, Artificial Sequence
  chemically synthesized
gtacatgacttagcatatct

SEQ ID NO: 331743 - DNA, 20 bp, Artificial Sequence
  chemically synthesized
gacttagcatatctcagctt

SEQ ID NO: 331744 - DNA, 20 bp, Artificial Sequence
  chemically synthesized
caggtgaagacactcaagct

SEQ ID NO: 331745 - DNA, 20 bp, Artificial Sequence
  chemically synthesized
ttttacaggtgaagacactc

SEQ ID NO: 331746 - DNA, 20 bp, Artificial Sequence
  chemically synthesized
cacctttcattttacaggtg

SEQ ID NO: 331747 - DNA, 20 bp, Artificial Sequence
  chemically synthesized
ctctacacctttcattttac

SEQ ID NO: 331748 - DNA, 20 bp, Artificial Sequence
  chemically synthesized
cctctacacctttcatttta

SEQ ID NO: 331749 - DNA, 20 bp, Artificial Sequence
  chemically synthesized
tgtcttcacctgtaaaatga

SEQ ID NO: 331750 - DNA, 20 bp, Artificial Sequence
  chemically synthesized
gtcttcacctgtaaaatgaa

SEQ ID NO: 331751 - DNA, 20 bp, Artificial Sequence
  chemically synthesized
cacctgtaaaatgaaaggtg

SEQ ID NO: 331752 - DNA, 20 bp, Artificial Sequence
  chemically synthesized
cctgtaaaatgaaaggtgta

SEQ ID NO: 331753 - DNA, 20 bp, Artificial Sequence
  chemically synthesized
ctgtaaaatgaaaggtgtag

SEQ ID NO: 331754 - DNA, 20 bp, Artificial Sequence
  chemically synthesized
aatgaaaggtgtagaggttt

SEQ ID NO: 331755 - DNA, 20 bp, Artificial Sequence
  chemically synthesized
ttaataccaagaatattaag

SEQ ID NO: 331756 - DNA, 20 bp, Artificial Sequence
  chemically synthesized
aatttaataccaagaatatt

SEQ ID NO: 331757 - DNA, 20 bp, Artificial Sequence
  chemically synthesized
cagtgtctacttaatattct

SEQ ID NO: 331758 - DNA, 20 bp, Artificial Sequence
  chemically synthesized
tgtatgtgtaatttaatacc

SEQ ID NO: 331759 - DNA, 20 bp, Artificial Sequence
  chemically synthesized
acatacaaattatttccaaa

SEQ ID NO: 331760 - DNA, 20 bp, Artificial Sequence
  chemically synthesized
aatgaaatttcaaatccatt

SEQ ID NO: 331761 - DNA, 20 bp, Artificial Sequence
  chemically synthesized
atttgaaatttcatttgtgc

SEQ ID NO: 331762 - DNA, 20 bp, Artificial Sequence
  chemically synthesized
gaaatttcatttgtgctaga

SEQ ID NO: 331763 - DNA, 20 bp, Artificial Sequence
  chemically synthesized
atggccacttaattgctttc

SEQ ID NO: 331764 - DNA, 20 bp, Artificial Sequence
  chemically synthesized
atttgtgctagaaagcaatt

SEQ ID NO: 331765 - DNA, 20 bp, Artificial Sequence
  chemically synthesized
tgtgctagaaagcaattaag

SEQ ID NO: 331766 - DNA, 20 bp, Artificial Sequence
  chemically synthesized
aagcaattaagtggccattt

SEQ ID NO: 331767 - DNA, 20 bp, Artificial Sequence
  chemically synthesized
tcacagagtaggagccgaaa

SEQ ID NO: 331768 - DNA, 20 bp, Artificial Sequence
  chemically synthesized
acataagtgtcacagagtag

SEQ ID NO: 331769 - DNA, 20 bp, Artificial Sequence
  chemically synthesized
gcacataagtgtcacagagt

SEQ ID NO: 331770 - DNA, 20 bp, Artificial Sequence
  chemically synthesized
tgcacataagtgtcacagag

SEQ ID NO: 331771 - DNA, 20 bp, Artificial Sequence
  chemically synthesized
ccttgcacataagtgtcaca

SEQ ID NO: 331772 - DNA, 20 bp, Artificial Sequence
  chemically synthesized
gtccttgcacataagtgtca

SEQ ID NO: 331773 - DNA, 20 bp, Artificial Sequence
  chemically synthesized
actctgtgacacttatgtgc

SEQ ID NO: 331774 - DNA, 20 bp, Artificial Sequence
  chemically synthesized
ctctgtgacacttatgtgca

SEQ ID NO: 331775 - DNA, 20 bp, Artificial Sequence
  chemically synthesized
ttgagaatgtccttgcacat

SEQ ID NO: 331776 - DNA, 20 bp, Artificial Sequence
  chemically synthesized
ggctcctgattaagaagttt

SEQ ID NO: 331777 - DNA, 20 bp, Artificial Sequence
  chemically synthesized
acattctcaaacttcttaat

SEQ ID NO: 331778 - DNA, 20 bp, Artificial Sequence
  chemically synthesized
cattctcaaacttcttaatc

SEQ ID NO: 331779 - DNA, 20 bp, Artificial Sequence
  chemically synthesized
tatccaggctcctgattaag

SEQ ID NO: 331780 - DNA, 20 bp, Artificial Sequence
  chemically synthesized
ttctcaaacttcttaatcag

SEQ ID NO: 331781 - DNA, 20 bp, Artificial Sequence
  chemically synthesized
aaatatccaggctcctgatt

SEQ ID NO: 331782 - DNA, 20 bp, Artificial Sequence
  chemically synthesized
aaacttcttaatcaggagcc

SEQ ID NO: 331783 - DNA, 20 bp, Artificial Sequence
  chemically synthesized
gtacagatcttcaaatatcc

SEQ ID NO: 331784 - DNA, 20 bp, Artificial Sequence
  chemically synthesized
tgtacagatcttcaaatatc

SEQ ID NO: 331785 - DNA, 20 bp, Artificial Sequence
  chemically synthesized
atcaggagcctggatatttg

SEQ ID NO: 331786 - DNA, 20 bp, Artificial Sequence
  chemically synthesized
ggatatttgaagatctgtac

SEQ ID NO: 331787 - DNA, 20 bp, Artificial Sequence
  chemically synthesized
ttgttttaggtaagcttgta

SEQ ID NO: 331788 - DNA, 20 bp, Artificial Sequence
  chemically synthesized
tgactgtacttgttttaggt

SEQ ID NO: 331789 - DNA, 20 bp, Artificial Sequence
  chemically synthesized
tgtacaagcttacctaaaac

SEQ ID NO: 331790 - DNA, 20 bp, Artificial Sequence
  chemically synthesized
ctgatgactgtacttgtttt

SEQ ID NO: 331791 - DNA, 20 bp, Artificial Sequence
  chemically synthesized
actgatgactgtacttgttt

SEQ ID NO: 331792 - DNA, 20 bp, Artificial Sequence
  chemically synthesized
aagcttacctaaaacaagta

SEQ ID NO: 331793 - DNA, 20 bp, Artificial Sequence
  chemically synthesized
cctaaaacaagtacagtcat

SEQ ID NO: 331794 - DNA, 20 bp, Artificial Sequence
  chemically synthesized
aaacaagtacagtcatcagt

SEQ ID NO: 331795 - DNA, 20 bp, Artificial Sequence
  chemically synthesized
caagtacagtcatcagtaag

SEQ ID NO: 331796 - DNA, 20 bp, Artificial Sequence
  chemically synthesized
agtacagtcatcagtaagta

SEQ ID NO: 331797 - DNA, 20 bp, Artificial Sequence
  chemically synthesized
tgcctaacaggtgttcaata

SEQ ID NO: 331798 - DNA, 20 bp, Artificial Sequence
  chemically synthesized
gcactttattgaacacctgt

SEQ ID NO: 331799 - DNA, 20 bp, Artificial Sequence
  chemically synthesized
cactttattgaacacctgtt

SEQ ID NO: 331800 - DNA, 20 bp, Artificial Sequence
  chemically synthesized
tggctagcatggtgcctaac

SEQ ID NO: 331801 - DNA, 20 bp, Artificial Sequence
  chemically synthesized
gtggctagcatggtgcctaa

SEQ ID NO: 331802 - DNA, 20 bp, Artificial Sequence
  chemically synthesized
acacctgttaggcaccatgc

SEQ ID NO: 331803 - DNA, 20 bp, Artificial Sequence
  chemically synthesized
gttgggaaatgtggctagca

SEQ ID NO: 331804 - DNA, 20 bp, Artificial Sequence
  chemically synthesized
ggttagttgggaaatgtggc

SEQ ID NO: 331805 - DNA, 20 bp, Artificial Sequence
  chemically synthesized
tccaggttagttgggaaatg

SEQ ID NO: 331806 - DNA, 20 bp, Artificial Sequence
  chemically synthesized
ctgaagaatccaggttagtt

SEQ ID NO: 331807 - DNA, 20 bp, Artificial Sequence
  chemically synthesized
gccacatttcccaactaacc

SEQ ID NO: 331808 - DNA, 20 bp, Artificial Sequence
  chemically synthesized
tctgaagaatccaggttagt

SEQ ID NO: 331809 - DNA, 20 bp, Artificial Sequence
  chemically synthesized
ttcttctgaagaatccaggt

SEQ ID NO: 331810 - DNA, 20 bp, Artificial Sequence
  chemically synthesized
aagattcttctgaagaatcc

SEQ ID NO: 331811 - DNA, 20 bp, Artificial Sequence
  chemically synthesized
cccaactaacctggattctt

SEQ ID NO: 331812 - DNA, 20 bp, Artificial Sequence
  chemically synthesized
caagattcttctgaagaatc

SEQ ID NO: 331813 - DNA, 20 bp, Artificial Sequence
  chemically synthesized
aactaacctggattcttcag

SEQ ID NO: 331814 - DNA, 20 bp, Artificial Sequence
  chemically synthesized
gaacttacaagattcttctg

SEQ ID NO: 331815 - DNA, 20 bp, Artificial Sequence
  chemically synthesized
attcttcagaagaatcttgt

SEQ ID NO: 331816 - DNA, 20 bp, Artificial Sequence
  chemically synthesized
tacaatctgtcagaacttac

SEQ ID NO: 331817 - DNA, 20 bp, Artificial Sequence
  chemically synthesized
aagaatcttgtaagttctga

SEQ ID NO: 331818 - DNA, 20 bp, Artificial Sequence
  chemically synthesized
cttaaaaaaatacaatctgt

SEQ ID NO: 331819 - DNA, 20 bp, Artificial Sequence
  chemically synthesized
ctgacagattgtattttttt

SEQ ID NO: 331820 - DNA, 20 bp, Artificial Sequence
  chemically synthesized
cagattgtatttttttaaga

SEQ ID NO: 331821 - DNA, 20 bp, Artificial Sequence
  chemically synthesized
acatccgaagaataacatgt

SEQ ID NO: 331822 - DNA, 20 bp, Artificial Sequence
  chemically synthesized
tcatcttacatgttattctt

SEQ ID NO: 331823 - DNA, 20 bp, Artificial Sequence
  chemically synthesized
aagtatcagtgttacatccg

SEQ ID NO: 331824 - DNA, 20 bp, Artificial Sequence
  chemically synthesized
aactcttgatggagaagtat

SEQ ID NO: 331825 - DNA, 20 bp, Artificial Sequence
  chemically synthesized
aacactgatacttctccatc

SEQ ID NO: 331826 - DNA, 20 bp, Artificial Sequence
  chemically synthesized
aaacccaactcttgatggag

SEQ ID NO: 331827 - DNA, 20 bp, Artificial Sequence
  chemically synthesized
cactgatacttctccatcaa

SEQ ID NO: 331828 - DNA, 20 bp, Artificial Sequence
  chemically synthesized
cataaacccaactcttgatg

SEQ ID NO: 331829 - DNA, 20 bp, Artificial Sequence
  chemically synthesized
aacataaacccaactcttga

SEQ ID NO: 331830 - DNA, 20 bp, Artificial Sequence
  chemically synthesized
gatacttctccatcaagagt

SEQ ID NO: 331831 - DNA, 20 bp, Artificial Sequence
  chemically synthesized
atacttctccatcaagagtt

SEQ ID NO: 331832 - DNA, 20 bp, Artificial Sequence
  chemically synthesized
ggtccatcctagtcaagggg

SEQ ID NO: 331833 - DNA, 20 bp, Artificial Sequence
  chemically synthesized
ttatgtttctgccccttgac

SEQ ID NO: 331834 - DNA, 20 bp, Artificial Sequence
  chemically synthesized
tatgtttctgccccttgact

SEQ ID NO: 331835 - DNA, 20 bp, Artificial Sequence
  chemically synthesized
aggggtccatcctagtcaag

SEQ ID NO: 331836 - DNA, 20 bp, Artificial Sequence
  chemically synthesized
caggggtccatcctagtcaa

SEQ ID NO: 331837 - DNA, 20 bp, Artificial Sequence
  chemically synthesized
tcaggggtccatcctagtca

SEQ ID NO: 331838 - DNA, 20 bp, Artificial Sequence
  chemically synthesized
gtcaggggtccatcctagtc

SEQ ID NO: 331839 - DNA, 20 bp, Artificial Sequence
  chemically synthesized
tttctgccccttgactagga

SEQ ID NO: 331840 - DNA, 20 bp, Artificial Sequence
  chemically synthesized
ccatagtcaggggtccatcc

SEQ ID NO: 331841 - DNA, 20 bp, Artificial Sequence
  chemically synthesized
ctaggatggacccctgacta

SEQ ID NO: 331842 - DNA, 20 bp, Artificial Sequence
  chemically synthesized
ataacttcttccatagtcag

SEQ ID NO: 331843 - DNA, 20 bp, Artificial Sequence
  chemically synthesized
tataacttcttccatagtca

SEQ ID NO: 331844 - DNA, 20 bp, Artificial Sequence
  chemically synthesized
gtataacttcttccatagtc

SEQ ID NO: 331845 - DNA, 20 bp, Artificial Sequence
  chemically synthesized
ggatggacccctgactatgg

SEQ ID NO: 331846 - DNA, 20 bp, Artificial Sequence
  chemically synthesized
agtataacttcttccatagt

SEQ ID NO: 331847 - DNA, 20 bp, Artificial Sequence
  chemically synthesized
tggacccctgactatggaag

SEQ ID NO: 331848 - DNA, 20 bp, Artificial Sequence
  chemically synthesized
acatagtataacttcttcca

SEQ ID NO: 331849 - DNA, 20 bp, Artificial Sequence
  chemically synthesized
acttagtcttggaagtcaca

SEQ ID NO: 331850 - DNA, 20 bp, Artificial Sequence
  chemically synthesized
agttatactatgtgacttcc

SEQ ID NO: 331851 - DNA, 20 bp, Artificial Sequence
  chemically synthesized
cttttgtgacttagtcttgg

SEQ ID NO: 331852 - DNA, 20 bp, Artificial Sequence
  chemically synthesized
actatgtgacttccaagact

SEQ ID NO: 331853 - DNA, 20 bp, Artificial Sequence
  chemically synthesized
tgccttttgtgacttagtct

SEQ ID NO: 331854 - DNA, 20 bp, Artificial Sequence
  chemically synthesized
ctctattgccttttgtgact

SEQ ID NO: 331855 - DNA, 20 bp, Artificial Sequence
  chemically synthesized
cttccaagactaagtcacaa

SEQ ID NO: 331856 - DNA, 20 bp, Artificial Sequence
  chemically synthesized
ttccaagactaagtcacaaa

SEQ ID NO: 331857 - DNA, 20 bp, Artificial Sequence
  chemically synthesized
gactaagtcacaaaaggcaa

SEQ ID NO: 331858 - DNA, 20 bp, Artificial Sequence
  chemically synthesized
ctaagtcacaaaaggcaata

SEQ ID NO: 331859 - DNA, 20 bp, Artificial Sequence
  chemically synthesized
aaggcaatagagtttctgct

SEQ ID NO: 331860 - DNA, 20 bp, Artificial Sequence
  chemically synthesized
gtgacccaaagagtaccaag

SEQ ID NO: 331861 - DNA, 20 bp, Artificial Sequence
  chemically synthesized
taagtgacccaaagagtacc

SEQ ID NO: 331862 - DNA, 20 bp, Artificial Sequence
  chemically synthesized
agtttctgcttggtactctt

SEQ ID NO: 331863 - DNA, 20 bp, Artificial Sequence
  chemically synthesized
gtttctgcttggtactcttt

SEQ ID NO: 331864 - DNA, 20 bp, Artificial Sequence
  chemically synthesized
ccaagagtaagtgacccaaa

SEQ ID NO: 331865 - DNA, 20 bp, Artificial Sequence
  chemically synthesized
ttccaagagtaagtgaccca

SEQ ID NO: 331866 - DNA, 20 bp, Artificial Sequence
  chemically synthesized
ctctttgggtcacttactct

SEQ ID NO: 331867 - DNA, 20 bp, Artificial Sequence
  chemically synthesized
gctggctggattccaagagt

SEQ ID NO: 331868 - DNA, 20 bp, Artificial Sequence
  chemically synthesized
aaatgctggctggattccaa

SEQ ID NO: 331869 - DNA, 20 bp, Artificial Sequence
  chemically synthesized
ggtcacttactcttggaatc

SEQ ID NO: 331870 - DNA, 20 bp, Artificial Sequence
  chemically synthesized
ctaaatgctggctggattcc

SEQ ID NO: 331871 - DNA, 20 bp, Artificial Sequence
  chemically synthesized
acttactcttggaatccagc

SEQ ID NO: 331872 - DNA, 20 bp, Artificial Sequence
  chemically synthesized
gtcactcactaaatgctggc

SEQ ID NO: 331873 - DNA, 20 bp, Artificial Sequence
  chemically synthesized
cttggaatccagccagcatt

SEQ ID NO: 331874 - DNA, 20 bp, Artificial Sequence
  chemically synthesized
tgcagtcactcactaaatgc

SEQ ID NO: 331875 - DNA, 20 bp, Artificial Sequence
  chemically synthesized
gaatccagccagcatttagt

SEQ ID NO: 331876 - DNA, 20 bp, Artificial Sequence
  chemically synthesized
cagcatttagtgagtgactg

SEQ ID NO: 331877 - DNA, 20 bp, Artificial Sequence
  chemically synthesized
atgtggccttatttaatctg

SEQ ID NO: 331878 - DNA, 20 bp, Artificial Sequence
  chemically synthesized
tgagtgactgcagattaaat

SEQ ID NO: 331879 - DNA, 20 bp, Artificial Sequence
  chemically synthesized
gagtgactgcagattaaata

SEQ ID NO: 331880 - DNA, 20 bp, Artificial Sequence
  chemically synthesized
ttggctggaacatgtatatg

SEQ ID NO: 331881 - DNA, 20 bp, Artificial Sequence
  chemically synthesized
aaggccacatatacatgttc

SEQ ID NO: 331882 - DNA, 20 bp, Artificial Sequence
  chemically synthesized
cttcagccagggcagttggc

SEQ ID NO: 331883 - DNA, 20 bp, Artificial Sequence
  chemically synthesized
catgttccagccaactgccc

SEQ ID NO: 331884 - DNA, 20 bp, Artificial Sequence
  chemically synthesized
ggaacttcagccagggcagt

SEQ ID NO: 331885 - DNA, 20 bp, Artificial Sequence
  chemically synthesized
tgctggaacttcagccaggg

SEQ ID NO: 331886 - DNA, 20 bp, Artificial Sequence
  chemically synthesized
ccagccaactgccctggctg

SEQ ID NO: 331887 - DNA, 20 bp, Artificial Sequence
  chemically synthesized
tactgctggaacttcagcca

SEQ ID NO: 331888 - DNA, 20 bp, Artificial Sequence
  chemically synthesized
ctactgctggaacttcagcc

SEQ ID NO: 331889 - DNA, 20 bp, Artificial Sequence
  chemically synthesized
gctactgctggaacttcagc

SEQ ID NO: 331890 - DNA, 20 bp, Artificial Sequence
  chemically synthesized
aactgccctggctgaagttc

SEQ ID NO: 331891 - DNA, 20 bp, Artificial Sequence
  chemically synthesized
ggtggctactgctggaactt

SEQ ID NO: 331892 - DNA, 20 bp, Artificial Sequence
  chemically synthesized
tgccctggctgaagttccag

SEQ ID NO: 331893 - DNA, 20 bp, Artificial Sequence
  chemically synthesized
cctggctgaagttccagcag

SEQ ID NO: 331894 - DNA, 20 bp, Artificial Sequence
  chemically synthesized
acatgcctggtggctactgc

SEQ ID NO: 331895 - DNA, 20 bp, Artificial Sequence
  chemically synthesized
gaagttccagcagtagccac

SEQ ID NO: 331896 - DNA, 20 bp, Artificial Sequence
  chemically synthesized
aagttccagcagtagccacc

SEQ ID NO: 331897 - DNA, 20 bp, Artificial Sequence
  chemically synthesized
ttcttcactaacatgcctgg

SEQ ID NO: 331898 - DNA, 20 bp, Artificial Sequence
  chemically synthesized
gcagtagccaccaggcatgt

SEQ ID NO: 331899 - DNA, 20 bp, Artificial Sequence
  chemically synthesized
ggcttcttcactaacatgcc

SEQ ID NO: 331900 - DNA, 20 bp, Artificial Sequence
  chemically synthesized
agccaccaggcatgttagtg

SEQ ID NO: 331901 - DNA, 20 bp, Artificial Sequence
  chemically synthesized
caccaggcatgttagtgaag

SEQ ID NO: 331902 - DNA, 20 bp, Artificial Sequence
  chemically synthesized
tgaagctgaagtcattttga

SEQ ID NO: 331903 - DNA, 20 bp, Artificial Sequence
  chemically synthesized
atgaagctgaagtcattttg

SEQ ID NO: 331904 - DNA, 20 bp, Artificial Sequence
  chemically synthesized
agaagccttcaaaatgactt

SEQ ID NO: 331905 - DNA, 20 bp, Artificial Sequence
  chemically synthesized
taaaatagtagatgaagctg

SEQ ID NO: 331906 - DNA, 20 bp, Artificial Sequence
  chemically synthesized
gtgtaataaaatagtagatg

SEQ ID NO: 331907 - DNA, 20 bp, Artificial Sequence
  chemically synthesized
atataggtgtaataaaatag

SEQ ID NO: 331908 - DNA, 20 bp, Artificial Sequence
  chemically synthesized
ctcatataggtgtaataaaa

SEQ ID NO: 331909 - DNA, 20 bp, Artificial Sequence
  chemically synthesized
ctattttattacacctatat

SEQ ID NO: 331910 - DNA, 20 bp, Artificial Sequence
  chemically synthesized
ttttattacacctatatgag

SEQ ID NO: 331911 - DNA, 20 bp, Artificial Sequence
  chemically synthesized
gggttcagggcttctcatat

SEQ ID NO: 331912 - DNA, 20 bp, Artificial Sequence
  chemically synthesized
tgggttcagggcttctcata

SEQ ID NO: 331913 - DNA, 20 bp, Artificial Sequence
  chemically synthesized
ctgggtctcagatgggttca

SEQ ID NO: 331914 - DNA, 20 bp, Artificial Sequence
  chemically synthesized
tctgggtctcagatgggttc

SEQ ID NO: 331915 - DNA, 20 bp, Artificial Sequence
  chemically synthesized
ttctgggtctcagatgggtt

SEQ ID NO: 331916 - DNA, 20 bp, Artificial Sequence
  chemically synthesized
gagaagccctgaacccatct

SEQ ID NO: 331917 - DNA, 20 bp, Artificial Sequence
  chemically synthesized
tttgattctgggtctcagat

SEQ ID NO: 331918 - DNA, 20 bp, Artificial Sequence
  chemically synthesized
ttttgattctgggtctcaga

SEQ ID NO: 331919 - DNA, 20 bp, Artificial Sequence
  chemically synthesized
ccctgaacccatctgagacc

SEQ ID NO: 331920 - DNA, 20 bp, Artificial Sequence
  chemically synthesized
tctcttttgattctgggtct

SEQ ID NO: 331921 - DNA, 20 bp, Artificial Sequence
  chemically synthesized
ttattatctcttttgattct

SEQ ID NO: 331922 - DNA, 20 bp, Artificial Sequence
  chemically synthesized
catctgagacccagaatcaa

SEQ ID NO: 331923 - DNA, 20 bp, Artificial Sequence
  chemically synthesized
cttattatctcttttgattc

SEQ ID NO: 331924 - DNA, 20 bp, Artificial Sequence
  chemically synthesized
tctgagacccagaatcaaaa

SEQ ID NO: 331925 - DNA, 20 bp, Artificial Sequence
  chemically synthesized
ccagaatcaaaagagataat

SEQ ID NO: 331926 - DNA, 20 bp, Artificial Sequence
  chemically synthesized
aaaacgaatgttgtttttat

SEQ ID NO: 331927 - DNA, 20 bp, Artificial Sequence
  chemically synthesized
tgttgtttttataagctccc

SEQ ID NO: 331928 - DNA, 20 bp, Artificial Sequence
  chemically synthesized
caaatcaactcaaaacttgg

SEQ ID NO: 331929 - DNA, 20 bp, Artificial Sequence
  chemically synthesized
tttataagctcccaagtttt

SEQ ID NO: 331930 - DNA, 20 bp, Artificial Sequence
  chemically synthesized
agcaaatcaactcaaaactt

SEQ ID NO: 331931 - DNA, 20 bp, Artificial Sequence
  chemically synthesized
tagcaaatcaactcaaaact

SEQ ID NO: 331932 - DNA, 20 bp, Artificial Sequence
  chemically synthesized
ttttgagttgatttgctata

SEQ ID NO: 331933 - DNA, 20 bp, Artificial Sequence
  chemically synthesized
caccagtaactattgccata

SEQ ID NO: 331934 - DNA, 20 bp, Artificial Sequence
  chemically synthesized
gttgatttgctatatggcaa

SEQ ID NO: 331935 - DNA, 20 bp, Artificial Sequence
  chemically synthesized
tgctatatggcaatagttac

SEQ ID NO: 331936 - DNA, 20 bp, Artificial Sequence
  chemically synthesized
ggcaatagttactggtgaac

SEQ ID NO: 331937 - DNA, 20 bp, Artificial Sequence
  chemically synthesized
gcaatagttactggtgaaca

SEQ ID NO: 331938 - DNA, 20 bp, Artificial Sequence
  chemically synthesized
ggtgtgcttaccttgttcac

SEQ ID NO: 331939 - DNA, 20 bp, Artificial Sequence
  chemically synthesized
tagttactggtgaacaaggt

SEQ ID NO: 331940 - DNA, 20 bp, Artificial Sequence
  chemically synthesized
ttagctcacctgtgtaatac

SEQ ID NO: 331941 - DNA, 20 bp, Artificial Sequence
  chemically synthesized
gtaagcacacctgtattaca

SEQ ID NO: 331942 - DNA, 20 bp, Artificial Sequence
  chemically synthesized
cttagctcacctgtgtaata

SEQ ID NO: 331943 - DNA, 20 bp, Artificial Sequence
  chemically synthesized
taagcacacctgtattacac

SEQ ID NO: 331944 - DNA, 20 bp, Artificial Sequence
  chemically synthesized
cacacctgtattacacaggt

SEQ ID NO: 331945 - DNA, 20 bp, Artificial Sequence
  chemically synthesized
ctgtattacacaggtgagct

SEQ ID NO: 331946 - DNA, 20 bp, Artificial Sequence
  chemically synthesized
tggcatacctgtgtaatgct

SEQ ID NO: 331947 - DNA, 20 bp, Artificial Sequence
  chemically synthesized
caggtgagctaagcattaca

SEQ ID NO: 331948 - DNA, 20 bp, Artificial Sequence
  chemically synthesized
aggtgagctaagcattacac

SEQ ID NO: 331949 - DNA, 20 bp, Artificial Sequence
  chemically synthesized
aagcattacacaggtatgcc

SEQ ID NO: 331950 - DNA, 20 bp, Artificial Sequence
  chemically synthesized
gcattacacaggtatgccaa

SEQ ID NO: 331951 - DNA, 20 bp, Artificial Sequence
  chemically synthesized
tgtgtgactcagttatctct

SEQ ID NO: 331952 - DNA, 20 bp, Artificial Sequence
  chemically synthesized
aggtatgccaagagataact

SEQ ID NO: 331953 - DNA, 20 bp, Artificial Sequence
  chemically synthesized
ttgaccttagttgtgtgact

SEQ ID NO: 331954 - DNA, 20 bp, Artificial Sequence
  chemically synthesized
gataactgagtcacacaact

SEQ ID NO: 331955 - DNA, 20 bp, Artificial Sequence
  chemically synthesized
ataactgagtcacacaacta

SEQ ID NO: 331956 - DNA, 20 bp, Artificial Sequence
  chemically synthesized
gtgttacaactgattgacct

SEQ ID NO: 331957 - DNA, 20 bp, Artificial Sequence
  chemically synthesized
gtcacacaactaaggtcaat

SEQ ID NO: 331958 - DNA, 20 bp, Artificial Sequence
  chemically synthesized
aatcaagtctttatggaagt

SEQ ID NO: 331959 - DNA, 20 bp, Artificial Sequence
  chemically synthesized
cacgaattcttacttccata

SEQ ID NO: 331960 - DNA, 20 bp, Artificial Sequence
  chemically synthesized
tacaaatcaagtctttatgg

SEQ ID NO: 331961 - DNA, 20 bp, Artificial Sequence
  chemically synthesized
ttttacaaatcaagtcttta

SEQ ID NO: 331962 - DNA, 20 bp, Artificial Sequence
  chemically synthesized
ttatttttcttttacaaatc

SEQ ID NO: 331963 - DNA, 20 bp, Artificial Sequence
  chemically synthesized
cataaagacttgatttgtaa

SEQ ID NO: 331964 - DNA, 20 bp, Artificial Sequence
  chemically synthesized
aataaaacataaaaataaaa

SEQ ID NO: 331965 - DNA, 20 bp, Artificial Sequence
  chemically synthesized
attaaaataaatgtttgaaa

SEQ ID NO: 331966 - DNA, 20 bp, Artificial Sequence
  chemically synthesized
gtttgaaaaagatattcctt

SEQ ID NO: 331967 - DNA, 20 bp, Artificial Sequence
  chemically synthesized
ttgaaaaagatattccttaa

SEQ ID NO: 331968 - DNA, 20 bp, Artificial Sequence
  chemically synthesized
tgaaaaagatattccttaag

SEQ ID NO: 331969 - DNA, 20 bp, Artificial Sequence
  chemically synthesized
tctttaggaagggcctctta

SEQ ID NO: 331970 - DNA, 20 bp, Artificial Sequence
  chemically synthesized
ttctttaggaagggcctctt

SEQ ID NO: 331971 - DNA, 20 bp, Artificial Sequence
  chemically synthesized
tccttaagaggcccttccta

SEQ ID NO: 331972 - DNA, 20 bp, Artificial Sequence
  chemically synthesized
cagtatgccttctttaggaa

SEQ ID NO: 331973 - DNA, 20 bp, Artificial Sequence
  chemically synthesized
gcagtatgccttctttagga

SEQ ID NO: 331974 - DNA, 20 bp, Artificial Sequence
  chemically synthesized
ttaagaggcccttcctaaag

SEQ ID NO: 331975 - DNA, 20 bp, Artificial Sequence
  chemically synthesized
tgcagtatgccttctttagg

SEQ ID NO: 331976 - DNA, 20 bp, Artificial Sequence
  chemically synthesized
taagaggcccttcctaaaga

SEQ ID NO: 331977 - DNA, 20 bp, Artificial Sequence
  chemically synthesized
agatgcagtatgccttcttt

SEQ ID NO: 331978 - DNA, 20 bp, Artificial Sequence
  chemically synthesized
tagatgcagtatgccttctt

SEQ ID NO: 331979 - DNA, 20 bp, Artificial Sequence
  chemically synthesized
taaagaaggcatactgcatc

SEQ ID NO: 331980 - DNA, 20 bp, Artificial Sequence
  chemically synthesized
ctccacatgtaggctagatg

SEQ ID NO: 331981 - DNA, 20 bp, Artificial Sequence
  chemically synthesized
ttggatctccacatgtaggc

SEQ ID NO: 331982 - DNA, 20 bp, Artificial Sequence
  chemically synthesized
tactgcatctagcctacatg

SEQ ID NO: 331983 - DNA, 20 bp, Artificial Sequence
  chemically synthesized
ctgcatctagcctacatgtg

SEQ ID NO: 331984 - DNA, 20 bp, Artificial Sequence
  chemically synthesized
ttgtttggatctccacatgt

SEQ ID NO: 331985 - DNA, 20 bp, Artificial Sequence
  chemically synthesized
tttgtttggatctccacatg

SEQ ID NO: 331986 - DNA, 20 bp, Artificial Sequence
  chemically synthesized
gtaatcattaatagtttgtt

SEQ ID NO: 331987 - DNA, 20 bp, Artificial Sequence
  chemically synthesized
ggcttatttgtaatcattaa

SEQ ID NO: 331988 - DNA, 20 bp, Artificial Sequence
  chemically synthesized
aactattaatgattacaaat

SEQ ID NO: 331989 - DNA, 20 bp, Artificial Sequence
  chemically synthesized
ggtgtttaagcaggtcaggg

SEQ ID NO: 331990 - DNA, 20 bp, Artificial Sequence
  chemically synthesized
tccggtgtttaagcaggtca

SEQ ID NO: 331991 - DNA, 20 bp, Artificial Sequence
  chemically synthesized
ttccggtgtttaagcaggtc

SEQ ID NO: 331992 - DNA, 20 bp, Artificial Sequence
  chemically synthesized
gttccggtgtttaagcaggt

SEQ ID NO: 331993 - DNA, 20 bp, Artificial Sequence
  chemically synthesized
ctgtgttccggtgtttaagc

SEQ ID NO: 331994 - DNA, 20 bp, Artificial Sequence
  chemically synthesized
tctgtgttccggtgtttaag

SEQ ID NO: 331995 - DNA, 20 bp, Artificial Sequence
  chemically synthesized
gccctgacctgcttaaacac

SEQ ID NO: 331996 - DNA, 20 bp, Artificial Sequence
  chemically synthesized
taatctgtgttccggtgttt

SEQ ID NO: 331997 - DNA, 20 bp, Artificial Sequence
  chemically synthesized
cctgcttaaacaccggaaca

SEQ ID NO: 331998 - DNA, 20 bp, Artificial Sequence
  chemically synthesized
aatttagctaatctgtgttc

SEQ ID NO: 331999 - DNA, 20 bp, Artificial Sequence
  chemically synthesized
ttaaacaccggaacacagat

SEQ ID NO: 332000 - DNA, 20 bp, Artificial Sequence
  chemically synthesized
atgaattattggatggaatt

SEQ ID NO: 332001 - DNA, 20 bp, Artificial Sequence
  chemically synthesized
aatttgaatgaattattgga

SEQ ID NO: 332002 - DNA, 20 bp, Artificial Sequence
  chemically synthesized
ctagaatttgaatgaattat

SEQ ID NO: 332003 - DNA, 20 bp, Artificial Sequence
  chemically synthesized
ccaataattcattcaaattc

SEQ ID NO: 332004 - DNA, 20 bp, Artificial Sequence
  chemically synthesized
caataattcattcaaattct

SEQ ID NO: 332005 - DNA, 20 bp, Artificial Sequence
  chemically synthesized
ttatgggatttgtcggttcc

SEQ ID NO: 332006 - DNA, 20 bp, Artificial Sequence
  chemically synthesized
ttacattttatgggatttgt

SEQ ID NO: 332007 - DNA, 20 bp, Artificial Sequence
  chemically synthesized
tcatgtttattacattttat

SEQ ID NO: 332008 - DNA, 20 bp, Artificial Sequence
  chemically synthesized
gtcatgtttattacatttta

SEQ ID NO: 332009 - DNA, 20 bp, Artificial Sequence
  chemically synthesized
gtaataaacatgacttaaat

SEQ ID NO: 332010 - DNA, 20 bp, Artificial Sequence
  chemically synthesized
aataaacatgacttaaatga

SEQ ID NO: 332011 - DNA, 20 bp, Artificial Sequence
  chemically synthesized
atatttgaatgctctcattt

SEQ ID NO: 332012 - DNA, 20 bp, Artificial Sequence
  chemically synthesized
tgagagcattcaaatatcct

SEQ ID NO: 332013 - DNA, 20 bp, Artificial Sequence
  chemically synthesized
gagtcaatttttgcgaacca

SEQ ID NO: 332014 - DNA, 20 bp, Artificial Sequence
  chemically synthesized
agagtcaatttttgcgaacc

SEQ ID NO: 332015 - DNA, 20 bp, Artificial Sequence
  chemically synthesized
ctgtggatgttacaaaaata

SEQ ID NO: 332016 - DNA, 20 bp, Artificial Sequence
  chemically synthesized
tgctgtggatgttacaaaaa

SEQ ID NO: 332017 - DNA, 20 bp, Artificial Sequence
  chemically synthesized
ctctatttttgtaacatcca

SEQ ID NO: 332018 - DNA, 20 bp, Artificial Sequence
  chemically synthesized
taggtccagaggtattgctg

SEQ ID NO: 332019 - DNA, 20 bp, Artificial Sequence
  chemically synthesized
aacatccacagcaatacctc

SEQ ID NO: 332020 - DNA, 20 bp, Artificial Sequence
  chemically synthesized
gataccagagataggtccag

SEQ ID NO: 332021 - DNA, 20 bp, Artificial Sequence
  chemically synthesized
tgataccagagataggtcca

SEQ ID NO: 332022 - DNA, 20 bp, Artificial Sequence
  chemically synthesized
cttgataccagagataggtc

SEQ ID NO: 332023 - DNA, 20 bp, Artificial Sequence
  chemically synthesized
aatacctctggacctatctc

SEQ ID NO: 332024 - DNA, 20 bp, Artificial Sequence
  chemically synthesized
tgtctcttgataccagagat

SEQ ID NO: 332025 - DNA, 20 bp, Artificial Sequence
  chemically synthesized
ttgtctcttgataccagaga

SEQ ID NO: 332026 - DNA, 20 bp, Artificial Sequence
  chemically synthesized
ctggacctatctctggtatc

SEQ ID NO: 332027 - DNA, 20 bp, Artificial Sequence
  chemically synthesized
ttttttgtctcttgatacca

SEQ ID NO: 332028 - DNA, 20 bp, Artificial Sequence
  chemically synthesized
ggacctatctctggtatcaa

SEQ ID NO: 332029 - DNA, 20 bp, Artificial Sequence
  chemically synthesized
acttttttgtctcttgatac

SEQ ID NO: 332030 - DNA, 20 bp, Artificial Sequence
  chemically synthesized
tctggtatcaagagacaaaa

SEQ ID NO: 332031 - DNA, 20 bp, Artificial Sequence
  chemically synthesized
gagacaaaaaagtcattttc

SEQ ID NO: 332032 - DNA, 20 bp, Artificial Sequence
  chemically synthesized
aaaaaagtcattttctagaa

SEQ ID NO: 332033 - DNA, 20 bp, Artificial Sequence
  chemically synthesized
aagtcattttctagaatggt

SEQ ID NO: 332034 - DNA, 20 bp, Artificial Sequence
  chemically synthesized
tataattttaccaaccattc

SEQ ID NO: 332035 - DNA, 20 bp, Artificial Sequence
  chemically synthesized
aaattatatatcatctcttc

SEQ ID NO: 332036 - DNA, 20 bp, Artificial Sequence
  chemically synthesized
gatatttggagtttctggaa

SEQ ID NO: 332037 - DNA, 20 bp, Artificial Sequence
  chemically synthesized
aagatatttggagtttctgg

SEQ ID NO: 332038 - DNA, 20 bp, Artificial Sequence
  chemically synthesized
gtaaagatatttggagtttc

SEQ ID NO: 332039 - DNA, 20 bp, Artificial Sequence
  chemically synthesized
acatttggtaaagatatttg

SEQ ID NO: 332040 - DNA, 20 bp, Artificial Sequence
  chemically synthesized
ttacatttggtaaagatatt

SEQ ID NO: 332041 - DNA, 20 bp, Artificial Sequence
  chemically synthesized
gtccatttttacatttggta

SEQ ID NO: 332042 - DNA, 20 bp, Artificial Sequence
  chemically synthesized
tgaaagtccatttttacatt

SEQ ID NO: 332043 - DNA, 20 bp, Artificial Sequence
  chemically synthesized
atctttaccaaatgtaaaaa

SEQ ID NO: 332044 - DNA, 20 bp, Artificial Sequence
  chemically synthesized
agtcaaaaaatgtagaatga

SEQ ID NO: 332045 - DNA, 20 bp, Artificial Sequence
  chemically synthesized
aaaatataagtcaaaaaatg

SEQ ID NO: 332046 - DNA, 20 bp, Artificial Sequence
  chemically synthesized
taatgtaatcttaaaaatat

SEQ ID NO: 332047 - DNA, 20 bp, Artificial Sequence
  chemically synthesized
attttttgacttatattttt

SEQ ID NO: 332048 - DNA, 20 bp, Artificial Sequence
  chemically synthesized
tttataaatataatgcaaaa

SEQ ID NO: 332049 - DNA, 20 bp, Artificial Sequence
  chemically synthesized
ataaatataatgcaaaatgg

SEQ ID NO: 332050 - DNA, 20 bp, Artificial Sequence
  chemically synthesized
aaatataatgcaaaatggaa

SEQ ID NO: 332051 - DNA, 20 bp, Artificial Sequence
  chemically synthesized
aagaaatatttacaacaacg

SEQ ID NO: 332052 - DNA, 20 bp, Artificial Sequence
  chemically synthesized
tcaataagtagttaagggta

SEQ ID NO: 332053 - DNA, 20 bp, Artificial Sequence
  chemically synthesized
ggcattcaataagtagttaa

SEQ ID NO: 332054 - DNA, 20 bp, Artificial Sequence
  chemically synthesized
aggcattcaataagtagtta

SEQ ID NO: 332055 - DNA, 20 bp, Artificial Sequence
  chemically synthesized
caggcattcaataagtagtt

SEQ ID NO: 332056 - DNA, 20 bp, Artificial Sequence
  chemically synthesized
cacaacaggcattcaataag

SEQ ID NO: 332057 - DNA, 20 bp, Artificial Sequence
  chemically synthesized
ttacacaacaggcattcaat

SEQ ID NO: 332058 - DNA, 20 bp, Artificial Sequence
  chemically synthesized
ttattgaatgcctgttgtgt

SEQ ID NO: 332059 - DNA, 20 bp, Artificial Sequence
  chemically synthesized
cattcaccttcttacacaac

SEQ ID NO: 332060 - DNA, 20 bp, Artificial Sequence
  chemically synthesized
ccattcaccttcttacacaa

SEQ ID NO: 332061 - DNA, 20 bp, Artificial Sequence
  chemically synthesized
ttgaatgcctgttgtgtaag

SEQ ID NO: 332062 - DNA, 20 bp, Artificial Sequence
  chemically synthesized
tgaatgcctgttgtgtaaga

SEQ ID NO: 332063 - DNA, 20 bp, Artificial Sequence
  chemically synthesized
ctgttgtgtaagaaggtgaa

SEQ ID NO: 332064 - DNA, 20 bp, Artificial Sequence
  chemically synthesized
gttgtgtaagaaggtgaatg

SEQ ID NO: 332065 - DNA, 20 bp, Artificial Sequence
  chemically synthesized
acatagagtgttagagggga

SEQ ID NO: 332066 - DNA, 20 bp, Artificial Sequence
  chemically synthesized
tatcacatagagtgttagag

SEQ ID NO: 332067 - DNA, 20 bp, Artificial Sequence
  chemically synthesized
ctatcacatagagtgttaga

SEQ ID NO: 332068 - DNA, 20 bp, Artificial Sequence
  chemically synthesized
actatcacatagagtgttag

SEQ ID NO: 332069 - DNA, 20 bp, Artificial Sequence
  chemically synthesized
cactatcacatagagtgtta

SEQ ID NO: 332070 - DNA, 20 bp, Artificial Sequence
  chemically synthesized
tccactatcacatagagtgt

SEQ ID NO: 332071 - DNA, 20 bp, Artificial Sequence
  chemically synthesized
ccctctaacactctatgtga

SEQ ID NO: 332072 - DNA, 20 bp, Artificial Sequence
  chemically synthesized
aaagcctccactatcacata

SEQ ID NO: 332073 - DNA, 20 bp, Artificial Sequence
  chemically synthesized
gaaaagcctccactatcaca

SEQ ID NO: 332074 - DNA, 20 bp, Artificial Sequence
  chemically synthesized
tctaacactctatgtgatag

SEQ ID NO: 332075 - DNA, 20 bp, Artificial Sequence
  chemically synthesized
taacactctatgtgatagtg

SEQ ID NO: 332076 - DNA, 20 bp, Artificial Sequence
  chemically synthesized
aacactctatgtgatagtgg

SEQ ID NO: 332077 - DNA, 20 bp, Artificial Sequence
  chemically synthesized
atgcatagtgtatgtgagaa

SEQ ID NO: 332078 - DNA, 20 bp, Artificial Sequence
  chemically synthesized
aattaatgcatagtgtatgt

SEQ ID NO: 332079 - DNA, 20 bp, Artificial Sequence
  chemically synthesized
tggctaaaataattaatgca

SEQ ID NO: 332080 - DNA, 20 bp, Artificial Sequence
  chemically synthesized
acactatgcattaattattt

SEQ ID NO: 332081 - DNA, 20 bp, Artificial Sequence
  chemically synthesized
taattattttagccacccca

SEQ ID NO: 332082 - DNA, 20 bp, Artificial Sequence
  chemically synthesized
actttcaactttccatgggg

SEQ ID NO: 332083 - DNA, 20 bp, Artificial Sequence
  chemically synthesized
tattttagccaccccatgga

SEQ ID NO: 332084 - DNA, 20 bp, Artificial Sequence
  chemically synthesized
gatactttcaactttccatg

SEQ ID NO: 332085 - DNA, 20 bp, Artificial Sequence
  chemically synthesized
agatactttcaactttccat

SEQ ID NO: 332086 - DNA, 20 bp, Artificial Sequence
  chemically synthesized
aagatactttcaactttcca

SEQ ID NO: 332087 - DNA, 20 bp, Artificial Sequence
  chemically synthesized
gccaccccatggaaagttga

SEQ ID NO: 332088 - DNA, 20 bp, Artificial Sequence
  chemically synthesized
agttgaaagtatctttattt

SEQ ID NO: 332089 - DNA, 20 bp, Artificial Sequence
  chemically synthesized
ttgaaagtatctttatttta

SEQ ID NO: 332090 - DNA, 20 bp, Artificial Sequence
  chemically synthesized
gttttctcatctctaaaata

SEQ ID NO: 332091 - DNA, 20 bp, Artificial Sequence
  chemically synthesized
agtatctttattttagagat

SEQ ID NO: 332092 - DNA, 20 bp, Artificial Sequence
  chemically synthesized
attttagagatgagaaaact

SEQ ID NO: 332093 - DNA, 20 bp, Artificial Sequence
  chemically synthesized
gagatgagaaaactgagtaa

SEQ ID NO: 332094 - DNA, 20 bp, Artificial Sequence
  chemically synthesized
gatgagaaaactgagtaata

SEQ ID NO: 332095 - DNA, 20 bp, Artificial Sequence
  chemically synthesized
gctattttctctctattact

SEQ ID NO: 332096 - DNA, 20 bp, Artificial Sequence
  chemically synthesized
tgagaaaactgagtaataga

SEQ ID NO: 332097 - DNA, 20 bp, Artificial Sequence
  chemically synthesized
actgagtaatagagagaaaa

SEQ ID NO: 332098 - DNA, 20 bp, Artificial Sequence
  chemically synthesized
tagagagaaaatagcatatg

SEQ ID NO: 332099 - DNA, 20 bp, Artificial Sequence
  chemically synthesized
agagagaaaatagcatatgc

SEQ ID NO: 332100 - DNA, 20 bp, Artificial Sequence
  chemically synthesized
aatagcatatgcaggtccca

SEQ ID NO: 332101 - DNA, 20 bp, Artificial Sequence
  chemically synthesized
catatgcaggtcccacagac

SEQ ID NO: 332102 - DNA, 20 bp, Artificial Sequence
  chemically synthesized
ataataggaatctagtctgt

SEQ ID NO: 332103 - DNA, 20 bp, Artificial Sequence
  chemically synthesized
tataataggaatctagtctg

SEQ ID NO: 332104 - DNA, 20 bp, Artificial Sequence
  chemically synthesized
acaggagtataataggaatc

SEQ ID NO: 332105 - DNA, 20 bp, Artificial Sequence
  chemically synthesized
gatgaaaacaggagtataat

SEQ ID NO: 332106 - DNA, 20 bp, Artificial Sequence
  chemically synthesized
agatgaaaacaggagtataa

SEQ ID NO: 332107 - DNA, 20 bp, Artificial Sequence
  chemically synthesized
agatattaagatgaaaacag

SEQ ID NO: 332108 - DNA, 20 bp, Artificial Sequence
  chemically synthesized
taagatattaagatgaaaac

SEQ ID NO: 332109 - DNA, 20 bp, Artificial Sequence
  chemically synthesized
ctaagatattaagatgaaaa

SEQ ID NO: 332110 - DNA, 20 bp, Artificial Sequence
  chemically synthesized
ctgttttcatcttaatatct

SEQ ID NO: 332111 - DNA, 20 bp, Artificial Sequence
  chemically synthesized
tattccatagctaagatatt

SEQ ID NO: 332112 - DNA, 20 bp, Artificial Sequence
  chemically synthesized
tcatcttaatatcttagcta

SEQ ID NO: 332113 - DNA, 20 bp, Artificial Sequence
  chemically synthesized
ttaaggaatattccatagct

SEQ ID NO: 332114 - DNA, 20 bp, Artificial Sequence
  chemically synthesized
gaacattaaggaatattcca

SEQ ID NO: 332115 - DNA, 20 bp, Artificial Sequence
  chemically synthesized
aaacttttcgaagaacatta

SEQ ID NO: 332116 - DNA, 20 bp, Artificial Sequence
  chemically synthesized
taaacttttcgaagaacatt

SEQ ID NO: 332117 - DNA, 20 bp, Artificial Sequence
  chemically synthesized
attccttaatgttcttcgaa

SEQ ID NO: 332118 - DNA, 20 bp, Artificial Sequence
  chemically synthesized
taatggtgttaaacttttcg

SEQ ID NO: 332119 - DNA, 20 bp, Artificial Sequence
  chemically synthesized
gatgtaaataagaattttaa

SEQ ID NO: 332120 - DNA, 20 bp, Artificial Sequence
  chemically synthesized
atgtttattttgatgtaaat

SEQ ID NO: 332121 - DNA, 20 bp, Artificial Sequence
  chemically synthesized
tacatcaaaataaacatgaa

SEQ ID NO: 332122 - DNA, 20 bp, Artificial Sequence
  chemically synthesized
taaacatgaatagaataatt

SEQ ID NO: 332123 - DNA, 20 bp, Artificial Sequence
  chemically synthesized
aacatgaatagaataattca

SEQ ID NO: 332124 - DNA, 20 bp, Artificial Sequence
  chemically synthesized
acatgaatagaataattcag

SEQ ID NO: 332125 - DNA, 20 bp, Artificial Sequence
  chemically synthesized
gaataattcagaggacaaaa

SEQ ID NO: 332126 - DNA, 20 bp, Artificial Sequence
  chemically synthesized
aataattcagaggacaaaac

SEQ ID NO: 332127 - DNA, 20 bp, Artificial Sequence
  chemically synthesized
gacaaaacaggaaatgtatt

SEQ ID NO: 332128 - DNA, 20 bp, Artificial Sequence
  chemically synthesized
acaaaacaggaaatgtattt

SEQ ID NO: 332129 - DNA, 20 bp, Artificial Sequence
  chemically synthesized
caggaaatgtatttgggaca

SEQ ID NO: 332130 - DNA, 20 bp, Artificial Sequence
  chemically synthesized
tgtatttgggacatggatga

SEQ ID NO: 332131 - DNA, 20 bp, Artificial Sequence
  chemically synthesized
tgataattctaaataagaat

SEQ ID NO: 332132 - DNA, 20 bp, Artificial Sequence
  chemically synthesized
gtgataattctaaataagaa

SEQ ID NO: 332133 - DNA, 20 bp, Artificial Sequence
  chemically synthesized
gaaaatttcctattcttatt

SEQ ID NO: 332134 - DNA, 20 bp, Artificial Sequence
  chemically synthesized
tataagtgataattctaaat

SEQ ID NO: 332135 - DNA, 20 bp, Artificial Sequence
  chemically synthesized
agaattatcacttatatgtc

SEQ ID NO: 332136 - DNA, 20 bp, Artificial Sequence
  chemically synthesized
tatttttcttcttgacatat

SEQ ID NO: 332137 - DNA, 20 bp, Artificial Sequence
  chemically synthesized
attatcacttatatgtcaag

SEQ ID NO: 332138 - DNA, 20 bp, Artificial Sequence
  chemically synthesized
aaaaaagctttgaatagtgt

SEQ ID NO: 332139 - DNA, 20 bp, Artificial Sequence
  chemically synthesized
aaaaaaagctttgaatagtg

SEQ ID NO: 332140 - DNA, 20 bp, Artificial Sequence
  chemically synthesized
taacattcccacactattca

SEQ ID NO: 332141 - DNA, 20 bp, Artificial Sequence
  chemically synthesized
tgcttaaaaaaagctttgaa

SEQ ID NO: 332142 - DNA, 20 bp, Artificial Sequence
  chemically synthesized
cactattcaaagcttttttt

SEQ ID NO: 332143 - DNA, 20 bp, Artificial Sequence
  chemically synthesized
aggaaattgatgcttaaaaa

SEQ ID NO: 332144 - DNA, 20 bp, Artificial Sequence
  chemically synthesized
gttacctatcaaaataggtt

SEQ ID NO: 332145 - DNA, 20 bp, Artificial Sequence
  chemically synthesized
agttacctatcaaaataggt

SEQ ID NO: 332146 - DNA, 20 bp, Artificial Sequence
  chemically synthesized
aatttcctaacctattttga

SEQ ID NO: 332147 - DNA, 20 bp, Artificial Sequence
  chemically synthesized
atggagttacctatcaaaat

SEQ ID NO: 332148 - DNA, 20 bp, Artificial Sequence
  chemically synthesized
atttcctaacctattttgat

SEQ ID NO: 332149 - DNA, 20 bp, Artificial Sequence
  chemically synthesized
aatggagttacctatcaaaa

SEQ ID NO: 332150 - DNA, 20 bp, Artificial Sequence
  chemically synthesized
ttgataggtaactccatttg

SEQ ID NO: 332151 - DNA, 20 bp, Artificial Sequence
  chemically synthesized
aagatgtaactccacaaatg

SEQ ID NO: 332152 - DNA, 20 bp, Artificial Sequence
  chemically synthesized
gataggtaactccatttgtg

SEQ ID NO: 332153 - DNA, 20 bp, Artificial Sequence
  chemically synthesized
caaagatgtaactccacaaa

SEQ ID NO: 332154 - DNA, 20 bp, Artificial Sequence
  chemically synthesized
ttgtggagttacatctttgt

SEQ ID NO: 332155 - DNA, 20 bp, Artificial Sequence
  chemically synthesized
atcttcaaaaaaatcttaca

SEQ ID NO: 332156 - DNA, 20 bp, Artificial Sequence
  chemically synthesized
atctttgtaagatttttttg

SEQ ID NO: 332157 - DNA, 20 bp, Artificial Sequence
  chemically synthesized
tgtaagatttttttgaagat

SEQ ID NO: 332158 - DNA, 20 bp, Artificial Sequence
  chemically synthesized
aataaatgtaaattacatgc

SEQ ID NO: 332159 - DNA, 20 bp, Artificial Sequence
  chemically synthesized
ataaatgtaaattacatgct

SEQ ID NO: 332160 - DNA, 20 bp, Artificial Sequence
  chemically synthesized
taggaaatatgttaaatgcc

SEQ ID NO: 332161 - DNA, 20 bp, Artificial Sequence
  chemically synthesized
tttaacatatttcctaaatg

SEQ ID NO: 332162 - DNA, 20 bp, Artificial Sequence
  chemically synthesized
cactaggtgtgtctgcattt

SEQ ID NO: 332163 - DNA, 20 bp, Artificial Sequence
  chemically synthesized
ccactaggtgtgtctgcatt

SEQ ID NO: 332164 - DNA, 20 bp, Artificial Sequence
  chemically synthesized
ttcctaaatgcagacacacc

SEQ ID NO: 332165 - DNA, 20 bp, Artificial Sequence
  chemically synthesized
ctaaatgcagacacacctag

SEQ ID NO: 332166 - DNA, 20 bp, Artificial Sequence
  chemically synthesized
aatacatcatttattccact

SEQ ID NO: 332167 - DNA, 20 bp, Artificial Sequence
  chemically synthesized
aaatacatcatttattccac

SEQ ID NO: 332168 - DNA, 20 bp, Artificial Sequence
  chemically synthesized
gtggaataaatgatgtattt

SEQ ID NO: 332169 - DNA, 20 bp, Artificial Sequence
  chemically synthesized
gtatgaaaattttataagga

SEQ ID NO: 332170 - DNA, 20 bp, Artificial Sequence
  chemically synthesized
ttaagtatgaaaattttata

SEQ ID NO: 332171 - DNA, 20 bp, Artificial Sequence
  chemically synthesized
attaagtatgaaaattttat

SEQ ID NO: 332172 - DNA, 20 bp, Artificial Sequence
  chemically synthesized
ataaaattttcatacttaat

SEQ ID NO: 332173 - DNA, 20 bp, Artificial Sequence
  chemically synthesized
taaaattttcatacttaatg

SEQ ID NO: 332174 - DNA, 20 bp, Artificial Sequence
  chemically synthesized
aaaattttcatacttaatga

SEQ ID NO: 332175 - DNA, 20 bp, Artificial Sequence
  chemically synthesized
tttaaggtaaagccctcatt

SEQ ID NO: 332176 - DNA, 20 bp, Artificial Sequence
  chemically synthesized
acaaaaagttatttaaggta

SEQ ID NO: 332177 - DNA, 20 bp, Artificial Sequence
  chemically synthesized
taaaaacaaaaagttattta

SEQ ID NO: 332178 - DNA, 20 bp, Artificial Sequence
  chemically synthesized
ttaaaaacaaaaagttattt

SEQ ID NO: 332179 - DNA, 20 bp, Artificial Sequence
  chemically synthesized
gtaagtaacttaaaaacaaa

SEQ ID NO: 332180 - DNA, 20 bp, Artificial Sequence
  chemically synthesized
ttaaataactttttgttttt

SEQ ID NO: 332181 - DNA, 20 bp, Artificial Sequence
  chemically synthesized
ttaaaaaaatgatttagtgt

SEQ ID NO: 332182 - DNA, 20 bp, Artificial Sequence
  chemically synthesized
aggtttttaaaaaaatgatt

SEQ ID NO: 332183 - DNA, 20 bp, Artificial Sequence
  chemically synthesized
atcatttttttaaaaacctc

SEQ ID NO: 332184 - DNA, 20 bp, Artificial Sequence
  chemically synthesized
tcatttttttaaaaacctct

SEQ ID NO: 332185 - DNA, 20 bp, Artificial Sequence
  chemically synthesized
gttatagtccaaaaacctag

SEQ ID NO: 332186 - DNA, 20 bp, Artificial Sequence
  chemically synthesized
tgttatagtccaaaaaccta

SEQ ID NO: 332187 - DNA, 20 bp, Artificial Sequence
  chemically synthesized
tttaaaaacctctaggtttt

SEQ ID NO: 332188 - DNA, 20 bp, Artificial Sequence
  chemically synthesized
tgtgttatagtccaaaaacc

SEQ ID NO: 332189 - DNA, 20 bp, Artificial Sequence
  chemically synthesized
aaaggagcgttattgtgtta

SEQ ID NO: 332190 - DNA, 20 bp, Artificial Sequence
  chemically synthesized
tctctttatgaagattaaag

SEQ ID NO: 332191 - DNA, 20 bp, Artificial Sequence
  chemically synthesized
ggtctctttatgaagattaa

SEQ ID NO: 332192 - DNA, 20 bp, Artificial Sequence
  chemically synthesized
tggtctctttatgaagatta

SEQ ID NO: 332193 - DNA, 20 bp, Artificial Sequence
  chemically synthesized
acgctcctttaatcttcata

SEQ ID NO: 332194 - DNA, 20 bp, Artificial Sequence
  chemically synthesized
gctcctttaatcttcataaa

SEQ ID NO: 332195 - DNA, 20 bp, Artificial Sequence
  chemically synthesized
ttcatagtggtctctttatg

SEQ ID NO: 332196 - DNA, 20 bp, Artificial Sequence
  chemically synthesized
tggtgtaaaattgttcatag

SEQ ID NO: 332197 - DNA, 20 bp, Artificial Sequence
  chemically synthesized
tcttggtgtaaaattgttca

SEQ ID NO: 332198 - DNA, 20 bp, Artificial Sequence
  chemically synthesized
actatgaacaattttacacc

SEQ ID NO: 332199 - DNA, 20 bp, Artificial Sequence
  chemically synthesized
gtttttagattacagtttct

SEQ ID NO: 332200 - DNA, 20 bp, Artificial Sequence
  chemically synthesized
ttaaccatgtttttagatta

SEQ ID NO: 332201 - DNA, 20 bp, Artificial Sequence
  chemically synthesized
gaaactgtaatctaaaaaca

SEQ ID NO: 332202 - DNA, 20 bp, Artificial Sequence
  chemically synthesized
taggaatttaaccatgtttt

SEQ ID NO: 332203 - DNA, 20 bp, Artificial Sequence
  chemically synthesized
taaaaacatggttaaattcc

SEQ ID NO: 332204 - DNA, 20 bp, Artificial Sequence
  chemically synthesized
ttggtaggttttatgtttct

SEQ ID NO: 332205 - DNA, 20 bp, Artificial Sequence
  chemically synthesized
tttggtaggttttatgtttc

SEQ ID NO: 332206 - DNA, 20 bp, Artificial Sequence
  chemically synthesized
ttacacagttcagatttggt

SEQ ID NO: 332207 - DNA, 20 bp, Artificial Sequence
  chemically synthesized
tttacacagttcagatttgg

SEQ ID NO: 332208 - DNA, 20 bp, Artificial Sequence
  chemically synthesized
atttttacacagttcagatt

SEQ ID NO: 332209 - DNA, 20 bp, Artificial Sequence
  chemically synthesized
ttttccatttttacacagtt

SEQ ID NO: 332210 - DNA, 20 bp, Artificial Sequence
  chemically synthesized
cagacttttccatttttaca

SEQ ID NO: 332211 - DNA, 20 bp, Artificial Sequence
  chemically synthesized
aaatctgaactgtgtaaaaa

SEQ ID NO: 332212 - DNA, 20 bp, Artificial Sequence
  chemically synthesized
tgaactgtgtaaaaatggaa

SEQ ID NO: 332213 - DNA, 20 bp, Artificial Sequence
  chemically synthesized
taaaaatggaaaagtctgaa

SEQ ID NO: 332214 - DNA, 20 bp, Artificial Sequence
  chemically synthesized
cttacttgtattgatctatt

SEQ ID NO: 332215 - DNA, 20 bp, Artificial Sequence
  chemically synthesized
aagtctgaatagatcaatac

SEQ ID NO: 332216 - DNA, 20 bp, Artificial Sequence
  chemically synthesized
ctgaatagatcaatacaagt

SEQ ID NO: 332217 - DNA, 20 bp, Artificial Sequence
  chemically synthesized
tgaatagatcaatacaagta

SEQ ID NO: 332218 - DNA, 20 bp, Artificial Sequence
  chemically synthesized
gaatagatcaatacaagtaa

SEQ ID NO: 332219 - DNA, 20 bp, Artificial Sequence
  chemically synthesized
atcaatacaagtaagggatt

SEQ ID NO: 332220 - DNA, 20 bp, Artificial Sequence
  chemically synthesized
atacaagtaagggattgagt

SEQ ID NO: 332221 - DNA, 20 bp, Artificial Sequence
  chemically synthesized
taatttttaaactctcaaca

SEQ ID NO: 332222 - DNA, 20 bp, Artificial Sequence
  chemically synthesized
cttttgcttttctttgttga

SEQ ID NO: 332223 - DNA, 20 bp, Artificial Sequence
  chemically synthesized
gtcttttgcttttctttgtt

SEQ ID NO: 332224 - DNA, 20 bp, Artificial Sequence
  chemically synthesized
tttaaactctcaacaaagaa

SEQ ID NO: 332225 - DNA, 20 bp, Artificial Sequence
  chemically synthesized
ctctcaacaaagaaaagcaa

SEQ ID NO: 332226 - DNA, 20 bp, Artificial Sequence
  chemically synthesized
aacaaagaaaagcaaaagac

SEQ ID NO: 332227 - DNA, 20 bp, Artificial Sequence
  chemically synthesized
acaaagaaaagcaaaagacg

SEQ ID NO: 332228 - DNA, 20 bp, Artificial Sequence
  chemically synthesized
aaaagacgaggtgacttcat

SEQ ID NO: 332229 - DNA, 20 bp, Artificial Sequence
  chemically synthesized
tttgatagaaatcacttatg

SEQ ID NO: 332230 - DNA, 20 bp, Artificial Sequence
  chemically synthesized
tttctttaaaaaatgtttga

SEQ ID NO: 332231 - DNA, 20 bp, Artificial Sequence
  chemically synthesized
tttctatcaaacatttttta

SEQ ID NO: 332232 - DNA, 20 bp, Artificial Sequence
  chemically synthesized
tcaaagagttcgtgaagcat

SEQ ID NO: 332233 - DNA, 20 bp, Artificial Sequence
  chemically synthesized
gttttttcaaagagttcgtg

SEQ ID NO: 332234 - DNA, 20 bp, Artificial Sequence
  chemically synthesized
tccacttcagttttttcaaa

SEQ ID NO: 332235 - DNA, 20 bp, Artificial Sequence
  chemically synthesized
cctccacttcagttttttca

SEQ ID NO: 332236 - DNA, 20 bp, Artificial Sequence
  chemically synthesized
cgaactctttgaaaaaactg

SEQ ID NO: 332237 - DNA, 20 bp, Artificial Sequence
  chemically synthesized
actctttgaaaaaactgaag

SEQ ID NO: 332238 - DNA, 20 bp, Artificial Sequence
  chemically synthesized
tctttgaaaaaactgaagtg

SEQ ID NO: 332239 - DNA, 20 bp, Artificial Sequence
  chemically synthesized
ctttgaaaaaactgaagtgg

SEQ ID NO: 332240 - DNA, 20 bp, Artificial Sequence
  chemically synthesized
tttgaaaaaactgaagtgga

SEQ ID NO: 332241 - DNA, 20 bp, Artificial Sequence
  chemically synthesized
tggaagtgctccctccactt

SEQ ID NO: 332242 - DNA, 20 bp, Artificial Sequence
  chemically synthesized
tgaaaaaactgaagtggagg

SEQ ID NO: 332243 - DNA, 20 bp, Artificial Sequence
  chemically synthesized
accttataaagtgaatttgg

SEQ ID NO: 332244 - DNA, 20 bp, Artificial Sequence
  chemically synthesized
ctgaccttataaagtgaatt

SEQ ID NO: 332245 - DNA, 20 bp, Artificial Sequence
  chemically synthesized
cacttccaaattcactttat

SEQ ID NO: 332246 - DNA, 20 bp, Artificial Sequence
  chemically synthesized
acttccaaattcactttata

SEQ ID NO: 332247 - DNA, 20 bp, Artificial Sequence
  chemically synthesized
ttggtaatgctgaccttata

SEQ ID NO: 332248 - DNA, 20 bp, Artificial Sequence
  chemically synthesized
ccaaattcactttataaggt

SEQ ID NO: 332249 - DNA, 20 bp, Artificial Sequence
  chemically synthesized
ttataaggtcagcattacca

SEQ ID NO: 332250 - DNA, 20 bp, Artificial Sequence
  chemically synthesized
aaggtcagcattaccaaagc

SEQ ID NO: 332251 - DNA, 20 bp, Artificial Sequence
  chemically synthesized
gggatgtctttttctggctt

SEQ ID NO: 332252 - DNA, 20 bp, Artificial Sequence
  chemically synthesized
agcattaccaaagccagaaa

SEQ ID NO: 332253 - DNA, 20 bp, Artificial Sequence
  chemically synthesized
tttcttgggatgtctttttc

SEQ ID NO: 332254 - DNA, 20 bp, Artificial Sequence
  chemically synthesized
aagccagaaaaagacatccc

SEQ ID NO: 332255 - DNA, 20 bp, Artificial Sequence
  chemically synthesized
tattgagttgcagttttctt

SEQ ID NO: 332256 - DNA, 20 bp, Artificial Sequence
  chemically synthesized
atattgagttgcagttttct

SEQ ID NO: 332257 - DNA, 20 bp, Artificial Sequence
  chemically synthesized
ctgtcaaggatattgagttg

SEQ ID NO: 332258 - DNA, 20 bp, Artificial Sequence
  chemically synthesized
ctatatctgtcaaggatatt

SEQ ID NO: 332259 - DNA, 20 bp, Artificial Sequence
  chemically synthesized
ctgcaactcaatatccttga

SEQ ID NO: 332260 - DNA, 20 bp, Artificial Sequence
  chemically synthesized
ttttgcctctatatctgtca

SEQ ID NO: 332261 - DNA, 20 bp, Artificial Sequence
  chemically synthesized
attttgcctctatatctgtc

SEQ ID NO: 332262 - DNA, 20 bp, Artificial Sequence
  chemically synthesized
ctcaatatccttgacagata

SEQ ID NO: 332263 - DNA, 20 bp, Artificial Sequence
  chemically synthesized
caatatccttgacagatata

SEQ ID NO: 332264 - DNA, 20 bp, Artificial Sequence
  chemically synthesized
aatatccttgacagatatag

SEQ ID NO: 332265 - DNA, 20 bp, Artificial Sequence
  chemically synthesized
aaatttgccagaattttgtt

SEQ ID NO: 332266 - DNA, 20 bp, Artificial Sequence
  chemically synthesized
caaaattctcaacaaaattc

SEQ ID NO: 332267 - DNA, 20 bp, Artificial Sequence
  chemically synthesized
aatgtgttgttaaaatttgc

SEQ ID NO: 332268 - DNA, 20 bp, Artificial Sequence
  chemically synthesized
aaattttaacaacacattaa

SEQ ID NO: 332269 - DNA, 20 bp, Artificial Sequence
  chemically synthesized
aattttaacaacacattaaa

SEQ ID NO: 332270 - DNA, 20 bp, Artificial Sequence
  chemically synthesized
aaggatcatataccatgacc

SEQ ID NO: 332271 - DNA, 20 bp, Artificial Sequence
  chemically synthesized
ggataaatctcacttggtca

SEQ ID NO: 332272 - DNA, 20 bp, Artificial Sequence
  chemically synthesized
atcatataccatgaccaagt

SEQ ID NO: 332273 - DNA, 20 bp, Artificial Sequence
  chemically synthesized
tcccaaggataaatctcact

SEQ ID NO: 332274 - DNA, 20 bp, Artificial Sequence
  chemically synthesized
gaccaagtgagatttatcct

SEQ ID NO: 332275 - DNA, 20 bp, Artificial Sequence
  chemically synthesized
accaagtgagatttatcctt

SEQ ID NO: 332276 - DNA, 20 bp, Artificial Sequence
  chemically synthesized
tgaaccatccttgtatccca

SEQ ID NO: 332277 - DNA, 20 bp, Artificial Sequence
  chemically synthesized
gagatttatccttgggatac

SEQ ID NO: 332278 - DNA, 20 bp, Artificial Sequence
  chemically synthesized
ttgaaccatccttgtatccc

SEQ ID NO: 332279 - DNA, 20 bp, Artificial Sequence
  chemically synthesized
agatttatccttgggataca

SEQ ID NO: 332280 - DNA, 20 bp, Artificial Sequence
  chemically synthesized
ttatccttgggatacaagga

SEQ ID NO: 332281 - DNA, 20 bp, Artificial Sequence
  chemically synthesized
ggttcaacatgaaaatcaat

SEQ ID NO: 332282 - DNA, 20 bp, Artificial Sequence
  chemically synthesized
agtatgatacaccacgttaa

SEQ ID NO: 332283 - DNA, 20 bp, Artificial Sequence
  chemically synthesized
tcttatttattctgttaacg

SEQ ID NO: 332284 - DNA, 20 bp, Artificial Sequence
  chemically synthesized
accacgttaacagaataaat

SEQ ID NO: 332285 - DNA, 20 bp, Artificial Sequence
  chemically synthesized
acgttaacagaataaataag

SEQ ID NO: 332286 - DNA, 20 bp, Artificial Sequence
  chemically synthesized
aagtcacatgttcatttcat

SEQ ID NO: 332287 - DNA, 20 bp, Artificial Sequence
  chemically synthesized
aattttgccaaacaagtttt

SEQ ID NO: 332288 - DNA, 20 bp, Artificial Sequence
  chemically synthesized
ttagatgctgaaaacttgtt

SEQ ID NO: 332289 - DNA, 20 bp, Artificial Sequence
  chemically synthesized
tgtgttgaattttgccaaac

SEQ ID NO: 332290 - DNA, 20 bp, Artificial Sequence
  chemically synthesized
gtttaatggttttttttaaa

SEQ ID NO: 332291 - DNA, 20 bp, Artificial Sequence
  chemically synthesized
ctagtttgttgagagtttaa

SEQ ID NO: 332292 - DNA, 20 bp, Artificial Sequence
  chemically synthesized
ttctattcctagtttgttga

SEQ ID NO: 332293 - DNA, 20 bp, Artificial Sequence
  chemically synthesized
ccattaaactctcaacaaac

SEQ ID NO: 332294 - DNA, 20 bp, Artificial Sequence
  chemically synthesized
ccttctattcctagtttgtt

SEQ ID NO: 332295 - DNA, 20 bp, Artificial Sequence
  chemically synthesized
cattaaactctcaacaaact

SEQ ID NO: 332296 - DNA, 20 bp, Artificial Sequence
  chemically synthesized
aactctcaacaaactaggaa

SEQ ID NO: 332297 - DNA, 20 bp, Artificial Sequence
  chemically synthesized
tctcaacaaactaggaatag

SEQ ID NO: 332298 - DNA, 20 bp, Artificial Sequence
  chemically synthesized
aagcaatttccttctattcc

SEQ ID NO: 332299 - DNA, 20 bp, Artificial Sequence
  chemically synthesized
ctcaacaaactaggaataga

SEQ ID NO: 332300 - DNA, 20 bp, Artificial Sequence
  chemically synthesized
tatatatggcttttacattg

SEQ ID NO: 332301 - DNA, 20 bp, Artificial Sequence
  chemically synthesized
aggaaattgcttcaatgtaa

SEQ ID NO: 332302 - DNA, 20 bp, Artificial Sequence
  chemically synthesized
acctgcgatctttttatata

SEQ ID NO: 332303 - DNA, 20 bp, Artificial Sequence
  chemically synthesized
atgtaaaagccatatataaa

SEQ ID NO: 332304 - DNA, 20 bp, Artificial Sequence
  chemically synthesized
agccatatataaaaagatcg

SEQ ID NO: 332305 - DNA, 20 bp, Artificial Sequence
  chemically synthesized
gccatatataaaaagatcgc

SEQ ID NO: 332306 - DNA, 20 bp, Artificial Sequence
  chemically synthesized
tagaaaatcctttcagttcg

SEQ ID NO: 332307 - DNA, 20 bp, Artificial Sequence
  chemically synthesized
tcacaacaactgcgaactga

SEQ ID NO: 332308 - DNA, 20 bp, Artificial Sequence
  chemically synthesized
cacaacaactgcgaactgaa

SEQ ID NO: 332309 - DNA, 20 bp, Artificial Sequence
  chemically synthesized
gatttcatagaaaatccttt

SEQ ID NO: 332310 - DNA, 20 bp, Artificial Sequence
  chemically synthesized
gaaaggattttctatgaaat

SEQ ID NO: 332311 - DNA, 20 bp, Artificial Sequence
  chemically synthesized
aaaggattttctatgaaatc

SEQ ID NO: 332312 - DNA, 20 bp, Artificial Sequence
  chemically synthesized
tcctcctgttcctgatttca

SEQ ID NO: 332313 - DNA, 20 bp, Artificial Sequence
  chemically synthesized
attttctatgaaatcaggaa

SEQ ID NO: 332314 - DNA, 20 bp, Artificial Sequence
  chemically synthesized
ttttctatgaaatcaggaac

SEQ ID NO: 332315 - DNA, 20 bp, Artificial Sequence
  chemically synthesized
ttctatgaaatcaggaacag

SEQ ID NO: 332316 - DNA, 20 bp, Artificial Sequence
  chemically synthesized
tctatgaaatcaggaacagg

SEQ ID NO: 332317 - DNA, 20 bp, Artificial Sequence
  chemically synthesized
aaatcaggaacaggaggaac

SEQ ID NO: 332318 - DNA, 20 bp, Artificial Sequence
  chemically synthesized
aatcaggaacaggaggaaca

SEQ ID NO: 332319 - DNA, 20 bp, Artificial Sequence
  chemically synthesized
aggaacaggaggaacaaggt

SEQ ID NO: 332320 - DNA, 20 bp, Artificial Sequence
  chemically synthesized
tcggtagaagtggcaagaat

SEQ ID NO: 332321 - DNA, 20 bp, Artificial Sequence
  chemically synthesized
atcggtagaagtggcaagaa

SEQ ID NO: 332322 - DNA, 20 bp, Artificial Sequence
  chemically synthesized
ttgccatcggtagaagtggc

SEQ ID NO: 332323 - DNA, 20 bp, Artificial Sequence
  chemically synthesized
agtattgccatcggtagaag

SEQ ID NO: 332324 - DNA, 20 bp, Artificial Sequence
  chemically synthesized
attcttgccacttctaccga

SEQ ID NO: 332325 - DNA, 20 bp, Artificial Sequence
  chemically synthesized
tccagtattgccatcggtag

SEQ ID NO: 332326 - DNA, 20 bp, Artificial Sequence
  chemically synthesized
acttccagtattgccatcgg

SEQ ID NO: 332327 - DNA, 20 bp, Artificial Sequence
  chemically synthesized
aggacttccagtattgccat

SEQ ID NO: 332328 - DNA, 20 bp, Artificial Sequence
  chemically synthesized
acttctaccgatggcaatac

SEQ ID NO: 332329 - DNA, 20 bp, Artificial Sequence
  chemically synthesized
tctaccgatggcaatactgg

SEQ ID NO: 332330 - DNA, 20 bp, Artificial Sequence
  chemically synthesized
attattctagcaaggacttc

SEQ ID NO: 332331 - DNA, 20 bp, Artificial Sequence
  chemically synthesized
gcaatactggaagtccttgc

SEQ ID NO: 332332 - DNA, 20 bp, Artificial Sequence
  chemically synthesized
tttgcctaattattctagca

SEQ ID NO: 332333 - DNA, 20 bp, Artificial Sequence
  chemically synthesized
ttttgcctaattattctagc

SEQ ID NO: 332334 - DNA, 20 bp, Artificial Sequence
  chemically synthesized
gaagtccttgctagaataat

SEQ ID NO: 332335 - DNA, 20 bp, Artificial Sequence
  chemically synthesized
ttttttttgcctaattattc

SEQ ID NO: 332336 - DNA, 20 bp, Artificial Sequence
  chemically synthesized
aagtccttgctagaataatt

SEQ ID NO: 332337 - DNA, 20 bp, Artificial Sequence
  chemically synthesized
ataattaggcaaaaaaaaaa

SEQ ID NO: 332338 - DNA, 20 bp, Artificial Sequence
  chemically synthesized
taggcaaaaaaaaaaaagta

SEQ ID NO: 332339 - DNA, 20 bp, Artificial Sequence
  chemically synthesized
aggcaaaaaaaaaaaagtaa

SEQ ID NO: 332340 - DNA, 20 bp, Artificial Sequence
  chemically synthesized
aaaagtaaaggtatataaat

SEQ ID NO: 332341 - DNA, 20 bp, Artificial Sequence
  chemically synthesized
aggtatataaatcagaaatg

SEQ ID NO: 332342 - DNA, 20 bp, Artificial Sequence
  chemically synthesized
aagaatgttattcctatttg

SEQ ID NO: 332343 - DNA, 20 bp, Artificial Sequence
  chemically synthesized
agattatgtcatctgcaaat

SEQ ID NO: 332344 - DNA, 20 bp, Artificial Sequence
  chemically synthesized
aagattatgtcatctgcaaa

SEQ ID NO: 332345 - DNA, 20 bp, Artificial Sequence
  chemically synthesized
agatgacataatcttatgaa

SEQ ID NO: 332346 - DNA, 20 bp, Artificial Sequence
  chemically synthesized
ttctagggttttctattcat

SEQ ID NO: 332347 - DNA, 20 bp, Artificial Sequence
  chemically synthesized
atcttatgaatagaaaaccc

SEQ ID NO: 332348 - DNA, 20 bp, Artificial Sequence
  chemically synthesized
agtgtttttaatggattcta

SEQ ID NO: 332349 - DNA, 20 bp, Artificial Sequence
  chemically synthesized
tagtgtttttaatggattct

SEQ ID NO: 332350 - DNA, 20 bp, Artificial Sequence
  chemically synthesized
ctagtgtttttaatggattc

SEQ ID NO: 332351 - DNA, 20 bp, Artificial Sequence
  chemically synthesized
attggttctagtgtttttaa

SEQ ID NO: 332352 - DNA, 20 bp, Artificial Sequence
  chemically synthesized
ctagaatccattaaaaacac

SEQ ID NO: 332353 - DNA, 20 bp, Artificial Sequence
  chemically synthesized
actgatttttaaattggttc

SEQ ID NO: 332354 - DNA, 20 bp, Artificial Sequence
  chemically synthesized
aactttactgatttttaaat

SEQ ID NO: 332355 - DNA, 20 bp, Artificial Sequence
  chemically synthesized
actagaaccaatttaaaaat

SEQ ID NO: 332356 - DNA, 20 bp, Artificial Sequence
  chemically synthesized
aaccaatttaaaaatcagta

SEQ ID NO: 332357 - DNA, 20 bp, Artificial Sequence
  chemically synthesized
tttaaaaatcagtaaagttg

SEQ ID NO: 332358 - DNA, 20 bp, Artificial Sequence
  chemically synthesized
ttaaaaatcagtaaagttgt

SEQ ID NO: 332359 - DNA, 20 bp, Artificial Sequence
  chemically synthesized
caaaatcatcatacaaaaat

SEQ ID NO: 332360 - DNA, 20 bp, Artificial Sequence
  chemically synthesized
tcatcatacaaaaattagtt

SEQ ID NO: 332361 - DNA, 20 bp, Artificial Sequence
  chemically synthesized
acaaaaattagttgagtttc

SEQ ID NO: 332362 - DNA, 20 bp, Artificial Sequence
  chemically synthesized
caaaaattagttgagtttct

SEQ ID NO: 332363 - DNA, 20 bp, Artificial Sequence
  chemically synthesized
aaaattagttgagtttctag

SEQ ID NO: 332364 - DNA, 20 bp, Artificial Sequence
  chemically synthesized
tgtgaatggaatttgtctcc

SEQ ID NO: 332365 - DNA, 20 bp, Artificial Sequence
  chemically synthesized
aggagacaaattccattcac

SEQ ID NO: 332366 - DNA, 20 bp, Artificial Sequence
  chemically synthesized
gagacaaattccattcacaa

SEQ ID NO: 332367 - DNA, 20 bp, Artificial Sequence
  chemically synthesized
ctttttggtgctcttgtgaa

SEQ ID NO: 332368 - DNA, 20 bp, Artificial Sequence
  chemically synthesized
ccattcacaagagcaccaaa

SEQ ID NO: 332369 - DNA, 20 bp, Artificial Sequence
  chemically synthesized
gtttattactgttttctttt

SEQ ID NO: 332370 - DNA, 20 bp, Artificial Sequence
  chemically synthesized
caagagcaccaaaaagaaaa

SEQ ID NO: 332371 - DNA, 20 bp, Artificial Sequence
  chemically synthesized
aagaaaacagtaataaacta

SEQ ID NO: 332372 - DNA, 20 bp, Artificial Sequence
  chemically synthesized
gaaaacagtaataaactaaa

SEQ ID NO: 332373 - DNA, 20 bp, Artificial Sequence
  chemically synthesized
aaaacagtaataaactaaag

SEQ ID NO: 332374 - DNA, 20 bp, Artificial Sequence
  chemically synthesized
tacatactctttgacctctt

SEQ ID NO: 332375 - DNA, 20 bp, Artificial Sequence
  chemically synthesized
gtaataaactaaagaggtca

SEQ ID NO: 332376 - DNA, 20 bp, Artificial Sequence
  chemically synthesized
aataaactaaagaggtcaaa

SEQ ID NO: 332377 - DNA, 20 bp, Artificial Sequence
  chemically synthesized
catcaatgttttatagtttt

SEQ ID NO: 332378 - DNA, 20 bp, Artificial Sequence
  chemically synthesized
tttctttcatcaatgtttta

SEQ ID NO: 332379 - DNA, 20 bp, Artificial Sequence
  chemically synthesized
aaactataaaacattgatga

SEQ ID NO: 332380 - DNA, 20 bp, Artificial Sequence
  chemically synthesized
aacattgatgaaagaaatta

SEQ ID NO: 332381 - DNA, 20 bp, Artificial Sequence
  chemically synthesized
ttaaagatgacaaaatcaaa

SEQ ID NO: 332382 - DNA, 20 bp, Artificial Sequence
  chemically synthesized
agatgacaaaatcaaatgga

SEQ ID NO: 332383 - DNA, 20 bp, Artificial Sequence
  chemically synthesized
ggaaagacatcctacattca

SEQ ID NO: 332384 - DNA, 20 bp, Artificial Sequence
  chemically synthesized
gtccttcgatccatgaatgt

SEQ ID NO: 332385 - DNA, 20 bp, Artificial Sequence
  chemically synthesized
agtccttcgatccatgaatg

SEQ ID NO: 332386 - DNA, 20 bp, Artificial Sequence
  chemically synthesized
catcctacattcatggatcg

SEQ ID NO: 332387 - DNA, 20 bp, Artificial Sequence
  chemically synthesized
atcctacattcatggatcga

SEQ ID NO: 332388 - DNA, 20 bp, Artificial Sequence
  chemically synthesized
ttgaatgtaatgacaatttt

SEQ ID NO: 332389 - DNA, 20 bp, Artificial Sequence
  chemically synthesized
taaaattgtcattacattca

SEQ ID NO: 332390 - DNA, 20 bp, Artificial Sequence
  chemically synthesized
attacattcaaagaaatcta

SEQ ID NO: 332391 - DNA, 20 bp, Artificial Sequence
  chemically synthesized
taaagattatattagttctg

SEQ ID NO: 332392 - DNA, 20 bp, Artificial Sequence
  chemically synthesized
aattttgataaagattatat

SEQ ID NO: 332393 - DNA, 20 bp, Artificial Sequence
  chemically synthesized
atgccattggaattttgata

SEQ ID NO: 332394 - DNA, 20 bp, Artificial Sequence
  chemically synthesized
aatctttatcaaaattccaa

SEQ ID NO: 332395 - DNA, 20 bp, Artificial Sequence
  chemically synthesized
gtttctgtgaaaaatgccat

SEQ ID NO: 332396 - DNA, 20 bp, Artificial Sequence
  chemically synthesized
aattccaatggcatttttca

SEQ ID NO: 332397 - DNA, 20 bp, Artificial Sequence
  chemically synthesized
aatggcatttttcacagaaa

SEQ ID NO: 332398 - DNA, 20 bp, Artificial Sequence
  chemically synthesized
tggcatttttcacagaaaca

SEQ ID NO: 332399 - DNA, 20 bp, Artificial Sequence
  chemically synthesized
gtggttccatatgaatttca

SEQ ID NO: 332400 - DNA, 20 bp, Artificial Sequence
  chemically synthesized
ttgtggttccatatgaattt

SEQ ID NO: 332401 - DNA, 20 bp, Artificial Sequence
  chemically synthesized
gaaaaactctgaaattcata

SEQ ID NO: 332402 - DNA, 20 bp, Artificial Sequence
  chemically synthesized
gaaattcatatggaaccaca

SEQ ID NO: 332403 - DNA, 20 bp, Artificial Sequence
  chemically synthesized
tagccatttgggattctttg

SEQ ID NO: 332404 - DNA, 20 bp, Artificial Sequence
  chemically synthesized
gaaccacaaagaatcccaaa

SEQ ID NO: 332405 - DNA, 20 bp, Artificial Sequence
  chemically synthesized
caaggttgatttagccattt

SEQ ID NO: 332406 - DNA, 20 bp, Artificial Sequence
  chemically synthesized
tcaaggttgatttagccatt

SEQ ID NO: 332407 - DNA, 20 bp, Artificial Sequence
  chemically synthesized
cttctttctcaaggttgatt

SEQ ID NO: 332408 - DNA, 20 bp, Artificial Sequence
  chemically synthesized
caaatggctaaatcaacctt

SEQ ID NO: 332409 - DNA, 20 bp, Artificial Sequence
  chemically synthesized
tggctaaatcaaccttgaga

SEQ ID NO: 332410 - DNA, 20 bp, Artificial Sequence
  chemically synthesized
aattttgtacttctttctca

SEQ ID NO: 332411 - DNA, 20 bp, Artificial Sequence
  chemically synthesized
ctaaatcaaccttgagaaag

SEQ ID NO: 332412 - DNA, 20 bp, Artificial Sequence
  chemically synthesized
caattttgtacttctttctc

SEQ ID NO: 332413 - DNA, 20 bp, Artificial Sequence
  chemically synthesized
ttgagaaagaagtacaaaat

SEQ ID NO: 332414 - DNA, 20 bp, Artificial Sequence
  chemically synthesized
gagaaagaagtacaaaattg

SEQ ID NO: 332415 - DNA, 20 bp, Artificial Sequence
  chemically synthesized
agaaagaagtacaaaattgg

SEQ ID NO: 332416 - DNA, 20 bp, Artificial Sequence
  chemically synthesized
taatatattttgaaatcagg

SEQ ID NO: 332417 - DNA, 20 bp, Artificial Sequence
  chemically synthesized
tagtaatatattttgaaatc

SEQ ID NO: 332418 - DNA, 20 bp, Artificial Sequence
  chemically synthesized
ttagtaatatattttgaaat

SEQ ID NO: 332419 - DNA, 20 bp, Artificial Sequence
  chemically synthesized
caaaatatattactaaacta

SEQ ID NO: 332420 - DNA, 20 bp, Artificial Sequence
  chemically synthesized
tatttttaattactgtagtt

SEQ ID NO: 332421 - DNA, 20 bp, Artificial Sequence
  chemically synthesized
caatttatttttaattactg

SEQ ID NO: 332422 - DNA, 20 bp, Artificial Sequence
  chemically synthesized
aaataaattgtattgtcatg

SEQ ID NO: 332423 - DNA, 20 bp, Artificial Sequence
  chemically synthesized
aaattgtattgtcatgaaga

SEQ ID NO: 332424 - DNA, 20 bp, Artificial Sequence
  chemically synthesized
ttgtcatgaagacagacata

SEQ ID NO: 332425 - DNA, 20 bp, Artificial Sequence
  chemically synthesized
aagacagacatatagaccaa

SEQ ID NO: 332426 - DNA, 20 bp, Artificial Sequence
  chemically synthesized
agacatatagaccaatagaa

SEQ ID NO: 332427 - DNA, 20 bp, Artificial Sequence
  chemically synthesized
tgggctctattctgttctat

SEQ ID NO: 332428 - DNA, 20 bp, Artificial Sequence
  chemically synthesized
tatagaccaatagaacagaa

SEQ ID NO: 332429 - DNA, 20 bp, Artificial Sequence
  chemically synthesized
tagaccaatagaacagaata

SEQ ID NO: 332430 - DNA, 20 bp, Artificial Sequence
  chemically synthesized
caatagaacagaatagagcc

SEQ ID NO: 332431 - DNA, 20 bp, Artificial Sequence
  chemically synthesized
atatgtgtagatttatatct

SEQ ID NO: 332432 - DNA, 20 bp, Artificial Sequence
  chemically synthesized
tatatgtgtagatttatatc

SEQ ID NO: 332433 - DNA, 20 bp, Artificial Sequence
  chemically synthesized
cagatataaatctacacata

SEQ ID NO: 332434 - DNA, 20 bp, Artificial Sequence
  chemically synthesized
agatataaatctacacatat

SEQ ID NO: 332435 - DNA, 20 bp, Artificial Sequence
  chemically synthesized
atcagttaaccctatatgtg

SEQ ID NO: 332436 - DNA, 20 bp, Artificial Sequence
  chemically synthesized
gatataaatctacacatata

SEQ ID NO: 332437 - DNA, 20 bp, Artificial Sequence
  chemically synthesized
ttggctctatcgtggaacat

SEQ ID NO: 332438 - DNA, 20 bp, Artificial Sequence
  chemically synthesized
ggttaactgatgttccacga

SEQ ID NO: 332439 - DNA, 20 bp, Artificial Sequence
  chemically synthesized
ttaactgatgttccacgata

SEQ ID NO: 332440 - DNA, 20 bp, Artificial Sequence
  chemically synthesized
gtgtatgcttggctctatcg

SEQ ID NO: 332441 - DNA, 20 bp, Artificial Sequence
  chemically synthesized
tgatgttccacgatagagcc

SEQ ID NO: 332442 - DNA, 20 bp, Artificial Sequence
  chemically synthesized
ctttcctccttgtgtatgct

SEQ ID NO: 332443 - DNA, 20 bp, Artificial Sequence
  chemically synthesized
cgatagagccaagcatacac

SEQ ID NO: 332444 - DNA, 20 bp, Artificial Sequence
  chemically synthesized
gatagagccaagcatacaca

SEQ ID NO: 332445 - DNA, 20 bp, Artificial Sequence
  chemically synthesized
tagagccaagcatacacaag

SEQ ID NO: 332446 - DNA, 20 bp, Artificial Sequence
  chemically synthesized
agagccaagcatacacaagg

SEQ ID NO: 332447 - DNA, 20 bp, Artificial Sequence
  chemically synthesized
ccaagcatacacaaggagga

SEQ ID NO: 332448 - DNA, 20 bp, Artificial Sequence
  chemically synthesized
caagcatacacaaggaggaa

SEQ ID NO: 332449 - DNA, 20 bp, Artificial Sequence
  chemically synthesized
ttccaacaccatttgttgaa

SEQ ID NO: 332450 - DNA, 20 bp, Artificial Sequence
  chemically synthesized
aggataatctcttcaacaaa

SEQ ID NO: 332451 - DNA, 20 bp, Artificial Sequence
  chemically synthesized
ttttccaacaccatttgttg

SEQ ID NO: 332452 - DNA, 20 bp, Artificial Sequence
  chemically synthesized
atctcttcaacaaatggtgt

SEQ ID NO: 332453 - DNA, 20 bp, Artificial Sequence
  chemically synthesized
acaaatggtgttggaaaaac

SEQ ID NO: 332454 - DNA, 20 bp, Artificial Sequence
  chemically synthesized
ttattttgcacgtggatatc

SEQ ID NO: 332455 - DNA, 20 bp, Artificial Sequence
  chemically synthesized
caatttcattattttgcacg

SEQ ID NO: 332456 - DNA, 20 bp, Artificial Sequence
  chemically synthesized
cacgtgcaaaataatgaaat

SEQ ID NO: 332457 - DNA, 20 bp, Artificial Sequence
  chemically synthesized
atttgcatatggcataagat

SEQ ID NO: 332458 - DNA, 20 bp, Artificial Sequence
  chemically synthesized
ttgatatttgcatatggcat

SEQ ID NO: 332459 - DNA, 20 bp, Artificial Sequence
  chemically synthesized
ttggagttgatatttgcata

SEQ ID NO: 332460 - DNA, 20 bp, Artificial Sequence
  chemically synthesized
atgcaaatatcaactccaaa

SEQ ID NO: 332461 - DNA, 20 bp, Artificial Sequence
  chemically synthesized
ttacatattttatccgtttg

SEQ ID NO: 332462 - DNA, 20 bp, Artificial Sequence
  chemically synthesized
atttacatattttatccgtt

SEQ ID NO: 332463 - DNA, 20 bp, Artificial Sequence
  chemically synthesized
tctaggagttttatggattg

SEQ ID NO: 332464 - DNA, 20 bp, Artificial Sequence
  chemically synthesized
ttctaggagttttatggatt

SEQ ID NO: 332465 - DNA, 20 bp, Artificial Sequence
  chemically synthesized
gttttcttctaggagtttta

SEQ ID NO: 332466 - DNA, 20 bp, Artificial Sequence
  chemically synthesized
acctcaatccataaaactcc

SEQ ID NO: 332467 - DNA, 20 bp, Artificial Sequence
  chemically synthesized
tcaatccataaaactcctag

SEQ ID NO: 332468 - DNA, 20 bp, Artificial Sequence
  chemically synthesized
tttccaatgttttcttctag

SEQ ID NO: 332469 - DNA, 20 bp, Artificial Sequence
  chemically synthesized
tttttccaatgttttcttct

SEQ ID NO: 332470 - DNA, 20 bp, Artificial Sequence
  chemically synthesized
atttttccaatgttttcttc

SEQ ID NO: 332471 - DNA, 20 bp, Artificial Sequence
  chemically synthesized
aaactcctagaagaaaacat

SEQ ID NO: 332472 - DNA, 20 bp, Artificial Sequence
  chemically synthesized
attgcgaggatgaatgtcac

SEQ ID NO: 332473 - DNA, 20 bp, Artificial Sequence
  chemically synthesized
tgcttttggaaataattgcg

SEQ ID NO: 332474 - DNA, 20 bp, Artificial Sequence
  chemically synthesized
gtgcttttggaaataattgc

SEQ ID NO: 332475 - DNA, 20 bp, Artificial Sequence
  chemically synthesized
atcctcgcaattatttccaa

SEQ ID NO: 332476 - DNA, 20 bp, Artificial Sequence
  chemically synthesized
gcaattatttccaaaagcac

SEQ ID NO: 332477 - DNA, 20 bp, Artificial Sequence
  chemically synthesized
gcttttattgcttgtgcttt

SEQ ID NO: 332478 - DNA, 20 bp, Artificial Sequence
  chemically synthesized
tccaaaagcacaagcaataa

SEQ ID NO: 332479 - DNA, 20 bp, Artificial Sequence
  chemically synthesized
agcaataaaagcaaaaaaaa

SEQ ID NO: 332480 - DNA, 20 bp, Artificial Sequence
  chemically synthesized
aaagcaaaaaaaatagaatt

SEQ ID NO: 332481 - DNA, 20 bp, Artificial Sequence
  chemically synthesized
agaagatttttagttttatg

SEQ ID NO: 332482 - DNA, 20 bp, Artificial Sequence
  chemically synthesized
ttttctaaacagaagatttt

SEQ ID NO: 332483 - DNA, 20 bp, Artificial Sequence
  chemically synthesized
aaaactaaaaatcttctgtt

SEQ ID NO: 332484 - DNA, 20 bp, Artificial Sequence
  chemically synthesized
ttgttcccttttctaaacag

SEQ ID NO: 332485 - DNA, 20 bp, Artificial Sequence
  chemically synthesized
taaaaatcttctgtttagaa

SEQ ID NO: 332486 - DNA, 20 bp, Artificial Sequence
  chemically synthesized
gatttgttcccttttctaaa

SEQ ID NO: 332487 - DNA, 20 bp, Artificial Sequence
  chemically synthesized
aaaaatcttctgtttagaaa

SEQ ID NO: 332488 - DNA, 20 bp, Artificial Sequence
  chemically synthesized
aaaatcttctgtttagaaaa

SEQ ID NO: 332489 - DNA, 20 bp, Artificial Sequence
  chemically synthesized
gaacaaatcaacactgtgaa

SEQ ID NO: 332490 - DNA, 20 bp, Artificial Sequence
  chemically synthesized
aacaaatcaacactgtgaaa

SEQ ID NO: 332491 - DNA, 20 bp, Artificial Sequence
  chemically synthesized
ttccatagattgccttttca

SEQ ID NO: 332492 - DNA, 20 bp, Artificial Sequence
  chemically synthesized
cactgtgaaaaggcaatcta

SEQ ID NO: 332493 - DNA, 20 bp, Artificial Sequence
  chemically synthesized
tgaaaaggcaatctatggaa

SEQ ID NO: 332494 - DNA, 20 bp, Artificial Sequence
  chemically synthesized
gaaaaggcaatctatggaat

SEQ ID NO: 332495 - DNA, 20 bp, Artificial Sequence
  chemically synthesized
gtttgtattttcccattcca

SEQ ID NO: 332496 - DNA, 20 bp, Artificial Sequence
  chemically synthesized
attctcataatatatatata

SEQ ID NO: 332497 - DNA, 20 bp, Artificial Sequence
  chemically synthesized
aaaccatatatatatattat

SEQ ID NO: 332498 - DNA, 20 bp, Artificial Sequence
  chemically synthesized
tatgagaattatttctaact

SEQ ID NO: 332499 - DNA, 20 bp, Artificial Sequence
  chemically synthesized
tgagaattatttctaactca

SEQ ID NO: 332500 - DNA, 20 bp, Artificial Sequence
  chemically synthesized
ccctcctaatagctctgagt

SEQ ID NO: 332501 - DNA, 20 bp, Artificial Sequence
  chemically synthesized
ttaaccctcctaatagctct

SEQ ID NO: 332502 - DNA, 20 bp, Artificial Sequence
  chemically synthesized
tatttctaactcagagctat

SEQ ID NO: 332503 - DNA, 20 bp, Artificial Sequence
  chemically synthesized
atttctaactcagagctatt

SEQ ID NO: 332504 - DNA, 20 bp, Artificial Sequence
  chemically synthesized
ttctaactcagagctattag

SEQ ID NO: 332505 - DNA, 20 bp, Artificial Sequence
  chemically synthesized
tctaactcagagctattagg

SEQ ID NO: 332506 - DNA, 20 bp, Artificial Sequence
  chemically synthesized
ctaactcagagctattagga

SEQ ID NO: 332507 - DNA, 20 bp, Artificial Sequence
  chemically synthesized
attttatttaaccctcctaa

SEQ ID NO: 332508 - DNA, 20 bp, Artificial Sequence
  chemically synthesized
taaataaaatgaattatata

SEQ ID NO: 332509 - DNA, 20 bp, Artificial Sequence
  chemically synthesized
attatataaagaatacttca

SEQ ID NO: 332510 - DNA, 20 bp, Artificial Sequence
  chemically synthesized
ataaagaatacttcatggta

SEQ ID NO: 332511 - DNA, 20 bp, Artificial Sequence
  chemically synthesized
tagaatgtagctataccatg

SEQ ID NO: 332512 - DNA, 20 bp, Artificial Sequence
  chemically synthesized
tcatggtatagctacattct

SEQ ID NO: 332513 - DNA, 20 bp, Artificial Sequence
  chemically synthesized
ctttttgataacttagaatg

SEQ ID NO: 332514 - DNA, 20 bp, Artificial Sequence
  chemically synthesized
ttgctgtctttttgataact

SEQ ID NO: 332515 - DNA, 20 bp, Artificial Sequence
  chemically synthesized
ctacattctaagttatcaaa

SEQ ID NO: 332516 - DNA, 20 bp, Artificial Sequence
  chemically synthesized
attctaagttatcaaaaaga

SEQ ID NO: 332517 - DNA, 20 bp, Artificial Sequence
  chemically synthesized
taaaatagtaatcatgatat

SEQ ID NO: 332518 - DNA, 20 bp, Artificial Sequence
  chemically synthesized
aagccctgatgtatttaaaa

SEQ ID NO: 332519 - DNA, 20 bp, Artificial Sequence
  chemically synthesized
gattactattttaaatacat

SEQ ID NO: 332520 - DNA, 20 bp, Artificial Sequence
  chemically synthesized
attactattttaaatacatc

SEQ ID NO: 332521 - DNA, 20 bp, Artificial Sequence
  chemically synthesized
ttactattttaaatacatca

SEQ ID NO: 332522 - DNA, 20 bp, Artificial Sequence
  chemically synthesized
attttaaatacatcagggct

SEQ ID NO: 332523 - DNA, 20 bp, Artificial Sequence
  chemically synthesized
ttttaaatacatcagggctt

SEQ ID NO: 332524 - DNA, 20 bp, Artificial Sequence
  chemically synthesized
aaatacatcagggcttaggt

SEQ ID NO: 332525 - DNA, 20 bp, Artificial Sequence
  chemically synthesized
ctgatcacaaaatcttacct

SEQ ID NO: 332526 - DNA, 20 bp, Artificial Sequence
  chemically synthesized
cttaggtaagattttgtgat

SEQ ID NO: 332527 - DNA, 20 bp, Artificial Sequence
  chemically synthesized
agattttgtgatcagacctg

SEQ ID NO: 332528 - DNA, 20 bp, Artificial Sequence
  chemically synthesized
taatataatataaggtcttc

SEQ ID NO: 332529 - DNA, 20 bp, Artificial Sequence
  chemically synthesized
ttaatataatataaggtctt

SEQ ID NO: 332530 - DNA, 20 bp, Artificial Sequence
  chemically synthesized
ccagttgttaatataatata

SEQ ID NO: 332531 - DNA, 20 bp, Artificial Sequence
  chemically synthesized
accagttgttaatataatat

SEQ ID NO: 332532 - DNA, 20 bp, Artificial Sequence
  chemically synthesized
ccttatattatattaacaac

SEQ ID NO: 332533 - DNA, 20 bp, Artificial Sequence
  chemically synthesized
tatatattttagaagataac

SEQ ID NO: 332534 - DNA, 20 bp, Artificial Sequence
  chemically synthesized
gaattctttatatattttag

SEQ ID NO: 332535 - DNA, 20 bp, Artificial Sequence
  chemically synthesized
taggaattctttatatattt

SEQ ID NO: 332536 - DNA, 20 bp, Artificial Sequence
  chemically synthesized
gttatcttctaaaatatata

SEQ ID NO: 332537 - DNA, 20 bp, Artificial Sequence
  chemically synthesized
tttttttgccaatgagttgt

SEQ ID NO: 332538 - DNA, 20 bp, Artificial Sequence
  chemically synthesized
ttttttttgccaatgagttg

SEQ ID NO: 332539 - DNA, 20 bp, Artificial Sequence
  chemically synthesized
aaagaattcctacaactcat

SEQ ID NO: 332540 - DNA, 20 bp, Artificial Sequence
  chemically synthesized
gtttttttttttttgccaat

SEQ ID NO: 332541 - DNA, 20 bp, Artificial Sequence
  chemically synthesized
cccatttttaattgcgtttt

SEQ ID NO: 332542 - DNA, 20 bp, Artificial Sequence
  chemically synthesized
actaaaaacgcaattaaaaa

SEQ ID NO: 332543 - DNA, 20 bp, Artificial Sequence
  chemically synthesized
ctaaaaacgcaattaaaaat

SEQ ID NO: 332544 - DNA, 20 bp, Artificial Sequence
  chemically synthesized
acgcaattaaaaatgggcta

SEQ ID NO: 332545 - DNA, 20 bp, Artificial Sequence
  chemically synthesized
cgcaattaaaaatgggctaa

SEQ ID NO: 332546 - DNA, 20 bp, Artificial Sequence
  chemically synthesized
gaaatgtctgttcaagcctt

SEQ ID NO: 332547 - DNA, 20 bp, Artificial Sequence
  chemically synthesized
aaatgggctaaaggcttgaa

SEQ ID NO: 332548 - DNA, 20 bp, Artificial Sequence
  chemically synthesized
ctttggagaaatgtctgttc

SEQ ID NO: 332549 - DNA, 20 bp, Artificial Sequence
  chemically synthesized
cttgaacagacatttctcca

SEQ ID NO: 332550 - DNA, 20 bp, Artificial Sequence
  chemically synthesized
ccatttgggtgtcgtctttg

SEQ ID NO: 332551 - DNA, 20 bp, Artificial Sequence
  chemically synthesized
gaccatttgggtgtcgtctt

SEQ ID NO: 332552 - DNA, 20 bp, Artificial Sequence
  chemically synthesized
ctccaaagacgacacccaaa

SEQ ID NO: 332553 - DNA, 20 bp, Artificial Sequence
  chemically synthesized
catacacctgttgaccattt

SEQ ID NO: 332554 - DNA, 20 bp, Artificial Sequence
  chemically synthesized
tcatacacctgttgaccatt

SEQ ID NO: 332555 - DNA, 20 bp, Artificial Sequence
  chemically synthesized
gacgacacccaaatggtcaa

SEQ ID NO: 332556 - DNA, 20 bp, Artificial Sequence
  chemically synthesized
acgacacccaaatggtcaac

SEQ ID NO: 332557 - DNA, 20 bp, Artificial Sequence
  chemically synthesized
tgttcaacattatgaattat

SEQ ID NO: 332558 - DNA, 20 bp, Artificial Sequence
  chemically synthesized
gttcaacattatgaattatc

SEQ ID NO: 332559 - DNA, 20 bp, Artificial Sequence
  chemically synthesized
ttcaacattatgaattatca

SEQ ID NO: 332560 - DNA, 20 bp, Artificial Sequence
  chemically synthesized
atcagggaaatgtaaatgaa

SEQ ID NO: 332561 - DNA, 20 bp, Artificial Sequence
  chemically synthesized
agggaaatgtaaatgaaaag

SEQ ID NO: 332562 - DNA, 20 bp, Artificial Sequence
  chemically synthesized
atgtaaatgaaaagcagaat

SEQ ID NO: 332563 - DNA, 20 bp, Artificial Sequence
  chemically synthesized
tccaacaggtataaatgtga

SEQ ID NO: 332564 - DNA, 20 bp, Artificial Sequence
  chemically synthesized
gctatcacatttatacctgt

SEQ ID NO: 332565 - DNA, 20 bp, Artificial Sequence
  chemically synthesized
tttaatagtaggcatccaac

SEQ ID NO: 332566 - DNA, 20 bp, Artificial Sequence
  chemically synthesized
ttttaatagtaggcatccaa

SEQ ID NO: 332567 - DNA, 20 bp, Artificial Sequence
  chemically synthesized
ctaatccattttttaatagt

SEQ ID NO: 332568 - DNA, 20 bp, Artificial Sequence
  chemically synthesized
actaatccattttttaatag

SEQ ID NO: 332569 - DNA, 20 bp, Artificial Sequence
  chemically synthesized
cttactaatccattttttaa

SEQ ID NO: 332570 - DNA, 20 bp, Artificial Sequence
  chemically synthesized
ggatgcctactattaaaaaa

SEQ ID NO: 332571 - DNA, 20 bp, Artificial Sequence
  chemically synthesized
cctactattaaaaaatggat

SEQ ID NO: 332572 - DNA, 20 bp, Artificial Sequence
  chemically synthesized
ctattaaaaaatggattagt

SEQ ID NO: 332573 - DNA, 20 bp, Artificial Sequence
  chemically synthesized
tattaaaaaatggattagta

SEQ ID NO: 332574 - DNA, 20 bp, Artificial Sequence
  chemically synthesized
aaaatggattagtaaggatg

SEQ ID NO: 332575 - DNA, 20 bp, Artificial Sequence
  chemically synthesized
tagtaaggatgtggaataat

SEQ ID NO: 332576 - DNA, 20 bp, Artificial Sequence
  chemically synthesized
acttcaccaacggtgtacaa

SEQ ID NO: 332577 - DNA, 20 bp, Artificial Sequence
  chemically synthesized
ttggaactattgtacaccgt

SEQ ID NO: 332578 - DNA, 20 bp, Artificial Sequence
  chemically synthesized
actattgtacaccgttggtg

SEQ ID NO: 332579 - DNA, 20 bp, Artificial Sequence
  chemically synthesized
gccattttttacttcaccaa

SEQ ID NO: 332580 - DNA, 20 bp, Artificial Sequence
  chemically synthesized
accgttggtgaagtaaaaaa

SEQ ID NO: 332581 - DNA, 20 bp, Artificial Sequence
  chemically synthesized
tggtgaagtaaaaaatggca

SEQ ID NO: 332582 - DNA, 20 bp, Artificial Sequence
  chemically synthesized
aaaaaatggcatggctatta

SEQ ID NO: 332583 - DNA, 20 bp, Artificial Sequence
  chemically synthesized
aactatattattttccataa

SEQ ID NO: 332584 - DNA, 20 bp, Artificial Sequence
  chemically synthesized
ggctattatggaaaataata

SEQ ID NO: 332585 - DNA, 20 bp, Artificial Sequence
  chemically synthesized
ttctgtttttaatttttgag

SEQ ID NO: 332586 - DNA, 20 bp, Artificial Sequence
  chemically synthesized
agttctgtttttaatttttg

SEQ ID NO: 332587 - DNA, 20 bp, Artificial Sequence
  chemically synthesized
gagttctgtttttaattttt

SEQ ID NO: 332588 - DNA, 20 bp, Artificial Sequence
  chemically synthesized
tgctcctcaaaaattaaaaa

SEQ ID NO: 332589 - DNA, 20 bp, Artificial Sequence
  chemically synthesized
gagattgctagatcaagtgg

SEQ ID NO: 332590 - DNA, 20 bp, Artificial Sequence
  chemically synthesized
gtgagattgctagatcaagt

SEQ ID NO: 332591 - DNA, 20 bp, Artificial Sequence
  chemically synthesized
aacagaactcccacttgatc

SEQ ID NO: 332592 - DNA, 20 bp, Artificial Sequence
  chemically synthesized
agtgagattgctagatcaag

SEQ ID NO: 332593 - DNA, 20 bp, Artificial Sequence
  chemically synthesized
aaaagtgagattgctagatc

SEQ ID NO: 332594 - DNA, 20 bp, Artificial Sequence
  chemically synthesized
atatccaaaagtgagattgc

SEQ ID NO: 332595 - DNA, 20 bp, Artificial Sequence
  chemically synthesized
tgatctagcaatctcacttt

SEQ ID NO: 332596 - DNA, 20 bp, Artificial Sequence
  chemically synthesized
ttggataaatatccaaaagt

SEQ ID NO: 332597 - DNA, 20 bp, Artificial Sequence
  chemically synthesized
tcttttggataaatatccaa

SEQ ID NO: 332598 - DNA, 20 bp, Artificial Sequence
  chemically synthesized
acttttggatatttatccaa

SEQ ID NO: 332599 - DNA, 20 bp, Artificial Sequence
  chemically synthesized
gatcctgatttcaattcttt

SEQ ID NO: 332600 - DNA, 20 bp, Artificial Sequence
  chemically synthesized
ttatccaaaagaattgaaat

SEQ ID NO: 332601 - DNA, 20 bp, Artificial Sequence
  chemically synthesized
tatccaaaagaattgaaatc

SEQ ID NO: 332602 - DNA, 20 bp, Artificial Sequence
  chemically synthesized
gaattgaaatcaggatcttg

SEQ ID NO: 332603 - DNA, 20 bp, Artificial Sequence
  chemically synthesized
aattgaaatcaggatcttga

SEQ ID NO: 332604 - DNA, 20 bp, Artificial Sequence
  chemically synthesized
attgaaatcaggatcttgaa

SEQ ID NO: 332605 - DNA, 20 bp, Artificial Sequence
  chemically synthesized
ggcattgcaggtatcccttc

SEQ ID NO: 332606 - DNA, 20 bp, Artificial Sequence
  chemically synthesized
tgcaatgaacatggcattgc

SEQ ID NO: 332607 - DNA, 20 bp, Artificial Sequence
  chemically synthesized
ttgcaatgaacatggcattg

SEQ ID NO: 332608 - DNA, 20 bp, Artificial Sequence
  chemically synthesized
gaatggtgttgcaatgaaca

SEQ ID NO: 332609 - DNA, 20 bp, Artificial Sequence
  chemically synthesized
ttcattgcaacaccattcac

SEQ ID NO: 332610 - DNA, 20 bp, Artificial Sequence
  chemically synthesized
cattgcaacaccattcacaa

SEQ ID NO: 332611 - DNA, 20 bp, Artificial Sequence
  chemically synthesized
cacatcttggctcttgtgaa

SEQ ID NO: 332612 - DNA, 20 bp, Artificial Sequence
  chemically synthesized
caacaccattcacaagagcc

SEQ ID NO: 332613 - DNA, 20 bp, Artificial Sequence
  chemically synthesized
cattcacaagagccaagatg

SEQ ID NO: 332614 - DNA, 20 bp, Artificial Sequence
  chemically synthesized
ctgaggatgtttccacatct

SEQ ID NO: 332615 - DNA, 20 bp, Artificial Sequence
  chemically synthesized
ccaagatgtggaaacatcct

SEQ ID NO: 332616 - DNA, 20 bp, Artificial Sequence
  chemically synthesized
tcatccatcagtggacactg

SEQ ID NO: 332617 - DNA, 20 bp, Artificial Sequence
  chemically synthesized
ctcatccatcagtggacact

SEQ ID NO: 332618 - DNA, 20 bp, Artificial Sequence
  chemically synthesized
acatcctcagtgtccactga

SEQ ID NO: 332619 - DNA, 20 bp, Artificial Sequence
  chemically synthesized
tttatcccctcatccatcag

SEQ ID NO: 332620 - DNA, 20 bp, Artificial Sequence
  chemically synthesized
ctcagtgtccactgatggat

SEQ ID NO: 332621 - DNA, 20 bp, Artificial Sequence
  chemically synthesized
tcagtgtccactgatggatg

SEQ ID NO: 332622 - DNA, 20 bp, Artificial Sequence
  chemically synthesized
ttctttatcccctcatccat

SEQ ID NO: 332623 - DNA, 20 bp, Artificial Sequence
  chemically synthesized
cagtgtccactgatggatga

SEQ ID NO: 332624 - DNA, 20 bp, Artificial Sequence
  chemically synthesized
agtgtccactgatggatgag

SEQ ID NO: 332625 - DNA, 20 bp, Artificial Sequence
  chemically synthesized
cactgatggatgaggggata

SEQ ID NO: 332626 - DNA, 20 bp, Artificial Sequence
  chemically synthesized
atgaggggataaagaaaatg

SEQ ID NO: 332627 - DNA, 20 bp, Artificial Sequence
  chemically synthesized
aaaatgtggtatatacatac

SEQ ID NO: 332628 - DNA, 20 bp, Artificial Sequence
  chemically synthesized
aatgtggtatatacatacaa

SEQ ID NO: 332629 - DNA, 20 bp, Artificial Sequence
  chemically synthesized
tctttctttttgaatattaa

SEQ ID NO: 332630 - DNA, 20 bp, Artificial Sequence
  chemically synthesized
gattactattaatattcaaa

SEQ ID NO: 332631 - DNA, 20 bp, Artificial Sequence
  chemically synthesized
actattaatattcaaaaaga

SEQ ID NO: 332632 - DNA, 20 bp, Artificial Sequence
  chemically synthesized
tattaatattcaaaaagaaa

SEQ ID NO: 332633 - DNA, 20 bp, Artificial Sequence
  chemically synthesized
atccatgttgttaatgtggc

SEQ ID NO: 332634 - DNA, 20 bp, Artificial Sequence
  chemically synthesized
catccatgttgttaatgtgg

SEQ ID NO: 332635 - DNA, 20 bp, Artificial Sequence
  chemically synthesized
gttcatccatgttgttaatg

SEQ ID NO: 332636 - DNA, 20 bp, Artificial Sequence
  chemically synthesized
atcctgccacattaacaaca

SEQ ID NO: 332637 - DNA, 20 bp, Artificial Sequence
  chemically synthesized
taacaacatggatgaaccct

SEQ ID NO: 332638 - DNA, 20 bp, Artificial Sequence
  chemically synthesized
aacaacatggatgaacccta

SEQ ID NO: 332639 - DNA, 20 bp, Artificial Sequence
  chemically synthesized
cacttcccataatgtcctta

SEQ ID NO: 332640 - DNA, 20 bp, Artificial Sequence
  chemically synthesized
tcacttcccataatgtcctt

SEQ ID NO: 332641 - DNA, 20 bp, Artificial Sequence
  chemically synthesized
ttcacttcccataatgtcct

SEQ ID NO: 332642 - DNA, 20 bp, Artificial Sequence
  chemically synthesized
gatgaaccctaaggacatta

SEQ ID NO: 332643 - DNA, 20 bp, Artificial Sequence
  chemically synthesized
atgaaccctaaggacattat

SEQ ID NO: 332644 - DNA, 20 bp, Artificial Sequence
  chemically synthesized
aaccctaaggacattatggg

SEQ ID NO: 332645 - DNA, 20 bp, Artificial Sequence
  chemically synthesized
gacattatgggaagtgaaat

SEQ ID NO: 332646 - DNA, 20 bp, Artificial Sequence
  chemically synthesized
ttatgggaagtgaaataaga

SEQ ID NO: 332647 - DNA, 20 bp, Artificial Sequence
  chemically synthesized
gtgaaataagacagtcacat

SEQ ID NO: 332648 - DNA, 20 bp, Artificial Sequence
  chemically synthesized
tgaaataagacagtcacata

SEQ ID NO: 332649 - DNA, 20 bp, Artificial Sequence
  chemically synthesized
ctcttataagtagaatcatg

SEQ ID NO: 332650 - DNA, 20 bp, Artificial Sequence
  chemically synthesized
acctcttataagtagaatca

SEQ ID NO: 332651 - DNA, 20 bp, Artificial Sequence
  chemically synthesized
cactccatgattctacttat

SEQ ID NO: 332652 - DNA, 20 bp, Artificial Sequence
  chemically synthesized
ctccatgattctacttataa

SEQ ID NO: 332653 - DNA, 20 bp, Artificial Sequence
  chemically synthesized
ttttacatacctcttataag

SEQ ID NO: 332654 - DNA, 20 bp, Artificial Sequence
  chemically synthesized
tccatgattctacttataag

SEQ ID NO: 332655 - DNA, 20 bp, Artificial Sequence
  chemically synthesized
gtattttacatacctcttat

SEQ ID NO: 332656 - DNA, 20 bp, Artificial Sequence
  chemically synthesized
aagaggtatgtaaaatactc

SEQ ID NO: 332657 - DNA, 20 bp, Artificial Sequence
  chemically synthesized
ctctctgatttgatcagctt

SEQ ID NO: 332658 - DNA, 20 bp, Artificial Sequence
  chemically synthesized
aatactcaagctgatcaaat

SEQ ID NO: 332659 - DNA, 20 bp, Artificial Sequence
  chemically synthesized
atttcactctctgatttgat

SEQ ID NO: 332660 - DNA, 20 bp, Artificial Sequence
  chemically synthesized
tactcaagctgatcaaatca

SEQ ID NO: 332661 - DNA, 20 bp, Artificial Sequence
  chemically synthesized
ctcaagctgatcaaatcaga

SEQ ID NO: 332662 - DNA, 20 bp, Artificial Sequence
  chemically synthesized
gatcaaatcagagagtgaaa

SEQ ID NO: 332663 - DNA, 20 bp, Artificial Sequence
  chemically synthesized
caaatcagagagtgaaatag

SEQ ID NO: 332664 - DNA, 20 bp, Artificial Sequence
  chemically synthesized
gagagtgaaatagtagttgc

SEQ ID NO: 332665 - DNA, 20 bp, Artificial Sequence
  chemically synthesized
gagtgaaatagtagttgcta

SEQ ID NO: 332666 - DNA, 20 bp, Artificial Sequence
  chemically synthesized
agtgaaatagtagttgctag

SEQ ID NO: 332667 - DNA, 20 bp, Artificial Sequence
  chemically synthesized
atagtagttgctagaggctg

SEQ ID NO: 332668 - DNA, 20 bp, Artificial Sequence
  chemically synthesized
ttcctcctctccacagcctc

SEQ ID NO: 332669 - DNA, 20 bp, Artificial Sequence
  chemically synthesized
agtagttgctagaggctgtg

SEQ ID NO: 332670 - DNA, 20 bp, Artificial Sequence
  chemically synthesized
tagttgctagaggctgtgga

SEQ ID NO: 332671 - DNA, 20 bp, Artificial Sequence
  chemically synthesized
agttgctagaggctgtggag

SEQ ID NO: 332672 - DNA, 20 bp, Artificial Sequence
  chemically synthesized
ttgctagaggctgtggagag

SEQ ID NO: 332673 - DNA, 20 bp, Artificial Sequence
  chemically synthesized
ttcccacttcctcctctcca

SEQ ID NO: 332674 - DNA, 20 bp, Artificial Sequence
  chemically synthesized
tgctagaggctgtggagagg

SEQ ID NO: 332675 - DNA, 20 bp, Artificial Sequence
  chemically synthesized
tagaggctgtggagaggagg

SEQ ID NO: 332676 - DNA, 20 bp, Artificial Sequence
  chemically synthesized
aggctgtggagaggaggaag

SEQ ID NO: 332677 - DNA, 20 bp, Artificial Sequence
  chemically synthesized
ggctgtggagaggaggaagt

SEQ ID NO: 332678 - DNA, 20 bp, Artificial Sequence
  chemically synthesized
tgtggagaggaggaagtggg

SEQ ID NO: 332679 - DNA, 20 bp, Artificial Sequence
  chemically synthesized
gctgaaccttcgttaattag

SEQ ID NO: 332680 - DNA, 20 bp, Artificial Sequence
  chemically synthesized
tgggaagctgctaattaacg

SEQ ID NO: 332681 - DNA, 20 bp, Artificial Sequence
  chemically synthesized
atagctgaaccttcgttaat

SEQ ID NO: 332682 - DNA, 20 bp, Artificial Sequence
  chemically synthesized
gggaagctgctaattaacga

SEQ ID NO: 332683 - DNA, 20 bp, Artificial Sequence
  chemically synthesized
gctgctaattaacgaaggtt

SEQ ID NO: 332684 - DNA, 20 bp, Artificial Sequence
  chemically synthesized
taacgaaggttcagctatga

SEQ ID NO: 332685 - DNA, 20 bp, Artificial Sequence
  chemically synthesized
gagaattttctcatctttca

SEQ ID NO: 332686 - DNA, 20 bp, Artificial Sequence
  chemically synthesized
aaggttcagctatgaaagat

SEQ ID NO: 332687 - DNA, 20 bp, Artificial Sequence
  chemically synthesized
tgaaagatgagaaaattctc

SEQ ID NO: 332688 - DNA, 20 bp, Artificial Sequence
  chemically synthesized
caagttgtacaacagatctt

SEQ ID NO: 332689 - DNA, 20 bp, Artificial Sequence
  chemically synthesized
tataggtacaagttgtacaa

SEQ ID NO: 332690 - DNA, 20 bp, Artificial Sequence
  chemically synthesized
gcattgttcagtataggtac

SEQ ID NO: 332691 - DNA, 20 bp, Artificial Sequence
  chemically synthesized
aatacagcattgttcagtat

SEQ ID NO: 332692 - DNA, 20 bp, Artificial Sequence
  chemically synthesized
aaatacagcattgttcagta

SEQ ID NO: 332693 - DNA, 20 bp, Artificial Sequence
  chemically synthesized
gtgtaaaatacagcattgtt

SEQ ID NO: 332694 - DNA, 20 bp, Artificial Sequence
  chemically synthesized
tgatttttaagtgtaaaata

SEQ ID NO: 332695 - DNA, 20 bp, Artificial Sequence
  chemically synthesized
tgtattttacacttaaaaat

SEQ ID NO: 332696 - DNA, 20 bp, Artificial Sequence
  chemically synthesized
caccctcttaactgattttt

SEQ ID NO: 332697 - DNA, 20 bp, Artificial Sequence
  chemically synthesized
tttacacttaaaaatcagtt

SEQ ID NO: 332698 - DNA, 20 bp, Artificial Sequence
  chemically synthesized
tacacttaaaaatcagttaa

SEQ ID NO: 332699 - DNA, 20 bp, Artificial Sequence
  chemically synthesized
acacttaaaaatcagttaag

SEQ ID NO: 332700 - DNA, 20 bp, Artificial Sequence
  chemically synthesized
cacttaaaaatcagttaaga

SEQ ID NO: 332701 - DNA, 20 bp, Artificial Sequence
  chemically synthesized
aagagggtgaatcccatgtt

SEQ ID NO: 332702 - DNA, 20 bp, Artificial Sequence
  chemically synthesized
tgtgtaagaacacttaacat

SEQ ID NO: 332703 - DNA, 20 bp, Artificial Sequence
  chemically synthesized
gtgtgtaagaacacttaaca

SEQ ID NO: 332704 - DNA, 20 bp, Artificial Sequence
  chemically synthesized
aaatttactttattgtgtgt

SEQ ID NO: 332705 - DNA, 20 bp, Artificial Sequence
  chemically synthesized
aagtgttcttacacacaata

SEQ ID NO: 332706 - DNA, 20 bp, Artificial Sequence
  chemically synthesized
cacaataaagtaaatttcaa

SEQ ID NO: 332707 - DNA, 20 bp, Artificial Sequence
  chemically synthesized
aataaagtaaatttcaaaag

SEQ ID NO: 332708 - DNA, 20 bp, Artificial Sequence
  chemically synthesized
ttcaaaagaagttaaacgat

SEQ ID NO: 332709 - DNA, 20 bp, Artificial Sequence
  chemically synthesized
caaaagaagttaaacgataa

SEQ ID NO: 332710 - DNA, 20 bp, Artificial Sequence
  chemically synthesized
tgtgatgatgttattttcaa

SEQ ID NO: 332711 - DNA, 20 bp, Artificial Sequence
  chemically synthesized
tcatcacatatattcacttc

SEQ ID NO: 332712 - DNA, 20 bp, Artificial Sequence
  chemically synthesized
catcacatatattcacttca

SEQ ID NO: 332713 - DNA, 20 bp, Artificial Sequence
  chemically synthesized
taaaactggaaggaaccttg

SEQ ID NO: 332714 - DNA, 20 bp, Artificial Sequence
  chemically synthesized
attcacttcaaggttccttc

SEQ ID NO: 332715 - DNA, 20 bp, Artificial Sequence
  chemically synthesized
agtagaattttaaaactgga

SEQ ID NO: 332716 - DNA, 20 bp, Artificial Sequence
  chemically synthesized
gagtagaattttaaaactgg

SEQ ID NO: 332717 - DNA, 20 bp, Artificial Sequence
  chemically synthesized
tctgagtagaattttaaaac

SEQ ID NO: 332718 - DNA, 20 bp, Artificial Sequence
  chemically synthesized
tccagttttaaaattctact

SEQ ID NO: 332719 - DNA, 20 bp, Artificial Sequence
  chemically synthesized
agttttaaaattctactcag

SEQ ID NO: 332720 - DNA, 20 bp, Artificial Sequence
  chemically synthesized
gtacactgaagacttctgag

SEQ ID NO: 332721 - DNA, 20 bp, Artificial Sequence
  chemically synthesized
ttggtacactgaagacttct

SEQ ID NO: 332722 - DNA, 20 bp, Artificial Sequence
  chemically synthesized
aaattctactcagaagtctt

SEQ ID NO: 332723 - DNA, 20 bp, Artificial Sequence
  chemically synthesized
ctctataaattggtacactg

SEQ ID NO: 332724 - DNA, 20 bp, Artificial Sequence
  chemically synthesized
gtcttcagtgtaccaattta

SEQ ID NO: 332725 - DNA, 20 bp, Artificial Sequence
  chemically synthesized
cttcagtgtaccaatttata

SEQ ID NO: 332726 - DNA, 20 bp, Artificial Sequence
  chemically synthesized
tttagctcaactctataaat

SEQ ID NO: 332727 - DNA, 20 bp, Artificial Sequence
  chemically synthesized
gtgtaccaatttatagagtt

SEQ ID NO: 332728 - DNA, 20 bp, Artificial Sequence
  chemically synthesized
gaaacagaattgttaggttt

SEQ ID NO: 332729 - DNA, 20 bp, Artificial Sequence
  chemically synthesized
tacccagaaacagaattgtt

SEQ ID NO: 332730 - DNA, 20 bp, Artificial Sequence
  chemically synthesized
ttacccagaaacagaattgt

SEQ ID NO: 332731 - DNA, 20 bp, Artificial Sequence
  chemically synthesized
aaacctaacaattctgtttc

SEQ ID NO: 332732 - DNA, 20 bp, Artificial Sequence
  chemically synthesized
aacctaacaattctgtttct

SEQ ID NO: 332733 - DNA, 20 bp, Artificial Sequence
  chemically synthesized
ctgaacaaattacccagaaa

SEQ ID NO: 332734 - DNA, 20 bp, Artificial Sequence
  chemically synthesized
atgtgactgaacaaattacc

SEQ ID NO: 332735 - DNA, 20 bp, Artificial Sequence
  chemically synthesized
ctgtttctgggtaatttgtt

SEQ ID NO: 332736 - DNA, 20 bp, Artificial Sequence
  chemically synthesized
ggtaatttgttcagtcacat

SEQ ID NO: 332737 - DNA, 20 bp, Artificial Sequence
  chemically synthesized
gtaatttgttcagtcacatc

SEQ ID NO: 332738 - DNA, 20 bp, Artificial Sequence
  chemically synthesized
cagtcacatcaggatgtata

SEQ ID NO: 332739 - DNA, 20 bp, Artificial Sequence
  chemically synthesized
agtcacatcaggatgtataa

SEQ ID NO: 332740 - DNA, 20 bp, Artificial Sequence
  chemically synthesized
gatgtataaaggcttcctcg

SEQ ID NO: 332741 - DNA, 20 bp, Artificial Sequence
  chemically synthesized
atcactaatttgcttcgagg

SEQ ID NO: 332742 - DNA, 20 bp, Artificial Sequence
  chemically synthesized
agtatcactaatttgcttcg

SEQ ID NO: 332743 - DNA, 20 bp, Artificial Sequence
  chemically synthesized
aagtatcactaatttgcttc

SEQ ID NO: 332744 - DNA, 20 bp, Artificial Sequence
  chemically synthesized
aaggcttcctcgaagcaaat

SEQ ID NO: 332745 - DNA, 20 bp, Artificial Sequence
  chemically synthesized
attagtgatacttttaatct

SEQ ID NO: 332746 - DNA, 20 bp, Artificial Sequence
  chemically synthesized
gagaccactccttagattaa

SEQ ID NO: 332747 - DNA, 20 bp, Artificial Sequence
  chemically synthesized
ttagtgatacttttaatcta

SEQ ID NO: 332748 - DNA, 20 bp, Artificial Sequence
  chemically synthesized
agtgatacttttaatctaag

SEQ ID NO: 332749 - DNA, 20 bp, Artificial Sequence
  chemically synthesized
gatacttttaatctaaggag

SEQ ID NO: 332750 - DNA, 20 bp, Artificial Sequence
  chemically synthesized
cagccagggagaccactcct

SEQ ID NO: 332751 - DNA, 20 bp, Artificial Sequence
  chemically synthesized
aatctaaggagtggtctccc

SEQ ID NO: 332752 - DNA, 20 bp, Artificial Sequence
  chemically synthesized
taaggagtggtctccctggc

SEQ ID NO: 332753 - DNA, 20 bp, Artificial Sequence
  chemically synthesized
aggatgggaagccagccagg

SEQ ID NO: 332754 - DNA, 20 bp, Artificial Sequence
  chemically synthesized
agaggatgggaagccagcca

SEQ ID NO: 332755 - DNA, 20 bp, Artificial Sequence
  chemically synthesized
cagaggatgggaagccagcc

SEQ ID NO: 332756 - DNA, 20 bp, Artificial Sequence
  chemically synthesized
acagaggatgggaagccagc

SEQ ID NO: 332757 - DNA, 20 bp, Artificial Sequence
  chemically synthesized
gcaaacagaggatgggaagc

SEQ ID NO: 332758 - DNA, 20 bp, Artificial Sequence
  chemically synthesized
attggcaaacagaggatggg

SEQ ID NO: 332759 - DNA, 20 bp, Artificial Sequence
  chemically synthesized
gtaattggcaaacagaggat

SEQ ID NO: 332760 - DNA, 20 bp, Artificial Sequence
  chemically synthesized
agtaattggcaaacagagga

SEQ ID NO: 332761 - DNA, 20 bp, Artificial Sequence
  chemically synthesized
agaaagtaattggcaaacag

SEQ ID NO: 332762 - DNA, 20 bp, Artificial Sequence
  chemically synthesized
tagaaagtaattggcaaaca

SEQ ID NO: 332763 - DNA, 20 bp, Artificial Sequence
  chemically synthesized
tgtagaaagtaattggcaaa

SEQ ID NO: 332764 - DNA, 20 bp, Artificial Sequence
  chemically synthesized
cacatattgtagaaagtaat

SEQ ID NO: 332765 - DNA, 20 bp, Artificial Sequence
  chemically synthesized
gactgtccacatattgtaga

SEQ ID NO: 332766 - DNA, 20 bp, Artificial Sequence
  chemically synthesized
caattactttctacaatatg

SEQ ID NO: 332767 - DNA, 20 bp, Artificial Sequence
  chemically synthesized
ctcagactgtccacatattg

SEQ ID NO: 332768 - DNA, 20 bp, Artificial Sequence
  chemically synthesized
tactttctacaatatgtgga

SEQ ID NO: 332769 - DNA, 20 bp, Artificial Sequence
  chemically synthesized
ctacaatatgtggacagtct

SEQ ID NO: 332770 - DNA, 20 bp, Artificial Sequence
  chemically synthesized
tacaatatgtggacagtctg

SEQ ID NO: 332771 - DNA, 20 bp, Artificial Sequence
  chemically synthesized
acaatatgtggacagtctga

SEQ ID NO: 332772 - DNA, 20 bp, Artificial Sequence
  chemically synthesized
atgtggacagtctgagggac

SEQ ID NO: 332773 - DNA, 20 bp, Artificial Sequence
  chemically synthesized
tcctggcacaacttgtccct

SEQ ID NO: 332774 - DNA, 20 bp, Artificial Sequence
  chemically synthesized
gtctgagggacaagttgtgc

SEQ ID NO: 332775 - DNA, 20 bp, Artificial Sequence
  chemically synthesized
tctgagggacaagttgtgcc

SEQ ID NO: 332776 - DNA, 20 bp, Artificial Sequence
  chemically synthesized
tgagggacaagttgtgccag

SEQ ID NO: 332777 - DNA, 20 bp, Artificial Sequence
  chemically synthesized
gagggacaagttgtgccagg

SEQ ID NO: 332778 - DNA, 20 bp, Artificial Sequence
  chemically synthesized
agggacaagttgtgccagga

SEQ ID NO: 332779 - DNA, 20 bp, Artificial Sequence
  chemically synthesized
gggacaagttgtgccaggag

SEQ ID NO: 332780 - DNA, 20 bp, Artificial Sequence
  chemically synthesized
ggacaagttgtgccaggagg

SEQ ID NO: 332781 - DNA, 20 bp, Artificial Sequence
  chemically synthesized
tctctgcctttgccccctcc

SEQ ID NO: 332782 - DNA, 20 bp, Artificial Sequence
  chemically synthesized
agttgtgccaggagggggca

SEQ ID NO: 332783 - DNA, 20 bp, Artificial Sequence
  chemically synthesized
gttgtgccaggagggggcaa

SEQ ID NO: 332784 - DNA, 20 bp, Artificial Sequence
  chemically synthesized
gtgccaggagggggcaaagg

SEQ ID NO: 332785 - DNA, 20 bp, Artificial Sequence
  chemically synthesized
gccaggagggggcaaaggca

SEQ ID NO: 332786 - DNA, 20 bp, Artificial Sequence
  chemically synthesized
ggagggggcaaaggcagaga

SEQ ID NO: 332787 - DNA, 20 bp, Artificial Sequence
  chemically synthesized
agggggcaaaggcagagata

SEQ ID NO: 332788 - DNA, 20 bp, Artificial Sequence
  chemically synthesized
tgggaggggatgaggcagag

SEQ ID NO: 332789 - DNA, 20 bp, Artificial Sequence
  chemically synthesized
gttgggaggggatgaggcag

SEQ ID NO: 332790 - DNA, 20 bp, Artificial Sequence
  chemically synthesized
tgttgggaggggatgaggca

SEQ ID NO: 332791 - DNA, 20 bp, Artificial Sequence
  chemically synthesized
tgtgttgggaggggatgagg

SEQ ID NO: 332792 - DNA, 20 bp, Artificial Sequence
  chemically synthesized
tcctgtgttgggaggggatg

SEQ ID NO: 332793 - DNA, 20 bp, Artificial Sequence
  chemically synthesized
atcctgtgttgggaggggat

SEQ ID NO: 332794 - DNA, 20 bp, Artificial Sequence
  chemically synthesized
cagcaatcctgtgttgggag

SEQ ID NO: 332795 - DNA, 20 bp, Artificial Sequence
  chemically synthesized
ccagcaatcctgtgttggga

SEQ ID NO: 332796 - DNA, 20 bp, Artificial Sequence
  chemically synthesized
tgcctcatcccctcccaaca

SEQ ID NO: 332797 - DNA, 20 bp, Artificial Sequence
  chemically synthesized
tccagcaatcctgtgttggg

SEQ ID NO: 332798 - DNA, 20 bp, Artificial Sequence
  chemically synthesized
gcctcatcccctcccaacac

SEQ ID NO: 332799 - DNA, 20 bp, Artificial Sequence
  chemically synthesized
atccagcaatcctgtgttgg

SEQ ID NO: 332800 - DNA, 20 bp, Artificial Sequence
  chemically synthesized
acatccagcaatcctgtgtt

SEQ ID NO: 332801 - DNA, 20 bp, Artificial Sequence
  chemically synthesized
tacatccagcaatcctgtgt

SEQ ID NO: 332802 - DNA, 20 bp, Artificial Sequence
  chemically synthesized
ccctcccaacacaggattgc

SEQ ID NO: 332803 - DNA, 20 bp, Artificial Sequence
  chemically synthesized
cttctgggtgattttacatc

SEQ ID NO: 332804 - DNA, 20 bp, Artificial Sequence
  chemically synthesized
ttgctggatgtaaaatcacc

SEQ ID NO: 332805 - DNA, 20 bp, Artificial Sequence
  chemically synthesized
ctggatgtaaaatcacccag

SEQ ID NO: 332806 - DNA, 20 bp, Artificial Sequence
  chemically synthesized
aaagcagaaaaagcacttct

SEQ ID NO: 332807 - DNA, 20 bp, Artificial Sequence
  chemically synthesized
taaagcagaaaaagcacttc

SEQ ID NO: 332808 - DNA, 20 bp, Artificial Sequence
  chemically synthesized
tgccttttataaagcagaaa

SEQ ID NO: 332809 - DNA, 20 bp, Artificial Sequence
  chemically synthesized
tagtaatgccttttataaag

SEQ ID NO: 332810 - DNA, 20 bp, Artificial Sequence
  chemically synthesized
gtgctttttctgctttataa

SEQ ID NO: 332811 - DNA, 20 bp, Artificial Sequence
  chemically synthesized
tgctttttctgctttataaa

SEQ ID NO: 332812 - DNA, 20 bp, Artificial Sequence
  chemically synthesized
acatagtaatgccttttata

SEQ ID NO: 332813 - DNA, 20 bp, Artificial Sequence
  chemically synthesized
gaaccatgcagagcagaaca

SEQ ID NO: 332814 - DNA, 20 bp, Artificial Sequence
  chemically synthesized
ttactatgttctgctctgca

SEQ ID NO: 332815 - DNA, 20 bp, Artificial Sequence
  chemically synthesized
aatcttggaaccatgcagag

SEQ ID NO: 332816 - DNA, 20 bp, Artificial Sequence
  chemically synthesized
aacaatcttggaaccatgca

SEQ ID NO: 332817 - DNA, 20 bp, Artificial Sequence
  chemically synthesized
ggaacaatcttggaaccatg

SEQ ID NO: 332818 - DNA, 20 bp, Artificial Sequence
  chemically synthesized
gttctgctctgcatggttcc

SEQ ID NO: 332819 - DNA, 20 bp, Artificial Sequence
  chemically synthesized
aggttgctgaggaacaatct

SEQ ID NO: 332820 - DNA, 20 bp, Artificial Sequence
  chemically synthesized
atggttccaagattgttcct

SEQ ID NO: 332821 - DNA, 20 bp, Artificial Sequence
  chemically synthesized
tttttgttctgaggttgctg

SEQ ID NO: 332822 - DNA, 20 bp, Artificial Sequence
  chemically synthesized
ttttttgttctgaggttgct

SEQ ID NO: 332823 - DNA, 20 bp, Artificial Sequence
  chemically synthesized
agattgttcctcagcaacct

SEQ ID NO: 332824 - DNA, 20 bp, Artificial Sequence
  chemically synthesized
ggatatccttttttgttctg

SEQ ID NO: 332825 - DNA, 20 bp, Artificial Sequence
  chemically synthesized
aggatatccttttttgttct

SEQ ID NO: 332826 - DNA, 20 bp, Artificial Sequence
  chemically synthesized
tcagcaacctcagaacaaaa

SEQ ID NO: 332827 - DNA, 20 bp, Artificial Sequence
  chemically synthesized
cagcaacctcagaacaaaaa

SEQ ID NO: 332828 - DNA, 20 bp, Artificial Sequence
  chemically synthesized
aaaaaggatatccttttcct

SEQ ID NO: 332829 - DNA, 20 bp, Artificial Sequence
  chemically synthesized
agtaaaagattctaaggaaa

SEQ ID NO: 332830 - DNA, 20 bp, Artificial Sequence
  chemically synthesized
gagtaaaagattctaaggaa

SEQ ID NO: 332831 - DNA, 20 bp, Artificial Sequence
  chemically synthesized
ataccgagtaaaagattcta

SEQ ID NO: 332832 - DNA, 20 bp, Artificial Sequence
  chemically synthesized
tataccgagtaaaagattct

SEQ ID NO: 332833 - DNA, 20 bp, Artificial Sequence
  chemically synthesized
tttccttagaatcttttact

SEQ ID NO: 332834 - DNA, 20 bp, Artificial Sequence
  chemically synthesized
caagttaatataccgagtaa

SEQ ID NO: 332835 - DNA, 20 bp, Artificial Sequence
  chemically synthesized
gttcggcaagttaatatacc

SEQ ID NO: 332836 - DNA, 20 bp, Artificial Sequence
  chemically synthesized
caacctgtatagagttcggc

SEQ ID NO: 332837 - DNA, 20 bp, Artificial Sequence
  chemically synthesized
ctcacaacctgtatagagtt

SEQ ID NO: 332838 - DNA, 20 bp, Artificial Sequence
  chemically synthesized
ttaacttgccgaactctata

SEQ ID NO: 332839 - DNA, 20 bp, Artificial Sequence
  chemically synthesized
taacttgccgaactctatac

SEQ ID NO: 332840 - DNA, 20 bp, Artificial Sequence
  chemically synthesized
acaaactcacaacctgtata

SEQ ID NO: 332841 - DNA, 20 bp, Artificial Sequence
  chemically synthesized
aaacaaactcacaacctgta

SEQ ID NO: 332842 - DNA, 20 bp, Artificial Sequence
  chemically synthesized
ccgaactctatacaggttgt

SEQ ID NO: 332843 - DNA, 20 bp, Artificial Sequence
  chemically synthesized
ttgtgagtttgtttataaat

SEQ ID NO: 332844 - DNA, 20 bp, Artificial Sequence
  chemically synthesized
tttgtttataaatcagaatc

SEQ ID NO: 332845 - DNA, 20 bp, Artificial Sequence
  chemically synthesized
ttgtttataaatcagaatcc

SEQ ID NO: 332846 - DNA, 20 bp, Artificial Sequence
  chemically synthesized
ttttatgagaagagatagcc

SEQ ID NO: 332847 - DNA, 20 bp, Artificial Sequence
  chemically synthesized
agcacttttatgagaagaga

SEQ ID NO: 332848 - DNA, 20 bp, Artificial Sequence
  chemically synthesized
tattagcacttttatgagaa

SEQ ID NO: 332849 - DNA, 20 bp, Artificial Sequence
  chemically synthesized
caggctatctcttctcataa

SEQ ID NO: 332850 - DNA, 20 bp, Artificial Sequence
  chemically synthesized
tttattagcacttttatgag

SEQ ID NO: 332851 - DNA, 20 bp, Artificial Sequence
  chemically synthesized
gtttttattagcacttttat

SEQ ID NO: 332852 - DNA, 20 bp, Artificial Sequence
  chemically synthesized
gaaaatttttatgtttttat

SEQ ID NO: 332853 - DNA, 20 bp, Artificial Sequence
  chemically synthesized
taaaaacataaaaattttct

SEQ ID NO: 332854 - DNA, 20 bp, Artificial Sequence
  chemically synthesized
acataaaaattttctcagat

SEQ ID NO: 332855 - DNA, 20 bp, Artificial Sequence
  chemically synthesized
aagattttgtggtctgatct

SEQ ID NO: 332856 - DNA, 20 bp, Artificial Sequence
  chemically synthesized
aggggttagataagattttg

SEQ ID NO: 332857 - DNA, 20 bp, Artificial Sequence
  chemically synthesized
agatacatcaggggttagat

SEQ ID NO: 332858 - DNA, 20 bp, Artificial Sequence
  chemically synthesized
actttagatacatcaggggt

SEQ ID NO: 332859 - DNA, 20 bp, Artificial Sequence
  chemically synthesized
tactactttagatacatcag

SEQ ID NO: 332860 - DNA, 20 bp, Artificial Sequence
  chemically synthesized
ttactactttagatacatca

SEQ ID NO: 332861 - DNA, 20 bp, Artificial Sequence
  chemically synthesized
attactactttagatacatc

SEQ ID NO: 332862 - DNA, 20 bp, Artificial Sequence
  chemically synthesized
gattactactttagatacat

SEQ ID NO: 332863 - DNA, 20 bp, Artificial Sequence
  chemically synthesized
tctaacccctgatgtatcta

SEQ ID NO: 332864 - DNA, 20 bp, Artificial Sequence
  chemically synthesized
aacccctgatgtatctaaag

SEQ ID NO: 332865 - DNA, 20 bp, Artificial Sequence
  chemically synthesized
aaccaatatgattactactt

SEQ ID NO: 332866 - DNA, 20 bp, Artificial Sequence
  chemically synthesized
atctaaagtagtaatcatat

SEQ ID NO: 332867 - DNA, 20 bp, Artificial Sequence
  chemically synthesized
gtagtaatcatattggttgc

SEQ ID NO: 332868 - DNA, 20 bp, Artificial Sequence
  chemically synthesized
tagtaatcatattggttgcc

SEQ ID NO: 332869 - DNA, 20 bp, Artificial Sequence
  chemically synthesized
catattggttgccgggtttt

SEQ ID NO: 332870 - DNA, 20 bp, Artificial Sequence
  chemically synthesized
cattgtaagttctcaaaacc

SEQ ID NO: 332871 - DNA, 20 bp, Artificial Sequence
  chemically synthesized
gcatggtataagcacattgt

SEQ ID NO: 332872 - DNA, 20 bp, Artificial Sequence
  chemically synthesized
taaagaacattgcatggtat

SEQ ID NO: 332873 - DNA, 20 bp, Artificial Sequence
  chemically synthesized
attttataaagaacattgca

SEQ ID NO: 332874 - DNA, 20 bp, Artificial Sequence
  chemically synthesized
taaatgagattaattttata

SEQ ID NO: 332875 - DNA, 20 bp, Artificial Sequence
  chemically synthesized
agttattaggagtgttaaat

SEQ ID NO: 332876 - DNA, 20 bp, Artificial Sequence
  chemically synthesized
ctaactcatatagttattag

SEQ ID NO: 332877 - DNA, 20 bp, Artificial Sequence
  chemically synthesized
ttctaactcatatagttatt

SEQ ID NO: 332878 - DNA, 20 bp, Artificial Sequence
  chemically synthesized
tttctaactcatatagttat

SEQ ID NO: 332879 - DNA, 20 bp, Artificial Sequence
  chemically synthesized
aacactcctaataactatat

SEQ ID NO: 332880 - DNA, 20 bp, Artificial Sequence
  chemically synthesized
ctcctaataactatatgagt

SEQ ID NO: 332881 - DNA, 20 bp, Artificial Sequence
  chemically synthesized
gaaactgtttctaactcata

SEQ ID NO: 332882 - DNA, 20 bp, Artificial Sequence
  chemically synthesized
ataactatatgagttagaaa

SEQ ID NO: 332883 - DNA, 20 bp, Artificial Sequence
  chemically synthesized
acagtttcaataatacacat

SEQ ID NO: 332884 - DNA, 20 bp, Artificial Sequence
  chemically synthesized
cagtttcaataatacacatg

SEQ ID NO: 332885 - DNA, 20 bp, Artificial Sequence
  chemically synthesized
ataatacacatgaggaaact

SEQ ID NO: 332886 - DNA, 20 bp, Artificial Sequence
  chemically synthesized
taatacacatgaggaaactg

SEQ ID NO: 332887 - DNA, 20 bp, Artificial Sequence
  chemically synthesized
cacatgaggaaactgaggcc

SEQ ID NO: 332888 - DNA, 20 bp, Artificial Sequence
  chemically synthesized
catgaggaaactgaggccca

SEQ ID NO: 332889 - DNA, 20 bp, Artificial Sequence
  chemically synthesized
atttcttgaactctgggcct

SEQ ID NO: 332890 - DNA, 20 bp, Artificial Sequence
  chemically synthesized
gaaactgaggcccagagttc

SEQ ID NO: 332891 - DNA, 20 bp, Artificial Sequence
  chemically synthesized
cagagaatttcttgaactct

SEQ ID NO: 332892 - DNA, 20 bp, Artificial Sequence
  chemically synthesized
tcagagaatttcttgaactc

SEQ ID NO: 332893 - DNA, 20 bp, Artificial Sequence
  chemically synthesized
agagttcaagaaattctctg

SEQ ID NO: 332894 - DNA, 20 bp, Artificial Sequence
  chemically synthesized
gagttcaagaaattctctga

SEQ ID NO: 332895 - DNA, 20 bp, Artificial Sequence
  chemically synthesized
tacttgctatgtgaccttca

SEQ ID NO: 332896 - DNA, 20 bp, Artificial Sequence
  chemically synthesized
cttacttgctatgtgacctt

SEQ ID NO: 332897 - DNA, 20 bp, Artificial Sequence
  chemically synthesized
gaaattctctgaaggtcaca

SEQ ID NO: 332898 - DNA, 20 bp, Artificial Sequence
  chemically synthesized
ttctctgaaggtcacatagc

SEQ ID NO: 332899 - DNA, 20 bp, Artificial Sequence
  chemically synthesized
ctgaaggtcacatagcaagt

SEQ ID NO: 332900 - DNA, 20 bp, Artificial Sequence
  chemically synthesized
atagcaagtaagtaataatg

SEQ ID NO: 332901 - DNA, 20 bp, Artificial Sequence
  chemically synthesized
tagcaagtaagtaataatga

SEQ ID NO: 332902 - DNA, 20 bp, Artificial Sequence
  chemically synthesized
gtaataatgaaggctcttaa

SEQ ID NO: 332903 - DNA, 20 bp, Artificial Sequence
  chemically synthesized
ataatgaaggctcttaaaag

SEQ ID NO: 332904 - DNA, 20 bp, Artificial Sequence
  chemically synthesized
ccccctacatctacttttaa

SEQ ID NO: 332905 - DNA, 20 bp, Artificial Sequence
  chemically synthesized
gcccccctacatctactttt

SEQ ID NO: 332906 - DNA, 20 bp, Artificial Sequence
  chemically synthesized
aaggctcttaaaagtagatg

SEQ ID NO: 332907 - DNA, 20 bp, Artificial Sequence
  chemically synthesized
aggctcttaaaagtagatgt

SEQ ID NO: 332908 - DNA, 20 bp, Artificial Sequence
  chemically synthesized
ggctcttaaaagtagatgta

SEQ ID NO: 332909 - DNA, 20 bp, Artificial Sequence
  chemically synthesized
gctcttaaaagtagatgtag

SEQ ID NO: 332910 - DNA, 20 bp, Artificial Sequence
  chemically synthesized
ctcttaaaagtagatgtagg

SEQ ID NO: 332911 - DNA, 20 bp, Artificial Sequence
  chemically synthesized
tcttaaaagtagatgtaggg

SEQ ID NO: 332912 - DNA, 20 bp, Artificial Sequence
  chemically synthesized
taaaagtagatgtagggggg

SEQ ID NO: 332913 - DNA, 20 bp, Artificial Sequence
  chemically synthesized
aagtagatgtaggggggcag

SEQ ID NO: 332914 - DNA, 20 bp, Artificial Sequence
  chemically synthesized
gtagatgtaggggggcagaa

SEQ ID NO: 332915 - DNA, 20 bp, Artificial Sequence
  chemically synthesized
tgtaggggggcagaagagta

SEQ ID NO: 332916 - DNA, 20 bp, Artificial Sequence
  chemically synthesized
gtaggggggcagaagagtat

SEQ ID NO: 332917 - DNA, 20 bp, Artificial Sequence
  chemically synthesized
gggggcagaagagtataggt

SEQ ID NO: 332918 - DNA, 20 bp, Artificial Sequence
  chemically synthesized
gggcagaagagtataggtaa

SEQ ID NO: 332919 - DNA, 20 bp, Artificial Sequence
  chemically synthesized
aggtaagagtgatgtcatat

SEQ ID NO: 332920 - DNA, 20 bp, Artificial Sequence
  chemically synthesized
aagagtgatgtcatatgaga

SEQ ID NO: 332921 - DNA, 20 bp, Artificial Sequence
  chemically synthesized
aaagctaacaagggcaaatt

SEQ ID NO: 332922 - DNA, 20 bp, Artificial Sequence
  chemically synthesized
aagactcaatttgcccttgt

SEQ ID NO: 332923 - DNA, 20 bp, Artificial Sequence
  chemically synthesized
ttcaacttcaaagctaacaa

SEQ ID NO: 332924 - DNA, 20 bp, Artificial Sequence
  chemically synthesized
tttcaacttcaaagctaaca

SEQ ID NO: 332925 - DNA, 20 bp, Artificial Sequence
  chemically synthesized
ctttcaacttcaaagctaac

SEQ ID NO: 332926 - DNA, 20 bp, Artificial Sequence
  chemically synthesized
atttgcccttgttagctttg

SEQ ID NO: 332927 - DNA, 20 bp, Artificial Sequence
  chemically synthesized
attgccccctttcaacttca

SEQ ID NO: 332928 - DNA, 20 bp, Artificial Sequence
  chemically synthesized
cttgttagctttgaagttga

SEQ ID NO: 332929 - DNA, 20 bp, Artificial Sequence
  chemically synthesized
ttgttagctttgaagttgaa

SEQ ID NO: 332930 - DNA, 20 bp, Artificial Sequence
  chemically synthesized
tgttagctttgaagttgaaa

SEQ ID NO: 332931 - DNA, 20 bp, Artificial Sequence
  chemically synthesized
gttagctttgaagttgaaag

SEQ ID NO: 332932 - DNA, 20 bp, Artificial Sequence
  chemically synthesized
ttagctttgaagttgaaagg

SEQ ID NO: 332933 - DNA, 20 bp, Artificial Sequence
  chemically synthesized
tgaagttgaaagggggcaat

SEQ ID NO: 332934 - DNA, 20 bp, Artificial Sequence
  chemically synthesized
gttgaaagggggcaatgagc

SEQ ID NO: 332935 - DNA, 20 bp, Artificial Sequence
  chemically synthesized
gggcaatgagccagtgaatg

SEQ ID NO: 332936 - DNA, 20 bp, Artificial Sequence
  chemically synthesized
tagaggctgaccacattcac

SEQ ID NO: 332937 - DNA, 20 bp, Artificial Sequence
  chemically synthesized
aatgagccagtgaatgtggt

SEQ ID NO: 332938 - DNA, 20 bp, Artificial Sequence
  chemically synthesized
cagtgaatgtggtcagcctc

SEQ ID NO: 332939 - DNA, 20 bp, Artificial Sequence
  chemically synthesized
tgaatgtggtcagcctctag

SEQ ID NO: 332940 - DNA, 20 bp, Artificial Sequence
  chemically synthesized
atgccttttctagcttctag

SEQ ID NO: 332941 - DNA, 20 bp, Artificial Sequence
  chemically synthesized
tgtggtcagcctctagaagc

SEQ ID NO: 332942 - DNA, 20 bp, Artificial Sequence
  chemically synthesized
catgccttttctagcttcta

SEQ ID NO: 332943 - DNA, 20 bp, Artificial Sequence
  chemically synthesized
tccatgccttttctagcttc

SEQ ID NO: 332944 - DNA, 20 bp, Artificial Sequence
  chemically synthesized
tcagcctctagaagctagaa

SEQ ID NO: 332945 - DNA, 20 bp, Artificial Sequence
  chemically synthesized
cagcctctagaagctagaaa

SEQ ID NO: 332946 - DNA, 20 bp, Artificial Sequence
  chemically synthesized
atccatttccatgccttttc

SEQ ID NO: 332947 - DNA, 20 bp, Artificial Sequence
  chemically synthesized
tctagaagctagaaaaggca

SEQ ID NO: 332948 - DNA, 20 bp, Artificial Sequence
  chemically synthesized
agctagaaaaggcatggaaa

SEQ ID NO: 332949 - DNA, 20 bp, Artificial Sequence
  chemically synthesized
tggaaatggattctcctcta

SEQ ID NO: 332950 - DNA, 20 bp, Artificial Sequence
  chemically synthesized
tccttttggaggctgtagag

SEQ ID NO: 332951 - DNA, 20 bp, Artificial Sequence
  chemically synthesized
cttccttttggaggctgtag

SEQ ID NO: 332952 - DNA, 20 bp, Artificial Sequence
  chemically synthesized
ccttccttttggaggctgta

SEQ ID NO: 332953 - DNA, 20 bp, Artificial Sequence
  chemically synthesized
tgccttccttttggaggctg

SEQ ID NO: 332954 - DNA, 20 bp, Artificial Sequence
  chemically synthesized
ttctcctctacagcctccaa

SEQ ID NO: 332955 - DNA, 20 bp, Artificial Sequence
  chemically synthesized
tctcctctacagcctccaaa

SEQ ID NO: 332956 - DNA, 20 bp, Artificial Sequence
  chemically synthesized
cagggctgccttccttttgg

SEQ ID NO: 332957 - DNA, 20 bp, Artificial Sequence
  chemically synthesized
cctctacagcctccaaaagg

SEQ ID NO: 332958 - DNA, 20 bp, Artificial Sequence
  chemically synthesized
gcagggctgccttccttttg

SEQ ID NO: 332959 - DNA, 20 bp, Artificial Sequence
  chemically synthesized
ctctacagcctccaaaagga

SEQ ID NO: 332960 - DNA, 20 bp, Artificial Sequence
  chemically synthesized
cagcagggctgccttccttt

SEQ ID NO: 332961 - DNA, 20 bp, Artificial Sequence
  chemically synthesized
tacagcctccaaaaggaagg

SEQ ID NO: 332962 - DNA, 20 bp, Artificial Sequence
  chemically synthesized
ctaacattaacatatcagca

SEQ ID NO: 332963 - DNA, 20 bp, Artificial Sequence
  chemically synthesized
gctaacattaacatatcagc

SEQ ID NO: 332964 - DNA, 20 bp, Artificial Sequence
  chemically synthesized
agctaacattaacatatcag

SEQ ID NO: 332965 - DNA, 20 bp, Artificial Sequence
  chemically synthesized
ttcagctaacattaacatat

SEQ ID NO: 332966 - DNA, 20 bp, Artificial Sequence
  chemically synthesized
ccctgctgatatgttaatgt

SEQ ID NO: 332967 - DNA, 20 bp, Artificial Sequence
  chemically synthesized
tatgttaatgttagctgaat

SEQ ID NO: 332968 - DNA, 20 bp, Artificial Sequence
  chemically synthesized
tgtttaaaacaggtctcatt

SEQ ID NO: 332969 - DNA, 20 bp, Artificial Sequence
  chemically synthesized
ttagttcagatgtttaaaac

SEQ ID NO: 332970 - DNA, 20 bp, Artificial Sequence
  chemically synthesized
tttagttcagatgtttaaaa

SEQ ID NO: 332971 - DNA, 20 bp, Artificial Sequence
  chemically synthesized
tgttttaaacatctgaacta

SEQ ID NO: 332972 - DNA, 20 bp, Artificial Sequence
  chemically synthesized
tattttacagttctttagtt

SEQ ID NO: 332973 - DNA, 20 bp, Artificial Sequence
  chemically synthesized
ttcattattttacagttctt

SEQ ID NO: 332974 - DNA, 20 bp, Artificial Sequence
  chemically synthesized
aacacatattcattatttta

SEQ ID NO: 332975 - DNA, 20 bp, Artificial Sequence
  chemically synthesized
aataatgaatatgtgttgat

SEQ ID NO: 332976 - DNA, 20 bp, Artificial Sequence
  chemically synthesized
ataatgaatatgtgttgatt

SEQ ID NO: 332977 - DNA, 20 bp, Artificial Sequence
  chemically synthesized
taatgaatatgtgttgatta

SEQ ID NO: 332978 - DNA, 20 bp, Artificial Sequence
  chemically synthesized
aatgaatatgtgttgattag

SEQ ID NO: 332979 - DNA, 20 bp, Artificial Sequence
  chemically synthesized
tatgtgttgattaggggcac

SEQ ID NO: 332980 - DNA, 20 bp, Artificial Sequence
  chemically synthesized
atgtgttgattaggggcact

SEQ ID NO: 332981 - DNA, 20 bp, Artificial Sequence
  chemically synthesized
gattaggggcactaggtttg

SEQ ID NO: 332982 - DNA, 20 bp, Artificial Sequence
  chemically synthesized
tgatgcaacaactacaaacc

SEQ ID NO: 332983 - DNA, 20 bp, Artificial Sequence
  chemically synthesized
aaaaatcgaactaatacata

SEQ ID NO: 332984 - DNA, 20 bp, Artificial Sequence
  chemically synthesized
aatcatgtgtctatatgtat

SEQ ID NO: 332985 - DNA, 20 bp, Artificial Sequence
  chemically synthesized
aatacatatagacacatgat

SEQ ID NO: 332986 - DNA, 20 bp, Artificial Sequence
  chemically synthesized
atagacacatgattagttat

SEQ ID NO: 332987 - DNA, 20 bp, Artificial Sequence
  chemically synthesized
tagacacatgattagttatc

SEQ ID NO: 332988 - DNA, 20 bp, Artificial Sequence
  chemically synthesized
cacatgattagttatcagga

SEQ ID NO: 332989 - DNA, 20 bp, Artificial Sequence
  chemically synthesized
acatgattagttatcaggat

SEQ ID NO: 332990 - DNA, 20 bp, Artificial Sequence
  chemically synthesized
atcaggatgggttaatttaa

SEQ ID NO: 332991 - DNA, 20 bp, Artificial Sequence
  chemically synthesized
aggatgggttaatttaaaag

SEQ ID NO: 332992 - DNA, 20 bp, Artificial Sequence
  chemically synthesized
gaagtatgtttttgtccctg

SEQ ID NO: 332993 - DNA, 20 bp, Artificial Sequence
  chemically synthesized
ctgaatagttgatggccaca

SEQ ID NO: 332994 - DNA, 20 bp, Artificial Sequence
  chemically synthesized
cctgaatagttgatggccac

SEQ ID NO: 332995 - DNA, 20 bp, Artificial Sequence
  chemically synthesized
ccctgaatagttgatggcca

SEQ ID NO: 332996 - DNA, 20 bp, Artificial Sequence
  chemically synthesized
acactaccctgaatagttga

SEQ ID NO: 332997 - DNA, 20 bp, Artificial Sequence
  chemically synthesized
ccctgtggccatcaactatt

SEQ ID NO: 332998 - DNA, 20 bp, Artificial Sequence
  chemically synthesized
cctgtggccatcaactattc

SEQ ID NO: 332999 - DNA, 20 bp, Artificial Sequence
  chemically synthesized
ctgtggccatcaactattca

SEQ ID NO: 333000 - DNA, 20 bp, Artificial Sequence
  chemically synthesized
tggccatcaactattcaggg

SEQ ID NO: 333001 - DNA, 20 bp, Artificial Sequence
  chemically synthesized
tctcaaaacactaccctgaa

SEQ ID NO: 333002 - DNA, 20 bp, Artificial Sequence
  chemically synthesized
actattcagggtagtgtttt

SEQ ID NO: 333003 - DNA, 20 bp, Artificial Sequence
  chemically synthesized
cagggtagtgttttgagacc

SEQ ID NO: 333004 - DNA, 20 bp, Artificial Sequence
  chemically synthesized
ctgggtgacagggcaagact

SEQ ID NO: 333005 - DNA, 20 bp, Artificial Sequence
  chemically synthesized
tccagcctgggtgacagggc

SEQ ID NO: 333006 - DNA, 20 bp, Artificial Sequence
  chemically synthesized
ccgagtcttgccctgtcacc

SEQ ID NO: 333007 - DNA, 20 bp, Artificial Sequence
  chemically synthesized
gcactccagcctgggtgaca

SEQ ID NO: 333008 - DNA, 20 bp, Artificial Sequence
  chemically synthesized
cgagtcttgccctgtcaccc

SEQ ID NO: 333009 - DNA, 20 bp, Artificial Sequence
  chemically synthesized
tgcactccagcctgggtgac

SEQ ID NO: 333010 - DNA, 20 bp, Artificial Sequence
  chemically synthesized
ctgcactccagcctgggtga

SEQ ID NO: 333011 - DNA, 20 bp, Artificial Sequence
  chemically synthesized
tcttgccctgtcacccaggc

SEQ ID NO: 333012 - DNA, 20 bp, Artificial Sequence
  chemically synthesized
ttgccctgtcacccaggctg

SEQ ID NO: 333013 - DNA, 20 bp, Artificial Sequence
  chemically synthesized
cggccactgcactccagcct

SEQ ID NO: 333014 - DNA, 20 bp, Artificial Sequence
  chemically synthesized
tcggccactgcactccagcc

SEQ ID NO: 333015 - DNA, 20 bp, Artificial Sequence
  chemically synthesized
ctgtcacccaggctggagtg

SEQ ID NO: 333016 - DNA, 20 bp, Artificial Sequence
  chemically synthesized
tgagatcggccactgcactc

SEQ ID NO: 333017 - DNA, 20 bp, Artificial Sequence
  chemically synthesized
tcacccaggctggagtgcag

SEQ ID NO: 333018 - DNA, 20 bp, Artificial Sequence
  chemically synthesized
tggagtgcagtggccgatct

SEQ ID NO: 333019 - DNA, 20 bp, Artificial Sequence
  chemically synthesized
aggttgcagtgagctgagat

SEQ ID NO: 333020 - DNA, 20 bp, Artificial Sequence
  chemically synthesized
ggtggaggttgcagtgagct

SEQ ID NO: 333021 - DNA, 20 bp, Artificial Sequence
  chemically synthesized
caggaggtggaggttgcagt

SEQ ID NO: 333022 - DNA, 20 bp, Artificial Sequence
  chemically synthesized
aagccaggaggtggaggttg

SEQ ID NO: 333023 - DNA, 20 bp, Artificial Sequence
  chemically synthesized
tgcttgaagccaggaggtgg

SEQ ID NO: 333024 - DNA, 20 bp, Artificial Sequence
  chemically synthesized
tcactgcaacctccacctcc

SEQ ID NO: 333025 - DNA, 20 bp, Artificial Sequence
  chemically synthesized
ttgcttgaagccaggaggtg

SEQ ID NO: 333026 - DNA, 20 bp, Artificial Sequence
  chemically synthesized
gattgcttgaagccaggagg

SEQ ID NO: 333027 - DNA, 20 bp, Artificial Sequence
  chemically synthesized
gaggattgcttgaagccagg

SEQ ID NO: 333028 - DNA, 20 bp, Artificial Sequence
  chemically synthesized
tgaggattgcttgaagccag

SEQ ID NO: 333029 - DNA, 20 bp, Artificial Sequence
  chemically synthesized
aacctccacctcctggcttc

SEQ ID NO: 333030 - DNA, 20 bp, Artificial Sequence
  chemically synthesized
catgaggattgcttgaagcc

SEQ ID NO: 333031 - DNA, 20 bp, Artificial Sequence
  chemically synthesized
gcatgaggattgcttgaagc

SEQ ID NO: 333032 - DNA, 20 bp, Artificial Sequence
  chemically synthesized
tgaggcatgaggattgcttg

SEQ ID NO: 333033 - DNA, 20 bp, Artificial Sequence
  chemically synthesized
ttcaagcaatcctcatgcct

SEQ ID NO: 333034 - DNA, 20 bp, Artificial Sequence
  chemically synthesized
acttgggaagctgaggcatg

SEQ ID NO: 333035 - DNA, 20 bp, Artificial Sequence
  chemically synthesized
tacttgggaagctgaggcat

SEQ ID NO: 333036 - DNA, 20 bp, Artificial Sequence
  chemically synthesized
cccagctacttgggaagctg

SEQ ID NO: 333037 - DNA, 20 bp, Artificial Sequence
  chemically synthesized
tcccagctacttgggaagct

SEQ ID NO: 333038 - DNA, 20 bp, Artificial Sequence
  chemically synthesized
tcctcatgcctcagcttccc

SEQ ID NO: 333039 - DNA, 20 bp, Artificial Sequence
  chemically synthesized
tcatgcctcagcttcccaag

SEQ ID NO: 333040 - DNA, 20 bp, Artificial Sequence
  chemically synthesized
tgtaatcccagctacttggg

SEQ ID NO: 333041 - DNA, 20 bp, Artificial Sequence
  chemically synthesized
gcctcagcttcccaagtagc

SEQ ID NO: 333042 - DNA, 20 bp, Artificial Sequence
  chemically synthesized
acctgtaatcccagctactt

SEQ ID NO: 333043 - DNA, 20 bp, Artificial Sequence
  chemically synthesized
cctcagcttcccaagtagct

SEQ ID NO: 333044 - DNA, 20 bp, Artificial Sequence
  chemically synthesized
cacctgtaatcccagctact

SEQ ID NO: 333045 - DNA, 20 bp, Artificial Sequence
  chemically synthesized
ttcccaagtagctgggatta

SEQ ID NO: 333046 - DNA, 20 bp, Artificial Sequence
  chemically synthesized
tcccaagtagctgggattac

SEQ ID NO: 333047 - DNA, 20 bp, Artificial Sequence
  chemically synthesized
gtggcacacacctgtaatcc

SEQ ID NO: 333048 - DNA, 20 bp, Artificial Sequence
  chemically synthesized
caaaaattaagcgagtgtgg

SEQ ID NO: 333049 - DNA, 20 bp, Artificial Sequence
  chemically synthesized
acacaaaaattaagcgagtg

SEQ ID NO: 333050 - DNA, 20 bp, Artificial Sequence
  chemically synthesized
tgaaaacacaaaaattaagc

SEQ ID NO: 333051 - DNA, 20 bp, Artificial Sequence
  chemically synthesized
ctactgaaaacacaaaaatt

SEQ ID NO: 333052 - DNA, 20 bp, Artificial Sequence
  chemically synthesized
tcgcttaatttttgtgtttt

SEQ ID NO: 333053 - DNA, 20 bp, Artificial Sequence
  chemically synthesized
cttaatttttgtgttttcag

SEQ ID NO: 333054 - DNA, 20 bp, Artificial Sequence
  chemically synthesized
ttttgtgttttcagtagaaa

SEQ ID NO: 333055 - DNA, 20 bp, Artificial Sequence
  chemically synthesized
gaaacagcattttgccatgt

SEQ ID NO: 333056 - DNA, 20 bp, Artificial Sequence
  chemically synthesized
cagcattttgccatgttggc

SEQ ID NO: 333057 - DNA, 20 bp, Artificial Sequence
  chemically synthesized
tgagaccagcctggccaaca

SEQ ID NO: 333058 - DNA, 20 bp, Artificial Sequence
  chemically synthesized
agcattttgccatgttggcc

SEQ ID NO: 333059 - DNA, 20 bp, Artificial Sequence
  chemically synthesized
ttttgccatgttggccaggc

SEQ ID NO: 333060 - DNA, 20 bp, Artificial Sequence
  chemically synthesized
ctaggagtttgagaccagcc

SEQ ID NO: 333061 - DNA, 20 bp, Artificial Sequence
  chemically synthesized
tgaggctaggagtttgagac

SEQ ID NO: 333062 - DNA, 20 bp, Artificial Sequence
  chemically synthesized
ccaggctggtctcaaactcc

SEQ ID NO: 333063 - DNA, 20 bp, Artificial Sequence
  chemically synthesized
tcacttgaggctaggagttt

SEQ ID NO: 333064 - DNA, 20 bp, Artificial Sequence
  chemically synthesized
gggagatcacttgaggctag

SEQ ID NO: 333065 - DNA, 20 bp, Artificial Sequence
  chemically synthesized
ggtctcaaactcctagcctc

SEQ ID NO: 333066 - DNA, 20 bp, Artificial Sequence
  chemically synthesized
cggggagatcacttgaggct

SEQ ID NO: 333067 - DNA, 20 bp, Artificial Sequence
  chemically synthesized
gcggggagatcacttgaggc

SEQ ID NO: 333068 - DNA, 20 bp, Artificial Sequence
  chemically synthesized
tgacgcggggagatcacttg

SEQ ID NO: 333069 - DNA, 20 bp, Artificial Sequence
  chemically synthesized
atgacgcggggagatcactt

SEQ ID NO: 333070 - DNA, 20 bp, Artificial Sequence
  chemically synthesized
cttttggaggatgacgcggg

SEQ ID NO: 333071 - DNA, 20 bp, Artificial Sequence
  chemically synthesized
ctcttttggaggatgacgcg

SEQ ID NO: 333072 - DNA, 20 bp, Artificial Sequence
  chemically synthesized
cctcttttggaggatgacgc

SEQ ID NO: 333073 - DNA, 20 bp, Artificial Sequence
  chemically synthesized
gcctcttttggaggatgacg

SEQ ID NO: 333074 - DNA, 20 bp, Artificial Sequence
  chemically synthesized
ctccccgcgtcatcctccaa

SEQ ID NO: 333075 - DNA, 20 bp, Artificial Sequence
  chemically synthesized
ccccgcgtcatcctccaaaa

SEQ ID NO: 333076 - DNA, 20 bp, Artificial Sequence
  chemically synthesized
cccgcgtcatcctccaaaag

SEQ ID NO: 333077 - DNA, 20 bp, Artificial Sequence
  chemically synthesized
tgtaatcccgcctcttttgg

SEQ ID NO: 333078 - DNA, 20 bp, Artificial Sequence
  chemically synthesized
ctgtaatcccgcctcttttg

SEQ ID NO: 333079 - DNA, 20 bp, Artificial Sequence
  chemically synthesized
gcgtcatcctccaaaagagg

SEQ ID NO: 333080 - DNA, 20 bp, Artificial Sequence
  chemically synthesized
gcctgtaatcccgcctcttt

SEQ ID NO: 333081 - DNA, 20 bp, Artificial Sequence
  chemically synthesized
cgtcatcctccaaaagaggc

SEQ ID NO: 333082 - DNA, 20 bp, Artificial Sequence
  chemically synthesized
ctccaaaagaggcgggatta

SEQ ID NO: 333083 - DNA, 20 bp, Artificial Sequence
  chemically synthesized
tccaaaagaggcgggattac

SEQ ID NO: 333084 - DNA, 20 bp, Artificial Sequence
  chemically synthesized
agaggcgggattacaggcat

SEQ ID NO: 333085 - DNA, 20 bp, Artificial Sequence
  chemically synthesized
caggcatgagccactacacc

SEQ ID NO: 333086 - DNA, 20 bp, Artificial Sequence
  chemically synthesized
acaccgcgagctgggtgtag

SEQ ID NO: 333087 - DNA, 20 bp, Artificial Sequence
  chemically synthesized
actacaccgcgagctgggtg

SEQ ID NO: 333088 - DNA, 20 bp, Artificial Sequence
  chemically synthesized
gagccactacacccagctcg

SEQ ID NO: 333089 - DNA, 20 bp, Artificial Sequence
  chemically synthesized
aacaaactacaccgcgagct

SEQ ID NO: 333090 - DNA, 20 bp, Artificial Sequence
  chemically synthesized
aaacaaactacaccgcgagc

SEQ ID NO: 333091 - DNA, 20 bp, Artificial Sequence
  chemically synthesized
actacacccagctcgcggtg

SEQ ID NO: 333092 - DNA, 20 bp, Artificial Sequence
  chemically synthesized
aaaaaaacaaactacaccgc

SEQ ID NO: 333093 - DNA, 20 bp, Artificial Sequence
  chemically synthesized
gcggtgtagtttgttttttt

SEQ ID NO: 333094 - DNA, 20 bp, Artificial Sequence
  chemically synthesized
gtttttttaagtgttacaat

SEQ ID NO: 333095 - DNA, 20 bp, Artificial Sequence
  chemically synthesized
tttttttaagtgttacaatg

SEQ ID NO: 333096 - DNA, 20 bp, Artificial Sequence
  chemically synthesized
ttttttaagtgttacaatga

SEQ ID NO: 333097 - DNA, 20 bp, Artificial Sequence
  chemically synthesized
tttaagtgttacaatgaggg

SEQ ID NO: 333098 - DNA, 20 bp, Artificial Sequence
  chemically synthesized
tcaaacgacagtaaaagtga

SEQ ID NO: 333099 - DNA, 20 bp, Artificial Sequence
  chemically synthesized
ttcaaacgacagtaaaagtg

SEQ ID NO: 333100 - DNA, 20 bp, Artificial Sequence
  chemically synthesized
gtaggttcaaacgacagtaa

SEQ ID NO: 333101 - DNA, 20 bp, Artificial Sequence
  chemically synthesized
attagagtaggttcaaacga

SEQ ID NO: 333102 - DNA, 20 bp, Artificial Sequence
  chemically synthesized
gaggtgttgctgattagagt

SEQ ID NO: 333103 - DNA, 20 bp, Artificial Sequence
  chemically synthesized
tcgtttgaacctactctaat

SEQ ID NO: 333104 - DNA, 20 bp, Artificial Sequence
  chemically synthesized
ggaggtgttgctgattagag

SEQ ID NO: 333105 - DNA, 20 bp, Artificial Sequence
  chemically synthesized
tttggaggtgttgctgatta

SEQ ID NO: 333106 - DNA, 20 bp, Artificial Sequence
  chemically synthesized
tatttggaggtgttgctgat

SEQ ID NO: 333107 - DNA, 20 bp, Artificial Sequence
  chemically synthesized
gtgcatgtgtgtgtatttgg

SEQ ID NO: 333108 - DNA, 20 bp, Artificial Sequence
  chemically synthesized
tgtgcatgtgtgtgtatttg

SEQ ID NO: 333109 - DNA, 20 bp, Artificial Sequence
  chemically synthesized
tgtgtgcatgtgtgtgtatt

SEQ ID NO: 333110 - DNA, 20 bp, Artificial Sequence
  chemically synthesized
tttaataagaacaatttcag

SEQ ID NO: 333111 - DNA, 20 bp, Artificial Sequence
  chemically synthesized
ccctttaataagaacaattt

SEQ ID NO: 333112 - DNA, 20 bp, Artificial Sequence
  chemically synthesized
cactgaaattgttcttatta

SEQ ID NO: 333113 - DNA, 20 bp, Artificial Sequence
  chemically synthesized
actgaaattgttcttattaa

SEQ ID NO: 333114 - DNA, 20 bp, Artificial Sequence
  chemically synthesized
ctgaaattgttcttattaaa

SEQ ID NO: 333115 - DNA, 20 bp, Artificial Sequence
  chemically synthesized
tgaaattgttcttattaaag

SEQ ID NO: 333116 - DNA, 20 bp, Artificial Sequence
  chemically synthesized
tagtttatatcccctttaat

SEQ ID NO: 333117 - DNA, 20 bp, Artificial Sequence
  chemically synthesized
ttattaaaggggatataaac

SEQ ID NO: 333118 - DNA, 20 bp, Artificial Sequence
  chemically synthesized
attaaaggggatataaacta

SEQ ID NO: 333119 - DNA, 20 bp, Artificial Sequence
  chemically synthesized
taaaggggatataaactaga

SEQ ID NO: 333120 - DNA, 20 bp, Artificial Sequence
  chemically synthesized
aaggggatataaactagaga

SEQ ID NO: 333121 - DNA, 20 bp, Artificial Sequence
  chemically synthesized
ataaagttacatgctctctc

SEQ ID NO: 333122 - DNA, 20 bp, Artificial Sequence
  chemically synthesized
gagagagcatgtaactttat

SEQ ID NO: 333123 - DNA, 20 bp, Artificial Sequence
  chemically synthesized
ctttcccattttgaccgata

SEQ ID NO: 333124 - DNA, 20 bp, Artificial Sequence
  chemically synthesized
tgtaactttatcggtcaaaa

SEQ ID NO: 333125 - DNA, 20 bp, Artificial Sequence
  chemically synthesized
gtaactttatcggtcaaaat

SEQ ID NO: 333126 - DNA, 20 bp, Artificial Sequence
  chemically synthesized
ctttatcggtcaaaatggga

SEQ ID NO: 333127 - DNA, 20 bp, Artificial Sequence
  chemically synthesized
ggtcaaaatgggaaagtttt

SEQ ID NO: 333128 - DNA, 20 bp, Artificial Sequence
  chemically synthesized
tcaaaatgggaaagttttaa

SEQ ID NO: 333129 - DNA, 20 bp, Artificial Sequence
  chemically synthesized
gggaaagttttaagagtgaa

SEQ ID NO: 333130 - DNA, 20 bp, Artificial Sequence
  chemically synthesized
ggaaagttttaagagtgaat

SEQ ID NO: 333131 - DNA, 20 bp, Artificial Sequence
  chemically synthesized
aaagttttaagagtgaatag

SEQ ID NO: 333132 - DNA, 20 bp, Artificial Sequence
  chemically synthesized
ttaagagtgaataggagtgt

SEQ ID NO: 333133 - DNA, 20 bp, Artificial Sequence
  chemically synthesized
gagtgttagtaattccactg

SEQ ID NO: 333134 - DNA, 20 bp, Artificial Sequence
  chemically synthesized
atatatagcagttactacag

SEQ ID NO: 333135 - DNA, 20 bp, Artificial Sequence
  chemically synthesized
ctaatatatagcagttacta

SEQ ID NO: 333136 - DNA, 20 bp, Artificial Sequence
  chemically synthesized
tgggaaatcctaatatatag

SEQ ID NO: 333137 - DNA, 20 bp, Artificial Sequence
  chemically synthesized
ctgtagtaactgctatatat

SEQ ID NO: 333138 - DNA, 20 bp, Artificial Sequence
  chemically synthesized
tgtagtaactgctatatatt

SEQ ID NO: 333139 - DNA, 20 bp, Artificial Sequence
  chemically synthesized
gtctgggaaatcctaatata

SEQ ID NO: 333140 - DNA, 20 bp, Artificial Sequence
  chemically synthesized
tgctatatattaggatttcc

SEQ ID NO: 333141 - DNA, 20 bp, Artificial Sequence
  chemically synthesized
aacagtagggtacgatgtct

SEQ ID NO: 333142 - DNA, 20 bp, Artificial Sequence
  chemically synthesized
aaacagtagggtacgatgtc

SEQ ID NO: 333143 - DNA, 20 bp, Artificial Sequence
  chemically synthesized
gtgaatttaggaaaacagta

SEQ ID NO: 333144 - DNA, 20 bp, Artificial Sequence
  chemically synthesized
agtgaatttaggaaaacagt

SEQ ID NO: 333145 - DNA, 20 bp, Artificial Sequence
  chemically synthesized
cagtgaatttaggaaaacag

SEQ ID NO: 333146 - DNA, 20 bp, Artificial Sequence
  chemically synthesized
attcagtgaatttaggaaaa

SEQ ID NO: 333147 - DNA, 20 bp, Artificial Sequence
  chemically synthesized
gaaaattattcagtgaattt

SEQ ID NO: 333148 - DNA, 20 bp, Artificial Sequence
  chemically synthesized
tgaaaattattcagtgaatt

SEQ ID NO: 333149 - DNA, 20 bp, Artificial Sequence
  chemically synthesized
catgatgattgaaaattatt

SEQ ID NO: 333150 - DNA, 20 bp, Artificial Sequence
  chemically synthesized
atcatgttatttgaactcat

SEQ ID NO: 333151 - DNA, 20 bp, Artificial Sequence
  chemically synthesized
ctacattaaatattgctgat

SEQ ID NO: 333152 - DNA, 20 bp, Artificial Sequence
  chemically synthesized
ctcatcagcaatatttaatg

SEQ ID NO: 333153 - DNA, 20 bp, Artificial Sequence
  chemically synthesized
tcagcaatatttaatgtagt

SEQ ID NO: 333154 - DNA, 20 bp, Artificial Sequence
  chemically synthesized
cagcaatatttaatgtagtt

SEQ ID NO: 333155 - DNA, 20 bp, Artificial Sequence
  chemically synthesized
aaagtgttttcagagaaagg

SEQ ID NO: 333156 - DNA, 20 bp, Artificial Sequence
  chemically synthesized
aagaaagtgttttcagagaa

SEQ ID NO: 333157 - DNA, 20 bp, Artificial Sequence
  chemically synthesized
gaagaaagtgttttcagaga

SEQ ID NO: 333158 - DNA, 20 bp, Artificial Sequence
  chemically synthesized
tccagaagaaagtgttttca

SEQ ID NO: 333159 - DNA, 20 bp, Artificial Sequence
  chemically synthesized
aatccagaagaaagtgtttt

SEQ ID NO: 333160 - DNA, 20 bp, Artificial Sequence
  chemically synthesized
tctctgaaaacactttcttc

SEQ ID NO: 333161 - DNA, 20 bp, Artificial Sequence
  chemically synthesized
gcattctggaatccagaaga

SEQ ID NO: 333162 - DNA, 20 bp, Artificial Sequence
  chemically synthesized
tgtggcattctggaatccag

SEQ ID NO: 333163 - DNA, 20 bp, Artificial Sequence
  chemically synthesized
aaacactttcttctggattc

SEQ ID NO: 333164 - DNA, 20 bp, Artificial Sequence
  chemically synthesized
agatgtggcattctggaatc

SEQ ID NO: 333165 - DNA, 20 bp, Artificial Sequence
  chemically synthesized
agaagatagatgtggcattc

SEQ ID NO: 333166 - DNA, 20 bp, Artificial Sequence
  chemically synthesized
gaaaaaggagaagatagatg

SEQ ID NO: 333167 - DNA, 20 bp, Artificial Sequence
  chemically synthesized
gggagagaaaaaggagaaga

SEQ ID NO: 333168 - DNA, 20 bp, Artificial Sequence
  chemically synthesized
aaaggggagagaaaaaggag

SEQ ID NO: 333169 - DNA, 20 bp, Artificial Sequence
  chemically synthesized
tagaaaggggagagaaaaag

SEQ ID NO: 333170 - DNA, 20 bp, Artificial Sequence
  chemically synthesized
gctagaaaggggagagaaaa

SEQ ID NO: 333171 - DNA, 20 bp, Artificial Sequence
  chemically synthesized
ggctagaaaggggagagaaa

SEQ ID NO: 333172 - DNA, 20 bp, Artificial Sequence
  chemically synthesized
aaaggtggctagaaagggga

SEQ ID NO: 333173 - DNA, 20 bp, Artificial Sequence
  chemically synthesized
tcctttttctctcccctttc

SEQ ID NO: 333174 - DNA, 20 bp, Artificial Sequence
  chemically synthesized
aaaaaggtggctagaaaggg

SEQ ID NO: 333175 - DNA, 20 bp, Artificial Sequence
  chemically synthesized
tgaaaaaggtggctagaaag

SEQ ID NO: 333176 - DNA, 20 bp, Artificial Sequence
  chemically synthesized
ctgaaaaaggtggctagaaa

SEQ ID NO: 333177 - DNA, 20 bp, Artificial Sequence
  chemically synthesized
gctgaaaaaggtggctagaa

SEQ ID NO: 333178 - DNA, 20 bp, Artificial Sequence
  chemically synthesized
ggctgaaaaaggtggctaga

SEQ ID NO: 333179 - DNA, 20 bp, Artificial Sequence
  chemically synthesized
aaggggctgaaaaaggtggc

SEQ ID NO: 333180 - DNA, 20 bp, Artificial Sequence
  chemically synthesized
ccctttctagccaccttttt

SEQ ID NO: 333181 - DNA, 20 bp, Artificial Sequence
  chemically synthesized
agcaaaggggctgaaaaagg

SEQ ID NO: 333182 - DNA, 20 bp, Artificial Sequence
  chemically synthesized
atcagcaaaggggctgaaaa

SEQ ID NO: 333183 - DNA, 20 bp, Artificial Sequence
  chemically synthesized
catcagcaaaggggctgaaa

SEQ ID NO: 333184 - DNA, 20 bp, Artificial Sequence
  chemically synthesized
atgatgaggcatcagcaaag

SEQ ID NO: 333185 - DNA, 20 bp, Artificial Sequence
  chemically synthesized
tatgatgaggcatcagcaaa

SEQ ID NO: 333186 - DNA, 20 bp, Artificial Sequence
  chemically synthesized
atatgatgaggcatcagcaa

SEQ ID NO: 333187 - DNA, 20 bp, Artificial Sequence
  chemically synthesized
tatatgatgaggcatcagca

SEQ ID NO: 333188 - DNA, 20 bp, Artificial Sequence
  chemically synthesized
atgtatatatgatgaggcat

SEQ ID NO: 333189 - DNA, 20 bp, Artificial Sequence
  chemically synthesized
ctctagatgtatatatgatg

SEQ ID NO: 333190 - DNA, 20 bp, Artificial Sequence
  chemically synthesized
tctctagatgtatatatgat

SEQ ID NO: 333191 - DNA, 20 bp, Artificial Sequence
  chemically synthesized
tgcctcatcatatatacatc

SEQ ID NO: 333192 - DNA, 20 bp, Artificial Sequence
  chemically synthesized
cctcatcatatatacatcta

SEQ ID NO: 333193 - DNA, 20 bp, Artificial Sequence
  chemically synthesized
gtgtagacagatgagatctc

SEQ ID NO: 333194 - DNA, 20 bp, Artificial Sequence
  chemically synthesized
ggaaaaatgtgtagacagat

SEQ ID NO: 333195 - DNA, 20 bp, Artificial Sequence
  chemically synthesized
gccaaggaaaaatgtgtaga

SEQ ID NO: 333196 - DNA, 20 bp, Artificial Sequence
  chemically synthesized
gattgccaaggaaaaatgtg

SEQ ID NO: 333197 - DNA, 20 bp, Artificial Sequence
  chemically synthesized
tctgtctacacatttttcct

SEQ ID NO: 333198 - DNA, 20 bp, Artificial Sequence
  chemically synthesized
cggccaggataagattgcca

SEQ ID NO: 333199 - DNA, 20 bp, Artificial Sequence
  chemically synthesized
tcggccaggataagattgcc

SEQ ID NO: 333200 - DNA, 20 bp, Artificial Sequence
  chemically synthesized
tttccttggcaatcttatcc

SEQ ID NO: 333201 - DNA, 20 bp, Artificial Sequence
  chemically synthesized
ttaaatccatcggccaggat

SEQ ID NO: 333202 - DNA, 20 bp, Artificial Sequence
  chemically synthesized
ggcaatcttatcctggccga

SEQ ID NO: 333203 - DNA, 20 bp, Artificial Sequence
  chemically synthesized
gttatttaaatccatcggcc

SEQ ID NO: 333204 - DNA, 20 bp, Artificial Sequence
  chemically synthesized
tgttatttaaatccatcggc

SEQ ID NO: 333205 - DNA, 20 bp, Artificial Sequence
  chemically synthesized
tagatgttatttaaatccat

SEQ ID NO: 333206 - DNA, 20 bp, Artificial Sequence
  chemically synthesized
ataatttagaagtcaacaca

SEQ ID NO: 333207 - DNA, 20 bp, Artificial Sequence
  chemically synthesized
agttgaggataataatttag

SEQ ID NO: 333208 - DNA, 20 bp, Artificial Sequence
  chemically synthesized
cagagttgaggataataatt

SEQ ID NO: 333209 - DNA, 20 bp, Artificial Sequence
  chemically synthesized
gggttctaagatcagagttg

SEQ ID NO: 333210 - DNA, 20 bp, Artificial Sequence
  chemically synthesized
ggggttctaagatcagagtt

SEQ ID NO: 333211 - DNA, 20 bp, Artificial Sequence
  chemically synthesized
attatcctcaactctgatct

SEQ ID NO: 333212 - DNA, 20 bp, Artificial Sequence
  chemically synthesized
aagaaggggttctaagatca

SEQ ID NO: 333213 - DNA, 20 bp, Artificial Sequence
  chemically synthesized
taaagaaggggttctaagat

SEQ ID NO: 333214 - DNA, 20 bp, Artificial Sequence
  chemically synthesized
gcatgtaaagaaggggttct

SEQ ID NO: 333215 - DNA, 20 bp, Artificial Sequence
  chemically synthesized
tatgaatgcatgtaaagaag

SEQ ID NO: 333216 - DNA, 20 bp, Artificial Sequence
  chemically synthesized
ctatgaatgcatgtaaagaa

SEQ ID NO: 333217 - DNA, 20 bp, Artificial Sequence
  chemically synthesized
gctatgaatgcatgtaaaga

SEQ ID NO: 333218 - DNA, 20 bp, Artificial Sequence
  chemically synthesized
ggctatgaatgcatgtaaag

SEQ ID NO: 333219 - DNA, 20 bp, Artificial Sequence
  chemically synthesized
tgaggctatgaatgcatgta

SEQ ID NO: 333220 - DNA, 20 bp, Artificial Sequence
  chemically synthesized
cccttctttacatgcattca

SEQ ID NO: 333221 - DNA, 20 bp, Artificial Sequence
  chemically synthesized
tacatgcattcatagcctca

SEQ ID NO: 333222 - DNA, 20 bp, Artificial Sequence
  chemically synthesized
acatgcattcatagcctcat

SEQ ID NO: 333223 - DNA, 20 bp, Artificial Sequence
  chemically synthesized
ttaatcttgaggtgcctatg

SEQ ID NO: 333224 - DNA, 20 bp, Artificial Sequence
  chemically synthesized
attaatcttgaggtgcctat

SEQ ID NO: 333225 - DNA, 20 bp, Artificial Sequence
  chemically synthesized
catagcctcataggcacctc

SEQ ID NO: 333226 - DNA, 20 bp, Artificial Sequence
  chemically synthesized
ttttaaacatattaatcttg

SEQ ID NO: 333227 - DNA, 20 bp, Artificial Sequence
  chemically synthesized
gttttaaacatattaatctt

SEQ ID NO: 333228 - DNA, 20 bp, Artificial Sequence
  chemically synthesized
gggagtgaacgttaggattt

SEQ ID NO: 333229 - DNA, 20 bp, Artificial Sequence
  chemically synthesized
caggtttgggagtgaacgtt

SEQ ID NO: 333230 - DNA, 20 bp, Artificial Sequence
  chemically synthesized
acaggtttgggagtgaacgt

SEQ ID NO: 333231 - DNA, 20 bp, Artificial Sequence
  chemically synthesized
tgtagaaggaacaggtttgg

SEQ ID NO: 333232 - DNA, 20 bp, Artificial Sequence
  chemically synthesized
actgtagaaggaacaggttt

SEQ ID NO: 333233 - DNA, 20 bp, Artificial Sequence
  chemically synthesized
gactgtagaaggaacaggtt

SEQ ID NO: 333234 - DNA, 20 bp, Artificial Sequence
  chemically synthesized
ggtgagactgtagaaggaac

SEQ ID NO: 333235 - DNA, 20 bp, Artificial Sequence
  chemically synthesized
gggtgagactgtagaaggaa

SEQ ID NO: 333236 - DNA, 20 bp, Artificial Sequence
  chemically synthesized
tcccaaacctgttccttcta

SEQ ID NO: 333237 - DNA, 20 bp, Artificial Sequence
  chemically synthesized
aagatgggtgagactgtaga

SEQ ID NO: 333238 - DNA, 20 bp, Artificial Sequence
  chemically synthesized
caagatgggtgagactgtag

SEQ ID NO: 333239 - DNA, 20 bp, Artificial Sequence
  chemically synthesized
aaccaagatgggtgagactg

SEQ ID NO: 333240 - DNA, 20 bp, Artificial Sequence
  chemically synthesized
tgccacaaaccaagatgggt

SEQ ID NO: 333241 - DNA, 20 bp, Artificial Sequence
  chemically synthesized
ttctacagtctcacccatct

SEQ ID NO: 333242 - DNA, 20 bp, Artificial Sequence
  chemically synthesized
gagttgccacaaaccaagat

SEQ ID NO: 333243 - DNA, 20 bp, Artificial Sequence
  chemically synthesized
agagttgccacaaaccaaga

SEQ ID NO: 333244 - DNA, 20 bp, Artificial Sequence
  chemically synthesized
gtctcacccatcttggtttg

SEQ ID NO: 333245 - DNA, 20 bp, Artificial Sequence
  chemically synthesized
aaatagagttgccacaaacc

SEQ ID NO: 333246 - DNA, 20 bp, Artificial Sequence
  chemically synthesized
tggtttgtggcaactctatt

SEQ ID NO: 333247 - DNA, 20 bp, Artificial Sequence
  chemically synthesized
cttaagcaactggccaaata

SEQ ID NO: 333248 - DNA, 20 bp, Artificial Sequence
  chemically synthesized
ttgtggcaactctatttggc

SEQ ID NO: 333249 - DNA, 20 bp, Artificial Sequence
  chemically synthesized
tacttaagcaactggccaaa

SEQ ID NO: 333250 - DNA, 20 bp, Artificial Sequence
  chemically synthesized
ctctatttggccagttgctt

SEQ ID NO: 333251 - DNA, 20 bp, Artificial Sequence
  chemically synthesized
aggtttcttacttaagcaac

SEQ ID NO: 333252 - DNA, 20 bp, Artificial Sequence
  chemically synthesized
atttggccagttgcttaagt

SEQ ID NO: 333253 - DNA, 20 bp, Artificial Sequence
  chemically synthesized
taccgtgaggtttcttactt

SEQ ID NO: 333254 - DNA, 20 bp, Artificial Sequence
  chemically synthesized
tgcttaagtaagaaacctca

SEQ ID NO: 333255 - DNA, 20 bp, Artificial Sequence
  chemically synthesized
agaaatcaaggattaccgtg

SEQ ID NO: 333256 - DNA, 20 bp, Artificial Sequence
  chemically synthesized
gagaaatcaaggattaccgt

SEQ ID NO: 333257 - DNA, 20 bp, Artificial Sequence
  chemically synthesized
tgaaataattagagaaatca

SEQ ID NO: 333258 - DNA, 20 bp, Artificial Sequence
  chemically synthesized
atgaaataattagagaaatc

SEQ ID NO: 333259 - DNA, 20 bp, Artificial Sequence
  chemically synthesized
tgtgacttatgaaataatta

SEQ ID NO: 333260 - DNA, 20 bp, Artificial Sequence
  chemically synthesized
gatgtgacttatgaaataat

SEQ ID NO: 333261 - DNA, 20 bp, Artificial Sequence
  chemically synthesized
gatttctctaattatttcat

SEQ ID NO: 333262 - DNA, 20 bp, Artificial Sequence
  chemically synthesized
ataagtcacatctactgcat

SEQ ID NO: 333263 - DNA, 20 bp, Artificial Sequence
  chemically synthesized
taagtcacatctactgcatc

SEQ ID NO: 333264 - DNA, 20 bp, Artificial Sequence
  chemically synthesized
tcatttccctcctgatgcag

SEQ ID NO: 333265 - DNA, 20 bp, Artificial Sequence
  chemically synthesized
agtcacatctactgcatcag

SEQ ID NO: 333266 - DNA, 20 bp, Artificial Sequence
  chemically synthesized
gtcacatctactgcatcagg

SEQ ID NO: 333267 - DNA, 20 bp, Artificial Sequence
  chemically synthesized
aagtcatttccctcctgatg

SEQ ID NO: 333268 - DNA, 20 bp, Artificial Sequence
  chemically synthesized
tcacatctactgcatcagga

SEQ ID NO: 333269 - DNA, 20 bp, Artificial Sequence
  chemically synthesized
tggaggccaatatttcatca

SEQ ID NO: 333270 - DNA, 20 bp, Artificial Sequence
  chemically synthesized
aaatgactttgatgaaatat

SEQ ID NO: 333271 - DNA, 20 bp, Artificial Sequence
  chemically synthesized
atatctggtagcagaattgg

SEQ ID NO: 333272 - DNA, 20 bp, Artificial Sequence
  chemically synthesized
catatctggtagcagaattg

SEQ ID NO: 333273 - DNA, 20 bp, Artificial Sequence
  chemically synthesized
agcatatctggtagcagaat

SEQ ID NO: 333274 - DNA, 20 bp, Artificial Sequence
  chemically synthesized
ttggcctccaattctgctac

SEQ ID NO: 333275 - DNA, 20 bp, Artificial Sequence
  chemically synthesized
tagcatagcatatctggtag

SEQ ID NO: 333276 - DNA, 20 bp, Artificial Sequence
  chemically synthesized
ctctagcatagcatatctgg

SEQ ID NO: 333277 - DNA, 20 bp, Artificial Sequence
  chemically synthesized
atcctctagcatagcatatc

SEQ ID NO: 333278 - DNA, 20 bp, Artificial Sequence
  chemically synthesized
tgctaccagatatgctatgc

SEQ ID NO: 333279 - DNA, 20 bp, Artificial Sequence
  chemically synthesized
ctaccagatatgctatgcta

SEQ ID NO: 333280 - DNA, 20 bp, Artificial Sequence
  chemically synthesized
taccagatatgctatgctag

SEQ ID NO: 333281 - DNA, 20 bp, Artificial Sequence
  chemically synthesized
tgtttcatgatcctctagca

SEQ ID NO: 333282 - DNA, 20 bp, Artificial Sequence
  chemically synthesized
ttttctgtttcatgatcctc

SEQ ID NO: 333283 - DNA, 20 bp, Artificial Sequence
  chemically synthesized
tatgctagaggatcatgaaa

SEQ ID NO: 333284 - DNA, 20 bp, Artificial Sequence
  chemically synthesized
tagaggatcatgaaacagaa

SEQ ID NO: 333285 - DNA, 20 bp, Artificial Sequence
  chemically synthesized
tcatgaaacagaaaagctca

SEQ ID NO: 333286 - DNA, 20 bp, Artificial Sequence
  chemically synthesized
agccttttaattttatctgt

SEQ ID NO: 333287 - DNA, 20 bp, Artificial Sequence
  chemically synthesized
aagctcacagataaaattaa

SEQ ID NO: 333288 - DNA, 20 bp, Artificial Sequence
  chemically synthesized
agctcacagataaaattaaa

SEQ ID NO: 333289 - DNA, 20 bp, Artificial Sequence
  chemically synthesized
aaaaataaatggtatgatat

SEQ ID NO: 333290 - DNA, 20 bp, Artificial Sequence
  chemically synthesized
acataaataaaaaaaataaa

SEQ ID NO: 333291 - DNA, 20 bp, Artificial Sequence
  chemically synthesized
ttttttatttatgtattttt

SEQ ID NO: 333292 - DNA, 20 bp, Artificial Sequence
  chemically synthesized
ttatttatgtatttttgaga

SEQ ID NO: 333293 - DNA, 20 bp, Artificial Sequence
  chemically synthesized
atttatgtatttttgagaca

SEQ ID NO: 333294 - DNA, 20 bp, Artificial Sequence
  chemically synthesized
cactacagcatgggcaacaa

SEQ ID NO: 333295 - DNA, 20 bp, Artificial Sequence
  chemically synthesized
tgcactacagcatgggcaac

SEQ ID NO: 333296 - DNA, 20 bp, Artificial Sequence
  chemically synthesized
cactcttgttgcccatgctg

SEQ ID NO: 333297 - DNA, 20 bp, Artificial Sequence
  chemically synthesized
atgccattgcactacagcat

SEQ ID NO: 333298 - DNA, 20 bp, Artificial Sequence
  chemically synthesized
catgccattgcactacagca

SEQ ID NO: 333299 - DNA, 20 bp, Artificial Sequence
  chemically synthesized
gaaatcatgccattgcacta

SEQ ID NO: 333300 - DNA, 20 bp, Artificial Sequence
  chemically synthesized
ttgcccatgctgtagtgcaa

SEQ ID NO: 333301 - DNA, 20 bp, Artificial Sequence
  chemically synthesized
cgggaggtggaggttgcagt

SEQ ID NO: 333302 - DNA, 20 bp, Artificial Sequence
  chemically synthesized
aacccgggaggtggaggttg

SEQ ID NO: 333303 - DNA, 20 bp, Artificial Sequence
  chemically synthesized
cacttgaacccgggaggtgg

SEQ ID NO: 333304 - DNA, 20 bp, Artificial Sequence
  chemically synthesized
tcactgcaacctccacctcc

SEQ ID NO: 333305 - DNA, 20 bp, Artificial Sequence
  chemically synthesized
tcacttgaacccgggaggtg

SEQ ID NO: 333306 - DNA, 20 bp, Artificial Sequence
  chemically synthesized
cactgcaacctccacctccc

SEQ ID NO: 333307 - DNA, 20 bp, Artificial Sequence
  chemically synthesized
aatcacttgaacccgggagg

SEQ ID NO: 333308 - DNA, 20 bp, Artificial Sequence
  chemically synthesized
gagaatcacttgaacccggg

SEQ ID NO: 333309 - DNA, 20 bp, Artificial Sequence
  chemically synthesized
ggagaatcacttgaacccgg

SEQ ID NO: 333310 - DNA, 20 bp, Artificial Sequence
  chemically synthesized
aacctccacctcccgggttc

SEQ ID NO: 333311 - DNA, 20 bp, Artificial Sequence
  chemically synthesized
caggagaatcacttgaaccc

SEQ ID NO: 333312 - DNA, 20 bp, Artificial Sequence
  chemically synthesized
gcaggagaatcacttgaacc

SEQ ID NO: 333313 - DNA, 20 bp, Artificial Sequence
  chemically synthesized
ttcaagtgattctcctgcct

SEQ ID NO: 333314 - DNA, 20 bp, Artificial Sequence
  chemically synthesized
tactcgggaggctgaggcag

SEQ ID NO: 333315 - DNA, 20 bp, Artificial Sequence
  chemically synthesized
gctactcgggaggctgaggc

SEQ ID NO: 333316 - DNA, 20 bp, Artificial Sequence
  chemically synthesized
agctactcgggaggctgagg

SEQ ID NO: 333317 - DNA, 20 bp, Artificial Sequence
  chemically synthesized
cccagctactcgggaggctg

SEQ ID NO: 333318 - DNA, 20 bp, Artificial Sequence
  chemically synthesized
tcccagctactcgggaggct

SEQ ID NO: 333319 - DNA, 20 bp, Artificial Sequence
  chemically synthesized
ttctcctgcctcagcctccc

SEQ ID NO: 333320 - DNA, 20 bp, Artificial Sequence
  chemically synthesized
tcctgcctcagcctcccgag

SEQ ID NO: 333321 - DNA, 20 bp, Artificial Sequence
  chemically synthesized
tgtaatcccagctactcggg

SEQ ID NO: 333322 - DNA, 20 bp, Artificial Sequence
  chemically synthesized
ctgtaatcccagctactcgg

SEQ ID NO: 333323 - DNA, 20 bp, Artificial Sequence
  chemically synthesized
gcctcagcctcccgagtagc

SEQ ID NO: 333324 - DNA, 20 bp, Artificial Sequence
  chemically synthesized
acctgtaatcccagctactc

SEQ ID NO: 333325 - DNA, 20 bp, Artificial Sequence
  chemically synthesized
cctcagcctcccgagtagct

SEQ ID NO: 333326 - DNA, 20 bp, Artificial Sequence
  chemically synthesized
cacctgtaatcccagctact

SEQ ID NO: 333327 - DNA, 20 bp, Artificial Sequence
  chemically synthesized
ctcccgagtagctgggatta

SEQ ID NO: 333328 - DNA, 20 bp, Artificial Sequence
  chemically synthesized
tcccgagtagctgggattac

SEQ ID NO: 333329 - DNA, 20 bp, Artificial Sequence
  chemically synthesized
gtggcgcacacctgtaatcc

SEQ ID NO: 333330 - DNA, 20 bp, Artificial Sequence
  chemically synthesized
caggtgtgcgccaccacacc

SEQ ID NO: 333331 - DNA, 20 bp, Artificial Sequence
  chemically synthesized
acaaaattagctgggtgtgg

SEQ ID NO: 333332 - DNA, 20 bp, Artificial Sequence
  chemically synthesized
aatacaaaattagctgggtg

SEQ ID NO: 333333 - DNA, 20 bp, Artificial Sequence
  chemically synthesized
ctaaaaatacaaaattagct

SEQ ID NO: 333334 - DNA, 20 bp, Artificial Sequence
  chemically synthesized
actaaaaatacaaaattagc

SEQ ID NO: 333335 - DNA, 20 bp, Artificial Sequence
  chemically synthesized
ctctactaaaaatacaaaat

SEQ ID NO: 333336 - DNA, 20 bp, Artificial Sequence
  chemically synthesized
cccagctaattttgtatttt

SEQ ID NO: 333337 - DNA, 20 bp, Artificial Sequence
  chemically synthesized
agctaattttgtatttttag

SEQ ID NO: 333338 - DNA, 20 bp, Artificial Sequence
  chemically synthesized
ctaattttgtatttttagta

SEQ ID NO: 333339 - DNA, 20 bp, Artificial Sequence
  chemically synthesized
ttttgtatttttagtagaga

SEQ ID NO: 333340 - DNA, 20 bp, Artificial Sequence
  chemically synthesized
tttgtatttttagtagagat

SEQ ID NO: 333341 - DNA, 20 bp, Artificial Sequence
  chemically synthesized
ttgtatttttagtagagatg

SEQ ID NO: 333342 - DNA, 20 bp, Artificial Sequence
  chemically synthesized
gagatggggttttaccatgt

SEQ ID NO: 333343 - DNA, 20 bp, Artificial Sequence
  chemically synthesized
cgagaccaaccgaaccaaca

SEQ ID NO: 333344 - DNA, 20 bp, Artificial Sequence
  chemically synthesized
ggggttttaccatgttggtt

SEQ ID NO: 333345 - DNA, 20 bp, Artificial Sequence
  chemically synthesized
ttttaccatgttggttcggt

SEQ ID NO: 333346 - DNA, 20 bp, Artificial Sequence
  chemically synthesized
atcacctgaggtcagagttc

SEQ ID NO: 333347 - DNA, 20 bp, Artificial Sequence
  chemically synthesized
ttggtctcgaactctgacct

SEQ ID NO: 333348 - DNA, 20 bp, Artificial Sequence
  chemically synthesized
tggtctcgaactctgacctc

SEQ ID NO: 333349 - DNA, 20 bp, Artificial Sequence
  chemically synthesized
gggtggatcacctgaggtca

SEQ ID NO: 333350 - DNA, 20 bp, Artificial Sequence
  chemically synthesized
gtgggtggatcacctgaggt

SEQ ID NO: 333351 - DNA, 20 bp, Artificial Sequence
  chemically synthesized
caaggtgggtggatcacctg

SEQ ID NO: 333352 - DNA, 20 bp, Artificial Sequence
  chemically synthesized
ccaaggtgggtggatcacct

SEQ ID NO: 333353 - DNA, 20 bp, Artificial Sequence
  chemically synthesized
ctcaggtgatccacccacct

SEQ ID NO: 333354 - DNA, 20 bp, Artificial Sequence
  chemically synthesized
ctttgggaggccaaggtggg

SEQ ID NO: 333355 - DNA, 20 bp, Artificial Sequence
  chemically synthesized
gtactttgggaggccaaggt

SEQ ID NO: 333356 - DNA, 20 bp, Artificial Sequence
  chemically synthesized
agtactttgggaggccaagg

SEQ ID NO: 333357 - DNA, 20 bp, Artificial Sequence
  chemically synthesized
cccagtactttgggaggcca

SEQ ID NO: 333358 - DNA, 20 bp, Artificial Sequence
  chemically synthesized
tcccagtactttgggaggcc

SEQ ID NO: 333359 - DNA, 20 bp, Artificial Sequence
  chemically synthesized
ccacccaccttggcctccca

SEQ ID NO: 333360 - DNA, 20 bp, Artificial Sequence
  chemically synthesized
tgtactcccagtactttggg

SEQ ID NO: 333361 - DNA, 20 bp, Artificial Sequence
  chemically synthesized
ctgtactcccagtactttgg

SEQ ID NO: 333362 - DNA, 20 bp, Artificial Sequence
  chemically synthesized
accttggcctcccaaagtac

SEQ ID NO: 333363 - DNA, 20 bp, Artificial Sequence
  chemically synthesized
gcctgtactcccagtacttt

SEQ ID NO: 333364 - DNA, 20 bp, Artificial Sequence
  chemically synthesized
ccttggcctcccaaagtact

SEQ ID NO: 333365 - DNA, 20 bp, Artificial Sequence
  chemically synthesized
tgcctgtactcccagtactt

SEQ ID NO: 333366 - DNA, 20 bp, Artificial Sequence
  chemically synthesized
ttggcctcccaaagtactgg

SEQ ID NO: 333367 - DNA, 20 bp, Artificial Sequence
  chemically synthesized
ctcccaaagtactgggagta

SEQ ID NO: 333368 - DNA, 20 bp, Artificial Sequence
  chemically synthesized
tcccaaagtactgggagtac

SEQ ID NO: 333369 - DNA, 20 bp, Artificial Sequence
  chemically synthesized
gtggctcatgcctgtactcc

SEQ ID NO: 333370 - DNA, 20 bp, Artificial Sequence
  chemically synthesized
agtactgggagtacaggcat

SEQ ID NO: 333371 - DNA, 20 bp, Artificial Sequence
  chemically synthesized
caggcatgagccaccacgcc

SEQ ID NO: 333372 - DNA, 20 bp, Artificial Sequence
  chemically synthesized
aatggtaaggccgggcgtgg

SEQ ID NO: 333373 - DNA, 20 bp, Artificial Sequence
  chemically synthesized
ataaatggtaaggccgggcg

SEQ ID NO: 333374 - DNA, 20 bp, Artificial Sequence
  chemically synthesized
atttaataaatggtaaggcc

SEQ ID NO: 333375 - DNA, 20 bp, Artificial Sequence
  chemically synthesized
catttaataaatggtaaggc

SEQ ID NO: 333376 - DNA, 20 bp, Artificial Sequence
  chemically synthesized
aactcatttaataaatggta

SEQ ID NO: 333377 - DNA, 20 bp, Artificial Sequence
  chemically synthesized
taactcatttaataaatggt

SEQ ID NO: 333378 - DNA, 20 bp, Artificial Sequence
  chemically synthesized
tttttaactcatttaataaa

SEQ ID NO: 333379 - DNA, 20 bp, Artificial Sequence
  chemically synthesized
ggccttaccatttattaaat

SEQ ID NO: 333380 - DNA, 20 bp, Artificial Sequence
  chemically synthesized
ttaaatgagttaaaaacgta

SEQ ID NO: 333381 - DNA, 20 bp, Artificial Sequence
  chemically synthesized
gagttaaaaacgtatggcat

SEQ ID NO: 333382 - DNA, 20 bp, Artificial Sequence
  chemically synthesized
agttaaaaacgtatggcatg

SEQ ID NO: 333383 - DNA, 20 bp, Artificial Sequence
  chemically synthesized
gttaaaaacgtatggcatga

SEQ ID NO: 333384 - DNA, 20 bp, Artificial Sequence
  chemically synthesized
aaaaacgtatggcatgaggg

SEQ ID NO: 333385 - DNA, 20 bp, Artificial Sequence
  chemically synthesized
acgtatggcatgagggaaga

SEQ ID NO: 333386 - DNA, 20 bp, Artificial Sequence
  chemically synthesized
tatggcatgagggaagacag

SEQ ID NO: 333387 - DNA, 20 bp, Artificial Sequence
  chemically synthesized
atggcatgagggaagacagc

SEQ ID NO: 333388 - DNA, 20 bp, Artificial Sequence
  chemically synthesized
ggcatgagggaagacagcag

SEQ ID NO: 333389 - DNA, 20 bp, Artificial Sequence
  chemically synthesized
gcatgagggaagacagcagg

SEQ ID NO: 333390 - DNA, 20 bp, Artificial Sequence
  chemically synthesized
cagcaggaggataataaaat

SEQ ID NO: 333391 - DNA, 20 bp, Artificial Sequence
  chemically synthesized
taataaaattagaatacttt

SEQ ID NO: 333392 - DNA, 20 bp, Artificial Sequence
  chemically synthesized
aattagaatactttcagaca

SEQ ID NO: 333393 - DNA, 20 bp, Artificial Sequence
  chemically synthesized
gcaaaacaatctgtgtctga

SEQ ID NO: 333394 - DNA, 20 bp, Artificial Sequence
  chemically synthesized
ccaggtactgttattgaagc

SEQ ID NO: 333395 - DNA, 20 bp, Artificial Sequence
  chemically synthesized
tgtgtcacttgcttcaataa

SEQ ID NO: 333396 - DNA, 20 bp, Artificial Sequence
  chemically synthesized
tgtgccaggtactgttattg

SEQ ID NO: 333397 - DNA, 20 bp, Artificial Sequence
  chemically synthesized
cttgcttcaataacagtacc

SEQ ID NO: 333398 - DNA, 20 bp, Artificial Sequence
  chemically synthesized
tgaatcacctattatgtgcc

SEQ ID NO: 333399 - DNA, 20 bp, Artificial Sequence
  chemically synthesized
ttgaatcacctattatgtgc

SEQ ID NO: 333400 - DNA, 20 bp, Artificial Sequence
  chemically synthesized
taacagtacctggcacataa

SEQ ID NO: 333401 - DNA, 20 bp, Artificial Sequence
  chemically synthesized
aacagtacctggcacataat

SEQ ID NO: 333402 - DNA, 20 bp, Artificial Sequence
  chemically synthesized
ataataggtgattcaaacac

SEQ ID NO: 333403 - DNA, 20 bp, Artificial Sequence
  chemically synthesized
tattcatacatttgattatt

SEQ ID NO: 333404 - DNA, 20 bp, Artificial Sequence
  chemically synthesized
tgcgttacgcacacatagag

SEQ ID NO: 333405 - DNA, 20 bp, Artificial Sequence
  chemically synthesized
tattgcgttacgcacacata

SEQ ID NO: 333406 - DNA, 20 bp, Artificial Sequence
  chemically synthesized
tatattgcgttacgcacaca

SEQ ID NO: 333407 - DNA, 20 bp, Artificial Sequence
  chemically synthesized
gtgtgcgtaacgcaatatat

SEQ ID NO: 333408 - DNA, 20 bp, Artificial Sequence
  chemically synthesized
aatatataagaatcaccgtc

SEQ ID NO: 333409 - DNA, 20 bp, Artificial Sequence
  chemically synthesized
tataagaatcaccgtcgaga

SEQ ID NO: 333410 - DNA, 20 bp, Artificial Sequence
  chemically synthesized
gtgacgctgcactttctcga

SEQ ID NO: 333411 - DNA, 20 bp, Artificial Sequence
  chemically synthesized
gaatcaccgtcgagaaagtg

SEQ ID NO: 333412 - DNA, 20 bp, Artificial Sequence
  chemically synthesized
tgcccatgctcattatagta

SEQ ID NO: 333413 - DNA, 20 bp, Artificial Sequence
  chemically synthesized
atgcccatgctcattatagt

SEQ ID NO: 333414 - DNA, 20 bp, Artificial Sequence
  chemically synthesized
cagcgtcaccctactataat

SEQ ID NO: 333415 - DNA, 20 bp, Artificial Sequence
  chemically synthesized
catgcccatgctcattatag

SEQ ID NO: 333416 - DNA, 20 bp, Artificial Sequence
  chemically synthesized
ctccatgcccatgctcatta

SEQ ID NO: 333417 - DNA, 20 bp, Artificial Sequence
  chemically synthesized
tcaccctactataatgagca

SEQ ID NO: 333418 - DNA, 20 bp, Artificial Sequence
  chemically synthesized
caccctactataatgagcat

SEQ ID NO: 333419 - DNA, 20 bp, Artificial Sequence
  chemically synthesized
tactataatgagcatgggca

SEQ ID NO: 333420 - DNA, 20 bp, Artificial Sequence
  chemically synthesized
ctataatgagcatgggcatg

SEQ ID NO: 333421 - DNA, 20 bp, Artificial Sequence
  chemically synthesized
aataaatgcaaatttgaatt

SEQ ID NO: 333422 - DNA, 20 bp, Artificial Sequence
  chemically synthesized
ataaatgcaaatttgaattc

SEQ ID NO: 333423 - DNA, 20 bp, Artificial Sequence
  chemically synthesized
taggcctaattagtaagtgg

SEQ ID NO: 333424 - DNA, 20 bp, Artificial Sequence
  chemically synthesized
ttctaggcctaattagtaag

SEQ ID NO: 333425 - DNA, 20 bp, Artificial Sequence
  chemically synthesized
aggttctgccacttactaat

SEQ ID NO: 333426 - DNA, 20 bp, Artificial Sequence
  chemically synthesized
ggttctgccacttactaatt

SEQ ID NO: 333427 - DNA, 20 bp, Artificial Sequence
  chemically synthesized
tatttctaggcctaattagt

SEQ ID NO: 333428 - DNA, 20 bp, Artificial Sequence
  chemically synthesized
tttgtatttctaggcctaat

SEQ ID NO: 333429 - DNA, 20 bp, Artificial Sequence
  chemically synthesized
tgccacttactaattaggcc

SEQ ID NO: 333430 - DNA, 20 bp, Artificial Sequence
  chemically synthesized
ccaacttaatttgtatttct

SEQ ID NO: 333431 - DNA, 20 bp, Artificial Sequence
  chemically synthesized
gccaacttaatttgtatttc

SEQ ID NO: 333432 - DNA, 20 bp, Artificial Sequence
  chemically synthesized
taggcctagaaatacaaatt

SEQ ID NO: 333433 - DNA, 20 bp, Artificial Sequence
  chemically synthesized
cctagaaatacaaattaagt

SEQ ID NO: 333434 - DNA, 20 bp, Artificial Sequence
  chemically synthesized
cttttgtctctgttttaaat

SEQ ID NO: 333435 - DNA, 20 bp, Artificial Sequence
  chemically synthesized
ttaagttggccaatttaaaa

SEQ ID NO: 333436 - DNA, 20 bp, Artificial Sequence
  chemically synthesized
aagttggccaatttaaaaca

SEQ ID NO: 333437 - DNA, 20 bp, Artificial Sequence
  chemically synthesized
ccaatttaaaacagagacaa

SEQ ID NO: 333438 - DNA, 20 bp, Artificial Sequence
  chemically synthesized
aacagagacaaaagcactct

SEQ ID NO: 333439 - DNA, 20 bp, Artificial Sequence
  chemically synthesized
agacaaaagcactctgagct

SEQ ID NO: 333440 - DNA, 20 bp, Artificial Sequence
  chemically synthesized
gacaaaagcactctgagcta

SEQ ID NO: 333441 - DNA, 20 bp, Artificial Sequence
  chemically synthesized
tttatgcttcccttagctca

SEQ ID NO: 333442 - DNA, 20 bp, Artificial Sequence
  chemically synthesized
acaaaagcactctgagctaa

SEQ ID NO: 333443 - DNA, 20 bp, Artificial Sequence
  chemically synthesized
cttttatgcttcccttagct

SEQ ID NO: 333444 - DNA, 20 bp, Artificial Sequence
  chemically synthesized
aaagcactctgagctaaggg

SEQ ID NO: 333445 - DNA, 20 bp, Artificial Sequence
  chemically synthesized
attagcttttatgcttccct

SEQ ID NO: 333446 - DNA, 20 bp, Artificial Sequence
  chemically synthesized
ctgagctaagggaagcataa

SEQ ID NO: 333447 - DNA, 20 bp, Artificial Sequence
  chemically synthesized
gggaagcataaaagctaata

SEQ ID NO: 333448 - DNA, 20 bp, Artificial Sequence
  chemically synthesized
tgccccaaaattttccatat

SEQ ID NO: 333449 - DNA, 20 bp, Artificial Sequence
  chemically synthesized
aaagctaatatggaaaattt

SEQ ID NO: 333450 - DNA, 20 bp, Artificial Sequence
  chemically synthesized
aagctaatatggaaaatttt

SEQ ID NO: 333451 - DNA, 20 bp, Artificial Sequence
  chemically synthesized
agctaatatggaaaattttg

SEQ ID NO: 333452 - DNA, 20 bp, Artificial Sequence
  chemically synthesized
aaaattttggggcacctgtg

SEQ ID NO: 333453 - DNA, 20 bp, Artificial Sequence
  chemically synthesized
aaattttggggcacctgtgt

SEQ ID NO: 333454 - DNA, 20 bp, Artificial Sequence
  chemically synthesized
attttggggcacctgtgtgg

SEQ ID NO: 333455 - DNA, 20 bp, Artificial Sequence
  chemically synthesized
catcactcgttctcccacac

SEQ ID NO: 333456 - DNA, 20 bp, Artificial Sequence
  chemically synthesized
acatcactcgttctcccaca

SEQ ID NO: 333457 - DNA, 20 bp, Artificial Sequence
  chemically synthesized
gggcacctgtgtgggagaac

SEQ ID NO: 333458 - DNA, 20 bp, Artificial Sequence
  chemically synthesized
ggagaacgagtgatgtaatt

SEQ ID NO: 333459 - DNA, 20 bp, Artificial Sequence
  chemically synthesized
cgagtgatgtaatttggttg

SEQ ID NO: 333460 - DNA, 20 bp, Artificial Sequence
  chemically synthesized
gagtgatgtaatttggttga

SEQ ID NO: 333461 - DNA, 20 bp, Artificial Sequence
  chemically synthesized
acatgaaatacgtgtgtaat

SEQ ID NO: 333462 - DNA, 20 bp, Artificial Sequence
  chemically synthesized
aatatatcataaatcttttc

SEQ ID NO: 333463 - DNA, 20 bp, Artificial Sequence
  chemically synthesized
atatatcataaatcttttcg

SEQ ID NO: 333464 - DNA, 20 bp, Artificial Sequence
  chemically synthesized
tatcataaatcttttcgagg

SEQ ID NO: 333465 - DNA, 20 bp, Artificial Sequence
  chemically synthesized
ctctcctaaactgcctcgaa

SEQ ID NO: 333466 - DNA, 20 bp, Artificial Sequence
  chemically synthesized
taaatcttttcgaggcagtt

SEQ ID NO: 333467 - DNA, 20 bp, Artificial Sequence
  chemically synthesized
aaatcttttcgaggcagttt

SEQ ID NO: 333468 - DNA, 20 bp, Artificial Sequence
  chemically synthesized
atcttttcgaggcagtttag

SEQ ID NO: 333469 - DNA, 20 bp, Artificial Sequence
  chemically synthesized
cttttcgaggcagtttagga

SEQ ID NO: 333470 - DNA, 20 bp, Artificial Sequence
  chemically synthesized
ttcgaggcagtttaggagag

SEQ ID NO: 333471 - DNA, 20 bp, Artificial Sequence
  chemically synthesized
aggagagtagccttgttata

SEQ ID NO: 333472 - DNA, 20 bp, Artificial Sequence
  chemically synthesized
ttaattttgtccatataaca

SEQ ID NO: 333473 - DNA, 20 bp, Artificial Sequence
  chemically synthesized
cttaattttgtccatataac

SEQ ID NO: 333474 - DNA, 20 bp, Artificial Sequence
  chemically synthesized
cttgttatatggacaaaatt

SEQ ID NO: 333475 - DNA, 20 bp, Artificial Sequence
  chemically synthesized
agcgaaaaaaattgtattat

SEQ ID NO: 333476 - DNA, 20 bp, Artificial Sequence
  chemically synthesized
gcgaaaaaaattgtattatt

SEQ ID NO: 333477 - DNA, 20 bp, Artificial Sequence
  chemically synthesized
cgaaaaaaattgtattatta

SEQ ID NO: 333478 - DNA, 20 bp, Artificial Sequence
  chemically synthesized
ccattttttaatgttattca

SEQ ID NO: 333479 - DNA, 20 bp, Artificial Sequence
  chemically synthesized
gtccattttttaatgttatt

SEQ ID NO: 333480 - DNA, 20 bp, Artificial Sequence
  chemically synthesized
ctctgaataacattaaaaaa

SEQ ID NO: 333481 - DNA, 20 bp, Artificial Sequence
  chemically synthesized
aataacattaaaaaatggac

SEQ ID NO: 333482 - DNA, 20 bp, Artificial Sequence
  chemically synthesized
tccaagtgaagtttattatg

SEQ ID NO: 333483 - DNA, 20 bp, Artificial Sequence
  chemically synthesized
acttcataataaacttcact

SEQ ID NO: 333484 - DNA, 20 bp, Artificial Sequence
  chemically synthesized
ttcataataaacttcacttg

SEQ ID NO: 333485 - DNA, 20 bp, Artificial Sequence
  chemically synthesized
acctagtatgtctccaagtg

SEQ ID NO: 333486 - DNA, 20 bp, Artificial Sequence
  chemically synthesized
ctcaaacctagtatgtctcc

SEQ ID NO: 333487 - DNA, 20 bp, Artificial Sequence
  chemically synthesized
aacttcacttggagacatac

SEQ ID NO: 333488 - DNA, 20 bp, Artificial Sequence
  chemically synthesized
acttcacttggagacatact

SEQ ID NO: 333489 - DNA, 20 bp, Artificial Sequence
  chemically synthesized
cttggagacatactaggttt

SEQ ID NO: 333490 - DNA, 20 bp, Artificial Sequence
  chemically synthesized
atccactaatatctcaaacc

SEQ ID NO: 333491 - DNA, 20 bp, Artificial Sequence
  chemically synthesized
acatactaggtttgagatat

SEQ ID NO: 333492 - DNA, 20 bp, Artificial Sequence
  chemically synthesized
tactaggtttgagatattag

SEQ ID NO: 333493 - DNA, 20 bp, Artificial Sequence
  chemically synthesized
ttgagatattagtggatatc

SEQ ID NO: 333494 - DNA, 20 bp, Artificial Sequence
  chemically synthesized
tgagatattagtggatatca

SEQ ID NO: 333495 - DNA, 20 bp, Artificial Sequence
  chemically synthesized
tattagtggatatcaaggta

SEQ ID NO: 333496 - DNA, 20 bp, Artificial Sequence
  chemically synthesized
tcaaggtatagatacataca

SEQ ID NO: 333497 - DNA, 20 bp, Artificial Sequence
  chemically synthesized
aaggtatagatacatacaaa

SEQ ID NO: 333498 - DNA, 20 bp, Artificial Sequence
  chemically synthesized
acaaagagttgaaaattaat

SEQ ID NO: 333499 - DNA, 20 bp, Artificial Sequence
  chemically synthesized
ttgaaaattaattggaaatg

SEQ ID NO: 333500 - DNA, 20 bp, Artificial Sequence
  chemically synthesized
tggaaatgtggctataactc

SEQ ID NO: 333501 - DNA, 20 bp, Artificial Sequence
  chemically synthesized
ttccaatcttacttgagtta

SEQ ID NO: 333502 - DNA, 20 bp, Artificial Sequence
  chemically synthesized
aatgtggctataactcaagt

SEQ ID NO: 333503 - DNA, 20 bp, Artificial Sequence
  chemically synthesized
caccacttccaatcttactt

SEQ ID NO: 333504 - DNA, 20 bp, Artificial Sequence
  chemically synthesized
ggctataactcaagtaagat

SEQ ID NO: 333505 - DNA, 20 bp, Artificial Sequence
  chemically synthesized
tataactcaagtaagattgg

SEQ ID NO: 333506 - DNA, 20 bp, Artificial Sequence
  chemically synthesized
aactcaagtaagattggaag

SEQ ID NO: 333507 - DNA, 20 bp, Artificial Sequence
  chemically synthesized
aagtaagattggaagtggtg

SEQ ID NO: 333508 - DNA, 20 bp, Artificial Sequence
  chemically synthesized
aagattggaagtggtgaaga

SEQ ID NO: 333509 - DNA, 20 bp, Artificial Sequence
  chemically synthesized
gattggaagtggtgaagaca

SEQ ID NO: 333510 - DNA, 20 bp, Artificial Sequence
  chemically synthesized
atacaatgatcatttgcata

SEQ ID NO: 333511 - DNA, 20 bp, Artificial Sequence
  chemically synthesized
atttgcatacagattgaata

SEQ ID NO: 333512 - DNA, 20 bp, Artificial Sequence
  chemically synthesized
tacagattgaatacagattg

SEQ ID NO: 333513 - DNA, 20 bp, Artificial Sequence
  chemically synthesized
gattgaatacagattgaagc

SEQ ID NO: 333514 - DNA, 20 bp, Artificial Sequence
  chemically synthesized
attgaatacagattgaagcc

SEQ ID NO: 333515 - DNA, 20 bp, Artificial Sequence
  chemically synthesized
ttaataataatttaataacc

SEQ ID NO: 333516 - DNA, 20 bp, Artificial Sequence
  chemically synthesized
ttattaaattatgttgataa

SEQ ID NO: 333517 - DNA, 20 bp, Artificial Sequence
  chemically synthesized
aattatgttgataaaagaac

SEQ ID NO: 333518 - DNA, 20 bp, Artificial Sequence
  chemically synthesized
tgttgataaaagaacaagta

SEQ ID NO: 333519 - DNA, 20 bp, Artificial Sequence
  chemically synthesized
ttgataaaagaacaagtaca

SEQ ID NO: 333520 - DNA, 20 bp, Artificial Sequence
  chemically synthesized
aaaagaacaagtacagagat

SEQ ID NO: 333521 - DNA, 20 bp, Artificial Sequence
  chemically synthesized
agtacagagataagaatgcc

SEQ ID NO: 333522 - DNA, 20 bp, Artificial Sequence
  chemically synthesized
gaaactcatgggaaatatct

SEQ ID NO: 333523 - DNA, 20 bp, Artificial Sequence
  chemically synthesized
aatgccaagatatttcccat

SEQ ID NO: 333524 - DNA, 20 bp, Artificial Sequence
  chemically synthesized
ctttagcttatgaaactcat

SEQ ID NO: 333525 - DNA, 20 bp, Artificial Sequence
  chemically synthesized
tctttagcttatgaaactca

SEQ ID NO: 333526 - DNA, 20 bp, Artificial Sequence
  chemically synthesized
atatttcccatgagtttcat

SEQ ID NO: 333527 - DNA, 20 bp, Artificial Sequence
  chemically synthesized
cccatgagtttcataagcta

SEQ ID NO: 333528 - DNA, 20 bp, Artificial Sequence
  chemically synthesized
atgagtttcataagctaaag

SEQ ID NO: 333529 - DNA, 20 bp, Artificial Sequence
  chemically synthesized
gtttcataagctaaagaagt

SEQ ID NO: 333530 - DNA, 20 bp, Artificial Sequence
  chemically synthesized
ttctgttcttccaacttctt

SEQ ID NO: 333531 - DNA, 20 bp, Artificial Sequence
  chemically synthesized
tcataagctaaagaagttgg

SEQ ID NO: 333532 - DNA, 20 bp, Artificial Sequence
  chemically synthesized
agctaaagaagttggaagaa

SEQ ID NO: 333533 - DNA, 20 bp, Artificial Sequence
  chemically synthesized
aaagaagttggaagaacaga

SEQ ID NO: 333534 - DNA, 20 bp, Artificial Sequence
  chemically synthesized
agaagttggaagaacagaaa

SEQ ID NO: 333535 - DNA, 20 bp, Artificial Sequence
  chemically synthesized
gttggaagaacagaaagagc

SEQ ID NO: 333536 - DNA, 20 bp, Artificial Sequence
  chemically synthesized
ttggaagaacagaaagagcc

SEQ ID NO: 333537 - DNA, 20 bp, Artificial Sequence
  chemically synthesized
attctgtgtctttcattacc

SEQ ID NO: 333538 - DNA, 20 bp, Artificial Sequence
  chemically synthesized
cagaaagagccaggtaatga

SEQ ID NO: 333539 - DNA, 20 bp, Artificial Sequence
  chemically synthesized
gagccaggtaatgaaagaca

SEQ ID NO: 333540 - DNA, 20 bp, Artificial Sequence
  chemically synthesized
aggtaatgaaagacacagaa

SEQ ID NO: 333541 - DNA, 20 bp, Artificial Sequence
  chemically synthesized
aatgaaagacacagaatagt

SEQ ID NO: 333542 - DNA, 20 bp, Artificial Sequence
  chemically synthesized
tgaaagacacagaatagtca

SEQ ID NO: 333543 - DNA, 20 bp, Artificial Sequence
  chemically synthesized
aaagacacagaatagtcaga

SEQ ID NO: 333544 - DNA, 20 bp, Artificial Sequence
  chemically synthesized
aagacacagaatagtcagag

SEQ ID NO: 333545 - DNA, 20 bp, Artificial Sequence
  chemically synthesized
acacagaatagtcagagagg

SEQ ID NO: 333546 - DNA, 20 bp, Artificial Sequence
  chemically synthesized
tcagagaggaagaacccgct

SEQ ID NO: 333547 - DNA, 20 bp, Artificial Sequence
  chemically synthesized
tctcagcctctacactcagc

SEQ ID NO: 333548 - DNA, 20 bp, Artificial Sequence
  chemically synthesized
gaggaagaacccgctgagtg

SEQ ID NO: 333549 - DNA, 20 bp, Artificial Sequence
  chemically synthesized
ttctcagcctctacactcag

SEQ ID NO: 333550 - DNA, 20 bp, Artificial Sequence
  chemically synthesized
ggaagaacccgctgagtgta

SEQ ID NO: 333551 - DNA, 20 bp, Artificial Sequence
  chemically synthesized
gaagaacccgctgagtgtag

SEQ ID NO: 333552 - DNA, 20 bp, Artificial Sequence
  chemically synthesized
tttttctcagcctctacact

SEQ ID NO: 333553 - DNA, 20 bp, Artificial Sequence
  chemically synthesized
acccgctgagtgtagaggct

SEQ ID NO: 333554 - DNA, 20 bp, Artificial Sequence
  chemically synthesized
cactgatgaaacatttttct

SEQ ID NO: 333555 - DNA, 20 bp, Artificial Sequence
  chemically synthesized
ggctgagaaaaatgtttcat

SEQ ID NO: 333556 - DNA, 20 bp, Artificial Sequence
  chemically synthesized
tgagaaaaatgtttcatcag

SEQ ID NO: 333557 - DNA, 20 bp, Artificial Sequence
  chemically synthesized
gaaaaatgtttcatcagtgg

SEQ ID NO: 333558 - DNA, 20 bp, Artificial Sequence
  chemically synthesized
aatgtttcatcagtggtaga

SEQ ID NO: 333559 - DNA, 20 bp, Artificial Sequence
  chemically synthesized
tttcatcagtggtagaaagt

SEQ ID NO: 333560 - DNA, 20 bp, Artificial Sequence
  chemically synthesized
ttcatcagtggtagaaagtt

SEQ ID NO: 333561 - DNA, 20 bp, Artificial Sequence
  chemically synthesized
catcagtggtagaaagttag

SEQ ID NO: 333562 - DNA, 20 bp, Artificial Sequence
  chemically synthesized
tcagtggtagaaagttagga

SEQ ID NO: 333563 - DNA, 20 bp, Artificial Sequence
  chemically synthesized
aagttaggagagctgaataa

SEQ ID NO: 333564 - DNA, 20 bp, Artificial Sequence
  chemically synthesized
agagacaaatggcttttatt

SEQ ID NO: 333565 - DNA, 20 bp, Artificial Sequence
  chemically synthesized
ttcttaatcacagagacaaa

SEQ ID NO: 333566 - DNA, 20 bp, Artificial Sequence
  chemically synthesized
agccatttgtctctgtgatt

SEQ ID NO: 333567 - DNA, 20 bp, Artificial Sequence
  chemically synthesized
aataagtattcttaatcaca

SEQ ID NO: 333568 - DNA, 20 bp, Artificial Sequence
  chemically synthesized
caaataagtattcttaatca

SEQ ID NO: 333569 - DNA, 20 bp, Artificial Sequence
  chemically synthesized
catttatttattcaacaaat

SEQ ID NO: 333570 - DNA, 20 bp, Artificial Sequence
  chemically synthesized
atttgttgaataaataaatg

SEQ ID NO: 333571 - DNA, 20 bp, Artificial Sequence
  chemically synthesized
tgaataaataaatgaagtta

SEQ ID NO: 333572 - DNA, 20 bp, Artificial Sequence
  chemically synthesized
ataaataaatgaagttaaag

SEQ ID NO: 333573 - DNA, 20 bp, Artificial Sequence
  chemically synthesized
aaataaatgaagttaaagca

SEQ ID NO: 333574 - DNA, 20 bp, Artificial Sequence
  chemically synthesized
ttaaagcagagtgatgtgtc

SEQ ID NO: 333575 - DNA, 20 bp, Artificial Sequence
  chemically synthesized
taaagcagagtgatgtgtct

SEQ ID NO: 333576 - DNA, 20 bp, Artificial Sequence
  chemically synthesized
aaagcagagtgatgtgtctg

SEQ ID NO: 333577 - DNA, 20 bp, Artificial Sequence
  chemically synthesized
agcagagtgatgtgtctggg

SEQ ID NO: 333578 - DNA, 20 bp, Artificial Sequence
  chemically synthesized
gagtgatgtgtctggggagt

SEQ ID NO: 333579 - DNA, 20 bp, Artificial Sequence
  chemically synthesized
agtgatgtgtctggggagtg

SEQ ID NO: 333580 - DNA, 20 bp, Artificial Sequence
  chemically synthesized
acgtgcatgccctcactccc

SEQ ID NO: 333581 - DNA, 20 bp, Artificial Sequence
  chemically synthesized
gtgatgtgtctggggagtga

SEQ ID NO: 333582 - DNA, 20 bp, Artificial Sequence
  chemically synthesized
gggcatgcacgtgttttcca

SEQ ID NO: 333583 - DNA, 20 bp, Artificial Sequence
  chemically synthesized
ggcatgcacgtgttttccat

SEQ ID NO: 333584 - DNA, 20 bp, Artificial Sequence
  chemically synthesized
gcatgcacgtgttttccata

SEQ ID NO: 333585 - DNA, 20 bp, Artificial Sequence
  chemically synthesized
catgcacgtgttttccatag

SEQ ID NO: 333586 - DNA, 20 bp, Artificial Sequence
  chemically synthesized
cacgtgttttccatagggga

SEQ ID NO: 333587 - DNA, 20 bp, Artificial Sequence
  chemically synthesized
atgtgggtgactgtccccta

SEQ ID NO: 333588 - DNA, 20 bp, Artificial Sequence
  chemically synthesized
ataggggacagtcacccaca

SEQ ID NO: 333589 - DNA, 20 bp, Artificial Sequence
  chemically synthesized
ataagaggagagagccatgt

SEQ ID NO: 333590 - DNA, 20 bp, Artificial Sequence
  chemically synthesized
tataagaggagagagccatg

SEQ ID NO: 333591 - DNA, 20 bp, Artificial Sequence
  chemically synthesized
acgttctctataagaggaga

SEQ ID NO: 333592 - DNA, 20 bp, Artificial Sequence
  chemically synthesized
taacgttctctataagagga

SEQ ID NO: 333593 - DNA, 20 bp, Artificial Sequence
  chemically synthesized
cacatggctctctcctctta

SEQ ID NO: 333594 - DNA, 20 bp, Artificial Sequence
  chemically synthesized
aataacgttctctataagag

SEQ ID NO: 333595 - DNA, 20 bp, Artificial Sequence
  chemically synthesized
catggctctctcctcttata

SEQ ID NO: 333596 - DNA, 20 bp, Artificial Sequence
  chemically synthesized
aaaataacgttctctataag

SEQ ID NO: 333597 - DNA, 20 bp, Artificial Sequence
  chemically synthesized
aaaaataacgttctctataa

SEQ ID NO: 333598 - DNA, 20 bp, Artificial Sequence
  chemically synthesized
agaaaaataacgttctctat

SEQ ID NO: 333599 - DNA, 20 bp, Artificial Sequence
  chemically synthesized
gagaacgttatttttctctg

SEQ ID NO: 333600 - DNA, 20 bp, Artificial Sequence
  chemically synthesized
cgttatttttctctgtagac

SEQ ID NO: 333601 - DNA, 20 bp, Artificial Sequence
  chemically synthesized
tgtttacttgctggtctaca

SEQ ID NO: 333602 - DNA, 20 bp, Artificial Sequence
  chemically synthesized
agtgtttacttgctggtcta

SEQ ID NO: 333603 - DNA, 20 bp, Artificial Sequence
  chemically synthesized
atttttctctgtagaccagc

SEQ ID NO: 333604 - DNA, 20 bp, Artificial Sequence
  chemically synthesized
ttattaaagtgtttacttgc

SEQ ID NO: 333605 - DNA, 20 bp, Artificial Sequence
  chemically synthesized
agcaagtaaacactttaata

SEQ ID NO: 333606 - DNA, 20 bp, Artificial Sequence
  chemically synthesized
tccatcagaaagctttatta

SEQ ID NO: 333607 - DNA, 20 bp, Artificial Sequence
  chemically synthesized
actttaataaagctttctga

SEQ ID NO: 333608 - DNA, 20 bp, Artificial Sequence
  chemically synthesized
ctggatctgattccatcaga

SEQ ID NO: 333609 - DNA, 20 bp, Artificial Sequence
  chemically synthesized
ataaagctttctgatggaat

SEQ ID NO: 333610 - DNA, 20 bp, Artificial Sequence
  chemically synthesized
caggctggatctgattccat

SEQ ID NO: 333611 - DNA, 20 bp, Artificial Sequence
  chemically synthesized
ctttctgatggaatcagatc

SEQ ID NO: 333612 - DNA, 20 bp, Artificial Sequence
  chemically synthesized
caaaggaactcaagacaggc

SEQ ID NO: 333613 - DNA, 20 bp, Artificial Sequence
  chemically synthesized
aatcagatccagcctgtctt

SEQ ID NO: 333614 - DNA, 20 bp, Artificial Sequence
  chemically synthesized
acttcaaaggaactcaagac

SEQ ID NO: 333615 - DNA, 20 bp, Artificial Sequence
  chemically synthesized
tacttcaaaggaactcaaga

SEQ ID NO: 333616 - DNA, 20 bp, Artificial Sequence
  chemically synthesized
gctctacttcaaaggaactc

SEQ ID NO: 333617 - DNA, 20 bp, Artificial Sequence
  chemically synthesized
gcctgtcttgagttcctttg

SEQ ID NO: 333618 - DNA, 20 bp, Artificial Sequence
  chemically synthesized
tgtcttgagttcctttgaag

SEQ ID NO: 333619 - DNA, 20 bp, Artificial Sequence
  chemically synthesized
ctgtacctgctctacttcaa

SEQ ID NO: 333620 - DNA, 20 bp, Artificial Sequence
  chemically synthesized
tcttgagttcctttgaagta

SEQ ID NO: 333621 - DNA, 20 bp, Artificial Sequence
  chemically synthesized
gctgtacctgctctacttca

SEQ ID NO: 333622 - DNA, 20 bp, Artificial Sequence
  chemically synthesized
tgagttcctttgaagtagag

SEQ ID NO: 333623 - DNA, 20 bp, Artificial Sequence
  chemically synthesized
gagttcctttgaagtagagc

SEQ ID NO: 333624 - DNA, 20 bp, Artificial Sequence
  chemically synthesized
cctttgaagtagagcaggta

SEQ ID NO: 333625 - DNA, 20 bp, Artificial Sequence
  chemically synthesized
agtagagcaggtacagcctg

SEQ ID NO: 333626 - DNA, 20 bp, Artificial Sequence
  chemically synthesized
gtagagcaggtacagcctgt

SEQ ID NO: 333627 - DNA, 20 bp, Artificial Sequence
  chemically synthesized
tagagcaggtacagcctgta

SEQ ID NO: 333628 - DNA, 20 bp, Artificial Sequence
  chemically synthesized
agagcaggtacagcctgtag

SEQ ID NO: 333629 - DNA, 20 bp, Artificial Sequence
  chemically synthesized
gcaggtacagcctgtagggg

SEQ ID NO: 333630 - DNA, 20 bp, Artificial Sequence
  chemically synthesized
tgagctttcactgcccctac

SEQ ID NO: 333631 - DNA, 20 bp, Artificial Sequence
  chemically synthesized
ctgagctttcactgccccta

SEQ ID NO: 333632 - DNA, 20 bp, Artificial Sequence
  chemically synthesized
acagcctgtaggggcagtga

SEQ ID NO: 333633 - DNA, 20 bp, Artificial Sequence
  chemically synthesized
ctgtaggggcagtgaaagct

SEQ ID NO: 333634 - DNA, 20 bp, Artificial Sequence
  chemically synthesized
tcaaaagtgtcaaaaggact

SEQ ID NO: 333635 - DNA, 20 bp, Artificial Sequence
  chemically synthesized
tttatttcaaaagtgtcaaa

SEQ ID NO: 333636 - DNA, 20 bp, Artificial Sequence
  chemically synthesized
atttatttcaaaagtgtcaa

SEQ ID NO: 333637 - DNA, 20 bp, Artificial Sequence
  chemically synthesized
actaagaacatttatttcaa

SEQ ID NO: 333638 - DNA, 20 bp, Artificial Sequence
  chemically synthesized
acttttgaaataaatgttct

SEQ ID NO: 333639 - DNA, 20 bp, Artificial Sequence
  chemically synthesized
atgccttaattattcacact

SEQ ID NO: 333640 - DNA, 20 bp, Artificial Sequence
  chemically synthesized
tgttcttagtgtgaataatt

SEQ ID NO: 333641 - DNA, 20 bp, Artificial Sequence
  chemically synthesized
gttcttagtgtgaataatta

SEQ ID NO: 333642 - DNA, 20 bp, Artificial Sequence
  chemically synthesized
tacatgtagttaggtttgat

SEQ ID NO: 333643 - DNA, 20 bp, Artificial Sequence
  chemically synthesized
agatgatgttacatgtagtt

SEQ ID NO: 333644 - DNA, 20 bp, Artificial Sequence
  chemically synthesized
aagatgatgttacatgtagt

SEQ ID NO: 333645 - DNA, 20 bp, Artificial Sequence
  chemically synthesized
tcagaagatgatgttacatg

SEQ ID NO: 333646 - DNA, 20 bp, Artificial Sequence
  chemically synthesized
cactaaaggaagcatatcag

SEQ ID NO: 333647 - DNA, 20 bp, Artificial Sequence
  chemically synthesized
tgtcactaaaggaagcatat

SEQ ID NO: 333648 - DNA, 20 bp, Artificial Sequence
  chemically synthesized
atcttctgatatgcttcctt

SEQ ID NO: 333649 - DNA, 20 bp, Artificial Sequence
  chemically synthesized
atatattctgtcactaaagg

SEQ ID NO: 333650 - DNA, 20 bp, Artificial Sequence
  chemically synthesized
tgatatgcttcctttagtga

SEQ ID NO: 333651 - DNA, 20 bp, Artificial Sequence
  chemically synthesized
atgatatattctgtcactaa

SEQ ID NO: 333652 - DNA, 20 bp, Artificial Sequence
  chemically synthesized
aatgatatattctgtcacta

SEQ ID NO: 333653 - DNA, 20 bp, Artificial Sequence
  chemically synthesized
atcacaagagatgggggatg

SEQ ID NO: 333654 - DNA, 20 bp, Artificial Sequence
  chemically synthesized
aatcacaagagatgggggat

SEQ ID NO: 333655 - DNA, 20 bp, Artificial Sequence
  chemically synthesized
aaatcacaagagatggggga

SEQ ID NO: 333656 - DNA, 20 bp, Artificial Sequence
  chemically synthesized
gcacaaatcacaagagatgg

SEQ ID NO: 333657 - DNA, 20 bp, Artificial Sequence
  chemically synthesized
agcacaaatcacaagagatg

SEQ ID NO: 333658 - DNA, 20 bp, Artificial Sequence
  chemically synthesized
cagcacaaatcacaagagat

SEQ ID NO: 333659 - DNA, 20 bp, Artificial Sequence
  chemically synthesized
acagcacaaatcacaagaga

SEQ ID NO: 333660 - DNA, 20 bp, Artificial Sequence
  chemically synthesized
agacacagcacaaatcacaa

SEQ ID NO: 333661 - DNA, 20 bp, Artificial Sequence
  chemically synthesized
aaagacacagcacaaatcac

SEQ ID NO: 333662 - DNA, 20 bp, Artificial Sequence
  chemically synthesized
tttatcatttaaaaaagaca

SEQ ID NO: 333663 - DNA, 20 bp, Artificial Sequence
  chemically synthesized
gtaatgtttatcatttaaaa

SEQ ID NO: 333664 - DNA, 20 bp, Artificial Sequence
  chemically synthesized
aaacattacatttatttgaa

SEQ ID NO: 333665 - DNA, 20 bp, Artificial Sequence
  chemically synthesized
ttacttgttttatttaaaat

SEQ ID NO: 333666 - DNA, 20 bp, Artificial Sequence
  chemically synthesized
tggcttattttaaataaaac

SEQ ID NO: 333667 - DNA, 20 bp, Artificial Sequence
  chemically synthesized
ttattttaaataaaacaagt

SEQ ID NO: 333668 - DNA, 20 bp, Artificial Sequence
  chemically synthesized
acataatatgtcataaatca

SEQ ID NO: 333669 - DNA, 20 bp, Artificial Sequence
  chemically synthesized
tttatgacatattatgtatt

SEQ ID NO: 333670 - DNA, 20 bp, Artificial Sequence
  chemically synthesized
tatttggtaatatttacaca

SEQ ID NO: 333671 - DNA, 20 bp, Artificial Sequence
  chemically synthesized
atttggtaatatttacacaa

SEQ ID NO: 333672 - DNA, 20 bp, Artificial Sequence
  chemically synthesized
tggtaatatttacacaaagg

SEQ ID NO: 333673 - DNA, 20 bp, Artificial Sequence
  chemically synthesized
tatttacacaaaggtagaat

SEQ ID NO: 333674 - DNA, 20 bp, Artificial Sequence
  chemically synthesized
ttacacaaaggtagaatgag

SEQ ID NO: 333675 - DNA, 20 bp, Artificial Sequence
  chemically synthesized
acacaaaggtagaatgagca

SEQ ID NO: 333676 - DNA, 20 bp, Artificial Sequence
  chemically synthesized
aaggtagaatgagcagagcc

SEQ ID NO: 333677 - DNA, 20 bp, Artificial Sequence
  chemically synthesized
tagaatgagcagagcctagc

SEQ ID NO: 333678 - DNA, 20 bp, Artificial Sequence
  chemically synthesized
aaatggacttacatcttgct

SEQ ID NO: 333679 - DNA, 20 bp, Artificial Sequence
  chemically synthesized
caaatggacttacatcttgc

SEQ ID NO: 333680 - DNA, 20 bp, Artificial Sequence
  chemically synthesized
agcagagcctagcaagatgt

SEQ ID NO: 333681 - DNA, 20 bp, Artificial Sequence
  chemically synthesized
cttaatgaagtaattacaaa

SEQ ID NO: 333682 - DNA, 20 bp, Artificial Sequence
  chemically synthesized
ccatttgtaattacttcatt

SEQ ID NO: 333683 - DNA, 20 bp, Artificial Sequence
  chemically synthesized
catttgtaattacttcatta

SEQ ID NO: 333684 - DNA, 20 bp, Artificial Sequence
  chemically synthesized
tttgtaattacttcattaag

SEQ ID NO: 333685 - DNA, 20 bp, Artificial Sequence
  chemically synthesized
tcaggtatgactccttaatg

SEQ ID NO: 333686 - DNA, 20 bp, Artificial Sequence
  chemically synthesized
ttcattaaggagtcatacct

SEQ ID NO: 333687 - DNA, 20 bp, Artificial Sequence
  chemically synthesized
ccttcattaaggcatcgctc

SEQ ID NO: 333688 - DNA, 20 bp, Artificial Sequence
  chemically synthesized
accttcattaaggcatcgct

SEQ ID NO: 333689 - DNA, 20 bp, Artificial Sequence
  chemically synthesized
acctgagcgatgccttaatg

SEQ ID NO: 333690 - DNA, 20 bp, Artificial Sequence
  chemically synthesized
cctgagcgatgccttaatga

SEQ ID NO: 333691 - DNA, 20 bp, Artificial Sequence
  chemically synthesized
cctcatcaccaccttcatta

SEQ ID NO: 333692 - DNA, 20 bp, Artificial Sequence
  chemically synthesized
acctcatcaccaccttcatt

SEQ ID NO: 333693 - DNA, 20 bp, Artificial Sequence
  chemically synthesized
gagcgatgccttaatgaagg

SEQ ID NO: 333694 - DNA, 20 bp, Artificial Sequence
  chemically synthesized
gccttaatgaaggtggtgat

SEQ ID NO: 333695 - DNA, 20 bp, Artificial Sequence
  chemically synthesized
ccttaatgaaggtggtgatg

SEQ ID NO: 333696 - DNA, 20 bp, Artificial Sequence
  chemically synthesized
atgaggtgaaaatgtgctac

SEQ ID NO: 333697 - DNA, 20 bp, Artificial Sequence
  chemically synthesized
gtgaaaatgtgctaccagaa

SEQ ID NO: 333698 - DNA, 20 bp, Artificial Sequence
  chemically synthesized
tgaaaatgtgctaccagaat

SEQ ID NO: 333699 - DNA, 20 bp, Artificial Sequence
  chemically synthesized
ttctccaatgcctattctgg

SEQ ID NO: 333700 - DNA, 20 bp, Artificial Sequence
  chemically synthesized
gttttctccaatgcctattc

SEQ ID NO: 333701 - DNA, 20 bp, Artificial Sequence
  chemically synthesized
tgtgctaccagaataggcat

SEQ ID NO: 333702 - DNA, 20 bp, Artificial Sequence
  chemically synthesized
tgctaccagaataggcattg

SEQ ID NO: 333703 - DNA, 20 bp, Artificial Sequence
  chemically synthesized
aataggcattggagaaaacc

SEQ ID NO: 333704 - DNA, 20 bp, Artificial Sequence
  chemically synthesized
gcattggagaaaacctagaa

SEQ ID NO: 333705 - DNA, 20 bp, Artificial Sequence
  chemically synthesized
cattggagaaaacctagaaa

SEQ ID NO: 333706 - DNA, 20 bp, Artificial Sequence
  chemically synthesized
tttattgagctgccttttct

SEQ ID NO: 333707 - DNA, 20 bp, Artificial Sequence
  chemically synthesized
tggagaaaacctagaaaagg

SEQ ID NO: 333708 - DNA, 20 bp, Artificial Sequence
  chemically synthesized
ctttattgagctgccttttc

SEQ ID NO: 333709 - DNA, 20 bp, Artificial Sequence
  chemically synthesized
ctagaaaaggcagctcaata

SEQ ID NO: 333710 - DNA, 20 bp, Artificial Sequence
  chemically synthesized
cctctcattatcactttatt

SEQ ID NO: 333711 - DNA, 20 bp, Artificial Sequence
  chemically synthesized
cagctcaataaagtgataat

SEQ ID NO: 333712 - DNA, 20 bp, Artificial Sequence
  chemically synthesized
gctcaataaagtgataatga

SEQ ID NO: 333713 - DNA, 20 bp, Artificial Sequence
  chemically synthesized
ctcaataaagtgataatgag

SEQ ID NO: 333714 - DNA, 20 bp, Artificial Sequence
  chemically synthesized
tcaataaagtgataatgaga

SEQ ID NO: 333715 - DNA, 20 bp, Artificial Sequence
  chemically synthesized
caataaagtgataatgagag

SEQ ID NO: 333716 - DNA, 20 bp, Artificial Sequence
  chemically synthesized
aataaagtgataatgagagg

SEQ ID NO: 333717 - DNA, 20 bp, Artificial Sequence
  chemically synthesized
tacaccaagcaaagatatag

SEQ ID NO: 333718 - DNA, 20 bp, Artificial Sequence
  chemically synthesized
atacaccaagcaaagatata

SEQ ID NO: 333719 - DNA, 20 bp, Artificial Sequence
  chemically synthesized
catacaccaagcaaagatat

SEQ ID NO: 333720 - DNA, 20 bp, Artificial Sequence
  chemically synthesized
gcatacaccaagcaaagata

SEQ ID NO: 333721 - DNA, 20 bp, Artificial Sequence
  chemically synthesized
aaaacccctatatctttgct

SEQ ID NO: 333722 - DNA, 20 bp, Artificial Sequence
  chemically synthesized
taaggagcatacaccaagca

SEQ ID NO: 333723 - DNA, 20 bp, Artificial Sequence
  chemically synthesized
aagattaaggagcatacacc

SEQ ID NO: 333724 - DNA, 20 bp, Artificial Sequence
  chemically synthesized
tgccacctcctaagattaag

SEQ ID NO: 333725 - DNA, 20 bp, Artificial Sequence
  chemically synthesized
tggtgtatgctccttaatct

SEQ ID NO: 333726 - DNA, 20 bp, Artificial Sequence
  chemically synthesized
ggtgtatgctccttaatctt

SEQ ID NO: 333727 - DNA, 20 bp, Artificial Sequence
  chemically synthesized
agtgccacctcctaagatta

SEQ ID NO: 333728 - DNA, 20 bp, Artificial Sequence
  chemically synthesized
aagtgccacctcctaagatt

SEQ ID NO: 333729 - DNA, 20 bp, Artificial Sequence
  chemically synthesized
tgtatgctccttaatcttag

SEQ ID NO: 333730 - DNA, 20 bp, Artificial Sequence
  chemically synthesized
gtatgctccttaatcttagg

SEQ ID NO: 333731 - DNA, 20 bp, Artificial Sequence
  chemically synthesized
tgctccttaatcttaggagg

SEQ ID NO: 333732 - DNA, 20 bp, Artificial Sequence
  chemically synthesized
aggaataagtgccacctcct

SEQ ID NO: 333733 - DNA, 20 bp, Artificial Sequence
  chemically synthesized
ggaggtggcacttattcctt

SEQ ID NO: 333734 - DNA, 20 bp, Artificial Sequence
  chemically synthesized
atcaccaagacttaaggaat

SEQ ID NO: 333735 - DNA, 20 bp, Artificial Sequence
  chemically synthesized
ggcacttattccttaagtct

SEQ ID NO: 333736 - DNA, 20 bp, Artificial Sequence
  chemically synthesized
gttgaaatcaccaagactta

SEQ ID NO: 333737 - DNA, 20 bp, Artificial Sequence
  chemically synthesized
cgttgaaatcaccaagactt

SEQ ID NO: 333738 - DNA, 20 bp, Artificial Sequence
  chemically synthesized
ttccctccgttgaaatcacc

SEQ ID NO: 333739 - DNA, 20 bp, Artificial Sequence
  chemically synthesized
ttaagtcttggtgatttcaa

SEQ ID NO: 333740 - DNA, 20 bp, Artificial Sequence
  chemically synthesized
aagtcttggtgatttcaacg

SEQ ID NO: 333741 - DNA, 20 bp, Artificial Sequence
  chemically synthesized
agtcttggtgatttcaacgg

SEQ ID NO: 333742 - DNA, 20 bp, Artificial Sequence
  chemically synthesized
gtcttggtgatttcaacgga

SEQ ID NO: 333743 - DNA, 20 bp, Artificial Sequence
  chemically synthesized
ggtgatttcaacggagggaa

SEQ ID NO: 333744 - DNA, 20 bp, Artificial Sequence
  chemically synthesized
ggagggaatggtgataaatt

SEQ ID NO: 333745 - DNA, 20 bp, Artificial Sequence
  chemically synthesized
gaatggtgataaattgagtc

SEQ ID NO: 333746 - DNA, 20 bp, Artificial Sequence
  chemically synthesized
atggtgataaattgagtcta

SEQ ID NO: 333747 - DNA, 20 bp, Artificial Sequence
  chemically synthesized
ggtgataaattgagtctaga

SEQ ID NO: 333748 - DNA, 20 bp, Artificial Sequence
  chemically synthesized
ttgactctccatcgactctc

SEQ ID NO: 333749 - DNA, 20 bp, Artificial Sequence
  chemically synthesized
aattgagtctagagagtcga

SEQ ID NO: 333750 - DNA, 20 bp, Artificial Sequence
  chemically synthesized
ttgagtctagagagtcgatg

SEQ ID NO: 333751 - DNA, 20 bp, Artificial Sequence
  chemically synthesized
gagtctagagagtcgatgga

SEQ ID NO: 333752 - DNA, 20 bp, Artificial Sequence
  chemically synthesized
tagagagtcgatggagagtc

SEQ ID NO: 333753 - DNA, 20 bp, Artificial Sequence
  chemically synthesized
gagagtcgatggagagtcaa

SEQ ID NO: 333754 - DNA, 20 bp, Artificial Sequence
  chemically synthesized
agagtcgatggagagtcaag

SEQ ID NO: 333755 - DNA, 20 bp, Artificial Sequence
  chemically synthesized
cgatggagagtcaagaggtc

SEQ ID NO: 333756 - DNA, 20 bp, Artificial Sequence
  chemically synthesized
agagtcaagaggtccagaat

SEQ ID NO: 333757 - DNA, 20 bp, Artificial Sequence
  chemically synthesized
agtcaagaggtccagaatga

SEQ ID NO: 333758 - DNA, 20 bp, Artificial Sequence
  chemically synthesized
cttctcactctctctcattc

SEQ ID NO: 333759 - DNA, 20 bp, Artificial Sequence
  chemically synthesized
tcaagaggtccagaatgaga

SEQ ID NO: 333760 - DNA, 20 bp, Artificial Sequence
  chemically synthesized
aagaggtccagaatgagaga

SEQ ID NO: 333761 - DNA, 20 bp, Artificial Sequence
  chemically synthesized
ggtccagaatgagagagagt

SEQ ID NO: 333762 - DNA, 20 bp, Artificial Sequence
  chemically synthesized
ccagaatgagagagagtgag

SEQ ID NO: 333763 - DNA, 20 bp, Artificial Sequence
  chemically synthesized
agaatgagagagagtgagaa

SEQ ID NO: 333764 - DNA, 20 bp, Artificial Sequence
  chemically synthesized
aatgagagagagtgagaaga

SEQ ID NO: 333765 - DNA, 20 bp, Artificial Sequence
  chemically synthesized
gagtgagaagagagctttgc

SEQ ID NO: 333766 - DNA, 20 bp, Artificial Sequence
  chemically synthesized
ccttggctagtttacttgca

SEQ ID NO: 333767 - DNA, 20 bp, Artificial Sequence
  chemically synthesized
agagagctttgcaagtaaac

SEQ ID NO: 333768 - DNA, 20 bp, Artificial Sequence
  chemically synthesized
gctttgcaagtaaactagcc

SEQ ID NO: 333769 - DNA, 20 bp, Artificial Sequence
  chemically synthesized
ctttgcaagtaaactagcca

SEQ ID NO: 333770 - DNA, 20 bp, Artificial Sequence
  chemically synthesized
ttatgacctccatccttggc

SEQ ID NO: 333771 - DNA, 20 bp, Artificial Sequence
  chemically synthesized
gcaagtaaactagccaagga

SEQ ID NO: 333772 - DNA, 20 bp, Artificial Sequence
  chemically synthesized
aagtaaactagccaaggatg

SEQ ID NO: 333773 - DNA, 20 bp, Artificial Sequence
  chemically synthesized
agtaaactagccaaggatgg

SEQ ID NO: 333774 - DNA, 20 bp, Artificial Sequence
  chemically synthesized
atagttatgacctccatcct

SEQ ID NO: 333775 - DNA, 20 bp, Artificial Sequence
  chemically synthesized
tggaggtcataactatttca

SEQ ID NO: 333776 - DNA, 20 bp, Artificial Sequence
  chemically synthesized
gaaaattctaagctttgaaa

SEQ ID NO: 333777 - DNA, 20 bp, Artificial Sequence
  chemically synthesized
gtcataactatttcaaagct

SEQ ID NO: 333778 - DNA, 20 bp, Artificial Sequence
  chemically synthesized
atgcattagctgaaaattct

SEQ ID NO: 333779 - DNA, 20 bp, Artificial Sequence
  chemically synthesized
atttcaaagcttagaatttt

SEQ ID NO: 333780 - DNA, 20 bp, Artificial Sequence
  chemically synthesized
ttggcagttaatcgatgcat

SEQ ID NO: 333781 - DNA, 20 bp, Artificial Sequence
  chemically synthesized
ttaattagtaatttatttgg

SEQ ID NO: 333782 - DNA, 20 bp, Artificial Sequence
  chemically synthesized
catttaattagtaatttatt

SEQ ID NO: 333783 - DNA, 20 bp, Artificial Sequence
  chemically synthesized
gatagtggtgtgcatttaat

SEQ ID NO: 333784 - DNA, 20 bp, Artificial Sequence
  chemically synthesized
tcaattttttgttaagatag

SEQ ID NO: 333785 - DNA, 20 bp, Artificial Sequence
  chemically synthesized
gactcaattttttgttaaga

SEQ ID NO: 333786 - DNA, 20 bp, Artificial Sequence
  chemically synthesized
tggagactcaattttttgtt

SEQ ID NO: 333787 - DNA, 20 bp, Artificial Sequence
  chemically synthesized
cactatcttaacaaaaaatt

SEQ ID NO: 333788 - DNA, 20 bp, Artificial Sequence
  chemically synthesized
aaaaaatgtgtacatttttg

SEQ ID NO: 333789 - DNA, 20 bp, Artificial Sequence
  chemically synthesized
ctaaaaaatgtgtacatttt

SEQ ID NO: 333790 - DNA, 20 bp, Artificial Sequence
  chemically synthesized
ccaaaaatgtacacattttt

SEQ ID NO: 333791 - DNA, 20 bp, Artificial Sequence
  chemically synthesized
tgtacacattttttagccga

SEQ ID NO: 333792 - DNA, 20 bp, Artificial Sequence
  chemically synthesized
gtacacattttttagccgat

SEQ ID NO: 333793 - DNA, 20 bp, Artificial Sequence
  chemically synthesized
cattttttagccgataggat

SEQ ID NO: 333794 - DNA, 20 bp, Artificial Sequence
  chemically synthesized
aatgatagacctgatcctat

SEQ ID NO: 333795 - DNA, 20 bp, Artificial Sequence
  chemically synthesized
attttttagccgataggatc

SEQ ID NO: 333796 - DNA, 20 bp, Artificial Sequence
  chemically synthesized
gaatgggagtttaaaaatga

SEQ ID NO: 333797 - DNA, 20 bp, Artificial Sequence
  chemically synthesized
catttttaaactcccattca

SEQ ID NO: 333798 - DNA, 20 bp, Artificial Sequence
  chemically synthesized
caaaactacactatgaatgg

SEQ ID NO: 333799 - DNA, 20 bp, Artificial Sequence
  chemically synthesized
atcaaaactacactatgaat

SEQ ID NO: 333800 - DNA, 20 bp, Artificial Sequence
  chemically synthesized
tatcaaaactacactatgaa

SEQ ID NO: 333801 - DNA, 20 bp, Artificial Sequence
  chemically synthesized
ttaaactcccattcatagtg

SEQ ID NO: 333802 - DNA, 20 bp, Artificial Sequence
  chemically synthesized
ttgataaaaatcacatcctc

SEQ ID NO: 333803 - DNA, 20 bp, Artificial Sequence
  chemically synthesized
gccaattcgaaacgtgctag

SEQ ID NO: 333804 - DNA, 20 bp, Artificial Sequence
  chemically synthesized
agccaattcgaaacgtgcta

SEQ ID NO: 333805 - DNA, 20 bp, Artificial Sequence
  chemically synthesized
ggagccaattcgaaacgtgc

SEQ ID NO: 333806 - DNA, 20 bp, Artificial Sequence
  chemically synthesized
tcctctagcacgtttcgaat

SEQ ID NO: 333807 - DNA, 20 bp, Artificial Sequence
  chemically synthesized
cgtttcgaattggctccatt

SEQ ID NO: 333808 - DNA, 20 bp, Artificial Sequence
  chemically synthesized
atgatttattttgctcaatg

SEQ ID NO: 333809 - DNA, 20 bp, Artificial Sequence
  chemically synthesized
aaatgatttattttgctcaa

SEQ ID NO: 333810 - DNA, 20 bp, Artificial Sequence
  chemically synthesized
aataaatcatttttgttaaa

SEQ ID NO: 333811 - DNA, 20 bp, Artificial Sequence
  chemically synthesized
aaaagtaattcttgcaaatc

SEQ ID NO: 333812 - DNA, 20 bp, Artificial Sequence
  chemically synthesized
gctaggattgctagatttgc

SEQ ID NO: 333813 - DNA, 20 bp, Artificial Sequence
  chemically synthesized
tcttgcaaatctagcaatcc

SEQ ID NO: 333814 - DNA, 20 bp, Artificial Sequence
  chemically synthesized
atgaaatgtgctaggattgc

SEQ ID NO: 333815 - DNA, 20 bp, Artificial Sequence
  chemically synthesized
gcgtgggaatgaaatgtgct

SEQ ID NO: 333816 - DNA, 20 bp, Artificial Sequence
  chemically synthesized
agcgtgggaatgaaatgtgc

SEQ ID NO: 333817 - DNA, 20 bp, Artificial Sequence
  chemically synthesized
ccttataaatgttacagcgt

SEQ ID NO: 333818 - DNA, 20 bp, Artificial Sequence
  chemically synthesized
gccttataaatgttacagcg

SEQ ID NO: 333819 - DNA, 20 bp, Artificial Sequence
  chemically synthesized
aaatagccttataaatgtta

SEQ ID NO: 333820 - DNA, 20 bp, Artificial Sequence
  chemically synthesized
tcccacgctgtaacatttat

SEQ ID NO: 333821 - DNA, 20 bp, Artificial Sequence
  chemically synthesized
cccacgctgtaacatttata

SEQ ID NO: 333822 - DNA, 20 bp, Artificial Sequence
  chemically synthesized
ggaacccaatatacaagaaa

SEQ ID NO: 333823 - DNA, 20 bp, Artificial Sequence
  chemically synthesized
taaggctatttcttgtatat

SEQ ID NO: 333824 - DNA, 20 bp, Artificial Sequence
  chemically synthesized
aaggctatttcttgtatatt

SEQ ID NO: 333825 - DNA, 20 bp, Artificial Sequence
  chemically synthesized
ttgtatggaacccaatatac

SEQ ID NO: 333826 - DNA, 20 bp, Artificial Sequence
  chemically synthesized
tccaccctttcaatattgta

SEQ ID NO: 333827 - DNA, 20 bp, Artificial Sequence
  chemically synthesized
tgggttccatacaatattga

SEQ ID NO: 333828 - DNA, 20 bp, Artificial Sequence
  chemically synthesized
gggttccatacaatattgaa

SEQ ID NO: 333829 - DNA, 20 bp, Artificial Sequence
  chemically synthesized
ggttccatacaatattgaaa

SEQ ID NO: 333830 - DNA, 20 bp, Artificial Sequence
  chemically synthesized
tccatacaatattgaaaggg

SEQ ID NO: 333831 - DNA, 20 bp, Artificial Sequence
  chemically synthesized
aaagggtggaaaactccact

SEQ ID NO: 333832 - DNA, 20 bp, Artificial Sequence
  chemically synthesized
tatatgaggaagactcagtg

SEQ ID NO: 333833 - DNA, 20 bp, Artificial Sequence
  chemically synthesized
tctatatgaggaagactcag

SEQ ID NO: 333834 - DNA, 20 bp, Artificial Sequence
  chemically synthesized
ctttctatatgaggaagact

SEQ ID NO: 333835 - DNA, 20 bp, Artificial Sequence
  chemically synthesized
tccactgagtcttcctcata

SEQ ID NO: 333836 - DNA, 20 bp, Artificial Sequence
  chemically synthesized
ttagtactttctatatgagg

SEQ ID NO: 333837 - DNA, 20 bp, Artificial Sequence
  chemically synthesized
tgtttagtactttctatatg

SEQ ID NO: 333838 - DNA, 20 bp, Artificial Sequence
  chemically synthesized
ctgagtcttcctcatataga

SEQ ID NO: 333839 - DNA, 20 bp, Artificial Sequence
  chemically synthesized
atgtttagtactttctatat

SEQ ID NO: 333840 - DNA, 20 bp, Artificial Sequence
  chemically synthesized
gtcatattctcggcaatgtt

SEQ ID NO: 333841 - DNA, 20 bp, Artificial Sequence
  chemically synthesized
agaaagtactaaacattgcc

SEQ ID NO: 333842 - DNA, 20 bp, Artificial Sequence
  chemically synthesized
ctgaaaccaggtcatattct

SEQ ID NO: 333843 - DNA, 20 bp, Artificial Sequence
  chemically synthesized
acattgccgagaatatgacc

SEQ ID NO: 333844 - DNA, 20 bp, Artificial Sequence
  chemically synthesized
ccgagaatatgacctggttt

SEQ ID NO: 333845 - DNA, 20 bp, Artificial Sequence
  chemically synthesized
gaaaaagtcacactgaaacc

SEQ ID NO: 333846 - DNA, 20 bp, Artificial Sequence
  chemically synthesized
agaaaaagtcacactgaaac

SEQ ID NO: 333847 - DNA, 20 bp, Artificial Sequence
  chemically synthesized
tctgtagtatttataagaaa

SEQ ID NO: 333848 - DNA, 20 bp, Artificial Sequence
  chemically synthesized
gcaggctctgtagtatttat

SEQ ID NO: 333849 - DNA, 20 bp, Artificial Sequence
  chemically synthesized
actttttcttataaatacta

SEQ ID NO: 333850 - DNA, 20 bp, Artificial Sequence
  chemically synthesized
tttttcttataaatactaca

SEQ ID NO: 333851 - DNA, 20 bp, Artificial Sequence
  chemically synthesized
cttgtgtatagcaggctctg

SEQ ID NO: 333852 - DNA, 20 bp, Artificial Sequence
  chemically synthesized
aatttaaacttgtgtatagc

SEQ ID NO: 333853 - DNA, 20 bp, Artificial Sequence
  chemically synthesized
taatttaaacttgtgtatag

SEQ ID NO: 333854 - DNA, 20 bp, Artificial Sequence
  chemically synthesized
ctacagagcctgctatacac

SEQ ID NO: 333855 - DNA, 20 bp, Artificial Sequence
  chemically synthesized
tgctaatttaaacttgtgta

SEQ ID NO: 333856 - DNA, 20 bp, Artificial Sequence
  chemically synthesized
tgctatacacaagtttaaat

SEQ ID NO: 333857 - DNA, 20 bp, Artificial Sequence
  chemically synthesized
agtttaaattagcaaaatta

SEQ ID NO: 333858 - DNA, 20 bp, Artificial Sequence
  chemically synthesized
gtttaaattagcaaaattaa

SEQ ID NO: 333859 - DNA, 20 bp, Artificial Sequence
  chemically synthesized
ttaaattagcaaaattaaag

SEQ ID NO: 333860 - DNA, 20 bp, Artificial Sequence
  chemically synthesized
aaattagcaaaattaaagga

SEQ ID NO: 333861 - DNA, 20 bp, Artificial Sequence
  chemically synthesized
aaattaaaggagagcatatg

SEQ ID NO: 333862 - DNA, 20 bp, Artificial Sequence
  chemically synthesized
ttaaaggagagcatatgaag

SEQ ID NO: 333863 - DNA, 20 bp, Artificial Sequence
  chemically synthesized
agagcatatgaagaagcttg

SEQ ID NO: 333864 - DNA, 20 bp, Artificial Sequence
  chemically synthesized
tgtaagaaaaatataactgc

SEQ ID NO: 333865 - DNA, 20 bp, Artificial Sequence
  chemically synthesized
gcagttatatttttcttaca

SEQ ID NO: 333866 - DNA, 20 bp, Artificial Sequence
  chemically synthesized
ctaaaatatatattctatgt

SEQ ID NO: 333867 - DNA, 20 bp, Artificial Sequence
  chemically synthesized
cttacatagaatatatattt

SEQ ID NO: 333868 - DNA, 20 bp, Artificial Sequence
  chemically synthesized
aatatatattttagaatgaa

SEQ ID NO: 333869 - DNA, 20 bp, Artificial Sequence
  chemically synthesized
aatagataaaataattcact

SEQ ID NO: 333870 - DNA, 20 bp, Artificial Sequence
  chemically synthesized
aaaggaaatacatacattct

SEQ ID NO: 333871 - DNA, 20 bp, Artificial Sequence
  chemically synthesized
atgtatgtatttcctttacg

SEQ ID NO: 333872 - DNA, 20 bp, Artificial Sequence
  chemically synthesized
atttttctggatctacgtaa

SEQ ID NO: 333873 - DNA, 20 bp, Artificial Sequence
  chemically synthesized
gatttttctggatctacgta

SEQ ID NO: 333874 - DNA, 20 bp, Artificial Sequence
  chemically synthesized
gtatttcctttacgtagatc

SEQ ID NO: 333875 - DNA, 20 bp, Artificial Sequence
  chemically synthesized
actatttggggagatttttc

SEQ ID NO: 333876 - DNA, 20 bp, Artificial Sequence
  chemically synthesized
tccagaaaaatctccccaaa

SEQ ID NO: 333877 - DNA, 20 bp, Artificial Sequence
  chemically synthesized
tgctaattacactatttggg

SEQ ID NO: 333878 - DNA, 20 bp, Artificial Sequence
  chemically synthesized
attgctaattacactatttg

SEQ ID NO: 333879 - DNA, 20 bp, Artificial Sequence
  chemically synthesized
aattgctaattacactattt

SEQ ID NO: 333880 - DNA, 20 bp, Artificial Sequence
  chemically synthesized
aaattgctaattacactatt

SEQ ID NO: 333881 - DNA, 20 bp, Artificial Sequence
  chemically synthesized
atctccccaaatagtgtaat

SEQ ID NO: 333882 - DNA, 20 bp, Artificial Sequence
  chemically synthesized
agtgtaattagcaattttca

SEQ ID NO: 333883 - DNA, 20 bp, Artificial Sequence
  chemically synthesized
tatgtaacttcgaaaagtgt

SEQ ID NO: 333884 - DNA, 20 bp, Artificial Sequence
  chemically synthesized
atatgtaacttcgaaaagtg

SEQ ID NO: 333885 - DNA, 20 bp, Artificial Sequence
  chemically synthesized
agatgtacctacacttttcg

SEQ ID NO: 333886 - DNA, 20 bp, Artificial Sequence
  chemically synthesized
tttatatatgtaacttcgaa

SEQ ID NO: 333887 - DNA, 20 bp, Artificial Sequence
  chemically synthesized
acatatataaaacttttcat

SEQ ID NO: 333888 - DNA, 20 bp, Artificial Sequence
  chemically synthesized
aaaaacatgaggctcatgaa

SEQ ID NO: 333889 - DNA, 20 bp, Artificial Sequence
  chemically synthesized
taatggttataaaaaacatg

SEQ ID NO: 333890 - DNA, 20 bp, Artificial Sequence
  chemically synthesized
ctaatggttataaaaaacat

SEQ ID NO: 333891 - DNA, 20 bp, Artificial Sequence
  chemically synthesized
ctcatgttttttataaccat

SEQ ID NO: 333892 - DNA, 20 bp, Artificial Sequence
  chemically synthesized
atgttttttataaccattag

SEQ ID NO: 333893 - DNA, 20 bp, Artificial Sequence
  chemically synthesized
tctttgacaaaggctgctaa

SEQ ID NO: 333894 - DNA, 20 bp, Artificial Sequence
  chemically synthesized
accattagcagcctttgtca

SEQ ID NO: 333895 - DNA, 20 bp, Artificial Sequence
  chemically synthesized
tctaaggttctctttgacaa

SEQ ID NO: 333896 - DNA, 20 bp, Artificial Sequence
  chemically synthesized
cattagcagcctttgtcaaa

SEQ ID NO: 333897 - DNA, 20 bp, Artificial Sequence
  chemically synthesized
ctctaaggttctctttgaca

SEQ ID NO: 333898 - DNA, 20 bp, Artificial Sequence
  chemically synthesized
gcctttgtcaaagagaacct

SEQ ID NO: 333899 - DNA, 20 bp, Artificial Sequence
  chemically synthesized
ctttgtcaaagagaacctta

SEQ ID NO: 333900 - DNA, 20 bp, Artificial Sequence
  chemically synthesized
tttgtcaaagagaaccttag

SEQ ID NO: 333901 - DNA, 20 bp, Artificial Sequence
  chemically synthesized
tcattatgtaataacctcta

SEQ ID NO: 333902 - DNA, 20 bp, Artificial Sequence
  chemically synthesized
ttcattatgtaataacctct

SEQ ID NO: 333903 - DNA, 20 bp, Artificial Sequence
  chemically synthesized
tagaggttattacataatga

SEQ ID NO: 333904 - DNA, 20 bp, Artificial Sequence
  chemically synthesized
aggttattacataatgaaag

SEQ ID NO: 333905 - DNA, 20 bp, Artificial Sequence
  chemically synthesized
aatgaaagtagaaaccatta

SEQ ID NO: 333906 - DNA, 20 bp, Artificial Sequence
  chemically synthesized
atgaaagtagaaaccattac

SEQ ID NO: 333907 - DNA, 20 bp, Artificial Sequence
  chemically synthesized
ataaatatgaattcccgtaa

SEQ ID NO: 333908 - DNA, 20 bp, Artificial Sequence
  chemically synthesized
tacgggaattcatatttatg

SEQ ID NO: 333909 - DNA, 20 bp, Artificial Sequence
  chemically synthesized
atttatgaagaatcaacgta

SEQ ID NO: 333910 - DNA, 20 bp, Artificial Sequence
  chemically synthesized
gaatcaacgtatagtaaacc

SEQ ID NO: 333911 - DNA, 20 bp, Artificial Sequence
  chemically synthesized
atcaacgtatagtaaaccta

SEQ ID NO: 333912 - DNA, 20 bp, Artificial Sequence
  chemically synthesized
aacgtatagtaaacctagag

SEQ ID NO: 333913 - DNA, 20 bp, Artificial Sequence
  chemically synthesized
tttgttattgagtcttctct

SEQ ID NO: 333914 - DNA, 20 bp, Artificial Sequence
  chemically synthesized
ctttgttattgagtcttctc

SEQ ID NO: 333915 - DNA, 20 bp, Artificial Sequence
  chemically synthesized
ctagagaagactcaataaca

SEQ ID NO: 333916 - DNA, 20 bp, Artificial Sequence
  chemically synthesized
tgtgattctgctttgttatt

SEQ ID NO: 333917 - DNA, 20 bp, Artificial Sequence
  chemically synthesized
gagaagactcaataacaaag

SEQ ID NO: 333918 - DNA, 20 bp, Artificial Sequence
  chemically synthesized
ataacaaagcagaatcacat

SEQ ID NO: 333919 - DNA, 20 bp, Artificial Sequence
  chemically synthesized
taacaaagcagaatcacatg

SEQ ID NO: 333920 - DNA, 20 bp, Artificial Sequence
  chemically synthesized
aacaaagcagaatcacatga

SEQ ID NO: 333921 - DNA, 20 bp, Artificial Sequence
  chemically synthesized
atgagggaatcaataaaact

SEQ ID NO: 333922 - DNA, 20 bp, Artificial Sequence
  chemically synthesized
aagagctggtttgtttttcc

SEQ ID NO: 333923 - DNA, 20 bp, Artificial Sequence
  chemically synthesized
taaaacttggaaaaacaaac

SEQ ID NO: 333924 - DNA, 20 bp, Artificial Sequence
  chemically synthesized
tttatctcctcgtgaagagc

SEQ ID NO: 333925 - DNA, 20 bp, Artificial Sequence
  chemically synthesized
aaaacaaaccagctcttcac

SEQ ID NO: 333926 - DNA, 20 bp, Artificial Sequence
  chemically synthesized
aaacaaaccagctcttcacg

SEQ ID NO: 333927 - DNA, 20 bp, Artificial Sequence
  chemically synthesized
gccttttatctcctcgtgaa

SEQ ID NO: 333928 - DNA, 20 bp, Artificial Sequence
  chemically synthesized
acaaaccagctcttcacgag

SEQ ID NO: 333929 - DNA, 20 bp, Artificial Sequence
  chemically synthesized
gtgccttttatctcctcgtg

SEQ ID NO: 333930 - DNA, 20 bp, Artificial Sequence
  chemically synthesized
agctcttcacgaggagataa

SEQ ID NO: 333931 - DNA, 20 bp, Artificial Sequence
  chemically synthesized
gctcttcacgaggagataaa

SEQ ID NO: 333932 - DNA, 20 bp, Artificial Sequence
  chemically synthesized
ttttacttgcttgaattttt

SEQ ID NO: 333933 - DNA, 20 bp, Artificial Sequence
  chemically synthesized
taaaaggcactgaaaaattc

SEQ ID NO: 333934 - DNA, 20 bp, Artificial Sequence
  chemically synthesized
aggcactgaaaaattcaagc

SEQ ID NO: 333935 - DNA, 20 bp, Artificial Sequence
  chemically synthesized
tgaaaaattcaagcaagtaa

SEQ ID NO: 333936 - DNA, 20 bp, Artificial Sequence
  chemically synthesized
aaaattcaagcaagtaaaag

SEQ ID NO: 333937 - DNA, 20 bp, Artificial Sequence
  chemically synthesized
caagcaagtaaaagcagtgt

SEQ ID NO: 333938 - DNA, 20 bp, Artificial Sequence
  chemically synthesized
aaagcagtgttagattatct

SEQ ID NO: 333939 - DNA, 20 bp, Artificial Sequence
  chemically synthesized
gcagtgttagattatcttgg

SEQ ID NO: 333940 - DNA, 20 bp, Artificial Sequence
  chemically synthesized
gtgttagattatcttggaag

SEQ ID NO: 333941 - DNA, 20 bp, Artificial Sequence
  chemically synthesized
caaaccagagaactgcttcc

SEQ ID NO: 333942 - DNA, 20 bp, Artificial Sequence
  chemically synthesized
ttatcttggaagcagttctc

SEQ ID NO: 333943 - DNA, 20 bp, Artificial Sequence
  chemically synthesized
actctctgttgtacaaacca

SEQ ID NO: 333944 - DNA, 20 bp, Artificial Sequence
  chemically synthesized
ttactctctgttgtacaaac

SEQ ID NO: 333945 - DNA, 20 bp, Artificial Sequence
  chemically synthesized
cagttctctggtttgtacaa

SEQ ID NO: 333946 - DNA, 20 bp, Artificial Sequence
  chemically synthesized
gttctctggtttgtacaaca

SEQ ID NO: 333947 - DNA, 20 bp, Artificial Sequence
  chemically synthesized
tctctggtttgtacaacaga

SEQ ID NO: 333948 - DNA, 20 bp, Artificial Sequence
  chemically synthesized
caacagagagtaaatgttga

SEQ ID NO: 333949 - DNA, 20 bp, Artificial Sequence
  chemically synthesized
taaatgttgacagacctgtg

SEQ ID NO: 333950 - DNA, 20 bp, Artificial Sequence
  chemically synthesized
aaatgttgacagacctgtga

SEQ ID NO: 333951 - DNA, 20 bp, Artificial Sequence
  chemically synthesized
acggagcccatttccttcac

SEQ ID NO: 333952 - DNA, 20 bp, Artificial Sequence
  chemically synthesized
cacggagcccatttccttca

SEQ ID NO: 333953 - DNA, 20 bp, Artificial Sequence
  chemically synthesized
tgacagacctgtgaaggaaa

SEQ ID NO: 333954 - DNA, 20 bp, Artificial Sequence
  chemically synthesized
gacagacctgtgaaggaaat

SEQ ID NO: 333955 - DNA, 20 bp, Artificial Sequence
  chemically synthesized
tgaaggaaatgggctccgtg

SEQ ID NO: 333956 - DNA, 20 bp, Artificial Sequence
  chemically synthesized
gaaggaaatgggctccgtgt

SEQ ID NO: 333957 - DNA, 20 bp, Artificial Sequence
  chemically synthesized
aaggaaatgggctccgtgta

SEQ ID NO: 333958 - DNA, 20 bp, Artificial Sequence
  chemically synthesized
accacctctgaccctacacg

SEQ ID NO: 333959 - DNA, 20 bp, Artificial Sequence
  chemically synthesized
tcaccacctctgaccctaca

SEQ ID NO: 333960 - DNA, 20 bp, Artificial Sequence
  chemically synthesized
aaatgggctccgtgtagggt

SEQ ID NO: 333961 - DNA, 20 bp, Artificial Sequence
  chemically synthesized
atgggctccgtgtagggtca

SEQ ID NO: 333962 - DNA, 20 bp, Artificial Sequence
  chemically synthesized
tgggctccgtgtagggtcag

SEQ ID NO: 333963 - DNA, 20 bp, Artificial Sequence
  chemically synthesized
gctccgtgtagggtcagagg

SEQ ID NO: 333964 - DNA, 20 bp, Artificial Sequence
  chemically synthesized
agggtcagaggtggtgacat

SEQ ID NO: 333965 - DNA, 20 bp, Artificial Sequence
  chemically synthesized
gtcagaggtggtgacataag

SEQ ID NO: 333966 - DNA, 20 bp, Artificial Sequence
  chemically synthesized
tgacataagcagcctgtgtg

SEQ ID NO: 333967 - DNA, 20 bp, Artificial Sequence
  chemically synthesized
gacataagcagcctgtgtgt

SEQ ID NO: 333968 - DNA, 20 bp, Artificial Sequence
  chemically synthesized
caagagctatgcctacacac

SEQ ID NO: 333969 - DNA, 20 bp, Artificial Sequence
  chemically synthesized
tcaagagctatgcctacaca

SEQ ID NO: 333970 - DNA, 20 bp, Artificial Sequence
  chemically synthesized
aagcagcctgtgtgtaggca

SEQ ID NO: 333971 - DNA, 20 bp, Artificial Sequence
  chemically synthesized
gtaggcatagctcttgaatc

SEQ ID NO: 333972 - DNA, 20 bp, Artificial Sequence
  chemically synthesized
tcccctaagcctcgattcaa

SEQ ID NO: 333973 - DNA, 20 bp, Artificial Sequence
  chemically synthesized
taggcatagctcttgaatcg

SEQ ID NO: 333974 - DNA, 20 bp, Artificial Sequence
  chemically synthesized
cttcccctaagcctcgattc

SEQ ID NO: 333975 - DNA, 20 bp, Artificial Sequence
  chemically synthesized
atagctcttgaatcgaggct

SEQ ID NO: 333976 - DNA, 20 bp, Artificial Sequence
  chemically synthesized
tagctcttgaatcgaggctt

SEQ ID NO: 333977 - DNA, 20 bp, Artificial Sequence
  chemically synthesized
agctcttgaatcgaggctta

SEQ ID NO: 333978 - DNA, 20 bp, Artificial Sequence
  chemically synthesized
gctcttgaatcgaggcttag

SEQ ID NO: 333979 - DNA, 20 bp, Artificial Sequence
  chemically synthesized
cttgaatcgaggcttagggg

SEQ ID NO: 333980 - DNA, 20 bp, Artificial Sequence
  chemically synthesized
atgagagaacttcttcccct

SEQ ID NO: 333981 - DNA, 20 bp, Artificial Sequence
  chemically synthesized
gaatcgaggcttaggggaag

SEQ ID NO: 333982 - DNA, 20 bp, Artificial Sequence
  chemically synthesized
agtctagcacagggatatga

SEQ ID NO: 333983 - DNA, 20 bp, Artificial Sequence
  chemically synthesized
tcagtctagcacagggatat

SEQ ID NO: 333984 - DNA, 20 bp, Artificial Sequence
  chemically synthesized
gttctctcatatccctgtgc

SEQ ID NO: 333985 - DNA, 20 bp, Artificial Sequence
  chemically synthesized
atcacggtcagtctagcaca

SEQ ID NO: 333986 - DNA, 20 bp, Artificial Sequence
  chemically synthesized
gatcacggtcagtctagcac

SEQ ID NO: 333987 - DNA, 20 bp, Artificial Sequence
  chemically synthesized
agatcacggtcagtctagca

SEQ ID NO: 333988 - DNA, 20 bp, Artificial Sequence
  chemically synthesized
tctgcagatcacggtcagtc

SEQ ID NO: 333989 - DNA, 20 bp, Artificial Sequence
  chemically synthesized
ccttctctgcagatcacggt

SEQ ID NO: 333990 - DNA, 20 bp, Artificial Sequence
  chemically synthesized
gctagactgaccgtgatctg

SEQ ID NO: 333991 - DNA, 20 bp, Artificial Sequence
  chemically synthesized
aaacccttctctgcagatca

SEQ ID NO: 333992 - DNA, 20 bp, Artificial Sequence
  chemically synthesized
tagactgaccgtgatctgca

SEQ ID NO: 333993 - DNA, 20 bp, Artificial Sequence
  chemically synthesized
actgaccgtgatctgcagag

SEQ ID NO: 333994 - DNA, 20 bp, Artificial Sequence
  chemically synthesized
ctgaccgtgatctgcagaga

SEQ ID NO: 333995 - DNA, 20 bp, Artificial Sequence
  chemically synthesized
tgaccgtgatctgcagagaa

SEQ ID NO: 333996 - DNA, 20 bp, Artificial Sequence
  chemically synthesized
ctcccccaaacccttctctg

SEQ ID NO: 333997 - DNA, 20 bp, Artificial Sequence
  chemically synthesized
gtgatctgcagagaagggtt

SEQ ID NO: 333998 - DNA, 20 bp, Artificial Sequence
  chemically synthesized
tgatctgcagagaagggttt

SEQ ID NO: 333999 - DNA, 20 bp, Artificial Sequence
  chemically synthesized
gatctgcagagaagggtttg

SEQ ID NO: 334000 - DNA, 20 bp, Artificial Sequence
  chemically synthesized
atctgcagagaagggtttgg

SEQ ID NO: 334001 - DNA, 20 bp, Artificial Sequence
  chemically synthesized
ctgcagagaagggtttgggg

SEQ ID NO: 334002 - DNA, 20 bp, Artificial Sequence
  chemically synthesized
cagagaagggtttgggggag

SEQ ID NO: 334003 - DNA, 20 bp, Artificial Sequence
  chemically synthesized
gaagggtttgggggagtgga

SEQ ID NO: 334004 - DNA, 20 bp, Artificial Sequence
  chemically synthesized
agggtttgggggagtggata

SEQ ID NO: 334005 - DNA, 20 bp, Artificial Sequence
  chemically synthesized
ggtttgggggagtggataga

SEQ ID NO: 334006 - DNA, 20 bp, Artificial Sequence
  chemically synthesized
gtttgggggagtggatagag

SEQ ID NO: 334007 - DNA, 20 bp, Artificial Sequence
  chemically synthesized
ttgggggagtggatagagag

SEQ ID NO: 334008 - DNA, 20 bp, Artificial Sequence
  chemically synthesized
tgggggagtggatagagagg

SEQ ID NO: 334009 - DNA, 20 bp, Artificial Sequence
  chemically synthesized
gggggagtggatagagagga

SEQ ID NO: 334010 - DNA, 20 bp, Artificial Sequence
  chemically synthesized
ggggagtggatagagaggag

SEQ ID NO: 334011 - DNA, 20 bp, Artificial Sequence
  chemically synthesized
gggagtggatagagaggagg

SEQ ID NO: 334012 - DNA, 20 bp, Artificial Sequence
  chemically synthesized
agaggagggggaaaaaccat

SEQ ID NO: 334013 - DNA, 20 bp, Artificial Sequence
  chemically synthesized
tagtcctttcgggttactta

SEQ ID NO: 334014 - DNA, 20 bp, Artificial Sequence
  chemically synthesized
aaaaaccataagtaacccga

SEQ ID NO: 334015 - DNA, 20 bp, Artificial Sequence
  chemically synthesized
aaaaccataagtaacccgaa

SEQ ID NO: 334016 - DNA, 20 bp, Artificial Sequence
  chemically synthesized
tgttggaaagtagtcctttc

SEQ ID NO: 334017 - DNA, 20 bp, Artificial Sequence
  chemically synthesized
atgttggaaagtagtccttt

SEQ ID NO: 334018 - DNA, 20 bp, Artificial Sequence
  chemically synthesized
ttttctaccatgttggaaag

SEQ ID NO: 334019 - DNA, 20 bp, Artificial Sequence
  chemically synthesized
gaaaggactactttccaaca

SEQ ID NO: 334020 - DNA, 20 bp, Artificial Sequence
  chemically synthesized
ctgttttctaccatgttgga

SEQ ID NO: 334021 - DNA, 20 bp, Artificial Sequence
  chemically synthesized
aggactactttccaacatgg

SEQ ID NO: 334022 - DNA, 20 bp, Artificial Sequence
  chemically synthesized
tgttctgttttctaccatgt

SEQ ID NO: 334023 - DNA, 20 bp, Artificial Sequence
  chemically synthesized
ctttccaacatggtagaaaa

SEQ ID NO: 334024 - DNA, 20 bp, Artificial Sequence
  chemically synthesized
gtagaaaacagaacattaaa

SEQ ID NO: 334025 - DNA, 20 bp, Artificial Sequence
  chemically synthesized
aacagaacattaaatggaaa

SEQ ID NO: 334026 - DNA, 20 bp, Artificial Sequence
  chemically synthesized
gaacattaaatggaaatggt

SEQ ID NO: 334027 - DNA, 20 bp, Artificial Sequence
  chemically synthesized
gaatatcatttatatatgtt

SEQ ID NO: 334028 - DNA, 20 bp, Artificial Sequence
  chemically synthesized
atataaatgatattcgaaat

SEQ ID NO: 334029 - DNA, 20 bp, Artificial Sequence
  chemically synthesized
attcgaaattggtatactcc

SEQ ID NO: 334030 - DNA, 20 bp, Artificial Sequence
  chemically synthesized
attaagtgccttcattctgg

SEQ ID NO: 334031 - DNA, 20 bp, Artificial Sequence
  chemically synthesized
attggtatactcccagaatg

SEQ ID NO: 334032 - DNA, 20 bp, Artificial Sequence
  chemically synthesized
ttggtatactcccagaatga

SEQ ID NO: 334033 - DNA, 20 bp, Artificial Sequence
  chemically synthesized
atattaagtgccttcattct

SEQ ID NO: 334034 - DNA, 20 bp, Artificial Sequence
  chemically synthesized
gatattaagtgccttcattc

SEQ ID NO: 334035 - DNA, 20 bp, Artificial Sequence
  chemically synthesized
ttactctccaacatgatatt

SEQ ID NO: 334036 - DNA, 20 bp, Artificial Sequence
  chemically synthesized
gaaggcacttaatatcatgt

SEQ ID NO: 334037 - DNA, 20 bp, Artificial Sequence
  chemically synthesized
aggcacttaatatcatgttg

SEQ ID NO: 334038 - DNA, 20 bp, Artificial Sequence
  chemically synthesized
gcacttaatatcatgttgga

SEQ ID NO: 334039 - DNA, 20 bp, Artificial Sequence
  chemically synthesized
atgttggagagtaaatgatc

SEQ ID NO: 334040 - DNA, 20 bp, Artificial Sequence
  chemically synthesized
tgttggagagtaaatgatct

SEQ ID NO: 334041 - DNA, 20 bp, Artificial Sequence
  chemically synthesized
tggagagtaaatgatctggg

SEQ ID NO: 334042 - DNA, 20 bp, Artificial Sequence
  chemically synthesized
atagcatgctcatatcttcc

SEQ ID NO: 334043 - DNA, 20 bp, Artificial Sequence
  chemically synthesized
taaatgatctgggaagatat

SEQ ID NO: 334044 - DNA, 20 bp, Artificial Sequence
  chemically synthesized
gaagatatgagcatgctatt

SEQ ID NO: 334045 - DNA, 20 bp, Artificial Sequence
  chemically synthesized
ttggaatcctcatggctaaa

SEQ ID NO: 334046 - DNA, 20 bp, Artificial Sequence
  chemically synthesized
tgagcatgctatttagccat

SEQ ID NO: 334047 - DNA, 20 bp, Artificial Sequence
  chemically synthesized
gagcatgctatttagccatg

SEQ ID NO: 334048 - DNA, 20 bp, Artificial Sequence
  chemically synthesized
gtgttactttggaatcctca

SEQ ID NO: 334049 - DNA, 20 bp, Artificial Sequence
  chemically synthesized
atttagccatgaggattcca

SEQ ID NO: 334050 - DNA, 20 bp, Artificial Sequence
  chemically synthesized
atgttggagttgtgttactt

SEQ ID NO: 334051 - DNA, 20 bp, Artificial Sequence
  chemically synthesized
accatcccatataaatgttg

SEQ ID NO: 334052 - DNA, 20 bp, Artificial Sequence
  chemically synthesized
gtaccatcccatataaatgt

SEQ ID NO: 334053 - DNA, 20 bp, Artificial Sequence
  chemically synthesized
acacaactccaacatttata

SEQ ID NO: 334054 - DNA, 20 bp, Artificial Sequence
  chemically synthesized
cacaactccaacatttatat

SEQ ID NO: 334055 - DNA, 20 bp, Artificial Sequence
  chemically synthesized
actccaacatttatatggga

SEQ ID NO: 334056 - DNA, 20 bp, Artificial Sequence
  chemically synthesized
tgggatggtactcttcaatc

SEQ ID NO: 334057 - DNA, 20 bp, Artificial Sequence
  chemically synthesized
cctgtttttgccggattgaa

SEQ ID NO: 334058 - DNA, 20 bp, Artificial Sequence
  chemically synthesized
tgcctgtttttgccggattg

SEQ ID NO: 334059 - DNA, 20 bp, Artificial Sequence
  chemically synthesized
actcttcaatccggcaaaaa

SEQ ID NO: 334060 - DNA, 20 bp, Artificial Sequence
  chemically synthesized
ttatggatgcctgtttttgc

SEQ ID NO: 334061 - DNA, 20 bp, Artificial Sequence
  chemically synthesized
ctcttcaatccggcaaaaac

SEQ ID NO: 334062 - DNA, 20 bp, Artificial Sequence
  chemically synthesized
cggcaaaaacaggcatccat

SEQ ID NO: 334063 - DNA, 20 bp, Artificial Sequence
  chemically synthesized
gatttagagaaaattgctta

SEQ ID NO: 334064 - DNA, 20 bp, Artificial Sequence
  chemically synthesized
ttttatttactttggattta

SEQ ID NO: 334065 - DNA, 20 bp, Artificial Sequence
  chemically synthesized
agcaattttctctaaatcca

SEQ ID NO: 334066 - DNA, 20 bp, Artificial Sequence
  chemically synthesized
gtttttatttactttggatt

SEQ ID NO: 334067 - DNA, 20 bp, Artificial Sequence
  chemically synthesized
aattctgtttttatttactt

SEQ ID NO: 334068 - DNA, 20 bp, Artificial Sequence
  chemically synthesized
aaatccaaagtaaataaaaa

SEQ ID NO: 334069 - DNA, 20 bp, Artificial Sequence
  chemically synthesized
taaataaaaacagaattcat

SEQ ID NO: 334070 - DNA, 20 bp, Artificial Sequence
  chemically synthesized
aaataaaaacagaattcatc

SEQ ID NO: 334071 - DNA, 20 bp, Artificial Sequence
  chemically synthesized
aattcatcaggtccataccc

SEQ ID NO: 334072 - DNA, 20 bp, Artificial Sequence
  chemically synthesized
ttttagtcctttccagggta

SEQ ID NO: 334073 - DNA, 20 bp, Artificial Sequence
  chemically synthesized
catcaggtccataccctgga

SEQ ID NO: 334074 - DNA, 20 bp, Artificial Sequence
  chemically synthesized
atcaggtccataccctggaa

SEQ ID NO: 334075 - DNA, 20 bp, Artificial Sequence
  chemically synthesized
gaaatttttagtcctttcca

SEQ ID NO: 334076 - DNA, 20 bp, Artificial Sequence
  chemically synthesized
tgaaatttttagtcctttcc

SEQ ID NO: 334077 - DNA, 20 bp, Artificial Sequence
  chemically synthesized
atgaaatttttagtcctttc

SEQ ID NO: 334078 - DNA, 20 bp, Artificial Sequence
  chemically synthesized
gtattagcttatgaaatttt

SEQ ID NO: 334079 - DNA, 20 bp, Artificial Sequence
  chemically synthesized
gaaaggactaaaaatttcat

SEQ ID NO: 334080 - DNA, 20 bp, Artificial Sequence
  chemically synthesized
aaaaatttcataagctaata

SEQ ID NO: 334081 - DNA, 20 bp, Artificial Sequence
  chemically synthesized
aaatttcataagctaataca

SEQ ID NO: 334082 - DNA, 20 bp, Artificial Sequence
  chemically synthesized
ttgctgagctagctctgtat

SEQ ID NO: 334083 - DNA, 20 bp, Artificial Sequence
  chemically synthesized
ttcataagctaatacagagc

SEQ ID NO: 334084 - DNA, 20 bp, Artificial Sequence
  chemically synthesized
aagctaatacagagctagct

SEQ ID NO: 334085 - DNA, 20 bp, Artificial Sequence
  chemically synthesized
actctctcactttgctgagc

SEQ ID NO: 334086 - DNA, 20 bp, Artificial Sequence
  chemically synthesized
aatacagagctagctcagca

SEQ ID NO: 334087 - DNA, 20 bp, Artificial Sequence
  chemically synthesized
ccaaactctctcactttgct

SEQ ID NO: 334088 - DNA, 20 bp, Artificial Sequence
  chemically synthesized
cagagctagctcagcaaagt

SEQ ID NO: 334089 - DNA, 20 bp, Artificial Sequence
  chemically synthesized
gagctagctcagcaaagtga

SEQ ID NO: 334090 - DNA, 20 bp, Artificial Sequence
  chemically synthesized
gctagctcagcaaagtgaga

SEQ ID NO: 334091 - DNA, 20 bp, Artificial Sequence
  chemically synthesized
ctcagcaaagtgagagagtt

SEQ ID NO: 334092 - DNA, 20 bp, Artificial Sequence
  chemically synthesized
aaagtgagagagtttggcct

SEQ ID NO: 334093 - DNA, 20 bp, Artificial Sequence
  chemically synthesized
agtgagagagtttggcctaa

SEQ ID NO: 334094 - DNA, 20 bp, Artificial Sequence
  chemically synthesized
tgaatgtgtggagagctctt

SEQ ID NO: 334095 - DNA, 20 bp, Artificial Sequence
  chemically synthesized
ctgaatgtgtggagagctct

SEQ ID NO: 334096 - DNA, 20 bp, Artificial Sequence
  chemically synthesized
atttctgctgaatgtgtgga

SEQ ID NO: 334097 - DNA, 20 bp, Artificial Sequence
  chemically synthesized
acatttctgctgaatgtgtg

SEQ ID NO: 334098 - DNA, 20 bp, Artificial Sequence
  chemically synthesized
ctaagagctctccacacatt

SEQ ID NO: 334099 - DNA, 20 bp, Artificial Sequence
  chemically synthesized
caacatttctgctgaatgtg

SEQ ID NO: 334100 - DNA, 20 bp, Artificial Sequence
  chemically synthesized
agagctctccacacattcag

SEQ ID NO: 334101 - DNA, 20 bp, Artificial Sequence
  chemically synthesized
attcagcagaaatgttgcta

SEQ ID NO: 334102 - DNA, 20 bp, Artificial Sequence
  chemically synthesized
ttcagcagaaatgttgctaa

SEQ ID NO: 334103 - DNA, 20 bp, Artificial Sequence
  chemically synthesized
aacaacagtgaagaaacctt

SEQ ID NO: 334104 - DNA, 20 bp, Artificial Sequence
  chemically synthesized
ctcaggcacaaacaacagtg

SEQ ID NO: 334105 - DNA, 20 bp, Artificial Sequence
  chemically synthesized
gctttctcaggcacaaacaa

SEQ ID NO: 334106 - DNA, 20 bp, Artificial Sequence
  chemically synthesized
cttcactgttgtttgtgcct

SEQ ID NO: 334107 - DNA, 20 bp, Artificial Sequence
  chemically synthesized
actgttgtttgtgcctgaga

SEQ ID NO: 334108 - DNA, 20 bp, Artificial Sequence
  chemically synthesized
atgttttcctatgctttctc

SEQ ID NO: 334109 - DNA, 20 bp, Artificial Sequence
  chemically synthesized
gatgttttcctatgctttct

SEQ ID NO: 334110 - DNA, 20 bp, Artificial Sequence
  chemically synthesized
tgtttgtgcctgagaaagca

SEQ ID NO: 334111 - DNA, 20 bp, Artificial Sequence
  chemically synthesized
gtttgtgcctgagaaagcat

SEQ ID NO: 334112 - DNA, 20 bp, Artificial Sequence
  chemically synthesized
tctctcaacagtgggtggtt

SEQ ID NO: 334113 - DNA, 20 bp, Artificial Sequence
  chemically synthesized
ttctttctctcaacagtggg

SEQ ID NO: 334114 - DNA, 20 bp, Artificial Sequence
  chemically synthesized
catccaaaccacccactgtt

SEQ ID NO: 334115 - DNA, 20 bp, Artificial Sequence
  chemically synthesized
ttgttctttctctcaacagt

SEQ ID NO: 334116 - DNA, 20 bp, Artificial Sequence
  chemically synthesized
tccaaaccacccactgttga

SEQ ID NO: 334117 - DNA, 20 bp, Artificial Sequence
  chemically synthesized
cttgttctttctctcaacag

SEQ ID NO: 334118 - DNA, 20 bp, Artificial Sequence
  chemically synthesized
tggcttgttctttctctcaa

SEQ ID NO: 334119 - DNA, 20 bp, Artificial Sequence
  chemically synthesized
aaccacccactgttgagaga

SEQ ID NO: 334120 - DNA, 20 bp, Artificial Sequence
  chemically synthesized
ccactgttgagagaaagaac

SEQ ID NO: 334121 - DNA, 20 bp, Artificial Sequence
  chemically synthesized
gaaagaacaagccaatgtca

SEQ ID NO: 334122 - DNA, 20 bp, Artificial Sequence
  chemically synthesized
gtggggttcttccatgacat

SEQ ID NO: 334123 - DNA, 20 bp, Artificial Sequence
  chemically synthesized
agaacaagccaatgtcatgg

SEQ ID NO: 334124 - DNA, 20 bp, Artificial Sequence
  chemically synthesized
taattgtatagaatttagtg

SEQ ID NO: 334125 - DNA, 20 bp, Artificial Sequence
  chemically synthesized
ataattgtatagaatttagt

SEQ ID NO: 334126 - DNA, 20 bp, Artificial Sequence
  chemically synthesized
cataattgtatagaatttag

SEQ ID NO: 334127 - DNA, 20 bp, Artificial Sequence
  chemically synthesized
ttacataattgtatagaatt

SEQ ID NO: 334128 - DNA, 20 bp, Artificial Sequence
  chemically synthesized
ttcttcgttacataattgta

SEQ ID NO: 334129 - DNA, 20 bp, Artificial Sequence
  chemically synthesized
ttctatacaattatgtaacg

SEQ ID NO: 334130 - DNA, 20 bp, Artificial Sequence
  chemically synthesized
actatttcaaataaacaata

SEQ ID NO: 334131 - DNA, 20 bp, Artificial Sequence
  chemically synthesized
tctttattgtttatttgaaa

SEQ ID NO: 334132 - DNA, 20 bp, Artificial Sequence
  chemically synthesized
taacaattttgaaaatagaa

SEQ ID NO: 334133 - DNA, 20 bp, Artificial Sequence
  chemically synthesized
caggataacaattttgaaaa

SEQ ID NO: 334134 - DNA, 20 bp, Artificial Sequence
  chemically synthesized
aagtcagattttgattattc

SEQ ID NO: 334135 - DNA, 20 bp, Artificial Sequence
  chemically synthesized
aaagtcagattttgattatt

SEQ ID NO: 334136 - DNA, 20 bp, Artificial Sequence
  chemically synthesized
gacaatatgatgtacaaagt

SEQ ID NO: 334137 - DNA, 20 bp, Artificial Sequence
  chemically synthesized
ttatgacaatatgatgtaca

SEQ ID NO: 334138 - DNA, 20 bp, Artificial Sequence
  chemically synthesized
ttgtacatcatattgtcata

SEQ ID NO: 334139 - DNA, 20 bp, Artificial Sequence
  chemically synthesized
agaaagattaaaggcaaata

SEQ ID NO: 334140 - DNA, 20 bp, Artificial Sequence
  chemically synthesized
aagagctagagaaagattaa

SEQ ID NO: 334141 - DNA, 20 bp, Artificial Sequence
  chemically synthesized
aaagagctagagaaagatta

SEQ ID NO: 334142 - DNA, 20 bp, Artificial Sequence
  chemically synthesized
atttgcctttaatctttctc

SEQ ID NO: 334143 - DNA, 20 bp, Artificial Sequence
  chemically synthesized
ctagaacaaagagctagaga

SEQ ID NO: 334144 - DNA, 20 bp, Artificial Sequence
  chemically synthesized
tcaactagaacaaagagcta

SEQ ID NO: 334145 - DNA, 20 bp, Artificial Sequence
  chemically synthesized
catcaactagaacaaagagc

SEQ ID NO: 334146 - DNA, 20 bp, Artificial Sequence
  chemically synthesized
ctttctctagctctttgttc

SEQ ID NO: 334147 - DNA, 20 bp, Artificial Sequence
  chemically synthesized
tcttcatcaactagaacaaa

SEQ ID NO: 334148 - DNA, 20 bp, Artificial Sequence
  chemically synthesized
aatcttcatcaactagaaca

SEQ ID NO: 334149 - DNA, 20 bp, Artificial Sequence
  chemically synthesized
gctctttgttctagttgatg

SEQ ID NO: 334150 - DNA, 20 bp, Artificial Sequence
  chemically synthesized
actctaaaatcttcatcaac

SEQ ID NO: 334151 - DNA, 20 bp, Artificial Sequence
  chemically synthesized
gttctagttgatgaagattt

SEQ ID NO: 334152 - DNA, 20 bp, Artificial Sequence
  chemically synthesized
tctagttgatgaagatttta

SEQ ID NO: 334153 - DNA, 20 bp, Artificial Sequence
  chemically synthesized
ttagagtttaatatgtacgt

SEQ ID NO: 334154 - DNA, 20 bp, Artificial Sequence
  chemically synthesized
gtaacacacaatgaaatgaa

SEQ ID NO: 334155 - DNA, 20 bp, Artificial Sequence
  chemically synthesized
tgtaacacacaatgaaatga

SEQ ID NO: 334156 - DNA, 20 bp, Artificial Sequence
  chemically synthesized
tttcattgtgtgttacacaa

SEQ ID NO: 334157 - DNA, 20 bp, Artificial Sequence
  chemically synthesized
tgtaccatatcataggaata

SEQ ID NO: 334158 - DNA, 20 bp, Artificial Sequence
  chemically synthesized
tgttctatattcctatgata

SEQ ID NO: 334159 - DNA, 20 bp, Artificial Sequence
  chemically synthesized
attcatatgtaccatatcat

SEQ ID NO: 334160 - DNA, 20 bp, Artificial Sequence
  chemically synthesized
tattcatatgtaccatatca

SEQ ID NO: 334161 - DNA, 20 bp, Artificial Sequence
  chemically synthesized
tatgatatggtacatatgaa

SEQ ID NO: 334162 - DNA, 20 bp, Artificial Sequence
  chemically synthesized
atgttttgaaatgaatattg

SEQ ID NO: 334163 - DNA, 20 bp, Artificial Sequence
  chemically synthesized
aatgaatattgtagtcaatg

SEQ ID NO: 334164 - DNA, 20 bp, Artificial Sequence
  chemically synthesized
gtcaatgaagcaaaattgaa

SEQ ID NO: 334165 - DNA, 20 bp, Artificial Sequence
  chemically synthesized
tcaatgaagcaaaattgaaa

SEQ ID NO: 334166 - DNA, 20 bp, Artificial Sequence
  chemically synthesized
gaagcaaaattgaaaaggtt

SEQ ID NO: 334167 - DNA, 20 bp, Artificial Sequence
  chemically synthesized
tgtatatgtacaaaaagaga

SEQ ID NO: 334168 - DNA, 20 bp, Artificial Sequence
  chemically synthesized
tgtatgtatatgtacaaaaa

SEQ ID NO: 334169 - DNA, 20 bp, Artificial Sequence
  chemically synthesized
aatgtatgtatatgtacaaa

SEQ ID NO: 334170 - DNA, 20 bp, Artificial Sequence
  chemically synthesized
ttttgtacatatacatacat

SEQ ID NO: 334171 - DNA, 20 bp, Artificial Sequence
  chemically synthesized
tttgtacatatacatacatt

SEQ ID NO: 334172 - DNA, 20 bp, Artificial Sequence
  chemically synthesized
tatacacgtgtatatataca

SEQ ID NO: 334173 - DNA, 20 bp, Artificial Sequence
  chemically synthesized
atacacgtgtatatacatat

SEQ ID NO: 334174 - DNA, 20 bp, Artificial Sequence
  chemically synthesized
tctgttttatatgcattttt

SEQ ID NO: 334175 - DNA, 20 bp, Artificial Sequence
  chemically synthesized
ttctgttttatatgcatttt

SEQ ID NO: 334176 - DNA, 20 bp, Artificial Sequence
  chemically synthesized
acctaaaaatgcatataaaa

SEQ ID NO: 334177 - DNA, 20 bp, Artificial Sequence
  chemically synthesized
aaaacagaaaacatcttgaa

SEQ ID NO: 334178 - DNA, 20 bp, Artificial Sequence
  chemically synthesized
acagaaaacatcttgaatag

SEQ ID NO: 334179 - DNA, 20 bp, Artificial Sequence
  chemically synthesized
gtaaaggacagctactattc

SEQ ID NO: 334180 - DNA, 20 bp, Artificial Sequence
  chemically synthesized
caggtaaagtgtgtaaagga

SEQ ID NO: 334181 - DNA, 20 bp, Artificial Sequence
  chemically synthesized
tcaacaggtaaagtgtgtaa

SEQ ID NO: 334182 - DNA, 20 bp, Artificial Sequence
  chemically synthesized
ctcaacaggtaaagtgtgta

SEQ ID NO: 334183 - DNA, 20 bp, Artificial Sequence
  chemically synthesized
tgcactattctcaacaggta

SEQ ID NO: 334184 - DNA, 20 bp, Artificial Sequence
  chemically synthesized
ctttacacactttacctgtt

SEQ ID NO: 334185 - DNA, 20 bp, Artificial Sequence
  chemically synthesized
tcaaatgcactattctcaac

SEQ ID NO: 334186 - DNA, 20 bp, Artificial Sequence
  chemically synthesized
cacactttacctgttgagaa

SEQ ID NO: 334187 - DNA, 20 bp, Artificial Sequence
  chemically synthesized
atcaaatgcactattctcaa

SEQ ID NO: 334188 - DNA, 20 bp, Artificial Sequence
  chemically synthesized
tgactaaagaagaacatttt

SEQ ID NO: 334189 - DNA, 20 bp, Artificial Sequence
  chemically synthesized
taactgaaaatgttcttctt

SEQ ID NO: 334190 - DNA, 20 bp, Artificial Sequence
  chemically synthesized
gccacctaaagtgactaaag

SEQ ID NO: 334191 - DNA, 20 bp, Artificial Sequence
  chemically synthesized
aaggccacctaaagtgacta

SEQ ID NO: 334192 - DNA, 20 bp, Artificial Sequence
  chemically synthesized
atgttcttctttagtcactt

SEQ ID NO: 334193 - DNA, 20 bp, Artificial Sequence
  chemically synthesized
tgttcttctttagtcacttt

SEQ ID NO: 334194 - DNA, 20 bp, Artificial Sequence
  chemically synthesized
tcttctttagtcactttagg

SEQ ID NO: 334195 - DNA, 20 bp, Artificial Sequence
  chemically synthesized
aatgttgccaaggccaccta

SEQ ID NO: 334196 - DNA, 20 bp, Artificial Sequence
  chemically synthesized
ttagtcactttaggtggcct

SEQ ID NO: 334197 - DNA, 20 bp, Artificial Sequence
  chemically synthesized
aggaagtggaaatgttgcca

SEQ ID NO: 334198 - DNA, 20 bp, Artificial Sequence
  chemically synthesized
caggaagtggaaatgttgcc

SEQ ID NO: 334199 - DNA, 20 bp, Artificial Sequence
  chemically synthesized
ttggcaacatttccacttcc

SEQ ID NO: 334200 - DNA, 20 bp, Artificial Sequence
  chemically synthesized
cattgaagccatccaggaag

SEQ ID NO: 334201 - DNA, 20 bp, Artificial Sequence
  chemically synthesized
caacatttccacttcctgga

SEQ ID NO: 334202 - DNA, 20 bp, Artificial Sequence
  chemically synthesized
gagcattgaagccatccagg

SEQ ID NO: 334203 - DNA, 20 bp, Artificial Sequence
  chemically synthesized
agtgagcattgaagccatcc

SEQ ID NO: 334204 - DNA, 20 bp, Artificial Sequence
  chemically synthesized
aagtgagcattgaagccatc

SEQ ID NO: 334205 - DNA, 20 bp, Artificial Sequence
  chemically synthesized
gcctcaacaagtgagcattg

SEQ ID NO: 334206 - DNA, 20 bp, Artificial Sequence
  chemically synthesized
ggcttcaatgctcacttgtt

SEQ ID NO: 334207 - DNA, 20 bp, Artificial Sequence
  chemically synthesized
caagttttgcctcaacaagt

SEQ ID NO: 334208 - DNA, 20 bp, Artificial Sequence
  chemically synthesized
gcttcaatgctcacttgttg

SEQ ID NO: 334209 - DNA, 20 bp, Artificial Sequence
  chemically synthesized
cttccaagttttgcctcaac

SEQ ID NO: 334210 - DNA, 20 bp, Artificial Sequence
  chemically synthesized
tcacttgttgaggcaaaact

SEQ ID NO: 334211 - DNA, 20 bp, Artificial Sequence
  chemically synthesized
cttgttgaggcaaaacttgg

SEQ ID NO: 334212 - DNA, 20 bp, Artificial Sequence
  chemically synthesized
tgttgaggcaaaacttggaa

SEQ ID NO: 334213 - DNA, 20 bp, Artificial Sequence
  chemically synthesized
gtacatcacatcactcttcc

SEQ ID NO: 334214 - DNA, 20 bp, Artificial Sequence
  chemically synthesized
agagtgatgtgatgtacatt

SEQ ID NO: 334215 - DNA, 20 bp, Artificial Sequence
  chemically synthesized
tgatgtgatgtacattaaga

SEQ ID NO: 334216 - DNA, 20 bp, Artificial Sequence
  chemically synthesized
attaagatggacttcttatc

SEQ ID NO: 334217 - DNA, 20 bp, Artificial Sequence
  chemically synthesized
ataccacctatccagataag

SEQ ID NO: 334218 - DNA, 20 bp, Artificial Sequence
  chemically synthesized
agatggacttcttatctgga

SEQ ID NO: 334219 - DNA, 20 bp, Artificial Sequence
  chemically synthesized
ttgataccacctatccagat

SEQ ID NO: 334220 - DNA, 20 bp, Artificial Sequence
  chemically synthesized
gatggacttcttatctggat

SEQ ID NO: 334221 - DNA, 20 bp, Artificial Sequence
  chemically synthesized
ggacttcttatctggatagg

SEQ ID NO: 334222 - DNA, 20 bp, Artificial Sequence
  chemically synthesized
agatgttgataccacctatc

SEQ ID NO: 334223 - DNA, 20 bp, Artificial Sequence
  chemically synthesized
taggtggtatcaacatctgt

SEQ ID NO: 334224 - DNA, 20 bp, Artificial Sequence
  chemically synthesized
gtgtagtgttaatgtgctta

SEQ ID NO: 334225 - DNA, 20 bp, Artificial Sequence
  chemically synthesized
agaaaccaaaaattgatgtg

SEQ ID NO: 334226 - DNA, 20 bp, Artificial Sequence
  chemically synthesized
taacactacacatcaatttt

SEQ ID NO: 334227 - DNA, 20 bp, Artificial Sequence
  chemically synthesized
aatttttggtttctatattt

SEQ ID NO: 334228 - DNA, 20 bp, Artificial Sequence
  chemically synthesized
tccttttagagtctcaaata

SEQ ID NO: 334229 - DNA, 20 bp, Artificial Sequence
  chemically synthesized
ttctatatttgagactctaa

SEQ ID NO: 334230 - DNA, 20 bp, Artificial Sequence
  chemically synthesized
tctatatttgagactctaaa

SEQ ID NO: 334231 - DNA, 20 bp, Artificial Sequence
  chemically synthesized
atttgttcattatcctttta

SEQ ID NO: 334232 - DNA, 20 bp, Artificial Sequence
  chemically synthesized
tgatttgttcattatccttt

SEQ ID NO: 334233 - DNA, 20 bp, Artificial Sequence
  chemically synthesized
aaaggataatgaacaaatca

SEQ ID NO: 334234 - DNA, 20 bp, Artificial Sequence
  chemically synthesized
taatgaacaaatcaaagtta

SEQ ID NO: 334235 - DNA, 20 bp, Artificial Sequence
  chemically synthesized
aatgaacaaatcaaagttaa

SEQ ID NO: 334236 - DNA, 20 bp, Artificial Sequence
  chemically synthesized
gaacaaatcaaagttaaagg

SEQ ID NO: 334237 - DNA, 20 bp, Artificial Sequence
  chemically synthesized
tcaaagttaaaggaagacga

SEQ ID NO: 334238 - DNA, 20 bp, Artificial Sequence
  chemically synthesized
gaagacgatagattaatgaa

SEQ ID NO: 334239 - DNA, 20 bp, Artificial Sequence
  chemically synthesized
tagtctctggaggacattca

SEQ ID NO: 334240 - DNA, 20 bp, Artificial Sequence
  chemically synthesized
aattgtccatgaatgtcctc

SEQ ID NO: 334241 - DNA, 20 bp, Artificial Sequence
  chemically synthesized
ttgtccatgaatgtcctcca

SEQ ID NO: 334242 - DNA, 20 bp, Artificial Sequence
  chemically synthesized
atgttctaattagtctctgg

SEQ ID NO: 334243 - DNA, 20 bp, Artificial Sequence
  chemically synthesized
catgttctaattagtctctg

SEQ ID NO: 334244 - DNA, 20 bp, Artificial Sequence
  chemically synthesized
ctcatgttctaattagtctc

SEQ ID NO: 334245 - DNA, 20 bp, Artificial Sequence
  chemically synthesized
aatgtcctccagagactaat

SEQ ID NO: 334246 - DNA, 20 bp, Artificial Sequence
  chemically synthesized
cctcattctcatgttctaat

SEQ ID NO: 334247 - DNA, 20 bp, Artificial Sequence
  chemically synthesized
ccagagactaattagaacat

SEQ ID NO: 334248 - DNA, 20 bp, Artificial Sequence
  chemically synthesized
actaattagaacatgagaat

SEQ ID NO: 334249 - DNA, 20 bp, Artificial Sequence
  chemically synthesized
ctaattagaacatgagaatg

SEQ ID NO: 334250 - DNA, 20 bp, Artificial Sequence
  chemically synthesized
ccaaattggaaagacatttt

SEQ ID NO: 334251 - DNA, 20 bp, Artificial Sequence
  chemically synthesized
gccaaattggaaagacattt

SEQ ID NO: 334252 - DNA, 20 bp, Artificial Sequence
  chemically synthesized
cctaaaatgtctttccaatt

SEQ ID NO: 334253 - DNA, 20 bp, Artificial Sequence
  chemically synthesized
cattggtctgccaaattgga

SEQ ID NO: 334254 - DNA, 20 bp, Artificial Sequence
  chemically synthesized
aaaatgtctttccaatttgg

SEQ ID NO: 334255 - DNA, 20 bp, Artificial Sequence
  chemically synthesized
atctcattggtctgccaaat

SEQ ID NO: 334256 - DNA, 20 bp, Artificial Sequence
  chemically synthesized
ttccaatttggcagaccaat

SEQ ID NO: 334257 - DNA, 20 bp, Artificial Sequence
  chemically synthesized
atttggcagaccaatgagat

SEQ ID NO: 334258 - DNA, 20 bp, Artificial Sequence
  chemically synthesized
aactttactgctcatctcat

SEQ ID NO: 334259 - DNA, 20 bp, Artificial Sequence
  chemically synthesized
tggcagaccaatgagatgag

SEQ ID NO: 334260 - DNA, 20 bp, Artificial Sequence
  chemically synthesized
gaccaatgagatgagcagta

SEQ ID NO: 334261 - DNA, 20 bp, Artificial Sequence
  chemically synthesized
atgaagtttttatatgaaca

SEQ ID NO: 334262 - DNA, 20 bp, Artificial Sequence
  chemically synthesized
aatgaagtttttatatgaac

SEQ ID NO: 334263 - DNA, 20 bp, Artificial Sequence
  chemically synthesized
ggaaaaagtaatatggaatg

SEQ ID NO: 334264 - DNA, 20 bp, Artificial Sequence
  chemically synthesized
tgacttaggaaaaagtaata

SEQ ID NO: 334265 - DNA, 20 bp, Artificial Sequence
  chemically synthesized
attccatattactttttcct

SEQ ID NO: 334266 - DNA, 20 bp, Artificial Sequence
  chemically synthesized
tggcaatttgacttaggaaa

SEQ ID NO: 334267 - DNA, 20 bp, Artificial Sequence
  chemically synthesized
ctagtttggcaatttgactt

SEQ ID NO: 334268 - DNA, 20 bp, Artificial Sequence
  chemically synthesized
gctagtttggcaatttgact

SEQ ID NO: 334269 - DNA, 20 bp, Artificial Sequence
  chemically synthesized
cctaagtcaaattgccaaac

SEQ ID NO: 334270 - DNA, 20 bp, Artificial Sequence
  chemically synthesized
ctctgttagatgggctagtt

SEQ ID NO: 334271 - DNA, 20 bp, Artificial Sequence
  chemically synthesized
agctactctgttagatgggc

SEQ ID NO: 334272 - DNA, 20 bp, Artificial Sequence
  chemically synthesized
tgccaaactagcccatctaa

SEQ ID NO: 334273 - DNA, 20 bp, Artificial Sequence
  chemically synthesized
tgaaagctactctgttagat

SEQ ID NO: 334274 - DNA, 20 bp, Artificial Sequence
  chemically synthesized
ccaaactagcccatctaaca

SEQ ID NO: 334275 - DNA, 20 bp, Artificial Sequence
  chemically synthesized
atgaaagctactctgttaga

SEQ ID NO: 334276 - DNA, 20 bp, Artificial Sequence
  chemically synthesized
aactagcccatctaacagag

SEQ ID NO: 334277 - DNA, 20 bp, Artificial Sequence
  chemically synthesized
tctaatgaaagctactctgt

SEQ ID NO: 334278 - DNA, 20 bp, Artificial Sequence
  chemically synthesized
tctaacagagtagctttcat

SEQ ID NO: 334279 - DNA, 20 bp, Artificial Sequence
  chemically synthesized
ttttgtttcttatctaatga

SEQ ID NO: 334280 - DNA, 20 bp, Artificial Sequence
  chemically synthesized
cagagtagctttcattagat

SEQ ID NO: 334281 - DNA, 20 bp, Artificial Sequence
  chemically synthesized
tagataagaaacaaaaataa

SEQ ID NO: 334282 - DNA, 20 bp, Artificial Sequence
  chemically synthesized
agattacattttccctccaa

SEQ ID NO: 334283 - DNA, 20 bp, Artificial Sequence
  chemically synthesized
taatataactttccattgga

SEQ ID NO: 334284 - DNA, 20 bp, Artificial Sequence
  chemically synthesized
ttaatataactttccattgg

SEQ ID NO: 334285 - DNA, 20 bp, Artificial Sequence
  chemically synthesized
tacattttccctccaatgga

SEQ ID NO: 334286 - DNA, 20 bp, Artificial Sequence
  chemically synthesized
gttaatataactttccattg

SEQ ID NO: 334287 - DNA, 20 bp, Artificial Sequence
  chemically synthesized
atgttaatataactttccat

SEQ ID NO: 334288 - DNA, 20 bp, Artificial Sequence
  chemically synthesized
tattaacatgtcaattcaaa

SEQ ID NO: 334289 - DNA, 20 bp, Artificial Sequence
  chemically synthesized
tgtcaattcaaatggtgcac

SEQ ID NO: 334290 - DNA, 20 bp, Artificial Sequence
  chemically synthesized
ttgtgtatttgtttaattac

SEQ ID NO: 334291 - DNA, 20 bp, Artificial Sequence
  chemically synthesized
aattaaacaaatacacaaaa

SEQ ID NO: 334292 - DNA, 20 bp, Artificial Sequence
  chemically synthesized
cacaaaatggtttaccgctt

SEQ ID NO: 334293 - DNA, 20 bp, Artificial Sequence
  chemically synthesized
ttctttactgagaaccaaag

SEQ ID NO: 334294 - DNA, 20 bp, Artificial Sequence
  chemically synthesized
tggtttaccgctttggttct

SEQ ID NO: 334295 - DNA, 20 bp, Artificial Sequence
  chemically synthesized
ggtttctttactgagaacca

SEQ ID NO: 334296 - DNA, 20 bp, Artificial Sequence
  chemically synthesized
taccgctttggttctcagta

SEQ ID NO: 334297 - DNA, 20 bp, Artificial Sequence
  chemically synthesized
aggtatcaggtttctttact

SEQ ID NO: 334298 - DNA, 20 bp, Artificial Sequence
  chemically synthesized
acattcagttaaaaggtatc

SEQ ID NO: 334299 - DNA, 20 bp, Artificial Sequence
  chemically synthesized
aacattcagttaaaaggtat

SEQ ID NO: 334300 - DNA, 20 bp, Artificial Sequence
  chemically synthesized
atcagcaacattcagttaaa

SEQ ID NO: 334301 - DNA, 20 bp, Artificial Sequence
  chemically synthesized
tatcagcaacattcagttaa

SEQ ID NO: 334302 - DNA, 20 bp, Artificial Sequence
  chemically synthesized
actttaatatcagcaacatt

SEQ ID NO: 334303 - DNA, 20 bp, Artificial Sequence
  chemically synthesized
actgaatgttgctgatatta

SEQ ID NO: 334304 - DNA, 20 bp, Artificial Sequence
  chemically synthesized
ctctctgcatactttaatat

SEQ ID NO: 334305 - DNA, 20 bp, Artificial Sequence
  chemically synthesized
gttgctgatattaaagtatg

SEQ ID NO: 334306 - DNA, 20 bp, Artificial Sequence
  chemically synthesized
tgctgatattaaagtatgca

SEQ ID NO: 334307 - DNA, 20 bp, Artificial Sequence
  chemically synthesized
ctgatattaaagtatgcaga

SEQ ID NO: 334308 - DNA, 20 bp, Artificial Sequence
  chemically synthesized
aagtatgcagagagctaaat

SEQ ID NO: 334309 - DNA, 20 bp, Artificial Sequence
  chemically synthesized
catttcagcagagacttatt

SEQ ID NO: 334310 - DNA, 20 bp, Artificial Sequence
  chemically synthesized
atacatgactcatttcagca

SEQ ID NO: 334311 - DNA, 20 bp, Artificial Sequence
  chemically synthesized
aaataagtctctgctgaaat

SEQ ID NO: 334312 - DNA, 20 bp, Artificial Sequence
  chemically synthesized
ggatacatgactcatttcag

SEQ ID NO: 334313 - DNA, 20 bp, Artificial Sequence
  chemically synthesized
tgtggatacatgactcattt

SEQ ID NO: 334314 - DNA, 20 bp, Artificial Sequence
  chemically synthesized
tttctgtttaatttatattg

SEQ ID NO: 334315 - DNA, 20 bp, Artificial Sequence
  chemically synthesized
tatccacaatataaattaaa

SEQ ID NO: 334316 - DNA, 20 bp, Artificial Sequence
  chemically synthesized
gaatagtaaaaatcattata

SEQ ID NO: 334317 - DNA, 20 bp, Artificial Sequence
  chemically synthesized
tatttttaacatacacggaa

SEQ ID NO: 334318 - DNA, 20 bp, Artificial Sequence
  chemically synthesized
acaaatatttttaacataca

SEQ ID NO: 334319 - DNA, 20 bp, Artificial Sequence
  chemically synthesized
aaaaatatttgtttacattg

SEQ ID NO: 334320 - DNA, 20 bp, Artificial Sequence
  chemically synthesized
tttgtttacattgtggtgca

SEQ ID NO: 334321 - DNA, 20 bp, Artificial Sequence
  chemically synthesized
ttgtttacattgtggtgcat

SEQ ID NO: 334322 - DNA, 20 bp, Artificial Sequence
  chemically synthesized
acattgtggtgcatgggata

SEQ ID NO: 334323 - DNA, 20 bp, Artificial Sequence
  chemically synthesized
ttgtggtgcatgggataaag

SEQ ID NO: 334324 - DNA, 20 bp, Artificial Sequence
  chemically synthesized
tagaatatcactttccttct

SEQ ID NO: 334325 - DNA, 20 bp, Artificial Sequence
  chemically synthesized
tctctaatgtctgagaagga

SEQ ID NO: 334326 - DNA, 20 bp, Artificial Sequence
  chemically synthesized
tttgtctctaatgtctgaga

SEQ ID NO: 334327 - DNA, 20 bp, Artificial Sequence
  chemically synthesized
atttgtctctaatgtctgag

SEQ ID NO: 334328 - DNA, 20 bp, Artificial Sequence
  chemically synthesized
tcactttccttctcagacat

SEQ ID NO: 334329 - DNA, 20 bp, Artificial Sequence
  chemically synthesized
tacatttgtctctaatgtct

SEQ ID NO: 334330 - DNA, 20 bp, Artificial Sequence
  chemically synthesized
actttccttctcagacatta

SEQ ID NO: 334331 - DNA, 20 bp, Artificial Sequence
  chemically synthesized
gacattagagacaaatgtaa

SEQ ID NO: 334332 - DNA, 20 bp, Artificial Sequence
  chemically synthesized
atgtaaaagtcccgcacatt

SEQ ID NO: 334333 - DNA, 20 bp, Artificial Sequence
  chemically synthesized
gtcagatcaacttaatgtgc

SEQ ID NO: 334334 - DNA, 20 bp, Artificial Sequence
  chemically synthesized
agtcagatcaacttaatgtg

SEQ ID NO: 334335 - DNA, 20 bp, Artificial Sequence
  chemically synthesized
tgtggcaaaggatatgaagt

SEQ ID NO: 334336 - DNA, 20 bp, Artificial Sequence
  chemically synthesized
tggatgtggcaaaggatatg

SEQ ID NO: 334337 - DNA, 20 bp, Artificial Sequence
  chemically synthesized
tcactttctggatgtggcaa

SEQ ID NO: 334338 - DNA, 20 bp, Artificial Sequence
  chemically synthesized
ttcactttctggatgtggca

SEQ ID NO: 334339 - DNA, 20 bp, Artificial Sequence
  chemically synthesized
ttcatatcctttgccacatc

SEQ ID NO: 334340 - DNA, 20 bp, Artificial Sequence
  chemically synthesized
tttcattcactttctggatg

SEQ ID NO: 334341 - DNA, 20 bp, Artificial Sequence
  chemically synthesized
tatcctttgccacatccaga

SEQ ID NO: 334342 - DNA, 20 bp, Artificial Sequence
  chemically synthesized
gctgcgtttcattcactttc

SEQ ID NO: 334343 - DNA, 20 bp, Artificial Sequence
  chemically synthesized
tccagaaagtgaatgaaacg

SEQ ID NO: 334344 - DNA, 20 bp, Artificial Sequence
  chemically synthesized
tgaatgaaacgcagcattta

SEQ ID NO: 334345 - DNA, 20 bp, Artificial Sequence
  chemically synthesized
actttatatgtgttattaca

SEQ ID NO: 334346 - DNA, 20 bp, Artificial Sequence
  chemically synthesized
actttgtaataacacatata

SEQ ID NO: 334347 - DNA, 20 bp, Artificial Sequence
  chemically synthesized
ttgtaataacacatataaag

SEQ ID NO: 334348 - DNA, 20 bp, Artificial Sequence
  chemically synthesized
taataacacatataaagtgg

SEQ ID NO: 334349 - DNA, 20 bp, Artificial Sequence
  chemically synthesized
taaagtggcagctccttcaa

SEQ ID NO: 334350 - DNA, 20 bp, Artificial Sequence
  chemically synthesized
agcaaatgaatcttttgaag

SEQ ID NO: 334351 - DNA, 20 bp, Artificial Sequence
  chemically synthesized
gtagcaaatgaatcttttga

SEQ ID NO: 334352 - DNA, 20 bp, Artificial Sequence
  chemically synthesized
agtagcaaatgaatcttttg

SEQ ID NO: 334353 - DNA, 20 bp, Artificial Sequence
  chemically synthesized
caaaagattcatttgctact

SEQ ID NO: 334354 - DNA, 20 bp, Artificial Sequence
  chemically synthesized
aagtaaattttaatgccaag

SEQ ID NO: 334355 - DNA, 20 bp, Artificial Sequence
  chemically synthesized
agtaagtaaattttaatgcc

SEQ ID NO: 334356 - DNA, 20 bp, Artificial Sequence
  chemically synthesized
ttcactggaatgagtgcagt

SEQ ID NO: 334357 - DNA, 20 bp, Artificial Sequence
  chemically synthesized
ttggttcactggaatgagtg

SEQ ID NO: 334358 - DNA, 20 bp, Artificial Sequence
  chemically synthesized
tttacttactgcactcattc

SEQ ID NO: 334359 - DNA, 20 bp, Artificial Sequence
  chemically synthesized
acatcttggttcactggaat

SEQ ID NO: 334360 - DNA, 20 bp, Artificial Sequence
  chemically synthesized
tgcactcattccagtgaacc

SEQ ID NO: 334361 - DNA, 20 bp, Artificial Sequence
  chemically synthesized
tactttacatcttggttcac

SEQ ID NO: 334362 - DNA, 20 bp, Artificial Sequence
  chemically synthesized
ttccagtgaaccaagatgta

SEQ ID NO: 334363 - DNA, 20 bp, Artificial Sequence
  chemically synthesized
taaaggattactttacatct

SEQ ID NO: 334364 - DNA, 20 bp, Artificial Sequence
  chemically synthesized
gtaaagtaatcctttatgtg

SEQ ID NO: 334365 - DNA, 20 bp, Artificial Sequence
  chemically synthesized
taatgacatacttcacataa

SEQ ID NO: 334366 - DNA, 20 bp, Artificial Sequence
  chemically synthesized
ctaatgacatacttcacata

SEQ ID NO: 334367 - DNA, 20 bp, Artificial Sequence
  chemically synthesized
ctttatgtgaagtatgtcat

SEQ ID NO: 334368 - DNA, 20 bp, Artificial Sequence
  chemically synthesized
gtgaagtatgtcattagtac

SEQ ID NO: 334369 - DNA, 20 bp, Artificial Sequence
  chemically synthesized
aacttatgtgttaacatttc

SEQ ID NO: 334370 - DNA, 20 bp, Artificial Sequence
  chemically synthesized
tactagaaatgttaacacat

SEQ ID NO: 334371 - DNA, 20 bp, Artificial Sequence
  chemically synthesized
aaatgctagcatttcatagt

SEQ ID NO: 334372 - DNA, 20 bp, Artificial Sequence
  chemically synthesized
aatgaaatgctagcatttca

SEQ ID NO: 334373 - DNA, 20 bp, Artificial Sequence
  chemically synthesized
aagttctgactatgaaatgc

SEQ ID NO: 334374 - DNA, 20 bp, Artificial Sequence
  chemically synthesized
aaaggatgacaatgaaatgc

SEQ ID NO: 334375 - DNA, 20 bp, Artificial Sequence
  chemically synthesized
ttctttttaaaggatgaaaa

SEQ ID NO: 334376 - DNA, 20 bp, Artificial Sequence
  chemically synthesized
cttctttttaaaggatgaaa

SEQ ID NO: 334377 - DNA, 20 bp, Artificial Sequence
  chemically synthesized
atcctttttcatcctttaaa

SEQ ID NO: 334378 - DNA, 20 bp, Artificial Sequence
  chemically synthesized
caaaatttccttctttttaa

SEQ ID NO: 334379 - DNA, 20 bp, Artificial Sequence
  chemically synthesized
ctttttcatcctttaaaaag

SEQ ID NO: 334380 - DNA, 20 bp, Artificial Sequence
  chemically synthesized
acaaaatttccttcttttta

SEQ ID NO: 334381 - DNA, 20 bp, Artificial Sequence
  chemically synthesized
tttttcatcctttaaaaaga

SEQ ID NO: 334382 - DNA, 20 bp, Artificial Sequence
  chemically synthesized
aagaaggaaattttgtcatt

SEQ ID NO: 334383 - DNA, 20 bp, Artificial Sequence
  chemically synthesized
aggaaattttgtcattgaga

SEQ ID NO: 334384 - DNA, 20 bp, Artificial Sequence
  chemically synthesized
tgagacagcatgtgtaaatc

SEQ ID NO: 334385 - DNA, 20 bp, Artificial Sequence
  chemically synthesized
agacagcatgtgtaaatctg

SEQ ID NO: 334386 - DNA, 20 bp, Artificial Sequence
  chemically synthesized
gacagcatgtgtaaatctgg

SEQ ID NO: 334387 - DNA, 20 bp, Artificial Sequence
  chemically synthesized
ttatttcacttaatatcctc

SEQ ID NO: 334388 - DNA, 20 bp, Artificial Sequence
  chemically synthesized
gtgtaaatctggaggatatt

SEQ ID NO: 334389 - DNA, 20 bp, Artificial Sequence
  chemically synthesized
tggaggatattaagtgaaat

SEQ ID NO: 334390 - DNA, 20 bp, Artificial Sequence
  chemically synthesized
ggatattaagtgaaataagc

SEQ ID NO: 334391 - DNA, 20 bp, Artificial Sequence
  chemically synthesized
gatattaagtgaaataagcc

SEQ ID NO: 334392 - DNA, 20 bp, Artificial Sequence
  chemically synthesized
taagtgaaataagccaggca

SEQ ID NO: 334393 - DNA, 20 bp, Artificial Sequence
  chemically synthesized
ggtacttatctttctgtgcc

SEQ ID NO: 334394 - DNA, 20 bp, Artificial Sequence
  chemically synthesized
tgaaataagccaggcacaga

SEQ ID NO: 334395 - DNA, 20 bp, Artificial Sequence
  chemically synthesized
taagccaggcacagaaagat

SEQ ID NO: 334396 - DNA, 20 bp, Artificial Sequence
  chemically synthesized
catgtgttagtgagatcatg

SEQ ID NO: 334397 - DNA, 20 bp, Artificial Sequence
  chemically synthesized
tttagattccatgtgttagt

SEQ ID NO: 334398 - DNA, 20 bp, Artificial Sequence
  chemically synthesized
cacatgatctcactaacaca

SEQ ID NO: 334399 - DNA, 20 bp, Artificial Sequence
  chemically synthesized
actttttagattccatgtgt

SEQ ID NO: 334400 - DNA, 20 bp, Artificial Sequence
  chemically synthesized
actaacacatggaatctaaa

SEQ ID NO: 334401 - DNA, 20 bp, Artificial Sequence
  chemically synthesized
cttctatgaattcaactttt

SEQ ID NO: 334402 - DNA, 20 bp, Artificial Sequence
  chemically synthesized
aatctaaaaagttgaattca

SEQ ID NO: 334403 - DNA, 20 bp, Artificial Sequence
  chemically synthesized
ctaaaaagttgaattcatag

SEQ ID NO: 334404 - DNA, 20 bp, Artificial Sequence
  chemically synthesized
aaaagttgaattcatagaag

SEQ ID NO: 334405 - DNA, 20 bp, Artificial Sequence
  chemically synthesized
aagttgaattcatagaagta

SEQ ID NO: 334406 - DNA, 20 bp, Artificial Sequence
  chemically synthesized
gttgaattcatagaagtaga

SEQ ID NO: 334407 - DNA, 20 bp, Artificial Sequence
  chemically synthesized
gaattcatagaagtagagag

SEQ ID NO: 334408 - DNA, 20 bp, Artificial Sequence
  chemically synthesized
catagaagtagagagtagaa

SEQ ID NO: 334409 - DNA, 20 bp, Artificial Sequence
  chemically synthesized
gagagtagaatggtgtttac

SEQ ID NO: 334410 - DNA, 20 bp, Artificial Sequence
  chemically synthesized
agagtagaatggtgtttacc

SEQ ID NO: 334411 - DNA, 20 bp, Artificial Sequence
  chemically synthesized
gagtagaatggtgtttacca

SEQ ID NO: 334412 - DNA, 20 bp, Artificial Sequence
  chemically synthesized
agtagaatggtgtttaccag

SEQ ID NO: 334413 - DNA, 20 bp, Artificial Sequence
  chemically synthesized
atggtgtttaccaggggctg

SEQ ID NO: 334414 - DNA, 20 bp, Artificial Sequence
  chemically synthesized
aacccctgccccacagcccc

SEQ ID NO: 334415 - DNA, 20 bp, Artificial Sequence
  chemically synthesized
tggtgtttaccaggggctgt

SEQ ID NO: 334416 - DNA, 20 bp, Artificial Sequence
  chemically synthesized
ggtgtttaccaggggctgtg

SEQ ID NO: 334417 - DNA, 20 bp, Artificial Sequence
  chemically synthesized
gtttaccaggggctgtgggg

SEQ ID NO: 334418 - DNA, 20 bp, Artificial Sequence
  chemically synthesized
tttaccaggggctgtggggc

SEQ ID NO: 334419 - DNA, 20 bp, Artificial Sequence
  chemically synthesized
ttaccaggggctgtggggca

SEQ ID NO: 334420 - DNA, 20 bp, Artificial Sequence
  chemically synthesized
tcttcccaacccctgcccca

SEQ ID NO: 334421 - DNA, 20 bp, Artificial Sequence
  chemically synthesized
taccaggggctgtggggcag

SEQ ID NO: 334422 - DNA, 20 bp, Artificial Sequence
  chemically synthesized
aggggctgtggggcaggggt

SEQ ID NO: 334423 - DNA, 20 bp, Artificial Sequence
  chemically synthesized
ggggctgtggggcaggggtt

SEQ ID NO: 334424 - DNA, 20 bp, Artificial Sequence
  chemically synthesized
gctgtggggcaggggttggg

SEQ ID NO: 334425 - DNA, 20 bp, Artificial Sequence
  chemically synthesized
ggcaggggttgggaagatgt

SEQ ID NO: 334426 - DNA, 20 bp, Artificial Sequence
  chemically synthesized
ggttgggaagatgttggtca

SEQ ID NO: 334427 - DNA, 20 bp, Artificial Sequence
  chemically synthesized
gttgggaagatgttggtcaa

SEQ ID NO: 334428 - DNA, 20 bp, Artificial Sequence
  chemically synthesized
ggtcaaaggacacaaaattt

SEQ ID NO: 334429 - DNA, 20 bp, Artificial Sequence
  chemically synthesized
aaaggacacaaaatttcagt

SEQ ID NO: 334430 - DNA, 20 bp, Artificial Sequence
  chemically synthesized
gacacaaaatttcagttaga

SEQ ID NO: 334431 - DNA, 20 bp, Artificial Sequence
  chemically synthesized
acacaaaatttcagttagat

SEQ ID NO: 334432 - DNA, 20 bp, Artificial Sequence
  chemically synthesized
ttcagttagataggaaaaat

SEQ ID NO: 334433 - DNA, 20 bp, Artificial Sequence
  chemically synthesized
ttagataggaaaaataagtt

SEQ ID NO: 334434 - DNA, 20 bp, Artificial Sequence
  chemically synthesized
tagataggaaaaataagttc

SEQ ID NO: 334435 - DNA, 20 bp, Artificial Sequence
  chemically synthesized
gataggaaaaataagttcag

SEQ ID NO: 334436 - DNA, 20 bp, Artificial Sequence
  chemically synthesized
ttataaactaggttgtacaa

SEQ ID NO: 334437 - DNA, 20 bp, Artificial Sequence
  chemically synthesized
aggagatctattgtacaacc

SEQ ID NO: 334438 - DNA, 20 bp, Artificial Sequence
  chemically synthesized
acaatacattgttataaact

SEQ ID NO: 334439 - DNA, 20 bp, Artificial Sequence
  chemically synthesized
tacaatacattgttataaac

SEQ ID NO: 334440 - DNA, 20 bp, Artificial Sequence
  chemically synthesized
ctactctcgcagcaattttt

SEQ ID NO: 334441 - DNA, 20 bp, Artificial Sequence
  chemically synthesized
tctactctcgcagcaatttt

SEQ ID NO: 334442 - DNA, 20 bp, Artificial Sequence
  chemically synthesized
gtattcctaaaaattgctgc

SEQ ID NO: 334443 - DNA, 20 bp, Artificial Sequence
  chemically synthesized
attcctaaaaattgctgcga

SEQ ID NO: 334444 - DNA, 20 bp, Artificial Sequence
  chemically synthesized
cctaaaaattgctgcgagag

SEQ ID NO: 334445 - DNA, 20 bp, Artificial Sequence
  chemically synthesized
atacttaatatctactctcg

SEQ ID NO: 334446 - DNA, 20 bp, Artificial Sequence
  chemically synthesized
ttgctgcgagagtagatatt

SEQ ID NO: 334447 - DNA, 20 bp, Artificial Sequence
  chemically synthesized
tgcttagcatgtttcatggt

SEQ ID NO: 334448 - DNA, 20 bp, Artificial Sequence
  chemically synthesized
catatgcttagcatgtttca

SEQ ID NO: 334449 - DNA, 20 bp, Artificial Sequence
  chemically synthesized
tactcaccatgaaacatgct

SEQ ID NO: 334450 - DNA, 20 bp, Artificial Sequence
  chemically synthesized
catgttttacttcatatgct

SEQ ID NO: 334451 - DNA, 20 bp, Artificial Sequence
  chemically synthesized
tgaaacatgctaagcatatg

SEQ ID NO: 334452 - DNA, 20 bp, Artificial Sequence
  chemically synthesized
gaagtaaaacatgtattaat

SEQ ID NO: 334453 - DNA, 20 bp, Artificial Sequence
  chemically synthesized
atgtattaattagttcaatg

SEQ ID NO: 334454 - DNA, 20 bp, Artificial Sequence
  chemically synthesized
ttagttcaatgtagccattc

SEQ ID NO: 334455 - DNA, 20 bp, Artificial Sequence
  chemically synthesized
aatatgtatacgttctggaa

SEQ ID NO: 334456 - DNA, 20 bp, Artificial Sequence
  chemically synthesized
tttgaaatatgtatacgttc

SEQ ID NO: 334457 - DNA, 20 bp, Artificial Sequence
  chemically synthesized
atgataaatgtatgcaattt

SEQ ID NO: 334458 - DNA, 20 bp, Artificial Sequence
  chemically synthesized
attaatgaatataaaaatca

SEQ ID NO: 334459 - DNA, 20 bp, Artificial Sequence
  chemically synthesized
aatataaaaatcaaagataa

SEQ ID NO: 334460 - DNA, 20 bp, Artificial Sequence
  chemically synthesized
taaaagataaacataaatcc

SEQ ID NO: 334461 - DNA, 20 bp, Artificial Sequence
  chemically synthesized
aagataaacataaatcctgg

SEQ ID NO: 334462 - DNA, 20 bp, Artificial Sequence
  chemically synthesized
agataaacataaatcctggc

SEQ ID NO: 334463 - DNA, 20 bp, Artificial Sequence
  chemically synthesized
ataaacataaatcctggcag

SEQ ID NO: 334464 - DNA, 20 bp, Artificial Sequence
  chemically synthesized
taaacataaatcctggcagg

SEQ ID NO: 334465 - DNA, 20 bp, Artificial Sequence
  chemically synthesized
cattaccttgacctcctgcc

SEQ ID NO: 334466 - DNA, 20 bp, Artificial Sequence
  chemically synthesized
acattaccttgacctcctgc

SEQ ID NO: 334467 - DNA, 20 bp, Artificial Sequence
  chemically synthesized
ataaatcctggcaggaggtc

SEQ ID NO: 334468 - DNA, 20 bp, Artificial Sequence
  chemically synthesized
taaatcctggcaggaggtca

SEQ ID NO: 334469 - DNA, 20 bp, Artificial Sequence
  chemically synthesized
ggcaggaggtcaaggtaatg

SEQ ID NO: 334470 - DNA, 20 bp, Artificial Sequence
  chemically synthesized
ctaagataaattgtatggca

SEQ ID NO: 334471 - DNA, 20 bp, Artificial Sequence
  chemically synthesized
gctaagataaattgtatggc

SEQ ID NO: 334472 - DNA, 20 bp, Artificial Sequence
  chemically synthesized
ttaagctaagataaattgta

SEQ ID NO: 334473 - DNA, 20 bp, Artificial Sequence
  chemically synthesized
ccttgccatacaatttatct

SEQ ID NO: 334474 - DNA, 20 bp, Artificial Sequence
  chemically synthesized
atcttaatagtagttaagct

SEQ ID NO: 334475 - DNA, 20 bp, Artificial Sequence
  chemically synthesized
cagatatcttaatagtagtt

SEQ ID NO: 334476 - DNA, 20 bp, Artificial Sequence
  chemically synthesized
atcttagcttaactactatt

SEQ ID NO: 334477 - DNA, 20 bp, Artificial Sequence
  chemically synthesized
gaatacagatatcttaatag

SEQ ID NO: 334478 - DNA, 20 bp, Artificial Sequence
  chemically synthesized
actgaatacagatatcttaa

SEQ ID NO: 334479 - DNA, 20 bp, Artificial Sequence
  chemically synthesized
actattaagatatctgtatt

SEQ ID NO: 334480 - DNA, 20 bp, Artificial Sequence
  chemically synthesized
cagaatatacatactgaata

SEQ ID NO: 334481 - DNA, 20 bp, Artificial Sequence
  chemically synthesized
ttcagtatgtatattctgat

SEQ ID NO: 334482 - DNA, 20 bp, Artificial Sequence
  chemically synthesized
tcagtatgtatattctgatc

SEQ ID NO: 334483 - DNA, 20 bp, Artificial Sequence
  chemically synthesized
ttataatcagaacacctgat

SEQ ID NO: 334484 - DNA, 20 bp, Artificial Sequence
  chemically synthesized
tgatcaggtgttctgattat

SEQ ID NO: 334485 - DNA, 20 bp, Artificial Sequence
  chemically synthesized
ttggctttttcacttataat

SEQ ID NO: 334486 - DNA, 20 bp, Artificial Sequence
  chemically synthesized
tgttctgattataagtgaaa

SEQ ID NO: 334487 - DNA, 20 bp, Artificial Sequence
  chemically synthesized
tgattataagtgaaaaagcc

SEQ ID NO: 334488 - DNA, 20 bp, Artificial Sequence
  chemically synthesized
attataagtgaaaaagccaa

SEQ ID NO: 334489 - DNA, 20 bp, Artificial Sequence
  chemically synthesized
aagtgaaaaagccaagagta

SEQ ID NO: 334490 - DNA, 20 bp, Artificial Sequence
  chemically synthesized
cggacttgagactttactct

SEQ ID NO: 334491 - DNA, 20 bp, Artificial Sequence
  chemically synthesized
aaagccaagagtaaagtctc

SEQ ID NO: 334492 - DNA, 20 bp, Artificial Sequence
  chemically synthesized
gcttttgtgctaacggactt

SEQ ID NO: 334493 - DNA, 20 bp, Artificial Sequence
  chemically synthesized
gagtaaagtctcaagtccgt

SEQ ID NO: 334494 - DNA, 20 bp, Artificial Sequence
  chemically synthesized
tcaacctgcttttgtgctaa

SEQ ID NO: 334495 - DNA, 20 bp, Artificial Sequence
  chemically synthesized
tctcaagtccgttagcacaa

SEQ ID NO: 334496 - DNA, 20 bp, Artificial Sequence
  chemically synthesized
caagtccgttagcacaaaag

SEQ ID NO: 334497 - DNA, 20 bp, Artificial Sequence
  chemically synthesized
aagtccgttagcacaaaagc

SEQ ID NO: 334498 - DNA, 20 bp, Artificial Sequence
  chemically synthesized
agcacaaaagcaggttgaac

SEQ ID NO: 334499 - DNA, 20 bp, Artificial Sequence
  chemically synthesized
tacttgcaaaagaattgatg

SEQ ID NO: 334500 - DNA, 20 bp, Artificial Sequence
  chemically synthesized
gacttcatcaattcttttgc

SEQ ID NO: 334501 - DNA, 20 bp, Artificial Sequence
  chemically synthesized
catggttctgatacttgcaa

SEQ ID NO: 334502 - DNA, 20 bp, Artificial Sequence
  chemically synthesized
atcaattcttttgcaagtat

SEQ ID NO: 334503 - DNA, 20 bp, Artificial Sequence
  chemically synthesized
atagctgttctgattaatca

SEQ ID NO: 334504 - DNA, 20 bp, Artificial Sequence
  chemically synthesized
gtatcagaaccatgattaat

SEQ ID NO: 334505 - DNA, 20 bp, Artificial Sequence
  chemically synthesized
agaaccatgattaatcagaa

SEQ ID NO: 334506 - DNA, 20 bp, Artificial Sequence
  chemically synthesized
aatcagaacagctattttta

SEQ ID NO: 334507 - DNA, 20 bp, Artificial Sequence
  chemically synthesized
ttttaaaaatactttaaaaa

SEQ ID NO: 334508 - DNA, 20 bp, Artificial Sequence
  chemically synthesized
atttttaaagtatttttaaa

SEQ ID NO: 334509 - DNA, 20 bp, Artificial Sequence
  chemically synthesized
ttttaaagtatttttaaaaa

SEQ ID NO: 334510 - DNA, 20 bp, Artificial Sequence
  chemically synthesized
gtatttttaaaaagagttac

SEQ ID NO: 334511 - DNA, 20 bp, Artificial Sequence
  chemically synthesized
atttttaaaaagagttacaa

SEQ ID NO: 334512 - DNA, 20 bp, Artificial Sequence
  chemically synthesized
acgaaaaaattaatgttcct

SEQ ID NO: 334513 - DNA, 20 bp, Artificial Sequence
  chemically synthesized
ctacggatagaagtagacca

SEQ ID NO: 334514 - DNA, 20 bp, Artificial Sequence
  chemically synthesized
tctacggatagaagtagacc

SEQ ID NO: 334515 - DNA, 20 bp, Artificial Sequence
  chemically synthesized
tattgttctacggatagaag

SEQ ID NO: 334516 - DNA, 20 bp, Artificial Sequence
  chemically synthesized
ccttggtctacttctatccg

SEQ ID NO: 334517 - DNA, 20 bp, Artificial Sequence
  chemically synthesized
ctgtattgttctacggatag

SEQ ID NO: 334518 - DNA, 20 bp, Artificial Sequence
  chemically synthesized
gcactgtattgttctacgga

SEQ ID NO: 334519 - DNA, 20 bp, Artificial Sequence
  chemically synthesized
agaagcactgtattgttcta

SEQ ID NO: 334520 - DNA, 20 bp, Artificial Sequence
  chemically synthesized
cttctatccgtagaacaata

SEQ ID NO: 334521 - DNA, 20 bp, Artificial Sequence
  chemically synthesized
tatgtacattaagaattgag

SEQ ID NO: 334522 - DNA, 20 bp, Artificial Sequence
  chemically synthesized
tcatatgtacattaagaatt

SEQ ID NO: 334523 - DNA, 20 bp, Artificial Sequence
  chemically synthesized
aggtgattcatatgtacatt

SEQ ID NO: 334524 - DNA, 20 bp, Artificial Sequence
  chemically synthesized
taatgtacatatgaatcacc

SEQ ID NO: 334525 - DNA, 20 bp, Artificial Sequence
  chemically synthesized
aatgtacatatgaatcacct

SEQ ID NO: 334526 - DNA, 20 bp, Artificial Sequence
  chemically synthesized
atgtacatatgaatcacctg

SEQ ID NO: 334527 - DNA, 20 bp, Artificial Sequence
  chemically synthesized
tgtagttttaaaagatcccc

SEQ ID NO: 334528 - DNA, 20 bp, Artificial Sequence
  chemically synthesized
ctgtagttttaaaagatccc

SEQ ID NO: 334529 - DNA, 20 bp, Artificial Sequence
  chemically synthesized
atcagattctgtagttttaa

SEQ ID NO: 334530 - DNA, 20 bp, Artificial Sequence
  chemically synthesized
ctggggatcttttaaaacta

SEQ ID NO: 334531 - DNA, 20 bp, Artificial Sequence
  chemically synthesized
atctattgaatcagattctg

SEQ ID NO: 334532 - DNA, 20 bp, Artificial Sequence
  chemically synthesized
aactacagaatctgattcaa

SEQ ID NO: 334533 - DNA, 20 bp, Artificial Sequence
  chemically synthesized
tctaccccgatctattgaat

SEQ ID NO: 334534 - DNA, 20 bp, Artificial Sequence
  chemically synthesized
cagaatctgattcaatagat

SEQ ID NO: 334535 - DNA, 20 bp, Artificial Sequence
  chemically synthesized
agaatctgattcaatagatc

SEQ ID NO: 334536 - DNA, 20 bp, Artificial Sequence
  chemically synthesized
gaatctgattcaatagatcg

SEQ ID NO: 334537 - DNA, 20 bp, Artificial Sequence
  chemically synthesized
tctgattcaatagatcgggg

SEQ ID NO: 334538 - DNA, 20 bp, Artificial Sequence
  chemically synthesized
tgattcaatagatcggggta

SEQ ID NO: 334539 - DNA, 20 bp, Artificial Sequence
  chemically synthesized
caatagatcggggtagagcc

SEQ ID NO: 334540 - DNA, 20 bp, Artificial Sequence
  chemically synthesized
atagatcggggtagagcctg

SEQ ID NO: 334541 - DNA, 20 bp, Artificial Sequence
  chemically synthesized
tattgcaaatgcagagctcc

SEQ ID NO: 334542 - DNA, 20 bp, Artificial Sequence
  chemically synthesized
ctattgcaaatgcagagctc

SEQ ID NO: 334543 - DNA, 20 bp, Artificial Sequence
  chemically synthesized
gggagactattgcaaatgca

SEQ ID NO: 334544 - DNA, 20 bp, Artificial Sequence
  chemically synthesized
ttgggagactattgcaaatg

SEQ ID NO: 334545 - DNA, 20 bp, Artificial Sequence
  chemically synthesized
ctggagctctgcatttgcaa

SEQ ID NO: 334546 - DNA, 20 bp, Artificial Sequence
  chemically synthesized
tgcatttgcaatagtctccc

SEQ ID NO: 334547 - DNA, 20 bp, Artificial Sequence
  chemically synthesized
gcagtttcagcatcacttgg

SEQ ID NO: 334548 - DNA, 20 bp, Artificial Sequence
  chemically synthesized
tagcagtttcagcatcactt

SEQ ID NO: 334549 - DNA, 20 bp, Artificial Sequence
  chemically synthesized
ctagcagtttcagcatcact

SEQ ID NO: 334550 - DNA, 20 bp, Artificial Sequence
  chemically synthesized
ccaagtgatgctgaaactgc

SEQ ID NO: 334551 - DNA, 20 bp, Artificial Sequence
  chemically synthesized
atgtagcagactagcagttt

SEQ ID NO: 334552 - DNA, 20 bp, Artificial Sequence
  chemically synthesized
ttcaaaatgtagcagactag

SEQ ID NO: 334553 - DNA, 20 bp, Artificial Sequence
  chemically synthesized
ttattcaaaatgtagcagac

SEQ ID NO: 334554 - DNA, 20 bp, Artificial Sequence
  chemically synthesized
ggcccttattcaaaatgtag

SEQ ID NO: 334555 - DNA, 20 bp, Artificial Sequence
  chemically synthesized
tttggcccttattcaaaatg

SEQ ID NO: 334556 - DNA, 20 bp, Artificial Sequence
  chemically synthesized
tagtctgctacattttgaat

SEQ ID NO: 334557 - DNA, 20 bp, Artificial Sequence
  chemically synthesized
agtctgctacattttgaata

SEQ ID NO: 334558 - DNA, 20 bp, Artificial Sequence
  chemically synthesized
gtctgctacattttgaataa

SEQ ID NO: 334559 - DNA, 20 bp, Artificial Sequence
  chemically synthesized
ctgcttataagtaatgtttt

SEQ ID NO: 334560 - DNA, 20 bp, Artificial Sequence
  chemically synthesized
gggccaaaaacattacttat

SEQ ID NO: 334561 - DNA, 20 bp, Artificial Sequence
  chemically synthesized
ccaaaaacattacttataag

SEQ ID NO: 334562 - DNA, 20 bp, Artificial Sequence
  chemically synthesized
tgatgtaacagtctgcttat

SEQ ID NO: 334563 - DNA, 20 bp, Artificial Sequence
  chemically synthesized
taaaacgggagatgatgtaa

SEQ ID NO: 334564 - DNA, 20 bp, Artificial Sequence
  chemically synthesized
tgaataaaacaataaaacgg

SEQ ID NO: 334565 - DNA, 20 bp, Artificial Sequence
  chemically synthesized
aatgaataaaacaataaaac

SEQ ID NO: 334566 - DNA, 20 bp, Artificial Sequence
  chemically synthesized
aaatgaataaaacaataaaa

SEQ ID NO: 334567 - DNA, 20 bp, Artificial Sequence
  chemically synthesized
ttcatttattcaaatgatat

SEQ ID NO: 334568 - DNA, 20 bp, Artificial Sequence
  chemically synthesized
tattagacatttcaatgcac

SEQ ID NO: 334569 - DNA, 20 bp, Artificial Sequence
  chemically synthesized
attagacatttcaatgcaca

SEQ ID NO: 334570 - DNA, 20 bp, Artificial Sequence
  chemically synthesized
atttcaatgcacaaggctga

SEQ ID NO: 334571 - DNA, 20 bp, Artificial Sequence
  chemically synthesized
tttcaatgcacaaggctgaa

SEQ ID NO: 334572 - DNA, 20 bp, Artificial Sequence
  chemically synthesized
ttgtataactttgtaccttt

SEQ ID NO: 334573 - DNA, 20 bp, Artificial Sequence
  chemically synthesized
gcacaaggctgaaaggtaca

SEQ ID NO: 334574 - DNA, 20 bp, Artificial Sequence
  chemically synthesized
acaaagttatacaacacata

SEQ ID NO: 334575 - DNA, 20 bp, Artificial Sequence
  chemically synthesized
taattaaagtgtaataagtt

SEQ ID NO: 334576 - DNA, 20 bp, Artificial Sequence
  chemically synthesized
attaataattaaagtgtaat

SEQ ID NO: 334577 - DNA, 20 bp, Artificial Sequence
  chemically synthesized
catctgttgattaataatta

SEQ ID NO: 334578 - DNA, 20 bp, Artificial Sequence
  chemically synthesized
acactttaattattaatcaa

SEQ ID NO: 334579 - DNA, 20 bp, Artificial Sequence
  chemically synthesized
tttaattattaatcaacaga

SEQ ID NO: 334580 - DNA, 20 bp, Artificial Sequence
  chemically synthesized
tattaatcaacagatggtca

SEQ ID NO: 334581 - DNA, 20 bp, Artificial Sequence
  chemically synthesized
atggtcaaagtaatttttgc

SEQ ID NO: 334582 - DNA, 20 bp, Artificial Sequence
  chemically synthesized
atttttgcaagtacttttta

SEQ ID NO: 334583 - DNA, 20 bp, Artificial Sequence
  chemically synthesized
tttgcaagtactttttaaag

SEQ ID NO: 334584 - DNA, 20 bp, Artificial Sequence
  chemically synthesized
ttatttagttcttctttaaa

SEQ ID NO: 334585 - DNA, 20 bp, Artificial Sequence
  chemically synthesized
ttcatgcacaaaatattatt

SEQ ID NO: 334586 - DNA, 20 bp, Artificial Sequence
  chemically synthesized
tgtaagattattaaggaagg

SEQ ID NO: 334587 - DNA, 20 bp, Artificial Sequence
  chemically synthesized
gtttgtaagattattaagga

SEQ ID NO: 334588 - DNA, 20 bp, Artificial Sequence
  chemically synthesized
agtttgtaagattattaagg

SEQ ID NO: 334589 - DNA, 20 bp, Artificial Sequence
  chemically synthesized
ctaagtttgtaagattatta

SEQ ID NO: 334590 - DNA, 20 bp, Artificial Sequence
  chemically synthesized
gctaagtttgtaagattatt

SEQ ID NO: 334591 - DNA, 20 bp, Artificial Sequence
  chemically synthesized
ccttaataatcttacaaact

SEQ ID NO: 334592 - DNA, 20 bp, Artificial Sequence
  chemically synthesized
aattccaaagctaagtttgt

SEQ ID NO: 334593 - DNA, 20 bp, Artificial Sequence
  chemically synthesized
taatcttacaaacttagctt

SEQ ID NO: 334594 - DNA, 20 bp, Artificial Sequence
  chemically synthesized
ggcttcagaattccaaagct

SEQ ID NO: 334595 - DNA, 20 bp, Artificial Sequence
  chemically synthesized
ttctaggcttcagaattcca

SEQ ID NO: 334596 - DNA, 20 bp, Artificial Sequence
  chemically synthesized
aacttagctttggaattctg

SEQ ID NO: 334597 - DNA, 20 bp, Artificial Sequence
  chemically synthesized
agctttggaattctgaagcc

SEQ ID NO: 334598 - DNA, 20 bp, Artificial Sequence
  chemically synthesized
aattggagatttctaggctt

SEQ ID NO: 334599 - DNA, 20 bp, Artificial Sequence
  chemically synthesized
caaatgaattggagatttct

SEQ ID NO: 334600 - DNA, 20 bp, Artificial Sequence
  chemically synthesized
tcaaatgaattggagatttc

SEQ ID NO: 334601 - DNA, 20 bp, Artificial Sequence
  chemically synthesized
aacaattatcaaatgaattg

SEQ ID NO: 334602 - DNA, 20 bp, Artificial Sequence
  chemically synthesized
aaaacaattatcaaatgaat

SEQ ID NO: 334603 - DNA, 20 bp, Artificial Sequence
  chemically synthesized
tctactatataagaaacaat

SEQ ID NO: 334604 - DNA, 20 bp, Artificial Sequence
  chemically synthesized
ttgaccaattgtttcttata

SEQ ID NO: 334605 - DNA, 20 bp, Artificial Sequence
  chemically synthesized
accaattgtttcttatatag

SEQ ID NO: 334606 - DNA, 20 bp, Artificial Sequence
  chemically synthesized
aagtatagtatctactatat

SEQ ID NO: 334607 - DNA, 20 bp, Artificial Sequence
  chemically synthesized
tttcaagatacggtgaagta

SEQ ID NO: 334608 - DNA, 20 bp, Artificial Sequence
  chemically synthesized
tagaatttcaagatacggtg

SEQ ID NO: 334609 - DNA, 20 bp, Artificial Sequence
  chemically synthesized
ttttctagaatttcaagata

SEQ ID NO: 334610 - DNA, 20 bp, Artificial Sequence
  chemically synthesized
ttcaccgtatcttgaaattc

SEQ ID NO: 334611 - DNA, 20 bp, Artificial Sequence
  chemically synthesized
agaacattttctagaatttc

SEQ ID NO: 334612 - DNA, 20 bp, Artificial Sequence
  chemically synthesized
tgagaaggaagaacattttc

SEQ ID NO: 334613 - DNA, 20 bp, Artificial Sequence
  chemically synthesized
actagttactagtgagaagg

SEQ ID NO: 334614 - DNA, 20 bp, Artificial Sequence
  chemically synthesized
aaaatgttcttccttctcac

SEQ ID NO: 334615 - DNA, 20 bp, Artificial Sequence
  chemically synthesized
ctgactagttactagtgaga

SEQ ID NO: 334616 - DNA, 20 bp, Artificial Sequence
  chemically synthesized
gctgactagttactagtgag

SEQ ID NO: 334617 - DNA, 20 bp, Artificial Sequence
  chemically synthesized
acagctgactagttactagt

SEQ ID NO: 334618 - DNA, 20 bp, Artificial Sequence
  chemically synthesized
tcttccttctcactagtaac

SEQ ID NO: 334619 - DNA, 20 bp, Artificial Sequence
  chemically synthesized
aggtacagctgactagttac

SEQ ID NO: 334620 - DNA, 20 bp, Artificial Sequence
  chemically synthesized
ccttctcactagtaactagt

SEQ ID NO: 334621 - DNA, 20 bp, Artificial Sequence
  chemically synthesized
taatcacaggtacagctgac

SEQ ID NO: 334622 - DNA, 20 bp, Artificial Sequence
  chemically synthesized
agttatgctaatcacaggta

SEQ ID NO: 334623 - DNA, 20 bp, Artificial Sequence
  chemically synthesized
tagtcagctgtacctgtgat

SEQ ID NO: 334624 - DNA, 20 bp, Artificial Sequence
  chemically synthesized
ctctaagttatgctaatcac

SEQ ID NO: 334625 - DNA, 20 bp, Artificial Sequence
  chemically synthesized
gctctaagttatgctaatca

SEQ ID NO: 334626 - DNA, 20 bp, Artificial Sequence
  chemically synthesized
tacctgtgattagcataact

SEQ ID NO: 334627 - DNA, 20 bp, Artificial Sequence
  chemically synthesized
cctgtgattagcataactta

SEQ ID NO: 334628 - DNA, 20 bp, Artificial Sequence
  chemically synthesized
actaaaaatgaaagagctct

SEQ ID NO: 334629 - DNA, 20 bp, Artificial Sequence
  chemically synthesized
ttaatatactaaaaatgaaa

SEQ ID NO: 334630 - DNA, 20 bp, Artificial Sequence
  chemically synthesized
acttagagctctttcatttt

SEQ ID NO: 334631 - DNA, 20 bp, Artificial Sequence
  chemically synthesized
atttaatatactaaaaatga

SEQ ID NO: 334632 - DNA, 20 bp, Artificial Sequence
  chemically synthesized
attaaataaaaccatgatgt

SEQ ID NO: 334633 - DNA, 20 bp, Artificial Sequence
  chemically synthesized
ctttttgttttctcacatca

SEQ ID NO: 334634 - DNA, 20 bp, Artificial Sequence
  chemically synthesized
ccatgatgtgagaaaacaaa

SEQ ID NO: 334635 - DNA, 20 bp, Artificial Sequence
  chemically synthesized
catgatgtgagaaaacaaaa

SEQ ID NO: 334636 - DNA, 20 bp, Artificial Sequence
  chemically synthesized
atgatgtgagaaaacaaaaa

SEQ ID NO: 334637 - DNA, 20 bp, Artificial Sequence
  chemically synthesized
gtgagaaaacaaaaagggtt

SEQ ID NO: 334638 - DNA, 20 bp, Artificial Sequence
  chemically synthesized
acacagcagtgaataggcac

SEQ ID NO: 334639 - DNA, 20 bp, Artificial Sequence
  chemically synthesized
aacacagcagtgaataggca

SEQ ID NO: 334640 - DNA, 20 bp, Artificial Sequence
  chemically synthesized
tgtataacacagcagtgaat

SEQ ID NO: 334641 - DNA, 20 bp, Artificial Sequence
  chemically synthesized
atgtataacacagcagtgaa

SEQ ID NO: 334642 - DNA, 20 bp, Artificial Sequence
  chemically synthesized
tgtgtctatgtataacacag

SEQ ID NO: 334643 - DNA, 20 bp, Artificial Sequence
  chemically synthesized
gcatgtgtctatgtataaca

SEQ ID NO: 334644 - DNA, 20 bp, Artificial Sequence
  chemically synthesized
attcactgctgtgttataca

SEQ ID NO: 334645 - DNA, 20 bp, Artificial Sequence
  chemically synthesized
tagacacatgcatgtatgtt

SEQ ID NO: 334646 - DNA, 20 bp, Artificial Sequence
  chemically synthesized
ttttataatggcatatattt

SEQ ID NO: 334647 - DNA, 20 bp, Artificial Sequence
  chemically synthesized
caaatatatgccattataaa

SEQ ID NO: 334648 - DNA, 20 bp, Artificial Sequence
  chemically synthesized
ccattttttactttttataa

SEQ ID NO: 334649 - DNA, 20 bp, Artificial Sequence
  chemically synthesized
ccattataaaaagtaaaaaa

SEQ ID NO: 334650 - DNA, 20 bp, Artificial Sequence
  chemically synthesized
agtaaaaaatggtgaaaaat

SEQ ID NO: 334651 - DNA, 20 bp, Artificial Sequence
  chemically synthesized
aaaatggtgaaaaattggcc

SEQ ID NO: 334652 - DNA, 20 bp, Artificial Sequence
  chemically synthesized
ggggcaataaaaataatgct

SEQ ID NO: 334653 - DNA, 20 bp, Artificial Sequence
  chemically synthesized
aatgtttgaaattttttggg

SEQ ID NO: 334654 - DNA, 20 bp, Artificial Sequence
  chemically synthesized
caatgtttgaaattttttgg

SEQ ID NO: 334655 - DNA, 20 bp, Artificial Sequence
  chemically synthesized
acaatgtttgaaattttttg

SEQ ID NO: 334656 - DNA, 20 bp, Artificial Sequence
  chemically synthesized
tacaatgtttgaaatttttt

SEQ ID NO: 334657 - DNA, 20 bp, Artificial Sequence
  chemically synthesized
ttacaatgtttgaaattttt

SEQ ID NO: 334658 - DNA, 20 bp, Artificial Sequence
  chemically synthesized
tttcatttacataaaacatg

SEQ ID NO: 334659 - DNA, 20 bp, Artificial Sequence
  chemically synthesized
taaaacatgtggactaaatg

SEQ ID NO: 334660 - DNA, 20 bp, Artificial Sequence
  chemically synthesized
tatttatgaacagctgcatt

SEQ ID NO: 334661 - DNA, 20 bp, Artificial Sequence
  chemically synthesized
taatgactgatatttatgaa

SEQ ID NO: 334662 - DNA, 20 bp, Artificial Sequence
  chemically synthesized
atgcagctgttcataaatat

SEQ ID NO: 334663 - DNA, 20 bp, Artificial Sequence
  chemically synthesized
tggcaatagtttggttaaat

SEQ ID NO: 334664 - DNA, 20 bp, Artificial Sequence
  chemically synthesized
ggggcaaaatggcaatagtt

SEQ ID NO: 334665 - DNA, 20 bp, Artificial Sequence
  chemically synthesized
agtttggggcaaaatggcaa

SEQ ID NO: 334666 - DNA, 20 bp, Artificial Sequence
  chemically synthesized
agtaatagtttggggcaaaa

SEQ ID NO: 334667 - DNA, 20 bp, Artificial Sequence
  chemically synthesized
agtgggatagtaatagtttg

SEQ ID NO: 334668 - DNA, 20 bp, Artificial Sequence
  chemically synthesized
aagtgggatagtaatagttt

SEQ ID NO: 334669 - DNA, 20 bp, Artificial Sequence
  chemically synthesized
gaagtgggatagtaatagtt

SEQ ID NO: 334670 - DNA, 20 bp, Artificial Sequence
  chemically synthesized
tctcagaagtgggatagtaa

SEQ ID NO: 334671 - DNA, 20 bp, Artificial Sequence
  chemically synthesized
acataatctcagaagtggga

SEQ ID NO: 334672 - DNA, 20 bp, Artificial Sequence
  chemically synthesized
actattactatcccacttct

SEQ ID NO: 334673 - DNA, 20 bp, Artificial Sequence
  chemically synthesized
ttccacataatctcagaagt

SEQ ID NO: 334674 - DNA, 20 bp, Artificial Sequence
  chemically synthesized
attccacataatctcagaag

SEQ ID NO: 334675 - DNA, 20 bp, Artificial Sequence
  chemically synthesized
tgaattccacataatctcag

SEQ ID NO: 334676 - DNA, 20 bp, Artificial Sequence
  chemically synthesized
ttttgaattccacataatct

SEQ ID NO: 334677 - DNA, 20 bp, Artificial Sequence
  chemically synthesized
atcccacttctgagattatg

SEQ ID NO: 334678 - DNA, 20 bp, Artificial Sequence
  chemically synthesized
tatgtggaattcaaaactgc

SEQ ID NO: 334679 - DNA, 20 bp, Artificial Sequence
  chemically synthesized
gtggaattcaaaactgccag

SEQ ID NO: 334680 - DNA, 20 bp, Artificial Sequence
  chemically synthesized
tggaattcaaaactgccagt

SEQ ID NO: 334681 - DNA, 20 bp, Artificial Sequence
  chemically synthesized
tacttatttctacctactgg

SEQ ID NO: 334682 - DNA, 20 bp, Artificial Sequence
  chemically synthesized
aattcaaaactgccagtagg

SEQ ID NO: 334683 - DNA, 20 bp, Artificial Sequence
  chemically synthesized
aattacttatttctacctac

SEQ ID NO: 334684 - DNA, 20 bp, Artificial Sequence
  chemically synthesized
aactgccagtaggtagaaat

SEQ ID NO: 334685 - DNA, 20 bp, Artificial Sequence
  chemically synthesized
gtagaaataagtaatttttg

SEQ ID NO: 334686 - DNA, 20 bp, Artificial Sequence
  chemically synthesized
aaataagtaatttttgaaga

SEQ ID NO: 334687 - DNA, 20 bp, Artificial Sequence
  chemically synthesized
aataagtaatttttgaagaa

SEQ ID NO: 334688 - DNA, 20 bp, Artificial Sequence
  chemically synthesized
aatttttgaagaaaggaatt

SEQ ID NO: 334689 - DNA, 20 bp, Artificial Sequence
  chemically synthesized
atttttgaagaaaggaattt

SEQ ID NO: 334690 - DNA, 20 bp, Artificial Sequence
  chemically synthesized
tgaaattcaaaatattttag

SEQ ID NO: 334691 - DNA, 20 bp, Artificial Sequence
  chemically synthesized
tgatgaaattcaaaatattt

SEQ ID NO: 334692 - DNA, 20 bp, Artificial Sequence
  chemically synthesized
tttcatcaacatacattttc

SEQ ID NO: 334693 - DNA, 20 bp, Artificial Sequence
  chemically synthesized
ttaaaatactttgaatataa

SEQ ID NO: 334694 - DNA, 20 bp, Artificial Sequence
  chemically synthesized
caagaaatctattatattca

SEQ ID NO: 334695 - DNA, 20 bp, Artificial Sequence
  chemically synthesized
ttatattcaaagtattttaa

SEQ ID NO: 334696 - DNA, 20 bp, Artificial Sequence
  chemically synthesized
aagtattttaatggattatc

SEQ ID NO: 334697 - DNA, 20 bp, Artificial Sequence
  chemically synthesized
agtattttaatggattatcc

SEQ ID NO: 334698 - DNA, 20 bp, Artificial Sequence
  chemically synthesized
tttctatctttcaaatttcc

SEQ ID NO: 334699 - DNA, 20 bp, Artificial Sequence
  chemically synthesized
ggattatccaggaaatttga

SEQ ID NO: 334700 - DNA, 20 bp, Artificial Sequence
  chemically synthesized
tatccaggaaatttgaaaga

SEQ ID NO: 334701 - DNA, 20 bp, Artificial Sequence
  chemically synthesized
ttcttattccaaattagaag

SEQ ID NO: 334702 - DNA, 20 bp, Artificial Sequence
  chemically synthesized
catgaattctgcttctaatt

SEQ ID NO: 334703 - DNA, 20 bp, Artificial Sequence
  chemically synthesized
actttcttattccaaattag

SEQ ID NO: 334704 - DNA, 20 bp, Artificial Sequence
  chemically synthesized
tttactttcttattccaaat

SEQ ID NO: 334705 - DNA, 20 bp, Artificial Sequence
  chemically synthesized
ttctgcttctaatttggaat

SEQ ID NO: 334706 - DNA, 20 bp, Artificial Sequence
  chemically synthesized
gcttctaatttggaataaga

SEQ ID NO: 334707 - DNA, 20 bp, Artificial Sequence
  chemically synthesized
tggaataagaaagtaaataa

SEQ ID NO: 334708 - DNA, 20 bp, Artificial Sequence
  chemically synthesized
aataagaaagtaaataatag

SEQ ID NO: 334709 - DNA, 20 bp, Artificial Sequence
  chemically synthesized
aagtaaataatagaagtaca

SEQ ID NO: 334710 - DNA, 20 bp, Artificial Sequence
  chemically synthesized
aaagtaattgcattgctgaa

SEQ ID NO: 334711 - DNA, 20 bp, Artificial Sequence
  chemically synthesized
aacacattttaaattctgtt

SEQ ID NO: 334712 - DNA, 20 bp, Artificial Sequence
  chemically synthesized
ttaaaatgtgttcctctaat

SEQ ID NO: 334713 - DNA, 20 bp, Artificial Sequence
  chemically synthesized
caactggttgtgccaattag

SEQ ID NO: 334714 - DNA, 20 bp, Artificial Sequence
  chemically synthesized
acaactggttgtgccaatta

SEQ ID NO: 334715 - DNA, 20 bp, Artificial Sequence
  chemically synthesized
aaacaactggttgtgccaat

SEQ ID NO: 334716 - DNA, 20 bp, Artificial Sequence
  chemically synthesized
gttcctctaattggcacaac

SEQ ID NO: 334717 - DNA, 20 bp, Artificial Sequence
  chemically synthesized
atctgaacatgttaaacaac

SEQ ID NO: 334718 - DNA, 20 bp, Artificial Sequence
  chemically synthesized
aaccagttgtttaacatgtt

SEQ ID NO: 334719 - DNA, 20 bp, Artificial Sequence
  chemically synthesized
tttttaaaatcatataatat

SEQ ID NO: 334720 - DNA, 20 bp, Artificial Sequence
  chemically synthesized
tttaaaatcatataatattg

SEQ ID NO: 334721 - DNA, 20 bp, Artificial Sequence
  chemically synthesized
ttaaaatcatataatattgg

SEQ ID NO: 334722 - DNA, 20 bp, Artificial Sequence
  chemically synthesized
atcatataatattggaggat

SEQ ID NO: 334723 - DNA, 20 bp, Artificial Sequence
  chemically synthesized
tcatataatattggaggata

SEQ ID NO: 334724 - DNA, 20 bp, Artificial Sequence
  chemically synthesized
ataaggcaattctctttaaa

SEQ ID NO: 334725 - DNA, 20 bp, Artificial Sequence
  chemically synthesized
taaggcaattctctttaaat

SEQ ID NO: 334726 - DNA, 20 bp, Artificial Sequence
  chemically synthesized
aattcagtttcctatttaaa

SEQ ID NO: 334727 - DNA, 20 bp, Artificial Sequence
  chemically synthesized
ttaattcagtttcctattta

SEQ ID NO: 334728 - DNA, 20 bp, Artificial Sequence
  chemically synthesized
aatcctatgcataattaatt

SEQ ID NO: 334729 - DNA, 20 bp, Artificial Sequence
  chemically synthesized
gaaactgaattaattatgca

SEQ ID NO: 334730 - DNA, 20 bp, Artificial Sequence
  chemically synthesized
aaactgaattaattatgcat

SEQ ID NO: 334731 - DNA, 20 bp, Artificial Sequence
  chemically synthesized
aattatgcataggatttcaa

SEQ ID NO: 334732 - DNA, 20 bp, Artificial Sequence
  chemically synthesized
atgcataggatttcaatagc

SEQ ID NO: 334733 - DNA, 20 bp, Artificial Sequence
  chemically synthesized
ggatttcaatagctggaaat

SEQ ID NO: 334734 - DNA, 20 bp, Artificial Sequence
  chemically synthesized
gatttcaatagctggaaatg

SEQ ID NO: 334735 - DNA, 20 bp, Artificial Sequence
  chemically synthesized
atttcaatagctggaaatga

SEQ ID NO: 334736 - DNA, 20 bp, Artificial Sequence
  chemically synthesized
cttccccattccctcatttc

SEQ ID NO: 334737 - DNA, 20 bp, Artificial Sequence
  chemically synthesized
aatagctggaaatgagggaa

SEQ ID NO: 334738 - DNA, 20 bp, Artificial Sequence
  chemically synthesized
atagctggaaatgagggaat

SEQ ID NO: 334739 - DNA, 20 bp, Artificial Sequence
  chemically synthesized
tagctggaaatgagggaatg

SEQ ID NO: 334740 - DNA, 20 bp, Artificial Sequence
  chemically synthesized
ctggaaatgagggaatgggg

SEQ ID NO: 334741 - DNA, 20 bp, Artificial Sequence
  chemically synthesized
ggaaatgagggaatggggaa

SEQ ID NO: 334742 - DNA, 20 bp, Artificial Sequence
  chemically synthesized
agggaatggggaagagtatt

SEQ ID NO: 334743 - DNA, 20 bp, Artificial Sequence
  chemically synthesized
gggaatggggaagagtattc

SEQ ID NO: 334744 - DNA, 20 bp, Artificial Sequence
  chemically synthesized
ggaatggggaagagtattcg

SEQ ID NO: 334745 - DNA, 20 bp, Artificial Sequence
  chemically synthesized
atggggaagagtattcgggg

SEQ ID NO: 334746 - DNA, 20 bp, Artificial Sequence
  chemically synthesized
gggaagagtattcggggcag

SEQ ID NO: 334747 - DNA, 20 bp, Artificial Sequence
  chemically synthesized
ggaagagtattcggggcagt

SEQ ID NO: 334748 - DNA, 20 bp, Artificial Sequence
  chemically synthesized
ttcggggcagtgggaatatg

SEQ ID NO: 334749 - DNA, 20 bp, Artificial Sequence
  chemically synthesized
gaatatgtagaataaacatg

SEQ ID NO: 334750 - DNA, 20 bp, Artificial Sequence
  chemically synthesized
atatgtagaataaacatgca

SEQ ID NO: 334751 - DNA, 20 bp, Artificial Sequence
  chemically synthesized
tatgtagaataaacatgcag

SEQ ID NO: 334752 - DNA, 20 bp, Artificial Sequence
  chemically synthesized
gtagaataaacatgcagagg

SEQ ID NO: 334753 - DNA, 20 bp, Artificial Sequence
  chemically synthesized
tagaataaacatgcagaggt

SEQ ID NO: 334754 - DNA, 20 bp, Artificial Sequence
  chemically synthesized
agaataaacatgcagaggta

SEQ ID NO: 334755 - DNA, 20 bp, Artificial Sequence
  chemically synthesized
atgcagaggtagggacacat

SEQ ID NO: 334756 - DNA, 20 bp, Artificial Sequence
  chemically synthesized
gggacacattagcgatgtct

SEQ ID NO: 334757 - DNA, 20 bp, Artificial Sequence
  chemically synthesized
cattagcgatgtcttggcaa

SEQ ID NO: 334758 - DNA, 20 bp, Artificial Sequence
  chemically synthesized
cacacaaagccactgttgcc

SEQ ID NO: 334759 - DNA, 20 bp, Artificial Sequence
  chemically synthesized
tagcgatgtcttggcaacag

SEQ ID NO: 334760 - DNA, 20 bp, Artificial Sequence
  chemically synthesized
tactctctctaagacacaca

SEQ ID NO: 334761 - DNA, 20 bp, Artificial Sequence
  chemically synthesized
aacagtggctttgtgtgtct

SEQ ID NO: 334762 - DNA, 20 bp, Artificial Sequence
  chemically synthesized
cagtggctttgtgtgtctta

SEQ ID NO: 334763 - DNA, 20 bp, Artificial Sequence
  chemically synthesized
gtggctttgtgtgtcttaga

SEQ ID NO: 334764 - DNA, 20 bp, Artificial Sequence
  chemically synthesized
ggctttgtgtgtcttagaga

SEQ ID NO: 334765 - DNA, 20 bp, Artificial Sequence
  chemically synthesized
ttcactactctactctctct

SEQ ID NO: 334766 - DNA, 20 bp, Artificial Sequence
  chemically synthesized
tttgtgtgtcttagagagag

SEQ ID NO: 334767 - DNA, 20 bp, Artificial Sequence
  chemically synthesized
tgtgtgtcttagagagagta

SEQ ID NO: 334768 - DNA, 20 bp, Artificial Sequence
  chemically synthesized
gtgtcttagagagagtagag

SEQ ID NO: 334769 - DNA, 20 bp, Artificial Sequence
  chemically synthesized
agagtagagtagtgaaaact

SEQ ID NO: 334770 - DNA, 20 bp, Artificial Sequence
  chemically synthesized
acaatctaccagtttcatct

SEQ ID NO: 334771 - DNA, 20 bp, Artificial Sequence
  chemically synthesized
agtgaaaactaagatgaaac

SEQ ID NO: 334772 - DNA, 20 bp, Artificial Sequence
  chemically synthesized
gaaaactaagatgaaactgg

SEQ ID NO: 334773 - DNA, 20 bp, Artificial Sequence
  chemically synthesized
gttttctatgtacaatctac

SEQ ID NO: 334774 - DNA, 20 bp, Artificial Sequence
  chemically synthesized
tgaaactggtagattgtaca

SEQ ID NO: 334775 - DNA, 20 bp, Artificial Sequence
  chemically synthesized
tagattgtacatagaaaact

SEQ ID NO: 334776 - DNA, 20 bp, Artificial Sequence
  chemically synthesized
agattgtacatagaaaactg

SEQ ID NO: 334777 - DNA, 20 bp, Artificial Sequence
  chemically synthesized
gattgtacatagaaaactga

SEQ ID NO: 334778 - DNA, 20 bp, Artificial Sequence
  chemically synthesized
gtttgctgttgatgatccct

SEQ ID NO: 334779 - DNA, 20 bp, Artificial Sequence
  chemically synthesized
gaaaactgagggatcatcaa

SEQ ID NO: 334780 - DNA, 20 bp, Artificial Sequence
  chemically synthesized
agggatcatcaacagcaaac

SEQ ID NO: 334781 - DNA, 20 bp, Artificial Sequence
  chemically synthesized
caacagcaaactagaaaacc

SEQ ID NO: 334782 - DNA, 20 bp, Artificial Sequence
  chemically synthesized
tgaatgaaggccaggttttc

SEQ ID NO: 334783 - DNA, 20 bp, Artificial Sequence
  chemically synthesized
tagtctattgaatgaaggcc

SEQ ID NO: 334784 - DNA, 20 bp, Artificial Sequence
  chemically synthesized
ctagtctattgaatgaaggc

SEQ ID NO: 334785 - DNA, 20 bp, Artificial Sequence
  chemically synthesized
ctctctagtctattgaatga

SEQ ID NO: 334786 - DNA, 20 bp, Artificial Sequence
  chemically synthesized
aaaacctggccttcattcaa

SEQ ID NO: 334787 - DNA, 20 bp, Artificial Sequence
  chemically synthesized
actctctagtctattgaatg

SEQ ID NO: 334788 - DNA, 20 bp, Artificial Sequence
  chemically synthesized
ctggccttcattcaatagac

SEQ ID NO: 334789 - DNA, 20 bp, Artificial Sequence
  chemically synthesized
ggccttcattcaatagacta

SEQ ID NO: 334790 - DNA, 20 bp, Artificial Sequence
  chemically synthesized
ccttcattcaatagactaga

SEQ ID NO: 334791 - DNA, 20 bp, Artificial Sequence
  chemically synthesized
attgaaaagtatttactctc

SEQ ID NO: 334792 - DNA, 20 bp, Artificial Sequence
  chemically synthesized
gagagtaaatacttttcaat

SEQ ID NO: 334793 - DNA, 20 bp, Artificial Sequence
  chemically synthesized
ggtgtcaccctctcattgaa

SEQ ID NO: 334794 - DNA, 20 bp, Artificial Sequence
  chemically synthesized
gagtaaatacttttcaatga

SEQ ID NO: 334795 - DNA, 20 bp, Artificial Sequence
  chemically synthesized
agtaaatacttttcaatgag

SEQ ID NO: 334796 - DNA, 20 bp, Artificial Sequence
  chemically synthesized
gtaaatacttttcaatgaga

SEQ ID NO: 334797 - DNA, 20 bp, Artificial Sequence
  chemically synthesized
ttactttaataaaattttga

SEQ ID NO: 334798 - DNA, 20 bp, Artificial Sequence
  chemically synthesized
acaccatcaaaattttatta

SEQ ID NO: 334799 - DNA, 20 bp, Artificial Sequence
  chemically synthesized
tttattaaagtaaattcttt

SEQ ID NO: 334800 - DNA, 20 bp, Artificial Sequence
  chemically synthesized
taaagtaaattctttaagta

SEQ ID NO: 334801 - DNA, 20 bp, Artificial Sequence
  chemically synthesized
agcaatccattctgtactta

SEQ ID NO: 334802 - DNA, 20 bp, Artificial Sequence
  chemically synthesized
taaattctttaagtacagaa

SEQ ID NO: 334803 - DNA, 20 bp, Artificial Sequence
  chemically synthesized
ttaagtacagaatggattgc

SEQ ID NO: 334804 - DNA, 20 bp, Artificial Sequence
  chemically synthesized
aagtacagaatggattgctg

SEQ ID NO: 334805 - DNA, 20 bp, Artificial Sequence
  chemically synthesized
agtacagaatggattgctgg

SEQ ID NO: 334806 - DNA, 20 bp, Artificial Sequence
  chemically synthesized
atttctctcaagttttcctc

SEQ ID NO: 334807 - DNA, 20 bp, Artificial Sequence
  chemically synthesized
ggattgctggaggaaaactt

SEQ ID NO: 334808 - DNA, 20 bp, Artificial Sequence
  chemically synthesized
attgctggaggaaaacttga

SEQ ID NO: 334809 - DNA, 20 bp, Artificial Sequence
  chemically synthesized
cctagcctcctatttctctc

SEQ ID NO: 334810 - DNA, 20 bp, Artificial Sequence
  chemically synthesized
ggaggaaaacttgagagaaa

SEQ ID NO: 334811 - DNA, 20 bp, Artificial Sequence
  chemically synthesized
gaggaaaacttgagagaaat

SEQ ID NO: 334812 - DNA, 20 bp, Artificial Sequence
  chemically synthesized
ggaaaacttgagagaaatag

SEQ ID NO: 334813 - DNA, 20 bp, Artificial Sequence
  chemically synthesized
gaaaacttgagagaaatagg

SEQ ID NO: 334814 - DNA, 20 bp, Artificial Sequence
  chemically synthesized
acttgagagaaataggaggc

SEQ ID NO: 334815 - DNA, 20 bp, Artificial Sequence
  chemically synthesized
cttgagagaaataggaggct

SEQ ID NO: 334816 - DNA, 20 bp, Artificial Sequence
  chemically synthesized
ttatatctggattatggtcc

SEQ ID NO: 334817 - DNA, 20 bp, Artificial Sequence
  chemically synthesized
aggaggctaggaccataatc

SEQ ID NO: 334818 - DNA, 20 bp, Artificial Sequence
  chemically synthesized
aacactttatatctggatta

SEQ ID NO: 334819 - DNA, 20 bp, Artificial Sequence
  chemically synthesized
aggaccataatccagatata

SEQ ID NO: 334820 - DNA, 20 bp, Artificial Sequence
  chemically synthesized
gatcttgaacactttatatc

SEQ ID NO: 334821 - DNA, 20 bp, Artificial Sequence
  chemically synthesized
aatccagatataaagtgttc

SEQ ID NO: 334822 - DNA, 20 bp, Artificial Sequence
  chemically synthesized
atataaagtgttcaagatct

SEQ ID NO: 334823 - DNA, 20 bp, Artificial Sequence
  chemically synthesized
tataaagtgttcaagatcta

SEQ ID NO: 334824 - DNA, 20 bp, Artificial Sequence
  chemically synthesized
ccccgtacacagttgtacct

SEQ ID NO: 334825 - DNA, 20 bp, Artificial Sequence
  chemically synthesized
atctaaggtacaactgtgta

SEQ ID NO: 334826 - DNA, 20 bp, Artificial Sequence
  chemically synthesized
tctaaggtacaactgtgtac

SEQ ID NO: 334827 - DNA, 20 bp, Artificial Sequence
  chemically synthesized
ctaaggtacaactgtgtacg

SEQ ID NO: 334828 - DNA, 20 bp, Artificial Sequence
  chemically synthesized
taaggtacaactgtgtacgg

SEQ ID NO: 334829 - DNA, 20 bp, Artificial Sequence
  chemically synthesized
gttttcatttcccccgtaca

SEQ ID NO: 334830 - DNA, 20 bp, Artificial Sequence
  chemically synthesized
tgtacgggggaaatgaaaac

SEQ ID NO: 334831 - DNA, 20 bp, Artificial Sequence
  chemically synthesized
caatgaatgacaaaaattct

SEQ ID NO: 334832 - DNA, 20 bp, Artificial Sequence
  chemically synthesized
gaatgacaaaaattctaaga

SEQ ID NO: 334833 - DNA, 20 bp, Artificial Sequence
  chemically synthesized
aagtcatttttgatccatct

SEQ ID NO: 334834 - DNA, 20 bp, Artificial Sequence
  chemically synthesized
aatgatttgaaaattgaatg

SEQ ID NO: 334835 - DNA, 20 bp, Artificial Sequence
  chemically synthesized
ttttcaaatcatttactcca

SEQ ID NO: 334836 - DNA, 20 bp, Artificial Sequence
  chemically synthesized
aggcatttccaaagactgtg

SEQ ID NO: 334837 - DNA, 20 bp, Artificial Sequence
  chemically synthesized
atcatttactccacagtctt

SEQ ID NO: 334838 - DNA, 20 bp, Artificial Sequence
  chemically synthesized
ataggcatttccaaagactg

SEQ ID NO: 334839 - DNA, 20 bp, Artificial Sequence
  chemically synthesized
tttgtatataggcatttcca

SEQ ID NO: 334840 - DNA, 20 bp, Artificial Sequence
  chemically synthesized
tttggaaatgcctatataca

SEQ ID NO: 334841 - DNA, 20 bp, Artificial Sequence
  chemically synthesized
tagcacataactttgtatat

SEQ ID NO: 334842 - DNA, 20 bp, Artificial Sequence
  chemically synthesized
gtagcacataactttgtata

SEQ ID NO: 334843 - DNA, 20 bp, Artificial Sequence
  chemically synthesized
atatacaaagttatgtgcta

SEQ ID NO: 334844 - DNA, 20 bp, Artificial Sequence
  chemically synthesized
aaagttatgtgctacagcct

SEQ ID NO: 334845 - DNA, 20 bp, Artificial Sequence
  chemically synthesized
aagttatgtgctacagcctt

SEQ ID NO: 334846 - DNA, 20 bp, Artificial Sequence
  chemically synthesized
atctttatatcctaaggctg

SEQ ID NO: 334847 - DNA, 20 bp, Artificial Sequence
  chemically synthesized
ttattaatctttatatccta

SEQ ID NO: 334848 - DNA, 20 bp, Artificial Sequence
  chemically synthesized
tttattaatctttatatcct

SEQ ID NO: 334849 - DNA, 20 bp, Artificial Sequence
  chemically synthesized
tgctacagccttaggatata

SEQ ID NO: 334850 - DNA, 20 bp, Artificial Sequence
  chemically synthesized
ttcctcctttgttttattgt

SEQ ID NO: 334851 - DNA, 20 bp, Artificial Sequence
  chemically synthesized
aataaactgacaataaaaca

SEQ ID NO: 334852 - DNA, 20 bp, Artificial Sequence
  chemically synthesized
ataaactgacaataaaacaa

SEQ ID NO: 334853 - DNA, 20 bp, Artificial Sequence
  chemically synthesized
aaactgacaataaaacaaag

SEQ ID NO: 334854 - DNA, 20 bp, Artificial Sequence
  chemically synthesized
aactgacaataaaacaaagg

SEQ ID NO: 334855 - DNA, 20 bp, Artificial Sequence
  chemically synthesized
tgacaataaaacaaaggagg

SEQ ID NO: 334856 - DNA, 20 bp, Artificial Sequence
  chemically synthesized
acaataaaacaaaggaggaa

SEQ ID NO: 334857 - DNA, 20 bp, Artificial Sequence
  chemically synthesized
caataaaacaaaggaggaag

SEQ ID NO: 334858 - DNA, 20 bp, Artificial Sequence
  chemically synthesized
acaaaggaggaagaggacga

SEQ ID NO: 334859 - DNA, 20 bp, Artificial Sequence
  chemically synthesized
aaaggaggaagaggacgaaa

SEQ ID NO: 334860 - DNA, 20 bp, Artificial Sequence
  chemically synthesized
aaggaggaagaggacgaaag

SEQ ID NO: 334861 - DNA, 20 bp, Artificial Sequence
  chemically synthesized
taccatggctgcagaacaat

SEQ ID NO: 334862 - DNA, 20 bp, Artificial Sequence
  chemically synthesized
agaggacactgattgttctg

SEQ ID NO: 334863 - DNA, 20 bp, Artificial Sequence
  chemically synthesized
cactgattgttctgcagcca

SEQ ID NO: 334864 - DNA, 20 bp, Artificial Sequence
  chemically synthesized
tctacttgttaccatggctg

SEQ ID NO: 334865 - DNA, 20 bp, Artificial Sequence
  chemically synthesized
tgttctgcagccatggtaac

SEQ ID NO: 334866 - DNA, 20 bp, Artificial Sequence
  chemically synthesized
ttggtgtctacttgttacca

SEQ ID NO: 334867 - DNA, 20 bp, Artificial Sequence
  chemically synthesized
tctgcagccatggtaacaag

SEQ ID NO: 334868 - DNA, 20 bp, Artificial Sequence
  chemically synthesized
taacaagtagacaccaacaa

SEQ ID NO: 334869 - DNA, 20 bp, Artificial Sequence
  chemically synthesized
gggtagattgaaacttttgt

SEQ ID NO: 334870 - DNA, 20 bp, Artificial Sequence
  chemically synthesized
tgttaaatgaataaataggg

SEQ ID NO: 334871 - DNA, 20 bp, Artificial Sequence
  chemically synthesized
aattgttaaatgaataaata

SEQ ID NO: 334872 - DNA, 20 bp, Artificial Sequence
  chemically synthesized
taattgttaaatgaataaat

SEQ ID NO: 334873 - DNA, 20 bp, Artificial Sequence
  chemically synthesized
ctaattgttaaatgaataaa

SEQ ID NO: 334874 - DNA, 20 bp, Artificial Sequence
  chemically synthesized
ctatttattcatttaacaat

SEQ ID NO: 334875 - DNA, 20 bp, Artificial Sequence
  chemically synthesized
aagcatgataagaatcatgg

SEQ ID NO: 334876 - DNA, 20 bp, Artificial Sequence
  chemically synthesized
gaagcatgataagaatcatg

SEQ ID NO: 334877 - DNA, 20 bp, Artificial Sequence
  chemically synthesized
gggaagcatgataagaatca

SEQ ID NO: 334878 - DNA, 20 bp, Artificial Sequence
  chemically synthesized
ttggctgggggaagcatgat

SEQ ID NO: 334879 - DNA, 20 bp, Artificial Sequence
  chemically synthesized
gattcttatcatgcttcccc

SEQ ID NO: 334880 - DNA, 20 bp, Artificial Sequence
  chemically synthesized
tgctgctggttggctggggg

SEQ ID NO: 334881 - DNA, 20 bp, Artificial Sequence
  chemically synthesized
gtttgctgctggttggctgg

SEQ ID NO: 334882 - DNA, 20 bp, Artificial Sequence
  chemically synthesized
tgtttgctgctggttggctg

SEQ ID NO: 334883 - DNA, 20 bp, Artificial Sequence
  chemically synthesized
tcatgcttcccccagccaac

SEQ ID NO: 334884 - DNA, 20 bp, Artificial Sequence
  chemically synthesized
gtgtttgctgctggttggct

SEQ ID NO: 334885 - DNA, 20 bp, Artificial Sequence
  chemically synthesized
agtgtttgctgctggttggc

SEQ ID NO: 334886 - DNA, 20 bp, Artificial Sequence
  chemically synthesized
tgcttcccccagccaaccag

SEQ ID NO: 334887 - DNA, 20 bp, Artificial Sequence
  chemically synthesized
agggagtgtttgctgctggt

SEQ ID NO: 334888 - DNA, 20 bp, Artificial Sequence
  chemically synthesized
cagaagggagtgtttgctgc

SEQ ID NO: 334889 - DNA, 20 bp, Artificial Sequence
  chemically synthesized
tctggcaaagtttcagaagg

SEQ ID NO: 334890 - DNA, 20 bp, Artificial Sequence
  chemically synthesized
actctggcaaagtttcagaa

SEQ ID NO: 334891 - DNA, 20 bp, Artificial Sequence
  chemically synthesized
cactctggcaaagtttcaga

SEQ ID NO: 334892 - DNA, 20 bp, Artificial Sequence
  chemically synthesized
ccactctggcaaagtttcag

SEQ ID NO: 334893 - DNA, 20 bp, Artificial Sequence
  chemically synthesized
aatccactctggcaaagttt

SEQ ID NO: 334894 - DNA, 20 bp, Artificial Sequence
  chemically synthesized
actcccttctgaaactttgc

SEQ ID NO: 334895 - DNA, 20 bp, Artificial Sequence
  chemically synthesized
tcccttctgaaactttgcca

SEQ ID NO: 334896 - DNA, 20 bp, Artificial Sequence
  chemically synthesized
gaagtgaatccactctggca

SEQ ID NO: 334897 - DNA, 20 bp, Artificial Sequence
  chemically synthesized
cttctgaaactttgccagag

SEQ ID NO: 334898 - DNA, 20 bp, Artificial Sequence
  chemically synthesized
tcattgaagtgaatccactc

SEQ ID NO: 334899 - DNA, 20 bp, Artificial Sequence
  chemically synthesized
agagtggattcacttcaatg

SEQ ID NO: 334900 - DNA, 20 bp, Artificial Sequence
  chemically synthesized
tttgagaattatcttcattg

SEQ ID NO: 334901 - DNA, 20 bp, Artificial Sequence
  chemically synthesized
agaccattgttaattagttt

SEQ ID NO: 334902 - DNA, 20 bp, Artificial Sequence
  chemically synthesized
caggtgagaccattgttaat

SEQ ID NO: 334903 - DNA, 20 bp, Artificial Sequence
  chemically synthesized
attctcaaactaattaacaa

SEQ ID NO: 334904 - DNA, 20 bp, Artificial Sequence
  chemically synthesized
aattaacaatggtctcacct

SEQ ID NO: 334905 - DNA, 20 bp, Artificial Sequence
  chemically synthesized
agaagcgtggtaactcaggt

SEQ ID NO: 334906 - DNA, 20 bp, Artificial Sequence
  chemically synthesized
ctttagaagcgtggtaactc

SEQ ID NO: 334907 - DNA, 20 bp, Artificial Sequence
  chemically synthesized
gctttagaagcgtggtaact

SEQ ID NO: 334908 - DNA, 20 bp, Artificial Sequence
  chemically synthesized
tgatgatagctttagaagcg

SEQ ID NO: 334909 - DNA, 20 bp, Artificial Sequence
  chemically synthesized
cctgagttaccacgcttcta

SEQ ID NO: 334910 - DNA, 20 bp, Artificial Sequence
  chemically synthesized
taggatgatgatagctttag

SEQ ID NO: 334911 - DNA, 20 bp, Artificial Sequence
  chemically synthesized
gaataggatgatgatagctt

SEQ ID NO: 334912 - DNA, 20 bp, Artificial Sequence
  chemically synthesized
gattgggaataggatgatga

SEQ ID NO: 334913 - DNA, 20 bp, Artificial Sequence
  chemically synthesized
gaacatttcagattgggaat

SEQ ID NO: 334914 - DNA, 20 bp, Artificial Sequence
  chemically synthesized
agaacatttcagattgggaa

SEQ ID NO: 334915 - DNA, 20 bp, Artificial Sequence
  chemically synthesized
atctaagaacatttcagatt

SEQ ID NO: 334916 - DNA, 20 bp, Artificial Sequence
  chemically synthesized
aatctaagaacatttcagat

SEQ ID NO: 334917 - DNA, 20 bp, Artificial Sequence
  chemically synthesized
ccagcaatctaagaacattt

SEQ ID NO: 334918 - DNA, 20 bp, Artificial Sequence
  chemically synthesized
ttcccaatctgaaatgttct

SEQ ID NO: 334919 - DNA, 20 bp, Artificial Sequence
  chemically synthesized
ctgaaatgttcttagattgc

SEQ ID NO: 334920 - DNA, 20 bp, Artificial Sequence
  chemically synthesized
agtcagaagtccagcaatct

SEQ ID NO: 334921 - DNA, 20 bp, Artificial Sequence
  chemically synthesized
tgcggggggagtcagaagtc

SEQ ID NO: 334922 - DNA, 20 bp, Artificial Sequence
  chemically synthesized
ggttttgcggggggagtcag

SEQ ID NO: 334923 - DNA, 20 bp, Artificial Sequence
  chemically synthesized
ttaggttttgcggggggagt

SEQ ID NO: 334924 - DNA, 20 bp, Artificial Sequence
  chemically synthesized
attcttaggttttgcggggg

SEQ ID NO: 334925 - DNA, 20 bp, Artificial Sequence
  chemically synthesized
gtattcttaggttttgcggg

SEQ ID NO: 334926 - DNA, 20 bp, Artificial Sequence
  chemically synthesized
cgtattcttaggttttgcgg

SEQ ID NO: 334927 - DNA, 20 bp, Artificial Sequence
  chemically synthesized
gcgtattcttaggttttgcg

SEQ ID NO: 334928 - DNA, 20 bp, Artificial Sequence
  chemically synthesized
agcgtattcttaggttttgc

SEQ ID NO: 334929 - DNA, 20 bp, Artificial Sequence
  chemically synthesized
gagcgtattcttaggttttg

SEQ ID NO: 334930 - DNA, 20 bp, Artificial Sequence
  chemically synthesized
tgactccccccgcaaaacct

SEQ ID NO: 334931 - DNA, 20 bp, Artificial Sequence
  chemically synthesized
tctgaaaggagcgtattctt

SEQ ID NO: 334932 - DNA, 20 bp, Artificial Sequence
  chemically synthesized
ctctgaaaggagcgtattct

SEQ ID NO: 334933 - DNA, 20 bp, Artificial Sequence
  chemically synthesized
acctaagaatacgctccttt

SEQ ID NO: 334934 - DNA, 20 bp, Artificial Sequence
  chemically synthesized
ctaagaatacgctcctttca

SEQ ID NO: 334935 - DNA, 20 bp, Artificial Sequence
  chemically synthesized
tcaaccacagtctctgaaag

SEQ ID NO: 334936 - DNA, 20 bp, Artificial Sequence
  chemically synthesized
ggtcaaccacagtctctgaa

SEQ ID NO: 334937 - DNA, 20 bp, Artificial Sequence
  chemically synthesized
tggtcaaccacagtctctga

SEQ ID NO: 334938 - DNA, 20 bp, Artificial Sequence
  chemically synthesized
tacgctcctttcagagactg

SEQ ID NO: 334939 - DNA, 20 bp, Artificial Sequence
  chemically synthesized
ggaatgctcctggtcaacca

SEQ ID NO: 334940 - DNA, 20 bp, Artificial Sequence
  chemically synthesized
tttcagagactgtggttgac

SEQ ID NO: 334941 - DNA, 20 bp, Artificial Sequence
  chemically synthesized
ttcagagactgtggttgacc

SEQ ID NO: 334942 - DNA, 20 bp, Artificial Sequence
  chemically synthesized
cagagactgtggttgaccag

SEQ ID NO: 334943 - DNA, 20 bp, Artificial Sequence
  chemically synthesized
taaataagagggaatgctcc

SEQ ID NO: 334944 - DNA, 20 bp, Artificial Sequence
  chemically synthesized
tcataacatcttaaataaga

SEQ ID NO: 334945 - DNA, 20 bp, Artificial Sequence
  chemically synthesized
aggagcattccctcttattt

SEQ ID NO: 334946 - DNA, 20 bp, Artificial Sequence
  chemically synthesized
ttcataacatcttaaataag

SEQ ID NO: 334947 - DNA, 20 bp, Artificial Sequence
  chemically synthesized
cttcataacatcttaaataa

SEQ ID NO: 334948 - DNA, 20 bp, Artificial Sequence
  chemically synthesized
ggcttcataacatcttaaat

SEQ ID NO: 334949 - DNA, 20 bp, Artificial Sequence
  chemically synthesized
ctcttatttaagatgttatg

SEQ ID NO: 334950 - DNA, 20 bp, Artificial Sequence
  chemically synthesized
ttttactaaacattggattt

SEQ ID NO: 334951 - DNA, 20 bp, Artificial Sequence
  chemically synthesized
gttttactaaacattggatt

SEQ ID NO: 334952 - DNA, 20 bp, Artificial Sequence
  chemically synthesized
tgaagcccaaatccaatgtt

SEQ ID NO: 334953 - DNA, 20 bp, Artificial Sequence
  chemically synthesized
tttacagttttactaaacat

SEQ ID NO: 334954 - DNA, 20 bp, Artificial Sequence
  chemically synthesized
caatgtttagtaaaactgta

SEQ ID NO: 334955 - DNA, 20 bp, Artificial Sequence
  chemically synthesized
ttaaggttcaacaaacttta

SEQ ID NO: 334956 - DNA, 20 bp, Artificial Sequence
  chemically synthesized
gcaacatagtaatggtatta

SEQ ID NO: 334957 - DNA, 20 bp, Artificial Sequence
  chemically synthesized
tgcaacatagtaatggtatt

SEQ ID NO: 334958 - DNA, 20 bp, Artificial Sequence
  chemically synthesized
aaaaaaatgcaacatagtaa

SEQ ID NO: 334959 - DNA, 20 bp, Artificial Sequence
  chemically synthesized
aatgacaaaaaaatgcaaca

SEQ ID NO: 334960 - DNA, 20 bp, Artificial Sequence
  chemically synthesized
ttttgtgttaatgatagaaa

SEQ ID NO: 334961 - DNA, 20 bp, Artificial Sequence
  chemically synthesized
gtttgtttttgtgttaatga

SEQ ID NO: 334962 - DNA, 20 bp, Artificial Sequence
  chemically synthesized
cattaacacaaaaacaaacc

SEQ ID NO: 334963 - DNA, 20 bp, Artificial Sequence
  chemically synthesized
cacaaaaacaaacctagttg

SEQ ID NO: 334964 - DNA, 20 bp, Artificial Sequence
  chemically synthesized
acaaaaacaaacctagttgt

SEQ ID NO: 334965 - DNA, 20 bp, Artificial Sequence
  chemically synthesized
acaaatggtctcctacaact

SEQ ID NO: 334966 - DNA, 20 bp, Artificial Sequence
  chemically synthesized
aaaaacaaacctagttgtag

SEQ ID NO: 334967 - DNA, 20 bp, Artificial Sequence
  chemically synthesized
tacaaatggtctcctacaac

SEQ ID NO: 334968 - DNA, 20 bp, Artificial Sequence
  chemically synthesized
tcctgttaatagtatacaaa

SEQ ID NO: 334969 - DNA, 20 bp, Artificial Sequence
  chemically synthesized
gaccatttgtatactattaa

SEQ ID NO: 334970 - DNA, 20 bp, Artificial Sequence
  chemically synthesized
accatttgtatactattaac

SEQ ID NO: 334971 - DNA, 20 bp, Artificial Sequence
  chemically synthesized
ttcttctggcttcctgttaa

SEQ ID NO: 334972 - DNA, 20 bp, Artificial Sequence
  chemically synthesized
atttgtatactattaacagg

SEQ ID NO: 334973 - DNA, 20 bp, Artificial Sequence
  chemically synthesized
gtatactattaacaggaagc

SEQ ID NO: 334974 - DNA, 20 bp, Artificial Sequence
  chemically synthesized
tactattaacaggaagccag

SEQ ID NO: 334975 - DNA, 20 bp, Artificial Sequence
  chemically synthesized
tccttctaagtaaattcttc

SEQ ID NO: 334976 - DNA, 20 bp, Artificial Sequence
  chemically synthesized
ggaagccagaagaatttact

SEQ ID NO: 334977 - DNA, 20 bp, Artificial Sequence
  chemically synthesized
agccagaagaatttacttag

SEQ ID NO: 334978 - DNA, 20 bp, Artificial Sequence
  chemically synthesized
gccagaagaatttacttaga

SEQ ID NO: 334979 - DNA, 20 bp, Artificial Sequence
  chemically synthesized
gataaatgctttttccttct

SEQ ID NO: 334980 - DNA, 20 bp, Artificial Sequence
  chemically synthesized
agaatttacttagaaggaaa

SEQ ID NO: 334981 - DNA, 20 bp, Artificial Sequence
  chemically synthesized
tcacttagcacatatggaat

SEQ ID NO: 334982 - DNA, 20 bp, Artificial Sequence
  chemically synthesized
tgacaatcacttagcacata

SEQ ID NO: 334983 - DNA, 20 bp, Artificial Sequence
  chemically synthesized
tcacttattccatatgtgct

SEQ ID NO: 334984 - DNA, 20 bp, Artificial Sequence
  chemically synthesized
tatagcacatgacaatcact

SEQ ID NO: 334985 - DNA, 20 bp, Artificial Sequence
  chemically synthesized
taagtgattgtcatgtgcta

SEQ ID NO: 334986 - DNA, 20 bp, Artificial Sequence
  chemically synthesized
catagtctaagtatattcta

SEQ ID NO: 334987 - DNA, 20 bp, Artificial Sequence
  chemically synthesized
catgtgctatagaatatact

SEQ ID NO: 334988 - DNA, 20 bp, Artificial Sequence
  chemically synthesized
ctcataatctaacatagtct

SEQ ID NO: 334989 - DNA, 20 bp, Artificial Sequence
  chemically synthesized
agaatatacttagactatgt

SEQ ID NO: 334990 - DNA, 20 bp, Artificial Sequence
  chemically synthesized
tatatactcataatctaaca

SEQ ID NO: 334991 - DNA, 20 bp, Artificial Sequence
  chemically synthesized
cttagactatgttagattat

SEQ ID NO: 334992 - DNA, 20 bp, Artificial Sequence
  chemically synthesized
tatgttagattatgagtata

SEQ ID NO: 334993 - DNA, 20 bp, Artificial Sequence
  chemically synthesized
gttagattatgagtatatag

SEQ ID NO: 334994 - DNA, 20 bp, Artificial Sequence
  chemically synthesized
attatgagtatatagcagat

SEQ ID NO: 334995 - DNA, 20 bp, Artificial Sequence
  chemically synthesized
taatgtttataattatgggg

SEQ ID NO: 334996 - DNA, 20 bp, Artificial Sequence
  chemically synthesized
aagtaatgtttataattatg

SEQ ID NO: 334997 - DNA, 20 bp, Artificial Sequence
  chemically synthesized
aaagtaatgtttataattat

SEQ ID NO: 334998 - DNA, 20 bp, Artificial Sequence
  chemically synthesized
aaaagtaatgtttataatta

SEQ ID NO: 334999 - DNA, 20 bp, Artificial Sequence
  chemically synthesized
attataaacattacttttta

SEQ ID NO: 335000 - DNA, 20 bp, Artificial Sequence
  chemically synthesized
ttataaacattactttttat

SEQ ID NO: 335001 - DNA, 20 bp, Artificial Sequence
  chemically synthesized
ttattttgatttcccataaa

SEQ ID NO: 335002 - DNA, 20 bp, Artificial Sequence
  chemically synthesized
ggaaatcaaaataaatgtta

SEQ ID NO: 335003 - DNA, 20 bp, Artificial Sequence
  chemically synthesized
aaaataaatgttatggactt

SEQ ID NO: 335004 - DNA, 20 bp, Artificial Sequence
  chemically synthesized
aaataaatgttatggacttc

SEQ ID NO: 335005 - DNA, 20 bp, Artificial Sequence
  chemically synthesized
aataaatgttatggacttcg

SEQ ID NO: 335006 - DNA, 20 bp, Artificial Sequence
  chemically synthesized
cataaatgaggattaccccg

SEQ ID NO: 335007 - DNA, 20 bp, Artificial Sequence
  chemically synthesized
tagtgcagtcatcataaatg

SEQ ID NO: 335008 - DNA, 20 bp, Artificial Sequence
  chemically synthesized
ttagtgcagtcatcataaat

SEQ ID NO: 335009 - DNA, 20 bp, Artificial Sequence
  chemically synthesized
tcatttatgatgactgcact

SEQ ID NO: 335010 - DNA, 20 bp, Artificial Sequence
  chemically synthesized
catttatgatgactgcacta

SEQ ID NO: 335011 - DNA, 20 bp, Artificial Sequence
  chemically synthesized
gccaggaattggccttagtg

SEQ ID NO: 335012 - DNA, 20 bp, Artificial Sequence
  chemically synthesized
agagtgccaggaattggcct

SEQ ID NO: 335013 - DNA, 20 bp, Artificial Sequence
  chemically synthesized
actgcactaaggccaattcc

SEQ ID NO: 335014 - DNA, 20 bp, Artificial Sequence
  chemically synthesized
gatcacagagtgccaggaat

SEQ ID NO: 335015 - DNA, 20 bp, Artificial Sequence
  chemically synthesized
ttaggtgatcacagagtgcc

SEQ ID NO: 335016 - DNA, 20 bp, Artificial Sequence
  chemically synthesized
cttaggtgatcacagagtgc

SEQ ID NO: 335017 - DNA, 20 bp, Artificial Sequence
  chemically synthesized
caaatacttaggtgatcaca

SEQ ID NO: 335018 - DNA, 20 bp, Artificial Sequence
  chemically synthesized
aacaaatacttaggtgatca

SEQ ID NO: 335019 - DNA, 20 bp, Artificial Sequence
  chemically synthesized
ctggcactctgtgatcacct

SEQ ID NO: 335020 - DNA, 20 bp, Artificial Sequence
  chemically synthesized
gagtttcttaacaaatactt

SEQ ID NO: 335021 - DNA, 20 bp, Artificial Sequence
  chemically synthesized
tgagtttcttaacaaatact

SEQ ID NO: 335022 - DNA, 20 bp, Artificial Sequence
  chemically synthesized
tgatcacctaagtatttgtt

SEQ ID NO: 335023 - DNA, 20 bp, Artificial Sequence
  chemically synthesized
atttgttaagaaactcaata

SEQ ID NO: 335024 - DNA, 20 bp, Artificial Sequence
  chemically synthesized
ttgttaagaaactcaataca

SEQ ID NO: 335025 - DNA, 20 bp, Artificial Sequence
  chemically synthesized
tgttaagaaactcaatacag

SEQ ID NO: 335026 - DNA, 20 bp, Artificial Sequence
  chemically synthesized
ctttaactgtcctctgtatt

SEQ ID NO: 335027 - DNA, 20 bp, Artificial Sequence
  chemically synthesized
aagaaactcaatacagagga

SEQ ID NO: 335028 - DNA, 20 bp, Artificial Sequence
  chemically synthesized
ctcaatacagaggacagtta

SEQ ID NO: 335029 - DNA, 20 bp, Artificial Sequence
  chemically synthesized
acagaggacagttaaagtca

SEQ ID NO: 335030 - DNA, 20 bp, Artificial Sequence
  chemically synthesized
ttaaagtcatagaaattgat

SEQ ID NO: 335031 - DNA, 20 bp, Artificial Sequence
  chemically synthesized
gaaattgatgagaattatgt

SEQ ID NO: 335032 - DNA, 20 bp, Artificial Sequence
  chemically synthesized
ttgatgagaattatgtaaga

SEQ ID NO: 335033 - DNA, 20 bp, Artificial Sequence
  chemically synthesized
attatgtaagacagtgacta

SEQ ID NO: 335034 - DNA, 20 bp, Artificial Sequence
  chemically synthesized
ttatgtaagacagtgactaa

SEQ ID NO: 335035 - DNA, 20 bp, Artificial Sequence
  chemically synthesized
aagacagtgactaaaggcaa

SEQ ID NO: 335036 - DNA, 20 bp, Artificial Sequence
  chemically synthesized
cattatcataccattgcctt

SEQ ID NO: 335037 - DNA, 20 bp, Artificial Sequence
  chemically synthesized
aaaggcaatggtatgataat

SEQ ID NO: 335038 - DNA, 20 bp, Artificial Sequence
  chemically synthesized
gtatgataatgagtactata

SEQ ID NO: 335039 - DNA, 20 bp, Artificial Sequence
  chemically synthesized
catactcctcaaatacttta

SEQ ID NO: 335040 - DNA, 20 bp, Artificial Sequence
  chemically synthesized
atgagtactataaagtattt

SEQ ID NO: 335041 - DNA, 20 bp, Artificial Sequence
  chemically synthesized
tgagtactataaagtatttg

SEQ ID NO: 335042 - DNA, 20 bp, Artificial Sequence
  chemically synthesized
agtactataaagtatttgag

SEQ ID NO: 335043 - DNA, 20 bp, Artificial Sequence
  chemically synthesized
tttgaggagtatgaaaatga

SEQ ID NO: 335044 - DNA, 20 bp, Artificial Sequence
  chemically synthesized
ttgaggagtatgaaaatgat

SEQ ID NO: 335045 - DNA, 20 bp, Artificial Sequence
  chemically synthesized
tcttaatgtcgtgtaataag

SEQ ID NO: 335046 - DNA, 20 bp, Artificial Sequence
  chemically synthesized
aaatcttaatgtcgtgtaat

SEQ ID NO: 335047 - DNA, 20 bp, Artificial Sequence
  chemically synthesized
acttcttattacacgacatt

SEQ ID NO: 335048 - DNA, 20 bp, Artificial Sequence
  chemically synthesized
acattaagattttatgaaat

SEQ ID NO: 335049 - DNA, 20 bp, Artificial Sequence
  chemically synthesized
attaagattttatgaaatga

SEQ ID NO: 335050 - DNA, 20 bp, Artificial Sequence
  chemically synthesized
aagattttatgaaatgagag

SEQ ID NO: 335051 - DNA, 20 bp, Artificial Sequence
  chemically synthesized
attttatgaaatgagagcag

SEQ ID NO: 335052 - DNA, 20 bp, Artificial Sequence
  chemically synthesized
aagttcttactttggggatt

SEQ ID NO: 335053 - DNA, 20 bp, Artificial Sequence
  chemically synthesized
gagcagtggctgaatcccca

SEQ ID NO: 335054 - DNA, 20 bp, Artificial Sequence
  chemically synthesized
agtggctgaatccccaaagt

SEQ ID NO: 335055 - DNA, 20 bp, Artificial Sequence
  chemically synthesized
attgttaagttcttactttg

SEQ ID NO: 335056 - DNA, 20 bp, Artificial Sequence
  chemically synthesized
aattgttaagttcttacttt

SEQ ID NO: 335057 - DNA, 20 bp, Artificial Sequence
  chemically synthesized
taattgttaagttcttactt

SEQ ID NO: 335058 - DNA, 20 bp, Artificial Sequence
  chemically synthesized
attacgttcatgtaattgtt

SEQ ID NO: 335059 - DNA, 20 bp, Artificial Sequence
  chemically synthesized
catgaacgtaattttacacc

SEQ ID NO: 335060 - DNA, 20 bp, Artificial Sequence
  chemically synthesized
cattttatgtagtagagtct

SEQ ID NO: 335061 - DNA, 20 bp, Artificial Sequence
  chemically synthesized
cgtgagcattttatgtagta

SEQ ID NO: 335062 - DNA, 20 bp, Artificial Sequence
  chemically synthesized
tccgtgagcattttatgtag

SEQ ID NO: 335063 - DNA, 20 bp, Artificial Sequence
  chemically synthesized
gtgtccgtgagcattttatg

SEQ ID NO: 335064 - DNA, 20 bp, Artificial Sequence
  chemically synthesized
tctactacataaaatgctca

SEQ ID NO: 335065 - DNA, 20 bp, Artificial Sequence
  chemically synthesized
tattaaaatctggtgtccgt

SEQ ID NO: 335066 - DNA, 20 bp, Artificial Sequence
  chemically synthesized
cataaaatgctcacggacac

SEQ ID NO: 335067 - DNA, 20 bp, Artificial Sequence
  chemically synthesized
gataagcaattattaaaatc

SEQ ID NO: 335068 - DNA, 20 bp, Artificial Sequence
  chemically synthesized
gacggcttcaaagattggat

SEQ ID NO: 335069 - DNA, 20 bp, Artificial Sequence
  chemically synthesized
aattgcttatccaatctttg

SEQ ID NO: 335070 - DNA, 20 bp, Artificial Sequence
  chemically synthesized
tctgagacggcttcaaagat

SEQ ID NO: 335071 - DNA, 20 bp, Artificial Sequence
  chemically synthesized
ttcattctgagacggcttca

SEQ ID NO: 335072 - DNA, 20 bp, Artificial Sequence
  chemically synthesized
tccaatctttgaagccgtct

SEQ ID NO: 335073 - DNA, 20 bp, Artificial Sequence
  chemically synthesized
tcactattttcattctgaga

SEQ ID NO: 335074 - DNA, 20 bp, Artificial Sequence
  chemically synthesized
gttctcactattttcattct

SEQ ID NO: 335075 - DNA, 20 bp, Artificial Sequence
  chemically synthesized
aagccgtctcagaatgaaaa

SEQ ID NO: 335076 - DNA, 20 bp, Artificial Sequence
  chemically synthesized
cgtctcagaatgaaaatagt

SEQ ID NO: 335077 - DNA, 20 bp, Artificial Sequence
  chemically synthesized
aaaatctctagcagtattgt

SEQ ID NO: 335078 - DNA, 20 bp, Artificial Sequence
  chemically synthesized
gtgagaactcacaatactgc

SEQ ID NO: 335079 - DNA, 20 bp, Artificial Sequence
  chemically synthesized
gagaactcacaatactgcta

SEQ ID NO: 335080 - DNA, 20 bp, Artificial Sequence
  chemically synthesized
tcataaagtaaaatctctag

SEQ ID NO: 335081 - DNA, 20 bp, Artificial Sequence
  chemically synthesized
tgttcataaagtaaaatctc

SEQ ID NO: 335082 - DNA, 20 bp, Artificial Sequence
  chemically synthesized
aaacggtgttattgttcata

SEQ ID NO: 335083 - DNA, 20 bp, Artificial Sequence
  chemically synthesized
tatgaaacactcatcagaaa

SEQ ID NO: 335084 - DNA, 20 bp, Artificial Sequence
  chemically synthesized
acaataacaccgtttctgat

SEQ ID NO: 335085 - DNA, 20 bp, Artificial Sequence
  chemically synthesized
ctcaaatatgaaacactcat

SEQ ID NO: 335086 - DNA, 20 bp, Artificial Sequence
  chemically synthesized
ctgatgagtgtttcatattt

SEQ ID NO: 335087 - DNA, 20 bp, Artificial Sequence
  chemically synthesized
tgatgagtgtttcatatttg

SEQ ID NO: 335088 - DNA, 20 bp, Artificial Sequence
  chemically synthesized
tttcatatttgaggatacta

SEQ ID NO: 335089 - DNA, 20 bp, Artificial Sequence
  chemically synthesized
taaatgatttatttgttcca

SEQ ID NO: 335090 - DNA, 20 bp, Artificial Sequence
  chemically synthesized
tatggaacaaataaatcatt

SEQ ID NO: 335091 - DNA, 20 bp, Artificial Sequence
  chemically synthesized
atttgatcatttttcgaata

SEQ ID NO: 335092 - DNA, 20 bp, Artificial Sequence
  chemically synthesized
tgatcatttttcgaataaag

SEQ ID NO: 335093 - DNA, 20 bp, Artificial Sequence
  chemically synthesized
aataaagaagttgaacctca

SEQ ID NO: 335094 - DNA, 20 bp, Artificial Sequence
  chemically synthesized
aaagaagttgaacctcatgg

SEQ ID NO: 335095 - DNA, 20 bp, Artificial Sequence
  chemically synthesized
tttgccttcagaccgccatg

SEQ ID NO: 335096 - DNA, 20 bp, Artificial Sequence
  chemically synthesized
atttgccttcagaccgccat

SEQ ID NO: 335097 - DNA, 20 bp, Artificial Sequence
  chemically synthesized
ttgaacctcatggcggtctg

SEQ ID NO: 335098 - DNA, 20 bp, Artificial Sequence
  chemically synthesized
tgaacctcatggcggtctga

SEQ ID NO: 335099 - DNA, 20 bp, Artificial Sequence
  chemically synthesized
ctagcctttgaatttgcctt

SEQ ID NO: 335100 - DNA, 20 bp, Artificial Sequence
  chemically synthesized
gcggtctgaaggcaaattca

SEQ ID NO: 335101 - DNA, 20 bp, Artificial Sequence
  chemically synthesized
cggtctgaaggcaaattcaa

SEQ ID NO: 335102 - DNA, 20 bp, Artificial Sequence
  chemically synthesized
ctgaaggcaaattcaaaggc

SEQ ID NO: 335103 - DNA, 20 bp, Artificial Sequence
  chemically synthesized
gtttctaatctgattttgac

SEQ ID NO: 335104 - DNA, 20 bp, Artificial Sequence
  chemically synthesized
attcaaaggctagtcaaaat

SEQ ID NO: 335105 - DNA, 20 bp, Artificial Sequence
  chemically synthesized
aaggctagtcaaaatcagat

SEQ ID NO: 335106 - DNA, 20 bp, Artificial Sequence
  chemically synthesized
gtcaaaatcagattagaaac

SEQ ID NO: 335107 - DNA, 20 bp, Artificial Sequence
  chemically synthesized
tggcagtgtagtgcaatgac

SEQ ID NO: 335108 - DNA, 20 bp, Artificial Sequence
  chemically synthesized
gttaaggtaccatggcagtg

SEQ ID NO: 335109 - DNA, 20 bp, Artificial Sequence
  chemically synthesized
gtcattgcactacactgcca

SEQ ID NO: 335110 - DNA, 20 bp, Artificial Sequence
  chemically synthesized
atgaggttaaggtaccatgg

SEQ ID NO: 335111 - DNA, 20 bp, Artificial Sequence
  chemically synthesized
agaatgaggttaaggtacca

SEQ ID NO: 335112 - DNA, 20 bp, Artificial Sequence
  chemically synthesized
tatctgagagaatgaggtta

SEQ ID NO: 335113 - DNA, 20 bp, Artificial Sequence
  chemically synthesized
gtatctgagagaatgaggtt

SEQ ID NO: 335114 - DNA, 20 bp, Artificial Sequence
  chemically synthesized
agatagtatctgagagaatg

SEQ ID NO: 335115 - DNA, 20 bp, Artificial Sequence
  chemically synthesized
gtaccttaacctcattctct

SEQ ID NO: 335116 - DNA, 20 bp, Artificial Sequence
  chemically synthesized
gagatagtatctgagagaat

SEQ ID NO: 335117 - DNA, 20 bp, Artificial Sequence
  chemically synthesized
tacactgagatagtatctga

SEQ ID NO: 335118 - DNA, 20 bp, Artificial Sequence
  chemically synthesized
aatacactgagatagtatct

SEQ ID NO: 335119 - DNA, 20 bp, Artificial Sequence
  chemically synthesized
cattctctcagatactatct

SEQ ID NO: 335120 - DNA, 20 bp, Artificial Sequence
  chemically synthesized
ggtcttcaaatacactgaga

SEQ ID NO: 335121 - DNA, 20 bp, Artificial Sequence
  chemically synthesized
acttggtcttcaaatacact

SEQ ID NO: 335122 - DNA, 20 bp, Artificial Sequence
  chemically synthesized
atactatctcagtgtatttg

SEQ ID NO: 335123 - DNA, 20 bp, Artificial Sequence
  chemically synthesized
tctcagtgtatttgaagacc

SEQ ID NO: 335124 - DNA, 20 bp, Artificial Sequence
  chemically synthesized
agcaaactttgtgcgatact

SEQ ID NO: 335125 - DNA, 20 bp, Artificial Sequence
  chemically synthesized
tgaagaccaagtatcgcaca

SEQ ID NO: 335126 - DNA, 20 bp, Artificial Sequence
  chemically synthesized
ttggggtgagggcatgttga

SEQ ID NO: 335127 - DNA, 20 bp, Artificial Sequence
  chemically synthesized
tttcaacatgccctcacccc

SEQ ID NO: 335128 - DNA, 20 bp, Artificial Sequence
  chemically synthesized
cattgactttcttggggtga

SEQ ID NO: 335129 - DNA, 20 bp, Artificial Sequence
  chemically synthesized
acattgactttcttggggtg

SEQ ID NO: 335130 - DNA, 20 bp, Artificial Sequence
  chemically synthesized
cacattgactttcttggggt

SEQ ID NO: 335131 - DNA, 20 bp, Artificial Sequence
  chemically synthesized
aacatgccctcaccccaaga

SEQ ID NO: 335132 - DNA, 20 bp, Artificial Sequence
  chemically synthesized
tactcacattgactttcttg

SEQ ID NO: 335133 - DNA, 20 bp, Artificial Sequence
  chemically synthesized
ttactcacattgactttctt

SEQ ID NO: 335134 - DNA, 20 bp, Artificial Sequence
  chemically synthesized
cttactcacattgactttct

SEQ ID NO: 335135 - DNA, 20 bp, Artificial Sequence
  chemically synthesized
caccccaagaaagtcaatgt

SEQ ID NO: 335136 - DNA, 20 bp, Artificial Sequence
  chemically synthesized
ccaagaaagtcaatgtgagt

SEQ ID NO: 335137 - DNA, 20 bp, Artificial Sequence
  chemically synthesized
gaaagtcaatgtgagtaagt

SEQ ID NO: 335138 - DNA, 20 bp, Artificial Sequence
  chemically synthesized
aatgtgagtaagtaagatga

SEQ ID NO: 335139 - DNA, 20 bp, Artificial Sequence
  chemically synthesized
gtgagtaagtaagatgaaag

SEQ ID NO: 335140 - DNA, 20 bp, Artificial Sequence
  chemically synthesized
cccaagattagttttgttga

SEQ ID NO: 335141 - DNA, 20 bp, Artificial Sequence
  chemically synthesized
gcccaagattagttttgttg

SEQ ID NO: 335142 - DNA, 20 bp, Artificial Sequence
  chemically synthesized
gccttcaacaaaactaatct

SEQ ID NO: 335143 - DNA, 20 bp, Artificial Sequence
  chemically synthesized
ccttcaacaaaactaatctt

SEQ ID NO: 335144 - DNA, 20 bp, Artificial Sequence
  chemically synthesized
tgaggttgactgcccaagat

SEQ ID NO: 335145 - DNA, 20 bp, Artificial Sequence
  chemically synthesized
tcaacaaaactaatcttggg

SEQ ID NO: 335146 - DNA, 20 bp, Artificial Sequence
  chemically synthesized
ttccctgaggttgactgccc

SEQ ID NO: 335147 - DNA, 20 bp, Artificial Sequence
  chemically synthesized
taatcttgggcagtcaacct

SEQ ID NO: 335148 - DNA, 20 bp, Artificial Sequence
  chemically synthesized
aatcttgggcagtcaacctc

SEQ ID NO: 335149 - DNA, 20 bp, Artificial Sequence
  chemically synthesized
atcttgggcagtcaacctca

SEQ ID NO: 335150 - DNA, 20 bp, Artificial Sequence
  chemically synthesized
ttgggcagtcaacctcaggg

SEQ ID NO: 335151 - DNA, 20 bp, Artificial Sequence
  chemically synthesized
tggctaatcggacttccctg

SEQ ID NO: 335152 - DNA, 20 bp, Artificial Sequence
  chemically synthesized
ctggctaatcggacttccct

SEQ ID NO: 335153 - DNA, 20 bp, Artificial Sequence
  chemically synthesized
caacctcagggaagtccgat

SEQ ID NO: 335154 - DNA, 20 bp, Artificial Sequence
  chemically synthesized
ctcagggaagtccgattagc

SEQ ID NO: 335155 - DNA, 20 bp, Artificial Sequence
  chemically synthesized
acacccagcgactggctaat

SEQ ID NO: 335156 - DNA, 20 bp, Artificial Sequence
  chemically synthesized
aagtccgattagccagtcgc

SEQ ID NO: 335157 - DNA, 20 bp, Artificial Sequence
  chemically synthesized
agtccgattagccagtcgct

SEQ ID NO: 335158 - DNA, 20 bp, Artificial Sequence
  chemically synthesized
tgaaggttacacccagcgac

SEQ ID NO: 335159 - DNA, 20 bp, Artificial Sequence
  chemically synthesized
cggtgtttgaaggttacacc

SEQ ID NO: 335160 - DNA, 20 bp, Artificial Sequence
  chemically synthesized
gatttcccagcggtgtttga

SEQ ID NO: 335161 - DNA, 20 bp, Artificial Sequence
  chemically synthesized
agatttcccagcggtgtttg

SEQ ID NO: 335162 - DNA, 20 bp, Artificial Sequence
  chemically synthesized
gtgtaaccttcaaacaccgc

SEQ ID NO: 335163 - DNA, 20 bp, Artificial Sequence
  chemically synthesized
tgtaaccttcaaacaccgct

SEQ ID NO: 335164 - DNA, 20 bp, Artificial Sequence
  chemically synthesized
ctcttctttagatttcccag

SEQ ID NO: 335165 - DNA, 20 bp, Artificial Sequence
  chemically synthesized
agcctcttctttagatttcc

SEQ ID NO: 335166 - DNA, 20 bp, Artificial Sequence
  chemically synthesized
aaacaccgctgggaaatcta

SEQ ID NO: 335167 - DNA, 20 bp, Artificial Sequence
  chemically synthesized
caccgctgggaaatctaaag

SEQ ID NO: 335168 - DNA, 20 bp, Artificial Sequence
  chemically synthesized
ccgctgggaaatctaaagaa

SEQ ID NO: 335169 - DNA, 20 bp, Artificial Sequence
  chemically synthesized
cgctgggaaatctaaagaag

SEQ ID NO: 335170 - DNA, 20 bp, Artificial Sequence
  chemically synthesized
agacagtagagcctcttctt

SEQ ID NO: 335171 - DNA, 20 bp, Artificial Sequence
  chemically synthesized
ggcctgaaatttagacagta

SEQ ID NO: 335172 - DNA, 20 bp, Artificial Sequence
  chemically synthesized
ttggcctgaaatttagacag

SEQ ID NO: 335173 - DNA, 20 bp, Artificial Sequence
  chemically synthesized
aacttggcctgaaatttaga

SEQ ID NO: 335174 - DNA, 20 bp, Artificial Sequence
  chemically synthesized
aggctctactgtctaaattt

SEQ ID NO: 335175 - DNA, 20 bp, Artificial Sequence
  chemically synthesized
ggctctactgtctaaatttc

SEQ ID NO: 335176 - DNA, 20 bp, Artificial Sequence
  chemically synthesized
cagaaacttggcctgaaatt

SEQ ID NO: 335177 - DNA, 20 bp, Artificial Sequence
  chemically synthesized
tactgtctaaatttcaggcc

SEQ ID NO: 335178 - DNA, 20 bp, Artificial Sequence
  chemically synthesized
cctgtcccttggcagaaact

SEQ ID NO: 335179 - DNA, 20 bp, Artificial Sequence
  chemically synthesized
tttcaggccaagtttctgcc

SEQ ID NO: 335180 - DNA, 20 bp, Artificial Sequence
  chemically synthesized
ttcaggccaagtttctgcca

SEQ ID NO: 335181 - DNA, 20 bp, Artificial Sequence
  chemically synthesized
tcaggccaagtttctgccaa

SEQ ID NO: 335182 - DNA, 20 bp, Artificial Sequence
  chemically synthesized
cattcctgcctgtcccttgg

SEQ ID NO: 335183 - DNA, 20 bp, Artificial Sequence
  chemically synthesized
gccaagtttctgccaaggga

SEQ ID NO: 335184 - DNA, 20 bp, Artificial Sequence
  chemically synthesized
ccaagtttctgccaagggac

SEQ ID NO: 335185 - DNA, 20 bp, Artificial Sequence
  chemically synthesized
ttccattcctgcctgtccct

SEQ ID NO: 335186 - DNA, 20 bp, Artificial Sequence
  chemically synthesized
agtttctgccaagggacagg

SEQ ID NO: 335187 - DNA, 20 bp, Artificial Sequence
  chemically synthesized
gtttctgccaagggacaggc

SEQ ID NO: 335188 - DNA, 20 bp, Artificial Sequence
  chemically synthesized
tgccaagggacaggcaggaa

SEQ ID NO: 335189 - DNA, 20 bp, Artificial Sequence
  chemically synthesized
gacaggcaggaatggaaata

SEQ ID NO: 335190 - DNA, 20 bp, Artificial Sequence
  chemically synthesized
aaatacagaattataatgca

SEQ ID NO: 335191 - DNA, 20 bp, Artificial Sequence
  chemically synthesized
tagcatgtgtaattgaaaac

SEQ ID NO: 335192 - DNA, 20 bp, Artificial Sequence
  chemically synthesized
atgtgtaattgaaaacaagc

SEQ ID NO: 335193 - DNA, 20 bp, Artificial Sequence
  chemically synthesized
tgaaaacaagcaagatttca

SEQ ID NO: 335194 - DNA, 20 bp, Artificial Sequence
  chemically synthesized
aacaagcaagatttcaaaga

SEQ ID NO: 335195 - DNA, 20 bp, Artificial Sequence
  chemically synthesized
aagcaagatttcaaagatag

SEQ ID NO: 335196 - DNA, 20 bp, Artificial Sequence
  chemically synthesized
agcaagatttcaaagatagc

SEQ ID NO: 335197 - DNA, 20 bp, Artificial Sequence
  chemically synthesized
ggtataaatgtgcactcaca

SEQ ID NO: 335198 - DNA, 20 bp, Artificial Sequence
  chemically synthesized
ctgaccaactaaagctttgt

SEQ ID NO: 335199 - DNA, 20 bp, Artificial Sequence
  chemically synthesized
aatgtgcactcacaaagctt

SEQ ID NO: 335200 - DNA, 20 bp, Artificial Sequence
  chemically synthesized
tgcactcacaaagctttagt

SEQ ID NO: 335201 - DNA, 20 bp, Artificial Sequence
  chemically synthesized
cttaaaagactgaccaacta

SEQ ID NO: 335202 - DNA, 20 bp, Artificial Sequence
  chemically synthesized
ctcacaaagctttagttggt

SEQ ID NO: 335203 - DNA, 20 bp, Artificial Sequence
  chemically synthesized
ctttagttggtcagtctttt

SEQ ID NO: 335204 - DNA, 20 bp, Artificial Sequence
  chemically synthesized
ttagttggtcagtcttttaa

SEQ ID NO: 335205 - DNA, 20 bp, Artificial Sequence
  chemically synthesized
ttgtttaataaaactcttaa

SEQ ID NO: 335206 - DNA, 20 bp, Artificial Sequence
  chemically synthesized
tattaaacaacaaaaactgt

SEQ ID NO: 335207 - DNA, 20 bp, Artificial Sequence
  chemically synthesized
ttaaacaacaaaaactgtga

SEQ ID NO: 335208 - DNA, 20 bp, Artificial Sequence
  chemically synthesized
taaacaacaaaaactgtgag

SEQ ID NO: 335209 - DNA, 20 bp, Artificial Sequence
  chemically synthesized
ttctaaatgacatcctctca

SEQ ID NO: 335210 - DNA, 20 bp, Artificial Sequence
  chemically synthesized
aactgtgagaggatgtcatt

SEQ ID NO: 335211 - DNA, 20 bp, Artificial Sequence
  chemically synthesized
tgtcatttagaaaccatgat

SEQ ID NO: 335212 - DNA, 20 bp, Artificial Sequence
  chemically synthesized
ggggaggttgatgctcatca

SEQ ID NO: 335213 - DNA, 20 bp, Artificial Sequence
  chemically synthesized
gatgagcatcaacctcccca

SEQ ID NO: 335214 - DNA, 20 bp, Artificial Sequence
  chemically synthesized
atgagcatcaacctccccac

SEQ ID NO: 335215 - DNA, 20 bp, Artificial Sequence
  chemically synthesized
tgagcatcaacctccccaca

SEQ ID NO: 335216 - DNA, 20 bp, Artificial Sequence
  chemically synthesized
ctaatacaaaccctgtgggg

SEQ ID NO: 335217 - DNA, 20 bp, Artificial Sequence
  chemically synthesized
cctaatacaaaccctgtggg

SEQ ID NO: 335218 - DNA, 20 bp, Artificial Sequence
  chemically synthesized
ttcctaatacaaaccctgtg

SEQ ID NO: 335219 - DNA, 20 bp, Artificial Sequence
  chemically synthesized
tttcctaatacaaaccctgt

SEQ ID NO: 335220 - DNA, 20 bp, Artificial Sequence
  chemically synthesized
gtttcctaatacaaaccctg

SEQ ID NO: 335221 - DNA, 20 bp, Artificial Sequence
  chemically synthesized
cctccccacagggtttgtat

SEQ ID NO: 335222 - DNA, 20 bp, Artificial Sequence
  chemically synthesized
ctccccacagggtttgtatt

SEQ ID NO: 335223 - DNA, 20 bp, Artificial Sequence
  chemically synthesized
caaaaataaataaattcact

SEQ ID NO: 335224 - DNA, 20 bp, Artificial Sequence
  chemically synthesized
aaataaataaattcactgag

SEQ ID NO: 335225 - DNA, 20 bp, Artificial Sequence
  chemically synthesized
aataaattcactgagaagaa

SEQ ID NO: 335226 - DNA, 20 bp, Artificial Sequence
  chemically synthesized
ttctctattccttttcttct

SEQ ID NO: 335227 - DNA, 20 bp, Artificial Sequence
  chemically synthesized
ataaattcactgagaagaaa

SEQ ID NO: 335228 - DNA, 20 bp, Artificial Sequence
  chemically synthesized
ttcactgagaagaaaaggaa

SEQ ID NO: 335229 - DNA, 20 bp, Artificial Sequence
  chemically synthesized
cactgagaagaaaaggaata

SEQ ID NO: 335230 - DNA, 20 bp, Artificial Sequence
  chemically synthesized
aagaaaaggaatagagaaac

SEQ ID NO: 335231 - DNA, 20 bp, Artificial Sequence
  chemically synthesized
aaaggaatagagaaactgga

SEQ ID NO: 335232 - DNA, 20 bp, Artificial Sequence
  chemically synthesized
ggaatagagaaactggaaag

SEQ ID NO: 335233 - DNA, 20 bp, Artificial Sequence
  chemically synthesized
gaatagagaaactggaaaga

SEQ ID NO: 335234 - DNA, 20 bp, Artificial Sequence
  chemically synthesized
gaccagaagtgccttctttc

SEQ ID NO: 335235 - DNA, 20 bp, Artificial Sequence
  chemically synthesized
aactggaaagaaggcacttc

SEQ ID NO: 335236 - DNA, 20 bp, Artificial Sequence
  chemically synthesized
tatggctagtttatgaccag

SEQ ID NO: 335237 - DNA, 20 bp, Artificial Sequence
  chemically synthesized
ggctatggctagtttatgac

SEQ ID NO: 335238 - DNA, 20 bp, Artificial Sequence
  chemically synthesized
aggcacttctggtcataaac

SEQ ID NO: 335239 - DNA, 20 bp, Artificial Sequence
  chemically synthesized
ttctggtcataaactagcca

SEQ ID NO: 335240 - DNA, 20 bp, Artificial Sequence
  chemically synthesized
ttgagcattctggctatggc

SEQ ID NO: 335241 - DNA, 20 bp, Artificial Sequence
  chemically synthesized
ggtcataaactagccatagc

SEQ ID NO: 335242 - DNA, 20 bp, Artificial Sequence
  chemically synthesized
tattttgagcattctggcta

SEQ ID NO: 335243 - DNA, 20 bp, Artificial Sequence
  chemically synthesized
ttttcatattttgagcattc

SEQ ID NO: 335244 - DNA, 20 bp, Artificial Sequence
  chemically synthesized
cctttctgttttcatatttt

SEQ ID NO: 335245 - DNA, 20 bp, Artificial Sequence
  chemically synthesized
gaatgctcaaaatatgaaaa

SEQ ID NO: 335246 - DNA, 20 bp, Artificial Sequence
  chemically synthesized
gctcaaaatatgaaaacaga

SEQ ID NO: 335247 - DNA, 20 bp, Artificial Sequence
  chemically synthesized
ctcaaaatatgaaaacagaa

SEQ ID NO: 335248 - DNA, 20 bp, Artificial Sequence
  chemically synthesized
aaacagaaaggcctatatgt

SEQ ID NO: 335249 - DNA, 20 bp, Artificial Sequence
  chemically synthesized
ttttggttgtgccaacatat

SEQ ID NO: 335250 - DNA, 20 bp, Artificial Sequence
  chemically synthesized
gttttggttgtgccaacata

SEQ ID NO: 335251 - DNA, 20 bp, Artificial Sequence
  chemically synthesized
gttggcacaaccaaaaccta

SEQ ID NO: 335252 - DNA, 20 bp, Artificial Sequence
  chemically synthesized
ttgtttacaaccataggttt

SEQ ID NO: 335253 - DNA, 20 bp, Artificial Sequence
  chemically synthesized
aggttattgtttacaaccat

SEQ ID NO: 335254 - DNA, 20 bp, Artificial Sequence
  chemically synthesized
taggttattgtttacaacca

SEQ ID NO: 335255 - DNA, 20 bp, Artificial Sequence
  chemically synthesized
gaatatcacatcaatgaatt

SEQ ID NO: 335256 - DNA, 20 bp, Artificial Sequence
  chemically synthesized
agaatatcacatcaatgaat

SEQ ID NO: 335257 - DNA, 20 bp, Artificial Sequence
  chemically synthesized
tcattgatgtgatattctaa

SEQ ID NO: 335258 - DNA, 20 bp, Artificial Sequence
  chemically synthesized
cattgatgtgatattctaaa

SEQ ID NO: 335259 - DNA, 20 bp, Artificial Sequence
  chemically synthesized
cttccagcactttgtccttt

SEQ ID NO: 335260 - DNA, 20 bp, Artificial Sequence
  chemically synthesized
tgtgatattctaaaaggaca

SEQ ID NO: 335261 - DNA, 20 bp, Artificial Sequence
  chemically synthesized
attctaaaaggacaaagtgc

SEQ ID NO: 335262 - DNA, 20 bp, Artificial Sequence
  chemically synthesized
ctaaaaggacaaagtgctgg

SEQ ID NO: 335263 - DNA, 20 bp, Artificial Sequence
  chemically synthesized
aggacaaagtgctggaagta

SEQ ID NO: 335264 - DNA, 20 bp, Artificial Sequence
  chemically synthesized
aaaataatccactttacttc

SEQ ID NO: 335265 - DNA, 20 bp, Artificial Sequence
  chemically synthesized
acaaagtgctggaagtaaag

SEQ ID NO: 335266 - DNA, 20 bp, Artificial Sequence
  chemically synthesized
agtaaagtggattatttttt

SEQ ID NO: 335267 - DNA, 20 bp, Artificial Sequence
  chemically synthesized
gtaaagtggattattttttg

SEQ ID NO: 335268 - DNA, 20 bp, Artificial Sequence
  chemically synthesized
ttttttgaggcttgcatacg

SEQ ID NO: 335269 - DNA, 20 bp, Artificial Sequence
  chemically synthesized
acataaatctcttcgtatgc

SEQ ID NO: 335270 - DNA, 20 bp, Artificial Sequence
  chemically synthesized
ttttgaggcttgcatacgaa

SEQ ID NO: 335271 - DNA, 20 bp, Artificial Sequence
  chemically synthesized
aaactccagcatttagatat

SEQ ID NO: 335272 - DNA, 20 bp, Artificial Sequence
  chemically synthesized
atcatctgatatctaaatgc

SEQ ID NO: 335273 - DNA, 20 bp, Artificial Sequence
  chemically synthesized
catctgatatctaaatgctg

SEQ ID NO: 335274 - DNA, 20 bp, Artificial Sequence
  chemically synthesized
aacttagaaactccagcatt

SEQ ID NO: 335275 - DNA, 20 bp, Artificial Sequence
  chemically synthesized
ggtctacaacttagaaactc

SEQ ID NO: 335276 - DNA, 20 bp, Artificial Sequence
  chemically synthesized
atctaaatgctggagtttct

SEQ ID NO: 335277 - DNA, 20 bp, Artificial Sequence
  chemically synthesized
atgctggagtttctaagttg

SEQ ID NO: 335278 - DNA, 20 bp, Artificial Sequence
  chemically synthesized
ccatgatatggtctacaact

SEQ ID NO: 335279 - DNA, 20 bp, Artificial Sequence
  chemically synthesized
ctaagttgtagaccatatca

SEQ ID NO: 335280 - DNA, 20 bp, Artificial Sequence
  chemically synthesized
attagtccattgccatgata

SEQ ID NO: 335281 - DNA, 20 bp, Artificial Sequence
  chemically synthesized
tgtagaccatatcatggcaa

SEQ ID NO: 335282 - DNA, 20 bp, Artificial Sequence
  chemically synthesized
aatatcatgctttaatgaat

SEQ ID NO: 335283 - DNA, 20 bp, Artificial Sequence
  chemically synthesized
ggcaatggactaattcatta

SEQ ID NO: 335284 - DNA, 20 bp, Artificial Sequence
  chemically synthesized
tatttttaatattttgtatt

SEQ ID NO: 335285 - DNA, 20 bp, Artificial Sequence
  chemically synthesized
aatattttgtatttggcatt

SEQ ID NO: 335286 - DNA, 20 bp, Artificial Sequence
  chemically synthesized
acatgtatgtacaatgcagt

SEQ ID NO: 335287 - DNA, 20 bp, Artificial Sequence
  chemically synthesized
gaatacatgtatgtacaatg

SEQ ID NO: 335288 - DNA, 20 bp, Artificial Sequence
  chemically synthesized
tacatgtattctctacttac

SEQ ID NO: 335289 - DNA, 20 bp, Artificial Sequence
  chemically synthesized
tatatagtgacttgtaagta

SEQ ID NO: 335290 - DNA, 20 bp, Artificial Sequence
  chemically synthesized
tgtatatagtgacttgtaag

SEQ ID NO: 335291 - DNA, 20 bp, Artificial Sequence
  chemically synthesized
tattgtatatagtgacttgt

SEQ ID NO: 335292 - DNA, 20 bp, Artificial Sequence
  chemically synthesized
ttacaagtcactatatacaa

SEQ ID NO: 335293 - DNA, 20 bp, Artificial Sequence
  chemically synthesized
tgttgtatatctattgtata

SEQ ID NO: 335294 - DNA, 20 bp, Artificial Sequence
  chemically synthesized
taaaaaatttaacatgggag

SEQ ID NO: 335295 - DNA, 20 bp, Artificial Sequence
  chemically synthesized
gttaaaaaatttaacatggg

SEQ ID NO: 335296 - DNA, 20 bp, Artificial Sequence
  chemically synthesized
tgttaaaaaatttaacatgg

SEQ ID NO: 335297 - DNA, 20 bp, Artificial Sequence
  chemically synthesized
aatgttaaaaaatttaacat

SEQ ID NO: 335298 - DNA, 20 bp, Artificial Sequence
  chemically synthesized
gaatgttaaaaaatttaaca

SEQ ID NO: 335299 - DNA, 20 bp, Artificial Sequence
  chemically synthesized
taaattttttaacattctgc

SEQ ID NO: 335300 - DNA, 20 bp, Artificial Sequence
  chemically synthesized
ctaaggcagaacatatcttg

SEQ ID NO: 335301 - DNA, 20 bp, Artificial Sequence
  chemically synthesized
ctgcaagatatgttctgcct

SEQ ID NO: 335302 - DNA, 20 bp, Artificial Sequence
  chemically synthesized
agtacttaatttagctaagg

SEQ ID NO: 335303 - DNA, 20 bp, Artificial Sequence
  chemically synthesized
aggagtacttaatttagcta

SEQ ID NO: 335304 - DNA, 20 bp, Artificial Sequence
  chemically synthesized
aaggagtacttaatttagct

SEQ ID NO: 335305 - DNA, 20 bp, Artificial Sequence
  chemically synthesized
tgttctgccttagctaaatt

SEQ ID NO: 335306 - DNA, 20 bp, Artificial Sequence
  chemically synthesized
taattaaggagtacttaatt

SEQ ID NO: 335307 - DNA, 20 bp, Artificial Sequence
  chemically synthesized
ctaaaaatggattaattaag

SEQ ID NO: 335308 - DNA, 20 bp, Artificial Sequence
  chemically synthesized
tgctaaaaatggattaatta

SEQ ID NO: 335309 - DNA, 20 bp, Artificial Sequence
  chemically synthesized
gtgctaaaaatggattaatt

SEQ ID NO: 335310 - DNA, 20 bp, Artificial Sequence
  chemically synthesized
ctccttaattaatccatttt

SEQ ID NO: 335311 - DNA, 20 bp, Artificial Sequence
  chemically synthesized
agtgaatgaagtgctaaaaa

SEQ ID NO: 335312 - DNA, 20 bp, Artificial Sequence
  chemically synthesized
actgcttgtatcagtgaatg

SEQ ID NO: 335313 - DNA, 20 bp, Artificial Sequence
  chemically synthesized
agcacttcattcactgatac

SEQ ID NO: 335314 - DNA, 20 bp, Artificial Sequence
  chemically synthesized
acttcattcactgatacaag

SEQ ID NO: 335315 - DNA, 20 bp, Artificial Sequence
  chemically synthesized
gtaaaagcaactgcttgtat

SEQ ID NO: 335316 - DNA, 20 bp, Artificial Sequence
  chemically synthesized
gcattgttactaaatggtaa

SEQ ID NO: 335317 - DNA, 20 bp, Artificial Sequence
  chemically synthesized
aagcagttgcttttaccatt

SEQ ID NO: 335318 - DNA, 20 bp, Artificial Sequence
  chemically synthesized
tgagaagcattgttactaaa

SEQ ID NO: 335319 - DNA, 20 bp, Artificial Sequence
  chemically synthesized
agtaacaatgcttctcatta

SEQ ID NO: 335320 - DNA, 20 bp, Artificial Sequence
  chemically synthesized
ttttaccgtcctttaatgag

SEQ ID NO: 335321 - DNA, 20 bp, Artificial Sequence
  chemically synthesized
gtaacaatgcttctcattaa

SEQ ID NO: 335322 - DNA, 20 bp, Artificial Sequence
  chemically synthesized
acattttaccgtcctttaat

SEQ ID NO: 335323 - DNA, 20 bp, Artificial Sequence
  chemically synthesized
caatgcttctcattaaagga

SEQ ID NO: 335324 - DNA, 20 bp, Artificial Sequence
  chemically synthesized
aggacggtaaaatgtcataa

SEQ ID NO: 335325 - DNA, 20 bp, Artificial Sequence
  chemically synthesized
ggaaataatttgcgttgatg

SEQ ID NO: 335326 - DNA, 20 bp, Artificial Sequence
  chemically synthesized
ataaaattaataacgataaa

SEQ ID NO: 335327 - DNA, 20 bp, Artificial Sequence
  chemically synthesized
ttaataacgataaaaagtaa

SEQ ID NO: 335328 - DNA, 20 bp, Artificial Sequence
  chemically synthesized
tgtttctcctggataaatat

SEQ ID NO: 335329 - DNA, 20 bp, Artificial Sequence
  chemically synthesized
gtgtttctcctggataaata

SEQ ID NO: 335330 - DNA, 20 bp, Artificial Sequence
  chemically synthesized
agtaatggcctatatttatc

SEQ ID NO: 335331 - DNA, 20 bp, Artificial Sequence
  chemically synthesized
gtaatggcctatatttatcc

SEQ ID NO: 335332 - DNA, 20 bp, Artificial Sequence
  chemically synthesized
aatggcctatatttatccag

SEQ ID NO: 335333 - DNA, 20 bp, Artificial Sequence
  chemically synthesized
aaattgttttgtgtttctcc

SEQ ID NO: 335334 - DNA, 20 bp, Artificial Sequence
  chemically synthesized
aagcgtaatggaaagtgcaa

SEQ ID NO: 335335 - DNA, 20 bp, Artificial Sequence
  chemically synthesized
atgttgaaaagcgtaatgga

SEQ ID NO: 335336 - DNA, 20 bp, Artificial Sequence
  chemically synthesized
aagcatgttgaaaagcgtaa

SEQ ID NO: 335337 - DNA, 20 bp, Artificial Sequence
  chemically synthesized
tacaccataagcatgttgaa

SEQ ID NO: 335338 - DNA, 20 bp, Artificial Sequence
  chemically synthesized
tacgcttttcaacatgctta

SEQ ID NO: 335339 - DNA, 20 bp, Artificial Sequence
  chemically synthesized
ttttctgctagttacaccat

SEQ ID NO: 335340 - DNA, 20 bp, Artificial Sequence
  chemically synthesized
caacatgcttatggtgtaac

SEQ ID NO: 335341 - DNA, 20 bp, Artificial Sequence
  chemically synthesized
catgcttatggtgtaactag

SEQ ID NO: 335342 - DNA, 20 bp, Artificial Sequence
  chemically synthesized
tgatggtgatagttttctgc

SEQ ID NO: 335343 - DNA, 20 bp, Artificial Sequence
  chemically synthesized
ttgtaacaagatgatggtga

SEQ ID NO: 335344 - DNA, 20 bp, Artificial Sequence
  chemically synthesized
ttctacttgtaacaagatga

SEQ ID NO: 335345 - DNA, 20 bp, Artificial Sequence
  chemically synthesized
tatcaccatcatcttgttac

SEQ ID NO: 335346 - DNA, 20 bp, Artificial Sequence
  chemically synthesized
cactgttttctacttgtaac

SEQ ID NO: 335347 - DNA, 20 bp, Artificial Sequence
  chemically synthesized
caccatcatcttgttacaag

SEQ ID NO: 335348 - DNA, 20 bp, Artificial Sequence
  chemically synthesized
atcttgttacaagtagaaaa

SEQ ID NO: 335349 - DNA, 20 bp, Artificial Sequence
  chemically synthesized
ttgttacaagtagaaaacag

SEQ ID NO: 335350 - DNA, 20 bp, Artificial Sequence
  chemically synthesized
acaagtagaaaacagtggct

SEQ ID NO: 335351 - DNA, 20 bp, Artificial Sequence
  chemically synthesized
caagtagaaaacagtggctc

SEQ ID NO: 335352 - DNA, 20 bp, Artificial Sequence
  chemically synthesized
tagaaaacagtggctcaggc

SEQ ID NO: 335353 - DNA, 20 bp, Artificial Sequence
  chemically synthesized
agaaaacagtggctcaggct

SEQ ID NO: 335354 - DNA, 20 bp, Artificial Sequence
  chemically synthesized
tgagctaaagcgcccagcct

SEQ ID NO: 335355 - DNA, 20 bp, Artificial Sequence
  chemically synthesized
gtggctcaggctgggcgctt

SEQ ID NO: 335356 - DNA, 20 bp, Artificial Sequence
  chemically synthesized
caggcatgagctaaagcgcc

SEQ ID NO: 335357 - DNA, 20 bp, Artificial Sequence
  chemically synthesized
gggattacaggcatgagcta

SEQ ID NO: 335358 - DNA, 20 bp, Artificial Sequence
  chemically synthesized
agtgctgggattacaggcat

SEQ ID NO: 335359 - DNA, 20 bp, Artificial Sequence
  chemically synthesized
ttagctcatgcctgtaatcc

SEQ ID NO: 335360 - DNA, 20 bp, Artificial Sequence
  chemically synthesized
tcccgaagtgctgggattac

SEQ ID NO: 335361 - DNA, 20 bp, Artificial Sequence
  chemically synthesized
ctcccgaagtgctgggatta

SEQ ID NO: 335362 - DNA, 20 bp, Artificial Sequence
  chemically synthesized
tgcctgtaatcccagcactt

SEQ ID NO: 335363 - DNA, 20 bp, Artificial Sequence
  chemically synthesized
cctcgtcctcccgaagtgct

SEQ ID NO: 335364 - DNA, 20 bp, Artificial Sequence
  chemically synthesized
gcctgtaatcccagcacttc

SEQ ID NO: 335365 - DNA, 20 bp, Artificial Sequence
  chemically synthesized
gcctcgtcctcccgaagtgc

SEQ ID NO: 335366 - DNA, 20 bp, Artificial Sequence
  chemically synthesized
ctgtaatcccagcacttcgg

SEQ ID NO: 335367 - DNA, 20 bp, Artificial Sequence
  chemically synthesized
tgtaatcccagcacttcggg

SEQ ID NO: 335368 - DNA, 20 bp, Artificial Sequence
  chemically synthesized
gcacctgcctcgtcctcccg

SEQ ID NO: 335369 - DNA, 20 bp, Artificial Sequence
  chemically synthesized
tcccagcacttcgggaggac

SEQ ID NO: 335370 - DNA, 20 bp, Artificial Sequence
  chemically synthesized
cccagcacttcgggaggacg

SEQ ID NO: 335371 - DNA, 20 bp, Artificial Sequence
  chemically synthesized
agcacttcgggaggacgagg

SEQ ID NO: 335372 - DNA, 20 bp, Artificial Sequence
  chemically synthesized
gcacttcgggaggacgaggc

SEQ ID NO: 335373 - DNA, 20 bp, Artificial Sequence
  chemically synthesized
acgaggcaggtgcatcgcct

SEQ ID NO: 335374 - DNA, 20 bp, Artificial Sequence
  chemically synthesized
cgaggcaggtgcatcgcctg

SEQ ID NO: 335375 - DNA, 20 bp, Artificial Sequence
  chemically synthesized
gcaggtgcatcgcctgaggt

SEQ ID NO: 335376 - DNA, 20 bp, Artificial Sequence
  chemically synthesized
caggtgcatcgcctgaggtt

SEQ ID NO: 335377 - DNA, 20 bp, Artificial Sequence
  chemically synthesized
ggtgtcaaattcctaacctc

SEQ ID NO: 335378 - DNA, 20 bp, Artificial Sequence
  chemically synthesized
tggtgtcaaattcctaacct

SEQ ID NO: 335379 - DNA, 20 bp, Artificial Sequence
  chemically synthesized
tgaggttaggaatttgacac

SEQ ID NO: 335380 - DNA, 20 bp, Artificial Sequence
  chemically synthesized
ttaggaatttgacaccagcc

SEQ ID NO: 335381 - DNA, 20 bp, Artificial Sequence
  chemically synthesized
tttcaccgtgttggccaggc

SEQ ID NO: 335382 - DNA, 20 bp, Artificial Sequence
  chemically synthesized
ggcttttcaccgtgttggcc

SEQ ID NO: 335383 - DNA, 20 bp, Artificial Sequence
  chemically synthesized
tgacaccagcctggccaaca

SEQ ID NO: 335384 - DNA, 20 bp, Artificial Sequence
  chemically synthesized
cggcttttcaccgtgttggc

SEQ ID NO: 335385 - DNA, 20 bp, Artificial Sequence
  chemically synthesized
gagacggcttttcaccgtgt

SEQ ID NO: 335386 - DNA, 20 bp, Artificial Sequence
  chemically synthesized
agcctggccaacacggtgaa

SEQ ID NO: 335387 - DNA, 20 bp, Artificial Sequence
  chemically synthesized
ttttatatttttagttgaga

SEQ ID NO: 335388 - DNA, 20 bp, Artificial Sequence
  chemically synthesized
aaatttttatatttttagtt

SEQ ID NO: 335389 - DNA, 20 bp, Artificial Sequence
  chemically synthesized
tggagaaatttttatatttt

SEQ ID NO: 335390 - DNA, 20 bp, Artificial Sequence
  chemically synthesized
caggtgccggagaggatgtg

SEQ ID NO: 335391 - DNA, 20 bp, Artificial Sequence
  chemically synthesized
aacaggtgccggagaggatg

SEQ ID NO: 335392 - DNA, 20 bp, Artificial Sequence
  chemically synthesized
aaatttctccacatcctctc

SEQ ID NO: 335393 - DNA, 20 bp, Artificial Sequence
  chemically synthesized
ggaaacaacaggtgccggag

SEQ ID NO: 335394 - DNA, 20 bp, Artificial Sequence
  chemically synthesized
aggaaacaacaggtgccgga

SEQ ID NO: 335395 - DNA, 20 bp, Artificial Sequence
  chemically synthesized
tcaggaaacaacaggtgccg

SEQ ID NO: 335396 - DNA, 20 bp, Artificial Sequence
  chemically synthesized
agtcaggaaacaacaggtgc

SEQ ID NO: 335397 - DNA, 20 bp, Artificial Sequence
  chemically synthesized
ttaaaaagtcaggaaacaac

SEQ ID NO: 335398 - DNA, 20 bp, Artificial Sequence
  chemically synthesized
attaaaaagtcaggaaacaa

SEQ ID NO: 335399 - DNA, 20 bp, Artificial Sequence
  chemically synthesized
atggcgatcattaaaaagtc

SEQ ID NO: 335400 - DNA, 20 bp, Artificial Sequence
  chemically synthesized
aatggcgatcattaaaaagt

SEQ ID NO: 335401 - DNA, 20 bp, Artificial Sequence
  chemically synthesized
ttagaatggcgatcattaaa

SEQ ID NO: 335402 - DNA, 20 bp, Artificial Sequence
  chemically synthesized
ttaatgatcgccattctaac

SEQ ID NO: 335403 - DNA, 20 bp, Artificial Sequence
  chemically synthesized
ccatctcacaccagttagaa

SEQ ID NO: 335404 - DNA, 20 bp, Artificial Sequence
  chemically synthesized
agataccatctcacaccagt

SEQ ID NO: 335405 - DNA, 20 bp, Artificial Sequence
  chemically synthesized
atcgccattctaactggtgt

SEQ ID NO: 335406 - DNA, 20 bp, Artificial Sequence
  chemically synthesized
aatgagataccatctcacac

SEQ ID NO: 335407 - DNA, 20 bp, Artificial Sequence
  chemically synthesized
ccattctaactggtgtgaga

SEQ ID NO: 335408 - DNA, 20 bp, Artificial Sequence
  chemically synthesized
tgtgagatggtatctcattg

SEQ ID NO: 335409 - DNA, 20 bp, Artificial Sequence
  chemically synthesized
atgcaaatcaaaaccacaat

SEQ ID NO: 335410 - DNA, 20 bp, Artificial Sequence
  chemically synthesized
tttgatttgcatttctctga

SEQ ID NO: 335411 - DNA, 20 bp, Artificial Sequence
  chemically synthesized
atttgcatttctctgatggc

SEQ ID NO: 335412 - DNA, 20 bp, Artificial Sequence
  chemically synthesized
ctcatcatcactggccatca

SEQ ID NO: 335413 - DNA, 20 bp, Artificial Sequence
  chemically synthesized
tgctcatcatcactggccat

SEQ ID NO: 335414 - DNA, 20 bp, Artificial Sequence
  chemically synthesized
gaaaaaatgctcatcatcac

SEQ ID NO: 335415 - DNA, 20 bp, Artificial Sequence
  chemically synthesized
ctctgatggccagtgatgat

SEQ ID NO: 335416 - DNA, 20 bp, Artificial Sequence
  chemically synthesized
gcattttttcatgtgttttt

SEQ ID NO: 335417 - DNA, 20 bp, Artificial Sequence
  chemically synthesized
agatccctgagacatttatt

SEQ ID NO: 335418 - DNA, 20 bp, Artificial Sequence
  chemically synthesized
ttttggctgaataaatgtct

SEQ ID NO: 335419 - DNA, 20 bp, Artificial Sequence
  chemically synthesized
tttggctgaataaatgtctc

SEQ ID NO: 335420 - DNA, 20 bp, Artificial Sequence
  chemically synthesized
ttggctgaataaatgtctca

SEQ ID NO: 335421 - DNA, 20 bp, Artificial Sequence
  chemically synthesized
gaataaatgtctcagggatc

SEQ ID NO: 335422 - DNA, 20 bp, Artificial Sequence
  chemically synthesized
atttctagttctagatccct

SEQ ID NO: 335423 - DNA, 20 bp, Artificial Sequence
  chemically synthesized
atgtctcagggatctagaac

SEQ ID NO: 335424 - DNA, 20 bp, Artificial Sequence
  chemically synthesized
tcaaatggtatttctagttc

SEQ ID NO: 335425 - DNA, 20 bp, Artificial Sequence
  chemically synthesized
gctggctcaaatggtatttc

SEQ ID NO: 335426 - DNA, 20 bp, Artificial Sequence
  chemically synthesized
tagaactagaaataccattt

SEQ ID NO: 335427 - DNA, 20 bp, Artificial Sequence
  chemically synthesized
actagaaataccatttgagc

SEQ ID NO: 335428 - DNA, 20 bp, Artificial Sequence
  chemically synthesized
aatgggatggctggctcaaa

SEQ ID NO: 335429 - DNA, 20 bp, Artificial Sequence
  chemically synthesized
atacccagtaatgggatggc

SEQ ID NO: 335430 - DNA, 20 bp, Artificial Sequence
  chemically synthesized
gtatatacccagtaatggga

SEQ ID NO: 335431 - DNA, 20 bp, Artificial Sequence
  chemically synthesized
tgagccagccatcccattac

SEQ ID NO: 335432 - DNA, 20 bp, Artificial Sequence
  chemically synthesized
gagccagccatcccattact

SEQ ID NO: 335433 - DNA, 20 bp, Artificial Sequence
  chemically synthesized
ttgggtatatacccagtaat

SEQ ID NO: 335434 - DNA, 20 bp, Artificial Sequence
  chemically synthesized
tttgggtatatacccagtaa

SEQ ID NO: 335435 - DNA, 20 bp, Artificial Sequence
  chemically synthesized
tagtcctttgggtatatacc

SEQ ID NO: 335436 - DNA, 20 bp, Artificial Sequence
  chemically synthesized
cattactgggtatataccca

SEQ ID NO: 335437 - DNA, 20 bp, Artificial Sequence
  chemically synthesized
attactgggtatatacccaa

SEQ ID NO: 335438 - DNA, 20 bp, Artificial Sequence
  chemically synthesized
agcatgatttatagtccttt

SEQ ID NO: 335439 - DNA, 20 bp, Artificial Sequence
  chemically synthesized
cagcatgatttatagtcctt

SEQ ID NO: 335440 - DNA, 20 bp, Artificial Sequence
  chemically synthesized
ctttatagcagcatgattta

SEQ ID NO: 335441 - DNA, 20 bp, Artificial Sequence
  chemically synthesized
ctataaatcatgctgctata

SEQ ID NO: 335442 - DNA, 20 bp, Artificial Sequence
  chemically synthesized
gtgtgcatgtgtctttatag

SEQ ID NO: 335443 - DNA, 20 bp, Artificial Sequence
  chemically synthesized
tacgtgtgcatgtgtcttta

SEQ ID NO: 335444 - DNA, 20 bp, Artificial Sequence
  chemically synthesized
atgcacacgtatgtttactg

SEQ ID NO: 335445 - DNA, 20 bp, Artificial Sequence
  chemically synthesized
tgctattgtgaatagtgctg

SEQ ID NO: 335446 - DNA, 20 bp, Artificial Sequence
  chemically synthesized
tactgcagcactattcacaa

SEQ ID NO: 335447 - DNA, 20 bp, Artificial Sequence
  chemically synthesized
caagtctttgctattgtgaa

SEQ ID NO: 335448 - DNA, 20 bp, Artificial Sequence
  chemically synthesized
cagcactattcacaatagca

SEQ ID NO: 335449 - DNA, 20 bp, Artificial Sequence
  chemically synthesized
tattcacaatagcaaagact

SEQ ID NO: 335450 - DNA, 20 bp, Artificial Sequence
  chemically synthesized
tggacatttgggttggttcc

SEQ ID NO: 335451 - DNA, 20 bp, Artificial Sequence
  chemically synthesized
tcattgttggacatttgggt

SEQ ID NO: 335452 - DNA, 20 bp, Artificial Sequence
  chemically synthesized
tctatcattgttggacattt

SEQ ID NO: 335453 - DNA, 20 bp, Artificial Sequence
  chemically synthesized
gtctatcattgttggacatt

SEQ ID NO: 335454 - DNA, 20 bp, Artificial Sequence
  chemically synthesized
acccaaatgtccaacaatga

SEQ ID NO: 335455 - DNA, 20 bp, Artificial Sequence
  chemically synthesized
ttaatccagtctatcattgt

SEQ ID NO: 335456 - DNA, 20 bp, Artificial Sequence
  chemically synthesized
aatgtccaacaatgatagac

SEQ ID NO: 335457 - DNA, 20 bp, Artificial Sequence
  chemically synthesized
caacaatgatagactggatt

SEQ ID NO: 335458 - DNA, 20 bp, Artificial Sequence
  chemically synthesized
tatgccacattttcttaatc

SEQ ID NO: 335459 - DNA, 20 bp, Artificial Sequence
  chemically synthesized
tagactggattaagaaaatg

SEQ ID NO: 335460 - DNA, 20 bp, Artificial Sequence
  chemically synthesized
aatgtggcatatatgcacca

SEQ ID NO: 335461 - DNA, 20 bp, Artificial Sequence
  chemically synthesized
tatgactgcatagtattcca

SEQ ID NO: 335462 - DNA, 20 bp, Artificial Sequence
  chemically synthesized
atgcaccatggaatactatg

SEQ ID NO: 335463 - DNA, 20 bp, Artificial Sequence
  chemically synthesized
catccttttttatgactgca

SEQ ID NO: 335464 - DNA, 20 bp, Artificial Sequence
  chemically synthesized
aatactatgcagtcataaaa

SEQ ID NO: 335465 - DNA, 20 bp, Artificial Sequence
  chemically synthesized
atactatgcagtcataaaaa

SEQ ID NO: 335466 - DNA, 20 bp, Artificial Sequence
  chemically synthesized
atgcagtcataaaaaaggat

SEQ ID NO: 335467 - DNA, 20 bp, Artificial Sequence
  chemically synthesized
ggatgagttcatgtcctttg

SEQ ID NO: 335468 - DNA, 20 bp, Artificial Sequence
  chemically synthesized
gatgagttcatgtcctttgt

SEQ ID NO: 335469 - DNA, 20 bp, Artificial Sequence
  chemically synthesized
atgagttcatgtcctttgta

SEQ ID NO: 335470 - DNA, 20 bp, Artificial Sequence
  chemically synthesized
cttcatccatgtccctacaa

SEQ ID NO: 335471 - DNA, 20 bp, Artificial Sequence
  chemically synthesized
gcttcatccatgtccctaca

SEQ ID NO: 335472 - DNA, 20 bp, Artificial Sequence
  chemically synthesized
tcatgtcctttgtagggaca

SEQ ID NO: 335473 - DNA, 20 bp, Artificial Sequence
  chemically synthesized
cctttgtagggacatggatg

SEQ ID NO: 335474 - DNA, 20 bp, Artificial Sequence
  chemically synthesized
tgtagggacatggatgaagc

SEQ ID NO: 335475 - DNA, 20 bp, Artificial Sequence
  chemically synthesized
ttgctgagaatgatggtttc

SEQ ID NO: 335476 - DNA, 20 bp, Artificial Sequence
  chemically synthesized
aagctggaaaccatcattct

SEQ ID NO: 335477 - DNA, 20 bp, Artificial Sequence
  chemically synthesized
tgatagtttgctgagaatga

SEQ ID NO: 335478 - DNA, 20 bp, Artificial Sequence
  chemically synthesized
tgtccttgtgatagtttgct

SEQ ID NO: 335479 - DNA, 20 bp, Artificial Sequence
  chemically synthesized
cattctcagcaaactatcac

SEQ ID NO: 335480 - DNA, 20 bp, Artificial Sequence
  chemically synthesized
attctcagcaaactatcaca

SEQ ID NO: 335481 - DNA, 20 bp, Artificial Sequence
  chemically synthesized
ttggttttttgtccttgtga

SEQ ID NO: 335482 - DNA, 20 bp, Artificial Sequence
  chemically synthesized
gagtgagaacatgcagtgtt

SEQ ID NO: 335483 - DNA, 20 bp, Artificial Sequence
  chemically synthesized
cacctctgagtgagaacatg

SEQ ID NO: 335484 - DNA, 20 bp, Artificial Sequence
  chemically synthesized
aaacactgcatgttctcact

SEQ ID NO: 335485 - DNA, 20 bp, Artificial Sequence
  chemically synthesized
acactgcatgttctcactca

SEQ ID NO: 335486 - DNA, 20 bp, Artificial Sequence
  chemically synthesized
cactgcatgttctcactcag

SEQ ID NO: 335487 - DNA, 20 bp, Artificial Sequence
  chemically synthesized
ttcagttcccacctctgagt

SEQ ID NO: 335488 - DNA, 20 bp, Artificial Sequence
  chemically synthesized
tgcatgttctcactcagagg

SEQ ID NO: 335489 - DNA, 20 bp, Artificial Sequence
  chemically synthesized
gcatgttctcactcagaggt

SEQ ID NO: 335490 - DNA, 20 bp, Artificial Sequence
  chemically synthesized
ttttttcagttcccacctct

SEQ ID NO: 335491 - DNA, 20 bp, Artificial Sequence
  chemically synthesized
tcagaggtgggaactgaaaa

SEQ ID NO: 335492 - DNA, 20 bp, Artificial Sequence
  chemically synthesized
agaggtgggaactgaaaaaa

SEQ ID NO: 335493 - DNA, 20 bp, Artificial Sequence
  chemically synthesized
gtccaagtgttctctttttt

SEQ ID NO: 335494 - DNA, 20 bp, Artificial Sequence
  chemically synthesized
aactgaaaaaagagaacact

SEQ ID NO: 335495 - DNA, 20 bp, Artificial Sequence
  chemically synthesized
aaaaagagaacacttggaca

SEQ ID NO: 335496 - DNA, 20 bp, Artificial Sequence
  chemically synthesized
aaaagagaacacttggacac

SEQ ID NO: 335497 - DNA, 20 bp, Artificial Sequence
  chemically synthesized
atgttccccttcctgtgtcc

SEQ ID NO: 335498 - DNA, 20 bp, Artificial Sequence
  chemically synthesized
agagaacacttggacacagg

SEQ ID NO: 335499 - DNA, 20 bp, Artificial Sequence
  chemically synthesized
gagaacacttggacacagga

SEQ ID NO: 335500 - DNA, 20 bp, Artificial Sequence
  chemically synthesized
agaacacttggacacaggaa

SEQ ID NO: 335501 - DNA, 20 bp, Artificial Sequence
  chemically synthesized
gaacacttggacacaggaag

SEQ ID NO: 335502 - DNA, 20 bp, Artificial Sequence
  chemically synthesized
ggaaggggaacatcacacac

SEQ ID NO: 335503 - DNA, 20 bp, Artificial Sequence
  chemically synthesized
gaaggggaacatcacacacc

SEQ ID NO: 335504 - DNA, 20 bp, Artificial Sequence
  chemically synthesized
aaggggaacatcacacaccg

SEQ ID NO: 335505 - DNA, 20 bp, Artificial Sequence
  chemically synthesized
ccccaccccacaacaggccc

SEQ ID NO: 335506 - DNA, 20 bp, Artificial Sequence
  chemically synthesized
tcacacaccggggcctgttg

SEQ ID NO: 335507 - DNA, 20 bp, Artificial Sequence
  chemically synthesized
cacacaccggggcctgttgt

SEQ ID NO: 335508 - DNA, 20 bp, Artificial Sequence
  chemically synthesized
acacaccggggcctgttgtg

SEQ ID NO: 335509 - DNA, 20 bp, Artificial Sequence
  chemically synthesized
cactccccccaccccacaac

SEQ ID NO: 335510 - DNA, 20 bp, Artificial Sequence
  chemically synthesized
ccactccccccaccccacaa

SEQ ID NO: 335511 - DNA, 20 bp, Artificial Sequence
  chemically synthesized
caccggggcctgttgtgggg

SEQ ID NO: 335512 - DNA, 20 bp, Artificial Sequence
  chemically synthesized
accggggcctgttgtggggt

SEQ ID NO: 335513 - DNA, 20 bp, Artificial Sequence
  chemically synthesized
ccggggcctgttgtggggtg

SEQ ID NO: 335514 - DNA, 20 bp, Artificial Sequence
  chemically synthesized
cggggcctgttgtggggtgg

SEQ ID NO: 335515 - DNA, 20 bp, Artificial Sequence
  chemically synthesized
ggggcctgttgtggggtggg

SEQ ID NO: 335516 - DNA, 20 bp, Artificial Sequence
  chemically synthesized
ggcctgttgtggggtggggg

SEQ ID NO: 335517 - DNA, 20 bp, Artificial Sequence
  chemically synthesized
ctgttgtggggtggggggag

SEQ ID NO: 335518 - DNA, 20 bp, Artificial Sequence
  chemically synthesized
tgttgtggggtggggggagt

SEQ ID NO: 335519 - DNA, 20 bp, Artificial Sequence
  chemically synthesized
gttgtggggtggggggagtg

SEQ ID NO: 335520 - DNA, 20 bp, Artificial Sequence
  chemically synthesized
tgtggggtggggggagtggg

SEQ ID NO: 335521 - DNA, 20 bp, Artificial Sequence
  chemically synthesized
gtggggtggggggagtgggg

SEQ ID NO: 335522 - DNA, 20 bp, Artificial Sequence
  chemically synthesized
tggggtggggggagtgggga

SEQ ID NO: 335523 - DNA, 20 bp, Artificial Sequence
  chemically synthesized
ggggtggggggagtggggag

SEQ ID NO: 335524 - DNA, 20 bp, Artificial Sequence
  chemically synthesized
gggtggggggagtggggagg

SEQ ID NO: 335525 - DNA, 20 bp, Artificial Sequence
  chemically synthesized
ggtggggggagtggggaggg

SEQ ID NO: 335526 - DNA, 20 bp, Artificial Sequence
  chemically synthesized
tggggggagtggggaggggg

SEQ ID NO: 335527 - DNA, 20 bp, Artificial Sequence
  chemically synthesized
ggggggagtggggagggggg

SEQ ID NO: 335528 - DNA, 20 bp, Artificial Sequence
  chemically synthesized
gggggagtggggagggggga

SEQ ID NO: 335529 - DNA, 20 bp, Artificial Sequence
  chemically synthesized
gagtggggaggggggaggga

SEQ ID NO: 335530 - DNA, 20 bp, Artificial Sequence
  chemically synthesized
ggaggggggagggatagcat

SEQ ID NO: 335531 - DNA, 20 bp, Artificial Sequence
  chemically synthesized
gaggggggagggatagcatt

SEQ ID NO: 335532 - DNA, 20 bp, Artificial Sequence
  chemically synthesized
ggggggagggatagcattag

SEQ ID NO: 335533 - DNA, 20 bp, Artificial Sequence
  chemically synthesized
ttaactcgtcatttcgcatt

SEQ ID NO: 335534 - DNA, 20 bp, Artificial Sequence
  chemically synthesized
attaactcgtcatttcgcat

SEQ ID NO: 335535 - DNA, 20 bp, Artificial Sequence
  chemically synthesized
tatacctaatgcgaaatgac

SEQ ID NO: 335536 - DNA, 20 bp, Artificial Sequence
  chemically synthesized
aatgcgaaatgacgagttaa

SEQ ID NO: 335537 - DNA, 20 bp, Artificial Sequence
  chemically synthesized
atgcgaaatgacgagttaat

SEQ ID NO: 335538 - DNA, 20 bp, Artificial Sequence
  chemically synthesized
aaatgacgagttaatgggtg

SEQ ID NO: 335539 - DNA, 20 bp, Artificial Sequence
  chemically synthesized
atgggtgcagcacaccaaca

SEQ ID NO: 335540 - DNA, 20 bp, Artificial Sequence
  chemically synthesized
tatgtatacatgtgccatgt

SEQ ID NO: 335541 - DNA, 20 bp, Artificial Sequence
  chemically synthesized
ggtacatgtgcacaacgtgc

SEQ ID NO: 335542 - DNA, 20 bp, Artificial Sequence
  chemically synthesized
gggtacatgtgcacaacgtg

SEQ ID NO: 335543 - DNA, 20 bp, Artificial Sequence
  chemically synthesized
ttattatactttaagtttta

SEQ ID NO: 335544 - DNA, 20 bp, Artificial Sequence
  chemically synthesized
attattatactttaagtttt

SEQ ID NO: 335545 - DNA, 20 bp, Artificial Sequence
  chemically synthesized
cacatgtaccctaaaactta

SEQ ID NO: 335546 - DNA, 20 bp, Artificial Sequence
  chemically synthesized
tattattatactttaagttt

SEQ ID NO: 335547 - DNA, 20 bp, Artificial Sequence
  chemically synthesized
tttttttattattatacttt

SEQ ID NO: 335548 - DNA, 20 bp, Artificial Sequence
  chemically synthesized
taaaaaaaaaatgtaaaaat

SEQ ID NO: 335549 - DNA, 20 bp, Artificial Sequence
  chemically synthesized
aaaaaaatgtaaaaattagc

SEQ ID NO: 335550 - DNA, 20 bp, Artificial Sequence
  chemically synthesized
aaaaaatgtaaaaattagct

SEQ ID NO: 335551 - DNA, 20 bp, Artificial Sequence
  chemically synthesized
atgtaaaaattagctgggca

SEQ ID NO: 335552 - DNA, 20 bp, Artificial Sequence
  chemically synthesized
gaggcgtgtatcaccatgcc

SEQ ID NO: 335553 - DNA, 20 bp, Artificial Sequence
  chemically synthesized
gtgatacacgcctctaatcc

SEQ ID NO: 335554 - DNA, 20 bp, Artificial Sequence
  chemically synthesized
ctgggatcacctgggattag

SEQ ID NO: 335555 - DNA, 20 bp, Artificial Sequence
  chemically synthesized
tgatacacgcctctaatccc

SEQ ID NO: 335556 - DNA, 20 bp, Artificial Sequence
  chemically synthesized
gctgggatcacctgggatta

SEQ ID NO: 335557 - DNA, 20 bp, Artificial Sequence
  chemically synthesized
tagctgggatcacctgggat

SEQ ID NO: 335558 - DNA, 20 bp, Artificial Sequence
  chemically synthesized
ccgaatagctgggatcacct

SEQ ID NO: 335559 - DNA, 20 bp, Artificial Sequence
  chemically synthesized
cccgaatagctgggatcacc

SEQ ID NO: 335560 - DNA, 20 bp, Artificial Sequence
  chemically synthesized
cctctaatcccaggtgatcc

SEQ ID NO: 335561 - DNA, 20 bp, Artificial Sequence
  chemically synthesized
cccaggtgatcccagctatt

SEQ ID NO: 335562 - DNA, 20 bp, Artificial Sequence
  chemically synthesized
cctcagcctcccgaatagct

SEQ ID NO: 335563 - DNA, 20 bp, Artificial Sequence
  chemically synthesized
ccaggtgatcccagctattc

SEQ ID NO: 335564 - DNA, 20 bp, Artificial Sequence
  chemically synthesized
acctcagcctcccgaatagc

SEQ ID NO: 335565 - DNA, 20 bp, Artificial Sequence
  chemically synthesized
aggtgatcccagctattcgg

SEQ ID NO: 335566 - DNA, 20 bp, Artificial Sequence
  chemically synthesized
ggtgatcccagctattcggg

SEQ ID NO: 335567 - DNA, 20 bp, Artificial Sequence
  chemically synthesized
tctaacctcagcctcccgaa

SEQ ID NO: 335568 - DNA, 20 bp, Artificial Sequence
  chemically synthesized
tcccagctattcgggaggct

SEQ ID NO: 335569 - DNA, 20 bp, Artificial Sequence
  chemically synthesized
cccagctattcgggaggctg

SEQ ID NO: 335570 - DNA, 20 bp, Artificial Sequence
  chemically synthesized
gctattcgggaggctgaggt

SEQ ID NO: 335571 - DNA, 20 bp, Artificial Sequence
  chemically synthesized
tattcgggaggctgaggtta

SEQ ID NO: 335572 - DNA, 20 bp, Artificial Sequence
  chemically synthesized
ttcaagcgattctctaacct

SEQ ID NO: 335573 - DNA, 20 bp, Artificial Sequence
  chemically synthesized
ggttagagaatcgcttgaac

SEQ ID NO: 335574 - DNA, 20 bp, Artificial Sequence
  chemically synthesized
gttagagaatcgcttgaacc

SEQ ID NO: 335575 - DNA, 20 bp, Artificial Sequence
  chemically synthesized
ttagagaatcgcttgaacca

SEQ ID NO: 335576 - DNA, 20 bp, Artificial Sequence
  chemically synthesized
aacctcctcctccctggttc

SEQ ID NO: 335577 - DNA, 20 bp, Artificial Sequence
  chemically synthesized
agagaatcgcttgaaccagg

SEQ ID NO: 335578 - DNA, 20 bp, Artificial Sequence
  chemically synthesized
gagaatcgcttgaaccaggg

SEQ ID NO: 335579 - DNA, 20 bp, Artificial Sequence
  chemically synthesized
gaatcgcttgaaccagggag

SEQ ID NO: 335580 - DNA, 20 bp, Artificial Sequence
  chemically synthesized
aatcgcttgaaccagggagg

SEQ ID NO: 335581 - DNA, 20 bp, Artificial Sequence
  chemically synthesized
tgctgcaacctcctcctccc

SEQ ID NO: 335582 - DNA, 20 bp, Artificial Sequence
  chemically synthesized
tcgcttgaaccagggaggag

SEQ ID NO: 335583 - DNA, 20 bp, Artificial Sequence
  chemically synthesized
cgcttgaaccagggaggagg

SEQ ID NO: 335584 - DNA, 20 bp, Artificial Sequence
  chemically synthesized
aaccagggaggaggaggttg

SEQ ID NO: 335585 - DNA, 20 bp, Artificial Sequence
  chemically synthesized
agggaggaggaggttgcagc

SEQ ID NO: 335586 - DNA, 20 bp, Artificial Sequence
  chemically synthesized
ggaggaggttgcagcaagct

SEQ ID NO: 335587 - DNA, 20 bp, Artificial Sequence
  chemically synthesized
aggttgcagcaagctgagat

SEQ ID NO: 335588 - DNA, 20 bp, Artificial Sequence
  chemically synthesized
ggttgcagcaagctgagatc

SEQ ID NO: 335589 - DNA, 20 bp, Artificial Sequence
  chemically synthesized
ggagtgcagtggcccgatct

SEQ ID NO: 335590 - DNA, 20 bp, Artificial Sequence
  chemically synthesized
tcacccagggtggagtgcag

SEQ ID NO: 335591 - DNA, 20 bp, Artificial Sequence
  chemically synthesized
ctctcacccagggtggagtg

SEQ ID NO: 335592 - DNA, 20 bp, Artificial Sequence
  chemically synthesized
cgggccactgcactccaccc

SEQ ID NO: 335593 - DNA, 20 bp, Artificial Sequence
  chemically synthesized
gggccactgcactccaccct

SEQ ID NO: 335594 - DNA, 20 bp, Artificial Sequence
  chemically synthesized
tcactctctcacccagggtg

SEQ ID NO: 335595 - DNA, 20 bp, Artificial Sequence
  chemically synthesized
tctcactctctcacccaggg

SEQ ID NO: 335596 - DNA, 20 bp, Artificial Sequence
  chemically synthesized
cactgcactccaccctgggt

SEQ ID NO: 335597 - DNA, 20 bp, Artificial Sequence
  chemically synthesized
ctgcactccaccctgggtga

SEQ ID NO: 335598 - DNA, 20 bp, Artificial Sequence
  chemically synthesized
gagtctcactctctcaccca

SEQ ID NO: 335599 - DNA, 20 bp, Artificial Sequence
  chemically synthesized
ggagtctcactctctcaccc

SEQ ID NO: 335600 - DNA, 20 bp, Artificial Sequence
  chemically synthesized
gcactccaccctgggtgaga

SEQ ID NO: 335601 - DNA, 20 bp, Artificial Sequence
  chemically synthesized
tggagtctcactctctcacc

SEQ ID NO: 335602 - DNA, 20 bp, Artificial Sequence
  chemically synthesized
tccaccctgggtgagagagt

SEQ ID NO: 335603 - DNA, 20 bp, Artificial Sequence
  chemically synthesized
tttgtttgttttttgagatg

SEQ ID NO: 335604 - DNA, 20 bp, Artificial Sequence
  chemically synthesized
tgtttgtttgttttttgaga

SEQ ID NO: 335605 - DNA, 20 bp, Artificial Sequence
  chemically synthesized
tttttgtttgtttgtttttt

SEQ ID NO: 335606 - DNA, 20 bp, Artificial Sequence
  chemically synthesized
aaacaaacaaaaaattaaaa

SEQ ID NO: 335607 - DNA, 20 bp, Artificial Sequence
  chemically synthesized
aaaattaaaaaagaaaaaaa

SEQ ID NO: 335608 - DNA, 20 bp, Artificial Sequence
  chemically synthesized
attaaaaaagaaaaaaacag

SEQ ID NO: 335609 - DNA, 20 bp, Artificial Sequence
  chemically synthesized
aggcaagcattatgcatttt

SEQ ID NO: 335610 - DNA, 20 bp, Artificial Sequence
  chemically synthesized
caaaatgcataatgcttgcc

SEQ ID NO: 335611 - DNA, 20 bp, Artificial Sequence
  chemically synthesized
aaatgcataatgcttgccta

SEQ ID NO: 335612 - DNA, 20 bp, Artificial Sequence
  chemically synthesized
ttccctgttatgctctaggc

SEQ ID NO: 335613 - DNA, 20 bp, Artificial Sequence
  chemically synthesized
ttttttccctgttatgctct

SEQ ID NO: 335614 - DNA, 20 bp, Artificial Sequence
  chemically synthesized
cttttttccctgttatgctc

SEQ ID NO: 335615 - DNA, 20 bp, Artificial Sequence
  chemically synthesized
aatgcttgcctagagcataa

SEQ ID NO: 335616 - DNA, 20 bp, Artificial Sequence
  chemically synthesized
atgcttgcctagagcataac

SEQ ID NO: 335617 - DNA, 20 bp, Artificial Sequence
  chemically synthesized
tgcttgcctagagcataaca

SEQ ID NO: 335618 - DNA, 20 bp, Artificial Sequence
  chemically synthesized
ctagagcataacagggaaaa

SEQ ID NO: 335619 - DNA, 20 bp, Artificial Sequence
  chemically synthesized
tagagcataacagggaaaaa

SEQ ID NO: 335620 - DNA, 20 bp, Artificial Sequence
  chemically synthesized
aacagggaaaaaaggaaaat

SEQ ID NO: 335621 - DNA, 20 bp, Artificial Sequence
  chemically synthesized
aaaggaaaatcagatgcttt

SEQ ID NO: 335622 - DNA, 20 bp, Artificial Sequence
  chemically synthesized
ggaaaatcagatgcttttag

SEQ ID NO: 335623 - DNA, 20 bp, Artificial Sequence
  chemically synthesized
tcagtgtatcagtcttctaa

SEQ ID NO: 335624 - DNA, 20 bp, Artificial Sequence
  chemically synthesized
tcaaatagttttcagtgtat

SEQ ID NO: 335625 - DNA, 20 bp, Artificial Sequence
  chemically synthesized
cagaacgctcaaatagtttt

SEQ ID NO: 335626 - DNA, 20 bp, Artificial Sequence
  chemically synthesized
tgatacactgaaaactattt

SEQ ID NO: 335627 - DNA, 20 bp, Artificial Sequence
  chemically synthesized
tgattaacagaacgctcaaa

SEQ ID NO: 335628 - DNA, 20 bp, Artificial Sequence
  chemically synthesized
gtttaggatttattgattaa

SEQ ID NO: 335629 - DNA, 20 bp, Artificial Sequence
  chemically synthesized
ccatttgtattggtaggttt

SEQ ID NO: 335630 - DNA, 20 bp, Artificial Sequence
  chemically synthesized
tccatttgtattggtaggtt

SEQ ID NO: 335631 - DNA, 20 bp, Artificial Sequence
  chemically synthesized
taagttccatttgtattggt

SEQ ID NO: 335632 - DNA, 20 bp, Artificial Sequence
  chemically synthesized
ataagttccatttgtattgg

SEQ ID NO: 335633 - DNA, 20 bp, Artificial Sequence
  chemically synthesized
cctaaacctaccaatacaaa

SEQ ID NO: 335634 - DNA, 20 bp, Artificial Sequence
  chemically synthesized
atgataagttccatttgtat

SEQ ID NO: 335635 - DNA, 20 bp, Artificial Sequence
  chemically synthesized
tacaaatggaacttatcatg

SEQ ID NO: 335636 - DNA, 20 bp, Artificial Sequence
  chemically synthesized
tactggattggctgcatgat

SEQ ID NO: 335637 - DNA, 20 bp, Artificial Sequence
  chemically synthesized
aacttatcatgcagccaatc

SEQ ID NO: 335638 - DNA, 20 bp, Artificial Sequence
  chemically synthesized
gctaccattatttactggat

SEQ ID NO: 335639 - DNA, 20 bp, Artificial Sequence
  chemically synthesized
ttccagctaccattatttac

SEQ ID NO: 335640 - DNA, 20 bp, Artificial Sequence
  chemically synthesized
gcagccaatccagtaaataa

SEQ ID NO: 335641 - DNA, 20 bp, Artificial Sequence
  chemically synthesized
gccaatccagtaaataatgg

SEQ ID NO: 335642 - DNA, 20 bp, Artificial Sequence
  chemically synthesized
atccagtaaataatggtagc

SEQ ID NO: 335643 - DNA, 20 bp, Artificial Sequence
  chemically synthesized
cagtaaataatggtagctgg

SEQ ID NO: 335644 - DNA, 20 bp, Artificial Sequence
  chemically synthesized
acaatcactatcattacttc

SEQ ID NO: 335645 - DNA, 20 bp, Artificial Sequence
  chemically synthesized
atggtagctggaagtaatga

SEQ ID NO: 335646 - DNA, 20 bp, Artificial Sequence
  chemically synthesized
gatagtgattgtaaaaacta

SEQ ID NO: 335647 - DNA, 20 bp, Artificial Sequence
  chemically synthesized
gtgattgtaaaaactatggc

SEQ ID NO: 335648 - DNA, 20 bp, Artificial Sequence
  chemically synthesized
tgattgtaaaaactatggct

SEQ ID NO: 335649 - DNA, 20 bp, Artificial Sequence
  chemically synthesized
tgagccaccatgcccagcca

SEQ ID NO: 335650 - DNA, 20 bp, Artificial Sequence
  chemically synthesized
gtaaaaactatggctgggca

SEQ ID NO: 335651 - DNA, 20 bp, Artificial Sequence
  chemically synthesized
aaaactatggctgggcatgg

SEQ ID NO: 335652 - DNA, 20 bp, Artificial Sequence
  chemically synthesized
caggcatgagccaccatgcc

SEQ ID NO: 335653 - DNA, 20 bp, Artificial Sequence
  chemically synthesized
agtgctcggattacaggcat

SEQ ID NO: 335654 - DNA, 20 bp, Artificial Sequence
  chemically synthesized
gtggctcatgcctgtaatcc

SEQ ID NO: 335655 - DNA, 20 bp, Artificial Sequence
  chemically synthesized
tcccaaagtgctcggattac

SEQ ID NO: 335656 - DNA, 20 bp, Artificial Sequence
  chemically synthesized
ctcccaaagtgctcggatta

SEQ ID NO: 335657 - DNA, 20 bp, Artificial Sequence
  chemically synthesized
tgcctgtaatccgagcactt

SEQ ID NO: 335658 - DNA, 20 bp, Artificial Sequence
  chemically synthesized
cctcagcctcccaaagtgct

SEQ ID NO: 335659 - DNA, 20 bp, Artificial Sequence
  chemically synthesized
gcctgtaatccgagcacttt

SEQ ID NO: 335660 - DNA, 20 bp, Artificial Sequence
  chemically synthesized
ctgtaatccgagcactttgg

SEQ ID NO: 335661 - DNA, 20 bp, Artificial Sequence
  chemically synthesized
tgtaatccgagcactttggg

SEQ ID NO: 335662 - DNA, 20 bp, Artificial Sequence
  chemically synthesized
ccgcccacctcagcctccca

SEQ ID NO: 335663 - DNA, 20 bp, Artificial Sequence
  chemically synthesized
tccgagcactttgggaggct

SEQ ID NO: 335664 - DNA, 20 bp, Artificial Sequence
  chemically synthesized
ccgagcactttgggaggctg

SEQ ID NO: 335665 - DNA, 20 bp, Artificial Sequence
  chemically synthesized
agcactttgggaggctgagg

SEQ ID NO: 335666 - DNA, 20 bp, Artificial Sequence
  chemically synthesized
gcactttgggaggctgaggt

SEQ ID NO: 335667 - DNA, 20 bp, Artificial Sequence
  chemically synthesized
ctttgggaggctgaggtggg

SEQ ID NO: 335668 - DNA, 20 bp, Artificial Sequence
  chemically synthesized
ctcaggtgatccgcccacct

SEQ ID NO: 335669 - DNA, 20 bp, Artificial Sequence
  chemically synthesized
ctgaggtgggcggatcacct

SEQ ID NO: 335670 - DNA, 20 bp, Artificial Sequence
  chemically synthesized
tgaggtgggcggatcacctg

SEQ ID NO: 335671 - DNA, 20 bp, Artificial Sequence
  chemically synthesized
gtgggcggatcacctgaggt

SEQ ID NO: 335672 - DNA, 20 bp, Artificial Sequence
  chemically synthesized
tgggcggatcacctgaggtc

SEQ ID NO: 335673 - DNA, 20 bp, Artificial Sequence
  chemically synthesized
gtctctgaactcctgacctc

SEQ ID NO: 335674 - DNA, 20 bp, Artificial Sequence
  chemically synthesized
ggcggatcacctgaggtcag

SEQ ID NO: 335675 - DNA, 20 bp, Artificial Sequence
  chemically synthesized
ggtctctgaactcctgacct

SEQ ID NO: 335676 - DNA, 20 bp, Artificial Sequence
  chemically synthesized
atcacctgaggtcaggagtt

SEQ ID NO: 335677 - DNA, 20 bp, Artificial Sequence
  chemically synthesized
cacctgaggtcaggagttca

SEQ ID NO: 335678 - DNA, 20 bp, Artificial Sequence
  chemically synthesized
gaggtcaggagttcagagac

SEQ ID NO: 335679 - DNA, 20 bp, Artificial Sequence
  chemically synthesized
caggagttcagagaccagcc

SEQ ID NO: 335680 - DNA, 20 bp, Artificial Sequence
  chemically synthesized
tttcaccatcttggccaggc

SEQ ID NO: 335681 - DNA, 20 bp, Artificial Sequence
  chemically synthesized
gttcagagaccagcctggcc

SEQ ID NO: 335682 - DNA, 20 bp, Artificial Sequence
  chemically synthesized
ggggtttcaccatcttggcc

SEQ ID NO: 335683 - DNA, 20 bp, Artificial Sequence
  chemically synthesized
agagaccagcctggccaaga

SEQ ID NO: 335684 - DNA, 20 bp, Artificial Sequence
  chemically synthesized
cggggtttcaccatcttggc

SEQ ID NO: 335685 - DNA, 20 bp, Artificial Sequence
  chemically synthesized
gagacggggtttcaccatct

SEQ ID NO: 335686 - DNA, 20 bp, Artificial Sequence
  chemically synthesized
ttgtatttttaatagagacg

SEQ ID NO: 335687 - DNA, 20 bp, Artificial Sequence
  chemically synthesized
tttgtatttttaatagagac

SEQ ID NO: 335688 - DNA, 20 bp, Artificial Sequence
  chemically synthesized
ttttgtatttttaatagaga

SEQ ID NO: 335689 - DNA, 20 bp, Artificial Sequence
  chemically synthesized
tgatttttgtatttttaata

SEQ ID NO: 335690 - DNA, 20 bp, Artificial Sequence
  chemically synthesized
gctgatttttgtatttttaa

SEQ ID NO: 335691 - DNA, 20 bp, Artificial Sequence
  chemically synthesized
tctattaaaaatacaaaaat

SEQ ID NO: 335692 - DNA, 20 bp, Artificial Sequence
  chemically synthesized
ttaaaaatacaaaaatcagc

SEQ ID NO: 335693 - DNA, 20 bp, Artificial Sequence
  chemically synthesized
taaaaatacaaaaatcagcc

SEQ ID NO: 335694 - DNA, 20 bp, Artificial Sequence
  chemically synthesized
atacaaaaatcagccgggta

SEQ ID NO: 335695 - DNA, 20 bp, Artificial Sequence
  chemically synthesized
caaaaatcagccgggtatgg

SEQ ID NO: 335696 - DNA, 20 bp, Artificial Sequence
  chemically synthesized
caggcatgcaccaccatacc

SEQ ID NO: 335697 - DNA, 20 bp, Artificial Sequence
  chemically synthesized
tcccgagtaggtgggattac

SEQ ID NO: 335698 - DNA, 20 bp, Artificial Sequence
  chemically synthesized
ctcccgagtaggtgggatta

SEQ ID NO: 335699 - DNA, 20 bp, Artificial Sequence
  chemically synthesized
tgcctgtaatcccacctact

SEQ ID NO: 335700 - DNA, 20 bp, Artificial Sequence
  chemically synthesized
cctcagcctcccgagtaggt

SEQ ID NO: 335701 - DNA, 20 bp, Artificial Sequence
  chemically synthesized
gcctgtaatcccacctactc

SEQ ID NO: 335702 - DNA, 20 bp, Artificial Sequence
  chemically synthesized
gcctcagcctcccgagtagg

SEQ ID NO: 335703 - DNA, 20 bp, Artificial Sequence
  chemically synthesized
ctgtaatcccacctactcgg

SEQ ID NO: 335704 - DNA, 20 bp, Artificial Sequence
  chemically synthesized
tgtaatcccacctactcggg

SEQ ID NO: 335705 - DNA, 20 bp, Artificial Sequence
  chemically synthesized
cctgcctcagcctcccgagt

SEQ ID NO: 335706 - DNA, 20 bp, Artificial Sequence
  chemically synthesized
tcctgcctcagcctcccgag

SEQ ID NO: 335707 - DNA, 20 bp, Artificial Sequence
  chemically synthesized
ttctcctgcctcagcctccc

SEQ ID NO: 335708 - DNA, 20 bp, Artificial Sequence
  chemically synthesized
tcccacctactcgggaggct

SEQ ID NO: 335709 - DNA, 20 bp, Artificial Sequence
  chemically synthesized
cccacctactcgggaggctg

SEQ ID NO: 335710 - DNA, 20 bp, Artificial Sequence
  chemically synthesized
acctactcgggaggctgagg

SEQ ID NO: 335711 - DNA, 20 bp, Artificial Sequence
  chemically synthesized
cctactcgggaggctgaggc

SEQ ID NO: 335712 - DNA, 20 bp, Artificial Sequence
  chemically synthesized
tactcgggaggctgaggcag

SEQ ID NO: 335713 - DNA, 20 bp, Artificial Sequence
  chemically synthesized
ttcaagcaattctcctgcct

SEQ ID NO: 335714 - DNA, 20 bp, Artificial Sequence
  chemically synthesized
gcaggagaattgcttgaacc

SEQ ID NO: 335715 - DNA, 20 bp, Artificial Sequence
  chemically synthesized
caggagaattgcttgaaccc

SEQ ID NO: 335716 - DNA, 20 bp, Artificial Sequence
  chemically synthesized
catctctgcctcccgggttc

SEQ ID NO: 335717 - DNA, 20 bp, Artificial Sequence
  chemically synthesized
ggagaattgcttgaacccgg

SEQ ID NO: 335718 - DNA, 20 bp, Artificial Sequence
  chemically synthesized
gagaattgcttgaacccggg

SEQ ID NO: 335719 - DNA, 20 bp, Artificial Sequence
  chemically synthesized
aattgcttgaacccgggagg

SEQ ID NO: 335720 - DNA, 20 bp, Artificial Sequence
  chemically synthesized
caccgtcatctctgcctccc

SEQ ID NO: 335721 - DNA, 20 bp, Artificial Sequence
  chemically synthesized
ttgcttgaacccgggaggca

SEQ ID NO: 335722 - DNA, 20 bp, Artificial Sequence
  chemically synthesized
tcaccgtcatctctgcctcc

SEQ ID NO: 335723 - DNA, 20 bp, Artificial Sequence
  chemically synthesized
aacccgggaggcagagatga

SEQ ID NO: 335724 - DNA, 20 bp, Artificial Sequence
  chemically synthesized
cgggaggcagagatgacggt

SEQ ID NO: 335725 - DNA, 20 bp, Artificial Sequence
  chemically synthesized
ggcagagatgacggtgagcc

SEQ ID NO: 335726 - DNA, 20 bp, Artificial Sequence
  chemically synthesized
ggagtacagtggcgtgatct

SEQ ID NO: 335727 - DNA, 20 bp, Artificial Sequence
  chemically synthesized
tttcccaggctggagtacag

SEQ ID NO: 335728 - DNA, 20 bp, Artificial Sequence
  chemically synthesized
gagatcacgccactgtactc

SEQ ID NO: 335729 - DNA, 20 bp, Artificial Sequence
  chemically synthesized
ctgtttcccaggctggagta

SEQ ID NO: 335730 - DNA, 20 bp, Artificial Sequence
  chemically synthesized
cacgccactgtactccagcc

SEQ ID NO: 335731 - DNA, 20 bp, Artificial Sequence
  chemically synthesized
acgccactgtactccagcct

SEQ ID NO: 335732 - DNA, 20 bp, Artificial Sequence
  chemically synthesized
ttgctctgtttcccaggctg

SEQ ID NO: 335733 - DNA, 20 bp, Artificial Sequence
  chemically synthesized
tcttgctctgtttcccaggc

SEQ ID NO: 335734 - DNA, 20 bp, Artificial Sequence
  chemically synthesized
ctgtactccagcctgggaaa

SEQ ID NO: 335735 - DNA, 20 bp, Artificial Sequence
  chemically synthesized
ggagtcttgctctgtttccc

SEQ ID NO: 335736 - DNA, 20 bp, Artificial Sequence
  chemically synthesized
gtactccagcctgggaaaca

SEQ ID NO: 335737 - DNA, 20 bp, Artificial Sequence
  chemically synthesized
cggagtcttgctctgtttcc

SEQ ID NO: 335738 - DNA, 20 bp, Artificial Sequence
  chemically synthesized
tccagcctgggaaacagagc

SEQ ID NO: 335739 - DNA, 20 bp, Artificial Sequence
  chemically synthesized
aacagagcaagactccgtct

SEQ ID NO: 335740 - DNA, 20 bp, Artificial Sequence
  chemically synthesized
cagagcaagactccgtctcg

SEQ ID NO: 335741 - DNA, 20 bp, Artificial Sequence
  chemically synthesized
tttttaccccctccgagacg

SEQ ID NO: 335742 - DNA, 20 bp, Artificial Sequence
  chemically synthesized
agagcaagactccgtctcgg

SEQ ID NO: 335743 - DNA, 20 bp, Artificial Sequence
  chemically synthesized
gagcaagactccgtctcgga

SEQ ID NO: 335744 - DNA, 20 bp, Artificial Sequence
  chemically synthesized
tttttttaccccctccgaga

SEQ ID NO: 335745 - DNA, 20 bp, Artificial Sequence
  chemically synthesized
agcaagactccgtctcggag

SEQ ID NO: 335746 - DNA, 20 bp, Artificial Sequence
  chemically synthesized
gcaagactccgtctcggagg

SEQ ID NO: 335747 - DNA, 20 bp, Artificial Sequence
  chemically synthesized
gatttttttttaccccctcc

SEQ ID NO: 335748 - DNA, 20 bp, Artificial Sequence
  chemically synthesized
tgtgtctcatattttcaata

SEQ ID NO: 335749 - DNA, 20 bp, Artificial Sequence
  chemically synthesized
aaaatctatattgaaaatat

SEQ ID NO: 335750 - DNA, 20 bp, Artificial Sequence
  chemically synthesized
tatattgaaaatatgagaca

SEQ ID NO: 335751 - DNA, 20 bp, Artificial Sequence
  chemically synthesized
taactcaataaacgtttgtg

SEQ ID NO: 335752 - DNA, 20 bp, Artificial Sequence
  chemically synthesized
agtaactcaataaacgtttg

SEQ ID NO: 335753 - DNA, 20 bp, Artificial Sequence
  chemically synthesized
atactccacaaacgtttatt

SEQ ID NO: 335754 - DNA, 20 bp, Artificial Sequence
  chemically synthesized
tttattgagttactttgtgc

SEQ ID NO: 335755 - DNA, 20 bp, Artificial Sequence
  chemically synthesized
ttattgagttactttgtgcc

SEQ ID NO: 335756 - DNA, 20 bp, Artificial Sequence
  chemically synthesized
ctaaaatatagcctggcaca

SEQ ID NO: 335757 - DNA, 20 bp, Artificial Sequence
  chemically synthesized
ttaaagtctaaaatatagcc

SEQ ID NO: 335758 - DNA, 20 bp, Artificial Sequence
  chemically synthesized
ctttgtgccaggctatattt

SEQ ID NO: 335759 - DNA, 20 bp, Artificial Sequence
  chemically synthesized
tattattaaagtctaaaata

SEQ ID NO: 335760 - DNA, 20 bp, Artificial Sequence
  chemically synthesized
tatttaccattgtattatta

SEQ ID NO: 335761 - DNA, 20 bp, Artificial Sequence
  chemically synthesized
tttagactttaataatacaa

SEQ ID NO: 335762 - DNA, 20 bp, Artificial Sequence
  chemically synthesized
caatggtaaataaatgatcc

SEQ ID NO: 335763 - DNA, 20 bp, Artificial Sequence
  chemically synthesized
atggtaaataaatgatccca

SEQ ID NO: 335764 - DNA, 20 bp, Artificial Sequence
  chemically synthesized
tttcatgagaacatatctct

SEQ ID NO: 335765 - DNA, 20 bp, Artificial Sequence
  chemically synthesized
ctttcatgagaacatatctc

SEQ ID NO: 335766 - DNA, 20 bp, Artificial Sequence
  chemically synthesized
ccagagatatgttctcatga

SEQ ID NO: 335767 - DNA, 20 bp, Artificial Sequence
  chemically synthesized
cattacagtcattctttcat

SEQ ID NO: 335768 - DNA, 20 bp, Artificial Sequence
  chemically synthesized
tcatgaaagaatgactgtaa

SEQ ID NO: 335769 - DNA, 20 bp, Artificial Sequence
  chemically synthesized
catgaaagaatgactgtaat

SEQ ID NO: 335770 - DNA, 20 bp, Artificial Sequence
  chemically synthesized
cgtaacttcctttcccatta

SEQ ID NO: 335771 - DNA, 20 bp, Artificial Sequence
  chemically synthesized
aaagaatgactgtaatggga

SEQ ID NO: 335772 - DNA, 20 bp, Artificial Sequence
  chemically synthesized
aagaatgactgtaatgggaa

SEQ ID NO: 335773 - DNA, 20 bp, Artificial Sequence
  chemically synthesized
aatgactgtaatgggaaagg

SEQ ID NO: 335774 - DNA, 20 bp, Artificial Sequence
  chemically synthesized
ataaataatttcaaaattct

SEQ ID NO: 335775 - DNA, 20 bp, Artificial Sequence
  chemically synthesized
acagtggcaagtggtaaact

SEQ ID NO: 335776 - DNA, 20 bp, Artificial Sequence
  chemically synthesized
agcagggatacagtggcaag

SEQ ID NO: 335777 - DNA, 20 bp, Artificial Sequence
  chemically synthesized
tgaagcagggatacagtggc

SEQ ID NO: 335778 - DNA, 20 bp, Artificial Sequence
  chemically synthesized
tcaatgaagcagggatacag

SEQ ID NO: 335779 - DNA, 20 bp, Artificial Sequence
  chemically synthesized
aattcaatgaagcagggata

SEQ ID NO: 335780 - DNA, 20 bp, Artificial Sequence
  chemically synthesized
gaaggcaattcaatgaagca

SEQ ID NO: 335781 - DNA, 20 bp, Artificial Sequence
  chemically synthesized
ggaaggcaattcaatgaagc

SEQ ID NO: 335782 - DNA, 20 bp, Artificial Sequence
  chemically synthesized
tggaaggcaattcaatgaag

SEQ ID NO: 335783 - DNA, 20 bp, Artificial Sequence
  chemically synthesized
ttatggaaggcaattcaatg

SEQ ID NO: 335784 - DNA, 20 bp, Artificial Sequence
  chemically synthesized
cattgaattgccttccataa

SEQ ID NO: 335785 - DNA, 20 bp, Artificial Sequence
  chemically synthesized
gcgaagagggcttttatgga

SEQ ID NO: 335786 - DNA, 20 bp, Artificial Sequence
  chemically synthesized
agcgaagagggcttttatgg

SEQ ID NO: 335787 - DNA, 20 bp, Artificial Sequence
  chemically synthesized
cccagcgaagagggctttta

SEQ ID NO: 335788 - DNA, 20 bp, Artificial Sequence
  chemically synthesized
tccataaaagccctcttcgc

SEQ ID NO: 335789 - DNA, 20 bp, Artificial Sequence
  chemically synthesized
aaaaactatcccagcgaaga

SEQ ID NO: 335790 - DNA, 20 bp, Artificial Sequence
  chemically synthesized
ccataaaagccctcttcgct

SEQ ID NO: 335791 - DNA, 20 bp, Artificial Sequence
  chemically synthesized
caaaaactatcccagcgaag

SEQ ID NO: 335792 - DNA, 20 bp, Artificial Sequence
  chemically synthesized
ccaaaaactatcccagcgaa

SEQ ID NO: 335793 - DNA, 20 bp, Artificial Sequence
  chemically synthesized
ttccaaaaactatcccagcg

SEQ ID NO: 335794 - DNA, 20 bp, Artificial Sequence
  chemically synthesized
aaaagccctcttcgctggga

SEQ ID NO: 335795 - DNA, 20 bp, Artificial Sequence
  chemically synthesized
ttaatttccaaaaactatcc

SEQ ID NO: 335796 - DNA, 20 bp, Artificial Sequence
  chemically synthesized
ctcttcgctgggatagtttt

SEQ ID NO: 335797 - DNA, 20 bp, Artificial Sequence
  chemically synthesized
atagtttttggaaattaaat

SEQ ID NO: 335798 - DNA, 20 bp, Artificial Sequence
  chemically synthesized
ttttggaaattaaatcagaa

SEQ ID NO: 335799 - DNA, 20 bp, Artificial Sequence
  chemically synthesized
tggaaattaaatcagaatgg

SEQ ID NO: 335800 - DNA, 20 bp, Artificial Sequence
  chemically synthesized
aaatcagaatggaagctctg

SEQ ID NO: 335801 - DNA, 20 bp, Artificial Sequence
  chemically synthesized
tgtttggtattaacactgca

SEQ ID NO: 335802 - DNA, 20 bp, Artificial Sequence
  chemically synthesized
gatgtttggtattaacactg

SEQ ID NO: 335803 - DNA, 20 bp, Artificial Sequence
  chemically synthesized
tgaggcactctcaggatgtt

SEQ ID NO: 335804 - DNA, 20 bp, Artificial Sequence
  chemically synthesized
gtgttaataccaaacatcct

SEQ ID NO: 335805 - DNA, 20 bp, Artificial Sequence
  chemically synthesized
gttaataccaaacatcctga

SEQ ID NO: 335806 - DNA, 20 bp, Artificial Sequence
  chemically synthesized
atttgctctgaggcactctc

SEQ ID NO: 335807 - DNA, 20 bp, Artificial Sequence
  chemically synthesized
catttgctctgaggcactct

SEQ ID NO: 335808 - DNA, 20 bp, Artificial Sequence
  chemically synthesized
caaacatcctgagagtgcct

SEQ ID NO: 335809 - DNA, 20 bp, Artificial Sequence
  chemically synthesized
aacatcctgagagtgcctca

SEQ ID NO: 335810 - DNA, 20 bp, Artificial Sequence
  chemically synthesized
gcttctgtgcatttgctctg

SEQ ID NO: 335811 - DNA, 20 bp, Artificial Sequence
  chemically synthesized
agcttctgtgcatttgctct

SEQ ID NO: 335812 - DNA, 20 bp, Artificial Sequence
  chemically synthesized
agtgcctcagagcaaatgca

SEQ ID NO: 335813 - DNA, 20 bp, Artificial Sequence
  chemically synthesized
gcctcagagcaaatgcacag

SEQ ID NO: 335814 - DNA, 20 bp, Artificial Sequence
  chemically synthesized
cagagcaaatgcacagaagc

SEQ ID NO: 335815 - DNA, 20 bp, Artificial Sequence
  chemically synthesized
agcaaatgcacagaagctgg

SEQ ID NO: 335816 - DNA, 20 bp, Artificial Sequence
  chemically synthesized
gcaaatgcacagaagctggt

SEQ ID NO: 335817 - DNA, 20 bp, Artificial Sequence
  chemically synthesized
caaatgcacagaagctggtg

SEQ ID NO: 335818 - DNA, 20 bp, Artificial Sequence
  chemically synthesized
tttaactgacttttccccac

SEQ ID NO: 335819 - DNA, 20 bp, Artificial Sequence
  chemically synthesized
gcacagaagctggtggggaa

SEQ ID NO: 335820 - DNA, 20 bp, Artificial Sequence
  chemically synthesized
agaagctggtggggaaaagt

SEQ ID NO: 335821 - DNA, 20 bp, Artificial Sequence
  chemically synthesized
aaaactcctaaagtcacagt

SEQ ID NO: 335822 - DNA, 20 bp, Artificial Sequence
  chemically synthesized
ttcgcaaccaactgtgactt

SEQ ID NO: 335823 - DNA, 20 bp, Artificial Sequence
  chemically synthesized
tcgcaaccaactgtgacttt

SEQ ID NO: 335824 - DNA, 20 bp, Artificial Sequence
  chemically synthesized
atttaaaactcctaaagtca

SEQ ID NO: 335825 - DNA, 20 bp, Artificial Sequence
  chemically synthesized
gcaaccaactgtgactttag

SEQ ID NO: 335826 - DNA, 20 bp, Artificial Sequence
  chemically synthesized
cgtcttatttaaaactccta

SEQ ID NO: 335827 - DNA, 20 bp, Artificial Sequence
  chemically synthesized
tgactttaggagttttaaat

SEQ ID NO: 335828 - DNA, 20 bp, Artificial Sequence
  chemically synthesized
gttttaaataagacgtgttt

SEQ ID NO: 335829 - DNA, 20 bp, Artificial Sequence
  chemically synthesized
taagacgtgtttcagttgaa

SEQ ID NO: 335830 - DNA, 20 bp, Artificial Sequence
  chemically synthesized
ctgttgattagggcacacgg

SEQ ID NO: 335831 - DNA, 20 bp, Artificial Sequence
  chemically synthesized
ttcctgttgattagggcaca

SEQ ID NO: 335832 - DNA, 20 bp, Artificial Sequence
  chemically synthesized
ctgccgtgtgccctaatcaa

SEQ ID NO: 335833 - DNA, 20 bp, Artificial Sequence
  chemically synthesized
agaacttttcctgttgatta

SEQ ID NO: 335834 - DNA, 20 bp, Artificial Sequence
  chemically synthesized
tgccgtgtgccctaatcaac

SEQ ID NO: 335835 - DNA, 20 bp, Artificial Sequence
  chemically synthesized
tagaacttttcctgttgatt

SEQ ID NO: 335836 - DNA, 20 bp, Artificial Sequence
  chemically synthesized
atagaacttttcctgttgat

SEQ ID NO: 335837 - DNA, 20 bp, Artificial Sequence
  chemically synthesized
tgtgccctaatcaacaggaa

SEQ ID NO: 335838 - DNA, 20 bp, Artificial Sequence
  chemically synthesized
ggaaattgaaaatttaaaga

SEQ ID NO: 335839 - DNA, 20 bp, Artificial Sequence
  chemically synthesized
atttggaaattgaaaattta

SEQ ID NO: 335840 - DNA, 20 bp, Artificial Sequence
  chemically synthesized
aaattttcaatttccaaatg

SEQ ID NO: 335841 - DNA, 20 bp, Artificial Sequence
  chemically synthesized
aattttcaatttccaaatgc

SEQ ID NO: 335842 - DNA, 20 bp, Artificial Sequence
  chemically synthesized
ttttgaaaatttcctgcatt

SEQ ID NO: 335843 - DNA, 20 bp, Artificial Sequence
  chemically synthesized
ttaggacaattgtgacggaa

SEQ ID NO: 335844 - DNA, 20 bp, Artificial Sequence
  chemically synthesized
acttaggacaattgtgacgg

SEQ ID NO: 335845 - DNA, 20 bp, Artificial Sequence
  chemically synthesized
taaacttaggacaattgtga

SEQ ID NO: 335846 - DNA, 20 bp, Artificial Sequence
  chemically synthesized
tcttccgtcacaattgtcct

SEQ ID NO: 335847 - DNA, 20 bp, Artificial Sequence
  chemically synthesized
tatttaacatatgtaaactt

SEQ ID NO: 335848 - DNA, 20 bp, Artificial Sequence
  chemically synthesized
atatttaacatatgtaaact

SEQ ID NO: 335849 - DNA, 20 bp, Artificial Sequence
  chemically synthesized
tctaaggatttaaatagtca

SEQ ID NO: 335850 - DNA, 20 bp, Artificial Sequence
  chemically synthesized
ttctaaggatttaaatagtc

SEQ ID NO: 335851 - DNA, 20 bp, Artificial Sequence
  chemically synthesized
atttgttctaaggatttaaa

SEQ ID NO: 335852 - DNA, 20 bp, Artificial Sequence
  chemically synthesized
tccttgactatttaaatcct

SEQ ID NO: 335853 - DNA, 20 bp, Artificial Sequence
  chemically synthesized
cataccaaatatttgttcta

SEQ ID NO: 335854 - DNA, 20 bp, Artificial Sequence
  chemically synthesized
acataccaaatatttgttct

SEQ ID NO: 335855 - DNA, 20 bp, Artificial Sequence
  chemically synthesized
aaatccttagaacaaatatt

SEQ ID NO: 335856 - DNA, 20 bp, Artificial Sequence
  chemically synthesized
tggtatgtaacttctaaacc

SEQ ID NO: 335857 - DNA, 20 bp, Artificial Sequence
  chemically synthesized
gtctgttctcctgggtttag

SEQ ID NO: 335858 - DNA, 20 bp, Artificial Sequence
  chemically synthesized
ggtatgtaacttctaaaccc

SEQ ID NO: 335859 - DNA, 20 bp, Artificial Sequence
  chemically synthesized
tatgtaacttctaaacccag

SEQ ID NO: 335860 - DNA, 20 bp, Artificial Sequence
  chemically synthesized
agtgtctgttctcctgggtt

SEQ ID NO: 335861 - DNA, 20 bp, Artificial Sequence
  chemically synthesized
aacttctaaacccaggagaa

SEQ ID NO: 335862 - DNA, 20 bp, Artificial Sequence
  chemically synthesized
aagttagtgtctgttctcct

SEQ ID NO: 335863 - DNA, 20 bp, Artificial Sequence
  chemically synthesized
caagttagtgtctgttctcc

SEQ ID NO: 335864 - DNA, 20 bp, Artificial Sequence
  chemically synthesized
ttccatttgttatgtcaagt

SEQ ID NO: 335865 - DNA, 20 bp, Artificial Sequence
  chemically synthesized
tagcttccatttgttatgtc

SEQ ID NO: 335866 - DNA, 20 bp, Artificial Sequence
  chemically synthesized
cactaacttgacataacaaa

SEQ ID NO: 335867 - DNA, 20 bp, Artificial Sequence
  chemically synthesized
taacttgacataacaaatgg

SEQ ID NO: 335868 - DNA, 20 bp, Artificial Sequence
  chemically synthesized
cataacaaatggaagctact

SEQ ID NO: 335869 - DNA, 20 bp, Artificial Sequence
  chemically synthesized
acaaatggaagctactcagt

SEQ ID NO: 335870 - DNA, 20 bp, Artificial Sequence
  chemically synthesized
agtctcccatgctgactgag

SEQ ID NO: 335871 - DNA, 20 bp, Artificial Sequence
  chemically synthesized
tgtagtctcccatgctgact

SEQ ID NO: 335872 - DNA, 20 bp, Artificial Sequence
  chemically synthesized
tggaagctactcagtcagca

SEQ ID NO: 335873 - DNA, 20 bp, Artificial Sequence
  chemically synthesized
ggaagctactcagtcagcat

SEQ ID NO: 335874 - DNA, 20 bp, Artificial Sequence
  chemically synthesized
aagctactcagtcagcatgg

SEQ ID NO: 335875 - DNA, 20 bp, Artificial Sequence
  chemically synthesized
tcagtcagcatgggagacta

SEQ ID NO: 335876 - DNA, 20 bp, Artificial Sequence
  chemically synthesized
tcagcatgggagactacaga

SEQ ID NO: 335877 - DNA, 20 bp, Artificial Sequence
  chemically synthesized
tacagatgtttttctatctg

SEQ ID NO: 335878 - DNA, 20 bp, Artificial Sequence
  chemically synthesized
gagagaattgtaagaaagta

SEQ ID NO: 335879 - DNA, 20 bp, Artificial Sequence
  chemically synthesized
atgtcgagagaattgtaaga

SEQ ID NO: 335880 - DNA, 20 bp, Artificial Sequence
  chemically synthesized
aggcatgtcgagagaattgt

SEQ ID NO: 335881 - DNA, 20 bp, Artificial Sequence
  chemically synthesized
tcccacaacaggcatgtcga

SEQ ID NO: 335882 - DNA, 20 bp, Artificial Sequence
  chemically synthesized
cttcccacaacaggcatgtc

SEQ ID NO: 335883 - DNA, 20 bp, Artificial Sequence
  chemically synthesized
ttctctcgacatgcctgttg

SEQ ID NO: 335884 - DNA, 20 bp, Artificial Sequence
  chemically synthesized
tctctcgacatgcctgttgt

SEQ ID NO: 335885 - DNA, 20 bp, Artificial Sequence
  chemically synthesized
ctaatagttcttcccacaac

SEQ ID NO: 335886 - DNA, 20 bp, Artificial Sequence
  chemically synthesized
ctcgacatgcctgttgtggg

SEQ ID NO: 335887 - DNA, 20 bp, Artificial Sequence
  chemically synthesized
cctaatagttcttcccacaa

SEQ ID NO: 335888 - DNA, 20 bp, Artificial Sequence
  chemically synthesized
cctgttgtgggaagaactat

SEQ ID NO: 335889 - DNA, 20 bp, Artificial Sequence
  chemically synthesized
ctgttgtgggaagaactatt

SEQ ID NO: 335890 - DNA, 20 bp, Artificial Sequence
  chemically synthesized
tgttgtgggaagaactatta

SEQ ID NO: 335891 - DNA, 20 bp, Artificial Sequence
  chemically synthesized
atctcaaatgtaaaccctaa

SEQ ID NO: 335892 - DNA, 20 bp, Artificial Sequence
  chemically synthesized
aactattagggtttacattt

SEQ ID NO: 335893 - DNA, 20 bp, Artificial Sequence
  chemically synthesized
agggtttacatttgagatga

SEQ ID NO: 335894 - DNA, 20 bp, Artificial Sequence
  chemically synthesized
gagatgaaagtattttgact

SEQ ID NO: 335895 - DNA, 20 bp, Artificial Sequence
  chemically synthesized
aagcagagttaaatgtcact

SEQ ID NO: 335896 - DNA, 20 bp, Artificial Sequence
  chemically synthesized
agtgacatttaactctgctt

SEQ ID NO: 335897 - DNA, 20 bp, Artificial Sequence
  chemically synthesized
aggtgacaatcacttaagca

SEQ ID NO: 335898 - DNA, 20 bp, Artificial Sequence
  chemically synthesized
gcaggtgacaatcacttaag

SEQ ID NO: 335899 - DNA, 20 bp, Artificial Sequence
  chemically synthesized
accgcaggtgacaatcactt

SEQ ID NO: 335900 - DNA, 20 bp, Artificial Sequence
  chemically synthesized
gcttaagtgattgtcacctg

SEQ ID NO: 335901 - DNA, 20 bp, Artificial Sequence
  chemically synthesized
aagcaaagcacgaaaaccgc

SEQ ID NO: 335902 - DNA, 20 bp, Artificial Sequence
  chemically synthesized
aaagcaaagcacgaaaaccg

SEQ ID NO: 335903 - DNA, 20 bp, Artificial Sequence
  chemically synthesized
atttggttaggtcaaaagca

SEQ ID NO: 335904 - DNA, 20 bp, Artificial Sequence
  chemically synthesized
agtcaatttggttaggtcaa

SEQ ID NO: 335905 - DNA, 20 bp, Artificial Sequence
  chemically synthesized
aagaaaaagtcaatttggtt

SEQ ID NO: 335906 - DNA, 20 bp, Artificial Sequence
  chemically synthesized
aaagaaaaagtcaatttggt

SEQ ID NO: 335907 - DNA, 20 bp, Artificial Sequence
  chemically synthesized
gaggaaagaaaaagtcaatt

SEQ ID NO: 335908 - DNA, 20 bp, Artificial Sequence
  chemically synthesized
ctagcagcagaggaaagaaa

SEQ ID NO: 335909 - DNA, 20 bp, Artificial Sequence
  chemically synthesized
ctttttctagcagcagagga

SEQ ID NO: 335910 - DNA, 20 bp, Artificial Sequence
  chemically synthesized
ctttttctttcctctgctgc

SEQ ID NO: 335911 - DNA, 20 bp, Artificial Sequence
  chemically synthesized
tatactttttctagcagcag

SEQ ID NO: 335912 - DNA, 20 bp, Artificial Sequence
  chemically synthesized
ctatactttttctagcagca

SEQ ID NO: 335913 - DNA, 20 bp, Artificial Sequence
  chemically synthesized
gactatactttttctagcag

SEQ ID NO: 335914 - DNA, 20 bp, Artificial Sequence
  chemically synthesized
ctttcctctgctgctagaaa

SEQ ID NO: 335915 - DNA, 20 bp, Artificial Sequence
  chemically synthesized
actgactatactttttctag

SEQ ID NO: 335916 - DNA, 20 bp, Artificial Sequence
  chemically synthesized
gaaactgactatactttttc

SEQ ID NO: 335917 - DNA, 20 bp, Artificial Sequence
  chemically synthesized
ctctgctgctagaaaaagta

SEQ ID NO: 335918 - DNA, 20 bp, Artificial Sequence
  chemically synthesized
gctgctagaaaaagtatagt

SEQ ID NO: 335919 - DNA, 20 bp, Artificial Sequence
  chemically synthesized
agaaaaagtatagtcagttt

SEQ ID NO: 335920 - DNA, 20 bp, Artificial Sequence
  chemically synthesized
aaaagtatagtcagtttcag

SEQ ID NO: 335921 - DNA, 20 bp, Artificial Sequence
  chemically synthesized
agcgaggaagataaggggtg

SEQ ID NO: 335922 - DNA, 20 bp, Artificial Sequence
  chemically synthesized
ttagcgaggaagataagggg

SEQ ID NO: 335923 - DNA, 20 bp, Artificial Sequence
  chemically synthesized
atgttagcgaggaagataag

SEQ ID NO: 335924 - DNA, 20 bp, Artificial Sequence
  chemically synthesized
tatgttagcgaggaagataa

SEQ ID NO: 335925 - DNA, 20 bp, Artificial Sequence
  chemically synthesized
ttatgttagcgaggaagata

SEQ ID NO: 335926 - DNA, 20 bp, Artificial Sequence
  chemically synthesized
tttatgttagcgaggaagat

SEQ ID NO: 335927 - DNA, 20 bp, Artificial Sequence
  chemically synthesized
actattttatgttagcgagg

SEQ ID NO: 335928 - DNA, 20 bp, Artificial Sequence
  chemically synthesized
tagactattttatgttagcg

SEQ ID NO: 335929 - DNA, 20 bp, Artificial Sequence
  chemically synthesized
atagactattttatgttagc

SEQ ID NO: 335930 - DNA, 20 bp, Artificial Sequence
  chemically synthesized
acaaatagactattttatgt

SEQ ID NO: 335931 - DNA, 20 bp, Artificial Sequence
  chemically synthesized
tcttcctcgctaacataaaa

SEQ ID NO: 335932 - DNA, 20 bp, Artificial Sequence
  chemically synthesized
aaacaattaaggttcacaaa

SEQ ID NO: 335933 - DNA, 20 bp, Artificial Sequence
  chemically synthesized
tctaacactgtaaacaatta

SEQ ID NO: 335934 - DNA, 20 bp, Artificial Sequence
  chemically synthesized
ttctaacactgtaaacaatt

SEQ ID NO: 335935 - DNA, 20 bp, Artificial Sequence
  chemically synthesized
ttgtgaaccttaattgttta

SEQ ID NO: 335936 - DNA, 20 bp, Artificial Sequence
  chemically synthesized
accttaattgtttacagtgt

SEQ ID NO: 335937 - DNA, 20 bp, Artificial Sequence
  chemically synthesized
ttaattgtttacagtgttag

SEQ ID NO: 335938 - DNA, 20 bp, Artificial Sequence
  chemically synthesized
tagaagttatacttgataca

SEQ ID NO: 335939 - DNA, 20 bp, Artificial Sequence
  chemically synthesized
ttctggcctcactgtgtatc

SEQ ID NO: 335940 - DNA, 20 bp, Artificial Sequence
  chemically synthesized
agttatacttgatacacagt

SEQ ID NO: 335941 - DNA, 20 bp, Artificial Sequence
  chemically synthesized
gttatacttgatacacagtg

SEQ ID NO: 335942 - DNA, 20 bp, Artificial Sequence
  chemically synthesized
tacttgatacacagtgaggc

SEQ ID NO: 335943 - DNA, 20 bp, Artificial Sequence
  chemically synthesized
tacacagtgaggccagaata

SEQ ID NO: 335944 - DNA, 20 bp, Artificial Sequence
  chemically synthesized
tgaaataaacatctttattc

SEQ ID NO: 335945 - DNA, 20 bp, Artificial Sequence
  chemically synthesized
tcatgtgacataaatttaat

SEQ ID NO: 335946 - DNA, 20 bp, Artificial Sequence
  chemically synthesized
taattggttattattctttc

SEQ ID NO: 335947 - DNA, 20 bp, Artificial Sequence
  chemically synthesized
aaatcccaaaatataccaga

SEQ ID NO: 335948 - DNA, 20 bp, Artificial Sequence
  chemically synthesized
tttgaaatcccaaaatatac

SEQ ID NO: 335949 - DNA, 20 bp, Artificial Sequence
  chemically synthesized
ttattctttctggtatattt

SEQ ID NO: 335950 - DNA, 20 bp, Artificial Sequence
  chemically synthesized
tattctttctggtatatttt

SEQ ID NO: 335951 - DNA, 20 bp, Artificial Sequence
  chemically synthesized
ggatttcaaaatatgcctga

SEQ ID NO: 335952 - DNA, 20 bp, Artificial Sequence
  chemically synthesized
aggactgcccttataccatc

SEQ ID NO: 335953 - DNA, 20 bp, Artificial Sequence
  chemically synthesized
caaaatatgcctgatggtat

SEQ ID NO: 335954 - DNA, 20 bp, Artificial Sequence
  chemically synthesized
caggactgcccttataccat

SEQ ID NO: 335955 - DNA, 20 bp, Artificial Sequence
  chemically synthesized
aaaatatgcctgatggtata

SEQ ID NO: 335956 - DNA, 20 bp, Artificial Sequence
  chemically synthesized
aaatatgcctgatggtataa

SEQ ID NO: 335957 - DNA, 20 bp, Artificial Sequence
  chemically synthesized
tatgcctgatggtataaggg

SEQ ID NO: 335958 - DNA, 20 bp, Artificial Sequence
  chemically synthesized
tgatggtataagggcagtcc

SEQ ID NO: 335959 - DNA, 20 bp, Artificial Sequence
  chemically synthesized
gatggtataagggcagtcct

SEQ ID NO: 335960 - DNA, 20 bp, Artificial Sequence
  chemically synthesized
atggtataagggcagtcctg

SEQ ID NO: 335961 - DNA, 20 bp, Artificial Sequence
  chemically synthesized
atcattgagtaatttgcccc

SEQ ID NO: 335962 - DNA, 20 bp, Artificial Sequence
  chemically synthesized
catcattgagtaatttgccc

SEQ ID NO: 335963 - DNA, 20 bp, Artificial Sequence
  chemically synthesized
gcgttaagctagtcatcatt

SEQ ID NO: 335964 - DNA, 20 bp, Artificial Sequence
  chemically synthesized
gcaaattactcaatgatgac

SEQ ID NO: 335965 - DNA, 20 bp, Artificial Sequence
  chemically synthesized
gtacaatatctgcgttaagc

SEQ ID NO: 335966 - DNA, 20 bp, Artificial Sequence
  chemically synthesized
caatgatgactagcttaacg

SEQ ID NO: 335967 - DNA, 20 bp, Artificial Sequence
  chemically synthesized
ttttgtacaatatctgcgtt

SEQ ID NO: 335968 - DNA, 20 bp, Artificial Sequence
  chemically synthesized
cagatattgtacaaaatgat

SEQ ID NO: 335969 - DNA, 20 bp, Artificial Sequence
  chemically synthesized
agatattgtacaaaatgatc

SEQ ID NO: 335970 - DNA, 20 bp, Artificial Sequence
  chemically synthesized
ttttttttttgaaaaaaata

SEQ ID NO: 335971 - DNA, 20 bp, Artificial Sequence
  chemically synthesized
tgaaaaaaatatggtaaaaa

SEQ ID NO: 335972 - DNA, 20 bp, Artificial Sequence
  chemically synthesized
taagctcttttatatgtagt

SEQ ID NO: 335973 - DNA, 20 bp, Artificial Sequence
  chemically synthesized
ctaagctcttttatatgtag

SEQ ID NO: 335974 - DNA, 20 bp, Artificial Sequence
  chemically synthesized
aatggacccactacatataa

SEQ ID NO: 335975 - DNA, 20 bp, Artificial Sequence
  chemically synthesized
aggctaagctcttttatatg

SEQ ID NO: 335976 - DNA, 20 bp, Artificial Sequence
  chemically synthesized
tggacccactacatataaaa

SEQ ID NO: 335977 - DNA, 20 bp, Artificial Sequence
  chemically synthesized
ccactacatataaaagagct

SEQ ID NO: 335978 - DNA, 20 bp, Artificial Sequence
  chemically synthesized
tatttttgcctcaacaggct

SEQ ID NO: 335979 - DNA, 20 bp, Artificial Sequence
  chemically synthesized
ataaaagagcttagcctgtt

SEQ ID NO: 335980 - DNA, 20 bp, Artificial Sequence
  chemically synthesized
taaaagagcttagcctgttg

SEQ ID NO: 335981 - DNA, 20 bp, Artificial Sequence
  chemically synthesized
caaggtatttttgcctcaac

SEQ ID NO: 335982 - DNA, 20 bp, Artificial Sequence
  chemically synthesized
tcaaggtatttttgcctcaa

SEQ ID NO: 335983 - DNA, 20 bp, Artificial Sequence
  chemically synthesized
atagggtcaggatttgatca

SEQ ID NO: 335984 - DNA, 20 bp, Artificial Sequence
  chemically synthesized
gatagggtcaggatttgatc

SEQ ID NO: 335985 - DNA, 20 bp, Artificial Sequence
  chemically synthesized
tacctattagtgatagggtc

SEQ ID NO: 335986 - DNA, 20 bp, Artificial Sequence
  chemically synthesized
ttacctattagtgatagggt

SEQ ID NO: 335987 - DNA, 20 bp, Artificial Sequence
  chemically synthesized
tcccttacctattagtgata

SEQ ID NO: 335988 - DNA, 20 bp, Artificial Sequence
  chemically synthesized
gtcccttacctattagtgat

SEQ ID NO: 335989 - DNA, 20 bp, Artificial Sequence
  chemically synthesized
aatcctgaccctatcactaa

SEQ ID NO: 335990 - DNA, 20 bp, Artificial Sequence
  chemically synthesized
agtcccttacctattagtga

SEQ ID NO: 335991 - DNA, 20 bp, Artificial Sequence
  chemically synthesized
atcctgaccctatcactaat

SEQ ID NO: 335992 - DNA, 20 bp, Artificial Sequence
  chemically synthesized
tgaccctatcactaataggt

SEQ ID NO: 335993 - DNA, 20 bp, Artificial Sequence
  chemically synthesized
gaccctatcactaataggta

SEQ ID NO: 335994 - DNA, 20 bp, Artificial Sequence
  chemically synthesized
taccacagtcccttacctat

SEQ ID NO: 335995 - DNA, 20 bp, Artificial Sequence
  chemically synthesized
accctatcactaataggtaa

SEQ ID NO: 335996 - DNA, 20 bp, Artificial Sequence
  chemically synthesized
cactaataggtaagggactg

SEQ ID NO: 335997 - DNA, 20 bp, Artificial Sequence
  chemically synthesized
gaaattagtgaattttacca

SEQ ID NO: 335998 - DNA, 20 bp, Artificial Sequence
  chemically synthesized
aaaaactgggacagggaaat

SEQ ID NO: 335999 - DNA, 20 bp, Artificial Sequence
  chemically synthesized
attcactaatttccctgtcc

SEQ ID NO: 336000 - DNA, 20 bp, Artificial Sequence
  chemically synthesized
tatagataaaaactgggaca

SEQ ID NO: 336001 - DNA, 20 bp, Artificial Sequence
  chemically synthesized
ttatagataaaaactgggac

SEQ ID NO: 336002 - DNA, 20 bp, Artificial Sequence
  chemically synthesized
tttatagataaaaactggga

SEQ ID NO: 336003 - DNA, 20 bp, Artificial Sequence
  chemically synthesized
tcattttatagataaaaact

SEQ ID NO: 336004 - DNA, 20 bp, Artificial Sequence
  chemically synthesized
ctcattttatagataaaaac

SEQ ID NO: 336005 - DNA, 20 bp, Artificial Sequence
  chemically synthesized
ccagtttttatctataaaat

SEQ ID NO: 336006 - DNA, 20 bp, Artificial Sequence
  chemically synthesized
tactaatatgactcatttta

SEQ ID NO: 336007 - DNA, 20 bp, Artificial Sequence
  chemically synthesized
atctataaaatgagtcatat

SEQ ID NO: 336008 - DNA, 20 bp, Artificial Sequence
  chemically synthesized
catcatccctaattatttgc

SEQ ID NO: 336009 - DNA, 20 bp, Artificial Sequence
  chemically synthesized
attagtatcttgcaaataat

SEQ ID NO: 336010 - DNA, 20 bp, Artificial Sequence
  chemically synthesized
ttagtatcttgcaaataatt

SEQ ID NO: 336011 - DNA, 20 bp, Artificial Sequence
  chemically synthesized
tagtatcttgcaaataatta

SEQ ID NO: 336012 - DNA, 20 bp, Artificial Sequence
  chemically synthesized
ataattagggatgatgttaa

SEQ ID NO: 336013 - DNA, 20 bp, Artificial Sequence
  chemically synthesized
aattagggatgatgttaaca

SEQ ID NO: 336014 - DNA, 20 bp, Artificial Sequence
  chemically synthesized
taacagagaaaatgaatgca

SEQ ID NO: 336015 - DNA, 20 bp, Artificial Sequence
  chemically synthesized
aataatagatcgtatatatt

SEQ ID NO: 336016 - DNA, 20 bp, Artificial Sequence
  chemically synthesized
aaggaaatcaggaaaaataa

SEQ ID NO: 336017 - DNA, 20 bp, Artificial Sequence
  chemically synthesized
gtgccaattggaaggaaatc

SEQ ID NO: 336018 - DNA, 20 bp, Artificial Sequence
  chemically synthesized
tgtgccaattggaaggaaat

SEQ ID NO: 336019 - DNA, 20 bp, Artificial Sequence
  chemically synthesized
tttcctgatttccttccaat

SEQ ID NO: 336020 - DNA, 20 bp, Artificial Sequence
  chemically synthesized
acaattatgtgccaattgga

SEQ ID NO: 336021 - DNA, 20 bp, Artificial Sequence
  chemically synthesized
tacaattatgtgccaattgg

SEQ ID NO: 336022 - DNA, 20 bp, Artificial Sequence
  chemically synthesized
aattacaattatgtgccaat

SEQ ID NO: 336023 - DNA, 20 bp, Artificial Sequence
  chemically synthesized
tggcacataattgtaattca

SEQ ID NO: 336024 - DNA, 20 bp, Artificial Sequence
  chemically synthesized
ggcacataattgtaattcat

SEQ ID NO: 336025 - DNA, 20 bp, Artificial Sequence
  chemically synthesized
cttaatgaaggcatgaatgc

SEQ ID NO: 336026 - DNA, 20 bp, Artificial Sequence
  chemically synthesized
cttgcattcatgccttcatt

SEQ ID NO: 336027 - DNA, 20 bp, Artificial Sequence
  chemically synthesized
attccacaaatacttaatga

SEQ ID NO: 336028 - DNA, 20 bp, Artificial Sequence
  chemically synthesized
cattccacaaatacttaatg

SEQ ID NO: 336029 - DNA, 20 bp, Artificial Sequence
  chemically synthesized
atgccttcattaagtatttg

SEQ ID NO: 336030 - DNA, 20 bp, Artificial Sequence
  chemically synthesized
tatcatgtctgacacatggt

SEQ ID NO: 336031 - DNA, 20 bp, Artificial Sequence
  chemically synthesized
gtatcatgtctgacacatgg

SEQ ID NO: 336032 - DNA, 20 bp, Artificial Sequence
  chemically synthesized
gtggaatgcctaccatgtgt

SEQ ID NO: 336033 - DNA, 20 bp, Artificial Sequence
  chemically synthesized
ttggtatcatgtctgacaca

SEQ ID NO: 336034 - DNA, 20 bp, Artificial Sequence
  chemically synthesized
agacatgataccaattcacc

SEQ ID NO: 336035 - DNA, 20 bp, Artificial Sequence
  chemically synthesized
tgattaattgcttggtgaat

SEQ ID NO: 336036 - DNA, 20 bp, Artificial Sequence
  chemically synthesized
ataaaacgtgattaattgct

SEQ ID NO: 336037 - DNA, 20 bp, Artificial Sequence
  chemically synthesized
aattaatcacgttttataat

SEQ ID NO: 336038 - DNA, 20 bp, Artificial Sequence
  chemically synthesized
atcacgttttataattagaa

SEQ ID NO: 336039 - DNA, 20 bp, Artificial Sequence
  chemically synthesized
tccttaggaattaggaaatg

SEQ ID NO: 336040 - DNA, 20 bp, Artificial Sequence
  chemically synthesized
cttccttaggaattaggaaa

SEQ ID NO: 336041 - DNA, 20 bp, Artificial Sequence
  chemically synthesized
ggctccatttcctaattcct

SEQ ID NO: 336042 - DNA, 20 bp, Artificial Sequence
  chemically synthesized
tcgtttcttccttaggaatt

SEQ ID NO: 336043 - DNA, 20 bp, Artificial Sequence
  chemically synthesized
gctccatttcctaattccta

SEQ ID NO: 336044 - DNA, 20 bp, Artificial Sequence
  chemically synthesized
ctcgtttcttccttaggaat

SEQ ID NO: 336045 - DNA, 20 bp, Artificial Sequence
  chemically synthesized
ccatttcctaattcctaagg

SEQ ID NO: 336046 - DNA, 20 bp, Artificial Sequence
  chemically synthesized
ggtccactcgtttcttcctt

SEQ ID NO: 336047 - DNA, 20 bp, Artificial Sequence
  chemically synthesized
tggtccactcgtttcttcct

SEQ ID NO: 336048 - DNA, 20 bp, Artificial Sequence
  chemically synthesized
ctaattcctaaggaagaaac

SEQ ID NO: 336049 - DNA, 20 bp, Artificial Sequence
  chemically synthesized
attcctaaggaagaaacgag

SEQ ID NO: 336050 - DNA, 20 bp, Artificial Sequence
  chemically synthesized
ggaagaaacgagtggaccat

SEQ ID NO: 336051 - DNA, 20 bp, Artificial Sequence
  chemically synthesized
atgccatctggtttgtccaa

SEQ ID NO: 336052 - DNA, 20 bp, Artificial Sequence
  chemically synthesized
gagtggaccattggacaaac

SEQ ID NO: 336053 - DNA, 20 bp, Artificial Sequence
  chemically synthesized
ggaccattggacaaaccaga

SEQ ID NO: 336054 - DNA, 20 bp, Artificial Sequence
  chemically synthesized
catcagtgttgtatgccatc

SEQ ID NO: 336055 - DNA, 20 bp, Artificial Sequence
  chemically synthesized
ttgtgctgagagagtcacat

SEQ ID NO: 336056 - DNA, 20 bp, Artificial Sequence
  chemically synthesized
caacactgatgtgactctct

SEQ ID NO: 336057 - DNA, 20 bp, Artificial Sequence
  chemically synthesized
ataaatgttttgtgctgaga

SEQ ID NO: 336058 - DNA, 20 bp, Artificial Sequence
  chemically synthesized
acataaatgttttgtgctga

SEQ ID NO: 336059 - DNA, 20 bp, Artificial Sequence
  chemically synthesized
ccacataaatgttttgtgct

SEQ ID NO: 336060 - DNA, 20 bp, Artificial Sequence
  chemically synthesized
ctcagcacaaaacatttatg

SEQ ID NO: 336061 - DNA, 20 bp, Artificial Sequence
  chemically synthesized
tcagcacaaaacatttatgt

SEQ ID NO: 336062 - DNA, 20 bp, Artificial Sequence
  chemically synthesized
cacaaaacatttatgtggga

SEQ ID NO: 336063 - DNA, 20 bp, Artificial Sequence
  chemically synthesized
atttatgtgggatggtgtca

SEQ ID NO: 336064 - DNA, 20 bp, Artificial Sequence
  chemically synthesized
tatgtgggatggtgtcatgg

SEQ ID NO: 336065 - DNA, 20 bp, Artificial Sequence
  chemically synthesized
tcatatgtcatacgcaacat

SEQ ID NO: 336066 - DNA, 20 bp, Artificial Sequence
  chemically synthesized
gtcatacgcaacatcagaat

SEQ ID NO: 336067 - DNA, 20 bp, Artificial Sequence
  chemically synthesized
tcatacgcaacatcagaata

SEQ ID NO: 336068 - DNA, 20 bp, Artificial Sequence
  chemically synthesized
catacgcaacatcagaataa

SEQ ID NO: 336069 - DNA, 20 bp, Artificial Sequence
  chemically synthesized
atacgcaacatcagaataag

SEQ ID NO: 336070 - DNA, 20 bp, Artificial Sequence
  chemically synthesized
caacatcagaataaggggtt

SEQ ID NO: 336071 - DNA, 20 bp, Artificial Sequence
  chemically synthesized
agaataaggggttcagtgtt

SEQ ID NO: 336072 - DNA, 20 bp, Artificial Sequence
  chemically synthesized
ttgttgaagtttgtgtgtga

SEQ ID NO: 336073 - DNA, 20 bp, Artificial Sequence
  chemically synthesized
agttattttgtcagttgttg

SEQ ID NO: 336074 - DNA, 20 bp, Artificial Sequence
  chemically synthesized
ttcgccatcagttattttgt

SEQ ID NO: 336075 - DNA, 20 bp, Artificial Sequence
  chemically synthesized
acaactgacaaaataactga

SEQ ID NO: 336076 - DNA, 20 bp, Artificial Sequence
  chemically synthesized
aggaaaacttaattcgccat

SEQ ID NO: 336077 - DNA, 20 bp, Artificial Sequence
  chemically synthesized
aaaataactgatggcgaatt

SEQ ID NO: 336078 - DNA, 20 bp, Artificial Sequence
  chemically synthesized
tgaaaactttggattagttc

SEQ ID NO: 336079 - DNA, 20 bp, Artificial Sequence
  chemically synthesized
ctgaaaactttggattagtt

SEQ ID NO: 336080 - DNA, 20 bp, Artificial Sequence
  chemically synthesized
agttttcctgaactaatcca

SEQ ID NO: 336081 - DNA, 20 bp, Artificial Sequence
  chemically synthesized
tactactgaaaactttggat

SEQ ID NO: 336082 - DNA, 20 bp, Artificial Sequence
  chemically synthesized
ctgaactaatccaaagtttt

SEQ ID NO: 336083 - DNA, 20 bp, Artificial Sequence
  chemically synthesized
tagagtactactgaaaactt

SEQ ID NO: 336084 - DNA, 20 bp, Artificial Sequence
  chemically synthesized
aactaatccaaagttttcag

SEQ ID NO: 336085 - DNA, 20 bp, Artificial Sequence
  chemically synthesized
ctggtttcagttttcagtta

SEQ ID NO: 336086 - DNA, 20 bp, Artificial Sequence
  chemically synthesized
cactggtttcagttttcagt

SEQ ID NO: 336087 - DNA, 20 bp, Artificial Sequence
  chemically synthesized
cgtccactggtttcagtttt

SEQ ID NO: 336088 - DNA, 20 bp, Artificial Sequence
  chemically synthesized
ctctaactgaaaactgaaac

SEQ ID NO: 336089 - DNA, 20 bp, Artificial Sequence
  chemically synthesized
taactgaaaactgaaaccag

SEQ ID NO: 336090 - DNA, 20 bp, Artificial Sequence
  chemically synthesized
tgatgttcgtccactggttt

SEQ ID NO: 336091 - DNA, 20 bp, Artificial Sequence
  chemically synthesized
aatgcgtgatgttcgtccac

SEQ ID NO: 336092 - DNA, 20 bp, Artificial Sequence
  chemically synthesized
cacgcatttgtgtattttct

SEQ ID NO: 336093 - DNA, 20 bp, Artificial Sequence
  chemically synthesized
agcatgcctccagtagtgct

SEQ ID NO: 336094 - DNA, 20 bp, Artificial Sequence
  chemically synthesized
gtgtattttctaagcactac

SEQ ID NO: 336095 - DNA, 20 bp, Artificial Sequence
  chemically synthesized
gtattttctaagcactactg

SEQ ID NO: 336096 - DNA, 20 bp, Artificial Sequence
  chemically synthesized
tattttctaagcactactgg

SEQ ID NO: 336097 - DNA, 20 bp, Artificial Sequence
  chemically synthesized
tttcatcagcatgcctccag

SEQ ID NO: 336098 - DNA, 20 bp, Artificial Sequence
  chemically synthesized
gtgtttcatcagcatgcctc

SEQ ID NO: 336099 - DNA, 20 bp, Artificial Sequence
  chemically synthesized
cttgattgggtgtgtttcat

SEQ ID NO: 336100 - DNA, 20 bp, Artificial Sequence
  chemically synthesized
ctgatgaaacacacccaatc

SEQ ID NO: 336101 - DNA, 20 bp, Artificial Sequence
  chemically synthesized
atgaaacacacccaatcaag

SEQ ID NO: 336102 - DNA, 20 bp, Artificial Sequence
  chemically synthesized
aagtttgctacttcttgatt

SEQ ID NO: 336103 - DNA, 20 bp, Artificial Sequence
  chemically synthesized
aaagtttgctacttcttgat

SEQ ID NO: 336104 - DNA, 20 bp, Artificial Sequence
  chemically synthesized
aaacacacccaatcaagaag

SEQ ID NO: 336105 - DNA, 20 bp, Artificial Sequence
  chemically synthesized
tgtaatttgaaaatgggtta

SEQ ID NO: 336106 - DNA, 20 bp, Artificial Sequence
  chemically synthesized
tatctttgtaatttgaaaat

SEQ ID NO: 336107 - DNA, 20 bp, Artificial Sequence
  chemically synthesized
gtatctttgtaatttgaaaa

SEQ ID NO: 336108 - DNA, 20 bp, Artificial Sequence
  chemically synthesized
taacccattttcaaattaca

SEQ ID NO: 336109 - DNA, 20 bp, Artificial Sequence
  chemically synthesized
aagatacattttccttttga

SEQ ID NO: 336110 - DNA, 20 bp, Artificial Sequence
  chemically synthesized
atttcataagtactgtcaaa

SEQ ID NO: 336111 - DNA, 20 bp, Artificial Sequence
  chemically synthesized
aatttcataagtactgtcaa

SEQ ID NO: 336112 - DNA, 20 bp, Artificial Sequence
  chemically synthesized
aaactcaaatgaaatttcat

SEQ ID NO: 336113 - DNA, 20 bp, Artificial Sequence
  chemically synthesized
gtacttatgaaatttcattt

SEQ ID NO: 336114 - DNA, 20 bp, Artificial Sequence
  chemically synthesized
tatgaaatttcatttgagtt

SEQ ID NO: 336115 - DNA, 20 bp, Artificial Sequence
  chemically synthesized
tgaaatttcatttgagtttg

SEQ ID NO: 336116 - DNA, 20 bp, Artificial Sequence
  chemically synthesized
tcatttgagtttggagtttc

SEQ ID NO: 336117 - DNA, 20 bp, Artificial Sequence
  chemically synthesized
ctaattacaatggtggaagc

SEQ ID NO: 336118 - DNA, 20 bp, Artificial Sequence
  chemically synthesized
ggtcctaattacaatggtgg

SEQ ID NO: 336119 - DNA, 20 bp, Artificial Sequence
  chemically synthesized
ggaggtcctaattacaatgg

SEQ ID NO: 336120 - DNA, 20 bp, Artificial Sequence
  chemically synthesized
ctggcttccaccattgtaat

SEQ ID NO: 336121 - DNA, 20 bp, Artificial Sequence
  chemically synthesized
ttgggaggtcctaattacaa

SEQ ID NO: 336122 - DNA, 20 bp, Artificial Sequence
  chemically synthesized
tggcttccaccattgtaatt

SEQ ID NO: 336123 - DNA, 20 bp, Artificial Sequence
  chemically synthesized
ttattgtatttgtagttggg

SEQ ID NO: 336124 - DNA, 20 bp, Artificial Sequence
  chemically synthesized
attattgtatttgtagttgg

SEQ ID NO: 336125 - DNA, 20 bp, Artificial Sequence
  chemically synthesized
atattattgtatttgtagtt

SEQ ID NO: 336126 - DNA, 20 bp, Artificial Sequence
  chemically synthesized
gatattattgtatttgtagt

SEQ ID NO: 336127 - DNA, 20 bp, Artificial Sequence
  chemically synthesized
catggatattattgtatttg

SEQ ID NO: 336128 - DNA, 20 bp, Artificial Sequence
  chemically synthesized
tacaaatacaataatatcca

SEQ ID NO: 336129 - DNA, 20 bp, Artificial Sequence
  chemically synthesized
tggaaattacttgacatcca

SEQ ID NO: 336130 - DNA, 20 bp, Artificial Sequence
  chemically synthesized
caataatatccatggatgtc

SEQ ID NO: 336131 - DNA, 20 bp, Artificial Sequence
  chemically synthesized
aaattgcatttttttcacat

SEQ ID NO: 336132 - DNA, 20 bp, Artificial Sequence
  chemically synthesized
aatgtgaaaaaaatgcaatt

SEQ ID NO: 336133 - DNA, 20 bp, Artificial Sequence
  chemically synthesized
aaatgcaatttagaaattta

SEQ ID NO: 336134 - DNA, 20 bp, Artificial Sequence
  chemically synthesized
tgcaatttagaaatttacag

SEQ ID NO: 336135 - DNA, 20 bp, Artificial Sequence
  chemically synthesized
tttagaaatttacagaagtg

SEQ ID NO: 336136 - DNA, 20 bp, Artificial Sequence
  chemically synthesized
agtgaagataatcaaatgtg

SEQ ID NO: 336137 - DNA, 20 bp, Artificial Sequence
  chemically synthesized
aatcaaatgtgaagcattga

SEQ ID NO: 336138 - DNA, 20 bp, Artificial Sequence
  chemically synthesized
tcaaatgtgaagcattgatg

SEQ ID NO: 336139 - DNA, 20 bp, Artificial Sequence
  chemically synthesized
atgtgaagcattgatggaga

SEQ ID NO: 336140 - DNA, 20 bp, Artificial Sequence
  chemically synthesized
tgtgaagcattgatggagaa

SEQ ID NO: 336141 - DNA, 20 bp, Artificial Sequence
  chemically synthesized
gcattgatggagaaaggtac

SEQ ID NO: 336142 - DNA, 20 bp, Artificial Sequence
  chemically synthesized
ggagaaaggtacaagtgaaa

SEQ ID NO: 336143 - DNA, 20 bp, Artificial Sequence
  chemically synthesized
agaaaggtacaagtgaaaaa

SEQ ID NO: 336144 - DNA, 20 bp, Artificial Sequence
  chemically synthesized
aaaggtacaagtgaaaaaga

SEQ ID NO: 336145 - DNA, 20 bp, Artificial Sequence
  chemically synthesized
gtacaagtgaaaaagagagt

SEQ ID NO: 336146 - DNA, 20 bp, Artificial Sequence
  chemically synthesized
atatttgtgttacatggttt

SEQ ID NO: 336147 - DNA, 20 bp, Artificial Sequence
  chemically synthesized
atcatcatatttgtgttaca

SEQ ID NO: 336148 - DNA, 20 bp, Artificial Sequence
  chemically synthesized
aacacaaatatgatgatgat

SEQ ID NO: 336149 - DNA, 20 bp, Artificial Sequence
  chemically synthesized
acacaaatatgatgatgata

SEQ ID NO: 336150 - DNA, 20 bp, Artificial Sequence
  chemically synthesized
cacaaatatgatgatgataa

SEQ ID NO: 336151 - DNA, 20 bp, Artificial Sequence
  chemically synthesized
gataagggataactttataa

SEQ ID NO: 336152 - DNA, 20 bp, Artificial Sequence
  chemically synthesized
taagggataactttataaaa

SEQ ID NO: 336153 - DNA, 20 bp, Artificial Sequence
  chemically synthesized
ttattacattctcttttata

SEQ ID NO: 336154 - DNA, 20 bp, Artificial Sequence
  chemically synthesized
agaatgtaataaatgatgtt

SEQ ID NO: 336155 - DNA, 20 bp, Artificial Sequence
  chemically synthesized
tgttaagaatgcgtaaaaca

SEQ ID NO: 336156 - DNA, 20 bp, Artificial Sequence
  chemically synthesized
agaatgcgtaaaacatagct

SEQ ID NO: 336157 - DNA, 20 bp, Artificial Sequence
  chemically synthesized
attttaatgaaaatcaatct

SEQ ID NO: 336158 - DNA, 20 bp, Artificial Sequence
  chemically synthesized
tcattaaaatgtatatacta

SEQ ID NO: 336159 - DNA, 20 bp, Artificial Sequence
  chemically synthesized
actattcaaaaaatatactt

SEQ ID NO: 336160 - DNA, 20 bp, Artificial Sequence
  chemically synthesized
actaaagtatattttttgaa

SEQ ID NO: 336161 - DNA, 20 bp, Artificial Sequence
  chemically synthesized
tatattttttgaatagtgaa

SEQ ID NO: 336162 - DNA, 20 bp, Artificial Sequence
  chemically synthesized
gaatttgatgtatgtgttaa

SEQ ID NO: 336163 - DNA, 20 bp, Artificial Sequence
  chemically synthesized
tactttacaggcatggaagg

SEQ ID NO: 336164 - DNA, 20 bp, Artificial Sequence
  chemically synthesized
ctgtactttacaggcatgga

SEQ ID NO: 336165 - DNA, 20 bp, Artificial Sequence
  chemically synthesized
gctgtactttacaggcatgg

SEQ ID NO: 336166 - DNA, 20 bp, Artificial Sequence
  chemically synthesized
catgctgtactttacaggca

SEQ ID NO: 336167 - DNA, 20 bp, Artificial Sequence
  chemically synthesized
cactgccttccatgcctgta

SEQ ID NO: 336168 - DNA, 20 bp, Artificial Sequence
  chemically synthesized
tgggtcatgctgtactttac

SEQ ID NO: 336169 - DNA, 20 bp, Artificial Sequence
  chemically synthesized
ccttccatgcctgtaaagta

SEQ ID NO: 336170 - DNA, 20 bp, Artificial Sequence
  chemically synthesized
ttgggtcatgctgtacttta

SEQ ID NO: 336171 - DNA, 20 bp, Artificial Sequence
  chemically synthesized
ttagctaagtgtgaaggatt

SEQ ID NO: 336172 - DNA, 20 bp, Artificial Sequence
  chemically synthesized
tttagctaagtgtgaaggat

SEQ ID NO: 336173 - DNA, 20 bp, Artificial Sequence
  chemically synthesized
atgacccaatccttcacact

SEQ ID NO: 336174 - DNA, 20 bp, Artificial Sequence
  chemically synthesized
gtgcttttagctaagtgtga

SEQ ID NO: 336175 - DNA, 20 bp, Artificial Sequence
  chemically synthesized
agtgcttttagctaagtgtg

SEQ ID NO: 336176 - DNA, 20 bp, Artificial Sequence
  chemically synthesized
aatccttcacacttagctaa

SEQ ID NO: 336177 - DNA, 20 bp, Artificial Sequence
  chemically synthesized
acattagagtgcttttagct

SEQ ID NO: 336178 - DNA, 20 bp, Artificial Sequence
  chemically synthesized
ggatgacattagagtgcttt

SEQ ID NO: 336179 - DNA, 20 bp, Artificial Sequence
  chemically synthesized
gagaaagagggatgacatta

SEQ ID NO: 336180 - DNA, 20 bp, Artificial Sequence
  chemically synthesized
aagagaaagagggatgacat

SEQ ID NO: 336181 - DNA, 20 bp, Artificial Sequence
  chemically synthesized
caatgtgtgaaagagaaaga

SEQ ID NO: 336182 - DNA, 20 bp, Artificial Sequence
  chemically synthesized
ccaatgtgtgaaagagaaag

SEQ ID NO: 336183 - DNA, 20 bp, Artificial Sequence
  chemically synthesized
accaatgtgtgaaagagaaa

SEQ ID NO: 336184 - DNA, 20 bp, Artificial Sequence
  chemically synthesized
agaccaatgtgtgaaagaga

SEQ ID NO: 336185 - DNA, 20 bp, Artificial Sequence
  chemically synthesized
aacaagaccaatgtgtgaaa

SEQ ID NO: 336186 - DNA, 20 bp, Artificial Sequence
  chemically synthesized
aaaacaagaccaatgtgtga

SEQ ID NO: 336187 - DNA, 20 bp, Artificial Sequence
  chemically synthesized
cctctttctctttcacacat

SEQ ID NO: 336188 - DNA, 20 bp, Artificial Sequence
  chemically synthesized
ttgagatgcaaaaacaaaac

SEQ ID NO: 336189 - DNA, 20 bp, Artificial Sequence
  chemically synthesized
taaaatggccttcggtattt

SEQ ID NO: 336190 - DNA, 20 bp, Artificial Sequence
  chemically synthesized
tttttgcatctcaaataccg

SEQ ID NO: 336191 - DNA, 20 bp, Artificial Sequence
  chemically synthesized
ttttgcatctcaaataccga

SEQ ID NO: 336192 - DNA, 20 bp, Artificial Sequence
  chemically synthesized
aagaggtgtaaaatggcctt

SEQ ID NO: 336193 - DNA, 20 bp, Artificial Sequence
  chemically synthesized
gaagatcaagaggtgtaaaa

SEQ ID NO: 336194 - DNA, 20 bp, Artificial Sequence
  chemically synthesized
caccaaatatgaagatcaag

SEQ ID NO: 336195 - DNA, 20 bp, Artificial Sequence
  chemically synthesized
gcaccaaatatgaagatcaa

SEQ ID NO: 336196 - DNA, 20 bp, Artificial Sequence
  chemically synthesized
gagcaccaaatatgaagatc

SEQ ID NO: 336197 - DNA, 20 bp, Artificial Sequence
  chemically synthesized
cacctcttgatcttcatatt

SEQ ID NO: 336198 - DNA, 20 bp, Artificial Sequence
  chemically synthesized
gtaaaagagcaccaaatatg

SEQ ID NO: 336199 - DNA, 20 bp, Artificial Sequence
  chemically synthesized
agaaattattttaggtaaaa

SEQ ID NO: 336200 - DNA, 20 bp, Artificial Sequence
  chemically synthesized
agagaaattattttaggtaa

SEQ ID NO: 336201 - DNA, 20 bp, Artificial Sequence
  chemically synthesized
gcaaaaagagaaattatttt

SEQ ID NO: 336202 - DNA, 20 bp, Artificial Sequence
  chemically synthesized
tgcaaaaagagaaattattt

SEQ ID NO: 336203 - DNA, 20 bp, Artificial Sequence
  chemically synthesized
atgaatcaaaaatgcaaaaa

SEQ ID NO: 336204 - DNA, 20 bp, Artificial Sequence
  chemically synthesized
gaatgaatcaaaaatgcaaa

SEQ ID NO: 336205 - DNA, 20 bp, Artificial Sequence
  chemically synthesized
tttgattcattctcacccat

SEQ ID NO: 336206 - DNA, 20 bp, Artificial Sequence
  chemically synthesized
ttgattcattctcacccatt

SEQ ID NO: 336207 - DNA, 20 bp, Artificial Sequence
  chemically synthesized
tgagttaagacctaatgggt

SEQ ID NO: 336208 - DNA, 20 bp, Artificial Sequence
  chemically synthesized
catatgagttaagacctaat

SEQ ID NO: 336209 - DNA, 20 bp, Artificial Sequence
  chemically synthesized
ccatatgagttaagacctaa

SEQ ID NO: 336210 - DNA, 20 bp, Artificial Sequence
  chemically synthesized
gaagaggtgccatatgagtt

SEQ ID NO: 336211 - DNA, 20 bp, Artificial Sequence
  chemically synthesized
ccattaggtcttaactcata

SEQ ID NO: 336212 - DNA, 20 bp, Artificial Sequence
  chemically synthesized
tctctgaagaggtgccatat

SEQ ID NO: 336213 - DNA, 20 bp, Artificial Sequence
  chemically synthesized
taactcatatggcacctctt

SEQ ID NO: 336214 - DNA, 20 bp, Artificial Sequence
  chemically synthesized
actcatatggcacctcttca

SEQ ID NO: 336215 - DNA, 20 bp, Artificial Sequence
  chemically synthesized
taggaaatgcatctctgaag

SEQ ID NO: 336216 - DNA, 20 bp, Artificial Sequence
  chemically synthesized
ataggaaatgcatctctgaa

SEQ ID NO: 336217 - DNA, 20 bp, Artificial Sequence
  chemically synthesized
ggataggaaatgcatctctg

SEQ ID NO: 336218 - DNA, 20 bp, Artificial Sequence
  chemically synthesized
tgggcttctttaaatgggat

SEQ ID NO: 336219 - DNA, 20 bp, Artificial Sequence
  chemically synthesized
ttgggcttctttaaatggga

SEQ ID NO: 336220 - DNA, 20 bp, Artificial Sequence
  chemically synthesized
tgcatttcctatcccattta

SEQ ID NO: 336221 - DNA, 20 bp, Artificial Sequence
  chemically synthesized
ggggttgggcttctttaaat

SEQ ID NO: 336222 - DNA, 20 bp, Artificial Sequence
  chemically synthesized
atttcctatcccatttaaag

SEQ ID NO: 336223 - DNA, 20 bp, Artificial Sequence
  chemically synthesized
aggggttgggcttctttaaa

SEQ ID NO: 336224 - DNA, 20 bp, Artificial Sequence
  chemically synthesized
aaaataaagggaaaggggtt

SEQ ID NO: 336225 - DNA, 20 bp, Artificial Sequence
  chemically synthesized
taaaataaagggaaaggggt

SEQ ID NO: 336226 - DNA, 20 bp, Artificial Sequence
  chemically synthesized
aatgtaaaataaagggaaag

SEQ ID NO: 336227 - DNA, 20 bp, Artificial Sequence
  chemically synthesized
caatgtaaaataaagggaaa

SEQ ID NO: 336228 - DNA, 20 bp, Artificial Sequence
  chemically synthesized
tcaatgtaaaataaagggaa

SEQ ID NO: 336229 - DNA, 20 bp, Artificial Sequence
  chemically synthesized
atcaatgtaaaataaaggga

SEQ ID NO: 336230 - DNA, 20 bp, Artificial Sequence
  chemically synthesized
ggaaatcaatgtaaaataaa

SEQ ID NO: 336231 - DNA, 20 bp, Artificial Sequence
  chemically synthesized
aggaaatcaatgtaaaataa

SEQ ID NO: 336232 - DNA, 20 bp, Artificial Sequence
  chemically synthesized
aaggaaatcaatgtaaaata

SEQ ID NO: 336233 - DNA, 20 bp, Artificial Sequence
  chemically synthesized
gtttgtgacaagcaatgtaa

SEQ ID NO: 336234 - DNA, 20 bp, Artificial Sequence
  chemically synthesized
agtttgtgacaagcaatgta

SEQ ID NO: 336235 - DNA, 20 bp, Artificial Sequence
  chemically synthesized
taataatgacagtttgtgac

SEQ ID NO: 336236 - DNA, 20 bp, Artificial Sequence
  chemically synthesized
aaaaataaacataataatga

SEQ ID NO: 336237 - DNA, 20 bp, Artificial Sequence
  chemically synthesized
attatgtttattttttatat

SEQ ID NO: 336238 - DNA, 20 bp, Artificial Sequence
  chemically synthesized
ataagaatataaaaaccaca

SEQ ID NO: 336239 - DNA, 20 bp, Artificial Sequence
  chemically synthesized
taagaatataaaaaccacaa

SEQ ID NO: 336240 - DNA, 20 bp, Artificial Sequence
  chemically synthesized
gaatataaaaaccacaaagg

SEQ ID NO: 336241 - DNA, 20 bp, Artificial Sequence
  chemically synthesized
aatataaaaaccacaaaggc

SEQ ID NO: 336242 - DNA, 20 bp, Artificial Sequence
  chemically synthesized
aaaggaagttcctgcctttg

SEQ ID NO: 336243 - DNA, 20 bp, Artificial Sequence
  chemically synthesized
acaaaggcaggaacttcctt

SEQ ID NO: 336244 - DNA, 20 bp, Artificial Sequence
  chemically synthesized
ttggtaaaacaatctaaagg

SEQ ID NO: 336245 - DNA, 20 bp, Artificial Sequence
  chemically synthesized
tcattggtaaaacaatctaa

SEQ ID NO: 336246 - DNA, 20 bp, Artificial Sequence
  chemically synthesized
gtcattggtaaaacaatcta

SEQ ID NO: 336247 - DNA, 20 bp, Artificial Sequence
  chemically synthesized
agattgttttaccaatgact

SEQ ID NO: 336248 - DNA, 20 bp, Artificial Sequence
  chemically synthesized
acctactacttctcagtcat

SEQ ID NO: 336249 - DNA, 20 bp, Artificial Sequence
  chemically synthesized
ttgttttaccaatgactgag

SEQ ID NO: 336250 - DNA, 20 bp, Artificial Sequence
  chemically synthesized
ttttaccaatgactgagaag

SEQ ID NO: 336251 - DNA, 20 bp, Artificial Sequence
  chemically synthesized
actgagtacctactacttct

SEQ ID NO: 336252 - DNA, 20 bp, Artificial Sequence
  chemically synthesized
taccaatgactgagaagtag

SEQ ID NO: 336253 - DNA, 20 bp, Artificial Sequence
  chemically synthesized
accaatgactgagaagtagt

SEQ ID NO: 336254 - DNA, 20 bp, Artificial Sequence
  chemically synthesized
actgagaagtagtaggtact

SEQ ID NO: 336255 - DNA, 20 bp, Artificial Sequence
  chemically synthesized
ttactgatttaacaaatact

SEQ ID NO: 336256 - DNA, 20 bp, Artificial Sequence
  chemically synthesized
gtactcagtatttgttaaat

SEQ ID NO: 336257 - DNA, 20 bp, Artificial Sequence
  chemically synthesized
ttgttaaatcagtaaatgaa

SEQ ID NO: 336258 - DNA, 20 bp, Artificial Sequence
  chemically synthesized
gttaaatcagtaaatgaatg

SEQ ID NO: 336259 - DNA, 20 bp, Artificial Sequence
  chemically synthesized
taaatcagtaaatgaatgga

SEQ ID NO: 336260 - DNA, 20 bp, Artificial Sequence
  chemically synthesized
aatcagtaaatgaatggaga

SEQ ID NO: 336261 - DNA, 20 bp, Artificial Sequence
  chemically synthesized
tgaatggagagagaaccttt

SEQ ID NO: 336262 - DNA, 20 bp, Artificial Sequence
  chemically synthesized
gaatggagagagaacctttt

SEQ ID NO: 336263 - DNA, 20 bp, Artificial Sequence
  chemically synthesized
aatgaacctttattcccaaa

SEQ ID NO: 336264 - DNA, 20 bp, Artificial Sequence
  chemically synthesized
aaatgaacctttattcccaa

SEQ ID NO: 336265 - DNA, 20 bp, Artificial Sequence
  chemically synthesized
gagagaaccttttgggaata

SEQ ID NO: 336266 - DNA, 20 bp, Artificial Sequence
  chemically synthesized
agagaaccttttgggaataa

SEQ ID NO: 336267 - DNA, 20 bp, Artificial Sequence
  chemically synthesized
ggaataaaggttcattttca

SEQ ID NO: 336268 - DNA, 20 bp, Artificial Sequence
  chemically synthesized
tactctacattcagggggtg

SEQ ID NO: 336269 - DNA, 20 bp, Artificial Sequence
  chemically synthesized
tgtcttactctacattcagg

SEQ ID NO: 336270 - DNA, 20 bp, Artificial Sequence
  chemically synthesized
tggtctacaccccctgaatg

SEQ ID NO: 336271 - DNA, 20 bp, Artificial Sequence
  chemically synthesized
gtgtcttactctacattcag

SEQ ID NO: 336272 - DNA, 20 bp, Artificial Sequence
  chemically synthesized
tgtgtcttactctacattca

SEQ ID NO: 336273 - DNA, 20 bp, Artificial Sequence
  chemically synthesized
gtctacaccccctgaatgta

SEQ ID NO: 336274 - DNA, 20 bp, Artificial Sequence
  chemically synthesized
atgtgtcttactctacattc

SEQ ID NO: 336275 - DNA, 20 bp, Artificial Sequence
  chemically synthesized
catgtgtcttactctacatt

SEQ ID NO: 336276 - DNA, 20 bp, Artificial Sequence
  chemically synthesized
acaccccctgaatgtagagt

SEQ ID NO: 336277 - DNA, 20 bp, Artificial Sequence
  chemically synthesized
taagacacatgttgaaaatt

SEQ ID NO: 336278 - DNA, 20 bp, Artificial Sequence
  chemically synthesized
tgaaaattgagcactgcttg

SEQ ID NO: 336279 - DNA, 20 bp, Artificial Sequence
  chemically synthesized
gaaaattgagcactgcttga

SEQ ID NO: 336280 - DNA, 20 bp, Artificial Sequence
  chemically synthesized
aaaattgagcactgcttgaa

SEQ ID NO: 336281 - DNA, 20 bp, Artificial Sequence
  chemically synthesized
aaattgagcactgcttgaag

SEQ ID NO: 336282 - DNA, 20 bp, Artificial Sequence
  chemically synthesized
gtgctttctgccccttcaag

SEQ ID NO: 336283 - DNA, 20 bp, Artificial Sequence
  chemically synthesized
ttgagcactgcttgaagggg

SEQ ID NO: 336284 - DNA, 20 bp, Artificial Sequence
  chemically synthesized
tatgtgctttctgccccttc

SEQ ID NO: 336285 - DNA, 20 bp, Artificial Sequence
  chemically synthesized
gcactgcttgaaggggcaga

SEQ ID NO: 336286 - DNA, 20 bp, Artificial Sequence
  chemically synthesized
ttgaaggggcagaaagcaca

SEQ ID NO: 336287 - DNA, 20 bp, Artificial Sequence
  chemically synthesized
aggggcagaaagcacatagc

SEQ ID NO: 336288 - DNA, 20 bp, Artificial Sequence
  chemically synthesized
ggggcagaaagcacatagca

SEQ ID NO: 336289 - DNA, 20 bp, Artificial Sequence
  chemically synthesized
agaaagcacatagcaaggaa

SEQ ID NO: 336290 - DNA, 20 bp, Artificial Sequence
  chemically synthesized
gaaagcacatagcaaggaac

SEQ ID NO: 336291 - DNA, 20 bp, Artificial Sequence
  chemically synthesized
aagcacatagcaaggaacag

SEQ ID NO: 336292 - DNA, 20 bp, Artificial Sequence
  chemically synthesized
cacatagcaaggaacaggag

SEQ ID NO: 336293 - DNA, 20 bp, Artificial Sequence
  chemically synthesized
ttttgtagggagaaaaatac

SEQ ID NO: 336294 - DNA, 20 bp, Artificial Sequence
  chemically synthesized
attttgtagggagaaaaata

SEQ ID NO: 336295 - DNA, 20 bp, Artificial Sequence
  chemically synthesized
cttttgcagaattttgtagg

SEQ ID NO: 336296 - DNA, 20 bp, Artificial Sequence
  chemically synthesized
ctcttttgcagaattttgta

SEQ ID NO: 336297 - DNA, 20 bp, Artificial Sequence
  chemically synthesized
tctcttttgcagaattttgt

SEQ ID NO: 336298 - DNA, 20 bp, Artificial Sequence
  chemically synthesized
atctcttttgcagaattttg

SEQ ID NO: 336299 - DNA, 20 bp, Artificial Sequence
  chemically synthesized
ctccctacaaaattctgcaa

SEQ ID NO: 336300 - DNA, 20 bp, Artificial Sequence
  chemically synthesized
ccctacaaaattctgcaaaa

SEQ ID NO: 336301 - DNA, 20 bp, Artificial Sequence
  chemically synthesized
accaaactgaatctcttttg

SEQ ID NO: 336302 - DNA, 20 bp, Artificial Sequence
  chemically synthesized
aaaattctgcaaaagagatt

SEQ ID NO: 336303 - DNA, 20 bp, Artificial Sequence
  chemically synthesized
tctgcaaaagagattcagtt

SEQ ID NO: 336304 - DNA, 20 bp, Artificial Sequence
  chemically synthesized
aaaagagattcagtttggta

SEQ ID NO: 336305 - DNA, 20 bp, Artificial Sequence
  chemically synthesized
gattcagtttggtatagaat

SEQ ID NO: 336306 - DNA, 20 bp, Artificial Sequence
  chemically synthesized
gtatagaattagtttttatc

SEQ ID NO: 336307 - DNA, 20 bp, Artificial Sequence
  chemically synthesized
atcaagtatcaattatatac

SEQ ID NO: 336308 - DNA, 20 bp, Artificial Sequence
  chemically synthesized
atgaaaaaaaaacataataa

SEQ ID NO: 336309 - DNA, 20 bp, Artificial Sequence
  chemically synthesized
attcttaactcacaagagag

SEQ ID NO: 336310 - DNA, 20 bp, Artificial Sequence
  chemically synthesized
taaattcaccactctcttgt

SEQ ID NO: 336311 - DNA, 20 bp, Artificial Sequence
  chemically synthesized
tgtattcttaactcacaaga

SEQ ID NO: 336312 - DNA, 20 bp, Artificial Sequence
  chemically synthesized
gctgtattcttaactcacaa

SEQ ID NO: 336313 - DNA, 20 bp, Artificial Sequence
  chemically synthesized
tcaccactctcttgtgagtt

SEQ ID NO: 336314 - DNA, 20 bp, Artificial Sequence
  chemically synthesized
gggctgtattcttaactcac

SEQ ID NO: 336315 - DNA, 20 bp, Artificial Sequence
  chemically synthesized
tctcttgtgagttaagaata

SEQ ID NO: 336316 - DNA, 20 bp, Artificial Sequence
  chemically synthesized
gtgagttaagaatacagccc

SEQ ID NO: 336317 - DNA, 20 bp, Artificial Sequence
  chemically synthesized
tgagttaagaatacagccca

SEQ ID NO: 336318 - DNA, 20 bp, Artificial Sequence
  chemically synthesized
cttattggttgtatgacctt

SEQ ID NO: 336319 - DNA, 20 bp, Artificial Sequence
  chemically synthesized
acttattggttgtatgacct

SEQ ID NO: 336320 - DNA, 20 bp, Artificial Sequence
  chemically synthesized
cccaaggtcatacaaccaat

SEQ ID NO: 336321 - DNA, 20 bp, Artificial Sequence
  chemically synthesized
ttaatcagactgtcacttat

SEQ ID NO: 336322 - DNA, 20 bp, Artificial Sequence
  chemically synthesized
gtcatacaaccaataagtga

SEQ ID NO: 336323 - DNA, 20 bp, Artificial Sequence
  chemically synthesized
aataagtgacagtctgatta

SEQ ID NO: 336324 - DNA, 20 bp, Artificial Sequence
  chemically synthesized
aagtgacagtctgattaaag

SEQ ID NO: 336325 - DNA, 20 bp, Artificial Sequence
  chemically synthesized
ttttttttttccactttaat

SEQ ID NO: 336326 - DNA, 20 bp, Artificial Sequence
  chemically synthesized
tgattaaagtggaaaaaaaa

SEQ ID NO: 336327 - DNA, 20 bp, Artificial Sequence
  chemically synthesized
ttaaagtggaaaaaaaaaag

SEQ ID NO: 336328 - DNA, 20 bp, Artificial Sequence
  chemically synthesized
aaagtggaaaaaaaaaagta

SEQ ID NO: 336329 - DNA, 20 bp, Artificial Sequence
  chemically synthesized
aaaaaaaaaagtagagtcct

SEQ ID NO: 336330 - DNA, 20 bp, Artificial Sequence
  chemically synthesized
aaaaagtagagtccttggtt

SEQ ID NO: 336331 - DNA, 20 bp, Artificial Sequence
  chemically synthesized
aagaactgggagccaaacca

SEQ ID NO: 336332 - DNA, 20 bp, Artificial Sequence
  chemically synthesized
aaagaactgggagccaaacc

SEQ ID NO: 336333 - DNA, 20 bp, Artificial Sequence
  chemically synthesized
agagtccttggtttggctcc

SEQ ID NO: 336334 - DNA, 20 bp, Artificial Sequence
  chemically synthesized
tcacaaaatgaaagaactgg

SEQ ID NO: 336335 - DNA, 20 bp, Artificial Sequence
  chemically synthesized
ggtcacaaaatgaaagaact

SEQ ID NO: 336336 - DNA, 20 bp, Artificial Sequence
  chemically synthesized
aggtcacaaaatgaaagaac

SEQ ID NO: 336337 - DNA, 20 bp, Artificial Sequence
  chemically synthesized
tatccaaggtcacaaaatga

SEQ ID NO: 336338 - DNA, 20 bp, Artificial Sequence
  chemically synthesized
gttctttcattttgtgacct

SEQ ID NO: 336339 - DNA, 20 bp, Artificial Sequence
  chemically synthesized
tcattttgtgaccttggata

SEQ ID NO: 336340 - DNA, 20 bp, Artificial Sequence
  chemically synthesized
attatgcttaactttatcca

SEQ ID NO: 336341 - DNA, 20 bp, Artificial Sequence
  chemically synthesized
cattatgcttaactttatcc

SEQ ID NO: 336342 - DNA, 20 bp, Artificial Sequence
  chemically synthesized
ttgtgaccttggataaagtt

SEQ ID NO: 336343 - DNA, 20 bp, Artificial Sequence
  chemically synthesized
aagttaagcataatgcacct

SEQ ID NO: 336344 - DNA, 20 bp, Artificial Sequence
  chemically synthesized
tgcaatacaataggaagctg

SEQ ID NO: 336345 - DNA, 20 bp, Artificial Sequence
  chemically synthesized
ttgcaatacaataggaagct

SEQ ID NO: 336346 - DNA, 20 bp, Artificial Sequence
  chemically synthesized
acttcttgcaatacaatagg

SEQ ID NO: 336347 - DNA, 20 bp, Artificial Sequence
  chemically synthesized
aaaacttcttgcaatacaat

SEQ ID NO: 336348 - DNA, 20 bp, Artificial Sequence
  chemically synthesized
aaaaacttcttgcaatacaa

SEQ ID NO: 336349 - DNA, 20 bp, Artificial Sequence
  chemically synthesized
tcagcttcctattgtattgc

SEQ ID NO: 336350 - DNA, 20 bp, Artificial Sequence
  chemically synthesized
gcttcctattgtattgcaag

SEQ ID NO: 336351 - DNA, 20 bp, Artificial Sequence
  chemically synthesized
tttttggaaatgtgatcaat

SEQ ID NO: 336352 - DNA, 20 bp, Artificial Sequence
  chemically synthesized
ttgatcacatttccaaaaat

SEQ ID NO: 336353 - DNA, 20 bp, Artificial Sequence
  chemically synthesized
ttcaaatcaagtcttatttt

SEQ ID NO: 336354 - DNA, 20 bp, Artificial Sequence
  chemically synthesized
caaaaataagacttgatttg

SEQ ID NO: 336355 - DNA, 20 bp, Artificial Sequence
  chemically synthesized
catgagatgttcttcaaatc

SEQ ID NO: 336356 - DNA, 20 bp, Artificial Sequence
  chemically synthesized
ttgaagaacatctcatgctc

SEQ ID NO: 336357 - DNA, 20 bp, Artificial Sequence
  chemically synthesized
tgatacagtttctagagcat

SEQ ID NO: 336358 - DNA, 20 bp, Artificial Sequence
  chemically synthesized
ataatctgatacagtttcta

SEQ ID NO: 336359 - DNA, 20 bp, Artificial Sequence
  chemically synthesized
aaataatctgatacagtttc

SEQ ID NO: 336360 - DNA, 20 bp, Artificial Sequence
  chemically synthesized
tcatgctctagaaactgtat

SEQ ID NO: 336361 - DNA, 20 bp, Artificial Sequence
  chemically synthesized
cacttaaaaataatctgata

SEQ ID NO: 336362 - DNA, 20 bp, Artificial Sequence
  chemically synthesized
aactgtatcagattattttt

SEQ ID NO: 336363 - DNA, 20 bp, Artificial Sequence
  chemically synthesized
atcagattatttttaagtga

SEQ ID NO: 336364 - DNA, 20 bp, Artificial Sequence
  chemically synthesized
tcagattatttttaagtgat

SEQ ID NO: 336365 - DNA, 20 bp, Artificial Sequence
  chemically synthesized
cagattatttttaagtgata

SEQ ID NO: 336366 - DNA, 20 bp, Artificial Sequence
  chemically synthesized
ttatttttaagtgataggga

SEQ ID NO: 336367 - DNA, 20 bp, Artificial Sequence
  chemically synthesized
tttttaagtgatagggaaag

SEQ ID NO: 336368 - DNA, 20 bp, Artificial Sequence
  chemically synthesized
agaagcattaatttccaaat

SEQ ID NO: 336369 - DNA, 20 bp, Artificial Sequence
  chemically synthesized
aagcattaatttccaaatta

SEQ ID NO: 336370 - DNA, 20 bp, Artificial Sequence
  chemically synthesized
gcattaatttccaaattaga

SEQ ID NO: 336371 - DNA, 20 bp, Artificial Sequence
  chemically synthesized
cctgctaatgctctctaatt

SEQ ID NO: 336372 - DNA, 20 bp, Artificial Sequence
  chemically synthesized
atttccaaattagagagcat

SEQ ID NO: 336373 - DNA, 20 bp, Artificial Sequence
  chemically synthesized
tccaaattagagagcattag

SEQ ID NO: 336374 - DNA, 20 bp, Artificial Sequence
  chemically synthesized
ccaaattagagagcattagc

SEQ ID NO: 336375 - DNA, 20 bp, Artificial Sequence
  chemically synthesized
agagcattagcaggttaatc

SEQ ID NO: 336376 - DNA, 20 bp, Artificial Sequence
  chemically synthesized
gcattagcaggttaatcaag

SEQ ID NO: 336377 - DNA, 20 bp, Artificial Sequence
  chemically synthesized
aggttaatcaagaagcctat

SEQ ID NO: 336378 - DNA, 20 bp, Artificial Sequence
  chemically synthesized
actttgtcatcatcactcat

SEQ ID NO: 336379 - DNA, 20 bp, Artificial Sequence
  chemically synthesized
aactttgtcatcatcactca

SEQ ID NO: 336380 - DNA, 20 bp, Artificial Sequence
  chemically synthesized
gcctatgagtgatgatgaca

SEQ ID NO: 336381 - DNA, 20 bp, Artificial Sequence
  chemically synthesized
atgagtgatgatgacaaagt

SEQ ID NO: 336382 - DNA, 20 bp, Artificial Sequence
  chemically synthesized
aagttagtacattttaaatt

SEQ ID NO: 336383 - DNA, 20 bp, Artificial Sequence
  chemically synthesized
aattcagattgaaaatactc

SEQ ID NO: 336384 - DNA, 20 bp, Artificial Sequence
  chemically synthesized
gattgaaaatactcaagaca

SEQ ID NO: 336385 - DNA, 20 bp, Artificial Sequence
  chemically synthesized
attgaaaatactcaagacac

SEQ ID NO: 336386 - DNA, 20 bp, Artificial Sequence
  chemically synthesized
cattagttttcctgtgtctt

SEQ ID NO: 336387 - DNA, 20 bp, Artificial Sequence
  chemically synthesized
tagaacaatgaataaaacat

SEQ ID NO: 336388 - DNA, 20 bp, Artificial Sequence
  chemically synthesized
ttattcattgttctaaactt

SEQ ID NO: 336389 - DNA, 20 bp, Artificial Sequence
  chemically synthesized
gtagtgtgtatgccaaagtt

SEQ ID NO: 336390 - DNA, 20 bp, Artificial Sequence
  chemically synthesized
attttgtagtgtgtatgcca

SEQ ID NO: 336391 - DNA, 20 bp, Artificial Sequence
  chemically synthesized
ttggcatacacactacaaaa

SEQ ID NO: 336392 - DNA, 20 bp, Artificial Sequence
  chemically synthesized
taaagcacggtgctattttg

SEQ ID NO: 336393 - DNA, 20 bp, Artificial Sequence
  chemically synthesized
aaatacgtttttgtaaagca

SEQ ID NO: 336394 - DNA, 20 bp, Artificial Sequence
  chemically synthesized
tttgaaaatacgtttttgta

SEQ ID NO: 336395 - DNA, 20 bp, Artificial Sequence
  chemically synthesized
ataatattgactgatatcta

SEQ ID NO: 336396 - DNA, 20 bp, Artificial Sequence
  chemically synthesized
atttttttttctgtagatat

SEQ ID NO: 336397 - DNA, 20 bp, Artificial Sequence
  chemically synthesized
tgagtacatttttttttctg

SEQ ID NO: 336398 - DNA, 20 bp, Artificial Sequence
  chemically synthesized
acagaaaaaaaaatgtactc

SEQ ID NO: 336399 - DNA, 20 bp, Artificial Sequence
  chemically synthesized
tcctcagtctgagagcactt

SEQ ID NO: 336400 - DNA, 20 bp, Artificial Sequence
  chemically synthesized
aaaatgtactcaagtgctct

SEQ ID NO: 336401 - DNA, 20 bp, Artificial Sequence
  chemically synthesized
tactcaagtgctctcagact

SEQ ID NO: 336402 - DNA, 20 bp, Artificial Sequence
  chemically synthesized
ttttcctatcctcagtctga

SEQ ID NO: 336403 - DNA, 20 bp, Artificial Sequence
  chemically synthesized
actcaagtgctctcagactg

SEQ ID NO: 336404 - DNA, 20 bp, Artificial Sequence
  chemically synthesized
gcttttcctatcctcagtct

SEQ ID NO: 336405 - DNA, 20 bp, Artificial Sequence
  chemically synthesized
aagtgctctcagactgagga

SEQ ID NO: 336406 - DNA, 20 bp, Artificial Sequence
  chemically synthesized
agtgctctcagactgaggat

SEQ ID NO: 336407 - DNA, 20 bp, Artificial Sequence
  chemically synthesized
gagtctgcttttcctatcct

SEQ ID NO: 336408 - DNA, 20 bp, Artificial Sequence
  chemically synthesized
tctcagactgaggataggaa

SEQ ID NO: 336409 - DNA, 20 bp, Artificial Sequence
  chemically synthesized
cagactgaggataggaaaag

SEQ ID NO: 336410 - DNA, 20 bp, Artificial Sequence
  chemically synthesized
gataggaaaagcagactcct

SEQ ID NO: 336411 - DNA, 20 bp, Artificial Sequence
  chemically synthesized
tatgcttccaaagttctaag

SEQ ID NO: 336412 - DNA, 20 bp, Artificial Sequence
  chemically synthesized
gctatgcttccaaagttcta

SEQ ID NO: 336413 - DNA, 20 bp, Artificial Sequence
  chemically synthesized
aagcagactccttagaactt

SEQ ID NO: 336414 - DNA, 20 bp, Artificial Sequence
  chemically synthesized
agctatgcttccaaagttct

SEQ ID NO: 336415 - DNA, 20 bp, Artificial Sequence
  chemically synthesized
cagactccttagaactttgg

SEQ ID NO: 336416 - DNA, 20 bp, Artificial Sequence
  chemically synthesized
ttttggaagctatgcttcca

SEQ ID NO: 336417 - DNA, 20 bp, Artificial Sequence
  chemically synthesized
tccttagaactttggaagca

SEQ ID NO: 336418 - DNA, 20 bp, Artificial Sequence
  chemically synthesized
gcttagcacaaaatttttgg

SEQ ID NO: 336419 - DNA, 20 bp, Artificial Sequence
  chemically synthesized
gacgcttagcacaaaatttt

SEQ ID NO: 336420 - DNA, 20 bp, Artificial Sequence
  chemically synthesized
gcttccaaaaattttgtgct

SEQ ID NO: 336421 - DNA, 20 bp, Artificial Sequence
  chemically synthesized
cccccaggtatgcagacgct

SEQ ID NO: 336422 - DNA, 20 bp, Artificial Sequence
  chemically synthesized
gtgctaagcgtctgcatacc

SEQ ID NO: 336423 - DNA, 20 bp, Artificial Sequence
  chemically synthesized
tgctaagcgtctgcatacct

SEQ ID NO: 336424 - DNA, 20 bp, Artificial Sequence
  chemically synthesized
ctttcaaacccccaggtatg

SEQ ID NO: 336425 - DNA, 20 bp, Artificial Sequence
  chemically synthesized
gctaagcgtctgcatacctg

SEQ ID NO: 336426 - DNA, 20 bp, Artificial Sequence
  chemically synthesized
ctaagcgtctgcatacctgg

SEQ ID NO: 336427 - DNA, 20 bp, Artificial Sequence
  chemically synthesized
cttgaatctttcaaaccccc

SEQ ID NO: 336428 - DNA, 20 bp, Artificial Sequence
  chemically synthesized
acttgaatctttcaaacccc

SEQ ID NO: 336429 - DNA, 20 bp, Artificial Sequence
  chemically synthesized
ctgcatacctgggggtttga

SEQ ID NO: 336430 - DNA, 20 bp, Artificial Sequence
  chemically synthesized
cctgggggtttgaaagattc

SEQ ID NO: 336431 - DNA, 20 bp, Artificial Sequence
  chemically synthesized
atagttttagtgagatgaca

SEQ ID NO: 336432 - DNA, 20 bp, Artificial Sequence
  chemically synthesized
catagttttagtgagatgac

SEQ ID NO: 336433 - DNA, 20 bp, Artificial Sequence
  chemically synthesized
cgctgactcatagttttagt

SEQ ID NO: 336434 - DNA, 20 bp, Artificial Sequence
  chemically synthesized
tgtcatctcactaaaactat

SEQ ID NO: 336435 - DNA, 20 bp, Artificial Sequence
  chemically synthesized
ccaccgctgactcatagttt

SEQ ID NO: 336436 - DNA, 20 bp, Artificial Sequence
  chemically synthesized
atctcactaaaactatgagt

SEQ ID NO: 336437 - DNA, 20 bp, Artificial Sequence
  chemically synthesized
tcctacccaccgctgactca

SEQ ID NO: 336438 - DNA, 20 bp, Artificial Sequence
  chemically synthesized
tcactaaaactatgagtcag

SEQ ID NO: 336439 - DNA, 20 bp, Artificial Sequence
  chemically synthesized
ctaaaactatgagtcagcgg

SEQ ID NO: 336440 - DNA, 20 bp, Artificial Sequence
  chemically synthesized
taaaactatgagtcagcggt

SEQ ID NO: 336441 - DNA, 20 bp, Artificial Sequence
  chemically synthesized
aactatgagtcagcggtggg

SEQ ID NO: 336442 - DNA, 20 bp, Artificial Sequence
  chemically synthesized
actatgagtcagcggtgggt

SEQ ID NO: 336443 - DNA, 20 bp, Artificial Sequence
  chemically synthesized
ttacaattatcattatttgg

SEQ ID NO: 336444 - DNA, 20 bp, Artificial Sequence
  chemically synthesized
tttttacaattatcattatt

SEQ ID NO: 336445 - DNA, 20 bp, Artificial Sequence
  chemically synthesized
aattgtaaaaaatgcttttt

SEQ ID NO: 336446 - DNA, 20 bp, Artificial Sequence
  chemically synthesized
ctcatatatctgagcttaaa

SEQ ID NO: 336447 - DNA, 20 bp, Artificial Sequence
  chemically synthesized
taaaaaatgctttttaagct

SEQ ID NO: 336448 - DNA, 20 bp, Artificial Sequence
  chemically synthesized
aatccctttctcatatatct

SEQ ID NO: 336449 - DNA, 20 bp, Artificial Sequence
  chemically synthesized
ctttttaagctcagatatat

SEQ ID NO: 336450 - DNA, 20 bp, Artificial Sequence
  chemically synthesized
ttaagctcagatatatgaga

SEQ ID NO: 336451 - DNA, 20 bp, Artificial Sequence
  chemically synthesized
taagctcagatatatgagaa

SEQ ID NO: 336452 - DNA, 20 bp, Artificial Sequence
  chemically synthesized
aagctcagatatatgagaaa

SEQ ID NO: 336453 - DNA, 20 bp, Artificial Sequence
  chemically synthesized
tatgagaaagggattcaata

SEQ ID NO: 336454 - DNA, 20 bp, Artificial Sequence
  chemically synthesized
tcaataaagaaacaaaaacc

SEQ ID NO: 336455 - DNA, 20 bp, Artificial Sequence
  chemically synthesized
caataaagaaacaaaaacct

SEQ ID NO: 336456 - DNA, 20 bp, Artificial Sequence
  chemically synthesized
aaagaaacaaaaacctagga

SEQ ID NO: 336457 - DNA, 20 bp, Artificial Sequence
  chemically synthesized
aaatgtgtgtataccatcct

SEQ ID NO: 336458 - DNA, 20 bp, Artificial Sequence
  chemically synthesized
taaatgtgtgtataccatcc

SEQ ID NO: 336459 - DNA, 20 bp, Artificial Sequence
  chemically synthesized
tgcatattatagttatatat

SEQ ID NO: 336460 - DNA, 20 bp, Artificial Sequence
  chemically synthesized
taatgtttgcatgcatatta

SEQ ID NO: 336461 - DNA, 20 bp, Artificial Sequence
  chemically synthesized
gcatgcaaacattacatatt

SEQ ID NO: 336462 - DNA, 20 bp, Artificial Sequence
  chemically synthesized
gcaaacattacatatttgga

SEQ ID NO: 336463 - DNA, 20 bp, Artificial Sequence
  chemically synthesized
tgctaatatctagtcaaagg

SEQ ID NO: 336464 - DNA, 20 bp, Artificial Sequence
  chemically synthesized
ggaaagcaactccctttgac

SEQ ID NO: 336465 - DNA, 20 bp, Artificial Sequence
  chemically synthesized
gttgctaatatctagtcaaa

SEQ ID NO: 336466 - DNA, 20 bp, Artificial Sequence
  chemically synthesized
agttgctaatatctagtcaa

SEQ ID NO: 336467 - DNA, 20 bp, Artificial Sequence
  chemically synthesized
aagttgctaatatctagtca

SEQ ID NO: 336468 - DNA, 20 bp, Artificial Sequence
  chemically synthesized
aactccctttgactagatat

SEQ ID NO: 336469 - DNA, 20 bp, Artificial Sequence
  chemically synthesized
tctttgaagttgctaatatc

SEQ ID NO: 336470 - DNA, 20 bp, Artificial Sequence
  chemically synthesized
actagatattagcaacttca

SEQ ID NO: 336471 - DNA, 20 bp, Artificial Sequence
  chemically synthesized
ttttctctatttagtctttg

SEQ ID NO: 336472 - DNA, 20 bp, Artificial Sequence
  chemically synthesized
tagcaacttcaaagactaaa

SEQ ID NO: 336473 - DNA, 20 bp, Artificial Sequence
  chemically synthesized
gcaacttcaaagactaaata

SEQ ID NO: 336474 - DNA, 20 bp, Artificial Sequence
  chemically synthesized
agcctttccttttctctatt

SEQ ID NO: 336475 - DNA, 20 bp, Artificial Sequence
  chemically synthesized
ttcaaagactaaatagagaa

SEQ ID NO: 336476 - DNA, 20 bp, Artificial Sequence
  chemically synthesized
tcaaagactaaatagagaaa

SEQ ID NO: 336477 - DNA, 20 bp, Artificial Sequence
  chemically synthesized
agactaaatagagaaaagga

SEQ ID NO: 336478 - DNA, 20 bp, Artificial Sequence
  chemically synthesized
gactaaatagagaaaaggaa

SEQ ID NO: 336479 - DNA, 20 bp, Artificial Sequence
  chemically synthesized
agaaaaggaaaggctttgcg

SEQ ID NO: 336480 - DNA, 20 bp, Artificial Sequence
  chemically synthesized
tagcagtaagattctacgca

SEQ ID NO: 336481 - DNA, 20 bp, Artificial Sequence
  chemically synthesized
tcagtaattaaaatagcagt

SEQ ID NO: 336482 - DNA, 20 bp, Artificial Sequence
  chemically synthesized
acattcagtaattaaaatag

SEQ ID NO: 336483 - DNA, 20 bp, Artificial Sequence
  chemically synthesized
ggaacattcagtaattaaaa

SEQ ID NO: 336484 - DNA, 20 bp, Artificial Sequence
  chemically synthesized
aaatggacaaaaggaacatt

SEQ ID NO: 336485 - DNA, 20 bp, Artificial Sequence
  chemically synthesized
taaaattgcaaatggacaaa

SEQ ID NO: 336486 - DNA, 20 bp, Artificial Sequence
  chemically synthesized
ttaaaattgcaaatggacaa

SEQ ID NO: 336487 - DNA, 20 bp, Artificial Sequence
  chemically synthesized
agaaattttaaaattgcaaa

SEQ ID NO: 336488 - DNA, 20 bp, Artificial Sequence
  chemically synthesized
agccactgagaaaaggaaag

SEQ ID NO: 336489 - DNA, 20 bp, Artificial Sequence
  chemically synthesized
tccagccactgagaaaagga

SEQ ID NO: 336490 - DNA, 20 bp, Artificial Sequence
  chemically synthesized
aatttcttctttccttttct

SEQ ID NO: 336491 - DNA, 20 bp, Artificial Sequence
  chemically synthesized
ctcatccagccactgagaaa

SEQ ID NO: 336492 - DNA, 20 bp, Artificial Sequence
  chemically synthesized
ttcttctttccttttctcag

SEQ ID NO: 336493 - DNA, 20 bp, Artificial Sequence
  chemically synthesized
cctcatccagccactgagaa

SEQ ID NO: 336494 - DNA, 20 bp, Artificial Sequence
  chemically synthesized
tctttccttttctcagtggc

SEQ ID NO: 336495 - DNA, 20 bp, Artificial Sequence
  chemically synthesized
ttaaccctcatccagccact

SEQ ID NO: 336496 - DNA, 20 bp, Artificial Sequence
  chemically synthesized
ccttttctcagtggctggat

SEQ ID NO: 336497 - DNA, 20 bp, Artificial Sequence
  chemically synthesized
cttttctcagtggctggatg

SEQ ID NO: 336498 - DNA, 20 bp, Artificial Sequence
  chemically synthesized
ttttctcagtggctggatga

SEQ ID NO: 336499 - DNA, 20 bp, Artificial Sequence
  chemically synthesized
tatcagttttaaccctcatc

SEQ ID NO: 336500 - DNA, 20 bp, Artificial Sequence
  chemically synthesized
ttatgtggtatttagcatat

SEQ ID NO: 336501 - DNA, 20 bp, Artificial Sequence
  chemically synthesized
aaaatgggttatgtggtatt

SEQ ID NO: 336502 - DNA, 20 bp, Artificial Sequence
  chemically synthesized
taccaagaaaatgggttatg

SEQ ID NO: 336503 - DNA, 20 bp, Artificial Sequence
  chemically synthesized
taccacataacccattttct

SEQ ID NO: 336504 - DNA, 20 bp, Artificial Sequence
  chemically synthesized
ggaagctataccaagaaaat

SEQ ID NO: 336505 - DNA, 20 bp, Artificial Sequence
  chemically synthesized
tggaagctataccaagaaaa

SEQ ID NO: 336506 - DNA, 20 bp, Artificial Sequence
  chemically synthesized
cataacccattttcttggta

SEQ ID NO: 336507 - DNA, 20 bp, Artificial Sequence
  chemically synthesized
gaagaactggaagctatacc

SEQ ID NO: 336508 - DNA, 20 bp, Artificial Sequence
  chemically synthesized
cattttcttggtatagcttc

SEQ ID NO: 336509 - DNA, 20 bp, Artificial Sequence
  chemically synthesized
tcagagtcaagaagaactgg

SEQ ID NO: 336510 - DNA, 20 bp, Artificial Sequence
  chemically synthesized
atttcagagtcaagaagaac

SEQ ID NO: 336511 - DNA, 20 bp, Artificial Sequence
  chemically synthesized
gccgacatttcagagtcaag

SEQ ID NO: 336512 - DNA, 20 bp, Artificial Sequence
  chemically synthesized
gaggccgacatttcagagtc

SEQ ID NO: 336513 - DNA, 20 bp, Artificial Sequence
  chemically synthesized
tgagagaggccgacatttca

SEQ ID NO: 336514 - DNA, 20 bp, Artificial Sequence
  chemically synthesized
tcttcttgactctgaaatgt

SEQ ID NO: 336515 - DNA, 20 bp, Artificial Sequence
  chemically synthesized
tttgagagaggccgacattt

SEQ ID NO: 336516 - DNA, 20 bp, Artificial Sequence
  chemically synthesized
gagggagaggtatttgagag

SEQ ID NO: 336517 - DNA, 20 bp, Artificial Sequence
  chemically synthesized
tgagggagaggtatttgaga

SEQ ID NO: 336518 - DNA, 20 bp, Artificial Sequence
  chemically synthesized
cctgagggagaggtatttga

SEQ ID NO: 336519 - DNA, 20 bp, Artificial Sequence
  chemically synthesized
tacctgagggagaggtattt

SEQ ID NO: 336520 - DNA, 20 bp, Artificial Sequence
  chemically synthesized
tctctcaaatacctctccct

SEQ ID NO: 336521 - DNA, 20 bp, Artificial Sequence
  chemically synthesized
ctctcaaatacctctccctc

SEQ ID NO: 336522 - DNA, 20 bp, Artificial Sequence
  chemically synthesized
tagagctctacctgagggag

SEQ ID NO: 336523 - DNA, 20 bp, Artificial Sequence
  chemically synthesized
gtagagctctacctgaggga

SEQ ID NO: 336524 - DNA, 20 bp, Artificial Sequence
  chemically synthesized
tcaaatacctctccctcagg

SEQ ID NO: 336525 - DNA, 20 bp, Artificial Sequence
  chemically synthesized
tagtagagctctacctgagg

SEQ ID NO: 336526 - DNA, 20 bp, Artificial Sequence
  chemically synthesized
aaatacctctccctcaggta

SEQ ID NO: 336527 - DNA, 20 bp, Artificial Sequence
  chemically synthesized
gctagtagagctctacctga

SEQ ID NO: 336528 - DNA, 20 bp, Artificial Sequence
  chemically synthesized
tgctagtagagctctacctg

SEQ ID NO: 336529 - DNA, 20 bp, Artificial Sequence
  chemically synthesized
ctgctagtagagctctacct

SEQ ID NO: 336530 - DNA, 20 bp, Artificial Sequence
  chemically synthesized
tccctcaggtagagctctac

SEQ ID NO: 336531 - DNA, 20 bp, Artificial Sequence
  chemically synthesized
ctcaggtagagctctactag

SEQ ID NO: 336532 - DNA, 20 bp, Artificial Sequence
  chemically synthesized
tcaggtagagctctactagc

SEQ ID NO: 336533 - DNA, 20 bp, Artificial Sequence
  chemically synthesized
aagacaggcccctgctagta

SEQ ID NO: 336534 - DNA, 20 bp, Artificial Sequence
  chemically synthesized
caggtagagctctactagca

SEQ ID NO: 336535 - DNA, 20 bp, Artificial Sequence
  chemically synthesized
aggtagagctctactagcag

SEQ ID NO: 336536 - DNA, 20 bp, Artificial Sequence
  chemically synthesized
gaaagacaggcccctgctag

SEQ ID NO: 336537 - DNA, 20 bp, Artificial Sequence
  chemically synthesized
caggaaagacaggcccctgc

SEQ ID NO: 336538 - DNA, 20 bp, Artificial Sequence
  chemically synthesized
ttctggtcatcaggaaagac

SEQ ID NO: 336539 - DNA, 20 bp, Artificial Sequence
  chemically synthesized
tttctggtcatcaggaaaga

SEQ ID NO: 336540 - DNA, 20 bp, Artificial Sequence
  chemically synthesized
tgggtttctggtcatcagga

SEQ ID NO: 336541 - DNA, 20 bp, Artificial Sequence
  chemically synthesized
ggcctgtctttcctgatgac

SEQ ID NO: 336542 - DNA, 20 bp, Artificial Sequence
  chemically synthesized
cccctgggtttctggtcatc

SEQ ID NO: 336543 - DNA, 20 bp, Artificial Sequence
  chemically synthesized
gcccctgggtttctggtcat

SEQ ID NO: 336544 - DNA, 20 bp, Artificial Sequence
  chemically synthesized
tttcctgatgaccagaaacc

SEQ ID NO: 336545 - DNA, 20 bp, Artificial Sequence
  chemically synthesized
ttcctgatgaccagaaaccc

SEQ ID NO: 336546 - DNA, 20 bp, Artificial Sequence
  chemically synthesized
ataccaagcccctgggtttc

SEQ ID NO: 336547 - DNA, 20 bp, Artificial Sequence
  chemically synthesized
tcctgatgaccagaaaccca

SEQ ID NO: 336548 - DNA, 20 bp, Artificial Sequence
  chemically synthesized
cctgatgaccagaaacccag

SEQ ID NO: 336549 - DNA, 20 bp, Artificial Sequence
  chemically synthesized
tgaccagaaacccaggggct

SEQ ID NO: 336550 - DNA, 20 bp, Artificial Sequence
  chemically synthesized
gatagttataccaagcccct

SEQ ID NO: 336551 - DNA, 20 bp, Artificial Sequence
  chemically synthesized
agatagttataccaagcccc

SEQ ID NO: 336552 - DNA, 20 bp, Artificial Sequence
  chemically synthesized
gtaattgagatagttatacc

SEQ ID NO: 336553 - DNA, 20 bp, Artificial Sequence
  chemically synthesized
ataggatatagtaattgaga

SEQ ID NO: 336554 - DNA, 20 bp, Artificial Sequence
  chemically synthesized
ctccataggatatagtaatt

SEQ ID NO: 336555 - DNA, 20 bp, Artificial Sequence
  chemically synthesized
atctcaattactatatccta

SEQ ID NO: 336556 - DNA, 20 bp, Artificial Sequence
  chemically synthesized
gagtcaggctccataggata

SEQ ID NO: 336557 - DNA, 20 bp, Artificial Sequence
  chemically synthesized
ctcaattactatatcctatg

SEQ ID NO: 336558 - DNA, 20 bp, Artificial Sequence
  chemically synthesized
gataaggagtcaggctccat

SEQ ID NO: 336559 - DNA, 20 bp, Artificial Sequence
  chemically synthesized
tgataaggagtcaggctcca

SEQ ID NO: 336560 - DNA, 20 bp, Artificial Sequence
  chemically synthesized
tggagctatgataaggagtc

SEQ ID NO: 336561 - DNA, 20 bp, Artificial Sequence
  chemically synthesized
ctggagctatgataaggagt

SEQ ID NO: 336562 - DNA, 20 bp, Artificial Sequence
  chemically synthesized
tggagcctgactccttatca

SEQ ID NO: 336563 - DNA, 20 bp, Artificial Sequence
  chemically synthesized
gggactggagctatgataag

SEQ ID NO: 336564 - DNA, 20 bp, Artificial Sequence
  chemically synthesized
tggggactggagctatgata

SEQ ID NO: 336565 - DNA, 20 bp, Artificial Sequence
  chemically synthesized
atggggactggagctatgat

SEQ ID NO: 336566 - DNA, 20 bp, Artificial Sequence
  chemically synthesized
ctgactccttatcatagctc

SEQ ID NO: 336567 - DNA, 20 bp, Artificial Sequence
  chemically synthesized
cagagcccatatggggactg

SEQ ID NO: 336568 - DNA, 20 bp, Artificial Sequence
  chemically synthesized
atcagagcccatatggggac

SEQ ID NO: 336569 - DNA, 20 bp, Artificial Sequence
  chemically synthesized
tcatagctccagtccccata

SEQ ID NO: 336570 - DNA, 20 bp, Artificial Sequence
  chemically synthesized
catagctccagtccccatat

SEQ ID NO: 336571 - DNA, 20 bp, Artificial Sequence
  chemically synthesized
ccaagatcagagcccatatg

SEQ ID NO: 336572 - DNA, 20 bp, Artificial Sequence
  chemically synthesized
tccaagatcagagcccatat

SEQ ID NO: 336573 - DNA, 20 bp, Artificial Sequence
  chemically synthesized
atccaagatcagagcccata

SEQ ID NO: 336574 - DNA, 20 bp, Artificial Sequence
  chemically synthesized
ccccatatgggctctgatct

SEQ ID NO: 336575 - DNA, 20 bp, Artificial Sequence
  chemically synthesized
atctggtcaatccaagatca

SEQ ID NO: 336576 - DNA, 20 bp, Artificial Sequence
  chemically synthesized
ccatctggtcaatccaagat

SEQ ID NO: 336577 - DNA, 20 bp, Artificial Sequence
  chemically synthesized
atgacccatctggtcaatcc

SEQ ID NO: 336578 - DNA, 20 bp, Artificial Sequence
  chemically synthesized
ggctctgatcttggattgac

SEQ ID NO: 336579 - DNA, 20 bp, Artificial Sequence
  chemically synthesized
ctgatcttggattgaccaga

SEQ ID NO: 336580 - DNA, 20 bp, Artificial Sequence
  chemically synthesized
tgatcttggattgaccagat

SEQ ID NO: 336581 - DNA, 20 bp, Artificial Sequence
  chemically synthesized
aagagtggaaatgacccatc

SEQ ID NO: 336582 - DNA, 20 bp, Artificial Sequence
  chemically synthesized
cgttcccattgagataagag

SEQ ID NO: 336583 - DNA, 20 bp, Artificial Sequence
  chemically synthesized
gcacgttcccattgagataa

SEQ ID NO: 336584 - DNA, 20 bp, Artificial Sequence
  chemically synthesized
catttccactcttatctcaa

SEQ ID NO: 336585 - DNA, 20 bp, Artificial Sequence
  chemically synthesized
gggcacgttcccattgagat

SEQ ID NO: 336586 - DNA, 20 bp, Artificial Sequence
  chemically synthesized
atttccactcttatctcaat

SEQ ID NO: 336587 - DNA, 20 bp, Artificial Sequence
  chemically synthesized
tcaaggggcacgttcccatt

SEQ ID NO: 336588 - DNA, 20 bp, Artificial Sequence
  chemically synthesized
atgggaacgtgccccttgat

SEQ ID NO: 336589 - DNA, 20 bp, Artificial Sequence
  chemically synthesized
tgggaacgtgccccttgatt

SEQ ID NO: 336590 - DNA, 20 bp, Artificial Sequence
  chemically synthesized
ggaaagctttcctaatcaag

SEQ ID NO: 336591 - DNA, 20 bp, Artificial Sequence
  chemically synthesized
gggaaagctttcctaatcaa

SEQ ID NO: 336592 - DNA, 20 bp, Artificial Sequence
  chemically synthesized
agggaaagctttcctaatca

SEQ ID NO: 336593 - DNA, 20 bp, Artificial Sequence
  chemically synthesized
gagggaaagctttcctaatc

SEQ ID NO: 336594 - DNA, 20 bp, Artificial Sequence
  chemically synthesized
aacgtgccccttgattagga

SEQ ID NO: 336595 - DNA, 20 bp, Artificial Sequence
  chemically synthesized
tgattaggaaagctttccct

SEQ ID NO: 336596 - DNA, 20 bp, Artificial Sequence
  chemically synthesized
attaggaaagctttccctca

SEQ ID NO: 336597 - DNA, 20 bp, Artificial Sequence
  chemically synthesized
gatgtgttttctctgaggga

SEQ ID NO: 336598 - DNA, 20 bp, Artificial Sequence
  chemically synthesized
atgggatgtgttttctctga

SEQ ID NO: 336599 - DNA, 20 bp, Artificial Sequence
  chemically synthesized
aatgggatgtgttttctctg

SEQ ID NO: 336600 - DNA, 20 bp, Artificial Sequence
  chemically synthesized
caatgggatgtgttttctct

SEQ ID NO: 336601 - DNA, 20 bp, Artificial Sequence
  chemically synthesized
gagaaaacacatcccattga

SEQ ID NO: 336602 - DNA, 20 bp, Artificial Sequence
  chemically synthesized
ttggggccaaaaccgtcaat

SEQ ID NO: 336603 - DNA, 20 bp, Artificial Sequence
  chemically synthesized
cttggggccaaaaccgtcaa

SEQ ID NO: 336604 - DNA, 20 bp, Artificial Sequence
  chemically synthesized
acacatcccattgacggttt

SEQ ID NO: 336605 - DNA, 20 bp, Artificial Sequence
  chemically synthesized
ccattgacggttttggcccc

SEQ ID NO: 336606 - DNA, 20 bp, Artificial Sequence
  chemically synthesized
attgacggttttggccccaa

SEQ ID NO: 336607 - DNA, 20 bp, Artificial Sequence
  chemically synthesized
aactaacggttgaactcttg

SEQ ID NO: 336608 - DNA, 20 bp, Artificial Sequence
  chemically synthesized
caactaacggttgaactctt

SEQ ID NO: 336609 - DNA, 20 bp, Artificial Sequence
  chemically synthesized
acaactaacggttgaactct

SEQ ID NO: 336610 - DNA, 20 bp, Artificial Sequence
  chemically synthesized
ggccccaagagttcaaccgt

SEQ ID NO: 336611 - DNA, 20 bp, Artificial Sequence
  chemically synthesized
aaaatatcaaagacaactaa

SEQ ID NO: 336612 - DNA, 20 bp, Artificial Sequence
  chemically synthesized
cttatgaaattaaaatatca

SEQ ID NO: 336613 - DNA, 20 bp, Artificial Sequence
  chemically synthesized
ctttgatattttaatttcat

SEQ ID NO: 336614 - DNA, 20 bp, Artificial Sequence
  chemically synthesized
atattttaatttcataagtc

SEQ ID NO: 336615 - DNA, 20 bp, Artificial Sequence
  chemically synthesized
taaaagtgagagattaaatc

SEQ ID NO: 336616 - DNA, 20 bp, Artificial Sequence
  chemically synthesized
aataaaatgtttaaaagtga

SEQ ID NO: 336617 - DNA, 20 bp, Artificial Sequence
  chemically synthesized
gtaataaaatgtttaaaagt

SEQ ID NO: 336618 - DNA, 20 bp, Artificial Sequence
  chemically synthesized
ttttgtaataaaatgtttaa

SEQ ID NO: 336619 - DNA, 20 bp, Artificial Sequence
  chemically synthesized
ttttaaacattttattacaa

SEQ ID NO: 336620 - DNA, 20 bp, Artificial Sequence
  chemically synthesized
tccactacaataagcatgta

SEQ ID NO: 336621 - DNA, 20 bp, Artificial Sequence
  chemically synthesized
aaagccatacatgcttattg

SEQ ID NO: 336622 - DNA, 20 bp, Artificial Sequence
  chemically synthesized
gccatacatgcttattgtag

SEQ ID NO: 336623 - DNA, 20 bp, Artificial Sequence
  chemically synthesized
ttttagttttccactacaat

SEQ ID NO: 336624 - DNA, 20 bp, Artificial Sequence
  chemically synthesized
attgtagtggaaaactaaaa

SEQ ID NO: 336625 - DNA, 20 bp, Artificial Sequence
  chemically synthesized
taaatgcgtctgtactgttt

SEQ ID NO: 336626 - DNA, 20 bp, Artificial Sequence
  chemically synthesized
agtggaaaactaaaacagta

SEQ ID NO: 336627 - DNA, 20 bp, Artificial Sequence
  chemically synthesized
aaacagtacagacgcattta

SEQ ID NO: 336628 - DNA, 20 bp, Artificial Sequence
  chemically synthesized
acagacgcatttaaagttaa

SEQ ID NO: 336629 - DNA, 20 bp, Artificial Sequence
  chemically synthesized
gcatttaaagttaatagtga

SEQ ID NO: 336630 - DNA, 20 bp, Artificial Sequence
  chemically synthesized
tgtggtgctgtagagatatg

SEQ ID NO: 336631 - DNA, 20 bp, Artificial Sequence
  chemically synthesized
ctgtggtgctgtagagatat

SEQ ID NO: 336632 - DNA, 20 bp, Artificial Sequence
  chemically synthesized
actgtggtgctgtagagata

SEQ ID NO: 336633 - DNA, 20 bp, Artificial Sequence
  chemically synthesized
gaaagtaccccatatctcta

SEQ ID NO: 336634 - DNA, 20 bp, Artificial Sequence
  chemically synthesized
aatgggactgtggtgctgta

SEQ ID NO: 336635 - DNA, 20 bp, Artificial Sequence
  chemically synthesized
ctaatgggactgtggtgctg

SEQ ID NO: 336636 - DNA, 20 bp, Artificial Sequence
  chemically synthesized
cccatatctctacagcacca

SEQ ID NO: 336637 - DNA, 20 bp, Artificial Sequence
  chemically synthesized
acttctagctaatgggactg

SEQ ID NO: 336638 - DNA, 20 bp, Artificial Sequence
  chemically synthesized
ctacagcaccacagtcccat

SEQ ID NO: 336639 - DNA, 20 bp, Artificial Sequence
  chemically synthesized
agcaccacagtcccattagc

SEQ ID NO: 336640 - DNA, 20 bp, Artificial Sequence
  chemically synthesized
aagtattacttctagctaat

SEQ ID NO: 336641 - DNA, 20 bp, Artificial Sequence
  chemically synthesized
caagtattacttctagctaa

SEQ ID NO: 336642 - DNA, 20 bp, Artificial Sequence
  chemically synthesized
accacagtcccattagctag

SEQ ID NO: 336643 - DNA, 20 bp, Artificial Sequence
  chemically synthesized
ctggtgacaagtattacttc

SEQ ID NO: 336644 - DNA, 20 bp, Artificial Sequence
  chemically synthesized
ctagaagtaatacttgtcac

SEQ ID NO: 336645 - DNA, 20 bp, Artificial Sequence
  chemically synthesized
atgacatagcatctggtgac

SEQ ID NO: 336646 - DNA, 20 bp, Artificial Sequence
  chemically synthesized
tgtatggatgacatagcatc

SEQ ID NO: 336647 - DNA, 20 bp, Artificial Sequence
  chemically synthesized
gcatggatgtatggatgaca

SEQ ID NO: 336648 - DNA, 20 bp, Artificial Sequence
  chemically synthesized
tggatagatgcatggatgta

SEQ ID NO: 336649 - DNA, 20 bp, Artificial Sequence
  chemically synthesized
tggctgaatggatagatgca

SEQ ID NO: 336650 - DNA, 20 bp, Artificial Sequence
  chemically synthesized
catccatgcatctatccatt

SEQ ID NO: 336651 - DNA, 20 bp, Artificial Sequence
  chemically synthesized
taaaagaatggctgaatgga

SEQ ID NO: 336652 - DNA, 20 bp, Artificial Sequence
  chemically synthesized
tagctaaaagaatggctgaa

SEQ ID NO: 336653 - DNA, 20 bp, Artificial Sequence
  chemically synthesized
tatccattcagccattcttt

SEQ ID NO: 336654 - DNA, 20 bp, Artificial Sequence
  chemically synthesized
taaatggatagctaaaagaa

SEQ ID NO: 336655 - DNA, 20 bp, Artificial Sequence
  chemically synthesized
tatgataaatggatagctaa

SEQ ID NO: 336656 - DNA, 20 bp, Artificial Sequence
  chemically synthesized
agatgagtatgataaatgga

SEQ ID NO: 336657 - DNA, 20 bp, Artificial Sequence
  chemically synthesized
aggcagatgagtatgataaa

SEQ ID NO: 336658 - DNA, 20 bp, Artificial Sequence
  chemically synthesized
atctcattagacaggcagat

SEQ ID NO: 336659 - DNA, 20 bp, Artificial Sequence
  chemically synthesized
gtttaatctcattagacagg

SEQ ID NO: 336660 - DNA, 20 bp, Artificial Sequence
  chemically synthesized
tactcatctgcctgtctaat

SEQ ID NO: 336661 - DNA, 20 bp, Artificial Sequence
  chemically synthesized
tatgtttaatctcattagac

SEQ ID NO: 336662 - DNA, 20 bp, Artificial Sequence
  chemically synthesized
atatgtttaatctcattaga

SEQ ID NO: 336663 - DNA, 20 bp, Artificial Sequence
  chemically synthesized
gtgtatatgtttaatctcat

SEQ ID NO: 336664 - DNA, 20 bp, Artificial Sequence
  chemically synthesized
taagaaagtacatgcataga

SEQ ID NO: 336665 - DNA, 20 bp, Artificial Sequence
  chemically synthesized
atcttaagaaagtacatgca

SEQ ID NO: 336666 - DNA, 20 bp, Artificial Sequence
  chemically synthesized
gtctatgcatgtactttctt

SEQ ID NO: 336667 - DNA, 20 bp, Artificial Sequence
  chemically synthesized
taattgagcacatcttaaga

SEQ ID NO: 336668 - DNA, 20 bp, Artificial Sequence
  chemically synthesized
ttactaattgagcacatctt

SEQ ID NO: 336669 - DNA, 20 bp, Artificial Sequence
  chemically synthesized
tttcttaagatgtgctcaat

SEQ ID NO: 336670 - DNA, 20 bp, Artificial Sequence
  chemically synthesized
attttgaatctttactaatt

SEQ ID NO: 336671 - DNA, 20 bp, Artificial Sequence
  chemically synthesized
taagatgtgctcaattagta

SEQ ID NO: 336672 - DNA, 20 bp, Artificial Sequence
  chemically synthesized
attagtaaagattcaaaatt

SEQ ID NO: 336673 - DNA, 20 bp, Artificial Sequence
  chemically synthesized
cataataccagtgagtggta

SEQ ID NO: 336674 - DNA, 20 bp, Artificial Sequence
  chemically synthesized
aatttagctttaccactcac

SEQ ID NO: 336675 - DNA, 20 bp, Artificial Sequence
  chemically synthesized
aaattcataataccagtgag

SEQ ID NO: 336676 - DNA, 20 bp, Artificial Sequence
  chemically synthesized
tccaaattcataataccagt

SEQ ID NO: 336677 - DNA, 20 bp, Artificial Sequence
  chemically synthesized
cttatccaaattcataatac

SEQ ID NO: 336678 - DNA, 20 bp, Artificial Sequence
  chemically synthesized
actcactggtattatgaatt

SEQ ID NO: 336679 - DNA, 20 bp, Artificial Sequence
  chemically synthesized
ctggtattatgaatttggat

SEQ ID NO: 336680 - DNA, 20 bp, Artificial Sequence
  chemically synthesized
tatgaagaaatgaagaaatt

SEQ ID NO: 336681 - DNA, 20 bp, Artificial Sequence
  chemically synthesized
aatgagggtatgaagaaatg

SEQ ID NO: 336682 - DNA, 20 bp, Artificial Sequence
  chemically synthesized
attttaccaatgagggtatg

SEQ ID NO: 336683 - DNA, 20 bp, Artificial Sequence
  chemically synthesized
tcatttcttcataccctcat

SEQ ID NO: 336684 - DNA, 20 bp, Artificial Sequence
  chemically synthesized
ttgcctcattttaccaatga

SEQ ID NO: 336685 - DNA, 20 bp, Artificial Sequence
  chemically synthesized
tttgcctcattttaccaatg

SEQ ID NO: 336686 - DNA, 20 bp, Artificial Sequence
  chemically synthesized
ctttgcctcattttaccaat

SEQ ID NO: 336687 - DNA, 20 bp, Artificial Sequence
  chemically synthesized
cataccctcattggtaaaat

SEQ ID NO: 336688 - DNA, 20 bp, Artificial Sequence
  chemically synthesized
ataccctcattggtaaaatg

SEQ ID NO: 336689 - DNA, 20 bp, Artificial Sequence
  chemically synthesized
ctcattggtaaaatgaggca

SEQ ID NO: 336690 - DNA, 20 bp, Artificial Sequence
  chemically synthesized
aatgaggcaaagacttttcc

SEQ ID NO: 336691 - DNA, 20 bp, Artificial Sequence
  chemically synthesized
gaggcaaagacttttccaag

SEQ ID NO: 336692 - DNA, 20 bp, Artificial Sequence
  chemically synthesized
ttgcacttaccttcttggaa

SEQ ID NO: 336693 - DNA, 20 bp, Artificial Sequence
  chemically synthesized
aggcaaagacttttccaaga

SEQ ID NO: 336694 - DNA, 20 bp, Artificial Sequence
  chemically synthesized
aaagacttttccaagaaggt

SEQ ID NO: 336695 - DNA, 20 bp, Artificial Sequence
  chemically synthesized
cttacttgcacttaccttct

SEQ ID NO: 336696 - DNA, 20 bp, Artificial Sequence
  chemically synthesized
ttttccaagaaggtaagtgc

SEQ ID NO: 336697 - DNA, 20 bp, Artificial Sequence
  chemically synthesized
ccaagaaggtaagtgcaagt

SEQ ID NO: 336698 - DNA, 20 bp, Artificial Sequence
  chemically synthesized
caagaaggtaagtgcaagta

SEQ ID NO: 336699 - DNA, 20 bp, Artificial Sequence
  chemically synthesized
gtaagtgcaagtaaggcatt

SEQ ID NO: 336700 - DNA, 20 bp, Artificial Sequence
  chemically synthesized
aagtgcaagtaaggcattta

SEQ ID NO: 336701 - DNA, 20 bp, Artificial Sequence
  chemically synthesized
aaggcatttagagcaatgcc

SEQ ID NO: 336702 - DNA, 20 bp, Artificial Sequence
  chemically synthesized
ttagagcaatgcctggcata

SEQ ID NO: 336703 - DNA, 20 bp, Artificial Sequence
  chemically synthesized
ctgaaaacatactttatgcc

SEQ ID NO: 336704 - DNA, 20 bp, Artificial Sequence
  chemically synthesized
gctgaaaacatactttatgc

SEQ ID NO: 336705 - DNA, 20 bp, Artificial Sequence
  chemically synthesized
cctggcataaagtatgtttt

SEQ ID NO: 336706 - DNA, 20 bp, Artificial Sequence
  chemically synthesized
gtatgttttcagcaaatttc

SEQ ID NO: 336707 - DNA, 20 bp, Artificial Sequence
  chemically synthesized
cattactgaaattaattttg

SEQ ID NO: 336708 - DNA, 20 bp, Artificial Sequence
  chemically synthesized
gtgaacttcaaaattaattt

SEQ ID NO: 336709 - DNA, 20 bp, Artificial Sequence
  chemically synthesized
atagttacagaataaataaa

SEQ ID NO: 336710 - DNA, 20 bp, Artificial Sequence
  chemically synthesized
aagtgtccaataaatagtta

SEQ ID NO: 336711 - DNA, 20 bp, Artificial Sequence
  chemically synthesized
tttattctgtaactatttat

SEQ ID NO: 336712 - DNA, 20 bp, Artificial Sequence
  chemically synthesized
tatggcaagtgtccaataaa

SEQ ID NO: 336713 - DNA, 20 bp, Artificial Sequence
  chemically synthesized
atttattggacacttgccat

SEQ ID NO: 336714 - DNA, 20 bp, Artificial Sequence
  chemically synthesized
cataatcctcgacttatggc

SEQ ID NO: 336715 - DNA, 20 bp, Artificial Sequence
  chemically synthesized
ttggacacttgccataagtc

SEQ ID NO: 336716 - DNA, 20 bp, Artificial Sequence
  chemically synthesized
tggacacttgccataagtcg

SEQ ID NO: 336717 - DNA, 20 bp, Artificial Sequence
  chemically synthesized
ccagcataatcctcgactta

SEQ ID NO: 336718 - DNA, 20 bp, Artificial Sequence
  chemically synthesized
ccataagtcgaggattatgc

SEQ ID NO: 336719 - DNA, 20 bp, Artificial Sequence
  chemically synthesized
gaggattatgctggacactg

SEQ ID NO: 336720 - DNA, 20 bp, Artificial Sequence
  chemically synthesized
actatttcagctgcagtgtc

SEQ ID NO: 336721 - DNA, 20 bp, Artificial Sequence
  chemically synthesized
tttgctcactatttcagctg

SEQ ID NO: 336722 - DNA, 20 bp, Artificial Sequence
  chemically synthesized
gctggacactgcagctgaaa

SEQ ID NO: 336723 - DNA, 20 bp, Artificial Sequence
  chemically synthesized
gacactgcagctgaaatagt

SEQ ID NO: 336724 - DNA, 20 bp, Artificial Sequence
  chemically synthesized
tttatttttgctcactattt

SEQ ID NO: 336725 - DNA, 20 bp, Artificial Sequence
  chemically synthesized
aaaacaaacacaaacaaacc

SEQ ID NO: 336726 - DNA, 20 bp, Artificial Sequence
  chemically synthesized
gcaccataaaatcagggtct

SEQ ID NO: 336727 - DNA, 20 bp, Artificial Sequence
  chemically synthesized
ggcaccataaaatcagggtc

SEQ ID NO: 336728 - DNA, 20 bp, Artificial Sequence
  chemically synthesized
ctataggcaccataaaatca

SEQ ID NO: 336729 - DNA, 20 bp, Artificial Sequence
  chemically synthesized
aaacctagaccctgatttta

SEQ ID NO: 336730 - DNA, 20 bp, Artificial Sequence
  chemically synthesized
actataggcaccataaaatc

SEQ ID NO: 336731 - DNA, 20 bp, Artificial Sequence
  chemically synthesized
gactataggcaccataaaat

SEQ ID NO: 336732 - DNA, 20 bp, Artificial Sequence
  chemically synthesized
ccctgattttatggtgccta

SEQ ID NO: 336733 - DNA, 20 bp, Artificial Sequence
  chemically synthesized
tatctctaccattggactat

SEQ ID NO: 336734 - DNA, 20 bp, Artificial Sequence
  chemically synthesized
atatctctaccattggacta

SEQ ID NO: 336735 - DNA, 20 bp, Artificial Sequence
  chemically synthesized
ttatggtgcctatagtccaa

SEQ ID NO: 336736 - DNA, 20 bp, Artificial Sequence
  chemically synthesized
tggtgcctatagtccaatgg

SEQ ID NO: 336737 - DNA, 20 bp, Artificial Sequence
  chemically synthesized
gtgcctatagtccaatggta

SEQ ID NO: 336738 - DNA, 20 bp, Artificial Sequence
  chemically synthesized
ggcagatatatctctaccat

SEQ ID NO: 336739 - DNA, 20 bp, Artificial Sequence
  chemically synthesized
gtagagatatatctgcctaa

SEQ ID NO: 336740 - DNA, 20 bp, Artificial Sequence
  chemically synthesized
tcatgctatggactgttagg

SEQ ID NO: 336741 - DNA, 20 bp, Artificial Sequence
  chemically synthesized
ttttcatgctatggactgtt

SEQ ID NO: 336742 - DNA, 20 bp, Artificial Sequence
  chemically synthesized
tttttcatgctatggactgt

SEQ ID NO: 336743 - DNA, 20 bp, Artificial Sequence
  chemically synthesized
tatatctgcctaacagtcca

SEQ ID NO: 336744 - DNA, 20 bp, Artificial Sequence
  chemically synthesized
ctccagtatttttcatgcta

SEQ ID NO: 336745 - DNA, 20 bp, Artificial Sequence
  chemically synthesized
gtccatagcatgaaaaatac

SEQ ID NO: 336746 - DNA, 20 bp, Artificial Sequence
  chemically synthesized
ccatagcatgaaaaatactg

SEQ ID NO: 336747 - DNA, 20 bp, Artificial Sequence
  chemically synthesized
agcgttgtacacagtagctc

SEQ ID NO: 336748 - DNA, 20 bp, Artificial Sequence
  chemically synthesized
cattgcagcgttgtacacag

SEQ ID NO: 336749 - DNA, 20 bp, Artificial Sequence
  chemically synthesized
gttcattgcagcgttgtaca

SEQ ID NO: 336750 - DNA, 20 bp, Artificial Sequence
  chemically synthesized
atgtgtaaggatgttcattg

SEQ ID NO: 336751 - DNA, 20 bp, Artificial Sequence
  chemically synthesized
atatctacgacaaatgtgta

SEQ ID NO: 336752 - DNA, 20 bp, Artificial Sequence
  chemically synthesized
catatctacgacaaatgtgt

SEQ ID NO: 336753 - DNA, 20 bp, Artificial Sequence
  chemically synthesized
acatccttacacatttgtcg

SEQ ID NO: 336754 - DNA, 20 bp, Artificial Sequence
  chemically synthesized
catttgtcgtagatatgtat

SEQ ID NO: 336755 - DNA, 20 bp, Artificial Sequence
  chemically synthesized
acatttaagaattagatata

SEQ ID NO: 336756 - DNA, 20 bp, Artificial Sequence
  chemically synthesized
gaggtttcacatttaagaat

SEQ ID NO: 336757 - DNA, 20 bp, Artificial Sequence
  chemically synthesized
gatcctgaggtttcacattt

SEQ ID NO: 336758 - DNA, 20 bp, Artificial Sequence
  chemically synthesized
aattcttaaatgtgaaacct

SEQ ID NO: 336759 - DNA, 20 bp, Artificial Sequence
  chemically synthesized
attcttaaatgtgaaacctc

SEQ ID NO: 336760 - DNA, 20 bp, Artificial Sequence
  chemically synthesized
tttacatatatttgatcctg

SEQ ID NO: 336761 - DNA, 20 bp, Artificial Sequence
  chemically synthesized
ttttacatatatttgatcct

SEQ ID NO: 336762 - DNA, 20 bp, Artificial Sequence
  chemically synthesized
tgtaaaattacatattttga

SEQ ID NO: 336763 - DNA, 20 bp, Artificial Sequence
  chemically synthesized
aatattttaatcagacaatt

SEQ ID NO: 336764 - DNA, 20 bp, Artificial Sequence
  chemically synthesized
acaacttgtaatattttaat

SEQ ID NO: 336765 - DNA, 20 bp, Artificial Sequence
  chemically synthesized
ttgtctgattaaaatattac

SEQ ID NO: 336766 - DNA, 20 bp, Artificial Sequence
  chemically synthesized
acaagttgtgtttcctccaa

SEQ ID NO: 336767 - DNA, 20 bp, Artificial Sequence
  chemically synthesized
aggccctgtgtttcttttgg

SEQ ID NO: 336768 - DNA, 20 bp, Artificial Sequence
  chemically synthesized
taggccctgtgtttcttttg

SEQ ID NO: 336769 - DNA, 20 bp, Artificial Sequence
  chemically synthesized
aataggccctgtgtttcttt

SEQ ID NO: 336770 - DNA, 20 bp, Artificial Sequence
  chemically synthesized
tgtttcctccaaaagaaaca

SEQ ID NO: 336771 - DNA, 20 bp, Artificial Sequence
  chemically synthesized
gtttcctccaaaagaaacac

SEQ ID NO: 336772 - DNA, 20 bp, Artificial Sequence
  chemically synthesized
tttcctccaaaagaaacaca

SEQ ID NO: 336773 - DNA, 20 bp, Artificial Sequence
  chemically synthesized
ttatgagggttcatgtaaat

SEQ ID NO: 336774 - DNA, 20 bp, Artificial Sequence
  chemically synthesized
attatgagggttcatgtaaa

SEQ ID NO: 336775 - DNA, 20 bp, Artificial Sequence
  chemically synthesized
tttacatgaaccctcataat

SEQ ID NO: 336776 - DNA, 20 bp, Artificial Sequence
  chemically synthesized
caaatatcttcttattatga

SEQ ID NO: 336777 - DNA, 20 bp, Artificial Sequence
  chemically synthesized
acaaatatcttcttattatg

SEQ ID NO: 336778 - DNA, 20 bp, Artificial Sequence
  chemically synthesized
tacaaatatcttcttattat

SEQ ID NO: 336779 - DNA, 20 bp, Artificial Sequence
  chemically synthesized
acatgaaccctcataataag

SEQ ID NO: 336780 - DNA, 20 bp, Artificial Sequence
  chemically synthesized
ttaactaataaataaatgca

SEQ ID NO: 336781 - DNA, 20 bp, Artificial Sequence
  chemically synthesized
tgtactatgcatttatttat

SEQ ID NO: 336782 - DNA, 20 bp, Artificial Sequence
  chemically synthesized
tatgcatttatttattagtt

SEQ ID NO: 336783 - DNA, 20 bp, Artificial Sequence
  chemically synthesized
tagcccatcaaaataaaatt

SEQ ID NO: 336784 - DNA, 20 bp, Artificial Sequence
  chemically synthesized
taagcttaattttattttga

SEQ ID NO: 336785 - DNA, 20 bp, Artificial Sequence
  chemically synthesized
aagcttaattttattttgat

SEQ ID NO: 336786 - DNA, 20 bp, Artificial Sequence
  chemically synthesized
tcacttgggaaaattagaaa

SEQ ID NO: 336787 - DNA, 20 bp, Artificial Sequence
  chemically synthesized
ggacattcacttgggaaaat

SEQ ID NO: 336788 - DNA, 20 bp, Artificial Sequence
  chemically synthesized
gggctatttctaattttccc

SEQ ID NO: 336789 - DNA, 20 bp, Artificial Sequence
  chemically synthesized
tatggtcaggacattcactt

SEQ ID NO: 336790 - DNA, 20 bp, Artificial Sequence
  chemically synthesized
ttatggtcaggacattcact

SEQ ID NO: 336791 - DNA, 20 bp, Artificial Sequence
  chemically synthesized
agtggctacatattatggtc

SEQ ID NO: 336792 - DNA, 20 bp, Artificial Sequence
  chemically synthesized
aagtggctacatattatggt

SEQ ID NO: 336793 - DNA, 20 bp, Artificial Sequence
  chemically synthesized
aatgtcctgaccataatatg

SEQ ID NO: 336794 - DNA, 20 bp, Artificial Sequence
  chemically synthesized
ttaaaagtggctacatatta

SEQ ID NO: 336795 - DNA, 20 bp, Artificial Sequence
  chemically synthesized
aaagtataatattttaaaag

SEQ ID NO: 336796 - DNA, 20 bp, Artificial Sequence
  chemically synthesized
tacaaagtataatattttaa

SEQ ID NO: 336797 - DNA, 20 bp, Artificial Sequence
  chemically synthesized
actcctacaatgaatataca

SEQ ID NO: 336798 - DNA, 20 bp, Artificial Sequence
  chemically synthesized
tatactttgtatattcattg

SEQ ID NO: 336799 - DNA, 20 bp, Artificial Sequence
  chemically synthesized
atactttgtatattcattgt

SEQ ID NO: 336800 - DNA, 20 bp, Artificial Sequence
  chemically synthesized
actttgtatattcattgtag

SEQ ID NO: 336801 - DNA, 20 bp, Artificial Sequence
  chemically synthesized
tgtaggagtgttatcatact

SEQ ID NO: 336802 - DNA, 20 bp, Artificial Sequence
  chemically synthesized
gtaggagtgttatcatactg

SEQ ID NO: 336803 - DNA, 20 bp, Artificial Sequence
  chemically synthesized
taataaaaaatcaataacct

SEQ ID NO: 336804 - DNA, 20 bp, Artificial Sequence
  chemically synthesized
ggttattgattttttattac

SEQ ID NO: 336805 - DNA, 20 bp, Artificial Sequence
  chemically synthesized
gatggactgcagaatgacac

SEQ ID NO: 336806 - DNA, 20 bp, Artificial Sequence
  chemically synthesized
ttattactagtgtcattctg

SEQ ID NO: 336807 - DNA, 20 bp, Artificial Sequence
  chemically synthesized
ataaaacctatgatggactg

SEQ ID NO: 336808 - DNA, 20 bp, Artificial Sequence
  chemically synthesized
tgtcattctgcagtccatca

SEQ ID NO: 336809 - DNA, 20 bp, Artificial Sequence
  chemically synthesized
gtcattctgcagtccatcat

SEQ ID NO: 336810 - DNA, 20 bp, Artificial Sequence
  chemically synthesized
aacagtaataaaacctatga

SEQ ID NO: 336811 - DNA, 20 bp, Artificial Sequence
  chemically synthesized
taggttttattactgtttaa

SEQ ID NO: 336812 - DNA, 20 bp, Artificial Sequence
  chemically synthesized
cattgtgaaagaccattaaa

SEQ ID NO: 336813 - DNA, 20 bp, Artificial Sequence
  chemically synthesized
tgtttaatggtctttcacaa

SEQ ID NO: 336814 - DNA, 20 bp, Artificial Sequence
  chemically synthesized
taaaatattttccattgtga

SEQ ID NO: 336815 - DNA, 20 bp, Artificial Sequence
  chemically synthesized
aaaatattttaattttgtgt

SEQ ID NO: 336816 - DNA, 20 bp, Artificial Sequence
  chemically synthesized
ttttgtgttggtaaatttgt

SEQ ID NO: 336817 - DNA, 20 bp, Artificial Sequence
  chemically synthesized
gtaaatttgtcggtatttta

SEQ ID NO: 336818 - DNA, 20 bp, Artificial Sequence
  chemically synthesized
tgtcggtattttacagcctc

SEQ ID NO: 336819 - DNA, 20 bp, Artificial Sequence
  chemically synthesized
gtcggtattttacagcctct

SEQ ID NO: 336820 - DNA, 20 bp, Artificial Sequence
  chemically synthesized
taaggtgatataaaacctag

SEQ ID NO: 336821 - DNA, 20 bp, Artificial Sequence
  chemically synthesized
ttaaggtgatataaaaccta

SEQ ID NO: 336822 - DNA, 20 bp, Artificial Sequence
  chemically synthesized
tattaaggtgatataaaacc

SEQ ID NO: 336823 - DNA, 20 bp, Artificial Sequence
  chemically synthesized
agaatattacaataatatta

SEQ ID NO: 336824 - DNA, 20 bp, Artificial Sequence
  chemically synthesized
aagaatattacaataatatt

SEQ ID NO: 336825 - DNA, 20 bp, Artificial Sequence
  chemically synthesized
aatactttattacaatgtag

SEQ ID NO: 336826 - DNA, 20 bp, Artificial Sequence
  chemically synthesized
ttaaatactttattacaatg

SEQ ID NO: 336827 - DNA, 20 bp, Artificial Sequence
  chemically synthesized
tattcttctacattgtaata

SEQ ID NO: 336828 - DNA, 20 bp, Artificial Sequence
  chemically synthesized
cacattcaatcattatctga

SEQ ID NO: 336829 - DNA, 20 bp, Artificial Sequence
  chemically synthesized
acaaatactaagataacttt

SEQ ID NO: 336830 - DNA, 20 bp, Artificial Sequence
  chemically synthesized
tcattatctgaaagttatct

SEQ ID NO: 336831 - DNA, 20 bp, Artificial Sequence
  chemically synthesized
cccaaggcacaacaaatact

SEQ ID NO: 336832 - DNA, 20 bp, Artificial Sequence
  chemically synthesized
tcttagtatttgttgtgcct

SEQ ID NO: 336833 - DNA, 20 bp, Artificial Sequence
  chemically synthesized
cttagtatttgttgtgcctt

SEQ ID NO: 336834 - DNA, 20 bp, Artificial Sequence
  chemically synthesized
ccttcaactgtggaaaccca

SEQ ID NO: 336835 - DNA, 20 bp, Artificial Sequence
  chemically synthesized
gccttcaactgtggaaaccc

SEQ ID NO: 336836 - DNA, 20 bp, Artificial Sequence
  chemically synthesized
tgttgtgccttgggtttcca

SEQ ID NO: 336837 - DNA, 20 bp, Artificial Sequence
  chemically synthesized
gccttgggtttccacagttg

SEQ ID NO: 336838 - DNA, 20 bp, Artificial Sequence
  chemically synthesized
ccttgggtttccacagttga

SEQ ID NO: 336839 - DNA, 20 bp, Artificial Sequence
  chemically synthesized
gctaataaagccttcaactg

SEQ ID NO: 336840 - DNA, 20 bp, Artificial Sequence
  chemically synthesized
tccacagttgaaggctttat

SEQ ID NO: 336841 - DNA, 20 bp, Artificial Sequence
  chemically synthesized
atagaataggttagctaata

SEQ ID NO: 336842 - DNA, 20 bp, Artificial Sequence
  chemically synthesized
tctctagagatagaataggt

SEQ ID NO: 336843 - DNA, 20 bp, Artificial Sequence
  chemically synthesized
catgtctctagagatagaat

SEQ ID NO: 336844 - DNA, 20 bp, Artificial Sequence
  chemically synthesized
tcatgtctctagagatagaa

SEQ ID NO: 336845 - DNA, 20 bp, Artificial Sequence
  chemically synthesized
tagctaacctattctatctc

SEQ ID NO: 336846 - DNA, 20 bp, Artificial Sequence
  chemically synthesized
gctaacctattctatctcta

SEQ ID NO: 336847 - DNA, 20 bp, Artificial Sequence
  chemically synthesized
acatttcatgtctctagaga

SEQ ID NO: 336848 - DNA, 20 bp, Artificial Sequence
  chemically synthesized
ggtgacatttcatgtctcta

SEQ ID NO: 336849 - DNA, 20 bp, Artificial Sequence
  chemically synthesized
agggtgacatttcatgtctc

SEQ ID NO: 336850 - DNA, 20 bp, Artificial Sequence
  chemically synthesized
gtaaatttagtacacaatta

SEQ ID NO: 336851 - DNA, 20 bp, Artificial Sequence
  chemically synthesized
ggtaaatttagtacacaatt

SEQ ID NO: 336852 - DNA, 20 bp, Artificial Sequence
  chemically synthesized
aggtaaatttagtacacaat

SEQ ID NO: 336853 - DNA, 20 bp, Artificial Sequence
  chemically synthesized
cccttttatttaggtaaatt

SEQ ID NO: 336854 - DNA, 20 bp, Artificial Sequence
  chemically synthesized
tactaaatttacctaaataa

SEQ ID NO: 336855 - DNA, 20 bp, Artificial Sequence
  chemically synthesized
actaaatttacctaaataaa

SEQ ID NO: 336856 - DNA, 20 bp, Artificial Sequence
  chemically synthesized
gacaacattcccttttattt

SEQ ID NO: 336857 - DNA, 20 bp, Artificial Sequence
  chemically synthesized
ctaaatttacctaaataaaa

SEQ ID NO: 336858 - DNA, 20 bp, Artificial Sequence
  chemically synthesized
tgacaacattcccttttatt

SEQ ID NO: 336859 - DNA, 20 bp, Artificial Sequence
  chemically synthesized
aataatttaatggtgtggaa

SEQ ID NO: 336860 - DNA, 20 bp, Artificial Sequence
  chemically synthesized
agagaaataatttaatggtg

SEQ ID NO: 336861 - DNA, 20 bp, Artificial Sequence
  chemically synthesized
atgatagagaaataatttaa

SEQ ID NO: 336862 - DNA, 20 bp, Artificial Sequence
  chemically synthesized
taacatagtatgacatgata

SEQ ID NO: 336863 - DNA, 20 bp, Artificial Sequence
  chemically synthesized
cttaacatagtatgacatga

SEQ ID NO: 336864 - DNA, 20 bp, Artificial Sequence
  chemically synthesized
ctatcatgtcatactatgtt

SEQ ID NO: 336865 - DNA, 20 bp, Artificial Sequence
  chemically synthesized
attttataacatacttaaca

SEQ ID NO: 336866 - DNA, 20 bp, Artificial Sequence
  chemically synthesized
gtatgttataaaatctacta

SEQ ID NO: 336867 - DNA, 20 bp, Artificial Sequence
  chemically synthesized
aaacaggtgatttgctttag

SEQ ID NO: 336868 - DNA, 20 bp, Artificial Sequence
  chemically synthesized
ttcaaacaggtgatttgctt

SEQ ID NO: 336869 - DNA, 20 bp, Artificial Sequence
  chemically synthesized
ttaagaaattattttcaaac

SEQ ID NO: 336870 - DNA, 20 bp, Artificial Sequence
  chemically synthesized
gttaagaaattattttcaaa

SEQ ID NO: 336871 - DNA, 20 bp, Artificial Sequence
  chemically synthesized
gtaaatgcgtgagtacagtt

SEQ ID NO: 336872 - DNA, 20 bp, Artificial Sequence
  chemically synthesized
taaatgtaaatgcgtgagta

SEQ ID NO: 336873 - DNA, 20 bp, Artificial Sequence
  chemically synthesized
ttgtttaaatgtaaatgcgt

SEQ ID NO: 336874 - DNA, 20 bp, Artificial Sequence
  chemically synthesized
atttacatttaaacaaattt

SEQ ID NO: 336875 - DNA, 20 bp, Artificial Sequence
  chemically synthesized
aaacaaattttagaattatc

SEQ ID NO: 336876 - DNA, 20 bp, Artificial Sequence
  chemically synthesized
gtaagagggattcagttttc

SEQ ID NO: 336877 - DNA, 20 bp, Artificial Sequence
  chemically synthesized
catgaatggtaagagggatt

SEQ ID NO: 336878 - DNA, 20 bp, Artificial Sequence
  chemically synthesized
aaatcacatgaatggtaaga

SEQ ID NO: 336879 - DNA, 20 bp, Artificial Sequence
  chemically synthesized
taaatcacatgaatggtaag

SEQ ID NO: 336880 - DNA, 20 bp, Artificial Sequence
  chemically synthesized
ataaatcacatgaatggtaa

SEQ ID NO: 336881 - DNA, 20 bp, Artificial Sequence
  chemically synthesized
acataaatcacatgaatggt

SEQ ID NO: 336882 - DNA, 20 bp, Artificial Sequence
  chemically synthesized
ctgaacataaatcacatgaa

SEQ ID NO: 336883 - DNA, 20 bp, Artificial Sequence
  chemically synthesized
ccattcatgtgatttatgtt

SEQ ID NO: 336884 - DNA, 20 bp, Artificial Sequence
  chemically synthesized
agggtgtttatgttcagggt

SEQ ID NO: 336885 - DNA, 20 bp, Artificial Sequence
  chemically synthesized
agaaagggtgtttatgttca

SEQ ID NO: 336886 - DNA, 20 bp, Artificial Sequence
  chemically synthesized
aagaaagggtgtttatgttc

SEQ ID NO: 336887 - DNA, 20 bp, Artificial Sequence
  chemically synthesized
gaagaaagggtgtttatgtt

SEQ ID NO: 336888 - DNA, 20 bp, Artificial Sequence
  chemically synthesized
gagaataagcagagaagaaa

SEQ ID NO: 336889 - DNA, 20 bp, Artificial Sequence
  chemically synthesized
agagaataagcagagaagaa

SEQ ID NO: 336890 - DNA, 20 bp, Artificial Sequence
  chemically synthesized
tagagaataagcagagaaga

SEQ ID NO: 336891 - DNA, 20 bp, Artificial Sequence
  chemically synthesized
cacttagagaataagcagag

SEQ ID NO: 336892 - DNA, 20 bp, Artificial Sequence
  chemically synthesized
agccacttagagaataagca

SEQ ID NO: 336893 - DNA, 20 bp, Artificial Sequence
  chemically synthesized
tcagccacttagagaataag

SEQ ID NO: 336894 - DNA, 20 bp, Artificial Sequence
  chemically synthesized
ttcttctctgcttattctct

SEQ ID NO: 336895 - DNA, 20 bp, Artificial Sequence
  chemically synthesized
gggtcagccacttagagaat

SEQ ID NO: 336896 - DNA, 20 bp, Artificial Sequence
  chemically synthesized
ttctctgcttattctctaag

SEQ ID NO: 336897 - DNA, 20 bp, Artificial Sequence
  chemically synthesized
gtgaaagggtcagccactta

SEQ ID NO: 336898 - DNA, 20 bp, Artificial Sequence
  chemically synthesized
gtgtgaaagggtcagccact

SEQ ID NO: 336899 - DNA, 20 bp, Artificial Sequence
  chemically synthesized
gagatacagtgtgaaagggt

SEQ ID NO: 336900 - DNA, 20 bp, Artificial Sequence
  chemically synthesized
acaggagatacagtgtgaaa

SEQ ID NO: 336901 - DNA, 20 bp, Artificial Sequence
  chemically synthesized
cacaggagatacagtgtgaa

SEQ ID NO: 336902 - DNA, 20 bp, Artificial Sequence
  chemically synthesized
tcacaggagatacagtgtga

SEQ ID NO: 336903 - DNA, 20 bp, Artificial Sequence
  chemically synthesized
gctaatgatcacaggagata

SEQ ID NO: 336904 - DNA, 20 bp, Artificial Sequence
  chemically synthesized
tagccagctaatgatcacag

SEQ ID NO: 336905 - DNA, 20 bp, Artificial Sequence
  chemically synthesized
tctagccagctaatgatcac

SEQ ID NO: 336906 - DNA, 20 bp, Artificial Sequence
  chemically synthesized
actgtatctcctgtgatcat

SEQ ID NO: 336907 - DNA, 20 bp, Artificial Sequence
  chemically synthesized
atctagccagctaatgatca

SEQ ID NO: 336908 - DNA, 20 bp, Artificial Sequence
  chemically synthesized
tatctcctgtgatcattagc

SEQ ID NO: 336909 - DNA, 20 bp, Artificial Sequence
  chemically synthesized
tcctgtgatcattagctggc

SEQ ID NO: 336910 - DNA, 20 bp, Artificial Sequence
  chemically synthesized
taatgcaactggaatctagc

SEQ ID NO: 336911 - DNA, 20 bp, Artificial Sequence
  chemically synthesized
atcattagctggctagattc

SEQ ID NO: 336912 - DNA, 20 bp, Artificial Sequence
  chemically synthesized
agcttaatgcaactggaatc

SEQ ID NO: 336913 - DNA, 20 bp, Artificial Sequence
  chemically synthesized
tcccaccagcttaatgcaac

SEQ ID NO: 336914 - DNA, 20 bp, Artificial Sequence
  chemically synthesized
ggctagattccagttgcatt

SEQ ID NO: 336915 - DNA, 20 bp, Artificial Sequence
  chemically synthesized
agattccagttgcattaagc

SEQ ID NO: 336916 - DNA, 20 bp, Artificial Sequence
  chemically synthesized
ttccagttgcattaagctgg

SEQ ID NO: 336917 - DNA, 20 bp, Artificial Sequence
  chemically synthesized
tccagttgcattaagctggt

SEQ ID NO: 336918 - DNA, 20 bp, Artificial Sequence
  chemically synthesized
agttgcattaagctggtggg

SEQ ID NO: 336919 - DNA, 20 bp, Artificial Sequence
  chemically synthesized
ctccagctggtacttcccac

SEQ ID NO: 336920 - DNA, 20 bp, Artificial Sequence
  chemically synthesized
attaagctggtgggaagtac

SEQ ID NO: 336921 - DNA, 20 bp, Artificial Sequence
  chemically synthesized
agctggtgggaagtaccagc

SEQ ID NO: 336922 - DNA, 20 bp, Artificial Sequence
  chemically synthesized
ctggtgggaagtaccagctg

SEQ ID NO: 336923 - DNA, 20 bp, Artificial Sequence
  chemically synthesized
ctcttctttcaatctccagc

SEQ ID NO: 336924 - DNA, 20 bp, Artificial Sequence
  chemically synthesized
ttccctcttctttcaatctc

SEQ ID NO: 336925 - DNA, 20 bp, Artificial Sequence
  chemically synthesized
aagtaccagctggagattga

SEQ ID NO: 336926 - DNA, 20 bp, Artificial Sequence
  chemically synthesized
taccagctggagattgaaag

SEQ ID NO: 336927 - DNA, 20 bp, Artificial Sequence
  chemically synthesized
ccagctggagattgaaagaa

SEQ ID NO: 336928 - DNA, 20 bp, Artificial Sequence
  chemically synthesized
cagctggagattgaaagaag

SEQ ID NO: 336929 - DNA, 20 bp, Artificial Sequence
  chemically synthesized
agctggagattgaaagaaga

SEQ ID NO: 336930 - DNA, 20 bp, Artificial Sequence
  chemically synthesized
ggagattgaaagaagaggga

SEQ ID NO: 336931 - DNA, 20 bp, Artificial Sequence
  chemically synthesized
agattgaaagaagagggaaa

SEQ ID NO: 336932 - DNA, 20 bp, Artificial Sequence
  chemically synthesized
tgaaagaagagggaaagaga

SEQ ID NO: 336933 - DNA, 20 bp, Artificial Sequence
  chemically synthesized
agaagagggaaagagaaagc

SEQ ID NO: 336934 - DNA, 20 bp, Artificial Sequence
  chemically synthesized
gaagagggaaagagaaagct

SEQ ID NO: 336935 - DNA, 20 bp, Artificial Sequence
  chemically synthesized
aagagggaaagagaaagctg

SEQ ID NO: 336936 - DNA, 20 bp, Artificial Sequence
  chemically synthesized
aaataatagagaaatttccc

SEQ ID NO: 336937 - DNA, 20 bp, Artificial Sequence
  chemically synthesized
tctggagcagggaaataata

SEQ ID NO: 336938 - DNA, 20 bp, Artificial Sequence
  chemically synthesized
gctctggagcagggaaataa

SEQ ID NO: 336939 - DNA, 20 bp, Artificial Sequence
  chemically synthesized
tctctattatttccctgctc

SEQ ID NO: 336940 - DNA, 20 bp, Artificial Sequence
  chemically synthesized
tctattatttccctgctcca

SEQ ID NO: 336941 - DNA, 20 bp, Artificial Sequence
  chemically synthesized
cattatgcagctctggagca

SEQ ID NO: 336942 - DNA, 20 bp, Artificial Sequence
  chemically synthesized
acattatgcagctctggagc

SEQ ID NO: 336943 - DNA, 20 bp, Artificial Sequence
  chemically synthesized
tacattatgcagctctggag

SEQ ID NO: 336944 - DNA, 20 bp, Artificial Sequence
  chemically synthesized
tactacattatgcagctctg

SEQ ID NO: 336945 - DNA, 20 bp, Artificial Sequence
  chemically synthesized
gatactacattatgcagctc

SEQ ID NO: 336946 - DNA, 20 bp, Artificial Sequence
  chemically synthesized
tgctccagagctgcataatg

SEQ ID NO: 336947 - DNA, 20 bp, Artificial Sequence
  chemically synthesized
aactcagatactacattatg

SEQ ID NO: 336948 - DNA, 20 bp, Artificial Sequence
  chemically synthesized
agctgcataatgtagtatct

SEQ ID NO: 336949 - DNA, 20 bp, Artificial Sequence
  chemically synthesized
atgtagttgttggtagaact

SEQ ID NO: 336950 - DNA, 20 bp, Artificial Sequence
  chemically synthesized
ggagggaatgtagttgttgg

SEQ ID NO: 336951 - DNA, 20 bp, Artificial Sequence
  chemically synthesized
aatggagggaatgtagttgt

SEQ ID NO: 336952 - DNA, 20 bp, Artificial Sequence
  chemically synthesized
ctgcaccaatggagggaatg

SEQ ID NO: 336953 - DNA, 20 bp, Artificial Sequence
  chemically synthesized
aacaactacattccctccat

SEQ ID NO: 336954 - DNA, 20 bp, Artificial Sequence
  chemically synthesized
gtgaaagctgcaccaatgga

SEQ ID NO: 336955 - DNA, 20 bp, Artificial Sequence
  chemically synthesized
agtgaaagctgcaccaatgg

SEQ ID NO: 336956 - DNA, 20 bp, Artificial Sequence
  chemically synthesized
cagtgaaagctgcaccaatg

SEQ ID NO: 336957 - DNA, 20 bp, Artificial Sequence
  chemically synthesized
ctacattccctccattggtg

SEQ ID NO: 336958 - DNA, 20 bp, Artificial Sequence
  chemically synthesized
ttcagtgaaagctgcaccaa

SEQ ID NO: 336959 - DNA, 20 bp, Artificial Sequence
  chemically synthesized
gggggaacggagttcagtga

SEQ ID NO: 336960 - DNA, 20 bp, Artificial Sequence
  chemically synthesized
aggaaagggggaacggagtt

SEQ ID NO: 336961 - DNA, 20 bp, Artificial Sequence
  chemically synthesized
ctgaaaggaaagggggaacg

SEQ ID NO: 336962 - DNA, 20 bp, Artificial Sequence
  chemically synthesized
agctgaaaggaaagggggaa

SEQ ID NO: 336963 - DNA, 20 bp, Artificial Sequence
  chemically synthesized
atagtagctgaaaggaaagg

SEQ ID NO: 336964 - DNA, 20 bp, Artificial Sequence
  chemically synthesized
tatagtagctgaaaggaaag

SEQ ID NO: 336965 - DNA, 20 bp, Artificial Sequence
  chemically synthesized
atatagtagctgaaaggaaa

SEQ ID NO: 336966 - DNA, 20 bp, Artificial Sequence
  chemically synthesized
ctccgttccccctttccttt

SEQ ID NO: 336967 - DNA, 20 bp, Artificial Sequence
  chemically synthesized
tatatagtagctgaaaggaa

SEQ ID NO: 336968 - DNA, 20 bp, Artificial Sequence
  chemically synthesized
ctatatagtagctgaaagga

SEQ ID NO: 336969 - DNA, 20 bp, Artificial Sequence
  chemically synthesized
cctactatatagtagctgaa

SEQ ID NO: 336970 - DNA, 20 bp, Artificial Sequence
  chemically synthesized
tcctactatatagtagctga

SEQ ID NO: 336971 - DNA, 20 bp, Artificial Sequence
  chemically synthesized
ctttcctttcagctactata

SEQ ID NO: 336972 - DNA, 20 bp, Artificial Sequence
  chemically synthesized
ctactattcctactatatag

SEQ ID NO: 336973 - DNA, 20 bp, Artificial Sequence
  chemically synthesized
tcctttcagctactatatag

SEQ ID NO: 336974 - DNA, 20 bp, Artificial Sequence
  chemically synthesized
cctttcagctactatatagt

SEQ ID NO: 336975 - DNA, 20 bp, Artificial Sequence
  chemically synthesized
tttctactattcctactata

SEQ ID NO: 336976 - DNA, 20 bp, Artificial Sequence
  chemically synthesized
cagctactatatagtaggaa

SEQ ID NO: 336977 - DNA, 20 bp, Artificial Sequence
  chemically synthesized
ctactatatagtaggaatag

SEQ ID NO: 336978 - DNA, 20 bp, Artificial Sequence
  chemically synthesized
tatagtaggaatagtagaaa

SEQ ID NO: 336979 - DNA, 20 bp, Artificial Sequence
  chemically synthesized
agaggagcaatagtaggaag

SEQ ID NO: 336980 - DNA, 20 bp, Artificial Sequence
  chemically synthesized
tagagaggagcaatagtagg

SEQ ID NO: 336981 - DNA, 20 bp, Artificial Sequence
  chemically synthesized
atctagagaggagcaatagt

SEQ ID NO: 336982 - DNA, 20 bp, Artificial Sequence
  chemically synthesized
aatctagagaggagcaatag

SEQ ID NO: 336983 - DNA, 20 bp, Artificial Sequence
  chemically synthesized
aataatctagagaggagcaa

SEQ ID NO: 336984 - DNA, 20 bp, Artificial Sequence
  chemically synthesized
ttcctactattgctcctctc

SEQ ID NO: 336985 - DNA, 20 bp, Artificial Sequence
  chemically synthesized
acaagaaataatctagagag

SEQ ID NO: 336986 - DNA, 20 bp, Artificial Sequence
  chemically synthesized
tgacaagaaataatctagag

SEQ ID NO: 336987 - DNA, 20 bp, Artificial Sequence
  chemically synthesized
gtgacaagaaataatctaga

SEQ ID NO: 336988 - DNA, 20 bp, Artificial Sequence
  chemically synthesized
aggtgacaagaaataatcta

SEQ ID NO: 336989 - DNA, 20 bp, Artificial Sequence
  chemically synthesized
ataggtgacaagaaataatc

SEQ ID NO: 336990 - DNA, 20 bp, Artificial Sequence
  chemically synthesized
tatattaacaaataggtgac

SEQ ID NO: 336991 - DNA, 20 bp, Artificial Sequence
  chemically synthesized
agaagtatatattaacaaat

SEQ ID NO: 336992 - DNA, 20 bp, Artificial Sequence
  chemically synthesized
cagaagtatatattaacaaa

SEQ ID NO: 336993 - DNA, 20 bp, Artificial Sequence
  chemically synthesized
ttgtattttaaaagttacag

SEQ ID NO: 336994 - DNA, 20 bp, Artificial Sequence
  chemically synthesized
taattgtattttaaaagtta

SEQ ID NO: 336995 - DNA, 20 bp, Artificial Sequence
  chemically synthesized
tgaagataattgtattttaa

SEQ ID NO: 336996 - DNA, 20 bp, Artificial Sequence
  chemically synthesized
ttatctcagatggtaaaatg

SEQ ID NO: 336997 - DNA, 20 bp, Artificial Sequence
  chemically synthesized
ttatcttcattttaccatct

SEQ ID NO: 336998 - DNA, 20 bp, Artificial Sequence
  chemically synthesized
taaatagaatttatctcaga

SEQ ID NO: 336999 - DNA, 20 bp, Artificial Sequence
  chemically synthesized
gcaataaatagaatttatct

SEQ ID NO: 337000 - DNA, 20 bp, Artificial Sequence
  chemically synthesized
aacagaaccctagcaataaa

SEQ ID NO: 337001 - DNA, 20 bp, Artificial Sequence
  chemically synthesized
agataaattctatttattgc

SEQ ID NO: 337002 - DNA, 20 bp, Artificial Sequence
  chemically synthesized
gataaattctatttattgct

SEQ ID NO: 337003 - DNA, 20 bp, Artificial Sequence
  chemically synthesized
ataaattctatttattgcta

SEQ ID NO: 337004 - DNA, 20 bp, Artificial Sequence
  chemically synthesized
tagaggatataacagaaccc

SEQ ID NO: 337005 - DNA, 20 bp, Artificial Sequence
  chemically synthesized
tattattttagaggatataa

SEQ ID NO: 337006 - DNA, 20 bp, Artificial Sequence
  chemically synthesized
ctatatttgtattattttag

SEQ ID NO: 337007 - DNA, 20 bp, Artificial Sequence
  chemically synthesized
tctatatttgtattatttta

SEQ ID NO: 337008 - DNA, 20 bp, Artificial Sequence
  chemically synthesized
tatctatatttgtattattt

SEQ ID NO: 337009 - DNA, 20 bp, Artificial Sequence
  chemically synthesized
cctctaaaataatacaaata

SEQ ID NO: 337010 - DNA, 20 bp, Artificial Sequence
  chemically synthesized
ataatacaaatatagataca

SEQ ID NO: 337011 - DNA, 20 bp, Artificial Sequence
  chemically synthesized
aatacaaatatagatacaca

SEQ ID NO: 337012 - DNA, 20 bp, Artificial Sequence
  chemically synthesized
tacaaatatagatacacaga

SEQ ID NO: 337013 - DNA, 20 bp, Artificial Sequence
  chemically synthesized
gtcgcatacatacatgtttg

SEQ ID NO: 337014 - DNA, 20 bp, Artificial Sequence
  chemically synthesized
tcgcatacatacatgtttgt

SEQ ID NO: 337015 - DNA, 20 bp, Artificial Sequence
  chemically synthesized
atacatgtttgtgggcatgt

SEQ ID NO: 337016 - DNA, 20 bp, Artificial Sequence
  chemically synthesized
catgtgagtgtgtaattata

SEQ ID NO: 337017 - DNA, 20 bp, Artificial Sequence
  chemically synthesized
taaccctgtcataagtcgag

SEQ ID NO: 337018 - DNA, 20 bp, Artificial Sequence
  chemically synthesized
tgtaaccctgtcataagtcg

SEQ ID NO: 337019 - DNA, 20 bp, Artificial Sequence
  chemically synthesized
atgtaaccctgtcataagtc

SEQ ID NO: 337020 - DNA, 20 bp, Artificial Sequence
  chemically synthesized
agatgctcctcgacttatga

SEQ ID NO: 337021 - DNA, 20 bp, Artificial Sequence
  chemically synthesized
gatgctcctcgacttatgac

SEQ ID NO: 337022 - DNA, 20 bp, Artificial Sequence
  chemically synthesized
atgctcctcgacttatgaca

SEQ ID NO: 337023 - DNA, 20 bp, Artificial Sequence
  chemically synthesized
ttggaatgtaaccctgtcat

SEQ ID NO: 337024 - DNA, 20 bp, Artificial Sequence
  chemically synthesized
tctatggacaatgggtttat

SEQ ID NO: 337025 - DNA, 20 bp, Artificial Sequence
  chemically synthesized
ctatattttctatggacaat

SEQ ID NO: 337026 - DNA, 20 bp, Artificial Sequence
  chemically synthesized
tccaataaacccattgtcca

SEQ ID NO: 337027 - DNA, 20 bp, Artificial Sequence
  chemically synthesized
actatattttctatggacaa

SEQ ID NO: 337028 - DNA, 20 bp, Artificial Sequence
  chemically synthesized
ttgactcactatattttcta

SEQ ID NO: 337029 - DNA, 20 bp, Artificial Sequence
  chemically synthesized
cccattgtccatagaaaata

SEQ ID NO: 337030 - DNA, 20 bp, Artificial Sequence
  chemically synthesized
ttgtccatagaaaatatagt

SEQ ID NO: 337031 - DNA, 20 bp, Artificial Sequence
  chemically synthesized
gctataatatttgacaggtt

SEQ ID NO: 337032 - DNA, 20 bp, Artificial Sequence
  chemically synthesized
gctaagctataatatttgac

SEQ ID NO: 337033 - DNA, 20 bp, Artificial Sequence
  chemically synthesized
ggctaagctataatatttga

SEQ ID NO: 337034 - DNA, 20 bp, Artificial Sequence
  chemically synthesized
actgaacctgtcaaatatta

SEQ ID NO: 337035 - DNA, 20 bp, Artificial Sequence
  chemically synthesized
acctgtcaaatattatagct

SEQ ID NO: 337036 - DNA, 20 bp, Artificial Sequence
  chemically synthesized
tcaaatattatagcttagcc

SEQ ID NO: 337037 - DNA, 20 bp, Artificial Sequence
  chemically synthesized
tgtttaaggaaggctaggct

SEQ ID NO: 337038 - DNA, 20 bp, Artificial Sequence
  chemically synthesized
ttgcatgtttaaggaaggct

SEQ ID NO: 337039 - DNA, 20 bp, Artificial Sequence
  chemically synthesized
cttgcatgtttaaggaaggc

SEQ ID NO: 337040 - DNA, 20 bp, Artificial Sequence
  chemically synthesized
tgttcttgcatgtttaagga

SEQ ID NO: 337041 - DNA, 20 bp, Artificial Sequence
  chemically synthesized
gtgttcttgcatgtttaagg

SEQ ID NO: 337042 - DNA, 20 bp, Artificial Sequence
  chemically synthesized
taagtgttcttgcatgttta

SEQ ID NO: 337043 - DNA, 20 bp, Artificial Sequence
  chemically synthesized
gtaagtgttcttgcatgttt

SEQ ID NO: 337044 - DNA, 20 bp, Artificial Sequence
  chemically synthesized
ctagccttccttaaacatgc

SEQ ID NO: 337045 - DNA, 20 bp, Artificial Sequence
  chemically synthesized
acatgcaagaacacttacat

SEQ ID NO: 337046 - DNA, 20 bp, Artificial Sequence
  chemically synthesized
gccaaagtataggctaatgt

SEQ ID NO: 337047 - DNA, 20 bp, Artificial Sequence
  chemically synthesized
acttacattagcctatactt

SEQ ID NO: 337048 - DNA, 20 bp, Artificial Sequence
  chemically synthesized
agatggttttgccaaagtat

SEQ ID NO: 337049 - DNA, 20 bp, Artificial Sequence
  chemically synthesized
tagatggttttgccaaagta

SEQ ID NO: 337050 - DNA, 20 bp, Artificial Sequence
  chemically synthesized
tgtgttagatggttttgcca

SEQ ID NO: 337051 - DNA, 20 bp, Artificial Sequence
  chemically synthesized
agaacaggctttgtgttaga

SEQ ID NO: 337052 - DNA, 20 bp, Artificial Sequence
  chemically synthesized
tggcaaaaccatctaacaca

SEQ ID NO: 337053 - DNA, 20 bp, Artificial Sequence
  chemically synthesized
ttatagaacaggctttgtgt

SEQ ID NO: 337054 - DNA, 20 bp, Artificial Sequence
  chemically synthesized
tactttagtttttatagaac

SEQ ID NO: 337055 - DNA, 20 bp, Artificial Sequence
  chemically synthesized
gtactttagtttttatagaa

SEQ ID NO: 337056 - DNA, 20 bp, Artificial Sequence
  chemically synthesized
attcagtactttagttttta

SEQ ID NO: 337057 - DNA, 20 bp, Artificial Sequence
  chemically synthesized
agcctgttctataaaaacta

SEQ ID NO: 337058 - DNA, 20 bp, Artificial Sequence
  chemically synthesized
acacgatatattcagtactt

SEQ ID NO: 337059 - DNA, 20 bp, Artificial Sequence
  chemically synthesized
aatgcattacacgatatatt

SEQ ID NO: 337060 - DNA, 20 bp, Artificial Sequence
  chemically synthesized
aatatatcgtgtaatgcatt

SEQ ID NO: 337061 - DNA, 20 bp, Artificial Sequence
  chemically synthesized
atcgtgtaatgcattgagca

SEQ ID NO: 337062 - DNA, 20 bp, Artificial Sequence
  chemically synthesized
gtgtaatgcattgagcacag

SEQ ID NO: 337063 - DNA, 20 bp, Artificial Sequence
  chemically synthesized
tgcattgagcacagtagtga

SEQ ID NO: 337064 - DNA, 20 bp, Artificial Sequence
  chemically synthesized
acagtagtgacagtgaaaaa

SEQ ID NO: 337065 - DNA, 20 bp, Artificial Sequence
  chemically synthesized
tgaaaaatggcatgattaaa

SEQ ID NO: 337066 - DNA, 20 bp, Artificial Sequence
  chemically synthesized
gaaaaatggcatgattaaat

SEQ ID NO: 337067 - DNA, 20 bp, Artificial Sequence
  chemically synthesized
catgattaaatgggtactca

SEQ ID NO: 337068 - DNA, 20 bp, Artificial Sequence
  chemically synthesized
ttaaatgggtactcaaagta

SEQ ID NO: 337069 - DNA, 20 bp, Artificial Sequence
  chemically synthesized
ttcagtagaaaccgtacttt

SEQ ID NO: 337070 - DNA, 20 bp, Artificial Sequence
  chemically synthesized
tgaaagcagtgtgcgttcag

SEQ ID NO: 337071 - DNA, 20 bp, Artificial Sequence
  chemically synthesized
gtgtgaaagcagtgtgcgtt

SEQ ID NO: 337072 - DNA, 20 bp, Artificial Sequence
  chemically synthesized
actttatgatggtgtgaaag

SEQ ID NO: 337073 - DNA, 20 bp, Artificial Sequence
  chemically synthesized
tcaactttatgatggtgtga

SEQ ID NO: 337074 - DNA, 20 bp, Artificial Sequence
  chemically synthesized
actgctttcacaccatcata

SEQ ID NO: 337075 - DNA, 20 bp, Artificial Sequence
  chemically synthesized
atgatttttcaactttatga

SEQ ID NO: 337076 - DNA, 20 bp, Artificial Sequence
  chemically synthesized
tcataaagttgaaaaatcat

SEQ ID NO: 337077 - DNA, 20 bp, Artificial Sequence
  chemically synthesized
atcattagtcaaaccatctt

SEQ ID NO: 337078 - DNA, 20 bp, Artificial Sequence
  chemically synthesized
agatggtccctgacttaaga

SEQ ID NO: 337079 - DNA, 20 bp, Artificial Sequence
  chemically synthesized
ttagtcaaaccatcttaagt

SEQ ID NO: 337080 - DNA, 20 bp, Artificial Sequence
  chemically synthesized
tagtcaaaccatcttaagtc

SEQ ID NO: 337081 - DNA, 20 bp, Artificial Sequence
  chemically synthesized
agtcaaaccatcttaagtca

SEQ ID NO: 337082 - DNA, 20 bp, Artificial Sequence
  chemically synthesized
atctagatggtccctgactt

SEQ ID NO: 337083 - DNA, 20 bp, Artificial Sequence
  chemically synthesized
atcttaagtcagggaccatc

SEQ ID NO: 337084 - DNA, 20 bp, Artificial Sequence
  chemically synthesized
tacttcaatcaagatctaga

SEQ ID NO: 337085 - DNA, 20 bp, Artificial Sequence
  chemically synthesized
aagttacttcaatcaagatc

SEQ ID NO: 337086 - DNA, 20 bp, Artificial Sequence
  chemically synthesized
gaccatctagatcttgattg

SEQ ID NO: 337087 - DNA, 20 bp, Artificial Sequence
  chemically synthesized
ttcctgaagttacttcaatc

SEQ ID NO: 337088 - DNA, 20 bp, Artificial Sequence
  chemically synthesized
gatcttgattgaagtaactt

SEQ ID NO: 337089 - DNA, 20 bp, Artificial Sequence
  chemically synthesized
atcttgattgaagtaacttc

SEQ ID NO: 337090 - DNA, 20 bp, Artificial Sequence
  chemically synthesized
ccttaaatctaaagttcctg

SEQ ID NO: 337091 - DNA, 20 bp, Artificial Sequence
  chemically synthesized
tgaagtaacttcaggaactt

SEQ ID NO: 337092 - DNA, 20 bp, Artificial Sequence
  chemically synthesized
acttcaggaactttagattt

SEQ ID NO: 337093 - DNA, 20 bp, Artificial Sequence
  chemically synthesized
acttgtaccccttaaatcta

SEQ ID NO: 337094 - DNA, 20 bp, Artificial Sequence
  chemically synthesized
cttcaggaactttagattta

SEQ ID NO: 337095 - DNA, 20 bp, Artificial Sequence
  chemically synthesized
ttcaggaactttagatttaa

SEQ ID NO: 337096 - DNA, 20 bp, Artificial Sequence
  chemically synthesized
tcaggaactttagatttaag

SEQ ID NO: 337097 - DNA, 20 bp, Artificial Sequence
  chemically synthesized
actttagatttaaggggtac

SEQ ID NO: 337098 - DNA, 20 bp, Artificial Sequence
  chemically synthesized
acaagtgcaattttgttaca

SEQ ID NO: 337099 - DNA, 20 bp, Artificial Sequence
  chemically synthesized
tgttacatggatatgttgtg

SEQ ID NO: 337100 - DNA, 20 bp, Artificial Sequence
  chemically synthesized
ggatatgttgtgtagtgatc

SEQ ID NO: 337101 - DNA, 20 bp, Artificial Sequence
  chemically synthesized
gttgtgtagtgatcaagtct

SEQ ID NO: 337102 - DNA, 20 bp, Artificial Sequence
  chemically synthesized
agtgatcaagtctcggcttt

SEQ ID NO: 337103 - DNA, 20 bp, Artificial Sequence
  chemically synthesized
tgatgggtacactaaaagcc

SEQ ID NO: 337104 - DNA, 20 bp, Artificial Sequence
  chemically synthesized
ttgtgtgatgggtacactaa

SEQ ID NO: 337105 - DNA, 20 bp, Artificial Sequence
  chemically synthesized
ttgtagactatttgtgtgat

SEQ ID NO: 337106 - DNA, 20 bp, Artificial Sequence
  chemically synthesized
attgtagactatttgtgtga

SEQ ID NO: 337107 - DNA, 20 bp, Artificial Sequence
  chemically synthesized
tagtgtacccatcacacaaa

SEQ ID NO: 337108 - DNA, 20 bp, Artificial Sequence
  chemically synthesized
attacctattaggtacattg

SEQ ID NO: 337109 - DNA, 20 bp, Artificial Sequence
  chemically synthesized
atagtctacaatgtacctaa

SEQ ID NO: 337110 - DNA, 20 bp, Artificial Sequence
  chemically synthesized
tagtctacaatgtacctaat

SEQ ID NO: 337111 - DNA, 20 bp, Artificial Sequence
  chemically synthesized
gagatgaaaaattacctatt

SEQ ID NO: 337112 - DNA, 20 bp, Artificial Sequence
  chemically synthesized
agagatgaaaaattacctat

SEQ ID NO: 337113 - DNA, 20 bp, Artificial Sequence
  chemically synthesized
ggagagtgggaagggggtga

SEQ ID NO: 337114 - DNA, 20 bp, Artificial Sequence
  chemically synthesized
tgggagagtgggaagggggt

SEQ ID NO: 337115 - DNA, 20 bp, Artificial Sequence
  chemically synthesized
aagatgggagagtgggaagg

SEQ ID NO: 337116 - DNA, 20 bp, Artificial Sequence
  chemically synthesized
aaagatgggagagtgggaag

SEQ ID NO: 337117 - DNA, 20 bp, Artificial Sequence
  chemically synthesized
aaaagatgggagagtgggaa

SEQ ID NO: 337118 - DNA, 20 bp, Artificial Sequence
  chemically synthesized
caaaagatgggagagtggga

SEQ ID NO: 337119 - DNA, 20 bp, Artificial Sequence
  chemically synthesized
ccaaaagatgggagagtggg

SEQ ID NO: 337120 - DNA, 20 bp, Artificial Sequence
  chemically synthesized
actccaaaagatgggagagt

SEQ ID NO: 337121 - DNA, 20 bp, Artificial Sequence
  chemically synthesized
gactccaaaagatgggagag

SEQ ID NO: 337122 - DNA, 20 bp, Artificial Sequence
  chemically synthesized
ggagactccaaaagatggga

SEQ ID NO: 337123 - DNA, 20 bp, Artificial Sequence
  chemically synthesized
ttggagactccaaaagatgg

SEQ ID NO: 337124 - DNA, 20 bp, Artificial Sequence
  chemically synthesized
cttcccactctcccatcttt

SEQ ID NO: 337125 - DNA, 20 bp, Artificial Sequence
  chemically synthesized
cattggagactccaaaagat

SEQ ID NO: 337126 - DNA, 20 bp, Artificial Sequence
  chemically synthesized
tcccactctcccatcttttg

SEQ ID NO: 337127 - DNA, 20 bp, Artificial Sequence
  chemically synthesized
acattggagactccaaaaga

SEQ ID NO: 337128 - DNA, 20 bp, Artificial Sequence
  chemically synthesized
ctcaacattggagactccaa

SEQ ID NO: 337129 - DNA, 20 bp, Artificial Sequence
  chemically synthesized
cttttggagtctccaatgtt

SEQ ID NO: 337130 - DNA, 20 bp, Artificial Sequence
  chemically synthesized
gaattgaatactcaacattg

SEQ ID NO: 337131 - DNA, 20 bp, Artificial Sequence
  chemically synthesized
cagaattgaatactcaacat

SEQ ID NO: 337132 - DNA, 20 bp, Artificial Sequence
  chemically synthesized
aatgggtacacatggacata

SEQ ID NO: 337133 - DNA, 20 bp, Artificial Sequence
  chemically synthesized
aactaatcaatgggtacaca

SEQ ID NO: 337134 - DNA, 20 bp, Artificial Sequence
  chemically synthesized
gtccatgtgtacccattgat

SEQ ID NO: 337135 - DNA, 20 bp, Artificial Sequence
  chemically synthesized
ataagtggtaactaatcaat

SEQ ID NO: 337136 - DNA, 20 bp, Artificial Sequence
  chemically synthesized
tataagtggtaactaatcaa

SEQ ID NO: 337137 - DNA, 20 bp, Artificial Sequence
  chemically synthesized
cattgattagttaccactta

SEQ ID NO: 337138 - DNA, 20 bp, Artificial Sequence
  chemically synthesized
attgattagttaccacttat

SEQ ID NO: 337139 - DNA, 20 bp, Artificial Sequence
  chemically synthesized
atactgtattttcctataag

SEQ ID NO: 337140 - DNA, 20 bp, Artificial Sequence
  chemically synthesized
caaatactgtattttcctat

SEQ ID NO: 337141 - DNA, 20 bp, Artificial Sequence
  chemically synthesized
ttaccacttataggaaaata

SEQ ID NO: 337142 - DNA, 20 bp, Artificial Sequence
  chemically synthesized
taagtgaaataagtcagaaa

SEQ ID NO: 337143 - DNA, 20 bp, Artificial Sequence
  chemically synthesized
tcatcctaagtgaaataagt

SEQ ID NO: 337144 - DNA, 20 bp, Artificial Sequence
  chemically synthesized
gctatcatcctaagtgaaat

SEQ ID NO: 337145 - DNA, 20 bp, Artificial Sequence
  chemically synthesized
tgtttctgacttatttcact

SEQ ID NO: 337146 - DNA, 20 bp, Artificial Sequence
  chemically synthesized
gtttctgacttatttcactt

SEQ ID NO: 337147 - DNA, 20 bp, Artificial Sequence
  chemically synthesized
acttatttcacttaggatga

SEQ ID NO: 337148 - DNA, 20 bp, Artificial Sequence
  chemically synthesized
aaactggaggctatcatcct

SEQ ID NO: 337149 - DNA, 20 bp, Artificial Sequence
  chemically synthesized
tcacttaggatgatagcctc

SEQ ID NO: 337150 - DNA, 20 bp, Artificial Sequence
  chemically synthesized
agcaacatggatgaaactgg

SEQ ID NO: 337151 - DNA, 20 bp, Artificial Sequence
  chemically synthesized
cagcaacatggatgaaactg

SEQ ID NO: 337152 - DNA, 20 bp, Artificial Sequence
  chemically synthesized
tgcagcaacatggatgaaac

SEQ ID NO: 337153 - DNA, 20 bp, Artificial Sequence
  chemically synthesized
ttatgtcttttgcagcaaca

SEQ ID NO: 337154 - DNA, 20 bp, Artificial Sequence
  chemically synthesized
tttcatccatgttgctgcaa

SEQ ID NO: 337155 - DNA, 20 bp, Artificial Sequence
  chemically synthesized
gaataaaattatgtcttttg

SEQ ID NO: 337156 - DNA, 20 bp, Artificial Sequence
  chemically synthesized
gacataattttattcctttg

SEQ ID NO: 337157 - DNA, 20 bp, Artificial Sequence
  chemically synthesized
ggaatactaacgagccacaa

SEQ ID NO: 337158 - DNA, 20 bp, Artificial Sequence
  chemically synthesized
tggaatactaacgagccaca

SEQ ID NO: 337159 - DNA, 20 bp, Artificial Sequence
  chemically synthesized
tttattcctttgtggctcgt

SEQ ID NO: 337160 - DNA, 20 bp, Artificial Sequence
  chemically synthesized
atatataatggaatactaac

SEQ ID NO: 337161 - DNA, 20 bp, Artificial Sequence
  chemically synthesized
aatgtggtgtgtatatataa

SEQ ID NO: 337162 - DNA, 20 bp, Artificial Sequence
  chemically synthesized
atgagtagataaagataatg

SEQ ID NO: 337163 - DNA, 20 bp, Artificial Sequence
  chemically synthesized
gttgtgtccatgagtagata

SEQ ID NO: 337164 - DNA, 20 bp, Artificial Sequence
  chemically synthesized
acattatctttatctactca

SEQ ID NO: 337165 - DNA, 20 bp, Artificial Sequence
  chemically synthesized
aatcaagttgtgtccatgag

SEQ ID NO: 337166 - DNA, 20 bp, Artificial Sequence
  chemically synthesized
tggaatcaagttgtgtccat

SEQ ID NO: 337167 - DNA, 20 bp, Artificial Sequence
  chemically synthesized
aatagcaaaatcgtggaatc

SEQ ID NO: 337168 - DNA, 20 bp, Artificial Sequence
  chemically synthesized
tatgcgtaatagcaaaatcg

SEQ ID NO: 337169 - DNA, 20 bp, Artificial Sequence
  chemically synthesized
cacgattttgctattacgca

SEQ ID NO: 337170 - DNA, 20 bp, Artificial Sequence
  chemically synthesized
cactggagcactatgcgtaa

SEQ ID NO: 337171 - DNA, 20 bp, Artificial Sequence
  chemically synthesized
tgctattacgcatagtgctc

SEQ ID NO: 337172 - DNA, 20 bp, Artificial Sequence
  chemically synthesized
tcacactcgcatgttcactg

SEQ ID NO: 337173 - DNA, 20 bp, Artificial Sequence
  chemically synthesized
agtcacactcgcatgttcac

SEQ ID NO: 337174 - DNA, 20 bp, Artificial Sequence
  chemically synthesized
tagtgctccagtgaacatgc

SEQ ID NO: 337175 - DNA, 20 bp, Artificial Sequence
  chemically synthesized
tgaacatgcgagtgtgactg

SEQ ID NO: 337176 - DNA, 20 bp, Artificial Sequence
  chemically synthesized
ttgtacattgaaagtaactt

SEQ ID NO: 337177 - DNA, 20 bp, Artificial Sequence
  chemically synthesized
taagttagtttgtacattga

SEQ ID NO: 337178 - DNA, 20 bp, Artificial Sequence
  chemically synthesized
tttcaatgtacaaactaact

SEQ ID NO: 337179 - DNA, 20 bp, Artificial Sequence
  chemically synthesized
ttcaatgtacaaactaactt

SEQ ID NO: 337180 - DNA, 20 bp, Artificial Sequence
  chemically synthesized
tcaatgtacaaactaactta

SEQ ID NO: 337181 - DNA, 20 bp, Artificial Sequence
  chemically synthesized
aatgtacaaactaacttagg

SEQ ID NO: 337182 - DNA, 20 bp, Artificial Sequence
  chemically synthesized
aatgctagttctccctaagt

SEQ ID NO: 337183 - DNA, 20 bp, Artificial Sequence
  chemically synthesized
tgaaaatgctagttctccct

SEQ ID NO: 337184 - DNA, 20 bp, Artificial Sequence
  chemically synthesized
caaactaacttagggagaac

SEQ ID NO: 337185 - DNA, 20 bp, Artificial Sequence
  chemically synthesized
gtcacatatgatgaaaatgc

SEQ ID NO: 337186 - DNA, 20 bp, Artificial Sequence
  chemically synthesized
aataaagacatgaggaaagg

SEQ ID NO: 337187 - DNA, 20 bp, Artificial Sequence
  chemically synthesized
ataaataaagacatgaggaa

SEQ ID NO: 337188 - DNA, 20 bp, Artificial Sequence
  chemically synthesized
cataaataaagacatgagga

SEQ ID NO: 337189 - DNA, 20 bp, Artificial Sequence
  chemically synthesized
agtacataaataaagacatg

SEQ ID NO: 337190 - DNA, 20 bp, Artificial Sequence
  chemically synthesized
aagtacataaataaagacat

SEQ ID NO: 337191 - DNA, 20 bp, Artificial Sequence
  chemically synthesized
tgtatataagtacataaata

SEQ ID NO: 337192 - DNA, 20 bp, Artificial Sequence
  chemically synthesized
ggaagtttaaagttgtatat

SEQ ID NO: 337193 - DNA, 20 bp, Artificial Sequence
  chemically synthesized
ttttttttataggaagttta

SEQ ID NO: 337194 - DNA, 20 bp, Artificial Sequence
  chemically synthesized
tataagcttttttttatagg

SEQ ID NO: 337195 - DNA, 20 bp, Artificial Sequence
  chemically synthesized
aagtataagcttttttttat

SEQ ID NO: 337196 - DNA, 20 bp, Artificial Sequence
  chemically synthesized
tttaaacttcctataaaaaa

SEQ ID NO: 337197 - DNA, 20 bp, Artificial Sequence
  chemically synthesized
aaagtataagctttttttta

SEQ ID NO: 337198 - DNA, 20 bp, Artificial Sequence
  chemically synthesized
taaaccgcacaagaaagtat

SEQ ID NO: 337199 - DNA, 20 bp, Artificial Sequence
  chemically synthesized
aaagcttatactttcttgtg

SEQ ID NO: 337200 - DNA, 20 bp, Artificial Sequence
  chemically synthesized
tagaagtaaaccgcacaaga

SEQ ID NO: 337201 - DNA, 20 bp, Artificial Sequence
  chemically synthesized
ttcttagaagtaaaccgcac

SEQ ID NO: 337202 - DNA, 20 bp, Artificial Sequence
  chemically synthesized
ttcttgtgcggtttacttct

SEQ ID NO: 337203 - DNA, 20 bp, Artificial Sequence
  chemically synthesized
aatctatgtagttttcttag

SEQ ID NO: 337204 - DNA, 20 bp, Artificial Sequence
  chemically synthesized
caaaatctatgtagttttct

SEQ ID NO: 337205 - DNA, 20 bp, Artificial Sequence
  chemically synthesized
ttacttctaagaaaactaca

SEQ ID NO: 337206 - DNA, 20 bp, Artificial Sequence
  chemically synthesized
gagaagttccaaaatctatg

SEQ ID NO: 337207 - DNA, 20 bp, Artificial Sequence
  chemically synthesized
taagaaaactacatagattt

SEQ ID NO: 337208 - DNA, 20 bp, Artificial Sequence
  chemically synthesized
aaattatttttaaaaaagag

SEQ ID NO: 337209 - DNA, 20 bp, Artificial Sequence
  chemically synthesized
ataaaattatttttaaaaaa

SEQ ID NO: 337210 - DNA, 20 bp, Artificial Sequence
  chemically synthesized
caataaaattatttttaaaa

SEQ ID NO: 337211 - DNA, 20 bp, Artificial Sequence
  chemically synthesized
ataattttattgtgtgtttt

SEQ ID NO: 337212 - DNA, 20 bp, Artificial Sequence
  chemically synthesized
taattttattgtgtgtttta

SEQ ID NO: 337213 - DNA, 20 bp, Artificial Sequence
  chemically synthesized
aggtatacacatgatgctat

SEQ ID NO: 337214 - DNA, 20 bp, Artificial Sequence
  chemically synthesized
ccatttacatgtgtatctta

SEQ ID NO: 337215 - DNA, 20 bp, Artificial Sequence
  chemically synthesized
ctataagatacacatgtaaa

SEQ ID NO: 337216 - DNA, 20 bp, Artificial Sequence
  chemically synthesized
ctttcattatggtttcatta

SEQ ID NO: 337217 - DNA, 20 bp, Artificial Sequence
  chemically synthesized
ccataatgaaaccataatga

SEQ ID NO: 337218 - DNA, 20 bp, Artificial Sequence
  chemically synthesized
tatgttaatttctttcatta

SEQ ID NO: 337219 - DNA, 20 bp, Artificial Sequence
  chemically synthesized
ggaacgattatgtgagatga

SEQ ID NO: 337220 - DNA, 20 bp, Artificial Sequence
  chemically synthesized
gggtgggggaacgattatgt

SEQ ID NO: 337221 - DNA, 20 bp, Artificial Sequence
  chemically synthesized
ttctcgtggtcagagggtgg

SEQ ID NO: 337222 - DNA, 20 bp, Artificial Sequence
  chemically synthesized
cttctcgtggtcagagggtg

SEQ ID NO: 337223 - DNA, 20 bp, Artificial Sequence
  chemically synthesized
gcttctcgtggtcagagggt

SEQ ID NO: 337224 - DNA, 20 bp, Artificial Sequence
  chemically synthesized
agcttctcgtggtcagaggg

SEQ ID NO: 337225 - DNA, 20 bp, Artificial Sequence
  chemically synthesized
tatagcttctcgtggtcaga

SEQ ID NO: 337226 - DNA, 20 bp, Artificial Sequence
  chemically synthesized
ttatagcttctcgtggtcag

SEQ ID NO: 337227 - DNA, 20 bp, Artificial Sequence
  chemically synthesized
ttcccccaccctctgaccac

SEQ ID NO: 337228 - DNA, 20 bp, Artificial Sequence
  chemically synthesized
attatagcttctcgtggtca

SEQ ID NO: 337229 - DNA, 20 bp, Artificial Sequence
  chemically synthesized
agattatagcttctcgtggt

SEQ ID NO: 337230 - DNA, 20 bp, Artificial Sequence
  chemically synthesized
ccccaccctctgaccacgag

SEQ ID NO: 337231 - DNA, 20 bp, Artificial Sequence
  chemically synthesized
gagtagattatagcttctcg

SEQ ID NO: 337232 - DNA, 20 bp, Artificial Sequence
  chemically synthesized
tttactaaatgagtagatta

SEQ ID NO: 337233 - DNA, 20 bp, Artificial Sequence
  chemically synthesized
gaagctataatctactcatt

SEQ ID NO: 337234 - DNA, 20 bp, Artificial Sequence
  chemically synthesized
cagaatttttactaaatgag

SEQ ID NO: 337235 - DNA, 20 bp, Artificial Sequence
  chemically synthesized
attcagaatttttactaaat

SEQ ID NO: 337236 - DNA, 20 bp, Artificial Sequence
  chemically synthesized
agttaatagtgtgttgtatt

SEQ ID NO: 337237 - DNA, 20 bp, Artificial Sequence
  chemically synthesized
aacatgaggattatagttaa

SEQ ID NO: 337238 - DNA, 20 bp, Artificial Sequence
  chemically synthesized
aatataaaacatgaggatta

SEQ ID NO: 337239 - DNA, 20 bp, Artificial Sequence
  chemically synthesized
aagatctaatataaaacatg

SEQ ID NO: 337240 - DNA, 20 bp, Artificial Sequence
  chemically synthesized
aaagatctaatataaaacat

SEQ ID NO: 337241 - DNA, 20 bp, Artificial Sequence
  chemically synthesized
ataatcctcatgttttatat

SEQ ID NO: 337242 - DNA, 20 bp, Artificial Sequence
  chemically synthesized
atgtgggataaacaagttga

SEQ ID NO: 337243 - DNA, 20 bp, Artificial Sequence
  chemically synthesized
agcaaatatgtgggataaac

SEQ ID NO: 337244 - DNA, 20 bp, Artificial Sequence
  chemically synthesized
ctataaagtagcaaatatgt

SEQ ID NO: 337245 - DNA, 20 bp, Artificial Sequence
  chemically synthesized
tctataaagtagcaaatatg

SEQ ID NO: 337246 - DNA, 20 bp, Artificial Sequence
  chemically synthesized
cccacatatttgctacttta

SEQ ID NO: 337247 - DNA, 20 bp, Artificial Sequence
  chemically synthesized
gtaggtcaaagtctataaag

SEQ ID NO: 337248 - DNA, 20 bp, Artificial Sequence
  chemically synthesized
gatgtaggtcaaagtctata

SEQ ID NO: 337249 - DNA, 20 bp, Artificial Sequence
  chemically synthesized
aaatggggagatgtaggtca

SEQ ID NO: 337250 - DNA, 20 bp, Artificial Sequence
  chemically synthesized
aggaggaaatggggagatgt

SEQ ID NO: 337251 - DNA, 20 bp, Artificial Sequence
  chemically synthesized
aaggaggaaatggggagatg

SEQ ID NO: 337252 - DNA, 20 bp, Artificial Sequence
  chemically synthesized
gggtggaaggaggaaatggg

SEQ ID NO: 337253 - DNA, 20 bp, Artificial Sequence
  chemically synthesized
gggggtggaaggaggaaatg

SEQ ID NO: 337254 - DNA, 20 bp, Artificial Sequence
  chemically synthesized
tgggggtggaaggaggaaat

SEQ ID NO: 337255 - DNA, 20 bp, Artificial Sequence
  chemically synthesized
ttgggggtggaaggaggaaa

SEQ ID NO: 337256 - DNA, 20 bp, Artificial Sequence
  chemically synthesized
accaggttgggggtggaagg

SEQ ID NO: 337257 - DNA, 20 bp, Artificial Sequence
  chemically synthesized
taccaggttgggggtggaag

SEQ ID NO: 337258 - DNA, 20 bp, Artificial Sequence
  chemically synthesized
gttaccaggttgggggtgga

SEQ ID NO: 337259 - DNA, 20 bp, Artificial Sequence
  chemically synthesized
ggttaccaggttgggggtgg

SEQ ID NO: 337260 - DNA, 20 bp, Artificial Sequence
  chemically synthesized
agtggttaccaggttggggg

SEQ ID NO: 337261 - DNA, 20 bp, Artificial Sequence
  chemically synthesized
tcctccttccacccccaacc

SEQ ID NO: 337262 - DNA, 20 bp, Artificial Sequence
  chemically synthesized
aacagtggttaccaggttgg

SEQ ID NO: 337263 - DNA, 20 bp, Artificial Sequence
  chemically synthesized
aaacagtggttaccaggttg

SEQ ID NO: 337264 - DNA, 20 bp, Artificial Sequence
  chemically synthesized
aaaacagtggttaccaggtt

SEQ ID NO: 337265 - DNA, 20 bp, Artificial Sequence
  chemically synthesized
taaaacagtggttaccaggt

SEQ ID NO: 337266 - DNA, 20 bp, Artificial Sequence
  chemically synthesized
agaataaaacagtggttacc

SEQ ID NO: 337267 - DNA, 20 bp, Artificial Sequence
  chemically synthesized
gagaataaaacagtggttac

SEQ ID NO: 337268 - DNA, 20 bp, Artificial Sequence
  chemically synthesized
atatagagagaataaaacag

SEQ ID NO: 337269 - DNA, 20 bp, Artificial Sequence
  chemically synthesized
actatatagagagaataaaa

SEQ ID NO: 337270 - DNA, 20 bp, Artificial Sequence
  chemically synthesized
actgttttattctctctata

SEQ ID NO: 337271 - DNA, 20 bp, Artificial Sequence
  chemically synthesized
attgtgtataactatataga

SEQ ID NO: 337272 - DNA, 20 bp, Artificial Sequence
  chemically synthesized
ccattgtgtataactatata

SEQ ID NO: 337273 - DNA, 20 bp, Artificial Sequence
  chemically synthesized
ttccattgtgtataactata

SEQ ID NO: 337274 - DNA, 20 bp, Artificial Sequence
  chemically synthesized
ctctatatagttatacacaa

SEQ ID NO: 337275 - DNA, 20 bp, Artificial Sequence
  chemically synthesized
atacacaatggaatattact

SEQ ID NO: 337276 - DNA, 20 bp, Artificial Sequence
  chemically synthesized
agatctcctttttaaaggcc

SEQ ID NO: 337277 - DNA, 20 bp, Artificial Sequence
  chemically synthesized
aatattacttggcctttaaa

SEQ ID NO: 337278 - DNA, 20 bp, Artificial Sequence
  chemically synthesized
atattacttggcctttaaaa

SEQ ID NO: 337279 - DNA, 20 bp, Artificial Sequence
  chemically synthesized
gcccaagatctcctttttaa

SEQ ID NO: 337280 - DNA, 20 bp, Artificial Sequence
  chemically synthesized
attacttggcctttaaaaag

SEQ ID NO: 337281 - DNA, 20 bp, Artificial Sequence
  chemically synthesized
ggcccaagatctccttttta

SEQ ID NO: 337282 - DNA, 20 bp, Artificial Sequence
  chemically synthesized
ggcctttaaaaaggagatct

SEQ ID NO: 337283 - DNA, 20 bp, Artificial Sequence
  chemically synthesized
gcctttaaaaaggagatctt

SEQ ID NO: 337284 - DNA, 20 bp, Artificial Sequence
  chemically synthesized
ttaaaaaggagatcttgggc

SEQ ID NO: 337285 - DNA, 20 bp, Artificial Sequence
  chemically synthesized
taaaaaggagatcttgggcc

SEQ ID NO: 337286 - DNA, 20 bp, Artificial Sequence
  chemically synthesized
tgagccaccacgcctggccc

SEQ ID NO: 337287 - DNA, 20 bp, Artificial Sequence
  chemically synthesized
aggagatcttgggccaggcg

SEQ ID NO: 337288 - DNA, 20 bp, Artificial Sequence
  chemically synthesized
agatcttgggccaggcgtgg

SEQ ID NO: 337289 - DNA, 20 bp, Artificial Sequence
  chemically synthesized
caggcatgagccaccacgcc

SEQ ID NO: 337290 - DNA, 20 bp, Artificial Sequence
  chemically synthesized
agtgctgggattacaggcat

SEQ ID NO: 337291 - DNA, 20 bp, Artificial Sequence
  chemically synthesized
gtggctcatgcctgtaatcc

SEQ ID NO: 337292 - DNA, 20 bp, Artificial Sequence
  chemically synthesized
tcccaaagtgctgggattac

SEQ ID NO: 337293 - DNA, 20 bp, Artificial Sequence
  chemically synthesized
ctcccaaagtgctgggatta

SEQ ID NO: 337294 - DNA, 20 bp, Artificial Sequence
  chemically synthesized
tgcctgtaatcccagcactt

SEQ ID NO: 337295 - DNA, 20 bp, Artificial Sequence
  chemically synthesized
ccttggcctcccaaagtgct

SEQ ID NO: 337296 - DNA, 20 bp, Artificial Sequence
  chemically synthesized
gcctgtaatcccagcacttt

SEQ ID NO: 337297 - DNA, 20 bp, Artificial Sequence
  chemically synthesized
gccttggcctcccaaagtgc

SEQ ID NO: 337298 - DNA, 20 bp, Artificial Sequence
  chemically synthesized
ctgtaatcccagcactttgg

SEQ ID NO: 337299 - DNA, 20 bp, Artificial Sequence
  chemically synthesized
tgtaatcccagcactttggg

SEQ ID NO: 337300 - DNA, 20 bp, Artificial Sequence
  chemically synthesized
cctcctgccttggcctccca

SEQ ID NO: 337301 - DNA, 20 bp, Artificial Sequence
  chemically synthesized
tcccagcactttgggaggcc

SEQ ID NO: 337302 - DNA, 20 bp, Artificial Sequence
  chemically synthesized
cccagcactttgggaggcca

SEQ ID NO: 337303 - DNA, 20 bp, Artificial Sequence
  chemically synthesized
agcactttgggaggccaagg

SEQ ID NO: 337304 - DNA, 20 bp, Artificial Sequence
  chemically synthesized
gcactttgggaggccaaggc

SEQ ID NO: 337305 - DNA, 20 bp, Artificial Sequence
  chemically synthesized
actttgggaggccaaggcag

SEQ ID NO: 337306 - DNA, 20 bp, Artificial Sequence
  chemically synthesized
ctttgggaggccaaggcagg

SEQ ID NO: 337307 - DNA, 20 bp, Artificial Sequence
  chemically synthesized
accttgtgatcctcctgcct

SEQ ID NO: 337308 - DNA, 20 bp, Artificial Sequence
  chemically synthesized
ggccaaggcaggaggatcac

SEQ ID NO: 337309 - DNA, 20 bp, Artificial Sequence
  chemically synthesized
gccaaggcaggaggatcaca

SEQ ID NO: 337310 - DNA, 20 bp, Artificial Sequence
  chemically synthesized
ggcaggaggatcacaaggtc

SEQ ID NO: 337311 - DNA, 20 bp, Artificial Sequence
  chemically synthesized
caggaggatcacaaggtcaa

SEQ ID NO: 337312 - DNA, 20 bp, Artificial Sequence
  chemically synthesized
gatcacaaggtcaagagatt

SEQ ID NO: 337313 - DNA, 20 bp, Artificial Sequence
  chemically synthesized
tcaagagattgagaccatcc

SEQ ID NO: 337314 - DNA, 20 bp, Artificial Sequence
  chemically synthesized
ttttaccatgttggccagga

SEQ ID NO: 337315 - DNA, 20 bp, Artificial Sequence
  chemically synthesized
tggcttttaccatgttggcc

SEQ ID NO: 337316 - DNA, 20 bp, Artificial Sequence
  chemically synthesized
tgagaccatcctggccaaca

SEQ ID NO: 337317 - DNA, 20 bp, Artificial Sequence
  chemically synthesized
ttggcttttaccatgttggc

SEQ ID NO: 337318 - DNA, 20 bp, Artificial Sequence
  chemically synthesized
gtgattggcttttaccatgt

SEQ ID NO: 337319 - DNA, 20 bp, Artificial Sequence
  chemically synthesized
catcctggccaacatggtaa

SEQ ID NO: 337320 - DNA, 20 bp, Artificial Sequence
  chemically synthesized
tttgaatttttagtagtgat

SEQ ID NO: 337321 - DNA, 20 bp, Artificial Sequence
  chemically synthesized
actaatttttgaatttttag

SEQ ID NO: 337322 - DNA, 20 bp, Artificial Sequence
  chemically synthesized
caaactaatttttgaatttt

SEQ ID NO: 337323 - DNA, 20 bp, Artificial Sequence
  chemically synthesized
actactaaaaattcaaaaat

SEQ ID NO: 337324 - DNA, 20 bp, Artificial Sequence
  chemically synthesized
taaaaattcaaaaattagtt

SEQ ID NO: 337325 - DNA, 20 bp, Artificial Sequence
  chemically synthesized
attcaaaaattagtttggct

SEQ ID NO: 337326 - DNA, 20 bp, Artificial Sequence
  chemically synthesized
caaaaattagtttggcttgg

SEQ ID NO: 337327 - DNA, 20 bp, Artificial Sequence
  chemically synthesized
gattacaggcgcacaccacc

SEQ ID NO: 337328 - DNA, 20 bp, Artificial Sequence
  chemically synthesized
gtggtgtgcgcctgtaatcc

SEQ ID NO: 337329 - DNA, 20 bp, Artificial Sequence
  chemically synthesized
tcctgaatagctgggattac

SEQ ID NO: 337330 - DNA, 20 bp, Artificial Sequence
  chemically synthesized
ctcctgaatagctgggatta

SEQ ID NO: 337331 - DNA, 20 bp, Artificial Sequence
  chemically synthesized
cgcctgtaatcccagctatt

SEQ ID NO: 337332 - DNA, 20 bp, Artificial Sequence
  chemically synthesized
cctcagcctcctgaatagct

SEQ ID NO: 337333 - DNA, 20 bp, Artificial Sequence
  chemically synthesized
gcctgtaatcccagctattc

SEQ ID NO: 337334 - DNA, 20 bp, Artificial Sequence
  chemically synthesized
gcctcagcctcctgaatagc

SEQ ID NO: 337335 - DNA, 20 bp, Artificial Sequence
  chemically synthesized
ctgtaatcccagctattcag

SEQ ID NO: 337336 - DNA, 20 bp, Artificial Sequence
  chemically synthesized
tgtaatcccagctattcagg

SEQ ID NO: 337337 - DNA, 20 bp, Artificial Sequence
  chemically synthesized
tcctgcctcagcctcctgaa

SEQ ID NO: 337338 - DNA, 20 bp, Artificial Sequence
  chemically synthesized
tcccagctattcaggaggct

SEQ ID NO: 337339 - DNA, 20 bp, Artificial Sequence
  chemically synthesized
cccagctattcaggaggctg

SEQ ID NO: 337340 - DNA, 20 bp, Artificial Sequence
  chemically synthesized
agctattcaggaggctgagg

SEQ ID NO: 337341 - DNA, 20 bp, Artificial Sequence
  chemically synthesized
gctattcaggaggctgaggc

SEQ ID NO: 337342 - DNA, 20 bp, Artificial Sequence
  chemically synthesized
tattcaggaggctgaggcag

SEQ ID NO: 337343 - DNA, 20 bp, Artificial Sequence
  chemically synthesized
tttaagagattctcctgcct

SEQ ID NO: 337344 - DNA, 20 bp, Artificial Sequence
  chemically synthesized
tgaggcaggagaatctctta

SEQ ID NO: 337345 - DNA, 20 bp, Artificial Sequence
  chemically synthesized
gcaggagaatctcttaaagc

SEQ ID NO: 337346 - DNA, 20 bp, Artificial Sequence
  chemically synthesized
cctccacttcctggctttaa

SEQ ID NO: 337347 - DNA, 20 bp, Artificial Sequence
  chemically synthesized
caggagaatctcttaaagcc

SEQ ID NO: 337348 - DNA, 20 bp, Artificial Sequence
  chemically synthesized
aacctccacttcctggcttt

SEQ ID NO: 337349 - DNA, 20 bp, Artificial Sequence
  chemically synthesized
gagaatctcttaaagccagg

SEQ ID NO: 337350 - DNA, 20 bp, Artificial Sequence
  chemically synthesized
aatctcttaaagccaggaag

SEQ ID NO: 337351 - DNA, 20 bp, Artificial Sequence
  chemically synthesized
tctcttaaagccaggaagtg

SEQ ID NO: 337352 - DNA, 20 bp, Artificial Sequence
  chemically synthesized
tcactgcaacctccacttcc

SEQ ID NO: 337353 - DNA, 20 bp, Artificial Sequence
  chemically synthesized
ctcttaaagccaggaagtgg

SEQ ID NO: 337354 - DNA, 20 bp, Artificial Sequence
  chemically synthesized
aagccaggaagtggaggttg

SEQ ID NO: 337355 - DNA, 20 bp, Artificial Sequence
  chemically synthesized
caggaagtggaggttgcagt

SEQ ID NO: 337356 - DNA, 20 bp, Artificial Sequence
  chemically synthesized
agtggaggttgcagtgagcc

SEQ ID NO: 337357 - DNA, 20 bp, Artificial Sequence
  chemically synthesized
gatgtgcagtggcacaatct

SEQ ID NO: 337358 - DNA, 20 bp, Artificial Sequence
  chemically synthesized
gtcaccaggctgatgtgcag

SEQ ID NO: 337359 - DNA, 20 bp, Artificial Sequence
  chemically synthesized
gagattgtgccactgcacat

SEQ ID NO: 337360 - DNA, 20 bp, Artificial Sequence
  chemically synthesized
tctgtcaccaggctgatgtg

SEQ ID NO: 337361 - DNA, 20 bp, Artificial Sequence
  chemically synthesized
tgtgccactgcacatcagcc

SEQ ID NO: 337362 - DNA, 20 bp, Artificial Sequence
  chemically synthesized
actgcacatcagcctggtga

SEQ ID NO: 337363 - DNA, 20 bp, Artificial Sequence
  chemically synthesized
tgcacatcagcctggtgaca

SEQ ID NO: 337364 - DNA, 20 bp, Artificial Sequence
  chemically synthesized
ttgatggaatctctgtcacc

SEQ ID NO: 337365 - DNA, 20 bp, Artificial Sequence
  chemically synthesized
tttgatggaatctctgtcac

SEQ ID NO: 337366 - DNA, 20 bp, Artificial Sequence
  chemically synthesized
ttttttttttttttttttga

SEQ ID NO: 337367 - DNA, 20 bp, Artificial Sequence
  chemically synthesized
aaaaaaaaaaaaaaaaaaaa

SEQ ID NO: 337368 - DNA, 20 bp, Artificial Sequence
  chemically synthesized
aaaaaaaaaaaaaaaaaaaa

SEQ ID NO: 337369 - DNA, 20 bp, Artificial Sequence
  chemically synthesized
aaaaaaaaaaaaaaaaaaag

SEQ ID NO: 337370 - DNA, 20 bp, Artificial Sequence
  chemically synthesized
aaaaaaaaggagatcttgac

SEQ ID NO: 337371 - DNA, 20 bp, Artificial Sequence
  chemically synthesized
aaaaaaaggagatcttgacc

SEQ ID NO: 337372 - DNA, 20 bp, Artificial Sequence
  chemically synthesized
ataagccaccacacctggtc

SEQ ID NO: 337373 - DNA, 20 bp, Artificial Sequence
  chemically synthesized
aaggagatcttgaccaggtg

SEQ ID NO: 337374 - DNA, 20 bp, Artificial Sequence
  chemically synthesized
gagatcttgaccaggtgtgg

SEQ ID NO: 337375 - DNA, 20 bp, Artificial Sequence
  chemically synthesized
taggcataagccaccacacc

SEQ ID NO: 337376 - DNA, 20 bp, Artificial Sequence
  chemically synthesized
agtgctaggattataggcat

SEQ ID NO: 337377 - DNA, 20 bp, Artificial Sequence
  chemically synthesized
gtggcttatgcctataatcc

SEQ ID NO: 337378 - DNA, 20 bp, Artificial Sequence
  chemically synthesized
tccctaagtgctaggattat

SEQ ID NO: 337379 - DNA, 20 bp, Artificial Sequence
  chemically synthesized
gtccctaagtgctaggatta

SEQ ID NO: 337380 - DNA, 20 bp, Artificial Sequence
  chemically synthesized
atgcctataatcctagcact

SEQ ID NO: 337381 - DNA, 20 bp, Artificial Sequence
  chemically synthesized
tgcctataatcctagcactt

SEQ ID NO: 337382 - DNA, 20 bp, Artificial Sequence
  chemically synthesized
tccctaagtccctaagtgct

SEQ ID NO: 337383 - DNA, 20 bp, Artificial Sequence
  chemically synthesized
gcctataatcctagcactta

SEQ ID NO: 337384 - DNA, 20 bp, Artificial Sequence
  chemically synthesized
ctccctaagtccctaagtgc

SEQ ID NO: 337385 - DNA, 20 bp, Artificial Sequence
  chemically synthesized
aatcctagcacttagggact

SEQ ID NO: 337386 - DNA, 20 bp, Artificial Sequence
  chemically synthesized
catggcctccctaagtccct

SEQ ID NO: 337387 - DNA, 20 bp, Artificial Sequence
  chemically synthesized
atcctagcacttagggactt

SEQ ID NO: 337388 - DNA, 20 bp, Artificial Sequence
  chemically synthesized
tcctagcacttagggactta

SEQ ID NO: 337389 - DNA, 20 bp, Artificial Sequence
  chemically synthesized
ctagcacttagggacttagg

SEQ ID NO: 337390 - DNA, 20 bp, Artificial Sequence
  chemically synthesized
tagcacttagggacttaggg

SEQ ID NO: 337391 - DNA, 20 bp, Artificial Sequence
  chemically synthesized
ctgcctgccatggcctccct

SEQ ID NO: 337392 - DNA, 20 bp, Artificial Sequence
  chemically synthesized
ttagggacttagggaggcca

SEQ ID NO: 337393 - DNA, 20 bp, Artificial Sequence
  chemically synthesized
gggacttagggaggccatgg

SEQ ID NO: 337394 - DNA, 20 bp, Artificial Sequence
  chemically synthesized
ggacttagggaggccatggc

SEQ ID NO: 337395 - DNA, 20 bp, Artificial Sequence
  chemically synthesized
cttagggaggccatggcagg

SEQ ID NO: 337396 - DNA, 20 bp, Artificial Sequence
  chemically synthesized
atctgcgtatctgcctgcca

SEQ ID NO: 337397 - DNA, 20 bp, Artificial Sequence
  chemically synthesized
ggccatggcaggcagatacg

SEQ ID NO: 337398 - DNA, 20 bp, Artificial Sequence
  chemically synthesized
ggcagatacgcagatcacct

SEQ ID NO: 337399 - DNA, 20 bp, Artificial Sequence
  chemically synthesized
gcagatacgcagatcacctg

SEQ ID NO: 337400 - DNA, 20 bp, Artificial Sequence
  chemically synthesized
atacgcagatcacctgaggt

SEQ ID NO: 337401 - DNA, 20 bp, Artificial Sequence
  chemically synthesized
tacgcagatcacctgaggtc

SEQ ID NO: 337402 - DNA, 20 bp, Artificial Sequence
  chemically synthesized
ggtctcaaactcctgacctc

SEQ ID NO: 337403 - DNA, 20 bp, Artificial Sequence
  chemically synthesized
cgcagatcacctgaggtcag

SEQ ID NO: 337404 - DNA, 20 bp, Artificial Sequence
  chemically synthesized
gggtctcaaactcctgacct

SEQ ID NO: 337405 - DNA, 20 bp, Artificial Sequence
  chemically synthesized
tcacctgaggtcaggagttt

SEQ ID NO: 337406 - DNA, 20 bp, Artificial Sequence
  chemically synthesized
aggtcaggagtttgagaccc

SEQ ID NO: 337407 - DNA, 20 bp, Artificial Sequence
  chemically synthesized
gggtttcaccatgttggcca

SEQ ID NO: 337408 - DNA, 20 bp, Artificial Sequence
  chemically synthesized
ggggtttcaccatgttggcc

SEQ ID NO: 337409 - DNA, 20 bp, Artificial Sequence
  chemically synthesized
gtttgagaccctggccaaca

SEQ ID NO: 337410 - DNA, 20 bp, Artificial Sequence
  chemically synthesized
tggggtttcaccatgttggc

SEQ ID NO: 337411 - DNA, 20 bp, Artificial Sequence
  chemically synthesized
gagatggggtttcaccatgt

SEQ ID NO: 337412 - DNA, 20 bp, Artificial Sequence
  chemically synthesized
ttgcatttttagtagagatg

SEQ ID NO: 337413 - DNA, 20 bp, Artificial Sequence
  chemically synthesized
tttgcatttttagtagagat

SEQ ID NO: 337414 - DNA, 20 bp, Artificial Sequence
  chemically synthesized
ttttgcatttttagtagaga

SEQ ID NO: 337415 - DNA, 20 bp, Artificial Sequence
  chemically synthesized
taatttttgcatttttagta

SEQ ID NO: 337416 - DNA, 20 bp, Artificial Sequence
  chemically synthesized
gctaatttttgcatttttag

SEQ ID NO: 337417 - DNA, 20 bp, Artificial Sequence
  chemically synthesized
ccagctaatttttgcatttt

SEQ ID NO: 337418 - DNA, 20 bp, Artificial Sequence
  chemically synthesized
tctactaaaaatgcaaaaat

SEQ ID NO: 337419 - DNA, 20 bp, Artificial Sequence
  chemically synthesized
ctaaaaatgcaaaaattagc

SEQ ID NO: 337420 - DNA, 20 bp, Artificial Sequence
  chemically synthesized
taaaaatgcaaaaattagct

SEQ ID NO: 337421 - DNA, 20 bp, Artificial Sequence
  chemically synthesized
atgcaaaaattagctgggtg

SEQ ID NO: 337422 - DNA, 20 bp, Artificial Sequence
  chemically synthesized
caaaaattagctgggtgtgg

SEQ ID NO: 337423 - DNA, 20 bp, Artificial Sequence
  chemically synthesized
caggcgcccaccaccacacc

SEQ ID NO: 337424 - DNA, 20 bp, Artificial Sequence
  chemically synthesized
aaattagctgggtgtggtgg

SEQ ID NO: 337425 - DNA, 20 bp, Artificial Sequence
  chemically synthesized
aattagctgggtgtggtggt

SEQ ID NO: 337426 - DNA, 20 bp, Artificial Sequence
  chemically synthesized
cccaagtagctgggatttac

SEQ ID NO: 337427 - DNA, 20 bp, Artificial Sequence
  chemically synthesized
tggtgggcgcctgtaaatcc

SEQ ID NO: 337428 - DNA, 20 bp, Artificial Sequence
  chemically synthesized
tcccaagtagctgggattta

SEQ ID NO: 337429 - DNA, 20 bp, Artificial Sequence
  chemically synthesized
gcctgtaaatcccagctact

SEQ ID NO: 337430 - DNA, 20 bp, Artificial Sequence
  chemically synthesized
cctcagcctcccaagtagct

SEQ ID NO: 337431 - DNA, 20 bp, Artificial Sequence
  chemically synthesized
cctgtaaatcccagctactt

SEQ ID NO: 337432 - DNA, 20 bp, Artificial Sequence
  chemically synthesized
acctcagcctcccaagtagc

SEQ ID NO: 337433 - DNA, 20 bp, Artificial Sequence
  chemically synthesized
tgtaaatcccagctacttgg

SEQ ID NO: 337434 - DNA, 20 bp, Artificial Sequence
  chemically synthesized
gtaaatcccagctacttggg

SEQ ID NO: 337435 - DNA, 20 bp, Artificial Sequence
  chemically synthesized
tcctacctcagcctcccaag

SEQ ID NO: 337436 - DNA, 20 bp, Artificial Sequence
  chemically synthesized
ttatcctacctcagcctccc

SEQ ID NO: 337437 - DNA, 20 bp, Artificial Sequence
  chemically synthesized
tcccagctacttgggaggct

SEQ ID NO: 337438 - DNA, 20 bp, Artificial Sequence
  chemically synthesized
cccagctacttgggaggctg

SEQ ID NO: 337439 - DNA, 20 bp, Artificial Sequence
  chemically synthesized
agctacttgggaggctgagg

SEQ ID NO: 337440 - DNA, 20 bp, Artificial Sequence
  chemically synthesized
gctacttgggaggctgaggt

SEQ ID NO: 337441 - DNA, 20 bp, Artificial Sequence
  chemically synthesized
ttcaagtgattatcctacct

SEQ ID NO: 337442 - DNA, 20 bp, Artificial Sequence
  chemically synthesized
ggtaggataatcacttgaac

SEQ ID NO: 337443 - DNA, 20 bp, Artificial Sequence
  chemically synthesized
gtaggataatcacttgaacc

SEQ ID NO: 337444 - DNA, 20 bp, Artificial Sequence
  chemically synthesized
taggataatcacttgaaccg

SEQ ID NO: 337445 - DNA, 20 bp, Artificial Sequence
  chemically synthesized
aacctccacctccccggttc

SEQ ID NO: 337446 - DNA, 20 bp, Artificial Sequence
  chemically synthesized
ggataatcacttgaaccggg

SEQ ID NO: 337447 - DNA, 20 bp, Artificial Sequence
  chemically synthesized
gataatcacttgaaccgggg

SEQ ID NO: 337448 - DNA, 20 bp, Artificial Sequence
  chemically synthesized
aatcacttgaaccggggagg

SEQ ID NO: 337449 - DNA, 20 bp, Artificial Sequence
  chemically synthesized
cactgcaacctccacctccc

SEQ ID NO: 337450 - DNA, 20 bp, Artificial Sequence
  chemically synthesized
tcacttgaaccggggaggtg

SEQ ID NO: 337451 - DNA, 20 bp, Artificial Sequence
  chemically synthesized
cacttgaaccggggaggtgg

SEQ ID NO: 337452 - DNA, 20 bp, Artificial Sequence
  chemically synthesized
aaccggggaggtggaggttg

SEQ ID NO: 337453 - DNA, 20 bp, Artificial Sequence
  chemically synthesized
ggggaggtggaggttgcagt

SEQ ID NO: 337454 - DNA, 20 bp, Artificial Sequence
  chemically synthesized
ccactcaagctggagtgcag

SEQ ID NO: 337455 - DNA, 20 bp, Artificial Sequence
  chemically synthesized
tgcagtgagccactgcactc

SEQ ID NO: 337456 - DNA, 20 bp, Artificial Sequence
  chemically synthesized
ctgccactcaagctggagtg

SEQ ID NO: 337457 - DNA, 20 bp, Artificial Sequence
  chemically synthesized
gagccactgcactccagctt

SEQ ID NO: 337458 - DNA, 20 bp, Artificial Sequence
  chemically synthesized
tcactctgccactcaagctg

SEQ ID NO: 337459 - DNA, 20 bp, Artificial Sequence
  chemically synthesized
ccactgcactccagcttgag

SEQ ID NO: 337460 - DNA, 20 bp, Artificial Sequence
  chemically synthesized
tctcactctgccactcaagc

SEQ ID NO: 337461 - DNA, 20 bp, Artificial Sequence
  chemically synthesized
ctgcactccagcttgagtgg

SEQ ID NO: 337462 - DNA, 20 bp, Artificial Sequence
  chemically synthesized
gaagtctcactctgccactc

SEQ ID NO: 337463 - DNA, 20 bp, Artificial Sequence
  chemically synthesized
gcactccagcttgagtggca

SEQ ID NO: 337464 - DNA, 20 bp, Artificial Sequence
  chemically synthesized
tccagcttgagtggcagagt

SEQ ID NO: 337465 - DNA, 20 bp, Artificial Sequence
  chemically synthesized
tgtgtttctgttttgagatg

SEQ ID NO: 337466 - DNA, 20 bp, Artificial Sequence
  chemically synthesized
agtgagacttcatctcaaaa

SEQ ID NO: 337467 - DNA, 20 bp, Artificial Sequence
  chemically synthesized
tttttttgtgtttctgtttt

SEQ ID NO: 337468 - DNA, 20 bp, Artificial Sequence
  chemically synthesized
tcaaaacagaaacacaaaaa

SEQ ID NO: 337469 - DNA, 20 bp, Artificial Sequence
  chemically synthesized
caaaacagaaacacaaaaaa

SEQ ID NO: 337470 - DNA, 20 bp, Artificial Sequence
  chemically synthesized
aaacagaaacacaaaaaaag

SEQ ID NO: 337471 - DNA, 20 bp, Artificial Sequence
  chemically synthesized
tctgtcctgtggcaaataag

SEQ ID NO: 337472 - DNA, 20 bp, Artificial Sequence
  chemically synthesized
ccatctgtcctgtggcaaat

SEQ ID NO: 337473 - DNA, 20 bp, Artificial Sequence
  chemically synthesized
ggagatcttcttatttgcca

SEQ ID NO: 337474 - DNA, 20 bp, Artificial Sequence
  chemically synthesized
gagatcttcttatttgccac

SEQ ID NO: 337475 - DNA, 20 bp, Artificial Sequence
  chemically synthesized
tcttcttatttgccacagga

SEQ ID NO: 337476 - DNA, 20 bp, Artificial Sequence
  chemically synthesized
cttcggctccatctgtcctg

SEQ ID NO: 337477 - DNA, 20 bp, Artificial Sequence
  chemically synthesized
cttatttgccacaggacaga

SEQ ID NO: 337478 - DNA, 20 bp, Artificial Sequence
  chemically synthesized
tatttgccacaggacagatg

SEQ ID NO: 337479 - DNA, 20 bp, Artificial Sequence
  chemically synthesized
ccacaggacagatggagccg

SEQ ID NO: 337480 - DNA, 20 bp, Artificial Sequence
  chemically synthesized
tcacttagcctaatgttctt

SEQ ID NO: 337481 - DNA, 20 bp, Artificial Sequence
  chemically synthesized
cagatggagccgaagaacat

SEQ ID NO: 337482 - DNA, 20 bp, Artificial Sequence
  chemically synthesized
agatggagccgaagaacatt

SEQ ID NO: 337483 - DNA, 20 bp, Artificial Sequence
  chemically synthesized
gagccgaagaacattaggct

SEQ ID NO: 337484 - DNA, 20 bp, Artificial Sequence
  chemically synthesized
tgtgtcttgcttatttcact

SEQ ID NO: 337485 - DNA, 20 bp, Artificial Sequence
  chemically synthesized
aacattaggctaagtgaaat

SEQ ID NO: 337486 - DNA, 20 bp, Artificial Sequence
  chemically synthesized
ttaggctaagtgaaataagc

SEQ ID NO: 337487 - DNA, 20 bp, Artificial Sequence
  chemically synthesized
taagtgaaataagcaagaca

SEQ ID NO: 337488 - DNA, 20 bp, Artificial Sequence
  chemically synthesized
tgaaataagcaagacacaga

SEQ ID NO: 337489 - DNA, 20 bp, Artificial Sequence
  chemically synthesized
ttcagtttccacaaacaagt

SEQ ID NO: 337490 - DNA, 20 bp, Artificial Sequence
  chemically synthesized
tgcatgatctcacttgtttg

SEQ ID NO: 337491 - DNA, 20 bp, Artificial Sequence
  chemically synthesized
gtttttcagtttccacaaac

SEQ ID NO: 337492 - DNA, 20 bp, Artificial Sequence
  chemically synthesized
catagttactttttgttttt

SEQ ID NO: 337493 - DNA, 20 bp, Artificial Sequence
  chemically synthesized
tgtggaaactgaaaaacaaa

SEQ ID NO: 337494 - DNA, 20 bp, Artificial Sequence
  chemically synthesized
aaacaaaaagtaactatgct

SEQ ID NO: 337495 - DNA, 20 bp, Artificial Sequence
  chemically synthesized
taataaaatgatactcagca

SEQ ID NO: 337496 - DNA, 20 bp, Artificial Sequence
  chemically synthesized
agtggtaataaaatgatact

SEQ ID NO: 337497 - DNA, 20 bp, Artificial Sequence
  chemically synthesized
caaaattaggaaatgtacag

SEQ ID NO: 337498 - DNA, 20 bp, Artificial Sequence
  chemically synthesized
tctcaaaattaggaaatgta

SEQ ID NO: 337499 - DNA, 20 bp, Artificial Sequence
  chemically synthesized
actgtacatttcctaatttt

SEQ ID NO: 337500 - DNA, 20 bp, Artificial Sequence
  chemically synthesized
tgtaaaatgatctcaaaatt

SEQ ID NO: 337501 - DNA, 20 bp, Artificial Sequence
  chemically synthesized
atgtaaaatgatctcaaaat

SEQ ID NO: 337502 - DNA, 20 bp, Artificial Sequence
  chemically synthesized
ttgagatcattttacataat

SEQ ID NO: 337503 - DNA, 20 bp, Artificial Sequence
  chemically synthesized
aaatatatattggaaagcac

SEQ ID NO: 337504 - DNA, 20 bp, Artificial Sequence
  chemically synthesized
tacatgaaatatatattgga

SEQ ID NO: 337505 - DNA, 20 bp, Artificial Sequence
  chemically synthesized
aagttacatgaaatatatat

SEQ ID NO: 337506 - DNA, 20 bp, Artificial Sequence
  chemically synthesized
caatattatatgacgagaga

SEQ ID NO: 337507 - DNA, 20 bp, Artificial Sequence
  chemically synthesized
tagccaatattatatgacga

SEQ ID NO: 337508 - DNA, 20 bp, Artificial Sequence
  chemically synthesized
cctagccaatattatatgac

SEQ ID NO: 337509 - DNA, 20 bp, Artificial Sequence
  chemically synthesized
tttctctcgtcatataatat

SEQ ID NO: 337510 - DNA, 20 bp, Artificial Sequence
  chemically synthesized
tctcgtcatataatattggc

SEQ ID NO: 337511 - DNA, 20 bp, Artificial Sequence
  chemically synthesized
ctcgtcatataatattggct

SEQ ID NO: 337512 - DNA, 20 bp, Artificial Sequence
  chemically synthesized
ataatattggctaggttctc

SEQ ID NO: 337513 - DNA, 20 bp, Artificial Sequence
  chemically synthesized
cagtatttttctggagaacc

SEQ ID NO: 337514 - DNA, 20 bp, Artificial Sequence
  chemically synthesized
cgctgttcagtatttttctg

SEQ ID NO: 337515 - DNA, 20 bp, Artificial Sequence
  chemically synthesized
gacgctgttcagtatttttc

SEQ ID NO: 337516 - DNA, 20 bp, Artificial Sequence
  chemically synthesized
ttctccagaaaaatactgaa

SEQ ID NO: 337517 - DNA, 20 bp, Artificial Sequence
  chemically synthesized
tcctctgtattgacgctgtt

SEQ ID NO: 337518 - DNA, 20 bp, Artificial Sequence
  chemically synthesized
aatactgaacagcgtcaata

SEQ ID NO: 337519 - DNA, 20 bp, Artificial Sequence
  chemically synthesized
tactgaacagcgtcaataca

SEQ ID NO: 337520 - DNA, 20 bp, Artificial Sequence
  chemically synthesized
actgaacagcgtcaatacag

SEQ ID NO: 337521 - DNA, 20 bp, Artificial Sequence
  chemically synthesized
tgaacagcgtcaatacagag

SEQ ID NO: 337522 - DNA, 20 bp, Artificial Sequence
  chemically synthesized
gaacagcgtcaatacagagg

SEQ ID NO: 337523 - DNA, 20 bp, Artificial Sequence
  chemically synthesized
actcaaacaataaatacgac

SEQ ID NO: 337524 - DNA, 20 bp, Artificial Sequence
  chemically synthesized
tcttgtcgtatttattgttt

SEQ ID NO: 337525 - DNA, 20 bp, Artificial Sequence
  chemically synthesized
atttattgtttgagtcattc

SEQ ID NO: 337526 - DNA, 20 bp, Artificial Sequence
  chemically synthesized
tccaaatcatatcaatatgc

SEQ ID NO: 337527 - DNA, 20 bp, Artificial Sequence
  chemically synthesized
tctagcatattgatatgatt

SEQ ID NO: 337528 - DNA, 20 bp, Artificial Sequence
  chemically synthesized
ctcaacatgagatttgggca

SEQ ID NO: 337529 - DNA, 20 bp, Artificial Sequence
  chemically synthesized
actcaacatgagatttgggc

SEQ ID NO: 337530 - DNA, 20 bp, Artificial Sequence
  chemically synthesized
cacaactcaacatgagattt

SEQ ID NO: 337531 - DNA, 20 bp, Artificial Sequence
  chemically synthesized
acacaactcaacatgagatt

SEQ ID NO: 337532 - DNA, 20 bp, Artificial Sequence
  chemically synthesized
ccttgcccaaatctcatgtt

SEQ ID NO: 337533 - DNA, 20 bp, Artificial Sequence
  chemically synthesized
tggggaacacaactcaacat

SEQ ID NO: 337534 - DNA, 20 bp, Artificial Sequence
  chemically synthesized
tcatgttgagttgtgttccc

SEQ ID NO: 337535 - DNA, 20 bp, Artificial Sequence
  chemically synthesized
tgagttgtgttccccagtgt

SEQ ID NO: 337536 - DNA, 20 bp, Artificial Sequence
  chemically synthesized
aggcccctcctccaacactg

SEQ ID NO: 337537 - DNA, 20 bp, Artificial Sequence
  chemically synthesized
agttgtgttccccagtgttg

SEQ ID NO: 337538 - DNA, 20 bp, Artificial Sequence
  chemically synthesized
caggcccctcctccaacact

SEQ ID NO: 337539 - DNA, 20 bp, Artificial Sequence
  chemically synthesized
gttgtgttccccagtgttgg

SEQ ID NO: 337540 - DNA, 20 bp, Artificial Sequence
  chemically synthesized
ccaggcccctcctccaacac

SEQ ID NO: 337541 - DNA, 20 bp, Artificial Sequence
  chemically synthesized
tgtgttccccagtgttggag

SEQ ID NO: 337542 - DNA, 20 bp, Artificial Sequence
  chemically synthesized
gtgttccccagtgttggagg

SEQ ID NO: 337543 - DNA, 20 bp, Artificial Sequence
  chemically synthesized
tgttccccagtgttggagga

SEQ ID NO: 337544 - DNA, 20 bp, Artificial Sequence
  chemically synthesized
gttccccagtgttggaggag

SEQ ID NO: 337545 - DNA, 20 bp, Artificial Sequence
  chemically synthesized
ccagtgttggaggaggggcc

SEQ ID NO: 337546 - DNA, 20 bp, Artificial Sequence
  chemically synthesized
gtgttggaggaggggcctgg

SEQ ID NO: 337547 - DNA, 20 bp, Artificial Sequence
  chemically synthesized
tgttggaggaggggcctggt

SEQ ID NO: 337548 - DNA, 20 bp, Artificial Sequence
  chemically synthesized
ttggaggaggggcctggtgg

SEQ ID NO: 337549 - DNA, 20 bp, Artificial Sequence
  chemically synthesized
tgatcctatcatctcccacc

SEQ ID NO: 337550 - DNA, 20 bp, Artificial Sequence
  chemically synthesized
atgatcctatcatctcccac

SEQ ID NO: 337551 - DNA, 20 bp, Artificial Sequence
  chemically synthesized
aggggcctggtgggagatga

SEQ ID NO: 337552 - DNA, 20 bp, Artificial Sequence
  chemically synthesized
ggggcctggtgggagatgat

SEQ ID NO: 337553 - DNA, 20 bp, Artificial Sequence
  chemically synthesized
gtgggagatgataggatcat

SEQ ID NO: 337554 - DNA, 20 bp, Artificial Sequence
  chemically synthesized
tgggagatgataggatcatg

SEQ ID NO: 337555 - DNA, 20 bp, Artificial Sequence
  chemically synthesized
gggagatgataggatcatga

SEQ ID NO: 337556 - DNA, 20 bp, Artificial Sequence
  chemically synthesized
gatcatgagggtgaatttcc

SEQ ID NO: 337557 - DNA, 20 bp, Artificial Sequence
  chemically synthesized
ttatcatgagaacagcaact

SEQ ID NO: 337558 - DNA, 20 bp, Artificial Sequence
  chemically synthesized
attatcatgagaacagcaac

SEQ ID NO: 337559 - DNA, 20 bp, Artificial Sequence
  chemically synthesized
agaactcattatcatgagaa

SEQ ID NO: 337560 - DNA, 20 bp, Artificial Sequence
  chemically synthesized
tcatgagaactcattatcat

SEQ ID NO: 337561 - DNA, 20 bp, Artificial Sequence
  chemically synthesized
gttgctgttctcatgataat

SEQ ID NO: 337562 - DNA, 20 bp, Artificial Sequence
  chemically synthesized
tcatgataatgagttctcat

SEQ ID NO: 337563 - DNA, 20 bp, Artificial Sequence
  chemically synthesized
tttaaacaaccagatctcat

SEQ ID NO: 337564 - DNA, 20 bp, Artificial Sequence
  chemically synthesized
taatgagttctcatgagatc

SEQ ID NO: 337565 - DNA, 20 bp, Artificial Sequence
  chemically synthesized
actacacacttttaaacaac

SEQ ID NO: 337566 - DNA, 20 bp, Artificial Sequence
  chemically synthesized
catgagatctggttgtttaa

SEQ ID NO: 337567 - DNA, 20 bp, Artificial Sequence
  chemically synthesized
tctggttgtttaaaagtgtg

SEQ ID NO: 337568 - DNA, 20 bp, Artificial Sequence
  chemically synthesized
aaggaggagaaagcaggggg

SEQ ID NO: 337569 - DNA, 20 bp, Artificial Sequence
  chemically synthesized
gagaaggaggagaaagcagg

SEQ ID NO: 337570 - DNA, 20 bp, Artificial Sequence
  chemically synthesized
agagaaggaggagaaagcag

SEQ ID NO: 337571 - DNA, 20 bp, Artificial Sequence
  chemically synthesized
cagagaaggaggagaaagca

SEQ ID NO: 337572 - DNA, 20 bp, Artificial Sequence
  chemically synthesized
ccagagaaggaggagaaagc

SEQ ID NO: 337573 - DNA, 20 bp, Artificial Sequence
  chemically synthesized
gccagagaaggaggagaaag

SEQ ID NO: 337574 - DNA, 20 bp, Artificial Sequence
  chemically synthesized
atggccagagaaggaggaga

SEQ ID NO: 337575 - DNA, 20 bp, Artificial Sequence
  chemically synthesized
ttacatggccagagaaggag

SEQ ID NO: 337576 - DNA, 20 bp, Artificial Sequence
  chemically synthesized
cctgctttctcctccttctc

SEQ ID NO: 337577 - DNA, 20 bp, Artificial Sequence
  chemically synthesized
ccttacatggccagagaagg

SEQ ID NO: 337578 - DNA, 20 bp, Artificial Sequence
  chemically synthesized
accttacatggccagagaag

SEQ ID NO: 337579 - DNA, 20 bp, Artificial Sequence
  chemically synthesized
ataccttacatggccagaga

SEQ ID NO: 337580 - DNA, 20 bp, Artificial Sequence
  chemically synthesized
tataccttacatggccagag

SEQ ID NO: 337581 - DNA, 20 bp, Artificial Sequence
  chemically synthesized
tcttataccttacatggcca

SEQ ID NO: 337582 - DNA, 20 bp, Artificial Sequence
  chemically synthesized
tcctccttctctggccatgt

SEQ ID NO: 337583 - DNA, 20 bp, Artificial Sequence
  chemically synthesized
catcttataccttacatggc

SEQ ID NO: 337584 - DNA, 20 bp, Artificial Sequence
  chemically synthesized
cctccttctctggccatgta

SEQ ID NO: 337585 - DNA, 20 bp, Artificial Sequence
  chemically synthesized
ggcacatcttataccttaca

SEQ ID NO: 337586 - DNA, 20 bp, Artificial Sequence
  chemically synthesized
tctctggccatgtaaggtat

SEQ ID NO: 337587 - DNA, 20 bp, Artificial Sequence
  chemically synthesized
gtggaaggcgaaggggaagc

SEQ ID NO: 337588 - DNA, 20 bp, Artificial Sequence
  chemically synthesized
tgtggaaggcgaaggggaag

SEQ ID NO: 337589 - DNA, 20 bp, Artificial Sequence
  chemically synthesized
tcttgtggaaggcgaagggg

SEQ ID NO: 337590 - DNA, 20 bp, Artificial Sequence
  chemically synthesized
ccttcttgtggaaggcgaag

SEQ ID NO: 337591 - DNA, 20 bp, Artificial Sequence
  chemically synthesized
accttcttgtggaaggcgaa

SEQ ID NO: 337592 - DNA, 20 bp, Artificial Sequence
  chemically synthesized
caccttcttgtggaaggcga

SEQ ID NO: 337593 - DNA, 20 bp, Artificial Sequence
  chemically synthesized
ccaccttcttgtggaaggcg

SEQ ID NO: 337594 - DNA, 20 bp, Artificial Sequence
  chemically synthesized
gcttccccttcgccttccac

SEQ ID NO: 337595 - DNA, 20 bp, Artificial Sequence
  chemically synthesized
aatttccaccttcttgtgga

SEQ ID NO: 337596 - DNA, 20 bp, Artificial Sequence
  chemically synthesized
tccccttcgccttccacaag

SEQ ID NO: 337597 - DNA, 20 bp, Artificial Sequence
  chemically synthesized
aaatttccaccttcttgtgg

SEQ ID NO: 337598 - DNA, 20 bp, Artificial Sequence
  chemically synthesized
ccccttcgccttccacaaga

SEQ ID NO: 337599 - DNA, 20 bp, Artificial Sequence
  chemically synthesized
aggaaatttccaccttcttg

SEQ ID NO: 337600 - DNA, 20 bp, Artificial Sequence
  chemically synthesized
cttcgccttccacaagaagg

SEQ ID NO: 337601 - DNA, 20 bp, Artificial Sequence
  chemically synthesized
caagaaggtggaaatttcct

SEQ ID NO: 337602 - DNA, 20 bp, Artificial Sequence
  chemically synthesized
aagaaggtggaaatttcctg

SEQ ID NO: 337603 - DNA, 20 bp, Artificial Sequence
  chemically synthesized
agtatggctggggatacctc

SEQ ID NO: 337604 - DNA, 20 bp, Artificial Sequence
  chemically synthesized
aagtatggctggggatacct

SEQ ID NO: 337605 - DNA, 20 bp, Artificial Sequence
  chemically synthesized
gaaatttcctgaggtatccc

SEQ ID NO: 337606 - DNA, 20 bp, Artificial Sequence
  chemically synthesized
ctgtacaggaagtatggctg

SEQ ID NO: 337607 - DNA, 20 bp, Artificial Sequence
  chemically synthesized
gctgtacaggaagtatggct

SEQ ID NO: 337608 - DNA, 20 bp, Artificial Sequence
  chemically synthesized
ggctgtacaggaagtatggc

SEQ ID NO: 337609 - DNA, 20 bp, Artificial Sequence
  chemically synthesized
ttcaggctgtacaggaagta

SEQ ID NO: 337610 - DNA, 20 bp, Artificial Sequence
  chemically synthesized
ccccagccatacttcctgta

SEQ ID NO: 337611 - DNA, 20 bp, Artificial Sequence
  chemically synthesized
agttcttcaggctgtacagg

SEQ ID NO: 337612 - DNA, 20 bp, Artificial Sequence
  chemically synthesized
caaagttcttcaggctgtac

SEQ ID NO: 337613 - DNA, 20 bp, Artificial Sequence
  chemically synthesized
tcaaagttcttcaggctgta

SEQ ID NO: 337614 - DNA, 20 bp, Artificial Sequence
  chemically synthesized
catacttcctgtacagcctg

SEQ ID NO: 337615 - DNA, 20 bp, Artificial Sequence
  chemically synthesized
tacttaactcaaagttcttc

SEQ ID NO: 337616 - DNA, 20 bp, Artificial Sequence
  chemically synthesized
ttacttaactcaaagttctt

SEQ ID NO: 337617 - DNA, 20 bp, Artificial Sequence
  chemically synthesized
tgtacagcctgaagaacttt

SEQ ID NO: 337618 - DNA, 20 bp, Artificial Sequence
  chemically synthesized
agcctgaagaactttgagtt

SEQ ID NO: 337619 - DNA, 20 bp, Artificial Sequence
  chemically synthesized
taagaggtttacttaactca

SEQ ID NO: 337620 - DNA, 20 bp, Artificial Sequence
  chemically synthesized
gagtaatttgtaaagataag

SEQ ID NO: 337621 - DNA, 20 bp, Artificial Sequence
  chemically synthesized
tgagtaatttgtaaagataa

SEQ ID NO: 337622 - DNA, 20 bp, Artificial Sequence
  chemically synthesized
attgagtaatttgtaaagat

SEQ ID NO: 337623 - DNA, 20 bp, Artificial Sequence
  chemically synthesized
ctgagattgagtaatttgta

SEQ ID NO: 337624 - DNA, 20 bp, Artificial Sequence
  chemically synthesized
ctttacaaattactcaatct

SEQ ID NO: 337625 - DNA, 20 bp, Artificial Sequence
  chemically synthesized
tttacaaattactcaatctc

SEQ ID NO: 337626 - DNA, 20 bp, Artificial Sequence
  chemically synthesized
gctataaactacctgagatt

SEQ ID NO: 337627 - DNA, 20 bp, Artificial Sequence
  chemically synthesized
acaaattactcaatctcagg

SEQ ID NO: 337628 - DNA, 20 bp, Artificial Sequence
  chemically synthesized
cgcattgctataaactacct

SEQ ID NO: 337629 - DNA, 20 bp, Artificial Sequence
  chemically synthesized
actcaatctcaggtagttta

SEQ ID NO: 337630 - DNA, 20 bp, Artificial Sequence
  chemically synthesized
caggtagtttatagcaatgc

SEQ ID NO: 337631 - DNA, 20 bp, Artificial Sequence
  chemically synthesized
tagtttatagcaatgcgaga

SEQ ID NO: 337632 - DNA, 20 bp, Artificial Sequence
  chemically synthesized
agtttatagcaatgcgagaa

SEQ ID NO: 337633 - DNA, 20 bp, Artificial Sequence
  chemically synthesized
aatgcgagaaaggactaata

SEQ ID NO: 337634 - DNA, 20 bp, Artificial Sequence
  chemically synthesized
tcggtaccaattttctgtat

SEQ ID NO: 337635 - DNA, 20 bp, Artificial Sequence
  chemically synthesized
aaaggactaatacagaaaat

SEQ ID NO: 337636 - DNA, 20 bp, Artificial Sequence
  chemically synthesized
taatacagaaaattggtacc

SEQ ID NO: 337637 - DNA, 20 bp, Artificial Sequence
  chemically synthesized
atacagaaaattggtaccga

SEQ ID NO: 337638 - DNA, 20 bp, Artificial Sequence
  chemically synthesized
tacagaaaattggtaccgag

SEQ ID NO: 337639 - DNA, 20 bp, Artificial Sequence
  chemically synthesized
agaaaattggtaccgagagg

SEQ ID NO: 337640 - DNA, 20 bp, Artificial Sequence
  chemically synthesized
gaaaattggtaccgagaggt

SEQ ID NO: 337641 - DNA, 20 bp, Artificial Sequence
  chemically synthesized
aaaattggtaccgagaggta

SEQ ID NO: 337642 - DNA, 20 bp, Artificial Sequence
  chemically synthesized
cgtagcagtgccctacctct

SEQ ID NO: 337643 - DNA, 20 bp, Artificial Sequence
  chemically synthesized
agaggtagggcactgctacg

SEQ ID NO: 337644 - DNA, 20 bp, Artificial Sequence
  chemically synthesized
gttctcatgtatcttcgtag

SEQ ID NO: 337645 - DNA, 20 bp, Artificial Sequence
  chemically synthesized
cacgttctcatgtatcttcg

SEQ ID NO: 337646 - DNA, 20 bp, Artificial Sequence
  chemically synthesized
gcactgctacgaagatacat

SEQ ID NO: 337647 - DNA, 20 bp, Artificial Sequence
  chemically synthesized
tacgaagatacatgagaacg

SEQ ID NO: 337648 - DNA, 20 bp, Artificial Sequence
  chemically synthesized
tgagaacgtggaactaactt

SEQ ID NO: 337649 - DNA, 20 bp, Artificial Sequence
  chemically synthesized
ttcttactctgttccaaagt

SEQ ID NO: 337650 - DNA, 20 bp, Artificial Sequence
  chemically synthesized
acgtggaactaactttggaa

SEQ ID NO: 337651 - DNA, 20 bp, Artificial Sequence
  chemically synthesized
gtggaactaactttggaaca

SEQ ID NO: 337652 - DNA, 20 bp, Artificial Sequence
  chemically synthesized
gtgcttcttactctgttcca

SEQ ID NO: 337653 - DNA, 20 bp, Artificial Sequence
  chemically synthesized
aactaactttggaacagagt

SEQ ID NO: 337654 - DNA, 20 bp, Artificial Sequence
  chemically synthesized
taactttggaacagagtaag

SEQ ID NO: 337655 - DNA, 20 bp, Artificial Sequence
  chemically synthesized
acagagtaagaagcacacgt

SEQ ID NO: 337656 - DNA, 20 bp, Artificial Sequence
  chemically synthesized
gtaagaagcacacgttggaa

SEQ ID NO: 337657 - DNA, 20 bp, Artificial Sequence
  chemically synthesized
aagcacacgttggaacagtg

SEQ ID NO: 337658 - DNA, 20 bp, Artificial Sequence
  chemically synthesized
gcacacgttggaacagtgtg

SEQ ID NO: 337659 - DNA, 20 bp, Artificial Sequence
  chemically synthesized
ttggaacagtgtggagcgct

SEQ ID NO: 337660 - DNA, 20 bp, Artificial Sequence
  chemically synthesized
gaacagtgtggagcgctcag

SEQ ID NO: 337661 - DNA, 20 bp, Artificial Sequence
  chemically synthesized
agtgtggagcgctcagaaga

SEQ ID NO: 337662 - DNA, 20 bp, Artificial Sequence
  chemically synthesized
gtgtggagcgctcagaagac

SEQ ID NO: 337663 - DNA, 20 bp, Artificial Sequence
  chemically synthesized
ccctcatcttcctgtcttct

SEQ ID NO: 337664 - DNA, 20 bp, Artificial Sequence
  chemically synthesized
tggagcgctcagaagacagg

SEQ ID NO: 337665 - DNA, 20 bp, Artificial Sequence
  chemically synthesized
cgctcagaagacaggaagat

SEQ ID NO: 337666 - DNA, 20 bp, Artificial Sequence
  chemically synthesized
gctcagaagacaggaagatg

SEQ ID NO: 337667 - DNA, 20 bp, Artificial Sequence
  chemically synthesized
ctcagaagacaggaagatga

SEQ ID NO: 337668 - DNA, 20 bp, Artificial Sequence
  chemically synthesized
gaagacaggaagatgaggga

SEQ ID NO: 337669 - DNA, 20 bp, Artificial Sequence
  chemically synthesized
agggaaagtttgtaacttcc

SEQ ID NO: 337670 - DNA, 20 bp, Artificial Sequence
  chemically synthesized
ggaaagtttgtaacttccta

SEQ ID NO: 337671 - DNA, 20 bp, Artificial Sequence
  chemically synthesized
aagcagttcaagtctctagg

SEQ ID NO: 337672 - DNA, 20 bp, Artificial Sequence
  chemically synthesized
tccaagcagttcaagtctct

SEQ ID NO: 337673 - DNA, 20 bp, Artificial Sequence
  chemically synthesized
gtccaagcagttcaagtctc

SEQ ID NO: 337674 - DNA, 20 bp, Artificial Sequence
  chemically synthesized
cattttggtccaagcagttc

SEQ ID NO: 337675 - DNA, 20 bp, Artificial Sequence
  chemically synthesized
tcctagagacttgaactgct

SEQ ID NO: 337676 - DNA, 20 bp, Artificial Sequence
  chemically synthesized
tatcagcattttggtccaag

SEQ ID NO: 337677 - DNA, 20 bp, Artificial Sequence
  chemically synthesized
caatatcagcattttggtcc

SEQ ID NO: 337678 - DNA, 20 bp, Artificial Sequence
  chemically synthesized
ccatatcaatatcagcattt

SEQ ID NO: 337679 - DNA, 20 bp, Artificial Sequence
  chemically synthesized
ctcattgtccatatcaatat

SEQ ID NO: 337680 - DNA, 20 bp, Artificial Sequence
  chemically synthesized
ccaaaatgctgatattgata

SEQ ID NO: 337681 - DNA, 20 bp, Artificial Sequence
  chemically synthesized
ctgatattgatatggacaat

SEQ ID NO: 337682 - DNA, 20 bp, Artificial Sequence
  chemically synthesized
ttgatatggacaatgagatc

SEQ ID NO: 337683 - DNA, 20 bp, Artificial Sequence
  chemically synthesized
tgatatggacaatgagatcc

SEQ ID NO: 337684 - DNA, 20 bp, Artificial Sequence
  chemically synthesized
tggacaatgagatccaggct

SEQ ID NO: 337685 - DNA, 20 bp, Artificial Sequence
  chemically synthesized
ggacaatgagatccaggctg

SEQ ID NO: 337686 - DNA, 20 bp, Artificial Sequence
  chemically synthesized
catctgagaccacctcagcc

SEQ ID NO: 337687 - DNA, 20 bp, Artificial Sequence
  chemically synthesized
caatgagatccaggctgagg

SEQ ID NO: 337688 - DNA, 20 bp, Artificial Sequence
  chemically synthesized
atcttcatctgagaccacct

SEQ ID NO: 337689 - DNA, 20 bp, Artificial Sequence
  chemically synthesized
gatccaggctgaggtggtct

SEQ ID NO: 337690 - DNA, 20 bp, Artificial Sequence
  chemically synthesized
ggctgaggtggtctcagatg

SEQ ID NO: 337691 - DNA, 20 bp, Artificial Sequence
  chemically synthesized
taagttcctcatcttcatct

SEQ ID NO: 337692 - DNA, 20 bp, Artificial Sequence
  chemically synthesized
aggtggtctcagatgaagat

SEQ ID NO: 337693 - DNA, 20 bp, Artificial Sequence
  chemically synthesized
ggtggtctcagatgaagatg

SEQ ID NO: 337694 - DNA, 20 bp, Artificial Sequence
  chemically synthesized
gatgaagatgaggaacttat

SEQ ID NO: 337695 - DNA, 20 bp, Artificial Sequence
  chemically synthesized
atgaagatgaggaacttatt

SEQ ID NO: 337696 - DNA, 20 bp, Artificial Sequence
  chemically synthesized
cctttattgcagttcccaat

SEQ ID NO: 337697 - DNA, 20 bp, Artificial Sequence
  chemically synthesized
acttattgggaactgcaata

SEQ ID NO: 337698 - DNA, 20 bp, Artificial Sequence
  chemically synthesized
cttattgggaactgcaataa

SEQ ID NO: 337699 - DNA, 20 bp, Artificial Sequence
  chemically synthesized
tgcgagagtgacctttattg

SEQ ID NO: 337700 - DNA, 20 bp, Artificial Sequence
  chemically synthesized
tttttgttaaagcattgcga

SEQ ID NO: 337701 - DNA, 20 bp, Artificial Sequence
  chemically synthesized
tctttttgttaaagcattgc

SEQ ID NO: 337702 - DNA, 20 bp, Artificial Sequence
  chemically synthesized
tctcgcaatgctttaacaaa

SEQ ID NO: 337703 - DNA, 20 bp, Artificial Sequence
  chemically synthesized
ctgccaatctctttttgtta

SEQ ID NO: 337704 - DNA, 20 bp, Artificial Sequence
  chemically synthesized
tcgcaatgctttaacaaaaa

SEQ ID NO: 337705 - DNA, 20 bp, Artificial Sequence
  chemically synthesized
atgctttaacaaaaagagat

SEQ ID NO: 337706 - DNA, 20 bp, Artificial Sequence
  chemically synthesized
ctttaacaaaaagagattgg

SEQ ID NO: 337707 - DNA, 20 bp, Artificial Sequence
  chemically synthesized
gcagcattgtgcccctgctc

SEQ ID NO: 337708 - DNA, 20 bp, Artificial Sequence
  chemically synthesized
cagcattgtgcccctgctct

SEQ ID NO: 337709 - DNA, 20 bp, Artificial Sequence
  chemically synthesized
tccacacatacctagagcag

SEQ ID NO: 337710 - DNA, 20 bp, Artificial Sequence
  chemically synthesized
ttccacacatacctagagca

SEQ ID NO: 337711 - DNA, 20 bp, Artificial Sequence
  chemically synthesized
gttccacacatacctagagc

SEQ ID NO: 337712 - DNA, 20 bp, Artificial Sequence
  chemically synthesized
agttccacacatacctagag

SEQ ID NO: 337713 - DNA, 20 bp, Artificial Sequence
  chemically synthesized
aaaagttccacacataccta

SEQ ID NO: 337714 - DNA, 20 bp, Artificial Sequence
  chemically synthesized
ttaaaagttccacacatacc

SEQ ID NO: 337715 - DNA, 20 bp, Artificial Sequence
  chemically synthesized
gcccctgctctaggtatgtg

SEQ ID NO: 337716 - DNA, 20 bp, Artificial Sequence
  chemically synthesized
atgtgtggaacttttaactt

SEQ ID NO: 337717 - DNA, 20 bp, Artificial Sequence
  chemically synthesized
aatcatcagtctcaagttaa

SEQ ID NO: 337718 - DNA, 20 bp, Artificial Sequence
  chemically synthesized
taccctaaatcatcagtctc

SEQ ID NO: 337719 - DNA, 20 bp, Artificial Sequence
  chemically synthesized
ttaacttgagactgatgatt

SEQ ID NO: 337720 - DNA, 20 bp, Artificial Sequence
  chemically synthesized
taacttgagactgatgattt

SEQ ID NO: 337721 - DNA, 20 bp, Artificial Sequence
  chemically synthesized
taccatataccctaaatcat

SEQ ID NO: 337722 - DNA, 20 bp, Artificial Sequence
  chemically synthesized
aacttgagactgatgattta

SEQ ID NO: 337723 - DNA, 20 bp, Artificial Sequence
  chemically synthesized
gactgatgatttagggtata

SEQ ID NO: 337724 - DNA, 20 bp, Artificial Sequence
  chemically synthesized
tgatgatttagggtatatgg

SEQ ID NO: 337725 - DNA, 20 bp, Artificial Sequence
  chemically synthesized
tgatttagggtatatggtag

SEQ ID NO: 337726 - DNA, 20 bp, Artificial Sequence
  chemically synthesized
tggtagaagaaatttctaac

SEQ ID NO: 337727 - DNA, 20 bp, Artificial Sequence
  chemically synthesized
atcttaaatgttttgctggt

SEQ ID NO: 337728 - DNA, 20 bp, Artificial Sequence
  chemically synthesized
tcacatcttaaatgttttgc

SEQ ID NO: 337729 - DNA, 20 bp, Artificial Sequence
  chemically synthesized
ttctaaccagcaaaacattt

SEQ ID NO: 337730 - DNA, 20 bp, Artificial Sequence
  chemically synthesized
aaaacatttaagatgtgacc

SEQ ID NO: 337731 - DNA, 20 bp, Artificial Sequence
  chemically synthesized
gtatactgttagaagaagcc

SEQ ID NO: 337732 - DNA, 20 bp, Artificial Sequence
  chemically synthesized
cgtatactgttagaagaagc

SEQ ID NO: 337733 - DNA, 20 bp, Artificial Sequence
  chemically synthesized
tgtgacctggcttcttctaa

SEQ ID NO: 337734 - DNA, 20 bp, Artificial Sequence
  chemically synthesized
tgaccgtatactgttagaag

SEQ ID NO: 337735 - DNA, 20 bp, Artificial Sequence
  chemically synthesized
atatgaccgtatactgttag

SEQ ID NO: 337736 - DNA, 20 bp, Artificial Sequence
  chemically synthesized
tacatatgaccgtatactgt

SEQ ID NO: 337737 - DNA, 20 bp, Artificial Sequence
  chemically synthesized
tggcttcttctaacagtata

SEQ ID NO: 337738 - DNA, 20 bp, Artificial Sequence
  chemically synthesized
cagtatacggtcatatgtat

SEQ ID NO: 337739 - DNA, 20 bp, Artificial Sequence
  chemically synthesized
tacggtcatatgtatgagca

SEQ ID NO: 337740 - DNA, 20 bp, Artificial Sequence
  chemically synthesized
cggtcatatgtatgagcaaa

SEQ ID NO: 337741 - DNA, 20 bp, Artificial Sequence
  chemically synthesized
gcaaagagattatctgaaac

SEQ ID NO: 337742 - DNA, 20 bp, Artificial Sequence
  chemically synthesized
ttaaatataagttccagttt

SEQ ID NO: 337743 - DNA, 20 bp, Artificial Sequence
  chemically synthesized
tcccttttaaatataagttc

SEQ ID NO: 337744 - DNA, 20 bp, Artificial Sequence
  chemically synthesized
tctgcttcccttttaaatat

SEQ ID NO: 337745 - DNA, 20 bp, Artificial Sequence
  chemically synthesized
aaactggaacttatatttaa

SEQ ID NO: 337746 - DNA, 20 bp, Artificial Sequence
  chemically synthesized
aactggaacttatatttaaa

SEQ ID NO: 337747 - DNA, 20 bp, Artificial Sequence
  chemically synthesized
actggaacttatatttaaaa

SEQ ID NO: 337748 - DNA, 20 bp, Artificial Sequence
  chemically synthesized
ggaacttatatttaaaaggg

SEQ ID NO: 337749 - DNA, 20 bp, Artificial Sequence
  chemically synthesized
acttatatttaaaagggaag

SEQ ID NO: 337750 - DNA, 20 bp, Artificial Sequence
  chemically synthesized
ttatatttaaaagggaagca

SEQ ID NO: 337751 - DNA, 20 bp, Artificial Sequence
  chemically synthesized
aaaagggaagcagagcataa

SEQ ID NO: 337752 - DNA, 20 bp, Artificial Sequence
  chemically synthesized
ggaagcagagcataaaagtt

SEQ ID NO: 337753 - DNA, 20 bp, Artificial Sequence
  chemically synthesized
ataaaagtttagaaaatttg

SEQ ID NO: 337754 - DNA, 20 bp, Artificial Sequence
  chemically synthesized
aaatttgcagcctgaccatg

SEQ ID NO: 337755 - DNA, 20 bp, Artificial Sequence
  chemically synthesized
ttgttttctaccacatggtc

SEQ ID NO: 337756 - DNA, 20 bp, Artificial Sequence
  chemically synthesized
tttgttttctaccacatggt

SEQ ID NO: 337757 - DNA, 20 bp, Artificial Sequence
  chemically synthesized
tttgcagcctgaccatgtgg

SEQ ID NO: 337758 - DNA, 20 bp, Artificial Sequence
  chemically synthesized
ggcttttgttttctaccaca

SEQ ID NO: 337759 - DNA, 20 bp, Artificial Sequence
  chemically synthesized
gaccatgtggtagaaaacaa

SEQ ID NO: 337760 - DNA, 20 bp, Artificial Sequence
  chemically synthesized
aaaacaaaagcctattttct

SEQ ID NO: 337761 - DNA, 20 bp, Artificial Sequence
  chemically synthesized
ccccaccaccccgagaaaat

SEQ ID NO: 337762 - DNA, 20 bp, Artificial Sequence
  chemically synthesized
aaacaaaagcctattttctc

SEQ ID NO: 337763 - DNA, 20 bp, Artificial Sequence
  chemically synthesized
cccccaccaccccgagaaaa

SEQ ID NO: 337764 - DNA, 20 bp, Artificial Sequence
  chemically synthesized
aacaaaagcctattttctcg

SEQ ID NO: 337765 - DNA, 20 bp, Artificial Sequence
  chemically synthesized
aaaagcctattttctcgggg

SEQ ID NO: 337766 - DNA, 20 bp, Artificial Sequence
  chemically synthesized
agcctattttctcggggtgg

SEQ ID NO: 337767 - DNA, 20 bp, Artificial Sequence
  chemically synthesized
tgaatttcccccaccacccc

SEQ ID NO: 337768 - DNA, 20 bp, Artificial Sequence
  chemically synthesized
gcctattttctcggggtggt

SEQ ID NO: 337769 - DNA, 20 bp, Artificial Sequence
  chemically synthesized
cctattttctcggggtggtg

SEQ ID NO: 337770 - DNA, 20 bp, Artificial Sequence
  chemically synthesized
ctattttctcggggtggtgg

SEQ ID NO: 337771 - DNA, 20 bp, Artificial Sequence
  chemically synthesized
cggggtggtgggggaaattc

SEQ ID NO: 337772 - DNA, 20 bp, Artificial Sequence
  chemically synthesized
ggggaaattcaagctgtctg

SEQ ID NO: 337773 - DNA, 20 bp, Artificial Sequence
  chemically synthesized
cttatgcaaatttccgcaga

SEQ ID NO: 337774 - DNA, 20 bp, Artificial Sequence
  chemically synthesized
tttacttatgcaaatttccg

SEQ ID NO: 337775 - DNA, 20 bp, Artificial Sequence
  chemically synthesized
ctgtctgcggaaatttgcat

SEQ ID NO: 337776 - DNA, 20 bp, Artificial Sequence
  chemically synthesized
cggaaatttgcataagtaaa

SEQ ID NO: 337777 - DNA, 20 bp, Artificial Sequence
  chemically synthesized
ggaaatttgcataagtaaaa

SEQ ID NO: 337778 - DNA, 20 bp, Artificial Sequence
  chemically synthesized
ttgtcttggttattaacatt

SEQ ID NO: 337779 - DNA, 20 bp, Artificial Sequence
  chemically synthesized
ggaactgaatgttaataacc

SEQ ID NO: 337780 - DNA, 20 bp, Artificial Sequence
  chemically synthesized
gaatgttaataaccaagaca

SEQ ID NO: 337781 - DNA, 20 bp, Artificial Sequence
  chemically synthesized
aatgttaataaccaagacaa

SEQ ID NO: 337782 - DNA, 20 bp, Artificial Sequence
  chemically synthesized
atgttaataaccaagacaaa

SEQ ID NO: 337783 - DNA, 20 bp, Artificial Sequence
  chemically synthesized
gggcattttcccctttgtct

SEQ ID NO: 337784 - DNA, 20 bp, Artificial Sequence
  chemically synthesized
tgttaataaccaagacaaag

SEQ ID NO: 337785 - DNA, 20 bp, Artificial Sequence
  chemically synthesized
gacaaaggggaaaatgccca

SEQ ID NO: 337786 - DNA, 20 bp, Artificial Sequence
  chemically synthesized
acaaaggggaaaatgcccaa

SEQ ID NO: 337787 - DNA, 20 bp, Artificial Sequence
  chemically synthesized
aagggttctgaaatgccttt

SEQ ID NO: 337788 - DNA, 20 bp, Artificial Sequence
  chemically synthesized
aaagggttctgaaatgcctt

SEQ ID NO: 337789 - DNA, 20 bp, Artificial Sequence
  chemically synthesized
gaaaatgcccaaaggcattt

SEQ ID NO: 337790 - DNA, 20 bp, Artificial Sequence
  chemically synthesized
aggcatttcagaaccctttg

SEQ ID NO: 337791 - DNA, 20 bp, Artificial Sequence
  chemically synthesized
catttcagaaccctttgcag

SEQ ID NO: 337792 - DNA, 20 bp, Artificial Sequence
  chemically synthesized
ataggaggggctgctgcaaa

SEQ ID NO: 337793 - DNA, 20 bp, Artificial Sequence
  chemically synthesized
gataggaggggctgctgcaa

SEQ ID NO: 337794 - DNA, 20 bp, Artificial Sequence
  chemically synthesized
tgataggaggggctgctgca

SEQ ID NO: 337795 - DNA, 20 bp, Artificial Sequence
  chemically synthesized
ctccagacctgtgataggag

SEQ ID NO: 337796 - DNA, 20 bp, Artificial Sequence
  chemically synthesized
cctccagacctgtgatagga

SEQ ID NO: 337797 - DNA, 20 bp, Artificial Sequence
  chemically synthesized
tgcagcagcccctcctatca

SEQ ID NO: 337798 - DNA, 20 bp, Artificial Sequence
  chemically synthesized
acctccagacctgtgatagg

SEQ ID NO: 337799 - DNA, 20 bp, Artificial Sequence
  chemically synthesized
gcagcagcccctcctatcac

SEQ ID NO: 337800 - DNA, 20 bp, Artificial Sequence
  chemically synthesized
gacctccagacctgtgatag

SEQ ID NO: 337801 - DNA, 20 bp, Artificial Sequence
  chemically synthesized
tagacctccagacctgtgat

SEQ ID NO: 337802 - DNA, 20 bp, Artificial Sequence
  chemically synthesized
ctagacctccagacctgtga

SEQ ID NO: 337803 - DNA, 20 bp, Artificial Sequence
  chemically synthesized
agcccctcctatcacaggtc

SEQ ID NO: 337804 - DNA, 20 bp, Artificial Sequence
  chemically synthesized
cccctcctatcacaggtctg

SEQ ID NO: 337805 - DNA, 20 bp, Artificial Sequence
  chemically synthesized
ccctcctatcacaggtctgg

SEQ ID NO: 337806 - DNA, 20 bp, Artificial Sequence
  chemically synthesized
ctatcacaggtctggaggtc

SEQ ID NO: 337807 - DNA, 20 bp, Artificial Sequence
  chemically synthesized
tatcacaggtctggaggtct

SEQ ID NO: 337808 - DNA, 20 bp, Artificial Sequence
  chemically synthesized
atttttccttcctagacctc

SEQ ID NO: 337809 - DNA, 20 bp, Artificial Sequence
  chemically synthesized
cacaggtctggaggtctagg

SEQ ID NO: 337810 - DNA, 20 bp, Artificial Sequence
  chemically synthesized
acaggtctggaggtctagga

SEQ ID NO: 337811 - DNA, 20 bp, Artificial Sequence
  chemically synthesized
ccgaaatcatttttccttcc

SEQ ID NO: 337812 - DNA, 20 bp, Artificial Sequence
  chemically synthesized
ctaggaaggaaaaatgattt

SEQ ID NO: 337813 - DNA, 20 bp, Artificial Sequence
  chemically synthesized
aggaaggaaaaatgatttcg

SEQ ID NO: 337814 - DNA, 20 bp, Artificial Sequence
  chemically synthesized
ggaaggaaaaatgatttcgg

SEQ ID NO: 337815 - DNA, 20 bp, Artificial Sequence
  chemically synthesized
ggaaaaatgatttcggaggc

SEQ ID NO: 337816 - DNA, 20 bp, Artificial Sequence
  chemically synthesized
gaaaaatgatttcggaggcc

SEQ ID NO: 337817 - DNA, 20 bp, Artificial Sequence
  chemically synthesized
atgatttcggaggccaggcc

SEQ ID NO: 337818 - DNA, 20 bp, Artificial Sequence
  chemically synthesized
tgatttcggaggccaggcct

SEQ ID NO: 337819 - DNA, 20 bp, Artificial Sequence
  chemically synthesized
gatttcggaggccaggccta

SEQ ID NO: 337820 - DNA, 20 bp, Artificial Sequence
  chemically synthesized
gagcagtgaggccctaggcc

SEQ ID NO: 337821 - DNA, 20 bp, Artificial Sequence
  chemically synthesized
gtgcagagcagtgaggccct

SEQ ID NO: 337822 - DNA, 20 bp, Artificial Sequence
  chemically synthesized
tgtgcagagcagtgaggccc

SEQ ID NO: 337823 - DNA, 20 bp, Artificial Sequence
  chemically synthesized
tgaggttgtgcagagcagtg

SEQ ID NO: 337824 - DNA, 20 bp, Artificial Sequence
  chemically synthesized
ttgaggttgtgcagagcagt

SEQ ID NO: 337825 - DNA, 20 bp, Artificial Sequence
  chemically synthesized
tgtcttgaggttgtgcagag

SEQ ID NO: 337826 - DNA, 20 bp, Artificial Sequence
  chemically synthesized
cagtgtcttgaggttgtgca

SEQ ID NO: 337827 - DNA, 20 bp, Artificial Sequence
  chemically synthesized
agcagtgtcttgaggttgtg

SEQ ID NO: 337828 - DNA, 20 bp, Artificial Sequence
  chemically synthesized
tcactgctctgcacaacctc

SEQ ID NO: 337829 - DNA, 20 bp, Artificial Sequence
  chemically synthesized
acatagggagcagtgtcttg

SEQ ID NO: 337830 - DNA, 20 bp, Artificial Sequence
  chemically synthesized
gacatagggagcagtgtctt

SEQ ID NO: 337831 - DNA, 20 bp, Artificial Sequence
  chemically synthesized
agtgtctgggacatagggag

SEQ ID NO: 337832 - DNA, 20 bp, Artificial Sequence
  chemically synthesized
tggagtgtctgggacatagg

SEQ ID NO: 337833 - DNA, 20 bp, Artificial Sequence
  chemically synthesized
agacactgctccctatgtcc

SEQ ID NO: 337834 - DNA, 20 bp, Artificial Sequence
  chemically synthesized
gctggagtgtctgggacata

SEQ ID NO: 337835 - DNA, 20 bp, Artificial Sequence
  chemically synthesized
agctggagtgtctgggacat

SEQ ID NO: 337836 - DNA, 20 bp, Artificial Sequence
  chemically synthesized
gagctggagtgtctgggaca

SEQ ID NO: 337837 - DNA, 20 bp, Artificial Sequence
  chemically synthesized
cagctggagctggagtgtct

SEQ ID NO: 337838 - DNA, 20 bp, Artificial Sequence
  chemically synthesized
tccctatgtcccagacactc

SEQ ID NO: 337839 - DNA, 20 bp, Artificial Sequence
  chemically synthesized
acagctggagctggagtgtc

SEQ ID NO: 337840 - DNA, 20 bp, Artificial Sequence
  chemically synthesized
tgtcccagacactccagctc

SEQ ID NO: 337841 - DNA, 20 bp, Artificial Sequence
  chemically synthesized
tttagtaacagctggagctg

SEQ ID NO: 337842 - DNA, 20 bp, Artificial Sequence
  chemically synthesized
tttttagtaacagctggagc

SEQ ID NO: 337843 - DNA, 20 bp, Artificial Sequence
  chemically synthesized
ggcctttttagtaacagctg

SEQ ID NO: 337844 - DNA, 20 bp, Artificial Sequence
  chemically synthesized
ggggcctttttagtaacagc

SEQ ID NO: 337845 - DNA, 20 bp, Artificial Sequence
  chemically synthesized
atctggggcctttttagtaa

SEQ ID NO: 337846 - DNA, 20 bp, Artificial Sequence
  chemically synthesized
cagctccagctgttactaaa

SEQ ID NO: 337847 - DNA, 20 bp, Artificial Sequence
  chemically synthesized
agctccagctgttactaaaa

SEQ ID NO: 337848 - DNA, 20 bp, Artificial Sequence
  chemically synthesized
agacacatctggggcctttt

SEQ ID NO: 337849 - DNA, 20 bp, Artificial Sequence
  chemically synthesized
agctgttactaaaaaggccc

SEQ ID NO: 337850 - DNA, 20 bp, Artificial Sequence
  chemically synthesized
aacaccccaagacacatctg

SEQ ID NO: 337851 - DNA, 20 bp, Artificial Sequence
  chemically synthesized
caacaccccaagacacatct

SEQ ID NO: 337852 - DNA, 20 bp, Artificial Sequence
  chemically synthesized
gcaacaccccaagacacatc

SEQ ID NO: 337853 - DNA, 20 bp, Artificial Sequence
  chemically synthesized
aaaaggccccagatgtgtct

SEQ ID NO: 337854 - DNA, 20 bp, Artificial Sequence
  chemically synthesized
aaaggccccagatgtgtctt

SEQ ID NO: 337855 - DNA, 20 bp, Artificial Sequence
  chemically synthesized
aaggccccagatgtgtcttg

SEQ ID NO: 337856 - DNA, 20 bp, Artificial Sequence
  chemically synthesized
accctctgaagcaacacccc

SEQ ID NO: 337857 - DNA, 20 bp, Artificial Sequence
  chemically synthesized
tgtgtcttggggtgttgctt

SEQ ID NO: 337858 - DNA, 20 bp, Artificial Sequence
  chemically synthesized
tgtcttggggtgttgcttca

SEQ ID NO: 337859 - DNA, 20 bp, Artificial Sequence
  chemically synthesized
gtcttggggtgttgcttcag

SEQ ID NO: 337860 - DNA, 20 bp, Artificial Sequence
  chemically synthesized
tcttggggtgttgcttcaga

SEQ ID NO: 337861 - DNA, 20 bp, Artificial Sequence
  chemically synthesized
cttatggcttgcaccctctg

SEQ ID NO: 337862 - DNA, 20 bp, Artificial Sequence
  chemically synthesized
ggtgttgcttcagagggtgc

SEQ ID NO: 337863 - DNA, 20 bp, Artificial Sequence
  chemically synthesized
cttcagagggtgcaagccat

SEQ ID NO: 337864 - DNA, 20 bp, Artificial Sequence
  chemically synthesized
agggtgcaagccataagcat

SEQ ID NO: 337865 - DNA, 20 bp, Artificial Sequence
  chemically synthesized
atggaagccaccaatgctta

SEQ ID NO: 337866 - DNA, 20 bp, Artificial Sequence
  chemically synthesized
gtgcaagccataagcattgg

SEQ ID NO: 337867 - DNA, 20 bp, Artificial Sequence
  chemically synthesized
aagcattggtggcttccatg

SEQ ID NO: 337868 - DNA, 20 bp, Artificial Sequence
  chemically synthesized
gcaggattaacaccacatgg

SEQ ID NO: 337869 - DNA, 20 bp, Artificial Sequence
  chemically synthesized
cttgcaggattaacaccaca

SEQ ID NO: 337870 - DNA, 20 bp, Artificial Sequence
  chemically synthesized
ccatgtggtgttaatcctgc

SEQ ID NO: 337871 - DNA, 20 bp, Artificial Sequence
  chemically synthesized
ctcacactctgcacacttgc

SEQ ID NO: 337872 - DNA, 20 bp, Artificial Sequence
  chemically synthesized
tctcacactctgcacacttg

SEQ ID NO: 337873 - DNA, 20 bp, Artificial Sequence
  chemically synthesized
gtgttaatcctgcaagtgtg

SEQ ID NO: 337874 - DNA, 20 bp, Artificial Sequence
  chemically synthesized
gttaatcctgcaagtgtgca

SEQ ID NO: 337875 - DNA, 20 bp, Artificial Sequence
  chemically synthesized
cctgcaagtgtgcagagtgt

SEQ ID NO: 337876 - DNA, 20 bp, Artificial Sequence
  chemically synthesized
tgcaagtgtgcagagtgtga

SEQ ID NO: 337877 - DNA, 20 bp, Artificial Sequence
  chemically synthesized
gtgtgcagagtgtgagagtt

SEQ ID NO: 337878 - DNA, 20 bp, Artificial Sequence
  chemically synthesized
tgtgcagagtgtgagagttg

SEQ ID NO: 337879 - DNA, 20 bp, Artificial Sequence
  chemically synthesized
gagtgtgagagttgaggctt

SEQ ID NO: 337880 - DNA, 20 bp, Artificial Sequence
  chemically synthesized
gtgtgagagttgaggcttga

SEQ ID NO: 337881 - DNA, 20 bp, Artificial Sequence
  chemically synthesized
aaatctaggtggatgctctc

SEQ ID NO: 337882 - DNA, 20 bp, Artificial Sequence
  chemically synthesized
gaggcttgagagcatccacc

SEQ ID NO: 337883 - DNA, 20 bp, Artificial Sequence
  chemically synthesized
cacattctctgaaatctagg

SEQ ID NO: 337884 - DNA, 20 bp, Artificial Sequence
  chemically synthesized
gagagcatccacctagattt

SEQ ID NO: 337885 - DNA, 20 bp, Artificial Sequence
  chemically synthesized
ccacacattctctgaaatct

SEQ ID NO: 337886 - DNA, 20 bp, Artificial Sequence
  chemically synthesized
gagcatccacctagatttca

SEQ ID NO: 337887 - DNA, 20 bp, Artificial Sequence
  chemically synthesized
tccacacattctctgaaatc

SEQ ID NO: 337888 - DNA, 20 bp, Artificial Sequence
  chemically synthesized
cctagatttcagagaatgtg

SEQ ID NO: 337889 - DNA, 20 bp, Artificial Sequence
  chemically synthesized
tgtggaaacacctgcatgtc

SEQ ID NO: 337890 - DNA, 20 bp, Artificial Sequence
  chemically synthesized
agacttctacctggacatgc

SEQ ID NO: 337891 - DNA, 20 bp, Artificial Sequence
  chemically synthesized
gtggaaacacctgcatgtcc

SEQ ID NO: 337892 - DNA, 20 bp, Artificial Sequence
  chemically synthesized
cagacttctacctggacatg

SEQ ID NO: 337893 - DNA, 20 bp, Artificial Sequence
  chemically synthesized
gaaacacctgcatgtccagg

SEQ ID NO: 337894 - DNA, 20 bp, Artificial Sequence
  chemically synthesized
acacctgcatgtccaggtag

SEQ ID NO: 337895 - DNA, 20 bp, Artificial Sequence
  chemically synthesized
cgctgcagcagacttctacc

SEQ ID NO: 337896 - DNA, 20 bp, Artificial Sequence
  chemically synthesized
gtccaggtagaagtctgctg

SEQ ID NO: 337897 - DNA, 20 bp, Artificial Sequence
  chemically synthesized
caggtagaagtctgctgcag

SEQ ID NO: 337898 - DNA, 20 bp, Artificial Sequence
  chemically synthesized
aggtagaagtctgctgcagc

SEQ ID NO: 337899 - DNA, 20 bp, Artificial Sequence
  chemically synthesized
tgcaggctcccccgctgcag

SEQ ID NO: 337900 - DNA, 20 bp, Artificial Sequence
  chemically synthesized
ggtagaagtctgctgcagcg

SEQ ID NO: 337901 - DNA, 20 bp, Artificial Sequence
  chemically synthesized
gtagaagtctgctgcagcgg

SEQ ID NO: 337902 - DNA, 20 bp, Artificial Sequence
  chemically synthesized
ctatgcaggctcccccgctg

SEQ ID NO: 337903 - DNA, 20 bp, Artificial Sequence
  chemically synthesized
agaagtctgctgcagcgggg

SEQ ID NO: 337904 - DNA, 20 bp, Artificial Sequence
  chemically synthesized
ctgcagcgggggagcctgca

SEQ ID NO: 337905 - DNA, 20 bp, Artificial Sequence
  chemically synthesized
gcagcgggggagcctgcata

SEQ ID NO: 337906 - DNA, 20 bp, Artificial Sequence
  chemically synthesized
ctagtagaggttctctatgc

SEQ ID NO: 337907 - DNA, 20 bp, Artificial Sequence
  chemically synthesized
cctagtagaggttctctatg

SEQ ID NO: 337908 - DNA, 20 bp, Artificial Sequence
  chemically synthesized
cctgcatagagaacctctac

SEQ ID NO: 337909 - DNA, 20 bp, Artificial Sequence
  chemically synthesized
ctgcatagagaacctctact

SEQ ID NO: 337910 - DNA, 20 bp, Artificial Sequence
  chemically synthesized
tgcatagagaacctctacta

SEQ ID NO: 337911 - DNA, 20 bp, Artificial Sequence
  chemically synthesized
cttctgcactgccctagtag

SEQ ID NO: 337912 - DNA, 20 bp, Artificial Sequence
  chemically synthesized
ccttctgcactgccctagta

SEQ ID NO: 337913 - DNA, 20 bp, Artificial Sequence
  chemically synthesized
atagagaacctctactaggg

SEQ ID NO: 337914 - DNA, 20 bp, Artificial Sequence
  chemically synthesized
acccttctgcactgccctag

SEQ ID NO: 337915 - DNA, 20 bp, Artificial Sequence
  chemically synthesized
attacccttctgcactgccc

SEQ ID NO: 337916 - DNA, 20 bp, Artificial Sequence
  chemically synthesized
gaacctctactagggcagtg

SEQ ID NO: 337917 - DNA, 20 bp, Artificial Sequence
  chemically synthesized
cctctactagggcagtgcag

SEQ ID NO: 337918 - DNA, 20 bp, Artificial Sequence
  chemically synthesized
ctctactagggcagtgcaga

SEQ ID NO: 337919 - DNA, 20 bp, Artificial Sequence
  chemically synthesized
tctactagggcagtgcagaa

SEQ ID NO: 337920 - DNA, 20 bp, Artificial Sequence
  chemically synthesized
ggcagtgcagaagggtaatg

SEQ ID NO: 337921 - DNA, 20 bp, Artificial Sequence
  chemically synthesized
gcagtgcagaagggtaatgt

SEQ ID NO: 337922 - DNA, 20 bp, Artificial Sequence
  chemically synthesized
cagtgcagaagggtaatgtg

SEQ ID NO: 337923 - DNA, 20 bp, Artificial Sequence
  chemically synthesized
gcagaagggtaatgtggggt

SEQ ID NO: 337924 - DNA, 20 bp, Artificial Sequence
  chemically synthesized
agaagggtaatgtggggtta

SEQ ID NO: 337925 - DNA, 20 bp, Artificial Sequence
  chemically synthesized
gtggggttagagctctcaca

SEQ ID NO: 337926 - DNA, 20 bp, Artificial Sequence
  chemically synthesized
ggggttagagctctcacaca

SEQ ID NO: 337927 - DNA, 20 bp, Artificial Sequence
  chemically synthesized
ccagtggggactctgtgtga

SEQ ID NO: 337928 - DNA, 20 bp, Artificial Sequence
  chemically synthesized
ccccagtggggactctgtgt

SEQ ID NO: 337929 - DNA, 20 bp, Artificial Sequence
  chemically synthesized
ctctcacacagagtccccac

SEQ ID NO: 337930 - DNA, 20 bp, Artificial Sequence
  chemically synthesized
tctcacacagagtccccact

SEQ ID NO: 337931 - DNA, 20 bp, Artificial Sequence
  chemically synthesized
ctcacacagagtccccactg

SEQ ID NO: 337932 - DNA, 20 bp, Artificial Sequence
  chemically synthesized
aagtaggcagtgccccagtg

SEQ ID NO: 337933 - DNA, 20 bp, Artificial Sequence
  chemically synthesized
caagtaggcagtgccccagt

SEQ ID NO: 337934 - DNA, 20 bp, Artificial Sequence
  chemically synthesized
tcaagtaggcagtgccccag

SEQ ID NO: 337935 - DNA, 20 bp, Artificial Sequence
  chemically synthesized
agctcaagtaggcagtgccc

SEQ ID NO: 337936 - DNA, 20 bp, Artificial Sequence
  chemically synthesized
cactggggcactgcctactt

SEQ ID NO: 337937 - DNA, 20 bp, Artificial Sequence
  chemically synthesized
cttctcaaagctcaagtagg

SEQ ID NO: 337938 - DNA, 20 bp, Artificial Sequence
  chemically synthesized
cctcttctcaaagctcaagt

SEQ ID NO: 337939 - DNA, 20 bp, Artificial Sequence
  chemically synthesized
ccctcttctcaaagctcaag

SEQ ID NO: 337940 - DNA, 20 bp, Artificial Sequence
  chemically synthesized
gcactgcctacttgagcttt

SEQ ID NO: 337941 - DNA, 20 bp, Artificial Sequence
  chemically synthesized
tggccctcttctcaaagctc

SEQ ID NO: 337942 - DNA, 20 bp, Artificial Sequence
  chemically synthesized
ctgcctacttgagctttgag

SEQ ID NO: 337943 - DNA, 20 bp, Artificial Sequence
  chemically synthesized
gcctacttgagctttgagaa

SEQ ID NO: 337944 - DNA, 20 bp, Artificial Sequence
  chemically synthesized
cctacttgagctttgagaag

SEQ ID NO: 337945 - DNA, 20 bp, Artificial Sequence
  chemically synthesized
ggacagtggccctcttctca

SEQ ID NO: 337946 - DNA, 20 bp, Artificial Sequence
  chemically synthesized
ctacttgagctttgagaaga

SEQ ID NO: 337947 - DNA, 20 bp, Artificial Sequence
  chemically synthesized
ttctaggctctggaggacag

SEQ ID NO: 337948 - DNA, 20 bp, Artificial Sequence
  chemically synthesized
agaagagggccactgtcctc

SEQ ID NO: 337949 - DNA, 20 bp, Artificial Sequence
  chemically synthesized
aagagggccactgtcctcca

SEQ ID NO: 337950 - DNA, 20 bp, Artificial Sequence
  chemically synthesized
ccattctaggctctggagga

SEQ ID NO: 337951 - DNA, 20 bp, Artificial Sequence
  chemically synthesized
gagaccattctaggctctgg

SEQ ID NO: 337952 - DNA, 20 bp, Artificial Sequence
  chemically synthesized
ggccactgtcctccagagcc

SEQ ID NO: 337953 - DNA, 20 bp, Artificial Sequence
  chemically synthesized
agagaccattctaggctctg

SEQ ID NO: 337954 - DNA, 20 bp, Artificial Sequence
  chemically synthesized
ggagagaccattctaggctc

SEQ ID NO: 337955 - DNA, 20 bp, Artificial Sequence
  chemically synthesized
ctgtcctccagagcctagaa

SEQ ID NO: 337956 - DNA, 20 bp, Artificial Sequence
  chemically synthesized
gtcactggagagaccattct

SEQ ID NO: 337957 - DNA, 20 bp, Artificial Sequence
  chemically synthesized
tgtcactggagagaccattc

SEQ ID NO: 337958 - DNA, 20 bp, Artificial Sequence
  chemically synthesized
agagcctagaatggtctctc

SEQ ID NO: 337959 - DNA, 20 bp, Artificial Sequence
  chemically synthesized
tggtgcaaactgtcactgga

SEQ ID NO: 337960 - DNA, 20 bp, Artificial Sequence
  chemically synthesized
tagaatggtctctccagtga

SEQ ID NO: 337961 - DNA, 20 bp, Artificial Sequence
  chemically synthesized
tatggtgcaaactgtcactg

SEQ ID NO: 337962 - DNA, 20 bp, Artificial Sequence
  chemically synthesized
tgtatggtgcaaactgtcac

SEQ ID NO: 337963 - DNA, 20 bp, Artificial Sequence
  chemically synthesized
gacagtttgcaccatacacc

SEQ ID NO: 337964 - DNA, 20 bp, Artificial Sequence
  chemically synthesized
ctggggcttttccaggtgta

SEQ ID NO: 337965 - DNA, 20 bp, Artificial Sequence
  chemically synthesized
tttgcaccatacacctggaa

SEQ ID NO: 337966 - DNA, 20 bp, Artificial Sequence
  chemically synthesized
tgagtgactggggcttttcc

SEQ ID NO: 337967 - DNA, 20 bp, Artificial Sequence
  chemically synthesized
ttgagtgactggggcttttc

SEQ ID NO: 337968 - DNA, 20 bp, Artificial Sequence
  chemically synthesized
ccatacacctggaaaagccc

SEQ ID NO: 337969 - DNA, 20 bp, Artificial Sequence
  chemically synthesized
gggctggcattgagtgactg

SEQ ID NO: 337970 - DNA, 20 bp, Artificial Sequence
  chemically synthesized
tgggctggcattgagtgact

SEQ ID NO: 337971 - DNA, 20 bp, Artificial Sequence
  chemically synthesized
atgggctggcattgagtgac

SEQ ID NO: 337972 - DNA, 20 bp, Artificial Sequence
  chemically synthesized
aagccccagtcactcaatgc

SEQ ID NO: 337973 - DNA, 20 bp, Artificial Sequence
  chemically synthesized
tgttttcatgggctggcatt

SEQ ID NO: 337974 - DNA, 20 bp, Artificial Sequence
  chemically synthesized
ccttagttgttttcatgggc

SEQ ID NO: 337975 - DNA, 20 bp, Artificial Sequence
  chemically synthesized
gcacccttagttgttttcat

SEQ ID NO: 337976 - DNA, 20 bp, Artificial Sequence
  chemically synthesized
agcacccttagttgttttca

SEQ ID NO: 337977 - DNA, 20 bp, Artificial Sequence
  chemically synthesized
gccagcccatgaaaacaact

SEQ ID NO: 337978 - DNA, 20 bp, Artificial Sequence
  chemically synthesized
ccagcccatgaaaacaacta

SEQ ID NO: 337979 - DNA, 20 bp, Artificial Sequence
  chemically synthesized
cagcccatgaaaacaactaa

SEQ ID NO: 337980 - DNA, 20 bp, Artificial Sequence
  chemically synthesized
agcagggtgtacagcaccct

SEQ ID NO: 337981 - DNA, 20 bp, Artificial Sequence
  chemically synthesized
ctgtggctcagcagggtgta

SEQ ID NO: 337982 - DNA, 20 bp, Artificial Sequence
  chemically synthesized
agggtgctgtacaccctgct

SEQ ID NO: 337983 - DNA, 20 bp, Artificial Sequence
  chemically synthesized
tccatccctgtggctcagca

SEQ ID NO: 337984 - DNA, 20 bp, Artificial Sequence
  chemically synthesized
ctccatccctgtggctcagc

SEQ ID NO: 337985 - DNA, 20 bp, Artificial Sequence
  chemically synthesized
tctccatccctgtggctcag

SEQ ID NO: 337986 - DNA, 20 bp, Artificial Sequence
  chemically synthesized
ctgtacaccctgctgagcca

SEQ ID NO: 337987 - DNA, 20 bp, Artificial Sequence
  chemically synthesized
tgtacaccctgctgagccac

SEQ ID NO: 337988 - DNA, 20 bp, Artificial Sequence
  chemically synthesized
gtacaccctgctgagccaca

SEQ ID NO: 337989 - DNA, 20 bp, Artificial Sequence
  chemically synthesized
gcatctccatccctgtggct

SEQ ID NO: 337990 - DNA, 20 bp, Artificial Sequence
  chemically synthesized
accctgctgagccacaggga

SEQ ID NO: 337991 - DNA, 20 bp, Artificial Sequence
  chemically synthesized
cttgggcatctccatccctg

SEQ ID NO: 337992 - DNA, 20 bp, Artificial Sequence
  chemically synthesized
cctgctgagccacagggatg

SEQ ID NO: 337993 - DNA, 20 bp, Artificial Sequence
  chemically synthesized
ccacagggatggagatgccc

SEQ ID NO: 337994 - DNA, 20 bp, Artificial Sequence
  chemically synthesized
cacagggatggagatgccca

SEQ ID NO: 337995 - DNA, 20 bp, Artificial Sequence
  chemically synthesized
gatggagatgcccaaggcct

SEQ ID NO: 337996 - DNA, 20 bp, Artificial Sequence
  chemically synthesized
ggacaggctcccaaggcctt

SEQ ID NO: 337997 - DNA, 20 bp, Artificial Sequence
  chemically synthesized
atggagatgcccaaggcctt

SEQ ID NO: 337998 - DNA, 20 bp, Artificial Sequence
  chemically synthesized
gggacaggctcccaaggcct

SEQ ID NO: 337999 - DNA, 20 bp, Artificial Sequence
  chemically synthesized
ggagatgcccaaggccttgg

SEQ ID NO: 338000 - DNA, 20 bp, Artificial Sequence
  chemically synthesized
atgcaagggacaggctccca

SEQ ID NO: 338001 - DNA, 20 bp, Artificial Sequence
  chemically synthesized
gatgcaagggacaggctccc

SEQ ID NO: 338002 - DNA, 20 bp, Artificial Sequence
  chemically synthesized
gccacagtgatgcaagggac

SEQ ID NO: 338003 - DNA, 20 bp, Artificial Sequence
  chemically synthesized
agccacagtgatgcaaggga

SEQ ID NO: 338004 - DNA, 20 bp, Artificial Sequence
  chemically synthesized
tccaagccacagtgatgcaa

SEQ ID NO: 338005 - DNA, 20 bp, Artificial Sequence
  chemically synthesized
atccaagccacagtgatgca

SEQ ID NO: 338006 - DNA, 20 bp, Artificial Sequence
  chemically synthesized
catccaagccacagtgatgc

SEQ ID NO: 338007 - DNA, 20 bp, Artificial Sequence
  chemically synthesized
gcctgtcccttgcatcactg

SEQ ID NO: 338008 - DNA, 20 bp, Artificial Sequence
  chemically synthesized
tcccttgcatcactgtggct

SEQ ID NO: 338009 - DNA, 20 bp, Artificial Sequence
  chemically synthesized
tccacatctcatccaagcca

SEQ ID NO: 338010 - DNA, 20 bp, Artificial Sequence
  chemically synthesized
tgcatcactgtggcttggat

SEQ ID NO: 338011 - DNA, 20 bp, Artificial Sequence
  chemically synthesized
tttgactccacatctcatcc

SEQ ID NO: 338012 - DNA, 20 bp, Artificial Sequence
  chemically synthesized
actgtggcttggatgagatg

SEQ ID NO: 338013 - DNA, 20 bp, Artificial Sequence
  chemically synthesized
tgtggcttggatgagatgtg

SEQ ID NO: 338014 - DNA, 20 bp, Artificial Sequence
  chemically synthesized
ttggatgagatgtggagtca

SEQ ID NO: 338015 - DNA, 20 bp, Artificial Sequence
  chemically synthesized
tggatgagatgtggagtcaa

SEQ ID NO: 338016 - DNA, 20 bp, Artificial Sequence
  chemically synthesized
ggagtcaaaggaaattattt

SEQ ID NO: 338017 - DNA, 20 bp, Artificial Sequence
  chemically synthesized
agtcaaaggaaattattttg

SEQ ID NO: 338018 - DNA, 20 bp, Artificial Sequence
  chemically synthesized
ggaaattattttggagcttt

SEQ ID NO: 338019 - DNA, 20 bp, Artificial Sequence
  chemically synthesized
agggtagtcattaaatctta

SEQ ID NO: 338020 - DNA, 20 bp, Artificial Sequence
  chemically synthesized
agatttaatgactaccctgc

SEQ ID NO: 338021 - DNA, 20 bp, Artificial Sequence
  chemically synthesized
gatttaatgactaccctgct

SEQ ID NO: 338022 - DNA, 20 bp, Artificial Sequence
  chemically synthesized
aagtccaaaacccagcaggg

SEQ ID NO: 338023 - DNA, 20 bp, Artificial Sequence
  chemically synthesized
tgcaagtccaaaacccagca

SEQ ID NO: 338024 - DNA, 20 bp, Artificial Sequence
  chemically synthesized
gtgcaagtccaaaacccagc

SEQ ID NO: 338025 - DNA, 20 bp, Artificial Sequence
  chemically synthesized
tgtgcaagtccaaaacccag

SEQ ID NO: 338026 - DNA, 20 bp, Artificial Sequence
  chemically synthesized
atgactaccctgctgggttt

SEQ ID NO: 338027 - DNA, 20 bp, Artificial Sequence
  chemically synthesized
ccctgtgcaagtccaaaacc

SEQ ID NO: 338028 - DNA, 20 bp, Artificial Sequence
  chemically synthesized
tgctgggttttggacttgca

SEQ ID NO: 338029 - DNA, 20 bp, Artificial Sequence
  chemically synthesized
gctgggttttggacttgcac

SEQ ID NO: 338030 - DNA, 20 bp, Artificial Sequence
  chemically synthesized
ctgggttttggacttgcaca

SEQ ID NO: 338031 - DNA, 20 bp, Artificial Sequence
  chemically synthesized
aggggttacaggccctgtgc

SEQ ID NO: 338032 - DNA, 20 bp, Artificial Sequence
  chemically synthesized
gatcagaagaaaggggttac

SEQ ID NO: 338033 - DNA, 20 bp, Artificial Sequence
  chemically synthesized
cgatcagaagaaaggggtta

SEQ ID NO: 338034 - DNA, 20 bp, Artificial Sequence
  chemically synthesized
ttaaatcgatcagaagaaag

SEQ ID NO: 338035 - DNA, 20 bp, Artificial Sequence
  chemically synthesized
gttaaatcgatcagaagaaa

SEQ ID NO: 338036 - DNA, 20 bp, Artificial Sequence
  chemically synthesized
agttaaatcgatcagaagaa

SEQ ID NO: 338037 - DNA, 20 bp, Artificial Sequence
  chemically synthesized
gagttaaatcgatcagaaga

SEQ ID NO: 338038 - DNA, 20 bp, Artificial Sequence
  chemically synthesized
aaaagagttaaatcgatcag

SEQ ID NO: 338039 - DNA, 20 bp, Artificial Sequence
  chemically synthesized
ctcaaaagagttaaatcgat

SEQ ID NO: 338040 - DNA, 20 bp, Artificial Sequence
  chemically synthesized
ctgatcgatttaactctttt

SEQ ID NO: 338041 - DNA, 20 bp, Artificial Sequence
  chemically synthesized
gtacaggcattagctcaaaa

SEQ ID NO: 338042 - DNA, 20 bp, Artificial Sequence
  chemically synthesized
gggtacaggcattagctcaa

SEQ ID NO: 338043 - DNA, 20 bp, Artificial Sequence
  chemically synthesized
tacaatgagggtacaggcat

SEQ ID NO: 338044 - DNA, 20 bp, Artificial Sequence
  chemically synthesized
ccaagatacaatgagggtac

SEQ ID NO: 338045 - DNA, 20 bp, Artificial Sequence
  chemically synthesized
tccaagatacaatgagggta

SEQ ID NO: 338046 - DNA, 20 bp, Artificial Sequence
  chemically synthesized
ttacttccaagatacaatga

SEQ ID NO: 338047 - DNA, 20 bp, Artificial Sequence
  chemically synthesized
gttacttccaagatacaatg

SEQ ID NO: 338048 - DNA, 20 bp, Artificial Sequence
  chemically synthesized
agttacttccaagatacaat

SEQ ID NO: 338049 - DNA, 20 bp, Artificial Sequence
  chemically synthesized
cctgtaccctcattgtatct

SEQ ID NO: 338050 - DNA, 20 bp, Artificial Sequence
  chemically synthesized
gtaccctcattgtatcttgg

SEQ ID NO: 338051 - DNA, 20 bp, Artificial Sequence
  chemically synthesized
aatcaaaatgagttacttcc

SEQ ID NO: 338052 - DNA, 20 bp, Artificial Sequence
  chemically synthesized
tgatcctgtaaaatcaaaat

SEQ ID NO: 338053 - DNA, 20 bp, Artificial Sequence
  chemically synthesized
agtaactcattttgatttta

SEQ ID NO: 338054 - DNA, 20 bp, Artificial Sequence
  chemically synthesized
gtaactcattttgattttac

SEQ ID NO: 338055 - DNA, 20 bp, Artificial Sequence
  chemically synthesized
attttgattttacaggatca

SEQ ID NO: 338056 - DNA, 20 bp, Artificial Sequence
  chemically synthesized
ttttgattttacaggatcat

SEQ ID NO: 338057 - DNA, 20 bp, Artificial Sequence
  chemically synthesized
ttttacaggatcataggttg

SEQ ID NO: 338058 - DNA, 20 bp, Artificial Sequence
  chemically synthesized
tttacaggatcataggttga

SEQ ID NO: 338059 - DNA, 20 bp, Artificial Sequence
  chemically synthesized
ttacaggatcataggttgaa

SEQ ID NO: 338060 - DNA, 20 bp, Artificial Sequence
  chemically synthesized
taggttgaagggacttgcct

SEQ ID NO: 338061 - DNA, 20 bp, Artificial Sequence
  chemically synthesized
gtctcatctgagactaaggc

SEQ ID NO: 338062 - DNA, 20 bp, Artificial Sequence
  chemically synthesized
gaagggacttgccttagtct

SEQ ID NO: 338063 - DNA, 20 bp, Artificial Sequence
  chemically synthesized
caaagtctcatctgagacta

SEQ ID NO: 338064 - DNA, 20 bp, Artificial Sequence
  chemically synthesized
ccaaagtctcatctgagact

SEQ ID NO: 338065 - DNA, 20 bp, Artificial Sequence
  chemically synthesized
gacttgccttagtctcagat

SEQ ID NO: 338066 - DNA, 20 bp, Artificial Sequence
  chemically synthesized
cacagtccaaagtctcatct

SEQ ID NO: 338067 - DNA, 20 bp, Artificial Sequence
  chemically synthesized
cttagtctcagatgagactt

SEQ ID NO: 338068 - DNA, 20 bp, Artificial Sequence
  chemically synthesized
tcagatgagactttggactg

SEQ ID NO: 338069 - DNA, 20 bp, Artificial Sequence
  chemically synthesized
gttcaaaagtccacagtcca

SEQ ID NO: 338070 - DNA, 20 bp, Artificial Sequence
  chemically synthesized
agtattagttcaaaagtcca

SEQ ID NO: 338071 - DNA, 20 bp, Artificial Sequence
  chemically synthesized
tcattccagtattagttcaa

SEQ ID NO: 338072 - DNA, 20 bp, Artificial Sequence
  chemically synthesized
gtggacttttgaactaatac

SEQ ID NO: 338073 - DNA, 20 bp, Artificial Sequence
  chemically synthesized
gtcttaactcattccagtat

SEQ ID NO: 338074 - DNA, 20 bp, Artificial Sequence
  chemically synthesized
ttttgaactaatactggaat

SEQ ID NO: 338075 - DNA, 20 bp, Artificial Sequence
  chemically synthesized
cccaaagtcttaactcattc

SEQ ID NO: 338076 - DNA, 20 bp, Artificial Sequence
  chemically synthesized
aactaatactggaatgagtt

SEQ ID NO: 338077 - DNA, 20 bp, Artificial Sequence
  chemically synthesized
actggaatgagttaagactt

SEQ ID NO: 338078 - DNA, 20 bp, Artificial Sequence
  chemically synthesized
ctggaatgagttaagacttt

SEQ ID NO: 338079 - DNA, 20 bp, Artificial Sequence
  chemically synthesized
tggaatgagttaagactttg

SEQ ID NO: 338080 - DNA, 20 bp, Artificial Sequence
  chemically synthesized
gctttcccaacagttcccca

SEQ ID NO: 338081 - DNA, 20 bp, Artificial Sequence
  chemically synthesized
ttaagactttggggaactgt

SEQ ID NO: 338082 - DNA, 20 bp, Artificial Sequence
  chemically synthesized
taagactttggggaactgtt

SEQ ID NO: 338083 - DNA, 20 bp, Artificial Sequence
  chemically synthesized
actttggggaactgttggga

SEQ ID NO: 338084 - DNA, 20 bp, Artificial Sequence
  chemically synthesized
atacaatcatgctttcccaa

SEQ ID NO: 338085 - DNA, 20 bp, Artificial Sequence
  chemically synthesized
atgattgtattttgaaatgt

SEQ ID NO: 338086 - DNA, 20 bp, Artificial Sequence
  chemically synthesized
ttgaaatgtgagaacaatat

SEQ ID NO: 338087 - DNA, 20 bp, Artificial Sequence
  chemically synthesized
tgtgagaacaatatgagatt

SEQ ID NO: 338088 - DNA, 20 bp, Artificial Sequence
  chemically synthesized
gtgagaacaatatgagattt

SEQ ID NO: 338089 - DNA, 20 bp, Artificial Sequence
  chemically synthesized
gagaacaatatgagatttgg

SEQ ID NO: 338090 - DNA, 20 bp, Artificial Sequence
  chemically synthesized
agaacaatatgagatttggg

SEQ ID NO: 338091 - DNA, 20 bp, Artificial Sequence
  chemically synthesized
gaacaatatgagatttggga

SEQ ID NO: 338092 - DNA, 20 bp, Artificial Sequence
  chemically synthesized
aacaatatgagatttgggag

SEQ ID NO: 338093 - DNA, 20 bp, Artificial Sequence
  chemically synthesized
atatgagatttgggaggggt

SEQ ID NO: 338094 - DNA, 20 bp, Artificial Sequence
  chemically synthesized
tatgagatttgggaggggtt

SEQ ID NO: 338095 - DNA, 20 bp, Artificial Sequence
  chemically synthesized
atgagatttgggaggggttg

SEQ ID NO: 338096 - DNA, 20 bp, Artificial Sequence
  chemically synthesized
agatttgggaggggttgggg

SEQ ID NO: 338097 - DNA, 20 bp, Artificial Sequence
  chemically synthesized
ggggttggggcagaacgata

SEQ ID NO: 338098 - DNA, 20 bp, Artificial Sequence
  chemically synthesized
tggggcagaacgatatagtt

SEQ ID NO: 338099 - DNA, 20 bp, Artificial Sequence
  chemically synthesized
atgagatttgggcagggaca

SEQ ID NO: 338100 - DNA, 20 bp, Artificial Sequence
  chemically synthesized
tacaacatgagatttgggca

SEQ ID NO: 338101 - DNA, 20 bp, Artificial Sequence
  chemically synthesized
atacaacatgagatttgggc

SEQ ID NO: 338102 - DNA, 20 bp, Artificial Sequence
  chemically synthesized
aatacaacatgagatttggg

SEQ ID NO: 338103 - DNA, 20 bp, Artificial Sequence
  chemically synthesized
cacaatacaacatgagattt

SEQ ID NO: 338104 - DNA, 20 bp, Artificial Sequence
  chemically synthesized
tcacaatacaacatgagatt

SEQ ID NO: 338105 - DNA, 20 bp, Artificial Sequence
  chemically synthesized
tggggatcacaatacaacat

SEQ ID NO: 338106 - DNA, 20 bp, Artificial Sequence
  chemically synthesized
aggcgcctcattcaatattg

SEQ ID NO: 338107 - DNA, 20 bp, Artificial Sequence
  chemically synthesized
caggcgcctcattcaatatt

SEQ ID NO: 338108 - DNA, 20 bp, Artificial Sequence
  chemically synthesized
ccaggcgcctcattcaatat

SEQ ID NO: 338109 - DNA, 20 bp, Artificial Sequence
  chemically synthesized
tgtgatccccaatattgaat

SEQ ID NO: 338110 - DNA, 20 bp, Artificial Sequence
  chemically synthesized
gtgatccccaatattgaatg

SEQ ID NO: 338111 - DNA, 20 bp, Artificial Sequence
  chemically synthesized
ccaatattgaatgaggcgcc

SEQ ID NO: 338112 - DNA, 20 bp, Artificial Sequence
  chemically synthesized
atattgaatgaggcgcctgg

SEQ ID NO: 338113 - DNA, 20 bp, Artificial Sequence
  chemically synthesized
tattgaatgaggcgcctggt

SEQ ID NO: 338114 - DNA, 20 bp, Artificial Sequence
  chemically synthesized
ttgaatgaggcgcctggtgg

SEQ ID NO: 338115 - DNA, 20 bp, Artificial Sequence
  chemically synthesized
tgaatgaggcgcctggtggg

SEQ ID NO: 338116 - DNA, 20 bp, Artificial Sequence
  chemically synthesized
tgattcagtcacctcccacc

SEQ ID NO: 338117 - DNA, 20 bp, Artificial Sequence
  chemically synthesized
atgattcagtcacctcccac

SEQ ID NO: 338118 - DNA, 20 bp, Artificial Sequence
  chemically synthesized
ggtgggaggtgactgaatca

SEQ ID NO: 338119 - DNA, 20 bp, Artificial Sequence
  chemically synthesized
gtgggaggtgactgaatcat

SEQ ID NO: 338120 - DNA, 20 bp, Artificial Sequence
  chemically synthesized
tgggaggtgactgaatcata

SEQ ID NO: 338121 - DNA, 20 bp, Artificial Sequence
  chemically synthesized
ggaaatctgcccctatgatt

SEQ ID NO: 338122 - DNA, 20 bp, Artificial Sequence
  chemically synthesized
gggaggtgactgaatcatag

SEQ ID NO: 338123 - DNA, 20 bp, Artificial Sequence
  chemically synthesized
aggtgactgaatcatagggg

SEQ ID NO: 338124 - DNA, 20 bp, Artificial Sequence
  chemically synthesized
ctatcattggaacagtaaga

SEQ ID NO: 338125 - DNA, 20 bp, Artificial Sequence
  chemically synthesized
actatcattggaacagtaag

SEQ ID NO: 338126 - DNA, 20 bp, Artificial Sequence
  chemically synthesized
cactatcattggaacagtaa

SEQ ID NO: 338127 - DNA, 20 bp, Artificial Sequence
  chemically synthesized
ctcactatcattggaacagt

SEQ ID NO: 338128 - DNA, 20 bp, Artificial Sequence
  chemically synthesized
agaactcactatcattggaa

SEQ ID NO: 338129 - DNA, 20 bp, Artificial Sequence
  chemically synthesized
ccctcttactgttccaatga

SEQ ID NO: 338130 - DNA, 20 bp, Artificial Sequence
  chemically synthesized
tcatgagaactcactatcat

SEQ ID NO: 338131 - DNA, 20 bp, Artificial Sequence
  chemically synthesized
cttactgttccaatgatagt

SEQ ID NO: 338132 - DNA, 20 bp, Artificial Sequence
  chemically synthesized
ttcacacaaccagatatcat

SEQ ID NO: 338133 - DNA, 20 bp, Artificial Sequence
  chemically synthesized
tagtgagttctcatgatatc

SEQ ID NO: 338134 - DNA, 20 bp, Artificial Sequence
  chemically synthesized
gctacacgctttcacacaac

SEQ ID NO: 338135 - DNA, 20 bp, Artificial Sequence
  chemically synthesized
catgatatctggttgtgtga

SEQ ID NO: 338136 - DNA, 20 bp, Artificial Sequence
  chemically synthesized
tctggttgtgtgaaagcgtg

SEQ ID NO: 338137 - DNA, 20 bp, Artificial Sequence
  chemically synthesized
ggaggaagagagagcaggca

SEQ ID NO: 338138 - DNA, 20 bp, Artificial Sequence
  chemically synthesized
aaggaggaagagagagcagg

SEQ ID NO: 338139 - DNA, 20 bp, Artificial Sequence
  chemically synthesized
gagaaggaggaagagagagc

SEQ ID NO: 338140 - DNA, 20 bp, Artificial Sequence
  chemically synthesized
agagaaggaggaagagagag

SEQ ID NO: 338141 - DNA, 20 bp, Artificial Sequence
  chemically synthesized
gccagagaaggaggaagaga

SEQ ID NO: 338142 - DNA, 20 bp, Artificial Sequence
  chemically synthesized
tggccagagaaggaggaaga

SEQ ID NO: 338143 - DNA, 20 bp, Artificial Sequence
  chemically synthesized
catggccagagaaggaggaa

SEQ ID NO: 338144 - DNA, 20 bp, Artificial Sequence
  chemically synthesized
tacatggccagagaaggagg

SEQ ID NO: 338145 - DNA, 20 bp, Artificial Sequence
  chemically synthesized
gctctctcttcctccttctc

SEQ ID NO: 338146 - DNA, 20 bp, Artificial Sequence
  chemically synthesized
gcttacatggccagagaagg

SEQ ID NO: 338147 - DNA, 20 bp, Artificial Sequence
  chemically synthesized
ggcttacatggccagagaag

SEQ ID NO: 338148 - DNA, 20 bp, Artificial Sequence
  chemically synthesized
acggcttacatggccagaga

SEQ ID NO: 338149 - DNA, 20 bp, Artificial Sequence
  chemically synthesized
cacggcttacatggccagag

SEQ ID NO: 338150 - DNA, 20 bp, Artificial Sequence
  chemically synthesized
aggcacggcttacatggcca

SEQ ID NO: 338151 - DNA, 20 bp, Artificial Sequence
  chemically synthesized
tcctccttctctggccatgt

SEQ ID NO: 338152 - DNA, 20 bp, Artificial Sequence
  chemically synthesized
gtaggcacggcttacatggc

SEQ ID NO: 338153 - DNA, 20 bp, Artificial Sequence
  chemically synthesized
ggaagtaggcacggcttaca

SEQ ID NO: 338154 - DNA, 20 bp, Artificial Sequence
  chemically synthesized
aggtgaaggggaagtaggca

SEQ ID NO: 338155 - DNA, 20 bp, Artificial Sequence
  chemically synthesized
gtggaaggtgaaggggaagt

SEQ ID NO: 338156 - DNA, 20 bp, Artificial Sequence
  chemically synthesized
tgtggaaggtgaaggggaag

SEQ ID NO: 338157 - DNA, 20 bp, Artificial Sequence
  chemically synthesized
cactgtggaaggtgaagggg

SEQ ID NO: 338158 - DNA, 20 bp, Artificial Sequence
  chemically synthesized
aatcactgtggaaggtgaag

SEQ ID NO: 338159 - DNA, 20 bp, Artificial Sequence
  chemically synthesized
aaatcactgtggaaggtgaa

SEQ ID NO: 338160 - DNA, 20 bp, Artificial Sequence
  chemically synthesized
gaaatcactgtggaaggtga

SEQ ID NO: 338161 - DNA, 20 bp, Artificial Sequence
  chemically synthesized
ggaaatcactgtggaaggtg

SEQ ID NO: 338162 - DNA, 20 bp, Artificial Sequence
  chemically synthesized
tacttccccttcaccttcca

SEQ ID NO: 338163 - DNA, 20 bp, Artificial Sequence
  chemically synthesized
tctcaggaaatcactgtgga

SEQ ID NO: 338164 - DNA, 20 bp, Artificial Sequence
  chemically synthesized
gtctcaggaaatcactgtgg

SEQ ID NO: 338165 - DNA, 20 bp, Artificial Sequence
  chemically synthesized
gaggtctcaggaaatcactg

SEQ ID NO: 338166 - DNA, 20 bp, Artificial Sequence
  chemically synthesized
accttccacagtgatttcct

SEQ ID NO: 338167 - DNA, 20 bp, Artificial Sequence
  chemically synthesized
agcatggctggggaggtctc

SEQ ID NO: 338168 - DNA, 20 bp, Artificial Sequence
  chemically synthesized
aagcatggctggggaggtct

SEQ ID NO: 338169 - DNA, 20 bp, Artificial Sequence
  chemically synthesized
gtgatttcctgagacctccc

SEQ ID NO: 338170 - DNA, 20 bp, Artificial Sequence
  chemically synthesized
tatgggaagcatggctgggg

SEQ ID NO: 338171 - DNA, 20 bp, Artificial Sequence
  chemically synthesized
gtatgggaagcatggctggg

SEQ ID NO: 338172 - DNA, 20 bp, Artificial Sequence
  chemically synthesized
ctgtatgggaagcatggctg

SEQ ID NO: 338173 - DNA, 20 bp, Artificial Sequence
  chemically synthesized
gctgtatgggaagcatggct

SEQ ID NO: 338174 - DNA, 20 bp, Artificial Sequence
  chemically synthesized
ggctgtatgggaagcatggc

SEQ ID NO: 338175 - DNA, 20 bp, Artificial Sequence
  chemically synthesized
cacaggctgtatgggaagca

SEQ ID NO: 338176 - DNA, 20 bp, Artificial Sequence
  chemically synthesized
ccccagccatgcttcccata

SEQ ID NO: 338177 - DNA, 20 bp, Artificial Sequence
  chemically synthesized
agttccacaggctgtatggg

SEQ ID NO: 338178 - DNA, 20 bp, Artificial Sequence
  chemically synthesized
tgcagttccacaggctgtat

SEQ ID NO: 338179 - DNA, 20 bp, Artificial Sequence
  chemically synthesized
ttgcagttccacaggctgta

SEQ ID NO: 338180 - DNA, 20 bp, Artificial Sequence
  chemically synthesized
catgcttcccatacagcctg

SEQ ID NO: 338181 - DNA, 20 bp, Artificial Sequence
  chemically synthesized
taattgacttgcagttccac

SEQ ID NO: 338182 - DNA, 20 bp, Artificial Sequence
  chemically synthesized
ttaattgacttgcagttcca

SEQ ID NO: 338183 - DNA, 20 bp, Artificial Sequence
  chemically synthesized
catacagcctgtggaactgc

SEQ ID NO: 338184 - DNA, 20 bp, Artificial Sequence
  chemically synthesized
aaagaggcttaattgacttg

SEQ ID NO: 338185 - DNA, 20 bp, Artificial Sequence
  chemically synthesized
tgtggaactgcaagtcaatt

SEQ ID NO: 338186 - DNA, 20 bp, Artificial Sequence
  chemically synthesized
gggtaatttataaagaaaag

SEQ ID NO: 338187 - DNA, 20 bp, Artificial Sequence
  chemically synthesized
tgggtaatttataaagaaaa

SEQ ID NO: 338188 - DNA, 20 bp, Artificial Sequence
  chemically synthesized
actgggtaatttataaagaa

SEQ ID NO: 338189 - DNA, 20 bp, Artificial Sequence
  chemically synthesized
ctgtgactgggtaatttata

SEQ ID NO: 338190 - DNA, 20 bp, Artificial Sequence
  chemically synthesized
tcttttctttataaattacc

SEQ ID NO: 338191 - DNA, 20 bp, Artificial Sequence
  chemically synthesized
ctttataaattacccagtca

SEQ ID NO: 338192 - DNA, 20 bp, Artificial Sequence
  chemically synthesized
tttataaattacccagtcac

SEQ ID NO: 338193 - DNA, 20 bp, Artificial Sequence
  chemically synthesized
ataaacaactacctgtgact

SEQ ID NO: 338194 - DNA, 20 bp, Artificial Sequence
  chemically synthesized
tataaacaactacctgtgac

SEQ ID NO: 338195 - DNA, 20 bp, Artificial Sequence
  chemically synthesized
ataaattacccagtcacagg

SEQ ID NO: 338196 - DNA, 20 bp, Artificial Sequence
  chemically synthesized
cagtcacaggtagttgttta

SEQ ID NO: 338197 - DNA, 20 bp, Artificial Sequence
  chemically synthesized
gtagttgtttatagcaatgt

SEQ ID NO: 338198 - DNA, 20 bp, Artificial Sequence
  chemically synthesized
tgtttatagcaatgtgagaa

SEQ ID NO: 338199 - DNA, 20 bp, Artificial Sequence
  chemically synthesized
ccttatcttgatatgtgtat

SEQ ID NO: 338200 - DNA, 20 bp, Artificial Sequence
  chemically synthesized
aacggactaatacacatatc

SEQ ID NO: 338201 - DNA, 20 bp, Artificial Sequence
  chemically synthesized
actaatacacatatcaagat

SEQ ID NO: 338202 - DNA, 20 bp, Artificial Sequence
  chemically synthesized
ctaatacacatatcaagata

SEQ ID NO: 338203 - DNA, 20 bp, Artificial Sequence
  chemically synthesized
aagataaggacatttattcc

SEQ ID NO: 338204 - DNA, 20 bp, Artificial Sequence
  chemically synthesized
aaggacatttattcccagat

SEQ ID NO: 338205 - DNA, 20 bp, Artificial Sequence
  chemically synthesized
agaaaggttcttactaatct

SEQ ID NO: 338206 - DNA, 20 bp, Artificial Sequence
  chemically synthesized
acatttattcccagattagt

SEQ ID NO: 338207 - DNA, 20 bp, Artificial Sequence
  chemically synthesized
gagaaaggttcttactaatc

SEQ ID NO: 338208 - DNA, 20 bp, Artificial Sequence
  chemically synthesized
agattagtaagaacctttct

SEQ ID NO: 338209 - DNA, 20 bp, Artificial Sequence
  chemically synthesized
gattagtaagaacctttctc

SEQ ID NO: 338210 - DNA, 20 bp, Artificial Sequence
  chemically synthesized
acattaccaagtcctgagaa

SEQ ID NO: 338211 - DNA, 20 bp, Artificial Sequence
  chemically synthesized
tacattaccaagtcctgaga

SEQ ID NO: 338212 - DNA, 20 bp, Artificial Sequence
  chemically synthesized
taagaacctttctcaggact

SEQ ID NO: 338213 - DNA, 20 bp, Artificial Sequence
  chemically synthesized
taaatacattaccaagtcct

SEQ ID NO: 338214 - DNA, 20 bp, Artificial Sequence
  chemically synthesized
atttgcttaaatacattacc

SEQ ID NO: 338215 - DNA, 20 bp, Artificial Sequence
  chemically synthesized
caggacttggtaatgtattt

SEQ ID NO: 338216 - DNA, 20 bp, Artificial Sequence
  chemically synthesized
tgtatttaagcaaatgtcat

SEQ ID NO: 338217 - DNA, 20 bp, Artificial Sequence
  chemically synthesized
agtcctatcagtaaaagcaa

SEQ ID NO: 338218 - DNA, 20 bp, Artificial Sequence
  chemically synthesized
attacttttgcttttactga

SEQ ID NO: 338219 - DNA, 20 bp, Artificial Sequence
  chemically synthesized
ctagtcagtcctatcagtaa

SEQ ID NO: 338220 - DNA, 20 bp, Artificial Sequence
  chemically synthesized
ttacttttgcttttactgat

SEQ ID NO: 338221 - DNA, 20 bp, Artificial Sequence
  chemically synthesized
ccagaactagtcagtcctat

SEQ ID NO: 338222 - DNA, 20 bp, Artificial Sequence
  chemically synthesized
cttttactgataggactgac

SEQ ID NO: 338223 - DNA, 20 bp, Artificial Sequence
  chemically synthesized
gtcaggaagccagaactagt

SEQ ID NO: 338224 - DNA, 20 bp, Artificial Sequence
  chemically synthesized
ctgataggactgactagttc

SEQ ID NO: 338225 - DNA, 20 bp, Artificial Sequence
  chemically synthesized
taaagtcaggaagccagaac

SEQ ID NO: 338226 - DNA, 20 bp, Artificial Sequence
  chemically synthesized
ttttcttaaagtcaggaagc

SEQ ID NO: 338227 - DNA, 20 bp, Artificial Sequence
  chemically synthesized
ttccttttcttaaagtcagg

SEQ ID NO: 338228 - DNA, 20 bp, Artificial Sequence
  chemically synthesized
agttctggcttcctgacttt

SEQ ID NO: 338229 - DNA, 20 bp, Artificial Sequence
  chemically synthesized
ttcttccttttcttaaagtc

SEQ ID NO: 338230 - DNA, 20 bp, Artificial Sequence
  chemically synthesized
gttcttccttttcttaaagt

SEQ ID NO: 338231 - DNA, 20 bp, Artificial Sequence
  chemically synthesized
tggcttcctgactttaagaa

SEQ ID NO: 338232 - DNA, 20 bp, Artificial Sequence
  chemically synthesized
ggcttcctgactttaagaaa

SEQ ID NO: 338233 - DNA, 20 bp, Artificial Sequence
  chemically synthesized
ctttgttcttccttttctta

SEQ ID NO: 338234 - DNA, 20 bp, Artificial Sequence
  chemically synthesized
ttcctgactttaagaaaagg

SEQ ID NO: 338235 - DNA, 20 bp, Artificial Sequence
  chemically synthesized
ctttaagaaaaggaagaaca

SEQ ID NO: 338236 - DNA, 20 bp, Artificial Sequence
  chemically synthesized
taaaatgcaaaacagtgaac

SEQ ID NO: 338237 - DNA, 20 bp, Artificial Sequence
  chemically synthesized
ataaaatgcaaaacagtgaa

SEQ ID NO: 338238 - DNA, 20 bp, Artificial Sequence
  chemically synthesized
attaataataaaatgcaaaa

SEQ ID NO: 338239 - DNA, 20 bp, Artificial Sequence
  chemically synthesized
taaaaacatcaattaaatga

SEQ ID NO: 338240 - DNA, 20 bp, Artificial Sequence
  chemically synthesized
ttttaaagtgatgaaattca

SEQ ID NO: 338241 - DNA, 20 bp, Artificial Sequence
  chemically synthesized
cttttaaagtgatgaaattc

SEQ ID NO: 338242 - DNA, 20 bp, Artificial Sequence
  chemically synthesized
tcttttaaagtgatgaaatt

SEQ ID NO: 338243 - DNA, 20 bp, Artificial Sequence
  chemically synthesized
cctgaatttcatcactttaa

SEQ ID NO: 338244 - DNA, 20 bp, Artificial Sequence
  chemically synthesized
gcaataaggaaagtctttta

SEQ ID NO: 338245 - DNA, 20 bp, Artificial Sequence
  chemically synthesized
attttaaagagcaataagga

SEQ ID NO: 338246 - DNA, 20 bp, Artificial Sequence
  chemically synthesized
atatattttaaagagcaata

SEQ ID NO: 338247 - DNA, 20 bp, Artificial Sequence
  chemically synthesized
catatattttaaagagcaat

SEQ ID NO: 338248 - DNA, 20 bp, Artificial Sequence
  chemically synthesized
catttgccatatattttaaa

SEQ ID NO: 338249 - DNA, 20 bp, Artificial Sequence
  chemically synthesized
cacatttgccatatatttta

SEQ ID NO: 338250 - DNA, 20 bp, Artificial Sequence
  chemically synthesized
ttattgctctttaaaatata

SEQ ID NO: 338251 - DNA, 20 bp, Artificial Sequence
  chemically synthesized
tttaaaatatatggcaaatg

SEQ ID NO: 338252 - DNA, 20 bp, Artificial Sequence
  chemically synthesized
aaatatatggcaaatgtgga

SEQ ID NO: 338253 - DNA, 20 bp, Artificial Sequence
  chemically synthesized
tatatggcaaatgtggatgg

SEQ ID NO: 338254 - DNA, 20 bp, Artificial Sequence
  chemically synthesized
tgtggatggaagtacacact

SEQ ID NO: 338255 - DNA, 20 bp, Artificial Sequence
  chemically synthesized
agctgacaaaattatttgct

SEQ ID NO: 338256 - DNA, 20 bp, Artificial Sequence
  chemically synthesized
cacttagcaaataattttgt

SEQ ID NO: 338257 - DNA, 20 bp, Artificial Sequence
  chemically synthesized
aacattggaataaaaagttt

SEQ ID NO: 338258 - DNA, 20 bp, Artificial Sequence
  chemically synthesized
tgagtcaacattggaataaa

SEQ ID NO: 338259 - DNA, 20 bp, Artificial Sequence
  chemically synthesized
atttacacttgagtcaacat

SEQ ID NO: 338260 - DNA, 20 bp, Artificial Sequence
  chemically synthesized
ttttattccaatgttgactc

SEQ ID NO: 338261 - DNA, 20 bp, Artificial Sequence
  chemically synthesized
gttattaactatttacactt

SEQ ID NO: 338262 - DNA, 20 bp, Artificial Sequence
  chemically synthesized
aatgttgactcaagtgtaaa

SEQ ID NO: 338263 - DNA, 20 bp, Artificial Sequence
  chemically synthesized
tggagcattttaaatatgga

SEQ ID NO: 338264 - DNA, 20 bp, Artificial Sequence
  chemically synthesized
atggagcattttaaatatgg

SEQ ID NO: 338265 - DNA, 20 bp, Artificial Sequence
  chemically synthesized
ctaatggagcattttaaata

SEQ ID NO: 338266 - DNA, 20 bp, Artificial Sequence
  chemically synthesized
ccatatttaaaatgctccat

SEQ ID NO: 338267 - DNA, 20 bp, Artificial Sequence
  chemically synthesized
catatttaaaatgctccatt

SEQ ID NO: 338268 - DNA, 20 bp, Artificial Sequence
  chemically synthesized
tacagattatttacctaatg

SEQ ID NO: 338269 - DNA, 20 bp, Artificial Sequence
  chemically synthesized
attacagattatttacctaa

SEQ ID NO: 338270 - DNA, 20 bp, Artificial Sequence
  chemically synthesized
ttaggtaaataatctgtaat

SEQ ID NO: 338271 - DNA, 20 bp, Artificial Sequence
  chemically synthesized
atataaagaggcaccaatta

SEQ ID NO: 338272 - DNA, 20 bp, Artificial Sequence
  chemically synthesized
gcctcttccccgatataaag

SEQ ID NO: 338273 - DNA, 20 bp, Artificial Sequence
  chemically synthesized
taattggtgcctctttatat

SEQ ID NO: 338274 - DNA, 20 bp, Artificial Sequence
  chemically synthesized
agcctcttccccgatataaa

SEQ ID NO: 338275 - DNA, 20 bp, Artificial Sequence
  chemically synthesized
aattggtgcctctttatatc

SEQ ID NO: 338276 - DNA, 20 bp, Artificial Sequence
  chemically synthesized
attggtgcctctttatatcg

SEQ ID NO: 338277 - DNA, 20 bp, Artificial Sequence
  chemically synthesized
atagcctcttccccgatata

SEQ ID NO: 338278 - DNA, 20 bp, Artificial Sequence
  chemically synthesized
ggtgcctctttatatcgggg

SEQ ID NO: 338279 - DNA, 20 bp, Artificial Sequence
  chemically synthesized
tgcctctttatatcggggaa

SEQ ID NO: 338280 - DNA, 20 bp, Artificial Sequence
  chemically synthesized
gcctctttatatcggggaag

SEQ ID NO: 338281 - DNA, 20 bp, Artificial Sequence
  chemically synthesized
cggggaagaggctatattct

SEQ ID NO: 338282 - DNA, 20 bp, Artificial Sequence
  chemically synthesized
ctattttgctaccaagaata

SEQ ID NO: 338283 - DNA, 20 bp, Artificial Sequence
  chemically synthesized
ggaagaggctatattcttgg

SEQ ID NO: 338284 - DNA, 20 bp, Artificial Sequence
  chemically synthesized
aatcagactattttgctacc

SEQ ID NO: 338285 - DNA, 20 bp, Artificial Sequence
  chemically synthesized
ctatattcttggtagcaaaa

SEQ ID NO: 338286 - DNA, 20 bp, Artificial Sequence
  chemically synthesized
atatatgtaggtaattgaat

SEQ ID NO: 338287 - DNA, 20 bp, Artificial Sequence
  chemically synthesized
gattcaattacctacatata

SEQ ID NO: 338288 - DNA, 20 bp, Artificial Sequence
  chemically synthesized
agttgagtaactatatatgt

SEQ ID NO: 338289 - DNA, 20 bp, Artificial Sequence
  chemically synthesized
tagttgagtaactatatatg

SEQ ID NO: 338290 - DNA, 20 bp, Artificial Sequence
  chemically synthesized
tacatatatagttactcaac

SEQ ID NO: 338291 - DNA, 20 bp, Artificial Sequence
  chemically synthesized
catatatagttactcaacta

SEQ ID NO: 338292 - DNA, 20 bp, Artificial Sequence
  chemically synthesized
tttgcctaccttctctagtt

SEQ ID NO: 338293 - DNA, 20 bp, Artificial Sequence
  chemically synthesized
atatagttactcaactagag

SEQ ID NO: 338294 - DNA, 20 bp, Artificial Sequence
  chemically synthesized
tatagttactcaactagaga

SEQ ID NO: 338295 - DNA, 20 bp, Artificial Sequence
  chemically synthesized
agttactcaactagagaagg

SEQ ID NO: 338296 - DNA, 20 bp, Artificial Sequence
  chemically synthesized
acctatttgcctaccttctc

SEQ ID NO: 338297 - DNA, 20 bp, Artificial Sequence
  chemically synthesized
gttactcaactagagaaggt

SEQ ID NO: 338298 - DNA, 20 bp, Artificial Sequence
  chemically synthesized
aactagagaaggtaggcaaa

SEQ ID NO: 338299 - DNA, 20 bp, Artificial Sequence
  chemically synthesized
actagagaaggtaggcaaat

SEQ ID NO: 338300 - DNA, 20 bp, Artificial Sequence
  chemically synthesized
caactatgtccagttatgtt

SEQ ID NO: 338301 - DNA, 20 bp, Artificial Sequence
  chemically synthesized
tcacaaacactaaacataac

SEQ ID NO: 338302 - DNA, 20 bp, Artificial Sequence
  chemically synthesized
acactaaacataactggaca

SEQ ID NO: 338303 - DNA, 20 bp, Artificial Sequence
  chemically synthesized
atagtatttccaactatgtc

SEQ ID NO: 338304 - DNA, 20 bp, Artificial Sequence
  chemically synthesized
taaacataactggacatagt

SEQ ID NO: 338305 - DNA, 20 bp, Artificial Sequence
  chemically synthesized
gaggatgcatgggtgattca

SEQ ID NO: 338306 - DNA, 20 bp, Artificial Sequence
  chemically synthesized
aatcatgatagaggatgcat

SEQ ID NO: 338307 - DNA, 20 bp, Artificial Sequence
  chemically synthesized
taatcatgatagaggatgca

SEQ ID NO: 338308 - DNA, 20 bp, Artificial Sequence
  chemically synthesized
tgctatgataatcatgatag

SEQ ID NO: 338309 - DNA, 20 bp, Artificial Sequence
  chemically synthesized
ctgctatgataatcatgata

SEQ ID NO: 338310 - DNA, 20 bp, Artificial Sequence
  chemically synthesized
cactgctatgataatcatga

SEQ ID NO: 338311 - DNA, 20 bp, Artificial Sequence
  chemically synthesized
atcctctatcatgattatca

SEQ ID NO: 338312 - DNA, 20 bp, Artificial Sequence
  chemically synthesized
ctctatcatgattatcatag

SEQ ID NO: 338313 - DNA, 20 bp, Artificial Sequence
  chemically synthesized
tatcatagcagtgttcctca

SEQ ID NO: 338314 - DNA, 20 bp, Artificial Sequence
  chemically synthesized
ataagttgagatatactttg

SEQ ID NO: 338315 - DNA, 20 bp, Artificial Sequence
  chemically synthesized
gataagttgagatatacttt

SEQ ID NO: 338316 - DNA, 20 bp, Artificial Sequence
  chemically synthesized
caaagtatatctcaacttat

SEQ ID NO: 338317 - DNA, 20 bp, Artificial Sequence
  chemically synthesized
gatgcaatggctgataagtt

SEQ ID NO: 338318 - DNA, 20 bp, Artificial Sequence
  chemically synthesized
atgtggatgcaatggctgat

SEQ ID NO: 338319 - DNA, 20 bp, Artificial Sequence
  chemically synthesized
atcagattatgtggatgcaa

SEQ ID NO: 338320 - DNA, 20 bp, Artificial Sequence
  chemically synthesized
tttcaattcatcagattatg

SEQ ID NO: 338321 - DNA, 20 bp, Artificial Sequence
  chemically synthesized
aattattattttcaattcat

SEQ ID NO: 338322 - DNA, 20 bp, Artificial Sequence
  chemically synthesized
ttgaaaataataattaatat

SEQ ID NO: 338323 - DNA, 20 bp, Artificial Sequence
  chemically synthesized
aaataataattaatataaga

SEQ ID NO: 338324 - DNA, 20 bp, Artificial Sequence
  chemically synthesized
ataattaatataagatagac

SEQ ID NO: 338325 - DNA, 20 bp, Artificial Sequence
  chemically synthesized
ttaatataagatagactggt

SEQ ID NO: 338326 - DNA, 20 bp, Artificial Sequence
  chemically synthesized
atataagatagactggttgg

SEQ ID NO: 338327 - DNA, 20 bp, Artificial Sequence
  chemically synthesized
tgaagctatttgcttccaac

SEQ ID NO: 338328 - DNA, 20 bp, Artificial Sequence
  chemically synthesized
atagactggttggaagcaaa

SEQ ID NO: 338329 - DNA, 20 bp, Artificial Sequence
  chemically synthesized
tggaagcaaatagcttcaaa

SEQ ID NO: 338330 - DNA, 20 bp, Artificial Sequence
  chemically synthesized
tttgtaatactttctatttg

SEQ ID NO: 338331 - DNA, 20 bp, Artificial Sequence
  chemically synthesized
agcaaatagcttcaaataga

SEQ ID NO: 338332 - DNA, 20 bp, Artificial Sequence
  chemically synthesized
ttcaaatagaaagtattaca

SEQ ID NO: 338333 - DNA, 20 bp, Artificial Sequence
  chemically synthesized
tcaaatagaaagtattacaa

SEQ ID NO: 338334 - DNA, 20 bp, Artificial Sequence
  chemically synthesized
tagaaagtattacaaaggtt

SEQ ID NO: 338335 - DNA, 20 bp, Artificial Sequence
  chemically synthesized
aaaggttcagataatcttaa

SEQ ID NO: 338336 - DNA, 20 bp, Artificial Sequence
  chemically synthesized
aggttcagataatcttaata

SEQ ID NO: 338337 - DNA, 20 bp, Artificial Sequence
  chemically synthesized
tctagaagcttagctctatt

SEQ ID NO: 338338 - DNA, 20 bp, Artificial Sequence
  chemically synthesized
cagataatcttaatagagct

SEQ ID NO: 338339 - DNA, 20 bp, Artificial Sequence
  chemically synthesized
tcttaatagagctaagcttc

SEQ ID NO: 338340 - DNA, 20 bp, Artificial Sequence
  chemically synthesized
catgtaaacctctagaagct

SEQ ID NO: 338341 - DNA, 20 bp, Artificial Sequence
  chemically synthesized
ttaatagagctaagcttcta

SEQ ID NO: 338342 - DNA, 20 bp, Artificial Sequence
  chemically synthesized
taatagagctaagcttctag

SEQ ID NO: 338343 - DNA, 20 bp, Artificial Sequence
  chemically synthesized
tggttcatgtaaacctctag

SEQ ID NO: 338344 - DNA, 20 bp, Artificial Sequence
  chemically synthesized
atttggttcatgtaaacctc

SEQ ID NO: 338345 - DNA, 20 bp, Artificial Sequence
  chemically synthesized
gctcagtgctgatttttatt

SEQ ID NO: 338346 - DNA, 20 bp, Artificial Sequence
  chemically synthesized
tacatgaaccaaataaaaat

SEQ ID NO: 338347 - DNA, 20 bp, Artificial Sequence
  chemically synthesized
accaaataaaaatcagcact

SEQ ID NO: 338348 - DNA, 20 bp, Artificial Sequence
  chemically synthesized
tgaaaaggaatatgaaagct

SEQ ID NO: 338349 - DNA, 20 bp, Artificial Sequence
  chemically synthesized
gaaattgaaaaggaatatga

SEQ ID NO: 338350 - DNA, 20 bp, Artificial Sequence
  chemically synthesized
ttgataatgagaaattgaaa

SEQ ID NO: 338351 - DNA, 20 bp, Artificial Sequence
  chemically synthesized
attgataatgagaaattgaa

SEQ ID NO: 338352 - DNA, 20 bp, Artificial Sequence
  chemically synthesized
cagagaaacaaattgataat

SEQ ID NO: 338353 - DNA, 20 bp, Artificial Sequence
  chemically synthesized
atcaatttgtttctctgtgt

SEQ ID NO: 338354 - DNA, 20 bp, Artificial Sequence
  chemically synthesized
catcaccctacactcacaca

SEQ ID NO: 338355 - DNA, 20 bp, Artificial Sequence
  chemically synthesized
ttcatcaccctacactcaca

SEQ ID NO: 338356 - DNA, 20 bp, Artificial Sequence
  chemically synthesized
tttgtttctctgtgtgagtg

SEQ ID NO: 338357 - DNA, 20 bp, Artificial Sequence
  chemically synthesized
ttgtttctctgtgtgagtgt

SEQ ID NO: 338358 - DNA, 20 bp, Artificial Sequence
  chemically synthesized
tgtttctctgtgtgagtgta

SEQ ID NO: 338359 - DNA, 20 bp, Artificial Sequence
  chemically synthesized
tgtgtgagtgtagggtgatg

SEQ ID NO: 338360 - DNA, 20 bp, Artificial Sequence
  chemically synthesized
gtgtagggtgatgaagaatg

SEQ ID NO: 338361 - DNA, 20 bp, Artificial Sequence
  chemically synthesized
tagggtgatgaagaatgaag

SEQ ID NO: 338362 - DNA, 20 bp, Artificial Sequence
  chemically synthesized
aatgaagtagatgaaatttt

SEQ ID NO: 338363 - DNA, 20 bp, Artificial Sequence
  chemically synthesized
agtagatgaaattttcagta

SEQ ID NO: 338364 - DNA, 20 bp, Artificial Sequence
  chemically synthesized
taaagtatacatatgttgcc

SEQ ID NO: 338365 - DNA, 20 bp, Artificial Sequence
  chemically synthesized
tacatatgttgccaagaaat

SEQ ID NO: 338366 - DNA, 20 bp, Artificial Sequence
  chemically synthesized
attatttgcctctgatttct

SEQ ID NO: 338367 - DNA, 20 bp, Artificial Sequence
  chemically synthesized
catatgttgccaagaaatca

SEQ ID NO: 338368 - DNA, 20 bp, Artificial Sequence
  chemically synthesized
atatgttgccaagaaatcag

SEQ ID NO: 338369 - DNA, 20 bp, Artificial Sequence
  chemically synthesized
ggcaaataattctataactt

SEQ ID NO: 338370 - DNA, 20 bp, Artificial Sequence
  chemically synthesized
gcaaataattctataacttt

SEQ ID NO: 338371 - DNA, 20 bp, Artificial Sequence
  chemically synthesized
agtacaatgacccaaagtta

SEQ ID NO: 338372 - DNA, 20 bp, Artificial Sequence
  chemically synthesized
ttatttagtacaatgaccca

SEQ ID NO: 338373 - DNA, 20 bp, Artificial Sequence
  chemically synthesized
tgggtcattgtactaaataa

SEQ ID NO: 338374 - DNA, 20 bp, Artificial Sequence
  chemically synthesized
ggtcattgtactaaataaaa

SEQ ID NO: 338375 - DNA, 20 bp, Artificial Sequence
  chemically synthesized
actaaggtttctcttttatt

SEQ ID NO: 338376 - DNA, 20 bp, Artificial Sequence
  chemically synthesized
actaaataaaagagaaacct

SEQ ID NO: 338377 - DNA, 20 bp, Artificial Sequence
  chemically synthesized
gtttaaactttgcaatacta

SEQ ID NO: 338378 - DNA, 20 bp, Artificial Sequence
  chemically synthesized
agtttaaactttgcaatact

SEQ ID NO: 338379 - DNA, 20 bp, Artificial Sequence
  chemically synthesized
agagaaaccttagtattgca

SEQ ID NO: 338380 - DNA, 20 bp, Artificial Sequence
  chemically synthesized
caaatgcatattaacataat

SEQ ID NO: 338381 - DNA, 20 bp, Artificial Sequence
  chemically synthesized
tattttactataatatttgg

SEQ ID NO: 338382 - DNA, 20 bp, Artificial Sequence
  chemically synthesized
ttattttactataatatttg

SEQ ID NO: 338383 - DNA, 20 bp, Artificial Sequence
  chemically synthesized
gcatttgcctccaaatatta

SEQ ID NO: 338384 - DNA, 20 bp, Artificial Sequence
  chemically synthesized
cattattttactataatatt

SEQ ID NO: 338385 - DNA, 20 bp, Artificial Sequence
  chemically synthesized
caaatattatagtaaaataa

SEQ ID NO: 338386 - DNA, 20 bp, Artificial Sequence
  chemically synthesized
ggaataacaaaatttaattc

SEQ ID NO: 338387 - DNA, 20 bp, Artificial Sequence
  chemically synthesized
ataacaaaatttaattctgg

SEQ ID NO: 338388 - DNA, 20 bp, Artificial Sequence
  chemically synthesized
aatatccaaaatatttccac

SEQ ID NO: 338389 - DNA, 20 bp, Artificial Sequence
  chemically synthesized
taattctggtggaaatattt

SEQ ID NO: 338390 - DNA, 20 bp, Artificial Sequence
  chemically synthesized
gaaatattttggatattgta

SEQ ID NO: 338391 - DNA, 20 bp, Artificial Sequence
  chemically synthesized
acagatgcacatgatgcttt

SEQ ID NO: 338392 - DNA, 20 bp, Artificial Sequence
  chemically synthesized
gtctacatttaatatgctca

SEQ ID NO: 338393 - DNA, 20 bp, Artificial Sequence
  chemically synthesized
tgctttgagcatattaaatg

SEQ ID NO: 338394 - DNA, 20 bp, Artificial Sequence
  chemically synthesized
ttaaataagaacacaaaagt

SEQ ID NO: 338395 - DNA, 20 bp, Artificial Sequence
  chemically synthesized
taacttaaataagaacacaa

SEQ ID NO: 338396 - DNA, 20 bp, Artificial Sequence
  chemically synthesized
ttacttttgtgttcttattt

SEQ ID NO: 338397 - DNA, 20 bp, Artificial Sequence
  chemically synthesized
gcagtgaaaataacttaaat

SEQ ID NO: 338398 - DNA, 20 bp, Artificial Sequence
  chemically synthesized
tttaagttattttcactgct

SEQ ID NO: 338399 - DNA, 20 bp, Artificial Sequence
  chemically synthesized
aaagtatcaggcattccaag

SEQ ID NO: 338400 - DNA, 20 bp, Artificial Sequence
  chemically synthesized
aaaaaagtatcaggcattcc

SEQ ID NO: 338401 - DNA, 20 bp, Artificial Sequence
  chemically synthesized
taaatgaaaaaaaaagtatc

SEQ ID NO: 338402 - DNA, 20 bp, Artificial Sequence
  chemically synthesized
ataaatgaaaaaaaaagtat

SEQ ID NO: 338403 - DNA, 20 bp, Artificial Sequence
  chemically synthesized
agctaaataaatgaaaaaaa

SEQ ID NO: 338404 - DNA, 20 bp, Artificial Sequence
  chemically synthesized
tactttttttttcatttatt

SEQ ID NO: 338405 - DNA, 20 bp, Artificial Sequence
  chemically synthesized
acagtaaatgtacatttatt

SEQ ID NO: 338406 - DNA, 20 bp, Artificial Sequence
  chemically synthesized
aaatgtacatttactgttat

SEQ ID NO: 338407 - DNA, 20 bp, Artificial Sequence
  chemically synthesized
ggatattgactgactgataa

SEQ ID NO: 338408 - DNA, 20 bp, Artificial Sequence
  chemically synthesized
gtacatttactgttatcagt

SEQ ID NO: 338409 - DNA, 20 bp, Artificial Sequence
  chemically synthesized
tcagtcaatatccaaatgct

SEQ ID NO: 338410 - DNA, 20 bp, Artificial Sequence
  chemically synthesized
ataactgcacaccaagcatt

SEQ ID NO: 338411 - DNA, 20 bp, Artificial Sequence
  chemically synthesized
atatccaaatgcttggtgtg

SEQ ID NO: 338412 - DNA, 20 bp, Artificial Sequence
  chemically synthesized
ctgggaaataactgcacacc

SEQ ID NO: 338413 - DNA, 20 bp, Artificial Sequence
  chemically synthesized
cttggtgtgcagttatttcc

SEQ ID NO: 338414 - DNA, 20 bp, Artificial Sequence
  chemically synthesized
ccaagctcttgaggtattct

SEQ ID NO: 338415 - DNA, 20 bp, Artificial Sequence
  chemically synthesized
accaagctcttgaggtattc

SEQ ID NO: 338416 - DNA, 20 bp, Artificial Sequence
  chemically synthesized
gttatttcccagaatacctc

SEQ ID NO: 338417 - DNA, 20 bp, Artificial Sequence
  chemically synthesized
tatttcccagaatacctcaa

SEQ ID NO: 338418 - DNA, 20 bp, Artificial Sequence
  chemically synthesized
cattgtgtaccaagctcttg

SEQ ID NO: 338419 - DNA, 20 bp, Artificial Sequence
  chemically synthesized
cccagaatacctcaagagct

SEQ ID NO: 338420 - DNA, 20 bp, Artificial Sequence
  chemically synthesized
gcattgtgtaccaagctctt

SEQ ID NO: 338421 - DNA, 20 bp, Artificial Sequence
  chemically synthesized
ggaaaagggcattgtgtacc

SEQ ID NO: 338422 - DNA, 20 bp, Artificial Sequence
  chemically synthesized
aacgttcagaggttggaaaa

SEQ ID NO: 338423 - DNA, 20 bp, Artificial Sequence
  chemically synthesized
aaacgttcagaggttggaaa

SEQ ID NO: 338424 - DNA, 20 bp, Artificial Sequence
  chemically synthesized
taaacgttcagaggttggaa

SEQ ID NO: 338425 - DNA, 20 bp, Artificial Sequence
  chemically synthesized
ggtgataaacgttcagaggt

SEQ ID NO: 338426 - DNA, 20 bp, Artificial Sequence
  chemically synthesized
atctggtgataaacgttcag

SEQ ID NO: 338427 - DNA, 20 bp, Artificial Sequence
  chemically synthesized
tatctggtgataaacgttca

SEQ ID NO: 338428 - DNA, 20 bp, Artificial Sequence
  chemically synthesized
tctatctggtgataaacgtt

SEQ ID NO: 338429 - DNA, 20 bp, Artificial Sequence
  chemically synthesized
aacctctgaacgtttatcac

SEQ ID NO: 338430 - DNA, 20 bp, Artificial Sequence
  chemically synthesized
tctgaacgtttatcaccaga

SEQ ID NO: 338431 - DNA, 20 bp, Artificial Sequence
  chemically synthesized
attatatgatagagtctatc

SEQ ID NO: 338432 - DNA, 20 bp, Artificial Sequence
  chemically synthesized
taacaacgtattatatgata

SEQ ID NO: 338433 - DNA, 20 bp, Artificial Sequence
  chemically synthesized
gataacaacgtattatatga

SEQ ID NO: 338434 - DNA, 20 bp, Artificial Sequence
  chemically synthesized
catataatacgttgttatcc

SEQ ID NO: 338435 - DNA, 20 bp, Artificial Sequence
  chemically synthesized
cacgtgtgcacatgcaagct

SEQ ID NO: 338436 - DNA, 20 bp, Artificial Sequence
  chemically synthesized
gcacgtgtgcacatgcaagc

SEQ ID NO: 338437 - DNA, 20 bp, Artificial Sequence
  chemically synthesized
gtgtgcacgtgtgcacatgc

SEQ ID NO: 338438 - DNA, 20 bp, Artificial Sequence
  chemically synthesized
ttctaatgggtcaggtcata

SEQ ID NO: 338439 - DNA, 20 bp, Artificial Sequence
  chemically synthesized
tactatatgacctgacccat

SEQ ID NO: 338440 - DNA, 20 bp, Artificial Sequence
  chemically synthesized
tgaatgaattctaatgggtc

SEQ ID NO: 338441 - DNA, 20 bp, Artificial Sequence
  chemically synthesized
atgaatgaattctaatgggt

SEQ ID NO: 338442 - DNA, 20 bp, Artificial Sequence
  chemically synthesized
atgaatgaatgaattctaat

SEQ ID NO: 338443 - DNA, 20 bp, Artificial Sequence
  chemically synthesized
tatgaatgaatgaattctaa

SEQ ID NO: 338444 - DNA, 20 bp, Artificial Sequence
  chemically synthesized
acacacacgttttaatatta

SEQ ID NO: 338445 - DNA, 20 bp, Artificial Sequence
  chemically synthesized
taaagtaaattaaatatatt

SEQ ID NO: 338446 - DNA, 20 bp, Artificial Sequence
  chemically synthesized
attaagtaaataaaatacac

SEQ ID NO: 338447 - DNA, 20 bp, Artificial Sequence
  chemically synthesized
aaaatacacaagatacttac

SEQ ID NO: 338448 - DNA, 20 bp, Artificial Sequence
  chemically synthesized
acacaagatacttacaagta

SEQ ID NO: 338449 - DNA, 20 bp, Artificial Sequence
  chemically synthesized
gtcttgtttgctttacttgt

SEQ ID NO: 338450 - DNA, 20 bp, Artificial Sequence
  chemically synthesized
tacttacaagtaaagcaaac

SEQ ID NO: 338451 - DNA, 20 bp, Artificial Sequence
  chemically synthesized
agcaaacaagacaacattac

SEQ ID NO: 338452 - DNA, 20 bp, Artificial Sequence
  chemically synthesized
agaaacagtcaaagaaatgc

SEQ ID NO: 338453 - DNA, 20 bp, Artificial Sequence
  chemically synthesized
ctgtcagatagaaacagtca

SEQ ID NO: 338454 - DNA, 20 bp, Artificial Sequence
  chemically synthesized
gtggctctgtcagatagaaa

SEQ ID NO: 338455 - DNA, 20 bp, Artificial Sequence
  chemically synthesized
ctttgactgtttctatctga

SEQ ID NO: 338456 - DNA, 20 bp, Artificial Sequence
  chemically synthesized
ttgactgtttctatctgaca

SEQ ID NO: 338457 - DNA, 20 bp, Artificial Sequence
  chemically synthesized
tgttgagtggctctgtcaga

SEQ ID NO: 338458 - DNA, 20 bp, Artificial Sequence
  chemically synthesized
cgagtgttgagtggctctgt

SEQ ID NO: 338459 - DNA, 20 bp, Artificial Sequence
  chemically synthesized
taggtgttacgagtgttgag

SEQ ID NO: 338460 - DNA, 20 bp, Artificial Sequence
  chemically synthesized
taataggtgttacgagtgtt

SEQ ID NO: 338461 - DNA, 20 bp, Artificial Sequence
  chemically synthesized
actcgtataataggtgttac

SEQ ID NO: 338462 - DNA, 20 bp, Artificial Sequence
  chemically synthesized
actcgtaacacctattatac

SEQ ID NO: 338463 - DNA, 20 bp, Artificial Sequence
  chemically synthesized
tatgatttgactcgtataat

SEQ ID NO: 338464 - DNA, 20 bp, Artificial Sequence
  chemically synthesized
gtatgatttgactcgtataa

SEQ ID NO: 338465 - DNA, 20 bp, Artificial Sequence
  chemically synthesized
agtcaaatcataccttacaa

SEQ ID NO: 338466 - DNA, 20 bp, Artificial Sequence
  chemically synthesized
tcaaatcataccttacaaaa

SEQ ID NO: 338467 - DNA, 20 bp, Artificial Sequence
  chemically synthesized
tagacaaaaactcttttgta

SEQ ID NO: 338468 - DNA, 20 bp, Artificial Sequence
  chemically synthesized
gtagacaaaaactcttttgt

SEQ ID NO: 338469 - DNA, 20 bp, Artificial Sequence
  chemically synthesized
acaacaataaagaattgtgg

SEQ ID NO: 338470 - DNA, 20 bp, Artificial Sequence
  chemically synthesized
gtaacaacaataaagaattg

SEQ ID NO: 338471 - DNA, 20 bp, Artificial Sequence
  chemically synthesized
tagaaaaggtaacaacaata

SEQ ID NO: 338472 - DNA, 20 bp, Artificial Sequence
  chemically synthesized
attctgaaaaaaattagaaa

SEQ ID NO: 338473 - DNA, 20 bp, Artificial Sequence
  chemically synthesized
cattctgaaaaaaattagaa

SEQ ID NO: 338474 - DNA, 20 bp, Artificial Sequence
  chemically synthesized
cctcccattctgaaaaaaat

SEQ ID NO: 338475 - DNA, 20 bp, Artificial Sequence
  chemically synthesized
ttaccttttctaattttttt

SEQ ID NO: 338476 - DNA, 20 bp, Artificial Sequence
  chemically synthesized
ttttctaatttttttcagaa

SEQ ID NO: 338477 - DNA, 20 bp, Artificial Sequence
  chemically synthesized
tttctaatttttttcagaat

SEQ ID NO: 338478 - DNA, 20 bp, Artificial Sequence
  chemically synthesized
tctaatttttttcagaatgg

SEQ ID NO: 338479 - DNA, 20 bp, Artificial Sequence
  chemically synthesized
ctaatttttttcagaatggg

SEQ ID NO: 338480 - DNA, 20 bp, Artificial Sequence
  chemically synthesized
taatttttttcagaatggga

SEQ ID NO: 338481 - DNA, 20 bp, Artificial Sequence
  chemically synthesized
aatttttttcagaatgggag

SEQ ID NO: 338482 - DNA, 20 bp, Artificial Sequence
  chemically synthesized
ggggaaacaatatgaactcc

SEQ ID NO: 338483 - DNA, 20 bp, Artificial Sequence
  chemically synthesized
gaaacaatatgaactcctag

SEQ ID NO: 338484 - DNA, 20 bp, Artificial Sequence
  chemically synthesized
taaaatgcattgtcttctag

SEQ ID NO: 338485 - DNA, 20 bp, Artificial Sequence
  chemically synthesized
gttaaaatgcattgtcttct

SEQ ID NO: 338486 - DNA, 20 bp, Artificial Sequence
  chemically synthesized
cgttaaaatgcattgtcttc

SEQ ID NO: 338487 - DNA, 20 bp, Artificial Sequence
  chemically synthesized
tagaagacaatgcattttaa

SEQ ID NO: 338488 - DNA, 20 bp, Artificial Sequence
  chemically synthesized
cattttaacggtctaatacc

SEQ ID NO: 338489 - DNA, 20 bp, Artificial Sequence
  chemically synthesized
aaatgagccagtcttggtat

SEQ ID NO: 338490 - DNA, 20 bp, Artificial Sequence
  chemically synthesized
taacggtctaataccaagac

SEQ ID NO: 338491 - DNA, 20 bp, Artificial Sequence
  chemically synthesized
ggtgcaaaatgagccagtct

SEQ ID NO: 338492 - DNA, 20 bp, Artificial Sequence
  chemically synthesized
ttaatgggtgcaaaatgagc

SEQ ID NO: 338493 - DNA, 20 bp, Artificial Sequence
  chemically synthesized
gcatttaatgggtgcaaaat

SEQ ID NO: 338494 - DNA, 20 bp, Artificial Sequence
  chemically synthesized
ttttttcacaggcatttaat

SEQ ID NO: 338495 - DNA, 20 bp, Artificial Sequence
  chemically synthesized
attttttcacaggcatttaa

SEQ ID NO: 338496 - DNA, 20 bp, Artificial Sequence
  chemically synthesized
attttggtcaattttttcac

SEQ ID NO: 338497 - DNA, 20 bp, Artificial Sequence
  chemically synthesized
aattttggtcaattttttca

SEQ ID NO: 338498 - DNA, 20 bp, Artificial Sequence
  chemically synthesized
gtgaaaaaattgaccaaaat

SEQ ID NO: 338499 - DNA, 20 bp, Artificial Sequence
  chemically synthesized
gttccatctgtgaccaattt

SEQ ID NO: 338500 - DNA, 20 bp, Artificial Sequence
  chemically synthesized
aaattgaccaaaattggtca

SEQ ID NO: 338501 - DNA, 20 bp, Artificial Sequence
  chemically synthesized
tgaccaaaattggtcacaga

SEQ ID NO: 338502 - DNA, 20 bp, Artificial Sequence
  chemically synthesized
aattatctaagaagagcaat

SEQ ID NO: 338503 - DNA, 20 bp, Artificial Sequence
  chemically synthesized
acacatctcattgctcttct

SEQ ID NO: 338504 - DNA, 20 bp, Artificial Sequence
  chemically synthesized
taatagaaattatctaagaa

SEQ ID NO: 338505 - DNA, 20 bp, Artificial Sequence
  chemically synthesized
agtaatagaaattatctaag

SEQ ID NO: 338506 - DNA, 20 bp, Artificial Sequence
  chemically synthesized
gtaagtaatagaaattatct

SEQ ID NO: 338507 - DNA, 20 bp, Artificial Sequence
  chemically synthesized
gtaaaagaaaatgtaagtaa

SEQ ID NO: 338508 - DNA, 20 bp, Artificial Sequence
  chemically synthesized
acgattgtaaaagaaaatgt

SEQ ID NO: 338509 - DNA, 20 bp, Artificial Sequence
  chemically synthesized
aagtaaaaaaacgattgtaa

SEQ ID NO: 338510 - DNA, 20 bp, Artificial Sequence
  chemically synthesized
tttacaatcgtttttttact

SEQ ID NO: 338511 - DNA, 20 bp, Artificial Sequence
  chemically synthesized
tgctcatttggatgtgagct

SEQ ID NO: 338512 - DNA, 20 bp, Artificial Sequence
  chemically synthesized
taatttgctcatttggatgt

SEQ ID NO: 338513 - DNA, 20 bp, Artificial Sequence
  chemically synthesized
tacttagctcacatccaaat

SEQ ID NO: 338514 - DNA, 20 bp, Artificial Sequence
  chemically synthesized
atgaatgtaatttgctcatt

SEQ ID NO: 338515 - DNA, 20 bp, Artificial Sequence
  chemically synthesized
atgagcaaattacattcatt

SEQ ID NO: 338516 - DNA, 20 bp, Artificial Sequence
  chemically synthesized
attcacattgtttgccccca

SEQ ID NO: 338517 - DNA, 20 bp, Artificial Sequence
  chemically synthesized
ttcacattgtttgcccccat

SEQ ID NO: 338518 - DNA, 20 bp, Artificial Sequence
  chemically synthesized
tcacattgtttgcccccatg

SEQ ID NO: 338519 - DNA, 20 bp, Artificial Sequence
  chemically synthesized
cgttaaaaaaatccccatgg

SEQ ID NO: 338520 - DNA, 20 bp, Artificial Sequence
  chemically synthesized
gcgttaaaaaaatccccatg

SEQ ID NO: 338521 - DNA, 20 bp, Artificial Sequence
  chemically synthesized
ggcgttaaaaaaatccccat

SEQ ID NO: 338522 - DNA, 20 bp, Artificial Sequence
  chemically synthesized
aggcgttaaaaaaatcccca

SEQ ID NO: 338523 - DNA, 20 bp, Artificial Sequence
  chemically synthesized
ggatttttttaacgcctttt

SEQ ID NO: 338524 - DNA, 20 bp, Artificial Sequence
  chemically synthesized
tatttaagtagtttctaaaa

SEQ ID NO: 338525 - DNA, 20 bp, Artificial Sequence
  chemically synthesized
ctatttaagtagtttctaaa

SEQ ID NO: 338526 - DNA, 20 bp, Artificial Sequence
  chemically synthesized
ctttttagaaactacttaaa

SEQ ID NO: 338527 - DNA, 20 bp, Artificial Sequence
  chemically synthesized
tttttagaaactacttaaat

SEQ ID NO: 338528 - DNA, 20 bp, Artificial Sequence
  chemically synthesized
aaatttaggacctatttaag

SEQ ID NO: 338529 - DNA, 20 bp, Artificial Sequence
  chemically synthesized
aataaatttaggacctattt

SEQ ID NO: 338530 - DNA, 20 bp, Artificial Sequence
  chemically synthesized
tggaccaagataataaattt

SEQ ID NO: 338531 - DNA, 20 bp, Artificial Sequence
  chemically synthesized
atggaccaagataataaatt

SEQ ID NO: 338532 - DNA, 20 bp, Artificial Sequence
  chemically synthesized
aggtcctaaatttattatct

SEQ ID NO: 338533 - DNA, 20 bp, Artificial Sequence
  chemically synthesized
aaatttattatcttggtcca

SEQ ID NO: 338534 - DNA, 20 bp, Artificial Sequence
  chemically synthesized
aatttattatcttggtccat

SEQ ID NO: 338535 - DNA, 20 bp, Artificial Sequence
  chemically synthesized
ttattcaacacccatggacc

SEQ ID NO: 338536 - DNA, 20 bp, Artificial Sequence
  chemically synthesized
gtttgcttattcaacaccca

SEQ ID NO: 338537 - DNA, 20 bp, Artificial Sequence
  chemically synthesized
ttggtccatgggtgttgaat

SEQ ID NO: 338538 - DNA, 20 bp, Artificial Sequence
  chemically synthesized
gggtgttgaataagcaaact

SEQ ID NO: 338539 - DNA, 20 bp, Artificial Sequence
  chemically synthesized
agttgtaacaatgattttct

SEQ ID NO: 338540 - DNA, 20 bp, Artificial Sequence
  chemically synthesized
catttttaatgtagaattga

SEQ ID NO: 338541 - DNA, 20 bp, Artificial Sequence
  chemically synthesized
ttttaacatcatttttaatg

SEQ ID NO: 338542 - DNA, 20 bp, Artificial Sequence
  chemically synthesized
ttaaaaatgatgttaaaatc

SEQ ID NO: 338543 - DNA, 20 bp, Artificial Sequence
  chemically synthesized
cagatccagagatgtatgac

SEQ ID NO: 338544 - DNA, 20 bp, Artificial Sequence
  chemically synthesized
aaaatctggtcatacatctc

SEQ ID NO: 338545 - DNA, 20 bp, Artificial Sequence
  chemically synthesized
tctaaaatatgtcagatcca

SEQ ID NO: 338546 - DNA, 20 bp, Artificial Sequence
  chemically synthesized
tatctaaaatatgtcagatc

SEQ ID NO: 338547 - DNA, 20 bp, Artificial Sequence
  chemically synthesized
aatatttatctaaaatatgt

SEQ ID NO: 338548 - DNA, 20 bp, Artificial Sequence
  chemically synthesized
tctctggatctgacatattt

SEQ ID NO: 338549 - DNA, 20 bp, Artificial Sequence
  chemically synthesized
gacatattttagataaatat

SEQ ID NO: 338550 - DNA, 20 bp, Artificial Sequence
  chemically synthesized
tattttagataaatattaga

SEQ ID NO: 338551 - DNA, 20 bp, Artificial Sequence
  chemically synthesized
attttagataaatattagaa

SEQ ID NO: 338552 - DNA, 20 bp, Artificial Sequence
  chemically synthesized
ttttagataaatattagaaa

SEQ ID NO: 338553 - DNA, 20 bp, Artificial Sequence
  chemically synthesized
gataaatattagaaagggtt

SEQ ID NO: 338554 - DNA, 20 bp, Artificial Sequence
  chemically synthesized
aaatattagaaagggttaag

SEQ ID NO: 338555 - DNA, 20 bp, Artificial Sequence
  chemically synthesized
ttagaaagggttaagtagct

SEQ ID NO: 338556 - DNA, 20 bp, Artificial Sequence
  chemically synthesized
tagaaagggttaagtagctg

SEQ ID NO: 338557 - DNA, 20 bp, Artificial Sequence
  chemically synthesized
gggttaagtagctgaggcga

SEQ ID NO: 338558 - DNA, 20 bp, Artificial Sequence
  chemically synthesized
agttaaaatgtctatcgcct

SEQ ID NO: 338559 - DNA, 20 bp, Artificial Sequence
  chemically synthesized
gaggcgatagacattttaac

SEQ ID NO: 338560 - DNA, 20 bp, Artificial Sequence
  chemically synthesized
cgatagacattttaactagc

SEQ ID NO: 338561 - DNA, 20 bp, Artificial Sequence
  chemically synthesized
tgagaaagatttgatctagc

SEQ ID NO: 338562 - DNA, 20 bp, Artificial Sequence
  chemically synthesized
attatgagaaagatttgatc

SEQ ID NO: 338563 - DNA, 20 bp, Artificial Sequence
  chemically synthesized
tctatgcatacattatgaga

SEQ ID NO: 338564 - DNA, 20 bp, Artificial Sequence
  chemically synthesized
ttgatctatgcatacattat

SEQ ID NO: 338565 - DNA, 20 bp, Artificial Sequence
  chemically synthesized
tctttctcataatgtatgca

SEQ ID NO: 338566 - DNA, 20 bp, Artificial Sequence
  chemically synthesized
gataataatggggtaaaatg

SEQ ID NO: 338567 - DNA, 20 bp, Artificial Sequence
  chemically synthesized
tataaaagcagataataatg

SEQ ID NO: 338568 - DNA, 20 bp, Artificial Sequence
  chemically synthesized
atataaaagcagataataat

SEQ ID NO: 338569 - DNA, 20 bp, Artificial Sequence
  chemically synthesized
aatataaaagcagataataa

SEQ ID NO: 338570 - DNA, 20 bp, Artificial Sequence
  chemically synthesized
tttttaaaaaaatataaaag

SEQ ID NO: 338571 - DNA, 20 bp, Artificial Sequence
  chemically synthesized
ccttttttaaaaaaatataa

SEQ ID NO: 338572 - DNA, 20 bp, Artificial Sequence
  chemically synthesized
gcttttatatttttttaaaa

SEQ ID NO: 338573 - DNA, 20 bp, Artificial Sequence
  chemically synthesized
cttttatatttttttaaaaa

SEQ ID NO: 338574 - DNA, 20 bp, Artificial Sequence
  chemically synthesized
ttttatatttttttaaaaaa

SEQ ID NO: 338575 - DNA, 20 bp, Artificial Sequence
  chemically synthesized
atatttttttaaaaaagggt

SEQ ID NO: 338576 - DNA, 20 bp, Artificial Sequence
  chemically synthesized
aaatttagagtttcgatata

SEQ ID NO: 338577 - DNA, 20 bp, Artificial Sequence
  chemically synthesized
atgtgggataaataaattta

SEQ ID NO: 338578 - DNA, 20 bp, Artificial Sequence
  chemically synthesized
ttatgtgggataaataaatt

SEQ ID NO: 338579 - DNA, 20 bp, Artificial Sequence
  chemically synthesized
atggaaacttgcagttatgt

SEQ ID NO: 338580 - DNA, 20 bp, Artificial Sequence
  chemically synthesized
catggaaacttgcagttatg

SEQ ID NO: 338581 - DNA, 20 bp, Artificial Sequence
  chemically synthesized
tatttatcccacataactgc

SEQ ID NO: 338582 - DNA, 20 bp, Artificial Sequence
  chemically synthesized
aatgtgtacatggaaacttg

SEQ ID NO: 338583 - DNA, 20 bp, Artificial Sequence
  chemically synthesized
gaaataagtcaatgtgtaca

SEQ ID NO: 338584 - DNA, 20 bp, Artificial Sequence
  chemically synthesized
agtagtgagggtgaggaaat

SEQ ID NO: 338585 - DNA, 20 bp, Artificial Sequence
  chemically synthesized
taccaggagtagtgagggtg

SEQ ID NO: 338586 - DNA, 20 bp, Artificial Sequence
  chemically synthesized
ttaccaggagtagtgagggt

SEQ ID NO: 338587 - DNA, 20 bp, Artificial Sequence
  chemically synthesized
gtgattaccaggagtagtga

SEQ ID NO: 338588 - DNA, 20 bp, Artificial Sequence
  chemically synthesized
ggtgattaccaggagtagtg

SEQ ID NO: 338589 - DNA, 20 bp, Artificial Sequence
  chemically synthesized
tggtgattaccaggagtagt

SEQ ID NO: 338590 - DNA, 20 bp, Artificial Sequence
  chemically synthesized
ttcctcaccctcactactcc

SEQ ID NO: 338591 - DNA, 20 bp, Artificial Sequence
  chemically synthesized
agaatggtgattaccaggag

SEQ ID NO: 338592 - DNA, 20 bp, Artificial Sequence
  chemically synthesized
agtagaatggtgattaccag

SEQ ID NO: 338593 - DNA, 20 bp, Artificial Sequence
  chemically synthesized
acagtagaatggtgattacc

SEQ ID NO: 338594 - DNA, 20 bp, Artificial Sequence
  chemically synthesized
gacagtagaatggtgattac

SEQ ID NO: 338595 - DNA, 20 bp, Artificial Sequence
  chemically synthesized
tgaatacatagacagtagaa

SEQ ID NO: 338596 - DNA, 20 bp, Artificial Sequence
  chemically synthesized
taagttgaatacatagacag

SEQ ID NO: 338597 - DNA, 20 bp, Artificial Sequence
  chemically synthesized
gtataagttgaatacataga

SEQ ID NO: 338598 - DNA, 20 bp, Artificial Sequence
  chemically synthesized
aaatgtataagttgaataca

SEQ ID NO: 338599 - DNA, 20 bp, Artificial Sequence
  chemically synthesized
gaaatctgaagaaaatgtat

SEQ ID NO: 338600 - DNA, 20 bp, Artificial Sequence
  chemically synthesized
ttcaacttatacattttctt

SEQ ID NO: 338601 - DNA, 20 bp, Artificial Sequence
  chemically synthesized
tatacattttcttcagattt

SEQ ID NO: 338602 - DNA, 20 bp, Artificial Sequence
  chemically synthesized
tatctaacatctgaaatctg

SEQ ID NO: 338603 - DNA, 20 bp, Artificial Sequence
  chemically synthesized
tttcttcagatttcagatgt

SEQ ID NO: 338604 - DNA, 20 bp, Artificial Sequence
  chemically synthesized
atttcagatgttagataacg

SEQ ID NO: 338605 - DNA, 20 bp, Artificial Sequence
  chemically synthesized
taagtgaaataagcaagaca

SEQ ID NO: 338606 - DNA, 20 bp, Artificial Sequence
  chemically synthesized
ttacactaagtgaaataagc

SEQ ID NO: 338607 - DNA, 20 bp, Artificial Sequence
  chemically synthesized
gaaattacactaagtgaaat

SEQ ID NO: 338608 - DNA, 20 bp, Artificial Sequence
  chemically synthesized
tgtgtcttgcttatttcact

SEQ ID NO: 338609 - DNA, 20 bp, Artificial Sequence
  chemically synthesized
agcctgaaggaaattacact

SEQ ID NO: 338610 - DNA, 20 bp, Artificial Sequence
  chemically synthesized
tcacttagtgtaatttcctt

SEQ ID NO: 338611 - DNA, 20 bp, Artificial Sequence
  chemically synthesized
cacttagtgtaatttccttc

SEQ ID NO: 338612 - DNA, 20 bp, Artificial Sequence
  chemically synthesized
aacaacataggtgagcctga

SEQ ID NO: 338613 - DNA, 20 bp, Artificial Sequence
  chemically synthesized
taacaacataggtgagcctg

SEQ ID NO: 338614 - DNA, 20 bp, Artificial Sequence
  chemically synthesized
ccatttgtaacaacataggt

SEQ ID NO: 338615 - DNA, 20 bp, Artificial Sequence
  chemically synthesized
agtgccatttgtaacaacat

SEQ ID NO: 338616 - DNA, 20 bp, Artificial Sequence
  chemically synthesized
tagtgccatttgtaacaaca

SEQ ID NO: 338617 - DNA, 20 bp, Artificial Sequence
  chemically synthesized
ctcacctatgttgttacaaa

SEQ ID NO: 338618 - DNA, 20 bp, Artificial Sequence
  chemically synthesized
atattcagcctcacaaaaga

SEQ ID NO: 338619 - DNA, 20 bp, Artificial Sequence
  chemically synthesized
caaatggcactatcttttgt

SEQ ID NO: 338620 - DNA, 20 bp, Artificial Sequence
  chemically synthesized
aaatggcactatcttttgtg

SEQ ID NO: 338621 - DNA, 20 bp, Artificial Sequence
  chemically synthesized
acaaatattcagcctcacaa

SEQ ID NO: 338622 - DNA, 20 bp, Artificial Sequence
  chemically synthesized
cacacacacacacaaatatt

SEQ ID NO: 338623 - DNA, 20 bp, Artificial Sequence
  chemically synthesized
gtcacaatttctttatctgt

SEQ ID NO: 338624 - DNA, 20 bp, Artificial Sequence
  chemically synthesized
tgagtgtccactgacagata

SEQ ID NO: 338625 - DNA, 20 bp, Artificial Sequence
  chemically synthesized
acaatttctttatctgtcag

SEQ ID NO: 338626 - DNA, 20 bp, Artificial Sequence
  chemically synthesized
ataacctgagtgtccactga

SEQ ID NO: 338627 - DNA, 20 bp, Artificial Sequence
  chemically synthesized
tttatctgtcagtggacact

SEQ ID NO: 338628 - DNA, 20 bp, Artificial Sequence
  chemically synthesized
ttatctgtcagtggacactc

SEQ ID NO: 338629 - DNA, 20 bp, Artificial Sequence
  chemically synthesized
ccaagatatgaaaataacct

SEQ ID NO: 338630 - DNA, 20 bp, Artificial Sequence
  chemically synthesized
ctcaggttattttcatatct

SEQ ID NO: 338631 - DNA, 20 bp, Artificial Sequence
  chemically synthesized
cgttatgattcataatagcc

SEQ ID NO: 338632 - DNA, 20 bp, Artificial Sequence
  chemically synthesized
cattgcgttatgattcataa

SEQ ID NO: 338633 - DNA, 20 bp, Artificial Sequence
  chemically synthesized
aatcataacgcaatgaacat

SEQ ID NO: 338634 - DNA, 20 bp, Artificial Sequence
  chemically synthesized
tcataacgcaatgaacatga

SEQ ID NO: 338635 - DNA, 20 bp, Artificial Sequence
  chemically synthesized
aacgcaatgaacatgagagt

SEQ ID NO: 338636 - DNA, 20 bp, Artificial Sequence
  chemically synthesized
acgcaatgaacatgagagta

SEQ ID NO: 338637 - DNA, 20 bp, Artificial Sequence
  chemically synthesized
gagagtaaggctatctccac

SEQ ID NO: 338638 - DNA, 20 bp, Artificial Sequence
  chemically synthesized
aaatcagaaccttgtggaga

SEQ ID NO: 338639 - DNA, 20 bp, Artificial Sequence
  chemically synthesized
agagtaaggctatctccaca

SEQ ID NO: 338640 - DNA, 20 bp, Artificial Sequence
  chemically synthesized
aatgaaatcagaaccttgtg

SEQ ID NO: 338641 - DNA, 20 bp, Artificial Sequence
  chemically synthesized
aaaatgaaatcagaaccttg

SEQ ID NO: 338642 - DNA, 20 bp, Artificial Sequence
  chemically synthesized
agacccacagaaaatgaaat

SEQ ID NO: 338643 - DNA, 20 bp, Artificial Sequence
  chemically synthesized
ggttctgatttcattttctg

SEQ ID NO: 338644 - DNA, 20 bp, Artificial Sequence
  chemically synthesized
gttctgatttcattttctgt

SEQ ID NO: 338645 - DNA, 20 bp, Artificial Sequence
  chemically synthesized
cactcctgggtatagaccca

SEQ ID NO: 338646 - DNA, 20 bp, Artificial Sequence
  chemically synthesized
attttctgtgggtctatacc

SEQ ID NO: 338647 - DNA, 20 bp, Artificial Sequence
  chemically synthesized
ttttctgtgggtctataccc

SEQ ID NO: 338648 - DNA, 20 bp, Artificial Sequence
  chemically synthesized
ttctgtgggtctatacccag

SEQ ID NO: 338649 - DNA, 20 bp, Artificial Sequence
  chemically synthesized
aacaatcccactcctgggta

SEQ ID NO: 338650 - DNA, 20 bp, Artificial Sequence
  chemically synthesized
tgtgggtctatacccaggag

SEQ ID NO: 338651 - DNA, 20 bp, Artificial Sequence
  chemically synthesized
gtgggtctatacccaggagt

SEQ ID NO: 338652 - DNA, 20 bp, Artificial Sequence
  chemically synthesized
gacccaacaatcccactcct

SEQ ID NO: 338653 - DNA, 20 bp, Artificial Sequence
  chemically synthesized
tgacccaacaatcccactcc

SEQ ID NO: 338654 - DNA, 20 bp, Artificial Sequence
  chemically synthesized
atacccaggagtgggattgt

SEQ ID NO: 338655 - DNA, 20 bp, Artificial Sequence
  chemically synthesized
tacccaggagtgggattgtt

SEQ ID NO: 338656 - DNA, 20 bp, Artificial Sequence
  chemically synthesized
agtgggattgttgggtcata

SEQ ID NO: 338657 - DNA, 20 bp, Artificial Sequence
  chemically synthesized
gggattgttgggtcatatgg

SEQ ID NO: 338658 - DNA, 20 bp, Artificial Sequence
  chemically synthesized
tttcctcaaaaagttaaaaa

SEQ ID NO: 338659 - DNA, 20 bp, Artificial Sequence
  chemically synthesized
agttctatttttaacttttt

SEQ ID NO: 338660 - DNA, 20 bp, Artificial Sequence
  chemically synthesized
gttctatttttaactttttg

SEQ ID NO: 338661 - DNA, 20 bp, Artificial Sequence
  chemically synthesized
tctgggagtgtttcctcaaa

SEQ ID NO: 338662 - DNA, 20 bp, Artificial Sequence
  chemically synthesized
actttttgaggaaacactcc

SEQ ID NO: 338663 - DNA, 20 bp, Artificial Sequence
  chemically synthesized
cattatggaaaattgtctgg

SEQ ID NO: 338664 - DNA, 20 bp, Artificial Sequence
  chemically synthesized
gacattatggaaaattgtct

SEQ ID NO: 338665 - DNA, 20 bp, Artificial Sequence
  chemically synthesized
agacattatggaaaattgtc

SEQ ID NO: 338666 - DNA, 20 bp, Artificial Sequence
  chemically synthesized
gtaaattagagcagacatta

SEQ ID NO: 338667 - DNA, 20 bp, Artificial Sequence
  chemically synthesized
ggtgtcggtgtaaattagag

SEQ ID NO: 338668 - DNA, 20 bp, Artificial Sequence
  chemically synthesized
gctggtgtcggtgtaaatta

SEQ ID NO: 338669 - DNA, 20 bp, Artificial Sequence
  chemically synthesized
ctgctggtgtcggtgtaaat

SEQ ID NO: 338670 - DNA, 20 bp, Artificial Sequence
  chemically synthesized
gctctaatttacaccgacac

SEQ ID NO: 338671 - DNA, 20 bp, Artificial Sequence
  chemically synthesized
ctaatttacaccgacaccag

SEQ ID NO: 338672 - DNA, 20 bp, Artificial Sequence
  chemically synthesized
ccctgacatactgctggtgt

SEQ ID NO: 338673 - DNA, 20 bp, Artificial Sequence
  chemically synthesized
agggaaccctgacatactgc

SEQ ID NO: 338674 - DNA, 20 bp, Artificial Sequence
  chemically synthesized
caccgacaccagcagtatgt

SEQ ID NO: 338675 - DNA, 20 bp, Artificial Sequence
  chemically synthesized
accgacaccagcagtatgtc

SEQ ID NO: 338676 - DNA, 20 bp, Artificial Sequence
  chemically synthesized
ccgacaccagcagtatgtca

SEQ ID NO: 338677 - DNA, 20 bp, Artificial Sequence
  chemically synthesized
cagtaaaggcaaggaggaaa

SEQ ID NO: 338678 - DNA, 20 bp, Artificial Sequence
  chemically synthesized
ccagtaaaggcaaggaggaa

SEQ ID NO: 338679 - DNA, 20 bp, Artificial Sequence
  chemically synthesized
gccagtaaaggcaaggagga

SEQ ID NO: 338680 - DNA, 20 bp, Artificial Sequence
  chemically synthesized
aagtgccagtaaaggcaagg

SEQ ID NO: 338681 - DNA, 20 bp, Artificial Sequence
  chemically synthesized
caagtgccagtaaaggcaag

SEQ ID NO: 338682 - DNA, 20 bp, Artificial Sequence
  chemically synthesized
aacaagtgccagtaaaggca

SEQ ID NO: 338683 - DNA, 20 bp, Artificial Sequence
  chemically synthesized
taacaagtgccagtaaaggc

SEQ ID NO: 338684 - DNA, 20 bp, Artificial Sequence
  chemically synthesized
cctttcctccttgcctttac

SEQ ID NO: 338685 - DNA, 20 bp, Artificial Sequence
  chemically synthesized
gagataacaagtgccagtaa

SEQ ID NO: 338686 - DNA, 20 bp, Artificial Sequence
  chemically synthesized
tgagataacaagtgccagta

SEQ ID NO: 338687 - DNA, 20 bp, Artificial Sequence
  chemically synthesized
aaagatgagataacaagtgc

SEQ ID NO: 338688 - DNA, 20 bp, Artificial Sequence
  chemically synthesized
tatctaaaagatgagataac

SEQ ID NO: 338689 - DNA, 20 bp, Artificial Sequence
  chemically synthesized
gcacttgttatctcatcttt

SEQ ID NO: 338690 - DNA, 20 bp, Artificial Sequence
  chemically synthesized
atgagtattatctaaaagat

SEQ ID NO: 338691 - DNA, 20 bp, Artificial Sequence
  chemically synthesized
ttaggatgagtattatctaa

SEQ ID NO: 338692 - DNA, 20 bp, Artificial Sequence
  chemically synthesized
ttagataatactcatcctaa

SEQ ID NO: 338693 - DNA, 20 bp, Artificial Sequence
  chemically synthesized
tacttcatacctgttaggat

SEQ ID NO: 338694 - DNA, 20 bp, Artificial Sequence
  chemically synthesized
tagataatactcatcctaac

SEQ ID NO: 338695 - DNA, 20 bp, Artificial Sequence
  chemically synthesized
ggtattacttcatacctgtt

SEQ ID NO: 338696 - DNA, 20 bp, Artificial Sequence
  chemically synthesized
aggtattacttcatacctgt

SEQ ID NO: 338697 - DNA, 20 bp, Artificial Sequence
  chemically synthesized
tactcatcctaacaggtatg

SEQ ID NO: 338698 - DNA, 20 bp, Artificial Sequence
  chemically synthesized
tgcaaatcaaaatcataata

SEQ ID NO: 338699 - DNA, 20 bp, Artificial Sequence
  chemically synthesized
atgcaaatcaaaatcataat

SEQ ID NO: 338700 - DNA, 20 bp, Artificial Sequence
  chemically synthesized
tttgatttgcatttccctaa

SEQ ID NO: 338701 - DNA, 20 bp, Artificial Sequence
  chemically synthesized
cgtgctcaatatcactatta

SEQ ID NO: 338702 - DNA, 20 bp, Artificial Sequence
  chemically synthesized
acgtgctcaatatcactatt

SEQ ID NO: 338703 - DNA, 20 bp, Artificial Sequence
  chemically synthesized
aacgtgctcaatatcactat

SEQ ID NO: 338704 - DNA, 20 bp, Artificial Sequence
  chemically synthesized
atttccctaatagtgatatt

SEQ ID NO: 338705 - DNA, 20 bp, Artificial Sequence
  chemically synthesized
gcacgttttaatttccctgt

SEQ ID NO: 338706 - DNA, 20 bp, Artificial Sequence
  chemically synthesized
agatgtgcaaacggccaaca

SEQ ID NO: 338707 - DNA, 20 bp, Artificial Sequence
  chemically synthesized
aagatgtgcaaacggccaac

SEQ ID NO: 338708 - DNA, 20 bp, Artificial Sequence
  chemically synthesized
gaagatgtgcaaacggccaa

SEQ ID NO: 338709 - DNA, 20 bp, Artificial Sequence
  chemically synthesized
tttcaaagaagatgtgcaaa

SEQ ID NO: 338710 - DNA, 20 bp, Artificial Sequence
  chemically synthesized
gaacattttttttttcaaag

SEQ ID NO: 338711 - DNA, 20 bp, Artificial Sequence
  chemically synthesized
cttgaacattttttttttca

SEQ ID NO: 338712 - DNA, 20 bp, Artificial Sequence
  chemically synthesized
ctttgaaaaaaaaaatgttc

SEQ ID NO: 338713 - DNA, 20 bp, Artificial Sequence
  chemically synthesized
acccaattaaaaaattggga

SEQ ID NO: 338714 - DNA, 20 bp, Artificial Sequence
  chemically synthesized
aataacccaattaaaaaatt

SEQ ID NO: 338715 - DNA, 20 bp, Artificial Sequence
  chemically synthesized
aaataacccaattaaaaaat

SEQ ID NO: 338716 - DNA, 20 bp, Artificial Sequence
  chemically synthesized
ttctttcccaattttttaat

SEQ ID NO: 338717 - DNA, 20 bp, Artificial Sequence
  chemically synthesized
tctttcccaattttttaatt

SEQ ID NO: 338718 - DNA, 20 bp, Artificial Sequence
  chemically synthesized
aattttttaattgggttatt

SEQ ID NO: 338719 - DNA, 20 bp, Artificial Sequence
  chemically synthesized
ggttatttagtttgtcacta

SEQ ID NO: 338720 - DNA, 20 bp, Artificial Sequence
  chemically synthesized
aaggaacttgcacaattcca

SEQ ID NO: 338721 - DNA, 20 bp, Artificial Sequence
  chemically synthesized
ttgtcactatggaattgtgc

SEQ ID NO: 338722 - DNA, 20 bp, Artificial Sequence
  chemically synthesized
tttaatatccaaaatatata

SEQ ID NO: 338723 - DNA, 20 bp, Artificial Sequence
  chemically synthesized
gtttaatatccaaaatatat

SEQ ID NO: 338724 - DNA, 20 bp, Artificial Sequence
  chemically synthesized
tgcaagttccttatatattt

SEQ ID NO: 338725 - DNA, 20 bp, Artificial Sequence
  chemically synthesized
tttggatattaaacccttat

SEQ ID NO: 338726 - DNA, 20 bp, Artificial Sequence
  chemically synthesized
gcaaaacatatatctgataa

SEQ ID NO: 338727 - DNA, 20 bp, Artificial Sequence
  chemically synthesized
tgcaaaacatatatctgata

SEQ ID NO: 338728 - DNA, 20 bp, Artificial Sequence
  chemically synthesized
ttgcaaaacatatatctgat

SEQ ID NO: 338729 - DNA, 20 bp, Artificial Sequence
  chemically synthesized
cacagcctacagattatgag

SEQ ID NO: 338730 - DNA, 20 bp, Artificial Sequence
  chemically synthesized
aaacacagcctacagattat

SEQ ID NO: 338731 - DNA, 20 bp, Artificial Sequence
  chemically synthesized
aaatatctactcataatctg

SEQ ID NO: 338732 - DNA, 20 bp, Artificial Sequence
  chemically synthesized
aatatctactcataatctgt

SEQ ID NO: 338733 - DNA, 20 bp, Artificial Sequence
  chemically synthesized
caaaagaaaaacacagccta

SEQ ID NO: 338734 - DNA, 20 bp, Artificial Sequence
  chemically synthesized
tggaaagcaaaagaaaaaca

SEQ ID NO: 338735 - DNA, 20 bp, Artificial Sequence
  chemically synthesized
aaaaagcttctggaaagcaa

SEQ ID NO: 338736 - DNA, 20 bp, Artificial Sequence
  chemically synthesized
tgtgtttttcttttgctttc

SEQ ID NO: 338737 - DNA, 20 bp, Artificial Sequence
  chemically synthesized
gtttttcttttgctttccag

SEQ ID NO: 338738 - DNA, 20 bp, Artificial Sequence
  chemically synthesized
taatctaaaaagcttctgga

SEQ ID NO: 338739 - DNA, 20 bp, Artificial Sequence
  chemically synthesized
acattaatctaaaaagcttc

SEQ ID NO: 338740 - DNA, 20 bp, Artificial Sequence
  chemically synthesized
tttgctttccagaagctttt

SEQ ID NO: 338741 - DNA, 20 bp, Artificial Sequence
  chemically synthesized
tggaactacattaatctaaa

SEQ ID NO: 338742 - DNA, 20 bp, Artificial Sequence
  chemically synthesized
agaagctttttagattaatg

SEQ ID NO: 338743 - DNA, 20 bp, Artificial Sequence
  chemically synthesized
ttagattaatgtagttccac

SEQ ID NO: 338744 - DNA, 20 bp, Artificial Sequence
  chemically synthesized
agaaaacaaaaataaactag

SEQ ID NO: 338745 - DNA, 20 bp, Artificial Sequence
  chemically synthesized
gcaagaaaacaaaaataaac

SEQ ID NO: 338746 - DNA, 20 bp, Artificial Sequence
  chemically synthesized
atcacatcaaaatttcaggc

SEQ ID NO: 338747 - DNA, 20 bp, Artificial Sequence
  chemically synthesized
gaatatcacatcaaaatttc

SEQ ID NO: 338748 - DNA, 20 bp, Artificial Sequence
  chemically synthesized
tgaatatcacatcaaaattt

SEQ ID NO: 338749 - DNA, 20 bp, Artificial Sequence
  chemically synthesized
atattcaaaaaatccttgca

SEQ ID NO: 338750 - DNA, 20 bp, Artificial Sequence
  chemically synthesized
tattcaaaaaatccttgcaa

SEQ ID NO: 338751 - DNA, 20 bp, Artificial Sequence
  chemically synthesized
ctctgacagtcgcctttgca

SEQ ID NO: 338752 - DNA, 20 bp, Artificial Sequence
  chemically synthesized
tctctgacagtcgcctttgc

SEQ ID NO: 338753 - DNA, 20 bp, Artificial Sequence
  chemically synthesized
atccttgcaaaggcgactgt

SEQ ID NO: 338754 - DNA, 20 bp, Artificial Sequence
  chemically synthesized
ccttgcaaaggcgactgtca

SEQ ID NO: 338755 - DNA, 20 bp, Artificial Sequence
  chemically synthesized
ttgcaaaggcgactgtcaga

SEQ ID NO: 338756 - DNA, 20 bp, Artificial Sequence
  chemically synthesized
gagaggaaaaagctctctga

SEQ ID NO: 338757 - DNA, 20 bp, Artificial Sequence
  chemically synthesized
agaagaaaacagagaggaaa

SEQ ID NO: 338758 - DNA, 20 bp, Artificial Sequence
  chemically synthesized
actcctagaagaaaacagag

SEQ ID NO: 338759 - DNA, 20 bp, Artificial Sequence
  chemically synthesized
gactcctagaagaaaacaga

SEQ ID NO: 338760 - DNA, 20 bp, Artificial Sequence
  chemically synthesized
aagactcctagaagaaaaca

SEQ ID NO: 338761 - DNA, 20 bp, Artificial Sequence
  chemically synthesized
ataagactcctagaagaaaa

SEQ ID NO: 338762 - DNA, 20 bp, Artificial Sequence
  chemically synthesized
ttttcctctctgttttcttc

SEQ ID NO: 338763 - DNA, 20 bp, Artificial Sequence
  chemically synthesized
tttcctctctgttttcttct

SEQ ID NO: 338764 - DNA, 20 bp, Artificial Sequence
  chemically synthesized
tcctctctgttttcttctag

SEQ ID NO: 338765 - DNA, 20 bp, Artificial Sequence
  chemically synthesized
taaaatcataagactcctag

SEQ ID NO: 338766 - DNA, 20 bp, Artificial Sequence
  chemically synthesized
acctaaaatcataagactcc

SEQ ID NO: 338767 - DNA, 20 bp, Artificial Sequence
  chemically synthesized
ttctaggagtcttatgattt

SEQ ID NO: 338768 - DNA, 20 bp, Artificial Sequence
  chemically synthesized
aatataagacctaaaatcat

SEQ ID NO: 338769 - DNA, 20 bp, Artificial Sequence
  chemically synthesized
tctaggagtcttatgatttt

SEQ ID NO: 338770 - DNA, 20 bp, Artificial Sequence
  chemically synthesized
tgattttaggtcttatattt

SEQ ID NO: 338771 - DNA, 20 bp, Artificial Sequence
  chemically synthesized
tggactaaagacttaaatat

SEQ ID NO: 338772 - DNA, 20 bp, Artificial Sequence
  chemically synthesized
aggtcttatatttaagtctt

SEQ ID NO: 338773 - DNA, 20 bp, Artificial Sequence
  chemically synthesized
aattaagtgaaaatggacta

SEQ ID NO: 338774 - DNA, 20 bp, Artificial Sequence
  chemically synthesized
acacaaaaattaagtgaaaa

SEQ ID NO: 338775 - DNA, 20 bp, Artificial Sequence
  chemically synthesized
ttatactgtacacaaaaatt

SEQ ID NO: 338776 - DNA, 20 bp, Artificial Sequence
  chemically synthesized
tttcacttaatttttgtgta

SEQ ID NO: 338777 - DNA, 20 bp, Artificial Sequence
  chemically synthesized
ttaatttttgtgtacagtat

SEQ ID NO: 338778 - DNA, 20 bp, Artificial Sequence
  chemically synthesized
ttttgtgtacagtataagac

SEQ ID NO: 338779 - DNA, 20 bp, Artificial Sequence
  chemically synthesized
tttgtgtacagtataagaca

SEQ ID NO: 338780 - DNA, 20 bp, Artificial Sequence
  chemically synthesized
ttgtgtacagtataagacaa

SEQ ID NO: 338781 - DNA, 20 bp, Artificial Sequence
  chemically synthesized
atttacaacaccatttattg

SEQ ID NO: 338782 - DNA, 20 bp, Artificial Sequence
  chemically synthesized
aggacagtctcttcaataaa

SEQ ID NO: 338783 - DNA, 20 bp, Artificial Sequence
  chemically synthesized
ttacaacaccatttattgaa

SEQ ID NO: 338784 - DNA, 20 bp, Artificial Sequence
  chemically synthesized
gaagatatgtggggaaagga

SEQ ID NO: 338785 - DNA, 20 bp, Artificial Sequence
  chemically synthesized
ccaagaagatatgtggggaa

SEQ ID NO: 338786 - DNA, 20 bp, Artificial Sequence
  chemically synthesized
accaagaagatatgtgggga

SEQ ID NO: 338787 - DNA, 20 bp, Artificial Sequence
  chemically synthesized
gaccaccaagaagatatgtg

SEQ ID NO: 338788 - DNA, 20 bp, Artificial Sequence
  chemically synthesized
ggaccaccaagaagatatgt

SEQ ID NO: 338789 - DNA, 20 bp, Artificial Sequence
  chemically synthesized
aggaccaccaagaagatatg

SEQ ID NO: 338790 - DNA, 20 bp, Artificial Sequence
  chemically synthesized
cctttccccacatatcttct

SEQ ID NO: 338791 - DNA, 20 bp, Artificial Sequence
  chemically synthesized
ttccccacatatcttcttgg

SEQ ID NO: 338792 - DNA, 20 bp, Artificial Sequence
  chemically synthesized
ttttggacaggaccaccaag

SEQ ID NO: 338793 - DNA, 20 bp, Artificial Sequence
  chemically synthesized
taattttggacaggaccacc

SEQ ID NO: 338794 - DNA, 20 bp, Artificial Sequence
  chemically synthesized
ataatcaactaattttggac

SEQ ID NO: 338795 - DNA, 20 bp, Artificial Sequence
  chemically synthesized
tataatcaactaattttgga

SEQ ID NO: 338796 - DNA, 20 bp, Artificial Sequence
  chemically synthesized
ttggtggtcctgtccaaaat

SEQ ID NO: 338797 - DNA, 20 bp, Artificial Sequence
  chemically synthesized
cctatataatcaactaattt

SEQ ID NO: 338798 - DNA, 20 bp, Artificial Sequence
  chemically synthesized
tccaaaattagttgattata

SEQ ID NO: 338799 - DNA, 20 bp, Artificial Sequence
  chemically synthesized
ccaaaattagttgattatat

SEQ ID NO: 338800 - DNA, 20 bp, Artificial Sequence
  chemically synthesized
attagttgattatataggct

SEQ ID NO: 338801 - DNA, 20 bp, Artificial Sequence
  chemically synthesized
ttagttgattatataggctt

SEQ ID NO: 338802 - DNA, 20 bp, Artificial Sequence
  chemically synthesized
gagatctcacaaataaacct

SEQ ID NO: 338803 - DNA, 20 bp, Artificial Sequence
  chemically synthesized
ataggcttaggtttatttgt

SEQ ID NO: 338804 - DNA, 20 bp, Artificial Sequence
  chemically synthesized
taaactgatggaacagaata

SEQ ID NO: 338805 - DNA, 20 bp, Artificial Sequence
  chemically synthesized
cataaactgatggaacagaa

SEQ ID NO: 338806 - DNA, 20 bp, Artificial Sequence
  chemically synthesized
agatctctattctgttccat

SEQ ID NO: 338807 - DNA, 20 bp, Artificial Sequence
  chemically synthesized
agacacataaactgatggaa

SEQ ID NO: 338808 - DNA, 20 bp, Artificial Sequence
  chemically synthesized
aaaacagacacataaactga

SEQ ID NO: 338809 - DNA, 20 bp, Artificial Sequence
  chemically synthesized
agtttatgtgtctgttttta

SEQ ID NO: 338810 - DNA, 20 bp, Artificial Sequence
  chemically synthesized
gtattgtaatgccataaaaa

SEQ ID NO: 338811 - DNA, 20 bp, Artificial Sequence
  chemically synthesized
taaatctacagtattaaaaa

SEQ ID NO: 338812 - DNA, 20 bp, Artificial Sequence
  chemically synthesized
cataaatctacagtattaaa

SEQ ID NO: 338813 - DNA, 20 bp, Artificial Sequence
  chemically synthesized
caatactctttttaatactg

SEQ ID NO: 338814 - DNA, 20 bp, Artificial Sequence
  chemically synthesized
gaaattatatcataaatcta

SEQ ID NO: 338815 - DNA, 20 bp, Artificial Sequence
  chemically synthesized
atgatataatttcaaatcca

SEQ ID NO: 338816 - DNA, 20 bp, Artificial Sequence
  chemically synthesized
gatataatttcaaatccaaa

SEQ ID NO: 338817 - DNA, 20 bp, Artificial Sequence
  chemically synthesized
ataatttcaaatccaaagag

SEQ ID NO: 338818 - DNA, 20 bp, Artificial Sequence
  chemically synthesized
aagttggaaatactgctctt

SEQ ID NO: 338819 - DNA, 20 bp, Artificial Sequence
  chemically synthesized
aatcttgaggaaaaaaaagt

SEQ ID NO: 338820 - DNA, 20 bp, Artificial Sequence
  chemically synthesized
gaacaatcttgaggaaaaaa

SEQ ID NO: 338821 - DNA, 20 bp, Artificial Sequence
  chemically synthesized
tttccaacttttttttcctc

SEQ ID NO: 338822 - DNA, 20 bp, Artificial Sequence
  chemically synthesized
aaatagccagaacaatcttg

SEQ ID NO: 338823 - DNA, 20 bp, Artificial Sequence
  chemically synthesized
caaatagccagaacaatctt

SEQ ID NO: 338824 - DNA, 20 bp, Artificial Sequence
  chemically synthesized
ttttttcctcaagattgttc

SEQ ID NO: 338825 - DNA, 20 bp, Artificial Sequence
  chemically synthesized
tcaagattgttctggctatt

SEQ ID NO: 338826 - DNA, 20 bp, Artificial Sequence
  chemically synthesized
caagattgttctggctattt

SEQ ID NO: 338827 - DNA, 20 bp, Artificial Sequence
  chemically synthesized
tacatgaaatcccaaatagc

SEQ ID NO: 338828 - DNA, 20 bp, Artificial Sequence
  chemically synthesized
aacttacatgaaatcccaaa

SEQ ID NO: 338829 - DNA, 20 bp, Artificial Sequence
  chemically synthesized
ggctatttgggatttcatgt

SEQ ID NO: 338830 - DNA, 20 bp, Artificial Sequence
  chemically synthesized
tttttttcacagaaataaaa

SEQ ID NO: 338831 - DNA, 20 bp, Artificial Sequence
  chemically synthesized
attttttttcacagaaataa

SEQ ID NO: 338832 - DNA, 20 bp, Artificial Sequence
  chemically synthesized
ctaaatggcattttttttca

SEQ ID NO: 338833 - DNA, 20 bp, Artificial Sequence
  chemically synthesized
ctgtgaaaaaaaatgccatt

SEQ ID NO: 338834 - DNA, 20 bp, Artificial Sequence
  chemically synthesized
aatccctgtgaaaatctaaa

SEQ ID NO: 338835 - DNA, 20 bp, Artificial Sequence
  chemically synthesized
aaatgccatttagattttca

SEQ ID NO: 338836 - DNA, 20 bp, Artificial Sequence
  chemically synthesized
aatgccatttagattttcac

SEQ ID NO: 338837 - DNA, 20 bp, Artificial Sequence
  chemically synthesized
atgccatttagattttcaca

SEQ ID NO: 338838 - DNA, 20 bp, Artificial Sequence
  chemically synthesized
gggattacattaaatttgta

SEQ ID NO: 338839 - DNA, 20 bp, Artificial Sequence
  chemically synthesized
gttgcatccgtggaaataga

SEQ ID NO: 338840 - DNA, 20 bp, Artificial Sequence
  chemically synthesized
agttgcatccgtggaaatag

SEQ ID NO: 338841 - DNA, 20 bp, Artificial Sequence
  chemically synthesized
cagtcaaccttctatttcca

SEQ ID NO: 338842 - DNA, 20 bp, Artificial Sequence
  chemically synthesized
tacagttgcatccgtggaaa

SEQ ID NO: 338843 - DNA, 20 bp, Artificial Sequence
  chemically synthesized
ctggtctacagttgcatccg

SEQ ID NO: 338844 - DNA, 20 bp, Artificial Sequence
  chemically synthesized
tatttccacggatgcaactg

SEQ ID NO: 338845 - DNA, 20 bp, Artificial Sequence
  chemically synthesized
ccacggatgcaactgtagac

SEQ ID NO: 338846 - DNA, 20 bp, Artificial Sequence
  chemically synthesized
ttttgattatttctggtcta

SEQ ID NO: 338847 - DNA, 20 bp, Artificial Sequence
  chemically synthesized
gttctatttttgattatttc

SEQ ID NO: 338848 - DNA, 20 bp, Artificial Sequence
  chemically synthesized
agaccagaaataatcaaaaa

SEQ ID NO: 338849 - DNA, 20 bp, Artificial Sequence
  chemically synthesized
atattttttgttgttgtatt

SEQ ID NO: 338850 - DNA, 20 bp, Artificial Sequence
  chemically synthesized
acaacaaaaaatattaatac

SEQ ID NO: 338851 - DNA, 20 bp, Artificial Sequence
  chemically synthesized
atacaagtaaaaataatata

SEQ ID NO: 338852 - DNA, 20 bp, Artificial Sequence
  chemically synthesized
tatggtaacaactatttcta

SEQ ID NO: 338853 - DNA, 20 bp, Artificial Sequence
  chemically synthesized
caatgtaaatgctatagaaa

SEQ ID NO: 338854 - DNA, 20 bp, Artificial Sequence
  chemically synthesized
ctaatacaatgtaaatgcta

SEQ ID NO: 338855 - DNA, 20 bp, Artificial Sequence
  chemically synthesized
ctatagcatttacattgtat

SEQ ID NO: 338856 - DNA, 20 bp, Artificial Sequence
  chemically synthesized
tatagcatttacattgtatt

SEQ ID NO: 338857 - DNA, 20 bp, Artificial Sequence
  chemically synthesized
gtgtaataacaaataatcga

SEQ ID NO: 338858 - DNA, 20 bp, Artificial Sequence
  chemically synthesized
aataatcgatagatgtttta

SEQ ID NO: 338859 - DNA, 20 bp, Artificial Sequence
  chemically synthesized
gatagatgttttaaagtata

SEQ ID NO: 338860 - DNA, 20 bp, Artificial Sequence
  chemically synthesized
atagatgttttaaagtatat

SEQ ID NO: 338861 - DNA, 20 bp, Artificial Sequence
  chemically synthesized
tagatgttttaaagtatata

SEQ ID NO: 338862 - DNA, 20 bp, Artificial Sequence
  chemically synthesized
agatgttttaaagtatatag

SEQ ID NO: 338863 - DNA, 20 bp, Artificial Sequence
  chemically synthesized
gatgttttaaagtatatagg

SEQ ID NO: 338864 - DNA, 20 bp, Artificial Sequence
  chemically synthesized
atgttttaaagtatataggg

SEQ ID NO: 338865 - DNA, 20 bp, Artificial Sequence
  chemically synthesized
agtatataggggggtgtgca

SEQ ID NO: 338866 - DNA, 20 bp, Artificial Sequence
  chemically synthesized
gtatataggggggtgtgcat

SEQ ID NO: 338867 - DNA, 20 bp, Artificial Sequence
  chemically synthesized
atcccttatacaaaatggca

SEQ ID NO: 338868 - DNA, 20 bp, Artificial Sequence
  chemically synthesized
cttaaatcccttatacaaaa

SEQ ID NO: 338869 - DNA, 20 bp, Artificial Sequence
  chemically synthesized
aatactatgccattttgtat

SEQ ID NO: 338870 - DNA, 20 bp, Artificial Sequence
  chemically synthesized
atactatgccattttgtata

SEQ ID NO: 338871 - DNA, 20 bp, Artificial Sequence
  chemically synthesized
tactatgccattttgtataa

SEQ ID NO: 338872 - DNA, 20 bp, Artificial Sequence
  chemically synthesized
ccattttgtataagggattt

SEQ ID NO: 338873 - DNA, 20 bp, Artificial Sequence
  chemically synthesized
ataagggatttaagcatctt

SEQ ID NO: 338874 - DNA, 20 bp, Artificial Sequence
  chemically synthesized
atttaagcatctttggattt

SEQ ID NO: 338875 - DNA, 20 bp, Artificial Sequence
  chemically synthesized
ccagtggataccaaaatcca

SEQ ID NO: 338876 - DNA, 20 bp, Artificial Sequence
  chemically synthesized
ctttggattttggtatccac

SEQ ID NO: 338877 - DNA, 20 bp, Artificial Sequence
  chemically synthesized
catgggttccaggatgccag

SEQ ID NO: 338878 - DNA, 20 bp, Artificial Sequence
  chemically synthesized
tttggtatccactggcatcc

SEQ ID NO: 338879 - DNA, 20 bp, Artificial Sequence
  chemically synthesized
ggacatgggttccaggatgc

SEQ ID NO: 338880 - DNA, 20 bp, Artificial Sequence
  chemically synthesized
atccacgggacatgggttcc

SEQ ID NO: 338881 - DNA, 20 bp, Artificial Sequence
  chemically synthesized
tatccacgggacatgggttc

SEQ ID NO: 338882 - DNA, 20 bp, Artificial Sequence
  chemically synthesized
ccttggtatccacgggacat

SEQ ID NO: 338883 - DNA, 20 bp, Artificial Sequence
  chemically synthesized
atcctggaacccatgtcccg

SEQ ID NO: 338884 - DNA, 20 bp, Artificial Sequence
  chemically synthesized
cccttggtatccacgggaca

SEQ ID NO: 338885 - DNA, 20 bp, Artificial Sequence
  chemically synthesized
agctgtcccttggtatccac

SEQ ID NO: 338886 - DNA, 20 bp, Artificial Sequence
  chemically synthesized
tagctgtcccttggtatcca

SEQ ID NO: 338887 - DNA, 20 bp, Artificial Sequence
  chemically synthesized
acccatgtcccgtggatacc

SEQ ID NO: 338888 - DNA, 20 bp, Artificial Sequence
  chemically synthesized
cccatgtcccgtggatacca

SEQ ID NO: 338889 - DNA, 20 bp, Artificial Sequence
  chemically synthesized
ccatgtcccgtggataccaa

SEQ ID NO: 338890 - DNA, 20 bp, Artificial Sequence
  chemically synthesized
gtcccgtggataccaaggga

SEQ ID NO: 338891 - DNA, 20 bp, Artificial Sequence
  chemically synthesized
atggatatatagctgtccct

SEQ ID NO: 338892 - DNA, 20 bp, Artificial Sequence
  chemically synthesized
atactacccaaatggatata

SEQ ID NO: 338893 - DNA, 20 bp, Artificial Sequence
  chemically synthesized
gggacagctatatatccatt

SEQ ID NO: 338894 - DNA, 20 bp, Artificial Sequence
  chemically synthesized
ggacagctatatatccattt

SEQ ID NO: 338895 - DNA, 20 bp, Artificial Sequence
  chemically synthesized
cagctatatatccatttggg

SEQ ID NO: 338896 - DNA, 20 bp, Artificial Sequence
  chemically synthesized
aaatttccatactacccaaa

SEQ ID NO: 338897 - DNA, 20 bp, Artificial Sequence
  chemically synthesized
atatatccatttgggtagta

SEQ ID NO: 338898 - DNA, 20 bp, Artificial Sequence
  chemically synthesized
tttaacaatattacttcttc

SEQ ID NO: 338899 - DNA, 20 bp, Artificial Sequence
  chemically synthesized
ccatgtttgtagactggaag

SEQ ID NO: 338900 - DNA, 20 bp, Artificial Sequence
  chemically synthesized
atcccatgtttgtagactgg

SEQ ID NO: 338901 - DNA, 20 bp, Artificial Sequence
  chemically synthesized
aatatcccatgtttgtagac

SEQ ID NO: 338902 - DNA, 20 bp, Artificial Sequence
  chemically synthesized
cttcttccagtctacaaaca

SEQ ID NO: 338903 - DNA, 20 bp, Artificial Sequence
  chemically synthesized
ttcttccagtctacaaacat

SEQ ID NO: 338904 - DNA, 20 bp, Artificial Sequence
  chemically synthesized
gggaaaatatcccatgtttg

SEQ ID NO: 338905 - DNA, 20 bp, Artificial Sequence
  chemically synthesized
aaattaaaaggtaaatatat

SEQ ID NO: 338906 - DNA, 20 bp, Artificial Sequence
  chemically synthesized
caaattaaaaggtaaatata

SEQ ID NO: 338907 - DNA, 20 bp, Artificial Sequence
  chemically synthesized
acattgaggaacaaattaaa

SEQ ID NO: 338908 - DNA, 20 bp, Artificial Sequence
  chemically synthesized
aacattgaggaacaaattaa

SEQ ID NO: 338909 - DNA, 20 bp, Artificial Sequence
  chemically synthesized
accaaaactataaaacattg

SEQ ID NO: 338910 - DNA, 20 bp, Artificial Sequence
  chemically synthesized
aaccaaaactataaaacatt

SEQ ID NO: 338911 - DNA, 20 bp, Artificial Sequence
  chemically synthesized
atttgttcctcaatgtttta

SEQ ID NO: 338912 - DNA, 20 bp, Artificial Sequence
  chemically synthesized
tcctcaatgttttatagttt

SEQ ID NO: 338913 - DNA, 20 bp, Artificial Sequence
  chemically synthesized
aagacccaatttaaagaaga

SEQ ID NO: 338914 - DNA, 20 bp, Artificial Sequence
  chemically synthesized
atttaagacccaatttaaag

SEQ ID NO: 338915 - DNA, 20 bp, Artificial Sequence
  chemically synthesized
tttcactttcttctttaaat

SEQ ID NO: 338916 - DNA, 20 bp, Artificial Sequence
  chemically synthesized
ttcactttcttctttaaatt

SEQ ID NO: 338917 - DNA, 20 bp, Artificial Sequence
  chemically synthesized
aatatttaagacccaattta

SEQ ID NO: 338918 - DNA, 20 bp, Artificial Sequence
  chemically synthesized
taacatagaataaaatattt

SEQ ID NO: 338919 - DNA, 20 bp, Artificial Sequence
  chemically synthesized
aaattctatttatgataaca

SEQ ID NO: 338920 - DNA, 20 bp, Artificial Sequence
  chemically synthesized
ttattctatgttatcataaa

SEQ ID NO: 338921 - DNA, 20 bp, Artificial Sequence
  chemically synthesized
tagaattttttaaaattttt

SEQ ID NO: 338922 - DNA, 20 bp, Artificial Sequence
  chemically synthesized
ttagttgcatttttatgcaa

SEQ ID NO: 338923 - DNA, 20 bp, Artificial Sequence
  chemically synthesized
atacaaaatcaacataaaat

SEQ ID NO: 338924 - DNA, 20 bp, Artificial Sequence
  chemically synthesized
taaatgagttcagtaagtag

SEQ ID NO: 338925 - DNA, 20 bp, Artificial Sequence
  chemically synthesized
taataaatgagttcagtaag

SEQ ID NO: 338926 - DNA, 20 bp, Artificial Sequence
  chemically synthesized
aactaataaatgagttcagt

SEQ ID NO: 338927 - DNA, 20 bp, Artificial Sequence
  chemically synthesized
ttagaactaataaatgagtt

SEQ ID NO: 338928 - DNA, 20 bp, Artificial Sequence
  chemically synthesized
tacttactgaactcatttat

SEQ ID NO: 338929 - DNA, 20 bp, Artificial Sequence
  chemically synthesized
aaatgttagaactaataaat

SEQ ID NO: 338930 - DNA, 20 bp, Artificial Sequence
  chemically synthesized
ggactccacaagaaaaatgt

SEQ ID NO: 338931 - DNA, 20 bp, Artificial Sequence
  chemically synthesized
tagttctaacatttttcttg

SEQ ID NO: 338932 - DNA, 20 bp, Artificial Sequence
  chemically synthesized
gttctaacatttttcttgtg

SEQ ID NO: 338933 - DNA, 20 bp, Artificial Sequence
  chemically synthesized
gaaacccctaaggactccac

SEQ ID NO: 338934 - DNA, 20 bp, Artificial Sequence
  chemically synthesized
catttttcttgtggagtcct

SEQ ID NO: 338935 - DNA, 20 bp, Artificial Sequence
  chemically synthesized
atttttcttgtggagtcctt

SEQ ID NO: 338936 - DNA, 20 bp, Artificial Sequence
  chemically synthesized
tttttcttgtggagtcctta

SEQ ID NO: 338937 - DNA, 20 bp, Artificial Sequence
  chemically synthesized
ttttcttgtggagtccttag

SEQ ID NO: 338938 - DNA, 20 bp, Artificial Sequence
  chemically synthesized
cgtatatgtagaaaccccta

SEQ ID NO: 338939 - DNA, 20 bp, Artificial Sequence
  chemically synthesized
tcgtatatgtagaaacccct

SEQ ID NO: 338940 - DNA, 20 bp, Artificial Sequence
  chemically synthesized
aaatggtatgatcgtatatg

SEQ ID NO: 338941 - DNA, 20 bp, Artificial Sequence
  chemically synthesized
atattatttctgtttgcaaa

SEQ ID NO: 338942 - DNA, 20 bp, Artificial Sequence
  chemically synthesized
acgatcataccatttgcaaa

SEQ ID NO: 338943 - DNA, 20 bp, Artificial Sequence
  chemically synthesized
ctttcacatctgaaaggaag

SEQ ID NO: 338944 - DNA, 20 bp, Artificial Sequence
  chemically synthesized
ataatattacttcttccttt

SEQ ID NO: 338945 - DNA, 20 bp, Artificial Sequence
  chemically synthesized
aggctttcacatctgaaagg

SEQ ID NO: 338946 - DNA, 20 bp, Artificial Sequence
  chemically synthesized
aaaaggctttcacatctgaa

SEQ ID NO: 338947 - DNA, 20 bp, Artificial Sequence
  chemically synthesized
taaaaggctttcacatctga

SEQ ID NO: 338948 - DNA, 20 bp, Artificial Sequence
  chemically synthesized
cttcttcctttcagatgtga

SEQ ID NO: 338949 - DNA, 20 bp, Artificial Sequence
  chemically synthesized
agtgagacaaaattaataaa

SEQ ID NO: 338950 - DNA, 20 bp, Artificial Sequence
  chemically synthesized
cagtgagacaaaattaataa

SEQ ID NO: 338951 - DNA, 20 bp, Artificial Sequence
  chemically synthesized
aaaatactagcaggagcagt

SEQ ID NO: 338952 - DNA, 20 bp, Artificial Sequence
  chemically synthesized
ttttgtctcactgctcctgc

SEQ ID NO: 338953 - DNA, 20 bp, Artificial Sequence
  chemically synthesized
accaaaaatactagcaggag

SEQ ID NO: 338954 - DNA, 20 bp, Artificial Sequence
  chemically synthesized
agtaccaaaaatactagcag

SEQ ID NO: 338955 - DNA, 20 bp, Artificial Sequence
  chemically synthesized
atagtaccaaaaatactagc

SEQ ID NO: 338956 - DNA, 20 bp, Artificial Sequence
  chemically synthesized
catagtaccaaaaatactag

SEQ ID NO: 338957 - DNA, 20 bp, Artificial Sequence
  chemically synthesized
actgctcctgctagtatttt

SEQ ID NO: 338958 - DNA, 20 bp, Artificial Sequence
  chemically synthesized
tgtcatagtaccaaaaatac

SEQ ID NO: 338959 - DNA, 20 bp, Artificial Sequence
  chemically synthesized
atttttggtactatgacaaa

SEQ ID NO: 338960 - DNA, 20 bp, Artificial Sequence
  chemically synthesized
cttaccacttccatttgtca

SEQ ID NO: 338961 - DNA, 20 bp, Artificial Sequence
  chemically synthesized
tttggtactatgacaaatgg

SEQ ID NO: 338962 - DNA, 20 bp, Artificial Sequence
  chemically synthesized
ggtactatgacaaatggaag

SEQ ID NO: 338963 - DNA, 20 bp, Artificial Sequence
  chemically synthesized
ctatgacaaatggaagtggt

SEQ ID NO: 338964 - DNA, 20 bp, Artificial Sequence
  chemically synthesized
atgacaaatggaagtggtaa

SEQ ID NO: 338965 - DNA, 20 bp, Artificial Sequence
  chemically synthesized
acaaatggaagtggtaagag

SEQ ID NO: 338966 - DNA, 20 bp, Artificial Sequence
  chemically synthesized
caaatggaagtggtaagagt

SEQ ID NO: 338967 - DNA, 20 bp, Artificial Sequence
  chemically synthesized
gagtgggcatccttgctttt

SEQ ID NO: 338968 - DNA, 20 bp, Artificial Sequence
  chemically synthesized
ttaagatttgctaaaaagca

SEQ ID NO: 338969 - DNA, 20 bp, Artificial Sequence
  chemically synthesized
cttaagatttgctaaaaagc

SEQ ID NO: 338970 - DNA, 20 bp, Artificial Sequence
  chemically synthesized
tccccttaagatttgctaaa

SEQ ID NO: 338971 - DNA, 20 bp, Artificial Sequence
  chemically synthesized
cttgctttttagcaaatctt

SEQ ID NO: 338972 - DNA, 20 bp, Artificial Sequence
  chemically synthesized
ttgctttttagcaaatctta

SEQ ID NO: 338973 - DNA, 20 bp, Artificial Sequence
  chemically synthesized
tgctttttagcaaatcttaa

SEQ ID NO: 338974 - DNA, 20 bp, Artificial Sequence
  chemically synthesized
gctttttagcaaatcttaag

SEQ ID NO: 338975 - DNA, 20 bp, Artificial Sequence
  chemically synthesized
tttagcaaatcttaagggga

SEQ ID NO: 338976 - DNA, 20 bp, Artificial Sequence
  chemically synthesized
gtactgaaagctttcccctt

SEQ ID NO: 338977 - DNA, 20 bp, Artificial Sequence
  chemically synthesized
aatcttaaggggaaagcttt

SEQ ID NO: 338978 - DNA, 20 bp, Artificial Sequence
  chemically synthesized
ttgtggggtggttgtactga

SEQ ID NO: 338979 - DNA, 20 bp, Artificial Sequence
  chemically synthesized
gatcaacggtggttgtgggg

SEQ ID NO: 338980 - DNA, 20 bp, Artificial Sequence
  chemically synthesized
tatgatcaacggtggttgtg

SEQ ID NO: 338981 - DNA, 20 bp, Artificial Sequence
  chemically synthesized
atatgatcaacggtggttgt

SEQ ID NO: 338982 - DNA, 20 bp, Artificial Sequence
  chemically synthesized
aatatgatcaacggtggttg

SEQ ID NO: 338983 - DNA, 20 bp, Artificial Sequence
  chemically synthesized
atagctaatatgatcaacgg

SEQ ID NO: 338984 - DNA, 20 bp, Artificial Sequence
  chemically synthesized
cctatagctaatatgatcaa

SEQ ID NO: 338985 - DNA, 20 bp, Artificial Sequence
  chemically synthesized
acaaccaccgttgatcatat

SEQ ID NO: 338986 - DNA, 20 bp, Artificial Sequence
  chemically synthesized
accgttgatcatattagcta

SEQ ID NO: 338987 - DNA, 20 bp, Artificial Sequence
  chemically synthesized
ccgttgatcatattagctat

SEQ ID NO: 338988 - DNA, 20 bp, Artificial Sequence
  chemically synthesized
ggctatttatgaaaagccta

SEQ ID NO: 338989 - DNA, 20 bp, Artificial Sequence
  chemically synthesized
acatcaaggctatttatgaa

SEQ ID NO: 338990 - DNA, 20 bp, Artificial Sequence
  chemically synthesized
agctataggcttttcataaa

SEQ ID NO: 338991 - DNA, 20 bp, Artificial Sequence
  chemically synthesized
tcataaatagccttgatgtt

SEQ ID NO: 338992 - DNA, 20 bp, Artificial Sequence
  chemically synthesized
aggaaatttcctcaacatca

SEQ ID NO: 338993 - DNA, 20 bp, Artificial Sequence
  chemically synthesized
cataaatagccttgatgttg

SEQ ID NO: 338994 - DNA, 20 bp, Artificial Sequence
  chemically synthesized
aaggaaatttcctcaacatc

SEQ ID NO: 338995 - DNA, 20 bp, Artificial Sequence
  chemically synthesized
cttcgcaaaatatgtatgga

SEQ ID NO: 338996 - DNA, 20 bp, Artificial Sequence
  chemically synthesized
tcttcgcaaaatatgtatgg

SEQ ID NO: 338997 - DNA, 20 bp, Artificial Sequence
  chemically synthesized
aactcttcgcaaaatatgta

SEQ ID NO: 338998 - DNA, 20 bp, Artificial Sequence
  chemically synthesized
ccttccatacatattttgcg

SEQ ID NO: 338999 - DNA, 20 bp, Artificial Sequence
  chemically synthesized
ttccatacatattttgcgaa

SEQ ID NO: 339000 - DNA, 20 bp, Artificial Sequence
  chemically synthesized
gcgaagagttataataataa

SEQ ID NO: 339001 - DNA, 20 bp, Artificial Sequence
  chemically synthesized
cgaagagttataataataaa

SEQ ID NO: 339002 - DNA, 20 bp, Artificial Sequence
  chemically synthesized
tataataataaaaggatgtt

SEQ ID NO: 339003 - DNA, 20 bp, Artificial Sequence
  chemically synthesized
tgcagaaaaagcatttgata

SEQ ID NO: 339004 - DNA, 20 bp, Artificial Sequence
  chemically synthesized
tatctcaatacatgcagaaa

SEQ ID NO: 339005 - DNA, 20 bp, Artificial Sequence
  chemically synthesized
catgattatctcaatacatg

SEQ ID NO: 339006 - DNA, 20 bp, Artificial Sequence
  chemically synthesized
atgctttttctgcatgtatt

SEQ ID NO: 339007 - DNA, 20 bp, Artificial Sequence
  chemically synthesized
catgtattgagataatcatg

SEQ ID NO: 339008 - DNA, 20 bp, Artificial Sequence
  chemically synthesized
cgacatactacattaacaga

SEQ ID NO: 339009 - DNA, 20 bp, Artificial Sequence
  chemically synthesized
ttttcatctttctgttaatg

SEQ ID NO: 339010 - DNA, 20 bp, Artificial Sequence
  chemically synthesized
aatgcgacatactacattaa

SEQ ID NO: 339011 - DNA, 20 bp, Artificial Sequence
  chemically synthesized
ttagccctaggacacaaggt

SEQ ID NO: 339012 - DNA, 20 bp, Artificial Sequence
  chemically synthesized
gttaaaccaaccttgtgtcc

SEQ ID NO: 339013 - DNA, 20 bp, Artificial Sequence
  chemically synthesized
gggtttagccctaggacaca

SEQ ID NO: 339014 - DNA, 20 bp, Artificial Sequence
  chemically synthesized
ttaaaccaaccttgtgtcct

SEQ ID NO: 339015 - DNA, 20 bp, Artificial Sequence
  chemically synthesized
tgggtttagccctaggacac

SEQ ID NO: 339016 - DNA, 20 bp, Artificial Sequence
  chemically synthesized
taaaccaaccttgtgtccta

SEQ ID NO: 339017 - DNA, 20 bp, Artificial Sequence
  chemically synthesized
gaccaggtgggtttagccct

SEQ ID NO: 339018 - DNA, 20 bp, Artificial Sequence
  chemically synthesized
tgaccaggtgggtttagccc

SEQ ID NO: 339019 - DNA, 20 bp, Artificial Sequence
  chemically synthesized
aaaccgtgaccaggtgggtt

SEQ ID NO: 339020 - DNA, 20 bp, Artificial Sequence
  chemically synthesized
gtcctagggctaaacccacc

SEQ ID NO: 339021 - DNA, 20 bp, Artificial Sequence
  chemically synthesized
attataaaccgtgaccaggt

SEQ ID NO: 339022 - DNA, 20 bp, Artificial Sequence
  chemically synthesized
gattataaaccgtgaccagg

SEQ ID NO: 339023 - DNA, 20 bp, Artificial Sequence
  chemically synthesized
gggctaaacccacctggtca

SEQ ID NO: 339024 - DNA, 20 bp, Artificial Sequence
  chemically synthesized
ttggattataaaccgtgacc

SEQ ID NO: 339025 - DNA, 20 bp, Artificial Sequence
  chemically synthesized
attggattataaaccgtgac

SEQ ID NO: 339026 - DNA, 20 bp, Artificial Sequence
  chemically synthesized
tagcaagacaaataacacat

SEQ ID NO: 339027 - DNA, 20 bp, Artificial Sequence
  chemically synthesized
gtcctcaataaagtattagc

SEQ ID NO: 339028 - DNA, 20 bp, Artificial Sequence
  chemically synthesized
gaaagtcctcaataaagtat

SEQ ID NO: 339029 - DNA, 20 bp, Artificial Sequence
  chemically synthesized
tgtcttgctaatactttatt

SEQ ID NO: 339030 - DNA, 20 bp, Artificial Sequence
  chemically synthesized
gtcttgctaatactttattg

SEQ ID NO: 339031 - DNA, 20 bp, Artificial Sequence
  chemically synthesized
agatgtgaaagtcctcaata

SEQ ID NO: 339032 - DNA, 20 bp, Artificial Sequence
  chemically synthesized
taggaggaatatagatgtga

SEQ ID NO: 339033 - DNA, 20 bp, Artificial Sequence
  chemically synthesized
gccaatatctaggaggaata

SEQ ID NO: 339034 - DNA, 20 bp, Artificial Sequence
  chemically synthesized
tttcacatctatattcctcc

SEQ ID NO: 339035 - DNA, 20 bp, Artificial Sequence
  chemically synthesized
tatatatgccaatatctagg

SEQ ID NO: 339036 - DNA, 20 bp, Artificial Sequence
  chemically synthesized
atatatatgccaatatctag

SEQ ID NO: 339037 - DNA, 20 bp, Artificial Sequence
  chemically synthesized
tctatattcctcctagatat

SEQ ID NO: 339038 - DNA, 20 bp, Artificial Sequence
  chemically synthesized
atatatatatgccaatatct

SEQ ID NO: 339039 - DNA, 20 bp, Artificial Sequence
  chemically synthesized
aatatatatatgccaatatc

SEQ ID NO: 339040 - DNA, 20 bp, Artificial Sequence
  chemically synthesized
atatatattttcttctcttg

SEQ ID NO: 339041 - DNA, 20 bp, Artificial Sequence
  chemically synthesized
tcaaacagacaccgcaagag

SEQ ID NO: 339042 - DNA, 20 bp, Artificial Sequence
  chemically synthesized
aagtcaaacagacaccgcaa

SEQ ID NO: 339043 - DNA, 20 bp, Artificial Sequence
  chemically synthesized
gaaagtcaaacagacaccgc

SEQ ID NO: 339044 - DNA, 20 bp, Artificial Sequence
  chemically synthesized
ccctaaatacgaaagtcaaa

SEQ ID NO: 339045 - DNA, 20 bp, Artificial Sequence
  chemically synthesized
gtctgtttgactttcgtatt

SEQ ID NO: 339046 - DNA, 20 bp, Artificial Sequence
  chemically synthesized
cagcatcaccctaaatacga

SEQ ID NO: 339047 - DNA, 20 bp, Artificial Sequence
  chemically synthesized
tctgtttgactttcgtattt

SEQ ID NO: 339048 - DNA, 20 bp, Artificial Sequence
  chemically synthesized
ctgtttgactttcgtattta

SEQ ID NO: 339049 - DNA, 20 bp, Artificial Sequence
  chemically synthesized
tcgtatttagggtgatgctg

SEQ ID NO: 339050 - DNA, 20 bp, Artificial Sequence
  chemically synthesized
tccaaagccatttatgactt

SEQ ID NO: 339051 - DNA, 20 bp, Artificial Sequence
  chemically synthesized
ggtgatgctgaagtcataaa

SEQ ID NO: 339052 - DNA, 20 bp, Artificial Sequence
  chemically synthesized
gctgaagtcataaatggctt

SEQ ID NO: 339053 - DNA, 20 bp, Artificial Sequence
  chemically synthesized
tgaagtcataaatggctttg

SEQ ID NO: 339054 - DNA, 20 bp, Artificial Sequence
  chemically synthesized
gaagtcataaatggctttgg

SEQ ID NO: 339055 - DNA, 20 bp, Artificial Sequence
  chemically synthesized
tagaagaggaaatacctcca

SEQ ID NO: 339056 - DNA, 20 bp, Artificial Sequence
  chemically synthesized
aatcttctaaataatagaag

SEQ ID NO: 339057 - DNA, 20 bp, Artificial Sequence
  chemically synthesized
aaatcttctaaataatagaa

SEQ ID NO: 339058 - DNA, 20 bp, Artificial Sequence
  chemically synthesized
taaaatcttctaaataatag

SEQ ID NO: 339059 - DNA, 20 bp, Artificial Sequence
  chemically synthesized
gtatttcctcttctattatt

SEQ ID NO: 339060 - DNA, 20 bp, Artificial Sequence
  chemically synthesized
tcttaaaatcttctaaataa

SEQ ID NO: 339061 - DNA, 20 bp, Artificial Sequence
  chemically synthesized
tttcctcttctattatttag

SEQ ID NO: 339062 - DNA, 20 bp, Artificial Sequence
  chemically synthesized
tctattatttagaagatttt

SEQ ID NO: 339063 - DNA, 20 bp, Artificial Sequence
  chemically synthesized
tagaagattttaagaacaaa

SEQ ID NO: 339064 - DNA, 20 bp, Artificial Sequence
  chemically synthesized
atttcttccaaacatttaaa

SEQ ID NO: 339065 - DNA, 20 bp, Artificial Sequence
  chemically synthesized
tcatttcttccaaacattta

SEQ ID NO: 339066 - DNA, 20 bp, Artificial Sequence
  chemically synthesized
taaattactctttaaatgtt

SEQ ID NO: 339067 - DNA, 20 bp, Artificial Sequence
  chemically synthesized
attactctttaaatgtttgg

SEQ ID NO: 339068 - DNA, 20 bp, Artificial Sequence
  chemically synthesized
tttaaatgtttggaagaaat

SEQ ID NO: 339069 - DNA, 20 bp, Artificial Sequence
  chemically synthesized
ttaaatgtttggaagaaatg

SEQ ID NO: 339070 - DNA, 20 bp, Artificial Sequence
  chemically synthesized
aaatgtttggaagaaatgag

SEQ ID NO: 339071 - DNA, 20 bp, Artificial Sequence
  chemically synthesized
tgtttggaagaaatgaggag

SEQ ID NO: 339072 - DNA, 20 bp, Artificial Sequence
  chemically synthesized
ttggaagaaatgaggagaag

SEQ ID NO: 339073 - DNA, 20 bp, Artificial Sequence
  chemically synthesized
tggaagaaatgaggagaagt

SEQ ID NO: 339074 - DNA, 20 bp, Artificial Sequence
  chemically synthesized
aaatgaggagaagtaggtca

SEQ ID NO: 339075 - DNA, 20 bp, Artificial Sequence
  chemically synthesized
aatgaggagaagtaggtcaa

SEQ ID NO: 339076 - DNA, 20 bp, Artificial Sequence
  chemically synthesized
ggtcaaaggacacaaacttg

SEQ ID NO: 339077 - DNA, 20 bp, Artificial Sequence
  chemically synthesized
tatttatccaatataacttc

SEQ ID NO: 339078 - DNA, 20 bp, Artificial Sequence
  chemically synthesized
acacaaacttgaagttatat

SEQ ID NO: 339079 - DNA, 20 bp, Artificial Sequence
  chemically synthesized
catcatactaagcagttatc

SEQ ID NO: 339080 - DNA, 20 bp, Artificial Sequence
  chemically synthesized
aataaatctcgataactgct

SEQ ID NO: 339081 - DNA, 20 bp, Artificial Sequence
  chemically synthesized
actgtagtcatcatactaag

SEQ ID NO: 339082 - DNA, 20 bp, Artificial Sequence
  chemically synthesized
ttaactgtagtcatcatact

SEQ ID NO: 339083 - DNA, 20 bp, Artificial Sequence
  chemically synthesized
actgcttagtatgatgacta

SEQ ID NO: 339084 - DNA, 20 bp, Artificial Sequence
  chemically synthesized
agtatgatgactacagttaa

SEQ ID NO: 339085 - DNA, 20 bp, Artificial Sequence
  chemically synthesized
caatacaatgccattaactg

SEQ ID NO: 339086 - DNA, 20 bp, Artificial Sequence
  chemically synthesized
ttgtattgtacactgaacat

SEQ ID NO: 339087 - DNA, 20 bp, Artificial Sequence
  chemically synthesized
ctcttttcttagctaatgtt

SEQ ID NO: 339088 - DNA, 20 bp, Artificial Sequence
  chemically synthesized
ttgtacactgaacattagct

SEQ ID NO: 339089 - DNA, 20 bp, Artificial Sequence
  chemically synthesized
cactgaacattagctaagaa

SEQ ID NO: 339090 - DNA, 20 bp, Artificial Sequence
  chemically synthesized
ctgaacattagctaagaaaa

SEQ ID NO: 339091 - DNA, 20 bp, Artificial Sequence
  chemically synthesized
atacctaaagtctcttttct

SEQ ID NO: 339092 - DNA, 20 bp, Artificial Sequence
  chemically synthesized
ttagctaagaaaagagactt

SEQ ID NO: 339093 - DNA, 20 bp, Artificial Sequence
  chemically synthesized
tagctaagaaaagagacttt

SEQ ID NO: 339094 - DNA, 20 bp, Artificial Sequence
  chemically synthesized
tggtatggtaagaataccta

SEQ ID NO: 339095 - DNA, 20 bp, Artificial Sequence
  chemically synthesized
aataactgttttggtatggt

SEQ ID NO: 339096 - DNA, 20 bp, Artificial Sequence
  chemically synthesized
ccataataactgttttggta

SEQ ID NO: 339097 - DNA, 20 bp, Artificial Sequence
  chemically synthesized
gtattcttaccataccaaaa

SEQ ID NO: 339098 - DNA, 20 bp, Artificial Sequence
  chemically synthesized
atcttccataataactgttt

SEQ ID NO: 339099 - DNA, 20 bp, Artificial Sequence
  chemically synthesized
ccataccaaaacagttatta

SEQ ID NO: 339100 - DNA, 20 bp, Artificial Sequence
  chemically synthesized
taccaaaacagttattatgg

SEQ ID NO: 339101 - DNA, 20 bp, Artificial Sequence
  chemically synthesized
acagttattatggaagataa

SEQ ID NO: 339102 - DNA, 20 bp, Artificial Sequence
  chemically synthesized
ttattatggaagataatgga

SEQ ID NO: 339103 - DNA, 20 bp, Artificial Sequence
  chemically synthesized
tattatggaagataatggat

SEQ ID NO: 339104 - DNA, 20 bp, Artificial Sequence
  chemically synthesized
agataatggataggataatt

SEQ ID NO: 339105 - DNA, 20 bp, Artificial Sequence
  chemically synthesized
taggataatttggttgaatt

SEQ ID NO: 339106 - DNA, 20 bp, Artificial Sequence
  chemically synthesized
acaagatgttacgatataca

SEQ ID NO: 339107 - DNA, 20 bp, Artificial Sequence
  chemically synthesized
acccctgatttaaggggtac

SEQ ID NO: 339108 - DNA, 20 bp, Artificial Sequence
  chemically synthesized
acatcttgtaccccttaaat

SEQ ID NO: 339109 - DNA, 20 bp, Artificial Sequence
  chemically synthesized
ttacatacccctgatttaag

SEQ ID NO: 339110 - DNA, 20 bp, Artificial Sequence
  chemically synthesized
catcttgtaccccttaaatc

SEQ ID NO: 339111 - DNA, 20 bp, Artificial Sequence
  chemically synthesized
attacatacccctgatttaa

SEQ ID NO: 339112 - DNA, 20 bp, Artificial Sequence
  chemically synthesized
atcttgtaccccttaaatca

SEQ ID NO: 339113 - DNA, 20 bp, Artificial Sequence
  chemically synthesized
gattacatacccctgattta

SEQ ID NO: 339114 - DNA, 20 bp, Artificial Sequence
  chemically synthesized
tcttgtaccccttaaatcag

SEQ ID NO: 339115 - DNA, 20 bp, Artificial Sequence
  chemically synthesized
agattacatacccctgattt

SEQ ID NO: 339116 - DNA, 20 bp, Artificial Sequence
  chemically synthesized
atcaggggtatgtaatcttt

SEQ ID NO: 339117 - DNA, 20 bp, Artificial Sequence
  chemically synthesized
atggagcctaaggaagccaa

SEQ ID NO: 339118 - DNA, 20 bp, Artificial Sequence
  chemically synthesized
atgtaatcttttggcttcct

SEQ ID NO: 339119 - DNA, 20 bp, Artificial Sequence
  chemically synthesized
tgtaatcttttggcttcctt

SEQ ID NO: 339120 - DNA, 20 bp, Artificial Sequence
  chemically synthesized
tcttcaaatggagcctaagg

SEQ ID NO: 339121 - DNA, 20 bp, Artificial Sequence
  chemically synthesized
tattcttcaaatggagccta

SEQ ID NO: 339122 - DNA, 20 bp, Artificial Sequence
  chemically synthesized
ttattcttcaaatggagcct

SEQ ID NO: 339123 - DNA, 20 bp, Artificial Sequence
  chemically synthesized
gcttccttaggctccatttg

SEQ ID NO: 339124 - DNA, 20 bp, Artificial Sequence
  chemically synthesized
agataattattcttcaaatg

SEQ ID NO: 339125 - DNA, 20 bp, Artificial Sequence
  chemically synthesized
taagataattattcttcaaa

SEQ ID NO: 339126 - DNA, 20 bp, Artificial Sequence
  chemically synthesized
catttgaagaataattatct

SEQ ID NO: 339127 - DNA, 20 bp, Artificial Sequence
  chemically synthesized
atttgaagaataattatctt

SEQ ID NO: 339128 - DNA, 20 bp, Artificial Sequence
  chemically synthesized
gtgtattttaggtgtggcct

SEQ ID NO: 339129 - DNA, 20 bp, Artificial Sequence
  chemically synthesized
gtgttagtgtattttaggtg

SEQ ID NO: 339130 - DNA, 20 bp, Artificial Sequence
  chemically synthesized
tgttagtgttagtgtatttt

SEQ ID NO: 339131 - DNA, 20 bp, Artificial Sequence
  chemically synthesized
ttgttagtgttagtgtattt

SEQ ID NO: 339132 - DNA, 20 bp, Artificial Sequence
  chemically synthesized
tgattagctattgttagtgt

SEQ ID NO: 339133 - DNA, 20 bp, Artificial Sequence
  chemically synthesized
aaatacactaacactaacaa

SEQ ID NO: 339134 - DNA, 20 bp, Artificial Sequence
  chemically synthesized
tttagttgattagctattgt

SEQ ID NO: 339135 - DNA, 20 bp, Artificial Sequence
  chemically synthesized
ggtttttttttttagttgat

SEQ ID NO: 339136 - DNA, 20 bp, Artificial Sequence
  chemically synthesized
tttttgcaggtttttttttt

SEQ ID NO: 339137 - DNA, 20 bp, Artificial Sequence
  chemically synthesized
acattatgagatttttttgc

SEQ ID NO: 339138 - DNA, 20 bp, Artificial Sequence
  chemically synthesized
aacattatgagatttttttg

SEQ ID NO: 339139 - DNA, 20 bp, Artificial Sequence
  chemically synthesized
ccactttcttaaaacattat

SEQ ID NO: 339140 - DNA, 20 bp, Artificial Sequence
  chemically synthesized
aaaaaatctcataatgtttt

SEQ ID NO: 339141 - DNA, 20 bp, Artificial Sequence
  chemically synthesized
aatctcataatgttttaaga

SEQ ID NO: 339142 - DNA, 20 bp, Artificial Sequence
  chemically synthesized
ctcataatgttttaagaaag

SEQ ID NO: 339143 - DNA, 20 bp, Artificial Sequence
  chemically synthesized
tcataatgttttaagaaagt

SEQ ID NO: 339144 - DNA, 20 bp, Artificial Sequence
  chemically synthesized
ttaagaaagtgggtgaatta

SEQ ID NO: 339145 - DNA, 20 bp, Artificial Sequence
  chemically synthesized
gaaagtgggtgaattacagt

SEQ ID NO: 339146 - DNA, 20 bp, Artificial Sequence
  chemically synthesized
aaagtgggtgaattacagtt

SEQ ID NO: 339147 - DNA, 20 bp, Artificial Sequence
  chemically synthesized
ttacagttaggctgcattca

SEQ ID NO: 339148 - DNA, 20 bp, Artificial Sequence
  chemically synthesized
gcccaggacagctttgaatg

SEQ ID NO: 339149 - DNA, 20 bp, Artificial Sequence
  chemically synthesized
ggctgcattcaaagctgtcc

SEQ ID NO: 339150 - DNA, 20 bp, Artificial Sequence
  chemically synthesized
gctgcattcaaagctgtcct

SEQ ID NO: 339151 - DNA, 20 bp, Artificial Sequence
  chemically synthesized
gggctacatgtggcccagga

SEQ ID NO: 339152 - DNA, 20 bp, Artificial Sequence
  chemically synthesized
ccatgggctacatgtggccc

SEQ ID NO: 339153 - DNA, 20 bp, Artificial Sequence
  chemically synthesized
cccatgggctacatgtggcc

SEQ ID NO: 339154 - DNA, 20 bp, Artificial Sequence
  chemically synthesized
aagctgtcctgggccacatg

SEQ ID NO: 339155 - DNA, 20 bp, Artificial Sequence
  chemically synthesized
cacagcccatgggctacatg

SEQ ID NO: 339156 - DNA, 20 bp, Artificial Sequence
  chemically synthesized
cctgggccacatgtagccca

SEQ ID NO: 339157 - DNA, 20 bp, Artificial Sequence
  chemically synthesized
ctgggccacatgtagcccat

SEQ ID NO: 339158 - DNA, 20 bp, Artificial Sequence
  chemically synthesized
ttgtccaactcacagcccat

SEQ ID NO: 339159 - DNA, 20 bp, Artificial Sequence
  chemically synthesized
cttgtccaactcacagccca

SEQ ID NO: 339160 - DNA, 20 bp, Artificial Sequence
  chemically synthesized
acatgtagcccatgggctgt

SEQ ID NO: 339161 - DNA, 20 bp, Artificial Sequence
  chemically synthesized
gtagcccatgggctgtgagt

SEQ ID NO: 339162 - DNA, 20 bp, Artificial Sequence
  chemically synthesized
aggcaaccttgtccaactca

SEQ ID NO: 339163 - DNA, 20 bp, Artificial Sequence
  chemically synthesized
ccatgggctgtgagttggac

SEQ ID NO: 339164 - DNA, 20 bp, Artificial Sequence
  chemically synthesized
catgggctgtgagttggaca

SEQ ID NO: 339165 - DNA, 20 bp, Artificial Sequence
  chemically synthesized
gagttggacaaggttgcctt

SEQ ID NO: 339166 - DNA, 20 bp, Artificial Sequence
  chemically synthesized
tcttttactggatgtactta

SEQ ID NO: 339167 - DNA, 20 bp, Artificial Sequence
  chemically synthesized
ttcttttactggatgtactt

SEQ ID NO: 339168 - DNA, 20 bp, Artificial Sequence
  chemically synthesized
aaggttgccttaagtacatc

SEQ ID NO: 339169 - DNA, 20 bp, Artificial Sequence
  chemically synthesized
gccttaagtacatccagtaa

SEQ ID NO: 339170 - DNA, 20 bp, Artificial Sequence
  chemically synthesized
tttagtttttattcttttac

SEQ ID NO: 339171 - DNA, 20 bp, Artificial Sequence
  chemically synthesized
tgtgctaattattttagttt

SEQ ID NO: 339172 - DNA, 20 bp, Artificial Sequence
  chemically synthesized
aaaactaaaactaaaataat

SEQ ID NO: 339173 - DNA, 20 bp, Artificial Sequence
  chemically synthesized
acaatatgtgctaattattt

SEQ ID NO: 339174 - DNA, 20 bp, Artificial Sequence
  chemically synthesized
gtatttcaaatgatgacaat

SEQ ID NO: 339175 - DNA, 20 bp, Artificial Sequence
  chemically synthesized
atgatgacaattagattcga

SEQ ID NO: 339176 - DNA, 20 bp, Artificial Sequence
  chemically synthesized
aattagattcgacagttgac

SEQ ID NO: 339177 - DNA, 20 bp, Artificial Sequence
  chemically synthesized
tcaaatataatacatttaaa

SEQ ID NO: 339178 - DNA, 20 bp, Artificial Sequence
  chemically synthesized
atggtgcaattctacttctt

SEQ ID NO: 339179 - DNA, 20 bp, Artificial Sequence
  chemically synthesized
tggtgcaattctacttcttg

SEQ ID NO: 339180 - DNA, 20 bp, Artificial Sequence
  chemically synthesized
gaaaggatttcctcaagaag

SEQ ID NO: 339181 - DNA, 20 bp, Artificial Sequence
  chemically synthesized
tttgaaaggatttcctcaag

SEQ ID NO: 339182 - DNA, 20 bp, Artificial Sequence
  chemically synthesized
ttttttgaaaggatttcctc

SEQ ID NO: 339183 - DNA, 20 bp, Artificial Sequence
  chemically synthesized
agttggaccaattttttgaa

SEQ ID NO: 339184 - DNA, 20 bp, Artificial Sequence
  chemically synthesized
cagttggaccaattttttga

SEQ ID NO: 339185 - DNA, 20 bp, Artificial Sequence
  chemically synthesized
aggaaatcctttcaaaaaat

SEQ ID NO: 339186 - DNA, 20 bp, Artificial Sequence
  chemically synthesized
tttcaaaaaattggtccaac

SEQ ID NO: 339187 - DNA, 20 bp, Artificial Sequence
  chemically synthesized
gtatatttatacattccagt

SEQ ID NO: 339188 - DNA, 20 bp, Artificial Sequence
  chemically synthesized
aattgtatatttatacattc

SEQ ID NO: 339189 - DNA, 20 bp, Artificial Sequence
  chemically synthesized
gaatgtataaatatacaatt

SEQ ID NO: 339190 - DNA, 20 bp, Artificial Sequence
  chemically synthesized
aattgtgcatttaaaatcaa

SEQ ID NO: 339191 - DNA, 20 bp, Artificial Sequence
  chemically synthesized
aaaaagtctgatttaattta

SEQ ID NO: 339192 - DNA, 20 bp, Artificial Sequence
  chemically synthesized
caaaaaagtctgatttaatt

SEQ ID NO: 339193 - DNA, 20 bp, Artificial Sequence
  chemically synthesized
taataaactctaaattaaat

SEQ ID NO: 339194 - DNA, 20 bp, Artificial Sequence
  chemically synthesized
ctcgtttagtttcagcaaaa

SEQ ID NO: 339195 - DNA, 20 bp, Artificial Sequence
  chemically synthesized
ttattcacctcgtttagttt

SEQ ID NO: 339196 - DNA, 20 bp, Artificial Sequence
  chemically synthesized
cttttttgctgaaactaaac

SEQ ID NO: 339197 - DNA, 20 bp, Artificial Sequence
  chemically synthesized
ttttttgctgaaactaaacg

SEQ ID NO: 339198 - DNA, 20 bp, Artificial Sequence
  chemically synthesized
cctattttattcacctcgtt

SEQ ID NO: 339199 - DNA, 20 bp, Artificial Sequence
  chemically synthesized
actaaacgaggtgaataaaa

SEQ ID NO: 339200 - DNA, 20 bp, Artificial Sequence
  chemically synthesized
ctaaacgaggtgaataaaat

SEQ ID NO: 339201 - DNA, 20 bp, Artificial Sequence
  chemically synthesized
cgaggtgaataaaataggtg

SEQ ID NO: 339202 - DNA, 20 bp, Artificial Sequence
  chemically synthesized
gtgaagtgaacctaatttat

SEQ ID NO: 339203 - DNA, 20 bp, Artificial Sequence
  chemically synthesized
ccataacagccttataaatt

SEQ ID NO: 339204 - DNA, 20 bp, Artificial Sequence
  chemically synthesized
tgaagtgaacctaatttata

SEQ ID NO: 339205 - DNA, 20 bp, Artificial Sequence
  chemically synthesized
gccataacagccttataaat

SEQ ID NO: 339206 - DNA, 20 bp, Artificial Sequence
  chemically synthesized
cctaatttataaggctgtta

SEQ ID NO: 339207 - DNA, 20 bp, Artificial Sequence
  chemically synthesized
ttgaagaatttgagccataa

SEQ ID NO: 339208 - DNA, 20 bp, Artificial Sequence
  chemically synthesized
gaaatttatttgaagaattt

SEQ ID NO: 339209 - DNA, 20 bp, Artificial Sequence
  chemically synthesized
actgaacagaaatttatttg

SEQ ID NO: 339210 - DNA, 20 bp, Artificial Sequence
  chemically synthesized
tcttcaaataaatttctgtt

SEQ ID NO: 339211 - DNA, 20 bp, Artificial Sequence
  chemically synthesized
tgaaaatgataagaactgaa

SEQ ID NO: 339212 - DNA, 20 bp, Artificial Sequence
  chemically synthesized
atcaactttatgaaaatgat

SEQ ID NO: 339213 - DNA, 20 bp, Artificial Sequence
  chemically synthesized
cagttcttatcattttcata

SEQ ID NO: 339214 - DNA, 20 bp, Artificial Sequence
  chemically synthesized
ttttcataaagttgatttat

SEQ ID NO: 339215 - DNA, 20 bp, Artificial Sequence
  chemically synthesized
tttcataaagttgatttatg

SEQ ID NO: 339216 - DNA, 20 bp, Artificial Sequence
  chemically synthesized
tagactactctagatttgca

SEQ ID NO: 339217 - DNA, 20 bp, Artificial Sequence
  chemically synthesized
tatgaggaactatgcaaatc

SEQ ID NO: 339218 - DNA, 20 bp, Artificial Sequence
  chemically synthesized
tgaggaactatgcaaatcta

SEQ ID NO: 339219 - DNA, 20 bp, Artificial Sequence
  chemically synthesized
ggaactatgcaaatctagag

SEQ ID NO: 339220 - DNA, 20 bp, Artificial Sequence
  chemically synthesized
cagactttagtagactactc

SEQ ID NO: 339221 - DNA, 20 bp, Artificial Sequence
  chemically synthesized
aaatctagagtagtctacta

SEQ ID NO: 339222 - DNA, 20 bp, Artificial Sequence
  chemically synthesized
atataaaaagcagactttag

SEQ ID NO: 339223 - DNA, 20 bp, Artificial Sequence
  chemically synthesized
agcatataaaaagcagactt

SEQ ID NO: 339224 - DNA, 20 bp, Artificial Sequence
  chemically synthesized
tgaaataagcatataaaaag

SEQ ID NO: 339225 - DNA, 20 bp, Artificial Sequence
  chemically synthesized
gtgtgaaataagcatataaa

SEQ ID NO: 339226 - DNA, 20 bp, Artificial Sequence
  chemically synthesized
ataaccattttgtgtgaaat

SEQ ID NO: 339227 - DNA, 20 bp, Artificial Sequence
  chemically synthesized
tatgcttatttcacacaaaa

SEQ ID NO: 339228 - DNA, 20 bp, Artificial Sequence
  chemically synthesized
gggcctagacaaaatacata

SEQ ID NO: 339229 - DNA, 20 bp, Artificial Sequence
  chemically synthesized
ttgaccatatgtattttgtc

SEQ ID NO: 339230 - DNA, 20 bp, Artificial Sequence
  chemically synthesized
tgaccatatgtattttgtct

SEQ ID NO: 339231 - DNA, 20 bp, Artificial Sequence
  chemically synthesized
agctcctcttggtaagggcc

SEQ ID NO: 339232 - DNA, 20 bp, Artificial Sequence
  chemically synthesized
attttgtctaggcccttacc

SEQ ID NO: 339233 - DNA, 20 bp, Artificial Sequence
  chemically synthesized
tttgtctaggcccttaccaa

SEQ ID NO: 339234 - DNA, 20 bp, Artificial Sequence
  chemically synthesized
ttaacagctcctcttggtaa

SEQ ID NO: 339235 - DNA, 20 bp, Artificial Sequence
  chemically synthesized
ttgtctaggcccttaccaag

SEQ ID NO: 339236 - DNA, 20 bp, Artificial Sequence
  chemically synthesized
gttaacagctcctcttggta

SEQ ID NO: 339237 - DNA, 20 bp, Artificial Sequence
  chemically synthesized
tgttaacagctcctcttggt

SEQ ID NO: 339238 - DNA, 20 bp, Artificial Sequence
  chemically synthesized
gtctaggcccttaccaagag

SEQ ID NO: 339239 - DNA, 20 bp, Artificial Sequence
  chemically synthesized
attatgttaacagctcctct

SEQ ID NO: 339240 - DNA, 20 bp, Artificial Sequence
  chemically synthesized
ttgtaaatcaattatgttaa

SEQ ID NO: 339241 - DNA, 20 bp, Artificial Sequence
  chemically synthesized
aacataattgatttacaatt

SEQ ID NO: 339242 - DNA, 20 bp, Artificial Sequence
  chemically synthesized
taattgatttacaattcagt

SEQ ID NO: 339243 - DNA, 20 bp, Artificial Sequence
  chemically synthesized
aattgatttacaattcagtt

SEQ ID NO: 339244 - DNA, 20 bp, Artificial Sequence
  chemically synthesized
tgatttacaattcagttagg

SEQ ID NO: 339245 - DNA, 20 bp, Artificial Sequence
  chemically synthesized
gttaggaagaaaacatgtta

SEQ ID NO: 339246 - DNA, 20 bp, Artificial Sequence
  chemically synthesized
ttattgtttcagagtaaaat

SEQ ID NO: 339247 - DNA, 20 bp, Artificial Sequence
  chemically synthesized
tgggttgatttattgtttca

SEQ ID NO: 339248 - DNA, 20 bp, Artificial Sequence
  chemically synthesized
attgggttgatttattgttt

SEQ ID NO: 339249 - DNA, 20 bp, Artificial Sequence
  chemically synthesized
caataaatcaacccaatgtg

SEQ ID NO: 339250 - DNA, 20 bp, Artificial Sequence
  chemically synthesized
gctgtgatatacttcacatt

SEQ ID NO: 339251 - DNA, 20 bp, Artificial Sequence
  chemically synthesized
ggctgtgatatacttcacat

SEQ ID NO: 339252 - DNA, 20 bp, Artificial Sequence
  chemically synthesized
acccaatgtgaagtatatca

SEQ ID NO: 339253 - DNA, 20 bp, Artificial Sequence
  chemically synthesized
tggatcactgttcattttat

SEQ ID NO: 339254 - DNA, 20 bp, Artificial Sequence
  chemically synthesized
ttggatcactgttcatttta

SEQ ID NO: 339255 - DNA, 20 bp, Artificial Sequence
  chemically synthesized
atcacagcccataaaatgaa

SEQ ID NO: 339256 - DNA, 20 bp, Artificial Sequence
  chemically synthesized
tgaacagtgatccaattgta

SEQ ID NO: 339257 - DNA, 20 bp, Artificial Sequence
  chemically synthesized
acatggttcaactgtacaat

SEQ ID NO: 339258 - DNA, 20 bp, Artificial Sequence
  chemically synthesized
aattgtacagttgaaccatg

SEQ ID NO: 339259 - DNA, 20 bp, Artificial Sequence
  chemically synthesized
catgggatatgtgagctaca

SEQ ID NO: 339260 - DNA, 20 bp, Artificial Sequence
  chemically synthesized
ttaagtgccatgggatatgt

SEQ ID NO: 339261 - DNA, 20 bp, Artificial Sequence
  chemically synthesized
catgtagctcacatatccca

SEQ ID NO: 339262 - DNA, 20 bp, Artificial Sequence
  chemically synthesized
atgaagattttaagtgccat

SEQ ID NO: 339263 - DNA, 20 bp, Artificial Sequence
  chemically synthesized
gatgaagattttaagtgcca

SEQ ID NO: 339264 - DNA, 20 bp, Artificial Sequence
  chemically synthesized
aatgactggatgaagatttt

SEQ ID NO: 339265 - DNA, 20 bp, Artificial Sequence
  chemically synthesized
tggcacttaaaatcttcatc

SEQ ID NO: 339266 - DNA, 20 bp, Artificial Sequence
  chemically synthesized
acttatttaatgactggatg

SEQ ID NO: 339267 - DNA, 20 bp, Artificial Sequence
  chemically synthesized
cttgagacttatttaatgac

SEQ ID NO: 339268 - DNA, 20 bp, Artificial Sequence
  chemically synthesized
tcttcatccagtcattaaat

SEQ ID NO: 339269 - DNA, 20 bp, Artificial Sequence
  chemically synthesized
ccagtcattaaataagtctc

SEQ ID NO: 339270 - DNA, 20 bp, Artificial Sequence
  chemically synthesized
atgtaaatcttttggatctt

SEQ ID NO: 339271 - DNA, 20 bp, Artificial Sequence
  chemically synthesized
aaataagtctcaagatccaa

SEQ ID NO: 339272 - DNA, 20 bp, Artificial Sequence
  chemically synthesized
ttgtgcttatgtaaatcttt

SEQ ID NO: 339273 - DNA, 20 bp, Artificial Sequence
  chemically synthesized
aagatccaaaagatttacat

SEQ ID NO: 339274 - DNA, 20 bp, Artificial Sequence
  chemically synthesized
gaagagctaataaagttatt

SEQ ID NO: 339275 - DNA, 20 bp, Artificial Sequence
  chemically synthesized
gcacaactgaataactttat

SEQ ID NO: 339276 - DNA, 20 bp, Artificial Sequence
  chemically synthesized
ccagaagagaagagctaata

SEQ ID NO: 339277 - DNA, 20 bp, Artificial Sequence
  chemically synthesized
attataaacccagaagagaa

SEQ ID NO: 339278 - DNA, 20 bp, Artificial Sequence
  chemically synthesized
ctttattagctcttctcttc

SEQ ID NO: 339279 - DNA, 20 bp, Artificial Sequence
  chemically synthesized
tttattagctcttctcttct

SEQ ID NO: 339280 - DNA, 20 bp, Artificial Sequence
  chemically synthesized
tcattataaacccagaagag

SEQ ID NO: 339281 - DNA, 20 bp, Artificial Sequence
  chemically synthesized
tcatcattataaacccagaa

SEQ ID NO: 339282 - DNA, 20 bp, Artificial Sequence
  chemically synthesized
gttcatcattataaacccag

SEQ ID NO: 339283 - DNA, 20 bp, Artificial Sequence
  chemically synthesized
ttagttcatcattataaacc

SEQ ID NO: 339284 - DNA, 20 bp, Artificial Sequence
  chemically synthesized
ttataacaggttagtatttt

SEQ ID NO: 339285 - DNA, 20 bp, Artificial Sequence
  chemically synthesized
tgatgtaatttataacaggt

SEQ ID NO: 339286 - DNA, 20 bp, Artificial Sequence
  chemically synthesized
ttactgatgtaatttataac

SEQ ID NO: 339287 - DNA, 20 bp, Artificial Sequence
  chemically synthesized
attactgatgtaatttataa

SEQ ID NO: 339288 - DNA, 20 bp, Artificial Sequence
  chemically synthesized
taacctgttataaattacat

SEQ ID NO: 339289 - DNA, 20 bp, Artificial Sequence
  chemically synthesized
aaattacatcagtaatcttt

SEQ ID NO: 339290 - DNA, 20 bp, Artificial Sequence
  chemically synthesized
atgatgagaaaaagagctga

SEQ ID NO: 339291 - DNA, 20 bp, Artificial Sequence
  chemically synthesized
ttataatatgatgagaaaaa

SEQ ID NO: 339292 - DNA, 20 bp, Artificial Sequence
  chemically synthesized
atttataatatgatgagaaa

SEQ ID NO: 339293 - DNA, 20 bp, Artificial Sequence
  chemically synthesized
ttgtaaatttataatatgat

SEQ ID NO: 339294 - DNA, 20 bp, Artificial Sequence
  chemically synthesized
tataaatttacaatgttact

SEQ ID NO: 339295 - DNA, 20 bp, Artificial Sequence
  chemically synthesized
tgataaacattttttaatct

SEQ ID NO: 339296 - DNA, 20 bp, Artificial Sequence
  chemically synthesized
ttaattatttgcatgatctt

SEQ ID NO: 339297 - DNA, 20 bp, Artificial Sequence
  chemically synthesized
tccattgtttaaaaatgcta

SEQ ID NO: 339298 - DNA, 20 bp, Artificial Sequence
  chemically synthesized
tctttagcatttttaaacaa

SEQ ID NO: 339299 - DNA, 20 bp, Artificial Sequence
  chemically synthesized
catttttaaacaatggaaaa

SEQ ID NO: 339300 - DNA, 20 bp, Artificial Sequence
  chemically synthesized
tttttaaacaatggaaaaaa

SEQ ID NO: 339301 - DNA, 20 bp, Artificial Sequence
  chemically synthesized
tttaaacaatggaaaaaaga

SEQ ID NO: 339302 - DNA, 20 bp, Artificial Sequence
  chemically synthesized
aaaaagagagctaccaaaac

SEQ ID NO: 339303 - DNA, 20 bp, Artificial Sequence
  chemically synthesized
gaacacaactctggttttgg

SEQ ID NO: 339304 - DNA, 20 bp, Artificial Sequence
  chemically synthesized
aaagagagctaccaaaacca

SEQ ID NO: 339305 - DNA, 20 bp, Artificial Sequence
  chemically synthesized
caagaacacaactctggttt

SEQ ID NO: 339306 - DNA, 20 bp, Artificial Sequence
  chemically synthesized
tgatgccaagaacacaactc

SEQ ID NO: 339307 - DNA, 20 bp, Artificial Sequence
  chemically synthesized
caaaaccagagttgtgttct

SEQ ID NO: 339308 - DNA, 20 bp, Artificial Sequence
  chemically synthesized
cagagttgtgttcttggcat

SEQ ID NO: 339309 - DNA, 20 bp, Artificial Sequence
  chemically synthesized
tactagagctttctgatgcc

SEQ ID NO: 339310 - DNA, 20 bp, Artificial Sequence
  chemically synthesized
gttgtgttcttggcatcaga

SEQ ID NO: 339311 - DNA, 20 bp, Artificial Sequence
  chemically synthesized
ttcttggcatcagaaagctc

SEQ ID NO: 339312 - DNA, 20 bp, Artificial Sequence
  chemically synthesized
agtttatttgatgtttacta

SEQ ID NO: 339313 - DNA, 20 bp, Artificial Sequence
  chemically synthesized
aaagtttatttgatgtttac

SEQ ID NO: 339314 - DNA, 20 bp, Artificial Sequence
  chemically synthesized
aaacatcaaataaactttaa

SEQ ID NO: 339315 - DNA, 20 bp, Artificial Sequence
  chemically synthesized
atttacgcactaagctgtta

SEQ ID NO: 339316 - DNA, 20 bp, Artificial Sequence
  chemically synthesized
tcaaataaactttaacagct

SEQ ID NO: 339317 - DNA, 20 bp, Artificial Sequence
  chemically synthesized
ggctgtgttatttacgcact

SEQ ID NO: 339318 - DNA, 20 bp, Artificial Sequence
  chemically synthesized
agcttagtgcgtaaataaca

SEQ ID NO: 339319 - DNA, 20 bp, Artificial Sequence
  chemically synthesized
tgcgtaaataacacagcctc

SEQ ID NO: 339320 - DNA, 20 bp, Artificial Sequence
  chemically synthesized
tggctaaggtgttgtacttg

SEQ ID NO: 339321 - DNA, 20 bp, Artificial Sequence
  chemically synthesized
gtggctaaggtgttgtactt

SEQ ID NO: 339322 - DNA, 20 bp, Artificial Sequence
  chemically synthesized
cagcctcaagtacaacacct

SEQ ID NO: 339323 - DNA, 20 bp, Artificial Sequence
  chemically synthesized
caagtacaacaccttagcca

SEQ ID NO: 339324 - DNA, 20 bp, Artificial Sequence
  chemically synthesized
ttaagtactatctgtggcta

SEQ ID NO: 339325 - DNA, 20 bp, Artificial Sequence
  chemically synthesized
attaagtactatctgtggct

SEQ ID NO: 339326 - DNA, 20 bp, Artificial Sequence
  chemically synthesized
tacaacaccttagccacaga

SEQ ID NO: 339327 - DNA, 20 bp, Artificial Sequence
  chemically synthesized
tatttattaagtactatctg

SEQ ID NO: 339328 - DNA, 20 bp, Artificial Sequence
  chemically synthesized
cacagatagtacttaataaa

SEQ ID NO: 339329 - DNA, 20 bp, Artificial Sequence
  chemically synthesized
ccaaacaatgactatttatt

SEQ ID NO: 339330 - DNA, 20 bp, Artificial Sequence
  chemically synthesized
cttaataaatagtcattgtt

SEQ ID NO: 339331 - DNA, 20 bp, Artificial Sequence
  chemically synthesized
ctttcttctgttgtgttaca

SEQ ID NO: 339332 - DNA, 20 bp, Artificial Sequence
  chemically synthesized
gttgtatctgtgtaacacaa

SEQ ID NO: 339333 - DNA, 20 bp, Artificial Sequence
  chemically synthesized
gtatctgtgtaacacaacag

SEQ ID NO: 339334 - DNA, 20 bp, Artificial Sequence
  chemically synthesized
ctgtgtaacacaacagaaga

SEQ ID NO: 339335 - DNA, 20 bp, Artificial Sequence
  chemically synthesized
tagattctaaagcaaggatt

SEQ ID NO: 339336 - DNA, 20 bp, Artificial Sequence
  chemically synthesized
ctagattctaaagcaaggat

SEQ ID NO: 339337 - DNA, 20 bp, Artificial Sequence
  chemically synthesized
tacaatcctaatccttgctt

SEQ ID NO: 339338 - DNA, 20 bp, Artificial Sequence
  chemically synthesized
aatgtctagattctaaagca

SEQ ID NO: 339339 - DNA, 20 bp, Artificial Sequence
  chemically synthesized
caatgtctagattctaaagc

SEQ ID NO: 339340 - DNA, 20 bp, Artificial Sequence
  chemically synthesized
ctaatccttgctttagaatc

SEQ ID NO: 339341 - DNA, 20 bp, Artificial Sequence
  chemically synthesized
aaaacaatgtctagattcta

SEQ ID NO: 339342 - DNA, 20 bp, Artificial Sequence
  chemically synthesized
atggctaagaaaacaatgtc

SEQ ID NO: 339343 - DNA, 20 bp, Artificial Sequence
  chemically synthesized
gaatctagacattgttttct

SEQ ID NO: 339344 - DNA, 20 bp, Artificial Sequence
  chemically synthesized
ctgttattgcagaaatggct

SEQ ID NO: 339345 - DNA, 20 bp, Artificial Sequence
  chemically synthesized
tttaactgttattgcagaaa

SEQ ID NO: 339346 - DNA, 20 bp, Artificial Sequence
  chemically synthesized
cttagccatttctgcaataa

SEQ ID NO: 339347 - DNA, 20 bp, Artificial Sequence
  chemically synthesized
gtttattttaactgttattg

SEQ ID NO: 339348 - DNA, 20 bp, Artificial Sequence
  chemically synthesized
aacagttaaaataaacgtac

SEQ ID NO: 339349 - DNA, 20 bp, Artificial Sequence
  chemically synthesized
aataaacgtaccagcatttc

SEQ ID NO: 339350 - DNA, 20 bp, Artificial Sequence
  chemically synthesized
agagtctttaccagaaatgc

SEQ ID NO: 339351 - DNA, 20 bp, Artificial Sequence
  chemically synthesized
acgtaccagcatttctggta

SEQ ID NO: 339352 - DNA, 20 bp, Artificial Sequence
  chemically synthesized
ttatatattagagtctttac

SEQ ID NO: 339353 - DNA, 20 bp, Artificial Sequence
  chemically synthesized
tggaacacccttatatatta

SEQ ID NO: 339354 - DNA, 20 bp, Artificial Sequence
  chemically synthesized
tggtaaagactctaatatat

SEQ ID NO: 339355 - DNA, 20 bp, Artificial Sequence
  chemically synthesized
ggtaaagactctaatatata

SEQ ID NO: 339356 - DNA, 20 bp, Artificial Sequence
  chemically synthesized
tctggaacacccttatatat

SEQ ID NO: 339357 - DNA, 20 bp, Artificial Sequence
  chemically synthesized
gtaaagactctaatatataa

SEQ ID NO: 339358 - DNA, 20 bp, Artificial Sequence
  chemically synthesized
tctaatatataagggtgttc

SEQ ID NO: 339359 - DNA, 20 bp, Artificial Sequence
  chemically synthesized
atctagtatattgaaatttc

SEQ ID NO: 339360 - DNA, 20 bp, Artificial Sequence
  chemically synthesized
ttccagaaatttcaatatac

SEQ ID NO: 339361 - DNA, 20 bp, Artificial Sequence
  chemically synthesized
tttcaatatactagatttga

SEQ ID NO: 339362 - DNA, 20 bp, Artificial Sequence
  chemically synthesized
tcaagccatactgtcaaatc

SEQ ID NO: 339363 - DNA, 20 bp, Artificial Sequence
  chemically synthesized
atatactagatttgacagta

SEQ ID NO: 339364 - DNA, 20 bp, Artificial Sequence
  chemically synthesized
tagatttgacagtatggctt

SEQ ID NO: 339365 - DNA, 20 bp, Artificial Sequence
  chemically synthesized
gatttgacagtatggcttga

SEQ ID NO: 339366 - DNA, 20 bp, Artificial Sequence
  chemically synthesized
tttgacagtatggcttgaga

SEQ ID NO: 339367 - DNA, 20 bp, Artificial Sequence
  chemically synthesized
ttgacagtatggcttgagag

SEQ ID NO: 339368 - DNA, 20 bp, Artificial Sequence
  chemically synthesized
tgacagtatggcttgagaga

SEQ ID NO: 339369 - DNA, 20 bp, Artificial Sequence
  chemically synthesized
agcagtgggatccctctctc

SEQ ID NO: 339370 - DNA, 20 bp, Artificial Sequence
  chemically synthesized
gagagagggatcccactgct

SEQ ID NO: 339371 - DNA, 20 bp, Artificial Sequence
  chemically synthesized
ggcagagaatgctcagcagt

SEQ ID NO: 339372 - DNA, 20 bp, Artificial Sequence
  chemically synthesized
aggcagagaatgctcagcag

SEQ ID NO: 339373 - DNA, 20 bp, Artificial Sequence
  chemically synthesized
gagaggcagagaatgctcag

SEQ ID NO: 339374 - DNA, 20 bp, Artificial Sequence
  chemically synthesized
tatgagaggcagagaatgct

SEQ ID NO: 339375 - DNA, 20 bp, Artificial Sequence
  chemically synthesized
gatccatgatatgagaggca

SEQ ID NO: 339376 - DNA, 20 bp, Artificial Sequence
  chemically synthesized
atgatccatgatatgagagg

SEQ ID NO: 339377 - DNA, 20 bp, Artificial Sequence
  chemically synthesized
actatgatccatgatatgag

SEQ ID NO: 339378 - DNA, 20 bp, Artificial Sequence
  chemically synthesized
gactatgatccatgatatga

SEQ ID NO: 339379 - DNA, 20 bp, Artificial Sequence
  chemically synthesized
attctctgcctctcatatca

SEQ ID NO: 339380 - DNA, 20 bp, Artificial Sequence
  chemically synthesized
gtgactatgatccatgatat

SEQ ID NO: 339381 - DNA, 20 bp, Artificial Sequence
  chemically synthesized
gcctctcatatcatggatca

SEQ ID NO: 339382 - DNA, 20 bp, Artificial Sequence
  chemically synthesized
tattatagataaaatttcat

SEQ ID NO: 339383 - DNA, 20 bp, Artificial Sequence
  chemically synthesized
acctatggactacaatatta

SEQ ID NO: 339384 - DNA, 20 bp, Artificial Sequence
  chemically synthesized
aaattttatctataatattg

SEQ ID NO: 339385 - DNA, 20 bp, Artificial Sequence
  chemically synthesized
atctataatattgtagtcca

SEQ ID NO: 339386 - DNA, 20 bp, Artificial Sequence
  chemically synthesized
tctataatattgtagtccat

SEQ ID NO: 339387 - DNA, 20 bp, Artificial Sequence
  chemically synthesized
catatacatatatataccta

SEQ ID NO: 339388 - DNA, 20 bp, Artificial Sequence
  chemically synthesized
tcaagtattttgtagaatca

SEQ ID NO: 339389 - DNA, 20 bp, Artificial Sequence
  chemically synthesized
taaagatgtcaagtattttg

SEQ ID NO: 339390 - DNA, 20 bp, Artificial Sequence
  chemically synthesized
aggcggtcattaaagatgtc

SEQ ID NO: 339391 - DNA, 20 bp, Artificial Sequence
  chemically synthesized
atctttataggcggtcatta

SEQ ID NO: 339392 - DNA, 20 bp, Artificial Sequence
  chemically synthesized
atctttaatgaccgcctata

SEQ ID NO: 339393 - DNA, 20 bp, Artificial Sequence
  chemically synthesized
cccatgtgtatctttatagg

SEQ ID NO: 339394 - DNA, 20 bp, Artificial Sequence
  chemically synthesized
cagcccatgtgtatctttat

SEQ ID NO: 339395 - DNA, 20 bp, Artificial Sequence
  chemically synthesized
tcagcccatgtgtatcttta

SEQ ID NO: 339396 - DNA, 20 bp, Artificial Sequence
  chemically synthesized
accgcctataaagatacaca

SEQ ID NO: 339397 - DNA, 20 bp, Artificial Sequence
  chemically synthesized
ccgcctataaagatacacat

SEQ ID NO: 339398 - DNA, 20 bp, Artificial Sequence
  chemically synthesized
agatacacatgggctgaaaa

SEQ ID NO: 339399 - DNA, 20 bp, Artificial Sequence
  chemically synthesized
tatcttttttcatccatttt

SEQ ID NO: 339400 - DNA, 20 bp, Artificial Sequence
  chemically synthesized
gggctgaaaatggatgaaaa

SEQ ID NO: 339401 - DNA, 20 bp, Artificial Sequence
  chemically synthesized
aaaaagatattccatgccaa

SEQ ID NO: 339402 - DNA, 20 bp, Artificial Sequence
  chemically synthesized
ttttttggtttccattggca

SEQ ID NO: 339403 - DNA, 20 bp, Artificial Sequence
  chemically synthesized
tgctgttttttggtttccat

SEQ ID NO: 339404 - DNA, 20 bp, Artificial Sequence
  chemically synthesized
tgccaatggaaaccaaaaaa

SEQ ID NO: 339405 - DNA, 20 bp, Artificial Sequence
  chemically synthesized
cagccactcctgctgttttt

SEQ ID NO: 339406 - DNA, 20 bp, Artificial Sequence
  chemically synthesized
caatggaaaccaaaaaacag

SEQ ID NO: 339407 - DNA, 20 bp, Artificial Sequence
  chemically synthesized
aatggaaaccaaaaaacagc

SEQ ID NO: 339408 - DNA, 20 bp, Artificial Sequence
  chemically synthesized
tggaaaccaaaaaacagcag

SEQ ID NO: 339409 - DNA, 20 bp, Artificial Sequence
  chemically synthesized
aaaccaaaaaacagcaggag

SEQ ID NO: 339410 - DNA, 20 bp, Artificial Sequence
  chemically synthesized
tgttctgtctgaaaaaagta

SEQ ID NO: 339411 - DNA, 20 bp, Artificial Sequence
  chemically synthesized
aggagtggctgtactttttt

SEQ ID NO: 339412 - DNA, 20 bp, Artificial Sequence
  chemically synthesized
aaatctgttctgtctgaaaa

SEQ ID NO: 339413 - DNA, 20 bp, Artificial Sequence
  chemically synthesized
gtggctgtacttttttcaga

SEQ ID NO: 339414 - DNA, 20 bp, Artificial Sequence
  chemically synthesized
tgtacttttttcagacagaa

SEQ ID NO: 339415 - DNA, 20 bp, Artificial Sequence
  chemically synthesized
tttcagacagaacagatttc

SEQ ID NO: 339416 - DNA, 20 bp, Artificial Sequence
  chemically synthesized
cagatttcaagacaaaaaca

SEQ ID NO: 339417 - DNA, 20 bp, Artificial Sequence
  chemically synthesized
gatttcaagacaaaaacaaa

SEQ ID NO: 339418 - DNA, 20 bp, Artificial Sequence
  chemically synthesized
acaaaaacaaagagtcaaaa

SEQ ID NO: 339419 - DNA, 20 bp, Artificial Sequence
  chemically synthesized
caaaaacaaagagtcaaaaa

SEQ ID NO: 339420 - DNA, 20 bp, Artificial Sequence
  chemically synthesized
aaaaaaggtcattatataat

SEQ ID NO: 339421 - DNA, 20 bp, Artificial Sequence
  chemically synthesized
aaggtcattatataatgaga

SEQ ID NO: 339422 - DNA, 20 bp, Artificial Sequence
  chemically synthesized
aggtcattatataatgagaa

SEQ ID NO: 339423 - DNA, 20 bp, Artificial Sequence
  chemically synthesized
ggtcattatataatgagaaa

SEQ ID NO: 339424 - DNA, 20 bp, Artificial Sequence
  chemically synthesized
gtcattatataatgagaaag

SEQ ID NO: 339425 - DNA, 20 bp, Artificial Sequence
  chemically synthesized
taatgagaaaggggtcaatt

SEQ ID NO: 339426 - DNA, 20 bp, Artificial Sequence
  chemically synthesized
gaaaggggtcaattcagcaa

SEQ ID NO: 339427 - DNA, 20 bp, Artificial Sequence
  chemically synthesized
aaaggggtcaattcagcaaa

SEQ ID NO: 339428 - DNA, 20 bp, Artificial Sequence
  chemically synthesized
atacaacaattgcaaatatt

SEQ ID NO: 339429 - DNA, 20 bp, Artificial Sequence
  chemically synthesized
tacaacaattgcaaatattt

SEQ ID NO: 339430 - DNA, 20 bp, Artificial Sequence
  chemically synthesized
aatatttaggcacccaacac

SEQ ID NO: 339431 - DNA, 20 bp, Artificial Sequence
  chemically synthesized
tatttaggcacccaacactg

SEQ ID NO: 339432 - DNA, 20 bp, Artificial Sequence
  chemically synthesized
tatctgggtgctccagtgtt

SEQ ID NO: 339433 - DNA, 20 bp, Artificial Sequence
  chemically synthesized
ttatctgggtgctccagtgt

SEQ ID NO: 339434 - DNA, 20 bp, Artificial Sequence
  chemically synthesized
gcacccaacactggagcacc

SEQ ID NO: 339435 - DNA, 20 bp, Artificial Sequence
  chemically synthesized
ctttatttatctgggtgctc

SEQ ID NO: 339436 - DNA, 20 bp, Artificial Sequence
  chemically synthesized
aatatttgctttatttatct

SEQ ID NO: 339437 - DNA, 20 bp, Artificial Sequence
  chemically synthesized
taatatttgctttatttatc

SEQ ID NO: 339438 - DNA, 20 bp, Artificial Sequence
  chemically synthesized
ctggagcacccagataaata

SEQ ID NO: 339439 - DNA, 20 bp, Artificial Sequence
  chemically synthesized
ataaataaagcaaatattat

SEQ ID NO: 339440 - DNA, 20 bp, Artificial Sequence
  chemically synthesized
aaataaagcaaatattatta

SEQ ID NO: 339441 - DNA, 20 bp, Artificial Sequence
  chemically synthesized
agcaaatattattagagcta

SEQ ID NO: 339442 - DNA, 20 bp, Artificial Sequence
  chemically synthesized
caaatattattagagctaaa

SEQ ID NO: 339443 - DNA, 20 bp, Artificial Sequence
  chemically synthesized
aatattattagagctaaaga

SEQ ID NO: 339444 - DNA, 20 bp, Artificial Sequence
  chemically synthesized
tattattagagctaaagaga

SEQ ID NO: 339445 - DNA, 20 bp, Artificial Sequence
  chemically synthesized
ttgagatctctctctctctt

SEQ ID NO: 339446 - DNA, 20 bp, Artificial Sequence
  chemically synthesized
ttattagagctaaagagaga

SEQ ID NO: 339447 - DNA, 20 bp, Artificial Sequence
  chemically synthesized
attagagctaaagagagaga

SEQ ID NO: 339448 - DNA, 20 bp, Artificial Sequence
  chemically synthesized
gagagagagatctcaactca

SEQ ID NO: 339449 - DNA, 20 bp, Artificial Sequence
  chemically synthesized
agagagagatctcaactcaa

SEQ ID NO: 339450 - DNA, 20 bp, Artificial Sequence
  chemically synthesized
ccctactcagcctttgagtt

SEQ ID NO: 339451 - DNA, 20 bp, Artificial Sequence
  chemically synthesized
gagatctcaactcaaaggct

SEQ ID NO: 339452 - DNA, 20 bp, Artificial Sequence
  chemically synthesized
tagtaccctactcagccttt

SEQ ID NO: 339453 - DNA, 20 bp, Artificial Sequence
  chemically synthesized
atctcaactcaaaggctgag

SEQ ID NO: 339454 - DNA, 20 bp, Artificial Sequence
  chemically synthesized
tctcaactcaaaggctgagt

SEQ ID NO: 339455 - DNA, 20 bp, Artificial Sequence
  chemically synthesized
ctcaactcaaaggctgagta

SEQ ID NO: 339456 - DNA, 20 bp, Artificial Sequence
  chemically synthesized
ccaccccctagtaccctact

SEQ ID NO: 339457 - DNA, 20 bp, Artificial Sequence
  chemically synthesized
tcaaaggctgagtagggtac

SEQ ID NO: 339458 - DNA, 20 bp, Artificial Sequence
  chemically synthesized
caaaggctgagtagggtact

SEQ ID NO: 339459 - DNA, 20 bp, Artificial Sequence
  chemically synthesized
aaaggctgagtagggtacta

SEQ ID NO: 339460 - DNA, 20 bp, Artificial Sequence
  chemically synthesized
aaggctgagtagggtactag

SEQ ID NO: 339461 - DNA, 20 bp, Artificial Sequence
  chemically synthesized
aggctgagtagggtactagg

SEQ ID NO: 339462 - DNA, 20 bp, Artificial Sequence
  chemically synthesized
ctgagtagggtactaggggg

SEQ ID NO: 339463 - DNA, 20 bp, Artificial Sequence
  chemically synthesized
gagtagggtactagggggtg

SEQ ID NO: 339464 - DNA, 20 bp, Artificial Sequence
  chemically synthesized
cccagcttacctccaccccc

SEQ ID NO: 339465 - DNA, 20 bp, Artificial Sequence
  chemically synthesized
agtagggtactagggggtgg

SEQ ID NO: 339466 - DNA, 20 bp, Artificial Sequence
  chemically synthesized
gggtactagggggtggaggt

SEQ ID NO: 339467 - DNA, 20 bp, Artificial Sequence
  chemically synthesized
actagggggtggaggtaagc

SEQ ID NO: 339468 - DNA, 20 bp, Artificial Sequence
  chemically synthesized
ctagggggtggaggtaagct

SEQ ID NO: 339469 - DNA, 20 bp, Artificial Sequence
  chemically synthesized
tagggggtggaggtaagctg

SEQ ID NO: 339470 - DNA, 20 bp, Artificial Sequence
  chemically synthesized
gggtggaggtaagctggggt

SEQ ID NO: 339471 - DNA, 20 bp, Artificial Sequence
  chemically synthesized
ttgtacccattaaccaaccc

SEQ ID NO: 339472 - DNA, 20 bp, Artificial Sequence
  chemically synthesized
ggtaagctggggttggttaa

SEQ ID NO: 339473 - DNA, 20 bp, Artificial Sequence
  chemically synthesized
gtaagctggggttggttaat

SEQ ID NO: 339474 - DNA, 20 bp, Artificial Sequence
  chemically synthesized
taatgggtacaaaaattcct

SEQ ID NO: 339475 - DNA, 20 bp, Artificial Sequence
  chemically synthesized
gggtacaaaaattccttaga

SEQ ID NO: 339476 - DNA, 20 bp, Artificial Sequence
  chemically synthesized
actatgttttattctttcta

SEQ ID NO: 339477 - DNA, 20 bp, Artificial Sequence
  chemically synthesized
tactatgttttattctttct

SEQ ID NO: 339478 - DNA, 20 bp, Artificial Sequence
  chemically synthesized
tccttagaaagaataaaaca

SEQ ID NO: 339479 - DNA, 20 bp, Artificial Sequence
  chemically synthesized
gaataaaacatagtatttgc

SEQ ID NO: 339480 - DNA, 20 bp, Artificial Sequence
  chemically synthesized
aaacatagtatttgcgagca

SEQ ID NO: 339481 - DNA, 20 bp, Artificial Sequence
  chemically synthesized
atagtatttgcgagcacagc

SEQ ID NO: 339482 - DNA, 20 bp, Artificial Sequence
  chemically synthesized
tagtatttgcgagcacagca

SEQ ID NO: 339483 - DNA, 20 bp, Artificial Sequence
  chemically synthesized
tacagttaaattattgagta

SEQ ID NO: 339484 - DNA, 20 bp, Artificial Sequence
  chemically synthesized
aaatgtacagttaaattatt

SEQ ID NO: 339485 - DNA, 20 bp, Artificial Sequence
  chemically synthesized
ctgagttattataaaatgta

SEQ ID NO: 339486 - DNA, 20 bp, Artificial Sequence
  chemically synthesized
ctgtacattttataataact

SEQ ID NO: 339487 - DNA, 20 bp, Artificial Sequence
  chemically synthesized
ataaacaatccaatgatact

SEQ ID NO: 339488 - DNA, 20 bp, Artificial Sequence
  chemically synthesized
ttataataactcagtatcat

SEQ ID NO: 339489 - DNA, 20 bp, Artificial Sequence
  chemically synthesized
attggattgtttataacaca

SEQ ID NO: 339490 - DNA, 20 bp, Artificial Sequence
  chemically synthesized
ttggattgtttataacacaa

SEQ ID NO: 339491 - DNA, 20 bp, Artificial Sequence
  chemically synthesized
aacacaaaggataaatgctt

SEQ ID NO: 339492 - DNA, 20 bp, Artificial Sequence
  chemically synthesized
acaaaggataaatgcttgag

SEQ ID NO: 339493 - DNA, 20 bp, Artificial Sequence
  chemically synthesized
aggataaatgcttgagtgga

SEQ ID NO: 339494 - DNA, 20 bp, Artificial Sequence
  chemically synthesized
aatggggtatccatccactc

SEQ ID NO: 339495 - DNA, 20 bp, Artificial Sequence
  chemically synthesized
taataatcacatggagaatg

SEQ ID NO: 339496 - DNA, 20 bp, Artificial Sequence
  chemically synthesized
ataataatcacatggagaat

SEQ ID NO: 339497 - DNA, 20 bp, Artificial Sequence
  chemically synthesized
aataataatcacatggagaa

SEQ ID NO: 339498 - DNA, 20 bp, Artificial Sequence
  chemically synthesized
cagtaaataataatcacatg

SEQ ID NO: 339499 - DNA, 20 bp, Artificial Sequence
  chemically synthesized
tgcagtaaataataatcaca

SEQ ID NO: 339500 - DNA, 20 bp, Artificial Sequence
  chemically synthesized
gatactttgataaaggcatg

SEQ ID NO: 339501 - DNA, 20 bp, Artificial Sequence
  chemically synthesized
tttactgcatgcctttatca

SEQ ID NO: 339502 - DNA, 20 bp, Artificial Sequence
  chemically synthesized
tacatgagatactttgataa

SEQ ID NO: 339503 - DNA, 20 bp, Artificial Sequence
  chemically synthesized
gtacatgagatactttgata

SEQ ID NO: 339504 - DNA, 20 bp, Artificial Sequence
  chemically synthesized
gaaagagagagacagtacat

SEQ ID NO: 339505 - DNA, 20 bp, Artificial Sequence
  chemically synthesized
tatgtatagaaagagagaga

SEQ ID NO: 339506 - DNA, 20 bp, Artificial Sequence
  chemically synthesized
tatatatgtatagaaagaga

SEQ ID NO: 339507 - DNA, 20 bp, Artificial Sequence
  chemically synthesized
tgtatatatgtatagaaaga

SEQ ID NO: 339508 - DNA, 20 bp, Artificial Sequence
  chemically synthesized
tgtgtatatatgtatagaaa

SEQ ID NO: 339509 - DNA, 20 bp, Artificial Sequence
  chemically synthesized
tatgtgtatatatgtataga

SEQ ID NO: 339510 - DNA, 20 bp, Artificial Sequence
  chemically synthesized
tttgtatgtgtatatatgta

SEQ ID NO: 339511 - DNA, 20 bp, Artificial Sequence
  chemically synthesized
tttaaatttttgtgggtaca

SEQ ID NO: 339512 - DNA, 20 bp, Artificial Sequence
  chemically synthesized
ggaattttttaaatttttgt

SEQ ID NO: 339513 - DNA, 20 bp, Artificial Sequence
  chemically synthesized
gggaattttttaaatttttg

SEQ ID NO: 339514 - DNA, 20 bp, Artificial Sequence
  chemically synthesized
aaaaatttaaaaaattcccc

SEQ ID NO: 339515 - DNA, 20 bp, Artificial Sequence
  chemically synthesized
agaaattgcatatattccag

SEQ ID NO: 339516 - DNA, 20 bp, Artificial Sequence
  chemically synthesized
tagaaattgcatatattcca

SEQ ID NO: 339517 - DNA, 20 bp, Artificial Sequence
  chemically synthesized
ttagaaattgcatatattcc

SEQ ID NO: 339518 - DNA, 20 bp, Artificial Sequence
  chemically synthesized
attagaaattgcatatattc

SEQ ID NO: 339519 - DNA, 20 bp, Artificial Sequence
  chemically synthesized
ggaatatatgcaatttctaa

SEQ ID NO: 339520 - DNA, 20 bp, Artificial Sequence
  chemically synthesized
gaatatatgcaatttctaat

SEQ ID NO: 339521 - DNA, 20 bp, Artificial Sequence
  chemically synthesized
agattaagagatatacctat

SEQ ID NO: 339522 - DNA, 20 bp, Artificial Sequence
  chemically synthesized
caaaacattatttagattaa

SEQ ID NO: 339523 - DNA, 20 bp, Artificial Sequence
  chemically synthesized
ttcaaaacattatttagatt

SEQ ID NO: 339524 - DNA, 20 bp, Artificial Sequence
  chemically synthesized
agaatgttcaaaacattatt

SEQ ID NO: 339525 - DNA, 20 bp, Artificial Sequence
  chemically synthesized
tatattggataaaagtatat

SEQ ID NO: 339526 - DNA, 20 bp, Artificial Sequence
  chemically synthesized
gtaacatatatattggataa

SEQ ID NO: 339527 - DNA, 20 bp, Artificial Sequence
  chemically synthesized
taaatttgtaacatatatat

SEQ ID NO: 339528 - DNA, 20 bp, Artificial Sequence
  chemically synthesized
tatatgttacaaatttatta

SEQ ID NO: 339529 - DNA, 20 bp, Artificial Sequence
  chemically synthesized
ttacaaatttattacagctg

SEQ ID NO: 339530 - DNA, 20 bp, Artificial Sequence
  chemically synthesized
ttaagattgcgtagattctt

SEQ ID NO: 339531 - DNA, 20 bp, Artificial Sequence
  chemically synthesized
catagaaagttaagattgcg

SEQ ID NO: 339532 - DNA, 20 bp, Artificial Sequence
  chemically synthesized
cattgcctccatagaaagtt

SEQ ID NO: 339533 - DNA, 20 bp, Artificial Sequence
  chemically synthesized
tacgcaatcttaactttcta

SEQ ID NO: 339534 - DNA, 20 bp, Artificial Sequence
  chemically synthesized
cgcaatcttaactttctatg

SEQ ID NO: 339535 - DNA, 20 bp, Artificial Sequence
  chemically synthesized
gcaatcttaactttctatgg

SEQ ID NO: 339536 - DNA, 20 bp, Artificial Sequence
  chemically synthesized
agtgtcattgcctccataga

SEQ ID NO: 339537 - DNA, 20 bp, Artificial Sequence
  chemically synthesized
tagtagtgtcattgcctcca

SEQ ID NO: 339538 - DNA, 20 bp, Artificial Sequence
  chemically synthesized
gtgtcataaatagtttatag

SEQ ID NO: 339539 - DNA, 20 bp, Artificial Sequence
  chemically synthesized
gcagtgtcataaatagttta

SEQ ID NO: 339540 - DNA, 20 bp, Artificial Sequence
  chemically synthesized
taaccccgcagtgtcataaa

SEQ ID NO: 339541 - DNA, 20 bp, Artificial Sequence
  chemically synthesized
ataaactatttatgacactg

SEQ ID NO: 339542 - DNA, 20 bp, Artificial Sequence
  chemically synthesized
taaactatttatgacactgc

SEQ ID NO: 339543 - DNA, 20 bp, Artificial Sequence
  chemically synthesized
aaactatttatgacactgcg

SEQ ID NO: 339544 - DNA, 20 bp, Artificial Sequence
  chemically synthesized
tatttatgacactgcggggt

SEQ ID NO: 339545 - DNA, 20 bp, Artificial Sequence
  chemically synthesized
gggttgatttgctaaccccg

SEQ ID NO: 339546 - DNA, 20 bp, Artificial Sequence
  chemically synthesized
agaaaatgacatttgttcat

SEQ ID NO: 339547 - DNA, 20 bp, Artificial Sequence
  chemically synthesized
gagaaaatgacatttgttca

SEQ ID NO: 339548 - DNA, 20 bp, Artificial Sequence
  chemically synthesized
aactaataatatgatcaaaa

SEQ ID NO: 339549 - DNA, 20 bp, Artificial Sequence
  chemically synthesized
cgaactaataatatgatcaa

SEQ ID NO: 339550 - DNA, 20 bp, Artificial Sequence
  chemically synthesized
ttctcttttgatcatattat

SEQ ID NO: 339551 - DNA, 20 bp, Artificial Sequence
  chemically synthesized
tgatcatattattagttcga

SEQ ID NO: 339552 - DNA, 20 bp, Artificial Sequence
  chemically synthesized
atattattagttcgatagat

SEQ ID NO: 339553 - DNA, 20 bp, Artificial Sequence
  chemically synthesized
tattattagttcgatagata

SEQ ID NO: 339554 - DNA, 20 bp, Artificial Sequence
  chemically synthesized
ataaggtcatattcacaatg

SEQ ID NO: 339555 - DNA, 20 bp, Artificial Sequence
  chemically synthesized
ttattatgggagacattgat

SEQ ID NO: 339556 - DNA, 20 bp, Artificial Sequence
  chemically synthesized
tgtctgtgaatttattatgg

SEQ ID NO: 339557 - DNA, 20 bp, Artificial Sequence
  chemically synthesized
tttgtctgtgaatttattat

SEQ ID NO: 339558 - DNA, 20 bp, Artificial Sequence
  chemically synthesized
ttttgtctgtgaatttatta

SEQ ID NO: 339559 - DNA, 20 bp, Artificial Sequence
  chemically synthesized
tgtctcccataataaattca

SEQ ID NO: 339560 - DNA, 20 bp, Artificial Sequence
  chemically synthesized
taaaatactatattttagta

SEQ ID NO: 339561 - DNA, 20 bp, Artificial Sequence
  chemically synthesized
tttgaatctgtactaaaata

SEQ ID NO: 339562 - DNA, 20 bp, Artificial Sequence
  chemically synthesized
gtttttaaaatactatattt

SEQ ID NO: 339563 - DNA, 20 bp, Artificial Sequence
  chemically synthesized
gtattttaaaaacacacatg

SEQ ID NO: 339564 - DNA, 20 bp, Artificial Sequence
  chemically synthesized
ttttaaaaacacacatgtgg

SEQ ID NO: 339565 - DNA, 20 bp, Artificial Sequence
  chemically synthesized
ttgccatcactttttggata

SEQ ID NO: 339566 - DNA, 20 bp, Artificial Sequence
  chemically synthesized
ggcagcacaccctatccaaa

SEQ ID NO: 339567 - DNA, 20 bp, Artificial Sequence
  chemically synthesized
tttgccatcactttttggat

SEQ ID NO: 339568 - DNA, 20 bp, Artificial Sequence
  chemically synthesized
atttgccatcactttttgga

SEQ ID NO: 339569 - DNA, 20 bp, Artificial Sequence
  chemically synthesized
ggccatttgccatcactttt

SEQ ID NO: 339570 - DNA, 20 bp, Artificial Sequence
  chemically synthesized
acaccctatccaaaaagtga

SEQ ID NO: 339571 - DNA, 20 bp, Artificial Sequence
  chemically synthesized
atccaaaaagtgatggcaaa

SEQ ID NO: 339572 - DNA, 20 bp, Artificial Sequence
  chemically synthesized
gatggcaaatggccttgtgt

SEQ ID NO: 339573 - DNA, 20 bp, Artificial Sequence
  chemically synthesized
tataactttaaactgacaca

SEQ ID NO: 339574 - DNA, 20 bp, Artificial Sequence
  chemically synthesized
atataactttaaactgacac

SEQ ID NO: 339575 - DNA, 20 bp, Artificial Sequence
  chemically synthesized
aatggccttgtgtcagttta

SEQ ID NO: 339576 - DNA, 20 bp, Artificial Sequence
  chemically synthesized
ttaaagttatatctacttga

SEQ ID NO: 339577 - DNA, 20 bp, Artificial Sequence
  chemically synthesized
agagtcacatgaccatcaag

SEQ ID NO: 339578 - DNA, 20 bp, Artificial Sequence
  chemically synthesized
atgagagtcacatgaccatc

SEQ ID NO: 339579 - DNA, 20 bp, Artificial Sequence
  chemically synthesized
atggtcatgtgactctcatt

SEQ ID NO: 339580 - DNA, 20 bp, Artificial Sequence
  chemically synthesized
ggtggaagcagtccaaatga

SEQ ID NO: 339581 - DNA, 20 bp, Artificial Sequence
  chemically synthesized
ttggtggaagcagtccaaat

SEQ ID NO: 339582 - DNA, 20 bp, Artificial Sequence
  chemically synthesized
caaggtatatttggtggaag

SEQ ID NO: 339583 - DNA, 20 bp, Artificial Sequence
  chemically synthesized
tggcaaggtatatttggtgg

SEQ ID NO: 339584 - DNA, 20 bp, Artificial Sequence
  chemically synthesized
cattggcaaggtatatttgg

SEQ ID NO: 339585 - DNA, 20 bp, Artificial Sequence
  chemically synthesized
gatcattggcaaggtatatt

SEQ ID NO: 339586 - DNA, 20 bp, Artificial Sequence
  chemically synthesized
aagatccaagatcattggca

SEQ ID NO: 339587 - DNA, 20 bp, Artificial Sequence
  chemically synthesized
taagatccaagatcattggc

SEQ ID NO: 339588 - DNA, 20 bp, Artificial Sequence
  chemically synthesized
atataccttgccaatgatct

SEQ ID NO: 339589 - DNA, 20 bp, Artificial Sequence
  chemically synthesized
gccttaagatccaagatcat

SEQ ID NO: 339590 - DNA, 20 bp, Artificial Sequence
  chemically synthesized
tgccaatgatcttggatctt

SEQ ID NO: 339591 - DNA, 20 bp, Artificial Sequence
  chemically synthesized
atttttatgccttaagatcc

SEQ ID NO: 339592 - DNA, 20 bp, Artificial Sequence
  chemically synthesized
gccaatgatcttggatctta

SEQ ID NO: 339593 - DNA, 20 bp, Artificial Sequence
  chemically synthesized
tagctgtatttttatgcctt

SEQ ID NO: 339594 - DNA, 20 bp, Artificial Sequence
  chemically synthesized
gatcttaaggcataaaaata

SEQ ID NO: 339595 - DNA, 20 bp, Artificial Sequence
  chemically synthesized
agtaaaatattttattataa

SEQ ID NO: 339596 - DNA, 20 bp, Artificial Sequence
  chemically synthesized
aataaaatattttactctcc

SEQ ID NO: 339597 - DNA, 20 bp, Artificial Sequence
  chemically synthesized
aaatattttactctcctgga

SEQ ID NO: 339598 - DNA, 20 bp, Artificial Sequence
  chemically synthesized
aaaagctaccctttccagga

SEQ ID NO: 339599 - DNA, 20 bp, Artificial Sequence
  chemically synthesized
aatattttactctcctggaa

SEQ ID NO: 339600 - DNA, 20 bp, Artificial Sequence
  chemically synthesized
atattttactctcctggaaa

SEQ ID NO: 339601 - DNA, 20 bp, Artificial Sequence
  chemically synthesized
gtaaaagctaccctttccag

SEQ ID NO: 339602 - DNA, 20 bp, Artificial Sequence
  chemically synthesized
gagtaaaagctaccctttcc

SEQ ID NO: 339603 - DNA, 20 bp, Artificial Sequence
  chemically synthesized
ttttactctcctggaaaggg

SEQ ID NO: 339604 - DNA, 20 bp, Artificial Sequence
  chemically synthesized
agagtaaaagctaccctttc

SEQ ID NO: 339605 - DNA, 20 bp, Artificial Sequence
  chemically synthesized
aattttattacaaagagtaa

SEQ ID NO: 339606 - DNA, 20 bp, Artificial Sequence
  chemically synthesized
tagctgaattttattacaaa

SEQ ID NO: 339607 - DNA, 20 bp, Artificial Sequence
  chemically synthesized
catagctgaattttattaca

SEQ ID NO: 339608 - DNA, 20 bp, Artificial Sequence
  chemically synthesized
ttactctttgtaataaaatt

SEQ ID NO: 339609 - DNA, 20 bp, Artificial Sequence
  chemically synthesized
tttgtaataaaattcagcta

SEQ ID NO: 339610 - DNA, 20 bp, Artificial Sequence
  chemically synthesized
tattatagctaagacatcca

SEQ ID NO: 339611 - DNA, 20 bp, Artificial Sequence
  chemically synthesized
aaattcagctatggatgtct

SEQ ID NO: 339612 - DNA, 20 bp, Artificial Sequence
  chemically synthesized
gtttcgatattattatagct

SEQ ID NO: 339613 - DNA, 20 bp, Artificial Sequence
  chemically synthesized
tactggtttcgatattatta

SEQ ID NO: 339614 - DNA, 20 bp, Artificial Sequence
  chemically synthesized
agctataataatatcgaaac

SEQ ID NO: 339615 - DNA, 20 bp, Artificial Sequence
  chemically synthesized
ataataatatcgaaaccagt

SEQ ID NO: 339616 - DNA, 20 bp, Artificial Sequence
  chemically synthesized
tctgttaaattttatcttac

SEQ ID NO: 339617 - DNA, 20 bp, Artificial Sequence
  chemically synthesized
accagtaagataaaatttaa

SEQ ID NO: 339618 - DNA, 20 bp, Artificial Sequence
  chemically synthesized
aaatttaacagatcaccttt

SEQ ID NO: 339619 - DNA, 20 bp, Artificial Sequence
  chemically synthesized
aatattaatttcagacttaa

SEQ ID NO: 339620 - DNA, 20 bp, Artificial Sequence
  chemically synthesized
caatattaatttcagactta

SEQ ID NO: 339621 - DNA, 20 bp, Artificial Sequence
  chemically synthesized
gctctttccaatattaattt

SEQ ID NO: 339622 - DNA, 20 bp, Artificial Sequence
  chemically synthesized
tttaagtctgaaattaatat

SEQ ID NO: 339623 - DNA, 20 bp, Artificial Sequence
  chemically synthesized
agtctgaaattaatattgga

SEQ ID NO: 339624 - DNA, 20 bp, Artificial Sequence
  chemically synthesized
tctgaaattaatattggaaa

SEQ ID NO: 339625 - DNA, 20 bp, Artificial Sequence
  chemically synthesized
gaaattaatattggaaagag

SEQ ID NO: 339626 - DNA, 20 bp, Artificial Sequence
  chemically synthesized
atattggaaagagcagttat

SEQ ID NO: 339627 - DNA, 20 bp, Artificial Sequence
  chemically synthesized
tattggaaagagcagttata

SEQ ID NO: 339628 - DNA, 20 bp, Artificial Sequence
  chemically synthesized
gagcagttataaggactgca

SEQ ID NO: 339629 - DNA, 20 bp, Artificial Sequence
  chemically synthesized
agcagttataaggactgcat

SEQ ID NO: 339630 - DNA, 20 bp, Artificial Sequence
  chemically synthesized
aaataatttataaacccatg

SEQ ID NO: 339631 - DNA, 20 bp, Artificial Sequence
  chemically synthesized
atgggtttataaattatttg

SEQ ID NO: 339632 - DNA, 20 bp, Artificial Sequence
  chemically synthesized
tgggtttataaattatttgt

SEQ ID NO: 339633 - DNA, 20 bp, Artificial Sequence
  chemically synthesized
gtttataaattatttgtggg

SEQ ID NO: 339634 - DNA, 20 bp, Artificial Sequence
  chemically synthesized
aatatgtataattatcatgt

SEQ ID NO: 339635 - DNA, 20 bp, Artificial Sequence
  chemically synthesized
atgataattatacatattta

SEQ ID NO: 339636 - DNA, 20 bp, Artificial Sequence
  chemically synthesized
tgataattatacatatttat

SEQ ID NO: 339637 - DNA, 20 bp, Artificial Sequence
  chemically synthesized
gataattatacatatttatg

SEQ ID NO: 339638 - DNA, 20 bp, Artificial Sequence
  chemically synthesized
tgtgtgtagaaacattgtgt

SEQ ID NO: 339639 - DNA, 20 bp, Artificial Sequence
  chemically synthesized
caacacaatgtttctacaca

SEQ ID NO: 339640 - DNA, 20 bp, Artificial Sequence
  chemically synthesized
gcacatccaatgtctgtgtg

SEQ ID NO: 339641 - DNA, 20 bp, Artificial Sequence
  chemically synthesized
atgtttctacacacagacat

SEQ ID NO: 339642 - DNA, 20 bp, Artificial Sequence
  chemically synthesized
gataattaattcagggtaat

SEQ ID NO: 339643 - DNA, 20 bp, Artificial Sequence
  chemically synthesized
aatatgtgataattaattca

SEQ ID NO: 339644 - DNA, 20 bp, Artificial Sequence
  chemically synthesized
gaatatgtgataattaattc

SEQ ID NO: 339645 - DNA, 20 bp, Artificial Sequence
  chemically synthesized
tgaatatgtgataattaatt

SEQ ID NO: 339646 - DNA, 20 bp, Artificial Sequence
  chemically synthesized
aattaattatcacatattca

SEQ ID NO: 339647 - DNA, 20 bp, Artificial Sequence
  chemically synthesized
caaagaaattataaatatat

SEQ ID NO: 339648 - DNA, 20 bp, Artificial Sequence
  chemically synthesized
attataaatatataagatga

SEQ ID NO: 339649 - DNA, 20 bp, Artificial Sequence
  chemically synthesized
aatatataagatgatggatt

SEQ ID NO: 339650 - DNA, 20 bp, Artificial Sequence
  chemically synthesized
gatggattcagatattattt

SEQ ID NO: 339651 - DNA, 20 bp, Artificial Sequence
  chemically synthesized
tcagatattatttgagaatc

SEQ ID NO: 339652 - DNA, 20 bp, Artificial Sequence
  chemically synthesized
cagatattatttgagaatca

SEQ ID NO: 339653 - DNA, 20 bp, Artificial Sequence
  chemically synthesized
aatcaaggcaattcaaattc

SEQ ID NO: 339654 - DNA, 20 bp, Artificial Sequence
  chemically synthesized
atcaaggcaattcaaattct

SEQ ID NO: 339655 - DNA, 20 bp, Artificial Sequence
  chemically synthesized
catctagtaaacgttaggcc

SEQ ID NO: 339656 - DNA, 20 bp, Artificial Sequence
  chemically synthesized
tcctacatctagtaaacgtt

SEQ ID NO: 339657 - DNA, 20 bp, Artificial Sequence
  chemically synthesized
ctcctacatctagtaaacgt

SEQ ID NO: 339658 - DNA, 20 bp, Artificial Sequence
  chemically synthesized
attctaggcctaacgtttac

SEQ ID NO: 339659 - DNA, 20 bp, Artificial Sequence
  chemically synthesized
ggcctaacgtttactagatg

SEQ ID NO: 339660 - DNA, 20 bp, Artificial Sequence
  chemically synthesized
gcctaacgtttactagatgt

SEQ ID NO: 339661 - DNA, 20 bp, Artificial Sequence
  chemically synthesized
ctaacgtttactagatgtag

SEQ ID NO: 339662 - DNA, 20 bp, Artificial Sequence
  chemically synthesized
gtagtcatagctcctacatc

SEQ ID NO: 339663 - DNA, 20 bp, Artificial Sequence
  chemically synthesized
ctttatcgtcatggtagtca

SEQ ID NO: 339664 - DNA, 20 bp, Artificial Sequence
  chemically synthesized
ggtgtcctttatcgtcatgg

SEQ ID NO: 339665 - DNA, 20 bp, Artificial Sequence
  chemically synthesized
tttggtgtcctttatcgtca

SEQ ID NO: 339666 - DNA, 20 bp, Artificial Sequence
  chemically synthesized
ctatgactaccatgacgata

SEQ ID NO: 339667 - DNA, 20 bp, Artificial Sequence
  chemically synthesized
tatgactaccatgacgataa

SEQ ID NO: 339668 - DNA, 20 bp, Artificial Sequence
  chemically synthesized
atgacgataaaggacaccaa

SEQ ID NO: 339669 - DNA, 20 bp, Artificial Sequence
  chemically synthesized
cgataaaggacaccaaaagt

SEQ ID NO: 339670 - DNA, 20 bp, Artificial Sequence
  chemically synthesized
tttattattgggctcacttt

SEQ ID NO: 339671 - DNA, 20 bp, Artificial Sequence
  chemically synthesized
caaaagtgagcccaataata

SEQ ID NO: 339672 - DNA, 20 bp, Artificial Sequence
  chemically synthesized
tacccacagcctttattatt

SEQ ID NO: 339673 - DNA, 20 bp, Artificial Sequence
  chemically synthesized
aaaagtgagcccaataataa

SEQ ID NO: 339674 - DNA, 20 bp, Artificial Sequence
  chemically synthesized
atacccacagcctttattat

SEQ ID NO: 339675 - DNA, 20 bp, Artificial Sequence
  chemically synthesized
gagcccaataataaaggctg

SEQ ID NO: 339676 - DNA, 20 bp, Artificial Sequence
  chemically synthesized
agcccaataataaaggctgt

SEQ ID NO: 339677 - DNA, 20 bp, Artificial Sequence
  chemically synthesized
atctccaagatgaataccca

SEQ ID NO: 339678 - DNA, 20 bp, Artificial Sequence
  chemically synthesized
aaggctgtgggtattcatct

SEQ ID NO: 339679 - DNA, 20 bp, Artificial Sequence
  chemically synthesized
ggctgtgggtattcatcttg

SEQ ID NO: 339680 - DNA, 20 bp, Artificial Sequence
  chemically synthesized
gtgggtattcatcttggaga

SEQ ID NO: 339681 - DNA, 20 bp, Artificial Sequence
  chemically synthesized
tttatgaatctaccatctcc

SEQ ID NO: 339682 - DNA, 20 bp, Artificial Sequence
  chemically synthesized
ggtattcatcttggagatgg

SEQ ID NO: 339683 - DNA, 20 bp, Artificial Sequence
  chemically synthesized
ttggagatggtagattcata

SEQ ID NO: 339684 - DNA, 20 bp, Artificial Sequence
  chemically synthesized
ttcataaagaccttttcaaa

SEQ ID NO: 339685 - DNA, 20 bp, Artificial Sequence
  chemically synthesized
ctgcctttaaccatttgaaa

SEQ ID NO: 339686 - DNA, 20 bp, Artificial Sequence
  chemically synthesized
actgcctttaaccatttgaa

SEQ ID NO: 339687 - DNA, 20 bp, Artificial Sequence
  chemically synthesized
aagaccttttcaaatggtta

SEQ ID NO: 339688 - DNA, 20 bp, Artificial Sequence
  chemically synthesized
agaccttttcaaatggttaa

SEQ ID NO: 339689 - DNA, 20 bp, Artificial Sequence
  chemically synthesized
ccttttcaaatggttaaagg

SEQ ID NO: 339690 - DNA, 20 bp, Artificial Sequence
  chemically synthesized
caaatggttaaaggcagtca

SEQ ID NO: 339691 - DNA, 20 bp, Artificial Sequence
  chemically synthesized
aaaggcagtcatggttcctc

SEQ ID NO: 339692 - DNA, 20 bp, Artificial Sequence
  chemically synthesized
aaggcagtcatggttcctct

SEQ ID NO: 339693 - DNA, 20 bp, Artificial Sequence
  chemically synthesized
ttgattttacttcaacctag

SEQ ID NO: 339694 - DNA, 20 bp, Artificial Sequence
  chemically synthesized
gtcatggttcctctaggttg

SEQ ID NO: 339695 - DNA, 20 bp, Artificial Sequence
  chemically synthesized
attgattttacttcaaccta

SEQ ID NO: 339696 - DNA, 20 bp, Artificial Sequence
  chemically synthesized
acattgattttacttcaacc

SEQ ID NO: 339697 - DNA, 20 bp, Artificial Sequence
  chemically synthesized
atcaatgtgtgaatgttaca

SEQ ID NO: 339698 - DNA, 20 bp, Artificial Sequence
  chemically synthesized
ttgtcacattaaagaagcat

SEQ ID NO: 339699 - DNA, 20 bp, Artificial Sequence
  chemically synthesized
taaaatttgtcacattaaag

SEQ ID NO: 339700 - DNA, 20 bp, Artificial Sequence
  chemically synthesized
gcctaaaatttgtcacatta

SEQ ID NO: 339701 - DNA, 20 bp, Artificial Sequence
  chemically synthesized
ttctttaatgtgacaaattt

SEQ ID NO: 339702 - DNA, 20 bp, Artificial Sequence
  chemically synthesized
tctttaatgtgacaaatttt

SEQ ID NO: 339703 - DNA, 20 bp, Artificial Sequence
  chemically synthesized
ctagtctattataattatta

SEQ ID NO: 339704 - DNA, 20 bp, Artificial Sequence
  chemically synthesized
atcatctttaataattataa

SEQ ID NO: 339705 - DNA, 20 bp, Artificial Sequence
  chemically synthesized
ctttaataattataatagac

SEQ ID NO: 339706 - DNA, 20 bp, Artificial Sequence
  chemically synthesized
gaagcagatcttttttttgc

SEQ ID NO: 339707 - DNA, 20 bp, Artificial Sequence
  chemically synthesized
tataatagactagcaaaaaa

SEQ ID NO: 339708 - DNA, 20 bp, Artificial Sequence
  chemically synthesized
agcaaaaaaaagatctgctt

SEQ ID NO: 339709 - DNA, 20 bp, Artificial Sequence
  chemically synthesized
agttggaagtgtttctgaag

SEQ ID NO: 339710 - DNA, 20 bp, Artificial Sequence
  chemically synthesized
accagttggaagtgtttctg

SEQ ID NO: 339711 - DNA, 20 bp, Artificial Sequence
  chemically synthesized
gcttcagaaacacttccaac

SEQ ID NO: 339712 - DNA, 20 bp, Artificial Sequence
  chemically synthesized
tgaatttttgtaccagttgg

SEQ ID NO: 339713 - DNA, 20 bp, Artificial Sequence
  chemically synthesized
aactgaatttttgtaccagt

SEQ ID NO: 339714 - DNA, 20 bp, Artificial Sequence
  chemically synthesized
cactaactgaatttttgtac

SEQ ID NO: 339715 - DNA, 20 bp, Artificial Sequence
  chemically synthesized
ttccaactggtacaaaaatt

SEQ ID NO: 339716 - DNA, 20 bp, Artificial Sequence
  chemically synthesized
aactggtacaaaaattcagt

SEQ ID NO: 339717 - DNA, 20 bp, Artificial Sequence
  chemically synthesized
aaattcagttagtgaatgca

SEQ ID NO: 339718 - DNA, 20 bp, Artificial Sequence
  chemically synthesized
accttctctagtgcagatta

SEQ ID NO: 339719 - DNA, 20 bp, Artificial Sequence
  chemically synthesized
ttaccttctctagtgcagat

SEQ ID NO: 339720 - DNA, 20 bp, Artificial Sequence
  chemically synthesized
tagatatctctaatctgcac

SEQ ID NO: 339721 - DNA, 20 bp, Artificial Sequence
  chemically synthesized
gatatctctaatctgcacta

SEQ ID NO: 339722 - DNA, 20 bp, Artificial Sequence
  chemically synthesized
gcagattaccttctctagtg

SEQ ID NO: 339723 - DNA, 20 bp, Artificial Sequence
  chemically synthesized
atctctaatctgcactagag

SEQ ID NO: 339724 - DNA, 20 bp, Artificial Sequence
  chemically synthesized
tctctaatctgcactagaga

SEQ ID NO: 339725 - DNA, 20 bp, Artificial Sequence
  chemically synthesized
tctgggcagattaccttctc

SEQ ID NO: 339726 - DNA, 20 bp, Artificial Sequence
  chemically synthesized
actagagaaggtaatctgcc

SEQ ID NO: 339727 - DNA, 20 bp, Artificial Sequence
  chemically synthesized
agaaggtaatctgcccagat

SEQ ID NO: 339728 - DNA, 20 bp, Artificial Sequence
  chemically synthesized
gtaatctaagccaatctggg

SEQ ID NO: 339729 - DNA, 20 bp, Artificial Sequence
  chemically synthesized
tgtgtaatctaagccaatct

SEQ ID NO: 339730 - DNA, 20 bp, Artificial Sequence
  chemically synthesized
atgtgtaatctaagccaatc

SEQ ID NO: 339731 - DNA, 20 bp, Artificial Sequence
  chemically synthesized
gtaatctgcccagattggct

SEQ ID NO: 339732 - DNA, 20 bp, Artificial Sequence
  chemically synthesized
taagacacaatgtgtaatct

SEQ ID NO: 339733 - DNA, 20 bp, Artificial Sequence
  chemically synthesized
gagataatgtgtgcgaacat

SEQ ID NO: 339734 - DNA, 20 bp, Artificial Sequence
  chemically synthesized
gtattttttgaggagcaaat

SEQ ID NO: 339735 - DNA, 20 bp, Artificial Sequence
  chemically synthesized
ctactttagtattttttgag

SEQ ID NO: 339736 - DNA, 20 bp, Artificial Sequence
  chemically synthesized
acctactttagtattttttg

SEQ ID NO: 339737 - DNA, 20 bp, Artificial Sequence
  chemically synthesized
cacctactttagtatttttt

SEQ ID NO: 339738 - DNA, 20 bp, Artificial Sequence
  chemically synthesized
ttgctcctcaaaaaatacta

SEQ ID NO: 339739 - DNA, 20 bp, Artificial Sequence
  chemically synthesized
ctcctcaaaaaatactaaag

SEQ ID NO: 339740 - DNA, 20 bp, Artificial Sequence
  chemically synthesized
tcctcaaaaaatactaaagt

SEQ ID NO: 339741 - DNA, 20 bp, Artificial Sequence
  chemically synthesized
tcaaaaaatactaaagtagg

SEQ ID NO: 339742 - DNA, 20 bp, Artificial Sequence
  chemically synthesized
agttcttgttccacctactt

SEQ ID NO: 339743 - DNA, 20 bp, Artificial Sequence
  chemically synthesized
aatactaaagtaggtggaac

SEQ ID NO: 339744 - DNA, 20 bp, Artificial Sequence
  chemically synthesized
taggtggaacaagaactata

SEQ ID NO: 339745 - DNA, 20 bp, Artificial Sequence
  chemically synthesized
ggtggaacaagaactatata

SEQ ID NO: 339746 - DNA, 20 bp, Artificial Sequence
  chemically synthesized
tcaatgaattcatctctata

SEQ ID NO: 339747 - DNA, 20 bp, Artificial Sequence
  chemically synthesized
tatatagagatgaattcatt

SEQ ID NO: 339748 - DNA, 20 bp, Artificial Sequence
  chemically synthesized
tcgtgaaaccatttttatac

SEQ ID NO: 339749 - DNA, 20 bp, Artificial Sequence
  chemically synthesized
cattgagacttgtataaaaa

SEQ ID NO: 339750 - DNA, 20 bp, Artificial Sequence
  chemically synthesized
ttgtataaaaatggtttcac

SEQ ID NO: 339751 - DNA, 20 bp, Artificial Sequence
  chemically synthesized
aatggtttcacgagaccatt

SEQ ID NO: 339752 - DNA, 20 bp, Artificial Sequence
  chemically synthesized
ctgctctgttataaactcaa

SEQ ID NO: 339753 - DNA, 20 bp, Artificial Sequence
  chemically synthesized
cgagaccattgagtttataa

SEQ ID NO: 339754 - DNA, 20 bp, Artificial Sequence
  chemically synthesized
agaccattgagtttataaca

SEQ ID NO: 339755 - DNA, 20 bp, Artificial Sequence
  chemically synthesized
ccattgagtttataacagag

SEQ ID NO: 339756 - DNA, 20 bp, Artificial Sequence
  chemically synthesized
tgaacattaatcagaattta

SEQ ID NO: 339757 - DNA, 20 bp, Artificial Sequence
  chemically synthesized
cttgaacattaatcagaatt

SEQ ID NO: 339758 - DNA, 20 bp, Artificial Sequence
  chemically synthesized
tcagttgcttgaacattaat

SEQ ID NO: 339759 - DNA, 20 bp, Artificial Sequence
  chemically synthesized
ctaaattctgattaatgttc

SEQ ID NO: 339760 - DNA, 20 bp, Artificial Sequence
  chemically synthesized
ttaatgttcaagcaactgac

SEQ ID NO: 339761 - DNA, 20 bp, Artificial Sequence
  chemically synthesized
aatttagaaggtggtctagt

SEQ ID NO: 339762 - DNA, 20 bp, Artificial Sequence
  chemically synthesized
aatgaatttagaaggtggtc

SEQ ID NO: 339763 - DNA, 20 bp, Artificial Sequence
  chemically synthesized
tagtaaatgaatttagaagg

SEQ ID NO: 339764 - DNA, 20 bp, Artificial Sequence
  chemically synthesized
ctctagtaaatgaatttaga

SEQ ID NO: 339765 - DNA, 20 bp, Artificial Sequence
  chemically synthesized
actctagtaaatgaatttag

SEQ ID NO: 339766 - DNA, 20 bp, Artificial Sequence
  chemically synthesized
aggactctagtaaatgaatt

SEQ ID NO: 339767 - DNA, 20 bp, Artificial Sequence
  chemically synthesized
caccttctaaattcatttac

SEQ ID NO: 339768 - DNA, 20 bp, Artificial Sequence
  chemically synthesized
ccttctaaattcatttacta

SEQ ID NO: 339769 - DNA, 20 bp, Artificial Sequence
  chemically synthesized
tagaggtgtaagcaggactc

SEQ ID NO: 339770 - DNA, 20 bp, Artificial Sequence
  chemically synthesized
gtgattatagaggtgtaagc

SEQ ID NO: 339771 - DNA, 20 bp, Artificial Sequence
  chemically synthesized
ggtgattatagaggtgtaag

SEQ ID NO: 339772 - DNA, 20 bp, Artificial Sequence
  chemically synthesized
taaggtgattatagaggtgt

SEQ ID NO: 339773 - DNA, 20 bp, Artificial Sequence
  chemically synthesized
attaattaaggtgattatag

SEQ ID NO: 339774 - DNA, 20 bp, Artificial Sequence
  chemically synthesized
aattaattaaggtgattata

SEQ ID NO: 339775 - DNA, 20 bp, Artificial Sequence
  chemically synthesized
aaaattaattaaggtgatta

SEQ ID NO: 339776 - DNA, 20 bp, Artificial Sequence
  chemically synthesized
tgatatagaaaaattaatta

SEQ ID NO: 339777 - DNA, 20 bp, Artificial Sequence
  chemically synthesized
ctgatatagaaaaattaatt

SEQ ID NO: 339778 - DNA, 20 bp, Artificial Sequence
  chemically synthesized
cttaattaatttttctatat

SEQ ID NO: 339779 - DNA, 20 bp, Artificial Sequence
  chemically synthesized
ttaattaatttttctatatc

SEQ ID NO: 339780 - DNA, 20 bp, Artificial Sequence
  chemically synthesized
atgcaagcagaggcctgata

SEQ ID NO: 339781 - DNA, 20 bp, Artificial Sequence
  chemically synthesized
aataatatcaatgcaagcag

SEQ ID NO: 339782 - DNA, 20 bp, Artificial Sequence
  chemically synthesized
caataatatcaatgcaagca

SEQ ID NO: 339783 - DNA, 20 bp, Artificial Sequence
  chemically synthesized
accaataatatcaatgcaag

SEQ ID NO: 339784 - DNA, 20 bp, Artificial Sequence
  chemically synthesized
gggaccaataatatcaatgc

SEQ ID NO: 339785 - DNA, 20 bp, Artificial Sequence
  chemically synthesized
tctgcttgcattgatattat

SEQ ID NO: 339786 - DNA, 20 bp, Artificial Sequence
  chemically synthesized
attgatattattggtccctt

SEQ ID NO: 339787 - DNA, 20 bp, Artificial Sequence
  chemically synthesized
gtattttattattcactgaa

SEQ ID NO: 339788 - DNA, 20 bp, Artificial Sequence
  chemically synthesized
agtattttattattcactga

SEQ ID NO: 339789 - DNA, 20 bp, Artificial Sequence
  chemically synthesized
aagtattttattattcactg

SEQ ID NO: 339790 - DNA, 20 bp, Artificial Sequence
  chemically synthesized
aaattcagcataggaacgtc

SEQ ID NO: 339791 - DNA, 20 bp, Artificial Sequence
  chemically synthesized
tggttctaaaaattcagcat

SEQ ID NO: 339792 - DNA, 20 bp, Artificial Sequence
  chemically synthesized
ttggttctaaaaattcagca

SEQ ID NO: 339793 - DNA, 20 bp, Artificial Sequence
  chemically synthesized
acgttcctatgctgaatttt

SEQ ID NO: 339794 - DNA, 20 bp, Artificial Sequence
  chemically synthesized
aaatattggttctaaaaatt

SEQ ID NO: 339795 - DNA, 20 bp, Artificial Sequence
  chemically synthesized
atattttcctaaggaaatat

SEQ ID NO: 339796 - DNA, 20 bp, Artificial Sequence
  chemically synthesized
ttttagaaccaatatttcct

SEQ ID NO: 339797 - DNA, 20 bp, Artificial Sequence
  chemically synthesized
tttagaaccaatatttcctt

SEQ ID NO: 339798 - DNA, 20 bp, Artificial Sequence
  chemically synthesized
tgtttccggatattttccta

SEQ ID NO: 339799 - DNA, 20 bp, Artificial Sequence
  chemically synthesized
atgtttccggatattttcct

SEQ ID NO: 339800 - DNA, 20 bp, Artificial Sequence
  chemically synthesized
tatttccttaggaaaatatc

SEQ ID NO: 339801 - DNA, 20 bp, Artificial Sequence
  chemically synthesized
aattaggaaagtcatgtttc

SEQ ID NO: 339802 - DNA, 20 bp, Artificial Sequence
  chemically synthesized
acatgtatcctaaattagga

SEQ ID NO: 339803 - DNA, 20 bp, Artificial Sequence
  chemically synthesized
gaaacatgactttcctaatt

SEQ ID NO: 339804 - DNA, 20 bp, Artificial Sequence
  chemically synthesized
aaacatgactttcctaattt

SEQ ID NO: 339805 - DNA, 20 bp, Artificial Sequence
  chemically synthesized
agtaacatgtatcctaaatt

SEQ ID NO: 339806 - DNA, 20 bp, Artificial Sequence
  chemically synthesized
cagtaacatgtatcctaaat

SEQ ID NO: 339807 - DNA, 20 bp, Artificial Sequence
  chemically synthesized
acacatttgttgttatgacg

SEQ ID NO: 339808 - DNA, 20 bp, Artificial Sequence
  chemically synthesized
cataacaacaaatgtgttaa

SEQ ID NO: 339809 - DNA, 20 bp, Artificial Sequence
  chemically synthesized
atagaaacctttatatttaa

SEQ ID NO: 339810 - DNA, 20 bp, Artificial Sequence
  chemically synthesized
atgattttctcttaaatata

SEQ ID NO: 339811 - DNA, 20 bp, Artificial Sequence
  chemically synthesized
tcatagaaacctttatattt

SEQ ID NO: 339812 - DNA, 20 bp, Artificial Sequence
  chemically synthesized
tgattttctcttaaatataa

SEQ ID NO: 339813 - DNA, 20 bp, Artificial Sequence
  chemically synthesized
atgtgtgtatatatacatca

SEQ ID NO: 339814 - DNA, 20 bp, Artificial Sequence
  chemically synthesized
acatacacacatatacatat

SEQ ID NO: 339815 - DNA, 20 bp, Artificial Sequence
  chemically synthesized
tgaattggaatatattttaa

SEQ ID NO: 339816 - DNA, 20 bp, Artificial Sequence
  chemically synthesized
gtgaattggaatatatttta

SEQ ID NO: 339817 - DNA, 20 bp, Artificial Sequence
  chemically synthesized
tttggtaaataaaagtgaat

SEQ ID NO: 339818 - DNA, 20 bp, Artificial Sequence
  chemically synthesized
cagtctaatttggtaaataa

SEQ ID NO: 339819 - DNA, 20 bp, Artificial Sequence
  chemically synthesized
ttcacttttatttaccaaat

SEQ ID NO: 339820 - DNA, 20 bp, Artificial Sequence
  chemically synthesized
tgttttacagcagtctaatt

SEQ ID NO: 339821 - DNA, 20 bp, Artificial Sequence
  chemically synthesized
ctagtaatcatgttttacag

SEQ ID NO: 339822 - DNA, 20 bp, Artificial Sequence
  chemically synthesized
tttctagtaatcatgtttta

SEQ ID NO: 339823 - DNA, 20 bp, Artificial Sequence
  chemically synthesized
ctgctgtaaaacatgattac

SEQ ID NO: 339824 - DNA, 20 bp, Artificial Sequence
  chemically synthesized
gttttgtgtggtacattttc

SEQ ID NO: 339825 - DNA, 20 bp, Artificial Sequence
  chemically synthesized
agagtgatcagagttttgtg

SEQ ID NO: 339826 - DNA, 20 bp, Artificial Sequence
  chemically synthesized
aagtatgatcagagtgatca

SEQ ID NO: 339827 - DNA, 20 bp, Artificial Sequence
  chemically synthesized
aaaagtatgatcagagtgat

SEQ ID NO: 339828 - DNA, 20 bp, Artificial Sequence
  chemically synthesized
taaaaacaaaagtatgatca

SEQ ID NO: 339829 - DNA, 20 bp, Artificial Sequence
  chemically synthesized
attaaaaacaaaagtatgat

SEQ ID NO: 339830 - DNA, 20 bp, Artificial Sequence
  chemically synthesized
aaaagttaaattaaaaacaa

SEQ ID NO: 339831 - DNA, 20 bp, Artificial Sequence
  chemically synthesized
tggagattaaattacaaaaa

SEQ ID NO: 339832 - DNA, 20 bp, Artificial Sequence
  chemically synthesized
tttttgtaatttaatctcca

SEQ ID NO: 339833 - DNA, 20 bp, Artificial Sequence
  chemically synthesized
aatgccctttataaactatg

SEQ ID NO: 339834 - DNA, 20 bp, Artificial Sequence
  chemically synthesized
gtaatgccctttataaacta

SEQ ID NO: 339835 - DNA, 20 bp, Artificial Sequence
  chemically synthesized
tttaatctccatagtttata

SEQ ID NO: 339836 - DNA, 20 bp, Artificial Sequence
  chemically synthesized
ttaatctccatagtttataa

SEQ ID NO: 339837 - DNA, 20 bp, Artificial Sequence
  chemically synthesized
taatctccatagtttataaa

SEQ ID NO: 339838 - DNA, 20 bp, Artificial Sequence
  chemically synthesized
taaagggcattactgcttgt

SEQ ID NO: 339839 - DNA, 20 bp, Artificial Sequence
  chemically synthesized
aaagggcattactgcttgtc

SEQ ID NO: 339840 - DNA, 20 bp, Artificial Sequence
  chemically synthesized
gctcattttttcctgacaag

SEQ ID NO: 339841 - DNA, 20 bp, Artificial Sequence
  chemically synthesized
caagctcattttttcctgac

SEQ ID NO: 339842 - DNA, 20 bp, Artificial Sequence
  chemically synthesized
actgcttgtcaggaaaaaat

SEQ ID NO: 339843 - DNA, 20 bp, Artificial Sequence
  chemically synthesized
tacacacagctgagaaatac

SEQ ID NO: 339844 - DNA, 20 bp, Artificial Sequence
  chemically synthesized
aaaaatgagcttgtatttct

SEQ ID NO: 339845 - DNA, 20 bp, Artificial Sequence
  chemically synthesized
catgtaatttacacacagct

SEQ ID NO: 339846 - DNA, 20 bp, Artificial Sequence
  chemically synthesized
aaatgcatgtaatttacaca

SEQ ID NO: 339847 - DNA, 20 bp, Artificial Sequence
  chemically synthesized
tacatgcattttatattttt

SEQ ID NO: 339848 - DNA, 20 bp, Artificial Sequence
  chemically synthesized
acatgcattttatatttttt

SEQ ID NO: 339849 - DNA, 20 bp, Artificial Sequence
  chemically synthesized
gcattttatattttttaggc

SEQ ID NO: 339850 - DNA, 20 bp, Artificial Sequence
  chemically synthesized
cattttatattttttaggca

SEQ ID NO: 339851 - DNA, 20 bp, Artificial Sequence
  chemically synthesized
ctgaaaatattgattgatag

SEQ ID NO: 339852 - DNA, 20 bp, Artificial Sequence
  chemically synthesized
tctgaaaatattgattgata

SEQ ID NO: 339853 - DNA, 20 bp, Artificial Sequence
  chemically synthesized
tttctgaaaatattgattga

SEQ ID NO: 339854 - DNA, 20 bp, Artificial Sequence
  chemically synthesized
cctctatcaatcaatatttt

SEQ ID NO: 339855 - DNA, 20 bp, Artificial Sequence
  chemically synthesized
tttcagaaaatgacactcct

SEQ ID NO: 339856 - DNA, 20 bp, Artificial Sequence
  chemically synthesized
agaaaatgacactcctcagt

SEQ ID NO: 339857 - DNA, 20 bp, Artificial Sequence
  chemically synthesized
gaaaatgacactcctcagtt

SEQ ID NO: 339858 - DNA, 20 bp, Artificial Sequence
  chemically synthesized
acaatccctgcctaactgag

SEQ ID NO: 339859 - DNA, 20 bp, Artificial Sequence
  chemically synthesized
taacaatccctgcctaactg

SEQ ID NO: 339860 - DNA, 20 bp, Artificial Sequence
  chemically synthesized
aatgacactcctcagttagg

SEQ ID NO: 339861 - DNA, 20 bp, Artificial Sequence
  chemically synthesized
gtaacaatccctgcctaact

SEQ ID NO: 339862 - DNA, 20 bp, Artificial Sequence
  chemically synthesized
atgacactcctcagttaggc

SEQ ID NO: 339863 - DNA, 20 bp, Artificial Sequence
  chemically synthesized
tgacactcctcagttaggca

SEQ ID NO: 339864 - DNA, 20 bp, Artificial Sequence
  chemically synthesized
ttaggcagggattgttactg

SEQ ID NO: 339865 - DNA, 20 bp, Artificial Sequence
  chemically synthesized
gagtaaacatttatcagctt

SEQ ID NO: 339866 - DNA, 20 bp, Artificial Sequence
  chemically synthesized
aatgaagagtaaacatttat

SEQ ID NO: 339867 - DNA, 20 bp, Artificial Sequence
  chemically synthesized
gataaatgtttactcttcat

SEQ ID NO: 339868 - DNA, 20 bp, Artificial Sequence
  chemically synthesized
taaatgtttactcttcattg

SEQ ID NO: 339869 - DNA, 20 bp, Artificial Sequence
  chemically synthesized
atttgtcagtctccaatgaa

SEQ ID NO: 339870 - DNA, 20 bp, Artificial Sequence
  chemically synthesized
ctatttgtcagtctccaatg

SEQ ID NO: 339871 - DNA, 20 bp, Artificial Sequence
  chemically synthesized
cttcattggagactgacaaa

SEQ ID NO: 339872 - DNA, 20 bp, Artificial Sequence
  chemically synthesized
ctatgtcatatgctatttgt

SEQ ID NO: 339873 - DNA, 20 bp, Artificial Sequence
  chemically synthesized
ctgacaaatagcatatgaca

SEQ ID NO: 339874 - DNA, 20 bp, Artificial Sequence
  chemically synthesized
gcagtgtaagagcataagag

SEQ ID NO: 339875 - DNA, 20 bp, Artificial Sequence
  chemically synthesized
caagcagtgtaagagcataa

SEQ ID NO: 339876 - DNA, 20 bp, Artificial Sequence
  chemically synthesized
tacaagcagtgtaagagcat

SEQ ID NO: 339877 - DNA, 20 bp, Artificial Sequence
  chemically synthesized
ttttagtacaagcagtgtaa

SEQ ID NO: 339878 - DNA, 20 bp, Artificial Sequence
  chemically synthesized
agttttagtacaagcagtgt

SEQ ID NO: 339879 - DNA, 20 bp, Artificial Sequence
  chemically synthesized
tagacaagttttagtacaag

SEQ ID NO: 339880 - DNA, 20 bp, Artificial Sequence
  chemically synthesized
ttctagacaagttttagtac

SEQ ID NO: 339881 - DNA, 20 bp, Artificial Sequence
  chemically synthesized
ttatatttctagacaagttt

SEQ ID NO: 339882 - DNA, 20 bp, Artificial Sequence
  chemically synthesized
tgcttgtactaaaacttgtc

SEQ ID NO: 339883 - DNA, 20 bp, Artificial Sequence
  chemically synthesized
tgaattttatatttctagac

SEQ ID NO: 339884 - DNA, 20 bp, Artificial Sequence
  chemically synthesized
atttttgaattttatatttc

SEQ ID NO: 339885 - DNA, 20 bp, Artificial Sequence
  chemically synthesized
cctaacaagaaatttgaaag

SEQ ID NO: 339886 - DNA, 20 bp, Artificial Sequence
  chemically synthesized
cttcctaacaagaaatttga

SEQ ID NO: 339887 - DNA, 20 bp, Artificial Sequence
  chemically synthesized
actgctttcaaatttcttgt

SEQ ID NO: 339888 - DNA, 20 bp, Artificial Sequence
  chemically synthesized
ctgctttcaaatttcttgtt

SEQ ID NO: 339889 - DNA, 20 bp, Artificial Sequence
  chemically synthesized
ctttcaaatttcttgttagg

SEQ ID NO: 339890 - DNA, 20 bp, Artificial Sequence
  chemically synthesized
tgtctggcaagcttcctaac

SEQ ID NO: 339891 - DNA, 20 bp, Artificial Sequence
  chemically synthesized
tttcttgttaggaagcttgc

SEQ ID NO: 339892 - DNA, 20 bp, Artificial Sequence
  chemically synthesized
gttactctggagtgtctggc

SEQ ID NO: 339893 - DNA, 20 bp, Artificial Sequence
  chemically synthesized
aggaagcttgccagacactc

SEQ ID NO: 339894 - DNA, 20 bp, Artificial Sequence
  chemically synthesized
aaatgttactctggagtgtc

SEQ ID NO: 339895 - DNA, 20 bp, Artificial Sequence
  chemically synthesized
gaagcttgccagacactcca

SEQ ID NO: 339896 - DNA, 20 bp, Artificial Sequence
  chemically synthesized
cttcacaaaatgttactctg

SEQ ID NO: 339897 - DNA, 20 bp, Artificial Sequence
  chemically synthesized
tgcttcacaaaatgttactc

SEQ ID NO: 339898 - DNA, 20 bp, Artificial Sequence
  chemically synthesized
ctccagagtaacattttgtg

SEQ ID NO: 339899 - DNA, 20 bp, Artificial Sequence
  chemically synthesized
agagtaacattttgtgaagc

SEQ ID NO: 339900 - DNA, 20 bp, Artificial Sequence
  chemically synthesized
taacattttgtgaagcaagt

SEQ ID NO: 339901 - DNA, 20 bp, Artificial Sequence
  chemically synthesized
caagtcagtattacacgcat

SEQ ID NO: 339902 - DNA, 20 bp, Artificial Sequence
  chemically synthesized
attacacgcataagtaaatg

SEQ ID NO: 339903 - DNA, 20 bp, Artificial Sequence
  chemically synthesized
acacgcataagtaaatgaag

SEQ ID NO: 339904 - DNA, 20 bp, Artificial Sequence
  chemically synthesized
acgcataagtaaatgaagta

SEQ ID NO: 339905 - DNA, 20 bp, Artificial Sequence
  chemically synthesized
tttgcctgtattacaacatt

SEQ ID NO: 339906 - DNA, 20 bp, Artificial Sequence
  chemically synthesized
ttttgcctgtattacaacat

SEQ ID NO: 339907 - DNA, 20 bp, Artificial Sequence
  chemically synthesized
tacaacccaatgttgtaata

SEQ ID NO: 339908 - DNA, 20 bp, Artificial Sequence
  chemically synthesized
acaacccaatgttgtaatac

SEQ ID NO: 339909 - DNA, 20 bp, Artificial Sequence
  chemically synthesized
tttttaaatgatcaccatgt

SEQ ID NO: 339910 - DNA, 20 bp, Artificial Sequence
  chemically synthesized
ttttaaatgatcaccatgtg

SEQ ID NO: 339911 - DNA, 20 bp, Artificial Sequence
  chemically synthesized
atttgaatatagacctcaca

SEQ ID NO: 339912 - DNA, 20 bp, Artificial Sequence
  chemically synthesized
tatgaaaagacatttgaata

SEQ ID NO: 339913 - DNA, 20 bp, Artificial Sequence
  chemically synthesized
gcctggactccatttatgaa

SEQ ID NO: 339914 - DNA, 20 bp, Artificial Sequence
  chemically synthesized
ttcaaatgtcttttcataaa

SEQ ID NO: 339915 - DNA, 20 bp, Artificial Sequence
  chemically synthesized
caaatgtcttttcataaatg

SEQ ID NO: 339916 - DNA, 20 bp, Artificial Sequence
  chemically synthesized
gtcttttcataaatggagtc

SEQ ID NO: 339917 - DNA, 20 bp, Artificial Sequence
  chemically synthesized
tcttttcataaatggagtcc

SEQ ID NO: 339918 - DNA, 20 bp, Artificial Sequence
  chemically synthesized
gataaactacaaagagtgcc

SEQ ID NO: 339919 - DNA, 20 bp, Artificial Sequence
  chemically synthesized
tggagtccaggcactctttg

SEQ ID NO: 339920 - DNA, 20 bp, Artificial Sequence
  chemically synthesized
tgctcttgataaactacaaa

SEQ ID NO: 339921 - DNA, 20 bp, Artificial Sequence
  chemically synthesized
cctgctcttgataaactaca

SEQ ID NO: 339922 - DNA, 20 bp, Artificial Sequence
  chemically synthesized
ggcactctttgtagtttatc

SEQ ID NO: 339923 - DNA, 20 bp, Artificial Sequence
  chemically synthesized
cactctttgtagtttatcaa

SEQ ID NO: 339924 - DNA, 20 bp, Artificial Sequence
  chemically synthesized
tctttgtagtttatcaagag

SEQ ID NO: 339925 - DNA, 20 bp, Artificial Sequence
  chemically synthesized
ctttgtagtttatcaagagc

SEQ ID NO: 339926 - DNA, 20 bp, Artificial Sequence
  chemically synthesized
tttatcaagagcaggtttaa

SEQ ID NO: 339927 - DNA, 20 bp, Artificial Sequence
  chemically synthesized
atcaagagcaggtttaacag

SEQ ID NO: 339928 - DNA, 20 bp, Artificial Sequence
  chemically synthesized
aagagcaggtttaacagcag

SEQ ID NO: 339929 - DNA, 20 bp, Artificial Sequence
  chemically synthesized
taacagcagtagtttccaca

SEQ ID NO: 339930 - DNA, 20 bp, Artificial Sequence
  chemically synthesized
cagcagtagtttccacaaag

SEQ ID NO: 339931 - DNA, 20 bp, Artificial Sequence
  chemically synthesized
agcagtagtttccacaaagc

SEQ ID NO: 339932 - DNA, 20 bp, Artificial Sequence
  chemically synthesized
aatgacttcagcctgctttg

SEQ ID NO: 339933 - DNA, 20 bp, Artificial Sequence
  chemically synthesized
agtttccacaaagcaggctg

SEQ ID NO: 339934 - DNA, 20 bp, Artificial Sequence
  chemically synthesized
agccatggattaaatgactt

SEQ ID NO: 339935 - DNA, 20 bp, Artificial Sequence
  chemically synthesized
ggctgaagtcatttaatcca

SEQ ID NO: 339936 - DNA, 20 bp, Artificial Sequence
  chemically synthesized
ctgcgtataaaaagcagcca

SEQ ID NO: 339937 - DNA, 20 bp, Artificial Sequence
  chemically synthesized
aagcagctgcgtataaaaag

SEQ ID NO: 339938 - DNA, 20 bp, Artificial Sequence
  chemically synthesized
ataaagcagctgcgtataaa

SEQ ID NO: 339939 - DNA, 20 bp, Artificial Sequence
  chemically synthesized
ccatggctgctttttatacg

SEQ ID NO: 339940 - DNA, 20 bp, Artificial Sequence
  chemically synthesized
ctctctaagctcaaataaag

SEQ ID NO: 339941 - DNA, 20 bp, Artificial Sequence
  chemically synthesized
tatacgcagctgctttattt

SEQ ID NO: 339942 - DNA, 20 bp, Artificial Sequence
  chemically synthesized
ctcctctctaagctcaaata

SEQ ID NO: 339943 - DNA, 20 bp, Artificial Sequence
  chemically synthesized
gcagctgctttatttgagct

SEQ ID NO: 339944 - DNA, 20 bp, Artificial Sequence
  chemically synthesized
agctgctttatttgagctta

SEQ ID NO: 339945 - DNA, 20 bp, Artificial Sequence
  chemically synthesized
ctgctttatttgagcttaga

SEQ ID NO: 339946 - DNA, 20 bp, Artificial Sequence
  chemically synthesized
tgctttatttgagcttagag

SEQ ID NO: 339947 - DNA, 20 bp, Artificial Sequence
  chemically synthesized
ctttatttgagcttagagag

SEQ ID NO: 339948 - DNA, 20 bp, Artificial Sequence
  chemically synthesized
tatgtggtctactcctctct

SEQ ID NO: 339949 - DNA, 20 bp, Artificial Sequence
  chemically synthesized
tatttgagcttagagaggag

SEQ ID NO: 339950 - DNA, 20 bp, Artificial Sequence
  chemically synthesized
atattaacatgacatttatg

SEQ ID NO: 339951 - DNA, 20 bp, Artificial Sequence
  chemically synthesized
aatgtcatgttaatattcta

SEQ ID NO: 339952 - DNA, 20 bp, Artificial Sequence
  chemically synthesized
tcatgttaatattctaaagt

SEQ ID NO: 339953 - DNA, 20 bp, Artificial Sequence
  chemically synthesized
taacacaatttaactcactt

SEQ ID NO: 339954 - DNA, 20 bp, Artificial Sequence
  chemically synthesized
taaagtgagttaaattgtgt

SEQ ID NO: 339955 - DNA, 20 bp, Artificial Sequence
  chemically synthesized
gttaaattgtgttagcaaca

SEQ ID NO: 339956 - DNA, 20 bp, Artificial Sequence
  chemically synthesized
agcaacaaagcttgtcttat

SEQ ID NO: 339957 - DNA, 20 bp, Artificial Sequence
  chemically synthesized
ggtgaaatgtctgataagac

SEQ ID NO: 339958 - DNA, 20 bp, Artificial Sequence
  chemically synthesized
gccaaggtgaaatgtctgat

SEQ ID NO: 339959 - DNA, 20 bp, Artificial Sequence
  chemically synthesized
tcttatcagacatttcacct

SEQ ID NO: 339960 - DNA, 20 bp, Artificial Sequence
  chemically synthesized
tcacattttctcataggcca

SEQ ID NO: 339961 - DNA, 20 bp, Artificial Sequence
  chemically synthesized
gacatttcaccttggcctat

SEQ ID NO: 339962 - DNA, 20 bp, Artificial Sequence
  chemically synthesized
atcacattttctcataggcc

SEQ ID NO: 339963 - DNA, 20 bp, Artificial Sequence
  chemically synthesized
taactatcacattttctcat

SEQ ID NO: 339964 - DNA, 20 bp, Artificial Sequence
  chemically synthesized
ataactatcacattttctca

SEQ ID NO: 339965 - DNA, 20 bp, Artificial Sequence
  chemically synthesized
tggcctatgagaaaatgtga

SEQ ID NO: 339966 - DNA, 20 bp, Artificial Sequence
  chemically synthesized
atgagaaaatgtgatagtta

SEQ ID NO: 339967 - DNA, 20 bp, Artificial Sequence
  chemically synthesized
tggtattaattgatattaat

SEQ ID NO: 339968 - DNA, 20 bp, Artificial Sequence
  chemically synthesized
attaattgatattaatcagt

SEQ ID NO: 339969 - DNA, 20 bp, Artificial Sequence
  chemically synthesized
ttaattgatattaatcagta

SEQ ID NO: 339970 - DNA, 20 bp, Artificial Sequence
  chemically synthesized
attgatattaatcagtaagg

SEQ ID NO: 339971 - DNA, 20 bp, Artificial Sequence
  chemically synthesized
atcagtaaggcagatatctt

SEQ ID NO: 339972 - DNA, 20 bp, Artificial Sequence
  chemically synthesized
tcagtaaggcagatatcttt

SEQ ID NO: 339973 - DNA, 20 bp, Artificial Sequence
  chemically synthesized
ttctatgcattatattccca

SEQ ID NO: 339974 - DNA, 20 bp, Artificial Sequence
  chemically synthesized
atctttgggaatataatgca

SEQ ID NO: 339975 - DNA, 20 bp, Artificial Sequence
  chemically synthesized
ggaatataatgcatagaaaa

SEQ ID NO: 339976 - DNA, 20 bp, Artificial Sequence
  chemically synthesized
aatacaggaagaagaagagg

SEQ ID NO: 339977 - DNA, 20 bp, Artificial Sequence
  chemically synthesized
aaaaatacaggaagaagaag

SEQ ID NO: 339978 - DNA, 20 bp, Artificial Sequence
  chemically synthesized
aaaaaatacaggaagaagaa

SEQ ID NO: 339979 - DNA, 20 bp, Artificial Sequence
  chemically synthesized
caaaaaaatacaggaagaag

SEQ ID NO: 339980 - DNA, 20 bp, Artificial Sequence
  chemically synthesized
attcaaaaaaatacaggaag

SEQ ID NO: 339981 - DNA, 20 bp, Artificial Sequence
  chemically synthesized
gagattcaaaaaaatacagg

SEQ ID NO: 339982 - DNA, 20 bp, Artificial Sequence
  chemically synthesized
caagagattcaaaaaaatac

SEQ ID NO: 339983 - DNA, 20 bp, Artificial Sequence
  chemically synthesized
ccaagagattcaaaaaaata

SEQ ID NO: 339984 - DNA, 20 bp, Artificial Sequence
  chemically synthesized
ctgtatttttttgaatctct

SEQ ID NO: 339985 - DNA, 20 bp, Artificial Sequence
  chemically synthesized
ttttttgaatctcttggctt

SEQ ID NO: 339986 - DNA, 20 bp, Artificial Sequence
  chemically synthesized
gaagttctcactgaagccaa

SEQ ID NO: 339987 - DNA, 20 bp, Artificial Sequence
  chemically synthesized
aggaagttctcactgaagcc

SEQ ID NO: 339988 - DNA, 20 bp, Artificial Sequence
  chemically synthesized
ttgaatctcttggcttcagt

SEQ ID NO: 339989 - DNA, 20 bp, Artificial Sequence
  chemically synthesized
ccaacaggaagttctcactg

SEQ ID NO: 339990 - DNA, 20 bp, Artificial Sequence
  chemically synthesized
cttcagtgagaacttcctgt

SEQ ID NO: 339991 - DNA, 20 bp, Artificial Sequence
  chemically synthesized
ataagaataaatccaacagg

SEQ ID NO: 339992 - DNA, 20 bp, Artificial Sequence
  chemically synthesized
aagataagaataaatccaac

SEQ ID NO: 339993 - DNA, 20 bp, Artificial Sequence
  chemically synthesized
aaagataagaataaatccaa

SEQ ID NO: 339994 - DNA, 20 bp, Artificial Sequence
  chemically synthesized
ttaaacaattaaggaaagat

SEQ ID NO: 339995 - DNA, 20 bp, Artificial Sequence
  chemically synthesized
gaaaattaaacaattaagga

SEQ ID NO: 339996 - DNA, 20 bp, Artificial Sequence
  chemically synthesized
agaagaaaattaaacaatta

SEQ ID NO: 339997 - DNA, 20 bp, Artificial Sequence
  chemically synthesized
aagaagaaaattaaacaatt

SEQ ID NO: 339998 - DNA, 20 bp, Artificial Sequence
  chemically synthesized
gtttaattttcttctttcca

SEQ ID NO: 339999 - DNA, 20 bp, Artificial Sequence
  chemically synthesized
agtttaagaactgtggaaag

SEQ ID NO: 340000 - DNA, 20 bp, Artificial Sequence
  chemically synthesized
ttcagtttaagaactgtgga

SEQ ID NO: 340001 - DNA, 20 bp, Artificial Sequence
  chemically synthesized
cttcttcagtttaagaactg

SEQ ID NO: 340002 - DNA, 20 bp, Artificial Sequence
  chemically synthesized
tttccacagttcttaaactg

SEQ ID NO: 340003 - DNA, 20 bp, Artificial Sequence
  chemically synthesized
cgtcaggccttcttcagttt

SEQ ID NO: 340004 - DNA, 20 bp, Artificial Sequence
  chemically synthesized
ccacagttcttaaactgaag

SEQ ID NO: 340005 - DNA, 20 bp, Artificial Sequence
  chemically synthesized
cacagttcttaaactgaaga

SEQ ID NO: 340006 - DNA, 20 bp, Artificial Sequence
  chemically synthesized
ggccaacgtcaggccttctt

SEQ ID NO: 340007 - DNA, 20 bp, Artificial Sequence
  chemically synthesized
aactgaagaaggcctgacgt

SEQ ID NO: 340008 - DNA, 20 bp, Artificial Sequence
  chemically synthesized
aagtggctatggccaacgtc

SEQ ID NO: 340009 - DNA, 20 bp, Artificial Sequence
  chemically synthesized
taagtggctatggccaacgt

SEQ ID NO: 340010 - DNA, 20 bp, Artificial Sequence
  chemically synthesized
agaaggcctgacgttggcca

SEQ ID NO: 340011 - DNA, 20 bp, Artificial Sequence
  chemically synthesized
taacagtgtttaagtggcta

SEQ ID NO: 340012 - DNA, 20 bp, Artificial Sequence
  chemically synthesized
aaagactaacagtgtttaag

SEQ ID NO: 340013 - DNA, 20 bp, Artificial Sequence
  chemically synthesized
tggaaagactaacagtgttt

SEQ ID NO: 340014 - DNA, 20 bp, Artificial Sequence
  chemically synthesized
catagccacttaaacactgt

SEQ ID NO: 340015 - DNA, 20 bp, Artificial Sequence
  chemically synthesized
tggcaagatggaaagactaa

SEQ ID NO: 340016 - DNA, 20 bp, Artificial Sequence
  chemically synthesized
gtttggcatggcaagatgga

SEQ ID NO: 340017 - DNA, 20 bp, Artificial Sequence
  chemically synthesized
ttcagtttggcatggcaaga

SEQ ID NO: 340018 - DNA, 20 bp, Artificial Sequence
  chemically synthesized
gtatttcagtttggcatggc

SEQ ID NO: 340019 - DNA, 20 bp, Artificial Sequence
  chemically synthesized
aaaagtatttcagtttggca

SEQ ID NO: 340020 - DNA, 20 bp, Artificial Sequence
  chemically synthesized
taggtaaaagtatttcagtt

SEQ ID NO: 340021 - DNA, 20 bp, Artificial Sequence
  chemically synthesized
gtggataggtaaaagtattt

SEQ ID NO: 340022 - DNA, 20 bp, Artificial Sequence
  chemically synthesized
ctaaatgagtggataggtaa

SEQ ID NO: 340023 - DNA, 20 bp, Artificial Sequence
  chemically synthesized
tatttactaaatgagtggat

SEQ ID NO: 340024 - DNA, 20 bp, Artificial Sequence
  chemically synthesized
atatttactaaatgagtgga

SEQ ID NO: 340025 - DNA, 20 bp, Artificial Sequence
  chemically synthesized
cttttacctatccactcatt

SEQ ID NO: 340026 - DNA, 20 bp, Artificial Sequence
  chemically synthesized
gtaaatatttactaaatgag

SEQ ID NO: 340027 - DNA, 20 bp, Artificial Sequence
  chemically synthesized
tgagtaaatatttactaaat

SEQ ID NO: 340028 - DNA, 20 bp, Artificial Sequence
  chemically synthesized
tcatttagtaaatatttact

SEQ ID NO: 340029 - DNA, 20 bp, Artificial Sequence
  chemically synthesized
gttggaaaatggtagacact

SEQ ID NO: 340030 - DNA, 20 bp, Artificial Sequence
  chemically synthesized
ttgtggtagttggaaaatgg

SEQ ID NO: 340031 - DNA, 20 bp, Artificial Sequence
  chemically synthesized
cttttgtggtagttggaaaa

SEQ ID NO: 340032 - DNA, 20 bp, Artificial Sequence
  chemically synthesized
ctagcaccttttgtggtagt

SEQ ID NO: 340033 - DNA, 20 bp, Artificial Sequence
  chemically synthesized
ccattttccaactaccacaa

SEQ ID NO: 340034 - DNA, 20 bp, Artificial Sequence
  chemically synthesized
cattttccaactaccacaaa

SEQ ID NO: 340035 - DNA, 20 bp, Artificial Sequence
  chemically synthesized
cgccctagcaccttttgtgg

SEQ ID NO: 340036 - DNA, 20 bp, Artificial Sequence
  chemically synthesized
ttgcgccctagcaccttttg

SEQ ID NO: 340037 - DNA, 20 bp, Artificial Sequence
  chemically synthesized
ccaactaccacaaaaggtgc

SEQ ID NO: 340038 - DNA, 20 bp, Artificial Sequence
  chemically synthesized
caactaccacaaaaggtgct

SEQ ID NO: 340039 - DNA, 20 bp, Artificial Sequence
  chemically synthesized
aactaccacaaaaggtgcta

SEQ ID NO: 340040 - DNA, 20 bp, Artificial Sequence
  chemically synthesized
ctttgttcataattgcgccc

SEQ ID NO: 340041 - DNA, 20 bp, Artificial Sequence
  chemically synthesized
ctagggcgcaattatgaaca

SEQ ID NO: 340042 - DNA, 20 bp, Artificial Sequence
  chemically synthesized
gggcgcaattatgaacaaag

SEQ ID NO: 340043 - DNA, 20 bp, Artificial Sequence
  chemically synthesized
gcaattatgaacaaagaagt

SEQ ID NO: 340044 - DNA, 20 bp, Artificial Sequence
  chemically synthesized
attatgaacaaagaagtcag

SEQ ID NO: 340045 - DNA, 20 bp, Artificial Sequence
  chemically synthesized
gtcagcagatacttttttca

SEQ ID NO: 340046 - DNA, 20 bp, Artificial Sequence
  chemically synthesized
tactgtaagctctgtgaaaa

SEQ ID NO: 340047 - DNA, 20 bp, Artificial Sequence
  chemically synthesized
cagcagatacttttttcaca

SEQ ID NO: 340048 - DNA, 20 bp, Artificial Sequence
  chemically synthesized
tacttttttcacagagctta

SEQ ID NO: 340049 - DNA, 20 bp, Artificial Sequence
  chemically synthesized
ttttcacagagcttacagta

SEQ ID NO: 340050 - DNA, 20 bp, Artificial Sequence
  chemically synthesized
ttgcccgtttgctgtactgt

SEQ ID NO: 340051 - DNA, 20 bp, Artificial Sequence
  chemically synthesized
agagcttacagtacagcaaa

SEQ ID NO: 340052 - DNA, 20 bp, Artificial Sequence
  chemically synthesized
gagcttacagtacagcaaac

SEQ ID NO: 340053 - DNA, 20 bp, Artificial Sequence
  chemically synthesized
agcaaacgggcaacacgtgt

SEQ ID NO: 340054 - DNA, 20 bp, Artificial Sequence
  chemically synthesized
aacgggcaacacgtgtaagc

SEQ ID NO: 340055 - DNA, 20 bp, Artificial Sequence
  chemically synthesized
ggcaacacgtgtaagcaagt

SEQ ID NO: 340056 - DNA, 20 bp, Artificial Sequence
  chemically synthesized
gtaagcaagtaagttcaata

SEQ ID NO: 340057 - DNA, 20 bp, Artificial Sequence
  chemically synthesized
taagcaagtaagttcaatac

SEQ ID NO: 340058 - DNA, 20 bp, Artificial Sequence
  chemically synthesized
tacaggttgaacatccctaa

SEQ ID NO: 340059 - DNA, 20 bp, Artificial Sequence
  chemically synthesized
acaggttgaacatccctaat

SEQ ID NO: 340060 - DNA, 20 bp, Artificial Sequence
  chemically synthesized
gatttcaaattttcctatta

SEQ ID NO: 340061 - DNA, 20 bp, Artificial Sequence
  chemically synthesized
agatttcaaattttcctatt

SEQ ID NO: 340062 - DNA, 20 bp, Artificial Sequence
  chemically synthesized
cagatttcaaattttcctat

SEQ ID NO: 340063 - DNA, 20 bp, Artificial Sequence
  chemically synthesized
ttacagattttgtagcattt

SEQ ID NO: 340064 - DNA, 20 bp, Artificial Sequence
  chemically synthesized
tcaaaaaattacagattttg

SEQ ID NO: 340065 - DNA, 20 bp, Artificial Sequence
  chemically synthesized
tgtagttactcaaaaaatta

SEQ ID NO: 340066 - DNA, 20 bp, Artificial Sequence
  chemically synthesized
tacaaaatctgtaatttttt

SEQ ID NO: 340067 - DNA, 20 bp, Artificial Sequence
  chemically synthesized
ttcccttaaaaatgatcgtg

SEQ ID NO: 340068 - DNA, 20 bp, Artificial Sequence
  chemically synthesized
gtaactacacgatcattttt

SEQ ID NO: 340069 - DNA, 20 bp, Artificial Sequence
  chemically synthesized
taactacacgatcattttta

SEQ ID NO: 340070 - DNA, 20 bp, Artificial Sequence
  chemically synthesized
aactacacgatcatttttaa

SEQ ID NO: 340071 - DNA, 20 bp, Artificial Sequence
  chemically synthesized
aaatccgaaatgattcaata

SEQ ID NO: 340072 - DNA, 20 bp, Artificial Sequence
  chemically synthesized
gaaatccgaaatgattcaat

SEQ ID NO: 340073 - DNA, 20 bp, Artificial Sequence
  chemically synthesized
aaatccttattgaatcattt

SEQ ID NO: 340074 - DNA, 20 bp, Artificial Sequence
  chemically synthesized
tattgaatcatttcggattt

SEQ ID NO: 340075 - DNA, 20 bp, Artificial Sequence
  chemically synthesized
catttcggatttcagatttt

SEQ ID NO: 340076 - DNA, 20 bp, Artificial Sequence
  chemically synthesized
gatttcagattttcagatta

SEQ ID NO: 340077 - DNA, 20 bp, Artificial Sequence
  chemically synthesized
ctttattatacatacgagtt

SEQ ID NO: 340078 - DNA, 20 bp, Artificial Sequence
  chemically synthesized
aatatctttattatacatac

SEQ ID NO: 340079 - DNA, 20 bp, Artificial Sequence
  chemically synthesized
ctcaactcgtatgtataata

SEQ ID NO: 340080 - DNA, 20 bp, Artificial Sequence
  chemically synthesized
gattttggatattttcagtt

SEQ ID NO: 340081 - DNA, 20 bp, Artificial Sequence
  chemically synthesized
ttttggattttggatatttt

SEQ ID NO: 340082 - DNA, 20 bp, Artificial Sequence
  chemically synthesized
accagaagtgttttggattt

SEQ ID NO: 340083 - DNA, 20 bp, Artificial Sequence
  chemically synthesized
gcttgggaccagaagtgttt

SEQ ID NO: 340084 - DNA, 20 bp, Artificial Sequence
  chemically synthesized
tccaaaatccaaaacacttc

SEQ ID NO: 340085 - DNA, 20 bp, Artificial Sequence
  chemically synthesized
tccaaaatgcttgggaccag

SEQ ID NO: 340086 - DNA, 20 bp, Artificial Sequence
  chemically synthesized
tccaaaacacttctggtccc

SEQ ID NO: 340087 - DNA, 20 bp, Artificial Sequence
  chemically synthesized
ttatccaaaatgcttgggac

SEQ ID NO: 340088 - DNA, 20 bp, Artificial Sequence
  chemically synthesized
atcccttatccaaaatgctt

SEQ ID NO: 340089 - DNA, 20 bp, Artificial Sequence
  chemically synthesized
acttctggtcccaagcattt

SEQ ID NO: 340090 - DNA, 20 bp, Artificial Sequence
  chemically synthesized
tatcccttatccaaaatgct

SEQ ID NO: 340091 - DNA, 20 bp, Artificial Sequence
  chemically synthesized
tggtcccaagcattttggat

SEQ ID NO: 340092 - DNA, 20 bp, Artificial Sequence
  chemically synthesized
ggtcccaagcattttggata

SEQ ID NO: 340093 - DNA, 20 bp, Artificial Sequence
  chemically synthesized
gtcccaagcattttggataa

SEQ ID NO: 340094 - DNA, 20 bp, Artificial Sequence
  chemically synthesized
cttgccccaaaatatatgtt

SEQ ID NO: 340095 - DNA, 20 bp, Artificial Sequence
  chemically synthesized
gggatactcaacatatattt

SEQ ID NO: 340096 - DNA, 20 bp, Artificial Sequence
  chemically synthesized
ggatactcaacatatatttt

SEQ ID NO: 340097 - DNA, 20 bp, Artificial Sequence
  chemically synthesized
gatactcaacatatattttg

SEQ ID NO: 340098 - DNA, 20 bp, Artificial Sequence
  chemically synthesized
ctcaacatatattttggggc

SEQ ID NO: 340099 - DNA, 20 bp, Artificial Sequence
  chemically synthesized
ttttggggcaagttttatta

SEQ ID NO: 340100 - DNA, 20 bp, Artificial Sequence
  chemically synthesized
tttggggcaagttttattat

SEQ ID NO: 340101 - DNA, 20 bp, Artificial Sequence
  chemically synthesized
ttggggcaagttttattata

SEQ ID NO: 340102 - DNA, 20 bp, Artificial Sequence
  chemically synthesized
ggcaagttttattataggga

SEQ ID NO: 340103 - DNA, 20 bp, Artificial Sequence
  chemically synthesized
gactaaatattgggcaatgt

SEQ ID NO: 340104 - DNA, 20 bp, Artificial Sequence
  chemically synthesized
agctaacattgcccaatatt

SEQ ID NO: 340105 - DNA, 20 bp, Artificial Sequence
  chemically synthesized
gtgcctcaagactaaatatt

SEQ ID NO: 340106 - DNA, 20 bp, Artificial Sequence
  chemically synthesized
tgtgcctcaagactaaatat

SEQ ID NO: 340107 - DNA, 20 bp, Artificial Sequence
  chemically synthesized
attgcccaatatttagtctt

SEQ ID NO: 340108 - DNA, 20 bp, Artificial Sequence
  chemically synthesized
ttgcccaatatttagtcttg

SEQ ID NO: 340109 - DNA, 20 bp, Artificial Sequence
  chemically synthesized
aatggttgactttgtgcctc

SEQ ID NO: 340110 - DNA, 20 bp, Artificial Sequence
  chemically synthesized
atatttagtcttgaggcaca

SEQ ID NO: 340111 - DNA, 20 bp, Artificial Sequence
  chemically synthesized
cacaaagtcaaccattaatg

SEQ ID NO: 340112 - DNA, 20 bp, Artificial Sequence
  chemically synthesized
aagctgaagtgctacattaa

SEQ ID NO: 340113 - DNA, 20 bp, Artificial Sequence
  chemically synthesized
caaccattaatgtagcactt

SEQ ID NO: 340114 - DNA, 20 bp, Artificial Sequence
  chemically synthesized
ttaatgtagcacttcagctt

SEQ ID NO: 340115 - DNA, 20 bp, Artificial Sequence
  chemically synthesized
atgaaatgtttccaaagctg

SEQ ID NO: 340116 - DNA, 20 bp, Artificial Sequence
  chemically synthesized
attaacatgaaatgtttcca

SEQ ID NO: 340117 - DNA, 20 bp, Artificial Sequence
  chemically synthesized
tttcatgttaatgaatattt

SEQ ID NO: 340118 - DNA, 20 bp, Artificial Sequence
  chemically synthesized
agatacatacatagaaaaat

SEQ ID NO: 340119 - DNA, 20 bp, Artificial Sequence
  chemically synthesized
agaggcagaagatacataca

SEQ ID NO: 340120 - DNA, 20 bp, Artificial Sequence
  chemically synthesized
cagtgtttgaaaagaggcag

SEQ ID NO: 340121 - DNA, 20 bp, Artificial Sequence
  chemically synthesized
aatcagtgtttgaaaagagg

SEQ ID NO: 340122 - DNA, 20 bp, Artificial Sequence
  chemically synthesized
atgaatcagtgtttgaaaag

SEQ ID NO: 340123 - DNA, 20 bp, Artificial Sequence
  chemically synthesized
catgaatcagtgtttgaaaa

SEQ ID NO: 340124 - DNA, 20 bp, Artificial Sequence
  chemically synthesized
accatgaatcagtgtttgaa

SEQ ID NO: 340125 - DNA, 20 bp, Artificial Sequence
  chemically synthesized
tcttttcaaacactgattca

SEQ ID NO: 340126 - DNA, 20 bp, Artificial Sequence
  chemically synthesized
cttgccaagctaccatgaat

SEQ ID NO: 340127 - DNA, 20 bp, Artificial Sequence
  chemically synthesized
tttcaaacactgattcatgg

SEQ ID NO: 340128 - DNA, 20 bp, Artificial Sequence
  chemically synthesized
aacactgattcatggtagct

SEQ ID NO: 340129 - DNA, 20 bp, Artificial Sequence
  chemically synthesized
ctgattcatggtagcttggc

SEQ ID NO: 340130 - DNA, 20 bp, Artificial Sequence
  chemically synthesized
ggagaatcattcagcttgcc

SEQ ID NO: 340131 - DNA, 20 bp, Artificial Sequence
  chemically synthesized
actcctcttggagaatcatt

SEQ ID NO: 340132 - DNA, 20 bp, Artificial Sequence
  chemically synthesized
ggcaagctgaatgattctcc

SEQ ID NO: 340133 - DNA, 20 bp, Artificial Sequence
  chemically synthesized
caagctgaatgattctccaa

SEQ ID NO: 340134 - DNA, 20 bp, Artificial Sequence
  chemically synthesized
aagctgaatgattctccaag

SEQ ID NO: 340135 - DNA, 20 bp, Artificial Sequence
  chemically synthesized
gctgaatgattctccaagag

SEQ ID NO: 340136 - DNA, 20 bp, Artificial Sequence
  chemically synthesized
agcatataatactcctcttg

SEQ ID NO: 340137 - DNA, 20 bp, Artificial Sequence
  chemically synthesized
gaagcatataatactcctct

SEQ ID NO: 340138 - DNA, 20 bp, Artificial Sequence
  chemically synthesized
gtggttaagataagacattg

SEQ ID NO: 340139 - DNA, 20 bp, Artificial Sequence
  chemically synthesized
attgggggggtggttaagat

SEQ ID NO: 340140 - DNA, 20 bp, Artificial Sequence
  chemically synthesized
gatagattgggggggtggtt

SEQ ID NO: 340141 - DNA, 20 bp, Artificial Sequence
  chemically synthesized
ttaaagatagattggggggg

SEQ ID NO: 340142 - DNA, 20 bp, Artificial Sequence
  chemically synthesized
atgttaaagatagattgggg

SEQ ID NO: 340143 - DNA, 20 bp, Artificial Sequence
  chemically synthesized
aatgttaaagatagattggg

SEQ ID NO: 340144 - DNA, 20 bp, Artificial Sequence
  chemically synthesized
aaatgttaaagatagattgg

SEQ ID NO: 340145 - DNA, 20 bp, Artificial Sequence
  chemically synthesized
gaaatgttaaagatagattg

SEQ ID NO: 340146 - DNA, 20 bp, Artificial Sequence
  chemically synthesized
ggaaatgttaaagatagatt

SEQ ID NO: 340147 - DNA, 20 bp, Artificial Sequence
  chemically synthesized
tggaaatgttaaagatagat

SEQ ID NO: 340148 - DNA, 20 bp, Artificial Sequence
  chemically synthesized
aaatgtggaaatgttaaaga

SEQ ID NO: 340149 - DNA, 20 bp, Artificial Sequence
  chemically synthesized
tatgaaatgtggaaatgtta

SEQ ID NO: 340150 - DNA, 20 bp, Artificial Sequence
  chemically synthesized
ctgagatgatatatgaaatg

SEQ ID NO: 340151 - DNA, 20 bp, Artificial Sequence
  chemically synthesized
ccacatttcatatatcatct

SEQ ID NO: 340152 - DNA, 20 bp, Artificial Sequence
  chemically synthesized
catttcatatatcatctcag

SEQ ID NO: 340153 - DNA, 20 bp, Artificial Sequence
  chemically synthesized
tacaagggtagaaatctgct

SEQ ID NO: 340154 - DNA, 20 bp, Artificial Sequence
  chemically synthesized
cagcagatttctacccttgt

SEQ ID NO: 340155 - DNA, 20 bp, Artificial Sequence
  chemically synthesized
ttaacaaaaacttacaaggg

SEQ ID NO: 340156 - DNA, 20 bp, Artificial Sequence
  chemically synthesized
tttttaacaaaaacttacaa

SEQ ID NO: 340157 - DNA, 20 bp, Artificial Sequence
  chemically synthesized
ctttttaacaaaaacttaca

SEQ ID NO: 340158 - DNA, 20 bp, Artificial Sequence
  chemically synthesized
tctttttaacaaaaacttac

SEQ ID NO: 340159 - DNA, 20 bp, Artificial Sequence
  chemically synthesized
ccttgtaagtttttgttaaa

SEQ ID NO: 340160 - DNA, 20 bp, Artificial Sequence
  chemically synthesized
aagaaatatgccaaatttaa

SEQ ID NO: 340161 - DNA, 20 bp, Artificial Sequence
  chemically synthesized
ctatgatactctattaaatt

SEQ ID NO: 340162 - DNA, 20 bp, Artificial Sequence
  chemically synthesized
gaaatatgccaaatttaata

SEQ ID NO: 340163 - DNA, 20 bp, Artificial Sequence
  chemically synthesized
ccaaatttaatagagtatca

SEQ ID NO: 340164 - DNA, 20 bp, Artificial Sequence
  chemically synthesized
ttaatagagtatcatagatg

SEQ ID NO: 340165 - DNA, 20 bp, Artificial Sequence
  chemically synthesized
atagagtatcatagatgaag

SEQ ID NO: 340166 - DNA, 20 bp, Artificial Sequence
  chemically synthesized
aaaagctccttaagagacat

SEQ ID NO: 340167 - DNA, 20 bp, Artificial Sequence
  chemically synthesized
tttgtatacttatgtctctt

SEQ ID NO: 340168 - DNA, 20 bp, Artificial Sequence
  chemically synthesized
ttgtatacttatgtctctta

SEQ ID NO: 340169 - DNA, 20 bp, Artificial Sequence
  chemically synthesized
gtatacttatgtctcttaag

SEQ ID NO: 340170 - DNA, 20 bp, Artificial Sequence
  chemically synthesized
tagtataaaaagctccttaa

SEQ ID NO: 340171 - DNA, 20 bp, Artificial Sequence
  chemically synthesized
cttagtataaaaagctcctt

SEQ ID NO: 340172 - DNA, 20 bp, Artificial Sequence
  chemically synthesized
tctgaatttcttagtataaa

SEQ ID NO: 340173 - DNA, 20 bp, Artificial Sequence
  chemically synthesized
cttaaggagctttttatact

SEQ ID NO: 340174 - DNA, 20 bp, Artificial Sequence
  chemically synthesized
gctttttatactaagaaatt

SEQ ID NO: 340175 - DNA, 20 bp, Artificial Sequence
  chemically synthesized
atgtagttttctgaatttct

SEQ ID NO: 340176 - DNA, 20 bp, Artificial Sequence
  chemically synthesized
attcagaaaactacatgttc

SEQ ID NO: 340177 - DNA, 20 bp, Artificial Sequence
  chemically synthesized
tattaaagaaccagaacatg

SEQ ID NO: 340178 - DNA, 20 bp, Artificial Sequence
  chemically synthesized
atatttaattattaaagaac

SEQ ID NO: 340179 - DNA, 20 bp, Artificial Sequence
  chemically synthesized
acacacatatttaattatta

SEQ ID NO: 340180 - DNA, 20 bp, Artificial Sequence
  chemically synthesized
tactttgataggaaagtcaa

SEQ ID NO: 340181 - DNA, 20 bp, Artificial Sequence
  chemically synthesized
acgtttttactttgatagga

SEQ ID NO: 340182 - DNA, 20 bp, Artificial Sequence
  chemically synthesized
ttcttttgactttcctatca

SEQ ID NO: 340183 - DNA, 20 bp, Artificial Sequence
  chemically synthesized
gacaacgtttttactttgat

SEQ ID NO: 340184 - DNA, 20 bp, Artificial Sequence
  chemically synthesized
agacaacgtttttactttga

SEQ ID NO: 340185 - DNA, 20 bp, Artificial Sequence
  chemically synthesized
tcaaagtaaaaacgttgtct

SEQ ID NO: 340186 - DNA, 20 bp, Artificial Sequence
  chemically synthesized
aagtaaaaacgttgtctcag

SEQ ID NO: 340187 - DNA, 20 bp, Artificial Sequence
  chemically synthesized
agtaaaaacgttgtctcagc

SEQ ID NO: 340188 - DNA, 20 bp, Artificial Sequence
  chemically synthesized
gtaaaaacgttgtctcagca

SEQ ID NO: 340189 - DNA, 20 bp, Artificial Sequence
  chemically synthesized
gatatgttgaatgccctgct

SEQ ID NO: 340190 - DNA, 20 bp, Artificial Sequence
  chemically synthesized
cagtactatggtgaatggtt

SEQ ID NO: 340191 - DNA, 20 bp, Artificial Sequence
  chemically synthesized
catatcttaaccattcacca

SEQ ID NO: 340192 - DNA, 20 bp, Artificial Sequence
  chemically synthesized
atagtcagtactatggtgaa

SEQ ID NO: 340193 - DNA, 20 bp, Artificial Sequence
  chemically synthesized
ttattacatagtcagtacta

SEQ ID NO: 340194 - DNA, 20 bp, Artificial Sequence
  chemically synthesized
aaaattgtttattacatagt

SEQ ID NO: 340195 - DNA, 20 bp, Artificial Sequence
  chemically synthesized
ttagaaaattgtttattaca

SEQ ID NO: 340196 - DNA, 20 bp, Artificial Sequence
  chemically synthesized
aaacaattttctaaatgtac

SEQ ID NO: 340197 - DNA, 20 bp, Artificial Sequence
  chemically synthesized
tttagttttgctagtacatt

SEQ ID NO: 340198 - DNA, 20 bp, Artificial Sequence
  chemically synthesized
tatatatgctttagttttgc

SEQ ID NO: 340199 - DNA, 20 bp, Artificial Sequence
  chemically synthesized
taaatgtactagcaaaacta

SEQ ID NO: 340200 - DNA, 20 bp, Artificial Sequence
  chemically synthesized
ctgtgctactatatatgctt

SEQ ID NO: 340201 - DNA, 20 bp, Artificial Sequence
  chemically synthesized
tagcaaaactaaagcatata

SEQ ID NO: 340202 - DNA, 20 bp, Artificial Sequence
  chemically synthesized
caaaactaaagcatatatag

SEQ ID NO: 340203 - DNA, 20 bp, Artificial Sequence
  chemically synthesized
ctaaagcatatatagtagca

SEQ ID NO: 340204 - DNA, 20 bp, Artificial Sequence
  chemically synthesized
accatggtcatatagagcag

SEQ ID NO: 340205 - DNA, 20 bp, Artificial Sequence
  chemically synthesized
gaccatggtcatatagagca

SEQ ID NO: 340206 - DNA, 20 bp, Artificial Sequence
  chemically synthesized
tggaccatggtcatatagag

SEQ ID NO: 340207 - DNA, 20 bp, Artificial Sequence
  chemically synthesized
tcctggaccatggtcatata

SEQ ID NO: 340208 - DNA, 20 bp, Artificial Sequence
  chemically synthesized
cctcctggaccatggtcata

SEQ ID NO: 340209 - DNA, 20 bp, Artificial Sequence
  chemically synthesized
gcctctgctctatatgacca

SEQ ID NO: 340210 - DNA, 20 bp, Artificial Sequence
  chemically synthesized
tgctctatatgaccatggtc

SEQ ID NO: 340211 - DNA, 20 bp, Artificial Sequence
  chemically synthesized
gctctatatgaccatggtcc

SEQ ID NO: 340212 - DNA, 20 bp, Artificial Sequence
  chemically synthesized
taagtatacctcctggacca

SEQ ID NO: 340213 - DNA, 20 bp, Artificial Sequence
  chemically synthesized
tctatatgaccatggtccag

SEQ ID NO: 340214 - DNA, 20 bp, Artificial Sequence
  chemically synthesized
ctatatgaccatggtccagg

SEQ ID NO: 340215 - DNA, 20 bp, Artificial Sequence
  chemically synthesized
caactcttaagtatacctcc

SEQ ID NO: 340216 - DNA, 20 bp, Artificial Sequence
  chemically synthesized
atggtccaggaggtatactt

SEQ ID NO: 340217 - DNA, 20 bp, Artificial Sequence
  chemically synthesized
ggtccaggaggtatacttaa

SEQ ID NO: 340218 - DNA, 20 bp, Artificial Sequence
  chemically synthesized
caggaggtatacttaagagt

SEQ ID NO: 340219 - DNA, 20 bp, Artificial Sequence
  chemically synthesized
taaatatttaaccaactctt

SEQ ID NO: 340220 - DNA, 20 bp, Artificial Sequence
  chemically synthesized
aagagttggttaaatattta

SEQ ID NO: 340221 - DNA, 20 bp, Artificial Sequence
  chemically synthesized
ttggttaaatatttatagct

SEQ ID NO: 340222 - DNA, 20 bp, Artificial Sequence
  chemically synthesized
ttaaatatttatagctgagt

SEQ ID NO: 340223 - DNA, 20 bp, Artificial Sequence
  chemically synthesized
agccaaaaacatgactaact

SEQ ID NO: 340224 - DNA, 20 bp, Artificial Sequence
  chemically synthesized
agctgagttagtcatgtttt

SEQ ID NO: 340225 - DNA, 20 bp, Artificial Sequence
  chemically synthesized
gttagtcatgtttttggctt

SEQ ID NO: 340226 - DNA, 20 bp, Artificial Sequence
  chemically synthesized
ttagtcatgtttttggcttt

SEQ ID NO: 340227 - DNA, 20 bp, Artificial Sequence
  chemically synthesized
ctgaacactgcagtttccca

SEQ ID NO: 340228 - DNA, 20 bp, Artificial Sequence
  chemically synthesized
tttttggctttgggaaactg

SEQ ID NO: 340229 - DNA, 20 bp, Artificial Sequence
  chemically synthesized
ctttgggaaactgcagtgtt

SEQ ID NO: 340230 - DNA, 20 bp, Artificial Sequence
  chemically synthesized
cagtggggatctgaacactg

SEQ ID NO: 340231 - DNA, 20 bp, Artificial Sequence
  chemically synthesized
cacgttacattttaacagtg

SEQ ID NO: 340232 - DNA, 20 bp, Artificial Sequence
  chemically synthesized
ccacgttacattttaacagt

SEQ ID NO: 340233 - DNA, 20 bp, Artificial Sequence
  chemically synthesized
cccacgttacattttaacag

SEQ ID NO: 340234 - DNA, 20 bp, Artificial Sequence
  chemically synthesized
tggcccacgttacattttaa

SEQ ID NO: 340235 - DNA, 20 bp, Artificial Sequence
  chemically synthesized
cccactgttaaaatgtaacg

SEQ ID NO: 340236 - DNA, 20 bp, Artificial Sequence
  chemically synthesized
ccactgttaaaatgtaacgt

SEQ ID NO: 340237 - DNA, 20 bp, Artificial Sequence
  chemically synthesized
tgttaaaatgtaacgtgggc

SEQ ID NO: 340238 - DNA, 20 bp, Artificial Sequence
  chemically synthesized
gttaaaatgtaacgtgggcc

SEQ ID NO: 340239 - DNA, 20 bp, Artificial Sequence
  chemically synthesized
gtaacgtgggccaggcacaa

SEQ ID NO: 340240 - DNA, 20 bp, Artificial Sequence
  chemically synthesized
ggaatgtgaaccattgtgcc

SEQ ID NO: 340241 - DNA, 20 bp, Artificial Sequence
  chemically synthesized
atggttcacattcctaatct

SEQ ID NO: 340242 - DNA, 20 bp, Artificial Sequence
  chemically synthesized
cctccgaaaatgctgagatt

SEQ ID NO: 340243 - DNA, 20 bp, Artificial Sequence
  chemically synthesized
gcctccgaaaatgctgagat

SEQ ID NO: 340244 - DNA, 20 bp, Artificial Sequence
  chemically synthesized
cctcagcctccgaaaatgct

SEQ ID NO: 340245 - DNA, 20 bp, Artificial Sequence
  chemically synthesized
attcctaatctcagcatttt

SEQ ID NO: 340246 - DNA, 20 bp, Artificial Sequence
  chemically synthesized
tcctaatctcagcattttcg

SEQ ID NO: 340247 - DNA, 20 bp, Artificial Sequence
  chemically synthesized
cctaatctcagcattttcgg

SEQ ID NO: 340248 - DNA, 20 bp, Artificial Sequence
  chemically synthesized
tctcagcattttcggaggct

SEQ ID NO: 340249 - DNA, 20 bp, Artificial Sequence
  chemically synthesized
ctcagcattttcggaggctg

SEQ ID NO: 340250 - DNA, 20 bp, Artificial Sequence
  chemically synthesized
agcattttcggaggctgagg

SEQ ID NO: 340251 - DNA, 20 bp, Artificial Sequence
  chemically synthesized
gcattttcggaggctgaggc

SEQ ID NO: 340252 - DNA, 20 bp, Artificial Sequence
  chemically synthesized
attttcggaggctgaggcag

SEQ ID NO: 340253 - DNA, 20 bp, Artificial Sequence
  chemically synthesized
ttttcggaggctgaggcagg

SEQ ID NO: 340254 - DNA, 20 bp, Artificial Sequence
  chemically synthesized
ctcaagcgatcctcctgcct

SEQ ID NO: 340255 - DNA, 20 bp, Artificial Sequence
  chemically synthesized
ctgaggcaggaggatcgctt

SEQ ID NO: 340256 - DNA, 20 bp, Artificial Sequence
  chemically synthesized
tgaggcaggaggatcgcttg

SEQ ID NO: 340257 - DNA, 20 bp, Artificial Sequence
  chemically synthesized
gcaggaggatcgcttgaggc

SEQ ID NO: 340258 - DNA, 20 bp, Artificial Sequence
  chemically synthesized
caggaggatcgcttgaggcc

SEQ ID NO: 340259 - DNA, 20 bp, Artificial Sequence
  chemically synthesized
ggtctcaaactcctggcctc

SEQ ID NO: 340260 - DNA, 20 bp, Artificial Sequence
  chemically synthesized
ggaggatcgcttgaggccag

SEQ ID NO: 340261 - DNA, 20 bp, Artificial Sequence
  chemically synthesized
tcgcttgaggccaggagttt

SEQ ID NO: 340262 - DNA, 20 bp, Artificial Sequence
  chemically synthesized
cccggttggtctcaaactcc

SEQ ID NO: 340263 - DNA, 20 bp, Artificial Sequence
  chemically synthesized
gccaggagtttgagaccaac

SEQ ID NO: 340264 - DNA, 20 bp, Artificial Sequence
  chemically synthesized
ccaggagtttgagaccaacc

SEQ ID NO: 340265 - DNA, 20 bp, Artificial Sequence
  chemically synthesized
caggagtttgagaccaaccg

SEQ ID NO: 340266 - DNA, 20 bp, Artificial Sequence
  chemically synthesized
tcttgcttcattgccccggt

SEQ ID NO: 340267 - DNA, 20 bp, Artificial Sequence
  chemically synthesized
agggtcttgcttcattgccc

SEQ ID NO: 340268 - DNA, 20 bp, Artificial Sequence
  chemically synthesized
tgagaccaaccggggcaatg

SEQ ID NO: 340269 - DNA, 20 bp, Artificial Sequence
  chemically synthesized
accaaccggggcaatgaagc

SEQ ID NO: 340270 - DNA, 20 bp, Artificial Sequence
  chemically synthesized
attgttattttgtagagaca

SEQ ID NO: 340271 - DNA, 20 bp, Artificial Sequence
  chemically synthesized
tattgttattttgtagagac

SEQ ID NO: 340272 - DNA, 20 bp, Artificial Sequence
  chemically synthesized
ttattgttattttgtagaga

SEQ ID NO: 340273 - DNA, 20 bp, Artificial Sequence
  chemically synthesized
ttttttattgttattttgta

SEQ ID NO: 340274 - DNA, 20 bp, Artificial Sequence
  chemically synthesized
aattttttattgttattttg

SEQ ID NO: 340275 - DNA, 20 bp, Artificial Sequence
  chemically synthesized
aggtgtacaacacaatgcag

SEQ ID NO: 340276 - DNA, 20 bp, Artificial Sequence
  chemically synthesized
caggtgtacaacacaatgca

SEQ ID NO: 340277 - DNA, 20 bp, Artificial Sequence
  chemically synthesized
tgcaggtgtacaacacaatg

SEQ ID NO: 340278 - DNA, 20 bp, Artificial Sequence
  chemically synthesized
gtgttgtacacctgcaattc

SEQ ID NO: 340279 - DNA, 20 bp, Artificial Sequence
  chemically synthesized
tcctgagtaactagaattgc

SEQ ID NO: 340280 - DNA, 20 bp, Artificial Sequence
  chemically synthesized
ctcctgagtaactagaattg

SEQ ID NO: 340281 - DNA, 20 bp, Artificial Sequence
  chemically synthesized
cacctgcaattctagttact

SEQ ID NO: 340282 - DNA, 20 bp, Artificial Sequence
  chemically synthesized
acctgcaattctagttactc

SEQ ID NO: 340283 - DNA, 20 bp, Artificial Sequence
  chemically synthesized
agctcagcctcctgagtaac

SEQ ID NO: 340284 - DNA, 20 bp, Artificial Sequence
  chemically synthesized
ctgcaattctagttactcag

SEQ ID NO: 340285 - DNA, 20 bp, Artificial Sequence
  chemically synthesized
tgcaattctagttactcagg

SEQ ID NO: 340286 - DNA, 20 bp, Artificial Sequence
  chemically synthesized
tccttctagctcagcctcct

SEQ ID NO: 340287 - DNA, 20 bp, Artificial Sequence
  chemically synthesized
ttctagttactcaggaggct

SEQ ID NO: 340288 - DNA, 20 bp, Artificial Sequence
  chemically synthesized
agttactcaggaggctgagc

SEQ ID NO: 340289 - DNA, 20 bp, Artificial Sequence
  chemically synthesized
tactcaggaggctgagctag

SEQ ID NO: 340290 - DNA, 20 bp, Artificial Sequence
  chemically synthesized
actcaggaggctgagctaga

SEQ ID NO: 340291 - DNA, 20 bp, Artificial Sequence
  chemically synthesized
gtcaagtgatccttctagct

SEQ ID NO: 340292 - DNA, 20 bp, Artificial Sequence
  chemically synthesized
cctgagtcaagtgatccttc

SEQ ID NO: 340293 - DNA, 20 bp, Artificial Sequence
  chemically synthesized
gctagaaggatcacttgact

SEQ ID NO: 340294 - DNA, 20 bp, Artificial Sequence
  chemically synthesized
ctagaaggatcacttgactc

SEQ ID NO: 340295 - DNA, 20 bp, Artificial Sequence
  chemically synthesized
agaaggatcacttgactcag

SEQ ID NO: 340296 - DNA, 20 bp, Artificial Sequence
  chemically synthesized
aggcctccaactcctgagtc

SEQ ID NO: 340297 - DNA, 20 bp, Artificial Sequence
  chemically synthesized
ggatcacttgactcaggagt

SEQ ID NO: 340298 - DNA, 20 bp, Artificial Sequence
  chemically synthesized
accacaggcctccaactcct

SEQ ID NO: 340299 - DNA, 20 bp, Artificial Sequence
  chemically synthesized
atcacttgactcaggagttg

SEQ ID NO: 340300 - DNA, 20 bp, Artificial Sequence
  chemically synthesized
tcacttgactcaggagttgg

SEQ ID NO: 340301 - DNA, 20 bp, Artificial Sequence
  chemically synthesized
actcaggagttggaggcctg

SEQ ID NO: 340302 - DNA, 20 bp, Artificial Sequence
  chemically synthesized
aggagttggaggcctgtggt

SEQ ID NO: 340303 - DNA, 20 bp, Artificial Sequence
  chemically synthesized
gcacagtcgtagcttaccac

SEQ ID NO: 340304 - DNA, 20 bp, Artificial Sequence
  chemically synthesized
agcacagtcgtagcttacca

SEQ ID NO: 340305 - DNA, 20 bp, Artificial Sequence
  chemically synthesized
ggagtgcactagcacagtcg

SEQ ID NO: 340306 - DNA, 20 bp, Artificial Sequence
  chemically synthesized
gtggtaagctacgactgtgc

SEQ ID NO: 340307 - DNA, 20 bp, Artificial Sequence
  chemically synthesized
caggctggagtgcactagca

SEQ ID NO: 340308 - DNA, 20 bp, Artificial Sequence
  chemically synthesized
ttgcccaggctggagtgcac

SEQ ID NO: 340309 - DNA, 20 bp, Artificial Sequence
  chemically synthesized
acgactgtgctagtgcactc

SEQ ID NO: 340310 - DNA, 20 bp, Artificial Sequence
  chemically synthesized
tgtgctagtgcactccagcc

SEQ ID NO: 340311 - DNA, 20 bp, Artificial Sequence
  chemically synthesized
gtgctagtgcactccagcct

SEQ ID NO: 340312 - DNA, 20 bp, Artificial Sequence
  chemically synthesized
ttactcttttgcccaggctg

SEQ ID NO: 340313 - DNA, 20 bp, Artificial Sequence
  chemically synthesized
tattactcttttgcccaggc

SEQ ID NO: 340314 - DNA, 20 bp, Artificial Sequence
  chemically synthesized
gtgcactccagcctgggcaa

SEQ ID NO: 340315 - DNA, 20 bp, Artificial Sequence
  chemically synthesized
aagatattactcttttgccc

SEQ ID NO: 340316 - DNA, 20 bp, Artificial Sequence
  chemically synthesized
gcactccagcctgggcaaaa

SEQ ID NO: 340317 - DNA, 20 bp, Artificial Sequence
  chemically synthesized
caagatattactcttttgcc

SEQ ID NO: 340318 - DNA, 20 bp, Artificial Sequence
  chemically synthesized
ttttatttattttaagagac

SEQ ID NO: 340319 - DNA, 20 bp, Artificial Sequence
  chemically synthesized
ttacattttatttattttaa

SEQ ID NO: 340320 - DNA, 20 bp, Artificial Sequence
  chemically synthesized
cattacattttatttatttt

SEQ ID NO: 340321 - DNA, 20 bp, Artificial Sequence
  chemically synthesized
ttaaaataaataaaatgtaa

SEQ ID NO: 340322 - DNA, 20 bp, Artificial Sequence
  chemically synthesized
ataaaatgtaatggtgccat

SEQ ID NO: 340323 - DNA, 20 bp, Artificial Sequence
  chemically synthesized
catatctatgcatttactta

SEQ ID NO: 340324 - DNA, 20 bp, Artificial Sequence
  chemically synthesized
tggtgccataagtaaatgca

SEQ ID NO: 340325 - DNA, 20 bp, Artificial Sequence
  chemically synthesized
agatatgtgatccaatccat

SEQ ID NO: 340326 - DNA, 20 bp, Artificial Sequence
  chemically synthesized
atattttaaaactcatggat

SEQ ID NO: 340327 - DNA, 20 bp, Artificial Sequence
  chemically synthesized
ctgacatattttaaaactca

SEQ ID NO: 340328 - DNA, 20 bp, Artificial Sequence
  chemically synthesized
ccatgagttttaaaatatgt

SEQ ID NO: 340329 - DNA, 20 bp, Artificial Sequence
  chemically synthesized
catgagttttaaaatatgtc

SEQ ID NO: 340330 - DNA, 20 bp, Artificial Sequence
  chemically synthesized
aaatatgtcaggtaacacca

SEQ ID NO: 340331 - DNA, 20 bp, Artificial Sequence
  chemically synthesized
tatgtcaggtaacaccaaag

SEQ ID NO: 340332 - DNA, 20 bp, Artificial Sequence
  chemically synthesized
atgtcaggtaacaccaaagt

SEQ ID NO: 340333 - DNA, 20 bp, Artificial Sequence
  chemically synthesized
attgtttttgtgtcctactt

SEQ ID NO: 340334 - DNA, 20 bp, Artificial Sequence
  chemically synthesized
caatttgaatgtttatgaaa

SEQ ID NO: 340335 - DNA, 20 bp, Artificial Sequence
  chemically synthesized
atttgaatgtttatgaaaaa

SEQ ID NO: 340336 - DNA, 20 bp, Artificial Sequence
  chemically synthesized
tatgaaaaagagtacttcaa

SEQ ID NO: 340337 - DNA, 20 bp, Artificial Sequence
  chemically synthesized
atgaaaaagagtacttcaac

SEQ ID NO: 340338 - DNA, 20 bp, Artificial Sequence
  chemically synthesized
aaaaagagtacttcaacagg

SEQ ID NO: 340339 - DNA, 20 bp, Artificial Sequence
  chemically synthesized
tctaagtctacttcctgttg

SEQ ID NO: 340340 - DNA, 20 bp, Artificial Sequence
  chemically synthesized
aagagtacttcaacaggaag

SEQ ID NO: 340341 - DNA, 20 bp, Artificial Sequence
  chemically synthesized
acttcaacaggaagtagact

SEQ ID NO: 340342 - DNA, 20 bp, Artificial Sequence
  chemically synthesized
ttcaacaggaagtagactta

SEQ ID NO: 340343 - DNA, 20 bp, Artificial Sequence
  chemically synthesized
caacaggaagtagacttaga

SEQ ID NO: 340344 - DNA, 20 bp, Artificial Sequence
  chemically synthesized
cttctgtcctatggctctct

SEQ ID NO: 340345 - DNA, 20 bp, Artificial Sequence
  chemically synthesized
gaagtagacttagagagcca

SEQ ID NO: 340346 - DNA, 20 bp, Artificial Sequence
  chemically synthesized
aagtagacttagagagccat

SEQ ID NO: 340347 - DNA, 20 bp, Artificial Sequence
  chemically synthesized
agacttagagagccatagga

SEQ ID NO: 340348 - DNA, 20 bp, Artificial Sequence
  chemically synthesized
gaagacactcttctgtccta

SEQ ID NO: 340349 - DNA, 20 bp, Artificial Sequence
  chemically synthesized
cttagagagccataggacag

SEQ ID NO: 340350 - DNA, 20 bp, Artificial Sequence
  chemically synthesized
tagagagccataggacagaa

SEQ ID NO: 340351 - DNA, 20 bp, Artificial Sequence
  chemically synthesized
aggacagaagagtgtcttcc

SEQ ID NO: 340352 - DNA, 20 bp, Artificial Sequence
  chemically synthesized
ggacagaagagtgtcttcct

SEQ ID NO: 340353 - DNA, 20 bp, Artificial Sequence
  chemically synthesized
cgtcattcctattgcctagg

SEQ ID NO: 340354 - DNA, 20 bp, Artificial Sequence
  chemically synthesized
aagagtgtcttcctaggcaa

SEQ ID NO: 340355 - DNA, 20 bp, Artificial Sequence
  chemically synthesized
agagtgtcttcctaggcaat

SEQ ID NO: 340356 - DNA, 20 bp, Artificial Sequence
  chemically synthesized
caacgtcattcctattgcct

SEQ ID NO: 340357 - DNA, 20 bp, Artificial Sequence
  chemically synthesized
tcaacgtcattcctattgcc

SEQ ID NO: 340358 - DNA, 20 bp, Artificial Sequence
  chemically synthesized
aatgacgttgaatcacattt

SEQ ID NO: 340359 - DNA, 20 bp, Artificial Sequence
  chemically synthesized
gttgaatcacattttggaaa

SEQ ID NO: 340360 - DNA, 20 bp, Artificial Sequence
  chemically synthesized
aatcacattttggaaatagt

SEQ ID NO: 340361 - DNA, 20 bp, Artificial Sequence
  chemically synthesized
aaatagtaagatgtttgccc

SEQ ID NO: 340362 - DNA, 20 bp, Artificial Sequence
  chemically synthesized
aatagtaagatgtttgccct

SEQ ID NO: 340363 - DNA, 20 bp, Artificial Sequence
  chemically synthesized
aagatgtttgccctaggaat

SEQ ID NO: 340364 - DNA, 20 bp, Artificial Sequence
  chemically synthesized
ctactttaagcttattccta

SEQ ID NO: 340365 - DNA, 20 bp, Artificial Sequence
  chemically synthesized
actactttaagcttattcct

SEQ ID NO: 340366 - DNA, 20 bp, Artificial Sequence
  chemically synthesized
tactactttaagcttattcc

SEQ ID NO: 340367 - DNA, 20 bp, Artificial Sequence
  chemically synthesized
ttgccctaggaataagctta

SEQ ID NO: 340368 - DNA, 20 bp, Artificial Sequence
  chemically synthesized
ccctaggaataagcttaaag

SEQ ID NO: 340369 - DNA, 20 bp, Artificial Sequence
  chemically synthesized
gtcttatctcttactacttt

SEQ ID NO: 340370 - DNA, 20 bp, Artificial Sequence
  chemically synthesized
aggaataagcttaaagtagt

SEQ ID NO: 340371 - DNA, 20 bp, Artificial Sequence
  chemically synthesized
gaataagcttaaagtagtaa

SEQ ID NO: 340372 - DNA, 20 bp, Artificial Sequence
  chemically synthesized
agcttaaagtagtaagagat

SEQ ID NO: 340373 - DNA, 20 bp, Artificial Sequence
  chemically synthesized
gtagtaagagataagactaa

SEQ ID NO: 340374 - DNA, 20 bp, Artificial Sequence
  chemically synthesized
taagagataagactaaaaga

SEQ ID NO: 340375 - DNA, 20 bp, Artificial Sequence
  chemically synthesized
aagagataagactaaaagaa

SEQ ID NO: 340376 - DNA, 20 bp, Artificial Sequence
  chemically synthesized
tctagtcctgtcctttcttt

SEQ ID NO: 340377 - DNA, 20 bp, Artificial Sequence
  chemically synthesized
gataagactaaaagaaagga

SEQ ID NO: 340378 - DNA, 20 bp, Artificial Sequence
  chemically synthesized
ataagactaaaagaaaggac

SEQ ID NO: 340379 - DNA, 20 bp, Artificial Sequence
  chemically synthesized
actaaaagaaaggacaggac

SEQ ID NO: 340380 - DNA, 20 bp, Artificial Sequence
  chemically synthesized
aaagaaaggacaggactaga

SEQ ID NO: 340381 - DNA, 20 bp, Artificial Sequence
  chemically synthesized
aatatttttcataggctttc

SEQ ID NO: 340382 - DNA, 20 bp, Artificial Sequence
  chemically synthesized
tagttactaatatttttcat

SEQ ID NO: 340383 - DNA, 20 bp, Artificial Sequence
  chemically synthesized
gtagttactaatatttttca

SEQ ID NO: 340384 - DNA, 20 bp, Artificial Sequence
  chemically synthesized
agaaagcctatgaaaaatat

SEQ ID NO: 340385 - DNA, 20 bp, Artificial Sequence
  chemically synthesized
gaaaaatattagtaactact

SEQ ID NO: 340386 - DNA, 20 bp, Artificial Sequence
  chemically synthesized
atattagtaactactgagtt

SEQ ID NO: 340387 - DNA, 20 bp, Artificial Sequence
  chemically synthesized
attaaagattccaaactcag

SEQ ID NO: 340388 - DNA, 20 bp, Artificial Sequence
  chemically synthesized
tatattaaagattccaaact

SEQ ID NO: 340389 - DNA, 20 bp, Artificial Sequence
  chemically synthesized
tgagtttggaatctttaata

SEQ ID NO: 340390 - DNA, 20 bp, Artificial Sequence
  chemically synthesized
gagtttggaatctttaatat

SEQ ID NO: 340391 - DNA, 20 bp, Artificial Sequence
  chemically synthesized
ggctcccactacctatatta

SEQ ID NO: 340392 - DNA, 20 bp, Artificial Sequence
  chemically synthesized
tttggaatctttaatatagg

SEQ ID NO: 340393 - DNA, 20 bp, Artificial Sequence
  chemically synthesized
ggaatctttaatataggtag

SEQ ID NO: 340394 - DNA, 20 bp, Artificial Sequence
  chemically synthesized
gaatctttaatataggtagt

SEQ ID NO: 340395 - DNA, 20 bp, Artificial Sequence
  chemically synthesized
atctttaatataggtagtgg

SEQ ID NO: 340396 - DNA, 20 bp, Artificial Sequence
  chemically synthesized
tcattattcaaaatatttag

SEQ ID NO: 340397 - DNA, 20 bp, Artificial Sequence
  chemically synthesized
acttcattattcaaaatatt

SEQ ID NO: 340398 - DNA, 20 bp, Artificial Sequence
  chemically synthesized
actaaatattttgaataatg

SEQ ID NO: 340399 - DNA, 20 bp, Artificial Sequence
  chemically synthesized
atgaagttacatgatgaaat

SEQ ID NO: 340400 - DNA, 20 bp, Artificial Sequence
  chemically synthesized
gatgaaattagtattttatt

SEQ ID NO: 340401 - DNA, 20 bp, Artificial Sequence
  chemically synthesized
tgaaattagtattttattaa

SEQ ID NO: 340402 - DNA, 20 bp, Artificial Sequence
  chemically synthesized
ttagtattttattaagagtg

SEQ ID NO: 340403 - DNA, 20 bp, Artificial Sequence
  chemically synthesized
agtattttattaagagtgtg

SEQ ID NO: 340404 - DNA, 20 bp, Artificial Sequence
  chemically synthesized
gtattttattaagagtgtgg

SEQ ID NO: 340405 - DNA, 20 bp, Artificial Sequence
  chemically synthesized
atttgaatctattgaataca

SEQ ID NO: 340406 - DNA, 20 bp, Artificial Sequence
  chemically synthesized
tgtggaggctatgtattcaa

SEQ ID NO: 340407 - DNA, 20 bp, Artificial Sequence
  chemically synthesized
ttcaatagattcaaatatga

SEQ ID NO: 340408 - DNA, 20 bp, Artificial Sequence
  chemically synthesized
caatagattcaaatatgaaa

SEQ ID NO: 340409 - DNA, 20 bp, Artificial Sequence
  chemically synthesized
agattcaaatatgaaagaga

SEQ ID NO: 340410 - DNA, 20 bp, Artificial Sequence
  chemically synthesized
gattcaaatatgaaagagat

SEQ ID NO: 340411 - DNA, 20 bp, Artificial Sequence
  chemically synthesized
ttcaaatatgaaagagatgg

SEQ ID NO: 340412 - DNA, 20 bp, Artificial Sequence
  chemically synthesized
tatgaaagagatgggagata

SEQ ID NO: 340413 - DNA, 20 bp, Artificial Sequence
  chemically synthesized
tgggagatacagaaaatttt

SEQ ID NO: 340414 - DNA, 20 bp, Artificial Sequence
  chemically synthesized
tacagaaaattttcagccat

SEQ ID NO: 340415 - DNA, 20 bp, Artificial Sequence
  chemically synthesized
agaaaattttcagccatgag

SEQ ID NO: 340416 - DNA, 20 bp, Artificial Sequence
  chemically synthesized
tcctactctttttctgctca

SEQ ID NO: 340417 - DNA, 20 bp, Artificial Sequence
  chemically synthesized
ttttcagccatgagcagaaa

SEQ ID NO: 340418 - DNA, 20 bp, Artificial Sequence
  chemically synthesized
ttcagccatgagcagaaaaa

SEQ ID NO: 340419 - DNA, 20 bp, Artificial Sequence
  chemically synthesized
agccatgagcagaaaaagag

SEQ ID NO: 340420 - DNA, 20 bp, Artificial Sequence
  chemically synthesized
gccatgagcagaaaaagagt

SEQ ID NO: 340421 - DNA, 20 bp, Artificial Sequence
  chemically synthesized
gagcagaaaaagagtaggaa

SEQ ID NO: 340422 - DNA, 20 bp, Artificial Sequence
  chemically synthesized
gcagaaaaagagtaggaata

SEQ ID NO: 340423 - DNA, 20 bp, Artificial Sequence
  chemically synthesized
agagtaggaatagagcctac

SEQ ID NO: 340424 - DNA, 20 bp, Artificial Sequence
  chemically synthesized
gtaggaatagagcctaccag

SEQ ID NO: 340425 - DNA, 20 bp, Artificial Sequence
  chemically synthesized
taggaatagagcctaccagt

SEQ ID NO: 340426 - DNA, 20 bp, Artificial Sequence
  chemically synthesized
gttttaattttcccactggt

SEQ ID NO: 340427 - DNA, 20 bp, Artificial Sequence
  chemically synthesized
agttttaattttcccactgg

SEQ ID NO: 340428 - DNA, 20 bp, Artificial Sequence
  chemically synthesized
tcaagttttaattttcccac

SEQ ID NO: 340429 - DNA, 20 bp, Artificial Sequence
  chemically synthesized
aaaattaaaacttgaaatat

SEQ ID NO: 340430 - DNA, 20 bp, Artificial Sequence
  chemically synthesized
gatttctgatccaatatttc

SEQ ID NO: 340431 - DNA, 20 bp, Artificial Sequence
  chemically synthesized
taaaacttgaaatattggat

SEQ ID NO: 340432 - DNA, 20 bp, Artificial Sequence
  chemically synthesized
ttggatcagaaatctgattt

SEQ ID NO: 340433 - DNA, 20 bp, Artificial Sequence
  chemically synthesized
ggatcagaaatctgatttga

SEQ ID NO: 340434 - DNA, 20 bp, Artificial Sequence
  chemically synthesized
gatcagaaatctgatttgag

SEQ ID NO: 340435 - DNA, 20 bp, Artificial Sequence
  chemically synthesized
cttggctcctcctctcaaat

SEQ ID NO: 340436 - DNA, 20 bp, Artificial Sequence
  chemically synthesized
tcagaaatctgatttgagag

SEQ ID NO: 340437 - DNA, 20 bp, Artificial Sequence
  chemically synthesized
cagaaatctgatttgagagg

SEQ ID NO: 340438 - DNA, 20 bp, Artificial Sequence
  chemically synthesized
gaaatctgatttgagaggag

SEQ ID NO: 340439 - DNA, 20 bp, Artificial Sequence
  chemically synthesized
ctgatttgagaggaggagcc

SEQ ID NO: 340440 - DNA, 20 bp, Artificial Sequence
  chemically synthesized
tttgagaggaggagccaaga

SEQ ID NO: 340441 - DNA, 20 bp, Artificial Sequence
  chemically synthesized
ctgttcctattcggccatct

SEQ ID NO: 340442 - DNA, 20 bp, Artificial Sequence
  chemically synthesized
gaggagccaagatggccgaa

SEQ ID NO: 340443 - DNA, 20 bp, Artificial Sequence
  chemically synthesized
aggagccaagatggccgaat

SEQ ID NO: 340444 - DNA, 20 bp, Artificial Sequence
  chemically synthesized
agaccggagctgttcctatt

SEQ ID NO: 340445 - DNA, 20 bp, Artificial Sequence
  chemically synthesized
ccaagatggccgaataggaa

SEQ ID NO: 340446 - DNA, 20 bp, Artificial Sequence
  chemically synthesized
tggccgaataggaacagctc

SEQ ID NO: 340447 - DNA, 20 bp, Artificial Sequence
  chemically synthesized
ataggaacagctccggtcta

SEQ ID NO: 340448 - DNA, 20 bp, Artificial Sequence
  chemically synthesized
actctgggagctgtagaccg

SEQ ID NO: 340449 - DNA, 20 bp, Artificial Sequence
  chemically synthesized
tcactctgggagctgtagac

SEQ ID NO: 340450 - DNA, 20 bp, Artificial Sequence
  chemically synthesized
cagctccggtctacagctcc

SEQ ID NO: 340451 - DNA, 20 bp, Artificial Sequence
  chemically synthesized
gtcgctcactctgggagctg

SEQ ID NO: 340452 - DNA, 20 bp, Artificial Sequence
  chemically synthesized
gctccggtctacagctccca

SEQ ID NO: 340453 - DNA, 20 bp, Artificial Sequence
  chemically synthesized
cggtctacagctcccagagt

SEQ ID NO: 340454 - DNA, 20 bp, Artificial Sequence
  chemically synthesized
ttctgcgtcgctcactctgg

SEQ ID NO: 340455 - DNA, 20 bp, Artificial Sequence
  chemically synthesized
tcttctgcgtcgctcactct

SEQ ID NO: 340456 - DNA, 20 bp, Artificial Sequence
  chemically synthesized
gtcttctgcgtcgctcactc

SEQ ID NO: 340457 - DNA, 20 bp, Artificial Sequence
  chemically synthesized
agctcccagagtgagcgacg

SEQ ID NO: 340458 - DNA, 20 bp, Artificial Sequence
  chemically synthesized
tcccagagtgagcgacgcag

SEQ ID NO: 340459 - DNA, 20 bp, Artificial Sequence
  chemically synthesized
agagtgagcgacgcagaaga

SEQ ID NO: 340460 - DNA, 20 bp, Artificial Sequence
  chemically synthesized
gagtgagcgacgcagaagac

SEQ ID NO: 340461 - DNA, 20 bp, Artificial Sequence
  chemically synthesized
tggtacctcagatggaaatg

SEQ ID NO: 340462 - DNA, 20 bp, Artificial Sequence
  chemically synthesized
tgatttctgcatttccatct

SEQ ID NO: 340463 - DNA, 20 bp, Artificial Sequence
  chemically synthesized
gatttctgcatttccatctg

SEQ ID NO: 340464 - DNA, 20 bp, Artificial Sequence
  chemically synthesized
gatgaacctggtacctcaga

SEQ ID NO: 340465 - DNA, 20 bp, Artificial Sequence
  chemically synthesized
tgcatttccatctgaggtac

SEQ ID NO: 340466 - DNA, 20 bp, Artificial Sequence
  chemically synthesized
gcatttccatctgaggtacc

SEQ ID NO: 340467 - DNA, 20 bp, Artificial Sequence
  chemically synthesized
gtgagatgaacctggtacct

SEQ ID NO: 340468 - DNA, 20 bp, Artificial Sequence
  chemically synthesized
actccctagtgagatgaacc

SEQ ID NO: 340469 - DNA, 20 bp, Artificial Sequence
  chemically synthesized
aggtaccaggttcatctcac

SEQ ID NO: 340470 - DNA, 20 bp, Artificial Sequence
  chemically synthesized
ggtaccaggttcatctcact

SEQ ID NO: 340471 - DNA, 20 bp, Artificial Sequence
  chemically synthesized
gtaccaggttcatctcacta

SEQ ID NO: 340472 - DNA, 20 bp, Artificial Sequence
  chemically synthesized
accaggttcatctcactagg

SEQ ID NO: 340473 - DNA, 20 bp, Artificial Sequence
  chemically synthesized
actgtctggcactccctagt

SEQ ID NO: 340474 - DNA, 20 bp, Artificial Sequence
  chemically synthesized
gcccactgtctggcactccc

SEQ ID NO: 340475 - DNA, 20 bp, Artificial Sequence
  chemically synthesized
ttcatctcactagggagtgc

SEQ ID NO: 340476 - DNA, 20 bp, Artificial Sequence
  chemically synthesized
tctcactagggagtgccaga

SEQ ID NO: 340477 - DNA, 20 bp, Artificial Sequence
  chemically synthesized
cactagggagtgccagacag

SEQ ID NO: 340478 - DNA, 20 bp, Artificial Sequence
  chemically synthesized
actagggagtgccagacagt

SEQ ID NO: 340479 - DNA, 20 bp, Artificial Sequence
  chemically synthesized
actgagctgcgcccactgtc

SEQ ID NO: 340480 - DNA, 20 bp, Artificial Sequence
  chemically synthesized
ggagtgccagacagtgggcg

SEQ ID NO: 340481 - DNA, 20 bp, Artificial Sequence
  chemically synthesized
gccagacagtgggcgcagct

SEQ ID NO: 340482 - DNA, 20 bp, Artificial Sequence
  chemically synthesized
agacagtgggcgcagctcag

SEQ ID NO: 340483 - DNA, 20 bp, Artificial Sequence
  chemically synthesized
gacagtgggcgcagctcagt

SEQ ID NO: 340484 - DNA, 20 bp, Artificial Sequence
  chemically synthesized
gcacggtgcacgcacccact

SEQ ID NO: 340485 - DNA, 20 bp, Artificial Sequence
  chemically synthesized
accctgcttcgggtcgcgca

SEQ ID NO: 340486 - DNA, 20 bp, Artificial Sequence
  chemically synthesized
cgtgcaccgtgcgcgacccg

SEQ ID NO: 340487 - DNA, 20 bp, Artificial Sequence
  chemically synthesized
gcaccgtgcgcgacccgaag

SEQ ID NO: 340488 - DNA, 20 bp, Artificial Sequence
  chemically synthesized
caccgtgcgcgacccgaagc

SEQ ID NO: 340489 - DNA, 20 bp, Artificial Sequence
  chemically synthesized
accgtgcgcgacccgaagca

SEQ ID NO: 340490 - DNA, 20 bp, Artificial Sequence
  chemically synthesized
gcaatgcctcaccctgcttc

SEQ ID NO: 340491 - DNA, 20 bp, Artificial Sequence
  chemically synthesized
ggcaatgcctcaccctgctt

SEQ ID NO: 340492 - DNA, 20 bp, Artificial Sequence
  chemically synthesized
tgcgcgacccgaagcagggt

SEQ ID NO: 340493 - DNA, 20 bp, Artificial Sequence
  chemically synthesized
gcgcgacccgaagcagggtg

SEQ ID NO: 340494 - DNA, 20 bp, Artificial Sequence
  chemically synthesized
gggtgaggcattgcctcact

SEQ ID NO: 340495 - DNA, 20 bp, Artificial Sequence
  chemically synthesized
ggtgaggcattgcctcactc

SEQ ID NO: 340496 - DNA, 20 bp, Artificial Sequence
  chemically synthesized
ccccttgcacttcccgagtg

SEQ ID NO: 340497 - DNA, 20 bp, Artificial Sequence
  chemically synthesized
gaggcattgcctcactcggg

SEQ ID NO: 340498 - DNA, 20 bp, Artificial Sequence
  chemically synthesized
accccttgcacttcccgagt

SEQ ID NO: 340499 - DNA, 20 bp, Artificial Sequence
  chemically synthesized
cctgaccccttgcacttccc

SEQ ID NO: 340500 - DNA, 20 bp, Artificial Sequence
  chemically synthesized
ttgcctcactcgggaagtgc

SEQ ID NO: 340501 - DNA, 20 bp, Artificial Sequence
  chemically synthesized
tgcctcactcgggaagtgca

SEQ ID NO: 340502 - DNA, 20 bp, Artificial Sequence
  chemically synthesized
gcctcactcgggaagtgcaa

SEQ ID NO: 340503 - DNA, 20 bp, Artificial Sequence
  chemically synthesized
cctcactcgggaagtgcaag

SEQ ID NO: 340504 - DNA, 20 bp, Artificial Sequence
  chemically synthesized
actcgggaagtgcaaggggt

SEQ ID NO: 340505 - DNA, 20 bp, Artificial Sequence
  chemically synthesized
ctcgggaagtgcaaggggtc

SEQ ID NO: 340506 - DNA, 20 bp, Artificial Sequence
  chemically synthesized
tcgggaagtgcaaggggtca

SEQ ID NO: 340507 - DNA, 20 bp, Artificial Sequence
  chemically synthesized
gggaagtgcaaggggtcagg

SEQ ID NO: 340508 - DNA, 20 bp, Artificial Sequence
  chemically synthesized
ggtcagggagttccctttcc

SEQ ID NO: 340509 - DNA, 20 bp, Artificial Sequence
  chemically synthesized
ccctttctttgactaggaaa

SEQ ID NO: 340510 - DNA, 20 bp, Artificial Sequence
  chemically synthesized
cccctttctttgactaggaa

SEQ ID NO: 340511 - DNA, 20 bp, Artificial Sequence
  chemically synthesized
acccctttctttgactagga

SEQ ID NO: 340512 - DNA, 20 bp, Artificial Sequence
  chemically synthesized
ggagttccctttcctagtca

SEQ ID NO: 340513 - DNA, 20 bp, Artificial Sequence
  chemically synthesized
cgtcacccctttctttgact

SEQ ID NO: 340514 - DNA, 20 bp, Artificial Sequence
  chemically synthesized
ccgtcacccctttctttgac

SEQ ID NO: 340515 - DNA, 20 bp, Artificial Sequence
  chemically synthesized
ttccctttcctagtcaaaga

SEQ ID NO: 340516 - DNA, 20 bp, Artificial Sequence
  chemically synthesized
tccctttcctagtcaaagaa

SEQ ID NO: 340517 - DNA, 20 bp, Artificial Sequence
  chemically synthesized
ccctttcctagtcaaagaaa

SEQ ID NO: 340518 - DNA, 20 bp, Artificial Sequence
  chemically synthesized
cctttcctagtcaaagaaag

SEQ ID NO: 340519 - DNA, 20 bp, Artificial Sequence
  chemically synthesized
ctagtcaaagaaaggggtga

SEQ ID NO: 340520 - DNA, 20 bp, Artificial Sequence
  chemically synthesized
tcaaagaaaggggtgacgga

SEQ ID NO: 340521 - DNA, 20 bp, Artificial Sequence
  chemically synthesized
aaggggtgacggacagcacc

SEQ ID NO: 340522 - DNA, 20 bp, Artificial Sequence
  chemically synthesized
acggacagcacctggaaaat

SEQ ID NO: 340523 - DNA, 20 bp, Artificial Sequence
  chemically synthesized
tgggtgtgacccgattttcc

SEQ ID NO: 340524 - DNA, 20 bp, Artificial Sequence
  chemically synthesized
cggacagcacctggaaaatc

SEQ ID NO: 340525 - DNA, 20 bp, Artificial Sequence
  chemically synthesized
gtgggtgtgacccgattttc

SEQ ID NO: 340526 - DNA, 20 bp, Artificial Sequence
  chemically synthesized
gaaacacgcagtattcgggt

SEQ ID NO: 340527 - DNA, 20 bp, Artificial Sequence
  chemically synthesized
ggaaacacgcagtattcggg

SEQ ID NO: 340528 - DNA, 20 bp, Artificial Sequence
  chemically synthesized
gtcggaaacacgcagtattc

SEQ ID NO: 340529 - DNA, 20 bp, Artificial Sequence
  chemically synthesized
cgtcggaaacacgcagtatt

SEQ ID NO: 340530 - DNA, 20 bp, Artificial Sequence
  chemically synthesized
ttaagcccgtcggaaacacg

SEQ ID NO: 340531 - DNA, 20 bp, Artificial Sequence
  chemically synthesized
cgaatactgcgtgtttccga

SEQ ID NO: 340532 - DNA, 20 bp, Artificial Sequence
  chemically synthesized
gaatactgcgtgtttccgac

SEQ ID NO: 340533 - DNA, 20 bp, Artificial Sequence
  chemically synthesized
gtgccgttttttaagcccgt

SEQ ID NO: 340534 - DNA, 20 bp, Artificial Sequence
  chemically synthesized
tttccgacgggcttaaaaaa

SEQ ID NO: 340535 - DNA, 20 bp, Artificial Sequence
  chemically synthesized
ctcctggtgtgccgtttttt

SEQ ID NO: 340536 - DNA, 20 bp, Artificial Sequence
  chemically synthesized
gggcttaaaaaacggcacac

SEQ ID NO: 340537 - DNA, 20 bp, Artificial Sequence
  chemically synthesized
ggcttaaaaaacggcacacc

SEQ ID NO: 340538 - DNA, 20 bp, Artificial Sequence
  chemically synthesized
cttaaaaaacggcacaccag

SEQ ID NO: 340539 - DNA, 20 bp, Artificial Sequence
  chemically synthesized
agatgcaggatataatctcc

SEQ ID NO: 340540 - DNA, 20 bp, Artificial Sequence
  chemically synthesized
aggagattatatcctgcatc

SEQ ID NO: 340541 - DNA, 20 bp, Artificial Sequence
  chemically synthesized
ggaccctccgagccagatgc

SEQ ID NO: 340542 - DNA, 20 bp, Artificial Sequence
  chemically synthesized
aggaccctccgagccagatg

SEQ ID NO: 340543 - DNA, 20 bp, Artificial Sequence
  chemically synthesized
attatatcctgcatctggct

SEQ ID NO: 340544 - DNA, 20 bp, Artificial Sequence
  chemically synthesized
tatatcctgcatctggctcg

SEQ ID NO: 340545 - DNA, 20 bp, Artificial Sequence
  chemically synthesized
atatcctgcatctggctcgg

SEQ ID NO: 340546 - DNA, 20 bp, Artificial Sequence
  chemically synthesized
tatcctgcatctggctcgga

SEQ ID NO: 340547 - DNA, 20 bp, Artificial Sequence
  chemically synthesized
tggggtaggaccctccgagc

SEQ ID NO: 340548 - DNA, 20 bp, Artificial Sequence
  chemically synthesized
ccgttggggtaggaccctcc

SEQ ID NO: 340549 - DNA, 20 bp, Artificial Sequence
  chemically synthesized
ctcggagggtcctaccccaa

SEQ ID NO: 340550 - DNA, 20 bp, Artificial Sequence
  chemically synthesized
cagcgagattccgttggggt

SEQ ID NO: 340551 - DNA, 20 bp, Artificial Sequence
  chemically synthesized
tcagcgagattccgttgggg

SEQ ID NO: 340552 - DNA, 20 bp, Artificial Sequence
  chemically synthesized
caatcagcgagattccgttg

SEQ ID NO: 340553 - DNA, 20 bp, Artificial Sequence
  chemically synthesized
gcaatcagcgagattccgtt

SEQ ID NO: 340554 - DNA, 20 bp, Artificial Sequence
  chemically synthesized
agcaatcagcgagattccgt

SEQ ID NO: 340555 - DNA, 20 bp, Artificial Sequence
  chemically synthesized
ctgctgtgctagcaatcagc

SEQ ID NO: 340556 - DNA, 20 bp, Artificial Sequence
  chemically synthesized
aacggaatctcgctgattgc

SEQ ID NO: 340557 - DNA, 20 bp, Artificial Sequence
  chemically synthesized
cagactgctgtgctagcaat

SEQ ID NO: 340558 - DNA, 20 bp, Artificial Sequence
  chemically synthesized
aatctcgctgattgctagca

SEQ ID NO: 340559 - DNA, 20 bp, Artificial Sequence
  chemically synthesized
ctcgctgattgctagcacag

SEQ ID NO: 340560 - DNA, 20 bp, Artificial Sequence
  chemically synthesized
ttgatctcagactgctgtgc

SEQ ID NO: 340561 - DNA, 20 bp, Artificial Sequence
  chemically synthesized
gattgctagcacagcagtct

SEQ ID NO: 340562 - DNA, 20 bp, Artificial Sequence
  chemically synthesized
gccaccttgcagtttgatct

SEQ ID NO: 340563 - DNA, 20 bp, Artificial Sequence
  chemically synthesized
gcagtctgagatcaaactgc

SEQ ID NO: 340564 - DNA, 20 bp, Artificial Sequence
  chemically synthesized
cagtctgagatcaaactgca

SEQ ID NO: 340565 - DNA, 20 bp, Artificial Sequence
  chemically synthesized
tctgagatcaaactgcaagg

SEQ ID NO: 340566 - DNA, 20 bp, Artificial Sequence
  chemically synthesized
ccagccttgctgccaccttg

SEQ ID NO: 340567 - DNA, 20 bp, Artificial Sequence
  chemically synthesized
gagatcaaactgcaaggtgg

SEQ ID NO: 340568 - DNA, 20 bp, Artificial Sequence
  chemically synthesized
tcaaactgcaaggtggcagc

SEQ ID NO: 340569 - DNA, 20 bp, Artificial Sequence
  chemically synthesized
caaactgcaaggtggcagca

SEQ ID NO: 340570 - DNA, 20 bp, Artificial Sequence
  chemically synthesized
ctgcaaggtggcagcaaggc

SEQ ID NO: 340571 - DNA, 20 bp, Artificial Sequence
  chemically synthesized
tgcaaggtggcagcaaggct

SEQ ID NO: 340572 - DNA, 20 bp, Artificial Sequence
  chemically synthesized
gcaaggtggcagcaaggctg

SEQ ID NO: 340573 - DNA, 20 bp, Artificial Sequence
  chemically synthesized
caaggtggcagcaaggctgg

SEQ ID NO: 340574 - DNA, 20 bp, Artificial Sequence
  chemically synthesized
aggtggcagcaaggctgggg

SEQ ID NO: 340575 - DNA, 20 bp, Artificial Sequence
  chemically synthesized
ggtggcagcaaggctggggg

SEQ ID NO: 340576 - DNA, 20 bp, Artificial Sequence
  chemically synthesized
gtggcagcaaggctggggga

SEQ ID NO: 340577 - DNA, 20 bp, Artificial Sequence
  chemically synthesized
tggcagcaaggctgggggag

SEQ ID NO: 340578 - DNA, 20 bp, Artificial Sequence
  chemically synthesized
aatggcgggtgcccctcccc

SEQ ID NO: 340579 - DNA, 20 bp, Artificial Sequence
  chemically synthesized
aatcaagcctaggcaatggc

SEQ ID NO: 340580 - DNA, 20 bp, Artificial Sequence
  chemically synthesized
taatcaagcctaggcaatgg

SEQ ID NO: 340581 - DNA, 20 bp, Artificial Sequence
  chemically synthesized
gaggggcacccgccattgcc

SEQ ID NO: 340582 - DNA, 20 bp, Artificial Sequence
  chemically synthesized
aggggcacccgccattgcct

SEQ ID NO: 340583 - DNA, 20 bp, Artificial Sequence
  chemically synthesized
acctaatcaagcctaggcaa

SEQ ID NO: 340584 - DNA, 20 bp, Artificial Sequence
  chemically synthesized
ttgtttacctaatcaagcct

SEQ ID NO: 340585 - DNA, 20 bp, Artificial Sequence
  chemically synthesized
tttgtttacctaatcaagcc

SEQ ID NO: 340586 - DNA, 20 bp, Artificial Sequence
  chemically synthesized
cgccattgcctaggcttgat

SEQ ID NO: 340587 - DNA, 20 bp, Artificial Sequence
  chemically synthesized
gccattgcctaggcttgatt

SEQ ID NO: 340588 - DNA, 20 bp, Artificial Sequence
  chemically synthesized
gctgctttgtttacctaatc

SEQ ID NO: 340589 - DNA, 20 bp, Artificial Sequence
  chemically synthesized
taggcttgattaggtaaaca

SEQ ID NO: 340590 - DNA, 20 bp, Artificial Sequence
  chemically synthesized
gcttgattaggtaaacaaag

SEQ ID NO: 340591 - DNA, 20 bp, Artificial Sequence
  chemically synthesized
gattaggtaaacaaagcagc

SEQ ID NO: 340592 - DNA, 20 bp, Artificial Sequence
  chemically synthesized
attaggtaaacaaagcagct

SEQ ID NO: 340593 - DNA, 20 bp, Artificial Sequence
  chemically synthesized
aggtaaacaaagcagctggg

SEQ ID NO: 340594 - DNA, 20 bp, Artificial Sequence
  chemically synthesized
tccacccagttcaagcttcc

SEQ ID NO: 340595 - DNA, 20 bp, Artificial Sequence
  chemically synthesized
agcagctgggaagcttgaac

SEQ ID NO: 340596 - DNA, 20 bp, Artificial Sequence
  chemically synthesized
gcagctgggaagcttgaact

SEQ ID NO: 340597 - DNA, 20 bp, Artificial Sequence
  chemically synthesized
tggtgggctccacccagttc

SEQ ID NO: 340598 - DNA, 20 bp, Artificial Sequence
  chemically synthesized
gctgggaagcttgaactggg

SEQ ID NO: 340599 - DNA, 20 bp, Artificial Sequence
  chemically synthesized
tgggaagcttgaactgggtg

SEQ ID NO: 340600 - DNA, 20 bp, Artificial Sequence
  chemically synthesized
gagttgtggtgggctccacc

SEQ ID NO: 340601 - DNA, 20 bp, Artificial Sequence
  chemically synthesized
aggcctccttgagttgtggt

SEQ ID NO: 340602 - DNA, 20 bp, Artificial Sequence
  chemically synthesized
caggcctccttgagttgtgg

SEQ ID NO: 340603 - DNA, 20 bp, Artificial Sequence
  chemically synthesized
ggtggagcccaccacaactc

SEQ ID NO: 340604 - DNA, 20 bp, Artificial Sequence
  chemically synthesized
gtggagcccaccacaactca

SEQ ID NO: 340605 - DNA, 20 bp, Artificial Sequence
  chemically synthesized
aggcaggcctccttgagttg

SEQ ID NO: 340606 - DNA, 20 bp, Artificial Sequence
  chemically synthesized
ggagcccaccacaactcaag

SEQ ID NO: 340607 - DNA, 20 bp, Artificial Sequence
  chemically synthesized
gagcccaccacaactcaagg

SEQ ID NO: 340608 - DNA, 20 bp, Artificial Sequence
  chemically synthesized
agaggcaggcaggcctcctt

SEQ ID NO: 340609 - DNA, 20 bp, Artificial Sequence
  chemically synthesized
tggagcctacagaggcaggc

SEQ ID NO: 340610 - DNA, 20 bp, Artificial Sequence
  chemically synthesized
gtggagcctacagaggcagg

SEQ ID NO: 340611 - DNA, 20 bp, Artificial Sequence
  chemically synthesized
aggaggcctgcctgcctctg

SEQ ID NO: 340612 - DNA, 20 bp, Artificial Sequence
  chemically synthesized
gaggtggagcctacagaggc

SEQ ID NO: 340613 - DNA, 20 bp, Artificial Sequence
  chemically synthesized
ggaggcctgcctgcctctgt

SEQ ID NO: 340614 - DNA, 20 bp, Artificial Sequence
  chemically synthesized
agaggtggagcctacagagg

SEQ ID NO: 340615 - DNA, 20 bp, Artificial Sequence
  chemically synthesized
ctcagaggtggagcctacag

SEQ ID NO: 340616 - DNA, 20 bp, Artificial Sequence
  chemically synthesized
cctcagaggtggagcctaca

SEQ ID NO: 340617 - DNA, 20 bp, Artificial Sequence
  chemically synthesized
gccctcagaggtggagccta

SEQ ID NO: 340618 - DNA, 20 bp, Artificial Sequence
  chemically synthesized
cctctgtaggctccacctct

SEQ ID NO: 340619 - DNA, 20 bp, Artificial Sequence
  chemically synthesized
gtgccctgccctcagaggtg

SEQ ID NO: 340620 - DNA, 20 bp, Artificial Sequence
  chemically synthesized
ctctgtaggctccacctctg

SEQ ID NO: 340621 - DNA, 20 bp, Artificial Sequence
  chemically synthesized
tctgtaggctccacctctga

SEQ ID NO: 340622 - DNA, 20 bp, Artificial Sequence
  chemically synthesized
ctgtgccctgccctcagagg

SEQ ID NO: 340623 - DNA, 20 bp, Artificial Sequence
  chemically synthesized
gtaggctccacctctgaggg

SEQ ID NO: 340624 - DNA, 20 bp, Artificial Sequence
  chemically synthesized
tgtctgtgccctgccctcag

SEQ ID NO: 340625 - DNA, 20 bp, Artificial Sequence
  chemically synthesized
taggctccacctctgagggc

SEQ ID NO: 340626 - DNA, 20 bp, Artificial Sequence
  chemically synthesized
ttgtctgtgccctgccctca

SEQ ID NO: 340627 - DNA, 20 bp, Artificial Sequence
  chemically synthesized
aggctccacctctgagggca

SEQ ID NO: 340628 - DNA, 20 bp, Artificial Sequence
  chemically synthesized
gtttgtctgtgccctgccct

SEQ ID NO: 340629 - DNA, 20 bp, Artificial Sequence
  chemically synthesized
ccacctctgagggcagggca

SEQ ID NO: 340630 - DNA, 20 bp, Artificial Sequence
  chemically synthesized
gcagggcacagacaaacaaa

SEQ ID NO: 340631 - DNA, 20 bp, Artificial Sequence
  chemically synthesized
ggcacagacaaacaaaaaga

SEQ ID NO: 340632 - DNA, 20 bp, Artificial Sequence
  chemically synthesized
acagacaaacaaaaagacag

SEQ ID NO: 340633 - DNA, 20 bp, Artificial Sequence
  chemically synthesized
aaagacagcagtaacctctg

SEQ ID NO: 340634 - DNA, 20 bp, Artificial Sequence
  chemically synthesized
agggatatttaaatctgcag

SEQ ID NO: 340635 - DNA, 20 bp, Artificial Sequence
  chemically synthesized
cagggatatttaaatctgca

SEQ ID NO: 340636 - DNA, 20 bp, Artificial Sequence
  chemically synthesized
gacagggatatttaaatctg

SEQ ID NO: 340637 - DNA, 20 bp, Artificial Sequence
  chemically synthesized
atttaaatatccctgtctga

SEQ ID NO: 340638 - DNA, 20 bp, Artificial Sequence
  chemically synthesized
ctcttcaaagctgtcagaca

SEQ ID NO: 340639 - DNA, 20 bp, Artificial Sequence
  chemically synthesized
tctcttcaaagctgtcagac

SEQ ID NO: 340640 - DNA, 20 bp, Artificial Sequence
  chemically synthesized
ctctcttcaaagctgtcaga

SEQ ID NO: 340641 - DNA, 20 bp, Artificial Sequence
  chemically synthesized
actgctctcttcaaagctgt

SEQ ID NO: 340642 - DNA, 20 bp, Artificial Sequence
  chemically synthesized
atccctgtctgacagctttg

SEQ ID NO: 340643 - DNA, 20 bp, Artificial Sequence
  chemically synthesized
ccctgtctgacagctttgaa

SEQ ID NO: 340644 - DNA, 20 bp, Artificial Sequence
  chemically synthesized
ctgtctgacagctttgaaga

SEQ ID NO: 340645 - DNA, 20 bp, Artificial Sequence
  chemically synthesized
gagaaccactgctctcttca

SEQ ID NO: 340646 - DNA, 20 bp, Artificial Sequence
  chemically synthesized
tctgacagctttgaagagag

SEQ ID NO: 340647 - DNA, 20 bp, Artificial Sequence
  chemically synthesized
gacagctttgaagagagcag

SEQ ID NO: 340648 - DNA, 20 bp, Artificial Sequence
  chemically synthesized
gaagagagcagtggttctcc

SEQ ID NO: 340649 - DNA, 20 bp, Artificial Sequence
  chemically synthesized
gatctccagctgcgtactgg

SEQ ID NO: 340650 - DNA, 20 bp, Artificial Sequence
  chemically synthesized
gcagtggttctcccagtacg

SEQ ID NO: 340651 - DNA, 20 bp, Artificial Sequence
  chemically synthesized
cagatctccagctgcgtact

SEQ ID NO: 340652 - DNA, 20 bp, Artificial Sequence
  chemically synthesized
tcagatctccagctgcgtac

SEQ ID NO: 340653 - DNA, 20 bp, Artificial Sequence
  chemically synthesized
tggttctcccagtacgcagc

SEQ ID NO: 340654 - DNA, 20 bp, Artificial Sequence
  chemically synthesized
gttctcccagtacgcagctg

SEQ ID NO: 340655 - DNA, 20 bp, Artificial Sequence
  chemically synthesized
cagtacgcagctggagatct

SEQ ID NO: 340656 - DNA, 20 bp, Artificial Sequence
  chemically synthesized
tctgccccttctcagatctc

SEQ ID NO: 340657 - DNA, 20 bp, Artificial Sequence
  chemically synthesized
tacgcagctggagatctgag

SEQ ID NO: 340658 - DNA, 20 bp, Artificial Sequence
  chemically synthesized
acgcagctggagatctgaga

SEQ ID NO: 340659 - DNA, 20 bp, Artificial Sequence
  chemically synthesized
cgcagctggagatctgagaa

SEQ ID NO: 340660 - DNA, 20 bp, Artificial Sequence
  chemically synthesized
gcagctggagatctgagaag

SEQ ID NO: 340661 - DNA, 20 bp, Artificial Sequence
  chemically synthesized
ggaggcagtctgccccttct

SEQ ID NO: 340662 - DNA, 20 bp, Artificial Sequence
  chemically synthesized
gctggagatctgagaagggg

SEQ ID NO: 340663 - DNA, 20 bp, Artificial Sequence
  chemically synthesized
aaggggcagactgcctcctc

SEQ ID NO: 340664 - DNA, 20 bp, Artificial Sequence
  chemically synthesized
caggcacccacttgaggagg

SEQ ID NO: 340665 - DNA, 20 bp, Artificial Sequence
  chemically synthesized
gggcagactgcctcctcaag

SEQ ID NO: 340666 - DNA, 20 bp, Artificial Sequence
  chemically synthesized
ggtcaggcacccacttgagg

SEQ ID NO: 340667 - DNA, 20 bp, Artificial Sequence
  chemically synthesized
ggcagactgcctcctcaagt

SEQ ID NO: 340668 - DNA, 20 bp, Artificial Sequence
  chemically synthesized
gggtcaggcacccacttgag

SEQ ID NO: 340669 - DNA, 20 bp, Artificial Sequence
  chemically synthesized
aggggtcaggcacccacttg

SEQ ID NO: 340670 - DNA, 20 bp, Artificial Sequence
  chemically synthesized
caggggtcaggcacccactt

SEQ ID NO: 340671 - DNA, 20 bp, Artificial Sequence
  chemically synthesized
gtgctcgggggtcaggggtc

SEQ ID NO: 340672 - DNA, 20 bp, Artificial Sequence
  chemically synthesized
ggtgctcgggggtcaggggt

SEQ ID NO: 340673 - DNA, 20 bp, Artificial Sequence
  chemically synthesized
ttagggtgctcgggggtcag

SEQ ID NO: 340674 - DNA, 20 bp, Artificial Sequence
  chemically synthesized
gttagggtgctcgggggtca

SEQ ID NO: 340675 - DNA, 20 bp, Artificial Sequence
  chemically synthesized
gtgcctgacccctgaccccc

SEQ ID NO: 340676 - DNA, 20 bp, Artificial Sequence
  chemically synthesized
agttagggtgctcgggggtc

SEQ ID NO: 340677 - DNA, 20 bp, Artificial Sequence
  chemically synthesized
cagttagggtgctcgggggt

SEQ ID NO: 340678 - DNA, 20 bp, Artificial Sequence
  chemically synthesized
ctcccagttagggtgctcgg

SEQ ID NO: 340679 - DNA, 20 bp, Artificial Sequence
  chemically synthesized
cctcccagttagggtgctcg

SEQ ID NO: 340680 - DNA, 20 bp, Artificial Sequence
  chemically synthesized
gcctcccagttagggtgctc

SEQ ID NO: 340681 - DNA, 20 bp, Artificial Sequence
  chemically synthesized
tgcctcccagttagggtgct

SEQ ID NO: 340682 - DNA, 20 bp, Artificial Sequence
  chemically synthesized
tgacccccgagcaccctaac

SEQ ID NO: 340683 - DNA, 20 bp, Artificial Sequence
  chemically synthesized
gacccccgagcaccctaact

SEQ ID NO: 340684 - DNA, 20 bp, Artificial Sequence
  chemically synthesized
cccccgagcaccctaactgg

SEQ ID NO: 340685 - DNA, 20 bp, Artificial Sequence
  chemically synthesized
tggggagtgcctcccagtta

SEQ ID NO: 340686 - DNA, 20 bp, Artificial Sequence
  chemically synthesized
ccccgagcaccctaactggg

SEQ ID NO: 340687 - DNA, 20 bp, Artificial Sequence
  chemically synthesized
ttggggagtgcctcccagtt

SEQ ID NO: 340688 - DNA, 20 bp, Artificial Sequence
  chemically synthesized
tttggggagtgcctcccagt

SEQ ID NO: 340689 - DNA, 20 bp, Artificial Sequence
  chemically synthesized
cccttttggggagtgcctcc

SEQ ID NO: 340690 - DNA, 20 bp, Artificial Sequence
  chemically synthesized
aactgggaggcactccccaa

SEQ ID NO: 340691 - DNA, 20 bp, Artificial Sequence
  chemically synthesized
actgggaggcactccccaaa

SEQ ID NO: 340692 - DNA, 20 bp, Artificial Sequence
  chemically synthesized
ctgggaggcactccccaaaa

SEQ ID NO: 340693 - DNA, 20 bp, Artificial Sequence
  chemically synthesized
gtcagtatgccccttttggg

SEQ ID NO: 340694 - DNA, 20 bp, Artificial Sequence
  chemically synthesized
tgggaggcactccccaaaag

SEQ ID NO: 340695 - DNA, 20 bp, Artificial Sequence
  chemically synthesized
gtgtcagtatgccccttttg

SEQ ID NO: 340696 - DNA, 20 bp, Artificial Sequence
  chemically synthesized
ggtgtcagtatgcccctttt

SEQ ID NO: 340697 - DNA, 20 bp, Artificial Sequence
  chemically synthesized
aggtgtcagtatgccccttt

SEQ ID NO: 340698 - DNA, 20 bp, Artificial Sequence
  chemically synthesized
taccctgccgtgtgaggtgt

SEQ ID NO: 340699 - DNA, 20 bp, Artificial Sequence
  chemically synthesized
gggcatactgacacctcaca

SEQ ID NO: 340700 - DNA, 20 bp, Artificial Sequence
  chemically synthesized
catactgacacctcacacgg

SEQ ID NO: 340701 - DNA, 20 bp, Artificial Sequence
  chemically synthesized
ttggagtaccctgccgtgtg

SEQ ID NO: 340702 - DNA, 20 bp, Artificial Sequence
  chemically synthesized
atactgacacctcacacggc

SEQ ID NO: 340703 - DNA, 20 bp, Artificial Sequence
  chemically synthesized
gttggagtaccctgccgtgt

SEQ ID NO: 340704 - DNA, 20 bp, Artificial Sequence
  chemically synthesized
tactgacacctcacacggca

SEQ ID NO: 340705 - DNA, 20 bp, Artificial Sequence
  chemically synthesized
cacacggcagggtactccaa

SEQ ID NO: 340706 - DNA, 20 bp, Artificial Sequence
  chemically synthesized
cctcagctgcaggtctgttg

SEQ ID NO: 340707 - DNA, 20 bp, Artificial Sequence
  chemically synthesized
accctcagctgcaggtctgt

SEQ ID NO: 340708 - DNA, 20 bp, Artificial Sequence
  chemically synthesized
agggtactccaacagacctg

SEQ ID NO: 340709 - DNA, 20 bp, Artificial Sequence
  chemically synthesized
actccaacagacctgcagct

SEQ ID NO: 340710 - DNA, 20 bp, Artificial Sequence
  chemically synthesized
ctccaacagacctgcagctg

SEQ ID NO: 340711 - DNA, 20 bp, Artificial Sequence
  chemically synthesized
cagacaggaccctcagctgc

SEQ ID NO: 340712 - DNA, 20 bp, Artificial Sequence
  chemically synthesized
tccaacagacctgcagctga

SEQ ID NO: 340713 - DNA, 20 bp, Artificial Sequence
  chemically synthesized
acagacaggaccctcagctg

SEQ ID NO: 340714 - DNA, 20 bp, Artificial Sequence
  chemically synthesized
cttctaacagacaggaccct

SEQ ID NO: 340715 - DNA, 20 bp, Artificial Sequence
  chemically synthesized
cagctgagggtcctgtctgt

SEQ ID NO: 340716 - DNA, 20 bp, Artificial Sequence
  chemically synthesized
tagttttccttctaacagac

SEQ ID NO: 340717 - DNA, 20 bp, Artificial Sequence
  chemically synthesized
ttagttttccttctaacaga

SEQ ID NO: 340718 - DNA, 20 bp, Artificial Sequence
  chemically synthesized
ctgagggtcctgtctgttag

SEQ ID NO: 340719 - DNA, 20 bp, Artificial Sequence
  chemically synthesized
tgagggtcctgtctgttaga

SEQ ID NO: 340720 - DNA, 20 bp, Artificial Sequence
  chemically synthesized
tttgttagttttccttctaa

SEQ ID NO: 340721 - DNA, 20 bp, Artificial Sequence
  chemically synthesized
ttagaaggaaaactaacaaa

SEQ ID NO: 340722 - DNA, 20 bp, Artificial Sequence
  chemically synthesized
tggatgtcctttctgtttgt

SEQ ID NO: 340723 - DNA, 20 bp, Artificial Sequence
  chemically synthesized
aaggaaaactaacaaacaga

SEQ ID NO: 340724 - DNA, 20 bp, Artificial Sequence
  chemically synthesized
aggaaaactaacaaacagaa

SEQ ID NO: 340725 - DNA, 20 bp, Artificial Sequence
  chemically synthesized
gtccagatgggttttttgtg

SEQ ID NO: 340726 - DNA, 20 bp, Artificial Sequence
  chemically synthesized
atccacacaaaaaacccatc

SEQ ID NO: 340727 - DNA, 20 bp, Artificial Sequence
  chemically synthesized
gatgatggtgacgtccagat

SEQ ID NO: 340728 - DNA, 20 bp, Artificial Sequence
  chemically synthesized
tgatgatggtgacgtccaga

SEQ ID NO: 340729 - DNA, 20 bp, Artificial Sequence
  chemically synthesized
actttgatgatggtgacgtc

SEQ ID NO: 340730 - DNA, 20 bp, Artificial Sequence
  chemically synthesized
tctggacgtcaccatcatca

SEQ ID NO: 340731 - DNA, 20 bp, Artificial Sequence
  chemically synthesized
ctacttttggactttgatga

SEQ ID NO: 340732 - DNA, 20 bp, Artificial Sequence
  chemically synthesized
tcaccatcatcaaagtccaa

SEQ ID NO: 340733 - DNA, 20 bp, Artificial Sequence
  chemically synthesized
ccatcatcaaagtccaaaag

SEQ ID NO: 340734 - DNA, 20 bp, Artificial Sequence
  chemically synthesized
tttgtggttttatctacttt

SEQ ID NO: 340735 - DNA, 20 bp, Artificial Sequence
  chemically synthesized
caaaagtagataaaaccaca

SEQ ID NO: 340736 - DNA, 20 bp, Artificial Sequence
  chemically synthesized
agtagataaaaccacaaaga

SEQ ID NO: 340737 - DNA, 20 bp, Artificial Sequence
  chemically synthesized
gtagataaaaccacaaagat

SEQ ID NO: 340738 - DNA, 20 bp, Artificial Sequence
  chemically synthesized
ctgtttcttccccatctttg

SEQ ID NO: 340739 - DNA, 20 bp, Artificial Sequence
  chemically synthesized
tagataaaaccacaaagatg

SEQ ID NO: 340740 - DNA, 20 bp, Artificial Sequence
  chemically synthesized
ataaaaccacaaagatgggg

SEQ ID NO: 340741 - DNA, 20 bp, Artificial Sequence
  chemically synthesized
ccacaaagatggggaagaaa

SEQ ID NO: 340742 - DNA, 20 bp, Artificial Sequence
  chemically synthesized
acaaagatggggaagaaaca

SEQ ID NO: 340743 - DNA, 20 bp, Artificial Sequence
  chemically synthesized
aagatggggaagaaacagag

SEQ ID NO: 340744 - DNA, 20 bp, Artificial Sequence
  chemically synthesized
aagaaacagagcagaaaaac

SEQ ID NO: 340745 - DNA, 20 bp, Artificial Sequence
  chemically synthesized
gctctgctttttagagtttc

SEQ ID NO: 340746 - DNA, 20 bp, Artificial Sequence
  chemically synthesized
gaaaaactggaaactctaaa

SEQ ID NO: 340747 - DNA, 20 bp, Artificial Sequence
  chemically synthesized
aaactggaaactctaaaaag

SEQ ID NO: 340748 - DNA, 20 bp, Artificial Sequence
  chemically synthesized
gagaggtgctctgcttttta

SEQ ID NO: 340749 - DNA, 20 bp, Artificial Sequence
  chemically synthesized
actggaaactctaaaaagca

SEQ ID NO: 340750 - DNA, 20 bp, Artificial Sequence
  chemically synthesized
aggagaggtgctctgctttt

SEQ ID NO: 340751 - DNA, 20 bp, Artificial Sequence
  chemically synthesized
gtgttcctttggaggaggag

SEQ ID NO: 340752 - DNA, 20 bp, Artificial Sequence
  chemically synthesized
tgtgttcctttggaggagga

SEQ ID NO: 340753 - DNA, 20 bp, Artificial Sequence
  chemically synthesized
actgtgttcctttggaggag

SEQ ID NO: 340754 - DNA, 20 bp, Artificial Sequence
  chemically synthesized
agagcacctctcctcctcca

SEQ ID NO: 340755 - DNA, 20 bp, Artificial Sequence
  chemically synthesized
gagcacctctcctcctccaa

SEQ ID NO: 340756 - DNA, 20 bp, Artificial Sequence
  chemically synthesized
gaactgtgttcctttggagg

SEQ ID NO: 340757 - DNA, 20 bp, Artificial Sequence
  chemically synthesized
ggaactgtgttcctttggag

SEQ ID NO: 340758 - DNA, 20 bp, Artificial Sequence
  chemically synthesized
gaggaactgtgttcctttgg

SEQ ID NO: 340759 - DNA, 20 bp, Artificial Sequence
  chemically synthesized
tgaggaactgtgttcctttg

SEQ ID NO: 340760 - DNA, 20 bp, Artificial Sequence
  chemically synthesized
agtgaggaactgtgttcctt

SEQ ID NO: 340761 - DNA, 20 bp, Artificial Sequence
  chemically synthesized
tctcctcctccaaaggaaca

SEQ ID NO: 340762 - DNA, 20 bp, Artificial Sequence
  chemically synthesized
aaaggaacacagttcctcac

SEQ ID NO: 340763 - DNA, 20 bp, Artificial Sequence
  chemically synthesized
gctttgttccgttgctagtg

SEQ ID NO: 340764 - DNA, 20 bp, Artificial Sequence
  chemically synthesized
agctttgttccgttgctagt

SEQ ID NO: 340765 - DNA, 20 bp, Artificial Sequence
  chemically synthesized
acacagttcctcactagcaa

SEQ ID NO: 340766 - DNA, 20 bp, Artificial Sequence
  chemically synthesized
ctccagctttgttccgttgc

SEQ ID NO: 340767 - DNA, 20 bp, Artificial Sequence
  chemically synthesized
tcctcactagcaacggaaca

SEQ ID NO: 340768 - DNA, 20 bp, Artificial Sequence
  chemically synthesized
cactagcaacggaacaaagc

SEQ ID NO: 340769 - DNA, 20 bp, Artificial Sequence
  chemically synthesized
ctagcaacggaacaaagctg

SEQ ID NO: 340770 - DNA, 20 bp, Artificial Sequence
  chemically synthesized
agcaacggaacaaagctgga

SEQ ID NO: 340771 - DNA, 20 bp, Artificial Sequence
  chemically synthesized
caacggaacaaagctggaga

SEQ ID NO: 340772 - DNA, 20 bp, Artificial Sequence
  chemically synthesized
aacggaacaaagctggagag

SEQ ID NO: 340773 - DNA, 20 bp, Artificial Sequence
  chemically synthesized
cgtcaaagtcatcctctctc

SEQ ID NO: 340774 - DNA, 20 bp, Artificial Sequence
  chemically synthesized
ggagagaggatgactttgac

SEQ ID NO: 340775 - DNA, 20 bp, Artificial Sequence
  chemically synthesized
cttcttctctcagctcgtca

SEQ ID NO: 340776 - DNA, 20 bp, Artificial Sequence
  chemically synthesized
gaggatgactttgacgagct

SEQ ID NO: 340777 - DNA, 20 bp, Artificial Sequence
  chemically synthesized
ggatgactttgacgagctga

SEQ ID NO: 340778 - DNA, 20 bp, Artificial Sequence
  chemically synthesized
tgactttgacgagctgagag

SEQ ID NO: 340779 - DNA, 20 bp, Artificial Sequence
  chemically synthesized
ctttgacgagctgagagaag

SEQ ID NO: 340780 - DNA, 20 bp, Artificial Sequence
  chemically synthesized
cgtctgaagccttcttctct

SEQ ID NO: 340781 - DNA, 20 bp, Artificial Sequence
  chemically synthesized
tttgacgagctgagagaaga

SEQ ID NO: 340782 - DNA, 20 bp, Artificial Sequence
  chemically synthesized
gagctgagagaagaaggctt

SEQ ID NO: 340783 - DNA, 20 bp, Artificial Sequence
  chemically synthesized
cagagtaatttgatcgtctg

SEQ ID NO: 340784 - DNA, 20 bp, Artificial Sequence
  chemically synthesized
tcagacgatcaaattactct

SEQ ID NO: 340785 - DNA, 20 bp, Artificial Sequence
  chemically synthesized
gatcaaattactctgagcta

SEQ ID NO: 340786 - DNA, 20 bp, Artificial Sequence
  chemically synthesized
gaatgtcctcccgtagctca

SEQ ID NO: 340787 - DNA, 20 bp, Artificial Sequence
  chemically synthesized
atcaaattactctgagctac

SEQ ID NO: 340788 - DNA, 20 bp, Artificial Sequence
  chemically synthesized
ttgaatgtcctcccgtagct

SEQ ID NO: 340789 - DNA, 20 bp, Artificial Sequence
  chemically synthesized
caaattactctgagctacgg

SEQ ID NO: 340790 - DNA, 20 bp, Artificial Sequence
  chemically synthesized
aaattactctgagctacggg

SEQ ID NO: 340791 - DNA, 20 bp, Artificial Sequence
  chemically synthesized
ttggtttgaatgtcctcccg

SEQ ID NO: 340792 - DNA, 20 bp, Artificial Sequence
  chemically synthesized
acgggaggacattcaaacca

SEQ ID NO: 340793 - DNA, 20 bp, Artificial Sequence
  chemically synthesized
cgggaggacattcaaaccaa

SEQ ID NO: 340794 - DNA, 20 bp, Artificial Sequence
  chemically synthesized
ggacattcaaaccaaaggca

SEQ ID NO: 340795 - DNA, 20 bp, Artificial Sequence
  chemically synthesized
gttttcaacttctttgcctt

SEQ ID NO: 340796 - DNA, 20 bp, Artificial Sequence
  chemically synthesized
cattcaaaccaaaggcaaag

SEQ ID NO: 340797 - DNA, 20 bp, Artificial Sequence
  chemically synthesized
attcttctaaatgtttttca

SEQ ID NO: 340798 - DNA, 20 bp, Artificial Sequence
  chemically synthesized
tgaaaactttgaaaaacatt

SEQ ID NO: 340799 - DNA, 20 bp, Artificial Sequence
  chemically synthesized
aaactttgaaaaacatttag

SEQ ID NO: 340800 - DNA, 20 bp, Artificial Sequence
  chemically synthesized
aaacatttagaagaatgtat

SEQ ID NO: 340801 - DNA, 20 bp, Artificial Sequence
  chemically synthesized
catttagaagaatgtataag

SEQ ID NO: 340802 - DNA, 20 bp, Artificial Sequence
  chemically synthesized
tataagtagaataaccatta

SEQ ID NO: 340803 - DNA, 20 bp, Artificial Sequence
  chemically synthesized
taagtagaataaccattaca

SEQ ID NO: 340804 - DNA, 20 bp, Artificial Sequence
  chemically synthesized
ctttaagcacttctctgtaa

SEQ ID NO: 340805 - DNA, 20 bp, Artificial Sequence
  chemically synthesized
gtagaataaccattacagag

SEQ ID NO: 340806 - DNA, 20 bp, Artificial Sequence
  chemically synthesized
ccattacagagaagtgctta

SEQ ID NO: 340807 - DNA, 20 bp, Artificial Sequence
  chemically synthesized
cattacagagaagtgcttaa

SEQ ID NO: 340808 - DNA, 20 bp, Artificial Sequence
  chemically synthesized
ttacagagaagtgcttaaag

SEQ ID NO: 340809 - DNA, 20 bp, Artificial Sequence
  chemically synthesized
tcagctccatcagctccttt

SEQ ID NO: 340810 - DNA, 20 bp, Artificial Sequence
  chemically synthesized
gaagtgcttaaaggagctga

SEQ ID NO: 340811 - DNA, 20 bp, Artificial Sequence
  chemically synthesized
agtgcttaaaggagctgatg

SEQ ID NO: 340812 - DNA, 20 bp, Artificial Sequence
  chemically synthesized
gccttggttttcagctccat

SEQ ID NO: 340813 - DNA, 20 bp, Artificial Sequence
  chemically synthesized
agctgatggagctgaaaacc

SEQ ID NO: 340814 - DNA, 20 bp, Artificial Sequence
  chemically synthesized
gctgatggagctgaaaacca

SEQ ID NO: 340815 - DNA, 20 bp, Artificial Sequence
  chemically synthesized
acttctctagccttggtttt

SEQ ID NO: 340816 - DNA, 20 bp, Artificial Sequence
  chemically synthesized
atggagctgaaaaccaaggc

SEQ ID NO: 340817 - DNA, 20 bp, Artificial Sequence
  chemically synthesized
ggagctgaaaaccaaggcta

SEQ ID NO: 340818 - DNA, 20 bp, Artificial Sequence
  chemically synthesized
ttcacgtacttctctagcct

SEQ ID NO: 340819 - DNA, 20 bp, Artificial Sequence
  chemically synthesized
gctgaaaaccaaggctagag

SEQ ID NO: 340820 - DNA, 20 bp, Artificial Sequence
  chemically synthesized
gcattcttcacgtacttctc

SEQ ID NO: 340821 - DNA, 20 bp, Artificial Sequence
  chemically synthesized
caaggctagagaagtacgtg

SEQ ID NO: 340822 - DNA, 20 bp, Artificial Sequence
  chemically synthesized
agagaagtacgtgaagaatg

SEQ ID NO: 340823 - DNA, 20 bp, Artificial Sequence
  chemically synthesized
gaagtacgtgaagaatgcag

SEQ ID NO: 340824 - DNA, 20 bp, Artificial Sequence
  chemically synthesized
cgtgaagaatgcagaagcct

SEQ ID NO: 340825 - DNA, 20 bp, Artificial Sequence
  chemically synthesized
gtgaagaatgcagaagcctc

SEQ ID NO: 340826 - DNA, 20 bp, Artificial Sequence
  chemically synthesized
gaagaatgcagaagcctcag

SEQ ID NO: 340827 - DNA, 20 bp, Artificial Sequence
  chemically synthesized
gttgatcgcatcggctcctg

SEQ ID NO: 340828 - DNA, 20 bp, Artificial Sequence
  chemically synthesized
agttgatcgcatcggctcct

SEQ ID NO: 340829 - DNA, 20 bp, Artificial Sequence
  chemically synthesized
tttcttccagttgatcgcat

SEQ ID NO: 340830 - DNA, 20 bp, Artificial Sequence
  chemically synthesized
caggagccgatgcgatcaac

SEQ ID NO: 340831 - DNA, 20 bp, Artificial Sequence
  chemically synthesized
gagccgatgcgatcaactgg

SEQ ID NO: 340832 - DNA, 20 bp, Artificial Sequence
  chemically synthesized
cgatgcgatcaactggaaga

SEQ ID NO: 340833 - DNA, 20 bp, Artificial Sequence
  chemically synthesized
gatgcgatcaactggaagaa

SEQ ID NO: 340834 - DNA, 20 bp, Artificial Sequence
  chemically synthesized
atgcgatcaactggaagaaa

SEQ ID NO: 340835 - DNA, 20 bp, Artificial Sequence
  chemically synthesized
atcactgataccctttcttc

SEQ ID NO: 340836 - DNA, 20 bp, Artificial Sequence
  chemically synthesized
tcaactggaagaaagggtat

SEQ ID NO: 340837 - DNA, 20 bp, Artificial Sequence
  chemically synthesized
ggaagaaagggtatcagtga

SEQ ID NO: 340838 - DNA, 20 bp, Artificial Sequence
  chemically synthesized
agaaagggtatcagtgatgg

SEQ ID NO: 340839 - DNA, 20 bp, Artificial Sequence
  chemically synthesized
tgaaattaatgaaatgaacc

SEQ ID NO: 340840 - DNA, 20 bp, Artificial Sequence
  chemically synthesized
aattaatgaaatgaaccgag

SEQ ID NO: 340841 - DNA, 20 bp, Artificial Sequence
  chemically synthesized
attaatgaaatgaaccgaga

SEQ ID NO: 340842 - DNA, 20 bp, Artificial Sequence
  chemically synthesized
ttaatgaaatgaaccgagaa

SEQ ID NO: 340843 - DNA, 20 bp, Artificial Sequence
  chemically synthesized
atgaaatgaaccgagaaggg

SEQ ID NO: 340844 - DNA, 20 bp, Artificial Sequence
  chemically synthesized
ttcctctaaacttcccttct

SEQ ID NO: 340845 - DNA, 20 bp, Artificial Sequence
  chemically synthesized
atgaaccgagaagggaagtt

SEQ ID NO: 340846 - DNA, 20 bp, Artificial Sequence
  chemically synthesized
gaaccgagaagggaagttta

SEQ ID NO: 340847 - DNA, 20 bp, Artificial Sequence
  chemically synthesized
aaccgagaagggaagtttag

SEQ ID NO: 340848 - DNA, 20 bp, Artificial Sequence
  chemically synthesized
gaagggaagtttagaggaaa

SEQ ID NO: 340849 - DNA, 20 bp, Artificial Sequence
  chemically synthesized
tttagaggaaaaagaataaa

SEQ ID NO: 340850 - DNA, 20 bp, Artificial Sequence
  chemically synthesized
gaaaaagaataaaaagaaat

SEQ ID NO: 340851 - DNA, 20 bp, Artificial Sequence
  chemically synthesized
agaataaaaagaaatgagca

SEQ ID NO: 340852 - DNA, 20 bp, Artificial Sequence
  chemically synthesized
aagaaatgagcaaagcctcc

SEQ ID NO: 340853 - DNA, 20 bp, Artificial Sequence
  chemically synthesized
catagtcccatatttcttgg

SEQ ID NO: 340854 - DNA, 20 bp, Artificial Sequence
  chemically synthesized
acatagtcccatatttcttg

SEQ ID NO: 340855 - DNA, 20 bp, Artificial Sequence
  chemically synthesized
agcaaagcctccaagaaata

SEQ ID NO: 340856 - DNA, 20 bp, Artificial Sequence
  chemically synthesized
tcacatagtcccatatttct

SEQ ID NO: 340857 - DNA, 20 bp, Artificial Sequence
  chemically synthesized
gcaaagcctccaagaaatat

SEQ ID NO: 340858 - DNA, 20 bp, Artificial Sequence
  chemically synthesized
gaaatatgggactatgtgaa

SEQ ID NO: 340859 - DNA, 20 bp, Artificial Sequence
  chemically synthesized
gtagatttggtcttttcaca

SEQ ID NO: 340860 - DNA, 20 bp, Artificial Sequence
  chemically synthesized
acaccaatcagacgtagatt

SEQ ID NO: 340861 - DNA, 20 bp, Artificial Sequence
  chemically synthesized
tcaggtacaccaatcagacg

SEQ ID NO: 340862 - DNA, 20 bp, Artificial Sequence
  chemically synthesized
agaccaaatctacgtctgat

SEQ ID NO: 340863 - DNA, 20 bp, Artificial Sequence
  chemically synthesized
tcactttcaggtacaccaat

SEQ ID NO: 340864 - DNA, 20 bp, Artificial Sequence
  chemically synthesized
cgtctgattggtgtacctga

SEQ ID NO: 340865 - DNA, 20 bp, Artificial Sequence
  chemically synthesized
ccattctccccatcactttc

SEQ ID NO: 340866 - DNA, 20 bp, Artificial Sequence
  chemically synthesized
attggtgtacctgaaagtga

SEQ ID NO: 340867 - DNA, 20 bp, Artificial Sequence
  chemically synthesized
tccattctccccatcacttt

SEQ ID NO: 340868 - DNA, 20 bp, Artificial Sequence
  chemically synthesized
ttggtgtacctgaaagtgat

SEQ ID NO: 340869 - DNA, 20 bp, Artificial Sequence
  chemically synthesized
tggtgtacctgaaagtgatg

SEQ ID NO: 340870 - DNA, 20 bp, Artificial Sequence
  chemically synthesized
gtgtacctgaaagtgatggg

SEQ ID NO: 340871 - DNA, 20 bp, Artificial Sequence
  chemically synthesized
cctgaaagtgatggggagaa

SEQ ID NO: 340872 - DNA, 20 bp, Artificial Sequence
  chemically synthesized
tggggagaatggaaccaatt

SEQ ID NO: 340873 - DNA, 20 bp, Artificial Sequence
  chemically synthesized
ctgcagagtgttttccaaat

SEQ ID NO: 340874 - DNA, 20 bp, Artificial Sequence
  chemically synthesized
ccaatttggaaaacactctg

SEQ ID NO: 340875 - DNA, 20 bp, Artificial Sequence
  chemically synthesized
caatttggaaaacactctgc

SEQ ID NO: 340876 - DNA, 20 bp, Artificial Sequence
  chemically synthesized
ctcctggataatatcctgca

SEQ ID NO: 340877 - DNA, 20 bp, Artificial Sequence
  chemically synthesized
ttctcctggataatatcctg

SEQ ID NO: 340878 - DNA, 20 bp, Artificial Sequence
  chemically synthesized
acactctgcaggatattatc

SEQ ID NO: 340879 - DNA, 20 bp, Artificial Sequence
  chemically synthesized
cactctgcaggatattatcc

SEQ ID NO: 340880 - DNA, 20 bp, Artificial Sequence
  chemically synthesized
ctctgcaggatattatccag

SEQ ID NO: 340881 - DNA, 20 bp, Artificial Sequence
  chemically synthesized
ctagattggggaagttctcc

SEQ ID NO: 340882 - DNA, 20 bp, Artificial Sequence
  chemically synthesized
cctgccttgctagattgggg

SEQ ID NO: 340883 - DNA, 20 bp, Artificial Sequence
  chemically synthesized
ccaggagaacttccccaatc

SEQ ID NO: 340884 - DNA, 20 bp, Artificial Sequence
  chemically synthesized
tggcctgccttgctagattg

SEQ ID NO: 340885 - DNA, 20 bp, Artificial Sequence
  chemically synthesized
ttggcctgccttgctagatt

SEQ ID NO: 340886 - DNA, 20 bp, Artificial Sequence
  chemically synthesized
gagaacttccccaatctagc

SEQ ID NO: 340887 - DNA, 20 bp, Artificial Sequence
  chemically synthesized
gttggcctgccttgctagat

SEQ ID NO: 340888 - DNA, 20 bp, Artificial Sequence
  chemically synthesized
agaacttccccaatctagca

SEQ ID NO: 340889 - DNA, 20 bp, Artificial Sequence
  chemically synthesized
acttccccaatctagcaagg

SEQ ID NO: 340890 - DNA, 20 bp, Artificial Sequence
  chemically synthesized
cttccccaatctagcaaggc

SEQ ID NO: 340891 - DNA, 20 bp, Artificial Sequence
  chemically synthesized
tgaatgttggcctgccttgc

SEQ ID NO: 340892 - DNA, 20 bp, Artificial Sequence
  chemically synthesized
tagcaaggcaggccaacatt

SEQ ID NO: 340893 - DNA, 20 bp, Artificial Sequence
  chemically synthesized
tatttcctgaatctgaatgt

SEQ ID NO: 340894 - DNA, 20 bp, Artificial Sequence
  chemically synthesized
ggcaggccaacattcagatt

SEQ ID NO: 340895 - DNA, 20 bp, Artificial Sequence
  chemically synthesized
gcaggccaacattcagattc

SEQ ID NO: 340896 - DNA, 20 bp, Artificial Sequence
  chemically synthesized
acattcagattcaggaaata

SEQ ID NO: 340897 - DNA, 20 bp, Artificial Sequence
  chemically synthesized
attcagattcaggaaataca

SEQ ID NO: 340898 - DNA, 20 bp, Artificial Sequence
  chemically synthesized
gaaatacagagaatgccaca

SEQ ID NO: 340899 - DNA, 20 bp, Artificial Sequence
  chemically synthesized
cttctcgaggagtatctttg

SEQ ID NO: 340900 - DNA, 20 bp, Artificial Sequence
  chemically synthesized
atgccacaaagatactcctc

SEQ ID NO: 340901 - DNA, 20 bp, Artificial Sequence
  chemically synthesized
ccacaaagatactcctcgag

SEQ ID NO: 340902 - DNA, 20 bp, Artificial Sequence
  chemically synthesized
ttggagttgctcttctcgag

SEQ ID NO: 340903 - DNA, 20 bp, Artificial Sequence
  chemically synthesized
acaaagatactcctcgagaa

SEQ ID NO: 340904 - DNA, 20 bp, Artificial Sequence
  chemically synthesized
tcttggagttgctcttctcg

SEQ ID NO: 340905 - DNA, 20 bp, Artificial Sequence
  chemically synthesized
gtcttggagttgctcttctc

SEQ ID NO: 340906 - DNA, 20 bp, Artificial Sequence
  chemically synthesized
tcctcgagaagagcaactcc

SEQ ID NO: 340907 - DNA, 20 bp, Artificial Sequence
  chemically synthesized
tctgacaattatgtgtcttg

SEQ ID NO: 340908 - DNA, 20 bp, Artificial Sequence
  chemically synthesized
aatctgacaattatgtgtct

SEQ ID NO: 340909 - DNA, 20 bp, Artificial Sequence
  chemically synthesized
actccaagacacataattgt

SEQ ID NO: 340910 - DNA, 20 bp, Artificial Sequence
  chemically synthesized
cataattgtcagattcacca

SEQ ID NO: 340911 - DNA, 20 bp, Artificial Sequence
  chemically synthesized
tttttccttcatttcaactt

SEQ ID NO: 340912 - DNA, 20 bp, Artificial Sequence
  chemically synthesized
gattcaccaaagttgaaatg

SEQ ID NO: 340913 - DNA, 20 bp, Artificial Sequence
  chemically synthesized
attcaccaaagttgaaatga

SEQ ID NO: 340914 - DNA, 20 bp, Artificial Sequence
  chemically synthesized
caaagttgaaatgaaggaaa

SEQ ID NO: 340915 - DNA, 20 bp, Artificial Sequence
  chemically synthesized
gaaatgaaggaaaaagtgtt

SEQ ID NO: 340916 - DNA, 20 bp, Artificial Sequence
  chemically synthesized
aaatgaaggaaaaagtgtta

SEQ ID NO: 340917 - DNA, 20 bp, Artificial Sequence
  chemically synthesized
aatgaaggaaaaagtgttaa

SEQ ID NO: 340918 - DNA, 20 bp, Artificial Sequence
  chemically synthesized
gaaggaaaaagtgttaaggg

SEQ ID NO: 340919 - DNA, 20 bp, Artificial Sequence
  chemically synthesized
gaaaaagtgttaagggcagc

SEQ ID NO: 340920 - DNA, 20 bp, Artificial Sequence
  chemically synthesized
aaaagtgttaagggcagcca

SEQ ID NO: 340921 - DNA, 20 bp, Artificial Sequence
  chemically synthesized
aagtgttaagggcagccaga

SEQ ID NO: 340922 - DNA, 20 bp, Artificial Sequence
  chemically synthesized
gttaagggcagccagagaga

SEQ ID NO: 340923 - DNA, 20 bp, Artificial Sequence
  chemically synthesized
ttaagggcagccagagagaa

SEQ ID NO: 340924 - DNA, 20 bp, Artificial Sequence
  chemically synthesized
ggtaacccgacctttctctc

SEQ ID NO: 340925 - DNA, 20 bp, Artificial Sequence
  chemically synthesized
gggcagccagagagaaaggt

SEQ ID NO: 340926 - DNA, 20 bp, Artificial Sequence
  chemically synthesized
ggcagccagagagaaaggtc

SEQ ID NO: 340927 - DNA, 20 bp, Artificial Sequence
  chemically synthesized
gaaaggtcgggttaccctca

SEQ ID NO: 340928 - DNA, 20 bp, Artificial Sequence
  chemically synthesized
aaaggtcgggttaccctcaa

SEQ ID NO: 340929 - DNA, 20 bp, Artificial Sequence
  chemically synthesized
aaggtcgggttaccctcaaa

SEQ ID NO: 340930 - DNA, 20 bp, Artificial Sequence
  chemically synthesized
tgtgatgggcttccctttga

SEQ ID NO: 340931 - DNA, 20 bp, Artificial Sequence
  chemically synthesized
gtcgggttaccctcaaaggg

SEQ ID NO: 340932 - DNA, 20 bp, Artificial Sequence
  chemically synthesized
gtgtgatgggcttccctttg

SEQ ID NO: 340933 - DNA, 20 bp, Artificial Sequence
  chemically synthesized
agtgtgatgggcttcccttt

SEQ ID NO: 340934 - DNA, 20 bp, Artificial Sequence
  chemically synthesized
agatccgctgttagtgtgat

SEQ ID NO: 340935 - DNA, 20 bp, Artificial Sequence
  chemically synthesized
gagatccgctgttagtgtga

SEQ ID NO: 340936 - DNA, 20 bp, Artificial Sequence
  chemically synthesized
agggaagcccatcacactaa

SEQ ID NO: 340937 - DNA, 20 bp, Artificial Sequence
  chemically synthesized
gaagcccatcacactaacag

SEQ ID NO: 340938 - DNA, 20 bp, Artificial Sequence
  chemically synthesized
tctgccgagagatccgctgt

SEQ ID NO: 340939 - DNA, 20 bp, Artificial Sequence
  chemically synthesized
cacactaacagcggatctct

SEQ ID NO: 340940 - DNA, 20 bp, Artificial Sequence
  chemically synthesized
actaacagcggatctctcgg

SEQ ID NO: 340941 - DNA, 20 bp, Artificial Sequence
  chemically synthesized
gcttgtagggtgtctgccga

SEQ ID NO: 340942 - DNA, 20 bp, Artificial Sequence
  chemically synthesized
tggcttgtagggtgtctgcc

SEQ ID NO: 340943 - DNA, 20 bp, Artificial Sequence
  chemically synthesized
tctctcggcagacaccctac

SEQ ID NO: 340944 - DNA, 20 bp, Artificial Sequence
  chemically synthesized
tcggcagacaccctacaagc

SEQ ID NO: 340945 - DNA, 20 bp, Artificial Sequence
  chemically synthesized
ccactctcttctggcttgta

SEQ ID NO: 340946 - DNA, 20 bp, Artificial Sequence
  chemically synthesized
cccactctcttctggcttgt

SEQ ID NO: 340947 - DNA, 20 bp, Artificial Sequence
  chemically synthesized
ccccactctcttctggcttg

SEQ ID NO: 340948 - DNA, 20 bp, Artificial Sequence
  chemically synthesized
gcagacaccctacaagccag

SEQ ID NO: 340949 - DNA, 20 bp, Artificial Sequence
  chemically synthesized
agacaccctacaagccagaa

SEQ ID NO: 340950 - DNA, 20 bp, Artificial Sequence
  chemically synthesized
acaccctacaagccagaaga

SEQ ID NO: 340951 - DNA, 20 bp, Artificial Sequence
  chemically synthesized
tattggcccccactctcttc

SEQ ID NO: 340952 - DNA, 20 bp, Artificial Sequence
  chemically synthesized
ccctacaagccagaagagag

SEQ ID NO: 340953 - DNA, 20 bp, Artificial Sequence
  chemically synthesized
cctacaagccagaagagagt

SEQ ID NO: 340954 - DNA, 20 bp, Artificial Sequence
  chemically synthesized
ctacaagccagaagagagtg

SEQ ID NO: 340955 - DNA, 20 bp, Artificial Sequence
  chemically synthesized
tacaagccagaagagagtgg

SEQ ID NO: 340956 - DNA, 20 bp, Artificial Sequence
  chemically synthesized
tctttaagaatgttgaatat

SEQ ID NO: 340957 - DNA, 20 bp, Artificial Sequence
  chemically synthesized
gccaatattcaacattctta

SEQ ID NO: 340958 - DNA, 20 bp, Artificial Sequence
  chemically synthesized
tattcaacattcttaaagaa

SEQ ID NO: 340959 - DNA, 20 bp, Artificial Sequence
  chemically synthesized
ggttgaaaattcttttcttt

SEQ ID NO: 340960 - DNA, 20 bp, Artificial Sequence
  chemically synthesized
aaagaaaagaattttcaacc

SEQ ID NO: 340961 - DNA, 20 bp, Artificial Sequence
  chemically synthesized
ttgcctggatgtgaaattct

SEQ ID NO: 340962 - DNA, 20 bp, Artificial Sequence
  chemically synthesized
tttgcctggatgtgaaattc

SEQ ID NO: 340963 - DNA, 20 bp, Artificial Sequence
  chemically synthesized
tcaacccagaatttcacatc

SEQ ID NO: 340964 - DNA, 20 bp, Artificial Sequence
  chemically synthesized
caacccagaatttcacatcc

SEQ ID NO: 340965 - DNA, 20 bp, Artificial Sequence
  chemically synthesized
cttatgaagcttagtttgcc

SEQ ID NO: 340966 - DNA, 20 bp, Artificial Sequence
  chemically synthesized
atttcacatccaggcaaact

SEQ ID NO: 340967 - DNA, 20 bp, Artificial Sequence
  chemically synthesized
tctcctttacttatgaagct

SEQ ID NO: 340968 - DNA, 20 bp, Artificial Sequence
  chemically synthesized
ccaggcaaactaagcttcat

SEQ ID NO: 340969 - DNA, 20 bp, Artificial Sequence
  chemically synthesized
ttatttctcctttacttatg

SEQ ID NO: 340970 - DNA, 20 bp, Artificial Sequence
  chemically synthesized
caaactaagcttcataagta

SEQ ID NO: 340971 - DNA, 20 bp, Artificial Sequence
  chemically synthesized
aaactaagcttcataagtaa

SEQ ID NO: 340972 - DNA, 20 bp, Artificial Sequence
  chemically synthesized
actaagcttcataagtaaag

SEQ ID NO: 340973 - DNA, 20 bp, Artificial Sequence
  chemically synthesized
aggagaaataaaatactcta

SEQ ID NO: 340974 - DNA, 20 bp, Artificial Sequence
  chemically synthesized
aaataaaatactctacagac

SEQ ID NO: 340975 - DNA, 20 bp, Artificial Sequence
  chemically synthesized
tcagcatttgcttgtctgta

SEQ ID NO: 340976 - DNA, 20 bp, Artificial Sequence
  chemically synthesized
tctcagcatttgcttgtctg

SEQ ID NO: 340977 - DNA, 20 bp, Artificial Sequence
  chemically synthesized
tctacagacaagcaaatgct

SEQ ID NO: 340978 - DNA, 20 bp, Artificial Sequence
  chemically synthesized
tacagacaagcaaatgctga

SEQ ID NO: 340979 - DNA, 20 bp, Artificial Sequence
  chemically synthesized
ctggtggtgacaaaatctct

SEQ ID NO: 340980 - DNA, 20 bp, Artificial Sequence
  chemically synthesized
ctgagagattttgtcaccac

SEQ ID NO: 340981 - DNA, 20 bp, Artificial Sequence
  chemically synthesized
tgagagattttgtcaccacc

SEQ ID NO: 340982 - DNA, 20 bp, Artificial Sequence
  chemically synthesized
ctcttttagggcaggcctgg

SEQ ID NO: 340983 - DNA, 20 bp, Artificial Sequence
  chemically synthesized
gagctcttttagggcaggcc

SEQ ID NO: 340984 - DNA, 20 bp, Artificial Sequence
  chemically synthesized
caccaccaggcctgccctaa

SEQ ID NO: 340985 - DNA, 20 bp, Artificial Sequence
  chemically synthesized
ttcaggagctcttttagggc

SEQ ID NO: 340986 - DNA, 20 bp, Artificial Sequence
  chemically synthesized
cttcaggagctcttttaggg

SEQ ID NO: 340987 - DNA, 20 bp, Artificial Sequence
  chemically synthesized
ccaccaggcctgccctaaaa

SEQ ID NO: 340988 - DNA, 20 bp, Artificial Sequence
  chemically synthesized
ttccttcaggagctctttta

SEQ ID NO: 340989 - DNA, 20 bp, Artificial Sequence
  chemically synthesized
cttccttcaggagctctttt

SEQ ID NO: 340990 - DNA, 20 bp, Artificial Sequence
  chemically synthesized
gcttccttcaggagctcttt

SEQ ID NO: 340991 - DNA, 20 bp, Artificial Sequence
  chemically synthesized
ctgccctaaaagagctcctg

SEQ ID NO: 340992 - DNA, 20 bp, Artificial Sequence
  chemically synthesized
tgccctaaaagagctcctga

SEQ ID NO: 340993 - DNA, 20 bp, Artificial Sequence
  chemically synthesized
cctaaaagagctcctgaagg

SEQ ID NO: 340994 - DNA, 20 bp, Artificial Sequence
  chemically synthesized
atgtttagcgcttccttcag

SEQ ID NO: 340995 - DNA, 20 bp, Artificial Sequence
  chemically synthesized
ccatgtttagcgcttccttc

SEQ ID NO: 340996 - DNA, 20 bp, Artificial Sequence
  chemically synthesized
tccatgtttagcgcttcctt

SEQ ID NO: 340997 - DNA, 20 bp, Artificial Sequence
  chemically synthesized
cctgaaggaagcgctaaaca

SEQ ID NO: 340998 - DNA, 20 bp, Artificial Sequence
  chemically synthesized
cggttgttcctttccatgtt

SEQ ID NO: 340999 - DNA, 20 bp, Artificial Sequence
  chemically synthesized
aaggaagcgctaaacatgga

SEQ ID NO: 341000 - DNA, 20 bp, Artificial Sequence
  chemically synthesized
aggaagcgctaaacatggaa

SEQ ID NO: 341001 - DNA, 20 bp, Artificial Sequence
  chemically synthesized
taaacatggaaaggaacaac

SEQ ID NO: 341002 - DNA, 20 bp, Artificial Sequence
  chemically synthesized
tggaaaggaacaaccggtac

SEQ ID NO: 341003 - DNA, 20 bp, Artificial Sequence
  chemically synthesized
gattttgcagcggctggtac

SEQ ID NO: 341004 - DNA, 20 bp, Artificial Sequence
  chemically synthesized
tggcatgattttgcagcggc

SEQ ID NO: 341005 - DNA, 20 bp, Artificial Sequence
  chemically synthesized
attttggcatgattttgcag

SEQ ID NO: 341006 - DNA, 20 bp, Artificial Sequence
  chemically synthesized
tacattttggcatgattttg

SEQ ID NO: 341007 - DNA, 20 bp, Artificial Sequence
  chemically synthesized
caaaatcatgccaaaatgta

SEQ ID NO: 341008 - DNA, 20 bp, Artificial Sequence
  chemically synthesized
tctcaatggtctttacattt

SEQ ID NO: 341009 - DNA, 20 bp, Artificial Sequence
  chemically synthesized
gccaaaatgtaaagaccatt

SEQ ID NO: 341010 - DNA, 20 bp, Artificial Sequence
  chemically synthesized
aatgtaaagaccattgagac

SEQ ID NO: 341011 - DNA, 20 bp, Artificial Sequence
  chemically synthesized
cagtttcttcctagtctcaa

SEQ ID NO: 341012 - DNA, 20 bp, Artificial Sequence
  chemically synthesized
atgtaaagaccattgagact

SEQ ID NO: 341013 - DNA, 20 bp, Artificial Sequence
  chemically synthesized
taaagaccattgagactagg

SEQ ID NO: 341014 - DNA, 20 bp, Artificial Sequence
  chemically synthesized
tagttgatgcagtttcttcc

SEQ ID NO: 341015 - DNA, 20 bp, Artificial Sequence
  chemically synthesized
attttgctcgttagttgatg

SEQ ID NO: 341016 - DNA, 20 bp, Artificial Sequence
  chemically synthesized
aagaaactgcatcaactaac

SEQ ID NO: 341017 - DNA, 20 bp, Artificial Sequence
  chemically synthesized
tagctggtgattttgctcgt

SEQ ID NO: 341018 - DNA, 20 bp, Artificial Sequence
  chemically synthesized
caactaacgagcaaaatcac

SEQ ID NO: 341019 - DNA, 20 bp, Artificial Sequence
  chemically synthesized
cctgtcattatgatgttagc

SEQ ID NO: 341020 - DNA, 20 bp, Artificial Sequence
  chemically synthesized
tgatcctgtcattatgatgt

SEQ ID NO: 341021 - DNA, 20 bp, Artificial Sequence
  chemically synthesized
accagctaacatcataatga

SEQ ID NO: 341022 - DNA, 20 bp, Artificial Sequence
  chemically synthesized
ccagctaacatcataatgac

SEQ ID NO: 341023 - DNA, 20 bp, Artificial Sequence
  chemically synthesized
atttagcccatttacattta

SEQ ID NO: 341024 - DNA, 20 bp, Artificial Sequence
  chemically synthesized
catttagcccatttacattt

SEQ ID NO: 341025 - DNA, 20 bp, Artificial Sequence
  chemically synthesized
atattaaccttaaatgtaaa

SEQ ID NO: 341026 - DNA, 20 bp, Artificial Sequence
  chemically synthesized
tattaaccttaaatgtaaat

SEQ ID NO: 341027 - DNA, 20 bp, Artificial Sequence
  chemically synthesized
tgtcttttagttggagcatt

SEQ ID NO: 341028 - DNA, 20 bp, Artificial Sequence
  chemically synthesized
gggctaaatgctccaactaa

SEQ ID NO: 341029 - DNA, 20 bp, Artificial Sequence
  chemically synthesized
cagtctgtgtcttttagttg

SEQ ID NO: 341030 - DNA, 20 bp, Artificial Sequence
  chemically synthesized
gccagtctgtgtcttttagt

SEQ ID NO: 341031 - DNA, 20 bp, Artificial Sequence
  chemically synthesized
aatgctccaactaaaagaca

SEQ ID NO: 341032 - DNA, 20 bp, Artificial Sequence
  chemically synthesized
agttgccagtctgtgtcttt

SEQ ID NO: 341033 - DNA, 20 bp, Artificial Sequence
  chemically synthesized
tccaactaaaagacacagac

SEQ ID NO: 341034 - DNA, 20 bp, Artificial Sequence
  chemically synthesized
aaagacacagactggcaact

SEQ ID NO: 341035 - DNA, 20 bp, Artificial Sequence
  chemically synthesized
tgactctttatccaagttgc

SEQ ID NO: 341036 - DNA, 20 bp, Artificial Sequence
  chemically synthesized
acagactggcaacttggata

SEQ ID NO: 341037 - DNA, 20 bp, Artificial Sequence
  chemically synthesized
agactggcaacttggataaa

SEQ ID NO: 341038 - DNA, 20 bp, Artificial Sequence
  chemically synthesized
tgggtcttgactctttatcc

SEQ ID NO: 341039 - DNA, 20 bp, Artificial Sequence
  chemically synthesized
ggcaacttggataaagagtc

SEQ ID NO: 341040 - DNA, 20 bp, Artificial Sequence
  chemically synthesized
gataaagagtcaagacccat

SEQ ID NO: 341041 - DNA, 20 bp, Artificial Sequence
  chemically synthesized
aagagtcaagacccatcagt

SEQ ID NO: 341042 - DNA, 20 bp, Artificial Sequence
  chemically synthesized
cctgaatacagctcactgat

SEQ ID NO: 341043 - DNA, 20 bp, Artificial Sequence
  chemically synthesized
tcctgaatacagctcactga

SEQ ID NO: 341044 - DNA, 20 bp, Artificial Sequence
  chemically synthesized
acccatcagtgagctgtatt

SEQ ID NO: 341045 - DNA, 20 bp, Artificial Sequence
  chemically synthesized
cccatcagtgagctgtattc

SEQ ID NO: 341046 - DNA, 20 bp, Artificial Sequence
  chemically synthesized
tgagatgggtttcctgaata

SEQ ID NO: 341047 - DNA, 20 bp, Artificial Sequence
  chemically synthesized
tgtgtctctgcacatgagat

SEQ ID NO: 341048 - DNA, 20 bp, Artificial Sequence
  chemically synthesized
gtgtgtctctgcacatgaga

SEQ ID NO: 341049 - DNA, 20 bp, Artificial Sequence
  chemically synthesized
caggaaacccatctcatgtg

SEQ ID NO: 341050 - DNA, 20 bp, Artificial Sequence
  chemically synthesized
ggaaacccatctcatgtgca

SEQ ID NO: 341051 - DNA, 20 bp, Artificial Sequence
  chemically synthesized
ctatgtgtgtctctgcacat

SEQ ID NO: 341052 - DNA, 20 bp, Artificial Sequence
  chemically synthesized
ctcatgtgcagagacacaca

SEQ ID NO: 341053 - DNA, 20 bp, Artificial Sequence
  chemically synthesized
tcatgtgcagagacacacat

SEQ ID NO: 341054 - DNA, 20 bp, Artificial Sequence
  chemically synthesized
cacacataggctcaaaataa

SEQ ID NO: 341055 - DNA, 20 bp, Artificial Sequence
  chemically synthesized
ttcctccatccttttatttt

SEQ ID NO: 341056 - DNA, 20 bp, Artificial Sequence
  chemically synthesized
acacataggctcaaaataaa

SEQ ID NO: 341057 - DNA, 20 bp, Artificial Sequence
  chemically synthesized
ataggctcaaaataaaagga

SEQ ID NO: 341058 - DNA, 20 bp, Artificial Sequence
  chemically synthesized
aggctcaaaataaaaggatg

SEQ ID NO: 341059 - DNA, 20 bp, Artificial Sequence
  chemically synthesized
ggctcaaaataaaaggatgg

SEQ ID NO: 341060 - DNA, 20 bp, Artificial Sequence
  chemically synthesized
tcaaaataaaaggatggagg

SEQ ID NO: 341061 - DNA, 20 bp, Artificial Sequence
  chemically synthesized
aggatggaggaagatctacc

SEQ ID NO: 341062 - DNA, 20 bp, Artificial Sequence
  chemically synthesized
tttgttttccatttgcttgg

SEQ ID NO: 341063 - DNA, 20 bp, Artificial Sequence
  chemically synthesized
aggaagatctaccaagcaaa

SEQ ID NO: 341064 - DNA, 20 bp, Artificial Sequence
  chemically synthesized
ttttttgttttccatttgct

SEQ ID NO: 341065 - DNA, 20 bp, Artificial Sequence
  chemically synthesized
aagcaaatggaaaacaaaaa

SEQ ID NO: 341066 - DNA, 20 bp, Artificial Sequence
  chemically synthesized
agcaaatggaaaacaaaaaa

SEQ ID NO: 341067 - DNA, 20 bp, Artificial Sequence
  chemically synthesized
aaatggaaaacaaaaaaagg

SEQ ID NO: 341068 - DNA, 20 bp, Artificial Sequence
  chemically synthesized
aatggaaaacaaaaaaaggc

SEQ ID NO: 341069 - DNA, 20 bp, Artificial Sequence
  chemically synthesized
atggaaaacaaaaaaaggca

SEQ ID NO: 341070 - DNA, 20 bp, Artificial Sequence
  chemically synthesized
tggaaaacaaaaaaaggcag

SEQ ID NO: 341071 - DNA, 20 bp, Artificial Sequence
  chemically synthesized
aaaggcaggggttgcaatcc

SEQ ID NO: 341072 - DNA, 20 bp, Artificial Sequence
  chemically synthesized
agtctgttttatcagagact

SEQ ID NO: 341073 - DNA, 20 bp, Artificial Sequence
  chemically synthesized
aagtctgttttatcagagac

SEQ ID NO: 341074 - DNA, 20 bp, Artificial Sequence
  chemically synthesized
gtttaaagtctgttttatca

SEQ ID NO: 341075 - DNA, 20 bp, Artificial Sequence
  chemically synthesized
aatcctagtctctgataaaa

SEQ ID NO: 341076 - DNA, 20 bp, Artificial Sequence
  chemically synthesized
tggtttaaagtctgttttat

SEQ ID NO: 341077 - DNA, 20 bp, Artificial Sequence
  chemically synthesized
ttttgatctttgttggttta

SEQ ID NO: 341078 - DNA, 20 bp, Artificial Sequence
  chemically synthesized
aaacagactttaaaccaaca

SEQ ID NO: 341079 - DNA, 20 bp, Artificial Sequence
  chemically synthesized
ttgtctcttttgatctttgt

SEQ ID NO: 341080 - DNA, 20 bp, Artificial Sequence
  chemically synthesized
tttaaaccaacaaagatcaa

SEQ ID NO: 341081 - DNA, 20 bp, Artificial Sequence
  chemically synthesized
taaaccaacaaagatcaaaa

SEQ ID NO: 341082 - DNA, 20 bp, Artificial Sequence
  chemically synthesized
aacaaagatcaaaagagaca

SEQ ID NO: 341083 - DNA, 20 bp, Artificial Sequence
  chemically synthesized
aaagatcaaaagagacaaag

SEQ ID NO: 341084 - DNA, 20 bp, Artificial Sequence
  chemically synthesized
aagatcaaaagagacaaaga

SEQ ID NO: 341085 - DNA, 20 bp, Artificial Sequence
  chemically synthesized
attcctttaccattatgtaa

SEQ ID NO: 341086 - DNA, 20 bp, Artificial Sequence
  chemically synthesized
caaagaaggccattacataa

SEQ ID NO: 341087 - DNA, 20 bp, Artificial Sequence
  chemically synthesized
aaggccattacataatggta

SEQ ID NO: 341088 - DNA, 20 bp, Artificial Sequence
  chemically synthesized
aggccattacataatggtaa

SEQ ID NO: 341089 - DNA, 20 bp, Artificial Sequence
  chemically synthesized
tggtaaaggaatcaattcaa

SEQ ID NO: 341090 - DNA, 20 bp, Artificial Sequence
  chemically synthesized
ggtaaaggaatcaattcaac

SEQ ID NO: 341091 - DNA, 20 bp, Artificial Sequence
  chemically synthesized
aaaggaatcaattcaacagg

SEQ ID NO: 341092 - DNA, 20 bp, Artificial Sequence
  chemically synthesized
aggaatcaattcaacaggaa

SEQ ID NO: 341093 - DNA, 20 bp, Artificial Sequence
  chemically synthesized
gcatatatatttaggatagt

SEQ ID NO: 341094 - DNA, 20 bp, Artificial Sequence
  chemically synthesized
gggtgcatatatatttagga

SEQ ID NO: 341095 - DNA, 20 bp, Artificial Sequence
  chemically synthesized
tgttgggtgcatatatattt

SEQ ID NO: 341096 - DNA, 20 bp, Artificial Sequence
  chemically synthesized
ttgttgggtgcatatatatt

SEQ ID NO: 341097 - DNA, 20 bp, Artificial Sequence
  chemically synthesized
aaatatatatgcacccaaca

SEQ ID NO: 341098 - DNA, 20 bp, Artificial Sequence
  chemically synthesized
aatatatatgcacccaacaa

SEQ ID NO: 341099 - DNA, 20 bp, Artificial Sequence
  chemically synthesized
tatatatgcacccaacaaag

SEQ ID NO: 341100 - DNA, 20 bp, Artificial Sequence
  chemically synthesized
aatctgggtgctcctttgtt

SEQ ID NO: 341101 - DNA, 20 bp, Artificial Sequence
  chemically synthesized
gaatctgggtgctcctttgt

SEQ ID NO: 341102 - DNA, 20 bp, Artificial Sequence
  chemically synthesized
gcacccaacaaaggagcacc

SEQ ID NO: 341103 - DNA, 20 bp, Artificial Sequence
  chemically synthesized
aggacttgctttatgaatct

SEQ ID NO: 341104 - DNA, 20 bp, Artificial Sequence
  chemically synthesized
caggacttgctttatgaatc

SEQ ID NO: 341105 - DNA, 20 bp, Artificial Sequence
  chemically synthesized
aaggagcacccagattcata

SEQ ID NO: 341106 - DNA, 20 bp, Artificial Sequence
  chemically synthesized
agcacccagattcataaagc

SEQ ID NO: 341107 - DNA, 20 bp, Artificial Sequence
  chemically synthesized
agattcataaagcaagtcct

SEQ ID NO: 341108 - DNA, 20 bp, Artificial Sequence
  chemically synthesized
agtctctttgtaggtcactc

SEQ ID NO: 341109 - DNA, 20 bp, Artificial Sequence
  chemically synthesized
aagtctctttgtaggtcact

SEQ ID NO: 341110 - DNA, 20 bp, Artificial Sequence
  chemically synthesized
caagtcctgagtgacctaca

SEQ ID NO: 341111 - DNA, 20 bp, Artificial Sequence
  chemically synthesized
agtcctgagtgacctacaaa

SEQ ID NO: 341112 - DNA, 20 bp, Artificial Sequence
  chemically synthesized
gggagtctaagtctctttgt

SEQ ID NO: 341113 - DNA, 20 bp, Artificial Sequence
  chemically synthesized
tgggagtctaagtctctttg

SEQ ID NO: 341114 - DNA, 20 bp, Artificial Sequence
  chemically synthesized
gagtgacctacaaagagact

SEQ ID NO: 341115 - DNA, 20 bp, Artificial Sequence
  chemically synthesized
ttattaatgtgtgggagtct

SEQ ID NO: 341116 - DNA, 20 bp, Artificial Sequence
  chemically synthesized
ctcccattattaatgtgtgg

SEQ ID NO: 341117 - DNA, 20 bp, Artificial Sequence
  chemically synthesized
gtctcccattattaatgtgt

SEQ ID NO: 341118 - DNA, 20 bp, Artificial Sequence
  chemically synthesized
agtctcccattattaatgtg

SEQ ID NO: 341119 - DNA, 20 bp, Artificial Sequence
  chemically synthesized
agactcccacacattaataa

SEQ ID NO: 341120 - DNA, 20 bp, Artificial Sequence
  chemically synthesized
gactcccacacattaataat

SEQ ID NO: 341121 - DNA, 20 bp, Artificial Sequence
  chemically synthesized
ctcccacacattaataatgg

SEQ ID NO: 341122 - DNA, 20 bp, Artificial Sequence
  chemically synthesized
atgttgacagtggggtgtta

SEQ ID NO: 341123 - DNA, 20 bp, Artificial Sequence
  chemically synthesized
tctgtctaatgttgacagtg

SEQ ID NO: 341124 - DNA, 20 bp, Artificial Sequence
  chemically synthesized
atctgtctaatgttgacagt

SEQ ID NO: 341125 - DNA, 20 bp, Artificial Sequence
  chemically synthesized
gatctgtctaatgttgacag

SEQ ID NO: 341126 - DNA, 20 bp, Artificial Sequence
  chemically synthesized
taacaccccactgtcaacat

SEQ ID NO: 341127 - DNA, 20 bp, Artificial Sequence
  chemically synthesized
gttgatctgtctaatgttga

SEQ ID NO: 341128 - DNA, 20 bp, Artificial Sequence
  chemically synthesized
accccactgtcaacattaga

SEQ ID NO: 341129 - DNA, 20 bp, Artificial Sequence
  chemically synthesized
tcaacattagacagatcaac

SEQ ID NO: 341130 - DNA, 20 bp, Artificial Sequence
  chemically synthesized
cattagacagatcaacgaga

SEQ ID NO: 341131 - DNA, 20 bp, Artificial Sequence
  chemically synthesized
agacagatcaacgagacaga

SEQ ID NO: 341132 - DNA, 20 bp, Artificial Sequence
  chemically synthesized
caacgagacagaaagccaac

SEQ ID NO: 341133 - DNA, 20 bp, Artificial Sequence
  chemically synthesized
aacgagacagaaagccaaca

SEQ ID NO: 341134 - DNA, 20 bp, Artificial Sequence
  chemically synthesized
caattcctgggtatccttgt

SEQ ID NO: 341135 - DNA, 20 bp, Artificial Sequence
  chemically synthesized
agaaagccaacaaggatacc

SEQ ID NO: 341136 - DNA, 20 bp, Artificial Sequence
  chemically synthesized
gaaagccaacaaggataccc

SEQ ID NO: 341137 - DNA, 20 bp, Artificial Sequence
  chemically synthesized
cagagctgagttcaattcct

SEQ ID NO: 341138 - DNA, 20 bp, Artificial Sequence
  chemically synthesized
gcagagctgagttcaattcc

SEQ ID NO: 341139 - DNA, 20 bp, Artificial Sequence
  chemically synthesized
ggatacccaggaattgaact

SEQ ID NO: 341140 - DNA, 20 bp, Artificial Sequence
  chemically synthesized
ggtccacttggtgcagagct

SEQ ID NO: 341141 - DNA, 20 bp, Artificial Sequence
  chemically synthesized
attgaactcagctctgcacc

SEQ ID NO: 341142 - DNA, 20 bp, Artificial Sequence
  chemically synthesized
tattaggtccacttggtgca

SEQ ID NO: 341143 - DNA, 20 bp, Artificial Sequence
  chemically synthesized
gaactcagctctgcaccaag

SEQ ID NO: 341144 - DNA, 20 bp, Artificial Sequence
  chemically synthesized
tctattaggtccacttggtg

SEQ ID NO: 341145 - DNA, 20 bp, Artificial Sequence
  chemically synthesized
agatgtctattaggtccact

SEQ ID NO: 341146 - DNA, 20 bp, Artificial Sequence
  chemically synthesized
tctgcaccaagtggacctaa

SEQ ID NO: 341147 - DNA, 20 bp, Artificial Sequence
  chemically synthesized
gagttctgtagatgtctatt

SEQ ID NO: 341148 - DNA, 20 bp, Artificial Sequence
  chemically synthesized
agagttctgtagatgtctat

SEQ ID NO: 341149 - DNA, 20 bp, Artificial Sequence
  chemically synthesized
gtggacctaatagacatcta

SEQ ID NO: 341150 - DNA, 20 bp, Artificial Sequence
  chemically synthesized
atttggggtggagagttctg

SEQ ID NO: 341151 - DNA, 20 bp, Artificial Sequence
  chemically synthesized
ttctgttgatttggggtgga

SEQ ID NO: 341152 - DNA, 20 bp, Artificial Sequence
  chemically synthesized
tattctgttgatttggggtg

SEQ ID NO: 341153 - DNA, 20 bp, Artificial Sequence
  chemically synthesized
tatattctgttgatttgggg

SEQ ID NO: 341154 - DNA, 20 bp, Artificial Sequence
  chemically synthesized
atgtatattctgttgatttg

SEQ ID NO: 341155 - DNA, 20 bp, Artificial Sequence
  chemically synthesized
aactctccaccccaaatcaa

SEQ ID NO: 341156 - DNA, 20 bp, Artificial Sequence
  chemically synthesized
aatgtatattctgttgattt

SEQ ID NO: 341157 - DNA, 20 bp, Artificial Sequence
  chemically synthesized
gaatgtatattctgttgatt

SEQ ID NO: 341158 - DNA, 20 bp, Artificial Sequence
  chemically synthesized
aacagaatatacattctttt

SEQ ID NO: 341159 - DNA, 20 bp, Artificial Sequence
  chemically synthesized
aggtgtggtgtggtgctgaa

SEQ ID NO: 341160 - DNA, 20 bp, Artificial Sequence
  chemically synthesized
gttgtggaataggtgtggtg

SEQ ID NO: 341161 - DNA, 20 bp, Artificial Sequence
  chemically synthesized
ggtcagttgtggaataggtg

SEQ ID NO: 341162 - DNA, 20 bp, Artificial Sequence
  chemically synthesized
tatgtggtcagttgtggaat

SEQ ID NO: 341163 - DNA, 20 bp, Artificial Sequence
  chemically synthesized
gtatgtggtcagttgtggaa

SEQ ID NO: 341164 - DNA, 20 bp, Artificial Sequence
  chemically synthesized
tccaagtatgtggtcagttg

SEQ ID NO: 341165 - DNA, 20 bp, Artificial Sequence
  chemically synthesized
tttacttccaagtatgtggt

SEQ ID NO: 341166 - DNA, 20 bp, Artificial Sequence
  chemically synthesized
tccacaactgaccacatact

SEQ ID NO: 341167 - DNA, 20 bp, Artificial Sequence
  chemically synthesized
gagctttacttccaagtatg

SEQ ID NO: 341168 - DNA, 20 bp, Artificial Sequence
  chemically synthesized
acaactgaccacatacttgg

SEQ ID NO: 341169 - DNA, 20 bp, Artificial Sequence
  chemically synthesized
tgaccacatacttggaagta

SEQ ID NO: 341170 - DNA, 20 bp, Artificial Sequence
  chemically synthesized
ctgaggagagctttacttcc

SEQ ID NO: 341171 - DNA, 20 bp, Artificial Sequence
  chemically synthesized
cttggaagtaaagctctcct

SEQ ID NO: 341172 - DNA, 20 bp, Artificial Sequence
  chemically synthesized
tcttctacatttgctgagga

SEQ ID NO: 341173 - DNA, 20 bp, Artificial Sequence
  chemically synthesized
gttcttctacatttgctgag

SEQ ID NO: 341174 - DNA, 20 bp, Artificial Sequence
  chemically synthesized
ctgttcttctacatttgctg

SEQ ID NO: 341175 - DNA, 20 bp, Artificial Sequence
  chemically synthesized
tctgttcttctacatttgct

SEQ ID NO: 341176 - DNA, 20 bp, Artificial Sequence
  chemically synthesized
aaagctctcctcagcaaatg

SEQ ID NO: 341177 - DNA, 20 bp, Artificial Sequence
  chemically synthesized
gctctcctcagcaaatgtag

SEQ ID NO: 341178 - DNA, 20 bp, Artificial Sequence
  chemically synthesized
cctcagcaaatgtagaagaa

SEQ ID NO: 341179 - DNA, 20 bp, Artificial Sequence
  chemically synthesized
aattataacaaactatctct

SEQ ID NO: 341180 - DNA, 20 bp, Artificial Sequence
  chemically synthesized
ttgcactgtggtctgagaga

SEQ ID NO: 341181 - DNA, 20 bp, Artificial Sequence
  chemically synthesized
ttgattgcactgtggtctga

SEQ ID NO: 341182 - DNA, 20 bp, Artificial Sequence
  chemically synthesized
acaaactatctctcagacca

SEQ ID NO: 341183 - DNA, 20 bp, Artificial Sequence
  chemically synthesized
gtttgattgcactgtggtct

SEQ ID NO: 341184 - DNA, 20 bp, Artificial Sequence
  chemically synthesized
gttctagtttgattgcactg

SEQ ID NO: 341185 - DNA, 20 bp, Artificial Sequence
  chemically synthesized
agaccacagtgcaatcaaac

SEQ ID NO: 341186 - DNA, 20 bp, Artificial Sequence
  chemically synthesized
agtgcaatcaaactagaact

SEQ ID NO: 341187 - DNA, 20 bp, Artificial Sequence
  chemically synthesized
agattcttaattctgagttc

SEQ ID NO: 341188 - DNA, 20 bp, Artificial Sequence
  chemically synthesized
tcaaactagaactcagaatt

SEQ ID NO: 341189 - DNA, 20 bp, Artificial Sequence
  chemically synthesized
tgagtgagattcttaattct

SEQ ID NO: 341190 - DNA, 20 bp, Artificial Sequence
  chemically synthesized
gtagttgagcggttttgagt

SEQ ID NO: 341191 - DNA, 20 bp, Artificial Sequence
  chemically synthesized
ccatgtagttgagcggtttt

SEQ ID NO: 341192 - DNA, 20 bp, Artificial Sequence
  chemically synthesized
tcagtttccatgtagttgag

SEQ ID NO: 341193 - DNA, 20 bp, Artificial Sequence
  chemically synthesized
ctcaaaaccgctcaactaca

SEQ ID NO: 341194 - DNA, 20 bp, Artificial Sequence
  chemically synthesized
tgttcagtttccatgtagtt

SEQ ID NO: 341195 - DNA, 20 bp, Artificial Sequence
  chemically synthesized
gaggttgttcagtttccatg

SEQ ID NO: 341196 - DNA, 20 bp, Artificial Sequence
  chemically synthesized
tcattcaggaggaggttgtt

SEQ ID NO: 341197 - DNA, 20 bp, Artificial Sequence
  chemically synthesized
ccccgtagtcattcaggagg

SEQ ID NO: 341198 - DNA, 20 bp, Artificial Sequence
  chemically synthesized
accccgtagtcattcaggag

SEQ ID NO: 341199 - DNA, 20 bp, Artificial Sequence
  chemically synthesized
gcaccccgtagtcattcagg

SEQ ID NO: 341200 - DNA, 20 bp, Artificial Sequence
  chemically synthesized
tgcaccccgtagtcattcag

SEQ ID NO: 341201 - DNA, 20 bp, Artificial Sequence
  chemically synthesized
tatgcaccccgtagtcattc

SEQ ID NO: 341202 - DNA, 20 bp, Artificial Sequence
  chemically synthesized
ttatgcaccccgtagtcatt

SEQ ID NO: 341203 - DNA, 20 bp, Artificial Sequence
  chemically synthesized
aacctcctcctgaatgacta

SEQ ID NO: 341204 - DNA, 20 bp, Artificial Sequence
  chemically synthesized
acctcctcctgaatgactac

SEQ ID NO: 341205 - DNA, 20 bp, Artificial Sequence
  chemically synthesized
cctcctcctgaatgactacg

SEQ ID NO: 341206 - DNA, 20 bp, Artificial Sequence
  chemically synthesized
tcatttcattatgcaccccg

SEQ ID NO: 341207 - DNA, 20 bp, Artificial Sequence
  chemically synthesized
acggggtgcataatgaaatg

SEQ ID NO: 341208 - DNA, 20 bp, Artificial Sequence
  chemically synthesized
cggggtgcataatgaaatga

SEQ ID NO: 341209 - DNA, 20 bp, Artificial Sequence
  chemically synthesized
ggtgcataatgaaatgaagg

SEQ ID NO: 341210 - DNA, 20 bp, Artificial Sequence
  chemically synthesized
atgaaatgaaggcagaaata

SEQ ID NO: 341211 - DNA, 20 bp, Artificial Sequence
  chemically synthesized
ctttgttctcattggtttca

SEQ ID NO: 341212 - DNA, 20 bp, Artificial Sequence
  chemically synthesized
agatgttctttgaaaccaat

SEQ ID NO: 341213 - DNA, 20 bp, Artificial Sequence
  chemically synthesized
tgttgtgtctttgttctcat

SEQ ID NO: 341214 - DNA, 20 bp, Artificial Sequence
  chemically synthesized
ctttgaaaccaatgagaaca

SEQ ID NO: 341215 - DNA, 20 bp, Artificial Sequence
  chemically synthesized
agaacaaagacacaacatac

SEQ ID NO: 341216 - DNA, 20 bp, Artificial Sequence
  chemically synthesized
acacaacataccagaatctc

SEQ ID NO: 341217 - DNA, 20 bp, Artificial Sequence
  chemically synthesized
tgaatgtgtcccagagattc

SEQ ID NO: 341218 - DNA, 20 bp, Artificial Sequence
  chemically synthesized
cacaacataccagaatctct

SEQ ID NO: 341219 - DNA, 20 bp, Artificial Sequence
  chemically synthesized
actgctttgaatgtgtccca

SEQ ID NO: 341220 - DNA, 20 bp, Artificial Sequence
  chemically synthesized
acactgctttgaatgtgtcc

SEQ ID NO: 341221 - DNA, 20 bp, Artificial Sequence
  chemically synthesized
gaatctctgggacacattca

SEQ ID NO: 341222 - DNA, 20 bp, Artificial Sequence
  chemically synthesized
tctctgggacacattcaaag

SEQ ID NO: 341223 - DNA, 20 bp, Artificial Sequence
  chemically synthesized
gacacattcaaagcagtgtg

SEQ ID NO: 341224 - DNA, 20 bp, Artificial Sequence
  chemically synthesized
cacattcaaagcagtgtgta

SEQ ID NO: 341225 - DNA, 20 bp, Artificial Sequence
  chemically synthesized
acattcaaagcagtgtgtag

SEQ ID NO: 341226 - DNA, 20 bp, Artificial Sequence
  chemically synthesized
cattcaaagcagtgtgtaga

SEQ ID NO: 341227 - DNA, 20 bp, Artificial Sequence
  chemically synthesized
agtgtgtagagggaaattta

SEQ ID NO: 341228 - DNA, 20 bp, Artificial Sequence
  chemically synthesized
tgctttctcttgtgggcatt

SEQ ID NO: 341229 - DNA, 20 bp, Artificial Sequence
  chemically synthesized
ttatagcactaaatgcccac

SEQ ID NO: 341230 - DNA, 20 bp, Artificial Sequence
  chemically synthesized
atagcactaaatgcccacaa

SEQ ID NO: 341231 - DNA, 20 bp, Artificial Sequence
  chemically synthesized
tctttcctgctttctcttgt

SEQ ID NO: 341232 - DNA, 20 bp, Artificial Sequence
  chemically synthesized
cactaaatgcccacaagaga

SEQ ID NO: 341233 - DNA, 20 bp, Artificial Sequence
  chemically synthesized
atctttcctgctttctcttg

SEQ ID NO: 341234 - DNA, 20 bp, Artificial Sequence
  chemically synthesized
taaatgcccacaagagaaag

SEQ ID NO: 341235 - DNA, 20 bp, Artificial Sequence
  chemically synthesized
aaatgcccacaagagaaagc

SEQ ID NO: 341236 - DNA, 20 bp, Artificial Sequence
  chemically synthesized
gcccacaagagaaagcagga

SEQ ID NO: 341237 - DNA, 20 bp, Artificial Sequence
  chemically synthesized
tgatgttagggtgtcaattt

SEQ ID NO: 341238 - DNA, 20 bp, Artificial Sequence
  chemically synthesized
ttcttttaattgtgatgtta

SEQ ID NO: 341239 - DNA, 20 bp, Artificial Sequence
  chemically synthesized
gttcttttaattgtgatgtt

SEQ ID NO: 341240 - DNA, 20 bp, Artificial Sequence
  chemically synthesized
agttcttttaattgtgatgt

SEQ ID NO: 341241 - DNA, 20 bp, Artificial Sequence
  chemically synthesized
caccctaacatcacaattaa

SEQ ID NO: 341242 - DNA, 20 bp, Artificial Sequence
  chemically synthesized
aacatcacaattaaaagaac

SEQ ID NO: 341243 - DNA, 20 bp, Artificial Sequence
  chemically synthesized
cacaattaaaagaactagaa

SEQ ID NO: 341244 - DNA, 20 bp, Artificial Sequence
  chemically synthesized
attaaaagaactagaaaagc

SEQ ID NO: 341245 - DNA, 20 bp, Artificial Sequence
  chemically synthesized
tgtgtttgctcttgcttttc

SEQ ID NO: 341246 - DNA, 20 bp, Artificial Sequence
  chemically synthesized
taaaagaactagaaaagcaa

SEQ ID NO: 341247 - DNA, 20 bp, Artificial Sequence
  chemically synthesized
gcaagagcaaacacattcaa

SEQ ID NO: 341248 - DNA, 20 bp, Artificial Sequence
  chemically synthesized
gagcaaacacattcaaaagc

SEQ ID NO: 341249 - DNA, 20 bp, Artificial Sequence
  chemically synthesized
caaacacattcaaaagctag

SEQ ID NO: 341250 - DNA, 20 bp, Artificial Sequence
  chemically synthesized
acacattcaaaagctagcag

SEQ ID NO: 341251 - DNA, 20 bp, Artificial Sequence
  chemically synthesized
agttatttcttgtcttctgc

SEQ ID NO: 341252 - DNA, 20 bp, Artificial Sequence
  chemically synthesized
ttcaaaagctagcagaagac

SEQ ID NO: 341253 - DNA, 20 bp, Artificial Sequence
  chemically synthesized
agacaagaaataactaaaat

SEQ ID NO: 341254 - DNA, 20 bp, Artificial Sequence
  chemically synthesized
acaagaaataactaaaatca

SEQ ID NO: 341255 - DNA, 20 bp, Artificial Sequence
  chemically synthesized
cttcagttctgctctgattt

SEQ ID NO: 341256 - DNA, 20 bp, Artificial Sequence
  chemically synthesized
agaaataactaaaatcagag

SEQ ID NO: 341257 - DNA, 20 bp, Artificial Sequence
  chemically synthesized
ctaaaatcagagcagaactg

SEQ ID NO: 341258 - DNA, 20 bp, Artificial Sequence
  chemically synthesized
taaaatcagagcagaactga

SEQ ID NO: 341259 - DNA, 20 bp, Artificial Sequence
  chemically synthesized
cagagcagaactgaaggaaa

SEQ ID NO: 341260 - DNA, 20 bp, Artificial Sequence
  chemically synthesized
ttttgtgtctctatttcctt

SEQ ID NO: 341261 - DNA, 20 bp, Artificial Sequence
  chemically synthesized
gagcagaactgaaggaaata

SEQ ID NO: 341262 - DNA, 20 bp, Artificial Sequence
  chemically synthesized
ggattcattaattttttgaa

SEQ ID NO: 341263 - DNA, 20 bp, Artificial Sequence
  chemically synthesized
tggattcattaattttttga

SEQ ID NO: 341264 - DNA, 20 bp, Artificial Sequence
  chemically synthesized
ctggattcattaattttttg

SEQ ID NO: 341265 - DNA, 20 bp, Artificial Sequence
  chemically synthesized
cttcaaaaaattaatgaatc

SEQ ID NO: 341266 - DNA, 20 bp, Artificial Sequence
  chemically synthesized
ttcaaaaaattaatgaatcc

SEQ ID NO: 341267 - DNA, 20 bp, Artificial Sequence
  chemically synthesized
caaaaaattaatgaatccag

SEQ ID NO: 341268 - DNA, 20 bp, Artificial Sequence
  chemically synthesized
aaattaatgaatccaggagc

SEQ ID NO: 341269 - DNA, 20 bp, Artificial Sequence
  chemically synthesized
cctttcaaaaaaccagctcc

SEQ ID NO: 341270 - DNA, 20 bp, Artificial Sequence
  chemically synthesized
tgttgatcctttcaaaaaac

SEQ ID NO: 341271 - DNA, 20 bp, Artificial Sequence
  chemically synthesized
tccaggagctggttttttga

SEQ ID NO: 341272 - DNA, 20 bp, Artificial Sequence
  chemically synthesized
ccaggagctggttttttgaa

SEQ ID NO: 341273 - DNA, 20 bp, Artificial Sequence
  chemically synthesized
ttttgaaaggatcaacaaaa

SEQ ID NO: 341274 - DNA, 20 bp, Artificial Sequence
  chemically synthesized
gaaaggatcaacaaaataga

SEQ ID NO: 341275 - DNA, 20 bp, Artificial Sequence
  chemically synthesized
caacaaaatagatagactgc

SEQ ID NO: 341276 - DNA, 20 bp, Artificial Sequence
  chemically synthesized
aaaatagatagactgctagc

SEQ ID NO: 341277 - DNA, 20 bp, Artificial Sequence
  chemically synthesized
ttctttattagtcttgctag

SEQ ID NO: 341278 - DNA, 20 bp, Artificial Sequence
  chemically synthesized
tttttctttattagtcttgc

SEQ ID NO: 341279 - DNA, 20 bp, Artificial Sequence
  chemically synthesized
gactgctagcaagactaata

SEQ ID NO: 341280 - DNA, 20 bp, Artificial Sequence
  chemically synthesized
ttctctctttttttctttat

SEQ ID NO: 341281 - DNA, 20 bp, Artificial Sequence
  chemically synthesized
gcaagactaataaagaaaaa

SEQ ID NO: 341282 - DNA, 20 bp, Artificial Sequence
  chemically synthesized
aagactaataaagaaaaaaa

SEQ ID NO: 341283 - DNA, 20 bp, Artificial Sequence
  chemically synthesized
gactaataaagaaaaaaaga

SEQ ID NO: 341284 - DNA, 20 bp, Artificial Sequence
  chemically synthesized
taataaagaaaaaaagagag

SEQ ID NO: 341285 - DNA, 20 bp, Artificial Sequence
  chemically synthesized
aaaaagagagaagaatcaaa

SEQ ID NO: 341286 - DNA, 20 bp, Artificial Sequence
  chemically synthesized
agatgcaataaaaaatgata

SEQ ID NO: 341287 - DNA, 20 bp, Artificial Sequence
  chemically synthesized
gatgcaataaaaaatgataa

SEQ ID NO: 341288 - DNA, 20 bp, Artificial Sequence
  chemically synthesized
atgcaataaaaaatgataaa

SEQ ID NO: 341289 - DNA, 20 bp, Artificial Sequence
  chemically synthesized
tgcaataaaaaatgataaag

SEQ ID NO: 341290 - DNA, 20 bp, Artificial Sequence
  chemically synthesized
ttgtatttctgtgggatcag

SEQ ID NO: 341291 - DNA, 20 bp, Artificial Sequence
  chemically synthesized
ggatatcaccactgatccca

SEQ ID NO: 341292 - DNA, 20 bp, Artificial Sequence
  chemically synthesized
agtttgtatttctgtgggat

SEQ ID NO: 341293 - DNA, 20 bp, Artificial Sequence
  chemically synthesized
atggtagtttgtatttctgt

SEQ ID NO: 341294 - DNA, 20 bp, Artificial Sequence
  chemically synthesized
gatggtagtttgtatttctg

SEQ ID NO: 341295 - DNA, 20 bp, Artificial Sequence
  chemically synthesized
acagaaatacaaactaccat

SEQ ID NO: 341296 - DNA, 20 bp, Artificial Sequence
  chemically synthesized
agaaatacaaactaccatca

SEQ ID NO: 341297 - DNA, 20 bp, Artificial Sequence
  chemically synthesized
tttgtagtattctctgatgg

SEQ ID NO: 341298 - DNA, 20 bp, Artificial Sequence
  chemically synthesized
gtgtttgtagtattctctga

SEQ ID NO: 341299 - DNA, 20 bp, Artificial Sequence
  chemically synthesized
tatttgcgtagaggtgtttg

SEQ ID NO: 341300 - DNA, 20 bp, Artificial Sequence
  chemically synthesized
tttctagtttatttgcgtag

SEQ ID NO: 341301 - DNA, 20 bp, Artificial Sequence
  chemically synthesized
ttttctagtttatttgcgta

SEQ ID NO: 341302 - DNA, 20 bp, Artificial Sequence
  chemically synthesized
gattttctagtttatttgcg

SEQ ID NO: 341303 - DNA, 20 bp, Artificial Sequence
  chemically synthesized
acacctctacgcaaataaac

SEQ ID NO: 341304 - DNA, 20 bp, Artificial Sequence
  chemically synthesized
cgcaaataaactagaaaatc

SEQ ID NO: 341305 - DNA, 20 bp, Artificial Sequence
  chemically synthesized
tccatttcttctagattttc

SEQ ID NO: 341306 - DNA, 20 bp, Artificial Sequence
  chemically synthesized
aaataaactagaaaatctag

SEQ ID NO: 341307 - DNA, 20 bp, Artificial Sequence
  chemically synthesized
actagaaaatctagaagaaa

SEQ ID NO: 341308 - DNA, 20 bp, Artificial Sequence
  chemically synthesized
aggaatttatccatttcttc

SEQ ID NO: 341309 - DNA, 20 bp, Artificial Sequence
  chemically synthesized
ttgggagagtgtatgtgtgc

SEQ ID NO: 341310 - DNA, 20 bp, Artificial Sequence
  chemically synthesized
cttgggagagtgtatgtgtg

SEQ ID NO: 341311 - DNA, 20 bp, Artificial Sequence
  chemically synthesized
ctgcacacatacactctccc

SEQ ID NO: 341312 - DNA, 20 bp, Artificial Sequence
  chemically synthesized
ttcctggtttagtcttggga

SEQ ID NO: 341313 - DNA, 20 bp, Artificial Sequence
  chemically synthesized
tcttcctggtttagtcttgg

SEQ ID NO: 341314 - DNA, 20 bp, Artificial Sequence
  chemically synthesized
cttcttcctggtttagtctt

SEQ ID NO: 341315 - DNA, 20 bp, Artificial Sequence
  chemically synthesized
acttcttcctggtttagtct

SEQ ID NO: 341316 - DNA, 20 bp, Artificial Sequence
  chemically synthesized
acactctcccaagactaaac

SEQ ID NO: 341317 - DNA, 20 bp, Artificial Sequence
  chemically synthesized
cactctcccaagactaaacc

SEQ ID NO: 341318 - DNA, 20 bp, Artificial Sequence
  chemically synthesized
tctcccaagactaaaccagg

SEQ ID NO: 341319 - DNA, 20 bp, Artificial Sequence
  chemically synthesized
gattcaacttcttcctggtt

SEQ ID NO: 341320 - DNA, 20 bp, Artificial Sequence
  chemically synthesized
cccaagactaaaccaggaag

SEQ ID NO: 341321 - DNA, 20 bp, Artificial Sequence
  chemically synthesized
tcagagattcaacttcttcc

SEQ ID NO: 341322 - DNA, 20 bp, Artificial Sequence
  chemically synthesized
gaagaagttgaatctctgaa

SEQ ID NO: 341323 - DNA, 20 bp, Artificial Sequence
  chemically synthesized
tcctgttattggtctattca

SEQ ID NO: 341324 - DNA, 20 bp, Artificial Sequence
  chemically synthesized
gatcctgttattggtctatt

SEQ ID NO: 341325 - DNA, 20 bp, Artificial Sequence
  chemically synthesized
atctctgaatagaccaataa

SEQ ID NO: 341326 - DNA, 20 bp, Artificial Sequence
  chemically synthesized
tctctgaatagaccaataac

SEQ ID NO: 341327 - DNA, 20 bp, Artificial Sequence
  chemically synthesized
acaatttcagatcctgttat

SEQ ID NO: 341328 - DNA, 20 bp, Artificial Sequence
  chemically synthesized
aataacaggatctgaaattg

SEQ ID NO: 341329 - DNA, 20 bp, Artificial Sequence
  chemically synthesized
attgattattgccacaattt

SEQ ID NO: 341330 - DNA, 20 bp, Artificial Sequence
  chemically synthesized
gaaattgtggcaataatcaa

SEQ ID NO: 341331 - DNA, 20 bp, Artificial Sequence
  chemically synthesized
ctggactctttttggttggt

SEQ ID NO: 341332 - DNA, 20 bp, Artificial Sequence
  chemically synthesized
tcaatagcttaccaaccaaa

SEQ ID NO: 341333 - DNA, 20 bp, Artificial Sequence
  chemically synthesized
ggtcctggactctttttggt

SEQ ID NO: 341334 - DNA, 20 bp, Artificial Sequence
  chemically synthesized
aatagcttaccaaccaaaaa

SEQ ID NO: 341335 - DNA, 20 bp, Artificial Sequence
  chemically synthesized
atctggtcctggactctttt

SEQ ID NO: 341336 - DNA, 20 bp, Artificial Sequence
  chemically synthesized
cttaccaaccaaaaagagtc

SEQ ID NO: 341337 - DNA, 20 bp, Artificial Sequence
  chemically synthesized
ttaccaaccaaaaagagtcc

SEQ ID NO: 341338 - DNA, 20 bp, Artificial Sequence
  chemically synthesized
aaccaaaaagagtccaggac

SEQ ID NO: 341339 - DNA, 20 bp, Artificial Sequence
  chemically synthesized
gctgtgaatccatctggtcc

SEQ ID NO: 341340 - DNA, 20 bp, Artificial Sequence
  chemically synthesized
aaaaagagtccaggaccaga

SEQ ID NO: 341341 - DNA, 20 bp, Artificial Sequence
  chemically synthesized
aattcggctgtgaatccatc

SEQ ID NO: 341342 - DNA, 20 bp, Artificial Sequence
  chemically synthesized
tccaggaccagatggattca

SEQ ID NO: 341343 - DNA, 20 bp, Artificial Sequence
  chemically synthesized
cttgtacctctggtcgaatt

SEQ ID NO: 341344 - DNA, 20 bp, Artificial Sequence
  chemically synthesized
gattcacagccgaattcgac

SEQ ID NO: 341345 - DNA, 20 bp, Artificial Sequence
  chemically synthesized
ttcacagccgaattcgacca

SEQ ID NO: 341346 - DNA, 20 bp, Artificial Sequence
  chemically synthesized
tcacagccgaattcgaccag

SEQ ID NO: 341347 - DNA, 20 bp, Artificial Sequence
  chemically synthesized
ccgaattcgaccagaggtac

SEQ ID NO: 341348 - DNA, 20 bp, Artificial Sequence
  chemically synthesized
ccagttcctccttgtacctc

SEQ ID NO: 341349 - DNA, 20 bp, Artificial Sequence
  chemically synthesized
cgaattcgaccagaggtaca

SEQ ID NO: 341350 - DNA, 20 bp, Artificial Sequence
  chemically synthesized
aattcgaccagaggtacaag

SEQ ID NO: 341351 - DNA, 20 bp, Artificial Sequence
  chemically synthesized
attcgaccagaggtacaagg

SEQ ID NO: 341352 - DNA, 20 bp, Artificial Sequence
  chemically synthesized
ccagaggtacaaggaggaac

SEQ ID NO: 341353 - DNA, 20 bp, Artificial Sequence
  chemically synthesized
agtttcagaaggaatggtac

SEQ ID NO: 341354 - DNA, 20 bp, Artificial Sequence
  chemically synthesized
tggaatagtttcagaaggaa

SEQ ID NO: 341355 - DNA, 20 bp, Artificial Sequence
  chemically synthesized
ttgattggaatagtttcaga

SEQ ID NO: 341356 - DNA, 20 bp, Artificial Sequence
  chemically synthesized
attgattggaatagtttcag

SEQ ID NO: 341357 - DNA, 20 bp, Artificial Sequence
  chemically synthesized
tctattgattggaatagttt

SEQ ID NO: 341358 - DNA, 20 bp, Artificial Sequence
  chemically synthesized
tctttttctattgattggaa

SEQ ID NO: 341359 - DNA, 20 bp, Artificial Sequence
  chemically synthesized
tctgaaactattccaatcaa

SEQ ID NO: 341360 - DNA, 20 bp, Artificial Sequence
  chemically synthesized
ttccctctttttctattgat

SEQ ID NO: 341361 - DNA, 20 bp, Artificial Sequence
  chemically synthesized
actattccaatcaatagaaa

SEQ ID NO: 341362 - DNA, 20 bp, Artificial Sequence
  chemically synthesized
tattccaatcaatagaaaaa

SEQ ID NO: 341363 - DNA, 20 bp, Artificial Sequence
  chemically synthesized
attccaatcaatagaaaaag

SEQ ID NO: 341364 - DNA, 20 bp, Artificial Sequence
  chemically synthesized
ttccaatcaatagaaaaaga

SEQ ID NO: 341365 - DNA, 20 bp, Artificial Sequence
  chemically synthesized
cctcataaaatgagttaggg

SEQ ID NO: 341366 - DNA, 20 bp, Artificial Sequence
  chemically synthesized
gcctcataaaatgagttagg

SEQ ID NO: 341367 - DNA, 20 bp, Artificial Sequence
  chemically synthesized
tggcctcataaaatgagtta

SEQ ID NO: 341368 - DNA, 20 bp, Artificial Sequence
  chemically synthesized
ctggcctcataaaatgagtt

SEQ ID NO: 341369 - DNA, 20 bp, Artificial Sequence
  chemically synthesized
gctggcctcataaaatgagt

SEQ ID NO: 341370 - DNA, 20 bp, Artificial Sequence
  chemically synthesized
tcctccctaactcattttat

SEQ ID NO: 341371 - DNA, 20 bp, Artificial Sequence
  chemically synthesized
tgatgctggcctcataaaat

SEQ ID NO: 341372 - DNA, 20 bp, Artificial Sequence
  chemically synthesized
cctccctaactcattttatg

SEQ ID NO: 341373 - DNA, 20 bp, Artificial Sequence
  chemically synthesized
cctaactcattttatgaggc

SEQ ID NO: 341374 - DNA, 20 bp, Artificial Sequence
  chemically synthesized
ctttcgtatcaggatgatgc

SEQ ID NO: 341375 - DNA, 20 bp, Artificial Sequence
  chemically synthesized
ccagcatcatcctgatacga

SEQ ID NO: 341376 - DNA, 20 bp, Artificial Sequence
  chemically synthesized
ctctgccaggctttcgtatc

SEQ ID NO: 341377 - DNA, 20 bp, Artificial Sequence
  chemically synthesized
tctctgccaggctttcgtat

SEQ ID NO: 341378 - DNA, 20 bp, Artificial Sequence
  chemically synthesized
atcatcctgatacgaaagcc

SEQ ID NO: 341379 - DNA, 20 bp, Artificial Sequence
  chemically synthesized
atcctgatacgaaagcctgg

SEQ ID NO: 341380 - DNA, 20 bp, Artificial Sequence
  chemically synthesized
cctgatacgaaagcctggca

SEQ ID NO: 341381 - DNA, 20 bp, Artificial Sequence
  chemically synthesized
tttttggttgtgtctctgcc

SEQ ID NO: 341382 - DNA, 20 bp, Artificial Sequence
  chemically synthesized
ttttttggttgtgtctctgc

SEQ ID NO: 341383 - DNA, 20 bp, Artificial Sequence
  chemically synthesized
tggcagagacacaaccaaaa

SEQ ID NO: 341384 - DNA, 20 bp, Artificial Sequence
  chemically synthesized
gcagagacacaaccaaaaaa

SEQ ID NO: 341385 - DNA, 20 bp, Artificial Sequence
  chemically synthesized
tggtctaaaattctcttttt

SEQ ID NO: 341386 - DNA, 20 bp, Artificial Sequence
  chemically synthesized
acaaccaaaaaagagaattt

SEQ ID NO: 341387 - DNA, 20 bp, Artificial Sequence
  chemically synthesized
tcagtgttcatcaaggatat

SEQ ID NO: 341388 - DNA, 20 bp, Artificial Sequence
  chemically synthesized
ttttgcatcagtgttcatca

SEQ ID NO: 341389 - DNA, 20 bp, Artificial Sequence
  chemically synthesized
tttttgcatcagtgttcatc

SEQ ID NO: 341390 - DNA, 20 bp, Artificial Sequence
  chemically synthesized
tttattgaggatttttgcat

SEQ ID NO: 341391 - DNA, 20 bp, Artificial Sequence
  chemically synthesized
gttttgccagtattttattg

SEQ ID NO: 341392 - DNA, 20 bp, Artificial Sequence
  chemically synthesized
cgttttgccagtattttatt

SEQ ID NO: 341393 - DNA, 20 bp, Artificial Sequence
  chemically synthesized
aaaaatcctcaataaaatac

SEQ ID NO: 341394 - DNA, 20 bp, Artificial Sequence
  chemically synthesized
tgctgctggattcgttttgc

SEQ ID NO: 341395 - DNA, 20 bp, Artificial Sequence
  chemically synthesized
aaatactggcaaaacgaatc

SEQ ID NO: 341396 - DNA, 20 bp, Artificial Sequence
  chemically synthesized
tactggcaaaacgaatccag

SEQ ID NO: 341397 - DNA, 20 bp, Artificial Sequence
  chemically synthesized
taagctttttgatgtgctgc

SEQ ID NO: 341398 - DNA, 20 bp, Artificial Sequence
  chemically synthesized
gaatccagcagcacatcaaa

SEQ ID NO: 341399 - DNA, 20 bp, Artificial Sequence
  chemically synthesized
cccacttgatcatggtggat

SEQ ID NO: 341400 - DNA, 20 bp, Artificial Sequence
  chemically synthesized
tgaagcccacttgatcatgg

SEQ ID NO: 341401 - DNA, 20 bp, Artificial Sequence
  chemically synthesized
aaagcttatccaccatgatc

SEQ ID NO: 341402 - DNA, 20 bp, Artificial Sequence
  chemically synthesized
ggatgaagcccacttgatca

SEQ ID NO: 341403 - DNA, 20 bp, Artificial Sequence
  chemically synthesized
gcttatccaccatgatcaag

SEQ ID NO: 341404 - DNA, 20 bp, Artificial Sequence
  chemically synthesized
cttatccaccatgatcaagt

SEQ ID NO: 341405 - DNA, 20 bp, Artificial Sequence
  chemically synthesized
gatcaagtgggcttcatccc

SEQ ID NO: 341406 - DNA, 20 bp, Artificial Sequence
  chemically synthesized
atcaagtgggcttcatccct

SEQ ID NO: 341407 - DNA, 20 bp, Artificial Sequence
  chemically synthesized
agccttgcatcccagggatg

SEQ ID NO: 341408 - DNA, 20 bp, Artificial Sequence
  chemically synthesized
tgaaccagccttgcatccca

SEQ ID NO: 341409 - DNA, 20 bp, Artificial Sequence
  chemically synthesized
gggcttcatccctgggatgc

SEQ ID NO: 341410 - DNA, 20 bp, Artificial Sequence
  chemically synthesized
ttgaaccagccttgcatccc

SEQ ID NO: 341411 - DNA, 20 bp, Artificial Sequence
  chemically synthesized
ggcttcatccctgggatgca

SEQ ID NO: 341412 - DNA, 20 bp, Artificial Sequence
  chemically synthesized
attgaaccagccttgcatcc

SEQ ID NO: 341413 - DNA, 20 bp, Artificial Sequence
  chemically synthesized
tcatccctgggatgcaaggc

SEQ ID NO: 341414 - DNA, 20 bp, Artificial Sequence
  chemically synthesized
ttgatttgtgtatattgaac

SEQ ID NO: 341415 - DNA, 20 bp, Artificial Sequence
  chemically synthesized
acaaatcaataaatgtaatc

SEQ ID NO: 341416 - DNA, 20 bp, Artificial Sequence
  chemically synthesized
ctttggctctgtttatatgc

SEQ ID NO: 341417 - DNA, 20 bp, Artificial Sequence
  chemically synthesized
aatgtaatccagcatataaa

SEQ ID NO: 341418 - DNA, 20 bp, Artificial Sequence
  chemically synthesized
tgtaatccagcatataaaca

SEQ ID NO: 341419 - DNA, 20 bp, Artificial Sequence
  chemically synthesized
ccagcatataaacagagcca

SEQ ID NO: 341420 - DNA, 20 bp, Artificial Sequence
  chemically synthesized
aatcatgtggtttttgtctt

SEQ ID NO: 341421 - DNA, 20 bp, Artificial Sequence
  chemically synthesized
catctatggagataatcatg

SEQ ID NO: 341422 - DNA, 20 bp, Artificial Sequence
  chemically synthesized
aaaccacatgattatctcca

SEQ ID NO: 341423 - DNA, 20 bp, Artificial Sequence
  chemically synthesized
aggccttttctgcatctatg

SEQ ID NO: 341424 - DNA, 20 bp, Artificial Sequence
  chemically synthesized
catgattatctccatagatg

SEQ ID NO: 341425 - DNA, 20 bp, Artificial Sequence
  chemically synthesized
aaaggccttttctgcatcta

SEQ ID NO: 341426 - DNA, 20 bp, Artificial Sequence
  chemically synthesized
ttatctccatagatgcagaa

SEQ ID NO: 341427 - DNA, 20 bp, Artificial Sequence
  chemically synthesized
tatctccatagatgcagaaa

SEQ ID NO: 341428 - DNA, 20 bp, Artificial Sequence
  chemically synthesized
gggttgttgaattttgtcaa

SEQ ID NO: 341429 - DNA, 20 bp, Artificial Sequence
  chemically synthesized
agggttgttgaattttgtca

SEQ ID NO: 341430 - DNA, 20 bp, Artificial Sequence
  chemically synthesized
ctgagagtttttagcatgaa

SEQ ID NO: 341431 - DNA, 20 bp, Artificial Sequence
  chemically synthesized
actgagagtttttagcatga

SEQ ID NO: 341432 - DNA, 20 bp, Artificial Sequence
  chemically synthesized
tactgagagtttttagcatg

SEQ ID NO: 341433 - DNA, 20 bp, Artificial Sequence
  chemically synthesized
cctaatttactgagagtttt

SEQ ID NO: 341434 - DNA, 20 bp, Artificial Sequence
  chemically synthesized
cccttcatgctaaaaactct

SEQ ID NO: 341435 - DNA, 20 bp, Artificial Sequence
  chemically synthesized
gtcaatacctaatttactga

SEQ ID NO: 341436 - DNA, 20 bp, Artificial Sequence
  chemically synthesized
gctaaaaactctcagtaaat

SEQ ID NO: 341437 - DNA, 20 bp, Artificial Sequence
  chemically synthesized
ccgtcaatacctaatttact

SEQ ID NO: 341438 - DNA, 20 bp, Artificial Sequence
  chemically synthesized
ctaaaaactctcagtaaatt

SEQ ID NO: 341439 - DNA, 20 bp, Artificial Sequence
  chemically synthesized
ctcagtaaattaggtattga

SEQ ID NO: 341440 - DNA, 20 bp, Artificial Sequence
  chemically synthesized
tcagtaaattaggtattgac

SEQ ID NO: 341441 - DNA, 20 bp, Artificial Sequence
  chemically synthesized
gggacatatttcaaaataat

SEQ ID NO: 341442 - DNA, 20 bp, Artificial Sequence
  chemically synthesized
gacatatttcaaaataataa

SEQ ID NO: 341443 - DNA, 20 bp, Artificial Sequence
  chemically synthesized
ggctgtgggtttgtcataga

SEQ ID NO: 341444 - DNA, 20 bp, Artificial Sequence
  chemically synthesized
tattggctgtgggtttgtca

SEQ ID NO: 341445 - DNA, 20 bp, Artificial Sequence
  chemically synthesized
agctatctatgacaaaccca

SEQ ID NO: 341446 - DNA, 20 bp, Artificial Sequence
  chemically synthesized
ttcagtatgatattggctgt

SEQ ID NO: 341447 - DNA, 20 bp, Artificial Sequence
  chemically synthesized
attcagtatgatattggctg

SEQ ID NO: 341448 - DNA, 20 bp, Artificial Sequence
  chemically synthesized
ttgcccattcagtatgatat

SEQ ID NO: 341449 - DNA, 20 bp, Artificial Sequence
  chemically synthesized
acagccaatatcatactgaa

SEQ ID NO: 341450 - DNA, 20 bp, Artificial Sequence
  chemically synthesized
cagccaatatcatactgaat

SEQ ID NO: 341451 - DNA, 20 bp, Artificial Sequence
  chemically synthesized
gcttccagtttttgcccatt

SEQ ID NO: 341452 - DNA, 20 bp, Artificial Sequence
  chemically synthesized
catactgaatgggcaaaaac

SEQ ID NO: 341453 - DNA, 20 bp, Artificial Sequence
  chemically synthesized
actgaatgggcaaaaactgg

SEQ ID NO: 341454 - DNA, 20 bp, Artificial Sequence
  chemically synthesized
gttttcaaagggaatgcttc

SEQ ID NO: 341455 - DNA, 20 bp, Artificial Sequence
  chemically synthesized
gtcttgtgccagttttcaaa

SEQ ID NO: 341456 - DNA, 20 bp, Artificial Sequence
  chemically synthesized
tgtcttgtgccagttttcaa

SEQ ID NO: 341457 - DNA, 20 bp, Artificial Sequence
  chemically synthesized
gaagcattccctttgaaaac

SEQ ID NO: 341458 - DNA, 20 bp, Artificial Sequence
  chemically synthesized
ctgtcttgtgccagttttca

SEQ ID NO: 341459 - DNA, 20 bp, Artificial Sequence
  chemically synthesized
ttccctttgaaaactggcac

SEQ ID NO: 341460 - DNA, 20 bp, Artificial Sequence
  chemically synthesized
agggcatccctgtcttgtgc

SEQ ID NO: 341461 - DNA, 20 bp, Artificial Sequence
  chemically synthesized
ctttgaaaactggcacaaga

SEQ ID NO: 341462 - DNA, 20 bp, Artificial Sequence
  chemically synthesized
tttgaaaactggcacaagac

SEQ ID NO: 341463 - DNA, 20 bp, Artificial Sequence
  chemically synthesized
ttgaaaactggcacaagaca

SEQ ID NO: 341464 - DNA, 20 bp, Artificial Sequence
  chemically synthesized
tgaataggagtggtgagaga

SEQ ID NO: 341465 - DNA, 20 bp, Artificial Sequence
  chemically synthesized
ttgaataggagtggtgagag

SEQ ID NO: 341466 - DNA, 20 bp, Artificial Sequence
  chemically synthesized
gttgaataggagtggtgaga

SEQ ID NO: 341467 - DNA, 20 bp, Artificial Sequence
  chemically synthesized
atgttgaataggagtggtga

SEQ ID NO: 341468 - DNA, 20 bp, Artificial Sequence
  chemically synthesized
ctatgttgaataggagtggt

SEQ ID NO: 341469 - DNA, 20 bp, Artificial Sequence
  chemically synthesized
aacactatgttgaataggag

SEQ ID NO: 341470 - DNA, 20 bp, Artificial Sequence
  chemically synthesized
tccaacactatgttgaatag

SEQ ID NO: 341471 - DNA, 20 bp, Artificial Sequence
  chemically synthesized
cttccaacactatgttgaat

SEQ ID NO: 341472 - DNA, 20 bp, Artificial Sequence
  chemically synthesized
ctcaccactcctattcaaca

SEQ ID NO: 341473 - DNA, 20 bp, Artificial Sequence
  chemically synthesized
acttccaacactatgttgaa

SEQ ID NO: 341474 - DNA, 20 bp, Artificial Sequence
  chemically synthesized
actcctattcaacatagtgt

SEQ ID NO: 341475 - DNA, 20 bp, Artificial Sequence
  chemically synthesized
cctattcaacatagtgttgg

SEQ ID NO: 341476 - DNA, 20 bp, Artificial Sequence
  chemically synthesized
caacatagtgttggaagttc

SEQ ID NO: 341477 - DNA, 20 bp, Artificial Sequence
  chemically synthesized
atagtgttggaagttctggc

SEQ ID NO: 341478 - DNA, 20 bp, Artificial Sequence
  chemically synthesized
tagtgttggaagttctggcc

SEQ ID NO: 341479 - DNA, 20 bp, Artificial Sequence
  chemically synthesized
agtgttggaagttctggcca

SEQ ID NO: 341480 - DNA, 20 bp, Artificial Sequence
  chemically synthesized
tcctgcctaattgccctggc

SEQ ID NO: 341481 - DNA, 20 bp, Artificial Sequence
  chemically synthesized
gaagttctggccagggcaat

SEQ ID NO: 341482 - DNA, 20 bp, Artificial Sequence
  chemically synthesized
cttctcctgcctaattgccc

SEQ ID NO: 341483 - DNA, 20 bp, Artificial Sequence
  chemically synthesized
aagttctggccagggcaatt

SEQ ID NO: 341484 - DNA, 20 bp, Artificial Sequence
  chemically synthesized
ttctggccagggcaattagg

SEQ ID NO: 341485 - DNA, 20 bp, Artificial Sequence
  chemically synthesized
tctggccagggcaattaggc

SEQ ID NO: 341486 - DNA, 20 bp, Artificial Sequence
  chemically synthesized
tggccagggcaattaggcag

SEQ ID NO: 341487 - DNA, 20 bp, Artificial Sequence
  chemically synthesized
ccagggcaattaggcaggag

SEQ ID NO: 341488 - DNA, 20 bp, Artificial Sequence
  chemically synthesized
cagggcaattaggcaggaga

SEQ ID NO: 341489 - DNA, 20 bp, Artificial Sequence
  chemically synthesized
ttaggcaggagaaggaaata

SEQ ID NO: 341490 - DNA, 20 bp, Artificial Sequence
  chemically synthesized
taggcaggagaaggaaataa

SEQ ID NO: 341491 - DNA, 20 bp, Artificial Sequence
  chemically synthesized
aggcaggagaaggaaataaa

SEQ ID NO: 341492 - DNA, 20 bp, Artificial Sequence
  chemically synthesized
ggaaataaagggtattcaat

SEQ ID NO: 341493 - DNA, 20 bp, Artificial Sequence
  chemically synthesized
gaaataaagggtattcaatt

SEQ ID NO: 341494 - DNA, 20 bp, Artificial Sequence
  chemically synthesized
aaagggtattcaattaggaa

SEQ ID NO: 341495 - DNA, 20 bp, Artificial Sequence
  chemically synthesized
agggtattcaattaggaaaa

SEQ ID NO: 341496 - DNA, 20 bp, Artificial Sequence
  chemically synthesized
tattcaattaggaaaagaga

SEQ ID NO: 341497 - DNA, 20 bp, Artificial Sequence
  chemically synthesized
agtcaaattgaccctgtttg

SEQ ID NO: 341498 - DNA, 20 bp, Artificial Sequence
  chemically synthesized
aatcatgtcatctgcaaaca

SEQ ID NO: 341499 - DNA, 20 bp, Artificial Sequence
  chemically synthesized
caatcatgtcatctgcaaac

SEQ ID NO: 341500 - DNA, 20 bp, Artificial Sequence
  chemically synthesized
acaatcatgtcatctgcaaa

SEQ ID NO: 341501 - DNA, 20 bp, Artificial Sequence
  chemically synthesized
agatgacatgattgtatatc

SEQ ID NO: 341502 - DNA, 20 bp, Artificial Sequence
  chemically synthesized
gctgagacagtggggttttc

SEQ ID NO: 341503 - DNA, 20 bp, Artificial Sequence
  chemically synthesized
gattttaggctgagacagtg

SEQ ID NO: 341504 - DNA, 20 bp, Artificial Sequence
  chemically synthesized
tctagaaaaccccactgtct

SEQ ID NO: 341505 - DNA, 20 bp, Artificial Sequence
  chemically synthesized
agattttaggctgagacagt

SEQ ID NO: 341506 - DNA, 20 bp, Artificial Sequence
  chemically synthesized
gagattttaggctgagacag

SEQ ID NO: 341507 - DNA, 20 bp, Artificial Sequence
  chemically synthesized
aaggagattttaggctgaga

SEQ ID NO: 341508 - DNA, 20 bp, Artificial Sequence
  chemically synthesized
gcttaaggagattttaggct

SEQ ID NO: 341509 - DNA, 20 bp, Artificial Sequence
  chemically synthesized
tatcagcttaaggagatttt

SEQ ID NO: 341510 - DNA, 20 bp, Artificial Sequence
  chemically synthesized
ctatcagcttaaggagattt

SEQ ID NO: 341511 - DNA, 20 bp, Artificial Sequence
  chemically synthesized
tctcagcctaaaatctcctt

SEQ ID NO: 341512 - DNA, 20 bp, Artificial Sequence
  chemically synthesized
aagttccctatcagcttaag

SEQ ID NO: 341513 - DNA, 20 bp, Artificial Sequence
  chemically synthesized
tgaagttccctatcagctta

SEQ ID NO: 341514 - DNA, 20 bp, Artificial Sequence
  chemically synthesized
ctaaaatctccttaagctga

SEQ ID NO: 341515 - DNA, 20 bp, Artificial Sequence
  chemically synthesized
ctgaagttccctatcagctt

SEQ ID NO: 341516 - DNA, 20 bp, Artificial Sequence
  chemically synthesized
taaaatctccttaagctgat

SEQ ID NO: 341517 - DNA, 20 bp, Artificial Sequence
  chemically synthesized
aaaatctccttaagctgata

SEQ ID NO: 341518 - DNA, 20 bp, Artificial Sequence
  chemically synthesized
actttgctgaagttccctat

SEQ ID NO: 341519 - DNA, 20 bp, Artificial Sequence
  chemically synthesized
cttaagctgatagggaactt

SEQ ID NO: 341520 - DNA, 20 bp, Artificial Sequence
  chemically synthesized
gctgatagggaacttcagca

SEQ ID NO: 341521 - DNA, 20 bp, Artificial Sequence
  chemically synthesized
tgtatcctgagactttgctg

SEQ ID NO: 341522 - DNA, 20 bp, Artificial Sequence
  chemically synthesized
agggaacttcagcaaagtct

SEQ ID NO: 341523 - DNA, 20 bp, Artificial Sequence
  chemically synthesized
gggaacttcagcaaagtctc

SEQ ID NO: 341524 - DNA, 20 bp, Artificial Sequence
  chemically synthesized
gtacattgattttgtatcct

SEQ ID NO: 341525 - DNA, 20 bp, Artificial Sequence
  chemically synthesized
aatcaatgtacaaaaatcac

SEQ ID NO: 341526 - DNA, 20 bp, Artificial Sequence
  chemically synthesized
cttgtctgttgttggtgtat

SEQ ID NO: 341527 - DNA, 20 bp, Artificial Sequence
  chemically synthesized
gcattcttatacaccaacaa

SEQ ID NO: 341528 - DNA, 20 bp, Artificial Sequence
  chemically synthesized
gctctctgcttgtctgttgt

SEQ ID NO: 341529 - DNA, 20 bp, Artificial Sequence
  chemically synthesized
cttatacaccaacaacagac

SEQ ID NO: 341530 - DNA, 20 bp, Artificial Sequence
  chemically synthesized
atacaccaacaacagacaag

SEQ ID NO: 341531 - DNA, 20 bp, Artificial Sequence
  chemically synthesized
acaccaacaacagacaagca

SEQ ID NO: 341532 - DNA, 20 bp, Artificial Sequence
  chemically synthesized
accaacaacagacaagcaga

SEQ ID NO: 341533 - DNA, 20 bp, Artificial Sequence
  chemically synthesized
caagcagagagccaaatcat

SEQ ID NO: 341534 - DNA, 20 bp, Artificial Sequence
  chemically synthesized
atgggagttcactcatgatt

SEQ ID NO: 341535 - DNA, 20 bp, Artificial Sequence
  chemically synthesized
tttgaagcaattgtgaatgg

SEQ ID NO: 341536 - DNA, 20 bp, Artificial Sequence
  chemically synthesized
tctttgaagcaattgtgaat

SEQ ID NO: 341537 - DNA, 20 bp, Artificial Sequence
  chemically synthesized
ctctttgaagcaattgtgaa

SEQ ID NO: 341538 - DNA, 20 bp, Artificial Sequence
  chemically synthesized
tcccattcacaattgcttca

SEQ ID NO: 341539 - DNA, 20 bp, Artificial Sequence
  chemically synthesized
ccattcacaattgcttcaaa

SEQ ID NO: 341540 - DNA, 20 bp, Artificial Sequence
  chemically synthesized
taggtattttattctctttg

SEQ ID NO: 341541 - DNA, 20 bp, Artificial Sequence
  chemically synthesized
ttcaaagagaataaaatacc

SEQ ID NO: 341542 - DNA, 20 bp, Artificial Sequence
  chemically synthesized
tcaaagagaataaaatacct

SEQ ID NO: 341543 - DNA, 20 bp, Artificial Sequence
  chemically synthesized
cccttgtaagttggattcct

SEQ ID NO: 341544 - DNA, 20 bp, Artificial Sequence
  chemically synthesized
tcccttgtaagttggattcc

SEQ ID NO: 341545 - DNA, 20 bp, Artificial Sequence
  chemically synthesized
tacctaggaatccaacttac

SEQ ID NO: 341546 - DNA, 20 bp, Artificial Sequence
  chemically synthesized
acctaggaatccaacttaca

SEQ ID NO: 341547 - DNA, 20 bp, Artificial Sequence
  chemically synthesized
ccttcacatcccttgtaagt

SEQ ID NO: 341548 - DNA, 20 bp, Artificial Sequence
  chemically synthesized
cctaggaatccaacttacaa

SEQ ID NO: 341549 - DNA, 20 bp, Artificial Sequence
  chemically synthesized
aggtccttcacatcccttgt

SEQ ID NO: 341550 - DNA, 20 bp, Artificial Sequence
  chemically synthesized
tccaacttacaagggatgtg

SEQ ID NO: 341551 - DNA, 20 bp, Artificial Sequence
  chemically synthesized
ccaacttacaagggatgtga

SEQ ID NO: 341552 - DNA, 20 bp, Artificial Sequence
  chemically synthesized
gggatgtgaaggacctcttc

SEQ ID NO: 341553 - DNA, 20 bp, Artificial Sequence
  chemically synthesized
ggatgtgaaggacctcttcg

SEQ ID NO: 341554 - DNA, 20 bp, Artificial Sequence
  chemically synthesized
atgtgaaggacctcttcgag

SEQ ID NO: 341555 - DNA, 20 bp, Artificial Sequence
  chemically synthesized
gtttgtagttctcctcgaag

SEQ ID NO: 341556 - DNA, 20 bp, Artificial Sequence
  chemically synthesized
ggtttgtagttctcctcgaa

SEQ ID NO: 341557 - DNA, 20 bp, Artificial Sequence
  chemically synthesized
gtggtttgtagttctcctcg

SEQ ID NO: 341558 - DNA, 20 bp, Artificial Sequence
  chemically synthesized
tttcattgagcagtggtttg

SEQ ID NO: 341559 - DNA, 20 bp, Artificial Sequence
  chemically synthesized
tcttttatttcattgagcag

SEQ ID NO: 341560 - DNA, 20 bp, Artificial Sequence
  chemically synthesized
tcctcttttatttcattgag

SEQ ID NO: 341561 - DNA, 20 bp, Artificial Sequence
  chemically synthesized
gtatcctcttttatttcatt

SEQ ID NO: 341562 - DNA, 20 bp, Artificial Sequence
  chemically synthesized
accactgctcaatgaaataa

SEQ ID NO: 341563 - DNA, 20 bp, Artificial Sequence
  chemically synthesized
cactgctcaatgaaataaaa

SEQ ID NO: 341564 - DNA, 20 bp, Artificial Sequence
  chemically synthesized
actgctcaatgaaataaaag

SEQ ID NO: 341565 - DNA, 20 bp, Artificial Sequence
  chemically synthesized
taaaagaggatacaaacaaa

SEQ ID NO: 341566 - DNA, 20 bp, Artificial Sequence
  chemically synthesized
aagaggatacaaacaaatgg

SEQ ID NO: 341567 - DNA, 20 bp, Artificial Sequence
  chemically synthesized
ggaagaacattccatgctca

SEQ ID NO: 341568 - DNA, 20 bp, Artificial Sequence
  chemically synthesized
gaagaacattccatgctcat

SEQ ID NO: 341569 - DNA, 20 bp, Artificial Sequence
  chemically synthesized
attcttcctacccatgagca

SEQ ID NO: 341570 - DNA, 20 bp, Artificial Sequence
  chemically synthesized
gaacattccatgctcatggg

SEQ ID NO: 341571 - DNA, 20 bp, Artificial Sequence
  chemically synthesized
aacattccatgctcatgggt

SEQ ID NO: 341572 - DNA, 20 bp, Artificial Sequence
  chemically synthesized
tattgattcttcctacccat

SEQ ID NO: 341573 - DNA, 20 bp, Artificial Sequence
  chemically synthesized
attccatgctcatgggtagg

SEQ ID NO: 341574 - DNA, 20 bp, Artificial Sequence
  chemically synthesized
aagaatcaatatcgtgaaaa

SEQ ID NO: 341575 - DNA, 20 bp, Artificial Sequence
  chemically synthesized
gtaaattaccttgggcagta

SEQ ID NO: 341576 - DNA, 20 bp, Artificial Sequence
  chemically synthesized
tgaaaatggccatactgccc

SEQ ID NO: 341577 - DNA, 20 bp, Artificial Sequence
  chemically synthesized
gaaaatggccatactgccca

SEQ ID NO: 341578 - DNA, 20 bp, Artificial Sequence
  chemically synthesized
aatctgtaaattaccttggg

SEQ ID NO: 341579 - DNA, 20 bp, Artificial Sequence
  chemically synthesized
ttgaatctgtaaattacctt

SEQ ID NO: 341580 - DNA, 20 bp, Artificial Sequence
  chemically synthesized
attgaatctgtaaattacct

SEQ ID NO: 341581 - DNA, 20 bp, Artificial Sequence
  chemically synthesized
atactgcccaaggtaattta

SEQ ID NO: 341582 - DNA, 20 bp, Artificial Sequence
  chemically synthesized
gattcaatgtcatccccatc

SEQ ID NO: 341583 - DNA, 20 bp, Artificial Sequence
  chemically synthesized
aaggcattggtagcttgatg

SEQ ID NO: 341584 - DNA, 20 bp, Artificial Sequence
  chemically synthesized
aaaggcattggtagcttgat

SEQ ID NO: 341585 - DNA, 20 bp, Artificial Sequence
  chemically synthesized
gaaaggcattggtagcttga

SEQ ID NO: 341586 - DNA, 20 bp, Artificial Sequence
  chemically synthesized
tctgtgaagaaaggcattgg

SEQ ID NO: 341587 - DNA, 20 bp, Artificial Sequence
  chemically synthesized
aattctgtgaagaaaggcat

SEQ ID NO: 341588 - DNA, 20 bp, Artificial Sequence
  chemically synthesized
gctaccaatgcctttcttca

SEQ ID NO: 341589 - DNA, 20 bp, Artificial Sequence
  chemically synthesized
ttttccaattctgtgaagaa

SEQ ID NO: 341590 - DNA, 20 bp, Artificial Sequence
  chemically synthesized
tttttccaattctgtgaaga

SEQ ID NO: 341591 - DNA, 20 bp, Artificial Sequence
  chemically synthesized
tagttttttccaattctgtg

SEQ ID NO: 341592 - DNA, 20 bp, Artificial Sequence
  chemically synthesized
aatgcctttcttcacagaat

SEQ ID NO: 341593 - DNA, 20 bp, Artificial Sequence
  chemically synthesized
aattggaaaaaactacttta

SEQ ID NO: 341594 - DNA, 20 bp, Artificial Sequence
  chemically synthesized
gttccatatcaactttaaag

SEQ ID NO: 341595 - DNA, 20 bp, Artificial Sequence
  chemically synthesized
ttggttccatatcaacttta

SEQ ID NO: 341596 - DNA, 20 bp, Artificial Sequence
  chemically synthesized
aaactactttaaagttgata

SEQ ID NO: 341597 - DNA, 20 bp, Artificial Sequence
  chemically synthesized
aagttgatatggaaccaaaa

SEQ ID NO: 341598 - DNA, 20 bp, Artificial Sequence
  chemically synthesized
gttgatatggaaccaaaaaa

SEQ ID NO: 341599 - DNA, 20 bp, Artificial Sequence
  chemically synthesized
tggtgatgcgggctcttttt

SEQ ID NO: 341600 - DNA, 20 bp, Artificial Sequence
  chemically synthesized
taggagtgacttggtgatgc

SEQ ID NO: 341601 - DNA, 20 bp, Artificial Sequence
  chemically synthesized
aaaaaagagcccgcatcacc

SEQ ID NO: 341602 - DNA, 20 bp, Artificial Sequence
  chemically synthesized
ttaggagtgacttggtgatg

SEQ ID NO: 341603 - DNA, 20 bp, Artificial Sequence
  chemically synthesized
cttttggcttaggagtgact

SEQ ID NO: 341604 - DNA, 20 bp, Artificial Sequence
  chemically synthesized
cgcatcaccaagtcactcct

SEQ ID NO: 341605 - DNA, 20 bp, Artificial Sequence
  chemically synthesized
gctttgttcttttggcttag

SEQ ID NO: 341606 - DNA, 20 bp, Artificial Sequence
  chemically synthesized
ccaagtcactcctaagccaa

SEQ ID NO: 341607 - DNA, 20 bp, Artificial Sequence
  chemically synthesized
cagctttgttcttttggctt

SEQ ID NO: 341608 - DNA, 20 bp, Artificial Sequence
  chemically synthesized
ccagctttgttcttttggct

SEQ ID NO: 341609 - DNA, 20 bp, Artificial Sequence
  chemically synthesized
tgcctccagctttgttcttt

SEQ ID NO: 341610 - DNA, 20 bp, Artificial Sequence
  chemically synthesized
actcctaagccaaaagaaca

SEQ ID NO: 341611 - DNA, 20 bp, Artificial Sequence
  chemically synthesized
ctaagccaaaagaacaaagc

SEQ ID NO: 341612 - DNA, 20 bp, Artificial Sequence
  chemically synthesized
aagccaaaagaacaaagctg

SEQ ID NO: 341613 - DNA, 20 bp, Artificial Sequence
  chemically synthesized
agccaaaagaacaaagctgg

SEQ ID NO: 341614 - DNA, 20 bp, Artificial Sequence
  chemically synthesized
gtcaggtagtgtgatgcctc

SEQ ID NO: 341615 - DNA, 20 bp, Artificial Sequence
  chemically synthesized
tagtatagtttgaagtcagg

SEQ ID NO: 341616 - DNA, 20 bp, Artificial Sequence
  chemically synthesized
ttgtagtatagtttgaagtc

SEQ ID NO: 341617 - DNA, 20 bp, Artificial Sequence
  chemically synthesized
cttgtagtatagtttgaagt

SEQ ID NO: 341618 - DNA, 20 bp, Artificial Sequence
  chemically synthesized
cagccttgtagtatagtttg

SEQ ID NO: 341619 - DNA, 20 bp, Artificial Sequence
  chemically synthesized
ctgacttcaaactatactac

SEQ ID NO: 341620 - DNA, 20 bp, Artificial Sequence
  chemically synthesized
tgacttcaaactatactaca

SEQ ID NO: 341621 - DNA, 20 bp, Artificial Sequence
  chemically synthesized
gttactgcagccttgtagta

SEQ ID NO: 341622 - DNA, 20 bp, Artificial Sequence
  chemically synthesized
ttttggttactgcagccttg

SEQ ID NO: 341623 - DNA, 20 bp, Artificial Sequence
  chemically synthesized
caaactatactacaaggctg

SEQ ID NO: 341624 - DNA, 20 bp, Artificial Sequence
  chemically synthesized
ccatgctgttttggttactg

SEQ ID NO: 341625 - DNA, 20 bp, Artificial Sequence
  chemically synthesized
caaggctgcagtaaccaaaa

SEQ ID NO: 341626 - DNA, 20 bp, Artificial Sequence
  chemically synthesized
gtaccagtaccatgctgttt

SEQ ID NO: 341627 - DNA, 20 bp, Artificial Sequence
  chemically synthesized
ctgcagtaaccaaaacagca

SEQ ID NO: 341628 - DNA, 20 bp, Artificial Sequence
  chemically synthesized
taaccaaaacagcatggtac

SEQ ID NO: 341629 - DNA, 20 bp, Artificial Sequence
  chemically synthesized
ctatatctctgttttggtac

SEQ ID NO: 341630 - DNA, 20 bp, Artificial Sequence
  chemically synthesized
gcatggtactggtaccaaaa

SEQ ID NO: 341631 - DNA, 20 bp, Artificial Sequence
  chemically synthesized
atggtactggtaccaaaaca

SEQ ID NO: 341632 - DNA, 20 bp, Artificial Sequence
  chemically synthesized
attgatctatatctctgttt

SEQ ID NO: 341633 - DNA, 20 bp, Artificial Sequence
  chemically synthesized
ctggtaccaaaacagagata

SEQ ID NO: 341634 - DNA, 20 bp, Artificial Sequence
  chemically synthesized
aaaacagagatatagatcaa

SEQ ID NO: 341635 - DNA, 20 bp, Artificial Sequence
  chemically synthesized
agagatatagatcaatggaa

SEQ ID NO: 341636 - DNA, 20 bp, Artificial Sequence
  chemically synthesized
tatagatcaatggaacagaa

SEQ ID NO: 341637 - DNA, 20 bp, Artificial Sequence
  chemically synthesized
tagatcaatggaacagaaca

SEQ ID NO: 341638 - DNA, 20 bp, Artificial Sequence
  chemically synthesized
atggaacagaacagagccct

SEQ ID NO: 341639 - DNA, 20 bp, Artificial Sequence
  chemically synthesized
atatgcggcgttatttctga

SEQ ID NO: 341640 - DNA, 20 bp, Artificial Sequence
  chemically synthesized
gatatgcggcgttatttctg

SEQ ID NO: 341641 - DNA, 20 bp, Artificial Sequence
  chemically synthesized
agatatgcggcgttatttct

SEQ ID NO: 341642 - DNA, 20 bp, Artificial Sequence
  chemically synthesized
atcagatagtggtagatatg

SEQ ID NO: 341643 - DNA, 20 bp, Artificial Sequence
  chemically synthesized
tgtcaaagatcagatagtgg

SEQ ID NO: 341644 - DNA, 20 bp, Artificial Sequence
  chemically synthesized
gtttgtcaaagatcagatag

SEQ ID NO: 341645 - DNA, 20 bp, Artificial Sequence
  chemically synthesized
caggtttgtcaaagatcaga

SEQ ID NO: 341646 - DNA, 20 bp, Artificial Sequence
  chemically synthesized
ttctcaggtttgtcaaagat

SEQ ID NO: 341647 - DNA, 20 bp, Artificial Sequence
  chemically synthesized
tgtttttctcaggtttgtca

SEQ ID NO: 341648 - DNA, 20 bp, Artificial Sequence
  chemically synthesized
atctgatctttgacaaacct

SEQ ID NO: 341649 - DNA, 20 bp, Artificial Sequence
  chemically synthesized
ccccattgcttgtttttctc

SEQ ID NO: 341650 - DNA, 20 bp, Artificial Sequence
  chemically synthesized
tccccattgcttgtttttct

SEQ ID NO: 341651 - DNA, 20 bp, Artificial Sequence
  chemically synthesized
ttgacaaacctgagaaaaac

SEQ ID NO: 341652 - DNA, 20 bp, Artificial Sequence
  chemically synthesized
aacctgagaaaaacaagcaa

SEQ ID NO: 341653 - DNA, 20 bp, Artificial Sequence
  chemically synthesized
acctgagaaaaacaagcaat

SEQ ID NO: 341654 - DNA, 20 bp, Artificial Sequence
  chemically synthesized
cctgagaaaaacaagcaatg

SEQ ID NO: 341655 - DNA, 20 bp, Artificial Sequence
  chemically synthesized
agaaaaacaagcaatgggga

SEQ ID NO: 341656 - DNA, 20 bp, Artificial Sequence
  chemically synthesized
gaaaaacaagcaatggggaa

SEQ ID NO: 341657 - DNA, 20 bp, Artificial Sequence
  chemically synthesized
ctagcaccatttattaaata

SEQ ID NO: 341658 - DNA, 20 bp, Artificial Sequence
  chemically synthesized
cctagcaccatttattaaat

SEQ ID NO: 341659 - DNA, 20 bp, Artificial Sequence
  chemically synthesized
tcctagcaccatttattaaa

SEQ ID NO: 341660 - DNA, 20 bp, Artificial Sequence
  chemically synthesized
aggattccctatttaataaa

SEQ ID NO: 341661 - DNA, 20 bp, Artificial Sequence
  chemically synthesized
ccctatttaataaatggtgc

SEQ ID NO: 341662 - DNA, 20 bp, Artificial Sequence
  chemically synthesized
cctatttaataaatggtgct

SEQ ID NO: 341663 - DNA, 20 bp, Artificial Sequence
  chemically synthesized
ataaatggtgctaggaaaac

SEQ ID NO: 341664 - DNA, 20 bp, Artificial Sequence
  chemically synthesized
atatggctagccagttttcc

SEQ ID NO: 341665 - DNA, 20 bp, Artificial Sequence
  chemically synthesized
atggtgctaggaaaactggc

SEQ ID NO: 341666 - DNA, 20 bp, Artificial Sequence
  chemically synthesized
gctttctacatatggctagc

SEQ ID NO: 341667 - DNA, 20 bp, Artificial Sequence
  chemically synthesized
ttcagctttctacatatggc

SEQ ID NO: 341668 - DNA, 20 bp, Artificial Sequence
  chemically synthesized
gaaaactggctagccatatg

SEQ ID NO: 341669 - DNA, 20 bp, Artificial Sequence
  chemically synthesized
cagtttcagctttctacata

SEQ ID NO: 341670 - DNA, 20 bp, Artificial Sequence
  chemically synthesized
actggctagccatatgtaga

SEQ ID NO: 341671 - DNA, 20 bp, Artificial Sequence
  chemically synthesized
catatgtagaaagctgaaac

SEQ ID NO: 341672 - DNA, 20 bp, Artificial Sequence
  chemically synthesized
gtgaggaagggatccagttt

SEQ ID NO: 341673 - DNA, 20 bp, Artificial Sequence
  chemically synthesized
taaggtgtgaggaagggatc

SEQ ID NO: 341674 - DNA, 20 bp, Artificial Sequence
  chemically synthesized
tttgtataaggtgtgaggaa

SEQ ID NO: 341675 - DNA, 20 bp, Artificial Sequence
  chemically synthesized
ttttgtataaggtgtgagga

SEQ ID NO: 341676 - DNA, 20 bp, Artificial Sequence
  chemically synthesized
tttttgtataaggtgtgagg

SEQ ID NO: 341677 - DNA, 20 bp, Artificial Sequence
  chemically synthesized
tgatttttgtataaggtgtg

SEQ ID NO: 341678 - DNA, 20 bp, Artificial Sequence
  chemically synthesized
ttgatttttgtataaggtgt

SEQ ID NO: 341679 - DNA, 20 bp, Artificial Sequence
  chemically synthesized
gttgaattgatttttgtata

SEQ ID NO: 341680 - DNA, 20 bp, Artificial Sequence
  chemically synthesized
tgttgaattgatttttgtat

SEQ ID NO: 341681 - DNA, 20 bp, Artificial Sequence
  chemically synthesized
atacaaaaatcaattcaaca

SEQ ID NO: 341682 - DNA, 20 bp, Artificial Sequence
  chemically synthesized
tggattaaaaacttaaacgt

SEQ ID NO: 341683 - DNA, 20 bp, Artificial Sequence
  chemically synthesized
tggttttaggtctaacgttt

SEQ ID NO: 341684 - DNA, 20 bp, Artificial Sequence
  chemically synthesized
tccagggtttttatggtttt

SEQ ID NO: 341685 - DNA, 20 bp, Artificial Sequence
  chemically synthesized
ttccagggtttttatggttt

SEQ ID NO: 341686 - DNA, 20 bp, Artificial Sequence
  chemically synthesized
gttttcttccagggttttta

SEQ ID NO: 341687 - DNA, 20 bp, Artificial Sequence
  chemically synthesized
acctaaaaccataaaaaccc

SEQ ID NO: 341688 - DNA, 20 bp, Artificial Sequence
  chemically synthesized
taaaaccataaaaaccctgg

SEQ ID NO: 341689 - DNA, 20 bp, Artificial Sequence
  chemically synthesized
aatgcctaggttttcttcca

SEQ ID NO: 341690 - DNA, 20 bp, Artificial Sequence
  chemically synthesized
taatgcctaggttttcttcc

SEQ ID NO: 341691 - DNA, 20 bp, Artificial Sequence
  chemically synthesized
gtaatgcctaggttttcttc

SEQ ID NO: 341692 - DNA, 20 bp, Artificial Sequence
  chemically synthesized
aaaaaccctggaagaaaacc

SEQ ID NO: 341693 - DNA, 20 bp, Artificial Sequence
  chemically synthesized
aaaaccctggaagaaaacct

SEQ ID NO: 341694 - DNA, 20 bp, Artificial Sequence
  chemically synthesized
tgtcctgaatggtaatgcct

SEQ ID NO: 341695 - DNA, 20 bp, Artificial Sequence
  chemically synthesized
atgtcctgaatggtaatgcc

SEQ ID NO: 341696 - DNA, 20 bp, Artificial Sequence
  chemically synthesized
aaaacctaggcattaccatt

SEQ ID NO: 341697 - DNA, 20 bp, Artificial Sequence
  chemically synthesized
aaacctaggcattaccattc

SEQ ID NO: 341698 - DNA, 20 bp, Artificial Sequence
  chemically synthesized
gcccatgcctatgtcctgaa

SEQ ID NO: 341699 - DNA, 20 bp, Artificial Sequence
  chemically synthesized
aggcattaccattcaggaca

SEQ ID NO: 341700 - DNA, 20 bp, Artificial Sequence
  chemically synthesized
ggcattaccattcaggacat

SEQ ID NO: 341701 - DNA, 20 bp, Artificial Sequence
  chemically synthesized
taccattcaggacataggca

SEQ ID NO: 341702 - DNA, 20 bp, Artificial Sequence
  chemically synthesized
accattcaggacataggcat

SEQ ID NO: 341703 - DNA, 20 bp, Artificial Sequence
  chemically synthesized
ttcaggacataggcatgggc

SEQ ID NO: 341704 - DNA, 20 bp, Artificial Sequence
  chemically synthesized
tcaggacataggcatgggca

SEQ ID NO: 341705 - DNA, 20 bp, Artificial Sequence
  chemically synthesized
cttttggtgttttagacatg

SEQ ID NO: 341706 - DNA, 20 bp, Artificial Sequence
  chemically synthesized
tgccattgcttttggtgttt

SEQ ID NO: 341707 - DNA, 20 bp, Artificial Sequence
  chemically synthesized
cttcatgtctaaaacaccaa

SEQ ID NO: 341708 - DNA, 20 bp, Artificial Sequence
  chemically synthesized
gtctaaaacaccaaaagcaa

SEQ ID NO: 341709 - DNA, 20 bp, Artificial Sequence
  chemically synthesized
gcttttgttgccattgcttt

SEQ ID NO: 341710 - DNA, 20 bp, Artificial Sequence
  chemically synthesized
accaaaagcaatggcaacaa

SEQ ID NO: 341711 - DNA, 20 bp, Artificial Sequence
  chemically synthesized
aaagcaatggcaacaaaagc

SEQ ID NO: 341712 - DNA, 20 bp, Artificial Sequence
  chemically synthesized
gagatcccatttgtcagttc

SEQ ID NO: 341713 - DNA, 20 bp, Artificial Sequence
  chemically synthesized
caaaagccagaactgacaaa

SEQ ID NO: 341714 - DNA, 20 bp, Artificial Sequence
  chemically synthesized
aaaagccagaactgacaaat

SEQ ID NO: 341715 - DNA, 20 bp, Artificial Sequence
  chemically synthesized
tttaacgagatcccatttgt

SEQ ID NO: 341716 - DNA, 20 bp, Artificial Sequence
  chemically synthesized
cagaagctctttagtttaac

SEQ ID NO: 341717 - DNA, 20 bp, Artificial Sequence
  chemically synthesized
aatgggatctcgttaaacta

SEQ ID NO: 341718 - DNA, 20 bp, Artificial Sequence
  chemically synthesized
tgggatctcgttaaactaaa

SEQ ID NO: 341719 - DNA, 20 bp, Artificial Sequence
  chemically synthesized
tttgttgtgcagaagctctt

SEQ ID NO: 341720 - DNA, 20 bp, Artificial Sequence
  chemically synthesized
tagtttcttttgttgtgcag

SEQ ID NO: 341721 - DNA, 20 bp, Artificial Sequence
  chemically synthesized
tggtagtttcttttgttgtg

SEQ ID NO: 341722 - DNA, 20 bp, Artificial Sequence
  chemically synthesized
aaagagcttctgcacaacaa

SEQ ID NO: 341723 - DNA, 20 bp, Artificial Sequence
  chemically synthesized
acaacaaaagaaactaccat

SEQ ID NO: 341724 - DNA, 20 bp, Artificial Sequence
  chemically synthesized
aacaaaagaaactaccatca
